United States Patent 7,250,496 (BIOINFORMATICALLY DETECTABLE GROUP OF NOVEL REGULATORY GENES AND USES THEREOF) - sequence listing, part 7

SEQ ID NO: 240502 - RNA, 20 nt, Human
aggaaaauagcucagguucu

SEQ ID NO: 240503 - RNA, 22 nt, Human
aggaaagaacacccacaggaag

SEQ ID NO: 240504 - RNA, 22 nt, Human
aggauggcaggaugggcaccgu

SEQ ID NO: 240505 - RNA, 24 nt, Human
aggcacgguggcgcgcaccuguag

SEQ ID NO: 240506 - RNA, 24 nt, Human
aggcacgguggcucacaucugcaa

SEQ ID NO: 240507 - RNA, 21 nt, Human
aggcagaaucuggcauggucc

SEQ ID NO: 240508 - RNA, 24 nt, Human
aggcagaaucuggcaugguccaag

SEQ ID NO: 240509 - RNA, 23 nt, Human
aggcaggaggauugcuugagccc

SEQ ID NO: 240510 - RNA, 26 nt, Human
aggcagggagggacuuuuggcuugua

SEQ ID NO: 240511 - RNA, 23 nt, Human
aggcagguggauugcuugaggcc

SEQ ID NO: 240512 - RNA, 22 nt, Human
aggccugggggggacacaucug

SEQ ID NO: 240513 - RNA, 19 nt, Human
aggcucugugcuuggaggc

SEQ ID NO: 240514 - RNA, 21 nt, Human
aggcugaggcaggaggauugc

SEQ ID NO: 240515 - RNA, 24 nt, Human
aggcugaggcaggaggauugcuug

SEQ ID NO: 240516 - RNA, 21 nt, Human
aggggcagaguccgauccuug

SEQ ID NO: 240517 - RNA, 21 nt, Human
aggguacugcccucaggcagg

SEQ ID NO: 240518 - RNA, 21 nt, Human
aggugacucuggccucagccc

SEQ ID NO: 240519 - RNA, 24 nt, Human
aucaugccacugcacuccagccug

SEQ ID NO: 240520 - RNA, 18 nt, Human
caaaacgagaccccgucc

SEQ ID NO: 240521 - RNA, 22 nt, Human
caaaacgagaccccgucccuac

SEQ ID NO: 240522 - RNA, 23 nt, Human
caaagcagacagaccccuggacc

SEQ ID NO: 240523 - RNA, 20 nt, Human
caacagagaaacuccaccuu

SEQ ID NO: 240524 - RNA, 22 nt, Human
caacccucccuucccagcaccc

SEQ ID NO: 240525 - RNA, 23 nt, Human
caacccucccuucccagcaccca

SEQ ID NO: 240526 - RNA, 19 nt, Human
caagaaagcaaaaaagaaa

SEQ ID NO: 240527 - RNA, 24 nt, Human
caagaaagcaaaaaagaaaaagaa

SEQ ID NO: 240528 - RNA, 26 nt, Human
caaggcagguggauugcuugaggcca

SEQ ID NO: 240529 - RNA, 24 nt, Human
cacaucugcaaucucagcacuuug

SEQ ID NO: 240530 - RNA, 22 nt, Human
cacccucugguucacggugguu

SEQ ID NO: 240531 - RNA, 18 nt, Human
caccuguagucccagcua

SEQ ID NO: 240532 - RNA, 23 nt, Human
caccuguagucccagcuaguugg

SEQ ID NO: 240533 - RNA, 23 nt, Human
cacuccagccugggggacagagc

SEQ ID NO: 240534 - RNA, 18 nt, Human
cacugcacuccagccugg

SEQ ID NO: 240535 - RNA, 19 nt, Human
cacugcacuccagccuggg

SEQ ID NO: 240536 - RNA, 22 nt, Human
cacugcacuccagccuggggga

SEQ ID NO: 240537 - RNA, 24 nt, Human
cacugcacuccagccugggggaca

SEQ ID NO: 240538 - RNA, 25 nt, Human
cacugcacuccagccugggggacag

SEQ ID NO: 240539 - RNA, 26 nt, Human
cacugcuguguguaugccucuuuuuc

SEQ ID NO: 240540 - RNA, 18 nt, Human
cacuggacucugacugcc

SEQ ID NO: 240541 - RNA, 24 nt, Human
cagcacuuugggaggccaaggcag

SEQ ID NO: 240542 - RNA, 25 nt, Human
cagcacuuugggaggccaaggcagg

SEQ ID NO: 240543 - RNA, 24 nt, Human
cagccacuucuucucaggcaacgu

SEQ ID NO: 240544 - RNA, 25 nt, Human
caggcgcagcacaaaggccaccuug

SEQ ID NO: 240545 - RNA, 22 nt, Human
cagguccccagacucgccuucc

SEQ ID NO: 240546 - RNA, 24 nt, Human
caucugcaaucucagcacuuuggg

SEQ ID NO: 240547 - RNA, 21 nt, Human
cauggcggagcacagccuccg

SEQ ID NO: 240548 - RNA, 22 nt, Human
cauuccaccccuacaccucugc

SEQ ID NO: 240549 - RNA, 21 nt, Human
ccaaaccaaacaagaaaccac

SEQ ID NO: 240550 - RNA, 22 nt, Human
ccacagaaaaggugacucuggc

SEQ ID NO: 240551 - RNA, 21 nt, Human
ccacggugggccacucugggg

SEQ ID NO: 240552 - RNA, 19 nt, Human
ccacugcacuccagccugg

SEQ ID NO: 240553 - RNA, 20 nt, Human
ccacugcacuccagccuggg

SEQ ID NO: 240554 - RNA, 20 nt, Human
ccacugcacuccagccuggg

SEQ ID NO: 240555 - RNA, 22 nt, Human
ccacugcacuccagccuggggg

SEQ ID NO: 240556 - RNA, 24 nt, Human
ccacugcacuccagccugggggac

SEQ ID NO: 240557 - RNA, 23 nt, Human
ccagaacucagcccugaaggugc

SEQ ID NO: 240558 - RNA, 22 nt, Human
ccaggaguaugaggcugcagug

SEQ ID NO: 240559 - RNA, 21 nt, Human
ccauggagauauggagaaggc

SEQ ID NO: 240560 - RNA, 18 nt, Human
cccaccccuaccucgggg

SEQ ID NO: 240561 - RNA, 23 nt, Human
cccagcacccagcccagggccuc

SEQ ID NO: 240562 - RNA, 23 nt, Human
cccagccucuggccccagcugga

SEQ ID NO: 240563 - RNA, 19 nt, Human
cccagggccucagggucua

SEQ ID NO: 240564 - RNA, 22 nt, Human
cccagguccaggggcagagucc

SEQ ID NO: 240565 - RNA, 22 nt, Human
ccccaggggcuggccaucaccc

SEQ ID NO: 240566 - RNA, 19 nt, Human
ccccuacaccucugcggcc

SEQ ID NO: 240567 - RNA, 20 nt, Human
ccccuacaccucugcggcca

SEQ ID NO: 240568 - RNA, 21 nt, Human
ccccuggacccaucuccuggg

SEQ ID NO: 240569 - RNA, 20 nt, Human
cccgcggcucauuccacccc

SEQ ID NO: 240570 - RNA, 22 nt, Human
cccgcggcucauuccaccccua

SEQ ID NO: 240571 - RNA, 23 nt, Human
cccgcuggcccaggggugcagcc

SEQ ID NO: 240572 - RNA, 18 nt, Human
cccgucccuacaaaaaaa

SEQ ID NO: 240573 - RNA, 21 nt, Human
cccugaaggugcuaaggggga

SEQ ID NO: 240574 - RNA, 22 nt, Human
cccuuaaccaaagcagacagac

SEQ ID NO: 240575 - RNA, 23 nt, Human
ccgccucccgcuccgcacaucug

SEQ ID NO: 240576 - RNA, 25 nt, Human
ccuacaaaaaaaaugaaaaguuagc

SEQ ID NO: 240577 - RNA, 21 nt, Human
ccucagggccuuccccugggu

SEQ ID NO: 240578 - RNA, 24 nt, Human
ccucagggccuuccccugggugug

SEQ ID NO: 240579 - RNA, 19 nt, Human
ccuccagccaggccuggcu

SEQ ID NO: 240580 - RNA, 22 nt, Human
ccuccuuccuguggcuugccgg

SEQ ID NO: 240581 - RNA, 23 nt, Human
ccuccuuccuguggcuugccggg

SEQ ID NO: 240582 - RNA, 25 nt, Human
ccucuagaaacccagaacucagccc

SEQ ID NO: 240583 - RNA, 18 nt, Human
ccucugcccuccucuggc

SEQ ID NO: 240584 - RNA, 19 nt, Human
ccucugucuccguggggca

SEQ ID NO: 240585 - RNA, 24 nt, Human
ccucugucuccguggggcagucuc

SEQ ID NO: 240586 - RNA, 21 nt, Human
ccugaaccaaacaacagagaa

SEQ ID NO: 240587 - RNA, 22 nt, Human
ccugaccucuagaaacccagaa

SEQ ID NO: 240588 - RNA, 21 nt, Human
ccuguagucccagcuaguugg

SEQ ID NO: 240589 - RNA, 20 nt, Human
ccugucucuccccuccuucc

SEQ ID NO: 240590 - RNA, 20 nt, Human
ccugucucuccccuccuucc

SEQ ID NO: 240591 - RNA, 24 nt, Human
ccuuaaccaaagcagacagacccc

SEQ ID NO: 240592 - RNA, 24 nt, Human
cgcaccuguagucccagcuaguug

SEQ ID NO: 240593 - RNA, 19 nt, Human
cggggcugaggauggggca

SEQ ID NO: 240594 - RNA, 23 nt, Human
cuaaaccuggcuguaggcagagg

SEQ ID NO: 240595 - RNA, 19 nt, Human
cuaggacccaugagggcgg

SEQ ID NO: 240596 - RNA, 24 nt, Human
cucacaucugcaaucucagcacuu

SEQ ID NO: 240597 - RNA, 23 nt, Human
cuccacacugcugggcugccugu

SEQ ID NO: 240598 - RNA, 19 nt, Human
cucccucugcccuccucug

SEQ ID NO: 240599 - RNA, 24 nt, Human
cuccuuccuguggcuugccggggc

SEQ ID NO: 240600 - RNA, 19 nt, Human
cucgcaaguucccagacgc

SEQ ID NO: 240601 - RNA, 23 nt, Human
cucucucuaccaccgccucccgc

SEQ ID NO: 240602 - RNA, 21 nt, Human
cucugcugggggcuccagcuc

SEQ ID NO: 240603 - RNA, 22 nt, Human
cucuuuccuggaguuggggggg

SEQ ID NO: 240604 - RNA, 20 nt, Human
cugccucugcugggggcucc

SEQ ID NO: 240605 - RNA, 18 nt, Human
cugcuccuccagccaggc

SEQ ID NO: 240606 - RNA, 22 nt, Human
cugcugcuccuccagccaggcc

SEQ ID NO: 240607 - RNA, 20 nt, Human
cuggggccaggcacaggagg

SEQ ID NO: 240608 - RNA, 22 nt, Human
cugggggggacacaucugggcc

SEQ ID NO: 240609 - RNA, 19 nt, Human
cugugcuuggaggcuucug

SEQ ID NO: 240610 - RNA, 19 nt, Human
cuugaggccacaaguuuga

SEQ ID NO: 240611 - RNA, 23 nt, Human
cuuggauucucccucugcccucc

SEQ ID NO: 240612 - RNA, 21 nt, Human
cuugggucuggacugugccca

SEQ ID NO: 240613 - RNA, 23 nt, Human
gaagcaucuccccaccccuaccu

SEQ ID NO: 240614 - RNA, 26 nt, Human
gaagcccacccugucuggggccuggg

SEQ ID NO: 240615 - RNA, 24 nt, Human
gacagaccccuggacccaucuccu

SEQ ID NO: 240616 - RNA, 21 nt, Human
gacagagcaagacccugucuc

SEQ ID NO: 240617 - RNA, 18 nt, Human
gaccccuggacccaucuc

SEQ ID NO: 240618 - RNA, 20 nt, Human
gaccccuggacccaucuccu

SEQ ID NO: 240619 - RNA, 20 nt, Human
gaggcagagcacuggacucu

SEQ ID NO: 240620 - RNA, 22 nt, Human
gaggguacugcccucaggcagg

SEQ ID NO: 240621 - RNA, 18 nt, Human
gagggugccuggaaagcc

SEQ ID NO: 240622 - RNA, 21 nt, Human
gaucaugccacugcacuccag

SEQ ID NO: 240623 - RNA, 22 nt, Human
gauugcuugaggccacaaguuu

SEQ ID NO: 240624 - RNA, 24 nt, Human
gauugcuugaggccacaaguuuga

SEQ ID NO: 240625 - RNA, 21 nt, Human
gcaaaaaagaaaaagaaagaa

SEQ ID NO: 240626 - RNA, 24 nt, Human
gcacuccagccugggggacagagc

SEQ ID NO: 240627 - RNA, 19 nt, Human
gcagcaaggggcagucgug

SEQ ID NO: 240628 - RNA, 26 nt, Human
gcagcacaaaggccaccuugcacaag

SEQ ID NO: 240629 - RNA, 22 nt, Human
gccacggugggccacucugggg

SEQ ID NO: 240630 - RNA, 22 nt, Human
gcccaggggugcagccucuguc

SEQ ID NO: 240631 - RNA, 19 nt, Human
gcccugagguuucaaagcc

SEQ ID NO: 240632 - RNA, 18 nt, Human
gccuggggccaggcucug

SEQ ID NO: 240633 - RNA, 24 nt, Human
gcugcucucuccugcaggcguccu

SEQ ID NO: 240634 - RNA, 21 nt, Human
gcugguggcagcccagggaag

SEQ ID NO: 240635 - RNA, 19 nt, Human
ggaaagccagaggagucag

SEQ ID NO: 240636 - RNA, 19 nt, Human
ggaagggaugcuguccuga

SEQ ID NO: 240637 - RNA, 18 nt, Human
ggaauggggcaucuuuga

SEQ ID NO: 240638 - RNA, 22 nt, Human
ggagagcuaggagggaaccccg

SEQ ID NO: 240639 - RNA, 18 nt, Human
ggagaggauaucuauuuc

SEQ ID NO: 240640 - RNA, 18 nt, Human
ggaggcuucugcugucca

SEQ ID NO: 240641 - RNA, 21 nt, Human
ggaguuggggggggucuccag

SEQ ID NO: 240642 - RNA, 18 nt, Human
ggcagggucuuggaaagg

SEQ ID NO: 240643 - RNA, 18 nt, Human
ggccaccuugcacaagag

SEQ ID NO: 240644 - RNA, 20 nt, Human
ggccauggagauauggagaa

SEQ ID NO: 240645 - RNA, 22 nt, Human
ggccauggagauauggagaagg

SEQ ID NO: 240646 - RNA, 22 nt, Human
ggcgcagcacaaaggccaccuu

SEQ ID NO: 240647 - RNA, 22 nt, Human
ggcugugugugccuggcaggag

SEQ ID NO: 240648 - RNA, 22 nt, Human
gggcgugagaaauggcauucuu

SEQ ID NO: 240649 - RNA, 20 nt, Human
gggcugggacagcccugagg

SEQ ID NO: 240650 - RNA, 20 nt, Human
ggggacuggccuuggacucg

SEQ ID NO: 240651 - RNA, 28 nt, Human
ggggcagggccgggcagggucuuggaaa

SEQ ID NO: 240652 - RNA, 19 nt, Human
ggggucuugagguggaggg

SEQ ID NO: 240653 - RNA, 23 nt, Human
gguggcgcgcaccuguaguccca

SEQ ID NO: 240654 - RNA, 24 nt, Human
gguggcgcgcaccuguagucccag

SEQ ID NO: 240655 - RNA, 24 nt, Human
gguggcucacaucugcaaucucag

SEQ ID NO: 240656 - RNA, 19 nt, Human
guacugcccucaggcaggg

SEQ ID NO: 240657 - RNA, 22 nt, Human
gucccuacaaaaaaaaugaaaa

SEQ ID NO: 240658 - RNA, 18 nt, Human
guggggcagucucacugg

SEQ ID NO: 240659 - RNA, 25 nt, Human
gugguuucaacccucccuucccagc

SEQ ID NO: 240660 - RNA, 20 nt, Human
uaaaaauaaaaucccugaac

SEQ ID NO: 240661 - RNA, 19 nt, Human
uaaaaucccugaaccaaac

SEQ ID NO: 240662 - RNA, 24 nt, Human
uaaaaucccugaaccaaacaacag

SEQ ID NO: 240663 - RNA, 22 nt, Human
uaaacaggggcugggccccagg

SEQ ID NO: 240664 - RNA, 24 nt, Human
uaaauaaaaacauaaaauugccaa

SEQ ID NO: 240665 - RNA, 19 nt, Human
uaagccuagcuugggacua

SEQ ID NO: 240666 - RNA, 22 nt, Human
uacaaaaaaaaugaaaaguuag

SEQ ID NO: 240667 - RNA, 21 nt, Human
uaccucggggucucuaagggc

SEQ ID NO: 240668 - RNA, 27 nt, Human
uagaaacccagaacucagcccugaagg

SEQ ID NO: 240669 - RNA, 19 nt, Human
uaggcagaggaggaaaaug

SEQ ID NO: 240670 - RNA, 22 nt, Human
ucaaaagcaaaccaaaccaaac

SEQ ID NO: 240671 - RNA, 19 nt, Human
ucaaagccagcuuccccgc

SEQ ID NO: 240672 - RNA, 23 nt, Human
ucaacccucccuucccagcaccc

SEQ ID NO: 240673 - RNA, 19 nt, Human
ucacugggagagcuaggag

SEQ ID NO: 240674 - RNA, 21 nt, Human
ucagggccuuccccugggugu

SEQ ID NO: 240675 - RNA, 23 nt, Human
ucaugccacugcacuccagccug

SEQ ID NO: 240676 - RNA, 25 nt, Human
uccaccuuuuaucucucucuaccac

SEQ ID NO: 240677 - RNA, 19 nt, Human
uccagaggcugcucagcuc

SEQ ID NO: 240678 - RNA, 20 nt, Human
uccagaggcugcucagcucc

SEQ ID NO: 240679 - RNA, 23 nt, Human
uccagguuuaagccuagcuuggg

SEQ ID NO: 240680 - RNA, 21 nt, Human
ucccagcacccagcccagggc

SEQ ID NO: 240681 - RNA, 21 nt, Human
ucccagccugccucugcuggg

SEQ ID NO: 240682 - RNA, 19 nt, Human
ucccaugugagcucagugc

SEQ ID NO: 240683 - RNA, 18 nt, Human
uccccaagcugcugcucc

SEQ ID NO: 240684 - RNA, 21 nt, Human
uccccaagcugcugcuccucc

SEQ ID NO: 240685 - RNA, 19 nt, Human
uccccagacucgccuuccc

SEQ ID NO: 240686 - RNA, 22 nt, Human
uccccagacucgccuucccagg

SEQ ID NO: 240687 - RNA, 18 nt, Human
uccccuccuuccuguggc

SEQ ID NO: 240688 - RNA, 22 nt, Human
ucccgcuccgcacaucugcaga

SEQ ID NO: 240689 - RNA, 23 nt, Human
uccugcuuggggcucuggcuucc

SEQ ID NO: 240690 - RNA, 20 nt, Human
uccugggucugugucccagg

SEQ ID NO: 240691 - RNA, 23 nt, Human
uccuuggugaggugaugcggagu

SEQ ID NO: 240692 - RNA, 24 nt, Human
uccuuuggggacagagcagguugg

SEQ ID NO: 240693 - RNA, 24 nt, Human
ucggccagcaggcgugcccagagg

SEQ ID NO: 240694 - RNA, 18 nt, Human
ucuaccaccgccucccgc

SEQ ID NO: 240695 - RNA, 21 nt, Human
ucuagaaacccagaacucagc

SEQ ID NO: 240696 - RNA, 22 nt, Human
ucuagaaacccagaacucagcc

SEQ ID NO: 240697 - RNA, 21 nt, Human
ucucacugggaggaaaaacuc

SEQ ID NO: 240698 - RNA, 19 nt, Human
ucucucuaccaccgccucc

SEQ ID NO: 240699 - RNA, 24 nt, Human
ucuggccaggcacgguggcucaca

SEQ ID NO: 240700 - RNA, 24 nt, Human
ucuuuccagagaggcagaaucugg

SEQ ID NO: 240701 - RNA, 25 nt, Human
ugaaaaguuagccaggcacgguggc

SEQ ID NO: 240702 - RNA, 26 nt, Human
ugacucggggcugaggauggggcagg

SEQ ID NO: 240703 - RNA, 21 nt, Human
ugacugcucuuuccuggaguu

SEQ ID NO: 240704 - RNA, 18 nt, Human
ugacuugggucuggacug

SEQ ID NO: 240705 - RNA, 18 nt, Human
ugagaacagcagcugugg

SEQ ID NO: 240706 - RNA, 19 nt, Human
ugagcagccccgcuggccc

SEQ ID NO: 240707 - RNA, 19 nt, Human
ugagcagccccgcuggccc

SEQ ID NO: 240708 - RNA, 18 nt, Human
ugagcccaggaguaugag

SEQ ID NO: 240709 - RNA, 20 nt, Human
ugaggcagagcacuggacuc

SEQ ID NO: 240710 - RNA, 24 nt, Human
ugaggcaggaggauugcuugagcc

SEQ ID NO: 240711 - RNA, 25 nt, Human
ugaggcaggaggauugcuugagccc

SEQ ID NO: 240712 - RNA, 23 nt, Human
ugaggcugcagugagcuaugauc

SEQ ID NO: 240713 - RNA, 18 nt, Human
ugagguggagggaggaug

SEQ ID NO: 240714 - RNA, 23 nt, Human
ugcacgggagagcccugccuccc

SEQ ID NO: 240715 - RNA, 18 nt, Human
ugcccagagggaagggca

SEQ ID NO: 240716 - RNA, 21 nt, Human
ugccggggcugggacagcccu

SEQ ID NO: 240717 - RNA, 18 nt, Human
ugccugcaggcgcagcac

SEQ ID NO: 240718 - RNA, 23 nt, Human
ugccuggaaagccacacccucug

SEQ ID NO: 240719 - RNA, 20 nt, Human
ugcugggggcuccagcucug

SEQ ID NO: 240720 - RNA, 23 nt, Human
ugcugggggcuccagcucugccu

SEQ ID NO: 240721 - RNA, 22 nt, Human
ugcuguggccaccuucccugga

SEQ ID NO: 240722 - RNA, 19 nt, Human
ugcuuggaggcuucugcug

SEQ ID NO: 240723 - RNA, 22 nt, Human
uggaaggcugaggcaggaggau

SEQ ID NO: 240724 - RNA, 18 nt, Human
uggaggagggggagagga

SEQ ID NO: 240725 - RNA, 23 nt, Human
uggauugcuugaggccacaaguu

SEQ ID NO: 240726 - RNA, 24 nt, Human
uggauugcuugaggccacaaguuu

SEQ ID NO: 240727 - RNA, 20 nt, Human
uggcaacaaaacgagacccc

SEQ ID NO: 240728 - RNA, 20 nt, Human
uggcagcacccaccgcauga

SEQ ID NO: 240729 - RNA, 21 nt, Human
uggcagcacccaccgcaugau

SEQ ID NO: 240730 - RNA, 23 nt, Human
uggcagcccagggaagacaucug

SEQ ID NO: 240731 - RNA, 21 nt, Human
uggccaaaaagugacgucaaa

SEQ ID NO: 240732 - RNA, 18 nt, Human
uggccucagcccgcacuc

SEQ ID NO: 240733 - RNA, 24 nt, Human
uggcucacaucugcaaucucagca

SEQ ID NO: 240734 - RNA, 24 nt, Human
uggcuccgugaggggacugagguc

SEQ ID NO: 240735 - RNA, 25 nt, Human
uggcuguggcagggucuccacacug

SEQ ID NO: 240736 - RNA, 19 nt, Human
uggcuuguagauuccaggu

SEQ ID NO: 240737 - RNA, 21 nt, Human
ugggacaaaugggggucuuga

SEQ ID NO: 240738 - RNA, 24 nt, Human
ugggaggccaaggcagguggauug

SEQ ID NO: 240739 - RNA, 21 nt, Human
ugggcugcagggcuggugagc

SEQ ID NO: 240740 - RNA, 18 nt, Human
uggggagggggagccagc

SEQ ID NO: 240741 - RNA, 21 nt, Human
uggggcagggccgggcagggu

SEQ ID NO: 240742 - RNA, 18 nt, Human
uggggcaucuuugacuug

SEQ ID NO: 240743 - RNA, 20 nt, Human
uggggcucuggcuuccuggc

SEQ ID NO: 240744 - RNA, 23 nt, Human
uggggcugguuccaaggcuucug

SEQ ID NO: 240745 - RNA, 19 nt, Human
ugggucuggacugugccca

SEQ ID NO: 240746 - RNA, 22 nt, Human
ugucaaaagcaaaccaaaccaa

SEQ ID NO: 240747 - RNA, 18 nt, Human
ugucuggggccuggggcc

SEQ ID NO: 240748 - RNA, 19 nt, Human
uguggcagggucuccacac

SEQ ID NO: 240749 - RNA, 21 nt, Human
uuaaccaaagcagacagaccc

SEQ ID NO: 240750 - RNA, 25 nt, Human
uuacauggccaaaaagugacgucaa

SEQ ID NO: 240751 - RNA, 23 nt, Human
uuagagggcgugagaaauggcau

SEQ ID NO: 240752 - RNA, 18 nt, Human
uucccagacgcuccccuc

SEQ ID NO: 240753 - RNA, 24 nt, Human
uugcuugagcccaggaguaugagg

SEQ ID NO: 240754 - RNA, 20 nt, Human
uuggaaggcugaggcaggag

SEQ ID NO: 240755 - RNA, 21 nt, Human
uuugccgcuaaaccuggcugu

SEQ ID NO: 240756 - RNA, 19 nt, Human
aaacagggaaaucaaucua

SEQ ID NO: 240757 - RNA, 24 nt, Human
aaaucaaucuaaaacacauacugg

SEQ ID NO: 240758 - RNA, 23 nt, Human
aagaugacgcuuaggacagaaca

SEQ ID NO: 240759 - RNA, 22 nt, Human
aaucuugccuuuuucaagccac

SEQ ID NO: 240760 - RNA, 23 nt, Human
acagugcugugucaaagcuggua

SEQ ID NO: 240761 - RNA, 21 nt, Human
acuccuuucaucuuccuuucu

SEQ ID NO: 240762 - RNA, 21 nt, Human
agcugagggggcaaggguggc

SEQ ID NO: 240763 - RNA, 24 nt, Human
aggcgagagccgggagcgggaggg

SEQ ID NO: 240764 - RNA, 18 nt, Human
aguccugucuuuauggga

SEQ ID NO: 240765 - RNA, 25 nt, Human
auacuggugccuuucaaaagauagc

SEQ ID NO: 240766 - RNA, 18 nt, Human
caagcugaaggaaaaaca

SEQ ID NO: 240767 - RNA, 23 nt, Human
caauccuuacaaaagucauuguc

SEQ ID NO: 240768 - RNA, 19 nt, Human
cacuccacuccuuucaucu

SEQ ID NO: 240769 - RNA, 22 nt, Human
cagaacaugcagaguaaaaaua

SEQ ID NO: 240770 - RNA, 27 nt, Human
ccaaaccacacuccacuccuuucaucu

SEQ ID NO: 240771 - RNA, 28 nt, Human
cccgacggcgguggcgguccggacgacu

SEQ ID NO: 240772 - RNA, 19 nt, Human
ccggaggaacccgacggcg

SEQ ID NO: 240773 - RNA, 18 nt, Human
ccgggcagugucgcgcgc

SEQ ID NO: 240774 - RNA, 21 nt, Human
ccugucccgcugcaccgagag

SEQ ID NO: 240775 - RNA, 23 nt, Human
ccuuucaucuuccuuucuaggga

SEQ ID NO: 240776 - RNA, 25 nt, Human
cggcucccgcggccgccucacuccc

SEQ ID NO: 240777 - RNA, 21 nt, Human
cgggagcgggagggacuuagc

SEQ ID NO: 240778 - RNA, 19 nt, Human
cgugcgcgcgcggaggccg

SEQ ID NO: 240779 - RNA, 24 nt, Human
cucccgcuguggcugguggccgag

SEQ ID NO: 240780 - RNA, 19 nt, Human
cuccuagugaggcgagagc

SEQ ID NO: 240781 - RNA, 21 nt, Human
cugcaccgagagccgcuccua

SEQ ID NO: 240782 - RNA, 19 nt, Human
gagggggcaaggguggcgg

SEQ ID NO: 240783 - RNA, 21 nt, Human
gcaaggguggcggucccuucc

SEQ ID NO: 240784 - RNA, 23 nt, Human
gcagaguaaaaauaguuuccuuc

SEQ ID NO: 240785 - RNA, 19 nt, Human
gcagcugagggggcaaggg

SEQ ID NO: 240786 - RNA, 18 nt, Human
gcggcggccccggcuccc

SEQ ID NO: 240787 - RNA, 18 nt, Human
ggugguagcagcaggcau

SEQ ID NO: 240788 - RNA, 23 nt, Human
gugguagcagcaggcauuuggua

SEQ ID NO: 240789 - RNA, 22 nt, Human
uaaaguauauuguuuuacuccu

SEQ ID NO: 240790 - RNA, 21 nt, Human
uaaccacaguuguuuggccag

SEQ ID NO: 240791 - RNA, 21 nt, Human
uacaaaagucauugucucaaa

SEQ ID NO: 240792 - RNA, 22 nt, Human
uagaaagcugacaauuguaguc

SEQ ID NO: 240793 - RNA, 23 nt, Human
uaggugacaauacagcaaaaucc

SEQ ID NO: 240794 - RNA, 21 nt, Human
uaguaccaauccuuacaaaag

SEQ ID NO: 240795 - RNA, 21 nt, Human
uauuaugguacacuggccagu

SEQ ID NO: 240796 - RNA, 22 nt, Human
ucaaaaagugccaaucaaagcc

SEQ ID NO: 240797 - RNA, 20 nt, Human
uccacuccuuucaucuuccu

SEQ ID NO: 240798 - RNA, 22 nt, Human
uccuuacaaaagucauugucuc

SEQ ID NO: 240799 - RNA, 22 nt, Human
ugaaaagggugguagcagcagg

SEQ ID NO: 240800 - RNA, 25 nt, Human
ugaaacagggaaaucaaucuaaaac

SEQ ID NO: 240801 - RNA, 19 nt, Human
ugaaggaaaaacaugugac

SEQ ID NO: 240802 - RNA, 24 nt, Human
ugaaggaaaaacaugugaccgaga

SEQ ID NO: 240803 - RNA, 19 nt, Human
ugaauaacucgagggcuga

SEQ ID NO: 240804 - RNA, 24 nt, Human
ugacaauacagcaaaauccaagga

SEQ ID NO: 240805 - RNA, 18 nt, Human
ugagaagccggcgcggcg

SEQ ID NO: 240806 - RNA, 21 nt, Human
ugcaaggcucaagaugacgcu

SEQ ID NO: 240807 - RNA, 21 nt, Human
ugccgguugcggggugcugag

SEQ ID NO: 240808 - RNA, 18 nt, Human
uggccaguguguuuuugg

SEQ ID NO: 240809 - RNA, 18 nt, Human
uguuuugcuuauaccauc

SEQ ID NO: 240810 - RNA, 18 nt, Human
uuagccagccagcagccc

SEQ ID NO: 240811 - RNA, 22 nt, Human
uuccuuucuagggaaauaauuu

SEQ ID NO: 240812 - RNA, 26 nt, Human
uugcugccgcucccgcuguggcuggu

SEQ ID NO: 240813 - RNA, 24 nt, Human
uugucucaaagaaacuguuaagug

SEQ ID NO: 240814 - RNA, 19 nt, Human
uuuacaauaaguuuccuga

SEQ ID NO: 240815 - RNA, 20 nt, Human
uuuuccuuuuaaaaaaaagc

SEQ ID NO: 240816 - RNA, 25 nt, Human
aaaauaguuuuauccaaaucaacug

SEQ ID NO: 240817 - RNA, 21 nt, Human
aacauaacaacacuccaaucc

SEQ ID NO: 240818 - RNA, 18 nt, Human
aagcagaaagaaaaaugg

SEQ ID NO: 240819 - RNA, 23 nt, Human
aagcagaaagaaaaaugggggac

SEQ ID NO: 240820 - RNA, 23 nt, Human
aagcagaaagaaaaaugguucua

SEQ ID NO: 240821 - RNA, 19 nt, Human
aaggaccguccgcuaccgg

SEQ ID NO: 240822 - RNA, 24 nt, Human
aagggcuucuaucccauaccccag

SEQ ID NO: 240823 - RNA, 22 nt, Human
acauaacaacacuccaauccau

SEQ ID NO: 240824 - RNA, 20 nt, Human
acauguauaagcccgcggag

SEQ ID NO: 240825 - RNA, 20 nt, Human
acauuaagaaaaaaggcaac

SEQ ID NO: 240826 - RNA, 22 nt, Human
acuucuguaaacagagugagaa

SEQ ID NO: 240827 - RNA, 22 nt, Human
agaguaacaacauuucuaucau

SEQ ID NO: 240828 - RNA, 21 nt, Human
aggcagcuucccgcccccggg

SEQ ID NO: 240829 - RNA, 21 nt, Human
aguaguucuuucccuccaccu

SEQ ID NO: 240830 - RNA, 24 nt, Human
aguuucaauaaaagcagaaagaaa

SEQ ID NO: 240831 - RNA, 21 nt, Human
auaauacuauuaacuaucuuu

SEQ ID NO: 240832 - RNA, 22 nt, Human
aucaacccaauuacacccugcc

SEQ ID NO: 240833 - RNA, 18 nt, Human
augcaaaauuacuauaau

SEQ ID NO: 240834 - RNA, 18 nt, Human
augcauguuggaaauagu

SEQ ID NO: 240835 - RNA, 20 nt, Human
auuacacccugccgcuccac

SEQ ID NO: 240836 - RNA, 22 nt, Human
caaagaaaaauacucaguuuca

SEQ ID NO: 240837 - RNA, 19 nt, Human
caacccaauuacacccugc

SEQ ID NO: 240838 - RNA, 22 nt, Human
caacugaaaaacugucuucaua

SEQ ID NO: 240839 - RNA, 22 nt, Human
caagacaggucccacccaucaa

SEQ ID NO: 240840 - RNA, 19 nt, Human
caaugccaaauaacuauga

SEQ ID NO: 240841 - RNA, 21 nt, Human
caccaacuguacucaacacac

SEQ ID NO: 240842 - RNA, 21 nt, Human
cacccaucaacccaauuacac

SEQ ID NO: 240843 - RNA, 18 nt, Human
cacccugccgcuccaccu

SEQ ID NO: 240844 - RNA, 21 nt, Human
cacccugccgcuccaccuucu

SEQ ID NO: 240845 - RNA, 19 nt, Human
cagcuucccgcccccgggg

SEQ ID NO: 240846 - RNA, 22 nt, Human
caggagagcaacccgggcccuc

SEQ ID NO: 240847 - RNA, 21 nt, Human
cagguggcgauucugaccuug

SEQ ID NO: 240848 - RNA, 21 nt, Human
cagguggcgauucugaccuug

SEQ ID NO: 240849 - RNA, 24 nt, Human
cauaaaaaauccacauuagccaaa

SEQ ID NO: 240850 - RNA, 20 nt, Human
cauaacaacacuccaaucca

SEQ ID NO: 240851 - RNA, 23 nt, Human
ccaaagaaaaauacucaguuuca

SEQ ID NO: 240852 - RNA, 23 nt, Human
ccaccucccaacaauccuuuuau

SEQ ID NO: 240853 - RNA, 21 nt, Human
ccagcugccucuuccuguucu

SEQ ID NO: 240854 - RNA, 20 nt, Human
cccauaccccaaugacagaa

SEQ ID NO: 240855 - RNA, 19 nt, Human
cccccggggggcgccugcc

SEQ ID NO: 240856 - RNA, 21 nt, Human
cccccggggggcgccugccgg

SEQ ID NO: 240857 - RNA, 24 nt, Human
cccgcggaggucuccaaucuaucc

SEQ ID NO: 240858 - RNA, 23 nt, Human
ccgauggucaagacaggucccac

SEQ ID NO: 240859 - RNA, 22 nt, Human
ccucagguggcgauucugaccu

SEQ ID NO: 240860 - RNA, 22 nt, Human
ccucagguggcgauucugaccu

SEQ ID NO: 240861 - RNA, 28 nt, Human
ccucuuccuguucuaggcauucuagggg

SEQ ID NO: 240862 - RNA, 21 nt, Human
ccuuuugccuuucacauguuu

SEQ ID NO: 240863 - RNA, 19 nt, Human
cggaaagagugggguaaug

SEQ ID NO: 240864 - RNA, 20 nt, Human
cguccgcuaccggcucugcc

SEQ ID NO: 240865 - RNA, 22 nt, Human
cucaacacacuucuguaaacag

SEQ ID NO: 240866 - RNA, 19 nt, Human
cuguucuaggcauucuagg

SEQ ID NO: 240867 - RNA, 21 nt, Human
cuucuguaaacagagugagaa

SEQ ID NO: 240868 - RNA, 20 nt, Human
gaaaauuaacagauaucccc

SEQ ID NO: 240869 - RNA, 21 nt, Human
gacauuaagaaaaaaggcaac

SEQ ID NO: 240870 - RNA, 19 nt, Human
gcagaacaccagcugccuc

SEQ ID NO: 240871 - RNA, 21 nt, Human
gcagaacaccagcugccucuu

SEQ ID NO: 240872 - RNA, 23 nt, Human
gcuggaugggaaucguagucuuc

SEQ ID NO: 240873 - RNA, 18 nt, Human
ggaaagagugggguaaug

SEQ ID NO: 240874 - RNA, 18 nt, Human
guacuguaaaauaagauc

SEQ ID NO: 240875 - RNA, 22 nt, Human
guuggaaauaguaguucuuucc

SEQ ID NO: 240876 - RNA, 22 nt, Human
uaacaacacuccaauccauuac

SEQ ID NO: 240877 - RNA, 21 nt, Human
uaagacugcuuuggacacuau

SEQ ID NO: 240878 - RNA, 21 nt, Human
uaagacugcuuuggacacuau

SEQ ID NO: 240879 - RNA, 23 nt, Human
uacaaguacauacauaaccagga

SEQ ID NO: 240880 - RNA, 18 nt, Human
uacacuugucaaugcacu

SEQ ID NO: 240881 - RNA, 28 nt, Human
uaccuaaacuggagaccuccauuagggc

SEQ ID NO: 240882 - RNA, 24 nt, Human
uacucaacacacuucuguaaacag

SEQ ID NO: 240883 - RNA, 21 nt, Human
uagccaaagaaaaauacucag

SEQ ID NO: 240884 - RNA, 21 nt, Human
uaggaguuguagguaucuuuu

SEQ ID NO: 240885 - RNA, 18 nt, Human
uauguacaaguacauaca

SEQ ID NO: 240886 - RNA, 19 nt, Human
uauuucaccauucuuaagg

SEQ ID NO: 240887 - RNA, 21 nt, Human
uauuucaccauucuuaaggug

SEQ ID NO: 240888 - RNA, 18 nt, Human
ucaggccucagguggcga

SEQ ID NO: 240889 - RNA, 18 nt, Human
ucaggccucagguggcga

SEQ ID NO: 240890 - RNA, 22 nt, Human
ucauuugcccacccugaacuuc

SEQ ID NO: 240891 - RNA, 23 nt, Human
ucauuugcccacccugaacuuca

SEQ ID NO: 240892 - RNA, 22 nt, Human
uccaauccauuacuguugacau

SEQ ID NO: 240893 - RNA, 18 nt, Human
ucccauaccccaaugaca

SEQ ID NO: 240894 - RNA, 19 nt, Human
ucccauaccccaaugacag

SEQ ID NO: 240895 - RNA, 20 nt, Human
ucccuugaaguuggauacuc

SEQ ID NO: 240896 - RNA, 24 nt, Human
ucuccaaucuauccacuggauuuc

SEQ ID NO: 240897 - RNA, 22 nt, Human
ucuuccuccuuucauugaaaug

SEQ ID NO: 240898 - RNA, 21 nt, Human
ugaaaauuaacagauaucccc

SEQ ID NO: 240899 - RNA, 20 nt, Human
ugaaugcaccauggagucuu

SEQ ID NO: 240900 - RNA, 18 nt, Human
ugcccgagacucgugggg

SEQ ID NO: 240901 - RNA, 30 nt, Human
ugccucuuccuguucuaggcauucuagggg

SEQ ID NO: 240902 - RNA, 19 nt, Human
ugcggagauucccuugaag

SEQ ID NO: 240903 - RNA, 20 nt, Human
ugcggagauucccuugaagu

SEQ ID NO: 240904 - RNA, 19 nt, Human
uggccuagucucugcucuc

SEQ ID NO: 240905 - RNA, 18 nt, Human
uggcgauucugaccuugg

SEQ ID NO: 240906 - RNA, 21 nt, Human
uggcuugcaguuugaauccug

SEQ ID NO: 240907 - RNA, 22 nt, Human
uguaaaauaagaucugcccuga

SEQ ID NO: 240908 - RNA, 23 nt, Human
uucaaaaccugaaaauuaacaga

SEQ ID NO: 240909 - RNA, 23 nt, Human
uucauauucuuccuuuucuggaa

SEQ ID NO: 240910 - RNA, 21 nt, Human
uucccuugaaguuggauacuc

SEQ ID NO: 240911 - RNA, 19 nt, Human
uugcccacccugaacuuca

SEQ ID NO: 240912 - RNA, 20 nt, Human
uugcuccccaaaauacugua

SEQ ID NO: 240913 - RNA, 21 nt, Human
uugguauuggauguuccucuc

SEQ ID NO: 240914 - RNA, 22 nt, Human
uuugcagaacaccagcugccuc

SEQ ID NO: 240915 - RNA, 23 nt, Human
uuugcccacccugaacuucacug

SEQ ID NO: 240916 - RNA, 22 nt, Human
uuuuuuuuuuuuuugcaguuug

SEQ ID NO: 240917 - RNA, 21 nt, Human
cucccagcccugacaccucuc

SEQ ID NO: 240918 - RNA, 18 nt, Human
ucucccagcccugacacc

SEQ ID NO: 240919 - RNA, 21 nt, Human
uggcuauggauucuuagcucu

SEQ ID NO: 240920 - RNA, 24 nt, Human
uguuuauuuaaauaaagaagaaag

SEQ ID NO: 240921 - RNA, 24 nt, Human
uucuuagcucuguaaggaagugcu

SEQ ID NO: 240922 - RNA, 25 nt, Human
uucuuagcucuguaaggaagugcuu

SEQ ID NO: 240923 - RNA, 23 nt, Human
uuuauuuaaauaaagaagaaagc

SEQ ID NO: 240924 - RNA, 26 nt, Human
aaaaacagaaaauaaggaacaaaggg

SEQ ID NO: 240925 - RNA, 24 nt, Human
aaaaacuugugaaaauguguuuaa

SEQ ID NO: 240926 - RNA, 18 nt, Human
aaaaccacaugccugugg

SEQ ID NO: 240927 - RNA, 19 nt, Human
aaacaaacggccagugagc

SEQ ID NO: 240928 - RNA, 25 nt, Human
aaacaggaagauggaagcaucagag

SEQ ID NO: 240929 - RNA, 22 nt, Human
aaacgagaguacuuggacugca

SEQ ID NO: 240930 - RNA, 25 nt, Human
aaaucaaaagcaaacuggaaagcaa

SEQ ID NO: 240931 - RNA, 21 nt, Human
aagaagacacuucccugagcc

SEQ ID NO: 240932 - RNA, 22 nt, Human
aagcaucagaggauuaaaaacc

SEQ ID NO: 240933 - RNA, 20 nt, Human
acaacaugaaagcaaucaac

SEQ ID NO: 240934 - RNA, 20 nt, Human
accccuguggcacaggaguu

SEQ ID NO: 240935 - RNA, 20 nt, Human
acuggaaagcaagagcaaua

SEQ ID NO: 240936 - RNA, 28 nt, Human
agaaaaaacagaaaauaaggaacaaagg

SEQ ID NO: 240937 - RNA, 20 nt, Human
agcagcauuccacacccagc

SEQ ID NO: 240938 - RNA, 22 nt, Human
aggcauuuuggcuguaugugga

SEQ ID NO: 240939 - RNA, 25 nt, Human
aggguacagaauaacaacaugaaag

SEQ ID NO: 240940 - RNA, 19 nt, Human
agguuucugggcacauggc

SEQ ID NO: 240941 - RNA, 22 nt, Human
aguaguuccaagcagcaagaaa

SEQ ID NO: 240942 - RNA, 28 nt, Human
auugaaaaaaaggucaaaaccacaugcc

SEQ ID NO: 240943 - RNA, 21 nt, Human
caaaagcaaacuggaaagcaa

SEQ ID NO: 240944 - RNA, 24 nt, Human
caaacaaauaacaaaaaggaguuc

SEQ ID NO: 240945 - RNA, 19 nt, Human
caaacuggaaagcaagagc

SEQ ID NO: 240946 - RNA, 30 nt, Human
caacuguaccucucuagagaaaaaacagag

SEQ ID NO: 240947 - RNA, 27 nt, Human
cacaguccuuagcccaaucccagcuau

SEQ ID NO: 240948 - RNA, 20 nt, Human
cagaauaacaacaugaaagc

SEQ ID NO: 240949 - RNA, 24 nt, Human
cagaauccccagugaauacccuuc

SEQ ID NO: 240950 - RNA, 18 nt, Human
cagagcccucgauguccc

SEQ ID NO: 240951 - RNA, 20 nt, Human
cagaggacagcagagcccuc

SEQ ID NO: 240952 - RNA, 19 nt, Human
cagcgcagaggacagcaga

SEQ ID NO: 240953 - RNA, 20 nt, Human
cagcguucccccuagcgccu

SEQ ID NO: 240954 - RNA, 19 nt, Human
cagcuauacagucacccca

SEQ ID NO: 240955 - RNA, 21 nt, Human
cagcuauacagucaccccaau

SEQ ID NO: 240956 - RNA, 26 nt, Human
caguccagguuucugggcacauggcc

SEQ ID NO: 240957 - RNA, 18 nt, Human
ccaaagcucagaaucccc

SEQ ID NO: 240958 - RNA, 23 nt, Human
ccaaagcucagaauccccaguga

SEQ ID NO: 240959 - RNA, 19 nt, Human
ccacacccagcgcagagga

SEQ ID NO: 240960 - RNA, 24 nt, Human
cccacagaaaugugggcaagaaga

SEQ ID NO: 240961 - RNA, 19 nt, Human
cccaccaccgcaagguaaa

SEQ ID NO: 240962 - RNA, 20 nt, Human
ccgcaagguaaagugacuuc

SEQ ID NO: 240963 - RNA, 21 nt, Human
ccuaaggcuuauaaaaggccc

SEQ ID NO: 240964 - RNA, 28 nt, Human
cuauacagucaccccaauuuccacaaaa

SEQ ID NO: 240965 - RNA, 20 nt, Human
cuuauaaaaggcccccugcc

SEQ ID NO: 240966 - RNA, 24 nt, Human
cuuuccaacgaacuggauuucugg

SEQ ID NO: 240967 - RNA, 23 nt, Human
gaaaaaacagaaaauaaggaaca

SEQ ID NO: 240968 - RNA, 20 nt, Human
gaaauaccagauucucaugg

SEQ ID NO: 240969 - RNA, 20 nt, Human
gaauccccagugaauacccu

SEQ ID NO: 240970 - RNA, 23 nt, Human
gacuuacaacuguaccucucuag

SEQ ID NO: 240971 - RNA, 22 nt, Human
gagccugcuacaccauuuugcc

SEQ ID NO: 240972 - RNA, 18 nt, Human
gagcuaguuucagaggcc

SEQ ID NO: 240973 - RNA, 22 nt, Human
gcaagguaaagugacuucccuu

SEQ ID NO: 240974 - RNA, 20 nt, Human
gccaaagcucagaaucccca

SEQ ID NO: 240975 - RNA, 28 nt, Human
ggagaagcaagucuagaacaucuccagg

SEQ ID NO: 240976 - RNA, 18 nt, Human
ggaguagccaaagcucag

SEQ ID NO: 240977 - RNA, 24 nt, Human
gggcaagaagacacuucccugagc

SEQ ID NO: 240978 - RNA, 19 nt, Human
guauaauccuguaauuggg

SEQ ID NO: 240979 - RNA, 23 nt, Human
gugaauacccuucuggggauggg

SEQ ID NO: 240980 - RNA, 23 nt, Human
gugcagcagcauuccacacccag

SEQ ID NO: 240981 - RNA, 20 nt, Human
uaaaaaacaaacggccagug

SEQ ID NO: 240982 - RNA, 26 nt, Human
uaaaaaacaaacggccagugagccug

SEQ ID NO: 240983 - RNA, 25 nt, Human
uaaucacugcaaaguaguuccaagc

SEQ ID NO: 240984 - RNA, 25 nt, Human
uacccuucuggggaugggagacggg

SEQ ID NO: 240985 - RNA, 18 nt, Human
uagaaagaaaaaaaucac

SEQ ID NO: 240986 - RNA, 19 nt, Human
uagcgccucgcugugcccc

SEQ ID NO: 240987 - RNA, 21 nt, Human
ucaaaagcaaacuggaaagcu

SEQ ID NO: 240988 - RNA, 21 nt, Human
uccagguuucugggcacaugg

SEQ ID NO: 240989 - RNA, 20 nt, Human
uccagugucucaaaaacuug

SEQ ID NO: 240990 - RNA, 26 nt, Human
uccccacagaaaugugggcaagaaga

SEQ ID NO: 240991 - RNA, 24 nt, Human
uccuuagcccaaucccagcuauac

SEQ ID NO: 240992 - RNA, 20 nt, Human
ucuagagaaaaaacagaaaa

SEQ ID NO: 240993 - RNA, 28 nt, Human
ucuagagaaaaaacagaaaauaaggaac

SEQ ID NO: 240994 - RNA, 21 nt, Human
ugaaagacaucaggaucccac

SEQ ID NO: 240995 - RNA, 18 nt, Human
ugaaagcaaucaacccug

SEQ ID NO: 240996 - RNA, 20 nt, Human
ugacuuacaacuguaccucu

SEQ ID NO: 240997 - RNA, 21 nt, Human
ugagggacuggaguugagacu

SEQ ID NO: 240998 - RNA, 23 nt, Human
ugaugguuuuuuuucuucauuuu

SEQ ID NO: 240999 - RNA, 26 nt, Human
ugaugguuuuuuuucuucauuuuaaa

SEQ ID NO: 241000 - RNA, 24 nt, Human
ugcaaacaaauaacaaaaaagaug

SEQ ID NO: 241001 - RNA, 25 nt, Human
uggaaccccuguggcacaggaguac

SEQ ID NO: 241002 - RNA, 24 nt, Human
uggacugcaaccaaguaaucacug

SEQ ID NO: 241003 - RNA, 18 nt, Human
uggauuucuggauaggca

SEQ ID NO: 241004 - RNA, 19 nt, Human
ugggaaacuggaguagcca

SEQ ID NO: 241005 - RNA, 20 nt, Human
ugggagacggggccagcuaa

SEQ ID NO: 241006 - RNA, 18 nt, Human
uggggaugggagacgggg

SEQ ID NO: 241007 - RNA, 20 nt, Human
uggggaugggagacggggcc

SEQ ID NO: 241008 - RNA, 21 nt, Human
uguauguggacagauaagacc

SEQ ID NO: 241009 - RNA, 21 nt, Human
uuaacucugacuuacaacugu

SEQ ID NO: 241010 - RNA, 19 nt, Human
uuacaacuguaccucucua

SEQ ID NO: 241011 - RNA, 22 nt, Human
uucagaggccagcguucccccu

SEQ ID NO: 241012 - RNA, 24 nt, Human
uuguacaaaaggugaugguuuuuu

SEQ ID NO: 241013 - RNA, 19 nt, Human
aaaauaagcaccccuuucc

SEQ ID NO: 241014 - RNA, 22 nt, Human
aaacaaaaguugcgcugagacc

SEQ ID NO: 241015 - RNA, 18 nt, Human
aaaguucagacacuuuca

SEQ ID NO: 241016 - RNA, 25 nt, Human
aacacucagaaauggaucaaaaaug

SEQ ID NO: 241017 - RNA, 23 nt, Human
accaaaucacaaaacaccaacau

SEQ ID NO: 241018 - RNA, 18 nt, Human
agaaauggaucaaaaaug

SEQ ID NO: 241019 - RNA, 20 nt, Human
agacagaugcaccuaaauca

SEQ ID NO: 241020 - RNA, 18 nt, Human
aguagucaaaauaagcac

SEQ ID NO: 241021 - RNA, 18 nt, Human
aguggaaaaugucuggaa

SEQ ID NO: 241022 - RNA, 20 nt, Human
augcggcugcuagagcugga

SEQ ID NO: 241023 - RNA, 19 nt, Human
caaaacaccaacauccaca

SEQ ID NO: 241024 - RNA, 27 nt, Human
caaauuaaaaucuaaaucacaaaagua

SEQ ID NO: 241025 - RNA, 21 nt, Human
caccaaaucacaaaacaccaa

SEQ ID NO: 241026 - RNA, 23 nt, Human
caccaacauccacacuuucaaag

SEQ ID NO: 241027 - RNA, 18 nt, Human
caccggagucucgcagua

SEQ ID NO: 241028 - RNA, 19 nt, Human
caguagucaaaauaagcac

SEQ ID NO: 241029 - RNA, 20 nt, Human
cauugugugugcagcacugu

SEQ ID NO: 241030 - RNA, 22 nt, Human
ccuuccuuuuaucuuugagccc

SEQ ID NO: 241031 - RNA, 18 nt, Human
cgguguacuuuucaaggg

SEQ ID NO: 241032 - RNA, 21 nt, Human
cuaguggcuuuggguuuuucu

SEQ ID NO: 241033 - RNA, 23 nt, Human
cucacagacagaugcaccuaaau

SEQ ID NO: 241034 - RNA, 20 nt, Human
cucaggaauaaaaaacaaaa

SEQ ID NO: 241035 - RNA, 18 nt, Human
cucucuuccucuuuuaaa

SEQ ID NO: 241036 - RNA, 19 nt, Human
cugcugcugcugcugcugc

SEQ ID NO: 241037 - RNA, 23 nt, Human
cuguucaccaaaucacaaaacac

SEQ ID NO: 241038 - RNA, 22 nt, Human
cuuuucccuuccuuuuaucuuu

SEQ ID NO: 241039 - RNA, 24 nt, Human
gaauugaacagaaguuuacacuua

SEQ ID NO: 241040 - RNA, 24 nt, Human
gacagauaaaaguaccaggaagaa

SEQ ID NO: 241041 - RNA, 23 nt, Human
gacuuugagaaggguaauaauuu

SEQ ID NO: 241042 - RNA, 24 nt, Human
gcaaagcucuuccaguagucaaaa

SEQ ID NO: 241043 - RNA, 23 nt, Human
gcaacaaauuaaaaucuaaauca

SEQ ID NO: 241044 - RNA, 26 nt, Human
gccuuucggaagugcugcagcguugg

SEQ ID NO: 241045 - RNA, 19 nt, Human
ggaaagaagucuucuaaua

SEQ ID NO: 241046 - RNA, 20 nt, Human
guuacagcugggcuguuuac

SEQ ID NO: 241047 - RNA, 21 nt, Human
uaaagaauccuugugugagag

SEQ ID NO: 241048 - RNA, 22 nt, Human
uacuuuuucuccccuugugggg

SEQ ID NO: 241049 - RNA, 24 nt, Human
uccaaaucguguuuacucacagac

SEQ ID NO: 241050 - RNA, 24 nt, Human
uccgcuuccccuacuuuuucuccc

SEQ ID NO: 241051 - RNA, 24 nt, Human
uccuuuuaucuuugagcccagccg

SEQ ID NO: 241052 - RNA, 18 nt, Human
ucucgcaguaagcugugg

SEQ ID NO: 241053 - RNA, 23 nt, Human
ucucucuuccucuuuuaaagaau

SEQ ID NO: 241054 - RNA, 22 nt, Human
ugaaagacuguccuccccccuc

SEQ ID NO: 241055 - RNA, 21 nt, Human
ugcggaguggaauauuaggaa

SEQ ID NO: 241056 - RNA, 19 nt, Human
ugcugaguguguguccggg

SEQ ID NO: 241057 - RNA, 21 nt, Human
ugcugcugcugcugcugcugc

SEQ ID NO: 241058 - RNA, 21 nt, Human
ugcugcugcugcugcugcugc

SEQ ID NO: 241059 - RNA, 21 nt, Human
ugcugcugcugcugcugcugc

SEQ ID NO: 241060 - RNA, 21 nt, Human
ugcugcugcugcugcugcugc

SEQ ID NO: 241061 - RNA, 21 nt, Human
ugcugcugcugcugcugcugc

SEQ ID NO: 241062 - RNA, 21 nt, Human
ugcugcugcugcugcugcugc

SEQ ID NO: 241063 - RNA, 21 nt, Human
ugcugcugcugcugcugcugc

SEQ ID NO: 241064 - RNA, 21 nt, Human
ugcugcugcugcugcugcugc

SEQ ID NO: 241065 - RNA, 21 nt, Human
ugcugcugcugcugcugcugc

SEQ ID NO: 241066 - RNA, 21 nt, Human
ugcugcugcugcugcugcugc

SEQ ID NO: 241067 - RNA, 21 nt, Human
ugcugcugcugcugcugcugc

SEQ ID NO: 241068 - RNA, 21 nt, Human
ugcugcugcugcugcugcugc

SEQ ID NO: 241069 - RNA, 21 nt, Human
ugcugcugcugcugcugcugc

SEQ ID NO: 241070 - RNA, 21 nt, Human
ugcugcugcugcugcugcugc

SEQ ID NO: 241071 - RNA, 24 nt, Human
ugcugcugcugcugcugcugcuuu

SEQ ID NO: 241072 - RNA, 26 nt, Human
ugcugcugcugcugcugcugcuuuuc

SEQ ID NO: 241073 - RNA, 23 nt, Human
uggaauguuagaaauagaacaac

SEQ ID NO: 241074 - RNA, 20 nt, Human
ugggggugggugagaugaug

SEQ ID NO: 241075 - RNA, 21 nt, Human
ugugcagcacuguuaaucaaa

SEQ ID NO: 241076 - RNA, 19 nt, Human
uguguccggggugagugug

SEQ ID NO: 241077 - RNA, 19 nt, Human
uuaaaggaagagauuguuu

SEQ ID NO: 241078 - RNA, 21 nt, Human
uuaucuuugagcccagccguu

SEQ ID NO: 241079 - RNA, 18 nt, Human
uuccccuacuuuuucucc

SEQ ID NO: 241080 - RNA, 23 nt, Human
uucccugcugcugcugcugcugc

SEQ ID NO: 241081 - RNA, 22 nt, Human
uuccucuuuuaaagaauccuug

SEQ ID NO: 241082 - RNA, 22 nt, Human
uugcgcugagacccagcaaagc

SEQ ID NO: 241083 - RNA, 30 nt, Human
uugguuucccugcugcugcugcugcugccg

SEQ ID NO: 241084 - RNA, 21 nt, Human
uuucccugcugcugcugcugc

SEQ ID NO: 241085 - RNA, 21 nt, Human
uuucuccccuugugggggugg

SEQ ID NO: 241086 - RNA, 22 nt, Human
aacccacaauccuaagcaccuc

SEQ ID NO: 241087 - RNA, 25 nt, Human
aagcugauuuuggucaaggugggac

SEQ ID NO: 241088 - RNA, 23 nt, Human
acccacaauccuaagcaccuccu

SEQ ID NO: 241089 - RNA, 25 nt, Human
agaaccaacagggagaaccgguacc

SEQ ID NO: 241090 - RNA, 24 nt, Human
caaucagaaacccacaauccuaag

SEQ ID NO: 241091 - RNA, 23 nt, Human
cagaaacccacaauccuaagcac

SEQ ID NO: 241092 - RNA, 22 nt, Human
ccaacccccacugcccacgggc

SEQ ID NO: 241093 - RNA, 22 nt, Human
cccacaauccuaagcaccuccu

SEQ ID NO: 241094 - RNA, 25 nt, Human
ccgccgccggaccgcuguggagccc

SEQ ID NO: 241095 - RNA, 21 nt, Human
ccuaagcaccuccuugaaaac

SEQ ID NO: 241096 - RNA, 22 nt, Human
cgcuauggagcccgcuguggag

SEQ ID NO: 241097 - RNA, 21 nt, Human
gagcagggcugagggagccuc

SEQ ID NO: 241098 - RNA, 21 nt, Human
gaugcaaucagaaacccacaa

SEQ ID NO: 241099 - RNA, 19 nt, Human
gcccgcuguggaccccgcg

SEQ ID NO: 241100 - RNA, 20 nt, Human
gccggaccgcuguggagccc

SEQ ID NO: 241101 - RNA, 21 nt, Human
gcuguggagcccgcuauggag

SEQ ID NO: 241102 - RNA, 24 nt, Human
uaagcaccuccuugaaaacaguua

SEQ ID NO: 241103 - RNA, 21 nt, Human
ucgcugccgccgccggaccgc

SEQ ID NO: 241104 - RNA, 21 nt, Human
ucgcugccgccgccggaccgc

SEQ ID NO: 241105 - RNA, 21 nt, Human
ugggacacugaaguuuacgug

SEQ ID NO: 241106 - RNA, 18 nt, Human
ugugggcagguccaauac

SEQ ID NO: 241107 - RNA, 19 nt, Human
uugaaaacaguuacaaagc

SEQ ID NO: 241108 - RNA, 21 nt, Human
aaguccuggagaccaaaggcc

SEQ ID NO: 241109 - RNA, 21 nt, Human
aagucugaaggccucagagcc

SEQ ID NO: 241110 - RNA, 22 nt, Human
acacaguccaagucugaaggcc

SEQ ID NO: 241111 - RNA, 21 nt, Human
agccuggcagugugacacagu

SEQ ID NO: 241112 - RNA, 23 nt, Human
aguggcuccggcuaugcccccga

SEQ ID NO: 241113 - RNA, 24 nt, Human
caaguccuggagaccaaaggccgg

SEQ ID NO: 241114 - RNA, 31 nt, Human
cacaguccaagucugaaggccucagagccuc

SEQ ID NO: 241115 - RNA, 18 nt, Human
ccagcuugccgccgccgc

SEQ ID NO: 241116 - RNA, 20 nt, Human
cccuguggggcuggagaggc

SEQ ID NO: 241117 - RNA, 24 nt, Human
ccgucugcaaguuggagcccugga

SEQ ID NO: 241118 - RNA, 18 nt, Human
ccuggagaccaaaggccg

SEQ ID NO: 241119 - RNA, 18 nt, Human
cugcaaguuggagcccug

SEQ ID NO: 241120 - RNA, 20 nt, Human
cugcugcccuguggggcugg

SEQ ID NO: 241121 - RNA, 19 nt, Human
cuugccgccgccgcucgga

SEQ ID NO: 241122 - RNA, 25 nt, Human
gcagaguggcuccggcuaugccccc

SEQ ID NO: 241123 - RNA, 19 nt, Human
ucacaaggugaggaaccca

SEQ ID NO: 241124 - RNA, 23 nt, Human
ucacaaggugaggaacccaggcu

SEQ ID NO: 241125 - RNA, 27 nt, Human
ucaggccaagcagaguggcuccggcua

SEQ ID NO: 241126 - RNA, 23 nt, Human
ucgcagccagcuugccgccgccg

SEQ ID NO: 241127 - RNA, 18 nt, Human
ucucaguucgaggggcug

SEQ ID NO: 241128 - RNA, 24 nt, Human
ucugcaaguuggagcccuggaagc

SEQ ID NO: 241129 - RNA, 22 nt, Human
ugcugcccuguggggcuggaga

SEQ ID NO: 241130 - RNA, 22 nt, Human
ugcugggacaaguccuggagac

SEQ ID NO: 241131 - RNA, 18 nt, Human
uggagcccuggaagccug

SEQ ID NO: 241132 - RNA, 19 nt, Human
uggcagugugacacagucc

SEQ ID NO: 241133 - RNA, 18 nt, Human
uggcuccggcuaugcccc

SEQ ID NO: 241134 - RNA, 18 nt, Human
aaaagcacgcgcuuccac

SEQ ID NO: 241135 - RNA, 22 nt, Human
aaacaaaagcacgcgcuuccac

SEQ ID NO: 241136 - RNA, 22 nt, Human
aaacacaugaaaaaacauuuuu

SEQ ID NO: 241137 - RNA, 23 nt, Human
aacuacuugaccaaaacaucuga

SEQ ID NO: 241138 - RNA, 18 nt, Human
aagcaucuagcuuuauag

SEQ ID NO: 241139 - RNA, 22 nt, Human
acagcaaccacagcggcuccaa

SEQ ID NO: 241140 - RNA, 18 nt, Human
accacauuucaaaauuac

SEQ ID NO: 241141 - RNA, 18 nt, Human
acuccaugguaagucaaa

SEQ ID NO: 241142 - RNA, 25 nt, Human
agguaccaaaaaaauaaaggaacaa

SEQ ID NO: 241143 - RNA, 22 nt, Human
auaaaacacaugaaaaaacauu

SEQ ID NO: 241144 - RNA, 20 nt, Human
augguaagucaaauagguac

SEQ ID NO: 241145 - RNA, 20 nt, Human
auuacaauuacauuauuuuc

SEQ ID NO: 241146 - RNA, 20 nt, Human
auuacauuauuuuccucaug

SEQ ID NO: 241147 - RNA, 20 nt, Human
caaaaaaaccuccugguucc

SEQ ID NO: 241148 - RNA, 19 nt, Human
caaaaggagcuauacagca

SEQ ID NO: 241149 - RNA, 22 nt, Human
caaaaggagcuauacagcaaua

SEQ ID NO: 241150 - RNA, 23 nt, Human
caaaaggagcuauacagcaauau

SEQ ID NO: 241151 - RNA, 23 nt, Human
cacagaacauuaaacaguacaaa

SEQ ID NO: 241152 - RNA, 21 nt, Human
cacagcggcuccaacagcacu

SEQ ID NO: 241153 - RNA, 21 nt, Human
cagaacauuaaacaguacaaa

SEQ ID NO: 241154 - RNA, 24 nt, Human
caucacaauguugacaaaaaaacc

SEQ ID NO: 241155 - RNA, 19 nt, Human
cauuuuuaagaguucugua

SEQ ID NO: 241156 - RNA, 18 nt, Human
ccuccugguuccuuuuga

SEQ ID NO: 241157 - RNA, 22 nt, Human
cucacuuucacuuaaaacuuga

SEQ ID NO: 241158 - RNA, 18 nt, Human
cuuaaauaucucccuacc

SEQ ID NO: 241159 - RNA, 24 nt, Human
cuuccacuccgcggacagcaacca

SEQ ID NO: 241160 - RNA, 23 nt, Human
cuuuauuuccucacuuucacuua

SEQ ID NO: 241161 - RNA, 19 nt, Human
gaaaugaaggucaaaagga

SEQ ID NO: 241162 - RNA, 19 nt, Human
gaccaaaacaucugauuua

SEQ ID NO: 241163 - RNA, 23 nt, Human
gccagggacacaaacaaaagcac

SEQ ID NO: 241164 - RNA, 20 nt, Human
gggacacaaacaaaagcacg

SEQ ID NO: 241165 - RNA, 21 nt, Human
uacaaauauccauugcuucau

SEQ ID NO: 241166 - RNA, 21 nt, Human
uacaugaaaugaaggucaaaa

SEQ ID NO: 241167 - RNA, 23 nt, Human
uaccaaaaaaauaaaggaacaau

SEQ ID NO: 241168 - RNA, 19 nt, Human
uauaaaacacaugaaaaaa

SEQ ID NO: 241169 - RNA, 22 nt, Human
uaucucccuaccuauacugagu

SEQ ID NO: 241170 - RNA, 22 nt, Human
uaugaguuacuuucaggaccuu

SEQ ID NO: 241171 - RNA, 24 nt, Human
ucacaauguugacaaaaaaaccuc

SEQ ID NO: 241172 - RNA, 23 nt, Human
ucccuaccuauacugagucaaac

SEQ ID NO: 241173 - RNA, 24 nt, Human
uuaaccaaugaaauaaaacauauc

SEQ ID NO: 241174 - RNA, 24 nt, Human
acagacaguguuggccggcggaac

SEQ ID NO: 241175 - RNA, 19 nt, Human
accccaggaggcugagaag

SEQ ID NO: 241176 - RNA, 18 nt, Human
acugcccuccugggggag

SEQ ID NO: 241177 - RNA, 21 nt, Human
agcacugcccuaggcggggau

SEQ ID NO: 241178 - RNA, 20 nt, Human
agcacuuggaaucagggcag

SEQ ID NO: 241179 - RNA, 18 nt, Human
agccaugcagcacugccc

SEQ ID NO: 241180 - RNA, 23 nt, Human
cacagcacaguauuugagacaga

SEQ ID NO: 241181 - RNA, 21 nt, Human
cacaguauuugagacagacag

SEQ ID NO: 241182 - RNA, 22 nt, Human
cagcccagcccuugggccccuu

SEQ ID NO: 241183 - RNA, 22 nt, Human
ccaccgaccggaccgaucgcgc

SEQ ID NO: 241184 - RNA, 21 nt, Human
ccccaaagucugacaguuugg

SEQ ID NO: 241185 - RNA, 24 nt, Human
ccccaggaggcugagaagucgagg

SEQ ID NO: 241186 - RNA, 24 nt, Human
ccuccaagcagaccugagcggccc

SEQ ID NO: 241187 - RNA, 22 nt, Human
ccugggggaggcauccuccaag

SEQ ID NO: 241188 - RNA, 24 nt, Human
cuccugggggaggcauccuccaag

SEQ ID NO: 241189 - RNA, 23 nt, Human
gcccuccugggggaggcauccuc

SEQ ID NO: 241190 - RNA, 18 nt, Human
gccggcggaaccccagga

SEQ ID NO: 241191 - RNA, 23 nt, Human
gcggccccgggcuggggcgggcg

SEQ ID NO: 241192 - RNA, 18 nt, Human
ggaggcugagaagucgag

SEQ ID NO: 241193 - RNA, 20 nt, Human
ggcgauaagagcacuuggaa

SEQ ID NO: 241194 - RNA, 18 nt, Human
ggggagccaccgaccgga

SEQ ID NO: 241195 - RNA, 22 nt, Human
uccaagcagaccugagcggccc

SEQ ID NO: 241196 - RNA, 18 nt, Human
ugagaagucgagguugcg

SEQ ID NO: 241197 - RNA, 21 nt, Human
ugagacagacaguguuggccc

SEQ ID NO: 241198 - RNA, 23 nt, Human
aaaaucgaagucucccaagcucu

SEQ ID NO: 241199 - RNA, 18 nt, Human
aaaugucucaaggacaca

SEQ ID NO: 241200 - RNA, 18 nt, Human
aaaugucucaaggacaca

SEQ ID NO: 241201 - RNA, 21 nt, Human
aacacaaaugucucaaggaca

SEQ ID NO: 241202 - RNA, 21 nt, Human
aacacaaaugucucaaggaca

SEQ ID NO: 241203 - RNA, 18 nt, Human
aagcaucagggcaccaag

SEQ ID NO: 241204 - RNA, 18 nt, Human
aagcaucagggcaccaag

SEQ ID NO: 241205 - RNA, 18 nt, Human
aagcaucagggcaccaag

SEQ ID NO: 241206 - RNA, 20 nt, Human
aaggaagcagggaggcugcc

SEQ ID NO: 241207 - RNA, 20 nt, Human
aaggaagcagggaggcugcc

SEQ ID NO: 241208 - RNA, 23 nt, Human
aaggagucagcauucccaggagg

SEQ ID NO: 241209 - RNA, 23 nt, Human
aaggagucagcauucccaggagg

SEQ ID NO: 241210 - RNA, 23 nt, Human
aaggagucagcauucccaggagg

SEQ ID NO: 241211 - RNA, 19 nt, Human
acaaggaaccacaacacaa

SEQ ID NO: 241212 - RNA, 19 nt, Human
acaaggaaccacaacacaa

SEQ ID NO: 241213 - RNA, 24 nt, Human
acacauaaccgguaaccaaccaag

SEQ ID NO: 241214 - RNA, 24 nt, Human
acacauaaccgguaaccaaccaag

SEQ ID NO: 241215 - RNA, 18 nt, Human
acacggcucuucucuucc

SEQ ID NO: 241216 - RNA, 20 nt, Human
acacugcgggcccugggcag

SEQ ID NO: 241217 - RNA, 20 nt, Human
acacugcgggcccugggcag

SEQ ID NO: 241218 - RNA, 18 nt, Human
acagcagcaucgugcacu

SEQ ID NO: 241219 - RNA, 21 nt, Human
acagcagcaucgugcacuugg

SEQ ID NO: 241220 - RNA, 21 nt, Human
acagcagcaucgugcacuugg

SEQ ID NO: 241221 - RNA, 25 nt, Human
acagcagcaucgugcacuugggaac

SEQ ID NO: 241222 - RNA, 25 nt, Human
acagcagcaucgugcacuugggaac

SEQ ID NO: 241223 - RNA, 21 nt, Human
acccaggcugucucucccucc

SEQ ID NO: 241224 - RNA, 21 nt, Human
acccaggcugucucucccucc

SEQ ID NO: 241225 - RNA, 21 nt, Human
accccgugccuggagagacag

SEQ ID NO: 241226 - RNA, 21 nt, Human
accccgugccuggagagacag

SEQ ID NO: 241227 - RNA, 24 nt, Human
accccgugccuggagagacagccu

SEQ ID NO: 241228 - RNA, 24 nt, Human
accccgugccuggagagacagccu

SEQ ID NO: 241229 - RNA, 22 nt, Human
accggccccacagacuguacac

SEQ ID NO: 241230 - RNA, 22 nt, Human
accggccccacagacuguacac

SEQ ID NO: 241231 - RNA, 20 nt, Human
acucacuccggcugcccccc

SEQ ID NO: 241232 - RNA, 20 nt, Human
acucacuccggcugcccccc

SEQ ID NO: 241233 - RNA, 21 nt, Human
acuccggcugccccccaauuc

SEQ ID NO: 241234 - RNA, 21 nt, Human
acuccggcugccccccaauuc

SEQ ID NO: 241235 - RNA, 23 nt, Human
agacagaugugcaaacccagcuu

SEQ ID NO: 241236 - RNA, 23 nt, Human
agacagaugugcaaacccagcuu

SEQ ID NO: 241237 - RNA, 18 nt, Human
agagggagaagguggaca

SEQ ID NO: 241238 - RNA, 18 nt, Human
agagggagaagguggaca

SEQ ID NO: 241239 - RNA, 18 nt, Human
agaggggggcgcgcggcc

SEQ ID NO: 241240 - RNA, 22 nt, Human
agagggugagccccaggguucc

SEQ ID NO: 241241 - RNA, 22 nt, Human
agagggugagccccaggguucc

SEQ ID NO: 241242 - RNA, 21 nt, Human
agcagcaucgugcacuuggga

SEQ ID NO: 241243 - RNA, 21 nt, Human
agcagcaucgugcacuuggga

SEQ ID NO: 241244 - RNA, 23 nt, Human
agcaucauccacuccucagucac

SEQ ID NO: 241245 - RNA, 23 nt, Human
agcaucauccacuccucagucac

SEQ ID NO: 241246 - RNA, 20 nt, Human
agcccgacgucccccggcag

SEQ ID NO: 241247 - RNA, 18 nt, Human
agcccugaggggaaggca

SEQ ID NO: 241248 - RNA, 18 nt, Human
agcccugaggggaaggca

SEQ ID NO: 241249 - RNA, 19 nt, Human
agccuaccaauccugggca

SEQ ID NO: 241250 - RNA, 19 nt, Human
aggacauuuauuucacauu

SEQ ID NO: 241251 - RNA, 19 nt, Human
aggacauuuauuucacauu

SEQ ID NO: 241252 - RNA, 22 nt, Human
aggccggggcgggguucugaga

SEQ ID NO: 241253 - RNA, 22 nt, Human
aucauccacuccucagucacag

SEQ ID NO: 241254 - RNA, 22 nt, Human
aucauccacuccucagucacag

SEQ ID NO: 241255 - RNA, 18 nt, Human
augccaaaggaaaaacca

SEQ ID NO: 241256 - RNA, 23 nt, Human
caacacaaaugucucaaggacac

SEQ ID NO: 241257 - RNA, 23 nt, Human
caacacaaaugucucaaggacac

SEQ ID NO: 241258 - RNA, 19 nt, Human
caaggaaccacaacacaaa

SEQ ID NO: 241259 - RNA, 19 nt, Human
caaggaaccacaacacaaa

SEQ ID NO: 241260 - RNA, 20 nt, Human
caaggacacaaaauaguggg

SEQ ID NO: 241261 - RNA, 20 nt, Human
caaggacacaaaauaguggg

SEQ ID NO: 241262 - RNA, 22 nt, Human
caccccgugccuggagagacag

SEQ ID NO: 241263 - RNA, 25 nt, Human
caccccgugccuggagagacagccu

SEQ ID NO: 241264 - RNA, 23 nt, Human
caccggccccacagacuguacac

SEQ ID NO: 241265 - RNA, 23 nt, Human
caccggccccacagacuguacac

SEQ ID NO: 241266 - RNA, 26 nt, Human
cacuagccucgaccacuccauccucu

SEQ ID NO: 241267 - RNA, 26 nt, Human
cacuagccucgaccacuccauccucu

SEQ ID NO: 241268 - RNA, 19 nt, Human
cacuccauccucugaugcc

SEQ ID NO: 241269 - RNA, 19 nt, Human
cacuccauccucugaugcc

SEQ ID NO: 241270 - RNA, 24 nt, Human
cacuccauccucugaugccgaagg

SEQ ID NO: 241271 - RNA, 18 nt, Human
cacuccggcugcccccca

SEQ ID NO: 241272 - RNA, 18 nt, Human
cacuccggcugcccccca

SEQ ID NO: 241273 - RNA, 18 nt, Human
cacugcgggcccugggca

SEQ ID NO: 241274 - RNA, 19 nt, Human
cacugcgggcccugggcag

SEQ ID NO: 241275 - RNA, 19 nt, Human
cacugcgggcccugggcag

SEQ ID NO: 241276 - RNA, 20 nt, Human
cacugcgggcccugggcagu

SEQ ID NO: 241277 - RNA, 20 nt, Human
cacugcgggcccugggcagu

SEQ ID NO: 241278 - RNA, 23 nt, Human
cagcagcaucgugcacuugggaa

SEQ ID NO: 241279 - RNA, 21 nt, Human
cagcagccaacacugcgggcc

SEQ ID NO: 241280 - RNA, 24 nt, Human
cagcagccaacacugcgggcccug

SEQ ID NO: 241281 - RNA, 24 nt, Human
cagcagccaacacugcgggcccug

SEQ ID NO: 241282 - RNA, 19 nt, Human
cagcagggggcuugcagag

SEQ ID NO: 241283 - RNA, 19 nt, Human
cagcagggggcuugcagag

SEQ ID NO: 241284 - RNA, 21 nt, Human
cagcccgacgucccccggcag

SEQ ID NO: 241285 - RNA, 23 nt, Human
cagcuuggucuuuccugcccccu

SEQ ID NO: 241286 - RNA, 23 nt, Human
cagcuuggucuuuccugcccccu

SEQ ID NO: 241287 - RNA, 20 nt, Human
caggcugucucucccuccuc

SEQ ID NO: 241288 - RNA, 20 nt, Human
caggcugucucucccuccuc

SEQ ID NO: 241289 - RNA, 19 nt, Human
caggguucccucacuccuc

SEQ ID NO: 241290 - RNA, 19 nt, Human
caggguucccucacuccuc

SEQ ID NO: 241291 - RNA, 24 nt, Human
caguagcugccggcuugggaaugc

SEQ ID NO: 241292 - RNA, 24 nt, Human
caguagcugccggcuugggaaugc

SEQ ID NO: 241293 - RNA, 19 nt, Human
caucaguuuaucucagaga

SEQ ID NO: 241294 - RNA, 19 nt, Human
caucaguuuaucucagaga

SEQ ID NO: 241295 - RNA, 19 nt, Human
caucaguuuaucucagaga

SEQ ID NO: 241296 - RNA, 20 nt, Human
ccacacggcucuucucuucc

SEQ ID NO: 241297 - RNA, 23 nt, Human
ccacuagccucgaccacuccauc

SEQ ID NO: 241298 - RNA, 23 nt, Human
ccacuagccucgaccacuccauc

SEQ ID NO: 241299 - RNA, 21 nt, Human
cccagcccgacgucccccggc

SEQ ID NO: 241300 - RNA, 20 nt, Human
cccaggcugucucucccucc

SEQ ID NO: 241301 - RNA, 20 nt, Human
cccaggcugucucucccucc

SEQ ID NO: 241302 - RNA, 22 nt, Human
ccccaggguucccucacuccuc

SEQ ID NO: 241303 - RNA, 22 nt, Human
ccccaggguucccucacuccuc

SEQ ID NO: 241304 - RNA, 23 nt, Human
ccccgccgcaggacauccucccc

SEQ ID NO: 241305 - RNA, 23 nt, Human
cccgcggccacacggcucuucuc

SEQ ID NO: 241306 - RNA, 18 nt, Human
cccugggacuccacuagc

SEQ ID NO: 241307 - RNA, 18 nt, Human
cccugggacuccacuagc

SEQ ID NO: 241308 - RNA, 22 nt, Human
cccugggcuggggcagcugcgu

SEQ ID NO: 241309 - RNA, 22 nt, Human
cccugggcuggggcagcugcgu

SEQ ID NO: 241310 - RNA, 18 nt, Human
cccuuccucucugugccc

SEQ ID NO: 241311 - RNA, 18 nt, Human
cccuuccucucugugccc

SEQ ID NO: 241312 - RNA, 18 nt, Human
ccgcaggacauccucccc

SEQ ID NO: 241313 - RNA, 20 nt, Human
ccgcggcgcccgcugggaga

SEQ ID NO: 241314 - RNA, 19 nt, Human
ccucucugugcccuuccuc

SEQ ID NO: 241315 - RNA, 23 nt, Human
ccugcagacagaugugcaaaccc

SEQ ID NO: 241316 - RNA, 23 nt, Human
ccugcagacagaugugcaaaccc

SEQ ID NO: 241317 - RNA, 24 nt, Human
ccugggcuggggcagcugcguagc

SEQ ID NO: 241318 - RNA, 24 nt, Human
ccugggcuggggcagcugcguagc

SEQ ID NO: 241319 - RNA, 19 nt, Human
ccugucccaaagggccugg

SEQ ID NO: 241320 - RNA, 20 nt, Human
ccugucccaaagggccuggg

SEQ ID NO: 241321 - RNA, 18 nt, Human
cgagcaucauccacuccu

SEQ ID NO: 241322 - RNA, 18 nt, Human
cgagcaucauccacuccu

SEQ ID NO: 241323 - RNA, 20 nt, Human
cgagcaucauccacuccuca

SEQ ID NO: 241324 - RNA, 22 nt, Human
cgcggggagugggggggcgugg

SEQ ID NO: 241325 - RNA, 18 nt, Human
cgcucaagacacacucag

SEQ ID NO: 241326 - RNA, 18 nt, Human
cgcucaagacacacucag

SEQ ID NO: 241327 - RNA, 20 nt, Human
cggcucuucucuuccugucc

SEQ ID NO: 241328 - RNA, 22 nt, Human
cggcucuucucuuccuguccca

SEQ ID NO: 241329 - RNA, 18 nt, Human
cgugggccauuggugucu

SEQ ID NO: 241330 - RNA, 19 nt, Human
cuagagacaggccggggcg

SEQ ID NO: 241331 - RNA, 20 nt, Human
cuagccucgaccacuccauc

SEQ ID NO: 241332 - RNA, 22 nt, Human
cuccauccucugaugccgaagg

SEQ ID NO: 241333 - RNA, 22 nt, Human
cuccauccucugaugccgaagg

SEQ ID NO: 241334 - RNA, 20 nt, Human
cuccgagcgggcgccaguuc

SEQ ID NO: 241335 - RNA, 19 nt, Human
cucugugcccuuccucuga

SEQ ID NO: 241336 - RNA, 19 nt, Human
cucugugcccuuccucuga

SEQ ID NO: 241337 - RNA, 18 nt, Human
cugcccccucccugaugc

SEQ ID NO: 241338 - RNA, 18 nt, Human
cugcccccucccugaugc

SEQ ID NO: 241339 - RNA, 20 nt, Human
cugcccccucccugaugcuc

SEQ ID NO: 241340 - RNA, 20 nt, Human
cugcccccucccugaugcuc

SEQ ID NO: 241341 - RNA, 20 nt, Human
cugggcaguagcugccggcu

SEQ ID NO: 241342 - RNA, 20 nt, Human
cugggcuggggcagcugcgu

SEQ ID NO: 241343 - RNA, 21 nt, Human
cuucccuuccucucugugccc

SEQ ID NO: 241344 - RNA, 21 nt, Human
cuucccuuccucucugugccc

SEQ ID NO: 241345 - RNA, 25 nt, Human
cuuccugucccaaagggccugggga

SEQ ID NO: 241346 - RNA, 21 nt, Human
cuugcagaggacacacgagca

SEQ ID NO: 241347 - RNA, 21 nt, Human
cuugcagaggacacacgagca

SEQ ID NO: 241348 - RNA, 18 nt, Human
cuugcccauacccaggcu

SEQ ID NO: 241349 - RNA, 19 nt, Human
gaagucucccaagcucugg

SEQ ID NO: 241350 - RNA, 24 nt, Human
gagcgguggagccuaccaauccug

SEQ ID NO: 241351 - RNA, 18 nt, Human
gcagauuucgugggccau

SEQ ID NO: 241352 - RNA, 20 nt, Human
gcagcgggggcagagggggg

SEQ ID NO: 241353 - RNA, 20 nt, Human
gcaugcuacacaugcacgug

SEQ ID NO: 241354 - RNA, 21 nt, Human
gccacacggcucuucucuucc

SEQ ID NO: 241355 - RNA, 21 nt, Human
gccacacggcucuucucuucc

SEQ ID NO: 241356 - RNA, 18 nt, Human
gccccaggguucccucac

SEQ ID NO: 241357 - RNA, 18 nt, Human
gccccaggguucccucac

SEQ ID NO: 241358 - RNA, 22 nt, Human
gccccaggguucccucacuccu

SEQ ID NO: 241359 - RNA, 22 nt, Human
gccccaggguucccucacuccu

SEQ ID NO: 241360 - RNA, 19 nt, Human
gcccugggcuggggcagcu

SEQ ID NO: 241361 - RNA, 19 nt, Human
gcccugggcuggggcagcu

SEQ ID NO: 241362 - RNA, 21 nt, Human
gcccugggcuggggcagcugc

SEQ ID NO: 241363 - RNA, 21 nt, Human
gcccugggcuggggcagcugc

SEQ ID NO: 241364 - RNA, 23 nt, Human
gcuuggucuuuccugcccccucc

SEQ ID NO: 241365 - RNA, 23 nt, Human
gcuuggucuuuccugcccccucc

SEQ ID NO: 241366 - RNA, 18 nt, Human
ggaaggcaguuuggucuu

SEQ ID NO: 241367 - RNA, 18 nt, Human
ggaaggcaguuuggucuu

SEQ ID NO: 241368 - RNA, 23 nt, Human
ggacaguuauaacgccagggaca

SEQ ID NO: 241369 - RNA, 23 nt, Human
ggacaguuauaacgccagggaca

SEQ ID NO: 241370 - RNA, 21 nt, Human
ggagauggaguccagucaguc

SEQ ID NO: 241371 - RNA, 19 nt, Human
ggcagaggggggcgcgcgg

SEQ ID NO: 241372 - RNA, 22 nt, Human
ggcagcgggggcagaggggggc

SEQ ID NO: 241373 - RNA, 21 nt, Human
gggaacagcaaggggccaggg

SEQ ID NO: 241374 - RNA, 21 nt, Human
gggaacagcaaggggccaggg

SEQ ID NO: 241375 - RNA, 23 nt, Human
gggaacagcaaggggccaggggc

SEQ ID NO: 241376 - RNA, 23 nt, Human
gggaacagcaaggggccaggggc

SEQ ID NO: 241377 - RNA, 24 nt, Human
gggaaugcagaaggaagccgguac

SEQ ID NO: 241378 - RNA, 25 nt, Human
gggaaugcagaaggaagccgguacc

SEQ ID NO: 241379 - RNA, 25 nt, Human
gggaaugcagaaggaagccgguacc

SEQ ID NO: 241380 - RNA, 20 nt, Human
gggaguggagagggagaagg

SEQ ID NO: 241381 - RNA, 21 nt, Human
gggcagaggggggcgcgcggc

SEQ ID NO: 241382 - RNA, 21 nt, Human
gggcagcgggggcagaggggg

SEQ ID NO: 241383 - RNA, 23 nt, Human
gggcagcgggggcagaggggggc

SEQ ID NO: 241384 - RNA, 23 nt, Human
gggccuggggaccgacacugggu

SEQ ID NO: 241385 - RNA, 21 nt, Human
gggcgggguucugagaucuuc

SEQ ID NO: 241386 - RNA, 20 nt, Human
gggcguggccgcgccgcggc

SEQ ID NO: 241387 - RNA, 20 nt, Human
ggggagugggggggcguggc

SEQ ID NO: 241388 - RNA, 22 nt, Human
ggggcgggguucugagaucuuc

SEQ ID NO: 241389 - RNA, 19 nt, Human
ggucuuuccugcccccucc

SEQ ID NO: 241390 - RNA, 23 nt, Human
guagccccucuccaucagcuaga

SEQ ID NO: 241391 - RNA, 23 nt, Human
guggagagggagaagguggacac

SEQ ID NO: 241392 - RNA, 23 nt, Human
guggagagggagaagguggacac

SEQ ID NO: 241393 - RNA, 19 nt, Human
uaauguggggcugaaauau

SEQ ID NO: 241394 - RNA, 19 nt, Human
uaauguggggcugaaauau

SEQ ID NO: 241395 - RNA, 20 nt, Human
uaauguggggcugaaauauu

SEQ ID NO: 241396 - RNA, 18 nt, Human
ucacagaggcuguggcag

SEQ ID NO: 241397 - RNA, 18 nt, Human
ucacagaggcuguggcag

SEQ ID NO: 241398 - RNA, 24 nt, Human
ucaguccgcgaggacagccccgcc

SEQ ID NO: 241399 - RNA, 21 nt, Human
ucauccacuccucagucacag

SEQ ID NO: 241400 - RNA, 24 nt, Human
uccacuccucagucacagcagcau

SEQ ID NO: 241401 - RNA, 24 nt, Human
uccacuccucagucacagcagcau

SEQ ID NO: 241402 - RNA, 21 nt, Human
uccacugcagucacagaggcu

SEQ ID NO: 241403 - RNA, 21 nt, Human
uccacugcagucacagaggcu

SEQ ID NO: 241404 - RNA, 19 nt, Human
uccccgcggccacacggcu

SEQ ID NO: 241405 - RNA, 22 nt, Human
ucccucacuccucacagaguga

SEQ ID NO: 241406 - RNA, 23 nt, Human
ucccucacuccucacagagugaa

SEQ ID NO: 241407 - RNA, 23 nt, Human
ucccucacuccucacagagugaa

SEQ ID NO: 241408 - RNA, 19 nt, Human
ucccugaugcucaggcaga

SEQ ID NO: 241409 - RNA, 19 nt, Human
ucccugaugcucaggcaga

SEQ ID NO: 241410 - RNA, 20 nt, Human
uccucucugugcccuuccuc

SEQ ID NO: 241411 - RNA, 20 nt, Human
uccucucugugcccuuccuc

SEQ ID NO: 241412 - RNA, 19 nt, Human
uccugggcagcgggggcag

SEQ ID NO: 241413 - RNA, 19 nt, Human
ucuugcccauacccaggcu

SEQ ID NO: 241414 - RNA, 19 nt, Human
ucuugcccauacccaggcu

SEQ ID NO: 241415 - RNA, 21 nt, Human
ugaaaaucgaagucucccaag

SEQ ID NO: 241416 - RNA, 20 nt, Human
ugcaaacccagcuuggucuu

SEQ ID NO: 241417 - RNA, 20 nt, Human
ugcaaacccagcuuggucuu

SEQ ID NO: 241418 - RNA, 22 nt, Human
ugcaguggacaguuauaacgcc

SEQ ID NO: 241419 - RNA, 22 nt, Human
ugcaguggacaguuauaacgcc

SEQ ID NO: 241420 - RNA, 20 nt, Human
ugccaaaggaaaaaccaagg

SEQ ID NO: 241421 - RNA, 19 nt, Human
ugcccugggcuggggcagc

SEQ ID NO: 241422 - RNA, 19 nt, Human
ugcccugggcuggggcagc

SEQ ID NO: 241423 - RNA, 19 nt, Human
ugcccugggcuggggcagc

SEQ ID NO: 241424 - RNA, 19 nt, Human
ugcccugggcuggggcagc

SEQ ID NO: 241425 - RNA, 20 nt, Human
ugcccugggcuggggcagcu

SEQ ID NO: 241426 - RNA, 18 nt, Human
ugccuggagagacagccu

SEQ ID NO: 241427 - RNA, 18 nt, Human
ugccuggagagacagccu

SEQ ID NO: 241428 - RNA, 18 nt, Human
ugccuggagagacagccu

SEQ ID NO: 241429 - RNA, 18 nt, Human
ugccuggagagacagccu

SEQ ID NO: 241430 - RNA, 21 nt, Human
uggagccuaccaauccugggc

SEQ ID NO: 241431 - RNA, 24 nt, Human
uggcaggccacagggaauucgccg

SEQ ID NO: 241432 - RNA, 24 nt, Human
uggcaggccacagggaauucgccg

SEQ ID NO: 241433 - RNA, 21 nt, Human
ugggaacagcaaggggccagg

SEQ ID NO: 241434 - RNA, 21 nt, Human
ugggaacagcaaggggccagg

SEQ ID NO: 241435 - RNA, 25 nt, Human
ugggagauggaguccagucaguccg

SEQ ID NO: 241436 - RNA, 23 nt, Human
ugggaguggagagggagaaggug

SEQ ID NO: 241437 - RNA, 21 nt, Human
uucacauucacacaacuguac

SEQ ID NO: 241438 - RNA, 21 nt, Human
uucacauucacacaacuguac

SEQ ID NO: 241439 - RNA, 19 nt, Human
uucccuuccucucugugcc

SEQ ID NO: 241440 - RNA, 19 nt, Human
uucccuuccucucugugcc

SEQ ID NO: 241441 - RNA, 22 nt, Human
uuccucugagagggugagcccc

SEQ ID NO: 241442 - RNA, 22 nt, Human
uuccucugagagggugagcccc

SEQ ID NO: 241443 - RNA, 19 nt, Human
uugggaaugcagaaggaag

SEQ ID NO: 241444 - RNA, 19 nt, Human
uugggaaugcagaaggaag

SEQ ID NO: 241445 - RNA, 18 nt, Human
agcugcccagccuccacu

SEQ ID NO: 241446 - RNA, 19 nt, Human
agggagucggagcugccca

SEQ ID NO: 241447 - RNA, 24 nt, Human
agucagcaccggguuggcggcgcg

SEQ ID NO: 241448 - RNA, 19 nt, Human
agucggagcugcccagccu

SEQ ID NO: 241449 - RNA, 24 nt, Human
auaaagcugucuccaaaugcaaaa

SEQ ID NO: 241450 - RNA, 24 nt, Human
augcaaggcucaauaguuuuccag

SEQ ID NO: 241451 - RNA, 22 nt, Human
caaggcucaauaguuuuccaga

SEQ ID NO: 241452 - RNA, 19 nt, Human
cacucuccgcuccccgagc

SEQ ID NO: 241453 - RNA, 24 nt, Human
cagucagcaccggguuggcggcgc

SEQ ID NO: 241454 - RNA, 21 nt, Human
cauccauccuucaaguacaug

SEQ ID NO: 241455 - RNA, 21 nt, Human
ccagaggcagaugcuggggcc

SEQ ID NO: 241456 - RNA, 25 nt, Human
ccucuccuuucuccgcccgcccgcc

SEQ ID NO: 241457 - RNA, 23 nt, Human
cgcccgcccgccugcuuucuccu

SEQ ID NO: 241458 - RNA, 24 nt, Human
cggcccggguccggacggccgggc

SEQ ID NO: 241459 - RNA, 25 nt, Human
cuggagccuggauugaucuggucgc

SEQ ID NO: 241460 - RNA, 20 nt, Human
gccucggcccggguugagcc

SEQ ID NO: 241461 - RNA, 19 nt, Human
gccugcuuucuccuggagc

SEQ ID NO: 241462 - RNA, 21 nt, Human
gcggcgcgcccguccgugcgg

SEQ ID NO: 241463 - RNA, 21 nt, Human
ggagcugcccagccuccacuc

SEQ ID NO: 241464 - RNA, 20 nt, Human
ggcggcgcgcccguccgugc

SEQ ID NO: 241465 - RNA, 19 nt, Human
gguccggacggccgggcgg

SEQ ID NO: 241466 - RNA, 22 nt, Human
ggugaaauaaagcugucuccaa

SEQ ID NO: 241467 - RNA, 23 nt, Human
uaaaaaaguaacccagucagcac

SEQ ID NO: 241468 - RNA, 18 nt, Human
ucagcaccggguuggcgg

SEQ ID NO: 241469 - RNA, 22 nt, Human
uccagaagaguagaaauuacca

SEQ ID NO: 241470 - RNA, 21 nt, Human
uccccgagccucggcccgggu

SEQ ID NO: 241471 - RNA, 19 nt, Human
uccucagcugccaauaccc

SEQ ID NO: 241472 - RNA, 20 nt, Human
uccucagcugccaauacccc

SEQ ID NO: 241473 - RNA, 22 nt, Human
ugcaaggcucaauaguuuucca

SEQ ID NO: 241474 - RNA, 22 nt, Human
ugucugacucauccauccuuca

SEQ ID NO: 241475 - RNA, 20 nt, Human
uuuuuuuuuuuuuuuuguuu

SEQ ID NO: 241476 - RNA, 20 nt, Human
aaaaucuucucuuccucuuu

SEQ ID NO: 241477 - RNA, 20 nt, Human
aaagacacacaaaaauaaca

SEQ ID NO: 241478 - RNA, 24 nt, Human
aaccuuugggacacucaguuuuau

SEQ ID NO: 241479 - RNA, 18 nt, Human
aauaacagagaaguggga

SEQ ID NO: 241480 - RNA, 18 nt, Human
agcacaauacugugauac

SEQ ID NO: 241481 - RNA, 23 nt, Human
agccacgcuaggaaaacagccuc

SEQ ID NO: 241482 - RNA, 26 nt, Human
aggcagcaagccacgcuaggaaaaca

SEQ ID NO: 241483 - RNA, 21 nt, Human
augauacauuaccuguacaca

SEQ ID NO: 241484 - RNA, 22 nt, Human
auuaaaaaagacacacaaaaau

SEQ ID NO: 241485 - RNA, 22 nt, Human
caagguggcgccaggucccgcc

SEQ ID NO: 241486 - RNA, 18 nt, Human
cacacaaugcuaugacag

SEQ ID NO: 241487 - RNA, 18 nt, Human
cagcgcacacacacaccu

SEQ ID NO: 241488 - RNA, 28 nt, Human
cagcgcacacacacaccucaucuaugca

SEQ ID NO: 241489 - RNA, 21 nt, Human
ccccgcccccaggcccgggcc

SEQ ID NO: 241490 - RNA, 18 nt, Human
cccgcccccaggcccggg

SEQ ID NO: 241491 - RNA, 18 nt, Human
cccgccccgcccccaggc

SEQ ID NO: 241492 - RNA, 23 nt, Human
cccgccccgucagauccgggggg

SEQ ID NO: 241493 - RNA, 18 nt, Human
ccgccccgcccccaggcc

SEQ ID NO: 241494 - RNA, 23 nt, Human
ccgccccgcccccaggcccgggc

SEQ ID NO: 241495 - RNA, 22 nt, Human
ccgggggguccgggaccuuuug

SEQ ID NO: 241496 - RNA, 18 nt, Human
ccuagaucaagaagcagc

SEQ ID NO: 241497 - RNA, 19 nt, Human
ccucaucuaugcaaacuaa

SEQ ID NO: 241498 - RNA, 20 nt, Human
ccuguacacauaacuacuac

SEQ ID NO: 241499 - RNA, 18 nt, Human
ccuuugggacacucaguu

SEQ ID NO: 241500 - RNA, 20 nt, Human
gaccuuuuguuccuuccucu

SEQ ID NO: 241501 - RNA, 20 nt, Human
gaucaugauacauuaccugg

SEQ ID NO: 241502 - RNA, 18 nt, Human
gcagcgcacacacacacc

SEQ ID NO: 241503 - RNA, 26 nt, Human
gcgcacacacacaccucaucuaugca

SEQ ID NO: 241504 - RNA, 20 nt, Human
gcugggaggggaagagggga

SEQ ID NO: 241505 - RNA, 24 nt, Human
ggaacugaaaacacucccggccgc

SEQ ID NO: 241506 - RNA, 21 nt, Human
ggaggggaagaggggaauggg

SEQ ID NO: 241507 - RNA, 18 nt, Human
gggaaugggcgauuggag

SEQ ID NO: 241508 - RNA, 23 nt, Human
gggauggagggggcugggagggg

SEQ ID NO: 241509 - RNA, 20 nt, Human
gggcccggccggcggcccgg

SEQ ID NO: 241510 - RNA, 30 nt, Human
ggggaagaggggaaugggcgauuggaggcc

SEQ ID NO: 241511 - RNA, 22 nt, Human
ggggcugggaggggaagagggg

SEQ ID NO: 241512 - RNA, 23 nt, Human
gggggcugggaggggaagagggg

SEQ ID NO: 241513 - RNA, 23 nt, Human
gggggguccgggaccuuuuguuc

SEQ ID NO: 241514 - RNA, 25 nt, Human
ggugcuuuaauugaugagaccucaa

SEQ ID NO: 241515 - RNA, 25 nt, Human
uaaaaaagacacacaaaaauaacag

SEQ ID NO: 241516 - RNA, 19 nt, Human
uaaaaucuucucuuccucu

SEQ ID NO: 241517 - RNA, 20 nt, Human
uaaaaucuucucuuccucuu

SEQ ID NO: 241518 - RNA, 23 nt, Human
uaaaccuuugggacacucaguuu

SEQ ID NO: 241519 - RNA, 21 nt, Human
uaauaaaccuuugggacacuc

SEQ ID NO: 241520 - RNA, 23 nt, Human
uaauauucaaauauaggaaacag

SEQ ID NO: 241521 - RNA, 22 nt, Human
uaaugggagaguauuucuagac

SEQ ID NO: 241522 - RNA, 19 nt, Human
ucccgccccgcccccaggc

SEQ ID NO: 241523 - RNA, 20 nt, Human
ucccgccccgcccccaggcc

SEQ ID NO: 241524 - RNA, 21 nt, Human
ucccgccccgcccccaggccc

SEQ ID NO: 241525 - RNA, 24 nt, Human
ucccggccgccgucuucccgcccc

SEQ ID NO: 241526 - RNA, 18 nt, Human
uccgggaccuuuuguucc

SEQ ID NO: 241527 - RNA, 23 nt, Human
ucucuugaacuuuuggauaguaa

SEQ ID NO: 241528 - RNA, 22 nt, Human
ugaaaacacucccggccgccgu

SEQ ID NO: 241529 - RNA, 25 nt, Human
ugaacuuuuggauaguaaacagucc

SEQ ID NO: 241530 - RNA, 20 nt, Human
ugccuagaucaagaagcagc

SEQ ID NO: 241531 - RNA, 21 nt, Human
uggaggcggaacugaaaacac

SEQ ID NO: 241532 - RNA, 21 nt, Human
ugggaggggaagaggggaaug

SEQ ID NO: 241533 - RNA, 23 nt, Human
ugggaggggaagaggggaauggg

SEQ ID NO: 241534 - RNA, 23 nt, Human
ugggauggagggggcugggaggg

SEQ ID NO: 241535 - RNA, 23 nt, Human
uucaaauauaggaaacagauucc

SEQ ID NO: 241536 - RNA, 21 nt, Human
uucccgccccgcccccaggcc

SEQ ID NO: 241537 - RNA, 19 nt, Human
uuggaggcggaacugaaaa

SEQ ID NO: 241538 - RNA, 27 nt, Human
uuuuuuuuuuuuuucuuccccccccac

SEQ ID NO: 241539 - RNA, 24 nt, Human
aaaacucccucccuccccauccca

SEQ ID NO: 241540 - RNA, 19 nt, Human
aaaaggacaacguaaguga

SEQ ID NO: 241541 - RNA, 20 nt, Human
aacucccucccuccccaucc

SEQ ID NO: 241542 - RNA, 24 nt, Human
aagggccuccugcuucaugagaac

SEQ ID NO: 241543 - RNA, 22 nt, Human
acauaaaccaauauagccguau

SEQ ID NO: 241544 - RNA, 19 nt, Human
acugacuacauaaaccaau

SEQ ID NO: 241545 - RNA, 19 nt, Human
agacaaaacucccucccuc

SEQ ID NO: 241546 - RNA, 20 nt, Human
agaccaaaugccaucccacg

SEQ ID NO: 241547 - RNA, 18 nt, Human
agagucuggggggagggu

SEQ ID NO: 241548 - RNA, 18 nt, Human
agagucuggggggagggu

SEQ ID NO: 241549 - RNA, 21 nt, Human
agcagacgccauuucuugccc

SEQ ID NO: 241550 - RNA, 24 nt, Human
agucuggggggagggugccggugg

SEQ ID NO: 241551 - RNA, 20 nt, Human
cagagcagacgccauuucuu

SEQ ID NO: 241552 - RNA, 19 nt, Human
caugaggucugcaucgugc

SEQ ID NO: 241553 - RNA, 21 nt, Human
ccaaggugaacuccacacugc

SEQ ID NO: 241554 - RNA, 19 nt, Human
ccacacugcaguccuagac

SEQ ID NO: 241555 - RNA, 20 nt, Human
ccccggcggggcugggcucg

SEQ ID NO: 241556 - RNA, 18 nt, Human
cccucccuccccauccca

SEQ ID NO: 241557 - RNA, 24 nt, Human
cuacauaaaccaauauagccguau

SEQ ID NO: 241558 - RNA, 18 nt, Human
cucccuccccaucccaag

SEQ ID NO: 241559 - RNA, 22 nt, Human
cucccucccuccccaucccaag

SEQ ID NO: 241560 - RNA, 20 nt, Human
cugaacacgcaccucccaau

SEQ ID NO: 241561 - RNA, 21 nt, Human
cuggagacgcacccagugugg

SEQ ID NO: 241562 - RNA, 18 nt, Human
gaacacgcaccucccaau

SEQ ID NO: 241563 - RNA, 26 nt, Human
gagcagacgccauuucuugcccuuca

SEQ ID NO: 241564 - RNA, 21 nt, Human
gagcgcccccggcggggcugg

SEQ ID NO: 241565 - RNA, 23 nt, Human
gagcgcccccggcggggcugggc

SEQ ID NO: 241566 - RNA, 27 nt, Human
gagggugccgguggugucgcccgcggg

SEQ ID NO: 241567 - RNA, 21 nt, Human
gccugagaccaaaugccaucc

SEQ ID NO: 241568 - RNA, 20 nt, Human
gcgugcgggcggcgaggagc

SEQ ID NO: 241569 - RNA, 21 nt, Human
gcugggcugggaauguucacu

SEQ ID NO: 241570 - RNA, 19 nt, Human
gcuguccugugugcagguu

SEQ ID NO: 241571 - RNA, 21 nt, Human
gggcgugcgggcggcgaggag

SEQ ID NO: 241572 - RNA, 19 nt, Human
ggggcugggcucgacggga

SEQ ID NO: 241573 - RNA, 18 nt, Human
gggggagggugccggugg

SEQ ID NO: 241574 - RNA, 25 nt, Human
guauguucugagaggggagggagac

SEQ ID NO: 241575 - RNA, 21 nt, Human
gucagagagcugggcaugagg

SEQ ID NO: 241576 - RNA, 22 nt, Human
uacuaccuguucugcucacuua

SEQ ID NO: 241577 - RNA, 23 nt, Human
uccaacuuuucaaagugaaaaag

SEQ ID NO: 241578 - RNA, 25 nt, Human
uccacacugcaguccuagacagagg

SEQ ID NO: 241579 - RNA, 21 nt, Human
uccagcucacaacggggcggg

SEQ ID NO: 241580 - RNA, 20 nt, Human
ucccaagucuauccagcucc

SEQ ID NO: 241581 - RNA, 21 nt, Human
ugaaaaaggacaacguaagug

SEQ ID NO: 241582 - RNA, 22 nt, Human
ugaaugcaacugacuacauaaa

SEQ ID NO: 241583 - RNA, 19 nt, Human
ugacuggagacgcacccag

SEQ ID NO: 241584 - RNA, 23 nt, Human
ugaggucugcaucgugcgggcuc

SEQ ID NO: 241585 - RNA, 20 nt, Human
ugcagguucugcugaacacg

SEQ ID NO: 241586 - RNA, 21 nt, Human
uggggggagggugccgguggu

SEQ ID NO: 241587 - RNA, 19 nt, Human
uguucugagaggggaggga

SEQ ID NO: 241588 - RNA, 19 nt, Human
uguucugagaggggaggga

SEQ ID NO: 241589 - RNA, 18 nt, Human
uguucugcucacuuaagc

SEQ ID NO: 241590 - RNA, 23 nt, Human
uucaugagaacacuuaccgucau

SEQ ID NO: 241591 - RNA, 20 nt, Human
aaacagugaaaaacaacagc

SEQ ID NO: 241592 - RNA, 23 nt, Human
aagucacaucaaaucaaguacaa

SEQ ID NO: 241593 - RNA, 24 nt, Human
aauaaccaaaagauauaaaaaagu

SEQ ID NO: 241594 - RNA, 21 nt, Human
aaugauauacauaucgauguu

SEQ ID NO: 241595 - RNA, 21 nt, Human
accaaaaaaagucacaucaaa

SEQ ID NO: 241596 - RNA, 21 nt, Human
aggggagugggaaggcgcgaa

SEQ ID NO: 241597 - RNA, 24 nt, Human
caaagucacugccaauugauauga

SEQ ID NO: 241598 - RNA, 19 nt, Human
caagcucugagccaugccu

SEQ ID NO: 241599 - RNA, 22 nt, Human
cauagaauuuagcaguuuccaa

SEQ ID NO: 241600 - RNA, 21 nt, Human
cauauugugucugugguacag

SEQ ID NO: 241601 - RNA, 22 nt, Human
ccacccaaaccgcuccguuacc

SEQ ID NO: 241602 - RNA, 19 nt, Human
cgcagcggcgacgacgacc

SEQ ID NO: 241603 - RNA, 23 nt, Human
cugacaaguucugaagaggaaaa

SEQ ID NO: 241604 - RNA, 24 nt, Human
cugcagauaaaaggcucuaagacg

SEQ ID NO: 241605 - RNA, 19 nt, Human
cugcuaggagcaaggcagc

SEQ ID NO: 241606 - RNA, 21 nt, Human
cuggauuauucuguagaauga

SEQ ID NO: 241607 - RNA, 24 nt, Human
cuucuuagcaaccaaccuugugcc

SEQ ID NO: 241608 - RNA, 19 nt, Human
cuuggcaaaaauaaaacug

SEQ ID NO: 241609 - RNA, 18 nt, Human
gaacuguaauguuuccau

SEQ ID NO: 241610 - RNA, 23 nt, Human
gaaguauguucaacaauaacaac

SEQ ID NO: 241611 - RNA, 18 nt, Human
gcaggcuccgccacccaa

SEQ ID NO: 241612 - RNA, 23 nt, Human
gcuccgccacccaaaccgcuccg

SEQ ID NO: 241613 - RNA, 22 nt, Human
ggaaacagugaaaaacaacagc

SEQ ID NO: 241614 - RNA, 23 nt, Human
ggaauaacaaacguaauuuuaaa

SEQ ID NO: 241615 - RNA, 18 nt, Human
ggcuucuuagcaaccaac

SEQ ID NO: 241616 - RNA, 21 nt, Human
gggaaggcgcgaacgcaggcu

SEQ ID NO: 241617 - RNA, 18 nt, Human
uaaagcagaacaaaagug

SEQ ID NO: 241618 - RNA, 18 nt, Human
uaacaggugaagaauuaa

SEQ ID NO: 241619 - RNA, 18 nt, Human
uaacucacccacauggca

SEQ ID NO: 241620 - RNA, 27 nt, Human
uaacuugcaaaaaauauucugccggua

SEQ ID NO: 241621 - RNA, 25 nt, Human
uacaugauuuaaacauuauaccaaa

SEQ ID NO: 241622 - RNA, 23 nt, Human
uaccagcuagguaaaaagcauac

SEQ ID NO: 241623 - RNA, 18 nt, Human
uaggagcaaggcagcaaa

SEQ ID NO: 241624 - RNA, 22 nt, Human
uauacacacagauuaagaguuu

SEQ ID NO: 241625 - RNA, 25 nt, Human
uaugucuccaauuucugaagcaauu

SEQ ID NO: 241626 - RNA, 21 nt, Human
uauucaggauaaccugggcuc

SEQ ID NO: 241627 - RNA, 25 nt, Human
ucaacaauaacaacuuguacacaaa

SEQ ID NO: 241628 - RNA, 22 nt, Human
uccaaacuaccuauuaugaacu

SEQ ID NO: 241629 - RNA, 25 nt, Human
ucugaagaggaaaaaaaaaauuguu

SEQ ID NO: 241630 - RNA, 19 nt, Human
ucugucugcuaggagcaag

SEQ ID NO: 241631 - RNA, 19 nt, Human
uggaaacagugaaaaacaa

SEQ ID NO: 241632 - RNA, 23 nt, Human
uggcaaagggcuuagaauaacca

SEQ ID NO: 241633 - RNA, 19 nt, Human
uggcgaggggagugggaag

SEQ ID NO: 241634 - RNA, 22 nt, Human
uggcgaggggagugggaaggcg

SEQ ID NO: 241635 - RNA, 21 nt, Human
ugggcucgggcgguggcgagg

SEQ ID NO: 241636 - RNA, 18 nt, Human
uuaaaaucagcaauacug

SEQ ID NO: 241637 - RNA, 20 nt, Human
uuaauccaguuucugucugc

SEQ ID NO: 241638 - RNA, 27 nt, Human
uuaguguuuuaaaaaauacaaaaccuu

SEQ ID NO: 241639 - RNA, 24 nt, Human
uuaugaaaagauaaagcagaacaa

SEQ ID NO: 241640 - RNA, 18 nt, Human
uucccuaugaaugaagga

SEQ ID NO: 241641 - RNA, 18 nt, Human
uucucaauauacacacag

SEQ ID NO: 241642 - RNA, 21 nt, Human
uuggcaaaaauaaaacugaag

SEQ ID NO: 241643 - RNA, 19 nt, Human
uuugagaacuucucugccu

SEQ ID NO: 241644 - RNA, 26 nt, Human
aaacaaauguagauucaucacaaaau

SEQ ID NO: 241645 - RNA, 22 nt, Human
acuuacucuucacuguauaugc

SEQ ID NO: 241646 - RNA, 18 nt, Human
agguccuaagcagaaguu

SEQ ID NO: 241647 - RNA, 22 nt, Human
caaauuucugaacuggggcaua

SEQ ID NO: 241648 - RNA, 27 nt, Human
cacagguccuaagcagaagggacauac

SEQ ID NO: 241649 - RNA, 24 nt, Human
cacaguaucuguacucaaaguuuc

SEQ ID NO: 241650 - RNA, 21 nt, Human
cgaaagaacagaucacaggug

SEQ ID NO: 241651 - RNA, 21 nt, Human
cgaaagaacagaucacaggug

SEQ ID NO: 241652 - RNA, 18 nt, Human
gaaaaaaauaagcuguaa

SEQ ID NO: 241653 - RNA, 18 nt, Human
gaaagaacagaucacagg

SEQ ID NO: 241654 - RNA, 22 nt, Human
gaucacaggugaaacgucauac

SEQ ID NO: 241655 - RNA, 23 nt, Human
gcuaccgaaagaacagaucacag

SEQ ID NO: 241656 - RNA, 23 nt, Human
gugggacaaagaaacugguaaaa

SEQ ID NO: 241657 - RNA, 18 nt, Human
uaaaaagggaggaguaac

SEQ ID NO: 241658 - RNA, 22 nt, Human
uaaaauuaaaacaaguccacua

SEQ ID NO: 241659 - RNA, 20 nt, Human
uaaaguaaaagcauguuccc

SEQ ID NO: 241660 - RNA, 23 nt, Human
uaagaucaaugccaaauuucuga

SEQ ID NO: 241661 - RNA, 19 nt, Human
uaggagggaaaacuuacuc

SEQ ID NO: 241662 - RNA, 20 nt, Human
uauguagaaaaaaauaagcu

SEQ ID NO: 241663 - RNA, 18 nt, Human
ucacuguauaugcccucu

SEQ ID NO: 241664 - RNA, 22 nt, Human
ucaguggcuaccgaaagaacag

SEQ ID NO: 241665 - RNA, 18 nt, Human
ucauugggucaagucucg

SEQ ID NO: 241666 - RNA, 20 nt, Human
uccacuaacaauauaauuga

SEQ ID NO: 241667 - RNA, 22 nt, Human
ucgagaguaggagggaaaacuu

SEQ ID NO: 241668 - RNA, 24 nt, Human
ucgagaguaggagggaaaacuuac

SEQ ID NO: 241669 - RNA, 23 nt, Human
ucggagaccuuccuguaacucaa

SEQ ID NO: 241670 - RNA, 20 nt, Human
ugaaacgucauacacagguc

SEQ ID NO: 241671 - RNA, 18 nt, Human
ugcaucuuuuacaacacu

SEQ ID NO: 241672 - RNA, 19 nt, Human
uguaagcucacaguaucug

SEQ ID NO: 241673 - RNA, 19 nt, Human
uguagaaaaaaauaagcug

SEQ ID NO: 241674 - RNA, 23 nt, Human
uguauuggucacaauuauguaga

SEQ ID NO: 241675 - RNA, 25 nt, Human
uuagggcaauaaaguaaaagcaugu

SEQ ID NO: 241676 - RNA, 22 nt, Human
uuggugggacaaagaaacuggu

SEQ ID NO: 241677 - RNA, 18 nt, Human
aaaaagaaaaaaaaaagg

SEQ ID NO: 241678 - RNA, 22 nt, Human
aaaaagaaaaaaaaaaggaaag

SEQ ID NO: 241679 - RNA, 22 nt, Human
aaaagaaaaaaaaaaggaaaga

SEQ ID NO: 241680 - RNA, 23 nt, Human
aaaagaaaaaaaaaaggaaagaa

SEQ ID NO: 241681 - RNA, 21 nt, Human
aagaaaaaaaaaaggaaagaa

SEQ ID NO: 241682 - RNA, 20 nt, Human
aagaaagaaaaggaaauccc

SEQ ID NO: 241683 - RNA, 21 nt, Human
aagaaagaaaaggaaauccca

SEQ ID NO: 241684 - RNA, 23 nt, Human
aagaaagaaaaggaaaucccaaa

SEQ ID NO: 241685 - RNA, 21 nt, Human
aagagaaagaaaauauaucug

SEQ ID NO: 241686 - RNA, 20 nt, Human
aagcucgcgcgaaccccuaa

SEQ ID NO: 241687 - RNA, 22 nt, Human
aaggaagaggaaggaggaagag

SEQ ID NO: 241688 - RNA, 22 nt, Human
aaggcgggacggccgggaacac

SEQ ID NO: 241689 - RNA, 21 nt, Human
aagugccucccgguggccccg

SEQ ID NO: 241690 - RNA, 22 nt, Human
acacacauugcaccauacauaa

SEQ ID NO: 241691 - RNA, 24 nt, Human
acaccaaacccaggcuuuuccacc

SEQ ID NO: 241692 - RNA, 23 nt, Human
accccuaaaugugucuggaaagc

SEQ ID NO: 241693 - RNA, 22 nt, Human
agaaaaaaaaaaggaaagaaag

SEQ ID NO: 241694 - RNA, 23 nt, Human
agaaaaggaaaucccaaacaaaa

SEQ ID NO: 241695 - RNA, 27 nt, Human
agaaagaaaaggaaaucccaaacaaaa

SEQ ID NO: 241696 - RNA, 19 nt, Human
agaaagaaaauauaucugu

SEQ ID NO: 241697 - RNA, 25 nt, Human
agaaagaaaauauaucuguauugaa

SEQ ID NO: 241698 - RNA, 24 nt, Human
aucucaaaaaccauacaccaaacc

SEQ ID NO: 241699 - RNA, 21 nt, Human
augggcuuuucccgcaggauc

SEQ ID NO: 241700 - RNA, 21 nt, Human
auuagcuuuuugucugggcau

SEQ ID NO: 241701 - RNA, 19 nt, Human
caaaaagaaaaaaaaaagg

SEQ ID NO: 241702 - RNA, 23 nt, Human
caaaaagaaaaaaaaaaggaaag

SEQ ID NO: 241703 - RNA, 24 nt, Human
caaacaaaaccuaaaucccuggau

SEQ ID NO: 241704 - RNA, 23 nt, Human
caaagcucgcgcgaaccccuaaa

SEQ ID NO: 241705 - RNA, 22 nt, Human
caccaaacccaggcuuuuccac

SEQ ID NO: 241706 - RNA, 22 nt, Human
cacccccacaugaaccuccgcc

SEQ ID NO: 241707 - RNA, 21 nt, Human
cacgcgcacgcgaagccgcag

SEQ ID NO: 241708 - RNA, 18 nt, Human
cagguggcgguggccgcg

SEQ ID NO: 241709 - RNA, 20 nt, Human
ccacagcggcggggcugcuc

SEQ ID NO: 241710 - RNA, 24 nt, Human
ccauacaccaaacccaggcuuuuc

SEQ ID NO: 241711 - RNA, 27 nt, Human
ccauauacacacauugcaccauacaua

SEQ ID NO: 241712 - RNA, 23 nt, Human
cccaaagagcugcugggaauccu

SEQ ID NO: 241713 - RNA, 21 nt, Human
ccccagcucccuucuuacucc

SEQ ID NO: 241714 - RNA, 18 nt, Human
cccccacaugaaccuccg

SEQ ID NO: 241715 - RNA, 23 nt, Human
cccccacaugaaccuccgccgcg

SEQ ID NO: 241716 - RNA, 23 nt, Human
ccccccuccccccuccacaaaag

SEQ ID NO: 241717 - RNA, 24 nt, Human
ccccuaaaugugucuggaaagccc

SEQ ID NO: 241718 - RNA, 19 nt, Human
ccccuccccccuccacaaa

SEQ ID NO: 241719 - RNA, 20 nt, Human
cccgccccucccgccggggc

SEQ ID NO: 241720 - RNA, 22 nt, Human
cccuccacaaaagugccucccg

SEQ ID NO: 241721 - RNA, 23 nt, Human
ccgcagggcaacaacaugaggga

SEQ ID NO: 241722 - RNA, 24 nt, Human
ccgcggccucccacccgccccucc

SEQ ID NO: 241723 - RNA, 18 nt, Human
ccgggaacacgcgcacgc

SEQ ID NO: 241724 - RNA, 19 nt, Human
ccucccacccgccccuccc

SEQ ID NO: 241725 - RNA, 23 nt, Human
ccucccacccgccccucccgccg

SEQ ID NO: 241726 - RNA, 18 nt, Human
ccucccgguggccccggg

SEQ ID NO: 241727 - RNA, 21 nt, Human
ccugcaaaaagaaaaaaaaaa

SEQ ID NO: 241728 - RNA, 18 nt, Human
cgcgcacgcgaagccgca

SEQ ID NO: 241729 - RNA, 18 nt, Human
cgcuccucgugccgaauu

SEQ ID NO: 241730 - RNA, 22 nt, Human
cucaacaacuccagccccccgc

SEQ ID NO: 241731 - RNA, 23 nt, Human
cucccugcaaaaagaaaaaaaaa

SEQ ID NO: 241732 - RNA, 20 nt, Human
cuccgccgcggaccgccgug

SEQ ID NO: 241733 - RNA, 23 nt, Human
cugcaaaaagaaaaaaaaaagga

SEQ ID NO: 241734 - RNA, 22 nt, Human
cugguccaugagcacaaagcuc

SEQ ID NO: 241735 - RNA, 25 nt, Human
cuucaaaaguugugcggcugguccc

SEQ ID NO: 241736 - RNA, 24 nt, Human
gagcgaguuucuccuggacgcggg

SEQ ID NO: 241737 - RNA, 22 nt, Human
gcacaaagcucgcgcgaacccc

SEQ ID NO: 241738 - RNA, 21 nt, Human
gcaucggccccucucgaggcc

SEQ ID NO: 241739 - RNA, 24 nt, Human
gccgaggucgcccccccucccccc

SEQ ID NO: 241740 - RNA, 20 nt, Human
gccggcugcgcgggucgcac

SEQ ID NO: 241741 - RNA, 22 nt, Human
gcgcggccagcggcuacaugga

SEQ ID NO: 241742 - RNA, 21 nt, Human
ggaaagcccugccuuuaccuu

SEQ ID NO: 241743 - RNA, 23 nt, Human
ggcugugucucugggcaucggcc

SEQ ID NO: 241744 - RNA, 18 nt, Human
gggugggggggaggcggu

SEQ ID NO: 241745 - RNA, 19 nt, Human
gguggccccggggucccag

SEQ ID NO: 241746 - RNA, 22 nt, Human
gucgcccccccuccccccucca

SEQ ID NO: 241747 - RNA, 19 nt, Human
gucucaggucccaggcgcu

SEQ ID NO: 241748 - RNA, 25 nt, Human
guggccccggggucccagcgagguc

SEQ ID NO: 241749 - RNA, 24 nt, Human
gugggggggaggcggucuccgguu

SEQ ID NO: 241750 - RNA, 19 nt, Human
uaaaaaguaaggaagagga

SEQ ID NO: 241751 - RNA, 25 nt, Human
uaaaaaguaaggaagaggaaggagg

SEQ ID NO: 241752 - RNA, 19 nt, Human
uaaaugugucuggaaagcc

SEQ ID NO: 241753 - RNA, 18 nt, Human
uacuuuauuaucgaguga

SEQ ID NO: 241754 - RNA, 25 nt, Human
uaucauuuucuuuauauauauauau

SEQ ID NO: 241755 - RNA, 25 nt, Human
uaucucaaaaaccauacaccaaacc

SEQ ID NO: 241756 - RNA, 23 nt, Human
ucauuuucuuuauauauauauau

SEQ ID NO: 241757 - RNA, 23 nt, Human
uccaugagcacaaagcucgcgcg

SEQ ID NO: 241758 - RNA, 24 nt, Human
ucccaaacaaaaccuaaaucccug

SEQ ID NO: 241759 - RNA, 18 nt, Human
ucccaaagagcugcuggg

SEQ ID NO: 241760 - RNA, 20 nt, Human
ucccacccgccccucccgcc

SEQ ID NO: 241761 - RNA, 20 nt, Human
ucccaggcgcuagaugcacu

SEQ ID NO: 241762 - RNA, 19 nt, Human
ucccgguggccccgggguc

SEQ ID NO: 241763 - RNA, 19 nt, Human
ucccucaacaaggcgccgg

SEQ ID NO: 241764 - RNA, 20 nt, Human
ucccucaacaaggcgccggc

SEQ ID NO: 241765 - RNA, 19 nt, Human
ucccuucuuacucccugca

SEQ ID NO: 241766 - RNA, 19 nt, Human
uccgcgcgcggccagcggc

SEQ ID NO: 241767 - RNA, 26 nt, Human
uccgcgcgcggccagcggcuacaugg

SEQ ID NO: 241768 - RNA, 22 nt, Human
uccgugggggcugugucucugg

SEQ ID NO: 241769 - RNA, 19 nt, Human
ucgcccccccuccccccuc

SEQ ID NO: 241770 - RNA, 19 nt, Human
ucuggaaagcccugccuuu

SEQ ID NO: 241771 - RNA, 22 nt, Human
ucuuucucucggcucagcuccc

SEQ ID NO: 241772 - RNA, 18 nt, Human
uggccccggggucccagc

SEQ ID NO: 241773 - RNA, 21 nt, Human
uguaaaaaucccaaagagcug

SEQ ID NO: 241774 - RNA, 21 nt, Human
uuuccaccuagcucugcugua

SEQ ID NO: 241775 - RNA, 21 nt, Human
aaaaaaaaaacgaccaaagag

SEQ ID NO: 241776 - RNA, 25 nt, Human
aaaaccaaccaacaaacaaaaaaaa

SEQ ID NO: 241777 - RNA, 21 nt, Human
aaaacccccaacaauucuuuu

SEQ ID NO: 241778 - RNA, 21 nt, Human
aaaacgucuuuauauuuacaa

SEQ ID NO: 241779 - RNA, 23 nt, Human
aaacaaaaaaaaaacgaccaaag

SEQ ID NO: 241780 - RNA, 24 nt, Human
aaacaaaaaaaaaacgaccaaaga

SEQ ID NO: 241781 - RNA, 22 nt, Human
aaacaaaacagaacacaaacga

SEQ ID NO: 241782 - RNA, 23 nt, Human
aaacagaacacaaacgaggacga

SEQ ID NO: 241783 - RNA, 21 nt, Human
aacaugcucauugagcuaaga

SEQ ID NO: 241784 - RNA, 21 nt, Human
aaccaacaaacaaaaaaaaaa

SEQ ID NO: 241785 - RNA, 22 nt, Human
aagaacagugucgaaguaucau

SEQ ID NO: 241786 - RNA, 22 nt, Human
aagagacacaaaacaaagagca

SEQ ID NO: 241787 - RNA, 19 nt, Human
aagagcgaaacaaaacaga

SEQ ID NO: 241788 - RNA, 23 nt, Human
aagucguuugccugcuaaggagc

SEQ ID NO: 241789 - RNA, 25 nt, Human
aauggcaggggcuggcaggaaggga

SEQ ID NO: 241790 - RNA, 21 nt, Human
acacaggaugggagcaggcag

SEQ ID NO: 241791 - RNA, 22 nt, Human
acagcagcagcagcaggggccc

SEQ ID NO: 241792 - RNA, 24 nt, Human
accaaccaacaaacaaaaaaaaaa

SEQ ID NO: 241793 - RNA, 27 nt, Human
agaagaaaaccaaccaacaaacaaaaa

SEQ ID NO: 241794 - RNA, 24 nt, Human
agacaaggaugaaaauaagggacc

SEQ ID NO: 241795 - RNA, 20 nt, Human
agauggccaaaaaagaaaga

SEQ ID NO: 241796 - RNA, 21 nt, Human
agcagcagcagcaggggcccg

SEQ ID NO: 241797 - RNA, 22 nt, Human
agcagcagcaggggcccgggca

SEQ ID NO: 241798 - RNA, 25 nt, Human
agcaggcgcaggcgacagcagcagc

SEQ ID NO: 241799 - RNA, 21 nt, Human
agcccuugggaagcccaucuc

SEQ ID NO: 241800 - RNA, 21 nt, Human
aggcaggggagaggcugaggg

SEQ ID NO: 241801 - RNA, 19 nt, Human
agggacauccccgcuugcu

SEQ ID NO: 241802 - RNA, 18 nt, Human
agggagaggaggggcagg

SEQ ID NO: 241803 - RNA, 20 nt, Human
agggagaggaggggcagggg

SEQ ID NO: 241804 - RNA, 21 nt, Human
agggagaggaggggcaggggc

SEQ ID NO: 241805 - RNA, 21 nt, Human
agggagaggaggggcaggggc

SEQ ID NO: 241806 - RNA, 23 nt, Human
agggagaggaggggcaggggcuu

SEQ ID NO: 241807 - RNA, 18 nt, Human
agugaaaugaugaccgcc

SEQ ID NO: 241808 - RNA, 19 nt, Human
aguuguagaagaaaugaaa

SEQ ID NO: 241809 - RNA, 24 nt, Human
caaaacaaagagcacguugucucc

SEQ ID NO: 241810 - RNA, 20 nt, Human
caaacaaaaaaaaaacgacc

SEQ ID NO: 241811 - RNA, 26 nt, Human
caagugaaaugaugaccgccccccuu

SEQ ID NO: 241812 - RNA, 23 nt, Human
cacacagccgcacacucacacuc

SEQ ID NO: 241813 - RNA, 22 nt, Human
cacacuccugacaagugaaaug

SEQ ID NO: 241814 - RNA, 19 nt, Human
caccaugaagaagucgggc

SEQ ID NO: 241815 - RNA, 22 nt, Human
cacccauaggaaaaaacaccaa

SEQ ID NO: 241816 - RNA, 18 nt, Human
cacguugucuccccaucu

SEQ ID NO: 241817 - RNA, 24 nt, Human
cacucacacacacuccugacaagu

SEQ ID NO: 241818 - RNA, 18 nt, Human
cagaacacaaacgaggac

SEQ ID NO: 241819 - RNA, 24 nt, Human
cagaagccuguggacaggcccgug

SEQ ID NO: 241820 - RNA, 19 nt, Human
cagcagcagcagcaggggc

SEQ ID NO: 241821 - RNA, 18 nt, Human
cagcagcagcaggggccc

SEQ ID NO: 241822 - RNA, 22 nt, Human
cagcagcagcaggggcccgggc

SEQ ID NO: 241823 - RNA, 21 nt, Human
cagcagcaggggcccgggcag

SEQ ID NO: 241824 - RNA, 18 nt, Human
cauaccugccccuucuuc

SEQ ID NO: 241825 - RNA, 23 nt, Human
cauaccugccccuucuuccaaaa

SEQ ID NO: 241826 - RNA, 18 nt, Human
ccagguacugccucugcc

SEQ ID NO: 241827 - RNA, 23 nt, Human
ccaugaagaagucgggcgccgag

SEQ ID NO: 241828 - RNA, 22 nt, Human
ccccacugagcguguccaaggg

SEQ ID NO: 241829 - RNA, 18 nt, Human
ccccuucuuccaaaaaaa

SEQ ID NO: 241830 - RNA, 21 nt, Human
ccccuucuuccaaaaaaaccc

SEQ ID NO: 241831 - RNA, 18 nt, Human
ccgccccccuucauacac

SEQ ID NO: 241832 - RNA, 22 nt, Human
ccgcgcccugcgcggcucuccg

SEQ ID NO: 241833 - RNA, 18 nt, Human
cgacagcagcagcagcag

SEQ ID NO: 241834 - RNA, 19 nt, Human
cgagaagaagaaaaccaac

SEQ ID NO: 241835 - RNA, 20 nt, Human
cgcccugcgcggcucuccgc

SEQ ID NO: 241836 - RNA, 18 nt, Human
cgcucuguccccuccgca

SEQ ID NO: 241837 - RNA, 21 nt, Human
cgggggcccgggggcgcccgc

SEQ ID NO: 241838 - RNA, 23 nt, Human
cucacgcucuguccccuccgcac

SEQ ID NO: 241839 - RNA, 22 nt, Human
cucagcucacgcucuguccccu

SEQ ID NO: 241840 - RNA, 23 nt, Human
cugccucugccccacugagcgug

SEQ ID NO: 241841 - RNA, 18 nt, Human
cugcuaagcaugucccuc

SEQ ID NO: 241842 - RNA, 24 nt, Human
cugcuaaggagcgaacaugaccuc

SEQ ID NO: 241843 - RNA, 24 nt, Human
cugcugggaccccagccgccagcu

SEQ ID NO: 241844 - RNA, 23 nt, Human
cuuuagaaaaacauucagcuagg

SEQ ID NO: 241845 - RNA, 19 nt, Human
cuuuucauaagcuauuucu

SEQ ID NO: 241846 - RNA, 22 nt, Human
gaaggggacugcuaagcauguc

SEQ ID NO: 241847 - RNA, 20 nt, Human
gaccaaagaguuugcaugaa

SEQ ID NO: 241848 - RNA, 24 nt, Human
gagcgaaacaaaacagaacacaaa

SEQ ID NO: 241849 - RNA, 23 nt, Human
gaggacgagaagaagaaaaccaa

SEQ ID NO: 241850 - RNA, 23 nt, Human
gcacacgcgugcacacacagccg

SEQ ID NO: 241851 - RNA, 25 nt, Human
gcacacgcgugcacacacagccgca

SEQ ID NO: 241852 - RNA, 19 nt, Human
gcacugggugagcaauacu

SEQ ID NO: 241853 - RNA, 21 nt, Human
gcagcaggcgcaggcgacagc

SEQ ID NO: 241854 - RNA, 21 nt, Human
gcgugcacacacagccgcaca

SEQ ID NO: 241855 - RNA, 22 nt, Human
gcugcugggaccccagccgcca

SEQ ID NO: 241856 - RNA, 19 nt, Human
gcuugggacugcaaaccuc

SEQ ID NO: 241857 - RNA, 21 nt, Human
ggagaggaggggcaggggcuu

SEQ ID NO: 241858 - RNA, 20 nt, Human
ggcacugggugagcaauacu

SEQ ID NO: 241859 - RNA, 19 nt, Human
ggcaggaagggaauaagac

SEQ ID NO: 241860 - RNA, 19 nt, Human
ggcaggagagacaccgcuu

SEQ ID NO: 241861 - RNA, 20 nt, Human
ggcaggagagacaccgcuug

SEQ ID NO: 241862 - RNA, 18 nt, Human
ggcgccgaguuggggcag

SEQ ID NO: 241863 - RNA, 21 nt, Human
gggagaggcugaggggagagg

SEQ ID NO: 241864 - RNA, 21 nt, Human
gggcccgggcaggagcggcgg

SEQ ID NO: 241865 - RNA, 22 nt, Human
gggcgcgcgcgggggcccgggg

SEQ ID NO: 241866 - RNA, 23 nt, Human
ggggagaggcugaggggagaggg

SEQ ID NO: 241867 - RNA, 20 nt, Human
ggugauaacacccauaggaa

SEQ ID NO: 241868 - RNA, 21 nt, Human
gucgggcgccgaguuggggca

SEQ ID NO: 241869 - RNA, 19 nt, Human
gugaaaugaugaccgcccc

SEQ ID NO: 241870 - RNA, 21 nt, Human
gugaaaugaugaccgcccccc

SEQ ID NO: 241871 - RNA, 18 nt, Human
gugcuuggauuucugcuu

SEQ ID NO: 241872 - RNA, 20 nt, Human
guggcaugcgccagucuccc

SEQ ID NO: 241873 - RNA, 24 nt, Human
uaacauaaaauacauuuuuuucuu

SEQ ID NO: 241874 - RNA, 18 nt, Human
uaagagacacaaaacaaa

SEQ ID NO: 241875 - RNA, 24 nt, Human
uauacacauugcacaauacauagu

SEQ ID NO: 241876 - RNA, 26 nt, Human
uauuucucaaagagcgaaacaaaaca

SEQ ID NO: 241877 - RNA, 22 nt, Human
ucaaagagcgaaacaaaacaga

SEQ ID NO: 241878 - RNA, 22 nt, Human
ucccaggcuggggacagagccg

SEQ ID NO: 241879 - RNA, 20 nt, Human
ucgggcgccgaguuggggca

SEQ ID NO: 241880 - RNA, 22 nt, Human
ucucuuguucauuuaaaccuuu

SEQ ID NO: 241881 - RNA, 21 nt, Human
ucuuggagggaaggggacugc

SEQ ID NO: 241882 - RNA, 18 nt, Human
ugacaagugaaaugauga

SEQ ID NO: 241883 - RNA, 24 nt, Human
ugagcaauacugugagggggcugc

SEQ ID NO: 241884 - RNA, 19 nt, Human
ugagggagaggaggggcag

SEQ ID NO: 241885 - RNA, 21 nt, Human
ugagggagaggaggggcaggg

SEQ ID NO: 241886 - RNA, 18 nt, Human
ugaugagggagaggaggg

SEQ ID NO: 241887 - RNA, 26 nt, Human
ugccgcuccugcacacgcgugcacag

SEQ ID NO: 241888 - RNA, 19 nt, Human
ugggaccccagccgccagc

SEQ ID NO: 241889 - RNA, 21 nt, Human
ugggaccccagccgccagcuu

SEQ ID NO: 241890 - RNA, 18 nt, Human
uggggacagagccgugcu

SEQ ID NO: 241891 - RNA, 20 nt, Human
uguggacaggcccguguccu

SEQ ID NO: 241892 - RNA, 23 nt, Human
uguguuuaucuuuuuuaauuugg

SEQ ID NO: 241893 - RNA, 22 nt, Human
uuauauuaaagcaaagugcauc

SEQ ID NO: 241894 - RNA, 21 nt, Human
uucuuccaaaaaaacccccaa

SEQ ID NO: 241895 - RNA, 24 nt, Human
uugcuggccuaauagcagagcuua

SEQ ID NO: 241896 - RNA, 20 nt, Human
uuguucauuuaaaccuuugu

SEQ ID NO: 241897 - RNA, 19 nt, Human
uuuguaguuagaaaaauag

SEQ ID NO: 241898 - RNA, 21 nt, Human
uuuuuuuuuuuuuuuuucaag

SEQ ID NO: 241899 - RNA, 21 nt, Human
aaaguccugcuuuuccaauug

SEQ ID NO: 241900 - RNA, 24 nt, Human
aagaggccacagcaggcuccggcg

SEQ ID NO: 241901 - RNA, 22 nt, Human
aaucugcugcuuauagcacagg

SEQ ID NO: 241902 - RNA, 18 nt, Human
agcacaggcaccaaaguc

SEQ ID NO: 241903 - RNA, 20 nt, Human
agguuaacuagaaagcacaa

SEQ ID NO: 241904 - RNA, 21 nt, Human
auacaagccacucccugcaau

SEQ ID NO: 241905 - RNA, 24 nt, Human
auagcacaggcaccaaaguccugc

SEQ ID NO: 241906 - RNA, 21 nt, Human
augauacaagccacucccugc

SEQ ID NO: 241907 - RNA, 19 nt, Human
caacagcacuaaaagugac

SEQ ID NO: 241908 - RNA, 20 nt, Human
caccaaaguccugcuuuucc

SEQ ID NO: 241909 - RNA, 19 nt, Human
cacuguacuggcaucaggu

SEQ ID NO: 241910 - RNA, 22 nt, Human
ccucccacaaaaucugcugcuu

SEQ ID NO: 241911 - RNA, 20 nt, Human
cgcccguucuucugggagca

SEQ ID NO: 241912 - RNA, 19 nt, Human
cucaaguguuuccucccac

SEQ ID NO: 241913 - RNA, 23 nt, Human
cucccacaaaaucugcugcuuau

SEQ ID NO: 241914 - RNA, 19 nt, Human
gacaucauuuaaacuguag

SEQ ID NO: 241915 - RNA, 20 nt, Human
gcacgggaaccgcacagccc

SEQ ID NO: 241916 - RNA, 19 nt, Human
uaacuagaaagcacaaaac

SEQ ID NO: 241917 - RNA, 19 nt, Human
uacacauguuuuuagaaac

SEQ ID NO: 241918 - RNA, 19 nt, Human
uauaaacaguuucaauguu

SEQ ID NO: 241919 - RNA, 19 nt, Human
uauucugcuaacacccuuc

SEQ ID NO: 241920 - RNA, 23 nt, Human
ucaauguuucugugaggccacac

SEQ ID NO: 241921 - RNA, 21 nt, Human
ucugaaaugauacaagccacu

SEQ ID NO: 241922 - RNA, 24 nt, Human
ugacacggcugacuaaagcugucu

SEQ ID NO: 241923 - RNA, 21 nt, Human
ugcaaaucugaaaugauacaa

SEQ ID NO: 241924 - RNA, 21 nt, Human
uggcauagggaccaacccgcc

SEQ ID NO: 241925 - RNA, 18 nt, Human
uuuuuuuuuuuuuucuug

SEQ ID NO: 241926 - RNA, 20 nt, Human
uuuuuuuuuuuuuuuuuugg

SEQ ID NO: 241927 - RNA, 25 nt, Human
uuuuuuuuuuuuuuuuuugguuuuu

SEQ ID NO: 241928 - RNA, 19 nt, Human
aaaaaggagacuaaacaga

SEQ ID NO: 241929 - RNA, 20 nt, Human
aaaccuccaagcgcgcucac

SEQ ID NO: 241930 - RNA, 23 nt, Human
aagccgacaagcagcccgagcua

SEQ ID NO: 241931 - RNA, 21 nt, Human
aagcgcgcucacacacacacc

SEQ ID NO: 241932 - RNA, 23 nt, Human
aauagcgaaguccuggggaaaga

SEQ ID NO: 241933 - RNA, 21 nt, Human
acacacacacccccccgcccu

SEQ ID NO: 241934 - RNA, 21 nt, Human
acacacacccccccgcccugc

SEQ ID NO: 241935 - RNA, 22 nt, Human
acacacacccccccgcccugcc

SEQ ID NO: 241936 - RNA, 20 nt, Human
agagcaaaggggggaggggg

SEQ ID NO: 241937 - RNA, 18 nt, Human
agcgaaguccuggggaaa

SEQ ID NO: 241938 - RNA, 19 nt, Human
agcgggugagccagcuugc

SEQ ID NO: 241939 - RNA, 23 nt, Human
aggagcccggcccggugcgcggc

SEQ ID NO: 241940 - RNA, 19 nt, Human
aggggggagggggagccaa

SEQ ID NO: 241941 - RNA, 22 nt, Human
caaagugcaaggcagaggugca

SEQ ID NO: 241942 - RNA, 20 nt, Human
cacacccccccgcccugccc

SEQ ID NO: 241943 - RNA, 20 nt, Human
ccccccgcgcccgcccuccc

SEQ ID NO: 241944 - RNA, 20 nt, Human
ccccgcccugcccgcgcccc

SEQ ID NO: 241945 - RNA, 22 nt, Human
cccgaaaccuccaagcgcgcuc

SEQ ID NO: 241946 - RNA, 21 nt, Human
cccgcccugcccgcgcccccc

SEQ ID NO: 241947 - RNA, 25 nt, Human
cccgcgccccccgcgcccgcccucc

SEQ ID NO: 241948 - RNA, 26 nt, Human
cccugcccgcgccccccgcgcccgcc

SEQ ID NO: 241949 - RNA, 22 nt, Human
ccgccgccgccgccgccgccgc

SEQ ID NO: 241950 - RNA, 23 nt, Human
ccgccgccgccgccgccgccgcu

SEQ ID NO: 241951 - RNA, 21 nt, Human
ccgccgccgccgccgcuccgc

SEQ ID NO: 241952 - RNA, 23 nt, Human
ccgcgccccccgcgcccgcccuc

SEQ ID NO: 241953 - RNA, 24 nt, Human
ccucgcucgccccggccccuccuu

SEQ ID NO: 241954 - RNA, 20 nt, Human
ccucucucucccucgcgcgc

SEQ ID NO: 241955 - RNA, 19 nt, Human
ccugccgccgccgccgccg

SEQ ID NO: 241956 - RNA, 24 nt, Human
cgaaaccuccaagcgcgcucacac

SEQ ID NO: 241957 - RNA, 26 nt, Human
cgaaaccuccaagcgcgcucacacac

SEQ ID NO: 241958 - RNA, 24 nt, Human
cgagcugcgguggcggcgguggug

SEQ ID NO: 241959 - RNA, 26 nt, Human
cgagcugcgguggcggcggugguggc

SEQ ID NO: 241960 - RNA, 19 nt, Human
cgcccucccuccccccugc

SEQ ID NO: 241961 - RNA, 22 nt, Human
cgccgccgccgccgccgcuccg

SEQ ID NO: 241962 - RNA, 18 nt, Human
cgcggcgggcgucugucc

SEQ ID NO: 241963 - RNA, 22 nt, Human
cgcucacacacacacccccccg

SEQ ID NO: 241964 - RNA, 22 nt, Human
cucccuccccccugcucacgcc

SEQ ID NO: 241965 - RNA, 18 nt, Human
cucgcucgccccggcccc

SEQ ID NO: 241966 - RNA, 19 nt, Human
cucuucugcuuggcucucu

SEQ ID NO: 241967 - RNA, 18 nt, Human
cugcaggagaggggccag

SEQ ID NO: 241968 - RNA, 27 nt, Human
cugccgccgccgccgccgccgccgcuc

SEQ ID NO: 241969 - RNA, 24 nt, Human
cuugcgcgccgagccggcggcuuc

SEQ ID NO: 241970 - RNA, 23 nt, Human
gaagcuggaggagcccggcccgg

SEQ ID NO: 241971 - RNA, 19 nt, Human
gacaagcagcccgagcuac

SEQ ID NO: 241972 - RNA, 21 nt, Human
gagcugcgguggcggcggugg

SEQ ID NO: 241973 - RNA, 19 nt, Human
gaggagcccggcccggugc

SEQ ID NO: 241974 - RNA, 23 nt, Human
gccagaugggcugcaggagaggg

SEQ ID NO: 241975 - RNA, 18 nt, Human
gccagcuugccgggcugg

SEQ ID NO: 241976 - RNA, 28 nt, Human
gccccccgcgcccgcccucccucccccc

SEQ ID NO: 241977 - RNA, 20 nt, Human
gcccgcccucccuccccccu

SEQ ID NO: 241978 - RNA, 22 nt, Human
gccgccgccgccgccgccgccg

SEQ ID NO: 241979 - RNA, 20 nt, Human
gcggcggugguggcugcggc

SEQ ID NO: 241980 - RNA, 18 nt, Human
gcgggcugugcugggugg

SEQ ID NO: 241981 - RNA, 22 nt, Human
gcgguggcggcggugguggcug

SEQ ID NO: 241982 - RNA, 23 nt, Human
ggaaagacgaggcagagagcaaa

SEQ ID NO: 241983 - RNA, 19 nt, Human
ggaggagagggagggggga

SEQ ID NO: 241984 - RNA, 20 nt, Human
ggaggagagggaggggggag

SEQ ID NO: 241985 - RNA, 24 nt, Human
ggccagcgggugagccagcuugcc

SEQ ID NO: 241986 - RNA, 19 nt, Human
ggcgguggcuggcccgaaa

SEQ ID NO: 241987 - RNA, 26 nt, Human
ggcucucuuuauuauuuuuuuucuuu

SEQ ID NO: 241988 - RNA, 20 nt, Human
ggcugcaggagaggggccag

SEQ ID NO: 241989 - RNA, 21 nt, Human
ggcugcaggagaggggccagc

SEQ ID NO: 241990 - RNA, 27 nt, Human
ggcugcggcggcgaagcuggaggagcc

SEQ ID NO: 241991 - RNA, 19 nt, Human
ggcugugcuggguggccag

SEQ ID NO: 241992 - RNA, 18 nt, Human
gggcggcgcgggccuugg

SEQ ID NO: 241993 - RNA, 28 nt, Human
gguggcggcggugguggcugcggcggcg

SEQ ID NO: 241994 - RNA, 22 nt, Human
gguggcugcggcggcgaagcug

SEQ ID NO: 241995 - RNA, 21 nt, Human
uacagcuagaagaugaaaaaa

SEQ ID NO: 241996 - RNA, 23 nt, Human
uacagcuagaagaugaaaaaaga

SEQ ID NO: 241997 - RNA, 18 nt, Human
uaccucugugcaaagugc

SEQ ID NO: 241998 - RNA, 22 nt, Human
uauuuuuuuucuuuccucucuc

SEQ ID NO: 241999 - RNA, 22 nt, Human
ucgcgcugcuggcgcgcuuugc

SEQ ID NO: 242000 - RNA, 23 nt, Human
ucuccugccgccgccgccgccgc

SEQ ID NO: 242001 - RNA, 19 nt, Human
ucucucccucgcgcgcucu

SEQ ID NO: 242002 - RNA, 18 nt, Human
ugcaggcagggcggcgcg

SEQ ID NO: 242003 - RNA, 22 nt, Human
ugcaggcagggcggcgcgcggc

SEQ ID NO: 242004 - RNA, 18 nt, Human
ugccgggcuggggcgcuu

SEQ ID NO: 242005 - RNA, 22 nt, Human
ugcgcucgccuccuugcgcgcc

SEQ ID NO: 242006 - RNA, 21 nt, Human
ugcgguggcggcggugguggc

SEQ ID NO: 242007 - RNA, 23 nt, Human
ugcgguggcggcggugguggcug

SEQ ID NO: 242008 - RNA, 19 nt, Human
ugcuggguggccagcgggu

SEQ ID NO: 242009 - RNA, 23 nt, Human
ugcuggguggccagcgggugagc

SEQ ID NO: 242010 - RNA, 22 nt, Human
uggaggagcccggcccggugcg

SEQ ID NO: 242011 - RNA, 24 nt, Human
uggcccgaaaccuccaagcgcgcu

SEQ ID NO: 242012 - RNA, 24 nt, Human
uggcggcggugguggcugcggccg

SEQ ID NO: 242013 - RNA, 20 nt, Human
uggggaaagacgaggcagag

SEQ ID NO: 242014 - RNA, 18 nt, Human
uuaguucuuucuugccuu

SEQ ID NO: 242015 - RNA, 22 nt, Human
uuuuuucuuuccucucucuccc

SEQ ID NO: 242016 - RNA, 19 nt, Human
aaagugcugggauuacaga

SEQ ID NO: 242017 - RNA, 24 nt, Human
aaagugcugggauuacagauguga

SEQ ID NO: 242018 - RNA, 30 nt, Human
aacacaaccacuaagugaaaugugaccucu

SEQ ID NO: 242019 - RNA, 22 nt, Human
aaccacuaagugaaaugugacc

SEQ ID NO: 242020 - RNA, 20 nt, Human
aaccauggcuggacucagca

SEQ ID NO: 242021 - RNA, 21 nt, Human
aacuuuuuuuuugagacagga

SEQ ID NO: 242022 - RNA, 21 nt, Human
aagcccagcucagggccauac

SEQ ID NO: 242023 - RNA, 24 nt, Human
aagggaaugugugugcaccaaggg

SEQ ID NO: 242024 - RNA, 20 nt, Human
aaguagcugggacuacaggc

SEQ ID NO: 242025 - RNA, 22 nt, Human
aaguagcugggacuacaggcau

SEQ ID NO: 242026 - RNA, 27 nt, Human
aaguagcugggacuacaggcaugagcc

SEQ ID NO: 242027 - RNA, 21 nt, Human
aagugauccuccugccucagc

SEQ ID NO: 242028 - RNA, 18 nt, Human
aagugcugggauuacaga

SEQ ID NO: 242029 - RNA, 26 nt, Human
aagugcugggauuacagaugugagcc

SEQ ID NO: 242030 - RNA, 20 nt, Human
acaauaagagcaguuuccaa

SEQ ID NO: 242031 - RNA, 22 nt, Human
acaauaagagcaguuuccaaga

SEQ ID NO: 242032 - RNA, 23 nt, Human
acacugacagggguugagguggg

SEQ ID NO: 242033 - RNA, 18 nt, Human
acagaugugagccaccgc

SEQ ID NO: 242034 - RNA, 20 nt, Human
acccaacuuccccuucccag

SEQ ID NO: 242035 - RNA, 22 nt, Human
accugggcacagaggcggcgcu

SEQ ID NO: 242036 - RNA, 18 nt, Human
acgggguuucaccauguu

SEQ ID NO: 242037 - RNA, 19 nt, Human
acgggguuucaccauguug

SEQ ID NO: 242038 - RNA, 24 nt, Human
acgggguuucaccauguuguccag

SEQ ID NO: 242039 - RNA, 19 nt, Human
agaaggugcccucugggcu

SEQ ID NO: 242040 - RNA, 18 nt, Human
agacaggauuuugcuaug

SEQ ID NO: 242041 - RNA, 21 nt, Human
agaccucugccccauccccaa

SEQ ID NO: 242042 - RNA, 24 nt, Human
agcaggagcucgggcucuggcugg

SEQ ID NO: 242043 - RNA, 25 nt, Human
aggcuggagugcaguggugcgaucu

SEQ ID NO: 242044 - RNA, 19 nt, Human
agggagcaggagcucgggc

SEQ ID NO: 242045 - RNA, 21 nt, Human
agugcaguggugcgaucucag

SEQ ID NO: 242046 - RNA, 23 nt, Human
agugcaguggugcgaucucagcu

SEQ ID NO: 242047 - RNA, 24 nt, Human
agugcaguggugcgaucucagcuc

SEQ ID NO: 242048 - RNA, 20 nt, Human
aguuucggaaggccaggcac

SEQ ID NO: 242049 - RNA, 24 nt, Human
auuuugcuauguugcccaggcugg

SEQ ID NO: 242050 - RNA, 19 nt, Human
caaaauacagaagacgaua

SEQ ID NO: 242051 - RNA, 25 nt, Human
caaacuccuggacucaagcgauccc

SEQ ID NO: 242052 - RNA, 24 nt, Human
caaagugcugggauuacagaugug

SEQ ID NO: 242053 - RNA, 23 nt, Human
caaccucugccuucugggcuuaa

SEQ ID NO: 242054 - RNA, 19 nt, Human
cacaguggacacugacagg

SEQ ID NO: 242055 - RNA, 24 nt, Human
caccaugcauggcuaauuuuugua

SEQ ID NO: 242056 - RNA, 24 nt, Human
caccauguuguccaggcuggucuc

SEQ ID NO: 242057 - RNA, 27 nt, Human
caccauguuguccaggcuggucucaaa

SEQ ID NO: 242058 - RNA, 27 nt, Human
cacccacucuuuuaguuucggaaggcc

SEQ ID NO: 242059 - RNA, 19 nt, Human
caccuucucucucccucug

SEQ ID NO: 242060 - RNA, 21 nt, Human
caccuucucucucccucugcu

SEQ ID NO: 242061 - RNA, 23 nt, Human
cacuacaaccucugccuucuggg

SEQ ID NO: 242062 - RNA, 22 nt, Human
cacugucccccugaaaaccaug

SEQ ID NO: 242063 - RNA, 23 nt, Human
cagagaaaugggaccugggcaca

SEQ ID NO: 242064 - RNA, 18 nt, Human
cagcagugaggacaccca

SEQ ID NO: 242065 - RNA, 24 nt, Human
caggauuuugcuauguugcccagg

SEQ ID NO: 242066 - RNA, 22 nt, Human
caggcacccccaggcccaacca

SEQ ID NO: 242067 - RNA, 24 nt, Human
caggccuguuuccccauccgugaa

SEQ ID NO: 242068 - RNA, 18 nt, Human
cagggcccacgaagggaa

SEQ ID NO: 242069 - RNA, 21 nt, Human
cagggguugaggugggacccu

SEQ ID NO: 242070 - RNA, 19 nt, Human
caguggacacugacagggg

SEQ ID NO: 242071 - RNA, 23 nt, Human
cauguuguccaggcuggucucaa

SEQ ID NO: 242072 - RNA, 24 nt, Human
cauguuguccaggcuggucucaaa

SEQ ID NO: 242073 - RNA, 21 nt, Human
ccaaagugcugggauuacaga

SEQ ID NO: 242074 - RNA, 22 nt, Human
ccaaagugcugggauuacagau

SEQ ID NO: 242075 - RNA, 24 nt, Human
ccaaagugcugggauuacagaugu

SEQ ID NO: 242076 - RNA, 23 nt, Human
ccaaccuacccaacuuccccuuc

SEQ ID NO: 242077 - RNA, 27 nt, Human
ccaagccagggaggcccucccaccaca

SEQ ID NO: 242078 - RNA, 21 nt, Human
ccacugucccccugaaaacca

SEQ ID NO: 242079 - RNA, 19 nt, Human
ccaggcacccccaggccca

SEQ ID NO: 242080 - RNA, 21 nt, Human
ccauacgccacuuuucccagg

SEQ ID NO: 242081 - RNA, 24 nt, Human
cccaagccagggaggcccucccac

SEQ ID NO: 242082 - RNA, 23 nt, Human
cccaaguagcugggacuacaggc

SEQ ID NO: 242083 - RNA, 24 nt, Human
cccaaguagcugggacuacaggca

SEQ ID NO: 242084 - RNA, 18 nt, Human
cccacaguggacacugac

SEQ ID NO: 242085 - RNA, 23 nt, Human
cccccaacagcuguucucuaagc

SEQ ID NO: 242086 - RNA, 19 nt, Human
cccccggacacccuggcug

SEQ ID NO: 242087 - RNA, 22 nt, Human
ccccugaaaaccauggcuggac

SEQ ID NO: 242088 - RNA, 24 nt, Human
cccguaagucacagacagccaaac

SEQ ID NO: 242089 - RNA, 23 nt, Human
cccucuucucccccaacagcugu

SEQ ID NO: 242090 - RNA, 26 nt, Human
cccucuucucccccaacagcuguucu

SEQ ID NO: 242091 - RNA, 23 nt, Human
ccguaagucacagacagccaaac

SEQ ID NO: 242092 - RNA, 21 nt, Human
ccuagggcugagccaggccag

SEQ ID NO: 242093 - RNA, 22 nt, Human
ccucccaccacauuucugaguc

SEQ ID NO: 242094 - RNA, 20 nt, Human
ccuggacucaagcgaucccc

SEQ ID NO: 242095 - RNA, 23 nt, Human
ccuguccacugucccccugaaaa

SEQ ID NO: 242096 - RNA, 23 nt, Human
cgcgcucacacacgcgcgucucg

SEQ ID NO: 242097 - RNA, 23 nt, Human
cggccgcugucccgauccgcgcu

SEQ ID NO: 242098 - RNA, 21 nt, Human
cggcgcgcucacacacgcgcg

SEQ ID NO: 242099 - RNA, 24 nt, Human
cgggguuucaccauguuguccagg

SEQ ID NO: 242100 - RNA, 21 nt, Human
cuacaaccucugccuucuggg

SEQ ID NO: 242101 - RNA, 19 nt, Human
cuauguugcccaggcugga

SEQ ID NO: 242102 - RNA, 23 nt, Human
cucaagcgaucccccuccuugga

SEQ ID NO: 242103 - RNA, 19 nt, Human
cucacuacaaccucugccu

SEQ ID NO: 242104 - RNA, 24 nt, Human
cucagccucccaaguagcugggac

SEQ ID NO: 242105 - RNA, 22 nt, Human
cuccggucagucuccccuccgc

SEQ ID NO: 242106 - RNA, 21 nt, Human
cucgccgcugucccggccgcu

SEQ ID NO: 242107 - RNA, 21 nt, Human
cucuccggcuuucccuaaaua

SEQ ID NO: 242108 - RNA, 18 nt, Human
cucugacuggccagcccc

SEQ ID NO: 242109 - RNA, 23 nt, Human
cugccucagccucccaaguagcu

SEQ ID NO: 242110 - RNA, 23 nt, Human
cugucuccuugucucccuauuug

SEQ ID NO: 242111 - RNA, 21 nt, Human
cuucccagggucauucggucc

SEQ ID NO: 242112 - RNA, 20 nt, Human
cuuuuaguuucggaaggcca

SEQ ID NO: 242113 - RNA, 18 nt, Human
cuuuuuuuuugagacagg

SEQ ID NO: 242114 - RNA, 25 nt, Human
gaagggaaugugugugcaccaaggg

SEQ ID NO: 242115 - RNA, 18 nt, Human
gacacugacagggguuga

SEQ ID NO: 242116 - RNA, 22 nt, Human
gacgggguuucaccauguuguc

SEQ ID NO: 242117 - RNA, 21 nt, Human
gacuacaggcaugagccacca

SEQ ID NO: 242118 - RNA, 24 nt, Human
gacuacaggcaugagccaccaugc

SEQ ID NO: 242119 - RNA, 21 nt, Human
gagaauaacuuagauccgugc

SEQ ID NO: 242120 - RNA, 20 nt, Human
gagacgggguuucaccaugu

SEQ ID NO: 242121 - RNA, 20 nt, Human
gaggggcaguguggacagug

SEQ ID NO: 242122 - RNA, 18 nt, Human
gauuacagaugugagcca

SEQ ID NO: 242123 - RNA, 22 nt, Human
gauuacagaugugagccaccgc

SEQ ID NO: 242124 - RNA, 20 nt, Human
gcacccccaggcccaaccag

SEQ ID NO: 242125 - RNA, 19 nt, Human
gcagacccgcuucugggcc

SEQ ID NO: 242126 - RNA, 19 nt, Human
gcccaggcuggagugcagu

SEQ ID NO: 242127 - RNA, 18 nt, Human
gccccauccccaaccuac

SEQ ID NO: 242128 - RNA, 20 nt, Human
gccucagccucccaaguagc

SEQ ID NO: 242129 - RNA, 25 nt, Human
gcgcucaggcacuuuggggagggag

SEQ ID NO: 242130 - RNA, 20 nt, Human
gcuauguugcccaggcugga

SEQ ID NO: 242131 - RNA, 22 nt, Human
gcucacacacgcgcgucucgcc

SEQ ID NO: 242132 - RNA, 21 nt, Human
gcugggauuacagaugugagc

SEQ ID NO: 242133 - RNA, 21 nt, Human
ggaagacagggcccacgaagg

SEQ ID NO: 242134 - RNA, 24 nt, Human
ggacuacaggcaugagccaccaug

SEQ ID NO: 242135 - RNA, 25 nt, Human
ggagcugaggccggaggggcguggc

SEQ ID NO: 242136 - RNA, 21 nt, Human
ggagggagcugaggccggagg

SEQ ID NO: 242137 - RNA, 18 nt, Human
ggccgaggccgcgcggag

SEQ ID NO: 242138 - RNA, 20 nt, Human
ggcgcgcucacacacgcgcg

SEQ ID NO: 242139 - RNA, 19 nt, Human
ggcuuaagugauccuccug

SEQ ID NO: 242140 - RNA, 22 nt, Human
gggcacagaggcggcgcucagg

SEQ ID NO: 242141 - RNA, 25 nt, Human
gggcaguguggacagugucgggccc

SEQ ID NO: 242142 - RNA, 24 nt, Human
gggcaguguggacaguguuggggg

SEQ ID NO: 242143 - RNA, 18 nt, Human
gggccagugcugcagaga

SEQ ID NO: 242144 - RNA, 18 nt, Human
gggccgaggccgcgcgga

SEQ ID NO: 242145 - RNA, 18 nt, Human
gggcugagccaggccagc

SEQ ID NO: 242146 - RNA, 22 nt, Human
gggcuuaagugauccuccugcc

SEQ ID NO: 242147 - RNA, 23 nt, Human
gggguuucaccauguuguccagg

SEQ ID NO: 242148 - RNA, 21 nt, Human
guagagacgggguuucaccau

SEQ ID NO: 242149 - RNA, 22 nt, Human
guagagacgggguuucaccaug

SEQ ID NO: 242150 - RNA, 19 nt, Human
guccauggcccccuuucuc

SEQ ID NO: 242151 - RNA, 20 nt, Human
gugaaaugugaccucaggcc

SEQ ID NO: 242152 - RNA, 24 nt, Human
gugauccuccugccucagccuccc

SEQ ID NO: 242153 - RNA, 23 nt, Human
guuucaccauguuguccaggcug

SEQ ID NO: 242154 - RNA, 21 nt, Human
uaaagcccagcucagggccau

SEQ ID NO: 242155 - RNA, 26 nt, Human
uaagugauccuccugccucagccucc

SEQ ID NO: 242156 - RNA, 27 nt, Human
uaagugauccuccugccucagccuccc

SEQ ID NO: 242157 - RNA, 24 nt, Human
uaauuuuuguauuuuuuguagaga

SEQ ID NO: 242158 - RNA, 23 nt, Human
uacagaugugagccaccgcgccc

SEQ ID NO: 242159 - RNA, 18 nt, Human
uacaggcaugagccacca

SEQ ID NO: 242160 - RNA, 25 nt, Human
uagaaagucuacaaaauacagaaga

SEQ ID NO: 242161 - RNA, 21 nt, Human
uagagacgggguuucaccaug

SEQ ID NO: 242162 - RNA, 22 nt, Human
uagagacgggguuucaccaugu

SEQ ID NO: 242163 - RNA, 18 nt, Human
uauguugcccaggcugga

SEQ ID NO: 242164 - RNA, 22 nt, Human
uauguugcccaggcuggagugc

SEQ ID NO: 242165 - RNA, 23 nt, Human
uauguugcccaggcuggagugca

SEQ ID NO: 242166 - RNA, 18 nt, Human
ucacuacaaccucugccu

SEQ ID NO: 242167 - RNA, 24 nt, Human
ucacuacaaccucugccuucuggg

SEQ ID NO: 242168 - RNA, 25 nt, Human
ucacuacaaccucugccuucugggc

SEQ ID NO: 242169 - RNA, 23 nt, Human
ucacuagucuucccacccacucu

SEQ ID NO: 242170 - RNA, 19 nt, Human
ucagcagugaggacaccca

SEQ ID NO: 242171 - RNA, 20 nt, Human
ucagccucccaaguagcugg

SEQ ID NO: 242172 - RNA, 22 nt, Human
ucaggcacuuuggggagggagc

SEQ ID NO: 242173 - RNA, 19 nt, Human
uccaagaugaggggugccc

SEQ ID NO: 242174 - RNA, 21 nt, Human
uccagaccucugccccauccc

SEQ ID NO: 242175 - RNA, 24 nt, Human
uccagacuguaguaggacugcagg

SEQ ID NO: 242176 - RNA, 18 nt, Human
ucccaaagugcugggauu

SEQ ID NO: 242177 - RNA, 23 nt, Human
ucccaaagugcugggauuacaga

SEQ ID NO: 242178 - RNA, 23 nt, Human
ucccaacacaaccacuaagugaa

SEQ ID NO: 242179 - RNA, 18 nt, Human
ucccaagccagggaggcc

SEQ ID NO: 242180 - RNA, 20 nt, Human
ucccaagccagggaggcccu

SEQ ID NO: 242181 - RNA, 24 nt, Human
ucccaaguagcugggacuacaggc

SEQ ID NO: 242182 - RNA, 22 nt, Human
ucccagauccagaccucugccc

SEQ ID NO: 242183 - RNA, 28 nt, Human
ucccagggucauucggucccagucguaa

SEQ ID NO: 242184 - RNA, 25 nt, Human
uccccaaccuacccaacuuccccuu

SEQ ID NO: 242185 - RNA, 24 nt, Human
ucccgauccgcgcuccggucaguc

SEQ ID NO: 242186 - RNA, 21 nt, Human
ucccucugcuucucucccccu

SEQ ID NO: 242187 - RNA, 27 nt, Human
uccuccugccucagccucccaaguagc

SEQ ID NO: 242188 - RNA, 21 nt, Human
uccuuggacucccaaagugcu

SEQ ID NO: 242189 - RNA, 21 nt, Human
ucucaaucuaaaaaggcuaaa

SEQ ID NO: 242190 - RNA, 22 nt, Human
ucugggcuuaagugauccuccu

SEQ ID NO: 242191 - RNA, 19 nt, Human
ucuuaggaccccacuccag

SEQ ID NO: 242192 - RNA, 21 nt, Human
ugacaaucaaaggcagggguc

SEQ ID NO: 242193 - RNA, 18 nt, Human
ugagacaggauuuugcua

SEQ ID NO: 242194 - RNA, 22 nt, Human
ugagacaggauuuugcuauguu

SEQ ID NO: 242195 - RNA, 19 nt, Human
ugaggacacccagguuuug

SEQ ID NO: 242196 - RNA, 18 nt, Human
ugcccaggcuggagugca

SEQ ID NO: 242197 - RNA, 21 nt, Human
ugcccaggcuggagugcagug

SEQ ID NO: 242198 - RNA, 24 nt, Human
ugcccaggcuggagugcaguggug

SEQ ID NO: 242199 - RNA, 21 nt, Human
ugcccucugggcugcagaccc

SEQ ID NO: 242200 - RNA, 22 nt, Human
ugcccucuucucccccaacagc

SEQ ID NO: 242201 - RNA, 24 nt, Human
ugccucagccucccaaguagcugg

SEQ ID NO: 242202 - RNA, 24 nt, Human
ugcuauguugcccaggcuggagug

SEQ ID NO: 242203 - RNA, 25 nt, Human
ugcuauguugcccaggcuggagugc

SEQ ID NO: 242204 - RNA, 18 nt, Human
ugcugggauuacagaugu

SEQ ID NO: 242205 - RNA, 24 nt, Human
ugcugggauuacagaugugagcca

SEQ ID NO: 242206 - RNA, 23 nt, Human
uggagugcaguggugcgaucuca

SEQ ID NO: 242207 - RNA, 24 nt, Human
uggagugcaguggugcgaucucag

SEQ ID NO: 242208 - RNA, 22 nt, Human
uggcugcagggacagccuaggg

SEQ ID NO: 242209 - RNA, 23 nt, Human
uggcugcagggacagccuagggc

SEQ ID NO: 242210 - RNA, 18 nt, Human
ugggacuacaggcaugag

SEQ ID NO: 242211 - RNA, 22 nt, Human
ugggacuacaggcaugagccac

SEQ ID NO: 242212 - RNA, 24 nt, Human
ugggacuacaggcaugagccacca

SEQ ID NO: 242213 - RNA, 25 nt, Human
ugggacuacaggcaugagccaccau

SEQ ID NO: 242214 - RNA, 18 nt, Human
ugggauuacagaugugag

SEQ ID NO: 242215 - RNA, 19 nt, Human
ugggauuacagaugugagc

SEQ ID NO: 242216 - RNA, 21 nt, Human
ugggauuacagaugugagcca

SEQ ID NO: 242217 - RNA, 22 nt, Human
ugggauuacagaugugagccac

SEQ ID NO: 242218 - RNA, 23 nt, Human
ugggauuacagaugugagccacc

SEQ ID NO: 242219 - RNA, 24 nt, Human
ugggauuacagaugugagccaccg

SEQ ID NO: 242220 - RNA, 20 nt, Human
ugggcuuaagugauccuccu

SEQ ID NO: 242221 - RNA, 24 nt, Human
ugggcuuaagugauccuccugccu

SEQ ID NO: 242222 - RNA, 18 nt, Human
uggggaggggcagugugg

SEQ ID NO: 242223 - RNA, 19 nt, Human
uggggggcugcaagaggaa

SEQ ID NO: 242224 - RNA, 22 nt, Human
uggguuucacuagucuucccac

SEQ ID NO: 242225 - RNA, 24 nt, Human
uggugcgaucucagcucacuacaa

SEQ ID NO: 242226 - RNA, 24 nt, Human
uguagagacgggguuucaccaugu

SEQ ID NO: 242227 - RNA, 24 nt, Human
uguccaggcuggucucaaacuccu

SEQ ID NO: 242228 - RNA, 18 nt, Human
uguugcccaggcuggagu

SEQ ID NO: 242229 - RNA, 20 nt, Human
uguugggggagggacugagg

SEQ ID NO: 242230 - RNA, 22 nt, Human
uugagacaggauuuugcuaugu

SEQ ID NO: 242231 - RNA, 24 nt, Human
uugcccaggcuggagugcaguggu

SEQ ID NO: 242232 - RNA, 21 nt, Human
uugcuauguugcccaggcugg

SEQ ID NO: 242233 - RNA, 22 nt, Human
uugcuauguugcccaggcugga

SEQ ID NO: 242234 - RNA, 19 nt, Human
uuggacucccaaagugcug

SEQ ID NO: 242235 - RNA, 24 nt, Human
uuguagagacgggguuucaccaug

SEQ ID NO: 242236 - RNA, 22 nt, Human
uuucaccauguuguccaggcug

SEQ ID NO: 242237 - RNA, 23 nt, Human
uuucaccauguuguccaggcugg

SEQ ID NO: 242238 - RNA, 24 nt, Human
uuucaccauguuguccaggcuggu

SEQ ID NO: 242239 - RNA, 22 nt, Human
uuugaauccugggaggguuugg

SEQ ID NO: 242240 - RNA, 18 nt, Human
uuugcagauauauaauau

SEQ ID NO: 242241 - RNA, 18 nt, Human
uuuguagagacgggguuu

SEQ ID NO: 242242 - RNA, 24 nt, Human
uuuguagagacgggguuucaccau

SEQ ID NO: 242243 - RNA, 18 nt, Human
uuuguuguugcucuccgg

SEQ ID NO: 242244 - RNA, 24 nt, Human
uuuuaguuucggaaggccaggcac

SEQ ID NO: 242245 - RNA, 23 nt, Human
uuuugcuauguugcccaggcugg

SEQ ID NO: 242246 - RNA, 24 nt, Human
uuuugcuauguugcccaggcugga

SEQ ID NO: 242247 - RNA, 22 nt, Human
uuuuggucccaacacaaccacu

SEQ ID NO: 242248 - RNA, 20 nt, Human
uuuuuguauuuuuuguagag

SEQ ID NO: 242249 - RNA, 23 nt, Human
uuuuuguauuuuuuguagagacg

SEQ ID NO: 242250 - RNA, 24 nt, Human
uuuuuucuguggaaaaagaaagaa

SEQ ID NO: 242251 - RNA, 22 nt, Human
uuuuuuguagagacgggguuuc

SEQ ID NO: 242252 - RNA, 24 nt, Human
uuuuuuguagagacgggguuucac

SEQ ID NO: 242253 - RNA, 22 nt, Human
aagggcucagcccggcgccccu

SEQ ID NO: 242254 - RNA, 19 nt, Human
agaaggguggggaagagag

SEQ ID NO: 242255 - RNA, 23 nt, Human
agagaagagaaggaaacagaggg

SEQ ID NO: 242256 - RNA, 21 nt, Human
aggaaagagaagagaaggaaa

SEQ ID NO: 242257 - RNA, 26 nt, Human
aggaaggcaggcgcaagacaaggggc

SEQ ID NO: 242258 - RNA, 19 nt, Human
agggaggaaagagaagaga

SEQ ID NO: 242259 - RNA, 21 nt, Human
agggcucagcccggcgccccu

SEQ ID NO: 242260 - RNA, 20 nt, Human
cacccugccccuagagaacc

SEQ ID NO: 242261 - RNA, 22 nt, Human
caggcgcaagacaaggggcagg

SEQ ID NO: 242262 - RNA, 20 nt, Human
ccaugugccuaguggccccg

SEQ ID NO: 242263 - RNA, 20 nt, Human
ccccuagagaaccagguggg

SEQ ID NO: 242264 - RNA, 19 nt, Human
ccccugggguacagguugu

SEQ ID NO: 242265 - RNA, 20 nt, Human
cccgcaaagacccgccuggg

SEQ ID NO: 242266 - RNA, 23 nt, Human
cgacgacaaugacgagaucagaa

SEQ ID NO: 242267 - RNA, 20 nt, Human
cgcaaagacccgccugggca

SEQ ID NO: 242268 - RNA, 22 nt, Human
cuccucauccgucagcuggugc

SEQ ID NO: 242269 - RNA, 24 nt, Human
gagcaggcgcucucugauaggagg

SEQ ID NO: 242270 - RNA, 20 nt, Human
gaggucaggaaggucugacg

SEQ ID NO: 242271 - RNA, 19 nt, Human
gauuagaaggaauaagacg

SEQ ID NO: 242272 - RNA, 20 nt, Human
ggaaacagagggacagugca

SEQ ID NO: 242273 - RNA, 21 nt, Human
ggaaggcaggcgcaagacaag

SEQ ID NO: 242274 - RNA, 21 nt, Human
gucauaacccgggggcacagc

SEQ ID NO: 242275 - RNA, 19 nt, Human
uaacccgggggcacagcga

SEQ ID NO: 242276 - RNA, 24 nt, Human
uacgaucgggcauccgucuuggac

SEQ ID NO: 242277 - RNA, 22 nt, Human
ucauccgucagcuggugccauu

SEQ ID NO: 242278 - RNA, 23 nt, Human
ugcagccaaauucgccaugugcc

SEQ ID NO: 242279 - RNA, 19 nt, Human
uggacuuuacuauugugau

SEQ ID NO: 242280 - RNA, 19 nt, Human
ugggaggucaggaaggucu

SEQ ID NO: 242281 - RNA, 20 nt, Human
uggugccauucucacccggc

SEQ ID NO: 242282 - RNA, 19 nt, Human
uugcagggaagagagaagg

SEQ ID NO: 242283 - RNA, 18 nt, Human
uuugcagggaagagagaa

SEQ ID NO: 242284 - RNA, 18 nt, Human
aagaacaacaagugcccc

SEQ ID NO: 242285 - RNA, 19 nt, Human
aagaacaacaagugccccc

SEQ ID NO: 242286 - RNA, 20 nt, Human
caagugcccccgcgccgccc

SEQ ID NO: 242287 - RNA, 20 nt, Human
ccccucggccgccgccgccg

SEQ ID NO: 242288 - RNA, 21 nt, Human
cccgcgccgcccgccgccacc

SEQ ID NO: 242289 - RNA, 18 nt, Human
cccucggccgccgccgcc

SEQ ID NO: 242290 - RNA, 23 nt, Human
ccgccgccuggcgcucgggcucc

SEQ ID NO: 242291 - RNA, 20 nt, Human
ccucggccgccgccgccgcc

SEQ ID NO: 242292 - RNA, 21 nt, Human
cucacugucgcgcuccccucg

SEQ ID NO: 242293 - RNA, 18 nt, Human
gccgccgccuggcgcucg

SEQ ID NO: 242294 - RNA, 18 nt, Human
gcgccggcgcucacuguc

SEQ ID NO: 242295 - RNA, 21 nt, Human
gcggcggcuccucgcgggcac

SEQ ID NO: 242296 - RNA, 19 nt, Human
gcucacugucgcgcucccc

SEQ ID NO: 242297 - RNA, 20 nt, Human
gggcgcgggcgcgcggcggc

SEQ ID NO: 242298 - RNA, 24 nt, Human
uccccucggccgccgccgccgccu

SEQ ID NO: 242299 - RNA, 24 nt, Human
ugcccccgcgccgcccgccgccac

SEQ ID NO: 242300 - RNA, 21 nt, Human
uggaacucguagcuggcgucg

SEQ ID NO: 242301 - RNA, 23 nt, Human
aaauaacacggacagacagagcu

SEQ ID NO: 242302 - RNA, 23 nt, Human
aaauaacacggacagacagagcu

SEQ ID NO: 242303 - RNA, 21 nt, Human
acagagcuccccuccagacag

SEQ ID NO: 242304 - RNA, 21 nt, Human
acagagcuccccuccagacag

SEQ ID NO: 242305 - RNA, 22 nt, Human
accccgaaggcccagcagccuc

SEQ ID NO: 242306 - RNA, 21 nt, Human
accugccucacuccccuccug

SEQ ID NO: 242307 - RNA, 18 nt, Human
agaucccaggcgccucuc

SEQ ID NO: 242308 - RNA, 23 nt, Human
agccagugggggccagcgagggu

SEQ ID NO: 242309 - RNA, 23 nt, Human
agccagugggggccagcgagggu

SEQ ID NO: 242310 - RNA, 26 nt, Human
aggcaggaaguagcaauaaagggacc

SEQ ID NO: 242311 - RNA, 27 nt, Human
aggcaggaaguagcaauaaagggaccc

SEQ ID NO: 242312 - RNA, 23 nt, Human
aggcccagcagccuccucucaga

SEQ ID NO: 242313 - RNA, 22 nt, Human
agguccagcucugggggcucac

SEQ ID NO: 242314 - RNA, 19 nt, Human
auuucagcauacucagcua

SEQ ID NO: 242315 - RNA, 22 nt, Human
caccugccucacuccccuccug

SEQ ID NO: 242316 - RNA, 21 nt, Human
cacuccccuccugccccagcc

SEQ ID NO: 242317 - RNA, 21 nt, Human
cacuccccuccugccccagcc

SEQ ID NO: 242318 - RNA, 18 nt, Human
cagagcuccccuccagac

SEQ ID NO: 242319 - RNA, 18 nt, Human
cagagcuccccuccagac

SEQ ID NO: 242320 - RNA, 21 nt, Human
cagcagccuccucucagaucc

SEQ ID NO: 242321 - RNA, 19 nt, Human
cagcuccuucacuugaccc

SEQ ID NO: 242322 - RNA, 21 nt, Human
cagcuccuucacuugacccgg

SEQ ID NO: 242323 - RNA, 22 nt, Human
cagguccagcucugggggcuca

SEQ ID NO: 242324 - RNA, 22 nt, Human
ccagcccagcucgcaguccccu

SEQ ID NO: 242325 - RNA, 20 nt, Human
ccagcucgcaguccccugcc

SEQ ID NO: 242326 - RNA, 19 nt, Human
ccccagggccagguguggg

SEQ ID NO: 242327 - RNA, 19 nt, Human
ccccagggccagguguggg

SEQ ID NO: 242328 - RNA, 22 nt, Human
cccccagcuccuucacuugacc

SEQ ID NO: 242329 - RNA, 23 nt, Human
cccccagcuccuucacuugaccc

SEQ ID NO: 242330 - RNA, 19 nt, Human
cccccaggaccucacuguc

SEQ ID NO: 242331 - RNA, 20 nt, Human
cccccaggaccucacuguca

SEQ ID NO: 242332 - RNA, 20 nt, Human
cccccaggaccucacuguca

SEQ ID NO: 242333 - RNA, 21 nt, Human
cccccaggaccucacugucac

SEQ ID NO: 242334 - RNA, 21 nt, Human
cccccaggaccucacugucac

SEQ ID NO: 242335 - RNA, 22 nt, Human
cccccaggaccucacugucacc

SEQ ID NO: 242336 - RNA, 22 nt, Human
cccccaggaccucacugucacc

SEQ ID NO: 242337 - RNA, 23 nt, Human
cccccaggaccucacugucaccu

SEQ ID NO: 242338 - RNA, 23 nt, Human
cccccaggaccucacugucaccu

SEQ ID NO: 242339 - RNA, 25 nt, Human
cccccaggaccucacugucaccugc

SEQ ID NO: 242340 - RNA, 25 nt, Human
cccccaggaccucacugucaccugc

SEQ ID NO: 242341 - RNA, 20 nt, Human
cccccaggaccucacugucc

SEQ ID NO: 242342 - RNA, 23 nt, Human
cccuccugccccagcccccgaua

SEQ ID NO: 242343 - RNA, 23 nt, Human
cccuccugccccagcccccgaua

SEQ ID NO: 242344 - RNA, 23 nt, Human
ccgaaggcccagcagccuccucu

SEQ ID NO: 242345 - RNA, 22 nt, Human
ccucacuccccuccugccccag

SEQ ID NO: 242346 - RNA, 22 nt, Human
ccucacuccccuccugccccag

SEQ ID NO: 242347 - RNA, 22 nt, Human
ccuccagacagaugaggguaaa

SEQ ID NO: 242348 - RNA, 22 nt, Human
ccuccagacagaugaggguaaa

SEQ ID NO: 242349 - RNA, 24 nt, Human
cggacagacagagcuccccuccag

SEQ ID NO: 242350 - RNA, 24 nt, Human
cggacagacagagcuccccuccag

SEQ ID NO: 242351 - RNA, 23 nt, Human
cuccugccccagcccccgauacu

SEQ ID NO: 242352 - RNA, 23 nt, Human
cuccugccccagcccccgauacu

SEQ ID NO: 242353 - RNA, 19 nt, Human
cuuuuguacaggccccagg

SEQ ID NO: 242354 - RNA, 19 nt, Human
cuuuuguacaggccccagg

SEQ ID NO: 242355 - RNA, 20 nt, Human
gaaggagggggaggucaggc

SEQ ID NO: 242356 - RNA, 20 nt, Human
gaaggagggggaggucaggc

SEQ ID NO: 242357 - RNA, 20 nt, Human
gcagcugggaaggaggggga

SEQ ID NO: 242358 - RNA, 20 nt, Human
gcagcugggaaggaggggga

SEQ ID NO: 242359 - RNA, 19 nt, Human
gcuggcagggaggggcagc

SEQ ID NO: 242360 - RNA, 19 nt, Human
gcuggcagggaggggcagc

SEQ ID NO: 242361 - RNA, 22 nt, Human
gcuggcagggaggggcagcugg

SEQ ID NO: 242362 - RNA, 22 nt, Human
gcuggcagggaggggcagcugg

SEQ ID NO: 242363 - RNA, 25 nt, Human
ggauuucagcauacucagcuagcuc

SEQ ID NO: 242364 - RNA, 21 nt, Human
ggcaggagaccaggcaggaag

SEQ ID NO: 242365 - RNA, 21 nt, Human
ggcaggagaccaggcaggaag

SEQ ID NO: 242366 - RNA, 22 nt, Human
gggcgugggggugcuggcaggg

SEQ ID NO: 242367 - RNA, 22 nt, Human
gggcgugggggugcuggcaggg

SEQ ID NO: 242368 - RNA, 21 nt, Human
guguagcuguccuuggugggc

SEQ ID NO: 242369 - RNA, 19 nt, Human
uaaaggagguuagagagga

SEQ ID NO: 242370 - RNA, 19 nt, Human
uaaaggagguuagagagga

SEQ ID NO: 242371 - RNA, 25 nt, Human
uaacacggacagacagagcuccccu

SEQ ID NO: 242372 - RNA, 25 nt, Human
uaacacggacagacagagcuccccu

SEQ ID NO: 242373 - RNA, 20 nt, Human
uacuuuugggaggaagggag

SEQ ID NO: 242374 - RNA, 20 nt, Human
uacuuuugggaggaagggag

SEQ ID NO: 242375 - RNA, 19 nt, Human
ucccaggcgccucucgcuc

SEQ ID NO: 242376 - RNA, 19 nt, Human
ucucagaucccaggcgccu

SEQ ID NO: 242377 - RNA, 18 nt, Human
ucugggggcucaccccga

SEQ ID NO: 242378 - RNA, 26 nt, Human
ucuucuggguccaccugaagccgcca

SEQ ID NO: 242379 - RNA, 19 nt, Human
ugagggcgugggggugcug

SEQ ID NO: 242380 - RNA, 19 nt, Human
ugagggcgugggggugcug

SEQ ID NO: 242381 - RNA, 20 nt, Human
ugccccagcccccgauacuu

SEQ ID NO: 242382 - RNA, 21 nt, Human
ugccccagcccccgauacuuu

SEQ ID NO: 242383 - RNA, 25 nt, Human
ugcccccagcuccuucacuugaccc

SEQ ID NO: 242384 - RNA, 23 nt, Human
ugccucacuccccuccugcccca

SEQ ID NO: 242385 - RNA, 23 nt, Human
ugccucacuccccuccugcccca

SEQ ID NO: 242386 - RNA, 25 nt, Human
ugccucacuccccuccugccccagc

SEQ ID NO: 242387 - RNA, 25 nt, Human
ugccucacuccccuccugccccagc

SEQ ID NO: 242388 - RNA, 19 nt, Human
uggcagggaggggcagcug

SEQ ID NO: 242389 - RNA, 20 nt, Human
uggcagggaggggcagcugg

SEQ ID NO: 242390 - RNA, 22 nt, Human
ugggaggaagggagcccacagc

SEQ ID NO: 242391 - RNA, 22 nt, Human
ugggaggaagggagcccacagc

SEQ ID NO: 242392 - RNA, 21 nt, Human
aacacagugaagaaucugucu

SEQ ID NO: 242393 - RNA, 21 nt, Human
aacacagugaagaaucugucu

SEQ ID NO: 242394 - RNA, 21 nt, Human
aaccucgcuucucccucgugc

SEQ ID NO: 242395 - RNA, 21 nt, Human
agcaagguucucaccucccuu

SEQ ID NO: 242396 - RNA, 18 nt, Human
cccacugugucuguagaa

SEQ ID NO: 242397 - RNA, 19 nt, Human
ccccugagaaccuggacuc

SEQ ID NO: 242398 - RNA, 21 nt, Human
ccgaucucaagccugucccuc

SEQ ID NO: 242399 - RNA, 22 nt, Human
ccuccucacagagccugggccc

SEQ ID NO: 242400 - RNA, 18 nt, Human
gagaaccuggacucuugu

SEQ ID NO: 242401 - RNA, 22 nt, Human
gggcaggacuugggcgaugggg

SEQ ID NO: 242402 - RNA, 19 nt, Human
ggugggagugugggcagga

SEQ ID NO: 242403 - RNA, 18 nt, Human
ucaggguagcagguggga

SEQ ID NO: 242404 - RNA, 19 nt, Human
ucccucagaacgagaaccu

SEQ ID NO: 242405 - RNA, 20 nt, Human
ucccucagaacgagaaccuc

SEQ ID NO: 242406 - RNA, 18 nt, Human
ucccuugccuccucacaa

SEQ ID NO: 242407 - RNA, 21 nt, Human
ucucaccucccuugccuccuc

SEQ ID NO: 242408 - RNA, 22 nt, Human
ucucccuguccccugagaaccu

SEQ ID NO: 242409 - RNA, 19 nt, Human
ucugagagcaagguucuca

SEQ ID NO: 242410 - RNA, 20 nt, Human
uggggacccacaggcagguc

SEQ ID NO: 242411 - RNA, 18 nt, Human
ugguauuugacuugccuu

SEQ ID NO: 242412 - RNA, 25 nt, Human
uggugucccacagcucuugaccucu

SEQ ID NO: 242413 - RNA, 18 nt, Human
uugggcgauggggaccca

SEQ ID NO: 242414 - RNA, 23 nt, Human
aaacucacuacuaacaauacuga

SEQ ID NO: 242415 - RNA, 19 nt, Human
aacacucuuacuccuaaac

SEQ ID NO: 242416 - RNA, 21 nt, Human
aaccauccguuaaaaggaaca

SEQ ID NO: 242417 - RNA, 25 nt, Human
aaccuugccuccucacggagccugg

SEQ ID NO: 242418 - RNA, 23 nt, Human
aagaagccaaggauauccaggua

SEQ ID NO: 242419 - RNA, 21 nt, Human
aagccaaggauauccagguau

SEQ ID NO: 242420 - RNA, 19 nt, Human
agacccccucccacuggcc

SEQ ID NO: 242421 - RNA, 18 nt, Human
agauaaaucucaaaguca

SEQ ID NO: 242422 - RNA, 18 nt, Human
agcacuaugugugacuac

SEQ ID NO: 242423 - RNA, 22 nt, Human
agccugcgccugcuucccucca

SEQ ID NO: 242424 - RNA, 23 nt, Human
cacaauucacaaaauggaaugga

SEQ ID NO: 242425 - RNA, 23 nt, Human
cacuggcccagacccccucccac

SEQ ID NO: 242426 - RNA, 22 nt, Human
caggaaacaaagauaaaucuca

SEQ ID NO: 242427 - RNA, 18 nt, Human
ccacuggcccuggcugca

SEQ ID NO: 242428 - RNA, 19 nt, Human
ccagacccccucccacugg

SEQ ID NO: 242429 - RNA, 21 nt, Human
cuaaacuauauaaacagcacu

SEQ ID NO: 242430 - RNA, 24 nt, Human
cuaacaauacugacugcucucuuc

SEQ ID NO: 242431 - RNA, 23 nt, Human
cugacugcucucuucaaagagug

SEQ ID NO: 242432 - RNA, 25 nt, Human
ggcaggagcuagugcugcuccgggg

SEQ ID NO: 242433 - RNA, 25 nt, Human
gggcagcagguaggagugugggcaa

SEQ ID NO: 242434 - RNA, 26 nt, Human
gggcaggagcuagugcugcuccgggg

SEQ ID NO: 242435 - RNA, 20 nt, Human
gggccugucuccucagaacc

SEQ ID NO: 242436 - RNA, 22 nt, Human
uaaggcaagaauuaaguaucuu

SEQ ID NO: 242437 - RNA, 23 nt, Human
uagaacagaaacucacuacuaac

SEQ ID NO: 242438 - RNA, 26 nt, Human
uagaacagaaacucacuacuaacaau

SEQ ID NO: 242439 - RNA, 20 nt, Human
uauaaacagcacuaugugug

SEQ ID NO: 242440 - RNA, 24 nt, Human
uauuuuacugcuaauucuuucaca

SEQ ID NO: 242441 - RNA, 21 nt, Human
ugugggcaggagcuagugcug

SEQ ID NO: 242442 - RNA, 22 nt, Human
uugaggucuuuaucucauguau

SEQ ID NO: 242443 - RNA, 24 nt, Human
uugccuccucacggagccugcgcc

SEQ ID NO: 242444 - RNA, 20 nt, Human
uuuuucaaauuuacagaaua

SEQ ID NO: 242445 - RNA, 27 nt, Human
uuuuuccacugcuguuauuugucacaa

SEQ ID NO: 242446 - RNA, 22 nt, Human
aaaacaggacucuuaccccuaa

SEQ ID NO: 242447 - RNA, 25 nt, Human
aaaacaggacucuuaccccuaaacc

SEQ ID NO: 242448 - RNA, 22 nt, Human
aacaggacucuuaccccuaaac

SEQ ID NO: 242449 - RNA, 21 nt, Human
aaccauuuguuaaaaggaaca

SEQ ID NO: 242450 - RNA, 23 nt, Human
accccuaaacuauauaaacagca

SEQ ID NO: 242451 - RNA, 22 nt, Human
acuggcccagacccccucccac

SEQ ID NO: 242452 - RNA, 25 nt, Human
agaacagaaacucacugcuaagaau

SEQ ID NO: 242453 - RNA, 18 nt, Human
agauaaaucucaaaguca

SEQ ID NO: 242454 - RNA, 18 nt, Human
agcacuaugugugacuac

SEQ ID NO: 242455 - RNA, 22 nt, Human
agccugcgccugcuucccuccg

SEQ ID NO: 242456 - RNA, 19 nt, Human
aggcaggagugcgggcagg

SEQ ID NO: 242457 - RNA, 18 nt, Human
auccaacagaacagaaac

SEQ ID NO: 242458 - RNA, 22 nt, Human
caggaaacaaagauaaaucuca

SEQ ID NO: 242459 - RNA, 19 nt, Human
caggcaggagugcgggcag

SEQ ID NO: 242460 - RNA, 18 nt, Human
ccacuggcccuggcugca

SEQ ID NO: 242461 - RNA, 19 nt, Human
ccagacccccucccacugg

SEQ ID NO: 242462 - RNA, 21 nt, Human
ccagacccccucccacuggcc

SEQ ID NO: 242463 - RNA, 20 nt, Human
ccuggcugcaacaugugcug

SEQ ID NO: 242464 - RNA, 23 nt, Human
ccuggcugcaacaugugcugaga

SEQ ID NO: 242465 - RNA, 21 nt, Human
cuaaacuauauaaacagcacu

SEQ ID NO: 242466 - RNA, 24 nt, Human
cucucuucaaagaggcaggaauug

SEQ ID NO: 242467 - RNA, 26 nt, Human
cugacugcucucuucaaagaggcagu

SEQ ID NO: 242468 - RNA, 20 nt, Human
cugcuaagaaugcugacugc

SEQ ID NO: 242469 - RNA, 19 nt, Human
gaagacccacaggccuugc

SEQ ID NO: 242470 - RNA, 19 nt, Human
gcaggagugcgggcaggag

SEQ ID NO: 242471 - RNA, 22 nt, Human
gccuccucacggagccugcgcc

SEQ ID NO: 242472 - RNA, 18 nt, Human
gcucucuucaaagaggca

SEQ ID NO: 242473 - RNA, 21 nt, Human
ggcagcaggcaggagugcggg

SEQ ID NO: 242474 - RNA, 25 nt, Human
gggcagcaggcaggagugcgggcaa

SEQ ID NO: 242475 - RNA, 19 nt, Human
uagacugagguauaaggca

SEQ ID NO: 242476 - RNA, 20 nt, Human
uauaaacagcacuaugugug

SEQ ID NO: 242477 - RNA, 25 nt, Human
uauuccacugcuguuauuaugugac

SEQ ID NO: 242478 - RNA, 24 nt, Human
uauuuuacugcuaauucguucaca

SEQ ID NO: 242479 - RNA, 24 nt, Human
ucucaaagucauccaacagaacag

SEQ ID NO: 242480 - RNA, 19 nt, Human
ugcuaagaaugcugacugc

SEQ ID NO: 242481 - RNA, 19 nt, Human
ugcuaagaaugcugacugc

SEQ ID NO: 242482 - RNA, 19 nt, Human
uggucagggcagcaggcag

SEQ ID NO: 242483 - RNA, 19 nt, Human
uuggaugcugaaguucauc

SEQ ID NO: 242484 - RNA, 22 nt, Human
aacaacuccaacaggaaacaaa

SEQ ID NO: 242485 - RNA, 21 nt, Human
aaccauccguuaaaaggaaca

SEQ ID NO: 242486 - RNA, 21 nt, Human
aaccuugccuccucaccgagc

SEQ ID NO: 242487 - RNA, 25 nt, Human
aaccuugccuccucaccgagccugg

SEQ ID NO: 242488 - RNA, 24 nt, Human
aauaaucucaaagucauccaacag

SEQ ID NO: 242489 - RNA, 27 nt, Human
agaacagaaacccacuacuaagaaugc

SEQ ID NO: 242490 - RNA, 21 nt, Human
agaagucaaggaaauccuggu

SEQ ID NO: 242491 - RNA, 23 nt, Human
agaauagauugagguacaaggca

SEQ ID NO: 242492 - RNA, 18 nt, Human
agcacuaugugugacuac

SEQ ID NO: 242493 - RNA, 19 nt, Human
aggaaauccugguuugcau

SEQ ID NO: 242494 - RNA, 24 nt, Human
caacaggaaacaaagaauaaucuc

SEQ ID NO: 242495 - RNA, 23 nt, Human
caacuccaacaggaaacaaagaa

SEQ ID NO: 242496 - RNA, 27 nt, Human
caacuccaacaggaaacaaagaauaau

SEQ ID NO: 242497 - RNA, 23 nt, Human
cacaauucacaaaauggaaugga

SEQ ID NO: 242498 - RNA, 23 nt, Human
cacuggcccagacccccucccac

SEQ ID NO: 242499 - RNA, 20 nt, Human
cagaauagauugagguacaa

SEQ ID NO: 242500 - RNA, 20 nt, Human
ccaacagaacagaaacccac

SEQ ID NO: 242501 - RNA, 18 nt, Human
ccacuggcccuggcugca

SEQ ID NO: 242502 - RNA, 19 nt, Human
ccagacccccucccacugg

SEQ ID NO: 242503 - RNA, 21 nt, Human
ccagacccccucccacuggcc

SEQ ID NO: 242504 - RNA, 19 nt, Human
ccccggaaggugcacuggc

SEQ ID NO: 242505 - RNA, 24 nt, Human
cccucagaaccuugccuccucacc

SEQ ID NO: 242506 - RNA, 19 nt, Human
ccuccgggggccucugguc

SEQ ID NO: 242507 - RNA, 21 nt, Human
cuaaacuauauaaacagcacu

SEQ ID NO: 242508 - RNA, 18 nt, Human
cuggcagaucuucuccuu

SEQ ID NO: 242509 - RNA, 18 nt, Human
cugggcaauggagaccca

SEQ ID NO: 242510 - RNA, 22 nt, Human
gcauucucaaagaagucaagga

SEQ ID NO: 242511 - RNA, 26 nt, Human
gcggccccggaaggugcacuggccca

SEQ ID NO: 242512 - RNA, 20 nt, Human
gcgggagugugggcaggagc

SEQ ID NO: 242513 - RNA, 21 nt, Human
ggcgggagugugggcaggagc

SEQ ID NO: 242514 - RNA, 20 nt, Human
gggcaauggagacccacugg

SEQ ID NO: 242515 - RNA, 22 nt, Human
gggcaggagcugggcaauggag

SEQ ID NO: 242516 - RNA, 19 nt, Human
ggggccucugguccuccag

SEQ ID NO: 242517 - RNA, 22 nt, Human
uaaaaaacaagacucuuacucc

SEQ ID NO: 242518 - RNA, 25 nt, Human
uaaaaaacaagacucuuacuccuaa

SEQ ID NO: 242519 - RNA, 19 nt, Human
uacuaagaaugcugacugc

SEQ ID NO: 242520 - RNA, 21 nt, Human
uacuaagaaugcugacugcuc

SEQ ID NO: 242521 - RNA, 20 nt, Human
uauaaacagcacuaugugug

SEQ ID NO: 242522 - RNA, 18 nt, Human
ucaaagaagucaaggaaa

SEQ ID NO: 242523 - RNA, 18 nt, Human
ucaccgagccugggccgg

SEQ ID NO: 242524 - RNA, 23 nt, Human
ucagugcuccuccgggggccucu

SEQ ID NO: 242525 - RNA, 23 nt, Human
uccccucagaaccuugccuccuc

SEQ ID NO: 242526 - RNA, 24 nt, Human
ucgcucguugcucagggcgagaau

SEQ ID NO: 242527 - RNA, 24 nt, Human
ucucaaagucauccaacagaacag

SEQ ID NO: 242528 - RNA, 21 nt, Human
ugggcaggagcugggcaaugg

SEQ ID NO: 242529 - RNA, 19 nt, Human
uggucagggcaacaggcgg

SEQ ID NO: 242530 - RNA, 24 nt, Human
ugguccuccaggucagccuguccc

SEQ ID NO: 242531 - RNA, 21 nt, Human
uucuccuucagugcuccuccg

SEQ ID NO: 242532 - RNA, 23 nt, Human
uuugaacaacuccaacaggaaac

SEQ ID NO: 242533 - RNA, 24 nt, Human
uuugauuucuugaguuaucucaug

SEQ ID NO: 242534 - RNA, 28 nt, Human
uuuuuuuuuuuuuuuuuuuuuuuggggg

SEQ ID NO: 242535 - RNA, 22 nt, Human
aaaacaagacucuuacuccuaa

SEQ ID NO: 242536 - RNA, 19 nt, Human
aaacccacuacuaagaaca

SEQ ID NO: 242537 - RNA, 21 nt, Human
aagccaaggaaauccagguau

SEQ ID NO: 242538 - RNA, 22 nt, Human
aggcagaucuucuccuuggugc

SEQ ID NO: 242539 - RNA, 19 nt, Human
augucccaaauucacaaaa

SEQ ID NO: 242540 - RNA, 21 nt, Human
caaucugaauaaaaaacaaga

SEQ ID NO: 242541 - RNA, 21 nt, Human
cacagggccuggccugcuucc

SEQ ID NO: 242542 - RNA, 21 nt, Human
cacuucuaaauacuuacuccu

SEQ ID NO: 242543 - RNA, 24 nt, Human
cagagauaaaucuccaagucaucc

SEQ ID NO: 242544 - RNA, 19 nt, Human
cagcaggcaagagugcagg

SEQ ID NO: 242545 - RNA, 25 nt, Human
caggcagaucuucuccuuggugcuc

SEQ ID NO: 242546 - RNA, 21 nt, Human
ccaaucccaagcugcugguca

SEQ ID NO: 242547 - RNA, 21 nt, Human
cccaaauucacaaaauagaac

SEQ ID NO: 242548 - RNA, 21 nt, Human
ccuuccccacagcccuggcug

SEQ ID NO: 242549 - RNA, 19 nt, Human
cuccaagucauccaacaaa

SEQ ID NO: 242550 - RNA, 18 nt, Human
cucugcucagggcagcag

SEQ ID NO: 242551 - RNA, 22 nt, Human
cucuguggccuccagggaaucc

SEQ ID NO: 242552 - RNA, 18 nt, Human
cugggcaauggggaccca

SEQ ID NO: 242553 - RNA, 20 nt, Human
cuuccaccaaucccaagcug

SEQ ID NO: 242554 - RNA, 23 nt, Human
cuuccccacagcccuggcugcaa

SEQ ID NO: 242555 - RNA, 22 nt, Human
gaauccuguccuccgguuggcc

SEQ ID NO: 242556 - RNA, 18 nt, Human
gcucagggcagcaggcaa

SEQ ID NO: 242557 - RNA, 21 nt, Human
gggacccacaggcagaucuuc

SEQ ID NO: 242558 - RNA, 23 nt, Human
gugcuccucuguggccuccaggg

SEQ ID NO: 242559 - RNA, 22 nt, Human
uaaaaaacaagacucuuacucc

SEQ ID NO: 242560 - RNA, 23 nt, Human
uaaaaggaacauuucaacaauug

SEQ ID NO: 242561 - RNA, 18 nt, Human
ucacagggccuggccugc

SEQ ID NO: 242562 - RNA, 18 nt, Human
ucagaaccuugacuccuc

SEQ ID NO: 242563 - RNA, 22 nt, Human
ucccaaauucacaaaauagaac

SEQ ID NO: 242564 - RNA, 20 nt, Human
uggcccagcccugccccuuc

SEQ ID NO: 242565 - RNA, 23 nt, Human
uuuuuuuuuuuuuuuuuuaacag

SEQ ID NO: 242566 - RNA, 21 nt, Human
aaaaaccuuaauccucugcuc

SEQ ID NO: 242567 - RNA, 18 nt, Human
aaaaccuuaauccucugc

SEQ ID NO: 242568 - RNA, 23 nt, Human
aagaagccaagcaaauucaggua

SEQ ID NO: 242569 - RNA, 20 nt, Human
aagccgaccccucagaaccg

SEQ ID NO: 242570 - RNA, 23 nt, Human
aaggaaacaaagauaaaccucca

SEQ ID NO: 242571 - RNA, 24 nt, Human
aagugguggauguggcccuggaac

SEQ ID NO: 242572 - RNA, 20 nt, Human
acaaagauaaaccuccaaau

SEQ ID NO: 242573 - RNA, 22 nt, Human
acagacccugagcccgcuuccc

SEQ ID NO: 242574 - RNA, 23 nt, Human
accuugccuccucacagacccug

SEQ ID NO: 242575 - RNA, 18 nt, Human
agagaugguccacacugu

SEQ ID NO: 242576 - RNA, 27 nt, Human
agagaugguccacacuguguucccuca

SEQ ID NO: 242577 - RNA, 23 nt, Human
agagugugggccggagcugggca

SEQ ID NO: 242578 - RNA, 22 nt, Human
agauaaaccuccaaaucgccca

SEQ ID NO: 242579 - RNA, 22 nt, Human
agcaagacucuuacuccuaaac

SEQ ID NO: 242580 - RNA, 21 nt, Human
agccgaucucaagccgacccc

SEQ ID NO: 242581 - RNA, 23 nt, Human
aggagagugugggccggagcugg

SEQ ID NO: 242582 - RNA, 21 nt, Human
aggcccucccacaaccugccc

SEQ ID NO: 242583 - RNA, 22 nt, Human
cacaaccugccccacuggcccu

SEQ ID NO: 242584 - RNA, 21 nt, Human
cacuggcccaggcccucccac

SEQ ID NO: 242585 - RNA, 21 nt, Human
cagacccugagcccgcuuccc

SEQ ID NO: 242586 - RNA, 21 nt, Human
caggagagugugggccggagc

SEQ ID NO: 242587 - RNA, 23 nt, Human
caggcaggucuucuucagugcuu

SEQ ID NO: 242588 - RNA, 18 nt, Human
cauucucaaagaagccaa

SEQ ID NO: 242589 - RNA, 23 nt, Human
cccaggcccucccacaaccugcc

SEQ ID NO: 242590 - RNA, 22 nt, Human
cccaguauaaaugaaaagcaag

SEQ ID NO: 242591 - RNA, 22 nt, Human
cccucccacaaccugccccacu

SEQ ID NO: 242592 - RNA, 25 nt, Human
ccgaucucaagccgaccccucagaa

SEQ ID NO: 242593 - RNA, 22 nt, Human
ccucacacccaacaugcucccc

SEQ ID NO: 242594 - RNA, 21 nt, Human
ccucacagacccugagcccgc

SEQ ID NO: 242595 - RNA, 22 nt, Human
ccucccacaaccugccccacug

SEQ ID NO: 242596 - RNA, 21 nt, Human
ccugccccacuggcccuagcc

SEQ ID NO: 242597 - RNA, 24 nt, Human
cgaucucaagccgaccccucagaa

SEQ ID NO: 242598 - RNA, 22 nt, Human
cucacacccaacaugcucccca

SEQ ID NO: 242599 - RNA, 21 nt, Human
cuccaaaucgcccaauagaac

SEQ ID NO: 242600 - RNA, 20 nt, Human
cucccacaaccugccccacu

SEQ ID NO: 242601 - RNA, 24 nt, Human
cuccugaccuccuggcuggccugu

SEQ ID NO: 242602 - RNA, 19 nt, Human
cuuuaugucuuuaucucau

SEQ ID NO: 242603 - RNA, 21 nt, Human
gaacaauuccaaaaggaaaca

SEQ ID NO: 242604 - RNA, 19 nt, Human
gacccugagcccgcuuccc

SEQ ID NO: 242605 - RNA, 18 nt, Human
gagagaugguccacacug

SEQ ID NO: 242606 - RNA, 20 nt, Human
gcaggucuucuucagugcuu

SEQ ID NO: 242607 - RNA, 18 nt, Human
gggcagcaggagagugug

SEQ ID NO: 242608 - RNA, 23 nt, Human
gggccggagcugggcaauugaga

SEQ ID NO: 242609 - RNA, 20 nt, Human
uaaaccuccaaaucgcccaa

SEQ ID NO: 242610 - RNA, 21 nt, Human
uaacagagcagggaaaguggu

SEQ ID NO: 242611 - RNA, 24 nt, Human
uaacagagcagggaaaguggugga

SEQ ID NO: 242612 - RNA, 20 nt, Human
uaacauggguuucccaguau

SEQ ID NO: 242613 - RNA, 20 nt, Human
uaaggcaagaauuaacuauu

SEQ ID NO: 242614 - RNA, 18 nt, Human
uccaaaaggaaacaaaga

SEQ ID NO: 242615 - RNA, 25 nt, Human
ucccaguauaaaugaaaagcaagac

SEQ ID NO: 242616 - RNA, 21 nt, Human
ucucaaagaagccaagcaaau

SEQ ID NO: 242617 - RNA, 22 nt, Human
ucucauguauuuuacugcuaug

SEQ ID NO: 242618 - RNA, 18 nt, Human
ucucuggggccuccugac

SEQ ID NO: 242619 - RNA, 18 nt, Human
ucucuucaaacacagagu

SEQ ID NO: 242620 - RNA, 20 nt, Human
ucuggggccuccugaccucc

SEQ ID NO: 242621 - RNA, 20 nt, Human
ugaaaagcaagacucuuacu

SEQ ID NO: 242622 - RNA, 21 nt, Human
ugacucaggucagggcagcag

SEQ ID NO: 242623 - RNA, 23 nt, Human
ugcuauguuguuucacauuucua

SEQ ID NO: 242624 - RNA, 18 nt, Human
uggaacgugcacuggccc

SEQ ID NO: 242625 - RNA, 19 nt, Human
uggaacgugcacuggccca

SEQ ID NO: 242626 - RNA, 22 nt, Human
uggcccaggcccucccacaacc

SEQ ID NO: 242627 - RNA, 23 nt, Human
ugguggauguggcccuggaacgu

SEQ ID NO: 242628 - RNA, 22 nt, Human
uucauucucaaagaagccaagc

SEQ ID NO: 242629 - RNA, 23 nt, Human
uuucuaaaaaaaccuuaauccuc

SEQ ID NO: 242630 - RNA, 21 nt, Human
uuuuuuuuuuucagggggacu

SEQ ID NO: 242631 - RNA, 30 nt, Human
uuuuuuuuuuuuuuuuuuuuuuuucagggg

SEQ ID NO: 242632 - RNA, 22 nt, Human
aaaaaauuauuaauuccucugc

SEQ ID NO: 242633 - RNA, 23 nt, Human
aagaagccaagcaaauccaggua

SEQ ID NO: 242634 - RNA, 24 nt, Human
accauuaaaagaacauuugaacaa

SEQ ID NO: 242635 - RNA, 20 nt, Human
acccaauagacaaggaaccc

SEQ ID NO: 242636 - RNA, 18 nt, Human
agaaccuucacugcugac

SEQ ID NO: 242637 - RNA, 22 nt, Human
agaaccuucacugcugacacug

SEQ ID NO: 242638 - RNA, 22 nt, Human
aggccugccugcuuccuggagc

SEQ ID NO: 242639 - RNA, 22 nt, Human
agggagcaaggauaaaucucca

SEQ ID NO: 242640 - RNA, 24 nt, Human
auaaaucuccaaaucacccaauag

SEQ ID NO: 242641 - RNA, 26 nt, Human
caaaucacccaauagacaaggaaccc

SEQ ID NO: 242642 - RNA, 23 nt, Human
caauagacaaggaacccagagau

SEQ ID NO: 242643 - RNA, 19 nt, Human
cagucaggagcgugggcag

SEQ ID NO: 242644 - RNA, 27 nt, Human
ccuccugguuagccugucccgagaacc

SEQ ID NO: 242645 - RNA, 22 nt, Human
ccucugcucugcgaccugagga

SEQ ID NO: 242646 - RNA, 27 nt, Human
ccugaccccacaaacuuuggccccggc

SEQ ID NO: 242647 - RNA, 24 nt, Human
cgagaaccuucacugcugacacug

SEQ ID NO: 242648 - RNA, 18 nt, Human
cgugggcaggagcugggc

SEQ ID NO: 242649 - RNA, 19 nt, Human
cucacuuccacccacugcc

SEQ ID NO: 242650 - RNA, 20 nt, Human
cuccaaaucacccaauagac

SEQ ID NO: 242651 - RNA, 21 nt, Human
cucccuucucucugaccccca

SEQ ID NO: 242652 - RNA, 18 nt, Human
cuccuguccuccugguua

SEQ ID NO: 242653 - RNA, 19 nt, Human
cugaccauuaaaagaacau

SEQ ID NO: 242654 - RNA, 19 nt, Human
cugagaacacugauugcuc

SEQ ID NO: 242655 - RNA, 22 nt, Human
cugauugcucucuucaaacaca

SEQ ID NO: 242656 - RNA, 26 nt, Human
cugcucuggggccucuuggggcuccu

SEQ ID NO: 242657 - RNA, 18 nt, Human
cuggagcuccuccaccgg

SEQ ID NO: 242658 - RNA, 18 nt, Human
cugggcgauggagaccca

SEQ ID NO: 242659 - RNA, 21 nt, Human
gaacaauuccaaaagggagca

SEQ ID NO: 242660 - RNA, 21 nt, Human
gaccauuaaaagaacauuuga

SEQ ID NO: 242661 - RNA, 20 nt, Human
gauaaaucuccaaaucaccc

SEQ ID NO: 242662 - RNA, 20 nt, Human
gggcagcagucaggagcgug

SEQ ID NO: 242663 - RNA, 25 nt, Human
gggcagcagucaggagcgugggcaa

SEQ ID NO: 242664 - RNA, 22 nt, Human
uaaauaacauaaacagcaauau

SEQ ID NO: 242665 - RNA, 22 nt, Human
uacaugcucaaagaagccaagc

SEQ ID NO: 242666 - RNA, 19 nt, Human
ucaggagcgugggcaggag

SEQ ID NO: 242667 - RNA, 23 nt, Human
ucagugcugcucuggggccucuu

SEQ ID NO: 242668 - RNA, 22 nt, Human
uccccaugugacucaaaagcaa

SEQ ID NO: 242669 - RNA, 25 nt, Human
uccucugcuauguuaucuuguccca

SEQ ID NO: 242670 - RNA, 18 nt, Human
ucucuucaaacacagagc

SEQ ID NO: 242671 - RNA, 24 nt, Human
ucuuggggcuccuguccuccuggg

SEQ ID NO: 242672 - RNA, 23 nt, Human
ugaccccacaaacuuuggccccg

SEQ ID NO: 242673 - RNA, 25 nt, Human
ugauugcucucuucaaacacagagc

SEQ ID NO: 242674 - RNA, 23 nt, Human
ugcucacuuccacccacugccac

SEQ ID NO: 242675 - RNA, 19 nt, Human
ugcuggauggggcccugac

SEQ ID NO: 242676 - RNA, 18 nt, Human
uggauggggcccugaccc

SEQ ID NO: 242677 - RNA, 21 nt, Human
uggauggggcccugaccccac

SEQ ID NO: 242678 - RNA, 23 nt, Human
uggauggggcccugaccccacaa

SEQ ID NO: 242679 - RNA, 24 nt, Human
ugucucagaccaaggccugccugc

SEQ ID NO: 242680 - RNA, 21 nt, Human
ugugacucaaaagcaagaauc

SEQ ID NO: 242681 - RNA, 21 nt, Human
uuacuccuaaauaacauaaaa

SEQ ID NO: 242682 - RNA, 27 nt, Human
uucacaaaauaacagggauuuccccau

SEQ ID NO: 242683 - RNA, 24 nt, Human
uuuuauucuuucaauuuuuauuuc

SEQ ID NO: 242684 - RNA, 20 nt, Human
uuuuuuuuuuuuuuauucuu

SEQ ID NO: 242685 - RNA, 25 nt, Human
aauaaaaggaacauuugaaaaauau

SEQ ID NO: 242686 - RNA, 25 nt, Human
aggaacagcaggcaggagugucagc

SEQ ID NO: 242687 - RNA, 20 nt, Human
caacaaaugugaccaguauc

SEQ ID NO: 242688 - RNA, 22 nt, Human
caggcaggagugucagcagaag

SEQ ID NO: 242689 - RNA, 18 nt, Human
ccauuuagaacagaaaca

SEQ ID NO: 242690 - RNA, 18 nt, Human
cccaaaauacagauaaaa

SEQ ID NO: 242691 - RNA, 20 nt, Human
ccuccaguaacacccagucc

SEQ ID NO: 242692 - RNA, 19 nt, Human
cuuggaacagugacugccc

SEQ ID NO: 242693 - RNA, 24 nt, Human
guaacacccaguccuucacuccuu

SEQ ID NO: 242694 - RNA, 18 nt, Human
uaaaacacagaguaaaag

SEQ ID NO: 242695 - RNA, 19 nt, Human
uaaaacacagaguaaaagc

SEQ ID NO: 242696 - RNA, 21 nt, Human
uaaaaggaacauuugaaaaau

SEQ ID NO: 242697 - RNA, 18 nt, Human
uacaguguguucccucca

SEQ ID NO: 242698 - RNA, 24 nt, Human
uagaacagaaacaaaagguauuau

SEQ ID NO: 242699 - RNA, 22 nt, Human
uaggaaaccaaauauugaccau

SEQ ID NO: 242700 - RNA, 23 nt, Human
uuggaacagugacugcccucuuu

SEQ ID NO: 242701 - RNA, 25 nt, Human
uuuacugcugacuuuuuuuuuuuaa

SEQ ID NO: 242702 - RNA, 21 nt, Human
uuuagaacagaaacaaaaggu

SEQ ID NO: 242703 - RNA, 19 nt, Human
acagcaauaaaugugugau

SEQ ID NO: 242704 - RNA, 26 nt, Human
acagcaauaaaugugugaugcaugcc

SEQ ID NO: 242705 - RNA, 19 nt, Human
acugaacugaguaagacaa

SEQ ID NO: 242706 - RNA, 21 nt, Human
agaaagcagcaggucuuucaa

SEQ ID NO: 242707 - RNA, 24 nt, Human
agcagcaggucuuucaaccacaaa

SEQ ID NO: 242708 - RNA, 23 nt, Human
aggagugggagacacugcuggga

SEQ ID NO: 242709 - RNA, 27 nt, Human
aggcaggaguguaggcagaagggaccc

SEQ ID NO: 242710 - RNA, 19 nt, Human
aguuauuuuaaauuucuaa

SEQ ID NO: 242711 - RNA, 22 nt, Human
caaaaaaagacugaacugagua

SEQ ID NO: 242712 - RNA, 25 nt, Human
caaaaacaaaauuauuaucacuaaa

SEQ ID NO: 242713 - RNA, 18 nt, Human
caaagugaacaauuugcc

SEQ ID NO: 242714 - RNA, 20 nt, Human
cacacugaaacaugccaggc

SEQ ID NO: 242715 - RNA, 21 nt, Human
cacagcaggcaggaguguagg

SEQ ID NO: 242716 - RNA, 23 nt, Human
cacaggaacagagaaagcagcag

SEQ ID NO: 242717 - RNA, 19 nt, Human
caccacacugaaacaugcc

SEQ ID NO: 242718 - RNA, 19 nt, Human
caggcaggaguguaggcag

SEQ ID NO: 242719 - RNA, 26 nt, Human
cucagacuucacaaggagugggagac

SEQ ID NO: 242720 - RNA, 23 nt, Human
cucucucucccucaucucuuaaa

SEQ ID NO: 242721 - RNA, 25 nt, Human
cugauaaacagcaauaaauguguga

SEQ ID NO: 242722 - RNA, 18 nt, Human
gcagaagggcaggugaug

SEQ ID NO: 242723 - RNA, 18 nt, Human
gcaggaguguaggcagaa

SEQ ID NO: 242724 - RNA, 19 nt, Human
gcaggaguguaggcagaag

SEQ ID NO: 242725 - RNA, 21 nt, Human
gcaggaguguaggcagaaggg

SEQ ID NO: 242726 - RNA, 19 nt, Human
ggcaggaguguaggcagaa

SEQ ID NO: 242727 - RNA, 23 nt, Human
gggaagacaauggagacacuguc

SEQ ID NO: 242728 - RNA, 22 nt, Human
gugaugcaugccauuucuaaau

SEQ ID NO: 242729 - RNA, 23 nt, Human
uaaaccaaccugauaaacagcaa

SEQ ID NO: 242730 - RNA, 23 nt, Human
uaucacaaaaauuauuucaggau

SEQ ID NO: 242731 - RNA, 21 nt, Human
uauuuugcucuguaucacaaa

SEQ ID NO: 242732 - RNA, 21 nt, Human
ucacaaggagugggagacacu

SEQ ID NO: 242733 - RNA, 22 nt, Human
ucuuucaaccacaaagugaaca

SEQ ID NO: 242734 - RNA, 21 nt, Human
uggacaccacacugaaacaug

SEQ ID NO: 242735 - RNA, 23 nt, Human
ugggagacacugcuggacaccac

SEQ ID NO: 242736 - RNA, 23 nt, Human
ugucucuggcucucucucccuca

SEQ ID NO: 242737 - RNA, 18 nt, Human
uucucuuaauggagggaa

SEQ ID NO: 242738 - RNA, 27 nt, Human
uuucuauuuuaagaaacaucauggaaa

SEQ ID NO: 242739 - RNA, 22 nt, Human
aacaauccuuuacccacuauuu

SEQ ID NO: 242740 - RNA, 18 nt, Human
aaccaggcccuccaccac

SEQ ID NO: 242741 - RNA, 19 nt, Human
acaugugcgacucaugugc

SEQ ID NO: 242742 - RNA, 18 nt, Human
acuccuggcacugccugg

SEQ ID NO: 242743 - RNA, 23 nt, Human
agaaaaacagcaauacaugugcg

SEQ ID NO: 242744 - RNA, 22 nt, Human
agaaaauuccuacaguaacacc

SEQ ID NO: 242745 - RNA, 23 nt, Human
agaaaauuccuacaguaacacca

SEQ ID NO: 242746 - RNA, 22 nt, Human
agaagguuuucccaauguggug

SEQ ID NO: 242747 - RNA, 21 nt, Human
agguaaaccccauaacuaccc

SEQ ID NO: 242748 - RNA, 24 nt, Human
augaggcagaagguuuucccaaug

SEQ ID NO: 242749 - RNA, 22 nt, Human
caaauagcacuguguucucucc

SEQ ID NO: 242750 - RNA, 28 nt, Human
caaccaggcccuccaccacguagaaacu

SEQ ID NO: 242751 - RNA, 23 nt, Human
caagaaaauuccuacaguaacac

SEQ ID NO: 242752 - RNA, 24 nt, Human
caagaaaauuccuacaguaacacc

SEQ ID NO: 242753 - RNA, 22 nt, Human
caauacaugugcgacucaugug

SEQ ID NO: 242754 - RNA, 25 nt, Human
cagaaaaacagcaauacaugugcga

SEQ ID NO: 242755 - RNA, 21 nt, Human
caugugcgacucaugugcaua

SEQ ID NO: 242756 - RNA, 25 nt, Human
ccacguagaaacucgacugcccccu

SEQ ID NO: 242757 - RNA, 28 nt, Human
cccacuauuuaacugcagaagguuuucc

SEQ ID NO: 242758 - RNA, 22 nt, Human
cucacacccaggucuucaacuc

SEQ ID NO: 242759 - RNA, 20 nt, Human
cuccucccuccgcugaccuu

SEQ ID NO: 242760 - RNA, 18 nt, Human
cugaagcuauuuaaaccu

SEQ ID NO: 242761 - RNA, 23 nt, Human
cuggcacugccugggccuccucu

SEQ ID NO: 242762 - RNA, 19 nt, Human
cuuaaaccagaaaaacagc

SEQ ID NO: 242763 - RNA, 22 nt, Human
gaaaaauacccaaaaguaaaac

SEQ ID NO: 242764 - RNA, 23 nt, Human
gcaaacauuaacaauccuuuacc

SEQ ID NO: 242765 - RNA, 22 nt, Human
gcacuguguucucuccagccuc

SEQ ID NO: 242766 - RNA, 22 nt, Human
gggccuccucugcuguggugcu

SEQ ID NO: 242767 - RNA, 20 nt, Human
guaugugucccucacaccca

SEQ ID NO: 242768 - RNA, 18 nt, Human
uaaaacagguaaacccca

SEQ ID NO: 242769 - RNA, 18 nt, Human
uacagcucuucuucucuu

SEQ ID NO: 242770 - RNA, 23 nt, Human
uacaugugcgacucaugugcaua

SEQ ID NO: 242771 - RNA, 25 nt, Human
uacuuucuucuacuuucuuacguaa

SEQ ID NO: 242772 - RNA, 24 nt, Human
uaugugucccucacacccaggucu

SEQ ID NO: 242773 - RNA, 20 nt, Human
ucccaaugugguguguuugg

SEQ ID NO: 242774 - RNA, 22 nt, Human
ucccaaugugguguguuugggg

SEQ ID NO: 242775 - RNA, 22 nt, Human
uccucugcuguggugcuuuuag

SEQ ID NO: 242776 - RNA, 23 nt, Human
ucuccagccucaaccaggcccuc

SEQ ID NO: 242777 - RNA, 27 nt, Human
ucuccagccucaaccaggcccuccacc

SEQ ID NO: 242778 - RNA, 24 nt, Human
ucuucugggaaccuugacuccugg

SEQ ID NO: 242779 - RNA, 22 nt, Human
ugaaaaauacccaaaaguaaaa

SEQ ID NO: 242780 - RNA, 24 nt, Human
ugaaaaauacccaaaaguaaaaca

SEQ ID NO: 242781 - RNA, 18 nt, Human
ugacuccuggcacugccu

SEQ ID NO: 242782 - RNA, 21 nt, Human
ugagacgauccucgucacaaa

SEQ ID NO: 242783 - RNA, 24 nt, Human
uggaacagaaaugcaaauagcacu

SEQ ID NO: 242784 - RNA, 22 nt, Human
uucaaacucagagggaagaauc

SEQ ID NO: 242785 - RNA, 19 nt, Human
uuugaaaaauacccaaaag

SEQ ID NO: 242786 - RNA, 18 nt, Human
aaagaacaaccgauuaca

SEQ ID NO: 242787 - RNA, 21 nt, Human
aacagagaaccacagaucuca

SEQ ID NO: 242788 - RNA, 25 nt, Human
aauguccccccacccugucaguggc

SEQ ID NO: 242789 - RNA, 18 nt, Human
acaaagccagcacaaagc

SEQ ID NO: 242790 - RNA, 23 nt, Human
acacagaugccaaaauacagaac

SEQ ID NO: 242791 - RNA, 20 nt, Human
accacauaaaaaauguacaa

SEQ ID NO: 242792 - RNA, 20 nt, Human
accaggaacaaaaauguccc

SEQ ID NO: 242793 - RNA, 20 nt, Human
acccgaugccugggccugcu

SEQ ID NO: 242794 - RNA, 23 nt, Human
acuucucuguagacaguuuuuac

SEQ ID NO: 242795 - RNA, 25 nt, Human
agaugccaaaauacagaacagaaca

SEQ ID NO: 242796 - RNA, 28 nt, Human
aguagccgauugaaaucaacaccacagu

SEQ ID NO: 242797 - RNA, 23 nt, Human
augccaaaauacagaacagaaca

SEQ ID NO: 242798 - RNA, 20 nt, Human
auuugccgcugcuaccgggg

SEQ ID NO: 242799 - RNA, 22 nt, Human
caaaacagagaaccacagaucu

SEQ ID NO: 242800 - RNA, 24 nt, Human
caaaacagagaaccacagaucuca

SEQ ID NO: 242801 - RNA, 22 nt, Human
caaaacauaacaauuauaacac

SEQ ID NO: 242802 - RNA, 24 nt, Human
caaagccagcacaaagcugauacc

SEQ ID NO: 242803 - RNA, 24 nt, Human
caacaccacauaaaaaauguacaa

SEQ ID NO: 242804 - RNA, 20 nt, Human
cacaaaacagagaaccacag

SEQ ID NO: 242805 - RNA, 20 nt, Human
cacaaacaccaggaacaaaa

SEQ ID NO: 242806 - RNA, 22 nt, Human
cacaaacaccaggaacaaaaau

SEQ ID NO: 242807 - RNA, 23 nt, Human
caccacauaaaaaauguacaaag

SEQ ID NO: 242808 - RNA, 21 nt, Human
caccaggaacaaaaauguccc

SEQ ID NO: 242809 - RNA, 26 nt, Human
cacccugucaguggccucuggccagg

SEQ ID NO: 242810 - RNA, 25 nt, Human
cagaacagaacaguagccgauugaa

SEQ ID NO: 242811 - RNA, 20 nt, Human
cagagaaccacagaucucac

SEQ ID NO: 242812 - RNA, 19 nt, Human
cagaugccaaaauacagaa

SEQ ID NO: 242813 - RNA, 21 nt, Human
cagcuggaccaaggggggagc

SEQ ID NO: 242814 - RNA, 19 nt, Human
caggaacaaaaaugucccc

SEQ ID NO: 242815 - RNA, 23 nt, Human
caggaacaaaaauguccccccac

SEQ ID NO: 242816 - RNA, 19 nt, Human
caggaaggcuggagcggca

SEQ ID NO: 242817 - RNA, 22 nt, Human
ccagcacaaagcugauaccaaa

SEQ ID NO: 242818 - RNA, 20 nt, Human
cuaccggggguccgggcugg

SEQ ID NO: 242819 - RNA, 18 nt, Human
cucccugaaagggcugcu

SEQ ID NO: 242820 - RNA, 19 nt, Human
gaacaaaaaugucccccca

SEQ ID NO: 242821 - RNA, 21 nt, Human
gcugaaaguauauuuauauau

SEQ ID NO: 242822 - RNA, 21 nt, Human
ggaacacaaacaccaggaaca

SEQ ID NO: 242823 - RNA, 19 nt, Human
ggacccgaugccugggccu

SEQ ID NO: 242824 - RNA, 18 nt, Human
ggagggcggggcucccug

SEQ ID NO: 242825 - RNA, 19 nt, Human
gggagccugccucugggcc

SEQ ID NO: 242826 - RNA, 21 nt, Human
gggggagccugccucugggcc

SEQ ID NO: 242827 - RNA, 20 nt, Human
gggguccgggcugggccugc

SEQ ID NO: 242828 - RNA, 22 nt, Human
guggaacuggaacacaaacacc

SEQ ID NO: 242829 - RNA, 30 nt, Human
uaaaaacacagaugccaaaauacagaacag

SEQ ID NO: 242830 - RNA, 22 nt, Human
uaacacaaaacagagaaccaca

SEQ ID NO: 242831 - RNA, 24 nt, Human
uaacacaaaacagagaaccacaga

SEQ ID NO: 242832 - RNA, 25 nt, Human
uaccagaaaugagauggauagcuuc

SEQ ID NO: 242833 - RNA, 19 nt, Human
ucucacuuaaaaacacaga

SEQ ID NO: 242834 - RNA, 18 nt, Human
ugaaaucaacaccacaua

SEQ ID NO: 242835 - RNA, 20 nt, Human
ugccaaaauacagaacagaa

SEQ ID NO: 242836 - RNA, 22 nt, Human
uggaacacaaacaccaggaaca

SEQ ID NO: 242837 - RNA, 18 nt, Human
uggcagauacgaaaccaa

SEQ ID NO: 242838 - RNA, 19 nt, Human
uggccagggaaacacagga

SEQ ID NO: 242839 - RNA, 25 nt, Human
uuuugggagggcggggcucccugaa

SEQ ID NO: 242840 - RNA, 21 nt, Human
aaagacaaccgagccugaagg

SEQ ID NO: 242841 - RNA, 18 nt, Human
acucccacccacccccca

SEQ ID NO: 242842 - RNA, 22 nt, Human
caaaagacaaccgagccugaac

SEQ ID NO: 242843 - RNA, 20 nt, Human
caaccgagccugaacuucca

SEQ ID NO: 242844 - RNA, 21 nt, Human
caaccgagccugaacuuccaa

SEQ ID NO: 242845 - RNA, 19 nt, Human
caccccccauguccacacc

SEQ ID NO: 242846 - RNA, 21 nt, Human
caccccccauguccacaccaa

SEQ ID NO: 242847 - RNA, 20 nt, Human
caccccccauguccacaccu

SEQ ID NO: 242848 - RNA, 25 nt, Human
ccacccaccccccauguccacacca

SEQ ID NO: 242849 - RNA, 25 nt, Human
ccacccaccccccauguccacacca

SEQ ID NO: 242850 - RNA, 18 nt, Human
cccaaaagacaaccgagc

SEQ ID NO: 242851 - RNA, 22 nt, Human
cccacccaccccccauguccac

SEQ ID NO: 242852 - RNA, 20 nt, Human
cccccauguccacaccaaua

SEQ ID NO: 242853 - RNA, 19 nt, Human
ccgcacugccgccgucugc

SEQ ID NO: 242854 - RNA, 23 nt, Human
cucccacccaccccccaugucca

SEQ ID NO: 242855 - RNA, 24 nt, Human
uaauaaaaauuggauuuuaucaca

SEQ ID NO: 242856 - RNA, 19 nt, Human
ucccaaaagacaaccgagc

SEQ ID NO: 242857 - RNA, 22 nt, Human
ucccacccaccccccaugucca

SEQ ID NO: 242858 - RNA, 21 nt, Human
uucuacucccacccacccccc

SEQ ID NO: 242859 - RNA, 22 nt, Human
uuuuuuuuuuuuuuuuucacau

SEQ ID NO: 242860 - RNA, 24 nt, Human
uuuuuuuuuuuuuuuuuucacaug

SEQ ID NO: 242861 - RNA, 24 nt, Human
acccuaagaucuauaucagacaga

SEQ ID NO: 242862 - RNA, 20 nt, Human
agaauguuuguauauaagcc

SEQ ID NO: 242863 - RNA, 23 nt, Human
auucacugugucuaugauauuga

SEQ ID NO: 242864 - RNA, 23 nt, Human
caauaguaaagauuauuagccua

SEQ ID NO: 242865 - RNA, 22 nt, Human
cagcaaaauuaugcaauaauau

SEQ ID NO: 242866 - RNA, 21 nt, Human
ccgcugaaacaaugagaugag

SEQ ID NO: 242867 - RNA, 20 nt, Human
ccuccuuccucucacccaua

SEQ ID NO: 242868 - RNA, 22 nt, Human
cucacccauacauuuuuucuuc

SEQ ID NO: 242869 - RNA, 25 nt, Human
gagaagaaggagauccuccuuccuc

SEQ ID NO: 242870 - RNA, 20 nt, Human
gcugcugaaugugucucucu

SEQ ID NO: 242871 - RNA, 18 nt, Human
ggagagcaagaaagccag

SEQ ID NO: 242872 - RNA, 20 nt, Human
ggagagcaagaaagccaggc

SEQ ID NO: 242873 - RNA, 19 nt, Human
guucugcucuuuccaccga

SEQ ID NO: 242874 - RNA, 21 nt, Human
uaagaugaacagagccacucc

SEQ ID NO: 242875 - RNA, 19 nt, Human
uaucaguuugggugaaaaa

SEQ ID NO: 242876 - RNA, 18 nt, Human
ucccuggaaaggacuuca

SEQ ID NO: 242877 - RNA, 22 nt, Human
ucccuggaaaggacuucagauu

SEQ ID NO: 242878 - RNA, 22 nt, Human
ucuaugguguucugcucuuucc

SEQ ID NO: 242879 - RNA, 18 nt, Human
ugaaaaaguagagaguag

SEQ ID NO: 242880 - RNA, 23 nt, Human
ugagaagcagcaaaauuaugcaa

SEQ ID NO: 242881 - RNA, 18 nt, Human
ugauauugagaagcagca

SEQ ID NO: 242882 - RNA, 21 nt, Human
uguuuguauauaagccauaua

SEQ ID NO: 242883 - RNA, 22 nt, Human
uuguacauagaauguuuguaua

SEQ ID NO: 242884 - RNA, 20 nt, Human
uuuaagaaauacugucuaag

SEQ ID NO: 242885 - RNA, 20 nt, Human
aaaaaaaaaaaaaaaagcug

SEQ ID NO: 242886 - RNA, 20 nt, Human
aaaacaaaagacaaaccucu

SEQ ID NO: 242887 - RNA, 20 nt, Human
aaaacacaagccguccacua

SEQ ID NO: 242888 - RNA, 22 nt, Human
aaagugaagaacuacuaaacca

SEQ ID NO: 242889 - RNA, 20 nt, Human
aacauggugaaacccugucu

SEQ ID NO: 242890 - RNA, 21 nt, Human
aacauggugaaacccugucuc

SEQ ID NO: 242891 - RNA, 21 nt, Human
aaccagcaucaaacaaacaca

SEQ ID NO: 242892 - RNA, 23 nt, Human
aaccauuaccacuaggauaaauu

SEQ ID NO: 242893 - RNA, 24 nt, Human
aaccauuugggcacauacaacaaa

SEQ ID NO: 242894 - RNA, 23 nt, Human
aagaucaaaacacaagccgucca

SEQ ID NO: 242895 - RNA, 18 nt, Human
aagauuacagagguucau

SEQ ID NO: 242896 - RNA, 24 nt, Human
aaucacuugaacccaggaggugga

SEQ ID NO: 242897 - RNA, 18 nt, Human
aauuagccaggcauggug

SEQ ID NO: 242898 - RNA, 21 nt, Human
acagccagcaaagguuggccc

SEQ ID NO: 242899 - RNA, 23 nt, Human
acauuuuucaacaucuuacaucu

SEQ ID NO: 242900 - RNA, 24 nt, Human
accaacauggugaaacccugucuc

SEQ ID NO: 242901 - RNA, 24 nt, Human
acccugucucuacuaauacuacaa

SEQ ID NO: 242902 - RNA, 24 nt, Human
accugaggucaggaguuugagacc

SEQ ID NO: 242903 - RNA, 19 nt, Human
acuaaaacacucuaaacau

SEQ ID NO: 242904 - RNA, 24 nt, Human
acuccagccuggacacaagaguga

SEQ ID NO: 242905 - RNA, 20 nt, Human
acugcacuccagccuggaca

SEQ ID NO: 242906 - RNA, 23 nt, Human
acugcacuccagccuggacacaa

SEQ ID NO: 242907 - RNA, 26 nt, Human
acugcacuccagccuggacacaagag

SEQ ID NO: 242908 - RNA, 23 nt, Human
agaaaguggcagauuuaaacaga

SEQ ID NO: 242909 - RNA, 22 nt, Human
agauagugccacugcacuccag

SEQ ID NO: 242910 - RNA, 19 nt, Human
agcaaaugugaaggucaga

SEQ ID NO: 242911 - RNA, 23 nt, Human
agccaggcaugguggcacacgcc

SEQ ID NO: 242912 - RNA, 24 nt, Human
agccguccacuaaaaucaaguggc

SEQ ID NO: 242913 - RNA, 24 nt, Human
agccugaccaacauggugaaaccc

SEQ ID NO: 242914 - RNA, 20 nt, Human
aggaguuugagaccagccug

SEQ ID NO: 242915 - RNA, 18 nt, Human
aggcaggagaaucacuug

SEQ ID NO: 242916 - RNA, 23 nt, Human
aggcaggagaaucacuugaaccc

SEQ ID NO: 242917 - RNA, 24 nt, Human
aggcaggagaaucacuugaaccca

SEQ ID NO: 242918 - RNA, 18 nt, Human
aggcagguggaucaccug

SEQ ID NO: 242919 - RNA, 22 nt, Human
aggcagguggaucaccugaggu

SEQ ID NO: 242920 - RNA, 26 nt, Human
aggcagguggaucaccugaggucagg

SEQ ID NO: 242921 - RNA, 21 nt, Human
aggccgaggcagguggaucac

SEQ ID NO: 242922 - RNA, 24 nt, Human
aggcugaggcaggagaaucacuug

SEQ ID NO: 242923 - RNA, 19 nt, Human
agguggagguugcaguaag

SEQ ID NO: 242924 - RNA, 24 nt, Human
agguggagguugcaguaagccaag

SEQ ID NO: 242925 - RNA, 22 nt, Human
agguggaucaccugaggucagg

SEQ ID NO: 242926 - RNA, 24 nt, Human
auagugccacugcacuccagccug

SEQ ID NO: 242927 - RNA, 23 nt, Human
caaaacacaagccguccacuaaa

SEQ ID NO: 242928 - RNA, 21 nt, Human
caaaauggcagcgcagagccc

SEQ ID NO: 242929 - RNA, 20 nt, Human
caaacacaguuuccagaacu

SEQ ID NO: 242930 - RNA, 24 nt, Human
caacauggugaaacccugucucua

SEQ ID NO: 242931 - RNA, 24 nt, Human
caacugcuguacaaaaacaaaaga

SEQ ID NO: 242932 - RNA, 29 nt, Human
caagaucaaaacacaagccguccacuaag

SEQ ID NO: 242933 - RNA, 23 nt, Human
caaugaaccagcaucaaacaaac

SEQ ID NO: 242934 - RNA, 24 nt, Human
cacaccuguaagcccugcacuuug

SEQ ID NO: 242935 - RNA, 20 nt, Human
cacauacaacaaaugaaaac

SEQ ID NO: 242936 - RNA, 23 nt, Human
caccugaggucaggaguuugaga

SEQ ID NO: 242937 - RNA, 23 nt, Human
caccuguaagcccugcacuuugg

SEQ ID NO: 242938 - RNA, 24 nt, Human
caccuguaagcccugcacuuuggg

SEQ ID NO: 242939 - RNA, 19 nt, Human
cacgccucuaaucccagcu

SEQ ID NO: 242940 - RNA, 22 nt, Human
cacuccagccuggacacaagag

SEQ ID NO: 242941 - RNA, 22 nt, Human
cacuccagccuggacacaagag

SEQ ID NO: 242942 - RNA, 22 nt, Human
cacuccagccuggacacaagag

SEQ ID NO: 242943 - RNA, 24 nt, Human
cacuccagccuggacacaagagug

SEQ ID NO: 242944 - RNA, 18 nt, Human
cacugcacuccagccugg

SEQ ID NO: 242945 - RNA, 19 nt, Human
cacugcacuccagccugga

SEQ ID NO: 242946 - RNA, 21 nt, Human
cacugcacuccagccuggaca

SEQ ID NO: 242947 - RNA, 24 nt, Human
cacugcacuccagccuggacacaa

SEQ ID NO: 242948 - RNA, 21 nt, Human
cacuggugacagguuugucau

SEQ ID NO: 242949 - RNA, 24 nt, Human
cagaaacaaaacaauuugaaaagu

SEQ ID NO: 242950 - RNA, 20 nt, Human
cagcaugagcuggcuugggg

SEQ ID NO: 242951 - RNA, 24 nt, Human
cagcuacucgggaggcugaggcag

SEQ ID NO: 242952 - RNA, 29 nt, Human
caggagguggagguugcaguaacaacggu

SEQ ID NO: 242953 - RNA, 24 nt, Human
cagguggaucaccugaggucagga

SEQ ID NO: 242954 - RNA, 19 nt, Human
cauuuucuggaaguuguuu

SEQ ID NO: 242955 - RNA, 19 nt, Human
ccacugcacuccagccugg

SEQ ID NO: 242956 - RNA, 19 nt, Human
ccacugcacuccagccugg

SEQ ID NO: 242957 - RNA, 20 nt, Human
ccacugcacuccagccugga

SEQ ID NO: 242958 - RNA, 21 nt, Human
ccacugcacuccagccuggac

SEQ ID NO: 242959 - RNA, 18 nt, Human
ccaguccagaaaguggca

SEQ ID NO: 242960 - RNA, 21 nt, Human
cccaggagguggagguugcag

SEQ ID NO: 242961 - RNA, 23 nt, Human
cccauauaucaacacugugggca

SEQ ID NO: 242962 - RNA, 24 nt, Human
cccccaagauuacagagguucaug

SEQ ID NO: 242963 - RNA, 18 nt, Human
ccucaaaaaaaaaaaaaa

SEQ ID NO: 242964 - RNA, 22 nt, Human
ccugaccaacauggugaaaccc

SEQ ID NO: 242965 - RNA, 24 nt, Human
ccugaccaacauggugaaacccug

SEQ ID NO: 242966 - RNA, 22 nt, Human
ccugaggucaggaguuugagac

SEQ ID NO: 242967 - RNA, 20 nt, Human
cgaggcagguggaucaccug

SEQ ID NO: 242968 - RNA, 24 nt, Human
cgaggcagguggaucaccugaggu

SEQ ID NO: 242969 - RNA, 23 nt, Human
cgccucuaaucccagcuacucgg

SEQ ID NO: 242970 - RNA, 24 nt, Human
cgccucuaaucccagcuacucggg

SEQ ID NO: 242971 - RNA, 24 nt, Human
cgggaggcugaggcaggagaauca

SEQ ID NO: 242972 - RNA, 19 nt, Human
cuaaaaaaaaaaaaaaaaa

SEQ ID NO: 242973 - RNA, 18 nt, Human
cucaaaaaaaaaaaaaaa

SEQ ID NO: 242974 - RNA, 24 nt, Human
cugaccaacauggugaaacccugu

SEQ ID NO: 242975 - RNA, 26 nt, Human
cugcacuuugggaggccgaggcaggu

SEQ ID NO: 242976 - RNA, 19 nt, Human
cuggcacacuucaucuuug

SEQ ID NO: 242977 - RNA, 21 nt, Human
cuuccagaacucaguagaaau

SEQ ID NO: 242978 - RNA, 21 nt, Human
cuugaacccaggagguggagg

SEQ ID NO: 242979 - RNA, 21 nt, Human
gaaaaguccaaugaaccagca

SEQ ID NO: 242980 - RNA, 19 nt, Human
gaaacccugucucuacuaa

SEQ ID NO: 242981 - RNA, 18 nt, Human
gaaccacagcugacagcc

SEQ ID NO: 242982 - RNA, 26 nt, Human
gacacagaaacaaaacagcagggacu

SEQ ID NO: 242983 - RNA, 22 nt, Human
gacagccagcaaagguuggccc

SEQ ID NO: 242984 - RNA, 23 nt, Human
gagaaucacuugaacccaggagg

SEQ ID NO: 242985 - RNA, 25 nt, Human
gaggcagguggaucaccugagguca

SEQ ID NO: 242986 - RNA, 18 nt, Human
gagguugcaguaagccaa

SEQ ID NO: 242987 - RNA, 21 nt, Human
gagguugcaguaagccaagau

SEQ ID NO: 242988 - RNA, 24 nt, Human
gaucaccugaggucaggaguuuga

SEQ ID NO: 242989 - RNA, 22 nt, Human
gcaaugcuguaggguuucacac

SEQ ID NO: 242990 - RNA, 19 nt, Human
gcacauacaacaaaugaaa

SEQ ID NO: 242991 - RNA, 24 nt, Human
gcacuccagccuggacacaagagu

SEQ ID NO: 242992 - RNA, 22 nt, Human
gcacuuugggaggccgaggcag

SEQ ID NO: 242993 - RNA, 22 nt, Human
gcaggagaaucacuugaaccca

SEQ ID NO: 242994 - RNA, 20 nt, Human
gccuggacacaagagugaaa

SEQ ID NO: 242995 - RNA, 18 nt, Human
ggagguugcaguaagcca

SEQ ID NO: 242996 - RNA, 20 nt, Human
ggagguugcaguaagccaag

SEQ ID NO: 242997 - RNA, 22 nt, Human
ggaucaccugaggucaggaguu

SEQ ID NO: 242998 - RNA, 23 nt, Human
ggcacuguggcucacaccuguaa

SEQ ID NO: 242999 - RNA, 19 nt, Human
ggcuugggggaaccagcug

SEQ ID NO: 243000 - RNA, 19 nt, Human
ggucaggaguuugagacca

SEQ ID NO: 243001 - RNA, 23 nt, Human
uaaaaaaaaaaaaaaaaagcugg

SEQ ID NO: 243002 - RNA, 25 nt, Human
uaaccauuaccacuaggauaaauua

SEQ ID NO: 243003 - RNA, 23 nt, Human
uaagaaaaugcauuucuuggaaa

SEQ ID NO: 243004 - RNA, 19 nt, Human
uacuaugugauaucacugc

SEQ ID NO: 243005 - RNA, 20 nt, Human
uacuaugugauaucacugcc

SEQ ID NO: 243006 - RNA, 21 nt, Human
uacuggucaagaucaaaacac

SEQ ID NO: 243007 - RNA, 21 nt, Human
uagaaaaacaaauaauugcaa

SEQ ID NO: 243008 - RNA, 19 nt, Human
uagcaugaaggaaucgggc

SEQ ID NO: 243009 - RNA, 19 nt, Human
uagcuucaaaguagaaaaa

SEQ ID NO: 243010 - RNA, 20 nt, Human
ucaaaaaaaaaaaaaaagau

SEQ ID NO: 243011 - RNA, 19 nt, Human
ucaaaacacaagccgucca

SEQ ID NO: 243012 - RNA, 23 nt, Human
ucaaacaaacacaguuuccagaa

SEQ ID NO: 243013 - RNA, 19 nt, Human
ucaccugaggucaggaguu

SEQ ID NO: 243014 - RNA, 18 nt, Human
ucagagcugagucagugg

SEQ ID NO: 243015 - RNA, 20 nt, Human
ucaguagaaauagacauuug

SEQ ID NO: 243016 - RNA, 24 nt, Human
ucccaguaacaaaagacugcacag

SEQ ID NO: 243017 - RNA, 21 nt, Human
uccucacacuguuguugcuac

SEQ ID NO: 243018 - RNA, 22 nt, Human
ucgccucaaaaaaaaaaaaaaa

SEQ ID NO: 243019 - RNA, 25 nt, Human
ucgggaggcugaggcaggagaauca

SEQ ID NO: 243020 - RNA, 24 nt, Human
ucuaaaaaaaaaaaaaaaaagcuu

SEQ ID NO: 243021 - RNA, 22 nt, Human
ucucccccaagauuacagaggu

SEQ ID NO: 243022 - RNA, 24 nt, Human
ugaaaacuaaaacacucuaaacau

SEQ ID NO: 243023 - RNA, 24 nt, Human
ugaccaacauggugaaacccuguc

SEQ ID NO: 243024 - RNA, 18 nt, Human
ugagccugaccaacaugg

SEQ ID NO: 243025 - RNA, 22 nt, Human
ugagcuggcuugggggaaccag

SEQ ID NO: 243026 - RNA, 20 nt, Human
ugaggcaggagaaucacuug

SEQ ID NO: 243027 - RNA, 24 nt, Human
ugaggcaggagaaucacuugaacc

SEQ ID NO: 243028 - RNA, 25 nt, Human
ugaggcaggagaaucacuugaaccc

SEQ ID NO: 243029 - RNA, 18 nt, Human
ugaggucaggaguuugag

SEQ ID NO: 243030 - RNA, 24 nt, Human
ugccacugcacuccagccuggaca

SEQ ID NO: 243031 - RNA, 21 nt, Human
ugccccagcagcugaacgcac

SEQ ID NO: 243032 - RNA, 21 nt, Human
ugccuuuguauaaugcccaca

SEQ ID NO: 243033 - RNA, 23 nt, Human
uggaucaccugaggucaggaguu

SEQ ID NO: 243034 - RNA, 24 nt, Human
uggaucaccugaggucaggaguuu

SEQ ID NO: 243035 - RNA, 27 nt, Human
uggaucaccugaggucaggaguuugag

SEQ ID NO: 243036 - RNA, 22 nt, Human
uggcacacgccucuaaucccag

SEQ ID NO: 243037 - RNA, 24 nt, Human
ugggaggccgaggcagguggauca

SEQ ID NO: 243038 - RNA, 18 nt, Human
ugggcacuguggcucaca

SEQ ID NO: 243039 - RNA, 23 nt, Human
uguacaaaaacaaaagacaaacc

SEQ ID NO: 243040 - RNA, 22 nt, Human
uguacaaauacauauaaccauu

SEQ ID NO: 243041 - RNA, 21 nt, Human
uguacuggucaagaucaaaac

SEQ ID NO: 243042 - RNA, 21 nt, Human
ugucauugacaaaauggcagc

SEQ ID NO: 243043 - RNA, 27 nt, Human
uguuacaaagucacaaaauacauaaaa

SEQ ID NO: 243044 - RNA, 18 nt, Human
uucaaaguagaaaaacaa

SEQ ID NO: 243045 - RNA, 21 nt, Human
uucaucuuugugucugguagg

SEQ ID NO: 243046 - RNA, 25 nt, Human
uucgaagugucuauuuaaaauacca

SEQ ID NO: 243047 - RNA, 22 nt, Human
uugaaaugacuuccuuguugaa

SEQ ID NO: 243048 - RNA, 24 nt, Human
uugaacccaggagguggagguugc

SEQ ID NO: 243049 - RNA, 20 nt, Human
uugaagucaucaagccauug

SEQ ID NO: 243050 - RNA, 25 nt, Human
uugggaggccgaggcagguggauca

SEQ ID NO: 243051 - RNA, 21 nt, Human
uuuacaguacuaagguccagu

SEQ ID NO: 243052 - RNA, 22 nt, Human
uuucuggaaguuguuuuuuuuu

SEQ ID NO: 243053 - RNA, 24 nt, Human
uuugaaaaguccaaugaaccagca

SEQ ID NO: 243054 - RNA, 18 nt, Human
uuuuuuuuuaaggguucu

SEQ ID NO: 243055 - RNA, 20 nt, Human
aaacacagcacccacgagca

SEQ ID NO: 243056 - RNA, 19 nt, Human
aacaggaggugacccuagc

SEQ ID NO: 243057 - RNA, 22 nt, Human
acaauaccaacagguaguucuc

SEQ ID NO: 243058 - RNA, 20 nt, Human
acgggagaguaaacacagca

SEQ ID NO: 243059 - RNA, 23 nt, Human
agaacauccaugaagacuuaaaa

SEQ ID NO: 243060 - RNA, 18 nt, Human
aucgucuuccaccaugga

SEQ ID NO: 243061 - RNA, 25 nt, Human
augccggaaaguggggcggccaguu

SEQ ID NO: 243062 - RNA, 21 nt, Human
caaacaggaggugacccuagc

SEQ ID NO: 243063 - RNA, 22 nt, Human
caacccggacgcgaaggcacac

SEQ ID NO: 243064 - RNA, 20 nt, Human
caauaccaacagguaguucu

SEQ ID NO: 243065 - RNA, 18 nt, Human
cacacgggagaguaaaca

SEQ ID NO: 243066 - RNA, 22 nt, Human
cacagcacccacgagcaacagg

SEQ ID NO: 243067 - RNA, 24 nt, Human
cagggcagggcuuuuuuuuuuggg

SEQ ID NO: 243068 - RNA, 22 nt, Human
ccaacccggacgcgaaggcaca

SEQ ID NO: 243069 - RNA, 22 nt, Human
cccccgaacaagaagguccccu

SEQ ID NO: 243070 - RNA, 22 nt, Human
ccggaaaguggggcggccaguu

SEQ ID NO: 243071 - RNA, 20 nt, Human
ccuucucaggucacgguggc

SEQ ID NO: 243072 - RNA, 22 nt, Human
ccuuucacaaacaggaggugac

SEQ ID NO: 243073 - RNA, 25 nt, Human
cgagcaacagggcagggcuuuuuuu

SEQ ID NO: 243074 - RNA, 19 nt, Human
cuagcagacagcacagcag

SEQ ID NO: 243075 - RNA, 20 nt, Human
cuugggacgggacgagcgcc

SEQ ID NO: 243076 - RNA, 21 nt, Human
cuuuccuucucaggucacggu

SEQ ID NO: 243077 - RNA, 19 nt, Human
gaagacuuaaaacauggca

SEQ ID NO: 243078 - RNA, 25 nt, Human
gcagaacauccaugaagacuuaaaa

SEQ ID NO: 243079 - RNA, 21 nt, Human
ggcacacgggagaguaaacac

SEQ ID NO: 243080 - RNA, 19 nt, Human
guggccacuucccaccccc

SEQ ID NO: 243081 - RNA, 23 nt, Human
uccaugaagacuuaaaacauggc

SEQ ID NO: 243082 - RNA, 24 nt, Human
uccgcaugacaugcagaacaucca

SEQ ID NO: 243083 - RNA, 22 nt, Human
ucuuucuuuccuucucagguca

SEQ ID NO: 243084 - RNA, 20 nt, Human
ugaagacuuaaaacauggca

SEQ ID NO: 243085 - RNA, 19 nt, Human
ugaguuuuaguccgcauga

SEQ ID NO: 243086 - RNA, 19 nt, Human
ugcuccaggggucagcaga

SEQ ID NO: 243087 - RNA, 19 nt, Human
uggaaagaucuguugggug

SEQ ID NO: 243088 - RNA, 18 nt, Human
uggccacuucccaccccc

SEQ ID NO: 243089 - RNA, 19 nt, Human
uggguuuucagcucaaguu

SEQ ID NO: 243090 - RNA, 19 nt, Human
uucacaaacaggaggugac

SEQ ID NO: 243091 - RNA, 22 nt, Human
uuucacaaacaggaggugaccc

SEQ ID NO: 243092 - RNA, 19 nt, Human
uuugggcagugggggggug

SEQ ID NO: 243093 - RNA, 22 nt, Human
uuuucagcucaaguucuacugc

SEQ ID NO: 243094 - RNA, 23 nt, Human
uuuuuuuugggcagugggggggu

SEQ ID NO: 243095 - RNA, 22 nt, Human
uuuuuuuuuugggcaguggggg

SEQ ID NO: 243096 - RNA, 27 nt, Human
uuuuuuuuuugggcagugggggggugg

SEQ ID NO: 243097 - RNA, 23 nt, Human
accccggacugccggggcucccg

SEQ ID NO: 243098 - RNA, 23 nt, Human
agaaagaggaagucuguaauuaa

SEQ ID NO: 243099 - RNA, 20 nt, Human
agccgcggaggcaggggcgg

SEQ ID NO: 243100 - RNA, 22 nt, Human
aggcaggggcggaagaagggac

SEQ ID NO: 243101 - RNA, 20 nt, Human
ccgccccgucacgggccucg

SEQ ID NO: 243102 - RNA, 20 nt, Human
cggaagaacaaaucuggcag

SEQ ID NO: 243103 - RNA, 20 nt, Human
cggcgaccccggacugccgg

SEQ ID NO: 243104 - RNA, 22 nt, Human
cggggcucccgcccgccccguc

SEQ ID NO: 243105 - RNA, 23 nt, Human
cgucacgggccucggccccgggg

SEQ ID NO: 243106 - RNA, 22 nt, Human
cuggcagcgcggcacggcccuc

SEQ ID NO: 243107 - RNA, 18 nt, Human
gccggggcucccgcccgc

SEQ ID NO: 243108 - RNA, 22 nt, Human
gccuccgagccgcggaggcagg

SEQ ID NO: 243109 - RNA, 26 nt, Human
uacauauacaaauuugccuuuucaca

SEQ ID NO: 243110 - RNA, 24 nt, Human
uaugaaacaguuacuacuauucuu

SEQ ID NO: 243111 - RNA, 19 nt, Human
ucccgcccgccccgucacg

SEQ ID NO: 243112 - RNA, 22 nt, Human
ucgccggcgaccccggacugcc

SEQ ID NO: 243113 - RNA, 21 nt, Human
aaacuuaucauagcuccccca

SEQ ID NO: 243114 - RNA, 23 nt, Human
aaagcugacaaagagcagaaaca

SEQ ID NO: 243115 - RNA, 19 nt, Human
aaauggcuauuagaaaaga

SEQ ID NO: 243116 - RNA, 22 nt, Human
aacacacauauaaaggaucaua

SEQ ID NO: 243117 - RNA, 18 nt, Human
aaccucucauccccucac

SEQ ID NO: 243118 - RNA, 26 nt, Human
aaccucucauccccucaccgcgacuc

SEQ ID NO: 243119 - RNA, 23 nt, Human
aagaagugcaagucaucugacau

SEQ ID NO: 243120 - RNA, 21 nt, Human
aaucaccaugauggcacagau

SEQ ID NO: 243121 - RNA, 19 nt, Human
acaaagagcagaaacaaaa

SEQ ID NO: 243122 - RNA, 21 nt, Human
acggccgcgccaugcccccga

SEQ ID NO: 243123 - RNA, 25 nt, Human
agaaaggaugucuuaguguuauaaa

SEQ ID NO: 243124 - RNA, 23 nt, Human
agacccugcccagggccaggccu

SEQ ID NO: 243125 - RNA, 24 nt, Human
aggcggagugcagggccagcgagc

SEQ ID NO: 243126 - RNA, 19 nt, Human
aggggugggagacggggca

SEQ ID NO: 243127 - RNA, 21 nt, Human
agugcagggccagcgagcccc

SEQ ID NO: 243128 - RNA, 25 nt, Human
agugcagggccagcgagccccgggg

SEQ ID NO: 243129 - RNA, 21 nt, Human
auaaaaguaaaaaauauacag

SEQ ID NO: 243130 - RNA, 21 nt, Human
auacauguucagagaaaacug

SEQ ID NO: 243131 - RNA, 20 nt, Human
aucugagccacuuuucagca

SEQ ID NO: 243132 - RNA, 21 nt, Human
augaacacuaaaaacacuaca

SEQ ID NO: 243133 - RNA, 20 nt, Human
cacaacugcacagugaccac

SEQ ID NO: 243134 - RNA, 19 nt, Human
caccgcgacucaggcuggu

SEQ ID NO: 243135 - RNA, 23 nt, Human
cacugugucgccggccccaggac

SEQ ID NO: 243136 - RNA, 19 nt, Human
cagaacacucugcaucuga

SEQ ID NO: 243137 - RNA, 24 nt, Human
cagcauucucuuuucucuccacca

SEQ ID NO: 243138 - RNA, 20 nt, Human
cagcucccuggggggacccc

SEQ ID NO: 243139 - RNA, 19 nt, Human
cagguacugaugccagcag

SEQ ID NO: 243140 - RNA, 19 nt, Human
cauuguuuuccgcgcuacc

SEQ ID NO: 243141 - RNA, 24 nt, Human
ccaaaacacacauauaaaggauca

SEQ ID NO: 243142 - RNA, 18 nt, Human
ccacagacccugcccagg

SEQ ID NO: 243143 - RNA, 24 nt, Human
ccagcacugggguaaguggagcag

SEQ ID NO: 243144 - RNA, 22 nt, Human
ccagggccaggccucaccugga

SEQ ID NO: 243145 - RNA, 24 nt, Human
ccagggccaggccucaccuggagc

SEQ ID NO: 243146 - RNA, 19 nt, Human
ccaguggccuccuucuccc

SEQ ID NO: 243147 - RNA, 20 nt, Human
ccauauguagccuggggucc

SEQ ID NO: 243148 - RNA, 18 nt, Human
cccacaucucuaccuucc

SEQ ID NO: 243149 - RNA, 22 nt, Human
cccagcuccccaggccaugggc

SEQ ID NO: 243150 - RNA, 23 nt, Human
ccccaaaacacacauauaaagga

SEQ ID NO: 243151 - RNA, 22 nt, Human
ccccauuguuuuccgcgcuacc

SEQ ID NO: 243152 - RNA, 22 nt, Human
cccccacaucucuaccuuccau

SEQ ID NO: 243153 - RNA, 23 nt, Human
cccccagccggcgcuugcugccu

SEQ ID NO: 243154 - RNA, 19 nt, Human
ccccgcucggcccgacccc

SEQ ID NO: 243155 - RNA, 20 nt, Human
ccgcugaggucacccucuuc

SEQ ID NO: 243156 - RNA, 28 nt, Human
ccggccuacggccuccuuccccaaaacc

SEQ ID NO: 243157 - RNA, 23 nt, Human
ccucaagccucggccucucccca

SEQ ID NO: 243158 - RNA, 22 nt, Human
ccucacggccgcgccaugcccc

SEQ ID NO: 243159 - RNA, 22 nt, Human
ccuccccugacucccgaaaacc

SEQ ID NO: 243160 - RNA, 21 nt, Human
ccucggccucuccccaccgcc

SEQ ID NO: 243161 - RNA, 21 nt, Human
ccucucauccccucaccgcga

SEQ ID NO: 243162 - RNA, 18 nt, Human
ccuggaagacggggcugu

SEQ ID NO: 243163 - RNA, 20 nt, Human
ccugggguccugcugccagg

SEQ ID NO: 243164 - RNA, 21 nt, Human
cgaaaaccagguucauaaaua

SEQ ID NO: 243165 - RNA, 19 nt, Human
cgcagccacagacccugcc

SEQ ID NO: 243166 - RNA, 23 nt, Human
cggccuacggccuccuuccccaa

SEQ ID NO: 243167 - RNA, 18 nt, Human
cggggccggcuggcacug

SEQ ID NO: 243168 - RNA, 24 nt, Human
cguuuuccaaaaacagcucacaug

SEQ ID NO: 243169 - RNA, 21 nt, Human
cucacggccgcgccaugcccc

SEQ ID NO: 243170 - RNA, 21 nt, Human
cucacggccgcgccaugccuu

SEQ ID NO: 243171 - RNA, 21 nt, Human
cuccaggauacaggaccccca

SEQ ID NO: 243172 - RNA, 21 nt, Human
cuccaggauacaggaccccca

SEQ ID NO: 243173 - RNA, 22 nt, Human
cuccccgcggcuaccccucucc

SEQ ID NO: 243174 - RNA, 24 nt, Human
cuccccgcggcuaccccucuccgc

SEQ ID NO: 243175 - RNA, 22 nt, Human
cucggcccgacccccagccggc

SEQ ID NO: 243176 - RNA, 20 nt, Human
cucuaccugcccagcucccc

SEQ ID NO: 243177 - RNA, 21 nt, Human
cucucauccccucaccgcgac

SEQ ID NO: 243178 - RNA, 18 nt, Human
cucuccccaccgccccgg

SEQ ID NO: 243179 - RNA, 24 nt, Human
cugcuaggaagacccuagcugugu

SEQ ID NO: 243180 - RNA, 18 nt, Human
cugugcuuaccacuuugc

SEQ ID NO: 243181 - RNA, 24 nt, Human
cuucgcuccccgcggcuaccccuc

SEQ ID NO: 243182 - RNA, 19 nt, Human
cuuugagagcuaaacugag

SEQ ID NO: 243183 - RNA, 18 nt, Human
gaaggagaggcagacaga

SEQ ID NO: 243184 - RNA, 20 nt, Human
gacaggggugggagacgggg

SEQ ID NO: 243185 - RNA, 22 nt, Human
gacccccagccggcgcuugcug

SEQ ID NO: 243186 - RNA, 21 nt, Human
gagcagaaacaaaaaaggcuc

SEQ ID NO: 243187 - RNA, 22 nt, Human
gagcagaaacaaaaaaggcucu

SEQ ID NO: 243188 - RNA, 25 nt, Human
gauaaaacaaggaaaguaaagauuu

SEQ ID NO: 243189 - RNA, 20 nt, Human
gaucauaguuuuaaaaucua

SEQ ID NO: 243190 - RNA, 23 nt, Human
gcaacauacauguucagagaaaa

SEQ ID NO: 243191 - RNA, 21 nt, Human
gcagacagaaaggccaacggu

SEQ ID NO: 243192 - RNA, 22 nt, Human
gcagggccagcgagccccgggg

SEQ ID NO: 243193 - RNA, 19 nt, Human
gccucaccuggagcuuggg

SEQ ID NO: 243194 - RNA, 20 nt, Human
gccuccuuccccaaaaccuu

SEQ ID NO: 243195 - RNA, 19 nt, Human
gcgcagccacagacccugc

SEQ ID NO: 243196 - RNA, 24 nt, Human
gcggguuuuccuccugccccgcuc

SEQ ID NO: 243197 - RNA, 26 nt, Human
gcucucuccaucuucguuuuccaaaa

SEQ ID NO: 243198 - RNA, 31 nt, Human
gcugcaguuucuccacagaacacucugaucc

SEQ ID NO: 243199 - RNA, 21 nt, Human
gcuugcugccuaccucaagcc

SEQ ID NO: 243200 - RNA, 21 nt, Human
ggcagaaguugucaaaccaag

SEQ ID NO: 243201 - RNA, 19 nt, Human
ggccuccuuccccaaaacc

SEQ ID NO: 243202 - RNA, 20 nt, Human
gggagacggggcagcagcca

SEQ ID NO: 243203 - RNA, 19 nt, Human
gggcgcagccacagacccu

SEQ ID NO: 243204 - RNA, 22 nt, Human
gggcugcacgggccgggcccgg

SEQ ID NO: 243205 - RNA, 22 nt, Human
gggcugcaguuucuccacaggu

SEQ ID NO: 243206 - RNA, 20 nt, Human
gggucaggagaggaacaagg

SEQ ID NO: 243207 - RNA, 18 nt, Human
ggguuucacugguguuac

SEQ ID NO: 243208 - RNA, 19 nt, Human
gucaucuccuccccugacu

SEQ ID NO: 243209 - RNA, 19 nt, Human
gucugagcacccuuuucuu

SEQ ID NO: 243210 - RNA, 30 nt, Human
gugggguuucacugguguuacuguugggac

SEQ ID NO: 243211 - RNA, 30 nt, Human
gugggguuucacugguguuacuguugggau

SEQ ID NO: 243212 - RNA, 23 nt, Human
guugcucuuucuuugaaucugag

SEQ ID NO: 243213 - RNA, 25 nt, Human
uaaaacuuaucauagcucccccaaa

SEQ ID NO: 243214 - RNA, 23 nt, Human
uaaaaguaaaaaauauacaguug

SEQ ID NO: 243215 - RNA, 19 nt, Human
uaaggcggagugcagggcc

SEQ ID NO: 243216 - RNA, 23 nt, Human
uaagggcaguagaagaauauggg

SEQ ID NO: 243217 - RNA, 20 nt, Human
uacacaaagcaaauguguau

SEQ ID NO: 243218 - RNA, 22 nt, Human
uaccccucuccgccucacggcc

SEQ ID NO: 243219 - RNA, 24 nt, Human
uacgcagucaacagccugcacuua

SEQ ID NO: 243220 - RNA, 18 nt, Human
uaggaagacccuagcugu

SEQ ID NO: 243221 - RNA, 24 nt, Human
uaucauagcucccccaaaacacac

SEQ ID NO: 243222 - RNA, 21 nt, Human
ucacaugucauauucuauuuc

SEQ ID NO: 243223 - RNA, 22 nt, Human
uccagggaaacagaaguggggc

SEQ ID NO: 243224 - RNA, 19 nt, Human
ucccccaaaacacacauau

SEQ ID NO: 243225 - RNA, 21 nt, Human
uccgcgcuaccgccgcggccg

SEQ ID NO: 243226 - RNA, 18 nt, Human
uccugcugucccaacacc

SEQ ID NO: 243227 - RNA, 23 nt, Human
uccugggggccuugggagggagg

SEQ ID NO: 243228 - RNA, 25 nt, Human
ucgcgcgcggcggcggguuuuccuc

SEQ ID NO: 243229 - RNA, 20 nt, Human
ucuaugcuacaaauugcaaa

SEQ ID NO: 243230 - RNA, 18 nt, Human
ucucacauaggacacucc

SEQ ID NO: 243231 - RNA, 22 nt, Human
ucucacccugugcuuaccacuu

SEQ ID NO: 243232 - RNA, 19 nt, Human
ucuccacagaacacucugc

SEQ ID NO: 243233 - RNA, 18 nt, Human
ucucuuuucucuccacca

SEQ ID NO: 243234 - RNA, 21 nt, Human
ugacaaagagcagaaacaaaa

SEQ ID NO: 243235 - RNA, 24 nt, Human
ugacaaagagcagaaacaaaaaag

SEQ ID NO: 243236 - RNA, 18 nt, Human
ugagaauaaaaauauagg

SEQ ID NO: 243237 - RNA, 21 nt, Human
ugagagcuaaacugaguacau

SEQ ID NO: 243238 - RNA, 19 nt, Human
ugcccagcuccccaggcca

SEQ ID NO: 243239 - RNA, 25 nt, Human
ugccccgcucggcccgacccccagc

SEQ ID NO: 243240 - RNA, 24 nt, Human
ugcucucuccaucuucguuuucca

SEQ ID NO: 243241 - RNA, 19 nt, Human
ugggaaagguagggaaggu

SEQ ID NO: 243242 - RNA, 24 nt, Human
ugggagaaaagccgcugaggucac

SEQ ID NO: 243243 - RNA, 18 nt, Human
ugggagggaggaggagga

SEQ ID NO: 243244 - RNA, 23 nt, Human
uggggccagcccgauggaccucc

SEQ ID NO: 243245 - RNA, 24 nt, Human
uguaaaaaaauuuaaaaaucuuuu

SEQ ID NO: 243246 - RNA, 20 nt, Human
uucaccccuucuuugagagc

SEQ ID NO: 243247 - RNA, 24 nt, Human
uucuccacagaacacucugcaucu

SEQ ID NO: 243248 - RNA, 21 nt, Human
uugcuuccuccgggccggccu

SEQ ID NO: 243249 - RNA, 19 nt, Human
uuggggaacucccucagag

SEQ ID NO: 243250 - RNA, 28 nt, Human
uuuugaugacaauaaaaaguuaacaaua

SEQ ID NO: 243251 - RNA, 21 nt, Human
uuuuggcauacgcagucaaca

SEQ ID NO: 243252 - RNA, 26 nt, Human
uuuugguccaaaguaguugcucuuuc

SEQ ID NO: 243253 - RNA, 21 nt, Human
aaacauaaaagacugcaaaac

SEQ ID NO: 243254 - RNA, 22 nt, Human
aaacauaaaagacugcaaaaca

SEQ ID NO: 243255 - RNA, 18 nt, Human
aaccauaugaaacugcug

SEQ ID NO: 243256 - RNA, 18 nt, Human
aagaacuuaaucacagac

SEQ ID NO: 243257 - RNA, 22 nt, Human
aagcaggucauaaagauggucc

SEQ ID NO: 243258 - RNA, 23 nt, Human
aagcaggucauaaagaugguccu

SEQ ID NO: 243259 - RNA, 22 nt, Human
acacauuuacaaaauagaaaac

SEQ ID NO: 243260 - RNA, 21 nt, Human
acccucucuuuagacagaccc

SEQ ID NO: 243261 - RNA, 23 nt, Human
acuauaaccauacuaaauaugcu

SEQ ID NO: 243262 - RNA, 22 nt, Human
acuccgccgcggccccgcgagc

SEQ ID NO: 243263 - RNA, 23 nt, Human
agaaaaggaauuauuaagguaua

SEQ ID NO: 243264 - RNA, 23 nt, Human
agacaaaccagauuaacaugaaa

SEQ ID NO: 243265 - RNA, 25 nt, Human
agcaaacacaagguaucacaccaaa

SEQ ID NO: 243266 - RNA, 22 nt, Human
aggggcgcagcgugggcgggag

SEQ ID NO: 243267 - RNA, 25 nt, Human
auagagccuuuuucaaaucugagaa

SEQ ID NO: 243268 - RNA, 26 nt, Human
auagagccuuuuucaaaucugagaaa

SEQ ID NO: 243269 - RNA, 20 nt, Human
auauauguauauauaguggg

SEQ ID NO: 243270 - RNA, 21 nt, Human
augauaauaaacauaaaagac

SEQ ID NO: 243271 - RNA, 18 nt, Human
auggucaaaguccuugcc

SEQ ID NO: 243272 - RNA, 21 nt, Human
caaagaaaaaaaucaagauga

SEQ ID NO: 243273 - RNA, 24 nt, Human
caagugaacuaaaagccauaugaa

SEQ ID NO: 243274 - RNA, 24 nt, Human
caauucuauucaguuuaacaaaaa

SEQ ID NO: 243275 - RNA, 18 nt, Human
caucgcuauacaauucua

SEQ ID NO: 243276 - RNA, 20 nt, Human
cauggucaaaguccuugccc

SEQ ID NO: 243277 - RNA, 19 nt, Human
ccccucugggcaggagggg

SEQ ID NO: 243278 - RNA, 21 nt, Human
ccgccgcggccccgcgagcac

SEQ ID NO: 243279 - RNA, 22 nt, Human
ccgccgcggccccgcgagcacu

SEQ ID NO: 243280 - RNA, 23 nt, Human
ccgcgcugagacugcugccucuu

SEQ ID NO: 243281 - RNA, 21 nt, Human
cggcugcggggcuggguccug

SEQ ID NO: 243282 - RNA, 18 nt, Human
cgggcgaauggcagcgag

SEQ ID NO: 243283 - RNA, 19 nt, Human
cguagccaggccgcccgac

SEQ ID NO: 243284 - RNA, 21 nt, Human
cgucaacuucgcccgcucccc

SEQ ID NO: 243285 - RNA, 22 nt, Human
cuccgcgccgggucuucucccc

SEQ ID NO: 243286 - RNA, 23 nt, Human
cuccgcgcugagacugcugccuc

SEQ ID NO: 243287 - RNA, 20 nt, Human
cugcugccucuuuccuaggc

SEQ ID NO: 243288 - RNA, 20 nt, Human
cuuuuggaaugacuuucuaa

SEQ ID NO: 243289 - RNA, 18 nt, Human
gacauacaccaauguaug

SEQ ID NO: 243290 - RNA, 23 nt, Human
gcaaagcuucuuucagagucaaa

SEQ ID NO: 243291 - RNA, 18 nt, Human
gccgcgccgcucagcagc

SEQ ID NO: 243292 - RNA, 23 nt, Human
gcgacagaccgcuggcugcagcc

SEQ ID NO: 243293 - RNA, 18 nt, Human
gcgcagcgugggcgggag

SEQ ID NO: 243294 - RNA, 20 nt, Human
gcggcucaggugggcgagcg

SEQ ID NO: 243295 - RNA, 20 nt, Human
ggauggggaguggccauuuc

SEQ ID NO: 243296 - RNA, 22 nt, Human
ggcaaaacauuacagcuuaaag

SEQ ID NO: 243297 - RNA, 23 nt, Human
ggcgcggcucaggugggcgagcg

SEQ ID NO: 243298 - RNA, 22 nt, Human
gggcacacaggcacgcgcgaca

SEQ ID NO: 243299 - RNA, 18 nt, Human
guagccaggccgcccgac

SEQ ID NO: 243300 - RNA, 23 nt, Human
uaaaagacugcaaaacaauuuaa

SEQ ID NO: 243301 - RNA, 22 nt, Human
uaaaauaacuaaaacuauuaag

SEQ ID NO: 243302 - RNA, 23 nt, Human
uaaaauaacuaaaacuauuaagc

SEQ ID NO: 243303 - RNA, 18 nt, Human
uaaaauuaaaggacacau

SEQ ID NO: 243304 - RNA, 28 nt, Human
uaagccuauugauagcuaagaaaauaau

SEQ ID NO: 243305 - RNA, 24 nt, Human
uacaaacaagugaacuaaaagcca

SEQ ID NO: 243306 - RNA, 18 nt, Human
uacagugaagggaaugga

SEQ ID NO: 243307 - RNA, 19 nt, Human
uacauaaauauauauguau

SEQ ID NO: 243308 - RNA, 20 nt, Human
uacauaaauauauauguaua

SEQ ID NO: 243309 - RNA, 20 nt, Human
uacauaaauauauauguaua

SEQ ID NO: 243310 - RNA, 21 nt, Human
uagagcagcacgguacacucc

SEQ ID NO: 243311 - RNA, 25 nt, Human
uagagcagcacgguacacuccgccg

SEQ ID NO: 243312 - RNA, 21 nt, Human
uagcuaagaaaauaauugucu

SEQ ID NO: 243313 - RNA, 19 nt, Human
uauuauggcuuuuugcaac

SEQ ID NO: 243314 - RNA, 19 nt, Human
ucaaaguucaucaugugcc

SEQ ID NO: 243315 - RNA, 22 nt, Human
ucaaauaaugauagaccugcau

SEQ ID NO: 243316 - RNA, 21 nt, Human
uccaaagaaaaaaaucaagau

SEQ ID NO: 243317 - RNA, 18 nt, Human
ucccacggucccgcagcc

SEQ ID NO: 243318 - RNA, 25 nt, Human
ucuacauaaauauauauguauauau

SEQ ID NO: 243319 - RNA, 21 nt, Human
ugagauagagccuuuuucaaa

SEQ ID NO: 243320 - RNA, 19 nt, Human
ugauaauaaacauaaaaga

SEQ ID NO: 243321 - RNA, 22 nt, Human
ugauagcagagcucugcaaaau

SEQ ID NO: 243322 - RNA, 24 nt, Human
ugcugccucuuuccuaggcugggc

SEQ ID NO: 243323 - RNA, 22 nt, Human
uggacagacaaaccagauuaac

SEQ ID NO: 243324 - RNA, 23 nt, Human
ugggcugcggauccucccugggg

SEQ ID NO: 243325 - RNA, 20 nt, Human
ugucacagaagaucugucuc

SEQ ID NO: 243326 - RNA, 22 nt, Human
ugugggggauggggaguggcca

SEQ ID NO: 243327 - RNA, 22 nt, Human
uuaaaacacuuucaaaagcuaa

SEQ ID NO: 243328 - RNA, 23 nt, Human
uuaaaggacacauuuacaaaaua

SEQ ID NO: 243329 - RNA, 24 nt, Human
uucauauauucaguuaaacccaaa

SEQ ID NO: 243330 - RNA, 20 nt, Human
uuuaaacuacaaaugcagca

SEQ ID NO: 243331 - RNA, 19 nt, Human
uuuccuaggcugggcugag

SEQ ID NO: 243332 - RNA, 19 nt, Human
uuuugcaacauggcaaaac

SEQ ID NO: 243333 - RNA, 21 nt, Human
aaacgugugugaccuccccca

SEQ ID NO: 243334 - RNA, 19 nt, Human
aagccgccccuucaaacua

SEQ ID NO: 243335 - RNA, 23 nt, Human
agaaaagcugcaagguggguucu

SEQ ID NO: 243336 - RNA, 18 nt, Human
agaauacuuuagaaaguu

SEQ ID NO: 243337 - RNA, 23 nt, Human
agcgguggaaaaaauaagggucu

SEQ ID NO: 243338 - RNA, 18 nt, Human
auucuugacuugcuuuca

SEQ ID NO: 243339 - RNA, 25 nt, Human
auugaacugucuucaaaaucuuggc

SEQ ID NO: 243340 - RNA, 21 nt, Human
caaaaucuuggccaaaauggg

SEQ ID NO: 243341 - RNA, 20 nt, Human
caagccacacugcagaaaag

SEQ ID NO: 243342 - RNA, 27 nt, Human
caauacaguaguaacagguaucacuuc

SEQ ID NO: 243343 - RNA, 18 nt, Human
cacgcccauccauuccca

SEQ ID NO: 243344 - RNA, 20 nt, Human
cacugcagaaaagcugcaag

SEQ ID NO: 243345 - RNA, 19 nt, Human
cagaaacgugugugaccuc

SEQ ID NO: 243346 - RNA, 22 nt, Human
caggacucuaaaaacaauacag

SEQ ID NO: 243347 - RNA, 27 nt, Human
ccauguaaacaaaacacaggugaggag

SEQ ID NO: 243348 - RNA, 22 nt, Human
cccauccauucccacucagaaa

SEQ ID NO: 243349 - RNA, 27 nt, Human
cccccaaacgaucacaaguuuaggucc

SEQ ID NO: 243350 - RNA, 18 nt, Human
ccccuucaaacuaauuuc

SEQ ID NO: 243351 - RNA, 23 nt, Human
ccgccccuucaaacuaauuucug

SEQ ID NO: 243352 - RNA, 22 nt, Human
ccucuucauuccuagggguaga

SEQ ID NO: 243353 - RNA, 22 nt, Human
cgaggaguuguagaagguucac

SEQ ID NO: 243354 - RNA, 23 nt, Human
cgcccauccauucccacucagaa

SEQ ID NO: 243355 - RNA, 20 nt, Human
gaaaagcugcaagguggguu

SEQ ID NO: 243356 - RNA, 27 nt, Human
gccacacugcagaaaagcugcaaggug

SEQ ID NO: 243357 - RNA, 19 nt, Human
gguccagguuuucaaaagc

SEQ ID NO: 243358 - RNA, 22 nt, Human
gguccauguaaacaaaacacag

SEQ ID NO: 243359 - RNA, 19 nt, Human
guaucuacaaguugaacag

SEQ ID NO: 243360 - RNA, 24 nt, Human
gugaccucccccaaacgaucacaa

SEQ ID NO: 243361 - RNA, 23 nt, Human
uagccuccagacuucaggacucu

SEQ ID NO: 243362 - RNA, 23 nt, Human
uagcgguggaaaaaauaaggguc

SEQ ID NO: 243363 - RNA, 22 nt, Human
ucacuucucaugugaccaccuc

SEQ ID NO: 243364 - RNA, 25 nt, Human
ucagaacauguuuuggucagguaua

SEQ ID NO: 243365 - RNA, 22 nt, Human
uccagacuucaggacucuaaaa

SEQ ID NO: 243366 - RNA, 21 nt, Human
ucuguccuacacauaucagaa

SEQ ID NO: 243367 - RNA, 20 nt, Human
ucuuaugucaaauguagaau

SEQ ID NO: 243368 - RNA, 18 nt, Human
ucuuccgccccgaaaggg

SEQ ID NO: 243369 - RNA, 22 nt, Human
ucuugacuugcuuucaggaagu

SEQ ID NO: 243370 - RNA, 20 nt, Human
ugacauagagguccagguuu

SEQ ID NO: 243371 - RNA, 21 nt, Human
ugaccucccccaaacgaucac

SEQ ID NO: 243372 - RNA, 25 nt, Human
ugaccucccccaaacgaucacaagu

SEQ ID NO: 243373 - RNA, 18 nt, Human
ugacuugcuuucaggaag

SEQ ID NO: 243374 - RNA, 19 nt, Human
ugagaaugguccuucugga

SEQ ID NO: 243375 - RNA, 18 nt, Human
ugagaugcucaaacguag

SEQ ID NO: 243376 - RNA, 23 nt, Human
uggaaaaaauaagggucucccac

SEQ ID NO: 243377 - RNA, 22 nt, Human
uggccaaaaugggaaaacucaa

SEQ ID NO: 243378 - RNA, 23 nt, Human
uggguucuuccauuccugcaccu

SEQ ID NO: 243379 - RNA, 21 nt, Human
ugucuucaaaaucuuggccaa

SEQ ID NO: 243380 - RNA, 19 nt, Human
uuaaaggauuguugugcuu

SEQ ID NO: 243381 - RNA, 19 nt, Human
uuccagaaucucuuaaccu

SEQ ID NO: 243382 - RNA, 22 nt, Human
uucuuccauuccugcaccucag

SEQ ID NO: 243383 - RNA, 24 nt, Human
uuucaaaagccgccccuucaaacu

SEQ ID NO: 243384 - RNA, 20 nt, Human
uuuggucagguauaaaaugg

SEQ ID NO: 243385 - RNA, 22 nt, Human
aaaaaagaaaaaacccacagaa

SEQ ID NO: 243386 - RNA, 24 nt, Human
aaaacgcccuuggccuucgcccug

SEQ ID NO: 243387 - RNA, 22 nt, Human
aaaagaaaaaagaaaaaaccca

SEQ ID NO: 243388 - RNA, 18 nt, Human
aaagaaaaaagaaaaaac

SEQ ID NO: 243389 - RNA, 21 nt, Human
aaagccaaugauucucaaucc

SEQ ID NO: 243390 - RNA, 22 nt, Human
acagaauucauguucucacagu

SEQ ID NO: 243391 - RNA, 24 nt, Human
agaaaaaacccacagaaucacaga

SEQ ID NO: 243392 - RNA, 23 nt, Human
agaaaaaagaaaaaacccacaga

SEQ ID NO: 243393 - RNA, 23 nt, Human
agacucgccggcaacugggaagg

SEQ ID NO: 243394 - RNA, 21 nt, Human
caagaaagguauaaaagccaa

SEQ ID NO: 243395 - RNA, 23 nt, Human
caagaaagguauaaaagccaaug

SEQ ID NO: 243396 - RNA, 24 nt, Human
cacagaaucacagaauucauguuc

SEQ ID NO: 243397 - RNA, 18 nt, Human
cacucuccucagccaaag

SEQ ID NO: 243398 - RNA, 19 nt, Human
cagccaaaggagacagcgc

SEQ ID NO: 243399 - RNA, 19 nt, Human
cagcgccgaccuccggcag

SEQ ID NO: 243400 - RNA, 19 nt, Human
ccccacaaacuugaucgca

SEQ ID NO: 243401 - RNA, 22 nt, Human
ccccggggucgggcgccccucu

SEQ ID NO: 243402 - RNA, 18 nt, Human
cccgcacuuccugccacc

SEQ ID NO: 243403 - RNA, 19 nt, Human
ccggcaacugggaaggggg

SEQ ID NO: 243404 - RNA, 21 nt, Human
ccggcaacugggaaggggggc

SEQ ID NO: 243405 - RNA, 18 nt, Human
ccugccaccgccgcccca

SEQ ID NO: 243406 - RNA, 23 nt, Human
ccugccaccgccgccccaacuga

SEQ ID NO: 243407 - RNA, 20 nt, Human
ccuggccugccgcccucccc

SEQ ID NO: 243408 - RNA, 21 nt, Human
ccuggccugccgcccuccccg

SEQ ID NO: 243409 - RNA, 18 nt, Human
cgcccuggccugccgccc

SEQ ID NO: 243410 - RNA, 24 nt, Human
cgcccuuggccuucgcccuggccu

SEQ ID NO: 243411 - RNA, 18 nt, Human
cuagucuccggcgccaca

SEQ ID NO: 243412 - RNA, 20 nt, Human
cucagcgccgaccuccggcc

SEQ ID NO: 243413 - RNA, 19 nt, Human
cucccgggccggggccgcg

SEQ ID NO: 243414 - RNA, 21 nt, Human
cucgaggcgagacucgccggc

SEQ ID NO: 243415 - RNA, 23 nt, Human
cuuccugccaccgccgccccaac

SEQ ID NO: 243416 - RNA, 24 nt, Human
cuucgcccuggccugccgcccucc

SEQ ID NO: 243417 - RNA, 25 nt, Human
cuuggccuucgcccuggccugccgc

SEQ ID NO: 243418 - RNA, 23 nt, Human
cuuggccuucgcccuggccuggu

SEQ ID NO: 243419 - RNA, 19 nt, Human
gaaaaaagaaaaaacccac

SEQ ID NO: 243420 - RNA, 23 nt, Human
ggaggggaaaggaacaagaucgc

SEQ ID NO: 243421 - RNA, 27 nt, Human
gggccggggccgcgcagcuaggucaga

SEQ ID NO: 243422 - RNA, 23 nt, Human
uaaaagccaaugauucucaaucc

SEQ ID NO: 243423 - RNA, 20 nt, Human
uccaaaugugaaagucaggu

SEQ ID NO: 243424 - RNA, 18 nt, Human
uccccggggucgggcgcc

SEQ ID NO: 243425 - RNA, 18 nt, Human
ucccgggcugcgcgaccu

SEQ ID NO: 243426 - RNA, 23 nt, Human
ucucccgggcugcgcgaccuccg

SEQ ID NO: 243427 - RNA, 18 nt, Human
uggccugccgcccucccc

SEQ ID NO: 243428 - RNA, 18 nt, Human
ugggaaggggggccccca

SEQ ID NO: 243429 - RNA, 25 nt, Human
aaacagaaaaugagggcagagccca

SEQ ID NO: 243430 - RNA, 26 nt, Human
aacuuucucuucaggccacaagaagc

SEQ ID NO: 243431 - RNA, 27 nt, Human
aagaaagagcccuuggggacagcagcc

SEQ ID NO: 243432 - RNA, 25 nt, Human
aagaagcccuaacccaagcggaggc

SEQ ID NO: 243433 - RNA, 21 nt, Human
aagcagagccuggcacugccc

SEQ ID NO: 243434 - RNA, 23 nt, Human
aaggagguuggcugaaggaauac

SEQ ID NO: 243435 - RNA, 21 nt, Human
aagugaccuaugaucucuggc

SEQ ID NO: 243436 - RNA, 23 nt, Human
acagagcacagaagccaaagaga

SEQ ID NO: 243437 - RNA, 22 nt, Human
acauggagucucuacauaacca

SEQ ID NO: 243438 - RNA, 22 nt, Human
accaauccccacucccugccau

SEQ ID NO: 243439 - RNA, 22 nt, Human
acccacuuagccucccuuaccu

SEQ ID NO: 243440 - RNA, 22 nt, Human
acguagucccggauguccacca

SEQ ID NO: 243441 - RNA, 19 nt, Human
acucugauccugcucaucu

SEQ ID NO: 243442 - RNA, 23 nt, Human
agacuaaaggugaggcuucaagg

SEQ ID NO: 243443 - RNA, 20 nt, Human
agagacacccagggccuggg

SEQ ID NO: 243444 - RNA, 20 nt, Human
agagacagccccuccacccc

SEQ ID NO: 243445 - RNA, 18 nt, Human
agaggaugaaaugagcgc

SEQ ID NO: 243446 - RNA, 19 nt, Human
agcacagaagccaaagaga

SEQ ID NO: 243447 - RNA, 20 nt, Human
agcagcagcaauaaacagaa

SEQ ID NO: 243448 - RNA, 22 nt, Human
agcagcagcaauaaacagaaaa

SEQ ID NO: 243449 - RNA, 25 nt, Human
agcaggaggcggaaacgguugcagg

SEQ ID NO: 243450 - RNA, 30 nt, Human
aggaccccacaccccugccaccaucccacc

SEQ ID NO: 243451 - RNA, 19 nt, Human
aggcggcacuuacugcaaa

SEQ ID NO: 243452 - RNA, 20 nt, Human
agggcagagcccaguguguc

SEQ ID NO: 243453 - RNA, 23 nt, Human
agguacauggaggucagguggcu

SEQ ID NO: 243454 - RNA, 19 nt, Human
agguggcugaggagggaug

SEQ ID NO: 243455 - RNA, 18 nt, Human
auacagagcacagaagcc

SEQ ID NO: 243456 - RNA, 18 nt, Human
cacaagaagcccuaaccc

SEQ ID NO: 243457 - RNA, 20 nt, Human
cacaccccugccaccauccc

SEQ ID NO: 243458 - RNA, 23 nt, Human
cacagcagcagcaauaaacagaa

SEQ ID NO: 243459 - RNA, 20 nt, Human
cacagccauacugccuccuc

SEQ ID NO: 243460 - RNA, 28 nt, Human
cacauccaggccauggaaaaggcugccc

SEQ ID NO: 243461 - RNA, 25 nt, Human
caccccugccaccaucccacaaauc

SEQ ID NO: 243462 - RNA, 18 nt, Human
cacugcugaauaauagcu

SEQ ID NO: 243463 - RNA, 18 nt, Human
cacuggcgucugcccuau

SEQ ID NO: 243464 - RNA, 23 nt, Human
cagaagccaaagagaauucaggc

SEQ ID NO: 243465 - RNA, 19 nt, Human
cagagaaagaaaguaggac

SEQ ID NO: 243466 - RNA, 22 nt, Human
cagcagcauacagagcacagaa

SEQ ID NO: 243467 - RNA, 22 nt, Human
cauaguacgcaaccaccucuga

SEQ ID NO: 243468 - RNA, 20 nt, Human
caucagccgccgguccaaga

SEQ ID NO: 243469 - RNA, 19 nt, Human
cauggaggucagguggcug

SEQ ID NO: 243470 - RNA, 19 nt, Human
ccagagacagccccucccc

SEQ ID NO: 243471 - RNA, 21 nt, Human
cccaaguucuuggccuccagg

SEQ ID NO: 243472 - RNA, 19 nt, Human
cccaccccuguccucccag

SEQ ID NO: 243473 - RNA, 26 nt, Human
cccacugcuaacucuggguccccacc

SEQ ID NO: 243474 - RNA, 23 nt, Human
ccccacaccccugccaccauccc

SEQ ID NO: 243475 - RNA, 19 nt, Human
ccccugccaccaucccaca

SEQ ID NO: 243476 - RNA, 24 nt, Human
cccuauuaauugaagcugaaauga

SEQ ID NO: 243477 - RNA, 24 nt, Human
ccgucggggcugcacccuggcugu

SEQ ID NO: 243478 - RNA, 20 nt, Human
ccucccuuaccucuucuguc

SEQ ID NO: 243479 - RNA, 21 nt, Human
ccucccuuaccucuucugucu

SEQ ID NO: 243480 - RNA, 20 nt, Human
ccugagccugugcccaguug

SEQ ID NO: 243481 - RNA, 21 nt, Human
ccugaugcugggcuguuaccc

SEQ ID NO: 243482 - RNA, 20 nt, Human
ccugcaucagccgccggucc

SEQ ID NO: 243483 - RNA, 25 nt, Human
ccuggcacugcccacucugaccaag

SEQ ID NO: 243484 - RNA, 21 nt, Human
ccuggcuacaggcagagcgag

SEQ ID NO: 243485 - RNA, 23 nt, Human
cuagagccugcuguugccacagu

SEQ ID NO: 243486 - RNA, 20 nt, Human
cuaggagaaacagugauucc

SEQ ID NO: 243487 - RNA, 21 nt, Human
cuaguccccugugccaggaac

SEQ ID NO: 243488 - RNA, 21 nt, Human
cucacaacccaaagcagagcc

SEQ ID NO: 243489 - RNA, 23 nt, Human
cucacugcccacgguucgccgcu

SEQ ID NO: 243490 - RNA, 23 nt, Human
cucauauacucuacaugccccua

SEQ ID NO: 243491 - RNA, 22 nt, Human
cuccaggccgcagucaaaaccc

SEQ ID NO: 243492 - RNA, 19 nt, Human
cucuacauaaccacaggau

SEQ ID NO: 243493 - RNA, 19 nt, Human
cugauccugcucaucacac

SEQ ID NO: 243494 - RNA, 18 nt, Human
cugcacagccauacugcc

SEQ ID NO: 243495 - RNA, 21 nt, Human
cugcauguccaccugcugcuc

SEQ ID NO: 243496 - RNA, 20 nt, Human
cuuacgaaauaccuuuucag

SEQ ID NO: 243497 - RNA, 25 nt, Human
gaaaacacagcagcagcaauaaaca

SEQ ID NO: 243498 - RNA, 20 nt, Human
gaaauaccuuuucagcaucu

SEQ ID NO: 243499 - RNA, 19 nt, Human
gaccccacaccccugccac

SEQ ID NO: 243500 - RNA, 22 nt, Human
gaggccuucagacuccuaggag

SEQ ID NO: 243501 - RNA, 23 nt, Human
gauuccuucuacugcuccauccc

SEQ ID NO: 243502 - RNA, 18 nt, Human
gcaugggguagaaguugg

SEQ ID NO: 243503 - RNA, 21 nt, Human
gccccuaguccccugugccag

SEQ ID NO: 243504 - RNA, 18 nt, Human
ggcagugaggaagccaga

SEQ ID NO: 243505 - RNA, 20 nt, Human
ggccaagugcccaguuugcc

SEQ ID NO: 243506 - RNA, 23 nt, Human
gggauggguagcugguagagugg

SEQ ID NO: 243507 - RNA, 19 nt, Human
ggggacagcagcauacaga

SEQ ID NO: 243508 - RNA, 23 nt, Human
ggggcuccuuggggacguagggc

SEQ ID NO: 243509 - RNA, 22 nt, Human
gguggcugaggagggauggguu

SEQ ID NO: 243510 - RNA, 23 nt, Human
gugaaggaccccacaccccugcc

SEQ ID NO: 243511 - RNA, 21 nt, Human
guugguuucugaaacagaccu

SEQ ID NO: 243512 - RNA, 20 nt, Human
uaaacagaaaaugagggcag

SEQ ID NO: 243513 - RNA, 22 nt, Human
uaaacagaaaaugagggcagag

SEQ ID NO: 243514 - RNA, 19 nt, Human
uaacucuggguccccaccc

SEQ ID NO: 243515 - RNA, 21 nt, Human
uaacucuggguccccaccccu

SEQ ID NO: 243516 - RNA, 21 nt, Human
uaagaaagagcccuuggggac

SEQ ID NO: 243517 - RNA, 19 nt, Human
uacauggaggucagguggc

SEQ ID NO: 243518 - RNA, 22 nt, Human
uaccgucggggcugcacccugg

SEQ ID NO: 243519 - RNA, 21 nt, Human
uaccucuucugucugcuucca

SEQ ID NO: 243520 - RNA, 21 nt, Human
uaccugaagugaccuaugauc

SEQ ID NO: 243521 - RNA, 21 nt, Human
uagaaugccaucacuguuggu

SEQ ID NO: 243522 - RNA, 22 nt, Human
uaggccaagugcccaguuugcc

SEQ ID NO: 243523 - RNA, 20 nt, Human
uaggccaugacuggcauggg

SEQ ID NO: 243524 - RNA, 22 nt, Human
ucacuggguuuguggguugcgc

SEQ ID NO: 243525 - RNA, 23 nt, Human
ucagcgcccggccuccgcgccgc

SEQ ID NO: 243526 - RNA, 19 nt, Human
uccacacacaccgucagcg

SEQ ID NO: 243527 - RNA, 23 nt, Human
uccacacacaccgucagcgcccg

SEQ ID NO: 243528 - RNA, 21 nt, Human
uccagagaaagaaaguaggac

SEQ ID NO: 243529 - RNA, 21 nt, Human
uccagagacagccccuccacc

SEQ ID NO: 243530 - RNA, 25 nt, Human
uccugcaucagccgccgguccaaga

SEQ ID NO: 243531 - RNA, 21 nt, Human
uccuggcuacaggcagagcga

SEQ ID NO: 243532 - RNA, 22 nt, Human
uccuuccugccauucugcagcc

SEQ ID NO: 243533 - RNA, 18 nt, Human
uccuugagcccuuggccu

SEQ ID NO: 243534 - RNA, 22 nt, Human
ucuacauaaccacaggauuccc

SEQ ID NO: 243535 - RNA, 22 nt, Human
ucucuacauaaccacaggauuc

SEQ ID NO: 243536 - RNA, 18 nt, Human
ucucuggccaugacaauc

SEQ ID NO: 243537 - RNA, 19 nt, Human
ucugcagccuguuagccaa

SEQ ID NO: 243538 - RNA, 26 nt, Human
ucuguauggaugugcagggccagcuc

SEQ ID NO: 243539 - RNA, 20 nt, Human
ugaaaugagcgcagaccaac

SEQ ID NO: 243540 - RNA, 22 nt, Human
ugaaggaccccacaccccugcc

SEQ ID NO: 243541 - RNA, 19 nt, Human
ugaaggcuccugcacagcc

SEQ ID NO: 243542 - RNA, 23 nt, Human
ugaauaccucugcagauagacuu

SEQ ID NO: 243543 - RNA, 20 nt, Human
ugagaagaaagggccuucag

SEQ ID NO: 243544 - RNA, 22 nt, Human
ugagugcggucuccgccgaggg

SEQ ID NO: 243545 - RNA, 23 nt, Human
ugaucucuggccaugacaaucuc

SEQ ID NO: 243546 - RNA, 23 nt, Human
ugcauccuggcuacaggcagagc

SEQ ID NO: 243547 - RNA, 18 nt, Human
ugcauguccaccugcugc

SEQ ID NO: 243548 - RNA, 27 nt, Human
ugcccaagcacauggagucuuggaggc

SEQ ID NO: 243549 - RNA, 21 nt, Human
ugcccagggcuaccuugccuu

SEQ ID NO: 243550 - RNA, 21 nt, Human
uggacggggaggccagagggu

SEQ ID NO: 243551 - RNA, 19 nt, Human
uggccuggagggggagcuu

SEQ ID NO: 243552 - RNA, 21 nt, Human
uggcuaguuucugacuuuaau

SEQ ID NO: 243553 - RNA, 21 nt, Human
uggggacagcagcauacagag

SEQ ID NO: 243554 - RNA, 18 nt, Human
ugguuucugaaacagacc

SEQ ID NO: 243555 - RNA, 21 nt, Human
ugucacaguucugggaggcag

SEQ ID NO: 243556 - RNA, 20 nt, Human
uguccaccugcugcucgugc

SEQ ID NO: 243557 - RNA, 21 nt, Human
uuacccacuuagccucccuua

SEQ ID NO: 243558 - RNA, 19 nt, Human
uuccugccauucugcagcc

SEQ ID NO: 243559 - RNA, 23 nt, Human
uuccuucuacugcuccaucccca

SEQ ID NO: 243560 - RNA, 23 nt, Human
uucucuuguuguccuugagcccu

SEQ ID NO: 243561 - RNA, 24 nt, Human
uuggccuccaggccgcagucaaaa

SEQ ID NO: 243562 - RNA, 19 nt, Human
aagguaggaaaaugccacc

SEQ ID NO: 243563 - RNA, 18 nt, Human
cagcagccccaagaggag

SEQ ID NO: 243564 - RNA, 22 nt, Human
cagcagcuuccuccugggguuc

SEQ ID NO: 243565 - RNA, 23 nt, Human
cccccagacccggccgggccuau

SEQ ID NO: 243566 - RNA, 19 nt, Human
ccucagggcacugguuggg

SEQ ID NO: 243567 - RNA, 23 nt, Human
cgcccccagacccggccgggccu

SEQ ID NO: 243568 - RNA, 21 nt, Human
cgccccgcccccagacccggc

SEQ ID NO: 243569 - RNA, 19 nt, Human
cgggguggggggcggggcc

SEQ ID NO: 243570 - RNA, 19 nt, Human
cugggguuccccggcccug

SEQ ID NO: 243571 - RNA, 25 nt, Human
gagaggcuguagcccugggcaaucc

SEQ ID NO: 243572 - RNA, 19 nt, Human
gagcaggaggcuugggcuu

SEQ ID NO: 243573 - RNA, 22 nt, Human
gcaaacgccccgcccccagacc

SEQ ID NO: 243574 - RNA, 21 nt, Human
ggagcaggaggcuugggcuug

SEQ ID NO: 243575 - RNA, 23 nt, Human
ggcucagcagcuuccuccugggg

SEQ ID NO: 243576 - RNA, 20 nt, Human
gggggcggggccaggggcgg

SEQ ID NO: 243577 - RNA, 23 nt, Human
ggguggggggcggggccaggggc

SEQ ID NO: 243578 - RNA, 21 nt, Human
uacguuuuaaugcagcagccc

SEQ ID NO: 243579 - RNA, 19 nt, Human
uagagcagaagugcuuuuc

SEQ ID NO: 243580 - RNA, 20 nt, Human
uagcccugggcaaucccggg

SEQ ID NO: 243581 - RNA, 22 nt, Human
uaugaagacggaaugccucuua

SEQ ID NO: 243582 - RNA, 19 nt, Human
uggggggcggggccagggg

SEQ ID NO: 243583 - RNA, 25 nt, Human
aagcagaaauuaggaguccccagag

SEQ ID NO: 243584 - RNA, 19 nt, Human
caaacaaaaccccagcccc

SEQ ID NO: 243585 - RNA, 21 nt, Human
ccacaagaaaagacugauccc

SEQ ID NO: 243586 - RNA, 22 nt, Human
ccuucuacaaacaaaaccccag

SEQ ID NO: 243587 - RNA, 24 nt, Human
cuucuacaaacaaaaccccagccc

SEQ ID NO: 243588 - RNA, 22 nt, Human
uccccagagccuucuacaaaca

SEQ ID NO: 243589 - RNA, 25 nt, Human
ucccugcuuuaggcuggggaagcag

SEQ ID NO: 243590 - RNA, 20 nt, Human
uuaggcuggggaagcagaaa

SEQ ID NO: 243591 - RNA, 18 nt, Human
aaacagccuccccuggaa

SEQ ID NO: 243592 - RNA, 22 nt, Human
aagcuagcugugaaagaccuac

SEQ ID NO: 243593 - RNA, 20 nt, Human
aagggaccggcggugaagcc

SEQ ID NO: 243594 - RNA, 28 nt, Human
aauacccauauaccuuuacccaaauagc

SEQ ID NO: 243595 - RNA, 18 nt, Human
acaggcuuguuugaggac

SEQ ID NO: 243596 - RNA, 23 nt, Human
agaaaugcuuuauucccauuguc

SEQ ID NO: 243597 - RNA, 19 nt, Human
agcuagcugugaaagaccu

SEQ ID NO: 243598 - RNA, 21 nt, Human
auauaccuuuacccaaauagc

SEQ ID NO: 243599 - RNA, 22 nt, Human
auuguccacugaaaauacaacc

SEQ ID NO: 243600 - RNA, 19 nt, Human
caagggaccggcggugaag

SEQ ID NO: 243601 - RNA, 19 nt, Human
cagaaaaauacccauauac

SEQ ID NO: 243602 - RNA, 21 nt, Human
cagcacgcagacaugucucuc

SEQ ID NO: 243603 - RNA, 23 nt, Human
caguguacaacucuucacagagc

SEQ ID NO: 243604 - RNA, 22 nt, Human
ccaccaagaaaucucuguugua

SEQ ID NO: 243605 - RNA, 21 nt, Human
cccaaauagcuaccaccaaga

SEQ ID NO: 243606 - RNA, 20 nt, Human
cccucugaaauaauaacaaa

SEQ ID NO: 243607 - RNA, 24 nt, Human
ccggcggugaagccacucaccccc

SEQ ID NO: 243608 - RNA, 26 nt, Human
ccucaaaaccuuccauuugguuccuu

SEQ ID NO: 243609 - RNA, 22 nt, Human
ccugcuaaagcugagaggugaa

SEQ ID NO: 243610 - RNA, 23 nt, Human
ccuggguaaacagccuccccugg

SEQ ID NO: 243611 - RNA, 22 nt, Human
cgaaaggcagcgcugcaaggga

SEQ ID NO: 243612 - RNA, 24 nt, Human
cggcggugaagccacucacccccu

SEQ ID NO: 243613 - RNA, 21 nt, Human
cuccuugucucuguugccuuc

SEQ ID NO: 243614 - RNA, 20 nt, Human
gaaaggcagcgcugcaaggg

SEQ ID NO: 243615 - RNA, 19 nt, Human
gacauugccuggguaaaca

SEQ ID NO: 243616 - RNA, 23 nt, Human
gaccuacaucaccucaaaaccuu

SEQ ID NO: 243617 - RNA, 23 nt, Human
gagaggugaagggcuaaaaacac

SEQ ID NO: 243618 - RNA, 18 nt, Human
gcuuguuugaggacauug

SEQ ID NO: 243619 - RNA, 18 nt, Human
ucaguguacaacucuuca

SEQ ID NO: 243620 - RNA, 21 nt, Human
uccugccaugucacauucuug

SEQ ID NO: 243621 - RNA, 18 nt, Human
ucuuguaaccagcugcag

SEQ ID NO: 243622 - RNA, 18 nt, Human
ugaaauaauaacaaagca

SEQ ID NO: 243623 - RNA, 23 nt, Human
ugcuuuauucccauuguccacug

SEQ ID NO: 243624 - RNA, 18 nt, Human
ugguuccauagauccugc

SEQ ID NO: 243625 - RNA, 19 nt, Human
ugucucuguugccuuccuc

SEQ ID NO: 243626 - RNA, 24 nt, Human
aaccagugagcagagagcauaaga

SEQ ID NO: 243627 - RNA, 20 nt, Human
aacuugucaauauuuuccuc

SEQ ID NO: 243628 - RNA, 21 nt, Human
cacguuuaacuuugugaauuu

SEQ ID NO: 243629 - RNA, 25 nt, Human
cacuccugugccuacgacccaggag

SEQ ID NO: 243630 - RNA, 21 nt, Human
ccugugccuacgacccaggag

SEQ ID NO: 243631 - RNA, 19 nt, Human
cuccugugccuacgaccca

SEQ ID NO: 243632 - RNA, 22 nt, Human
ugaguugaucuacacugacaaa

SEQ ID NO: 243633 - RNA, 21 nt, Human
uggcccaaugacacagccuuu

SEQ ID NO: 243634 - RNA, 22 nt, Human
uggcccaaugacacagccuuua

SEQ ID NO: 243635 - RNA, 23 nt, Human
uguuuuuacuuuaacaaugauug

SEQ ID NO: 243636 - RNA, 21 nt, Human
aaacucauaucccaaauacag

SEQ ID NO: 243637 - RNA, 26 nt, Human
aacucuuuccccaaacucauauccca

SEQ ID NO: 243638 - RNA, 22 nt, Human
aagcaggggccacaacggagaa

SEQ ID NO: 243639 - RNA, 22 nt, Human
acaccgcacaaaacaguaagac

SEQ ID NO: 243640 - RNA, 18 nt, Human
acccacacaacgggacac

SEQ ID NO: 243641 - RNA, 20 nt, Human
acucuaaaacagaaggugag

SEQ ID NO: 243642 - RNA, 21 nt, Human
agcuggagacacaccgcacaa

SEQ ID NO: 243643 - RNA, 24 nt, Human
auacaauggaggauacaaaaggaa

SEQ ID NO: 243644 - RNA, 21 nt, Human
caacucuaaaacagaagguga

SEQ ID NO: 243645 - RNA, 20 nt, Human
cacaaaacaguaagacuuaa

SEQ ID NO: 243646 - RNA, 23 nt, Human
cagcuggagacacaccgcacaaa

SEQ ID NO: 243647 - RNA, 23 nt, Human
caggggccacaacggagaaagag

SEQ ID NO: 243648 - RNA, 18 nt, Human
cccacacaacgggacacc

SEQ ID NO: 243649 - RNA, 20 nt, Human
cccacacaacgggacaccau

SEQ ID NO: 243650 - RNA, 20 nt, Human
ccccaaacucauaucccaaa

SEQ ID NO: 243651 - RNA, 19 nt, Human
cccccagauaccaguggcu

SEQ ID NO: 243652 - RNA, 18 nt, Human
ccccguuccaggccuccc

SEQ ID NO: 243653 - RNA, 21 nt, Human
ccucccuggugcccgcugcuc

SEQ ID NO: 243654 - RNA, 23 nt, Human
cgggacaccaucgguaacuauga

SEQ ID NO: 243655 - RNA, 25 nt, Human
cuaaaacagaaggugaggacuaaau

SEQ ID NO: 243656 - RNA, 18 nt, Human
gagugaaggaggauaauu

SEQ ID NO: 243657 - RNA, 21 nt, Human
ggagacacaccgcacaaaaca

SEQ ID NO: 243658 - RNA, 24 nt, Human
ggccacaacggagaaagagauacc

SEQ ID NO: 243659 - RNA, 19 nt, Human
gggaaaacauccaaagagg

SEQ ID NO: 243660 - RNA, 21 nt, Human
gguaagaggaagaacaagcac

SEQ ID NO: 243661 - RNA, 20 nt, Human
gugaaacagaacgcuaagcc

SEQ ID NO: 243662 - RNA, 22 nt, Human
guggggcagcaagaaccuuaaa

SEQ ID NO: 243663 - RNA, 20 nt, Human
guguaagacaacuuagcaca

SEQ ID NO: 243664 - RNA, 25 nt, Human
uaaacccacacaacgggacaccuua

SEQ ID NO: 243665 - RNA, 23 nt, Human
uacaaaaggaagaagagauaaaa

SEQ ID NO: 243666 - RNA, 20 nt, Human
uacaauggaggauacaaaag

SEQ ID NO: 243667 - RNA, 25 nt, Human
uacaguaagaagagagugugauuac

SEQ ID NO: 243668 - RNA, 21 nt, Human
uaccaucaaaaaaguuaaaau

SEQ ID NO: 243669 - RNA, 20 nt, Human
uagcacagaguaaacccaca

SEQ ID NO: 243670 - RNA, 20 nt, Human
uauuugucuucauggaacuu

SEQ ID NO: 243671 - RNA, 24 nt, Human
ucaacuuuuauuuuuaauuaccca

SEQ ID NO: 243672 - RNA, 19 nt, Human
ucagcuggagacacaccgc

SEQ ID NO: 243673 - RNA, 22 nt, Human
ucagcuguaacaauacaguauu

SEQ ID NO: 243674 - RNA, 21 nt, Human
uccccaaacucauaucccaaa

SEQ ID NO: 243675 - RNA, 19 nt, Human
ugacagggagugaaggagg

SEQ ID NO: 243676 - RNA, 24 nt, Human
ugagggcaauaaacuuggaaacug

SEQ ID NO: 243677 - RNA, 21 nt, Human
ugauuacagacacccucucuc

SEQ ID NO: 243678 - RNA, 21 nt, Human
ugcaaagaacuagggaaggug

SEQ ID NO: 243679 - RNA, 23 nt, Human
ugcuccguuuucugggccucgau

SEQ ID NO: 243680 - RNA, 18 nt, Human
uggagacacaccgcacaa

SEQ ID NO: 243681 - RNA, 18 nt, Human
uggggaaaacauccaaag

SEQ ID NO: 243682 - RNA, 20 nt, Human
ugucuucauggaacuuuacu

SEQ ID NO: 243683 - RNA, 19 nt, Human
uguguacuguccuuuguau

SEQ ID NO: 243684 - RNA, 22 nt, Human
uguucuagucccccagauacca

SEQ ID NO: 243685 - RNA, 24 nt, Human
uuaauuacccaaguguguacuguc

SEQ ID NO: 243686 - RNA, 22 nt, Human
uucaugcuccccgccucacucc

SEQ ID NO: 243687 - RNA, 24 nt, Human
aaaggagcugggggaguggauccu

SEQ ID NO: 243688 - RNA, 22 nt, Human
aagcagggucugggggauaagc

SEQ ID NO: 243689 - RNA, 18 nt, Human
aagcuccuuucuccucuc

SEQ ID NO: 243690 - RNA, 20 nt, Human
acaacaagacaucucccucc

SEQ ID NO: 243691 - RNA, 24 nt, Human
acaugcagagaagccaagcagggg

SEQ ID NO: 243692 - RNA, 19 nt, Human
accacaugcagagaagcca

SEQ ID NO: 243693 - RNA, 18 nt, Human
acuauagcagggaagcgu

SEQ ID NO: 243694 - RNA, 20 nt, Human
agaacucagacccugguggu

SEQ ID NO: 243695 - RNA, 22 nt, Human
agaaggcaagcccacaugacua

SEQ ID NO: 243696 - RNA, 19 nt, Human
agcacggggaggguggagc

SEQ ID NO: 243697 - RNA, 21 nt, Human
agcagaacacagcagcacggg

SEQ ID NO: 243698 - RNA, 21 nt, Human
agcuucuggguuucucagucu

SEQ ID NO: 243699 - RNA, 20 nt, Human
aguggcuuauuuuuaaccca

SEQ ID NO: 243700 - RNA, 20 nt, Human
auaagcuccuuucuccucuc

SEQ ID NO: 243701 - RNA, 22 nt, Human
aucaccuuccccuaagcaggac

SEQ ID NO: 243702 - RNA, 23 nt, Human
auccuuggggaagggagggcggc

SEQ ID NO: 243703 - RNA, 18 nt, Human
aucucccuccccuccccc

SEQ ID NO: 243704 - RNA, 21 nt, Human
caaaggacucagcaguagcca

SEQ ID NO: 243705 - RNA, 23 nt, Human
caacaagacaucucccuccccuc

SEQ ID NO: 243706 - RNA, 27 nt, Human
caacaagacaucucccuccccuccccc

SEQ ID NO: 243707 - RNA, 19 nt, Human
caaccccaaaggacucagc

SEQ ID NO: 243708 - RNA, 22 nt, Human
caagccacagcagaugaccaca

SEQ ID NO: 243709 - RNA, 20 nt, Human
caaguccccacaacaagaca

SEQ ID NO: 243710 - RNA, 25 nt, Human
caaguccccacaacaagacaucucc

SEQ ID NO: 243711 - RNA, 23 nt, Human
caaguccucuggccuggcuucca

SEQ ID NO: 243712 - RNA, 21 nt, Human
cacugggauuuaccaggauga

SEQ ID NO: 243713 - RNA, 24 nt, Human
cagugcuaggagaggguucucagg

SEQ ID NO: 243714 - RNA, 18 nt, Human
caugacuaccagcuucug

SEQ ID NO: 243715 - RNA, 22 nt, Human
cauucucuaaaggagcuggggg

SEQ ID NO: 243716 - RNA, 22 nt, Human
ccagcccaaguccccacaacaa

SEQ ID NO: 243717 - RNA, 22 nt, Human
ccagucguuuggcagagaaggc

SEQ ID NO: 243718 - RNA, 18 nt, Human
cccagcccaaguccccac

SEQ ID NO: 243719 - RNA, 20 nt, Human
cccagcccaaguccccacaa

SEQ ID NO: 243720 - RNA, 24 nt, Human
cccaggacccugcuagaacucaga

SEQ ID NO: 243721 - RNA, 21 nt, Human
cccauuaaacaccaagccaca

SEQ ID NO: 243722 - RNA, 22 nt, Human
ccccaggacccugcuagaacuc

SEQ ID NO: 243723 - RNA, 19 nt, Human
cccccaggacccugcuaga

SEQ ID NO: 243724 - RNA, 20 nt, Human
cccucaaccccaaaggacuc

SEQ ID NO: 243725 - RNA, 22 nt, Human
cccuuuuuccuuccuccaucuc

SEQ ID NO: 243726 - RNA, 24 nt, Human
cccuuuuuccuuccuccaucuccc

SEQ ID NO: 243727 - RNA, 23 nt, Human
ccucccaggaugccaaauaaaua

SEQ ID NO: 243728 - RNA, 18 nt, Human
ccucccauuuagcccagc

SEQ ID NO: 243729 - RNA, 23 nt, Human
ccucccccauccucucccuguua

SEQ ID NO: 243730 - RNA, 21 nt, Human
ccucccccuagcucccaucuc

SEQ ID NO: 243731 - RNA, 21 nt, Human
ccuccccucccccuagcuccc

SEQ ID NO: 243732 - RNA, 22 nt, Human
ccuggcuuccaccucccagauc

SEQ ID NO: 243733 - RNA, 22 nt, Human
ccuggggugguauuuucagccc

SEQ ID NO: 243734 - RNA, 18 nt, Human
ccuugccguuuugugcug

SEQ ID NO: 243735 - RNA, 23 nt, Human
cucacugacgguauccugcccca

SEQ ID NO: 243736 - RNA, 22 nt, Human
cucccuccccucccccuagcuc

SEQ ID NO: 243737 - RNA, 20 nt, Human
cucccuguuaacuuugguuu

SEQ ID NO: 243738 - RNA, 19 nt, Human
cucuaaacuuugcccacuc

SEQ ID NO: 243739 - RNA, 19 nt, Human
cugaugagcugcuaagaag

SEQ ID NO: 243740 - RNA, 22 nt, Human
cugggaugugaaugguauaaag

SEQ ID NO: 243741 - RNA, 20 nt, Human
cugguggcaaaggguccucu

SEQ ID NO: 243742 - RNA, 24 nt, Human
cuuccuccaucucauuuuccccaa

SEQ ID NO: 243743 - RNA, 26 nt, Human
cuucucccuuuuuccuuccuccaucu

SEQ ID NO: 243744 - RNA, 18 nt, Human
gaccugggcaaaguuuuc

SEQ ID NO: 243745 - RNA, 24 nt, Human
gagcugggggaguggauccuuggg

SEQ ID NO: 243746 - RNA, 20 nt, Human
gcagggucugggggauaagc

SEQ ID NO: 243747 - RNA, 19 nt, Human
gcagugggauacccccagg

SEQ ID NO: 243748 - RNA, 21 nt, Human
gcucagcuucucccuuuuucc

SEQ ID NO: 243749 - RNA, 21 nt, Human
ggaaaucccucccaggaugcc

SEQ ID NO: 243750 - RNA, 18 nt, Human
ggaauguugggggaguca

SEQ ID NO: 243751 - RNA, 18 nt, Human
ggaggaaagggugcagcc

SEQ ID NO: 243752 - RNA, 21 nt, Human
ggaguggauccuuggggaagg

SEQ ID NO: 243753 - RNA, 18 nt, Human
ggcucagcuucucccuuu

SEQ ID NO: 243754 - RNA, 23 nt, Human
gggaagcaguagaacaguauagc

SEQ ID NO: 243755 - RNA, 18 nt, Human
gggaugggaaauggagga

SEQ ID NO: 243756 - RNA, 24 nt, Human
gggcugcucacuggcuugcuuggg

SEQ ID NO: 243757 - RNA, 21 nt, Human
ggggaggagcagaacacagca

SEQ ID NO: 243758 - RNA, 21 nt, Human
ggggaguggauccuuggggaa

SEQ ID NO: 243759 - RNA, 18 nt, Human
gggggaugggaaauggag

SEQ ID NO: 243760 - RNA, 24 nt, Human
ggguggagcuaggaagaacacaag

SEQ ID NO: 243761 - RNA, 18 nt, Human
ggucugggggauaagcuc

SEQ ID NO: 243762 - RNA, 21 nt, Human
gguggcuccaaucaccuuccc

SEQ ID NO: 243763 - RNA, 23 nt, Human
gucugggggauaagcuccuuucu

SEQ ID NO: 243764 - RNA, 19 nt, Human
uaaaggagcugggggagug

SEQ ID NO: 243765 - RNA, 19 nt, Human
uaagaagaugaugaaccuc

SEQ ID NO: 243766 - RNA, 27 nt, Human
uaagaagaugaugaaccucagagcuga

SEQ ID NO: 243767 - RNA, 18 nt, Human
uacagcagcugggaacua

SEQ ID NO: 243768 - RNA, 19 nt, Human
uaccaggaugauggucucu

SEQ ID NO: 243769 - RNA, 18 nt, Human
uagcagggaagcgugggg

SEQ ID NO: 243770 - RNA, 23 nt, Human
uagcucccaucucccucaacccc

SEQ ID NO: 243771 - RNA, 25 nt, Human
uauucuaauuuguccccucccccaa

SEQ ID NO: 243772 - RNA, 24 nt, Human
ucaauaccagcauuugacagugcu

SEQ ID NO: 243773 - RNA, 20 nt, Human
ucacaggaauggaugauggg

SEQ ID NO: 243774 - RNA, 22 nt, Human
ucaccuuccccuaagcaggaca

SEQ ID NO: 243775 - RNA, 19 nt, Human
ucccaucucccucaacccc

SEQ ID NO: 243776 - RNA, 21 nt, Human
ucccaucucccucaaccccaa

SEQ ID NO: 243777 - RNA, 18 nt, Human
uccccacaacaagacauc

SEQ ID NO: 243778 - RNA, 19 nt, Human
uccucuguccaagagcggg

SEQ ID NO: 243779 - RNA, 23 nt, Human
ucgggguugugaaggaccugggc

SEQ ID NO: 243780 - RNA, 20 nt, Human
ucguuuggcagagaaggcaa

SEQ ID NO: 243781 - RNA, 20 nt, Human
ucuaggaucucacucuggug

SEQ ID NO: 243782 - RNA, 23 nt, Human
ucucugagacccauccucagucc

SEQ ID NO: 243783 - RNA, 21 nt, Human
ugaaccucagagcugaugcug

SEQ ID NO: 243784 - RNA, 22 nt, Human
ugaccacaugcagagaagccaa

SEQ ID NO: 243785 - RNA, 19 nt, Human
ugagacccauccucagucc

SEQ ID NO: 243786 - RNA, 21 nt, Human
ugagacccauccucagucccc

SEQ ID NO: 243787 - RNA, 18 nt, Human
ugaugaaccucagagcug

SEQ ID NO: 243788 - RNA, 18 nt, Human
ugcuggggugucaaaugu

SEQ ID NO: 243789 - RNA, 24 nt, Human
uggagguggcuccguuacagcagc

SEQ ID NO: 243790 - RNA, 19 nt, Human
uggcucagcuucucccuuu

SEQ ID NO: 243791 - RNA, 19 nt, Human
uggcuuauuuuuaacccau

SEQ ID NO: 243792 - RNA, 20 nt, Human
uggcuugcuuggggcgaggu

SEQ ID NO: 243793 - RNA, 19 nt, Human
ugggaaaucucgggguugu

SEQ ID NO: 243794 - RNA, 24 nt, Human
ugggaaaucucgggguugugaagg

SEQ ID NO: 243795 - RNA, 18 nt, Human
ugggcagagugggcucag

SEQ ID NO: 243796 - RNA, 18 nt, Human
ugggcagagugggcucag

SEQ ID NO: 243797 - RNA, 19 nt, Human
ugggcagagugggcucagg

SEQ ID NO: 243798 - RNA, 20 nt, Human
ugggcagagugggcucaggg

SEQ ID NO: 243799 - RNA, 22 nt, Human
uggggugucaaauguugggaug

SEQ ID NO: 243800 - RNA, 26 nt, Human
uggggugucaaauguugggaugucag

SEQ ID NO: 243801 - RNA, 19 nt, Human
uggugguugaggagauggg

SEQ ID NO: 243802 - RNA, 19 nt, Human
ugguugaggagauggggga

SEQ ID NO: 243803 - RNA, 21 nt, Human
ugucuggacacagcccuggga

SEQ ID NO: 243804 - RNA, 18 nt, Human
uguugggaugucaggcag

SEQ ID NO: 243805 - RNA, 25 nt, Human
uucuaauuuguccccucccccaucc

SEQ ID NO: 243806 - RNA, 18 nt, Human
uucucccuuuuuccuucc

SEQ ID NO: 243807 - RNA, 18 nt, Human
uuggagaggcagccagug

SEQ ID NO: 243808 - RNA, 21 nt, Human
uuggagaggcagccaguguuc

SEQ ID NO: 243809 - RNA, 21 nt, Human
uuuucagcccguuuucauuuc

SEQ ID NO: 243810 - RNA, 18 nt, Human
aaaaacacaaacaaaaga

SEQ ID NO: 243811 - RNA, 21 nt, Human
aaaaacacaaacaaaagagga

SEQ ID NO: 243812 - RNA, 20 nt, Human
aaaaauggaaaacuuugccu

SEQ ID NO: 243813 - RNA, 19 nt, Human
aaacaaaagaggagaccuu

SEQ ID NO: 243814 - RNA, 23 nt, Human
aaacaaaagaggagaccuuuagc

SEQ ID NO: 243815 - RNA, 18 nt, Human
aaaguucucacauaucuu

SEQ ID NO: 243816 - RNA, 19 nt, Human
aacuugcaguaguaaagaa

SEQ ID NO: 243817 - RNA, 19 nt, Human
aagaaaaucccaaagcaaa

SEQ ID NO: 243818 - RNA, 24 nt, Human
aagccaauguaagacaaaggaagg

SEQ ID NO: 243819 - RNA, 21 nt, Human
acgaaacacuuaaaaaaaaag

SEQ ID NO: 243820 - RNA, 20 nt, Human
acuaguagguuccuccccag

SEQ ID NO: 243821 - RNA, 22 nt, Human
agccauuucagucuugaacuug

SEQ ID NO: 243822 - RNA, 19 nt, Human
aggcuggguuugugugguc

SEQ ID NO: 243823 - RNA, 18 nt, Human
aguaucuuuguacauuca

SEQ ID NO: 243824 - RNA, 22 nt, Human
aucucaccagaacucucuguca

SEQ ID NO: 243825 - RNA, 20 nt, Human
auggggcccaaaccacuugc

SEQ ID NO: 243826 - RNA, 23 nt, Human
auuaagacucuuuuugaugacuc

SEQ ID NO: 243827 - RNA, 19 nt, Human
caaaaacacaaacaaaaga

SEQ ID NO: 243828 - RNA, 21 nt, Human
caaaaauggaaaacuuugccu

SEQ ID NO: 243829 - RNA, 23 nt, Human
caaaccacuugcauggccagucu

SEQ ID NO: 243830 - RNA, 20 nt, Human
caaucagaucagcuucuagu

SEQ ID NO: 243831 - RNA, 22 nt, Human
cacaaaaacacaaacaaaagag

SEQ ID NO: 243832 - RNA, 19 nt, Human
cacaaacaaaagaggagac

SEQ ID NO: 243833 - RNA, 22 nt, Human
caccaugacacaguauagcauu

SEQ ID NO: 243834 - RNA, 24 nt, Human
cacugaagugggauucaacacgca

SEQ ID NO: 243835 - RNA, 26 nt, Human
cacuuuuauguuaugggaaucaaggg

SEQ ID NO: 243836 - RNA, 24 nt, Human
cagcaaaaacugagaaauuuagug

SEQ ID NO: 243837 - RNA, 20 nt, Human
cagcagagaugaacuggggu

SEQ ID NO: 243838 - RNA, 25 nt, Human
cagcagagaugaacugggguaguac

SEQ ID NO: 243839 - RNA, 25 nt, Human
cagccuucaaacugaaggagcuuaa

SEQ ID NO: 243840 - RNA, 21 nt, Human
caggcacaaaaacacaaacaa

SEQ ID NO: 243841 - RNA, 20 nt, Human
caucagaaggguugaucagg

SEQ ID NO: 243842 - RNA, 20 nt, Human
cauuacugcaauaucagacu

SEQ ID NO: 243843 - RNA, 21 nt, Human
cauuacugcaauaucagacuu

SEQ ID NO: 243844 - RNA, 24 nt, Human
ccagaacuucaaaaaacauuauuc

SEQ ID NO: 243845 - RNA, 18 nt, Human
ccccccuccucuggcgcc

SEQ ID NO: 243846 - RNA, 19 nt, Human
ccccugcguccccccuccc

SEQ ID NO: 243847 - RNA, 19 nt, Human
ccuauguagacuaaagaau

SEQ ID NO: 243848 - RNA, 19 nt, Human
ccucccgcucucacacucu

SEQ ID NO: 243849 - RNA, 22 nt, Human
ccucucccagcgccgcgagagu

SEQ ID NO: 243850 - RNA, 19 nt, Human
ccugcucucucuuuuucuc

SEQ ID NO: 243851 - RNA, 21 nt, Human
cgcgcgccgccucccccuccg

SEQ ID NO: 243852 - RNA, 19 nt, Human
cggugcugacugcuucauc

SEQ ID NO: 243853 - RNA, 26 nt, Human
cuaguacccccacacacgcucaccca

SEQ ID NO: 243854 - RNA, 18 nt, Human
cuauguagacuaaagaau

SEQ ID NO: 243855 - RNA, 21 nt, Human
cugaauggggcccaaaccacu

SEQ ID NO: 243856 - RNA, 20 nt, Human
cugcaauaucagacuucaau

SEQ ID NO: 243857 - RNA, 18 nt, Human
cugcccugccugcuccug

SEQ ID NO: 243858 - RNA, 20 nt, Human
cugcccugccugcuccuggg

SEQ ID NO: 243859 - RNA, 20 nt, Human
cuucuguacacuuguuccca

SEQ ID NO: 243860 - RNA, 20 nt, Human
cuugcugagaaccucuucca

SEQ ID NO: 243861 - RNA, 18 nt, Human
gaaauacuguuauuuccc

SEQ ID NO: 243862 - RNA, 19 nt, Human
gaaauucucuacaucaucu

SEQ ID NO: 243863 - RNA, 19 nt, Human
gaacuugcaguaguaaaga

SEQ ID NO: 243864 - RNA, 19 nt, Human
gacacaguauagcauuugg

SEQ ID NO: 243865 - RNA, 18 nt, Human
gcaauaucagacuucaau

SEQ ID NO: 243866 - RNA, 25 nt, Human
gcacugaaauucucuacaaccggag

SEQ ID NO: 243867 - RNA, 22 nt, Human
gccaauguaagacaaaggaagg

SEQ ID NO: 243868 - RNA, 22 nt, Human
gccgcgcgccgccucccccucc

SEQ ID NO: 243869 - RNA, 23 nt, Human
gccucccccuccgcccucuccca

SEQ ID NO: 243870 - RNA, 22 nt, Human
gcuauuaaaaaagagggugcag

SEQ ID NO: 243871 - RNA, 27 nt, Human
ggcacaaaaacacaaacagcagggacu

SEQ ID NO: 243872 - RNA, 19 nt, Human
ggcggggaggcggcgcgcu

SEQ ID NO: 243873 - RNA, 18 nt, Human
ggggcccaaaccacuugc

SEQ ID NO: 243874 - RNA, 18 nt, Human
guagcacuuuuauguuau

SEQ ID NO: 243875 - RNA, 20 nt, Human
gugaaaggcacaacuuguuu

SEQ ID NO: 243876 - RNA, 22 nt, Human
gugcucucacucucucucacuc

SEQ ID NO: 243877 - RNA, 21 nt, Human
gugguguggcuggccuugguc

SEQ ID NO: 243878 - RNA, 18 nt, Human
uaaaaaauaagugcauca

SEQ ID NO: 243879 - RNA, 19 nt, Human
uaaaaaauaagugcaucaa

SEQ ID NO: 243880 - RNA, 18 nt, Human
uaaaaagccaauguaaga

SEQ ID NO: 243881 - RNA, 21 nt, Human
uaagacaaaugccucuaccua

SEQ ID NO: 243882 - RNA, 22 nt, Human
uaagauucacuguuuucccagu

SEQ ID NO: 243883 - RNA, 24 nt, Human
uaagugcaucaaguaucuuuguac

SEQ ID NO: 243884 - RNA, 19 nt, Human
uaaguggguggacaaaugc

SEQ ID NO: 243885 - RNA, 21 nt, Human
uacacucacuacauuauguca

SEQ ID NO: 243886 - RNA, 22 nt, Human
uaccaugccauucucccccacu

SEQ ID NO: 243887 - RNA, 18 nt, Human
uaccccacccugcucucu

SEQ ID NO: 243888 - RNA, 25 nt, Human
uacucccaacugcuuugguauuugc

SEQ ID NO: 243889 - RNA, 23 nt, Human
uagcagaagucaguuggguuggc

SEQ ID NO: 243890 - RNA, 18 nt, Human
uaggauaccacuggguga

SEQ ID NO: 243891 - RNA, 18 nt, Human
uaggguucuuugaacuug

SEQ ID NO: 243892 - RNA, 19 nt, Human
uagguaauuuugcaggaau

SEQ ID NO: 243893 - RNA, 21 nt, Human
uagguuccuccccaggcuggg

SEQ ID NO: 243894 - RNA, 23 nt, Human
uaguagguuccuccccaggcugg

SEQ ID NO: 243895 - RNA, 18 nt, Human
uauguaggauaccacugg

SEQ ID NO: 243896 - RNA, 19 nt, Human
ucacuguuuucccaguucu

SEQ ID NO: 243897 - RNA, 20 nt, Human
ucagcagagaugaacugggg

SEQ ID NO: 243898 - RNA, 21 nt, Human
ucagcuucuaguacccccaca

SEQ ID NO: 243899 - RNA, 27 nt, Human
uccagaaaagaaaaucccaaagcaaau

SEQ ID NO: 243900 - RNA, 22 nt, Human
ucccaacugcuuugguauuugc

SEQ ID NO: 243901 - RNA, 22 nt, Human
ucccauaauuauguugaaauua

SEQ ID NO: 243902 - RNA, 20 nt, Human
uccuccuuaccccacccugc

SEQ ID NO: 243903 - RNA, 22 nt, Human
uccucuggcgccgcgcgccgcc

SEQ ID NO: 243904 - RNA, 21 nt, Human
ucucccccacucucaaguagc

SEQ ID NO: 243905 - RNA, 21 nt, Human
ucucucucucucuaagacaaa

SEQ ID NO: 243906 - RNA, 24 nt, Human
ucuugggaaacacaauuggugcua

SEQ ID NO: 243907 - RNA, 19 nt, Human
ucuuucucucucucucucc

SEQ ID NO: 243908 - RNA, 19 nt, Human
ugaaaaguagccuaccaug

SEQ ID NO: 243909 - RNA, 20 nt, Human
ugaaaauaucacaugcccuc

SEQ ID NO: 243910 - RNA, 25 nt, Human
ugacaaaaauggaaaacuuugccua

SEQ ID NO: 243911 - RNA, 23 nt, Human
ugagaauuuucuuugcaauuucc

SEQ ID NO: 243912 - RNA, 23 nt, Human
ugagagagggcggggaggcggcg

SEQ ID NO: 243913 - RNA, 22 nt, Human
ugauguacuugucaaggcccug

SEQ ID NO: 243914 - RNA, 21 nt, Human
ugcauggccagucuacacuca

SEQ ID NO: 243915 - RNA, 18 nt, Human
ugccagaacuucaaaaaa

SEQ ID NO: 243916 - RNA, 19 nt, Human
ugccagaacuucaaaaaac

SEQ ID NO: 243917 - RNA, 24 nt, Human
ugcccugccugcuccugggacagc

SEQ ID NO: 243918 - RNA, 18 nt, Human
ugcgcggcggagaggagc

SEQ ID NO: 243919 - RNA, 19 nt, Human
uggaaaauuuaaaaagcca

SEQ ID NO: 243920 - RNA, 23 nt, Human
ugggagguaucauuauuccuggu

SEQ ID NO: 243921 - RNA, 21 nt, Human
ugguacacagcacugaaauuc

SEQ ID NO: 243922 - RNA, 21 nt, Human
uggucgggggcuccucccgcu

SEQ ID NO: 243923 - RNA, 19 nt, Human
ugugcaggcacaaaaacac

SEQ ID NO: 243924 - RNA, 18 nt, Human
uguuaaaaaguucaucua

SEQ ID NO: 243925 - RNA, 22 nt, Human
uguuaaaaaguucaucuaugaa

SEQ ID NO: 243926 - RNA, 23 nt, Human
uguucagcagagaugaacugggg

SEQ ID NO: 243927 - RNA, 23 nt, Human
uguuuuauaaacuugcugucuca

SEQ ID NO: 243928 - RNA, 27 nt, Human
uucccaguucugaucauagaagccauu

SEQ ID NO: 243929 - RNA, 24 nt, Human
uucuagccaacuuguuuuagaaaa

SEQ ID NO: 243930 - RNA, 22 nt, Human
uugggguggacuuggguguugc

SEQ ID NO: 243931 - RNA, 21 nt, Human
uuguguguuuagagucugaga

SEQ ID NO: 243932 - RNA, 22 nt, Human
uuguguguuuagagucugagag

SEQ ID NO: 243933 - RNA, 21 nt, Human
uuuauaaacuugcugucucac

SEQ ID NO: 243934 - RNA, 21 nt, Human
uuucuuucucauucuuucucu

SEQ ID NO: 243935 - RNA, 20 nt, Human
uuuguguggucgggggcucc

SEQ ID NO: 243936 - RNA, 27 nt, Human
aaacagaauagugaaaugaggggaccc

SEQ ID NO: 243937 - RNA, 21 nt, Human
aagagcucaugccuaaauauu

SEQ ID NO: 243938 - RNA, 29 nt, Human
agcaaaaauaauuguccaauugaacccag

SEQ ID NO: 243939 - RNA, 19 nt, Human
aguuuggggaugagauuau

SEQ ID NO: 243940 - RNA, 22 nt, Human
auagccuucaggcacaugaaag

SEQ ID NO: 243941 - RNA, 18 nt, Human
auauauuuauaucuauaa

SEQ ID NO: 243942 - RNA, 19 nt, Human
aucaggucaauuucugcau

SEQ ID NO: 243943 - RNA, 21 nt, Human
auugaaucuuucuucccauuu

SEQ ID NO: 243944 - RNA, 23 nt, Human
caaaacagagcagagcaaaaaua

SEQ ID NO: 243945 - RNA, 21 nt, Human
caaggccuucagaauguagug

SEQ ID NO: 243946 - RNA, 23 nt, Human
cagcaauaccacucaagucuagc

SEQ ID NO: 243947 - RNA, 21 nt, Human
caugcucuucccuuccugcaa

SEQ ID NO: 243948 - RNA, 28 nt, Human
ccugcaaucagacuccuugaucaacggg

SEQ ID NO: 243949 - RNA, 27 nt, Human
ccugcaaucagacuccuugguuuaauu

SEQ ID NO: 243950 - RNA, 18 nt, Human
cucaaaggguugauaaua

SEQ ID NO: 243951 - RNA, 23 nt, Human
gccuuguuauuucuccugcaacu

SEQ ID NO: 243952 - RNA, 21 nt, Human
uaacaaggccuucagaaugua

SEQ ID NO: 243953 - RNA, 21 nt, Human
uacuccaugcaaaacagagca

SEQ ID NO: 243954 - RNA, 19 nt, Human
uauaauacuguaucaaaca

SEQ ID NO: 243955 - RNA, 19 nt, Human
ucaggcacaugaaagguaa

SEQ ID NO: 243956 - RNA, 18 nt, Human
ucccaaauggccucagag

SEQ ID NO: 243957 - RNA, 21 nt, Human
ucguugugucguguucucaaa

SEQ ID NO: 243958 - RNA, 19 nt, Human
ucuaaacaccacuuccuca

SEQ ID NO: 243959 - RNA, 22 nt, Human
ucuuccuguugcaaauggaaau

SEQ ID NO: 243960 - RNA, 22 nt, Human
ugaaagggggggugaaacuggu

SEQ ID NO: 243961 - RNA, 22 nt, Human
ugaauaagaaguuauaauauuc

SEQ ID NO: 243962 - RNA, 21 nt, Human
ugcaacuauucaaggaagugg

SEQ ID NO: 243963 - RNA, 20 nt, Human
ugccaagagcucaugccuaa

SEQ ID NO: 243964 - RNA, 22 nt, Human
ugccagaauccuucucgggagc

SEQ ID NO: 243965 - RNA, 23 nt, Human
uguaguggauagccuucaggcac

SEQ ID NO: 243966 - RNA, 21 nt, Human
uucaggcacaugaaagguaaa

SEQ ID NO: 243967 - RNA, 20 nt, Human
uucauuuuuuaaauagaaaa

SEQ ID NO: 243968 - RNA, 18 nt, Human
uugaacccauguaaagcc

SEQ ID NO: 243969 - RNA, 25 nt, Human
uugauaauauuuucuggcuucuuuc

SEQ ID NO: 243970 - RNA, 23 nt, Human
aaagcgacauggcaaaccaccgg

SEQ ID NO: 243971 - RNA, 20 nt, Human
aaauagccccaagcacaaag

SEQ ID NO: 243972 - RNA, 24 nt, Human
aagaaacauuaaucaaaacuuaaa

SEQ ID NO: 243973 - RNA, 22 nt, Human
aagcaaauaauaauaauaaaau

SEQ ID NO: 243974 - RNA, 18 nt, Human
aaguccaccaaaugucaa

SEQ ID NO: 243975 - RNA, 19 nt, Human
acaggcagacagccaguca

SEQ ID NO: 243976 - RNA, 22 nt, Human
acaggugaaaugcacaucugaa

SEQ ID NO: 243977 - RNA, 22 nt, Human
acuguaauucagccuggcacag

SEQ ID NO: 243978 - RNA, 18 nt, Human
agacagccagucauggag

SEQ ID NO: 243979 - RNA, 19 nt, Human
agcaagauaaaguccacca

SEQ ID NO: 243980 - RNA, 24 nt, Human
agcuuucuccuuuuuuuuuuauuu

SEQ ID NO: 243981 - RNA, 25 nt, Human
agugcaauuguaagaaugacuaccc

SEQ ID NO: 243982 - RNA, 18 nt, Human
auaguaauaagaauaaag

SEQ ID NO: 243983 - RNA, 18 nt, Human
auggagcaggaacagcag

SEQ ID NO: 243984 - RNA, 24 nt, Human
augggaaggaggcccaaaagcgac

SEQ ID NO: 243985 - RNA, 23 nt, Human
caagauaaaguccaccaaauguc

SEQ ID NO: 243986 - RNA, 22 nt, Human
cacacaaauagccccaagcaca

SEQ ID NO: 243987 - RNA, 23 nt, Human
cacacaaauagccccaagcacaa

SEQ ID NO: 243988 - RNA, 19 nt, Human
cacacaguauacugaaaau

SEQ ID NO: 243989 - RNA, 23 nt, Human
caccucucgcuuccucccucgac

SEQ ID NO: 243990 - RNA, 20 nt, Human
cacuguaauucagccuggca

SEQ ID NO: 243991 - RNA, 21 nt, Human
cagagacaggcaugggaagga

SEQ ID NO: 243992 - RNA, 22 nt, Human
cagcaagauaaaguccaccaaa

SEQ ID NO: 243993 - RNA, 22 nt, Human
cagcaagauaaaguccaccaaa

SEQ ID NO: 243994 - RNA, 27 nt, Human
cauuaaucaaaacuuaaagagacauac

SEQ ID NO: 243995 - RNA, 24 nt, Human
ccaaaagcgacauggcaaaccacc

SEQ ID NO: 243996 - RNA, 18 nt, Human
ccacaguagacagacugg

SEQ ID NO: 243997 - RNA, 23 nt, Human
ccagcaagauaaaguccaccaaa

SEQ ID NO: 243998 - RNA, 25 nt, Human
cccaaaagcgacauggcaaaccacc

SEQ ID NO: 243999 - RNA, 23 nt, Human
ccccaagcacaaagccaauccac

SEQ ID NO: 244000 - RNA, 21 nt, Human
cucacaaggcucccuccuaga

SEQ ID NO: 244001 - RNA, 23 nt, Human
cugaguucuacaugaaaagcaaa

SEQ ID NO: 244002 - RNA, 21 nt, Human
gaaaauacaggcagacagcca

SEQ ID NO: 244003 - RNA, 20 nt, Human
gaaauacaaccagaagucua

SEQ ID NO: 244004 - RNA, 21 nt, Human
gaaauacaaccagaagucuac

SEQ ID NO: 244005 - RNA, 20 nt, Human
ggcucccuccuagagagaaa

SEQ ID NO: 244006 - RNA, 18 nt, Human
gggcaggggacucgcucu

SEQ ID NO: 244007 - RNA, 24 nt, Human
gggcaggggacucgcucuuuguug

SEQ ID NO: 244008 - RNA, 22 nt, Human
uaaguaucccacacaguauacu

SEQ ID NO: 244009 - RNA, 25 nt, Human
uacaaccagaagucuacagaucacc

SEQ ID NO: 244010 - RNA, 24 nt, Human
uagaaucuuggcacaugcuguguu

SEQ ID NO: 244011 - RNA, 22 nt, Human
uagacagacuggugaagcccca

SEQ ID NO: 244012 - RNA, 19 nt, Human
ucauagcagcaaagcaugc

SEQ ID NO: 244013 - RNA, 23 nt, Human
ucugaacagagacaggcauggga

SEQ ID NO: 244014 - RNA, 20 nt, Human
ugaaaugcacaucugaacag

SEQ ID NO: 244015 - RNA, 23 nt, Human
ugcuguguucuucauccuuuguc

SEQ ID NO: 244016 - RNA, 19 nt, Human
uggagcaggaacagcagug

SEQ ID NO: 244017 - RNA, 24 nt, Human
uucaaauaauuccauuuaagaaac

SEQ ID NO: 244018 - RNA, 20 nt, Human
uucacuguaauucagccugg

SEQ ID NO: 244019 - RNA, 18 nt, Human
uuuauuagaauaagagau

SEQ ID NO: 244020 - RNA, 23 nt, Human
uuuuuuuuuuuuuuuuuagcuuu

SEQ ID NO: 244021 - RNA, 19 nt, Human
aaccuaaggaagcagagcc

SEQ ID NO: 244022 - RNA, 21 nt, Human
aagcagagccucugagaccac

SEQ ID NO: 244023 - RNA, 19 nt, Human
agcuggaagggcggggcau

SEQ ID NO: 244024 - RNA, 18 nt, Human
aggaggguggguggaggc

SEQ ID NO: 244025 - RNA, 21 nt, Human
agggacggugggcaggucacc

SEQ ID NO: 244026 - RNA, 18 nt, Human
caccagcgggacgcaggg

SEQ ID NO: 244027 - RNA, 22 nt, Human
cagagccucugagaccacacac

SEQ ID NO: 244028 - RNA, 25 nt, Human
cagaggcaccccggccaggacgggc

SEQ ID NO: 244029 - RNA, 23 nt, Human
cagcuggaagggcggggcaugga

SEQ ID NO: 244030 - RNA, 19 nt, Human
caggaggguggguggaggc

SEQ ID NO: 244031 - RNA, 19 nt, Human
ccccgccacggugcucucc

SEQ ID NO: 244032 - RNA, 22 nt, Human
ccgcgggccggcggcggcggcg

SEQ ID NO: 244033 - RNA, 20 nt, Human
ccggcggcggcggcgccucu

SEQ ID NO: 244034 - RNA, 24 nt, Human
ccggcggcggcggcgccucuagcc

SEQ ID NO: 244035 - RNA, 25 nt, Human
ccucuagccggggcccauagggggc

SEQ ID NO: 244036 - RNA, 20 nt, Human
cgaagaaggcugacgccgca

SEQ ID NO: 244037 - RNA, 21 nt, Human
cgaggcccgaagaaggcugac

SEQ ID NO: 244038 - RNA, 19 nt, Human
cgaggguagccgaggggcg

SEQ ID NO: 244039 - RNA, 24 nt, Human
cgcagcccgaguccgagaggcagg

SEQ ID NO: 244040 - RNA, 22 nt, Human
cgccacggugcucuccgcaggg

SEQ ID NO: 244041 - RNA, 19 nt, Human
cggcccaggccggcgucgg

SEQ ID NO: 244042 - RNA, 24 nt, Human
cggcgucggggcggccgagggcgg

SEQ ID NO: 244043 - RNA, 21 nt, Human
gcccguccccagaggcacccc

SEQ ID NO: 244044 - RNA, 23 nt, Human
gccgcuaccgcugccgaggcccg

SEQ ID NO: 244045 - RNA, 19 nt, Human
gccgggagcggucggcgcc

SEQ ID NO: 244046 - RNA, 21 nt, Human
gcgggccggcggcggcggcga

SEQ ID NO: 244047 - RNA, 18 nt, Human
ggcaggucaccagcggga

SEQ ID NO: 244048 - RNA, 21 nt, Human
ggcggccgagggcgggcggcg

SEQ ID NO: 244049 - RNA, 19 nt, Human
ggcggcggcgccucuagcc

SEQ ID NO: 244050 - RNA, 22 nt, Human
ggcggcggcggcgccucuagcc

SEQ ID NO: 244051 - RNA, 22 nt, Human
ggcggggcauggacagggacgg

SEQ ID NO: 244052 - RNA, 22 nt, Human
gggacggugggcaggucaccag

SEQ ID NO: 244053 - RNA, 19 nt, Human
gggcauggacagggacggu

SEQ ID NO: 244054 - RNA, 19 nt, Human
ggggcauggacagggacgg

SEQ ID NO: 244055 - RNA, 22 nt, Human
ggggcggccgagggcgggcggc

SEQ ID NO: 244056 - RNA, 20 nt, Human
ucaccagcgggacgcaggga

SEQ ID NO: 244057 - RNA, 24 nt, Human
uccccagaggcaccccggccagga

SEQ ID NO: 244058 - RNA, 22 nt, Human
uccucagcuggaagggcggggc

SEQ ID NO: 244059 - RNA, 25 nt, Human
ugaggcgagcgagccgcuaccgcug

SEQ ID NO: 244060 - RNA, 24 nt, Human
uuuugcuuuuucucucccuguuuu

SEQ ID NO: 244061 - RNA, 23 nt, Human
uuuuuuuuuuuuuuuugcuuuuu

SEQ ID NO: 244062 - RNA, 25 nt, Human
uuuuuuuuuuuuuuuuuugcuuuuu

SEQ ID NO: 244063 - RNA, 27 nt, Human
uuuuuuuuuuuuuuuuuuuuuuugggg

SEQ ID NO: 244064 - RNA, 23 nt, Human
aaagaucagcuuucccugaauaa

SEQ ID NO: 244065 - RNA, 24 nt, Human
aaauauuaaaauagauccugagcc

SEQ ID NO: 244066 - RNA, 18 nt, Human
acaaugagccacaacugc

SEQ ID NO: 244067 - RNA, 19 nt, Human
acugcccugguauuuaaga

SEQ ID NO: 244068 - RNA, 24 nt, Human
agcauccuguuucuacuguaguug

SEQ ID NO: 244069 - RNA, 20 nt, Human
agccagugacaaaaaauuug

SEQ ID NO: 244070 - RNA, 22 nt, Human
agccagugacaaaaaauuugaa

SEQ ID NO: 244071 - RNA, 18 nt, Human
aggcagauacugauuuua

SEQ ID NO: 244072 - RNA, 20 nt, Human
augggccaacaguaaaaugc

SEQ ID NO: 244073 - RNA, 24 nt, Human
cacaaugagccacaacugcccugg

SEQ ID NO: 244074 - RNA, 23 nt, Human
ccaacaguaaaaugcacaaugag

SEQ ID NO: 244075 - RNA, 23 nt, Human
ccccgcugcguccgcgggcuccg

SEQ ID NO: 244076 - RNA, 23 nt, Human
cccgcagcagucccgcggcagcc

SEQ ID NO: 244077 - RNA, 18 nt, Human
cccugguauuuaagaaaa

SEQ ID NO: 244078 - RNA, 19 nt, Human
ccgccgcggcucgcggcuc

SEQ ID NO: 244079 - RNA, 28 nt, Human
ccgccucccgcagcagucccgcggcagc

SEQ ID NO: 244080 - RNA, 18 nt, Human
ccgcugcccgccucccgc

SEQ ID NO: 244081 - RNA, 19 nt, Human
ccggcgccgccaccgacuu

SEQ ID NO: 244082 - RNA, 19 nt, Human
ccucccgcagcagucccgc

SEQ ID NO: 244083 - RNA, 24 nt, Human
cgcggcccccgcugcccgccuccc

SEQ ID NO: 244084 - RNA, 19 nt, Human
cggcgggggccgcugcagg

SEQ ID NO: 244085 - RNA, 26 nt, Human
cucgcggcccccgcugcccgccuccc

SEQ ID NO: 244086 - RNA, 18 nt, Human
cugcccgccucccgcagc

SEQ ID NO: 244087 - RNA, 18 nt, Human
gaaaugaaugggccaaca

SEQ ID NO: 244088 - RNA, 19 nt, Human
gaccuaaaagaggcagaua

SEQ ID NO: 244089 - RNA, 26 nt, Human
gaggccggcggugaggcggcaaggaa

SEQ ID NO: 244090 - RNA, 18 nt, Human
gagggcuccuccgccgcc

SEQ ID NO: 244091 - RNA, 21 nt, Human
gcaaggaagagcggcugcuca

SEQ ID NO: 244092 - RNA, 18 nt, Human
gcgggcgcgcugcucgcc

SEQ ID NO: 244093 - RNA, 22 nt, Human
ggaauugcagaacccccugcuu

SEQ ID NO: 244094 - RNA, 20 nt, Human
ggcgacggggaagucgagga

SEQ ID NO: 244095 - RNA, 18 nt, Human
ggcggcgggcgcccgcuu

SEQ ID NO: 244096 - RNA, 20 nt, Human
gggaagucgaggaggccggc

SEQ ID NO: 244097 - RNA, 23 nt, Human
uaaaauagauccugagccccuca

SEQ ID NO: 244098 - RNA, 22 nt, Human
uaaaaugcacaaugagccacaa

SEQ ID NO: 244099 - RNA, 22 nt, Human
uagaauaucaaugugguucccc

SEQ ID NO: 244100 - RNA, 21 nt, Human
uagauccugagccccucagcc

SEQ ID NO: 244101 - RNA, 28 nt, Human
uagcauacucugaccuaaaagaggcaga

SEQ ID NO: 244102 - RNA, 24 nt, Human
ucauagcuguucaguggcaucaug

SEQ ID NO: 244103 - RNA, 20 nt, Human
ucauuuuuuuuuucugguuu

SEQ ID NO: 244104 - RNA, 25 nt, Human
ucggcggcgggcgcccgcuucuccc

SEQ ID NO: 244105 - RNA, 19 nt, Human
ucugaccuaaaagaggcag

SEQ ID NO: 244106 - RNA, 18 nt, Human
ugaaaauacaaaaccaua

SEQ ID NO: 244107 - RNA, 24 nt, Human
ugaaaauacaaaaccauaauuucc

SEQ ID NO: 244108 - RNA, 22 nt, Human
ugacaaaaaauuugaacggaau

SEQ ID NO: 244109 - RNA, 18 nt, Human
ugagccccucagccgcua

SEQ ID NO: 244110 - RNA, 21 nt, Human
uggaagccggucccacucccc

SEQ ID NO: 244111 - RNA, 20 nt, Human
ugggcuuuugcauacugagc

SEQ ID NO: 244112 - RNA, 23 nt, Human
uguuucuacuguaguugaucugc

SEQ ID NO: 244113 - RNA, 18 nt, Human
uucauuguuuuccuguuc

SEQ ID NO: 244114 - RNA, 21 nt, Human
uucccugaauaaacaaaaaug

SEQ ID NO: 244115 - RNA, 26 nt, Human
uuuuaaaaauauauguauguauugcu

SEQ ID NO: 244116 - RNA, 22 nt, Human
uuuuuuuuucugguuugaaaaa

SEQ ID NO: 244117 - RNA, 26 nt, Human
aaaaaaacccuuucaaagggcaggcu

SEQ ID NO: 244118 - RNA, 18 nt, Human
aaaucccccaugaugccc

SEQ ID NO: 244119 - RNA, 24 nt, Human
aagaaaaaaaacccuuucaaaggg

SEQ ID NO: 244120 - RNA, 21 nt, Human
acccgugccccccaaacggca

SEQ ID NO: 244121 - RNA, 20 nt, Human
agagugaacauccugcccag

SEQ ID NO: 244122 - RNA, 21 nt, Human
aggaauaaguuaagugucccc

SEQ ID NO: 244123 - RNA, 21 nt, Human
aggcgggcgguggugggcagg

SEQ ID NO: 244124 - RNA, 22 nt, Human
auccugcccagggccuccccca

SEQ ID NO: 244125 - RNA, 18 nt, Human
auggagggcagucccugc

SEQ ID NO: 244126 - RNA, 19 nt, Human
auggagggcagucccugcg

SEQ ID NO: 244127 - RNA, 20 nt, Human
auggagggcagucccugcgg

SEQ ID NO: 244128 - RNA, 24 nt, Human
cacccgugccccccaaacggcaga

SEQ ID NO: 244129 - RNA, 20 nt, Human
caccuuguggcauggcgggc

SEQ ID NO: 244130 - RNA, 18 nt, Human
cagggcuccacccccugg

SEQ ID NO: 244131 - RNA, 20 nt, Human
cagguucacccgugcccccc

SEQ ID NO: 244132 - RNA, 19 nt, Human
cccacccuccccccagugc

SEQ ID NO: 244133 - RNA, 22 nt, Human
ccccagugcagggugggcacag

SEQ ID NO: 244134 - RNA, 19 nt, Human
cccccagugcagggugggc

SEQ ID NO: 244135 - RNA, 19 nt, Human
ccccccagugcaggguggg

SEQ ID NO: 244136 - RNA, 18 nt, Human
ccccccucccuccuuccc

SEQ ID NO: 244137 - RNA, 23 nt, Human
cccugcccacccuccccccagug

SEQ ID NO: 244138 - RNA, 19 nt, Human
cccugcggggucuagggag

SEQ ID NO: 244139 - RNA, 21 nt, Human
ccggcggccgggauggagggc

SEQ ID NO: 244140 - RNA, 19 nt, Human
ccugcccacccucccccca

SEQ ID NO: 244141 - RNA, 23 nt, Human
ccugcccagggccucccccaccu

SEQ ID NO: 244142 - RNA, 21 nt, Human
cggcagagggcuaagagggcc

SEQ ID NO: 244143 - RNA, 19 nt, Human
cgggcggggcggggcgggg

SEQ ID NO: 244144 - RNA, 22 nt, Human
cggggcggggugggaguggggc

SEQ ID NO: 244145 - RNA, 19 nt, Human
cgggggcugcgggaggccg

SEQ ID NO: 244146 - RNA, 21 nt, Human
cugcccagggccucccccacc

SEQ ID NO: 244147 - RNA, 24 nt, Human
cuuccccaauaaauagagugaaca

SEQ ID NO: 244148 - RNA, 19 nt, Human
gcacagggcuccacccccu

SEQ ID NO: 244149 - RNA, 18 nt, Human
gcaggagcaagaaaaaaa

SEQ ID NO: 244150 - RNA, 25 nt, Human
gcggggugggaguggggcggcaggu

SEQ ID NO: 244151 - RNA, 19 nt, Human
ggccauggcuggggcgccc

SEQ ID NO: 244152 - RNA, 23 nt, Human
ggcggggcggggcggggugggag

SEQ ID NO: 244153 - RNA, 18 nt, Human
ggcuggggcagggccugg

SEQ ID NO: 244154 - RNA, 19 nt, Human
gggccgggggcugcgggag

SEQ ID NO: 244155 - RNA, 19 nt, Human
gggcggggugggagugggg

SEQ ID NO: 244156 - RNA, 20 nt, Human
gggcugcgggaggccgcuuc

SEQ ID NO: 244157 - RNA, 24 nt, Human
gggcuggggcagggccuggggcgc

SEQ ID NO: 244158 - RNA, 19 nt, Human
ggggugggaguggggcggc

SEQ ID NO: 244159 - RNA, 22 nt, Human
guucacccgugccccccaaacg

SEQ ID NO: 244160 - RNA, 18 nt, Human
uaagagggccuggccgcg

SEQ ID NO: 244161 - RNA, 23 nt, Human
uacgggcggggcggggcggggug

SEQ ID NO: 244162 - RNA, 18 nt, Human
ucauggcugcccaggcgg

SEQ ID NO: 244163 - RNA, 23 nt, Human
ucccccaugaugcccugucccug

SEQ ID NO: 244164 - RNA, 19 nt, Human
ucccugcccacccuccccc

SEQ ID NO: 244165 - RNA, 20 nt, Human
ucccugcccacccucccccc

SEQ ID NO: 244166 - RNA, 21 nt, Human
ugcagggugggcacagggcuc

SEQ ID NO: 244167 - RNA, 24 nt, Human
ugccaaaucccccaugaugcccug

SEQ ID NO: 244168 - RNA, 18 nt, Human
ugcccgcgggaugcagag

SEQ ID NO: 244169 - RNA, 21 nt, Human
ugggcacagggcuccaccccc

SEQ ID NO: 244170 - RNA, 18 nt, Human
uggggcgcccuccgcagg

SEQ ID NO: 244171 - RNA, 24 nt, Human
uguacgggcggggcggggcggggu

SEQ ID NO: 244172 - RNA, 18 nt, Human
aaaggggggugggguccc

SEQ ID NO: 244173 - RNA, 18 nt, Human
aaggcuuccugugcagug

SEQ ID NO: 244174 - RNA, 19 nt, Human
acccccaaagggggguggg

SEQ ID NO: 244175 - RNA, 28 nt, Human
accuccccuccucccugcaucaccccag

SEQ ID NO: 244176 - RNA, 21 nt, Human
agagcccuggccccagaugac

SEQ ID NO: 244177 - RNA, 22 nt, Human
aggcauccagagagcccuggcc

SEQ ID NO: 244178 - RNA, 20 nt, Human
aguuuauuuggcuucuggcu

SEQ ID NO: 244179 - RNA, 25 nt, Human
caccuccccuccucccugcaucacc

SEQ ID NO: 244180 - RNA, 18 nt, Human
cacuggaucccgaggcua

SEQ ID NO: 244181 - RNA, 24 nt, Human
cacuggaucccgaggcuaagacuc

SEQ ID NO: 244182 - RNA, 19 nt, Human
cagccccagacccacgccu

SEQ ID NO: 244183 - RNA, 22 nt, Human
cccacgccucucuggggagcca

SEQ ID NO: 244184 - RNA, 20 nt, Human
ccccagacccacgccucucu

SEQ ID NO: 244185 - RNA, 18 nt, Human
ccccagaugacccccagg

SEQ ID NO: 244186 - RNA, 25 nt, Human
cccccaaagggggguggggucccug

SEQ ID NO: 244187 - RNA, 21 nt, Human
cccccagggcaggagguccau

SEQ ID NO: 244188 - RNA, 22 nt, Human
ccccccgcaucucgggcuucug

SEQ ID NO: 244189 - RNA, 19 nt, Human
ccccgcucccuucuuccuc

SEQ ID NO: 244190 - RNA, 24 nt, Human
ccccgcucccuucuuccuccuccc

SEQ ID NO: 244191 - RNA, 20 nt, Human
ccccgucuccuuuggccccg

SEQ ID NO: 244192 - RNA, 18 nt, Human
ccccuuccagugugaagg

SEQ ID NO: 244193 - RNA, 21 nt, Human
cccggaaccugggcauccggg

SEQ ID NO: 244194 - RNA, 20 nt, Human
cccugcaccuccccuccucc

SEQ ID NO: 244195 - RNA, 19 nt, Human
cccuggccccagaugaccc

SEQ ID NO: 244196 - RNA, 18 nt, Human
cccuggcccucagcccca

SEQ ID NO: 244197 - RNA, 24 nt, Human
cccuggcuggggcagcaggaaggc

SEQ ID NO: 244198 - RNA, 24 nt, Human
ccgaccccgcucccuucuuccucc

SEQ ID NO: 244199 - RNA, 20 nt, Human
ccgggcccuggcccucagcc

SEQ ID NO: 244200 - RNA, 18 nt, Human
ccugcaucaccccagcag

SEQ ID NO: 244201 - RNA, 24 nt, Human
ccugcaucaccccagcaggcaauu

SEQ ID NO: 244202 - RNA, 22 nt, Human
ccuggccccagaugacccccag

SEQ ID NO: 244203 - RNA, 27 nt, Human
ccuggccccgucuccuuuggccccgac

SEQ ID NO: 244204 - RNA, 18 nt, Human
ccuggcccucagccccag

SEQ ID NO: 244205 - RNA, 21 nt, Human
ccuguuccuggccccgucucc

SEQ ID NO: 244206 - RNA, 30 nt, Human
cgcaggucccccuuccagugugaaggcuuu

SEQ ID NO: 244207 - RNA, 22 nt, Human
cgccucaacuccgguugggucu

SEQ ID NO: 244208 - RNA, 23 nt, Human
cggaaccugggcauccgggcccu

SEQ ID NO: 244209 - RNA, 23 nt, Human
cggccccucuucccugcaccucc

SEQ ID NO: 244210 - RNA, 19 nt, Human
cucccuucuuccuccuccc

SEQ ID NO: 244211 - RNA, 23 nt, Human
cuccggcgccucaccauggcuag

SEQ ID NO: 244212 - RNA, 24 nt, Human
cugcaccuccccuccucccugcag

SEQ ID NO: 244213 - RNA, 26 nt, Human
cuggggcagcaggaaggcauccagag

SEQ ID NO: 244214 - RNA, 27 nt, Human
cuuccugugcaguguaguguuccugac

SEQ ID NO: 244215 - RNA, 20 nt, Human
gagcucgggggaguggccug

SEQ ID NO: 244216 - RNA, 19 nt, Human
gcagcuggagcucggggga

SEQ ID NO: 244217 - RNA, 22 nt, Human
gccccggggccuccggcgccuc

SEQ ID NO: 244218 - RNA, 25 nt, Human
gccggccccucuucccugcaccucc

SEQ ID NO: 244219 - RNA, 20 nt, Human
gcuccgaccccgcucccuuc

SEQ ID NO: 244220 - RNA, 24 nt, Human
gcugaggccggccccucuucccug

SEQ ID NO: 244221 - RNA, 21 nt, Human
gcuggguacaguguugggccc

SEQ ID NO: 244222 - RNA, 20 nt, Human
ggaccuacagguuucagaug

SEQ ID NO: 244223 - RNA, 21 nt, Human
ggcagcaggaaggcauccaga

SEQ ID NO: 244224 - RNA, 18 nt, Human
gggcagcaggaaggcauc

SEQ ID NO: 244225 - RNA, 21 nt, Human
gggcaguguggucaggccggg

SEQ ID NO: 244226 - RNA, 21 nt, Human
gggcccuggcccucagcccca

SEQ ID NO: 244227 - RNA, 24 nt, Human
ggggggaccuacagguuucagaug

SEQ ID NO: 244228 - RNA, 19 nt, Human
gggggguggggccccgggg

SEQ ID NO: 244229 - RNA, 20 nt, Human
gggggguggggucccugggg

SEQ ID NO: 244230 - RNA, 20 nt, Human
ggguggggccccggggccuc

SEQ ID NO: 244231 - RNA, 23 nt, Human
ggucaggccggggggguggggcc

SEQ ID NO: 244232 - RNA, 19 nt, Human
gguggggccccggggccuc

SEQ ID NO: 244233 - RNA, 18 nt, Human
gguggggucccuggggaa

SEQ ID NO: 244234 - RNA, 19 nt, Human
gguggggucccuggggaaa

SEQ ID NO: 244235 - RNA, 20 nt, Human
guagggcaggugagcugggg

SEQ ID NO: 244236 - RNA, 24 nt, Human
gugacagcugaggccggccccucu

SEQ ID NO: 244237 - RNA, 23 nt, Human
uaagacuccaacccuggcugggg

SEQ ID NO: 244238 - RNA, 20 nt, Human
ucaccauggcuagcuuggag

SEQ ID NO: 244239 - RNA, 21 nt, Human
uccagagagcccuggccccag

SEQ ID NO: 244240 - RNA, 22 nt, Human
ucccugagacaggcucuggucc

SEQ ID NO: 244241 - RNA, 19 nt, Human
ucccuggggaaacugaggc

SEQ ID NO: 244242 - RNA, 19 nt, Human
ucucugggugcccgugguc

SEQ ID NO: 244243 - RNA, 20 nt, Human
ucucugggugcccguggucc

SEQ ID NO: 244244 - RNA, 18 nt, Human
ugacccagcuccuguucc

SEQ ID NO: 244245 - RNA, 19 nt, Human
ugcaccuccccuccucccu

SEQ ID NO: 244246 - RNA, 19 nt, Human
ugcucuaagcccuagggca

SEQ ID NO: 244247 - RNA, 19 nt, Human
ugcuggugacagcugaggc

SEQ ID NO: 244248 - RNA, 20 nt, Human
ugcugugacuccuccuaagg

SEQ ID NO: 244249 - RNA, 20 nt, Human
uggagcaguccugggagccu

SEQ ID NO: 244250 - RNA, 22 nt, Human
uggaggagggcacccagggcag

SEQ ID NO: 244251 - RNA, 18 nt, Human
uggccccagaugaccccc

SEQ ID NO: 244252 - RNA, 24 nt, Human
uggcuucuggcuucacuggauccc

SEQ ID NO: 244253 - RNA, 18 nt, Human
ugggucuuuuugcgcagg

SEQ ID NO: 244254 - RNA, 19 nt, Human
ugggucuuuuugcgcaggg

SEQ ID NO: 244255 - RNA, 19 nt, Human
uucucugggugcccguggu

SEQ ID NO: 244256 - RNA, 21 nt, Human
uuuuuuggggagacagcuuuu

SEQ ID NO: 244257 - RNA, 21 nt, Human
uuuuuuuuuuuuggggagaca

SEQ ID NO: 244258 - RNA, 20 nt, Human
aaagugcagucuaagugguu

SEQ ID NO: 244259 - RNA, 22 nt, Human
aacagcaccccgguucuucagc

SEQ ID NO: 244260 - RNA, 22 nt, Human
aaccucccccugggccuuaaga

SEQ ID NO: 244261 - RNA, 18 nt, Human
aggacccagccuuagccu

SEQ ID NO: 244262 - RNA, 18 nt, Human
auaaagacaacccuggcu

SEQ ID NO: 244263 - RNA, 20 nt, Human
aucuuucuguugauuaugug

SEQ ID NO: 244264 - RNA, 18 nt, Human
auuucaagguuuuucaca

SEQ ID NO: 244265 - RNA, 21 nt, Human
caccgccccuccccccacccc

SEQ ID NO: 244266 - RNA, 23 nt, Human
caccgccccuccccccacccccu

SEQ ID NO: 244267 - RNA, 20 nt, Human
cacugggcccucgggggcuc

SEQ ID NO: 244268 - RNA, 21 nt, Human
cagcacaaaaggcggcgcugc

SEQ ID NO: 244269 - RNA, 22 nt, Human
cagcacaaaaggcggcgcugcu

SEQ ID NO: 244270 - RNA, 24 nt, Human
cagccccaucuuucuguugauuau

SEQ ID NO: 244271 - RNA, 21 nt, Human
ccaccgccccuccccccaccc

SEQ ID NO: 244272 - RNA, 22 nt, Human
cccaccgccccuccccccaccc

SEQ ID NO: 244273 - RNA, 20 nt, Human
cccagccuuagccucccucc

SEQ ID NO: 244274 - RNA, 22 nt, Human
cccccuauuauuuggggauaaa

SEQ ID NO: 244275 - RNA, 18 nt, Human
ccccuccccccacccccu

SEQ ID NO: 244276 - RNA, 23 nt, Human
cccucccaccgccccucccccca

SEQ ID NO: 244277 - RNA, 20 nt, Human
ccgccccuccccccaccccc

SEQ ID NO: 244278 - RNA, 19 nt, Human
ccuaaccucccccugggcc

SEQ ID NO: 244279 - RNA, 18 nt, Human
ccucagaggggaggaccc

SEQ ID NO: 244280 - RNA, 20 nt, Human
ccugagaaaccucagagggg

SEQ ID NO: 244281 - RNA, 23 nt, Human
ccugccccucccaccgccccucc

SEQ ID NO: 244282 - RNA, 19 nt, Human
ccuuagccacagcucuacg

SEQ ID NO: 244283 - RNA, 22 nt, Human
cgcauauauauauauauaugua

SEQ ID NO: 244284 - RNA, 18 nt, Human
cgccccuccccccacccc

SEQ ID NO: 244285 - RNA, 26 nt, Human
cggaacagaaaagugcagucuaagug

SEQ ID NO: 244286 - RNA, 24 nt, Human
cggccgcagcacaaaaggcggcgc

SEQ ID NO: 244287 - RNA, 21 nt, Human
cucccuccucccaagugcaaa

SEQ ID NO: 244288 - RNA, 18 nt, Human
cugcugcagcuccgcucc

SEQ ID NO: 244289 - RNA, 20 nt, Human
gaaaccucagaggggaggac

SEQ ID NO: 244290 - RNA, 19 nt, Human
gauaaaagcagggacuuaa

SEQ ID NO: 244291 - RNA, 18 nt, Human
gauggugaacacugggcc

SEQ ID NO: 244292 - RNA, 18 nt, Human
gcauauauauauauauau

SEQ ID NO: 244293 - RNA, 19 nt, Human
gccuuagccucccuccucc

SEQ ID NO: 244294 - RNA, 19 nt, Human
gcgcauauauauauauaua

SEQ ID NO: 244295 - RNA, 19 nt, Human
gcgcauauauauauauaua

SEQ ID NO: 244296 - RNA, 21 nt, Human
gggcaggaaggggcuugcccu

SEQ ID NO: 244297 - RNA, 23 nt, Human
gggguggggcaggaaggggcuug

SEQ ID NO: 244298 - RNA, 21 nt, Human
uacauugccaccugagaaacc

SEQ ID NO: 244299 - RNA, 22 nt, Human
uacauugccaccugagaaaccu

SEQ ID NO: 244300 - RNA, 20 nt, Human
uaggacaguccccaccccaa

SEQ ID NO: 244301 - RNA, 18 nt, Human
uauauauauauguauaua

SEQ ID NO: 244302 - RNA, 18 nt, Human
uauauauauguauauaua

SEQ ID NO: 244303 - RNA, 18 nt, Human
uauauauguauauauaua

SEQ ID NO: 244304 - RNA, 19 nt, Human
uauauauguauauauauau

SEQ ID NO: 244305 - RNA, 18 nt, Human
uauauguauauauauaua

SEQ ID NO: 244306 - RNA, 18 nt, Human
uauauguauauauauaua

SEQ ID NO: 244307 - RNA, 20 nt, Human
uauauguauauauauauaau

SEQ ID NO: 244308 - RNA, 23 nt, Human
uauguauauauauauaauccaua

SEQ ID NO: 244309 - RNA, 25 nt, Human
uauguauauauauauaauccauaua

SEQ ID NO: 244310 - RNA, 19 nt, Human
uauguggcgcauauauaua

SEQ ID NO: 244311 - RNA, 30 nt, Human
uauguggcgcauauauauauauauauguaa

SEQ ID NO: 244312 - RNA, 18 nt, Human
ucccaccgccccuccccc

SEQ ID NO: 244313 - RNA, 22 nt, Human
ucccaccgccccuccccccacc

SEQ ID NO: 244314 - RNA, 20 nt, Human
ucccuccucccaagugcaaa

SEQ ID NO: 244315 - RNA, 23 nt, Human
uccgcggccgcagcacaaaaggc

SEQ ID NO: 244316 - RNA, 18 nt, Human
ucuccugccccucccacc

SEQ ID NO: 244317 - RNA, 22 nt, Human
ugggguggggcaggaaggggcu

SEQ ID NO: 244318 - RNA, 23 nt, Human
uguauauauauauaauccauaua

SEQ ID NO: 244319 - RNA, 21 nt, Human
uguggcgcauauauauauaua

SEQ ID NO: 244320 - RNA, 21 nt, Human
uguggcgcauauauauauaua

SEQ ID NO: 244321 - RNA, 25 nt, Human
uguggcgcauauauauauauauaug

SEQ ID NO: 244322 - RNA, 27 nt, Human
uuauguggcgcauauauauauauauau

SEQ ID NO: 244323 - RNA, 22 nt, Human
uuccacagcugccagugucccu

SEQ ID NO: 244324 - RNA, 23 nt, Human
uucuauugccuuguugcuugcug

SEQ ID NO: 244325 - RNA, 24 nt, Human
uuucaagguuuuucacagggguug

SEQ ID NO: 244326 - RNA, 21 nt, Human
uuuucuauugccuuguugcua

SEQ ID NO: 244327 - RNA, 18 nt, Human
aaaauaaauaucaauguu

SEQ ID NO: 244328 - RNA, 22 nt, Human
aaaaugcugggagagaguggga

SEQ ID NO: 244329 - RNA, 21 nt, Human
agagagugggaugagucuggg

SEQ ID NO: 244330 - RNA, 22 nt, Human
agcuagaauauucaauaaaaua

SEQ ID NO: 244331 - RNA, 20 nt, Human
agggggugguaaagaugggg

SEQ ID NO: 244332 - RNA, 24 nt, Human
augacacucagaagauuuuuggga

SEQ ID NO: 244333 - RNA, 23 nt, Human
auucaauaaaauagaucccugcc

SEQ ID NO: 244334 - RNA, 25 nt, Human
cucuuuuuuuuuuugcaagaaauua

SEQ ID NO: 244335 - RNA, 24 nt, Human
gagagagugggaugagucuggggg

SEQ ID NO: 244336 - RNA, 23 nt, Human
gggugggguggaucugaaaugcc

SEQ ID NO: 244337 - RNA, 21 nt, Human
gugggguggaucugaaaugcc

SEQ ID NO: 244338 - RNA, 19 nt, Human
ucugggggugggguggauc

SEQ ID NO: 244339 - RNA, 23 nt, Human
uuccagagauuugcgaagucuca

SEQ ID NO: 244340 - RNA, 24 nt, Human
uuuuugcaagaaauuauugucucu

SEQ ID NO: 244341 - RNA, 22 nt, Human
aacagaguccaccucucaacag

SEQ ID NO: 244342 - RNA, 18 nt, Human
aaccugaaaaguguggug

SEQ ID NO: 244343 - RNA, 21 nt, Human
aagggcucgcccaccccuucu

SEQ ID NO: 244344 - RNA, 24 nt, Human
aaugcuacgugaguccugaguagc

SEQ ID NO: 244345 - RNA, 22 nt, Human
acagaugagggaacugagugcc

SEQ ID NO: 244346 - RNA, 18 nt, Human
acagcagccuggagggug

SEQ ID NO: 244347 - RNA, 18 nt, Human
accagggagccuucccag

SEQ ID NO: 244348 - RNA, 19 nt, Human
acucgacuggagcaggggc

SEQ ID NO: 244349 - RNA, 23 nt, Human
acugauccaagcgggucaggcca

SEQ ID NO: 244350 - RNA, 20 nt, Human
agaacacaggucagccuugg

SEQ ID NO: 244351 - RNA, 21 nt, Human
agccagcagcaaaggggcaca

SEQ ID NO: 244352 - RNA, 22 nt, Human
aggaccuguguugcaacaaccu

SEQ ID NO: 244353 - RNA, 24 nt, Human
aggagguugaggcuagcagacacc

SEQ ID NO: 244354 - RNA, 23 nt, Human
aggcugcaguucuuuaugugcug

SEQ ID NO: 244355 - RNA, 27 nt, Human
agugugaugcugagcugugcucugggg

SEQ ID NO: 244356 - RNA, 24 nt, Human
auaccugcugaccugguucugcac

SEQ ID NO: 244357 - RNA, 21 nt, Human
auccugagagagaccaaacac

SEQ ID NO: 244358 - RNA, 19 nt, Human
auucuaccagggagccuuc

SEQ ID NO: 244359 - RNA, 23 nt, Human
caaacacagagcaggucacuuag

SEQ ID NO: 244360 - RNA, 26 nt, Human
caacucaggaccuguguugcaacaag

SEQ ID NO: 244361 - RNA, 21 nt, Human
caagcgggucaggccaacucg

SEQ ID NO: 244362 - RNA, 24 nt, Human
caaugguaacagaguccaccucuc

SEQ ID NO: 244363 - RNA, 26 nt, Human
cacacauacucauccuccaaacaucc

SEQ ID NO: 244364 - RNA, 20 nt, Human
cacugaucauguccauccac

SEQ ID NO: 244365 - RNA, 23 nt, Human
cacuuagaaucccagaccuggga

SEQ ID NO: 244366 - RNA, 22 nt, Human
cagaggucaacucaggaccugu

SEQ ID NO: 244367 - RNA, 21 nt, Human
cagcaggguggggcagggcuc

SEQ ID NO: 244368 - RNA, 18 nt, Human
cagccuggagggugaggg

SEQ ID NO: 244369 - RNA, 21 nt, Human
cagcucaagacugugucccuu

SEQ ID NO: 244370 - RNA, 21 nt, Human
caggaaggcugcuuuccggca

SEQ ID NO: 244371 - RNA, 23 nt, Human
caggaccuguguugcaacaaccu

SEQ ID NO: 244372 - RNA, 24 nt, Human
caggagguugaggcuagcagacac

SEQ ID NO: 244373 - RNA, 19 nt, Human
caucacccuucaccuuuac

SEQ ID NO: 244374 - RNA, 19 nt, Human
cauucugcuugcccccacc

SEQ ID NO: 244375 - RNA, 22 nt, Human
cauucuuuuccccuacacccaa

SEQ ID NO: 244376 - RNA, 18 nt, Human
ccagguaacuccugccau

SEQ ID NO: 244377 - RNA, 25 nt, Human
cccaccccuucugacccaggcugga

SEQ ID NO: 244378 - RNA, 20 nt, Human
cccacugugagccggggggc

SEQ ID NO: 244379 - RNA, 23 nt, Human
ccucugccacacauacucauccu

SEQ ID NO: 244380 - RNA, 19 nt, Human
ccuuggguugggggagaaa

SEQ ID NO: 244381 - RNA, 23 nt, Human
cggacgucucucucugcugcuuu

SEQ ID NO: 244382 - RNA, 19 nt, Human
cggcguccccugccccagg

SEQ ID NO: 244383 - RNA, 19 nt, Human
cuccccugucugccaacaa

SEQ ID NO: 244384 - RNA, 19 nt, Human
cuccuacagugucacugcc

SEQ ID NO: 244385 - RNA, 24 nt, Human
cucgcccaccccuucugacccagg

SEQ ID NO: 244386 - RNA, 24 nt, Human
cugcaucacccuucaccuuuacag

SEQ ID NO: 244387 - RNA, 22 nt, Human
cugcugcucuggggaagagugg

SEQ ID NO: 244388 - RNA, 20 nt, Human
cuggagcaggggcagaaaaa

SEQ ID NO: 244389 - RNA, 23 nt, Human
cugggagaagaggcuaagcuggg

SEQ ID NO: 244390 - RNA, 22 nt, Human
cuuuccggcaguguggagccgg

SEQ ID NO: 244391 - RNA, 23 nt, Human
gacagcucaagacugugucccuu

SEQ ID NO: 244392 - RNA, 24 nt, Human
gagaagaggcuaagcuggggcaau

SEQ ID NO: 244393 - RNA, 22 nt, Human
gagcagucugacucaaugugga

SEQ ID NO: 244394 - RNA, 22 nt, Human
gaggcuagcagacacccccuga

SEQ ID NO: 244395 - RNA, 26 nt, Human
gcagcaaaggggcacaugucugggga

SEQ ID NO: 244396 - RNA, 23 nt, Human
gcagccaugaaagugcuuugagg

SEQ ID NO: 244397 - RNA, 26 nt, Human
gcccaccccuucugacccaggcugga

SEQ ID NO: 244398 - RNA, 22 nt, Human
gcuuuccuuagcacugaucaug

SEQ ID NO: 244399 - RNA, 23 nt, Human
ggagccuucccagggucaggcau

SEQ ID NO: 244400 - RNA, 22 nt, Human
ggagucucggcguccccugccc

SEQ ID NO: 244401 - RNA, 20 nt, Human
ggcugagccuguguuuucag

SEQ ID NO: 244402 - RNA, 21 nt, Human
gggcagugcugggccugaagg

SEQ ID NO: 244403 - RNA, 18 nt, Human
ggggcaauggggaagggg

SEQ ID NO: 244404 - RNA, 20 nt, Human
ggguugggggagaaaggcag

SEQ ID NO: 244405 - RNA, 19 nt, Human
gguugggggagaaaggcag

SEQ ID NO: 244406 - RNA, 20 nt, Human
uaacuccugccauccuccuu

SEQ ID NO: 244407 - RNA, 24 nt, Human
uacaaagaguucucuacaacccag

SEQ ID NO: 244408 - RNA, 23 nt, Human
uacaacccagacucugcaguacc

SEQ ID NO: 244409 - RNA, 20 nt, Human
uacagugucacugcccugcc

SEQ ID NO: 244410 - RNA, 21 nt, Human
uaccagggagccuucccaggg

SEQ ID NO: 244411 - RNA, 18 nt, Human
uauccugcaucacccuuc

SEQ ID NO: 244412 - RNA, 24 nt, Human
ucaaugguaacagaguccaccucu

SEQ ID NO: 244413 - RNA, 24 nt, Human
ucaggcauucuuuuccccuacacc

SEQ ID NO: 244414 - RNA, 24 nt, Human
ucauccugagagagaccaaacaca

SEQ ID NO: 244415 - RNA, 19 nt, Human
uccccagguaacuccugcc

SEQ ID NO: 244416 - RNA, 21 nt, Human
uccccgggagcagucugacuc

SEQ ID NO: 244417 - RNA, 22 nt, Human
uccccugggaacggcugagccu

SEQ ID NO: 244418 - RNA, 23 nt, Human
uccucaaugguaacagaguccac

SEQ ID NO: 244419 - RNA, 18 nt, Human
uccugcaucacccuucac

SEQ ID NO: 244420 - RNA, 24 nt, Human
uccuuagcacugaucauguccauc

SEQ ID NO: 244421 - RNA, 21 nt, Human
ucuacaacccagacucugcag

SEQ ID NO: 244422 - RNA, 23 nt, Human
ucucuacaacccagacucugcag

SEQ ID NO: 244423 - RNA, 20 nt, Human
ucugccacacauacucaucc

SEQ ID NO: 244424 - RNA, 21 nt, Human
ugacccaggcuggaagcugcu

SEQ ID NO: 244425 - RNA, 22 nt, Human
ugagagagaccaaacacagagc

SEQ ID NO: 244426 - RNA, 22 nt, Human
ugagcuggccaggugaggccag

SEQ ID NO: 244427 - RNA, 22 nt, Human
ugagcuucucccacggagucuc

SEQ ID NO: 244428 - RNA, 21 nt, Human
ugagggaacugagugccagcg

SEQ ID NO: 244429 - RNA, 19 nt, Human
ugaguccugaguagcuccc

SEQ ID NO: 244430 - RNA, 19 nt, Human
ugagugccagcgagucugg

SEQ ID NO: 244431 - RNA, 24 nt, Human
ugcacugaaccugaguuugggccc

SEQ ID NO: 244432 - RNA, 24 nt, Human
ugccacacauacucauccuccaaa

SEQ ID NO: 244433 - RNA, 25 nt, Human
ugccagagggcagccaugaaagugc

SEQ ID NO: 244434 - RNA, 23 nt, Human
ugcugagcugugcucuggggaac

SEQ ID NO: 244435 - RNA, 20 nt, Human
ugcugcucuggggaagagug

SEQ ID NO: 244436 - RNA, 20 nt, Human
ugcugcugcgaggcccuggu

SEQ ID NO: 244437 - RNA, 20 nt, Human
ugcugggccugaaggggcuc

SEQ ID NO: 244438 - RNA, 18 nt, Human
uggaagagguuugaggag

SEQ ID NO: 244439 - RNA, 21 nt, Human
uggaagagguuugaggaguca

SEQ ID NO: 244440 - RNA, 23 nt, Human
uggcggauguuuuuucagcaggg

SEQ ID NO: 244441 - RNA, 24 nt, Human
ugggcccuuacacacuugacacuc

SEQ ID NO: 244442 - RNA, 22 nt, Human
uggguugggggagaaaggcagg

SEQ ID NO: 244443 - RNA, 18 nt, Human
ugguagccagcagcaaag

SEQ ID NO: 244444 - RNA, 22 nt, Human
ugguucugcacugaaccugagu

SEQ ID NO: 244445 - RNA, 19 nt, Human
ugucaucaccccaaacuuu

SEQ ID NO: 244446 - RNA, 20 nt, Human
ugucuuggcaagauguggga

SEQ ID NO: 244447 - RNA, 18 nt, Human
ugugcugggggccggggc

SEQ ID NO: 244448 - RNA, 20 nt, Human
uguuuuguuuccccagguaa

SEQ ID NO: 244449 - RNA, 21 nt, Human
uucugacccaggcuggaagcu

SEQ ID NO: 244450 - RNA, 22 nt, Human
uugcuaugcuccuacaguguca

SEQ ID NO: 244451 - RNA, 18 nt, Human
uuuaugugugccucugcc

SEQ ID NO: 244452 - RNA, 21 nt, Human
aaacaggagauuaaaaacaaa

SEQ ID NO: 244453 - RNA, 22 nt, Human
aaacaggagauuaaaaacaagg

SEQ ID NO: 244454 - RNA, 20 nt, Human
aacaacaaaaaagguaaagg

SEQ ID NO: 244455 - RNA, 23 nt, Human
aacaacaacaaaaaagguaaagg

SEQ ID NO: 244456 - RNA, 21 nt, Human
aaccucguggccaccagcccu

SEQ ID NO: 244457 - RNA, 23 nt, Human
acaacaaaaaagguaaagguuuc

SEQ ID NO: 244458 - RNA, 27 nt, Human
acaacaacaaaaaagguaaagguuuca

SEQ ID NO: 244459 - RNA, 20 nt, Human
accucguggccaccagcccu

SEQ ID NO: 244460 - RNA, 19 nt, Human
agaauuuuccaaguccaua

SEQ ID NO: 244461 - RNA, 21 nt, Human
auacaguagugauuaagagaa

SEQ ID NO: 244462 - RNA, 22 nt, Human
caacaaaaaagguaaagguuuc

SEQ ID NO: 244463 - RNA, 23 nt, Human
caacaacaacaaaaaagguaaag

SEQ ID NO: 244464 - RNA, 24 nt, Human
cacagucagugcacucaacaaaca

SEQ ID NO: 244465 - RNA, 25 nt, Human
caccggagccccgaagugcgggagu

SEQ ID NO: 244466 - RNA, 20 nt, Human
cagcuugccaacaacaacaa

SEQ ID NO: 244467 - RNA, 23 nt, Human
ccaacaacaacaaaaaagguaaa

SEQ ID NO: 244468 - RNA, 21 nt, Human
ccccgcauggccgcggcgggc

SEQ ID NO: 244469 - RNA, 22 nt, Human
ccugcagcuugccaacaacaac

SEQ ID NO: 244470 - RNA, 21 nt, Human
cgcuugucaccugugcagucu

SEQ ID NO: 244471 - RNA, 31 nt, Human
cguggccaccagcccuccagagggccuuuuc

SEQ ID NO: 244472 - RNA, 21 nt, Human
cugcagcuugccaacaacaac

SEQ ID NO: 244473 - RNA, 20 nt, Human
gcuugucaccugugcagucu

SEQ ID NO: 244474 - RNA, 24 nt, Human
ggaggagacagaggcgaugguccg

SEQ ID NO: 244475 - RNA, 27 nt, Human
ggccgcggcgggcaguaagcugcagcc

SEQ ID NO: 244476 - RNA, 19 nt, Human
uaaaaacaagguaugggac

SEQ ID NO: 244477 - RNA, 22 nt, Human
uaaagguuucacagucagugca

SEQ ID NO: 244478 - RNA, 22 nt, Human
uaaccucguggccaccagcccu

SEQ ID NO: 244479 - RNA, 19 nt, Human
uacaaaccugcagcuugcc

SEQ ID NO: 244480 - RNA, 23 nt, Human
uacaaaccugcagcuugccaaca

SEQ ID NO: 244481 - RNA, 25 nt, Human
uacaguagugauuaagagaauuuuc

SEQ ID NO: 244482 - RNA, 26 nt, Human
uacaguagugauuaagagaauuuucc

SEQ ID NO: 244483 - RNA, 22 nt, Human
ucaaaacacuacgcugauguca

SEQ ID NO: 244484 - RNA, 21 nt, Human
ucacagucagugcacucaaca

SEQ ID NO: 244485 - RNA, 23 nt, Human
ucagccuuuugcauuacaaaccu

SEQ ID NO: 244486 - RNA, 18 nt, Human
ucgcgcgagacacggagg

SEQ ID NO: 244487 - RNA, 22 nt, Human
uggccgcggcgggcaguaagcu

SEQ ID NO: 244488 - RNA, 19 nt, Human
uuauacugcuucucagcac

SEQ ID NO: 244489 - RNA, 22 nt, Human
uucacagucagugcacucaaca

SEQ ID NO: 244490 - RNA, 23 nt, Human
uugaaccuagaaaggucaaaaca

SEQ ID NO: 244491 - RNA, 19 nt, Human
uuucacagucagugcacuu

SEQ ID NO: 244492 - RNA, 20 nt, Human
aaacaaauguacgacagguc

SEQ ID NO: 244493 - RNA, 23 nt, Human
aaacaaauguacgacaggucaga

SEQ ID NO: 244494 - RNA, 26 nt, Human
aaacaaauguacgacaggucagaaac

SEQ ID NO: 244495 - RNA, 22 nt, Human
aaacuuuauacaguaauugaaa

SEQ ID NO: 244496 - RNA, 22 nt, Human
aaauacuggauuuaaagugcag

SEQ ID NO: 244497 - RNA, 22 nt, Human
acggagcuuccuuuucuuggcc

SEQ ID NO: 244498 - RNA, 21 nt, Human
agucaauauuacaauuaacac

SEQ ID NO: 244499 - RNA, 21 nt, Human
auauuacaaacacacagaagc

SEQ ID NO: 244500 - RNA, 19 nt, Human
auuacaauuaacacagaga

SEQ ID NO: 244501 - RNA, 20 nt, Human
caaacacacagaagccuaaa

SEQ ID NO: 244502 - RNA, 21 nt, Human
caaacacacagaagccuaaac

SEQ ID NO: 244503 - RNA, 21 nt, Human
caccgccuggccagccacagc

SEQ ID NO: 244504 - RNA, 23 nt, Human
cagcgccuuucuccucucccuuc

SEQ ID NO: 244505 - RNA, 23 nt, Human
caguaauugaaauuacgcauuuc

SEQ ID NO: 244506 - RNA, 22 nt, Human
cauaaacgacucaaacaaaugu

SEQ ID NO: 244507 - RNA, 21 nt, Human
caugaguaaacaaauacugga

SEQ ID NO: 244508 - RNA, 19 nt, Human
cauugcucucagauucugc

SEQ ID NO: 244509 - RNA, 19 nt, Human
ccagccgcaccgccuggcc

SEQ ID NO: 244510 - RNA, 19 nt, Human
ccccaagaagaucagcucu

SEQ ID NO: 244511 - RNA, 20 nt, Human
ccgcaccgccuggccagcca

SEQ ID NO: 244512 - RNA, 19 nt, Human
ccgccgcgccgccgccucc

SEQ ID NO: 244513 - RNA, 19 nt, Human
ccgcgcccucgccgccgcg

SEQ ID NO: 244514 - RNA, 21 nt, Human
ccgcgccgccgccuccucucc

SEQ ID NO: 244515 - RNA, 20 nt, Human
ccgcgccgcucgcccucugc

SEQ ID NO: 244516 - RNA, 28 nt, Human
ccgggcagcaacggcggcggcguccccc

SEQ ID NO: 244517 - RNA, 24 nt, Human
ccuccguggccgcgccgcucgccc

SEQ ID NO: 244518 - RNA, 22 nt, Human
ccuccucuccggcgcccucucc

SEQ ID NO: 244519 - RNA, 25 nt, Human
ccugcgccgcggugcagcucaaggg

SEQ ID NO: 244520 - RNA, 22 nt, Human
ccuuaaaaauuauagaaauaga

SEQ ID NO: 244521 - RNA, 23 nt, Human
cgacucaaacaaauguacgacag

SEQ ID NO: 244522 - RNA, 18 nt, Human
cgccgcgcccucgccgcc

SEQ ID NO: 244523 - RNA, 20 nt, Human
cgccgcgccgccgccuccuc

SEQ ID NO: 244524 - RNA, 24 nt, Human
cgccuccucuccggcgcccucucc

SEQ ID NO: 244525 - RNA, 21 nt, Human
cggcggcggcucgcuccuccu

SEQ ID NO: 244526 - RNA, 21 nt, Human
cucgccgccgcgccgccgccu

SEQ ID NO: 244527 - RNA, 24 nt, Human
cuguuuuuuuuuuuuuuaacauga

SEQ ID NO: 244528 - RNA, 25 nt, Human
gcagaguuuagaguacagcggaccg

SEQ ID NO: 244529 - RNA, 22 nt, Human
gccgcgccgcucgcccucugcc

SEQ ID NO: 244530 - RNA, 19 nt, Human
gcgccgcgcccucgccgcc

SEQ ID NO: 244531 - RNA, 21 nt, Human
gcugaagugcaauagcugcug

SEQ ID NO: 244532 - RNA, 20 nt, Human
ggaagggacggagcuuccuu

SEQ ID NO: 244533 - RNA, 19 nt, Human
gggcagcaacggcggcggc

SEQ ID NO: 244534 - RNA, 24 nt, Human
gggugagcgggaagggacggagcu

SEQ ID NO: 244535 - RNA, 20 nt, Human
gugcagcgccuuucuccucu

SEQ ID NO: 244536 - RNA, 27 nt, Human
guguuuugucuguuuuuuuuuuuuuuc

SEQ ID NO: 244537 - RNA, 18 nt, Human
uaaagugcagcgccuuuc

SEQ ID NO: 244538 - RNA, 20 nt, Human
uacgacaggucagaaacuua

SEQ ID NO: 244539 - RNA, 24 nt, Human
uauuagagcauauuacaaacacac

SEQ ID NO: 244540 - RNA, 24 nt, Human
ucgcgcgccgcgcccucgccgccg

SEQ ID NO: 244541 - RNA, 20 nt, Human
uggccggcugacaagucggc

SEQ ID NO: 244542 - RNA, 24 nt, Human
uggccggcugacaagucggcuucg

SEQ ID NO: 244543 - RNA, 19 nt, Human
uggcugaagugcaauagcu

SEQ ID NO: 244544 - RNA, 20 nt, Human
uggcugaagugcaauagcug

SEQ ID NO: 244545 - RNA, 18 nt, Human
ugugcaacugguacaguu

SEQ ID NO: 244546 - RNA, 25 nt, Human
uucccacccccaagaagaucagcuc

SEQ ID NO: 244547 - RNA, 22 nt, Human
uuuuuuuuuuguugagagucuc

SEQ ID NO: 244548 - RNA, 20 nt, Human
uuuuuuuuuuuuuuguugag

SEQ ID NO: 244549 - RNA, 20 nt, Human
uuuuuuuuuuuuuuuuuguu

SEQ ID NO: 244550 - RNA, 24 nt, Human
uuuuuuuuuuuuuuuuuuuuuggg

SEQ ID NO: 244551 - RNA, 18 nt, Human
aaaaaugcagcaaauaua

SEQ ID NO: 244552 - RNA, 26 nt, Human
aaaaggaaaauaaacaaugaaaaaaa

SEQ ID NO: 244553 - RNA, 25 nt, Human
aaauaaacaaugaaaaaaaugcagc

SEQ ID NO: 244554 - RNA, 22 nt, Human
aacacgccaaaaagcuaacacu

SEQ ID NO: 244555 - RNA, 26 nt, Human
aauaaacaaugaaaaaaaugcagcaa

SEQ ID NO: 244556 - RNA, 18 nt, Human
acacgccaaaaagcuaac

SEQ ID NO: 244557 - RNA, 20 nt, Human
acauacacacaaucacagaa

SEQ ID NO: 244558 - RNA, 21 nt, Human
acuuccgguuccgggcugaaa

SEQ ID NO: 244559 - RNA, 18 nt, Human
agaacacgccaaaaagcu

SEQ ID NO: 244560 - RNA, 23 nt, Human
agcuaguuugauaccuccuguuc

SEQ ID NO: 244561 - RNA, 26 nt, Human
aggaaaauaaacaaugaaaaaaaugc

SEQ ID NO: 244562 - RNA, 19 nt, Human
aggaagaaaugaucauuua

SEQ ID NO: 244563 - RNA, 25 nt, Human
aggaggagggccguaaacuccgggg

SEQ ID NO: 244564 - RNA, 19 nt, Human
aggcaguuggcauucagaa

SEQ ID NO: 244565 - RNA, 21 nt, Human
auagagcagcugccacuuacc

SEQ ID NO: 244566 - RNA, 27 nt, Human
auucagaacacgccaaaaagcuaacua

SEQ ID NO: 244567 - RNA, 21 nt, Human
caacacacauacacacaauca

SEQ ID NO: 244568 - RNA, 27 nt, Human
caacacacauacacacaaucacagaau

SEQ ID NO: 244569 - RNA, 26 nt, Human
caagaauaaagucauucuugagguuc

SEQ ID NO: 244570 - RNA, 21 nt, Human
cagaacacgccaaaaagcuaa

SEQ ID NO: 244571 - RNA, 24 nt, Human
caguaaaauuguauguccaccaug

SEQ ID NO: 244572 - RNA, 22 nt, Human
cauucagaacacgccaaaaagc

SEQ ID NO: 244573 - RNA, 19 nt, Human
ccaaaaagcuaacacucau

SEQ ID NO: 244574 - RNA, 24 nt, Human
ccccgcccacuacacuuccgguuc

SEQ ID NO: 244575 - RNA, 24 nt, Human
cccgcgcccacccgccuccggacc

SEQ ID NO: 244576 - RNA, 19 nt, Human
ccgccuccggaccgacccu

SEQ ID NO: 244577 - RNA, 26 nt, Human
ccgggugagacccgcgcccacccgcc

SEQ ID NO: 244578 - RNA, 21 nt, Human
ccuccggaccgacccucagcc

SEQ ID NO: 244579 - RNA, 22 nt, Human
ccuccggaccgacccucagccu

SEQ ID NO: 244580 - RNA, 21 nt, Human
ccucuaauaugaaaaaaugga

SEQ ID NO: 244581 - RNA, 20 nt, Human
cgccaaaaagcuaacacuca

SEQ ID NO: 244582 - RNA, 27 nt, Human
gaaaaggaaaauaaacaaugaaaaaaa

SEQ ID NO: 244583 - RNA, 21 nt, Human
gaggcagcggccacagccgug

SEQ ID NO: 244584 - RNA, 19 nt, Human
gccaaaaagcuaacacuca

SEQ ID NO: 244585 - RNA, 26 nt, Human
gccacaguucacugcaucuugcgugc

SEQ ID NO: 244586 - RNA, 24 nt, Human
ggaaacaggaggagggccguaaac

SEQ ID NO: 244587 - RNA, 20 nt, Human
ggauggaacugaguucagua

SEQ ID NO: 244588 - RNA, 18 nt, Human
ggcucuggcuccgcugcg

SEQ ID NO: 244589 - RNA, 27 nt, Human
uaaaaaaaaagucuuucuuugcauauu

SEQ ID NO: 244590 - RNA, 19 nt, Human
uaacuugguauauaccauc

SEQ ID NO: 244591 - RNA, 26 nt, Human
uaauauaccaccaaucacucuaaauu

SEQ ID NO: 244592 - RNA, 19 nt, Human
uacccugucuuuaacuugg

SEQ ID NO: 244593 - RNA, 23 nt, Human
uauaccaucuuuugggaaaaaaa

SEQ ID NO: 244594 - RNA, 23 nt, Human
ucaacacacauacacacaaucac

SEQ ID NO: 244595 - RNA, 19 nt, Human
ucacugcaggaagaaauga

SEQ ID NO: 244596 - RNA, 22 nt, Human
ucagaacacgccaaaaagcuaa

SEQ ID NO: 244597 - RNA, 23 nt, Human
ucagaacacgccaaaaagcuaac

SEQ ID NO: 244598 - RNA, 24 nt, Human
uccaagaaucacugcaggaagaaa

SEQ ID NO: 244599 - RNA, 26 nt, Human
uccaagaaucacugcaggaagaaaug

SEQ ID NO: 244600 - RNA, 18 nt, Human
uccgggcugaaaucggaa

SEQ ID NO: 244601 - RNA, 22 nt, Human
uccgggguaggggaggggagaa

SEQ ID NO: 244602 - RNA, 19 nt, Human
uccguggcggggguagagg

SEQ ID NO: 244603 - RNA, 21 nt, Human
ugaaaaaauggacgcuguuug

SEQ ID NO: 244604 - RNA, 22 nt, Human
ugagaaaacaauccaagaauca

SEQ ID NO: 244605 - RNA, 27 nt, Human
ugagaugagauacaagaauaaagucau

SEQ ID NO: 244606 - RNA, 19 nt, Human
uggaacugaguucaguacu

SEQ ID NO: 244607 - RNA, 22 nt, Human
uguauguccaccaugagaaaag

SEQ ID NO: 244608 - RNA, 19 nt, Human
uguccaccaugagaaaagg

SEQ ID NO: 244609 - RNA, 21 nt, Human
uuauaagguuuuccuuuccuu

SEQ ID NO: 244610 - RNA, 28 nt, Human
uuuaagagauuaauauuagagucauaaa

SEQ ID NO: 244611 - RNA, 30 nt, Human
uuuacaguuucaacacacauacacacagug

SEQ ID NO: 244612 - RNA, 20 nt, Human
aaauccucucaccugcagaa

SEQ ID NO: 244613 - RNA, 19 nt, Human
aaccacauuccaacuccuc

SEQ ID NO: 244614 - RNA, 24 nt, Human
aaccucuucccuccugggaaccac

SEQ ID NO: 244615 - RNA, 22 nt, Human
aagaagcaaggcaggcaguggg

SEQ ID NO: 244616 - RNA, 19 nt, Human
aagggcgaugguccuggcu

SEQ ID NO: 244617 - RNA, 23 nt, Human
acagcaccagaaggaagaagcaa

SEQ ID NO: 244618 - RNA, 19 nt, Human
acagggcgccucuuccugc

SEQ ID NO: 244619 - RNA, 20 nt, Human
acaguucaucucagcugccu

SEQ ID NO: 244620 - RNA, 24 nt, Human
acucuacugcccggagagccaugg

SEQ ID NO: 244621 - RNA, 23 nt, Human
agccuauggucuucacagcacca

SEQ ID NO: 244622 - RNA, 21 nt, Human
agcggccccugccucagccca

SEQ ID NO: 244623 - RNA, 25 nt, Human
aggcaggcaccagcucacccuggcu

SEQ ID NO: 244624 - RNA, 22 nt, Human
aggugauggugggaggaggggu

SEQ ID NO: 244625 - RNA, 24 nt, Human
aggugauggugggaggaggggugg

SEQ ID NO: 244626 - RNA, 20 nt, Human
aucccaggccccagaugcuc

SEQ ID NO: 244627 - RNA, 19 nt, Human
caacagaugacacaaccaa

SEQ ID NO: 244628 - RNA, 23 nt, Human
caagucccccagccugacucaca

SEQ ID NO: 244629 - RNA, 19 nt, Human
cacaaccaaggcaggucca

SEQ ID NO: 244630 - RNA, 24 nt, Human
cacagcaccagaaggaagaagcaa

SEQ ID NO: 244631 - RNA, 25 nt, Human
cacagcaccagaaggaagaagcaag

SEQ ID NO: 244632 - RNA, 22 nt, Human
caccagaaggaagaagcaaggc

SEQ ID NO: 244633 - RNA, 20 nt, Human
caccaggcccugcucucccg

SEQ ID NO: 244634 - RNA, 23 nt, Human
caccugcagaacagagauggcuu

SEQ ID NO: 244635 - RNA, 23 nt, Human
cacgccuggcucuggggaagccc

SEQ ID NO: 244636 - RNA, 21 nt, Human
cacucuacugcccggagagcc

SEQ ID NO: 244637 - RNA, 18 nt, Human
cagagaccaagcaccccu

SEQ ID NO: 244638 - RNA, 21 nt, Human
cagaggauggggcaccugcug

SEQ ID NO: 244639 - RNA, 25 nt, Human
cagaugacacaaccaaggcaggucc

SEQ ID NO: 244640 - RNA, 20 nt, Human
cagaugcuccccugguccuc

SEQ ID NO: 244641 - RNA, 21 nt, Human
cagcccaccggggccaguccu

SEQ ID NO: 244642 - RNA, 26 nt, Human
cagccuauggucuucacagcaccaga

SEQ ID NO: 244643 - RNA, 24 nt, Human
cagcucccugguuccacaccaggc

SEQ ID NO: 244644 - RNA, 21 nt, Human
cagcugccugccagccuaugg

SEQ ID NO: 244645 - RNA, 19 nt, Human
caggcaccagcucacccug

SEQ ID NO: 244646 - RNA, 20 nt, Human
cagggcugagaggcuggaga

SEQ ID NO: 244647 - RNA, 23 nt, Human
cagugguaaagacaguucaucuc

SEQ ID NO: 244648 - RNA, 21 nt, Human
caguuccaggucucuuagacc

SEQ ID NO: 244649 - RNA, 18 nt, Human
caucccaggccccagaug

SEQ ID NO: 244650 - RNA, 20 nt, Human
ccagaugcuccccugguccu

SEQ ID NO: 244651 - RNA, 24 nt, Human
cccacagcucccugguuccacacc

SEQ ID NO: 244652 - RNA, 19 nt, Human
cccagggacagauacggac

SEQ ID NO: 244653 - RNA, 21 nt, Human
ccccagaugcuccccuggucc

SEQ ID NO: 244654 - RNA, 20 nt, Human
ccccucaucagugguaaaga

SEQ ID NO: 244655 - RNA, 24 nt, Human
ccccugccucagcccaccggggcc

SEQ ID NO: 244656 - RNA, 25 nt, Human
ccccuggcuccuuuccaccuggccu

SEQ ID NO: 244657 - RNA, 23 nt, Human
cccgacccuucuccuaugccucc

SEQ ID NO: 244658 - RNA, 20 nt, Human
cccugcuugcuacccucagc

SEQ ID NO: 244659 - RNA, 23 nt, Human
ccucucaccugcagaacagagau

SEQ ID NO: 244660 - RNA, 21 nt, Human
ccucuucccuccugggaacca

SEQ ID NO: 244661 - RNA, 21 nt, Human
ccugguggcacccccucccca

SEQ ID NO: 244662 - RNA, 21 nt, Human
cgacccuucuccuaugccucc

SEQ ID NO: 244663 - RNA, 21 nt, Human
cucacacacucuacugccccu

SEQ ID NO: 244664 - RNA, 21 nt, Human
cuccuuuccaccuggccugcc

SEQ ID NO: 244665 - RNA, 20 nt, Human
cucucggccugcuuccucuc

SEQ ID NO: 244666 - RNA, 18 nt, Human
cugccucagcccaccggg

SEQ ID NO: 244667 - RNA, 20 nt, Human
cuggagaaguggagggcuac

SEQ ID NO: 244668 - RNA, 20 nt, Human
cuggccugccccuucugugg

SEQ ID NO: 244669 - RNA, 18 nt, Human
cuggggcauggggggcag

SEQ ID NO: 244670 - RNA, 23 nt, Human
cuugggacagcagggucugcugg

SEQ ID NO: 244671 - RNA, 22 nt, Human
cuuugcagagaccaagcacccc

SEQ ID NO: 244672 - RNA, 24 nt, Human
gaaggcagagaacaugugggaaau

SEQ ID NO: 244673 - RNA, 20 nt, Human
gaccuguuuuucuuccauuu

SEQ ID NO: 244674 - RNA, 25 nt, Human
gagaacaugugggaaauagucuaac

SEQ ID NO: 244675 - RNA, 20 nt, Human
gaggacccugggcugagacc

SEQ ID NO: 244676 - RNA, 24 nt, Human
gccccugccucagcccaccggggc

SEQ ID NO: 244677 - RNA, 20 nt, Human
gccguuguggcacaggcaga

SEQ ID NO: 244678 - RNA, 18 nt, Human
gcugagaccuguuuuucu

SEQ ID NO: 244679 - RNA, 22 nt, Human
gcugagaggcuggagaagugga

SEQ ID NO: 244680 - RNA, 19 nt, Human
ggagauggggagggcgugg

SEQ ID NO: 244681 - RNA, 24 nt, Human
ggccgccauccucuggcaguucca

SEQ ID NO: 244682 - RNA, 19 nt, Human
ggcucaggccugacgacag

SEQ ID NO: 244683 - RNA, 18 nt, Human
ggcucuggggaagcccag

SEQ ID NO: 244684 - RNA, 19 nt, Human
ggcugagaggcuggagaag

SEQ ID NO: 244685 - RNA, 19 nt, Human
gggaagcccaggccgccau

SEQ ID NO: 244686 - RNA, 20 nt, Human
gggacagcagggucugcugg

SEQ ID NO: 244687 - RNA, 18 nt, Human
gggaggaaguggccuuca

SEQ ID NO: 244688 - RNA, 19 nt, Human
gggaggaaguggccuucag

SEQ ID NO: 244689 - RNA, 21 nt, Human
gggagggcguggagaauccgg

SEQ ID NO: 244690 - RNA, 22 nt, Human
gggcagaggauggggcaccugc

SEQ ID NO: 244691 - RNA, 25 nt, Human
gggcagaggauggggcaccugcugg

SEQ ID NO: 244692 - RNA, 19 nt, Human
ggggcaccugcuggccguu

SEQ ID NO: 244693 - RNA, 19 nt, Human
gggggcagggagacuggga

SEQ ID NO: 244694 - RNA, 23 nt, Human
gggugggcuugggacagcagggu

SEQ ID NO: 244695 - RNA, 21 nt, Human
ggguggugacaagguaugaac

SEQ ID NO: 244696 - RNA, 19 nt, Human
ggugggaggaggggugggc

SEQ ID NO: 244697 - RNA, 18 nt, Human
guggagggcuacuguccc

SEQ ID NO: 244698 - RNA, 23 nt, Human
uacaggguucacagggcgccucu

SEQ ID NO: 244699 - RNA, 22 nt, Human
uauggucuucacagcaccagaa

SEQ ID NO: 244700 - RNA, 21 nt, Human
ucaaaguggggagugagggag

SEQ ID NO: 244701 - RNA, 23 nt, Human
ucacaaccccugcuugcuacccu

SEQ ID NO: 244702 - RNA, 21 nt, Human
ucagcccaccggggccagucc

SEQ ID NO: 244703 - RNA, 19 nt, Human
ucccaggccccagaugcuc

SEQ ID NO: 244704 - RNA, 24 nt, Human
ucccaggccccagaugcuccccug

SEQ ID NO: 244705 - RNA, 20 nt, Human
ucccaggguuacugugucuc

SEQ ID NO: 244706 - RNA, 21 nt, Human
ucccaggguuacugugucuca

SEQ ID NO: 244707 - RNA, 23 nt, Human
ucccccagccugacucacaaccc

SEQ ID NO: 244708 - RNA, 21 nt, Human
uccccugguccuccuggaaug

SEQ ID NO: 244709 - RNA, 23 nt, Human
ucccgcaggaaaauggauuccca

SEQ ID NO: 244710 - RNA, 21 nt, Human
ucccugguuccacaccaggcc

SEQ ID NO: 244711 - RNA, 18 nt, Human
ucucccgcacgccuggcu

SEQ ID NO: 244712 - RNA, 20 nt, Human
ucucccgcaggaaaauggau

SEQ ID NO: 244713 - RNA, 24 nt, Human
ucugcugugggcagaggauggggc

SEQ ID NO: 244714 - RNA, 22 nt, Human
ucuggauacaggagcacagggg

SEQ ID NO: 244715 - RNA, 19 nt, Human
ucuggggcauggggggcag

SEQ ID NO: 244716 - RNA, 21 nt, Human
ugaaggcagagaacauguggg

SEQ ID NO: 244717 - RNA, 21 nt, Human
ugacacaaccaaggcaggucc

SEQ ID NO: 244718 - RNA, 21 nt, Human
ugacucacaaccccugcuugc

SEQ ID NO: 244719 - RNA, 20 nt, Human
ugagggaggugaugguggga

SEQ ID NO: 244720 - RNA, 20 nt, Human
ugauggugggaggaggggug

SEQ ID NO: 244721 - RNA, 24 nt, Human
ugauggugggaggaggggugggcu

SEQ ID NO: 244722 - RNA, 22 nt, Human
ugcagaacagagauggcuucaa

SEQ ID NO: 244723 - RNA, 25 nt, Human
ugccagccuauggucuucacagcac

SEQ ID NO: 244724 - RNA, 18 nt, Human
ugccccuucuguggccau

SEQ ID NO: 244725 - RNA, 19 nt, Human
ugcccggagagccauggga

SEQ ID NO: 244726 - RNA, 21 nt, Human
ugccucagcccaccggggccg

SEQ ID NO: 244727 - RNA, 20 nt, Human
ugcuggggaggcucgggcgg

SEQ ID NO: 244728 - RNA, 22 nt, Human
uggccgacagcccugguggcac

SEQ ID NO: 244729 - RNA, 21 nt, Human
uggcucaggccugacgacagc

SEQ ID NO: 244730 - RNA, 22 nt, Human
ugggagauggggagggcgugga

SEQ ID NO: 244731 - RNA, 19 nt, Human
ugggaggaaguggccuuca

SEQ ID NO: 244732 - RNA, 18 nt, Human
ugggaggaggggugggcu

SEQ ID NO: 244733 - RNA, 20 nt, Human
ugggcagaggauggggcacc

SEQ ID NO: 244734 - RNA, 24 nt, Human
uggggagggcguggagaauccggg

SEQ ID NO: 244735 - RNA, 20 nt, Human
uggucuucacagcaccagaa

SEQ ID NO: 244736 - RNA, 23 nt, Human
uuccacaccaggcccugcucucc

SEQ ID NO: 244737 - RNA, 21 nt, Human
uuccaggucucuuagaccacu

SEQ ID NO: 244738 - RNA, 18 nt, Human
uucuccuaugccucccag

SEQ ID NO: 244739 - RNA, 20 nt, Human
uuucccuaccuggcccucug

SEQ ID NO: 244740 - RNA, 22 nt, Human
uuucugcuguggcuucccacag

SEQ ID NO: 244741 - RNA, 21 nt, Human
uuugcagagaccaagcacccc

SEQ ID NO: 244742 - RNA, 26 nt, Human
aaaaaagaaaauuaguuaacaaaagg

SEQ ID NO: 244743 - RNA, 18 nt, Human
aaaaaagggcuguaggua

SEQ ID NO: 244744 - RNA, 21 nt, Human
aaacugauuuaucaaucuuca

SEQ ID NO: 244745 - RNA, 23 nt, Human
aaagacaaggccaagaguaccac

SEQ ID NO: 244746 - RNA, 20 nt, Human
aaaguacagaauaaguagag

SEQ ID NO: 244747 - RNA, 21 nt, Human
aaccuuguuguucugucagug

SEQ ID NO: 244748 - RNA, 22 nt, Human
aagaaaagaaaucacuuaaagc

SEQ ID NO: 244749 - RNA, 19 nt, Human
aagaaaauaaucaagaaga

SEQ ID NO: 244750 - RNA, 18 nt, Human
aagaagaaaagaaaucac

SEQ ID NO: 244751 - RNA, 19 nt, Human
aagacaaagacaaggccaa

SEQ ID NO: 244752 - RNA, 22 nt, Human
aagcuuuacaaauaaaacaagc

SEQ ID NO: 244753 - RNA, 22 nt, Human
acaaggccaagaguaccacaga

SEQ ID NO: 244754 - RNA, 20 nt, Human
accacagauuucugaaguuc

SEQ ID NO: 244755 - RNA, 23 nt, Human
agaagaaaagaaaucacuuaaag

SEQ ID NO: 244756 - RNA, 20 nt, Human
agguacugcugcuguugcug

SEQ ID NO: 244757 - RNA, 22 nt, Human
auagaacugcagaugaagcuga

SEQ ID NO: 244758 - RNA, 19 nt, Human
augaagcugaaaaacaagg

SEQ ID NO: 244759 - RNA, 19 nt, Human
caaaaugcaaagccugaaa

SEQ ID NO: 244760 - RNA, 26 nt, Human
cacaaaaccaucaacucaagauaucc

SEQ ID NO: 244761 - RNA, 21 nt, Human
cacuaugcggcagcaaauggu

SEQ ID NO: 244762 - RNA, 18 nt, Human
cacuguacacaguuaggc

SEQ ID NO: 244763 - RNA, 21 nt, Human
cacuguguugugucacccacu

SEQ ID NO: 244764 - RNA, 20 nt, Human
cagcaaaugguucuuaaaua

SEQ ID NO: 244765 - RNA, 23 nt, Human
cagcaaaugguucuuaaauaguu

SEQ ID NO: 244766 - RNA, 22 nt, Human
cagugaaacuuuuucccgauga

SEQ ID NO: 244767 - RNA, 20 nt, Human
cauagaacugcagaugaagc

SEQ ID NO: 244768 - RNA, 22 nt, Human
ccaaaaaaagggcuguagguac

SEQ ID NO: 244769 - RNA, 18 nt, Human
cccuccuccuccucggcc

SEQ ID NO: 244770 - RNA, 19 nt, Human
cccuuagccccauucuaag

SEQ ID NO: 244771 - RNA, 20 nt, Human
ccgccgcuucccccuccucc

SEQ ID NO: 244772 - RNA, 19 nt, Human
ccuauguagcagugaaacu

SEQ ID NO: 244773 - RNA, 24 nt, Human
ccuccucggccgccgccgccgccu

SEQ ID NO: 244774 - RNA, 20 nt, Human
ccucggccgccgccgccgcc

SEQ ID NO: 244775 - RNA, 20 nt, Human
cgccgccgccgccucuccca

SEQ ID NO: 244776 - RNA, 20 nt, Human
cuaaaucacaaaaccaucaa

SEQ ID NO: 244777 - RNA, 24 nt, Human
cugaaguucuucccuauccaaugg

SEQ ID NO: 244778 - RNA, 22 nt, Human
cugcaauucacugugcagcauc

SEQ ID NO: 244779 - RNA, 19 nt, Human
cuggcuucacagaguggag

SEQ ID NO: 244780 - RNA, 21 nt, Human
gaaacuuuuucccgaugacag

SEQ ID NO: 244781 - RNA, 22 nt, Human
gaagacaaagacaaggccaaga

SEQ ID NO: 244782 - RNA, 20 nt, Human
gaagcugaaaaacaaggccu

SEQ ID NO: 244783 - RNA, 19 nt, Human
gacaugaggggaaaaaggu

SEQ ID NO: 244784 - RNA, 22 nt, Human
gacauuuaacauuagcagaaca

SEQ ID NO: 244785 - RNA, 23 nt, Human
gacuguacuuucccaauaacaac

SEQ ID NO: 244786 - RNA, 23 nt, Human
gggcagccgucuccaccgucgcc

SEQ ID NO: 244787 - RNA, 22 nt, Human
gggcuguagguacugcugcugu

SEQ ID NO: 244788 - RNA, 20 nt, Human
uaaaaagggacaugaucgug

SEQ ID NO: 244789 - RNA, 21 nt, Human
uaaaacacagccacuugcaaa

SEQ ID NO: 244790 - RNA, 22 nt, Human
uaaaacacagccacuugcaaac

SEQ ID NO: 244791 - RNA, 22 nt, Human
uaaacuucucuccaaaaaaagg

SEQ ID NO: 244792 - RNA, 22 nt, Human
uaagaaaauaaucaagaagaaa

SEQ ID NO: 244793 - RNA, 22 nt, Human
uaagggcuuugggucuaugguu

SEQ ID NO: 244794 - RNA, 20 nt, Human
uacaguaggaaaagcuuugg

SEQ ID NO: 244795 - RNA, 19 nt, Human
uaggaaaagcuuuggggua

SEQ ID NO: 244796 - RNA, 22 nt, Human
ucagguaaggcuuaaaaaggga

SEQ ID NO: 244797 - RNA, 22 nt, Human
uccaagcauuuuccuuugccgc

SEQ ID NO: 244798 - RNA, 18 nt, Human
uccauaaugggacacugg

SEQ ID NO: 244799 - RNA, 19 nt, Human
ucccaauaacaacugcuuu

SEQ ID NO: 244800 - RNA, 22 nt, Human
ucccauuuaaaacacagccacu

SEQ ID NO: 244801 - RNA, 18 nt, Human
uccucggccgccgccgcc

SEQ ID NO: 244802 - RNA, 22 nt, Human
uccucggccgccgccgccgccu

SEQ ID NO: 244803 - RNA, 23 nt, Human
uccuuugccgccgccgcuucccc

SEQ ID NO: 244804 - RNA, 19 nt, Human
ucuaugguuuaauuaccua

SEQ ID NO: 244805 - RNA, 19 nt, Human
ucuccaaaaaaagggcugu

SEQ ID NO: 244806 - RNA, 20 nt, Human
ucuccaaaaaaagggcugua

SEQ ID NO: 244807 - RNA, 20 nt, Human
ucuuuuguuuuaagcuuccc

SEQ ID NO: 244808 - RNA, 23 nt, Human
ucuuuuguuuuaagcuucccugu

SEQ ID NO: 244809 - RNA, 18 nt, Human
ugcugcuuuccuuugcau

SEQ ID NO: 244810 - RNA, 20 nt, Human
ugggguauuucgcugcacau

SEQ ID NO: 244811 - RNA, 20 nt, Human
ugguuuugagacuguacuuu

SEQ ID NO: 244812 - RNA, 18 nt, Human
uguggaagacaaacacug

SEQ ID NO: 244813 - RNA, 21 nt, Human
ugugguuuuagagaagauaca

SEQ ID NO: 244814 - RNA, 20 nt, Human
uuaaaaauaaauugcaucaa

SEQ ID NO: 244815 - RNA, 23 nt, Human
uuaaaacacagccacuugcaaac

SEQ ID NO: 244816 - RNA, 19 nt, Human
uuagccccauucuaagcac

SEQ ID NO: 244817 - RNA, 23 nt, Human
uuccuuugccgccgccgcuuccc

SEQ ID NO: 244818 - RNA, 24 nt, Human
uuugccgccgccgcuucccccucc

SEQ ID NO: 244819 - RNA, 28 nt, Human
uuuuauaaauacacaugauacugucacc

SEQ ID NO: 244820 - RNA, 20 nt, Human
aaaagaaacugucacuagug

SEQ ID NO: 244821 - RNA, 21 nt, Human
aaaaucaucaauaauuuacaa

SEQ ID NO: 244822 - RNA, 19 nt, Human
aaacagaaagagacugccc

SEQ ID NO: 244823 - RNA, 21 nt, Human
aaacagaaagagacugcccgg

SEQ ID NO: 244824 - RNA, 19 nt, Human
aacauacacaguaugcuau

SEQ ID NO: 244825 - RNA, 21 nt, Human
aaccagccuccaggagaucaa

SEQ ID NO: 244826 - RNA, 22 nt, Human
aagguucggugcgaugcuggcu

SEQ ID NO: 244827 - RNA, 21 nt, Human
aauuaugugguuuacacaguu

SEQ ID NO: 244828 - RNA, 22 nt, Human
accccagagcguggcgcgcagu

SEQ ID NO: 244829 - RNA, 22 nt, Human
accgccuccccgacuuuuccau

SEQ ID NO: 244830 - RNA, 23 nt, Human
acgccgggccacugggauccggc

SEQ ID NO: 244831 - RNA, 22 nt, Human
agaguuauauaauauacaccaa

SEQ ID NO: 244832 - RNA, 21 nt, Human
agauacugcguuagcuuccuu

SEQ ID NO: 244833 - RNA, 20 nt, Human
agcagaaccagccuccagga

SEQ ID NO: 244834 - RNA, 22 nt, Human
agcagaaccagccuccaggaga

SEQ ID NO: 244835 - RNA, 19 nt, Human
agcaggaaccagggcgccg

SEQ ID NO: 244836 - RNA, 21 nt, Human
aguggccugcugucagauggc

SEQ ID NO: 244837 - RNA, 19 nt, Human
auaccagaauuuaccaaua

SEQ ID NO: 244838 - RNA, 19 nt, Human
auugcuacaaucuucaagu

SEQ ID NO: 244839 - RNA, 21 nt, Human
caaauuccugccuuagaauca

SEQ ID NO: 244840 - RNA, 21 nt, Human
cacggcgucugagccugccca

SEQ ID NO: 244841 - RNA, 18 nt, Human
cagcagaaccagccucca

SEQ ID NO: 244842 - RNA, 23 nt, Human
cagcauagcauguacaguauaaa

SEQ ID NO: 244843 - RNA, 19 nt, Human
cagccgcggccccccgaag

SEQ ID NO: 244844 - RNA, 20 nt, Human
caggggcaugguaaauaagc

SEQ ID NO: 244845 - RNA, 22 nt, Human
cccuguguagaggcagcagaac

SEQ ID NO: 244846 - RNA, 18 nt, Human
ccgacccgccaccccgcc

SEQ ID NO: 244847 - RNA, 23 nt, Human
ccgcccugcucugccccugacuc

SEQ ID NO: 244848 - RNA, 20 nt, Human
ccgccgccccucauuugccc

SEQ ID NO: 244849 - RNA, 21 nt, Human
ccgccgccccucauuugcccu

SEQ ID NO: 244850 - RNA, 19 nt, Human
ccggccgagcgcuccagcc

SEQ ID NO: 244851 - RNA, 18 nt, Human
ccggcggcggcagcggca

SEQ ID NO: 244852 - RNA, 23 nt, Human
ccuucgaaaauggcaccauucac

SEQ ID NO: 244853 - RNA, 20 nt, Human
ccuuugggauguacaaaaau

SEQ ID NO: 244854 - RNA, 22 nt, Human
cgaaaauggcaccauucacugu

SEQ ID NO: 244855 - RNA, 19 nt, Human
cgacuuuuccauuuccccu

SEQ ID NO: 244856 - RNA, 20 nt, Human
cggcagaagcaggaaccagg

SEQ ID NO: 244857 - RNA, 23 nt, Human
cggcggcagcggcagaagcagga

SEQ ID NO: 244858 - RNA, 18 nt, Human
cucaugagguggucguga

SEQ ID NO: 244859 - RNA, 26 nt, Human
cugcaggccugugggagccgagcacg

SEQ ID NO: 244860 - RNA, 22 nt, Human
cugcccaggggcggcgcagcgg

SEQ ID NO: 244861 - RNA, 22 nt, Human
cugcugucagauggcuucuaau

SEQ ID NO: 244862 - RNA, 19 nt, Human
gcagugucaggggcauggu

SEQ ID NO: 244863 - RNA, 20 nt, Human
gccggaccccagagcguggc

SEQ ID NO: 244864 - RNA, 18 nt, Human
ggacgccagccaccgccu

SEQ ID NO: 244865 - RNA, 23 nt, Human
ggacgccagccaccgccuccccg

SEQ ID NO: 244866 - RNA, 20 nt, Human
ggcgcagcggacgccagcca

SEQ ID NO: 244867 - RNA, 18 nt, Human
gugucauuuuuagcugcu

SEQ ID NO: 244868 - RNA, 26 nt, Human
uaaaaugaauauuccauacuuaaaua

SEQ ID NO: 244869 - RNA, 18 nt, Human
uaagaauuacaaaaucau

SEQ ID NO: 244870 - RNA, 25 nt, Human
uacaauguuacaaauauauauaugu

SEQ ID NO: 244871 - RNA, 21 nt, Human
uacaccaauauacacaaaaca

SEQ ID NO: 244872 - RNA, 20 nt, Human
uacuuuacaauguuacaaau

SEQ ID NO: 244873 - RNA, 21 nt, Human
ucaaugcugucuuaauuuaga

SEQ ID NO: 244874 - RNA, 18 nt, Human
uccacauucaaaacauca

SEQ ID NO: 244875 - RNA, 21 nt, Human
uccauacuuaaauaagaacca

SEQ ID NO: 244876 - RNA, 19 nt, Human
uccccccgacccgccaccc

SEQ ID NO: 244877 - RNA, 19 nt, Human
uccguaaacagaaagagac

SEQ ID NO: 244878 - RNA, 22 nt, Human
uccguaaacagaaagagacugc

SEQ ID NO: 244879 - RNA, 23 nt, Human
ucucuccguaaacagaaagagac

SEQ ID NO: 244880 - RNA, 22 nt, Human
ucugcaaacaagauguggcuac

SEQ ID NO: 244881 - RNA, 24 nt, Human
ugaaacagucagcagacacgaucc

SEQ ID NO: 244882 - RNA, 18 nt, Human
ugaaagauucaugaaggc

SEQ ID NO: 244883 - RNA, 24 nt, Human
ugaaugaaacagucagcagacacg

SEQ ID NO: 244884 - RNA, 21 nt, Human
ugacucacggcgucugagccu

SEQ ID NO: 244885 - RNA, 22 nt, Human
ugauuugaccaaccacauugga

SEQ ID NO: 244886 - RNA, 27 nt, Human
ugccccugacucacggcgucugagccu

SEQ ID NO: 244887 - RNA, 19 nt, Human
ugcgaugcuggcugcaggc

SEQ ID NO: 244888 - RNA, 24 nt, Human
ugcucagugcagugucaggggcau

SEQ ID NO: 244889 - RNA, 21 nt, Human
ugcucuuucuggagagucuca

SEQ ID NO: 244890 - RNA, 23 nt, Human
uggagagucucaugagguggucg

SEQ ID NO: 244891 - RNA, 24 nt, Human
uggagagucucaugagguggucgu

SEQ ID NO: 244892 - RNA, 20 nt, Human
uggcgcgcaguccagagcgg

SEQ ID NO: 244893 - RNA, 18 nt, Human
uggcugcaggccuguggg

SEQ ID NO: 244894 - RNA, 20 nt, Human
ugggauccggcggcggcagc

SEQ ID NO: 244895 - RNA, 22 nt, Human
uguauaccagaauuuaccaaua

SEQ ID NO: 244896 - RNA, 21 nt, Human
uguuacaaauauauauaugua

SEQ ID NO: 244897 - RNA, 20 nt, Human
uuagagcaaacauggcaucc

SEQ ID NO: 244898 - RNA, 27 nt, Human
uucuuaucugcaaacaagauguggcua

SEQ ID NO: 244899 - RNA, 21 nt, Human
uugaccaaccacauuggacaa

SEQ ID NO: 244900 - RNA, 22 nt, Human
uuguaugcaugagugagaaaag

SEQ ID NO: 244901 - RNA, 20 nt, Human
uuuacaaaaguuuucauuuu

SEQ ID NO: 244902 - RNA, 20 nt, Human
uuuccauuuccccuuucucu

SEQ ID NO: 244903 - RNA, 21 nt, Human
aaaucaauuucuaacaacuga

SEQ ID NO: 244904 - RNA, 22 nt, Human
aacauccccguccccccguucu

SEQ ID NO: 244905 - RNA, 23 nt, Human
aaggaagacuguggagggugggg

SEQ ID NO: 244906 - RNA, 20 nt, Human
aaggcaaggaagacugugga

SEQ ID NO: 244907 - RNA, 21 nt, Human
aaggugagcuccgcaaaauca

SEQ ID NO: 244908 - RNA, 20 nt, Human
acagcaaccucauccccuau

SEQ ID NO: 244909 - RNA, 20 nt, Human
accacgucgcccagccgcag

SEQ ID NO: 244910 - RNA, 25 nt, Human
accacgucgcccagccgcaggguca

SEQ ID NO: 244911 - RNA, 25 nt, Human
accccuuccuccccuacacagccag

SEQ ID NO: 244912 - RNA, 24 nt, Human
accuucccaaagcccccgaugcca

SEQ ID NO: 244913 - RNA, 24 nt, Human
accuugcuuucagucuuccugcua

SEQ ID NO: 244914 - RNA, 21 nt, Human
acgauagaccuucccaaagcc

SEQ ID NO: 244915 - RNA, 23 nt, Human
agaaagcacgauagaccuuccca

SEQ ID NO: 244916 - RNA, 20 nt, Human
agccagagcugauggccaca

SEQ ID NO: 244917 - RNA, 21 nt, Human
aggcaguuccccuuuccaccu

SEQ ID NO: 244918 - RNA, 23 nt, Human
aguggacacggguagaaaggccc

SEQ ID NO: 244919 - RNA, 23 nt, Human
caaccucauccccuauccagaaa

SEQ ID NO: 244920 - RNA, 22 nt, Human
caagcccuaugaccccacacug

SEQ ID NO: 244921 - RNA, 24 nt, Human
caccacgucgcccagccgcagggu

SEQ ID NO: 244922 - RNA, 25 nt, Human
caccacgucgcccagccgcaggguc

SEQ ID NO: 244923 - RNA, 23 nt, Human
caccagcccucgucgccggacac

SEQ ID NO: 244924 - RNA, 21 nt, Human
caccccuuccuccccuacaca

SEQ ID NO: 244925 - RNA, 24 nt, Human
caccuccaccacgucgcccagccg

SEQ ID NO: 244926 - RNA, 18 nt, Human
cacgauagaccuucccaa

SEQ ID NO: 244927 - RNA, 25 nt, Human
cagaaaagcuccuaucucgaaccaa

SEQ ID NO: 244928 - RNA, 18 nt, Human
cagaauauccaacacugg

SEQ ID NO: 244929 - RNA, 22 nt, Human
cagggucagcucguccucgccc

SEQ ID NO: 244930 - RNA, 18 nt, Human
ccaacuggcugaggagag

SEQ ID NO: 244931 - RNA, 27 nt, Human
ccaauaaucucuuccaaggugagcucc

SEQ ID NO: 244932 - RNA, 24 nt, Human
ccaccagcccucgucgccggacac

SEQ ID NO: 244933 - RNA, 25 nt, Human
ccccacacugggccaccuugcuuuc

SEQ ID NO: 244934 - RNA, 22 nt, Human
cccgaugccaauaaucucuucc

SEQ ID NO: 244935 - RNA, 26 nt, Human
cccucaucuccgcuggcugucccccu

SEQ ID NO: 244936 - RNA, 24 nt, Human
ccuccaguggacacggguagaaag

SEQ ID NO: 244937 - RNA, 22 nt, Human
ccucgcccgccgccucguacuc

SEQ ID NO: 244938 - RNA, 23 nt, Human
cgucgccggacaccugcgagucc

SEQ ID NO: 244939 - RNA, 24 nt, Human
cugaggcaguuccccuuuccaccu

SEQ ID NO: 244940 - RNA, 18 nt, Human
cugauguccucaucaggg

SEQ ID NO: 244941 - RNA, 22 nt, Human
cuggaagugcagauaggcagug

SEQ ID NO: 244942 - RNA, 18 nt, Human
cuuccugcuagcaugaaa

SEQ ID NO: 244943 - RNA, 23 nt, Human
cuugcccgccccaauccuuuucg

SEQ ID NO: 244944 - RNA, 18 nt, Human
gaacucggggcugacaaa

SEQ ID NO: 244945 - RNA, 19 nt, Human
gaccaaaaucaaucacaga

SEQ ID NO: 244946 - RNA, 19 nt, Human
gagcugcuuucacagcaac

SEQ ID NO: 244947 - RNA, 21 nt, Human
gcccuguuuccaucccuucca

SEQ ID NO: 244948 - RNA, 21 nt, Human
gcggcuggagaaggcgcugcg

SEQ ID NO: 244949 - RNA, 18 nt, Human
ggcuggagaaggcgcugc

SEQ ID NO: 244950 - RNA, 18 nt, Human
gggcuggaucucaggggg

SEQ ID NO: 244951 - RNA, 20 nt, Human
gguccucgccgccgggcugg

SEQ ID NO: 244952 - RNA, 22 nt, Human
gucgccggacaccugcgagucc

SEQ ID NO: 244953 - RNA, 22 nt, Human
gugacucugcagggucacuccc

SEQ ID NO: 244954 - RNA, 22 nt, Human
ucaaagugcauuaucagugcaa

SEQ ID NO: 244955 - RNA, 24 nt, Human
ucaagcccuaugaccccacacugg

SEQ ID NO: 244956 - RNA, 22 nt, Human
ucacagcaaccucauccccuau

SEQ ID NO: 244957 - RNA, 19 nt, Human
ucacucuaaaggcaaggaa

SEQ ID NO: 244958 - RNA, 19 nt, Human
ucagugcaagaaguagggc

SEQ ID NO: 244959 - RNA, 21 nt, Human
ucagugcaagaaguagggcug

SEQ ID NO: 244960 - RNA, 18 nt, Human
ucccaaagcccccgaugc

SEQ ID NO: 244961 - RNA, 21 nt, Human
ucccaaagcccccgaugccaa

SEQ ID NO: 244962 - RNA, 18 nt, Human
uccuaacauccccguccc

SEQ ID NO: 244963 - RNA, 18 nt, Human
uccuggguguugggggac

SEQ ID NO: 244964 - RNA, 24 nt, Human
uccuuggacagcaccuccaccacg

SEQ ID NO: 244965 - RNA, 18 nt, Human
ucgccggacaccugcgag

SEQ ID NO: 244966 - RNA, 18 nt, Human
ucuauggucuggcugaug

SEQ ID NO: 244967 - RNA, 22 nt, Human
ucuuccaaggugagcuccgcaa

SEQ ID NO: 244968 - RNA, 24 nt, Human
ucuuggcgaacauucucuaugguc

SEQ ID NO: 244969 - RNA, 25 nt, Human
ugcaugcaccccuuccuccccuaca

SEQ ID NO: 244970 - RNA, 19 nt, Human
ugcccacccgcugguucag

SEQ ID NO: 244971 - RNA, 18 nt, Human
uggagggugggggacaug

SEQ ID NO: 244972 - RNA, 20 nt, Human
uggcagcggcuggagaaggc

SEQ ID NO: 244973 - RNA, 18 nt, Human
uggcugagugacucugca

SEQ ID NO: 244974 - RNA, 20 nt, Human
uggcugagugacucugcagg

SEQ ID NO: 244975 - RNA, 21 nt, Human
ugggaagcugaacucggggcu

SEQ ID NO: 244976 - RNA, 23 nt, Human
aaaauggcaaaaccaaccagucc

SEQ ID NO: 244977 - RNA, 23 nt, Human
aaaauggcaaaaccaaccagucc

SEQ ID NO: 244978 - RNA, 24 nt, Human
aaacaagaaaaaugugacagcagc

SEQ ID NO: 244979 - RNA, 24 nt, Human
aaacaagaaaaaugugacagcagc

SEQ ID NO: 244980 - RNA, 18 nt, Human
aaagcagggagaugggcc

SEQ ID NO: 244981 - RNA, 18 nt, Human
aaagcagggagaugggcc

SEQ ID NO: 244982 - RNA, 19 nt, Human
aacaaaauggcaaaaccaa

SEQ ID NO: 244983 - RNA, 23 nt, Human
aacaaaauggcaaaaccaaccag

SEQ ID NO: 244984 - RNA, 26 nt, Human
aaccaccccaacccccucccaaccuc

SEQ ID NO: 244985 - RNA, 26 nt, Human
aaccaccccaacccccucccaaccuc

SEQ ID NO: 244986 - RNA, 22 nt, Human
aacccccucccaaccuccucca

SEQ ID NO: 244987 - RNA, 22 nt, Human
aacccccucccaaccuccucca

SEQ ID NO: 244988 - RNA, 22 nt, Human
aacuuagccucaaccaccccaa

SEQ ID NO: 244989 - RNA, 22 nt, Human
aagaaaaaugugacagcagcua

SEQ ID NO: 244990 - RNA, 22 nt, Human
aagaaaaaugugacagcagcua

SEQ ID NO: 244991 - RNA, 23 nt, Human
aagcaggagggaaggcgagccua

SEQ ID NO: 244992 - RNA, 23 nt, Human
aagcaggagggaaggcgagccua

SEQ ID NO: 244993 - RNA, 24 nt, Human
aagcaggagggaaggcgagccuag

SEQ ID NO: 244994 - RNA, 24 nt, Human
aagcaggagggaaggcgagccuag

SEQ ID NO: 244995 - RNA, 19 nt, Human
aaggacccgggagcccgag

SEQ ID NO: 244996 - RNA, 20 nt, Human
aaggacccgggagcccgagu

SEQ ID NO: 244997 - RNA, 20 nt, Human
aagggcccgacaccaccugc

SEQ ID NO: 244998 - RNA, 24 nt, Human
aauaaaaggacaaaacaagaaaaa

SEQ ID NO: 244999 - RNA, 24 nt, Human
aauaaaaggacaaaacaagaaaaa

SEQ ID NO: 245000 - RNA, 20 nt, Human
acaaaacaagaaaaauguga

SEQ ID NO: 245001 - RNA, 19 nt, Human
accaccccaacccccuccc

SEQ ID NO: 245002 - RNA, 19 nt, Human
accaccccaacccccuccc

SEQ ID NO: 245003 - RNA, 22 nt, Human
accccaacccccucccaaccuc

SEQ ID NO: 245004 - RNA, 25 nt, Human
accccaacccccucccaaccuccuu

SEQ ID NO: 245005 - RNA, 19 nt, Human
acccgggagcccgaguugg

SEQ ID NO: 245006 - RNA, 19 nt, Human
agaaaaaaauaaaaggaca

SEQ ID NO: 245007 - RNA, 19 nt, Human
agaaaaaaauaaaaggaca

SEQ ID NO: 245008 - RNA, 22 nt, Human
agaaaaaaauaaaaggacaaaa

SEQ ID NO: 245009 - RNA, 22 nt, Human
agaaaaaaauaaaaggacaaaa

SEQ ID NO: 245010 - RNA, 21 nt, Human
agaaaagcagcauacacacaa

SEQ ID NO: 245011 - RNA, 21 nt, Human
agaaaagcagcauacacacaa

SEQ ID NO: 245012 - RNA, 19 nt, Human
agacaagaggggaacacgg

SEQ ID NO: 245013 - RNA, 20 nt, Human
agacaagaggggaacacggg

SEQ ID NO: 245014 - RNA, 18 nt, Human
agagggagaggcaguggc

SEQ ID NO: 245015 - RNA, 18 nt, Human
agagggagaggcaguggc

SEQ ID NO: 245016 - RNA, 18 nt, Human
agauccagggagaaggga

SEQ ID NO: 245017 - RNA, 18 nt, Human
agauccagggagaaggga

SEQ ID NO: 245018 - RNA, 24 nt, Human
agcagggagaugggcccaggcugg

SEQ ID NO: 245019 - RNA, 24 nt, Human
agcagggagaugggcccaggcugg

SEQ ID NO: 245020 - RNA, 23 nt, Human
agccuagcgggcugcccagcacg

SEQ ID NO: 245021 - RNA, 23 nt, Human
agccuagcgggcugcccagcacg

SEQ ID NO: 245022 - RNA, 21 nt, Human
agccucugcaccccucuuccc

SEQ ID NO: 245023 - RNA, 22 nt, Human
aggacccgggagcccgaguugg

SEQ ID NO: 245024 - RNA, 21 nt, Human
aggagccgggagccagcgagc

SEQ ID NO: 245025 - RNA, 18 nt, Human
aggagguguggggcaggg

SEQ ID NO: 245026 - RNA, 20 nt, Human
aggcagcacugacccccaac

SEQ ID NO: 245027 - RNA, 20 nt, Human
aggcagcacugacccccaac

SEQ ID NO: 245028 - RNA, 18 nt, Human
agggaaggcgagccuagc

SEQ ID NO: 245029 - RNA, 18 nt, Human
agggaaggcgagccuagc

SEQ ID NO: 245030 - RNA, 18 nt, Human
agggaaguguggggggcg

SEQ ID NO: 245031 - RNA, 18 nt, Human
agggaaguguggggggcg

SEQ ID NO: 245032 - RNA, 22 nt, Human
agggagaggcaguggcuuaagc

SEQ ID NO: 245033 - RNA, 18 nt, Human
agggagaggggaacaggg

SEQ ID NO: 245034 - RNA, 24 nt, Human
agggggccaaggacccgggagccc

SEQ ID NO: 245035 - RNA, 24 nt, Human
agggggccaaggacccgggagccc

SEQ ID NO: 245036 - RNA, 18 nt, Human
agguagauccagggagaa

SEQ ID NO: 245037 - RNA, 18 nt, Human
agguagauccagggagaa

SEQ ID NO: 245038 - RNA, 24 nt, Human
agugacaugggaggagggaaggga

SEQ ID NO: 245039 - RNA, 23 nt, Human
auccaccuccacucuucccucca

SEQ ID NO: 245040 - RNA, 18 nt, Human
augggacagagaugccaa

SEQ ID NO: 245041 - RNA, 20 nt, Human
augggacagagaugccaaaa

SEQ ID NO: 245042 - RNA, 21 nt, Human
augggacagagaugccaaaac

SEQ ID NO: 245043 - RNA, 21 nt, Human
caaaaaaagaugaggauagaa

SEQ ID NO: 245044 - RNA, 21 nt, Human
caaaaaaagaugaggauagaa

SEQ ID NO: 245045 - RNA, 21 nt, Human
caaaacaagaaaaaugugaca

SEQ ID NO: 245046 - RNA, 21 nt, Human
caaaacaagaaaaaugugaca

SEQ ID NO: 245047 - RNA, 24 nt, Human
caaaaccaaccaguccacgcucca

SEQ ID NO: 245048 - RNA, 24 nt, Human
caaaaccaaccaguccacgcucca

SEQ ID NO: 245049 - RNA, 24 nt, Human
caaaauggcaaaaccaaccagucc

SEQ ID NO: 245050 - RNA, 24 nt, Human
caaaauggcaaaaccaaccagucc

SEQ ID NO: 245051 - RNA, 20 nt, Human
caacaaaauggcaaaaccaa

SEQ ID NO: 245052 - RNA, 23 nt, Human
caacaaaauggcaaaaccaacca

SEQ ID NO: 245053 - RNA, 23 nt, Human
caacaaaauggcaaaaccaacca

SEQ ID NO: 245054 - RNA, 24 nt, Human
caacaaaauggcaaaaccaaccag

SEQ ID NO: 245055 - RNA, 23 nt, Human
caacuuagccucaaccaccccaa

SEQ ID NO: 245056 - RNA, 20 nt, Human
cacagccucugcaccccucu

SEQ ID NO: 245057 - RNA, 20 nt, Human
cacagccucugcaccccucu

SEQ ID NO: 245058 - RNA, 22 nt, Human
caccacucggaauccaccucca

SEQ ID NO: 245059 - RNA, 22 nt, Human
caccacucggaauccaccucca

SEQ ID NO: 245060 - RNA, 21 nt, Human
cacggucagcguccugucacc

SEQ ID NO: 245061 - RNA, 21 nt, Human
cacggucagcguccugucacc

SEQ ID NO: 245062 - RNA, 21 nt, Human
cagaagggagccaggagagcg

SEQ ID NO: 245063 - RNA, 21 nt, Human
cagcaagaagggcccgacacc

SEQ ID NO: 245064 - RNA, 21 nt, Human
cagcaagaagggcccgacacc

SEQ ID NO: 245065 - RNA, 22 nt, Human
cagccucugcaccccucuuccc

SEQ ID NO: 245066 - RNA, 22 nt, Human
cagcguccugucaccacucgga

SEQ ID NO: 245067 - RNA, 22 nt, Human
cagcguccugucaccacucgga

SEQ ID NO: 245068 - RNA, 21 nt, Human
caguccacgcuccaagggccc

SEQ ID NO: 245069 - RNA, 21 nt, Human
caguccacgcuccaagggccc

SEQ ID NO: 245070 - RNA, 23 nt, Human
caguuucuuuuggguuuggacca

SEQ ID NO: 245071 - RNA, 23 nt, Human
caguuucuuuuggguuuggacca

SEQ ID NO: 245072 - RNA, 26 nt, Human
cauacacacaacaaaauggcaaaacc

SEQ ID NO: 245073 - RNA, 26 nt, Human
cauacacacaacaaaauggcaaaacc

SEQ ID NO: 245074 - RNA, 19 nt, Human
ccaaagaaccaaaaaaaga

SEQ ID NO: 245075 - RNA, 22 nt, Human
ccaacccccucccaaccuccuc

SEQ ID NO: 245076 - RNA, 22 nt, Human
ccaacccccucccaaccuccuc

SEQ ID NO: 245077 - RNA, 19 nt, Human
ccaaccuccuccacggagc

SEQ ID NO: 245078 - RNA, 19 nt, Human
ccacagccucugcaccccu

SEQ ID NO: 245079 - RNA, 20 nt, Human
ccagccacagccucugcacc

SEQ ID NO: 245080 - RNA, 20 nt, Human
ccagccacagccucugcacc

SEQ ID NO: 245081 - RNA, 22 nt, Human
ccagguagauccagggagaagg

SEQ ID NO: 245082 - RNA, 22 nt, Human
ccagguagauccagggagaagg

SEQ ID NO: 245083 - RNA, 21 nt, Human
cccaaccuccuccacggagca

SEQ ID NO: 245084 - RNA, 26 nt, Human
cccaacuuagccucaaccaccccaac

SEQ ID NO: 245085 - RNA, 26 nt, Human
cccaacuuagccucaaccaccccaac

SEQ ID NO: 245086 - RNA, 23 nt, Human
ccccaacccccucccaaccuccu

SEQ ID NO: 245087 - RNA, 23 nt, Human
ccccaacuuggggcagggcagca

SEQ ID NO: 245088 - RNA, 24 nt, Human
cccccaacuuggggcagggcagca

SEQ ID NO: 245089 - RNA, 18 nt, Human
cccgggagcccgaguugg

SEQ ID NO: 245090 - RNA, 21 nt, Human
cccuaagcugcccacauccuc

SEQ ID NO: 245091 - RNA, 21 nt, Human
cccuaagcugcccacauccuc

SEQ ID NO: 245092 - RNA, 20 nt, Human
ccgcaccgccuccagggccc

SEQ ID NO: 245093 - RNA, 20 nt, Human
ccgcaccgccuccagggccc

SEQ ID NO: 245094 - RNA, 20 nt, Human
ccgccgagacggagcugggg

SEQ ID NO: 245095 - RNA, 24 nt, Human
ccucaaccaccccaacccccuccc

SEQ ID NO: 245096 - RNA, 24 nt, Human
ccucaaccaccccaacccccuccc

SEQ ID NO: 245097 - RNA, 25 nt, Human
ccucaaccaccccaacccccuccca

SEQ ID NO: 245098 - RNA, 25 nt, Human
ccucaaccaccccaacccccuccca

SEQ ID NO: 245099 - RNA, 22 nt, Human
ccuccagggcccuaagcugccc

SEQ ID NO: 245100 - RNA, 22 nt, Human
ccuccagggcccuaagcugccc

SEQ ID NO: 245101 - RNA, 22 nt, Human
ccuggcauuugcccggaacguc

SEQ ID NO: 245102 - RNA, 22 nt, Human
ccuggcauuugcccggaacguc

SEQ ID NO: 245103 - RNA, 18 nt, Human
cgccagggaagugugggg

SEQ ID NO: 245104 - RNA, 18 nt, Human
cgccagggaagugugggg

SEQ ID NO: 245105 - RNA, 19 nt, Human
cgcccuguucccucuaaca

SEQ ID NO: 245106 - RNA, 19 nt, Human
cgcccuguucccucuaaca

SEQ ID NO: 245107 - RNA, 23 nt, Human
cggagcuggggcagaagggagcc

SEQ ID NO: 245108 - RNA, 21 nt, Human
cgggaaagggggccaaggacc

SEQ ID NO: 245109 - RNA, 21 nt, Human
cgggaaagggggccaaggacc

SEQ ID NO: 245110 - RNA, 20 nt, Human
cgggagcccgaguuggggcc

SEQ ID NO: 245111 - RNA, 20 nt, Human
cgggagcccgaguuggggcc

SEQ ID NO: 245112 - RNA, 22 nt, Human
cgggaggagccgggagccagcg

SEQ ID NO: 245113 - RNA, 21 nt, Human
cgggcacgcaaagcaggaggg

SEQ ID NO: 245114 - RNA, 21 nt, Human
cgggcacgcaaagcaggaggg

SEQ ID NO: 245115 - RNA, 19 nt, Human
cggucagcguccugucacc

SEQ ID NO: 245116 - RNA, 19 nt, Human
cggucagcguccugucacc

SEQ ID NO: 245117 - RNA, 24 nt, Human
cuccacggucagcguccugucacc

SEQ ID NO: 245118 - RNA, 24 nt, Human
cuccacggucagcguccugucacc

SEQ ID NO: 245119 - RNA, 20 nt, Human
cucggaauccaccuccacuc

SEQ ID NO: 245120 - RNA, 20 nt, Human
cucggaauccaccuccacuc

SEQ ID NO: 245121 - RNA, 22 nt, Human
cugaccggcucaccagccacag

SEQ ID NO: 245122 - RNA, 22 nt, Human
cugaccggcucaccagccacag

SEQ ID NO: 245123 - RNA, 19 nt, Human
cugcaccccucuucccugc

SEQ ID NO: 245124 - RNA, 19 nt, Human
cugcaccccucuucccugc

SEQ ID NO: 245125 - RNA, 21 nt, Human
cugcaccccucuucccugccg

SEQ ID NO: 245126 - RNA, 21 nt, Human
cugcaccccucuucccugccg

SEQ ID NO: 245127 - RNA, 23 nt, Human
cugcaccccucuucccugccgca

SEQ ID NO: 245128 - RNA, 23 nt, Human
cugcaccccucuucccugccgca

SEQ ID NO: 245129 - RNA, 22 nt, Human
cugguucuccucuccuagaucc

SEQ ID NO: 245130 - RNA, 22 nt, Human
cugguucuccucuccuagaucc

SEQ ID NO: 245131 - RNA, 21 nt, Human
cuuagccucaaccaccccaac

SEQ ID NO: 245132 - RNA, 21 nt, Human
cuuagccucaaccaccccaac

SEQ ID NO: 245133 - RNA, 22 nt, Human
cuuagccucaaccaccccaacc

SEQ ID NO: 245134 - RNA, 22 nt, Human
cuuagccucaaccaccccaacc

SEQ ID NO: 245135 - RNA, 19 nt, Human
gaagagccgugaggaggua

SEQ ID NO: 245136 - RNA, 21 nt, Human
gaagggcccgacaccaccugc

SEQ ID NO: 245137 - RNA, 19 nt, Human
gacagcagcuaggcgggua

SEQ ID NO: 245138 - RNA, 18 nt, Human
gacaugggaggagggaag

SEQ ID NO: 245139 - RNA, 20 nt, Human
gacccgggagcccgaguugg

SEQ ID NO: 245140 - RNA, 18 nt, Human
gaggagggaagggagagg

SEQ ID NO: 245141 - RNA, 19 nt, Human
gaggagguguggggcaggg

SEQ ID NO: 245142 - RNA, 18 nt, Human
gagugagaggaggugugg

SEQ ID NO: 245143 - RNA, 18 nt, Human
gagugagaggaggugugg

SEQ ID NO: 245144 - RNA, 23 nt, Human
gcaaagcaggagggaaggcgagc

SEQ ID NO: 245145 - RNA, 23 nt, Human
gcaaagcaggagggaaggcgagc

SEQ ID NO: 245146 - RNA, 29 nt, Human
gcaaagcaggagggaaggcgagccuagcg

SEQ ID NO: 245147 - RNA, 29 nt, Human
gcaaagcaggagggaaggcgagccuagcg

SEQ ID NO: 245148 - RNA, 18 nt, Human
gcggggcgcagggaggcg

SEQ ID NO: 245149 - RNA, 21 nt, Human
ggacaggcagcacugaccccc

SEQ ID NO: 245150 - RNA, 21 nt, Human
ggacaggcagcacugaccccc

SEQ ID NO: 245151 - RNA, 23 nt, Human
ggaccagagggagaggcaguggc

SEQ ID NO: 245152 - RNA, 23 nt, Human
ggaccagagggagaggcaguggc

SEQ ID NO: 245153 - RNA, 18 nt, Human
ggagaggggaacagggga

SEQ ID NO: 245154 - RNA, 19 nt, Human
ggagaugggcccaggcugg

SEQ ID NO: 245155 - RNA, 19 nt, Human
ggagaugggcccaggcugg

SEQ ID NO: 245156 - RNA, 23 nt, Human
ggcccuuucuuguucuccagccc

SEQ ID NO: 245157 - RNA, 23 nt, Human
ggcccuuucuuguucuccagccc

SEQ ID NO: 245158 - RNA, 24 nt, Human
gggaacacgggggagaccgguacc

SEQ ID NO: 245159 - RNA, 19 nt, Human
gggacagagaugccaaaac

SEQ ID NO: 245160 - RNA, 21 nt, Human
gggagaggcaguggcuuaagc

SEQ ID NO: 245161 - RNA, 21 nt, Human
gggaggagggaagggagaggg

SEQ ID NO: 245162 - RNA, 20 nt, Human
gggcaagaccaaagcaggga

SEQ ID NO: 245163 - RNA, 18 nt, Human
gggcagggcugcugcugc

SEQ ID NO: 245164 - RNA, 18 nt, Human
gggcagggcugcugcugc

SEQ ID NO: 245165 - RNA, 18 nt, Human
gggcagggcugcugcugc

SEQ ID NO: 245166 - RNA, 22 nt, Human
ggggcaagaccaaagcagggag

SEQ ID NO: 245167 - RNA, 19 nt, Human
ggggcagggcugcugcugc

SEQ ID NO: 245168 - RNA, 18 nt, Human
ggucggugcgggcccugg

SEQ ID NO: 245169 - RNA, 18 nt, Human
ggucggugcgggcccugg

SEQ ID NO: 245170 - RNA, 21 nt, Human
guagauccagggagaagggag

SEQ ID NO: 245171 - RNA, 21 nt, Human
guagauccagggagaagggag

SEQ ID NO: 245172 - RNA, 23 nt, Human
gugacaugggaggagggaaggga

SEQ ID NO: 245173 - RNA, 21 nt, Human
gugauggggcaagaccaaagc

SEQ ID NO: 245174 - RNA, 21 nt, Human
gugauggggcaagaccaaagc

SEQ ID NO: 245175 - RNA, 21 nt, Human
guggggcagggcugcugcugc

SEQ ID NO: 245176 - RNA, 20 nt, Human
guucccucuaacacuuacug

SEQ ID NO: 245177 - RNA, 20 nt, Human
uagaaaagaaaagcagcaua

SEQ ID NO: 245178 - RNA, 20 nt, Human
uagaaaagaaaagcagcaua

SEQ ID NO: 245179 - RNA, 22 nt, Human
uagccucaaccaccccaacccc

SEQ ID NO: 245180 - RNA, 22 nt, Human
uagccucaaccaccccaacccc

SEQ ID NO: 245181 - RNA, 24 nt, Human
ucaaccaccccaacccccucccaa

SEQ ID NO: 245182 - RNA, 24 nt, Human
ucaaccaccccaacccccucccaa

SEQ ID NO: 245183 - RNA, 23 nt, Human
ucagcguccugucaccacucgga

SEQ ID NO: 245184 - RNA, 23 nt, Human
ucagcguccugucaccacucgga

SEQ ID NO: 245185 - RNA, 22 nt, Human
uccaccuccacucuucccucca

SEQ ID NO: 245186 - RNA, 23 nt, Human
uccgcccuguucccucuaacacc

SEQ ID NO: 245187 - RNA, 23 nt, Human
uccgcccuguucccucuaacacc

SEQ ID NO: 245188 - RNA, 22 nt, Human
uccuagaucccaacuuagccuc

SEQ ID NO: 245189 - RNA, 22 nt, Human
uccuagaucccaacuuagccuc

SEQ ID NO: 245190 - RNA, 18 nt, Human
uccuccagcggggguggc

SEQ ID NO: 245191 - RNA, 18 nt, Human
uccuccagcggggguggc

SEQ ID NO: 245192 - RNA, 24 nt, Human
ucggaauccaccuccacucuuccc

SEQ ID NO: 245193 - RNA, 24 nt, Human
ucggaauccaccuccacucuuccc

SEQ ID NO: 245194 - RNA, 23 nt, Human
ucuccuagaucccaacuuagccu

SEQ ID NO: 245195 - RNA, 23 nt, Human
ucuccuagaucccaacuuagccu

SEQ ID NO: 245196 - RNA, 18 nt, Human
ucuccuggcccuuucuug

SEQ ID NO: 245197 - RNA, 18 nt, Human
ucuccuggcccuuucuug

SEQ ID NO: 245198 - RNA, 21 nt, Human
ucuugguuagaaaagaaaagc

SEQ ID NO: 245199 - RNA, 21 nt, Human
ucuugguuagaaaagaaaagc

SEQ ID NO: 245200 - RNA, 19 nt, Human
ugacccccaacuuggggca

SEQ ID NO: 245201 - RNA, 19 nt, Human
ugacccccaacuuggggca

SEQ ID NO: 245202 - RNA, 20 nt, Human
ugagaggagguguggggcag

SEQ ID NO: 245203 - RNA, 20 nt, Human
ugagaggagguguggggcag

SEQ ID NO: 245204 - RNA, 18 nt, Human
ugaggauagaaucugguu

SEQ ID NO: 245205 - RNA, 18 nt, Human
ugaggauagaaucugguu

SEQ ID NO: 245206 - RNA, 24 nt, Human
ugaggauagaaucugguucuccuc

SEQ ID NO: 245207 - RNA, 25 nt, Human
ugaggauagaaucugguucuccucu

SEQ ID NO: 245208 - RNA, 26 nt, Human
ugaggauagaaucugguucuccucuc

SEQ ID NO: 245209 - RNA, 26 nt, Human
ugaggauagaaucugguucuccucuc

SEQ ID NO: 245210 - RNA, 24 nt, Human
ugcccagcacggcgcccaagcgcu

SEQ ID NO: 245211 - RNA, 24 nt, Human
ugcccagcacggcgcccaagcgcu

SEQ ID NO: 245212 - RNA, 21 nt, Human
ugcgggcccuggcauuugccc

SEQ ID NO: 245213 - RNA, 21 nt, Human
ugcgggcccuggcauuugccc

SEQ ID NO: 245214 - RNA, 24 nt, Human
uggcaaaaccaaccaguccacgcu

SEQ ID NO: 245215 - RNA, 24 nt, Human
uggcaaaaccaaccaguccacgcu

SEQ ID NO: 245216 - RNA, 19 nt, Human
uggggaggggggggcgccc

SEQ ID NO: 245217 - RNA, 19 nt, Human
uggggcaagaccaaagcag

SEQ ID NO: 245218 - RNA, 20 nt, Human
uggggcaagaccaaagcagg

SEQ ID NO: 245219 - RNA, 19 nt, Human
uguggggggcgggagacaa

SEQ ID NO: 245220 - RNA, 19 nt, Human
uguggggggcgggagacaa

SEQ ID NO: 245221 - RNA, 19 nt, Human
uucccucuaacacuuacug

SEQ ID NO: 245222 - RNA, 23 nt, Human
uucuuguucuccagcccuggcuu

SEQ ID NO: 245223 - RNA, 23 nt, Human
uucuuguucuccagcccuggcuu

SEQ ID NO: 245224 - RNA, 21 nt, Human
uuucuuguucuccagcccugg

SEQ ID NO: 245225 - RNA, 21 nt, Human
uuucuuguucuccagcccugg

SEQ ID NO: 245226 - RNA, 22 nt, Human
aaaugcaggggcaggcucuugg

SEQ ID NO: 245227 - RNA, 19 nt, Human
aggaaauguggaacaaaau

SEQ ID NO: 245228 - RNA, 26 nt, Human
augggggagugacagcagcucccccu

SEQ ID NO: 245229 - RNA, 20 nt, Human
auuucucaggauuacuucuu

SEQ ID NO: 245230 - RNA, 23 nt, Human
cagcagggccagggccugggcuc

SEQ ID NO: 245231 - RNA, 24 nt, Human
caggggcaggcucuuggcagaaag

SEQ ID NO: 245232 - RNA, 18 nt, Human
ccaaaagggccugcagcu

SEQ ID NO: 245233 - RNA, 22 nt, Human
cccagcagggccagggccuggg

SEQ ID NO: 245234 - RNA, 18 nt, Human
cccaggacaaaugcaggg

SEQ ID NO: 245235 - RNA, 22 nt, Human
cccaggcccagggucccugccu

SEQ ID NO: 245236 - RNA, 18 nt, Human
ccccucccuccccaggcc

SEQ ID NO: 245237 - RNA, 20 nt, Human
ccggcaggcgggcgggcgcg

SEQ ID NO: 245238 - RNA, 18 nt, Human
ccggcgcggggcggcgcg

SEQ ID NO: 245239 - RNA, 26 nt, Human
ccugcagcuaaggcgugggguggggc

SEQ ID NO: 245240 - RNA, 19 nt, Human
cgcggggcggcgcggggcg

SEQ ID NO: 245241 - RNA, 19 nt, Human
cggagccggcgcggggcga

SEQ ID NO: 245242 - RNA, 21 nt, Human
cggcgcggggcggcgcggggc

SEQ ID NO: 245243 - RNA, 23 nt, Human
cggcgcggggcggcgcggggcgg

SEQ ID NO: 245244 - RNA, 18 nt, Human
gagccccuggacaggccc

SEQ ID NO: 245245 - RNA, 21 nt, Human
gagccggcgcggggcggcgcg

SEQ ID NO: 245246 - RNA, 22 nt, Human
gauggcccaggcccaggguccc

SEQ ID NO: 245247 - RNA, 19 nt, Human
gccccuggacaggcccgcu

SEQ ID NO: 245248 - RNA, 21 nt, Human
gccugcagcuaaggcgugggg

SEQ ID NO: 245249 - RNA, 24 nt, Human
gcgcggggcggcgcggggcggggc

SEQ ID NO: 245250 - RNA, 19 nt, Human
gcgggcgcgagcugcggag

SEQ ID NO: 245251 - RNA, 20 nt, Human
gcugcggagccggcgcgggg

SEQ ID NO: 245252 - RNA, 18 nt, Human
ggcugccucggggauggg

SEQ ID NO: 245253 - RNA, 21 nt, Human
gggccggcaggcgggcgggcg

SEQ ID NO: 245254 - RNA, 18 nt, Human
gggcggcgcggggcgggg

SEQ ID NO: 245255 - RNA, 23 nt, Human
uccccaggccugaaacauuucuc

SEQ ID NO: 245256 - RNA, 23 nt, Human
uccccaggccugaaacauuucuc

SEQ ID NO: 245257 - RNA, 23 nt, Human
ucgggggcuccccucccucccca

SEQ ID NO: 245258 - RNA, 20 nt, Human
ucugaccuucagccccagcc

SEQ ID NO: 245259 - RNA, 20 nt, Human
ugacagcagcucccccuggu

SEQ ID NO: 245260 - RNA, 24 nt, Human
uggauggcccaggcccaggguccc

SEQ ID NO: 245261 - RNA, 22 nt, Human
uggcagaaagaguagaaaggaa

SEQ ID NO: 245262 - RNA, 21 nt, Human
ugggccccuuugcccaaaagg

SEQ ID NO: 245263 - RNA, 20 nt, Human
ugggcugccucggggaugga

SEQ ID NO: 245264 - RNA, 23 nt, Human
uuaauaccaauauaguucucucu

SEQ ID NO: 245265 - RNA, 20 nt, Human
uuuuuuuuuuaaaacaaacc

SEQ ID NO: 245266 - RNA, 18 nt, Human
aagcaaaucauagugcag

SEQ ID NO: 245267 - RNA, 18 nt, Human
accacguuccccacccgg

SEQ ID NO: 245268 - RNA, 22 nt, Human
cacccggggcugcgucaccccg

SEQ ID NO: 245269 - RNA, 18 nt, Human
cccccgccagcucacccc

SEQ ID NO: 245270 - RNA, 22 nt, Human
ccccgcggcucccggauucccg

SEQ ID NO: 245271 - RNA, 18 nt, Human
ccgcacccgcguccuccc

SEQ ID NO: 245272 - RNA, 25 nt, Human
ccgccgccgcaccacguuccccacc

SEQ ID NO: 245273 - RNA, 20 nt, Human
ccgccgccgccgccgcacca

SEQ ID NO: 245274 - RNA, 21 nt, Human
ccgccgccgccgccgcaccac

SEQ ID NO: 245275 - RNA, 18 nt, Human
ccgccgccgccgccgccg

SEQ ID NO: 245276 - RNA, 23 nt, Human
ccgcuaacaagcacgaacggcgc

SEQ ID NO: 245277 - RNA, 24 nt, Human
ccggguuugccgucgccgccgccg

SEQ ID NO: 245278 - RNA, 21 nt, Human
ccucucgggggcggcggaggc

SEQ ID NO: 245279 - RNA, 25 nt, Human
cgccgccgccgccgcaccacguucc

SEQ ID NO: 245280 - RNA, 19 nt, Human
gcccccgccagcucacccc

SEQ ID NO: 245281 - RNA, 23 nt, Human
ggcgcguccucucgggggcggcg

SEQ ID NO: 245282 - RNA, 27 nt, Human
uaacaagcacgaacggcgccgcuuccc

SEQ ID NO: 245283 - RNA, 20 nt, Human
uagaccgcacccgcguccuc

SEQ ID NO: 245284 - RNA, 22 nt, Human
uagggcccggcccccgccagcu

SEQ ID NO: 245285 - RNA, 18 nt, Human
uaguuaaagcaaaucaua

SEQ ID NO: 245286 - RNA, 25 nt, Human
uauaacccauaauaguuaaagcaaa

SEQ ID NO: 245287 - RNA, 22 nt, Human
ucagccgcugcacggcgcgucc

SEQ ID NO: 245288 - RNA, 20 nt, Human
ucccagccagcaugggucgg

SEQ ID NO: 245289 - RNA, 21 nt, Human
uccuccucccgcgcgccggcc

SEQ ID NO: 245290 - RNA, 21 nt, Human
uccuuauuuuuccuuucaaug

SEQ ID NO: 245291 - RNA, 18 nt, Human
ucgccgccgccgccacuc

SEQ ID NO: 245292 - RNA, 18 nt, Human
ucgccgccgccgccacuc

SEQ ID NO: 245293 - RNA, 24 nt, Human
ucgccgccgccgccacucagccgc

SEQ ID NO: 245294 - RNA, 21 nt, Human
ucgccgccgccgccgccgccg

SEQ ID NO: 245295 - RNA, 22 nt, Human
ucgccgccgccgccgccgccgc

SEQ ID NO: 245296 - RNA, 18 nt, Human
uuagggcccggcccccgc

SEQ ID NO: 245297 - RNA, 21 nt, Human
uucauuuuccugucauuugag

SEQ ID NO: 245298 - RNA, 21 nt, Human
uuugccgucgccgccgccgcc

SEQ ID NO: 245299 - RNA, 20 nt, Human
aaauagcccugaaucaucag

SEQ ID NO: 245300 - RNA, 20 nt, Human
aaccugguaaucugccuaua

SEQ ID NO: 245301 - RNA, 21 nt, Human
aagaaggagcacacuggaaaa

SEQ ID NO: 245302 - RNA, 18 nt, Human
aaggaguugcaagaaaaa

SEQ ID NO: 245303 - RNA, 26 nt, Human
acaaauagagcucuuugcaauaauau

SEQ ID NO: 245304 - RNA, 23 nt, Human
aggaaugcagcuaacaaauuugu

SEQ ID NO: 245305 - RNA, 24 nt, Human
caccaucacugggacagcagcaac

SEQ ID NO: 245306 - RNA, 25 nt, Human
cagcagcaacauacagacuucagaa

SEQ ID NO: 245307 - RNA, 18 nt, Human
ccucccaggccagcggcc

SEQ ID NO: 245308 - RNA, 19 nt, Human
ccucccaggccagcggcca

SEQ ID NO: 245309 - RNA, 20 nt, Human
cgcuccgcccuuuccucggc

SEQ ID NO: 245310 - RNA, 19 nt, Human
cucccaggccagcggccca

SEQ ID NO: 245311 - RNA, 27 nt, Human
gaaaaacuuuauaaauacauuauguaa

SEQ ID NO: 245312 - RNA, 20 nt, Human
gaugacgcgcccggagagcc

SEQ ID NO: 245313 - RNA, 19 nt, Human
gcggcccagacaggugagc

SEQ ID NO: 245314 - RNA, 25 nt, Human
ggaaaggaauuccauuaauuguaga

SEQ ID NO: 245315 - RNA, 22 nt, Human
ggacagcagcaacauacagacu

SEQ ID NO: 245316 - RNA, 20 nt, Human
ggguggaggggaugcuccuu

SEQ ID NO: 245317 - RNA, 20 nt, Human
uagcaggaaaggaauuccau

SEQ ID NO: 245318 - RNA, 21 nt, Human
uagcccugaaucaucaguaac

SEQ ID NO: 245319 - RNA, 22 nt, Human
uagucugcuuuugcaaaaggag

SEQ ID NO: 245320 - RNA, 19 nt, Human
uaucgugguaacaucagaa

SEQ ID NO: 245321 - RNA, 18 nt, Human
ucccaggccagcggccca

SEQ ID NO: 245322 - RNA, 20 nt, Human
ucccgccggcccccgccucc

SEQ ID NO: 245323 - RNA, 24 nt, Human
ucccgccggcccccgccucccagg

SEQ ID NO: 245324 - RNA, 18 nt, Human
uccucggcuuggcucccg

SEQ ID NO: 245325 - RNA, 21 nt, Human
ucggcuuggcucccgccggcc

SEQ ID NO: 245326 - RNA, 24 nt, Human
ugcaaaaggaguugcaagaaaaau

SEQ ID NO: 245327 - RNA, 19 nt, Human
ugcaagaaaaaugugacag

SEQ ID NO: 245328 - RNA, 20 nt, Human
ugcaagaaaaaugugacagc

SEQ ID NO: 245329 - RNA, 27 nt, Human
ugcagaaaaauauugauugaucagugg

SEQ ID NO: 245330 - RNA, 22 nt, Human
ugcagaaaaauauugauugcua

SEQ ID NO: 245331 - RNA, 24 nt, Human
uuaaaacauuuuagucugcuuuug

SEQ ID NO: 245332 - RNA, 23 nt, Human
uuaaagaaauauaaaucuuaauu

SEQ ID NO: 245333 - RNA, 19 nt, Human
uucaaaaugauggucaaga

SEQ ID NO: 245334 - RNA, 23 nt, Human
aaacaagaaaaaaggacagcuga

SEQ ID NO: 245335 - RNA, 20 nt, Human
aaaccagaaagcaauuagug

SEQ ID NO: 245336 - RNA, 23 nt, Human
aaaccgccccuccaaacggcuca

SEQ ID NO: 245337 - RNA, 21 nt, Human
aaagccacaacuaccagaaac

SEQ ID NO: 245338 - RNA, 20 nt, Human
aagacggagcuaagcuguag

SEQ ID NO: 245339 - RNA, 27 nt, Human
aagagaucaguaaaauauggauagagc

SEQ ID NO: 245340 - RNA, 26 nt, Human
aagcaacaguaagcaguaaggugcac

SEQ ID NO: 245341 - RNA, 20 nt, Human
aagccaagacgggcuggaga

SEQ ID NO: 245342 - RNA, 19 nt, Human
aagugcuccccaaggauuc

SEQ ID NO: 245343 - RNA, 21 nt, Human
acaccgagucaacuccacagu

SEQ ID NO: 245344 - RNA, 20 nt, Human
acagagugacacugcugggu

SEQ ID NO: 245345 - RNA, 23 nt, Human
acagggcugccaggaggaauucu

SEQ ID NO: 245346 - RNA, 19 nt, Human
acauccccagaaaccgccc

SEQ ID NO: 245347 - RNA, 19 nt, Human
accaaugggugacacacac

SEQ ID NO: 245348 - RNA, 21 nt, Human
accacaguaacuacagaguga

SEQ ID NO: 245349 - RNA, 19 nt, Human
acccugggacauccccaga

SEQ ID NO: 245350 - RNA, 19 nt, Human
accgcacugggacagaaca

SEQ ID NO: 245351 - RNA, 28 nt, Human
accuugaggaacauaauauucuagaaag

SEQ ID NO: 245352 - RNA, 22 nt, Human
acuaccagaaaccgccccucca

SEQ ID NO: 245353 - RNA, 21 nt, Human
agagccaauuggggaagaauc

SEQ ID NO: 245354 - RNA, 19 nt, Human
agaugccagugacuagagc

SEQ ID NO: 245355 - RNA, 21 nt, Human
agaugccagugacuagagcca

SEQ ID NO: 245356 - RNA, 24 nt, Human
agccacaacuaccagaaaccgccc

SEQ ID NO: 245357 - RNA, 26 nt, Human
aggaaccacugcaucuuucaaacccu

SEQ ID NO: 245358 - RNA, 18 nt, Human
aggauucaggagagggag

SEQ ID NO: 245359 - RNA, 23 nt, Human
aggcaccgcacugggacagaaca

SEQ ID NO: 245360 - RNA, 27 nt, Human
aguggcaggaacaaauacuuaaagaga

SEQ ID NO: 245361 - RNA, 24 nt, Human
caagacgggcuggagacaggacca

SEQ ID NO: 245362 - RNA, 19 nt, Human
cacaacuaccagaaaccgc

SEQ ID NO: 245363 - RNA, 23 nt, Human
cacagcucagcacugcaaccuuu

SEQ ID NO: 245364 - RNA, 25 nt, Human
cacaguaacuacagagugacacugc

SEQ ID NO: 245365 - RNA, 18 nt, Human
cacaguacacaguggcag

SEQ ID NO: 245366 - RNA, 19 nt, Human
cacuguauuaaacuccagg

SEQ ID NO: 245367 - RNA, 24 nt, Human
cagaaaccgcccacagcucagcac

SEQ ID NO: 245368 - RNA, 25 nt, Human
cagaaaccgcccacagcucagcacu

SEQ ID NO: 245369 - RNA, 25 nt, Human
cagcagggcaucauguagaaaagga

SEQ ID NO: 245370 - RNA, 24 nt, Human
cagcucuugucgccccucccgcag

SEQ ID NO: 245371 - RNA, 19 nt, Human
caggcugcaacaucagcca

SEQ ID NO: 245372 - RNA, 22 nt, Human
cauaaaagccacaacuaccaga

SEQ ID NO: 245373 - RNA, 23 nt, Human
cauugcugucaaaaaucaaacaa

SEQ ID NO: 245374 - RNA, 22 nt, Human
cccuccaaacggcucaaaggag

SEQ ID NO: 245375 - RNA, 21 nt, Human
ccgccgccgccuccgccgcgc

SEQ ID NO: 245376 - RNA, 22 nt, Human
ccgccgccgccuccgccgcgcu

SEQ ID NO: 245377 - RNA, 19 nt, Human
ccgccgccuccgccgcgcu

SEQ ID NO: 245378 - RNA, 21 nt, Human
ccgccgccuccgccgcgcuga

SEQ ID NO: 245379 - RNA, 22 nt, Human
ccgcucagcucuugucgccccu

SEQ ID NO: 245380 - RNA, 18 nt, Human
cgcacugggacagaacac

SEQ ID NO: 245381 - RNA, 18 nt, Human
cgccccucccgcagggac

SEQ ID NO: 245382 - RNA, 23 nt, Human
cgccgccgccggugcagccgccg

SEQ ID NO: 245383 - RNA, 24 nt, Human
cgcugaccgggaggaggaaggaag

SEQ ID NO: 245384 - RNA, 19 nt, Human
cgggagagcugaagagccg

SEQ ID NO: 245385 - RNA, 22 nt, Human
cgggccggcgggcgggcggagg

SEQ ID NO: 245386 - RNA, 20 nt, Human
cgugguugaaaagacggagc

SEQ ID NO: 245387 - RNA, 19 nt, Human
cuccacaguacacaguggc

SEQ ID NO: 245388 - RNA, 20 nt, Human
gaaaaaaggacagcugagaa

SEQ ID NO: 245389 - RNA, 27 nt, Human
gaaguacauacugccgcaggucaccaa

SEQ ID NO: 245390 - RNA, 23 nt, Human
gagacaggaccaggggucaagaa

SEQ ID NO: 245391 - RNA, 23 nt, Human
gauaagccaagacgggcuggaga

SEQ ID NO: 245392 - RNA, 20 nt, Human
gcaccgcacugggacagaac

SEQ ID NO: 245393 - RNA, 23 nt, Human
gcccacagcucagcacugcaacc

SEQ ID NO: 245394 - RNA, 18 nt, Human
gcugccgggccgccgccg

SEQ ID NO: 245395 - RNA, 20 nt, Human
ggaagucaagaggaggcacc

SEQ ID NO: 245396 - RNA, 18 nt, Human
ggagagggaggaaccacu

SEQ ID NO: 245397 - RNA, 18 nt, Human
ggagagggaggaaccacu

SEQ ID NO: 245398 - RNA, 19 nt, Human
ggcgggcggagggaggggc

SEQ ID NO: 245399 - RNA, 18 nt, Human
gggcgggccggcgggcgg

SEQ ID NO: 245400 - RNA, 20 nt, Human
gggcgggcggagggaggggc

SEQ ID NO: 245401 - RNA, 20 nt, Human
gucaacuccacaguacacag

SEQ ID NO: 245402 - RNA, 18 nt, Human
guccaguccucugagccc

SEQ ID NO: 245403 - RNA, 21 nt, Human
gugcagccgccgacgcugacc

SEQ ID NO: 245404 - RNA, 19 nt, Human
gugcggcugcauggucagc

SEQ ID NO: 245405 - RNA, 22 nt, Human
gugcuccccaaggauuccggag

SEQ ID NO: 245406 - RNA, 22 nt, Human
uaaagugagaugccagugacuu

SEQ ID NO: 245407 - RNA, 20 nt, Human
uacaaacauuaaguacugca

SEQ ID NO: 245408 - RNA, 19 nt, Human
uacugccgcaggucaccaa

SEQ ID NO: 245409 - RNA, 31 nt, Human
uagcacauaccuuauauauguuagugacuag

SEQ ID NO: 245410 - RNA, 20 nt, Human
ucaaaaaucaaacaagaaaa

SEQ ID NO: 245411 - RNA, 22 nt, Human
ucaagaacugggaagaagaaca

SEQ ID NO: 245412 - RNA, 20 nt, Human
ucagcucuugucgccccucc

SEQ ID NO: 245413 - RNA, 21 nt, Human
uccacaagcuccugcucuggg

SEQ ID NO: 245414 - RNA, 23 nt, Human
uccacccugggacauccccagaa

SEQ ID NO: 245415 - RNA, 19 nt, Human
ucgccccucccgcagggac

SEQ ID NO: 245416 - RNA, 19 nt, Human
ucugacagucugacucagc

SEQ ID NO: 245417 - RNA, 24 nt, Human
ugaaagcauaaaagccacaacuac

SEQ ID NO: 245418 - RNA, 21 nt, Human
ugaauuacaaaugcauuucug

SEQ ID NO: 245419 - RNA, 19 nt, Human
ugaccacaguaacuacaga

SEQ ID NO: 245420 - RNA, 23 nt, Human
ugacgggcgggccggcgggcggg

SEQ ID NO: 245421 - RNA, 21 nt, Human
ugacugcauuuucuaaaagcu

SEQ ID NO: 245422 - RNA, 22 nt, Human
ugagaugccagugacuagagcc

SEQ ID NO: 245423 - RNA, 20 nt, Human
ugcaguacuuccuuuuuauu

SEQ ID NO: 245424 - RNA, 21 nt, Human
uggaacacaacucagagguaa

SEQ ID NO: 245425 - RNA, 21 nt, Human
uggggaaacaguuaugguccc

SEQ ID NO: 245426 - RNA, 22 nt, Human
uggggaagaaucucucucuggu

SEQ ID NO: 245427 - RNA, 21 nt, Human
uguacuucucucaccaaaugu

SEQ ID NO: 245428 - RNA, 25 nt, Human
ugucaaaaaucaaacaagaaaaaag

SEQ ID NO: 245429 - RNA, 18 nt, Human
ugucgccccucccgcagg

SEQ ID NO: 245430 - RNA, 21 nt, Human
uuaaguacugcacauaacgcu

SEQ ID NO: 245431 - RNA, 18 nt, Human
uucauauuagcaggcagu

SEQ ID NO: 245432 - RNA, 25 nt, Human
uuccaauaaggagcuugggguaccc

SEQ ID NO: 245433 - RNA, 19 nt, Human
uucgugguugaaaagacgg

SEQ ID NO: 245434 - RNA, 24 nt, Human
uuggcugccgggccgccgccgccu

SEQ ID NO: 245435 - RNA, 19 nt, Human
uugucgccccucccgcagg

SEQ ID NO: 245436 - RNA, 20 nt, Human
uuucaaaccagaaagcaauu

SEQ ID NO: 245437 - RNA, 18 nt, Human
uuuuuuuuuuuuuuuuug

SEQ ID NO: 245438 - RNA, 24 nt, Human
aacucuugccuacuugauuaagga

SEQ ID NO: 245439 - RNA, 22 nt, Human
aagaaaaagaucuugccaagaa

SEQ ID NO: 245440 - RNA, 25 nt, Human
aagaagaccaaagcaagagcaacua

SEQ ID NO: 245441 - RNA, 25 nt, Human
aagaagaccaaagcaagagcaacua

SEQ ID NO: 245442 - RNA, 19 nt, Human
aagaaggagaaacaggaga

SEQ ID NO: 245443 - RNA, 23 nt, Human
aagggaagaaggagaaacaggag

SEQ ID NO: 245444 - RNA, 21 nt, Human
acagaacccuggggaagaagc

SEQ ID NO: 245445 - RNA, 21 nt, Human
acagaacccuggggaagaagc

SEQ ID NO: 245446 - RNA, 20 nt, Human
acaucaucuccugaagaacg

SEQ ID NO: 245447 - RNA, 20 nt, Human
acaucaucuccugaagaacg

SEQ ID NO: 245448 - RNA, 21 nt, Human
acuggcaauauauuacagaug

SEQ ID NO: 245449 - RNA, 21 nt, Human
acuggcaauauauuacagaug

SEQ ID NO: 245450 - RNA, 24 nt, Human
agaaacaggagaaggggggaagga

SEQ ID NO: 245451 - RNA, 22 nt, Human
agaagaaaaagaucuugccaag

SEQ ID NO: 245452 - RNA, 18 nt, Human
agaaggggggaaggagua

SEQ ID NO: 245453 - RNA, 24 nt, Human
agaaggggggaaggaguagaagag

SEQ ID NO: 245454 - RNA, 23 nt, Human
agcuuguaugguuucucaucuau

SEQ ID NO: 245455 - RNA, 25 nt, Human
aggagaaacaggagaaggggggaag

SEQ ID NO: 245456 - RNA, 18 nt, Human
aggagaaggggggaagga

SEQ ID NO: 245457 - RNA, 23 nt, Human
aguagugcuguaugaauacagac

SEQ ID NO: 245458 - RNA, 19 nt, Human
auggaccaugugguacccc

SEQ ID NO: 245459 - RNA, 19 nt, Human
auggaccaugugguacccc

SEQ ID NO: 245460 - RNA, 20 nt, Human
caaauuuggaagcuacaucu

SEQ ID NO: 245461 - RNA, 20 nt, Human
caaauuuggaagcuacaucu

SEQ ID NO: 245462 - RNA, 23 nt, Human
caagagcaacucagaauuaagaa

SEQ ID NO: 245463 - RNA, 20 nt, Human
cacuguagagauccaagagc

SEQ ID NO: 245464 - RNA, 23 nt, Human
cagaacccuggggaagaagcagg

SEQ ID NO: 245465 - RNA, 23 nt, Human
cagaacccuggggaagaagcagg

SEQ ID NO: 245466 - RNA, 22 nt, Human
cagaauuaagaacaaaagauuc

SEQ ID NO: 245467 - RNA, 18 nt, Human
cagccauuaaaauuacac

SEQ ID NO: 245468 - RNA, 19 nt, Human
cagggguccugccgaggcu

SEQ ID NO: 245469 - RNA, 21 nt, Human
caugaaauggaccauguggua

SEQ ID NO: 245470 - RNA, 20 nt, Human
cauuuguguguguguguguu

SEQ ID NO: 245471 - RNA, 18 nt, Human
ccccauauauucccccuu

SEQ ID NO: 245472 - RNA, 18 nt, Human
ccccauauauucccccuu

SEQ ID NO: 245473 - RNA, 21 nt, Human
cucagaauuaagaacaaaaga

SEQ ID NO: 245474 - RNA, 24 nt, Human
cugcauuugugugugugugugugg

SEQ ID NO: 245475 - RNA, 24 nt, Human
cugcauuugugugugugugugugg

SEQ ID NO: 245476 - RNA, 19 nt, Human
gaagaaggagaaacaggag

SEQ ID NO: 245477 - RNA, 25 nt, Human
gaugaagaagaguuggaggaaggga

SEQ ID NO: 245478 - RNA, 21 nt, Human
gcggaucuguaucuacaucca

SEQ ID NO: 245479 - RNA, 21 nt, Human
gcggaucuguaucuacaucca

SEQ ID NO: 245480 - RNA, 19 nt, Human
gcugcaauacagaacccug

SEQ ID NO: 245481 - RNA, 19 nt, Human
gcugcaauacagaacccug

SEQ ID NO: 245482 - RNA, 18 nt, Human
gcuggauggggccacugc

SEQ ID NO: 245483 - RNA, 19 nt, Human
ggaagggaagaaggagaaa

SEQ ID NO: 245484 - RNA, 22 nt, Human
gggaagaaggagaaacaggaga

SEQ ID NO: 245485 - RNA, 18 nt, Human
gggaaggaguagaagagg

SEQ ID NO: 245486 - RNA, 19 nt, Human
gggaaggaguagaagaggg

SEQ ID NO: 245487 - RNA, 21 nt, Human
gggcaaaggagaagaaaaaga

SEQ ID NO: 245488 - RNA, 21 nt, Human
gggcaaaggagaagaaaaaga

SEQ ID NO: 245489 - RNA, 21 nt, Human
guaaagaaaaugcuauuucgg

SEQ ID NO: 245490 - RNA, 23 nt, Human
gugugugugucugcgugugugug

SEQ ID NO: 245491 - RNA, 21 nt, Human
gugugugugugugucugcgug

SEQ ID NO: 245492 - RNA, 21 nt, Human
uaaguagugcuguaugaauac

SEQ ID NO: 245493 - RNA, 21 nt, Human
uaaguagugcuguaugaauac

SEQ ID NO: 245494 - RNA, 18 nt, Human
uacacuuuauggaaaagg

SEQ ID NO: 245495 - RNA, 18 nt, Human
uacacuuuauggaaaagg

SEQ ID NO: 245496 - RNA, 21 nt, Human
uagcugcaauacagaacccug

SEQ ID NO: 245497 - RNA, 21 nt, Human
uagcugcaauacagaacccug

SEQ ID NO: 245498 - RNA, 21 nt, Human
uagugcuguaugaauacagac

SEQ ID NO: 245499 - RNA, 18 nt, Human
uauauucccccuuuacau

SEQ ID NO: 245500 - RNA, 18 nt, Human
uauauucccccuuuacau

SEQ ID NO: 245501 - RNA, 19 nt, Human
uauggaaaaggcuucucua

SEQ ID NO: 245502 - RNA, 19 nt, Human
uauggaaaaggcuucucua

SEQ ID NO: 245503 - RNA, 19 nt, Human
ucagaugccagggucuggu

SEQ ID NO: 245504 - RNA, 24 nt, Human
ucuacauccaucugacuaggccaa

SEQ ID NO: 245505 - RNA, 24 nt, Human
ucuacauccaucugacuaggccaa

SEQ ID NO: 245506 - RNA, 24 nt, Human
ucugagagagcucacuccccccau

SEQ ID NO: 245507 - RNA, 24 nt, Human
ucugagagagcucacuccccccau

SEQ ID NO: 245508 - RNA, 19 nt, Human
ugaaauggaccauguggua

SEQ ID NO: 245509 - RNA, 19 nt, Human
ugaaauggaccauguggua

SEQ ID NO: 245510 - RNA, 23 nt, Human
ugaaauggaccaugugguacccc

SEQ ID NO: 245511 - RNA, 23 nt, Human
ugaaauggaccaugugguacccc

SEQ ID NO: 245512 - RNA, 21 nt, Human
ugacagacgaggauggaggga

SEQ ID NO: 245513 - RNA, 21 nt, Human
ugcauuugugugugugugugu

SEQ ID NO: 245514 - RNA, 21 nt, Human
ugcauuugugugugugugugu

SEQ ID NO: 245515 - RNA, 21 nt, Human
ugccaagaauauagcauauaa

SEQ ID NO: 245516 - RNA, 19 nt, Human
ugcuggauggggccacugc

SEQ ID NO: 245517 - RNA, 24 nt, Human
ugcuggauggggccacugcacacc

SEQ ID NO: 245518 - RNA, 24 nt, Human
ugcuggauggggccacugcacacc

SEQ ID NO: 245519 - RNA, 18 nt, Human
uggaagcuacaucuucaa

SEQ ID NO: 245520 - RNA, 18 nt, Human
uggaagcuacaucuucaa

SEQ ID NO: 245521 - RNA, 21 nt, Human
uggaggaagggaagaaggaga

SEQ ID NO: 245522 - RNA, 18 nt, Human
uguaugaauacagacaca

SEQ ID NO: 245523 - RNA, 18 nt, Human
uguaugaauacagacaca

SEQ ID NO: 245524 - RNA, 22 nt, Human
uguaugaauacagacacaugcg

SEQ ID NO: 245525 - RNA, 22 nt, Human
uguaugaauacagacacaugcg

SEQ ID NO: 245526 - RNA, 19 nt, Human
ugucugcauuugugugugu

SEQ ID NO: 245527 - RNA, 19 nt, Human
ugucugcauuugugugugu

SEQ ID NO: 245528 - RNA, 20 nt, Human
ugugucugauuugcuuucug

SEQ ID NO: 245529 - RNA, 20 nt, Human
ugugucugauuugcuuucug

SEQ ID NO: 245530 - RNA, 21 nt, Human
ugugugucugcgugugugugu

SEQ ID NO: 245531 - RNA, 21 nt, Human
ugugugucugcgugugugugu

SEQ ID NO: 245532 - RNA, 22 nt, Human
ugugugugucugcgugugugug

SEQ ID NO: 245533 - RNA, 22 nt, Human
ugugugugugugucugcgugug

SEQ ID NO: 245534 - RNA, 22 nt, Human
ugugugugugugucugcgugug

SEQ ID NO: 245535 - RNA, 21 nt, Human
ugugugugugugugugucugc

SEQ ID NO: 245536 - RNA, 21 nt, Human
ugugugugugugugugucugc

SEQ ID NO: 245537 - RNA, 24 nt, Human
ugugugugugugugugucugcgug

SEQ ID NO: 245538 - RNA, 18 nt, Human
uuagauacugucuacucu

SEQ ID NO: 245539 - RNA, 22 nt, Human
uucaaauuuggaagcuacaucu

SEQ ID NO: 245540 - RNA, 22 nt, Human
uucaaauuuggaagcuacaucu

SEQ ID NO: 245541 - RNA, 21 nt, Human
uucccccuuuacauguuuucu

SEQ ID NO: 245542 - RNA, 21 nt, Human
uucccccuuuacauguuuucu

SEQ ID NO: 245543 - RNA, 24 nt, Human
uucucuaauugugucugauuugcu

SEQ ID NO: 245544 - RNA, 24 nt, Human
uucucuaauugugucugauuugcu

SEQ ID NO: 245545 - RNA, 21 nt, Human
uugugugucugcauuugugug

SEQ ID NO: 245546 - RNA, 21 nt, Human
uugugugucugcauuugugug

SEQ ID NO: 245547 - RNA, 31 nt, Human
uugugugucugcauuuguguguguguguguu

SEQ ID NO: 245548 - RNA, 20 nt, Human
uuugcagccauuaaaauuac

SEQ ID NO: 245549 - RNA, 20 nt, Human
uuugcagccauuaaaauuac

SEQ ID NO: 245550 - RNA, 20 nt, Human
accccggcccgaccccgacc

SEQ ID NO: 245551 - RNA, 21 nt, Human
aggugaaggugguccucacug

SEQ ID NO: 245552 - RNA, 20 nt, Human
cccccacgaccggggacggg

SEQ ID NO: 245553 - RNA, 28 nt, Human
cccgaccccgacccaggcugcgcacggc

SEQ ID NO: 245554 - RNA, 21 nt, Human
cccgcagagccugcgggcggc

SEQ ID NO: 245555 - RNA, 23 nt, Human
cccggcccgaccccgacccaggc

SEQ ID NO: 245556 - RNA, 25 nt, Human
ccgcucguccgcucgcccgcccgcc

SEQ ID NO: 245557 - RNA, 23 nt, Human
cgacccaggcugcgcacggcccc

SEQ ID NO: 245558 - RNA, 23 nt, Human
cgcccucgcccgcccuccggccc

SEQ ID NO: 245559 - RNA, 18 nt, Human
cggccccucccccgcccg

SEQ ID NO: 245560 - RNA, 20 nt, Human
cggccccucccccgcccggg

SEQ ID NO: 245561 - RNA, 20 nt, Human
cggccccuccggaaacccga

SEQ ID NO: 245562 - RNA, 23 nt, Human
cggcccuucccucagggaugucc

SEQ ID NO: 245563 - RNA, 24 nt, Human
cucacugccaccccggaagguuuc

SEQ ID NO: 245564 - RNA, 20 nt, Human
cugcgcacggccccuccccc

SEQ ID NO: 245565 - RNA, 18 nt, Human
gacccaggcugcgcacgg

SEQ ID NO: 245566 - RNA, 23 nt, Human
gaccccggcccgaccccgaccca

SEQ ID NO: 245567 - RNA, 19 nt, Human
gcccgcccuccggccccuc

SEQ ID NO: 245568 - RNA, 18 nt, Human
gcccggggaccaaccggc

SEQ ID NO: 245569 - RNA, 20 nt, Human
gccgaccccggcccgacccc

SEQ ID NO: 245570 - RNA, 19 nt, Human
gggacggggcucccucggc

SEQ ID NO: 245571 - RNA, 19 nt, Human
gggcggugcccccacgacc

SEQ ID NO: 245572 - RNA, 19 nt, Human
ucacugccaccccggagcc

SEQ ID NO: 245573 - RNA, 22 nt, Human
ucccaggugccgaccccggccc

SEQ ID NO: 245574 - RNA, 18 nt, Human
ucccgcucccggcccuuc

SEQ ID NO: 245575 - RNA, 20 nt, Human
ucggcgcgcgccucgggccg

SEQ ID NO: 245576 - RNA, 19 nt, Human
aaaaaugcuauacauccac

SEQ ID NO: 245577 - RNA, 20 nt, Human
aaaagcaugaccgggauugg

SEQ ID NO: 245578 - RNA, 20 nt, Human
aaaagcaugaccgggauugg

SEQ ID NO: 245579 - RNA, 22 nt, Human
aaaccugccugacaccagggcc

SEQ ID NO: 245580 - RNA, 22 nt, Human
aaaccugccugacaccagggcc

SEQ ID NO: 245581 - RNA, 21 nt, Human
aaacgacacuucuccaccccu

SEQ ID NO: 245582 - RNA, 21 nt, Human
aaacgacacuucuccaccccu

SEQ ID NO: 245583 - RNA, 18 nt, Human
aaaucucugcaacaagag

SEQ ID NO: 245584 - RNA, 18 nt, Human
aaaucucugcaacaagag

SEQ ID NO: 245585 - RNA, 19 nt, Human
aacacauccucacucugcu

SEQ ID NO: 245586 - RNA, 19 nt, Human
aacacauccucacucugcu

SEQ ID NO: 245587 - RNA, 22 nt, Human
aaccaaacauggcugauaaaau

SEQ ID NO: 245588 - RNA, 22 nt, Human
aaccaaacauggcugauaaaau

SEQ ID NO: 245589 - RNA, 20 nt, Human
aaccagaagguaugggccuu

SEQ ID NO: 245590 - RNA, 20 nt, Human
aaccagaagguaugggccuu

SEQ ID NO: 245591 - RNA, 21 nt, Human
aagagcuccagcuuagagucc

SEQ ID NO: 245592 - RNA, 21 nt, Human
aagagcuccagcuuagagucc

SEQ ID NO: 245593 - RNA, 18 nt, Human
aagcaaguuaaucacagg

SEQ ID NO: 245594 - RNA, 18 nt, Human
aagcaaguuaaucacagg

SEQ ID NO: 245595 - RNA, 22 nt, Human
aagcagcuguccaacagcccuc

SEQ ID NO: 245596 - RNA, 22 nt, Human
aagcagcuguccaacagcccuc

SEQ ID NO: 245597 - RNA, 21 nt, Human
aagcagcugugcaugcucaaa

SEQ ID NO: 245598 - RNA, 21 nt, Human
aagcagcugugcaugcucaaa

SEQ ID NO: 245599 - RNA, 19 nt, Human
aagcugccaagaagacccu

SEQ ID NO: 245600 - RNA, 19 nt, Human
aagcugccaagaagacccu

SEQ ID NO: 245601 - RNA, 20 nt, Human
aaguucaugaauacaaauaa

SEQ ID NO: 245602 - RNA, 20 nt, Human
aaguucaugaauacaaauaa

SEQ ID NO: 245603 - RNA, 20 nt, Human
aauagcacuaggggcugaag

SEQ ID NO: 245604 - RNA, 20 nt, Human
aauagcacuaggggcugaag

SEQ ID NO: 245605 - RNA, 25 nt, Human
aaucacacgagcauuuacaaccaaa

SEQ ID NO: 245606 - RNA, 25 nt, Human
aaucacacgagcauuuacaaccaaa

SEQ ID NO: 245607 - RNA, 24 nt, Human
acaaagacagacacacacaugcac

SEQ ID NO: 245608 - RNA, 24 nt, Human
acaaagacagacacacacaugcac

SEQ ID NO: 245609 - RNA, 19 nt, Human
acacacacaugcacacaca

SEQ ID NO: 245610 - RNA, 33 nt, Human
acacacacaugcacacacacuaacacgcacggu

SEQ ID NO: 245611 - RNA, 33 nt, Human
acacacuaacacgcacgcacacgcacgcacagu

SEQ ID NO: 245612 - RNA, 33 nt, Human; identical to SEQ ID NO: 245611

SEQ ID NO: 245613 - RNA, 33 nt, Human
acacaugcacacacacuaacacgcacgcacagu

SEQ ID NO: 245614 - RNA, 27 nt, Human
acaugcacacacacuaacacgcacggu

SEQ ID NO: 245615 - RNA, 27 nt, Human
acaugcacacacacuaacacgcacggu

SEQ ID NO: 245616 - RNA, 19 nt, Human
acgacacuucuccaccccu

SEQ ID NO: 245617 - RNA, 21 nt, Human
acgacacuucuccaccccuga

SEQ ID NO: 245618 - RNA, 21 nt, Human
acgacacuucuccaccccuga

SEQ ID NO: 245619 - RNA, 22 nt, Human
agaagccaaaguggcaaaagca

SEQ ID NO: 245620 - RNA, 22 nt, Human
agaagccaaaguggcaaaagca

SEQ ID NO: 245621 - RNA, 23 nt, Human
agagagcaggacaagcagcugug

SEQ ID NO: 245622 - RNA, 23 nt, Human
agagagcaggacaagcagcugug

SEQ ID NO: 245623 - RNA, 19 nt, Human
agagcucuuccaagagcuc

SEQ ID NO: 245624 - RNA, 19 nt, Human
agagcucuuccaagagcuc

SEQ ID NO: 245625 - RNA, 24 nt, Human
agccaaaguggcaaaagcaugacc

SEQ ID NO: 245626 - RNA, 24 nt, Human
agccaaaguggcaaaagcaugacc

SEQ ID NO: 245627 - RNA, 18 nt, Human
aggacaagcagcugugca

SEQ ID NO: 245628 - RNA, 18 nt, Human
aggacaagcagcugugca

SEQ ID NO: 245629 - RNA, 20 nt, Human
agggaaucgccaucagucug

SEQ ID NO: 245630 - RNA, 19 nt, Human
auaaaaaugcuauacaucc

SEQ ID NO: 245631 - RNA, 19 nt, Human
auaaaaaugcuauacaucc

SEQ ID NO: 245632 - RNA, 24 nt, Human
auagcaagacgugcaaaacacauc

SEQ ID NO: 245633 - RNA, 24 nt, Human
auagcaagacgugcaaaacacauc

SEQ ID NO: 245634 - RNA, 29 nt, Human
augcacacacacuaacacgcacgcacacg

SEQ ID NO: 245635 - RNA, 29 nt, Human
augcacacacacuaacacgcacgcacacg

SEQ ID NO: 245636 - RNA, 29 nt, Human
augcacacacacuaacacgcacgcacagu

SEQ ID NO: 245637 - RNA, 29 nt, Human
augcacacacacuaacacgcacgcacagu

SEQ ID NO: 245638 - RNA, 22 nt, Human
auucugucacacagccaacacu

SEQ ID NO: 245639 - RNA, 22 nt, Human
auucugucacacagccaacacu

SEQ ID NO: 245640 - RNA, 22 nt, Human
auuuauuucuccccaaaccaag

SEQ ID NO: 245641 - RNA, 22 nt, Human
auuuauuucuccccaaaccaag

SEQ ID NO: 245642 - RNA, 18 nt, Human
auuugcccuuucucccca

SEQ ID NO: 245643 - RNA, 18 nt, Human
auuugcccuuucucccca

SEQ ID NO: 245644 - RNA, 24 nt, Human
caaaaggagaaacucuucuucaaa

SEQ ID NO: 245645 - RNA, 21 nt, Human
caaaaugccugaaauucagca

SEQ ID NO: 245646 - RNA, 21 nt, Human
caaaaugccugaaauucagca

SEQ ID NO: 245647 - RNA, 23 nt, Human
caaauaaaauagcaauuucccuc

SEQ ID NO: 245648 - RNA, 23 nt, Human
caaauaaaauagcaauuucccuc

SEQ ID NO: 245649 - RNA, 19 nt, Human
caacucucagaaagaagag

SEQ ID NO: 245650 - RNA, 19 nt, Human
caacucucagaaagaagag

SEQ ID NO: 245651 - RNA, 19 nt, Human
caagccccgcuaagggcag

SEQ ID NO: 245652 - RNA, 24 nt, Human
caagguggggucacaggagaagcc

SEQ ID NO: 245653 - RNA, 24 nt, Human
caagguggggucacaggagaagcc

SEQ ID NO: 245654 - RNA, 18 nt, Human
cacaaacauauuuacagu

SEQ ID NO: 245655 - RNA, 21 nt, Human
cacaaacauauuuacaguuuc

SEQ ID NO: 245656 - RNA, 21 nt, Human
cacaaacauauuuacaguuuc

SEQ ID NO: 245657 - RNA, 18 nt, Human
cacacacaugcacacaca

SEQ ID NO: 245658 - RNA, 18 nt, Human
cacacacaugcacacaca

SEQ ID NO: 245659 - RNA, 25 nt, Human
caccagggccuccugaagagagcag

SEQ ID NO: 245660 - RNA, 25 nt, Human
caccagggccuccugaagagagcag

SEQ ID NO: 245661 - RNA, 19 nt, Human
cacccugucccucuggagu

SEQ ID NO: 245662 - RNA, 23 nt, Human
cagaacagaaaccaggugcucag

SEQ ID NO: 245663 - RNA, 22 nt, Human
cagcugcagucuuuuaacuauc

SEQ ID NO: 245664 - RNA, 18 nt, Human
caggggguccacccuguc

SEQ ID NO: 245665 - RNA, 18 nt, Human
caggggguccacccuguc

SEQ ID NO: 245666 - RNA, 19 nt, Human
caugacaucaagaaccugc

SEQ ID NO: 245667 - RNA, 19 nt, Human
caugacaucaagaaccugc

SEQ ID NO: 245668 - RNA, 25 nt, Human
caugugcucacaugcacacaugacc

SEQ ID NO: 245669 - RNA, 25 nt, Human
caugugcucacaugcacacaugacc

SEQ ID NO: 245670 - RNA, 22 nt, Human
cccacaagcagcuguccaacag

SEQ ID NO: 245671 - RNA, 22 nt, Human
cccacaagcagcuguccaacag

SEQ ID NO: 245672 - RNA, 18 nt, Human
cccaccgucaaggugggg

SEQ ID NO: 245673 - RNA, 19 nt, Human
cccaccgucaagguggggu

SEQ ID NO: 245674 - RNA, 18 nt, Human
cccccuuccaccauggag

SEQ ID NO: 245675 - RNA, 18 nt, Human
cccccuuccaccauggag

SEQ ID NO: 245676 - RNA, 27 nt, Human
ccccgccugcacccgcacccucucccc

SEQ ID NO: 245677 - RNA, 19 nt, Human
ccccugcgacuggggcaag

SEQ ID NO: 245678 - RNA, 20 nt, Human
cccgcacccucuccccggcc

SEQ ID NO: 245679 - RNA, 21 nt, Human
cccgcacccucuccccggccc

SEQ ID NO: 245680 - RNA, 26 nt, Human
cccgcgcgcgcggcugcugucagccg

SEQ ID NO: 245681 - RNA, 28 nt, Human
cccgcgcgcgcggcugcugucagccgca

SEQ ID NO: 245682 - RNA, 22 nt, Human
cccugcgacuggggcaagcccc

SEQ ID NO: 245683 - RNA, 20 nt, Human
ccgcacccucuccccggccc

SEQ ID NO: 245684 - RNA, 24 nt, Human
ccgggcccacaagcagcuguccaa

SEQ ID NO: 245685 - RNA, 24 nt, Human
ccgggcccacaagcagcuguccaa

SEQ ID NO: 245686 - RNA, 18 nt, Human
ccuaaaaggacagcagcu

SEQ ID NO: 245687 - RNA, 18 nt, Human
ccuaaaaggacagcagcu

SEQ ID NO: 245688 - RNA, 18 nt, Human
ccucccacaaagacagac

SEQ ID NO: 245689 - RNA, 24 nt, Human
ccucccacaaagacagacacacca

SEQ ID NO: 245690 - RNA, 24 nt, Human
ccucccacaaagacagacacacca

SEQ ID NO: 245691 - RNA, 19 nt, Human
ccuccuuccuucuugcucc

SEQ ID NO: 245692 - RNA, 19 nt, Human
ccuccuuccuucuugcucc

SEQ ID NO: 245693 - RNA, 19 nt, Human
ccucucgacuugcccggcu

SEQ ID NO: 245694 - RNA, 19 nt, Human
ccucucgacuugcccggcu

SEQ ID NO: 245695 - RNA, 21 nt, Human
ccugcacccgcacccucuccc

SEQ ID NO: 245696 - RNA, 31 nt, Human
ccugcgacuggggcaagccccgcuaagggcc

SEQ ID NO: 245697 - RNA, 26 nt, Human
ccugcgacuggggcaagccggggucc

SEQ ID NO: 245698 - RNA, 22 nt, Human
ccuuccccucacagugaagugg

SEQ ID NO: 245699 - RNA, 22 nt, Human
ccuuccccucacagugaagugg

SEQ ID NO: 245700 - RNA, 26 nt, Human
cgacuugcccggcucagaacuucagc

SEQ ID NO: 245701 - RNA, 26 nt, Human
cgacuugcccggcucagaacuucagc

SEQ ID NO: 245702 - RNA, 18 nt, Human
cgcacauauacgcaugug

SEQ ID NO: 245703 - RNA, 18 nt, Human
cgcacauauacgcaugug

SEQ ID NO: 245704 - RNA, 21 nt, Human
cgccugcacccgcacccucuc

SEQ ID NO: 245705 - RNA, 19 nt, Human
cgcgaccccgcagacuccc

SEQ ID NO: 245706 - RNA, 19 nt, Human
cggcucagaacuucagcag

SEQ ID NO: 245707 - RNA, 19 nt, Human
cggcucagaacuucagcag

SEQ ID NO: 245708 - RNA, 23 nt, Human
cgucgcaguacucccguuccagc

SEQ ID NO: 245709 - RNA, 21 nt, Human
cguuccagcugcugcgcccgc

SEQ ID NO: 245710 - RNA, 25 nt, Human
cuacaaggccgacuccgggcugcgu

SEQ ID NO: 245711 - RNA, 18 nt, Human
cuacgccccaccgucaag

SEQ ID NO: 245712 - RNA, 18 nt, Human
cuacgccccaccgucaag

SEQ ID NO: 245713 - RNA, 19 nt, Human
cuagugcacagaagccagu

SEQ ID NO: 245714 - RNA, 19 nt, Human
cuagugcacagaagccagu

SEQ ID NO: 245715 - RNA, 24 nt, Human
cucacaugcacacaugaccgccua

SEQ ID NO: 245716 - RNA, 24 nt, Human
cucacaugcacacaugaccgccua

SEQ ID NO: 245717 - RNA, 20 nt, Human
cuccccggcccuugcugccc

SEQ ID NO: 245718 - RNA, 24 nt, Human
cugaaguaucaauuguguucaaca

SEQ ID NO: 245719 - RNA, 24 nt, Human
cugaaguaucaauuguguucaaca

SEQ ID NO: 245720 - RNA, 18 nt, Human
cugcaccuucgccccuac

SEQ ID NO: 245721 - RNA, 21 nt, Human
cugccugacaccagggccucc

SEQ ID NO: 245722 - RNA, 21 nt, Human
cugccugacaccagggccucc

SEQ ID NO: 245723 - RNA, 20 nt, Human
cugcgcccgcuaaggcucca

SEQ ID NO: 245724 - RNA, 21 nt, Human
cuguaggaaaucacacgagca

SEQ ID NO: 245725 - RNA, 21 nt, Human
cuguaggaaaucacacgagca

SEQ ID NO: 245726 - RNA, 22 nt, Human
cuuuuuggcuguacguaucacu

SEQ ID NO: 245727 - RNA, 21 nt, Human
gaaaacagauggcaugaauaa

SEQ ID NO: 245728 - RNA, 21 nt, Human
gaaaacagauggcaugaauaa

SEQ ID NO: 245729 - RNA, 20 nt, Human
gacgcacauauacgcaugug

SEQ ID NO: 245730 - RNA, 19 nt, Human
gagaaagacagcaaaagga

SEQ ID NO: 245731 - RNA, 19 nt, Human
gagaaagacagcaaaagga

SEQ ID NO: 245732 - RNA, 23 nt, Human
gagaaagacagcaaaaggaggaa

SEQ ID NO: 245733 - RNA, 19 nt, Human
gagaaauggcaacaccugg

SEQ ID NO: 245734 - RNA, 19 nt, Human
gagaaauggcaacaccugg

SEQ ID NO: 245735 - RNA, 18 nt, Human
gcaacaccugggggugag

SEQ ID NO: 245736 - RNA, 21 nt, Human
gcacacccccuuccaccaugg

SEQ ID NO: 245737 - RNA, 21 nt, Human
gcacacccccuuccaccaugg

SEQ ID NO: 245738 - RNA, 22 nt, Human
gcaugugcucacaugcacacau

SEQ ID NO: 245739 - RNA, 22 nt, Human
gcaugugcucacaugcacacau

SEQ ID NO: 245740 - RNA, 24 nt, Human
gccaaaguggcaaaagcaugaccg

SEQ ID NO: 245741 - RNA, 24 nt, Human
gccaaaguggcaaaagcaugaccg

SEQ ID NO: 245742 - RNA, 19 nt, Human
gcccaaauacaagauucug

SEQ ID NO: 245743 - RNA, 19 nt, Human
gcccaaauacaagauucug

SEQ ID NO: 245744 - RNA, 22 nt, Human
gcccuggagcauccacaaccuc

SEQ ID NO: 245745 - RNA, 22 nt, Human
gcccuggagcauccacaaccuc

SEQ ID NO: 245746 - RNA, 19 nt, Human
gccugcacccgcacccucu

SEQ ID NO: 245747 - RNA, 19 nt, Human
gcgcaggugcggcugccgc

SEQ ID NO: 245748 - RNA, 24 nt, Human
gcgucgcaguacucccguuccagc

SEQ ID NO: 245749 - RNA, 24 nt, Human
gcuggaugugccccugcgacuggg

SEQ ID NO: 245750 - RNA, 18 nt, Human
ggaaaagcccuggucuuu

SEQ ID NO: 245751 - RNA, 18 nt, Human
ggaaaagcccuggucuuu

SEQ ID NO: 245752 - RNA, 20 nt, Human
ggaaacaccuuggcccaaau

SEQ ID NO: 245753 - RNA, 21 nt, Human
ggacggugucaggucugaagc

SEQ ID NO: 245754 - RNA, 21 nt, Human
ggacggugucaggucugaagc

SEQ ID NO: 245755 - RNA, 23 nt, Human
ggagcauccacaaccuccuguaa

SEQ ID NO: 245756 - RNA, 23 nt, Human
ggagcauccacaaccuccuguaa

SEQ ID NO: 245757 - RNA, 20 nt, Human
ggcccuugcugcccgcccag

SEQ ID NO: 245758 - RNA, 25 nt, Human
ggcuggaugugccccugcgacuggg

SEQ ID NO: 245759 - RNA, 18 nt, Human
ggugagggagaaagagag

SEQ ID NO: 245760 - RNA, 18 nt, Human
ggugagggagaaagagag

SEQ ID NO: 245761 - RNA, 22 nt, Human
ggugagggagaaagagagacgc

SEQ ID NO: 245762 - RNA, 22 nt, Human
ggugagggagaaagagagacgc

SEQ ID NO: 245763 - RNA, 23 nt, Human
gucgcaguacucccguuccagcu

SEQ ID NO: 245764 - RNA, 20 nt, Human
guuccagcugcugcgcccgc

SEQ ID NO: 245765 - RNA, 20 nt, Human
uaaaaaugcuauacauccac

SEQ ID NO: 245766 - RNA, 20 nt, Human
uaaaaaugcuauacauccac

SEQ ID NO: 245767 - RNA, 20 nt, Human
uaaagaguacacaggaagua

SEQ ID NO: 245768 - RNA, 20 nt, Human
uaaagaguacacaggaagua

SEQ ID NO: 245769 - RNA, 20 nt, Human
uaagcagagaaauggcaaca

SEQ ID NO: 245770 - RNA, 23 nt, Human
uaagcagagaaauggcaacacug

SEQ ID NO: 245771 - RNA, 19 nt, Human
uaauuugcccuuucucccc

SEQ ID NO: 245772 - RNA, 19 nt, Human
uaauuugcccuuucucccc

SEQ ID NO: 245773 - RNA, 18 nt, Human
uacaaaauucugaaacaa

SEQ ID NO: 245774 - RNA, 18 nt, Human
uacaaaauucugaaacaa

SEQ ID NO: 245775 - RNA, 26 nt, Human
uacaauauacaaaauucugaaacaaa

SEQ ID NO: 245776 - RNA, 26 nt, Human
uacaauauacaaaauucugaaacaaa

SEQ ID NO: 245777 - RNA, 25 nt, Human
uacacuuucuucucuccuuuuaagg

SEQ ID NO: 245778 - RNA, 25 nt, Human
uacacuuucuucucuccuuuuaagg

SEQ ID NO: 245779 - RNA, 18 nt, Human
uacauguaucacugcacu

SEQ ID NO: 245780 - RNA, 18 nt, Human
uacauguaucacugcacu

SEQ ID NO: 245781 - RNA, 21 nt, Human
uacuccgggcccacaagcagc

SEQ ID NO: 245782 - RNA, 21 nt, Human
uacuccgggcccacaagcagc

SEQ ID NO: 245783 - RNA, 23 nt, Human
uaucaauuguguucaacacagaa

SEQ ID NO: 245784 - RNA, 23 nt, Human
uaucaauuguguucaacacagaa

SEQ ID NO: 245785 - RNA, 21 nt, Human
uauuuggucaaaaggagaaac

SEQ ID NO: 245786 - RNA, 20 nt, Human
ucaagaucugagaaccauac

SEQ ID NO: 245787 - RNA, 20 nt, Human
ucaagaucugagaaccauac

SEQ ID NO: 245788 - RNA, 20 nt, Human
ucacaucaaaagcaccugaa

SEQ ID NO: 245789 - RNA, 20 nt, Human
ucacaucaaaagcaccugaa

SEQ ID NO: 245790 - RNA, 19 nt, Human
ucacaugcacacaugaccg

SEQ ID NO: 245791 - RNA, 19 nt, Human
ucacaugcacacaugaccg

SEQ ID NO: 245792 - RNA, 19 nt, Human
ucacuugccauaauauccu

SEQ ID NO: 245793 - RNA, 19 nt, Human
ucacuugccauaauauccu

SEQ ID NO: 245794 - RNA, 18 nt, Human
ucagaacuucagcagcug

SEQ ID NO: 245795 - RNA, 18 nt, Human
ucagaacuucagcagcug

SEQ ID NO: 245796 - RNA, 18 nt, Human
ucagucugccuccuuccu

SEQ ID NO: 245797 - RNA, 18 nt, Human
ucagucugccuccuuccu

SEQ ID NO: 245798 - RNA, 20 nt, Human
ucccgcgcgcgcggcugcug

SEQ ID NO: 245799 - RNA, 18 nt, Human
ucccguuccagcugcugc

SEQ ID NO: 245800 - RNA, 24 nt, Human
ucccucuggaguacauguaucacu

SEQ ID NO: 245801 - RNA, 19 nt, Human
uccucauguagaacaaaau

SEQ ID NO: 245802 - RNA, 19 nt, Human
uccucauguagaacaaaau

SEQ ID NO: 245803 - RNA, 20 nt, Human
uccucauguagaacaaaauu

SEQ ID NO: 245804 - RNA, 20 nt, Human
uccucauguagaacaaaauu

SEQ ID NO: 245805 - RNA, 24 nt, Human
uccuuuuuggcuguacguaucacu

SEQ ID NO: 245806 - RNA, 22 nt, Human
ucgcaguacucccguuccagcu

SEQ ID NO: 245807 - RNA, 21 nt, Human
ucgccaucagucugccuccuu

SEQ ID NO: 245808 - RNA, 21 nt, Human
ucgccaucagucugccuccuu

SEQ ID NO: 245809 - RNA, 21 nt, Human
ucuccccggcccuugcugccc

SEQ ID NO: 245810 - RNA, 18 nt, Human
ucugaagcaaccagaagg

SEQ ID NO: 245811 - RNA, 18 nt, Human
ucugaagcaaccagaagg

SEQ ID NO: 245812 - RNA, 22 nt, Human
ucugccuccuuccuucuugcuc

SEQ ID NO: 245813 - RNA, 22 nt, Human
ucugccuccuuccuucuugcuc

SEQ ID NO: 245814 - RNA, 18 nt, Human
ucuguucagagaaaucag

SEQ ID NO: 245815 - RNA, 18 nt, Human
ucuguucagagaaaucag

SEQ ID NO: 245816 - RNA, 18 nt, Human
ucuucuucaaauccccaa

SEQ ID NO: 245817 - RNA, 26 nt, Human
ugaaaacgacacuucuccaccccuga

SEQ ID NO: 245818 - RNA, 26 nt, Human
ugaaaacgacacuucuccaccccuga

SEQ ID NO: 245819 - RNA, 18 nt, Human
ugaaagggggagaguccc

SEQ ID NO: 245820 - RNA, 18 nt, Human
ugaaagggggagaguccc

SEQ ID NO: 245821 - RNA, 24 nt, Human
ugaaggguaagcagagaaauggca

SEQ ID NO: 245822 - RNA, 24 nt, Human
ugaaggguaagcagagaaauggca

SEQ ID NO: 245823 - RNA, 18 nt, Human
ugacaccagggccuccug

SEQ ID NO: 245824 - RNA, 18 nt, Human
ugacaccagggccuccug

SEQ ID NO: 245825 - RNA, 24 nt, Human
ugagagggaaucgccaucagucug

SEQ ID NO: 245826 - RNA, 20 nt, Human
ugagggagaaagagagacgc

SEQ ID NO: 245827 - RNA, 22 nt, Human
ugagggagaaagagagacgcaa

SEQ ID NO: 245828 - RNA, 22 nt, Human
ugagggagaaagagagacgcaa

SEQ ID NO: 245829 - RNA, 20 nt, Human
ugcacacaugaccgccuaug

SEQ ID NO: 245830 - RNA, 20 nt, Human
ugcacacaugaccgccuaug

SEQ ID NO: 245831 - RNA, 21 nt, Human
ugcacagaagccaguuggucc

SEQ ID NO: 245832 - RNA, 21 nt, Human
ugcacagaagccaguuggucc

SEQ ID NO: 245833 - RNA, 20 nt, Human
ugcacccgcacccucucccc

SEQ ID NO: 245834 - RNA, 22 nt, Human
ugccaagaagacccuuuuccau

SEQ ID NO: 245835 - RNA, 22 nt, Human
ugccaagaagacccuuuuccau

SEQ ID NO: 245836 - RNA, 18 nt, Human
ugccauaauaucagcuga

SEQ ID NO: 245837 - RNA, 18 nt, Human
ugccauaauaucagcuga

SEQ ID NO: 245838 - RNA, 20 nt, Human
ugcccuggagcauccacaac

SEQ ID NO: 245839 - RNA, 20 nt, Human
ugcccuggagcauccacaac

SEQ ID NO: 245840 - RNA, 20 nt, Human
ugccgcgaccccgcagaccg

SEQ ID NO: 245841 - RNA, 19 nt, Human
ugccuccuuccuucuugcu

SEQ ID NO: 245842 - RNA, 19 nt, Human
ugccuccuuccuucuugcu

SEQ ID NO: 245843 - RNA, 23 nt, Human
ugcgcuggucgcccgcgcaggug

SEQ ID NO: 245844 - RNA, 20 nt, Human
ugcucacaugcacacaugac

SEQ ID NO: 245845 - RNA, 20 nt, Human
ugcucacaugcacacaugac

SEQ ID NO: 245846 - RNA, 26 nt, Human
ugcucacaugcacacaugaccgccua

SEQ ID NO: 245847 - RNA, 26 nt, Human
ugcucacaugcacacaugaccgccua

SEQ ID NO: 245848 - RNA, 25 nt, Human
ugcucagaaaccgaagagcucuucc

SEQ ID NO: 245849 - RNA, 25 nt, Human
ugcucagaaaccgaagagcucuucc

SEQ ID NO: 245850 - RNA, 21 nt, Human
ugcucaggacuccaucucuuc

SEQ ID NO: 245851 - RNA, 21 nt, Human
uggaaacaccuuggcccaaau

SEQ ID NO: 245852 - RNA, 21 nt, Human
uggaaacaccuuggcccaaau

SEQ ID NO: 245853 - RNA, 20 nt, Human
uggcaacaccugggggugag

SEQ ID NO: 245854 - RNA, 20 nt, Human
uggggucacaggagaagcca

SEQ ID NO: 245855 - RNA, 20 nt, Human
uggggucacaggagaagcca

SEQ ID NO: 245856 - RNA, 19 nt, Human
uguagaacaaaaugccuga

SEQ ID NO: 245857 - RNA, 18 nt, Human
ugucacacagccaacacu

SEQ ID NO: 245858 - RNA, 18 nt, Human
uguuaagcugccaagaag

SEQ ID NO: 245859 - RNA, 18 nt, Human
uguuaagcugccaagaag

SEQ ID NO: 245860 - RNA, 19 nt, Human
uguucaacacagaauagca

SEQ ID NO: 245861 - RNA, 19 nt, Human
uguucaacacagaauagca

SEQ ID NO: 245862 - RNA, 21 nt, Human
uucacuggcaaaccugccuga

SEQ ID NO: 245863 - RNA, 21 nt, Human
uucacuggcaaaccugccuga

SEQ ID NO: 245864 - RNA, 21 nt, Human
uucaucuugcuguggauggug

SEQ ID NO: 245865 - RNA, 21 nt, Human
uucaucuugcuguggauggug

SEQ ID NO: 245866 - RNA, 23 nt, Human
uucaucuugcuguggauggugag

SEQ ID NO: 245867 - RNA, 23 nt, Human
uucaucuugcuguggauggugag

SEQ ID NO: 245868 - RNA, 21 nt, Human
uuccagcugcugcgcccgcua

SEQ ID NO: 245869 - RNA, 19 nt, Human
uucuguucagagaaaucag

SEQ ID NO: 245870 - RNA, 19 nt, Human
uucuguucagagaaaucag

SEQ ID NO: 245871 - RNA, 19 nt, Human
uugaacauauuccuaaaag

SEQ ID NO: 245872 - RNA, 19 nt, Human
uugaacauauuccuaaaag

SEQ ID NO: 245873 - RNA, 21 nt, Human
uugcuguggauggugaggauu

SEQ ID NO: 245874 - RNA, 21 nt, Human
uugcuguggauggugaggauu

SEQ ID NO: 245875 - RNA, 23 nt, Human
uuuacuuugcauugaacauauuc

SEQ ID NO: 245876 - RNA, 23 nt, Human
uuuacuuugcauugaacauauuc

SEQ ID NO: 245877 - RNA, 18 nt, Human
uuucacaucaaaagcacc

SEQ ID NO: 245878 - RNA, 18 nt, Human
uuucacaucaaaagcacc

SEQ ID NO: 245879 - RNA, 26 nt, Human
uuuuacuuugauuuucagcauuucuu

SEQ ID NO: 245880 - RNA, 26 nt, Human
uuuuacuuugauuuucagcauuucuu

SEQ ID NO: 245881 - RNA, 23 nt, Human
aagcuggaggccucagcaaagga

SEQ ID NO: 245882 - RNA, 21 nt, Human
acucagcgccccccacccucc

SEQ ID NO: 245883 - RNA, 22 nt, Human
agaacccuuccauuccagaacu

SEQ ID NO: 245884 - RNA, 19 nt, Human
agagguggccaggcccaug

SEQ ID NO: 245885 - RNA, 18 nt, Human
agccagaacccuuccauu

SEQ ID NO: 245886 - RNA, 26 nt, Human
aggaggcagguccaggccccagggug

SEQ ID NO: 245887 - RNA, 20 nt, Human
aggcaggaggcagguccagg

SEQ ID NO: 245888 - RNA, 28 nt, Human
aggcaggaggcagguccaggccccaggg

SEQ ID NO: 245889 - RNA, 21 nt, Human
aggcagguccaggccccaggg

SEQ ID NO: 245890 - RNA, 22 nt, Human
aggcccaugcuccaccccggcc

SEQ ID NO: 245891 - RNA, 21 nt, Human
agggugcagagaugucugucu

SEQ ID NO: 245892 - RNA, 18 nt, Human
cacacacagaagcagcga

SEQ ID NO: 245893 - RNA, 19 nt, Human
caccacacacagaagcagc

SEQ ID NO: 245894 - RNA, 21 nt, Human
caccacacacagaagcagcga

SEQ ID NO: 245895 - RNA, 22 nt, Human
caccucugcccuucagcagguu

SEQ ID NO: 245896 - RNA, 21 nt, Human
cacgccccccagcuccacuuc

SEQ ID NO: 245897 - RNA, 18 nt, Human
cagagacugggacgcugg

SEQ ID NO: 245898 - RNA, 20 nt, Human
cagcagcagcagcgggagau

SEQ ID NO: 245899 - RNA, 21 nt, Human
cagcagcagcgggagauugaa

SEQ ID NO: 245900 - RNA, 18 nt, Human
cagcagguuggggcagcc

SEQ ID NO: 245901 - RNA, 19 nt, Human
cagcgccccccacccucca

SEQ ID NO: 245902 - RNA, 23 nt, Human
cagcgggagauugaacuggggcc

SEQ ID NO: 245903 - RNA, 19 nt, Human
caggccccagggugcagag

SEQ ID NO: 245904 - RNA, 22 nt, Human
cagguccaggccccagggugca

SEQ ID NO: 245905 - RNA, 23 nt, Human
cccacggcggccccgcccgaggc

SEQ ID NO: 245906 - RNA, 24 nt, Human
ccccacccuccaccucugcccuuc

SEQ ID NO: 245907 - RNA, 22 nt, Human
ccccacggcggccccgcccgag

SEQ ID NO: 245908 - RNA, 18 nt, Human
ccccccacccuccaccuc

SEQ ID NO: 245909 - RNA, 20 nt, Human
ccccccagcuccacuucugc

SEQ ID NO: 245910 - RNA, 24 nt, Human
cccgaggccccguggggagggcgg

SEQ ID NO: 245911 - RNA, 24 nt, Human
cccguggggagggcggguggggag

SEQ ID NO: 245912 - RNA, 19 nt, Human
cccuccaccucugcccuuc

SEQ ID NO: 245913 - RNA, 23 nt, Human
cccucccaccgcccuccucccca

SEQ ID NO: 245914 - RNA, 23 nt, Human
cccugagucccuacucagcgccc

SEQ ID NO: 245915 - RNA, 21 nt, Human
ccuacucagcgccccccaccc

SEQ ID NO: 245916 - RNA, 18 nt, Human
ccucagggaugcuagccc

SEQ ID NO: 245917 - RNA, 20 nt, Human
ccucccaccgcccuccuccc

SEQ ID NO: 245918 - RNA, 20 nt, Human
cgcagcagcagcagcgggag

SEQ ID NO: 245919 - RNA, 24 nt, Human
cgccccccacccuccaccucugcc

SEQ ID NO: 245920 - RNA, 20 nt, Human
cucagcgccccccacccucc

SEQ ID NO: 245921 - RNA, 25 nt, Human
cucagcgccccccacccuccaccuc

SEQ ID NO: 245922 - RNA, 18 nt, Human
cuccaccccggccugggc

SEQ ID NO: 245923 - RNA, 21 nt, Human
cucuccacgccccccagcucc

SEQ ID NO: 245924 - RNA, 20 nt, Human
cugccagagacugggacgcu

SEQ ID NO: 245925 - RNA, 22 nt, Human
cuggaggccucagcaaaggaga

SEQ ID NO: 245926 - RNA, 24 nt, Human
cuuccauuccagaacugccagaga

SEQ ID NO: 245927 - RNA, 18 nt, Human
cuuggccugccugaagcu

SEQ ID NO: 245928 - RNA, 23 nt, Human
gaggcagguccaggccccagggu

SEQ ID NO: 245929 - RNA, 23 nt, Human
gaggucccgaggccccgugggga

SEQ ID NO: 245930 - RNA, 26 nt, Human
gagucccuacucagcgccccccaccc

SEQ ID NO: 245931 - RNA, 21 nt, Human
gcagguccaggccccagggug

SEQ ID NO: 245932 - RNA, 19 nt, Human
gcgggagaggggcaggcag

SEQ ID NO: 245933 - RNA, 23 nt, Human
ggaggcagguccaggccccccaa

SEQ ID NO: 245934 - RNA, 28 nt, Human
ggaugcuagcccuugagacuaaggaauu

SEQ ID NO: 245935 - RNA, 21 nt, Human
ggcccugagucccuacucagc

SEQ ID NO: 245936 - RNA, 20 nt, Human
gggcaggcaggaggcagguc

SEQ ID NO: 245937 - RNA, 21 nt, Human
gggcgcagcagcagcagcggg

SEQ ID NO: 245938 - RNA, 24 nt, Human
gggcgcagcagcagcagcgggaga

SEQ ID NO: 245939 - RNA, 18 nt, Human
ggggaggagaaggccuug

SEQ ID NO: 245940 - RNA, 20 nt, Human
gggugggguuugaaugagau

SEQ ID NO: 245941 - RNA, 18 nt, Human
ucagcgccccccacccuc

SEQ ID NO: 245942 - RNA, 22 nt, Human
ucccaccgcccuccuccccacg

SEQ ID NO: 245943 - RNA, 18 nt, Human
uccccacggcggccccgc

SEQ ID NO: 245944 - RNA, 20 nt, Human
uccccacggcggccccgccc

SEQ ID NO: 245945 - RNA, 18 nt, Human
ucuccacgccccccagcu

SEQ ID NO: 245946 - RNA, 19 nt, Human
ugaacuggggccaccugag

SEQ ID NO: 245947 - RNA, 20 nt, Human
ugagaugaggggggcaggca

SEQ ID NO: 245948 - RNA, 20 nt, Human
ugaggggggcaggcauggcc

SEQ ID NO: 245949 - RNA, 22 nt, Human
ugaggucccgaggccccguggg

SEQ ID NO: 245950 - RNA, 18 nt, Human
ugccaagguccgggcugg

SEQ ID NO: 245951 - RNA, 18 nt, Human
uggcccugagucccuacu

SEQ ID NO: 245952 - RNA, 20 nt, Human
uggcgggagaggggcaggca

SEQ ID NO: 245953 - RNA, 23 nt, Human
aaaaagccagaacgaccccagua

SEQ ID NO: 245954 - RNA, 26 nt, Human
aaaagaacaucgaaugguaauggaca

SEQ ID NO: 245955 - RNA, 21 nt, Human
aaacauugcucugaacaaaag

SEQ ID NO: 245956 - RNA, 23 nt, Human
aaagaaaaaacaaaacccaaaca

SEQ ID NO: 245957 - RNA, 21 nt, Human
aaccugcauugggagcgcugu

SEQ ID NO: 245958 - RNA, 28 nt, Human
aagaaaaaacaaaacccaaacacuuccu

SEQ ID NO: 245959 - RNA, 23 nt, Human
aagaaacauugcucugaacaaaa

SEQ ID NO: 245960 - RNA, 18 nt, Human
aagaacaucucagaccaa

SEQ ID NO: 245961 - RNA, 20 nt, Human
aagcgcccucugaggacaaa

SEQ ID NO: 245962 - RNA, 23 nt, Human
aagcgcccucugaggacaaaaug

SEQ ID NO: 245963 - RNA, 22 nt, Human
aagcucguccucacacuaagcc

SEQ ID NO: 245964 - RNA, 21 nt, Human
aaggcagcagagagggcggag

SEQ ID NO: 245965 - RNA, 21 nt, Human
acaggggaagaacaucucaga

SEQ ID NO: 245966 - RNA, 20 nt, Human
accucacugcuguccuccaa

SEQ ID NO: 245967 - RNA, 19 nt, Human
accuggaaacuggcuggac

SEQ ID NO: 245968 - RNA, 24 nt, Human
acugcaaaguaaaagaugcagaaa

SEQ ID NO: 245969 - RNA, 24 nt, Human
agaaauggacauuccucucgcucc

SEQ ID NO: 245970 - RNA, 22 nt, Human
agacccugccugggggccagga

SEQ ID NO: 245971 - RNA, 18 nt, Human
agcagcuuguucuuuacc

SEQ ID NO: 245972 - RNA, 20 nt, Human
agccagaacgaccccaguag

SEQ ID NO: 245973 - RNA, 21 nt, Human
agccaggaaaguaugcuuggu

SEQ ID NO: 245974 - RNA, 21 nt, Human
agcccuugcuguugacaccuc

SEQ ID NO: 245975 - RNA, 25 nt, Human
aggacgcccaguggggaaagagggc

SEQ ID NO: 245976 - RNA, 22 nt, Human
aggcgcugugguuagggugggg

SEQ ID NO: 245977 - RNA, 19 nt, Human
aggcuguucugaccugaaa

SEQ ID NO: 245978 - RNA, 21 nt, Human
agggggugugugcacaggccu

SEQ ID NO: 245979 - RNA, 20 nt, Human
aggggugaggcaaauacagg

SEQ ID NO: 245980 - RNA, 21 nt, Human
aguguugggggaagagaagga

SEQ ID NO: 245981 - RNA, 23 nt, Human
aucuuccuaccuuucuggauucc

SEQ ID NO: 245982 - RNA, 21 nt, Human
caaaaagccagaacgacccca

SEQ ID NO: 245983 - RNA, 21 nt, Human
caaaguaaaagaugcagaaac

SEQ ID NO: 245984 - RNA, 22 nt, Human
caaggcagcagagagggcggag

SEQ ID NO: 245985 - RNA, 18 nt, Human
caaggcagcagcuuguuc

SEQ ID NO: 245986 - RNA, 19 nt, Human
caagucccacggcugaggg

SEQ ID NO: 245987 - RNA, 19 nt, Human
cacacaguuugcaugcacc

SEQ ID NO: 245988 - RNA, 23 nt, Human
caccaaacucaccuuagccuaca

SEQ ID NO: 245989 - RNA, 21 nt, Human
caccccacgcuucugcagagg

SEQ ID NO: 245990 - RNA, 19 nt, Human
cacgaggucgccagggugc

SEQ ID NO: 245991 - RNA, 23 nt, Human
cagacccugccugggggccagga

SEQ ID NO: 245992 - RNA, 24 nt, Human
caggaaaggccaagucucggcuag

SEQ ID NO: 245993 - RNA, 21 nt, Human
caggccugggagaagggcuga

SEQ ID NO: 245994 - RNA, 18 nt, Human
caggggcagucaggaaag

SEQ ID NO: 245995 - RNA, 19 nt, Human
caggguccaguucaaaccc

SEQ ID NO: 245996 - RNA, 22 nt, Human
caugaggucuccaugcuggugc

SEQ ID NO: 245997 - RNA, 22 nt, Human
cauguggucucccuuucguaga

SEQ ID NO: 245998 - RNA, 23 nt, Human
ccaaacucaccuuagccuacacu

SEQ ID NO: 245999 - RNA, 21 nt, Human
ccaaccccaaggcagcagaga

SEQ ID NO: 246000 - RNA, 22 nt, Human
ccaccagcucucuggagacgag

SEQ ID NO: 246001 - RNA, 20 nt, Human
ccaguucaaacccgcuccca

SEQ ID NO: 246002 - RNA, 23 nt, Human
cccaggcuguucugaccugaaac

SEQ ID NO: 246003 - RNA, 22 nt, Human
ccccaccccacgcuucugcaga

SEQ ID NO: 246004 - RNA, 24 nt, Human
ccuaagagcccuugcuguugacac

SEQ ID NO: 246005 - RNA, 20 nt, Human
ccucacugcuguccuccaaa

SEQ ID NO: 246006 - RNA, 20 nt, Human
ccugaacccuucuuaaagcu

SEQ ID NO: 246007 - RNA, 21 nt, Human
ccugcucuguggggccuggag

SEQ ID NO: 246008 - RNA, 18 nt, Human
ccugggaccagauagggc

SEQ ID NO: 246009 - RNA, 18 nt, Human
ccuggucaaggcagcagc

SEQ ID NO: 246010 - RNA, 22 nt, Human
cguagaaaugagucaccccuaa

SEQ ID NO: 246011 - RNA, 26 nt, Human
cucagaccaaguuucuaacaaaaagc

SEQ ID NO: 246012 - RNA, 22 nt, Human
cuccaugcuggugccugacccc

SEQ ID NO: 246013 - RNA, 21 nt, Human
cuccugcucuguggggccugg

SEQ ID NO: 246014 - RNA, 19 nt, Human
cucggcuagcggccucccu

SEQ ID NO: 246015 - RNA, 21 nt, Human
cugagggggugugugcacagg

SEQ ID NO: 246016 - RNA, 18 nt, Human
cugcaccaguggccgcag

SEQ ID NO: 246017 - RNA, 22 nt, Human
cugcuguccuccaaaugagcag

SEQ ID NO: 246018 - RNA, 18 nt, Human
cuggaaacuggcuggacu

SEQ ID NO: 246019 - RNA, 22 nt, Human
cugggggucuccugcucugugg

SEQ ID NO: 246020 - RNA, 23 nt, Human
cugugcacacauguggucucccu

SEQ ID NO: 246021 - RNA, 19 nt, Human
cuguggguaucuuugggag

SEQ ID NO: 246022 - RNA, 21 nt, Human
cugugguuagggugggggggc

SEQ ID NO: 246023 - RNA, 27 nt, Human
cuuaaagaaaaaacaaaacccaaacua

SEQ ID NO: 246024 - RNA, 21 nt, Human
cuugcccccaaggucacgacg

SEQ ID NO: 246025 - RNA, 18 nt, Human
gaaaaaacaaaacccaaa

SEQ ID NO: 246026 - RNA, 21 nt, Human
gaagggcugauuuuacccaca

SEQ ID NO: 246027 - RNA, 24 nt, Human
gaccugaucaaguuuaauaauguu

SEQ ID NO: 246028 - RNA, 24 nt, Human
gagggugaacgcagcccaagacca

SEQ ID NO: 246029 - RNA, 18 nt, Human
gauguguuuucuccuagu

SEQ ID NO: 246030 - RNA, 19 nt, Human
gcagaggccugugucuaca

SEQ ID NO: 246031 - RNA, 21 nt, Human
gccaaccccaaggcagcagag

SEQ ID NO: 246032 - RNA, 19 nt, Human
gcgagugucucugccucuc

SEQ ID NO: 246033 - RNA, 23 nt, Human
gcugagcugugcuaguugggggc

SEQ ID NO: 246034 - RNA, 23 nt, Human
gcugagggggugugugcacaggg

SEQ ID NO: 246035 - RNA, 19 nt, Human
gcugcccagguaacacagg

SEQ ID NO: 246036 - RNA, 20 nt, Human
ggaagaacaucucagaccaa

SEQ ID NO: 246037 - RNA, 24 nt, Human
ggagcgcugucuacuaauuccugu

SEQ ID NO: 246038 - RNA, 21 nt, Human
ggcagcagcuuguucuuuacc

SEQ ID NO: 246039 - RNA, 21 nt, Human
ggccgccuccugccagccccg

SEQ ID NO: 246040 - RNA, 21 nt, Human
ggccugggagaagggcugauu

SEQ ID NO: 246041 - RNA, 23 nt, Human
ggcggccgccuccugccagcccc

SEQ ID NO: 246042 - RNA, 19 nt, Human
gggagugcugagggggugu

SEQ ID NO: 246043 - RNA, 25 nt, Human
gggccggguguggggugaaggggga

SEQ ID NO: 246044 - RNA, 25 nt, Human
ggggugaagggggagugcuggcagg

SEQ ID NO: 246045 - RNA, 20 nt, Human
gucaggaaaggccaagucuc

SEQ ID NO: 246046 - RNA, 20 nt, Human
gucccuccuuugucaugagg

SEQ ID NO: 246047 - RNA, 25 nt, Human
gugcugagggggugugugcacaggg

SEQ ID NO: 246048 - RNA, 24 nt, Human
uaacaaaaagccagaacgacccca

SEQ ID NO: 246049 - RNA, 20 nt, Human
uaagagcccuugcuguugac

SEQ ID NO: 246050 - RNA, 27 nt, Human
uaagccaggguccaguucaaacccgcu

SEQ ID NO: 246051 - RNA, 22 nt, Human
uaaguacuuggggagccaggaa

SEQ ID NO: 246052 - RNA, 20 nt, Human
uacacaccauuaccccaugc

SEQ ID NO: 246053 - RNA, 18 nt, Human
uaccccaugcucuguggg

SEQ ID NO: 246054 - RNA, 18 nt, Human
uagggugggggggccggg

SEQ ID NO: 246055 - RNA, 22 nt, Human
ucacugccaccagcucucugga

SEQ ID NO: 246056 - RNA, 21 nt, Human
ucuccaugcuggugccugacc

SEQ ID NO: 246057 - RNA, 18 nt, Human
ucugaacaaaagaacauc

SEQ ID NO: 246058 - RNA, 21 nt, Human
ucugucaagucccacggcuga

SEQ ID NO: 246059 - RNA, 24 nt, Human
ucugugggugacacacaguuugca

SEQ ID NO: 246060 - RNA, 21 nt, Human
ucuuucuggcugaaaugcaag

SEQ ID NO: 246061 - RNA, 23 nt, Human
ugaaaccuucucuccuaacacau

SEQ ID NO: 246062 - RNA, 19 nt, Human
ugaacaccaguggcagaaa

SEQ ID NO: 246063 - RNA, 18 nt, Human
ugaacgcagcccaagacc

SEQ ID NO: 246064 - RNA, 20 nt, Human
ugacacacaguuugcaugca

SEQ ID NO: 246065 - RNA, 21 nt, Human
ugaccugaucaaguuuaauaa

SEQ ID NO: 246066 - RNA, 22 nt, Human
ugagggugaacgcagcccaaga

SEQ ID NO: 246067 - RNA, 25 nt, Human
ugagggugaacgcagcccaagacca

SEQ ID NO: 246068 - RNA, 18 nt, Human
ugaggucuccaugcuggu

SEQ ID NO: 246069 - RNA, 21 nt, Human
ugaggucuccaugcuggugcc

SEQ ID NO: 246070 - RNA, 29 nt, Human
ugagucccuccuuugucaugaaggaaccu

SEQ ID NO: 246071 - RNA, 22 nt, Human
ugaucuggagcugcccagguaa

SEQ ID NO: 246072 - RNA, 19 nt, Human
ugcccagguaacacagggg

SEQ ID NO: 246073 - RNA, 22 nt, Human
ugcuggcagggagguuggaggg

SEQ ID NO: 246074 - RNA, 22 nt, Human
ugcuuugagucccuccuuuguc

SEQ ID NO: 246075 - RNA, 22 nt, Human
uggaaagaaaacccaguaucau

SEQ ID NO: 246076 - RNA, 21 nt, Human
uggagacgagaauggcauaug

SEQ ID NO: 246077 - RNA, 21 nt, Human
ugggcucagugaucuggagcu

SEQ ID NO: 246078 - RNA, 19 nt, Human
ugggggggccggguguggg

SEQ ID NO: 246079 - RNA, 23 nt, Human
ugguggaucucuaccuggaaacu

SEQ ID NO: 246080 - RNA, 21 nt, Human
ugguucaguuuccaguuucag

SEQ ID NO: 246081 - RNA, 20 nt, Human
uguagagaacauuugguccg

SEQ ID NO: 246082 - RNA, 22 nt, Human
ugucaugaggucuccaugcugg

SEQ ID NO: 246083 - RNA, 19 nt, Human
ugugcacacauguggucuc

SEQ ID NO: 246084 - RNA, 18 nt, Human
uguggggugaagggggag

SEQ ID NO: 246085 - RNA, 21 nt, Human
uguggggugaagggggagugc

SEQ ID NO: 246086 - RNA, 26 nt, Human
uuacugagcugagcuccuuaagaugc

SEQ ID NO: 246087 - RNA, 23 nt, Human
uuagaauggcucauauuucuuuu

SEQ ID NO: 246088 - RNA, 24 nt, Human
uuauuuggccugaccugaucaagu

SEQ ID NO: 246089 - RNA, 23 nt, Human
uuggugacuaggagaaaggcaaa

SEQ ID NO: 246090 - RNA, 18 nt, Human
uuuaacgacaaauuauag

SEQ ID NO: 246091 - RNA, 22 nt, Human
uuuaaguacuuggggagccagg

SEQ ID NO: 246092 - RNA, 22 nt, Human
uuuaccaaaaaguaagcgcccu

SEQ ID NO: 246093 - RNA, 21 nt, Human
uuugcaugcaccaaacucacc

SEQ ID NO: 246094 - RNA, 23 nt, Human
uuuuacccacagaccccaggcug

SEQ ID NO: 246095 - RNA, 22 nt, Human
aaggccgcagccaccaccucag

SEQ ID NO: 246096 - RNA, 19 nt, Human
aagggaaccuuguauuuca

SEQ ID NO: 246097 - RNA, 20 nt, Human
accgaggcggccgcccaacu

SEQ ID NO: 246098 - RNA, 23 nt, Human
agaauaauccaagccgagccuca

SEQ ID NO: 246099 - RNA, 21 nt, Human
agcaaggcacaggcugggggc

SEQ ID NO: 246100 - RNA, 20 nt, Human
aggccgcagccaccaccuca

SEQ ID NO: 246101 - RNA, 23 nt, Human
auucccgugcuuugggcugcagc

SEQ ID NO: 246102 - RNA, 21 nt, Human
caaaggccgcagccaccaccu

SEQ ID NO: 246103 - RNA, 24 nt, Human
cagaauaauccaagccgagccuca

SEQ ID NO: 246104 - RNA, 20 nt, Human
cagcaaggcacaggcugggg

SEQ ID NO: 246105 - RNA, 22 nt, Human
cagccaccaccucagcgucuug

SEQ ID NO: 246106 - RNA, 18 nt, Human
cagggggaguuggggucu

SEQ ID NO: 246107 - RNA, 23 nt, Human
ccccgguagagggugcccgucac

SEQ ID NO: 246108 - RNA, 20 nt, Human
cccgaaguccccuuccgccc

SEQ ID NO: 246109 - RNA, 19 nt, Human
ccggccaaguuggacugca

SEQ ID NO: 246110 - RNA, 25 nt, Human
ccucccguccccagcgcgggggucu

SEQ ID NO: 246111 - RNA, 24 nt, Human
ccuccgggauucuagagcguccgg

SEQ ID NO: 246112 - RNA, 21 nt, Human
cggccgaacccuccacugacu

SEQ ID NO: 246113 - RNA, 22 nt, Human
cuaaagccuuugagaaugcucc

SEQ ID NO: 246114 - RNA, 20 nt, Human
cucgccggccucccgucccc

SEQ ID NO: 246115 - RNA, 19 nt, Human
cugcuccucugcggagccc

SEQ ID NO: 246116 - RNA, 22 nt, Human
cugggaaugugucauccccggu

SEQ ID NO: 246117 - RNA, 27 nt, Human
cugggaaugugucauccccgguagagg

SEQ ID NO: 246118 - RNA, 22 nt, Human
cuggguccagggcuaaagccuu

SEQ ID NO: 246119 - RNA, 23 nt, Human
cuuguucaaaggccgcagccacc

SEQ ID NO: 246120 - RNA, 25 nt, Human
gcagaagggaaccuuguauuucaca

SEQ ID NO: 246121 - RNA, 22 nt, Human
gccuuugagaaugcucccaugg

SEQ ID NO: 246122 - RNA, 18 nt, Human
ggccgaacccuccacuga

SEQ ID NO: 246123 - RNA, 20 nt, Human
ggguccagggcuaaagccuu

SEQ ID NO: 246124 - RNA, 24 nt, Human
gguggcucagguggcugcuuaaga

SEQ ID NO: 246125 - RNA, 22 nt, Human
guggcugagccucuccgcagcu

SEQ ID NO: 246126 - RNA, 18 nt, Human
uaaccgaggcggccgccc

SEQ ID NO: 246127 - RNA, 21 nt, Human
uagcuuggcuacuggcucccg

SEQ ID NO: 246128 - RNA, 20 nt, Human
uagguaucuucccuccgcuc

SEQ ID NO: 246129 - RNA, 22 nt, Human
uauaauacugaaaaggauuguu

SEQ ID NO: 246130 - RNA, 19 nt, Human
ucagguggcugcuuaaggc

SEQ ID NO: 246131 - RNA, 23 nt, Human
uccagggcuaaagccuuugagaa

SEQ ID NO: 246132 - RNA, 21 nt, Human
uccccagcgcgggggucuccg

SEQ ID NO: 246133 - RNA, 20 nt, Human
ucccgaaguccccuuccgcc

SEQ ID NO: 246134 - RNA, 21 nt, Human
uccgccauuugcuugguccca

SEQ ID NO: 246135 - RNA, 26 nt, Human
uccgccauuugcuuggucccaagucc

SEQ ID NO: 246136 - RNA, 23 nt, Human
ucuccgaggguggcucacuuacu

SEQ ID NO: 246137 - RNA, 24 nt, Human
ugccauggcucggugguggcucag

SEQ ID NO: 246138 - RNA, 26 nt, Human
ugccauggcucggugguggcucaggu

SEQ ID NO: 246139 - RNA, 19 nt, Human
uggcagcaaggcacaggcu

SEQ ID NO: 246140 - RNA, 23 nt, Human
uggcuacuggcucccgaaguccc

SEQ ID NO: 246141 - RNA, 21 nt, Human
uggcucagguggcugcuuaag

SEQ ID NO: 246142 - RNA, 24 nt, Human
uggcucccgaaguccccuuccgcc

SEQ ID NO: 246143 - RNA, 20 nt, Human
uggcuucuagguaucuuccc

SEQ ID NO: 246144 - RNA, 21 nt, Human
uggguccagggcuaaagccuu

SEQ ID NO: 246145 - RNA, 21 nt, Human
uggucccaggagcucugggaa

SEQ ID NO: 246146 - RNA, 21 nt, Human
ugucugucccgcgauucccgu

SEQ ID NO: 246147 - RNA, 19 nt, Human
uucaaaggccgcagccacc

SEQ ID NO: 246148 - RNA, 20 nt, Human
uucagggggaguuggggucu

SEQ ID NO: 246149 - RNA, 24 nt, Human
uugcuuggucccaggagcucuggg

SEQ ID NO: 246150 - RNA, 24 nt, Human
uuggcuacuggcucccgaaguccc

SEQ ID NO: 246151 - RNA, 23 nt, Human
uuuguucaaaggccgcagccacc

SEQ ID NO: 246152 - RNA, 22 nt, Human
uuuuuuuuuuugcagaagggaa

SEQ ID NO: 246153 - RNA, 24 nt, Human
uuuuuuuuuuugcagaagggaacc

SEQ ID NO: 246154 - RNA, 25 nt, Human
uuuuuuuuuuuuuuuugcagaaggg

SEQ ID NO: 246155 - RNA, 18 nt, Human
uuuuuuuuuuuuuuuuug

SEQ ID NO: 246156 - RNA, 21 nt, Human
uuuuuuuuuuuuuuuuugcag

SEQ ID NO: 246157 - RNA, 20 nt, Human
uuuuuuuuuuuuuuuuuugg

SEQ ID NO: 246158 - RNA, 20 nt, Human
aaaguccuugggagguggcu

SEQ ID NO: 246159 - RNA, 21 nt, Human
aauccccaggcagcccacucu

SEQ ID NO: 246160 - RNA, 22 nt, Human
accaagauggggcuggccugug

SEQ ID NO: 246161 - RNA, 22 nt, Human
agcccugucccucccaaucccc

SEQ ID NO: 246162 - RNA, 26 nt, Human
aggaggcggcggcugcgaaggaggcg

SEQ ID NO: 246163 - RNA, 22 nt, Human
agggcugggggacgcagagggc

SEQ ID NO: 246164 - RNA, 20 nt, Human
caagauggggcuggccugug

SEQ ID NO: 246165 - RNA, 24 nt, Human
caagcccugucccucccaaucccc

SEQ ID NO: 246166 - RNA, 24 nt, Human
caauaaacugcauuugccucuccc

SEQ ID NO: 246167 - RNA, 20 nt, Human
cacccagaagccccgcagau

SEQ ID NO: 246168 - RNA, 24 nt, Human
cacuuccuuguccucuggcggugg

SEQ ID NO: 246169 - RNA, 22 nt, Human
cacuuuaauaguuggggccagg

SEQ ID NO: 246170 - RNA, 20 nt, Human
cagcagccagcuguccuggc

SEQ ID NO: 246171 - RNA, 22 nt, Human
cagccgccgccgcggaguucgg

SEQ ID NO: 246172 - RNA, 18 nt, Human
caggggcagggcgggcac

SEQ ID NO: 246173 - RNA, 23 nt, Human
caggugccccuccucaagcagug

SEQ ID NO: 246174 - RNA, 18 nt, Human
caugccggugaggucagu

SEQ ID NO: 246175 - RNA, 20 nt, Human
ccagagaccugcuccccaag

SEQ ID NO: 246176 - RNA, 27 nt, Human
ccagcggcccccacuuccuuguccucu

SEQ ID NO: 246177 - RNA, 18 nt, Human
ccagggugacaggaccaa

SEQ ID NO: 246178 - RNA, 21 nt, Human
ccauugccccacccuccccua

SEQ ID NO: 246179 - RNA, 19 nt, Human
cccaggauggggcagggcc

SEQ ID NO: 246180 - RNA, 22 nt, Human
ccccaagcccugucccucccaa

SEQ ID NO: 246181 - RNA, 24 nt, Human
ccccacccuccccuacccugggcc

SEQ ID NO: 246182 - RNA, 19 nt, Human
ccccaggcagcccacucug

SEQ ID NO: 246183 - RNA, 19 nt, Human
ccccauugccccacccucc

SEQ ID NO: 246184 - RNA, 20 nt, Human
cccccacuuccuuguccucu

SEQ ID NO: 246185 - RNA, 21 nt, Human
ccccuccucaagcagugccac

SEQ ID NO: 246186 - RNA, 24 nt, Human
cccuacccugggccagcggccccc

SEQ ID NO: 246187 - RNA, 26 nt, Human
cccucccaauccccaggcagcccacu

SEQ ID NO: 246188 - RNA, 18 nt, Human
cccuccccuacccugggc

SEQ ID NO: 246189 - RNA, 18 nt, Human
cccugggccagcggcccc

SEQ ID NO: 246190 - RNA, 19 nt, Human
cccugucccucccaauccc

SEQ ID NO: 246191 - RNA, 23 nt, Human
ccuccccgccugagguccuaggc

SEQ ID NO: 246192 - RNA, 20 nt, Human
ccuugcggcagcuccuccuc

SEQ ID NO: 246193 - RNA, 25 nt, Human
ccuugggagguggcugggcucagcc

SEQ ID NO: 246194 - RNA, 18 nt, Human
cgcggaggaggcggcggc

SEQ ID NO: 246195 - RNA, 21 nt, Human
cgcggcacagcaccgcgcacg

SEQ ID NO: 246196 - RNA, 18 nt, Human
cggagcgcggcgcggagg

SEQ ID NO: 246197 - RNA, 22 nt, Human
cucugccagagaccugcucccc

SEQ ID NO: 246198 - RNA, 19 nt, Human
cuggcaggggagguaaggc

SEQ ID NO: 246199 - RNA, 20 nt, Human
gcacuggccugagggcuggg

SEQ ID NO: 246200 - RNA, 21 nt, Human
gcaggagccacccagaagccc

SEQ ID NO: 246201 - RNA, 19 nt, Human
gcaggggagguaaggccca

SEQ ID NO: 246202 - RNA, 18 nt, Human
gcaggggcagggcgggca

SEQ ID NO: 246203 - RNA, 24 nt, Human
gccugagggcugggggacgcagag

SEQ ID NO: 246204 - RNA, 18 nt, Human
gcggcggcugcgaaggag

SEQ ID NO: 246205 - RNA, 23 nt, Human
gcucagggcucuucggugggggu

SEQ ID NO: 246206 - RNA, 18 nt, Human
gcugggcucagccugagc

SEQ ID NO: 246207 - RNA, 21 nt, Human
ggacauccuucucugccagag

SEQ ID NO: 246208 - RNA, 21 nt, Human
ggagcgcggcgcggaggaggc

SEQ ID NO: 246209 - RNA, 19 nt, Human
ggagguggcugggcucagc

SEQ ID NO: 246210 - RNA, 20 nt, Human
ggagguggcugggcucagcc

SEQ ID NO: 246211 - RNA, 24 nt, Human
ggcacuugcagguggcacaggcuu

SEQ ID NO: 246212 - RNA, 19 nt, Human
gggcaggggcagggcgggc

SEQ ID NO: 246213 - RNA, 18 nt, Human
gggguuggggcaggggca

SEQ ID NO: 246214 - RNA, 24 nt, Human
guuggggcaggggcagggcgggca

SEQ ID NO: 246215 - RNA, 19 nt, Human
uagaugaaucuaaucccau

SEQ ID NO: 246216 - RNA, 20 nt, Human
ucagcagccagcuguccugg

SEQ ID NO: 246217 - RNA, 20 nt, Human
ucccaauccccaggcagccc

SEQ ID NO: 246218 - RNA, 20 nt, Human
uccccaggcagcccacucug

SEQ ID NO: 246219 - RNA, 23 nt, Human
uccccaggcagcccacucugccc

SEQ ID NO: 246220 - RNA, 22 nt, Human
uccccgccugagguccuaggcc

SEQ ID NO: 246221 - RNA, 22 nt, Human
ucucgggcacagcccuggcccc

SEQ ID NO: 246222 - RNA, 22 nt, Human
ucugccagagaccugcucccca

SEQ ID NO: 246223 - RNA, 23 nt, Human
ugagguccuaggccugccacagg

SEQ ID NO: 246224 - RNA, 19 nt, Human
ugccacaggccagcaugcc

SEQ ID NO: 246225 - RNA, 20 nt, Human
ugccacaggccagcaugccg

SEQ ID NO: 246226 - RNA, 19 nt, Human
uggaaaguccuugggaggu

SEQ ID NO: 246227 - RNA, 23 nt, Human
uggaacggacauccuucucugcc

SEQ ID NO: 246228 - RNA, 22 nt, Human
uggcaggagccacccagaagcc

SEQ ID NO: 246229 - RNA, 24 nt, Human
uggcagggcgcggcacagcaccgc

SEQ ID NO: 246230 - RNA, 19 nt, Human
uggcaggugccccuccuca

SEQ ID NO: 246231 - RNA, 23 nt, Human
ugggacagggccuugcggcagcu

SEQ ID NO: 246232 - RNA, 19 nt, Human
uggggcagggccgugugcu

SEQ ID NO: 246233 - RNA, 18 nt, Human
ugggggacgcagagggcg

SEQ ID NO: 246234 - RNA, 18 nt, Human
uggggguuggggcagggg

SEQ ID NO: 246235 - RNA, 19 nt, Human
ugucagcagccagcugucc

SEQ ID NO: 246236 - RNA, 19 nt, Human
uguccuggcacuggccuga

SEQ ID NO: 246237 - RNA, 21 nt, Human
uuuuuuuuuuuuuuuuccaga

SEQ ID NO: 246238 - RNA, 22 nt, Human
uuuuuuuuuuuuuuuuuuccag

SEQ ID NO: 246239 - RNA, 19 nt, Human
aagcaggcaauccuaucag

SEQ ID NO: 246240 - RNA, 19 nt, Human
aagcaggcaauccuaucag

SEQ ID NO: 246241 - RNA, 24 nt, Human
aagcaggcaauccuaucaggucug

SEQ ID NO: 246242 - RNA, 24 nt, Human
aagcaggcaauccuaucaggucug

SEQ ID NO: 246243 - RNA, 20 nt, Human
aauacaaaagauagaauaaa

SEQ ID NO: 246244 - RNA, 20 nt, Human
aauacaaaagauagaauaaa

SEQ ID NO: 246245 - RNA, 23 nt, Human
acaaaagauagaauaaagggacc

SEQ ID NO: 246246 - RNA, 24 nt, Human
acucuaacugcucaccugaaauga

SEQ ID NO: 246247 - RNA, 24 nt, Human
acucuaacugcucaccugaaauga

SEQ ID NO: 246248 - RNA, 19 nt, Human
agacugagaaggaguggcg

SEQ ID NO: 246249 - RNA, 20 nt, Human
aguggacauggaugaaaugu

SEQ ID NO: 246250 - RNA, 26 nt, Human
auacaaaagauagaauaaagggaccc

SEQ ID NO: 246251 - RNA, 23 nt, Human
caacucccaagcauuucaggccc

SEQ ID NO: 246252 - RNA, 23 nt, Human
caacucccaagcauuucaggccc

SEQ ID NO: 246253 - RNA, 24 nt, Human
cacuaccuggaagauuauuuggca

SEQ ID NO: 246254 - RNA, 24 nt, Human
cacuaccuggaagauuauuuggca

SEQ ID NO: 246255 - RNA, 25 nt, Human
cauuucaggcccacggaggugagag

SEQ ID NO: 246256 - RNA, 25 nt, Human
cauuucaggcccacggaggugagag

SEQ ID NO: 246257 - RNA, 28 nt, Human
cauuuuaucaucuaagcaggcaauccua

SEQ ID NO: 246258 - RNA, 28 nt, Human
cauuuuaucaucuaagcaggcaauccua

SEQ ID NO: 246259 - RNA, 18 nt, Human
ccaaagugcuagaugggc

SEQ ID NO: 246260 - RNA, 18 nt, Human
ccaaagugcuagaugggc

SEQ ID NO: 246261 - RNA, 19 nt, Human
cgaugaagacugagaagga

SEQ ID NO: 246262 - RNA, 21 nt, Human
cuaacugcucaccugaaauga

SEQ ID NO: 246263 - RNA, 21 nt, Human
cuaacugcucaccugaaauga

SEQ ID NO: 246264 - RNA, 22 nt, Human
cucccaagcauuucaggcccac

SEQ ID NO: 246265 - RNA, 22 nt, Human
cucccaagcauuucaggcccac

SEQ ID NO: 246266 - RNA, 22 nt, Human
cuucugaaauacaaaagauaga

SEQ ID NO: 246267 - RNA, 22 nt, Human
cuucugaaauacaaaagauaga

SEQ ID NO: 246268 - RNA, 22 nt, Human
gaucgaugaagacugagaagga

SEQ ID NO: 246269 - RNA, 20 nt, Human
ggcaaggcauuguguuucuu

SEQ ID NO: 246270 - RNA, 21 nt, Human
gggcaaggcauuguguuucuu

SEQ ID NO: 246271 - RNA, 21 nt, Human
gucugaggccagcgucugcuc

SEQ ID NO: 246272 - RNA, 22 nt, Human
uaaaagggaauaagauaugaua

SEQ ID NO: 246273 - RNA, 22 nt, Human
uaaaagggaauaagauaugaua

SEQ ID NO: 246274 - RNA, 22 nt, Human
uaaccuaucaucgacagccuuc

SEQ ID NO: 246275 - RNA, 19 nt, Human
uauaugucuucugaaauac

SEQ ID NO: 246276 - RNA, 19 nt, Human
uauaugucuucugaaauac

SEQ ID NO: 246277 - RNA, 21 nt, Human
ucccaagcauuucaggcccac

SEQ ID NO: 246278 - RNA, 21 nt, Human
ucccaagcauuucaggcccac

SEQ ID NO: 246279 - RNA, 21 nt, Human
ucucuagaaguguggcuugca

SEQ ID NO: 246280 - RNA, 21 nt, Human
ucucuagaaguguggcuugca

SEQ ID NO: 246281 - RNA, 20 nt, Human
ucugaaauacaaaagauaga

SEQ ID NO: 246282 - RNA, 21 nt, Human
ugaaaugucauugaucgauga

SEQ ID NO: 246283 - RNA, 20 nt, Human
ugagaaacugucacuaguac

SEQ ID NO: 246284 - RNA, 20 nt, Human
ugagaaacugucacuaguac

SEQ ID NO: 246285 - RNA, 22 nt, Human
ugagaguuccuucaaugcugac

SEQ ID NO: 246286 - RNA, 22 nt, Human
ugagaguuccuucaaugcugac

SEQ ID NO: 246287 - RNA, 22 nt, Human
ugcaauaucccgaagggugggc

SEQ ID NO: 246288 - RNA, 18 nt, Human
ugcuauuucuaaccuauc

SEQ ID NO: 246289 - RNA, 18 nt, Human
ugcucaccugaaaugauc

SEQ ID NO: 246290 - RNA, 18 nt, Human
ugcucaccugaaaugauc

SEQ ID NO: 246291 - RNA, 20 nt, Human
ugucacuaguacaauuugaa

SEQ ID NO: 246292 - RNA, 20 nt, Human
ugucacuaguacaauuugaa

SEQ ID NO: 246293 - RNA, 22 nt, Human
uuuaaauacugauuuccaaagu

SEQ ID NO: 246294 - RNA, 22 nt, Human
uuuaaauacugauuuccaaagu

SEQ ID NO: 246295 - RNA, 22 nt, Human
uuuuuuuuuuuuuuuuuuaaag

SEQ ID NO: 246296 - RNA, 22 nt, Human
uuuuuuuuuuuuuuuuuuaaag

SEQ ID NO: 246297 - RNA, 20 nt, Human
aaaaaacccugucaagaaag

SEQ ID NO: 246298 - RNA, 30 nt, Human
aaaaggccacaaaagagaaauagcaccacc

SEQ ID NO: 246299 - RNA, 23 nt, Human
aaaagucuaaaaggccacaaaag

SEQ ID NO: 246300 - RNA, 18 nt, Human
aaaccuaaaagacaguaa

SEQ ID NO: 246301 - RNA, 25 nt, Human
aaagaccagguggaaaauggguucc

SEQ ID NO: 246302 - RNA, 20 nt, Human
aaagcaaaugagggagaguu

SEQ ID NO: 246303 - RNA, 21 nt, Human
aaagcuccuaacucaaacuua

SEQ ID NO: 246304 - RNA, 21 nt, Human
aaaugcucaaugaaaccaagc

SEQ ID NO: 246305 - RNA, 22 nt, Human
aaaugcucaaugaaaccaagcu

SEQ ID NO: 246306 - RNA, 20 nt, Human
aaaugggauacaauccccau

SEQ ID NO: 246307 - RNA, 24 nt, Human
aaauguuccuuuuagaccaaagcc

SEQ ID NO: 246308 - RNA, 19 nt, Human
aacaaaagucuaaaaggcc

SEQ ID NO: 246309 - RNA, 20 nt, Human
aaggaacugaauaggcugug

SEQ ID NO: 246310 - RNA, 22 nt, Human
aaggaacugaauaggcuguggg

SEQ ID NO: 246311 - RNA, 18 nt, Human
accucagcauauuacaua

SEQ ID NO: 246312 - RNA, 20 nt, Human
accugccugcugcacuucca

SEQ ID NO: 246313 - RNA, 22 nt, Human
agaaaccagugaguccucuaag

SEQ ID NO: 246314 - RNA, 19 nt, Human
agaauccugccaaacaaag

SEQ ID NO: 246315 - RNA, 21 nt, Human
agagaagagaaacgugguaaa

SEQ ID NO: 246316 - RNA, 22 nt, Human
agauaccgaaaacaccccagcc

SEQ ID NO: 246317 - RNA, 20 nt, Human
aucucagggcugaaacacau

SEQ ID NO: 246318 - RNA, 19 nt, Human
auuuugcagaauccugcca

SEQ ID NO: 246319 - RNA, 20 nt, Human
caaaggaacugaauaggcug

SEQ ID NO: 246320 - RNA, 23 nt, Human
cacaaugucaaacgcaaaaucuc

SEQ ID NO: 246321 - RNA, 19 nt, Human
cacugaccacucccuuugc

SEQ ID NO: 246322 - RNA, 21 nt, Human
cacugcccgcaaccggcuccg

SEQ ID NO: 246323 - RNA, 18 nt, Human
cagaaagaacuugcagca

SEQ ID NO: 246324 - RNA, 19 nt, Human
cagaauccugccaaacaaa

SEQ ID NO: 246325 - RNA, 22 nt, Human
cagauaccgaaaacaccccagc

SEQ ID NO: 246326 - RNA, 21 nt, Human
cagaucccaagguaacgaugg

SEQ ID NO: 246327 - RNA, 21 nt, Human
cagcaaacuucaaggagccaa

SEQ ID NO: 246328 - RNA, 22 nt, Human
cagcagauaccgaaaacacccc

SEQ ID NO: 246329 - RNA, 22 nt, Human
caggacaagcuaccaccagaaa

SEQ ID NO: 246330 - RNA, 18 nt, Human
cauuuugcagaauccugc

SEQ ID NO: 246331 - RNA, 23 nt, Human
ccaaacaaaggaacugaauaggc

SEQ ID NO: 246332 - RNA, 25 nt, Human
ccaaagccuaggccuaugaggguuc

SEQ ID NO: 246333 - RNA, 19 nt, Human
ccaaauaacuuuacagggc

SEQ ID NO: 246334 - RNA, 21 nt, Human
ccacugcccgcaaccggcucc

SEQ ID NO: 246335 - RNA, 25 nt, Human
ccacugcccgcaaccggcuccgguu

SEQ ID NO: 246336 - RNA, 21 nt, Human
cccacggucagccucucuguu

SEQ ID NO: 246337 - RNA, 23 nt, Human
cccgcauccgcauggugagcccc

SEQ ID NO: 246338 - RNA, 19 nt, Human
ccugcugcacuuccaacuc

SEQ ID NO: 246339 - RNA, 24 nt, Human
ccuucacugaccacucccuuugcc

SEQ ID NO: 246340 - RNA, 21 nt, Human
ccuuugccagagguccagaaa

SEQ ID NO: 246341 - RNA, 26 nt, Human
cgaaaacaccccagccuggcagaucc

SEQ ID NO: 246342 - RNA, 19 nt, Human
cgcguccacugcccgcaac

SEQ ID NO: 246343 - RNA, 21 nt, Human
cgggauaacuggaaaaauaga

SEQ ID NO: 246344 - RNA, 19 nt, Human
cugaccacucccuuugcca

SEQ ID NO: 246345 - RNA, 21 nt, Human
gacaagcuaccaccagaaaca

SEQ ID NO: 246346 - RNA, 20 nt, Human
gauuucacauuagcuuaaaa

SEQ ID NO: 246347 - RNA, 22 nt, Human
gcaaacuucaaggagccaaaga

SEQ ID NO: 246348 - RNA, 21 nt, Human
gcaaagcaaaugagggagagu

SEQ ID NO: 246349 - RNA, 19 nt, Human
gccugcugcacuuccaacu

SEQ ID NO: 246350 - RNA, 22 nt, Human
ggacaagcuaccaccagaaaca

SEQ ID NO: 246351 - RNA, 22 nt, Human
ggcaaggggagcagagaagaga

SEQ ID NO: 246352 - RNA, 18 nt, Human
guagaaaaaaacccuguc

SEQ ID NO: 246353 - RNA, 21 nt, Human
uaaaaaacugggcacaccuca

SEQ ID NO: 246354 - RNA, 23 nt, Human
uaaaaggccacaaaagagaaaua

SEQ ID NO: 246355 - RNA, 19 nt, Human
uaaaccuaaaagacaguaa

SEQ ID NO: 246356 - RNA, 21 nt, Human
uaaaccuaaaagacaguaaaa

SEQ ID NO: 246357 - RNA, 24 nt, Human
uaaauguuccuuuuagaccaaagc

SEQ ID NO: 246358 - RNA, 19 nt, Human
uaagaccuguugacagcag

SEQ ID NO: 246359 - RNA, 28 nt, Human
uagggcaacaaaagucuaaaaggccaca

SEQ ID NO: 246360 - RNA, 19 nt, Human
ucaagcagcccuguaagac

SEQ ID NO: 246361 - RNA, 20 nt, Human
ucaaggagccaaagaggagu

SEQ ID NO: 246362 - RNA, 22 nt, Human
uccacugaggucgccaccucag

SEQ ID NO: 246363 - RNA, 28 nt, Human
uccagaaagaacuugcagcaugaucacc

SEQ ID NO: 246364 - RNA, 18 nt, Human
ucccagacacaaugucaa

SEQ ID NO: 246365 - RNA, 22 nt, Human
uccgauguugcucugcuggucc

SEQ ID NO: 246366 - RNA, 24 nt, Human
ugaaaagaaaccagugaguccucu

SEQ ID NO: 246367 - RNA, 23 nt, Human
ugaacagcagauaccgaaaacac

SEQ ID NO: 246368 - RNA, 24 nt, Human
ugaaccaacuagauguuaauacug

SEQ ID NO: 246369 - RNA, 18 nt, Human
ugaaucuggguuuuccuc

SEQ ID NO: 246370 - RNA, 19 nt, Human
ugagacacauuuugcagaa

SEQ ID NO: 246371 - RNA, 22 nt, Human
ugagccccacggucaggacccu

SEQ ID NO: 246372 - RNA, 20 nt, Human
ugauuuggagugaagaauuc

SEQ ID NO: 246373 - RNA, 20 nt, Human
ugccucuugcuuuuuagcug

SEQ ID NO: 246374 - RNA, 21 nt, Human
ugccucuugcuuuuuagcugg

SEQ ID NO: 246375 - RNA, 22 nt, Human
ugcucaaugaaaccaagcucuu

SEQ ID NO: 246376 - RNA, 20 nt, Human
uggcagaucccaagguaacu

SEQ ID NO: 246377 - RNA, 18 nt, Human
ugggaugcaauuggucaa

SEQ ID NO: 246378 - RNA, 22 nt, Human
uuagggcaacaaaagucuaaaa

SEQ ID NO: 246379 - RNA, 24 nt, Human
uucaauucagucuuuacauuucuc

SEQ ID NO: 246380 - RNA, 22 nt, Human
uuccuuuuagaccaaagccuag

SEQ ID NO: 246381 - RNA, 25 nt, Human
uuuaaaguagaaaaaaacccuguca

SEQ ID NO: 246382 - RNA, 20 nt, Human
uuuaaauacucuuaaggcau

SEQ ID NO: 246383 - RNA, 26 nt, Human
uuuaagaagagguacuuuuugcuuau

SEQ ID NO: 246384 - RNA, 23 nt, Human
uuuuaaauguuccuuuuagacca

SEQ ID NO: 246385 - RNA, 21 nt, Human
uuuuacaguuaagcacaugau

SEQ ID NO: 246386 - RNA, 19 nt, Human
uuuuggcauuguuaaucac

SEQ ID NO: 246387 - RNA, 23 nt, Human
aaaaaugccaauauaaauaccau

SEQ ID NO: 246388 - RNA, 20 nt, Human
aaaauaaggaaugcuuuuaa

SEQ ID NO: 246389 - RNA, 22 nt, Human
aaagagcagaaccaaucucaag

SEQ ID NO: 246390 - RNA, 18 nt, Human
aaagaggcaaagacuugg

SEQ ID NO: 246391 - RNA, 18 nt, Human
aaauaccauauaucaaau

SEQ ID NO: 246392 - RNA, 18 nt, Human
aagcaccacaaaugugug

SEQ ID NO: 246393 - RNA, 23 nt, Human
aagcaccacaaaugugugugacc

SEQ ID NO: 246394 - RNA, 25 nt, Human
aaggaaaaaauaaaaauaaagaaaa

SEQ ID NO: 246395 - RNA, 23 nt, Human
aaguaaaccuaaaguuagaaacc

SEQ ID NO: 246396 - RNA, 24 nt, Human
aauauaaauaccauauaucaaauu

SEQ ID NO: 246397 - RNA, 18 nt, Human
aaugaggcaggaagaccc

SEQ ID NO: 246398 - RNA, 19 nt, Human
acccugagaaagaaaagag

SEQ ID NO: 246399 - RNA, 18 nt, Human
agaaaaaaaagaggcaaa

SEQ ID NO: 246400 - RNA, 21 nt, Human
agaaaagagcauaaccuggga

SEQ ID NO: 246401 - RNA, 22 nt, Human
agaaaccaaggugaaaugaaug

SEQ ID NO: 246402 - RNA, 23 nt, Human
agaaagaaaagagcauaaccugg

SEQ ID NO: 246403 - RNA, 21 nt, Human
agagcagaaccaaucucaagc

SEQ ID NO: 246404 - RNA, 23 nt, Human
agaggaaugaggcaggaagaccc

SEQ ID NO: 246405 - RNA, 18 nt, Human
agccuuggagcucagggc

SEQ ID NO: 246406 - RNA, 24 nt, Human
aggaaaaaauaaaaauaaagaaaa

SEQ ID NO: 246407 - RNA, 21 nt, Human
aggaagacccguaccuaacca

SEQ ID NO: 246408 - RNA, 20 nt, Human
aggaagguggcugcgucuuc

SEQ ID NO: 246409 - RNA, 22 nt, Human
aggcaggaagacccguaccuaa

SEQ ID NO: 246410 - RNA, 20 nt, Human
agugucaagagcagccgggg

SEQ ID NO: 246411 - RNA, 19 nt, Human
auccaggaagggauaccau

SEQ ID NO: 246412 - RNA, 19 nt, Human
auccauuuuuucccuuuag

SEQ ID NO: 246413 - RNA, 24 nt, Human
augaccuuauguuuucccccacga

SEQ ID NO: 246414 - RNA, 19 nt, Human
caaguaucuguuucccuuu

SEQ ID NO: 246415 - RNA, 19 nt, Human
cacauuuguuucuuguuuu

SEQ ID NO: 246416 - RNA, 18 nt, Human
cagaagaaacguucccac

SEQ ID NO: 246417 - RNA, 21 nt, Human
caggaagggauaccaucuguc

SEQ ID NO: 246418 - RNA, 20 nt, Human
cauaucaaguaucuguuucc

SEQ ID NO: 246419 - RNA, 19 nt, Human
cccacacacaauggaaguu

SEQ ID NO: 246420 - RNA, 20 nt, Human
cccacgacacaagucaccgu

SEQ ID NO: 246421 - RNA, 19 nt, Human
cccgcucgcucgccucucc

SEQ ID NO: 246422 - RNA, 19 nt, Human
ccgcugugggcuggcuggu

SEQ ID NO: 246423 - RNA, 23 nt, Human
cuaauacaccuuagcaaagaaaa

SEQ ID NO: 246424 - RNA, 18 nt, Human
cuccgcacggaccgugcc

SEQ ID NO: 246425 - RNA, 24 nt, Human
cucgcucgccucuccgcacggacc

SEQ ID NO: 246426 - RNA, 19 nt, Human
cugcccaccaaagaggacc

SEQ ID NO: 246427 - RNA, 18 nt, Human
cugggcccugaaauccua

SEQ ID NO: 246428 - RNA, 24 nt, Human
cugguuucuguugagcuuggggcc

SEQ ID NO: 246429 - RNA, 22 nt, Human
cuugcaaacaucaaagcaccac

SEQ ID NO: 246430 - RNA, 20 nt, Human
gaaccaaucucaagcagcca

SEQ ID NO: 246431 - RNA, 21 nt, Human
gcugcccaccaaagaggaccc

SEQ ID NO: 246432 - RNA, 19 nt, Human
gcugugggcuggcugguga

SEQ ID NO: 246433 - RNA, 23 nt, Human
ggaaaguggggugggcacauuug

SEQ ID NO: 246434 - RNA, 18 nt, Human
gguguuggggugggaaag

SEQ ID NO: 246435 - RNA, 22 nt, Human
gugacccuacgaucucucgggu

SEQ ID NO: 246436 - RNA, 20 nt, Human
guguggcauggugcagagcc

SEQ ID NO: 246437 - RNA, 18 nt, Human
guguguggcauggugcag

SEQ ID NO: 246438 - RNA, 22 nt, Human
uaaaccuaaaguuagaaaccaa

SEQ ID NO: 246439 - RNA, 22 nt, Human
uaauacaccuuagcaaagaaaa

SEQ ID NO: 246440 - RNA, 24 nt, Human
ucaaaacuaacaacauacugugua

SEQ ID NO: 246441 - RNA, 19 nt, Human
ucacaccaggauaaaaaga

SEQ ID NO: 246442 - RNA, 21 nt, Human
ucagagguuagacuugcaaac

SEQ ID NO: 246443 - RNA, 18 nt, Human
ucccacacacaauggaag

SEQ ID NO: 246444 - RNA, 22 nt, Human
ucccccacgacacaagucaccg

SEQ ID NO: 246445 - RNA, 22 nt, Human
uccgcacggaccgugccugccg

SEQ ID NO: 246446 - RNA, 18 nt, Human
ucggguagguggccagag

SEQ ID NO: 246447 - RNA, 19 nt, Human
ucuccagaagaaacguucc

SEQ ID NO: 246448 - RNA, 27 nt, Human
ucuccgcacggaccgugccugccgccu

SEQ ID NO: 246449 - RNA, 19 nt, Human
ucucucggguagguggcca

SEQ ID NO: 246450 - RNA, 18 nt, Human
ugaaugacaguuuugugg

SEQ ID NO: 246451 - RNA, 20 nt, Human
ugagaaagaaaagagcauaa

SEQ ID NO: 246452 - RNA, 21 nt, Human
ugaggcaggaagacccguacc

SEQ ID NO: 246453 - RNA, 24 nt, Human
ugccaauauaaauaccauauauca

SEQ ID NO: 246454 - RNA, 21 nt, Human
uggaaagagacuaagaaaaug

SEQ ID NO: 246455 - RNA, 22 nt, Human
uggcaacaucucggggaguggc

SEQ ID NO: 246456 - RNA, 20 nt, Human
uggcugcgucuucccgcucg

SEQ ID NO: 246457 - RNA, 19 nt, Human
ugggaaaugggcuacaugg

SEQ ID NO: 246458 - RNA, 18 nt, Human
uggguugaaaaaugccaa

SEQ ID NO: 246459 - RNA, 21 nt, Human
uguguggcauggugcagagcc

SEQ ID NO: 246460 - RNA, 18 nt, Human
uguugcaccugcuaaguc

SEQ ID NO: 246461 - RNA, 25 nt, Human
uguuggggugggaaagaguuguucu

SEQ ID NO: 246462 - RNA, 21 nt, Human
uuaguuaaaaaauaaggaaug

SEQ ID NO: 246463 - RNA, 19 nt, Human
uucccacacacaauggaag

SEQ ID NO: 246464 - RNA, 21 nt, Human
uuggaaagagacuaagaaaau

SEQ ID NO: 246465 - RNA, 23 nt, Human
uuggaaagagacuaagaaaaugu

SEQ ID NO: 246466 - RNA, 24 nt, Human
uugggagucauagauuuuucugug

SEQ ID NO: 246467 - RNA, 22 nt, Human
aaaagaacagguaaagugcaag

SEQ ID NO: 246468 - RNA, 23 nt, Human
aagcagacagacaauggggucca

SEQ ID NO: 246469 - RNA, 18 nt, Human
acagcagagagacaacgg

SEQ ID NO: 246470 - RNA, 20 nt, Human
acagcagagagacaacggaa

SEQ ID NO: 246471 - RNA, 21 nt, Human
accaacugggccagcaccacc

SEQ ID NO: 246472 - RNA, 21 nt, Human
acccugggaaguguugggcga

SEQ ID NO: 246473 - RNA, 22 nt, Human
acugcgccggagcccgugcugu

SEQ ID NO: 246474 - RNA, 19 nt, Human
agcacuaccuccucagccc

SEQ ID NO: 246475 - RNA, 18 nt, Human
agcagguggcuggcuggg

SEQ ID NO: 246476 - RNA, 20 nt, Human
agcccgugcugucagcucug

SEQ ID NO: 246477 - RNA, 22 nt, Human
agcuacugagaagccaaaagac

SEQ ID NO: 246478 - RNA, 19 nt, Human
aggcggagggggaggggac

SEQ ID NO: 246479 - RNA, 22 nt, Human
aggcggagggggaggggacagg

SEQ ID NO: 246480 - RNA, 18 nt, Human
agggagggaggcacgggg

SEQ ID NO: 246481 - RNA, 21 nt, Human
agggcaggugggaagcagaca

SEQ ID NO: 246482 - RNA, 25 nt, Human
aggugggaagcagacagacaauggg

SEQ ID NO: 246483 - RNA, 21 nt, Human
augcaggcuggugcccgaggg

SEQ ID NO: 246484 - RNA, 22 nt, Human
auuuccaucccucacaugcccc

SEQ ID NO: 246485 - RNA, 21 nt, Human
caaaauaaauuagaaugggug

SEQ ID NO: 246486 - RNA, 20 nt, Human
caacugggccagcaccaccc

SEQ ID NO: 246487 - RNA, 21 nt, Human
caacugggccagcaccaccca

SEQ ID NO: 246488 - RNA, 18 nt, Human
cagcccccucucccucuc

SEQ ID NO: 246489 - RNA, 22 nt, Human
cagcgcugggauucagugcugg

SEQ ID NO: 246490 - RNA, 20 nt, Human
cagucagccagggcugcggc

SEQ ID NO: 246491 - RNA, 18 nt, Human
cauggcauguacuuuuac

SEQ ID NO: 246492 - RNA, 22 nt, Human
ccaugcccccaagccccccucg

SEQ ID NO: 246493 - RNA, 24 nt, Human
ccaugcccccaagccccccucgcc

SEQ ID NO: 246494 - RNA, 22 nt, Human
ccccaugcccccaagccccccc

SEQ ID NO: 246495 - RNA, 24 nt, Human
ccccaugcccccaagccccccucg

SEQ ID NO: 246496 - RNA, 18 nt, Human
cccccaagccccccucgc

SEQ ID NO: 246497 - RNA, 21 nt, Human
cccccucccuuucccugaccc

SEQ ID NO: 246498 - RNA, 20 nt, Human
ccccucccuuucccugaccc

SEQ ID NO: 246499 - RNA, 19 nt, Human
ccccugggccuacagcacu

SEQ ID NO: 246500 - RNA, 19 nt, Human
cccucacaugccccccucc

SEQ ID NO: 246501 - RNA, 24 nt, Human
ccucccuuucccugacccccuggg

SEQ ID NO: 246502 - RNA, 24 nt, Human
ccugacaucagccuuccccuuagc

SEQ ID NO: 246503 - RNA, 24 nt, Human
cgacacagcagagagacaacggaa

SEQ ID NO: 246504 - RNA, 21 nt, Human
cgaggcggcuccggcggaggc

SEQ ID NO: 246505 - RNA, 21 nt, Human
cggaaauaaauagggugggug

SEQ ID NO: 246506 - RNA, 21 nt, Human
cggccggcggcuccggggcgg

SEQ ID NO: 246507 - RNA, 19 nt, Human
cggcuccggcggaggcgga

SEQ ID NO: 246508 - RNA, 23 nt, Human
cuccccagugcugcagcacugac

SEQ ID NO: 246509 - RNA, 18 nt, Human
cuccucagcccccucucc

SEQ ID NO: 246510 - RNA, 23 nt, Human
cuggugcccgaggggcagggggu

SEQ ID NO: 246511 - RNA, 18 nt, Human
gaagccaagccaggcaca

SEQ ID NO: 246512 - RNA, 23 nt, Human
gacaaugggguccaggcagaguu

SEQ ID NO: 246513 - RNA, 19 nt, Human
gagaagccaaaagacaaaa

SEQ ID NO: 246514 - RNA, 19 nt, Human
gagggaguggcugggggcc

SEQ ID NO: 246515 - RNA, 19 nt, Human
gcagggagggaggcacggg

SEQ ID NO: 246516 - RNA, 21 nt, Human
gcccgaggggcaggggguggg

SEQ ID NO: 246517 - RNA, 25 nt, Human
gcgacacagcagagagacaacggaa

SEQ ID NO: 246518 - RNA, 18 nt, Human
gcgccggagcccgugcug

SEQ ID NO: 246519 - RNA, 19 nt, Human
gcugggggccucagggcag

SEQ ID NO: 246520 - RNA, 24 nt, Human
ggcaggggguggggagggcaggug

SEQ ID NO: 246521 - RNA, 20 nt, Human
gggcaggggguggggagggc

SEQ ID NO: 246522 - RNA, 19 nt, Human
gggggcgcugcggcagagg

SEQ ID NO: 246523 - RNA, 21 nt, Human
ggggguggggagggcaggugg

SEQ ID NO: 246524 - RNA, 25 nt, Human
ggggguggggagggcaggugggaag

SEQ ID NO: 246525 - RNA, 22 nt, Human
gggugggugagccuggugccag

SEQ ID NO: 246526 - RNA, 22 nt, Human
gguaaagugcaaggagaaucca

SEQ ID NO: 246527 - RNA, 22 nt, Human
gucaggagcagguggcuggcug

SEQ ID NO: 246528 - RNA, 22 nt, Human
gugcugcagcacugacacaaag

SEQ ID NO: 246529 - RNA, 19 nt, Human
uaccacacaaguuuauuua

SEQ ID NO: 246530 - RNA, 18 nt, Human
uaccccagcccccagcca

SEQ ID NO: 246531 - RNA, 23 nt, Human
uacugagaagccaaaagacaaaa

SEQ ID NO: 246532 - RNA, 19 nt, Human
uaggaaaggacuauaaugg

SEQ ID NO: 246533 - RNA, 20 nt, Human
ucaaauacacagcugcuggc

SEQ ID NO: 246534 - RNA, 19 nt, Human
ucccucacaugccccccuc

SEQ ID NO: 246535 - RNA, 19 nt, Human
ugaacacauaugcaggcug

SEQ ID NO: 246536 - RNA, 20 nt, Human
ugaacacauaugcaggcugg

SEQ ID NO: 246537 - RNA, 22 nt, Human
ugagaagccaaaagacaaaaua

SEQ ID NO: 246538 - RNA, 18 nt, Human
ugaguccuaccccagccc

SEQ ID NO: 246539 - RNA, 24 nt, Human
ugcaggcuggugcccgaggggcag

SEQ ID NO: 246540 - RNA, 22 nt, Human
ugcccgaggggcaggggguggg

SEQ ID NO: 246541 - RNA, 22 nt, Human
ugcugucagcucuggaaaagaa

SEQ ID NO: 246542 - RNA, 18 nt, Human
uggcagcagcacccuggg

SEQ ID NO: 246543 - RNA, 19 nt, Human
uggcuggggcggguggcag

SEQ ID NO: 246544 - RNA, 19 nt, Human
uggcugggggccucagggc

SEQ ID NO: 246545 - RNA, 21 nt, Human
uggcugggggccucagggcag

SEQ ID NO: 246546 - RNA, 20 nt, Human
ugggaaguguugggcgacac

SEQ ID NO: 246547 - RNA, 23 nt, Human
ugggauucagugcuggggcaggg

SEQ ID NO: 246548 - RNA, 20 nt, Human
ugggccagcaccacccagga

SEQ ID NO: 246549 - RNA, 21 nt, Human
uggggagggcaggugggaagc

SEQ ID NO: 246550 - RNA, 24 nt, Human
ugggguccaggcagaguuugugug

SEQ ID NO: 246551 - RNA, 21 nt, Human
uggugccaggaggucauuucc

SEQ ID NO: 246552 - RNA, 22 nt, Human
uguggugaaccaggcugcugga

SEQ ID NO: 246553 - RNA, 23 nt, Human
uguguggugaaccaggcugcugg

SEQ ID NO: 246554 - RNA, 23 nt, Human
uuccggccccaugcccccaagcc

SEQ ID NO: 246555 - RNA, 20 nt, Human
aacccgcugucccuucuccc

SEQ ID NO: 246556 - RNA, 21 nt, Human
aacccgcugucccuucuccca

SEQ ID NO: 246557 - RNA, 21 nt, Human
aagaggccagcgcucucaaga

SEQ ID NO: 246558 - RNA, 22 nt, Human
aagaggccagcgcucucaagac

SEQ ID NO: 246559 - RNA, 19 nt, Human
aagcagcuuucagagccuc

SEQ ID NO: 246560 - RNA, 19 nt, Human
aaggaggucaucaucgaag

SEQ ID NO: 246561 - RNA, 18 nt, Human
aagucccgagccaaagcc

SEQ ID NO: 246562 - RNA, 21 nt, Human
acaacagcacagcggcgcaga

SEQ ID NO: 246563 - RNA, 18 nt, Human
acacacuccagagaugcc

SEQ ID NO: 246564 - RNA, 18 nt, Human
acacucacacaagguuga

SEQ ID NO: 246565 - RNA, 19 nt, Human
acacucacacaagguugac

SEQ ID NO: 246566 - RNA, 24 nt, Human
acccccacaacagggccagaggug

SEQ ID NO: 246567 - RNA, 19 nt, Human
acccccagucccuugaaau

SEQ ID NO: 246568 - RNA, 19 nt, Human
acucacacaagguugacau

SEQ ID NO: 246569 - RNA, 23 nt, Human
acugccucugugacaacccccac

SEQ ID NO: 246570 - RNA, 19 nt, Human
agaaaaaagaaucaaaagg

SEQ ID NO: 246571 - RNA, 19 nt, Human
agaagguggcugugguggc

SEQ ID NO: 246572 - RNA, 26 nt, Human
agagaugccaguggcccaggcuugga

SEQ ID NO: 246573 - RNA, 23 nt, Human
agcagcugggggcagagggcggg

SEQ ID NO: 246574 - RNA, 25 nt, Human
agcagcugggggcagagggcggggg

SEQ ID NO: 246575 - RNA, 19 nt, Human
agcaggcccccacccccgg

SEQ ID NO: 246576 - RNA, 18 nt, Human
agccccugccucggccuc

SEQ ID NO: 246577 - RNA, 20 nt, Human
agcggaggaggagaaggugg

SEQ ID NO: 246578 - RNA, 22 nt, Human
agcugggggcagagggcggggg

SEQ ID NO: 246579 - RNA, 21 nt, Human
aggaaauguuggauguggcca

SEQ ID NO: 246580 - RNA, 20 nt, Human
aggagaagguggcuguggug

SEQ ID NO: 246581 - RNA, 21 nt, Human
aggagcagcugggggcagagg

SEQ ID NO: 246582 - RNA, 21 nt, Human
aggcccccacccccggccacc

SEQ ID NO: 246583 - RNA, 30 nt, Human
aggcgaggacgggagaggacagcggaggaa

SEQ ID NO: 246584 - RNA, 19 nt, Human
agggagggaggaagaggcc

SEQ ID NO: 246585 - RNA, 21 nt, Human
agguggcugugguggcggcgg

SEQ ID NO: 246586 - RNA, 23 nt, Human
aucaucgaagugccaacccuccu

SEQ ID NO: 246587 - RNA, 22 nt, Human
cacccccagucccuugaaaucc

SEQ ID NO: 246588 - RNA, 19 nt, Human
cacuccagagaugccagug

SEQ ID NO: 246589 - RNA, 22 nt, Human
cacugacccacagcaggccccc

SEQ ID NO: 246590 - RNA, 24 nt, Human
cacugccucugugacaacccccac

SEQ ID NO: 246591 - RNA, 21 nt, Human
cagaaggugggcgguggcagc

SEQ ID NO: 246592 - RNA, 18 nt, Human
cagcaggcccccaccccc

SEQ ID NO: 246593 - RNA, 22 nt, Human
cagcaggcccccacccccggcc

SEQ ID NO: 246594 - RNA, 19 nt, Human
cagccccugccucggccuc

SEQ ID NO: 246595 - RNA, 22 nt, Human
cagcgcucucaagacaucaagg

SEQ ID NO: 246596 - RNA, 20 nt, Human
cagcggcaaggagggggaug

SEQ ID NO: 246597 - RNA, 19 nt, Human
caggcgcccuacccugcag

SEQ ID NO: 246598 - RNA, 18 nt, Human
cagguggcauaggccuug

SEQ ID NO: 246599 - RNA, 22 nt, Human
ccaaagccgagugacaaaagca

SEQ ID NO: 246600 - RNA, 22 nt, Human
ccaggucugcaaaguggccaaa

SEQ ID NO: 246601 - RNA, 22 nt, Human
cccacaacagggccagaggugg

SEQ ID NO: 246602 - RNA, 27 nt, Human
cccacaacagggccagaggugguugau

SEQ ID NO: 246603 - RNA, 19 nt, Human
cccacccaucaauuuggaa

SEQ ID NO: 246604 - RNA, 20 nt, Human
cccaccccaacccccgucac

SEQ ID NO: 246605 - RNA, 31 nt, Human
cccagccccugccucggccucccccguggcc

SEQ ID NO: 246606 - RNA, 21 nt, Human
ccccaacccccgucacacuca

SEQ ID NO: 246607 - RNA, 22 nt, Human
ccccacacacuccagagaugcc

SEQ ID NO: 246608 - RNA, 22 nt, Human
ccccaccccaacccccgucaca

SEQ ID NO: 246609 - RNA, 20 nt, Human
ccccacccccggccaccaag

SEQ ID NO: 246610 - RNA, 28 nt, Human
ccccagaagcagcuuucagagccucucc

SEQ ID NO: 246611 - RNA, 18 nt, Human
cccccagucccuugaaau

SEQ ID NO: 246612 - RNA, 21 nt, Human
ccccucugcccagccccugcc

SEQ ID NO: 246613 - RNA, 22 nt, Human
cccgagccaaagccgagugaca

SEQ ID NO: 246614 - RNA, 18 nt, Human
cccgccccaccccaaccc

SEQ ID NO: 246615 - RNA, 20 nt, Human
cccgccccaccccaaccccc

SEQ ID NO: 246616 - RNA, 20 nt, Human
cccucugcccagccccugcc

SEQ ID NO: 246617 - RNA, 18 nt, Human
ccgccccaccccaacccc

SEQ ID NO: 246618 - RNA, 23 nt, Human
ccgccccaccccaacccccguca

SEQ ID NO: 246619 - RNA, 23 nt, Human
ccucccagacccccacacacucc

SEQ ID NO: 246620 - RNA, 19 nt, Human
ccucccgccccaccccaac

SEQ ID NO: 246621 - RNA, 26 nt, Human
ccucccgccccaccccaacccccguc

SEQ ID NO: 246622 - RNA, 22 nt, Human
ccuccuccccucugcccagccc

SEQ ID NO: 246623 - RNA, 21 nt, Human
ccuccugccaggcuugccuuc

SEQ ID NO: 246624 - RNA, 18 nt, Human
ccucugugacaaccccca

SEQ ID NO: 246625 - RNA, 22 nt, Human
ccucugugacaacccccacaac

SEQ ID NO: 246626 - RNA, 24 nt, Human
cgccccaccccaacccccgucaca

SEQ ID NO: 246627 - RNA, 21 nt, Human
cgcggcgagagggcgcguucc

SEQ ID NO: 246628 - RNA, 24 nt, Human
cgcugcuguuggugccggagcugg

SEQ ID NO: 246629 - RNA, 20 nt, Human
cggccucccccguggccucc

SEQ ID NO: 246630 - RNA, 22 nt, Human
cgggaccugccucccagacccc

SEQ ID NO: 246631 - RNA, 24 nt, Human
cgggcggcaggcgcgagcagcggg

SEQ ID NO: 246632 - RNA, 19 nt, Human
cgguggcagcggcgcugcu

SEQ ID NO: 246633 - RNA, 18 nt, Human
cucaagacaucaagguca

SEQ ID NO: 246634 - RNA, 21 nt, Human
cuccagagaugccaguggccc

SEQ ID NO: 246635 - RNA, 22 nt, Human
cucccagacccccacacacucc

SEQ ID NO: 246636 - RNA, 19 nt, Human
cucccccguggccucccgc

SEQ ID NO: 246637 - RNA, 23 nt, Human
cucccccguggccucccgcccca

SEQ ID NO: 246638 - RNA, 19 nt, Human
cucccgccccaccccaacc

SEQ ID NO: 246639 - RNA, 21 nt, Human
cuccuccccucugcccagccc

SEQ ID NO: 246640 - RNA, 21 nt, Human
cucggccucccccguggccuc

SEQ ID NO: 246641 - RNA, 22 nt, Human
cucggccucccccguggccucc

SEQ ID NO: 246642 - RNA, 20 nt, Human
cucuccacaauuauugaccg

SEQ ID NO: 246643 - RNA, 19 nt, Human
cugggggcagagggcgggg

SEQ ID NO: 246644 - RNA, 21 nt, Human
cugguggguggcggugacugc

SEQ ID NO: 246645 - RNA, 24 nt, Human
cuucucccacaggcugcccugcag

SEQ ID NO: 246646 - RNA, 21 nt, Human
gaagugccaacccuccugcca

SEQ ID NO: 246647 - RNA, 23 nt, Human
gaagugccaacccuccugccagg

SEQ ID NO: 246648 - RNA, 18 nt, Human
gacccacagcaggccccc

SEQ ID NO: 246649 - RNA, 21 nt, Human
gaccugccucccagaccccca

SEQ ID NO: 246650 - RNA, 22 nt, Human
gaccugccucccagacccccac

SEQ ID NO: 246651 - RNA, 21 nt, Human
gagaagguggcugugguggcg

SEQ ID NO: 246652 - RNA, 25 nt, Human
gagccaaagccgagugacaaaagca

SEQ ID NO: 246653 - RNA, 21 nt, Human
gaggagaagguggcuguggug

SEQ ID NO: 246654 - RNA, 18 nt, Human
gaggagcagcugggggca

SEQ ID NO: 246655 - RNA, 31 nt, Human
gaggaggagaagguggcugugguggcggccg

SEQ ID NO: 246656 - RNA, 18 nt, Human
gccaacccuccugccagg

SEQ ID NO: 246657 - RNA, 20 nt, Human
gcccaggcuuggaaacgggu

SEQ ID NO: 246658 - RNA, 20 nt, Human
gcggcaggcgcgagcagcgg

SEQ ID NO: 246659 - RNA, 19 nt, Human
gcggcgagagggcgcguuc

SEQ ID NO: 246660 - RNA, 21 nt, Human
gcugggggcagagggcggggg

SEQ ID NO: 246661 - RNA, 18 nt, Human
gcuuucagagccucuccu

SEQ ID NO: 246662 - RNA, 23 nt, Human
ggacagcggaggaggagaaggug

SEQ ID NO: 246663 - RNA, 20 nt, Human
ggagaggacagcggaggagg

SEQ ID NO: 246664 - RNA, 18 nt, Human
ggcccaggcuuggaaacg

SEQ ID NO: 246665 - RNA, 20 nt, Human
ggcggcaggcgcgagcagcg

SEQ ID NO: 246666 - RNA, 19 nt, Human
ggcgguggcagcggcgcug

SEQ ID NO: 246667 - RNA, 19 nt, Human
gggaaggacagggggcucg

SEQ ID NO: 246668 - RNA, 21 nt, Human
gggaaggacagggggcucggg

SEQ ID NO: 246669 - RNA, 18 nt, Human
gggaaggacagggggcug

SEQ ID NO: 246670 - RNA, 21 nt, Human
gggaccugccucccagacccc

SEQ ID NO: 246671 - RNA, 20 nt, Human
ggggaagaaaaaagaaucaa

SEQ ID NO: 246672 - RNA, 19 nt, Human
ggguuucuguggagcagag

SEQ ID NO: 246673 - RNA, 20 nt, Human
gugccaacccuccugccagg

SEQ ID NO: 246674 - RNA, 19 nt, Human
gugcuuccuccuccccucu

SEQ ID NO: 246675 - RNA, 24 nt, Human
guggcccaggcuuggaaacgggug

SEQ ID NO: 246676 - RNA, 32 nt, Human
guggcggcggcagaaggugggcgguggcaaca

SEQ ID NO: 246677 - RNA, 33 nt, Human
guggcggcggcagaaggugggcgguggcaacga

SEQ ID NO: 246678 - RNA, 21 nt, Human
guggcugugguggcggcggca

SEQ ID NO: 246679 - RNA, 21 nt, Human
guggcuuccucucccacuccc

SEQ ID NO: 246680 - RNA, 20 nt, Human
gugguggcggcggcagaagg

SEQ ID NO: 246681 - RNA, 22 nt, Human
uaaaacaggguuucuguggagc

SEQ ID NO: 246682 - RNA, 18 nt, Human
uagcccuaaagucccagg

SEQ ID NO: 246683 - RNA, 23 nt, Human
ucaaaaggaauugccugaggaaa

SEQ ID NO: 246684 - RNA, 19 nt, Human
ucaaauccuuuguugcugc

SEQ ID NO: 246685 - RNA, 28 nt, Human
ucaccugauagucgacagaggcgaggac

SEQ ID NO: 246686 - RNA, 19 nt, Human
ucacugauuuugaaguccc

SEQ ID NO: 246687 - RNA, 20 nt, Human
ucaggcgcccuacccugcag

SEQ ID NO: 246688 - RNA, 24 nt, Human
ucccccagaagcagcuuucagagc

SEQ ID NO: 246689 - RNA, 21 nt, Human
ucccccguggccucccgcccc

SEQ ID NO: 246690 - RNA, 24 nt, Human
ucccgagccaaagccgagugacaa

SEQ ID NO: 246691 - RNA, 21 nt, Human
ucccgccccaccccaaccccc

SEQ ID NO: 246692 - RNA, 20 nt, Human
uccuuuguugcugccacugc

SEQ ID NO: 246693 - RNA, 21 nt, Human
ugacaacccccacaacagggc

SEQ ID NO: 246694 - RNA, 22 nt, Human
ugacaacccccacaacagggcc

SEQ ID NO: 246695 - RNA, 27 nt, Human
ugacaucgucugccuguggccguaguc

SEQ ID NO: 246696 - RNA, 24 nt, Human
ugacccacagcaggcccccacccc

SEQ ID NO: 246697 - RNA, 23 nt, Human
ugaggaaauguuggauguggcca

SEQ ID NO: 246698 - RNA, 19 nt, Human
ugaggccggcgggcggcag

SEQ ID NO: 246699 - RNA, 18 nt, Human
ugccacugccucugugac

SEQ ID NO: 246700 - RNA, 20 nt, Human
ugccaggcuugccuucucuu

SEQ ID NO: 246701 - RNA, 22 nt, Human
ugccaguggcccaggcuuggaa

SEQ ID NO: 246702 - RNA, 22 nt, Human
ugccucggccucccccguggcc

SEQ ID NO: 246703 - RNA, 23 nt, Human
ugccucggccucccccguggccu

SEQ ID NO: 246704 - RNA, 20 nt, Human
ugcgaggagcagcugggggc

SEQ ID NO: 246705 - RNA, 18 nt, Human
ugcuguuggugccggagc

SEQ ID NO: 246706 - RNA, 19 nt, Human
uggcacacugacccacagc

SEQ ID NO: 246707 - RNA, 23 nt, Human
uggcauaggccuuggcucuccca

SEQ ID NO: 246708 - RNA, 20 nt, Human
uggcccaggcuuggaaacgg

SEQ ID NO: 246709 - RNA, 25 nt, Human
uggccucccgccccaccccaacccc

SEQ ID NO: 246710 - RNA, 18 nt, Human
uggcuccacgaacacacc

SEQ ID NO: 246711 - RNA, 21 nt, Human
uggcuccacgaacacaccaaa

SEQ ID NO: 246712 - RNA, 18 nt, Human
uggcuuccucucccacuc

SEQ ID NO: 246713 - RNA, 20 nt, Human
uggcuuccucucccacuccc

SEQ ID NO: 246714 - RNA, 20 nt, Human
ugggggcagagggcgggggc

SEQ ID NO: 246715 - RNA, 21 nt, Human
ugggggcagagggcgggggcc

SEQ ID NO: 246716 - RNA, 22 nt, Human
ugggggcagagggcgggggccg

SEQ ID NO: 246717 - RNA, 23 nt, Human
ugggggcagagggcgggggccgg

SEQ ID NO: 246718 - RNA, 23 nt, Human
uggguggcggugacugcgagggc

SEQ ID NO: 246719 - RNA, 23 nt, Human
ugguggcggcggcagaagguggg

SEQ ID NO: 246720 - RNA, 21 nt, Human
ugugguggcggcggcagaagg

SEQ ID NO: 246721 - RNA, 21 nt, Human
ugugguggcggcggcagaagg

SEQ ID NO: 246722 - RNA, 23 nt, Human
ugugguggcggcggcagaaggug

SEQ ID NO: 246723 - RNA, 19 nt, Human
uuagcccuaaagucccagg

SEQ ID NO: 246724 - RNA, 23 nt, Human
uucaccugauagucgacagaggc

SEQ ID NO: 246725 - RNA, 21 nt, Human
uugaagucccgagccaaagcc

SEQ ID NO: 246726 - RNA, 20 nt, Human
uugugcuuccuccuccccuc

SEQ ID NO: 246727 - RNA, 21 nt, Human
aacagaaauacacaauauacu

SEQ ID NO: 246728 - RNA, 24 nt, Human
accacauuaggcauuaccaguaca

SEQ ID NO: 246729 - RNA, 18 nt, Human
agaggagggggagccgcu

SEQ ID NO: 246730 - RNA, 20 nt, Human
agagggaagaggacgcggag

SEQ ID NO: 246731 - RNA, 24 nt, Human
agggaagaggacgcggaguaagag

SEQ ID NO: 246732 - RNA, 22 nt, Human
caggcagaccacauuaggcauu

SEQ ID NO: 246733 - RNA, 22 nt, Human
caugugaaccuacuuuuuaagc

SEQ ID NO: 246734 - RNA, 20 nt, Human
ccccggcgggggaaagaggg

SEQ ID NO: 246735 - RNA, 21 nt, Human
cggccgggcuguggugcgggc

SEQ ID NO: 246736 - RNA, 18 nt, Human
cgggacggugcaacaagc

SEQ ID NO: 246737 - RNA, 26 nt, Human
gaacagaaaaugaacagaagggaccc

SEQ ID NO: 246738 - RNA, 30 nt, Human
gcggacaguaacgagggagggcuucgggcc

SEQ ID NO: 246739 - RNA, 22 nt, Human
uacacaauauacuuaccuguac

SEQ ID NO: 246740 - RNA, 20 nt, Human
uauuauacaacucuaugaac

SEQ ID NO: 246741 - RNA, 23 nt, Human
uuuuaagcaaucauguuuuauua

SEQ ID NO: 246742 - RNA, 24 nt, Human
uuuuuuuuuuuuuuucaaguuuuu

SEQ ID NO: 246743 - RNA, 23 nt, Human
uuuuuuuuuuuuuuuuuuucaag

SEQ ID NO: 246744 - RNA, 21 nt, Human
aaaacaaaacagcacagcccu

SEQ ID NO: 246745 - RNA, 20 nt, Human
aaacaaaacagcacagcccu

SEQ ID NO: 246746 - RNA, 26 nt, Human
aaacaaaacagcacagcccuaggagg

SEQ ID NO: 246747 - RNA, 29 nt, Human
aaacgaggaggcggaggaggagggacccc

SEQ ID NO: 246748 - RNA, 19 nt, Human
aaacgaugccgaccggcga

SEQ ID NO: 246749 - RNA, 22 nt, Human
aacaggucugugaugcccuuag

SEQ ID NO: 246750 - RNA, 18 nt, Human
aacccguugaaccccauu

SEQ ID NO: 246751 - RNA, 18 nt, Human
acugcacuuuaauucugc

SEQ ID NO: 246752 - RNA, 19 nt, Human
agaugcagacguuauugcc

SEQ ID NO: 246753 - RNA, 19 nt, Human
aggcgccguggggagggcg

SEQ ID NO: 246754 - RNA, 19 nt, Human
caaaacaaaacagcacagc

SEQ ID NO: 246755 - RNA, 21 nt, Human
caaaacaaaacagcacagccc

SEQ ID NO: 246756 - RNA, 20 nt, Human
caaaacaaaacagcacagcu

SEQ ID NO: 246757 - RNA, 22 nt, Human
cacaaugcgagggucaaaacaa

SEQ ID NO: 246758 - RNA, 20 nt, Human
cagcgccgccggcggcgccu

SEQ ID NO: 246759 - RNA, 21 nt, Human
cauuuccaucaguguucagga

SEQ ID NO: 246760 - RNA, 19 nt, Human
ccccucaccuccuucucca

SEQ ID NO: 246761 - RNA, 18 nt, Human
cccgacugcuucucccuc

SEQ ID NO: 246762 - RNA, 21 nt, Human
cccgccggcguccccuugccu

SEQ ID NO: 246763 - RNA, 22 nt, Human
cccgccggcguccccuugccuc

SEQ ID NO: 246764 - RNA, 26 nt, Human
ccucaccuccuucuccacucccuccc

SEQ ID NO: 246765 - RNA, 23 nt, Human
ccucucuagcgagcuugcugccu

SEQ ID NO: 246766 - RNA, 23 nt, Human
ccuggcccgggccgucccccggc

SEQ ID NO: 246767 - RNA, 23 nt, Human
ccuugccucagggcgccccgcga

SEQ ID NO: 246768 - RNA, 19 nt, Human
cgaagacgaucagauaccg

SEQ ID NO: 246769 - RNA, 18 nt, Human
cgaggaggcggaggagga

SEQ ID NO: 246770 - RNA, 24 nt, Human
cgagggucaaaacaaaacagcaca

SEQ ID NO: 246771 - RNA, 24 nt, Human
cgauccugggcccccucaccuccu

SEQ ID NO: 246772 - RNA, 19 nt, Human
cgccguggggagggcggcu

SEQ ID NO: 246773 - RNA, 25 nt, Human
cucucguccucagacuuuaauuuca

SEQ ID NO: 246774 - RNA, 21 nt, Human
cugccucagccuccgcccugc

SEQ ID NO: 246775 - RNA, 22 nt, Human
cugccucagccuccgcccugcu

SEQ ID NO: 246776 - RNA, 20 nt, Human
gaccauaaacgaugccgacc

SEQ ID NO: 246777 - RNA, 19 nt, Human
gagacucuggcaugcuaac

SEQ ID NO: 246778 - RNA, 20 nt, Human
gagccgagccugcgggcggc

SEQ ID NO: 246779 - RNA, 18 nt, Human
gagccugcgggcggcggg

SEQ ID NO: 246780 - RNA, 18 nt, Human
gcaaagcugaaacuuaaa

SEQ ID NO: 246781 - RNA, 22 nt, Human
gcccccucaccuccuucuccac

SEQ ID NO: 246782 - RNA, 22 nt, Human
gcccccucaccuccuucuccac

SEQ ID NO: 246783 - RNA, 18 nt, Human
gcccggacacggacagga

SEQ ID NO: 246784 - RNA, 19 nt, Human
gccgccgcgggcugugggc

SEQ ID NO: 246785 - RNA, 23 nt, Human
gcgagcuugcugccucagccucc

SEQ ID NO: 246786 - RNA, 18 nt, Human
gcggagcgcugagaagac

SEQ ID NO: 246787 - RNA, 21 nt, Human
gcuacacugacuggcucagcg

SEQ ID NO: 246788 - RNA, 19 nt, Human
gcucauucucucccugccu

SEQ ID NO: 246789 - RNA, 25 nt, Human
ggcccgggccgucccccggcggguc

SEQ ID NO: 246790 - RNA, 18 nt, Human
ggccgaggcgaggagacc

SEQ ID NO: 246791 - RNA, 18 nt, Human
ggcggccgaggcgaggag

SEQ ID NO: 246792 - RNA, 24 nt, Human
ggcggcgggcugcgcuucucgcgg

SEQ ID NO: 246793 - RNA, 22 nt, Human
ggcggcucccuucccccuacgg

SEQ ID NO: 246794 - RNA, 20 nt, Human
gucggcccacggcccuggcc

SEQ ID NO: 246795 - RNA, 22 nt, Human
uaacccguugaaccccauucgu

SEQ ID NO: 246796 - RNA, 23 nt, Human
uaagucccugcccuuuguacaca

SEQ ID NO: 246797 - RNA, 19 nt, Human
uagaucccgggccuggccc

SEQ ID NO: 246798 - RNA, 23 nt, Human
uaggaggccggcgaccagcgucc

SEQ ID NO: 246799 - RNA, 18 nt, Human
uaucuagaggaaguaaaa

SEQ ID NO: 246800 - RNA, 20 nt, Human
ucaccuccuucuccacuccc

SEQ ID NO: 246801 - RNA, 22 nt, Human
ucagccuccgcccugcuggccg

SEQ ID NO: 246802 - RNA, 20 nt, Human
uccacacagcgccgccggcg

SEQ ID NO: 246803 - RNA, 18 nt, Human
uccccaugaacgaggaau

SEQ ID NO: 246804 - RNA, 22 nt, Human
uccccaugaacgaggaauuccc

SEQ ID NO: 246805 - RNA, 24 nt, Human
ucccccaacuucuuagagggacaa

SEQ ID NO: 246806 - RNA, 18 nt, Human
ucccggggcucauucucu

SEQ ID NO: 246807 - RNA, 18 nt, Human
uccgaaaaggcgccgugg

SEQ ID NO: 246808 - RNA, 21 nt, Human
uccugggcccccucaccuccu

SEQ ID NO: 246809 - RNA, 22 nt, Human
ucggcggccgaggcgaggagac

SEQ ID NO: 246810 - RNA, 21 nt, Human
ucuagaucccgggccuggccc

SEQ ID NO: 246811 - RNA, 21 nt, Human
ucuccacucccucccgucgca

SEQ ID NO: 246812 - RNA, 18 nt, Human
ugaaggaaguggagcgca

SEQ ID NO: 246813 - RNA, 24 nt, Human
ugagaagacggucgaacuugacua

SEQ ID NO: 246814 - RNA, 19 nt, Human
ugcaaagcugaaacuuaaa

SEQ ID NO: 246815 - RNA, 20 nt, Human
ugccucagccuccgcccugc

SEQ ID NO: 246816 - RNA, 23 nt, Human
ugccucagccuccgcccugcugg

SEQ ID NO: 246817 - RNA, 20 nt, Human
ugccucagggcgccccgcga

SEQ ID NO: 246818 - RNA, 25 nt, Human
ugcgcccgacugcuucucccucucu

SEQ ID NO: 246819 - RNA, 23 nt, Human
ugcgggcggcgggcugcgcuucg

SEQ ID NO: 246820 - RNA, 26 nt, Human
ugcuucucccucucuagcgagcuugc

SEQ ID NO: 246821 - RNA, 23 nt, Human
uggcccgggccgucccccggcgg

SEQ ID NO: 246822 - RNA, 19 nt, Human
uggcucagcgugugccuac

SEQ ID NO: 246823 - RNA, 19 nt, Human
ugggcccccucaccuccuu

SEQ ID NO: 246824 - RNA, 21 nt, Human
uggguuccggggggaguaugg

SEQ ID NO: 246825 - RNA, 21 nt, Human
uguccggggcugcacgcgcgc

SEQ ID NO: 246826 - RNA, 24 nt, Human
ugugaugcccuuagauguccgggg

SEQ ID NO: 246827 - RNA, 25 nt, Human
uuacugcacuuuaauucugcacaau

SEQ ID NO: 246828 - RNA, 24 nt, Human
uuagauguccggggcugcacgcgc

SEQ ID NO: 246829 - RNA, 19 nt, Human
uuccccaugaacgaggaau

SEQ ID NO: 246830 - RNA, 22 nt, Human
uugcuacuuaauuuacaucaua

SEQ ID NO: 246831 - RNA, 22 nt, Human
agaaagcacuguccuggcccuc

SEQ ID NO: 246832 - RNA, 18 nt, Human
agcagauagaagcgccag

SEQ ID NO: 246833 - RNA, 24 nt, Human
agcagcagguccguccaggagaaa

SEQ ID NO: 246834 - RNA, 22 nt, Human
agccaauaguggcaucaaacca

SEQ ID NO: 246835 - RNA, 24 nt, Human
auagaauaccuugucuucaaaaga

SEQ ID NO: 246836 - RNA, 19 nt, Human
cagcagcagguccguccag

SEQ ID NO: 246837 - RNA, 18 nt, Human
cagcuccuaggguugcuc

SEQ ID NO: 246838 - RNA, 24 nt, Human
cauguccccaaacacucccacacc

SEQ ID NO: 246839 - RNA, 22 nt, Human
cccacaccgcggcucuuagaga

SEQ ID NO: 246840 - RNA, 23 nt, Human
ccccguguccugggccauguccc

SEQ ID NO: 246841 - RNA, 23 nt, Human
cucuguagcaaugagguggcuga

SEQ ID NO: 246842 - RNA, 24 nt, Human
cuuccaccaucucucccacugguc

SEQ ID NO: 246843 - RNA, 23 nt, Human
ggccgaauguacagcagauagaa

SEQ ID NO: 246844 - RNA, 22 nt, Human
ucaggccgaauguacagcagau

SEQ ID NO: 246845 - RNA, 22 nt, Human
ucagguacucuguagcaaugag

SEQ ID NO: 246846 - RNA, 20 nt, Human
uccguccaggagaaagcacu

SEQ ID NO: 246847 - RNA, 22 nt, Human
uccuaggguugcucuggguucu

SEQ ID NO: 246848 - RNA, 22 nt, Human
ucuuccaccaucucucccacug

SEQ ID NO: 246849 - RNA, 18 nt, Human
ugagguggcugaccaagg

SEQ ID NO: 246850 - RNA, 24 nt, Human
ugagguggcugaccaagguauagu

SEQ ID NO: 246851 - RNA, 20 nt, Human
uguagcaaugagguggcuga

SEQ ID NO: 246852 - RNA, 24 nt, Human
acuaaaaaugaccuguguuccacc

SEQ ID NO: 246853 - RNA, 27 nt, Human
ccuguguuccaccauuuuuauccacca

SEQ ID NO: 246854 - RNA, 21 nt, Human
uuccaccauuuuuauccacaa

SEQ ID NO: 246855 - RNA, 19 nt, Human
uuuauccacaacuucccuc

SEQ ID NO: 246856 - RNA, 21 nt, Human
uuuuauccacaacuucccuca

SEQ ID NO: 246857 - RNA, 22 nt, Human
aaacagaagacaggaacuugga

SEQ ID NO: 246858 - RNA, 19 nt, Human
aaagcacagcaggacacag

SEQ ID NO: 246859 - RNA, 18 nt, Human
aagacaggaacuuggagc

SEQ ID NO: 246860 - RNA, 24 nt, Human
aagcuuuugggagagaaaccccag

SEQ ID NO: 246861 - RNA, 19 nt, Human
acagcaggacacagugugg

SEQ ID NO: 246862 - RNA, 21 nt, Human
accccacucuuucuuccauuu

SEQ ID NO: 246863 - RNA, 18 nt, Human
accugcucuauugcccag

SEQ ID NO: 246864 - RNA, 21 nt, Human
acggagaaccagagacucaga

SEQ ID NO: 246865 - RNA, 20 nt, Human
acuagaacccaggacuccug

SEQ ID NO: 246866 - RNA, 19 nt, Human
agaaccagagacucagaca

SEQ ID NO: 246867 - RNA, 24 nt, Human
agaaccagagacucagacaaagaa

SEQ ID NO: 246868 - RNA, 21 nt, Human
agaagggaaggaggccagggc

SEQ ID NO: 246869 - RNA, 21 nt, Human
agacacaucgaccuucugcua

SEQ ID NO: 246870 - RNA, 18 nt, Human
agagaggaugggagaggc

SEQ ID NO: 246871 - RNA, 22 nt, Human
agagcagggacuagaacccagg

SEQ ID NO: 246872 - RNA, 23 nt, Human
agaggaaggauuaggccaaggug

SEQ ID NO: 246873 - RNA, 19 nt, Human
agcacaaaccuucccaacu

SEQ ID NO: 246874 - RNA, 19 nt, Human
agcagcauuuugucugcau

SEQ ID NO: 246875 - RNA, 21 nt, Human
agcuucgucugccugguagac

SEQ ID NO: 246876 - RNA, 24 nt, Human
aggaauaaggaaggauccuuuggc

SEQ ID NO: 246877 - RNA, 19 nt, Human
aggaggggggaugggagga

SEQ ID NO: 246878 - RNA, 18 nt, Human
aggcauuuugcuuggaaa

SEQ ID NO: 246879 - RNA, 21 nt, Human
aggcucccuccugucccugcu

SEQ ID NO: 246880 - RNA, 22 nt, Human
aggcucccuccugucccugcuu

SEQ ID NO: 246881 - RNA, 24 nt, Human
aggcuuagacugcaagaagcuuuu

SEQ ID NO: 246882 - RNA, 18 nt, Human
agggacuagaacccagga

SEQ ID NO: 246883 - RNA, 18 nt, Human
aggggacauaccacagga

SEQ ID NO: 246884 - RNA, 21 nt, Human
aggggaccuuaugccagccug

SEQ ID NO: 246885 - RNA, 22 nt, Human
aggggaggcaggccccgaggaa

SEQ ID NO: 246886 - RNA, 21 nt, Human
agggguggguauuucaggagc

SEQ ID NO: 246887 - RNA, 24 nt, Human
agucagcacaaaccuucccaacuu

SEQ ID NO: 246888 - RNA, 21 nt, Human
agugcugggauuggcacagag

SEQ ID NO: 246889 - RNA, 23 nt, Human
auaaaacagaagacaggaagagg

SEQ ID NO: 246890 - RNA, 19 nt, Human
augagccaucucccaaaac

SEQ ID NO: 246891 - RNA, 20 nt, Human
auggugucuugggaugccuu

SEQ ID NO: 246892 - RNA, 21 nt, Human
cacagcaggacacaguguggg

SEQ ID NO: 246893 - RNA, 21 nt, Human
cacucugccucucaggguccu

SEQ ID NO: 246894 - RNA, 22 nt, Human
cagaauaaacagcagggcacaa

SEQ ID NO: 246895 - RNA, 22 nt, Human
cagagcagggacuagaacccag

SEQ ID NO: 246896 - RNA, 22 nt, Human
cagaggccuugguugagcuccu

SEQ ID NO: 246897 - RNA, 18 nt, Human
cagcaggacacagugugg

SEQ ID NO: 246898 - RNA, 19 nt, Human
cagcagggcacaaagaggu

SEQ ID NO: 246899 - RNA, 23 nt, Human
caggaaaauauacagaugcggca

SEQ ID NO: 246900 - RNA, 19 nt, Human
caggccccgaggaaguaag

SEQ ID NO: 246901 - RNA, 24 nt, Human
cagggaugccaggcagccuggcag

SEQ ID NO: 246902 - RNA, 21 nt, Human
caggucaagaguuaaaguccc

SEQ ID NO: 246903 - RNA, 21 nt, Human
cagguguggacgcccauggug

SEQ ID NO: 246904 - RNA, 22 nt, Human
cagucagggaagcucugagugc

SEQ ID NO: 246905 - RNA, 18 nt, Human
caguuucccaagaaggga

SEQ ID NO: 246906 - RNA, 20 nt, Human
cauugccaccuuccccuuac

SEQ ID NO: 246907 - RNA, 19 nt, Human
cauuuauugaaaacagugu

SEQ ID NO: 246908 - RNA, 22 nt, Human
ccaaaaccugaaugcucuucuc

SEQ ID NO: 246909 - RNA, 23 nt, Human
ccaaaccacaauccccaggcucc

SEQ ID NO: 246910 - RNA, 22 nt, Human
ccaacagcugcauacaggucaa

SEQ ID NO: 246911 - RNA, 21 nt, Human
ccacaggagccaccacagccu

SEQ ID NO: 246912 - RNA, 21 nt, Human
ccagaaggcagagcaggaaaa

SEQ ID NO: 246913 - RNA, 19 nt, Human
ccagagaggcugcuagcag

SEQ ID NO: 246914 - RNA, 20 nt, Human
ccagggaagaucaauuucua

SEQ ID NO: 246915 - RNA, 22 nt, Human
cccaaaccacaauccccaggcu

SEQ ID NO: 246916 - RNA, 23 nt, Human
cccacagcugguggugcuggggc

SEQ ID NO: 246917 - RNA, 24 nt, Human
cccaggcaugaaggugcuccaagg

SEQ ID NO: 246918 - RNA, 19 nt, Human
cccauggugucagcuggug

SEQ ID NO: 246919 - RNA, 23 nt, Human
cccccagggaagaucaauuucua

SEQ ID NO: 246920 - RNA, 21 nt, Human
cccggccuugguccucccagc

SEQ ID NO: 246921 - RNA, 21 nt, Human
cccuauaccacacucugccuc

SEQ ID NO: 246922 - RNA, 23 nt, Human
cccuccugucccugcuucucuca

SEQ ID NO: 246923 - RNA, 21 nt, Human
ccgaaggaggggggaugggag

SEQ ID NO: 246924 - RNA, 18 nt, Human
ccucccacggcuauucug

SEQ ID NO: 246925 - RNA, 21 nt, Human
ccugaguauucagccuggggc

SEQ ID NO: 246926 - RNA, 21 nt, Human
ccugccaugggugagccucug

SEQ ID NO: 246927 - RNA, 24 nt, Human
ccugcucuauugcccaguaaugga

SEQ ID NO: 246928 - RNA, 21 nt, Human
ccuggcucuuuucacugccug

SEQ ID NO: 246929 - RNA, 21 nt, Human
ccugucccauguccuugggaa

SEQ ID NO: 246930 - RNA, 21 nt, Human
ccuuuaauggggaacauaagg

SEQ ID NO: 246931 - RNA, 24 nt, Human
cuagaaccaggugucugccuuccc

SEQ ID NO: 246932 - RNA, 20 nt, Human
cuagaacccaggacuccugg

SEQ ID NO: 246933 - RNA, 23 nt, Human
cucaggcccucccgcaaucuguc

SEQ ID NO: 246934 - RNA, 23 nt, Human
cucaugcagcccaguuucccaag

SEQ ID NO: 246935 - RNA, 22 nt, Human
cucauucuccauuaucuuccuc

SEQ ID NO: 246936 - RNA, 20 nt, Human
cuccgcccagcucaugcccc

SEQ ID NO: 246937 - RNA, 19 nt, Human
cucuauugcccaguaaugg

SEQ ID NO: 246938 - RNA, 22 nt, Human
cucugcuacugacugcccacag

SEQ ID NO: 246939 - RNA, 19 nt, Human
cugcccaaaagcacagcag

SEQ ID NO: 246940 - RNA, 22 nt, Human
cugccuucccaaaccacaaucc

SEQ ID NO: 246941 - RNA, 22 nt, Human
cuggagccuuuucccuauacca

SEQ ID NO: 246942 - RNA, 21 nt, Human
cuuaauauauauauauauaug

SEQ ID NO: 246943 - RNA, 21 nt, Human
cuucccaaucauucccucuca

SEQ ID NO: 246944 - RNA, 21 nt, Human
gaaccagaggcaggcugugaa

SEQ ID NO: 246945 - RNA, 22 nt, Human
gagccuggauucggccuguguu

SEQ ID NO: 246946 - RNA, 20 nt, Human
gaggaaggaaaggagaaaug

SEQ ID NO: 246947 - RNA, 23 nt, Human
gaggccagggcccagagcagaug

SEQ ID NO: 246948 - RNA, 18 nt, Human
gaugcggcauucaguuca

SEQ ID NO: 246949 - RNA, 25 nt, Human
gcacagaggccuugguugagcuccu

SEQ ID NO: 246950 - RNA, 18 nt, Human
gcagcacuuggcaggguu

SEQ ID NO: 246951 - RNA, 22 nt, Human
gcagcagcagcauuuugucugc

SEQ ID NO: 246952 - RNA, 19 nt, Human
gcccaguuucccaagaagg

SEQ ID NO: 246953 - RNA, 23 nt, Human
gccuggagccuuuucccuauacc

SEQ ID NO: 246954 - RNA, 21 nt, Human
gcucuauugcccaguaaugga

SEQ ID NO: 246955 - RNA, 19 nt, Human
ggaaggaaaggagaaaugg

SEQ ID NO: 246956 - RNA, 19 nt, Human
ggacgcccauggugucagc

SEQ ID NO: 246957 - RNA, 18 nt, Human
ggagaaccagagacucag

SEQ ID NO: 246958 - RNA, 19 nt, Human
ggagaaccagagacucaga

SEQ ID NO: 246959 - RNA, 19 nt, Human
ggagaagccaccgcuaggg

SEQ ID NO: 246960 - RNA, 18 nt, Human
ggagcagcagcagcagca

SEQ ID NO: 246961 - RNA, 25 nt, Human
ggagccuuuucccuauaccacacua

SEQ ID NO: 246962 - RNA, 19 nt, Human
ggaggccagggcccagagc

SEQ ID NO: 246963 - RNA, 24 nt, Human
ggagucggggaacggcugcuuggg

SEQ ID NO: 246964 - RNA, 20 nt, Human
ggagugcugggauuggcaca

SEQ ID NO: 246965 - RNA, 23 nt, Human
ggagugcugggauuggcacagaa

SEQ ID NO: 246966 - RNA, 21 nt, Human
ggauguuggggugugcccagg

SEQ ID NO: 246967 - RNA, 20 nt, Human
ggcagauggagauggucaag

SEQ ID NO: 246968 - RNA, 21 nt, Human
ggcccagagcagaugcucugc

SEQ ID NO: 246969 - RNA, 20 nt, Human
ggccuugguccucccagcuu

SEQ ID NO: 246970 - RNA, 19 nt, Human
gggaacauaagggauaagg

SEQ ID NO: 246971 - RNA, 22 nt, Human
gggaaggaggccagggcccaga

SEQ ID NO: 246972 - RNA, 23 nt, Human
gggacauaccacaggacucagaa

SEQ ID NO: 246973 - RNA, 21 nt, Human
gggaugggaggaaggaaagga

SEQ ID NO: 246974 - RNA, 21 nt, Human
ggggaacauaagggauaaggc

SEQ ID NO: 246975 - RNA, 18 nt, Human
ggggaugggaggaaggaa

SEQ ID NO: 246976 - RNA, 18 nt, Human
gguagacacaucgaccuu

SEQ ID NO: 246977 - RNA, 23 nt, Human
ggucaagaguuaaagucccccag

SEQ ID NO: 246978 - RNA, 23 nt, Human
gucccauguccuugggaacccac

SEQ ID NO: 246979 - RNA, 23 nt, Human
gugaggcucaggggugaggaguc

SEQ ID NO: 246980 - RNA, 18 nt, Human
uaaaacagaagacaggaa

SEQ ID NO: 246981 - RNA, 19 nt, Human
uaaaacagaagacaggaac

SEQ ID NO: 246982 - RNA, 18 nt, Human
uaaaggccacugggguaa

SEQ ID NO: 246983 - RNA, 19 nt, Human
uaaggugcauuuauugaaa

SEQ ID NO: 246984 - RNA, 23 nt, Human
uacaaaauauaacaucauuuaca

SEQ ID NO: 246985 - RNA, 23 nt, Human
uacagaauggugaagcauaugau

SEQ ID NO: 246986 - RNA, 20 nt, Human
uacaugugccauucauagac

SEQ ID NO: 246987 - RNA, 22 nt, Human
uaccacaggacucagaaccuug

SEQ ID NO: 246988 - RNA, 20 nt, Human
uacuuuuuuagggaugaggg

SEQ ID NO: 246989 - RNA, 22 nt, Human
uagaaccaggugucugccuucc

SEQ ID NO: 246990 - RNA, 20 nt, Human
uagaacccaggacuccuggc

SEQ ID NO: 246991 - RNA, 21 nt, Human
uagaacccaggacuccuggcu

SEQ ID NO: 246992 - RNA, 18 nt, Human
uagagugaggcccagacu

SEQ ID NO: 246993 - RNA, 23 nt, Human
uauaaaacagaagacaggaacuu

SEQ ID NO: 246994 - RNA, 21 nt, Human
uauaggggccugggguacaaa

SEQ ID NO: 246995 - RNA, 23 nt, Human
uaucuuggagcucuggagggcau

SEQ ID NO: 246996 - RNA, 20 nt, Human
ucaggggaggcaggccccga

SEQ ID NO: 246997 - RNA, 25 nt, Human
ucaucuagugcauguuccuaguuac

SEQ ID NO: 246998 - RNA, 20 nt, Human
ucccaaaaccugaaugcucu

SEQ ID NO: 246999 - RNA, 19 nt, Human
ucccaaaaccugaaugcuu

SEQ ID NO: 247000 - RNA, 24 nt, Human
ucccaaaccacaauccccaggcuc

SEQ ID NO: 247001 - RNA, 23 nt, Human
ucccaagaagggaaggaggccag

SEQ ID NO: 247002 - RNA, 18 nt, Human
ucccacaggagccaccac

SEQ ID NO: 247003 - RNA, 18 nt, Human
ucccacggcuauucugcu

SEQ ID NO: 247004 - RNA, 22 nt, Human
ucccauugccaccuuccccuua

SEQ ID NO: 247005 - RNA, 20 nt, Human
uccccaggcucccuccuguc

SEQ ID NO: 247006 - RNA, 18 nt, Human
ucccugaguauucagccu

SEQ ID NO: 247007 - RNA, 21 nt, Human
ucccugaguauucagccuggg

SEQ ID NO: 247008 - RNA, 25 nt, Human
ucccugaguauucagccuggggagg

SEQ ID NO: 247009 - RNA, 22 nt, Human
uccugccuugggugcucccggc

SEQ ID NO: 247010 - RNA, 19 nt, Human
ucgaagagaugaagucacc

SEQ ID NO: 247011 - RNA, 19 nt, Human
ucucaggggcuucucuggc

SEQ ID NO: 247012 - RNA, 22 nt, Human
ucucaggggcuucucuggcucc

SEQ ID NO: 247013 - RNA, 20 nt, Human
ucuccugccuggagccuuuu

SEQ ID NO: 247014 - RNA, 18 nt, Human
ucugaccacucucuugcu

SEQ ID NO: 247015 - RNA, 20 nt, Human
ucugccuucccaaaccacaa

SEQ ID NO: 247016 - RNA, 19 nt, Human
ucugcuagcuugacaagug

SEQ ID NO: 247017 - RNA, 18 nt, Human
ugaaaacaguguaugcua

SEQ ID NO: 247018 - RNA, 23 nt, Human
ugaaagauugcuuugugcuuguc

SEQ ID NO: 247019 - RNA, 20 nt, Human
ugaaaugggaagauauggug

SEQ ID NO: 247020 - RNA, 21 nt, Human
ugaagaaacugaaguucgaag

SEQ ID NO: 247021 - RNA, 20 nt, Human
ugaaggagugggucccucug

SEQ ID NO: 247022 - RNA, 23 nt, Human
ugaaguucgaagagaugaaguca

SEQ ID NO: 247023 - RNA, 18 nt, Human
ugacuucuaaugugcccu

SEQ ID NO: 247024 - RNA, 18 nt, Human
ugagaugagggaggagga

SEQ ID NO: 247025 - RNA, 19 nt, Human
ugagcuccugcauuguauu

SEQ ID NO: 247026 - RNA, 24 nt, Human
ugaggcccagacagggaaagagac

SEQ ID NO: 247027 - RNA, 23 nt, Human
ugagggccagagaggcugcuagc

SEQ ID NO: 247028 - RNA, 22 nt, Human
ugaggggagaggugugucacug

SEQ ID NO: 247029 - RNA, 19 nt, Human
ugaguugacaaugggaauu

SEQ ID NO: 247030 - RNA, 18 nt, Human
ugcagcccaguuucccaa

SEQ ID NO: 247031 - RNA, 26 nt, Human
ugccaggcagccuggcaggauuuggg

SEQ ID NO: 247032 - RNA, 21 nt, Human
ugcccaaaagcacagcaggac

SEQ ID NO: 247033 - RNA, 21 nt, Human
ugcccacagcugguggugcug

SEQ ID NO: 247034 - RNA, 22 nt, Human
ugccccagggaugccaggcagc

SEQ ID NO: 247035 - RNA, 19 nt, Human
ugccuugggugcucccggc

SEQ ID NO: 247036 - RNA, 18 nt, Human
ugcuacugacugcccaca

SEQ ID NO: 247037 - RNA, 19 nt, Human
ugcuaugcacucuguuaag

SEQ ID NO: 247038 - RNA, 21 nt, Human
uggcaaaaaagcauacagcau

SEQ ID NO: 247039 - RNA, 22 nt, Human
uggcaggauuugggugacuucu

SEQ ID NO: 247040 - RNA, 25 nt, Human
uggcauaugggcccaaauguguucu

SEQ ID NO: 247041 - RNA, 24 nt, Human
ugggagagaaaccccaggcaugaa

SEQ ID NO: 247042 - RNA, 23 nt, Human
ugggauguuggggugugcccagg

SEQ ID NO: 247043 - RNA, 19 nt, Human
ugggauuggcacagaggcc

SEQ ID NO: 247044 - RNA, 20 nt, Human
ugggcccaaauguguucuga

SEQ ID NO: 247045 - RNA, 23 nt, Human
uggguauuucaggagcagcagca

SEQ ID NO: 247046 - RNA, 21 nt, Human
uggugucuugggaugccuugg

SEQ ID NO: 247047 - RNA, 21 nt, Human
uucaugucucccaauaggagc

SEQ ID NO: 247048 - RNA, 18 nt, Human
uuccuaguuacauuugcu

SEQ ID NO: 247049 - RNA, 25 nt, Human
uuccugccuugggugcucccggcug

SEQ ID NO: 247050 - RNA, 20 nt, Human
uuccuuugacucugaaaaau

SEQ ID NO: 247051 - RNA, 20 nt, Human
uucgaagagaugaagucacc

SEQ ID NO: 247052 - RNA, 19 nt, Human
uucugcucccagcagucag

SEQ ID NO: 247053 - RNA, 20 nt, Human
uucuuuggcauugaaaaugg

SEQ ID NO: 247054 - RNA, 20 nt, Human
uugaaaauggaguuucugcu

SEQ ID NO: 247055 - RNA, 22 nt, Human
uugcuuugugcuugucuggagc

SEQ ID NO: 247056 - RNA, 24 nt, Human
uuggagggcuuauaucuuggagcu

SEQ ID NO: 247057 - RNA, 23 nt, Human
uuuuuugguuauccacgaggguu

SEQ ID NO: 247058 - RNA, 18 nt, Human
uuuuuuuuuuuuuuuuug

SEQ ID NO: 247059 - RNA, 21 nt, Human
uuuuuuuuuuuuuuuuugguu

SEQ ID NO: 247060 - RNA, 20 nt, Human
aaaugccaacagccaguaug

SEQ ID NO: 247061 - RNA, 21 nt, Human
aacccggagcugaggccagca

SEQ ID NO: 247062 - RNA, 22 nt, Human
aacccggagcugaggccagcag

SEQ ID NO: 247063 - RNA, 21 nt, Human
aaugccaacagccaguaugaa

SEQ ID NO: 247064 - RNA, 18 nt, Human
aggccggagcuccagggg

SEQ ID NO: 247065 - RNA, 18 nt, Human
caacugccauguccacag

SEQ ID NO: 247066 - RNA, 20 nt, Human
cagcaggcuggcucuggcuu

SEQ ID NO: 247067 - RNA, 22 nt, Human
caggcaguuuacagaaaugcca

SEQ ID NO: 247068 - RNA, 23 nt, Human
caguaugaaaagagacuggcuuu

SEQ ID NO: 247069 - RNA, 19 nt, Human
caguuuacagaaaugccaa

SEQ ID NO: 247070 - RNA, 21 nt, Human
ccaacccggagcugaggccag

SEQ ID NO: 247071 - RNA, 22 nt, Human
cccggagcugaggccagcaggc

SEQ ID NO: 247072 - RNA, 27 nt, Human
gaaugggaguuggggcacagccaucuc

SEQ ID NO: 247073 - RNA, 21 nt, Human
gcugaggccagcaggcuggcu

SEQ ID NO: 247074 - RNA, 19 nt, Human
ggcuucugaccugcugggc

SEQ ID NO: 247075 - RNA, 19 nt, Human
gguaaggcuggaauuaaac

SEQ ID NO: 247076 - RNA, 21 nt, Human
guccauggugggugaauggga

SEQ ID NO: 247077 - RNA, 22 nt, Human
uacacugggugggcaaagauga

SEQ ID NO: 247078 - RNA, 25 nt, Human
uccacaguaaugaugaaugcuucuc

SEQ ID NO: 247079 - RNA, 20 nt, Human
ugaaauguaauuugagcagu

SEQ ID NO: 247080 - RNA, 21 nt, Human
ugaaugggaguuggggcacag

SEQ ID NO: 247081 - RNA, 20 nt, Human
ugacagcagccucaccugga

SEQ ID NO: 247082 - RNA, 24 nt, Human
ugaccugcugggcaggccggagcu

SEQ ID NO: 247083 - RNA, 21 nt, Human
ugggguggggccagguuuauu

SEQ ID NO: 247084 - RNA, 20 nt, Human
uggguaaggcuggaauuaaa

SEQ ID NO: 247085 - RNA, 24 nt, Human
uggguccauggugggugaauggga

SEQ ID NO: 247086 - RNA, 25 nt, Human
uggugggugaaugggaguuggggca

SEQ ID NO: 247087 - RNA, 24 nt, Human
uuuuuggguggagcaacaacugcc

SEQ ID NO: 247088 - RNA, 22 nt, Human
uuuuuuuuuuugggguggggcc

SEQ ID NO: 247089 - RNA, 21 nt, Human
uuuuuuuuuuuuuuggggugg

SEQ ID NO: 247090 - RNA, 22 nt, Human
uuuuuuuuuuuuuuuuuggggu

SEQ ID NO: 247091 - RNA, 26 nt, Human
uuuuuuuuuuuuuuuuuggggugggg

SEQ ID NO: 247092 - RNA, 18 nt, Human
aaaaagaucuuauuucuc

SEQ ID NO: 247093 - RNA, 24 nt, Human
aaacaaacugacaaaaaagaucuu

SEQ ID NO: 247094 - RNA, 26 nt, Human
aaaccacucccucccuccaugggaag

SEQ ID NO: 247095 - RNA, 23 nt, Human
aacucacccucagucaucuucug

SEQ ID NO: 247096 - RNA, 18 nt, Human
aagaaaaaacgagaucag

SEQ ID NO: 247097 - RNA, 20 nt, Human
aagauccaaccuccagcacc

SEQ ID NO: 247098 - RNA, 18 nt, Human
aaggggagggagggggag

SEQ ID NO: 247099 - RNA, 18 nt, Human
acaaacugacaaaaaaga

SEQ ID NO: 247100 - RNA, 20 nt, Human
acaagagcuaguggguuaau

SEQ ID NO: 247101 - RNA, 21 nt, Human
acacaugaagcaaacaaaaua

SEQ ID NO: 247102 - RNA, 20 nt, Human
accugcaaaccacucccucc

SEQ ID NO: 247103 - RNA, 21 nt, Human
accuggcacaggcaaggggag

SEQ ID NO: 247104 - RNA, 20 nt, Human
agaaaaugaaagccaggguc

SEQ ID NO: 247105 - RNA, 18 nt, Human
agaaggcaagccccgccu

SEQ ID NO: 247106 - RNA, 19 nt, Human
agacagucaccuggcaaag

SEQ ID NO: 247107 - RNA, 26 nt, Human
agagaaaaugaaagccagggucuuug

SEQ ID NO: 247108 - RNA, 21 nt, Human
agcaggccaaggacugcucag

SEQ ID NO: 247109 - RNA, 23 nt, Human
agccugugguccugggagcuggg

SEQ ID NO: 247110 - RNA, 22 nt, Human
aggaacuuggccaccugcaaac

SEQ ID NO: 247111 - RNA, 23 nt, Human
aggcaaguuccaagaccuuagca

SEQ ID NO: 247112 - RNA, 18 nt, Human
aggcagaaucuccucaug

SEQ ID NO: 247113 - RNA, 23 nt, Human
aggcccacaaggagcccugaggc

SEQ ID NO: 247114 - RNA, 21 nt, Human
aggcuccugagucaaagcucc

SEQ ID NO: 247115 - RNA, 19 nt, Human
aggcuuccuaggugaccag

SEQ ID NO: 247116 - RNA, 18 nt, Human
agggaccagggaaagaga

SEQ ID NO: 247117 - RNA, 18 nt, Human
agggagggggagcugguc

SEQ ID NO: 247118 - RNA, 21 nt, Human
aggggagggagggggagcugg

SEQ ID NO: 247119 - RNA, 22 nt, Human
agggggcugggauucuaaagcu

SEQ ID NO: 247120 - RNA, 21 nt, Human
agggggguccaggagcccagg

SEQ ID NO: 247121 - RNA, 19 nt, Human
agucaccuggcaaaggcag

SEQ ID NO: 247122 - RNA, 22 nt, Human
augaagcaaacaaaauagcccu

SEQ ID NO: 247123 - RNA, 25 nt, Human
auggaggccccugccugagccugug

SEQ ID NO: 247124 - RNA, 25 nt, Human
caaccuccagcaccaggaagccccu

SEQ ID NO: 247125 - RNA, 19 nt, Human
caccaggugccuccagggu

SEQ ID NO: 247126 - RNA, 19 nt, Human
caccuggcaaaggcagaau

SEQ ID NO: 247127 - RNA, 21 nt, Human
caccuggcacaggcaagggga

SEQ ID NO: 247128 - RNA, 22 nt, Human
cacuaaauuaacauugccccag

SEQ ID NO: 247129 - RNA, 24 nt, Human
cagaagcuuguccaacaccagaag

SEQ ID NO: 247130 - RNA, 23 nt, Human
cagacaauugcccacggcucaac

SEQ ID NO: 247131 - RNA, 18 nt, Human
cagcagccaggcgucugg

SEQ ID NO: 247132 - RNA, 21 nt, Human
cagcaggagaacaccaugccc

SEQ ID NO: 247133 - RNA, 23 nt, Human
cagcaggagaacaccaugcccau

SEQ ID NO: 247134 - RNA, 24 nt, Human
caggacagaguccauggccucauu

SEQ ID NO: 247135 - RNA, 20 nt, Human
caggagcccaggcccacaag

SEQ ID NO: 247136 - RNA, 25 nt, Human
caggccaaggacugcucaggccccu

SEQ ID NO: 247137 - RNA, 27 nt, Human
caggccaaggcccagaugcuggcugcc

SEQ ID NO: 247138 - RNA, 23 nt, Human
caggcuccugagucaaagcuccu

SEQ ID NO: 247139 - RNA, 22 nt, Human
caggggauacaagggaccaggg

SEQ ID NO: 247140 - RNA, 22 nt, Human
cagggugagaccaggcccagcu

SEQ ID NO: 247141 - RNA, 24 nt, Human
cauacaaacaaacugacaaaaaag

SEQ ID NO: 247142 - RNA, 22 nt, Human
caucauguugcagugaagaaaa

SEQ ID NO: 247143 - RNA, 22 nt, Human
ccacuaaauuaacauugcccca

SEQ ID NO: 247144 - RNA, 22 nt, Human
ccagcaccaggaagccccugcc

SEQ ID NO: 247145 - RNA, 22 nt, Human
ccaggcccacaaggagcccuga

SEQ ID NO: 247146 - RNA, 19 nt, Human
ccccagaaguccaaaaacc

SEQ ID NO: 247147 - RNA, 20 nt, Human
cccccaucuauaaaugggau

SEQ ID NO: 247148 - RNA, 21 nt, Human
ccccugccacaugccuggccu

SEQ ID NO: 247149 - RNA, 25 nt, Human
ccccuggggcccauggaggccccug

SEQ ID NO: 247150 - RNA, 21 nt, Human
cccugccugagccuguggucc

SEQ ID NO: 247151 - RNA, 20 nt, Human
cccuggauccgaaagggcca

SEQ ID NO: 247152 - RNA, 22 nt, Human
ccuaacuccagccuacccugau

SEQ ID NO: 247153 - RNA, 21 nt, Human
ccuaggugaccaggagccggg

SEQ ID NO: 247154 - RNA, 19 nt, Human
ccucaggccuucaggacag

SEQ ID NO: 247155 - RNA, 18 nt, Human
ccucauuucugaaucugc

SEQ ID NO: 247156 - RNA, 20 nt, Human
ccuccaaaugcacucagccu

SEQ ID NO: 247157 - RNA, 19 nt, Human
ccuccagcaccaggaagcc

SEQ ID NO: 247158 - RNA, 27 nt, Human
ccuccagggugagaccaggcccagcuc

SEQ ID NO: 247159 - RNA, 21 nt, Human
ccugcucuaaccccugccaca

SEQ ID NO: 247160 - RNA, 23 nt, Human
ccugggcugccucucccagcacc

SEQ ID NO: 247161 - RNA, 23 nt, Human
cuaaagcugcuggucagucccua

SEQ ID NO: 247162 - RNA, 21 nt, Human
cuaacuccagccuacccugau

SEQ ID NO: 247163 - RNA, 21 nt, Human
cuccaaaugcacucagccugc

SEQ ID NO: 247164 - RNA, 20 nt, Human
cuccugagucaaagcuccua

SEQ ID NO: 247165 - RNA, 27 nt, Human
cuccugagucaaagcuccuaguuauac

SEQ ID NO: 247166 - RNA, 21 nt, Human
cucucccagcaccauguaccc

SEQ ID NO: 247167 - RNA, 24 nt, Human
cucucccagcaccauguacccuag

SEQ ID NO: 247168 - RNA, 18 nt, Human
cugaggccuguugagaug

SEQ ID NO: 247169 - RNA, 19 nt, Human
cuggccauggauggaaagg

SEQ ID NO: 247170 - RNA, 21 nt, Human
cuggggaagaggagcauggcc

SEQ ID NO: 247171 - RNA, 18 nt, Human
cuggguggggcuuucugg

SEQ ID NO: 247172 - RNA, 22 nt, Human
cuugggagcagacccgcucccc

SEQ ID NO: 247173 - RNA, 21 nt, Human
cuuugugcuccaggccaaggc

SEQ ID NO: 247174 - RNA, 18 nt, Human
gaaucugaggcuuccuag

SEQ ID NO: 247175 - RNA, 20 nt, Human
gacacaugaagcaaacaaaa

SEQ ID NO: 247176 - RNA, 24 nt, Human
gaccacuuaccccagaaguccaaa

SEQ ID NO: 247177 - RNA, 18 nt, Human
gagcauggccaccaggug

SEQ ID NO: 247178 - RNA, 20 nt, Human
gaggagcauggccaccaggu

SEQ ID NO: 247179 - RNA, 22 nt, Human
gauacaagggaccagggaaaga

SEQ ID NO: 247180 - RNA, 24 nt, Human
gaucagcagccaggcgucugggga

SEQ ID NO: 247181 - RNA, 23 nt, Human
gcacaggcaaggggagggagggg

SEQ ID NO: 247182 - RNA, 19 nt, Human
gcaugagacaacggugggg

SEQ ID NO: 247183 - RNA, 20 nt, Human
gccaugaugaugacaggaca

SEQ ID NO: 247184 - RNA, 19 nt, Human
gccuguuacuggcaugaga

SEQ ID NO: 247185 - RNA, 24 nt, Human
gcuccccagaugagacuuccuggg

SEQ ID NO: 247186 - RNA, 19 nt, Human
gcugcuucugcuccaggaa

SEQ ID NO: 247187 - RNA, 21 nt, Human
ggagaagguagagaugcugcu

SEQ ID NO: 247188 - RNA, 19 nt, Human
ggauauaaaagguacuacc

SEQ ID NO: 247189 - RNA, 18 nt, Human
ggccaaggcccagaugcu

SEQ ID NO: 247190 - RNA, 25 nt, Human
gggaaggaaucugaggcuuccuagg

SEQ ID NO: 247191 - RNA, 20 nt, Human
ggggagggagggggagcugg

SEQ ID NO: 247192 - RNA, 23 nt, Human
ggucaggguccagcuguuggggg

SEQ ID NO: 247193 - RNA, 18 nt, Human
ggucuaaacacguggcug

SEQ ID NO: 247194 - RNA, 18 nt, Human
ggugaccaggagccgggc

SEQ ID NO: 247195 - RNA, 21 nt, Human
gguggggaaggcgaucagcag

SEQ ID NO: 247196 - RNA, 23 nt, Human
gucaggguccagcuguuggggga

SEQ ID NO: 247197 - RNA, 22 nt, Human
gucuaaacacguggcuguggga

SEQ ID NO: 247198 - RNA, 24 nt, Human
uaaggacaaguggggcagguaggg

SEQ ID NO: 247199 - RNA, 22 nt, Human
uacaucaagauccaaccuccag

SEQ ID NO: 247200 - RNA, 23 nt, Human
uaccccagaaguccaaaaaccca

SEQ ID NO: 247201 - RNA, 23 nt, Human
uagaccacuuaccccagaagucc

SEQ ID NO: 247202 - RNA, 19 nt, Human
uaggagacaucaguccugc

SEQ ID NO: 247203 - RNA, 18 nt, Human
ucacccucagucaucuuc

SEQ ID NO: 247204 - RNA, 22 nt, Human
ucagaagcuuguccaacaccag

SEQ ID NO: 247205 - RNA, 20 nt, Human
ucaugucgagugugagccaa

SEQ ID NO: 247206 - RNA, 24 nt, Human
uccaaaaacccaaucucugcaugu

SEQ ID NO: 247207 - RNA, 26 nt, Human
uccaaaaacccaaucucugcaugucu

SEQ ID NO: 247208 - RNA, 23 nt, Human
uccaggcuaaggacaaguggggc

SEQ ID NO: 247209 - RNA, 22 nt, Human
uccaugggaaggaaucugaggc

SEQ ID NO: 247210 - RNA, 19 nt, Human
ucccagcaccauguacccu

SEQ ID NO: 247211 - RNA, 20 nt, Human
uccccagaugagacuuccug

SEQ ID NO: 247212 - RNA, 25 nt, Human
uccccaguguuccccuggggcccau

SEQ ID NO: 247213 - RNA, 27 nt, Human
ucccuggauccgaaagggccacucacu

SEQ ID NO: 247214 - RNA, 21 nt, Human
ucuaaagcugcuggucagucc

SEQ ID NO: 247215 - RNA, 20 nt, Human
ucucccagcaccauguaccc

SEQ ID NO: 247216 - RNA, 23 nt, Human
ucucccagcaccauguacccuag

SEQ ID NO: 247217 - RNA, 22 nt, Human
ucugcuccaggaagcccagaua

SEQ ID NO: 247218 - RNA, 20 nt, Human
ugaagcaaacaaaauagccc

SEQ ID NO: 247219 - RNA, 23 nt, Human
ugagagaaaaugaaagccagggu

SEQ ID NO: 247220 - RNA, 19 nt, Human
ugagaugugcugaccucac

SEQ ID NO: 247221 - RNA, 23 nt, Human
ugagaugugcugaccucaccugg

SEQ ID NO: 247222 - RNA, 24 nt, Human
ugagccugugguccugggagcugg

SEQ ID NO: 247223 - RNA, 19 nt, Human
ugaggcugugacuuugccu

SEQ ID NO: 247224 - RNA, 21 nt, Human
ugaggcugugacuuugccuga

SEQ ID NO: 247225 - RNA, 24 nt, Human
ugagggaauucacucuugacgggg

SEQ ID NO: 247226 - RNA, 25 nt, Human
ugaggguugguggguggggaaggcg

SEQ ID NO: 247227 - RNA, 19 nt, Human
ugaguggucagggggcugg

SEQ ID NO: 247228 - RNA, 23 nt, Human
ugaguggucagggggcugggauu

SEQ ID NO: 247229 - RNA, 23 nt, Human
ugaugacaggacaggcuaaaugg

SEQ ID NO: 247230 - RNA, 21 nt, Human
ugcaaaccacucccucccucc

SEQ ID NO: 247231 - RNA, 18 nt, Human
ugccugagccuguggucc

SEQ ID NO: 247232 - RNA, 25 nt, Human
ugccugagccugugguccugggagc

SEQ ID NO: 247233 - RNA, 20 nt, Human
ugcucaggccccuugggagc

SEQ ID NO: 247234 - RNA, 21 nt, Human
ugcucuaaccccugccacaug

SEQ ID NO: 247235 - RNA, 18 nt, Human
ugcugcugucagaggucc

SEQ ID NO: 247236 - RNA, 25 nt, Human
uggcuuugcccugaggguugguggg

SEQ ID NO: 247237 - RNA, 22 nt, Human
uggggaagaggagcauggccac

SEQ ID NO: 247238 - RNA, 19 nt, Human
uggggaaggcgaucagcag

SEQ ID NO: 247239 - RNA, 21 nt, Human
uggucaggguccagcuguugg

SEQ ID NO: 247240 - RNA, 19 nt, Human
ugguccugggagcugggga

SEQ ID NO: 247241 - RNA, 24 nt, Human
ugucacaggcuccugagucaaagc

SEQ ID NO: 247242 - RNA, 19 nt, Human
ugucagagguccaggcuaa

SEQ ID NO: 247243 - RNA, 18 nt, Human
ugucauuguuugagccug

SEQ ID NO: 247244 - RNA, 21 nt, Human
ugucauuguuugagccuguua

SEQ ID NO: 247245 - RNA, 24 nt, Human
uguccaacaccagaaggcaagccc

SEQ ID NO: 247246 - RNA, 21 nt, Human
ugucgagugugagccaaguua

SEQ ID NO: 247247 - RNA, 18 nt, Human
ugugaaagggggguccag

SEQ ID NO: 247248 - RNA, 26 nt, Human
uuaacauugccccagucugagggagc

SEQ ID NO: 247249 - RNA, 24 nt, Human
uuacaucaagauccaaccuccagc

SEQ ID NO: 247250 - RNA, 23 nt, Human
uuauccagacucucugugcuuug

SEQ ID NO: 247251 - RNA, 25 nt, Human
uuccugggcugccucucccagcacc

SEQ ID NO: 247252 - RNA, 21 nt, Human
aaaacaccuagggacagaaua

SEQ ID NO: 247253 - RNA, 22 nt, Human
aacacucccugacaaagagcua

SEQ ID NO: 247254 - RNA, 22 nt, Human
aagaaaaaaaaaaguuaucugg

SEQ ID NO: 247255 - RNA, 22 nt, Human
aagaggacaggaaaauuuagga

SEQ ID NO: 247256 - RNA, 22 nt, Human
aagcagucauggaauaagcaug

SEQ ID NO: 247257 - RNA, 22 nt, Human
aagugugcaaccuacagacccu

SEQ ID NO: 247258 - RNA, 24 nt, Human
aauaagcaauuagaaaacguucaa

SEQ ID NO: 247259 - RNA, 21 nt, Human
aauucaugcugacagggcugu

SEQ ID NO: 247260 - RNA, 19 nt, Human
acagucccccacaaaagcu

SEQ ID NO: 247261 - RNA, 18 nt, Human
acauuacaaauucaugcu

SEQ ID NO: 247262 - RNA, 21 nt, Human
accagcucugcccucccuucu

SEQ ID NO: 247263 - RNA, 20 nt, Human
agaauagcaagcccaacuua

SEQ ID NO: 247264 - RNA, 21 nt, Human
agacauacguaauaaaccucc

SEQ ID NO: 247265 - RNA, 18 nt, Human
agagaaaaaaaaaaaauc

SEQ ID NO: 247266 - RNA, 21 nt, Human
agauccugaaaggcacuuucu

SEQ ID NO: 247267 - RNA, 20 nt, Human
aggcggcagcggcugcgaaa

SEQ ID NO: 247268 - RNA, 20 nt, Human
agggaggauaaggggaaggc

SEQ ID NO: 247269 - RNA, 18 nt, Human
agucuggggaaaaaaggc

SEQ ID NO: 247270 - RNA, 22 nt, Human
agugcugaaaccaugcauagga

SEQ ID NO: 247271 - RNA, 26 nt, Human
auaaaccuccaaaaauagauccugaa

SEQ ID NO: 247272 - RNA, 30 nt, Human
auuacaaauucaugcugacagggcuguggg

SEQ ID NO: 247273 - RNA, 19 nt, Human
caaagcauuauuuacuaca

SEQ ID NO: 247274 - RNA, 23 nt, Human
caaagugugcaaccuacagaccc

SEQ ID NO: 247275 - RNA, 22 nt, Human
caagcccaacuuacaguccccc

SEQ ID NO: 247276 - RNA, 19 nt, Human
cagccgcaccagcucugcc

SEQ ID NO: 247277 - RNA, 22 nt, Human
ccaaaaauagauccugaaaggc

SEQ ID NO: 247278 - RNA, 19 nt, Human
ccagaauacaauaaauaag

SEQ ID NO: 247279 - RNA, 21 nt, Human
ccagaauacaauaaauaagca

SEQ ID NO: 247280 - RNA, 18 nt, Human
ccauggccagccgcaccg

SEQ ID NO: 247281 - RNA, 23 nt, Human
cccccacaaaagcuaaaauucau

SEQ ID NO: 247282 - RNA, 21 nt, Human
ccuuuuuugaugucaggcugg

SEQ ID NO: 247283 - RNA, 24 nt, Human
cgccaacaagucuggggaaaaaag

SEQ ID NO: 247284 - RNA, 24 nt, Human
cguacguccuccaaaagacagcug

SEQ ID NO: 247285 - RNA, 18 nt, Human
cuccaaaaauagauccug

SEQ ID NO: 247286 - RNA, 21 nt, Human
cuccaaaaauagauccugaaa

SEQ ID NO: 247287 - RNA, 18 nt, Human
cucuguaccacaccagcc

SEQ ID NO: 247288 - RNA, 20 nt, Human
cuggagcuccaacugggaac

SEQ ID NO: 247289 - RNA, 19 nt, Human
cuguaugacaucacaaggc

SEQ ID NO: 247290 - RNA, 20 nt, Human
cuuacagucccccacaaaag

SEQ ID NO: 247291 - RNA, 22 nt, Human
cuuacagucccccacaaaagcc

SEQ ID NO: 247292 - RNA, 18 nt, Human
gaaagucaaugcaauuau

SEQ ID NO: 247293 - RNA, 18 nt, Human
gaaaugcgcaagcugcgg

SEQ ID NO: 247294 - RNA, 18 nt, Human
gaaggaagcugguuucuc

SEQ ID NO: 247295 - RNA, 19 nt, Human
gaaggagcagcggcgaggc

SEQ ID NO: 247296 - RNA, 18 nt, Human
gagcucaagacauuacaa

SEQ ID NO: 247297 - RNA, 19 nt, Human
gagcugaaagaggacagga

SEQ ID NO: 247298 - RNA, 21 nt, Human
gagcugaaagaggacaggaaa

SEQ ID NO: 247299 - RNA, 20 nt, Human
gaggcggcagcggcugcgaa

SEQ ID NO: 247300 - RNA, 21 nt, Human
gaguuggugagguuuggcuag

SEQ ID NO: 247301 - RNA, 21 nt, Human
gcaagcagucauggaauaagc

SEQ ID NO: 247302 - RNA, 18 nt, Human
gcgcaagcugcggacagc

SEQ ID NO: 247303 - RNA, 19 nt, Human
guaauaaaccuccaaaaau

SEQ ID NO: 247304 - RNA, 24 nt, Human
uacaauaaauaagcaauuagaaaa

SEQ ID NO: 247305 - RNA, 21 nt, Human
uacugcccugugacuucucug

SEQ ID NO: 247306 - RNA, 22 nt, Human
uagcaggcgggcgccucgugcc

SEQ ID NO: 247307 - RNA, 21 nt, Human
uaggacaccuuggccuaccug

SEQ ID NO: 247308 - RNA, 21 nt, Human
uauugugcaguguggaguacu

SEQ ID NO: 247309 - RNA, 20 nt, Human
ucaggagcugaaagaggaca

SEQ ID NO: 247310 - RNA, 22 nt, Human
ucuaacccaagguuuuucugua

SEQ ID NO: 247311 - RNA, 19 nt, Human
ucucugaaggaagcugguu

SEQ ID NO: 247312 - RNA, 20 nt, Human
ucucuguagcuacaccagcu

SEQ ID NO: 247313 - RNA, 26 nt, Human
ucucuguaugacaucacaaggcugcc

SEQ ID NO: 247314 - RNA, 21 nt, Human
ucuguacuuacgccauacccc

SEQ ID NO: 247315 - RNA, 21 nt, Human
ugaacaaaacaccuagggaca

SEQ ID NO: 247316 - RNA, 24 nt, Human
ugaacaaaacaccuagggacagaa

SEQ ID NO: 247317 - RNA, 18 nt, Human
ugacaucacaaggcugcc

SEQ ID NO: 247318 - RNA, 20 nt, Human
ugaggugauggcuucucugu

SEQ ID NO: 247319 - RNA, 28 nt, Human
ugagguuuggcuagugcugaccacaggg

SEQ ID NO: 247320 - RNA, 19 nt, Human
ugccaagugccuguuuuuc

SEQ ID NO: 247321 - RNA, 18 nt, Human
ugcccugugacuucucug

SEQ ID NO: 247322 - RNA, 20 nt, Human
ugcugaaaccaugcauagga

SEQ ID NO: 247323 - RNA, 23 nt, Human
ugcuggaaacauguuguuaaagg

SEQ ID NO: 247324 - RNA, 21 nt, Human
ugggaacuugcguuacaugca

SEQ ID NO: 247325 - RNA, 22 nt, Human
ugggaggaguuauugugcagug

SEQ ID NO: 247326 - RNA, 19 nt, Human
uguacuuacgccauacccc

SEQ ID NO: 247327 - RNA, 20 nt, Human
ugugcaguguggaguacuca

SEQ ID NO: 247328 - RNA, 20 nt, Human
uuacagggaggauaagggga

SEQ ID NO: 247329 - RNA, 19 nt, Human
uuagagguggcaauuaaga

SEQ ID NO: 247330 - RNA, 19 nt, Human
uucaugcugacagggcugu

SEQ ID NO: 247331 - RNA, 18 nt, Human
uucuagaacuaggaguug

SEQ ID NO: 247332 - RNA, 21 nt, Human
uugagagaaaaaaaaaaaauc

SEQ ID NO: 247333 - RNA, 18 nt, Human
uugggugauagggcacaa

SEQ ID NO: 247334 - RNA, 19 nt, Human
uuggugcuguuagaggugg

SEQ ID NO: 247335 - RNA, 21 nt, Human
uuuuuugaugucaggcuggag

SEQ ID NO: 247336 - RNA, 22 nt, Human
uuuuuuuuuuuuuuuuuuaagg

SEQ ID NO: 247337 - RNA, 28 nt, Human
acgugggccagccccugcugugggcacc

SEQ ID NO: 247338 - RNA, 22 nt, Human
acugcggucuccuccgcgcgcc

SEQ ID NO: 247339 - RNA, 23 nt, Human
agggagcugggugccacuggacc

SEQ ID NO: 247340 - RNA, 20 nt, Human
agggguguugcuucuccagc

SEQ ID NO: 247341 - RNA, 21 nt, Human
cacacugagcaaguggucacu

SEQ ID NO: 247342 - RNA, 24 nt, Human
caccgaaucccuucgcuaaccaac

SEQ ID NO: 247343 - RNA, 25 nt, Human
cagcccccugcagccuggugucuuc

SEQ ID NO: 247344 - RNA, 20 nt, Human
cagccccugcugugggcacc

SEQ ID NO: 247345 - RNA, 24 nt, Human
cagugcccccacgccgcacucucc

SEQ ID NO: 247346 - RNA, 19 nt, Human
ccacccgccggccugcucc

SEQ ID NO: 247347 - RNA, 21 nt, Human
ccacgggccgcccagagcccc

SEQ ID NO: 247348 - RNA, 21 nt, Human
ccacuggaccgagccugguuc

SEQ ID NO: 247349 - RNA, 22 nt, Human
ccagagcccccuacgugggcca

SEQ ID NO: 247350 - RNA, 25 nt, Human
ccagcccccugcagccuggugucuu

SEQ ID NO: 247351 - RNA, 22 nt, Human
ccauccaucugcaccgaauccc

SEQ ID NO: 247352 - RNA, 18 nt, Human
cccagagcccccuacgug

SEQ ID NO: 247353 - RNA, 19 nt, Human
cccccacgccgcacucucc

SEQ ID NO: 247354 - RNA, 23 nt, Human
ccccgaggcggucccggcugcac

SEQ ID NO: 247355 - RNA, 21 nt, Human
ccccgcggguccuagcgccgg

SEQ ID NO: 247356 - RNA, 19 nt, Human
cccgcgcccgcccccagga

SEQ ID NO: 247357 - RNA, 22 nt, Human
cccguggacuccgcagcccaga

SEQ ID NO: 247358 - RNA, 21 nt, Human
ccgaggcggucccggcugcac

SEQ ID NO: 247359 - RNA, 19 nt, Human
ccgcacucuccacucucuc

SEQ ID NO: 247360 - RNA, 25 nt, Human
ccgcccagagcccccuacgugggcc

SEQ ID NO: 247361 - RNA, 21 nt, Human
ccgcgccccgcgcccgccccc

SEQ ID NO: 247362 - RNA, 26 nt, Human
ccgcgcccgcccccaggagggccucc

SEQ ID NO: 247363 - RNA, 23 nt, Human
ccggccgcacugcggucuccucc

SEQ ID NO: 247364 - RNA, 21 nt, Human
ccggggaccgcggccuggugg

SEQ ID NO: 247365 - RNA, 25 nt, Human
ccuccgcgcgccgccgccgccgccg

SEQ ID NO: 247366 - RNA, 19 nt, Human
ccucuggggccaagggccc

SEQ ID NO: 247367 - RNA, 23 nt, Human
ccugcugugggcaccaggaggau

SEQ ID NO: 247368 - RNA, 19 nt, Human
ccuugggccuggucagugc

SEQ ID NO: 247369 - RNA, 20 nt, Human
ccuugggccuggucagugcc

SEQ ID NO: 247370 - RNA, 21 nt, Human
cgcagcccagacgguccaucc

SEQ ID NO: 247371 - RNA, 22 nt, Human
cgcccagagcccccuacguggg

SEQ ID NO: 247372 - RNA, 19 nt, Human
cgcccccgagccgcgcccc

SEQ ID NO: 247373 - RNA, 24 nt, Human
cgcggguccuagcgccggccgcac

SEQ ID NO: 247374 - RNA, 23 nt, Human
cuccggggaccgcggccuggugg

SEQ ID NO: 247375 - RNA, 21 nt, Human
cugggguguccacgggccgcc

SEQ ID NO: 247376 - RNA, 22 nt, Human
cuuccuguuuucugcucagggg

SEQ ID NO: 247377 - RNA, 22 nt, Human
cuugcccgccuggacccuccuu

SEQ ID NO: 247378 - RNA, 20 nt, Human
gagggccuccgcgagccggc

SEQ ID NO: 247379 - RNA, 18 nt, Human
gcaaccgagguccccgcg

SEQ ID NO: 247380 - RNA, 23 nt, Human
gcaccgaaucccuucgcuaacca

SEQ ID NO: 247381 - RNA, 21 nt, Human
gcagcccagacgguccaucca

SEQ ID NO: 247382 - RNA, 21 nt, Human
gcccagagcccccuacguggg

SEQ ID NO: 247383 - RNA, 24 nt, Human
gcccagagcccccuacgugggcca

SEQ ID NO: 247384 - RNA, 22 nt, Human
gcccccacgccgcacucuccac

SEQ ID NO: 247385 - RNA, 18 nt, Human
gccugccacaggccaggc

SEQ ID NO: 247386 - RNA, 25 nt, Human
gcggggagggagagggguguugcuu

SEQ ID NO: 247387 - RNA, 23 nt, Human
gcggguccuagcgccggccgcac

SEQ ID NO: 247388 - RNA, 19 nt, Human
gcugagacgggaggggggu

SEQ ID NO: 247389 - RNA, 18 nt, Human
gggagugggggaaagcgc

SEQ ID NO: 247390 - RNA, 23 nt, Human
ggggagugggggaaagcgcgagg

SEQ ID NO: 247391 - RNA, 20 nt, Human
gucuccuccgcgcgccgccg

SEQ ID NO: 247392 - RNA, 18 nt, Human
uccacgggccgcccagag

SEQ ID NO: 247393 - RNA, 20 nt, Human
uccgcgcgccgccgccgccg

SEQ ID NO: 247394 - RNA, 23 nt, Human
uccgcgcgccgccgccgccgccg

SEQ ID NO: 247395 - RNA, 21 nt, Human
uccuccgcgcgccgccgccgc

SEQ ID NO: 247396 - RNA, 21 nt, Human
uccuugggccuggucagugcc

SEQ ID NO: 247397 - RNA, 18 nt, Human
ucuccuccgcgcgccgcc

SEQ ID NO: 247398 - RNA, 22 nt, Human
ucugggguguccacgggccgcc

SEQ ID NO: 247399 - RNA, 22 nt, Human
ugcaccgaaucccuucgcuaac

SEQ ID NO: 247400 - RNA, 22 nt, Human
ugcaccgaaucccuucgcuaac

SEQ ID NO: 247401 - RNA, 20 nt, Human
ugcggaggacgggucaggag

SEQ ID NO: 247402 - RNA, 20 nt, Human
uggggccaagggccccaccg

SEQ ID NO: 247403 - RNA, 22 nt, Human
uuuaagaugcucuagcacccca

SEQ ID NO: 247404 - RNA, 21 nt, Human
uuuaagaugcucuagcacccu

SEQ ID NO: 247405 - RNA, 18 nt, Human
uuuugggggcgaagaagg

SEQ ID NO: 247406 - RNA, 22 nt, Human
uuuugggggcgaagaagggucg

SEQ ID NO: 247407 - RNA, 19 nt, Human
uuuuuuuuuuuuagagucc

SEQ ID NO: 247408 - RNA, 19 nt, Human
aaccccacugcccgcccag

SEQ ID NO: 247409 - RNA, 26 nt, Human
aauaggcacacccagacacacccccu

SEQ ID NO: 247410 - RNA, 20 nt, Human
aauggaggugugugugcccu

SEQ ID NO: 247411 - RNA, 23 nt, Human
aaugguaaagcuacggcggacac

SEQ ID NO: 247412 - RNA, 23 nt, Human
acacacacacacacacacacaca

SEQ ID NO: 247413 - RNA, 23 nt, Human
acacacacacacacacacacaug

SEQ ID NO: 247414 - RNA, 23 nt, Human
acacacacacacacacacaugca

SEQ ID NO: 247415 - RNA, 23 nt, Human
acacacacacacacacaugcacg

SEQ ID NO: 247416 - RNA, 24 nt, Human
acacacacacacacaugcacgcau

SEQ ID NO: 247417 - RNA, 23 nt, Human
acacacacgcacacauacacaca

SEQ ID NO: 247418 - RNA, 23 nt, Human
acacacaugcacgcauacacaca

SEQ ID NO: 247419 - RNA, 24 nt, Human
acaugcacgcauacacacacgcac

SEQ ID NO: 247420 - RNA, 21 nt, Human
accugaguccaauggcccggc

SEQ ID NO: 247421 - RNA, 23 nt, Human
acgcagucccucucacacucacc

SEQ ID NO: 247422 - RNA, 25 nt, Human
agaaaucaguaaagaaauucacagc

SEQ ID NO: 247423 - RNA, 23 nt, Human
agaggccccucugaccacaaggg

SEQ ID NO: 247424 - RNA, 19 nt, Human
agcccccccaaagggcggg

SEQ ID NO: 247425 - RNA, 23 nt, Human
agcccgcccuggcccccagcccc

SEQ ID NO: 247426 - RNA, 22 nt, Human
aggcacacccagacacaccccc

SEQ ID NO: 247427 - RNA, 25 nt, Human
aggcacacccagacacacccccucc

SEQ ID NO: 247428 - RNA, 18 nt, Human
aggugggugggggguggc

SEQ ID NO: 247429 - RNA, 18 nt, Human
aucccacacccaaauccu

SEQ ID NO: 247430 - RNA, 22 nt, Human
auccuucccccacucacaaccc

SEQ ID NO: 247431 - RNA, 19 nt, Human
auucacuuccccuucccca

SEQ ID NO: 247432 - RNA, 20 nt, Human
cacacacacacacacacaca

SEQ ID NO: 247433 - RNA, 20 nt, Human
cacacacacacacacacaca

SEQ ID NO: 247434 - RNA, 20 nt, Human
cacacacacacacacacaca

SEQ ID NO: 247435 - RNA, 26 nt, Human
cacacacacacacacacaugcacgca

SEQ ID NO: 247436 - RNA, 28 nt, Human
cacacacaugcacgcauacacacacgca

SEQ ID NO: 247437 - RNA, 20 nt, Human
cacacccagacacacccccu

SEQ ID NO: 247438 - RNA, 19 nt, Human
cacacccccucccaccccc

SEQ ID NO: 247439 - RNA, 18 nt, Human
cacacucaccccugcauu

SEQ ID NO: 247440 - RNA, 19 nt, Human
cacccaaauccuuccccca

SEQ ID NO: 247441 - RNA, 22 nt, Human
cacccaaauccuucccccacuc

SEQ ID NO: 247442 - RNA, 23 nt, Human
cacccagacacacccccucccac

SEQ ID NO: 247443 - RNA, 18 nt, Human
caccccaagccuaggcau

SEQ ID NO: 247444 - RNA, 19 nt, Human
caccuucaucccacaccca

SEQ ID NO: 247445 - RNA, 22 nt, Human
cacgcucucaauaggcacaccc

SEQ ID NO: 247446 - RNA, 26 nt, Human
cacgugcacacacacacacacacaca

SEQ ID NO: 247447 - RNA, 22 nt, Human
cagacacacccccucccacccc

SEQ ID NO: 247448 - RNA, 22 nt, Human
cagcacucagagucaagaaagg

SEQ ID NO: 247449 - RNA, 33 nt, Human
caggcgcacgugcacacacacacacacacagug

SEQ ID NO: 247450 - RNA, 23 nt, Human
cagguggcccccaacugacgacu

SEQ ID NO: 247451 - RNA, 21 nt, Human
ccacugcccgcccagccuuug

SEQ ID NO: 247452 - RNA, 22 nt, Human
ccagacacacccccucccaccc

SEQ ID NO: 247453 - RNA, 25 nt, Human
cccacucacaaccccaaguuucuca

SEQ ID NO: 247454 - RNA, 23 nt, Human
cccagacacacccccucccaccc

SEQ ID NO: 247455 - RNA, 19 nt, Human
cccagcccccccaaagggc

SEQ ID NO: 247456 - RNA, 21 nt, Human
ccccaagccuaggcauaccug

SEQ ID NO: 247457 - RNA, 21 nt, Human
cccccagcccccccaaagggc

SEQ ID NO: 247458 - RNA, 20 nt, Human
ccccucugaccacaagggcu

SEQ ID NO: 247459 - RNA, 21 nt, Human
cccucugaccacaagggcucc

SEQ ID NO: 247460 - RNA, 21 nt, Human
ccgcccagccuuugggucagg

SEQ ID NO: 247461 - RNA, 22 nt, Human
ccgcccuggcccccagcccccc

SEQ ID NO: 247462 - RNA, 18 nt, Human
ccucccacccccgggcug

SEQ ID NO: 247463 - RNA, 22 nt, Human
ccugaguccaauggcccggccc

SEQ ID NO: 247464 - RNA, 18 nt, Human
ccuuccccagccucacug

SEQ ID NO: 247465 - RNA, 26 nt, Human
cgcauacacacacgcacacauacaca

SEQ ID NO: 247466 - RNA, 25 nt, Human
cgugcacacacacacacacacacac

SEQ ID NO: 247467 - RNA, 30 nt, Human
cucagagucaagaaaggguuaacuaaaaaa

SEQ ID NO: 247468 - RNA, 24 nt, Human
cugcauuaucacucucacacucac

SEQ ID NO: 247469 - RNA, 19 nt, Human
gagcggcagcuggaauuug

SEQ ID NO: 247470 - RNA, 25 nt, Human
gcacacauacacacacgagcuccca

SEQ ID NO: 247471 - RNA, 25 nt, Human
gcacacauacacacacgagcuccca

SEQ ID NO: 247472 - RNA, 18 nt, Human
gcagcagccggcacgguu

SEQ ID NO: 247473 - RNA, 22 nt, Human
gccacaguggugacaggcagcc

SEQ ID NO: 247474 - RNA, 23 nt, Human
ggccacaguggugacaggcagcc

SEQ ID NO: 247475 - RNA, 18 nt, Human
ggcccccagcccccccaa

SEQ ID NO: 247476 - RNA, 22 nt, Human
ggcuggagcccgcgcugccuug

SEQ ID NO: 247477 - RNA, 20 nt, Human
gugggaccagugggguccag

SEQ ID NO: 247478 - RNA, 23 nt, Human
uaaagaaauucacagcacucaga

SEQ ID NO: 247479 - RNA, 19 nt, Human
uacacacacgcacacauac

SEQ ID NO: 247480 - RNA, 25 nt, Human
uacacacacgcacacauacacacac

SEQ ID NO: 247481 - RNA, 19 nt, Human
uaccugaguccaauggccc

SEQ ID NO: 247482 - RNA, 23 nt, Human
uaucacucucacacucacauucu

SEQ ID NO: 247483 - RNA, 20 nt, Human
ucaugcccacccucaggcgc

SEQ ID NO: 247484 - RNA, 22 nt, Human
uccaauggcccggcccagcccu

SEQ ID NO: 247485 - RNA, 21 nt, Human
uccaccccaagccuaggcaua

SEQ ID NO: 247486 - RNA, 23 nt, Human
ucccacacccaaauccuuccccc

SEQ ID NO: 247487 - RNA, 22 nt, Human
ucccccacucacaaccccaagu

SEQ ID NO: 247488 - RNA, 24 nt, Human
uccuucccccacucacaaccccaa

SEQ ID NO: 247489 - RNA, 18 nt, Human
ugagagggcgggagagcc

SEQ ID NO: 247490 - RNA, 22 nt, Human
ugcaaacgcagucccucucaca

SEQ ID NO: 247491 - RNA, 20 nt, Human
ugcacacacacacacacaca

SEQ ID NO: 247492 - RNA, 25 nt, Human
ugcacacacacacacacacacacac

SEQ ID NO: 247493 - RNA, 26 nt, Human
ugcacgcauacacacacgcacacaua

SEQ ID NO: 247494 - RNA, 24 nt, Human
ugcccacccucaggcgcacgugca

SEQ ID NO: 247495 - RNA, 21 nt, Human
ugcuuacguuaaaucacauuu

SEQ ID NO: 247496 - RNA, 23 nt, Human
ugcuugcagaagcaacuagagcg

SEQ ID NO: 247497 - RNA, 18 nt, Human
ugggaaaucucagguggg

SEQ ID NO: 247498 - RNA, 21 nt, Human
ugggaauauauuaagcuuuug

SEQ ID NO: 247499 - RNA, 22 nt, Human
ugggggcagcccgcccuggccc

SEQ ID NO: 247500 - RNA, 23 nt, Human
ugggucagguggcccccaacuga

SEQ ID NO: 247501 - RNA, 21 nt, Human
ugggugggggguggcucuucc

SEQ ID NO: 247502 - RNA, 28 nt, Human
uguccugcaccuucaucccacacccaaa

SEQ ID NO: 247503 - RNA, 19 nt, Human
uucccccacucacaacccc

SEQ ID NO: 247504 - RNA, 20 nt, Human
uuggagaggccacaguggug

SEQ ID NO: 247505 - RNA, 21 nt, Human
aaaacagcauuuccuauggcc

SEQ ID NO: 247506 - RNA, 21 nt, Human
aagaagagggcagggugagau

SEQ ID NO: 247507 - RNA, 21 nt, Human
aaggcaggaugaggcagaagc

SEQ ID NO: 247508 - RNA, 21 nt, Human
agccugagcuuuggggcucug

SEQ ID NO: 247509 - RNA, 21 nt, Human
agggcagggugagauuuccgg

SEQ ID NO: 247510 - RNA, 22 nt, Human
auacaaugacuacaaauguguc

SEQ ID NO: 247511 - RNA, 21 nt, Human
caaaauaccuugcauagcuua

SEQ ID NO: 247512 - RNA, 19 nt, Human
caacacaagaagagggcag

SEQ ID NO: 247513 - RNA, 25 nt, Human
caaguacauauguccuaugauuuua

SEQ ID NO: 247514 - RNA, 20 nt, Human
cacaacacaagaagagggca

SEQ ID NO: 247515 - RNA, 21 nt, Human
cacuaaggcaggaugaggcag

SEQ ID NO: 247516 - RNA, 27 nt, Human
cccugaacuccaggagcugcaggcccc

SEQ ID NO: 247517 - RNA, 19 nt, Human
cuccaggagcugcaggccc

SEQ ID NO: 247518 - RNA, 19 nt, Human
cugagcuuuggggcucugc

SEQ ID NO: 247519 - RNA, 20 nt, Human
cuugcauagcuuauucauuc

SEQ ID NO: 247520 - RNA, 22 nt, Human
gcagaagcaaguuguguccaca

SEQ ID NO: 247521 - RNA, 18 nt, Human
gcaggaugaggcagaagc

SEQ ID NO: 247522 - RNA, 21 nt, Human
gcuuuggggcucugcacugcg

SEQ ID NO: 247523 - RNA, 20 nt, Human
ggcagggugagauuuccggg

SEQ ID NO: 247524 - RNA, 22 nt, Human
ggcgagcaagaggggcaaggcu

SEQ ID NO: 247525 - RNA, 21 nt, Human
gggcagggugagauuuccggg

SEQ ID NO: 247526 - RNA, 22 nt, Human
uacaaaaaaacagcauuuccua

SEQ ID NO: 247527 - RNA, 21 nt, Human
uacaaaauaccuugcauagcu

SEQ ID NO: 247528 - RNA, 21 nt, Human
ucaaaugagauugcacacuaa

SEQ ID NO: 247529 - RNA, 18 nt, Human
uccacaaguacauauguc

SEQ ID NO: 247530 - RNA, 18 nt, Human
ucccugaacuccaggagc

SEQ ID NO: 247531 - RNA, 25 nt, Human
uccgggucucccugaacuccaggag

SEQ ID NO: 247532 - RNA, 26 nt, Human
ugaaguggugaauuuuaacucuuuga

SEQ ID NO: 247533 - RNA, 22 nt, Human
ugacaaacacaacacaagaaga

SEQ ID NO: 247534 - RNA, 20 nt, Human
ugcauacauccauauacaua

SEQ ID NO: 247535 - RNA, 19 nt, Human
uggccaguguucuacagaa

SEQ ID NO: 247536 - RNA, 20 nt, Human
uguauaaaaaauccaacuug

SEQ ID NO: 247537 - RNA, 21 nt, Human
uuguuccacaaguacauaugu

SEQ ID NO: 247538 - RNA, 24 nt, Human
uuuaugcauacauccauauacaua

SEQ ID NO: 247539 - RNA, 19 nt, Human
aaacagaauugagcagugc

SEQ ID NO: 247540 - RNA, 21 nt, Human
aaacgaaaaacagaauugagc

SEQ ID NO: 247541 - RNA, 23 nt, Human
acaaaauaagcaaaaaacaaaaa

SEQ ID NO: 247542 - RNA, 22 nt, Human
acauuaaaaagacaacauuaga

SEQ ID NO: 247543 - RNA, 20 nt, Human
acuaaacuuuucauucuauu

SEQ ID NO: 247544 - RNA, 18 nt, Human
agaaacuagaccuaaagu

SEQ ID NO: 247545 - RNA, 19 nt, Human
agacacuaaaguuugcucu

SEQ ID NO: 247546 - RNA, 22 nt, Human
agcaaaaaacaaaaaguguuaa

SEQ ID NO: 247547 - RNA, 24 nt, Human
agcacuuugggaggcugaggcagg

SEQ ID NO: 247548 - RNA, 23 nt, Human
agccuguaaucccagcacuuugg

SEQ ID NO: 247549 - RNA, 24 nt, Human
agccuguaaucccagcacuuuggg

SEQ ID NO: 247550 - RNA, 19 nt, Human
aggcugaggcagguggauc

SEQ ID NO: 247551 - RNA, 21 nt, Human
aggcugaggcagguggaucac

SEQ ID NO: 247552 - RNA, 20 nt, Human
aguauuaaguacaccaagcu

SEQ ID NO: 247553 - RNA, 24 nt, Human
auaaauacuaucaaaagaaacuag

SEQ ID NO: 247554 - RNA, 22 nt, Human
auuacaaucuauugaucacauc

SEQ ID NO: 247555 - RNA, 24 nt, Human
caaaaaacaaaaaguguuaaacag

SEQ ID NO: 247556 - RNA, 23 nt, Human
caccaagcuguccacauuuucag

SEQ ID NO: 247557 - RNA, 18 nt, Human
cagaagaucuucauacaa

SEQ ID NO: 247558 - RNA, 24 nt, Human
cagcacuuugggaggcugaggcag

SEQ ID NO: 247559 - RNA, 24 nt, Human
cagcacuuugggaggcugaggcag

SEQ ID NO: 247560 - RNA, 18 nt, Human
caucaaaaauagacauga

SEQ ID NO: 247561 - RNA, 19 nt, Human
caucaaaaauagacaugau

SEQ ID NO: 247562 - RNA, 20 nt, Human
caucaaaaauagacaugaua

SEQ ID NO: 247563 - RNA, 20 nt, Human
caucaaaaauagacaugaua

SEQ ID NO: 247564 - RNA, 19 nt, Human
ccauugugaauaugguuau

SEQ ID NO: 247565 - RNA, 20 nt, Human
ccuguaaucccagcacuuug

SEQ ID NO: 247566 - RNA, 19 nt, Human
cgaaaaacagaauugagca

SEQ ID NO: 247567 - RNA, 20 nt, Human
cuaacauuaaaaagacaaca

SEQ ID NO: 247568 - RNA, 18 nt, Human
cugcauauguauuuccuu

SEQ ID NO: 247569 - RNA, 24 nt, Human
cuguccacauuuucaggugagaaa

SEQ ID NO: 247570 - RNA, 22 nt, Human
gacaaugcaaacgaaaaacaga

SEQ ID NO: 247571 - RNA, 24 nt, Human
ggcaauaacaggugugcaaaagaa

SEQ ID NO: 247572 - RNA, 19 nt, Human
ggcuccgugggccuggugg

SEQ ID NO: 247573 - RNA, 19 nt, Human
uaaaaauggcaauguaaug

SEQ ID NO: 247574 - RNA, 21 nt, Human
uaagcaaaaaacaaaaagugu

SEQ ID NO: 247575 - RNA, 26 nt, Human
uagauuuugucgauuuauagcaauuu

SEQ ID NO: 247576 - RNA, 25 nt, Human
uauauaaguaaaaaaaaguuagacu

SEQ ID NO: 247577 - RNA, 23 nt, Human
ucaagccuguaaucccagcacuu

SEQ ID NO: 247578 - RNA, 20 nt, Human
ugaagcaaaauaauaaagug

SEQ ID NO: 247579 - RNA, 25 nt, Human
ugcaaacgaaaaacagaauugagca

SEQ ID NO: 247580 - RNA, 22 nt, Human
uggcaauaacaggugugcaaaa

SEQ ID NO: 247581 - RNA, 18 nt, Human
ugggaggcugaggcaggu

SEQ ID NO: 247582 - RNA, 24 nt, Human
ugggaggcugaggcagguggauca

SEQ ID NO: 247583 - RNA, 20 nt, Human
ugggcuccgugggccuggug

SEQ ID NO: 247584 - RNA, 23 nt, Human
uuaaauggcucaauuaguagaua

SEQ ID NO: 247585 - RNA, 25 nt, Human
uugggaggcugaggcagguggauca

SEQ ID NO: 247586 - RNA, 20 nt, Human
uuucacagucauaacuuaga

SEQ ID NO: 247587 - RNA, 26 nt, Human
uuuuauaaauauauaacuuugucacu

SEQ ID NO: 247588 - RNA, 21 nt, Human
aaacaagaaauccaacaaaga

SEQ ID NO: 247589 - RNA, 21 nt, Human
aacaagaaauccaacaaagaa

SEQ ID NO: 247590 - RNA, 23 nt, Human
aacucagcucaaugccggaagcc

SEQ ID NO: 247591 - RNA, 25 nt, Human
aagaacacaaacaagaaauccaaca

SEQ ID NO: 247592 - RNA, 18 nt, Human
accacccgcuaucccccu

SEQ ID NO: 247593 - RNA, 19 nt, Human
caacaaagaacugagcgca

SEQ ID NO: 247594 - RNA, 24 nt, Human
caacucagcucaaugccggaagcc

SEQ ID NO: 247595 - RNA, 24 nt, Human
caccguccguggugccgcgcccca

SEQ ID NO: 247596 - RNA, 23 nt, Human
ccaacaaagaacugagcgcagca

SEQ ID NO: 247597 - RNA, 18 nt, Human
ccaagccggacgggccca

SEQ ID NO: 247598 - RNA, 18 nt, Human
ccccuucccucaccaccc

SEQ ID NO: 247599 - RNA, 18 nt, Human
cccgccagcgccuccgcc

SEQ ID NO: 247600 - RNA, 18 nt, Human
cccgccagcgccuccgcc

SEQ ID NO: 247601 - RNA, 19 nt, Human
cccgccagcgccuccgccc

SEQ ID NO: 247602 - RNA, 23 nt, Human
cccucaccacccgcuaucccccu

SEQ ID NO: 247603 - RNA, 21 nt, Human
ccgcgccccagcccgggucug

SEQ ID NO: 247604 - RNA, 23 nt, Human
ccucaccacccgcuaucccccug

SEQ ID NO: 247605 - RNA, 18 nt, Human
ccuccgccccgacagccc

SEQ ID NO: 247606 - RNA, 23 nt, Human
ccuggccccggcgcaccgauggc

SEQ ID NO: 247607 - RNA, 18 nt, Human
cgccccgacagcccaagc

SEQ ID NO: 247608 - RNA, 19 nt, Human
cgccuccgccccgacagcc

SEQ ID NO: 247609 - RNA, 21 nt, Human
cgccuccgccccgacagccca

SEQ ID NO: 247610 - RNA, 25 nt, Human
cuccgccccgacagcccaagccgga

SEQ ID NO: 247611 - RNA, 23 nt, Human
gaagcccgccagcgccuccgccc

SEQ ID NO: 247612 - RNA, 23 nt, Human
gccccgacagcccaagccggacg

SEQ ID NO: 247613 - RNA, 21 nt, Human
gggcccagguucugccuggcc

SEQ ID NO: 247614 - RNA, 21 nt, Human
guccguggugccgcgccccag

SEQ ID NO: 247615 - RNA, 20 nt, Human
uaagaacacaaacaagaaau

SEQ ID NO: 247616 - RNA, 21 nt, Human
uaagaacacaaacaagaaauc

SEQ ID NO: 247617 - RNA, 23 nt, Human
uaagaacacaaacaagaaaucca

SEQ ID NO: 247618 - RNA, 24 nt, Human
uccgccccgacagcccaagccgga

SEQ ID NO: 247619 - RNA, 23 nt, Human
uccguggugccgcgccccagccc

SEQ ID NO: 247620 - RNA, 21 nt, Human
ugccggaagcccgccagcgcc

SEQ ID NO: 247621 - RNA, 21 nt, Human
uuuuuuuuuuuuuuuccgugg

SEQ ID NO: 247622 - RNA, 19 nt, Human
uuuuuuuuuuuuuuuuccg

SEQ ID NO: 247623 - RNA, 21 nt, Human
uuuuuuuuuuuuuuuuuccgu

SEQ ID NO: 247624 - RNA, 23 nt, Human
uuuuuuuuuuuuuuuuuccgugg

SEQ ID NO: 247625 - RNA, 25 nt, Human
aaaaaaaaaaaacccuuaaaaagga

SEQ ID NO: 247626 - RNA, 23 nt, Human
aaaaaaaaaacccuuaaaaagga

SEQ ID NO: 247627 - RNA, 18 nt, Human
aaaaaaaaaagggagaaa

SEQ ID NO: 247628 - RNA, 20 nt, Human
aaaaaaacccuuaaaaagga

SEQ ID NO: 247629 - RNA, 20 nt, Human
aaaaauuccuguuggggaca

SEQ ID NO: 247630 - RNA, 19 nt, Human
aaaaccucuaugccaccca

SEQ ID NO: 247631 - RNA, 25 nt, Human
aaaagacaaagaaaugaggccuaaa

SEQ ID NO: 247632 - RNA, 23 nt, Human
aaaaggaggaggguucauucuga

SEQ ID NO: 247633 - RNA, 20 nt, Human
aaacacacaaaacccuucac

SEQ ID NO: 247634 - RNA, 19 nt, Human
aaaccucuaugccacccaa

SEQ ID NO: 247635 - RNA, 21 nt, Human
aaaggaggaggguucauucug

SEQ ID NO: 247636 - RNA, 20 nt, Human
aacaacaagccgaguccccc

SEQ ID NO: 247637 - RNA, 21 nt, Human
aacaacaagccgagucccccc

SEQ ID NO: 247638 - RNA, 22 nt, Human
aacaagccgagucccccccaca

SEQ ID NO: 247639 - RNA, 21 nt, Human
aagcagcuuaauuaaagccag

SEQ ID NO: 247640 - RNA, 20 nt, Human
aagcaggagugaaacaugcc

SEQ ID NO: 247641 - RNA, 21 nt, Human
acaaaaccucuaugccaccca

SEQ ID NO: 247642 - RNA, 23 nt, Human
acaaaaccucuaugccacccaaa

SEQ ID NO: 247643 - RNA, 22 nt, Human
acaagccgagucccccccacac

SEQ ID NO: 247644 - RNA, 22 nt, Human
acaauggagacagguuccagga

SEQ ID NO: 247645 - RNA, 22 nt, Human
acacacacacacaacacgggca

SEQ ID NO: 247646 - RNA, 21 nt, Human
acacccucccugucccaaccc

SEQ ID NO: 247647 - RNA, 20 nt, Human
acccucccugucccaacccc

SEQ ID NO: 247648 - RNA, 20 nt, Human
agaaaugaggccuaaacaca

SEQ ID NO: 247649 - RNA, 24 nt, Human
agacaaagaaaugaggccuaaaca

SEQ ID NO: 247650 - RNA, 21 nt, Human
agaccgacaucaucagaaaua

SEQ ID NO: 247651 - RNA, 20 nt, Human
agagucucuuaaaugguucu

SEQ ID NO: 247652 - RNA, 18 nt, Human
agccgagucccccccaca

SEQ ID NO: 247653 - RNA, 23 nt, Human
aggaaaaagacaaagaaaugagg

SEQ ID NO: 247654 - RNA, 21 nt, Human
aggaagugggaugagggcugg

SEQ ID NO: 247655 - RNA, 21 nt, Human
aggaggccaccugggcagggc

SEQ ID NO: 247656 - RNA, 20 nt, Human
aggcagagcuaucagcccuc

SEQ ID NO: 247657 - RNA, 24 nt, Human
agguuguaaggccagagucagcac

SEQ ID NO: 247658 - RNA, 21 nt, Human
agucagcacagacccauggcu

SEQ ID NO: 247659 - RNA, 23 nt, Human
aucucccauacauaccacgagag

SEQ ID NO: 247660 - RNA, 21 nt, Human
auggaaccccaucaaugccag

SEQ ID NO: 247661 - RNA, 25 nt, Human
auuacuccaaaccggucaucuucuc

SEQ ID NO: 247662 - RNA, 26 nt, Human
caaaacacccucccugucccaacccc

SEQ ID NO: 247663 - RNA, 22 nt, Human
caaaacgaaagaauaugcacaa

SEQ ID NO: 247664 - RNA, 23 nt, Human
caaagaaaugaggccuaaacaca

SEQ ID NO: 247665 - RNA, 23 nt, Human
caacaacaagccgaguccccccc

SEQ ID NO: 247666 - RNA, 25 nt, Human
caacaacaagccgaguccccccucu

SEQ ID NO: 247667 - RNA, 19 nt, Human
caacaagccgagucccccc

SEQ ID NO: 247668 - RNA, 23 nt, Human
caacaagccgagucccccccaca

SEQ ID NO: 247669 - RNA, 21 nt, Human
caaccccaaauggccacuccc

SEQ ID NO: 247670 - RNA, 24 nt, Human
caagcagcuuaauuaaagccagga

SEQ ID NO: 247671 - RNA, 23 nt, Human
cacacacacacacaacacgggca

SEQ ID NO: 247672 - RNA, 19 nt, Human
cacacucacucacucacuc

SEQ ID NO: 247673 - RNA, 18 nt, Human
cacagacccauggcuccu

SEQ ID NO: 247674 - RNA, 24 nt, Human
cacccaaaacacccucccuguccc

SEQ ID NO: 247675 - RNA, 25 nt, Human
cacccaaaacacccucccuguccca

SEQ ID NO: 247676 - RNA, 24 nt, Human
cacccucccugucccaaccccaaa

SEQ ID NO: 247677 - RNA, 20 nt, Human
caccgacaacaacaagccga

SEQ ID NO: 247678 - RNA, 21 nt, Human
caccgacaacaacaagccgag

SEQ ID NO: 247679 - RNA, 18 nt, Human
cacggcccuccgugaggc

SEQ ID NO: 247680 - RNA, 18 nt, Human
cacuaugugcucagaggu

SEQ ID NO: 247681 - RNA, 21 nt, Human
cacuggcccucaauacaaaac

SEQ ID NO: 247682 - RNA, 18 nt, Human
cagcggcggcggggaggg

SEQ ID NO: 247683 - RNA, 24 nt, Human
caugugcccggcagggcuggagga

SEQ ID NO: 247684 - RNA, 18 nt, Human
cauucugauuacuccaaa

SEQ ID NO: 247685 - RNA, 22 nt, Human
ccaaaacgaaagaauaugcaca

SEQ ID NO: 247686 - RNA, 19 nt, Human
ccaaaccggucaucuucuc

SEQ ID NO: 247687 - RNA, 24 nt, Human
ccaccugggcagggcaggcguccc

SEQ ID NO: 247688 - RNA, 21 nt, Human
ccaggacaguaggaaaggaag

SEQ ID NO: 247689 - RNA, 23 nt, Human
cccaaaacacccucccuguccca

SEQ ID NO: 247690 - RNA, 19 nt, Human
cccaaccccaaauggccac

SEQ ID NO: 247691 - RNA, 22 nt, Human
cccaucaaugccagcaaaggag

SEQ ID NO: 247692 - RNA, 23 nt, Human
ccccaaauggccacucccuggug

SEQ ID NO: 247693 - RNA, 24 nt, Human
ccccaaauggccacucccuggugg

SEQ ID NO: 247694 - RNA, 18 nt, Human
ccccccacacacacacuc

SEQ ID NO: 247695 - RNA, 22 nt, Human
cccccccacacacacacucacu

SEQ ID NO: 247696 - RNA, 25 nt, Human
cccugguggcugcugcuucacugcu

SEQ ID NO: 247697 - RNA, 21 nt, Human
ccgagucccccccacacacac

SEQ ID NO: 247698 - RNA, 21 nt, Human
ccuacggcccagggagcggcc

SEQ ID NO: 247699 - RNA, 23 nt, Human
ccucaauacaaaaccucuaugcc

SEQ ID NO: 247700 - RNA, 20 nt, Human
ccucccugucccaaccccaa

SEQ ID NO: 247701 - RNA, 25 nt, Human
ccucccugucccaaccccaaauggc

SEQ ID NO: 247702 - RNA, 18 nt, Human
ccugucccaaccccaaau

SEQ ID NO: 247703 - RNA, 22 nt, Human
cgccgcaggcuuaaacagcugg

SEQ ID NO: 247704 - RNA, 21 nt, Human
cggcccagggagcggccacug

SEQ ID NO: 247705 - RNA, 22 nt, Human
cggcccagggagcggccacugc

SEQ ID NO: 247706 - RNA, 20 nt, Human
cggcggcggggaggggaagg

SEQ ID NO: 247707 - RNA, 23 nt, Human
cuaaacacacaaaacccuucacu

SEQ ID NO: 247708 - RNA, 21 nt, Human
cucaauacaaaaccucuaugc

SEQ ID NO: 247709 - RNA, 22 nt, Human
cucaauacaaaaccucuaugcc

SEQ ID NO: 247710 - RNA, 25 nt, Human
cucacucacacacacacacaacacg

SEQ ID NO: 247711 - RNA, 19 nt, Human
cucacucacucacucacuc

SEQ ID NO: 247712 - RNA, 20 nt, Human
cucacucacucgcucucuca

SEQ ID NO: 247713 - RNA, 23 nt, Human
cucugugcugcgaaucugucccc

SEQ ID NO: 247714 - RNA, 23 nt, Human
cuuaacuugcaagacaauucuuc

SEQ ID NO: 247715 - RNA, 21 nt, Human
gaagaaagaaagauuucauca

SEQ ID NO: 247716 - RNA, 24 nt, Human
gacgauggagacagacaguuuuua

SEQ ID NO: 247717 - RNA, 21 nt, Human
gaggaggguucauucugauua

SEQ ID NO: 247718 - RNA, 21 nt, Human
gcugcugcuucacugcugcca

SEQ ID NO: 247719 - RNA, 19 nt, Human
gcuggaucacacaauggag

SEQ ID NO: 247720 - RNA, 20 nt, Human
ggaaaaagacaaagaaauga

SEQ ID NO: 247721 - RNA, 20 nt, Human
ggaaggggugaaggggaggg

SEQ ID NO: 247722 - RNA, 20 nt, Human
ggacagggaaucccugaagg

SEQ ID NO: 247723 - RNA, 19 nt, Human
ggcagagcuaucagcccuc

SEQ ID NO: 247724 - RNA, 18 nt, Human
ggcaggcgucccccgggc

SEQ ID NO: 247725 - RNA, 19 nt, Human
ggcaugugcccggcagggc

SEQ ID NO: 247726 - RNA, 23 nt, Human
gggaagaaagaaagauuucauca

SEQ ID NO: 247727 - RNA, 24 nt, Human
gggcagggcaggcgucccccgggc

SEQ ID NO: 247728 - RNA, 20 nt, Human
gggcaugugcccggcagggc

SEQ ID NO: 247729 - RNA, 18 nt, Human
ggggaaggggugaagggg

SEQ ID NO: 247730 - RNA, 21 nt, Human
gguaaagggagggcccagggc

SEQ ID NO: 247731 - RNA, 20 nt, Human
guucauucaaaaauggaacc

SEQ ID NO: 247732 - RNA, 21 nt, Human
uaaacacacaaaacccuucac

SEQ ID NO: 247733 - RNA, 20 nt, Human
uaaacagcuggcugagagaa

SEQ ID NO: 247734 - RNA, 18 nt, Human
uaaagggagggcccaggg

SEQ ID NO: 247735 - RNA, 18 nt, Human
uacaaaaccucuaugcca

SEQ ID NO: 247736 - RNA, 24 nt, Human
uacaaaaucaguuggcucuauuuc

SEQ ID NO: 247737 - RNA, 22 nt, Human
uacacauaugaagguaaaggga

SEQ ID NO: 247738 - RNA, 23 nt, Human
uacacuagaaaucagcaaaugcc

SEQ ID NO: 247739 - RNA, 23 nt, Human
uacuuuuuauuuccauggaaugg

SEQ ID NO: 247740 - RNA, 22 nt, Human
uagaaaaaggaaaaaaaaaaaa

SEQ ID NO: 247741 - RNA, 22 nt, Human
uagaaaucagcaaaugccagga

SEQ ID NO: 247742 - RNA, 20 nt, Human
uagcuuuuuagaaaaaggaa

SEQ ID NO: 247743 - RNA, 22 nt, Human
ucaccgacaacaacaagccgag

SEQ ID NO: 247744 - RNA, 24 nt, Human
ucacucacacacacacacaacacg

SEQ ID NO: 247745 - RNA, 18 nt, Human
ucacucacucacucacuc

SEQ ID NO: 247746 - RNA, 19 nt, Human
ucacuggcaucugcugacc

SEQ ID NO: 247747 - RNA, 25 nt, Human
ucagcccucaagcagcuuaauuaaa

SEQ ID NO: 247748 - RNA, 18 nt, Human
ucaucagaaauagguaca

SEQ ID NO: 247749 - RNA, 20 nt, Human
uccacagaaaaagcugccaa

SEQ ID NO: 247750 - RNA, 21 nt, Human
uccuacggcccagggagcggc

SEQ ID NO: 247751 - RNA, 23 nt, Human
ucucacucacacacacacacaac

SEQ ID NO: 247752 - RNA, 23 nt, Human
ucucccauacauaccacgagagu

SEQ ID NO: 247753 - RNA, 20 nt, Human
ucugaaaccuguguaagcuu

SEQ ID NO: 247754 - RNA, 19 nt, Human
ugaaaggaggaugagacga

SEQ ID NO: 247755 - RNA, 24 nt, Human
ugaggccuaaacacacaaaacccu

SEQ ID NO: 247756 - RNA, 25 nt, Human
ugcccggcagggcuggaggagcugg

SEQ ID NO: 247757 - RNA, 18 nt, Human
ugcucagagguccggccg

SEQ ID NO: 247758 - RNA, 23 nt, Human
uggaauggaaucaaacacgaacu

SEQ ID NO: 247759 - RNA, 24 nt, Human
uggaauggaaucaaacacgaacuu

SEQ ID NO: 247760 - RNA, 24 nt, Human
uggaggagcugguagggugggcag

SEQ ID NO: 247761 - RNA, 21 nt, Human
uggcugcugcuucacugcugc

SEQ ID NO: 247762 - RNA, 22 nt, Human
ugggaaggguccgcacuggggu

SEQ ID NO: 247763 - RNA, 23 nt, Human
uggggacagggaaucccugaagg

SEQ ID NO: 247764 - RNA, 24 nt, Human
ugguagggugggcaggacacuaug

SEQ ID NO: 247765 - RNA, 19 nt, Human
ugucccaaccccaaauggc

SEQ ID NO: 247766 - RNA, 21 nt, Human
ugucgcuuugcaagaccgaca

SEQ ID NO: 247767 - RNA, 20 nt, Human
uuaaaaaauauacaguggaa

SEQ ID NO: 247768 - RNA, 22 nt, Human
uuaaacagcuggcugagagaag

SEQ ID NO: 247769 - RNA, 21 nt, Human
uucacuggcaucugcugacca

SEQ ID NO: 247770 - RNA, 19 nt, Human
uucuucggcaguauguaca

SEQ ID NO: 247771 - RNA, 20 nt, Human
uugaaggcuuccugcugcca

SEQ ID NO: 247772 - RNA, 20 nt, Human
uuuccaugugaauaagccau

SEQ ID NO: 247773 - RNA, 23 nt, Human
uuuuuuuuuuuuuuuuuuuaagg

SEQ ID NO: 247774 - RNA, 23 nt, Human
aaaaaaaaaaaaaaggaaaagaa

SEQ ID NO: 247775 - RNA, 19 nt, Human
aaccaacuuggagcucacc

SEQ ID NO: 247776 - RNA, 21 nt, Human
acaggcacccccuccgccccc

SEQ ID NO: 247777 - RNA, 20 nt, Human
agagaggagaggggguacgg

SEQ ID NO: 247778 - RNA, 19 nt, Human
agaggagaggggguacggg

SEQ ID NO: 247779 - RNA, 19 nt, Human
agauguagggccccuugcu

SEQ ID NO: 247780 - RNA, 23 nt, Human
aggaguuggugggaaaagagggg

SEQ ID NO: 247781 - RNA, 28 nt, Human
aggcggggggcgcggccuccucgcgcgg

SEQ ID NO: 247782 - RNA, 18 nt, Human
agggagcccacagcugug

SEQ ID NO: 247783 - RNA, 23 nt, Human
aggggacccggccggccuuggcu

SEQ ID NO: 247784 - RNA, 22 nt, Human
aggggcugcagacagcaggggg

SEQ ID NO: 247785 - RNA, 25 nt, Human
aggggguacgggcaguggcugcucg

SEQ ID NO: 247786 - RNA, 24 nt, Human
caacuccccggggaggggcugcag

SEQ ID NO: 247787 - RNA, 23 nt, Human
caaggcagacgcgaccggggcca

SEQ ID NO: 247788 - RNA, 18 nt, Human
cacaggcacccccuccgc

SEQ ID NO: 247789 - RNA, 23 nt, Human
caccccugcccacuguccagggg

SEQ ID NO: 247790 - RNA, 24 nt, Human
cagacagcagggggagaggacugg

SEQ ID NO: 247791 - RNA, 26 nt, Human
ccaaggcagacgcgaccggggccacg

SEQ ID NO: 247792 - RNA, 22 nt, Human
ccaggguugggagggaaguggc

SEQ ID NO: 247793 - RNA, 21 nt, Human
cccccuggaaaaaaaaaaaaa

SEQ ID NO: 247794 - RNA, 21 nt, Human
ccccuaagaaaacauuucuuc

SEQ ID NO: 247795 - RNA, 21 nt, Human
ccccugcccacuguccagggg

SEQ ID NO: 247796 - RNA, 19 nt, Human
cccgagagggagcccacag

SEQ ID NO: 247797 - RNA, 18 nt, Human
cccuggaaaaaaaaaaaa

SEQ ID NO: 247798 - RNA, 18 nt, Human
cccugggaagacagggca

SEQ ID NO: 247799 - RNA, 22 nt, Human
ccgcccccgagagggagcccac

SEQ ID NO: 247800 - RNA, 25 nt, Human
ccggggccacggcgaccgucgaggu

SEQ ID NO: 247801 - RNA, 19 nt, Human
ccuccggagauuguagccg

SEQ ID NO: 247802 - RNA, 23 nt, Human
ccuccuuuccuucuggaggcucc

SEQ ID NO: 247803 - RNA, 22 nt, Human
ccuugcucuuugucuucuucuc

SEQ ID NO: 247804 - RNA, 18 nt, Human
cgaccggggccacggcga

SEQ ID NO: 247805 - RNA, 24 nt, Human
cgcggcgauaguggcggcggaggc

SEQ ID NO: 247806 - RNA, 27 nt, Human
cggccuuggcucccguguggauggcuu

SEQ ID NO: 247807 - RNA, 22 nt, Human
cuacuccauucuccccucuccc

SEQ ID NO: 247808 - RNA, 18 nt, Human
cucacaagucccugggaa

SEQ ID NO: 247809 - RNA, 22 nt, Human
cuccauucuccccucucccccg

SEQ ID NO: 247810 - RNA, 20 nt, Human
cugccaccccugcccacugu

SEQ ID NO: 247811 - RNA, 21 nt, Human
cugggaagacagggcaugggc

SEQ ID NO: 247812 - RNA, 21 nt, Human
cugugggaggggccggggucc

SEQ ID NO: 247813 - RNA, 19 nt, Human
cuucagggccgcugugucc

SEQ ID NO: 247814 - RNA, 21 nt, Human
cuuuccuucuggaggcuccuu

SEQ ID NO: 247815 - RNA, 22 nt, Human
gaaaaaaaaaaaaaaggaaaag

SEQ ID NO: 247816 - RNA, 24 nt, Human
gaaaaaaaaaaaaaaggaaaagaa

SEQ ID NO: 247817 - RNA, 20 nt, Human
gacucuacuccauucucccc

SEQ ID NO: 247818 - RNA, 20 nt, Human
gagaggagcuuguaccaagg

SEQ ID NO: 247819 - RNA, 19 nt, Human
gagcuuguaccaagggacc

SEQ ID NO: 247820 - RNA, 22 nt, Human
gccgacacuggcggggguggcg

SEQ ID NO: 247821 - RNA, 21 nt, Human
gcuuacagagaggagaggggg

SEQ ID NO: 247822 - RNA, 18 nt, Human
ggaaaaaaaaaaaaaagg

SEQ ID NO: 247823 - RNA, 21 nt, Human
ggaaaaaaaaaaaaaaggaaa

SEQ ID NO: 247824 - RNA, 18 nt, Human
ggaagacagggcaugggc

SEQ ID NO: 247825 - RNA, 21 nt, Human
ggaggcggggggcgcggccuc

SEQ ID NO: 247826 - RNA, 18 nt, Human
ggccggccuuggcucccg

SEQ ID NO: 247827 - RNA, 21 nt, Human
ggcggggggcgcggccucggc

SEQ ID NO: 247828 - RNA, 22 nt, Human
gggaaauaggaguuggugggaa

SEQ ID NO: 247829 - RNA, 20 nt, Human
gggacccggccggccuuggc

SEQ ID NO: 247830 - RNA, 23 nt, Human
gggcgcggccucggccgcgggcg

SEQ ID NO: 247831 - RNA, 24 nt, Human
gggcugcagacagcagggggagag

SEQ ID NO: 247832 - RNA, 21 nt, Human
ggggaggggcugcagacagca

SEQ ID NO: 247833 - RNA, 22 nt, Human
guggcggcggaggcggggggcg

SEQ ID NO: 247834 - RNA, 24 nt, Human
guguccucugccaccccugcccac

SEQ ID NO: 247835 - RNA, 24 nt, Human
uaaaaccuagcgaauuccccuaag

SEQ ID NO: 247836 - RNA, 25 nt, Human
uaagaaaacauuucuuccuccuuuc

SEQ ID NO: 247837 - RNA, 18 nt, Human
uagccguucuugaacucc

SEQ ID NO: 247838 - RNA, 21 nt, Human
uaggaguuggugggaaaagag

SEQ ID NO: 247839 - RNA, 18 nt, Human
ucacaggcacccccuccg

SEQ ID NO: 247840 - RNA, 21 nt, Human
ucccccgcaaccaacuuggag

SEQ ID NO: 247841 - RNA, 21 nt, Human
uccucugccaccccugcccac

SEQ ID NO: 247842 - RNA, 20 nt, Human
uccuugguugguagggaaau

SEQ ID NO: 247843 - RNA, 18 nt, Human
ucuuccuccuuuccuucu

SEQ ID NO: 247844 - RNA, 22 nt, Human
ucuugaacuccuuggcgcacag

SEQ ID NO: 247845 - RNA, 19 nt, Human
uggaaaaaaaaaaaaaagg

SEQ ID NO: 247846 - RNA, 19 nt, Human
uggaaaaaaaaaaaaaagg

SEQ ID NO: 247847 - RNA, 18 nt, Human
uggaggcuccuugguugg

SEQ ID NO: 247848 - RNA, 24 nt, Human
uggcggggguggcggagggggccg

SEQ ID NO: 247849 - RNA, 19 nt, Human
uggcugagagcucacaggc

SEQ ID NO: 247850 - RNA, 21 nt, Human
uggcugagagcucacaggcac

SEQ ID NO: 247851 - RNA, 26 nt, Human
uggugggaaaagaggggggagaggag

SEQ ID NO: 247852 - RNA, 19 nt, Human
ugucuucuucuccaaggca

SEQ ID NO: 247853 - RNA, 26 nt, Human
uguggauggcuucgugccuccggaga

SEQ ID NO: 247854 - RNA, 29 nt, Human
uguggauggcuucgugccuccggagauuu

SEQ ID NO: 247855 - RNA, 20 nt, Human
uuggugggaaaagagggggg

SEQ ID NO: 247856 - RNA, 24 nt, Human
uuggugggaaaagaggggggagag

SEQ ID NO: 247857 - RNA, 23 nt, Human
aaacaaagcagacacucagaagc

SEQ ID NO: 247858 - RNA, 25 nt, Human
aaacaaagcagacacucagaagcaa

SEQ ID NO: 247859 - RNA, 21 nt, Human
aacaccccagccccagccccu

SEQ ID NO: 247860 - RNA, 24 nt, Human
aagaagacaaaaagagcaaguaug

SEQ ID NO: 247861 - RNA, 23 nt, Human
aaggggccagugauuaaucagac

SEQ ID NO: 247862 - RNA, 21 nt, Human
acaaagcagacacucagaagc

SEQ ID NO: 247863 - RNA, 18 nt, Human
acaccccagccccagccc

SEQ ID NO: 247864 - RNA, 18 nt, Human
acccggggcccagauggg

SEQ ID NO: 247865 - RNA, 23 nt, Human
agaacacagugagccaagggcac

SEQ ID NO: 247866 - RNA, 24 nt, Human
agccaacuucaacaccccagcccc

SEQ ID NO: 247867 - RNA, 19 nt, Human
caaaaagagcaaguauggg

SEQ ID NO: 247868 - RNA, 20 nt, Human
caaagcagacacucagaagc

SEQ ID NO: 247869 - RNA, 24 nt, Human
caaagcagacacucagaagcaaac

SEQ ID NO: 247870 - RNA, 23 nt, Human
caacuucaacaccccagccccag

SEQ ID NO: 247871 - RNA, 22 nt, Human
cacacaaguuccagauagucaa

SEQ ID NO: 247872 - RNA, 18 nt, Human
cacugccauaccugagga

SEQ ID NO: 247873 - RNA, 19 nt, Human
cagccccucagcuccuccu

SEQ ID NO: 247874 - RNA, 23 nt, Human
ccaacuucaacaccccagcccca

SEQ ID NO: 247875 - RNA, 21 nt, Human
ccagauagucaaaugcuuccc

SEQ ID NO: 247876 - RNA, 21 nt, Human
ccaugcagaacacagugagcc

SEQ ID NO: 247877 - RNA, 20 nt, Human
cccagccccucagcuccucc

SEQ ID NO: 247878 - RNA, 22 nt, Human
ccccagccccagccccucagcu

SEQ ID NO: 247879 - RNA, 23 nt, Human
ccccagccccagccccucagcuc

SEQ ID NO: 247880 - RNA, 19 nt, Human
ccccucagcuccuccugcc

SEQ ID NO: 247881 - RNA, 18 nt, Human
cccggggcccagaugggu

SEQ ID NO: 247882 - RNA, 20 nt, Human
ccgcucucucuugaacccgg

SEQ ID NO: 247883 - RNA, 24 nt, Human
ccggggcccagaugggugggggug

SEQ ID NO: 247884 - RNA, 20 nt, Human
ccucagcuccuccugcccac

SEQ ID NO: 247885 - RNA, 26 nt, Human
ccuccugcccaccucuacuaaacaaa

SEQ ID NO: 247886 - RNA, 22 nt, Human
cuacuaaacaaagcagacacuc

SEQ ID NO: 247887 - RNA, 24 nt, Human
cuacuaaacaaagcagacacucag

SEQ ID NO: 247888 - RNA, 23 nt, Human
cucagcuccuccugcccaccucu

SEQ ID NO: 247889 - RNA, 22 nt, Human
cugaagaagacaaaaagagcaa

SEQ ID NO: 247890 - RNA, 20 nt, Human
cuuggauuugggguuacagc

SEQ ID NO: 247891 - RNA, 20 nt, Human
gaccccgcucucucuugaac

SEQ ID NO: 247892 - RNA, 20 nt, Human
gcagaacacagugagccaag

SEQ ID NO: 247893 - RNA, 20 nt, Human
ggggugggagcggcaggggc

SEQ ID NO: 247894 - RNA, 23 nt, Human
uaaaaccaggugagucacugcca

SEQ ID NO: 247895 - RNA, 20 nt, Human
ucaacaccccagccccagcc

SEQ ID NO: 247896 - RNA, 18 nt, Human
ucacuggguguccuggcc

SEQ ID NO: 247897 - RNA, 22 nt, Human
ucagaagcaaacucuauauggc

SEQ ID NO: 247898 - RNA, 21 nt, Human
ucagcuccuccugcccaccuc

SEQ ID NO: 247899 - RNA, 21 nt, Human
uccaaaccaugcagaacacag

SEQ ID NO: 247900 - RNA, 20 nt, Human
ucccagggugaugacauccc

SEQ ID NO: 247901 - RNA, 23 nt, Human
uccccagcuggcccgcccagccc

SEQ ID NO: 247902 - RNA, 23 nt, Human
uccugcccaccucuacuaaacaa

SEQ ID NO: 247903 - RNA, 20 nt, Human
ucugaagaagacaaaaagag

SEQ ID NO: 247904 - RNA, 21 nt, Human
ugaagaagacaaaaagagcaa

SEQ ID NO: 247905 - RNA, 19 nt, Human
ugggguuacagccaguuug

SEQ ID NO: 247906 - RNA, 18 nt, Human
uguccuggccccaacagc

SEQ ID NO: 247907 - RNA, 23 nt, Human
uguccuggccccaacagcugggg

SEQ ID NO: 247908 - RNA, 22 nt, Human
uuaaaaccaggugagucacugc

SEQ ID NO: 247909 - RNA, 19 nt, Human
uucccagggugaugacauc

SEQ ID NO: 247910 - RNA, 20 nt, Human
uuguuuuauuaaaaccaggu

SEQ ID NO: 247911 - RNA, 22 nt, Human
aagaugggccacaagagacauu

SEQ ID NO: 247912 - RNA, 20 nt, Human
aagcagcagcacauuguuuu

SEQ ID NO: 247913 - RNA, 24 nt, Human
acacuuggaagguuggugcugggg

SEQ ID NO: 247914 - RNA, 19 nt, Human
acugugccccaaacaaggu

SEQ ID NO: 247915 - RNA, 18 nt, Human
agcugcuccaccuucccc

SEQ ID NO: 247916 - RNA, 23 nt, Human
aggaagcagcaguagccaguuug

SEQ ID NO: 247917 - RNA, 24 nt, Human
agguggugagagacugacaugggu

SEQ ID NO: 247918 - RNA, 19 nt, Human
agucaggccugcagccagg

SEQ ID NO: 247919 - RNA, 22 nt, Human
agucaggccugcagccaggccu

SEQ ID NO: 247920 - RNA, 24 nt, Human
auagaaacuaaauuauuuccaauu

SEQ ID NO: 247921 - RNA, 20 nt, Human
aucaccaugaaauccauggu

SEQ ID NO: 247922 - RNA, 25 nt, Human
aucauccuuucagcuucucuaauuc

SEQ ID NO: 247923 - RNA, 22 nt, Human
augacacaaaaauagccaggac

SEQ ID NO: 247924 - RNA, 18 nt, Human
auggcgagggucccuccu

SEQ ID NO: 247925 - RNA, 19 nt, Human
caaacaagguucacaaaag

SEQ ID NO: 247926 - RNA, 21 nt, Human
caauacuugaauaaaugacac

SEQ ID NO: 247927 - RNA, 22 nt, Human
caccaugaaauccauggucuuc

SEQ ID NO: 247928 - RNA, 24 nt, Human
cacccacaucaucgaagcuggagg

SEQ ID NO: 247929 - RNA, 23 nt, Human
cacuuggaagguuggugcugggg

SEQ ID NO: 247930 - RNA, 21 nt, Human
cagcaaguuuuuucugggugg

SEQ ID NO: 247931 - RNA, 18 nt, Human
cagcaguagccaguuugg

SEQ ID NO: 247932 - RNA, 19 nt, Human
caggaucauccuuucagcu

SEQ ID NO: 247933 - RNA, 23 nt, Human
caugauaaaguuggaaauccauu

SEQ ID NO: 247934 - RNA, 20 nt, Human
ccacaucaucgaagcuggag

SEQ ID NO: 247935 - RNA, 23 nt, Human
ccauguaucugcuagaucaccuc

SEQ ID NO: 247936 - RNA, 20 nt, Human
cccauggcgagggucccucc

SEQ ID NO: 247937 - RNA, 21 nt, Human
cccauggcgagggucccuccu

SEQ ID NO: 247938 - RNA, 20 nt, Human
cccguggacccauggcgagg

SEQ ID NO: 247939 - RNA, 19 nt, Human
cccuccuccccuuccuccu

SEQ ID NO: 247940 - RNA, 21 nt, Human
cccuccuccccuuccuccucc

SEQ ID NO: 247941 - RNA, 19 nt, Human
ccucccaacaauuuucuga

SEQ ID NO: 247942 - RNA, 18 nt, Human
ccucccgccucgcccucc

SEQ ID NO: 247943 - RNA, 20 nt, Human
ccucccgccucgcccuccuc

SEQ ID NO: 247944 - RNA, 19 nt, Human
ccucgcccuccuccccuuc

SEQ ID NO: 247945 - RNA, 21 nt, Human
ccucgcccuccuccccuuccu

SEQ ID NO: 247946 - RNA, 23 nt, Human
ccugcaccucccgccucgcccuc

SEQ ID NO: 247947 - RNA, 20 nt, Human
ccugcagcugcuccaccuuc

SEQ ID NO: 247948 - RNA, 20 nt, Human
ccugcagcugcuccaccuuc

SEQ ID NO: 247949 - RNA, 21 nt, Human
ccugcagcugcuccaccuucc

SEQ ID NO: 247950 - RNA, 25 nt, Human
cguggacccauggcgagggucccuc

SEQ ID NO: 247951 - RNA, 19 nt, Human
cuacugugccccaaacaag

SEQ ID NO: 247952 - RNA, 19 nt, Human
cucccacacuuuacaucca

SEQ ID NO: 247953 - RNA, 18 nt, Human
cucgugcucgugggcucc

SEQ ID NO: 247954 - RNA, 18 nt, Human
cucuaggcccguggaccc

SEQ ID NO: 247955 - RNA, 21 nt, Human
cugcaccucccgccucgcccu

SEQ ID NO: 247956 - RNA, 21 nt, Human
cugcagcugcuccaccuuccc

SEQ ID NO: 247957 - RNA, 23 nt, Human
cugcuagaucaccucguuggugu

SEQ ID NO: 247958 - RNA, 22 nt, Human
cuuccaguaagaugggccacaa

SEQ ID NO: 247959 - RNA, 25 nt, Human
cuugcuggaaucaccaugaaaucca

SEQ ID NO: 247960 - RNA, 20 nt, Human
gagagacugacauggguucc

SEQ ID NO: 247961 - RNA, 20 nt, Human
gaggccacaggaagcagcag

SEQ ID NO: 247962 - RNA, 19 nt, Human
gauaaaguuggaaauccau

SEQ ID NO: 247963 - RNA, 18 nt, Human
gcaccucccgccucgccc

SEQ ID NO: 247964 - RNA, 22 nt, Human
gcagcaguagccaguuuggcac

SEQ ID NO: 247965 - RNA, 19 nt, Human
gcagcugcuccaccuuccc

SEQ ID NO: 247966 - RNA, 19 nt, Human
gcauauuuaacucugugag

SEQ ID NO: 247967 - RNA, 23 nt, Human
gcccuccuccccuuccuccuccu

SEQ ID NO: 247968 - RNA, 21 nt, Human
gccucgcccuccuccccuucc

SEQ ID NO: 247969 - RNA, 18 nt, Human
ggaagguuggugcugggg

SEQ ID NO: 247970 - RNA, 22 nt, Human
ggacacccacaucaucgaagcu

SEQ ID NO: 247971 - RNA, 23 nt, Human
ggccugcagcugcuccaccuucc

SEQ ID NO: 247972 - RNA, 18 nt, Human
gucaccuuggugaggcua

SEQ ID NO: 247973 - RNA, 19 nt, Human
gucuguagaagccuccagc

SEQ ID NO: 247974 - RNA, 18 nt, Human
gugucaccuuggugaggc

SEQ ID NO: 247975 - RNA, 20 nt, Human
uaaaugacacaaaaauagcu

SEQ ID NO: 247976 - RNA, 20 nt, Human
uacauccaucuucccuuccc

SEQ ID NO: 247977 - RNA, 22 nt, Human
uacauccaucuucccuucccga

SEQ ID NO: 247978 - RNA, 20 nt, Human
uacugugccccaaacaaggu

SEQ ID NO: 247979 - RNA, 23 nt, Human
uauguuucccggaacucucuucc

SEQ ID NO: 247980 - RNA, 19 nt, Human
ucagcuuugcauuuucagc

SEQ ID NO: 247981 - RNA, 18 nt, Human
ucaggccugcagccaggc

SEQ ID NO: 247982 - RNA, 21 nt, Human
ucaggccugcagccaggccug

SEQ ID NO: 247983 - RNA, 19 nt, Human
ucaggugagcagugagacc

SEQ ID NO: 247984 - RNA, 19 nt, Human
uccaccuuccccaggauca

SEQ ID NO: 247985 - RNA, 19 nt, Human
uccucaggugagcagugag

SEQ ID NO: 247986 - RNA, 21 nt, Human
ucgcccuccuccccuuccucc

SEQ ID NO: 247987 - RNA, 20 nt, Human
ucgugcucgugggcuccacu

SEQ ID NO: 247988 - RNA, 25 nt, Human
ucugcaggacacccacaucaucgaa

SEQ ID NO: 247989 - RNA, 18 nt, Human
ucuguagaagccuccagu

SEQ ID NO: 247990 - RNA, 18 nt, Human
ugaagcagcagcacauug

SEQ ID NO: 247991 - RNA, 21 nt, Human
ugagagacugacauggguucc

SEQ ID NO: 247992 - RNA, 20 nt, Human
ugcaggacacccacaucauc

SEQ ID NO: 247993 - RNA, 22 nt, Human
ugcauuuucagcaacauaguua

SEQ ID NO: 247994 - RNA, 23 nt, Human
ugcccugcagacuugaauccuac

SEQ ID NO: 247995 - RNA, 20 nt, Human
ugcucgugggcuccacugug

SEQ ID NO: 247996 - RNA, 20 nt, Human
uggcgagggucccuccugca

SEQ ID NO: 247997 - RNA, 24 nt, Human
ugggccacaagagacauuuugcuu

SEQ ID NO: 247998 - RNA, 18 nt, Human
uggguuccaggccauccu

SEQ ID NO: 247999 - RNA, 18 nt, Human
ugugggcaguagucaggc

SEQ ID NO: 248000 - RNA, 22 nt, Human
uguuucccggaacucucuucca

SEQ ID NO: 248001 - RNA, 25 nt, Human
uucaccauuuguaauacauauugau

SEQ ID NO: 248002 - RNA, 20 nt, Human
uuccccaggaucauccuuuc

SEQ ID NO: 248003 - RNA, 22 nt, Human
uugccauguaucugcuagauca

SEQ ID NO: 248004 - RNA, 20 nt, Human
uuuugcuugauaaccggagg

SEQ ID NO: 248005 - RNA, 18 nt, Human
aaacagaagggaaaccga

SEQ ID NO: 248006 - RNA, 25 nt, Human
aaacagaagggaaaccgaggcaggg

SEQ ID NO: 248007 - RNA, 23 nt, Human
aacagaagggaaaccgaggcagg

SEQ ID NO: 248008 - RNA, 21 nt, Human
aagccggacucuguagaggac

SEQ ID NO: 248009 - RNA, 24 nt, Human
aagcugccagcccacugccuccau

SEQ ID NO: 248010 - RNA, 19 nt, Human
accagggacuggccgcaga

SEQ ID NO: 248011 - RNA, 24 nt, Human
accccugggagcgucagcaccacc

SEQ ID NO: 248012 - RNA, 18 nt, Human
acccgacuccagggagcc

SEQ ID NO: 248013 - RNA, 19 nt, Human
accugcuggcugcucucca

SEQ ID NO: 248014 - RNA, 23 nt, Human
acucaggcacggugaggcucugu

SEQ ID NO: 248015 - RNA, 19 nt, Human
agaaacccucccagcuguc

SEQ ID NO: 248016 - RNA, 24 nt, Human
agccagugggcaccaaccucagga

SEQ ID NO: 248017 - RNA, 21 nt, Human
agcugugugccccgaggcccc

SEQ ID NO: 248018 - RNA, 18 nt, Human
aggcacugggggguuaag

SEQ ID NO: 248019 - RNA, 21 nt, Human
agggagcccccguggccccgc

SEQ ID NO: 248020 - RNA, 20 nt, Human
agggucuuucgggugggggc

SEQ ID NO: 248021 - RNA, 24 nt, Human
aucccucagacggccuugggccag

SEQ ID NO: 248022 - RNA, 21 nt, Human
augccacucaggcacggugag

SEQ ID NO: 248023 - RNA, 24 nt, Human
caaagggucccagccagugggcac

SEQ ID NO: 248024 - RNA, 20 nt, Human
caccagccgcauggcagggc

SEQ ID NO: 248025 - RNA, 24 nt, Human
cacccaugguggcuuuauucaguc

SEQ ID NO: 248026 - RNA, 22 nt, Human
cacgcugcacagugggugaugu

SEQ ID NO: 248027 - RNA, 19 nt, Human
cacuaaacagaagggaaac

SEQ ID NO: 248028 - RNA, 27 nt, Human
cacuaaacagaagggaaaccgaggcag

SEQ ID NO: 248029 - RNA, 21 nt, Human
cagcucccgcggucaggcccc

SEQ ID NO: 248030 - RNA, 19 nt, Human
caggacccgacuccaggga

SEQ ID NO: 248031 - RNA, 21 nt, Human
cagggagggcuggcuuuagcg

SEQ ID NO: 248032 - RNA, 21 nt, Human
cagggccaggagggcaccagg

SEQ ID NO: 248033 - RNA, 21 nt, Human
caggggggccggcuggcagug

SEQ ID NO: 248034 - RNA, 19 nt, Human
caucccaagcacaucugug

SEQ ID NO: 248035 - RNA, 21 nt, Human
caugccccccacagcagacca

SEQ ID NO: 248036 - RNA, 24 nt, Human
ccaccuggagcuucccucggcugc

SEQ ID NO: 248037 - RNA, 23 nt, Human
ccacgcccacggcucccuccacc

SEQ ID NO: 248038 - RNA, 18 nt, Human
ccacugccuccaugcggg

SEQ ID NO: 248039 - RNA, 22 nt, Human
ccagaagcucccuggagagcug

SEQ ID NO: 248040 - RNA, 26 nt, Human
cccaggagcacccggcacuucccgaa

SEQ ID NO: 248041 - RNA, 18 nt, Human
ccccaaagcugggugccu

SEQ ID NO: 248042 - RNA, 22 nt, Human
ccccacgcccacggcucccucc

SEQ ID NO: 248043 - RNA, 24 nt, Human
ccccagcugugugccccgaggccc

SEQ ID NO: 248044 - RNA, 23 nt, Human
cccccacagcagaccagaguccc

SEQ ID NO: 248045 - RNA, 24 nt, Human
ccccgaggccccgggaagugggga

SEQ ID NO: 248046 - RNA, 23 nt, Human
ccccuggggcagcgaccagaucc

SEQ ID NO: 248047 - RNA, 22 nt, Human
cccgucaucccaagcacaucug

SEQ ID NO: 248048 - RNA, 18 nt, Human
cccuccaccaggcagaca

SEQ ID NO: 248049 - RNA, 22 nt, Human
ccgcgucugcaggcggcuccag

SEQ ID NO: 248050 - RNA, 18 nt, Human
ccuccagaccgagaaacc

SEQ ID NO: 248051 - RNA, 24 nt, Human
ccugcaugccccccacagcagacc

SEQ ID NO: 248052 - RNA, 20 nt, Human
ccuggcaccccugggagcgu

SEQ ID NO: 248053 - RNA, 20 nt, Human
ccugucccaguggcuccugg

SEQ ID NO: 248054 - RNA, 23 nt, Human
cgacuccacgggacggggacgcu

SEQ ID NO: 248055 - RNA, 26 nt, Human
cgagcccaaaggucguagggagccag

SEQ ID NO: 248056 - RNA, 22 nt, Human
cgccgagcugccgggcaccugc

SEQ ID NO: 248057 - RNA, 19 nt, Human
cgcggucaggccccaucag

SEQ ID NO: 248058 - RNA, 19 nt, Human
cggccuugggccagaagcu

SEQ ID NO: 248059 - RNA, 23 nt, Human
cggcuggaguuugguuuucagaa

SEQ ID NO: 248060 - RNA, 20 nt, Human
cgggacggggacgcuugggc

SEQ ID NO: 248061 - RNA, 23 nt, Human
cuacgccuccagaccgagaaacc

SEQ ID NO: 248062 - RNA, 19 nt, Human
cucccgcggucaggcccca

SEQ ID NO: 248063 - RNA, 19 nt, Human
cucccuggagagcugggca

SEQ ID NO: 248064 - RNA, 18 nt, Human
cucgcugggcccaggcca

SEQ ID NO: 248065 - RNA, 19 nt, Human
cugccaggacccgacucca

SEQ ID NO: 248066 - RNA, 19 nt, Human
cugcccaucagucccccug

SEQ ID NO: 248067 - RNA, 22 nt, Human
cugccgggcaccugcuggcugc

SEQ ID NO: 248068 - RNA, 24 nt, Human
cuggagagcugggcaccucgagga

SEQ ID NO: 248069 - RNA, 26 nt, Human
gacgggccgaggagggagccaggagc

SEQ ID NO: 248070 - RNA, 19 nt, Human
gacucugcccaucaguccc

SEQ ID NO: 248071 - RNA, 19 nt, Human
gaggagcuggccucgagcc

SEQ ID NO: 248072 - RNA, 18 nt, Human
gcagcaccgggacaggcc

SEQ ID NO: 248073 - RNA, 19 nt, Human
gcagcaccgggacaggccc

SEQ ID NO: 248074 - RNA, 22 nt, Human
gcagcgccgggcgaccaagucc

SEQ ID NO: 248075 - RNA, 18 nt, Human
gcguuggcacacagggaa

SEQ ID NO: 248076 - RNA, 21 nt, Human
gcuccagcaggcagcacgggc

SEQ ID NO: 248077 - RNA, 20 nt, Human
gcucucggcagggccucugg

SEQ ID NO: 248078 - RNA, 21 nt, Human
ggacagcgggcauggggagga

SEQ ID NO: 248079 - RNA, 20 nt, Human
ggccaggagggcaccaggga

SEQ ID NO: 248080 - RNA, 26 nt, Human
ggccgaggaccgcgucugccguggac

SEQ ID NO: 248081 - RNA, 19 nt, Human
gggacagcgggcaugggga

SEQ ID NO: 248082 - RNA, 23 nt, Human
gggagcagcaggaagcugccagc

SEQ ID NO: 248083 - RNA, 20 nt, Human
gggaggcacccgucauccca

SEQ ID NO: 248084 - RNA, 21 nt, Human
gggcagcaccgggacaggccc

SEQ ID NO: 248085 - RNA, 18 nt, Human
gggcagcagggccaggag

SEQ ID NO: 248086 - RNA, 20 nt, Human
gggcagcagggccaggaggg

SEQ ID NO: 248087 - RNA, 19 nt, Human
gggcauggggaggagcugg

SEQ ID NO: 248088 - RNA, 21 nt, Human
gggccaggagggcaccaggga

SEQ ID NO: 248089 - RNA, 19 nt, Human
gggccuaaggucaaugcag

SEQ ID NO: 248090 - RNA, 22 nt, Human
gguggagcggcgcuuccucagc

SEQ ID NO: 248091 - RNA, 23 nt, Human
ggugggggcagccccagcugugu

SEQ ID NO: 248092 - RNA, 21 nt, Human
guggagcauucuggcagcgcc

SEQ ID NO: 248093 - RNA, 24 nt, Human
guggagggucuuucgggugggggc

SEQ ID NO: 248094 - RNA, 24 nt, Human
guggggacgggccgaggagggagc

SEQ ID NO: 248095 - RNA, 18 nt, Human
gugggggcagccccagcu

SEQ ID NO: 248096 - RNA, 21 nt, Human
gugggggcagccccagcugug

SEQ ID NO: 248097 - RNA, 19 nt, Human
gugugccccgaggccccgg

SEQ ID NO: 248098 - RNA, 24 nt, Human
uaggagcccucacugggcagcagg

SEQ ID NO: 248099 - RNA, 18 nt, Human
uccaccaggcagacagag

SEQ ID NO: 248100 - RNA, 21 nt, Human
ucccaguggcuccuggcaccc

SEQ ID NO: 248101 - RNA, 24 nt, Human
uccccacgcccacggcucccucca

SEQ ID NO: 248102 - RNA, 26 nt, Human
ucccucagacggccuuggggugccaa

SEQ ID NO: 248103 - RNA, 21 nt, Human
uccuggcuggggcagcaccgg

SEQ ID NO: 248104 - RNA, 24 nt, Human
uccuggcuggggcagcaccgggac

SEQ ID NO: 248105 - RNA, 20 nt, Human
uccuuggagggcagacggug

SEQ ID NO: 248106 - RNA, 21 nt, Human
uccuuggagggcagacggugg

SEQ ID NO: 248107 - RNA, 24 nt, Human
ucucaaggagcugggacagcgggc

SEQ ID NO: 248108 - RNA, 21 nt, Human
ucugcaggcggcuccagcagg

SEQ ID NO: 248109 - RNA, 21 nt, Human
ugaacccacccguaggagccc

SEQ ID NO: 248110 - RNA, 19 nt, Human
ugacagggagcagcaggaa

SEQ ID NO: 248111 - RNA, 21 nt, Human
ugacagggagcagcaggaagc

SEQ ID NO: 248112 - RNA, 24 nt, Human
ugcccuggcccuugagcccguccu

SEQ ID NO: 248113 - RNA, 21 nt, Human
ugccgggcaccugcuggcugc

SEQ ID NO: 248114 - RNA, 19 nt, Human
uggcuccuggcaccccugg

SEQ ID NO: 248115 - RNA, 26 nt, Human
ugggcuucgccgccgagccugguuca

SEQ ID NO: 248116 - RNA, 25 nt, Human
uggggaggagcuggccucgagccca

SEQ ID NO: 248117 - RNA, 20 nt, Human
ugggugucuccaaggcuggg

SEQ ID NO: 248118 - RNA, 21 nt, Human
ugucccaguggcuccuggcac

SEQ ID NO: 248119 - RNA, 19 nt, Human
uuuucagaagcgaaggcug

SEQ ID NO: 248120 - RNA, 20 nt, Human
aacacauucaguagcaaaga

SEQ ID NO: 248121 - RNA, 18 nt, Human
aagaaagcacacacacua

SEQ ID NO: 248122 - RNA, 20 nt, Human
aagcgccccagacgccgccg

SEQ ID NO: 248123 - RNA, 19 nt, Human
aaugauccuccugccucag

SEQ ID NO: 248124 - RNA, 19 nt, Human
acuggagugcaguggcaug

SEQ ID NO: 248125 - RNA, 24 nt, Human
agccuuccgagauuacaggcaugc

SEQ ID NO: 248126 - RNA, 24 nt, Human
agcucacggcaccgggcugcaacc

SEQ ID NO: 248127 - RNA, 20 nt, Human
agugcaguggcaugaucaug

SEQ ID NO: 248128 - RNA, 23 nt, Human
agugcaguggcaugaucauggcu

SEQ ID NO: 248129 - RNA, 24 nt, Human
agugcaguggcaugaucauggcuc

SEQ ID NO: 248130 - RNA, 24 nt, Human
auccagacuggagugcaguggcau

SEQ ID NO: 248131 - RNA, 24 nt, Human
augauccuccugccucagccuucc

SEQ ID NO: 248132 - RNA, 19 nt, Human
caaaacauguucaaacaca

SEQ ID NO: 248133 - RNA, 27 nt, Human
caaaugauccuccugccucagccuucc

SEQ ID NO: 248134 - RNA, 21 nt, Human
caacgagcccagcgccgcaac

SEQ ID NO: 248135 - RNA, 19 nt, Human
cacacacauuaagaaagca

SEQ ID NO: 248136 - RNA, 23 nt, Human
cagccuuccgagauuacaggcau

SEQ ID NO: 248137 - RNA, 21 nt, Human
caugcaccaccacgccuagcc

SEQ ID NO: 248138 - RNA, 23 nt, Human
caugcaccaccacgccuagccga

SEQ ID NO: 248139 - RNA, 20 nt, Human
cauggcucacugaagccuug

SEQ ID NO: 248140 - RNA, 19 nt, Human
ccagcgccgcaacgcccag

SEQ ID NO: 248141 - RNA, 18 nt, Human
ccccagacgccgccgcug

SEQ ID NO: 248142 - RNA, 24 nt, Human
ccccagacgccgccgcugcuuucc

SEQ ID NO: 248143 - RNA, 21 nt, Human
ccgccgcugcuuuccggccgc

SEQ ID NO: 248144 - RNA, 23 nt, Human
ccgccgcugcuuuccggccgccc

SEQ ID NO: 248145 - RNA, 19 nt, Human
ccgcugcuuuccggccgcc

SEQ ID NO: 248146 - RNA, 22 nt, Human
ccggccgcccccucggcuacag

SEQ ID NO: 248147 - RNA, 26 nt, Human
ccuccugccucagccuuccgagauua

SEQ ID NO: 248148 - RNA, 21 nt, Human
cgaaagcgccccagacgccgc

SEQ ID NO: 248149 - RNA, 21 nt, Human
cgagauuacaggcaugcacca

SEQ ID NO: 248150 - RNA, 21 nt, Human
cggcugcagcaacgagcccag

SEQ ID NO: 248151 - RNA, 24 nt, Human
cucaaaugauccuccugccucagc

SEQ ID NO: 248152 - RNA, 24 nt, Human
cucucucugucauccagacuggag

SEQ ID NO: 248153 - RNA, 23 nt, Human
cucucugucauccagacuggagu

SEQ ID NO: 248154 - RNA, 19 nt, Human
cugaagccuugaccuccug

SEQ ID NO: 248155 - RNA, 18 nt, Human
cugccucagccuuccgag

SEQ ID NO: 248156 - RNA, 22 nt, Human
cuuuccggccgcccccucggcu

SEQ ID NO: 248157 - RNA, 19 nt, Human
gaaaccucuucagcucacg

SEQ ID NO: 248158 - RNA, 23 nt, Human
gagauuacaggcaugcaccacca

SEQ ID NO: 248159 - RNA, 18 nt, Human
gagcaggguccggcugca

SEQ ID NO: 248160 - RNA, 21 nt, Human
gaugagcuugaaagcugcaga

SEQ ID NO: 248161 - RNA, 21 nt, Human
gcucacugaagccuugaccuc

SEQ ID NO: 248162 - RNA, 22 nt, Human
uacaggcaugcaccaccacgcc

SEQ ID NO: 248163 - RNA, 19 nt, Human
uagcaaggcugauagaaau

SEQ ID NO: 248164 - RNA, 18 nt, Human
uagcuuuagcaaggcuga

SEQ ID NO: 248165 - RNA, 24 nt, Human
ucacugaagccuugaccuccuggg

SEQ ID NO: 248166 - RNA, 21 nt, Human
ucagccuuccgagauuacagg

SEQ ID NO: 248167 - RNA, 21 nt, Human
uccugccucagccuuccgaga

SEQ ID NO: 248168 - RNA, 20 nt, Human
uccugggcccucaugagcuc

SEQ ID NO: 248169 - RNA, 24 nt, Human
ucucucucugucauccagacugga

SEQ ID NO: 248170 - RNA, 24 nt, Human
ucucucugucauccagacuggagu

SEQ ID NO: 248171 - RNA, 22 nt, Human
ugagacagggucucucucuguc

SEQ ID NO: 248172 - RNA, 24 nt, Human
ugagcucaaaugauccuccugccu

SEQ ID NO: 248173 - RNA, 19 nt, Human
ugagcuugaaagcugcaga

SEQ ID NO: 248174 - RNA, 23 nt, Human
ugcaguggcaugaucauggcuca

SEQ ID NO: 248175 - RNA, 24 nt, Human
ugccucagccuuccgagauuacag

SEQ ID NO: 248176 - RNA, 19 nt, Human
uggagugcaguggcaugau

SEQ ID NO: 248177 - RNA, 21 nt, Human
uggagugcaguggcaugauca

SEQ ID NO: 248178 - RNA, 24 nt, Human
uggagugcaguggcaugaucaugg

SEQ ID NO: 248179 - RNA, 22 nt, Human
uggcacacacauuaagaaagca

SEQ ID NO: 248180 - RNA, 21 nt, Human
uggcaugaucauggcucacug

SEQ ID NO: 248181 - RNA, 24 nt, Human
uggcucacugaagccuugaccucc

SEQ ID NO: 248182 - RNA, 24 nt, Human
ugggccccuagcuuuagcaaggcu

SEQ ID NO: 248183 - RNA, 21 nt, Human
ugucauccagacuggagugca

SEQ ID NO: 248184 - RNA, 20 nt, Human
uucaaacacauucaguagca

SEQ ID NO: 248185 - RNA, 22 nt, Human
uucaaacacauucaguagcaaa

SEQ ID NO: 248186 - RNA, 18 nt, Human
uugagacagggucucucu

SEQ ID NO: 248187 - RNA, 22 nt, Human
uugagacagggucucucucugu

SEQ ID NO: 248188 - RNA, 23 nt, Human
aaaaacuagcaaaauauuuguaa

SEQ ID NO: 248189 - RNA, 22 nt, Human
aaaaagacaaggagggccugag

SEQ ID NO: 248190 - RNA, 20 nt, Human
aaaacaagauauacaagguu

SEQ ID NO: 248191 - RNA, 20 nt, Human
aaaaggaacaauacuggaua

SEQ ID NO: 248192 - RNA, 18 nt, Human
aaaaucacuaaaaccacc

SEQ ID NO: 248193 - RNA, 18 nt, Human
aaaaugcaccacccuagu

SEQ ID NO: 248194 - RNA, 18 nt, Human
aaaauuggaagccacuua

SEQ ID NO: 248195 - RNA, 18 nt, Human
aaacagaaaggaaggcuc

SEQ ID NO: 248196 - RNA, 19 nt, Human
aaacagacacacacacaua

SEQ ID NO: 248197 - RNA, 28 nt, Human
aaacagacacacacacauacaguuaccu

SEQ ID NO: 248198 - RNA, 27 nt, Human
aaacaucguaagacuacacacaaaacu

SEQ ID NO: 248199 - RNA, 19 nt, Human
aaagcaauugggaagaagc

SEQ ID NO: 248200 - RNA, 18 nt, Human
aaauacauggcugaaaca

SEQ ID NO: 248201 - RNA, 21 nt, Human
aaauggaaaaauaaauccguc

SEQ ID NO: 248202 - RNA, 20 nt, Human
aacuuauuucaucaucccca

SEQ ID NO: 248203 - RNA, 23 nt, Human
aagcauuacagauuaauuaaacu

SEQ ID NO: 248204 - RNA, 21 nt, Human
acagcccagaaacagacacac

SEQ ID NO: 248205 - RNA, 20 nt, Human
acauuaucucauuaaaaagc

SEQ ID NO: 248206 - RNA, 19 nt, Human
accugaaacuugguaaaaa

SEQ ID NO: 248207 - RNA, 19 nt, Human
acuacuacuacuacuauua

SEQ ID NO: 248208 - RNA, 21 nt, Human
acuacuacuacuauuauugcu

SEQ ID NO: 248209 - RNA, 19 nt, Human
acuagaauagacagcccag

SEQ ID NO: 248210 - RNA, 22 nt, Human
agaaaaaaauggaaaaagggac

SEQ ID NO: 248211 - RNA, 18 nt, Human
agaaaaaaauggaaaaau

SEQ ID NO: 248212 - RNA, 25 nt, Human
agaaaagaaaaaauauuuaaaauau

SEQ ID NO: 248213 - RNA, 26 nt, Human
agaaagaaaacagaguucauagagaa

SEQ ID NO: 248214 - RNA, 22 nt, Human
agaagaacaaagcuggacuaca

SEQ ID NO: 248215 - RNA, 24 nt, Human
agaauagacagcccagaaacagac

SEQ ID NO: 248216 - RNA, 22 nt, Human
agaauguaaaaauaacuuaaaa

SEQ ID NO: 248217 - RNA, 20 nt, Human
agaauuugugaagcuguuug

SEQ ID NO: 248218 - RNA, 18 nt, Human
agacaaggagggccugag

SEQ ID NO: 248219 - RNA, 20 nt, Human
auagagcaucuaggacugcc

SEQ ID NO: 248220 - RNA, 23 nt, Human
augaaugaaucucacagacuuaa

SEQ ID NO: 248221 - RNA, 18 nt, Human
augauuccaacuauacaa

SEQ ID NO: 248222 - RNA, 20 nt, Human
auuaacaauagaauggauga

SEQ ID NO: 248223 - RNA, 21 nt, Human
caaagcaagguugauuuaauu

SEQ ID NO: 248224 - RNA, 22 nt, Human
caaaguaacuggcucuagauca

SEQ ID NO: 248225 - RNA, 20 nt, Human
caagcaucaacaaauagacu

SEQ ID NO: 248226 - RNA, 24 nt, Human
caagcaucaacaaauagacuagaa

SEQ ID NO: 248227 - RNA, 25 nt, Human
caaguggauaucuauucuaccagga

SEQ ID NO: 248228 - RNA, 24 nt, Human
cacaaaaagcacuaauuuugaaag

SEQ ID NO: 248229 - RNA, 21 nt, Human
cacauuaucucauuaaaaagc

SEQ ID NO: 248230 - RNA, 19 nt, Human
cagaagaagauacccaagu

SEQ ID NO: 248231 - RNA, 22 nt, Human
cagauuaaaaccauggggaaau

SEQ ID NO: 248232 - RNA, 23 nt, Human
cagcccagaaacagacacacaca

SEQ ID NO: 248233 - RNA, 19 nt, Human
caucaacaaauagacuaga

SEQ ID NO: 248234 - RNA, 21 nt, Human
ccacuuaagugccuauuaaca

SEQ ID NO: 248235 - RNA, 22 nt, Human
cccagaaacagacacacacaca

SEQ ID NO: 248236 - RNA, 18 nt, Human
ccugaaacuugguaaaaa

SEQ ID NO: 248237 - RNA, 19 nt, Human
ccuuggugugagaaaacuc

SEQ ID NO: 248238 - RNA, 19 nt, Human
cuacauggcaaugaaaagg

SEQ ID NO: 248239 - RNA, 19 nt, Human
cucaaguggauaucuauuc

SEQ ID NO: 248240 - RNA, 19 nt, Human
cucauuagaaagaaaacag

SEQ ID NO: 248241 - RNA, 20 nt, Human
cuccuggauagguagugaaa

SEQ ID NO: 248242 - RNA, 22 nt, Human
cugcugcugcuaacuacuacua

SEQ ID NO: 248243 - RNA, 21 nt, Human
cuuaaacaugacacaaaaagc

SEQ ID NO: 248244 - RNA, 21 nt, Human
gaauccaguuuagauaggccu

SEQ ID NO: 248245 - RNA, 23 nt, Human
gagggccugagugauaugacccu

SEQ ID NO: 248246 - RNA, 23 nt, Human
gauuccaacuauacaauguuuau

SEQ ID NO: 248247 - RNA, 21 nt, Human
gcugaaacacaaaguaacugg

SEQ ID NO: 248248 - RNA, 24 nt, Human
ggacauauucagaauguaaaaaua

SEQ ID NO: 248249 - RNA, 19 nt, Human
gggagcccucuacccaaac

SEQ ID NO: 248250 - RNA, 24 nt, Human
ggggcuucuagggagucaaaaaug

SEQ ID NO: 248251 - RNA, 23 nt, Human
guggguugcaguaaaaagacaag

SEQ ID NO: 248252 - RNA, 20 nt, Human
uaaaaucacuaaaaccacca

SEQ ID NO: 248253 - RNA, 23 nt, Human
uaaauucauacaaucacuuagga

SEQ ID NO: 248254 - RNA, 18 nt, Human
uaagugacagagcuguga

SEQ ID NO: 248255 - RNA, 18 nt, Human
uaauacacauuaaaaagg

SEQ ID NO: 248256 - RNA, 21 nt, Human
uaauucugaguaagcaagaca

SEQ ID NO: 248257 - RNA, 25 nt, Human
uacaaaauccagaggaaucuacaaa

SEQ ID NO: 248258 - RNA, 21 nt, Human
uacccaaacagaaaggaaggc

SEQ ID NO: 248259 - RNA, 18 nt, Human
uagaaagaaaacagaguu

SEQ ID NO: 248260 - RNA, 19 nt, Human
uagaaagaaaacagaguuc

SEQ ID NO: 248261 - RNA, 21 nt, Human
uagaaagaaaacagaguucau

SEQ ID NO: 248262 - RNA, 21 nt, Human
uagaauagacagcccagaaac

SEQ ID NO: 248263 - RNA, 20 nt, Human
uagaauggaugaacugagga

SEQ ID NO: 248264 - RNA, 26 nt, Human
uagaucauguagcaauuaguuaaaga

SEQ ID NO: 248265 - RNA, 20 nt, Human
uauagguauguaugugugug

SEQ ID NO: 248266 - RNA, 20 nt, Human
ucaaaaucaugaaaaaucuc

SEQ ID NO: 248267 - RNA, 22 nt, Human
uccccacaauuuucaugaaaua

SEQ ID NO: 248268 - RNA, 19 nt, Human
ucuauaccugcucuggugg

SEQ ID NO: 248269 - RNA, 20 nt, Human
ugaaacacaaaguaacuggc

SEQ ID NO: 248270 - RNA, 20 nt, Human
ugaaacacaaaguaacuggc

SEQ ID NO: 248271 - RNA, 18 nt, Human
ugaagaagaacaaagcug

SEQ ID NO: 248272 - RNA, 18 nt, Human
ugacaugaaugaaucuca

SEQ ID NO: 248273 - RNA, 24 nt, Human
ugacuuuuuacaagcacauagagc

SEQ ID NO: 248274 - RNA, 23 nt, Human
ugaguaagcaagacauacaacau

SEQ ID NO: 248275 - RNA, 21 nt, Human
ugaguauauagguauguaugu

SEQ ID NO: 248276 - RNA, 18 nt, Human
ugcaccauguccaccaaa

SEQ ID NO: 248277 - RNA, 21 nt, Human
ugcucugguggucucuguauu

SEQ ID NO: 248278 - RNA, 27 nt, Human
ugcuuuccucauccucuaccaguucca

SEQ ID NO: 248279 - RNA, 21 nt, Human
uggggaaauacagauuaaaaa

SEQ ID NO: 248280 - RNA, 27 nt, Human
uguacacaugacaugaaugaaucucac

SEQ ID NO: 248281 - RNA, 21 nt, Human
ugugugagaauuugugaagcu

SEQ ID NO: 248282 - RNA, 19 nt, Human
uguuauguauaauaucaca

SEQ ID NO: 248283 - RNA, 21 nt, Human
uguucguggguucucuuccuc

SEQ ID NO: 248284 - RNA, 25 nt, Human
uuacaagcacauagagcaucuagga

SEQ ID NO: 248285 - RNA, 18 nt, Human
uuacuagauuuaagaaau

SEQ ID NO: 248286 - RNA, 21 nt, Human
uuaggaaaacugguaauaucu

SEQ ID NO: 248287 - RNA, 21 nt, Human
uucaaaaucaugaaaaauauc

SEQ ID NO: 248288 - RNA, 25 nt, Human
uucguggguucucuuccccuaaggg

SEQ ID NO: 248289 - RNA, 22 nt, Human
uuguucaucaaaauucaacauu

SEQ ID NO: 248290 - RNA, 23 nt, Human
uuuacuacacacuuuaaaggugu

SEQ ID NO: 248291 - RNA, 21 nt, Human
uuuauaaacagacgaaauuac

SEQ ID NO: 248292 - RNA, 22 nt, Human
uuugacacaagcaucaacaaau

SEQ ID NO: 248293 - RNA, 19 nt, Human
uuuucauacugcagcaagu

SEQ ID NO: 248294 - RNA, 20 nt, Human
aaaaaaaaaagcugaacuga

SEQ ID NO: 248295 - RNA, 22 nt, Human
aaaaaaagcugaacugaugaug

SEQ ID NO: 248296 - RNA, 20 nt, Human
aaaacaaaacaaaacaaaaa

SEQ ID NO: 248297 - RNA, 22 nt, Human
aaaacaagucuauaaacugaaa

SEQ ID NO: 248298 - RNA, 23 nt, Human
aaaauacuuuuccccacucccug

SEQ ID NO: 248299 - RNA, 19 nt, Human
aaacaaaacaaaacaaaaa

SEQ ID NO: 248300 - RNA, 21 nt, Human
aaacaaauugcagcccaagac

SEQ ID NO: 248301 - RNA, 18 nt, Human
aaacuugcaguaaacuug

SEQ ID NO: 248302 - RNA, 18 nt, Human
aaagaacaggauccuaca

SEQ ID NO: 248303 - RNA, 22 nt, Human
aaagaggcccuugcaccgggcu

SEQ ID NO: 248304 - RNA, 23 nt, Human
aaagcugaacugaugaugaaaau

SEQ ID NO: 248305 - RNA, 18 nt, Human
aaauguacaaaguguaua

SEQ ID NO: 248306 - RNA, 25 nt, Human
aaauguccccucaaaauacuuuucc

SEQ ID NO: 248307 - RNA, 19 nt, Human
aacaaaaaugacugugcau

SEQ ID NO: 248308 - RNA, 20 nt, Human
aacaaugacugacauucuua

SEQ ID NO: 248309 - RNA, 20 nt, Human
aacauccaaaccucaaaaaa

SEQ ID NO: 248310 - RNA, 22 nt, Human
aaccaaaaaaaaaagcugaacu

SEQ ID NO: 248311 - RNA, 22 nt, Human
aaccaacaaacccaaccccccc

SEQ ID NO: 248312 - RNA, 23 nt, Human
aaccaacaaacccaaccccccca

SEQ ID NO: 248313 - RNA, 20 nt, Human
aacuacaagcagaaaguaag

SEQ ID NO: 248314 - RNA, 26 nt, Human
aagaaagcaaagcaacauggugggca

SEQ ID NO: 248315 - RNA, 21 nt, Human
aagcaacuacaagcagaaagu

SEQ ID NO: 248316 - RNA, 20 nt, Human
aagcaaggcaaaagcagaga

SEQ ID NO: 248317 - RNA, 22 nt, Human
aagcacacuguccuuuccucuu

SEQ ID NO: 248318 - RNA, 27 nt, Human
aagcauaaaacaaauugcagcccaaga

SEQ ID NO: 248319 - RNA, 21 nt, Human
aagcaucucucucaagcauaa

SEQ ID NO: 248320 - RNA, 22 nt, Human
aagcaugaaaacguggcagacc

SEQ ID NO: 248321 - RNA, 21 nt, Human
aagggguauggagugcuaacu

SEQ ID NO: 248322 - RNA, 19 nt, Human
aauaacaugugaagucacc

SEQ ID NO: 248323 - RNA, 26 nt, Human
aaucaugguuacaccauagucugguu

SEQ ID NO: 248324 - RNA, 21 nt, Human
acaagcuguccacaagaaagc

SEQ ID NO: 248325 - RNA, 18 nt, Human
acauaauaguaaaaccaa

SEQ ID NO: 248326 - RNA, 24 nt, Human
acauuucccauuuucauauuuugg

SEQ ID NO: 248327 - RNA, 23 nt, Human
accaaaaaaaaaagcugaacuga

SEQ ID NO: 248328 - RNA, 22 nt, Human
accaacaaacccaaccccccca

SEQ ID NO: 248329 - RNA, 25 nt, Human
accacgucuuacaaucuauuacauu

SEQ ID NO: 248330 - RNA, 20 nt, Human
acuguaaaguuaaauuggcc

SEQ ID NO: 248331 - RNA, 20 nt, Human
agaagauaucuuacuuuuuc

SEQ ID NO: 248332 - RNA, 23 nt, Human
agaagugcaaaaagucaaccuuc

SEQ ID NO: 248333 - RNA, 20 nt, Human
agacaagaacuaacaaugac

SEQ ID NO: 248334 - RNA, 18 nt, Human
agagcaaaaucgagaaaa

SEQ ID NO: 248335 - RNA, 22 nt, Human
agcaaacuuuucuuuuaacacu

SEQ ID NO: 248336 - RNA, 18 nt, Human
agcaacaaccaaaaaaaa

SEQ ID NO: 248337 - RNA, 20 nt, Human
agcaauuaaaaaacaaucac

SEQ ID NO: 248338 - RNA, 21 nt, Human
agcacauuuguccuuucagca

SEQ ID NO: 248339 - RNA, 22 nt, Human
agcaggaggaagccggagcccg

SEQ ID NO: 248340 - RNA, 22 nt, Human
agcauaaaacaaauugcagccc

SEQ ID NO: 248341 - RNA, 23 nt, Human
agccggagcccgcgcgggcgccg

SEQ ID NO: 248342 - RNA, 18 nt, Human
aggaggaagccggagccc

SEQ ID NO: 248343 - RNA, 24 nt, Human
aggcagauuuggccccauggaguu

SEQ ID NO: 248344 - RNA, 22 nt, Human
agucuuuugacuuuugacagag

SEQ ID NO: 248345 - RNA, 26 nt, Human
agugaaaccaacaaacccaacccccc

SEQ ID NO: 248346 - RNA, 21 nt, Human
aguugaaaauuaaaaccauga

SEQ ID NO: 248347 - RNA, 22 nt, Human
aguuugguggugcaaucgguau

SEQ ID NO: 248348 - RNA, 19 nt, Human
auaaaacaaauugcagccc

SEQ ID NO: 248349 - RNA, 24 nt, Human
auacagaagugcaaaaagucaacc

SEQ ID NO: 248350 - RNA, 24 nt, Human
auacuuuuccccacucccugcuuu

SEQ ID NO: 248351 - RNA, 22 nt, Human
auccuuuacuagcugcaacauc

SEQ ID NO: 248352 - RNA, 21 nt, Human
auggcaauuuuaaauacaagg

SEQ ID NO: 248353 - RNA, 24 nt, Human
augguacuuaaagccaugaugugc

SEQ ID NO: 248354 - RNA, 23 nt, Human
caaaaaagagcaacaaccaaaaa

SEQ ID NO: 248355 - RNA, 19 nt, Human
caaaacaaaacaaaaauca

SEQ ID NO: 248356 - RNA, 22 nt, Human
caaaacaaaacaaaacaaaaau

SEQ ID NO: 248357 - RNA, 20 nt, Human
caaacccaacccccccaaaa

SEQ ID NO: 248358 - RNA, 22 nt, Human
caaaccucaaaaaaaggaauuc

SEQ ID NO: 248359 - RNA, 24 nt, Human
caacaaaaagucccuuguucuauu

SEQ ID NO: 248360 - RNA, 18 nt, Human
caacaaacccaacccccc

SEQ ID NO: 248361 - RNA, 21 nt, Human
caacaaacccaacccccccaa

SEQ ID NO: 248362 - RNA, 19 nt, Human
caaccaaaaaaaaaagcug

SEQ ID NO: 248363 - RNA, 23 nt, Human
caacccccccaaaaaagagcaac

SEQ ID NO: 248364 - RNA, 25 nt, Human
caacccccccaaaaaagagcaacaa

SEQ ID NO: 248365 - RNA, 22 nt, Human
caauuuuuagaacugcugaaca

SEQ ID NO: 248366 - RNA, 21 nt, Human
cacuaaagcagccuagggcaa

SEQ ID NO: 248367 - RNA, 28 nt, Human
cacucccugcuuuaaaaguacauggaaa

SEQ ID NO: 248368 - RNA, 18 nt, Human
cagagcaaaaauauccuu

SEQ ID NO: 248369 - RNA, 23 nt, Human
cagaucccucccucaccacgucu

SEQ ID NO: 248370 - RNA, 21 nt, Human
cagcccaagacaaaauacaua

SEQ ID NO: 248371 - RNA, 21 nt, Human
cagguuucucucuuuugacua

SEQ ID NO: 248372 - RNA, 21 nt, Human
caguaaacuuggaaguaugga

SEQ ID NO: 248373 - RNA, 22 nt, Human
caguuuagagcaaaaucgagaa

SEQ ID NO: 248374 - RNA, 20 nt, Human
cauaaaaacuugcaguaaac

SEQ ID NO: 248375 - RNA, 24 nt, Human
cauaaaacaaauugcagcccaaga

SEQ ID NO: 248376 - RNA, 26 nt, Human
cauaaucaacccucaagaguuugcac

SEQ ID NO: 248377 - RNA, 23 nt, Human
cauugguauggguuccaacccgu

SEQ ID NO: 248378 - RNA, 20 nt, Human
cauuuguccuuucagcagau

SEQ ID NO: 248379 - RNA, 18 nt, Human
ccaaaaaagagcaacaac

SEQ ID NO: 248380 - RNA, 20 nt, Human
ccaaaaaagagcaacaacca

SEQ ID NO: 248381 - RNA, 21 nt, Human
ccaaaaaagagcaacaaccaa

SEQ ID NO: 248382 - RNA, 24 nt, Human
ccaaaaaagagcaacaaccaaaaa

SEQ ID NO: 248383 - RNA, 24 nt, Human
ccaacaaacccaacccccccaaaa

SEQ ID NO: 248384 - RNA, 26 nt, Human
ccaacccccccaaaaaagagcaacaa

SEQ ID NO: 248385 - RNA, 22 nt, Human
ccaauacauaauagaaucaugg

SEQ ID NO: 248386 - RNA, 18 nt, Human
ccacaagaaagcaaagca

SEQ ID NO: 248387 - RNA, 19 nt, Human
cccaaaaaagagcaacaac

SEQ ID NO: 248388 - RNA, 20 nt, Human
cccacccaauuacuagguua

SEQ ID NO: 248389 - RNA, 24 nt, Human
cccacucccugcuuuaaaaguaca

SEQ ID NO: 248390 - RNA, 18 nt, Human
cccagccccaccaggaag

SEQ ID NO: 248391 - RNA, 18 nt, Human
cccagcggcgccgagagc

SEQ ID NO: 248392 - RNA, 18 nt, Human
cccccaaaaaagagcaac

SEQ ID NO: 248393 - RNA, 24 nt, Human
cccccaaaaaagagcaacaaccaa

SEQ ID NO: 248394 - RNA, 21 nt, Human
cccccgcccgcccagccccac

SEQ ID NO: 248395 - RNA, 22 nt, Human
cccccgcccgcccagccccacc

SEQ ID NO: 248396 - RNA, 24 nt, Human
ccccgcccgcccagccccaccagg

SEQ ID NO: 248397 - RNA, 21 nt, Human
cccgcccagccccaccaggaa

SEQ ID NO: 248398 - RNA, 20 nt, Human
cccgcgacggaaaauggaac

SEQ ID NO: 248399 - RNA, 23 nt, Human
cccucaaaauacuuuuccccacu

SEQ ID NO: 248400 - RNA, 22 nt, Human
cccuucgacaccgaauuuccaa

SEQ ID NO: 248401 - RNA, 20 nt, Human
ccgcccgcccagccccacca

SEQ ID NO: 248402 - RNA, 19 nt, Human
ccucccgcgcuuccccggg

SEQ ID NO: 248403 - RNA, 20 nt, Human
ccugguaucagccuugugcu

SEQ ID NO: 248404 - RNA, 20 nt, Human
ccuugcaccgggcuuugcaa

SEQ ID NO: 248405 - RNA, 23 nt, Human
cgauagcaacaacuuaacuucuu

SEQ ID NO: 248406 - RNA, 19 nt, Human
cgccguggauccccucggc

SEQ ID NO: 248407 - RNA, 19 nt, Human
cgcgggcgccguggauccc

SEQ ID NO: 248408 - RNA, 28 nt, Human
cggccccucccccgcccgcccagccccc

SEQ ID NO: 248409 - RNA, 24 nt, Human
cgucaauaucaaggaaaagaucuc

SEQ ID NO: 248410 - RNA, 24 nt, Human
cgugcagaccggacgcccucccgc

SEQ ID NO: 248411 - RNA, 21 nt, Human
cguggauccccucggccuccc

SEQ ID NO: 248412 - RNA, 21 nt, Human
cguuccaacaugcuaaauugc

SEQ ID NO: 248413 - RNA, 23 nt, Human
cucaccacgucuuacaaucuauu

SEQ ID NO: 248414 - RNA, 24 nt, Human
cucccgcgcuuccccgggccacag

SEQ ID NO: 248415 - RNA, 21 nt, Human
cucucaguaaccccuucccag

SEQ ID NO: 248416 - RNA, 22 nt, Human
cugaaaacaauaacacugaaga

SEQ ID NO: 248417 - RNA, 23 nt, Human
cugaaaacaauaacacugaagaa

SEQ ID NO: 248418 - RNA, 18 nt, Human
cuuggcacauucaucucu

SEQ ID NO: 248419 - RNA, 19 nt, Human
cuuuccgccggcgcccucc

SEQ ID NO: 248420 - RNA, 28 nt, Human
cuuugguuucaaaaaaaaaaaaaaagaa

SEQ ID NO: 248421 - RNA, 27 nt, Human
gaaauuggcagaaacugaucugaauaa

SEQ ID NO: 248422 - RNA, 22 nt, Human
gaacaaaacaaaacaaaacaaa

SEQ ID NO: 248423 - RNA, 21 nt, Human
gaacagagcaaaaauauccuu

SEQ ID NO: 248424 - RNA, 22 nt, Human
gaccuggccccuacuucagcaa

SEQ ID NO: 248425 - RNA, 21 nt, Human
gagaaaaugauuuuuuuuuuc

SEQ ID NO: 248426 - RNA, 25 nt, Human
gcaaacuuuucuuuuaacacuaaag

SEQ ID NO: 248427 - RNA, 18 nt, Human
gcaaagcauuuauagucu

SEQ ID NO: 248428 - RNA, 21 nt, Human
gcaagcaaggcaaaagcagag

SEQ ID NO: 248429 - RNA, 22 nt, Human
gcaagcaaggcaaaagcagaga

SEQ ID NO: 248430 - RNA, 26 nt, Human
gcaauuuuuagaacugcugaacagag

SEQ ID NO: 248431 - RNA, 20 nt, Human
gcagugaaaagacuguugca

SEQ ID NO: 248432 - RNA, 25 nt, Human
gcguaucuuuccagcugaaaaaauc

SEQ ID NO: 248433 - RNA, 22 nt, Human
gcucucaguaaccccuucccag

SEQ ID NO: 248434 - RNA, 20 nt, Human
ggaaaagaucucccacuaga

SEQ ID NO: 248435 - RNA, 22 nt, Human
ggccccucccccgcccgcccag

SEQ ID NO: 248436 - RNA, 19 nt, Human
ggguuugaaaggauggcgu

SEQ ID NO: 248437 - RNA, 23 nt, Human
gucccuuguucuauuuauugauu

SEQ ID NO: 248438 - RNA, 22 nt, Human
gugaaaccaacaaacccaaccc

SEQ ID NO: 248439 - RNA, 20 nt, Human
guuaacaugcaauaugugga

SEQ ID NO: 248440 - RNA, 23 nt, Human
guucauuuugaaagaggcccuug

SEQ ID NO: 248441 - RNA, 21 nt, Human
guuuuuauucaaaauaagauc

SEQ ID NO: 248442 - RNA, 24 nt, Human
uaaaaaacaaucacauaacaacua

SEQ ID NO: 248443 - RNA, 18 nt, Human
uaaaacaagucuauaaac

SEQ ID NO: 248444 - RNA, 19 nt, Human
uaaaaucaacacaucaguc

SEQ ID NO: 248445 - RNA, 21 nt, Human
uaaccagcuggagugaaggcu

SEQ ID NO: 248446 - RNA, 21 nt, Human
uaacuagguaugcaucuuuga

SEQ ID NO: 248447 - RNA, 22 nt, Human
uaagaucuuacuauuauacagg

SEQ ID NO: 248448 - RNA, 18 nt, Human
uaaggaauaucugaucca

SEQ ID NO: 248449 - RNA, 20 nt, Human
uaagugcaacauuuuuaacc

SEQ ID NO: 248450 - RNA, 24 nt, Human
uaauguaacuaacuacaauaacau

SEQ ID NO: 248451 - RNA, 21 nt, Human
uacaaucaguaaaaucaacac

SEQ ID NO: 248452 - RNA, 20 nt, Human
uacagaagugcaaaaaguca

SEQ ID NO: 248453 - RNA, 22 nt, Human
uacagacguaccaauacauaau

SEQ ID NO: 248454 - RNA, 19 nt, Human
uacagcaaagucaacuacu

SEQ ID NO: 248455 - RNA, 18 nt, Human
uacaguauaguaugcaua

SEQ ID NO: 248456 - RNA, 21 nt, Human
uacauaauaguaaaaccaagc

SEQ ID NO: 248457 - RNA, 18 nt, Human
uacuagcugcaacaucca

SEQ ID NO: 248458 - RNA, 24 nt, Human
uagaagcgguuccaagcagcagag

SEQ ID NO: 248459 - RNA, 23 nt, Human
uagaaguaccugcuauuuuuggu

SEQ ID NO: 248460 - RNA, 24 nt, Human
uagagcaaaaucgagaaaaugauu

SEQ ID NO: 248461 - RNA, 24 nt, Human
uagcuacagugugcuguuugguuu

SEQ ID NO: 248462 - RNA, 22 nt, Human
uagcugcaacauccaaaccuca

SEQ ID NO: 248463 - RNA, 21 nt, Human
uagcuggcagcaagcaaggca

SEQ ID NO: 248464 - RNA, 24 nt, Human
uagcuggcagcaagcaaggcaaaa

SEQ ID NO: 248465 - RNA, 18 nt, Human
uaguaccaaccucucaca

SEQ ID NO: 248466 - RNA, 27 nt, Human
uauauuagaaagcaucucucucaagca

SEQ ID NO: 248467 - RNA, 22 nt, Human
uauuagaaagcaucucucucaa

SEQ ID NO: 248468 - RNA, 22 nt, Human
ucaacccucaagaguuugcaca

SEQ ID NO: 248469 - RNA, 25 nt, Human
ucaaccuucucccuagacguuccaa

SEQ ID NO: 248470 - RNA, 23 nt, Human
ucagcaaaguugucugaaaggga

SEQ ID NO: 248471 - RNA, 21 nt, Human
ucagcagaugaaagugguagg

SEQ ID NO: 248472 - RNA, 18 nt, Human
uccacaagaaagcaaagc

SEQ ID NO: 248473 - RNA, 20 nt, Human
ucccccgcccgcccagcccc

SEQ ID NO: 248474 - RNA, 21 nt, Human
uccuggcaaacuacaagcugu

SEQ ID NO: 248475 - RNA, 23 nt, Human
ucuccucacagcugaauuugcaa

SEQ ID NO: 248476 - RNA, 22 nt, Human
ucucuugauuauaaguagaaau

SEQ ID NO: 248477 - RNA, 21 nt, Human
ucuggcuuccgcugcugcugc

SEQ ID NO: 248478 - RNA, 18 nt, Human
ugaaaacaauaacacuga

SEQ ID NO: 248479 - RNA, 24 nt, Human
ugaaaacuagacaagaacuaacaa

SEQ ID NO: 248480 - RNA, 23 nt, Human
ugaaaauguccccucaaaauacu

SEQ ID NO: 248481 - RNA, 18 nt, Human
ugaaaccaacaaacccaa

SEQ ID NO: 248482 - RNA, 21 nt, Human
ugaaaccaacaaacccaaccc

SEQ ID NO: 248483 - RNA, 18 nt, Human
ugaaagggaaucuccuca

SEQ ID NO: 248484 - RNA, 23 nt, Human
ugaaauggauacaguagaaaaua

SEQ ID NO: 248485 - RNA, 20 nt, Human
ugaccuggccccuacuucag

SEQ ID NO: 248486 - RNA, 21 nt, Human
ugcaagcaugaaaacguggca

SEQ ID NO: 248487 - RNA, 21 nt, Human
ugcaauggaguuugguggugc

SEQ ID NO: 248488 - RNA, 19 nt, Human
ugcauaacucugugcuaga

SEQ ID NO: 248489 - RNA, 21 nt, Human
ugcugcgcggccccucccccg

SEQ ID NO: 248490 - RNA, 20 nt, Human
ugcuguuugguuugccuguu

SEQ ID NO: 248491 - RNA, 20 nt, Human
uggaguuugguggugcaauc

SEQ ID NO: 248492 - RNA, 22 nt, Human
uggaguuugguggugcaaucgg

SEQ ID NO: 248493 - RNA, 23 nt, Human
ugggggugucugggcuagaggug

SEQ ID NO: 248494 - RNA, 23 nt, Human
ugguaaaaucuaauaaaacaagu

SEQ ID NO: 248495 - RNA, 18 nt, Human
ugguauggguuccaaccc

SEQ ID NO: 248496 - RNA, 22 nt, Human
ugguuucaaaaaaaaaaaaaaa

SEQ ID NO: 248497 - RNA, 24 nt, Human
uguacaaaguguauaggcaacagu

SEQ ID NO: 248498 - RNA, 22 nt, Human
uguccacaagaaagcaaagcaa

SEQ ID NO: 248499 - RNA, 23 nt, Human
ugucugggcuagagguggagggu

SEQ ID NO: 248500 - RNA, 19 nt, Human
uguuacugugucucagaaa

SEQ ID NO: 248501 - RNA, 21 nt, Human
uguuauacaguauaguaugca

SEQ ID NO: 248502 - RNA, 18 nt, Human
uuaaaaguagggccuggu

SEQ ID NO: 248503 - RNA, 21 nt, Human
uuacaaacaaaauaaaucauc

SEQ ID NO: 248504 - RNA, 24 nt, Human
uuagaaagcaucucucucaagcau

SEQ ID NO: 248505 - RNA, 20 nt, Human
uuagagaaauacuaggauug

SEQ ID NO: 248506 - RNA, 25 nt, Human
uuaguacuagcaaauaugcaacaaa

SEQ ID NO: 248507 - RNA, 23 nt, Human
uuauaacaaggccugauacucag

SEQ ID NO: 248508 - RNA, 22 nt, Human
uucaaaaaaaaaaaaaaagaau

SEQ ID NO: 248509 - RNA, 24 nt, Human
uucaaagagguuuugguuuuuaga

SEQ ID NO: 248510 - RNA, 19 nt, Human
uucaacuuuccgccggcgc

SEQ ID NO: 248511 - RNA, 24 nt, Human
uucaccugcugaaagaacaggauc

SEQ ID NO: 248512 - RNA, 22 nt, Human
uucauuuugaaagaggcccuug

SEQ ID NO: 248513 - RNA, 24 nt, Human
uugauuauaaguagaaaugggggu

SEQ ID NO: 248514 - RNA, 27 nt, Human
uugcaguaaacuuggaaguauggaaag

SEQ ID NO: 248515 - RNA, 25 nt, Human
uugguaucuuccaucucaugcguuc

SEQ ID NO: 248516 - RNA, 21 nt, Human
uugguuucaaaaaaaaaaaaa

SEQ ID NO: 248517 - RNA, 21 nt, Human
uuuagagcaaaaucgagaaaa

SEQ ID NO: 248518 - RNA, 24 nt, Human
uuuguuauuuguaaaccuugaaag

SEQ ID NO: 248519 - RNA, 23 nt, Human
aaaaaaaacaaaggaagcuugga

SEQ ID NO: 248520 - RNA, 19 nt, Human
aaacgaaaacguccuaagc

SEQ ID NO: 248521 - RNA, 23 nt, Human
aaacggaacaaggaaccagagcu

SEQ ID NO: 248522 - RNA, 24 nt, Human
aaacggaacaaggaaccagagcuc

SEQ ID NO: 248523 - RNA, 25 nt, Human
aaagcucccacauguaguaagccac

SEQ ID NO: 248524 - RNA, 18 nt, Human
aacagcugcccagcccgc

SEQ ID NO: 248525 - RNA, 24 nt, Human
aagaaaguccaaggguggaggggg

SEQ ID NO: 248526 - RNA, 22 nt, Human
aagcacacaccaccagagaccc

SEQ ID NO: 248527 - RNA, 23 nt, Human
aagcgcaagggugccgcagccac

SEQ ID NO: 248528 - RNA, 18 nt, Human
acaccaccagagacccug

SEQ ID NO: 248529 - RNA, 24 nt, Human
accagcaaaagcgcaagggugccg

SEQ ID NO: 248530 - RNA, 20 nt, Human
acccaguguugaaccccagc

SEQ ID NO: 248531 - RNA, 20 nt, Human
acucauuuaucccucccccc

SEQ ID NO: 248532 - RNA, 18 nt, Human
acugucuaauccuguuag

SEQ ID NO: 248533 - RNA, 22 nt, Human
acuuuaggaggugagagaagga

SEQ ID NO: 248534 - RNA, 19 nt, Human
agcacugacuccaggaaaa

SEQ ID NO: 248535 - RNA, 19 nt, Human
agcagcacugacuccagga

SEQ ID NO: 248536 - RNA, 22 nt, Human
agccacggcgaaaagaaagucc

SEQ ID NO: 248537 - RNA, 18 nt, Human
aggaaaaaaaaacaaagg

SEQ ID NO: 248538 - RNA, 22 nt, Human
aggaaaaaacgagcauaaccca

SEQ ID NO: 248539 - RNA, 23 nt, Human
aggaaaaaacgagcauaacccag

SEQ ID NO: 248540 - RNA, 21 nt, Human
augguccaugguacuugcugu

SEQ ID NO: 248541 - RNA, 18 nt, Human
auuccugagccacacccc

SEQ ID NO: 248542 - RNA, 24 nt, Human
caaaagcgcaagggugccgcagcc

SEQ ID NO: 248543 - RNA, 20 nt, Human
caacaugaagcuagcagcac

SEQ ID NO: 248544 - RNA, 21 nt, Human
caagcacacaccaccagagac

SEQ ID NO: 248545 - RNA, 21 nt, Human
caccccugucaccgccaaaga

SEQ ID NO: 248546 - RNA, 18 nt, Human
caccuggcccccugaaga

SEQ ID NO: 248547 - RNA, 25 nt, Human
caccuggcccccugaagacccacgu

SEQ ID NO: 248548 - RNA, 26 nt, Human
cacucuugggcucauaugcauucucc

SEQ ID NO: 248549 - RNA, 19 nt, Human
cagagccccgcuugggcgc

SEQ ID NO: 248550 - RNA, 21 nt, Human
cagcaaaagcgcaagggugcc

SEQ ID NO: 248551 - RNA, 20 nt, Human
cagcacggaacgagaccuuu

SEQ ID NO: 248552 - RNA, 23 nt, Human
caggaaaaaacgagcauaaccca

SEQ ID NO: 248553 - RNA, 24 nt, Human
cagucaucaaguccgcaagcacac

SEQ ID NO: 248554 - RNA, 22 nt, Human
cauaacccaguguugaacccca

SEQ ID NO: 248555 - RNA, 23 nt, Human
cauagacacucauuuaucccucc

SEQ ID NO: 248556 - RNA, 19 nt, Human
caugucacauaccaaaagc

SEQ ID NO: 248557 - RNA, 21 nt, Human
caugucacauaccaaaagcuc

SEQ ID NO: 248558 - RNA, 21 nt, Human
cauuaggggaggggucaucug

SEQ ID NO: 248559 - RNA, 18 nt, Human
ccaaggguggagggguga

SEQ ID NO: 248560 - RNA, 20 nt, Human
ccagagccccgcuugggcgc

SEQ ID NO: 248561 - RNA, 21 nt, Human
ccagguacuuggauccgugcc

SEQ ID NO: 248562 - RNA, 21 nt, Human
ccaguucuuccucuaauggcu

SEQ ID NO: 248563 - RNA, 22 nt, Human
ccccaaagacgcuugaaccuuu

SEQ ID NO: 248564 - RNA, 23 nt, Human
ccccagcgugugggcugcagagg

SEQ ID NO: 248565 - RNA, 21 nt, Human
ccccugaagacccacgugcgu

SEQ ID NO: 248566 - RNA, 24 nt, Human
ccccugaagacccacgugcgucug

SEQ ID NO: 248567 - RNA, 18 nt, Human
cccgcaugucacauacca

SEQ ID NO: 248568 - RNA, 21 nt, Human
ccuaagcagccacucaggccc

SEQ ID NO: 248569 - RNA, 20 nt, Human
ccuccauggcagugaccagc

SEQ ID NO: 248570 - RNA, 21 nt, Human
ccuccccccuuccacuucuca

SEQ ID NO: 248571 - RNA, 19 nt, Human
ccugaauggauuggcucuu

SEQ ID NO: 248572 - RNA, 23 nt, Human
ccugagccacaccccggccacca

SEQ ID NO: 248573 - RNA, 21 nt, Human
cgcacggggguccccaaagac

SEQ ID NO: 248574 - RNA, 20 nt, Human
cgcagccacggcgaaaagaa

SEQ ID NO: 248575 - RNA, 23 nt, Human
cgugccucugggagggucucuuc

SEQ ID NO: 248576 - RNA, 21 nt, Human
cuaaaacuccucuacuccuca

SEQ ID NO: 248577 - RNA, 18 nt, Human
cuaagcagccacucaggc

SEQ ID NO: 248578 - RNA, 18 nt, Human
cucaaggcggauuuaaau

SEQ ID NO: 248579 - RNA, 24 nt, Human
cucaaggcggauuuaaauugagga

SEQ ID NO: 248580 - RNA, 21 nt, Human
cucauuuaucccuccccccuu

SEQ ID NO: 248581 - RNA, 20 nt, Human
cuccccccuuccacuucuca

SEQ ID NO: 248582 - RNA, 24 nt, Human
cuccccccuuccacuucucagacc

SEQ ID NO: 248583 - RNA, 18 nt, Human
cugggggcacauugcggg

SEQ ID NO: 248584 - RNA, 21 nt, Human
cuuccacuucucagaccacag

SEQ ID NO: 248585 - RNA, 24 nt, Human
gaaaaaacgagcauaacccagugu

SEQ ID NO: 248586 - RNA, 23 nt, Human
gaagcgcccgauggagucaagga

SEQ ID NO: 248587 - RNA, 20 nt, Human
gaaggacaggaaaaaaaaac

SEQ ID NO: 248588 - RNA, 20 nt, Human
gacccugagaauguggcucu

SEQ ID NO: 248589 - RNA, 26 nt, Human
gagaaggacaggaaaaaaaaacaaag

SEQ ID NO: 248590 - RNA, 25 nt, Human
gagcucgccuguuuccagccagagu

SEQ ID NO: 248591 - RNA, 21 nt, Human
gcaaaagcgcaagggugccgg

SEQ ID NO: 248592 - RNA, 20 nt, Human
gcaccccugucaccgccaaa

SEQ ID NO: 248593 - RNA, 21 nt, Human
gcacugacuccaggaaaaaac

SEQ ID NO: 248594 - RNA, 23 nt, Human
gcagagcaacaugaagcuagcag

SEQ ID NO: 248595 - RNA, 20 nt, Human
gccccacuccaccuuccaaa

SEQ ID NO: 248596 - RNA, 23 nt, Human
gcuuugauucauagacacucauu

SEQ ID NO: 248597 - RNA, 19 nt, Human
ggcugcagaggcaacauca

SEQ ID NO: 248598 - RNA, 20 nt, Human
ggcugcagaggcaacaucag

SEQ ID NO: 248599 - RNA, 21 nt, Human
gggcagccacggccuggggag

SEQ ID NO: 248600 - RNA, 20 nt, Human
gguaacaggggcaaguggga

SEQ ID NO: 248601 - RNA, 22 nt, Human
gguacuugcuguggccagguac

SEQ ID NO: 248602 - RNA, 22 nt, Human
ggugagagaaggacaggaaaaa

SEQ ID NO: 248603 - RNA, 24 nt, Human
uaacagcugcccagcccgcauguc

SEQ ID NO: 248604 - RNA, 19 nt, Human
uaagaagcugaggacagga

SEQ ID NO: 248605 - RNA, 20 nt, Human
uaagcagccacucaggccca

SEQ ID NO: 248606 - RNA, 19 nt, Human
uagacacucauuuaucccu

SEQ ID NO: 248607 - RNA, 21 nt, Human
uagcagcacugacuccaggaa

SEQ ID NO: 248608 - RNA, 23 nt, Human
uaggaaaaaugaagucuacuuua

SEQ ID NO: 248609 - RNA, 24 nt, Human
uaguaagccacuccuugacugucu

SEQ ID NO: 248610 - RNA, 24 nt, Human
ucaaaagucuuccucgaccucaag

SEQ ID NO: 248611 - RNA, 22 nt, Human
ucagagcucaccuugccagagc

SEQ ID NO: 248612 - RNA, 26 nt, Human
ucauuuaucccuccccccuuccacuu

SEQ ID NO: 248613 - RNA, 23 nt, Human
uccaggaaaaaacgagcauaacc

SEQ ID NO: 248614 - RNA, 19 nt, Human
uccaugguacuugcugugg

SEQ ID NO: 248615 - RNA, 21 nt, Human
ucccaagccccacuccaccuu

SEQ ID NO: 248616 - RNA, 22 nt, Human
ucccaagccccacuccaccuuc

SEQ ID NO: 248617 - RNA, 24 nt, Human
ucccuugugaggaaaagagggggu

SEQ ID NO: 248618 - RNA, 22 nt, Human
uccgcaagcacacaccaccaga

SEQ ID NO: 248619 - RNA, 24 nt, Human
uccgcaagcacacaccaccagggu

SEQ ID NO: 248620 - RNA, 24 nt, Human
uccuaagcagccacucaggcccac

SEQ ID NO: 248621 - RNA, 20 nt, Human
ucuaagacucuguaugcaaa

SEQ ID NO: 248622 - RNA, 22 nt, Human
ucuacuuuaggaggugagagaa

SEQ ID NO: 248623 - RNA, 19 nt, Human
ucucugugcugccccacgu

SEQ ID NO: 248624 - RNA, 18 nt, Human
ucugcagcugugugccuc

SEQ ID NO: 248625 - RNA, 22 nt, Human
ugaagcuagcagcacugacucc

SEQ ID NO: 248626 - RNA, 21 nt, Human
ugaauggauuggcucuucaga

SEQ ID NO: 248627 - RNA, 20 nt, Human
ugaggaaaagagggggugag

SEQ ID NO: 248628 - RNA, 19 nt, Human
ugaggaguuuguucaaaag

SEQ ID NO: 248629 - RNA, 27 nt, Human
ugauucauagacacucauuuaucccuc

SEQ ID NO: 248630 - RNA, 20 nt, Human
ugccagagccccgcuugggc

SEQ ID NO: 248631 - RNA, 18 nt, Human
ugcccgugucucugugcc

SEQ ID NO: 248632 - RNA, 22 nt, Human
uggaaaacggaacaaggaacca

SEQ ID NO: 248633 - RNA, 21 nt, Human
uggacucuaacagcugcccag

SEQ ID NO: 248634 - RNA, 24 nt, Human
uggacucuaacagcugcccagccc

SEQ ID NO: 248635 - RNA, 22 nt, Human
uggcccccucucugugcugccc

SEQ ID NO: 248636 - RNA, 18 nt, Human
uggccggaaauugccggu

SEQ ID NO: 248637 - RNA, 22 nt, Human
ugggaggaagccaugccuggca

SEQ ID NO: 248638 - RNA, 22 nt, Human
ugggagggucucuucugugacg

SEQ ID NO: 248639 - RNA, 19 nt, Human
uggggugugugggcagcca

SEQ ID NO: 248640 - RNA, 22 nt, Human
uggggugugugggcagccacgg

SEQ ID NO: 248641 - RNA, 19 nt, Human
ugucgcagagcaacaugaa

SEQ ID NO: 248642 - RNA, 26 nt, Human
uguggccagguacuuggauccgugcc

SEQ ID NO: 248643 - RNA, 24 nt, Human
uguugcaauuggaaaacggaacaa

SEQ ID NO: 248644 - RNA, 19 nt, Human
uuacauuccugagccacac

SEQ ID NO: 248645 - RNA, 22 nt, Human
uucauagacacucauuuauccc

SEQ ID NO: 248646 - RNA, 19 nt, Human
uucccaagccccacuccac

SEQ ID NO: 248647 - RNA, 27 nt, Human
uucccaagccccacuccaccuuccaaa

SEQ ID NO: 248648 - RNA, 28 nt, Human
uucccaagccccacuccaccuuccaaaa

SEQ ID NO: 248649 - RNA, 22 nt, Human
uuuuuauccacauuugcuuuug

SEQ ID NO: 248650 - RNA, 21 nt, Human
aaaccugcagcuggaaacugg

SEQ ID NO: 248651 - RNA, 18 nt, Human
aacugcauuccacugaca

SEQ ID NO: 248652 - RNA, 23 nt, Human
aaggcucucucuggcccucacgg

SEQ ID NO: 248653 - RNA, 23 nt, Human
aagucccuccugacgggaucccc

SEQ ID NO: 248654 - RNA, 18 nt, Human
acaagucuuuaaagugac

SEQ ID NO: 248655 - RNA, 23 nt, Human
agaagaccccagacagccuuucc

SEQ ID NO: 248656 - RNA, 23 nt, Human
aggccgugacgacugaguccugu

SEQ ID NO: 248657 - RNA, 20 nt, Human
auagaaaauagccuuuaaca

SEQ ID NO: 248658 - RNA, 21 nt, Human
auggaauaguaaaaaaacugc

SEQ ID NO: 248659 - RNA, 22 nt, Human
caaaccugcagcuggaaacugg

SEQ ID NO: 248660 - RNA, 19 nt, Human
cacagcucggcucacccac

SEQ ID NO: 248661 - RNA, 23 nt, Human
cacagcucggcucacccaccagc

SEQ ID NO: 248662 - RNA, 24 nt, Human
cacuaagucccuccugacgggauc

SEQ ID NO: 248663 - RNA, 24 nt, Human
cagcugccggcgggaagucucacu

SEQ ID NO: 248664 - RNA, 18 nt, Human
caucacaggagggcaggc

SEQ ID NO: 248665 - RNA, 18 nt, Human
ccacagaaccaacgucca

SEQ ID NO: 248666 - RNA, 18 nt, Human
cccacagcugggagccuc

SEQ ID NO: 248667 - RNA, 19 nt, Human
cccacagcugggagccuca

SEQ ID NO: 248668 - RNA, 20 nt, Human
ccccagacagccuuuccagu

SEQ ID NO: 248669 - RNA, 19 nt, Human
ccgggauaacggcgccucc

SEQ ID NO: 248670 - RNA, 22 nt, Human
ccucacggucagccaggcugcc

SEQ ID NO: 248671 - RNA, 19 nt, Human
ccuccgcggcgaacacgcc

SEQ ID NO: 248672 - RNA, 27 nt, Human
ccuccugacgggauccacaggaauugg

SEQ ID NO: 248673 - RNA, 19 nt, Human
cgggauccacaggaaucuu

SEQ ID NO: 248674 - RNA, 24 nt, Human
cucacggucagccaggcugccuug

SEQ ID NO: 248675 - RNA, 19 nt, Human
cuuuuaaaccagccgccac

SEQ ID NO: 248676 - RNA, 19 nt, Human
gaaggcucucucuggcccu

SEQ ID NO: 248677 - RNA, 23 nt, Human
gagccaaucugcgccgccgggag

SEQ ID NO: 248678 - RNA, 19 nt, Human
gauuugugcauguuuccuu

SEQ ID NO: 248679 - RNA, 21 nt, Human
gcccacagcugggagccucag

SEQ ID NO: 248680 - RNA, 22 nt, Human
gcccacagcugggagccucagc

SEQ ID NO: 248681 - RNA, 21 nt, Human
gccuuuugugguucagccuga

SEQ ID NO: 248682 - RNA, 18 nt, Human
ggaauaguaaaaaaacug

SEQ ID NO: 248683 - RNA, 19 nt, Human
ggcagagccacuaaguccc

SEQ ID NO: 248684 - RNA, 21 nt, Human
ggccgugacgacugaguccug

SEQ ID NO: 248685 - RNA, 22 nt, Human
guacauccuuccccugcaguca

SEQ ID NO: 248686 - RNA, 20 nt, Human
uagaacagacucuaacaaac

SEQ ID NO: 248687 - RNA, 22 nt, Human
uaguaaaaaaacugcauuccac

SEQ ID NO: 248688 - RNA, 19 nt, Human
ucaaaucucagucuguacu

SEQ ID NO: 248689 - RNA, 21 nt, Human
ucaaaucucagucuguacugu

SEQ ID NO: 248690 - RNA, 22 nt, Human
ucacacuuuuuucuucuugauu

SEQ ID NO: 248691 - RNA, 19 nt, Human
ucacaggagggcaggccca

SEQ ID NO: 248692 - RNA, 23 nt, Human
ucaccgacaauggugaaaucaag

SEQ ID NO: 248693 - RNA, 20 nt, Human
uccacugacaaaaaaaauag

SEQ ID NO: 248694 - RNA, 19 nt, Human
uccaucuuggaaauaaggc

SEQ ID NO: 248695 - RNA, 24 nt, Human
uccauuuguaccacagaaccaacg

SEQ ID NO: 248696 - RNA, 18 nt, Human
ucccauggccuuuugugg

SEQ ID NO: 248697 - RNA, 24 nt, Human
ucccauggccuuuugugguucagc

SEQ ID NO: 248698 - RNA, 23 nt, Human
uccgugaaggcucucucuggccc

SEQ ID NO: 248699 - RNA, 20 nt, Human
uccuguacuccauuuguacc

SEQ ID NO: 248700 - RNA, 20 nt, Human
ucuuucuccgcuucuucucc

SEQ ID NO: 248701 - RNA, 22 nt, Human
ugcauuccacugacaaaaaaaa

SEQ ID NO: 248702 - RNA, 20 nt, Human
uggaauaguaaaaaaacugc

SEQ ID NO: 248703 - RNA, 19 nt, Human
uuggaaauaaggcuucucu

SEQ ID NO: 248704 - RNA, 22 nt, Human
uuuaaagugacuuuucccaaca

SEQ ID NO: 248705 - RNA, 22 nt, Human
uuuccaguucucccgagucuuu

SEQ ID NO: 248706 - RNA, 18 nt, Human
aacagcugaccgcgcgcg

SEQ ID NO: 248707 - RNA, 22 nt, Human
caccgccaacagcugaccgcgc

SEQ ID NO: 248708 - RNA, 22 nt, Human
cacuuuauauuucauaccaagu

SEQ ID NO: 248709 - RNA, 23 nt, Human
ccacauagcuguauacuguaacu

SEQ ID NO: 248710 - RNA, 22 nt, Human
ccuuacagccccagcauccgcu

SEQ ID NO: 248711 - RNA, 24 nt, Human
cgccaacagcugaccgcgcgcgcc

SEQ ID NO: 248712 - RNA, 20 nt, Human
cggcagcggcggcagaggag

SEQ ID NO: 248713 - RNA, 21 nt, Human
cuuacagccccagcauccgcu

SEQ ID NO: 248714 - RNA, 19 nt, Human
gagccccggcguccuccuc

SEQ ID NO: 248715 - RNA, 20 nt, Human
gcagcggcggcagaggaggg

SEQ ID NO: 248716 - RNA, 23 nt, Human
gcggcagcggcggcagaggaggg

SEQ ID NO: 248717 - RNA, 18 nt, Human
gggaaggcgagccccggc

SEQ ID NO: 248718 - RNA, 22 nt, Human
aacugcccagggucacacagga

SEQ ID NO: 248719 - RNA, 19 nt, Human
aagcaggaaggagucguug

SEQ ID NO: 248720 - RNA, 20 nt, Human
acaauaucaccaccucccuc

SEQ ID NO: 248721 - RNA, 25 nt, Human
aggaaggagucguuggaagguuacc

SEQ ID NO: 248722 - RNA, 22 nt, Human
aucaccaccucccucugcccag

SEQ ID NO: 248723 - RNA, 18 nt, Human
cacaauaucaccaccucc

SEQ ID NO: 248724 - RNA, 18 nt, Human
caccaccucccucugccc

SEQ ID NO: 248725 - RNA, 26 nt, Human
caggaaccagaccacacaaccuucag

SEQ ID NO: 248726 - RNA, 22 nt, Human
cagguccccacaguucuucccc

SEQ ID NO: 248727 - RNA, 25 nt, Human
caucugggcacccccagaucugccc

SEQ ID NO: 248728 - RNA, 22 nt, Human
cauggugcugccagggggccuu

SEQ ID NO: 248729 - RNA, 19 nt, Human
ccacaguucuuccccucca

SEQ ID NO: 248730 - RNA, 21 nt, Human
ccagaccacacaauaucacca

SEQ ID NO: 248731 - RNA, 24 nt, Human
ccagaccacacaauaucaccaccu

SEQ ID NO: 248732 - RNA, 21 nt, Human
ccagaucugcccucacacccu

SEQ ID NO: 248733 - RNA, 19 nt, Human
cccacaguucuuccccucc

SEQ ID NO: 248734 - RNA, 20 nt, Human
cccacaguucuuccccucca

SEQ ID NO: 248735 - RNA, 20 nt, Human
ccccacaguucuuccccucc

SEQ ID NO: 248736 - RNA, 23 nt, Human
ccuccagguguccugcuuaguuc

SEQ ID NO: 248737 - RNA, 18 nt, Human
ccucuuugacaaacgggg

SEQ ID NO: 248738 - RNA, 23 nt, Human
cuccuuccaucugggcaccccca

SEQ ID NO: 248739 - RNA, 21 nt, Human
gcccagggucacacaggaacc

SEQ ID NO: 248740 - RNA, 20 nt, Human
ggccuccagguccccacagu

SEQ ID NO: 248741 - RNA, 19 nt, Human
ucacacaggaaccagacca

SEQ ID NO: 248742 - RNA, 20 nt, Human
ucacacaggaaccagaccac

SEQ ID NO: 248743 - RNA, 19 nt, Human
ucccccaugccugccuccu

SEQ ID NO: 248744 - RNA, 23 nt, Human
ugacaaacggggaccagggaggu

SEQ ID NO: 248745 - RNA, 18 nt, Human
ugcccagggucacacagg

SEQ ID NO: 248746 - RNA, 23 nt, Human
ugggugucccccaugccugccuc

SEQ ID NO: 248747 - RNA, 23 nt, Human
uugggugucccccaugccugccu

SEQ ID NO: 248748 - RNA, 20 nt, Human
aaaauguucaguaucuccuc

SEQ ID NO: 248749 - RNA, 25 nt, Human
aaaugcuggaggcacacacaggucu

SEQ ID NO: 248750 - RNA, 18 nt, Human
aaccaaagccuugcugua

SEQ ID NO: 248751 - RNA, 19 nt, Human
aagcagaaacgaggcucug

SEQ ID NO: 248752 - RNA, 20 nt, Human
aagcagaaacgaggcucugc

SEQ ID NO: 248753 - RNA, 25 nt, Human
aagcaggaggaaagaggagaaacga

SEQ ID NO: 248754 - RNA, 23 nt, Human
aagcaggaggaaagaggagggac

SEQ ID NO: 248755 - RNA, 28 nt, Human
acagaaaaaaacaguaaaugguccuuca

SEQ ID NO: 248756 - RNA, 22 nt, Human
acuccauuguccaagugccgag

SEQ ID NO: 248757 - RNA, 18 nt, Human
agaaaucccagaaucaag

SEQ ID NO: 248758 - RNA, 24 nt, Human
agagaagagguaaaacugaaaaag

SEQ ID NO: 248759 - RNA, 19 nt, Human
agagcuacaaaugcaccca

SEQ ID NO: 248760 - RNA, 19 nt, Human
aggaaagaggagaaacgag

SEQ ID NO: 248761 - RNA, 26 nt, Human
agguagagacagguccagagcuacaa

SEQ ID NO: 248762 - RNA, 18 nt, Human
aguguagaacugagagag

SEQ ID NO: 248763 - RNA, 22 nt, Human
aucaaaaagauucccagcucua

SEQ ID NO: 248764 - RNA, 26 nt, Human
augaagcaggaggaaagaggagaaac

SEQ ID NO: 248765 - RNA, 21 nt, Human
caaaaagauucccagcucuaa

SEQ ID NO: 248766 - RNA, 20 nt, Human
cacaaugucaccauggccag

SEQ ID NO: 248767 - RNA, 18 nt, Human
caccauguaucugggggc

SEQ ID NO: 248768 - RNA, 19 nt, Human
cagaaacgaggcucugcug

SEQ ID NO: 248769 - RNA, 20 nt, Human
cagaaacgaggcucugcuga

SEQ ID NO: 248770 - RNA, 21 nt, Human
cagaacagcaauuauguagug

SEQ ID NO: 248771 - RNA, 19 nt, Human
cagcaucuaccaaaaagag

SEQ ID NO: 248772 - RNA, 26 nt, Human
cagcaucuaccaaaaagaggauacaa

SEQ ID NO: 248773 - RNA, 22 nt, Human
caggcucaauauccacugcuug

SEQ ID NO: 248774 - RNA, 20 nt, Human
caugacaacaggagcuaagu

SEQ ID NO: 248775 - RNA, 18 nt, Human
caugcucugaaaauagac

SEQ ID NO: 248776 - RNA, 25 nt, Human
cauggccagucaccccaaggguuga

SEQ ID NO: 248777 - RNA, 22 nt, Human
ccaggacaguugcgaagcgcaa

SEQ ID NO: 248778 - RNA, 25 nt, Human
ccaguggccugcugcaguuuacuuc

SEQ ID NO: 248779 - RNA, 19 nt, Human
cccaggagggaagagcggg

SEQ ID NO: 248780 - RNA, 23 nt, Human
ccccgucaugacaacaggagcug

SEQ ID NO: 248781 - RNA, 23 nt, Human
cccuucccagcccugccuccaaa

SEQ ID NO: 248782 - RNA, 18 nt, Human
ccgccucuaucuuaaagu

SEQ ID NO: 248783 - RNA, 21 nt, Human
ccuauaacucccagagaucac

SEQ ID NO: 248784 - RNA, 22 nt, Human
ccucacucuguccccgucauga

SEQ ID NO: 248785 - RNA, 19 nt, Human
cgaccuaccugccagccuu

SEQ ID NO: 248786 - RNA, 20 nt, Human
cucuaugcagaaaccuccuc

SEQ ID NO: 248787 - RNA, 22 nt, Human
cucuggugcuacagaaaaaaac

SEQ ID NO: 248788 - RNA, 20 nt, Human
cuggugcuacagaaaaaaac

SEQ ID NO: 248789 - RNA, 24 nt, Human
cuuaagaguuggacuucacaggcu

SEQ ID NO: 248790 - RNA, 23 nt, Human
cuucccaugggcagaacuccggu

SEQ ID NO: 248791 - RNA, 21 nt, Human
cuucccuuuccuccuccuccc

SEQ ID NO: 248792 - RNA, 25 nt, Human
gaucaccucuuauggccgccucuau

SEQ ID NO: 248793 - RNA, 23 nt, Human
gcacagccgccagaccagaagag

SEQ ID NO: 248794 - RNA, 19 nt, Human
gcagaaaccuccucaacuu

SEQ ID NO: 248795 - RNA, 22 nt, Human
gcagaaaccuccucaacuuuaa

SEQ ID NO: 248796 - RNA, 18 nt, Human
gcccaggagggaagagcg

SEQ ID NO: 248797 - RNA, 19 nt, Human
gcccuggggcgggaagugc

SEQ ID NO: 248798 - RNA, 18 nt, Human
gcgcucccuucccagccc

SEQ ID NO: 248799 - RNA, 20 nt, Human
gcucccuucccagcccugcc

SEQ ID NO: 248800 - RNA, 25 nt, Human
gcugaaagcagaaacgaggcucugg

SEQ ID NO: 248801 - RNA, 23 nt, Human
ggagcuuaagaguuggacuucac

SEQ ID NO: 248802 - RNA, 20 nt, Human
ggagggggagagugagugcu

SEQ ID NO: 248803 - RNA, 22 nt, Human
gggcaccucuggauacagucca

SEQ ID NO: 248804 - RNA, 20 nt, Human
gguagagacagguccagagc

SEQ ID NO: 248805 - RNA, 25 nt, Human
guaacaccugucuacgcucuuccca

SEQ ID NO: 248806 - RNA, 19 nt, Human
uaacucccagagaucaccu

SEQ ID NO: 248807 - RNA, 18 nt, Human
uaauaaggcuccacugag

SEQ ID NO: 248808 - RNA, 19 nt, Human
uacaaaugcacccaugugg

SEQ ID NO: 248809 - RNA, 20 nt, Human
uaccaaaaagaggauacaau

SEQ ID NO: 248810 - RNA, 23 nt, Human
uauggacauaaagacucuaugca

SEQ ID NO: 248811 - RNA, 19 nt, Human
ucacccaggacaguugcga

SEQ ID NO: 248812 - RNA, 23 nt, Human
ucagcaguccuuuuaaaugcugg

SEQ ID NO: 248813 - RNA, 27 nt, Human
ucagcaguccuuuuaaaugcuggaggc

SEQ ID NO: 248814 - RNA, 20 nt, Human
ucaguaucuccucagugucu

SEQ ID NO: 248815 - RNA, 20 nt, Human
ucagugucuuguccuuaggu

SEQ ID NO: 248816 - RNA, 24 nt, Human
uccaaaaugaagauugaaggaagu

SEQ ID NO: 248817 - RNA, 24 nt, Human
uccacugagagggagaaaucccag

SEQ ID NO: 248818 - RNA, 21 nt, Human
ucccagaaucaagagagcgcu

SEQ ID NO: 248819 - RNA, 23 nt, Human
ucccaugaccuauaacucccaga

SEQ ID NO: 248820 - RNA, 19 nt, Human
ugaaagcagaaacgaggcu

SEQ ID NO: 248821 - RNA, 24 nt, Human
ugagacccgggacuuggaaaccaa

SEQ ID NO: 248822 - RNA, 23 nt, Human
ugagagagaagagguaaaacugg

SEQ ID NO: 248823 - RNA, 19 nt, Human
ugauucagcagaacagcaa

SEQ ID NO: 248824 - RNA, 18 nt, Human
ugcuaaccaucaccaugu

SEQ ID NO: 248825 - RNA, 18 nt, Human
ugcuacagaaaaaaacag

SEQ ID NO: 248826 - RNA, 20 nt, Human
ugcuggaggcacacacaggu

SEQ ID NO: 248827 - RNA, 26 nt, Human
ugcuuggucccuucugccacauuuua

SEQ ID NO: 248828 - RNA, 21 nt, Human
uggaagagauuugauucagca

SEQ ID NO: 248829 - RNA, 21 nt, Human
uggucuguuuguaacuuuagu

SEQ ID NO: 248830 - RNA, 20 nt, Human
uguaguaaacaaaucagcaa

SEQ ID NO: 248831 - RNA, 23 nt, Human
uucaaguguaucaguguagaacu

SEQ ID NO: 248832 - RNA, 23 nt, Human
uucaguaucuccucagugucuug

SEQ ID NO: 248833 - RNA, 21 nt, Human
uuucacggacgagccauugcu

SEQ ID NO: 248834 - RNA, 20 nt, Human
uuucauagggaacuuuggau

SEQ ID NO: 248835 - RNA, 21 nt, Human
uuuguagucagcuauggcaau

SEQ ID NO: 248836 - RNA, 18 nt, Human
aacugcucuuuaugagac

SEQ ID NO: 248837 - RNA, 22 nt, Human
acagaggcagcugcgucccaca

SEQ ID NO: 248838 - RNA, 23 nt, Human
ccacuccgugacuccccaguaca

SEQ ID NO: 248839 - RNA, 19 nt, Human
cccccagaaaagcuggagg

SEQ ID NO: 248840 - RNA, 19 nt, Human
ccuggagcccggccacucc

SEQ ID NO: 248841 - RNA, 23 nt, Human
gcacuuccucuuuuugguggaga

SEQ ID NO: 248842 - RNA, 18 nt, Human
gcaugauucuccaauaug

SEQ ID NO: 248843 - RNA, 21 nt, Human
ggcacuuccucuuuuuggugg

SEQ ID NO: 248844 - RNA, 23 nt, Human
ggcagcugcgucccacacgccaa

SEQ ID NO: 248845 - RNA, 21 nt, Human
uacgaagccucgugacccccg

SEQ ID NO: 248846 - RNA, 21 nt, Human
uaguaaaacugcucuuuauga

SEQ ID NO: 248847 - RNA, 21 nt, Human
ugagacccccagaaaagcugg

SEQ ID NO: 248848 - RNA, 22 nt, Human
ugagacccccagaaaagcugga

SEQ ID NO: 248849 - RNA, 19 nt, Human
uggagagagaagacacuac

SEQ ID NO: 248850 - RNA, 18 nt, Human
uggaggcacuuccucuuu

SEQ ID NO: 248851 - RNA, 21 nt, Human
uuuaugagacccccagaaaag

SEQ ID NO: 248852 - RNA, 24 nt, Human
aaauaagcccgcuaaaauaucacc

SEQ ID NO: 248853 - RNA, 21 nt, Human
aagcauaaccagcaaaacaau

SEQ ID NO: 248854 - RNA, 24 nt, Human
aagcauaaccagcaaaacaaucau

SEQ ID NO: 248855 - RNA, 22 nt, Human
acagaaaacauccuuuauucca

SEQ ID NO: 248856 - RNA, 23 nt, Human
agggcacuuuaugcaacugaagu

SEQ ID NO: 248857 - RNA, 22 nt, Human
agugugagggcacuuuaugcaa

SEQ ID NO: 248858 - RNA, 19 nt, Human
caagcauaaccagcaaaac

SEQ ID NO: 248859 - RNA, 22 nt, Human
cagcagugugagggcacuuuau

SEQ ID NO: 248860 - RNA, 22 nt, Human
cccgcuaaaauaucaccaagca

SEQ ID NO: 248861 - RNA, 20 nt, Human
cgcuuuaugggugguaaaac

SEQ ID NO: 248862 - RNA, 24 nt, Human
cuacuacauguguuaauuuucagu

SEQ ID NO: 248863 - RNA, 22 nt, Human
cucuaagaaaauuuaaaaggaa

SEQ ID NO: 248864 - RNA, 24 nt, Human
cugagaacaaauucuggagaugaa

SEQ ID NO: 248865 - RNA, 22 nt, Human
cuggagccggugcuuuccccug

SEQ ID NO: 248866 - RNA, 22 nt, Human
uaaaauuuuaaggcuacuacau

SEQ ID NO: 248867 - RNA, 18 nt, Human
uaagguagaaaaguacaa

SEQ ID NO: 248868 - RNA, 19 nt, Human
uacagaacugaguuuacag

SEQ ID NO: 248869 - RNA, 21 nt, Human
uaucaccaagcauaaccagca

SEQ ID NO: 248870 - RNA, 19 nt, Human
ucccuggcuggggcggaag

SEQ ID NO: 248871 - RNA, 20 nt, Human
ucccuggcuggggcggaagc

SEQ ID NO: 248872 - RNA, 20 nt, Human
ugaauggugguaauggcugc

SEQ ID NO: 248873 - RNA, 18 nt, Human
ugggucagaaaggauaac

SEQ ID NO: 248874 - RNA, 21 nt, Human
uuaaauaaauauccucacuga

SEQ ID NO: 248875 - RNA, 24 nt, Human
uucaguacauguccaacagaaaac

SEQ ID NO: 248876 - RNA, 19 nt, Human
uugaaugguauaguuucag

SEQ ID NO: 248877 - RNA, 19 nt, Human
uuuacagauuacagaacuu

SEQ ID NO: 248878 - RNA, 21 nt, Human
aagcugccguggugcuuccau

SEQ ID NO: 248879 - RNA, 21 nt, Human
aaggcacaccgauugcauuug

SEQ ID NO: 248880 - RNA, 18 nt, Human
agaaaauagcagagcaca

SEQ ID NO: 248881 - RNA, 23 nt, Human
agaagaaauaauuuucaagucca

SEQ ID NO: 248882 - RNA, 21 nt, Human
agaaucuuucaagcacaauau

SEQ ID NO: 248883 - RNA, 18 nt, Human
aggaaagagcuacuugcc

SEQ ID NO: 248884 - RNA, 20 nt, Human
aggcaggaaagagcuacuug

SEQ ID NO: 248885 - RNA, 19 nt, Human
caaaauuuacucaugcccc

SEQ ID NO: 248886 - RNA, 19 nt, Human
caaaguagagaagaaauaa

SEQ ID NO: 248887 - RNA, 22 nt, Human
cacaaguuaaaacaaugggcac

SEQ ID NO: 248888 - RNA, 20 nt, Human
cacaguggcagcaauguugg

SEQ ID NO: 248889 - RNA, 23 nt, Human
cagaaaauagcagagcacaacua

SEQ ID NO: 248890 - RNA, 25 nt, Human
cauuaaccugaaaacaacaucugca

SEQ ID NO: 248891 - RNA, 21 nt, Human
cguguccauuaaccugaaaac

SEQ ID NO: 248892 - RNA, 18 nt, Human
cugggcuuuguauuguuu

SEQ ID NO: 248893 - RNA, 23 nt, Human
cuugaccuuagccauuuugcagc

SEQ ID NO: 248894 - RNA, 18 nt, Human
gagaagcaggcaggaaag

SEQ ID NO: 248895 - RNA, 22 nt, Human
gagcugagaagcaggcaggaaa

SEQ ID NO: 248896 - RNA, 18 nt, Human
guguccauuaaccugaaa

SEQ ID NO: 248897 - RNA, 18 nt, Human
guguccauuaaccugaaa

SEQ ID NO: 248898 - RNA, 19 nt, Human
uaaaaagacagcguaccau

SEQ ID NO: 248899 - RNA, 19 nt, Human
uaaaaagacagcguaccau

SEQ ID NO: 248900 - RNA, 22 nt, Human
uaaaaagacagcguaccauaau

SEQ ID NO: 248901 - RNA, 21 nt, Human
uaaaacaaugggcacaaaagc

SEQ ID NO: 248902 - RNA, 24 nt, Human
uaaccugaaaacaacaucugcauc

SEQ ID NO: 248903 - RNA, 18 nt, Human
uaauccaaggcacaccga

SEQ ID NO: 248904 - RNA, 24 nt, Human
uacaugauuuuaaaaagacagcgu

SEQ ID NO: 248905 - RNA, 25 nt, Human
ugaaaaaaagaauuacaacaugaaa

SEQ ID NO: 248906 - RNA, 21 nt, Human
ugaaaacaacaucugcaucau

SEQ ID NO: 248907 - RNA, 19 nt, Human
ugaaauacgagcugcuucu

SEQ ID NO: 248908 - RNA, 21 nt, Human
ugacuuaauucauuaauaaac

SEQ ID NO: 248909 - RNA, 18 nt, Human
ugagaagcaggcaggaaa

SEQ ID NO: 248910 - RNA, 21 nt, Human
ugagaagcaggcaggaaagag

SEQ ID NO: 248911 - RNA, 18 nt, Human
ugagaugagaaucuuuca

SEQ ID NO: 248912 - RNA, 20 nt, Human
ugccccgaaaagaauuucug

SEQ ID NO: 248913 - RNA, 22 nt, Human
ugccccgaaaagaauuucuggg

SEQ ID NO: 248914 - RNA, 19 nt, Human
ugggaggaaaaaaaaaaaa

SEQ ID NO: 248915 - RNA, 23 nt, Human
uuuaaaaagacagcguaccauaa

SEQ ID NO: 248916 - RNA, 24 nt, Human
uuuguaaacuacucucaugaaaau

SEQ ID NO: 248917 - RNA, 20 nt, Human
aaaaacuaauguaaauucga

SEQ ID NO: 248918 - RNA, 24 nt, Human
aaaaacuacauaaagugcuuuuag

SEQ ID NO: 248919 - RNA, 20 nt, Human
aaacacuagaggacugcauu

SEQ ID NO: 248920 - RNA, 20 nt, Human
aaacagaaaguuagggaaac

SEQ ID NO: 248921 - RNA, 21 nt, Human
aaacagaagucaaaaaguagu

SEQ ID NO: 248922 - RNA, 19 nt, Human
aaacuugcaacaagguuug

SEQ ID NO: 248923 - RNA, 21 nt, Human
aaagauaccaguccaaggaaa

SEQ ID NO: 248924 - RNA, 22 nt, Human
aaagauuuauuuuuuuuucuca

SEQ ID NO: 248925 - RNA, 23 nt, Human
aaaguccuccuccauagcuuccc

SEQ ID NO: 248926 - RNA, 21 nt, Human
aaagugcuuuuagguccuuag

SEQ ID NO: 248927 - RNA, 22 nt, Human
aacacagcucaccucuuucugu

SEQ ID NO: 248928 - RNA, 19 nt, Human
aagaaaauuuaaaccugca

SEQ ID NO: 248929 - RNA, 21 nt, Human
aagaaucauggaaaccaagcc

SEQ ID NO: 248930 - RNA, 20 nt, Human
aagcggcuuaugaucaagaa

SEQ ID NO: 248931 - RNA, 21 nt, Human
acaucuaugcacuuguuucca

SEQ ID NO: 248932 - RNA, 24 nt, Human
accaccugccuccuccucccccua

SEQ ID NO: 248933 - RNA, 22 nt, Human
acucuagaacugaacagaacaa

SEQ ID NO: 248934 - RNA, 21 nt, Human
acugaaauccaaagaugccag

SEQ ID NO: 248935 - RNA, 23 nt, Human
acugccccaagcccaaaauauca

SEQ ID NO: 248936 - RNA, 20 nt, Human
agaaaaaccuaucuaaggaa

SEQ ID NO: 248937 - RNA, 19 nt, Human
agaacugaacagaacaaag

SEQ ID NO: 248938 - RNA, 20 nt, Human
agaggacugcauguuuuucc

SEQ ID NO: 248939 - RNA, 22 nt, Human
agaugggcaggcagggcaguuc

SEQ ID NO: 248940 - RNA, 22 nt, Human
agcacccaugguauuaccaccu

SEQ ID NO: 248941 - RNA, 24 nt, Human
agcccucacugccccaagcccaaa

SEQ ID NO: 248942 - RNA, 22 nt, Human
aggaaaagggacuuccucccac

SEQ ID NO: 248943 - RNA, 20 nt, Human
aggaaguuacagcuuggaga

SEQ ID NO: 248944 - RNA, 23 nt, Human
aggaaguuacagcuuggagucca

SEQ ID NO: 248945 - RNA, 25 nt, Human
agggauggcaggggaaagcuguagg

SEQ ID NO: 248946 - RNA, 18 nt, Human
agguauaaaaguccugaa

SEQ ID NO: 248947 - RNA, 19 nt, Human
aguccaacugcauaaacug

SEQ ID NO: 248948 - RNA, 26 nt, Human
auaaaacaauaguugaaaagauacca

SEQ ID NO: 248949 - RNA, 23 nt, Human
auacacucuagaacugaacagaa

SEQ ID NO: 248950 - RNA, 21 nt, Human
augaaacacuagaggacugca

SEQ ID NO: 248951 - RNA, 25 nt, Human
auugaaaacuugcauauaaugaagu

SEQ ID NO: 248952 - RNA, 23 nt, Human
caaaaggguaugaaaaaaacuaa

SEQ ID NO: 248953 - RNA, 26 nt, Human
caaaccacuugggguguccuaagccc

SEQ ID NO: 248954 - RNA, 21 nt, Human
caaaugucucuccauccaccu

SEQ ID NO: 248955 - RNA, 24 nt, Human
caaccagucugcauacaguuacac

SEQ ID NO: 248956 - RNA, 23 nt, Human
caagacugaaauccaaagaugcc

SEQ ID NO: 248957 - RNA, 20 nt, Human
caccugccuccuccuccccc

SEQ ID NO: 248958 - RNA, 19 nt, Human
cacuacaaccagucugcau

SEQ ID NO: 248959 - RNA, 20 nt, Human
cacuacaaccagucugcaua

SEQ ID NO: 248960 - RNA, 21 nt, Human
cacuccccuccuccuuuccca

SEQ ID NO: 248961 - RNA, 23 nt, Human
cacuccccuccuccuuucccaaa

SEQ ID NO: 248962 - RNA, 19 nt, Human
cacugccccaagcccaaaa

SEQ ID NO: 248963 - RNA, 22 nt, Human
cagaucuuaagauuaauuaaaa

SEQ ID NO: 248964 - RNA, 24 nt, Human
cagucagcacuuagaccaccugcc

SEQ ID NO: 248965 - RNA, 28 nt, Human
cauagaaaagcuguaagaaacagguucc

SEQ ID NO: 248966 - RNA, 23 nt, Human
cauggaaaccaagccgucagaga

SEQ ID NO: 248967 - RNA, 24 nt, Human
ccaagccaaaguauaacagguaua

SEQ ID NO: 248968 - RNA, 24 nt, Human
ccaaggaaaagggacuuccuccca

SEQ ID NO: 248969 - RNA, 18 nt, Human
ccagucgccgccgccgcc

SEQ ID NO: 248970 - RNA, 24 nt, Human
cccaaaccacuugggguguccuaa

SEQ ID NO: 248971 - RNA, 26 nt, Human
cccacagaauguacaugaaacacuag

SEQ ID NO: 248972 - RNA, 22 nt, Human
cccagguuuucaaagaaaaacc

SEQ ID NO: 248973 - RNA, 21 nt, Human
cccaugguauuaccaccugcu

SEQ ID NO: 248974 - RNA, 19 nt, Human
ccccaaagacaggauaaaa

SEQ ID NO: 248975 - RNA, 22 nt, Human
ccccaagcccaaaauaucaacu

SEQ ID NO: 248976 - RNA, 25 nt, Human
ccccaagcccaaaauaucaacuaag

SEQ ID NO: 248977 - RNA, 20 nt, Human
cccccaaagacaggauaaaa

SEQ ID NO: 248978 - RNA, 21 nt, Human
cccccuauaaacccaccacuc

SEQ ID NO: 248979 - RNA, 20 nt, Human
ccccuauaaacccaccacuc

SEQ ID NO: 248980 - RNA, 24 nt, Human
ccccuauaaacccaccacuccccu

SEQ ID NO: 248981 - RNA, 23 nt, Human
cccuaccaucuucacuaaaucua

SEQ ID NO: 248982 - RNA, 24 nt, Human
cccuaccaucuucacuaaaucuaa

SEQ ID NO: 248983 - RNA, 20 nt, Human
cccuauaaacccaccacucc

SEQ ID NO: 248984 - RNA, 22 nt, Human
cccuccuccuuucccaaaccac

SEQ ID NO: 248985 - RNA, 21 nt, Human
cccugagagaagcguaagaca

SEQ ID NO: 248986 - RNA, 24 nt, Human
ccuauaaacccaccacuccccucc

SEQ ID NO: 248987 - RNA, 22 nt, Human
ccuccuccauagcuucccaaac

SEQ ID NO: 248988 - RNA, 22 nt, Human
ccuccucccccuauaaacccac

SEQ ID NO: 248989 - RNA, 18 nt, Human
ccugccuccuccuccccc

SEQ ID NO: 248990 - RNA, 20 nt, Human
cgugaaagaugaaaggucug

SEQ ID NO: 248991 - RNA, 26 nt, Human
cuaaaaguccuccuccauagcuuccc

SEQ ID NO: 248992 - RNA, 19 nt, Human
cuaaaggucauguuccgag

SEQ ID NO: 248993 - RNA, 25 nt, Human
cucacugccccaagcccaaaauauc

SEQ ID NO: 248994 - RNA, 20 nt, Human
cucaggaaaaacagaaaguu

SEQ ID NO: 248995 - RNA, 23 nt, Human
cuccuccauagcuucccaaacaa

SEQ ID NO: 248996 - RNA, 19 nt, Human
cucuugguggggagggagg

SEQ ID NO: 248997 - RNA, 19 nt, Human
cucuugguggggagggagg

SEQ ID NO: 248998 - RNA, 21 nt, Human
cuuuccacccuaccaucuuca

SEQ ID NO: 248999 - RNA, 21 nt, Human
cuuuuggaggauuugcccaaa

SEQ ID NO: 249000 - RNA, 30 nt, Human
gaaaaaccuaucuaaggaauacuuaccaaa

SEQ ID NO: 249001 - RNA, 18 nt, Human
gaaccaagguguucaccc

SEQ ID NO: 249002 - RNA, 23 nt, Human
gaaccaagguguucaccccccac

SEQ ID NO: 249003 - RNA, 21 nt, Human
gccauccuucuaagcaaaucc

SEQ ID NO: 249004 - RNA, 18 nt, Human
gcuacuggccacuuuccu

SEQ ID NO: 249005 - RNA, 19 nt, Human
gggaaucauuaauagaaac

SEQ ID NO: 249006 - RNA, 19 nt, Human
gggagggagggucacucag

SEQ ID NO: 249007 - RNA, 22 nt, Human
guaagacaaacagaagucaaaa

SEQ ID NO: 249008 - RNA, 18 nt, Human
gucugcauacaguuacac

SEQ ID NO: 249009 - RNA, 24 nt, Human
guuaaauuaggucaaauggaagga

SEQ ID NO: 249010 - RNA, 23 nt, Human
guuuugguggugguggugguugg

SEQ ID NO: 249011 - RNA, 22 nt, Human
uaaaaauagcucuagcaaagau

SEQ ID NO: 249012 - RNA, 27 nt, Human
uaacaagcaagccuaauaauagcacca

SEQ ID NO: 249013 - RNA, 22 nt, Human
uaacagguauaaaaguccugaa

SEQ ID NO: 249014 - RNA, 23 nt, Human
uaacagguauaaaaguccugaac

SEQ ID NO: 249015 - RNA, 21 nt, Human
uaagaaguauacugggaaagc

SEQ ID NO: 249016 - RNA, 21 nt, Human
uaagacaaacagaagucaaaa

SEQ ID NO: 249017 - RNA, 25 nt, Human
uaagcccucacugccccaagcccaa

SEQ ID NO: 249018 - RNA, 22 nt, Human
uaagucugauagaacaaacaac

SEQ ID NO: 249019 - RNA, 24 nt, Human
uaauguaaauucgauacuuccuuc

SEQ ID NO: 249020 - RNA, 22 nt, Human
uagaacaaacaucaagacugaa

SEQ ID NO: 249021 - RNA, 23 nt, Human
uagaacaaacaucaagacugaaa

SEQ ID NO: 249022 - RNA, 25 nt, Human
uagaccaccugccuccuccuccccc

SEQ ID NO: 249023 - RNA, 18 nt, Human
uaguugaaaagauaccag

SEQ ID NO: 249024 - RNA, 25 nt, Human
uauggcucugagaugggcaggcagg

SEQ ID NO: 249025 - RNA, 21 nt, Human
uauuugcuuuauugacauacu

SEQ ID NO: 249026 - RNA, 22 nt, Human
ucaaauggaaggaacucaaaug

SEQ ID NO: 249027 - RNA, 23 nt, Human
ucaccaguuaaauuaggucaaau

SEQ ID NO: 249028 - RNA, 21 nt, Human
ucaggaaaaacagaaaguuag

SEQ ID NO: 249029 - RNA, 19 nt, Human
ucauaccuaaugaauuggg

SEQ ID NO: 249030 - RNA, 23 nt, Human
uccacccuaccaucuucacuaaa

SEQ ID NO: 249031 - RNA, 20 nt, Human
ucccuuguacaguacugagg

SEQ ID NO: 249032 - RNA, 24 nt, Human
uccuaagcccucacugccccaagg

SEQ ID NO: 249033 - RNA, 22 nt, Human
uccuccauagcuucccaaacaa

SEQ ID NO: 249034 - RNA, 22 nt, Human
uccuccuccauagcuucccaaa

SEQ ID NO: 249035 - RNA, 24 nt, Human
uccuccuuucccaaaccacuuggg

SEQ ID NO: 249036 - RNA, 22 nt, Human
ugaacagaacaaaguuuagcau

SEQ ID NO: 249037 - RNA, 18 nt, Human
ugacucuucaaucaaugg

SEQ ID NO: 249038 - RNA, 21 nt, Human
ugagaaaacuggggaagaccc

SEQ ID NO: 249039 - RNA, 23 nt, Human
ugagaugggcaggcagggcaguu

SEQ ID NO: 249040 - RNA, 19 nt, Human
ugaggggacuuuugacaca

SEQ ID NO: 249041 - RNA, 19 nt, Human
ugccaaaaucuaaaagggc

SEQ ID NO: 249042 - RNA, 19 nt, Human
uggaaggaacucaaaugag

SEQ ID NO: 249043 - RNA, 26 nt, Human
uggcacagcuaucaaaaguacagcug

SEQ ID NO: 249044 - RNA, 18 nt, Human
uggggccccuaaaaacca

SEQ ID NO: 249045 - RNA, 21 nt, Human
ugucuguauuuccacagucau

SEQ ID NO: 249046 - RNA, 18 nt, Human
uguugcugaaacugaacu

SEQ ID NO: 249047 - RNA, 22 nt, Human
uuaaauggaguccacagacuaa

SEQ ID NO: 249048 - RNA, 18 nt, Human
uuaaccagaaccaaggug

SEQ ID NO: 249049 - RNA, 22 nt, Human
uucagggauggcaggggaaagc

SEQ ID NO: 249050 - RNA, 19 nt, Human
uuccauucaucaaccucuc

SEQ ID NO: 249051 - RNA, 19 nt, Human
uucccaaacaaaguuuguu

SEQ ID NO: 249052 - RNA, 20 nt, Human
uugccuggcuacuggccacu

SEQ ID NO: 249053 - RNA, 23 nt, Human
uugcugaaacugaacuuugcuuc

SEQ ID NO: 249054 - RNA, 25 nt, Human
uugcugaaacugaacuuugcuucuu

SEQ ID NO: 249055 - RNA, 21 nt, Human
uuucaaggaaggacaggaaau

SEQ ID NO: 249056 - RNA, 22 nt, Human
uuucaaggaaggacaggaaaua

SEQ ID NO: 249057 - RNA, 18 nt, Human
uuuuuauaugcacacagc

SEQ ID NO: 249058 - RNA, 22 nt, Human
aaaacuacagaaaccaaaccga

SEQ ID NO: 249059 - RNA, 19 nt, Human
aaacaaacagucaugccag

SEQ ID NO: 249060 - RNA, 19 nt, Human
aaacagacagggagcaaug

SEQ ID NO: 249061 - RNA, 23 nt, Human
aaaggcagcaaaagcagccugaa

SEQ ID NO: 249062 - RNA, 19 nt, Human
aaccgaaugcacaaauaag

SEQ ID NO: 249063 - RNA, 23 nt, Human
aagagaguggggaaacagacagg

SEQ ID NO: 249064 - RNA, 18 nt, Human
aaggcaucccacccaaag

SEQ ID NO: 249065 - RNA, 22 nt, Human
aauccgcaugacucacauccca

SEQ ID NO: 249066 - RNA, 21 nt, Human
acaaagcaggcuuggagaaac

SEQ ID NO: 249067 - RNA, 27 nt, Human
acagaaaccaaaccgaaugcacaaaua

SEQ ID NO: 249068 - RNA, 19 nt, Human
acaucuucaaccagcucuc

SEQ ID NO: 249069 - RNA, 23 nt, Human
acccuaguaccccgaguucauca

SEQ ID NO: 249070 - RNA, 28 nt, Human
agacauccugcuauaagcccugacccuu

SEQ ID NO: 249071 - RNA, 26 nt, Human
agagaguggggaaacagacagggagc

SEQ ID NO: 249072 - RNA, 23 nt, Human
aggcauccugaacucagcagcuc

SEQ ID NO: 249073 - RNA, 21 nt, Human
aggcuuggagaaacaaacagu

SEQ ID NO: 249074 - RNA, 23 nt, Human
aggugcagccagacauccugcua

SEQ ID NO: 249075 - RNA, 22 nt, Human
auaaagcacagagggcacugac

SEQ ID NO: 249076 - RNA, 20 nt, Human
augacucacaucccaccccu

SEQ ID NO: 249077 - RNA, 21 nt, Human
caaggcaucccacccaaaggu

SEQ ID NO: 249078 - RNA, 20 nt, Human
cacagaaaccugcaggagac

SEQ ID NO: 249079 - RNA, 21 nt, Human
cagaacgcugcgcuggcacug

SEQ ID NO: 249080 - RNA, 19 nt, Human
cagcagcucuccugacauc

SEQ ID NO: 249081 - RNA, 23 nt, Human
ccagaacgcugcgcuggcacugu

SEQ ID NO: 249082 - RNA, 18 nt, Human
cccaaggaauccuuaugg

SEQ ID NO: 249083 - RNA, 23 nt, Human
cccacccaaaggugagaagcaca

SEQ ID NO: 249084 - RNA, 20 nt, Human
cccaccccugcgacugagga

SEQ ID NO: 249085 - RNA, 25 nt, Human
ccuaaaccacacgcaggcauccuga

SEQ ID NO: 249086 - RNA, 23 nt, Human
ccuaguaccccgaguucaucaag

SEQ ID NO: 249087 - RNA, 23 nt, Human
ccugcgacugaggagcccagaac

SEQ ID NO: 249088 - RNA, 22 nt, Human
cgaaugcacaaauaagagagug

SEQ ID NO: 249089 - RNA, 21 nt, Human
cuaaaccacacgcaggcaucc

SEQ ID NO: 249090 - RNA, 21 nt, Human
cucacaucccaccccugcgac

SEQ ID NO: 249091 - RNA, 22 nt, Human
cuggcaaggcaucccacccaaa

SEQ ID NO: 249092 - RNA, 21 nt, Human
gaaugcacaaauaagagagug

SEQ ID NO: 249093 - RNA, 24 nt, Human
gaccaccccaaaccagaaucccaa

SEQ ID NO: 249094 - RNA, 18 nt, Human
gacugaggagcccagaac

SEQ ID NO: 249095 - RNA, 26 nt, Human
gagaaacaaacagucaugccaggugc

SEQ ID NO: 249096 - RNA, 20 nt, Human
gauuacaaacaucuucaacc

SEQ ID NO: 249097 - RNA, 23 nt, Human
ggaaacagacagggagcaauggc

SEQ ID NO: 249098 - RNA, 20 nt, Human
ggcagcaaaagcagccugaa

SEQ ID NO: 249099 - RNA, 18 nt, Human
gugagaagcacaaagcag

SEQ ID NO: 249100 - RNA, 22 nt, Human
uaaaaauuaaaacuacagaaac

SEQ ID NO: 249101 - RNA, 21 nt, Human
uaaaacuacagaaaccaaacc

SEQ ID NO: 249102 - RNA, 22 nt, Human
uaaaacuacagaaaccaaaccg

SEQ ID NO: 249103 - RNA, 25 nt, Human
uaaaacuacagaaaccaaagggagc

SEQ ID NO: 249104 - RNA, 22 nt, Human
uaagaaggcuaacaccuaaacc

SEQ ID NO: 249105 - RNA, 18 nt, Human
uaagagaguggggaaaca

SEQ ID NO: 249106 - RNA, 19 nt, Human
uaagagaguggggaaacag

SEQ ID NO: 249107 - RNA, 22 nt, Human
ucagcaaccaaguaagacacac

SEQ ID NO: 249108 - RNA, 23 nt, Human
ucaucaagugcucugguuuugug

SEQ ID NO: 249109 - RNA, 22 nt, Human
ucaugccaggugcagccagaca

SEQ ID NO: 249110 - RNA, 18 nt, Human
ugacucacaucccacccc

SEQ ID NO: 249111 - RNA, 26 nt, Human
ugcagccagacauccugcuauaagcc

SEQ ID NO: 249112 - RNA, 19 nt, Human
ugcaggagacugaaaacga

SEQ ID NO: 249113 - RNA, 23 nt, Human
ugccaggugcagccagacauccu

SEQ ID NO: 249114 - RNA, 23 nt, Human
ugcccucuuccaccacaggggca

SEQ ID NO: 249115 - RNA, 21 nt, Human
ugcucugguuuuguguccaua

SEQ ID NO: 249116 - RNA, 18 nt, Human
uggagacaaagcacucgg

SEQ ID NO: 249117 - RNA, 23 nt, Human
uguucagcaaccaaguaagacac

SEQ ID NO: 249118 - RNA, 25 nt, Human
aaaaaaaacaaaacaaaaaaacagc

SEQ ID NO: 249119 - RNA, 21 nt, Human
aaaaaaacagcaaacagaaaa

SEQ ID NO: 249120 - RNA, 24 nt, Human
aaaaaaacagcaaacagaaaacag

SEQ ID NO: 249121 - RNA, 28 nt, Human
aaaaacagcaaacagaaaaccgguaccc

SEQ ID NO: 249122 - RNA, 19 nt, Human
aaaacaaaaaaacagcaaa

SEQ ID NO: 249123 - RNA, 23 nt, Human
aaacaaaaaaacagcaaacagaa

SEQ ID NO: 249124 - RNA, 22 nt, Human
aaacaaaacaaaaaaacagcaa

SEQ ID NO: 249125 - RNA, 25 nt, Human
aaacagaaaacaguugugcccccaa

SEQ ID NO: 249126 - RNA, 27 nt, Human
aaacagaaaacaguugugcccccaaaa

SEQ ID NO: 249127 - RNA, 20 nt, Human
aaacagcaaacagaaaacag

SEQ ID NO: 249128 - RNA, 20 nt, Human
aaacucucucggcacaaccc

SEQ ID NO: 249129 - RNA, 25 nt, Human
aacaaaacaaaaaaacagcaaacag

SEQ ID NO: 249130 - RNA, 23 nt, Human
aaccacccaaagccuagucuaga

SEQ ID NO: 249131 - RNA, 18 nt, Human
aauucaacacuguuaagg

SEQ ID NO: 249132 - RNA, 26 nt, Human
acaaaacaaaaaaacagcaaacagaa

SEQ ID NO: 249133 - RNA, 27 nt, Human
acaaaacaaaaaaacagcaaacagaaa

SEQ ID NO: 249134 - RNA, 25 nt, Human
acagcaaacagaaaacaguugugcc

SEQ ID NO: 249135 - RNA, 22 nt, Human
acccauucccaaaggguccacc

SEQ ID NO: 249136 - RNA, 22 nt, Human
accgggccccccuuuuuuugua

SEQ ID NO: 249137 - RNA, 22 nt, Human
agaaaaaaaacaaaacaaaaaa

SEQ ID NO: 249138 - RNA, 23 nt, Human
agaaaaaaaacaaaacaaaaaaa

SEQ ID NO: 249139 - RNA, 25 nt, Human
agaaaaaaaacaaaacaaaaaaaca

SEQ ID NO: 249140 - RNA, 26 nt, Human
agaaaaaaaacaaaacaaaaaaacag

SEQ ID NO: 249141 - RNA, 27 nt, Human
agaaaaaaaacaaaacaaaaaaacagc

SEQ ID NO: 249142 - RNA, 19 nt, Human
agggaguagaggcaaagac

SEQ ID NO: 249143 - RNA, 20 nt, Human
caaaacaaaaaaacagcaaa

SEQ ID NO: 249144 - RNA, 19 nt, Human
caaaaguacucagaaguca

SEQ ID NO: 249145 - RNA, 25 nt, Human
caaacagaaaacaguugugccccca

SEQ ID NO: 249146 - RNA, 27 nt, Human
cacaacccaaguucagagacgaggccu

SEQ ID NO: 249147 - RNA, 18 nt, Human
caugacccauucccaaag

SEQ ID NO: 249148 - RNA, 19 nt, Human
ccaaagaacuaccuccacc

SEQ ID NO: 249149 - RNA, 23 nt, Human
ccaaagaacuaccuccaccaaag

SEQ ID NO: 249150 - RNA, 23 nt, Human
ccaaaggguccaccgaguccuga

SEQ ID NO: 249151 - RNA, 20 nt, Human
ccccaaaaguacucagaagu

SEQ ID NO: 249152 - RNA, 21 nt, Human
ccccccuuuuuuuguacgaaa

SEQ ID NO: 249153 - RNA, 22 nt, Human
ccugcaugacgugccucagagc

SEQ ID NO: 249154 - RNA, 19 nt, Human
cuccucuuuccucacccca

SEQ ID NO: 249155 - RNA, 18 nt, Human
cuggagaaaaaaaacaaa

SEQ ID NO: 249156 - RNA, 21 nt, Human
cuggugcuacugcaaagaaag

SEQ ID NO: 249157 - RNA, 20 nt, Human
gagaaaaaaaacaaaacaaa

SEQ ID NO: 249158 - RNA, 23 nt, Human
gagaaaaaaaacaaaacaaaaaa

SEQ ID NO: 249159 - RNA, 24 nt, Human
gagaaaaaaaacaaaacaaaaaaa

SEQ ID NO: 249160 - RNA, 22 nt, Human
gauacaauacauauucaccuua

SEQ ID NO: 249161 - RNA, 22 nt, Human
ggaaccacccaaagccuagucu

SEQ ID NO: 249162 - RNA, 23 nt, Human
gugauacaauacauauucaccuu

SEQ ID NO: 249163 - RNA, 19 nt, Human
uaccgggccccccuuuuuu

SEQ ID NO: 249164 - RNA, 18 nt, Human
ucaccaacauuccucgcc

SEQ ID NO: 249165 - RNA, 24 nt, Human
uccaccgaguccugaacucagcuu

SEQ ID NO: 249166 - RNA, 20 nt, Human
ucucucggcacaacccaagu

SEQ ID NO: 249167 - RNA, 20 nt, Human
ugaccugcaugacgugccuc

SEQ ID NO: 249168 - RNA, 21 nt, Human
ugccucagagcuucucuccac

SEQ ID NO: 249169 - RNA, 19 nt, Human
ugggaaacacagaacaaac

SEQ ID NO: 249170 - RNA, 19 nt, Human
ugggaugggaaguagggcg

SEQ ID NO: 249171 - RNA, 23 nt, Human
ugugauacaauacauauucaccu

SEQ ID NO: 249172 - RNA, 24 nt, Human
aaagugcugggauuacagguguga

SEQ ID NO: 249173 - RNA, 18 nt, Human
aacgugaaaaaaaugaaa

SEQ ID NO: 249174 - RNA, 18 nt, Human
aagugcugggauuacagg

SEQ ID NO: 249175 - RNA, 19 nt, Human
aagugcugggauuacaggu

SEQ ID NO: 249176 - RNA, 26 nt, Human
aagugcugggauuacaggugugagcc

SEQ ID NO: 249177 - RNA, 24 nt, Human
accaucuuggcuaggcuggucuug

SEQ ID NO: 249178 - RNA, 20 nt, Human
acgggguuucaccaucuugg

SEQ ID NO: 249179 - RNA, 21 nt, Human
acgggguuucaccaucuuggc

SEQ ID NO: 249180 - RNA, 21 nt, Human
acgggguuucaccaucuuggc

SEQ ID NO: 249181 - RNA, 21 nt, Human
agcucuauuuacacugauggc

SEQ ID NO: 249182 - RNA, 19 nt, Human
aggacaugcagggagccuu

SEQ ID NO: 249183 - RNA, 25 nt, Human
aggcuggagugcaguggcgcgaucu

SEQ ID NO: 249184 - RNA, 19 nt, Human
aguagcugggauuacaggc

SEQ ID NO: 249185 - RNA, 23 nt, Human
agugcaguggcgcgaucuuggcu

SEQ ID NO: 249186 - RNA, 24 nt, Human
agugcaguggcgcgaucuuggcuc

SEQ ID NO: 249187 - RNA, 27 nt, Human
augaaaacagauacuucacuacaaaua

SEQ ID NO: 249188 - RNA, 24 nt, Human
augauccacccacauuggccuccc

SEQ ID NO: 249189 - RNA, 22 nt, Human
augcagaccacacccauguggc

SEQ ID NO: 249190 - RNA, 18 nt, Human
auuacaggcgcaugccau

SEQ ID NO: 249191 - RNA, 24 nt, Human
caaagugcugggauuacaggugug

SEQ ID NO: 249192 - RNA, 18 nt, Human
caagcccagcuaauuuuu

SEQ ID NO: 249193 - RNA, 21 nt, Human
caccaucuuggcuaggcuggu

SEQ ID NO: 249194 - RNA, 24 nt, Human
caccaucuuggcuaggcuggucuu

SEQ ID NO: 249195 - RNA, 22 nt, Human
cacucuauugcugaggcuggag

SEQ ID NO: 249196 - RNA, 21 nt, Human
cacugcaaccucugccgccug

SEQ ID NO: 249197 - RNA, 23 nt, Human
cacugcaaccucugccgccuggg

SEQ ID NO: 249198 - RNA, 19 nt, Human
caguggcgcgaucuuggcu

SEQ ID NO: 249199 - RNA, 21 nt, Human
ccaaagugcugggauuacagg

SEQ ID NO: 249200 - RNA, 21 nt, Human
ccaaagugcugggauuacagg

SEQ ID NO: 249201 - RNA, 24 nt, Human
ccaaagugcugggauuacaggugu

SEQ ID NO: 249202 - RNA, 22 nt, Human
ccacccacauuggccucccaaa

SEQ ID NO: 249203 - RNA, 23 nt, Human
cccgaguagcugggauuacaggc

SEQ ID NO: 249204 - RNA, 24 nt, Human
cccgaguagcugggauuacaggcg

SEQ ID NO: 249205 - RNA, 22 nt, Human
ccgaguagcugggauuacaggc

SEQ ID NO: 249206 - RNA, 20 nt, Human
ccgcagcgcggacguucccg

SEQ ID NO: 249207 - RNA, 24 nt, Human
ccgccuggguuuaagcgauucucc

SEQ ID NO: 249208 - RNA, 18 nt, Human
ccgcgccacgcccucccc

SEQ ID NO: 249209 - RNA, 21 nt, Human
ccgcgcccggccagcauagua

SEQ ID NO: 249210 - RNA, 20 nt, Human
ccucugccgccuggguuuaa

SEQ ID NO: 249211 - RNA, 22 nt, Human
ccugaccucaugauccacccac

SEQ ID NO: 249212 - RNA, 23 nt, Human
ccugccucaaccucccgaguagc

SEQ ID NO: 249213 - RNA, 24 nt, Human
ccugccucaaccucccgaguagcu

SEQ ID NO: 249214 - RNA, 18 nt, Human
ccugcuccgcagcgcgga

SEQ ID NO: 249215 - RNA, 20 nt, Human
ccuggguuuaagcgauucuc

SEQ ID NO: 249216 - RNA, 23 nt, Human
ccuggguuuaagcgauucuccug

SEQ ID NO: 249217 - RNA, 19 nt, Human
cggccgcuugccgacgacg

SEQ ID NO: 249218 - RNA, 24 nt, Human
cgggguuucaccaucuuggcuagg

SEQ ID NO: 249219 - RNA, 24 nt, Human
cucacugcaaccucugccgccugg

SEQ ID NO: 249220 - RNA, 20 nt, Human
cuccgcgccacgcccucccc

SEQ ID NO: 249221 - RNA, 18 nt, Human
cuccugaccucaugaucc

SEQ ID NO: 249222 - RNA, 21 nt, Human
cucgggccgggcccgccuccc

SEQ ID NO: 249223 - RNA, 23 nt, Human
cugcaaccucugccgccuggguu

SEQ ID NO: 249224 - RNA, 24 nt, Human
cugcaaccucugccgccuggguuu

SEQ ID NO: 249225 - RNA, 24 nt, Human
gaccucaugauccacccacauugg

SEQ ID NO: 249226 - RNA, 24 nt, Human
gagacgggguuucaccaucuuggc

SEQ ID NO: 249227 - RNA, 26 nt, Human
gaguagcugggauuacaggcgcaugc

SEQ ID NO: 249228 - RNA, 18 nt, Human
gauuacaggcgcaugcca

SEQ ID NO: 249229 - RNA, 18 nt, Human
gauuacaggugugagcca

SEQ ID NO: 249230 - RNA, 22 nt, Human
gauuacaggugugagccaccgc

SEQ ID NO: 249231 - RNA, 22 nt, Human
gauuacaggugugagccaccgc

SEQ ID NO: 249232 - RNA, 24 nt, Human
gccuggguuuaagcgauucuccug

SEQ ID NO: 249233 - RNA, 18 nt, Human
gcuccgcgccacgcccuc

SEQ ID NO: 249234 - RNA, 19 nt, Human
gcuccgcgccacgcccucc

SEQ ID NO: 249235 - RNA, 23 nt, Human
gcuccgcgccacgcccuccccgc

SEQ ID NO: 249236 - RNA, 23 nt, Human
gcuggucuugaacuccugaccuc

SEQ ID NO: 249237 - RNA, 18 nt, Human
ggcuggagugcaguggcg

SEQ ID NO: 249238 - RNA, 24 nt, Human
ggcuggucuugaacuccugaccuc

SEQ ID NO: 249239 - RNA, 23 nt, Human
gggguuucaccaucuuggcuagg

SEQ ID NO: 249240 - RNA, 19 nt, Human
ggucuugaacuccugaccu

SEQ ID NO: 249241 - RNA, 24 nt, Human
gugaaaaaaaugaaaacagauacc

SEQ ID NO: 249242 - RNA, 20 nt, Human
uaagcgauucuccugccuca

SEQ ID NO: 249243 - RNA, 23 nt, Human
uacaggugugagccaccgcgccc

SEQ ID NO: 249244 - RNA, 19 nt, Human
uacuagagacgggguuuca

SEQ ID NO: 249245 - RNA, 26 nt, Human
uacuagagacgggguuucaccaucuu

SEQ ID NO: 249246 - RNA, 21 nt, Human
uauugcugaggcuggagugca

SEQ ID NO: 249247 - RNA, 21 nt, Human
ucacugcaaccucugccgccu

SEQ ID NO: 249248 - RNA, 23 nt, Human
ucacugcaaccucugccgccugg

SEQ ID NO: 249249 - RNA, 24 nt, Human
ucacugcaaccucugccgccuggg

SEQ ID NO: 249250 - RNA, 23 nt, Human
ucccaaagugcugggauuacagg

SEQ ID NO: 249251 - RNA, 24 nt, Human
ucccgaguagcugggauuacaggc

SEQ ID NO: 249252 - RNA, 25 nt, Human
ucggcuccgcgccacgcccuccccg

SEQ ID NO: 249253 - RNA, 24 nt, Human
ucucacucuauugcugaggcugga

SEQ ID NO: 249254 - RNA, 24 nt, Human
ucuccugccucaaccucccgagua

SEQ ID NO: 249255 - RNA, 21 nt, Human
ucuugaacuccugaccucaug

SEQ ID NO: 249256 - RNA, 22 nt, Human
ugcaguggcgcgaucuuggcuc

SEQ ID NO: 249257 - RNA, 24 nt, Human
ugccucaaccucccgaguagcugg

SEQ ID NO: 249258 - RNA, 22 nt, Human
ugcugaggcuggagugcagugg

SEQ ID NO: 249259 - RNA, 24 nt, Human
ugcugaggcuggagugcaguggcg

SEQ ID NO: 249260 - RNA, 24 nt, Human
ugcugggauuacaggugugagcca

SEQ ID NO: 249261 - RNA, 23 nt, Human
uggagugcaguggcgcgaucuug

SEQ ID NO: 249262 - RNA, 24 nt, Human
uggagugcaguggcgcgaucuugg

SEQ ID NO: 249263 - RNA, 24 nt, Human
uggcuaggcuggucuugaacuccu

SEQ ID NO: 249264 - RNA, 19 nt, Human
ugggauuacaggcgcaugc

SEQ ID NO: 249265 - RNA, 21 nt, Human
ugggauuacaggcgcaugcca

SEQ ID NO: 249266 - RNA, 21 nt, Human
ugggauuacaggcgcaugcca

SEQ ID NO: 249267 - RNA, 22 nt, Human
ugggauuacaggcgcaugccau

SEQ ID NO: 249268 - RNA, 24 nt, Human
ugggauuacaggcgcaugccauca

SEQ ID NO: 249269 - RNA, 18 nt, Human
ugggauuacaggugugag

SEQ ID NO: 249270 - RNA, 19 nt, Human
ugggauuacaggugugagc

SEQ ID NO: 249271 - RNA, 21 nt, Human
ugggauuacaggugugagcca

SEQ ID NO: 249272 - RNA, 22 nt, Human
ugggauuacaggugugagccac

SEQ ID NO: 249273 - RNA, 23 nt, Human
ugggauuacaggugugagccacc

SEQ ID NO: 249274 - RNA, 24 nt, Human
ugggauuacaggugugagccaccg

SEQ ID NO: 249275 - RNA, 24 nt, Human
uuacuagagacgggguuucaccau

SEQ ID NO: 249276 - RNA, 23 nt, Human
uugcugaggcuggagugcagugg

SEQ ID NO: 249277 - RNA, 18 nt, Human
uuggccucccaaagugcu

SEQ ID NO: 249278 - RNA, 19 nt, Human
uuuaagcucuauuuacacu

SEQ ID NO: 249279 - RNA, 24 nt, Human
uuucaccaucuuggcuaggcuggu

SEQ ID NO: 249280 - RNA, 20 nt, Human
aaaagcacacuucccagaac

SEQ ID NO: 249281 - RNA, 19 nt, Human
aggcagaggucccagcaac

SEQ ID NO: 249282 - RNA, 18 nt, Human
aggcagcggcaggagggg

SEQ ID NO: 249283 - RNA, 20 nt, Human
aggcagcggcaggaggggcg

SEQ ID NO: 249284 - RNA, 18 nt, Human
cacaaaccaggggagaca

SEQ ID NO: 249285 - RNA, 20 nt, Human
cagaggucccagcaacauug

SEQ ID NO: 249286 - RNA, 20 nt, Human
cagcggcaggaggggcgagg

SEQ ID NO: 249287 - RNA, 18 nt, Human
cagcuccuuccucugggg

SEQ ID NO: 249288 - RNA, 21 nt, Human
caggacacuacagcuccuucc

SEQ ID NO: 249289 - RNA, 22 nt, Human
caggggagacaagaaccuccac

SEQ ID NO: 249290 - RNA, 22 nt, Human
cauugucaauggcaggcagcgg

SEQ ID NO: 249291 - RNA, 20 nt, Human
ccaaaagcacacuucccaga

SEQ ID NO: 249292 - RNA, 21 nt, Human
ggcagaaaggagggugccugg

SEQ ID NO: 249293 - RNA, 22 nt, Human
ggcgugggcgaguccaugaguc

SEQ ID NO: 249294 - RNA, 19 nt, Human
ggcugcaguggggaggcag

SEQ ID NO: 249295 - RNA, 21 nt, Human
ucccagaaccgcgcuagaggc

SEQ ID NO: 249296 - RNA, 18 nt, Human
ugcaguggggaggcagag

SEQ ID NO: 249297 - RNA, 18 nt, Human
uggcaggcagcggcagga

SEQ ID NO: 249298 - RNA, 21 nt, Human
ugggaaguucgagggcugcag

SEQ ID NO: 249299 - RNA, 18 nt, Human
uuaacggaugccaaaagc

SEQ ID NO: 249300 - RNA, 26 nt, Human
aacacuucugucccuagcagagcucc

SEQ ID NO: 249301 - RNA, 21 nt, Human
aagcaucacuuccagaaacac

SEQ ID NO: 249302 - RNA, 24 nt, Human
aagcaucacuuccagaaacacuuc

SEQ ID NO: 249303 - RNA, 19 nt, Human
aaguaaugggccuuuucuu

SEQ ID NO: 249304 - RNA, 22 nt, Human
acuucugucccuagcagagcuc

SEQ ID NO: 249305 - RNA, 21 nt, Human
agagcuccagccaggcuccag

SEQ ID NO: 249306 - RNA, 21 nt, Human
agccuguguugguaugaaacc

SEQ ID NO: 249307 - RNA, 23 nt, Human
aggaagugcugaagccuguguug

SEQ ID NO: 249308 - RNA, 18 nt, Human
aggacagcacauaccuua

SEQ ID NO: 249309 - RNA, 19 nt, Human
agugccgaggauucgccug

SEQ ID NO: 249310 - RNA, 25 nt, Human
caacuucacugggacaggaaacaca

SEQ ID NO: 249311 - RNA, 20 nt, Human
cacuucugucccuagcagag

SEQ ID NO: 249312 - RNA, 25 nt, Human
cacuucugucccuagcagagcucca

SEQ ID NO: 249313 - RNA, 21 nt, Human
caggaaacacaccaaaggaag

SEQ ID NO: 249314 - RNA, 18 nt, Human
ccacgcucgaccgccaca

SEQ ID NO: 249315 - RNA, 19 nt, Human
gaagcaucacuuccagaaa

SEQ ID NO: 249316 - RNA, 20 nt, Human
gagcuccagccaggcuccag

SEQ ID NO: 249317 - RNA, 19 nt, Human
gcagagcuccagccaggcu

SEQ ID NO: 249318 - RNA, 19 nt, Human
gccacgcucgaccgccaca

SEQ ID NO: 249319 - RNA, 23 nt, Human
gcucuggucaguuacuuucacua

SEQ ID NO: 249320 - RNA, 18 nt, Human
uaaugggccuuuucuuac

SEQ ID NO: 249321 - RNA, 22 nt, Human
uaaugggccuuuucuuacacau

SEQ ID NO: 249322 - RNA, 20 nt, Human
uauuugguuccaacuucacu

SEQ ID NO: 249323 - RNA, 23 nt, Human
ucaauaggacagcacauaccuua

SEQ ID NO: 249324 - RNA, 18 nt, Human
ucaguuacuuucacuauc

SEQ ID NO: 249325 - RNA, 19 nt, Human
ucugaaaacaaauccugga

SEQ ID NO: 249326 - RNA, 18 nt, Human
ucugucccuagcagagcu

SEQ ID NO: 249327 - RNA, 20 nt, Human
ugaaugugacacauaggacc

SEQ ID NO: 249328 - RNA, 22 nt, Human
ugaugaaugugacacauaggac

SEQ ID NO: 249329 - RNA, 20 nt, Human
uuucugaaaacaaauccugg

SEQ ID NO: 249330 - RNA, 19 nt, Human
aacaagaggaccccagggu

SEQ ID NO: 249331 - RNA, 20 nt, Human
caaaaggaguaagugcagca

SEQ ID NO: 249332 - RNA, 24 nt, Human
cacugccccuucccaaggggcagg

SEQ ID NO: 249333 - RNA, 19 nt, Human
cagcaugggagaaagaggg

SEQ ID NO: 249334 - RNA, 20 nt, Human
ccucaaaggcaucacugccc

SEQ ID NO: 249335 - RNA, 22 nt, Human
ccucaaaggcaucacugccccu

SEQ ID NO: 249336 - RNA, 21 nt, Human
ccuuccccucaaaggcaucac

SEQ ID NO: 249337 - RNA, 18 nt, Human
gacuguggccggccaacc

SEQ ID NO: 249338 - RNA, 25 nt, Human
gaggaccccaggguugcaagcaggc

SEQ ID NO: 249339 - RNA, 25 nt, Human
gggaagcugagaaucuccgcgcggu

SEQ ID NO: 249340 - RNA, 18 nt, Human
ggggcaggccagcaggga

SEQ ID NO: 249341 - RNA, 20 nt, Human
uccgcgcgguggacuguggc

SEQ ID NO: 249342 - RNA, 22 nt, Human
uccgcgcgguggacuguggccg

SEQ ID NO: 249343 - RNA, 19 nt, Human
uccuccuuccccucaaagg

SEQ ID NO: 249344 - RNA, 21 nt, Human
ugccgagggccgugcggccgc

SEQ ID NO: 249345 - RNA, 20 nt, Human
ugcggccgcgcuuggcgggc

SEQ ID NO: 249346 - RNA, 18 nt, Human
aacacccuccccacccag

SEQ ID NO: 249347 - RNA, 23 nt, Human
aacacccuccccacccagggcac

SEQ ID NO: 249348 - RNA, 22 nt, Human
aacccuccggcaucagcugauc

SEQ ID NO: 249349 - RNA, 21 nt, Human
aagcggggucgggggcggggg

SEQ ID NO: 249350 - RNA, 24 nt, Human
caacacccuccccacccagucucc

SEQ ID NO: 249351 - RNA, 19 nt, Human
cccacccagucuccccgcc

SEQ ID NO: 249352 - RNA, 19 nt, Human
ccccacccagucuccccgc

SEQ ID NO: 249353 - RNA, 20 nt, Human
cccuccccacccagucuccc

SEQ ID NO: 249354 - RNA, 21 nt, Human
cggcuucaaacccuccggcau

SEQ ID NO: 249355 - RNA, 18 nt, Human
cucgcucccucgcggcgc

SEQ ID NO: 249356 - RNA, 20 nt, Human
gacacgaaagguccaggccc

SEQ ID NO: 249357 - RNA, 22 nt, Human
gccgauccuuaaaagcaaaccc

SEQ ID NO: 249358 - RNA, 22 nt, Human
gcgacagggagccgauccuuaa

SEQ ID NO: 249359 - RNA, 18 nt, Human
gcgggacgcaggcgggua

SEQ ID NO: 249360 - RNA, 20 nt, Human
gcggggucgggggcgggggu

SEQ ID NO: 249361 - RNA, 21 nt, Human
gggggcgggggucucugcagu

SEQ ID NO: 249362 - RNA, 18 nt, Human
gguccgaucgcccgccgc

SEQ ID NO: 249363 - RNA, 22 nt, Human
ggucgggggcgggggucucugc

SEQ ID NO: 249364 - RNA, 26 nt, Human
uaaaagcaaacccuacaaauaaauaa

SEQ ID NO: 249365 - RNA, 26 nt, Human
ucaacacccuccccacccagucuccc

SEQ ID NO: 249366 - RNA, 23 nt, Human
ucgcccgccgcugucacugcgac

SEQ ID NO: 249367 - RNA, 19 nt, Human
uuuauucaacacccucccc

SEQ ID NO: 249368 - RNA, 18 nt, Human
aagaguuggcauuaaucu

SEQ ID NO: 249369 - RNA, 20 nt, Human
aagcaucaaaggaugcuacc

SEQ ID NO: 249370 - RNA, 22 nt, Human
acuacaguguucacuucgcacc

SEQ ID NO: 249371 - RNA, 19 nt, Human
acuucuuaugaaaggaugc

SEQ ID NO: 249372 - RNA, 22 nt, Human
agagucaaaagaugaacuggca

SEQ ID NO: 249373 - RNA, 18 nt, Human
agaguccucucacuucuu

SEQ ID NO: 249374 - RNA, 20 nt, Human
aucaaaggaugcuaccuaca

SEQ ID NO: 249375 - RNA, 23 nt, Human
caaaccagguuguggaaucuauu

SEQ ID NO: 249376 - RNA, 24 nt, Human
caaaugccacacauacacuuucua

SEQ ID NO: 249377 - RNA, 21 nt, Human
caaccuaagagaacauacgga

SEQ ID NO: 249378 - RNA, 22 nt, Human
cacuuucuagcuuucugaaauc

SEQ ID NO: 249379 - RNA, 25 nt, Human
cacuuucuagcuuucugaaaucacc

SEQ ID NO: 249380 - RNA, 18 nt, Human
cagcuccaccaucugcuu

SEQ ID NO: 249381 - RNA, 21 nt, Human
cauacggaguucucuuuggga

SEQ ID NO: 249382 - RNA, 24 nt, Human
cauaucccugcuuuaauacaacca

SEQ ID NO: 249383 - RNA, 26 nt, Human
cucucugcucugcuggagugguugau

SEQ ID NO: 249384 - RNA, 25 nt, Human
cuuucugaaaucaccgaacacauua

SEQ ID NO: 249385 - RNA, 19 nt, Human
ggaaaacaacaagacuaca

SEQ ID NO: 249386 - RNA, 23 nt, Human
ggcagaguggguuacucaaccua

SEQ ID NO: 249387 - RNA, 23 nt, Human
uaaaaagugaaaacaaaugccac

SEQ ID NO: 249388 - RNA, 23 nt, Human
uaagggaaagcaggcaaucuguu

SEQ ID NO: 249389 - RNA, 20 nt, Human
uaaguggcauauucagcucc

SEQ ID NO: 249390 - RNA, 24 nt, Human
uaaucuuugaacaaaaaagauuuc

SEQ ID NO: 249391 - RNA, 18 nt, Human
uaaugauaaaagcaaacc

SEQ ID NO: 249392 - RNA, 22 nt, Human
uauaguuggugaaagaauaauc

SEQ ID NO: 249393 - RNA, 23 nt, Human
ucagccucucugcucugcuggag

SEQ ID NO: 249394 - RNA, 22 nt, Human
ugaaacuacagaauaacaacua

SEQ ID NO: 249395 - RNA, 24 nt, Human
ugaacaaaaaagauuucaagccac

SEQ ID NO: 249396 - RNA, 21 nt, Human
ugcaucugauucugaaauuac

SEQ ID NO: 249397 - RNA, 25 nt, Human
ugccacacauacacuuucuagcuuu

SEQ ID NO: 249398 - RNA, 21 nt, Human
ugcuaccuacauucaagccac

SEQ ID NO: 249399 - RNA, 22 nt, Human
uggcacuccuguuauggcuguc

SEQ ID NO: 249400 - RNA, 19 nt, Human
ugguuaaagaagccaaguu

SEQ ID NO: 249401 - RNA, 18 nt, Human
uguucacuucgcaccaug

SEQ ID NO: 249402 - RNA, 22 nt, Human
uguuuuaaaaagugaaaacaaa

SEQ ID NO: 249403 - RNA, 21 nt, Human
uuagcuaagccacaguugcac

SEQ ID NO: 249404 - RNA, 24 nt, Human
uuugccaauuuuauaaaauacagc

SEQ ID NO: 249405 - RNA, 19 nt, Human
uuuucaguguucuuguuuu

SEQ ID NO: 249406 - RNA, 25 nt, Human
acacaggucuagccugacucucagu

SEQ ID NO: 249407 - RNA, 21 nt, Human
auuccaguagguauuauugau

SEQ ID NO: 249408 - RNA, 18 nt, Human
auugcucuuuauuucugu

SEQ ID NO: 249409 - RNA, 20 nt, Human
cacugugaaaacugcuccuc

SEQ ID NO: 249410 - RNA, 21 nt, Human
cagggacuucuucuuuguuug

SEQ ID NO: 249411 - RNA, 19 nt, Human
caugcuugacuucucauga

SEQ ID NO: 249412 - RNA, 25 nt, Human
ccagggacuucuucuuuguuugacu

SEQ ID NO: 249413 - RNA, 22 nt, Human
ccucccauuuccagauggaggc

SEQ ID NO: 249414 - RNA, 27 nt, Human
ccucuaaacacaggucuagccugacuc

SEQ ID NO: 249415 - RNA, 21 nt, Human
cucaguaaucccccacccuac

SEQ ID NO: 249416 - RNA, 21 nt, Human
cuccucuaaacacaggucuag

SEQ ID NO: 249417 - RNA, 21 nt, Human
uccaugcuugacuucucauga

SEQ ID NO: 249418 - RNA, 20 nt, Human
ugacucucaguaauccccca

SEQ ID NO: 249419 - RNA, 22 nt, Human
uggaggccucccuaggguaggg

SEQ ID NO: 249420 - RNA, 19 nt, Human
aaagccuaggaaaggagac

SEQ ID NO: 249421 - RNA, 18 nt, Human
aaccugguaacccaguaa

SEQ ID NO: 249422 - RNA, 22 nt, Human
acccaguaaagaguucaggcuu

SEQ ID NO: 249423 - RNA, 21 nt, Human
accucccucccuucccuuccu

SEQ ID NO: 249424 - RNA, 19 nt, Human
agaggcaggcaccaggagc

SEQ ID NO: 249425 - RNA, 24 nt, Human
agccggauccccgcgcggggcccg

SEQ ID NO: 249426 - RNA, 20 nt, Human
aggagguggccccucugaga

SEQ ID NO: 249427 - RNA, 23 nt, Human
aguaaagaguucaggcuucucug

SEQ ID NO: 249428 - RNA, 23 nt, Human
cagauagaacagaccucccuccc

SEQ ID NO: 249429 - RNA, 19 nt, Human
caguccugggccuggcccc

SEQ ID NO: 249430 - RNA, 21 nt, Human
ccacccacggcugaggaggug

SEQ ID NO: 249431 - RNA, 23 nt, Human
cccaaaaaagccuaggaaaggag

SEQ ID NO: 249432 - RNA, 21 nt, Human
cccaccggcccacccucccca

SEQ ID NO: 249433 - RNA, 19 nt, Human
cccacggcugaggaggugg

SEQ ID NO: 249434 - RNA, 20 nt, Human
cccagcccuggcugcccucu

SEQ ID NO: 249435 - RNA, 23 nt, Human
cccaggucccgcuggcucccggg

SEQ ID NO: 249436 - RNA, 19 nt, Human
ccccaccggcccacccucc

SEQ ID NO: 249437 - RNA, 20 nt, Human
ccccaccggcccacccuccc

SEQ ID NO: 249438 - RNA, 22 nt, Human
ccccaccggcccacccucccca

SEQ ID NO: 249439 - RNA, 21 nt, Human
ccccaggcucucgccuagccc

SEQ ID NO: 249440 - RNA, 22 nt, Human
ccccaggcucucgccuagcccu

SEQ ID NO: 249441 - RNA, 27 nt, Human
cccccaccccagcccugccccuagguu

SEQ ID NO: 249442 - RNA, 18 nt, Human
ccccgcgcggggcccgcc

SEQ ID NO: 249443 - RNA, 22 nt, Human
ccccgcgcggggcccgccaugc

SEQ ID NO: 249444 - RNA, 18 nt, Human
ccccuuccagucuuuucc

SEQ ID NO: 249445 - RNA, 19 nt, Human
ccccuuccagucuuuucca

SEQ ID NO: 249446 - RNA, 18 nt, Human
ccccuuccccucucacuc

SEQ ID NO: 249447 - RNA, 18 nt, Human
cccucccgccccacccca

SEQ ID NO: 249448 - RNA, 21 nt, Human
cccucccgccccaccccaggc

SEQ ID NO: 249449 - RNA, 22 nt, Human
cccucccuucccuuccuuuccc

SEQ ID NO: 249450 - RNA, 21 nt, Human
cccuggcugcccucugcggcc

SEQ ID NO: 249451 - RNA, 22 nt, Human
cccuuccuuuccccuuccaguc

SEQ ID NO: 249452 - RNA, 24 nt, Human
cccuuccuuuccccuuccagucuu

SEQ ID NO: 249453 - RNA, 18 nt, Human
ccgcuggcucccgggugc

SEQ ID NO: 249454 - RNA, 21 nt, Human
ccggcccacccuccccaagua

SEQ ID NO: 249455 - RNA, 24 nt, Human
ccuagcccugcccucuggggugac

SEQ ID NO: 249456 - RNA, 20 nt, Human
ccucccgccccaccccaggc

SEQ ID NO: 249457 - RNA, 24 nt, Human
ccucccgccccaccccaggcucuc

SEQ ID NO: 249458 - RNA, 21 nt, Human
ccugccccuagguuguccugu

SEQ ID NO: 249459 - RNA, 25 nt, Human
ccuggccccacucagagggacccug

SEQ ID NO: 249460 - RNA, 22 nt, Human
ccugggguggaggagagaggca

SEQ ID NO: 249461 - RNA, 22 nt, Human
ccuucccuuccuuuccccuucc

SEQ ID NO: 249462 - RNA, 24 nt, Human
cgccuggcgccccuuccccucuca

SEQ ID NO: 249463 - RNA, 23 nt, Human
cgggcgccccugcccaggucccg

SEQ ID NO: 249464 - RNA, 19 nt, Human
cucccgccccaccccaggc

SEQ ID NO: 249465 - RNA, 20 nt, Human
cucccuucccuuccuuuccc

SEQ ID NO: 249466 - RNA, 18 nt, Human
cugccccuagguuguccu

SEQ ID NO: 249467 - RNA, 19 nt, Human
cugcuccgggcgccccugc

SEQ ID NO: 249468 - RNA, 18 nt, Human
cuguccucuaagccuggg

SEQ ID NO: 249469 - RNA, 20 nt, Human
cuuuccccuuccagucuuuu

SEQ ID NO: 249470 - RNA, 22 nt, Human
cuuuccccuuccagucuuuucc

SEQ ID NO: 249471 - RNA, 18 nt, Human
gaaaggagacuggagagg

SEQ ID NO: 249472 - RNA, 18 nt, Human
gaaaggagacuggagagg

SEQ ID NO: 249473 - RNA, 19 nt, Human
gcccccaccccagcccugc

SEQ ID NO: 249474 - RNA, 21 nt, Human
gcgccccuuccccucucacuc

SEQ ID NO: 249475 - RNA, 19 nt, Human
gcuacggccccaccggccc

SEQ ID NO: 249476 - RNA, 23 nt, Human
gcucgccuggcgccccuuccccu

SEQ ID NO: 249477 - RNA, 20 nt, Human
gcucucgccuagcccugccc

SEQ ID NO: 249478 - RNA, 19 nt, Human
ggaaaggagacuggagagg

SEQ ID NO: 249479 - RNA, 22 nt, Human
ggcugcccucugcggcccccac

SEQ ID NO: 249480 - RNA, 22 nt, Human
gggcccaccacccacggcugag

SEQ ID NO: 249481 - RNA, 19 nt, Human
ggguaggagaggaccaggg

SEQ ID NO: 249482 - RNA, 24 nt, Human
gguaggagaggaccagggagaggg

SEQ ID NO: 249483 - RNA, 24 nt, Human
guccucagcaauguaugaaccugg

SEQ ID NO: 249484 - RNA, 22 nt, Human
uagaacagaccucccucccuuc

SEQ ID NO: 249485 - RNA, 22 nt, Human
uagcccugcccucuggggugac

SEQ ID NO: 249486 - RNA, 22 nt, Human
uccccuuccagucuuuuccaua

SEQ ID NO: 249487 - RNA, 27 nt, Human
ucccgccccaccccaggcucucgccua

SEQ ID NO: 249488 - RNA, 25 nt, Human
ucccuuccuuuccccuuccagucuu

SEQ ID NO: 249489 - RNA, 20 nt, Human
uccugggccuggccccacuc

SEQ ID NO: 249490 - RNA, 23 nt, Human
ucucugccaugggcccaccaccc

SEQ ID NO: 249491 - RNA, 22 nt, Human
ucugcggcccccaccccagccc

SEQ ID NO: 249492 - RNA, 18 nt, Human
ucuguccucuaagccugg

SEQ ID NO: 249493 - RNA, 19 nt, Human
ucuguccucuaagccuggg

SEQ ID NO: 249494 - RNA, 18 nt, Human
ugcuccgggcgccccugc

SEQ ID NO: 249495 - RNA, 23 nt, Human
ugcuccgggcgccccugcccagg

SEQ ID NO: 249496 - RNA, 19 nt, Human
uggagagggcuggcugagg

SEQ ID NO: 249497 - RNA, 19 nt, Human
uggcucccgggugcucgcc

SEQ ID NO: 249498 - RNA, 18 nt, Human
uggcugaggguggguggg

SEQ ID NO: 249499 - RNA, 20 nt, Human
ugggguggaggagagaggca

SEQ ID NO: 249500 - RNA, 22 nt, Human
ugggguucugagaggacauggg

SEQ ID NO: 249501 - RNA, 24 nt, Human
ugggguucugagaggacaugggug

SEQ ID NO: 249502 - RNA, 19 nt, Human
uguaugaaccugguaaccc

SEQ ID NO: 249503 - RNA, 21 nt, Human
ugugacaguccugggccuggc

SEQ ID NO: 249504 - RNA, 24 nt, Human
uucaaggcugggguucugagagga

SEQ ID NO: 249505 - RNA, 20 nt, Human
uuucuguccucuaagccugg

SEQ ID NO: 249506 - RNA, 23 nt, Human
cacaaaccuguaccaagaagcac

SEQ ID NO: 249507 - RNA, 22 nt, Human
ucacaaaccuguaccaagaagc

SEQ ID NO: 249508 - RNA, 19 nt, Human
ugagucaaagacgacauuu

SEQ ID NO: 249509 - RNA, 24 nt, Human
uucaacaacugcaaaaugagccuc

SEQ ID NO: 249510 - RNA, 24 nt, Human
uugguacuugagucaaagacgaca

SEQ ID NO: 249511 - RNA, 19 nt, Human
uuugaagcauuuaguaaca

SEQ ID NO: 249512 - RNA, 22 nt, Human
aaguuuaucugcaacggcuuug

SEQ ID NO: 249513 - RNA, 23 nt, Human
accuugaaaaauaaaaucaagga

SEQ ID NO: 249514 - RNA, 22 nt, Human
auuaaaauacaaaguuuaucug

SEQ ID NO: 249515 - RNA, 20 nt, Human
auuuggaaggcaugaugaug

SEQ ID NO: 249516 - RNA, 21 nt, Human
ccacccacaauuuggaaggca

SEQ ID NO: 249517 - RNA, 18 nt, Human
ccgacuggcaggcacagg

SEQ ID NO: 249518 - RNA, 18 nt, Human
cgacuggcaggcacagga

SEQ ID NO: 249519 - RNA, 20 nt, Human
cgcggaagugacuccaacga

SEQ ID NO: 249520 - RNA, 21 nt, Human
cuccaacgaccuccacacugc

SEQ ID NO: 249521 - RNA, 20 nt, Human
cuggcaggcacaggagcugg

SEQ ID NO: 249522 - RNA, 18 nt, Human
gaccuccacacugcccag

SEQ ID NO: 249523 - RNA, 25 nt, Human
gcggaagugacuccaacgaccucca

SEQ ID NO: 249524 - RNA, 24 nt, Human
uacaguaaucaucaccaaagcaaa

SEQ ID NO: 249525 - RNA, 18 nt, Human
uccacacugcccagcgcc

SEQ ID NO: 249526 - RNA, 21 nt, Human
ugaaaaauaaaaucaaggacg

SEQ ID NO: 249527 - RNA, 23 nt, Human
ugaaaaauaaaaucaaggacggc

SEQ ID NO: 249528 - RNA, 20 nt, Human
ugacaugaugccuucauaaa

SEQ ID NO: 249529 - RNA, 21 nt, Human
ugacgcggaagugacuccaac

SEQ ID NO: 249530 - RNA, 18 nt, Human
ugacuccaacgaccucca

SEQ ID NO: 249531 - RNA, 21 nt, Human
ugcgcccacagagccacccac

SEQ ID NO: 249532 - RNA, 20 nt, Human
uggaaggcaugaugauguca

SEQ ID NO: 249533 - RNA, 19 nt, Human
uugaaaaauaaaaucaagg

SEQ ID NO: 249534 - RNA, 26 nt, Human
uuuuuuuuuuuuuuuuuacagaaggg

SEQ ID NO: 249535 - RNA, 22 nt, Human
uuuuuuuuuuuuuuuuuuacag

SEQ ID NO: 249536 - RNA, 21 nt, Human
aacgagcagacagaaggcacu

SEQ ID NO: 249537 - RNA, 23 nt, Human
aauggaauuguggggaagaacaa

SEQ ID NO: 249538 - RNA, 18 nt, Human
agggcaugauugauuaaa

SEQ ID NO: 249539 - RNA, 18 nt, Human
agggguggggcuggggag

SEQ ID NO: 249540 - RNA, 18 nt, Human
agggguggggcuggggag

SEQ ID NO: 249541 - RNA, 21 nt, Human
cacuggugggucacaucucgg

SEQ ID NO: 249542 - RNA, 23 nt, Human
caggccccaugugacaccagggg

SEQ ID NO: 249543 - RNA, 19 nt, Human
ccccaugugacaccagggg

SEQ ID NO: 249544 - RNA, 19 nt, Human
ccuuggcauccaggcuugg

SEQ ID NO: 249545 - RNA, 18 nt, Human
cgggccugggagagggag

SEQ ID NO: 249546 - RNA, 20 nt, Human
cgggccugggagagggaggg

SEQ ID NO: 249547 - RNA, 24 nt, Human
cguggccaggccccaugugacacc

SEQ ID NO: 249548 - RNA, 27 nt, Human
cuucccagaaucccuugucccucccca

SEQ ID NO: 249549 - RNA, 20 nt, Human
gaagaacaaaagcgggcucu

SEQ ID NO: 249550 - RNA, 21 nt, Human
gaagaacaaaagcgggcucug

SEQ ID NO: 249551 - RNA, 18 nt, Human
gagagggagggcguggcc

SEQ ID NO: 249552 - RNA, 19 nt, Human
gcuggggagugagagggac

SEQ ID NO: 249553 - RNA, 22 nt, Human
ggagugagagggacaaggcagg

SEQ ID NO: 249554 - RNA, 20 nt, Human
ggccugggagagggagggcg

SEQ ID NO: 249555 - RNA, 19 nt, Human
ggcguggccaggccccaug

SEQ ID NO: 249556 - RNA, 23 nt, Human
gggcacuuagggguggggcuggg

SEQ ID NO: 249557 - RNA, 22 nt, Human
gggccugggagagggagggcgu

SEQ ID NO: 249558 - RNA, 18 nt, Human
gggguggggcuggggagu

SEQ ID NO: 249559 - RNA, 23 nt, Human
guggccaggccccaugugacacc

SEQ ID NO: 249560 - RNA, 19 nt, Human
uaaagcuaacgagcagaca

SEQ ID NO: 249561 - RNA, 24 nt, Human
uaguaauggaauuguggggaagaa

SEQ ID NO: 249562 - RNA, 27 nt, Human
ucccagaaucccuugucccuccccacu

SEQ ID NO: 249563 - RNA, 20 nt, Human
ugauguguuucuuaguaaug

SEQ ID NO: 249564 - RNA, 26 nt, Human
uggccaggccccaugugacaccaggg

SEQ ID NO: 249565 - RNA, 27 nt, Human
uggccaggccccaugugacaccagggg

SEQ ID NO: 249566 - RNA, 18 nt, Human
uuagggguggggcugggg

SEQ ID NO: 249567 - RNA, 18 nt, Human
aaaaagucccagcacuuu

SEQ ID NO: 249568 - RNA, 22 nt, Human
aaaaauauaauacucucagucc

SEQ ID NO: 249569 - RNA, 21 nt, Human
aaaacuuaccaguuccccaag

SEQ ID NO: 249570 - RNA, 28 nt, Human
aaacaaaauccacucaaagacauuaaaa

SEQ ID NO: 249571 - RNA, 20 nt, Human
aaaugccucuucaggguccc

SEQ ID NO: 249572 - RNA, 18 nt, Human
aacuuaccaguuccccaa

SEQ ID NO: 249573 - RNA, 19 nt, Human
aaggggcuagguagaaguc

SEQ ID NO: 249574 - RNA, 21 nt, Human
aaguuccugcagccucugcuu

SEQ ID NO: 249575 - RNA, 23 nt, Human
acacaucaccuuccuuguucccu

SEQ ID NO: 249576 - RNA, 20 nt, Human
accaaaaagucccagcacuu

SEQ ID NO: 249577 - RNA, 20 nt, Human
acuucccuucucugucucaa

SEQ ID NO: 249578 - RNA, 19 nt, Human
agaagucuauccaacuguu

SEQ ID NO: 249579 - RNA, 20 nt, Human
agcacccugccagaaguaag

SEQ ID NO: 249580 - RNA, 20 nt, Human
agggaccugcugcaggccag

SEQ ID NO: 249581 - RNA, 22 nt, Human
auaagagagcagaaaugcaagg

SEQ ID NO: 249582 - RNA, 18 nt, Human
auccccacacaaguuccu

SEQ ID NO: 249583 - RNA, 21 nt, Human
cagaagccuaggacaguauaa

SEQ ID NO: 249584 - RNA, 21 nt, Human
cagaauuucucaaggcauuau

SEQ ID NO: 249585 - RNA, 22 nt, Human
caguuucuuuagaagucuucca

SEQ ID NO: 249586 - RNA, 23 nt, Human
ccacacaaguuccugcagccucu

SEQ ID NO: 249587 - RNA, 18 nt, Human
ccagcuuuuucaacaagc

SEQ ID NO: 249588 - RNA, 26 nt, Human
cccaggaaaaauauaauacucucagu

SEQ ID NO: 249589 - RNA, 27 nt, Human
ccuccaggcuacuuaaguacuuaauuu

SEQ ID NO: 249590 - RNA, 27 nt, Human
ccugcacacugcuucuaugaacacccc

SEQ ID NO: 249591 - RNA, 22 nt, Human
ccugcagccucugcuuaugugc

SEQ ID NO: 249592 - RNA, 21 nt, Human
ccuuguucccuuucaccccca

SEQ ID NO: 249593 - RNA, 20 nt, Human
cgccggagcccccgcuacuc

SEQ ID NO: 249594 - RNA, 26 nt, Human
cgccggagcccccgcuacuccgacag

SEQ ID NO: 249595 - RNA, 20 nt, Human
cuccaacacucugaaaugcc

SEQ ID NO: 249596 - RNA, 26 nt, Human
cugcacacugcuucuaugaacacccc

SEQ ID NO: 249597 - RNA, 24 nt, Human
cugcagccucugcuuaugugcuca

SEQ ID NO: 249598 - RNA, 20 nt, Human
cugcaggccagcugugacau

SEQ ID NO: 249599 - RNA, 22 nt, Human
cuucuccugccugccagacuca

SEQ ID NO: 249600 - RNA, 24 nt, Human
gagaaagaaauguggaaagcauug

SEQ ID NO: 249601 - RNA, 21 nt, Human
gcaaacuuucuucaacuuaua

SEQ ID NO: 249602 - RNA, 22 nt, Human
gcaaacuuucuucaacuuauaa

SEQ ID NO: 249603 - RNA, 20 nt, Human
gcaagaucucugagagacag

SEQ ID NO: 249604 - RNA, 20 nt, Human
gcagaaaugcaagaucucug

SEQ ID NO: 249605 - RNA, 18 nt, Human
guccuuuccuacuaauca

SEQ ID NO: 249606 - RNA, 20 nt, Human
uaaaaauugugguaaaaaau

SEQ ID NO: 249607 - RNA, 19 nt, Human
uaacuggagaaaaagcucc

SEQ ID NO: 249608 - RNA, 22 nt, Human
uagcaaaacucucauuuugguu

SEQ ID NO: 249609 - RNA, 22 nt, Human
uauguaaaucuacauuacuaga

SEQ ID NO: 249610 - RNA, 26 nt, Human
ucaagugucaaacuauuuaaaauucc

SEQ ID NO: 249611 - RNA, 24 nt, Human
ucacagggaccugcugcaggccag

SEQ ID NO: 249612 - RNA, 22 nt, Human
ucagcucagcacccugccagaa

SEQ ID NO: 249613 - RNA, 18 nt, Human
ucagugguggacaugaac

SEQ ID NO: 249614 - RNA, 21 nt, Human
uccaaacaaacugccuuugau

SEQ ID NO: 249615 - RNA, 22 nt, Human
ucuggcaacaaugaucaucaga

SEQ ID NO: 249616 - RNA, 21 nt, Human
ugaaggaacaacagucaaucc

SEQ ID NO: 249617 - RNA, 22 nt, Human
ugagauccccacacaaguuccu

SEQ ID NO: 249618 - RNA, 18 nt, Human
ugcuucuaugaacacccc

SEQ ID NO: 249619 - RNA, 21 nt, Human
uggcaacaaugaucaucagaa

SEQ ID NO: 249620 - RNA, 19 nt, Human
ugguacagcaaacuuucuu

SEQ ID NO: 249621 - RNA, 21 nt, Human
ugguacagcaaacuuucuuca

SEQ ID NO: 249622 - RNA, 22 nt, Human
uuaacuggagaaaaagcuccga

SEQ ID NO: 249623 - RNA, 24 nt, Human
uuaccaaaaagucccagcacuuug

SEQ ID NO: 249624 - RNA, 21 nt, Human
uuucuagaaccuaccuccagg

SEQ ID NO: 249625 - RNA, 20 nt, Human
uuuucuagaaccuaccucca

SEQ ID NO: 249626 - RNA, 19 nt, Human
aaaaaaaaaaccaaguacu

SEQ ID NO: 249627 - RNA, 26 nt, Human
aaaaaaaaaaccaaguacuucucauu

SEQ ID NO: 249628 - RNA, 21 nt, Human
aaaaaaaaccaaguacuucuc

SEQ ID NO: 249629 - RNA, 19 nt, Human
aacacggugaaacccuguc

SEQ ID NO: 249630 - RNA, 20 nt, Human
aacacggugaaacccugucu

SEQ ID NO: 249631 - RNA, 21 nt, Human
aacacggugaaacccugucuc

SEQ ID NO: 249632 - RNA, 24 nt, Human
acagagcaagacucggucucaaaa

SEQ ID NO: 249633 - RNA, 26 nt, Human
acccacugcacuccagccuggguaac

SEQ ID NO: 249634 - RNA, 24 nt, Human
acccugucucuacuaaaaguacaa

SEQ ID NO: 249635 - RNA, 24 nt, Human
acugcacuccagccuggguaacag

SEQ ID NO: 249636 - RNA, 26 nt, Human
acugcacuccagccuggguaacagag

SEQ ID NO: 249637 - RNA, 19 nt, Human
agagcuugcagugagccaa

SEQ ID NO: 249638 - RNA, 23 nt, Human
agagcuugcagugagccaagauc

SEQ ID NO: 249639 - RNA, 24 nt, Human
agcacuuugggaggccgagguggg

SEQ ID NO: 249640 - RNA, 24 nt, Human
agccuggguaacagagcaagacuc

SEQ ID NO: 249641 - RNA, 23 nt, Human
agcuaauugggaggcugaggcag

SEQ ID NO: 249642 - RNA, 18 nt, Human
aggcaggagaauggugcg

SEQ ID NO: 249643 - RNA, 21 nt, Human
aggcaggagaauggugcgaac

SEQ ID NO: 249644 - RNA, 24 nt, Human
aggcaggagaauggugcgaacccg

SEQ ID NO: 249645 - RNA, 19 nt, Human
aggccccagaagcagccaa

SEQ ID NO: 249646 - RNA, 22 nt, Human
aggccccagaagcagccaagcu

SEQ ID NO: 249647 - RNA, 21 nt, Human
aggccgaggugggcggaucac

SEQ ID NO: 249648 - RNA, 18 nt, Human
aggcugaggcaggagaau

SEQ ID NO: 249649 - RNA, 19 nt, Human
aggcugaggcaggagaaug

SEQ ID NO: 249650 - RNA, 24 nt, Human
aggugggcggaucacgaggucagg

SEQ ID NO: 249651 - RNA, 23 nt, Human
aucacccacugcacuccagccug

SEQ ID NO: 249652 - RNA, 19 nt, Human
augccuguaaucccagcac

SEQ ID NO: 249653 - RNA, 20 nt, Human
caagaucacccacugcacuc

SEQ ID NO: 249654 - RNA, 19 nt, Human
caagcuaauugggaggcug

SEQ ID NO: 249655 - RNA, 21 nt, Human
caaguacuucucauuuaagac

SEQ ID NO: 249656 - RNA, 21 nt, Human
cacacaggccccagaagcagc

SEQ ID NO: 249657 - RNA, 19 nt, Human
cacuaauccggggagggac

SEQ ID NO: 249658 - RNA, 23 nt, Human
cacuccagccuggguaacagagc

SEQ ID NO: 249659 - RNA, 18 nt, Human
cacugcacuccagccugg

SEQ ID NO: 249660 - RNA, 19 nt, Human
cacugcacuccagccuggg

SEQ ID NO: 249661 - RNA, 19 nt, Human
cacugcacuccagccuggg

SEQ ID NO: 249662 - RNA, 21 nt, Human
cacugcacuccagccugggua

SEQ ID NO: 249663 - RNA, 22 nt, Human
cacugcacuccagccuggguaa

SEQ ID NO: 249664 - RNA, 23 nt, Human
cacugcacuccagccuggguaac

SEQ ID NO: 249665 - RNA, 24 nt, Human
cacugcacuccagccuggguaaca

SEQ ID NO: 249666 - RNA, 21 nt, Human
cagagcaagacucggucucag

SEQ ID NO: 249667 - RNA, 21 nt, Human
cagcacuuugggaggccgagg

SEQ ID NO: 249668 - RNA, 24 nt, Human
cagcacuuugggaggccgaggugg

SEQ ID NO: 249669 - RNA, 19 nt, Human
caggccccagaagcagcca

SEQ ID NO: 249670 - RNA, 20 nt, Human
caggccccagaagcagccaa

SEQ ID NO: 249671 - RNA, 21 nt, Human
caggccccagaagcagccaag

SEQ ID NO: 249672 - RNA, 20 nt, Human
caugccuguaaucccagcac

SEQ ID NO: 249673 - RNA, 24 nt, Human
caugccuguaaucccagcacuuug

SEQ ID NO: 249674 - RNA, 18 nt, Human
ccacugcacuccagccug

SEQ ID NO: 249675 - RNA, 20 nt, Human
ccacugcacuccagccuggg

SEQ ID NO: 249676 - RNA, 20 nt, Human
ccacugcacuccagccuggg

SEQ ID NO: 249677 - RNA, 21 nt, Human
ccacugcacuccagccugggu

SEQ ID NO: 249678 - RNA, 22 nt, Human
ccacugcacuccagccugggua

SEQ ID NO: 249679 - RNA, 24 nt, Human
ccacugcacuccagccuggguaac

SEQ ID NO: 249680 - RNA, 24 nt, Human
cccacugcacuccagccuggguaa

SEQ ID NO: 249681 - RNA, 18 nt, Human
ccccagaagcagccaagc

SEQ ID NO: 249682 - RNA, 19 nt, Human
ccccagaagcagccaagcu

SEQ ID NO: 249683 - RNA, 23 nt, Human
cccggggagggcagagcuugcag

SEQ ID NO: 249684 - RNA, 18 nt, Human
cccugggccucggggauc

SEQ ID NO: 249685 - RNA, 20 nt, Human
ccgacacacagggccacacc

SEQ ID NO: 249686 - RNA, 22 nt, Human
ccuggcuaacacggugaaaccc

SEQ ID NO: 249687 - RNA, 24 nt, Human
ccuggcuaacacggugaaacccug

SEQ ID NO: 249688 - RNA, 22 nt, Human
ccuggguaacagagcaagacuc

SEQ ID NO: 249689 - RNA, 20 nt, Human
ccuguaaucccagcacuuug

SEQ ID NO: 249690 - RNA, 22 nt, Human
ccuguaaucccagcacuuuggg

SEQ ID NO: 249691 - RNA, 24 nt, Human
cgagaccauccuggcuaacacggu

SEQ ID NO: 249692 - RNA, 24 nt, Human
cgaggugggcggaucacgagguca

SEQ ID NO: 249693 - RNA, 24 nt, Human
cgcccugggccucggggaucauuc

SEQ ID NO: 249694 - RNA, 18 nt, Human
cgcggccgccccucgggc

SEQ ID NO: 249695 - RNA, 18 nt, Human
cgguggcucaugccugua

SEQ ID NO: 249696 - RNA, 23 nt, Human
cucaugccuguaaucccagcacu

SEQ ID NO: 249697 - RNA, 24 nt, Human
cucaugccuguaaucccagcacuu

SEQ ID NO: 249698 - RNA, 18 nt, Human
cuggcuaacacggugaaa

SEQ ID NO: 249699 - RNA, 24 nt, Human
cuggcuaacacggugaaacccugu

SEQ ID NO: 249700 - RNA, 27 nt, Human
gaaaaaaaaaaccaaguacuucucauu

SEQ ID NO: 249701 - RNA, 19 nt, Human
gaaacccugucucuacuaa

SEQ ID NO: 249702 - RNA, 20 nt, Human
gaacccggggagggcagagc

SEQ ID NO: 249703 - RNA, 20 nt, Human
gagcaagacucggucucaaa

SEQ ID NO: 249704 - RNA, 18 nt, Human
gagcuugcagugagccaa

SEQ ID NO: 249705 - RNA, 21 nt, Human
gaggcauuuucucacuuugau

SEQ ID NO: 249706 - RNA, 23 nt, Human
gaggugggcggaucacgagguca

SEQ ID NO: 249707 - RNA, 24 nt, Human
gaucacccacugcacuccagccug

SEQ ID NO: 249708 - RNA, 24 nt, Human
gcacuccagccuggguaacagagc

SEQ ID NO: 249709 - RNA, 19 nt, Human
gcccugggccucggggauc

SEQ ID NO: 249710 - RNA, 23 nt, Human
gcccugggccucggggaucauuc

SEQ ID NO: 249711 - RNA, 21 nt, Human
gcccugggccucggggauccc

SEQ ID NO: 249712 - RNA, 18 nt, Human
gccugcuccucaccaucc

SEQ ID NO: 249713 - RNA, 24 nt, Human
gcuaacacggugaaacccugucuc

SEQ ID NO: 249714 - RNA, 23 nt, Human
ggcagagcuugcagugagccaag

SEQ ID NO: 249715 - RNA, 21 nt, Human
ggcagaugacuguaggccaag

SEQ ID NO: 249716 - RNA, 21 nt, Human
ggcggaucacgaggucaggag

SEQ ID NO: 249717 - RNA, 21 nt, Human
ggcucaugccuguaaucccag

SEQ ID NO: 249718 - RNA, 20 nt, Human
gggaggccgaggugggcgga

SEQ ID NO: 249719 - RNA, 24 nt, Human
gggcggaucacgaggucaggagau

SEQ ID NO: 249720 - RNA, 18 nt, Human
ggugcgaacccggggagg

SEQ ID NO: 249721 - RNA, 23 nt, Human
gguggcucaugccuguaauccca

SEQ ID NO: 249722 - RNA, 24 nt, Human
gguggcucaugccuguaaucccag

SEQ ID NO: 249723 - RNA, 21 nt, Human
gugaaacccugucucuacuaa

SEQ ID NO: 249724 - RNA, 23 nt, Human
guggcucaugccuguaaucccag

SEQ ID NO: 249725 - RNA, 22 nt, Human
uaacacggugaaacccugucuc

SEQ ID NO: 249726 - RNA, 24 nt, Human
uaacacggugaaacccugucucua

SEQ ID NO: 249727 - RNA, 25 nt, Human
uaacagagcaagacucggucucagu

SEQ ID NO: 249728 - RNA, 18 nt, Human
uaagaaaaaaaaaaccaa

SEQ ID NO: 249729 - RNA, 22 nt, Human
uaagaaaaaaaaaaccaaguac

SEQ ID NO: 249730 - RNA, 26 nt, Human
uauacauauuuaagaaaaaaaaaacc

SEQ ID NO: 249731 - RNA, 23 nt, Human
uauaguaaguauucacuauucca

SEQ ID NO: 249732 - RNA, 24 nt, Human
uauaguaaguauucacuauuccac

SEQ ID NO: 249733 - RNA, 18 nt, Human
ucacgaggucaggagauc

SEQ ID NO: 249734 - RNA, 24 nt, Human
ucacgaggucaggagaucgagacc

SEQ ID NO: 249735 - RNA, 22 nt, Human
ucaugccuguaaucccagcacu

SEQ ID NO: 249736 - RNA, 19 nt, Human
uccacuaccaaaguagguc

SEQ ID NO: 249737 - RNA, 19 nt, Human
uccgggccagggcacuggg

SEQ ID NO: 249738 - RNA, 19 nt, Human
ucgcggccgccccucgggc

SEQ ID NO: 249739 - RNA, 19 nt, Human
ucgcggccgccccucgggc

SEQ ID NO: 249740 - RNA, 27 nt, Human
ucgggcucggcuucuugcuccuccggg

SEQ ID NO: 249741 - RNA, 22 nt, Human
ucucuacuaaaaguacaaaaaa

SEQ ID NO: 249742 - RNA, 24 nt, Human
ucucuacuaaaaguacaaaaaauu

SEQ ID NO: 249743 - RNA, 23 nt, Human
ugaggcaggagaauggugcgaac

SEQ ID NO: 249744 - RNA, 24 nt, Human
ugaggcaggagaauggugcgaacc

SEQ ID NO: 249745 - RNA, 25 nt, Human
ugaggcaggagaauggugcgaaccc

SEQ ID NO: 249746 - RNA, 20 nt, Human
ugccugcuccucaccauccg

SEQ ID NO: 249747 - RNA, 23 nt, Human
ugccuguaaucccagcacuuugg

SEQ ID NO: 249748 - RNA, 23 nt, Human
ugccuguaaucccagcacuuugg

SEQ ID NO: 249749 - RNA, 24 nt, Human
ugccuguaaucccagcacuuuggg

SEQ ID NO: 249750 - RNA, 21 nt, Human
ugcggaagcacgacgcccugg

SEQ ID NO: 249751 - RNA, 22 nt, Human
uggcagaugacuguaggccaag

SEQ ID NO: 249752 - RNA, 22 nt, Human
uggcucaugccuguaaucccag

SEQ ID NO: 249753 - RNA, 24 nt, Human
uggcucaugccuguaaucccagca

SEQ ID NO: 249754 - RNA, 18 nt, Human
uggcugcgaaagcagcag

SEQ ID NO: 249755 - RNA, 19 nt, Human
ugggaggccgaggugggcg

SEQ ID NO: 249756 - RNA, 24 nt, Human
ugggaggccgaggugggcggauca

SEQ ID NO: 249757 - RNA, 18 nt, Human
ugggaggcugaggcagga

SEQ ID NO: 249758 - RNA, 24 nt, Human
ugggaggcugaggcaggagaaugg

SEQ ID NO: 249759 - RNA, 19 nt, Human
uggugcgaacccggggagg

SEQ ID NO: 249760 - RNA, 19 nt, Human
uuauacuaaagagaagaaa

SEQ ID NO: 249761 - RNA, 20 nt, Human
uugcagugagccaagaucac

SEQ ID NO: 249762 - RNA, 21 nt, Human
uugccugcuccucaccauccg

SEQ ID NO: 249763 - RNA, 25 nt, Human
uugggaggccgaggugggcggauca

SEQ ID NO: 249764 - RNA, 20 nt, Human
uuuaagaaaaaaaaaaccaa

SEQ ID NO: 249765 - RNA, 23 nt, Human
uuuaagaaaaaaaaaaccaagua

SEQ ID NO: 249766 - RNA, 26 nt, Human
aaaaaaaaaaaaaacuagggugagag

SEQ ID NO: 249767 - RNA, 24 nt, Human
aaaaaaaaaaaacuagggugagag

SEQ ID NO: 249768 - RNA, 19 nt, Human
acccaggcuggagugcagu

SEQ ID NO: 249769 - RNA, 18 nt, Human
accuccccuauacccccg

SEQ ID NO: 249770 - RNA, 20 nt, Human
acucacugcacuucagccug

SEQ ID NO: 249771 - RNA, 18 nt, Human
acugcacuucagccuggg

SEQ ID NO: 249772 - RNA, 24 nt, Human
acugcacuucagccugggagacag

SEQ ID NO: 249773 - RNA, 22 nt, Human
acugcagucuguugguaaaacu

SEQ ID NO: 249774 - RNA, 20 nt, Human
acuucagccugggagacaga

SEQ ID NO: 249775 - RNA, 19 nt, Human
agacagaacaagacagacc

SEQ ID NO: 249776 - RNA, 24 nt, Human
agacagacccugucgccccacacc

SEQ ID NO: 249777 - RNA, 25 nt, Human
aggcuggagugcaguggcucaaucu

SEQ ID NO: 249778 - RNA, 20 nt, Human
agugcaguggcucaaucuug

SEQ ID NO: 249779 - RNA, 22 nt, Human
caagaguuuuucuuuuggguuc

SEQ ID NO: 249780 - RNA, 21 nt, Human
cacaccuccccuauacccccg

SEQ ID NO: 249781 - RNA, 18 nt, Human
cacugcacuucagccugg

SEQ ID NO: 249782 - RNA, 19 nt, Human
cacugcacuucagccuggg

SEQ ID NO: 249783 - RNA, 19 nt, Human
cacugcacuucagccuggg

SEQ ID NO: 249784 - RNA, 21 nt, Human
cacugcacuucagccugggag

SEQ ID NO: 249785 - RNA, 22 nt, Human
cacugcacuucagccugggaga

SEQ ID NO: 249786 - RNA, 23 nt, Human
cacugcacuucagccugggagac

SEQ ID NO: 249787 - RNA, 24 nt, Human
cacugcacuucagccugggagaca

SEQ ID NO: 249788 - RNA, 25 nt, Human
cacugcacuucagccugggagacag

SEQ ID NO: 249789 - RNA, 26 nt, Human
cagaacaagacagacccugucgcccc

SEQ ID NO: 249790 - RNA, 25 nt, Human
cccacaccuccccuauaaucgguug

SEQ ID NO: 249791 - RNA, 21 nt, Human
cccacaccuccccuauacccc

SEQ ID NO: 249792 - RNA, 19 nt, Human
cccugucgccccacaccuc

SEQ ID NO: 249793 - RNA, 24 nt, Human
cccugucgccccacaccuccccua

SEQ ID NO: 249794 - RNA, 24 nt, Human
cgcgcugucacccaggcuggagug

SEQ ID NO: 249795 - RNA, 25 nt, Human
cggaaaaaaaaaagugcaaaaaaaa

SEQ ID NO: 249796 - RNA, 18 nt, Human
cggguggggggaggggug

SEQ ID NO: 249797 - RNA, 21 nt, Human
cucagauuucuacaacucguu

SEQ ID NO: 249798 - RNA, 25 nt, Human
cuucuguucuucauuguuagcucca

SEQ ID NO: 249799 - RNA, 21 nt, Human
gagagccaugaaauagcugaa

SEQ ID NO: 249800 - RNA, 18 nt, Human
gcaaaaaaaaaaaaaaac

SEQ ID NO: 249801 - RNA, 25 nt, Human
gcuggagugcaguggcucaaucuug

SEQ ID NO: 249802 - RNA, 24 nt, Human
gcugucacccaggcuggagugcag

SEQ ID NO: 249803 - RNA, 22 nt, Human
ggaaaaaaaaaagugcaaaaaa

SEQ ID NO: 249804 - RNA, 23 nt, Human
ggaaaaaaaaaagugcaaaaaaa

SEQ ID NO: 249805 - RNA, 23 nt, Human
ggaaaaaaaaaagugcaaaaaaa

SEQ ID NO: 249806 - RNA, 20 nt, Human
ggaaauaaaauuaaauaaag

SEQ ID NO: 249807 - RNA, 19 nt, Human
ggcuggagugcaguggcuc

SEQ ID NO: 249808 - RNA, 21 nt, Human
uagaaggaaacacuuuaucau

SEQ ID NO: 249809 - RNA, 20 nt, Human
ucaagaguuuuucuuuuggg

SEQ ID NO: 249810 - RNA, 22 nt, Human
ucacccaggcuggagugcagug

SEQ ID NO: 249811 - RNA, 19 nt, Human
ucacugcacuucagccugg

SEQ ID NO: 249812 - RNA, 24 nt, Human
ucacugcacuucagccugggagac

SEQ ID NO: 249813 - RNA, 26 nt, Human
ucgccccacaccuccccuauaccccc

SEQ ID NO: 249814 - RNA, 24 nt, Human
ucgcgcugucacccaggcuggagu

SEQ ID NO: 249815 - RNA, 23 nt, Human
ucucgcgcugucacccaggcugg

SEQ ID NO: 249816 - RNA, 24 nt, Human
ucucgcgcugucacccaggcugga

SEQ ID NO: 249817 - RNA, 24 nt, Human
ucucuuguuuucaagaguuuuucu

SEQ ID NO: 249818 - RNA, 24 nt, Human
ugaagaaacugcaguccugugcgg

SEQ ID NO: 249819 - RNA, 20 nt, Human
ugagagccaugaaauagcug

SEQ ID NO: 249820 - RNA, 22 nt, Human
ugagauggagucucgcgcuguc

SEQ ID NO: 249821 - RNA, 18 nt, Human
ugcaaaaaaaaaaaaaaa

SEQ ID NO: 249822 - RNA, 22 nt, Human
ugcaaaaaaaaaaaaaaacuag

SEQ ID NO: 249823 - RNA, 23 nt, Human
ugcaguggcucaaucuugacuca

SEQ ID NO: 249824 - RNA, 22 nt, Human
ugcauggaagaaaucucuuguu

SEQ ID NO: 249825 - RNA, 19 nt, Human
uggagugcaguggcucaau

SEQ ID NO: 249826 - RNA, 23 nt, Human
uggagugcaguggcucaaucuug

SEQ ID NO: 249827 - RNA, 19 nt, Human
ugucugaagaggggcagaa

SEQ ID NO: 249828 - RNA, 18 nt, Human
uucaccuaacuauguacc

SEQ ID NO: 249829 - RNA, 23 nt, Human
uugacucacugcacuucagccug

SEQ ID NO: 249830 - RNA, 19 nt, Human
aacccugcggcccccaccu

SEQ ID NO: 249831 - RNA, 20 nt, Human
aacccugcggcccccaccuc

SEQ ID NO: 249832 - RNA, 19 nt, Human
agacagugcgccugaucag

SEQ ID NO: 249833 - RNA, 23 nt, Human
agcuaugagcuguucuauuuucu

SEQ ID NO: 249834 - RNA, 19 nt, Human
cacucucucucccucccuc

SEQ ID NO: 249835 - RNA, 20 nt, Human
cccucccucucucuccuguc

SEQ ID NO: 249836 - RNA, 20 nt, Human
cccuccuguuucucuccugu

SEQ ID NO: 249837 - RNA, 20 nt, Human
ccucccucucucccuuucuc

SEQ ID NO: 249838 - RNA, 19 nt, Human
ccugcggcccccaccuccu

SEQ ID NO: 249839 - RNA, 21 nt, Human
cgucgguaggaaaacaaaagg

SEQ ID NO: 249840 - RNA, 18 nt, Human
cucccucccucucucucc

SEQ ID NO: 249841 - RNA, 24 nt, Human
cucccucucucccuuucucucaaa

SEQ ID NO: 249842 - RNA, 19 nt, Human
cucccuuucucucaaucca

SEQ ID NO: 249843 - RNA, 18 nt, Human
cucucucucucucucucu

SEQ ID NO: 249844 - RNA, 18 nt, Human
cucucucucucucucucu

SEQ ID NO: 249845 - RNA, 18 nt, Human
cucucucucucucucucu

SEQ ID NO: 249846 - RNA, 18 nt, Human
cucucucucucucucucu

SEQ ID NO: 249847 - RNA, 18 nt, Human
cucucucucucucucucu

SEQ ID NO: 249848 - RNA, 18 nt, Human
cucucucucucucucucu

SEQ ID NO: 249849 - RNA, 18 nt, Human
cucucucucucucucucu

SEQ ID NO: 249850 - RNA, 18 nt, Human
cucucucucucucucucu

SEQ ID NO: 249851 - RNA, 18 nt, Human
cucucucucucucucucu

SEQ ID NO: 249852 - RNA, 18 nt, Human
cucucucucucucucucu

SEQ ID NO: 249853 - RNA, 18 nt, Human
cucucucucucucucucu

SEQ ID NO: 249854 - RNA, 18 nt, Human
cucucucucucucucucu

SEQ ID NO: 249855 - RNA, 18 nt, Human
cucucucucucucucucu

SEQ ID NO: 249856 - RNA, 18 nt, Human
cucucucucucucucucu

SEQ ID NO: 249857 - RNA, 18 nt, Human
cuuggauccuuuccuucu

SEQ ID NO: 249858 - RNA, 18 nt, Human
cuuuccuucuuuugcucu

SEQ ID NO: 249859 - RNA, 18 nt, Human
gagcucagcgccccaacc

SEQ ID NO: 249860 - RNA, 19 nt, Human
gcagccucugguguguggu

SEQ ID NO: 249861 - RNA, 21 nt, Human
gcaggacgccgguagauggca

SEQ ID NO: 249862 - RNA, 23 nt, Human
gccccaacccugcggcccccacc

SEQ ID NO: 249863 - RNA, 19 nt, Human
gcccccaccuccuugcccu

SEQ ID NO: 249864 - RNA, 23 nt, Human
gccugaucagggggucugggagc

SEQ ID NO: 249865 - RNA, 21 nt, Human
gcgccugaucagggggucugg

SEQ ID NO: 249866 - RNA, 23 nt, Human
gcgccugaucagggggucuggga

SEQ ID NO: 249867 - RNA, 22 nt, Human
gggccuccgaguuuuuuccccu

SEQ ID NO: 249868 - RNA, 23 nt, Human
gugcccaguccugcagccucugg

SEQ ID NO: 249869 - RNA, 23 nt, Human
uacaaaacugcuuucaaaacgag

SEQ ID NO: 249870 - RNA, 19 nt, Human
ucacucucucucccucccu

SEQ ID NO: 249871 - RNA, 20 nt, Human
ucccuuucucucaauccaca

SEQ ID NO: 249872 - RNA, 22 nt, Human
uccuguuucucucucucuucca

SEQ ID NO: 249873 - RNA, 26 nt, Human
ucgcucccucccucucucuccugucu

SEQ ID NO: 249874 - RNA, 26 nt, Human
ucucccucccucucucccuuucucuc

SEQ ID NO: 249875 - RNA, 18 nt, Human
ucuccugucucucucucu

SEQ ID NO: 249876 - RNA, 23 nt, Human
ucucgcucccucccucucucucc

SEQ ID NO: 249877 - RNA, 21 nt, Human
ugagggauuuguuuuaugaug

SEQ ID NO: 249878 - RNA, 20 nt, Human
uggcuucggguggggggagg

SEQ ID NO: 249879 - RNA, 19 nt, Human
uggggcuuuuuuuucuugg

SEQ ID NO: 249880 - RNA, 18 nt, Human
uguguauuaaauaucaag

SEQ ID NO: 249881 - RNA, 19 nt, Human
uuucucucucucuuccaca

SEQ ID NO: 249882 - RNA, 25 nt, Human
aaauaaccagaaggcaaagugaagc

SEQ ID NO: 249883 - RNA, 22 nt, Human
agacagaaaccauaaauaacca

SEQ ID NO: 249884 - RNA, 23 nt, Human
cggugcaggcggcggaugcugcu

SEQ ID NO: 249885 - RNA, 19 nt, Human
cuuuaaaaauuaugaaagg

SEQ ID NO: 249886 - RNA, 19 nt, Human
gcggggucaggccggggcg

SEQ ID NO: 249887 - RNA, 26 nt, Human
ucagacagaaaccauaaauaaccaac

SEQ ID NO: 249888 - RNA, 22 nt, Human
ucaggccggggcgggccgcacg

SEQ ID NO: 249889 - RNA, 20 nt, Human
ucaggccggggcgggccgcc

SEQ ID NO: 249890 - RNA, 24 nt, Human
ucauuaauagaguuagaaauguuu

SEQ ID NO: 249891 - RNA, 23 nt, Human
ugcaggcggcggaugcugcuggg

SEQ ID NO: 249892 - RNA, 26 nt, Human
uggggugacggugcugacugcagcca

SEQ ID NO: 249893 - RNA, 24 nt, Human
aggagguacacccggcggagaggc

SEQ ID NO: 249894 - RNA, 18 nt, Human
aagugggucucugagaag

SEQ ID NO: 249895 - RNA, 23 nt, Human
agauggaaauggacauuacaacc

SEQ ID NO: 249896 - RNA, 18 nt, Human
cuccccucaaauggcccc

SEQ ID NO: 249897 - RNA, 19 nt, Human
guguucaguccugugcugg

SEQ ID NO: 249898 - RNA, 20 nt, Human
uaaggugguugggcuuggac

SEQ ID NO: 249899 - RNA, 23 nt, Human
uaggugcuuuauucuccacagag

SEQ ID NO: 249900 - RNA, 18 nt, Human
ugagaagucugaugugcc

SEQ ID NO: 249901 - RNA, 18 nt, Human
ugauguggaaagggagac

SEQ ID NO: 249902 - RNA, 24 nt, Human
ugcuuuauucuccacagagugaua

SEQ ID NO: 249903 - RNA, 20 nt, Human
uggaaauggacauuacaacc

SEQ ID NO: 249904 - RNA, 20 nt, Human
uguacagaacugaauaaagu

SEQ ID NO: 249905 - RNA, 19 nt, Human
uguucaguccugugcuggu

SEQ ID NO: 249906 - RNA, 21 nt, Human
uugauguggaaagggagacgg

SEQ ID NO: 249907 - RNA, 19 nt, Human
aaaaaccaaaccaaaccca

SEQ ID NO: 249908 - RNA, 21 nt, Human
aaaaaccaaaccaaacccaaa

SEQ ID NO: 249909 - RNA, 18 nt, Human
aaaaacuaaaagcaaaac

SEQ ID NO: 249910 - RNA, 20 nt, Human
aaaaagcaaaacaaaagccc

SEQ ID NO: 249911 - RNA, 22 nt, Human
aaaaccccagaaagacaaguaa

SEQ ID NO: 249912 - RNA, 20 nt, Human
aaaagcaaaacaaaagccca

SEQ ID NO: 249913 - RNA, 21 nt, Human
aaaagcccaggauagaggaga

SEQ ID NO: 249914 - RNA, 21 nt, Human
aaacagaaaaaccccagaaag

SEQ ID NO: 249915 - RNA, 18 nt, Human
aaaccaaaccaaacccaa

SEQ ID NO: 249916 - RNA, 20 nt, Human
aaaccccagaaagacaagua

SEQ ID NO: 249917 - RNA, 30 nt, Human
aaacuaaaaagcaaaacaaaagcccaggag

SEQ ID NO: 249918 - RNA, 26 nt, Human
aaacuaaaagcaaaacuaaaaagcaa

SEQ ID NO: 249919 - RNA, 25 nt, Human
aaacugaucaauuaaaaacccacag

SEQ ID NO: 249920 - RNA, 23 nt, Human
aaacuggaagggaaagaggcugg

SEQ ID NO: 249921 - RNA, 18 nt, Human
aaagaggcccccaucuuc

SEQ ID NO: 249922 - RNA, 23 nt, Human
aaagaggcugggcaacugccucu

SEQ ID NO: 249923 - RNA, 20 nt, Human
aaagggcaaagaaggaaggg

SEQ ID NO: 249924 - RNA, 31 nt, Human
aaauaaaaaccaaaccaaacccaaacagaaa

SEQ ID NO: 249925 - RNA, 19 nt, Human
aaauacacaagacaacaca

SEQ ID NO: 249926 - RNA, 18 nt, Human
aaauauaagccucaacac

SEQ ID NO: 249927 - RNA, 20 nt, Human
aaaugcuguguucccaacca

SEQ ID NO: 249928 - RNA, 24 nt, Human
aacacagaaaaggauauaccaaua

SEQ ID NO: 249929 - RNA, 23 nt, Human
aaccaaaccaaacccaaacagaa

SEQ ID NO: 249930 - RNA, 20 nt, Human
aacccaaacagaaaaacccc

SEQ ID NO: 249931 - RNA, 23 nt, Human
aacuaaaaagcaaaacaaaagcc

SEQ ID NO: 249932 - RNA, 20 nt, Human
aacuaggaaggaggaggacg

SEQ ID NO: 249933 - RNA, 24 nt, Human
aacucccucacuucuaaccauucc

SEQ ID NO: 249934 - RNA, 18 nt, Human
aacuccuuucuccaccca

SEQ ID NO: 249935 - RNA, 22 nt, Human
aagcaaaacaagaauccacugg

SEQ ID NO: 249936 - RNA, 23 nt, Human
aagcaacagguauaauuuuaaca

SEQ ID NO: 249937 - RNA, 24 nt, Human
aagcagcucuggacaaugauucca

SEQ ID NO: 249938 - RNA, 21 nt, Human
aagcaggaacuggugagucug

SEQ ID NO: 249939 - RNA, 26 nt, Human
aagcccaccagcaggcagggccggga

SEQ ID NO: 249940 - RNA, 18 nt, Human
aagccuuuugcacuccac

SEQ ID NO: 249941 - RNA, 23 nt, Human
aaggagcaggcuucaaguucugc

SEQ ID NO: 249942 - RNA, 27 nt, Human
aaggagccuaguuuagaaaagugcaaa

SEQ ID NO: 249943 - RNA, 21 nt, Human
aaggagcugugguuagacggg

SEQ ID NO: 249944 - RNA, 22 nt, Human
aagggcucacggguagcccgac

SEQ ID NO: 249945 - RNA, 24 nt, Human
aaucuugccuuuccuuaaaagcac

SEQ ID NO: 249946 - RNA, 19 nt, Human
aaugcccacggggcacacc

SEQ ID NO: 249947 - RNA, 23 nt, Human
acaaauauaagccucaacaccac

SEQ ID NO: 249948 - RNA, 20 nt, Human
acaaauccagguaguucuca

SEQ ID NO: 249949 - RNA, 21 nt, Human
acaaauucacugaaagaggcc

SEQ ID NO: 249950 - RNA, 18 nt, Human
acaagagugcaaaaccug

SEQ ID NO: 249951 - RNA, 26 nt, Human
acacacacauccccuccuggcucccc

SEQ ID NO: 249952 - RNA, 25 nt, Human
acacagcacacguuacaguguccag

SEQ ID NO: 249953 - RNA, 23 nt, Human
acaccacaguuaagaggaccagu

SEQ ID NO: 249954 - RNA, 21 nt, Human
acacgcacguggacgcacgca

SEQ ID NO: 249955 - RNA, 22 nt, Human
acacguuacaguguccagauac

SEQ ID NO: 249956 - RNA, 19 nt, Human
acacuacaaaaaagcaauc

SEQ ID NO: 249957 - RNA, 21 nt, Human
acagacagugaaauguguggu

SEQ ID NO: 249958 - RNA, 21 nt, Human
acagcaagcccaugccucuaa

SEQ ID NO: 249959 - RNA, 20 nt, Human
acagcagggagggaagcuuu

SEQ ID NO: 249960 - RNA, 25 nt, Human
accacagcuauggaccagacagaca

SEQ ID NO: 249961 - RNA, 21 nt, Human
accaggaagaacagcuuugcc

SEQ ID NO: 249962 - RNA, 18 nt, Human
acccaaacagaaaaaccc

SEQ ID NO: 249963 - RNA, 20 nt, Human
accccaaggcaggggcagca

SEQ ID NO: 249964 - RNA, 19 nt, Human
accuggugcagcucacagg

SEQ ID NO: 249965 - RNA, 22 nt, Human
accuuccauaccacucccaaaa

SEQ ID NO: 249966 - RNA, 21 nt, Human
acgaaacucuaaguuuacuga

SEQ ID NO: 249967 - RNA, 19 nt, Human
acgaaucugcuuggacaga

SEQ ID NO: 249968 - RNA, 23 nt, Human
acgucccuugagaauggaccaug

SEQ ID NO: 249969 - RNA, 24 nt, Human
acuaaaaagcaaaacaaaagccca

SEQ ID NO: 249970 - RNA, 25 nt, Human
acucacccucucuucugaccccccu

SEQ ID NO: 249971 - RNA, 19 nt, Human
acuccuucaugauuacacc

SEQ ID NO: 249972 - RNA, 20 nt, Human
acugaaauacacaagacaac

SEQ ID NO: 249973 - RNA, 23 nt, Human
acugcuaacacugaacacacgcc

SEQ ID NO: 249974 - RNA, 22 nt, Human
acugcucugagugauuaggaau

SEQ ID NO: 249975 - RNA, 23 nt, Human
acugcuuuggguggcuucuggcu

SEQ ID NO: 249976 - RNA, 19 nt, Human
agaaaaacauccccaaugc

SEQ ID NO: 249977 - RNA, 22 nt, Human
agaaagacaaguaaagggcaaa

SEQ ID NO: 249978 - RNA, 19 nt, Human
agaaagggggaaauagaga

SEQ ID NO: 249979 - RNA, 21 nt, Human
agaagaaagggacauuucugg

SEQ ID NO: 249980 - RNA, 22 nt, Human
agaagugaagcuggggggguca

SEQ ID NO: 249981 - RNA, 24 nt, Human
agacaacacacacuugacaguuca

SEQ ID NO: 249982 - RNA, 19 nt, Human
agacaccaaaauggagaga

SEQ ID NO: 249983 - RNA, 18 nt, Human
agacacccugccuagcuc

SEQ ID NO: 249984 - RNA, 22 nt, Human
agacagacagugaaaugugugg

SEQ ID NO: 249985 - RNA, 18 nt, Human
agacaggugccacuuucc

SEQ ID NO: 249986 - RNA, 25 nt, Human
agacagguucagaagccauguccuc

SEQ ID NO: 249987 - RNA, 19 nt, Human
agagaaaccaaucaggaag

SEQ ID NO: 249988 - RNA, 26 nt, Human
agagaaucaacaaaucccgucagagc

SEQ ID NO: 249989 - RNA, 18 nt, Human
agagcagagagaagagua

SEQ ID NO: 249990 - RNA, 19 nt, Human
agaggaagggcuggggacc

SEQ ID NO: 249991 - RNA, 21 nt, Human
agagugggaaggaggguggug

SEQ ID NO: 249992 - RNA, 23 nt, Human
agaugaucaaaaagaacuguuac

SEQ ID NO: 249993 - RNA, 24 nt, Human
agcaaaacauugccauucaagaag

SEQ ID NO: 249994 - RNA, 20 nt, Human
agcaggucaagggagcgcuc

SEQ ID NO: 249995 - RNA, 20 nt, Human
agcagguggaagggaucagg

SEQ ID NO: 249996 - RNA, 22 nt, Human
agccagcucccuucugcacagg

SEQ ID NO: 249997 - RNA, 22 nt, Human
agcccggagcgggagcuggggg

SEQ ID NO: 249998 - RNA, 22 nt, Human
agccucaggccccacuggcagc

SEQ ID NO: 249999 - RNA, 19 nt, Human
agcuaaacucucuagcaga

SEQ ID NO: 250000 - RNA, 21 nt, Human
agcuaagugugucccggccuc

SEQ ID NO: 250001 - RNA, 20 nt, Human
agcugcagggccccugccug

SEQ ID NO: 250002 - RNA, 24 nt, Human
agcugccuuuauucuuguugguuu

SEQ ID NO: 250003 - RNA, 20 nt, Human
aggaaauggacacauauaug

SEQ ID NO: 250004 - RNA, 21 nt, Human
aggaaggaggaggacggagga

SEQ ID NO: 250005 - RNA, 23 nt, Human
aggacaaagggcaggcagaguuc

SEQ ID NO: 250006 - RNA, 23 nt, Human
aggacacagguccuagaaucugc

SEQ ID NO: 250007 - RNA, 21 nt, Human
aggcagaaauggaaggggaga

SEQ ID NO: 250008 - RNA, 26 nt, Human
aggcagaagugccuuccuaguucccu

SEQ ID NO: 250009 - RNA, 22 nt, Human
aggcagggggccuuggggaggc

SEQ ID NO: 250010 - RNA, 18 nt, Human
aggcagugagaggccagc

SEQ ID NO: 250011 - RNA, 19 nt, Human
aggccauagccacugguca

SEQ ID NO: 250012 - RNA, 22 nt, Human
aggccucccgucuccgcuccag

SEQ ID NO: 250013 - RNA, 18 nt, Human
aggcugccccagcccugg

SEQ ID NO: 250014 - RNA, 19 nt, Human
agggaggggcugucaggug

SEQ ID NO: 250015 - RNA, 20 nt, Human
agggauugggcugaugggag

SEQ ID NO: 250016 - RNA, 20 nt, Human
aggggcuaucagugggcagg

SEQ ID NO: 250017 - RNA, 22 nt, Human
agguguuuugggagcccaaaac

SEQ ID NO: 250018 - RNA, 23 nt, Human
agucagaagugaagcuggggggg

SEQ ID NO: 250019 - RNA, 23 nt, Human
aguuuagaaaagugcaaagcuac

SEQ ID NO: 250020 - RNA, 18 nt, Human
auaaaaacccaacugacc

SEQ ID NO: 250021 - RNA, 18 nt, Human
aucuguucagcucucccc

SEQ ID NO: 250022 - RNA, 24 nt, Human
augccuaaugaggguaauggcuuu

SEQ ID NO: 250023 - RNA, 21 nt, Human
auggaccaugccaccucaccc

SEQ ID NO: 250024 - RNA, 24 nt, Human
auggccucuagcgccacccguugg

SEQ ID NO: 250025 - RNA, 21 nt, Human
augggugacaggggggccugg

SEQ ID NO: 250026 - RNA, 19 nt, Human
auuaagaauuacaaaagca

SEQ ID NO: 250027 - RNA, 18 nt, Human
auucugucagcuaaagaa

SEQ ID NO: 250028 - RNA, 19 nt, Human
auugucccaaaacacaaaa

SEQ ID NO: 250029 - RNA, 21 nt, Human
caaaacaagaauccacugggc

SEQ ID NO: 250030 - RNA, 23 nt, Human
caaaacaagaauccacugggcgg

SEQ ID NO: 250031 - RNA, 26 nt, Human
caaaacacaaaaacugaaggugaaua

SEQ ID NO: 250032 - RNA, 23 nt, Human
caaaauugaaauugaggucacac

SEQ ID NO: 250033 - RNA, 21 nt, Human
caaacccaaacagaaaaaccc

SEQ ID NO: 250034 - RNA, 22 nt, Human
caaacccaaacagaaaaacccc

SEQ ID NO: 250035 - RNA, 23 nt, Human
caaacccaaacagaaaaacccca

SEQ ID NO: 250036 - RNA, 24 nt, Human
caaacccaaacagaaaaaccccag

SEQ ID NO: 250037 - RNA, 19 nt, Human
caaagcaggaacuggugag

SEQ ID NO: 250038 - RNA, 19 nt, Human
caaagggcaggcagaguuc

SEQ ID NO: 250039 - RNA, 20 nt, Human
caacagaagggagcugugcu

SEQ ID NO: 250040 - RNA, 18 nt, Human
caaccugaccccaaggca

SEQ ID NO: 250041 - RNA, 24 nt, Human
caacuaugagacucuacaaacaga

SEQ ID NO: 250042 - RNA, 24 nt, Human
caacucaggagggggcagacaccc

SEQ ID NO: 250043 - RNA, 18 nt, Human
caacuggaacaagggugg

SEQ ID NO: 250044 - RNA, 28 nt, Human
caacuggaacaagggugggggagacugu

SEQ ID NO: 250045 - RNA, 21 nt, Human
caagaagaacuccgagggaaa

SEQ ID NO: 250046 - RNA, 23 nt, Human
caagaccggcaaucccacuggcu

SEQ ID NO: 250047 - RNA, 25 nt, Human
caaggaaacaucaaucuugccuuuc

SEQ ID NO: 250048 - RNA, 29 nt, Human
caauaacugaaauacacaagacaacacac

SEQ ID NO: 250049 - RNA, 22 nt, Human
cacaccccaaaacugggccgga

SEQ ID NO: 250050 - RNA, 19 nt, Human
cacaggccauagccacugg

SEQ ID NO: 250051 - RNA, 19 nt, Human
cacaguuaagaggaccagu

SEQ ID NO: 250052 - RNA, 30 nt, Human
caccaaaauggagagaaucaacaaaucccc

SEQ ID NO: 250053 - RNA, 20 nt, Human
caccaggaagaacagcuuug

SEQ ID NO: 250054 - RNA, 18 nt, Human
caccauaguaaggaagcc

SEQ ID NO: 250055 - RNA, 23 nt, Human
cacccaacuuggcaguuuguguc

SEQ ID NO: 250056 - RNA, 23 nt, Human
cacccaccuguucacggccaaac

SEQ ID NO: 250057 - RNA, 25 nt, Human
caccccaguggacuccagcucccag

SEQ ID NO: 250058 - RNA, 23 nt, Human
caccugcuuccuucugccuccug

SEQ ID NO: 250059 - RNA, 20 nt, Human
caccuggcacaggaaagccc

SEQ ID NO: 250060 - RNA, 24 nt, Human
cacgacugccccaucggcccugaa

SEQ ID NO: 250061 - RNA, 18 nt, Human
cacggggcacaccuugga

SEQ ID NO: 250062 - RNA, 20 nt, Human
cacuccacuguccagcuccc

SEQ ID NO: 250063 - RNA, 18 nt, Human
cacugaaccgggugggcc

SEQ ID NO: 250064 - RNA, 19 nt, Human
cacugaaccgggugggccc

SEQ ID NO: 250065 - RNA, 22 nt, Human
cacugagcugucaagaccggca

SEQ ID NO: 250066 - RNA, 20 nt, Human
cacuuuaaaacaagcgcagg

SEQ ID NO: 250067 - RNA, 20 nt, Human
cagaaaacacgcacguggac

SEQ ID NO: 250068 - RNA, 21 nt, Human
cagaaagacaaguaaagggca

SEQ ID NO: 250069 - RNA, 20 nt, Human
cagaagugaagcuggggggg

SEQ ID NO: 250070 - RNA, 20 nt, Human
cagacagugaaauguguggu

SEQ ID NO: 250071 - RNA, 26 nt, Human
cagagcccaaggccuccucagggcuc

SEQ ID NO: 250072 - RNA, 18 nt, Human
cagcaaugaaaagcuggg

SEQ ID NO: 250073 - RNA, 20 nt, Human
cagcacacguuacagugucc

SEQ ID NO: 250074 - RNA, 22 nt, Human
cagcaggaggacaaagggcagg

SEQ ID NO: 250075 - RNA, 24 nt, Human
cagcaggcagggccgggaggggua

SEQ ID NO: 250076 - RNA, 25 nt, Human
cagccugccugcaccuuguccuacu

SEQ ID NO: 250077 - RNA, 22 nt, Human
cagcucacagguuccgagacag

SEQ ID NO: 250078 - RNA, 20 nt, Human
cagcuccccagaaacacuga

SEQ ID NO: 250079 - RNA, 25 nt, Human
cagcuccccagaaacacugaaccgg

SEQ ID NO: 250080 - RNA, 19 nt, Human
caggagccuucuguccuug

SEQ ID NO: 250081 - RNA, 23 nt, Human
caggcaucucaggccaagugcua

SEQ ID NO: 250082 - RNA, 18 nt, Human
cagggcaggcagggggcc

SEQ ID NO: 250083 - RNA, 23 nt, Human
cagggcucugcccccccaccggg

SEQ ID NO: 250084 - RNA, 24 nt, Human
caguagagagaaccucauguuugg

SEQ ID NO: 250085 - RNA, 18 nt, Human
cagugggcaggagccaaa

SEQ ID NO: 250086 - RNA, 21 nt, Human
cauaccacucccaaaagacag

SEQ ID NO: 250087 - RNA, 27 nt, Human
caucagcagagcagguggaagggauca

SEQ ID NO: 250088 - RNA, 22 nt, Human
caugucacaucaaagcaggaac

SEQ ID NO: 250089 - RNA, 24 nt, Human
cauuuggggcaaugacacaggcua

SEQ ID NO: 250090 - RNA, 22 nt, Human
ccaaaacacaaaaacugaaggu

SEQ ID NO: 250091 - RNA, 24 nt, Human
ccaaaaccaugccuaaugagggua

SEQ ID NO: 250092 - RNA, 24 nt, Human
ccaaaacugggccggacacagcug

SEQ ID NO: 250093 - RNA, 20 nt, Human
ccaaaagacagguucagaag

SEQ ID NO: 250094 - RNA, 22 nt, Human
ccaaaauggagagaaucaacaa

SEQ ID NO: 250095 - RNA, 25 nt, Human
ccaaacagaaaaaccccagaaagac

SEQ ID NO: 250096 - RNA, 24 nt, Human
ccaaaccaaacccaaacagaaaaa

SEQ ID NO: 250097 - RNA, 23 nt, Human
ccaacauuagccugaccugugcc

SEQ ID NO: 250098 - RNA, 23 nt, Human
ccaaccuccugucaaccugaccc

SEQ ID NO: 250099 - RNA, 18 nt, Human
ccaagagagugcaagccc

SEQ ID NO: 250100 - RNA, 21 nt, Human
ccacagcaagcccaugccucu

SEQ ID NO: 250101 - RNA, 22 nt, Human
ccacagcaagcccaugccucua

SEQ ID NO: 250102 - RNA, 19 nt, Human
ccaccaccuggccugucca

SEQ ID NO: 250103 - RNA, 24 nt, Human
ccaccuuccauaccacucccaaaa

SEQ ID NO: 250104 - RNA, 21 nt, Human
ccacuggcagcucuggaauaa

SEQ ID NO: 250105 - RNA, 22 nt, Human
ccacuggcuaugacaagcccac

SEQ ID NO: 250106 - RNA, 26 nt, Human
ccacugggcggaacaaaaccugguuu

SEQ ID NO: 250107 - RNA, 22 nt, Human
ccagaaagacaaguaaagggca

SEQ ID NO: 250108 - RNA, 18 nt, Human
ccagaagagacaaacacg

SEQ ID NO: 250109 - RNA, 21 nt, Human
ccagggcgauaaaccgccaag

SEQ ID NO: 250110 - RNA, 22 nt, Human
ccagucagcccagagagccuga

SEQ ID NO: 250111 - RNA, 23 nt, Human
ccauagcucucggccucugggcu

SEQ ID NO: 250112 - RNA, 22 nt, Human
ccaucacugucacagcaaugaa

SEQ ID NO: 250113 - RNA, 23 nt, Human
ccaugccucuaagccccuacacc

SEQ ID NO: 250114 - RNA, 20 nt, Human
cccaaccucagacagguuuc

SEQ ID NO: 250115 - RNA, 19 nt, Human
cccacagcaagcccaugcc

SEQ ID NO: 250116 - RNA, 23 nt, Human
cccacagcaagcccaugccucua

SEQ ID NO: 250117 - RNA, 25 nt, Human
cccacagcaagcccaugccucuaag

SEQ ID NO: 250118 - RNA, 26 nt, Human
cccacugcuaacacugaaagguuuuc

SEQ ID NO: 250119 - RNA, 22 nt, Human
cccacuggcagcucuggaauaa

SEQ ID NO: 250120 - RNA, 20 nt, Human
cccagaggcugccccagccc

SEQ ID NO: 250121 - RNA, 21 nt, Human
cccagccccauucuccccagc

SEQ ID NO: 250122 - RNA, 27 nt, Human
cccagcccugguccuccgaagggccgg

SEQ ID NO: 250123 - RNA, 18 nt, Human
cccaggccagccugccug

SEQ ID NO: 250124 - RNA, 22 nt, Human
cccaggccagccugccugcacc

SEQ ID NO: 250125 - RNA, 20 nt, Human
cccaggcucgacagaguggg

SEQ ID NO: 250126 - RNA, 21 nt, Human
ccccccaccgggcagguccuc

SEQ ID NO: 250127 - RNA, 26 nt, Human
ccccgcuccauccgggcagggcuaga

SEQ ID NO: 250128 - RNA, 20 nt, Human
ccccgcugugcucugcccgg

SEQ ID NO: 250129 - RNA, 21 nt, Human
ccccucucaucucagucacca

SEQ ID NO: 250130 - RNA, 22 nt, Human
cccggccugaccccaggccagc

SEQ ID NO: 250131 - RNA, 22 nt, Human
cccuacaccacagcuauggacc

SEQ ID NO: 250132 - RNA, 21 nt, Human
cccucuuucgccaucacuguc

SEQ ID NO: 250133 - RNA, 21 nt, Human
cccugguccuccgaagggcuc

SEQ ID NO: 250134 - RNA, 21 nt, Human
cccugugccccaagugcaccu

SEQ ID NO: 250135 - RNA, 23 nt, Human
ccggcaugcaauggucacuacag

SEQ ID NO: 250136 - RNA, 24 nt, Human
ccuacaccacagcuauggaccaga

SEQ ID NO: 250137 - RNA, 18 nt, Human
ccuaguucccuggguguu

SEQ ID NO: 250138 - RNA, 21 nt, Human
ccuaugcuaugguuaucagaa

SEQ ID NO: 250139 - RNA, 21 nt, Human
ccucacaccucccugucccaa

SEQ ID NO: 250140 - RNA, 22 nt, Human
ccucacccugggccauccucuc

SEQ ID NO: 250141 - RNA, 23 nt, Human
ccucacccugggccauccucucc

SEQ ID NO: 250142 - RNA, 22 nt, Human
ccucaggccccacuggcagcuc

SEQ ID NO: 250143 - RNA, 19 nt, Human
ccucagggcucaaaacagg

SEQ ID NO: 250144 - RNA, 19 nt, Human
ccuccagauuccccuugcc

SEQ ID NO: 250145 - RNA, 28 nt, Human
ccucccgucuccgcuccagcccccaggc

SEQ ID NO: 250146 - RNA, 19 nt, Human
ccuccucgccuccucugcc

SEQ ID NO: 250147 - RNA, 18 nt, Human
ccucgccuccuccuccuc

SEQ ID NO: 250148 - RNA, 20 nt, Human
ccucgccuccuccuccuccu

SEQ ID NO: 250149 - RNA, 20 nt, Human
ccucuaagccccuacaccac

SEQ ID NO: 250150 - RNA, 19 nt, Human
ccucugccccuaucccagg

SEQ ID NO: 250151 - RNA, 18 nt, Human
ccucugggcuggcacagg

SEQ ID NO: 250152 - RNA, 19 nt, Human
ccucuuucacaagcacggg

SEQ ID NO: 250153 - RNA, 22 nt, Human
ccugaccccaaggcaggggcag

SEQ ID NO: 250154 - RNA, 23 nt, Human
ccugaccccaaggcaggggcagc

SEQ ID NO: 250155 - RNA, 18 nt, Human
ccugaccccaggccagcc

SEQ ID NO: 250156 - RNA, 23 nt, Human
ccugaccccaggccagccugccu

SEQ ID NO: 250157 - RNA, 22 nt, Human
ccugcacccagaaccuugggac

SEQ ID NO: 250158 - RNA, 23 nt, Human
ccugcaccuuguccuacugccuc

SEQ ID NO: 250159 - RNA, 18 nt, Human
ccuggcacaggaaagccc

SEQ ID NO: 250160 - RNA, 21 nt, Human
ccuggcacaggaaagcccuug

SEQ ID NO: 250161 - RNA, 22 nt, Human
ccugucccaacgugguugggag

SEQ ID NO: 250162 - RNA, 20 nt, Human
ccugucccaggugcacuguu

SEQ ID NO: 250163 - RNA, 20 nt, Human
ccuguccugugaagcguccu

SEQ ID NO: 250164 - RNA, 22 nt, Human
ccugucugcaucgagcaaaagc

SEQ ID NO: 250165 - RNA, 26 nt, Human
ccugucugcaucgagcaaaagcaaaa

SEQ ID NO: 250166 - RNA, 22 nt, Human
ccuugcugcucucuugcucuuc

SEQ ID NO: 250167 - RNA, 18 nt, Human
ccuuugguagugccagga

SEQ ID NO: 250168 - RNA, 25 nt, Human
ccuuuucuaaagauugauacaauau

SEQ ID NO: 250169 - RNA, 23 nt, Human
cgaaaacgggaguguccucucaa

SEQ ID NO: 250170 - RNA, 20 nt, Human
cgagcagagcaggagugggc

SEQ ID NO: 250171 - RNA, 19 nt, Human
cgcccaggugacggggaag

SEQ ID NO: 250172 - RNA, 29 nt, Human
cgcggcggcggcggcggcggccauuuucc

SEQ ID NO: 250173 - RNA, 30 nt, Human
cgcucggcgcggcggcggcggcggcgacga

SEQ ID NO: 250174 - RNA, 18 nt, Human
cggccaaacaucagcggc

SEQ ID NO: 250175 - RNA, 20 nt, Human
cggccaaacaucagcggcaa

SEQ ID NO: 250176 - RNA, 22 nt, Human
cggccucugggcuggcacaggg

SEQ ID NO: 250177 - RNA, 20 nt, Human
cgggagcccagcaugggcaa

SEQ ID NO: 250178 - RNA, 22 nt, Human
cuaaaaagcaaaacaaaagccc

SEQ ID NO: 250179 - RNA, 22 nt, Human
cuaaaagcaaaacuaaaaagca

SEQ ID NO: 250180 - RNA, 25 nt, Human
cuaaaagcaaaacuaaaaagcaaaa

SEQ ID NO: 250181 - RNA, 23 nt, Human
cuaaagauugauacaauaucuaa

SEQ ID NO: 250182 - RNA, 21 nt, Human
cuacuccuggaggggaccccu

SEQ ID NO: 250183 - RNA, 22 nt, Human
cuagcgccuggcugugaccaag

SEQ ID NO: 250184 - RNA, 24 nt, Human
cuaugugcugagcccacuuuaaaa

SEQ ID NO: 250185 - RNA, 19 nt, Human
cucacccucucuucugacc

SEQ ID NO: 250186 - RNA, 21 nt, Human
cucacggguagcccggccacu

SEQ ID NO: 250187 - RNA, 19 nt, Human
cuccaaccuccugucaacc

SEQ ID NO: 250188 - RNA, 22 nt, Human
cuccuagccaugccagagcuuu

SEQ ID NO: 250189 - RNA, 19 nt, Human
cuccugggcuccacugcuu

SEQ ID NO: 250190 - RNA, 25 nt, Human
cucggccucugggcuggcacagggg

SEQ ID NO: 250191 - RNA, 21 nt, Human
cucggcgcggcggcggcggcg

SEQ ID NO: 250192 - RNA, 18 nt, Human
cucuccccucucaucuca

SEQ ID NO: 250193 - RNA, 23 nt, Human
cugaacacuacaaaaaagcaauc

SEQ ID NO: 250194 - RNA, 23 nt, Human
cugaccccccuucccuuccuggg

SEQ ID NO: 250195 - RNA, 22 nt, Human
cugcacccagaaccuugggacc

SEQ ID NO: 250196 - RNA, 21 nt, Human
cugcagcaagccuuguugaag

SEQ ID NO: 250197 - RNA, 26 nt, Human
cugccaacauuagccugaccugugcc

SEQ ID NO: 250198 - RNA, 20 nt, Human
cugcgaggcugacuccacau

SEQ ID NO: 250199 - RNA, 21 nt, Human
cugcuuuggguggcuucuggc

SEQ ID NO: 250200 - RNA, 23 nt, Human
cuggcacaggggagcaugacuuc

SEQ ID NO: 250201 - RNA, 18 nt, Human
cugggcaacugccucuuu

SEQ ID NO: 250202 - RNA, 22 nt, Human
cuggggccguuggcuaguuugg

SEQ ID NO: 250203 - RNA, 22 nt, Human
cugggugcugccuggagccucc

SEQ ID NO: 250204 - RNA, 23 nt, Human
cuggucccagcucgggucuuggg

SEQ ID NO: 250205 - RNA, 21 nt, Human
cuggugauuauaaugcucucu

SEQ ID NO: 250206 - RNA, 22 nt, Human
cugucaagaugagaagaguggg

SEQ ID NO: 250207 - RNA, 26 nt, Human
cugucaagaugagaagagugggaagg

SEQ ID NO: 250208 - RNA, 20 nt, Human
cuucaaccugacugugcuug

SEQ ID NO: 250209 - RNA, 18 nt, Human
cuucacagacaggccagg

SEQ ID NO: 250210 - RNA, 19 nt, Human
cuucugaccccccuucccu

SEQ ID NO: 250211 - RNA, 22 nt, Human
cuugcuggcuuggagugggacu

SEQ ID NO: 250212 - RNA, 22 nt, Human
cuuggccuuuucaccucaucug

SEQ ID NO: 250213 - RNA, 24 nt, Human
cuuucacccaccaaaaauuacaca

SEQ ID NO: 250214 - RNA, 22 nt, Human
cuuuugcacuccacuguccagc

SEQ ID NO: 250215 - RNA, 21 nt, Human
gaaaaacauccccaaugcucc

SEQ ID NO: 250216 - RNA, 18 nt, Human
gaaaguaacuggaagaac

SEQ ID NO: 250217 - RNA, 24 nt, Human
gaaaugugugguguucuggccccc

SEQ ID NO: 250218 - RNA, 23 nt, Human
gaacaaaaggcagaaauggaagg

SEQ ID NO: 250219 - RNA, 23 nt, Human
gaagaaagggacauuucuggagu

SEQ ID NO: 250220 - RNA, 21 nt, Human
gaagaacagcuuugccacuug

SEQ ID NO: 250221 - RNA, 20 nt, Human
gaaggggacugggggaguca

SEQ ID NO: 250222 - RNA, 18 nt, Human
gaagugccuuccuaguuc

SEQ ID NO: 250223 - RNA, 24 nt, Human
gacagcagggagggaagcuuuugg

SEQ ID NO: 250224 - RNA, 23 nt, Human
gacucacccucucuucugacccc

SEQ ID NO: 250225 - RNA, 25 nt, Human
gagaaauaaaaaccaaaccaaaccc

SEQ ID NO: 250226 - RNA, 23 nt, Human
gagaagcaggugacaauuugggg

SEQ ID NO: 250227 - RNA, 23 nt, Human
gagaggggcuaucagugggcagg

SEQ ID NO: 250228 - RNA, 22 nt, Human
gagcagacaggugccacuuucc

SEQ ID NO: 250229 - RNA, 20 nt, Human
gagcagagcaggagugggca

SEQ ID NO: 250230 - RNA, 19 nt, Human
gagcagaggaagggcuggg

SEQ ID NO: 250231 - RNA, 20 nt, Human
gagcagggcucugccccccc

SEQ ID NO: 250232 - RNA, 24 nt, Human
gagccuccuucaccuggcacagga

SEQ ID NO: 250233 - RNA, 18 nt, Human
gagcugucaagaccggca

SEQ ID NO: 250234 - RNA, 22 nt, Human
gaggugccuggucaacagcuug

SEQ ID NO: 250235 - RNA, 19 nt, Human
gagugggacuccugggcuc

SEQ ID NO: 250236 - RNA, 19 nt, Human
gcacaagucggagcccgga

SEQ ID NO: 250237 - RNA, 21 nt, Human
gcagugagaggccagcucaga

SEQ ID NO: 250238 - RNA, 22 nt, Human
gcauggagccccuguugggcca

SEQ ID NO: 250239 - RNA, 22 nt, Human
gccaaacaucagcggcaacggc

SEQ ID NO: 250240 - RNA, 22 nt, Human
gccaguuuuggauuggggcugg

SEQ ID NO: 250241 - RNA, 21 nt, Human
gcccacagcagagcgucccag

SEQ ID NO: 250242 - RNA, 20 nt, Human
gccguuggcuaguuuggcac

SEQ ID NO: 250243 - RNA, 22 nt, Human
gccucaggccccacuggcagcc

SEQ ID NO: 250244 - RNA, 19 nt, Human
gcggcggcggcggcggcca

SEQ ID NO: 250245 - RNA, 19 nt, Human
gcgggaggggaggugccug

SEQ ID NO: 250246 - RNA, 21 nt, Human
gcuaccuaggagagcaagacc

SEQ ID NO: 250247 - RNA, 23 nt, Human
gcucaccaggcaucucaggccaa

SEQ ID NO: 250248 - RNA, 23 nt, Human
gcucuggacaaugauuccagaag

SEQ ID NO: 250249 - RNA, 26 nt, Human
gcuggcacaggggagcaugacuucaa

SEQ ID NO: 250250 - RNA, 18 nt, Human
gcuuggagugggacuccu

SEQ ID NO: 250251 - RNA, 23 nt, Human
gcuuucccuccaaccuccuguca

SEQ ID NO: 250252 - RNA, 21 nt, Human
ggaacaaaaccugguuuugca

SEQ ID NO: 250253 - RNA, 22 nt, Human
ggaagcaaaacaagaauccacu

SEQ ID NO: 250254 - RNA, 18 nt, Human
ggaauaaacuggaaggga

SEQ ID NO: 250255 - RNA, 22 nt, Human
ggacagaauggggguuuggggg

SEQ ID NO: 250256 - RNA, 21 nt, Human
ggacuccugggcuccacugcu

SEQ ID NO: 250257 - RNA, 19 nt, Human
ggacugggggagucaggcc

SEQ ID NO: 250258 - RNA, 26 nt, Human
ggagaaacaagagugcaaaaccuggg

SEQ ID NO: 250259 - RNA, 21 nt, Human
ggagaagagacaacagcugcc

SEQ ID NO: 250260 - RNA, 21 nt, Human
ggagcuggucuacagaagcaa

SEQ ID NO: 250261 - RNA, 27 nt, Human
ggaggacaaagggcaggcagaguucug

SEQ ID NO: 250262 - RNA, 26 nt, Human
ggaggguggggaauagagaugucaca

SEQ ID NO: 250263 - RNA, 21 nt, Human
ggaucagggauugggcugaug

SEQ ID NO: 250264 - RNA, 22 nt, Human
ggcaacggccuccucgccuccu

SEQ ID NO: 250265 - RNA, 20 nt, Human
ggcagagaagcaggugacaa

SEQ ID NO: 250266 - RNA, 21 nt, Human
ggcaggagccaaaccucuugg

SEQ ID NO: 250267 - RNA, 19 nt, Human
ggcccagcuccuccagucc

SEQ ID NO: 250268 - RNA, 18 nt, Human
ggccuuggggaggcagug

SEQ ID NO: 250269 - RNA, 22 nt, Human
ggcgcggcggcggcggcggcgg

SEQ ID NO: 250270 - RNA, 19 nt, Human
gggaaggaggguggugcug

SEQ ID NO: 250271 - RNA, 19 nt, Human
gggaaggaggguggugcug

SEQ ID NO: 250272 - RNA, 22 nt, Human
gggaaggaggguggugcugggc

SEQ ID NO: 250273 - RNA, 19 nt, Human
gggaaugaggaagaaaggg

SEQ ID NO: 250274 - RNA, 21 nt, Human
gggagaaacaagagugcaaaa

SEQ ID NO: 250275 - RNA, 19 nt, Human
gggagcagaggaagggcug

SEQ ID NO: 250276 - RNA, 18 nt, Human
gggaggggcugucaggug

SEQ ID NO: 250277 - RNA, 25 nt, Human
gggagguggggggagcugggggagc

SEQ ID NO: 250278 - RNA, 18 nt, Human
gggagugggggagguggg

SEQ ID NO: 250279 - RNA, 24 nt, Human
gggagugggggagguggggggagc

SEQ ID NO: 250280 - RNA, 27 nt, Human
gggcaggagccaaaccucuuggccuuu

SEQ ID NO: 250281 - RNA, 19 nt, Human
gggcagggcuagaggucac

SEQ ID NO: 250282 - RNA, 23 nt, Human
gggcagggcuagaggucaccggg

SEQ ID NO: 250283 - RNA, 20 nt, Human
gggccuuggggaggcaguga

SEQ ID NO: 250284 - RNA, 20 nt, Human
gggcucugcccccccaccgg

SEQ ID NO: 250285 - RNA, 22 nt, Human
ggggagcagaggaagggcuggg

SEQ ID NO: 250286 - RNA, 19 nt, Human
ggggagguggggggagcug

SEQ ID NO: 250287 - RNA, 23 nt, Human
ggggcugucagguguuuugggag

SEQ ID NO: 250288 - RNA, 23 nt, Human
ggggggaggggaagcaaaacaag

SEQ ID NO: 250289 - RNA, 19 nt, Human
gggucccuggcguucuacc

SEQ ID NO: 250290 - RNA, 18 nt, Human
guaggauuuccuccaggg

SEQ ID NO: 250291 - RNA, 18 nt, Human
gucaccaucccccucccu

SEQ ID NO: 250292 - RNA, 23 nt, Human
gucaccaucccccucccuccgaa

SEQ ID NO: 250293 - RNA, 19 nt, Human
gucugguuauuacccucuu

SEQ ID NO: 250294 - RNA, 18 nt, Human
gugacaggggggccuggu

SEQ ID NO: 250295 - RNA, 18 nt, Human
gugcugggccuuccaggu

SEQ ID NO: 250296 - RNA, 21 nt, Human
gugcugggccuuccaggucaa

SEQ ID NO: 250297 - RNA, 21 nt, Human
gugggcccagaggcugcccca

SEQ ID NO: 250298 - RNA, 18 nt, Human
gugugguguucuggcccc

SEQ ID NO: 250299 - RNA, 20 nt, Human
guucccaaccacgacugccc

SEQ ID NO: 250300 - RNA, 22 nt, Human
guuuugcagugacuuggaaagu

SEQ ID NO: 250301 - RNA, 18 nt, Human
uaaaaaccaaaccaaacc

SEQ ID NO: 250302 - RNA, 19 nt, Human
uaaaaacccacagcaagcc

SEQ ID NO: 250303 - RNA, 22 nt, Human
uaaaaagaugggaucccacaug

SEQ ID NO: 250304 - RNA, 19 nt, Human
uaaaaagcaaaacaaaagc

SEQ ID NO: 250305 - RNA, 22 nt, Human
uaaaaagcaaaacaaaagccca

SEQ ID NO: 250306 - RNA, 22 nt, Human
uaaaacgaccuacuuauuuucu

SEQ ID NO: 250307 - RNA, 20 nt, Human
uaaaguaauugucccaaaac

SEQ ID NO: 250308 - RNA, 24 nt, Human
uaacugaaauacacaagacaacac

SEQ ID NO: 250309 - RNA, 21 nt, Human
uaagaaaaacauccccaaugc

SEQ ID NO: 250310 - RNA, 18 nt, Human
uaagccccuacaccacag

SEQ ID NO: 250311 - RNA, 23 nt, Human
uaaggaaauggacacauauaugc

SEQ ID NO: 250312 - RNA, 21 nt, Human
uaagucacagacugcucugag

SEQ ID NO: 250313 - RNA, 25 nt, Human
uaagugauuuaaaauucagagauuc

SEQ ID NO: 250314 - RNA, 21 nt, Human
uaauuuuagacccugggggag

SEQ ID NO: 250315 - RNA, 27 nt, Human
uacauaaaaacccaacugaccaaaaua

SEQ ID NO: 250316 - RNA, 18 nt, Human
uacuuagcaaaauuccuu

SEQ ID NO: 250317 - RNA, 22 nt, Human
uagcucuuccagaugcugcacc

SEQ ID NO: 250318 - RNA, 22 nt, Human
uaggaaggaggaggacggagga

SEQ ID NO: 250319 - RNA, 23 nt, Human
uauaacaaguagacuaugccuuu

SEQ ID NO: 250320 - RNA, 18 nt, Human
uauacagauauauauaua

SEQ ID NO: 250321 - RNA, 23 nt, Human
uauauaaaaauucaacugcuuug

SEQ ID NO: 250322 - RNA, 18 nt, Human
uaucccucugcucccucc

SEQ ID NO: 250323 - RNA, 21 nt, Human
uaucuaaaagagaaagacacc

SEQ ID NO: 250324 - RNA, 18 nt, Human
uaugcgcacagucuaugu

SEQ ID NO: 250325 - RNA, 24 nt, Human
ucaagaccggcaaucccacuggcu

SEQ ID NO: 250326 - RNA, 23 nt, Human
ucagaagaagcaaugacagcagg

SEQ ID NO: 250327 - RNA, 21 nt, Human
ucagcucuccccucucaucuc

SEQ ID NO: 250328 - RNA, 20 nt, Human
ucaggagggggcagacaccc

SEQ ID NO: 250329 - RNA, 19 nt, Human
uccagcccccaggcucgac

SEQ ID NO: 250330 - RNA, 21 nt, Human
uccaugguaggaacucuagaa

SEQ ID NO: 250331 - RNA, 27 nt, Human
ucccaaccucagacagguuuccaggcu

SEQ ID NO: 250332 - RNA, 18 nt, Human
ucccacaugaaaacugau

SEQ ID NO: 250333 - RNA, 21 nt, Human
ucccagagguggaaggcgacc

SEQ ID NO: 250334 - RNA, 21 nt, Human
uccccuccuggcuccccucaa

SEQ ID NO: 250335 - RNA, 21 nt, Human
ucccucacuucuaaccauucc

SEQ ID NO: 250336 - RNA, 22 nt, Human
uccgcucggcgcggcggcggcg

SEQ ID NO: 250337 - RNA, 23 nt, Human
uccucagggcucaaaacaggguu

SEQ ID NO: 250338 - RNA, 18 nt, Human
uccuccucgccuccuccu

SEQ ID NO: 250339 - RNA, 21 nt, Human
uccugacagggcaggcagggg

SEQ ID NO: 250340 - RNA, 22 nt, Human
ucgcacaggccauagccacugg

SEQ ID NO: 250341 - RNA, 24 nt, Human
ucggacccuacuggcagggaggcc

SEQ ID NO: 250342 - RNA, 20 nt, Human
ucggcuugcuggcuuggagu

SEQ ID NO: 250343 - RNA, 22 nt, Human
ucuacacccaguaguucaaggg

SEQ ID NO: 250344 - RNA, 19 nt, Human
ucucuaaagaauccaacug

SEQ ID NO: 250345 - RNA, 19 nt, Human
ucuggaagcauaagacugc

SEQ ID NO: 250346 - RNA, 18 nt, Human
ucuggagucuucacuacu

SEQ ID NO: 250347 - RNA, 23 nt, Human
ucuguaaacacagaaaaggauau

SEQ ID NO: 250348 - RNA, 20 nt, Human
ucuguccuuggaggaagagu

SEQ ID NO: 250349 - RNA, 20 nt, Human
ucuguucagcucuccccucu

SEQ ID NO: 250350 - RNA, 23 nt, Human
ucuucacuacuccuggaggggac

SEQ ID NO: 250351 - RNA, 26 nt, Human
ucuucagcucugcacacacacauccc

SEQ ID NO: 250352 - RNA, 22 nt, Human
ucuucuuaaagaacugguaccu

SEQ ID NO: 250353 - RNA, 22 nt, Human
ucuuuuggauucaggccucaga

SEQ ID NO: 250354 - RNA, 24 nt, Human
ucuuuuuuuauuuucccuuguccu

SEQ ID NO: 250355 - RNA, 23 nt, Human
ugaaacacacucggacccuacug

SEQ ID NO: 250356 - RNA, 18 nt, Human
ugaaagaagcgaggaaaa

SEQ ID NO: 250357 - RNA, 22 nt, Human
ugaaaggcgacugacucgugau

SEQ ID NO: 250358 - RNA, 19 nt, Human
ugaaaugaacaaaaggcag

SEQ ID NO: 250359 - RNA, 24 nt, Human
ugaaaugaacaaaaggcagaaaug

SEQ ID NO: 250360 - RNA, 24 nt, Human
ugaacacuacaaaaaagcaaucaa

SEQ ID NO: 250361 - RNA, 23 nt, Human
ugaagauaugcagcuagauaagg

SEQ ID NO: 250362 - RNA, 25 nt, Human
ugaagcagugacaaaucaaacggaa

SEQ ID NO: 250363 - RNA, 18 nt, Human
ugaaugaacugucauggg

SEQ ID NO: 250364 - RNA, 21 nt, Human
ugacaaaucaaacggaaagga

SEQ ID NO: 250365 - RNA, 18 nt, Human
ugaccccccuucccuucc

SEQ ID NO: 250366 - RNA, 20 nt, Human
ugagaagagugggaaggagg

SEQ ID NO: 250367 - RNA, 21 nt, Human
ugagaauggaccaugccaccu

SEQ ID NO: 250368 - RNA, 20 nt, Human
ugagagcugcagggccccug

SEQ ID NO: 250369 - RNA, 21 nt, Human
ugaggucacaccccaaaacug

SEQ ID NO: 250370 - RNA, 22 nt, Human
ugauccgaggcgagcagagcag

SEQ ID NO: 250371 - RNA, 18 nt, Human
ugcacugcccucacaccu

SEQ ID NO: 250372 - RNA, 20 nt, Human
ugccagagcuggagcagaca

SEQ ID NO: 250373 - RNA, 19 nt, Human
ugcccggccugaccccagg

SEQ ID NO: 250374 - RNA, 25 nt, Human
ugcccugcugcacuacgcuagacuc

SEQ ID NO: 250375 - RNA, 18 nt, Human
ugcccugggaaggggagg

SEQ ID NO: 250376 - RNA, 18 nt, Human
ugcccugggaaggggagg

SEQ ID NO: 250377 - RNA, 22 nt, Human
ugccuaaugaggguaauggcuu

SEQ ID NO: 250378 - RNA, 20 nt, Human
ugccucuaagccccuacacc

SEQ ID NO: 250379 - RNA, 19 nt, Human
ugccuggagccuccuucac

SEQ ID NO: 250380 - RNA, 20 nt, Human
ugccuggagccuccuucacc

SEQ ID NO: 250381 - RNA, 22 nt, Human
ugcuagaaaguccaacuaugag

SEQ ID NO: 250382 - RNA, 21 nt, Human
ugcucccuccuugcacugccc

SEQ ID NO: 250383 - RNA, 21 nt, Human
uggaaaaggagcugugguuag

SEQ ID NO: 250384 - RNA, 25 nt, Human
uggaacacaaaaggagaaauaaaaa

SEQ ID NO: 250385 - RNA, 21 nt, Human
uggaaggcgaccaggcugugc

SEQ ID NO: 250386 - RNA, 20 nt, Human
uggaagggaaagaggcuggg

SEQ ID NO: 250387 - RNA, 21 nt, Human
uggagagagaaugcccaccac

SEQ ID NO: 250388 - RNA, 21 nt, Human
uggaggaagaguucuggagga

SEQ ID NO: 250389 - RNA, 22 nt, Human
uggauauaaucagggucaccag

SEQ ID NO: 250390 - RNA, 20 nt, Human
uggauguggccuuaaugacc

SEQ ID NO: 250391 - RNA, 23 nt, Human
uggcaacacaucagcuauucggc

SEQ ID NO: 250392 - RNA, 26 nt, Human
uggcaaggaagugcuagacaguuucu

SEQ ID NO: 250393 - RNA, 22 nt, Human
uggcacaggggagcaugacuuc

SEQ ID NO: 250394 - RNA, 28 nt, Human
uggcagcagcucacaugggacaugccug

SEQ ID NO: 250395 - RNA, 21 nt, Human
uggcagggaggccugcgaggc

SEQ ID NO: 250396 - RNA, 28 nt, Human
uggcaguuugugucugguuccggcaccg

SEQ ID NO: 250397 - RNA, 18 nt, Human
uggccucuagcgccaccc

SEQ ID NO: 250398 - RNA, 24 nt, Human
uggcguuucuggguguccccugug

SEQ ID NO: 250399 - RNA, 20 nt, Human
ugggcccagaggcugcccca

SEQ ID NO: 250400 - RNA, 22 nt, Human
ugggcggaacaaaaccugguuu

SEQ ID NO: 250401 - RNA, 22 nt, Human
uggggccagacuugagccacca

SEQ ID NO: 250402 - RNA, 20 nt, Human
uggggcugguguggggccag

SEQ ID NO: 250403 - RNA, 26 nt, Human
ugggggcaaagagauuucccccgagg

SEQ ID NO: 250404 - RNA, 18 nt, Human
uggggggagcugggggag

SEQ ID NO: 250405 - RNA, 18 nt, Human
uggggguugugcucccuc

SEQ ID NO: 250406 - RNA, 20 nt, Human
ugggugacaggggggccugg

SEQ ID NO: 250407 - RNA, 21 nt, Human
ugggugacaggggggccuggu

SEQ ID NO: 250408 - RNA, 23 nt, Human
ugggugacaggggggccuggugg

SEQ ID NO: 250409 - RNA, 24 nt, Human
ugguagugccaggaguucgaggcc

SEQ ID NO: 250410 - RNA, 19 nt, Human
uggugaacgcuccaccuuc

SEQ ID NO: 250411 - RNA, 20 nt, Human
uggugcugggccuuccaggu

SEQ ID NO: 250412 - RNA, 23 nt, Human
ugguucaggccagucuacaccca

SEQ ID NO: 250413 - RNA, 19 nt, Human
uguaauuuucugccaaaug

SEQ ID NO: 250414 - RNA, 21 nt, Human
uguauuuuuauggagcagucu

SEQ ID NO: 250415 - RNA, 18 nt, Human
ugucacaucaaagcagga

SEQ ID NO: 250416 - RNA, 24 nt, Human
ugucaugggugacaggggggccug

SEQ ID NO: 250417 - RNA, 24 nt, Human
ugucaugggugacaggggggccug

SEQ ID NO: 250418 - RNA, 18 nt, Human
uguccagauacacgggag

SEQ ID NO: 250419 - RNA, 19 nt, Human
uguccugugaagcguccuu

SEQ ID NO: 250420 - RNA, 23 nt, Human
ugucuuaaacaguaaugcccacg

SEQ ID NO: 250421 - RNA, 22 nt, Human
ugugaagcguccuugccaguuu

SEQ ID NO: 250422 - RNA, 22 nt, Human
ugugaccaaguaucuccagcuc

SEQ ID NO: 250423 - RNA, 21 nt, Human
ugugcaauauacagauauaua

SEQ ID NO: 250424 - RNA, 23 nt, Human
ugugcccacagcagagcguccca

SEQ ID NO: 250425 - RNA, 18 nt, Human
ugugucuagucggugcgu

SEQ ID NO: 250426 - RNA, 18 nt, Human
uguucuugaauucaaagg

SEQ ID NO: 250427 - RNA, 24 nt, Human
uguugguuugcuuugcaauccgcu

SEQ ID NO: 250428 - RNA, 20 nt, Human
uuaaaaagaugggaucccac

SEQ ID NO: 250429 - RNA, 23 nt, Human
uuaaagguaggacagaauggggg

SEQ ID NO: 250430 - RNA, 18 nt, Human
uucaaccugacugugcuu

SEQ ID NO: 250431 - RNA, 23 nt, Human
uucccuggguguuuuccugacac

SEQ ID NO: 250432 - RNA, 23 nt, Human
uucccuuguccuaugcuaugguu

SEQ ID NO: 250433 - RNA, 21 nt, Human
uuccugaacagagguuaaaaa

SEQ ID NO: 250434 - RNA, 18 nt, Human
uuccugacacgucagcgc

SEQ ID NO: 250435 - RNA, 22 nt, Human
uucucuaaagaauccaacuguc

SEQ ID NO: 250436 - RNA, 23 nt, Human
uucuggggacuggagccgacaag

SEQ ID NO: 250437 - RNA, 23 nt, Human
uugcagcaaacacuuagaguuuc

SEQ ID NO: 250438 - RNA, 24 nt, Human
uugccaguuuuggauuggggcugg

SEQ ID NO: 250439 - RNA, 23 nt, Human
uugccauucaagaagaacuccga

SEQ ID NO: 250440 - RNA, 18 nt, Human
uugcccccuccccugucc

SEQ ID NO: 250441 - RNA, 22 nt, Human
uuggaacugucaacuaugguuc

SEQ ID NO: 250442 - RNA, 19 nt, Human
uugggaaagacgagggaau

SEQ ID NO: 250443 - RNA, 19 nt, Human
uuggggcugguguggggcc

SEQ ID NO: 250444 - RNA, 18 nt, Human
uuuccuuaaaagcacggg

SEQ ID NO: 250445 - RNA, 18 nt, Human
uuucuccacccaacuugg

SEQ ID NO: 250446 - RNA, 21 nt, Human
uuucuggauuuuuuugguguu

SEQ ID NO: 250447 - RNA, 27 nt, Human
uuuuccccucuaauauguaauuuuaga

SEQ ID NO: 250448 - RNA, 22 nt, Human
uuuuuauuuucccuuguccuau

SEQ ID NO: 250449 - RNA, 23 nt, Human
aaaaguacaaacaucagcuugga

SEQ ID NO: 250450 - RNA, 19 nt, Human
aacauggugaaacuccauc

SEQ ID NO: 250451 - RNA, 20 nt, Human
aacauggugaaacuccaucu

SEQ ID NO: 250452 - RNA, 21 nt, Human
aacauggugaaacuccaucuc

SEQ ID NO: 250453 - RNA, 20 nt, Human
aagauaugaauguaaaaaga

SEQ ID NO: 250454 - RNA, 21 nt, Human
aagguucugcuugcaagauau

SEQ ID NO: 250455 - RNA, 26 nt, Human
acacacacucacacccacauacauau

SEQ ID NO: 250456 - RNA, 23 nt, Human
acacacccacacauacacacaca

SEQ ID NO: 250457 - RNA, 24 nt, Human
acacccacacauacacacacacuc

SEQ ID NO: 250458 - RNA, 21 nt, Human
acagcuucuguuauuucagcu

SEQ ID NO: 250459 - RNA, 18 nt, Human
acaucugcagaccuacaa

SEQ ID NO: 250460 - RNA, 20 nt, Human
accgagaucacaccacugca

SEQ ID NO: 250461 - RNA, 24 nt, Human
acuccaucucuacuaaaaauauaa

SEQ ID NO: 250462 - RNA, 18 nt, Human
acugcacuucagccuggg

SEQ ID NO: 250463 - RNA, 24 nt, Human
acugcacuucagccugggggguag

SEQ ID NO: 250464 - RNA, 22 nt, Human
acugguuaucuuuacgaaacaa

SEQ ID NO: 250465 - RNA, 24 nt, Human
acuucagccugggggguagaguga

SEQ ID NO: 250466 - RNA, 21 nt, Human
agaguuaaaccaagauaaagc

SEQ ID NO: 250467 - RNA, 23 nt, Human
agccaggcaugguggcaggcgcc

SEQ ID NO: 250468 - RNA, 22 nt, Human
agccuggccaacauggugaaac

SEQ ID NO: 250469 - RNA, 24 nt, Human
agccuggccaacauggugaaacuc

SEQ ID NO: 250470 - RNA, 24 nt, Human
agccugggggguagagugagacuc

SEQ ID NO: 250471 - RNA, 24 nt, Human
aggcaugguggcaggcgccuguaa

SEQ ID NO: 250472 - RNA, 21 nt, Human
aggcggagguugcagugaacc

SEQ ID NO: 250473 - RNA, 24 nt, Human
aggcggagguugcagugaaccgag

SEQ ID NO: 250474 - RNA, 24 nt, Human
aggcugagguacgagaaucacuug

SEQ ID NO: 250475 - RNA, 24 nt, Human
agguacgagaaucacuugaaccug

SEQ ID NO: 250476 - RNA, 25 nt, Human
aguuaaauaaaacaaguagggggcc

SEQ ID NO: 250477 - RNA, 21 nt, Human
auaaaacaaguagggggcccu

SEQ ID NO: 250478 - RNA, 18 nt, Human
auaaagcuauucucuaaa

SEQ ID NO: 250479 - RNA, 21 nt, Human
auaaauauauuuaacucaugu

SEQ ID NO: 250480 - RNA, 24 nt, Human
aucacaccacugcacuucagccug

SEQ ID NO: 250481 - RNA, 25 nt, Human
augcaccccuuugcaacagacaccc

SEQ ID NO: 250482 - RNA, 21 nt, Human
caaaacaguuauguguggggc

SEQ ID NO: 250483 - RNA, 24 nt, Human
caacauggugaaacuccaucucua

SEQ ID NO: 250484 - RNA, 21 nt, Human
caauacauuuuugcacgugca

SEQ ID NO: 250485 - RNA, 28 nt, Human
cacacucacacccacauacauauauaug

SEQ ID NO: 250486 - RNA, 20 nt, Human
cacccacauacauauauaug

SEQ ID NO: 250487 - RNA, 18 nt, Human
cacccaugccagguugga

SEQ ID NO: 250488 - RNA, 18 nt, Human
caccccuuugcaacagac

SEQ ID NO: 250489 - RNA, 18 nt, Human
cacugcacuucagccugg

SEQ ID NO: 250490 - RNA, 19 nt, Human
cacugcacuucagccuggg

SEQ ID NO: 250491 - RNA, 19 nt, Human
cacugcacuucagccuggg

SEQ ID NO: 250492 - RNA, 24 nt, Human
cacugcacuucagccuggggggua

SEQ ID NO: 250493 - RNA, 18 nt, Human
cacugcaguaacacaaaa

SEQ ID NO: 250494 - RNA, 23 nt, Human
cacuucagccugggggguagagu

SEQ ID NO: 250495 - RNA, 23 nt, Human
cagcaaaaagugcacuuagauau

SEQ ID NO: 250496 - RNA, 22 nt, Human
cagccugggggguagagugaga

SEQ ID NO: 250497 - RNA, 18 nt, Human
cagguaagugccugauuc

SEQ ID NO: 250498 - RNA, 21 nt, Human
cauacacacacacucacaccc

SEQ ID NO: 250499 - RNA, 23 nt, Human
cauacacacacacucacacccac

SEQ ID NO: 250500 - RNA, 33 nt, Human
cauacacacacacucacacccacauacauagug

SEQ ID NO: 250501 - RNA, 18 nt, Human
caucguacacagcuucug

SEQ ID NO: 250502 - RNA, 20 nt, Human
ccacugcacuucagccuggg

SEQ ID NO: 250503 - RNA, 20 nt, Human
ccacugcacuucagccuggg

SEQ ID NO: 250504 - RNA, 22 nt, Human
ccacugcacuucagccuggggg

SEQ ID NO: 250505 - RNA, 23 nt, Human
ccacugcacuucagccugggggg

SEQ ID NO: 250506 - RNA, 24 nt, Human
ccacugcacuucagccuggggggu

SEQ ID NO: 250507 - RNA, 18 nt, Human
ccagaguucgagaccagc

SEQ ID NO: 250508 - RNA, 25 nt, Human
ccaugcaccccuuugcaacagacac

SEQ ID NO: 250509 - RNA, 18 nt, Human
cccacacauacacacaca

SEQ ID NO: 250510 - RNA, 23 nt, Human
ccuggccaacauggugaaacucc

SEQ ID NO: 250511 - RNA, 24 nt, Human
ccuggccaacauggugaaacucca

SEQ ID NO: 250512 - RNA, 19 nt, Human
ccuguaaucccagcuacuc

SEQ ID NO: 250513 - RNA, 21 nt, Human
ccuguaaucccagcuacucgg

SEQ ID NO: 250514 - RNA, 22 nt, Human
ccuguaaucccagcuacucggg

SEQ ID NO: 250515 - RNA, 19 nt, Human
ccuuauuuaccgauuuaga

SEQ ID NO: 250516 - RNA, 24 nt, Human
cgagaccagccuggccaacauggu

SEQ ID NO: 250517 - RNA, 24 nt, Human
cgccuguaaucccagcuacucggg

SEQ ID NO: 250518 - RNA, 21 nt, Human
cgugcaaaacaguuaugugug

SEQ ID NO: 250519 - RNA, 26 nt, Human
cuaaaaauauaaauaucagccaggca

SEQ ID NO: 250520 - RNA, 23 nt, Human
cuggccaacauggugaaacucca

SEQ ID NO: 250521 - RNA, 20 nt, Human
cugugccuacagggugcuuu

SEQ ID NO: 250522 - RNA, 23 nt, Human
gagaucacaccacugcacuucag

SEQ ID NO: 250523 - RNA, 22 nt, Human
gagguugcagugaaccgagauc

SEQ ID NO: 250524 - RNA, 18 nt, Human
gcaguaacacaaaaguac

SEQ ID NO: 250525 - RNA, 24 nt, Human
gccaacauggugaaacuccaucuc

SEQ ID NO: 250526 - RNA, 18 nt, Human
ggagguugcagugaaccg

SEQ ID NO: 250527 - RNA, 24 nt, Human
ggagguugcagugaaccgagauca

SEQ ID NO: 250528 - RNA, 23 nt, Human
gggaggcugagguacgagaauca

SEQ ID NO: 250529 - RNA, 24 nt, Human
gguggcaggcgccuguaaucccag

SEQ ID NO: 250530 - RNA, 18 nt, Human
guccagaguucgagaccg

SEQ ID NO: 250531 - RNA, 22 nt, Human
uaaaauaaaacuaaagaguuaa

SEQ ID NO: 250532 - RNA, 21 nt, Human
uaaagaucacuucuugaccca

SEQ ID NO: 250533 - RNA, 24 nt, Human
uacaugagcuaaaaucaguuucuu

SEQ ID NO: 250534 - RNA, 22 nt, Human
uacccuaaugcaucguacacag

SEQ ID NO: 250535 - RNA, 19 nt, Human
uagagugagacucaauguc

SEQ ID NO: 250536 - RNA, 25 nt, Human
uagcuuuggcuuauauaaauaauuc

SEQ ID NO: 250537 - RNA, 25 nt, Human
uauauauguauguacauauaaauau

SEQ ID NO: 250538 - RNA, 24 nt, Human
uauguaaagggauauauauaugua

SEQ ID NO: 250539 - RNA, 28 nt, Human
uauguaacacacacccacacauacacac

SEQ ID NO: 250540 - RNA, 27 nt, Human
uauguauguacauauaaauauauuuca

SEQ ID NO: 250541 - RNA, 24 nt, Human
uauuuuuguuuuccccucuuaaaa

SEQ ID NO: 250542 - RNA, 26 nt, Human
ucaacagcccuuucccaugcaccccu

SEQ ID NO: 250543 - RNA, 21 nt, Human
ucaacuuuccuuauuuccuua

SEQ ID NO: 250544 - RNA, 20 nt, Human
ucaaugucuagaaaugaagu

SEQ ID NO: 250545 - RNA, 22 nt, Human
ucagcaaaaagugcacuuagau

SEQ ID NO: 250546 - RNA, 23 nt, Human
ucagccaggcaugguggcaggcg

SEQ ID NO: 250547 - RNA, 23 nt, Human
uccaagggcuacagcugaaauuu

SEQ ID NO: 250548 - RNA, 22 nt, Human
ucccaugcaccccuuugcaaca

SEQ ID NO: 250549 - RNA, 25 nt, Human
ucgggaggcugagguacgagaauca

SEQ ID NO: 250550 - RNA, 20 nt, Human
ucuacaagaucugaggucca

SEQ ID NO: 250551 - RNA, 19 nt, Human
ucucuacuaaaaauauaaa

SEQ ID NO: 250552 - RNA, 23 nt, Human
ucugagguccagaguucgagacc

SEQ ID NO: 250553 - RNA, 25 nt, Human
ucugcagaccuacaaggaguuugca

SEQ ID NO: 250554 - RNA, 23 nt, Human
ugaaguaucagcaaaaagugcac

SEQ ID NO: 250555 - RNA, 22 nt, Human
ugagcuaaaaucaguuucuuua

SEQ ID NO: 250556 - RNA, 24 nt, Human
ugagguacgagaaucacuugaacc

SEQ ID NO: 250557 - RNA, 18 nt, Human
ugcaacagacacccaugc

SEQ ID NO: 250558 - RNA, 22 nt, Human
uggcaggcgccuguaaucccag

SEQ ID NO: 250559 - RNA, 24 nt, Human
uggccaacauggugaaacuccauc

SEQ ID NO: 250560 - RNA, 18 nt, Human
ugggacacacaucugcag

SEQ ID NO: 250561 - RNA, 24 nt, Human
ugguggcaggcgccuguaauccca

SEQ ID NO: 250562 - RNA, 23 nt, Human
ugguuccugcuuuucuacugcuc

SEQ ID NO: 250563 - RNA, 20 nt, Human
uguacauauaaauauauuua

SEQ ID NO: 250564 - RNA, 21 nt, Human
ugucugugccuacagggugcu

SEQ ID NO: 250565 - RNA, 20 nt, Human
ugugggagaauuauauaugg

SEQ ID NO: 250566 - RNA, 24 nt, Human
uucagccugggggguagagugaga

SEQ ID NO: 250567 - RNA, 25 nt, Human
uucauaaggguguuuucuuucauau

SEQ ID NO: 250568 - RNA, 19 nt, Human
uucccaugcaccccuuugc

SEQ ID NO: 250569 - RNA, 20 nt, Human
uuccuuauauuccaaauauu

SEQ ID NO: 250570 - RNA, 23 nt, Human
uucucugcaaaaacugguuaucu

SEQ ID NO: 250571 - RNA, 23 nt, Human
uugaaccuggaggcggagguugc

SEQ ID NO: 250572 - RNA, 20 nt, Human
uugcagugaaccgagaucac

SEQ ID NO: 250573 - RNA, 23 nt, Human
uuucuacugcucuguucuacaaa

SEQ ID NO: 250574 - RNA, 18 nt, Human
uuuuguuuuguuuguuuu

SEQ ID NO: 250575 - RNA, 24 nt, Human
uuuuuuguuuuguuuguuuuuaau

SEQ ID NO: 250576 - RNA, 20 nt, Human
uuuuuuuuuuucaagguucu

SEQ ID NO: 250577 - RNA, 22 nt, Human
aagaaggaaaggagccccccag

SEQ ID NO: 250578 - RNA, 19 nt, Human
aaggagccccccagggugg

SEQ ID NO: 250579 - RNA, 20 nt, Human
aggcugaggagggcgggggu

SEQ ID NO: 250580 - RNA, 19 nt, Human
caaauaggaagaaggaaag

SEQ ID NO: 250581 - RNA, 21 nt, Human
caccagguucuucacggcgcu

SEQ ID NO: 250582 - RNA, 21 nt, Human
cagccgcccaccuccaagccc

SEQ ID NO: 250583 - RNA, 19 nt, Human
cagcucggggagggagcga

SEQ ID NO: 250584 - RNA, 18 nt, Human
caggaucaggcugaggag

SEQ ID NO: 250585 - RNA, 19 nt, Human
ccaccagguucuucacggc

SEQ ID NO: 250586 - RNA, 24 nt, Human
ccggcuccuccauagcgacccccg

SEQ ID NO: 250587 - RNA, 21 nt, Human
ccuccaagcccccaccgcgga

SEQ ID NO: 250588 - RNA, 21 nt, Human
ccuccacgcugcggaaguaga

SEQ ID NO: 250589 - RNA, 18 nt, Human
ccuugugcugggccagcu

SEQ ID NO: 250590 - RNA, 19 nt, Human
ccuugugcugggccagcuc

SEQ ID NO: 250591 - RNA, 21 nt, Human
cggcgcugcaggcguacucca

SEQ ID NO: 250592 - RNA, 19 nt, Human
cucccaacgcugcaugucu

SEQ ID NO: 250593 - RNA, 18 nt, Human
cuccuccauagcgacccc

SEQ ID NO: 250594 - RNA, 23 nt, Human
ggaaaggagccccccagggugga

SEQ ID NO: 250595 - RNA, 19 nt, Human
guggaaugaucuuugucug

SEQ ID NO: 250596 - RNA, 21 nt, Human
guggcccugggcacuggcauu

SEQ ID NO: 250597 - RNA, 19 nt, Human
uccagccgcccaccuccaa

SEQ ID NO: 250598 - RNA, 18 nt, Human
uccaggaucaggcugagg

SEQ ID NO: 250599 - RNA, 24 nt, Human
ucccaacgcugcaugucugccuug

SEQ ID NO: 250600 - RNA, 19 nt, Human
ucccuggcucugcuccucc

SEQ ID NO: 250601 - RNA, 21 nt, Human
ucccuggcucugcuccuccca

SEQ ID NO: 250602 - RNA, 24 nt, Human
ugauggccuguuugagcagacccu

SEQ ID NO: 250603 - RNA, 23 nt, Human
uggauugaguccagccgcccacc

SEQ ID NO: 250604 - RNA, 21 nt, Human
uggcucccuggcucugcuccu

SEQ ID NO: 250605 - RNA, 20 nt, Human
uguccgugacuuucuucccc

SEQ ID NO: 250606 - RNA, 19 nt, Human
uuccuccgggcuguggccc

SEQ ID NO: 250607 - RNA, 23 nt, Human
aaaaaaacacauuuuggcuuaag

SEQ ID NO: 250608 - RNA, 19 nt, Human
aaaaaaagggacauagaga

SEQ ID NO: 250609 - RNA, 18 nt, Human
aaaaaagggacauagaga

SEQ ID NO: 250610 - RNA, 23 nt, Human
aaaaacaaaacuucuacaaagag

SEQ ID NO: 250611 - RNA, 23 nt, Human
aaaagagaaaaaauggauaagaa

SEQ ID NO: 250612 - RNA, 24 nt, Human
aaacagaaagaaaauaguuacuca

SEQ ID NO: 250613 - RNA, 22 nt, Human
aaacaugcagccacggcgaccc

SEQ ID NO: 250614 - RNA, 21 nt, Human
aaccaaccagaugauuuagaa

SEQ ID NO: 250615 - RNA, 19 nt, Human
aaccuucaaagucaaucca

SEQ ID NO: 250616 - RNA, 21 nt, Human
aacuacaaaaagccacaaaug

SEQ ID NO: 250617 - RNA, 23 nt, Human
aaggagcacaacagugaaaagaa

SEQ ID NO: 250618 - RNA, 25 nt, Human
aaggggcccugcauuugauaaaaau

SEQ ID NO: 250619 - RNA, 24 nt, Human
aauaacaacaauaaucuuuacuuc

SEQ ID NO: 250620 - RNA, 21 nt, Human
aauauaccccccucccgcuau

SEQ ID NO: 250621 - RNA, 24 nt, Human
acaugcagccacggcgacccacac

SEQ ID NO: 250622 - RNA, 18 nt, Human
acuuuuuuuuuuuccaca

SEQ ID NO: 250623 - RNA, 24 nt, Human
agaaaaaaaaaauaacaacaauaa

SEQ ID NO: 250624 - RNA, 25 nt, Human
agaaagaaaauaguuacucaaaugu

SEQ ID NO: 250625 - RNA, 21 nt, Human
agaaauacacauuucaaaaac

SEQ ID NO: 250626 - RNA, 23 nt, Human
agagaaaaaaaaaauaacaacaa

SEQ ID NO: 250627 - RNA, 19 nt, Human
agcacaacagugaaaagaa

SEQ ID NO: 250628 - RNA, 19 nt, Human
agcacccagucuuucacau

SEQ ID NO: 250629 - RNA, 24 nt, Human
agcagagcgagcagagagcuggga

SEQ ID NO: 250630 - RNA, 20 nt, Human
agcucaguucccaaauuccu

SEQ ID NO: 250631 - RNA, 18 nt, Human
agggccauauuugcagga

SEQ ID NO: 250632 - RNA, 21 nt, Human
aguaaaagaaaacagaaagaa

SEQ ID NO: 250633 - RNA, 18 nt, Human
aguccuuuuugguuuuuu

SEQ ID NO: 250634 - RNA, 19 nt, Human
auagcacacacacacacug

SEQ ID NO: 250635 - RNA, 22 nt, Human
auauagcaguguugauauuacu

SEQ ID NO: 250636 - RNA, 21 nt, Human
auuccugcauucguuccugau

SEQ ID NO: 250637 - RNA, 22 nt, Human
auuuggggguccugacacaccg

SEQ ID NO: 250638 - RNA, 19 nt, Human
caaaugcuuugcaaacucu

SEQ ID NO: 250639 - RNA, 24 nt, Human
caagaaaaaaaaaaaaacuaguaa

SEQ ID NO: 250640 - RNA, 25 nt, Human
caaggggaaaaaaacacauuuuggc

SEQ ID NO: 250641 - RNA, 18 nt, Human
caaguuaagaaaaauaua

SEQ ID NO: 250642 - RNA, 19 nt, Human
caaguuaggauaugcacuu

SEQ ID NO: 250643 - RNA, 25 nt, Human
cacacacacacacugcaagaaaaaa

SEQ ID NO: 250644 - RNA, 22 nt, Human
caccgggauuguucaacagucc

SEQ ID NO: 250645 - RNA, 20 nt, Human
cacugcaagaaaaaaaaaaa

SEQ ID NO: 250646 - RNA, 25 nt, Human
cagaguaaaagaaaacagaaagaaa

SEQ ID NO: 250647 - RNA, 24 nt, Human
cagaguaccugacuuuuuuuuuuu

SEQ ID NO: 250648 - RNA, 19 nt, Human
cagcccgaagaugucuggg

SEQ ID NO: 250649 - RNA, 19 nt, Human
cagcguugaagugcuucuc

SEQ ID NO: 250650 - RNA, 25 nt, Human
cagcugaccuuaaacuuauaaaaug

SEQ ID NO: 250651 - RNA, 18 nt, Human
ccacacagaaccuucaaa

SEQ ID NO: 250652 - RNA, 23 nt, Human
ccagcggcagccuuuuacaauga

SEQ ID NO: 250653 - RNA, 19 nt, Human
cccacacagaaccuucaaa

SEQ ID NO: 250654 - RNA, 24 nt, Human
cccagcggcagccuuuuacaauga

SEQ ID NO: 250655 - RNA, 24 nt, Human
cccauuaccgggucuguccaagca

SEQ ID NO: 250656 - RNA, 19 nt, Human
ccuauauugcugacaagau

SEQ ID NO: 250657 - RNA, 18 nt, Human
ccugcaacaugacacuau

SEQ ID NO: 250658 - RNA, 18 nt, Human
ccuuuugacagcugaccu

SEQ ID NO: 250659 - RNA, 21 nt, Human
cguugaagugcuucuccaccu

SEQ ID NO: 250660 - RNA, 20 nt, Human
cuagcacccagucuuucaca

SEQ ID NO: 250661 - RNA, 19 nt, Human
cugcaagaaaaaaaaaaaa

SEQ ID NO: 250662 - RNA, 22 nt, Human
cugcaagaaaaaaaaaaaaacu

SEQ ID NO: 250663 - RNA, 24 nt, Human
cugcaagaaaaaaaaaaaaacuag

SEQ ID NO: 250664 - RNA, 19 nt, Human
cugccacccagcggcagcc

SEQ ID NO: 250665 - RNA, 18 nt, Human
cuggguguacgcgugugc

SEQ ID NO: 250666 - RNA, 20 nt, Human
cuuauucaccaaguaaauuc

SEQ ID NO: 250667 - RNA, 18 nt, Human
cuugaaauggcuauuaaa

SEQ ID NO: 250668 - RNA, 20 nt, Human
gaaccugcaacaugacacua

SEQ ID NO: 250669 - RNA, 27 nt, Human
gagcacaacagugaaaagaaguuagcc

SEQ ID NO: 250670 - RNA, 19 nt, Human
gaggcaauuuaaaaguacu

SEQ ID NO: 250671 - RNA, 23 nt, Human
ggauauuuuccuuucuuaagaga

SEQ ID NO: 250672 - RNA, 18 nt, Human
guaaauuccauaucacuu

SEQ ID NO: 250673 - RNA, 21 nt, Human
gugagaucagaaaggggcccu

SEQ ID NO: 250674 - RNA, 24 nt, Human
guugcaaugugauauguucuaacc

SEQ ID NO: 250675 - RNA, 23 nt, Human
guuuuucuucucucucucguccc

SEQ ID NO: 250676 - RNA, 21 nt, Human
uaaaaacggaugacaaagcaa

SEQ ID NO: 250677 - RNA, 21 nt, Human
uaaaaauagcaugaaagaaac

SEQ ID NO: 250678 - RNA, 23 nt, Human
uaaaaguacuuuuacaaaacaga

SEQ ID NO: 250679 - RNA, 23 nt, Human
uaaauaacguugaaccugcaaca

SEQ ID NO: 250680 - RNA, 19 nt, Human
uaaccccacagguuauccu

SEQ ID NO: 250681 - RNA, 24 nt, Human
uaauuaaaaacggaugacaaagca

SEQ ID NO: 250682 - RNA, 21 nt, Human
uaccaauggccacccauuacc

SEQ ID NO: 250683 - RNA, 23 nt, Human
uagaaauacacauuucaaaaaca

SEQ ID NO: 250684 - RNA, 24 nt, Human
uagcaaagcauggaguucuucaug

SEQ ID NO: 250685 - RNA, 18 nt, Human
uauaaaauguaagcagag

SEQ ID NO: 250686 - RNA, 22 nt, Human
uauagcacacacacacacugca

SEQ ID NO: 250687 - RNA, 19 nt, Human
uauagcaguguugauauua

SEQ ID NO: 250688 - RNA, 18 nt, Human
uauuuaauaagagaugca

SEQ ID NO: 250689 - RNA, 20 nt, Human
uauuuuuuccuuccuuuucu

SEQ ID NO: 250690 - RNA, 23 nt, Human
ucaaaaacaaaacuucuacaaag

SEQ ID NO: 250691 - RNA, 22 nt, Human
ucaaacaugcagccacggcgac

SEQ ID NO: 250692 - RNA, 27 nt, Human
ucaaacaugcagccacggcgacccaca

SEQ ID NO: 250693 - RNA, 19 nt, Human
ucagaaaggggcccugcau

SEQ ID NO: 250694 - RNA, 21 nt, Human
uccaagagaaggaaaaucuuu

SEQ ID NO: 250695 - RNA, 22 nt, Human
uccaagagaaggaaaaucuuuc

SEQ ID NO: 250696 - RNA, 19 nt, Human
uccacacacggcacauaua

SEQ ID NO: 250697 - RNA, 18 nt, Human
uccuuccuuuucuuucuc

SEQ ID NO: 250698 - RNA, 21 nt, Human
ucuagcacccagucuuucacc

SEQ ID NO: 250699 - RNA, 19 nt, Human
ucucuuggcuucugccacc

SEQ ID NO: 250700 - RNA, 24 nt, Human
ucugugacugcgagcagagcgagc

SEQ ID NO: 250701 - RNA, 20 nt, Human
ucuuucucuuuccuguuucc

SEQ ID NO: 250702 - RNA, 22 nt, Human
ugaaauggugagaucagaaagg

SEQ ID NO: 250703 - RNA, 18 nt, Human
ugacugcgagcagagcga

SEQ ID NO: 250704 - RNA, 21 nt, Human
ugacugcgagcagagcgagca

SEQ ID NO: 250705 - RNA, 20 nt, Human
ugcaaaaaacaaaauaaaaa

SEQ ID NO: 250706 - RNA, 18 nt, Human
uggauacaaccaaaggug

SEQ ID NO: 250707 - RNA, 22 nt, Human
ugggaugucaggugaccuggug

SEQ ID NO: 250708 - RNA, 22 nt, Human
uggugaaauggugagaucagaa

SEQ ID NO: 250709 - RNA, 21 nt, Human
uguuguacaacucaaguggcg

SEQ ID NO: 250710 - RNA, 20 nt, Human
uucaaagucaauccaauagc

SEQ ID NO: 250711 - RNA, 21 nt, Human
uuccaagagaaggaaaaucuu

SEQ ID NO: 250712 - RNA, 20 nt, Human
uuccugaugaaggaagaccc

SEQ ID NO: 250713 - RNA, 21 nt, Human
uuuccuuccuuuucuuucucu

SEQ ID NO: 250714 - RNA, 24 nt, Human
uuucuauauguugcauaacagcug

SEQ ID NO: 250715 - RNA, 19 nt, Human
uuucuucucucucucgucc

SEQ ID NO: 250716 - RNA, 19 nt, Human
uuugcaaacucugucuuac

SEQ ID NO: 250717 - RNA, 21 nt, Human
uuuuuuuuuuuccacacacgg

SEQ ID NO: 250718 - RNA, 21 nt, Human
aaaccuggggagggggagggc

SEQ ID NO: 250719 - RNA, 19 nt, Human
aaagcaggucugggguugg

SEQ ID NO: 250720 - RNA, 22 nt, Human
aaaggacacugaaacauccaca

SEQ ID NO: 250721 - RNA, 21 nt, Human
aaaggacacugaaacauccag

SEQ ID NO: 250722 - RNA, 23 nt, Human
aaauaaucagcaagagaaggugc

SEQ ID NO: 250723 - RNA, 27 nt, Human
aacaggacacgaagcacaagaaaggaa

SEQ ID NO: 250724 - RNA, 18 nt, Human
aacuuaccccucacccca

SEQ ID NO: 250725 - RNA, 24 nt, Human
aagaggagagaauccagauucucc

SEQ ID NO: 250726 - RNA, 24 nt, Human
aagguagggagggcugggaggggg

SEQ ID NO: 250727 - RNA, 20 nt, Human
acaaaucaacagccucacac

SEQ ID NO: 250728 - RNA, 22 nt, Human
acagagaagaaaggacacugaa

SEQ ID NO: 250729 - RNA, 18 nt, Human
accccucaccccacccca

SEQ ID NO: 250730 - RNA, 24 nt, Human
accccucaccccaccccaggggau

SEQ ID NO: 250731 - RNA, 21 nt, Human
acccuggcuucuuucaagccc

SEQ ID NO: 250732 - RNA, 18 nt, Human
acgaagcacaagaaagga

SEQ ID NO: 250733 - RNA, 21 nt, Human
acucgcccugccccaggaccc

SEQ ID NO: 250734 - RNA, 20 nt, Human
acugcagaaaugucacauau

SEQ ID NO: 250735 - RNA, 22 nt, Human
agaagaaaggacacugaaacau

SEQ ID NO: 250736 - RNA, 21 nt, Human
agaauacuaagaaagcaucac

SEQ ID NO: 250737 - RNA, 20 nt, Human
agcagaggggagaacaagga

SEQ ID NO: 250738 - RNA, 19 nt, Human
agcgggaggagcccggggc

SEQ ID NO: 250739 - RNA, 21 nt, Human
aggcugagaggaggggagugg

SEQ ID NO: 250740 - RNA, 18 nt, Human
agggacagagaagaaagg

SEQ ID NO: 250741 - RNA, 23 nt, Human
agggcugggagggggucaggggu

SEQ ID NO: 250742 - RNA, 24 nt, Human
aggggagaacaaggaguucccagg

SEQ ID NO: 250743 - RNA, 18 nt, Human
aggggauuccaaagaguc

SEQ ID NO: 250744 - RNA, 19 nt, Human
aggggauuccaaagaguca

SEQ ID NO: 250745 - RNA, 20 nt, Human
aggugguggggggggguguc

SEQ ID NO: 250746 - RNA, 21 nt, Human
agguggugggggggggugucc

SEQ ID NO: 250747 - RNA, 25 nt, Human
auacagcacgaaaagaaauauugaa

SEQ ID NO: 250748 - RNA, 20 nt, Human
aucagaaacguguauucuuu

SEQ ID NO: 250749 - RNA, 18 nt, Human
augaacaagauuacaccc

SEQ ID NO: 250750 - RNA, 18 nt, Human
cacauauucacagaccac

SEQ ID NO: 250751 - RNA, 20 nt, Human
cacauauucacagaccaccc

SEQ ID NO: 250752 - RNA, 18 nt, Human
caccaccucccucccucu

SEQ ID NO: 250753 - RNA, 18 nt, Human
caccauacagcacgaaaa

SEQ ID NO: 250754 - RNA, 23 nt, Human
caccauacagcacgaaaagaaau

SEQ ID NO: 250755 - RNA, 23 nt, Human
cagauucuccauuccagccuccc

SEQ ID NO: 250756 - RNA, 21 nt, Human
cagccuccagcccggcugggg

SEQ ID NO: 250757 - RNA, 21 nt, Human
caggacccaggaagagcccca

SEQ ID NO: 250758 - RNA, 19 nt, Human
cagggaagggcgggcggug

SEQ ID NO: 250759 - RNA, 22 nt, Human
cagggacagagaagaaaggaca

SEQ ID NO: 250760 - RNA, 18 nt, Human
cauacagcacgaaaagaa

SEQ ID NO: 250761 - RNA, 19 nt, Human
cauggcccauccugccccu

SEQ ID NO: 250762 - RNA, 25 nt, Human
cccaggacccaggaagagccccagg

SEQ ID NO: 250763 - RNA, 22 nt, Human
cccaggagccccuacccccaag

SEQ ID NO: 250764 - RNA, 23 nt, Human
cccaggagccccuacccccaaga

SEQ ID NO: 250765 - RNA, 22 nt, Human
cccaguucuucagagggagugg

SEQ ID NO: 250766 - RNA, 22 nt, Human
ccccaggacccaggaagagccc

SEQ ID NO: 250767 - RNA, 18 nt, Human
ccccagggacagagaaga

SEQ ID NO: 250768 - RNA, 21 nt, Human
ccccucccuuccucuuccuca

SEQ ID NO: 250769 - RNA, 20 nt, Human
cccggggcagggaagggcgg

SEQ ID NO: 250770 - RNA, 18 nt, Human
cccucccuuccucuuccu

SEQ ID NO: 250771 - RNA, 21 nt, Human
cccuggaucgaggcucaucag

SEQ ID NO: 250772 - RNA, 20 nt, Human
cccuuccucuuccucaccac

SEQ ID NO: 250773 - RNA, 22 nt, Human
ccgcccaggagccccuaccucg

SEQ ID NO: 250774 - RNA, 23 nt, Human
ccuaucauucaacuauucaccca

SEQ ID NO: 250775 - RNA, 20 nt, Human
ccucacacuuggacucgccc

SEQ ID NO: 250776 - RNA, 22 nt, Human
ccucaccaccucccucccucug

SEQ ID NO: 250777 - RNA, 24 nt, Human
ccucaccaccucccucccucugga

SEQ ID NO: 250778 - RNA, 25 nt, Human
ccuccgcgaaagccuaaacuuaccc

SEQ ID NO: 250779 - RNA, 18 nt, Human
ccugccccaggacccagg

SEQ ID NO: 250780 - RNA, 18 nt, Human
ccugccccucccuuccuc

SEQ ID NO: 250781 - RNA, 24 nt, Human
ccuggggagggggagggccauuag

SEQ ID NO: 250782 - RNA, 19 nt, Human
cgaaagccuaaacuuaccc

SEQ ID NO: 250783 - RNA, 18 nt, Human
cgggaggagcccggggca

SEQ ID NO: 250784 - RNA, 18 nt, Human
cgucaacaggacacgaag

SEQ ID NO: 250785 - RNA, 22 nt, Human
cucaccccaccccaggggauuc

SEQ ID NO: 250786 - RNA, 18 nt, Human
cuccauggcccauccugc

SEQ ID NO: 250787 - RNA, 18 nt, Human
cuccaugucuccuccccu

SEQ ID NO: 250788 - RNA, 25 nt, Human
cucgcccugccccaggacccaggaa

SEQ ID NO: 250789 - RNA, 22 nt, Human
cucuuccucaccaccucccucc

SEQ ID NO: 250790 - RNA, 24 nt, Human
cuugcccacugucccugaaagcug

SEQ ID NO: 250791 - RNA, 18 nt, Human
cuuggacucgcccugccc

SEQ ID NO: 250792 - RNA, 19 nt, Human
gaaacauccacacauggua

SEQ ID NO: 250793 - RNA, 20 nt, Human
gaaagaguuuucaaacaaaa

SEQ ID NO: 250794 - RNA, 21 nt, Human
gaacaagauuacacccuggcu

SEQ ID NO: 250795 - RNA, 21 nt, Human
gacacgaagcacaagaaagga

SEQ ID NO: 250796 - RNA, 23 nt, Human
gagcccggggcagggaagggcgg

SEQ ID NO: 250797 - RNA, 18 nt, Human
gaggagcccggggcaggg

SEQ ID NO: 250798 - RNA, 18 nt, Human
gaggugggaaggcuggac

SEQ ID NO: 250799 - RNA, 18 nt, Human
gcccaggagccccuaccc

SEQ ID NO: 250800 - RNA, 19 nt, Human
gcccaggagccccuacccc

SEQ ID NO: 250801 - RNA, 18 nt, Human
gcccauccugccccuccc

SEQ ID NO: 250802 - RNA, 19 nt, Human
gcccucacccccaccccgu

SEQ ID NO: 250803 - RNA, 22 nt, Human
ggcaaagagcggguagcccucg

SEQ ID NO: 250804 - RNA, 20 nt, Human
ggcagggaagggcgggcggu

SEQ ID NO: 250805 - RNA, 23 nt, Human
ggcugggagggggucagggguca

SEQ ID NO: 250806 - RNA, 20 nt, Human
gggaauagccugagaaggga

SEQ ID NO: 250807 - RNA, 22 nt, Human
gggaggggcucgcuggguggug

SEQ ID NO: 250808 - RNA, 23 nt, Human
ggggaggggcucgcuggguggug

SEQ ID NO: 250809 - RNA, 22 nt, Human
ggggagggggagggccauuaga

SEQ ID NO: 250810 - RNA, 24 nt, Human
ggggcagggaagggcgggcgguga

SEQ ID NO: 250811 - RNA, 18 nt, Human
gggguugggggaagaggg

SEQ ID NO: 250812 - RNA, 24 nt, Human
gguccucagugcuacggaggggag

SEQ ID NO: 250813 - RNA, 19 nt, Human
gguggaggcgaauuuggcu

SEQ ID NO: 250814 - RNA, 23 nt, Human
gguggggggggguguccucuugc

SEQ ID NO: 250815 - RNA, 19 nt, Human
gucacggcaaagagcgggu

SEQ ID NO: 250816 - RNA, 23 nt, Human
gugcucaguucauggucugcagg

SEQ ID NO: 250817 - RNA, 25 nt, Human
gugcuguugagggggggagaauggu

SEQ ID NO: 250818 - RNA, 24 nt, Human
uaaccgucaacaggacacgaagca

SEQ ID NO: 250819 - RNA, 20 nt, Human
uacuccaggaacugugucaa

SEQ ID NO: 250820 - RNA, 21 nt, Human
uacugaacugcagaaauguca

SEQ ID NO: 250821 - RNA, 26 nt, Human
ucaacuauucacccauucagcauuua

SEQ ID NO: 250822 - RNA, 21 nt, Human
ucccaggcuccaugucuccuc

SEQ ID NO: 250823 - RNA, 19 nt, Human
ucccugaaagcugugggaa

SEQ ID NO: 250824 - RNA, 20 nt, Human
uccucaccaccucccucccu

SEQ ID NO: 250825 - RNA, 21 nt, Human
uccuucuaccaacugcuuuaa

SEQ ID NO: 250826 - RNA, 23 nt, Human
ugaaagaguuuucaaacaaaacu

SEQ ID NO: 250827 - RNA, 22 nt, Human
ugaaagcugugggaaaccuggg

SEQ ID NO: 250828 - RNA, 23 nt, Human
ugacuccagugguuacuuuggca

SEQ ID NO: 250829 - RNA, 24 nt, Human
ugagcaccuaucauucaacuauuc

SEQ ID NO: 250830 - RNA, 21 nt, Human
ugagguggugggggggggugu

SEQ ID NO: 250831 - RNA, 20 nt, Human
ugaguaagugaucacugcuc

SEQ ID NO: 250832 - RNA, 18 nt, Human
ugauugucaggugugggg

SEQ ID NO: 250833 - RNA, 22 nt, Human
ugcaugaacaagauuacacccu

SEQ ID NO: 250834 - RNA, 22 nt, Human
ugcucagcugagggagaagcuu

SEQ ID NO: 250835 - RNA, 21 nt, Human
ugcucugaaagcaggucuggg

SEQ ID NO: 250836 - RNA, 22 nt, Human
ugcuuuaagggguggggagagg

SEQ ID NO: 250837 - RNA, 19 nt, Human
uggcuugagaggaagaaga

SEQ ID NO: 250838 - RNA, 20 nt, Human
ugggaaaccuggggaggggg

SEQ ID NO: 250839 - RNA, 23 nt, Human
ugggaaaccuggggagggggagg

SEQ ID NO: 250840 - RNA, 25 nt, Human
ugggaaaccuggggagggggagggc

SEQ ID NO: 250841 - RNA, 21 nt, Human
ugggaaggcuggacgugcugu

SEQ ID NO: 250842 - RNA, 20 nt, Human
ugggggaagaggguacucca

SEQ ID NO: 250843 - RNA, 23 nt, Human
uguuccacugagguggugggggg

SEQ ID NO: 250844 - RNA, 19 nt, Human
uucacagaccaccccaucc

SEQ ID NO: 250845 - RNA, 19 nt, Human
uucagagggagugggugga

SEQ ID NO: 250846 - RNA, 21 nt, Human
uugagaggaagaagacauuaa

SEQ ID NO: 250847 - RNA, 19 nt, Human
aaaaauacaagaaaaccag

SEQ ID NO: 250848 - RNA, 21 nt, Human
aaauacuucuaucccaaucca

SEQ ID NO: 250849 - RNA, 20 nt, Human
aacaugaugaaaccucaugu

SEQ ID NO: 250850 - RNA, 20 nt, Human
aacauggugaaacccccguc

SEQ ID NO: 250851 - RNA, 21 nt, Human
aacauggugaaacccccgucu

SEQ ID NO: 250852 - RNA, 22 nt, Human
aacauggugaaacccccgucuc

SEQ ID NO: 250853 - RNA, 19 nt, Human
aaccagccugguguggugg

SEQ ID NO: 250854 - RNA, 21 nt, Human
aagaaaaccagccuggugugg

SEQ ID NO: 250855 - RNA, 22 nt, Human
aagacagaagcagagagaacaa

SEQ ID NO: 250856 - RNA, 23 nt, Human
aagagcaaaacuuugucucaaaa

SEQ ID NO: 250857 - RNA, 24 nt, Human
aaucgcuugaaccugggaggugga

SEQ ID NO: 250858 - RNA, 24 nt, Human
aaucucuugaaccugggaggcgga

SEQ ID NO: 250859 - RNA, 24 nt, Human
aaucuucuguucaggagcaccuga

SEQ ID NO: 250860 - RNA, 24 nt, Human
acagagcaagauuuggucucaaaa

SEQ ID NO: 250861 - RNA, 19 nt, Human
accacugcacuccagccug

SEQ ID NO: 250862 - RNA, 24 nt, Human
accacugcacuccagccuggguga

SEQ ID NO: 250863 - RNA, 24 nt, Human
accugaggucaggaguucgagacc

SEQ ID NO: 250864 - RNA, 24 nt, Human
accugaggucaggaguuugagacc

SEQ ID NO: 250865 - RNA, 22 nt, Human
acuaaaaauacaagaaaaccag

SEQ ID NO: 250866 - RNA, 19 nt, Human
acuccagccugggccacag

SEQ ID NO: 250867 - RNA, 24 nt, Human
acuccagccugggccacagagcaa

SEQ ID NO: 250868 - RNA, 18 nt, Human
acugcacuccagccuggg

SEQ ID NO: 250869 - RNA, 18 nt, Human
acugcacuccagccuggg

SEQ ID NO: 250870 - RNA, 24 nt, Human
acugcacuccagccugggccacag

SEQ ID NO: 250871 - RNA, 24 nt, Human
acugcacuccagccugggugacaa

SEQ ID NO: 250872 - RNA, 25 nt, Human
acugcacuccagccugggugacaag

SEQ ID NO: 250873 - RNA, 20 nt, Human
agaacaaggggacauauauu

SEQ ID NO: 250874 - RNA, 19 nt, Human
agacagaagcagagagaac

SEQ ID NO: 250875 - RNA, 23 nt, Human
agacagaagcagagagaacaagg

SEQ ID NO: 250876 - RNA, 24 nt, Human
agcacuuugggaggcugaggcggg

SEQ ID NO: 250877 - RNA, 22 nt, Human
agccuggcuaacauggugaaac

SEQ ID NO: 250878 - RNA, 24 nt, Human
agccuggcuaacauggugaaaccc

SEQ ID NO: 250879 - RNA, 24 nt, Human
agccugggccacagagcaagauuu

SEQ ID NO: 250880 - RNA, 22 nt, Human
aggcaggagaaucgcuugaacc

SEQ ID NO: 250881 - RNA, 24 nt, Human
aggcaggagaaucgcuugaaccug

SEQ ID NO: 250882 - RNA, 22 nt, Human
aggcaggagaaucucuugaacc

SEQ ID NO: 250883 - RNA, 24 nt, Human
aggcaggagaaucucuugaaccug

SEQ ID NO: 250884 - RNA, 24 nt, Human
aggcaugguggcucaugccuguaa

SEQ ID NO: 250885 - RNA, 19 nt, Human
aggccagaagcaggaagag

SEQ ID NO: 250886 - RNA, 24 nt, Human
aggcggagguugcagugagccaag

SEQ ID NO: 250887 - RNA, 22 nt, Human
aggcggguggaucaccugaggu

SEQ ID NO: 250888 - RNA, 26 nt, Human
aggcggguggaucaccugaggucagg

SEQ ID NO: 250889 - RNA, 20 nt, Human
aggcugaggcaggagaaucg

SEQ ID NO: 250890 - RNA, 24 nt, Human
aggcugaggcaggagaaucgcuug

SEQ ID NO: 250891 - RNA, 24 nt, Human
aggcugaggcaggagaaucucuug

SEQ ID NO: 250892 - RNA, 21 nt, Human
aggcugaggcggguggaucac

SEQ ID NO: 250893 - RNA, 24 nt, Human
aggcugaggcggguggaucaccug

SEQ ID NO: 250894 - RNA, 20 nt, Human
agguggagguugcagugagc

SEQ ID NO: 250895 - RNA, 24 nt, Human
agguggagguugcagugagcugag

SEQ ID NO: 250896 - RNA, 22 nt, Human
aggugggugcaucaccugaggu

SEQ ID NO: 250897 - RNA, 23 nt, Human
aguggcucaugccuguaauccca

SEQ ID NO: 250898 - RNA, 24 nt, Human
aguggcucaugccuguaaucccag

SEQ ID NO: 250899 - RNA, 24 nt, Human
auaggccgggcacaguggcucaug

SEQ ID NO: 250900 - RNA, 19 nt, Human
auaguucauuaauccaggu

SEQ ID NO: 250901 - RNA, 24 nt, Human
aucaccugaggucaggaguucgag

SEQ ID NO: 250902 - RNA, 24 nt, Human
aucaccugaggucaggaguuugag

SEQ ID NO: 250903 - RNA, 23 nt, Human
auccuugccgugggguucugagg

SEQ ID NO: 250904 - RNA, 24 nt, Human
aucgugccacugcacuccagccug

SEQ ID NO: 250905 - RNA, 19 nt, Human
augccuguaaucccagcac

SEQ ID NO: 250906 - RNA, 24 nt, Human
auugcaccacugcacuccagccug

SEQ ID NO: 250907 - RNA, 28 nt, Human
auuuggucucaaaaaaaaaaaaaaaaaa

SEQ ID NO: 250908 - RNA, 24 nt, Human
caagaaaaccagccugguguggug

SEQ ID NO: 250909 - RNA, 21 nt, Human
caagacagaagcagagagaac

SEQ ID NO: 250910 - RNA, 20 nt, Human
caccacugcacuccagccug

SEQ ID NO: 250911 - RNA, 26 nt, Human
caccacugcacuccagccugggugac

SEQ ID NO: 250912 - RNA, 23 nt, Human
caccugaggucaggaguucgaga

SEQ ID NO: 250913 - RNA, 23 nt, Human
caccugaggucaggaguuugaga

SEQ ID NO: 250914 - RNA, 21 nt, Human
caccuguaaucccagcugcuc

SEQ ID NO: 250915 - RNA, 24 nt, Human
caccuguaaucccagcugcucagg

SEQ ID NO: 250916 - RNA, 23 nt, Human
cacuccagccugggccacagagc

SEQ ID NO: 250917 - RNA, 20 nt, Human
cacuccagccugggugacaa

SEQ ID NO: 250918 - RNA, 21 nt, Human
cacuccagccugggugacaag

SEQ ID NO: 250919 - RNA, 24 nt, Human
cacuccagccugggugacaagagc

SEQ ID NO: 250920 - RNA, 18 nt, Human
cacugcacuccagccugg

SEQ ID NO: 250921 - RNA, 19 nt, Human
cacugcacuccagccuggg

SEQ ID NO: 250922 - RNA, 19 nt, Human
cacugcacuccagccuggg

SEQ ID NO: 250923 - RNA, 22 nt, Human
cacugcacuccagccugggcca

SEQ ID NO: 250924 - RNA, 24 nt, Human
cacugcacuccagccugggccaca

SEQ ID NO: 250925 - RNA, 21 nt, Human
cacugcacuccagccugggug

SEQ ID NO: 250926 - RNA, 22 nt, Human
cacugcacuccagccuggguga

SEQ ID NO: 250927 - RNA, 23 nt, Human
cacugcacuccagccugggugac

SEQ ID NO: 250928 - RNA, 24 nt, Human
cacugcacuccagccugggugaca

SEQ ID NO: 250929 - RNA, 25 nt, Human
cacugcacuccagccugggugacaa

SEQ ID NO: 250930 - RNA, 24 nt, Human
cagcacuuugggaggcugaggcgg

SEQ ID NO: 250931 - RNA, 24 nt, Human
cagcugcucaggaggcugaggcag

SEQ ID NO: 250932 - RNA, 24 nt, Human
caucaccugaggucaggaguuuga

SEQ ID NO: 250933 - RNA, 20 nt, Human
caugccuguaaucccagcac

SEQ ID NO: 250934 - RNA, 24 nt, Human
caugccuguaaucccagcacuuug

SEQ ID NO: 250935 - RNA, 24 nt, Human
caugccuguaaucccugcacuuug

SEQ ID NO: 250936 - RNA, 24 nt, Human
cauggccaggcaugguggcucaug

SEQ ID NO: 250937 - RNA, 18 nt, Human
ccacugcacuccagccug

SEQ ID NO: 250938 - RNA, 20 nt, Human
ccacugcacuccagccuggg

SEQ ID NO: 250939 - RNA, 20 nt, Human
ccacugcacuccagccuggg

SEQ ID NO: 250940 - RNA, 20 nt, Human
ccacugcacuccagccuggg

SEQ ID NO: 250941 - RNA, 21 nt, Human
ccacugcacuccagccugggc

SEQ ID NO: 250942 - RNA, 24 nt, Human
ccacugcacuccagccugggccac

SEQ ID NO: 250943 - RNA, 21 nt, Human
ccacugcacuccagccugggu

SEQ ID NO: 250944 - RNA, 21 nt, Human
ccacugcacuccagccugggu

SEQ ID NO: 250945 - RNA, 24 nt, Human
ccacugcacuccagccugggugac

SEQ ID NO: 250946 - RNA, 25 nt, Human
ccacugcacuccagccugggugaca

SEQ ID NO: 250947 - RNA, 19 nt, Human
cccaauccagucugcuugc

SEQ ID NO: 250948 - RNA, 23 nt, Human
ccccgucucuacuaaaaauacaa

SEQ ID NO: 250949 - RNA, 23 nt, Human
ccguacuuccuccucugaaaucc

SEQ ID NO: 250950 - RNA, 23 nt, Human
ccucaagacagaagcagagagaa

SEQ ID NO: 250951 - RNA, 18 nt, Human
ccucugaaauccauggug

SEQ ID NO: 250952 - RNA, 22 nt, Human
ccugaggucaggaguucgagac

SEQ ID NO: 250953 - RNA, 22 nt, Human
ccugaggucaggaguuugagac

SEQ ID NO: 250954 - RNA, 24 nt, Human
ccuggccaacaugaugaaaccuca

SEQ ID NO: 250955 - RNA, 23 nt, Human
ccuggcuaacauggugaaacccc

SEQ ID NO: 250956 - RNA, 25 nt, Human
ccuggcuaacauggugaaacccccg

SEQ ID NO: 250957 - RNA, 19 nt, Human
ccugggaggcggagguugc

SEQ ID NO: 250958 - RNA, 21 nt, Human
ccugggagguggagguugcag

SEQ ID NO: 250959 - RNA, 19 nt, Human
ccugggccacagagcaaga

SEQ ID NO: 250960 - RNA, 22 nt, Human
ccuguaaucccagcuacuucgg

SEQ ID NO: 250961 - RNA, 21 nt, Human
ccuguaaucccagcugcucag

SEQ ID NO: 250962 - RNA, 22 nt, Human
ccuguaaucccugcacuuuggg

SEQ ID NO: 250963 - RNA, 24 nt, Human
cgagaccagccuggcuaacauggu

SEQ ID NO: 250964 - RNA, 20 nt, Human
cgcaccuguaaucccagcug

SEQ ID NO: 250965 - RNA, 24 nt, Human
cgccuguaaucccagcuacuucgg

SEQ ID NO: 250966 - RNA, 24 nt, Human
cggguggaucaccugaggucagga

SEQ ID NO: 250967 - RNA, 18 nt, Human
cucaaaaaaaaaaaaaaa

SEQ ID NO: 250968 - RNA, 18 nt, Human
cucaaaaaaaaaaaaaaa

SEQ ID NO: 250969 - RNA, 18 nt, Human
cucaaaaaaaaaaaaaaa

SEQ ID NO: 250970 - RNA, 18 nt, Human
cucaaaaaaaaaaaaaaa

SEQ ID NO: 250971 - RNA, 24 nt, Human
cucaaaaaaaaaaaaaaaaaagaa

SEQ ID NO: 250972 - RNA, 26 nt, Human
cucaaaaaaaaaaaaaaaaaagaauc

SEQ ID NO: 250973 - RNA, 22 nt, Human
cucaagacagaagcagagagaa

SEQ ID NO: 250974 - RNA, 24 nt, Human
cucaugccuguaaucccagcacuu

SEQ ID NO: 250975 - RNA, 24 nt, Human
cucaugccuguaaucccugcacuu

SEQ ID NO: 250976 - RNA, 18 nt, Human
cucgagccagcugucugg

SEQ ID NO: 250977 - RNA, 24 nt, Human
cucuacuaaaaauacaagaaaacc

SEQ ID NO: 250978 - RNA, 24 nt, Human
cugcacuuugggaggcugaggugg

SEQ ID NO: 250979 - RNA, 21 nt, Human
cuguaaucccagcugcucagg

SEQ ID NO: 250980 - RNA, 19 nt, Human
cuugaaccugggaggugga

SEQ ID NO: 250981 - RNA, 23 nt, Human
gagaaucgcuugaaccugggagg

SEQ ID NO: 250982 - RNA, 20 nt, Human
gagaccggccuggccaacau

SEQ ID NO: 250983 - RNA, 21 nt, Human
gagaggcucgagccagcuguc

SEQ ID NO: 250984 - RNA, 23 nt, Human
gagaucgugccacugcacuccag

SEQ ID NO: 250985 - RNA, 20 nt, Human
gagcaagauuuggucucaaa

SEQ ID NO: 250986 - RNA, 19 nt, Human
gagcaggagaggcucgagc

SEQ ID NO: 250987 - RNA, 18 nt, Human
gagguugcagugagccaa

SEQ ID NO: 250988 - RNA, 21 nt, Human
gagguugcagugagccaagau

SEQ ID NO: 250989 - RNA, 23 nt, Human
gagguugcagugagccaagauug

SEQ ID NO: 250990 - RNA, 23 nt, Human
gagguugcagugagcugagaucg

SEQ ID NO: 250991 - RNA, 21 nt, Human
gaucaccugaggucaggaguu

SEQ ID NO: 250992 - RNA, 24 nt, Human
gaucaccugaggucaggaguucga

SEQ ID NO: 250993 - RNA, 24 nt, Human
gcacuccagccugggccacagagc

SEQ ID NO: 250994 - RNA, 19 nt, Human
gcacuuugggaggcugagg

SEQ ID NO: 250995 - RNA, 23 nt, Human
gcacuuugggaggcugagguggg

SEQ ID NO: 250996 - RNA, 20 nt, Human
gcaggaagagagaugcagug

SEQ ID NO: 250997 - RNA, 22 nt, Human
gcaucaccugaggucaggaguu

SEQ ID NO: 250998 - RNA, 22 nt, Human
gccacugcacuccagccugggc

SEQ ID NO: 250999 - RNA, 22 nt, Human
gccaggcaugguggcucaugcc

SEQ ID NO: 251000 - RNA, 22 nt, Human
gccuggccaacaugaugaaacc

SEQ ID NO: 251001 - RNA, 25 nt, Human
gcuaacauggugaaacccccgucuc

SEQ ID NO: 251002 - RNA, 20 nt, Human
gcugagaucgugccacugca

SEQ ID NO: 251003 - RNA, 22 nt, Human
ggagguugcagugagccaagau

SEQ ID NO: 251004 - RNA, 24 nt, Human
ggagguugcagugagccaagauug

SEQ ID NO: 251005 - RNA, 22 nt, Human
ggagguugcagugagcugagau

SEQ ID NO: 251006 - RNA, 23 nt, Human
ggagguugcagugagcugagauc

SEQ ID NO: 251007 - RNA, 24 nt, Human
ggagguugcagugagcugagaucg

SEQ ID NO: 251008 - RNA, 23 nt, Human
ggcacaguggcucaugccuguaa

SEQ ID NO: 251009 - RNA, 23 nt, Human
ggcaugguggcgggcgccuguaa

SEQ ID NO: 251010 - RNA, 23 nt, Human
ggccgggcacaguggcucaugcc

SEQ ID NO: 251011 - RNA, 18 nt, Human
gggcacaguggcucaugc

SEQ ID NO: 251012 - RNA, 18 nt, Human
ggucaggaguuugagacc

SEQ ID NO: 251013 - RNA, 19 nt, Human
gguggagguugcagugagc

SEQ ID NO: 251014 - RNA, 24 nt, Human
gguggcacgcaccuguaaucccag

SEQ ID NO: 251015 - RNA, 24 nt, Human
gguggcgggcgccuguaaucccag

SEQ ID NO: 251016 - RNA, 24 nt, Human
gguggcucaugccuguaaucccug

SEQ ID NO: 251017 - RNA, 20 nt, Human
guggagguugcagugagcug

SEQ ID NO: 251018 - RNA, 24 nt, Human
guugcagugagcugagaucgugcc

SEQ ID NO: 251019 - RNA, 19 nt, Human
uaaaaauacaagaaaacca

SEQ ID NO: 251020 - RNA, 24 nt, Human
uaaaaauacaagaaaaccagccug

SEQ ID NO: 251021 - RNA, 23 nt, Human
uaacauggugaaacccccgucuc

SEQ ID NO: 251022 - RNA, 25 nt, Human
uaacauggugaaacccccgucucua

SEQ ID NO: 251023 - RNA, 21 nt, Human
uacacaaauacuucuauccca

SEQ ID NO: 251024 - RNA, 19 nt, Human
uacuucggaggcugaggca

SEQ ID NO: 251025 - RNA, 22 nt, Human
uaucccaauccagucugcuugc

SEQ ID NO: 251026 - RNA, 20 nt, Human
ucaaaaaaaaaaaaaaaaaa

SEQ ID NO: 251027 - RNA, 24 nt, Human
ucaaaaaaaaaaaaaaaaaagaau

SEQ ID NO: 251028 - RNA, 21 nt, Human
ucaagacagaagcagagagaa

SEQ ID NO: 251029 - RNA, 25 nt, Human
ucaagacagaagcagagagaacaac

SEQ ID NO: 251030 - RNA, 22 nt, Human
ucaugccuguaaucccagcacu

SEQ ID NO: 251031 - RNA, 22 nt, Human
ucaugccuguaaucccugcacu

SEQ ID NO: 251032 - RNA, 19 nt, Human
uccagccugggugacaaga

SEQ ID NO: 251033 - RNA, 19 nt, Human
ucccugcacuuugggaggc

SEQ ID NO: 251034 - RNA, 24 nt, Human
ucgcuugaaccugggagguggagg

SEQ ID NO: 251035 - RNA, 19 nt, Human
ucucaaaaaaaaaaaaaaa

SEQ ID NO: 251036 - RNA, 19 nt, Human
ucucaaaaaaaaaaaaaaa

SEQ ID NO: 251037 - RNA, 24 nt, Human
ucucaaaaaaaaaaaaaaaaaauc

SEQ ID NO: 251038 - RNA, 18 nt, Human
ucucuacuaaaaauacaa

SEQ ID NO: 251039 - RNA, 22 nt, Human
ucucuugaaccugggaggcgga

SEQ ID NO: 251040 - RNA, 24 nt, Human
ucucuugaaccugggaggcggagg

SEQ ID NO: 251041 - RNA, 24 nt, Human
ugaaccugggaggcggagguugca

SEQ ID NO: 251042 - RNA, 24 nt, Human
ugaaccugggagguggagguugca

SEQ ID NO: 251043 - RNA, 21 nt, Human
ugaaugcaagauacaaggcca

SEQ ID NO: 251044 - RNA, 24 nt, Human
ugaaugcaagauacaaggccagaa

SEQ ID NO: 251045 - RNA, 23 nt, Human
ugagaccggccuggccaacauga

SEQ ID NO: 251046 - RNA, 22 nt, Human
ugagcugagaucgugccacugc

SEQ ID NO: 251047 - RNA, 20 nt, Human
ugaggcaggagaaucgcuug

SEQ ID NO: 251048 - RNA, 24 nt, Human
ugaggcaggagaaucgcuugaacc

SEQ ID NO: 251049 - RNA, 25 nt, Human
ugaggcaggagaaucgcuugaaccu

SEQ ID NO: 251050 - RNA, 20 nt, Human
ugaggcaggagaaucucuug

SEQ ID NO: 251051 - RNA, 24 nt, Human
ugaggcaggagaaucucuugaacc

SEQ ID NO: 251052 - RNA, 25 nt, Human
ugaggcaggagaaucucuugaaccu

SEQ ID NO: 251053 - RNA, 20 nt, Human
ugaggcggguggaucaccug

SEQ ID NO: 251054 - RNA, 22 nt, Human
ugaggcggguggaucaccugag

SEQ ID NO: 251055 - RNA, 24 nt, Human
ugaggcggguggaucaccugaggu

SEQ ID NO: 251056 - RNA, 26 nt, Human
ugaggcggguggaucaccugagguca

SEQ ID NO: 251057 - RNA, 22 nt, Human
ugagggaaaaugagggccaaau

SEQ ID NO: 251058 - RNA, 18 nt, Human
ugaggucaggaguuugag

SEQ ID NO: 251059 - RNA, 20 nt, Human
ugaggugggugcaucaccug

SEQ ID NO: 251060 - RNA, 24 nt, Human
ugaggugggugcaucaccugaggu

SEQ ID NO: 251061 - RNA, 26 nt, Human
ugaggugggugcaucaccugagguca

SEQ ID NO: 251062 - RNA, 21 nt, Human
ugcaccacugcacuccagccu

SEQ ID NO: 251063 - RNA, 24 nt, Human
ugcaucaccugaggucaggaguuu

SEQ ID NO: 251064 - RNA, 18 nt, Human
ugccgugggguucugagg

SEQ ID NO: 251065 - RNA, 23 nt, Human
ugccuguaaucccagcacuuugg

SEQ ID NO: 251066 - RNA, 24 nt, Human
ugccuguaaucccagcacuuuggg

SEQ ID NO: 251067 - RNA, 23 nt, Human
ugccuguaaucccugcacuuugg

SEQ ID NO: 251068 - RNA, 22 nt, Human
ugcuugcguuucucuaggcuuc

SEQ ID NO: 251069 - RNA, 24 nt, Human
uggaucaccugaggucaggaguuc

SEQ ID NO: 251070 - RNA, 27 nt, Human
uggaucaccugaggucaggaguucgag

SEQ ID NO: 251071 - RNA, 24 nt, Human
uggccaggcaugguggcucaugcc

SEQ ID NO: 251072 - RNA, 24 nt, Human
uggcucaugccuguaaucccagca

SEQ ID NO: 251073 - RNA, 24 nt, Human
uggcucaugccuguaaucccugca

SEQ ID NO: 251074 - RNA, 29 nt, Human
ugggaggcggagguugcagugacaacggu

SEQ ID NO: 251075 - RNA, 24 nt, Human
ugggaggcggagguugcagugagc

SEQ ID NO: 251076 - RNA, 20 nt, Human
ugggaggcugaggcgggugg

SEQ ID NO: 251077 - RNA, 23 nt, Human
ugggaggcugaggcggguggauc

SEQ ID NO: 251078 - RNA, 24 nt, Human
ugggaggcugaggcggguggauca

SEQ ID NO: 251079 - RNA, 19 nt, Human
ugggaggcugaggugggug

SEQ ID NO: 251080 - RNA, 18 nt, Human
ugggagguggagguugca

SEQ ID NO: 251081 - RNA, 29 nt, Human
ugggagguggagguugcagugacaacggu

SEQ ID NO: 251082 - RNA, 24 nt, Human
ugggagguggagguugcagugagc

SEQ ID NO: 251083 - RNA, 21 nt, Human
ugggguucugagggaaaauga

SEQ ID NO: 251084 - RNA, 24 nt, Human
ugggugcaucaccugaggucagga

SEQ ID NO: 251085 - RNA, 20 nt, Human
uggucucaaaaaaaaaaaaa

SEQ ID NO: 251086 - RNA, 24 nt, Human
ugguggcacgcaccuguaauccca

SEQ ID NO: 251087 - RNA, 24 nt, Human
ugguggcgggcgccuguaauccca

SEQ ID NO: 251088 - RNA, 23 nt, Human
ugguggcucaugccuguaauccc

SEQ ID NO: 251089 - RNA, 24 nt, Human
uggugugguggcacgcaccuguaa

SEQ ID NO: 251090 - RNA, 24 nt, Human
ugucuacuaaaaaugcaaaaaauu

SEQ ID NO: 251091 - RNA, 18 nt, Human
uuagccgggcaugguggc

SEQ ID NO: 251092 - RNA, 22 nt, Human
uuccuaacuuaccucugcuaua

SEQ ID NO: 251093 - RNA, 24 nt, Human
uugaaccugggaggcggagguugc

SEQ ID NO: 251094 - RNA, 24 nt, Human
uugaaccugggagguggagguugc

SEQ ID NO: 251095 - RNA, 22 nt, Human
uugcagugagccaagauugcac

SEQ ID NO: 251096 - RNA, 18 nt, Human
uugcagugagcugagauc

SEQ ID NO: 251097 - RNA, 21 nt, Human
uugcagugagcugagaucgug

SEQ ID NO: 251098 - RNA, 22 nt, Human
uugcagugagcugagaucgugc

SEQ ID NO: 251099 - RNA, 25 nt, Human
uugggaggcugaggcggguggauca

SEQ ID NO: 251100 - RNA, 21 nt, Human
uuggucucaaaaaaaaaaaaa

SEQ ID NO: 251101 - RNA, 22 nt, Human
uuucccauagcagcuagcaccu

SEQ ID NO: 251102 - RNA, 22 nt, Human
aaacaggaagugauguauaagg

SEQ ID NO: 251103 - RNA, 23 nt, Human
aaagagagagaaagagagagagc

SEQ ID NO: 251104 - RNA, 24 nt, Human
aacaguauaauagcauuuacaaua

SEQ ID NO: 251105 - RNA, 18 nt, Human
aagaaacaacguaauaug

SEQ ID NO: 251106 - RNA, 22 nt, Human
aagaauggaacuccacagucau

SEQ ID NO: 251107 - RNA, 24 nt, Human
aauccugcaaaucagaccuuccug

SEQ ID NO: 251108 - RNA, 19 nt, Human
aaugcauauucccuuaagc

SEQ ID NO: 251109 - RNA, 23 nt, Human
aauuuauuuacaaugucuacaua

SEQ ID NO: 251110 - RNA, 18 nt, Human
agagaaagagagagagcg

SEQ ID NO: 251111 - RNA, 22 nt, Human
agaggaaaagagagagaaagag

SEQ ID NO: 251112 - RNA, 21 nt, Human
agguggugguuguugcauggg

SEQ ID NO: 251113 - RNA, 22 nt, Human
aguuauuuuaaugcucuaaaaa

SEQ ID NO: 251114 - RNA, 22 nt, Human
auacaguucauuuuuccagucc

SEQ ID NO: 251115 - RNA, 18 nt, Human
caagccccaggcuagaaa

SEQ ID NO: 251116 - RNA, 22 nt, Human
caagccccaggcuagaaagagg

SEQ ID NO: 251117 - RNA, 21 nt, Human
caaugcauauucccuuaagcu

SEQ ID NO: 251118 - RNA, 21 nt, Human
cacagucauugcagaaaaaac

SEQ ID NO: 251119 - RNA, 18 nt, Human
cacuguuggguggugagg

SEQ ID NO: 251120 - RNA, 21 nt, Human
caguucauuuuuccaguccuu

SEQ ID NO: 251121 - RNA, 21 nt, Human
caugaccgaugcuuugcucag

SEQ ID NO: 251122 - RNA, 20 nt, Human
ccccgggcuacauacucccc

SEQ ID NO: 251123 - RNA, 21 nt, Human
ccuuccugucccuugcaggau

SEQ ID NO: 251124 - RNA, 19 nt, Human
cucccuuccuacuucaacu

SEQ ID NO: 251125 - RNA, 18 nt, Human
gaugcuccuugguccaga

SEQ ID NO: 251126 - RNA, 19 nt, Human
ggaaaagagagagaaagag

SEQ ID NO: 251127 - RNA, 28 nt, Human
ggauaacuguaaggcuuuuuaauguaag

SEQ ID NO: 251128 - RNA, 23 nt, Human
gggcaucugggguuggguauaac

SEQ ID NO: 251129 - RNA, 19 nt, Human
gguccagaguagaugccaa

SEQ ID NO: 251130 - RNA, 19 nt, Human
uaccagucuccuuaagaca

SEQ ID NO: 251131 - RNA, 20 nt, Human
uaggcuucuaaacacacggc

SEQ ID NO: 251132 - RNA, 24 nt, Human
ucaguugguauuuccugcuuuuua

SEQ ID NO: 251133 - RNA, 18 nt, Human
uccacagucauugcagaa

SEQ ID NO: 251134 - RNA, 24 nt, Human
uccaugcaucaucacuguugggug

SEQ ID NO: 251135 - RNA, 19 nt, Human
ucccuuaagcuacugagca

SEQ ID NO: 251136 - RNA, 22 nt, Human
ugaaaucagucaccauugcaga

SEQ ID NO: 251137 - RNA, 18 nt, Human
ugaagagcuauggaaaca

SEQ ID NO: 251138 - RNA, 25 nt, Human
ugacuucaguugguauuuccugcuu

SEQ ID NO: 251139 - RNA, 19 nt, Human
ugagcaggaugggggggca

SEQ ID NO: 251140 - RNA, 23 nt, Human
ugagcaugaauguccaugacuug

SEQ ID NO: 251141 - RNA, 23 nt, Human
ugcagaaaaaacaugauuugaaa

SEQ ID NO: 251142 - RNA, 26 nt, Human
ugcagaaaaaacaugauuugaaauca

SEQ ID NO: 251143 - RNA, 21 nt, Human
ugccaagaauggaacuccaca

SEQ ID NO: 251144 - RNA, 20 nt, Human
uggaaacaacacacauagug

SEQ ID NO: 251145 - RNA, 28 nt, Human
uguaaggaggcuucuggaggaagugaag

SEQ ID NO: 251146 - RNA, 21 nt, Human
uugcagccuucccccuugcuu

SEQ ID NO: 251147 - RNA, 25 nt, Human
aaaaaagcccagucuagacaacgaa

SEQ ID NO: 251148 - RNA, 21 nt, Human
aaaaagcccagucuagacaac

SEQ ID NO: 251149 - RNA, 21 nt, Human
aacacauucugaagcuggagu

SEQ ID NO: 251150 - RNA, 24 nt, Human
aagaauucauggacauacaauacc

SEQ ID NO: 251151 - RNA, 20 nt, Human
aagcccagucuagacaaccg

SEQ ID NO: 251152 - RNA, 24 nt, Human
aagcccagucuagacaacgaagaa

SEQ ID NO: 251153 - RNA, 21 nt, Human
aaugacaaaaguaaaaaauaa

SEQ ID NO: 251154 - RNA, 19 nt, Human
acacaaagcuccccauggg

SEQ ID NO: 251155 - RNA, 19 nt, Human
acacacauaguguggaaaa

SEQ ID NO: 251156 - RNA, 20 nt, Human
acacauaguguggaaaacaa

SEQ ID NO: 251157 - RNA, 24 nt, Human
acauuuauggaggaacaaaggccg

SEQ ID NO: 251158 - RNA, 22 nt, Human
acugaugaaccaaaacagucau

SEQ ID NO: 251159 - RNA, 23 nt, Human
agaaaagaagaauucauggacau

SEQ ID NO: 251160 - RNA, 22 nt, Human
agaccgaacucuguacgaaguu

SEQ ID NO: 251161 - RNA, 18 nt, Human
agauuccuuuuuuuuuuu

SEQ ID NO: 251162 - RNA, 21 nt, Human
agccaaaaguucaucaugauc

SEQ ID NO: 251163 - RNA, 21 nt, Human
aguaaaaaauaaucacagcug

SEQ ID NO: 251164 - RNA, 18 nt, Human
auauaccacagucucucc

SEQ ID NO: 251165 - RNA, 24 nt, Human
caaagcuccccaugggcugacccu

SEQ ID NO: 251166 - RNA, 18 nt, Human
caaauaugaaugcauugg

SEQ ID NO: 251167 - RNA, 18 nt, Human
cacaaccaaggcucagaa

SEQ ID NO: 251168 - RNA, 23 nt, Human
cacauagaauaucuaacaugaaa

SEQ ID NO: 251169 - RNA, 18 nt, Human
caugcccauuccacucau

SEQ ID NO: 251170 - RNA, 28 nt, Human
ccaauuccacagcagaucugauacuagc

SEQ ID NO: 251171 - RNA, 20 nt, Human
ccacaaccaaggcucagaac

SEQ ID NO: 251172 - RNA, 18 nt, Human
ccaggguggguagggggu

SEQ ID NO: 251173 - RNA, 19 nt, Human
ccaggguggguaggggguc

SEQ ID NO: 251174 - RNA, 26 nt, Human
ccaugggcugacccucuggacuauau

SEQ ID NO: 251175 - RNA, 22 nt, Human
ccccaaaaauaauaauaagaau

SEQ ID NO: 251176 - RNA, 21 nt, Human
cccccaagcuuugaguuucug

SEQ ID NO: 251177 - RNA, 21 nt, Human
ccucuggacuauaugcugcuc

SEQ ID NO: 251178 - RNA, 20 nt, Human
ccucuucuuccuccuccucc

SEQ ID NO: 251179 - RNA, 20 nt, Human
ccucuucuuccuccuccucc

SEQ ID NO: 251180 - RNA, 19 nt, Human
cgcuccaauaaacuccugg

SEQ ID NO: 251181 - RNA, 25 nt, Human
cggauccccauguguugcugaccau

SEQ ID NO: 251182 - RNA, 19 nt, Human
cgggcaugaaaacacauuc

SEQ ID NO: 251183 - RNA, 22 nt, Human
cuguacuauucuucuucuggca

SEQ ID NO: 251184 - RNA, 22 nt, Human
gaacaaaggccgggcaugaaaa

SEQ ID NO: 251185 - RNA, 21 nt, Human
gaacuccuggaagaagcuccu

SEQ ID NO: 251186 - RNA, 22 nt, Human
gagacuucucccaauucuccaa

SEQ ID NO: 251187 - RNA, 23 nt, Human
gauauuucuucuuuuucucuuuu

SEQ ID NO: 251188 - RNA, 20 nt, Human
gauuccuuuuuuuuuuuucc

SEQ ID NO: 251189 - RNA, 21 nt, Human
gcugaagauuccuuuuuuuuu

SEQ ID NO: 251190 - RNA, 20 nt, Human
gcugacauagucauuccagg

SEQ ID NO: 251191 - RNA, 18 nt, Human
gcugcuccuuggcucacu

SEQ ID NO: 251192 - RNA, 26 nt, Human
ggcaaauaugaaugcauugggggucc

SEQ ID NO: 251193 - RNA, 22 nt, Human
ggguguggggucaucuggggag

SEQ ID NO: 251194 - RNA, 25 nt, Human
guuacaguauucucuugcuccuuuu

SEQ ID NO: 251195 - RNA, 19 nt, Human
uaacggcgugaucaacaga

SEQ ID NO: 251196 - RNA, 24 nt, Human
uaacucucggagucuuuuuccagg

SEQ ID NO: 251197 - RNA, 19 nt, Human
uagaauaucuaacaugaaa

SEQ ID NO: 251198 - RNA, 22 nt, Human
uagacaacgaagaauuuuuuuu

SEQ ID NO: 251199 - RNA, 27 nt, Human
uaguccccuggcaugcucugcaaacuu

SEQ ID NO: 251200 - RNA, 18 nt, Human
uauggaggaacaaaggcc

SEQ ID NO: 251201 - RNA, 19 nt, Human
uauggaggaacaaaggccg

SEQ ID NO: 251202 - RNA, 25 nt, Human
uauuaagugucaacaucuggucaaa

SEQ ID NO: 251203 - RNA, 20 nt, Human
uccgccaacauugggaucua

SEQ ID NO: 251204 - RNA, 23 nt, Human
uccgugcaucaucauggcuggcc

SEQ ID NO: 251205 - RNA, 21 nt, Human
uccuccugaucuuccuccucc

SEQ ID NO: 251206 - RNA, 24 nt, Human
uccucuucuuccuccuccuccuga

SEQ ID NO: 251207 - RNA, 21 nt, Human
ucucuccuggauggugaauuc

SEQ ID NO: 251208 - RNA, 20 nt, Human
ucugcaaacuucccccuugc

SEQ ID NO: 251209 - RNA, 25 nt, Human
ucugugauauuucuucuuuuucucu

SEQ ID NO: 251210 - RNA, 24 nt, Human
ucuuccuccuccuccugaucuucc

SEQ ID NO: 251211 - RNA, 25 nt, Human
ucuucuuuuucucuuuuuuccucuu

SEQ ID NO: 251212 - RNA, 19 nt, Human
ucuuuuuuccucuucuucc

SEQ ID NO: 251213 - RNA, 18 nt, Human
ucuuuuuuuuuucaauug

SEQ ID NO: 251214 - RNA, 19 nt, Human
ugaauguccauaaccuguc

SEQ ID NO: 251215 - RNA, 22 nt, Human
ugaccauccaacacaaagcucc

SEQ ID NO: 251216 - RNA, 20 nt, Human
ugacuggucaaucaugggcu

SEQ ID NO: 251217 - RNA, 19 nt, Human
ugagaaacguaguccccug

SEQ ID NO: 251218 - RNA, 21 nt, Human
ugaugaagguuacauguagug

SEQ ID NO: 251219 - RNA, 20 nt, Human
ugcgauugcuuuacaugaug

SEQ ID NO: 251220 - RNA, 18 nt, Human
ugcuauuuuuuagggggg

SEQ ID NO: 251221 - RNA, 20 nt, Human
ugcucugcaaacuucccccu

SEQ ID NO: 251222 - RNA, 21 nt, Human
ugcugaccauccaacacaaag

SEQ ID NO: 251223 - RNA, 19 nt, Human
uggcaugcucugcaaacuu

SEQ ID NO: 251224 - RNA, 20 nt, Human
ugggaacaacacacauagug

SEQ ID NO: 251225 - RNA, 21 nt, Human
ugggcaugaauguccauaacc

SEQ ID NO: 251226 - RNA, 18 nt, Human
uggucaaucaugggcugu

SEQ ID NO: 251227 - RNA, 18 nt, Human
ugguggggauggcuuggc

SEQ ID NO: 251228 - RNA, 23 nt, Human
uguccauaaccuguccgccaaca

SEQ ID NO: 251229 - RNA, 18 nt, Human
uguggggucaucugggga

SEQ ID NO: 251230 - RNA, 19 nt, Human
uguguugaggaaagcugcc

SEQ ID NO: 251231 - RNA, 22 nt, Human
uguguuuccuuuucccuugagu

SEQ ID NO: 251232 - RNA, 19 nt, Human
uuacaguauucucuugcuc

SEQ ID NO: 251233 - RNA, 20 nt, Human
uuacauggacagaauugucu

SEQ ID NO: 251234 - RNA, 20 nt, Human
uuauggaggaacaaaggccg

SEQ ID NO: 251235 - RNA, 26 nt, Human
uuccuauauuuauacuacaguaguua

SEQ ID NO: 251236 - RNA, 21 nt, Human
uuccuuuuuuuuuuuuccaaa

SEQ ID NO: 251237 - RNA, 26 nt, Human
uucugugauauuucuucuuuuucucu

SEQ ID NO: 251238 - RNA, 21 nt, Human
uucuuguugcauugguccucu

SEQ ID NO: 251239 - RNA, 18 nt, Human
uuuaggggggaaaaaaag

SEQ ID NO: 251240 - RNA, 23 nt, Human
uuuugcguguguuuccuuuuccc

SEQ ID NO: 251241 - RNA, 26 nt, Human
uuuuuucucuucuaaaacuauuugag

SEQ ID NO: 251242 - RNA, 24 nt, Human
aaaaagaaaaggcuggugacaccc

SEQ ID NO: 251243 - RNA, 19 nt, Human
aaagaaaaggcuggugaca

SEQ ID NO: 251244 - RNA, 23 nt, Human
aagaagagugagggggcaaaaug

SEQ ID NO: 251245 - RNA, 20 nt, Human
aagcaaaggcccagaggcaa

SEQ ID NO: 251246 - RNA, 21 nt, Human
acaaagcaaaggcccagaggc

SEQ ID NO: 251247 - RNA, 25 nt, Human
acaaagcaaaggcccagaggcagag

SEQ ID NO: 251248 - RNA, 25 nt, Human
acaaagcaaaggcccagaggcagag

SEQ ID NO: 251249 - RNA, 18 nt, Human
acaguuaaaaaagaagag

SEQ ID NO: 251250 - RNA, 21 nt, Human
acaguuaaaaaagaagaguga

SEQ ID NO: 251251 - RNA, 26 nt, Human
acaguuaaaaaagaagagugaggggg

SEQ ID NO: 251252 - RNA, 19 nt, Human
agagaagagguggaagugg

SEQ ID NO: 251253 - RNA, 18 nt, Human
agauguggaaaaauaaaa

SEQ ID NO: 251254 - RNA, 23 nt, Human
aggaggaaaaaaaaaaaaagaaa

SEQ ID NO: 251255 - RNA, 18 nt, Human
aggaggaccaugugacgg

SEQ ID NO: 251256 - RNA, 21 nt, Human
aggcagaggccugacacuggc

SEQ ID NO: 251257 - RNA, 18 nt, Human
aggcucagaguaaggcgg

SEQ ID NO: 251258 - RNA, 19 nt, Human
aguuaaaaaagaagaguga

SEQ ID NO: 251259 - RNA, 28 nt, Human
augggacagcagagcugucaaaacagaa

SEQ ID NO: 251260 - RNA, 22 nt, Human
caaaacagaacccaaugaugac

SEQ ID NO: 251261 - RNA, 21 nt, Human
caaaggcccagaggcagaggc

SEQ ID NO: 251262 - RNA, 26 nt, Human
caaauuuuuaacuuauuccaucucca

SEQ ID NO: 251263 - RNA, 22 nt, Human
cacaaagcaaaggcccagaggc

SEQ ID NO: 251264 - RNA, 27 nt, Human
cacaaagcaaaggcccagaggcagagg

SEQ ID NO: 251265 - RNA, 22 nt, Human
caccgcuggccuucugggaccu

SEQ ID NO: 251266 - RNA, 18 nt, Human
cagcagcuuaaggaggaa

SEQ ID NO: 251267 - RNA, 18 nt, Human
cagcugggcugagcgagg

SEQ ID NO: 251268 - RNA, 25 nt, Human
ccaaugaugacggcugaaaaucaag

SEQ ID NO: 251269 - RNA, 22 nt, Human
ccaccagcaccguccaucagca

SEQ ID NO: 251270 - RNA, 24 nt, Human
ccccuggcgugguugaccuggucc

SEQ ID NO: 251271 - RNA, 19 nt, Human
cccuaugggacagcagagc

SEQ ID NO: 251272 - RNA, 22 nt, Human
ccgaucacccagguuugccauu

SEQ ID NO: 251273 - RNA, 24 nt, Human
ccuaaccccuggcuguggacagga

SEQ ID NO: 251274 - RNA, 21 nt, Human
ccuccugguggagcuuugugu

SEQ ID NO: 251275 - RNA, 21 nt, Human
ccuggaaccaccgcuggccuu

SEQ ID NO: 251276 - RNA, 19 nt, Human
ccuucugggaccucgcuuc

SEQ ID NO: 251277 - RNA, 25 nt, Human
cgaaggagugggggccauuuuggug

SEQ ID NO: 251278 - RNA, 18 nt, Human
cgggccugcagaccuaac

SEQ ID NO: 251279 - RNA, 24 nt, Human
cuaaccccuggcuguggacaggag

SEQ ID NO: 251280 - RNA, 22 nt, Human
cuccuggaaccaccgcuggccu

SEQ ID NO: 251281 - RNA, 23 nt, Human
cuuguucccgaucacccagguuu

SEQ ID NO: 251282 - RNA, 19 nt, Human
cuuuccuuugguuuaacag

SEQ ID NO: 251283 - RNA, 27 nt, Human
gaagugggcgccaaaucucccaagggg

SEQ ID NO: 251284 - RNA, 20 nt, Human
gaggacacgaaggagugggg

SEQ ID NO: 251285 - RNA, 19 nt, Human
gccagcgccucuccacugg

SEQ ID NO: 251286 - RNA, 19 nt, Human
gccuccugguggagcuuug

SEQ ID NO: 251287 - RNA, 22 nt, Human
gcguuggaggugggagggcccc

SEQ ID NO: 251288 - RNA, 19 nt, Human
ggagauagcgggaggacac

SEQ ID NO: 251289 - RNA, 21 nt, Human
ggauuuccuucauuugugcuu

SEQ ID NO: 251290 - RNA, 19 nt, Human
ggcuguggacaggagaggc

SEQ ID NO: 251291 - RNA, 19 nt, Human
gggcaaaaugguuugucac

SEQ ID NO: 251292 - RNA, 21 nt, Human
gggcggggcguuggagguggg

SEQ ID NO: 251293 - RNA, 24 nt, Human
gggcguuggaggugggagggcccc

SEQ ID NO: 251294 - RNA, 21 nt, Human
gggggcaaaaugguuugucac

SEQ ID NO: 251295 - RNA, 24 nt, Human
gguacaacgugcuuguucccgauc

SEQ ID NO: 251296 - RNA, 19 nt, Human
guacaacgugcuuguuccc

SEQ ID NO: 251297 - RNA, 21 nt, Human
guccuggcgaucgguugccuu

SEQ ID NO: 251298 - RNA, 21 nt, Human
guggaagugggcgccaaaucu

SEQ ID NO: 251299 - RNA, 18 nt, Human
gugggcccguucagcaga

SEQ ID NO: 251300 - RNA, 18 nt, Human
guuguuuucggggucacu

SEQ ID NO: 251301 - RNA, 22 nt, Human
guuguuuucggggucacuugca

SEQ ID NO: 251302 - RNA, 19 nt, Human
uaaaaaagaagagugaggg

SEQ ID NO: 251303 - RNA, 18 nt, Human
uaacaguuaaaaaagaag

SEQ ID NO: 251304 - RNA, 19 nt, Human
uaauuuguuuguuuuccuu

SEQ ID NO: 251305 - RNA, 24 nt, Human
uagaaagaacguccgauuuggaga

SEQ ID NO: 251306 - RNA, 22 nt, Human
uauguugguuuuaauugaaaag

SEQ ID NO: 251307 - RNA, 19 nt, Human
ucacucagaacaggcacag

SEQ ID NO: 251308 - RNA, 22 nt, Human
ucagaacaggcacagucagcug

SEQ ID NO: 251309 - RNA, 22 nt, Human
ucagacaguuacuaaaauaaac

SEQ ID NO: 251310 - RNA, 23 nt, Human
uccaaaguugaaaaagaucagac

SEQ ID NO: 251311 - RNA, 23 nt, Human
uccccuugaugcucgauggggac

SEQ ID NO: 251312 - RNA, 23 nt, Human
uccugggugaugcuuccuggucc

SEQ ID NO: 251313 - RNA, 25 nt, Human
ucucagcuagaaagaacguccgauu

SEQ ID NO: 251314 - RNA, 24 nt, Human
ucuccacuggccaccagcaccguc

SEQ ID NO: 251315 - RNA, 19 nt, Human
ugaaccagccuccuggugg

SEQ ID NO: 251316 - RNA, 19 nt, Human
ugacggcugugguuguuuu

SEQ ID NO: 251317 - RNA, 19 nt, Human
ugagagaagagguggaagu

SEQ ID NO: 251318 - RNA, 18 nt, Human
ugagaggagggugcccca

SEQ ID NO: 251319 - RNA, 22 nt, Human
ugagggggcaaaaugguuuguc

SEQ ID NO: 251320 - RNA, 18 nt, Human
uggaaccaccgcuggccu

SEQ ID NO: 251321 - RNA, 23 nt, Human
uggacaggagaggcugcuccagg

SEQ ID NO: 251322 - RNA, 21 nt, Human
uggaggugggagggccccggc

SEQ ID NO: 251323 - RNA, 19 nt, Human
uggcacuacagauguggaa

SEQ ID NO: 251324 - RNA, 20 nt, Human
uggcacuacagauguggaaa

SEQ ID NO: 251325 - RNA, 19 nt, Human
ugggagggccccggcugag

SEQ ID NO: 251326 - RNA, 21 nt, Human
ugucaaaacagaacccaauga

SEQ ID NO: 251327 - RNA, 21 nt, Human
uguugcagugaggccacaaag

SEQ ID NO: 251328 - RNA, 26 nt, Human
uuaaggaggaaaaaaaaaaaaagaaa

SEQ ID NO: 251329 - RNA, 22 nt, Human
uucagcagauguuacaggaaaa

SEQ ID NO: 251330 - RNA, 19 nt, Human
uuguucccgaucacccagg

SEQ ID NO: 251331 - RNA, 18 nt, Human
uuuuuuuuuuuuuuggac

SEQ ID NO: 251332 - RNA, 18 nt, Human
uuuuuuuuuuuuuuuuug

SEQ ID NO: 251333 - RNA, 23 nt, Human
uuuuuuuuuuuuuuuuuggacuu

SEQ ID NO: 251334 - RNA, 22 nt, Human
aaaaagaaccugaggggcggag

SEQ ID NO: 251335 - RNA, 21 nt, Human
aagaaagucaacaauuauuaa

SEQ ID NO: 251336 - RNA, 20 nt, Human
agagauauuggucuuaagau

SEQ ID NO: 251337 - RNA, 24 nt, Human
agauagcucuuuagaaacaaguug

SEQ ID NO: 251338 - RNA, 18 nt, Human
cggcaggauggaagaauc

SEQ ID NO: 251339 - RNA, 24 nt, Human
gaaaaagaaccugaggggcggagg

SEQ ID NO: 251340 - RNA, 22 nt, Human
gagcggcgcccgacagaaggac

SEQ ID NO: 251341 - RNA, 19 nt, Human
gcaggauggaagaauccau

SEQ ID NO: 251342 - RNA, 21 nt, Human
gguuguggccgcuuccgcccg

SEQ ID NO: 251343 - RNA, 22 nt, Human
uaaaaaagacaguaacauaaug

SEQ ID NO: 251344 - RNA, 22 nt, Human
uaacauaaugacagaugggcuu

SEQ ID NO: 251345 - RNA, 21 nt, Human
uagaaaaagaaccugaggggc

SEQ ID NO: 251346 - RNA, 23 nt, Human
uaucacacccacacucauccggc

SEQ ID NO: 251347 - RNA, 18 nt, Human
uggaauuagaaaaagaac

SEQ ID NO: 251348 - RNA, 19 nt, Human
uggccgcuuccgcccgcca

SEQ ID NO: 251349 - RNA, 24 nt, Human
uuggucuuaagauagcucuuuaga

SEQ ID NO: 251350 - RNA, 32 nt, Human
aaaaaaaaauacacacacacacacacauagug

SEQ ID NO: 251351 - RNA, 21 nt, Human
aaaaaacaauuaaagaaagca

SEQ ID NO: 251352 - RNA, 22 nt, Human
aaaaaccaagacaguauuuagu

SEQ ID NO: 251353 - RNA, 21 nt, Human
aaaaagcaaagcaaaggggua

SEQ ID NO: 251354 - RNA, 21 nt, Human
aaaaagucugagcuacaagga

SEQ ID NO: 251355 - RNA, 23 nt, Human
aaaaauggaacccagaagacaga

SEQ ID NO: 251356 - RNA, 27 nt, Human
aaaagaccaaggcagacaugaauacag

SEQ ID NO: 251357 - RNA, 23 nt, Human
aaaauaaaucuauguacaaaaca

SEQ ID NO: 251358 - RNA, 21 nt, Human
aaacaacccucugaaacaggc

SEQ ID NO: 251359 - RNA, 22 nt, Human
aaacaaggaguucugaaaagaa

SEQ ID NO: 251360 - RNA, 18 nt, Human
aaacagaaaguagaaugg

SEQ ID NO: 251361 - RNA, 23 nt, Human
aaacagacaagugaauaaaagau

SEQ ID NO: 251362 - RNA, 25 nt, Human
aaacagacaagugaauaaaagauca

SEQ ID NO: 251363 - RNA, 20 nt, Human
aaacaggaugagaaacaagg

SEQ ID NO: 251364 - RNA, 26 nt, Human
aaacuuaaagggaagaaggaaaugau

SEQ ID NO: 251365 - RNA, 21 nt, Human
aaagagaggaaaggcagugca

SEQ ID NO: 251366 - RNA, 21 nt, Human
aaagagauaacaacagacgug

SEQ ID NO: 251367 - RNA, 20 nt, Human
aaagaggacccuggauucug

SEQ ID NO: 251368 - RNA, 21 nt, Human
aaagauuagugagaaauagga

SEQ ID NO: 251369 - RNA, 21 nt, Human
aaagcaaguaaaagagagcca

SEQ ID NO: 251370 - RNA, 18 nt, Human
aaagccaucacuagaaaa

SEQ ID NO: 251371 - RNA, 23 nt, Human
aaauauauacucugaaaaacaca

SEQ ID NO: 251372 - RNA, 23 nt, Human
aacaaaacaacccucugaaacag

SEQ ID NO: 251373 - RNA, 25 nt, Human
aacaacaacaacaaaaacuggagcc

SEQ ID NO: 251374 - RNA, 25 nt, Human
aacaacaacgauaacucuaauaacc

SEQ ID NO: 251375 - RNA, 22 nt, Human
aacaacagacgugaaaaagucu

SEQ ID NO: 251376 - RNA, 21 nt, Human
aacaaggaguucugaaaagaa

SEQ ID NO: 251377 - RNA, 19 nt, Human
aacaccuccugucgaucuc

SEQ ID NO: 251378 - RNA, 19 nt, Human
aacagacgugaaaaagucu

SEQ ID NO: 251379 - RNA, 20 nt, Human
aacauacaaaugaccaguaa

SEQ ID NO: 251380 - RNA, 19 nt, Human
aaccaacccaucaaccagu

SEQ ID NO: 251381 - RNA, 22 nt, Human
aaccucagcuccuacaagcugg

SEQ ID NO: 251382 - RNA, 23 nt, Human
aaccuuacaccccaagagguaac

SEQ ID NO: 251383 - RNA, 27 nt, Human
aacgaaaaaaccaagacagcagggacu

SEQ ID NO: 251384 - RNA, 22 nt, Human
aacuggccaugacgguggccuc

SEQ ID NO: 251385 - RNA, 23 nt, Human
aagaaaaaaaaagaaaauuauaa

SEQ ID NO: 251386 - RNA, 19 nt, Human
aagaaggaaaugauaaaaa

SEQ ID NO: 251387 - RNA, 18 nt, Human
aagacagaaagaucccaa

SEQ ID NO: 251388 - RNA, 24 nt, Human
aagagccucaaccaauacuggcuc

SEQ ID NO: 251389 - RNA, 21 nt, Human
aagcaacaaccaggggcccau

SEQ ID NO: 251390 - RNA, 22 nt, Human
aagcaagugagagauaaaccca

SEQ ID NO: 251391 - RNA, 18 nt, Human
aagcacaauggcauaaaa

SEQ ID NO: 251392 - RNA, 24 nt, Human
aagcaccccaaugaggagccccaa

SEQ ID NO: 251393 - RNA, 24 nt, Human
aagcagaaaauaacaaguguuggg

SEQ ID NO: 251394 - RNA, 20 nt, Human
aagcagaaagaggacccugg

SEQ ID NO: 251395 - RNA, 20 nt, Human
aaggcagacaugaauacaga

SEQ ID NO: 251396 - RNA, 24 nt, Human
aaguaaccuuauggaauaagagaa

SEQ ID NO: 251397 - RNA, 21 nt, Human
aaguaccuuauaacguuggau

SEQ ID NO: 251398 - RNA, 23 nt, Human
aaguucacagccaccugccuugg

SEQ ID NO: 251399 - RNA, 18 nt, Human
aauacagauaugcggugc

SEQ ID NO: 251400 - RNA, 25 nt, Human
aauagaaaaaugacuaggaauuaga

SEQ ID NO: 251401 - RNA, 21 nt, Human
aauccccaacauuuauacccc

SEQ ID NO: 251402 - RNA, 18 nt, Human
aauccccauccccuuccc

SEQ ID NO: 251403 - RNA, 24 nt, Human
aaugguuccccaaaaagggaaugg

SEQ ID NO: 251404 - RNA, 21 nt, Human
aauguacacuacucaggugac

SEQ ID NO: 251405 - RNA, 23 nt, Human
aauguucugcucccugugccccu

SEQ ID NO: 251406 - RNA, 20 nt, Human
acaaaacaacccucugaaac

SEQ ID NO: 251407 - RNA, 21 nt, Human
acaaaacagugucaccaacca

SEQ ID NO: 251408 - RNA, 22 nt, Human
acaacaacaaaaacuggagccu

SEQ ID NO: 251409 - RNA, 20 nt, Human
acaacaacaaaaacuggagg

SEQ ID NO: 251410 - RNA, 21 nt, Human
acaagcaacaaccaggggccc

SEQ ID NO: 251411 - RNA, 22 nt, Human
acaaggcaaauucuuuagugag

SEQ ID NO: 251412 - RNA, 22 nt, Human
acaauaugaagauacauccaaa

SEQ ID NO: 251413 - RNA, 22 nt, Human
acaauaugagaaaaacagauac

SEQ ID NO: 251414 - RNA, 21 nt, Human
acacacacacacacacacgca

SEQ ID NO: 251415 - RNA, 18 nt, Human
acacacacacacacacau

SEQ ID NO: 251416 - RNA, 23 nt, Human
acacacacacacacgcacacaca

SEQ ID NO: 251417 - RNA, 23 nt, Human
acacacacacacgcacacacaca

SEQ ID NO: 251418 - RNA, 23 nt, Human
acacacacgcacacacacacaca

SEQ ID NO: 251419 - RNA, 19 nt, Human
acacagaugacaagaaucu

SEQ ID NO: 251420 - RNA, 19 nt, Human
acacagcagugccccaucu

SEQ ID NO: 251421 - RNA, 19 nt, Human
acacagcagugccccaucu

SEQ ID NO: 251422 - RNA, 26 nt, Human
acaccaaaagcacagaccacaaaagu

SEQ ID NO: 251423 - RNA, 21 nt, Human
acaccccaagagguaacacag

SEQ ID NO: 251424 - RNA, 24 nt, Human
acacgcacacacacacacaccaca

SEQ ID NO: 251425 - RNA, 25 nt, Human
acagaacagcagugcaaggacagaa

SEQ ID NO: 251426 - RNA, 18 nt, Human
acagcagugcaaggacag

SEQ ID NO: 251427 - RNA, 21 nt, Human
accaaaagcacagaccacaaa

SEQ ID NO: 251428 - RNA, 23 nt, Human
accaaaagccauuuguaccccaa

SEQ ID NO: 251429 - RNA, 23 nt, Human
accaaaagccauuuguaccccaa

SEQ ID NO: 251430 - RNA, 18 nt, Human
accauaccaacacguaca

SEQ ID NO: 251431 - RNA, 18 nt, Human
accaugcucuccuacaug

SEQ ID NO: 251432 - RNA, 22 nt, Human
acccacaccccaaacaaaacaa

SEQ ID NO: 251433 - RNA, 20 nt, Human
acccacuccuaaccccucug

SEQ ID NO: 251434 - RNA, 18 nt, Human
acccaggaauuucacuuc

SEQ ID NO: 251435 - RNA, 22 nt, Human
accccaagagguaacacagaac

SEQ ID NO: 251436 - RNA, 26 nt, Human
accccaagagguaacacagaacagca

SEQ ID NO: 251437 - RNA, 23 nt, Human
acccuguaugcccauugaaacaa

SEQ ID NO: 251438 - RNA, 21 nt, Human
accuacagaugcugccuccuc

SEQ ID NO: 251439 - RNA, 21 nt, Human
accucagcuccuacaagcugg

SEQ ID NO: 251440 - RNA, 19 nt, Human
accuccgcgcuuacauccc

SEQ ID NO: 251441 - RNA, 24 nt, Human
accucgcccacucucuccccacaa

SEQ ID NO: 251442 - RNA, 21 nt, Human
accugaaacacaaaauuaaaa

SEQ ID NO: 251443 - RNA, 21 nt, Human
acgcaguuuuaccccaguucc

SEQ ID NO: 251444 - RNA, 20 nt, Human
acgcugugcccagcggaggg

SEQ ID NO: 251445 - RNA, 19 nt, Human
acuagcagaaacuuaaguu

SEQ ID NO: 251446 - RNA, 23 nt, Human
acucaccaaaaggaaaaaaacaa

SEQ ID NO: 251447 - RNA, 25 nt, Human
acucauauauaugaccaaaagccau

SEQ ID NO: 251448 - RNA, 18 nt, Human
acuccuggguaucuaccc

SEQ ID NO: 251449 - RNA, 22 nt, Human
acucucuccccacaauccccau

SEQ ID NO: 251450 - RNA, 24 nt, Human
agaaaaaaaagaaaauuauaagaa

SEQ ID NO: 251451 - RNA, 24 nt, Human
agaaaaacagauacuuuuaaacac

SEQ ID NO: 251452 - RNA, 18 nt, Human
agaaaagacaacagaugu

SEQ ID NO: 251453 - RNA, 18 nt, Human
agaaagaaacuccuacaa

SEQ ID NO: 251454 - RNA, 24 nt, Human
agaaagcaaguaaaagagagccau

SEQ ID NO: 251455 - RNA, 26 nt, Human
agaaagcgcacccaggucaagccccc

SEQ ID NO: 251456 - RNA, 23 nt, Human
agaacagucccacccaggagaca

SEQ ID NO: 251457 - RNA, 22 nt, Human
agaauuccuccugaggaaacuu

SEQ ID NO: 251458 - RNA, 18 nt, Human
agacaacagauguguuuc

SEQ ID NO: 251459 - RNA, 22 nt, Human
agacagaaagugugugcuuagc

SEQ ID NO: 251460 - RNA, 18 nt, Human
agaggaaaaaugcagaga

SEQ ID NO: 251461 - RNA, 23 nt, Human
agaguaacagggacagcacacca

SEQ ID NO: 251462 - RNA, 21 nt, Human
agcaacaacuuaaccaacacu

SEQ ID NO: 251463 - RNA, 24 nt, Human
agcaagaaauaaauaaaagggacc

SEQ ID NO: 251464 - RNA, 19 nt, Human
agcaaguaaaagagagcca

SEQ ID NO: 251465 - RNA, 20 nt, Human
agcaauaugaaccugaaguc

SEQ ID NO: 251466 - RNA, 19 nt, Human
agcaccuuccuucucagca

SEQ ID NO: 251467 - RNA, 23 nt, Human
agcagucauagucagucagaugc

SEQ ID NO: 251468 - RNA, 19 nt, Human
agcauacccgagacuacuu

SEQ ID NO: 251469 - RNA, 20 nt, Human
agccuaaaauuuccagaaau

SEQ ID NO: 251470 - RNA, 24 nt, Human
agcgauucucgugccucagccucc

SEQ ID NO: 251471 - RNA, 19 nt, Human
aggaaaaaaacaaggcaaa

SEQ ID NO: 251472 - RNA, 22 nt, Human
aggaaaggcagugcagggcugg

SEQ ID NO: 251473 - RNA, 21 nt, Human
aggaagagggcggggcucagg

SEQ ID NO: 251474 - RNA, 25 nt, Human
aggaagaggggaaggcaucagguuu

SEQ ID NO: 251475 - RNA, 19 nt, Human
aggacaaagccacagugug

SEQ ID NO: 251476 - RNA, 20 nt, Human
aggacagaacagucccaccc

SEQ ID NO: 251477 - RNA, 18 nt, Human
aggacaguugcugcaaug

SEQ ID NO: 251478 - RNA, 23 nt, Human
aggacccuggauucugcacacag

SEQ ID NO: 251479 - RNA, 23 nt, Human
aggagccccaauggccgccccgc

SEQ ID NO: 251480 - RNA, 22 nt, Human
aggagcuuggguuucuaggggc

SEQ ID NO: 251481 - RNA, 28 nt, Human
aggcaaacaggcccaggugaguagaaca

SEQ ID NO: 251482 - RNA, 21 nt, Human
aggcacauuccagccucccaa

SEQ ID NO: 251483 - RNA, 20 nt, Human
aggcggcaggggaggcgggu

SEQ ID NO: 251484 - RNA, 21 nt, Human
aggcuggggguuagagaaaga

SEQ ID NO: 251485 - RNA, 26 nt, Human
agggcagcugagucaaucuccuuuuu

SEQ ID NO: 251486 - RNA, 20 nt, Human
agguauagucacaugaugag

SEQ ID NO: 251487 - RNA, 24 nt, Human
aggucaagcccccaaaccccaagg

SEQ ID NO: 251488 - RNA, 18 nt, Human
agucagaugcaccaaggg

SEQ ID NO: 251489 - RNA, 22 nt, Human
agugacccuaugagguaagagc

SEQ ID NO: 251490 - RNA, 22 nt, Human
agugcaagacaggcuguguggu

SEQ ID NO: 251491 - RNA, 21 nt, Human
aguuuaagggcacagccuggg

SEQ ID NO: 251492 - RNA, 22 nt, Human
auaaaaaacaggaugagaaaca

SEQ ID NO: 251493 - RNA, 20 nt, Human
auaagcagaggacaaagcca

SEQ ID NO: 251494 - RNA, 23 nt, Human
auacacacacacacacacacagu

SEQ ID NO: 251495 - RNA, 22 nt, Human
auacacacacacacacacauaa

SEQ ID NO: 251496 - RNA, 23 nt, Human
auacuaaauucccuugaaauuca

SEQ ID NO: 251497 - RNA, 19 nt, Human
auagaaagaaacuccuaca

SEQ ID NO: 251498 - RNA, 21 nt, Human
auagcaguuaucuuccagggu

SEQ ID NO: 251499 - RNA, 25 nt, Human
auauauauauauauacauauauaua

SEQ ID NO: 251500 - RNA, 25 nt, Human
auauauauauauauacauauauaua

SEQ ID NO: 251501 - RNA, 19 nt, Human
auauauguauauauauaua

SEQ ID NO: 251502 - RNA, 19 nt, Human
auauauguauauauauaug

SEQ ID NO: 251503 - RNA, 20 nt, Human
auauguauauauauauauau

SEQ ID NO: 251504 - RNA, 20 nt, Human
aucccacacuaggcaccgcg

SEQ ID NO: 251505 - RNA, 20 nt, Human
aucccacacuaggcaccgcg

SEQ ID NO: 251506 - RNA, 22 nt, Human
aucccacacuaggcaccgcggc

SEQ ID NO: 251507 - RNA, 22 nt, Human
aucccacacuaggcaccgcggc

SEQ ID NO: 251508 - RNA, 21 nt, Human
auccccacuuccaauccccaa

SEQ ID NO: 251509 - RNA, 18 nt, Human
auccccauccccuucccu

SEQ ID NO: 251510 - RNA, 24 nt, Human
aucccccaccauuuguguuggucc

SEQ ID NO: 251511 - RNA, 23 nt, Human
augaaggcaaagaauguggcccc

SEQ ID NO: 251512 - RNA, 18 nt, Human
augaggaacaaauccaga

SEQ ID NO: 251513 - RNA, 20 nt, Human
augccaagccggguggugcc

SEQ ID NO: 251514 - RNA, 23 nt, Human
augcucacagcugcacgauuuaa

SEQ ID NO: 251515 - RNA, 19 nt, Human
augcucuccuacauggccu

SEQ ID NO: 251516 - RNA, 18 nt, Human
augcugccuccucuggac

SEQ ID NO: 251517 - RNA, 23 nt, Human
auggggugcgccccaagcacccc

SEQ ID NO: 251518 - RNA, 25 nt, Human
auguacauaaaaacccauguacaca

SEQ ID NO: 251519 - RNA, 22 nt, Human
auguauauauauauauauacau

SEQ ID NO: 251520 - RNA, 21 nt, Human
auuauaaaggucaauaugaga

SEQ ID NO: 251521 - RNA, 22 nt, Human
auuaucaauauccuuaagaugu

SEQ ID NO: 251522 - RNA, 24 nt, Human
auucaaacacggcuaccacacaga

SEQ ID NO: 251523 - RNA, 20 nt, Human
caaaacaacccucugaaaca

SEQ ID NO: 251524 - RNA, 25 nt, Human
caaaagcaacccaaguguccacuaa

SEQ ID NO: 251525 - RNA, 22 nt, Human
caaaagcacagaccacaaaagu

SEQ ID NO: 251526 - RNA, 23 nt, Human
caaaagcacagaccacaaaagua

SEQ ID NO: 251527 - RNA, 26 nt, Human
caaaagcacagaccacaaaaguaaaa

SEQ ID NO: 251528 - RNA, 22 nt, Human
caaaccccaaggagaguccugg

SEQ ID NO: 251529 - RNA, 20 nt, Human
caaacuaaacagacaaguga

SEQ ID NO: 251530 - RNA, 23 nt, Human
caaacuaaaugaacuauccccug

SEQ ID NO: 251531 - RNA, 21 nt, Human
caaauaaccaaguuuaagggc

SEQ ID NO: 251532 - RNA, 22 nt, Human
caaauaaccaaguuuaagggca

SEQ ID NO: 251533 - RNA, 18 nt, Human
caaauaaccucaaagcca

SEQ ID NO: 251534 - RNA, 24 nt, Human
caaaucaaccaccuaaguugcuaa

SEQ ID NO: 251535 - RNA, 24 nt, Human
caaaucccaggcacauuccagccu

SEQ ID NO: 251536 - RNA, 24 nt, Human
caacaacaaaaacuggagccuaaa

SEQ ID NO: 251537 - RNA, 23 nt, Human
caacaacaacaaaaacuggagcc

SEQ ID NO: 251538 - RNA, 22 nt, Human
caacaaccaggggcccauucag

SEQ ID NO: 251539 - RNA, 24 nt, Human
caacagcauacccgagacuacuuc

SEQ ID NO: 251540 - RNA, 22 nt, Human
caacaggccguuccugcgguuc

SEQ ID NO: 251541 - RNA, 22 nt, Human
caacagggcagaauggagaaaa

SEQ ID NO: 251542 - RNA, 19 nt, Human
caacccaauagaaauacaa

SEQ ID NO: 251543 - RNA, 26 nt, Human
caacuucucacuuccaagcaacaacu

SEQ ID NO: 251544 - RNA, 18 nt, Human
caagcaacaaccaggggc

SEQ ID NO: 251545 - RNA, 23 nt, Human
caagcaccccaaugaggagcccc

SEQ ID NO: 251546 - RNA, 21 nt, Human
caagcccccaaaccccaagga

SEQ ID NO: 251547 - RNA, 28 nt, Human
caagcgauucucgugccucagccucccg

SEQ ID NO: 251548 - RNA, 22 nt, Human
caaggaaagucaucgcaaguau

SEQ ID NO: 251549 - RNA, 24 nt, Human
caagugccauuucauccccacuuc

SEQ ID NO: 251550 - RNA, 21 nt, Human
caaguguuggggaggaugugg

SEQ ID NO: 251551 - RNA, 24 nt, Human
caauagaaauacaaauccaaacua

SEQ ID NO: 251552 - RNA, 24 nt, Human
caauagccaaaagcaacccaagug

SEQ ID NO: 251553 - RNA, 23 nt, Human
caauaugaagauacauccaaagu

SEQ ID NO: 251554 - RNA, 23 nt, Human
cacaaaauagaauuuauggcaua

SEQ ID NO: 251555 - RNA, 21 nt, Human
cacaacacacaccacggggaa

SEQ ID NO: 251556 - RNA, 20 nt, Human
cacaagaucagccaugccca

SEQ ID NO: 251557 - RNA, 21 nt, Human
cacaagaucagccaugcccac

SEQ ID NO: 251558 - RNA, 22 nt, Human
cacaauugcaaagauguggaac

SEQ ID NO: 251559 - RNA, 18 nt, Human
cacacacacacacacaca

SEQ ID NO: 251560 - RNA, 20 nt, Human
cacacacacacacacacaca

SEQ ID NO: 251561 - RNA, 20 nt, Human
cacacacacacacacacaca

SEQ ID NO: 251562 - RNA, 22 nt, Human
cacacacacacacacacacaca

SEQ ID NO: 251563 - RNA, 26 nt, Human
cacacacacacacacacacacgcaca

SEQ ID NO: 251564 - RNA, 25 nt, Human
cacacacacacacacacacgcacac

SEQ ID NO: 251565 - RNA, 26 nt, Human
cacacacacacacacgcacacacaca

SEQ ID NO: 251566 - RNA, 24 nt, Human
cacacacacacacgcacacacaca

SEQ ID NO: 251567 - RNA, 24 nt, Human
cacacacacaccacaaauggccaa

SEQ ID NO: 251568 - RNA, 27 nt, Human
cacacacacgcacacacacacacacca

SEQ ID NO: 251569 - RNA, 20 nt, Human
cacacaguugucaccuugac

SEQ ID NO: 251570 - RNA, 22 nt, Human
cacacauaaagaaaaaaaagaa

SEQ ID NO: 251571 - RNA, 20 nt, Human
cacaccucuggaaauucaca

SEQ ID NO: 251572 - RNA, 21 nt, Human
cacagaacagcagugcaagga

SEQ ID NO: 251573 - RNA, 22 nt, Human
cacagaccacaaaaguaaaaac

SEQ ID NO: 251574 - RNA, 25 nt, Human
cacagaccacaaaaguaaaaacaga

SEQ ID NO: 251575 - RNA, 20 nt, Human
cacagaugacaagaaucuac

SEQ ID NO: 251576 - RNA, 22 nt, Human
cacagauuccacaacacacacc

SEQ ID NO: 251577 - RNA, 18 nt, Human
cacagcacaauucagaau

SEQ ID NO: 251578 - RNA, 20 nt, Human
cacaggagcagaggcccagg

SEQ ID NO: 251579 - RNA, 22 nt, Human
cacaguuucaaaucaaccaccu

SEQ ID NO: 251580 - RNA, 24 nt, Human
cacauaacaaguucagaaaccaca

SEQ ID NO: 251581 - RNA, 26 nt, Human
cacauacacagguucucuggaaagaa

SEQ ID NO: 251582 - RNA, 21 nt, Human
caccaaaaggaaaaaaacaag

SEQ ID NO: 251583 - RNA, 23 nt, Human
caccaagggcagcugagucaauc

SEQ ID NO: 251584 - RNA, 19 nt, Human
caccaggaggaagcuggua

SEQ ID NO: 251585 - RNA, 23 nt, Human
caccaugccccuccucacacaaa

SEQ ID NO: 251586 - RNA, 21 nt, Human
cacccacuccuaaccccucug

SEQ ID NO: 251587 - RNA, 20 nt, Human
cacccacucuggagggcaac

SEQ ID NO: 251588 - RNA, 21 nt, Human
cacccacucuggagggcaaca

SEQ ID NO: 251589 - RNA, 24 nt, Human
caccccaaacaaaacaacccucug

SEQ ID NO: 251590 - RNA, 20 nt, Human
caccccucccuuugguucuc

SEQ ID NO: 251591 - RNA, 21 nt, Human
caccccugccccgcagagccu

SEQ ID NO: 251592 - RNA, 25 nt, Human
caccucgcccacucucuccccacaa

SEQ ID NO: 251593 - RNA, 28 nt, Human
caccugugacaaaugaggaacaaaucca

SEQ ID NO: 251594 - RNA, 20 nt, Human
caccuuccuucucagcacag

SEQ ID NO: 251595 - RNA, 21 nt, Human
caccuuguagcaaagcaaaac

SEQ ID NO: 251596 - RNA, 21 nt, Human
cacuacuggguaucuacccaa

SEQ ID NO: 251597 - RNA, 23 nt, Human
cacuauauauuaaagucacaaaa

SEQ ID NO: 251598 - RNA, 18 nt, Human
cacugcacauggagaggu

SEQ ID NO: 251599 - RNA, 22 nt, Human
cacuucuucagucuuccccacc

SEQ ID NO: 251600 - RNA, 19 nt, Human
cacuuuggaaaguuucuaa

SEQ ID NO: 251601 - RNA, 23 nt, Human
cagaaagcgcacccaggucaagc

SEQ ID NO: 251602 - RNA, 19 nt, Human
cagaagaguaacagggaca

SEQ ID NO: 251603 - RNA, 22 nt, Human
cagaauugcaaagauauggaac

SEQ ID NO: 251604 - RNA, 22 nt, Human
cagacaagugaauaaaagauca

SEQ ID NO: 251605 - RNA, 19 nt, Human
cagacagcacuccuuccca

SEQ ID NO: 251606 - RNA, 27 nt, Human
cagaccacuugggauaauaccaguucu

SEQ ID NO: 251607 - RNA, 20 nt, Human
cagagccgggcucacaccug

SEQ ID NO: 251608 - RNA, 19 nt, Human
cagagccuuuuuguccccc

SEQ ID NO: 251609 - RNA, 19 nt, Human
cagagugacauaauggaca

SEQ ID NO: 251610 - RNA, 23 nt, Human
cagaguugggggacuaaggcgga

SEQ ID NO: 251611 - RNA, 26 nt, Human
cagcacaauucagaauugcaaagaua

SEQ ID NO: 251612 - RNA, 23 nt, Human
cagcagacaaagcaaugcucaca

SEQ ID NO: 251613 - RNA, 19 nt, Human
cagcaugccaguugcugga

SEQ ID NO: 251614 - RNA, 22 nt, Human
cagccucccaaagacuauggaa

SEQ ID NO: 251615 - RNA, 21 nt, Human
cagccucgacuucacgggcuc

SEQ ID NO: 251616 - RNA, 24 nt, Human
cagcucagaaccaagcaggguuuu

SEQ ID NO: 251617 - RNA, 22 nt, Human
cagcuccugaaaaaaucacacc

SEQ ID NO: 251618 - RNA, 20 nt, Human
cagggcuggagguccuggag

SEQ ID NO: 251619 - RNA, 21 nt, Human
cagggcuggagguccuggagg

SEQ ID NO: 251620 - RNA, 19 nt, Human
caggguggaagcaagaguu

SEQ ID NO: 251621 - RNA, 18 nt, Human
cagugcagggcuggaggu

SEQ ID NO: 251622 - RNA, 18 nt, Human
cagugcagggcuggaggu

SEQ ID NO: 251623 - RNA, 24 nt, Human
cauaaugaguaccacacaaagcca

SEQ ID NO: 251624 - RNA, 22 nt, Human
cauaauggacacuagagacuca

SEQ ID NO: 251625 - RNA, 25 nt, Human
cauacacacacacacacacacacac

SEQ ID NO: 251626 - RNA, 19 nt, Human
cauaggaguacauacaugu

SEQ ID NO: 251627 - RNA, 18 nt, Human
cauauauauauauauaca

SEQ ID NO: 251628 - RNA, 23 nt, Human
caucaaagaacacaaucaacaaa

SEQ ID NO: 251629 - RNA, 19 nt, Human
caucaguguaaauaauuaa

SEQ ID NO: 251630 - RNA, 25 nt, Human
cauccccacucagcagucugcagac

SEQ ID NO: 251631 - RNA, 24 nt, Human
cauccccuucccuuuuuaggucuu

SEQ ID NO: 251632 - RNA, 21 nt, Human
caugaagucccgccccuaggg

SEQ ID NO: 251633 - RNA, 18 nt, Human
caugauagaucaaagaug

SEQ ID NO: 251634 - RNA, 23 nt, Human
caugcugugcccagaauuccucc

SEQ ID NO: 251635 - RNA, 18 nt, Human
cauguacacagauaugcg

SEQ ID NO: 251636 - RNA, 23 nt, Human
cauguacacagauaugcgguaua

SEQ ID NO: 251637 - RNA, 23 nt, Human
ccaaaaggaaaaaaacaaggcaa

SEQ ID NO: 251638 - RNA, 20 nt, Human
ccaaacacagaaaagacaac

SEQ ID NO: 251639 - RNA, 21 nt, Human
ccaaccagaugugccaagagc

SEQ ID NO: 251640 - RNA, 22 nt, Human
ccaagcaacaacuuaaccaaca

SEQ ID NO: 251641 - RNA, 23 nt, Human
ccaauggccgccccgcccccucu

SEQ ID NO: 251642 - RNA, 23 nt, Human
ccacaccccaaacaaaacaaccc

SEQ ID NO: 251643 - RNA, 24 nt, Human
ccacagugauaaacuaaccuaaga

SEQ ID NO: 251644 - RNA, 18 nt, Human
ccagaaagcgcacccagg

SEQ ID NO: 251645 - RNA, 19 nt, Human
ccagaagacagaaagaucc

SEQ ID NO: 251646 - RNA, 22 nt, Human
ccagaggucucacugcacaugg

SEQ ID NO: 251647 - RNA, 22 nt, Human
ccagcacuccacccguuuguca

SEQ ID NO: 251648 - RNA, 22 nt, Human
ccagcagacaaagcaaugcuca

SEQ ID NO: 251649 - RNA, 23 nt, Human
ccagcagacacaugacaaaagca

SEQ ID NO: 251650 - RNA, 19 nt, Human
ccagcccugcagcucaugg

SEQ ID NO: 251651 - RNA, 22 nt, Human
ccaggucaagcccccaaacccc

SEQ ID NO: 251652 - RNA, 25 nt, Human
ccaugccccuccucacacaaacaca

SEQ ID NO: 251653 - RNA, 23 nt, Human
ccauguacauaaaaacccaugua

SEQ ID NO: 251654 - RNA, 18 nt, Human
ccauuuccaaacaguguc

SEQ ID NO: 251655 - RNA, 24 nt, Human
cccaaacaaaacaacccucugaaa

SEQ ID NO: 251656 - RNA, 26 nt, Human
cccaaacaaaacaacccucugaaaca

SEQ ID NO: 251657 - RNA, 27 nt, Human
cccaaagagauaacaacagaggaguuc

SEQ ID NO: 251658 - RNA, 20 nt, Human
cccaaagccccagagaauuc

SEQ ID NO: 251659 - RNA, 23 nt, Human
cccaacgauaaaaauaaccauga

SEQ ID NO: 251660 - RNA, 21 nt, Human
cccaaugaggagccccaaugg

SEQ ID NO: 251661 - RNA, 25 nt, Human
cccacaauauaggcauuuacaaggc

SEQ ID NO: 251662 - RNA, 20 nt, Human
cccacaauccccauccccuu

SEQ ID NO: 251663 - RNA, 20 nt, Human
cccacaccccaaacaaaaca

SEQ ID NO: 251664 - RNA, 21 nt, Human
cccacaccccaaacaaaacaa

SEQ ID NO: 251665 - RNA, 22 nt, Human
cccacaccccaaacaaaacaac

SEQ ID NO: 251666 - RNA, 19 nt, Human
cccacauaucacuucuaca

SEQ ID NO: 251667 - RNA, 19 nt, Human
cccaccccugccccgcaga

SEQ ID NO: 251668 - RNA, 24 nt, Human
cccacucucuccccacaaucccca

SEQ ID NO: 251669 - RNA, 20 nt, Human
cccagaagacagaaagaucc

SEQ ID NO: 251670 - RNA, 22 nt, Human
ccccaaaagccauugaaauuaa

SEQ ID NO: 251671 - RNA, 27 nt, Human
ccccaauggccgccccgcccccucucu

SEQ ID NO: 251672 - RNA, 18 nt, Human
ccccacaauccccauccc

SEQ ID NO: 251673 - RNA, 21 nt, Human
ccccacaauccccauccccuu

SEQ ID NO: 251674 - RNA, 23 nt, Human
ccccacaauuccgggacgcccgg

SEQ ID NO: 251675 - RNA, 23 nt, Human
ccccagcacuccacccguuuguc

SEQ ID NO: 251676 - RNA, 19 nt, Human
cccccaaaccccaaggaga

SEQ ID NO: 251677 - RNA, 20 nt, Human
cccccaaaccccaaggagag

SEQ ID NO: 251678 - RNA, 22 nt, Human
cccccacaauuccgggacgccc

SEQ ID NO: 251679 - RNA, 18 nt, Human
ccccgggcuggagguggg

SEQ ID NO: 251680 - RNA, 18 nt, Human
ccccuagggucgcacuac

SEQ ID NO: 251681 - RNA, 20 nt, Human
ccccuagggucgcacuaccc

SEQ ID NO: 251682 - RNA, 18 nt, Human
ccccucgcccaccuccgc

SEQ ID NO: 251683 - RNA, 21 nt, Human
ccccucucuacgacugugccc

SEQ ID NO: 251684 - RNA, 25 nt, Human
ccccugaagcagccacgcugugccc

SEQ ID NO: 251685 - RNA, 21 nt, Human
ccccuggauuggaguggaggc

SEQ ID NO: 251686 - RNA, 24 nt, Human
ccccuggauuggaguggaggcaag

SEQ ID NO: 251687 - RNA, 19 nt, Human
ccccuggcuagucccaguu

SEQ ID NO: 251688 - RNA, 19 nt, Human
ccccuucccuuuuuagguc

SEQ ID NO: 251689 - RNA, 18 nt, Human
cccgcacugcaccauaau

SEQ ID NO: 251690 - RNA, 21 nt, Human
cccgcacugcaccauaaugag

SEQ ID NO: 251691 - RNA, 25 nt, Human
cccgcagagccuggaaauaguggcg

SEQ ID NO: 251692 - RNA, 25 nt, Human
cccgcagagccuggaaauaguggcg

SEQ ID NO: 251693 - RNA, 18 nt, Human
cccgggcuggagguggga

SEQ ID NO: 251694 - RNA, 22 nt, Human
cccuagggucgcacuacccgcc

SEQ ID NO: 251695 - RNA, 22 nt, Human
cccucagccgagacugcagagc

SEQ ID NO: 251696 - RNA, 18 nt, Human
cccugaguaacguugguc

SEQ ID NO: 251697 - RNA, 23 nt, Human
cccugccccgcagagccuggaaa

SEQ ID NO: 251698 - RNA, 23 nt, Human
cccugccccgcagagccuggaaa

SEQ ID NO: 251699 - RNA, 23 nt, Human
ccgcccgcgagauacucuaacac

SEQ ID NO: 251700 - RNA, 18 nt, Human
ccgccgggaaguggaguc

SEQ ID NO: 251701 - RNA, 24 nt, Human
ccuaaaauuuccagaaauagaucc

SEQ ID NO: 251702 - RNA, 18 nt, Human
ccuacaagucaacaacaa

SEQ ID NO: 251703 - RNA, 21 nt, Human
ccucagcuccuacaagcuggg

SEQ ID NO: 251704 - RNA, 18 nt, Human
ccuccagauuccacguga

SEQ ID NO: 251705 - RNA, 19 nt, Human
ccucgcccacucucucccc

SEQ ID NO: 251706 - RNA, 23 nt, Human
ccucgcccacucucuccccacaa

SEQ ID NO: 251707 - RNA, 19 nt, Human
ccucuagucuuggcucauu

SEQ ID NO: 251708 - RNA, 19 nt, Human
ccucuggacacugccucug

SEQ ID NO: 251709 - RNA, 20 nt, Human
ccucuggagggugggggauu

SEQ ID NO: 251710 - RNA, 19 nt, Human
ccucugggugccucagcuc

SEQ ID NO: 251711 - RNA, 19 nt, Human
ccucugugggaagggaggc

SEQ ID NO: 251712 - RNA, 21 nt, Human
ccugaagcagccacgcugugc

SEQ ID NO: 251713 - RNA, 20 nt, Human
ccugcagcucaugggaagga

SEQ ID NO: 251714 - RNA, 20 nt, Human
ccugcaggacccacuacugu

SEQ ID NO: 251715 - RNA, 21 nt, Human
ccugccccgcagagccuggaa

SEQ ID NO: 251716 - RNA, 21 nt, Human
ccugccccgcagagccuggaa

SEQ ID NO: 251717 - RNA, 24 nt, Human
ccuggaacgaaaaaaccaagacag

SEQ ID NO: 251718 - RNA, 18 nt, Human
ccuggauuggaguggagg

SEQ ID NO: 251719 - RNA, 24 nt, Human
ccuguacagcuuuacacauacaca

SEQ ID NO: 251720 - RNA, 22 nt, Human
ccuugagguggaagcugggggu

SEQ ID NO: 251721 - RNA, 19 nt, Human
ccuuggccuaggggguggc

SEQ ID NO: 251722 - RNA, 19 nt, Human
ccuuuggggucagcacagg

SEQ ID NO: 251723 - RNA, 18 nt, Human
cgaaggagaggaaacuag

SEQ ID NO: 251724 - RNA, 19 nt, Human
cgacauacuuaacacuacu

SEQ ID NO: 251725 - RNA, 21 nt, Human
cgaccaaacacagaaaagacu

SEQ ID NO: 251726 - RNA, 23 nt, Human
cgcauacacuuagacccaaaucc

SEQ ID NO: 251727 - RNA, 19 nt, Human
cgcccaucuuucaagugac

SEQ ID NO: 251728 - RNA, 20 nt, Human
cgccccaagcaccccaauga

SEQ ID NO: 251729 - RNA, 19 nt, Human
cgccgggaaguggagucug

SEQ ID NO: 251730 - RNA, 20 nt, Human
cgccgggaaguggagucugg

SEQ ID NO: 251731 - RNA, 22 nt, Human
cggccucaccucucugcuccug

SEQ ID NO: 251732 - RNA, 21 nt, Human
cggccuccgcgcuuacauccc

SEQ ID NO: 251733 - RNA, 21 nt, Human
cggcggcaucccacacuaggc

SEQ ID NO: 251734 - RNA, 18 nt, Human
cggcggcuuccccuucuu

SEQ ID NO: 251735 - RNA, 18 nt, Human
cggcuccggacaccuccu

SEQ ID NO: 251736 - RNA, 19 nt, Human
cgggauacgaaggagagga

SEQ ID NO: 251737 - RNA, 21 nt, Human
cgguauggacaggcagcugca

SEQ ID NO: 251738 - RNA, 20 nt, Human
cgugacuaauacacucuaag

SEQ ID NO: 251739 - RNA, 24 nt, Human
cgugccucagccucccgaguagcu

SEQ ID NO: 251740 - RNA, 24 nt, Human
cguuaugaaggcaaugugauaggg

SEQ ID NO: 251741 - RNA, 25 nt, Human
cguuaugaaggcaaugugauagggg

SEQ ID NO: 251742 - RNA, 18 nt, Human
cuaaccuaagaaaaucgu

SEQ ID NO: 251743 - RNA, 18 nt, Human
cuaauacacucuaaaucc

SEQ ID NO: 251744 - RNA, 24 nt, Human
cucaaggucuucugaauugaaccc

SEQ ID NO: 251745 - RNA, 26 nt, Human
cucacacaaacacagauuccacaaca

SEQ ID NO: 251746 - RNA, 23 nt, Human
cucacagaaacagaaaguagaau

SEQ ID NO: 251747 - RNA, 19 nt, Human
cucaccaaaaggaaaaaaa

SEQ ID NO: 251748 - RNA, 23 nt, Human
cucaccaaaaggaaaaaaacaag

SEQ ID NO: 251749 - RNA, 25 nt, Human
cucacccacgcacuaaauuccccaa

SEQ ID NO: 251750 - RNA, 18 nt, Human
cucaccucucugcuccug

SEQ ID NO: 251751 - RNA, 23 nt, Human
cucacugccgaggcaaugccacu

SEQ ID NO: 251752 - RNA, 20 nt, Human
cucaggaauggaaaaccaaa

SEQ ID NO: 251753 - RNA, 21 nt, Human
cucaggaauggaaaaccaaau

SEQ ID NO: 251754 - RNA, 19 nt, Human
cuccccaccuacacaccca

SEQ ID NO: 251755 - RNA, 26 nt, Human
cucccuugcugcucccuuugaaacaa

SEQ ID NO: 251756 - RNA, 22 nt, Human
cuccggacaccuccuucccgag

SEQ ID NO: 251757 - RNA, 18 nt, Human
cuccuaaccccucugcag

SEQ ID NO: 251758 - RNA, 18 nt, Human
cuccuggcauguggcggc

SEQ ID NO: 251759 - RNA, 19 nt, Human
cucgcccacucucucccca

SEQ ID NO: 251760 - RNA, 24 nt, Human
cucggucccccucgcccaccuccc

SEQ ID NO: 251761 - RNA, 25 nt, Human
cucgugccucagccucccgaguagc

SEQ ID NO: 251762 - RNA, 24 nt, Human
cucuacgacugugcccccggggcu

SEQ ID NO: 251763 - RNA, 18 nt, Human
cucuccuacauggccuua

SEQ ID NO: 251764 - RNA, 19 nt, Human
cucuguguaaggagaaaac

SEQ ID NO: 251765 - RNA, 18 nt, Human
cucuugucacccacuccu

SEQ ID NO: 251766 - RNA, 19 nt, Human
cucuuucgcccaggcugga

SEQ ID NO: 251767 - RNA, 24 nt, Human
cugcagauuuccuccgggaugcuc

SEQ ID NO: 251768 - RNA, 22 nt, Human
cuggccacaggagguggguucu

SEQ ID NO: 251769 - RNA, 18 nt, Human
cugguuaccccucuggag

SEQ ID NO: 251770 - RNA, 20 nt, Human
cuguauuguccuaguuuuuu

SEQ ID NO: 251771 - RNA, 18 nt, Human
cuguccccuuugggcugg

SEQ ID NO: 251772 - RNA, 22 nt, Human
cugugugcagcacucguuuccc

SEQ ID NO: 251773 - RNA, 18 nt, Human
cuuaaagggaagaaggaa

SEQ ID NO: 251774 - RNA, 26 nt, Human
cuuccaauccccaacauuuauacccc

SEQ ID NO: 251775 - RNA, 18 nt, Human
cuuccuguugccauuucc

SEQ ID NO: 251776 - RNA, 21 nt, Human
cuugagguggaagcugggggu

SEQ ID NO: 251777 - RNA, 24 nt, Human
cuuggauaugacaccaaaagcaca

SEQ ID NO: 251778 - RNA, 20 nt, Human
cuuuuguuuguuuguuuuga

SEQ ID NO: 251779 - RNA, 25 nt, Human
gaaaagaccaaggcagacaugaaua

SEQ ID NO: 251780 - RNA, 31 nt, Human
gaaaaucauacacacacacacacacacacag

SEQ ID NO: 251781 - RNA, 20 nt, Human
gaaagaucccaacgauaaaa

SEQ ID NO: 251782 - RNA, 21 nt, Human
gaaggcaaugugauagggguc

SEQ ID NO: 251783 - RNA, 21 nt, Human
gacaaaugaggaacaaaucca

SEQ ID NO: 251784 - RNA, 19 nt, Human
gacacugccucugggugcc

SEQ ID NO: 251785 - RNA, 24 nt, Human
gacauuuuuccaaagacaacauac

SEQ ID NO: 251786 - RNA, 21 nt, Human
gaccaaacacagaaaagacaa

SEQ ID NO: 251787 - RNA, 24 nt, Human
gaccaacauuauucuauuuuggca

SEQ ID NO: 251788 - RNA, 23 nt, Human
gaccacaaaaguaaaaacagaua

SEQ ID NO: 251789 - RNA, 21 nt, Human
gagccuuuuugucccccacaa

SEQ ID NO: 251790 - RNA, 19 nt, Human
gaggagcccugaguaacgu

SEQ ID NO: 251791 - RNA, 26 nt, Human
gaggagcccugaguaacguuggucug

SEQ ID NO: 251792 - RNA, 23 nt, Human
gaggagcuuggguuucuaggggc

SEQ ID NO: 251793 - RNA, 19 nt, Human
gaguaccacacaaagccag

SEQ ID NO: 251794 - RNA, 20 nt, Human
gagucagggacaagcaacaa

SEQ ID NO: 251795 - RNA, 21 nt, Human
gauaacaacagacgugaaaaa

SEQ ID NO: 251796 - RNA, 21 nt, Human
gaucacaggcgugcgccacca

SEQ ID NO: 251797 - RNA, 24 nt, Human
gaugagaaacaaggaguucugaaa

SEQ ID NO: 251798 - RNA, 24 nt, Human
gaugccuacucugugugcagcacu

SEQ ID NO: 251799 - RNA, 23 nt, Human
gaugccuucacucagaggaaguu

SEQ ID NO: 251800 - RNA, 26 nt, Human
gcaaaauauuacaauaaaacuuaaag

SEQ ID NO: 251801 - RNA, 21 nt, Human
gcaaucuaaaaaaagcagaaa

SEQ ID NO: 251802 - RNA, 21 nt, Human
gcacacacacacacaccacaa

SEQ ID NO: 251803 - RNA, 22 nt, Human
gcacuaaauuccccaaagcccc

SEQ ID NO: 251804 - RNA, 22 nt, Human
gcacuggguugggcaucaccag

SEQ ID NO: 251805 - RNA, 20 nt, Human
gcagaggcccaggcagggcc

SEQ ID NO: 251806 - RNA, 22 nt, Human
gcagauuuccuccgggaugcuc

SEQ ID NO: 251807 - RNA, 20 nt, Human
gcagcugagucaaucuccuu

SEQ ID NO: 251808 - RNA, 23 nt, Human
gcagggcuggagguccuggaggg

SEQ ID NO: 251809 - RNA, 18 nt, Human
gcaguucucuguguacuc

SEQ ID NO: 251810 - RNA, 24 nt, Human
gcccaggcuggaaugcaguggcuc

SEQ ID NO: 251811 - RNA, 25 nt, Human
gcccccaaaccccaaggagaguccu

SEQ ID NO: 251812 - RNA, 26 nt, Human
gccccuccucacacaaacacagauuc

SEQ ID NO: 251813 - RNA, 25 nt, Human
gcccggagccugcugggacaugaag

SEQ ID NO: 251814 - RNA, 24 nt, Human
gccucggucccccucgcccaccuc

SEQ ID NO: 251815 - RNA, 24 nt, Human
gcgauucucgugccucagccuccc

SEQ ID NO: 251816 - RNA, 20 nt, Human
gcggagggcaggcgcagaca

SEQ ID NO: 251817 - RNA, 30 nt, Human
gcgggcggugggcggcggcggcuuccccuu

SEQ ID NO: 251818 - RNA, 20 nt, Human
gcgguauagccuuaucuaca

SEQ ID NO: 251819 - RNA, 21 nt, Human
gcgguuauagaggugcugggg

SEQ ID NO: 251820 - RNA, 21 nt, Human
gcuaccugcagacucggggug

SEQ ID NO: 251821 - RNA, 21 nt, Human
gcuaccugcagacucggggug

SEQ ID NO: 251822 - RNA, 19 nt, Human
gcuauauacucaaaagaac

SEQ ID NO: 251823 - RNA, 27 nt, Human
gcucauuuaaaaagcacaaacauucaa

SEQ ID NO: 251824 - RNA, 21 nt, Human
gcuccccgggcuggagguggg

SEQ ID NO: 251825 - RNA, 21 nt, Human
gcugaaucuuaccaugguauu

SEQ ID NO: 251826 - RNA, 24 nt, Human
gcuggaaugcaguggcucgaucug

SEQ ID NO: 251827 - RNA, 22 nt, Human
ggaaaggaggccuggauuguuu

SEQ ID NO: 251828 - RNA, 21 nt, Human
ggaaauaguggcgggccgggc

SEQ ID NO: 251829 - RNA, 21 nt, Human
ggaaauaguggcgggccgggc

SEQ ID NO: 251830 - RNA, 25 nt, Human
ggaaaugucaaugggaccaaccucc

SEQ ID NO: 251831 - RNA, 21 nt, Human
ggaagagggcggggcucagga

SEQ ID NO: 251832 - RNA, 18 nt, Human
ggaccugugcucccuugg

SEQ ID NO: 251833 - RNA, 19 nt, Human
ggagcccugaguaacguug

SEQ ID NO: 251834 - RNA, 24 nt, Human
ggagcccugaguaacguuggucug

SEQ ID NO: 251835 - RNA, 20 nt, Human
ggccaguuucgucaggaaga

SEQ ID NO: 251836 - RNA, 20 nt, Human
ggccaugacgguggccucug

SEQ ID NO: 251837 - RNA, 20 nt, Human
ggcggcacagugacuucucc

SEQ ID NO: 251838 - RNA, 24 nt, Human
ggcggcaggggaggcggguggugu

SEQ ID NO: 251839 - RNA, 19 nt, Human
ggcgggcggugggcggcgg

SEQ ID NO: 251840 - RNA, 19 nt, Human
ggcgggcggugggcggcgg

SEQ ID NO: 251841 - RNA, 19 nt, Human
ggcgggcggugggcggcgg

SEQ ID NO: 251842 - RNA, 19 nt, Human
ggcgggcggugggcggcgg

SEQ ID NO: 251843 - RNA, 19 nt, Human
ggcgggcggugggcggcgg

SEQ ID NO: 251844 - RNA, 22 nt, Human
ggcgggcggugggcggcggcgg

SEQ ID NO: 251845 - RNA, 25 nt, Human
ggcggugggcggcggccuccgcgcu

SEQ ID NO: 251846 - RNA, 19 nt, Human
ggcggugggcggcggcggc

SEQ ID NO: 251847 - RNA, 19 nt, Human
ggcugggggcagaacaugg

SEQ ID NO: 251848 - RNA, 18 nt, Human
gggaagaaggaaaugaua

SEQ ID NO: 251849 - RNA, 19 nt, Human
gggagguuaaguaacuugc

SEQ ID NO: 251850 - RNA, 23 nt, Human
gggaugccuucacucagaggaag

SEQ ID NO: 251851 - RNA, 18 nt, Human
gggcggugggcggcggca

SEQ ID NO: 251852 - RNA, 19 nt, Human
ggggguggcaggaggcggc

SEQ ID NO: 251853 - RNA, 23 nt, Human
gggguggcaggaggcggcagggg

SEQ ID NO: 251854 - RNA, 22 nt, Human
gguuaccccucuggaggguggg

SEQ ID NO: 251855 - RNA, 19 nt, Human
guauauauauauauauaca

SEQ ID NO: 251856 - RNA, 21 nt, Human
gucaaaacaguuuaacagcuc

SEQ ID NO: 251857 - RNA, 18 nt, Human
gugagguuuccauuggcc

SEQ ID NO: 251858 - RNA, 22 nt, Human
gugccucagccucccgaguagc

SEQ ID NO: 251859 - RNA, 18 nt, Human
guucugagcuggagaaaa

SEQ ID NO: 251860 - RNA, 20 nt, Human
guugcugaggcuggagggaa

SEQ ID NO: 251861 - RNA, 19 nt, Human
guuuggguagaggugaggc

SEQ ID NO: 251862 - RNA, 24 nt, Human
guuuguuuugagacacggucuuuc

SEQ ID NO: 251863 - RNA, 24 nt, Human
uaaaaaaaagauauaaaauaagaa

SEQ ID NO: 251864 - RNA, 22 nt, Human
uaaaaaaagcagaaaauaacaa

SEQ ID NO: 251865 - RNA, 21 nt, Human
uaaaaaacaauuaaagaaagc

SEQ ID NO: 251866 - RNA, 22 nt, Human
uaaaaaacaggaugagaaacaa

SEQ ID NO: 251867 - RNA, 26 nt, Human
uaaaaaaccacauauuggguacaaug

SEQ ID NO: 251868 - RNA, 21 nt, Human
uaaaaaacgaaaccauacaag

SEQ ID NO: 251869 - RNA, 19 nt, Human
uaaaaagacaccugaucac

SEQ ID NO: 251870 - RNA, 22 nt, Human
uaaaaagacaccugaucacagc

SEQ ID NO: 251871 - RNA, 20 nt, Human
uaaaaagcaaagcaaagggg

SEQ ID NO: 251872 - RNA, 23 nt, Human
uaaaaagcaaagcaaagggguaa

SEQ ID NO: 251873 - RNA, 19 nt, Human
uaaaaauugcugaaacaac

SEQ ID NO: 251874 - RNA, 21 nt, Human
uaaaaccauaagugcucacug

SEQ ID NO: 251875 - RNA, 26 nt, Human
uaaaaguaccuuauaacguuggauuu

SEQ ID NO: 251876 - RNA, 24 nt, Human
uaaaauagucaaaggacuugaaua

SEQ ID NO: 251877 - RNA, 18 nt, Human
uaaaaucucagacuucac

SEQ ID NO: 251878 - RNA, 18 nt, Human
uaaaaucucagacuucac

SEQ ID NO: 251879 - RNA, 24 nt, Human
uaaaaucucagacuucacuacugu

SEQ ID NO: 251880 - RNA, 24 nt, Human
uaaaaucucagacuucacuacugu

SEQ ID NO: 251881 - RNA, 20 nt, Human
uaaaaugaccauaccaacac

SEQ ID NO: 251882 - RNA, 20 nt, Human
uaaaauuuccagaaauagau

SEQ ID NO: 251883 - RNA, 23 nt, Human
uaaacuggaaaaaaauauuugca

SEQ ID NO: 251884 - RNA, 20 nt, Human
uaaagauuagugagaaauag

SEQ ID NO: 251885 - RNA, 20 nt, Human
uaaaggcaccucgcccacuc

SEQ ID NO: 251886 - RNA, 25 nt, Human
uaacaaaauguauucaucuuucuug

SEQ ID NO: 251887 - RNA, 22 nt, Human
uaacaacaacaacaaaaacugg

SEQ ID NO: 251888 - RNA, 24 nt, Human
uaacaacaacaacaaaaacuggag

SEQ ID NO: 251889 - RNA, 18 nt, Human
uaacacccacaccccaaa

SEQ ID NO: 251890 - RNA, 21 nt, Human
uaagacaacuaaaauaccuua

SEQ ID NO: 251891 - RNA, 21 nt, Human
uaagacacaguugcaaggacg

SEQ ID NO: 251892 - RNA, 21 nt, Human
uaagcaaaaccuuacacccca

SEQ ID NO: 251893 - RNA, 23 nt, Human
uaaggcacgauuuacauacuaaa

SEQ ID NO: 251894 - RNA, 20 nt, Human
uaaggcggagccuggguccc

SEQ ID NO: 251895 - RNA, 20 nt, Human
uaauauaauaacauuagcca

SEQ ID NO: 251896 - RNA, 19 nt, Human
uaaugaguaccacacaaag

SEQ ID NO: 251897 - RNA, 22 nt, Human
uaaugaguaccacacaaagcca

SEQ ID NO: 251898 - RNA, 22 nt, Human
uaaugguuccccaaaaagggaa

SEQ ID NO: 251899 - RNA, 21 nt, Human
uacaaaacaggaagagaucag

SEQ ID NO: 251900 - RNA, 23 nt, Human
uacaaaacaggaagagaucaggc

SEQ ID NO: 251901 - RNA, 26 nt, Human
uacacacacacacacacacacacacg

SEQ ID NO: 251902 - RNA, 20 nt, Human
uacacacacacacacacaua

SEQ ID NO: 251903 - RNA, 20 nt, Human
uacacacacacacacacaua

SEQ ID NO: 251904 - RNA, 21 nt, Human
uacacacacacacacacauaa

SEQ ID NO: 251905 - RNA, 21 nt, Human
uacacacacacacacacauaa

SEQ ID NO: 251906 - RNA, 27 nt, Human
uacacacacacacacacauaaagaaaa

SEQ ID NO: 251907 - RNA, 27 nt, Human
uacacacacacacacacauaaagaaaa

SEQ ID NO: 251908 - RNA, 26 nt, Human
uacacauaacaaguucagaaaccaca

SEQ ID NO: 251909 - RNA, 26 nt, Human
uacagaaauauagacuaagacaacua

SEQ ID NO: 251910 - RNA, 22 nt, Human
uacagaguuuguuuugcaagau

SEQ ID NO: 251911 - RNA, 22 nt, Human
uacaggaguguucuagccucca

SEQ ID NO: 251912 - RNA, 18 nt, Human
uacagugaccacaaaagg

SEQ ID NO: 251913 - RNA, 21 nt, Human
uaccacauuauuaaaaaacaa

SEQ ID NO: 251914 - RNA, 18 nt, Human
uaccaggaauuagacucu

SEQ ID NO: 251915 - RNA, 21 nt, Human
uaccauacagagcaacauacc

SEQ ID NO: 251916 - RNA, 25 nt, Human
uaccaugguauuaaaugagaauguu

SEQ ID NO: 251917 - RNA, 25 nt, Human
uaccaugguauuaaaugagaauguu

SEQ ID NO: 251918 - RNA, 19 nt, Human
uaccccucuggaggguggg

SEQ ID NO: 251919 - RNA, 18 nt, Human
uacccgagacuacuuccc

SEQ ID NO: 251920 - RNA, 20 nt, Human
uacccgccgggaaguggagu

SEQ ID NO: 251921 - RNA, 23 nt, Human
uagaaaaaugguuaaaaugacca

SEQ ID NO: 251922 - RNA, 23 nt, Human
uagaaaauacccuguaugcccau

SEQ ID NO: 251923 - RNA, 20 nt, Human
uagaaugggguugcugaggc

SEQ ID NO: 251924 - RNA, 19 nt, Human
uagacgcagcucagaacca

SEQ ID NO: 251925 - RNA, 25 nt, Human
uagcaaagguacauggauucuggcc

SEQ ID NO: 251926 - RNA, 25 nt, Human
uagcaagaaauaaauaaaauuguaa

SEQ ID NO: 251927 - RNA, 23 nt, Human
uagcuuuuguuuguuuguuuuga

SEQ ID NO: 251928 - RNA, 19 nt, Human
uaggggguggcaggaggcg

SEQ ID NO: 251929 - RNA, 21 nt, Human
uaggggguggcaggaggcggc

SEQ ID NO: 251930 - RNA, 24 nt, Human
uaggggguggcaggaggcggcagg

SEQ ID NO: 251931 - RNA, 22 nt, Human
uagggucgcacuacccgccggg

SEQ ID NO: 251932 - RNA, 25 nt, Human
uaguaguuaucuuagggguccggga

SEQ ID NO: 251933 - RNA, 19 nt, Human
uagugccaacguuguuguc

SEQ ID NO: 251934 - RNA, 18 nt, Human
uaguuuguuuuugguuua

SEQ ID NO: 251935 - RNA, 18 nt, Human
uaguuuuuguauuggaua

SEQ ID NO: 251936 - RNA, 25 nt, Human
uauaaacuggaaaaaaauauuugca

SEQ ID NO: 251937 - RNA, 22 nt, Human
uauaauaggugcuuuuugcacc

SEQ ID NO: 251938 - RNA, 23 nt, Human
uauacacacacacacacacauaa

SEQ ID NO: 251939 - RNA, 21 nt, Human
uauacauauauauauaaacua

SEQ ID NO: 251940 - RNA, 22 nt, Human
uauacucacaacaggaagugua

SEQ ID NO: 251941 - RNA, 20 nt, Human
uauauacauauauauauaua

SEQ ID NO: 251942 - RNA, 20 nt, Human
uauauacauauauauauaua

SEQ ID NO: 251943 - RNA, 24 nt, Human
uauauacauauauauauauauaca

SEQ ID NO: 251944 - RNA, 22 nt, Human
uauauauacauauauauauaua

SEQ ID NO: 251945 - RNA, 23 nt, Human
uauauauacauauauauauauau

SEQ ID NO: 251946 - RNA, 22 nt, Human
uauauauauacauauauauaua

SEQ ID NO: 251947 - RNA, 23 nt, Human
uauauauauacauauauauauaa

SEQ ID NO: 251948 - RNA, 23 nt, Human
uauauauauacauauauauauau

SEQ ID NO: 251949 - RNA, 24 nt, Human
uauauauauacauauauauauaua

SEQ ID NO: 251950 - RNA, 27 nt, Human
uauauauauacauauauauauauauua

SEQ ID NO: 251951 - RNA, 31 nt, Human
uauauauauauacacacacacacacacauag

SEQ ID NO: 251952 - RNA, 20 nt, Human
uauauauauauacauauaua

SEQ ID NO: 251953 - RNA, 20 nt, Human
uauauauauauacauauaua

SEQ ID NO: 251954 - RNA, 22 nt, Human
uauauauauauacauauauaua

SEQ ID NO: 251955 - RNA, 22 nt, Human
uauauauauauacauauauaua

SEQ ID NO: 251956 - RNA, 24 nt, Human
uauauauauauauacauauauaua

SEQ ID NO: 251957 - RNA, 24 nt, Human
uauauauauauauacauauauaua

SEQ ID NO: 251958 - RNA, 18 nt, Human
uauauauauauguauaua

SEQ ID NO: 251959 - RNA, 18 nt, Human
uauauauauauguauaua

SEQ ID NO: 251960 - RNA, 20 nt, Human
uauauauauguauauauaua

SEQ ID NO: 251961 - RNA, 20 nt, Human
uauauauauguauauauaua

SEQ ID NO: 251962 - RNA, 23 nt, Human
uauauauauguauauauauauau

SEQ ID NO: 251963 - RNA, 23 nt, Human
uauauauauguauauauauaugu

SEQ ID NO: 251964 - RNA, 24 nt, Human
uauauauauguauauauauaugua

SEQ ID NO: 251965 - RNA, 24 nt, Human
uauauaugaccaaaagccauuugu

SEQ ID NO: 251966 - RNA, 24 nt, Human
uauauguauauauauauauauaca

SEQ ID NO: 251967 - RNA, 24 nt, Human
uauauguauauauauauguauaua

SEQ ID NO: 251968 - RNA, 19 nt, Human
uauauuacccacaccucug

SEQ ID NO: 251969 - RNA, 18 nt, Human
uauccagaauauagaaag

SEQ ID NO: 251970 - RNA, 25 nt, Human
uauccuccagauuccacgugauccu

SEQ ID NO: 251971 - RNA, 18 nt, Human
uaucuucuacauggccuu

SEQ ID NO: 251972 - RNA, 24 nt, Human
uaugaacaacagauacucucauac

SEQ ID NO: 251973 - RNA, 23 nt, Human
uaugaccaaaagccauuuguacc

SEQ ID NO: 251974 - RNA, 23 nt, Human
uaugaccaaaagccauuuguacc

SEQ ID NO: 251975 - RNA, 19 nt, Human
uaugacccaggaauuucac

SEQ ID NO: 251976 - RNA, 20 nt, Human
uaugacccaggaauuucacu

SEQ ID NO: 251977 - RNA, 23 nt, Human
uaugagaaaaacagauacuuuua

SEQ ID NO: 251978 - RNA, 21 nt, Human
uauggcaaaguacuccccacc

SEQ ID NO: 251979 - RNA, 18 nt, Human
uauguauauauauauaua

SEQ ID NO: 251980 - RNA, 19 nt, Human
uauguauauauauauauau

SEQ ID NO: 251981 - RNA, 24 nt, Human
uauguauauauauauauauacaua

SEQ ID NO: 251982 - RNA, 18 nt, Human
uauguauauauauaugua

SEQ ID NO: 251983 - RNA, 19 nt, Human
uauguauauauauauguau

SEQ ID NO: 251984 - RNA, 22 nt, Human
uauguauauauauauguauaua

SEQ ID NO: 251985 - RNA, 22 nt, Human
uaugugcauauacauaaauaua

SEQ ID NO: 251986 - RNA, 23 nt, Human
ucaaacucacagaaacagaaagu

SEQ ID NO: 251987 - RNA, 22 nt, Human
ucaaagauggcaacuagcagaa

SEQ ID NO: 251988 - RNA, 24 nt, Human
ucaagugaaacuuaaagggaagaa

SEQ ID NO: 251989 - RNA, 19 nt, Human
ucacacauguaguaaaggc

SEQ ID NO: 251990 - RNA, 23 nt, Human
ucacaccuucacaguuucaaauc

SEQ ID NO: 251991 - RNA, 18 nt, Human
ucacagccaccugccuug

SEQ ID NO: 251992 - RNA, 24 nt, Human
ucacccacgcacuaaauuccccaa

SEQ ID NO: 251993 - RNA, 26 nt, Human
ucacucaccaaaaggaaaaaaacaag

SEQ ID NO: 251994 - RNA, 24 nt, Human
ucacugcagccucgacuucacggg

SEQ ID NO: 251995 - RNA, 18 nt, Human
ucacuucuacaaggacac

SEQ ID NO: 251996 - RNA, 18 nt, Human
ucagcaugccaguugcug

SEQ ID NO: 251997 - RNA, 19 nt, Human
ucagcaugccaguugcugg

SEQ ID NO: 251998 - RNA, 19 nt, Human
ucaggaagagggcggggcu

SEQ ID NO: 251999 - RNA, 18 nt, Human
ucagggacaagcaacaac

SEQ ID NO: 252000 - RNA, 19 nt, Human
ucaugaucccccaccauuu

SEQ ID NO: 252001 - RNA, 19 nt, Human
uccaaacuacaauuaaaua

SEQ ID NO: 252002 - RNA, 18 nt, Human
uccaaagacaacauacaa

SEQ ID NO: 252003 - RNA, 19 nt, Human
uccaaauucuggaagcagg

SEQ ID NO: 252004 - RNA, 20 nt, Human
uccacagggaaagcagacuc

SEQ ID NO: 252005 - RNA, 27 nt, Human
uccacagugcaagacaggccggggucc

SEQ ID NO: 252006 - RNA, 23 nt, Human
uccacagugcaagacaggcugug

SEQ ID NO: 252007 - RNA, 22 nt, Human
uccacgugauccugcucacacc

SEQ ID NO: 252008 - RNA, 18 nt, Human
uccaggggauacaugugu

SEQ ID NO: 252009 - RNA, 24 nt, Human
ucccaacgauaaaaauaaccauga

SEQ ID NO: 252010 - RNA, 21 nt, Human
uccccacaauccccauccccu

SEQ ID NO: 252011 - RNA, 21 nt, Human
uccccacaauccccauccccu

SEQ ID NO: 252012 - RNA, 21 nt, Human
uccccaccuuguagcaaagca

SEQ ID NO: 252013 - RNA, 18 nt, Human
uccccagcacuccacccg

SEQ ID NO: 252014 - RNA, 24 nt, Human
ucccgaguagcugugaucacaggc

SEQ ID NO: 252015 - RNA, 20 nt, Human
ucccuacuguuaaaugaaaa

SEQ ID NO: 252016 - RNA, 27 nt, Human
ucccuuggguuaagggugaaaccucag

SEQ ID NO: 252017 - RNA, 22 nt, Human
uccgagaugggcuggaccucug

SEQ ID NO: 252018 - RNA, 21 nt, Human
uccggacaccuccuucccgag

SEQ ID NO: 252019 - RNA, 19 nt, Human
uccgucggaggagcaaagg

SEQ ID NO: 252020 - RNA, 23 nt, Human
uccgucggaggagcaaagguuuu

SEQ ID NO: 252021 - RNA, 24 nt, Human
uccucacacaaacacagauuccac

SEQ ID NO: 252022 - RNA, 19 nt, Human
uccuccagaggucucacug

SEQ ID NO: 252023 - RNA, 21 nt, Human
uccucuggacacugccucugg

SEQ ID NO: 252024 - RNA, 22 nt, Human
uccugcgguucucagugcugcc

SEQ ID NO: 252025 - RNA, 21 nt, Human
uccuuaagauguaaauggcuu

SEQ ID NO: 252026 - RNA, 21 nt, Human
uccuuaauauguaaagagcuc

SEQ ID NO: 252027 - RNA, 18 nt, Human
uccuuggaaucucucagc

SEQ ID NO: 252028 - RNA, 19 nt, Human
ucgaucucaccugaucuga

SEQ ID NO: 252029 - RNA, 20 nt, Human
ucgcccaccuccgcgcuuac

SEQ ID NO: 252030 - RNA, 20 nt, Human
ucgcccacucucuccccaca

SEQ ID NO: 252031 - RNA, 23 nt, Human
ucgcccacucucuccccacaauc

SEQ ID NO: 252032 - RNA, 22 nt, Human
ucgcccaggcuggaaugcagug

SEQ ID NO: 252033 - RNA, 21 nt, Human
ucggaagggagguccugcucu

SEQ ID NO: 252034 - RNA, 26 nt, Human
ucuaagaggaaaaaaaaacuagaaaa

SEQ ID NO: 252035 - RNA, 23 nt, Human
ucuacaguaaaaauugcugaaac

SEQ ID NO: 252036 - RNA, 22 nt, Human
ucuacgacugugcccccggggc

SEQ ID NO: 252037 - RNA, 20 nt, Human
ucuauagcaguuaucuucca

SEQ ID NO: 252038 - RNA, 24 nt, Human
ucuauaugaccaaaagccauuugu

SEQ ID NO: 252039 - RNA, 21 nt, Human
ucugaggaagaggggaaggca

SEQ ID NO: 252040 - RNA, 20 nt, Human
ucugcacacagcagugcccc

SEQ ID NO: 252041 - RNA, 25 nt, Human
ucugcagauuuccuccgggaugcuc

SEQ ID NO: 252042 - RNA, 19 nt, Human
ucugcugcguaugcaaguc

SEQ ID NO: 252043 - RNA, 22 nt, Human
ucuguauuguccuaguuuuugu

SEQ ID NO: 252044 - RNA, 19 nt, Human
ucuuggacccugggggccu

SEQ ID NO: 252045 - RNA, 18 nt, Human
ucuuuagugagguaagaa

SEQ ID NO: 252046 - RNA, 19 nt, Human
ucuuucgcccaggcuggaa

SEQ ID NO: 252047 - RNA, 23 nt, Human
ucuuucucuuucgcccaggcugg

SEQ ID NO: 252048 - RNA, 24 nt, Human
ucuuucucuuucgcccaggcugga

SEQ ID NO: 252049 - RNA, 21 nt, Human
ugaaaaaguaaccuuauggaa

SEQ ID NO: 252050 - RNA, 20 nt, Human
ugaaacaagcaccuuccuuc

SEQ ID NO: 252051 - RNA, 21 nt, Human
ugaaaggugcuggaggggaug

SEQ ID NO: 252052 - RNA, 23 nt, Human
ugaaaggugcuggaggggaugcc

SEQ ID NO: 252053 - RNA, 22 nt, Human
ugaagacaccuacagaugcugc

SEQ ID NO: 252054 - RNA, 19 nt, Human
ugaagguguggggaaaugu

SEQ ID NO: 252055 - RNA, 21 nt, Human
ugaauagacauuuuuccaaag

SEQ ID NO: 252056 - RNA, 26 nt, Human
ugaaucacccacaggguuugaaguuc

SEQ ID NO: 252057 - RNA, 21 nt, Human
ugaauggauaaaaaaaagaua

SEQ ID NO: 252058 - RNA, 21 nt, Human
ugacaccaaaagcacagacca

SEQ ID NO: 252059 - RNA, 18 nt, Human
ugaccaaaagccauuugu

SEQ ID NO: 252060 - RNA, 20 nt, Human
ugaccaaaagccauuuguac

SEQ ID NO: 252061 - RNA, 22 nt, Human
ugaccuggaacgaaaaaaccaa

SEQ ID NO: 252062 - RNA, 22 nt, Human
ugacuaauucacuugauaacac

SEQ ID NO: 252063 - RNA, 21 nt, Human
ugacuaauucacuugauaacc

SEQ ID NO: 252064 - RNA, 23 nt, Human
ugacugaccuggaacgaaaaaac

SEQ ID NO: 252065 - RNA, 19 nt, Human
ugacuucuccccagcacuc

SEQ ID NO: 252066 - RNA, 21 nt, Human
ugagaaaaacagauacuuuua

SEQ ID NO: 252067 - RNA, 18 nt, Human
ugagaaacaaggaguucu

SEQ ID NO: 252068 - RNA, 24 nt, Human
ugagagcaccaugccccuccucaa

SEQ ID NO: 252069 - RNA, 21 nt, Human
ugaggaaaaagaucagguugc

SEQ ID NO: 252070 - RNA, 24 nt, Human
ugaggaagaggggaaggcaucagg

SEQ ID NO: 252071 - RNA, 25 nt, Human
ugaggaagaggggaaggcaucaggu

SEQ ID NO: 252072 - RNA, 22 nt, Human
ugaguggauaaauaaaaugugg

SEQ ID NO: 252073 - RNA, 24 nt, Human
ugauaaagccgguucugaggaaga

SEQ ID NO: 252074 - RNA, 21 nt, Human
ugauaacacccacaccccaaa

SEQ ID NO: 252075 - RNA, 21 nt, Human
ugaucuagcaaucccacuccu

SEQ ID NO: 252076 - RNA, 24 nt, Human
ugcaaaacaaucaauagaaaaaug

SEQ ID NO: 252077 - RNA, 24 nt, Human
ugcaaaauaauaaauuuucucuaa

SEQ ID NO: 252078 - RNA, 20 nt, Human
ugcaaacuuuacaguaaacu

SEQ ID NO: 252079 - RNA, 22 nt, Human
ugcaagaugaaaaaguucugga

SEQ ID NO: 252080 - RNA, 18 nt, Human
ugcagagagaaacugugg

SEQ ID NO: 252081 - RNA, 18 nt, Human
ugcagagagaaacugugg

SEQ ID NO: 252082 - RNA, 23 nt, Human
ugcagagagaaacugugguaaaa

SEQ ID NO: 252083 - RNA, 21 nt, Human
ugcagcaauuuuggauggagc

SEQ ID NO: 252084 - RNA, 24 nt, Human
ugcagcaauuuuggauggagcugg

SEQ ID NO: 252085 - RNA, 24 nt, Human
ugccucagccucccgaguagcugu

SEQ ID NO: 252086 - RNA, 25 nt, Human
ugccucagccucccgaguagcugug

SEQ ID NO: 252087 - RNA, 19 nt, Human
ugccucugggugccucagc

SEQ ID NO: 252088 - RNA, 26 nt, Human
ugcgguucucagugcugccaaccugg

SEQ ID NO: 252089 - RNA, 18 nt, Human
ugcuauuucaauuucauc

SEQ ID NO: 252090 - RNA, 24 nt, Human
ugcucauaggcugggggcggaguu

SEQ ID NO: 252091 - RNA, 18 nt, Human
ugcucuccuacauggccu

SEQ ID NO: 252092 - RNA, 22 nt, Human
ugcuggaggggaugccuucacu

SEQ ID NO: 252093 - RNA, 18 nt, Human
uggaaagaaacugcagca

SEQ ID NO: 252094 - RNA, 21 nt, Human
uggaacaaaaaaucaaagaca

SEQ ID NO: 252095 - RNA, 24 nt, Human
uggaacauguaccuguucaucuuu

SEQ ID NO: 252096 - RNA, 20 nt, Human
uggaaccaacccaucaacca

SEQ ID NO: 252097 - RNA, 21 nt, Human
uggaaccaacccaucaaccag

SEQ ID NO: 252098 - RNA, 19 nt, Human
uggaaccaaccuacaugcc

SEQ ID NO: 252099 - RNA, 20 nt, Human
uggaacgaaaaaaccaagaa

SEQ ID NO: 252100 - RNA, 21 nt, Human
uggaaggaaacuagcaaagca

SEQ ID NO: 252101 - RNA, 23 nt, Human
uggaauaugacuuagcaauaaaa

SEQ ID NO: 252102 - RNA, 19 nt, Human
uggaaugcaguggcucgau

SEQ ID NO: 252103 - RNA, 23 nt, Human
uggaaugcaguggcucgaucugg

SEQ ID NO: 252104 - RNA, 23 nt, Human
uggacacugccucugggugccuc

SEQ ID NO: 252105 - RNA, 22 nt, Human
uggaccucugggagguucccag

SEQ ID NO: 252106 - RNA, 24 nt, Human
uggaggugggaccugugcucccuu

SEQ ID NO: 252107 - RNA, 25 nt, Human
uggauaucauauacucacaacagga

SEQ ID NO: 252108 - RNA, 23 nt, Human
uggaugaauggauaaaaaaaaga

SEQ ID NO: 252109 - RNA, 22 nt, Human
uggcaaaguacuccccaccuac

SEQ ID NO: 252110 - RNA, 21 nt, Human
uggcaaauguggccuucccuc

SEQ ID NO: 252111 - RNA, 19 nt, Human
uggcaguggcuuccauucu

SEQ ID NO: 252112 - RNA, 20 nt, Human
uggcauaaucccauuuuugu

SEQ ID NO: 252113 - RNA, 19 nt, Human
uggcgggccgggccgcugc

SEQ ID NO: 252114 - RNA, 19 nt, Human
uggcgggccgggccgcugc

SEQ ID NO: 252115 - RNA, 23 nt, Human
ugggaagggaggcuggggguuag

SEQ ID NO: 252116 - RNA, 21 nt, Human
ugggaggagcccugaguaacg

SEQ ID NO: 252117 - RNA, 22 nt, Human
ugggaggagcccugaguaacgu

SEQ ID NO: 252118 - RNA, 21 nt, Human
ugggauaauaccaguucuauc

SEQ ID NO: 252119 - RNA, 19 nt, Human
ugggccuuuaaagacuggu

SEQ ID NO: 252120 - RNA, 23 nt, Human
ugggcugggggcagaacaugggc

SEQ ID NO: 252121 - RNA, 20 nt, Human
uggggaaauggagagucagg

SEQ ID NO: 252122 - RNA, 18 nt, Human
uggggaggguaagagggg

SEQ ID NO: 252123 - RNA, 20 nt, Human
uggggaggguaagagggggg

SEQ ID NO: 252124 - RNA, 21 nt, Human
uggggaggguaagaggggggc

SEQ ID NO: 252125 - RNA, 26 nt, Human
ugggggcagaacaugggcucagaguu

SEQ ID NO: 252126 - RNA, 22 nt, Human
ugggugucuucauuucaugccc

SEQ ID NO: 252127 - RNA, 25 nt, Human
uguaaaaaccugauguuaguggcua

SEQ ID NO: 252128 - RNA, 20 nt, Human
uguaaaggggaagaaaagug

SEQ ID NO: 252129 - RNA, 25 nt, Human
uguaagcaaaaccuuacaccccaag

SEQ ID NO: 252130 - RNA, 20 nt, Human
uguaaggagaaaacacccac

SEQ ID NO: 252131 - RNA, 22 nt, Human
uguacauuacagcauuauacuu

SEQ ID NO: 252132 - RNA, 18 nt, Human
uguauauauauauauaua

SEQ ID NO: 252133 - RNA, 22 nt, Human
uguauauauauauauauacaua

SEQ ID NO: 252134 - RNA, 22 nt, Human
uguauauauauauguauauaua

SEQ ID NO: 252135 - RNA, 22 nt, Human
ugucacagacgcuuuccuagaa

SEQ ID NO: 252136 - RNA, 19 nt, Human
ugugcacaagggguugugu

SEQ ID NO: 252137 - RNA, 21 nt, Human
uguguacauuacagcauuaua

SEQ ID NO: 252138 - RNA, 18 nt, Human
uguguaugugcauauaca

SEQ ID NO: 252139 - RNA, 19 nt, Human
uguguaugugcauauacau

SEQ ID NO: 252140 - RNA, 21 nt, Human
ugugucccagacucgggauac

SEQ ID NO: 252141 - RNA, 18 nt, Human
uguguguaugugcauaua

SEQ ID NO: 252142 - RNA, 22 nt, Human
uguguguaugugcauauacaua

SEQ ID NO: 252143 - RNA, 24 nt, Human
uguuauagagccauaaaaauaaca

SEQ ID NO: 252144 - RNA, 23 nt, Human
uuaaaaaacaauuaaagaaagca

SEQ ID NO: 252145 - RNA, 20 nt, Human
uuaaaaagcacaaacauuca

SEQ ID NO: 252146 - RNA, 20 nt, Human
uuaaaauuucaagugaaacu

SEQ ID NO: 252147 - RNA, 22 nt, Human
uuaaacacugccagagaguaaa

SEQ ID NO: 252148 - RNA, 24 nt, Human
uuaacacuucuucagucuucccca

SEQ ID NO: 252149 - RNA, 19 nt, Human
uuaauuuuacagugaccac

SEQ ID NO: 252150 - RNA, 22 nt, Human
uuacaaggcuuuucuaagacuu

SEQ ID NO: 252151 - RNA, 21 nt, Human
uuagacuauuucaaaacuaaa

SEQ ID NO: 252152 - RNA, 21 nt, Human
uuagucacucaccaaaaggaa

SEQ ID NO: 252153 - RNA, 21 nt, Human
uuauaccagaaagacacuuga

SEQ ID NO: 252154 - RNA, 25 nt, Human
uuaugaggaaaaagaucagguuguc

SEQ ID NO: 252155 - RNA, 24 nt, Human
uuauuuucuaagaggaaaaaaaaa

SEQ ID NO: 252156 - RNA, 19 nt, Human
uucaacaaacuaaacagac

SEQ ID NO: 252157 - RNA, 20 nt, Human
uucauacacuccacagcccc

SEQ ID NO: 252158 - RNA, 24 nt, Human
uuccaagcaacaacuuaaccaaca

SEQ ID NO: 252159 - RNA, 22 nt, Human
uuccacggcacaugaggagagg

SEQ ID NO: 252160 - RNA, 25 nt, Human
uuccagaaauagauccagagagaaa

SEQ ID NO: 252161 - RNA, 21 nt, Human
uucccuugaaauucaaugcaa

SEQ ID NO: 252162 - RNA, 19 nt, Human
uuccgaggaggagcuuggg

SEQ ID NO: 252163 - RNA, 22 nt, Human
uuccgaggaggagcuuggguuu

SEQ ID NO: 252164 - RNA, 26 nt, Human
uuccuagaauaguuuguuuuugguuu

SEQ ID NO: 252165 - RNA, 21 nt, Human
uucucuuucgcccaggcugga

SEQ ID NO: 252166 - RNA, 22 nt, Human
uucuucuucagcaugccaguug

SEQ ID NO: 252167 - RNA, 22 nt, Human
uugauacagacuguacucggga

SEQ ID NO: 252168 - RNA, 19 nt, Human
uugcagcaauuuuggaugg

SEQ ID NO: 252169 - RNA, 22 nt, Human
uugcugaggcuggagggaaugg

SEQ ID NO: 252170 - RNA, 19 nt, Human
uuggagaugccaugagcac

SEQ ID NO: 252171 - RNA, 24 nt, Human
uuggucccccuggcuagucccagu

SEQ ID NO: 252172 - RNA, 22 nt, Human
uugguuguuacaaagacuacaa

SEQ ID NO: 252173 - RNA, 21 nt, Human
uugugcacucuuggugagaac

SEQ ID NO: 252174 - RNA, 20 nt, Human
uuuacagagaugcucacagc

SEQ ID NO: 252175 - RNA, 23 nt, Human
uuuaguacauccacagccagaaa

SEQ ID NO: 252176 - RNA, 26 nt, Human
uuucacaacagcauacccgagacuac

SEQ ID NO: 252177 - RNA, 23 nt, Human
uuuccauuggccggcugggauuc

SEQ ID NO: 252178 - RNA, 19 nt, Human
uuuccuagaauaguuuguu

SEQ ID NO: 252179 - RNA, 18 nt, Human
uuuguaaucauaaaaaac

SEQ ID NO: 252180 - RNA, 21 nt, Human
uuuuaucuucuacauggccuu

SEQ ID NO: 252181 - RNA, 24 nt, Human
uuuugcaccaacaauaacaggaaa

SEQ ID NO: 252182 - RNA, 20 nt, Human
uuuuugguuuauuuaaucug

SEQ ID NO: 252183 - RNA, 21 nt, Human
aaccuagcauuuccucccaca

SEQ ID NO: 252184 - RNA, 21 nt, Human
aaggggccccaaagccucaga

SEQ ID NO: 252185 - RNA, 23 nt, Human
aaggggccccaaagccucagaug

SEQ ID NO: 252186 - RNA, 23 nt, Human
aaggggccccaaagccucagaug

SEQ ID NO: 252187 - RNA, 21 nt, Human
acaauaacagcauuuguagaa

SEQ ID NO: 252188 - RNA, 19 nt, Human
acagagcgcugaggcagcc

SEQ ID NO: 252189 - RNA, 19 nt, Human
acagagcgcugaggcagcc

SEQ ID NO: 252190 - RNA, 18 nt, Human
acgggccuauauggggac

SEQ ID NO: 252191 - RNA, 18 nt, Human
acgggccuauauggggac

SEQ ID NO: 252192 - RNA, 23 nt, Human
acuuggagaggcuguggaguccc

SEQ ID NO: 252193 - RNA, 19 nt, Human
agaagcaguaucucugaag

SEQ ID NO: 252194 - RNA, 19 nt, Human
agaagcaguaucucugaag

SEQ ID NO: 252195 - RNA, 20 nt, Human
agacagggauguguuucugg

SEQ ID NO: 252196 - RNA, 20 nt, Human
agacagggauguguuucugg

SEQ ID NO: 252197 - RNA, 24 nt, Human
agccucuacguuguuuucagcucc

SEQ ID NO: 252198 - RNA, 24 nt, Human
agccucuacguuguuuucagcucc

SEQ ID NO: 252199 - RNA, 19 nt, Human
aggaggaggcauggguggc

SEQ ID NO: 252200 - RNA, 19 nt, Human
aggaggaggcauggguggc

SEQ ID NO: 252201 - RNA, 18 nt, Human
aggcagccagggcuucag

SEQ ID NO: 252202 - RNA, 18 nt, Human
aggcagccagggcuucag

SEQ ID NO: 252203 - RNA, 24 nt, Human
aggccaggugguguccagaccagg

SEQ ID NO: 252204 - RNA, 24 nt, Human
aggccaggugguguccagaccagg

SEQ ID NO: 252205 - RNA, 20 nt, Human
aggcccucacccagcagccc

SEQ ID NO: 252206 - RNA, 20 nt, Human
aggcccucacccagcagccc

SEQ ID NO: 252207 - RNA, 23 nt, Human
aucucugucugauuccaugagag

SEQ ID NO: 252208 - RNA, 23 nt, Human
aucucugucugauuccaugagag

SEQ ID NO: 252209 - RNA, 19 nt, Human
cacaaaaaccuagcauuuc

SEQ ID NO: 252210 - RNA, 19 nt, Human
cacaaaaaccuagcauuuc

SEQ ID NO: 252211 - RNA, 22 nt, Human
cacaauaacagcauuuguagaa

SEQ ID NO: 252212 - RNA, 20 nt, Human
cacagcccaacagccccuuu

SEQ ID NO: 252213 - RNA, 20 nt, Human
cacagcccaacagccccuuu

SEQ ID NO: 252214 - RNA, 21 nt, Human
cacaggacacugucacuggag

SEQ ID NO: 252215 - RNA, 21 nt, Human
cacaggacacugucacuggag

SEQ ID NO: 252216 - RNA, 23 nt, Human
cagaacuuccuagaaaauccuaa

SEQ ID NO: 252217 - RNA, 23 nt, Human
cagaacuuccuagaaaauccuaa

SEQ ID NO: 252218 - RNA, 20 nt, Human
cagaagaccuggcugagguc

SEQ ID NO: 252219 - RNA, 20 nt, Human
cagaagaccuggcugagguc

SEQ ID NO: 252220 - RNA, 21 nt, Human
cagcuccuaguuguucagccc

SEQ ID NO: 252221 - RNA, 21 nt, Human
cagcuccuaguuguucagccc

SEQ ID NO: 252222 - RNA, 21 nt, Human
caggggacacuuuccagccuc

SEQ ID NO: 252223 - RNA, 21 nt, Human
caggggacacuuuccagccuc

SEQ ID NO: 252224 - RNA, 21 nt, Human
caucuccagaagaccuggcug

SEQ ID NO: 252225 - RNA, 21 nt, Human
caucuccagaagaccuggcug

SEQ ID NO: 252226 - RNA, 22 nt, Human
cauuuggcaaucauuuuccaca

SEQ ID NO: 252227 - RNA, 22 nt, Human
cauuuggcaaucauuuuccaca

SEQ ID NO: 252228 - RNA, 19 nt, Human
ccacccagucaagccugug

SEQ ID NO: 252229 - RNA, 19 nt, Human
ccacccagucaagccugug

SEQ ID NO: 252230 - RNA, 25 nt, Human
ccagcagcccuccuuauuaucuccc

SEQ ID NO: 252231 - RNA, 25 nt, Human
ccagcagcccuccuuauuaucuccc

SEQ ID NO: 252232 - RNA, 23 nt, Human
ccagccaucucauuuggcaauca

SEQ ID NO: 252233 - RNA, 23 nt, Human
ccagccaucucauuuggcaauca

SEQ ID NO: 252234 - RNA, 23 nt, Human
ccagccucuacguuguuuucagc

SEQ ID NO: 252235 - RNA, 23 nt, Human
ccagccucuacguuguuuucagc

SEQ ID NO: 252236 - RNA, 20 nt, Human
cccagcagcccuccuuauua

SEQ ID NO: 252237 - RNA, 20 nt, Human
cccagcagcccuccuuauua

SEQ ID NO: 252238 - RNA, 19 nt, Human
cccuccccuccagaaugca

SEQ ID NO: 252239 - RNA, 19 nt, Human
cccuccccuccagaaugca

SEQ ID NO: 252240 - RNA, 22 nt, Human
ccucaaaugucaucuccagaag

SEQ ID NO: 252241 - RNA, 22 nt, Human
ccucaaaugucaucuccagaag

SEQ ID NO: 252242 - RNA, 18 nt, Human
cucacccagcagcccucc

SEQ ID NO: 252243 - RNA, 18 nt, Human
cucacccagcagcccucc

SEQ ID NO: 252244 - RNA, 25 nt, Human
cucacucugaacuuggaagguuuuc

SEQ ID NO: 252245 - RNA, 21 nt, Human
cucagaugugcagccuacaga

SEQ ID NO: 252246 - RNA, 21 nt, Human
cucagaugugcagccuacaga

SEQ ID NO: 252247 - RNA, 21 nt, Human
cuccagaagaccuggcugagg

SEQ ID NO: 252248 - RNA, 21 nt, Human
cuccagaagaccuggcugagg

SEQ ID NO: 252249 - RNA, 22 nt, Human
cuccaugcagaaucucacucug

SEQ ID NO: 252250 - RNA, 24 nt, Human
cuccuuuucucuggagcacagccc

SEQ ID NO: 252251 - RNA, 24 nt, Human
cuccuuuucucuggagcacagccc

SEQ ID NO: 252252 - RNA, 18 nt, Human
cugguguugggagacaga

SEQ ID NO: 252253 - RNA, 18 nt, Human
cugguguugggagacaga

SEQ ID NO: 252254 - RNA, 20 nt, Human
cugucacuggagaaccuucc

SEQ ID NO: 252255 - RNA, 20 nt, Human
cugucacuggagaaccuucc

SEQ ID NO: 252256 - RNA, 25 nt, Human
cuuauuaucuccccuccccuccaga

SEQ ID NO: 252257 - RNA, 25 nt, Human
cuuauuaucuccccuccccuccaga

SEQ ID NO: 252258 - RNA, 20 nt, Human
cuuauuuuuuuuuuuggcuu

SEQ ID NO: 252259 - RNA, 20 nt, Human
cuuauuuuuuuuuuuggcuu

SEQ ID NO: 252260 - RNA, 21 nt, Human
cuuguccacccagucaagccu

SEQ ID NO: 252261 - RNA, 21 nt, Human
cuuguccacccagucaagccu

SEQ ID NO: 252262 - RNA, 19 nt, Human
gacagagcgcugaggcagc

SEQ ID NO: 252263 - RNA, 19 nt, Human
gacagagcgcugaggcagc

SEQ ID NO: 252264 - RNA, 25 nt, Human
gaccaggaggaggccuggcugaccu

SEQ ID NO: 252265 - RNA, 25 nt, Human
gaccaggaggaggccuggcugaccu

SEQ ID NO: 252266 - RNA, 22 nt, Human
gagaacagcgguaggaggaggc

SEQ ID NO: 252267 - RNA, 22 nt, Human
gagaacagcgguaggaggaggc

SEQ ID NO: 252268 - RNA, 18 nt, Human
gagaguuuucuuacaaag

SEQ ID NO: 252269 - RNA, 18 nt, Human
gagaguuuucuuacaaag

SEQ ID NO: 252270 - RNA, 20 nt, Human
gagcacagcccaacagccgu

SEQ ID NO: 252271 - RNA, 20 nt, Human
gagcacagcccaacagccgu

SEQ ID NO: 252272 - RNA, 24 nt, Human
gcagcugaguugcuguccuugacu

SEQ ID NO: 252273 - RNA, 24 nt, Human
gcagcugaguugcuguccuugacu

SEQ ID NO: 252274 - RNA, 19 nt, Human
gcagucacaggacacuguc

SEQ ID NO: 252275 - RNA, 19 nt, Human
gcugcuccuuuucucugga

SEQ ID NO: 252276 - RNA, 19 nt, Human
gcugcuccuuuucucugga

SEQ ID NO: 252277 - RNA, 21 nt, Human
ggcuauuuuucugucuucucu

SEQ ID NO: 252278 - RNA, 21 nt, Human
ggcuauuuuucugucuucucu

SEQ ID NO: 252279 - RNA, 24 nt, Human
gggagacagagcgcugaggcagcc

SEQ ID NO: 252280 - RNA, 24 nt, Human
gggagacagagcgcugaggcagcc

SEQ ID NO: 252281 - RNA, 28 nt, Human
gggcuucagucccccaugcucuuuggcc

SEQ ID NO: 252282 - RNA, 28 nt, Human
gggcuucagucccccaugcucuuuggcc

SEQ ID NO: 252283 - RNA, 24 nt, Human
gugaaggugggauugggguggggg

SEQ ID NO: 252284 - RNA, 24 nt, Human
gugaaggugggauugggguggggg

SEQ ID NO: 252285 - RNA, 18 nt, Human
gugguguccagaccagga

SEQ ID NO: 252286 - RNA, 18 nt, Human
gugguguccagaccagga

SEQ ID NO: 252287 - RNA, 20 nt, Human
guguugggagacagagcgcu

SEQ ID NO: 252288 - RNA, 20 nt, Human
guguugggagacagagcgcu

SEQ ID NO: 252289 - RNA, 22 nt, Human
uaagacucccaggaaugcuggg

SEQ ID NO: 252290 - RNA, 22 nt, Human
uaagacucccaggaaugcuggg

SEQ ID NO: 252291 - RNA, 18 nt, Human
uagaacacacagcaagag

SEQ ID NO: 252292 - RNA, 18 nt, Human
uagaacacacagcaagag

SEQ ID NO: 252293 - RNA, 21 nt, Human
uaggaggaggcauggguggca

SEQ ID NO: 252294 - RNA, 21 nt, Human
uaggaggaggcauggguggca

SEQ ID NO: 252295 - RNA, 20 nt, Human
ucacccagcagcccuccuua

SEQ ID NO: 252296 - RNA, 20 nt, Human
ucacccagcagcccuccuua

SEQ ID NO: 252297 - RNA, 18 nt, Human
ucagcccaacaacucagc

SEQ ID NO: 252298 - RNA, 18 nt, Human
ucagcccaacaacucagc

SEQ ID NO: 252299 - RNA, 20 nt, Human
uccaaagcuccucucccacc

SEQ ID NO: 252300 - RNA, 21 nt, Human
uccaaagcuccucucccacca

SEQ ID NO: 252301 - RNA, 21 nt, Human
uccaaagcuccucucccacca

SEQ ID NO: 252302 - RNA, 23 nt, Human
uccacagcucuugcccuuuuugg

SEQ ID NO: 252303 - RNA, 23 nt, Human
uccacagcucuugcccuuuuugg

SEQ ID NO: 252304 - RNA, 24 nt, Human
uccacaucuccaggcccucaccca

SEQ ID NO: 252305 - RNA, 24 nt, Human
uccacaucuccaggcccucaccca

SEQ ID NO: 252306 - RNA, 21 nt, Human
ucccccaugcucuuuggccau

SEQ ID NO: 252307 - RNA, 21 nt, Human
ucccccaugcucuuuggccau

SEQ ID NO: 252308 - RNA, 24 nt, Human
ucccucugcaacaccagcuggugu

SEQ ID NO: 252309 - RNA, 24 nt, Human
ucccucugcaacaccagcuggugu

SEQ ID NO: 252310 - RNA, 22 nt, Human
uccuuauuaucuccccuccccu

SEQ ID NO: 252311 - RNA, 22 nt, Human
uccuuauuaucuccccuccccu

SEQ ID NO: 252312 - RNA, 21 nt, Human
ucuccaggcccucacccagca

SEQ ID NO: 252313 - RNA, 21 nt, Human
ucuccaggcccucacccagca

SEQ ID NO: 252314 - RNA, 20 nt, Human
ucuccccuccccuccagaau

SEQ ID NO: 252315 - RNA, 20 nt, Human
ucuccccuccccuccagaau

SEQ ID NO: 252316 - RNA, 24 nt, Human
ucugcaacaccagcugguguuggg

SEQ ID NO: 252317 - RNA, 24 nt, Human
ucugcaacaccagcugguguuggg

SEQ ID NO: 252318 - RNA, 19 nt, Human
ugaccuaggagaacagcgg

SEQ ID NO: 252319 - RNA, 19 nt, Human
ugaccuaggagaacagcgg

SEQ ID NO: 252320 - RNA, 21 nt, Human
ugagaagcaguaucucugaag

SEQ ID NO: 252321 - RNA, 21 nt, Human
ugagaagcaguaucucugaag

SEQ ID NO: 252322 - RNA, 27 nt, Human
uggagcacagcccaacagccccugcug

SEQ ID NO: 252323 - RNA, 27 nt, Human
uggagcacagcccaacagccccugcug

SEQ ID NO: 252324 - RNA, 18 nt, Human
uggggacaccgaaaccua

SEQ ID NO: 252325 - RNA, 18 nt, Human
uggggacaccgaaaccua

SEQ ID NO: 252326 - RNA, 21 nt, Human
ugggguggggguaguugggua

SEQ ID NO: 252327 - RNA, 23 nt, Human
uguguggacgggccuauaugggg

SEQ ID NO: 252328 - RNA, 23 nt, Human
uguguggacgggccuauaugggg

SEQ ID NO: 252329 - RNA, 22 nt, Human
uuucuuguccccuuuugcaguc

SEQ ID NO: 252330 - RNA, 22 nt, Human
uuucuuguccccuuuugcaguc

SEQ ID NO: 252331 - RNA, 22 nt, Human
uuugcagucacaggacacuguc

SEQ ID NO: 252332 - RNA, 18 nt, Human
uuuuucuugggguuucgg

SEQ ID NO: 252333 - RNA, 18 nt, Human
uuuuucuugggguuucgg

SEQ ID NO: 252334 - RNA, 18 nt, Human
aaaagcaaauaccugccc

SEQ ID NO: 252335 - RNA, 20 nt, Human
aaaagcaaauaccugcccac

SEQ ID NO: 252336 - RNA, 19 nt, Human
aagcaaaagcaaacacaua

SEQ ID NO: 252337 - RNA, 23 nt, Human
aagcaaaagcaaacacauaccug

SEQ ID NO: 252338 - RNA, 21 nt, Human
aagcaaaagcaaauaccugcc

SEQ ID NO: 252339 - RNA, 23 nt, Human
aagcaaaagcaaauaccugccca

SEQ ID NO: 252340 - RNA, 24 nt, Human
aagcaaaagcaaauaccugcccac

SEQ ID NO: 252341 - RNA, 26 nt, Human
acaaagauaguuguucugcaugaaua

SEQ ID NO: 252342 - RNA, 23 nt, Human
acacaugaucucacacaucugga

SEQ ID NO: 252343 - RNA, 22 nt, Human
accugcucacugccauacgcac

SEQ ID NO: 252344 - RNA, 24 nt, Human
acuucacgacgguuccaaaggcca

SEQ ID NO: 252345 - RNA, 23 nt, Human
acuuuuuauccacuugagugaau

SEQ ID NO: 252346 - RNA, 21 nt, Human
agcggugcacuucugcagagc

SEQ ID NO: 252347 - RNA, 18 nt, Human
agugccuauuuucaucag

SEQ ID NO: 252348 - RNA, 22 nt, Human
auccucggcaucuucacucugg

SEQ ID NO: 252349 - RNA, 23 nt, Human
caaaagcaaacacauaccugcuc

SEQ ID NO: 252350 - RNA, 22 nt, Human
caaagcaauagcggugcacuuc

SEQ ID NO: 252351 - RNA, 18 nt, Human
caagcaaaagcaaacaca

SEQ ID NO: 252352 - RNA, 22 nt, Human
caagcaaaagcaaacacauacc

SEQ ID NO: 252353 - RNA, 19 nt, Human
caccuugucuaacacuguu

SEQ ID NO: 252354 - RNA, 24 nt, Human
cacgacgguuccaaaggccaccac

SEQ ID NO: 252355 - RNA, 18 nt, Human
cacuuuguguaaacccuc

SEQ ID NO: 252356 - RNA, 19 nt, Human
caggaagaaauguuuucuu

SEQ ID NO: 252357 - RNA, 18 nt, Human
caggagcuagguaaguuu

SEQ ID NO: 252358 - RNA, 18 nt, Human
cauccucggcaucuucac

SEQ ID NO: 252359 - RNA, 18 nt, Human
cccgguccugagccccag

SEQ ID NO: 252360 - RNA, 20 nt, Human
cccgguccugagccccagcc

SEQ ID NO: 252361 - RNA, 27 nt, Human
cccucugucacuuuuucacuggaaacc

SEQ ID NO: 252362 - RNA, 21 nt, Human
ccucugucacuuuuucacugg

SEQ ID NO: 252363 - RNA, 21 nt, Human
cgguccugagccccagcggcc

SEQ ID NO: 252364 - RNA, 23 nt, Human
cuggaaaccgugugauuuuuuuu

SEQ ID NO: 252365 - RNA, 22 nt, Human
cuuuguguaaacccucuauaaa

SEQ ID NO: 252366 - RNA, 20 nt, Human
gauagcaauuuaauuuucag

SEQ ID NO: 252367 - RNA, 20 nt, Human
gauagcaauuuaauuuucag

SEQ ID NO: 252368 - RNA, 20 nt, Human
ggcacuuuguguaaacccuc

SEQ ID NO: 252369 - RNA, 19 nt, Human
guccugagccccagcggcc

SEQ ID NO: 252370 - RNA, 19 nt, Human
uaaaaaagacaagaaacug

SEQ ID NO: 252371 - RNA, 24 nt, Human
uaauacacaugaucucacacaucu

SEQ ID NO: 252372 - RNA, 19 nt, Human
ucaccuucuccaucuucac

SEQ ID NO: 252373 - RNA, 22 nt, Human
ucacucuggagacaucuugaau

SEQ ID NO: 252374 - RNA, 20 nt, Human
uccaaaggccaccacccucu

SEQ ID NO: 252375 - RNA, 21 nt, Human
uccugagccccagcggccagu

SEQ ID NO: 252376 - RNA, 18 nt, Human
ucucacacaucuggaaug

SEQ ID NO: 252377 - RNA, 18 nt, Human
ucuuuaauaaguggcacu

SEQ ID NO: 252378 - RNA, 18 nt, Human
ugaaaaacagauucgaaa

SEQ ID NO: 252379 - RNA, 19 nt, Human
ugaauucaggcacuguggc

SEQ ID NO: 252380 - RNA, 24 nt, Human
ugacaaaauguauaaaaaagacaa

SEQ ID NO: 252381 - RNA, 22 nt, Human
ugagccccagcggccagucucc

SEQ ID NO: 252382 - RNA, 24 nt, Human
ugagugaauucaggcacuguggcu

SEQ ID NO: 252383 - RNA, 22 nt, Human
ugauagcaauuuaauuuucagu

SEQ ID NO: 252384 - RNA, 22 nt, Human
ugauagcaauuuaauuuucagu

SEQ ID NO: 252385 - RNA, 21 nt, Human
ugcaagcaaaagcaaauaccu

SEQ ID NO: 252386 - RNA, 21 nt, Human
ugcaugaauacaucacauaug

SEQ ID NO: 252387 - RNA, 22 nt, Human
uuaaaaacaaaauacaaagaua

SEQ ID NO: 252388 - RNA, 22 nt, Human
uuaaacacauuuuaaaaacaaa

SEQ ID NO: 252389 - RNA, 23 nt, Human
uucaaagcaaguucaccuucucc

SEQ ID NO: 252390 - RNA, 22 nt, Human
uuccaggcagaagacuucacga

SEQ ID NO: 252391 - RNA, 22 nt, Human
uuuuuuuuuuacccucccaaag

SEQ ID NO: 252392 - RNA, 18 nt, Human
uuuuuuuuuuuacccucc

SEQ ID NO: 252393 - RNA, 19 nt, Human
uuuuuuuuuuuacccuccc

SEQ ID NO: 252394 - RNA, 25 nt, Human
uuuuuuuuuuuuuuauuuacaaagg

SEQ ID NO: 252395 - RNA, 21 nt, Human
uuuuuuuuuuuuuuuuuauuu

SEQ ID NO: 252396 - RNA, 22 nt, Human
aguugaaaguagcuaacuauga

SEQ ID NO: 252397 - RNA, 18 nt, Human
uagaagaaugagguggcu

SEQ ID NO: 252398 - RNA, 18 nt, Human
uagaagaaugagguggcu

SEQ ID NO: 252399 - RNA, 20 nt, Human
uauuuccagcuauuuacaga

SEQ ID NO: 252400 - RNA, 23 nt, Human
uuuuuuuuuuuuuuugacuuuga

SEQ ID NO: 252401 - RNA, 18 nt, Human
uuuuuuuuuuuuuuuuug

SEQ ID NO: 252402 - RNA, 24 nt, Human
uuuuuuuuuuuuuuuuuugacuuu

SEQ ID NO: 252403 - RNA, 21 nt, Human
agcaaacaacauagaaggcau

SEQ ID NO: 252404 - RNA, 20 nt, Human
auagaauuuuauacugugac

SEQ ID NO: 252405 - RNA, 23 nt, Human
caacauagaaggcauuugugaca

SEQ ID NO: 252406 - RNA, 25 nt, Human
cacucuauccucucuucaccugguc

SEQ ID NO: 252407 - RNA, 19 nt, Human
cauagaaggcauuugugac

SEQ ID NO: 252408 - RNA, 24 nt, Human
cauagaucuguaaugauuuuuuuu

SEQ ID NO: 252409 - RNA, 22 nt, Human
cuacagagcaaacaacauagaa

SEQ ID NO: 252410 - RNA, 22 nt, Human
cuucagaauaccugcucgugcc

SEQ ID NO: 252411 - RNA, 20 nt, Human
gcaaaaauucccccaaggag

SEQ ID NO: 252412 - RNA, 23 nt, Human
gcaaaaauucccccaaggagacc

SEQ ID NO: 252413 - RNA, 22 nt, Human
ggauucuuggcucacucaguuc

SEQ ID NO: 252414 - RNA, 22 nt, Human
uacucaaauguuaccuauuuca

SEQ ID NO: 252415 - RNA, 23 nt, Human
ucagcugucagguggcucuccuc

SEQ ID NO: 252416 - RNA, 19 nt, Human
uguaaugauuuuuuuuugc

SEQ ID NO: 252417 - RNA, 21 nt, Human
uucacucuauccucucuucac

SEQ ID NO: 252418 - RNA, 21 nt, Human
uugagaaucucugguaucuuu

SEQ ID NO: 252419 - RNA, 25 nt, Human
aaacaacuucaacucuguacaaagg

SEQ ID NO: 252420 - RNA, 20 nt, Human
aaggaagacaaauaccaaaa

SEQ ID NO: 252421 - RNA, 19 nt, Human
agacaaauaccaaaaacaa

SEQ ID NO: 252422 - RNA, 20 nt, Human
aggaagacaaauaccaaaaa

SEQ ID NO: 252423 - RNA, 18 nt, Human
aguaaugaaaaagaaaag

SEQ ID NO: 252424 - RNA, 19 nt, Human
caaauacaucaagaccaga

SEQ ID NO: 252425 - RNA, 21 nt, Human
caacuucaacucuguacaaag

SEQ ID NO: 252426 - RNA, 24 nt, Human
cauucaucuggugcuuuggggcca

SEQ ID NO: 252427 - RNA, 22 nt, Human
ccaagucaaauauggcauuuca

SEQ ID NO: 252428 - RNA, 24 nt, Human
ccagaagccaagucaaauauggca

SEQ ID NO: 252429 - RNA, 23 nt, Human
cucccuguccgggcggccgggag

SEQ ID NO: 252430 - RNA, 22 nt, Human
cugcggaucuguaauuucucuc

SEQ ID NO: 252431 - RNA, 22 nt, Human
cuggugcuuuggggccauggag

SEQ ID NO: 252432 - RNA, 22 nt, Human
gaaaagaaguugaaaaaacaac

SEQ ID NO: 252433 - RNA, 25 nt, Human
gaaagcucccuguccgggcggccgg

SEQ ID NO: 252434 - RNA, 23 nt, Human
gaagacaaauaccaaaaacauca

SEQ ID NO: 252435 - RNA, 24 nt, Human
gguaaggaagacaaauaccaaaaa

SEQ ID NO: 252436 - RNA, 24 nt, Human
uaagugaaaugaaauaaguaaugu

SEQ ID NO: 252437 - RNA, 21 nt, Human
uacaauuggauucuccuacag

SEQ ID NO: 252438 - RNA, 19 nt, Human
uaguaaugaaaaagaaaag

SEQ ID NO: 252439 - RNA, 25 nt, Human
uaucagaaaauuaaucauucuuauc

SEQ ID NO: 252440 - RNA, 21 nt, Human
ucaugauauacacauauuuuu

SEQ ID NO: 252441 - RNA, 18 nt, Human
ugagugccgagacacgaa

SEQ ID NO: 252442 - RNA, 19 nt, Human
ugguaaggaagacaaauac

SEQ ID NO: 252443 - RNA, 21 nt, Human
uguccugucgccggccaagcg

SEQ ID NO: 252444 - RNA, 22 nt, Human
uuccuuaacaacauucaucugg

SEQ ID NO: 252445 - RNA, 19 nt, Human
aaaaacagcugaugaaaca

SEQ ID NO: 252446 - RNA, 21 nt, Human
aaaagucuuuuaugcaaaaga

SEQ ID NO: 252447 - RNA, 19 nt, Human
aaacagcugaugaaacacu

SEQ ID NO: 252448 - RNA, 22 nt, Human
aagacaaugaaauguggcuuua

SEQ ID NO: 252449 - RNA, 18 nt, Human
aaguuguuauacuugaag

SEQ ID NO: 252450 - RNA, 24 nt, Human
aaucacuuaauaauccugcuuuga

SEQ ID NO: 252451 - RNA, 21 nt, Human
acagggaagcuacucuuucca

SEQ ID NO: 252452 - RNA, 21 nt, Human
agcacaaaaaacaaagccaag

SEQ ID NO: 252453 - RNA, 21 nt, Human
aggaauuacugagcuacauug

SEQ ID NO: 252454 - RNA, 18 nt, Human
aggacccggccacgaaua

SEQ ID NO: 252455 - RNA, 20 nt, Human
auucagcauggugacuugac

SEQ ID NO: 252456 - RNA, 20 nt, Human
caaaaaacaaagccaagucu

SEQ ID NO: 252457 - RNA, 20 nt, Human
caagcccaucgcccccgagc

SEQ ID NO: 252458 - RNA, 21 nt, Human
cacaacacauaagggaguagg

SEQ ID NO: 252459 - RNA, 21 nt, Human
cagcaugugcugccgccuucu

SEQ ID NO: 252460 - RNA, 20 nt, Human
cauaaaggaaucaguguaca

SEQ ID NO: 252461 - RNA, 20 nt, Human
ccagagguucucggccuuca

SEQ ID NO: 252462 - RNA, 24 nt, Human
ccagcuaauaacaguacaucucug

SEQ ID NO: 252463 - RNA, 19 nt, Human
ccccccuucuccuccuccu

SEQ ID NO: 252464 - RNA, 21 nt, Human
ccccccuucuccuccuccucc

SEQ ID NO: 252465 - RNA, 21 nt, Human
cccccgagcccagcaugugcu

SEQ ID NO: 252466 - RNA, 22 nt, Human
cccccgagcccagcaugugcuc

SEQ ID NO: 252467 - RNA, 24 nt, Human
cccccgagcccagcaugugcugcc

SEQ ID NO: 252468 - RNA, 22 nt, Human
cccccuucuccuccuccuuacu

SEQ ID NO: 252469 - RNA, 27 nt, Human
ccgagcccagcaugugcugccgccuuc

SEQ ID NO: 252470 - RNA, 21 nt, Human
ccuaauagcacaaaaaacaaa

SEQ ID NO: 252471 - RNA, 19 nt, Human
ccugcuggcuucuuccuau

SEQ ID NO: 252472 - RNA, 18 nt, Human
cgccuucucccugccagg

SEQ ID NO: 252473 - RNA, 21 nt, Human
cuaaaaacagcugaugaaaca

SEQ ID NO: 252474 - RNA, 20 nt, Human
cuauagaauuccuguugggg

SEQ ID NO: 252475 - RNA, 19 nt, Human
cuugacuacacaacaaucc

SEQ ID NO: 252476 - RNA, 18 nt, Human
cuuucugcaucagugaau

SEQ ID NO: 252477 - RNA, 18 nt, Human
gaaggagccccccuucuc

SEQ ID NO: 252478 - RNA, 23 nt, Human
gaggagucucagacuguuauuug

SEQ ID NO: 252479 - RNA, 21 nt, Human
gagguaugaggagucucagac

SEQ ID NO: 252480 - RNA, 18 nt, Human
gccagaaauuagcacuuc

SEQ ID NO: 252481 - RNA, 20 nt, Human
gcccaucgcccccgagccca

SEQ ID NO: 252482 - RNA, 20 nt, Human
ggaaagccucucugggacag

SEQ ID NO: 252483 - RNA, 19 nt, Human
ggacaggcaguggggaguu

SEQ ID NO: 252484 - RNA, 22 nt, Human
ggaguaggggagguaauacagg

SEQ ID NO: 252485 - RNA, 24 nt, Human
ggaguaggggagguaauacaggga

SEQ ID NO: 252486 - RNA, 19 nt, Human
guaucauuuaaaccaauau

SEQ ID NO: 252487 - RNA, 20 nt, Human
guggcuuuaaaaaaaaagua

SEQ ID NO: 252488 - RNA, 18 nt, Human
guuagaauuggucuuccc

SEQ ID NO: 252489 - RNA, 24 nt, Human
uaacuaaaaacagcugaugaaaca

SEQ ID NO: 252490 - RNA, 23 nt, Human
uaaugcucaucagaauuuccuaa

SEQ ID NO: 252491 - RNA, 18 nt, Human
uacaggacuccauguuuc

SEQ ID NO: 252492 - RNA, 18 nt, Human
uagaauuccuguuggggg

SEQ ID NO: 252493 - RNA, 19 nt, Human
uaggggagguaauacaggg

SEQ ID NO: 252494 - RNA, 24 nt, Human
uaguucaauuuauucagaaaccaa

SEQ ID NO: 252495 - RNA, 23 nt, Human
uaguuuggauuuaguucaauuua

SEQ ID NO: 252496 - RNA, 24 nt, Human
uaucaaaguaaugggagguggacc

SEQ ID NO: 252497 - RNA, 18 nt, Human
ucaauuuauucagaaacc

SEQ ID NO: 252498 - RNA, 19 nt, Human
ucccuuccccucuacugua

SEQ ID NO: 252499 - RNA, 22 nt, Human
uccgcgcacaagcccaucgccc

SEQ ID NO: 252500 - RNA, 24 nt, Human
ucucagacuguuauuugcuguuag

SEQ ID NO: 252501 - RNA, 20 nt, Human
ucuccuccuccuuacuauag

SEQ ID NO: 252502 - RNA, 19 nt, Human
ucuucccagcuaauaacag

SEQ ID NO: 252503 - RNA, 19 nt, Human
ugaggagucucagacuguu

SEQ ID NO: 252504 - RNA, 18 nt, Human
ugauggccaggaccucuu

SEQ ID NO: 252505 - RNA, 22 nt, Human
ugauucagguaagaccuugccu

SEQ ID NO: 252506 - RNA, 22 nt, Human
ugcgcaugcgcuuccugaggcc

SEQ ID NO: 252507 - RNA, 28 nt, Human
uggcacagaugcuauugguccuuaaugu

SEQ ID NO: 252508 - RNA, 19 nt, Human
ugggggugggccagaaauu

SEQ ID NO: 252509 - RNA, 21 nt, Human
uuacugagcuacauuggaaag

SEQ ID NO: 252510 - RNA, 21 nt, Human
uucauuuuuauuaauagaaaa

SEQ ID NO: 252511 - RNA, 20 nt, Human
uuccaguuucaaaguuguuc

SEQ ID NO: 252512 - RNA, 23 nt, Human
uugcgcaugcgcuuccugaggcc

SEQ ID NO: 252513 - RNA, 19 nt, Human
uugcucauaggucuuucag

SEQ ID NO: 252514 - RNA, 25 nt, Human
uuggucuucccagcuaauaacagua

SEQ ID NO: 252515 - RNA, 18 nt, Human
uuuguucuuaaaguuucu

SEQ ID NO: 252516 - RNA, 21 nt, Human
acacgcgcgcuccgcgccucc

SEQ ID NO: 252517 - RNA, 22 nt, Human
acacgcgcgcuccgcgccuccc

SEQ ID NO: 252518 - RNA, 21 nt, Human
aggaccacacgcgcgcuccgc

SEQ ID NO: 252519 - RNA, 22 nt, Human
aggucaggcagugaaaaaacca

SEQ ID NO: 252520 - RNA, 20 nt, Human
ccccgcaucuggcucgcgcc

SEQ ID NO: 252521 - RNA, 23 nt, Human
cgcucggggcgccgcgggcggcg

SEQ ID NO: 252522 - RNA, 22 nt, Human
cggcgcaaggaccacacgcgcg

SEQ ID NO: 252523 - RNA, 19 nt, Human
cggcuccgcaucugcucac

SEQ ID NO: 252524 - RNA, 19 nt, Human
cucgcgcccuccacucggc

SEQ ID NO: 252525 - RNA, 20 nt, Human
gcagugaaaaaaccauugga

SEQ ID NO: 252526 - RNA, 21 nt, Human
ggaaccaguggagaagucagc

SEQ ID NO: 252527 - RNA, 18 nt, Human
ggcgcaaggaccacacgc

SEQ ID NO: 252528 - RNA, 21 nt, Human
ucagcggcgcaaggaccacac

SEQ ID NO: 252529 - RNA, 18 nt, Human
uccacucggcuccgcauc

SEQ ID NO: 252530 - RNA, 24 nt, Human
uccguggccugugggaccaagccu

SEQ ID NO: 252531 - RNA, 23 nt, Human
ucgccccgcaucuggcucgcgcc

SEQ ID NO: 252532 - RNA, 23 nt, Human
ucucagcaagucagcugucgccc

SEQ ID NO: 252533 - RNA, 21 nt, Human
ugcaggccauugguccguggc

SEQ ID NO: 252534 - RNA, 24 nt, Human
uggacaaaguguggacuguugcuu

SEQ ID NO: 252535 - RNA, 20 nt, Human
uggcaagagcaaagaauauc

SEQ ID NO: 252536 - RNA, 21 nt, Human
aaacagaagugguaauugagc

SEQ ID NO: 252537 - RNA, 21 nt, Human
aaacagaagugguaauugagc

SEQ ID NO: 252538 - RNA, 21 nt, Human
aaacagaagugguaauugagc

SEQ ID NO: 252539 - RNA, 24 nt, Human
aaacagaagugguaauugagccua

SEQ ID NO: 252540 - RNA, 24 nt, Human
aaacagaagugguaauugagccua

SEQ ID NO: 252541 - RNA, 24 nt, Human
aaacagaagugguaauugagccua

SEQ ID NO: 252542 - RNA, 21 nt, Human
aagaccccacagccuuccaaa

SEQ ID NO: 252543 - RNA, 29 nt, Human
aagaccccacagccuuccaaagauccccc

SEQ ID NO: 252544 - RNA, 29 nt, Human
aagaccccacagccuuccaaagauccccc

SEQ ID NO: 252545 - RNA, 20 nt, Human
acaccagccccccaacucuu

SEQ ID NO: 252546 - RNA, 22 nt, Human
acaggccaccauagccacagcc

SEQ ID NO: 252547 - RNA, 24 nt, Human
accccacagccuuccaaagauccc

SEQ ID NO: 252548 - RNA, 24 nt, Human
accccacagccuuccaaagauccc

SEQ ID NO: 252549 - RNA, 24 nt, Human
accccacagccuuccaaagauccc

SEQ ID NO: 252550 - RNA, 24 nt, Human
acguagaacuuucuuccccuccuc

SEQ ID NO: 252551 - RNA, 24 nt, Human
acguagaacuuucuuccccuccuc

SEQ ID NO: 252552 - RNA, 24 nt, Human
acuccugcucuuuucucuaauccc

SEQ ID NO: 252553 - RNA, 24 nt, Human
acuccugcucuuuucucuaauccc

SEQ ID NO: 252554 - RNA, 24 nt, Human
acuccugcucuuuucucuaauccc

SEQ ID NO: 252555 - RNA, 22 nt, Human
acugugucucagcuccagcagu

SEQ ID NO: 252556 - RNA, 22 nt, Human
acugugucucagcuccagcagu

SEQ ID NO: 252557 - RNA, 19 nt, Human
acuugggccugagcucucu

SEQ ID NO: 252558 - RNA, 19 nt, Human
aggaagagcaagaccccac

SEQ ID NO: 252559 - RNA, 19 nt, Human
aggaagagcaagaccccac

SEQ ID NO: 252560 - RNA, 19 nt, Human
aggaagagcaagaccccac

SEQ ID NO: 252561 - RNA, 22 nt, Human
aggaagagcaagaccccacagc

SEQ ID NO: 252562 - RNA, 22 nt, Human
aggaagagcaagaccccacagc

SEQ ID NO: 252563 - RNA, 22 nt, Human
aggaagagcaagaccccacagc

SEQ ID NO: 252564 - RNA, 18 nt, Human
aggcaggcugguuuggga

SEQ ID NO: 252565 - RNA, 18 nt, Human
aggcaggcugguuuggga

SEQ ID NO: 252566 - RNA, 20 nt, Human
agggaacacagauuccccag

SEQ ID NO: 252567 - RNA, 20 nt, Human
agggaacacagauuccccag

SEQ ID NO: 252568 - RNA, 20 nt, Human
agggaacacagauuccccag

SEQ ID NO: 252569 - RNA, 18 nt, Human
agggacaaggugagagga

SEQ ID NO: 252570 - RNA, 18 nt, Human
agggacaaggugagagga

SEQ ID NO: 252571 - RNA, 18 nt, Human
agggacaaggugagagga

SEQ ID NO: 252572 - RNA, 20 nt, Human
aguggagggacaaggugaga

SEQ ID NO: 252573 - RNA, 21 nt, Human
aguggagggacaaggugagag

SEQ ID NO: 252574 - RNA, 21 nt, Human
aguggagggacaaggugagag

SEQ ID NO: 252575 - RNA, 21 nt, Human
aucccaggauccacaaagcaa

SEQ ID NO: 252576 - RNA, 21 nt, Human
aucccaggauccacaaagcaa

SEQ ID NO: 252577 - RNA, 22 nt, Human
augugacccuggccggguaacu

SEQ ID NO: 252578 - RNA, 27 nt, Human
caaagauccccuaugguccaaaguccu

SEQ ID NO: 252579 - RNA, 27 nt, Human
caaagauccccuaugguccaaaguccu

SEQ ID NO: 252580 - RNA, 27 nt, Human
caaagauccccuaugguccaaaguccu

SEQ ID NO: 252581 - RNA, 22 nt, Human
caagaccccacagccuuccaaa

SEQ ID NO: 252582 - RNA, 22 nt, Human
caagaccccacagccuuccaaa

SEQ ID NO: 252583 - RNA, 30 nt, Human
caagaccccacagccuuccaaagauccccc

SEQ ID NO: 252584 - RNA, 20 nt, Human
cacugggauccuacuuugug

SEQ ID NO: 252585 - RNA, 22 nt, Human
caguggguucugcccugggcag

SEQ ID NO: 252586 - RNA, 22 nt, Human
caguggguucugcccugggcag

SEQ ID NO: 252587 - RNA, 19 nt, Human
cauccagucguguagcucc

SEQ ID NO: 252588 - RNA, 22 nt, Human
caucuuugucagcuggcccuug

SEQ ID NO: 252589 - RNA, 22 nt, Human
cauuccucauuccagcugagga

SEQ ID NO: 252590 - RNA, 22 nt, Human
cauuccucauuccagcugagga

SEQ ID NO: 252591 - RNA, 22 nt, Human
cauuccucauuccagcugagga

SEQ ID NO: 252592 - RNA, 24 nt, Human
ccaguggguucugcccugggcagc

SEQ ID NO: 252593 - RNA, 24 nt, Human
ccaguggguucugcccugggcagc

SEQ ID NO: 252594 - RNA, 24 nt, Human
ccaguggguucugcccugggcagc

SEQ ID NO: 252595 - RNA, 23 nt, Human
cgaagaacucuggguauagcuca

SEQ ID NO: 252596 - RNA, 21 nt, Human
cggaagauggcugggaaauuc

SEQ ID NO: 252597 - RNA, 21 nt, Human
cggaagauggcugggaaauuc

SEQ ID NO: 252598 - RNA, 22 nt, Human
cucucuuuucuuucuuauccuu

SEQ ID NO: 252599 - RNA, 21 nt, Human
cugggcagcuccccaccuucu

SEQ ID NO: 252600 - RNA, 21 nt, Human
cugggcagcuccccaccuucu

SEQ ID NO: 252601 - RNA, 21 nt, Human
cugggcagcuccccaccuucu

SEQ ID NO: 252602 - RNA, 24 nt, Human
cuggggcacaaguuccccuucucc

SEQ ID NO: 252603 - RNA, 21 nt, Human
cugugucucagcuccagcagu

SEQ ID NO: 252604 - RNA, 21 nt, Human
cugugucucagcuccagcagu

SEQ ID NO: 252605 - RNA, 21 nt, Human
cugugucucagcuccagcagu

SEQ ID NO: 252606 - RNA, 24 nt, Human
cugugucucagcuccagcagucuc

SEQ ID NO: 252607 - RNA, 24 nt, Human
cugugucucagcuccagcagucuc

SEQ ID NO: 252608 - RNA, 24 nt, Human
cugugucucagcuccagcagucuc

SEQ ID NO: 252609 - RNA, 20 nt, Human
cuucggaagauggcugggaa

SEQ ID NO: 252610 - RNA, 20 nt, Human
cuucggaagauggcugggaa

SEQ ID NO: 252611 - RNA, 19 nt, Human
cuuuccugagaaauggcag

SEQ ID NO: 252612 - RNA, 18 nt, Human
gaagagcaagaccccaca

SEQ ID NO: 252613 - RNA, 18 nt, Human
gaagagcaagaccccaca

SEQ ID NO: 252614 - RNA, 18 nt, Human
gaagagcaagaccccaca

SEQ ID NO: 252615 - RNA, 23 nt, Human
gacaaggugagaggagccagggg

SEQ ID NO: 252616 - RNA, 21 nt, Human
gacccaggacuccugcucuuu

SEQ ID NO: 252617 - RNA, 24 nt, Human
gagcaagaccccacagccuuccaa

SEQ ID NO: 252618 - RNA, 24 nt, Human
gagcaagaccccacagccuuccaa

SEQ ID NO: 252619 - RNA, 24 nt, Human
gagcaagaccccacagccuuccaa

SEQ ID NO: 252620 - RNA, 21 nt, Human
gaguggagcgaagaacucugg

SEQ ID NO: 252621 - RNA, 21 nt, Human
gcagucucaacugggaagacc

SEQ ID NO: 252622 - RNA, 21 nt, Human
gcagucucaacugggaagacc

SEQ ID NO: 252623 - RNA, 21 nt, Human
gcagucucaacugggaagacc

SEQ ID NO: 252624 - RNA, 20 nt, Human
gccccccaacucuuagcacc

SEQ ID NO: 252625 - RNA, 24 nt, Human
ggacaaggugagaggagccagggg

SEQ ID NO: 252626 - RNA, 24 nt, Human
ggacaaggugagaggagccagggg

SEQ ID NO: 252627 - RNA, 24 nt, Human
ggacaaggugagaggagccagggg

SEQ ID NO: 252628 - RNA, 22 nt, Human
gggacugaugauucgccacuug

SEQ ID NO: 252629 - RNA, 19 nt, Human
gugagaggagccaggggua

SEQ ID NO: 252630 - RNA, 23 nt, Human
uaacaggccaccauagccacagc

SEQ ID NO: 252631 - RNA, 22 nt, Human
uacaccagccccccaacucuua

SEQ ID NO: 252632 - RNA, 24 nt, Human
uacaccagccccccaacucuuagc

SEQ ID NO: 252633 - RNA, 23 nt, Human
uagcucagaccaguccaucuccu

SEQ ID NO: 252634 - RNA, 20 nt, Human
uaggaaggugcuucauggca

SEQ ID NO: 252635 - RNA, 27 nt, Human
uaggcauguguacacauauacauggug

SEQ ID NO: 252636 - RNA, 21 nt, Human
uaucccaggauccacaaagca

SEQ ID NO: 252637 - RNA, 21 nt, Human
uaucccaggauccacaaagca

SEQ ID NO: 252638 - RNA, 21 nt, Human
uaucccaggauccacaaagca

SEQ ID NO: 252639 - RNA, 20 nt, Human
ucacaaggagaaaggagugc

SEQ ID NO: 252640 - RNA, 20 nt, Human
ucacaaggagaaaggagugc

SEQ ID NO: 252641 - RNA, 20 nt, Human
ucacaaggagaaaggagugc

SEQ ID NO: 252642 - RNA, 22 nt, Human
uccaaaguccuuugaccaucuc

SEQ ID NO: 252643 - RNA, 22 nt, Human
uccaaaguccuuugaccaucuc

SEQ ID NO: 252644 - RNA, 22 nt, Human
uccaaaguccuuugaccaucuc

SEQ ID NO: 252645 - RNA, 19 nt, Human
uccacuaacaggccaccau

SEQ ID NO: 252646 - RNA, 19 nt, Human
ucccaggauccacaaagca

SEQ ID NO: 252647 - RNA, 19 nt, Human
ucccugggagacgaggucc

SEQ ID NO: 252648 - RNA, 19 nt, Human
ucccugggagacgaggucc

SEQ ID NO: 252649 - RNA, 19 nt, Human
ucccugggagacgaggucc

SEQ ID NO: 252650 - RNA, 19 nt, Human
ucccugggagacgaggucc

SEQ ID NO: 252651 - RNA, 20 nt, Human
ucccugggagacgaggucca

SEQ ID NO: 252652 - RNA, 20 nt, Human
ucccugggagacgaggucca

SEQ ID NO: 252653 - RNA, 22 nt, Human
uccuccagaggcacacgcucaa

SEQ ID NO: 252654 - RNA, 24 nt, Human
uccuccagaggcacacgcucaaac

SEQ ID NO: 252655 - RNA, 24 nt, Human
ucggaagauggcugggaaauucuu

SEQ ID NO: 252656 - RNA, 24 nt, Human
ucggaagauggcugggaaauucuu

SEQ ID NO: 252657 - RNA, 23 nt, Human
ucucaacugggaagacccaggac

SEQ ID NO: 252658 - RNA, 23 nt, Human
ucucaacugggaagacccaggac

SEQ ID NO: 252659 - RNA, 23 nt, Human
ucucaacugggaagacccaggac

SEQ ID NO: 252660 - RNA, 21 nt, Human
ucugcaaacuccacuugggcc

SEQ ID NO: 252661 - RNA, 18 nt, Human
ugagaggagccaggggua

SEQ ID NO: 252662 - RNA, 18 nt, Human
ugagaggagccaggggua

SEQ ID NO: 252663 - RNA, 20 nt, Human
ugagugcacauccagucgug

SEQ ID NO: 252664 - RNA, 20 nt, Human
ugccuggaggacgggaucuu

SEQ ID NO: 252665 - RNA, 20 nt, Human
ugccuggaggacgggaucuu

SEQ ID NO: 252666 - RNA, 22 nt, Human
uggaagccaccugcaggagcug

SEQ ID NO: 252667 - RNA, 19 nt, Human
uggcaguggagggacaagg

SEQ ID NO: 252668 - RNA, 19 nt, Human
uggcaguggagggacaagg

SEQ ID NO: 252669 - RNA, 19 nt, Human
uggcaguggagggacaagg

SEQ ID NO: 252670 - RNA, 22 nt, Human
uggcgguugaugugacccuggc

SEQ ID NO: 252671 - RNA, 19 nt, Human
ugguagaaggcauaugaua

SEQ ID NO: 252672 - RNA, 19 nt, Human
ugguagaaggcauaugaua

SEQ ID NO: 252673 - RNA, 19 nt, Human
ugguagaaggcauaugaua

SEQ ID NO: 252674 - RNA, 22 nt, Human
ugguccaaaguccuuugaccau

SEQ ID NO: 252675 - RNA, 22 nt, Human
ugguccaaaguccuuugaccau

SEQ ID NO: 252676 - RNA, 22 nt, Human
ugguccaaaguccuuugaccau

SEQ ID NO: 252677 - RNA, 22 nt, Human
uguauucuucggaagauggcug

SEQ ID NO: 252678 - RNA, 22 nt, Human
uguauucuucggaagauggcug

SEQ ID NO: 252679 - RNA, 24 nt, Human
ugugggucggggaagaggaagaac

SEQ ID NO: 252680 - RNA, 20 nt, Human
uguguacacauauacauggu

SEQ ID NO: 252681 - RNA, 20 nt, Human
uguguacacauauacauggu

SEQ ID NO: 252682 - RNA, 19 nt, Human
uguguacacauauacaugu

SEQ ID NO: 252683 - RNA, 21 nt, Human
uguguacacauauacauguua

SEQ ID NO: 252684 - RNA, 21 nt, Human
uguguacacauauacauguua

SEQ ID NO: 252685 - RNA, 22 nt, Human
uucacccggaucuccagaccca

SEQ ID NO: 252686 - RNA, 25 nt, Human
uuuuuuuuuuuuuuuuuuuuagggg

SEQ ID NO: 252687 - RNA, 25 nt, Human
uuuuuuuuuuuuuuuuuuuuagggg

SEQ ID NO: 252688 - RNA, 25 nt, Human
uuuuuuuuuuuuuuuuuuuuagggg

SEQ ID NO: 252689 - RNA, 26 nt, Human
auggcagcgacggugauucccgaaac

SEQ ID NO: 252690 - RNA, 19 nt, Human
caccagcaacgucaacgaa

SEQ ID NO: 252691 - RNA, 22 nt, Human
caccugaguccgcgaacacagc

SEQ ID NO: 252692 - RNA, 29 nt, Human
cagcaacgucaacgaagagaagaaauucc

SEQ ID NO: 252693 - RNA, 24 nt, Human
cagcgacggugauucccgaaacuu

SEQ ID NO: 252694 - RNA, 19 nt, Human
ccaaacagugaacaccagc

SEQ ID NO: 252695 - RNA, 22 nt, Human
ccagcaacgucaacgaagagaa

SEQ ID NO: 252696 - RNA, 19 nt, Human
ccgaaacuugacuaauucc

SEQ ID NO: 252697 - RNA, 21 nt, Human
cgaaacuugacuaauuccaaa

SEQ ID NO: 252698 - RNA, 21 nt, Human
gagaagaaauuccuuccaccu

SEQ ID NO: 252699 - RNA, 22 nt, Human
ggcagcgacggugauucccgaa

SEQ ID NO: 252700 - RNA, 22 nt, Human
gugauucccgaaacuugacuaa

SEQ ID NO: 252701 - RNA, 26 nt, Human
guugauggcagcgacggugauucccu

SEQ ID NO: 252702 - RNA, 20 nt, Human
ugacuaauuccaaacaguga

SEQ ID NO: 252703 - RNA, 22 nt, Human
ugacuaauuccaaacagugaac

SEQ ID NO: 252704 - RNA, 20 nt, Human
aacauggggauggggaaaaa

SEQ ID NO: 252705 - RNA, 22 nt, Human
acaggcugaaggaggggccuga

SEQ ID NO: 252706 - RNA, 19 nt, Human
accagcuggggugggggga

SEQ ID NO: 252707 - RNA, 20 nt, Human
agaagggcccgucaggccca

SEQ ID NO: 252708 - RNA, 18 nt, Human
agaucccaggagggccag

SEQ ID NO: 252709 - RNA, 24 nt, Human
agcagaccagcuggggugggggga

SEQ ID NO: 252710 - RNA, 20 nt, Human
auggggauggggaaaaaagc

SEQ ID NO: 252711 - RNA, 21 nt, Human
caacccccagggcugcagucc

SEQ ID NO: 252712 - RNA, 23 nt, Human
cccccaacccgaggggcagacug

SEQ ID NO: 252713 - RNA, 26 nt, Human
gccccagaucccaggagggccaggac

SEQ ID NO: 252714 - RNA, 19 nt, Human
gcucccacccuggccuaag

SEQ ID NO: 252715 - RNA, 23 nt, Human
ggauggggaaaaaagcaccaggu

SEQ ID NO: 252716 - RNA, 18 nt, Human
ggccacaggcugaaggag

SEQ ID NO: 252717 - RNA, 22 nt, Human
ggccacaggcugaaggaggggc

SEQ ID NO: 252718 - RNA, 19 nt, Human
ggcuguaggaaauccaagc

SEQ ID NO: 252719 - RNA, 23 nt, Human
ugaggcaccgcagccugcaaccc

SEQ ID NO: 252720 - RNA, 24 nt, Human
ugaggcaccgcagccugcaacccc

SEQ ID NO: 252721 - RNA, 18 nt, Human
ugggauacucccccaacc

SEQ ID NO: 252722 - RNA, 19 nt, Human
ugggauacucccccaaccc

SEQ ID NO: 252723 - RNA, 24 nt, Human
uggggauggggaaaaaagcaccag

SEQ ID NO: 252724 - RNA, 18 nt, Human
ugucagagaggacagcug

SEQ ID NO: 252725 - RNA, 21 nt, Human
ugucuguccucaaaacgggcu

SEQ ID NO: 252726 - RNA, 24 nt, Human
uucagaauaaaaggaacaugggga

SEQ ID NO: 252727 - RNA, 23 nt, Human
uuuucagaauaaaaggaacaugg

SEQ ID NO: 252728 - RNA, 23 nt, Human
aaaaacuucuacacuacaacaaa

SEQ ID NO: 252729 - RNA, 21 nt, Human
aaacaaaaauaaaaaccucaa

SEQ ID NO: 252730 - RNA, 22 nt, Human
aaacaagauaaagacgcaugca

SEQ ID NO: 252731 - RNA, 24 nt, Human
aaagaauggcaaacauuuucgccu

SEQ ID NO: 252732 - RNA, 21 nt, Human
aaaguaguuuacagagcaguu

SEQ ID NO: 252733 - RNA, 18 nt, Human
aacagaaauaugaaaauc

SEQ ID NO: 252734 - RNA, 24 nt, Human
aaccucaacaacaaaauauuaacc

SEQ ID NO: 252735 - RNA, 19 nt, Human
aacuaaaaugaugucucag

SEQ ID NO: 252736 - RNA, 20 nt, Human
aagaagcgaguaaaaguccc

SEQ ID NO: 252737 - RNA, 23 nt, Human
aagaauggcaaacauuuucgccu

SEQ ID NO: 252738 - RNA, 21 nt, Human
aagggcaggaggguugacaga

SEQ ID NO: 252739 - RNA, 19 nt, Human
aaguguucgaugaccgaac

SEQ ID NO: 252740 - RNA, 21 nt, Human
aauggcaaacauuuucgccuc

SEQ ID NO: 252741 - RNA, 30 nt, Human
accccaaccaagccgucaccuacccgaccu

SEQ ID NO: 252742 - RNA, 20 nt, Human
accuaagaccacaaagggca

SEQ ID NO: 252743 - RNA, 24 nt, Human
agagaugagugaagauucugguaa

SEQ ID NO: 252744 - RNA, 24 nt, Human
agagcuagaaacaacuucagaucu

SEQ ID NO: 252745 - RNA, 24 nt, Human
agggcaggaggguugacagagguc

SEQ ID NO: 252746 - RNA, 18 nt, Human
agugcuuuuccccaucau

SEQ ID NO: 252747 - RNA, 22 nt, Human
augcaaccuauagcaccauacc

SEQ ID NO: 252748 - RNA, 19 nt, Human
caaaacaucugaaaaacac

SEQ ID NO: 252749 - RNA, 26 nt, Human
caaccaagccgucaccuacccgaccu

SEQ ID NO: 252750 - RNA, 21 nt, Human
caaccuauagcaccauaccua

SEQ ID NO: 252751 - RNA, 23 nt, Human
caaccucaaugaacuaaaaugau

SEQ ID NO: 252752 - RNA, 24 nt, Human
caagauaaagacgcaugcaaccua

SEQ ID NO: 252753 - RNA, 26 nt, Human
caaguaguccccucgcagcgacccca

SEQ ID NO: 252754 - RNA, 22 nt, Human
caauggaagaacugugaccaga

SEQ ID NO: 252755 - RNA, 22 nt, Human
cacacccaggccagacuuucaa

SEQ ID NO: 252756 - RNA, 20 nt, Human
cacccccaccaaggaccaau

SEQ ID NO: 252757 - RNA, 23 nt, Human
cacccccaccaaggaccaauuua

SEQ ID NO: 252758 - RNA, 23 nt, Human
cacuacaacaaaagcacagcggg

SEQ ID NO: 252759 - RNA, 23 nt, Human
cacucccgaccccaagccacagg

SEQ ID NO: 252760 - RNA, 19 nt, Human
cacugcuugagagcagggc

SEQ ID NO: 252761 - RNA, 19 nt, Human
cagaagacagaugauuuga

SEQ ID NO: 252762 - RNA, 23 nt, Human
caucauguuuaucuggggcuccu

SEQ ID NO: 252763 - RNA, 21 nt, Human
cauggcaaaacaucugaaaaa

SEQ ID NO: 252764 - RNA, 19 nt, Human
ccaaacaaacaagauaaag

SEQ ID NO: 252765 - RNA, 21 nt, Human
ccaaacaaacaagauaaagac

SEQ ID NO: 252766 - RNA, 24 nt, Human
ccaaccaagccgucaccuacccga

SEQ ID NO: 252767 - RNA, 20 nt, Human
ccaagauaaguaucagaucc

SEQ ID NO: 252768 - RNA, 24 nt, Human
ccaagccacaggcuacgacucacg

SEQ ID NO: 252769 - RNA, 23 nt, Human
cccacacccaggccagacuuuca

SEQ ID NO: 252770 - RNA, 22 nt, Human
ccccaagccacaggcuacgacu

SEQ ID NO: 252771 - RNA, 23 nt, Human
ccccaagccacaggcuacgacuc

SEQ ID NO: 252772 - RNA, 19 nt, Human
cccgaccccaagccacagg

SEQ ID NO: 252773 - RNA, 19 nt, Human
ccgaccccaagccacaggc

SEQ ID NO: 252774 - RNA, 21 nt, Human
ccgaccccaagccacaggcua

SEQ ID NO: 252775 - RNA, 22 nt, Human
ccuauagcaccauaccuaagac

SEQ ID NO: 252776 - RNA, 24 nt, Human
ccuccugcacucccgaccccaagc

SEQ ID NO: 252777 - RNA, 19 nt, Human
ccugccaaccucaaugaac

SEQ ID NO: 252778 - RNA, 18 nt, Human
cuacaacaaaagcacagc

SEQ ID NO: 252779 - RNA, 23 nt, Human
cucacgccucggcgcuccaagua

SEQ ID NO: 252780 - RNA, 18 nt, Human
cuccaaguaguccccucg

SEQ ID NO: 252781 - RNA, 23 nt, Human
cucgcagcgaccccaaccaagcc

SEQ ID NO: 252782 - RNA, 19 nt, Human
cugcacucccgaccccaag

SEQ ID NO: 252783 - RNA, 27 nt, Human
cugugaccagaagagaaaccggggucc

SEQ ID NO: 252784 - RNA, 21 nt, Human
cuucuacacuacaacaaaagc

SEQ ID NO: 252785 - RNA, 23 nt, Human
gaaacaacuucagaucucaccua

SEQ ID NO: 252786 - RNA, 24 nt, Human
gaacuaccaccuuagauaaucccg

SEQ ID NO: 252787 - RNA, 23 nt, Human
gaagucccaagauaaguaucaga

SEQ ID NO: 252788 - RNA, 19 nt, Human
gagagcagggcccuuccgu

SEQ ID NO: 252789 - RNA, 23 nt, Human
gagcccagggcagugccuggcag

SEQ ID NO: 252790 - RNA, 24 nt, Human
gauggguuaagaagcuauagagcu

SEQ ID NO: 252791 - RNA, 19 nt, Human
gcaaucccugccaaccuca

SEQ ID NO: 252792 - RNA, 20 nt, Human
gcauuaugacauuggugugg

SEQ ID NO: 252793 - RNA, 19 nt, Human
gcugccuucuaaugaagac

SEQ ID NO: 252794 - RNA, 19 nt, Human
ggcaucauccaucauuuuu

SEQ ID NO: 252795 - RNA, 27 nt, Human
ggcuacaaaagcagccauagcucagaa

SEQ ID NO: 252796 - RNA, 20 nt, Human
gggaaaaugggacaaaaucu

SEQ ID NO: 252797 - RNA, 23 nt, Human
gggcagugccuggcagguaucug

SEQ ID NO: 252798 - RNA, 24 nt, Human
gguugacagaggucuuaagaggaa

SEQ ID NO: 252799 - RNA, 20 nt, Human
guucguugacugaugugucc

SEQ ID NO: 252800 - RNA, 24 nt, Human
guuuuucaaaaaccucugugcauu

SEQ ID NO: 252801 - RNA, 22 nt, Human
uaaaaaccucaacaacaaaaua

SEQ ID NO: 252802 - RNA, 21 nt, Human
uaaacaaaaauaaaaaccuca

SEQ ID NO: 252803 - RNA, 23 nt, Human
uaacacacccucacaauuaucua

SEQ ID NO: 252804 - RNA, 23 nt, Human
uaacccuacagacaugugcuaca

SEQ ID NO: 252805 - RNA, 19 nt, Human
uacaguugaagcagguggc

SEQ ID NO: 252806 - RNA, 21 nt, Human
uagaaacaacuucagaucuca

SEQ ID NO: 252807 - RNA, 19 nt, Human
uagaguccaauacuuuuaa

SEQ ID NO: 252808 - RNA, 22 nt, Human
uagcaccauaccuaagaccaca

SEQ ID NO: 252809 - RNA, 31 nt, Human
uaggaugagaucccaaauauagaaccuauuu

SEQ ID NO: 252810 - RNA, 25 nt, Human
uaucagagaggaaaaaugcugccuu

SEQ ID NO: 252811 - RNA, 26 nt, Human
uaucugaaguaaacaaaaauaaaaac

SEQ ID NO: 252812 - RNA, 18 nt, Human
uaugcuccacauggcaaa

SEQ ID NO: 252813 - RNA, 24 nt, Human
ucagguuagugcuucucggaaagg

SEQ ID NO: 252814 - RNA, 22 nt, Human
ucagugcuuuuccccaucaugu

SEQ ID NO: 252815 - RNA, 20 nt, Human
ucauguuuaucuggggcucc

SEQ ID NO: 252816 - RNA, 19 nt, Human
ucccacacccaggccagac

SEQ ID NO: 252817 - RNA, 27 nt, Human
ucccacacccaggccagacuuucaaaa

SEQ ID NO: 252818 - RNA, 22 nt, Human
ucgccuccugcacucccgaccc

SEQ ID NO: 252819 - RNA, 20 nt, Human
ucggaaaggcuacaaaagca

SEQ ID NO: 252820 - RNA, 23 nt, Human
ucucugacaucuguauaacccua

SEQ ID NO: 252821 - RNA, 18 nt, Human
ucuuagcaugcauaauuu

SEQ ID NO: 252822 - RNA, 30 nt, Human
ugaaaaacacucagauguuuuucaaaaacc

SEQ ID NO: 252823 - RNA, 22 nt, Human
ugaaaauccaugauuuuccaga

SEQ ID NO: 252824 - RNA, 24 nt, Human
ugaagcagguggcaucauccauca

SEQ ID NO: 252825 - RNA, 19 nt, Human
ugacauugguguggaaauu

SEQ ID NO: 252826 - RNA, 21 nt, Human
ugaccgaacucccacacccag

SEQ ID NO: 252827 - RNA, 24 nt, Human
ugaccgaacucccacacccaggcc

SEQ ID NO: 252828 - RNA, 18 nt, Human
ugagaucccaaauauaga

SEQ ID NO: 252829 - RNA, 24 nt, Human
ugauacacccccaccaaggaccaa

SEQ ID NO: 252830 - RNA, 20 nt, Human
uggaagaacugugaccagaa

SEQ ID NO: 252831 - RNA, 21 nt, Human
uuaauauuaacaaacggaaaa

SEQ ID NO: 252832 - RNA, 19 nt, Human
uuaguucagugcuuuuccc

SEQ ID NO: 252833 - RNA, 20 nt, Human
uuugacacuguucuuauucu

SEQ ID NO: 252834 - RNA, 21 nt, Human
uuuuucuuccucuugaugucu

SEQ ID NO: 252835 - RNA, 24 nt, Human
uuuuuuuuuuugucaucauaagug

SEQ ID NO: 252836 - RNA, 18 nt, Human
uuuuuuuuuuuuuuuguc

SEQ ID NO: 252837 - RNA, 18 nt, Human
uuuuuuuuuuuuuuuuug

SEQ ID NO: 252838 - RNA, 19 nt, Human
uuuuuuuuuuuuuuuuugu

SEQ ID NO: 252839 - RNA, 20 nt, Human
aaaggccugcagcugggaga

SEQ ID NO: 252840 - RNA, 21 nt, Human
aaggaguuggugcucgggaau

SEQ ID NO: 252841 - RNA, 18 nt, Human
aaggcccccuuguaagga

SEQ ID NO: 252842 - RNA, 18 nt, Human
aaucagcagaagcaugca

SEQ ID NO: 252843 - RNA, 22 nt, Human
acccagaggguauggggaagac

SEQ ID NO: 252844 - RNA, 20 nt, Human
agagggagcacucauggaga

SEQ ID NO: 252845 - RNA, 23 nt, Human
aggggcugggaugggccaucagg

SEQ ID NO: 252846 - RNA, 24 nt, Human
aggggcugggaugggccaucaggg

SEQ ID NO: 252847 - RNA, 25 nt, Human
agucccuacccacucccagcccugc

SEQ ID NO: 252848 - RNA, 20 nt, Human
agugaggaagcaggacaaga

SEQ ID NO: 252849 - RNA, 25 nt, Human
augggcccuguucacacugcacugc

SEQ ID NO: 252850 - RNA, 18 nt, Human
auuacacugucuuuuugc

SEQ ID NO: 252851 - RNA, 24 nt, Human
caacacccagaggguauggggaag

SEQ ID NO: 252852 - RNA, 21 nt, Human
caacucauucucauggagccc

SEQ ID NO: 252853 - RNA, 19 nt, Human
cagcaggggagcaaggagg

SEQ ID NO: 252854 - RNA, 18 nt, Human
caggacaagauggaccac

SEQ ID NO: 252855 - RNA, 21 nt, Human
caggggaagcugaguaugaua

SEQ ID NO: 252856 - RNA, 18 nt, Human
cagucccuacccacuccc

SEQ ID NO: 252857 - RNA, 19 nt, Human
ccaucagcaggggagcaag

SEQ ID NO: 252858 - RNA, 24 nt, Human
cccagcccugcagagauuguccuc

SEQ ID NO: 252859 - RNA, 19 nt, Human
cccccuuguaaggaguugg

SEQ ID NO: 252860 - RNA, 24 nt, Human
cccuacccacucccagcccugcag

SEQ ID NO: 252861 - RNA, 18 nt, Human
ccugcagcugggagagug

SEQ ID NO: 252862 - RNA, 20 nt, Human
ccugcagcugggagaguggc

SEQ ID NO: 252863 - RNA, 20 nt, Human
cuagaauacaccaugggccc

SEQ ID NO: 252864 - RNA, 18 nt, Human
cugcucccucauguggcu

SEQ ID NO: 252865 - RNA, 18 nt, Human
cuuggcauagagcuucag

SEQ ID NO: 252866 - RNA, 23 nt, Human
gaugcugaagaugggacaugguu

SEQ ID NO: 252867 - RNA, 19 nt, Human
gcagagauuguccucugcu

SEQ ID NO: 252868 - RNA, 23 nt, Human
gcagcagagggagcacucaugga

SEQ ID NO: 252869 - RNA, 19 nt, Human
gcccuguucacacugcacu

SEQ ID NO: 252870 - RNA, 21 nt, Human
ggacaagauggaccacaaagg

SEQ ID NO: 252871 - RNA, 20 nt, Human
ggaggagccaggugccuaca

SEQ ID NO: 252872 - RNA, 25 nt, Human
ggaugcugaagaugggacaugguuu

SEQ ID NO: 252873 - RNA, 19 nt, Human
gggaagcugaguaugauag

SEQ ID NO: 252874 - RNA, 19 nt, Human
gggaggaaaggugccugag

SEQ ID NO: 252875 - RNA, 24 nt, Human
ggggagcaaggaggagccaggugc

SEQ ID NO: 252876 - RNA, 21 nt, Human
ggggaggaaaggugccugagg

SEQ ID NO: 252877 - RNA, 20 nt, Human
ggggaguaaguuggugggag

SEQ ID NO: 252878 - RNA, 18 nt, Human
gucccuacccacucccag

SEQ ID NO: 252879 - RNA, 22 nt, Human
guggcuaaaccucucaacaccc

SEQ ID NO: 252880 - RNA, 21 nt, Human
guucuuggcauagagcuucag

SEQ ID NO: 252881 - RNA, 19 nt, Human
uaaaccucucaacacccag

SEQ ID NO: 252882 - RNA, 26 nt, Human
uaaguuggugggagggaugcugauca

SEQ ID NO: 252883 - RNA, 18 nt, Human
uagaaccaugugccucuc

SEQ ID NO: 252884 - RNA, 21 nt, Human
uaggaauggaugcccugggug

SEQ ID NO: 252885 - RNA, 18 nt, Human
uaugauagugaggugggc

SEQ ID NO: 252886 - RNA, 18 nt, Human
ucauggagcccagccagg

SEQ ID NO: 252887 - RNA, 19 nt, Human
uccacagugaggaagcagg

SEQ ID NO: 252888 - RNA, 21 nt, Human
uccacagugaggaagcaggac

SEQ ID NO: 252889 - RNA, 24 nt, Human
uccaggggaggaaaggugccugag

SEQ ID NO: 252890 - RNA, 25 nt, Human
uccucugcucccucauguggcuaau

SEQ ID NO: 252891 - RNA, 18 nt, Human
uccuggcugucagcuguu

SEQ ID NO: 252892 - RNA, 19 nt, Human
ucucggaagaggccugggg

SEQ ID NO: 252893 - RNA, 18 nt, Human
ugaagccaguucauucag

SEQ ID NO: 252894 - RNA, 19 nt, Human
ugagagcagcccagaggag

SEQ ID NO: 252895 - RNA, 21 nt, Human
ugagagcagcccagaggagug

SEQ ID NO: 252896 - RNA, 23 nt, Human
ugaggugggcugggguuccacgg

SEQ ID NO: 252897 - RNA, 19 nt, Human
ugcaccugacuccaggugu

SEQ ID NO: 252898 - RNA, 24 nt, Human
ugcaccugacuccagguguaauuu

SEQ ID NO: 252899 - RNA, 25 nt, Human
uggcauagagcuucaggggcuggga

SEQ ID NO: 252900 - RNA, 21 nt, Human
uggcuaaaccucucaacaccc

SEQ ID NO: 252901 - RNA, 18 nt, Human
ugggagaguggcuccugg

SEQ ID NO: 252902 - RNA, 20 nt, Human
ugggagggaugcugaagaug

SEQ ID NO: 252903 - RNA, 21 nt, Human
ugggaugggccaucaggggaa

SEQ ID NO: 252904 - RNA, 22 nt, Human
uggugugcgguagcuguguucu

SEQ ID NO: 252905 - RNA, 20 nt, Human
uguaaggaguuggugcucgg

SEQ ID NO: 252906 - RNA, 19 nt, Human
uguggcauggcugagagcc

SEQ ID NO: 252907 - RNA, 18 nt, Human
uucagucccuacccacuc

SEQ ID NO: 252908 - RNA, 23 nt, Human
uuggcuguggcuguuucagggug

SEQ ID NO: 252909 - RNA, 21 nt, Human
uuggugcucgggaaucagcag

SEQ ID NO: 252910 - RNA, 21 nt, Human
uuuauugagaccuucaguccc

SEQ ID NO: 252911 - RNA, 23 nt, Human
aaccacacgcccuacuuugcccu

SEQ ID NO: 252912 - RNA, 19 nt, Human
aacccaugccggcuccucu

SEQ ID NO: 252913 - RNA, 22 nt, Human
aagaggcagcgggcccauggaa

SEQ ID NO: 252914 - RNA, 21 nt, Human
aagccagcaugagggccccaa

SEQ ID NO: 252915 - RNA, 25 nt, Human
aaggggcaagagaggcaaccaggga

SEQ ID NO: 252916 - RNA, 19 nt, Human
acacgcaccugggaucggc

SEQ ID NO: 252917 - RNA, 22 nt, Human
acaggacagugaggacuggggg

SEQ ID NO: 252918 - RNA, 27 nt, Human
acccgccccacccccuucugugucgcu

SEQ ID NO: 252919 - RNA, 21 nt, Human
acccuccccuuccccaguccc

SEQ ID NO: 252920 - RNA, 22 nt, Human
agacccgccccacccccuucug

SEQ ID NO: 252921 - RNA, 18 nt, Human
agagggagggagggguga

SEQ ID NO: 252922 - RNA, 20 nt, Human
aggaagaccuggggguggca

SEQ ID NO: 252923 - RNA, 18 nt, Human
aggacaaggggcaagaga

SEQ ID NO: 252924 - RNA, 24 nt, Human
aggcaaccagggagacaaggggaa

SEQ ID NO: 252925 - RNA, 23 nt, Human
aggcagcgggcccauggaaagca

SEQ ID NO: 252926 - RNA, 22 nt, Human
agggaggggugacuguguggug

SEQ ID NO: 252927 - RNA, 22 nt, Human
aggggcuggggcagggcccgug

SEQ ID NO: 252928 - RNA, 22 nt, Human
agguggagggugggaaagaggg

SEQ ID NO: 252929 - RNA, 18 nt, Human
augugugagagaggggcu

SEQ ID NO: 252930 - RNA, 21 nt, Human
caaacgcccacccugccaacc

SEQ ID NO: 252931 - RNA, 23 nt, Human
ccacagcaguuguggcacauggu

SEQ ID NO: 252932 - RNA, 22 nt, Human
ccagcaugagggccccaaacgc

SEQ ID NO: 252933 - RNA, 21 nt, Human
ccaguccccagcccuauggug

SEQ ID NO: 252934 - RNA, 22 nt, Human
ccauagacccgccccacccccu

SEQ ID NO: 252935 - RNA, 22 nt, Human
ccccaaacgcccacccugccaa

SEQ ID NO: 252936 - RNA, 24 nt, Human
ccccaguccccagcccuaugguga

SEQ ID NO: 252937 - RNA, 22 nt, Human
cccgugagagguggaggguggg

SEQ ID NO: 252938 - RNA, 19 nt, Human
cccuuuccuguccauccca

SEQ ID NO: 252939 - RNA, 22 nt, Human
ccgugagagguggaggguggga

SEQ ID NO: 252940 - RNA, 18 nt, Human
ccuauggugauuuaaagg

SEQ ID NO: 252941 - RNA, 18 nt, Human
ccuccccuuccccagucc

SEQ ID NO: 252942 - RNA, 20 nt, Human
ccucgcucccuuucucccca

SEQ ID NO: 252943 - RNA, 26 nt, Human
ccucugaacacccuccccuuccccag

SEQ ID NO: 252944 - RNA, 18 nt, Human
ccuggggcuuccgggccu

SEQ ID NO: 252945 - RNA, 27 nt, Human
cuacuuugcccuuuccuguccauccca

SEQ ID NO: 252946 - RNA, 20 nt, Human
cucagugccuaagaaaacag

SEQ ID NO: 252947 - RNA, 18 nt, Human
cuccucugaccucgcucc

SEQ ID NO: 252948 - RNA, 21 nt, Human
cugaacacccuccccuucccc

SEQ ID NO: 252949 - RNA, 18 nt, Human
cuggggguggcagguggc

SEQ ID NO: 252950 - RNA, 20 nt, Human
gacccgccccacccccuucu

SEQ ID NO: 252951 - RNA, 18 nt, Human
gagacagagacacacgca

SEQ ID NO: 252952 - RNA, 20 nt, Human
gcaagagaggcaaccaggga

SEQ ID NO: 252953 - RNA, 24 nt, Human
gccaagaggcagcgggcccaugga

SEQ ID NO: 252954 - RNA, 18 nt, Human
gccucugaacacccuccc

SEQ ID NO: 252955 - RNA, 20 nt, Human
gccucugaacacccuccccu

SEQ ID NO: 252956 - RNA, 19 nt, Human
gcuaggagagacagagaca

SEQ ID NO: 252957 - RNA, 19 nt, Human
ggaaagcaggaagaccugg

SEQ ID NO: 252958 - RNA, 18 nt, Human
ggaaugggcacgcugggc

SEQ ID NO: 252959 - RNA, 21 nt, Human
ggcuccucugaccucgcuccc

SEQ ID NO: 252960 - RNA, 21 nt, Human
gggaggggugacuguguggug

SEQ ID NO: 252961 - RNA, 18 nt, Human
gggcugagaagccaagag

SEQ ID NO: 252962 - RNA, 20 nt, Human
gggcuggggcagggcccguc

SEQ ID NO: 252963 - RNA, 25 nt, Human
gggcuggggcagggcccgugagagg

SEQ ID NO: 252964 - RNA, 19 nt, Human
gggcuucaggacaaggggc

SEQ ID NO: 252965 - RNA, 23 nt, Human
ggggaagugucuuggggacagaa

SEQ ID NO: 252966 - RNA, 18 nt, Human
ggggacggggcuuagggg

SEQ ID NO: 252967 - RNA, 22 nt, Human
ggggacggggcuuaggggcugg

SEQ ID NO: 252968 - RNA, 26 nt, Human
uaccccagggccgacgcagggccgac

SEQ ID NO: 252969 - RNA, 19 nt, Human
uaggagagacagagacaca

SEQ ID NO: 252970 - RNA, 24 nt, Human
ucaggacaaggggcaagagaggca

SEQ ID NO: 252971 - RNA, 27 nt, Human
ucagugccuaagaaaacaggacaguga

SEQ ID NO: 252972 - RNA, 25 nt, Human
uccccauagacccgccccacccccu

SEQ ID NO: 252973 - RNA, 23 nt, Human
ucccucagugccuaagaaaacag

SEQ ID NO: 252974 - RNA, 21 nt, Human
ucugaccucgcucccuuucuc

SEQ ID NO: 252975 - RNA, 23 nt, Human
ucugaccucgcucccuuucuccc

SEQ ID NO: 252976 - RNA, 26 nt, Human
ugaacacccuccccuuccccaguccc

SEQ ID NO: 252977 - RNA, 19 nt, Human
ugacugugugguggugcug

SEQ ID NO: 252978 - RNA, 24 nt, Human
ugagagguggagggugggaaagag

SEQ ID NO: 252979 - RNA, 19 nt, Human
ugagggccccaaacgccca

SEQ ID NO: 252980 - RNA, 22 nt, Human
ugaugugugagagaggggcuag

SEQ ID NO: 252981 - RNA, 20 nt, Human
ugccucugaacacccucccc

SEQ ID NO: 252982 - RNA, 19 nt, Human
uggaaagcaggaagaccug

SEQ ID NO: 252983 - RNA, 20 nt, Human
uggaagcugccuguguccuc

SEQ ID NO: 252984 - RNA, 21 nt, Human
uggaagcugccuguguccucu

SEQ ID NO: 252985 - RNA, 23 nt, Human
uggaagcugccuguguccucugg

SEQ ID NO: 252986 - RNA, 20 nt, Human
uggagggugggaaagaggga

SEQ ID NO: 252987 - RNA, 21 nt, Human
uggagggugggaaagagggag

SEQ ID NO: 252988 - RNA, 19 nt, Human
uggcacaugguaccccagg

SEQ ID NO: 252989 - RNA, 22 nt, Human
ugggaaagagggagggaggggu

SEQ ID NO: 252990 - RNA, 18 nt, Human
uguccaucccagaccuac

SEQ ID NO: 252991 - RNA, 18 nt, Human
uucuugaggccaccaugg

SEQ ID NO: 252992 - RNA, 24 nt, Human
uuggaagcugccuguguccucugg

SEQ ID NO: 252993 - RNA, 23 nt, Human
uuuaaaggggcugagaagccaag

SEQ ID NO: 252994 - RNA, 21 nt, Human
aaagcuauuuuaaaacaaaac

SEQ ID NO: 252995 - RNA, 23 nt, Human
aaaguccugucacuucccugcuu

SEQ ID NO: 252996 - RNA, 21 nt, Human
aacauggugagacccccaucc

SEQ ID NO: 252997 - RNA, 24 nt, Human
aagcugccaggugcacgccuguca

SEQ ID NO: 252998 - RNA, 22 nt, Human
acacuuugaaaaagcugccagg

SEQ ID NO: 252999 - RNA, 24 nt, Human
accuuaagacaaggaggaaaaaaa

SEQ ID NO: 253000 - RNA, 20 nt, Human
acuuugaaaaagcugccagg

SEQ ID NO: 253001 - RNA, 22 nt, Human
agccugggcaacauggugagac

SEQ ID NO: 253002 - RNA, 23 nt, Human
agccugggcaacauggugagacc

SEQ ID NO: 253003 - RNA, 24 nt, Human
agccugggcaacauggugagaccc

SEQ ID NO: 253004 - RNA, 22 nt, Human
agcucuggggcggggcggccgg

SEQ ID NO: 253005 - RNA, 22 nt, Human
aggaaaaaaaccucuacaagga

SEQ ID NO: 253006 - RNA, 22 nt, Human
aggaggaaaaaaaccucuacaa

SEQ ID NO: 253007 - RNA, 23 nt, Human
aucguuuaggaaaacucccuaaa

SEQ ID NO: 253008 - RNA, 21 nt, Human
auuugccuucccacagacaaa

SEQ ID NO: 253009 - RNA, 18 nt, Human
caaaggcaucauuuaggu

SEQ ID NO: 253010 - RNA, 19 nt, Human
caacauggugagaccccca

SEQ ID NO: 253011 - RNA, 21 nt, Human
caacauggugagacccccauc

SEQ ID NO: 253012 - RNA, 23 nt, Human
caacauggugagacccccauccc

SEQ ID NO: 253013 - RNA, 19 nt, Human
cacccgcaccagagugauc

SEQ ID NO: 253014 - RNA, 19 nt, Human
cacgccugucaucccagcu

SEQ ID NO: 253015 - RNA, 26 nt, Human
cacucccgcuucuccucagccaagaa

SEQ ID NO: 253016 - RNA, 19 nt, Human
caggugcacgccugucauc

SEQ ID NO: 253017 - RNA, 24 nt, Human
cauggugagacccccaucccaaaa

SEQ ID NO: 253018 - RNA, 23 nt, Human
ccaaacacccgcaccagagugau

SEQ ID NO: 253019 - RNA, 22 nt, Human
ccacauaacaauauuuuuauga

SEQ ID NO: 253020 - RNA, 23 nt, Human
cccacauaacaauauuuuuauga

SEQ ID NO: 253021 - RNA, 23 nt, Human
ccugggcaacauggugagacccc

SEQ ID NO: 253022 - RNA, 25 nt, Human
ccugggcaacauggugagaccccca

SEQ ID NO: 253023 - RNA, 31 nt, Human
ccuucccacagacaaaggcaucauuuagguu

SEQ ID NO: 253024 - RNA, 22 nt, Human
ccuuugguuagagcucuggggc

SEQ ID NO: 253025 - RNA, 20 nt, Human
cgaggagguccgcagcagcc

SEQ ID NO: 253026 - RNA, 18 nt, Human
cgccugucaucccagcua

SEQ ID NO: 253027 - RNA, 24 nt, Human
cgccugucaucccagcuacucagg

SEQ ID NO: 253028 - RNA, 21 nt, Human
cuacccccgcuucccaacuuu

SEQ ID NO: 253029 - RNA, 19 nt, Human
cuggcuggggccgggcugg

SEQ ID NO: 253030 - RNA, 23 nt, Human
cuggggccgggcuggggcugggu

SEQ ID NO: 253031 - RNA, 19 nt, Human
cuggggcggggcggccggg

SEQ ID NO: 253032 - RNA, 23 nt, Human
cuuggcucuuaccaaucuuucug

SEQ ID NO: 253033 - RNA, 24 nt, Human
cuuggcucuuaccaaucuuucugu

SEQ ID NO: 253034 - RNA, 23 nt, Human
gccugucaucccagcuacucagg

SEQ ID NO: 253035 - RNA, 18 nt, Human
ggccgggcuggggcuggg

SEQ ID NO: 253036 - RNA, 22 nt, Human
gggcuggggcuggguccggguc

SEQ ID NO: 253037 - RNA, 19 nt, Human
gggguuugagaccagccug

SEQ ID NO: 253038 - RNA, 22 nt, Human
gggguuugagaccagccugggc

SEQ ID NO: 253039 - RNA, 21 nt, Human
uaaaaaaugacucccuuagau

SEQ ID NO: 253040 - RNA, 20 nt, Human
uaaaacaaaaccaaacaccc

SEQ ID NO: 253041 - RNA, 21 nt, Human
uaaaacaaaaccaaacacccg

SEQ ID NO: 253042 - RNA, 22 nt, Human
uaaaacaaaaccaaacacccgc

SEQ ID NO: 253043 - RNA, 20 nt, Human
uaggugcuuccaucagccac

SEQ ID NO: 253044 - RNA, 24 nt, Human
uaugaccuuaagacaaggaggaaa

SEQ ID NO: 253045 - RNA, 18 nt, Human
ucagccaagaacaaugaa

SEQ ID NO: 253046 - RNA, 21 nt, Human
ucagccacucccgcuucuccu

SEQ ID NO: 253047 - RNA, 20 nt, Human
ucccacauaacaauauuuuu

SEQ ID NO: 253048 - RNA, 24 nt, Human
uccccgggcgggcaucggagcucu

SEQ ID NO: 253049 - RNA, 22 nt, Human
ucuacaaggaaauaggaagaaa

SEQ ID NO: 253050 - RNA, 21 nt, Human
ugcaaagcuauuuuaaaacaa

SEQ ID NO: 253051 - RNA, 20 nt, Human
ugcuuccaucagccacuccc

SEQ ID NO: 253052 - RNA, 25 nt, Human
uggcuggggccgggcuggggcuggg

SEQ ID NO: 253053 - RNA, 21 nt, Human
uggggccgggcuggggcuggg

SEQ ID NO: 253054 - RNA, 21 nt, Human
uggggguuugagaccagccug

SEQ ID NO: 253055 - RNA, 22 nt, Human
uguaguccuacccccgcuuccc

SEQ ID NO: 253056 - RNA, 18 nt, Human
uuaagacaaggaggaaaa

SEQ ID NO: 253057 - RNA, 22 nt, Human
uucaguguaguccuacccccgc

SEQ ID NO: 253058 - RNA, 20 nt, Human
uuuuuuuuuuuuuuucccac

SEQ ID NO: 253059 - RNA, 19 nt, Human
aaccuuugcccagcaguuc

SEQ ID NO: 253060 - RNA, 21 nt, Human
aaggagcuuugggagacuggu

SEQ ID NO: 253061 - RNA, 22 nt, Human
acaaaaucugguccuguucgca

SEQ ID NO: 253062 - RNA, 20 nt, Human
acagcucagcccccaaaucc

SEQ ID NO: 253063 - RNA, 21 nt, Human
acccagaagucucugcccaac

SEQ ID NO: 253064 - RNA, 25 nt, Human
accuuccccagaaacaucucuauug

SEQ ID NO: 253065 - RNA, 23 nt, Human
accuuugcccagcaguucaggau

SEQ ID NO: 253066 - RNA, 22 nt, Human
acugagagacauuagccagggc

SEQ ID NO: 253067 - RNA, 21 nt, Human
agacagggaggggaagcuggu

SEQ ID NO: 253068 - RNA, 21 nt, Human
agagacauuagccagggccaa

SEQ ID NO: 253069 - RNA, 22 nt, Human
agccaaggcacacccagaaguc

SEQ ID NO: 253070 - RNA, 23 nt, Human
agccaaggcacacccagaagucu

SEQ ID NO: 253071 - RNA, 19 nt, Human
agcucagcccccaaauccc

SEQ ID NO: 253072 - RNA, 20 nt, Human
aggaccccugagccccagcc

SEQ ID NO: 253073 - RNA, 22 nt, Human
aggagcuuugggagacugguug

SEQ ID NO: 253074 - RNA, 19 nt, Human
aggcaaaagucuggcaggc

SEQ ID NO: 253075 - RNA, 19 nt, Human
aggcaaaagucuggcaggc

SEQ ID NO: 253076 - RNA, 21 nt, Human
agggacccacagugccaccuu

SEQ ID NO: 253077 - RNA, 21 nt, Human
caaccacccgaaggcccugcc

SEQ ID NO: 253078 - RNA, 19 nt, Human
caagacacuugccagggac

SEQ ID NO: 253079 - RNA, 20 nt, Human
caaggcacacccagaagucu

SEQ ID NO: 253080 - RNA, 21 nt, Human
caagguggcugccccagaucc

SEQ ID NO: 253081 - RNA, 18 nt, Human
caagugcccccugcccuu

SEQ ID NO: 253082 - RNA, 22 nt, Human
cagacagggaggggaagcuggu

SEQ ID NO: 253083 - RNA, 22 nt, Human
cagaccccacccagaggccaug

SEQ ID NO: 253084 - RNA, 19 nt, Human
cagaggcaaaagucuggca

SEQ ID NO: 253085 - RNA, 23 nt, Human
cagauccugggcuugccaaccac

SEQ ID NO: 253086 - RNA, 25 nt, Human
cagcagaggcaaaagucuggcaggc

SEQ ID NO: 253087 - RNA, 21 nt, Human
cagcccccaaaucccaaccag

SEQ ID NO: 253088 - RNA, 21 nt, Human
cagcucaagugcccccugccc

SEQ ID NO: 253089 - RNA, 20 nt, Human
caggaagauggggagugggc

SEQ ID NO: 253090 - RNA, 24 nt, Human
cagggacugccuaucacaagacac

SEQ ID NO: 253091 - RNA, 21 nt, Human
cagugccaauugccacucaga

SEQ ID NO: 253092 - RNA, 23 nt, Human
ccaaccagacagggaggggaagc

SEQ ID NO: 253093 - RNA, 19 nt, Human
ccaccaccugguccaccug

SEQ ID NO: 253094 - RNA, 20 nt, Human
ccaccuugggagccaaggca

SEQ ID NO: 253095 - RNA, 18 nt, Human
ccagccaucacacccaca

SEQ ID NO: 253096 - RNA, 21 nt, Human
ccagcucaagugcccccugcc

SEQ ID NO: 253097 - RNA, 24 nt, Human
cccagcccagcucaagugcccccu

SEQ ID NO: 253098 - RNA, 26 nt, Human
cccagcucaagugcccccugcccuuu

SEQ ID NO: 253099 - RNA, 20 nt, Human
ccccagacagcucagccccc

SEQ ID NO: 253100 - RNA, 21 nt, Human
ccccagacagcucagccccca

SEQ ID NO: 253101 - RNA, 25 nt, Human
ccccagauccagccaucacacccac

SEQ ID NO: 253102 - RNA, 24 nt, Human
ccccaggggaaugacugagagaca

SEQ ID NO: 253103 - RNA, 23 nt, Human
cccccaaaucccaaccagacagg

SEQ ID NO: 253104 - RNA, 22 nt, Human
cccccugcccuuuuucaauuca

SEQ ID NO: 253105 - RNA, 20 nt, Human
ccccugagccccagcccagc

SEQ ID NO: 253106 - RNA, 22 nt, Human
ccccugagccccagcccagcuc

SEQ ID NO: 253107 - RNA, 21 nt, Human
ccccuggagccucucuggccc

SEQ ID NO: 253108 - RNA, 21 nt, Human
cccugagccccagcccagcuc

SEQ ID NO: 253109 - RNA, 21 nt, Human
cccuggagccucucuggccac

SEQ ID NO: 253110 - RNA, 23 nt, Human
cccuggagccucucuggccacca

SEQ ID NO: 253111 - RNA, 23 nt, Human
cccugggcugucuaacucaccuc

SEQ ID NO: 253112 - RNA, 24 nt, Human
ccuaacagcaagaaaggcugggaa

SEQ ID NO: 253113 - RNA, 18 nt, Human
ccucucuggccaccaccu

SEQ ID NO: 253114 - RNA, 20 nt, Human
ccugggaccccagacagcuc

SEQ ID NO: 253115 - RNA, 20 nt, Human
ccugggcuugccaaccaccc

SEQ ID NO: 253116 - RNA, 21 nt, Human
ccugguccaccugguccccug

SEQ ID NO: 253117 - RNA, 22 nt, Human
cggccagaccccacccagaggc

SEQ ID NO: 253118 - RNA, 23 nt, Human
cggccagaccccacccagaggcc

SEQ ID NO: 253119 - RNA, 22 nt, Human
cuaacucaccucccaggggccu

SEQ ID NO: 253120 - RNA, 19 nt, Human
cuagccccuggagccucuc

SEQ ID NO: 253121 - RNA, 18 nt, Human
cuccagcagaggcaaaag

SEQ ID NO: 253122 - RNA, 21 nt, Human
cugagagacauuagccagggc

SEQ ID NO: 253123 - RNA, 19 nt, Human
cugccuaaaggguuaggac

SEQ ID NO: 253124 - RNA, 24 nt, Human
cuucaugguagcaagguggcugcc

SEQ ID NO: 253125 - RNA, 23 nt, Human
cuugccagggacccacagugcca

SEQ ID NO: 253126 - RNA, 18 nt, Human
cuuggccuuuccuucaug

SEQ ID NO: 253127 - RNA, 19 nt, Human
gcaaaaccuuccccagaaa

SEQ ID NO: 253128 - RNA, 18 nt, Human
gccaaggcacacccagaa

SEQ ID NO: 253129 - RNA, 22 nt, Human
gcccccugcccuuuuucaauuc

SEQ ID NO: 253130 - RNA, 21 nt, Human
gccccuggagccucucuggcc

SEQ ID NO: 253131 - RNA, 24 nt, Human
gcucagcccccaaaucccaaccag

SEQ ID NO: 253132 - RNA, 21 nt, Human
gcugggacccguuaugcucca

SEQ ID NO: 253133 - RNA, 21 nt, Human
ggaaaugagcaaaaaggauca

SEQ ID NO: 253134 - RNA, 22 nt, Human
ggaagagguaggagcugaggcu

SEQ ID NO: 253135 - RNA, 19 nt, Human
ggacacagaugagggaggc

SEQ ID NO: 253136 - RNA, 20 nt, Human
ggaccccugagccccagccc

SEQ ID NO: 253137 - RNA, 24 nt, Human
ggagcuuugggagacugguuggca

SEQ ID NO: 253138 - RNA, 21 nt, Human
ggcuggcaaggagggaagagg

SEQ ID NO: 253139 - RNA, 22 nt, Human
gggaagagguaggagcugaggc

SEQ ID NO: 253140 - RNA, 20 nt, Human
ggguggggagcaaggagcuu

SEQ ID NO: 253141 - RNA, 19 nt, Human
uagcaagguggcugcccca

SEQ ID NO: 253142 - RNA, 20 nt, Human
uaugcuccaucaucugggcc

SEQ ID NO: 253143 - RNA, 20 nt, Human
ucagcccccaaaucccaacc

SEQ ID NO: 253144 - RNA, 23 nt, Human
ucagcccccaaaucccaaccaga

SEQ ID NO: 253145 - RNA, 21 nt, Human
ucaggaacucgggacacagau

SEQ ID NO: 253146 - RNA, 19 nt, Human
ucccaggggccuggggugc

SEQ ID NO: 253147 - RNA, 24 nt, Human
uccccagaaacaucucuauuggau

SEQ ID NO: 253148 - RNA, 28 nt, Human
uccccagaaacaucucuauuggauuugc

SEQ ID NO: 253149 - RNA, 21 nt, Human
ucucuauuggauuugcuuagu

SEQ ID NO: 253150 - RNA, 18 nt, Human
ucucuggccaccaccugg

SEQ ID NO: 253151 - RNA, 21 nt, Human
ucucuggccaccaccuggucc

SEQ ID NO: 253152 - RNA, 20 nt, Human
ugagccccagcccagcucaa

SEQ ID NO: 253153 - RNA, 21 nt, Human
ugagccccaggggaaugacug

SEQ ID NO: 253154 - RNA, 21 nt, Human
ugaggcucuggacccagaggc

SEQ ID NO: 253155 - RNA, 20 nt, Human
ugagggaggcaggagugggc

SEQ ID NO: 253156 - RNA, 19 nt, Human
ugccacucagauccugggc

SEQ ID NO: 253157 - RNA, 18 nt, Human
ugccagggacccacagug

SEQ ID NO: 253158 - RNA, 24 nt, Human
ugccagggacccacagugccaccu

SEQ ID NO: 253159 - RNA, 21 nt, Human
ugccccagauccagccaucac

SEQ ID NO: 253160 - RNA, 23 nt, Human
ugccccagauccagccaucacac

SEQ ID NO: 253161 - RNA, 22 nt, Human
ugcugcagacccuggauucugc

SEQ ID NO: 253162 - RNA, 18 nt, Human
ugcuggagggaauagcug

SEQ ID NO: 253163 - RNA, 22 nt, Human
uggagggaauagcuguggauga

SEQ ID NO: 253164 - RNA, 22 nt, Human
uggcaggcaucaggggcuggca

SEQ ID NO: 253165 - RNA, 20 nt, Human
uggcccugggaccccagaca

SEQ ID NO: 253166 - RNA, 25 nt, Human
ugggaccccagacagcucagccccc

SEQ ID NO: 253167 - RNA, 23 nt, Human
ugggccccggcaugcugaggcuc

SEQ ID NO: 253168 - RNA, 23 nt, Human
ugguccuguucgcaagggguggg

SEQ ID NO: 253169 - RNA, 24 nt, Human
ugguccuguucgcaaggggugggg

SEQ ID NO: 253170 - RNA, 23 nt, Human
ugucccuucaggaacucgggaca

SEQ ID NO: 253171 - RNA, 29 nt, Human
uucagugccaauugccacucagauccugg

SEQ ID NO: 253172 - RNA, 21 nt, Human
uugucuuggccuuuccuucau

SEQ ID NO: 253173 - RNA, 18 nt, Human
aaaaagcagauggaaagg

SEQ ID NO: 253174 - RNA, 21 nt, Human
aaaaagcagauggaaagggga

SEQ ID NO: 253175 - RNA, 19 nt, Human
aaaaggucagaaggcaggc

SEQ ID NO: 253176 - RNA, 21 nt, Human
aagaggccuggaugggaagug

SEQ ID NO: 253177 - RNA, 23 nt, Human
agaacuucgagagacggacacac

SEQ ID NO: 253178 - RNA, 24 nt, Human
agacggacacacagggcaccuccu

SEQ ID NO: 253179 - RNA, 19 nt, Human
agagacuugagcugggcac

SEQ ID NO: 253180 - RNA, 18 nt, Human
aggaagagggcaggggcc

SEQ ID NO: 253181 - RNA, 23 nt, Human
aggaagagggcaggggccggcuu

SEQ ID NO: 253182 - RNA, 19 nt, Human
aggacgggcaggaagaggg

SEQ ID NO: 253183 - RNA, 26 nt, Human
aggagggggagagagacuugagcugg

SEQ ID NO: 253184 - RNA, 20 nt, Human
aggcagacagccaguuggau

SEQ ID NO: 253185 - RNA, 20 nt, Human
aggcagggcaguggcagaga

SEQ ID NO: 253186 - RNA, 18 nt, Human
agggagggugguaggguc

SEQ ID NO: 253187 - RNA, 22 nt, Human
agggcaggggccggcuucaggg

SEQ ID NO: 253188 - RNA, 21 nt, Human
aggucagaaggcaggcgaugg

SEQ ID NO: 253189 - RNA, 23 nt, Human
cacaugaauagaugcucaguaca

SEQ ID NO: 253190 - RNA, 22 nt, Human
cagagaccaaggaccagacccc

SEQ ID NO: 253191 - RNA, 24 nt, Human
caggaaggagcagggaggguggua

SEQ ID NO: 253192 - RNA, 21 nt, Human
cagggagggugguaggguccc

SEQ ID NO: 253193 - RNA, 18 nt, Human
cagggcaguggcagagac

SEQ ID NO: 253194 - RNA, 23 nt, Human
cagggcaguggcagagaccaagg

SEQ ID NO: 253195 - RNA, 20 nt, Human
caguggcagagaccaaggac

SEQ ID NO: 253196 - RNA, 20 nt, Human
cauuuuuguugaaucaagga

SEQ ID NO: 253197 - RNA, 21 nt, Human
ccaagacccccaagggcccac

SEQ ID NO: 253198 - RNA, 21 nt, Human
ccagggccagaggagaggcag

SEQ ID NO: 253199 - RNA, 20 nt, Human
cccaagacccccaagggccc

SEQ ID NO: 253200 - RNA, 24 nt, Human
cccaagacccccaagggcccacuc

SEQ ID NO: 253201 - RNA, 23 nt, Human
ccuccuguucccagggccagagg

SEQ ID NO: 253202 - RNA, 20 nt, Human
ccugcugaugcuccuuccuu

SEQ ID NO: 253203 - RNA, 19 nt, Human
cugaccggcaaaagaggac

SEQ ID NO: 253204 - RNA, 23 nt, Human
cugccaggcuagaccaguucuug

SEQ ID NO: 253205 - RNA, 21 nt, Human
cugugacagcccaagaccccc

SEQ ID NO: 253206 - RNA, 19 nt, Human
gacaggggccugccacaug

SEQ ID NO: 253207 - RNA, 20 nt, Human
gaccccauuucagggagaaa

SEQ ID NO: 253208 - RNA, 20 nt, Human
gagggggagagagacuugag

SEQ ID NO: 253209 - RNA, 26 nt, Human
gcacaaggcucugcauggcuuucugg

SEQ ID NO: 253210 - RNA, 20 nt, Human
gcaguggcagagaccaagga

SEQ ID NO: 253211 - RNA, 20 nt, Human
gcccaagacccccaagggcc

SEQ ID NO: 253212 - RNA, 23 nt, Human
gcccaagacccccaagggcccac

SEQ ID NO: 253213 - RNA, 20 nt, Human
gcccugaccggcaaaagagg

SEQ ID NO: 253214 - RNA, 23 nt, Human
ggcaggaagagggcaggggccgg

SEQ ID NO: 253215 - RNA, 20 nt, Human
ggcaggggccggcuucaggg

SEQ ID NO: 253216 - RNA, 21 nt, Human
ggcgauggagaagcugaaaaa

SEQ ID NO: 253217 - RNA, 18 nt, Human
gggggagaaaggaggggg

SEQ ID NO: 253218 - RNA, 22 nt, Human
gggggagagagacuugagcugg

SEQ ID NO: 253219 - RNA, 25 nt, Human
guuuagggggagaaaggagggggag

SEQ ID NO: 253220 - RNA, 21 nt, Human
uagggucccaugagccccagc

SEQ ID NO: 253221 - RNA, 21 nt, Human
ucaaggaaaaggucagaaggc

SEQ ID NO: 253222 - RNA, 21 nt, Human
ucagaaggcaggcgauggaga

SEQ ID NO: 253223 - RNA, 19 nt, Human
ucccccucccugggagccc

SEQ ID NO: 253224 - RNA, 19 nt, Human
uccccugcgugccagcccu

SEQ ID NO: 253225 - RNA, 19 nt, Human
ucccugggagccccagaga

SEQ ID NO: 253226 - RNA, 21 nt, Human
uccgguggcacaguguggggc

SEQ ID NO: 253227 - RNA, 22 nt, Human
uccuguucccagggccagagga

SEQ ID NO: 253228 - RNA, 22 nt, Human
uccuuuguuccccugcgugcca

SEQ ID NO: 253229 - RNA, 19 nt, Human
ucuagaggcagacagccag

SEQ ID NO: 253230 - RNA, 23 nt, Human
ugaaaaagcagauggaaagggga

SEQ ID NO: 253231 - RNA, 22 nt, Human
ugaaucaaggaaaaggucagaa

SEQ ID NO: 253232 - RNA, 19 nt, Human
ugacagcccaagaccccca

SEQ ID NO: 253233 - RNA, 23 nt, Human
ugaggacuucucuucccccuccc

SEQ ID NO: 253234 - RNA, 23 nt, Human
ugcauggcuuucuggagucccug

SEQ ID NO: 253235 - RNA, 18 nt, Human
ugccaggcuagaccaguu

SEQ ID NO: 253236 - RNA, 20 nt, Human
uggaaaggggaagaggccug

SEQ ID NO: 253237 - RNA, 20 nt, Human
uggaaaggggaagaggccug

SEQ ID NO: 253238 - RNA, 19 nt, Human
uggagaagcugaaaaagca

SEQ ID NO: 253239 - RNA, 23 nt, Human
ugggaaauaacucguggugucgc

SEQ ID NO: 253240 - RNA, 21 nt, Human
ugggagccccagagaaggaug

SEQ ID NO: 253241 - RNA, 18 nt, Human
uggggccagucagcagcc

SEQ ID NO: 253242 - RNA, 21 nt, Human
uggguagagacccugcugaug

SEQ ID NO: 253243 - RNA, 21 nt, Human
uucuggagucccugugacagc

SEQ ID NO: 253244 - RNA, 21 nt, Human
aaaaauauaaauaucuuuaca

SEQ ID NO: 253245 - RNA, 23 nt, Human
aaaaccaacaagaauuugcuccc

SEQ ID NO: 253246 - RNA, 21 nt, Human
aaaauauauacucccaguaaa

SEQ ID NO: 253247 - RNA, 21 nt, Human
aaacaaacagaugccugcaga

SEQ ID NO: 253248 - RNA, 26 nt, Human
aaaggaaguguuaagcuaaccgaacg

SEQ ID NO: 253249 - RNA, 22 nt, Human
aaaggcaagcagcacaaaacca

SEQ ID NO: 253250 - RNA, 19 nt, Human
aaauuuccagccccaugau

SEQ ID NO: 253251 - RNA, 21 nt, Human
aacauuccauuuauuuacaga

SEQ ID NO: 253252 - RNA, 25 nt, Human
aagaacuagaaaccacuguggagcc

SEQ ID NO: 253253 - RNA, 21 nt, Human
aagaagacaggagauauagaa

SEQ ID NO: 253254 - RNA, 23 nt, Human
aagaagacaggagauauagaaga

SEQ ID NO: 253255 - RNA, 23 nt, Human
aagcagaaaaggaaagagggacc

SEQ ID NO: 253256 - RNA, 18 nt, Human
aagcagcacaaaaccaac

SEQ ID NO: 253257 - RNA, 21 nt, Human
aagggaaccaaccauggaaau

SEQ ID NO: 253258 - RNA, 18 nt, Human
aagugucucuucuggauc

SEQ ID NO: 253259 - RNA, 20 nt, Human
aaugguaucugcagccuucc

SEQ ID NO: 253260 - RNA, 21 nt, Human
acaaacaaacagaugccugca

SEQ ID NO: 253261 - RNA, 26 nt, Human
acaaaguccuucacuuugguauucca

SEQ ID NO: 253262 - RNA, 26 nt, Human
acaagcaaauccugucaaugaagaca

SEQ ID NO: 253263 - RNA, 18 nt, Human
acaagcaagaaaauaacg

SEQ ID NO: 253264 - RNA, 23 nt, Human
acacaaacaaacagaugccugca

SEQ ID NO: 253265 - RNA, 20 nt, Human
accaacaagaauuugcuccc

SEQ ID NO: 253266 - RNA, 21 nt, Human
accaacaagaauuugcuccca

SEQ ID NO: 253267 - RNA, 23 nt, Human
acguuccucaacuccucucacuc

SEQ ID NO: 253268 - RNA, 19 nt, Human
acugcaauuuucagaaguu

SEQ ID NO: 253269 - RNA, 19 nt, Human
acugucucuggucugggga

SEQ ID NO: 253270 - RNA, 21 nt, Human
agaaagggaaccaaccaugga

SEQ ID NO: 253271 - RNA, 24 nt, Human
agaaaucuaugaaaacaacuauac

SEQ ID NO: 253272 - RNA, 18 nt, Human
agaagaaauagcaucacc

SEQ ID NO: 253273 - RNA, 25 nt, Human
agacagaacagggguuacauuccaa

SEQ ID NO: 253274 - RNA, 26 nt, Human
agacaggagauauagaagagggaccc

SEQ ID NO: 253275 - RNA, 22 nt, Human
agagaaaggaggugagaucuau

SEQ ID NO: 253276 - RNA, 21 nt, Human
agagaggaugaggggacccag

SEQ ID NO: 253277 - RNA, 18 nt, Human
agaugccugcagagaaag

SEQ ID NO: 253278 - RNA, 20 nt, Human
agugauucuugacccccuag

SEQ ID NO: 253279 - RNA, 24 nt, Human
auagugaaugaaaccuucaagcac

SEQ ID NO: 253280 - RNA, 19 nt, Human
aucuugugauucaaauacu

SEQ ID NO: 253281 - RNA, 18 nt, Human
augaaaccuucaagcacc

SEQ ID NO: 253282 - RNA, 21 nt, Human
auucauagaucaguucccccu

SEQ ID NO: 253283 - RNA, 24 nt, Human
caaaaugcagcagcuaaaucccag

SEQ ID NO: 253284 - RNA, 18 nt, Human
caaacagaugccugcaga

SEQ ID NO: 253285 - RNA, 19 nt, Human
caacacaagcaaauccugu

SEQ ID NO: 253286 - RNA, 20 nt, Human
caacacaagcaaauccuguc

SEQ ID NO: 253287 - RNA, 22 nt, Human
cacaaacaaacagaugccugca

SEQ ID NO: 253288 - RNA, 19 nt, Human
cacaguaucuuggggguua

SEQ ID NO: 253289 - RNA, 22 nt, Human
cagaauagugauucuugacccc

SEQ ID NO: 253290 - RNA, 23 nt, Human
cagaauuucagaguacuucuuau

SEQ ID NO: 253291 - RNA, 22 nt, Human
cagcaccacaagugagguaaca

SEQ ID NO: 253292 - RNA, 24 nt, Human
cagcagcuaaaucccagucuauac

SEQ ID NO: 253293 - RNA, 20 nt, Human
cagcucuuucgcuugugggg

SEQ ID NO: 253294 - RNA, 20 nt, Human
caggugcuggacuccuuggc

SEQ ID NO: 253295 - RNA, 20 nt, Human
caguccuucauauccugaca

SEQ ID NO: 253296 - RNA, 20 nt, Human
cccagcaccacaagugaggu

SEQ ID NO: 253297 - RNA, 22 nt, Human
ccccuuucucccaucauuaucc

SEQ ID NO: 253298 - RNA, 23 nt, Human
cccuaggaguuuccaagagaccc

SEQ ID NO: 253299 - RNA, 19 nt, Human
ccuggauuaaaguacuagc

SEQ ID NO: 253300 - RNA, 24 nt, Human
cucccucuaugccuaccuccaaaa

SEQ ID NO: 253301 - RNA, 19 nt, Human
cucuaaggacaauuauuag

SEQ ID NO: 253302 - RNA, 18 nt, Human
cugacccucaaaagccac

SEQ ID NO: 253303 - RNA, 22 nt, Human
cuuaaaaacauuccauuuauuu

SEQ ID NO: 253304 - RNA, 20 nt, Human
cuuccaccguuuucaaucug

SEQ ID NO: 253305 - RNA, 21 nt, Human
cuugacccccuaggaguuucc

SEQ ID NO: 253306 - RNA, 20 nt, Human
gaaauagcaucaccuaggca

SEQ ID NO: 253307 - RNA, 18 nt, Human
gacuaagcccuccucaaa

SEQ ID NO: 253308 - RNA, 21 nt, Human
gauugaaaaggugagggaaug

SEQ ID NO: 253309 - RNA, 24 nt, Human
gcacggcccaggcacuggaagcuc

SEQ ID NO: 253310 - RNA, 20 nt, Human
gccacugucucuggucuggg

SEQ ID NO: 253311 - RNA, 18 nt, Human
gcucacugucuuccacgu

SEQ ID NO: 253312 - RNA, 24 nt, Human
gcugacccucaaaagccacaaaga

SEQ ID NO: 253313 - RNA, 28 nt, Human
ggagacaggugcuggacuccccaagggg

SEQ ID NO: 253314 - RNA, 24 nt, Human
uaaaagaaaaugcuaaaucugaca

SEQ ID NO: 253315 - RNA, 21 nt, Human
uaacacauuuuaacaugauca

SEQ ID NO: 253316 - RNA, 23 nt, Human
uaacagaaagggaaccaaccaug

SEQ ID NO: 253317 - RNA, 21 nt, Human
uaauggaucacaucuucuuag

SEQ ID NO: 253318 - RNA, 19 nt, Human
uacaguuucagaauaguga

SEQ ID NO: 253319 - RNA, 21 nt, Human
uaccuggauuaaaguacuagc

SEQ ID NO: 253320 - RNA, 21 nt, Human
uagcugucucuugaguaacgu

SEQ ID NO: 253321 - RNA, 20 nt, Human
uaggauaugaaaaaagaaaa

SEQ ID NO: 253322 - RNA, 19 nt, Human
uaggcacggcccaggcacu

SEQ ID NO: 253323 - RNA, 19 nt, Human
uaguucuaagaggucuuga

SEQ ID NO: 253324 - RNA, 21 nt, Human
uauaguguuagggugagagcu

SEQ ID NO: 253325 - RNA, 21 nt, Human
uaucuugugauucaaauacug

SEQ ID NO: 253326 - RNA, 28 nt, Human
uauucuucuuaaaaaaaaaaaaaaaaaa

SEQ ID NO: 253327 - RNA, 23 nt, Human
ucaaugcccacaaaaauaauaag

SEQ ID NO: 253328 - RNA, 23 nt, Human
ucaccaaacuucuguucuuagau

SEQ ID NO: 253329 - RNA, 21 nt, Human
uccaagagaccccucaagugc

SEQ ID NO: 253330 - RNA, 19 nt, Human
uccaaucaagaaucauuac

SEQ ID NO: 253331 - RNA, 21 nt, Human
ucccacugcaauuuucagaag

SEQ ID NO: 253332 - RNA, 21 nt, Human
ucccucauuuccaucuucgua

SEQ ID NO: 253333 - RNA, 18 nt, Human
ucccucuaugccuaccuc

SEQ ID NO: 253334 - RNA, 20 nt, Human
ucccugacaacaccuaguuc

SEQ ID NO: 253335 - RNA, 22 nt, Human
ucccugacaacaccuaguucua

SEQ ID NO: 253336 - RNA, 22 nt, Human
uccuuagauuuuggacuuaauu

SEQ ID NO: 253337 - RNA, 22 nt, Human
uccuucauauccugacaguuaa

SEQ ID NO: 253338 - RNA, 21 nt, Human
uccuuggguaagaggggcacc

SEQ ID NO: 253339 - RNA, 21 nt, Human
ucuacagaucauuggauccau

SEQ ID NO: 253340 - RNA, 23 nt, Human
ucucuucuggaucccuuugcaca

SEQ ID NO: 253341 - RNA, 24 nt, Human
ucuucuuagagaggaugaggggac

SEQ ID NO: 253342 - RNA, 22 nt, Human
ugaagacagaacagggguuaca

SEQ ID NO: 253343 - RNA, 18 nt, Human
ugaagacuaagcccuccu

SEQ ID NO: 253344 - RNA, 21 nt, Human
ugaaugaaaccuucaagcacc

SEQ ID NO: 253345 - RNA, 22 nt, Human
ugaaugacacaaaguccuucac

SEQ ID NO: 253346 - RNA, 23 nt, Human
ugagaaaucuaugaaaacaacua

SEQ ID NO: 253347 - RNA, 19 nt, Human
ugcagccuucccccuaaaa

SEQ ID NO: 253348 - RNA, 23 nt, Human
ugcuaaaucugacauaauuauau

SEQ ID NO: 253349 - RNA, 21 nt, Human
uggaagggguagggcucccuc

SEQ ID NO: 253350 - RNA, 24 nt, Human
uggaagggguagggcucccucuau

SEQ ID NO: 253351 - RNA, 21 nt, Human
uggaaucaucccucauuucca

SEQ ID NO: 253352 - RNA, 18 nt, Human
ugggauuugggauaaaga

SEQ ID NO: 253353 - RNA, 18 nt, Human
uggguaaagaguggaagg

SEQ ID NO: 253354 - RNA, 21 nt, Human
ugguacugugaaaugagcuuu

SEQ ID NO: 253355 - RNA, 22 nt, Human
ugguaucuccaaucaagaauca

SEQ ID NO: 253356 - RNA, 25 nt, Human
uguaauauucauagaucaguucccc

SEQ ID NO: 253357 - RNA, 23 nt, Human
ugucaguccuucauauccugaca

SEQ ID NO: 253358 - RNA, 23 nt, Human
uguuaauucugauugaaaaggug

SEQ ID NO: 253359 - RNA, 19 nt, Human
uguuauaaauuccuugggu

SEQ ID NO: 253360 - RNA, 20 nt, Human
uuaaaaaaaaaaaaaaaaaa

SEQ ID NO: 253361 - RNA, 30 nt, Human
uuauccacugcaucauugaagucaaggauu

SEQ ID NO: 253362 - RNA, 22 nt, Human
uucaaucuguugauuaccagag

SEQ ID NO: 253363 - RNA, 19 nt, Human
uuggacuuaauucaacagc

SEQ ID NO: 253364 - RNA, 22 nt, Human
uuggauguugaaggcaacaggg

SEQ ID NO: 253365 - RNA, 21 nt, Human
uuugcacaaguccaucgcauu

SEQ ID NO: 253366 - RNA, 20 nt, Human
uuuggacuuaauucaacagc

SEQ ID NO: 253367 - RNA, 24 nt, Human
aaaaauaaauuauuuuuaaccucc

SEQ ID NO: 253368 - RNA, 22 nt, Human
aacagaaauauuucaccaauag

SEQ ID NO: 253369 - RNA, 19 nt, Human
aagcuuucucuuguguauu

SEQ ID NO: 253370 - RNA, 18 nt, Human
aaggcccccagcugcauc

SEQ ID NO: 253371 - RNA, 24 nt, Human
aagggucuugcugcucaggccccu

SEQ ID NO: 253372 - RNA, 25 nt, Human
aaucaggccagaccuuuccccagac

SEQ ID NO: 253373 - RNA, 19 nt, Human
acacugcccacuccccaga

SEQ ID NO: 253374 - RNA, 21 nt, Human
accaguagcccuuuaugcuaa

SEQ ID NO: 253375 - RNA, 21 nt, Human
acgcuccaggacagggcugac

SEQ ID NO: 253376 - RNA, 22 nt, Human
acuaucaucuucuguuucaucu

SEQ ID NO: 253377 - RNA, 21 nt, Human
agaaauauuucaccaauagug

SEQ ID NO: 253378 - RNA, 19 nt, Human
agaagagggaaauguggag

SEQ ID NO: 253379 - RNA, 26 nt, Human
agauaucugcucccguauaggauaug

SEQ ID NO: 253380 - RNA, 24 nt, Human
agaugcugauuagcuucaagaccu

SEQ ID NO: 253381 - RNA, 18 nt, Human
agccaauguccugcccag

SEQ ID NO: 253382 - RNA, 22 nt, Human
agccagcccccagcaguuccuu

SEQ ID NO: 253383 - RNA, 22 nt, Human
aggcaggauaaggcugugucuc

SEQ ID NO: 253384 - RNA, 20 nt, Human
aggcccccagcugcauccag

SEQ ID NO: 253385 - RNA, 23 nt, Human
aggccccugucccuggacuccaa

SEQ ID NO: 253386 - RNA, 24 nt, Human
agggagggugguucagagaggcgu

SEQ ID NO: 253387 - RNA, 26 nt, Human
agucacuaccauacuaaccacacaga

SEQ ID NO: 253388 - RNA, 22 nt, Human
auaugccaaagaggcugaacuu

SEQ ID NO: 253389 - RNA, 18 nt, Human
auguggucaagaggggcu

SEQ ID NO: 253390 - RNA, 21 nt, Human
auuucuggcauuacgcuccag

SEQ ID NO: 253391 - RNA, 18 nt, Human
caaaggauuuguaccagu

SEQ ID NO: 253392 - RNA, 19 nt, Human
caacaacaucaggaaaauc

SEQ ID NO: 253393 - RNA, 24 nt, Human
caagacccucuucuucaagugagu

SEQ ID NO: 253394 - RNA, 25 nt, Human
cacaaaagcaacaucccaggacaca

SEQ ID NO: 253395 - RNA, 20 nt, Human
cacacaaaaaacauauaaca

SEQ ID NO: 253396 - RNA, 23 nt, Human
cacagagugcuuauccacgucaa

SEQ ID NO: 253397 - RNA, 19 nt, Human
caccuauaaccaauuaggu

SEQ ID NO: 253398 - RNA, 18 nt, Human
cacggcuucguauguggg

SEQ ID NO: 253399 - RNA, 25 nt, Human
cacuaccauacuaaccacacagaga

SEQ ID NO: 253400 - RNA, 22 nt, Human
cagcugaucccaugcggccgug

SEQ ID NO: 253401 - RNA, 21 nt, Human
caucauccaaggcaauuuuga

SEQ ID NO: 253402 - RNA, 23 nt, Human
caucauggacccaguucaucuuc

SEQ ID NO: 253403 - RNA, 23 nt, Human
cauuaauauccacacccguguag

SEQ ID NO: 253404 - RNA, 22 nt, Human
cauuagaaauaagauuuacaca

SEQ ID NO: 253405 - RNA, 21 nt, Human
ccaaugauagacuucuucagc

SEQ ID NO: 253406 - RNA, 24 nt, Human
ccaauguccugcccagcggccaga

SEQ ID NO: 253407 - RNA, 20 nt, Human
ccacagauaucugcucccgu

SEQ ID NO: 253408 - RNA, 21 nt, Human
ccaccuauaaccaauuaggua

SEQ ID NO: 253409 - RNA, 19 nt, Human
ccaggacagggcugaccag

SEQ ID NO: 253410 - RNA, 23 nt, Human
ccaucaaacuucaagcuccucuc

SEQ ID NO: 253411 - RNA, 21 nt, Human
ccccucgcugucccgucaccu

SEQ ID NO: 253412 - RNA, 24 nt, Human
ccgcucccucucugucugaaggau

SEQ ID NO: 253413 - RNA, 22 nt, Human
ccguguugucucccagccaaug

SEQ ID NO: 253414 - RNA, 23 nt, Human
ccuauaaccaacuagcagauguu

SEQ ID NO: 253415 - RNA, 25 nt, Human
ccucccaccgccuauaaccaacuag

SEQ ID NO: 253416 - RNA, 19 nt, Human
ccucuuccaccacuuggca

SEQ ID NO: 253417 - RNA, 21 nt, Human
ccugcagccuggagaaacugc

SEQ ID NO: 253418 - RNA, 21 nt, Human
ccuggagaaacugccccauuc

SEQ ID NO: 253419 - RNA, 19 nt, Human
ccuuguguuugccuuuucu

SEQ ID NO: 253420 - RNA, 22 nt, Human
cucauuaccucuugcagccgcu

SEQ ID NO: 253421 - RNA, 21 nt, Human
cucccagccaauguccugccc

SEQ ID NO: 253422 - RNA, 20 nt, Human
cucuuccuuuuuccucccca

SEQ ID NO: 253423 - RNA, 18 nt, Human
cugacugucuauguccca

SEQ ID NO: 253424 - RNA, 19 nt, Human
cugugucucauugccagaa

SEQ ID NO: 253425 - RNA, 23 nt, Human
cuucaagcuccucucuggauucu

SEQ ID NO: 253426 - RNA, 22 nt, Human
cuuugcuuaucaugcucccccc

SEQ ID NO: 253427 - RNA, 20 nt, Human
cuuuuuccuccccaugaggc

SEQ ID NO: 253428 - RNA, 21 nt, Human
gaaauaugcagugacauuucu

SEQ ID NO: 253429 - RNA, 23 nt, Human
gaagacgucauccuccacgcccc

SEQ ID NO: 253430 - RNA, 21 nt, Human
gacccaguucaucuucaguaa

SEQ ID NO: 253431 - RNA, 21 nt, Human
gaggggcuggcaaggucuucc

SEQ ID NO: 253432 - RNA, 21 nt, Human
gccgcacaacagugacgcccu

SEQ ID NO: 253433 - RNA, 19 nt, Human
gcuuaucaugcucccccca

SEQ ID NO: 253434 - RNA, 19 nt, Human
ggggucauuguugaaggag

SEQ ID NO: 253435 - RNA, 21 nt, Human
ggguaugaacaaauuagcaac

SEQ ID NO: 253436 - RNA, 27 nt, Human
gggugguucagagaggcgucccugcag

SEQ ID NO: 253437 - RNA, 28 nt, Human
guaauagaguccuuucccaaccggaggg

SEQ ID NO: 253438 - RNA, 23 nt, Human
guagcccccacggacaugaagau

SEQ ID NO: 253439 - RNA, 25 nt, Human
gucccgucaccuccugcacggcuuc

SEQ ID NO: 253440 - RNA, 24 nt, Human
guggacauacacacacuucaucau

SEQ ID NO: 253441 - RNA, 23 nt, Human
guucauucauaucaauccacaug

SEQ ID NO: 253442 - RNA, 19 nt, Human
guuucuugagaagggguaa

SEQ ID NO: 253443 - RNA, 25 nt, Human
uaacagaaauauuucaccaauagug

SEQ ID NO: 253444 - RNA, 22 nt, Human
uaggauaugccaaagaggcuga

SEQ ID NO: 253445 - RNA, 22 nt, Human
uaucaugcuccccccaccuaua

SEQ ID NO: 253446 - RNA, 22 nt, Human
uauggcaacaggguguaucugg

SEQ ID NO: 253447 - RNA, 24 nt, Human
uauggcaacaggguguaucugguc

SEQ ID NO: 253448 - RNA, 21 nt, Human
uaugugggucuggucugggac

SEQ ID NO: 253449 - RNA, 25 nt, Human
uauuuuuaugugaaaugugguugua

SEQ ID NO: 253450 - RNA, 19 nt, Human
ucaaacuucaagcuccucu

SEQ ID NO: 253451 - RNA, 18 nt, Human
ucaauguagcccaguuuc

SEQ ID NO: 253452 - RNA, 20 nt, Human
ucacacaaaaaacauauaac

SEQ ID NO: 253453 - RNA, 20 nt, Human
ucaccaguagcccuuuaugc

SEQ ID NO: 253454 - RNA, 22 nt, Human
ucacuaccauacuaaccacaca

SEQ ID NO: 253455 - RNA, 18 nt, Human
ucaggccccugucccugg

SEQ ID NO: 253456 - RNA, 21 nt, Human
uccacgucaaugaaguaaaau

SEQ ID NO: 253457 - RNA, 18 nt, Human
uccaggacagggcugacc

SEQ ID NO: 253458 - RNA, 21 nt, Human
uccaucauuuggguauuugau

SEQ ID NO: 253459 - RNA, 18 nt, Human
uccccagacaaugucucc

SEQ ID NO: 253460 - RNA, 20 nt, Human
ucccugcagccuggagaaac

SEQ ID NO: 253461 - RNA, 21 nt, Human
ucguggggucauuguugaagg

SEQ ID NO: 253462 - RNA, 20 nt, Human
ucuaugauuacaaacgugga

SEQ ID NO: 253463 - RNA, 26 nt, Human
ucuccauacaaagggucuugcugcuc

SEQ ID NO: 253464 - RNA, 18 nt, Human
ucucccagccaauguccu

SEQ ID NO: 253465 - RNA, 21 nt, Human
ucucccagccaauguccugcc

SEQ ID NO: 253466 - RNA, 22 nt, Human
ucucccagccaauguccugccc

SEQ ID NO: 253467 - RNA, 19 nt, Human
ucucuuguguauuuaacaa

SEQ ID NO: 253468 - RNA, 23 nt, Human
ucuucuguuucaucugaucuuuc

SEQ ID NO: 253469 - RNA, 18 nt, Human
ugaccaggaaggcugggc

SEQ ID NO: 253470 - RNA, 23 nt, Human
ugagaugcugauuagcuucaaga

SEQ ID NO: 253471 - RNA, 21 nt, Human
ugcaggcucuugccagggcag

SEQ ID NO: 253472 - RNA, 22 nt, Human
ugcauccagcgaacacacaucu

SEQ ID NO: 253473 - RNA, 23 nt, Human
ugccagaaauggcuggauccaga

SEQ ID NO: 253474 - RNA, 18 nt, Human
ugcuguaaaaauucacag

SEQ ID NO: 253475 - RNA, 18 nt, Human
ugcuuugcccaucauccc

SEQ ID NO: 253476 - RNA, 18 nt, Human
uggauucuguggauuguu

SEQ ID NO: 253477 - RNA, 24 nt, Human
uggcaaggucuuccacucuccucu

SEQ ID NO: 253478 - RNA, 18 nt, Human
ugggcccagcaggaacug

SEQ ID NO: 253479 - RNA, 18 nt, Human
ugucucauugccagaaau

SEQ ID NO: 253480 - RNA, 21 nt, Human
uguguauuuaacaaaagaaug

SEQ ID NO: 253481 - RNA, 21 nt, Human
uguguuugccuuuucuuugcu

SEQ ID NO: 253482 - RNA, 19 nt, Human
uguugaaaauuauauggcu

SEQ ID NO: 253483 - RNA, 20 nt, Human
uguugaaaauuauauggcuu

SEQ ID NO: 253484 - RNA, 19 nt, Human
uguuucaucugaucuuucc

SEQ ID NO: 253485 - RNA, 18 nt, Human
uguuugccuuuucuuugc

SEQ ID NO: 253486 - RNA, 21 nt, Human
uuccuuguguuugccuuuucu

SEQ ID NO: 253487 - RNA, 21 nt, Human
uucuggcuggcagaaaagcug

SEQ ID NO: 253488 - RNA, 20 nt, Human
uucuugagaagggguaaaag

SEQ ID NO: 253489 - RNA, 19 nt, Human
uugcagccgcucccucucu

SEQ ID NO: 253490 - RNA, 24 nt, Human
uuggcaguugaauuacggaaaaag

SEQ ID NO: 253491 - RNA, 21 nt, Human
uuguauaguucuucuauuucc

SEQ ID NO: 253492 - RNA, 18 nt, Human
uuugcaucguauucuggc

SEQ ID NO: 253493 - RNA, 21 nt, Human
aaacugaggucaggcaagaaa

SEQ ID NO: 253494 - RNA, 23 nt, Human
aaaugcaccuaagagggaaacac

SEQ ID NO: 253495 - RNA, 25 nt, Human
acaaggccuuccucccugcaccucu

SEQ ID NO: 253496 - RNA, 20 nt, Human
acagcugggcaugggcugag

SEQ ID NO: 253497 - RNA, 18 nt, Human
accaaguccucuccaucc

SEQ ID NO: 253498 - RNA, 21 nt, Human
accaaguccucuccauccugc

SEQ ID NO: 253499 - RNA, 21 nt, Human
accagguccucccgacguccu

SEQ ID NO: 253500 - RNA, 23 nt, Human
agaaacaaaaauccaccaagucc

SEQ ID NO: 253501 - RNA, 19 nt, Human
agaaaggaggggucagggc

SEQ ID NO: 253502 - RNA, 21 nt, Human
agacaggagagaagggcagga

SEQ ID NO: 253503 - RNA, 23 nt, Human
agaggcguccuggucacugcucc

SEQ ID NO: 253504 - RNA, 19 nt, Human
agcagguauagaaggaggg

SEQ ID NO: 253505 - RNA, 19 nt, Human
agccccgaugacccaccaa

SEQ ID NO: 253506 - RNA, 18 nt, Human
agcgcugccgcggccgcc

SEQ ID NO: 253507 - RNA, 21 nt, Human
aggcaagaaacaaaaauccac

SEQ ID NO: 253508 - RNA, 23 nt, Human
aggcaagaaacaaaaauccacca

SEQ ID NO: 253509 - RNA, 25 nt, Human
aggcaagaaacaaaaauccaccaag

SEQ ID NO: 253510 - RNA, 23 nt, Human
aggcaagagagagguugucccag

SEQ ID NO: 253511 - RNA, 19 nt, Human
aggcggggcggggcggggc

SEQ ID NO: 253512 - RNA, 18 nt, Human
aggcugggcagcacuggg

SEQ ID NO: 253513 - RNA, 22 nt, Human
aggggcgugaccgacagccccg

SEQ ID NO: 253514 - RNA, 27 nt, Human
caacauacccuagaauaguuccccuga

SEQ ID NO: 253515 - RNA, 21 nt, Human
caagaaacaaaaauccaccaa

SEQ ID NO: 253516 - RNA, 22 nt, Human
caagaaacaaaaauccaccaag

SEQ ID NO: 253517 - RNA, 22 nt, Human
caaggaggggcccaggaaggac

SEQ ID NO: 253518 - RNA, 22 nt, Human
cacaaauauguccccuucuccc

SEQ ID NO: 253519 - RNA, 20 nt, Human
cacaugcuccaggagaaagc

SEQ ID NO: 253520 - RNA, 21 nt, Human
caccagguccucccgacgucc

SEQ ID NO: 253521 - RNA, 22 nt, Human
cacugggccagaggcguccugg

SEQ ID NO: 253522 - RNA, 21 nt, Human
cacuuaaaugccacucggaaa

SEQ ID NO: 253523 - RNA, 20 nt, Human
cagacaggagagaagggcag

SEQ ID NO: 253524 - RNA, 23 nt, Human
cagccuuuauuuuagaaaauaau

SEQ ID NO: 253525 - RNA, 23 nt, Human
ccacaaauauguccccuucuccc

SEQ ID NO: 253526 - RNA, 24 nt, Human
ccaccaggcccugacaaggaagcc

SEQ ID NO: 253527 - RNA, 18 nt, Human
ccaccggggagggcaggc

SEQ ID NO: 253528 - RNA, 20 nt, Human
ccauggcguccuggccugug

SEQ ID NO: 253529 - RNA, 24 nt, Human
cccaacaagcccagugccccccac

SEQ ID NO: 253530 - RNA, 20 nt, Human
cccaagcgcugccgcggccg

SEQ ID NO: 253531 - RNA, 23 nt, Human
cccaaguuuucccaggaccccaa

SEQ ID NO: 253532 - RNA, 23 nt, Human
cccaggacccaaguuuucccagg

SEQ ID NO: 253533 - RNA, 20 nt, Human
cccaggaccccaacuucggg

SEQ ID NO: 253534 - RNA, 23 nt, Human
ccccaacaagcccagugcccccc

SEQ ID NO: 253535 - RNA, 23 nt, Human
ccccaacaagcccagugcccccc

SEQ ID NO: 253536 - RNA, 23 nt, Human
ccccgccccccggccggcguccg

SEQ ID NO: 253537 - RNA, 21 nt, Human
ccccgccgcgccccgcccccc

SEQ ID NO: 253538 - RNA, 23 nt, Human
ccccuucucccauaacucagucc

SEQ ID NO: 253539 - RNA, 24 nt, Human
cccgcaguccuagggaugccuccu

SEQ ID NO: 253540 - RNA, 19 nt, Human
cccugggcuugcccggcuc

SEQ ID NO: 253541 - RNA, 21 nt, Human
ccgcaguccuagggaugccuc

SEQ ID NO: 253542 - RNA, 18 nt, Human
ccgccaggcccccuccuc

SEQ ID NO: 253543 - RNA, 24 nt, Human
ccgccaggcccccuccuccuggcc

SEQ ID NO: 253544 - RNA, 18 nt, Human
ccgccgcgccccgccccc

SEQ ID NO: 253545 - RNA, 18 nt, Human
ccgccucgccuuucgacu

SEQ ID NO: 253546 - RNA, 18 nt, Human
ccgcgccccgccccccgg

SEQ ID NO: 253547 - RNA, 23 nt, Human
ccggcguccgccaggcccccucc

SEQ ID NO: 253548 - RNA, 21 nt, Human
ccgggcaacguggcccuuccc

SEQ ID NO: 253549 - RNA, 21 nt, Human
ccucccugcaccucucuccug

SEQ ID NO: 253550 - RNA, 23 nt, Human
ccuccuagagcaacagggagggc

SEQ ID NO: 253551 - RNA, 24 nt, Human
ccugccauggcguccuggccugug

SEQ ID NO: 253552 - RNA, 22 nt, Human
ccuggccccgaacuuggccugc

SEQ ID NO: 253553 - RNA, 22 nt, Human
cgccgcuucucagucaacccag

SEQ ID NO: 253554 - RNA, 22 nt, Human
cgccucgccuuucgacucgcca

SEQ ID NO: 253555 - RNA, 21 nt, Human
cggccgggccgggcaacgugg

SEQ ID NO: 253556 - RNA, 23 nt, Human
cggccgggccgggcaacguggcc

SEQ ID NO: 253557 - RNA, 19 nt, Human
cggcucccuggcgcaaccc

SEQ ID NO: 253558 - RNA, 19 nt, Human
cucuccugacagcugggca

SEQ ID NO: 253559 - RNA, 19 nt, Human
cugcaccucucuccugaca

SEQ ID NO: 253560 - RNA, 26 nt, Human
cugcuaggcugcaaggagagaagggc

SEQ ID NO: 253561 - RNA, 21 nt, Human
gacaggagagaagggcaggag

SEQ ID NO: 253562 - RNA, 24 nt, Human
gagaagggcaggaggcagugagcc

SEQ ID NO: 253563 - RNA, 21 nt, Human
gaggagccugugugucaaacc

SEQ ID NO: 253564 - RNA, 25 nt, Human
gcacaaggccuuccucccugcaccu

SEQ ID NO: 253565 - RNA, 19 nt, Human
gccccgaacuuggccugcu

SEQ ID NO: 253566 - RNA, 18 nt, Human
gccugugaggacaugggg

SEQ ID NO: 253567 - RNA, 19 nt, Human
gcgccggggccggacggcc

SEQ ID NO: 253568 - RNA, 22 nt, Human
gcuuuccggcucccuggcgcaa

SEQ ID NO: 253569 - RNA, 21 nt, Human
ggaccccaacuucgggagucg

SEQ ID NO: 253570 - RNA, 23 nt, Human
ggaggcagccaugcaccaggucc

SEQ ID NO: 253571 - RNA, 21 nt, Human
ggcaagaaacaaaaauccacc

SEQ ID NO: 253572 - RNA, 23 nt, Human
ggcaaggaggggcccaggaagga

SEQ ID NO: 253573 - RNA, 19 nt, Human
ggccgggcaacguggcccu

SEQ ID NO: 253574 - RNA, 23 nt, Human
ggcgccugggagcgggcggggag

SEQ ID NO: 253575 - RNA, 21 nt, Human
gggcaggaggcagugagcccc

SEQ ID NO: 253576 - RNA, 23 nt, Human
ggggagcagguauagaaggaggg

SEQ ID NO: 253577 - RNA, 23 nt, Human
ggggaggcugggcagcacugggc

SEQ ID NO: 253578 - RNA, 21 nt, Human
ggggagggcaggccaggggac

SEQ ID NO: 253579 - RNA, 18 nt, Human
ggucagggagaagggguc

SEQ ID NO: 253580 - RNA, 19 nt, Human
gucuucuaccaagccagca

SEQ ID NO: 253581 - RNA, 18 nt, Human
gucuugcuugcccccuuc

SEQ ID NO: 253582 - RNA, 26 nt, Human
uaaaugcaccuaagagggaaacacag

SEQ ID NO: 253583 - RNA, 18 nt, Human
uaacucaguccccacugg

SEQ ID NO: 253584 - RNA, 25 nt, Human
uauagaaggagggcucgugcccugg

SEQ ID NO: 253585 - RNA, 21 nt, Human
uaucauuuuggccacaaauau

SEQ ID NO: 253586 - RNA, 22 nt, Human
ucacugcuccaccuggucacug

SEQ ID NO: 253587 - RNA, 24 nt, Human
ucaggcaagaaacaaaaauccacc

SEQ ID NO: 253588 - RNA, 19 nt, Human
ucagggagaaggggucugg

SEQ ID NO: 253589 - RNA, 25 nt, Human
uccaccaaguccucuccauccugcc

SEQ ID NO: 253590 - RNA, 23 nt, Human
uccaccaggcccugacaaggaag

SEQ ID NO: 253591 - RNA, 23 nt, Human
ucccaggaccccaacuucgggag

SEQ ID NO: 253592 - RNA, 18 nt, Human
uccgccaggcccccuccu

SEQ ID NO: 253593 - RNA, 20 nt, Human
uccuggccccgaacuuggcc

SEQ ID NO: 253594 - RNA, 27 nt, Human
ucucuccugacagcugggcaugggcug

SEQ ID NO: 253595 - RNA, 22 nt, Human
ucugucuucuaccaagccagca

SEQ ID NO: 253596 - RNA, 19 nt, Human
ugacaaggaagccccuuug

SEQ ID NO: 253597 - RNA, 24 nt, Human
ugacaaggaagccccuuugguuag

SEQ ID NO: 253598 - RNA, 19 nt, Human
ugacagcugggcaugggcu

SEQ ID NO: 253599 - RNA, 23 nt, Human
ugacagcugggcaugggcugagg

SEQ ID NO: 253600 - RNA, 18 nt, Human
ugcagccuggggacugug

SEQ ID NO: 253601 - RNA, 24 nt, Human
ugccaaacucucugcacaugcucc

SEQ ID NO: 253602 - RNA, 24 nt, Human
ugccacucggaaaaaucaaaaaga

SEQ ID NO: 253603 - RNA, 25 nt, Human
ugccauggcguccuggccugugagg

SEQ ID NO: 253604 - RNA, 23 nt, Human
ugcccaggcgcgucccaagcgcu

SEQ ID NO: 253605 - RNA, 27 nt, Human
ugcccggcucccuugcccgcaguccua

SEQ ID NO: 253606 - RNA, 21 nt, Human
ugcccuggcuggaagagccag

SEQ ID NO: 253607 - RNA, 21 nt, Human
uggcaaggaggggcccaggaa

SEQ ID NO: 253608 - RNA, 21 nt, Human
uggcaaggaggggcccaggaa

SEQ ID NO: 253609 - RNA, 18 nt, Human
ugggagcgggcggggagg

SEQ ID NO: 253610 - RNA, 20 nt, Human
ugggagcgggcggggaggcu

SEQ ID NO: 253611 - RNA, 19 nt, Human
ugggauuaggaggcagcca

SEQ ID NO: 253612 - RNA, 24 nt, Human
ugucccagcacaaggccuuccucc

SEQ ID NO: 253613 - RNA, 20 nt, Human
uguggcaaggaggggcccag

SEQ ID NO: 253614 - RNA, 22 nt, Human
uguggcaaggaggggcccagga

SEQ ID NO: 253615 - RNA, 18 nt, Human
uuccccugaucugacucc

SEQ ID NO: 253616 - RNA, 18 nt, Human
uuccucccugcaccucuc

SEQ ID NO: 253617 - RNA, 20 nt, Human
uucuguagcuuccacuuucu

SEQ ID NO: 253618 - RNA, 19 nt, Human
uugcccccuucaacuuucc

SEQ ID NO: 253619 - RNA, 18 nt, Human
uuucagacaauucagccu

SEQ ID NO: 253620 - RNA, 24 nt, Human
aaaaagcucagccgcggucccaac

SEQ ID NO: 253621 - RNA, 22 nt, Human
aaaaccacuguauuucuacauu

SEQ ID NO: 253622 - RNA, 23 nt, Human
aaaagaaaaaaaaaaacaaaacc

SEQ ID NO: 253623 - RNA, 19 nt, Human
aaaccuucaguuuuaaauc

SEQ ID NO: 253624 - RNA, 27 nt, Human
aaagauuaauaaaugcaauuuaaauaa

SEQ ID NO: 253625 - RNA, 24 nt, Human
aaauaaaauuuccccucuucucuc

SEQ ID NO: 253626 - RNA, 21 nt, Human
aacacaauaguacaggaaucu

SEQ ID NO: 253627 - RNA, 29 nt, Human
aacacacucaaaacacaauaguacaggaa

SEQ ID NO: 253628 - RNA, 20 nt, Human
aaggagcagcugcuucugcc

SEQ ID NO: 253629 - RNA, 23 nt, Human
acaauaguacaggaaucuaauac

SEQ ID NO: 253630 - RNA, 19 nt, Human
acaauguuuaaacuuucuu

SEQ ID NO: 253631 - RNA, 21 nt, Human
acaggaaucuaauacugaaaa

SEQ ID NO: 253632 - RNA, 18 nt, Human
acccuacucccaaaauga

SEQ ID NO: 253633 - RNA, 19 nt, Human
acccuacucccaaaaugaa

SEQ ID NO: 253634 - RNA, 22 nt, Human
accugcgccuccagcggcccug

SEQ ID NO: 253635 - RNA, 18 nt, Human
agaaaaaaaaaaacaaaa

SEQ ID NO: 253636 - RNA, 21 nt, Human
agaaaguguguucuaugaagg

SEQ ID NO: 253637 - RNA, 22 nt, Human
agacggccagaacugagcgacg

SEQ ID NO: 253638 - RNA, 18 nt, Human
agcacuaaaagaaaaaaa

SEQ ID NO: 253639 - RNA, 25 nt, Human
agcacuaaaagaaaaaaaaaaacaa

SEQ ID NO: 253640 - RNA, 18 nt, Human
agcagcugcuucugcacg

SEQ ID NO: 253641 - RNA, 19 nt, Human
aucccgggccccggggguc

SEQ ID NO: 253642 - RNA, 20 nt, Human
aucuaauacugaaaaugacu

SEQ ID NO: 253643 - RNA, 20 nt, Human
caaaacacaauaguacagga

SEQ ID NO: 253644 - RNA, 28 nt, Human
caaaacacaauaguacaggaaucuaaua

SEQ ID NO: 253645 - RNA, 18 nt, Human
cacuguauuucuacauug

SEQ ID NO: 253646 - RNA, 21 nt, Human
cagccgcggucccaaccgcac

SEQ ID NO: 253647 - RNA, 20 nt, Human
cagcugcuucugcacggaag

SEQ ID NO: 253648 - RNA, 22 nt, Human
ccaaaacacacucaaaacacaa

SEQ ID NO: 253649 - RNA, 20 nt, Human
ccaaccgcacccuagcuucg

SEQ ID NO: 253650 - RNA, 22 nt, Human
ccacgggucccggaaaaagcuc

SEQ ID NO: 253651 - RNA, 20 nt, Human
ccagcggcccugcguccucu

SEQ ID NO: 253652 - RNA, 19 nt, Human
cccccgcggcugcccucgc

SEQ ID NO: 253653 - RNA, 18 nt, Human
ccccggggguccuggggc

SEQ ID NO: 253654 - RNA, 18 nt, Human
cccgcaacugccccgcgg

SEQ ID NO: 253655 - RNA, 18 nt, Human
cccgcggcugcccucgcu

SEQ ID NO: 253656 - RNA, 22 nt, Human
cccuagcuucguuaccugcgcc

SEQ ID NO: 253657 - RNA, 21 nt, Human
cgccucacuccggcggggacc

SEQ ID NO: 253658 - RNA, 19 nt, Human
cggcugcccucgcuaacuc

SEQ ID NO: 253659 - RNA, 21 nt, Human
cgucuccguccucuccauuca

SEQ ID NO: 253660 - RNA, 25 nt, Human
cuaaaagaaaaaaaaaaacaaaacc

SEQ ID NO: 253661 - RNA, 19 nt, Human
cuacucccaaaaugaaacc

SEQ ID NO: 253662 - RNA, 22 nt, Human
cugcgcuccacacauccucgcc

SEQ ID NO: 253663 - RNA, 19 nt, Human
cuucacugaauuuugguau

SEQ ID NO: 253664 - RNA, 19 nt, Human
cuuguagaaugccuucacc

SEQ ID NO: 253665 - RNA, 25 nt, Human
gaaaguguguucuaugaagguucca

SEQ ID NO: 253666 - RNA, 19 nt, Human
gagcgcaggcgggcgggcg

SEQ ID NO: 253667 - RNA, 24 nt, Human
gcacuaaaagaaaaaaaaaaacaa

SEQ ID NO: 253668 - RNA, 19 nt, Human
gcccucgcuaacucauccc

SEQ ID NO: 253669 - RNA, 18 nt, Human
ggaaaaagcucagccgcg

SEQ ID NO: 253670 - RNA, 20 nt, Human
ggaaaggagcagcugcuucu

SEQ ID NO: 253671 - RNA, 21 nt, Human
ggaaggggcgggcgggcggcg

SEQ ID NO: 253672 - RNA, 21 nt, Human
ggcggcggccgucgccuuggc

SEQ ID NO: 253673 - RNA, 22 nt, Human
gggcggcggccgucgccuuggc

SEQ ID NO: 253674 - RNA, 19 nt, Human
gggcgggcgcggaaaggag

SEQ ID NO: 253675 - RNA, 25 nt, Human
ggucccaaccgcacccuagcuucgu

SEQ ID NO: 253676 - RNA, 25 nt, Human
gucagcacuaaaagaaaaaaaaaaa

SEQ ID NO: 253677 - RNA, 21 nt, Human
guccuggggcccgagaccucu

SEQ ID NO: 253678 - RNA, 19 nt, Human
gucuccagggccgggagcg

SEQ ID NO: 253679 - RNA, 20 nt, Human
uacaauguagcaauaguaaa

SEQ ID NO: 253680 - RNA, 22 nt, Human
uacaggaaucuaauacugaaaa

SEQ ID NO: 253681 - RNA, 18 nt, Human
uagaaugccuucacugaa

SEQ ID NO: 253682 - RNA, 22 nt, Human
uagcagauaacagauugagcuu

SEQ ID NO: 253683 - RNA, 19 nt, Human
uauaaagaguaaacaaaac

SEQ ID NO: 253684 - RNA, 24 nt, Human
uauuaaaauguaaugcuaacucaa

SEQ ID NO: 253685 - RNA, 18 nt, Human
ucaaaacacaauaguaca

SEQ ID NO: 253686 - RNA, 23 nt, Human
ucagcacuaaaagaaaaaaaaaa

SEQ ID NO: 253687 - RNA, 21 nt, Human
ucccaaaaugaaaccuucagu

SEQ ID NO: 253688 - RNA, 28 nt, Human
ucccgggccccggggguccuggggcccc

SEQ ID NO: 253689 - RNA, 21 nt, Human
uccguccucuccauucagcac

SEQ ID NO: 253690 - RNA, 19 nt, Human
uccuggggcccgagaccuc

SEQ ID NO: 253691 - RNA, 23 nt, Human
ucugacaggguguuuaacaaaca

SEQ ID NO: 253692 - RNA, 23 nt, Human
ugaaaacaauguuuaaacuuucu

SEQ ID NO: 253693 - RNA, 21 nt, Human
ugacaggguguuuaacaaaca

SEQ ID NO: 253694 - RNA, 19 nt, Human
uggcccccgcggcugcccu

SEQ ID NO: 253695 - RNA, 18 nt, Human
uguccuguuuggacaaau

SEQ ID NO: 253696 - RNA, 23 nt, Human
uuaauacccuaacaauuucaucg

SEQ ID NO: 253697 - RNA, 21 nt, Human
uucagcaccacgggucccgga

SEQ ID NO: 253698 - RNA, 20 nt, Human
uuugcuguacuuaaaauagg

SEQ ID NO: 253699 - RNA, 19 nt, Human
aaacccuacccccaccccc

SEQ ID NO: 253700 - RNA, 22 nt, Human
aacccuacccccacccccacuc

SEQ ID NO: 253701 - RNA, 22 nt, Human
agcgcggccccggcccggcccc

SEQ ID NO: 253702 - RNA, 23 nt, Human
aggcagcgcggccccggcccggc

SEQ ID NO: 253703 - RNA, 23 nt, Human
auccugccuacccucccccgcua

SEQ ID NO: 253704 - RNA, 25 nt, Human
auccugccuacccucccccgcuacc

SEQ ID NO: 253705 - RNA, 20 nt, Human
caaacccuaucagaucaugc

SEQ ID NO: 253706 - RNA, 22 nt, Human
caaaggccugacccuugauuca

SEQ ID NO: 253707 - RNA, 23 nt, Human
caaggagccggcaggaggcaggg

SEQ ID NO: 253708 - RNA, 24 nt, Human
cacccagacgucacggccugcgcc

SEQ ID NO: 253709 - RNA, 21 nt, Human
cacccccacuccccacccacu

SEQ ID NO: 253710 - RNA, 29 nt, Human
cacuccugguccccucaagaaccaaggag

SEQ ID NO: 253711 - RNA, 22 nt, Human
cacuuccaccccgucccgggga

SEQ ID NO: 253712 - RNA, 22 nt, Human
cagcagcggcggcggcggcucc

SEQ ID NO: 253713 - RNA, 20 nt, Human
cagccucucgccccaucccg

SEQ ID NO: 253714 - RNA, 19 nt, Human
caggcucucuuccccaauc

SEQ ID NO: 253715 - RNA, 21 nt, Human
caggcucucuuccccaauccu

SEQ ID NO: 253716 - RNA, 22 nt, Human
ccacccccacuccccacccacu

SEQ ID NO: 253717 - RNA, 19 nt, Human
ccacuccccacccacuccu

SEQ ID NO: 253718 - RNA, 20 nt, Human
ccacuccccacccacuccug

SEQ ID NO: 253719 - RNA, 30 nt, Human
ccacuccccacccacuccugguccccucaa

SEQ ID NO: 253720 - RNA, 19 nt, Human
ccacuuccaccccgucccg

SEQ ID NO: 253721 - RNA, 21 nt, Human
ccagacgucacggccugcgcc

SEQ ID NO: 253722 - RNA, 20 nt, Human
cccaauccugccuacccucc

SEQ ID NO: 253723 - RNA, 19 nt, Human
cccacacggagcccaaggc

SEQ ID NO: 253724 - RNA, 22 nt, Human
cccacccccacuccccacccac

SEQ ID NO: 253725 - RNA, 24 nt, Human
cccagggaccaccacgcacacucc

SEQ ID NO: 253726 - RNA, 21 nt, Human
ccccacccccacuuccacccc

SEQ ID NO: 253727 - RNA, 19 nt, Human
ccccagaggcugccuggug

SEQ ID NO: 253728 - RNA, 22 nt, Human
cccccacccccacuuccacccc

SEQ ID NO: 253729 - RNA, 23 nt, Human
cccccacuccccacccacuccug

SEQ ID NO: 253730 - RNA, 22 nt, Human
cccccacuuccaccccgucccc

SEQ ID NO: 253731 - RNA, 20 nt, Human
ccccccacccccacuuccac

SEQ ID NO: 253732 - RNA, 20 nt, Human
cccccgggguccccggcggg

SEQ ID NO: 253733 - RNA, 21 nt, Human
ccccgauccccuccccccacc

SEQ ID NO: 253734 - RNA, 23 nt, Human
ccccgauccccuccccccacccc

SEQ ID NO: 253735 - RNA, 24 nt, Human
cccggccccgauccccucccccca

SEQ ID NO: 253736 - RNA, 23 nt, Human
cccggcccggccccgauccgguu

SEQ ID NO: 253737 - RNA, 23 nt, Human
cccuacccccacccccacucccc

SEQ ID NO: 253738 - RNA, 21 nt, Human
cccuccccccacccccacuuc

SEQ ID NO: 253739 - RNA, 22 nt, Human
cccuccccccacccccacuucc

SEQ ID NO: 253740 - RNA, 23 nt, Human
cccucccccgcuacccagggacc

SEQ ID NO: 253741 - RNA, 20 nt, Human
cccugucacaaacccuauca

SEQ ID NO: 253742 - RNA, 18 nt, Human
ccgccgcagccucucgcc

SEQ ID NO: 253743 - RNA, 24 nt, Human
ccuacccccacccccacuccccac

SEQ ID NO: 253744 - RNA, 23 nt, Human
ccuccccccacccccacuuccac

SEQ ID NO: 253745 - RNA, 20 nt, Human
ccucccccgcuacccaggga

SEQ ID NO: 253746 - RNA, 21 nt, Human
ccuggacccaaaugcaucuac

SEQ ID NO: 253747 - RNA, 26 nt, Human
cgcggccccggcccggccccgauccc

SEQ ID NO: 253748 - RNA, 24 nt, Human
cggcagcagcggcggcggcggcuc

SEQ ID NO: 253749 - RNA, 19 nt, Human
cggccugcgcccucuccca

SEQ ID NO: 253750 - RNA, 23 nt, Human
cggcggcagcagcggcggcggcg

SEQ ID NO: 253751 - RNA, 23 nt, Human
cggcggcggcggcuccgcggccc

SEQ ID NO: 253752 - RNA, 20 nt, Human
cuacccccacccccacuccc

SEQ ID NO: 253753 - RNA, 21 nt, Human
cuccccccacccccacuucca

SEQ ID NO: 253754 - RNA, 24 nt, Human
cuccccccacccccacuuccaccc

SEQ ID NO: 253755 - RNA, 20 nt, Human
cuccggcggcagcggcugcg

SEQ ID NO: 253756 - RNA, 19 nt, Human
cucucccaacaggagggau

SEQ ID NO: 253757 - RNA, 22 nt, Human
cucucgccccaucccgggcucc

SEQ ID NO: 253758 - RNA, 23 nt, Human
cugcaggcucucuuccccaaucc

SEQ ID NO: 253759 - RNA, 24 nt, Human
cugcaggcucucuuccccaauccu

SEQ ID NO: 253760 - RNA, 20 nt, Human
cugcgcccucucccaacagg

SEQ ID NO: 253761 - RNA, 21 nt, Human
cuggacccaaaugcaucuacu

SEQ ID NO: 253762 - RNA, 23 nt, Human
cugguccccucaagaaccaagga

SEQ ID NO: 253763 - RNA, 24 nt, Human
gaaacccuacccccacccccacuc

SEQ ID NO: 253764 - RNA, 22 nt, Human
gagcccaaggcccagggaugcc

SEQ ID NO: 253765 - RNA, 19 nt, Human
gauccccuccccccacccc

SEQ ID NO: 253766 - RNA, 23 nt, Human
gauccccuccccccacccccacu

SEQ ID NO: 253767 - RNA, 25 nt, Human
gcagcggcggcggcggcuccgcggc

SEQ ID NO: 253768 - RNA, 27 nt, Human
gcagcggcggcggcggcuccgcggccc

SEQ ID NO: 253769 - RNA, 19 nt, Human
gcagcggcugcggcgggcg

SEQ ID NO: 253770 - RNA, 18 nt, Human
gcaggccggucucccaca

SEQ ID NO: 253771 - RNA, 21 nt, Human
gccccgauccccuccccccac

SEQ ID NO: 253772 - RNA, 22 nt, Human
gccccgauccccuccccccacc

SEQ ID NO: 253773 - RNA, 21 nt, Human
gccccggcccggccccgaucc

SEQ ID NO: 253774 - RNA, 21 nt, Human
gcccggccccgauccccuccc

SEQ ID NO: 253775 - RNA, 28 nt, Human
gcggcagcagcggcggcggcggcuccuu

SEQ ID NO: 253776 - RNA, 19 nt, Human
gcggcagcggcugcggcgg

SEQ ID NO: 253777 - RNA, 21 nt, Human
ggcagcagcggcggcggcggc

SEQ ID NO: 253778 - RNA, 22 nt, Human
ggcagggagauagcgcuagggg

SEQ ID NO: 253779 - RNA, 19 nt, Human
gggcgcccggcaucgcagg

SEQ ID NO: 253780 - RNA, 19 nt, Human
gugggcuuuuucccggccu

SEQ ID NO: 253781 - RNA, 21 nt, Human
uagggaaacccuacccccaau

SEQ ID NO: 253782 - RNA, 20 nt, Human
ucaaaggccugacccuugau

SEQ ID NO: 253783 - RNA, 23 nt, Human
ucacaagggcuucaguagggaaa

SEQ ID NO: 253784 - RNA, 19 nt, Human
ucaguagggaaacccuacc

SEQ ID NO: 253785 - RNA, 19 nt, Human
ucccacacggagcccaagg

SEQ ID NO: 253786 - RNA, 23 nt, Human
ucccggccuggccaccccccaga

SEQ ID NO: 253787 - RNA, 29 nt, Human
ucccgggcuccggcggcagcggcugcggg

SEQ ID NO: 253788 - RNA, 19 nt, Human
uccggcggcagcggcugcg

SEQ ID NO: 253789 - RNA, 24 nt, Human
ucucccacacggagcccaaggccc

SEQ ID NO: 253790 - RNA, 18 nt, Human
ugagauccugcaggcucu

SEQ ID NO: 253791 - RNA, 20 nt, Human
ugagauccugcaggcucucu

SEQ ID NO: 253792 - RNA, 25 nt, Human
ugagauccugcaggcucucuucccc

SEQ ID NO: 253793 - RNA, 23 nt, Human
ugcaucuacuuacagagcccugg

SEQ ID NO: 253794 - RNA, 23 nt, Human
ugccaaauggugggcuuuuuccc

SEQ ID NO: 253795 - RNA, 18 nt, Human
uuccuccuggacccaaau

SEQ ID NO: 253796 - RNA, 26 nt, Human
aaacaaauacaauuauuaugggagau

SEQ ID NO: 253797 - RNA, 26 nt, Human
acaggaaaaaauguguugguuucuca

SEQ ID NO: 253798 - RNA, 23 nt, Human
acccugaaagucaacugaaugca

SEQ ID NO: 253799 - RNA, 24 nt, Human
acuguuuucuuuuuacccugaaag

SEQ ID NO: 253800 - RNA, 28 nt, Human
caaauuuaaagaauguaacaauauguac

SEQ ID NO: 253801 - RNA, 24 nt, Human
cacaggaaaaaauguguugguuuc

SEQ ID NO: 253802 - RNA, 24 nt, Human
ccaaaauaguacaagucauauuaa

SEQ ID NO: 253803 - RNA, 20 nt, Human
ccucaaaaguacccccuuca

SEQ ID NO: 253804 - RNA, 21 nt, Human
gaaagucaacugaaugcagua

SEQ ID NO: 253805 - RNA, 19 nt, Human
gacaaucgucuuaucuaca

SEQ ID NO: 253806 - RNA, 18 nt, Human
uaaaaaaaagauacaugc

SEQ ID NO: 253807 - RNA, 23 nt, Human
uaaaauaagugaaccucaaaagu

SEQ ID NO: 253808 - RNA, 20 nt, Human
uaacaaauucacaggaaaaa

SEQ ID NO: 253809 - RNA, 20 nt, Human
uaagugaaccucaaaaguac

SEQ ID NO: 253810 - RNA, 22 nt, Human
uaagugaaccucaaaaguaccc

SEQ ID NO: 253811 - RNA, 27 nt, Human
uaagugaaccucaaaaguacccccuuc

SEQ ID NO: 253812 - RNA, 21 nt, Human
uacaagucauauuaacaggcu

SEQ ID NO: 253813 - RNA, 23 nt, Human
uacccugaaagucaacugaaugc

SEQ ID NO: 253814 - RNA, 23 nt, Human
ucauuucaccaucacacuggucc

SEQ ID NO: 253815 - RNA, 24 nt, Human
ucuuaucuacaguagacuucacaa

SEQ ID NO: 253816 - RNA, 18 nt, Human
ugaggacagcuuaguuuc

SEQ ID NO: 253817 - RNA, 18 nt, Human
uguguugguuucucagau

SEQ ID NO: 253818 - RNA, 25 nt, Human
uguucaaguagaaauaaaaaaaaga

SEQ ID NO: 253819 - RNA, 20 nt, Human
uuucucaaauuuaaagaaug

SEQ ID NO: 253820 - RNA, 22 nt, Human
aaacggccugacuggggcaggc

SEQ ID NO: 253821 - RNA, 25 nt, Human
aaaugagguugagaaaccggccccu

SEQ ID NO: 253822 - RNA, 22 nt, Human
aacaaccuccugguggcucggu

SEQ ID NO: 253823 - RNA, 18 nt, Human
aacccuuugggcggggcc

SEQ ID NO: 253824 - RNA, 21 nt, Human
accccaggccggcccaagccc

SEQ ID NO: 253825 - RNA, 19 nt, Human
acucuaaaauuacacugac

SEQ ID NO: 253826 - RNA, 21 nt, Human
agaauaaaaaacacagcacau

SEQ ID NO: 253827 - RNA, 20 nt, Human
agcccucuuccaguacucuc

SEQ ID NO: 253828 - RNA, 18 nt, Human
aggcagaacccuuugggc

SEQ ID NO: 253829 - RNA, 18 nt, Human
aggcaucugaaguggaaa

SEQ ID NO: 253830 - RNA, 20 nt, Human
aggcaucugaaguggaaaua

SEQ ID NO: 253831 - RNA, 21 nt, Human
aggccucugccaggcgagucu

SEQ ID NO: 253832 - RNA, 28 nt, Human
aguauaugcauuccaguguucgcgccag

SEQ ID NO: 253833 - RNA, 19 nt, Human
augagggcuguagguggau

SEQ ID NO: 253834 - RNA, 28 nt, Human
caaauguauccaagaauaaaaaacacag

SEQ ID NO: 253835 - RNA, 23 nt, Human
caacagcagcgaggggacuagcu

SEQ ID NO: 253836 - RNA, 23 nt, Human
caagaauaaaaaacacagcacau

SEQ ID NO: 253837 - RNA, 21 nt, Human
cacagagguggggcugcccga

SEQ ID NO: 253838 - RNA, 20 nt, Human
cacaguccacgcagcaggac

SEQ ID NO: 253839 - RNA, 21 nt, Human
cagcaggacgcuccaggccuc

SEQ ID NO: 253840 - RNA, 21 nt, Human
cagcuccuagggccuccgggc

SEQ ID NO: 253841 - RNA, 27 nt, Human
caggccgggugcgaacgguuccgggcc

SEQ ID NO: 253842 - RNA, 24 nt, Human
cagugugggggccgccugccuccu

SEQ ID NO: 253843 - RNA, 20 nt, Human
ccaguguucgcgccagagac

SEQ ID NO: 253844 - RNA, 19 nt, Human
cccaagcccgacgccaggc

SEQ ID NO: 253845 - RNA, 18 nt, Human
cccaggcaugagggcugu

SEQ ID NO: 253846 - RNA, 21 nt, Human
cccaggccggcccaagcccga

SEQ ID NO: 253847 - RNA, 20 nt, Human
ccccaggccggcccaagccc

SEQ ID NO: 253848 - RNA, 23 nt, Human
ccccaggccggcccaagcccgac

SEQ ID NO: 253849 - RNA, 18 nt, Human
ccuccgcggcccggcggg

SEQ ID NO: 253850 - RNA, 23 nt, Human
ccuccgggccagcggcggacccc

SEQ ID NO: 253851 - RNA, 21 nt, Human
ccucugccaggcgagucucug

SEQ ID NO: 253852 - RNA, 18 nt, Human
ccugugcugcgccugggg

SEQ ID NO: 253853 - RNA, 21 nt, Human
ccugugucucuggagaccugu

SEQ ID NO: 253854 - RNA, 23 nt, Human
cgcagcaggacgcuccaggccuc

SEQ ID NO: 253855 - RNA, 24 nt, Human
cgcccaaguaaaagcucuucuaaa

SEQ ID NO: 253856 - RNA, 22 nt, Human
cgcggcgggcgcccgcggggcc

SEQ ID NO: 253857 - RNA, 21 nt, Human
cggcccggcgggcgggggcag

SEQ ID NO: 253858 - RNA, 19 nt, Human
cggcgggcgcccgcggggc

SEQ ID NO: 253859 - RNA, 23 nt, Human
cgugaaaaaaucaaauguaucca

SEQ ID NO: 253860 - RNA, 23 nt, Human
cucacuucauugcucaggugagc

SEQ ID NO: 253861 - RNA, 24 nt, Human
cugcucaaggacagucaacagcag

SEQ ID NO: 253862 - RNA, 23 nt, Human
gaaaaccaggggaauuagcccuc

SEQ ID NO: 253863 - RNA, 22 nt, Human
gaacagccucagacugaauccg

SEQ ID NO: 253864 - RNA, 20 nt, Human
gaaccuccagcugggcccag

SEQ ID NO: 253865 - RNA, 21 nt, Human
gaccagugagcaagaaugaga

SEQ ID NO: 253866 - RNA, 20 nt, Human
gagaaaaccaggggaauuag

SEQ ID NO: 253867 - RNA, 19 nt, Human
gcagcgaggggacuagcuc

SEQ ID NO: 253868 - RNA, 19 nt, Human
gccccgggggguggcugcu

SEQ ID NO: 253869 - RNA, 25 nt, Human
gcccucuuccaguacucucccccac

SEQ ID NO: 253870 - RNA, 21 nt, Human
gcgcggcgggcgcccgcgggg

SEQ ID NO: 253871 - RNA, 19 nt, Human
gcggaccccaggccggccc

SEQ ID NO: 253872 - RNA, 21 nt, Human
gcggcgggcgcccgcggggcc

SEQ ID NO: 253873 - RNA, 20 nt, Human
gcgggcgggggcagcaccag

SEQ ID NO: 253874 - RNA, 22 nt, Human
gcucaggugagcaaaugagguu

SEQ ID NO: 253875 - RNA, 19 nt, Human
ggaccccaggccggcccaa

SEQ ID NO: 253876 - RNA, 26 nt, Human
ggacggcagugacgacacccccagaa

SEQ ID NO: 253877 - RNA, 21 nt, Human
ggacuuacgugaaaaaaucaa

SEQ ID NO: 253878 - RNA, 20 nt, Human
ggcaggccgggugcgaacgg

SEQ ID NO: 253879 - RNA, 21 nt, Human
ggccucugccaggcgagucuc

SEQ ID NO: 253880 - RNA, 30 nt, Human
gggcaggccgggugcgaacgguuccgggcc

SEQ ID NO: 253881 - RNA, 20 nt, Human
ggggcagcaccagcuccuag

SEQ ID NO: 253882 - RNA, 23 nt, Human
gggggcagcaccagcuccuaggg

SEQ ID NO: 253883 - RNA, 25 nt, Human
gggggguggcugcugcaguuccagg

SEQ ID NO: 253884 - RNA, 21 nt, Human
gguccgcaugccaccccaggg

SEQ ID NO: 253885 - RNA, 21 nt, Human
gguggauggggcagcacagag

SEQ ID NO: 253886 - RNA, 20 nt, Human
gguggcugcugcaguuccag

SEQ ID NO: 253887 - RNA, 18 nt, Human
uaaaaaacacagcacaua

SEQ ID NO: 253888 - RNA, 20 nt, Human
uaaaaaacacagcacauaaa

SEQ ID NO: 253889 - RNA, 21 nt, Human
uaaaaaacacagcacauaaag

SEQ ID NO: 253890 - RNA, 23 nt, Human
uaaaaaacacagcacauaaagua

SEQ ID NO: 253891 - RNA, 21 nt, Human
uacacugacacuaaugcucau

SEQ ID NO: 253892 - RNA, 19 nt, Human
ucaggcacagugugggggc

SEQ ID NO: 253893 - RNA, 21 nt, Human
ucggugcccacaguccacgca

SEQ ID NO: 253894 - RNA, 21 nt, Human
ugaaguggaaauacgauuucc

SEQ ID NO: 253895 - RNA, 22 nt, Human
ugagcaaaugagguugagaaac

SEQ ID NO: 253896 - RNA, 19 nt, Human
uggauggggcagcacagag

SEQ ID NO: 253897 - RNA, 23 nt, Human
uggccuccaaagcccacucuugc

SEQ ID NO: 253898 - RNA, 21 nt, Human
ugggcggggccguaucuggcc

SEQ ID NO: 253899 - RNA, 18 nt, Human
uggggcacccugaagggu

SEQ ID NO: 253900 - RNA, 19 nt, Human
uggggcugcucaaggacag

SEQ ID NO: 253901 - RNA, 22 nt, Human
uggugccugugucucuggagac

SEQ ID NO: 253902 - RNA, 19 nt, Human
ugugggggccgccugccuc

SEQ ID NO: 253903 - RNA, 21 nt, Human
aaaaauuuuuaaaacagggaa

SEQ ID NO: 253904 - RNA, 22 nt, Human
aaaagcaauaaaaaauauguaa

SEQ ID NO: 253905 - RNA, 18 nt, Human
aaaaugucaacucuuaaa

SEQ ID NO: 253906 - RNA, 21 nt, Human
aaaugguuaccagcaugccca

SEQ ID NO: 253907 - RNA, 23 nt, Human
aacacccaccacaaugccuauua

SEQ ID NO: 253908 - RNA, 25 nt, Human
aacauucucugacaauggaauacua

SEQ ID NO: 253909 - RNA, 21 nt, Human
aagcugaggggaaaucuggcu

SEQ ID NO: 253910 - RNA, 24 nt, Human
acaauacagcaaaauaaaccagaa

SEQ ID NO: 253911 - RNA, 18 nt, Human
accccagcucuaguccca

SEQ ID NO: 253912 - RNA, 21 nt, Human
agagaggggggugaggaggga

SEQ ID NO: 253913 - RNA, 22 nt, Human
agaggggggugaggagggagug

SEQ ID NO: 253914 - RNA, 24 nt, Human
agcaacagggauauacccgaagga

SEQ ID NO: 253915 - RNA, 21 nt, Human
aggagagaggggggugaggga

SEQ ID NO: 253916 - RNA, 20 nt, Human
agggguggggaggagagagg

SEQ ID NO: 253917 - RNA, 21 nt, Human
agggguggggaggagagaggg

SEQ ID NO: 253918 - RNA, 21 nt, Human
auaaaccagaagccauguuuu

SEQ ID NO: 253919 - RNA, 21 nt, Human
aucauccucacucccccaaca

SEQ ID NO: 253920 - RNA, 23 nt, Human
aucuaccucuuaacagagaaggu

SEQ ID NO: 253921 - RNA, 19 nt, Human
aucuaggcauggcccaggg

SEQ ID NO: 253922 - RNA, 27 nt, Human
aucuuaugauucaggaacuguaagcug

SEQ ID NO: 253923 - RNA, 22 nt, Human
augcacacucauguuucagagc

SEQ ID NO: 253924 - RNA, 25 nt, Human
augcagaagcuaaaaaguugcuauc

SEQ ID NO: 253925 - RNA, 19 nt, Human
caacacccaccacaaugcc

SEQ ID NO: 253926 - RNA, 21 nt, Human
caauaccagucagcuuacgaa

SEQ ID NO: 253927 - RNA, 20 nt, Human
cacaauacagcaaaauaaac

SEQ ID NO: 253928 - RNA, 23 nt, Human
caccccucucccacuacguaccu

SEQ ID NO: 253929 - RNA, 30 nt, Human
caccccuucagccagaguccugggcccaaa

SEQ ID NO: 253930 - RNA, 18 nt, Human
cacuacguaccugcuggu

SEQ ID NO: 253931 - RNA, 19 nt, Human
cacugaaucagcaacugag

SEQ ID NO: 253932 - RNA, 23 nt, Human
cagaaaaagagagagaaauccug

SEQ ID NO: 253933 - RNA, 27 nt, Human
cagaaaggcaacuaccguacaaucuca

SEQ ID NO: 253934 - RNA, 25 nt, Human
cagaccccagcucuagucccaccac

SEQ ID NO: 253935 - RNA, 23 nt, Human
cagagcccuugaccaggcagccu

SEQ ID NO: 253936 - RNA, 22 nt, Human
cagcaaaaacggggagggugga

SEQ ID NO: 253937 - RNA, 18 nt, Human
cagccagaguccugggcc

SEQ ID NO: 253938 - RNA, 22 nt, Human
cagccagauccuaucuaaugcc

SEQ ID NO: 253939 - RNA, 21 nt, Human
cagccuggaccaaauucaaaa

SEQ ID NO: 253940 - RNA, 22 nt, Human
caggcacagaaaggcaacuacc

SEQ ID NO: 253941 - RNA, 20 nt, Human
cagggauauacccgaaggac

SEQ ID NO: 253942 - RNA, 24 nt, Human
cagggguggggaggagagaggggg

SEQ ID NO: 253943 - RNA, 23 nt, Human
caguguuccccaaaugugguccc

SEQ ID NO: 253944 - RNA, 20 nt, Human
caucauccucacucccccaa

SEQ ID NO: 253945 - RNA, 19 nt, Human
caugaggaaaagguacacc

SEQ ID NO: 253946 - RNA, 22 nt, Human
caugaggaaaagguacaccuca

SEQ ID NO: 253947 - RNA, 19 nt, Human
cauugccuaucaacagagu

SEQ ID NO: 253948 - RNA, 19 nt, Human
ccacacccacugaaucagc

SEQ ID NO: 253949 - RNA, 21 nt, Human
ccaccugccucagaccauuuc

SEQ ID NO: 253950 - RNA, 24 nt, Human
ccacuacguaccugcuggucugcu

SEQ ID NO: 253951 - RNA, 20 nt, Human
ccagaaaaagagagagaaau

SEQ ID NO: 253952 - RNA, 19 nt, Human
ccagcacagaccaggccac

SEQ ID NO: 253953 - RNA, 24 nt, Human
ccagcagcauggugcagggcugag

SEQ ID NO: 253954 - RNA, 24 nt, Human
ccaugaggcaaaaugagacauuaa

SEQ ID NO: 253955 - RNA, 21 nt, Human
ccaugccccaccuucccuaca

SEQ ID NO: 253956 - RNA, 20 nt, Human
cccaaauguggucccaauca

SEQ ID NO: 253957 - RNA, 23 nt, Human
cccagggcuccagccugcagugu

SEQ ID NO: 253958 - RNA, 19 nt, Human
ccccacccacacccacuga

SEQ ID NO: 253959 - RNA, 21 nt, Human
ccccagggcuccagccugcag

SEQ ID NO: 253960 - RNA, 18 nt, Human
ccugagaggcuuccccuu

SEQ ID NO: 253961 - RNA, 20 nt, Human
ccugagaggcuuccccuucu

SEQ ID NO: 253962 - RNA, 21 nt, Human
cgaucccuuauaagagacuaa

SEQ ID NO: 253963 - RNA, 21 nt, Human
cucugccccaucacaccccuc

SEQ ID NO: 253964 - RNA, 20 nt, Human
cugcaguguuccuuuccuag

SEQ ID NO: 253965 - RNA, 22 nt, Human
cugcuggucugcucauuaccau

SEQ ID NO: 253966 - RNA, 19 nt, Human
cuucacucggcugcuccuc

SEQ ID NO: 253967 - RNA, 18 nt, Human
gaaaugugaauucucagg

SEQ ID NO: 253968 - RNA, 23 nt, Human
gaaguuuguuuugcaaggugggg

SEQ ID NO: 253969 - RNA, 24 nt, Human
gaccaguguuccccaaaugugguc

SEQ ID NO: 253970 - RNA, 19 nt, Human
gagaagaauuagccaagug

SEQ ID NO: 253971 - RNA, 18 nt, Human
gagaggggggugaggagg

SEQ ID NO: 253972 - RNA, 24 nt, Human
gcagcaacagggauauacccgaag

SEQ ID NO: 253973 - RNA, 21 nt, Human
gcauggccagcuuuucaccau

SEQ ID NO: 253974 - RNA, 19 nt, Human
gccacugucuuccccagca

SEQ ID NO: 253975 - RNA, 19 nt, Human
gccccacccacacccacug

SEQ ID NO: 253976 - RNA, 21 nt, Human
gccuguuuguauauggcagag

SEQ ID NO: 253977 - RNA, 21 nt, Human
gcuaggcaacaagaagcuaag

SEQ ID NO: 253978 - RNA, 23 nt, Human
ggaaaugugaauucucaggcccc

SEQ ID NO: 253979 - RNA, 23 nt, Human
ggaggagagaggggggugaggag

SEQ ID NO: 253980 - RNA, 23 nt, Human
ggcccaaaagaaaaugguagcag

SEQ ID NO: 253981 - RNA, 23 nt, Human
gggaagugugcgucugaccuucg

SEQ ID NO: 253982 - RNA, 18 nt, Human
ggggugaggagggagugg

SEQ ID NO: 253983 - RNA, 23 nt, Human
ggguggggaggagagaggggggu

SEQ ID NO: 253984 - RNA, 21 nt, Human
gguggggaggagagagggggg

SEQ ID NO: 253985 - RNA, 22 nt, Human
gguugccuuuccucacuuccau

SEQ ID NO: 253986 - RNA, 24 nt, Human
gucugccucuuacuguuuucccau

SEQ ID NO: 253987 - RNA, 23 nt, Human
uaaaaugaggcucaaccucuguc

SEQ ID NO: 253988 - RNA, 19 nt, Human
uaaaaugucaacucuuaaa

SEQ ID NO: 253989 - RNA, 24 nt, Human
uaaguuccucugccccaucacacc

SEQ ID NO: 253990 - RNA, 18 nt, Human
uaauuugaucauuucaca

SEQ ID NO: 253991 - RNA, 25 nt, Human
uaccucuaaguaaaaugucaacucu

SEQ ID NO: 253992 - RNA, 23 nt, Human
uaggugcaccagcacagagaaga

SEQ ID NO: 253993 - RNA, 23 nt, Human
uauuaaaccaugccccaccuucc

SEQ ID NO: 253994 - RNA, 24 nt, Human
ucaacacccaccacaaugccuauu

SEQ ID NO: 253995 - RNA, 20 nt, Human
ucaaccagaaaaagagagag

SEQ ID NO: 253996 - RNA, 25 nt, Human
ucaaccagaaaaagagagagaaauc

SEQ ID NO: 253997 - RNA, 19 nt, Human
ucacaccccucucccacua

SEQ ID NO: 253998 - RNA, 18 nt, Human
ucacugaauccucagaag

SEQ ID NO: 253999 - RNA, 23 nt, Human
uccagccuggaccaaauucaaaa

SEQ ID NO: 254000 - RNA, 21 nt, Human
uccauucugaugugaaggagg

SEQ ID NO: 254001 - RNA, 23 nt, Human
uccccaaauguggucccaaucag

SEQ ID NO: 254002 - RNA, 21 nt, Human
ucugccucuuacuguuuuccc

SEQ ID NO: 254003 - RNA, 26 nt, Human
ucugcuggucucacucuggcuccugu

SEQ ID NO: 254004 - RNA, 24 nt, Human
ucuggcaaggacuagaacaugcaa

SEQ ID NO: 254005 - RNA, 21 nt, Human
ucuucacucggcugcuccucc

SEQ ID NO: 254006 - RNA, 18 nt, Human
ugaaaagcaauaaaaaau

SEQ ID NO: 254007 - RNA, 23 nt, Human
ugaaaagcaauaaaaaauaugua

SEQ ID NO: 254008 - RNA, 21 nt, Human
ugaugugaaggaggagaagaa

SEQ ID NO: 254009 - RNA, 25 nt, Human
ugcacagcgaggugacuaugguuaa

SEQ ID NO: 254010 - RNA, 24 nt, Human
ugcagccagauccuaucuaaugcc

SEQ ID NO: 254011 - RNA, 21 nt, Human
ugcaugcuguagcacaagaaa

SEQ ID NO: 254012 - RNA, 19 nt, Human
ugccacucaagggagagcu

SEQ ID NO: 254013 - RNA, 23 nt, Human
ugccccaucacaccccucuccca

SEQ ID NO: 254014 - RNA, 19 nt, Human
ugcucauuaccauaaaccc

SEQ ID NO: 254015 - RNA, 18 nt, Human
uggcaaaggucagccagc

SEQ ID NO: 254016 - RNA, 18 nt, Human
uggcggaaugucagcaaa

SEQ ID NO: 254017 - RNA, 20 nt, Human
uggcuaggcaacaagaagcu

SEQ ID NO: 254018 - RNA, 19 nt, Human
uggggaggagacagaagga

SEQ ID NO: 254019 - RNA, 21 nt, Human
uggggguaacuagacaaagaa

SEQ ID NO: 254020 - RNA, 20 nt, Human
uggucucacucuggcuccug

SEQ ID NO: 254021 - RNA, 21 nt, Human
uggugaggugagcaagaaagu

SEQ ID NO: 254022 - RNA, 25 nt, Human
ugguggggcuguuccagccuggggc

SEQ ID NO: 254023 - RNA, 19 nt, Human
ugugccuguaacuuaagcu

SEQ ID NO: 254024 - RNA, 20 nt, Human
ugugccuguaacuuaagcuu

SEQ ID NO: 254025 - RNA, 22 nt, Human
uuaaaccaugccccaccuuccc

SEQ ID NO: 254026 - RNA, 18 nt, Human
uuauaaauucuagcuaua

SEQ ID NO: 254027 - RNA, 18 nt, Human
uucaccuguccuuggcuc

SEQ ID NO: 254028 - RNA, 18 nt, Human
uucacucccaccaugagg

SEQ ID NO: 254029 - RNA, 18 nt, Human
uuccagccuggaccaaau

SEQ ID NO: 254030 - RNA, 24 nt, Human
uuccccagcagcauggugcagggc

SEQ ID NO: 254031 - RNA, 21 nt, Human
uucuaaaagagacaauuuuaa

SEQ ID NO: 254032 - RNA, 20 nt, Human
uucucaggccccacccacac

SEQ ID NO: 254033 - RNA, 25 nt, Human
uucucugacaauggaauacuauuca

SEQ ID NO: 254034 - RNA, 24 nt, Human
uuggcaaaggucagccagcuaugu

SEQ ID NO: 254035 - RNA, 21 nt, Human
uuucagagcccuugaccaggc

SEQ ID NO: 254036 - RNA, 18 nt, Human
aaaaacaaccccaaaccc

SEQ ID NO: 254037 - RNA, 21 nt, Human
aaaaacaaccccaaacccaaa

SEQ ID NO: 254038 - RNA, 23 nt, Human
aaaaacaaccccaaacccaaaga

SEQ ID NO: 254039 - RNA, 23 nt, Human
aaaaagaacaaaaacaaccccaa

SEQ ID NO: 254040 - RNA, 24 nt, Human
aaaaagaacaaaaacaaccccaaa

SEQ ID NO: 254041 - RNA, 22 nt, Human
aaaaagcagaauaacugcccca

SEQ ID NO: 254042 - RNA, 19 nt, Human
aaaaagcagaauaacuggu

SEQ ID NO: 254043 - RNA, 20 nt, Human
aaaagaacaaaaacaacccc

SEQ ID NO: 254044 - RNA, 23 nt, Human
aaaagaacaaaaacaaccccaaa

SEQ ID NO: 254045 - RNA, 25 nt, Human
aaaagccaagauaaaaccaaaagca

SEQ ID NO: 254046 - RNA, 22 nt, Human
aaacaaaugcacauuugucccu

SEQ ID NO: 254047 - RNA, 22 nt, Human
aaacaaccccaaacccaaagac

SEQ ID NO: 254048 - RNA, 19 nt, Human
aaacaacugaccugagggc

SEQ ID NO: 254049 - RNA, 24 nt, Human
aaacaguaaacacaaaggauaguc

SEQ ID NO: 254050 - RNA, 26 nt, Human
aaaccaaaagcaaacuugcuaaaaaa

SEQ ID NO: 254051 - RNA, 25 nt, Human
aaagaacaaaaacaaccccaaaccc

SEQ ID NO: 254052 - RNA, 19 nt, Human
aaagcagaauaacugcccc

SEQ ID NO: 254053 - RNA, 21 nt, Human
aaauccuccaaacaaaaugcc

SEQ ID NO: 254054 - RNA, 20 nt, Human
aaaugcuagaauuguccacu

SEQ ID NO: 254055 - RNA, 19 nt, Human
aacaaaaacaaccccaaac

SEQ ID NO: 254056 - RNA, 22 nt, Human
aacaaaaacaaccccaaaccca

SEQ ID NO: 254057 - RNA, 24 nt, Human
aacaaaaacaaccccaaacccaaa

SEQ ID NO: 254058 - RNA, 25 nt, Human
aacaaaaacaaccccaaacccaaag

SEQ ID NO: 254059 - RNA, 24 nt, Human
aacaaccccaaacccaaagacaaa

SEQ ID NO: 254060 - RNA, 18 nt, Human
aaccaaggaagaugacag

SEQ ID NO: 254061 - RNA, 22 nt, Human
aacccaaagacaaaaguaaaga

SEQ ID NO: 254062 - RNA, 18 nt, Human
aaccuucucuccuuucuu

SEQ ID NO: 254063 - RNA, 25 nt, Human
aacgcaaccacacuggaugcagaaa

SEQ ID NO: 254064 - RNA, 22 nt, Human
aacucugaaauccuccaaacaa

SEQ ID NO: 254065 - RNA, 18 nt, Human
aagacaaaaguaaagaaa

SEQ ID NO: 254066 - RNA, 23 nt, Human
aagcggagagcgaggcugugacc

SEQ ID NO: 254067 - RNA, 24 nt, Human
aagugccauucugaaccaacaccc

SEQ ID NO: 254068 - RNA, 18 nt, Human
aaucagccagccaugaug

SEQ ID NO: 254069 - RNA, 19 nt, Human
acaaaaacaaccccaaacc

SEQ ID NO: 254070 - RNA, 22 nt, Human
acaaaaacaaccccaaacccaa

SEQ ID NO: 254071 - RNA, 24 nt, Human
acaaaaacaaccccaaacccaaag

SEQ ID NO: 254072 - RNA, 19 nt, Human
accccaaacccaaagacaa

SEQ ID NO: 254073 - RNA, 23 nt, Human
acccugacacuucugaaacccac

SEQ ID NO: 254074 - RNA, 24 nt, Human
accuaaaaaccuucucuccuuucu

SEQ ID NO: 254075 - RNA, 19 nt, Human
acuacauuuauugaagacu

SEQ ID NO: 254076 - RNA, 20 nt, Human
acugaggaaaacucagcuga

SEQ ID NO: 254077 - RNA, 23 nt, Human
agacaaaaguaaagaaaagggac

SEQ ID NO: 254078 - RNA, 20 nt, Human
agacaaaaguaaagaaaauc

SEQ ID NO: 254079 - RNA, 22 nt, Human
agacaaaaguaaagaaaaucca

SEQ ID NO: 254080 - RNA, 19 nt, Human
agacggccaaggguccugu

SEQ ID NO: 254081 - RNA, 24 nt, Human
agcaaacuugcuaaaaaauccuga

SEQ ID NO: 254082 - RNA, 23 nt, Human
agccaugaugaaaaaaugagucc

SEQ ID NO: 254083 - RNA, 18 nt, Human
agccccgagcucucccuc

SEQ ID NO: 254084 - RNA, 18 nt, Human
aggguccuguccucguuc

SEQ ID NO: 254085 - RNA, 20 nt, Human
agugcauacucaaaggcuuu

SEQ ID NO: 254086 - RNA, 18 nt, Human
augcaagaauuaaagacu

SEQ ID NO: 254087 - RNA, 26 nt, Human
augccacaaccaucccacuuggaauu

SEQ ID NO: 254088 - RNA, 21 nt, Human
caaaaacaaccccaaacccaa

SEQ ID NO: 254089 - RNA, 23 nt, Human
caaaaacaaccccaaacccaaag

SEQ ID NO: 254090 - RNA, 24 nt, Human
caaaaacaaccccaaacccaaaga

SEQ ID NO: 254091 - RNA, 25 nt, Human
caaaaacaaccccaaacccaaagac

SEQ ID NO: 254092 - RNA, 24 nt, Human
caaaaacaguaaacacaaaggaua

SEQ ID NO: 254093 - RNA, 21 nt, Human
caaaaaggaagcccacaucuc

SEQ ID NO: 254094 - RNA, 25 nt, Human
caaaaguaaagaaaauccacuuuuc

SEQ ID NO: 254095 - RNA, 26 nt, Human
caaaaugcuagaauuguccacuagug

SEQ ID NO: 254096 - RNA, 23 nt, Human
caaacaaaugcacauuugucccu

SEQ ID NO: 254097 - RNA, 21 nt, Human
caaacccaaagacaaaaguaa

SEQ ID NO: 254098 - RNA, 24 nt, Human
caaacccaaagacaaaaguaaaga

SEQ ID NO: 254099 - RNA, 23 nt, Human
caaagcccacaaugguggaguuc

SEQ ID NO: 254100 - RNA, 22 nt, Human
caacaugauuacuaaaagccaa

SEQ ID NO: 254101 - RNA, 23 nt, Human
caacauuucacaugcugaccuaa

SEQ ID NO: 254102 - RNA, 25 nt, Human
caagauaaaaccaaaagcaaacuug

SEQ ID NO: 254103 - RNA, 26 nt, Human
caauaaaaauguaauuccaaccuuaa

SEQ ID NO: 254104 - RNA, 21 nt, Human
caauaaaccaaggaagaugac

SEQ ID NO: 254105 - RNA, 19 nt, Human
cacaagacucaaaaaggaa

SEQ ID NO: 254106 - RNA, 19 nt, Human
caccugugaccagaccagc

SEQ ID NO: 254107 - RNA, 21 nt, Human
cacggcuuuacaaaaagcaga

SEQ ID NO: 254108 - RNA, 26 nt, Human
cacucagcucaaaguuaaacagcuga

SEQ ID NO: 254109 - RNA, 18 nt, Human
cacuuggaaucacuccac

SEQ ID NO: 254110 - RNA, 18 nt, Human
cagaaucuaaauuaaaau

SEQ ID NO: 254111 - RNA, 18 nt, Human
cagccaugaugaaaaaau

SEQ ID NO: 254112 - RNA, 18 nt, Human
cagcucaaaguuaaacag

SEQ ID NO: 254113 - RNA, 23 nt, Human
caggaaauagcauagcacuucau

SEQ ID NO: 254114 - RNA, 18 nt, Human
caucccacuuggaaucac

SEQ ID NO: 254115 - RNA, 21 nt, Human
caucccacuuggaaucacucc

SEQ ID NO: 254116 - RNA, 19 nt, Human
caugcaagaauuaaagacu

SEQ ID NO: 254117 - RNA, 21 nt, Human
cauuacaggagacaauuggcc

SEQ ID NO: 254118 - RNA, 22 nt, Human
ccaaaagcaaacuugcuaaaaa

SEQ ID NO: 254119 - RNA, 23 nt, Human
ccaaacccaaagacaaaaguaaa

SEQ ID NO: 254120 - RNA, 22 nt, Human
ccaaagacaaaaguaaagaaaa

SEQ ID NO: 254121 - RNA, 25 nt, Human
ccaagugugcgccccuccggcuccu

SEQ ID NO: 254122 - RNA, 18 nt, Human
ccacaaccaucccacuug

SEQ ID NO: 254123 - RNA, 24 nt, Human
ccagaaguaacugcacuuuucaac

SEQ ID NO: 254124 - RNA, 20 nt, Human
cccaaacccaaagacaaaag

SEQ ID NO: 254125 - RNA, 26 nt, Human
cccccggccgcugccaccucugcggg

SEQ ID NO: 254126 - RNA, 18 nt, Human
ccccgagcucucccucug

SEQ ID NO: 254127 - RNA, 23 nt, Human
ccccucuccccucacucagcuca

SEQ ID NO: 254128 - RNA, 21 nt, Human
ccccucuguccuucccccucc

SEQ ID NO: 254129 - RNA, 24 nt, Human
cccucuccccucacucagcucaaa

SEQ ID NO: 254130 - RNA, 23 nt, Human
cccuguauaagcccauguaaaag

SEQ ID NO: 254131 - RNA, 22 nt, Human
cccuuaaaaacacagaaucuaa

SEQ ID NO: 254132 - RNA, 19 nt, Human
ccgcugccaccucugcggg

SEQ ID NO: 254133 - RNA, 19 nt, Human
ccuccaagccccgagcucu

SEQ ID NO: 254134 - RNA, 18 nt, Human
ccuccggcuccuuccccu

SEQ ID NO: 254135 - RNA, 19 nt, Human
ccucguucucugccucugc

SEQ ID NO: 254136 - RNA, 18 nt, Human
ccugcccccggccgcugc

SEQ ID NO: 254137 - RNA, 18 nt, Human
ccugugaccagaccagcc

SEQ ID NO: 254138 - RNA, 21 nt, Human
cgcagggacccgaaugcccgg

SEQ ID NO: 254139 - RNA, 18 nt, Human
cggccgcugccaccucug

SEQ ID NO: 254140 - RNA, 19 nt, Human
cggcuccuuccccuccccc

SEQ ID NO: 254141 - RNA, 22 nt, Human
cggcuuuacaaaaagcagaauc

SEQ ID NO: 254142 - RNA, 21 nt, Human
cuaaaaaccuucucuccuuuc

SEQ ID NO: 254143 - RNA, 21 nt, Human
cuaaaagccaagauaaaacca

SEQ ID NO: 254144 - RNA, 22 nt, Human
cuaacacaagacucaaaaagga

SEQ ID NO: 254145 - RNA, 19 nt, Human
cuaaugccacaaccauccc

SEQ ID NO: 254146 - RNA, 23 nt, Human
cuccacccugacacuucugaaac

SEQ ID NO: 254147 - RNA, 23 nt, Human
cucuccccucacucagcucaaag

SEQ ID NO: 254148 - RNA, 19 nt, Human
cucuccuuucuucucaccu

SEQ ID NO: 254149 - RNA, 20 nt, Human
cucugccucugcugcccucc

SEQ ID NO: 254150 - RNA, 19 nt, Human
cugaacccuaccugacaug

SEQ ID NO: 254151 - RNA, 19 nt, Human
cugccccaaauugaaauua

SEQ ID NO: 254152 - RNA, 20 nt, Human
cugugaccagaccagccaac

SEQ ID NO: 254153 - RNA, 19 nt, Human
cuuaaacuaaugccacaac

SEQ ID NO: 254154 - RNA, 21 nt, Human
cuuuaccccucuccccucacu

SEQ ID NO: 254155 - RNA, 18 nt, Human
cuuuagggcucucucaaa

SEQ ID NO: 254156 - RNA, 20 nt, Human
gaacaaaaacaaccccaaac

SEQ ID NO: 254157 - RNA, 20 nt, Human
gaacccuuaaaaacacagaa

SEQ ID NO: 254158 - RNA, 20 nt, Human
gaagcuuucacaauccgguu

SEQ ID NO: 254159 - RNA, 19 nt, Human
gcaaaugggaccaaucagu

SEQ ID NO: 254160 - RNA, 21 nt, Human
gcccacaaugguggaguucug

SEQ ID NO: 254161 - RNA, 19 nt, Human
gcggcaccggcgcgagccc

SEQ ID NO: 254162 - RNA, 19 nt, Human
gcuuugguuggaagucacu

SEQ ID NO: 254163 - RNA, 21 nt, Human
ggccaaggguccuguccucgu

SEQ ID NO: 254164 - RNA, 21 nt, Human
gggcggcggcaccggcgcgag

SEQ ID NO: 254165 - RNA, 20 nt, Human
uaaaaaauccugaauuccau

SEQ ID NO: 254166 - RNA, 21 nt, Human
uaaaaccaaaagcaaacuugc

SEQ ID NO: 254167 - RNA, 20 nt, Human
uaaaacuucaaaaagaacaa

SEQ ID NO: 254168 - RNA, 19 nt, Human
uaaaagccaagauaaaacc

SEQ ID NO: 254169 - RNA, 24 nt, Human
uaaaagccaagauaaaaccaaaag

SEQ ID NO: 254170 - RNA, 25 nt, Human
uaaaaggucucagcaccuaacacaa

SEQ ID NO: 254171 - RNA, 20 nt, Human
uaaacaacugaccugagggc

SEQ ID NO: 254172 - RNA, 22 nt, Human
uaaccaggaaauagcauagcac

SEQ ID NO: 254173 - RNA, 24 nt, Human
uaaccaggaaauagcauagcacuu

SEQ ID NO: 254174 - RNA, 22 nt, Human
uaauuccaaccuuaauauucau

SEQ ID NO: 254175 - RNA, 22 nt, Human
uacaaaaagcagaauaacugcc

SEQ ID NO: 254176 - RNA, 27 nt, Human
uacaaaaagcagaauaacugccccaaa

SEQ ID NO: 254177 - RNA, 26 nt, Human
uacaaaauuaggcucucguaccccaa

SEQ ID NO: 254178 - RNA, 20 nt, Human
uacaacauaccauauccuuc

SEQ ID NO: 254179 - RNA, 18 nt, Human
uacaugaagcuuucacaa

SEQ ID NO: 254180 - RNA, 21 nt, Human
uagugcauacucaaaggcuuu

SEQ ID NO: 254181 - RNA, 20 nt, Human
uauggagaaaucagccagcc

SEQ ID NO: 254182 - RNA, 21 nt, Human
ucaaaggcuuugguuggaagu

SEQ ID NO: 254183 - RNA, 21 nt, Human
ucaaguuuuauuuugccucuu

SEQ ID NO: 254184 - RNA, 22 nt, Human
ucaaguuuuauuuugccucuug

SEQ ID NO: 254185 - RNA, 22 nt, Human
ucacaaggugcaguuaagagac

SEQ ID NO: 254186 - RNA, 23 nt, Human
ucacaaggugcaguuaagagacu

SEQ ID NO: 254187 - RNA, 24 nt, Human
ucagcaccuaacacaagacucaaa

SEQ ID NO: 254188 - RNA, 19 nt, Human
ucagucccugaacccuacc

SEQ ID NO: 254189 - RNA, 26 nt, Human
uccaaccagugaguagucucaaagug

SEQ ID NO: 254190 - RNA, 27 nt, Human
uccaaccuuaauauucauaaccaggaa

SEQ ID NO: 254191 - RNA, 18 nt, Human
uccccuaagacugagagc

SEQ ID NO: 254192 - RNA, 23 nt, Human
ucccuacaaaguacaacaugccu

SEQ ID NO: 254193 - RNA, 18 nt, Human
uccgcuguuuccccucca

SEQ ID NO: 254194 - RNA, 22 nt, Human
ucucccucugcugcugccuuag

SEQ ID NO: 254195 - RNA, 23 nt, Human
ucuccuuucuucucaccuauuua

SEQ ID NO: 254196 - RNA, 19 nt, Human
ucugaaacccacucuuucu

SEQ ID NO: 254197 - RNA, 18 nt, Human
ucuguccuucccccuccu

SEQ ID NO: 254198 - RNA, 21 nt, Human
ucuguccuucccccuccuucu

SEQ ID NO: 254199 - RNA, 22 nt, Human
ucuuucucuuuaccccucuccc

SEQ ID NO: 254200 - RNA, 19 nt, Human
ugaaagcaagaccaggggc

SEQ ID NO: 254201 - RNA, 23 nt, Human
ugagggcaaaugggaccaaucag

SEQ ID NO: 254202 - RNA, 20 nt, Human
ugagguuaauuuccagaagu

SEQ ID NO: 254203 - RNA, 18 nt, Human
ugaugaaaaaaugagucc

SEQ ID NO: 254204 - RNA, 30 nt, Human
ugccugaaccaacagucauuacaggagacc

SEQ ID NO: 254205 - RNA, 21 nt, Human
ugcuaaaaaauccugaauucc

SEQ ID NO: 254206 - RNA, 27 nt, Human
ugcuaaaaaauccugaauuccaugagg

SEQ ID NO: 254207 - RNA, 19 nt, Human
ugcucagaacccuuaaaaa

SEQ ID NO: 254208 - RNA, 20 nt, Human
ugggaccaaucagucccuga

SEQ ID NO: 254209 - RNA, 19 nt, Human
ugguuuacauuauucaaag

SEQ ID NO: 254210 - RNA, 23 nt, Human
uguaaaaggucucagcaccuaac

SEQ ID NO: 254211 - RNA, 23 nt, Human
uguccucguucucugccucugcu

SEQ ID NO: 254212 - RNA, 28 nt, Human
ugugaccagaccagccaacaugauuacu

SEQ ID NO: 254213 - RNA, 21 nt, Human
uuaagcuggggcgccagaagc

SEQ ID NO: 254214 - RNA, 20 nt, Human
uuagugcauacucaaaggcu

SEQ ID NO: 254215 - RNA, 25 nt, Human
uucaaagugccauucugaaccaaca

SEQ ID NO: 254216 - RNA, 23 nt, Human
uucaacagauuaaguccuacaaa

SEQ ID NO: 254217 - RNA, 20 nt, Human
uucaucucaagcccucaaaa

SEQ ID NO: 254218 - RNA, 19 nt, Human
uuccgcuguuuccccucca

SEQ ID NO: 254219 - RNA, 23 nt, Human
uucuagaggcugaacuguaugaa

SEQ ID NO: 254220 - RNA, 25 nt, Human
uucucugccucugcugcccucccga

SEQ ID NO: 254221 - RNA, 22 nt, Human
uugaagacucucucccuguaua

SEQ ID NO: 254222 - RNA, 20 nt, Human
uugagguuaauuuccagaag

SEQ ID NO: 254223 - RNA, 22 nt, Human
uuggaagucacuagguaccacu

SEQ ID NO: 254224 - RNA, 24 nt, Human
uuucacagucaccugugaccagac

SEQ ID NO: 254225 - RNA, 19 nt, Human
uuugguuggaagucacuag

SEQ ID NO: 254226 - RNA, 18 nt, Human
uuugucagccgcagccuc

SEQ ID NO: 254227 - RNA, 18 nt, Human
ccaaguaccaaggggcgg

SEQ ID NO: 254228 - RNA, 23 nt, Human
cgaugcaguguuacacgugugug

SEQ ID NO: 254229 - RNA, 18 nt, Human
ggcggcggggggggcggg

SEQ ID NO: 254230 - RNA, 20 nt, Human
ggcggcggggggggcggggg

SEQ ID NO: 254231 - RNA, 19 nt, Human
gggcggcggggggggcggg

SEQ ID NO: 254232 - RNA, 22 nt, Human
gggcggcggggggggcgggggg

SEQ ID NO: 254233 - RNA, 19 nt, Human
uccauccuacugcacauac

SEQ ID NO: 254234 - RNA, 19 nt, Human
uuaauacagcggugccucc

SEQ ID NO: 254235 - RNA, 24 nt, Human
caaucugggggcgggaaaaagggg

SEQ ID NO: 254236 - RNA, 21 nt, Human
cagccuccagaaaaaaagaga

SEQ ID NO: 254237 - RNA, 23 nt, Human
gacaagagaauauacaggaaaga

SEQ ID NO: 254238 - RNA, 23 nt, Human
gccagccuccagaaaaaaagaga

SEQ ID NO: 254239 - RNA, 21 nt, Human
ggugccagccuccagaaaaaa

SEQ ID NO: 254240 - RNA, 20 nt, Human
guaucacaccagaaguuuau

SEQ ID NO: 254241 - RNA, 19 nt, Human
uauacaggaaagaagcauu

SEQ ID NO: 254242 - RNA, 20 nt, Human
ucacaccagaaguuuauuau

SEQ ID NO: 254243 - RNA, 18 nt, Human
ucucaggguucuugugua

SEQ ID NO: 254244 - RNA, 19 nt, Human
ucuccuuugacccucacug

SEQ ID NO: 254245 - RNA, 21 nt, Human
ugccagccuccagaaaaaaag

SEQ ID NO: 254246 - RNA, 23 nt, Human
ugcuacagggggauacaaaauca

SEQ ID NO: 254247 - RNA, 23 nt, Human
aaacaagaauacaggauauuggc

SEQ ID NO: 254248 - RNA, 19 nt, Human
aagaauacaggauauuggc

SEQ ID NO: 254249 - RNA, 22 nt, Human
acagaauucuuaaaaagccaac

SEQ ID NO: 254250 - RNA, 20 nt, Human
ccccuccuaccuaaaaucua

SEQ ID NO: 254251 - RNA, 24 nt, Human
ccccuccuaccuaaaaucuaagaa

SEQ ID NO: 254252 - RNA, 22 nt, Human
gccgaggaggaggaagcagcaa

SEQ ID NO: 254253 - RNA, 18 nt, Human
guaaaacaagaauacagg

SEQ ID NO: 254254 - RNA, 23 nt, Human
guucauaauuccucugcuccccu

SEQ ID NO: 254255 - RNA, 23 nt, Human
uagguuucucauacgugcaauuc

SEQ ID NO: 254256 - RNA, 20 nt, Human
uccccuccuaccuaaaaucu

SEQ ID NO: 254257 - RNA, 18 nt, Human
uggaauggugaggccgag

SEQ ID NO: 254258 - RNA, 21 nt, Human
uucuaauccaaauguaaaaca

SEQ ID NO: 254259 - RNA, 27 nt, Human
uuuuuuuuuuuuuuuuuuuuuuugggg

SEQ ID NO: 254260 - RNA, 18 nt, Human
aggaaggcaggcaggucu

SEQ ID NO: 254261 - RNA, 23 nt, Human
augaccuuugcucuggaacagaa

SEQ ID NO: 254262 - RNA, 18 nt, Human
caagcggcugaaugaccu

SEQ ID NO: 254263 - RNA, 23 nt, Human
ccuuugcucuggaacagaaguca

SEQ ID NO: 254264 - RNA, 23 nt, Human
ccuuugcucuggaacagaaguug

SEQ ID NO: 254265 - RNA, 21 nt, Human
cggguggggggaaaaggcuga

SEQ ID NO: 254266 - RNA, 22 nt, Human
cuggaacagaagucaggaaggc

SEQ ID NO: 254267 - RNA, 19 nt, Human
ggaacagcuucugcaagca

SEQ ID NO: 254268 - RNA, 19 nt, Human
gggaaaaggcugauucaag

SEQ ID NO: 254269 - RNA, 21 nt, Human
gggaaaaggcugauucaagcg

SEQ ID NO: 254270 - RNA, 19 nt, Human
ggggaaaaggcugauucaa

SEQ ID NO: 254271 - RNA, 18 nt, Human
gguggggggaaaaggcug

SEQ ID NO: 254272 - RNA, 22 nt, Human
uaaacaaaguuggggaccggga

SEQ ID NO: 254273 - RNA, 20 nt, Human
ucaagcggcugaaugaccuu

SEQ ID NO: 254274 - RNA, 23 nt, Human
ugccggucacagaucuuuauggg

SEQ ID NO: 254275 - RNA, 19 nt, Human
accuucgaacagcuggagc

SEQ ID NO: 254276 - RNA, 21 nt, Human
cagcgcggugugggugcggcg

SEQ ID NO: 254277 - RNA, 18 nt, Human
gggugcggcgcccucgcc

SEQ ID NO: 254278 - RNA, 18 nt, Human
ggugugggugcggcgccc

SEQ ID NO: 254279 - RNA, 21 nt, Human
gucuggaucaccuucgaacag

SEQ ID NO: 254280 - RNA, 27 nt, Human
uaaaaugaaugagaguuuuuaaacccc

SEQ ID NO: 254281 - RNA, 23 nt, Human
uagaaaaaaaauguaacuggaaa

SEQ ID NO: 254282 - RNA, 21 nt, Human
ucuggaucaccuucgaacagc

SEQ ID NO: 254283 - RNA, 19 nt, Human
ugggugcggcgcccucgcc

SEQ ID NO: 254284 - RNA, 20 nt, Human
uuagguaugaggcugaugcc

SEQ ID NO: 254285 - RNA, 23 nt, Human
uuuuuuuuuuuuuuuuuuuuagg

SEQ ID NO: 254286 - RNA, 21 nt, Human
aaaaaagaaguacuuucuccc

SEQ ID NO: 254287 - RNA, 28 nt, Human
aaaaaccagcucacucccaggacagagc

SEQ ID NO: 254288 - RNA, 21 nt, Human
aaaaaugaaaaauuagccaga

SEQ ID NO: 254289 - RNA, 24 nt, Human
aaaaccuggcacauggcacagugg

SEQ ID NO: 254290 - RNA, 21 nt, Human
aaaagcagcugccacugaagc

SEQ ID NO: 254291 - RNA, 20 nt, Human
aacacggcaaaacccugucu

SEQ ID NO: 254292 - RNA, 21 nt, Human
aacacggcaaaacccugucuc

SEQ ID NO: 254293 - RNA, 22 nt, Human
aacauagugagacccuggcucu

SEQ ID NO: 254294 - RNA, 21 nt, Human
aacccagccaccauacuuaug

SEQ ID NO: 254295 - RNA, 23 nt, Human
aacccugaaccagcaggggccgg

SEQ ID NO: 254296 - RNA, 22 nt, Human
aagaaguacuuucuccccaggg

SEQ ID NO: 254297 - RNA, 24 nt, Human
aagagugaaaacucugucucaaaa

SEQ ID NO: 254298 - RNA, 19 nt, Human
aagcacacagccucaucac

SEQ ID NO: 254299 - RNA, 24 nt, Human
aagcagaagaaucgcuugaaccca

SEQ ID NO: 254300 - RNA, 19 nt, Human
aagcagugggucagaccaa

SEQ ID NO: 254301 - RNA, 22 nt, Human
aagcccaacuagcccacaugga

SEQ ID NO: 254302 - RNA, 19 nt, Human
aagcugaaccuggauggca

SEQ ID NO: 254303 - RNA, 22 nt, Human
aaggugggacuccgucuccgcu

SEQ ID NO: 254304 - RNA, 24 nt, Human
aaucacuugaggccaggaguucaa

SEQ ID NO: 254305 - RNA, 24 nt, Human
aaucgcuugaacccaagaggcgga

SEQ ID NO: 254306 - RNA, 23 nt, Human
acaaagaaaaguccucucagaaa

SEQ ID NO: 254307 - RNA, 19 nt, Human
acacagccucaucacuaac

SEQ ID NO: 254308 - RNA, 20 nt, Human
acagagugagacccugccuc

SEQ ID NO: 254309 - RNA, 18 nt, Human
acagccucaucacuaacc

SEQ ID NO: 254310 - RNA, 24 nt, Human
acaugccuguccagagcacagcug

SEQ ID NO: 254311 - RNA, 20 nt, Human
accagcaggggccgggugcc

SEQ ID NO: 254312 - RNA, 20 nt, Human
acccagaucgcaccacugca

SEQ ID NO: 254313 - RNA, 24 nt, Human
acccagcucucacuugcuggggag

SEQ ID NO: 254314 - RNA, 22 nt, Human
acccugucucuaccaaaaauga

SEQ ID NO: 254315 - RNA, 22 nt, Human
acgcguguguguguaugugugu

SEQ ID NO: 254316 - RNA, 23 nt, Human
acgcguguguguguauguguguu

SEQ ID NO: 254317 - RNA, 18 nt, Human
acuccgucuccgcuaaaa

SEQ ID NO: 254318 - RNA, 21 nt, Human
acucugucaccuaggcuauag

SEQ ID NO: 254319 - RNA, 18 nt, Human
acugcacgccagccuggg

SEQ ID NO: 254320 - RNA, 24 nt, Human
acugcacgccagccugggcaacag

SEQ ID NO: 254321 - RNA, 26 nt, Human
acugcacuccagcgugggcauaagag

SEQ ID NO: 254322 - RNA, 18 nt, Human
acugugucccagaacauc

SEQ ID NO: 254323 - RNA, 19 nt, Human
acugugugacuucuaaggc

SEQ ID NO: 254324 - RNA, 18 nt, Human
agaaaaguccucucagaa

SEQ ID NO: 254325 - RNA, 18 nt, Human
agaaguacuuucucccca

SEQ ID NO: 254326 - RNA, 24 nt, Human
agaaucacuugaggccaggaguuc

SEQ ID NO: 254327 - RNA, 23 nt, Human
agagcaguggguaccccaaaaug

SEQ ID NO: 254328 - RNA, 24 nt, Human
agcacuuugggaggcugaggcagg

SEQ ID NO: 254329 - RNA, 24 nt, Human
agcacuuugggaggcugagguggg

SEQ ID NO: 254330 - RNA, 18 nt, Human
agcaggguggagaaguac

SEQ ID NO: 254331 - RNA, 18 nt, Human
agccacuaugauuugggg

SEQ ID NO: 254332 - RNA, 23 nt, Human
agccagacaugauggugggugcc

SEQ ID NO: 254333 - RNA, 21 nt, Human
agccaguucgaggcaggaggu

SEQ ID NO: 254334 - RNA, 21 nt, Human
agcccaacccucaagcugccc

SEQ ID NO: 254335 - RNA, 20 nt, Human
agcccggccaacacggcaag

SEQ ID NO: 254336 - RNA, 21 nt, Human
agccgcacacacaggagccca

SEQ ID NO: 254337 - RNA, 24 nt, Human
agcuauucgggaggcugagguggg

SEQ ID NO: 254338 - RNA, 25 nt, Human
agcuguuucccugcuaagggcuggu

SEQ ID NO: 254339 - RNA, 24 nt, Human
agcuuccaaguccuuucgacuccc

SEQ ID NO: 254340 - RNA, 18 nt, Human
aggaaaugaagcugugcu

SEQ ID NO: 254341 - RNA, 18 nt, Human
aggcaggagaaucacuug

SEQ ID NO: 254342 - RNA, 19 nt, Human
aggcggagguugcagugaa

SEQ ID NO: 254343 - RNA, 24 nt, Human
aggcugaagcagaagaaucgcuug

SEQ ID NO: 254344 - RNA, 24 nt, Human
aggcugaggcaggagaaucacuug

SEQ ID NO: 254345 - RNA, 19 nt, Human
aggcugaggugggaggauc

SEQ ID NO: 254346 - RNA, 19 nt, Human
aggcugagguggguggauc

SEQ ID NO: 254347 - RNA, 18 nt, Human
aggggccaacccugaacc

SEQ ID NO: 254348 - RNA, 19 nt, Human
aggugggaggaucacuuag

SEQ ID NO: 254349 - RNA, 22 nt, Human
agguggguggaucacccgaggu

SEQ ID NO: 254350 - RNA, 22 nt, Human
agguugaggcugcagugagccg

SEQ ID NO: 254351 - RNA, 18 nt, Human
agucccagcuauucggga

SEQ ID NO: 254352 - RNA, 19 nt, Human
agugcaguggcgugaucuc

SEQ ID NO: 254353 - RNA, 20 nt, Human
agugcaguggcgugaucucg

SEQ ID NO: 254354 - RNA, 23 nt, Human
agugcaguggcgugaucucggcu

SEQ ID NO: 254355 - RNA, 24 nt, Human
agugcaguggcgugaucucggcuc

SEQ ID NO: 254356 - RNA, 24 nt, Human
aguggcucacgcuuguaaucccag

SEQ ID NO: 254357 - RNA, 18 nt, Human
aucaaaauccucaaaccu

SEQ ID NO: 254358 - RNA, 19 nt, Human
aucaaaauccucaaaccuc

SEQ ID NO: 254359 - RNA, 23 nt, Human
aucaaaauccucaaaccucauac

SEQ ID NO: 254360 - RNA, 24 nt, Human
aucgcaccacugcacgccagccug

SEQ ID NO: 254361 - RNA, 21 nt, Human
augaacucaaacccugggacc

SEQ ID NO: 254362 - RNA, 24 nt, Human
augcugaggcucaugggauacagc

SEQ ID NO: 254363 - RNA, 23 nt, Human
caaaaaugaaaaauuagccagac

SEQ ID NO: 254364 - RNA, 23 nt, Human
caaaauccucaaaccucauacaa

SEQ ID NO: 254365 - RNA, 20 nt, Human
caaccuuucucauccccaaa

SEQ ID NO: 254366 - RNA, 23 nt, Human
cacacagccucaucacuaaccag

SEQ ID NO: 254367 - RNA, 24 nt, Human
cacaccuguaaucccagcacuuug

SEQ ID NO: 254368 - RNA, 18 nt, Human
cacaccuguagucccagc

SEQ ID NO: 254369 - RNA, 18 nt, Human
cacaggagcccauggccu

SEQ ID NO: 254370 - RNA, 24 nt, Human
caccacugcacgccagccugggca

SEQ ID NO: 254371 - RNA, 20 nt, Human
cacccuccaacccagccacc

SEQ ID NO: 254372 - RNA, 24 nt, Human
cacccuccaacccagccaccauac

SEQ ID NO: 254373 - RNA, 21 nt, Human
caccgccccauuaguguccca

SEQ ID NO: 254374 - RNA, 24 nt, Human
caccugagcuauuuacaagcugaa

SEQ ID NO: 254375 - RNA, 23 nt, Human
caccuguaaucccagcacuuugg

SEQ ID NO: 254376 - RNA, 24 nt, Human
caccuguaaucccagcacuuuggg

SEQ ID NO: 254377 - RNA, 23 nt, Human
caccuguagucccagcuauucgg

SEQ ID NO: 254378 - RNA, 24 nt, Human
caccuguagucccagcuauucggg

SEQ ID NO: 254379 - RNA, 24 nt, Human
cacgcuuguaaucccagcacuuug

SEQ ID NO: 254380 - RNA, 23 nt, Human
cacuccagcgugggcauaagagu

SEQ ID NO: 254381 - RNA, 20 nt, Human
cacucugucaccuaggcuau

SEQ ID NO: 254382 - RNA, 24 nt, Human
cacucugucaccuaggcuauagug

SEQ ID NO: 254383 - RNA, 22 nt, Human
cacugaggcccccagccaacag

SEQ ID NO: 254384 - RNA, 20 nt, Human
cacugcacgccagccugggc

SEQ ID NO: 254385 - RNA, 23 nt, Human
cacugcacgccagccugggcaac

SEQ ID NO: 254386 - RNA, 24 nt, Human
cacugcacgccagccugggcaaca

SEQ ID NO: 254387 - RNA, 18 nt, Human
cacugcacuccagcgugg

SEQ ID NO: 254388 - RNA, 19 nt, Human
cacugcacuccagcguggg

SEQ ID NO: 254389 - RNA, 19 nt, Human
cacugcacuccagcguggg

SEQ ID NO: 254390 - RNA, 20 nt, Human
cacugcacuccagcgugggc

SEQ ID NO: 254391 - RNA, 21 nt, Human
cacugcacuccagcgugggca

SEQ ID NO: 254392 - RNA, 23 nt, Human
cacugcacuccagcgugggcaua

SEQ ID NO: 254393 - RNA, 18 nt, Human
cacugugugacuucaggc

SEQ ID NO: 254394 - RNA, 18 nt, Human
cagaacauccucccgccc

SEQ ID NO: 254395 - RNA, 21 nt, Human
cagaauggggcugccucuguc

SEQ ID NO: 254396 - RNA, 25 nt, Human
cagagaacaugccuguccagagcac

SEQ ID NO: 254397 - RNA, 24 nt, Human
cagagaacaugccuguccccugaa

SEQ ID NO: 254398 - RNA, 24 nt, Human
cagcacuuugggaggcugaggcag

SEQ ID NO: 254399 - RNA, 25 nt, Human
cagcacuuugggaggcugaggcagg

SEQ ID NO: 254400 - RNA, 24 nt, Human
cagcacuuugggaggcugaggugg

SEQ ID NO: 254401 - RNA, 24 nt, Human
cagcuauucgggaggcugaggugg

SEQ ID NO: 254402 - RNA, 18 nt, Human
cagcucagaagcacacag

SEQ ID NO: 254403 - RNA, 25 nt, Human
cagcucccggagucuggcagccccu

SEQ ID NO: 254404 - RNA, 23 nt, Human
cagcugccaccaggcauccaccc

SEQ ID NO: 254405 - RNA, 19 nt, Human
caggggccugggcaggcag

SEQ ID NO: 254406 - RNA, 22 nt, Human
caggggccugggcaggcagaau

SEQ ID NO: 254407 - RNA, 19 nt, Human
caucaucacacagaccaaa

SEQ ID NO: 254408 - RNA, 20 nt, Human
ccaaacaauuaauuuuccac

SEQ ID NO: 254409 - RNA, 22 nt, Human
ccaacaaugucagugcauugag

SEQ ID NO: 254410 - RNA, 18 nt, Human
ccaacccugaaccagcag

SEQ ID NO: 254411 - RNA, 18 nt, Human
ccacaaagaaaaguccuc

SEQ ID NO: 254412 - RNA, 21 nt, Human
ccacugcacgccagccugggc

SEQ ID NO: 254413 - RNA, 23 nt, Human
ccacugcacgccagccugggcaa

SEQ ID NO: 254414 - RNA, 24 nt, Human
ccacugcacgccagccugggcaac

SEQ ID NO: 254415 - RNA, 25 nt, Human
ccacugccaccaggggcucgcuggg

SEQ ID NO: 254416 - RNA, 19 nt, Human
ccagcccaacccucaagcu

SEQ ID NO: 254417 - RNA, 22 nt, Human
ccaggagguugaggcugcagug

SEQ ID NO: 254418 - RNA, 22 nt, Human
cccaacccucaagcugccccac

SEQ ID NO: 254419 - RNA, 26 nt, Human
cccauuagugucccauuagcuguuuc

SEQ ID NO: 254420 - RNA, 22 nt, Human
cccgaggucaagaguucgagac

SEQ ID NO: 254421 - RNA, 18 nt, Human
cccgcccuacacauagaa

SEQ ID NO: 254422 - RNA, 24 nt, Human
cccggccaacacggcaaaacccug

SEQ ID NO: 254423 - RNA, 18 nt, Human
cccuugguaagcuuuugg

SEQ ID NO: 254424 - RNA, 22 nt, Human
ccggagucuggcagccccuccu

SEQ ID NO: 254425 - RNA, 20 nt, Human
ccuccaacccagccaccaua

SEQ ID NO: 254426 - RNA, 18 nt, Human
ccucugucacucccucug

SEQ ID NO: 254427 - RNA, 22 nt, Human
ccugggcaacauagugagaccc

SEQ ID NO: 254428 - RNA, 21 nt, Human
ccuguagucccagcuacucgg

SEQ ID NO: 254429 - RNA, 22 nt, Human
ccuguagucccagcuacucggg

SEQ ID NO: 254430 - RNA, 21 nt, Human
ccuguagucccagcuauucgg

SEQ ID NO: 254431 - RNA, 18 nt, Human
ccuucggaugcccagcuc

SEQ ID NO: 254432 - RNA, 20 nt, Human
cgcacacacaggagcccaug

SEQ ID NO: 254433 - RNA, 21 nt, Human
cgcagccgggcaggggccaac

SEQ ID NO: 254434 - RNA, 23 nt, Human
cgcccuacacauagaaaccuggg

SEQ ID NO: 254435 - RNA, 23 nt, Human
cgcuuguaaucccagcacuuugg

SEQ ID NO: 254436 - RNA, 24 nt, Human
cgcuuguaaucccagcacuuuggg

SEQ ID NO: 254437 - RNA, 27 nt, Human
cgggaggcugaagcagaagaaucgcuu

SEQ ID NO: 254438 - RNA, 24 nt, Human
cgggaggcugaggugggaggauca

SEQ ID NO: 254439 - RNA, 21 nt, Human
cuauuuacaagcugaaccugg

SEQ ID NO: 254440 - RNA, 20 nt, Human
cucacaccuguagucccagc

SEQ ID NO: 254441 - RNA, 24 nt, Human
cucacaccuguagucccagcuauu

SEQ ID NO: 254442 - RNA, 22 nt, Human
cucacgcuuguaaucccagcac

SEQ ID NO: 254443 - RNA, 24 nt, Human
cucacgcuuguaaucccagcacuu

SEQ ID NO: 254444 - RNA, 23 nt, Human
cucggcucacugcacuccagcgu

SEQ ID NO: 254445 - RNA, 20 nt, Human
cucucucuauccccuccuuu

SEQ ID NO: 254446 - RNA, 19 nt, Human
cuggagccgggccuguguc

SEQ ID NO: 254447 - RNA, 20 nt, Human
cuggagccgggccugugucu

SEQ ID NO: 254448 - RNA, 19 nt, Human
cugugucugucagcagagc

SEQ ID NO: 254449 - RNA, 22 nt, Human
cuuagcccaggagguugaggcu

SEQ ID NO: 254450 - RNA, 20 nt, Human
cuugacacccagcucucacc

SEQ ID NO: 254451 - RNA, 22 nt, Human
gacacccuccaacccagccacc

SEQ ID NO: 254452 - RNA, 21 nt, Human
gacucacaccuguagucccag

SEQ ID NO: 254453 - RNA, 18 nt, Human
gagaaacuuuuguguuuu

SEQ ID NO: 254454 - RNA, 22 nt, Human
gagaaucacuugaggccaggag

SEQ ID NO: 254455 - RNA, 21 nt, Human
gaggccaggaguucaagaccu

SEQ ID NO: 254456 - RNA, 23 nt, Human
gagguggguggaucacccgaggu

SEQ ID NO: 254457 - RNA, 19 nt, Human
gagguugcagugaacccag

SEQ ID NO: 254458 - RNA, 24 nt, Human
gaucacccgaggucaagaguucga

SEQ ID NO: 254459 - RNA, 20 nt, Human
gcacagagugagacccugcc

SEQ ID NO: 254460 - RNA, 20 nt, Human
gcaccacugcacgccagccu

SEQ ID NO: 254461 - RNA, 22 nt, Human
gcaggagaaucacuugaggcca

SEQ ID NO: 254462 - RNA, 24 nt, Human
gccaacacggcaaaacccugucuc

SEQ ID NO: 254463 - RNA, 21 nt, Human
gccaaggugggacuccgucuc

SEQ ID NO: 254464 - RNA, 19 nt, Human
gcccggugcaguggcucac

SEQ ID NO: 254465 - RNA, 21 nt, Human
gccugggcaacauagugagac

SEQ ID NO: 254466 - RNA, 22 nt, Human
gcuggugcaucuggccaggccu

SEQ ID NO: 254467 - RNA, 21 nt, Human
ggacacccuccaacccagcca

SEQ ID NO: 254468 - RNA, 18 nt, Human
ggaccagcuuggaucaaa

SEQ ID NO: 254469 - RNA, 20 nt, Human
ggagaagagcuguguccaca

SEQ ID NO: 254470 - RNA, 24 nt, Human
ggagguugcagugaacccagaucg

SEQ ID NO: 254471 - RNA, 22 nt, Human
ggcaacauagugagacccuggc

SEQ ID NO: 254472 - RNA, 19 nt, Human
ggcacaguggaugaucaga

SEQ ID NO: 254473 - RNA, 19 nt, Human
ggcccggugcaguggcuca

SEQ ID NO: 254474 - RNA, 22 nt, Human
ggcuauagugcaguggcgugau

SEQ ID NO: 254475 - RNA, 19 nt, Human
ggcuggguguggugguuca

SEQ ID NO: 254476 - RNA, 18 nt, Human
gggaggcugaggugggag

SEQ ID NO: 254477 - RNA, 23 nt, Human
gggaggcugaggugggaggauca

SEQ ID NO: 254478 - RNA, 19 nt, Human
gggcacagagugagacccu

SEQ ID NO: 254479 - RNA, 22 nt, Human
ggggagaggagcagagcuuggg

SEQ ID NO: 254480 - RNA, 24 nt, Human
ggguguggugguucacaccuguaa

SEQ ID NO: 254481 - RNA, 20 nt, Human
ggguugcccaucagugucuu

SEQ ID NO: 254482 - RNA, 24 nt, Human
ggugacucacaccuguagucccag

SEQ ID NO: 254483 - RNA, 23 nt, Human
ggugcaguggcucacgcuuguaa

SEQ ID NO: 254484 - RNA, 24 nt, Human
ggugguucacaccuguaaucccag

SEQ ID NO: 254485 - RNA, 20 nt, Human
guacagaagaaugagucuuc

SEQ ID NO: 254486 - RNA, 18 nt, Human
guaggacagaaggagcug

SEQ ID NO: 254487 - RNA, 22 nt, Human
guccuuucgacucccugcagcc

SEQ ID NO: 254488 - RNA, 25 nt, Human
gugaaaaaagacacaggaaaugaag

SEQ ID NO: 254489 - RNA, 20 nt, Human
gugacaccagcccaacccuc

SEQ ID NO: 254490 - RNA, 19 nt, Human
gugcucacuccuguagccg

SEQ ID NO: 254491 - RNA, 21 nt, Human
guggcuguccgcaauguccuu

SEQ ID NO: 254492 - RNA, 18 nt, Human
gugugugcacgcgugugu

SEQ ID NO: 254493 - RNA, 21 nt, Human
guguguguguaugugugugua

SEQ ID NO: 254494 - RNA, 19 nt, Human
uaaaacauauauauguagc

SEQ ID NO: 254495 - RNA, 20 nt, Human
uaacucgaggcucugaccuc

SEQ ID NO: 254496 - RNA, 24 nt, Human
uaagagugaaaacucugucucaaa

SEQ ID NO: 254497 - RNA, 20 nt, Human
uaccaaaaaugaaaaauuag

SEQ ID NO: 254498 - RNA, 23 nt, Human
uaccaaaaaugaaaaauuagcca

SEQ ID NO: 254499 - RNA, 25 nt, Human
uaccaaaaaugaaaaauuagccaga

SEQ ID NO: 254500 - RNA, 24 nt, Human
uauagugcaguggcgugaucucgg

SEQ ID NO: 254501 - RNA, 21 nt, Human
ucaaaccucauacaacacugu

SEQ ID NO: 254502 - RNA, 23 nt, Human
ucacaccuguaaucccagcacuu

SEQ ID NO: 254503 - RNA, 19 nt, Human
ucacacuggccaacagaau

SEQ ID NO: 254504 - RNA, 21 nt, Human
ucaccucccuguccucgacuc

SEQ ID NO: 254505 - RNA, 20 nt, Human
ucacugcacuccagcguggg

SEQ ID NO: 254506 - RNA, 21 nt, Human
ucacugcacuccagcgugggc

SEQ ID NO: 254507 - RNA, 23 nt, Human
ucacuugaggccaggaguucaag

SEQ ID NO: 254508 - RNA, 22 nt, Human
ucagaagcacacagccucauca

SEQ ID NO: 254509 - RNA, 21 nt, Human
ucagacccucuugacacccag

SEQ ID NO: 254510 - RNA, 24 nt, Human
uccacaaguacccaguucaagguc

SEQ ID NO: 254511 - RNA, 20 nt, Human
ucccagaacauccucccgcc

SEQ ID NO: 254512 - RNA, 19 nt, Human
ucccugcagccaagguggg

SEQ ID NO: 254513 - RNA, 20 nt, Human
uccgucuccgcuaaaaacca

SEQ ID NO: 254514 - RNA, 23 nt, Human
uccucagacccucuugacaccca

SEQ ID NO: 254515 - RNA, 23 nt, Human
ucgcaccacugcacgccagccug

SEQ ID NO: 254516 - RNA, 24 nt, Human
ucgcuugaacccaagaggcggagg

SEQ ID NO: 254517 - RNA, 24 nt, Human
ucgggaggcugaagcagaagaauc

SEQ ID NO: 254518 - RNA, 25 nt, Human
ucgggaggcugaggugggaggauca

SEQ ID NO: 254519 - RNA, 27 nt, Human
ucuaccaaaaaugaaaaauuagccaga

SEQ ID NO: 254520 - RNA, 24 nt, Human
ucuauccccuccuuucuuuuuggg

SEQ ID NO: 254521 - RNA, 19 nt, Human
ucucacucugucaccuagg

SEQ ID NO: 254522 - RNA, 22 nt, Human
ucucacucugucaccuaggcua

SEQ ID NO: 254523 - RNA, 23 nt, Human
ucucacucugucaccuaggcuau

SEQ ID NO: 254524 - RNA, 24 nt, Human
ucucacucugucaccuaggcuaua

SEQ ID NO: 254525 - RNA, 19 nt, Human
ucuccgcuaaaaaccagcu

SEQ ID NO: 254526 - RNA, 20 nt, Human
ucucucuauccccuccuuuc

SEQ ID NO: 254527 - RNA, 26 nt, Human
ucucugcuauggacugaguggaccag

SEQ ID NO: 254528 - RNA, 21 nt, Human
ucucugggcccuuucauucuc

SEQ ID NO: 254529 - RNA, 25 nt, Human
ucuucaggugacaccagcccaaccc

SEQ ID NO: 254530 - RNA, 22 nt, Human
ugaacaggcagcucccacugcc

SEQ ID NO: 254531 - RNA, 20 nt, Human
ugaagcagaagaaucgcuug

SEQ ID NO: 254532 - RNA, 24 nt, Human
ugaagcagaagaaucgcuugaacc

SEQ ID NO: 254533 - RNA, 23 nt, Human
ugacaccagcccaacccucaagc

SEQ ID NO: 254534 - RNA, 19 nt, Human
ugagaauugaacugugucc

SEQ ID NO: 254535 - RNA, 22 nt, Human
ugagacagagucucacucuguc

SEQ ID NO: 254536 - RNA, 20 nt, Human
ugaggcaggagaaucacuug

SEQ ID NO: 254537 - RNA, 25 nt, Human
ugaggcaggagaaucacuugaggcc

SEQ ID NO: 254538 - RNA, 26 nt, Human
ugaggcaggagaaucacuugaggcca

SEQ ID NO: 254539 - RNA, 23 nt, Human
ugaggcugcagugagccgugauc

SEQ ID NO: 254540 - RNA, 18 nt, Human
ugaggugggaggaucacu

SEQ ID NO: 254541 - RNA, 23 nt, Human
ugaggugggaggaucacuuagcc

SEQ ID NO: 254542 - RNA, 24 nt, Human
ugaggugggaggaucacuuagccc

SEQ ID NO: 254543 - RNA, 20 nt, Human
ugagguggguggaucacccg

SEQ ID NO: 254544 - RNA, 24 nt, Human
ugagguggguggaucacccgaggu

SEQ ID NO: 254545 - RNA, 26 nt, Human
ugagguggguggaucacccgagguca

SEQ ID NO: 254546 - RNA, 24 nt, Human
ugaguggaccagcuuggaucaaaa

SEQ ID NO: 254547 - RNA, 19 nt, Human
ugaucagagcacaccucag

SEQ ID NO: 254548 - RNA, 24 nt, Human
ugauggugggugccuguaguccca

SEQ ID NO: 254549 - RNA, 19 nt, Human
ugcacgcguguguguguau

SEQ ID NO: 254550 - RNA, 22 nt, Human
ugcacugaggcccccagccaac

SEQ ID NO: 254551 - RNA, 22 nt, Human
ugcagugagccgugaucauacc

SEQ ID NO: 254552 - RNA, 22 nt, Human
ugcaguggcgugaucucggcuc

SEQ ID NO: 254553 - RNA, 19 nt, Human
ugccaccaggcauccaccc

SEQ ID NO: 254554 - RNA, 21 nt, Human
ugccacugaagcccagccugu

SEQ ID NO: 254555 - RNA, 23 nt, Human
ugccuguagucccagcuacucgg

SEQ ID NO: 254556 - RNA, 24 nt, Human
ugccuguagucccagcuacucggg

SEQ ID NO: 254557 - RNA, 18 nt, Human
ugccuucggaugcccagc

SEQ ID NO: 254558 - RNA, 21 nt, Human
ugcuaagggcuggugcaucug

SEQ ID NO: 254559 - RNA, 23 nt, Human
ugcuauggacugaguggaccagc

SEQ ID NO: 254560 - RNA, 23 nt, Human
uggaccagcuuggaucaaaaucc

SEQ ID NO: 254561 - RNA, 20 nt, Human
uggagaagagcuguguccac

SEQ ID NO: 254562 - RNA, 22 nt, Human
uggagcugaacaggcagcuccc

SEQ ID NO: 254563 - RNA, 24 nt, Human
uggaucacccgaggucaagaguuc

SEQ ID NO: 254564 - RNA, 27 nt, Human
uggaucacccgaggucaagaguucgag

SEQ ID NO: 254565 - RNA, 18 nt, Human
uggcagaagugggcuggg

SEQ ID NO: 254566 - RNA, 19 nt, Human
uggcagaagugggcugggu

SEQ ID NO: 254567 - RNA, 18 nt, Human
uggccuggccguggcugu

SEQ ID NO: 254568 - RNA, 20 nt, Human
uggcgugaucucggcucacu

SEQ ID NO: 254569 - RNA, 22 nt, Human
uggcucacgcuuguaaucccag

SEQ ID NO: 254570 - RNA, 24 nt, Human
uggcucacgcuuguaaucccagca

SEQ ID NO: 254571 - RNA, 19 nt, Human
ugggaggcugaggcaggag

SEQ ID NO: 254572 - RNA, 24 nt, Human
ugggaggcugaggcaggagaauca

SEQ ID NO: 254573 - RNA, 20 nt, Human
ugggaggcugaggugggugg

SEQ ID NO: 254574 - RNA, 23 nt, Human
ugggaggcugagguggguggauc

SEQ ID NO: 254575 - RNA, 24 nt, Human
ugggaggcugagguggguggauca

SEQ ID NO: 254576 - RNA, 22 nt, Human
ugggcaacagugagacccuguc

SEQ ID NO: 254577 - RNA, 18 nt, Human
ugggcccuuucauucucu

SEQ ID NO: 254578 - RNA, 21 nt, Human
uggggagaggagcagagcuug

SEQ ID NO: 254579 - RNA, 19 nt, Human
uggggcuggugagcuggag

SEQ ID NO: 254580 - RNA, 21 nt, Human
uggguagaaagcggagcuucc

SEQ ID NO: 254581 - RNA, 24 nt, Human
uggguggaucacccgaggucaaga

SEQ ID NO: 254582 - RNA, 24 nt, Human
uggugacucacaccuguaguccca

SEQ ID NO: 254583 - RNA, 21 nt, Human
uggugggugccuguaguccca

SEQ ID NO: 254584 - RNA, 24 nt, Human
uggugggugccuguagucccagcu

SEQ ID NO: 254585 - RNA, 24 nt, Human
uggugguucacaccuguaauccca

SEQ ID NO: 254586 - RNA, 23 nt, Human
uggugugugcacgcgugugugug

SEQ ID NO: 254587 - RNA, 24 nt, Human
uggugugugcacgcgugugugugu

SEQ ID NO: 254588 - RNA, 21 nt, Human
ugguucacaccuguaauccca

SEQ ID NO: 254589 - RNA, 22 nt, Human
ugguucacaccuguaaucccag

SEQ ID NO: 254590 - RNA, 24 nt, Human
ugguucacaccuguaaucccagca

SEQ ID NO: 254591 - RNA, 18 nt, Human
ugugcacgcgugugugug

SEQ ID NO: 254592 - RNA, 21 nt, Human
ugugcacgcguguguguguau

SEQ ID NO: 254593 - RNA, 24 nt, Human
ugugguggaaaggaggguggguag

SEQ ID NO: 254594 - RNA, 20 nt, Human
uguguacgugcacacacgug

SEQ ID NO: 254595 - RNA, 20 nt, Human
uguguauguguguguacgug

SEQ ID NO: 254596 - RNA, 22 nt, Human
ugugugcacgcgugugugugua

SEQ ID NO: 254597 - RNA, 21 nt, Human
uguguguguauguguguguac

SEQ ID NO: 254598 - RNA, 20 nt, Human
uguuaauaacucgaggcucu

SEQ ID NO: 254599 - RNA, 21 nt, Human
uucaaccuuucucauccccaa

SEQ ID NO: 254600 - RNA, 22 nt, Human
uuccccuugguaagcuuuuggu

SEQ ID NO: 254601 - RNA, 24 nt, Human
uugaacccaagaggcggagguugc

SEQ ID NO: 254602 - RNA, 22 nt, Human
uugaggccaggaguucaagacc

SEQ ID NO: 254603 - RNA, 22 nt, Human
uugcagugaacccagaucgcac

SEQ ID NO: 254604 - RNA, 24 nt, Human
uuggaucaaaauccucaaaccuca

SEQ ID NO: 254605 - RNA, 22 nt, Human
uuggcuuuggccaacaauguca

SEQ ID NO: 254606 - RNA, 25 nt, Human
uugggaggcugaggcaggagaauca

SEQ ID NO: 254607 - RNA, 25 nt, Human
uugggaggcugagguggguggauca

SEQ ID NO: 254608 - RNA, 26 nt, Human
uuuggcuuuggccaacaaugucagug

SEQ ID NO: 254609 - RNA, 22 nt, Human
aacccaaggaggggaaacggca

SEQ ID NO: 254610 - RNA, 24 nt, Human
gcacugggcugauuguauuugcau

SEQ ID NO: 254611 - RNA, 22 nt, Human
ggaaacggcagggccagcggua

SEQ ID NO: 254612 - RNA, 20 nt, Human
uccaauuuccuccccucccu

SEQ ID NO: 254613 - RNA, 23 nt, Human
cccgcggcggggaccccgggggc

SEQ ID NO: 254614 - RNA, 23 nt, Human
ccgggggcggucgccagagugga

SEQ ID NO: 254615 - RNA, 21 nt, Human
cggcccggacuguagcggcgg

SEQ ID NO: 254616 - RNA, 20 nt, Human
cggggaccccgggggcgguc

SEQ ID NO: 254617 - RNA, 20 nt, Human
gcggcggcugcggcugcggc

SEQ ID NO: 254618 - RNA, 23 nt, Human
aaaaagaagucggggcuaccagg

SEQ ID NO: 254619 - RNA, 23 nt, Human
accagggguuucagacgugcucg

SEQ ID NO: 254620 - RNA, 20 nt, Human
agcaacaagcaaagcacauc

SEQ ID NO: 254621 - RNA, 21 nt, Human
aggacagauacucccccacgg

SEQ ID NO: 254622 - RNA, 23 nt, Human
auccgcccagcaacaagcaaagc

SEQ ID NO: 254623 - RNA, 22 nt, Human
augaaaaacaaauaucccuaca

SEQ ID NO: 254624 - RNA, 24 nt, Human
augaaaaacaaauaucccuacaaa

SEQ ID NO: 254625 - RNA, 22 nt, Human
cacgggccggguggggcgaagc

SEQ ID NO: 254626 - RNA, 19 nt, Human
caggacagauacuccccca

SEQ ID NO: 254627 - RNA, 18 nt, Human
cagggcgugggcgaaggc

SEQ ID NO: 254628 - RNA, 24 nt, Human
cauccgcccagcaacaagcaaagc

SEQ ID NO: 254629 - RNA, 20 nt, Human
caucucugcucucaggcagg

SEQ ID NO: 254630 - RNA, 23 nt, Human
ccaugggaaaccgcccccccggg

SEQ ID NO: 254631 - RNA, 21 nt, Human
cccaugggaaaccgccccccc

SEQ ID NO: 254632 - RNA, 19 nt, Human
cccccccgggccuuggaga

SEQ ID NO: 254633 - RNA, 18 nt, Human
ccccgccccggccucccc

SEQ ID NO: 254634 - RNA, 19 nt, Human
ccccgccccggccuccccu

SEQ ID NO: 254635 - RNA, 19 nt, Human
ccgcccagcaacaagcaaa

SEQ ID NO: 254636 - RNA, 23 nt, Human
ccucaggcagcuguucuaacccu

SEQ ID NO: 254637 - RNA, 26 nt, Human
ccuuauuuuaauuaaaaagaagucgg

SEQ ID NO: 254638 - RNA, 22 nt, Human
ccuuggagaauggggguccaag

SEQ ID NO: 254639 - RNA, 22 nt, Human
cgcccagagcgcgcagggacgg

SEQ ID NO: 254640 - RNA, 22 nt, Human
cgcccagcaacaagcaaagcac

SEQ ID NO: 254641 - RNA, 21 nt, Human
cgggggggugccucggugggg

SEQ ID NO: 254642 - RNA, 18 nt, Human
cgugaacagaaggccucc

SEQ ID NO: 254643 - RNA, 23 nt, Human
cgugggcgaaggcggcaggacag

SEQ ID NO: 254644 - RNA, 18 nt, Human
cuaacccugcugccaacg

SEQ ID NO: 254645 - RNA, 21 nt, Human
cugcaagcucagcgccggcug

SEQ ID NO: 254646 - RNA, 19 nt, Human
gcaggacagauacuccccc

SEQ ID NO: 254647 - RNA, 20 nt, Human
gcagggcgugggcgaaggcg

SEQ ID NO: 254648 - RNA, 18 nt, Human
gccaagauucugggggac

SEQ ID NO: 254649 - RNA, 23 nt, Human
gcccagcaacaagcaaagcacau

SEQ ID NO: 254650 - RNA, 18 nt, Human
gcccgccccgccccggcc

SEQ ID NO: 254651 - RNA, 24 nt, Human
gcccgccccgccccggccuccccu

SEQ ID NO: 254652 - RNA, 20 nt, Human
gccggcugcgcccgccccgc

SEQ ID NO: 254653 - RNA, 21 nt, Human
ggcgaagcccggggacucgaa

SEQ ID NO: 254654 - RNA, 24 nt, Human
ggcugcgcccgccccgccccggcc

SEQ ID NO: 254655 - RNA, 24 nt, Human
gggccggguggggcgaagcccggg

SEQ ID NO: 254656 - RNA, 24 nt, Human
ggggacgggggggugccucggugg

SEQ ID NO: 254657 - RNA, 24 nt, Human
ggguggggcgaagcccggggacuc

SEQ ID NO: 254658 - RNA, 24 nt, Human
uaaaacaaagaauccgccgugaac

SEQ ID NO: 254659 - RNA, 21 nt, Human
ucagggaggagccucaggcag

SEQ ID NO: 254660 - RNA, 22 nt, Human
ucccccacgggccggguggggc

SEQ ID NO: 254661 - RNA, 23 nt, Human
uccgcccagcaacaagcaaagca

SEQ ID NO: 254662 - RNA, 20 nt, Human
uccgccgugaacagaaggcu

SEQ ID NO: 254663 - RNA, 24 nt, Human
ucucaggcagguguccuucaggga

SEQ ID NO: 254664 - RNA, 20 nt, Human
uggggcgaagcccggggacu

SEQ ID NO: 254665 - RNA, 21 nt, Human
ugggggacgggggggugccuc

SEQ ID NO: 254666 - RNA, 19 nt, Human
uuuuuuuuuuuuuuuuuug

SEQ ID NO: 254667 - RNA, 23 nt, Human
uuuuuuuuuuuuuuuuuuuuggg

SEQ ID NO: 254668 - RNA, 24 nt, Human
aggaaacugaggcaccaagaggga

SEQ ID NO: 254669 - RNA, 18 nt, Human
aucccagcugccuggcug

SEQ ID NO: 254670 - RNA, 20 nt, Human
caccaagagggaaagugcuc

SEQ ID NO: 254671 - RNA, 18 nt, Human
cacccucucagcggcuca

SEQ ID NO: 254672 - RNA, 24 nt, Human
cugcaaacgccucauaucuacuaa

SEQ ID NO: 254673 - RNA, 20 nt, Human
gccccgacgucgccacccuc

SEQ ID NO: 254674 - RNA, 19 nt, Human
gggaauugaaucccagcug

SEQ ID NO: 254675 - RNA, 18 nt, Human
uuucauaggucaggaaac

SEQ ID NO: 254676 - RNA, 23 nt, Human
aaaaacaaaaacaaaaacaaaaa

SEQ ID NO: 254677 - RNA, 22 nt, Human
aaaacaaaaacaaaaacaaaaa

SEQ ID NO: 254678 - RNA, 25 nt, Human
aaacaaaaacaaaaacaaaaacaaa

SEQ ID NO: 254679 - RNA, 26 nt, Human
aaacaaaaacaaaaacaaaaacaaca

SEQ ID NO: 254680 - RNA, 23 nt, Human
aaacaaaaacaaaaacaacagaa

SEQ ID NO: 254681 - RNA, 27 nt, Human
aaacaaaaacaaaaacaacagaaauaa

SEQ ID NO: 254682 - RNA, 21 nt, Human
aaagaguauauuuggaacaag

SEQ ID NO: 254683 - RNA, 25 nt, Human
aaagugcuggugagauccaggcagg

SEQ ID NO: 254684 - RNA, 21 nt, Human
aacaaaaacaaaaacaacaga

SEQ ID NO: 254685 - RNA, 22 nt, Human
aacgugggaauaaagagaaaga

SEQ ID NO: 254686 - RNA, 24 nt, Human
aacugcagccugggugacagagug

SEQ ID NO: 254687 - RNA, 20 nt, Human
aacuuggcgaaaccccgucu

SEQ ID NO: 254688 - RNA, 21 nt, Human
aacuuggcgaaaccccgucuc

SEQ ID NO: 254689 - RNA, 18 nt, Human
aagaguaaacauuuacgg

SEQ ID NO: 254690 - RNA, 25 nt, Human
aaggcaggcagaucaccugagguca

SEQ ID NO: 254691 - RNA, 19 nt, Human
aagggccccacaacccugu

SEQ ID NO: 254692 - RNA, 24 nt, Human
aagggcucugaucuuccacagccc

SEQ ID NO: 254693 - RNA, 25 nt, Human
acaaaaacaaaaacaaaaacaaaaa

SEQ ID NO: 254694 - RNA, 22 nt, Human
acaaaaacaaaaacaacagaaa

SEQ ID NO: 254695 - RNA, 23 nt, Human
acagagugagacucugucucaaa

SEQ ID NO: 254696 - RNA, 24 nt, Human
acagagugagacucugucucaaaa

SEQ ID NO: 254697 - RNA, 18 nt, Human
accauggagugaaugccc

SEQ ID NO: 254698 - RNA, 24 nt, Human
accccgucucuacaaaaaauacaa

SEQ ID NO: 254699 - RNA, 21 nt, Human
acugcagccugggugacagag

SEQ ID NO: 254700 - RNA, 24 nt, Human
acugcagccugggugacagaguga

SEQ ID NO: 254701 - RNA, 24 nt, Human
agaaagacaaaagaguauauuugg

SEQ ID NO: 254702 - RNA, 20 nt, Human
agaaagcugguccugggcug

SEQ ID NO: 254703 - RNA, 24 nt, Human
agaaggagucagcugcugggucca

SEQ ID NO: 254704 - RNA, 18 nt, Human
agagguugcagugagcug

SEQ ID NO: 254705 - RNA, 22 nt, Human
agagguugcagugagcugagau

SEQ ID NO: 254706 - RNA, 23 nt, Human
agagguugcagugagcugagauc

SEQ ID NO: 254707 - RNA, 24 nt, Human
agagguugcagugagcugagauca

SEQ ID NO: 254708 - RNA, 20 nt, Human
agagguugcagugagcuggc

SEQ ID NO: 254709 - RNA, 22 nt, Human
agaucaccugaggucaggaguu

SEQ ID NO: 254710 - RNA, 25 nt, Human
agcaagaagagggguggaagaagga

SEQ ID NO: 254711 - RNA, 24 nt, Human
agccugggugacagagugagacuc

SEQ ID NO: 254712 - RNA, 21 nt, Human
agcugggugugguggugccug

SEQ ID NO: 254713 - RNA, 24 nt, Human
aggcacgguggcucauucuuguaa

SEQ ID NO: 254714 - RNA, 20 nt, Human
aggcagagguugcagugagc

SEQ ID NO: 254715 - RNA, 24 nt, Human
aggcagagguugcagugagcugag

SEQ ID NO: 254716 - RNA, 26 nt, Human
aggcagaucaccugaggucaggaguu

SEQ ID NO: 254717 - RNA, 26 nt, Human
aggcaggcagaucaccugaggucagg

SEQ ID NO: 254718 - RNA, 24 nt, Human
agguacgagaagugcuugaaccug

SEQ ID NO: 254719 - RNA, 25 nt, Human
caaaaacaaaaacaaaaacaaaaac

SEQ ID NO: 254720 - RNA, 25 nt, Human
caaaaacaaaaacaaaaacaaaaac

SEQ ID NO: 254721 - RNA, 24 nt, Human
caaggcaggcagaucaccugaggu

SEQ ID NO: 254722 - RNA, 22 nt, Human
caccauggagugaaugcccuca

SEQ ID NO: 254723 - RNA, 24 nt, Human
cagaucaccugaggucaggaguuu

SEQ ID NO: 254724 - RNA, 27 nt, Human
cagaucaccugaggucaggaguuugaa

SEQ ID NO: 254725 - RNA, 25 nt, Human
cagcaaacaccucauaccuacuaac

SEQ ID NO: 254726 - RNA, 21 nt, Human
cagcacuuugggaugccaagg

SEQ ID NO: 254727 - RNA, 24 nt, Human
cagcacuuugggaugccaaggcag

SEQ ID NO: 254728 - RNA, 27 nt, Human
cagccugggugacagagugagacucuu

SEQ ID NO: 254729 - RNA, 24 nt, Human
caggcagaucaccugaggucagga

SEQ ID NO: 254730 - RNA, 20 nt, Human
cauuccucaaacaauaggcu

SEQ ID NO: 254731 - RNA, 24 nt, Human
cauucuuguaaucccagcacuuug

SEQ ID NO: 254732 - RNA, 24 nt, Human
ccaacaacaauaaauaagugaugu

SEQ ID NO: 254733 - RNA, 24 nt, Human
ccagugaacugcagccugggugac

SEQ ID NO: 254734 - RNA, 21 nt, Human
ccucauaccuacuaacacuuu

SEQ ID NO: 254735 - RNA, 22 nt, Human
ccugaggucaggaguuugaaac

SEQ ID NO: 254736 - RNA, 25 nt, Human
ccugggaggcagagguugcagugag

SEQ ID NO: 254737 - RNA, 22 nt, Human
ccugggugacagagugagacuc

SEQ ID NO: 254738 - RNA, 21 nt, Human
cuaacacuuugcagcauccaa

SEQ ID NO: 254739 - RNA, 24 nt, Human
cuaacacuuugcagcauccaacaa

SEQ ID NO: 254740 - RNA, 22 nt, Human
cucaaaaacaaaaacaaaaaca

SEQ ID NO: 254741 - RNA, 21 nt, Human
cucacucauaaaguucaccca

SEQ ID NO: 254742 - RNA, 24 nt, Human
cucauucuuguaaucccagcacuu

SEQ ID NO: 254743 - RNA, 24 nt, Human
cugcuggguccagaguaggcuugu

SEQ ID NO: 254744 - RNA, 18 nt, Human
cuggugagauccaggcag

SEQ ID NO: 254745 - RNA, 18 nt, Human
cuguaaucccagcuauuc

SEQ ID NO: 254746 - RNA, 23 nt, Human
cugucucaaaaacaaaaacaaaa

SEQ ID NO: 254747 - RNA, 27 nt, Human
cugucucaaaaacaaaaacaaaaacaa

SEQ ID NO: 254748 - RNA, 24 nt, Human
cuucucgugaacaagggcucugau

SEQ ID NO: 254749 - RNA, 19 nt, Human
cuuugggaugccaaggcag

SEQ ID NO: 254750 - RNA, 20 nt, Human
gagcagucgugaguuugccc

SEQ ID NO: 254751 - RNA, 24 nt, Human
gaucaccugaggucaggaguuuga

SEQ ID NO: 254752 - RNA, 24 nt, Human
gcuggucaacuuggcgaaaccccg

SEQ ID NO: 254753 - RNA, 21 nt, Human
ggaugccaaggcaggcagauc

SEQ ID NO: 254754 - RNA, 18 nt, Human
ggucaggaaacagaggga

SEQ ID NO: 254755 - RNA, 21 nt, Human
gguccugggcuggucaggagg

SEQ ID NO: 254756 - RNA, 21 nt, Human
ggugccugucuguaaucccag

SEQ ID NO: 254757 - RNA, 23 nt, Human
gguggcucauucuuguaauccca

SEQ ID NO: 254758 - RNA, 24 nt, Human
gguggcucauucuuguaaucccag

SEQ ID NO: 254759 - RNA, 24 nt, Human
gguggugccugucuguaaucccag

SEQ ID NO: 254760 - RNA, 24 nt, Human
gugacagagugagacucugucuca

SEQ ID NO: 254761 - RNA, 24 nt, Human
gugcuugaaccugggaggcagagg

SEQ ID NO: 254762 - RNA, 23 nt, Human
guggcucauucuuguaaucccag

SEQ ID NO: 254763 - RNA, 20 nt, Human
guggugccugucuguaaucc

SEQ ID NO: 254764 - RNA, 23 nt, Human
guggugccugucuguaaucccag

SEQ ID NO: 254765 - RNA, 19 nt, Human
guugcagugagcugagauc

SEQ ID NO: 254766 - RNA, 18 nt, Human
uaagggccccacaacccu

SEQ ID NO: 254767 - RNA, 23 nt, Human
uaagugauguuauuuucuguuuc

SEQ ID NO: 254768 - RNA, 23 nt, Human
uacguggcagagcagcaaacacc

SEQ ID NO: 254769 - RNA, 24 nt, Human
uaggacaggcaugguggcuaauau

SEQ ID NO: 254770 - RNA, 25 nt, Human
uaggccaggcacgguggcucauucu

SEQ ID NO: 254771 - RNA, 21 nt, Human
ucaaaaacaaaaacaaaaaca

SEQ ID NO: 254772 - RNA, 23 nt, Human
ucacaccagugaacugcagccug

SEQ ID NO: 254773 - RNA, 18 nt, Human
ucaccaagauacucacuc

SEQ ID NO: 254774 - RNA, 21 nt, Human
ucauaggucaggaaacagagg

SEQ ID NO: 254775 - RNA, 24 nt, Human
ucaugaucccuuugcuggcucucu

SEQ ID NO: 254776 - RNA, 19 nt, Human
uccaaugagcaccauggag

SEQ ID NO: 254777 - RNA, 20 nt, Human
ucccagcacuuugggaugcc

SEQ ID NO: 254778 - RNA, 22 nt, Human
uccucaaacaauaggcucuaga

SEQ ID NO: 254779 - RNA, 31 nt, Human
ucucaaaaacaaaaacaaaaacaaaaacaaa

SEQ ID NO: 254780 - RNA, 21 nt, Human
ucuguaaucccagcuauucgg

SEQ ID NO: 254781 - RNA, 18 nt, Human
ucuguuggcaggagcagg

SEQ ID NO: 254782 - RNA, 18 nt, Human
ugaacaaagggcgaacgu

SEQ ID NO: 254783 - RNA, 24 nt, Human
ugaaccugggaggcagagguugca

SEQ ID NO: 254784 - RNA, 22 nt, Human
ugaacugcagccugggugacag

SEQ ID NO: 254785 - RNA, 22 nt, Human
ugaaugcccucagcaaaccuuc

SEQ ID NO: 254786 - RNA, 21 nt, Human
ugagguacgagaagugcuuga

SEQ ID NO: 254787 - RNA, 18 nt, Human
ugaggucaggaguuugaa

SEQ ID NO: 254788 - RNA, 19 nt, Human
ugcacacauaauaguagac

SEQ ID NO: 254789 - RNA, 22 nt, Human
ugcagcauccaacaacaauaaa

SEQ ID NO: 254790 - RNA, 24 nt, Human
ugcagccugggugacagagugaga

SEQ ID NO: 254791 - RNA, 21 nt, Human
ugcuugaaccugggaggcaga

SEQ ID NO: 254792 - RNA, 22 nt, Human
uggcagagcagcaaacaccuca

SEQ ID NO: 254793 - RNA, 21 nt, Human
uggcaggagcagucgugaguu

SEQ ID NO: 254794 - RNA, 21 nt, Human
uggcucauucuuguaauccca

SEQ ID NO: 254795 - RNA, 24 nt, Human
uggcucauucuuguaaucccagca

SEQ ID NO: 254796 - RNA, 24 nt, Human
ugggaggcagagguugcagugagc

SEQ ID NO: 254797 - RNA, 24 nt, Human
ugggaugccaaggcaggcagauca

SEQ ID NO: 254798 - RNA, 24 nt, Human
ugguggugccugucuguaauccca

SEQ ID NO: 254799 - RNA, 20 nt, Human
uguaaucccagcacuuuggg

SEQ ID NO: 254800 - RNA, 24 nt, Human
ugucuguaaucccagcuauucggg

SEQ ID NO: 254801 - RNA, 20 nt, Human
uuagcugggugugguggugc

SEQ ID NO: 254802 - RNA, 24 nt, Human
uuagcugggugugguggugccugu

SEQ ID NO: 254803 - RNA, 18 nt, Human
uucuuguaaucccagcac

SEQ ID NO: 254804 - RNA, 23 nt, Human
uucuuguaaucccagcacuuugg

SEQ ID NO: 254805 - RNA, 24 nt, Human
uugaaccugggaggcagagguugc

SEQ ID NO: 254806 - RNA, 18 nt, Human
uugcagugagcugagauc

SEQ ID NO: 254807 - RNA, 19 nt, Human
uugcagugagcugagauca

SEQ ID NO: 254808 - RNA, 20 nt, Human
uugcagugagcugagaucac

SEQ ID NO: 254809 - RNA, 23 nt, Human
uuggcaggagcagucgugaguuu

SEQ ID NO: 254810 - RNA, 19 nt, Human
uuggcgaaaccccgucucu

SEQ ID NO: 254811 - RNA, 18 nt, Human
uuucauaggucaggaaac

SEQ ID NO: 254812 - RNA, 18 nt, Human
aaaacagaauccuaccuc

SEQ ID NO: 254813 - RNA, 19 nt, Human
aaaacagaauccuaccucu

SEQ ID NO: 254814 - RNA, 18 nt, Human
aaaacccaaggaagcuga

SEQ ID NO: 254815 - RNA, 18 nt, Human
aaaacccaaggaagcuga

SEQ ID NO: 254816 - RNA, 18 nt, Human
aaacagaauccuaccucu

SEQ ID NO: 254817 - RNA, 21 nt, Human
aaaccagaguaagaaagccug

SEQ ID NO: 254818 - RNA, 18 nt, Human
aaaggaacuauuaaaagg

SEQ ID NO: 254819 - RNA, 23 nt, Human
aaaggaacuauuaaaaggaaggg

SEQ ID NO: 254820 - RNA, 19 nt, Human
aagccuguuuccuccccua

SEQ ID NO: 254821 - RNA, 21 nt, Human
acaagacacaguaaaaggaga

SEQ ID NO: 254822 - RNA, 18 nt, Human
acuagacuauagagggac

SEQ ID NO: 254823 - RNA, 19 nt, Human
acucagccccggagacaaa

SEQ ID NO: 254824 - RNA, 18 nt, Human
agacaaaaggaaaauuga

SEQ ID NO: 254825 - RNA, 18 nt, Human
agacaaaaggaaaauuga

SEQ ID NO: 254826 - RNA, 24 nt, Human
aggaaaauugauaugggggagcgg

SEQ ID NO: 254827 - RNA, 20 nt, Human
aggaaggauaaguagauucu

SEQ ID NO: 254828 - RNA, 18 nt, Human
aggcaaagcucucuugug

SEQ ID NO: 254829 - RNA, 18 nt, Human
aggcaaagcucucuugug

SEQ ID NO: 254830 - RNA, 21 nt, Human
aguaagaaagccuguuuccuc

SEQ ID NO: 254831 - RNA, 19 nt, Human
auaaaacagaauccuaccu

SEQ ID NO: 254832 - RNA, 19 nt, Human
auaaaacagaauccuaccu

SEQ ID NO: 254833 - RNA, 24 nt, Human
auagauuuuccucuaaauacaaaa

SEQ ID NO: 254834 - RNA, 24 nt, Human
auuguaaacuauacuagacuauag

SEQ ID NO: 254835 - RNA, 19 nt, Human
cagaaccuuucuuuccaac

SEQ ID NO: 254836 - RNA, 22 nt, Human
cagccccggagacaaaaggaaa

SEQ ID NO: 254837 - RNA, 20 nt, Human
cagcuaucagcuuccccauu

SEQ ID NO: 254838 - RNA, 22 nt, Human
cagggcaaaauguggccaaagg

SEQ ID NO: 254839 - RNA, 18 nt, Human
cauacaaaacuacaaaag

SEQ ID NO: 254840 - RNA, 21 nt, Human
caugacccauccggcagggag

SEQ ID NO: 254841 - RNA, 18 nt, Human
ccagaguaagaaagccug

SEQ ID NO: 254842 - RNA, 25 nt, Human
ccccagaaagcagcuccauguggcc

SEQ ID NO: 254843 - RNA, 18 nt, Human
cccgcaagacaaaagcaa

SEQ ID NO: 254844 - RNA, 22 nt, Human
ccggagacaaaaggaaaauuga

SEQ ID NO: 254845 - RNA, 18 nt, Human
cgacaggagcccgcaaga

SEQ ID NO: 254846 - RNA, 20 nt, Human
cgaggugagaagaccuacca

SEQ ID NO: 254847 - RNA, 21 nt, Human
cggcaagguccgagguccaaa

SEQ ID NO: 254848 - RNA, 22 nt, Human
cucagccccggagacaaaagga

SEQ ID NO: 254849 - RNA, 20 nt, Human
cucaguccccuaaauagugg

SEQ ID NO: 254850 - RNA, 20 nt, Human
cucauguuuagaaucccaug

SEQ ID NO: 254851 - RNA, 24 nt, Human
cucuaaauacaaaaaaauuaaaga

SEQ ID NO: 254852 - RNA, 19 nt, Human
cugauguccuggagagcaa

SEQ ID NO: 254853 - RNA, 26 nt, Human
cuucaaauuaaaccagaguaagaaaa

SEQ ID NO: 254854 - RNA, 21 nt, Human
gacaaaagcaacccggcgaaa

SEQ ID NO: 254855 - RNA, 18 nt, Human
gcaagacaaaagcaaccc

SEQ ID NO: 254856 - RNA, 19 nt, Human
gccccggagacaaaaggaa

SEQ ID NO: 254857 - RNA, 20 nt, Human
ggguuugucgacgcggcgca

SEQ ID NO: 254858 - RNA, 23 nt, Human
guuuagaaucccaugacccaucc

SEQ ID NO: 254859 - RNA, 19 nt, Human
uaaaacagaauccuaccuc

SEQ ID NO: 254860 - RNA, 24 nt, Human
uaaaagacaaaucagccugaauuu

SEQ ID NO: 254861 - RNA, 21 nt, Human
uaccaugggaucaucauggga

SEQ ID NO: 254862 - RNA, 22 nt, Human
uagcaaauaguacuuuauacaa

SEQ ID NO: 254863 - RNA, 23 nt, Human
uaggagaacuauuaaauguagug

SEQ ID NO: 254864 - RNA, 24 nt, Human
uauaaaacagaauccuaccucuga

SEQ ID NO: 254865 - RNA, 24 nt, Human
uauaaaacagaauccuaccucuga

SEQ ID NO: 254866 - RNA, 22 nt, Human
uaugcaccaucgaggugagaag

SEQ ID NO: 254867 - RNA, 20 nt, Human
ucaacucuuuucauucucug

SEQ ID NO: 254868 - RNA, 21 nt, Human
ucaacucuuuucauucucugu

SEQ ID NO: 254869 - RNA, 18 nt, Human
ucagcuaugagaagguaa

SEQ ID NO: 254870 - RNA, 21 nt, Human
ucagggccaugugcugauguc

SEQ ID NO: 254871 - RNA, 19 nt, Human
uccccagaaagcagcucca

SEQ ID NO: 254872 - RNA, 25 nt, Human
uccccagaaagcagcuccauguggc

SEQ ID NO: 254873 - RNA, 22 nt, Human
uccccauuuuucccaggauggg

SEQ ID NO: 254874 - RNA, 18 nt, Human
ucgaggugagaagaccua

SEQ ID NO: 254875 - RNA, 23 nt, Human
ucucuuauaaauaaucuauagau

SEQ ID NO: 254876 - RNA, 19 nt, Human
ucucuugugucaucagcaa

SEQ ID NO: 254877 - RNA, 19 nt, Human
ucucuugugucaucagcaa

SEQ ID NO: 254878 - RNA, 21 nt, Human
ugaaccuuacuguuccccaga

SEQ ID NO: 254879 - RNA, 19 nt, Human
ugauaaaagacaaucagcc

SEQ ID NO: 254880 - RNA, 21 nt, Human
ugcaccaucgaggugagaaga

SEQ ID NO: 254881 - RNA, 22 nt, Human
ugccucauguuuagaaucccau

SEQ ID NO: 254882 - RNA, 18 nt, Human
ugggauaucagguaagaa

SEQ ID NO: 254883 - RNA, 25 nt, Human
ugucaucagcaaaacccaaggaagc

SEQ ID NO: 254884 - RNA, 25 nt, Human
ugucaucagcaaaacccaaggaagc

SEQ ID NO: 254885 - RNA, 19 nt, Human
ugugguagugcugaucagg

SEQ ID NO: 254886 - RNA, 22 nt, Human
ugugguagugcugaucagggcc

SEQ ID NO: 254887 - RNA, 22 nt, Human
uguuccccagaaagcagcucca

SEQ ID NO: 254888 - RNA, 23 nt, Human
uguuuccuccccuacuagguuca

SEQ ID NO: 254889 - RNA, 23 nt, Human
uuaaaaggaagggauaaaguaga

SEQ ID NO: 254890 - RNA, 25 nt, Human
uuaauacaagacacaguaaaaggag

SEQ ID NO: 254891 - RNA, 20 nt, Human
uucagagcggaaacaccgaa

SEQ ID NO: 254892 - RNA, 22 nt, Human
uuccugcagcccuaguucuacg

SEQ ID NO: 254893 - RNA, 22 nt, Human
uucucaguccccuaaauagugg

SEQ ID NO: 254894 - RNA, 25 nt, Human
uuggaugugguagugcugaucaggg

SEQ ID NO: 254895 - RNA, 19 nt, Human
uuucauucucugucuugcu

SEQ ID NO: 254896 - RNA, 18 nt, Human
uuugaggcaugaaucuag

SEQ ID NO: 254897 - RNA, 19 nt, Human
uuuguaagcccacagauug

SEQ ID NO: 254898 - RNA, 19 nt, Human
uuuguaagcccacagauug

SEQ ID NO: 254899 - RNA, 20 nt, Human
uuuguaagcccacagauugu

SEQ ID NO: 254900 - RNA, 18 nt, Human
uuuuuuuuuuuuuuuuug

SEQ ID NO: 254901 - RNA, 18 nt, Human
uuuuuuuuuuuuuuuuug

SEQ ID NO: 254902 - RNA, 22 nt, Human
uuuuuuuuuuuuuuuuuggucu

SEQ ID NO: 254903 - RNA, 23 nt, Human
aggcauuaagaaccacggaggcu

SEQ ID NO: 254904 - RNA, 19 nt, Human
ccauagcguucccaggugc

SEQ ID NO: 254905 - RNA, 25 nt, Human
cccauagcguucccaggugccagcc

SEQ ID NO: 254906 - RNA, 21 nt, Human
ccccggucgccgccgccgccg

SEQ ID NO: 254907 - RNA, 22 nt, Human
ccgacgccgcgcagcagccggg

SEQ ID NO: 254908 - RNA, 20 nt, Human
ccgcccgccuucgccgccgc

SEQ ID NO: 254909 - RNA, 21 nt, Human
ccgcccgccuucgccgccgcu

SEQ ID NO: 254910 - RNA, 21 nt, Human
ccgccgcccgccuucgccgcc

SEQ ID NO: 254911 - RNA, 28 nt, Human
ccgccgcccgccuucgccgccgcugccg

SEQ ID NO: 254912 - RNA, 23 nt, Human
cgagcucccgggccccggucgcc

SEQ ID NO: 254913 - RNA, 18 nt, Human
cgccgcuaccacuguagg

SEQ ID NO: 254914 - RNA, 22 nt, Human
cucccgggccccggucgccgcc

SEQ ID NO: 254915 - RNA, 18 nt, Human
cugccgcuaccgucgccg

SEQ ID NO: 254916 - RNA, 23 nt, Human
cugccgcuaccgucgccgacgcc

SEQ ID NO: 254917 - RNA, 22 nt, Human
gaggggaagaacugcugaacua

SEQ ID NO: 254918 - RNA, 22 nt, Human
gccgcuaccgucgccgacgccg

SEQ ID NO: 254919 - RNA, 23 nt, Human
ggaggggaagaacugcugaacua

SEQ ID NO: 254920 - RNA, 18 nt, Human
ucccaggugccagccauc

SEQ ID NO: 254921 - RNA, 23 nt, Human
ucccaggugccagccaucuccuc

SEQ ID NO: 254922 - RNA, 22 nt, Human
ucgccgccgccgccgcuaccac

SEQ ID NO: 254923 - RNA, 27 nt, Human
ucgccgccgcugccgcuaccgucgccg

SEQ ID NO: 254924 - RNA, 23 nt, Human
uguaggaggggaagaacugcuga

SEQ ID NO: 254925 - RNA, 20 nt, Human
uuagugaaaauaguccuccu

SEQ ID NO: 254926 - RNA, 20 nt, Human
uuagugaaaauaguccuccu

SEQ ID NO: 254927 - RNA, 18 nt, Human
uugaacgcuaacuuaggu

SEQ ID NO: 254928 - RNA, 22 nt, Human
ccgcugagcuacgugccugacu

SEQ ID NO: 254929 - RNA, 23 nt, Human
ccgcugagcuacgugccugacuu

SEQ ID NO: 254930 - RNA, 21 nt, Human
cgccgcggccgccgcugagcu

SEQ ID NO: 254931 - RNA, 22 nt, Human
uaaaccguuuauuucuccccac

SEQ ID NO: 254932 - RNA, 21 nt, Human
aaaaaggaauuauugaaaaaa

SEQ ID NO: 254933 - RNA, 19 nt, Human
aaaagacagaaauacucaa

SEQ ID NO: 254934 - RNA, 19 nt, Human
aaacccagagagaaaccca

SEQ ID NO: 254935 - RNA, 21 nt, Human
aaaugcuagagcuguccuacc

SEQ ID NO: 254936 - RNA, 21 nt, Human
aagaaagaaagaaaaaucaaa

SEQ ID NO: 254937 - RNA, 20 nt, Human
aagaagagagaacugcagaa

SEQ ID NO: 254938 - RNA, 22 nt, Human
accacaauauuccugauuaaga

SEQ ID NO: 254939 - RNA, 25 nt, Human
agagaacugcagaacaaucuguaaa

SEQ ID NO: 254940 - RNA, 18 nt, Human
agccaagugacagaauga

SEQ ID NO: 254941 - RNA, 24 nt, Human
auauaaaagcuuccuguaaucaag

SEQ ID NO: 254942 - RNA, 20 nt, Human
aucacaauucuaucucagug

SEQ ID NO: 254943 - RNA, 22 nt, Human
cagaacuauuuacaaagaaaga

SEQ ID NO: 254944 - RNA, 24 nt, Human
cagaaugaaaaaguuagcuaagca

SEQ ID NO: 254945 - RNA, 23 nt, Human
cagagugauacucccagcuuacc

SEQ ID NO: 254946 - RNA, 22 nt, Human
cagauuccuaaagaauuaaaaa

SEQ ID NO: 254947 - RNA, 18 nt, Human
cagggccagcuguuucuc

SEQ ID NO: 254948 - RNA, 20 nt, Human
cauuguacuuuccgacuugc

SEQ ID NO: 254949 - RNA, 20 nt, Human
ccugaggaaaagaagagaga

SEQ ID NO: 254950 - RNA, 27 nt, Human
ccuguaaucaaggaauugccggggucc

SEQ ID NO: 254951 - RNA, 23 nt, Human
cucccagcuuaccacaauauucc

SEQ ID NO: 254952 - RNA, 21 nt, Human
gaaaagacagaaauacucaag

SEQ ID NO: 254953 - RNA, 20 nt, Human
gauucuaacuaucugacuug

SEQ ID NO: 254954 - RNA, 26 nt, Human
guaaaaaggaauuauugaaaaaaugu

SEQ ID NO: 254955 - RNA, 20 nt, Human
uaaaagcuuccuguaaucaa

SEQ ID NO: 254956 - RNA, 21 nt, Human
uaagaaaaugcuagagcuguc

SEQ ID NO: 254957 - RNA, 24 nt, Human
uaagaaaaugcuagagcuguccua

SEQ ID NO: 254958 - RNA, 22 nt, Human
uacaaagaaagaaagaaaaauc

SEQ ID NO: 254959 - RNA, 21 nt, Human
uaccacaauauuccugauuaa

SEQ ID NO: 254960 - RNA, 19 nt, Human
uaccugaggaaaagaagag

SEQ ID NO: 254961 - RNA, 18 nt, Human
uauagcaaauacuuucac

SEQ ID NO: 254962 - RNA, 27 nt, Human
uauuucauaaauaaauaccaaaaauau

SEQ ID NO: 254963 - RNA, 25 nt, Human
uauuuuguuacuccagcacuuuuca

SEQ ID NO: 254964 - RNA, 26 nt, Human
ucagaacuauuuacaaagaaagaaag

SEQ ID NO: 254965 - RNA, 23 nt, Human
uccaaacauauaauaauuuaaga

SEQ ID NO: 254966 - RNA, 22 nt, Human
uccaaacccagagagaaaccca

SEQ ID NO: 254967 - RNA, 21 nt, Human
uccuagacaguucaaucaagu

SEQ ID NO: 254968 - RNA, 24 nt, Human
uccugauuaagaaaaugcuagagc

SEQ ID NO: 254969 - RNA, 24 nt, Human
ugaaaagacagaaauacucaagua

SEQ ID NO: 254970 - RNA, 20 nt, Human
ugcagauuccuaaagaauua

SEQ ID NO: 254971 - RNA, 23 nt, Human
uuacaaagaaagaaagaaaaauc

SEQ ID NO: 254972 - RNA, 22 nt, Human
uucaaauucucaucuggagaug

SEQ ID NO: 254973 - RNA, 18 nt, Human
uuuaaagucacaagaauu

SEQ ID NO: 254974 - RNA, 19 nt, Human
uuuuuuuuuuuuuuuuuaa

SEQ ID NO: 254975 - RNA, 18 nt, Human
aaaaaaaaaaaaaacaac

SEQ ID NO: 254976 - RNA, 22 nt, Human
aaaaaaaaaaaaaacaaccaca

SEQ ID NO: 254977 - RNA, 18 nt, Human
aaaaaaaaaaaacaaccc

SEQ ID NO: 254978 - RNA, 20 nt, Human
aaaccccuccacguaaacuc

SEQ ID NO: 254979 - RNA, 18 nt, Human
aaagaaguacaugccccu

SEQ ID NO: 254980 - RNA, 19 nt, Human
agcaaaaggaaaaaaaaaa

SEQ ID NO: 254981 - RNA, 19 nt, Human
auaaagaaguacaugcccc

SEQ ID NO: 254982 - RNA, 18 nt, Human
cccuccacguaaacucag

SEQ ID NO: 254983 - RNA, 19 nt, Human
cucuuucuucaucuagggg

SEQ ID NO: 254984 - RNA, 26 nt, Human
gaaaaaaaaaaaaaaaacaaccacau

SEQ ID NO: 254985 - RNA, 26 nt, Human
ucagaagcuuucuacucccucuauuc

SEQ ID NO: 254986 - RNA, 21 nt, Human
ucucuuucuucaucuaggggc

SEQ ID NO: 254987 - RNA, 19 nt, Human
aagcgaacaaugaaaucag

SEQ ID NO: 254988 - RNA, 23 nt, Human
aagcgaacaaugaaaucagaaac

SEQ ID NO: 254989 - RNA, 23 nt, Human
aaguucuaccaguuuaaaguuuu

SEQ ID NO: 254990 - RNA, 22 nt, Human
agaauuacagaagcgaacaaug

SEQ ID NO: 254991 - RNA, 28 nt, Human
cacagcuguagcauuuauaacaaaguca

SEQ ID NO: 254992 - RNA, 19 nt, Human
ccugcugcuuucgcuggga

SEQ ID NO: 254993 - RNA, 23 nt, Human
cuagcaccagagcagucccuucc

SEQ ID NO: 254994 - RNA, 22 nt, Human
gaagcgaacaaugaaaucagaa

SEQ ID NO: 254995 - RNA, 23 nt, Human
gaagcgaacaaugaaaucagaaa

SEQ ID NO: 254996 - RNA, 19 nt, Human
uagcauuuauaacaaaguc

SEQ ID NO: 254997 - RNA, 21 nt, Human
ugaaaucagaaacaagcucuc

SEQ ID NO: 254998 - RNA, 22 nt, Human
ugaaaucagaaacaagcucuca

SEQ ID NO: 254999 - RNA, 25 nt, Human
uuuuucagaauuacagaagcgaaca

SEQ ID NO: 255000 - RNA, 22 nt, Human
aaacucucagugacagagaucc

SEQ ID NO: 255001 - RNA, 19 nt, Human
aagcagccuggucaccaga

SEQ ID NO: 255002 - RNA, 19 nt, Human
agaugcagugauucacacc

SEQ ID NO: 255003 - RNA, 19 nt, Human
agaugugaucgcuucccca

SEQ ID NO: 255004 - RNA, 24 nt, Human
agcauuaaaggcauucuaugagcu

SEQ ID NO: 255005 - RNA, 19 nt, Human
agggggacuguuugagccc

SEQ ID NO: 255006 - RNA, 19 nt, Human
agucugggcaauauaguga

SEQ ID NO: 255007 - RNA, 24 nt, Human
agucugggcaauauagugagaccu

SEQ ID NO: 255008 - RNA, 25 nt, Human
agucugggcaauauagugagaccuc

SEQ ID NO: 255009 - RNA, 19 nt, Human
agugauucacaccuguaau

SEQ ID NO: 255010 - RNA, 22 nt, Human
auuccaucacuuugggaggcca

SEQ ID NO: 255011 - RNA, 24 nt, Human
cacaccuguaauuccaucacuuug

SEQ ID NO: 255012 - RNA, 21 nt, Human
caccagaugugaucgcuuccc

SEQ ID NO: 255013 - RNA, 19 nt, Human
caccuguaauuccaucacu

SEQ ID NO: 255014 - RNA, 24 nt, Human
caccuguaauuccaucacuuuggg

SEQ ID NO: 255015 - RNA, 21 nt, Human
caucacuuugggaggccaacg

SEQ ID NO: 255016 - RNA, 24 nt, Human
caucacuuugggaggccaacgcag

SEQ ID NO: 255017 - RNA, 22 nt, Human
cauucuaugagcuccuuuagcc

SEQ ID NO: 255018 - RNA, 25 nt, Human
ccaggaguucgagaccagucugggc

SEQ ID NO: 255019 - RNA, 18 nt, Human
cccacaacaaccuugaga

SEQ ID NO: 255020 - RNA, 24 nt, Human
cgagaccagucugggcaauauagu

SEQ ID NO: 255021 - RNA, 23 nt, Human
cuccaagauuugcagcucacaga

SEQ ID NO: 255022 - RNA, 22 nt, Human
cucccacaacaaccuugagaac

SEQ ID NO: 255023 - RNA, 21 nt, Human
cuguuugagcccaggaguucg

SEQ ID NO: 255024 - RNA, 24 nt, Human
cuuguuugcucuggcaaugucucu

SEQ ID NO: 255025 - RNA, 25 nt, Human
gaaugugguuggagugucccacuuc

SEQ ID NO: 255026 - RNA, 20 nt, Human
gcccaggaguucgagaccag

SEQ ID NO: 255027 - RNA, 21 nt, Human
gcuguaguaagcuucuccuuu

SEQ ID NO: 255028 - RNA, 20 nt, Human
ggaggccaacgcagggggac

SEQ ID NO: 255029 - RNA, 26 nt, Human
guaguaagcuucuccuuuuccaauuu

SEQ ID NO: 255030 - RNA, 22 nt, Human
guuugagcccaggaguucgaga

SEQ ID NO: 255031 - RNA, 23 nt, Human
uaagcuucuccuuuuccaauuuu

SEQ ID NO: 255032 - RNA, 23 nt, Human
ucacaccuguaauuccaucacuu

SEQ ID NO: 255033 - RNA, 24 nt, Human
ucacaccuguaauuccaucacuuu

SEQ ID NO: 255034 - RNA, 23 nt, Human
ucucccacaacaaccuugagaac

SEQ ID NO: 255035 - RNA, 24 nt, Human
ucucccacaacaaccuugagaacc

SEQ ID NO: 255036 - RNA, 19 nt, Human
ucucugguuuuugcuccaa

SEQ ID NO: 255037 - RNA, 20 nt, Human
ucucugguuuuugcuccaag

SEQ ID NO: 255038 - RNA, 21 nt, Human
ucucugguuuuugcuccaaga

SEQ ID NO: 255039 - RNA, 22 nt, Human
ugaagcagccuggucaccagau

SEQ ID NO: 255040 - RNA, 23 nt, Human
ugagcccaggaguucgagaccag

SEQ ID NO: 255041 - RNA, 20 nt, Human
ugcucuggcaaugucucugg

SEQ ID NO: 255042 - RNA, 18 nt, Human
uggaauuggcaaucuuuu

SEQ ID NO: 255043 - RNA, 18 nt, Human
uggcaaugucucugguuu

SEQ ID NO: 255044 - RNA, 20 nt, Human
uguuugcuaaguuaaggcuu

SEQ ID NO: 255045 - RNA, 20 nt, Human
uuaaacauuugugauuugau

SEQ ID NO: 255046 - RNA, 19 nt, Human
uuggauuagcauuaaaggc

SEQ ID NO: 255047 - RNA, 23 nt, Human
uuugagcccaggaguucgagacc

SEQ ID NO: 255048 - RNA, 22 nt, Human
uuuggaauuggcaaucuuuuuc

SEQ ID NO: 255049 - RNA, 20 nt, Human
aaaagugcaacucugccccc

SEQ ID NO: 255050 - RNA, 19 nt, Human
aacaguguugaacucuggc

SEQ ID NO: 255051 - RNA, 19 nt, Human
aaccccuucccuuccacag

SEQ ID NO: 255052 - RNA, 25 nt, Human
aaguaauccuccugccucagcuuuc

SEQ ID NO: 255053 - RNA, 25 nt, Human
aagugauccucccaccucaaccucc

SEQ ID NO: 255054 - RNA, 19 nt, Human
acccguuucgucccaccgu

SEQ ID NO: 255055 - RNA, 20 nt, Human
accucaaccuccugaguagc

SEQ ID NO: 255056 - RNA, 18 nt, Human
acuggauugcaugguggc

SEQ ID NO: 255057 - RNA, 21 nt, Human
aguagcugggaauacaggcau

SEQ ID NO: 255058 - RNA, 23 nt, Human
aguagcugggaauacaggcaugc

SEQ ID NO: 255059 - RNA, 20 nt, Human
caaguaauccuccugccuca

SEQ ID NO: 255060 - RNA, 22 nt, Human
caaguaauccuccugccucagc

SEQ ID NO: 255061 - RNA, 27 nt, Human
caaguaauccuccugccucagcuuucu

SEQ ID NO: 255062 - RNA, 27 nt, Human
caagugauccucccaccucaaccuccu

SEQ ID NO: 255063 - RNA, 19 nt, Human
caccaccaugccuaauuuu

SEQ ID NO: 255064 - RNA, 20 nt, Human
caccaugccuaauuuuuuag

SEQ ID NO: 255065 - RNA, 20 nt, Human
caccggcacggacgggaguc

SEQ ID NO: 255066 - RNA, 24 nt, Human
caccucaaccuccugaguagcugg

SEQ ID NO: 255067 - RNA, 18 nt, Human
caccugauuccccagggc

SEQ ID NO: 255068 - RNA, 23 nt, Human
cacugaagccucacuggauugca

SEQ ID NO: 255069 - RNA, 22 nt, Human
cacugggucucccugugugccu

SEQ ID NO: 255070 - RNA, 20 nt, Human
cauggcucauugcagccuug

SEQ ID NO: 255071 - RNA, 22 nt, Human
cauuuacaucugcaucugcaaa

SEQ ID NO: 255072 - RNA, 20 nt, Human
ccagauuuucaagagcaacg

SEQ ID NO: 255073 - RNA, 24 nt, Human
ccagggccugggcuagcacaaagg

SEQ ID NO: 255074 - RNA, 21 nt, Human
cccggacccgccgggcuccug

SEQ ID NO: 255075 - RNA, 21 nt, Human
cccugugugccucagcuaggg

SEQ ID NO: 255076 - RNA, 20 nt, Human
ccggacccgccgggcuccuc

SEQ ID NO: 255077 - RNA, 23 nt, Human
ccuaccauuuugguugcuguaca

SEQ ID NO: 255078 - RNA, 23 nt, Human
ccuaugaucagaucacaucuguu

SEQ ID NO: 255079 - RNA, 21 nt, Human
ccucagcuagggcagggcagg

SEQ ID NO: 255080 - RNA, 24 nt, Human
ccucagcuagggcagggcaggggc

SEQ ID NO: 255081 - RNA, 24 nt, Human
ccucccaccucaaccuccugagua

SEQ ID NO: 255082 - RNA, 24 nt, Human
ccuccugccucagcuuucugaauu

SEQ ID NO: 255083 - RNA, 23 nt, Human
ccugaguagcugggaauacaggc

SEQ ID NO: 255084 - RNA, 22 nt, Human
ccuugaacuucugggcucaagu

SEQ ID NO: 255085 - RNA, 22 nt, Human
cggcacggacgggagucccgga

SEQ ID NO: 255086 - RNA, 24 nt, Human
cucaaguaauccuccugccucagc

SEQ ID NO: 255087 - RNA, 24 nt, Human
cucaagugauccucccaccucaac

SEQ ID NO: 255088 - RNA, 19 nt, Human
cucauugcagccuugaacu

SEQ ID NO: 255089 - RNA, 23 nt, Human
cuccugccucagcuuucugaauu

SEQ ID NO: 255090 - RNA, 19 nt, Human
cugccucagcuuucugaau

SEQ ID NO: 255091 - RNA, 21 nt, Human
cuucaagaccucccuaccauu

SEQ ID NO: 255092 - RNA, 22 nt, Human
cuucaagaccucccuaccauuu

SEQ ID NO: 255093 - RNA, 23 nt, Human
cuucugggcucaagugauccucc

SEQ ID NO: 255094 - RNA, 20 nt, Human
gaaaagugcaacucugcccc

SEQ ID NO: 255095 - RNA, 24 nt, Human
gaacuucugggcucaagugauccu

SEQ ID NO: 255096 - RNA, 24 nt, Human
gaauacaggcaugcaccaccaugc

SEQ ID NO: 255097 - RNA, 24 nt, Human
gaauugcugggauuaucggcauga

SEQ ID NO: 255098 - RNA, 22 nt, Human
gagucccggacccgccgggcuc

SEQ ID NO: 255099 - RNA, 18 nt, Human
gauuaucggcaugagcca

SEQ ID NO: 255100 - RNA, 19 nt, Human
gauuaucggcaugagccac

SEQ ID NO: 255101 - RNA, 21 nt, Human
gauuaucggcaugagccacug

SEQ ID NO: 255102 - RNA, 23 nt, Human
gcaugguggcuuccccaaauucc

SEQ ID NO: 255103 - RNA, 23 nt, Human
gcccccuggugguuugcagcucu

SEQ ID NO: 255104 - RNA, 21 nt, Human
gccggcgcccgcaccggcacg

SEQ ID NO: 255105 - RNA, 24 nt, Human
gccucagcuuucugaauugcuggg

SEQ ID NO: 255106 - RNA, 18 nt, Human
gcucaagugauccuccca

SEQ ID NO: 255107 - RNA, 20 nt, Human
ggcaugagccacugugccca

SEQ ID NO: 255108 - RNA, 19 nt, Human
ggcucaagugauccuccca

SEQ ID NO: 255109 - RNA, 20 nt, Human
gggcaggggcucuugugcgu

SEQ ID NO: 255110 - RNA, 22 nt, Human
gggcucaagugauccucccacc

SEQ ID NO: 255111 - RNA, 19 nt, Human
guaauccuccugccucagc

SEQ ID NO: 255112 - RNA, 20 nt, Human
gucccggacccgccgggcuc

SEQ ID NO: 255113 - RNA, 19 nt, Human
uaaaaugaggacaaaccua

SEQ ID NO: 255114 - RNA, 22 nt, Human
uacaggcaugcaccaccaugcc

SEQ ID NO: 255115 - RNA, 20 nt, Human
uagagauggggucuugcuau

SEQ ID NO: 255116 - RNA, 22 nt, Human
uagcugaguacaaauauuugaa

SEQ ID NO: 255117 - RNA, 23 nt, Human
uauauugcccagucuggccucaa

SEQ ID NO: 255118 - RNA, 24 nt, Human
ucauugcagccuugaacuucuggg

SEQ ID NO: 255119 - RNA, 24 nt, Human
uccacagaguuuaguuuccucauu

SEQ ID NO: 255120 - RNA, 21 nt, Human
uccccaaauuccguaugccuu

SEQ ID NO: 255121 - RNA, 24 nt, Human
uccugaguagcugggaauacaggc

SEQ ID NO: 255122 - RNA, 25 nt, Human
ucuggcaugccauggugcauggugg

SEQ ID NO: 255123 - RNA, 23 nt, Human
ucuggccucaaguaauccuccug

SEQ ID NO: 255124 - RNA, 22 nt, Human
ucugggcucaagugauccuccc

SEQ ID NO: 255125 - RNA, 23 nt, Human
ucuugcuauauugcccagucugg

SEQ ID NO: 255126 - RNA, 23 nt, Human
ugaguacaaauauuugaaauaag

SEQ ID NO: 255127 - RNA, 18 nt, Human
ugccauggugcauggugg

SEQ ID NO: 255128 - RNA, 24 nt, Human
ugccucagcuuucugaauugcugg

SEQ ID NO: 255129 - RNA, 23 nt, Human
ugccuuaggauaugaugcuuggc

SEQ ID NO: 255130 - RNA, 20 nt, Human
ugcuauaaaucccucauugg

SEQ ID NO: 255131 - RNA, 20 nt, Human
ugcugggauuaucggcauga

SEQ ID NO: 255132 - RNA, 18 nt, Human
uggcaaguuuuaaaaugu

SEQ ID NO: 255133 - RNA, 18 nt, Human
uggccucaaguaauccuc

SEQ ID NO: 255134 - RNA, 24 nt, Human
uggccucaaguaauccuccugccu

SEQ ID NO: 255135 - RNA, 25 nt, Human
uggcucauugcagccuugaacuucu

SEQ ID NO: 255136 - RNA, 24 nt, Human
ugggaauacaggcaugcaccacca

SEQ ID NO: 255137 - RNA, 22 nt, Human
ugggauuaucggcaugagccac

SEQ ID NO: 255138 - RNA, 22 nt, Human
ugggauuaucggcaugagccac

SEQ ID NO: 255139 - RNA, 24 nt, Human
ugggauuaucggcaugagccacug

SEQ ID NO: 255140 - RNA, 24 nt, Human
ugggcucaagugauccucccaccu

SEQ ID NO: 255141 - RNA, 23 nt, Human
uggggucuugcuauauugcccag

SEQ ID NO: 255142 - RNA, 24 nt, Human
ugguguaaucauggcucauugcag

SEQ ID NO: 255143 - RNA, 25 nt, Human
uguaugaggccccuggcaguuucug

SEQ ID NO: 255144 - RNA, 20 nt, Human
uuagugcuccuuuuaauaau

SEQ ID NO: 255145 - RNA, 21 nt, Human
uuagugcuccuuuuaauaauu

SEQ ID NO: 255146 - RNA, 22 nt, Human
uuccacagaguuuaguuuccuc

SEQ ID NO: 255147 - RNA, 30 nt, Human
uuccuuuagugcuccuuuuaauaauuuuaa

SEQ ID NO: 255148 - RNA, 21 nt, Human
uugcagcucucuauucaagau

SEQ ID NO: 255149 - RNA, 18 nt, Human
uugcccagucuggccuca

SEQ ID NO: 255150 - RNA, 19 nt, Human
uuuuuuuuuuuuaagaguc

SEQ ID NO: 255151 - RNA, 21 nt, Human
uuuuuuuuuuuuuuuuuuaag

SEQ ID NO: 255152 - RNA, 24 nt, Human
aaaauucuaaaaauaaaauauauc

SEQ ID NO: 255153 - RNA, 21 nt, Human
aagauggacuggcaaagagaa

SEQ ID NO: 255154 - RNA, 20 nt, Human
aauucaguucacagauacug

SEQ ID NO: 255155 - RNA, 22 nt, Human
agaaagcuaaagucugugguga

SEQ ID NO: 255156 - RNA, 26 nt, Human
agucuguggugaauucaguucacaga

SEQ ID NO: 255157 - RNA, 24 nt, Human
aucaaguuuccccugaauaaaaau

SEQ ID NO: 255158 - RNA, 20 nt, Human
gcaaaauccucuugcucaga

SEQ ID NO: 255159 - RNA, 21 nt, Human
gcaaaauccucuugcucagaa

SEQ ID NO: 255160 - RNA, 22 nt, Human
ggcauaaaaaucucaaaucaag

SEQ ID NO: 255161 - RNA, 18 nt, Human
uaaaauauauccugggcu

SEQ ID NO: 255162 - RNA, 22 nt, Human
ucacaggcauaaaaaucucaaa

SEQ ID NO: 255163 - RNA, 24 nt, Human
ucacaggcauaaaaaucucaaauc

SEQ ID NO: 255164 - RNA, 31 nt, Human
ucauauuaaaggaaaauuaucaagaaaaccc

SEQ ID NO: 255165 - RNA, 19 nt, Human
ugauaaagcaugaaaaaaa

SEQ ID NO: 255166 - RNA, 19 nt, Human
uguaaaauagaauauacaa

SEQ ID NO: 255167 - RNA, 23 nt, Human
uuaaaggaaaauuaucaagaaaa

SEQ ID NO: 255168 - RNA, 23 nt, Human
uuccaaggaagucacaggcauuu

SEQ ID NO: 255169 - RNA, 26 nt, Human
aaaaaagaaaaagaaacauuuagaaa

SEQ ID NO: 255170 - RNA, 24 nt, Human
aaaaagaaaaagaaacauuuagaa

SEQ ID NO: 255171 - RNA, 26 nt, Human
aaaaagaaaacaaacuauauggaaaa

SEQ ID NO: 255172 - RNA, 23 nt, Human
aaaacacuggagcacacgguaua

SEQ ID NO: 255173 - RNA, 23 nt, Human
aaaacacuggagcacacgguaua

SEQ ID NO: 255174 - RNA, 23 nt, Human
aaaagaaaaagaaacauuuagaa

SEQ ID NO: 255175 - RNA, 25 nt, Human
aaaagaaaacaaacuauauggaaaa

SEQ ID NO: 255176 - RNA, 23 nt, Human
aagaaaaagaaacauuuagaaaa

SEQ ID NO: 255177 - RNA, 27 nt, Human
aaugcucauuuauucucaaguacuugu

SEQ ID NO: 255178 - RNA, 21 nt, Human
acaacacaagaaaacacugga

SEQ ID NO: 255179 - RNA, 19 nt, Human
acaagacagaaaaagaaaa

SEQ ID NO: 255180 - RNA, 20 nt, Human
acacauuaccaaaguggacc

SEQ ID NO: 255181 - RNA, 28 nt, Human
accuacaagacagaaaaagaaaacaaac

SEQ ID NO: 255182 - RNA, 22 nt, Human
acgccgaaccacccccuccagc

SEQ ID NO: 255183 - RNA, 25 nt, Human
acgccgaaccacccccuccagcucc

SEQ ID NO: 255184 - RNA, 26 nt, Human
agaaaaagaaacauuuagaaaacuau

SEQ ID NO: 255185 - RNA, 21 nt, Human
agaaaacaacacaagaaaaca

SEQ ID NO: 255186 - RNA, 25 nt, Human
agaaaacaacacaagaaaacacugg

SEQ ID NO: 255187 - RNA, 25 nt, Human
agacagaaaaagaaaacaaacuaua

SEQ ID NO: 255188 - RNA, 26 nt, Human
agacagaaaaagaaaacaaacuauau

SEQ ID NO: 255189 - RNA, 25 nt, Human
agacagaaaaagaaaacaaagggac

SEQ ID NO: 255190 - RNA, 26 nt, Human
agacagaaaaagaaaacaaagggacc

SEQ ID NO: 255191 - RNA, 21 nt, Human
agagaaaacaacacaagaaaa

SEQ ID NO: 255192 - RNA, 23 nt, Human
agagaaaacaacacaagaaaaca

SEQ ID NO: 255193 - RNA, 20 nt, Human
agccugaggcgagagcuaau

SEQ ID NO: 255194 - RNA, 18 nt, Human
aguugaagggagaacugu

SEQ ID NO: 255195 - RNA, 19 nt, Human
auggaaaaagccugaggcg

SEQ ID NO: 255196 - RNA, 21 nt, Human
augugagccaacuuaccuaca

SEQ ID NO: 255197 - RNA, 18 nt, Human
auuacaugaugugagcca

SEQ ID NO: 255198 - RNA, 19 nt, Human
caacaucaggaaaguagag

SEQ ID NO: 255199 - RNA, 22 nt, Human
caacggcccccacgccgaacca

SEQ ID NO: 255200 - RNA, 19 nt, Human
caagaaaacacuggagcac

SEQ ID NO: 255201 - RNA, 25 nt, Human
caagaaaacacuggagcacacggua

SEQ ID NO: 255202 - RNA, 18 nt, Human
cacccccuccagcuccgc

SEQ ID NO: 255203 - RNA, 20 nt, Human
cacccccuccagcuccgccc

SEQ ID NO: 255204 - RNA, 21 nt, Human
cacgccgaaccacccccucca

SEQ ID NO: 255205 - RNA, 26 nt, Human
cacgccgaaccacccccuccagcucc

SEQ ID NO: 255206 - RNA, 23 nt, Human
cagaaaaguugugaucagagaaa

SEQ ID NO: 255207 - RNA, 20 nt, Human
caguugaagggagaacuguu

SEQ ID NO: 255208 - RNA, 23 nt, Human
ccaacggcccccacgccgaacca

SEQ ID NO: 255209 - RNA, 22 nt, Human
ccagucaugaaauaaugauccc

SEQ ID NO: 255210 - RNA, 23 nt, Human
ccagucaugaaauaaugaucccc

SEQ ID NO: 255211 - RNA, 22 nt, Human
ccccacgccgaaccacccccuc

SEQ ID NO: 255212 - RNA, 22 nt, Human
ccccacgccgaaccacccccuc

SEQ ID NO: 255213 - RNA, 23 nt, Human
cccccacgccgaaccacccccuc

SEQ ID NO: 255214 - RNA, 18 nt, Human
ccccuccagcuccgcccc

SEQ ID NO: 255215 - RNA, 18 nt, Human
cgcauuguuccacuuucc

SEQ ID NO: 255216 - RNA, 23 nt, Human
cgccgaaccacccccuccagcuc

SEQ ID NO: 255217 - RNA, 24 nt, Human
cggcccccacgccgaaccaccccc

SEQ ID NO: 255218 - RNA, 21 nt, Human
cuacaagacagaaaaagaaaa

SEQ ID NO: 255219 - RNA, 24 nt, Human
cucaaguacuugugcaaggcugau

SEQ ID NO: 255220 - RNA, 20 nt, Human
cuguucauccuucuagaacc

SEQ ID NO: 255221 - RNA, 21 nt, Human
cuuaaaacgcuaaaccucaga

SEQ ID NO: 255222 - RNA, 24 nt, Human
gaaaacacuggagcacacgguaua

SEQ ID NO: 255223 - RNA, 23 nt, Human
gaaaauaaugaaaaccagguagc

SEQ ID NO: 255224 - RNA, 24 nt, Human
ggaaaauaaugaaaaccagguagc

SEQ ID NO: 255225 - RNA, 18 nt, Human
ggaacgcaccagucauga

SEQ ID NO: 255226 - RNA, 23 nt, Human
ggcccccacgccgaaccaccccc

SEQ ID NO: 255227 - RNA, 23 nt, Human
uacaagacagaaaaagaaaacaa

SEQ ID NO: 255228 - RNA, 20 nt, Human
ucaaaaaagaaaaagaaaca

SEQ ID NO: 255229 - RNA, 23 nt, Human
ucagagaaaacaacacaagaaaa

SEQ ID NO: 255230 - RNA, 26 nt, Human
uccuacaaccgacgcauuguuccacu

SEQ ID NO: 255231 - RNA, 19 nt, Human
uccucaucucuuugacaca

SEQ ID NO: 255232 - RNA, 22 nt, Human
ucuuuaauugcugaaugccucu

SEQ ID NO: 255233 - RNA, 19 nt, Human
ugaagggagaacuguucau

SEQ ID NO: 255234 - RNA, 24 nt, Human
ugcacacucaaaaaagaaaaagaa

SEQ ID NO: 255235 - RNA, 19 nt, Human
ugcccuaacuuuagacaug

SEQ ID NO: 255236 - RNA, 21 nt, Human
ugcccuaacuuuagacauguu

SEQ ID NO: 255237 - RNA, 18 nt, Human
uggaagaucauuauuuag

SEQ ID NO: 255238 - RNA, 21 nt, Human
ugggaaaauaaugaaaaccag

SEQ ID NO: 255239 - RNA, 21 nt, Human
uuggaaaguaugaauaucuaa

SEQ ID NO: 255240 - RNA, 20 nt, Human
uuugcaaaccgcuaaaaguc

SEQ ID NO: 255241 - RNA, 25 nt, Human
uuuuuuuuuuuuuaaaaaaugcuca

SEQ ID NO: 255242 - RNA, 20 nt, Human
aaaaaguaaaaacagcuugu

SEQ ID NO: 255243 - RNA, 24 nt, Human
aaaaguauucccaagagaccaagg

SEQ ID NO: 255244 - RNA, 23 nt, Human
aaacaaacguggagacagggcac

SEQ ID NO: 255245 - RNA, 19 nt, Human
aacacagagaggacagggg

SEQ ID NO: 255246 - RNA, 22 nt, Human
aacagcccuguaaaaugaaaac

SEQ ID NO: 255247 - RNA, 23 nt, Human
aacauuuuuaacccaucaucaac

SEQ ID NO: 255248 - RNA, 21 nt, Human
aagaaaacaggcgggagcaga

SEQ ID NO: 255249 - RNA, 21 nt, Human
aagaagccucccuuaagcuga

SEQ ID NO: 255250 - RNA, 25 nt, Human
aagagaccaaggcaagccacgaguc

SEQ ID NO: 255251 - RNA, 23 nt, Human
aagcaaauuuacaacucuuccac

SEQ ID NO: 255252 - RNA, 23 nt, Human
aaucccuguacccuuugcagccc

SEQ ID NO: 255253 - RNA, 20 nt, Human
aaucguggcugaaggugcuu

SEQ ID NO: 255254 - RNA, 20 nt, Human
aaugacaggaaagcuggaga

SEQ ID NO: 255255 - RNA, 19 nt, Human
acaaacgacgacacagugu

SEQ ID NO: 255256 - RNA, 18 nt, Human
accagggugagaaaaggu

SEQ ID NO: 255257 - RNA, 20 nt, Human
accagggugagaaaaggugc

SEQ ID NO: 255258 - RNA, 24 nt, Human
acuuguaauuuaugacaaaaacug

SEQ ID NO: 255259 - RNA, 19 nt, Human
agaaagaaaacaggcggga

SEQ ID NO: 255260 - RNA, 19 nt, Human
agacagggcacugcccgca

SEQ ID NO: 255261 - RNA, 23 nt, Human
agacaggugaucugggggauggc

SEQ ID NO: 255262 - RNA, 18 nt, Human
agacccagcaaauccaaa

SEQ ID NO: 255263 - RNA, 21 nt, Human
agacuccuucacaaagcccuu

SEQ ID NO: 255264 - RNA, 18 nt, Human
agaggacagggggcaaag

SEQ ID NO: 255265 - RNA, 24 nt, Human
agaugaacgaguuauaucuacaag

SEQ ID NO: 255266 - RNA, 21 nt, Human
agauguccccucccugcccuu

SEQ ID NO: 255267 - RNA, 19 nt, Human
agccugggacccugagauu

SEQ ID NO: 255268 - RNA, 18 nt, Human
aggaaaggacaucaaaaa

SEQ ID NO: 255269 - RNA, 26 nt, Human
aggaagcauuuaugccucacaccuuu

SEQ ID NO: 255270 - RNA, 23 nt, Human
aggaggagccggcgccgcgcuca

SEQ ID NO: 255271 - RNA, 22 nt, Human
aggcaaacaaacgacgacacag

SEQ ID NO: 255272 - RNA, 24 nt, Human
aggcaggagaugguagguacagag

SEQ ID NO: 255273 - RNA, 21 nt, Human
aggccacuugucgaaccaccg

SEQ ID NO: 255274 - RNA, 26 nt, Human
aggcgaaaaaguaaaaacaggggacc

SEQ ID NO: 255275 - RNA, 27 nt, Human
aggcuucauucugcaaagcugagggca

SEQ ID NO: 255276 - RNA, 20 nt, Human
agucacuccuuacagaaagu

SEQ ID NO: 255277 - RNA, 21 nt, Human
aguuaaggcugcuguagggug

SEQ ID NO: 255278 - RNA, 18 nt, Human
aucguggcugaaggugcu

SEQ ID NO: 255279 - RNA, 21 nt, Human
augaacaaaacuuacaacccc

SEQ ID NO: 255280 - RNA, 18 nt, Human
auggguggguauuuguuc

SEQ ID NO: 255281 - RNA, 19 nt, Human
auuggacaucuccuguggc

SEQ ID NO: 255282 - RNA, 19 nt, Human
auuugucagaucucucccu

SEQ ID NO: 255283 - RNA, 26 nt, Human
auuugucagaucucucccucccccag

SEQ ID NO: 255284 - RNA, 21 nt, Human
caaagugccucugcuaagagc

SEQ ID NO: 255285 - RNA, 21 nt, Human
caaccccaggaggggagccag

SEQ ID NO: 255286 - RNA, 23 nt, Human
caacucuuccacugggacgauua

SEQ ID NO: 255287 - RNA, 19 nt, Human
caagagaccaaggcaagcc

SEQ ID NO: 255288 - RNA, 19 nt, Human
cacagggcacauuuugggg

SEQ ID NO: 255289 - RNA, 22 nt, Human
cacgagucauucuccaaagcac

SEQ ID NO: 255290 - RNA, 23 nt, Human
cagaacaauuccaggcaaacuaa

SEQ ID NO: 255291 - RNA, 18 nt, Human
cagacccagcaaauccaa

SEQ ID NO: 255292 - RNA, 19 nt, Human
cagcagggaguguguggug

SEQ ID NO: 255293 - RNA, 22 nt, Human
cagccuggaggacaggcauggg

SEQ ID NO: 255294 - RNA, 19 nt, Human
caggaaagcuggagauuag

SEQ ID NO: 255295 - RNA, 25 nt, Human
caggagcccagcagugcucccagug

SEQ ID NO: 255296 - RNA, 23 nt, Human
cagggaaaacagcagggagugug

SEQ ID NO: 255297 - RNA, 21 nt, Human
cauaggcaaacaaacgacgac

SEQ ID NO: 255298 - RNA, 22 nt, Human
cauaggcaaacaaacgacgaca

SEQ ID NO: 255299 - RNA, 22 nt, Human
cauccucaccugcaccuggcaa

SEQ ID NO: 255300 - RNA, 20 nt, Human
ccaagagaccaaggcaagcc

SEQ ID NO: 255301 - RNA, 23 nt, Human
ccaaggaugaugaugcuuuacag

SEQ ID NO: 255302 - RNA, 22 nt, Human
ccacugggacgauccggcccgc

SEQ ID NO: 255303 - RNA, 22 nt, Human
ccaggcaaacuaagaaccugcc

SEQ ID NO: 255304 - RNA, 21 nt, Human
cccaagagaccaaggcaagcc

SEQ ID NO: 255305 - RNA, 22 nt, Human
cccaggaggggagccagaaacu

SEQ ID NO: 255306 - RNA, 23 nt, Human
cccgcaaggccacuugucgaacc

SEQ ID NO: 255307 - RNA, 23 nt, Human
cccugccccuuucuauucccucc

SEQ ID NO: 255308 - RNA, 20 nt, Human
cccuggugcaaucccuguac

SEQ ID NO: 255309 - RNA, 19 nt, Human
ccgaagcuuucaaugacag

SEQ ID NO: 255310 - RNA, 21 nt, Human
ccuaggggaaugggcaguauu

SEQ ID NO: 255311 - RNA, 22 nt, Human
ccucccugccccuuucuauucc

SEQ ID NO: 255312 - RNA, 22 nt, Human
ccucugcuaagagccacucuuc

SEQ ID NO: 255313 - RNA, 23 nt, Human
ccugagauuccgcggguggagaa

SEQ ID NO: 255314 - RNA, 23 nt, Human
ccuggcaaggugggugaaugggg

SEQ ID NO: 255315 - RNA, 24 nt, Human
ccugugaagcccucagaugucccc

SEQ ID NO: 255316 - RNA, 23 nt, Human
ccuuaaaugaacauuuuuaaccc

SEQ ID NO: 255317 - RNA, 24 nt, Human
cgggcugccagauagagucagaaa

SEQ ID NO: 255318 - RNA, 23 nt, Human
cgugauggcccacagccugggac

SEQ ID NO: 255319 - RNA, 20 nt, Human
cuaagucuaaaguguuagaa

SEQ ID NO: 255320 - RNA, 21 nt, Human
cuaguuagaaaaguauuccca

SEQ ID NO: 255321 - RNA, 22 nt, Human
cucacaccuuccaaagugccuc

SEQ ID NO: 255322 - RNA, 21 nt, Human
cucaggugagagcaacccuag

SEQ ID NO: 255323 - RNA, 24 nt, Human
cuccccuguucugcccuggugcaa

SEQ ID NO: 255324 - RNA, 24 nt, Human
cugaaaucguggcugaaggugcug

SEQ ID NO: 255325 - RNA, 25 nt, Human
cugaagcucagagaaguuaccauac

SEQ ID NO: 255326 - RNA, 18 nt, Human
gaaaggacaucaaaaaua

SEQ ID NO: 255327 - RNA, 20 nt, Human
gacaggcaugggggugagga

SEQ ID NO: 255328 - RNA, 20 nt, Human
gagaccaaggcaagccacga

SEQ ID NO: 255329 - RNA, 21 nt, Human
gcagccaauauaguacaaguc

SEQ ID NO: 255330 - RNA, 22 nt, Human
gccuaggggaaugggcaguauu

SEQ ID NO: 255331 - RNA, 21 nt, Human
gccuggaggacaggcaugggg

SEQ ID NO: 255332 - RNA, 23 nt, Human
gcucaguguugggacagacgagg

SEQ ID NO: 255333 - RNA, 24 nt, Human
gcuggugggaaaguuccaggcagg

SEQ ID NO: 255334 - RNA, 18 nt, Human
ggaaauacagucggcccu

SEQ ID NO: 255335 - RNA, 23 nt, Human
ggaggacaggcaugggggugagg

SEQ ID NO: 255336 - RNA, 24 nt, Human
gggaacacagagaggacagggggc

SEQ ID NO: 255337 - RNA, 21 nt, Human
gggacccugagauuccgcggg

SEQ ID NO: 255338 - RNA, 19 nt, Human
ggggaacacagagaggaca

SEQ ID NO: 255339 - RNA, 19 nt, Human
ggucgugauggcccacagc

SEQ ID NO: 255340 - RNA, 19 nt, Human
ggugaucugggggauggcg

SEQ ID NO: 255341 - RNA, 23 nt, Human
gugcuacaaagagguacagaaca

SEQ ID NO: 255342 - RNA, 21 nt, Human
guggaaauggguggguauuug

SEQ ID NO: 255343 - RNA, 23 nt, Human
guggaaauggguggguauuuguu

SEQ ID NO: 255344 - RNA, 19 nt, Human
guguggcaagugucacagu

SEQ ID NO: 255345 - RNA, 22 nt, Human
uaaacagaauauuccacuccac

SEQ ID NO: 255346 - RNA, 20 nt, Human
uaaaugaacauuuuuaaccc

SEQ ID NO: 255347 - RNA, 21 nt, Human
uaaccaggaaauacagucggc

SEQ ID NO: 255348 - RNA, 19 nt, Human
uaagcagacugacagccuu

SEQ ID NO: 255349 - RNA, 28 nt, Human
uaagcagacugacagccuuacuuacaga

SEQ ID NO: 255350 - RNA, 19 nt, Human
uacaaagagguacagaaca

SEQ ID NO: 255351 - RNA, 23 nt, Human
uaccauaccaugguggaaauggg

SEQ ID NO: 255352 - RNA, 20 nt, Human
uacuaaacagaauauuccac

SEQ ID NO: 255353 - RNA, 20 nt, Human
uacuucagcaagauuucugg

SEQ ID NO: 255354 - RNA, 22 nt, Human
uagaacuuaucacaaaacuaac

SEQ ID NO: 255355 - RNA, 20 nt, Human
uaggcaaacaaacgacgaca

SEQ ID NO: 255356 - RNA, 24 nt, Human
ucacaacacuacgugcuacaaaga

SEQ ID NO: 255357 - RNA, 24 nt, Human
ucagaaagaaaacaggcgggagca

SEQ ID NO: 255358 - RNA, 25 nt, Human
ucagagaaguuaccauaccauggug

SEQ ID NO: 255359 - RNA, 19 nt, Human
ucccccaguaccaaggagg

SEQ ID NO: 255360 - RNA, 21 nt, Human
uccccgccagacacuggggaa

SEQ ID NO: 255361 - RNA, 20 nt, Human
uccugccaccgugcccugga

SEQ ID NO: 255362 - RNA, 20 nt, Human
ucuacaagucugaagcugga

SEQ ID NO: 255363 - RNA, 21 nt, Human
ucuccaaagcacaaaacuuua

SEQ ID NO: 255364 - RNA, 18 nt, Human
ucuugguggggcuggugg

SEQ ID NO: 255365 - RNA, 21 nt, Human
ugaacaaaacuuacaacccca

SEQ ID NO: 255366 - RNA, 18 nt, Human
ugacaaaaacugcacuag

SEQ ID NO: 255367 - RNA, 19 nt, Human
ugaggucgugauggcccac

SEQ ID NO: 255368 - RNA, 18 nt, Human
ugcagcccugugaagccc

SEQ ID NO: 255369 - RNA, 24 nt, Human
ugccccuuucuauucccucccuca

SEQ ID NO: 255370 - RNA, 21 nt, Human
ugcccuggagaacauaggcaa

SEQ ID NO: 255371 - RNA, 20 nt, Human
ugcccuggugcaaucccugu

SEQ ID NO: 255372 - RNA, 19 nt, Human
ugcuguaggguggcugugg

SEQ ID NO: 255373 - RNA, 19 nt, Human
ugcuguaggguggcugugg

SEQ ID NO: 255374 - RNA, 21 nt, Human
uggaaaguaaaugaagaugaa

SEQ ID NO: 255375 - RNA, 26 nt, Human
uggacaucuccuguggcuggucacug

SEQ ID NO: 255376 - RNA, 20 nt, Human
uggcaaggugggugaauggg

SEQ ID NO: 255377 - RNA, 19 nt, Human
uggcccagacuccuucaca

SEQ ID NO: 255378 - RNA, 24 nt, Human
uggcuccccgccagacacugggga

SEQ ID NO: 255379 - RNA, 25 nt, Human
uggggaggaauccagacaggugauc

SEQ ID NO: 255380 - RNA, 21 nt, Human
ugguggggcuggugggaaagu

SEQ ID NO: 255381 - RNA, 22 nt, Human
ugguggggcuggugggaaaguu

SEQ ID NO: 255382 - RNA, 18 nt, Human
uguggcuggucacuggga

SEQ ID NO: 255383 - RNA, 20 nt, Human
uguggugguuggaggugccu

SEQ ID NO: 255384 - RNA, 22 nt, Human
uuaccagggugagaaaaggugc

SEQ ID NO: 255385 - RNA, 24 nt, Human
uucauaauuacuacuaagucuaaa

SEQ ID NO: 255386 - RNA, 20 nt, Human
uucauucugcaaagcugagg

SEQ ID NO: 255387 - RNA, 23 nt, Human
uuccaggcaaacuaagaaccugc

SEQ ID NO: 255388 - RNA, 26 nt, Human
uuccaggcagggaaaacagcagggag

SEQ ID NO: 255389 - RNA, 22 nt, Human
uuugucagaucucucccucccc

SEQ ID NO: 255390 - RNA, 19 nt, Human
uuuuuuuuuuuuuuuuuaa

SEQ ID NO: 255391 - RNA, 21 nt, Human
aaagauaucccagcuacaaga

SEQ ID NO: 255392 - RNA, 20 nt, Human
aagccugcuacuuccccugg

SEQ ID NO: 255393 - RNA, 21 nt, Human
aaucuuguccccuuuggucca

SEQ ID NO: 255394 - RNA, 22 nt, Human
aaucuuguccccuuugguccac

SEQ ID NO: 255395 - RNA, 22 nt, Human
accccaaauguaugagcccaac

SEQ ID NO: 255396 - RNA, 22 nt, Human
acgauaacagaagguagcagcc

SEQ ID NO: 255397 - RNA, 21 nt, Human
agcagccacuugucuucucug

SEQ ID NO: 255398 - RNA, 24 nt, Human
aucaaaaaguucaauguuuaugaa

SEQ ID NO: 255399 - RNA, 19 nt, Human
caaccaaaacuuuguaguc

SEQ ID NO: 255400 - RNA, 22 nt, Human
caacugguauuuuucaucucuu

SEQ ID NO: 255401 - RNA, 20 nt, Human
cacaaguuccgaaggcucau

SEQ ID NO: 255402 - RNA, 19 nt, Human
cagaaaaguagagaaucuu

SEQ ID NO: 255403 - RNA, 23 nt, Human
cagagagccuuucucucagcacu

SEQ ID NO: 255404 - RNA, 19 nt, Human
cagcauagaaugauuuaau

SEQ ID NO: 255405 - RNA, 26 nt, Human
caucucuucuuucgauaugaagcuca

SEQ ID NO: 255406 - RNA, 24 nt, Human
cgauaugaagcucagauucaaagc

SEQ ID NO: 255407 - RNA, 21 nt, Human
cguuuuaacauuaaaaauuau

SEQ ID NO: 255408 - RNA, 19 nt, Human
cucauaguacuucagcauc

SEQ ID NO: 255409 - RNA, 21 nt, Human
cuuuugauucuguaccaccuu

SEQ ID NO: 255410 - RNA, 24 nt, Human
gaaaaacuagucacugccacccac

SEQ ID NO: 255411 - RNA, 23 nt, Human
uaaagggaccauaacaaccaaaa

SEQ ID NO: 255412 - RNA, 21 nt, Human
uaugaagcucagauucaaagc

SEQ ID NO: 255413 - RNA, 21 nt, Human
uaugaagcucagauucaaagc

SEQ ID NO: 255414 - RNA, 23 nt, Human
ucacucuucaauacucuuuuguu

SEQ ID NO: 255415 - RNA, 21 nt, Human
uccaagauggacaccuaugaa

SEQ ID NO: 255416 - RNA, 25 nt, Human
uccaagauggacaccuaugaaagau

SEQ ID NO: 255417 - RNA, 20 nt, Human
uccacaaguuccgaaggcuc

SEQ ID NO: 255418 - RNA, 23 nt, Human
ucugcuucagcucuuaguucaga

SEQ ID NO: 255419 - RNA, 19 nt, Human
ucuuuuguuugcuuugaga

SEQ ID NO: 255420 - RNA, 22 nt, Human
ucuuuuguuugcuuugagacug

SEQ ID NO: 255421 - RNA, 23 nt, Human
ugcaaaaaguauguuccaagaug

SEQ ID NO: 255422 - RNA, 23 nt, Human
uguaccaccccaaauguaugagc

SEQ ID NO: 255423 - RNA, 24 nt, Human
uucugcuucagcucuuaguucaga

SEQ ID NO: 255424 - RNA, 24 nt, Human
uuuaugaagcuaaucagcauagaa

SEQ ID NO: 255425 - RNA, 23 nt, Human
uuuguagucucuccacaaguucc

SEQ ID NO: 255426 - RNA, 19 nt, Human
aguccucaaucacugcagc

SEQ ID NO: 255427 - RNA, 26 nt, Human
cuggaaaguauaccaauuucacuuua

SEQ ID NO: 255428 - RNA, 23 nt, Human
cuggugcaguccucaaucacugc

SEQ ID NO: 255429 - RNA, 26 nt, Human
guuaagaucccuucagaacucuggug

SEQ ID NO: 255430 - RNA, 23 nt, Human
ucacugcagcuuuacugucaguc

SEQ ID NO: 255431 - RNA, 22 nt, Human
uccaaaagacggaaaaucgacu

SEQ ID NO: 255432 - RNA, 23 nt, Human
uccaaaagacggaaaaucgacuc

SEQ ID NO: 255433 - RNA, 19 nt, Human
uuacugucagucaguggag

SEQ ID NO: 255434 - RNA, 21 nt, Human
uuuaggaauaggaugaggaga

SEQ ID NO: 255435 - RNA, 21 nt, Human
augggagcuggccuggggcca

SEQ ID NO: 255436 - RNA, 26 nt, Human
caaaacagaauacaaaauuccggcau

SEQ ID NO: 255437 - RNA, 21 nt, Human
cacuuuaaaaaaacuuuugag

SEQ ID NO: 255438 - RNA, 22 nt, Human
cgaugggagcuggccuggggcc

SEQ ID NO: 255439 - RNA, 18 nt, Human
cuggggccaggguccucc

SEQ ID NO: 255440 - RNA, 23 nt, Human
guuuuuuuuuuuuuuuugucuuu

SEQ ID NO: 255441 - RNA, 20 nt, Human
uaaaucuuuacaaaacagaa

SEQ ID NO: 255442 - RNA, 21 nt, Human
uacaaaacagaauacaaaauu

SEQ ID NO: 255443 - RNA, 27 nt, Human
uacaaaacagaauacaaaauuccggca

SEQ ID NO: 255444 - RNA, 22 nt, Human
ugagguuuuuuuuuuuuuuuug

SEQ ID NO: 255445 - RNA, 19 nt, Human
ugggagcuggccuggggcc

SEQ ID NO: 255446 - RNA, 20 nt, Human
uugagguuuuuuuuuuuuuu

SEQ ID NO: 255447 - RNA, 24 nt, Human
uuuuuuuuuuuuuugcaaguuuuu

SEQ ID NO: 255448 - RNA, 23 nt, Human
uuuuuuuuuuuuuugucuuuuaa

SEQ ID NO: 255449 - RNA, 19 nt, Human
uuuuuuuuuuuuuuugcaa

SEQ ID NO: 255450 - RNA, 27 nt, Human
aaaccagagauaaaacccacaccaagg

SEQ ID NO: 255451 - RNA, 22 nt, Human
aaacccacaccaagggcuauuu

SEQ ID NO: 255452 - RNA, 18 nt, Human
aacccacaccaagggcua

SEQ ID NO: 255453 - RNA, 23 nt, Human
aagcgagguacagaaaccuccac

SEQ ID NO: 255454 - RNA, 21 nt, Human
acccagggcgcuccagagacc

SEQ ID NO: 255455 - RNA, 22 nt, Human
acgagcgccaagccacccacaa

SEQ ID NO: 255456 - RNA, 25 nt, Human
agccacccacaaggcagugcggcaa

SEQ ID NO: 255457 - RNA, 22 nt, Human
agcgucccuccucgcuccgccc

SEQ ID NO: 255458 - RNA, 26 nt, Human
aggcagugcggcaaggcucccgggau

SEQ ID NO: 255459 - RNA, 19 nt, Human
agggaggaggagcggcggg

SEQ ID NO: 255460 - RNA, 21 nt, Human
caccaagggcuauuucccaag

SEQ ID NO: 255461 - RNA, 21 nt, Human
caccacggagaacacaaacca

SEQ ID NO: 255462 - RNA, 23 nt, Human
cacugggcucguccuugggaggc

SEQ ID NO: 255463 - RNA, 21 nt, Human
cagagauaaaacccacaccaa

SEQ ID NO: 255464 - RNA, 25 nt, Human
cagcggcagggaccggccgggcaag

SEQ ID NO: 255465 - RNA, 18 nt, Human
cagugucaacaagucagc

SEQ ID NO: 255466 - RNA, 22 nt, Human
cauaaacaugacuacguauaua

SEQ ID NO: 255467 - RNA, 24 nt, Human
ccaagcgagguacagaaaccucca

SEQ ID NO: 255468 - RNA, 25 nt, Human
ccacccacaaggcagugcggcaagg

SEQ ID NO: 255469 - RNA, 23 nt, Human
cccacuccgcccucgcggacccc

SEQ ID NO: 255470 - RNA, 19 nt, Human
ccccacuccgcccucgcgg

SEQ ID NO: 255471 - RNA, 21 nt, Human
ccccggcucgcggccgccggg

SEQ ID NO: 255472 - RNA, 21 nt, Human
cccgcccccgugcgcaccggg

SEQ ID NO: 255473 - RNA, 19 nt, Human
cccuccucgcuccgcccgc

SEQ ID NO: 255474 - RNA, 23 nt, Human
ccgccuugccgguccccgccccc

SEQ ID NO: 255475 - RNA, 18 nt, Human
ccuccacagcagugggga

SEQ ID NO: 255476 - RNA, 22 nt, Human
ccuccacagcaguggggauaag

SEQ ID NO: 255477 - RNA, 21 nt, Human
ccuggcugccgcgccccacuc

SEQ ID NO: 255478 - RNA, 20 nt, Human
cggcagggaccggccgggca

SEQ ID NO: 255479 - RNA, 18 nt, Human
cggccgccgggcguggga

SEQ ID NO: 255480 - RNA, 19 nt, Human
cggccgggcaacccagggc

SEQ ID NO: 255481 - RNA, 19 nt, Human
cggcgggagccgggcaggg

SEQ ID NO: 255482 - RNA, 25 nt, Human
cgggagggacugagugcucgcagug

SEQ ID NO: 255483 - RNA, 19 nt, Human
cgggauccuuacaggcauc

SEQ ID NO: 255484 - RNA, 23 nt, Human
cgggcggggaggaggcgcgcggg

SEQ ID NO: 255485 - RNA, 21 nt, Human
cugccgcgccccacuccgccc

SEQ ID NO: 255486 - RNA, 20 nt, Human
gagcgccaagccacccacaa

SEQ ID NO: 255487 - RNA, 18 nt, Human
gagcggcggggcgggcgg

SEQ ID NO: 255488 - RNA, 20 nt, Human
gaggagcggcggggcgggcg

SEQ ID NO: 255489 - RNA, 20 nt, Human
gcacuauggcauguuacagg

SEQ ID NO: 255490 - RNA, 22 nt, Human
gccaagccacccacaaggcagu

SEQ ID NO: 255491 - RNA, 19 nt, Human
gccgcgccccacuccgccc

SEQ ID NO: 255492 - RNA, 20 nt, Human
gccgcgccccacuccgcccu

SEQ ID NO: 255493 - RNA, 25 nt, Human
ggagaacacaaaccagagauaaaac

SEQ ID NO: 255494 - RNA, 23 nt, Human
gggcgcuccagagacccggcgug

SEQ ID NO: 255495 - RNA, 18 nt, Human
ggggaaaauauuuucucu

SEQ ID NO: 255496 - RNA, 20 nt, Human
ggggcgggcggggaggaggc

SEQ ID NO: 255497 - RNA, 21 nt, Human
ggguuccuggcugccgcgccc

SEQ ID NO: 255498 - RNA, 20 nt, Human
gguggcugaaggcgaacgcu

SEQ ID NO: 255499 - RNA, 26 nt, Human
guagucggguuccuggcugccgcgcc

SEQ ID NO: 255500 - RNA, 18 nt, Human
ucacgccacacaacuaca

SEQ ID NO: 255501 - RNA, 19 nt, Human
ucgcggccgccgggcgugg

SEQ ID NO: 255502 - RNA, 22 nt, Human
ucggguuccuggcugccgcgcc

SEQ ID NO: 255503 - RNA, 20 nt, Human
ugaaggcgaacgcuagcgcc

SEQ ID NO: 255504 - RNA, 23 nt, Human
ugccgguccccgcccccgugcgc

SEQ ID NO: 255505 - RNA, 18 nt, Human
ugcuaaagaauauccuua

SEQ ID NO: 255506 - RNA, 21 nt, Human
uguggguuugcaauauuucag

SEQ ID NO: 255507 - RNA, 23 nt, Human
uucagcuucaaaugaaaaacaag

SEQ ID NO: 255508 - RNA, 22 nt, Human
uuuuuuuuuuuuaaacuuggcu

SEQ ID NO: 255509 - RNA, 20 nt, Human
aacaaaagcgaaacuccauc

SEQ ID NO: 255510 - RNA, 21 nt, Human
aacaaaagcgaaacuccaucu

SEQ ID NO: 255511 - RNA, 22 nt, Human
aacaaaagcgaaacuccaucuc

SEQ ID NO: 255512 - RNA, 20 nt, Human
aacauggagaaaccccgucu

SEQ ID NO: 255513 - RNA, 21 nt, Human
aacauggagaaaccccgucuc

SEQ ID NO: 255514 - RNA, 23 nt, Human
aagaucgcgccauugcacuccag

SEQ ID NO: 255515 - RNA, 24 nt, Human
aauugcuugaaccugggaggcgga

SEQ ID NO: 255516 - RNA, 24 nt, Human
accccgucucuacuaaaacuacaa

SEQ ID NO: 255517 - RNA, 24 nt, Human
accugaggucaggaguuugagacc

SEQ ID NO: 255518 - RNA, 22 nt, Human
agaauugcuugaaccugggagg

SEQ ID NO: 255519 - RNA, 20 nt, Human
agauaguaucaugcauugca

SEQ ID NO: 255520 - RNA, 22 nt, Human
agaucaccugaggucaggaguu

SEQ ID NO: 255521 - RNA, 24 nt, Human
agcacuuugggaggcugaggcggg

SEQ ID NO: 255522 - RNA, 21 nt, Human
agccugggcaacaaaagcgaa

SEQ ID NO: 255523 - RNA, 23 nt, Human
agccugggcaacaaaagcgaaac

SEQ ID NO: 255524 - RNA, 20 nt, Human
aggaguuugagaccagccug

SEQ ID NO: 255525 - RNA, 22 nt, Human
aggcaggagaauugcuugaacc

SEQ ID NO: 255526 - RNA, 24 nt, Human
aggcaggagaauugcuugaaccug

SEQ ID NO: 255527 - RNA, 24 nt, Human
aggcauaguggcgcacgccuguaa

SEQ ID NO: 255528 - RNA, 19 nt, Human
aggcggagguuauggugag

SEQ ID NO: 255529 - RNA, 24 nt, Human
aggcggagguuauggugagccaag

SEQ ID NO: 255530 - RNA, 22 nt, Human
aggcgggcagaucaccugaggu

SEQ ID NO: 255531 - RNA, 26 nt, Human
aggcgggcagaucaccugaggucagg

SEQ ID NO: 255532 - RNA, 24 nt, Human
aggcgugguggcucacgccuguaa

SEQ ID NO: 255533 - RNA, 24 nt, Human
aggcuaaggcaggagaauugcuug

SEQ ID NO: 255534 - RNA, 23 nt, Human
agucaggcauaguggcgcacgcc

SEQ ID NO: 255535 - RNA, 24 nt, Human
aguggcgcacgccuguaaucccag

SEQ ID NO: 255536 - RNA, 24 nt, Human
aucgcgccauugcacuccagccug

SEQ ID NO: 255537 - RNA, 23 nt, Human
aucucaaaaaaaaagagcuauag

SEQ ID NO: 255538 - RNA, 23 nt, Human
auugcacuccagccugggcaaca

SEQ ID NO: 255539 - RNA, 24 nt, Human
auugcacuccagccugggcaacaa

SEQ ID NO: 255540 - RNA, 24 nt, Human
caacauggagaaaccccgucucua

SEQ ID NO: 255541 - RNA, 21 nt, Human
caagagagcuaaauugccaua

SEQ ID NO: 255542 - RNA, 23 nt, Human
cacaggcaucagcacuaaggcag

SEQ ID NO: 255543 - RNA, 23 nt, Human
caccugaggucaggaguuugaga

SEQ ID NO: 255544 - RNA, 18 nt, Human
cacgccuguaaucccagc

SEQ ID NO: 255545 - RNA, 19 nt, Human
cacgccuguaaucccagcu

SEQ ID NO: 255546 - RNA, 24 nt, Human
cacgccuguaauuccagcacuuug

SEQ ID NO: 255547 - RNA, 24 nt, Human
cagaucaccugaggucaggaguuu

SEQ ID NO: 255548 - RNA, 27 nt, Human
cagaucaccugaggucaggaguuugag

SEQ ID NO: 255549 - RNA, 24 nt, Human
cagcacuuugggaggcugaggcgg

SEQ ID NO: 255550 - RNA, 24 nt, Human
cagccaggcgugguggcucacgcc

SEQ ID NO: 255551 - RNA, 24 nt, Human
cagccugaccaacauggagaaacc

SEQ ID NO: 255552 - RNA, 18 nt, Human
caguacacaggcaucagc

SEQ ID NO: 255553 - RNA, 19 nt, Human
cauugcaacauuuauugau

SEQ ID NO: 255554 - RNA, 19 nt, Human
cauugcacuccagccuggg

SEQ ID NO: 255555 - RNA, 21 nt, Human
cauugcacuccagccugggca

SEQ ID NO: 255556 - RNA, 22 nt, Human
cauugcacuccagccugggcaa

SEQ ID NO: 255557 - RNA, 24 nt, Human
cauugcacuccagccugggcaaca

SEQ ID NO: 255558 - RNA, 23 nt, Human
ccagaauacccacuugaauucug

SEQ ID NO: 255559 - RNA, 18 nt, Human
ccauugcacuccagccug

SEQ ID NO: 255560 - RNA, 20 nt, Human
ccauugcacuccagccuggg

SEQ ID NO: 255561 - RNA, 21 nt, Human
ccauugcacuccagccugggc

SEQ ID NO: 255562 - RNA, 23 nt, Human
ccauugcacuccagccugggcaa

SEQ ID NO: 255563 - RNA, 24 nt, Human
ccauugcacuccagccugggcaac

SEQ ID NO: 255564 - RNA, 19 nt, Human
cccaagagagcuaaauugc

SEQ ID NO: 255565 - RNA, 23 nt, Human
ccugaccaacauggagaaacccc

SEQ ID NO: 255566 - RNA, 24 nt, Human
ccugaccaacauggagaaaccccg

SEQ ID NO: 255567 - RNA, 22 nt, Human
ccugaggucaggaguuugagac

SEQ ID NO: 255568 - RNA, 19 nt, Human
ccugggaggcggagguuau

SEQ ID NO: 255569 - RNA, 25 nt, Human
ccugggcaacaaaagcgaaacucca

SEQ ID NO: 255570 - RNA, 21 nt, Human
ccuguaaucccagcuacucag

SEQ ID NO: 255571 - RNA, 22 nt, Human
ccuguaaucccagcuacucagg

SEQ ID NO: 255572 - RNA, 23 nt, Human
cgaaacuccaucucaaaaaaaaa

SEQ ID NO: 255573 - RNA, 24 nt, Human
cgccauugcacuccagccugggca

SEQ ID NO: 255574 - RNA, 24 nt, Human
cgccuguaaucccagcuacucagg

SEQ ID NO: 255575 - RNA, 23 nt, Human
cgccuguaauuccagcacuuugg

SEQ ID NO: 255576 - RNA, 24 nt, Human
cgccuguaauuccagcacuuuggg

SEQ ID NO: 255577 - RNA, 24 nt, Human
cgggcagaucaccugaggucagga

SEQ ID NO: 255578 - RNA, 23 nt, Human
cucaaaaaaaaagagcuauagga

SEQ ID NO: 255579 - RNA, 24 nt, Human
cucacgccuguaauuccagcacuu

SEQ ID NO: 255580 - RNA, 19 nt, Human
cucaucauuuccucacaug

SEQ ID NO: 255581 - RNA, 20 nt, Human
cucaucauuuccucacauga

SEQ ID NO: 255582 - RNA, 18 nt, Human
cuccaucucaaaaaaaaa

SEQ ID NO: 255583 - RNA, 19 nt, Human
cuugaaccugggaggcgga

SEQ ID NO: 255584 - RNA, 24 nt, Human
cuuuuacuuauuuaaauccuucua

SEQ ID NO: 255585 - RNA, 21 nt, Human
gagaaaccccgucucuacuaa

SEQ ID NO: 255586 - RNA, 19 nt, Human
gagguuauggugagccaag

SEQ ID NO: 255587 - RNA, 20 nt, Human
gaguuuucccaauuuaauau

SEQ ID NO: 255588 - RNA, 24 nt, Human
gaucaccugaggucaggaguuuga

SEQ ID NO: 255589 - RNA, 22 nt, Human
gccauugcacuccagccugggc

SEQ ID NO: 255590 - RNA, 24 nt, Human
gccauugcacuccagccugggcaa

SEQ ID NO: 255591 - RNA, 23 nt, Human
gccuguaaucccagcuacucagg

SEQ ID NO: 255592 - RNA, 24 nt, Human
ggagguuauggugagccaagaucg

SEQ ID NO: 255593 - RNA, 25 nt, Human
ggcagaucaccugaggucaggaguu

SEQ ID NO: 255594 - RNA, 21 nt, Human
gggauuugggaacccaagaga

SEQ ID NO: 255595 - RNA, 19 nt, Human
ggucaggaguuugagacca

SEQ ID NO: 255596 - RNA, 24 nt, Human
gguggcucacgccuguaauuccag

SEQ ID NO: 255597 - RNA, 23 nt, Human
guaaagagaaauuggauggcccc

SEQ ID NO: 255598 - RNA, 19 nt, Human
uaaaaguauccuuugugaa

SEQ ID NO: 255599 - RNA, 20 nt, Human
uaaccuguaaaaguauccuu

SEQ ID NO: 255600 - RNA, 24 nt, Human
uaaggcaggagaauugcuugaacc

SEQ ID NO: 255601 - RNA, 24 nt, Human
uaaggcaggagaauugcuugaacc

SEQ ID NO: 255602 - RNA, 18 nt, Human
uacacaggcaucagcacu

SEQ ID NO: 255603 - RNA, 21 nt, Human
uacaccauuccaaaggagaac

SEQ ID NO: 255604 - RNA, 23 nt, Human
uacuaaaacuacaaaauuaguca

SEQ ID NO: 255605 - RNA, 24 nt, Human
uagaauuuuagagcacaaagagac

SEQ ID NO: 255606 - RNA, 23 nt, Human
uagagauggcuugcauuuuuccu

SEQ ID NO: 255607 - RNA, 21 nt, Human
uagagcacaaagagacauugc

SEQ ID NO: 255608 - RNA, 20 nt, Human
uagcggaccuacuaaaauuu

SEQ ID NO: 255609 - RNA, 25 nt, Human
uagguacauuuaaggcaguacacag

SEQ ID NO: 255610 - RNA, 24 nt, Human
uaguggcgcacgccuguaauccca

SEQ ID NO: 255611 - RNA, 21 nt, Human
ucaagcaaaagugugagagaa

SEQ ID NO: 255612 - RNA, 19 nt, Human
ucaccugaggucaggaguu

SEQ ID NO: 255613 - RNA, 22 nt, Human
ucacgccuguaauuccagcacu

SEQ ID NO: 255614 - RNA, 20 nt, Human
ucaggcauaguggcgcacgc

SEQ ID NO: 255615 - RNA, 24 nt, Human
uccagccaggcgugguggcucacg

SEQ ID NO: 255616 - RNA, 20 nt, Human
ucucuacuaaaacuacaaaa

SEQ ID NO: 255617 - RNA, 24 nt, Human
ugagaccagccugaccaacaugga

SEQ ID NO: 255618 - RNA, 22 nt, Human
ugagccaagaucgcgccauugc

SEQ ID NO: 255619 - RNA, 20 nt, Human
ugaggcgggcagaucaccug

SEQ ID NO: 255620 - RNA, 24 nt, Human
ugaggcgggcagaucaccugaggu

SEQ ID NO: 255621 - RNA, 26 nt, Human
ugaggcgggcagaucaccugagguca

SEQ ID NO: 255622 - RNA, 18 nt, Human
ugaggucaggaguuugag

SEQ ID NO: 255623 - RNA, 19 nt, Human
ugauuaguacugcuagcgg

SEQ ID NO: 255624 - RNA, 21 nt, Human
ugauuaguacugcuagcggac

SEQ ID NO: 255625 - RNA, 21 nt, Human
uggcgcacgccuguaauccca

SEQ ID NO: 255626 - RNA, 22 nt, Human
uggcucacgccuguaauuccag

SEQ ID NO: 255627 - RNA, 24 nt, Human
uggcucacgccuguaauuccagca

SEQ ID NO: 255628 - RNA, 24 nt, Human
ugggaggcggagguuauggugagc

SEQ ID NO: 255629 - RNA, 20 nt, Human
ugggaggcugaggcgggcag

SEQ ID NO: 255630 - RNA, 24 nt, Human
ugggaggcugaggcgggcagauca

SEQ ID NO: 255631 - RNA, 24 nt, Human
ugguggcucacgccuguaauucca

SEQ ID NO: 255632 - RNA, 24 nt, Human
uguaaaaguauccuuugugagcac

SEQ ID NO: 255633 - RNA, 22 nt, Human
uguuauuagccaaauuucaagu

SEQ ID NO: 255634 - RNA, 22 nt, Human
uuacuaacauuaccucuggcac

SEQ ID NO: 255635 - RNA, 22 nt, Human
uucaagcaaaagugugagagaa

SEQ ID NO: 255636 - RNA, 24 nt, Human
uuccagcacuuugggaggcugagg

SEQ ID NO: 255637 - RNA, 21 nt, Human
uugaaccugggaggcggaggu

SEQ ID NO: 255638 - RNA, 24 nt, Human
uugcuugaaccugggaggcggagg

SEQ ID NO: 255639 - RNA, 25 nt, Human
uugggaggcugaggcgggcagauca

SEQ ID NO: 255640 - RNA, 22 nt, Human
uuucucaucauuuccucacaug

SEQ ID NO: 255641 - RNA, 20 nt, Human
aaaacagcggagauggagaa

SEQ ID NO: 255642 - RNA, 29 nt, Human
aaagccaguguuauucucacaacaggggu

SEQ ID NO: 255643 - RNA, 18 nt, Human
aacaaaagcucagcaaac

SEQ ID NO: 255644 - RNA, 21 nt, Human
aacagcauuccaguuucacag

SEQ ID NO: 255645 - RNA, 21 nt, Human
aagaccccaaaacagcggaga

SEQ ID NO: 255646 - RNA, 28 nt, Human
aagccaguguuauucucacaacaggggu

SEQ ID NO: 255647 - RNA, 21 nt, Human
aagcgcucuaaaauaagaaaa

SEQ ID NO: 255648 - RNA, 18 nt, Human
aagcguauuaaacaaaaa

SEQ ID NO: 255649 - RNA, 19 nt, Human
aagcguauuaaacaaaaau

SEQ ID NO: 255650 - RNA, 23 nt, Human
aagcucagcaaacuugagcugaa

SEQ ID NO: 255651 - RNA, 24 nt, Human
acagcagccucuccucucccacgg

SEQ ID NO: 255652 - RNA, 20 nt, Human
accaguucuuuaucuccccc

SEQ ID NO: 255653 - RNA, 21 nt, Human
accaguucuuuaucucccccg

SEQ ID NO: 255654 - RNA, 18 nt, Human
acccacagucuggucagg

SEQ ID NO: 255655 - RNA, 19 nt, Human
accccauucccaggagcag

SEQ ID NO: 255656 - RNA, 18 nt, Human
accccgccagccucaaag

SEQ ID NO: 255657 - RNA, 19 nt, Human
acccuaagaccccaaaaca

SEQ ID NO: 255658 - RNA, 22 nt, Human
acccuaagaccccaaaacagcg

SEQ ID NO: 255659 - RNA, 23 nt, Human
acgccggggacucaagcacguua

SEQ ID NO: 255660 - RNA, 25 nt, Human
agagaggcaggaagaggagcugggg

SEQ ID NO: 255661 - RNA, 18 nt, Human
agagcccacuccagccca

SEQ ID NO: 255662 - RNA, 20 nt, Human
agagugggcaggagacgcag

SEQ ID NO: 255663 - RNA, 20 nt, Human
agcgcucuaaaauaagaaaa

SEQ ID NO: 255664 - RNA, 19 nt, Human
aggagcuggggccaguuca

SEQ ID NO: 255665 - RNA, 22 nt, Human
aggagcuggggccaguucaggg

SEQ ID NO: 255666 - RNA, 20 nt, Human
aggcaggaagaggagcuggg

SEQ ID NO: 255667 - RNA, 18 nt, Human
aggcaggggaaggagagc

SEQ ID NO: 255668 - RNA, 18 nt, Human
aggccgccccauccagcu

SEQ ID NO: 255669 - RNA, 19 nt, Human
agguguuagaagcaguagc

SEQ ID NO: 255670 - RNA, 26 nt, Human
aguaaugggagcaaacacaggaggga

SEQ ID NO: 255671 - RNA, 19 nt, Human
aucucccccgcugcucugc

SEQ ID NO: 255672 - RNA, 21 nt, Human
aucucccccgcugcucugccg

SEQ ID NO: 255673 - RNA, 22 nt, Human
augaaacaaaagcucagcaaac

SEQ ID NO: 255674 - RNA, 22 nt, Human
caacaccugacaacauccaucg

SEQ ID NO: 255675 - RNA, 23 nt, Human
caacuucguccaugaacacauca

SEQ ID NO: 255676 - RNA, 18 nt, Human
caccacagcugugcugaa

SEQ ID NO: 255677 - RNA, 18 nt, Human
caccacagcugugcugaa

SEQ ID NO: 255678 - RNA, 20 nt, Human
caccacagcugugcugaaug

SEQ ID NO: 255679 - RNA, 20 nt, Human
caccacagcugugcugaaug

SEQ ID NO: 255680 - RNA, 22 nt, Human
cacccaacugucccugcagccu

SEQ ID NO: 255681 - RNA, 23 nt, Human
cacccaacugucccugcagccug

SEQ ID NO: 255682 - RNA, 26 nt, Human
caccccauucccaggagcagaccccu

SEQ ID NO: 255683 - RNA, 24 nt, Human
cacuacccaaagccaguguuauuc

SEQ ID NO: 255684 - RNA, 23 nt, Human
cacugaggcacagacuagccaac

SEQ ID NO: 255685 - RNA, 22 nt, Human
cagaaggaaagaaacaaaacca

SEQ ID NO: 255686 - RNA, 22 nt, Human
cagaaggaaagaaacaaaaccu

SEQ ID NO: 255687 - RNA, 23 nt, Human
cagacccuaagcguggagggagg

SEQ ID NO: 255688 - RNA, 21 nt, Human
cagccccacccccaagaacac

SEQ ID NO: 255689 - RNA, 20 nt, Human
cagcggagauggagaagacc

SEQ ID NO: 255690 - RNA, 21 nt, Human
caggacagaggcgccaagccc

SEQ ID NO: 255691 - RNA, 18 nt, Human
caggagacgcagggaccc

SEQ ID NO: 255692 - RNA, 18 nt, Human
ccaagcugggcaugacag

SEQ ID NO: 255693 - RNA, 18 nt, Human
ccaagcugggcaugacag

SEQ ID NO: 255694 - RNA, 24 nt, Human
ccaagcugggcaugacagcaccca

SEQ ID NO: 255695 - RNA, 20 nt, Human
ccaagcugggcaugacagug

SEQ ID NO: 255696 - RNA, 20 nt, Human
ccacugggcugacugaguac

SEQ ID NO: 255697 - RNA, 18 nt, Human
ccacuugucaugaacacc

SEQ ID NO: 255698 - RNA, 26 nt, Human
ccagcccugcucucacuguccaggaa

SEQ ID NO: 255699 - RNA, 23 nt, Human
ccagccucaaagcugcagggagg

SEQ ID NO: 255700 - RNA, 18 nt, Human
ccaggagcagaccccgcc

SEQ ID NO: 255701 - RNA, 22 nt, Human
cccaagaagacaucagcccgcc

SEQ ID NO: 255702 - RNA, 20 nt, Human
cccaccccauucccaggagc

SEQ ID NO: 255703 - RNA, 19 nt, Human
cccaggacgugggccggcc

SEQ ID NO: 255704 - RNA, 21 nt, Human
ccccauccagcugcaucuccc

SEQ ID NO: 255705 - RNA, 24 nt, Human
ccccggucacuggggccagggaga

SEQ ID NO: 255706 - RNA, 19 nt, Human
cccuaggaagugaaaaccc

SEQ ID NO: 255707 - RNA, 22 nt, Human
ccgcugcccuggggccuucuca

SEQ ID NO: 255708 - RNA, 19 nt, Human
ccgcugcucugccguuggg

SEQ ID NO: 255709 - RNA, 23 nt, Human
ccggccccugacuguguccuucc

SEQ ID NO: 255710 - RNA, 18 nt, Human
ccgguaccagugacagca

SEQ ID NO: 255711 - RNA, 22 nt, Human
ccuaagaccccaaaacagcgga

SEQ ID NO: 255712 - RNA, 21 nt, Human
ccucuaggagcagcugggaag

SEQ ID NO: 255713 - RNA, 23 nt, Human
ccugggaggguccucaaaccccc

SEQ ID NO: 255714 - RNA, 19 nt, Human
ccugggcuguacccuaaga

SEQ ID NO: 255715 - RNA, 20 nt, Human
cgcugggcagccugagccug

SEQ ID NO: 255716 - RNA, 22 nt, Human
cggcagccugugucgcuugcgc

SEQ ID NO: 255717 - RNA, 24 nt, Human
cgggccaggacagaggcgccaagc

SEQ ID NO: 255718 - RNA, 18 nt, Human
cucacacccaacuguccc

SEQ ID NO: 255719 - RNA, 23 nt, Human
cucacuguccaggaagagccgcu

SEQ ID NO: 255720 - RNA, 21 nt, Human
cuccaagugccuaauucugac

SEQ ID NO: 255721 - RNA, 21 nt, Human
cucccgggccaggacagaggc

SEQ ID NO: 255722 - RNA, 24 nt, Human
cugccacccgguuuccgcgucugg

SEQ ID NO: 255723 - RNA, 22 nt, Human
cugggaggguccucaaaccccc

SEQ ID NO: 255724 - RNA, 19 nt, Human
cuggggccaguucaggggu

SEQ ID NO: 255725 - RNA, 19 nt, Human
gacccacagucuggucagg

SEQ ID NO: 255726 - RNA, 19 nt, Human
gacugcagagagggccugg

SEQ ID NO: 255727 - RNA, 22 nt, Human
gagaggcaggaagaggagcugg

SEQ ID NO: 255728 - RNA, 20 nt, Human
gagcagaccccgccagccuc

SEQ ID NO: 255729 - RNA, 23 nt, Human
gaggagacgcagggaaacccacu

SEQ ID NO: 255730 - RNA, 21 nt, Human
gaggagcuggggccaguucag

SEQ ID NO: 255731 - RNA, 23 nt, Human
gaggagcuggggccaguucaggg

SEQ ID NO: 255732 - RNA, 22 nt, Human
gcagccugguuugcccucacac

SEQ ID NO: 255733 - RNA, 19 nt, Human
gccagagucacuccuguuc

SEQ ID NO: 255734 - RNA, 21 nt, Human
gccagccucaaagcugcaggg

SEQ ID NO: 255735 - RNA, 19 nt, Human
gccaggacagaggcgccaa

SEQ ID NO: 255736 - RNA, 23 nt, Human
gccccauccagcugcaucuccca

SEQ ID NO: 255737 - RNA, 19 nt, Human
gcccccaagaagacaucag

SEQ ID NO: 255738 - RNA, 20 nt, Human
gcgcccagcccugcucucac

SEQ ID NO: 255739 - RNA, 20 nt, Human
gcugggcgcugccacccggu

SEQ ID NO: 255740 - RNA, 20 nt, Human
ggaaaccugggaggguccuc

SEQ ID NO: 255741 - RNA, 21 nt, Human
ggaaggagagcugcuuccuga

SEQ ID NO: 255742 - RNA, 18 nt, Human
ggaaguggguaagauccc

SEQ ID NO: 255743 - RNA, 18 nt, Human
ggagcugacugaucucac

SEQ ID NO: 255744 - RNA, 23 nt, Human
ggagcuggggccaguucaggggu

SEQ ID NO: 255745 - RNA, 18 nt, Human
ggccaggcugggcgcugc

SEQ ID NO: 255746 - RNA, 20 nt, Human
ggcucuggaggaggggcccc

SEQ ID NO: 255747 - RNA, 25 nt, Human
ggcucuggaggaggggccccugcgg

SEQ ID NO: 255748 - RNA, 21 nt, Human
gggcagcggccauguggcacu

SEQ ID NO: 255749 - RNA, 25 nt, Human
gggcuguggccaaaguguuugcccg

SEQ ID NO: 255750 - RNA, 19 nt, Human
ggggccaggcugggcgcug

SEQ ID NO: 255751 - RNA, 24 nt, Human
ggggcccuuccucggccugggaag

SEQ ID NO: 255752 - RNA, 18 nt, Human
ggggcuguggccaaagug

SEQ ID NO: 255753 - RNA, 22 nt, Human
gguccagccgguuuacaaagcc

SEQ ID NO: 255754 - RNA, 23 nt, Human
gugacagcagccucuccucuccc

SEQ ID NO: 255755 - RNA, 19 nt, Human
gugggccggccaguguggc

SEQ ID NO: 255756 - RNA, 21 nt, Human
uaaacaaaaauguagacugaa

SEQ ID NO: 255757 - RNA, 23 nt, Human
uaagaucccacugggcugacuga

SEQ ID NO: 255758 - RNA, 22 nt, Human
uacccuaagaccccaaaacagc

SEQ ID NO: 255759 - RNA, 21 nt, Human
uaggagguagagggcgcuggg

SEQ ID NO: 255760 - RNA, 27 nt, Human
ucaaacccccuggcagggucugcaggc

SEQ ID NO: 255761 - RNA, 19 nt, Human
ucaaagcugcagggaggug

SEQ ID NO: 255762 - RNA, 22 nt, Human
ucacagcagcggccacguggca

SEQ ID NO: 255763 - RNA, 23 nt, Human
ucagaucagaaggaaagaaacaa

SEQ ID NO: 255764 - RNA, 20 nt, Human
uccaagugccuaauucugac

SEQ ID NO: 255765 - RNA, 19 nt, Human
uccaucggcaacuucgucc

SEQ ID NO: 255766 - RNA, 23 nt, Human
uccaucggcaacuucguccauga

SEQ ID NO: 255767 - RNA, 24 nt, Human
ucccaccccauucccaggagcaga

SEQ ID NO: 255768 - RNA, 20 nt, Human
ucccccgcugcucugccguu

SEQ ID NO: 255769 - RNA, 22 nt, Human
ucccucuagaaugacugggucu

SEQ ID NO: 255770 - RNA, 20 nt, Human
ucccugcagccuggcaggug

SEQ ID NO: 255771 - RNA, 23 nt, Human
ucccuguggcucccaccccauuc

SEQ ID NO: 255772 - RNA, 20 nt, Human
uccgcagugggaaaccuggg

SEQ ID NO: 255773 - RNA, 21 nt, Human
uccugggcucugaccugaucu

SEQ ID NO: 255774 - RNA, 20 nt, Human
ucggagcugacugaucucac

SEQ ID NO: 255775 - RNA, 24 nt, Human
ucuaaaauaagaaaauaagaaagu

SEQ ID NO: 255776 - RNA, 21 nt, Human
ucucugggugagggacuucca

SEQ ID NO: 255777 - RNA, 23 nt, Human
ucucuggucugcccccaagaaga

SEQ ID NO: 255778 - RNA, 21 nt, Human
ucugcaggccgccccauccag

SEQ ID NO: 255779 - RNA, 18 nt, Human
ucuggucugcccccaaga

SEQ ID NO: 255780 - RNA, 19 nt, Human
ucuuugaucuugauggccc

SEQ ID NO: 255781 - RNA, 18 nt, Human
ugaaacaaaagcucagca

SEQ ID NO: 255782 - RNA, 21 nt, Human
ugaaacaaaagcucagcaaac

SEQ ID NO: 255783 - RNA, 19 nt, Human
ugacaacauccaucggcaa

SEQ ID NO: 255784 - RNA, 20 nt, Human
ugacaacauccaucggcaac

SEQ ID NO: 255785 - RNA, 21 nt, Human
ugacugaucucacugaggcac

SEQ ID NO: 255786 - RNA, 22 nt, Human
ugacugggucuaaguagggaga

SEQ ID NO: 255787 - RNA, 20 nt, Human
ugagagaggcaggaagagga

SEQ ID NO: 255788 - RNA, 24 nt, Human
ugagcugaaggcaggggaaggaga

SEQ ID NO: 255789 - RNA, 24 nt, Human
ugaguaaugggagcaaacacagga

SEQ ID NO: 255790 - RNA, 21 nt, Human
ugcccgggacgugggcagcgg

SEQ ID NO: 255791 - RNA, 21 nt, Human
ugcccgggacgugggcagcgg

SEQ ID NO: 255792 - RNA, 20 nt, Human
uggaggaggggccccugcgg

SEQ ID NO: 255793 - RNA, 22 nt, Human
uggaucccucuagaaugacugg

SEQ ID NO: 255794 - RNA, 19 nt, Human
uggaugcagccccaccccc

SEQ ID NO: 255795 - RNA, 19 nt, Human
uggcacuccaagcugggca

SEQ ID NO: 255796 - RNA, 18 nt, Human
ugggaaaccugggagggu

SEQ ID NO: 255797 - RNA, 23 nt, Human
ugggagcaaacacaggagggagg

SEQ ID NO: 255798 - RNA, 21 nt, Human
ugggcaggagacgcagggacc

SEQ ID NO: 255799 - RNA, 20 nt, Human
ugggcagugaccgccugggc

SEQ ID NO: 255800 - RNA, 22 nt, Human
ugggcagugaccgccugggcca

SEQ ID NO: 255801 - RNA, 18 nt, Human
uggggccagggagacgug

SEQ ID NO: 255802 - RNA, 20 nt, Human
uggggccagggagacguggu

SEQ ID NO: 255803 - RNA, 18 nt, Human
ugucaugaacaccaugaa

SEQ ID NO: 255804 - RNA, 21 nt, Human
ugucuugccugcaucccccuu

SEQ ID NO: 255805 - RNA, 23 nt, Human
ugucuugccugcaucccccuuca

SEQ ID NO: 255806 - RNA, 22 nt, Human
ugugcugaauguacagccacgu

SEQ ID NO: 255807 - RNA, 22 nt, Human
ugugcugaauguacagccacgu

SEQ ID NO: 255808 - RNA, 21 nt, Human
uguggcacuccaagcugggca

SEQ ID NO: 255809 - RNA, 24 nt, Human
uguggccaaaguguuugcccggcc

SEQ ID NO: 255810 - RNA, 22 nt, Human
uuaaaugccucauugauccauc

SEQ ID NO: 255811 - RNA, 19 nt, Human
uucacagucgccccaacuc

SEQ ID NO: 255812 - RNA, 20 nt, Human
uucacagucgccccaacucu

SEQ ID NO: 255813 - RNA, 20 nt, Human
uuggaugcagccccaccccc

SEQ ID NO: 255814 - RNA, 20 nt, Human
uuuuuuuuuuuuuuuucacg

SEQ ID NO: 255815 - RNA, 20 nt, Human
aaacaaaucaaaugcauggc

SEQ ID NO: 255816 - RNA, 21 nt, Human
acccagcaccauuacuaacug

SEQ ID NO: 255817 - RNA, 21 nt, Human
agaagaaaguugccaaggaca

SEQ ID NO: 255818 - RNA, 19 nt, Human
cagcaccauuacuaacugu

SEQ ID NO: 255819 - RNA, 19 nt, Human
ccaguacggacgggaacac

SEQ ID NO: 255820 - RNA, 21 nt, Human
cgcgacaagagcuagccucca

SEQ ID NO: 255821 - RNA, 18 nt, Human
cggccgcgacaagagcua

SEQ ID NO: 255822 - RNA, 21 nt, Human
uaacagcaagagauuggucuu

SEQ ID NO: 255823 - RNA, 18 nt, Human
ucagaagaaaguugccaa

SEQ ID NO: 255824 - RNA, 23 nt, Human
ucagauaucagaagaaaguugcc

SEQ ID NO: 255825 - RNA, 24 nt, Human
ugccaaggacagaacugauuuaac

SEQ ID NO: 255826 - RNA, 21 nt, Human
uggcucugucuuggguggcgg

SEQ ID NO: 255827 - RNA, 25 nt, Human
aaagauccaggguagcugagggaug

SEQ ID NO: 255828 - RNA, 23 nt, Human
acaaguugcacaaaucaaaaaau

SEQ ID NO: 255829 - RNA, 19 nt, Human
accuccguacgccccccuc

SEQ ID NO: 255830 - RNA, 19 nt, Human
agagaggcugagggcccgg

SEQ ID NO: 255831 - RNA, 19 nt, Human
agagaggcugagggcccgg

SEQ ID NO: 255832 - RNA, 20 nt, Human
aggaggagggagagaguuag

SEQ ID NO: 255833 - RNA, 20 nt, Human
aggaugggaaaggugagggg

SEQ ID NO: 255834 - RNA, 18 nt, Human
aggcugagggcccggggc

SEQ ID NO: 255835 - RNA, 22 nt, Human
agggggccccuaaacccagagc

SEQ ID NO: 255836 - RNA, 19 nt, Human
agggggcuccacacagugc

SEQ ID NO: 255837 - RNA, 18 nt, Human
caagagaggcugagggcc

SEQ ID NO: 255838 - RNA, 25 nt, Human
cacacagugcccgauucgggcucag

SEQ ID NO: 255839 - RNA, 20 nt, Human
cagagcucaccccaaaaugc

SEQ ID NO: 255840 - RNA, 19 nt, Human
cagcugccaccuccguacg

SEQ ID NO: 255841 - RNA, 24 nt, Human
cagucugcuccuuccacagcccua

SEQ ID NO: 255842 - RNA, 22 nt, Human
ccaccuccguacgccccccucg

SEQ ID NO: 255843 - RNA, 21 nt, Human
ccagagcucaccccaaaaugc

SEQ ID NO: 255844 - RNA, 19 nt, Human
cccggaacguggggauugg

SEQ ID NO: 255845 - RNA, 20 nt, Human
cccugagacccccagggaga

SEQ ID NO: 255846 - RNA, 18 nt, Human
ccucccacagcugccacc

SEQ ID NO: 255847 - RNA, 25 nt, Human
ccucccacagcugccaccuccguac

SEQ ID NO: 255848 - RNA, 23 nt, Human
ccuccucccacagcugccaccuc

SEQ ID NO: 255849 - RNA, 24 nt, Human
cgugaaagguucucccugagaccc

SEQ ID NO: 255850 - RNA, 19 nt, Human
cuaaacccagagcucaccc

SEQ ID NO: 255851 - RNA, 29 nt, Human
cucccugagacccccagggagaggugggg

SEQ ID NO: 255852 - RNA, 19 nt, Human
cucugaggaagaggugggc

SEQ ID NO: 255853 - RNA, 24 nt, Human
gaagucaucaaugguaaaccagga

SEQ ID NO: 255854 - RNA, 21 nt, Human
gccaccuccguacgccccccu

SEQ ID NO: 255855 - RNA, 19 nt, Human
gcucugaggaagagguggg

SEQ ID NO: 255856 - RNA, 18 nt, Human
ggaugauuucucagccuc

SEQ ID NO: 255857 - RNA, 23 nt, Human
ggcgaagucaucaaugguaaacc

SEQ ID NO: 255858 - RNA, 20 nt, Human
gggaugggaaucgagaggaa

SEQ ID NO: 255859 - RNA, 20 nt, Human
gggcaaagauccaggguagc

SEQ ID NO: 255860 - RNA, 24 nt, Human
gggggcucugaggaagaggugggc

SEQ ID NO: 255861 - RNA, 18 nt, Human
gguccgggcuugagcucc

SEQ ID NO: 255862 - RNA, 23 nt, Human
guacaagagaggcugagggcccg

SEQ ID NO: 255863 - RNA, 20 nt, Human
ucagcuccagggggcuccac

SEQ ID NO: 255864 - RNA, 19 nt, Human
ucagggucgcggcccggaa

SEQ ID NO: 255865 - RNA, 19 nt, Human
uccauaaacaccuaguuac

SEQ ID NO: 255866 - RNA, 19 nt, Human
ucgcggcccggaacguggg

SEQ ID NO: 255867 - RNA, 25 nt, Human
ucgggcucagcggcccaaccggacg

SEQ ID NO: 255868 - RNA, 30 nt, Human
ugagacccccagggagaggugggggccggg

SEQ ID NO: 255869 - RNA, 24 nt, Human
ugagcuccucggccuuccacgccg

SEQ ID NO: 255870 - RNA, 21 nt, Human
ugcccgauucgggcucagcgg

SEQ ID NO: 255871 - RNA, 18 nt, Human
uggcagaaugaaaaauca

SEQ ID NO: 255872 - RNA, 19 nt, Human
uggcaggaguaggauggga

SEQ ID NO: 255873 - RNA, 22 nt, Human
ugggggcucugaggaagaggug

SEQ ID NO: 255874 - RNA, 19 nt, Human
ugugugugggcaggaggag

SEQ ID NO: 255875 - RNA, 21 nt, Human
uuuuuuuuucuuuuuuccauu

SEQ ID NO: 255876 - RNA, 24 nt, Human
uuuuuuuuuuucuuuuuuccauuc

SEQ ID NO: 255877 - RNA, 25 nt, Human
uuuuuuuuuuuuuuuuuuucuuuuu

SEQ ID NO: 255878 - RNA, 21 nt, Human
agaaagaagaacacaucccac

SEQ ID NO: 255879 - RNA, 18 nt, Human
aggcaaguauaagucuua

SEQ ID NO: 255880 - RNA, 22 nt, Human
cacacuuugauacaacacuuug

SEQ ID NO: 255881 - RNA, 30 nt, Human
gaagaacacaucccacagugcauaaauaaa

SEQ ID NO: 255882 - RNA, 21 nt, Human
aaaaaaaacuguacaaaaaca

SEQ ID NO: 255883 - RNA, 20 nt, Human
aaaaaucacccaccccuuca

SEQ ID NO: 255884 - RNA, 25 nt, Human
aagaagacugaagggaaaagagggg

SEQ ID NO: 255885 - RNA, 19 nt, Human
acaaaaacaaaaaucaccc

SEQ ID NO: 255886 - RNA, 21 nt, Human
acaaaaaucacccaccccuuc

SEQ ID NO: 255887 - RNA, 21 nt, Human
agucagggccgugcugguacc

SEQ ID NO: 255888 - RNA, 18 nt, Human
auagcaaccuucugugcc

SEQ ID NO: 255889 - RNA, 22 nt, Human
auucagucagggccgugcuggu

SEQ ID NO: 255890 - RNA, 19 nt, Human
caagaaagacugauacaga

SEQ ID NO: 255891 - RNA, 27 nt, Human
caagaaagacugauacagagagcccug

SEQ ID NO: 255892 - RNA, 30 nt, Human
cagugaacaucccuuuguuccuuuuagacu

SEQ ID NO: 255893 - RNA, 19 nt, Human
cagugcagaaacccugggg

SEQ ID NO: 255894 - RNA, 23 nt, Human
cagugcagaaacccugggggcag

SEQ ID NO: 255895 - RNA, 18 nt, Human
cccugggggcagccuggg

SEQ ID NO: 255896 - RNA, 19 nt, Human
cugcucucugcucagaggc

SEQ ID NO: 255897 - RNA, 22 nt, Human
cugguaccugcugcugcugcuc

SEQ ID NO: 255898 - RNA, 27 nt, Human
cuucaaauaauuuuuuuuuuuuuuuuu

SEQ ID NO: 255899 - RNA, 19 nt, Human
cuuggacuugagcaucagc

SEQ ID NO: 255900 - RNA, 24 nt, Human
gaaaagaggggaccagugcagaaa

SEQ ID NO: 255901 - RNA, 21 nt, Human
gccugggaaggcagacuaccc

SEQ ID NO: 255902 - RNA, 22 nt, Human
uaaacugucauuaaauuuuauc

SEQ ID NO: 255903 - RNA, 25 nt, Human
uacuauauagcaaccuucugugccc

SEQ ID NO: 255904 - RNA, 22 nt, Human
ucagggacacugggcugauuca

SEQ ID NO: 255905 - RNA, 19 nt, Human
ucucugacuggaaauaauu

SEQ ID NO: 255906 - RNA, 21 nt, Human
ucucugcucagaggcauacag

SEQ ID NO: 255907 - RNA, 22 nt, Human
ugaaaaaaaacuguacaaaaac

SEQ ID NO: 255908 - RNA, 18 nt, Human
ugaagcuugaaaaaaaac

SEQ ID NO: 255909 - RNA, 23 nt, Human
ugaauugucuuuaggcuugaauu

SEQ ID NO: 255910 - RNA, 20 nt, Human
ugcagaaacccugggggcag

SEQ ID NO: 255911 - RNA, 19 nt, Human
ugcugcugcugcucucugc

SEQ ID NO: 255912 - RNA, 21 nt, Human
ugcugcugcugcucucugcuc

SEQ ID NO: 255913 - RNA, 22 nt, Human
ugcugguaccugcugcugcugc

SEQ ID NO: 255914 - RNA, 18 nt, Human
uggaugcaaaugaaugaa

SEQ ID NO: 255915 - RNA, 18 nt, Human
uggugagaaugccaggca

SEQ ID NO: 255916 - RNA, 25 nt, Human
uguacaaaaacaaaaaucacccacc

SEQ ID NO: 255917 - RNA, 19 nt, Human
ugucuaagcugcucaggga

SEQ ID NO: 255918 - RNA, 19 nt, Human
ugugaagcuugaaaaaaaa

SEQ ID NO: 255919 - RNA, 24 nt, Human
uucagucagggccgugcugguacc

SEQ ID NO: 255920 - RNA, 20 nt, Human
uuuuuuuuuuuuaaacuguc

SEQ ID NO: 255921 - RNA, 19 nt, Human
agccucccaggaccccggc

SEQ ID NO: 255922 - RNA, 19 nt, Human
aggcgagacgggagaggag

SEQ ID NO: 255923 - RNA, 20 nt, Human
cccccgggccccgcgucgcu

SEQ ID NO: 255924 - RNA, 21 nt, Human
cccccgggccccgcgucgcuc

SEQ ID NO: 255925 - RNA, 22 nt, Human
ccccgccccgcccccgggcccc

SEQ ID NO: 255926 - RNA, 21 nt, Human
ccccgccgcccucauugucug

SEQ ID NO: 255927 - RNA, 20 nt, Human
ccccgggccccgcgucgcuc

SEQ ID NO: 255928 - RNA, 19 nt, Human
cccgccagccccgcggaac

SEQ ID NO: 255929 - RNA, 18 nt, Human
cccgccccgcccccgggc

SEQ ID NO: 255930 - RNA, 18 nt, Human
ccgccccgcccccgggcc

SEQ ID NO: 255931 - RNA, 18 nt, Human
ccgccgccgccgccgccg

SEQ ID NO: 255932 - RNA, 18 nt, Human
ccgccgccgccgccgccg

SEQ ID NO: 255933 - RNA, 25 nt, Human
ccgccgccgccgccgccgaucccgg

SEQ ID NO: 255934 - RNA, 23 nt, Human
ccgccgccgccgccgccgccgau

SEQ ID NO: 255935 - RNA, 23 nt, Human
ccgccgccgccgccgccgccgcc

SEQ ID NO: 255936 - RNA, 24 nt, Human
ccgccgccgccgccgccgccgccg

SEQ ID NO: 255937 - RNA, 24 nt, Human
ccgccgccgccgccgccgccgccg

SEQ ID NO: 255938 - RNA, 25 nt, Human
ccgccgccgccgccgccgccgccga

SEQ ID NO: 255939 - RNA, 26 nt, Human
ccgccgccgccgccgccgccgccgcu

SEQ ID NO: 255940 - RNA, 23 nt, Human
ccgccgccgccgccgccgccgcu

SEQ ID NO: 255941 - RNA, 23 nt, Human
ccgccgccgccgccgccgcucaa

SEQ ID NO: 255942 - RNA, 25 nt, Human
ccgccgccgccgccgcucaacgccg

SEQ ID NO: 255943 - RNA, 22 nt, Human
ccgccgccgcucaacgccgccc

SEQ ID NO: 255944 - RNA, 21 nt, Human
ccggccgcccgcucgcccgcc

SEQ ID NO: 255945 - RNA, 18 nt, Human
cgagacgggagaggaggg

SEQ ID NO: 255946 - RNA, 22 nt, Human
cgccccgcccccgggccccgcg

SEQ ID NO: 255947 - RNA, 21 nt, Human
cgccgccgccgccgccgaucc

SEQ ID NO: 255948 - RNA, 25 nt, Human
cgccgccgccgccgccgccgccggc

SEQ ID NO: 255949 - RNA, 21 nt, Human
cggccgcccgcucgcccgcca

SEQ ID NO: 255950 - RNA, 20 nt, Human
cggcggugggggcccggcac

SEQ ID NO: 255951 - RNA, 19 nt, Human
cucgccgccgccgccgccg

SEQ ID NO: 255952 - RNA, 22 nt, Human
gcgccgccgccgccgccgccgg

SEQ ID NO: 255953 - RNA, 18 nt, Human
gggcaggcgaggccuggc

SEQ ID NO: 255954 - RNA, 27 nt, Human
ucccaggaccccggcggugggggcccc

SEQ ID NO: 255955 - RNA, 25 nt, Human
ucgccgccgccgccgccgccgccgg

SEQ ID NO: 255956 - RNA, 20 nt, Human
ucgcucgccgccgccgccgc

SEQ ID NO: 255957 - RNA, 26 nt, Human
ucgcucgccgccgccgccgccgccgg

SEQ ID NO: 255958 - RNA, 22 nt, Human
aaaaaaaaucauccacaaaacc

SEQ ID NO: 255959 - RNA, 20 nt, Human
aaaaacccgaaagcccagcc

SEQ ID NO: 255960 - RNA, 25 nt, Human
aaaaauaguucccaaggcauugaau

SEQ ID NO: 255961 - RNA, 21 nt, Human
aaaacaaaaaaacccgaaagc

SEQ ID NO: 255962 - RNA, 23 nt, Human
aaaacaaaaaaacccgaaagccc

SEQ ID NO: 255963 - RNA, 23 nt, Human
aaaacaaaaaacaaaaaaacccg

SEQ ID NO: 255964 - RNA, 21 nt, Human
aaaacaaaacaaaacaaaaaa

SEQ ID NO: 255965 - RNA, 21 nt, Human
aaaacccgaaagcccagccuc

SEQ ID NO: 255966 - RNA, 24 nt, Human
aaaauauagccucucuaagaagca

SEQ ID NO: 255967 - RNA, 21 nt, Human
aaaauuaaaacaagauuuggg

SEQ ID NO: 255968 - RNA, 23 nt, Human
aaacaaaacaaaacaaaaaacaa

SEQ ID NO: 255969 - RNA, 24 nt, Human
aaacaaaacaaaacaaaaaacaaa

SEQ ID NO: 255970 - RNA, 22 nt, Human
aaacaaaacaaaacaaaacaaa

SEQ ID NO: 255971 - RNA, 22 nt, Human
aaacaaaacaaaacaaaacaaa

SEQ ID NO: 255972 - RNA, 24 nt, Human
aaacaauuuuaauaauaccaagau

SEQ ID NO: 255973 - RNA, 19 nt, Human
aaagcccagccucaagccu

SEQ ID NO: 255974 - RNA, 24 nt, Human
aaauucaauaauucacagaaagga

SEQ ID NO: 255975 - RNA, 18 nt, Human
aacagccucacacagacc

SEQ ID NO: 255976 - RNA, 19 nt, Human
aaccugccauaaagaacac

SEQ ID NO: 255977 - RNA, 20 nt, Human
aagaaaacaaaacaaaacaa

SEQ ID NO: 255978 - RNA, 20 nt, Human
aagaacacaacccuucacaa

SEQ ID NO: 255979 - RNA, 24 nt, Human
aagaaucugugguaggaagcaagc

SEQ ID NO: 255980 - RNA, 25 nt, Human
aagcaaagcaaguugccuuccuuag

SEQ ID NO: 255981 - RNA, 18 nt, Human
aaggagcuguaggguuuc

SEQ ID NO: 255982 - RNA, 18 nt, Human
aagucaccgagaaaccaa

SEQ ID NO: 255983 - RNA, 23 nt, Human
aauuacauuuuuguuuaaacagc

SEQ ID NO: 255984 - RNA, 23 nt, Human
aauucucucacagaucacauauu

SEQ ID NO: 255985 - RNA, 25 nt, Human
acaaaauauucuugcaagauuuaaa

SEQ ID NO: 255986 - RNA, 19 nt, Human
acacaccaaaccuaccagg

SEQ ID NO: 255987 - RNA, 22 nt, Human
acacaccaaaccuaccaggcaa

SEQ ID NO: 255988 - RNA, 19 nt, Human
acacaucaaggucuuaugc

SEQ ID NO: 255989 - RNA, 20 nt, Human
acagcugucauucucuggcu

SEQ ID NO: 255990 - RNA, 22 nt, Human
accacucacacugugagagaua

SEQ ID NO: 255991 - RNA, 21 nt, Human
accuuacauccguuaauccua

SEQ ID NO: 255992 - RNA, 21 nt, Human
acuguucauuuaacacagguu

SEQ ID NO: 255993 - RNA, 24 nt, Human
agaaaaaaaaaaacccacaaagag

SEQ ID NO: 255994 - RNA, 25 nt, Human
agaaaacaaaacaaaacaaaacaaa

SEQ ID NO: 255995 - RNA, 20 nt, Human
agcaaaaagacccuaugaac

SEQ ID NO: 255996 - RNA, 22 nt, Human
agcaugcagugaaaaagugcaa

SEQ ID NO: 255997 - RNA, 20 nt, Human
aggaaacauguccaggggca

SEQ ID NO: 255998 - RNA, 20 nt, Human
aggaagcaagcagguuuaag

SEQ ID NO: 255999 - RNA, 22 nt, Human
aggacaaaaggggaggggaugg

SEQ ID NO: 256000 - RNA, 24 nt, Human
agggaccagaccucugacuuaagu

SEQ ID NO: 256001 - RNA, 20 nt, Human
aggggugggaaauggcaggg

SEQ ID NO: 256002 - RNA, 21 nt, Human
aguauaauuugauaaauuuua

SEQ ID NO: 256003 - RNA, 23 nt, Human
agucaccgagaaaccaacacaac

SEQ ID NO: 256004 - RNA, 19 nt, Human
agucccuuucgcugaagca

SEQ ID NO: 256005 - RNA, 19 nt, Human
auaaagcagaggaguaaaa

SEQ ID NO: 256006 - RNA, 23 nt, Human
aucuggucagguauaaauguugg

SEQ ID NO: 256007 - RNA, 21 nt, Human
augcucuggcacaaucugcau

SEQ ID NO: 256008 - RNA, 20 nt, Human
caaaaaaacccgaaagccca

SEQ ID NO: 256009 - RNA, 21 nt, Human
caaaaaacaaaaaaacccgaa

SEQ ID NO: 256010 - RNA, 23 nt, Human
caaaacaaaaaacaaaaaaaccc

SEQ ID NO: 256011 - RNA, 29 nt, Human
caaaacaaaacaaaaaacaaaaaaacccc

SEQ ID NO: 256012 - RNA, 24 nt, Human
caaaacaaaacaaaacaaaacaaa

SEQ ID NO: 256013 - RNA, 25 nt, Human
caaaacaaaacaaaacaaaacaaaa

SEQ ID NO: 256014 - RNA, 22 nt, Human
caaaacagauaauaugaagguc

SEQ ID NO: 256015 - RNA, 24 nt, Human
caaauacaacucaaacuucauaaa

SEQ ID NO: 256016 - RNA, 22 nt, Human
caaccaccccaaaucucuacau

SEQ ID NO: 256017 - RNA, 20 nt, Human
caaccguaacagcaaaaaga

SEQ ID NO: 256018 - RNA, 23 nt, Human
caagaucaucucuggggccagcc

SEQ ID NO: 256019 - RNA, 19 nt, Human
caagucaccgagaaaccaa

SEQ ID NO: 256020 - RNA, 26 nt, Human
cacaacacacacacacacacacaccu

SEQ ID NO: 256021 - RNA, 20 nt, Human
cacacaacacacacacacac

SEQ ID NO: 256022 - RNA, 28 nt, Human
cacacaacacacacacacacacacaccu

SEQ ID NO: 256023 - RNA, 20 nt, Human
cacacaaccccaacaugaac

SEQ ID NO: 256024 - RNA, 18 nt, Human
cacacacacacacacaca

SEQ ID NO: 256025 - RNA, 19 nt, Human
cacaguguccaaccaauga

SEQ ID NO: 256026 - RNA, 18 nt, Human
caccauaauuaagaacug

SEQ ID NO: 256027 - RNA, 18 nt, Human
caccccaaaucucuacau

SEQ ID NO: 256028 - RNA, 18 nt, Human
cacgcucgaagaccgccg

SEQ ID NO: 256029 - RNA, 23 nt, Human
cacgcucgaagaccgccggcgcc

SEQ ID NO: 256030 - RNA, 19 nt, Human
cacuggggccucugcggcg

SEQ ID NO: 256031 - RNA, 21 nt, Human
cacuguucauuggcagaaagu

SEQ ID NO: 256032 - RNA, 22 nt, Human
cagaaaguggggcacaguggag

SEQ ID NO: 256033 - RNA, 19 nt, Human
cagcacaguaaugagaagu

SEQ ID NO: 256034 - RNA, 18 nt, Human
cagccccgggcucggccc

SEQ ID NO: 256035 - RNA, 19 nt, Human
cagcgccgcgcucaccauu

SEQ ID NO: 256036 - RNA, 22 nt, Human
cagggguaggaaauggcagcgc

SEQ ID NO: 256037 - RNA, 23 nt, Human
caguacagauuuugccuuuggga

SEQ ID NO: 256038 - RNA, 24 nt, Human
caguacagauuuugccuuugggaa

SEQ ID NO: 256039 - RNA, 23 nt, Human
cauccgggcacuggggccucugc

SEQ ID NO: 256040 - RNA, 24 nt, Human
caugagggaccagaccucugacuu

SEQ ID NO: 256041 - RNA, 19 nt, Human
cauucaaaauggacuuggu

SEQ ID NO: 256042 - RNA, 24 nt, Human
ccaaaacucaaaagaaaaaaaauc

SEQ ID NO: 256043 - RNA, 24 nt, Human
ccagaccucugacuuaagugacaa

SEQ ID NO: 256044 - RNA, 27 nt, Human
ccagcaacagcacaacgcgggccacag

SEQ ID NO: 256045 - RNA, 22 nt, Human
ccagcgccgcgcucaccauuug

SEQ ID NO: 256046 - RNA, 18 nt, Human
cccaugugcuguggcucc

SEQ ID NO: 256047 - RNA, 20 nt, Human
cccccacgcucgaagaccgc

SEQ ID NO: 256048 - RNA, 21 nt, Human
ccccuagacaaucaaggacuc

SEQ ID NO: 256049 - RNA, 22 nt, Human
cccgaaagcccagccucaagcc

SEQ ID NO: 256050 - RNA, 19 nt, Human
cccgcgggcccugcugcca

SEQ ID NO: 256051 - RNA, 22 nt, Human
cccgggcucggcccguauuggc

SEQ ID NO: 256052 - RNA, 18 nt, Human
ccucacacagaccacuca

SEQ ID NO: 256053 - RNA, 24 nt, Human
ccucaccacugcuacuagguggcc

SEQ ID NO: 256054 - RNA, 21 nt, Human
ccucauuucauuugcaacuug

SEQ ID NO: 256055 - RNA, 21 nt, Human
cgaaauaaagccugauucugg

SEQ ID NO: 256056 - RNA, 19 nt, Human
cgcagccccgggcucggcc

SEQ ID NO: 256057 - RNA, 22 nt, Human
cgcgggcccugcugccagcgcc

SEQ ID NO: 256058 - RNA, 22 nt, Human
cgcucgaagaccgccggcgccc

SEQ ID NO: 256059 - RNA, 20 nt, Human
cggagccgggcggggacgcg

SEQ ID NO: 256060 - RNA, 27 nt, Human
cuaaaaaaaaacuauaauucucucacu

SEQ ID NO: 256061 - RNA, 23 nt, Human
cuaccaagagaguuccugcauuc

SEQ ID NO: 256062 - RNA, 22 nt, Human
cucaaaagaaaaaaaaucaucc

SEQ ID NO: 256063 - RNA, 21 nt, Human
cucccaaaacucaaaagaaaa

SEQ ID NO: 256064 - RNA, 22 nt, Human
cucccaucccucgacacauccc

SEQ ID NO: 256065 - RNA, 20 nt, Human
cuccuccucaccgcuccgac

SEQ ID NO: 256066 - RNA, 19 nt, Human
cucugcuucugcauaacca

SEQ ID NO: 256067 - RNA, 18 nt, Human
cugaaggaacagccucac

SEQ ID NO: 256068 - RNA, 19 nt, Human
cuguccuuuaguuaggaag

SEQ ID NO: 256069 - RNA, 24 nt, Human
cuugcugggcccucccacuccuca

SEQ ID NO: 256070 - RNA, 20 nt, Human
gaagaccgccggcgcccaac

SEQ ID NO: 256071 - RNA, 20 nt, Human
gaagcagauuucauguuucu

SEQ ID NO: 256072 - RNA, 18 nt, Human
gaaugggacaaaggcgga

SEQ ID NO: 256073 - RNA, 18 nt, Human
gaccagaccucugacuua

SEQ ID NO: 256074 - RNA, 21 nt, Human
gagaacacucuggagugaagg

SEQ ID NO: 256075 - RNA, 25 nt, Human
gagcuggggucaaugugcagcgcuc

SEQ ID NO: 256076 - RNA, 19 nt, Human
gaggggauggcuaagggag

SEQ ID NO: 256077 - RNA, 23 nt, Human
gauacuuuucccauucagggcac

SEQ ID NO: 256078 - RNA, 18 nt, Human
gcaaaaauaguucccaag

SEQ ID NO: 256079 - RNA, 24 nt, Human
gcagccccgggcucggcccguauu

SEQ ID NO: 256080 - RNA, 20 nt, Human
gcccagccucaagccucaac

SEQ ID NO: 256081 - RNA, 21 nt, Human
gcuacacacacaccaaaccua

SEQ ID NO: 256082 - RNA, 22 nt, Human
ggacccaaaacaaaagagacaa

SEQ ID NO: 256083 - RNA, 20 nt, Human
ggauucaucagccacuaccu

SEQ ID NO: 256084 - RNA, 19 nt, Human
ggcaggagcggggguugcc

SEQ ID NO: 256085 - RNA, 20 nt, Human
ggcccguauuggcucgcgcu

SEQ ID NO: 256086 - RNA, 20 nt, Human
ggcgcccaacgccugcccag

SEQ ID NO: 256087 - RNA, 21 nt, Human
gggaggggauggcuaagggag

SEQ ID NO: 256088 - RNA, 19 nt, Human
gggccacaguuccuccuca

SEQ ID NO: 256089 - RNA, 18 nt, Human
gggcggcaggagcggggg

SEQ ID NO: 256090 - RNA, 22 nt, Human
ggggaggggauggcuaagggag

SEQ ID NO: 256091 - RNA, 19 nt, Human
ggggcggcaggagcggggg

SEQ ID NO: 256092 - RNA, 21 nt, Human
guuuaaacagcaauuaauccu

SEQ ID NO: 256093 - RNA, 18 nt, Human
uaaaagcacuuuagccau

SEQ ID NO: 256094 - RNA, 20 nt, Human
uaaacagaugaaauggcaaa

SEQ ID NO: 256095 - RNA, 25 nt, Human
uaaauacugcuaaucaguggcaaag

SEQ ID NO: 256096 - RNA, 21 nt, Human
uaacagauggacacacaaugc

SEQ ID NO: 256097 - RNA, 23 nt, Human
uaacagcaaaaagacccuaugaa

SEQ ID NO: 256098 - RNA, 20 nt, Human
uaagauaccaaauaaggcaa

SEQ ID NO: 256099 - RNA, 19 nt, Human
uaaggccacugaaaaagca

SEQ ID NO: 256100 - RNA, 22 nt, Human
uaauaaaacaguaagcuccuga

SEQ ID NO: 256101 - RNA, 24 nt, Human
uacaagaaaacaaaacaaaacaaa

SEQ ID NO: 256102 - RNA, 25 nt, Human
uacaagaaaacaaaacaaaacaaaa

SEQ ID NO: 256103 - RNA, 20 nt, Human
uacacacauacacacacaca

SEQ ID NO: 256104 - RNA, 24 nt, Human
uacagcuugauccucuuaugaaaa

SEQ ID NO: 256105 - RNA, 21 nt, Human
uaccaggcaauuacuguucau

SEQ ID NO: 256106 - RNA, 19 nt, Human
uagcagaaaaauauagccu

SEQ ID NO: 256107 - RNA, 21 nt, Human
uagcaucccuucauggcugca

SEQ ID NO: 256108 - RNA, 23 nt, Human
uagccaucuggucagguauaaau

SEQ ID NO: 256109 - RNA, 19 nt, Human
uaggcacuucucuacccag

SEQ ID NO: 256110 - RNA, 24 nt, Human
uauauacaaccguaacagcaaaaa

SEQ ID NO: 256111 - RNA, 27 nt, Human
uaucaaguucagagaaaaaaaaaaacc

SEQ ID NO: 256112 - RNA, 19 nt, Human
uaucacuugcaguguuuga

SEQ ID NO: 256113 - RNA, 19 nt, Human
ucaaaacagauaauaugaa

SEQ ID NO: 256114 - RNA, 18 nt, Human
ucaaacgacuauacaagg

SEQ ID NO: 256115 - RNA, 23 nt, Human
ucaaccaaaucaaaucuagcuga

SEQ ID NO: 256116 - RNA, 22 nt, Human
ucauccacaaaacccuuuacca

SEQ ID NO: 256117 - RNA, 21 nt, Human
ucccugaagccauggcgaaac

SEQ ID NO: 256118 - RNA, 23 nt, Human
ucccugaagccauggcgaaacaa

SEQ ID NO: 256119 - RNA, 23 nt, Human
uccgggcacuggggccucugcgg

SEQ ID NO: 256120 - RNA, 21 nt, Human
ucuaaacauccugagaccuga

SEQ ID NO: 256121 - RNA, 21 nt, Human
ucucgagccccgggcguccuc

SEQ ID NO: 256122 - RNA, 20 nt, Human
ucugcauaaccacagugucc

SEQ ID NO: 256123 - RNA, 20 nt, Human
ucuggucagguauaaauguu

SEQ ID NO: 256124 - RNA, 18 nt, Human
ugaaacaaacgucuggac

SEQ ID NO: 256125 - RNA, 20 nt, Human
ugaagccauggcgaaacaaa

SEQ ID NO: 256126 - RNA, 18 nt, Human
ugagaagucagagcuggg

SEQ ID NO: 256127 - RNA, 22 nt, Human
ugagaagucagagcugggguca

SEQ ID NO: 256128 - RNA, 21 nt, Human
ugaugcuaguaacauuaaugu

SEQ ID NO: 256129 - RNA, 21 nt, Human
ugcauauuugagguucacaug

SEQ ID NO: 256130 - RNA, 22 nt, Human
ugcgugcguacauacacacaua

SEQ ID NO: 256131 - RNA, 18 nt, Human
uggacaacaugaguuacc

SEQ ID NO: 256132 - RNA, 21 nt, Human
uggcaauaacuuacggagggc

SEQ ID NO: 256133 - RNA, 23 nt, Human
uggcagaaaguggggcacagugg

SEQ ID NO: 256134 - RNA, 22 nt, Human
uggcagcgccaaguccuccugu

SEQ ID NO: 256135 - RNA, 20 nt, Human
ugggaauggacuagcguggc

SEQ ID NO: 256136 - RNA, 23 nt, Human
ugggacccaaaacaaaagagaca

SEQ ID NO: 256137 - RNA, 18 nt, Human
uggggcacaguggagucc

SEQ ID NO: 256138 - RNA, 18 nt, Human
ugggggcggcaggagcgg

SEQ ID NO: 256139 - RNA, 18 nt, Human
ugguaggaagcaagcagg

SEQ ID NO: 256140 - RNA, 25 nt, Human
ugguggcaauaucacuugcaguguu

SEQ ID NO: 256141 - RNA, 21 nt, Human
ugguucccuucuuccccaagg

SEQ ID NO: 256142 - RNA, 24 nt, Human
uguagaggacacaauggcuuucuu

SEQ ID NO: 256143 - RNA, 25 nt, Human
uuaaaaacacugcacucaaaguaau

SEQ ID NO: 256144 - RNA, 22 nt, Human
uuaaaacaagauuugggacaca

SEQ ID NO: 256145 - RNA, 20 nt, Human
uuaaacaaaacuuuaaaagc

SEQ ID NO: 256146 - RNA, 18 nt, Human
uuaaaggauacaggacaa

SEQ ID NO: 256147 - RNA, 27 nt, Human
uuaaaguuucaaugaaaaagaaaaauc

SEQ ID NO: 256148 - RNA, 20 nt, Human
uuagacucuauuuucacucc

SEQ ID NO: 256149 - RNA, 23 nt, Human
uuaggucagccacugccuggucc

SEQ ID NO: 256150 - RNA, 20 nt, Human
uuaguaaaguguuuuuucau

SEQ ID NO: 256151 - RNA, 23 nt, Human
uuaguaaaguguuuuuucauuau

SEQ ID NO: 256152 - RNA, 22 nt, Human
uucaaaagucuaaucaaccacc

SEQ ID NO: 256153 - RNA, 19 nt, Human
uucaaaugaucuaccucag

SEQ ID NO: 256154 - RNA, 20 nt, Human
uucaagggacaaauaaaauc

SEQ ID NO: 256155 - RNA, 20 nt, Human
uucacaaagccccaaguugc

SEQ ID NO: 256156 - RNA, 20 nt, Human
uucacagaaaggacagaaac

SEQ ID NO: 256157 - RNA, 24 nt, Human
uucauacacccauuuaagcuaaau

SEQ ID NO: 256158 - RNA, 22 nt, Human
uucucuggcuuucaccuaaaca

SEQ ID NO: 256159 - RNA, 19 nt, Human
uuuaagcuaaauugcacuu

SEQ ID NO: 256160 - RNA, 22 nt, Human
uuucuuguucacugacgaaacu

SEQ ID NO: 256161 - RNA, 19 nt, Human
uuugcauuugucuuacucu

SEQ ID NO: 256162 - RNA, 23 nt, Human
uuuguguugcacaucuucccauu

SEQ ID NO: 256163 - RNA, 21 nt, Human
aaaaaaaaccaaaaaaaaaaa

SEQ ID NO: 256164 - RNA, 25 nt, Human
aaaaaaaaccaaaaaaaaaaaacac

SEQ ID NO: 256165 - RNA, 22 nt, Human
aaaaaaaccaaaaaaaaaaaac

SEQ ID NO: 256166 - RNA, 20 nt, Human
aaaaaaauccccccaucccc

SEQ ID NO: 256167 - RNA, 20 nt, Human
aaaaauccccccauccccaa

SEQ ID NO: 256168 - RNA, 18 nt, Human
aaaauccccccaucccca

SEQ ID NO: 256169 - RNA, 22 nt, Human
aaaauccccccauccccaaccg

SEQ ID NO: 256170 - RNA, 26 nt, Human
aaaauccccccauccccaaccgucuu

SEQ ID NO: 256171 - RNA, 23 nt, Human
aaacaaaagguggaaaauacaga

SEQ ID NO: 256172 - RNA, 21 nt, Human
aaacagacacaagaauguuga

SEQ ID NO: 256173 - RNA, 24 nt, Human
aaacagacacaagaauguugauga

SEQ ID NO: 256174 - RNA, 23 nt, Human
aaacagguauugaaccacugaau

SEQ ID NO: 256175 - RNA, 26 nt, Human
aaacagguauugaaccacugaaucua

SEQ ID NO: 256176 - RNA, 24 nt, Human
aaagaccacaaagaagaaaaucaa

SEQ ID NO: 256177 - RNA, 20 nt, Human
aacaagaacaaaaaaauccc

SEQ ID NO: 256178 - RNA, 23 nt, Human
aacaagaacaaaaaaaucccccc

SEQ ID NO: 256179 - RNA, 21 nt, Human
aacaagaacaaaaaaucacaa

SEQ ID NO: 256180 - RNA, 23 nt, Human
aaccaaaaaaaaaaaaaaccaaa

SEQ ID NO: 256181 - RNA, 18 nt, Human
aagaacaaaaaaaucccc

SEQ ID NO: 256182 - RNA, 25 nt, Human
aagaagaaaaucaagguggcuauuu

SEQ ID NO: 256183 - RNA, 19 nt, Human
aagagaugaugacuggcuu

SEQ ID NO: 256184 - RNA, 28 nt, Human
aaucacaaccaaaaaaaaaaaaaaccaa

SEQ ID NO: 256185 - RNA, 23 nt, Human
acaaagaagaaaaucaagguggc

SEQ ID NO: 256186 - RNA, 28 nt, Human
acaacaagaacaaaaaaucacaaccaaa

SEQ ID NO: 256187 - RNA, 24 nt, Human
acacaauaguucuugaugcaucca

SEQ ID NO: 256188 - RNA, 22 nt, Human
accaaaaaaaaaaaacacaaua

SEQ ID NO: 256189 - RNA, 19 nt, Human
accacagagagauacauga

SEQ ID NO: 256190 - RNA, 19 nt, Human
agaaaaauaaagcugaagg

SEQ ID NO: 256191 - RNA, 30 nt, Human
agaauaaccaagaauuuuuccccaaagaag

SEQ ID NO: 256192 - RNA, 18 nt, Human
agccaaggacugggcccc

SEQ ID NO: 256193 - RNA, 22 nt, Human
aggaaaaagaccacaaagaaga

SEQ ID NO: 256194 - RNA, 25 nt, Human
aggaaaaagaccacaaagaagaaaa

SEQ ID NO: 256195 - RNA, 23 nt, Human
augguccaagaucauuacaugga

SEQ ID NO: 256196 - RNA, 27 nt, Human
caaaaaaaaaaaacacaauaguucuug

SEQ ID NO: 256197 - RNA, 23 nt, Human
caaaacaaggguacaacaagaac

SEQ ID NO: 256198 - RNA, 24 nt, Human
caaacaaaaaucucugauuccaga

SEQ ID NO: 256199 - RNA, 23 nt, Human
caacaagaacaaaaaaauccccc

SEQ ID NO: 256200 - RNA, 24 nt, Human
caacaagaacaaaaaaaucccccc

SEQ ID NO: 256201 - RNA, 24 nt, Human
caacaagaacaaaaaaucacaacc

SEQ ID NO: 256202 - RNA, 25 nt, Human
caacaagaacaaaaaaucacaacca

SEQ ID NO: 256203 - RNA, 25 nt, Human
caaccaaaaaaaaaaaaaaccaaaa

SEQ ID NO: 256204 - RNA, 23 nt, Human
caacuuucaggaaaaagaccaca

SEQ ID NO: 256205 - RNA, 19 nt, Human
caagaacaaaaaaaucccc

SEQ ID NO: 256206 - RNA, 21 nt, Human
caagaacaaaaaaaucccccc

SEQ ID NO: 256207 - RNA, 22 nt, Human
caagaacaaaaaaaucccccca

SEQ ID NO: 256208 - RNA, 22 nt, Human
caagaacaaaaaaaucccccca

SEQ ID NO: 256209 - RNA, 22 nt, Human
caagagaugaugacuggcuuua

SEQ ID NO: 256210 - RNA, 24 nt, Human
caaggguacaacaagaacaaaaaa

SEQ ID NO: 256211 - RNA, 22 nt, Human
cacaaccaaaaaaaaaaaaaac

SEQ ID NO: 256212 - RNA, 25 nt, Human
caccaaaaguacuuugguuuuuuuc

SEQ ID NO: 256213 - RNA, 23 nt, Human
cacugaaucuacaaguuaauaca

SEQ ID NO: 256214 - RNA, 24 nt, Human
cacuuuuguuuaaaaguccuacaa

SEQ ID NO: 256215 - RNA, 23 nt, Human
caggaaaaagaccacaaagaaga

SEQ ID NO: 256216 - RNA, 28 nt, Human
cauauaaacaacaagaacaaaaaaucac

SEQ ID NO: 256217 - RNA, 25 nt, Human
ccaaaaaaaaaaaacacaauaguuc

SEQ ID NO: 256218 - RNA, 26 nt, Human
ccccccaguugauaaucugugucccc

SEQ ID NO: 256219 - RNA, 18 nt, Human
cccggagguuugcugggg

SEQ ID NO: 256220 - RNA, 18 nt, Human
ccuuggagagaagagugg

SEQ ID NO: 256221 - RNA, 20 nt, Human
cgaguaaggucacugggcuu

SEQ ID NO: 256222 - RNA, 23 nt, Human
cgcccccccucagcuguaauuca

SEQ ID NO: 256223 - RNA, 18 nt, Human
cugaaacucugacuaaua

SEQ ID NO: 256224 - RNA, 20 nt, Human
cugcaacgaguuaaaggacu

SEQ ID NO: 256225 - RNA, 18 nt, Human
cuggaacuggaaaaacaa

SEQ ID NO: 256226 - RNA, 20 nt, Human
cuggaacuggaaaaacaaaa

SEQ ID NO: 256227 - RNA, 22 nt, Human
gaaaaacaaaagguggaaaaua

SEQ ID NO: 256228 - RNA, 20 nt, Human
gaacuggaaaaacaaaaggu

SEQ ID NO: 256229 - RNA, 20 nt, Human
gaauaaccaagaauuuuucc

SEQ ID NO: 256230 - RNA, 19 nt, Human
gacuuggaaaaaguuggug

SEQ ID NO: 256231 - RNA, 22 nt, Human
gcgcucgcuugcucgcucgcuc

SEQ ID NO: 256232 - RNA, 19 nt, Human
gcuugcucgcucgcucgcu

SEQ ID NO: 256233 - RNA, 23 nt, Human
ggagagaagagugguccgcugag

SEQ ID NO: 256234 - RNA, 18 nt, Human
ggguguugugugguaccc

SEQ ID NO: 256235 - RNA, 22 nt, Human
gguaccccccccuccuccgccc

SEQ ID NO: 256236 - RNA, 24 nt, Human
guaacacacuggcagcugaagaaa

SEQ ID NO: 256237 - RNA, 23 nt, Human
guacaacaagaacaaaaaaaucc

SEQ ID NO: 256238 - RNA, 23 nt, Human
guucuuacuuuucauuucuccac

SEQ ID NO: 256239 - RNA, 18 nt, Human
uaaagaaaaauaaagcug

SEQ ID NO: 256240 - RNA, 22 nt, Human
uaaaggacuuggaaaaaguugg

SEQ ID NO: 256241 - RNA, 19 nt, Human
uacaacaagaacaaaaaaa

SEQ ID NO: 256242 - RNA, 23 nt, Human
uacaacaguuuuuuuuuuuuaga

SEQ ID NO: 256243 - RNA, 23 nt, Human
uaccccccccuccuccgcccccc

SEQ ID NO: 256244 - RNA, 20 nt, Human
uacuuugguuuuuuucuuuu

SEQ ID NO: 256245 - RNA, 20 nt, Human
uagaauaucuguaugcgaua

SEQ ID NO: 256246 - RNA, 23 nt, Human
ucacaaccaaaaaaaaaaaaaac

SEQ ID NO: 256247 - RNA, 18 nt, Human
ucaggacauuuacaggua

SEQ ID NO: 256248 - RNA, 19 nt, Human
uccccaaagaaagauuuua

SEQ ID NO: 256249 - RNA, 19 nt, Human
uccuccgcccccccucagc

SEQ ID NO: 256250 - RNA, 22 nt, Human
uccuccgcccccccucagcugu

SEQ ID NO: 256251 - RNA, 23 nt, Human
ucuguuauggcagaauaaccaag

SEQ ID NO: 256252 - RNA, 19 nt, Human
ugaagaaagcugaaacucu

SEQ ID NO: 256253 - RNA, 19 nt, Human
ugaagaggcugcuaugaau

SEQ ID NO: 256254 - RNA, 21 nt, Human
ugauaaucuguguccuggaac

SEQ ID NO: 256255 - RNA, 20 nt, Human
ugaugacuggcuuuaaagaa

SEQ ID NO: 256256 - RNA, 24 nt, Human
uggaaaaacaaaagguggaaaaga

SEQ ID NO: 256257 - RNA, 21 nt, Human
uggaaaauacagacugcaacg

SEQ ID NO: 256258 - RNA, 19 nt, Human
uggauacagccaaggacug

SEQ ID NO: 256259 - RNA, 20 nt, Human
uggcagcugaagaaagcuga

SEQ ID NO: 256260 - RNA, 21 nt, Human
ugucugauggugucauucccu

SEQ ID NO: 256261 - RNA, 20 nt, Human
uuccuuggagagaagagugg

SEQ ID NO: 256262 - RNA, 19 nt, Human
uugaauaugcauucguccu

SEQ ID NO: 256263 - RNA, 20 nt, Human
uugugugguaccccccccuc

SEQ ID NO: 256264 - RNA, 22 nt, Human
uugugugguaccccccccuccu

SEQ ID NO: 256265 - RNA, 21 nt, Human
uuuaaagaaaaauaaagcuga

SEQ ID NO: 256266 - RNA, 25 nt, Human
aaaaacucgaguccaucgggaagcc

SEQ ID NO: 256267 - RNA, 28 nt, Human
aaaaauaacacugcagagagcccauaac

SEQ ID NO: 256268 - RNA, 24 nt, Human
aaaaugcugggauuacagguguga

SEQ ID NO: 256269 - RNA, 26 nt, Human
aaaugcugggauuacaggugugagcc

SEQ ID NO: 256270 - RNA, 18 nt, Human
aacacagcaccacccauc

SEQ ID NO: 256271 - RNA, 20 nt, Human
aacacagcaccacccaucgg

SEQ ID NO: 256272 - RNA, 25 nt, Human
acacagcaccacccaucggacccag

SEQ ID NO: 256273 - RNA, 24 nt, Human
accucgugaucugcccgccuuggc

SEQ ID NO: 256274 - RNA, 18 nt, Human
acgggguuucaccguguu

SEQ ID NO: 256275 - RNA, 19 nt, Human
acgggguuucaccguguua

SEQ ID NO: 256276 - RNA, 20 nt, Human
acgggguuucaccguguuag

SEQ ID NO: 256277 - RNA, 24 nt, Human
acgggguuucaccguguuagccag

SEQ ID NO: 256278 - RNA, 20 nt, Human
agaaaaacgagaaugauuca

SEQ ID NO: 256279 - RNA, 23 nt, Human
agcaccacccaucggacccagca

SEQ ID NO: 256280 - RNA, 18 nt, Human
agcauguuuaccuuuuau

SEQ ID NO: 256281 - RNA, 18 nt, Human
auauaccaguuaugggag

SEQ ID NO: 256282 - RNA, 19 nt, Human
aucugcccgccuuggccuc

SEQ ID NO: 256283 - RNA, 22 nt, Human
augacccuugaaaugcacacaa

SEQ ID NO: 256284 - RNA, 24 nt, Human
caaaaugcugggauuacaggugug

SEQ ID NO: 256285 - RNA, 18 nt, Human
caacacagcaccacccau

SEQ ID NO: 256286 - RNA, 22 nt, Human
cacagcaccacccaucggaccc

SEQ ID NO: 256287 - RNA, 20 nt, Human
caccccaagagcggcagagc

SEQ ID NO: 256288 - RNA, 22 nt, Human
caccgcacagcagugugggggc

SEQ ID NO: 256289 - RNA, 24 nt, Human
caccgcccguccggacucugcacc

SEQ ID NO: 256290 - RNA, 18 nt, Human
caccguguuagccaggau

SEQ ID NO: 256291 - RNA, 23 nt, Human
caccguguuagccaggauggucu

SEQ ID NO: 256292 - RNA, 24 nt, Human
caccguguuagccaggauggucuu

SEQ ID NO: 256293 - RNA, 23 nt, Human
caggaaaggauuuaaaaugacgg

SEQ ID NO: 256294 - RNA, 22 nt, Human
cauauggcucagaauaucaucc

SEQ ID NO: 256295 - RNA, 24 nt, Human
caugacccuugaaaugcacacaaa

SEQ ID NO: 256296 - RNA, 21 nt, Human
cauuuggauccagcaccgccc

SEQ ID NO: 256297 - RNA, 21 nt, Human
ccaaaaugcugggauuacagg

SEQ ID NO: 256298 - RNA, 21 nt, Human
ccaaaaugcugggauuacagg

SEQ ID NO: 256299 - RNA, 24 nt, Human
ccaaaaugcugggauuacaggugu

SEQ ID NO: 256300 - RNA, 21 nt, Human
ccagcacugcccauuuagauc

SEQ ID NO: 256301 - RNA, 21 nt, Human
ccaguggugcaaugagaauag

SEQ ID NO: 256302 - RNA, 19 nt, Human
ccaucggacccaucaccgc

SEQ ID NO: 256303 - RNA, 20 nt, Human
ccgaaccgaacauagcaccg

SEQ ID NO: 256304 - RNA, 23 nt, Human
ccggacccaacacagcaccaccc

SEQ ID NO: 256305 - RNA, 19 nt, Human
ccggcuuugcaaacucauu

SEQ ID NO: 256306 - RNA, 21 nt, Human
ccguccgaaccgaacauagca

SEQ ID NO: 256307 - RNA, 24 nt, Human
ccugaccucgugaucugcccgccu

SEQ ID NO: 256308 - RNA, 26 nt, Human
ccugaccucgugaucugcccgccuug

SEQ ID NO: 256309 - RNA, 18 nt, Human
cgcgcguccgaaccgaac

SEQ ID NO: 256310 - RNA, 22 nt, Human
cggcagagcgcgguucagaaaa

SEQ ID NO: 256311 - RNA, 24 nt, Human
cgggguuucaccguguuagccagg

SEQ ID NO: 256312 - RNA, 21 nt, Human
cguccagauccagcaccgccc

SEQ ID NO: 256313 - RNA, 24 nt, Human
cucacucugugagaggaacaccgc

SEQ ID NO: 256314 - RNA, 24 nt, Human
cuccugaccucgugaucugcccgc

SEQ ID NO: 256315 - RNA, 18 nt, Human
cuggaaauuuucaugucc

SEQ ID NO: 256316 - RNA, 21 nt, Human
gaccucgugaucugcccgccu

SEQ ID NO: 256317 - RNA, 24 nt, Human
gagacgggguuucaccguguuagc

SEQ ID NO: 256318 - RNA, 18 nt, Human
gauuacaggugugagcca

SEQ ID NO: 256319 - RNA, 22 nt, Human
gauuacaggugugagccacugc

SEQ ID NO: 256320 - RNA, 22 nt, Human
gauuacaggugugagccacugc

SEQ ID NO: 256321 - RNA, 23 nt, Human
gcccauuuggauccagcaccgcc

SEQ ID NO: 256322 - RNA, 19 nt, Human
gcccggcccuauuuuguuu

SEQ ID NO: 256323 - RNA, 23 nt, Human
gcccguccagauccagcaccgcc

SEQ ID NO: 256324 - RNA, 24 nt, Human
ggauggucuugaucuccugaccuc

SEQ ID NO: 256325 - RNA, 21 nt, Human
gggaaggaacccgguaccgcc

SEQ ID NO: 256326 - RNA, 23 nt, Human
gggguuucaccguguuagccagg

SEQ ID NO: 256327 - RNA, 23 nt, Human
guagagacgggguuucaccgugu

SEQ ID NO: 256328 - RNA, 20 nt, Human
gugggggcucgaacacccca

SEQ ID NO: 256329 - RNA, 19 nt, Human
uacaggugugagccacugc

SEQ ID NO: 256330 - RNA, 23 nt, Human
uacaggugugagccacugcgccc

SEQ ID NO: 256331 - RNA, 22 nt, Human
uaccacucauacauaauacaaa

SEQ ID NO: 256332 - RNA, 19 nt, Human
uaccuuuuauuguucuagg

SEQ ID NO: 256333 - RNA, 21 nt, Human
uaguagagacgggguuucacc

SEQ ID NO: 256334 - RNA, 24 nt, Human
uaguagagacgggguuucaccgug

SEQ ID NO: 256335 - RNA, 26 nt, Human
uaguagagacgggguuucaccguguu

SEQ ID NO: 256336 - RNA, 26 nt, Human
uaguagagacgggguuucaccguugg

SEQ ID NO: 256337 - RNA, 24 nt, Human
ucaccguguuagccaggauggucu

SEQ ID NO: 256338 - RNA, 22 nt, Human
ucacguggcaucucucagggcc

SEQ ID NO: 256339 - RNA, 22 nt, Human
uccagcaccgcccauuuggauc

SEQ ID NO: 256340 - RNA, 22 nt, Human
uccagcaccgcccguccggacu

SEQ ID NO: 256341 - RNA, 23 nt, Human
ucccaaaaugcugggauuacagg

SEQ ID NO: 256342 - RNA, 21 nt, Human
uccucaggaaugaagcuccug

SEQ ID NO: 256343 - RNA, 18 nt, Human
ucucagggccaaaugggg

SEQ ID NO: 256344 - RNA, 24 nt, Human
ucugcccgccuuggccucccaaaa

SEQ ID NO: 256345 - RNA, 23 nt, Human
ugacgaucacguggcaucucuca

SEQ ID NO: 256346 - RNA, 24 nt, Human
ugcugggauuacaggugugagcca

SEQ ID NO: 256347 - RNA, 22 nt, Human
uggcagauaacgaugugucuga

SEQ ID NO: 256348 - RNA, 22 nt, Human
uggcugcucuuaaacauuuguc

SEQ ID NO: 256349 - RNA, 18 nt, Human
ugggauuacaggugugag

SEQ ID NO: 256350 - RNA, 19 nt, Human
ugggauuacaggugugagc

SEQ ID NO: 256351 - RNA, 21 nt, Human
ugggauuacaggugugagcca

SEQ ID NO: 256352 - RNA, 22 nt, Human
ugggauuacaggugugagccac

SEQ ID NO: 256353 - RNA, 22 nt, Human
ugggauuacaggugugagccac

SEQ ID NO: 256354 - RNA, 24 nt, Human
ugggauuacaggugugagccacug

SEQ ID NO: 256355 - RNA, 18 nt, Human
uuaguagagacgggguuu

SEQ ID NO: 256356 - RNA, 22 nt, Human
uuaguagagacgggguuucacc

SEQ ID NO: 256357 - RNA, 24 nt, Human
uuaguagagacgggguuucaccgu

SEQ ID NO: 256358 - RNA, 24 nt, Human
uugcaaacucauucuucaagaggc

SEQ ID NO: 256359 - RNA, 24 nt, Human
uuggacaucagcaaucuaacugcc

SEQ ID NO: 256360 - RNA, 18 nt, Human
uuggccucccaaaaugcu

SEQ ID NO: 256361 - RNA, 19 nt, Human
uuucaccguguuagccagg

SEQ ID NO: 256362 - RNA, 24 nt, Human
uuuuuaguagagacgggguuucac

SEQ ID NO: 256363 - RNA, 24 nt, Human
aaaccugauccacaucccccccca

SEQ ID NO: 256364 - RNA, 18 nt, Human
aaagcauucugcccacca

SEQ ID NO: 256365 - RNA, 23 nt, Human
aacccucuccccuuuccccuccc

SEQ ID NO: 256366 - RNA, 20 nt, Human
aaggagccccagauggccuc

SEQ ID NO: 256367 - RNA, 21 nt, Human
aagucgcgaacuucccccuag

SEQ ID NO: 256368 - RNA, 19 nt, Human
acaaagccuucagaaagaa

SEQ ID NO: 256369 - RNA, 24 nt, Human
acaaagccuucagaaagaaaaaaa

SEQ ID NO: 256370 - RNA, 27 nt, Human
acaaagccuucagaaagaaaaaaaagc

SEQ ID NO: 256371 - RNA, 22 nt, Human
accagaccccacccuagcucua

SEQ ID NO: 256372 - RNA, 19 nt, Human
accuggguuagcuuuuuug

SEQ ID NO: 256373 - RNA, 20 nt, Human
acuccccaccucuccccacu

SEQ ID NO: 256374 - RNA, 23 nt, Human
agaaaaaaaagcauucugcccac

SEQ ID NO: 256375 - RNA, 22 nt, Human
agccaagcuccccagcuccccc

SEQ ID NO: 256376 - RNA, 23 nt, Human
aggaaaugaugggaacccacagc

SEQ ID NO: 256377 - RNA, 22 nt, Human
aggcagggguaaggccacuggu

SEQ ID NO: 256378 - RNA, 19 nt, Human
aggcauuuauugaauuuau

SEQ ID NO: 256379 - RNA, 21 nt, Human
agggccaggaggcacauuccu

SEQ ID NO: 256380 - RNA, 19 nt, Human
aggggccacugcauagaaa

SEQ ID NO: 256381 - RNA, 23 nt, Human
agucagggaaggggaagaagggc

SEQ ID NO: 256382 - RNA, 23 nt, Human
auagaaaucccaggcuccagcua

SEQ ID NO: 256383 - RNA, 21 nt, Human
auuacuccccaccucucccca

SEQ ID NO: 256384 - RNA, 25 nt, Human
caauguacucucccaccauagcacu

SEQ ID NO: 256385 - RNA, 19 nt, Human
cacacacucccaggcacaa

SEQ ID NO: 256386 - RNA, 21 nt, Human
cacacuuccacauaaccccug

SEQ ID NO: 256387 - RNA, 22 nt, Human
caccacacacucccaggcacaa

SEQ ID NO: 256388 - RNA, 18 nt, Human
cacccuaacaccacacac

SEQ ID NO: 256389 - RNA, 21 nt, Human
cacccuagcucuaaagcaggg

SEQ ID NO: 256390 - RNA, 24 nt, Human
cacccuagcucuaaagcagggucc

SEQ ID NO: 256391 - RNA, 21 nt, Human
caccugugugugaccagaccc

SEQ ID NO: 256392 - RNA, 22 nt, Human
cagcaggggugggggaggggac

SEQ ID NO: 256393 - RNA, 21 nt, Human
cagcccacccaccgcacauca

SEQ ID NO: 256394 - RNA, 24 nt, Human
cagcucccccuucccuguuccucc

SEQ ID NO: 256395 - RNA, 18 nt, Human
caggaggcacauuccugc

SEQ ID NO: 256396 - RNA, 28 nt, Human
cauaucguccccagauggggcagcuuua

SEQ ID NO: 256397 - RNA, 24 nt, Human
ccacagucccucacgaugccuccc

SEQ ID NO: 256398 - RNA, 24 nt, Human
ccacauccccccccaucccugcuc

SEQ ID NO: 256399 - RNA, 20 nt, Human
cccaccgcacaucacuggcc

SEQ ID NO: 256400 - RNA, 22 nt, Human
cccaccgcacaucacuggccua

SEQ ID NO: 256401 - RNA, 19 nt, Human
cccagucccuucccuggcc

SEQ ID NO: 256402 - RNA, 24 nt, Human
ccccaagcuaauuccaggccuuca

SEQ ID NO: 256403 - RNA, 27 nt, Human
ccccccaucccugcucauuucccagac

SEQ ID NO: 256404 - RNA, 19 nt, Human
ccccuaaacagcccaccca

SEQ ID NO: 256405 - RNA, 18 nt, Human
ccccuuuccccucccauc

SEQ ID NO: 256406 - RNA, 19 nt, Human
cccuaaacagcccacccac

SEQ ID NO: 256407 - RNA, 18 nt, Human
cccuccuucucuucucuc

SEQ ID NO: 256408 - RNA, 21 nt, Human
ccucccaucucccuccccaua

SEQ ID NO: 256409 - RNA, 18 nt, Human
ccuccuucucuucucucc

SEQ ID NO: 256410 - RNA, 19 nt, Human
ccuggggagggcucaaggg

SEQ ID NO: 256411 - RNA, 19 nt, Human
ccuucccuccuucucuucu

SEQ ID NO: 256412 - RNA, 21 nt, Human
ccuucucuucucuccccuccc

SEQ ID NO: 256413 - RNA, 18 nt, Human
cuaaauccuucccuccuu

SEQ ID NO: 256414 - RNA, 22 nt, Human
cucccaccauagcacuaaccca

SEQ ID NO: 256415 - RNA, 19 nt, Human
cucccaucucccuccccau

SEQ ID NO: 256416 - RNA, 31 nt, Human
cucccaucucccuccccauaucguccccagg

SEQ ID NO: 256417 - RNA, 18 nt, Human
cucuccccucccaguccc

SEQ ID NO: 256418 - RNA, 20 nt, Human
cugcacccuaacaccacaca

SEQ ID NO: 256419 - RNA, 21 nt, Human
cugccugcugccacacacacu

SEQ ID NO: 256420 - RNA, 21 nt, Human
cuucagaaagucgcgaacuuc

SEQ ID NO: 256421 - RNA, 21 nt, Human
gaagcaucgagggccaggagg

SEQ ID NO: 256422 - RNA, 18 nt, Human
gaccuccccggcucagcg

SEQ ID NO: 256423 - RNA, 23 nt, Human
gcccaccacuagcacccugccau

SEQ ID NO: 256424 - RNA, 23 nt, Human
gccccaagcuaauuccaggccuu

SEQ ID NO: 256425 - RNA, 22 nt, Human
ggaagggcugcuuugggggcug

SEQ ID NO: 256426 - RNA, 22 nt, Human
ggaccuggguuagcuuuuuugu

SEQ ID NO: 256427 - RNA, 23 nt, Human
ggcugcuuugggggcuggggugg

SEQ ID NO: 256428 - RNA, 23 nt, Human
gggcugcuuugggggcuggggug

SEQ ID NO: 256429 - RNA, 24 nt, Human
gucccaaauuccuggggagggcuc

SEQ ID NO: 256430 - RNA, 24 nt, Human
gucuguaguguuuguaucauguca

SEQ ID NO: 256431 - RNA, 22 nt, Human
guucagugaagccugccacagu

SEQ ID NO: 256432 - RNA, 19 nt, Human
uaaagcagggucccaaauu

SEQ ID NO: 256433 - RNA, 19 nt, Human
uacaaagccuaagugggua

SEQ ID NO: 256434 - RNA, 20 nt, Human
uagccuggcucagcucagau

SEQ ID NO: 256435 - RNA, 20 nt, Human
uagcucuaaagcaggguccc

SEQ ID NO: 256436 - RNA, 23 nt, Human
uauuacuccccaccucuccccac

SEQ ID NO: 256437 - RNA, 18 nt, Human
ucaacaccugugugugac

SEQ ID NO: 256438 - RNA, 22 nt, Human
ucaacaccugugugugaccaga

SEQ ID NO: 256439 - RNA, 24 nt, Human
ucacuaucacaaagccuucagaaa

SEQ ID NO: 256440 - RNA, 19 nt, Human
ucagaaagaaaaaaaagca

SEQ ID NO: 256441 - RNA, 22 nt, Human
ucaggggccuugaacagggagg

SEQ ID NO: 256442 - RNA, 20 nt, Human
uccacaucugaagcagggga

SEQ ID NO: 256443 - RNA, 22 nt, Human
uccacaucugaagcaggggaca

SEQ ID NO: 256444 - RNA, 22 nt, Human
uccaggccuucaauguacucuc

SEQ ID NO: 256445 - RNA, 22 nt, Human
ucccagacccucagccaagcuc

SEQ ID NO: 256446 - RNA, 20 nt, Human
ucccaggacgauagucccua

SEQ ID NO: 256447 - RNA, 21 nt, Human
uccccaccucuccccacuucc

SEQ ID NO: 256448 - RNA, 22 nt, Human
uccccagcucccccuucccugu

SEQ ID NO: 256449 - RNA, 25 nt, Human
uccccagcucccccuucccuguucc

SEQ ID NO: 256450 - RNA, 18 nt, Human
uccccuaaacagcccacc

SEQ ID NO: 256451 - RNA, 22 nt, Human
uccccucccaucucccucccca

SEQ ID NO: 256452 - RNA, 20 nt, Human
ucccuccccauaucgucccc

SEQ ID NO: 256453 - RNA, 21 nt, Human
ucccuguguuuacuauuacuc

SEQ ID NO: 256454 - RNA, 22 nt, Human
uccugcucccaaaggcaggggu

SEQ ID NO: 256455 - RNA, 21 nt, Human
ucuguaguguuuguaucaugu

SEQ ID NO: 256456 - RNA, 25 nt, Human
ugaagccugccacagucccucacga

SEQ ID NO: 256457 - RNA, 18 nt, Human
ugaaggaaugaggggacc

SEQ ID NO: 256458 - RNA, 27 nt, Human
ugacacaggaaaugaugggaacccaca

SEQ ID NO: 256459 - RNA, 21 nt, Human
ugaccagaccccacccuagcu

SEQ ID NO: 256460 - RNA, 23 nt, Human
ugagaaaaacccucuccccuuuc

SEQ ID NO: 256461 - RNA, 23 nt, Human
ugauccacauccccccccauccc

SEQ ID NO: 256462 - RNA, 19 nt, Human
ugauuugacacacuucccc

SEQ ID NO: 256463 - RNA, 23 nt, Human
ugcugggucauagaagagugugg

SEQ ID NO: 256464 - RNA, 22 nt, Human
ugcuuugggggcugggguggag

SEQ ID NO: 256465 - RNA, 21 nt, Human
uggcacagugagaaaaacccu

SEQ ID NO: 256466 - RNA, 23 nt, Human
uggcacagugagaaaaacccucc

SEQ ID NO: 256467 - RNA, 18 nt, Human
uggccccaagcuaauucc

SEQ ID NO: 256468 - RNA, 19 nt, Human
uggccuaaggggccacugc

SEQ ID NO: 256469 - RNA, 20 nt, Human
ugggaacccacagcaggggu

SEQ ID NO: 256470 - RNA, 24 nt, Human
ugggggaagggcugcuuugggggc

SEQ ID NO: 256471 - RNA, 19 nt, Human
ugggguggagaaggagccc

SEQ ID NO: 256472 - RNA, 23 nt, Human
uguacucucccaccauagcacua

SEQ ID NO: 256473 - RNA, 24 nt, Human
uuccagauccccuaaacagcccac

SEQ ID NO: 256474 - RNA, 22 nt, Human
uuccuggggagggcucaagggu

SEQ ID NO: 256475 - RNA, 22 nt, Human
uuuuuuuuuuuuucugcugguu

SEQ ID NO: 256476 - RNA, 18 nt, Human
uuuuuuuuuuuuuuucug

SEQ ID NO: 256477 - RNA, 22 nt, Human
uuuuuuuuuuuuuuucugcugg

SEQ ID NO: 256478 - RNA, 23 nt, Human
uuuuuuuuuuuuuuucugcuggu

SEQ ID NO: 256479 - RNA, 20 nt, Human
aaucuguccaccuucucccc

SEQ ID NO: 256480 - RNA, 23 nt, Human
acguggucugagugggucuggag

SEQ ID NO: 256481 - RNA, 23 nt, Human
agggccucacuugggcaggaggg

SEQ ID NO: 256482 - RNA, 20 nt, Human
aucuguccaccuucucccca

SEQ ID NO: 256483 - RNA, 24 nt, Human
caggaggggccucccaaaucuguc

SEQ ID NO: 256484 - RNA, 20 nt, Human
cugagugggucuggaggagu

SEQ ID NO: 256485 - RNA, 18 nt, Human
cuuccaagcccagcuggc

SEQ ID NO: 256486 - RNA, 18 nt, Human
ggcaggaggggccuccca

SEQ ID NO: 256487 - RNA, 19 nt, Human
gggcaggaggggccuccca

SEQ ID NO: 256488 - RNA, 25 nt, Human
gggcaggaggggccucccaaaucug

SEQ ID NO: 256489 - RNA, 19 nt, Human
ucccagggccucacuuggg

SEQ ID NO: 256490 - RNA, 19 nt, Human
ucucugcuugucuucuggu

SEQ ID NO: 256491 - RNA, 19 nt, Human
uugcuggaggggaauuugc

SEQ ID NO: 256492 - RNA, 21 nt, Human
aaagcacagagccaaugaggg

SEQ ID NO: 256493 - RNA, 25 nt, Human
acaguauaaaggucuucgguguguc

SEQ ID NO: 256494 - RNA, 20 nt, Human
accugggagagaaaggaggc

SEQ ID NO: 256495 - RNA, 23 nt, Human
acugagucaucuuuuuuccauuc

SEQ ID NO: 256496 - RNA, 23 nt, Human
agaaaggaggcgacgaagcaggg

SEQ ID NO: 256497 - RNA, 19 nt, Human
agagaggaugguggggcag

SEQ ID NO: 256498 - RNA, 20 nt, Human
agagccaaugagggacagga

SEQ ID NO: 256499 - RNA, 22 nt, Human
agcacagagccaaugagggaca

SEQ ID NO: 256500 - RNA, 21 nt, Human
augaaagcaacauaagaaagc

SEQ ID NO: 256501 - RNA, 19 nt, Human
auuccauucaugaaagcaa

SEQ ID NO: 256502 - RNA, 19 nt, Human
cagcaccugggagagaaag

SEQ ID NO: 256503 - RNA, 27 nt, Human
cagcaccugggagagaaaggaggcgac

SEQ ID NO: 256504 - RNA, 19 nt, Human
cagggcgcggggcgcagag

SEQ ID NO: 256505 - RNA, 24 nt, Human
cagugcagggcugcucugucucuc

SEQ ID NO: 256506 - RNA, 22 nt, Human
cauucaugaaagcaacauaaga

SEQ ID NO: 256507 - RNA, 18 nt, Human
ccauguggagggugcucc

SEQ ID NO: 256508 - RNA, 24 nt, Human
ccggacccucuccgggggacgcuc

SEQ ID NO: 256509 - RNA, 19 nt, Human
cuuuuuuccauuccauuca

SEQ ID NO: 256510 - RNA, 18 nt, Human
gagggaaaacagugcagg

SEQ ID NO: 256511 - RNA, 20 nt, Human
gauaaugggggcaagcaggg

SEQ ID NO: 256512 - RNA, 19 nt, Human
gcucugucucucuguccug

SEQ ID NO: 256513 - RNA, 19 nt, Human
ggaaaacagugcagggcug

SEQ ID NO: 256514 - RNA, 22 nt, Human
ggcaaggcuggauaaugggggc

SEQ ID NO: 256515 - RNA, 21 nt, Human
uaaaagaucacaguauaaagg

SEQ ID NO: 256516 - RNA, 24 nt, Human
uaacugagucaucuuuuuuccauu

SEQ ID NO: 256517 - RNA, 18 nt, Human
uaaugggggcaagcaggc

SEQ ID NO: 256518 - RNA, 21 nt, Human
ucaguaaacccaggugagcag

SEQ ID NO: 256519 - RNA, 21 nt, Human
ucuccgggggacgcucagucc

SEQ ID NO: 256520 - RNA, 18 nt, Human
ugaaagggguaaaagauc

SEQ ID NO: 256521 - RNA, 24 nt, Human
uggagggaaaacagugcagggcug

SEQ ID NO: 256522 - RNA, 24 nt, Human
ugggacggugacuguguauagugg

SEQ ID NO: 256523 - RNA, 23 nt, Human
uguggagggugcuccuucuuguu

SEQ ID NO: 256524 - RNA, 22 nt, Human
ugugguggagggaaaacagugc

SEQ ID NO: 256525 - RNA, 23 nt, Human
uucgguguguccuucaaagauuu

SEQ ID NO: 256526 - RNA, 22 nt, Human
uuuuccauuccauucaugaaag

SEQ ID NO: 256527 - RNA, 20 nt, Human
uuuuuuuuuuuuuuuuuggu

SEQ ID NO: 256528 - RNA, 28 nt, Human
uuuuuuuuuuuuuuuuuuuuuuuggggg

SEQ ID NO: 256529 - RNA, 23 nt, Human
aaaagaagaaaaaaaaaucagga

SEQ ID NO: 256530 - RNA, 21 nt, Human
aaaauggaaaguucucaagug

SEQ ID NO: 256531 - RNA, 19 nt, Human
aaacauaacuccccaaggc

SEQ ID NO: 256532 - RNA, 19 nt, Human
aaaccaggcaaagcuagug

SEQ ID NO: 256533 - RNA, 23 nt, Human
aaaccugaaaagacaggagaugc

SEQ ID NO: 256534 - RNA, 21 nt, Human
aaagacaaaaccaggcaaagc

SEQ ID NO: 256535 - RNA, 23 nt, Human
aaauucccagcccccaaaucagc

SEQ ID NO: 256536 - RNA, 21 nt, Human
aacaagaaugauaaaugcuuu

SEQ ID NO: 256537 - RNA, 22 nt, Human
aacaaggacucuuuucucugga

SEQ ID NO: 256538 - RNA, 22 nt, Human
aacaggaaaagagaggaacaga

SEQ ID NO: 256539 - RNA, 21 nt, Human
aacccuuugugucucagcuuc

SEQ ID NO: 256540 - RNA, 20 nt, Human
aacuauguaagcuccaaggc

SEQ ID NO: 256541 - RNA, 23 nt, Human
aacuauguaagcuccaaggcccc

SEQ ID NO: 256542 - RNA, 24 nt, Human
aacuauguaagcuccaaggcccca

SEQ ID NO: 256543 - RNA, 18 nt, Human
aagaagccaggcacaaaa

SEQ ID NO: 256544 - RNA, 19 nt, Human
aagaagccaggcacaaaag

SEQ ID NO: 256545 - RNA, 20 nt, Human
aagacaaaaccaggcaaagc

SEQ ID NO: 256546 - RNA, 21 nt, Human
aagaguaccauguaaaauuca

SEQ ID NO: 256547 - RNA, 22 nt, Human
aagcagguacaacaaaaaacaa

SEQ ID NO: 256548 - RNA, 22 nt, Human
aagcugaaacuucaauauucau

SEQ ID NO: 256549 - RNA, 21 nt, Human
aaggacuguaaauguugcaaa

SEQ ID NO: 256550 - RNA, 19 nt, Human
aaguuugugcuuaaaucuu

SEQ ID NO: 256551 - RNA, 23 nt, Human
acaaggacucuuuucucuggaca

SEQ ID NO: 256552 - RNA, 18 nt, Human
acagaaugaauaacugau

SEQ ID NO: 256553 - RNA, 18 nt, Human
acagaggggauccaggca

SEQ ID NO: 256554 - RNA, 24 nt, Human
acaguaacagcagcacagacccaa

SEQ ID NO: 256555 - RNA, 26 nt, Human
acagugaccccuagggcccauuuucu

SEQ ID NO: 256556 - RNA, 18 nt, Human
acccccuuccucccucca

SEQ ID NO: 256557 - RNA, 23 nt, Human
accucaaagguuuugcauuguuu

SEQ ID NO: 256558 - RNA, 19 nt, Human
acuauguaagcuccaaggc

SEQ ID NO: 256559 - RNA, 20 nt, Human
agaagaaaaaaaaaucagug

SEQ ID NO: 256560 - RNA, 21 nt, Human
agaauuuuggaagugcuccuc

SEQ ID NO: 256561 - RNA, 20 nt, Human
agacacuuaaaugggaguuu

SEQ ID NO: 256562 - RNA, 18 nt, Human
agacagauucaugggaag

SEQ ID NO: 256563 - RNA, 22 nt, Human
agacagauucaugggaaggcag

SEQ ID NO: 256564 - RNA, 19 nt, Human
agagaaagaagccaggcac

SEQ ID NO: 256565 - RNA, 22 nt, Human
agagcccagccaagcgccucuc

SEQ ID NO: 256566 - RNA, 18 nt, Human
agaggcccaaaggaauau

SEQ ID NO: 256567 - RNA, 21 nt, Human
agaguuguuccuccauaggga

SEQ ID NO: 256568 - RNA, 24 nt, Human
agaguuguuccuccauagggaugg

SEQ ID NO: 256569 - RNA, 18 nt, Human
agcacagacccaaacuug

SEQ ID NO: 256570 - RNA, 18 nt, Human
agcagcacagacccaaac

SEQ ID NO: 256571 - RNA, 21 nt, Human
agcugaaacuucaauauucau

SEQ ID NO: 256572 - RNA, 20 nt, Human
aggaaacuuugagaauagaa

SEQ ID NO: 256573 - RNA, 19 nt, Human
agggaaauauaaguauacu

SEQ ID NO: 256574 - RNA, 22 nt, Human
aggguauccacaguuggcuuga

SEQ ID NO: 256575 - RNA, 24 nt, Human
aggguauccacaguuggcuugaaa

SEQ ID NO: 256576 - RNA, 21 nt, Human
auaaaucucugaaaaauacca

SEQ ID NO: 256577 - RNA, 24 nt, Human
auagagucuuucuucuuuccaaaa

SEQ ID NO: 256578 - RNA, 23 nt, Human
auauaaaucucugaaaaauacca

SEQ ID NO: 256579 - RNA, 21 nt, Human
aucaaaauauuuccaucugau

SEQ ID NO: 256580 - RNA, 24 nt, Human
aucagaaggcucuauagaacucaa

SEQ ID NO: 256581 - RNA, 24 nt, Human
aucuugcaccuacaauccacucga

SEQ ID NO: 256582 - RNA, 20 nt, Human
auuuguacuagucacucuuc

SEQ ID NO: 256583 - RNA, 18 nt, Human
auuuuguauuuuugagac

SEQ ID NO: 256584 - RNA, 22 nt, Human
caaaauggaaaguucucaagug

SEQ ID NO: 256585 - RNA, 25 nt, Human
caaaccugaaaagacaggagaugca

SEQ ID NO: 256586 - RNA, 25 nt, Human
caaaccuugcuuuuuaaaaagaaga

SEQ ID NO: 256587 - RNA, 19 nt, Human
caaaucagccccggugcaa

SEQ ID NO: 256588 - RNA, 23 nt, Human
caacaaaaaacaauuuuagacau

SEQ ID NO: 256589 - RNA, 23 nt, Human
caacaagaaugauaaaugcuuuu

SEQ ID NO: 256590 - RNA, 23 nt, Human
caacaggaaaagagaggaacaga

SEQ ID NO: 256591 - RNA, 23 nt, Human
caacccuuugugucucagcuucu

SEQ ID NO: 256592 - RNA, 22 nt, Human
caagaaugauaaaugcuuuuga

SEQ ID NO: 256593 - RNA, 25 nt, Human
caagcgccucucaguccgugcaucc

SEQ ID NO: 256594 - RNA, 20 nt, Human
caaggcagaggccgcaggga

SEQ ID NO: 256595 - RNA, 22 nt, Human
caaggcagaggccgcagggaac

SEQ ID NO: 256596 - RNA, 21 nt, Human
cacaauuucaauuuauuauca

SEQ ID NO: 256597 - RNA, 21 nt, Human
cacccuuucuaggacaaccua

SEQ ID NO: 256598 - RNA, 22 nt, Human
caccuaaaauccaaaaugaaaa

SEQ ID NO: 256599 - RNA, 20 nt, Human
caccuaaaauccugacguga

SEQ ID NO: 256600 - RNA, 21 nt, Human
cagacacuuaaaugggaguuu

SEQ ID NO: 256601 - RNA, 20 nt, Human
cagagcuacauaggugcaga

SEQ ID NO: 256602 - RNA, 19 nt, Human
cagaggaaucucacaaaug

SEQ ID NO: 256603 - RNA, 20 nt, Human
cagaggaaucucacaaaugu

SEQ ID NO: 256604 - RNA, 22 nt, Human
cagaucccgcgccaggaguugg

SEQ ID NO: 256605 - RNA, 22 nt, Human
cagcacaauacagaggaaucuc

SEQ ID NO: 256606 - RNA, 20 nt, Human
cagcagaauggcaaauuccc

SEQ ID NO: 256607 - RNA, 22 nt, Human
cagcagaauggcaaauucccag

SEQ ID NO: 256608 - RNA, 20 nt, Human
cagcagaucccgcgccagga

SEQ ID NO: 256609 - RNA, 20 nt, Human
cagcccccaaaucagccccu

SEQ ID NO: 256610 - RNA, 23 nt, Human
caggcaaagcuagugaaugauau

SEQ ID NO: 256611 - RNA, 18 nt, Human
cagggaacuaauacucau

SEQ ID NO: 256612 - RNA, 20 nt, Human
caggugcuggcuacagggcc

SEQ ID NO: 256613 - RNA, 21 nt, Human
cagucaaagcagguacaacaa

SEQ ID NO: 256614 - RNA, 22 nt, Human
caguccgugcauccgcccaagg

SEQ ID NO: 256615 - RNA, 18 nt, Human
caguggcgggcugagagc

SEQ ID NO: 256616 - RNA, 20 nt, Human
cagugucuguacagcagaau

SEQ ID NO: 256617 - RNA, 23 nt, Human
cauaaaagacaaaaccaggcaaa

SEQ ID NO: 256618 - RNA, 25 nt, Human
caucagaaggcucuauagaacucaa

SEQ ID NO: 256619 - RNA, 21 nt, Human
caucagcaaacugguagacca

SEQ ID NO: 256620 - RNA, 24 nt, Human
caucagcucccaacccuuuguguc

SEQ ID NO: 256621 - RNA, 26 nt, Human
caucuugcaccuacaauccacucgaa

SEQ ID NO: 256622 - RNA, 26 nt, Human
ccaaggcagaggccgcagggaacuau

SEQ ID NO: 256623 - RNA, 23 nt, Human
ccacugauucauaacugggagac

SEQ ID NO: 256624 - RNA, 22 nt, Human
cccaaaggaauauugcaaauac

SEQ ID NO: 256625 - RNA, 22 nt, Human
cccaaaucagccccggugcaau

SEQ ID NO: 256626 - RNA, 22 nt, Human
cccaaggucacccugucaggag

SEQ ID NO: 256627 - RNA, 20 nt, Human
cccucagcagaucccgcgcc

SEQ ID NO: 256628 - RNA, 24 nt, Human
cccuccacacccuuucuaggacaa

SEQ ID NO: 256629 - RNA, 21 nt, Human
ccuacaauccacucgaacacu

SEQ ID NO: 256630 - RNA, 19 nt, Human
ccuuccucccuccacaccc

SEQ ID NO: 256631 - RNA, 21 nt, Human
ccuuuugauuagaaauccugg

SEQ ID NO: 256632 - RNA, 19 nt, Human
cgggagaaguuggaggcug

SEQ ID NO: 256633 - RNA, 24 nt, Human
cggguauugucgagagcuucuucc

SEQ ID NO: 256634 - RNA, 21 nt, Human
cuauagugucaccuacucuuc

SEQ ID NO: 256635 - RNA, 20 nt, Human
cuaucugcauaaaagacaaa

SEQ ID NO: 256636 - RNA, 20 nt, Human
cucagcaucagucaaagcag

SEQ ID NO: 256637 - RNA, 21 nt, Human
cucagcaucagucaaagcagg

SEQ ID NO: 256638 - RNA, 27 nt, Human
cucgguaacaaaacauaacuccccaag

SEQ ID NO: 256639 - RNA, 23 nt, Human
cugcaaugagaaugaaaagaucc

SEQ ID NO: 256640 - RNA, 23 nt, Human
cugcuccagccugcucucgguca

SEQ ID NO: 256641 - RNA, 20 nt, Human
cuuuugauuagaaauccugg

SEQ ID NO: 256642 - RNA, 22 nt, Human
cuuuuuaaaaagaagaaaaaaa

SEQ ID NO: 256643 - RNA, 23 nt, Human
cuuuuuaaaaagaagaaaaaaaa

SEQ ID NO: 256644 - RNA, 19 nt, Human
gaaaagacaggagaugcag

SEQ ID NO: 256645 - RNA, 20 nt, Human
gaaaauugcaggaagccuga

SEQ ID NO: 256646 - RNA, 19 nt, Human
gaaaguccaauuugaaaac

SEQ ID NO: 256647 - RNA, 23 nt, Human
gaacaaauuguaauaagucccac

SEQ ID NO: 256648 - RNA, 20 nt, Human
gaacucagccauaguagaac

SEQ ID NO: 256649 - RNA, 22 nt, Human
gaaggacuguaaauguugcaaa

SEQ ID NO: 256650 - RNA, 19 nt, Human
gacccccuuccucccucca

SEQ ID NO: 256651 - RNA, 20 nt, Human
gaucccgcgccaggaguugg

SEQ ID NO: 256652 - RNA, 18 nt, Human
gcaauuuauguacauaug

SEQ ID NO: 256653 - RNA, 25 nt, Human
gcagagcuacauaggugcagauuug

SEQ ID NO: 256654 - RNA, 24 nt, Human
gcucuguuucuuacaggugcuggc

SEQ ID NO: 256655 - RNA, 21 nt, Human
ggaguugggcggcugcuccag

SEQ ID NO: 256656 - RNA, 22 nt, Human
ggaugaacaaauuguaauaagu

SEQ ID NO: 256657 - RNA, 23 nt, Human
ggccggguggcaguggcgggcug

SEQ ID NO: 256658 - RNA, 18 nt, Human
gggagaaguuggaggcug

SEQ ID NO: 256659 - RNA, 22 nt, Human
gggauagggaggcauugcuauu

SEQ ID NO: 256660 - RNA, 22 nt, Human
gggcuggaacaaggacucuuuc

SEQ ID NO: 256661 - RNA, 22 nt, Human
ggugcuuuuagagcgcugguac

SEQ ID NO: 256662 - RNA, 26 nt, Human
guagcgcggaucucgguaacaaaaca

SEQ ID NO: 256663 - RNA, 20 nt, Human
gugcccaucaacaauaggau

SEQ ID NO: 256664 - RNA, 22 nt, Human
guugggcggcugcuccagccug

SEQ ID NO: 256665 - RNA, 18 nt, Human
uaaaagacaaaaccaggc

SEQ ID NO: 256666 - RNA, 19 nt, Human
uaaaauaaaugaucacaga

SEQ ID NO: 256667 - RNA, 21 nt, Human
uaacaaaacauaacuccccaa

SEQ ID NO: 256668 - RNA, 18 nt, Human
uaacagcagcacagaccu

SEQ ID NO: 256669 - RNA, 24 nt, Human
uaacaguaacagcagcacagaccu

SEQ ID NO: 256670 - RNA, 19 nt, Human
uaagucccacaauagaaca

SEQ ID NO: 256671 - RNA, 18 nt, Human
uacacagugagaaaugau

SEQ ID NO: 256672 - RNA, 18 nt, Human
uacuuguaacggugguug

SEQ ID NO: 256673 - RNA, 24 nt, Human
uaggaugaacaaauuguaauaagu

SEQ ID NO: 256674 - RNA, 24 nt, Human
uaguugcacuauuuguaauagcgc

SEQ ID NO: 256675 - RNA, 20 nt, Human
uauagugucaccuacucuuc

SEQ ID NO: 256676 - RNA, 25 nt, Human
uauaucucuagacaacuguccaauc

SEQ ID NO: 256677 - RNA, 25 nt, Human
uaucaagcaguaaacaguucuuuuc

SEQ ID NO: 256678 - RNA, 21 nt, Human
uauugcaaauacccaagguca

SEQ ID NO: 256679 - RNA, 19 nt, Human
uauuuuguauuuuugagac

SEQ ID NO: 256680 - RNA, 23 nt, Human
ucaaugcuuauaauaauuuuugg

SEQ ID NO: 256681 - RNA, 18 nt, Human
ucaguccgugcauccgcc

SEQ ID NO: 256682 - RNA, 24 nt, Human
uccacaaucagcacaauacagagg

SEQ ID NO: 256683 - RNA, 19 nt, Human
ucccauuucuauucagaaa

SEQ ID NO: 256684 - RNA, 19 nt, Human
uccuccauagggaugggag

SEQ ID NO: 256685 - RNA, 26 nt, Human
ucgguaacaaaacauaacuccccaag

SEQ ID NO: 256686 - RNA, 24 nt, Human
ucugcaaugagaaugaaaagaucc

SEQ ID NO: 256687 - RNA, 18 nt, Human
ugaaaagacaggagaugc

SEQ ID NO: 256688 - RNA, 21 nt, Human
ugaaaagacaggagaugcaga

SEQ ID NO: 256689 - RNA, 22 nt, Human
ugaaaagauccacaaucagcac

SEQ ID NO: 256690 - RNA, 28 nt, Human
ugaaaagauccacaaucagcacaauaca

SEQ ID NO: 256691 - RNA, 21 nt, Human
ugaagagccaaccugacguga

SEQ ID NO: 256692 - RNA, 22 nt, Human
ugaaugauauuagaagucagga

SEQ ID NO: 256693 - RNA, 20 nt, Human
ugacaugauggaaauaaaau

SEQ ID NO: 256694 - RNA, 19 nt, Human
ugaccccucagcagauccc

SEQ ID NO: 256695 - RNA, 20 nt, Human
ugaccccucagcagaucccu

SEQ ID NO: 256696 - RNA, 21 nt, Human
ugacuuauaauucuagaaggu

SEQ ID NO: 256697 - RNA, 19 nt, Human
ugacuuccagagcccuccu

SEQ ID NO: 256698 - RNA, 20 nt, Human
ugacuuccagagcccuccuc

SEQ ID NO: 256699 - RNA, 23 nt, Human
ugagaaccaccaauauaaucuaa

SEQ ID NO: 256700 - RNA, 24 nt, Human
ugagaaccaccaauauaaucuaaa

SEQ ID NO: 256701 - RNA, 23 nt, Human
ugagaaugaaaagauccacaauc

SEQ ID NO: 256702 - RNA, 18 nt, Human
ugagagcuccagcugugg

SEQ ID NO: 256703 - RNA, 20 nt, Human
ugaguuucaucagcucccaa

SEQ ID NO: 256704 - RNA, 22 nt, Human
ugcaaugagaaugaaaagaucc

SEQ ID NO: 256705 - RNA, 20 nt, Human
ugcuuuuagagcgcugguac

SEQ ID NO: 256706 - RNA, 23 nt, Human
uggaacaaggacucuuuucucug

SEQ ID NO: 256707 - RNA, 21 nt, Human
uggcaacaagaaugauaaaug

SEQ ID NO: 256708 - RNA, 21 nt, Human
uggcaagucuagccaagggcu

SEQ ID NO: 256709 - RNA, 23 nt, Human
uggcaguggcgggcugagagccc

SEQ ID NO: 256710 - RNA, 24 nt, Human
uggcuacagggccauuguucaguu

SEQ ID NO: 256711 - RNA, 18 nt, Human
ugggagacagauucaugg

SEQ ID NO: 256712 - RNA, 18 nt, Human
ugggcauuuuucaagaga

SEQ ID NO: 256713 - RNA, 22 nt, Human
ugguuaacaguaacagcagcac

SEQ ID NO: 256714 - RNA, 19 nt, Human
ugguugugauaaaggagga

SEQ ID NO: 256715 - RNA, 21 nt, Human
ugugaguuucaucagcuccca

SEQ ID NO: 256716 - RNA, 28 nt, Human
uguguauaagaauucuuuggaaggauuu

SEQ ID NO: 256717 - RNA, 20 nt, Human
uguucaguuaaaguuaaguu

SEQ ID NO: 256718 - RNA, 19 nt, Human
uguuuuaaaaagcuaacag

SEQ ID NO: 256719 - RNA, 24 nt, Human
uucaauuuauuaucaaaauauuuc

SEQ ID NO: 256720 - RNA, 23 nt, Human
uucacaauuucaauuuauuauca

SEQ ID NO: 256721 - RNA, 18 nt, Human
uuccaaaauaacaaaugu

SEQ ID NO: 256722 - RNA, 22 nt, Human
uucccagcccccaaaucagccc

SEQ ID NO: 256723 - RNA, 21 nt, Human
uucuaaaguuagacaguuguc

SEQ ID NO: 256724 - RNA, 20 nt, Human
uuggaaggauuugaagaaau

SEQ ID NO: 256725 - RNA, 21 nt, Human
uugugucucagcuucuaaacu

SEQ ID NO: 256726 - RNA, 19 nt, Human
uuugagagcuccagcugug

SEQ ID NO: 256727 - RNA, 19 nt, Human
uuuguacuagucacucuuc

SEQ ID NO: 256728 - RNA, 24 nt, Human
uuugugacuuauaauucuagaagg

SEQ ID NO: 256729 - RNA, 24 nt, Human
uuugugaguuucaucagcucccaa

SEQ ID NO: 256730 - RNA, 21 nt, Human
uuuguuaggaaaaauaagaau

SEQ ID NO: 256731 - RNA, 19 nt, Human
uuuucaguuuauccugccc

SEQ ID NO: 256732 - RNA, 20 nt, Human
uuuuuuuuuuaaaggcaaau

SEQ ID NO: 256733 - RNA, 24 nt, Human
aaacaccuucuuuggacucacacc

SEQ ID NO: 256734 - RNA, 21 nt, Human
aacaagguugacuuuauucca

SEQ ID NO: 256735 - RNA, 22 nt, Human
acaaaaagggcuacauucuaaa

SEQ ID NO: 256736 - RNA, 22 nt, Human
accauguguuuuccauucaaau

SEQ ID NO: 256737 - RNA, 28 nt, Human
auuauaucaguacaaaaagggcuacauu

SEQ ID NO: 256738 - RNA, 27 nt, Human
caaaaagggcuacauucuaaauaguag

SEQ ID NO: 256739 - RNA, 22 nt, Human
cuggaaaagaucuuugcaacuc

SEQ ID NO: 256740 - RNA, 20 nt, Human
gaaaacaccuucuuuggacu

SEQ ID NO: 256741 - RNA, 21 nt, Human
gauuauauucuguguaucagu

SEQ ID NO: 256742 - RNA, 21 nt, Human
uaugaauccauaagccacaaa

SEQ ID NO: 256743 - RNA, 18 nt, Human
ucagugcaagguaaguga

SEQ ID NO: 256744 - RNA, 22 nt, Human
uccauaagccacaaacuugacu

SEQ ID NO: 256745 - RNA, 24 nt, Human
ucuccugucucuuucugucuugaa

SEQ ID NO: 256746 - RNA, 19 nt, Human
ucuugcuacuccaauaucc

SEQ ID NO: 256747 - RNA, 21 nt, Human
ucuuuggacucacaccaugug

SEQ ID NO: 256748 - RNA, 20 nt, Human
ugacugcacauguguucuug

SEQ ID NO: 256749 - RNA, 24 nt, Human
ugagcugcuuuuccuccggcaaaa

SEQ ID NO: 256750 - RNA, 22 nt, Human
ugauggcuucccagccucuugc

SEQ ID NO: 256751 - RNA, 23 nt, Human
ugauggcuucccagccucuugcu

SEQ ID NO: 256752 - RNA, 19 nt, Human
uggaacuaaauuauaucag

SEQ ID NO: 256753 - RNA, 23 nt, Human
uuguggaacuaaauuauaucagu

SEQ ID NO: 256754 - RNA, 22 nt, Human
uuucucagugcaagguaaguga

SEQ ID NO: 256755 - RNA, 25 nt, Human
aaaacacccauaucugucuuccccc

SEQ ID NO: 256756 - RNA, 24 nt, Human
aaauacauucucucaccuauugca

SEQ ID NO: 256757 - RNA, 22 nt, Human
acccauaucugucuucccccua

SEQ ID NO: 256758 - RNA, 23 nt, Human
agucacagaacaugcaggaaaaa

SEQ ID NO: 256759 - RNA, 19 nt, Human
cacccauaucugucuuccc

SEQ ID NO: 256760 - RNA, 23 nt, Human
caggcccaaaauaaaacuuuuua

SEQ ID NO: 256761 - RNA, 22 nt, Human
caugcaggaaaaauuaaccauu

SEQ ID NO: 256762 - RNA, 25 nt, Human
ccaaaauaaaacuuuuuauugagga

SEQ ID NO: 256763 - RNA, 19 nt, Human
gaaaauacauucucucacc

SEQ ID NO: 256764 - RNA, 24 nt, Human
uaaaaacacccauaucugucuucc

SEQ ID NO: 256765 - RNA, 18 nt, Human
ucaaaagcaagugaagaa

SEQ ID NO: 256766 - RNA, 25 nt, Human
ugaaaauacauucucucaccuauug

SEQ ID NO: 256767 - RNA, 19 nt, Human
ugcaaggcucaucuucuuc

SEQ ID NO: 256768 - RNA, 20 nt, Human
aaaaaaaaaaaagaagaaga

SEQ ID NO: 256769 - RNA, 21 nt, Human
aaaaaaaaaagaagaagaagg

SEQ ID NO: 256770 - RNA, 26 nt, Human
aacuuuuuggccuggauucuggagaa

SEQ ID NO: 256771 - RNA, 19 nt, Human
aagccucccugcccagucu

SEQ ID NO: 256772 - RNA, 19 nt, Human
aagccucccugcccagucu

SEQ ID NO: 256773 - RNA, 19 nt, Human
aaggaaccucacaacaggg

SEQ ID NO: 256774 - RNA, 19 nt, Human
acacauuuacaauggcuuu

SEQ ID NO: 256775 - RNA, 24 nt, Human
acagaugcaggcaccuaccaagac

SEQ ID NO: 256776 - RNA, 22 nt, Human
accccaccccaucccccugcag

SEQ ID NO: 256777 - RNA, 18 nt, Human
acccugagggacagggau

SEQ ID NO: 256778 - RNA, 21 nt, Human
acccugagggacagggaugag

SEQ ID NO: 256779 - RNA, 20 nt, Human
acuccaguucccccaguccu

SEQ ID NO: 256780 - RNA, 23 nt, Human
agaugcaggcaccuaccaagacc

SEQ ID NO: 256781 - RNA, 20 nt, Human
agcgggucccaagacugccc

SEQ ID NO: 256782 - RNA, 23 nt, Human
aggccauggggccccagcacccu

SEQ ID NO: 256783 - RNA, 21 nt, Human
agggcugaaggccauggggcc

SEQ ID NO: 256784 - RNA, 18 nt, Human
aguucccccaguccugcc

SEQ ID NO: 256785 - RNA, 21 nt, Human
aucccccugcaggagacaugg

SEQ ID NO: 256786 - RNA, 21 nt, Human
caccccaucccccugcaggag

SEQ ID NO: 256787 - RNA, 23 nt, Human
cacccuugcuucagugccagccc

SEQ ID NO: 256788 - RNA, 19 nt, Human
cacuccaguucccccaguc

SEQ ID NO: 256789 - RNA, 22 nt, Human
cagaaggcagacagaugcaggc

SEQ ID NO: 256790 - RNA, 20 nt, Human
cagccccuggaaggaaccuc

SEQ ID NO: 256791 - RNA, 25 nt, Human
cagccuccagggccuggggucuccu

SEQ ID NO: 256792 - RNA, 25 nt, Human
caggcaccuaccaagaccugaccuc

SEQ ID NO: 256793 - RNA, 24 nt, Human
caugaagaauaccccuccccauuu

SEQ ID NO: 256794 - RNA, 21 nt, Human
cauggugguuguaccccaccc

SEQ ID NO: 256795 - RNA, 24 nt, Human
ccaaagccucccugcccagucuga

SEQ ID NO: 256796 - RNA, 22 nt, Human
ccaagaccugaccucaggaagu

SEQ ID NO: 256797 - RNA, 19 nt, Human
ccagcacccuugcuucagu

SEQ ID NO: 256798 - RNA, 24 nt, Human
ccagccccuggaaggaaccucaca

SEQ ID NO: 256799 - RNA, 18 nt, Human
ccagggccuggggucucc

SEQ ID NO: 256800 - RNA, 23 nt, Human
cccacagccacaaagauggccau

SEQ ID NO: 256801 - RNA, 21 nt, Human
ccccaccccaucccccugcag

SEQ ID NO: 256802 - RNA, 23 nt, Human
ccccaccccaucccccugcagga

SEQ ID NO: 256803 - RNA, 24 nt, Human
ccccagcacccuugcuucagugcc

SEQ ID NO: 256804 - RNA, 21 nt, Human
cccccugcaggagacaugggc

SEQ ID NO: 256805 - RNA, 22 nt, Human
ccgccccggggcugcugggcuu

SEQ ID NO: 256806 - RNA, 18 nt, Human
cguggcccucccggcagu

SEQ ID NO: 256807 - RNA, 18 nt, Human
cugcguggcccucccggc

SEQ ID NO: 256808 - RNA, 21 nt, Human
cuuaagucaugccaaagccuu

SEQ ID NO: 256809 - RNA, 20 nt, Human
cuuuuuggccuggauucugg

SEQ ID NO: 256810 - RNA, 25 nt, Human
gaccacgaccugcguggcccucccg

SEQ ID NO: 256811 - RNA, 18 nt, Human
gauucuggagaacagauu

SEQ ID NO: 256812 - RNA, 25 nt, Human
gcagccuccagggccuggggucucc

SEQ ID NO: 256813 - RNA, 18 nt, Human
gccccggggcugcugggc

SEQ ID NO: 256814 - RNA, 18 nt, Human
gcucagccagggcugaag

SEQ ID NO: 256815 - RNA, 19 nt, Human
ggccuggauucuggagaac

SEQ ID NO: 256816 - RNA, 20 nt, Human
ggcugaaggccauggggccc

SEQ ID NO: 256817 - RNA, 23 nt, Human
gggacagggaugagacagggaag

SEQ ID NO: 256818 - RNA, 20 nt, Human
uacacacauuuacaauggcu

SEQ ID NO: 256819 - RNA, 20 nt, Human
uacccugagggacagggauu

SEQ ID NO: 256820 - RNA, 21 nt, Human
ucagucccaugccuggugccc

SEQ ID NO: 256821 - RNA, 19 nt, Human
ucaguuuaaaaaaaaaaaa

SEQ ID NO: 256822 - RNA, 26 nt, Human
ucaguuuaaaaaaaaaaaagaagaaa

SEQ ID NO: 256823 - RNA, 28 nt, Human
ucaguuuaaaaaaaaaaaagaagaagaa

SEQ ID NO: 256824 - RNA, 22 nt, Human
ucaugccaaagccucccugccc

SEQ ID NO: 256825 - RNA, 18 nt, Human
uccagggccuggggucuc

SEQ ID NO: 256826 - RNA, 22 nt, Human
ucccccaguccugccauggugc

SEQ ID NO: 256827 - RNA, 18 nt, Human
ugaagaauaccccucccc

SEQ ID NO: 256828 - RNA, 20 nt, Human
ugagggcauccaagccaugg

SEQ ID NO: 256829 - RNA, 19 nt, Human
ugcaggcaccuaccaagac

SEQ ID NO: 256830 - RNA, 21 nt, Human
ugggacaggauugagguaugu

SEQ ID NO: 256831 - RNA, 22 nt, Human
ugggacaggauugagguauguu

SEQ ID NO: 256832 - RNA, 23 nt, Human
uuaaaaaaaaaaaagaagaagaa

SEQ ID NO: 256833 - RNA, 23 nt, Human
uuaaaaaaaaaaaagaagaagaa

SEQ ID NO: 256834 - RNA, 22 nt, Human
uugcagccuccagggccugggg

SEQ ID NO: 256835 - RNA, 22 nt, Human
uuggaggauagcagugcugcga

SEQ ID NO: 256836 - RNA, 22 nt, Human
aagcaagaauggacaauuagag

SEQ ID NO: 256837 - RNA, 20 nt, Human
acagagcaugcuucaaauag

SEQ ID NO: 256838 - RNA, 21 nt, Human
caaauaugcaauaaauacuua

SEQ ID NO: 256839 - RNA, 19 nt, Human
gcugaagugaacuaacaaa

SEQ ID NO: 256840 - RNA, 19 nt, Human
uagaauuaucuugcuuuga

SEQ ID NO: 256841 - RNA, 24 nt, Human
uagcaaauaugcaauaaauacuua

SEQ ID NO: 256842 - RNA, 29 nt, Human
ugaacuaacaaaaaccauuaagggaggcc

SEQ ID NO: 256843 - RNA, 22 nt, Human
ugaagugaacuaacaaaaacca

SEQ ID NO: 256844 - RNA, 25 nt, Human
uugagccaaaauauauauacuuaau

SEQ ID NO: 256845 - RNA, 21 nt, Human
aaaagugaaaauuaaacagaa

SEQ ID NO: 256846 - RNA, 23 nt, Human
aaagacaucauccuucuuuaucc

SEQ ID NO: 256847 - RNA, 21 nt, Human
aaauagccuauauauccaaga

SEQ ID NO: 256848 - RNA, 23 nt, Human
aagauauauuuuauuucaugcua

SEQ ID NO: 256849 - RNA, 18 nt, Human
aagucuuuagaaaauagc

SEQ ID NO: 256850 - RNA, 18 nt, Human
aagugccaagcacccucc

SEQ ID NO: 256851 - RNA, 22 nt, Human
acagcaacaagaaucagaugcu

SEQ ID NO: 256852 - RNA, 23 nt, Human
acugcucuuuugucuccugucuu

SEQ ID NO: 256853 - RNA, 19 nt, Human
aguaagaaugauuuauuca

SEQ ID NO: 256854 - RNA, 22 nt, Human
aguauuaccccaaaugcucuuc

SEQ ID NO: 256855 - RNA, 24 nt, Human
augaaaaagggaugccauggccuu

SEQ ID NO: 256856 - RNA, 20 nt, Human
augcaaaggaauauuugucu

SEQ ID NO: 256857 - RNA, 21 nt, Human
augcaaaggaauauuugucuu

SEQ ID NO: 256858 - RNA, 18 nt, Human
caaagauaacuuacugaa

SEQ ID NO: 256859 - RNA, 21 nt, Human
caagaaucagaugcucuuuag

SEQ ID NO: 256860 - RNA, 22 nt, Human
caagcacccuccccaaguauca

SEQ ID NO: 256861 - RNA, 23 nt, Human
cacagaaccaagcuuucuccuga

SEQ ID NO: 256862 - RNA, 24 nt, Human
cagagaaaaaaaggcauccuucca

SEQ ID NO: 256863 - RNA, 21 nt, Human
ccacugcucuuuugucuccug

SEQ ID NO: 256864 - RNA, 19 nt, Human
cccaaauuuccauuuucau

SEQ ID NO: 256865 - RNA, 21 nt, Human
ccuaccccgcacuucuggaag

SEQ ID NO: 256866 - RNA, 19 nt, Human
gaaaauuauuuauuuggaa

SEQ ID NO: 256867 - RNA, 22 nt, Human
gauagcucuucuuccccuaccc

SEQ ID NO: 256868 - RNA, 23 nt, Human
gcaacuuuuagucuuaaauaauc

SEQ ID NO: 256869 - RNA, 20 nt, Human
gcacccuccccaaguaucaa

SEQ ID NO: 256870 - RNA, 18 nt, Human
uaauuuaugaaaaaggga

SEQ ID NO: 256871 - RNA, 22 nt, Human
uaccccgcacuucuggaaguau

SEQ ID NO: 256872 - RNA, 24 nt, Human
uaccccgcacuucuggaaguauua

SEQ ID NO: 256873 - RNA, 21 nt, Human
uagcucuucuuccccuacccc

SEQ ID NO: 256874 - RNA, 25 nt, Human
uagucauauagauacuaguuaaaga

SEQ ID NO: 256875 - RNA, 21 nt, Human
uauucaauaagugccaagcac

SEQ ID NO: 256876 - RNA, 22 nt, Human
uccuuccauaucucaagggauc

SEQ ID NO: 256877 - RNA, 21 nt, Human
ucuccugauagcucuucuucc

SEQ ID NO: 256878 - RNA, 21 nt, Human
ugcauuucauuuucuuugccu

SEQ ID NO: 256879 - RNA, 22 nt, Human
ugccaaaagugaaaauuaaaca

SEQ ID NO: 256880 - RNA, 19 nt, Human
ugccaagcacccuccccaa

SEQ ID NO: 256881 - RNA, 24 nt, Human
uggaaguuacagucuauuauuaca

SEQ ID NO: 256882 - RNA, 18 nt, Human
ugggaagugcugggggau

SEQ ID NO: 256883 - RNA, 27 nt, Human
uuagagauccuccauuucauuacucua

SEQ ID NO: 256884 - RNA, 20 nt, Human
uucaauaagugccaagcacc

SEQ ID NO: 256885 - RNA, 21 nt, Human
uucacagaaccaagcuuucuc

SEQ ID NO: 256886 - RNA, 23 nt, Human
uuccauuuucauacuauuuuaua

SEQ ID NO: 256887 - RNA, 24 nt, Human
uugauggccgaucauauauucaau

SEQ ID NO: 256888 - RNA, 18 nt, Human
uuuagagauccuccauuu

SEQ ID NO: 256889 - RNA, 25 nt, Human
aaaaaaacaaacaagacagaaaucu

SEQ ID NO: 256890 - RNA, 26 nt, Human
aaaacaaacaagacagaaaucuagcc

SEQ ID NO: 256891 - RNA, 24 nt, Human
aaacaaaacaaaaaaacaaacaag

SEQ ID NO: 256892 - RNA, 20 nt, Human
aaacaagacagaaaucuagc

SEQ ID NO: 256893 - RNA, 23 nt, Human
aaagccccauccaaggcuaacau

SEQ ID NO: 256894 - RNA, 20 nt, Human
aaagcuacaggguuccccug

SEQ ID NO: 256895 - RNA, 22 nt, Human
aacaaaaaaacaaacaagacag

SEQ ID NO: 256896 - RNA, 24 nt, Human
aacaaaaaaacaaacaagacagaa

SEQ ID NO: 256897 - RNA, 24 nt, Human
aacaaaacaaaaaaacaaacaaga

SEQ ID NO: 256898 - RNA, 21 nt, Human
aaggagcagaugaccccauuu

SEQ ID NO: 256899 - RNA, 26 nt, Human
acaaaacaaaaaaacaaacaagacag

SEQ ID NO: 256900 - RNA, 26 nt, Human
acaaaacaaaaaaacaaacaagacag

SEQ ID NO: 256901 - RNA, 19 nt, Human
accauggccaccaccuuug

SEQ ID NO: 256902 - RNA, 26 nt, Human
agacagaaaucuagccgaaccgacgc

SEQ ID NO: 256903 - RNA, 22 nt, Human
agagggcaggccacuggugaga

SEQ ID NO: 256904 - RNA, 21 nt, Human
agcaagugugccuuccucagg

SEQ ID NO: 256905 - RNA, 22 nt, Human
agcagcccacccaccaccaccu

SEQ ID NO: 256906 - RNA, 18 nt, Human
agccgaacugccagcacc

SEQ ID NO: 256907 - RNA, 20 nt, Human
aggcagaggcagaucuccga

SEQ ID NO: 256908 - RNA, 25 nt, Human
aggcagaggcagaucuccgaggaaa

SEQ ID NO: 256909 - RNA, 22 nt, Human
aggcugcggggagggggcucgg

SEQ ID NO: 256910 - RNA, 18 nt, Human
agggagggaggcggucag

SEQ ID NO: 256911 - RNA, 18 nt, Human
agggcuggagugcccaga

SEQ ID NO: 256912 - RNA, 20 nt, Human
agucggcgaacuggggucug

SEQ ID NO: 256913 - RNA, 21 nt, Human
aucccucuccucuugcucccu

SEQ ID NO: 256914 - RNA, 18 nt, Human
augggagcagcccaccca

SEQ ID NO: 256915 - RNA, 21 nt, Human
caaaacaaaaaaacaaacaag

SEQ ID NO: 256916 - RNA, 21 nt, Human
caaagugccuguuugcucuuc

SEQ ID NO: 256917 - RNA, 22 nt, Human
caagacagaaaucuagccgaac

SEQ ID NO: 256918 - RNA, 19 nt, Human
caagugcagagcccccaac

SEQ ID NO: 256919 - RNA, 23 nt, Human
cacagcccacccuguggcccccu

SEQ ID NO: 256920 - RNA, 18 nt, Human
caccaccugcugccacug

SEQ ID NO: 256921 - RNA, 23 nt, Human
cacccaccaccaccugcugccac

SEQ ID NO: 256922 - RNA, 20 nt, Human
caccccauuuccccuacccc

SEQ ID NO: 256923 - RNA, 30 nt, Human
caccccauuuccccuaccccgugccccacc

SEQ ID NO: 256924 - RNA, 18 nt, Human
cacccuguggcccccugc

SEQ ID NO: 256925 - RNA, 18 nt, Human
cacccuguggcccccugc

SEQ ID NO: 256926 - RNA, 22 nt, Human
caccggccccacccuaccugac

SEQ ID NO: 256927 - RNA, 18 nt, Human
caccugcugccacuggcc

SEQ ID NO: 256928 - RNA, 19 nt, Human
cagagcccccaacacauuc

SEQ ID NO: 256929 - RNA, 21 nt, Human
cagccaggggacagagagaag

SEQ ID NO: 256930 - RNA, 18 nt, Human
cagcccacccuguggccc

SEQ ID NO: 256931 - RNA, 18 nt, Human
cagcucuucuaacuguga

SEQ ID NO: 256932 - RNA, 18 nt, Human
cagggaccaacaggagca

SEQ ID NO: 256933 - RNA, 25 nt, Human
cauuaaacaaaacaaaaaaacaaac

SEQ ID NO: 256934 - RNA, 18 nt, Human
ccacccuguggcccccug

SEQ ID NO: 256935 - RNA, 23 nt, Human
ccaccgggucagccgggcagugu

SEQ ID NO: 256936 - RNA, 19 nt, Human
ccagccaggcccuguggcc

SEQ ID NO: 256937 - RNA, 23 nt, Human
ccagcugccugaguuugggcaag

SEQ ID NO: 256938 - RNA, 24 nt, Human
cccacccaccaccaccugcugcca

SEQ ID NO: 256939 - RNA, 21 nt, Human
cccaccggccccacccuaccu

SEQ ID NO: 256940 - RNA, 22 nt, Human
cccagccuaagcgagccccagc

SEQ ID NO: 256941 - RNA, 25 nt, Human
cccauccaaggcuaacauucgagag

SEQ ID NO: 256942 - RNA, 25 nt, Human
ccccacccccccgacaucccucucc

SEQ ID NO: 256943 - RNA, 18 nt, Human
ccccacccccucacacug

SEQ ID NO: 256944 - RNA, 19 nt, Human
ccccacccuaccugacagc

SEQ ID NO: 256945 - RNA, 18 nt, Human
ccccagggcucugacccg

SEQ ID NO: 256946 - RNA, 20 nt, Human
ccccagggcucugacccggg

SEQ ID NO: 256947 - RNA, 23 nt, Human
ccccaguggcucaggcuccuucc

SEQ ID NO: 256948 - RNA, 24 nt, Human
cccccaacacauucagauggggcu

SEQ ID NO: 256949 - RNA, 19 nt, Human
ccccccgacaucccucucc

SEQ ID NO: 256950 - RNA, 19 nt, Human
ccccgguaccauggccacc

SEQ ID NO: 256951 - RNA, 21 nt, Human
ccccgugccccacccccccga

SEQ ID NO: 256952 - RNA, 18 nt, Human
ccccugaggggcagaggc

SEQ ID NO: 256953 - RNA, 22 nt, Human
cccuccugcccccucuggcugu

SEQ ID NO: 256954 - RNA, 21 nt, Human
cccuuccugagagcuccacag

SEQ ID NO: 256955 - RNA, 24 nt, Human
cccuuccugagagcuccacagccc

SEQ ID NO: 256956 - RNA, 22 nt, Human
ccggccccagccuuccaaugcu

SEQ ID NO: 256957 - RNA, 19 nt, Human
ccgggcccacgcccugggg

SEQ ID NO: 256958 - RNA, 25 nt, Human
ccgggcccacgcccuggggucgcac

SEQ ID NO: 256959 - RNA, 21 nt, Human
ccuaagcgagccccagcuccu

SEQ ID NO: 256960 - RNA, 23 nt, Human
ccucagccccagcugccugaguu

SEQ ID NO: 256961 - RNA, 22 nt, Human
ccucagggcccuuccugagagc

SEQ ID NO: 256962 - RNA, 22 nt, Human
ccucauuuuccuuuuugguccc

SEQ ID NO: 256963 - RNA, 22 nt, Human
ccucccacucagcccucagggg

SEQ ID NO: 256964 - RNA, 21 nt, Human
ccuccugcccccucuggcugu

SEQ ID NO: 256965 - RNA, 26 nt, Human
ccucuugcucccuccacugggucuca

SEQ ID NO: 256966 - RNA, 21 nt, Human
ccugaggggcagaggcuggaa

SEQ ID NO: 256967 - RNA, 20 nt, Human
ccugggcagcaaggacaggg

SEQ ID NO: 256968 - RNA, 23 nt, Human
ccuggggucgcaccgccacuccc

SEQ ID NO: 256969 - RNA, 20 nt, Human
ccuguuugcucuucuccucu

SEQ ID NO: 256970 - RNA, 21 nt, Human
ccuuugggccucagccccagc

SEQ ID NO: 256971 - RNA, 19 nt, Human
cggggagggggcucgggac

SEQ ID NO: 256972 - RNA, 20 nt, Human
cuaccccgugccccaccccc

SEQ ID NO: 256973 - RNA, 22 nt, Human
cucacccccagggcucugaccc

SEQ ID NO: 256974 - RNA, 21 nt, Human
cuccacugggucucacucucc

SEQ ID NO: 256975 - RNA, 20 nt, Human
cucgugaagccccucauucc

SEQ ID NO: 256976 - RNA, 23 nt, Human
cucucccaccggccccacccuac

SEQ ID NO: 256977 - RNA, 23 nt, Human
cucuccucuugcucccuccacug

SEQ ID NO: 256978 - RNA, 20 nt, Human
cucugcuccuuucucuggcu

SEQ ID NO: 256979 - RNA, 20 nt, Human
cucuggcugcccuacccuuc

SEQ ID NO: 256980 - RNA, 19 nt, Human
cugcccccucuggcuguuc

SEQ ID NO: 256981 - RNA, 21 nt, Human
cugcccuacccuuccccucca

SEQ ID NO: 256982 - RNA, 19 nt, Human
cugccugaguuugggcaag

SEQ ID NO: 256983 - RNA, 24 nt, Human
cugccuuugggccucagccccagc

SEQ ID NO: 256984 - RNA, 20 nt, Human
cugcggggagggggcucggg

SEQ ID NO: 256985 - RNA, 21 nt, Human
cugcugccacuggccuucaga

SEQ ID NO: 256986 - RNA, 18 nt, Human
cuguuugcucuucuccuc

SEQ ID NO: 256987 - RNA, 21 nt, Human
cuuggcaguccccacccccuc

SEQ ID NO: 256988 - RNA, 26 nt, Human
cuuggccuggccugcccggccccagc

SEQ ID NO: 256989 - RNA, 25 nt, Human
cuuggcuuggccuggccugcccggc

SEQ ID NO: 256990 - RNA, 22 nt, Human
cuuucagggcuggagugcccag

SEQ ID NO: 256991 - RNA, 21 nt, Human
cuuucucuguggccuucaggc

SEQ ID NO: 256992 - RNA, 22 nt, Human
gaaaaggagcagaugaccccau

SEQ ID NO: 256993 - RNA, 20 nt, Human
gaacuugacugacugagcaa

SEQ ID NO: 256994 - RNA, 19 nt, Human
gcccuacccuuccccucca

SEQ ID NO: 256995 - RNA, 21 nt, Human
gccgcccucccacucagcccu

SEQ ID NO: 256996 - RNA, 19 nt, Human
gccgggacagcguggccag

SEQ ID NO: 256997 - RNA, 21 nt, Human
gccgggcccacgcccuggggu

SEQ ID NO: 256998 - RNA, 22 nt, Human
gcgagccccagcuccugccccu

SEQ ID NO: 256999 - RNA, 18 nt, Human
gcggggagggggcucggg

SEQ ID NO: 257000 - RNA, 20 nt, Human
gcguggccagccaggcccug

SEQ ID NO: 257001 - RNA, 21 nt, Human
gcugccaauuggguacaccug

SEQ ID NO: 257002 - RNA, 19 nt, Human
ggacagggaccaacaggag

SEQ ID NO: 257003 - RNA, 22 nt, Human
ggccgggacagcguggccagcc

SEQ ID NO: 257004 - RNA, 26 nt, Human
gggcagugugggcuccgcggccgggc

SEQ ID NO: 257005 - RNA, 20 nt, Human
gggccucagccccagcugcc

SEQ ID NO: 257006 - RNA, 22 nt, Human
gggcucgggacgaugggagcag

SEQ ID NO: 257007 - RNA, 20 nt, Human
gggugggggagcgagagggc

SEQ ID NO: 257008 - RNA, 20 nt, Human
guccuugugguaggaguggg

SEQ ID NO: 257009 - RNA, 18 nt, Human
guggacccagccuaagcg

SEQ ID NO: 257010 - RNA, 18 nt, Human
guuugcucuucuccucuu

SEQ ID NO: 257011 - RNA, 22 nt, Human
guuugcucuucuccucuuuucc

SEQ ID NO: 257012 - RNA, 19 nt, Human
guuuuccucccaaggucuu

SEQ ID NO: 257013 - RNA, 18 nt, Human
uaacugugaaagccccau

SEQ ID NO: 257014 - RNA, 19 nt, Human
uaacugugaaagccccauc

SEQ ID NO: 257015 - RNA, 18 nt, Human
uagccgaacugccagcac

SEQ ID NO: 257016 - RNA, 21 nt, Human
uagucggcgaacuggggucug

SEQ ID NO: 257017 - RNA, 30 nt, Human
uauaauaaaaauauacauuaaacaaaacaa

SEQ ID NO: 257018 - RNA, 20 nt, Human
ucagauggggcuggacagac

SEQ ID NO: 257019 - RNA, 21 nt, Human
ucagcucuucuaacugugaaa

SEQ ID NO: 257020 - RNA, 22 nt, Human
uccacugggucucacucuccca

SEQ ID NO: 257021 - RNA, 23 nt, Human
uccacugggucucacucucccaa

SEQ ID NO: 257022 - RNA, 24 nt, Human
uccacugggucucacucucccccc

SEQ ID NO: 257023 - RNA, 19 nt, Human
uccccugaggggcagaggc

SEQ ID NO: 257024 - RNA, 23 nt, Human
ucccucggggcgccuuugucuuc

SEQ ID NO: 257025 - RNA, 23 nt, Human
uccucauuuuccuuuuugguccc

SEQ ID NO: 257026 - RNA, 21 nt, Human
uccucguuugugugccuucuc

SEQ ID NO: 257027 - RNA, 19 nt, Human
uccuuuuugguccccuccu

SEQ ID NO: 257028 - RNA, 23 nt, Human
ucucacucucccaaguccccggu

SEQ ID NO: 257029 - RNA, 21 nt, Human
ugaaagccccauccaaggcua

SEQ ID NO: 257030 - RNA, 18 nt, Human
ugaagccccucauuccuc

SEQ ID NO: 257031 - RNA, 18 nt, Human
ugacugacugagcaacga

SEQ ID NO: 257032 - RNA, 19 nt, Human
ugacugacugagcaacgaa

SEQ ID NO: 257033 - RNA, 21 nt, Human
ugacugacugagcaacgaaga

SEQ ID NO: 257034 - RNA, 18 nt, Human
ugacugagcaacgaagac

SEQ ID NO: 257035 - RNA, 21 nt, Human
ugagacaggcuugaggggugc

SEQ ID NO: 257036 - RNA, 24 nt, Human
ugagacaggcuugaggggugcugg

SEQ ID NO: 257037 - RNA, 20 nt, Human
ugaggcagaggcagaucucc

SEQ ID NO: 257038 - RNA, 22 nt, Human
ugaggggcagaggcuggaaagg

SEQ ID NO: 257039 - RNA, 19 nt, Human
ugccacuggccuucagagg

SEQ ID NO: 257040 - RNA, 22 nt, Human
ugccccacccccccgacauccc

SEQ ID NO: 257041 - RNA, 18 nt, Human
ugcggggagggggcucgg

SEQ ID NO: 257042 - RNA, 21 nt, Human
ugcggggagggggcucgggac

SEQ ID NO: 257043 - RNA, 24 nt, Human
ugcggggagggggcucgggacgau

SEQ ID NO: 257044 - RNA, 23 nt, Human
ugcuccuuucucuggcugcccua

SEQ ID NO: 257045 - RNA, 19 nt, Human
ugcucuucuccucuuuucc

SEQ ID NO: 257046 - RNA, 20 nt, Human
uggacagacacaaagcuacu

SEQ ID NO: 257047 - RNA, 18 nt, Human
uggcaccagggaagcgug

SEQ ID NO: 257048 - RNA, 21 nt, Human
uggccucucgugaagccccuu

SEQ ID NO: 257049 - RNA, 18 nt, Human
uggccuggccugcccggc

SEQ ID NO: 257050 - RNA, 18 nt, Human
uggccuucaggcucaccc

SEQ ID NO: 257051 - RNA, 20 nt, Human
uggcucaggcuccuuccuug

SEQ ID NO: 257052 - RNA, 21 nt, Human
uggcuguucugccuuugggcc

SEQ ID NO: 257053 - RNA, 19 nt, Human
ugggcagcaaggacaggga

SEQ ID NO: 257054 - RNA, 18 nt, Human
ugggcugggugggggagc

SEQ ID NO: 257055 - RNA, 22 nt, Human
uggguacaccuggggcuuucag

SEQ ID NO: 257056 - RNA, 21 nt, Human
ugguaggagugggcgggccgg

SEQ ID NO: 257057 - RNA, 24 nt, Human
ugugaaagccccauccaaggcuag

SEQ ID NO: 257058 - RNA, 25 nt, Human
ugugccuuccucagggcccuuccug

SEQ ID NO: 257059 - RNA, 26 nt, Human
ugugugccuucucugcuccuuucucu

SEQ ID NO: 257060 - RNA, 23 nt, Human
uuaggguggcuuggcagucccca

SEQ ID NO: 257061 - RNA, 27 nt, Human
uucagggcuggagugcccagagccucc

SEQ ID NO: 257062 - RNA, 20 nt, Human
uucccugggguaggugaggc

SEQ ID NO: 257063 - RNA, 18 nt, Human
uuccucagggcccuuccu

SEQ ID NO: 257064 - RNA, 19 nt, Human
uuccuuggaaguucccugg

SEQ ID NO: 257065 - RNA, 21 nt, Human
uuccuuggaaguucccugggg

SEQ ID NO: 257066 - RNA, 20 nt, Human
uucuccucuuuuccgguuuu

SEQ ID NO: 257067 - RNA, 19 nt, Human
uugcucccuccacuggguc

SEQ ID NO: 257068 - RNA, 20 nt, Human
uugcucccuccacugggucu

SEQ ID NO: 257069 - RNA, 21 nt, Human
uugugugccuucucugcuccu

SEQ ID NO: 257070 - RNA, 23 nt, Human
uuucagggcuggagugcccagag

SEQ ID NO: 257071 - RNA, 23 nt, Human
uuugguccccuccugcccccucu

SEQ ID NO: 257072 - RNA, 18 nt, Human
uuuuuuuuuuuuuuuuug

SEQ ID NO: 257073 - RNA, 23 nt, Human
uuuuuuuuuuuuuuuuuggaauu

SEQ ID NO: 257074 - RNA, 22 nt, Human
aaaacaaaacaaaacaaacacc

SEQ ID NO: 257075 - RNA, 22 nt, Human
aaacaaaacaaacaccuggaca

SEQ ID NO: 257076 - RNA, 21 nt, Human
aaacaaaacaaacaccugggg

SEQ ID NO: 257077 - RNA, 26 nt, Human
aaauggucaaguaaggugccaaaaac

SEQ ID NO: 257078 - RNA, 19 nt, Human
aacaaaacaaacaccugga

SEQ ID NO: 257079 - RNA, 18 nt, Human
aauggucaaguaaggugc

SEQ ID NO: 257080 - RNA, 27 nt, Human
acaaaacaaacaccuggacauaaauaa

SEQ ID NO: 257081 - RNA, 20 nt, Human
acaaaacaaacaccuggacc

SEQ ID NO: 257082 - RNA, 22 nt, Human
acagggaaggaacagaggguuc

SEQ ID NO: 257083 - RNA, 18 nt, Human
agaaccacaggcgccccc

SEQ ID NO: 257084 - RNA, 20 nt, Human
agaaccacaggcgcccccug

SEQ ID NO: 257085 - RNA, 18 nt, Human
agaccccugaggcuagug

SEQ ID NO: 257086 - RNA, 26 nt, Human
agccaucucagaaccacaggcgcccc

SEQ ID NO: 257087 - RNA, 23 nt, Human
aggaaccccucaugcccagugcc

SEQ ID NO: 257088 - RNA, 18 nt, Human
aggaggggaccagggggg

SEQ ID NO: 257089 - RNA, 18 nt, Human
aggcugcugcuucccugg

SEQ ID NO: 257090 - RNA, 23 nt, Human
agggagcuggaggggaggaaccc

SEQ ID NO: 257091 - RNA, 21 nt, Human
agggaggaggcacagggaagg

SEQ ID NO: 257092 - RNA, 20 nt, Human
agggggcagaagcugccgga

SEQ ID NO: 257093 - RNA, 24 nt, Human
agugccuuggggauccuggguggc

SEQ ID NO: 257094 - RNA, 19 nt, Human
auucacggccauccacugc

SEQ ID NO: 257095 - RNA, 26 nt, Human
caagaaaccacucgcagaggccagca

SEQ ID NO: 257096 - RNA, 22 nt, Human
caagccagaggaugaugggggc

SEQ ID NO: 257097 - RNA, 21 nt, Human
caaugugggccucugccccuc

SEQ ID NO: 257098 - RNA, 24 nt, Human
caccuggacauaaauaaugagggc

SEQ ID NO: 257099 - RNA, 21 nt, Human
cacugcacgccggauccucgc

SEQ ID NO: 257100 - RNA, 22 nt, Human
cacugcccaggccuaggcaccc

SEQ ID NO: 257101 - RNA, 18 nt, Human
cagcagaauccuuccccc

SEQ ID NO: 257102 - RNA, 20 nt, Human
cagcagaauccuucccccuc

SEQ ID NO: 257103 - RNA, 22 nt, Human
caggggcgaggcugcugcuucc

SEQ ID NO: 257104 - RNA, 26 nt, Human
cauccacugcccaggccuaggcaccc

SEQ ID NO: 257105 - RNA, 19 nt, Human
caucucagaaccacaggcg

SEQ ID NO: 257106 - RNA, 19 nt, Human
ccaggacccugggggcaca

SEQ ID NO: 257107 - RNA, 21 nt, Human
ccagguccccuuuggccuggg

SEQ ID NO: 257108 - RNA, 24 nt, Human
ccagugccugacacugugggcacc

SEQ ID NO: 257109 - RNA, 20 nt, Human
ccauccacugcccaggccua

SEQ ID NO: 257110 - RNA, 18 nt, Human
cccaccagcccccucucc

SEQ ID NO: 257111 - RNA, 23 nt, Human
cccagugccugacacugugggca

SEQ ID NO: 257112 - RNA, 19 nt, Human
cccccgcagccccaccccu

SEQ ID NO: 257113 - RNA, 22 nt, Human
ccccuggcuguggccaagccag

SEQ ID NO: 257114 - RNA, 19 nt, Human
cccucugcuccccuggcug

SEQ ID NO: 257115 - RNA, 25 nt, Human
cccucugcuccccuggcuguggcca

SEQ ID NO: 257116 - RNA, 20 nt, Human
cccuggcagacucccuuugg

SEQ ID NO: 257117 - RNA, 18 nt, Human
ccuaaggcccagagagac

SEQ ID NO: 257118 - RNA, 19 nt, Human
ccucuugcuugcuuuggga

SEQ ID NO: 257119 - RNA, 21 nt, Human
ccuggggcugccccugggugg

SEQ ID NO: 257120 - RNA, 24 nt, Human
cggaacacugcacgccggauccuc

SEQ ID NO: 257121 - RNA, 19 nt, Human
cggacccgcacuuggugcc

SEQ ID NO: 257122 - RNA, 21 nt, Human
cggccauccacugcccaggcc

SEQ ID NO: 257123 - RNA, 20 nt, Human
cucaagggccacggcccacc

SEQ ID NO: 257124 - RNA, 25 nt, Human
cucaagggccacggcccaccucccu

SEQ ID NO: 257125 - RNA, 20 nt, Human
cucagaaccacaggcgcccc

SEQ ID NO: 257126 - RNA, 21 nt, Human
cuccuucgugggguucacagu

SEQ ID NO: 257127 - RNA, 18 nt, Human
cucgcagaggccagcaga

SEQ ID NO: 257128 - RNA, 20 nt, Human
cucgcagaggccagcagaau

SEQ ID NO: 257129 - RNA, 19 nt, Human
cucugccccucugcucccc

SEQ ID NO: 257130 - RNA, 19 nt, Human
cugccgggggugggcuggg

SEQ ID NO: 257131 - RNA, 20 nt, Human
cugcugccgggggugggcug

SEQ ID NO: 257132 - RNA, 24 nt, Human
cuggagcagaacuacauuuagaaa

SEQ ID NO: 257133 - RNA, 22 nt, Human
cugggggcugcugccgggggug

SEQ ID NO: 257134 - RNA, 19 nt, Human
gaaccacaggcgcccccug

SEQ ID NO: 257135 - RNA, 22 nt, Human
gaacccccgcagccccaccccu

SEQ ID NO: 257136 - RNA, 23 nt, Human
gaacuacauuuagaaaauucuaa

SEQ ID NO: 257137 - RNA, 22 nt, Human
gaagaaggugugggcccaaggg

SEQ ID NO: 257138 - RNA, 20 nt, Human
gaagcccaaaggagcuggag

SEQ ID NO: 257139 - RNA, 21 nt, Human
gagagccuggcaguuacagcc

SEQ ID NO: 257140 - RNA, 19 nt, Human
gaggcaggcccagggcccu

SEQ ID NO: 257141 - RNA, 19 nt, Human
gauccuggguggcagacuc

SEQ ID NO: 257142 - RNA, 23 nt, Human
gcaaagagagccuggcaguuaca

SEQ ID NO: 257143 - RNA, 21 nt, Human
gccaaaaacaaaacaaaacaa

SEQ ID NO: 257144 - RNA, 20 nt, Human
gccaagccagaggaugaugg

SEQ ID NO: 257145 - RNA, 23 nt, Human
gccagcagaauccuucccccuca

SEQ ID NO: 257146 - RNA, 21 nt, Human
gccccaccccuuagcuggcuc

SEQ ID NO: 257147 - RNA, 22 nt, Human
gcccccucucccuggggcucag

SEQ ID NO: 257148 - RNA, 23 nt, Human
gcccugggguucaggcugaggag

SEQ ID NO: 257149 - RNA, 24 nt, Human
gccuggcaguuacagcccuggggu

SEQ ID NO: 257150 - RNA, 20 nt, Human
gcggagggagccccugggag

SEQ ID NO: 257151 - RNA, 21 nt, Human
gcugaagcccaaaggagcugg

SEQ ID NO: 257152 - RNA, 22 nt, Human
ggaacccccgcagccccacccc

SEQ ID NO: 257153 - RNA, 23 nt, Human
ggaaccccucaugcccagugccu

SEQ ID NO: 257154 - RNA, 22 nt, Human
ggaagaaggugugggcccaagg

SEQ ID NO: 257155 - RNA, 22 nt, Human
ggaagaaggugugggcccaagg

SEQ ID NO: 257156 - RNA, 23 nt, Human
ggagggcagccucuuaggccaca

SEQ ID NO: 257157 - RNA, 22 nt, Human
ggaggugggagcugggggcugc

SEQ ID NO: 257158 - RNA, 20 nt, Human
ggcagaagcugccggacccg

SEQ ID NO: 257159 - RNA, 23 nt, Human
ggccaagccagaggaugaugggg

SEQ ID NO: 257160 - RNA, 18 nt, Human
ggcucaggacacuggcag

SEQ ID NO: 257161 - RNA, 19 nt, Human
gggaaacagaaacaaaugg

SEQ ID NO: 257162 - RNA, 25 nt, Human
gggaagaaggugugggcccaagggg

SEQ ID NO: 257163 - RNA, 19 nt, Human
gggagggaggaggcacagg

SEQ ID NO: 257164 - RNA, 20 nt, Human
gggcaaagagagccuggcag

SEQ ID NO: 257165 - RNA, 24 nt, Human
ggugccaaaaacaaaacaaaacaa

SEQ ID NO: 257166 - RNA, 21 nt, Human
ggugugggcccaaggggaggu

SEQ ID NO: 257167 - RNA, 18 nt, Human
gguucuagcucagggagg

SEQ ID NO: 257168 - RNA, 22 nt, Human
gugccaaaaacaaaacaaaaca

SEQ ID NO: 257169 - RNA, 19 nt, Human
uaaggugccaaaaacaaaa

SEQ ID NO: 257170 - RNA, 19 nt, Human
uacagcccugggguucagg

SEQ ID NO: 257171 - RNA, 19 nt, Human
uacaguaccauuucccaca

SEQ ID NO: 257172 - RNA, 21 nt, Human
uauccccaccagugucucucc

SEQ ID NO: 257173 - RNA, 20 nt, Human
ucaaguaaggugccaaaaac

SEQ ID NO: 257174 - RNA, 18 nt, Human
ucacuugggaaggagggg

SEQ ID NO: 257175 - RNA, 23 nt, Human
uccacugcccaggccuaggcacc

SEQ ID NO: 257176 - RNA, 22 nt, Human
uccagguccccuuuggccuggg

SEQ ID NO: 257177 - RNA, 19 nt, Human
ucccuggggagaggggccc

SEQ ID NO: 257178 - RNA, 21 nt, Human
ucccuggggagaggggcccug

SEQ ID NO: 257179 - RNA, 24 nt, Human
uccguggugaggcaggcccagggc

SEQ ID NO: 257180 - RNA, 21 nt, Human
ucgcucagggccauggggaag

SEQ ID NO: 257181 - RNA, 23 nt, Human
ucgggagggagggaggaggcaca

SEQ ID NO: 257182 - RNA, 18 nt, Human
ucucuggcacaaggagcc

SEQ ID NO: 257183 - RNA, 18 nt, Human
ucuggcacaaggagccag

SEQ ID NO: 257184 - RNA, 21 nt, Human
ugaagcccaaaggagcuggag

SEQ ID NO: 257185 - RNA, 20 nt, Human
ugagggcggggcagacaggg

SEQ ID NO: 257186 - RNA, 21 nt, Human
ugagggcggggcagacagggu

SEQ ID NO: 257187 - RNA, 22 nt, Human
ugagggcggggcagacagggug

SEQ ID NO: 257188 - RNA, 21 nt, Human
ugccaaaaacaaaacaaaaca

SEQ ID NO: 257189 - RNA, 22 nt, Human
ugccaaaaacaaaacaaaacaa

SEQ ID NO: 257190 - RNA, 23 nt, Human
ugccaaaaacaaaacaaaacaaa

SEQ ID NO: 257191 - RNA, 26 nt, Human
ugccccagucggggaaacagaaacaa

SEQ ID NO: 257192 - RNA, 21 nt, Human
ugcugcuucccuggggagagg

SEQ ID NO: 257193 - RNA, 20 nt, Human
ugcuuugggaaggaaaagag

SEQ ID NO: 257194 - RNA, 21 nt, Human
uggagcucagaccccugaggc

SEQ ID NO: 257195 - RNA, 23 nt, Human
uggcagcugaagcccaaaggagc

SEQ ID NO: 257196 - RNA, 19 nt, Human
uggccuggggcugccccug

SEQ ID NO: 257197 - RNA, 21 nt, Human
ugggaaggaggggaccagggg

SEQ ID NO: 257198 - RNA, 24 nt, Human
ugggagcugggggcugcugccggg

SEQ ID NO: 257199 - RNA, 21 nt, Human
ugggcaaagagagccuggcag

SEQ ID NO: 257200 - RNA, 18 nt, Human
ugggccucugccccucug

SEQ ID NO: 257201 - RNA, 25 nt, Human
uggggagaggggcccuggcagacuc

SEQ ID NO: 257202 - RNA, 18 nt, Human
uggggauccuggguggca

SEQ ID NO: 257203 - RNA, 22 nt, Human
ugggggcacagggagcuggagg

SEQ ID NO: 257204 - RNA, 18 nt, Human
ugggggcggagggagccc

SEQ ID NO: 257205 - RNA, 19 nt, Human
uggggguggacacggaacc

SEQ ID NO: 257206 - RNA, 18 nt, Human
uggguggcagacuccacu

SEQ ID NO: 257207 - RNA, 24 nt, Human
ugugagggcugagaggggccccua

SEQ ID NO: 257208 - RNA, 19 nt, Human
uuccagguccccuuuggcc

SEQ ID NO: 257209 - RNA, 21 nt, Human
uucccuggggagaggggcccu

SEQ ID NO: 257210 - RNA, 21 nt, Human
uuucccacagcagccacggcc

SEQ ID NO: 257211 - RNA, 19 nt, Human
uuuuuuuuuuuuuugccgg

SEQ ID NO: 257212 - RNA, 18 nt, Human
uuuuuuuuuuuuuuuuug

SEQ ID NO: 257213 - RNA, 23 nt, Human
uuuuuuuuuuuuuuuuugccggc

SEQ ID NO: 257214 - RNA, 24 nt, Human
uuuuuuuuuuuuuuuuuuugccgg

SEQ ID NO: 257215 - RNA, 23 nt, Human
aaacuccugcaaaagaaagaaag

SEQ ID NO: 257216 - RNA, 20 nt, Human
aagaacagcagauacugugc

SEQ ID NO: 257217 - RNA, 20 nt, Human
aagacaaaggacugaagaac

SEQ ID NO: 257218 - RNA, 22 nt, Human
aaugacaaagaaagacaaagga

SEQ ID NO: 257219 - RNA, 24 nt, Human
acaaacuccugcaaaagaaagaaa

SEQ ID NO: 257220 - RNA, 23 nt, Human
acugaaugacaaagaaagacaaa

SEQ ID NO: 257221 - RNA, 19 nt, Human
caaacuccugcaaaagaaa

SEQ ID NO: 257222 - RNA, 20 nt, Human
cagcauaacagcucuugucu

SEQ ID NO: 257223 - RNA, 19 nt, Human
caggaccagcaacccucug

SEQ ID NO: 257224 - RNA, 23 nt, Human
caucauggaagcuuccccaugag

SEQ ID NO: 257225 - RNA, 21 nt, Human
ccccaugaguguauuuccacu

SEQ ID NO: 257226 - RNA, 18 nt, Human
cccucucccucccucccu

SEQ ID NO: 257227 - RNA, 22 nt, Human
cccuuuguuuuaaagccaaaaa

SEQ ID NO: 257228 - RNA, 22 nt, Human
cguccugcauguguauuccaaa

SEQ ID NO: 257229 - RNA, 23 nt, Human
cuagaacugaaugacaaagaaag

SEQ ID NO: 257230 - RNA, 18 nt, Human
cucccaccugacaaaaug

SEQ ID NO: 257231 - RNA, 19 nt, Human
cuccugcaaaagaaagaaa

SEQ ID NO: 257232 - RNA, 21 nt, Human
cuccugcaaaagaaagaaaga

SEQ ID NO: 257233 - RNA, 23 nt, Human
cugaagaacagcagauacugugc

SEQ ID NO: 257234 - RNA, 22 nt, Human
cugaaugacaaagaaagacaaa

SEQ ID NO: 257235 - RNA, 24 nt, Human
cugcauguguauuccaaaucuccc

SEQ ID NO: 257236 - RNA, 20 nt, Human
cuuuuuuuuucucccccccc

SEQ ID NO: 257237 - RNA, 18 nt, Human
gagcuccccuucguuuuc

SEQ ID NO: 257238 - RNA, 20 nt, Human
gauuugcuuuuuuuuucucc

SEQ ID NO: 257239 - RNA, 22 nt, Human
gcaaaagaaagaaagaagaaaa

SEQ ID NO: 257240 - RNA, 24 nt, Human
gcagaggaaaggccuagaacugaa

SEQ ID NO: 257241 - RNA, 22 nt, Human
gcuuuuuuuuucuccccccaga

SEQ ID NO: 257242 - RNA, 19 nt, Human
gggucuucacacuuuccug

SEQ ID NO: 257243 - RNA, 18 nt, Human
guaggagacuauccaaag

SEQ ID NO: 257244 - RNA, 21 nt, Human
uaaagccaaaaaagaaaaaaa

SEQ ID NO: 257245 - RNA, 22 nt, Human
uaaagccaaaaaagaaaaaaag

SEQ ID NO: 257246 - RNA, 18 nt, Human
uaacagcucuugucuuga

SEQ ID NO: 257247 - RNA, 20 nt, Human
uaagaaagaaucuuuucuuc

SEQ ID NO: 257248 - RNA, 24 nt, Human
ucaauggauggacgagcuccccuu

SEQ ID NO: 257249 - RNA, 24 nt, Human
ucccucucccucccucccuaguuu

SEQ ID NO: 257250 - RNA, 22 nt, Human
ucuucuuuuucuccucuucucc

SEQ ID NO: 257251 - RNA, 23 nt, Human
ucuuuucuucuuuuucuccucuu

SEQ ID NO: 257252 - RNA, 19 nt, Human
ugaagaacagcagauacug

SEQ ID NO: 257253 - RNA, 22 nt, Human
ugaguguauuuccacucaugug

SEQ ID NO: 257254 - RNA, 23 nt, Human
ugauuugcuuuuuuuuucucccc

SEQ ID NO: 257255 - RNA, 22 nt, Human
uguuuuguuguuuucaauguag

SEQ ID NO: 257256 - RNA, 22 nt, Human
uuaaagacaaacauuuaguagu

SEQ ID NO: 257257 - RNA, 23 nt, Human
uuaguuaauccugaaauuuuacu

SEQ ID NO: 257258 - RNA, 25 nt, Human
uucagaaggaaaauaacauuagaaa

SEQ ID NO: 257259 - RNA, 24 nt, Human
uuccacucaugugcaggaccagca

SEQ ID NO: 257260 - RNA, 21 nt, Human
uuccccaugaguguauuucca

SEQ ID NO: 257261 - RNA, 18 nt, Human
uucuucuuuuucuccucu

SEQ ID NO: 257262 - RNA, 18 nt, Human
uucuucuuuuucuccucu

SEQ ID NO: 257263 - RNA, 22 nt, Human
uugcagauugaucccucgguau

SEQ ID NO: 257264 - RNA, 18 nt, Human
uugcuuuuuuuuucuccc

SEQ ID NO: 257265 - RNA, 23 nt, Human
uuguggguuuuuuguuuaaacuc

SEQ ID NO: 257266 - RNA, 21 nt, Human
uuuucuucuuuuucuccucuu

SEQ ID NO: 257267 - RNA, 21 nt, Human
uuuuguuguuuucaauguaga

SEQ ID NO: 257268 - RNA, 18 nt, Human
aaaaagacagaggucaag

SEQ ID NO: 257269 - RNA, 25 nt, Human
aaaauucccccagcuauguucacua

SEQ ID NO: 257270 - RNA, 25 nt, Human
aaaauucccccagcuauguucacua

SEQ ID NO: 257271 - RNA, 23 nt, Human
aaacuacccccacccccaccucc

SEQ ID NO: 257272 - RNA, 23 nt, Human
aaacuacccccacccccaccucc

SEQ ID NO: 257273 - RNA, 24 nt, Human
aaacuacccccacccccaccuccg

SEQ ID NO: 257274 - RNA, 24 nt, Human
aaacuacccccacccccaccuccg

SEQ ID NO: 257275 - RNA, 18 nt, Human
aaagugcuaggauuauag

SEQ ID NO: 257276 - RNA, 18 nt, Human
aaagugcuaggauuauag

SEQ ID NO: 257277 - RNA, 22 nt, Human
aacaaaacaaaagcccugcaga

SEQ ID NO: 257278 - RNA, 19 nt, Human
aacaagucaccucuguccu

SEQ ID NO: 257279 - RNA, 23 nt, Human
aacaggacccaggcaucucccuc

SEQ ID NO: 257280 - RNA, 23 nt, Human
aacaggacccaggcaucucccuc

SEQ ID NO: 257281 - RNA, 23 nt, Human
aacaggacccaggcaucucccuc

SEQ ID NO: 257282 - RNA, 23 nt, Human
aacaggacccaggcaucucccuc

SEQ ID NO: 257283 - RNA, 25 nt, Human
aacccuugauugguuugggguagcu

SEQ ID NO: 257284 - RNA, 25 nt, Human
aacccuugauugguuugggguagcu

SEQ ID NO: 257285 - RNA, 24 nt, Human
aaccucacccuccccuccaagugg

SEQ ID NO: 257286 - RNA, 25 nt, Human
aacucuucccccucugacucuccug

SEQ ID NO: 257287 - RNA, 25 nt, Human
aacucuucccccucugacucuccug

SEQ ID NO: 257288 - RNA, 23 nt, Human
aagagaaaauuaaaggcagacaa

SEQ ID NO: 257289 - RNA, 23 nt, Human
aagauaccccaaccuccaggccc

SEQ ID NO: 257290 - RNA, 23 nt, Human
aagauaccccaaccuccaggccc

SEQ ID NO: 257291 - RNA, 19 nt, Human
aagauugugucugugggug

SEQ ID NO: 257292 - RNA, 19 nt, Human
aagauugugucugugggug

SEQ ID NO: 257293 - RNA, 19 nt, Human
aagauugugucugugggug

SEQ ID NO: 257294 - RNA, 19 nt, Human
aaggagccuggucuucagg

SEQ ID NO: 257295 - RNA, 19 nt, Human
aaggagccuggucuucagg

SEQ ID NO: 257296 - RNA, 22 nt, Human
aaggagccuggucuucagggcu

SEQ ID NO: 257297 - RNA, 22 nt, Human
aaggagccuggucuucagggcu

SEQ ID NO: 257298 - RNA, 22 nt, Human
aagucaccucuguccucaggug

SEQ ID NO: 257299 - RNA, 18 nt, Human
aagugccugccuaagcca

SEQ ID NO: 257300 - RNA, 18 nt, Human
aagugcuaggauuauagc

SEQ ID NO: 257301 - RNA, 18 nt, Human
aagugcuaggauuauagc

SEQ ID NO: 257302 - RNA, 19 nt, Human
aagugguggcuggaguucg

SEQ ID NO: 257303 - RNA, 21 nt, Human
aauuuccuccuuaaccagaac

SEQ ID NO: 257304 - RNA, 21 nt, Human
aauuuccuccuuaaccagaac

SEQ ID NO: 257305 - RNA, 25 nt, Human
acacauagucccccuugaaagcaua

SEQ ID NO: 257306 - RNA, 19 nt, Human
acacugcccagcucuggga

SEQ ID NO: 257307 - RNA, 19 nt, Human
acacugcccagcucuggga

SEQ ID NO: 257308 - RNA, 23 nt, Human
acagggcagugccugccucagga

SEQ ID NO: 257309 - RNA, 23 nt, Human
acagggcagugccugccucagga

SEQ ID NO: 257310 - RNA, 20 nt, Human
acagugggcagcucugucuc

SEQ ID NO: 257311 - RNA, 20 nt, Human
acagugggcagcucugucuc

SEQ ID NO: 257312 - RNA, 22 nt, Human
accauugaccuccagagaagag

SEQ ID NO: 257313 - RNA, 20 nt, Human
acccccacccccaccuccgc

SEQ ID NO: 257314 - RNA, 20 nt, Human
acccccacccccaccuccgc

SEQ ID NO: 257315 - RNA, 21 nt, Human
acccccaccuccgccuccuac

SEQ ID NO: 257316 - RNA, 21 nt, Human
acccccaccuccgccuccuac

SEQ ID NO: 257317 - RNA, 18 nt, Human
acccugccuauuauaaac

SEQ ID NO: 257318 - RNA, 18 nt, Human
acccugccuauuauaaac

SEQ ID NO: 257319 - RNA, 20 nt, Human
accuauucagaaacuucuca

SEQ ID NO: 257320 - RNA, 20 nt, Human
accuccagagaagagaugac

SEQ ID NO: 257321 - RNA, 20 nt, Human
accuccagagaagagaugac

SEQ ID NO: 257322 - RNA, 18 nt, Human
accuccgccuccuaccuc

SEQ ID NO: 257323 - RNA, 18 nt, Human
accuccgccuccuaccuc

SEQ ID NO: 257324 - RNA, 21 nt, Human
accuccgccuccuaccucagc

SEQ ID NO: 257325 - RNA, 21 nt, Human
accuccgccuccuaccucagc

SEQ ID NO: 257326 - RNA, 24 nt, Human
accuccgccuccuaccucagcugg

SEQ ID NO: 257327 - RNA, 24 nt, Human
accucuguccucaggugauagcuu

SEQ ID NO: 257328 - RNA, 24 nt, Human
accuuuaauuuggcuccgaacucu

SEQ ID NO: 257329 - RNA, 19 nt, Human
accuuuuugaugggaagaa

SEQ ID NO: 257330 - RNA, 19 nt, Human
accuuuuugaugggaagaa

SEQ ID NO: 257331 - RNA, 23 nt, Human
acucccguaaacaaacccuugau

SEQ ID NO: 257332 - RNA, 25 nt, Human
acucucccuggacaaaggcaaaggu

SEQ ID NO: 257333 - RNA, 19 nt, Human
agacagcuagaggaagagc

SEQ ID NO: 257334 - RNA, 20 nt, Human
agacagcuagaggaagagcu

SEQ ID NO: 257335 - RNA, 20 nt, Human
agacaggaaauggaguuggg

SEQ ID NO: 257336 - RNA, 20 nt, Human
agacaggaaauggaguuggg

SEQ ID NO: 257337 - RNA, 24 nt, Human
agacaggaaauggaguugggggcc

SEQ ID NO: 257338 - RNA, 24 nt, Human
agacaggaaauggaguugggggcc

SEQ ID NO: 257339 - RNA, 24 nt, Human
agacaggaaauggaguugggggcc

SEQ ID NO: 257340 - RNA, 24 nt, Human
agacaggaaauggaguugggggcc

SEQ ID NO: 257341 - RNA, 26 nt, Human
agacaggaaauggaguuggggggacc

SEQ ID NO: 257342 - RNA, 26 nt, Human
agacaggaaauggaguuggggggacc

SEQ ID NO: 257343 - RNA, 27 nt, Human
agacaggaaauggaguuggggggaccc

SEQ ID NO: 257344 - RNA, 27 nt, Human
agacaggaaauggaguuggggggaccc

SEQ ID NO: 257345 - RNA, 23 nt, Human
agacagggucucccuauguugcc

SEQ ID NO: 257346 - RNA, 23 nt, Human
agacagggucucccuauguugcc

SEQ ID NO: 257347 - RNA, 19 nt, Human
agaggcuguccgugccucu

SEQ ID NO: 257348 - RNA, 19 nt, Human
agaggcuguccgugccucu

SEQ ID NO: 257349 - RNA, 22 nt, Human
agcaaggcuacaaugggaggga

SEQ ID NO: 257350 - RNA, 22 nt, Human
agcaaggcuacaaugggaggga

SEQ ID NO: 257351 - RNA, 24 nt, Human
agcugaccugagacucagagccuc

SEQ ID NO: 257352 - RNA, 18 nt, Human
agcuggucuugaacuccu

SEQ ID NO: 257353 - RNA, 18 nt, Human
agcuggucuugaacuccu

SEQ ID NO: 257354 - RNA, 24 nt, Human
agcuggucuugaacuccugggcuc

SEQ ID NO: 257355 - RNA, 24 nt, Human
agcuggucuugaacuccugggcuc

SEQ ID NO: 257356 - RNA, 24 nt, Human
aggaucagcaggcugcccccaccg

SEQ ID NO: 257357 - RNA, 23 nt, Human
aggcaucucccuccaccauugac

SEQ ID NO: 257358 - RNA, 23 nt, Human
aggcauuugauaccuuuuugaug

SEQ ID NO: 257359 - RNA, 23 nt, Human
aggcauuugauaccuuuuugaug

SEQ ID NO: 257360 - RNA, 21 nt, Human
aggcugcccccaccgccugcc

SEQ ID NO: 257361 - RNA, 19 nt, Human
aggcuucuggggggaaaug

SEQ ID NO: 257362 - RNA, 20 nt, Human
aggcuucugggggggaaaug

SEQ ID NO: 257363 - RNA, 20 nt, Human
aggcuucugggggggaaaug

SEQ ID NO: 257364 - RNA, 24 nt, Human
agggaguccagccucugcuguugc

SEQ ID NO: 257365 - RNA, 24 nt, Human
agggugggugguggagccucaggg

SEQ ID NO: 257366 - RNA, 20 nt, Human
auaucccuccccugggcagc

SEQ ID NO: 257367 - RNA, 20 nt, Human
auaucccuccccugggcagc

SEQ ID NO: 257368 - RNA, 22 nt, Human
augaugcgcagguucaccccac

SEQ ID NO: 257369 - RNA, 22 nt, Human
augaugcgcagguucaccccac

SEQ ID NO: 257370 - RNA, 22 nt, Human
augcacaggaaagugguggcug

SEQ ID NO: 257371 - RNA, 22 nt, Human
augcacaggaaagugguggcug

SEQ ID NO: 257372 - RNA, 22 nt, Human
augcacaggaaagugguggcug

SEQ ID NO: 257373 - RNA, 22 nt, Human
augcacaggaaagugguggcug

SEQ ID NO: 257374 - RNA, 18 nt, Human
augcuuuguugcucagag

SEQ ID NO: 257375 - RNA, 19 nt, Human
augucacaugucuccuucc

SEQ ID NO: 257376 - RNA, 21 nt, Human
auuugauaccuuuuugauggg

SEQ ID NO: 257377 - RNA, 21 nt, Human
auuugauaccuuuuugauggg

SEQ ID NO: 257378 - RNA, 23 nt, Human
auuuggcuccgaacucucccucc

SEQ ID NO: 257379 - RNA, 21 nt, Human
caaagggcagacacucggaac

SEQ ID NO: 257380 - RNA, 21 nt, Human
caaaggugaacaggaaggagg

SEQ ID NO: 257381 - RNA, 21 nt, Human
caaaggugaacaggaaggagg

SEQ ID NO: 257382 - RNA, 24 nt, Human
caaaggugaacaggaaggagguca

SEQ ID NO: 257383 - RNA, 24 nt, Human
caaaggugaacaggaaggagguca

SEQ ID NO: 257384 - RNA, 18 nt, Human
caaagugcuaggauuaua

SEQ ID NO: 257385 - RNA, 18 nt, Human
caaagugcuaggauuaua

SEQ ID NO: 257386 - RNA, 23 nt, Human
caacaagucaaaaagacagaggu

SEQ ID NO: 257387 - RNA, 22 nt, Human
caagugauccuccugcuucagc

SEQ ID NO: 257388 - RNA, 22 nt, Human
caagugauccuccugcuucagc

SEQ ID NO: 257389 - RNA, 27 nt, Human
caagugauccuccugcuucagccuccc

SEQ ID NO: 257390 - RNA, 27 nt, Human
caagugauccuccugcuucagccuccc

SEQ ID NO: 257391 - RNA, 18 nt, Human
cacagggcagugccugcc

SEQ ID NO: 257392 - RNA, 18 nt, Human
cacagggcagugccugcc

SEQ ID NO: 257393 - RNA, 19 nt, Human
cacaguuggaagggcuguc

SEQ ID NO: 257394 - RNA, 19 nt, Human
cacaguuggaagggcuguc

SEQ ID NO: 257395 - RNA, 19 nt, Human
cacaguuggaagggcuguc

SEQ ID NO: 257396 - RNA, 19 nt, Human
cacaguuggaagggcuguc

SEQ ID NO: 257397 - RNA, 23 nt, Human
cacccucucuaacaggcaaucug

SEQ ID NO: 257398 - RNA, 19 nt, Human
caccgccugccaacagccu

SEQ ID NO: 257399 - RNA, 21 nt, Human
caccgccugccaacagccugg

SEQ ID NO: 257400 - RNA, 18 nt, Human
caccguggguggcacuaa

SEQ ID NO: 257401 - RNA, 18 nt, Human
caccguggguggcacuaa

SEQ ID NO: 257402 - RNA, 22 nt, Human
caccuccgccuccuaccucagc

SEQ ID NO: 257403 - RNA, 22 nt, Human
caccuccgccuccuaccucagc

SEQ ID NO: 257404 - RNA, 25 nt, Human
caccuccgccuccuaccucagcugg

SEQ ID NO: 257405 - RNA, 28 nt, Human
caccuccgccuccuaccucagcugggag

SEQ ID NO: 257406 - RNA, 28 nt, Human
caccuccgccuccuaccucagcugggag

SEQ ID NO: 257407 - RNA, 23 nt, Human
cagagaagagaugacacaguugg

SEQ ID NO: 257408 - RNA, 23 nt, Human
cagagaagagaugacacaguugg

SEQ ID NO: 257409 - RNA, 23 nt, Human
cagagaagagaugacacaguugg

SEQ ID NO: 257410 - RNA, 23 nt, Human
cagagaagagaugacacaguugg

SEQ ID NO: 257411 - RNA, 22 nt, Human
cagagacagggucucccuaugu

SEQ ID NO: 257412 - RNA, 22 nt, Human
cagagacagggucucccuaugu

SEQ ID NO: 257413 - RNA, 25 nt, Human
cagcagcauccagguuuccggggag

SEQ ID NO: 257414 - RNA, 22 nt, Human
cagcaggcugcccccaccgccu

SEQ ID NO: 257415 - RNA, 18 nt, Human
cagcauccagguuuccgg

SEQ ID NO: 257416 - RNA, 21 nt, Human
caggacccggccugagacugu

SEQ ID NO: 257417 - RNA, 21 nt, Human
caggaucagccuggaggggag

SEQ ID NO: 257418 - RNA, 25 nt, Human
caggcaucucccuccaccauugacc

SEQ ID NO: 257419 - RNA, 25 nt, Human
caggcaucucccuccaccauugacc

SEQ ID NO: 257420 - RNA, 25 nt, Human
caggcaucucccuccaccauugacc

SEQ ID NO: 257421 - RNA, 22 nt, Human
cagguaguccacgggcgccacc

SEQ ID NO: 257422 - RNA, 21 nt, Human
cagugggcagcucugucucuu

SEQ ID NO: 257423 - RNA, 21 nt, Human
cagugggcagcucugucucuu

SEQ ID NO: 257424 - RNA, 23 nt, Human
cagugggcagcucugucucuucu

SEQ ID NO: 257425 - RNA, 23 nt, Human
cagugggcagcucugucucuucu

SEQ ID NO: 257426 - RNA, 22 nt, Human
caucacugucccuuaccuuccc

SEQ ID NO: 257427 - RNA, 22 nt, Human
caucacugucccuuaccuuccc

SEQ ID NO: 257428 - RNA, 18 nt, Human
ccaaagugcuaggauuau

SEQ ID NO: 257429 - RNA, 18 nt, Human
ccaaagugcuaggauuau

SEQ ID NO: 257430 - RNA, 24 nt, Human
ccaagcuggucuugaacuccuggg

SEQ ID NO: 257431 - RNA, 24 nt, Human
ccaagcuggucuugaacuccuggg

SEQ ID NO: 257432 - RNA, 21 nt, Human
ccaccgccugccaacagccug

SEQ ID NO: 257433 - RNA, 21 nt, Human
ccacucccugcucucugaccc

SEQ ID NO: 257434 - RNA, 21 nt, Human
ccacucccugcucucugaccc

SEQ ID NO: 257435 - RNA, 23 nt, Human
ccagaggcuguccgugccucuga

SEQ ID NO: 257436 - RNA, 23 nt, Human
ccagaggcuguccgugccucuga

SEQ ID NO: 257437 - RNA, 18 nt, Human
ccagccacagcugcuggc

SEQ ID NO: 257438 - RNA, 19 nt, Human
ccaggcaucucccuccacc

SEQ ID NO: 257439 - RNA, 19 nt, Human
ccaggcaucucccuccacc

SEQ ID NO: 257440 - RNA, 19 nt, Human
ccaggcaucucccuccacc

SEQ ID NO: 257441 - RNA, 19 nt, Human
ccaggcaucucccuccacc

SEQ ID NO: 257442 - RNA, 21 nt, Human
ccaugucacaugucuccuucc

SEQ ID NO: 257443 - RNA, 22 nt, Human
ccauugcucaugcugaaguccc

SEQ ID NO: 257444 - RNA, 20 nt, Human
cccaaaggagccuggucuuc

SEQ ID NO: 257445 - RNA, 20 nt, Human
cccaaaggagccuggucuuc

SEQ ID NO: 257446 - RNA, 22 nt, Human
cccaagccccagagcauggccc

SEQ ID NO: 257447 - RNA, 24 nt, Human
cccaccagacgagagcuccagagg

SEQ ID NO: 257448 - RNA, 24 nt, Human
cccaccagacgagagcuccagagg

SEQ ID NO: 257449 - RNA, 21 nt, Human
cccacugccaguacccggagc

SEQ ID NO: 257450 - RNA, 19 nt, Human
cccagccacagcugcuggc

SEQ ID NO: 257451 - RNA, 25 nt, Human
ccccaaaagcuggcuucuugcuccu

SEQ ID NO: 257452 - RNA, 25 nt, Human
ccccaaaagcuggcuucuugcuccu

SEQ ID NO: 257453 - RNA, 23 nt, Human
ccccaccgccugccaacagccug

SEQ ID NO: 257454 - RNA, 23 nt, Human
cccccacccccaccuccgccucc

SEQ ID NO: 257455 - RNA, 23 nt, Human
cccccacccccaccuccgccucc

SEQ ID NO: 257456 - RNA, 22 nt, Human
cccccaccuccgccuccuaccc

SEQ ID NO: 257457 - RNA, 22 nt, Human
cccccaccuccgccuccuaccc

SEQ ID NO: 257458 - RNA, 24 nt, Human
cccuccaaguggcuuccuaguugu

SEQ ID NO: 257459 - RNA, 22 nt, Human
cccuccaccauugaccuccaga

SEQ ID NO: 257460 - RNA, 22 nt, Human
cccuccaccauugaccuccaga

SEQ ID NO: 257461 - RNA, 22 nt, Human
cccuccaccauugaccuccaga

SEQ ID NO: 257462 - RNA, 23 nt, Human
ccgcaccucgucuugaaauagcc

SEQ ID NO: 257463 - RNA, 23 nt, Human
ccgcaccucgucuugaaauagcc

SEQ ID NO: 257464 - RNA, 22 nt, Human
ccggggacgacagugcauccag

SEQ ID NO: 257465 - RNA, 22 nt, Human
ccggggacgacagugcauccag

SEQ ID NO: 257466 - RNA, 22 nt, Human
ccuauguugcccaagcuggucu

SEQ ID NO: 257467 - RNA, 24 nt, Human
ccuauguugcccaagcuggucuug

SEQ ID NO: 257468 - RNA, 20 nt, Human
ccucaaccuggggaagacca

SEQ ID NO: 257469 - RNA, 20 nt, Human
ccucaaccuggggaagacca

SEQ ID NO: 257470 - RNA, 20 nt, Human
ccucaggaccugccuucccc

SEQ ID NO: 257471 - RNA, 20 nt, Human
ccucaggaccugccuucccc

SEQ ID NO: 257472 - RNA, 26 nt, Human
ccuccugcuucagccucccaaagugc

SEQ ID NO: 257473 - RNA, 26 nt, Human
ccuccugcuucagccucccaaagugc

SEQ ID NO: 257474 - RNA, 19 nt, Human
ccugccaacagccuggagg

SEQ ID NO: 257475 - RNA, 24 nt, Human
ccugcuucagccucccaaagugcu

SEQ ID NO: 257476 - RNA, 18 nt, Human
ccugggcucaagugaucc

SEQ ID NO: 257477 - RNA, 18 nt, Human
ccugggcucaagugaucc

SEQ ID NO: 257478 - RNA, 22 nt, Human
ccugggcucaagugauccuccu

SEQ ID NO: 257479 - RNA, 22 nt, Human
ccugggcucaagugauccuccu

SEQ ID NO: 257480 - RNA, 23 nt, Human
ccugggcucaagugauccuccug

SEQ ID NO: 257481 - RNA, 23 nt, Human
ccugggcucaagugauccuccug

SEQ ID NO: 257482 - RNA, 20 nt, Human
ccuggucuucagggcugcau

SEQ ID NO: 257483 - RNA, 20 nt, Human
ccuggucuucagggcugcau

SEQ ID NO: 257484 - RNA, 22 nt, Human
ccuuaucacuggacucuucuug

SEQ ID NO: 257485 - RNA, 22 nt, Human
ccuuaucacuggacucuucuug

SEQ ID NO: 257486 - RNA, 20 nt, Human
ccuuccaaccaggugcaccc

SEQ ID NO: 257487 - RNA, 18 nt, Human
ccuucccagccacucccu

SEQ ID NO: 257488 - RNA, 18 nt, Human
cgaggcgaguagacagca

SEQ ID NO: 257489 - RNA, 19 nt, Human
cggggcccugagcguaaug

SEQ ID NO: 257490 - RNA, 22 nt, Human
cgguccaccuauucagaaacuu

SEQ ID NO: 257491 - RNA, 18 nt, Human
cguagacuggggccauga

SEQ ID NO: 257492 - RNA, 18 nt, Human
cuaguuguccuuccaacc

SEQ ID NO: 257493 - RNA, 24 nt, Human
cucaagugauccuccugcuucagc

SEQ ID NO: 257494 - RNA, 24 nt, Human
cucaagugauccuccugcuucagc

SEQ ID NO: 257495 - RNA, 25 nt, Human
cucacccagcaucauggcauccagu

SEQ ID NO: 257496 - RNA, 25 nt, Human
cucacccagcaucauggcauccagu

SEQ ID NO: 257497 - RNA, 20 nt, Human
cucaggaccugccuucccca

SEQ ID NO: 257498 - RNA, 20 nt, Human
cucaggaccugccuucccca

SEQ ID NO: 257499 - RNA, 25 nt, Human
cucaggagugaaaaugcacaggaaa

SEQ ID NO: 257500 - RNA, 25 nt, Human
cucaggagugaaaaugcacaggaaa

SEQ ID NO: 257501 - RNA, 25 nt, Human
cucaggagugaaaaugcacaggaaa

SEQ ID NO: 257502 - RNA, 25 nt, Human
cucaggagugaaaaugcacaggaaa

SEQ ID NO: 257503 - RNA, 23 nt, Human
cucaggcugacuaacaauuugcc

SEQ ID NO: 257504 - RNA, 19 nt, Human
cuccagaggcuguccgugc

SEQ ID NO: 257505 - RNA, 20 nt, Human
cuccagaggcuguccgugcc

SEQ ID NO: 257506 - RNA, 23 nt, Human
cuccagaggcuguccgugccucu

SEQ ID NO: 257507 - RNA, 23 nt, Human
cuccagaggcuguccgugccucu

SEQ ID NO: 257508 - RNA, 21 nt, Human
cucccuccaccauugaccucc

SEQ ID NO: 257509 - RNA, 21 nt, Human
cucccuccaccauugaccucc

SEQ ID NO: 257510 - RNA, 21 nt, Human
cucccuccaccauugaccucc

SEQ ID NO: 257511 - RNA, 21 nt, Human
cucccuccaccauugaccucc

SEQ ID NO: 257512 - RNA, 22 nt, Human
cuccucaaccuggggaagacca

SEQ ID NO: 257513 - RNA, 23 nt, Human
cuccugggcucaagugauccucc

SEQ ID NO: 257514 - RNA, 25 nt, Human
cuccugggcucaagugauccuccug

SEQ ID NO: 257515 - RNA, 27 nt, Human
cucucccugcaggcugauucuucaaaa

SEQ ID NO: 257516 - RNA, 23 nt, Human
cugcuucagccucccaaagugcu

SEQ ID NO: 257517 - RNA, 24 nt, Human
cugcuucagccucccaaagugcua

SEQ ID NO: 257518 - RNA, 24 nt, Human
cugcuucagccucccaaagugcua

SEQ ID NO: 257519 - RNA, 19 nt, Human
cuggucuugaacuccuggg

SEQ ID NO: 257520 - RNA, 19 nt, Human
cuggucuugaacuccuggg

SEQ ID NO: 257521 - RNA, 24 nt, Human
cugucucuuggaugcuucuuucuc

SEQ ID NO: 257522 - RNA, 24 nt, Human
cugucucuuggaugcuucuuucuc

SEQ ID NO: 257523 - RNA, 22 nt, Human
cuuaaaguggggccgguagccc

SEQ ID NO: 257524 - RNA, 22 nt, Human
cuuaaaguggggccgguagccc

SEQ ID NO: 257525 - RNA, 20 nt, Human
cuugaacuccugggcucaag

SEQ ID NO: 257526 - RNA, 21 nt, Human
gaacaagucaccucuguccuc

SEQ ID NO: 257527 - RNA, 22 nt, Human
gaagugaauccauuguguucga

SEQ ID NO: 257528 - RNA, 22 nt, Human
gacaaaggcaaaggugaacagg

SEQ ID NO: 257529 - RNA, 22 nt, Human
gacaaaggcaaaggugaacagg

SEQ ID NO: 257530 - RNA, 18 nt, Human
gacccaggcaucucccuc

SEQ ID NO: 257531 - RNA, 18 nt, Human
gacccaggcaucucccuc

SEQ ID NO: 257532 - RNA, 18 nt, Human
gacccaggcaucucccuc

SEQ ID NO: 257533 - RNA, 18 nt, Human
gacccaggcaucucccuc

SEQ ID NO: 257534 - RNA, 22 nt, Human
gacccauucuaacucuuccccc

SEQ ID NO: 257535 - RNA, 22 nt, Human
gacccauucuaacucuuccccc

SEQ ID NO: 257536 - RNA, 20 nt, Human
gacccggccugagacuguca

SEQ ID NO: 257537 - RNA, 18 nt, Human
gcaaaggugaacaggaag

SEQ ID NO: 257538 - RNA, 20 nt, Human
gcagcucugucucuucuucu

SEQ ID NO: 257539 - RNA, 20 nt, Human
gcagcucugucucuucuucu

SEQ ID NO: 257540 - RNA, 23 nt, Human
gcccaagccccagagcauggccc

SEQ ID NO: 257541 - RNA, 18 nt, Human
gccucacccagcaucaug

SEQ ID NO: 257542 - RNA, 18 nt, Human
gccucacccagcaucaug

SEQ ID NO: 257543 - RNA, 19 nt, Human
gccuccuaccucagcuggg

SEQ ID NO: 257544 - RNA, 19 nt, Human
gccuccuaccucagcuggg

SEQ ID NO: 257545 - RNA, 20 nt, Human
gcuacagcaccugcaagguu

SEQ ID NO: 257546 - RNA, 21 nt, Human
gcuacagcaccugcaagguuc

SEQ ID NO: 257547 - RNA, 21 nt, Human
gcuacagcaccugcaagguuc

SEQ ID NO: 257548 - RNA, 19 nt, Human
gcucaagugauccuccugc

SEQ ID NO: 257549 - RNA, 21 nt, Human
gcuccagaggcuguccgugcc

SEQ ID NO: 257550 - RNA, 19 nt, Human
gcuucuugcuccaaggaga

SEQ ID NO: 257551 - RNA, 19 nt, Human
gcuucuugcuccaaggaga

SEQ ID NO: 257552 - RNA, 19 nt, Human
ggaagaacaggacccaggg

SEQ ID NO: 257553 - RNA, 19 nt, Human
ggaagaacaggacccaggg

SEQ ID NO: 257554 - RNA, 19 nt, Human
ggaagaacaggacccaggg

SEQ ID NO: 257555 - RNA, 19 nt, Human
ggaagaacaggacccaggg

SEQ ID NO: 257556 - RNA, 18 nt, Human
ggaagaccacagggcagu

SEQ ID NO: 257557 - RNA, 28 nt, Human
ggagccccucccaaagggcagacacuau

SEQ ID NO: 257558 - RNA, 20 nt, Human
ggaguccagccucugcuguu

SEQ ID NO: 257559 - RNA, 20 nt, Human
ggaguccagccucugcuguu

SEQ ID NO: 257560 - RNA, 22 nt, Human
ggaguccagccucugcuguugc

SEQ ID NO: 257561 - RNA, 18 nt, Human
ggcagcucugucucuucu

SEQ ID NO: 257562 - RNA, 18 nt, Human
ggcagcucugucucuucu

SEQ ID NO: 257563 - RNA, 27 nt, Human
ggcaugggacuggguucucccucuagg

SEQ ID NO: 257564 - RNA, 27 nt, Human
ggcaugggacuggguucucccucuagg

SEQ ID NO: 257565 - RNA, 20 nt, Human
gggaagaccacagggcagug

SEQ ID NO: 257566 - RNA, 19 nt, Human
gggaagccaggagacaucu

SEQ ID NO: 257567 - RNA, 19 nt, Human
gggaagccaggagacaucu

SEQ ID NO: 257568 - RNA, 20 nt, Human
gggagcagugcuaggcagag

SEQ ID NO: 257569 - RNA, 20 nt, Human
gggaggggccucacccagca

SEQ ID NO: 257570 - RNA, 20 nt, Human
gggaggggccucacccagca

SEQ ID NO: 257571 - RNA, 22 nt, Human
gggcagcucugucucuucuucu

SEQ ID NO: 257572 - RNA, 22 nt, Human
gggcagcucugucucuucuucu

SEQ ID NO: 257573 - RNA, 22 nt, Human
gggcgccaccucugcaagcccc

SEQ ID NO: 257574 - RNA, 19 nt, Human
gggcucaagugauccuccu

SEQ ID NO: 257575 - RNA, 19 nt, Human
gggcucaagugauccuccu

SEQ ID NO: 257576 - RNA, 21 nt, Human
gggcucaagugauccuccugc

SEQ ID NO: 257577 - RNA, 19 nt, Human
ggggaucugaguuagggga

SEQ ID NO: 257578 - RNA, 19 nt, Human
ggggaucugaguuagggga

SEQ ID NO: 257579 - RNA, 19 nt, Human
ggggaucugaguuagggga

SEQ ID NO: 257580 - RNA, 19 nt, Human
ggggaucugaguuagggga

SEQ ID NO: 257581 - RNA, 23 nt, Human
gggggggaaaugaaagggugggu

SEQ ID NO: 257582 - RNA, 23 nt, Human
gggggggaaaugaaagggugggu

SEQ ID NO: 257583 - RNA, 21 nt, Human
ggggguaucucaggcugacua

SEQ ID NO: 257584 - RNA, 19 nt, Human
ggguagcugcugaagucag

SEQ ID NO: 257585 - RNA, 19 nt, Human
ggguagcugcugaagucag

SEQ ID NO: 257586 - RNA, 21 nt, Human
ggguggcacuaauuuccuccu

SEQ ID NO: 257587 - RNA, 21 nt, Human
ggguggcacuaauuuccuccu

SEQ ID NO: 257588 - RNA, 22 nt, Human
ggugggugguggagccucaggg

SEQ ID NO: 257589 - RNA, 22 nt, Human
ggugggugguggagccucaggg

SEQ ID NO: 257590 - RNA, 22 nt, Human
ggugggugguggagccucaggg

SEQ ID NO: 257591 - RNA, 21 nt, Human
guaaucauaagcacauaaaug

SEQ ID NO: 257592 - RNA, 21 nt, Human
guaaucauaagcacauaaaug

SEQ ID NO: 257593 - RNA, 21 nt, Human
guaaucauaagcacauaaaug

SEQ ID NO: 257594 - RNA, 21 nt, Human
guaaucauaagcacauaaaug

SEQ ID NO: 257595 - RNA, 22 nt, Human
gucccaugucacucccauuugu

SEQ ID NO: 257596 - RNA, 24 nt, Human
gugauccuccugcuucagccuccc

SEQ ID NO: 257597 - RNA, 24 nt, Human
gugauccuccugcuucagccuccc

SEQ ID NO: 257598 - RNA, 18 nt, Human
gugccugccucaggaccu

SEQ ID NO: 257599 - RNA, 18 nt, Human
gugccugccucaggaccu

SEQ ID NO: 257600 - RNA, 24 nt, Human
guuugggguagcugcugaagucag

SEQ ID NO: 257601 - RNA, 22 nt, Human
uaaaauucccccagcuauguuc

SEQ ID NO: 257602 - RNA, 22 nt, Human
uaaaauucccccagcuauguuc

SEQ ID NO: 257603 - RNA, 18 nt, Human
uaaacuacccccaccccc

SEQ ID NO: 257604 - RNA, 18 nt, Human
uaaacuacccccaccccc

SEQ ID NO: 257605 - RNA, 24 nt, Human
uaaacuacccccacccccaccucc

SEQ ID NO: 257606 - RNA, 24 nt, Human
uaaacuacccccacccccaccucc

SEQ ID NO: 257607 - RNA, 21 nt, Human
uaaaugugauucucaaggauu

SEQ ID NO: 257608 - RNA, 21 nt, Human
uaaaugugauucucaaggauu

SEQ ID NO: 257609 - RNA, 21 nt, Human
uaaaugugauucucaaggauu

SEQ ID NO: 257610 - RNA, 21 nt, Human
uaaaugugauucucaaggauu

SEQ ID NO: 257611 - RNA, 24 nt, Human
uaacucuucccccucugacucucc

SEQ ID NO: 257612 - RNA, 24 nt, Human
uaacucuucccccucugacucucc

SEQ ID NO: 257613 - RNA, 22 nt, Human
uaagacacuguaacuagccucc

SEQ ID NO: 257614 - RNA, 19 nt, Human
uaccuucccagccacuccc

SEQ ID NO: 257615 - RNA, 19 nt, Human
uaccuucccagccacuccc

SEQ ID NO: 257616 - RNA, 22 nt, Human
uagacagaaacuuggggguauc

SEQ ID NO: 257617 - RNA, 21 nt, Human
uagacugggccaugagggccg

SEQ ID NO: 257618 - RNA, 23 nt, Human
uagccaccgcaccucgucuugaa

SEQ ID NO: 257619 - RNA, 23 nt, Human
uagccaccgcaccucgucuugaa

SEQ ID NO: 257620 - RNA, 21 nt, Human
uagcgccacaccuugucuccc

SEQ ID NO: 257621 - RNA, 21 nt, Human
uagcgccacaccuugucuccu

SEQ ID NO: 257622 - RNA, 23 nt, Human
uaggaaccucacccuccccucca

SEQ ID NO: 257623 - RNA, 21 nt, Human
uaggaugcaagugccuucucu

SEQ ID NO: 257624 - RNA, 21 nt, Human
uaggaugcaagugccuucucu

SEQ ID NO: 257625 - RNA, 21 nt, Human
uauaguuuucuccaucuugcu

SEQ ID NO: 257626 - RNA, 23 nt, Human
uauguugcccaagcuggucuuga

SEQ ID NO: 257627 - RNA, 23 nt, Human
uauguugcccaagcuggucuuga

SEQ ID NO: 257628 - RNA, 24 nt, Human
uauguugcccaagcuggucuugaa

SEQ ID NO: 257629 - RNA, 24 nt, Human
uauguugcccaagcuggucuugaa

SEQ ID NO: 257630 - RNA, 22 nt, Human
uauuagauccuucuagaggcuu

SEQ ID NO: 257631 - RNA, 23 nt, Human
ucagagccucggugauaucuucu

SEQ ID NO: 257632 - RNA, 23 nt, Human
uccaaccaggugcacccucucua

SEQ ID NO: 257633 - RNA, 24 nt, Human
uccaagauaccccaaccuccaggc

SEQ ID NO: 257634 - RNA, 25 nt, Human
uccaagauaccccaaccuccaggcc

SEQ ID NO: 257635 - RNA, 19 nt, Human
uccaaggagagagcauuga

SEQ ID NO: 257636 - RNA, 19 nt, Human
uccaaggagagagcauuga

SEQ ID NO: 257637 - RNA, 18 nt, Human
ucccaaagggcagacacu

SEQ ID NO: 257638 - RNA, 23 nt, Human
ucccaaagugcuaggauuauagc

SEQ ID NO: 257639 - RNA, 23 nt, Human
ucccaaagugcuaggauuauagc

SEQ ID NO: 257640 - RNA, 23 nt, Human
uccccuaaagaucuaauagagau

SEQ ID NO: 257641 - RNA, 19 nt, Human
ucccuccaccauugaccuc

SEQ ID NO: 257642 - RNA, 19 nt, Human
ucccuccaccauugaccuc

SEQ ID NO: 257643 - RNA, 19 nt, Human
ucccuccaccauugaccuc

SEQ ID NO: 257644 - RNA, 19 nt, Human
ucccuccaccauugaccuc

SEQ ID NO: 257645 - RNA, 20 nt, Human
ucccuccaccauugaccucc

SEQ ID NO: 257646 - RNA, 20 nt, Human
ucccuccaccauugaccucc

SEQ ID NO: 257647 - RNA, 20 nt, Human
ucccuccaccauugaccucc

SEQ ID NO: 257648 - RNA, 20 nt, Human
ucccuccaccauugaccucc

SEQ ID NO: 257649 - RNA, 18 nt, Human
ucccuggacaaaggcaaa

SEQ ID NO: 257650 - RNA, 18 nt, Human
ucccuggacaaaggcaaa

SEQ ID NO: 257651 - RNA, 18 nt, Human
ucccuuaccuucccagcc

SEQ ID NO: 257652 - RNA, 21 nt, Human
ucccuuaccuucccagccacu

SEQ ID NO: 257653 - RNA, 21 nt, Human
ucccuuaccuucccagccacu

SEQ ID NO: 257654 - RNA, 21 nt, Human
uccucaaccuggggaagacca

SEQ ID NO: 257655 - RNA, 20 nt, Human
uccucaaguaagacacugua

SEQ ID NO: 257656 - RNA, 18 nt, Human
uccucucuggcccauacc

SEQ ID NO: 257657 - RNA, 18 nt, Human
uccucucuggcccauacc

SEQ ID NO: 257658 - RNA, 21 nt, Human
uccugggcucaagugauccuc

SEQ ID NO: 257659 - RNA, 21 nt, Human
uccugggcucaagugauccuc

SEQ ID NO: 257660 - RNA, 22 nt, Human
uccugggcucaagugauccucc

SEQ ID NO: 257661 - RNA, 22 nt, Human
uccugggcucaagugauccucc

SEQ ID NO: 257662 - RNA, 24 nt, Human
uccugggcucaagugauccuccug

SEQ ID NO: 257663 - RNA, 24 nt, Human
uccugggcucaagugauccuccug

SEQ ID NO: 257664 - RNA, 25 nt, Human
uccuuaggaaccucacccuccccuc

SEQ ID NO: 257665 - RNA, 18 nt, Human
ucuaagacagacaggaaa

SEQ ID NO: 257666 - RNA, 20 nt, Human
ucuaagacagacaggaaaug

SEQ ID NO: 257667 - RNA, 20 nt, Human
ucuaagacagacaggaaaug

SEQ ID NO: 257668 - RNA, 20 nt, Human
ucuaagacagacaggaaaug

SEQ ID NO: 257669 - RNA, 23 nt, Human
ucucaggcugacuaacaauuugc

SEQ ID NO: 257670 - RNA, 24 nt, Human
ucucccuauguugcccaagcuggu

SEQ ID NO: 257671 - RNA, 24 nt, Human
ucucccuauguugcccaagcuggu

SEQ ID NO: 257672 - RNA, 24 nt, Human
ucucccugcaggcugauucuucaa

SEQ ID NO: 257673 - RNA, 23 nt, Human
ucucccuggacaaaggcaaaggu

SEQ ID NO: 257674 - RNA, 23 nt, Human
ucuccucaaccuggggaagacca

SEQ ID NO: 257675 - RNA, 23 nt, Human
ucuccucaaccuggggaagacca

SEQ ID NO: 257676 - RNA, 21 nt, Human
ucucuaacaggcaaucugggu

SEQ ID NO: 257677 - RNA, 23 nt, Human
ucucuuaugaacauggaguuagc

SEQ ID NO: 257678 - RNA, 23 nt, Human
ucugcaagccccaggacccggcc

SEQ ID NO: 257679 - RNA, 25 nt, Human
ucuguccucaggugauagcuuuugg

SEQ ID NO: 257680 - RNA, 20 nt, Human
ucugucucuucuucuuccuc

SEQ ID NO: 257681 - RNA, 20 nt, Human
ucugucucuucuucuuccuc

SEQ ID NO: 257682 - RNA, 22 nt, Human
ucuguuccugguuucccagaug

SEQ ID NO: 257683 - RNA, 22 nt, Human
ucuguuccugguuucccagaug

SEQ ID NO: 257684 - RNA, 21 nt, Human
ucuugaacuccugggcucaag

SEQ ID NO: 257685 - RNA, 21 nt, Human
ucuugaacuccugggcucaag

SEQ ID NO: 257686 - RNA, 22 nt, Human
ucuugaacuccugggcucaagu

SEQ ID NO: 257687 - RNA, 23 nt, Human
ucuugaacuccugggcucaagug

SEQ ID NO: 257688 - RNA, 23 nt, Human
ucuugaacuccugggcucaagug

SEQ ID NO: 257689 - RNA, 19 nt, Human
ucuugccuuuugcccaaag

SEQ ID NO: 257690 - RNA, 19 nt, Human
ucuugccuuuugcccaaag

SEQ ID NO: 257691 - RNA, 18 nt, Human
ucuuggaugcuucuuucu

SEQ ID NO: 257692 - RNA, 18 nt, Human
ucuuggaugcuucuuucu

SEQ ID NO: 257693 - RNA, 25 nt, Human
ugaacuccugggcucaagugauccu

SEQ ID NO: 257694 - RNA, 25 nt, Human
ugaacuccugggcucaagugauccu

SEQ ID NO: 257695 - RNA, 19 nt, Human
ugaagaaguagacucggcc

SEQ ID NO: 257696 - RNA, 19 nt, Human
ugaagaaguagacucggcc

SEQ ID NO: 257697 - RNA, 20 nt, Human
ugacaaauccucuguccccu

SEQ ID NO: 257698 - RNA, 20 nt, Human
ugacaaauccucuguccccu

SEQ ID NO: 257699 - RNA, 21 nt, Human
ugacccaccugccagagucuu

SEQ ID NO: 257700 - RNA, 21 nt, Human
ugacccaccugccagagucuu

SEQ ID NO: 257701 - RNA, 24 nt, Human
ugacccaguccucucuggcccaua

SEQ ID NO: 257702 - RNA, 24 nt, Human
ugacccaguccucucuggcccaua

SEQ ID NO: 257703 - RNA, 26 nt, Human
ugacccaguccucucuggcccauacc

SEQ ID NO: 257704 - RNA, 26 nt, Human
ugacccaguccucucuggcccauacc

SEQ ID NO: 257705 - RNA, 22 nt, Human
ugacccauucuaacucuucccc

SEQ ID NO: 257706 - RNA, 22 nt, Human
ugacccauucuaacucuucccc

SEQ ID NO: 257707 - RNA, 22 nt, Human
ugaccuccagagaagagaugac

SEQ ID NO: 257708 - RNA, 21 nt, Human
ugaccugagauuucugggagc

SEQ ID NO: 257709 - RNA, 21 nt, Human
ugaccugagauuucugggagc

SEQ ID NO: 257710 - RNA, 24 nt, Human
ugagagcaugugaggaaagaacaa

SEQ ID NO: 257711 - RNA, 21 nt, Human
ugagcagacagguauuucauu

SEQ ID NO: 257712 - RNA, 21 nt, Human
ugagcagacagguauuucauu

SEQ ID NO: 257713 - RNA, 21 nt, Human
ugagcagacagguauuucauu

SEQ ID NO: 257714 - RNA, 19 nt, Human
ugaugggaagaagggcucu

SEQ ID NO: 257715 - RNA, 19 nt, Human
ugaugggaagaagggcucu

SEQ ID NO: 257716 - RNA, 20 nt, Human
ugcaaauggggaaucugaga

SEQ ID NO: 257717 - RNA, 20 nt, Human
ugcaaauggggaaucugaga

SEQ ID NO: 257718 - RNA, 20 nt, Human
ugcaaauggggaaucugaga

SEQ ID NO: 257719 - RNA, 20 nt, Human
ugcaaauggggaaucugaga

SEQ ID NO: 257720 - RNA, 19 nt, Human
ugccagagucuugccuuuu

SEQ ID NO: 257721 - RNA, 19 nt, Human
ugccagagucuugccuuuu

SEQ ID NO: 257722 - RNA, 18 nt, Human
ugccaggcacuucacaua

SEQ ID NO: 257723 - RNA, 18 nt, Human
ugccaggcacuucacaua

SEQ ID NO: 257724 - RNA, 18 nt, Human
ugccaggcacuucacaua

SEQ ID NO: 257725 - RNA, 18 nt, Human
ugccaggcacuucacaua

SEQ ID NO: 257726 - RNA, 18 nt, Human
ugccauagagagccugga

SEQ ID NO: 257727 - RNA, 18 nt, Human
ugccauagagagccugga

SEQ ID NO: 257728 - RNA, 20 nt, Human
ugcccaaaggagccuggucu

SEQ ID NO: 257729 - RNA, 20 nt, Human
ugcccaaaggagccuggucu

SEQ ID NO: 257730 - RNA, 22 nt, Human
ugcccaaaggagccuggucuuc

SEQ ID NO: 257731 - RNA, 22 nt, Human
ugcccaaaggagccuggucuuc

SEQ ID NO: 257732 - RNA, 24 nt, Human
ugcccaagcuggucuugaacuccu

SEQ ID NO: 257733 - RNA, 24 nt, Human
ugcccaagcuggucuugaacuccu

SEQ ID NO: 257734 - RNA, 19 nt, Human
ugccucugaccugagauuu

SEQ ID NO: 257735 - RNA, 24 nt, Human
ugccugccuaagccaccuuuaauu

SEQ ID NO: 257736 - RNA, 24 nt, Human
ugcuucagccucccaaagugcuag

SEQ ID NO: 257737 - RNA, 24 nt, Human
ugcuucagccucccaaagugcuag

SEQ ID NO: 257738 - RNA, 19 nt, Human
ugcuucuuucuccccuuuc

SEQ ID NO: 257739 - RNA, 19 nt, Human
ugcuucuuucuccccuuuc

SEQ ID NO: 257740 - RNA, 19 nt, Human
uggccuuucccccugggcc

SEQ ID NO: 257741 - RNA, 21 nt, Human
uggcuccgaacucucccuccc

SEQ ID NO: 257742 - RNA, 18 nt, Human
uggcuuccuaguuguccu

SEQ ID NO: 257743 - RNA, 24 nt, Human
ugggagcaugugaauaaaauggca

SEQ ID NO: 257744 - RNA, 24 nt, Human
ugggagcaugugaauaaaauggca

SEQ ID NO: 257745 - RNA, 19 nt, Human
ugggagggagggagaacau

SEQ ID NO: 257746 - RNA, 19 nt, Human
ugggagggagggagaacau

SEQ ID NO: 257747 - RNA, 20 nt, Human
ugggcucaagugauccuccu

SEQ ID NO: 257748 - RNA, 20 nt, Human
ugggcucaagugauccuccu

SEQ ID NO: 257749 - RNA, 24 nt, Human
ugggcucaagugauccuccugcuu

SEQ ID NO: 257750 - RNA, 24 nt, Human
ugggcucaagugauccuccugcuu

SEQ ID NO: 257751 - RNA, 22 nt, Human
uggggaaucugagauucaacaa

SEQ ID NO: 257752 - RNA, 22 nt, Human
uggggaaucugagauucaacaa

SEQ ID NO: 257753 - RNA, 22 nt, Human
uggggaaucugagauucaacaa

SEQ ID NO: 257754 - RNA, 22 nt, Human
uggggaaucugagauucaacaa

SEQ ID NO: 257755 - RNA, 18 nt, Human
ugggggggaaaugaaagg

SEQ ID NO: 257756 - RNA, 18 nt, Human
ugggggggaaaugaaagg

SEQ ID NO: 257757 - RNA, 20 nt, Human
ugggggggaaaugaaagggu

SEQ ID NO: 257758 - RNA, 20 nt, Human
ugggggggaaaugaaagggu

SEQ ID NO: 257759 - RNA, 22 nt, Human
uggguuucuguuuggccuuucc

SEQ ID NO: 257760 - RNA, 22 nt, Human
uggguuucuguuuggccuuucc

SEQ ID NO: 257761 - RNA, 26 nt, Human
ugguccacucaacaaaacaaaagccc

SEQ ID NO: 257762 - RNA, 18 nt, Human
ugguugagaggccaauag

SEQ ID NO: 257763 - RNA, 24 nt, Human
ugucuaagacagacaggaaaugga

SEQ ID NO: 257764 - RNA, 24 nt, Human
ugucuaagacagacaggaaaugga

SEQ ID NO: 257765 - RNA, 24 nt, Human
ugucuaagacagacaggaaaugga

SEQ ID NO: 257766 - RNA, 24 nt, Human
ugucuaagacagacaggaaaugga

SEQ ID NO: 257767 - RNA, 24 nt, Human
uguugcugcucuuuucuuucucug

SEQ ID NO: 257768 - RNA, 24 nt, Human
uguugcugcucuuuucuuucucug

SEQ ID NO: 257769 - RNA, 25 nt, Human
uuaaagaagugaauccauuguguuc

SEQ ID NO: 257770 - RNA, 20 nt, Human
uuccaaggcauuugauaccu

SEQ ID NO: 257771 - RNA, 20 nt, Human
uuccaaggcauuugauaccu

SEQ ID NO: 257772 - RNA, 20 nt, Human
uuccaaggcccuugcucagu

SEQ ID NO: 257773 - RNA, 20 nt, Human
uuccaaggcccuugcucagu

SEQ ID NO: 257774 - RNA, 20 nt, Human
uuccaaggcccuugcucagu

SEQ ID NO: 257775 - RNA, 20 nt, Human
uuccaaggcccuugcucagu

SEQ ID NO: 257776 - RNA, 24 nt, Human
uuccaaggcccuugcucaguuuuc

SEQ ID NO: 257777 - RNA, 23 nt, Human
uuccagauguguucuaguggccc

SEQ ID NO: 257778 - RNA, 19 nt, Human
uuccauggucauuaaugcc

SEQ ID NO: 257779 - RNA, 24 nt, Human
uucucaucucccucccuuuuauag

SEQ ID NO: 257780 - RNA, 21 nt, Human
uucuccaucuugcugcauuuc

SEQ ID NO: 257781 - RNA, 23 nt, Human
uucugggagccuugggggagcag

SEQ ID NO: 257782 - RNA, 21 nt, Human
uugaaagcauaggucuuccca

SEQ ID NO: 257783 - RNA, 24 nt, Human
uugcaaauggggaaucugagauuc

SEQ ID NO: 257784 - RNA, 24 nt, Human
uugcaaauggggaaucugagauuc

SEQ ID NO: 257785 - RNA, 23 nt, Human
uugcagagacagggucucccuau

SEQ ID NO: 257786 - RNA, 23 nt, Human
uugcagagacagggucucccuau

SEQ ID NO: 257787 - RNA, 21 nt, Human
uugcgccugcuacagcaccug

SEQ ID NO: 257788 - RNA, 21 nt, Human
uugcgccugcuacagcaccug

SEQ ID NO: 257789 - RNA, 21 nt, Human
uugcgccugcuacagcaccug

SEQ ID NO: 257790 - RNA, 19 nt, Human
uugcugcauuuccagaugu

SEQ ID NO: 257791 - RNA, 23 nt, Human
uugcugcauuuccagauguguuc

SEQ ID NO: 257792 - RNA, 23 nt, Human
uuggaugcuucuuucuccccuuu

SEQ ID NO: 257793 - RNA, 23 nt, Human
uuggaugcuucuuucuccccuuu

SEQ ID NO: 257794 - RNA, 22 nt, Human
uuuauuuuuuugcagagacagg

SEQ ID NO: 257795 - RNA, 22 nt, Human
uuuauuuuuuugcagagacagg

SEQ ID NO: 257796 - RNA, 23 nt, Human
uuuauuuuuuugcagagacaggg

SEQ ID NO: 257797 - RNA, 23 nt, Human
uuuauuuuuuugcagagacaggg

SEQ ID NO: 257798 - RNA, 19 nt, Human
uuucccccugggccccaua

SEQ ID NO: 257799 - RNA, 19 nt, Human
uuucccccugggccccaua

SEQ ID NO: 257800 - RNA, 19 nt, Human
uuugaugggaagaagggcu

SEQ ID NO: 257801 - RNA, 25 nt, Human
uuuuuauuuuuuugcagagacaggg

SEQ ID NO: 257802 - RNA, 25 nt, Human
uuuuuauuuuuuugcagagacaggg

SEQ ID NO: 257803 - RNA, 21 nt, Human
aaaaaaacaaagugcauacaa

SEQ ID NO: 257804 - RNA, 24 nt, Human
aaaaacaagacccaaagaaaaaaa

SEQ ID NO: 257805 - RNA, 22 nt, Human
aaaacaaagugcauacaaagca

SEQ ID NO: 257806 - RNA, 25 nt, Human
aaagguucuaaggcagccagcagug

SEQ ID NO: 257807 - RNA, 21 nt, Human
aacaagacccaaagaaaaaaa

SEQ ID NO: 257808 - RNA, 25 nt, Human
aagaaaaaaacaaagugcauacaaa

SEQ ID NO: 257809 - RNA, 21 nt, Human
aagacccaaagaaaaaaacaa

SEQ ID NO: 257810 - RNA, 18 nt, Human
agaagagccugaagugug

SEQ ID NO: 257811 - RNA, 21 nt, Human
agcggcucaugguccggcccc

SEQ ID NO: 257812 - RNA, 19 nt, Human
aggagccacucucuggaau

SEQ ID NO: 257813 - RNA, 21 nt, Human
aggcagccagcagugaaaagc

SEQ ID NO: 257814 - RNA, 19 nt, Human
aggggcagggagggcugag

SEQ ID NO: 257815 - RNA, 19 nt, Human
aggggcagggagggcugag

SEQ ID NO: 257816 - RNA, 19 nt, Human
aguggaaaaaaaaaacaag

SEQ ID NO: 257817 - RNA, 21 nt, Human
caaagaaaaaaacaaagugca

SEQ ID NO: 257818 - RNA, 22 nt, Human
cacucucuggaaucuuaaauua

SEQ ID NO: 257819 - RNA, 25 nt, Human
cagcagugaaaagccaggggucugg

SEQ ID NO: 257820 - RNA, 19 nt, Human
cagccuccagccaccgccu

SEQ ID NO: 257821 - RNA, 18 nt, Human
cagguaggagugagaaug

SEQ ID NO: 257822 - RNA, 18 nt, Human
cauggggaaugguugaag

SEQ ID NO: 257823 - RNA, 22 nt, Human
ccaggccccuccggguccuucu

SEQ ID NO: 257824 - RNA, 24 nt, Human
cccaaagaaaaaaacaaagugcau

SEQ ID NO: 257825 - RNA, 24 nt, Human
cccaaagcagggcugcguugaaaa

SEQ ID NO: 257826 - RNA, 25 nt, Human
cccccgccgccgccgccgccgccgg

SEQ ID NO: 257827 - RNA, 20 nt, Human
cccccgcgccccagcccccg

SEQ ID NO: 257828 - RNA, 21 nt, Human
cccccgcgccccagcccccgc

SEQ ID NO: 257829 - RNA, 19 nt, Human
ccccgccgccgccgccgcc

SEQ ID NO: 257830 - RNA, 21 nt, Human
ccccgccgccgccgccgccgc

SEQ ID NO: 257831 - RNA, 20 nt, Human
ccccgcgccccagcccccgc

SEQ ID NO: 257832 - RNA, 18 nt, Human
ccccgcgcgucgcccggg

SEQ ID NO: 257833 - RNA, 18 nt, Human
cccggcucagcggcucau

SEQ ID NO: 257834 - RNA, 25 nt, Human
ccgccgccgccgccgcagguccugg

SEQ ID NO: 257835 - RNA, 18 nt, Human
ccgccgccgccgccgccg

SEQ ID NO: 257836 - RNA, 18 nt, Human
ccgccgccgccgccgccg

SEQ ID NO: 257837 - RNA, 21 nt, Human
ccgccgccgccgccgccgcag

SEQ ID NO: 257838 - RNA, 22 nt, Human
ccggguccuucucuaguucucc

SEQ ID NO: 257839 - RNA, 26 nt, Human
ccuccggguccuucucuaggggccgc

SEQ ID NO: 257840 - RNA, 22 nt, Human
ccugguccgcggcgcagggcug

SEQ ID NO: 257841 - RNA, 18 nt, Human
ccugugggagccagggcc

SEQ ID NO: 257842 - RNA, 23 nt, Human
cgccgccgccgccgcaggucccc

SEQ ID NO: 257843 - RNA, 20 nt, Human
cgcuggcucgguggccuggg

SEQ ID NO: 257844 - RNA, 22 nt, Human
cggcccccgcgccccagccccc

SEQ ID NO: 257845 - RNA, 21 nt, Human
cucagcggcucaugguccggc

SEQ ID NO: 257846 - RNA, 22 nt, Human
cucccuggccccgcgcgucgcc

SEQ ID NO: 257847 - RNA, 18 nt, Human
cuccggguccuucucuag

SEQ ID NO: 257848 - RNA, 23 nt, Human
cuggccccgcgcgucgcccgggg

SEQ ID NO: 257849 - RNA, 18 nt, Human
cuggcucgguggccuggg

SEQ ID NO: 257850 - RNA, 24 nt, Human
cugguccgcggcgcagggcugcgc

SEQ ID NO: 257851 - RNA, 25 nt, Human
gaaaaaaaaaacaagacccaaagaa

SEQ ID NO: 257852 - RNA, 24 nt, Human
gaaaaaaacaaagugcauacaaag

SEQ ID NO: 257853 - RNA, 22 nt, Human
gagaagagccugaaguguggca

SEQ ID NO: 257854 - RNA, 20 nt, Human
gagcugaaggcacggcugcc

SEQ ID NO: 257855 - RNA, 24 nt, Human
gauuagcuguagagcugaaggcac

SEQ ID NO: 257856 - RNA, 23 nt, Human
gcagcaccagggcagcccaaagc

SEQ ID NO: 257857 - RNA, 24 nt, Human
gcagugaaaagccaggggucugga

SEQ ID NO: 257858 - RNA, 20 nt, Human
gcccccgccgccgccgccgc

SEQ ID NO: 257859 - RNA, 21 nt, Human
gccucgccgccugguuggagc

SEQ ID NO: 257860 - RNA, 19 nt, Human
ggaggggcagggagggcug

SEQ ID NO: 257861 - RNA, 18 nt, Human
ggccccuccggguccuuc

SEQ ID NO: 257862 - RNA, 23 nt, Human
ggccugggguuugcccggcucag

SEQ ID NO: 257863 - RNA, 24 nt, Human
gggaaggggcgccugggaggagua

SEQ ID NO: 257864 - RNA, 22 nt, Human
gggcagggagggcugagcggga

SEQ ID NO: 257865 - RNA, 18 nt, Human
ggggaaugguugaaggga

SEQ ID NO: 257866 - RNA, 19 nt, Human
gugucuuuauucauacuug

SEQ ID NO: 257867 - RNA, 20 nt, Human
guugugaaaggagaagagcc

SEQ ID NO: 257868 - RNA, 24 nt, Human
uaagaaagguucuaaggcagccag

SEQ ID NO: 257869 - RNA, 25 nt, Human
uaaggcagccagcagugaaaagcca

SEQ ID NO: 257870 - RNA, 27 nt, Human
uacagucagcaucuauucuugggcacc

SEQ ID NO: 257871 - RNA, 21 nt, Human
uaggugucuuuauucauacuu

SEQ ID NO: 257872 - RNA, 18 nt, Human
ucacuaugugggcugaga

SEQ ID NO: 257873 - RNA, 23 nt, Human
ucaugguccggcccccgcgcccc

SEQ ID NO: 257874 - RNA, 25 nt, Human
ugaaguguggcagcaccagggcagc

SEQ ID NO: 257875 - RNA, 19 nt, Human
ugagaaugcugauuagcug

SEQ ID NO: 257876 - RNA, 18 nt, Human
ugagcgggaagccacggc

SEQ ID NO: 257877 - RNA, 21 nt, Human
ugaggaagucuggaugcagcg

SEQ ID NO: 257878 - RNA, 22 nt, Human
uggagaagagacucgguaggga

SEQ ID NO: 257879 - RNA, 20 nt, Human
uggggaaugguugaagggag

SEQ ID NO: 257880 - RNA, 19 nt, Human
ugguugaagggaggggcag

SEQ ID NO: 257881 - RNA, 19 nt, Human
uuagggguggcucugaggg

SEQ ID NO: 257882 - RNA, 25 nt, Human
uucuaaguggaaaaaaaaaacaaga

SEQ ID NO: 257883 - RNA, 21 nt, Human
uuggagccugguccgcggcgc

SEQ ID NO: 257884 - RNA, 22 nt, Human
aaguaaaaauugggaaauuuau

SEQ ID NO: 257885 - RNA, 22 nt, Human
caacuaugaaaaaaauuggaag

SEQ ID NO: 257886 - RNA, 23 nt, Human
ccaccacuagucuuccuccugga

SEQ ID NO: 257887 - RNA, 21 nt, Human
cucuccuacauucugcuuuag

SEQ ID NO: 257888 - RNA, 21 nt, Human
cuuuuaaguaaaaauugggaa

SEQ ID NO: 257889 - RNA, 27 nt, Human
gaaaaaauaauggugucuaacugcaga

SEQ ID NO: 257890 - RNA, 23 nt, Human
ggaaauaaaaaucaaacggauca

SEQ ID NO: 257891 - RNA, 24 nt, Human
uauacaacuaugaaaaaaauugga

SEQ ID NO: 257892 - RNA, 22 nt, Human
ucuaauguggauugaaauucug

SEQ ID NO: 257893 - RNA, 28 nt, Human
uggccacaaaagccauugcuuguaaaua

SEQ ID NO: 257894 - RNA, 21 nt, Human
ugucauggaauccaccacuag

SEQ ID NO: 257895 - RNA, 23 nt, Human
uggggcucagggcugcauggggc

SEQ ID NO: 257896 - RNA, 24 nt, Human
aaacagccagcuacugccccccac

SEQ ID NO: 257897 - RNA, 23 nt, Human
aaagaaacugacagaggcccaaa

SEQ ID NO: 257898 - RNA, 18 nt, Human
aaagucuccugccuucug

SEQ ID NO: 257899 - RNA, 18 nt, Human
aacagacaaggggccucc

SEQ ID NO: 257900 - RNA, 19 nt, Human
aacagccagcuacugcccc

SEQ ID NO: 257901 - RNA, 21 nt, Human
aacagccagcuacugcccccc

SEQ ID NO: 257902 - RNA, 24 nt, Human
aacagccagcuacugccccccaca

SEQ ID NO: 257903 - RNA, 18 nt, Human
aagcacuagggggucacu

SEQ ID NO: 257904 - RNA, 19 nt, Human
aagggggccuggcuggggc

SEQ ID NO: 257905 - RNA, 26 nt, Human
aagugcgcgguggagucagcggaggg

SEQ ID NO: 257906 - RNA, 18 nt, Human
acagaaaugccacgaaac

SEQ ID NO: 257907 - RNA, 18 nt, Human
acagacaaggggccuccg

SEQ ID NO: 257908 - RNA, 20 nt, Human
acauggaaaagaaacugaca

SEQ ID NO: 257909 - RNA, 19 nt, Human
accccacccugagugagga

SEQ ID NO: 257910 - RNA, 20 nt, Human
acccugagugaggauucagg

SEQ ID NO: 257911 - RNA, 19 nt, Human
acugccccccacaaucccc

SEQ ID NO: 257912 - RNA, 28 nt, Human
agaggggcaaggcacagcuucgcaguca

SEQ ID NO: 257913 - RNA, 22 nt, Human
agccacagaaaugccacgaaac

SEQ ID NO: 257914 - RNA, 24 nt, Human
aggaagcacuagggggucacugag

SEQ ID NO: 257915 - RNA, 20 nt, Human
aggaggagguggguggcggg

SEQ ID NO: 257916 - RNA, 21 nt, Human
aggcaguucugggcccaggga

SEQ ID NO: 257917 - RNA, 22 nt, Human
aggcggguuccgguggcagcgc

SEQ ID NO: 257918 - RNA, 19 nt, Human
agucagcggagggucccgg

SEQ ID NO: 257919 - RNA, 18 nt, Human
aguggggacagggugaac

SEQ ID NO: 257920 - RNA, 19 nt, Human
aguucugggcccagggagg

SEQ ID NO: 257921 - RNA, 26 nt, Human
aguugaugggagucaagcuguucucu

SEQ ID NO: 257922 - RNA, 20 nt, Human
augagcaacuggggcaaccc

SEQ ID NO: 257923 - RNA, 22 nt, Human
auggaaggcaguucugggccca

SEQ ID NO: 257924 - RNA, 18 nt, Human
caacuggggcaaccccuc

SEQ ID NO: 257925 - RNA, 18 nt, Human
caaugaccaggccugagc

SEQ ID NO: 257926 - RNA, 18 nt, Human
caccaguguggcagugac

SEQ ID NO: 257927 - RNA, 26 nt, Human
caccccucacucuagagcuaaggccu

SEQ ID NO: 257928 - RNA, 24 nt, Human
cacugcagagccacagaaaugcca

SEQ ID NO: 257929 - RNA, 21 nt, Human
cagaaaugccacgaaacagcc

SEQ ID NO: 257930 - RNA, 19 nt, Human
cagcccgggccgccggcgg

SEQ ID NO: 257931 - RNA, 20 nt, Human
cagccgggagggaacgacgg

SEQ ID NO: 257932 - RNA, 21 nt, Human
caggccugagccaggguucgg

SEQ ID NO: 257933 - RNA, 20 nt, Human
cagguaacugaccaaagucu

SEQ ID NO: 257934 - RNA, 18 nt, Human
caguggccaggcggggcg

SEQ ID NO: 257935 - RNA, 19 nt, Human
caguggccaggcggggcgg

SEQ ID NO: 257936 - RNA, 20 nt, Human
cauacauggaaaagaaacug

SEQ ID NO: 257937 - RNA, 22 nt, Human
ccaaaucguuuccuggcagccc

SEQ ID NO: 257938 - RNA, 21 nt, Human
ccacagccucagcuccaggaa

SEQ ID NO: 257939 - RNA, 22 nt, Human
ccaguguggcagugacuguagg

SEQ ID NO: 257940 - RNA, 20 nt, Human
cccacaauccccgcgacuag

SEQ ID NO: 257941 - RNA, 26 nt, Human
cccacagccucagcuccaggaagcac

SEQ ID NO: 257942 - RNA, 20 nt, Human
cccagcccgggccgccggcc

SEQ ID NO: 257943 - RNA, 24 nt, Human
cccagcgccaggcgaccggucccc

SEQ ID NO: 257944 - RNA, 20 nt, Human
cccccacaauccccgcgacu

SEQ ID NO: 257945 - RNA, 18 nt, Human
cccccagguuccacccac

SEQ ID NO: 257946 - RNA, 20 nt, Human
cccccagguuccacccaccc

SEQ ID NO: 257947 - RNA, 19 nt, Human
ccccgccgccgccgccccu

SEQ ID NO: 257948 - RNA, 20 nt, Human
ccccugaaggcggguuccgg

SEQ ID NO: 257949 - RNA, 19 nt, Human
ccccugcuuaguccgcgcc

SEQ ID NO: 257950 - RNA, 24 nt, Human
cccgccccuccccgggcucgggag

SEQ ID NO: 257951 - RNA, 26 nt, Human
cccgggcucgggaggcgggguccccc

SEQ ID NO: 257952 - RNA, 21 nt, Human
cccugcgcgggagaucccccc

SEQ ID NO: 257953 - RNA, 18 nt, Human
ccgccgccgccgccccug

SEQ ID NO: 257954 - RNA, 19 nt, Human
ccgggccuggagagggcgg

SEQ ID NO: 257955 - RNA, 21 nt, Human
ccuccccgccccuccccgggc

SEQ ID NO: 257956 - RNA, 18 nt, Human
ccugaaggcggguuccgg

SEQ ID NO: 257957 - RNA, 23 nt, Human
ccuguccucuaacgacccaggaa

SEQ ID NO: 257958 - RNA, 20 nt, Human
ccuuguccuccccgccccuc

SEQ ID NO: 257959 - RNA, 23 nt, Human
cgaaacagccagcuacugccccc

SEQ ID NO: 257960 - RNA, 22 nt, Human
cgaagggggccuggcuggggcc

SEQ ID NO: 257961 - RNA, 19 nt, Human
cgaccagguccagcggcgg

SEQ ID NO: 257962 - RNA, 23 nt, Human
cgaccagguccagcggcggggga

SEQ ID NO: 257963 - RNA, 22 nt, Human
cgagaaaagcuggcucuuccug

SEQ ID NO: 257964 - RNA, 23 nt, Human
cgcauggucccagcgcgcgugcg

SEQ ID NO: 257965 - RNA, 21 nt, Human
cgccaggcgaccgguccccgc

SEQ ID NO: 257966 - RNA, 21 nt, Human
cgcgcccgagcccccguccgu

SEQ ID NO: 257967 - RNA, 23 nt, Human
cgggagggaacgacgggggcgac

SEQ ID NO: 257968 - RNA, 18 nt, Human
cgguggagucagcggagg

SEQ ID NO: 257969 - RNA, 21 nt, Human
cugagcccagcgccaggcgac

SEQ ID NO: 257970 - RNA, 22 nt, Human
cugggcccagggaggugcccaa

SEQ ID NO: 257971 - RNA, 18 nt, Human
gaggaggagguggguggc

SEQ ID NO: 257972 - RNA, 19 nt, Human
gaggaggagguggguggcg

SEQ ID NO: 257973 - RNA, 24 nt, Human
gcagcgccggggucucccgaaucg

SEQ ID NO: 257974 - RNA, 19 nt, Human
gcauggucccagcgcgcgu

SEQ ID NO: 257975 - RNA, 20 nt, Human
gcccagaauucccagguaac

SEQ ID NO: 257976 - RNA, 22 nt, Human
gcccccagguuccacccacccc

SEQ ID NO: 257977 - RNA, 20 nt, Human
gccguggagggcgcuguucg

SEQ ID NO: 257978 - RNA, 24 nt, Human
gccuggggaggaggaggugggugg

SEQ ID NO: 257979 - RNA, 22 nt, Human
ggaagcacuagggggucacuga

SEQ ID NO: 257980 - RNA, 22 nt, Human
ggacguggcgcauggguccuca

SEQ ID NO: 257981 - RNA, 19 nt, Human
ggagagucccaggacugcg

SEQ ID NO: 257982 - RNA, 19 nt, Human
ggagcagaacggggugaga

SEQ ID NO: 257983 - RNA, 23 nt, Human
ggccuggggaggaggaggugggu

SEQ ID NO: 257984 - RNA, 21 nt, Human
gggaacgacgggggcgacgac

SEQ ID NO: 257985 - RNA, 25 nt, Human
gggagcaacggaaaagguuaacagc

SEQ ID NO: 257986 - RNA, 18 nt, Human
gggggucccgggaagugc

SEQ ID NO: 257987 - RNA, 21 nt, Human
gggucgggugggcccgggaau

SEQ ID NO: 257988 - RNA, 20 nt, Human
gggugggagaggggcaaggc

SEQ ID NO: 257989 - RNA, 21 nt, Human
ggguucuuggggauagaaggg

SEQ ID NO: 257990 - RNA, 18 nt, Human
ggucacugaggcuggaca

SEQ ID NO: 257991 - RNA, 19 nt, Human
gguccagcggcgggggacu

SEQ ID NO: 257992 - RNA, 24 nt, Human
ggugaggccgcgggcccgccccuu

SEQ ID NO: 257993 - RNA, 21 nt, Human
ggugcaagcagggaagggguu

SEQ ID NO: 257994 - RNA, 19 nt, Human
guccagcggcgggggacuc

SEQ ID NO: 257995 - RNA, 18 nt, Human
gucccugucuuuccacca

SEQ ID NO: 257996 - RNA, 22 nt, Human
guccucaggggugauaucuggg

SEQ ID NO: 257997 - RNA, 18 nt, Human
gugcgcgguggagucagc

SEQ ID NO: 257998 - RNA, 21 nt, Human
uaaaacuguggggagugggga

SEQ ID NO: 257999 - RNA, 22 nt, Human
uaaaaugcagauuccugacccc

SEQ ID NO: 258000 - RNA, 21 nt, Human
uacaaauuucccccuccucau

SEQ ID NO: 258001 - RNA, 25 nt, Human
uacauggaaaagaaacugacagagg

SEQ ID NO: 258002 - RNA, 19 nt, Human
ucacugaggcuggacagca

SEQ ID NO: 258003 - RNA, 23 nt, Human
ucagggugagugugggaucugca

SEQ ID NO: 258004 - RNA, 24 nt, Human
uccaccacccaggacguggcgcau

SEQ ID NO: 258005 - RNA, 18 nt, Human
uccacccaccccucacuc

SEQ ID NO: 258006 - RNA, 18 nt, Human
ucccggagggccaggguc

SEQ ID NO: 258007 - RNA, 20 nt, Human
ucccuccagccacugauucc

SEQ ID NO: 258008 - RNA, 23 nt, Human
uccuccccgccccuccccgggcu

SEQ ID NO: 258009 - RNA, 18 nt, Human
uccugagugggaugaaua

SEQ ID NO: 258010 - RNA, 21 nt, Human
uccuggaaaaggaagguccug

SEQ ID NO: 258011 - RNA, 19 nt, Human
ucuagaagaauaguuccag

SEQ ID NO: 258012 - RNA, 20 nt, Human
ucuuggggauagaaggguuc

SEQ ID NO: 258013 - RNA, 19 nt, Human
ugagcaacuggggcaaccc

SEQ ID NO: 258014 - RNA, 20 nt, Human
ugaggagacugagcccagcg

SEQ ID NO: 258015 - RNA, 23 nt, Human
ugaggaggcaaugaccaggccug

SEQ ID NO: 258016 - RNA, 24 nt, Human
ugaguugaugggagucaagcuguu

SEQ ID NO: 258017 - RNA, 27 nt, Human
ugcagagccacagaaaugccacgaaac

SEQ ID NO: 258018 - RNA, 26 nt, Human
ugcccaagcuggguggccuggggagg

SEQ ID NO: 258019 - RNA, 20 nt, Human
ugcccccagguuccacccac

SEQ ID NO: 258020 - RNA, 23 nt, Human
ugcccccagguuccacccacccc

SEQ ID NO: 258021 - RNA, 22 nt, Human
ugcgggugggagaggggcaagg

SEQ ID NO: 258022 - RNA, 24 nt, Human
uggaaaagaaacugacagaggccc

SEQ ID NO: 258023 - RNA, 19 nt, Human
uggagagggcggggggcac

SEQ ID NO: 258024 - RNA, 23 nt, Human
uggaggaacacugcagagccaca

SEQ ID NO: 258025 - RNA, 22 nt, Human
uggagucagcggagggucccgg

SEQ ID NO: 258026 - RNA, 22 nt, Human
uggccccuaagugacucuaccc

SEQ ID NO: 258027 - RNA, 19 nt, Human
uggcgcauggguccucagg

SEQ ID NO: 258028 - RNA, 18 nt, Human
uggcggcagccgggaggg

SEQ ID NO: 258029 - RNA, 23 nt, Human
ugggcccagggaggugcccaagc

SEQ ID NO: 258030 - RNA, 21 nt, Human
ugggcugguuccgggucuggg

SEQ ID NO: 258031 - RNA, 18 nt, Human
uggggaggaggagguggg

SEQ ID NO: 258032 - RNA, 18 nt, Human
uggggaguggggacaggg

SEQ ID NO: 258033 - RNA, 22 nt, Human
ugggguggaggaacacugcaga

SEQ ID NO: 258034 - RNA, 21 nt, Human
ugggucccagguccccaccag

SEQ ID NO: 258035 - RNA, 18 nt, Human
uguccugagugggaugaa

SEQ ID NO: 258036 - RNA, 19 nt, Human
uguggggaguggggacagg

SEQ ID NO: 258037 - RNA, 21 nt, Human
ugugugggggucccgggaagu

SEQ ID NO: 258038 - RNA, 23 nt, Human
uuccgggucugggucccaggucc

SEQ ID NO: 258039 - RNA, 18 nt, Human
uugguccugggguggagg

SEQ ID NO: 258040 - RNA, 19 nt, Human
acucaguagcguuuugagu

SEQ ID NO: 258041 - RNA, 20 nt, Human
agcguuuugagugucgguuc

SEQ ID NO: 258042 - RNA, 24 nt, Human
gagugucgguucagcuaaccugac

SEQ ID NO: 258043 - RNA, 20 nt, Human
gggcuucauccuagcagucc

SEQ ID NO: 258044 - RNA, 21 nt, Human
uagcguuuugagugucgguuc

SEQ ID NO: 258045 - RNA, 21 nt, Human
ucuuuauugugacucaguagc

SEQ ID NO: 258046 - RNA, 20 nt, Human
uugaauaaguccucugugcu

SEQ ID NO: 258047 - RNA, 22 nt, Human
uuuuuuacucuuuaaaacaauc

SEQ ID NO: 258048 - RNA, 27 nt, Human
uuuuuuuuuuuuuuuuuuacucuuuaa

SEQ ID NO: 258049 - RNA, 19 nt, Human
aaagugcccauauugugcc

SEQ ID NO: 258050 - RNA, 23 nt, Human
aaaugaccggcaagauacagauu

SEQ ID NO: 258051 - RNA, 21 nt, Human
aacgaacauuucaauucacag

SEQ ID NO: 258052 - RNA, 19 nt, Human
acagcacaggcaggagaaa

SEQ ID NO: 258053 - RNA, 21 nt, Human
acagcacaggcaggagaaaac

SEQ ID NO: 258054 - RNA, 18 nt, Human
caagcuaagcagcagccc

SEQ ID NO: 258055 - RNA, 18 nt, Human
cacucuaugugacaaggu

SEQ ID NO: 258056 - RNA, 20 nt, Human
cagcacaggcaggagaaaac

SEQ ID NO: 258057 - RNA, 21 nt, Human
cagcagcccauuugaaugccc

SEQ ID NO: 258058 - RNA, 23 nt, Human
cauuuaaagugcccauauugugc

SEQ ID NO: 258059 - RNA, 21 nt, Human
ccauauugugccuucuacaua

SEQ ID NO: 258060 - RNA, 23 nt, Human
cucuaugugacaaggugcaagcu

SEQ ID NO: 258061 - RNA, 20 nt, Human
cugucuugccugccuccuug

SEQ ID NO: 258062 - RNA, 23 nt, Human
gcccuguaauaacauaaaaauga

SEQ ID NO: 258063 - RNA, 20 nt, Human
uaaagugcccauauugugcc

SEQ ID NO: 258064 - RNA, 24 nt, Human
uaagcaaauagucuacacagauac

SEQ ID NO: 258065 - RNA, 18 nt, Human
ugacucgagucacagcac

SEQ ID NO: 258066 - RNA, 22 nt, Human
ugcccuguaauaacauaaaaau

SEQ ID NO: 258067 - RNA, 24 nt, Human
ugggaaagaucacucuaugugaca

SEQ ID NO: 258068 - RNA, 22 nt, Human
uguaauaacauaaaaaugaccg

SEQ ID NO: 258069 - RNA, 21 nt, Human
uuaggugaagaauuauuagcu

SEQ ID NO: 258070 - RNA, 23 nt, Human
caacugcaauaaaaaagggugac

SEQ ID NO: 258071 - RNA, 20 nt, Human
caauaaaaaagggugacaua

SEQ ID NO: 258072 - RNA, 22 nt, Human
ccaacugcaauaaaaaagggug

SEQ ID NO: 258073 - RNA, 19 nt, Human
cguccagagacaauuguuc

SEQ ID NO: 258074 - RNA, 22 nt, Human
gaacagugcuuaucaauucuga

SEQ ID NO: 258075 - RNA, 19 nt, Human
uaccauggaauaaacauuu

SEQ ID NO: 258076 - RNA, 23 nt, Human
ugaaugaaugaauggauguucug

SEQ ID NO: 258077 - RNA, 18 nt, Human
aaaucuaguucuaaauug

SEQ ID NO: 258078 - RNA, 19 nt, Human
acaauucaacccacgaaac

SEQ ID NO: 258079 - RNA, 19 nt, Human
acccugguaagcucacauu

SEQ ID NO: 258080 - RNA, 23 nt, Human
aucuucucuucaaacucuacccc

SEQ ID NO: 258081 - RNA, 21 nt, Human
auguaagauggaauguguaag

SEQ ID NO: 258082 - RNA, 19 nt, Human
caaacucuaccccuccugg

SEQ ID NO: 258083 - RNA, 23 nt, Human
caaagacccugguaagcucacau

SEQ ID NO: 258084 - RNA, 22 nt, Human
caacccacgaaacauaucaucu

SEQ ID NO: 258085 - RNA, 21 nt, Human
cacuccaaucucugccucugu

SEQ ID NO: 258086 - RNA, 19 nt, Human
ccccuagguggcuaugcuc

SEQ ID NO: 258087 - RNA, 22 nt, Human
ccuucaacauucugaaagugga

SEQ ID NO: 258088 - RNA, 21 nt, Human
cuuaacuaauuacaucugcaa

SEQ ID NO: 258089 - RNA, 21 nt, Human
gcaggacacaauguaacgaaa

SEQ ID NO: 258090 - RNA, 22 nt, Human
ggagaugcgucacuccaaucuc

SEQ ID NO: 258091 - RNA, 21 nt, Human
guccucuggguagggcccuuc

SEQ ID NO: 258092 - RNA, 21 nt, Human
uaagcaggacacaauguaacg

SEQ ID NO: 258093 - RNA, 22 nt, Human
uacagugaugggaaacaaugac

SEQ ID NO: 258094 - RNA, 21 nt, Human
uagaagauauacauaggacau

SEQ ID NO: 258095 - RNA, 23 nt, Human
uagaauggauacagugaugggaa

SEQ ID NO: 258096 - RNA, 18 nt, Human
uaggacauuuuaagaaac

SEQ ID NO: 258097 - RNA, 23 nt, Human
ucacauucauggguaccuggggu

SEQ ID NO: 258098 - RNA, 19 nt, Human
ucacuccaaucucugccuc

SEQ ID NO: 258099 - RNA, 21 nt, Human
ucacuccaaucucugccucug

SEQ ID NO: 258100 - RNA, 22 nt, Human
uccaaggguagaaaacagcacc

SEQ ID NO: 258101 - RNA, 20 nt, Human
ucugucuucacacggccucc

SEQ ID NO: 258102 - RNA, 22 nt, Human
ugaaauaguaaauauugaggug

SEQ ID NO: 258103 - RNA, 21 nt, Human
ugacaaaaaggcuuacuuucc

SEQ ID NO: 258104 - RNA, 22 nt, Human
ugccucugucuucacacggccu

SEQ ID NO: 258105 - RNA, 21 nt, Human
ugcugaacuucccuucaacau

SEQ ID NO: 258106 - RNA, 18 nt, Human
uggaaucacuaauguaag

SEQ ID NO: 258107 - RNA, 21 nt, Human
ugggggacacaauucaaccca

SEQ ID NO: 258108 - RNA, 18 nt, Human
ugguaagcucacauucau

SEQ ID NO: 258109 - RNA, 18 nt, Human
uguaagauggaaugugua

SEQ ID NO: 258110 - RNA, 20 nt, Human
uguccucuggguagggcccu

SEQ ID NO: 258111 - RNA, 22 nt, Human
uugaggugacaaaaaggcuuac

SEQ ID NO: 258112 - RNA, 19 nt, Human
uuucuguccucuggguagg

SEQ ID NO: 258113 - RNA, 21 nt, Human
aaacacuccaacaaaaaacaa

SEQ ID NO: 258114 - RNA, 24 nt, Human
aaacacuccaacaaaaaacaaagg

SEQ ID NO: 258115 - RNA, 19 nt, Human
aacaaaaaacaaaggugag

SEQ ID NO: 258116 - RNA, 21 nt, Human
aacacuccaacaaaaaacaaa

SEQ ID NO: 258117 - RNA, 18 nt, Human
acacuccaacaaaaaaca

SEQ ID NO: 258118 - RNA, 25 nt, Human
accuccacuccucccuuuccuccag

SEQ ID NO: 258119 - RNA, 23 nt, Human
acuccaacaaaaaacaaagguga

SEQ ID NO: 258120 - RNA, 18 nt, Human
caaacuggcuccuucccc

SEQ ID NO: 258121 - RNA, 19 nt, Human
cacuccaacaaaaaacaaa

SEQ ID NO: 258122 - RNA, 18 nt, Human
cacuccucccuuuccucc

SEQ ID NO: 258123 - RNA, 24 nt, Human
cacuccucccuuuccuccagaaca

SEQ ID NO: 258124 - RNA, 18 nt, Human
cauggcacugcaaagcag

SEQ ID NO: 258125 - RNA, 22 nt, Human
ccacuccucccuuuccuccaga

SEQ ID NO: 258126 - RNA, 19 nt, Human
ccagcccaccuccacuccu

SEQ ID NO: 258127 - RNA, 24 nt, Human
cccagcccaccuccacuccucccu

SEQ ID NO: 258128 - RNA, 25 nt, Human
cccagcccaccuccacuccucccuu

SEQ ID NO: 258129 - RNA, 23 nt, Human
ccuccagaacagaauaccaguuu

SEQ ID NO: 258130 - RNA, 22 nt, Human
cggcaaacuggcuccuucccca

SEQ ID NO: 258131 - RNA, 23 nt, Human
gaauccaaguuuauuagaaacac

SEQ ID NO: 258132 - RNA, 24 nt, Human
gagaauccaaguuuauuagaaaca

SEQ ID NO: 258133 - RNA, 19 nt, Human
ggguuggucccagugggga

SEQ ID NO: 258134 - RNA, 24 nt, Human
gguuagagaauccaaguuuauuag

SEQ ID NO: 258135 - RNA, 19 nt, Human
uauuagaaacacuccaaca

SEQ ID NO: 258136 - RNA, 26 nt, Human
uccaacaaaaaacaaaggugagaaga

SEQ ID NO: 258137 - RNA, 24 nt, Human
uccacuccucccuuuccuccagaa

SEQ ID NO: 258138 - RNA, 21 nt, Human
uccggcaaacuggcuccuucc

SEQ ID NO: 258139 - RNA, 19 nt, Human
aaaaaaaaaacucauccac

SEQ ID NO: 258140 - RNA, 28 nt, Human
aaaaacucauccacucagcaauaguggc

SEQ ID NO: 258141 - RNA, 19 nt, Human
aaaaagaaaauaaaagggg

SEQ ID NO: 258142 - RNA, 28 nt, Human
aaaaggaccggcagaaggaaagagggga

SEQ ID NO: 258143 - RNA, 24 nt, Human
aaaaggggaggggguaagaaaagg

SEQ ID NO: 258144 - RNA, 21 nt, Human
aaaaguuaaguggggggaaug

SEQ ID NO: 258145 - RNA, 23 nt, Human
aaacaaggaaagaggucaucuaa

SEQ ID NO: 258146 - RNA, 21 nt, Human
aaaccaaauuuaaugaaauaa

SEQ ID NO: 258147 - RNA, 23 nt, Human
aaagccgcggcuggcgccgggca

SEQ ID NO: 258148 - RNA, 24 nt, Human
aaaguuaaguggggggaaugggga

SEQ ID NO: 258149 - RNA, 20 nt, Human
aacaaaacaaggaaagaggu

SEQ ID NO: 258150 - RNA, 21 nt, Human
aacauuccaacuccuucccac

SEQ ID NO: 258151 - RNA, 24 nt, Human
aaccaccacucaucucugcucaga

SEQ ID NO: 258152 - RNA, 20 nt, Human
aagaauaaaaaagaaagcaa

SEQ ID NO: 258153 - RNA, 23 nt, Human
aagacacuuugcuccccggccuu

SEQ ID NO: 258154 - RNA, 18 nt, Human
aaggaaacagacaggggg

SEQ ID NO: 258155 - RNA, 21 nt, Human
aauaagcagugaacaaagcaa

SEQ ID NO: 258156 - RNA, 22 nt, Human
aauacuuggacauacagcagca

SEQ ID NO: 258157 - RNA, 18 nt, Human
acaaaacaaggaaagagg

SEQ ID NO: 258158 - RNA, 22 nt, Human
acaaggaaagaggucaucuaaa

SEQ ID NO: 258159 - RNA, 21 nt, Human
accuggagggggugggggagc

SEQ ID NO: 258160 - RNA, 22 nt, Human
accuggagggggugggggagcu

SEQ ID NO: 258161 - RNA, 22 nt, Human
acuccagcacccaaggcacggg

SEQ ID NO: 258162 - RNA, 21 nt, Human
acuuggcggggggcagagggg

SEQ ID NO: 258163 - RNA, 27 nt, Human
agaaagcaacucuugucuuauuaugaa

SEQ ID NO: 258164 - RNA, 19 nt, Human
agaaagcccagaucugcaa

SEQ ID NO: 258165 - RNA, 19 nt, Human
agaagacugcacuuuacau

SEQ ID NO: 258166 - RNA, 19 nt, Human
agaagggaggggaaagagu

SEQ ID NO: 258167 - RNA, 18 nt, Human
agacagggggagaggaag

SEQ ID NO: 258168 - RNA, 23 nt, Human
agaccaaaggcugcuuagcacag

SEQ ID NO: 258169 - RNA, 23 nt, Human
agagcagagcuggacacguccuc

SEQ ID NO: 258170 - RNA, 19 nt, Human
agagcggucccuccccccg

SEQ ID NO: 258171 - RNA, 23 nt, Human
agagcggucccuccccccgcccc

SEQ ID NO: 258172 - RNA, 18 nt, Human
agaggggagaagggaggg

SEQ ID NO: 258173 - RNA, 19 nt, Human
agaggggagaagggagggg

SEQ ID NO: 258174 - RNA, 26 nt, Human
agaggggagaagggaggggaaagagu

SEQ ID NO: 258175 - RNA, 20 nt, Human
agaggggcugcgaggcggca

SEQ ID NO: 258176 - RNA, 19 nt, Human
agcagccuugcuccaaaga

SEQ ID NO: 258177 - RNA, 20 nt, Human
agcaggcugagcaagagggu

SEQ ID NO: 258178 - RNA, 24 nt, Human
agcagugaacaaagcaaaaagaaa

SEQ ID NO: 258179 - RNA, 22 nt, Human
agcccaugguggggggaaauuc

SEQ ID NO: 258180 - RNA, 20 nt, Human
agccgcggcuggcgccgggc

SEQ ID NO: 258181 - RNA, 20 nt, Human
aggaaaaaaaaaaaacucau

SEQ ID NO: 258182 - RNA, 18 nt, Human
aggaaagaggggagaagg

SEQ ID NO: 258183 - RNA, 25 nt, Human
aggaaagaggucaucuaaaaaaugu

SEQ ID NO: 258184 - RNA, 21 nt, Human
aggaccuggaggggguggggg

SEQ ID NO: 258185 - RNA, 19 nt, Human
aggcacgggcagcagccuu

SEQ ID NO: 258186 - RNA, 22 nt, Human
aggcacgggcagcagccuugcu

SEQ ID NO: 258187 - RNA, 20 nt, Human
agggaggggaaagagugagg

SEQ ID NO: 258188 - RNA, 18 nt, Human
agggccugguagaggagg

SEQ ID NO: 258189 - RNA, 19 nt, Human
agggggaaggaaacagaca

SEQ ID NO: 258190 - RNA, 20 nt, Human
agggggagaggaagggccug

SEQ ID NO: 258191 - RNA, 21 nt, Human
agggggcagaggaauuccaga

SEQ ID NO: 258192 - RNA, 19 nt, Human
aggggugggguugcccagg

SEQ ID NO: 258193 - RNA, 24 nt, Human
agggugagauuccaaaaaaauguu

SEQ ID NO: 258194 - RNA, 22 nt, Human
aguggaagggaacugaaggcug

SEQ ID NO: 258195 - RNA, 18 nt, Human
aguggggggaauggggag

SEQ ID NO: 258196 - RNA, 18 nt, Human
aucacgguuauauauuug

SEQ ID NO: 258197 - RNA, 21 nt, Human
auucccuucccuuuccauucc

SEQ ID NO: 258198 - RNA, 18 nt, Human
auucuauucucuuucucu

SEQ ID NO: 258199 - RNA, 20 nt, Human
caaacucugaggaccuggag

SEQ ID NO: 258200 - RNA, 23 nt, Human
caacucucccacagcccauggug

SEQ ID NO: 258201 - RNA, 24 nt, Human
caauuggacuuucacccggcaaua

SEQ ID NO: 258202 - RNA, 21 nt, Human
cacccaaggcacgggcagcag

SEQ ID NO: 258203 - RNA, 19 nt, Human
cacucaucucugcucagag

SEQ ID NO: 258204 - RNA, 19 nt, Human
cacugcugucgaacauucc

SEQ ID NO: 258205 - RNA, 27 nt, Human
cagaacgcaggaacugccucggccggc

SEQ ID NO: 258206 - RNA, 21 nt, Human
cagcagcacccaaaguugccu

SEQ ID NO: 258207 - RNA, 24 nt, Human
cagcagcacccaaaguugccugcc

SEQ ID NO: 258208 - RNA, 19 nt, Human
cagcagcaugaaaacaaaa

SEQ ID NO: 258209 - RNA, 23 nt, Human
cagcagcaugaaaacaaaacaag

SEQ ID NO: 258210 - RNA, 19 nt, Human
cagccaaaaggaccggcag

SEQ ID NO: 258211 - RNA, 24 nt, Human
cagcgcgcaccuccaccccgccug

SEQ ID NO: 258212 - RNA, 18 nt, Human
cagcgggucggaggacug

SEQ ID NO: 258213 - RNA, 19 nt, Human
cagcuuccgggccacgucc

SEQ ID NO: 258214 - RNA, 19 nt, Human
caggaauacagaagacugc

SEQ ID NO: 258215 - RNA, 22 nt, Human
caggacgccgcccgcagccucc

SEQ ID NO: 258216 - RNA, 26 nt, Human
caggcgccgggggcuggagccgaggg

SEQ ID NO: 258217 - RNA, 21 nt, Human
cagggggagaggaagggccug

SEQ ID NO: 258218 - RNA, 18 nt, Human
caugcagaccaaaggcug

SEQ ID NO: 258219 - RNA, 22 nt, Human
ccaaccaccacucaucucugcu

SEQ ID NO: 258220 - RNA, 20 nt, Human
ccaagcauuucagaaaugaa

SEQ ID NO: 258221 - RNA, 24 nt, Human
ccaccgagcacgauccgcucgcac

SEQ ID NO: 258222 - RNA, 24 nt, Human
ccacguccgccgccugccgcuucu

SEQ ID NO: 258223 - RNA, 20 nt, Human
ccagaaaaggagagaaaaca

SEQ ID NO: 258224 - RNA, 25 nt, Human
ccaggaacagcuuucagaaaaggga

SEQ ID NO: 258225 - RNA, 22 nt, Human
ccaggggugggguugcccaggc

SEQ ID NO: 258226 - RNA, 23 nt, Human
cccaggauugggcgcuccgggac

SEQ ID NO: 258227 - RNA, 26 nt, Human
cccccgagccgaggacgcagaggggc

SEQ ID NO: 258228 - RNA, 23 nt, Human
cccccgccccccggaguccccgc

SEQ ID NO: 258229 - RNA, 20 nt, Human
cccccggaguccccgcgccc

SEQ ID NO: 258230 - RNA, 20 nt, Human
ccccgcagcccgagccucca

SEQ ID NO: 258231 - RNA, 24 nt, Human
ccccgcagcccgagccuccaccga

SEQ ID NO: 258232 - RNA, 22 nt, Human
ccccgcgccccgcagcccgagc

SEQ ID NO: 258233 - RNA, 21 nt, Human
ccccgggcgguugucacagcc

SEQ ID NO: 258234 - RNA, 19 nt, Human
cccgcagccucccggaguc

SEQ ID NO: 258235 - RNA, 19 nt, Human
cccggaguccccgcgcccc

SEQ ID NO: 258236 - RNA, 19 nt, Human
cccggaguccguggcagag

SEQ ID NO: 258237 - RNA, 24 nt, Human
cccuccuucuucccugggaugccc

SEQ ID NO: 258238 - RNA, 18 nt, Human
cccuucccuuuccauucc

SEQ ID NO: 258239 - RNA, 21 nt, Human
ccgccugaugugagggacggg

SEQ ID NO: 258240 - RNA, 18 nt, Human
ccggaguccccgcgcccc

SEQ ID NO: 258241 - RNA, 18 nt, Human
ccggcaauauuccagaac

SEQ ID NO: 258242 - RNA, 18 nt, Human
ccggcccccgagccgagg

SEQ ID NO: 258243 - RNA, 24 nt, Human
ccggccuuaagcaauuaaggagaa

SEQ ID NO: 258244 - RNA, 25 nt, Human
ccucaggacgccgcccgcagccucc

SEQ ID NO: 258245 - RNA, 21 nt, Human
ccucaggagucugcagauccc

SEQ ID NO: 258246 - RNA, 21 nt, Human
ccucggcucacaccuuucucg

SEQ ID NO: 258247 - RNA, 19 nt, Human
ccugaagcuccgauucugc

SEQ ID NO: 258248 - RNA, 21 nt, Human
ccugucuaacccaccggggaa

SEQ ID NO: 258249 - RNA, 21 nt, Human
cgcaggaacugccucggcuca

SEQ ID NO: 258250 - RNA, 22 nt, Human
cgcccgcagccucccggagucc

SEQ ID NO: 258251 - RNA, 19 nt, Human
cgccgggcaccgacagagc

SEQ ID NO: 258252 - RNA, 18 nt, Human
cgcggcgcgccuccggcc

SEQ ID NO: 258253 - RNA, 18 nt, Human
cggccaggaacagcuuuc

SEQ ID NO: 258254 - RNA, 23 nt, Human
cggccuuaagcaauuaaggagaa

SEQ ID NO: 258255 - RNA, 23 nt, Human
cgugaaaaugcagggccugggca

SEQ ID NO: 258256 - RNA, 18 nt, Human
cuccaccgagcacgaucc

SEQ ID NO: 258257 - RNA, 22 nt, Human
cuccccccgccccccggagucc

SEQ ID NO: 258258 - RNA, 23 nt, Human
cuccgcgcaccguugcaggcgcg

SEQ ID NO: 258259 - RNA, 20 nt, Human
cuccuccaacuccagcaccc

SEQ ID NO: 258260 - RNA, 19 nt, Human
cuccugaagcuccgauucu

SEQ ID NO: 258261 - RNA, 21 nt, Human
cugcgaggcggcaggcgccgg

SEQ ID NO: 258262 - RNA, 19 nt, Human
cuucuguucuccgccguug

SEQ ID NO: 258263 - RNA, 19 nt, Human
cuuugucugcccucugaag

SEQ ID NO: 258264 - RNA, 19 nt, Human
gaaaacaaaacaaggaaag

SEQ ID NO: 258265 - RNA, 27 nt, Human
gacacuggggugucaauauauaacauu

SEQ ID NO: 258266 - RNA, 20 nt, Human
gagacccuucaaagccgcgg

SEQ ID NO: 258267 - RNA, 22 nt, Human
gagagaaaacacugcugucgaa

SEQ ID NO: 258268 - RNA, 19 nt, Human
gagcaguuauuccuuugug

SEQ ID NO: 258269 - RNA, 21 nt, Human
gagcguccgcucggcaucgcc

SEQ ID NO: 258270 - RNA, 18 nt, Human
gaggggcauucauuguuu

SEQ ID NO: 258271 - RNA, 21 nt, Human
gagggggugggggagcucaaa

SEQ ID NO: 258272 - RNA, 22 nt, Human
gcagaacgcaggaacugccucg

SEQ ID NO: 258273 - RNA, 19 nt, Human
gcagacucagaccccagcc

SEQ ID NO: 258274 - RNA, 18 nt, Human
gcagcaugaaaacaaaac

SEQ ID NO: 258275 - RNA, 20 nt, Human
gcaggaauacagaagacugg

SEQ ID NO: 258276 - RNA, 23 nt, Human
gccacuaagcagguaccaaccua

SEQ ID NO: 258277 - RNA, 18 nt, Human
gccccgcagcccgagccu

SEQ ID NO: 258278 - RNA, 23 nt, Human
gccccgcagcccgagccuccacc

SEQ ID NO: 258279 - RNA, 24 nt, Human
gcccucaggagucugcagaucccu

SEQ ID NO: 258280 - RNA, 24 nt, Human
ggaaacagacagggggagaggaag

SEQ ID NO: 258281 - RNA, 21 nt, Human
ggaaggaaacagacaggggga

SEQ ID NO: 258282 - RNA, 23 nt, Human
ggacauacagcagcaugaaaaca

SEQ ID NO: 258283 - RNA, 22 nt, Human
ggagaggaagggccugguagag

SEQ ID NO: 258284 - RNA, 23 nt, Human
ggagcacaccaucccccaugcag

SEQ ID NO: 258285 - RNA, 19 nt, Human
ggaggggaucuuucuuguc

SEQ ID NO: 258286 - RNA, 25 nt, Human
ggaggggguaagaaaaggaaaaaga

SEQ ID NO: 258287 - RNA, 18 nt, Human
ggagggggugggggagcu

SEQ ID NO: 258288 - RNA, 20 nt, Human
ggcggcaggcgccgggggcu

SEQ ID NO: 258289 - RNA, 19 nt, Human
ggcugagcaagagggugcc

SEQ ID NO: 258290 - RNA, 21 nt, Human
ggcugcgaggcggcaggcgcc

SEQ ID NO: 258291 - RNA, 20 nt, Human
gggaacagacaaaacaaaag

SEQ ID NO: 258292 - RNA, 20 nt, Human
gggaauggggagggaagggg

SEQ ID NO: 258293 - RNA, 25 nt, Human
gggaauggggagggaaggggguugg

SEQ ID NO: 258294 - RNA, 21 nt, Human
gggcagagggggaucaauagg

SEQ ID NO: 258295 - RNA, 23 nt, Human
gggcaggggagggagacccuuca

SEQ ID NO: 258296 - RNA, 21 nt, Human
gggcauucauuguuuggcucc

SEQ ID NO: 258297 - RNA, 24 nt, Human
gggcgguugucacagccgcgggug

SEQ ID NO: 258298 - RNA, 24 nt, Human
gggcuggagccgagggucggggaa

SEQ ID NO: 258299 - RNA, 18 nt, Human
ggggaaucuaugugcccc

SEQ ID NO: 258300 - RNA, 22 nt, Human
ggggagaagggaggggaaagag

SEQ ID NO: 258301 - RNA, 30 nt, Human
ggggagaagggaggggaaagagugagguuu

SEQ ID NO: 258302 - RNA, 19 nt, Human
ggggagaggaagggccugg

SEQ ID NO: 258303 - RNA, 26 nt, Human
gggggcccaugccccgggcgguuguc

SEQ ID NO: 258304 - RNA, 21 nt, Human
ggggguugggagagcagagcg

SEQ ID NO: 258305 - RNA, 25 nt, Human
gguauuagcuccucuccugaagcuc

SEQ ID NO: 258306 - RNA, 22 nt, Human
ggucauggagucuugcccagaa

SEQ ID NO: 258307 - RNA, 25 nt, Human
gguucccccccuuuaaauuaacccu

SEQ ID NO: 258308 - RNA, 20 nt, Human
guaaaaugaugaggcucuca

SEQ ID NO: 258309 - RNA, 23 nt, Human
guaagacacgcucguuaacaaaa

SEQ ID NO: 258310 - RNA, 19 nt, Human
guaucuagaggaaaaaggc

SEQ ID NO: 258311 - RNA, 19 nt, Human
gucaacucucccacagccc

SEQ ID NO: 258312 - RNA, 18 nt, Human
gucacagccgcggguggg

SEQ ID NO: 258313 - RNA, 18 nt, Human
guccccuccuucuucccu

SEQ ID NO: 258314 - RNA, 19 nt, Human
guuguauggugagcccaga

SEQ ID NO: 258315 - RNA, 26 nt, Human
uaaauagauaaccaucacuguaauga

SEQ ID NO: 258316 - RNA, 22 nt, Human
uaagaaaaggaaaaagaauaaa

SEQ ID NO: 258317 - RNA, 21 nt, Human
uacagcagcaugaaaacaaaa

SEQ ID NO: 258318 - RNA, 25 nt, Human
uacagcagcaugaaaacaaaacaag

SEQ ID NO: 258319 - RNA, 19 nt, Human
uacggucaacucucccaca

SEQ ID NO: 258320 - RNA, 20 nt, Human
uagggaacagacaaaacaaa

SEQ ID NO: 258321 - RNA, 21 nt, Human
uaggguguguuuuucauuuac

SEQ ID NO: 258322 - RNA, 21 nt, Human
uaguguguaggguguguuuuu

SEQ ID NO: 258323 - RNA, 23 nt, Human
ucagagaaggcugagcaggcuga

SEQ ID NO: 258324 - RNA, 24 nt, Human
ucauucuggggucguggggagcga

SEQ ID NO: 258325 - RNA, 20 nt, Human
uccagaacuacuauucucca

SEQ ID NO: 258326 - RNA, 21 nt, Human
ucccuccccccgccccccgga

SEQ ID NO: 258327 - RNA, 20 nt, Human
uccgcgcaccguugcaggcg

SEQ ID NO: 258328 - RNA, 22 nt, Human
uccgcgcaccguugcaggcgcg

SEQ ID NO: 258329 - RNA, 23 nt, Human
uccguggcagagcugcuaagggc

SEQ ID NO: 258330 - RNA, 24 nt, Human
ucggggaaaggcgcggcuccucug

SEQ ID NO: 258331 - RNA, 18 nt, Human
ucuaguguguagggugug

SEQ ID NO: 258332 - RNA, 20 nt, Human
ugaaauaaacaacgugggug

SEQ ID NO: 258333 - RNA, 20 nt, Human
ugaacaaagcaaaaagaaaa

SEQ ID NO: 258334 - RNA, 21 nt, Human
ugaaggcgggguuugcuccuc

SEQ ID NO: 258335 - RNA, 19 nt, Human
ugagcccagagccuucaga

SEQ ID NO: 258336 - RNA, 18 nt, Human
ugaugugagggacggggg

SEQ ID NO: 258337 - RNA, 25 nt, Human
ugcccagaauacggucaacucuccc

SEQ ID NO: 258338 - RNA, 19 nt, Human
ugccuaacacacagcagag

SEQ ID NO: 258339 - RNA, 19 nt, Human
uggaagggaacugaaggcu

SEQ ID NO: 258340 - RNA, 20 nt, Human
uggcaaaguguugaugacuc

SEQ ID NO: 258341 - RNA, 19 nt, Human
uggcuccugccugacugau

SEQ ID NO: 258342 - RNA, 21 nt, Human
uggggagcccucaggacgccg

SEQ ID NO: 258343 - RNA, 21 nt, Human
uggggagggaaggggguuggg

SEQ ID NO: 258344 - RNA, 23 nt, Human
uggggagggaaggggguugggag

SEQ ID NO: 258345 - RNA, 19 nt, Human
uggggggaauggggaggga

SEQ ID NO: 258346 - RNA, 19 nt, Human
ugggucugccggggagggg

SEQ ID NO: 258347 - RNA, 21 nt, Human
ugucacagccgcggguggguc

SEQ ID NO: 258348 - RNA, 23 nt, Human
uguucggagucuaguguguaggg

SEQ ID NO: 258349 - RNA, 24 nt, Human
uguuggggggcccaugccccgggc

SEQ ID NO: 258350 - RNA, 20 nt, Human
uuaugaaauaacaauacuug

SEQ ID NO: 258351 - RNA, 22 nt, Human
uucaccauuaacgucauauuua

SEQ ID NO: 258352 - RNA, 24 nt, Human
uuggggagggggcagaggaauucc

SEQ ID NO: 258353 - RNA, 22 nt, Human
uugggucugcuggggagcccuc

SEQ ID NO: 258354 - RNA, 20 nt, Human
uugucacagccgcggguggg

SEQ ID NO: 258355 - RNA, 22 nt, Human
ccuccuacagacucucggaagc

SEQ ID NO: 258356 - RNA, 21 nt, Human
ccucugaaaaauauaaguaaa

SEQ ID NO: 258357 - RNA, 19 nt, Human
cucaaacacauauagguga

SEQ ID NO: 258358 - RNA, 22 nt, Human
cucugaaaaauauaaguaaaaa

SEQ ID NO: 258359 - RNA, 22 nt, Human
uaacacagcugcuaguggaagg

SEQ ID NO: 258360 - RNA, 24 nt, Human
uaagucugucacaaccucaaacac

SEQ ID NO: 258361 - RNA, 18 nt, Human
uauuuauuccucucuucc

SEQ ID NO: 258362 - RNA, 23 nt, Human
ucccugguucagcuccaaggucc

SEQ ID NO: 258363 - RNA, 30 nt, Human
uuucacaaauauauauccccuauauuacuu

SEQ ID NO: 258364 - RNA, 23 nt, Human
aagcuaacaaggaaaaauggcac

SEQ ID NO: 258365 - RNA, 18 nt, Human
acaucauuuaaaugaauu

SEQ ID NO: 258366 - RNA, 25 nt, Human
agaaagcaaacuaaucuauaacuca

SEQ ID NO: 258367 - RNA, 25 nt, Human
agaaaugaaagcuaacaaggaaaaa

SEQ ID NO: 258368 - RNA, 20 nt, Human
cauaaaagcaaaauguaaua

SEQ ID NO: 258369 - RNA, 19 nt, Human
ccuggagucacugucuugu

SEQ ID NO: 258370 - RNA, 20 nt, Human
ggacagaaucacuguccgua

SEQ ID NO: 258371 - RNA, 25 nt, Human
uaagaagaaaauuuuauuccagaaa

SEQ ID NO: 258372 - RNA, 27 nt, Human
uaauggaugcuucuuccacaauagucu

SEQ ID NO: 258373 - RNA, 26 nt, Human
uaugcuagaauauaucuacugaaaca

SEQ ID NO: 258374 - RNA, 29 nt, Human
ucacugucuuguuuaggacagaaucacuu

SEQ ID NO: 258375 - RNA, 19 nt, Human
ugaaagcuaacaaggaaaa

SEQ ID NO: 258376 - RNA, 21 nt, Human
uucuuccacaauagucuucag

SEQ ID NO: 258377 - RNA, 21 nt, Human
aaacacaagaaaaacagcaac

SEQ ID NO: 258378 - RNA, 18 nt, Human
aaaggccugggaagagaa

SEQ ID NO: 258379 - RNA, 23 nt, Human
aacacaagaaaaacagcaacacc

SEQ ID NO: 258380 - RNA, 21 nt, Human
aacaugaggcuccggaggaaa

SEQ ID NO: 258381 - RNA, 20 nt, Human
aaccaaggaccucuucucag

SEQ ID NO: 258382 - RNA, 18 nt, Human
aaccucccccuccucccc

SEQ ID NO: 258383 - RNA, 20 nt, Human
aacgggggagcacggggaga

SEQ ID NO: 258384 - RNA, 23 nt, Human
aagaagucagggagcgugacguc

SEQ ID NO: 258385 - RNA, 25 nt, Human
aagcagcuuuucuggagaaaagggg

SEQ ID NO: 258386 - RNA, 24 nt, Human
aagcguccccgggagaagcagggu

SEQ ID NO: 258387 - RNA, 21 nt, Human
aaggaacaguccccugggagg

SEQ ID NO: 258388 - RNA, 23 nt, Human
aaggaacaguccccugggaggug

SEQ ID NO: 258389 - RNA, 18 nt, Human
aagggcuggguggugacu

SEQ ID NO: 258390 - RNA, 20 nt, Human
aagucccuccuuccccaccu

SEQ ID NO: 258391 - RNA, 21 nt, Human
acacagcagauguuccaaaca

SEQ ID NO: 258392 - RNA, 18 nt, Human
accagacagcaauagcag

SEQ ID NO: 258393 - RNA, 18 nt, Human
accuuccugaugucucaa

SEQ ID NO: 258394 - RNA, 22 nt, Human
agacagcaauagcagcagcagc

SEQ ID NO: 258395 - RNA, 22 nt, Human
agaccagaugcugguccauguc

SEQ ID NO: 258396 - RNA, 18 nt, Human
agacccaggcugcagggg

SEQ ID NO: 258397 - RNA, 19 nt, Human
agagagaaauaaggaacag

SEQ ID NO: 258398 - RNA, 23 nt, Human
agccgcuggguuuuuaccuuccu

SEQ ID NO: 258399 - RNA, 19 nt, Human
aggaggccugggggugggu

SEQ ID NO: 258400 - RNA, 24 nt, Human
aggaggccuggggguggguggggg

SEQ ID NO: 258401 - RNA, 24 nt, Human
aggcauucccugccuucuuuggcc

SEQ ID NO: 258402 - RNA, 22 nt, Human
aggccaaagcaggcugcccaga

SEQ ID NO: 258403 - RNA, 22 nt, Human
aggcccccgaugcuggggacag

SEQ ID NO: 258404 - RNA, 22 nt, Human
aggccggggcagggccggggga

SEQ ID NO: 258405 - RNA, 23 nt, Human
aggcugaggggaggggcgagcuc

SEQ ID NO: 258406 - RNA, 19 nt, Human
aggcuggcgggcaggcagg

SEQ ID NO: 258407 - RNA, 23 nt, Human
aggcuggcgggcaggcaggaggg

SEQ ID NO: 258408 - RNA, 20 nt, Human
agggaacaggaagggauuuu

SEQ ID NO: 258409 - RNA, 18 nt, Human
agggagaggcgggcaggc

SEQ ID NO: 258410 - RNA, 24 nt, Human
agggagggagggccaggcgcuccc

SEQ ID NO: 258411 - RNA, 25 nt, Human
agggccaccucuggggguuuggggg

SEQ ID NO: 258412 - RNA, 22 nt, Human
aggguguugaggggaugggagg

SEQ ID NO: 258413 - RNA, 22 nt, Human
auagcagcagcagcacacgaag

SEQ ID NO: 258414 - RNA, 22 nt, Human
caaacugcaggaggcacccaaa

SEQ ID NO: 258415 - RNA, 21 nt, Human
caaagcaggcugcccagaggc

SEQ ID NO: 258416 - RNA, 21 nt, Human
caagaaaaacagcaacaccca

SEQ ID NO: 258417 - RNA, 18 nt, Human
caagagccaagcccaggg

SEQ ID NO: 258418 - RNA, 18 nt, Human
caaggaaccaaccucccc

SEQ ID NO: 258419 - RNA, 24 nt, Human
caauagcagcagcagcacacgaag

SEQ ID NO: 258420 - RNA, 24 nt, Human
cacaaacacaagaaaaacagcaac

SEQ ID NO: 258421 - RNA, 25 nt, Human
cacaaacacaagaaaaacagcaacc

SEQ ID NO: 258422 - RNA, 18 nt, Human
cacacgaaggccggggca

SEQ ID NO: 258423 - RNA, 25 nt, Human
caccucagccugcccuccugagguc

SEQ ID NO: 258424 - RNA, 27 nt, Human
cacuccgcagggaagaacgggggagca

SEQ ID NO: 258425 - RNA, 21 nt, Human
cacuggcucaggaugcaggga

SEQ ID NO: 258426 - RNA, 19 nt, Human
cacugggccggacaggugg

SEQ ID NO: 258427 - RNA, 20 nt, Human
cagacagcaauagcagcagc

SEQ ID NO: 258428 - RNA, 24 nt, Human
cagagcaaggccccuuaucacccc

SEQ ID NO: 258429 - RNA, 21 nt, Human
cagcaacacccaucgucacca

SEQ ID NO: 258430 - RNA, 23 nt, Human
cagcaacacccaucgucaccaau

SEQ ID NO: 258431 - RNA, 22 nt, Human
cagcacacgaaggccggggcag

SEQ ID NO: 258432 - RNA, 25 nt, Human
cagcaggguggcccuucccucccuu

SEQ ID NO: 258433 - RNA, 22 nt, Human
cagcaucacaugcguucacaaa

SEQ ID NO: 258434 - RNA, 24 nt, Human
caggaccaggagggaacaggaagg

SEQ ID NO: 258435 - RNA, 18 nt, Human
caggcauucccugccuuc

SEQ ID NO: 258436 - RNA, 21 nt, Human
caggcugaggccccaccuguc

SEQ ID NO: 258437 - RNA, 23 nt, Human
caggcuggaagggcuagggaggg

SEQ ID NO: 258438 - RNA, 18 nt, Human
cagguggggagggggggg

SEQ ID NO: 258439 - RNA, 22 nt, Human
ccaaagcaggcugcccagaggc

SEQ ID NO: 258440 - RNA, 23 nt, Human
ccaagcccagggcuggggacugg

SEQ ID NO: 258441 - RNA, 22 nt, Human
ccaccugucccuuggagcagug

SEQ ID NO: 258442 - RNA, 23 nt, Human
ccagaggcagagaaagccgcauc

SEQ ID NO: 258443 - RNA, 19 nt, Human
ccaggaccaggagggaaca

SEQ ID NO: 258444 - RNA, 19 nt, Human
ccaggcccaccugucccuu

SEQ ID NO: 258445 - RNA, 24 nt, Human
cccaaacccacaggccgccaggcc

SEQ ID NO: 258446 - RNA, 19 nt, Human
cccacaggccgccaggccc

SEQ ID NO: 258447 - RNA, 21 nt, Human
cccacauacaaggaaaggcca

SEQ ID NO: 258448 - RNA, 18 nt, Human
cccacuuccacagcauca

SEQ ID NO: 258449 - RNA, 20 nt, Human
cccagggcuggggacugggg

SEQ ID NO: 258450 - RNA, 25 nt, Human
ccccaaggaaccaaccucccccucu

SEQ ID NO: 258451 - RNA, 19 nt, Human
ccccaggcugaggccccac

SEQ ID NO: 258452 - RNA, 23 nt, Human
cccccaaggaaccaaccuccccc

SEQ ID NO: 258453 - RNA, 23 nt, Human
cccccucgccgcccagccccugc

SEQ ID NO: 258454 - RNA, 21 nt, Human
ccccgggcccccucgccgccc

SEQ ID NO: 258455 - RNA, 22 nt, Human
ccccugacuccucccccuucca

SEQ ID NO: 258456 - RNA, 19 nt, Human
ccccugccccagcccaucu

SEQ ID NO: 258457 - RNA, 19 nt, Human
cccuagcucuggcccucug

SEQ ID NO: 258458 - RNA, 21 nt, Human
cccuccaggcauucccugccu

SEQ ID NO: 258459 - RNA, 19 nt, Human
cccuccuccccgagguaag

SEQ ID NO: 258460 - RNA, 24 nt, Human
ccgcagcuuucugggccaaguggc

SEQ ID NO: 258461 - RNA, 18 nt, Human
ccgcgagccgggcacagg

SEQ ID NO: 258462 - RNA, 20 nt, Human
ccuccaggcauucccugccu

SEQ ID NO: 258463 - RNA, 19 nt, Human
ccucccauccagacccagg

SEQ ID NO: 258464 - RNA, 23 nt, Human
ccucccccuuccacgcucagccc

SEQ ID NO: 258465 - RNA, 20 nt, Human
ccucgccgcccagccccugc

SEQ ID NO: 258466 - RNA, 24 nt, Human
ccucugaggauggugaccugguuu

SEQ ID NO: 258467 - RNA, 19 nt, Human
ccucugaguggccucgucc

SEQ ID NO: 258468 - RNA, 22 nt, Human
ccugggaagagaacaugaggcu

SEQ ID NO: 258469 - RNA, 20 nt, Human
ccuuuacccacaccaggaga

SEQ ID NO: 258470 - RNA, 21 nt, Human
cgccggggccgaggcugcggc

SEQ ID NO: 258471 - RNA, 19 nt, Human
cgcucccacaggugaggac

SEQ ID NO: 258472 - RNA, 18 nt, Human
cggcacuggagcuggcac

SEQ ID NO: 258473 - RNA, 19 nt, Human
cgggauggggggagaagca

SEQ ID NO: 258474 - RNA, 20 nt, Human
cgggcccccucgccgcccag

SEQ ID NO: 258475 - RNA, 20 nt, Human
cuacagucuggggucgcuac

SEQ ID NO: 258476 - RNA, 23 nt, Human
cucagcccuguccuugacccaac

SEQ ID NO: 258477 - RNA, 21 nt, Human
cucccccuuccacgcucagcc

SEQ ID NO: 258478 - RNA, 22 nt, Human
cucccccuuccacgcucagccc

SEQ ID NO: 258479 - RNA, 22 nt, Human
cuccccgagguaaggacuccca

SEQ ID NO: 258480 - RNA, 19 nt, Human
cuccggaggaaagccgggg

SEQ ID NO: 258481 - RNA, 21 nt, Human
cucuccucccauccagaccca

SEQ ID NO: 258482 - RNA, 22 nt, Human
cugacuccucccccuuccacgc

SEQ ID NO: 258483 - RNA, 21 nt, Human
cugcaggaggcacccaaaccc

SEQ ID NO: 258484 - RNA, 18 nt, Human
cugcccacuuccacagcu

SEQ ID NO: 258485 - RNA, 20 nt, Human
cugcugcucugcagcucccc

SEQ ID NO: 258486 - RNA, 20 nt, Human
cugggggugggugggggggc

SEQ ID NO: 258487 - RNA, 23 nt, Human
gacugcccacuuccacagcauca

SEQ ID NO: 258488 - RNA, 18 nt, Human
gacuggggacaggggccc

SEQ ID NO: 258489 - RNA, 18 nt, Human
gagaagcaggguguugag

SEQ ID NO: 258490 - RNA, 22 nt, Human
gagccaagcccagggcugggga

SEQ ID NO: 258491 - RNA, 26 nt, Human
gaggguagggaggggaagcaggagcg

SEQ ID NO: 258492 - RNA, 19 nt, Human
gcacccccuuccccuagga

SEQ ID NO: 258493 - RNA, 25 nt, Human
gcacuagauuucggcacuagauuug

SEQ ID NO: 258494 - RNA, 23 nt, Human
gcacuagauuugcaggcccccgg

SEQ ID NO: 258495 - RNA, 18 nt, Human
gcagggcccacucaaaag

SEQ ID NO: 258496 - RNA, 20 nt, Human
gcccagaggcagagaaagcc

SEQ ID NO: 258497 - RNA, 21 nt, Human
gccccugacuccucccccuuc

SEQ ID NO: 258498 - RNA, 23 nt, Human
gccccugccccagcccaucagug

SEQ ID NO: 258499 - RNA, 18 nt, Human
gccgaggcugcggcccgc

SEQ ID NO: 258500 - RNA, 18 nt, Human
gccggacagguggcacau

SEQ ID NO: 258501 - RNA, 18 nt, Human
gccggggccgaggcugcg

SEQ ID NO: 258502 - RNA, 24 nt, Human
gcgcagcgcacuccgaccccuugg

SEQ ID NO: 258503 - RNA, 23 nt, Human
gcggguggaugaugagguaucug

SEQ ID NO: 258504 - RNA, 20 nt, Human
gcucuggcccucuguucuga

SEQ ID NO: 258505 - RNA, 18 nt, Human
gcugcaggggacggggaa

SEQ ID NO: 258506 - RNA, 21 nt, Human
gcuuccucccgcuacacugaa

SEQ ID NO: 258507 - RNA, 18 nt, Human
ggaaagccgggggccugg

SEQ ID NO: 258508 - RNA, 23 nt, Human
ggacagauguggucccgacagca

SEQ ID NO: 258509 - RNA, 20 nt, Human
ggacggggaggggcagcggg

SEQ ID NO: 258510 - RNA, 19 nt, Human
ggaggacagaggcaaaggg

SEQ ID NO: 258511 - RNA, 20 nt, Human
ggagggggggggggcccacu

SEQ ID NO: 258512 - RNA, 24 nt, Human
ggaugggaggacagaggcaaaggg

SEQ ID NO: 258513 - RNA, 18 nt, Human
ggcaaaggggcuggagca

SEQ ID NO: 258514 - RNA, 20 nt, Human
ggcagggccgggggaagaag

SEQ ID NO: 258515 - RNA, 19 nt, Human
ggcccgggggcacuggcuc

SEQ ID NO: 258516 - RNA, 21 nt, Human
ggcccgggggcacuggcucag

SEQ ID NO: 258517 - RNA, 19 nt, Human
ggccgaggcugcggcccgc

SEQ ID NO: 258518 - RNA, 19 nt, Human
ggccugggggugggugggg

SEQ ID NO: 258519 - RNA, 22 nt, Human
ggcuagggagggagggccaggc

SEQ ID NO: 258520 - RNA, 19 nt, Human
gggaagaacgggggagcac

SEQ ID NO: 258521 - RNA, 19 nt, Human
gggcacaggucaggcuggc

SEQ ID NO: 258522 - RNA, 23 nt, Human
gggccaccucuggggguuugggg

SEQ ID NO: 258523 - RNA, 24 nt, Human
gggccaccucuggggguuuggggg

SEQ ID NO: 258524 - RNA, 20 nt, Human
gggccgaggcugcggcccgc

SEQ ID NO: 258525 - RNA, 21 nt, Human
gggcugaacgcaggacagcgc

SEQ ID NO: 258526 - RNA, 18 nt, Human
ggggacggggaaggggaa

SEQ ID NO: 258527 - RNA, 18 nt, Human
ggggacggggaaggggaa

SEQ ID NO: 258528 - RNA, 21 nt, Human
ggggaugggaggacagaggca

SEQ ID NO: 258529 - RNA, 22 nt, Human
ggggcagcggguggaugaugag

SEQ ID NO: 258530 - RNA, 18 nt, Human
gggggugggugggggggc

SEQ ID NO: 258531 - RNA, 18 nt, Human
ggguuggucuggggacag

SEQ ID NO: 258532 - RNA, 21 nt, Human
ggugggugagagaguggggga

SEQ ID NO: 258533 - RNA, 19 nt, Human
guguguguguguccaggug

SEQ ID NO: 258534 - RNA, 23 nt, Human
gugugugugugugucccaggcug

SEQ ID NO: 258535 - RNA, 18 nt, Human
gugugugugugugugugu

SEQ ID NO: 258536 - RNA, 23 nt, Human
uaacgaaucacagugacugcaac

SEQ ID NO: 258537 - RNA, 21 nt, Human
uacaaggaaaggccaaagcag

SEQ ID NO: 258538 - RNA, 21 nt, Human
uacaggcucagccucugagga

SEQ ID NO: 258539 - RNA, 22 nt, Human
uagcaaaagggcucucucccag

SEQ ID NO: 258540 - RNA, 19 nt, Human
uaggaucuaaggauucuuu

SEQ ID NO: 258541 - RNA, 23 nt, Human
uaguaaaaauacaguauguacaa

SEQ ID NO: 258542 - RNA, 21 nt, Human
ucacauccagggacaccggcu

SEQ ID NO: 258543 - RNA, 24 nt, Human
uccacacagcagauguuccaaaca

SEQ ID NO: 258544 - RNA, 24 nt, Human
uccacgcucagcccuguccuugac

SEQ ID NO: 258545 - RNA, 26 nt, Human
ucccagagccacgggucuggcaggag

SEQ ID NO: 258546 - RNA, 22 nt, Human
uccccaccucagccugcccucc

SEQ ID NO: 258547 - RNA, 25 nt, Human
uccccauuuccccuccaaaggcccc

SEQ ID NO: 258548 - RNA, 19 nt, Human
ucccccuccuccccgaggu

SEQ ID NO: 258549 - RNA, 19 nt, Human
uccccgggcagggcccacu

SEQ ID NO: 258550 - RNA, 21 nt, Human
uccccgggcagggcccacuca

SEQ ID NO: 258551 - RNA, 22 nt, Human
uccccgggcccccucgccgccc

SEQ ID NO: 258552 - RNA, 18 nt, Human
ucccuuggagcagugccc

SEQ ID NO: 258553 - RNA, 22 nt, Human
ucgguaacuaaagucuuggagc

SEQ ID NO: 258554 - RNA, 22 nt, Human
ucuacagucuggggucgcuaca

SEQ ID NO: 258555 - RNA, 18 nt, Human
ucucagagaaaggugcug

SEQ ID NO: 258556 - RNA, 20 nt, Human
ucuggagaaaagggguucau

SEQ ID NO: 258557 - RNA, 19 nt, Human
ucuuugcugccuucuggaa

SEQ ID NO: 258558 - RNA, 23 nt, Human
ugacuccucccccuuccacgcuc

SEQ ID NO: 258559 - RNA, 19 nt, Human
ugagggcacaggaagcuug

SEQ ID NO: 258560 - RNA, 20 nt, Human
ugaggggaggggcgagcucc

SEQ ID NO: 258561 - RNA, 22 nt, Human
ugaggggaggggcgagcuccac

SEQ ID NO: 258562 - RNA, 20 nt, Human
ugagguaucugugcaggccc

SEQ ID NO: 258563 - RNA, 19 nt, Human
ugcagcuccccgggcaggg

SEQ ID NO: 258564 - RNA, 20 nt, Human
ugcaggcccccgaugcuggg

SEQ ID NO: 258565 - RNA, 24 nt, Human
ugcccacuuccacagcaucacaug

SEQ ID NO: 258566 - RNA, 19 nt, Human
ugccccguccggucaggcc

SEQ ID NO: 258567 - RNA, 21 nt, Human
ugcgugcgugugugugugugu

SEQ ID NO: 258568 - RNA, 24 nt, Human
ugcgugcgugugugugugugugug

SEQ ID NO: 258569 - RNA, 27 nt, Human
ugcgugugcgugcgugugugugugugu

SEQ ID NO: 258570 - RNA, 21 nt, Human
ugcgugugugugugugugugu

SEQ ID NO: 258571 - RNA, 21 nt, Human
ugcgugugugugugugugugu

SEQ ID NO: 258572 - RNA, 21 nt, Human
ugcgugugugugugugugugu

SEQ ID NO: 258573 - RNA, 24 nt, Human
ugcguucacaaacacaagaaaaac

SEQ ID NO: 258574 - RNA, 22 nt, Human
ugcugguccaugucucccaaac

SEQ ID NO: 258575 - RNA, 22 nt, Human
ugcuuuccccauuuccccucca

SEQ ID NO: 258576 - RNA, 19 nt, Human
uggaaacaagaccagaugc

SEQ ID NO: 258577 - RNA, 23 nt, Human
uggaugaugagguaucugugcag

SEQ ID NO: 258578 - RNA, 23 nt, Human
uggccccccaaggaaccaaccuc

SEQ ID NO: 258579 - RNA, 19 nt, Human
uggggacuggggacagggg

SEQ ID NO: 258580 - RNA, 23 nt, Human
uggggacuggggacaggggccca

SEQ ID NO: 258581 - RNA, 18 nt, Human
ugggggccucugaguggc

SEQ ID NO: 258582 - RNA, 21 nt, Human
ugggggugggacccgggaugg

SEQ ID NO: 258583 - RNA, 18 nt, Human
ugggguggguacaggcuc

SEQ ID NO: 258584 - RNA, 21 nt, Human
ugggugggggggcuggccugg

SEQ ID NO: 258585 - RNA, 23 nt, Human
uggugggugagagagugggggac

SEQ ID NO: 258586 - RNA, 21 nt, Human
ugguguguguguguccaggug

SEQ ID NO: 258587 - RNA, 24 nt, Human
ugugcaggcccgggggcacuggcu

SEQ ID NO: 258588 - RNA, 21 nt, Human
ugugcgugcgugugugugugu

SEQ ID NO: 258589 - RNA, 24 nt, Human
ugugugcgugugcgugcgugugug

SEQ ID NO: 258590 - RNA, 21 nt, Human
uguguguguguguguguccca

SEQ ID NO: 258591 - RNA, 18 nt, Human
ugugugugugugugugug

SEQ ID NO: 258592 - RNA, 18 nt, Human
ugugugugugugugugug

SEQ ID NO: 258593 - RNA, 18 nt, Human
ugugugugugugugugug

SEQ ID NO: 258594 - RNA, 18 nt, Human
ugugugugugugugugug

SEQ ID NO: 258595 - RNA, 18 nt, Human
ugugugugugugugugug

SEQ ID NO: 258596 - RNA, 18 nt, Human
ugugugugugugugugug

SEQ ID NO: 258597 - RNA, 18 nt, Human
ugugugugugugugugug

SEQ ID NO: 258598 - RNA, 18 nt, Human
ugugugugugugugugug

SEQ ID NO: 258599 - RNA, 18 nt, Human
ugugugugugugugugug

SEQ ID NO: 258600 - RNA, 18 nt, Human
ugugugugugugugugug

SEQ ID NO: 258601 - RNA, 21 nt, Human
ugugugugugugugugugugu

SEQ ID NO: 258602 - RNA, 21 nt, Human
ugugugugugugugugugugu

SEQ ID NO: 258603 - RNA, 21 nt, Human
ugugugugugugugugugugu

SEQ ID NO: 258604 - RNA, 21 nt, Human
ugugugugugugugugugugu

SEQ ID NO: 258605 - RNA, 21 nt, Human
ugugugugugugugugugugu

SEQ ID NO: 258606 - RNA, 21 nt, Human
ugugugugugugugugugugu

SEQ ID NO: 258607 - RNA, 21 nt, Human
ugugugugugugugugugugu

SEQ ID NO: 258608 - RNA, 21 nt, Human
ugugugugugugugugugugu

SEQ ID NO: 258609 - RNA, 21 nt, Human
ugugugugugugugugugugu

SEQ ID NO: 258610 - RNA, 21 nt, Human
ugugugugugugugugugugu

SEQ ID NO: 258611 - RNA, 21 nt, Human
ugugugugugugugugugugu

SEQ ID NO: 258612 - RNA, 21 nt, Human
ugugugugugugugugugugu

SEQ ID NO: 258613 - RNA, 21 nt, Human
ugugugugugugugugugugu

SEQ ID NO: 258614 - RNA, 21 nt, Human
ugugugugugugugugugugu

SEQ ID NO: 258615 - RNA, 21 nt, Human
ugugugugugugugugugugu

SEQ ID NO: 258616 - RNA, 21 nt, Human
ugugugugugugugugugugu

SEQ ID NO: 258617 - RNA, 22 nt, Human
ugugugugugugugugugugug

SEQ ID NO: 258618 - RNA, 22 nt, Human
ugugugugugugugugugugug

SEQ ID NO: 258619 - RNA, 22 nt, Human
ugugugugugugugugugugug

SEQ ID NO: 258620 - RNA, 22 nt, Human
ugugugugugugugugugugug

SEQ ID NO: 258621 - RNA, 22 nt, Human
ugugugugugugugugugugug

SEQ ID NO: 258622 - RNA, 22 nt, Human
ugugugugugugugugugugug

SEQ ID NO: 258623 - RNA, 22 nt, Human
ugugugugugugugugugugug

SEQ ID NO: 258624 - RNA, 22 nt, Human
ugugugugugugugugugugug

SEQ ID NO: 258625 - RNA, 22 nt, Human
uguguguguguguguguguguu

SEQ ID NO: 258626 - RNA, 21 nt, Human
uucaagaccuuugcugaccuu

SEQ ID NO: 258627 - RNA, 22 nt, Human
uucacaaacacaagaaaaacag

SEQ ID NO: 258628 - RNA, 18 nt, Human
uuccccauuuccccucca

SEQ ID NO: 258629 - RNA, 22 nt, Human
uuccccuccaaaggccugggaa

SEQ ID NO: 258630 - RNA, 19 nt, Human
uugacccaaccaaggaccu

SEQ ID NO: 258631 - RNA, 20 nt, Human
uugcacccccuuccccuagg

SEQ ID NO: 258632 - RNA, 19 nt, Human
uuucuggagaaaagggguu

SEQ ID NO: 258633 - RNA, 23 nt, Human
uuuucuggagaaaagggguucau

SEQ ID NO: 258634 - RNA, 19 nt, Human
uuuuuuuuuuuccacacag

SEQ ID NO: 258635 - RNA, 22 nt, Human
uuuuuuuuuuuuuuuuuuuggc

SEQ ID NO: 258636 - RNA, 21 nt, Human
aaagcaggagaagagaaaacc

SEQ ID NO: 258637 - RNA, 20 nt, Human
aacagccgugaacagggcca

SEQ ID NO: 258638 - RNA, 20 nt, Human
aagcaggagaagagaaaacc

SEQ ID NO: 258639 - RNA, 22 nt, Human
aagcaggagaagagaaaaccca

SEQ ID NO: 258640 - RNA, 23 nt, Human
aagcaggagaagagaaaacccaa

SEQ ID NO: 258641 - RNA, 25 nt, Human
aagcaggagaagagaaaacccaaaa

SEQ ID NO: 258642 - RNA, 21 nt, Human
aagcuugaaggcuaccggucc

SEQ ID NO: 258643 - RNA, 23 nt, Human
aaggacccaccccuuaaguauuc

SEQ ID NO: 258644 - RNA, 19 nt, Human
acagacuugggcagaagga

SEQ ID NO: 258645 - RNA, 23 nt, Human
accuuggcugccuggacuccagc

SEQ ID NO: 258646 - RNA, 21 nt, Human
agacccugaacauggagcggg

SEQ ID NO: 258647 - RNA, 21 nt, Human
agaggaaaaggggccagcagg

SEQ ID NO: 258648 - RNA, 21 nt, Human
agaugaagucaggacaggaca

SEQ ID NO: 258649 - RNA, 19 nt, Human
agcagaggucagggccucc

SEQ ID NO: 258650 - RNA, 19 nt, Human
aggaggaccacggcugaag

SEQ ID NO: 258651 - RNA, 21 nt, Human
aggaggggucugggggacccu

SEQ ID NO: 258652 - RNA, 22 nt, Human
aggcugcaagucugaugggaca

SEQ ID NO: 258653 - RNA, 23 nt, Human
agggggcagcagaagcccaggaa

SEQ ID NO: 258654 - RNA, 23 nt, Human
agucccgcucccacgaccuuagu

SEQ ID NO: 258655 - RNA, 23 nt, Human
aguguccuggaaggcuuaagggc

SEQ ID NO: 258656 - RNA, 27 nt, Human
aucuccuccaacacgaugucccugcug

SEQ ID NO: 258657 - RNA, 19 nt, Human
augggacacagacuugggc

SEQ ID NO: 258658 - RNA, 23 nt, Human
augggacacagacuugggcagaa

SEQ ID NO: 258659 - RNA, 18 nt, Human
caaagugggcuccucugc

SEQ ID NO: 258660 - RNA, 21 nt, Human
cacugcagcagaggucagggc

SEQ ID NO: 258661 - RNA, 21 nt, Human
cagaauaaagaggggugggug

SEQ ID NO: 258662 - RNA, 25 nt, Human
cagaauaaagagggguggguggaaa

SEQ ID NO: 258663 - RNA, 21 nt, Human
cagccagcugggccaccacua

SEQ ID NO: 258664 - RNA, 23 nt, Human
cagccagcugggccaccacuagg

SEQ ID NO: 258665 - RNA, 18 nt, Human
ccaaaaugagaaggaaaa

SEQ ID NO: 258666 - RNA, 18 nt, Human
ccacagccacccgcucug

SEQ ID NO: 258667 - RNA, 19 nt, Human
ccaggugugggcugugugg

SEQ ID NO: 258668 - RNA, 23 nt, Human
cccaggaaccugggcuaaggcac

SEQ ID NO: 258669 - RNA, 24 nt, Human
cccaugugugcacauccuguuuca

SEQ ID NO: 258670 - RNA, 18 nt, Human
ccccaggaaagcaggaga

SEQ ID NO: 258671 - RNA, 21 nt, Human
cccgcucugugucuggcuucc

SEQ ID NO: 258672 - RNA, 20 nt, Human
ccuccaacacgaugucccug

SEQ ID NO: 258673 - RNA, 19 nt, Human
ccugcugguauccucccua

SEQ ID NO: 258674 - RNA, 21 nt, Human
ccuggauguggcucagggcca

SEQ ID NO: 258675 - RNA, 18 nt, Human
cugaagccacagccaccc

SEQ ID NO: 258676 - RNA, 24 nt, Human
cugacagccuugcacaugucauac

SEQ ID NO: 258677 - RNA, 19 nt, Human
cuggacuccagccagcugg

SEQ ID NO: 258678 - RNA, 19 nt, Human
cuuccgaguccacaugagu

SEQ ID NO: 258679 - RNA, 20 nt, Human
gaacagggccaggugugggc

SEQ ID NO: 258680 - RNA, 23 nt, Human
gagaaggaaaaguucugggcugg

SEQ ID NO: 258681 - RNA, 25 nt, Human
gagaaguugggauccauucuucagg

SEQ ID NO: 258682 - RNA, 23 nt, Human
gagcgcuuaaucucuccccagga

SEQ ID NO: 258683 - RNA, 21 nt, Human
gcagaagcccaggaaccuggg

SEQ ID NO: 258684 - RNA, 20 nt, Human
gcccaugugugcacauccug

SEQ ID NO: 258685 - RNA, 20 nt, Human
gccccgagcccggcaagaug

SEQ ID NO: 258686 - RNA, 20 nt, Human
gccuccaucuccaccccggu

SEQ ID NO: 258687 - RNA, 18 nt, Human
gcuaagcccgauggaagu

SEQ ID NO: 258688 - RNA, 20 nt, Human
gcugacagccuugcacaugu

SEQ ID NO: 258689 - RNA, 19 nt, Human
gcuguccagcuccagcugc

SEQ ID NO: 258690 - RNA, 23 nt, Human
ggaccacggcugaagccacagcc

SEQ ID NO: 258691 - RNA, 20 nt, Human
ggcugccuggacuccagcca

SEQ ID NO: 258692 - RNA, 21 nt, Human
gggaauuggggaacaucaaaa

SEQ ID NO: 258693 - RNA, 21 nt, Human
gggcagaaggagagaugaagu

SEQ ID NO: 258694 - RNA, 23 nt, Human
gggggucgggggcggauggugau

SEQ ID NO: 258695 - RNA, 19 nt, Human
guuggcaucugagucugca

SEQ ID NO: 258696 - RNA, 26 nt, Human
uaaaggaaccugacgucuuucccuca

SEQ ID NO: 258697 - RNA, 25 nt, Human
uagacccugaacauggagcgggucc

SEQ ID NO: 258698 - RNA, 20 nt, Human
uccacaaagaacaugauuuc

SEQ ID NO: 258699 - RNA, 23 nt, Human
ucccucagccuacauugcauccc

SEQ ID NO: 258700 - RNA, 18 nt, Human
ucugugucuggcuuccug

SEQ ID NO: 258701 - RNA, 19 nt, Human
ugaaaggagccagacccca

SEQ ID NO: 258702 - RNA, 20 nt, Human
ugagggggcagcagaagccc

SEQ ID NO: 258703 - RNA, 18 nt, Human
ugagguuagcuggggucc

SEQ ID NO: 258704 - RNA, 20 nt, Human
ugauaugcuccagaauaaag

SEQ ID NO: 258705 - RNA, 20 nt, Human
ugcccacaucuaccauagcc

SEQ ID NO: 258706 - RNA, 24 nt, Human
ugcccguccuuccgaguccacaug

SEQ ID NO: 258707 - RNA, 18 nt, Human
ugccuggacuccagccag

SEQ ID NO: 258708 - RNA, 21 nt, Human
ugccuggaucuucacggcaug

SEQ ID NO: 258709 - RNA, 19 nt, Human
ugcucaagguaaacaaaca

SEQ ID NO: 258710 - RNA, 22 nt, Human
ugcuguccagcuccagcugcac

SEQ ID NO: 258711 - RNA, 20 nt, Human
uggaaggcuuaagggccugc

SEQ ID NO: 258712 - RNA, 25 nt, Human
uggagcgggucccaggagaaaaugc

SEQ ID NO: 258713 - RNA, 20 nt, Human
uggccaccuggcuggagaaa

SEQ ID NO: 258714 - RNA, 19 nt, Human
uggcuggagaaacucauuc

SEQ ID NO: 258715 - RNA, 23 nt, Human
uggcugguggggaauuggggaac

SEQ ID NO: 258716 - RNA, 19 nt, Human
ugggaaggacccaccccuu

SEQ ID NO: 258717 - RNA, 22 nt, Human
ugggcagaaggagagaugaagu

SEQ ID NO: 258718 - RNA, 18 nt, Human
uggucaccuuggcugccu

SEQ ID NO: 258719 - RNA, 24 nt, Human
uguuggggaagcugggauuguccc

SEQ ID NO: 258720 - RNA, 21 nt, Human
uucuucaggcaagcuugugcu

SEQ ID NO: 258721 - RNA, 24 nt, Human
uugcaucccagcuccaggccuggg

SEQ ID NO: 258722 - RNA, 21 nt, Human
uuggauuggcugguggggaau

SEQ ID NO: 258723 - RNA, 23 nt, Human
uuucucaguuaucuggcauugcu

SEQ ID NO: 258724 - RNA, 18 nt, Human
aaccuggcacagcggcac

SEQ ID NO: 258725 - RNA, 20 nt, Human
aacuccuguuauuucagcac

SEQ ID NO: 258726 - RNA, 21 nt, Human
acaagaauucuccaugaggug

SEQ ID NO: 258727 - RNA, 18 nt, Human
acaaugcucucccagaac

SEQ ID NO: 258728 - RNA, 19 nt, Human
acagaaauggucucugaac

SEQ ID NO: 258729 - RNA, 23 nt, Human
auggggggcggugaggugggguu

SEQ ID NO: 258730 - RNA, 21 nt, Human
cagauaucuuuccucacauuu

SEQ ID NO: 258731 - RNA, 18 nt, Human
cagcggcaccaucccgcc

SEQ ID NO: 258732 - RNA, 19 nt, Human
caguucugccaacauuccu

SEQ ID NO: 258733 - RNA, 23 nt, Human
cccauaccucaauguguguugag

SEQ ID NO: 258734 - RNA, 24 nt, Human
cccuucauccuacauacccauuua

SEQ ID NO: 258735 - RNA, 25 nt, Human
cccuuuugucccacuaguauaagag

SEQ ID NO: 258736 - RNA, 23 nt, Human
ccgggauggggggcggugaggug

SEQ ID NO: 258737 - RNA, 20 nt, Human
ccuacauacccauuuaucuu

SEQ ID NO: 258738 - RNA, 21 nt, Human
ccuuuuucucccuuuuguccc

SEQ ID NO: 258739 - RNA, 23 nt, Human
cguccuugcugccgugagcugac

SEQ ID NO: 258740 - RNA, 21 nt, Human
cuugcuuccuuuuucucccuu

SEQ ID NO: 258741 - RNA, 24 nt, Human
cuugcuuccuuuuucucccuuuug

SEQ ID NO: 258742 - RNA, 22 nt, Human
gauuucuaacaucagccaaucc

SEQ ID NO: 258743 - RNA, 23 nt, Human
gcaaaauacaauacuucaaccug

SEQ ID NO: 258744 - RNA, 28 nt, Human
gcacaguucuucacaagaagggaacgcc

SEQ ID NO: 258745 - RNA, 18 nt, Human
gcuucaguaaacuauccu

SEQ ID NO: 258746 - RNA, 22 nt, Human
ggaaggacaugucuaccacaga

SEQ ID NO: 258747 - RNA, 18 nt, Human
gggggcggugaggugggg

SEQ ID NO: 258748 - RNA, 20 nt, Human
uaacaaugcucucccagaac

SEQ ID NO: 258749 - RNA, 23 nt, Human
uacuucaaccuggcacagcggca

SEQ ID NO: 258750 - RNA, 22 nt, Human
uagcuucaucaaaacgaauaau

SEQ ID NO: 258751 - RNA, 23 nt, Human
ucaauaauaauaguuuaacaaag

SEQ ID NO: 258752 - RNA, 21 nt, Human
uccacagaugaagcacaguuc

SEQ ID NO: 258753 - RNA, 21 nt, Human
uccuacauacccauuuaucuu

SEQ ID NO: 258754 - RNA, 25 nt, Human
uccuuaauaacaaugcucucccaga

SEQ ID NO: 258755 - RNA, 21 nt, Human
uccuuuuucucccuuuugucc

SEQ ID NO: 258756 - RNA, 19 nt, Human
ucuugcuuccuuuuucucc

SEQ ID NO: 258757 - RNA, 23 nt, Human
ugaagcacaguucuucacaagaa

SEQ ID NO: 258758 - RNA, 26 nt, Human
ugcuuccuuuuucucccuuuuguccc

SEQ ID NO: 258759 - RNA, 24 nt, Human
ugggaaagagguggucauaaaagu

SEQ ID NO: 258760 - RNA, 18 nt, Human
uggggggcggugaggugg

SEQ ID NO: 258761 - RNA, 24 nt, Human
uggggggcggugaggugggguugg

SEQ ID NO: 258762 - RNA, 18 nt, Human
ugggguuggugggggagu

SEQ ID NO: 258763 - RNA, 18 nt, Human
ugucccacuaguauaaga

SEQ ID NO: 258764 - RNA, 23 nt, Human
uuaaauaacccuucauccuacau

SEQ ID NO: 258765 - RNA, 25 nt, Human
uucaaccuggcacagcggcaccauc

SEQ ID NO: 258766 - RNA, 18 nt, Human
uuccacagcugcaacgcu

SEQ ID NO: 258767 - RNA, 20 nt, Human
uuuccaguucugccaacauu

SEQ ID NO: 258768 - RNA, 24 nt, Human
uuuuuuuuuuuuuuaaacuuuuga

SEQ ID NO: 258769 - RNA, 21 nt, Human
aaaaaugggaaaaugaagaga

SEQ ID NO: 258770 - RNA, 24 nt, Human
aaagugcugggauuacaggcguga

SEQ ID NO: 258771 - RNA, 23 nt, Human
aaaucaauucuacuuggaauuca

SEQ ID NO: 258772 - RNA, 23 nt, Human
aagagaaaagguagaugacagaa

SEQ ID NO: 258773 - RNA, 18 nt, Human
aagaugccagugagugug

SEQ ID NO: 258774 - RNA, 22 nt, Human
aagggcuacagacugaggggau

SEQ ID NO: 258775 - RNA, 19 nt, Human
aagugcugggauuacaggc

SEQ ID NO: 258776 - RNA, 19 nt, Human
aagugcugggauuacaggc

SEQ ID NO: 258777 - RNA, 26 nt, Human
aagugcugggauuacaggcgugagcc

SEQ ID NO: 258778 - RNA, 20 nt, Human
aaguggaggcccuuggggug

SEQ ID NO: 258779 - RNA, 24 nt, Human
aauuguuuguauuuuuaguagaga

SEQ ID NO: 258780 - RNA, 20 nt, Human
acaggaccuuaggaagaggc

SEQ ID NO: 258781 - RNA, 24 nt, Human
accauguuggccaggcuggucuug

SEQ ID NO: 258782 - RNA, 21 nt, Human
acugcugaaaagcccaaggga

SEQ ID NO: 258783 - RNA, 22 nt, Human
agagaaaagguagaugacagaa

SEQ ID NO: 258784 - RNA, 23 nt, Human
agaggaaggaaagauucugagga

SEQ ID NO: 258785 - RNA, 20 nt, Human
agauuccuggccuccaguuc

SEQ ID NO: 258786 - RNA, 20 nt, Human
agccagagagggcuuccagg

SEQ ID NO: 258787 - RNA, 24 nt, Human
agcgauucuccugccucagccucc

SEQ ID NO: 258788 - RNA, 23 nt, Human
aggggcaccugccuguccuuagc

SEQ ID NO: 258789 - RNA, 21 nt, Human
aggggcuaaucaguggggcag

SEQ ID NO: 258790 - RNA, 19 nt, Human
agguggaagacuggagaga

SEQ ID NO: 258791 - RNA, 22 nt, Human
aguagaaggaaaacauucuaaa

SEQ ID NO: 258792 - RNA, 22 nt, Human
aguagagaugggguuucaccau

SEQ ID NO: 258793 - RNA, 18 nt, Human
aguagcugguauuauagg

SEQ ID NO: 258794 - RNA, 21 nt, Human
agugcaguggcgcgaucucag

SEQ ID NO: 258795 - RNA, 23 nt, Human
agugcaguggcgcgaucucagcu

SEQ ID NO: 258796 - RNA, 24 nt, Human
agugcaguggcgcgaucucagcuc

SEQ ID NO: 258797 - RNA, 18 nt, Human
aucccugggcaaccaggc

SEQ ID NO: 258798 - RNA, 20 nt, Human
augggaaaaugaagagaaaa

SEQ ID NO: 258799 - RNA, 22 nt, Human
augggguuucaccauguuggcc

SEQ ID NO: 258800 - RNA, 23 nt, Human
augggguuucaccauguuggcca

SEQ ID NO: 258801 - RNA, 24 nt, Human
augggguuucaccauguuggccag

SEQ ID NO: 258802 - RNA, 19 nt, Human
auucagaguguuccugaaa

SEQ ID NO: 258803 - RNA, 33 nt, Human
auuuauuuauuuauuuauuuauuuauuuuuggu

SEQ ID NO: 258804 - RNA, 24 nt, Human
caaagugcugggauuacaggcgug

SEQ ID NO: 258805 - RNA, 20 nt, Human
caagcgauucuccugccuca

SEQ ID NO: 258806 - RNA, 22 nt, Human
caagcgauucuccugccucagc

SEQ ID NO: 258807 - RNA, 21 nt, Human
caccauguuggccaggcuggu

SEQ ID NO: 258808 - RNA, 23 nt, Human
caccauguuggccaggcuggucu

SEQ ID NO: 258809 - RNA, 24 nt, Human
caccauguuggccaggcuggucuu

SEQ ID NO: 258810 - RNA, 27 nt, Human
caccauguuggccaggcuggucuugaa

SEQ ID NO: 258811 - RNA, 22 nt, Human
cacucuuccucuuccuucccuu

SEQ ID NO: 258812 - RNA, 21 nt, Human
cacugcaaccucugccuccug

SEQ ID NO: 258813 - RNA, 23 nt, Human
cacugcaaccucugccuccuggg

SEQ ID NO: 258814 - RNA, 19 nt, Human
caggcucuccuccaccccu

SEQ ID NO: 258815 - RNA, 24 nt, Human
cauguuggccaggcuggucuugaa

SEQ ID NO: 258816 - RNA, 22 nt, Human
ccaaagugcugggauuacaggc

SEQ ID NO: 258817 - RNA, 22 nt, Human
ccaaagugcugggauuacaggc

SEQ ID NO: 258818 - RNA, 24 nt, Human
ccaaagugcugggauuacaggcgu

SEQ ID NO: 258819 - RNA, 22 nt, Human
ccaggcucuccuccaccccugc

SEQ ID NO: 258820 - RNA, 24 nt, Human
ccagguggaagacuggagagagaa

SEQ ID NO: 258821 - RNA, 20 nt, Human
ccccacgucacccuugccag

SEQ ID NO: 258822 - RNA, 23 nt, Human
cccgcagcaaggucaggccaagu

SEQ ID NO: 258823 - RNA, 18 nt, Human
cccugggcaaccaggcuc

SEQ ID NO: 258824 - RNA, 18 nt, Human
ccgcagaaacagccccac

SEQ ID NO: 258825 - RNA, 21 nt, Human
ccucccccacucccuccugga

SEQ ID NO: 258826 - RNA, 24 nt, Human
ccuccuggguucaagcgauucucc

SEQ ID NO: 258827 - RNA, 19 nt, Human
ccucugccuccuggguuca

SEQ ID NO: 258828 - RNA, 21 nt, Human
ccugaccucgugauucgcccg

SEQ ID NO: 258829 - RNA, 23 nt, Human
ccugccucagccuccggaguagc

SEQ ID NO: 258830 - RNA, 23 nt, Human
ccuggguucaagcgauucuccug

SEQ ID NO: 258831 - RNA, 21 nt, Human
ccugguacagggcuuuccucc

SEQ ID NO: 258832 - RNA, 24 nt, Human
cgccucggccucccaaagugcugg

SEQ ID NO: 258833 - RNA, 24 nt, Human
cucacugcaaccucugccuccugg

SEQ ID NO: 258834 - RNA, 24 nt, Human
cuccugaccucgugauucgcccgc

SEQ ID NO: 258835 - RNA, 21 nt, Human
cuccuggguucaagcgauucu

SEQ ID NO: 258836 - RNA, 22 nt, Human
cucuacuguuccuggggacaga

SEQ ID NO: 258837 - RNA, 19 nt, Human
cugcaaccucugccuccug

SEQ ID NO: 258838 - RNA, 23 nt, Human
cugcaaccucugccuccuggguu

SEQ ID NO: 258839 - RNA, 24 nt, Human
cugcaaccucugccuccuggguuc

SEQ ID NO: 258840 - RNA, 23 nt, Human
cugccucagccuccggaguagcu

SEQ ID NO: 258841 - RNA, 18 nt, Human
cugguacagggcuuuccu

SEQ ID NO: 258842 - RNA, 19 nt, Human
cuucuaggggcuaaucagu

SEQ ID NO: 258843 - RNA, 21 nt, Human
gaaaucaauucuacuuggaau

SEQ ID NO: 258844 - RNA, 22 nt, Human
gaagaucuuggagggcagugcu

SEQ ID NO: 258845 - RNA, 25 nt, Human
gaccaggguuugucuuccccacccc

SEQ ID NO: 258846 - RNA, 22 nt, Human
gaccucgugauucgcccgccuc

SEQ ID NO: 258847 - RNA, 18 nt, Human
gagaugggguuucaccau

SEQ ID NO: 258848 - RNA, 24 nt, Human
gagaugggguuucaccauguuggc

SEQ ID NO: 258849 - RNA, 18 nt, Human
gagcaauggagcagaggg

SEQ ID NO: 258850 - RNA, 18 nt, Human
gaggggaugaccaggguu

SEQ ID NO: 258851 - RNA, 18 nt, Human
gauuacaggcgugagcca

SEQ ID NO: 258852 - RNA, 22 nt, Human
gauuacaggcgugagccaccgc

SEQ ID NO: 258853 - RNA, 23 nt, Human
gauuacaggcgugagccaccgca

SEQ ID NO: 258854 - RNA, 22 nt, Human
gcaaccucugccuccuggguuc

SEQ ID NO: 258855 - RNA, 20 nt, Human
gcagaaacagccccacguca

SEQ ID NO: 258856 - RNA, 18 nt, Human
gcagcaaggucaggccaa

SEQ ID NO: 258857 - RNA, 24 nt, Human
gccaagacaaggaggagcucuggc

SEQ ID NO: 258858 - RNA, 19 nt, Human
gcuagagugcaguggcgcg

SEQ ID NO: 258859 - RNA, 23 nt, Human
gcuggucuugaacuccugaccuc

SEQ ID NO: 258860 - RNA, 23 nt, Human
ggaaagauucugagaccugugga

SEQ ID NO: 258861 - RNA, 22 nt, Human
ggaagaucuuggagggcagugc

SEQ ID NO: 258862 - RNA, 24 nt, Human
ggcuggucuugaacuccugaccuc

SEQ ID NO: 258863 - RNA, 20 nt, Human
ggcuuuccucccccacuccc

SEQ ID NO: 258864 - RNA, 24 nt, Human
gggaagaucuuggagggcagugcu

SEQ ID NO: 258865 - RNA, 25 nt, Human
gggcagugcugccugggccgggccc

SEQ ID NO: 258866 - RNA, 22 nt, Human
gggguuucaccauguuggccag

SEQ ID NO: 258867 - RNA, 21 nt, Human
ggucaggccaaguggaggccc

SEQ ID NO: 258868 - RNA, 19 nt, Human
ggucuugaacuccugaccu

SEQ ID NO: 258869 - RNA, 23 nt, Human
guagagaugggguuucaccaugu

SEQ ID NO: 258870 - RNA, 26 nt, Human
guagguuucuccccaucuccagguuu

SEQ ID NO: 258871 - RNA, 24 nt, Human
gugauucgcccgccucggccuccc

SEQ ID NO: 258872 - RNA, 24 nt, Human
guggaagacuggagagagaaaugg

SEQ ID NO: 258873 - RNA, 20 nt, Human
guuugucuuccccacccccc

SEQ ID NO: 258874 - RNA, 22 nt, Human
guuuguuugugucugaccauca

SEQ ID NO: 258875 - RNA, 22 nt, Human
uaaagcaggcauguugcccagc

SEQ ID NO: 258876 - RNA, 24 nt, Human
uaauuguuuguauuuuuaguagag

SEQ ID NO: 258877 - RNA, 23 nt, Human
uacaggcgugagccaccgcaccc

SEQ ID NO: 258878 - RNA, 24 nt, Human
uacucugucacuccggcuagagug

SEQ ID NO: 258879 - RNA, 19 nt, Human
uagaagugugcuuaugaaa

SEQ ID NO: 258880 - RNA, 22 nt, Human
uagagaugggguuucaccaugu

SEQ ID NO: 258881 - RNA, 23 nt, Human
uagagugcaguggcgcgaucuca

SEQ ID NO: 258882 - RNA, 24 nt, Human
uagagugcaguggcgcgaucucag

SEQ ID NO: 258883 - RNA, 22 nt, Human
uagcuuguuuguuugugucuga

SEQ ID NO: 258884 - RNA, 25 nt, Human
uaggagaaaaggaugagaggaaggg

SEQ ID NO: 258885 - RNA, 19 nt, Human
uaggugcccaccacuaugc

SEQ ID NO: 258886 - RNA, 21 nt, Human
uaggugcccaccacuaugcuc

SEQ ID NO: 258887 - RNA, 24 nt, Human
uaguagagaugggguuucaccaug

SEQ ID NO: 258888 - RNA, 26 nt, Human
uaguagagaugggguuucaccauguu

SEQ ID NO: 258889 - RNA, 31 nt, Human
uauuauuuuuuauuuauuuauuuauuuauuu

SEQ ID NO: 258890 - RNA, 19 nt, Human
ucaagcgauucuccugccu

SEQ ID NO: 258891 - RNA, 24 nt, Human
ucacugcaaccucugccuccuggg

SEQ ID NO: 258892 - RNA, 25 nt, Human
ucacugcaaccucugccuccugggu

SEQ ID NO: 258893 - RNA, 27 nt, Human
ucacugcaaccucugccuccuggguuc

SEQ ID NO: 258894 - RNA, 24 nt, Human
ucccaaagugcugggauuacaggc

SEQ ID NO: 258895 - RNA, 20 nt, Human
uccccaaggacaaaucccug

SEQ ID NO: 258896 - RNA, 23 nt, Human
uccccaggucccuaguaggcugc

SEQ ID NO: 258897 - RNA, 18 nt, Human
ucccccacucccuccugg

SEQ ID NO: 258898 - RNA, 19 nt, Human
ucccugggcaaccaggcuc

SEQ ID NO: 258899 - RNA, 24 nt, Human
ucccugggcaaccaggcucuccuc

SEQ ID NO: 258900 - RNA, 25 nt, Human
ucccugggcaaccaggcucuccucc

SEQ ID NO: 258901 - RNA, 26 nt, Human
ucccugggcaaccaggcucuccucca

SEQ ID NO: 258902 - RNA, 18 nt, Human
uccugaaagugcaaauug

SEQ ID NO: 258903 - RNA, 19 nt, Human
uccuggggacagagagccc

SEQ ID NO: 258904 - RNA, 21 nt, Human
uccuggguucaagcgauucuc

SEQ ID NO: 258905 - RNA, 24 nt, Human
uccuggguucaagcgauucuccug

SEQ ID NO: 258906 - RNA, 18 nt, Human
ucggccucccaaagugcu

SEQ ID NO: 258907 - RNA, 24 nt, Human
ucuccugccucagccuccggagua

SEQ ID NO: 258908 - RNA, 18 nt, Human
ucuguagguuucucccca

SEQ ID NO: 258909 - RNA, 24 nt, Human
ucugucacuccggcuagagugcag

SEQ ID NO: 258910 - RNA, 19 nt, Human
ucuuacucugucacuccgg

SEQ ID NO: 258911 - RNA, 24 nt, Human
ucuuacucugucacuccggcuaga

SEQ ID NO: 258912 - RNA, 19 nt, Human
ucuuccccacccccccaga

SEQ ID NO: 258913 - RNA, 19 nt, Human
ucuugaacuccugaccucg

SEQ ID NO: 258914 - RNA, 21 nt, Human
ugaccaggguuugucuucccc

SEQ ID NO: 258915 - RNA, 18 nt, Human
ugagacagagucuuacuc

SEQ ID NO: 258916 - RNA, 19 nt, Human
ugagacagagucuuacucu

SEQ ID NO: 258917 - RNA, 22 nt, Human
ugagacagagucuuacucuguc

SEQ ID NO: 258918 - RNA, 21 nt, Human
ugauggagagaggggcaccug

SEQ ID NO: 258919 - RNA, 22 nt, Human
ugcaguggcgcgaucucagcuc

SEQ ID NO: 258920 - RNA, 24 nt, Human
ugccucagccuccggaguagcugg

SEQ ID NO: 258921 - RNA, 19 nt, Human
ugcugcagcugugcccgca

SEQ ID NO: 258922 - RNA, 24 nt, Human
ugcugggauuacaggcgugagcca

SEQ ID NO: 258923 - RNA, 18 nt, Human
uggaagaaacaaccacca

SEQ ID NO: 258924 - RNA, 19 nt, Human
uggaagaaacaaccaccau

SEQ ID NO: 258925 - RNA, 19 nt, Human
uggaagaaacaaccaccau

SEQ ID NO: 258926 - RNA, 24 nt, Human
uggaagaaacaaccaccauuugca

SEQ ID NO: 258927 - RNA, 25 nt, Human
uggaggcccuuggggugccgguagc

SEQ ID NO: 258928 - RNA, 19 nt, Human
uggcagagaccauccugug

SEQ ID NO: 258929 - RNA, 24 nt, Human
uggccaggcuggucuugaacuccu

SEQ ID NO: 258930 - RNA, 24 nt, Human
uggcgcgaucucagcucacugcaa

SEQ ID NO: 258931 - RNA, 18 nt, Human
ugggauuacaggcgugag

SEQ ID NO: 258932 - RNA, 19 nt, Human
ugggauuacaggcgugagc

SEQ ID NO: 258933 - RNA, 21 nt, Human
ugggauuacaggcgugagcca

SEQ ID NO: 258934 - RNA, 22 nt, Human
ugggauuacaggcgugagccac

SEQ ID NO: 258935 - RNA, 23 nt, Human
ugggauuacaggcgugagccacc

SEQ ID NO: 258936 - RNA, 24 nt, Human
ugggauuacaggcgugagccaccg

SEQ ID NO: 258937 - RNA, 24 nt, Human
ugggguuucaccauguuggccagg

SEQ ID NO: 258938 - RNA, 23 nt, Human
uggguucaagcgauucuccugcc

SEQ ID NO: 258939 - RNA, 24 nt, Human
uggguucaagcgauucuccugccu

SEQ ID NO: 258940 - RNA, 21 nt, Human
ugguauuauaggugcccacca

SEQ ID NO: 258941 - RNA, 23 nt, Human
ugucuuccccacccccccagagc

SEQ ID NO: 258942 - RNA, 18 nt, Human
uuaguagagaugggguuu

SEQ ID NO: 258943 - RNA, 22 nt, Human
uuaguagagaugggguuucacc

SEQ ID NO: 258944 - RNA, 24 nt, Human
uuaguagagaugggguuucaccau

SEQ ID NO: 258945 - RNA, 18 nt, Human
uuauuuauuuauuuauuu

SEQ ID NO: 258946 - RNA, 18 nt, Human
uuauuuauuuauuuauuu

SEQ ID NO: 258947 - RNA, 19 nt, Human
uuauuuauuuauuuauuua

SEQ ID NO: 258948 - RNA, 19 nt, Human
uuauuuauuuauuuauuua

SEQ ID NO: 258949 - RNA, 25 nt, Human
uuauuuauuuauuuauuuauuuauu

SEQ ID NO: 258950 - RNA, 25 nt, Human
uuauuuauuuauuuauuuauuuauu

SEQ ID NO: 258951 - RNA, 25 nt, Human
uuauuuauuuauuuauuuauuuauu

SEQ ID NO: 258952 - RNA, 25 nt, Human
uuauuuauuuauuuauuuauuuauu

SEQ ID NO: 258953 - RNA, 21 nt, Human
uucaagcgauucuccugccuc

SEQ ID NO: 258954 - RNA, 23 nt, Human
uucaagcgauucuccugccucag

SEQ ID NO: 258955 - RNA, 24 nt, Human
uucaagcgauucuccugccucagc

SEQ ID NO: 258956 - RNA, 20 nt, Human
uuccccaggucccuaguagg

SEQ ID NO: 258957 - RNA, 21 nt, Human
uucuaaagcaggcauguugcc

SEQ ID NO: 258958 - RNA, 19 nt, Human
uugaagggucuucuagggg

SEQ ID NO: 258959 - RNA, 23 nt, Human
uuguauuuuuaguagagaugggg

SEQ ID NO: 258960 - RNA, 20 nt, Human
uugugucugaccaucaagua

SEQ ID NO: 258961 - RNA, 24 nt, Human
uuguuuguauuuuuaguagagaug

SEQ ID NO: 258962 - RNA, 22 nt, Human
uuuauuuauuuauuuauuuauu

SEQ ID NO: 258963 - RNA, 24 nt, Human
uuucaccauguuggccaggcuggu

SEQ ID NO: 258964 - RNA, 24 nt, Human
uuucuccccaucuccagguuuggg

SEQ ID NO: 258965 - RNA, 18 nt, Human
uuugcuuccccagguccc

SEQ ID NO: 258966 - RNA, 19 nt, Human
uuuguauuuuuaguagaga

SEQ ID NO: 258967 - RNA, 24 nt, Human
uuuuuaguagagaugggguuucac

SEQ ID NO: 258968 - RNA, 23 nt, Human
aaagaaaaggaagauuuagauaa

SEQ ID NO: 258969 - RNA, 19 nt, Human
aacaaaauuacaauaacaa

SEQ ID NO: 258970 - RNA, 25 nt, Human
aacaauuuuuacauauguguaauau

SEQ ID NO: 258971 - RNA, 24 nt, Human
aacauacuucuuuacguauaugua

SEQ ID NO: 258972 - RNA, 19 nt, Human
aagaaaaggaagauuuaga

SEQ ID NO: 258973 - RNA, 19 nt, Human
acaguaacaacaacaaaaa

SEQ ID NO: 258974 - RNA, 22 nt, Human
acucaaggggacaaggacaccu

SEQ ID NO: 258975 - RNA, 22 nt, Human
aggaauaacaaaaguuaagccg

SEQ ID NO: 258976 - RNA, 23 nt, Human
aggaauaacaaaauuacaauaac

SEQ ID NO: 258977 - RNA, 24 nt, Human
aguaacaacaacaaaaaagaaaaa

SEQ ID NO: 258978 - RNA, 19 nt, Human
aucuuccaauuuucuuauu

SEQ ID NO: 258979 - RNA, 20 nt, Human
caagaggaggugauucugua

SEQ ID NO: 258980 - RNA, 19 nt, Human
cagacauuucuaaacaaaa

SEQ ID NO: 258981 - RNA, 21 nt, Human
cgcgcaacucaaggggacaag

SEQ ID NO: 258982 - RNA, 21 nt, Human
gaacacgacccgcgcaacuca

SEQ ID NO: 258983 - RNA, 22 nt, Human
gcgcaacucaaggggacaagga

SEQ ID NO: 258984 - RNA, 23 nt, Human
ggauuagggaauacauaaauugu

SEQ ID NO: 258985 - RNA, 23 nt, Human
uaacaacaacaaaaaagaaaaau

SEQ ID NO: 258986 - RNA, 19 nt, Human
uagaguacacaauuuucuu

SEQ ID NO: 258987 - RNA, 23 nt, Human
uauaguggagaaagggcauaaug

SEQ ID NO: 258988 - RNA, 19 nt, Human
uaucaagaaaaguguaaaa

SEQ ID NO: 258989 - RNA, 22 nt, Human
uauguauacauauuaugcuuag

SEQ ID NO: 258990 - RNA, 25 nt, Human
uauguauacauauuaugcuuaggag

SEQ ID NO: 258991 - RNA, 19 nt, Human
uauguguaauauguauaca

SEQ ID NO: 258992 - RNA, 24 nt, Human
ugauucuguaguccuucacauauc

SEQ ID NO: 258993 - RNA, 19 nt, Human
uguguaauauguauacaua

SEQ ID NO: 258994 - RNA, 22 nt, Human
uuuacaguaacaacaacaaaaa

SEQ ID NO: 258995 - RNA, 22 nt, Human
aaagcagacaaacaggcaaugu

SEQ ID NO: 258996 - RNA, 24 nt, Human
aaaugacuucuucaacacaaaagu

SEQ ID NO: 258997 - RNA, 18 nt, Human
acagucccaugacaaaaa

SEQ ID NO: 258998 - RNA, 22 nt, Human
agacaaacaggcaauguugaug

SEQ ID NO: 258999 - RNA, 20 nt, Human
agcagacaaacaggcaaugu

SEQ ID NO: 259000 - RNA, 21 nt, Human
caacaggaaagacugcauucg

SEQ ID NO: 259001 - RNA, 21 nt, Human
caagaccagaauuggaacuuc

SEQ ID NO: 259002 - RNA, 22 nt, Human
caggaaagacugcauucgggug

SEQ ID NO: 259003 - RNA, 22 nt, Human
ccuuaagagauucaaaagcaga

SEQ ID NO: 259004 - RNA, 19 nt, Human
cuuacaaacauccauccuu

SEQ ID NO: 259005 - RNA, 22 nt, Human
uaacugggaaaucaagaccaga

SEQ ID NO: 259006 - RNA, 23 nt, Human
uaacugggaaaucaagaccagaa

SEQ ID NO: 259007 - RNA, 21 nt, Human
uaagagauucaaaagcagaca

SEQ ID NO: 259008 - RNA, 20 nt, Human
uaagcaacaucuuacaaaca

SEQ ID NO: 259009 - RNA, 19 nt, Human
ucaaaagcagacaaacagg

SEQ ID NO: 259010 - RNA, 22 nt, Human
ucaaaagcagacaaacaggcaa

SEQ ID NO: 259011 - RNA, 22 nt, Human
ucaacacaaaaguuacccauag

SEQ ID NO: 259012 - RNA, 21 nt, Human
ucccaugacaaaaauggagau

SEQ ID NO: 259013 - RNA, 25 nt, Human
uguauuaagcaacaucuuacaaaca

SEQ ID NO: 259014 - RNA, 18 nt, Human
uucgggugaaagaacauc

SEQ ID NO: 259015 - RNA, 21 nt, Human
uuggaacuuccaaacguuuuu

SEQ ID NO: 259016 - RNA, 24 nt, Human
uuuguauuuaacagaacuugcaca

SEQ ID NO: 259017 - RNA, 24 nt, Human
aggcuggcauaugccaaagucagg

SEQ ID NO: 259018 - RNA, 21 nt, Human
ccaggcugagcacauggccuc

SEQ ID NO: 259019 - RNA, 21 nt, Human
ccccacacccacacacgaccc

SEQ ID NO: 259020 - RNA, 25 nt, Human
ccccacacccacacacgacccugcc

SEQ ID NO: 259021 - RNA, 24 nt, Human
ccugccuggcugcgagacaagggc

SEQ ID NO: 259022 - RNA, 21 nt, Human
ccuguggcaggaacaggcugg

SEQ ID NO: 259023 - RNA, 23 nt, Human
cggcaacguggccaggcugagca

SEQ ID NO: 259024 - RNA, 18 nt, Human
cguggccaggcugagcac

SEQ ID NO: 259025 - RNA, 21 nt, Human
cucccugcugucagccacugc

SEQ ID NO: 259026 - RNA, 22 nt, Human
cucgcccggccuaggcugcccc

SEQ ID NO: 259027 - RNA, 22 nt, Human
cugagcacauggccucccugcu

SEQ ID NO: 259028 - RNA, 20 nt, Human
cuggcagccccacacccaca

SEQ ID NO: 259029 - RNA, 20 nt, Human
gccacggagcagacuguaac

SEQ ID NO: 259030 - RNA, 19 nt, Human
gcuggcauaugccaaaguc

SEQ ID NO: 259031 - RNA, 21 nt, Human
ggccaggcugagcacauggcc

SEQ ID NO: 259032 - RNA, 24 nt, Human
ucagggcagcagcagcugcgucca

SEQ ID NO: 259033 - RNA, 22 nt, Human
ucccugcugucagccacugcag

SEQ ID NO: 259034 - RNA, 22 nt, Human
ugcguccaaccuggcagcccca

SEQ ID NO: 259035 - RNA, 21 nt, Human
uggccaggcugagcacauggc

SEQ ID NO: 259036 - RNA, 22 nt, Human
aaaaagaagccagcagagacaa

SEQ ID NO: 259037 - RNA, 23 nt, Human
aaagcagaagauacugaaaaagc

SEQ ID NO: 259038 - RNA, 25 nt, Human
aaagcagaagauacugaaaaagcaa

SEQ ID NO: 259039 - RNA, 20 nt, Human
aagaagccagcagagacaaa

SEQ ID NO: 259040 - RNA, 24 nt, Human
aagcagaagauacugaaaaagcaa

SEQ ID NO: 259041 - RNA, 27 nt, Human
aaugauggggaaacagaagggagggcc

SEQ ID NO: 259042 - RNA, 24 nt, Human
agaaacaauacagaauuaaauaac

SEQ ID NO: 259043 - RNA, 18 nt, Human
agugaaaccaaggauucu

SEQ ID NO: 259044 - RNA, 21 nt, Human
auaggaagaagagauguaaca

SEQ ID NO: 259045 - RNA, 23 nt, Human
augaagaacagcagugaaaccaa

SEQ ID NO: 259046 - RNA, 23 nt, Human
augagguaaagugacuaacagag

SEQ ID NO: 259047 - RNA, 27 nt, Human
auucuuucuucucucucucuuucaauu

SEQ ID NO: 259048 - RNA, 19 nt, Human
caaagcaguaagcaggaac

SEQ ID NO: 259049 - RNA, 18 nt, Human
caaauggacagggagggc

SEQ ID NO: 259050 - RNA, 19 nt, Human
caaccacauaacauggcau

SEQ ID NO: 259051 - RNA, 19 nt, Human
caaggauucuagcaaggcc

SEQ ID NO: 259052 - RNA, 19 nt, Human
caccaguaggagcccaagu

SEQ ID NO: 259053 - RNA, 19 nt, Human
cagaagauacugaaaaagc

SEQ ID NO: 259054 - RNA, 23 nt, Human
cagauggcaguaaaaagucgugg

SEQ ID NO: 259055 - RNA, 20 nt, Human
cauauuugccuccucugcua

SEQ ID NO: 259056 - RNA, 20 nt, Human
caucaacagaaaggcaaaag

SEQ ID NO: 259057 - RNA, 20 nt, Human
caucaacagaaaggcaaaag

SEQ ID NO: 259058 - RNA, 19 nt, Human
cauuccacuagcuggaaca

SEQ ID NO: 259059 - RNA, 21 nt, Human
cauugcuuuacaaaaucaagu

SEQ ID NO: 259060 - RNA, 19 nt, Human
ccccuuuuccuccugcuuu

SEQ ID NO: 259061 - RNA, 22 nt, Human
cgcucccaccucuuuugcucuu

SEQ ID NO: 259062 - RNA, 22 nt, Human
cucccaccucuuuugcucuuuc

SEQ ID NO: 259063 - RNA, 24 nt, Human
cucuugggauucaaacacugagua

SEQ ID NO: 259064 - RNA, 21 nt, Human
cucuuuugcucuuucaggucc

SEQ ID NO: 259065 - RNA, 21 nt, Human
cuucucucucucuuucaauuc

SEQ ID NO: 259066 - RNA, 21 nt, Human
gaagccagcagagacaaagca

SEQ ID NO: 259067 - RNA, 19 nt, Human
gagguaaagugacuaacag

SEQ ID NO: 259068 - RNA, 19 nt, Human
gagguccccaccaguagga

SEQ ID NO: 259069 - RNA, 20 nt, Human
gcuuuucucuugugucaaau

SEQ ID NO: 259070 - RNA, 20 nt, Human
ggauccuuaaggcuuucgcu

SEQ ID NO: 259071 - RNA, 22 nt, Human
uaacaucaacagaaaggcaaaa

SEQ ID NO: 259072 - RNA, 21 nt, Human
uaacauggcauugcuuuacaa

SEQ ID NO: 259073 - RNA, 21 nt, Human
uacuacaaauauaagaaacaa

SEQ ID NO: 259074 - RNA, 19 nt, Human
uacugaaaaagcaacuaau

SEQ ID NO: 259075 - RNA, 18 nt, Human
uagaagcacaugaagaac

SEQ ID NO: 259076 - RNA, 21 nt, Human
uagaagcacaugaagaacagc

SEQ ID NO: 259077 - RNA, 20 nt, Human
uagagcuaugugguaaauua

SEQ ID NO: 259078 - RNA, 25 nt, Human
uagagcuaugugguaaauuauuuuu

SEQ ID NO: 259079 - RNA, 21 nt, Human
uagcaaagcaguaagcaggaa

SEQ ID NO: 259080 - RNA, 22 nt, Human
uauucccuuuuuuuuucuggaa

SEQ ID NO: 259081 - RNA, 25 nt, Human
uauucuuucuucucucucucuuuca

SEQ ID NO: 259082 - RNA, 18 nt, Human
ucucucucucuuucaauu

SEQ ID NO: 259083 - RNA, 23 nt, Human
ucucucucuuucaauucuucccc

SEQ ID NO: 259084 - RNA, 21 nt, Human
ucuuucuucucucucucuuuc

SEQ ID NO: 259085 - RNA, 21 nt, Human
ugagagguaaacugacuuccu

SEQ ID NO: 259086 - RNA, 21 nt, Human
ugagcucagugcuccugauac

SEQ ID NO: 259087 - RNA, 23 nt, Human
ugcuauacaggaaaucuccuaaa

SEQ ID NO: 259088 - RNA, 21 nt, Human
ugcuauauauauauauaaaua

SEQ ID NO: 259089 - RNA, 21 nt, Human
uggauagacacagacaaagca

SEQ ID NO: 259090 - RNA, 19 nt, Human
uggaugagguaaagugacu

SEQ ID NO: 259091 - RNA, 22 nt, Human
uucccuuuuuuuuucuggaauu

SEQ ID NO: 259092 - RNA, 23 nt, Human
uucucuugugucaaauucaagua

SEQ ID NO: 259093 - RNA, 21 nt, Human
uugcucuuucagguccuuugg

SEQ ID NO: 259094 - RNA, 18 nt, Human
uuuccuccugcuuuucuc

SEQ ID NO: 259095 - RNA, 24 nt, Human
uuuuacuacaaauauaagaaacaa

SEQ ID NO: 259096 - RNA, 20 nt, Human
aaccuccucaccccacccug

SEQ ID NO: 259097 - RNA, 22 nt, Human
accagccccaucuccacucccu

SEQ ID NO: 259098 - RNA, 18 nt, Human
accuccucaccccacccc

SEQ ID NO: 259099 - RNA, 18 nt, Human
acucuacccccauccucu

SEQ ID NO: 259100 - RNA, 20 nt, Human
acucugccguccagacucag

SEQ ID NO: 259101 - RNA, 22 nt, Human
aggaucuggauccaucaaccau

SEQ ID NO: 259102 - RNA, 19 nt, Human
agggaagcagggaggcugg

SEQ ID NO: 259103 - RNA, 24 nt, Human
agucuuuauugucccaucuguucc

SEQ ID NO: 259104 - RNA, 18 nt, Human
caaaauuuuggcuuggga

SEQ ID NO: 259105 - RNA, 24 nt, Human
caaccagccccaucuccacucccu

SEQ ID NO: 259106 - RNA, 18 nt, Human
cacaccagcaggcuggcu

SEQ ID NO: 259107 - RNA, 19 nt, Human
cacucugccguccagacuc

SEQ ID NO: 259108 - RNA, 25 nt, Human
cacucugccguccagacucagucuu

SEQ ID NO: 259109 - RNA, 23 nt, Human
cagccgggcugagggagggaggc

SEQ ID NO: 259110 - RNA, 18 nt, Human
cagccucccagucccucc

SEQ ID NO: 259111 - RNA, 21 nt, Human
cagccucccagucccuccacu

SEQ ID NO: 259112 - RNA, 23 nt, Human
ccacuaaaagaaaacccuggcuc

SEQ ID NO: 259113 - RNA, 18 nt, Human
ccagagcaggaaccuccu

SEQ ID NO: 259114 - RNA, 22 nt, Human
ccagcaggcuggcucagauggg

SEQ ID NO: 259115 - RNA, 20 nt, Human
ccagccccaucuccacuccc

SEQ ID NO: 259116 - RNA, 24 nt, Human
ccagccccaucuccacucccuucc

SEQ ID NO: 259117 - RNA, 18 nt, Human
cccaccccagcacugggg

SEQ ID NO: 259118 - RNA, 19 nt, Human
cccauccucuccuuuucua

SEQ ID NO: 259119 - RNA, 20 nt, Human
cccccuucccccaccccagc

SEQ ID NO: 259120 - RNA, 24 nt, Human
ccuagaccugccagagcaggaacc

SEQ ID NO: 259121 - RNA, 19 nt, Human
cgaaagcacucaaauguca

SEQ ID NO: 259122 - RNA, 22 nt, Human
cuuacgaaagcacucaaauguc

SEQ ID NO: 259123 - RNA, 19 nt, Human
cuuccgccuagaccugcca

SEQ ID NO: 259124 - RNA, 20 nt, Human
ggaaccuccucaccccaccc

SEQ ID NO: 259125 - RNA, 19 nt, Human
gggagacucuacccccauc

SEQ ID NO: 259126 - RNA, 20 nt, Human
gggaggcuggaggacagggu

SEQ ID NO: 259127 - RNA, 18 nt, Human
gugcagaggaauggagga

SEQ ID NO: 259128 - RNA, 20 nt, Human
uaaaagaaaacccuggcuca

SEQ ID NO: 259129 - RNA, 18 nt, Human
uaguacauguacagggcu

SEQ ID NO: 259130 - RNA, 21 nt, Human
ucacugcagcagcaaccagcc

SEQ ID NO: 259131 - RNA, 18 nt, Human
uccacucugccguccaga

SEQ ID NO: 259132 - RNA, 24 nt, Human
ucccagccgggcugagggagggag

SEQ ID NO: 259133 - RNA, 18 nt, Human
ucccccuucccccacccc

SEQ ID NO: 259134 - RNA, 23 nt, Human
uccccucacugcagcagcaacca

SEQ ID NO: 259135 - RNA, 22 nt, Human
ucuuuauugucccaucuguucc

SEQ ID NO: 259136 - RNA, 18 nt, Human
ugagggagggaggcagcc

SEQ ID NO: 259137 - RNA, 21 nt, Human
ugagggagggaggcagccaca

SEQ ID NO: 259138 - RNA, 18 nt, Human
ugagguugggugaaugag

SEQ ID NO: 259139 - RNA, 19 nt, Human
ugagguugggugaaugagu

SEQ ID NO: 259140 - RNA, 19 nt, Human
uggcucagaaagucugcaa

SEQ ID NO: 259141 - RNA, 19 nt, Human
ugucccaucuguuccccuc

SEQ ID NO: 259142 - RNA, 19 nt, Human
uguuaaacagcuggaaauu

SEQ ID NO: 259143 - RNA, 20 nt, Human
aaaaacgagauucaccuaca

SEQ ID NO: 259144 - RNA, 22 nt, Human
aaacgagauucaccuacacaaa

SEQ ID NO: 259145 - RNA, 19 nt, Human
aagaagaaaagaaaaauga

SEQ ID NO: 259146 - RNA, 21 nt, Human
aagacccggcugaacacagca

SEQ ID NO: 259147 - RNA, 19 nt, Human
acaaaacauuagauaucuc

SEQ ID NO: 259148 - RNA, 24 nt, Human
agaagaaaagaaaaaugauguuag

SEQ ID NO: 259149 - RNA, 20 nt, Human
agaugagaaaaagaaacuua

SEQ ID NO: 259150 - RNA, 22 nt, Human
aggaaagcauuucuagaugaga

SEQ ID NO: 259151 - RNA, 19 nt, Human
agggguuggguugguucaa

SEQ ID NO: 259152 - RNA, 24 nt, Human
caaaacauuagauaucuccacaaa

SEQ ID NO: 259153 - RNA, 26 nt, Human
caaauaaaaacgagauucaccuacac

SEQ ID NO: 259154 - RNA, 23 nt, Human
caguaaggaaagcauuucuagau

SEQ ID NO: 259155 - RNA, 21 nt, Human
cauuucuagaugagaaaaaga

SEQ ID NO: 259156 - RNA, 20 nt, Human
cccuacaguuuugaagaccc

SEQ ID NO: 259157 - RNA, 22 nt, Human
ccuacaguuuugaagacccggc

SEQ ID NO: 259158 - RNA, 20 nt, Human
cucuuuaaguucacaaaaug

SEQ ID NO: 259159 - RNA, 22 nt, Human
ggcugaacacagcauaaaaauu

SEQ ID NO: 259160 - RNA, 21 nt, Human
ucacaaaaugcaagaagaaaa

SEQ ID NO: 259161 - RNA, 20 nt, Human
uccacaaauaaaaacgagau

SEQ ID NO: 259162 - RNA, 22 nt, Human
uccacaaauaaaaacgagauuc

SEQ ID NO: 259163 - RNA, 22 nt, Human
ucuuucuuuauacuaaccagcu

SEQ ID NO: 259164 - RNA, 19 nt, Human
ugacuacaaaacauuagau

SEQ ID NO: 259165 - RNA, 21 nt, Human
ugacuacaaaacauuagauau

SEQ ID NO: 259166 - RNA, 25 nt, Human
ugagcuagggguuggguugguucaa

SEQ ID NO: 259167 - RNA, 21 nt, Human
uguuagguugucaguaaggaa

SEQ ID NO: 259168 - RNA, 22 nt, Human
uuagguugucaguaaggaaagg

SEQ ID NO: 259169 - RNA, 22 nt, Human
uuucauccuaacuuacugaagc

SEQ ID NO: 259170 - RNA, 23 nt, Human
cacccugacacacucgaggccuc

SEQ ID NO: 259171 - RNA, 19 nt, Human
gaggcacaaacacccugac

SEQ ID NO: 259172 - RNA, 21 nt, Human
ugaggcacaaacacccugaca

SEQ ID NO: 259173 - RNA, 23 nt, Human
uguuaugaggcacaaacacccug

SEQ ID NO: 259174 - RNA, 23 nt, Human
aaaaacaaauaagauaaaaagaa

SEQ ID NO: 259175 - RNA, 25 nt, Human
aaaacaaauaagauaaaaagaauga

SEQ ID NO: 259176 - RNA, 18 nt, Human
aaccaaauaccugaccua

SEQ ID NO: 259177 - RNA, 18 nt, Human
aauguuuacaaaauaagu

SEQ ID NO: 259178 - RNA, 20 nt, Human
accugaccuauuacauccug

SEQ ID NO: 259179 - RNA, 18 nt, Human
acuauguacccacaaaau

SEQ ID NO: 259180 - RNA, 23 nt, Human
ccaaauaccugaccuauuacauc

SEQ ID NO: 259181 - RNA, 28 nt, Human
ccaaauaccugaccuauuacauccugua

SEQ ID NO: 259182 - RNA, 25 nt, Human
gagauaauagggaaauaccgguacc

SEQ ID NO: 259183 - RNA, 24 nt, Human
uaaaauuauacuauguauaaaaca

SEQ ID NO: 259184 - RNA, 21 nt, Human
uaaauauauacauguacuaug

SEQ ID NO: 259185 - RNA, 23 nt, Human
uaacagccucuuuccuaggaucu

SEQ ID NO: 259186 - RNA, 18 nt, Human
uauauacauguacuaugu

SEQ ID NO: 259187 - RNA, 25 nt, Human
ucaaaacaucucacauaccccguaa

SEQ ID NO: 259188 - RNA, 18 nt, Human
ucugcaaacuucgccuga

SEQ ID NO: 259189 - RNA, 21 nt, Human
ugagaauaacagccucuuucc

SEQ ID NO: 259190 - RNA, 19 nt, Human
ugagauaauagggaaauac

SEQ ID NO: 259191 - RNA, 23 nt, Human
ugaggggauggauaccucauucu

SEQ ID NO: 259192 - RNA, 22 nt, Human
ugaucuguacacacuuauucuc

SEQ ID NO: 259193 - RNA, 23 nt, Human
uguauaaaacagcaaucuauaug

SEQ ID NO: 259194 - RNA, 19 nt, Human
ugugucaaaacaucucaca

SEQ ID NO: 259195 - RNA, 24 nt, Human
uuuccuaggaucuucacugaucca

SEQ ID NO: 259196 - RNA, 22 nt, Human
aaacaacauaauaccauaaacu

SEQ ID NO: 259197 - RNA, 19 nt, Human
aaacauaaacauaagggca

SEQ ID NO: 259198 - RNA, 21 nt, Human
aaaguagauuuuuauuacaga

SEQ ID NO: 259199 - RNA, 20 nt, Human
aaaucuuuaggaagcagccc

SEQ ID NO: 259200 - RNA, 19 nt, Human
aaccugagguaaaaaaaau

SEQ ID NO: 259201 - RNA, 22 nt, Human
aagcagcccuguaacaauguac

SEQ ID NO: 259202 - RNA, 18 nt, Human
acuauauuaagagaaacc

SEQ ID NO: 259203 - RNA, 26 nt, Human
acucugaaugaauaccaagaagcaaa

SEQ ID NO: 259204 - RNA, 18 nt, Human
agcuccagaugcccugcu

SEQ ID NO: 259205 - RNA, 20 nt, Human
aggcauuuuuauucuugaua

SEQ ID NO: 259206 - RNA, 20 nt, Human
auuggcaguaguuuauguaa

SEQ ID NO: 259207 - RNA, 23 nt, Human
caacauaauaccauaaacugaca

SEQ ID NO: 259208 - RNA, 18 nt, Human
caacauccaucacacauc

SEQ ID NO: 259209 - RNA, 21 nt, Human
caagaagcaaaggauguacaa

SEQ ID NO: 259210 - RNA, 22 nt, Human
caaguaaacguuacaguauuaa

SEQ ID NO: 259211 - RNA, 21 nt, Human
cauaauaccauaaacugacaa

SEQ ID NO: 259212 - RNA, 23 nt, Human
cuccagaugcccugcugacuucc

SEQ ID NO: 259213 - RNA, 20 nt, Human
uaaaacaacauaauaccaua

SEQ ID NO: 259214 - RNA, 18 nt, Human
uaagagaaaccugaggua

SEQ ID NO: 259215 - RNA, 19 nt, Human
uaagagaaaccugagguaa

SEQ ID NO: 259216 - RNA, 24 nt, Human
uaccaagaagcaaaggauguacaa

SEQ ID NO: 259217 - RNA, 24 nt, Human
uagaucaggggcuaaaaauccacu

SEQ ID NO: 259218 - RNA, 20 nt, Human
uauuacagagcaaauuuuuc

SEQ ID NO: 259219 - RNA, 26 nt, Human
ugacauaauaaacauaaacauaaggg

SEQ ID NO: 259220 - RNA, 20 nt, Human
ugacuuccaccaagcacccc

SEQ ID NO: 259221 - RNA, 21 nt, Human
ugacuuccaccaagcaccccu

SEQ ID NO: 259222 - RNA, 23 nt, Human
ugagguaaaaaaaaucuuuagga

SEQ ID NO: 259223 - RNA, 21 nt, Human
ugcugacuuccaccaagcacc

SEQ ID NO: 259224 - RNA, 18 nt, Human
uggagaacuauauuaaga

SEQ ID NO: 259225 - RNA, 25 nt, Human
ugggaugagcuccagaugcccugcu

SEQ ID NO: 259226 - RNA, 23 nt, Human
uguacaacauccaucacacaucu

SEQ ID NO: 259227 - RNA, 22 nt, Human
uuccaccaagcaccccugggcc

SEQ ID NO: 259228 - RNA, 24 nt, Human
uuggcaguaguuuauguaagucaa

SEQ ID NO: 259229 - RNA, 18 nt, Human
uuuuuuuuuuuuuuuuug

SEQ ID NO: 259230 - RNA, 20 nt, Human
aaauuggagacagauacuau

SEQ ID NO: 259231 - RNA, 20 nt, Human
aggcuuauaaacaguacaaa

SEQ ID NO: 259232 - RNA, 18 nt, Human
caccgguucagggcaaga

SEQ ID NO: 259233 - RNA, 19 nt, Human
cagaggugcgcaaaacaug

SEQ ID NO: 259234 - RNA, 24 nt, Human
caguuaauuguaaaaggauaacac

SEQ ID NO: 259235 - RNA, 18 nt, Human
ccucuguuuauauuuccu

SEQ ID NO: 259236 - RNA, 19 nt, Human
cgaucuuccaaggcuuccu

SEQ ID NO: 259237 - RNA, 25 nt, Human
gaucuuccaaggcuuccugauuuaa

SEQ ID NO: 259238 - RNA, 19 nt, Human
gcgucaugcgaacugaacc

SEQ ID NO: 259239 - RNA, 21 nt, Human
guccuuuucuuuuguaaguuc

SEQ ID NO: 259240 - RNA, 18 nt, Human
uaaaaggauaacacuauu

SEQ ID NO: 259241 - RNA, 24 nt, Human
uaaauuggagacagauacuauuua

SEQ ID NO: 259242 - RNA, 24 nt, Human
uaauuauacauuagugcaaacaaa

SEQ ID NO: 259243 - RNA, 23 nt, Human
uacaaaauaguuugccuuuucug

SEQ ID NO: 259244 - RNA, 19 nt, Human
uacauuagugcaaacaaaa

SEQ ID NO: 259245 - RNA, 18 nt, Human
uagaaacaagcugcuucc

SEQ ID NO: 259246 - RNA, 21 nt, Human
uauaaaauagcaaguguaaga

SEQ ID NO: 259247 - RNA, 18 nt, Human
ucauagcuaacugauuua

SEQ ID NO: 259248 - RNA, 21 nt, Human
uccaaggcuuccugauuuaau

SEQ ID NO: 259249 - RNA, 20 nt, Human
uccaggagaaggcauccugc

SEQ ID NO: 259250 - RNA, 30 nt, Human
uccucuguuuauauuuccuuauucuugauu

SEQ ID NO: 259251 - RNA, 24 nt, Human
uguagaacaagucuauaaaauuga

SEQ ID NO: 259252 - RNA, 20 nt, Human
uuccugauuuaaucuugucu

SEQ ID NO: 259253 - RNA, 21 nt, Human
uucuuacuuugcucauuuccu

SEQ ID NO: 259254 - RNA, 22 nt, Human
uucuucacuccauuuggcaccg

SEQ ID NO: 259255 - RNA, 22 nt, Human
uuugcuguauauucaaaaucau

SEQ ID NO: 259256 - RNA, 21 nt, Human
aaaaaaaaaaaaaauuagcug

SEQ ID NO: 259257 - RNA, 23 nt, Human
aaacaaauaaaaaaaaccuacua

SEQ ID NO: 259258 - RNA, 22 nt, Human
aaaccggucucuccuaaaaaua

SEQ ID NO: 259259 - RNA, 24 nt, Human
aacacuuugggaggccaagguggg

SEQ ID NO: 259260 - RNA, 20 nt, Human
aacauggcaaaacccugucu

SEQ ID NO: 259261 - RNA, 21 nt, Human
aacauggcaaaacccugucuc

SEQ ID NO: 259262 - RNA, 23 nt, Human
aaucgcuugaacccggaggugga

SEQ ID NO: 259263 - RNA, 24 nt, Human
aauggcuugaacccgggaggcaga

SEQ ID NO: 259264 - RNA, 18 nt, Human
acagagugagacccuguc

SEQ ID NO: 259265 - RNA, 20 nt, Human
acagagugagacccugucuc

SEQ ID NO: 259266 - RNA, 23 nt, Human
acagagugagacccugucucaaa

SEQ ID NO: 259267 - RNA, 22 nt, Human
acaggcaaggcuccgucuaaaa

SEQ ID NO: 259268 - RNA, 24 nt, Human
acccugucucuacuaaaaauauga

SEQ ID NO: 259269 - RNA, 24 nt, Human
acgcuguacucccagcuacuuggg

SEQ ID NO: 259270 - RNA, 20 nt, Human
acuaucaugcaccaagcacu

SEQ ID NO: 259271 - RNA, 23 nt, Human
acugcacuccagucuggcaacag

SEQ ID NO: 259272 - RNA, 24 nt, Human
acugcagccugggugacagaguga

SEQ ID NO: 259273 - RNA, 22 nt, Human
agaagucucgagaguuuagcuc

SEQ ID NO: 259274 - RNA, 20 nt, Human
agagaggaaguaaaggagga

SEQ ID NO: 259275 - RNA, 27 nt, Human
agagaggaaguaaaggaggagggaccc

SEQ ID NO: 259276 - RNA, 24 nt, Human
agagguugcagugagccgagaucg

SEQ ID NO: 259277 - RNA, 24 nt, Human
agcacuuugggaggcagaggcagg

SEQ ID NO: 259278 - RNA, 24 nt, Human
agccugggcaacauggcaaaaccc

SEQ ID NO: 259279 - RNA, 22 nt, Human
agccugggugacagagugagac

SEQ ID NO: 259280 - RNA, 18 nt, Human
agcugugugugguggugu

SEQ ID NO: 259281 - RNA, 23 nt, Human
agcugugugugguggugugcgcc

SEQ ID NO: 259282 - RNA, 22 nt, Human
aggacaaauaaaucauguuccu

SEQ ID NO: 259283 - RNA, 19 nt, Human
aggagaagugaguagucag

SEQ ID NO: 259284 - RNA, 23 nt, Human
aggaguucaagaccagccugggc

SEQ ID NO: 259285 - RNA, 20 nt, Human
aggcaaggcuccgucuaaaa

SEQ ID NO: 259286 - RNA, 24 nt, Human
aggcacaagaaucgcuugaacccg

SEQ ID NO: 259287 - RNA, 21 nt, Human
aggcagaauggcuugaacccg

SEQ ID NO: 259288 - RNA, 22 nt, Human
aggcagaauggcuugaacccgg

SEQ ID NO: 259289 - RNA, 21 nt, Human
aggcagagguugcagugagcc

SEQ ID NO: 259290 - RNA, 24 nt, Human
aggcagagguugcagugagccgag

SEQ ID NO: 259291 - RNA, 18 nt, Human
aggcaggcggaucacgag

SEQ ID NO: 259292 - RNA, 26 nt, Human
aggcaggcggaucacgagaucagaua

SEQ ID NO: 259293 - RNA, 18 nt, Human
aggcaugguggcagacgc

SEQ ID NO: 259294 - RNA, 21 nt, Human
aggccaagguggguggaucac

SEQ ID NO: 259295 - RNA, 24 nt, Human
aggccgaggcacaagaaucgcuug

SEQ ID NO: 259296 - RNA, 19 nt, Human
aggcggaucacgagaucag

SEQ ID NO: 259297 - RNA, 21 nt, Human
aggcugaggcagaauggcuug

SEQ ID NO: 259298 - RNA, 25 nt, Human
agggggauggaggugaggucugggg

SEQ ID NO: 259299 - RNA, 24 nt, Human
agguggagguugcagugagcugag

SEQ ID NO: 259300 - RNA, 21 nt, Human
aguggcucaugccuguaaucc

SEQ ID NO: 259301 - RNA, 23 nt, Human
aguggcucaugccuguaauccua

SEQ ID NO: 259302 - RNA, 24 nt, Human
agugggucacaccuguaaucccag

SEQ ID NO: 259303 - RNA, 24 nt, Human
aucacccgagguuaggaguucaag

SEQ ID NO: 259304 - RNA, 24 nt, Human
aucgugccacugcacuccagucug

SEQ ID NO: 259305 - RNA, 19 nt, Human
augccuguaauccuaacac

SEQ ID NO: 259306 - RNA, 23 nt, Human
auugcacugcagccugggugaca

SEQ ID NO: 259307 - RNA, 22 nt, Human
caacauggcaaaacccugucuc

SEQ ID NO: 259308 - RNA, 24 nt, Human
caacauggcaaaacccugucucua

SEQ ID NO: 259309 - RNA, 21 nt, Human
caagguggguggaucacccga

SEQ ID NO: 259310 - RNA, 24 nt, Human
caagguggguggaucacccgaggu

SEQ ID NO: 259311 - RNA, 24 nt, Human
cacaccuguaaucccagcacuuug

SEQ ID NO: 259312 - RNA, 24 nt, Human
cacagugcuguaguagaugucuga

SEQ ID NO: 259313 - RNA, 23 nt, Human
cacccgagguuaggaguucaaga

SEQ ID NO: 259314 - RNA, 23 nt, Human
caccuguaaucccagcacuuugg

SEQ ID NO: 259315 - RNA, 24 nt, Human
caccuguaaucccagcacuuuggg

SEQ ID NO: 259316 - RNA, 18 nt, Human
cacugcacuccagucugg

SEQ ID NO: 259317 - RNA, 20 nt, Human
cacugcacuccagucuggca

SEQ ID NO: 259318 - RNA, 22 nt, Human
cacugcacuccagucuggcaac

SEQ ID NO: 259319 - RNA, 23 nt, Human
cacugcacuccagucuggcaaca

SEQ ID NO: 259320 - RNA, 24 nt, Human
cacugcacuccagucuggcaacag

SEQ ID NO: 259321 - RNA, 20 nt, Human
cacugcagccugggugacag

SEQ ID NO: 259322 - RNA, 23 nt, Human
cacugcagccugggugacagagu

SEQ ID NO: 259323 - RNA, 24 nt, Human
cacugcagccugggugacagagug

SEQ ID NO: 259324 - RNA, 25 nt, Human
cagaggcaggcggaucacgagauca

SEQ ID NO: 259325 - RNA, 24 nt, Human
cagcacuuugggaggcagaggcag

SEQ ID NO: 259326 - RNA, 26 nt, Human
cagcacuuugggaggcagaggcaggc

SEQ ID NO: 259327 - RNA, 22 nt, Human
cagccuugacaaaucuuacagc

SEQ ID NO: 259328 - RNA, 24 nt, Human
cagcuacuugggaggcugaggcag

SEQ ID NO: 259329 - RNA, 23 nt, Human
caguagaguaagaucagugcaau

SEQ ID NO: 259330 - RNA, 24 nt, Human
caugccuguaauccuaacacuuug

SEQ ID NO: 259331 - RNA, 19 nt, Human
cauugcacugcagccuggg

SEQ ID NO: 259332 - RNA, 24 nt, Human
cauugcacugcagccugggugaca

SEQ ID NO: 259333 - RNA, 25 nt, Human
cauugcacugcagccugggugacag

SEQ ID NO: 259334 - RNA, 21 nt, Human
ccaagcacuacucuaggugcu

SEQ ID NO: 259335 - RNA, 19 nt, Human
ccacugcacuccagucugg

SEQ ID NO: 259336 - RNA, 19 nt, Human
ccacugcacuccagucugg

SEQ ID NO: 259337 - RNA, 20 nt, Human
ccacugcacuccagucuggc

SEQ ID NO: 259338 - RNA, 23 nt, Human
ccacugcacuccagucuggcaac

SEQ ID NO: 259339 - RNA, 20 nt, Human
ccauugcacugcagccuggg

SEQ ID NO: 259340 - RNA, 21 nt, Human
ccauugcacugcagccugggu

SEQ ID NO: 259341 - RNA, 24 nt, Human
ccauugcacugcagccugggugac

SEQ ID NO: 259342 - RNA, 23 nt, Human
cccgagguuaggaguucaagacc

SEQ ID NO: 259343 - RNA, 20 nt, Human
cccggagguggagguugcag

SEQ ID NO: 259344 - RNA, 24 nt, Human
cccugucucaaacaaauaaaaaaa

SEQ ID NO: 259345 - RNA, 24 nt, Human
ccugccuuagcccauccucccuuc

SEQ ID NO: 259346 - RNA, 22 nt, Human
ccuggccaacguggugaaaacc

SEQ ID NO: 259347 - RNA, 23 nt, Human
ccuggccaacguggugaaaaccg

SEQ ID NO: 259348 - RNA, 22 nt, Human
ccugggcaacauggcaaaaccc

SEQ ID NO: 259349 - RNA, 24 nt, Human
ccugggcaacauggcaaaacccug

SEQ ID NO: 259350 - RNA, 20 nt, Human
ccugggugacagagugagac

SEQ ID NO: 259351 - RNA, 22 nt, Human
ccuguaaucccagcuacuaggg

SEQ ID NO: 259352 - RNA, 24 nt, Human
cgagaccauccuggccaacguggu

SEQ ID NO: 259353 - RNA, 24 nt, Human
cgagaucgugccacugcacuccag

SEQ ID NO: 259354 - RNA, 24 nt, Human
cgaggcacaagaaucgcuugaacc

SEQ ID NO: 259355 - RNA, 23 nt, Human
cgccuguaaucccagcuacuagg

SEQ ID NO: 259356 - RNA, 24 nt, Human
cgccuguaaucccagcuacuaggg

SEQ ID NO: 259357 - RNA, 23 nt, Human
cgcuguacucccagcuacuuggg

SEQ ID NO: 259358 - RNA, 23 nt, Human
cggagguggagguugcagugagc

SEQ ID NO: 259359 - RNA, 24 nt, Human
cgggaggcagagguugcagugagc

SEQ ID NO: 259360 - RNA, 20 nt, Human
cgucuaaaaaaaaaaaaaaa

SEQ ID NO: 259361 - RNA, 20 nt, Human
cuaaaaaaaaaaaaaaaaaa

SEQ ID NO: 259362 - RNA, 19 nt, Human
cuaacacuuugggaggcca

SEQ ID NO: 259363 - RNA, 24 nt, Human
cucaugccuguaauccuaacacuu

SEQ ID NO: 259364 - RNA, 21 nt, Human
cugguuuuaugucagcagcag

SEQ ID NO: 259365 - RNA, 24 nt, Human
gacagagugagacccugucucaaa

SEQ ID NO: 259366 - RNA, 22 nt, Human
gaggcaggaccaagguaggaaa

SEQ ID NO: 259367 - RNA, 23 nt, Human
gagguugcagugagcugagaucg

SEQ ID NO: 259368 - RNA, 23 nt, Human
gaucacccgagguuaggaguuca

SEQ ID NO: 259369 - RNA, 24 nt, Human
gaucacccgagguuaggaguucaa

SEQ ID NO: 259370 - RNA, 24 nt, Human
gccaacguggugaaaaccggucuc

SEQ ID NO: 259371 - RNA, 24 nt, Human
gccauugcacugcagccuggguga

SEQ ID NO: 259372 - RNA, 20 nt, Human
gccgagaucgugccacugca

SEQ ID NO: 259373 - RNA, 18 nt, Human
gcgcagugggucacaccu

SEQ ID NO: 259374 - RNA, 21 nt, Human
ggaaguguggggaaguggagg

SEQ ID NO: 259375 - RNA, 21 nt, Human
ggacaaauaaaucauguuccu

SEQ ID NO: 259376 - RNA, 21 nt, Human
ggaggcugaggcagaauggcu

SEQ ID NO: 259377 - RNA, 22 nt, Human
ggagguugcagugagcugagau

SEQ ID NO: 259378 - RNA, 23 nt, Human
ggagguugcagugagcugagauc

SEQ ID NO: 259379 - RNA, 24 nt, Human
ggagguugcagugagcugagaucg

SEQ ID NO: 259380 - RNA, 21 nt, Human
ggaucacgagaucagauaucg

SEQ ID NO: 259381 - RNA, 27 nt, Human
ggcaaggcuccgucuaaaaaaaaaaaa

SEQ ID NO: 259382 - RNA, 22 nt, Human
gggaggccgaggcacaagaauc

SEQ ID NO: 259383 - RNA, 24 nt, Human
gggcagacagagggggauggaggu

SEQ ID NO: 259384 - RNA, 24 nt, Human
gggcgcaguggcucaugccuguaa

SEQ ID NO: 259385 - RNA, 19 nt, Human
gguggagguugcagugagc

SEQ ID NO: 259386 - RNA, 24 nt, Human
gguggugugcgccuguaaucccag

SEQ ID NO: 259387 - RNA, 21 nt, Human
guaaacaguuaguugcauaaa

SEQ ID NO: 259388 - RNA, 24 nt, Human
gucagccuugacaaaucuuacagc

SEQ ID NO: 259389 - RNA, 20 nt, Human
guccugguuuuaugucagca

SEQ ID NO: 259390 - RNA, 20 nt, Human
guggagguugcagugagcug

SEQ ID NO: 259391 - RNA, 24 nt, Human
guggugugcgccuguaaucccagc

SEQ ID NO: 259392 - RNA, 24 nt, Human
guugcagugagccgagaucgugcc

SEQ ID NO: 259393 - RNA, 19 nt, Human
guugcagugagcugagauc

SEQ ID NO: 259394 - RNA, 24 nt, Human
uaacacuuugggaggccaaggugg

SEQ ID NO: 259395 - RNA, 18 nt, Human
uacuagggaggccgaggc

SEQ ID NO: 259396 - RNA, 22 nt, Human
uagcucuguccagggaacuggg

SEQ ID NO: 259397 - RNA, 20 nt, Human
uaggggaacuaauugaagua

SEQ ID NO: 259398 - RNA, 23 nt, Human
uaucccuguuuuacagaugaaaa

SEQ ID NO: 259399 - RNA, 18 nt, Human
ucaacauauaguaaaggc

SEQ ID NO: 259400 - RNA, 23 nt, Human
ucacaccuguaaucccagcacuu

SEQ ID NO: 259401 - RNA, 23 nt, Human
ucacgagaucagauaucgagacc

SEQ ID NO: 259402 - RNA, 23 nt, Human
ucagccgggcgcaguggcucaug

SEQ ID NO: 259403 - RNA, 18 nt, Human
ucagugcaaugaagccua

SEQ ID NO: 259404 - RNA, 22 nt, Human
uccgucuaaaaaaaaaaaaaaa

SEQ ID NO: 259405 - RNA, 25 nt, Human
uccgucuaaaaaaaaaaaaaaaaaa

SEQ ID NO: 259406 - RNA, 23 nt, Human
ucgcuugaacccggagguggagg

SEQ ID NO: 259407 - RNA, 23 nt, Human
ucgugccacugcacuccagucug

SEQ ID NO: 259408 - RNA, 21 nt, Human
ucucuacuaaaaauaugaaaa

SEQ ID NO: 259409 - RNA, 19 nt, Human
ucugagcuagagauaagaa

SEQ ID NO: 259410 - RNA, 21 nt, Human
ugaaaaaacuaaggcucaaag

SEQ ID NO: 259411 - RNA, 27 nt, Human
ugaaaaaacuaaggcucaaagacauua

SEQ ID NO: 259412 - RNA, 22 nt, Human
ugacagagugagacccugucuc

SEQ ID NO: 259413 - RNA, 22 nt, Human
ugagccgagaucgugccacugc

SEQ ID NO: 259414 - RNA, 22 nt, Human
ugagcugagaucgcgccauugc

SEQ ID NO: 259415 - RNA, 21 nt, Human
ugaggcagaauggcuugaacc

SEQ ID NO: 259416 - RNA, 22 nt, Human
ugaggcagaauggcuugaaccc

SEQ ID NO: 259417 - RNA, 21 nt, Human
ugagggcagacagagggggau

SEQ ID NO: 259418 - RNA, 22 nt, Human
ugaggugcacuuugccugggca

SEQ ID NO: 259419 - RNA, 23 nt, Human
ugcaaugaagccuaauugugagg

SEQ ID NO: 259420 - RNA, 22 nt, Human
ugcacugcagccugggugacag

SEQ ID NO: 259421 - RNA, 24 nt, Human
ugcacugcagccugggugacagag

SEQ ID NO: 259422 - RNA, 24 nt, Human
ugcagccugggugacagagugaga

SEQ ID NO: 259423 - RNA, 23 nt, Human
ugccuguaauccuaacacuuugg

SEQ ID NO: 259424 - RNA, 23 nt, Human
ugccuguaauccuaacacuuugg

SEQ ID NO: 259425 - RNA, 24 nt, Human
ugccuguaauccuaacacuuuggg

SEQ ID NO: 259426 - RNA, 20 nt, Human
ugccuguggagaaagggucc

SEQ ID NO: 259427 - RNA, 23 nt, Human
ugccuuagcccauccucccuuca

SEQ ID NO: 259428 - RNA, 21 nt, Human
uggaauggucaacauauagua

SEQ ID NO: 259429 - RNA, 18 nt, Human
uggagguugcagugagcu

SEQ ID NO: 259430 - RNA, 24 nt, Human
uggaucacccgagguuaggaguuc

SEQ ID NO: 259431 - RNA, 19 nt, Human
uggccaacguggugaaaac

SEQ ID NO: 259432 - RNA, 19 nt, Human
uggcucaugccuguaaucc

SEQ ID NO: 259433 - RNA, 24 nt, Human
uggcucaugccuguaauccuaaca

SEQ ID NO: 259434 - RNA, 20 nt, Human
uggcuugaacccgggaggca

SEQ ID NO: 259435 - RNA, 19 nt, Human
ugggaaguguggggaagug

SEQ ID NO: 259436 - RNA, 18 nt, Human
ugggaggcagaggcaggc

SEQ ID NO: 259437 - RNA, 19 nt, Human
ugggaggcagaggcaggcg

SEQ ID NO: 259438 - RNA, 24 nt, Human
ugggaggcagaggcaggcggauca

SEQ ID NO: 259439 - RNA, 23 nt, Human
ugggaggccaagguggguggauc

SEQ ID NO: 259440 - RNA, 24 nt, Human
ugggaggccaagguggguggauca

SEQ ID NO: 259441 - RNA, 18 nt, Human
ugggaggcugaggcagaa

SEQ ID NO: 259442 - RNA, 21 nt, Human
ugggaggcugaggcagaaugg

SEQ ID NO: 259443 - RNA, 19 nt, Human
uggggcugugcgcaguggg

SEQ ID NO: 259444 - RNA, 22 nt, Human
uggggugcuguuauuaucccug

SEQ ID NO: 259445 - RNA, 22 nt, Human
ugggucacaccuguaaucccag

SEQ ID NO: 259446 - RNA, 24 nt, Human
ugggucacaccuguaaucccagca

SEQ ID NO: 259447 - RNA, 21 nt, Human
ugggugacagagugagacccu

SEQ ID NO: 259448 - RNA, 24 nt, Human
uggguggaucacccgagguuagga

SEQ ID NO: 259449 - RNA, 24 nt, Human
ugguggugugcgccuguaauccca

SEQ ID NO: 259450 - RNA, 21 nt, Human
uggugugcgccuguaauccca

SEQ ID NO: 259451 - RNA, 24 nt, Human
uggugugcgccuguaaucccagcu

SEQ ID NO: 259452 - RNA, 20 nt, Human
uguggagaaaggguccuggu

SEQ ID NO: 259453 - RNA, 18 nt, Human
uguggggguaggguaggg

SEQ ID NO: 259454 - RNA, 19 nt, Human
uuacuuagauuaucucaau

SEQ ID NO: 259455 - RNA, 18 nt, Human
uuagcuggggcugugcgc

SEQ ID NO: 259456 - RNA, 22 nt, Human
uuagcugugugugguggugugc

SEQ ID NO: 259457 - RNA, 24 nt, Human
uuagcugugugugguggugugcgc

SEQ ID NO: 259458 - RNA, 22 nt, Human
uucuccgccacugugugccugc

SEQ ID NO: 259459 - RNA, 23 nt, Human
uugaacccggagguggagguugc

SEQ ID NO: 259460 - RNA, 25 nt, Human
uugaaggccuacuaucaugcaccaa

SEQ ID NO: 259461 - RNA, 21 nt, Human
uugacaucaaagaggagagag

SEQ ID NO: 259462 - RNA, 18 nt, Human
uugcagugagccgagauc

SEQ ID NO: 259463 - RNA, 22 nt, Human
uugcagugagccgagaucgugc

SEQ ID NO: 259464 - RNA, 18 nt, Human
uugcagugagcugagauc

SEQ ID NO: 259465 - RNA, 19 nt, Human
uugcagugagcugagaucg

SEQ ID NO: 259466 - RNA, 20 nt, Human
uugcagugagcugagaucgc

SEQ ID NO: 259467 - RNA, 22 nt, Human
uugcagugagcugagaucgcgc

SEQ ID NO: 259468 - RNA, 20 nt, Human
uugggaggcugaggcagaau

SEQ ID NO: 259469 - RNA, 21 nt, Human
uuuggaauggucaacauauag

SEQ ID NO: 259470 - RNA, 27 nt, Human
aagaaaccaugacagauggugggcacc

SEQ ID NO: 259471 - RNA, 21 nt, Human
aagaaccagaggauacaagug

SEQ ID NO: 259472 - RNA, 23 nt, Human
aauaaaugguacagaaagggcaa

SEQ ID NO: 259473 - RNA, 24 nt, Human
acaagugggcccuccaagaaacca

SEQ ID NO: 259474 - RNA, 21 nt, Human
acacacacgcaugaaaagcca

SEQ ID NO: 259475 - RNA, 19 nt, Human
acacacucacauaaauggc

SEQ ID NO: 259476 - RNA, 23 nt, Human
acauacacauaacccaugaaaca

SEQ ID NO: 259477 - RNA, 20 nt, Human
acugguccagcucugcuaac

SEQ ID NO: 259478 - RNA, 22 nt, Human
agauauaccccucacugcugca

SEQ ID NO: 259479 - RNA, 21 nt, Human
agauggcaucuugguaucucu

SEQ ID NO: 259480 - RNA, 18 nt, Human
agcaagaaaucaggguga

SEQ ID NO: 259481 - RNA, 21 nt, Human
agcuuccaaggaccccaccuc

SEQ ID NO: 259482 - RNA, 24 nt, Human
aggaagaaaacucuuguuuaagga

SEQ ID NO: 259483 - RNA, 23 nt, Human
aggcagucuaguuccugagcugu

SEQ ID NO: 259484 - RNA, 22 nt, Human
aggugcucaauaaaugaagaac

SEQ ID NO: 259485 - RNA, 24 nt, Human
agucuaguuccugagcugugcucc

SEQ ID NO: 259486 - RNA, 18 nt, Human
aguuccugagcugugcuc

SEQ ID NO: 259487 - RNA, 19 nt, Human
caacuggccagcccagaua

SEQ ID NO: 259488 - RNA, 21 nt, Human
caagugggcccuccaagaaac

SEQ ID NO: 259489 - RNA, 24 nt, Human
cacaaacacacacucacauaaaug

SEQ ID NO: 259490 - RNA, 22 nt, Human
cacugcucucuuauccccuugc

SEQ ID NO: 259491 - RNA, 19 nt, Human
cagaggauacaagugggcc

SEQ ID NO: 259492 - RNA, 27 nt, Human
cagcacaaacacacacucacauaaaug

SEQ ID NO: 259493 - RNA, 22 nt, Human
cagcccagcugcagcuggcuua

SEQ ID NO: 259494 - RNA, 21 nt, Human
cagcuggcuuaucccuccaag

SEQ ID NO: 259495 - RNA, 22 nt, Human
caggauuggaacccaggcaguc

SEQ ID NO: 259496 - RNA, 29 nt, Human
cauguucagacaacacacacgcauggugu

SEQ ID NO: 259497 - RNA, 22 nt, Human
cccagaacagggcugggcucau

SEQ ID NO: 259498 - RNA, 18 nt, Human
ccccuuuguaccucagcc

SEQ ID NO: 259499 - RNA, 18 nt, Human
cccuugccagcugcuguc

SEQ ID NO: 259500 - RNA, 18 nt, Human
ccuuuauuaucauaaaca

SEQ ID NO: 259501 - RNA, 20 nt, Human
cucacugcugcacccccuua

SEQ ID NO: 259502 - RNA, 20 nt, Human
cuccaaggcaccacuggucc

SEQ ID NO: 259503 - RNA, 23 nt, Human
cucuuauccccuugccagcugcu

SEQ ID NO: 259504 - RNA, 18 nt, Human
cugcacccccuuaccugg

SEQ ID NO: 259505 - RNA, 24 nt, Human
cugcucaaucccccuuuguaccuc

SEQ ID NO: 259506 - RNA, 18 nt, Human
cugcugcacccccuuacc

SEQ ID NO: 259507 - RNA, 23 nt, Human
cugcugccuuccacauacucagu

SEQ ID NO: 259508 - RNA, 20 nt, Human
gacaacacacacgcaugaaa

SEQ ID NO: 259509 - RNA, 18 nt, Human
gcacccccuuaccuggcc

SEQ ID NO: 259510 - RNA, 23 nt, Human
gggagccauggccugagccuggc

SEQ ID NO: 259511 - RNA, 20 nt, Human
guaucucuuucuugccucua

SEQ ID NO: 259512 - RNA, 23 nt, Human
uaacccaugaaacacuccccaug

SEQ ID NO: 259513 - RNA, 18 nt, Human
uaagucaaccacacagcc

SEQ ID NO: 259514 - RNA, 19 nt, Human
uaauuugcucaaggucaca

SEQ ID NO: 259515 - RNA, 21 nt, Human
uaguuccugagcugugcuccu

SEQ ID NO: 259516 - RNA, 24 nt, Human
uauggauaaagccagaccuccuug

SEQ ID NO: 259517 - RNA, 23 nt, Human
ucaaccacacagcccagcugcag

SEQ ID NO: 259518 - RNA, 21 nt, Human
ucagggugaggaagaaaaagg

SEQ ID NO: 259519 - RNA, 19 nt, Human
uccaaggaccccaccuccc

SEQ ID NO: 259520 - RNA, 18 nt, Human
ucccccuuuguaccucag

SEQ ID NO: 259521 - RNA, 19 nt, Human
uccugggcugcucaauccc

SEQ ID NO: 259522 - RNA, 19 nt, Human
ucuccugggcugcucaauc

SEQ ID NO: 259523 - RNA, 18 nt, Human
ucucuuauccccuugcca

SEQ ID NO: 259524 - RNA, 24 nt, Human
ugaauaagcaagaaaucaggguug

SEQ ID NO: 259525 - RNA, 26 nt, Human
ugacagauguaauuuacaaggaagaa

SEQ ID NO: 259526 - RNA, 22 nt, Human
uggccugagccuggcuggcugg

SEQ ID NO: 259527 - RNA, 22 nt, Human
uucgcacauacaugagcacaca

SEQ ID NO: 259528 - RNA, 22 nt, Human
aaaagacaaaugaaauacccag

SEQ ID NO: 259529 - RNA, 19 nt, Human
aagaagacugaaccuuacu

SEQ ID NO: 259530 - RNA, 23 nt, Human
acaaaacuaguuggagcagcccu

SEQ ID NO: 259531 - RNA, 24 nt, Human
acuggaacgcaagacagggcaguc

SEQ ID NO: 259532 - RNA, 19 nt, Human
agacagggcagcgcuggga

SEQ ID NO: 259533 - RNA, 24 nt, Human
agagcuggaagcugacacaaaacu

SEQ ID NO: 259534 - RNA, 18 nt, Human
agcugacacaaaacuagu

SEQ ID NO: 259535 - RNA, 25 nt, Human
agcuggaacacuggaacgcaagaca

SEQ ID NO: 259536 - RNA, 19 nt, Human
cacaaaacuaguuggagca

SEQ ID NO: 259537 - RNA, 19 nt, Human
caggagccugagcaagaag

SEQ ID NO: 259538 - RNA, 19 nt, Human
ccaaaugcuggagaggggc

SEQ ID NO: 259539 - RNA, 21 nt, Human
ccaaaugcuggagaggggcau

SEQ ID NO: 259540 - RNA, 22 nt, Human
ccaaaugcuggagaggggcaua

SEQ ID NO: 259541 - RNA, 21 nt, Human
cugacacaaaacuaguuggag

SEQ ID NO: 259542 - RNA, 23 nt, Human
cuucaggagccugagcaagaaga

SEQ ID NO: 259543 - RNA, 22 nt, Human
gacagggcagcgcugggaauga

SEQ ID NO: 259544 - RNA, 20 nt, Human
gacagggcccggggccugcg

SEQ ID NO: 259545 - RNA, 18 nt, Human
gcccggggccugcggggc

SEQ ID NO: 259546 - RNA, 19 nt, Human
gcccuguuugucuuaaagc

SEQ ID NO: 259547 - RNA, 19 nt, Human
gcggggcugcggagaaggc

SEQ ID NO: 259548 - RNA, 19 nt, Human
gcugcggagaaggcgggag

SEQ ID NO: 259549 - RNA, 19 nt, Human
gcuggaacacuggaacgca

SEQ ID NO: 259550 - RNA, 19 nt, Human
gcugggaaugacagggccc

SEQ ID NO: 259551 - RNA, 19 nt, Human
ggaacacuggaacgcaaga

SEQ ID NO: 259552 - RNA, 24 nt, Human
ggccugcggggcugcggagaaggc

SEQ ID NO: 259553 - RNA, 23 nt, Human
gggcugcggagaaggcgggagac

SEQ ID NO: 259554 - RNA, 19 nt, Human
uacuucuuacccccaauuu

SEQ ID NO: 259555 - RNA, 21 nt, Human
uagaaaguugcaguuaaaaac

SEQ ID NO: 259556 - RNA, 19 nt, Human
ucgcagaagcuggaacacu

SEQ ID NO: 259557 - RNA, 21 nt, Human
ucgcagaagcuggaacacugg

SEQ ID NO: 259558 - RNA, 21 nt, Human
ucuaucaggagaaucaacccu

SEQ ID NO: 259559 - RNA, 19 nt, Human
ugaaauacccagcauauac

SEQ ID NO: 259560 - RNA, 21 nt, Human
ugaaccuuacuggcugaauua

SEQ ID NO: 259561 - RNA, 22 nt, Human
ugacacaaaacuaguuggagca

SEQ ID NO: 259562 - RNA, 18 nt, Human
ugagcaagaagacugaac

SEQ ID NO: 259563 - RNA, 22 nt, Human
ugagcaagaagacugaaccuua

SEQ ID NO: 259564 - RNA, 26 nt, Human
ugcuuuugcugugcaucacccuugau

SEQ ID NO: 259565 - RNA, 19 nt, Human
uggagaggggcauacagug

SEQ ID NO: 259566 - RNA, 20 nt, Human
uggagaggggcauacagugg

SEQ ID NO: 259567 - RNA, 23 nt, Human
uuagagggaugggguccauugcu

SEQ ID NO: 259568 - RNA, 24 nt, Human
uuagagggaugggguccauugcuu

SEQ ID NO: 259569 - RNA, 20 nt, Human
uugaagguuucccuagagca

SEQ ID NO: 259570 - RNA, 20 nt, Human
aaaaccaaucagugagaaaa

SEQ ID NO: 259571 - RNA, 21 nt, Human
aaacaccccauuuccuuccca

SEQ ID NO: 259572 - RNA, 20 nt, Human
aaaggagcugggagcugcag

SEQ ID NO: 259573 - RNA, 21 nt, Human
aaaucuggagaaacuucggca

SEQ ID NO: 259574 - RNA, 19 nt, Human
aaccaaucagugagaaaac

SEQ ID NO: 259575 - RNA, 22 nt, Human
aacccccagaaaggggccccaa

SEQ ID NO: 259576 - RNA, 30 nt, Human
aagaaaaccaaucagugagaaaacucaagg

SEQ ID NO: 259577 - RNA, 24 nt, Human
aagagugaccuccaaaacaaaacc

SEQ ID NO: 259578 - RNA, 23 nt, Human
aagcagcugcaacaacagaucuu

SEQ ID NO: 259579 - RNA, 20 nt, Human
aagcagcuuuucucuucucu

SEQ ID NO: 259580 - RNA, 22 nt, Human
aagcccaggcucccaagguccc

SEQ ID NO: 259581 - RNA, 23 nt, Human
aaggaccgagcagcaucugcccu

SEQ ID NO: 259582 - RNA, 21 nt, Human
aagguccccucugcacuccuc

SEQ ID NO: 259583 - RNA, 22 nt, Human
aagugacccuauagccucaggu

SEQ ID NO: 259584 - RNA, 23 nt, Human
acacacacacacacgcacgugca

SEQ ID NO: 259585 - RNA, 20 nt, Human
acacacacgcacgugcacac

SEQ ID NO: 259586 - RNA, 20 nt, Human
accaccacccgggccugccu

SEQ ID NO: 259587 - RNA, 22 nt, Human
accaccacccgggccugccugg

SEQ ID NO: 259588 - RNA, 18 nt, Human
accauguggucccaaagc

SEQ ID NO: 259589 - RNA, 19 nt, Human
acccagccccagcccuguu

SEQ ID NO: 259590 - RNA, 18 nt, Human
accccaugaaugcccacc

SEQ ID NO: 259591 - RNA, 24 nt, Human
accccauuuccuucccacucccuu

SEQ ID NO: 259592 - RNA, 33 nt, Human
accugacacacacacacacacacgcacguggug

SEQ ID NO: 259593 - RNA, 19 nt, Human
acgcacacacauacacaca

SEQ ID NO: 259594 - RNA, 19 nt, Human
acucugacuccuccagccu

SEQ ID NO: 259595 - RNA, 22 nt, Human
acugacuaagggaaaagaggag

SEQ ID NO: 259596 - RNA, 24 nt, Human
agaaaacaccccauuuccuuccca

SEQ ID NO: 259597 - RNA, 25 nt, Human
agaaaaccaaauggaccaaggucaa

SEQ ID NO: 259598 - RNA, 24 nt, Human
agacagaaaaccaaauggaccaag

SEQ ID NO: 259599 - RNA, 22 nt, Human
agacagaaaaccaaauggacug

SEQ ID NO: 259600 - RNA, 22 nt, Human
agacaggagggaagggccccag

SEQ ID NO: 259601 - RNA, 27 nt, Human
agacaggagggaagggccccaggccug

SEQ ID NO: 259602 - RNA, 19 nt, Human
agaccgagaagagacagga

SEQ ID NO: 259603 - RNA, 23 nt, Human
agagucauagagcuguggugggg

SEQ ID NO: 259604 - RNA, 18 nt, Human
agaucuuccccugccucu

SEQ ID NO: 259605 - RNA, 19 nt, Human
agccaaagaccaggugaac

SEQ ID NO: 259606 - RNA, 22 nt, Human
agccccuagcuccgggcggcuc

SEQ ID NO: 259607 - RNA, 21 nt, Human
aggaaaaagaaagaaaaccaa

SEQ ID NO: 259608 - RNA, 21 nt, Human
aggaaauggcaagugacccua

SEQ ID NO: 259609 - RNA, 21 nt, Human
aggagcugggagcugcagugc

SEQ ID NO: 259610 - RNA, 19 nt, Human
aggagggaagggccccagg

SEQ ID NO: 259611 - RNA, 23 nt, Human
aggcaagggcucugaaacgucuc

SEQ ID NO: 259612 - RNA, 23 nt, Human
agggaggagacaucaggaaagga

SEQ ID NO: 259613 - RNA, 18 nt, Human
agggccccaggccugccc

SEQ ID NO: 259614 - RNA, 21 nt, Human
augguaggguccucacucucu

SEQ ID NO: 259615 - RNA, 18 nt, Human
caaauggaccaaggucaa

SEQ ID NO: 259616 - RNA, 18 nt, Human
caacccagccccagcccu

SEQ ID NO: 259617 - RNA, 21 nt, Human
caagaaaacaccccauuuccu

SEQ ID NO: 259618 - RNA, 21 nt, Human
caaggaaaaagaaagaaaacc

SEQ ID NO: 259619 - RNA, 20 nt, Human
cacaaccuggugccagaggc

SEQ ID NO: 259620 - RNA, 19 nt, Human
cacaagguaccccaugaau

SEQ ID NO: 259621 - RNA, 27 nt, Human
cacaagguaccccaugaaugcccaccu

SEQ ID NO: 259622 - RNA, 24 nt, Human
cacacaaccuggugccagaggcac

SEQ ID NO: 259623 - RNA, 26 nt, Human
cacacacacacacacacgcacgugca

SEQ ID NO: 259624 - RNA, 23 nt, Human
cacacacacacacgcacgugcac

SEQ ID NO: 259625 - RNA, 22 nt, Human
cacacagugguucaggggccag

SEQ ID NO: 259626 - RNA, 31 nt, Human
cacgcacgugcacacgcacacacauacacag

SEQ ID NO: 259627 - RNA, 26 nt, Human
cacuuggaagaacugggaggcacaag

SEQ ID NO: 259628 - RNA, 20 nt, Human
cagcagcccugaugcaagug

SEQ ID NO: 259629 - RNA, 21 nt, Human
cagcaucugcccugcgacccu

SEQ ID NO: 259630 - RNA, 23 nt, Human
cagcaucugcccugcgacccugu

SEQ ID NO: 259631 - RNA, 23 nt, Human
caggacacauuggagaaaucugg

SEQ ID NO: 259632 - RNA, 18 nt, Human
caggagugggcagcaccu

SEQ ID NO: 259633 - RNA, 22 nt, Human
caggucagcaagaaaacacccc

SEQ ID NO: 259634 - RNA, 21 nt, Human
caggugccgaacaugcacgug

SEQ ID NO: 259635 - RNA, 26 nt, Human
ccaaaacaaaacccuuugcuuccucc

SEQ ID NO: 259636 - RNA, 21 nt, Human
ccaagguccccucugcacucc

SEQ ID NO: 259637 - RNA, 26 nt, Human
ccaccacccgggccugccuggcugcc

SEQ ID NO: 259638 - RNA, 19 nt, Human
ccacccgggccugccuggc

SEQ ID NO: 259639 - RNA, 22 nt, Human
ccacccgggccugccuggcugc

SEQ ID NO: 259640 - RNA, 23 nt, Human
ccagccuggcccuguggggagca

SEQ ID NO: 259641 - RNA, 21 nt, Human
ccagcgggccacacauucccc

SEQ ID NO: 259642 - RNA, 18 nt, Human
ccaucagagaugaugguc

SEQ ID NO: 259643 - RNA, 21 nt, Human
ccauccugccccuaccugggc

SEQ ID NO: 259644 - RNA, 21 nt, Human
cccaaagagugaccuccaaaa

SEQ ID NO: 259645 - RNA, 19 nt, Human
cccaaauuaaaccugacac

SEQ ID NO: 259646 - RNA, 26 nt, Human
cccagccccagcccuguuccgguucc

SEQ ID NO: 259647 - RNA, 18 nt, Human
ccccaaagagugaccucc

SEQ ID NO: 259648 - RNA, 22 nt, Human
ccccaugaaugcccaccucccu

SEQ ID NO: 259649 - RNA, 22 nt, Human
ccccuaccugggcugagcccac

SEQ ID NO: 259650 - RNA, 22 nt, Human
ccccuaccugggcugagcccac

SEQ ID NO: 259651 - RNA, 24 nt, Human
cccuauagccucaggucagcaaga

SEQ ID NO: 259652 - RNA, 20 nt, Human
cccuccauccugccccuacc

SEQ ID NO: 259653 - RNA, 19 nt, Human
cccucugaggacaggcucc

SEQ ID NO: 259654 - RNA, 18 nt, Human
cccuguggggagcagggc

SEQ ID NO: 259655 - RNA, 19 nt, Human
cccuugagcaucccuagca

SEQ ID NO: 259656 - RNA, 22 nt, Human
ccuagcagugaaggugccauga

SEQ ID NO: 259657 - RNA, 20 nt, Human
ccucccuggcagugcacgcc

SEQ ID NO: 259658 - RNA, 20 nt, Human
ccucccuggcagugcacgcc

SEQ ID NO: 259659 - RNA, 21 nt, Human
ccugcugggagcuguuaccca

SEQ ID NO: 259660 - RNA, 24 nt, Human
ccuggaccuggcuagacagaaaac

SEQ ID NO: 259661 - RNA, 21 nt, Human
ccuggcccuguggggagcagg

SEQ ID NO: 259662 - RNA, 18 nt, Human
ccuucaagcccaggcucc

SEQ ID NO: 259663 - RNA, 23 nt, Human
cuaccuggaccuggcuagacaga

SEQ ID NO: 259664 - RNA, 19 nt, Human
cucagcccuccauccugcc

SEQ ID NO: 259665 - RNA, 24 nt, Human
cuccauccugccccuaccugggcu

SEQ ID NO: 259666 - RNA, 18 nt, Human
cucccaagguccccucug

SEQ ID NO: 259667 - RNA, 25 nt, Human
cucccuuaggcugagggugaugcaa

SEQ ID NO: 259668 - RNA, 20 nt, Human
cuccuccuuagccccuccaa

SEQ ID NO: 259669 - RNA, 21 nt, Human
cucucacucugacuccuccag

SEQ ID NO: 259670 - RNA, 22 nt, Human
cucucuugaggucccucaaaua

SEQ ID NO: 259671 - RNA, 20 nt, Human
cucugugcugaagccagacc

SEQ ID NO: 259672 - RNA, 23 nt, Human
cugaaacgucucuccugcgcccc

SEQ ID NO: 259673 - RNA, 21 nt, Human
cugagcccacuggccccugcc

SEQ ID NO: 259674 - RNA, 18 nt, Human
cugcagcuguggccacua

SEQ ID NO: 259675 - RNA, 23 nt, Human
cugcagugcucugcagcuguggc

SEQ ID NO: 259676 - RNA, 20 nt, Human
cugcgccccgggaagccccu

SEQ ID NO: 259677 - RNA, 20 nt, Human
cuggggagggguggcagggg

SEQ ID NO: 259678 - RNA, 19 nt, Human
cugugggccauggagagcu

SEQ ID NO: 259679 - RNA, 19 nt, Human
gaccgagaagagacaggag

SEQ ID NO: 259680 - RNA, 23 nt, Human
gaggcacagacaggugccgaaca

SEQ ID NO: 259681 - RNA, 19 nt, Human
gcaacaacagaucuucccc

SEQ ID NO: 259682 - RNA, 20 nt, Human
gcagugcucugcagcugugg

SEQ ID NO: 259683 - RNA, 18 nt, Human
gccagaggcacagacagg

SEQ ID NO: 259684 - RNA, 21 nt, Human
gccccugccagccuggcccug

SEQ ID NO: 259685 - RNA, 22 nt, Human
gcugcagugcucugcagcugug

SEQ ID NO: 259686 - RNA, 25 nt, Human
gcuguggugggggcacacaccuguu

SEQ ID NO: 259687 - RNA, 18 nt, Human
ggagcagggcugaccugu

SEQ ID NO: 259688 - RNA, 21 nt, Human
ggcagaagcagcugcaacaac

SEQ ID NO: 259689 - RNA, 20 nt, Human
ggcagggagggagaacagag

SEQ ID NO: 259690 - RNA, 21 nt, Human
ggcagggggcagugugccuac

SEQ ID NO: 259691 - RNA, 19 nt, Human
gggagggguggcagggggc

SEQ ID NO: 259692 - RNA, 22 nt, Human
gggggcauuuaggguaggggga

SEQ ID NO: 259693 - RNA, 19 nt, Human
gguggguguggccagucca

SEQ ID NO: 259694 - RNA, 20 nt, Human
gguucuggguuucaacacag

SEQ ID NO: 259695 - RNA, 20 nt, Human
guacccaacccaucuccauc

SEQ ID NO: 259696 - RNA, 22 nt, Human
guaccccaugaaugcccaccuc

SEQ ID NO: 259697 - RNA, 19 nt, Human
gugagaagcuguggaugag

SEQ ID NO: 259698 - RNA, 23 nt, Human
gugcacacgcacacacauacaca

SEQ ID NO: 259699 - RNA, 20 nt, Human
gugcucugcagcuguggcca

SEQ ID NO: 259700 - RNA, 22 nt, Human
uaacagcagguugucacaggaa

SEQ ID NO: 259701 - RNA, 22 nt, Human
uaccugggcugagcccacuggc

SEQ ID NO: 259702 - RNA, 19 nt, Human
uagagcuguggugggggca

SEQ ID NO: 259703 - RNA, 21 nt, Human
uagcuuggcccucagagauau

SEQ ID NO: 259704 - RNA, 20 nt, Human
uaggguagggggacaauaag

SEQ ID NO: 259705 - RNA, 24 nt, Human
ucacagguuguccccucugaggac

SEQ ID NO: 259706 - RNA, 23 nt, Human
ucagcaagaaaacaccccauuuc

SEQ ID NO: 259707 - RNA, 18 nt, Human
ucaggagggggauggauu

SEQ ID NO: 259708 - RNA, 19 nt, Human
ucauuuggaucaagggggc

SEQ ID NO: 259709 - RNA, 19 nt, Human
uccaaggaaaaagaaagaa

SEQ ID NO: 259710 - RNA, 24 nt, Human
ucccaagguccccucugcacuccu

SEQ ID NO: 259711 - RNA, 26 nt, Human
ucccaagguccccucugcacuccucc

SEQ ID NO: 259712 - RNA, 19 nt, Human
ucccacucccuuaggcuga

SEQ ID NO: 259713 - RNA, 25 nt, Human
uccccaaguuauggcaggggggcau

SEQ ID NO: 259714 - RNA, 18 nt, Human
uccccccggaaggaaugc

SEQ ID NO: 259715 - RNA, 21 nt, Human
uccccugccucuacccucaaa

SEQ ID NO: 259716 - RNA, 22 nt, Human
ucccucaaauacaagaguccac

SEQ ID NO: 259717 - RNA, 20 nt, Human
uccugccccuaccugggcug

SEQ ID NO: 259718 - RNA, 24 nt, Human
uccugcgccccgggaagccccuag

SEQ ID NO: 259719 - RNA, 20 nt, Human
uccugggcauagcuuggccc

SEQ ID NO: 259720 - RNA, 21 nt, Human
ucggcagugagaagcugugga

SEQ ID NO: 259721 - RNA, 23 nt, Human
ucugcagcuguggccacuagcuc

SEQ ID NO: 259722 - RNA, 24 nt, Human
ucugugcugaagccagaccggggc

SEQ ID NO: 259723 - RNA, 20 nt, Human
ucuguuuauucuccuucccc

SEQ ID NO: 259724 - RNA, 24 nt, Human
ucuugaggucccucaaauacaaga

SEQ ID NO: 259725 - RNA, 21 nt, Human
ugaaggccagguacccaaccc

SEQ ID NO: 259726 - RNA, 21 nt, Human
ugaaggccagguacccaaccc

SEQ ID NO: 259727 - RNA, 22 nt, Human
ugaaggccagguacccaaccca

SEQ ID NO: 259728 - RNA, 26 nt, Human
ugacacacacacacacacacgcacgg

SEQ ID NO: 259729 - RNA, 19 nt, Human
ugagaggugggaggagucc

SEQ ID NO: 259730 - RNA, 23 nt, Human
ugcccugcgacccugucccuuuc

SEQ ID NO: 259731 - RNA, 20 nt, Human
ugccgaacaugcacguggaa

SEQ ID NO: 259732 - RNA, 20 nt, Human
ugccucuacccucaaauccc

SEQ ID NO: 259733 - RNA, 30 nt, Human
ugcuagguaccugggagggcuguggagugg

SEQ ID NO: 259734 - RNA, 24 nt, Human
uggaaccacagguuguacagacua

SEQ ID NO: 259735 - RNA, 20 nt, Human
uggaugguaggguccucacu

SEQ ID NO: 259736 - RNA, 25 nt, Human
uggcaccaggcuggcaccaccaccc

SEQ ID NO: 259737 - RNA, 21 nt, Human
uggcugacgcugcagcgaaga

SEQ ID NO: 259738 - RNA, 19 nt, Human
uggcugagggagggaacag

SEQ ID NO: 259739 - RNA, 23 nt, Human
ugggagcuguuacccaaggacag

SEQ ID NO: 259740 - RNA, 23 nt, Human
ugggaggaguccaggaauggggu

SEQ ID NO: 259741 - RNA, 21 nt, Human
ugggaggcacaaggguuuggg

SEQ ID NO: 259742 - RNA, 18 nt, Human
ugggagggcuguggagug

SEQ ID NO: 259743 - RNA, 21 nt, Human
ugggaucaggguauuauaaga

SEQ ID NO: 259744 - RNA, 20 nt, Human
ugggcacacagugguucagg

SEQ ID NO: 259745 - RNA, 21 nt, Human
ugguucaggggccagcuuugg

SEQ ID NO: 259746 - RNA, 26 nt, Human
uguauagucuaugcaaaugcaaauga

SEQ ID NO: 259747 - RNA, 18 nt, Human
ugucacagggcucagccc

SEQ ID NO: 259748 - RNA, 33 nt, Human
uuaaaccugacacacacacacacacacgcagug

SEQ ID NO: 259749 - RNA, 23 nt, Human
uucaacacagagugagccaaaga

SEQ ID NO: 259750 - RNA, 20 nt, Human
uuccaacccagccccagccu

SEQ ID NO: 259751 - RNA, 20 nt, Human
uuggagucugggaucagggu

SEQ ID NO: 259752 - RNA, 22 nt, Human
uuggaucaagggggcagaagca

SEQ ID NO: 259753 - RNA, 21 nt, Human
uuuacaaaacugcccucccca

SEQ ID NO: 259754 - RNA, 20 nt, Human
uuuccaaaggagcugggagc

SEQ ID NO: 259755 - RNA, 26 nt, Human
aaaaacaacagacaaaaaccaacaac

SEQ ID NO: 259756 - RNA, 26 nt, Human
aaacaacagacaaaaaccaacaacaa

SEQ ID NO: 259757 - RNA, 20 nt, Human
aaaugaaauguguuguuuuc

SEQ ID NO: 259758 - RNA, 22 nt, Human
aacaacagacaaaaaccaacaa

SEQ ID NO: 259759 - RNA, 20 nt, Human
aacagacaaaaaccaacaac

SEQ ID NO: 259760 - RNA, 25 nt, Human
aagcacuucaaaaaaaagguuaaga

SEQ ID NO: 259761 - RNA, 19 nt, Human
aagcauuguguggggugau

SEQ ID NO: 259762 - RNA, 20 nt, Human
aagcgucacuauguuuaaaa

SEQ ID NO: 259763 - RNA, 23 nt, Human
aauuuguggagaauucucucccu

SEQ ID NO: 259764 - RNA, 20 nt, Human
acagacaaaaaccaacaaca

SEQ ID NO: 259765 - RNA, 24 nt, Human
acucugcuuacuuuuuucagagag

SEQ ID NO: 259766 - RNA, 21 nt, Human
acucugggucuacauacuuuu

SEQ ID NO: 259767 - RNA, 19 nt, Human
agacaaaaaccaacaacaa

SEQ ID NO: 259768 - RNA, 19 nt, Human
agacaaaaaccaacaacaa

SEQ ID NO: 259769 - RNA, 27 nt, Human
agacaaaaaccaacaacaaccccgggg

SEQ ID NO: 259770 - RNA, 23 nt, Human
agagaggaaggaaauaaagcuaa

SEQ ID NO: 259771 - RNA, 21 nt, Human
agagucaucugguuucccaag

SEQ ID NO: 259772 - RNA, 21 nt, Human
aggaaggaaauaaagcuaaga

SEQ ID NO: 259773 - RNA, 29 nt, Human
aggaaggaaauaaagcuaagagggacccc

SEQ ID NO: 259774 - RNA, 23 nt, Human
caaaagggacaauggauggaaua

SEQ ID NO: 259775 - RNA, 23 nt, Human
caacaacaaacaagacuucccac

SEQ ID NO: 259776 - RNA, 21 nt, Human
cacuaccacccacaaaagaca

SEQ ID NO: 259777 - RNA, 28 nt, Human
cagacaaaaaccaacaacaaacaagacu

SEQ ID NO: 259778 - RNA, 22 nt, Human
cagccuuccagagaaaauuuac

SEQ ID NO: 259779 - RNA, 18 nt, Human
cagggagagucaucuggu

SEQ ID NO: 259780 - RNA, 25 nt, Human
cagugacguagccauaggguacccc

SEQ ID NO: 259781 - RNA, 21 nt, Human
ccaggcuguggacagagagga

SEQ ID NO: 259782 - RNA, 19 nt, Human
ccucccgaccucucccugc

SEQ ID NO: 259783 - RNA, 25 nt, Human
cguccagcuuggauguucugggaua

SEQ ID NO: 259784 - RNA, 22 nt, Human
cucugcuuacuuuuuucagaga

SEQ ID NO: 259785 - RNA, 23 nt, Human
cugcagauucuggaagaaggggg

SEQ ID NO: 259786 - RNA, 23 nt, Human
cuguguucucugagaccaggcug

SEQ ID NO: 259787 - RNA, 19 nt, Human
cuucccacuuauacucuuc

SEQ ID NO: 259788 - RNA, 20 nt, Human
gaagaaggggguggaggugg

SEQ ID NO: 259789 - RNA, 18 nt, Human
gaagugugccucagccuu

SEQ ID NO: 259790 - RNA, 20 nt, Human
gacaguggcuacuuaacuuu

SEQ ID NO: 259791 - RNA, 20 nt, Human
gccauaguuuugacagggag

SEQ ID NO: 259792 - RNA, 21 nt, Human
gcccacacucugggucuacau

SEQ ID NO: 259793 - RNA, 21 nt, Human
gggacaauggauggaauagaa

SEQ ID NO: 259794 - RNA, 20 nt, Human
ggggguggagguggguauug

SEQ ID NO: 259795 - RNA, 22 nt, Human
guccagcuuggauguucuggga

SEQ ID NO: 259796 - RNA, 18 nt, Human
gugaagugugccucagcc

SEQ ID NO: 259797 - RNA, 22 nt, Human
gugaagugugccucagccuucc

SEQ ID NO: 259798 - RNA, 27 nt, Human
uaaaaagcuuaaacauucugcgaauca

SEQ ID NO: 259799 - RNA, 19 nt, Human
uaaaauaggcagagaaccc

SEQ ID NO: 259800 - RNA, 22 nt, Human
uaaauuaaccacuaccacccac

SEQ ID NO: 259801 - RNA, 22 nt, Human
uaacaaaagggacaauggaugg

SEQ ID NO: 259802 - RNA, 21 nt, Human
uaagaugugcugaguguccuc

SEQ ID NO: 259803 - RNA, 20 nt, Human
uacuguguucucugagacca

SEQ ID NO: 259804 - RNA, 21 nt, Human
uagaacaaaucaaacaaagca

SEQ ID NO: 259805 - RNA, 18 nt, Human
uauuaccaggcaagcacu

SEQ ID NO: 259806 - RNA, 31 nt, Human
uauuaccaggcaagcacuucaaaaaaaaggg

SEQ ID NO: 259807 - RNA, 23 nt, Human
ucaaaaaaaagguuaagaucaac

SEQ ID NO: 259808 - RNA, 18 nt, Human
ucagggucagcuugccug

SEQ ID NO: 259809 - RNA, 21 nt, Human
ucccugaaggcaccacugcag

SEQ ID NO: 259810 - RNA, 22 nt, Human
ucugaggguauuuagaaagggg

SEQ ID NO: 259811 - RNA, 23 nt, Human
ugaaaaacaacagacaaaaacca

SEQ ID NO: 259812 - RNA, 24 nt, Human
ugaaaaacaacagacaaaaaccaa

SEQ ID NO: 259813 - RNA, 25 nt, Human
ugaaaaacaacagacaaaaaccaac

SEQ ID NO: 259814 - RNA, 19 nt, Human
ugaagacaggggaacuuca

SEQ ID NO: 259815 - RNA, 20 nt, Human
ugaagacaggggaacuucag

SEQ ID NO: 259816 - RNA, 24 nt, Human
ugacuacacaucuacuguguucuc

SEQ ID NO: 259817 - RNA, 20 nt, Human
ugaugguaaaaugagggagu

SEQ ID NO: 259818 - RNA, 24 nt, Human
uggaagaaggggguggaggugggu

SEQ ID NO: 259819 - RNA, 20 nt, Human
uggcagggacuggcuaggac

SEQ ID NO: 259820 - RNA, 23 nt, Human
uuaaaauaggcagagaacccguu

SEQ ID NO: 259821 - RNA, 20 nt, Human
uucaaaucaugauccaaaga

SEQ ID NO: 259822 - RNA, 19 nt, Human
uucccaagaucuagcacaa

SEQ ID NO: 259823 - RNA, 21 nt, Human
uuccucgagucccugaaggca

SEQ ID NO: 259824 - RNA, 24 nt, Human
uuggauaaaacaaguuagcuucca

SEQ ID NO: 259825 - RNA, 21 nt, Human
uuuuuuaggcccacacucugg

SEQ ID NO: 259826 - RNA, 18 nt, Human
uuuuuuuuuuuuaggccc

SEQ ID NO: 259827 - RNA, 21 nt, Human
uuuuuuuuuuuuuuuuuuagg

SEQ ID NO: 259828 - RNA, 26 nt, Human
aaaagaucaugugaaaucugcgaaag

SEQ ID NO: 259829 - RNA, 19 nt, Human
aaaaugggucaaauacugu

SEQ ID NO: 259830 - RNA, 22 nt, Human
aaacuccagcauuaaacaagaa

SEQ ID NO: 259831 - RNA, 22 nt, Human
aacauuauucauauuucuacca

SEQ ID NO: 259832 - RNA, 19 nt, Human
acacugcaagacuguaaac

SEQ ID NO: 259833 - RNA, 18 nt, Human
agauugcaacuauggauc

SEQ ID NO: 259834 - RNA, 20 nt, Human
agcugccaaagucaccucac

SEQ ID NO: 259835 - RNA, 19 nt, Human
caaagucaccucacugcuc

SEQ ID NO: 259836 - RNA, 23 nt, Human
cagucccacuggccaccagcucu

SEQ ID NO: 259837 - RNA, 22 nt, Human
cuaccacagcugcauaugaggu

SEQ ID NO: 259838 - RNA, 24 nt, Human
cuaccacagcugcauaugaggucg

SEQ ID NO: 259839 - RNA, 21 nt, Human
cucccugccggagcuucugaa

SEQ ID NO: 259840 - RNA, 21 nt, Human
cugcaagacuguaaacaugca

SEQ ID NO: 259841 - RNA, 23 nt, Human
uaaaauagguaaccacauaacca

SEQ ID NO: 259842 - RNA, 19 nt, Human
uacaguguuaaaacuccag

SEQ ID NO: 259843 - RNA, 18 nt, Human
uagguaaccacauaacca

SEQ ID NO: 259844 - RNA, 19 nt, Human
uagguaaccacauaaccau

SEQ ID NO: 259845 - RNA, 23 nt, Human
ugcuccuauccagacaaaagcug

SEQ ID NO: 259846 - RNA, 22 nt, Human
uuguuuuagauugcaacuaugg

SEQ ID NO: 259847 - RNA, 24 nt, Human
aaaaaacuauuagcaucaugagga

SEQ ID NO: 259848 - RNA, 18 nt, Human
aaagccauguauagagaa

SEQ ID NO: 259849 - RNA, 19 nt, Human
aaaugcaaaaacugucaaa

SEQ ID NO: 259850 - RNA, 21 nt, Human
aagaaccgcuaaagccaugua

SEQ ID NO: 259851 - RNA, 23 nt, Human
aaguuuuucacagagauacaacu

SEQ ID NO: 259852 - RNA, 22 nt, Human
acaaaguagcuucaacccaaag

SEQ ID NO: 259853 - RNA, 18 nt, Human
acagagauacaacuaagc

SEQ ID NO: 259854 - RNA, 23 nt, Human
aguagcuucaacccaaaguggca

SEQ ID NO: 259855 - RNA, 19 nt, Human
agugucgggcaguccuccu

SEQ ID NO: 259856 - RNA, 20 nt, Human
auccacaaagucugagcaag

SEQ ID NO: 259857 - RNA, 21 nt, Human
aucuuauccucaaucuugcug

SEQ ID NO: 259858 - RNA, 20 nt, Human
cauaaaaaugcaaaaacugu

SEQ ID NO: 259859 - RNA, 22 nt, Human
cauuuagaaucccaaaaugagg

SEQ ID NO: 259860 - RNA, 23 nt, Human
ccaaaaugaggcaagaaccgcua

SEQ ID NO: 259861 - RNA, 24 nt, Human
cuaacaaaguagcuucaacccaaa

SEQ ID NO: 259862 - RNA, 23 nt, Human
cucccauguauacaaaaaacuau

SEQ ID NO: 259863 - RNA, 24 nt, Human
cugauccacaaagucugagcaaaa

SEQ ID NO: 259864 - RNA, 24 nt, Human
gaacaccugccauucauaaaaaug

SEQ ID NO: 259865 - RNA, 22 nt, Human
gggaagcuaagugaguaaauca

SEQ ID NO: 259866 - RNA, 24 nt, Human
gggcaguccuccuauuggcaguuu

SEQ ID NO: 259867 - RNA, 20 nt, Human
gucaaaugugcuauccuccc

SEQ ID NO: 259868 - RNA, 21 nt, Human
guguauacaaguuuuucacag

SEQ ID NO: 259869 - RNA, 21 nt, Human
uaagcaaauacugccuugccc

SEQ ID NO: 259870 - RNA, 26 nt, Human
uaaugaacaccugccauucauaaaaa

SEQ ID NO: 259871 - RNA, 18 nt, Human
uagaaucccaaaaugagg

SEQ ID NO: 259872 - RNA, 20 nt, Human
uagaaucccaaaaugaggca

SEQ ID NO: 259873 - RNA, 19 nt, Human
uagcacagucauaggauac

SEQ ID NO: 259874 - RNA, 18 nt, Human
uauagagaauaaaggaug

SEQ ID NO: 259875 - RNA, 23 nt, Human
uauuagcaucaugaggaagaaac

SEQ ID NO: 259876 - RNA, 19 nt, Human
ucaacccaaaguggcacca

SEQ ID NO: 259877 - RNA, 20 nt, Human
ucaagccuaacaaaguagcu

SEQ ID NO: 259878 - RNA, 23 nt, Human
ucaagccuaacaaaguagcuuca

SEQ ID NO: 259879 - RNA, 25 nt, Human
ucaauacagauuauaaugaacaccu

SEQ ID NO: 259880 - RNA, 20 nt, Human
ucaauauuugugugagacau

SEQ ID NO: 259881 - RNA, 23 nt, Human
uccacaaagucugagcaaaaaaa

SEQ ID NO: 259882 - RNA, 25 nt, Human
uccacaaagucugagcaaaaaaaac

SEQ ID NO: 259883 - RNA, 23 nt, Human
ugaggcaagaaccgcuaaagcca

SEQ ID NO: 259884 - RNA, 21 nt, Human
ugagggaagggaagcuaagug

SEQ ID NO: 259885 - RNA, 18 nt, Human
ugauggcauuguguaucu

SEQ ID NO: 259886 - RNA, 22 nt, Human
ugugcucauacauaaaaaugca

SEQ ID NO: 259887 - RNA, 22 nt, Human
uuauacugcugccuuccaucuu

SEQ ID NO: 259888 - RNA, 21 nt, Human
uucaagagaucuaagaacaga

SEQ ID NO: 259889 - RNA, 23 nt, Human
uugccagaucaaguccaacaugc

SEQ ID NO: 259890 - RNA, 18 nt, Human
uuugccagaucaagucca

SEQ ID NO: 259891 - RNA, 22 nt, Human
uuuuuaggaaaguaucucugau

SEQ ID NO: 259892 - RNA, 27 nt, Human
accuucuuacagaaaucucuccugcug

SEQ ID NO: 259893 - RNA, 21 nt, Human
agaaagauuauccauacaaag

SEQ ID NO: 259894 - RNA, 20 nt, Human
agcugcuuaaaauggaaaug

SEQ ID NO: 259895 - RNA, 18 nt, Human
caccucagccgccuccgc

SEQ ID NO: 259896 - RNA, 21 nt, Human
cagaaaucucuccugcuguuu

SEQ ID NO: 259897 - RNA, 19 nt, Human
cagucacuuuuuaagaguu

SEQ ID NO: 259898 - RNA, 23 nt, Human
ccaaaucccuuucuucuccaaac

SEQ ID NO: 259899 - RNA, 18 nt, Human
ccgccgcugccgccgcuc

SEQ ID NO: 259900 - RNA, 25 nt, Human
ccgcgccgccgcugccgccgcuccc

SEQ ID NO: 259901 - RNA, 18 nt, Human
ccgcugccgccgcucccg

SEQ ID NO: 259902 - RNA, 18 nt, Human
ccgcugccgccgcucccg

SEQ ID NO: 259903 - RNA, 18 nt, Human
ccgcugcucucccucagc

SEQ ID NO: 259904 - RNA, 25 nt, Human
ccuccgcgccgccgcugccgccgcu

SEQ ID NO: 259905 - RNA, 24 nt, Human
ccuuuguuaccaaaucccuuucuu

SEQ ID NO: 259906 - RNA, 23 nt, Human
cgccgccgcugccgccgcucccg

SEQ ID NO: 259907 - RNA, 22 nt, Human
cuccccgccgccgcugcucucc

SEQ ID NO: 259908 - RNA, 23 nt, Human
cuccccgccgccgcugcucuccc

SEQ ID NO: 259909 - RNA, 18 nt, Human
cuccgcgccgccgcugcc

SEQ ID NO: 259910 - RNA, 28 nt, Human
gccgccuccgcgccgccgcugccgccgg

SEQ ID NO: 259911 - RNA, 23 nt, Human
gcuccccgccgccgcugcucucc

SEQ ID NO: 259912 - RNA, 19 nt, Human
uaaaauggaaauggcuguc

SEQ ID NO: 259913 - RNA, 26 nt, Human
uaccaaaucccuuucuucuccaaacu

SEQ ID NO: 259914 - RNA, 22 nt, Human
ucccucagccacaggcgccgcc

SEQ ID NO: 259915 - RNA, 18 nt, Human
uccgcgccgccgcugccg

SEQ ID NO: 259916 - RNA, 21 nt, Human
uccgcgccgccgcugccgccg

SEQ ID NO: 259917 - RNA, 19 nt, Human
ucgcuccccgccgccgcug

SEQ ID NO: 259918 - RNA, 18 nt, Human
ucucccucagccacaggc

SEQ ID NO: 259919 - RNA, 20 nt, Human
ucucuccugcuguuuagcug

SEQ ID NO: 259920 - RNA, 23 nt, Human
ucugcaaacucguggcucguagu

SEQ ID NO: 259921 - RNA, 19 nt, Human
uuuuuuuuuuuuuugcuuc

SEQ ID NO: 259922 - RNA, 19 nt, Human
uuuuuuuuuuuuuuugcuu

SEQ ID NO: 259923 - RNA, 26 nt, Human
aaaacagaaaggaggcggggccccag

SEQ ID NO: 259924 - RNA, 21 nt, Human
aaacagaaaggaggcggggcc

SEQ ID NO: 259925 - RNA, 24 nt, Human
aaacagaaaggaggcggggcccca

SEQ ID NO: 259926 - RNA, 18 nt, Human
accaggccaggcauugcu

SEQ ID NO: 259927 - RNA, 21 nt, Human
accugaguugagugaagaaac

SEQ ID NO: 259928 - RNA, 24 nt, Human
agcuguccccuccucccgcccccc

SEQ ID NO: 259929 - RNA, 19 nt, Human
ccaggccaggcauugcugg

SEQ ID NO: 259930 - RNA, 19 nt, Human
ccccaaaugccaccugagu

SEQ ID NO: 259931 - RNA, 19 nt, Human
cccccgcggcgcggcgccc

SEQ ID NO: 259932 - RNA, 24 nt, Human
cccccgcggcgcggcgcccccucc

SEQ ID NO: 259933 - RNA, 20 nt, Human
ccccgcgcccgcagcugucc

SEQ ID NO: 259934 - RNA, 24 nt, Human
ccccgcgcccgcagcuguccccuc

SEQ ID NO: 259935 - RNA, 18 nt, Human
cccgcagcuguccccucc

SEQ ID NO: 259936 - RNA, 22 nt, Human
cccgcggcgcggcgcccccucc

SEQ ID NO: 259937 - RNA, 25 nt, Human
ccgcgcccgcagcuguccccuccuc

SEQ ID NO: 259938 - RNA, 21 nt, Human
ccucaaaaauaaaacagaaag

SEQ ID NO: 259939 - RNA, 24 nt, Human
ccucaaaaauaaaacagaaaggag

SEQ ID NO: 259940 - RNA, 22 nt, Human
ccucccgccccuacuggcagcc

SEQ ID NO: 259941 - RNA, 24 nt, Human
ccucccgccccuacuggcagccaa

SEQ ID NO: 259942 - RNA, 22 nt, Human
cggaguuguggccucccuccuc

SEQ ID NO: 259943 - RNA, 18 nt, Human
cggcuuccuggcuccgcc

SEQ ID NO: 259944 - RNA, 24 nt, Human
cggggccccagcucagcaccaggu

SEQ ID NO: 259945 - RNA, 21 nt, Human
cuccgccuuuccucccgcccc

SEQ ID NO: 259946 - RNA, 24 nt, Human
cucucuuggugaaagcagaagcug

SEQ ID NO: 259947 - RNA, 27 nt, Human
gaggcggggccccagcuccccaagggg

SEQ ID NO: 259948 - RNA, 25 nt, Human
gcagaagcggagcuaccaggccagg

SEQ ID NO: 259949 - RNA, 21 nt, Human
gcgcggcgcccccuccccgcg

SEQ ID NO: 259950 - RNA, 24 nt, Human
gcgggcccgggucucggacucccg

SEQ ID NO: 259951 - RNA, 21 nt, Human
guuauuuuauuuccucaaaaa

SEQ ID NO: 259952 - RNA, 19 nt, Human
ucggaguuguggccucccu

SEQ ID NO: 259953 - RNA, 22 nt, Human
ugaagaaacacucucuugguga

SEQ ID NO: 259954 - RNA, 24 nt, Human
ugaagaaacacucucuuggugaaa

SEQ ID NO: 259955 - RNA, 21 nt, Human
ugaguugagugaagaaacacu

SEQ ID NO: 259956 - RNA, 22 nt, Human
ugaguugagugaagaaacacuc

SEQ ID NO: 259957 - RNA, 23 nt, Human
uggcagccaacaagucaacggaa

SEQ ID NO: 259958 - RNA, 24 nt, Human
uggcccccgcggcgcggcgccccc

SEQ ID NO: 259959 - RNA, 18 nt, Human
uggcuccgccauggcccc

SEQ ID NO: 259960 - RNA, 20 nt, Human
uuccuggcuccgccauggcc

SEQ ID NO: 259961 - RNA, 18 nt, Human
uuuuuuaucacuugguua

SEQ ID NO: 259962 - RNA, 26 nt, Human
uuuuuuuuuuuuuuaucacuugguua

SEQ ID NO: 259963 - RNA, 20 nt, Human
uuuuuuuuuuuuuuuuuauc

SEQ ID NO: 259964 - RNA, 22 nt, Human
aacccaaccccguggaaacugg

SEQ ID NO: 259965 - RNA, 25 nt, Human
aagaagccuaggcaggguuagagua

SEQ ID NO: 259966 - RNA, 23 nt, Human
aagcugcaucacugcaagguggg

SEQ ID NO: 259967 - RNA, 23 nt, Human
agagugaagaggggcauugcagg

SEQ ID NO: 259968 - RNA, 22 nt, Human
agcuggagcuacaagaagccua

SEQ ID NO: 259969 - RNA, 23 nt, Human
auggagugccuaguauguggugg

SEQ ID NO: 259970 - RNA, 23 nt, Human
caacccaaccccguggaaacugg

SEQ ID NO: 259971 - RNA, 18 nt, Human
cuggagcuacaagaagcc

SEQ ID NO: 259972 - RNA, 20 nt, Human
cuuaagcucugaccggcaac

SEQ ID NO: 259973 - RNA, 22 nt, Human
cuuaagcucugaccggcaaccc

SEQ ID NO: 259974 - RNA, 21 nt, Human
gagugccuaguaugugguggg

SEQ ID NO: 259975 - RNA, 19 nt, Human
gcuggagcuacaagaagcc

SEQ ID NO: 259976 - RNA, 21 nt, Human
gguaugcccacuuugaggagg

SEQ ID NO: 259977 - RNA, 18 nt, Human
uaagcucugaccggcaac

SEQ ID NO: 259978 - RNA, 22 nt, Human
uaagcucugaccggcaacccaa

SEQ ID NO: 259979 - RNA, 18 nt, Human
uccugagcgccgagccuc

SEQ ID NO: 259980 - RNA, 19 nt, Human
ugaagaguggggaugagug

SEQ ID NO: 259981 - RNA, 21 nt, Human
ugaagaguggggaugaguggc

SEQ ID NO: 259982 - RNA, 21 nt, Human
ugcugggauauggguguaaag

SEQ ID NO: 259983 - RNA, 21 nt, Human
ugggaauaagacuauuaucaa

SEQ ID NO: 259984 - RNA, 18 nt, Human
ugucuaugaagagugggg

SEQ ID NO: 259985 - RNA, 23 nt, Human
uuccagggucaagcugcaucacu

SEQ ID NO: 259986 - RNA, 21 nt, Human
agaauggauuaaaaaauaaaa

SEQ ID NO: 259987 - RNA, 20 nt, Human
agaccuggagucccagaaca

SEQ ID NO: 259988 - RNA, 19 nt, Human
agcaggccggagcuccggg

SEQ ID NO: 259989 - RNA, 24 nt, Human
agccacaugacgucauugguccuc

SEQ ID NO: 259990 - RNA, 21 nt, Human
auggagcuggggaaugaauuc

SEQ ID NO: 259991 - RNA, 24 nt, Human
caaaguggucagggggaaccaaug

SEQ ID NO: 259992 - RNA, 20 nt, Human
caggcccaucauguucuuga

SEQ ID NO: 259993 - RNA, 20 nt, Human
cagggggaaccaaugcuaua

SEQ ID NO: 259994 - RNA, 19 nt, Human
caucucaaagggaggugag

SEQ ID NO: 259995 - RNA, 25 nt, Human
cauuuguuuuuccugcuuuuuguuu

SEQ ID NO: 259996 - RNA, 19 nt, Human
ccaccccuaacccccgauc

SEQ ID NO: 259997 - RNA, 19 nt, Human
ccccccauuucccauuugu

SEQ ID NO: 259998 - RNA, 21 nt, Human
ccccccauuucccauuuguuu

SEQ ID NO: 259999 - RNA, 22 nt, Human
ccccccgcccccccauuuccca

SEQ ID NO: 260000 - RNA, 22 nt, Human
cccccgaucccccgcccggccc

SEQ ID NO: 260001 - RNA, 20 nt, Human
cccccgcccccccauuuccc

SEQ ID NO: 260002 - RNA, 22 nt, Human
cccccucccccacucccugacc

SEQ ID NO: 260003 - RNA, 23 nt, Human
cccccucccccacucccugaccu

SEQ ID NO: 260004 - RNA, 19 nt, Human
ccccgcccccccauuuccc

SEQ ID NO: 260005 - RNA, 21 nt, Human
cccugcucuggcagggccugg

SEQ ID NO: 260006 - RNA, 21 nt, Human
ccuuuggcggacuccaccccu

SEQ ID NO: 260007 - RNA, 21 nt, Human
cggacuccaccccuaaccccc

SEQ ID NO: 260008 - RNA, 22 nt, Human
cgggcucugcucauccuuucgu

SEQ ID NO: 260009 - RNA, 21 nt, Human
cucaagaccuggagucccaga

SEQ ID NO: 260010 - RNA, 20 nt, Human
cuuccucccccccgcccccc

SEQ ID NO: 260011 - RNA, 21 nt, Human
gagggcguuuuugaggcuggu

SEQ ID NO: 260012 - RNA, 19 nt, Human
gcaaagagggaaagcaccu

SEQ ID NO: 260013 - RNA, 22 nt, Human
gcaaagagggaaagcaccuaga

SEQ ID NO: 260014 - RNA, 27 nt, Human
gcucugcucauccuuucguagcuccaa

SEQ ID NO: 260015 - RNA, 21 nt, Human
ggagccuaggucccccugcuc

SEQ ID NO: 260016 - RNA, 22 nt, Human
ggaggugagggcagggcagggc

SEQ ID NO: 260017 - RNA, 23 nt, Human
ggaggugagggcagggcagggcg

SEQ ID NO: 260018 - RNA, 19 nt, Human
ggcagggccuggggugggg

SEQ ID NO: 260019 - RNA, 20 nt, Human
gggaggugagggcagggcag

SEQ ID NO: 260020 - RNA, 21 nt, Human
gggccuggggugggggggugg

SEQ ID NO: 260021 - RNA, 20 nt, Human
ggggagcaaagagggaaagc

SEQ ID NO: 260022 - RNA, 22 nt, Human
gugggguugagaaagugccucg

SEQ ID NO: 260023 - RNA, 20 nt, Human
uaacccccgaucccccgccc

SEQ ID NO: 260024 - RNA, 22 nt, Human
uauacagaauguagaaaaaucc

SEQ ID NO: 260025 - RNA, 30 nt, Human
ucccccugcucuggcagggccugggguggg

SEQ ID NO: 260026 - RNA, 23 nt, Human
uccugcuuuuuguuugguuguuu

SEQ ID NO: 260027 - RNA, 24 nt, Human
ucuggaaugaaacuuacaucucaa

SEQ ID NO: 260028 - RNA, 22 nt, Human
ucuuaaggcucauuugcccccu

SEQ ID NO: 260029 - RNA, 21 nt, Human
ugaauugcaaaagccacauga

SEQ ID NO: 260030 - RNA, 18 nt, Human
ugagaagaaauauacaga

SEQ ID NO: 260031 - RNA, 18 nt, Human
ugagaagaaauauacaga

SEQ ID NO: 260032 - RNA, 22 nt, Human
ugagaagaaauauacagaaugu

SEQ ID NO: 260033 - RNA, 21 nt, Human
ugagcacagguaaacaaacaa

SEQ ID NO: 260034 - RNA, 21 nt, Human
ugagggcagggcagggcgggg

SEQ ID NO: 260035 - RNA, 22 nt, Human
ugcucauccuuucguagcucca

SEQ ID NO: 260036 - RNA, 22 nt, Human
uggcagggccuggggugggggg

SEQ ID NO: 260037 - RNA, 20 nt, Human
ugggugcucuggguauuagc

SEQ ID NO: 260038 - RNA, 22 nt, Human
uguaagggcagaggaugagcac

SEQ ID NO: 260039 - RNA, 24 nt, Human
ugucucucuccucaagaccuggag

SEQ ID NO: 260040 - RNA, 20 nt, Human
uucccauuuguuuuuccugc

SEQ ID NO: 260041 - RNA, 22 nt, Human
uucccauuuguuuuuccugcuu

SEQ ID NO: 260042 - RNA, 23 nt, Human
uucugcugggggacuugacagca

SEQ ID NO: 260043 - RNA, 20 nt, Human
uugcccccucccccacuccc

SEQ ID NO: 260044 - RNA, 18 nt, Human
uuuguuuuuccugcuuuu

SEQ ID NO: 260045 - RNA, 18 nt, Human
uuuuuuuuuuuuuuucug

SEQ ID NO: 260046 - RNA, 18 nt, Human
uuuuuuuuuuuuuuucug

SEQ ID NO: 260047 - RNA, 20 nt, Human
aaagaaaacaaucacauuga

SEQ ID NO: 260048 - RNA, 19 nt, Human
aacgaggccccccaacugc

SEQ ID NO: 260049 - RNA, 24 nt, Human
aagaaaacaaucacauugaacuaa

SEQ ID NO: 260050 - RNA, 18 nt, Human
aagauucucagcugccuu

SEQ ID NO: 260051 - RNA, 24 nt, Human
acaggacaaagaacacauuugcaa

SEQ ID NO: 260052 - RNA, 19 nt, Human
agcugacaucagcuaccca

SEQ ID NO: 260053 - RNA, 18 nt, Human
auaaaaacugguaaaaga

SEQ ID NO: 260054 - RNA, 21 nt, Human
ccaguacaauucaguacucau

SEQ ID NO: 260055 - RNA, 24 nt, Human
ccaguacaauucaguacucauuuu

SEQ ID NO: 260056 - RNA, 21 nt, Human
cccaacugccucuccaccuag

SEQ ID NO: 260057 - RNA, 22 nt, Human
ccccccaacugccucuccaccu

SEQ ID NO: 260058 - RNA, 28 nt, Human
ccuguaaaacucucuugggggaaacaag

SEQ ID NO: 260059 - RNA, 19 nt, Human
cugccuuauucuucugcac

SEQ ID NO: 260060 - RNA, 20 nt, Human
gcaaaacaacgaggcccccc

SEQ ID NO: 260061 - RNA, 22 nt, Human
gcaaaacaacgaggccccccaa

SEQ ID NO: 260062 - RNA, 22 nt, Human
uaaaagagaaaacugacuacau

SEQ ID NO: 260063 - RNA, 22 nt, Human
uaaguacauccaguuaugcaaa

SEQ ID NO: 260064 - RNA, 24 nt, Human
ucuccugauggacaggagggcgga

SEQ ID NO: 260065 - RNA, 18 nt, Human
ugaaaauaucuugccagg

SEQ ID NO: 260066 - RNA, 21 nt, Human
ugacaucagcuacccaucacu

SEQ ID NO: 260067 - RNA, 20 nt, Human
ugcacauguacaaauaaagu

SEQ ID NO: 260068 - RNA, 22 nt, Human
ugccaggcuagaaaacaagcaa

SEQ ID NO: 260069 - RNA, 23 nt, Human
ugccuuauucuucugcacaugua

SEQ ID NO: 260070 - RNA, 20 nt, Human
uggaguggaaauaaaaacug

SEQ ID NO: 260071 - RNA, 24 nt, Human
uuaucuaaguacauccaguuaugc

SEQ ID NO: 260072 - RNA, 19 nt, Human
uucaaauaucucagaaucg

SEQ ID NO: 260073 - RNA, 24 nt, Human
uuuugggagcuccuuaaaauaugc

SEQ ID NO: 260074 - RNA, 20 nt, Human
aaaaaaacaaggugaaucaa

SEQ ID NO: 260075 - RNA, 25 nt, Human
aaaugucagaaaaugcacucgauuc

SEQ ID NO: 260076 - RNA, 26 nt, Human
aaaugucagaaaaugcacucgauucc

SEQ ID NO: 260077 - RNA, 21 nt, Human
acaaccagguuaaaaaaacaa

SEQ ID NO: 260078 - RNA, 26 nt, Human
agcuuguaacauuuucauuuuuccug

SEQ ID NO: 260079 - RNA, 24 nt, Human
augguagcuuuauuuuaaucuuua

SEQ ID NO: 260080 - RNA, 24 nt, Human
cacaaucgcgacccaaggcugucu

SEQ ID NO: 260081 - RNA, 28 nt, Human
cagaaaaugcacucgauuccccugaaag

SEQ ID NO: 260082 - RNA, 28 nt, Human
cagaaaaugcacucgauuccccugaaag

SEQ ID NO: 260083 - RNA, 21 nt, Human
cagguuaaaaaaacaagguga

SEQ ID NO: 260084 - RNA, 21 nt, Human
cccacaaucgcgacccaaggc

SEQ ID NO: 260085 - RNA, 21 nt, Human
cccacaaucgcgacccaaggc

SEQ ID NO: 260086 - RNA, 25 nt, Human
cccacaaucgcgacccaaggcuguc

SEQ ID NO: 260087 - RNA, 23 nt, Human
ccccacaaucgcgacccaaggcu

SEQ ID NO: 260088 - RNA, 24 nt, Human
cucuuagcuuguaacauuuucauu

SEQ ID NO: 260089 - RNA, 19 nt, Human
cugcuggacucuucgaagc

SEQ ID NO: 260090 - RNA, 22 nt, Human
ggaaacaauacuuaaaaucuua

SEQ ID NO: 260091 - RNA, 21 nt, Human
ggacucuucgaagccccacaa

SEQ ID NO: 260092 - RNA, 19 nt, Human
uaaaaucuuaaacuguaaa

SEQ ID NO: 260093 - RNA, 27 nt, Human
uaaacucuuagcuuguaacauuuucau

SEQ ID NO: 260094 - RNA, 21 nt, Human
uaaucuuuacucaagagugau

SEQ ID NO: 260095 - RNA, 21 nt, Human
ucuccaagaaccccuggguac

SEQ ID NO: 260096 - RNA, 21 nt, Human
ucuccaagaaccccuggguac

SEQ ID NO: 260097 - RNA, 23 nt, Human
ucuuacuuauggaguuaugcuca

SEQ ID NO: 260098 - RNA, 21 nt, Human
uguaaaaugguagcuuuauuu

SEQ ID NO: 260099 - RNA, 24 nt, Human
uguaaaaugguagcuuuauuuuaa

SEQ ID NO: 260100 - RNA, 20 nt, Human
uguaacauuuucauuuuucc

SEQ ID NO: 260101 - RNA, 21 nt, Human
uucgaagccccacaaucgcga

SEQ ID NO: 260102 - RNA, 19 nt, Human
aggugucgggacugcucug

SEQ ID NO: 260103 - RNA, 19 nt, Human
cacagcugcccaccugggg

SEQ ID NO: 260104 - RNA, 19 nt, Human
cacagcugcccaccugggg

SEQ ID NO: 260105 - RNA, 19 nt, Human
cacggcccgaaccagcugg

SEQ ID NO: 260106 - RNA, 21 nt, Human
ccacagcugcccaccuggggc

SEQ ID NO: 260107 - RNA, 21 nt, Human
ccacagcugcccaccuggggc

SEQ ID NO: 260108 - RNA, 19 nt, Human
ccccgccgcgggucgcugc

SEQ ID NO: 260109 - RNA, 19 nt, Human
ccgccgcgggucgcugcuc

SEQ ID NO: 260110 - RNA, 23 nt, Human
gggacugcucugccacagcugcc

SEQ ID NO: 260111 - RNA, 20 nt, Human
ggggcgcgucccugcuggcc

SEQ ID NO: 260112 - RNA, 20 nt, Human
ggggcgcgucccugcuggcc

SEQ ID NO: 260113 - RNA, 19 nt, Human
ucugccacagcugcccacc

SEQ ID NO: 260114 - RNA, 19 nt, Human
ucugccacagcugcccacc

SEQ ID NO: 260115 - RNA, 20 nt, Human
ugccacagcugcccaccugg

SEQ ID NO: 260116 - RNA, 20 nt, Human
ugccacagcugcccaccugg

SEQ ID NO: 260117 - RNA, 21 nt, Human
uggggcgcgucccugcuggcc

SEQ ID NO: 260118 - RNA, 21 nt, Human
uggggcgcgucccugcuggcc

SEQ ID NO: 260119 - RNA, 23 nt, Human
ugucgggacugcucugccacagc

SEQ ID NO: 260120 - RNA, 21 nt, Human
aaaagaacaggccaagauagg

SEQ ID NO: 260121 - RNA, 21 nt, Human
aacaaaacaggccaaggugga

SEQ ID NO: 260122 - RNA, 21 nt, Human
aacagagugagacuccgucuc

SEQ ID NO: 260123 - RNA, 24 nt, Human
aacagagugagacuccgucucaaa

SEQ ID NO: 260124 - RNA, 18 nt, Human
aacaggccaagguggacc

SEQ ID NO: 260125 - RNA, 23 nt, Human
aacaggccaagguggaccaggca

SEQ ID NO: 260126 - RNA, 19 nt, Human
aacauggugaaaccccauc

SEQ ID NO: 260127 - RNA, 20 nt, Human
aacauggugaaaccccaucu

SEQ ID NO: 260128 - RNA, 20 nt, Human
aacauggugaaaccccaucu

SEQ ID NO: 260129 - RNA, 21 nt, Human
aacauggugaaaccccaucuc

SEQ ID NO: 260130 - RNA, 24 nt, Human
aacgcuuugggaggccaagguggg

SEQ ID NO: 260131 - RNA, 20 nt, Human
aagcaaggccugaccccaaa

SEQ ID NO: 260132 - RNA, 21 nt, Human
aagcaaggccugaccccaaag

SEQ ID NO: 260133 - RNA, 19 nt, Human
aagccagcacuauccuugg

SEQ ID NO: 260134 - RNA, 24 nt, Human
aagccagcacuauccuuggggaca

SEQ ID NO: 260135 - RNA, 25 nt, Human
aaggugggcggaucacuucgaguca

SEQ ID NO: 260136 - RNA, 20 nt, Human
aagugcccaguggcucugcc

SEQ ID NO: 260137 - RNA, 21 nt, Human
acacccaccucccuccuccug

SEQ ID NO: 260138 - RNA, 24 nt, Human
acagagugagacuccgucucaaaa

SEQ ID NO: 260139 - RNA, 24 nt, Human
accaaacaagaucuggccuagagc

SEQ ID NO: 260140 - RNA, 28 nt, Human
acccaccucccuccuccugaggcccccu

SEQ ID NO: 260141 - RNA, 24 nt, Human
accccaucucuacuaaaaauacaa

SEQ ID NO: 260142 - RNA, 20 nt, Human
acucugugccccagugccag

SEQ ID NO: 260143 - RNA, 18 nt, Human
acugcacuccacccuggg

SEQ ID NO: 260144 - RNA, 24 nt, Human
acugcacuccacccugggcaacag

SEQ ID NO: 260145 - RNA, 24 nt, Human
acuucgagucaggaguuugagacc

SEQ ID NO: 260146 - RNA, 21 nt, Human
agaaaaacaaaacaggccaag

SEQ ID NO: 260147 - RNA, 22 nt, Human
agagaagcagcccagaguucag

SEQ ID NO: 260148 - RNA, 23 nt, Human
agagcaaaggcuuggggguauuu

SEQ ID NO: 260149 - RNA, 21 nt, Human
agcacuauccuuggggacacc

SEQ ID NO: 260150 - RNA, 22 nt, Human
agccuggccaacauggugaaac

SEQ ID NO: 260151 - RNA, 24 nt, Human
agccuggccaacauggugaaaccc

SEQ ID NO: 260152 - RNA, 23 nt, Human
aggaacugaaagcugucuuagcc

SEQ ID NO: 260153 - RNA, 20 nt, Human
aggaguuugagaccagccug

SEQ ID NO: 260154 - RNA, 20 nt, Human
aggcacauggcucaugccua

SEQ ID NO: 260155 - RNA, 21 nt, Human
aggccaaggugggcggaucac

SEQ ID NO: 260156 - RNA, 22 nt, Human
aggccagcaagucuggucugca

SEQ ID NO: 260157 - RNA, 24 nt, Human
aggcugaggcaggagaaucccuug

SEQ ID NO: 260158 - RNA, 19 nt, Human
aggcugcagggggaugucc

SEQ ID NO: 260159 - RNA, 20 nt, Human
agggcagagaccaaguuggg

SEQ ID NO: 260160 - RNA, 19 nt, Human
agguggaaguugcagugag

SEQ ID NO: 260161 - RNA, 24 nt, Human
agguggaaguugcagugagccaag

SEQ ID NO: 260162 - RNA, 24 nt, Human
aucacuucgagucaggaguuugag

SEQ ID NO: 260163 - RNA, 24 nt, Human
aucaugccacugcacuccacccug

SEQ ID NO: 260164 - RNA, 22 nt, Human
aucccaacgcuuugggaggcca

SEQ ID NO: 260165 - RNA, 22 nt, Human
augccacugcacuccacccugg

SEQ ID NO: 260166 - RNA, 22 nt, Human
auggcucaugccuauaauccca

SEQ ID NO: 260167 - RNA, 18 nt, Human
auuccugccugcaaaccc

SEQ ID NO: 260168 - RNA, 25 nt, Human
caaaaaacaaaaaagaacaggccaa

SEQ ID NO: 260169 - RNA, 19 nt, Human
caaaaaagaacaggccaag

SEQ ID NO: 260170 - RNA, 24 nt, Human
caacauggugaaaccccaucucua

SEQ ID NO: 260171 - RNA, 24 nt, Human
caacgcuuugggaggccaaggugg

SEQ ID NO: 260172 - RNA, 18 nt, Human
caaggugggcggaucacu

SEQ ID NO: 260173 - RNA, 19 nt, Human
caccugcaccaaacaagau

SEQ ID NO: 260174 - RNA, 23 nt, Human
cacuccacccugggcaacagagu

SEQ ID NO: 260175 - RNA, 23 nt, Human
cacugcacuccacccugggcaac

SEQ ID NO: 260176 - RNA, 24 nt, Human
cacugcacuccacccugggcaaca

SEQ ID NO: 260177 - RNA, 21 nt, Human
cacuguacuuugaacagaaga

SEQ ID NO: 260178 - RNA, 20 nt, Human
cacuugaaaauggaauggaa

SEQ ID NO: 260179 - RNA, 24 nt, Human
cagcuacucaagaggcugaggcag

SEQ ID NO: 260180 - RNA, 19 nt, Human
caggcacauggcucaugcc

SEQ ID NO: 260181 - RNA, 22 nt, Human
caggccuuuggccccugggagg

SEQ ID NO: 260182 - RNA, 20 nt, Human
caggguggggucucaggccu

SEQ ID NO: 260183 - RNA, 24 nt, Human
caugccuauaaucccaacgcuuug

SEQ ID NO: 260184 - RNA, 19 nt, Human
ccaaggaaagaaaaacaaa

SEQ ID NO: 260185 - RNA, 24 nt, Human
ccaaggaaagaaaaacaaaacagg

SEQ ID NO: 260186 - RNA, 28 nt, Human
ccaaggaaagaaaaacaaaacaggccaa

SEQ ID NO: 260187 - RNA, 23 nt, Human
ccacagggcaugcugacaagcag

SEQ ID NO: 260188 - RNA, 21 nt, Human
ccacugcacuccacccugggc

SEQ ID NO: 260189 - RNA, 23 nt, Human
ccacugcacuccacccugggcaa

SEQ ID NO: 260190 - RNA, 24 nt, Human
ccacugcacuccacccugggcaac

SEQ ID NO: 260191 - RNA, 23 nt, Human
ccagccuugauugcaggucagaa

SEQ ID NO: 260192 - RNA, 20 nt, Human
cccaaggaaagaaaaacaaa

SEQ ID NO: 260193 - RNA, 21 nt, Human
cccaaggaaagaaaaacaaaa

SEQ ID NO: 260194 - RNA, 23 nt, Human
cccgagucaucuguguucuccau

SEQ ID NO: 260195 - RNA, 20 nt, Human
ccuagagcaaaggcuugggg

SEQ ID NO: 260196 - RNA, 22 nt, Human
ccuauaaucccaacgcuuuggg

SEQ ID NO: 260197 - RNA, 20 nt, Human
ccuccuaccucucuaucaga

SEQ ID NO: 260198 - RNA, 18 nt, Human
ccugcaaaccccucccca

SEQ ID NO: 260199 - RNA, 23 nt, Human
ccuggccaacauggugaaacccc

SEQ ID NO: 260200 - RNA, 24 nt, Human
ccuggccaacauggugaaacccca

SEQ ID NO: 260201 - RNA, 22 nt, Human
ccugggcaacagagugagacuc

SEQ ID NO: 260202 - RNA, 19 nt, Human
ccuguaaucccagcuacuc

SEQ ID NO: 260203 - RNA, 22 nt, Human
ccuguaaucccagcuacucaag

SEQ ID NO: 260204 - RNA, 20 nt, Human
ccuugauugcaggucagaag

SEQ ID NO: 260205 - RNA, 22 nt, Human
ccuugcuguggcuguacacuug

SEQ ID NO: 260206 - RNA, 23 nt, Human
ccuuguggucaggccagcaaguc

SEQ ID NO: 260207 - RNA, 19 nt, Human
cgccuguaaucccagcuac

SEQ ID NO: 260208 - RNA, 24 nt, Human
cggaucacuucgagucaggaguuu

SEQ ID NO: 260209 - RNA, 21 nt, Human
cuagaauuugaauugcugagc

SEQ ID NO: 260210 - RNA, 24 nt, Human
cucaugccuauaaucccaacgcuu

SEQ ID NO: 260211 - RNA, 23 nt, Human
cucccuuguggucaggccagcaa

SEQ ID NO: 260212 - RNA, 23 nt, Human
cuggccaacauggugaaacccca

SEQ ID NO: 260213 - RNA, 24 nt, Human
cuggugaucccuauuuggucuccc

SEQ ID NO: 260214 - RNA, 20 nt, Human
cuguauccccugucucaggg

SEQ ID NO: 260215 - RNA, 19 nt, Human
gaacaggccaagauaggag

SEQ ID NO: 260216 - RNA, 19 nt, Human
gaaguugcagugagccaag

SEQ ID NO: 260217 - RNA, 24 nt, Human
gaucacuucgagucaggaguuuga

SEQ ID NO: 260218 - RNA, 22 nt, Human
gaucuccaagacccaugcccga

SEQ ID NO: 260219 - RNA, 23 nt, Human
gauuaggaagaugugcccauuuu

SEQ ID NO: 260220 - RNA, 24 nt, Human
gccaacauggugaaaccccaucuc

SEQ ID NO: 260221 - RNA, 20 nt, Human
gccaagaucaugccacugca

SEQ ID NO: 260222 - RNA, 24 nt, Human
gccacugcacuccacccugggcaa

SEQ ID NO: 260223 - RNA, 20 nt, Human
gccugcaaaccccuccccag

SEQ ID NO: 260224 - RNA, 20 nt, Human
gcuccuugcuguggcuguac

SEQ ID NO: 260225 - RNA, 18 nt, Human
ggaacagugaccaagaac

SEQ ID NO: 260226 - RNA, 20 nt, Human
ggaaguugcagugagccaag

SEQ ID NO: 260227 - RNA, 24 nt, Human
ggaaguugcagugagccaagauca

SEQ ID NO: 260228 - RNA, 22 nt, Human
ggaucacuucgagucaggaguu

SEQ ID NO: 260229 - RNA, 18 nt, Human
ggcagagaccaaguuggg

SEQ ID NO: 260230 - RNA, 21 nt, Human
ggccuuuggccccugugacuc

SEQ ID NO: 260231 - RNA, 24 nt, Human
ggcugugguggugggcgccuguaa

SEQ ID NO: 260232 - RNA, 24 nt, Human
gggaugggauggcagggugaaagg

SEQ ID NO: 260233 - RNA, 21 nt, Human
gggcagagaccaaguugggga

SEQ ID NO: 260234 - RNA, 21 nt, Human
ggggcaggguggggucucagg

SEQ ID NO: 260235 - RNA, 24 nt, Human
gguggugggcgccuguaaucccag

SEQ ID NO: 260236 - RNA, 18 nt, Human
gugggcacucugugcccc

SEQ ID NO: 260237 - RNA, 20 nt, Human
guugggaugggauggcaggg

SEQ ID NO: 260238 - RNA, 22 nt, Human
guuucuguauccccugucucag

SEQ ID NO: 260239 - RNA, 25 nt, Human
uaaaaauacaaaaauuagcaggcug

SEQ ID NO: 260240 - RNA, 24 nt, Human
ucacuucgagucaggaguuugaga

SEQ ID NO: 260241 - RNA, 21 nt, Human
ucagggcagagaccaaguugg

SEQ ID NO: 260242 - RNA, 21 nt, Human
ucagugcccugcuucagggca

SEQ ID NO: 260243 - RNA, 23 nt, Human
ucaugccacugcacuccacccug

SEQ ID NO: 260244 - RNA, 24 nt, Human
ucccuugaucccagagguggaagu

SEQ ID NO: 260245 - RNA, 24 nt, Human
ucccuuguggucaggccagcaagu

SEQ ID NO: 260246 - RNA, 18 nt, Human
ucucaaaaaacaaaaaag

SEQ ID NO: 260247 - RNA, 18 nt, Human
ucucaggggcuccaacac

SEQ ID NO: 260248 - RNA, 24 nt, Human
ucuccuuuaugcaagcaaggccug

SEQ ID NO: 260249 - RNA, 23 nt, Human
ucucuacuaaaaauacaaaaauu

SEQ ID NO: 260250 - RNA, 26 nt, Human
ucugcaauggaacagugaccaagaac

SEQ ID NO: 260251 - RNA, 19 nt, Human
ugaaaccccaucucuacua

SEQ ID NO: 260252 - RNA, 23 nt, Human
ugaacagaagaucuccaagaccc

SEQ ID NO: 260253 - RNA, 22 nt, Human
ugacaagcaggcugcucggcug

SEQ ID NO: 260254 - RNA, 20 nt, Human
ugaccaagaacgugccuccu

SEQ ID NO: 260255 - RNA, 23 nt, Human
ugagaccagccuggccaacaugg

SEQ ID NO: 260256 - RNA, 24 nt, Human
ugagaccagccuggccaacauggu

SEQ ID NO: 260257 - RNA, 18 nt, Human
ugaggcaggagaaucccu

SEQ ID NO: 260258 - RNA, 24 nt, Human
ugaggcaggagaaucccuugaucc

SEQ ID NO: 260259 - RNA, 19 nt, Human
ugaguucccagccacuccc

SEQ ID NO: 260260 - RNA, 23 nt, Human
ugcaagcaaggccugaccccaaa

SEQ ID NO: 260261 - RNA, 25 nt, Human
ugcacuccacccugggcaacagagu

SEQ ID NO: 260262 - RNA, 18 nt, Human
ugcccaguggcucugccc

SEQ ID NO: 260263 - RNA, 20 nt, Human
ugcccugugcuaccuucccc

SEQ ID NO: 260264 - RNA, 21 nt, Human
ugcccugugcuaccuuccccu

SEQ ID NO: 260265 - RNA, 19 nt, Human
ugccugcaaaccccucccc

SEQ ID NO: 260266 - RNA, 25 nt, Human
ugccugcaaaccccuccccagccuu

SEQ ID NO: 260267 - RNA, 24 nt, Human
uggccaacauggugaaaccccauc

SEQ ID NO: 260268 - RNA, 21 nt, Human
uggcucaugccuauaauccca

SEQ ID NO: 260269 - RNA, 19 nt, Human
ugggaggccaaggugggcg

SEQ ID NO: 260270 - RNA, 24 nt, Human
ugggaggccaaggugggcggauca

SEQ ID NO: 260271 - RNA, 19 nt, Human
ugggaugggauggcagggu

SEQ ID NO: 260272 - RNA, 24 nt, Human
ugggcggaucacuucgagucagga

SEQ ID NO: 260273 - RNA, 24 nt, Human
uggggagucaggaacugaaagcug

SEQ ID NO: 260274 - RNA, 23 nt, Human
ugggggcaggguggggucucagg

SEQ ID NO: 260275 - RNA, 25 nt, Human
ugggggcaggguggggucucaggcc

SEQ ID NO: 260276 - RNA, 21 nt, Human
uggugggguuugugucacaga

SEQ ID NO: 260277 - RNA, 24 nt, Human
ugguggugggcgccuguaauccca

SEQ ID NO: 260278 - RNA, 20 nt, Human
uuagcaggcugugguggugg

SEQ ID NO: 260279 - RNA, 22 nt, Human
uuagcaggcugugguggugggc

SEQ ID NO: 260280 - RNA, 23 nt, Human
uucgagucaggaguuugagacca

SEQ ID NO: 260281 - RNA, 20 nt, Human
uugcagugagccaagaucau

SEQ ID NO: 260282 - RNA, 23 nt, Human
uugcauuaacaauuggugggguu

SEQ ID NO: 260283 - RNA, 20 nt, Human
uuugggggcagggugggguc

SEQ ID NO: 260284 - RNA, 21 nt, Human
aaaagguccuucaggccaccc

SEQ ID NO: 260285 - RNA, 22 nt, Human
aaauaccucuauaggucuaacc

SEQ ID NO: 260286 - RNA, 19 nt, Human
accgauccgcaaaugcucc

SEQ ID NO: 260287 - RNA, 19 nt, Human
aggaaaaagugaccgaucc

SEQ ID NO: 260288 - RNA, 19 nt, Human
cacaggaccuaaaggugag

SEQ ID NO: 260289 - RNA, 20 nt, Human
caccccucuaaacacaggag

SEQ ID NO: 260290 - RNA, 27 nt, Human
caggagccaaggguguugacagaaaac

SEQ ID NO: 260291 - RNA, 20 nt, Human
caggauuccaccgaccucac

SEQ ID NO: 260292 - RNA, 20 nt, Human
caucacaagcgccagggucu

SEQ ID NO: 260293 - RNA, 24 nt, Human
ccagcagaaaagguccuucaggcc

SEQ ID NO: 260294 - RNA, 22 nt, Human
ccccucuaaacacaggagccaa

SEQ ID NO: 260295 - RNA, 21 nt, Human
ccccuucccagcagagggcag

SEQ ID NO: 260296 - RNA, 21 nt, Human
cccgagggcccaaccacucuc

SEQ ID NO: 260297 - RNA, 19 nt, Human
cccucuaaacacaggagcc

SEQ ID NO: 260298 - RNA, 22 nt, Human
ccucacaggaccuaaaggugag

SEQ ID NO: 260299 - RNA, 23 nt, Human
ccucaugcugcuaacagaaaguc

SEQ ID NO: 260300 - RNA, 22 nt, Human
ccugugguaggggauaagagac

SEQ ID NO: 260301 - RNA, 22 nt, Human
cucagaaaggaggaaaaaguga

SEQ ID NO: 260302 - RNA, 22 nt, Human
cugccaccugggccgucccugu

SEQ ID NO: 260303 - RNA, 24 nt, Human
gaagaggcggagccaggacuugaa

SEQ ID NO: 260304 - RNA, 22 nt, Human
gaguggcugccucuagaggcgg

SEQ ID NO: 260305 - RNA, 18 nt, Human
gcuccccgauccgcucuc

SEQ ID NO: 260306 - RNA, 20 nt, Human
gcugccucuagaggcgcaaa

SEQ ID NO: 260307 - RNA, 23 nt, Human
ggaaaaagugaccgauccgcaaa

SEQ ID NO: 260308 - RNA, 20 nt, Human
ggcugccucuagaggcgcaa

SEQ ID NO: 260309 - RNA, 22 nt, Human
gggauaagagacucagaaagga

SEQ ID NO: 260310 - RNA, 20 nt, Human
guugacagaggggcacccuu

SEQ ID NO: 260311 - RNA, 19 nt, Human
ucaggccaccccucuaaac

SEQ ID NO: 260312 - RNA, 19 nt, Human
uccaugaguggcugccucu

SEQ ID NO: 260313 - RNA, 21 nt, Human
ucccucacaggaccuaaaggu

SEQ ID NO: 260314 - RNA, 23 nt, Human
ucccucuauaggucuaaccacag

SEQ ID NO: 260315 - RNA, 19 nt, Human
uccgcaaaugcuccccgag

SEQ ID NO: 260316 - RNA, 23 nt, Human
uccuucaggccaccccucuaaac

SEQ ID NO: 260317 - RNA, 18 nt, Human
ucggaggacccuguggca

SEQ ID NO: 260318 - RNA, 19 nt, Human
ucugcaggggcgcccagcc

SEQ ID NO: 260319 - RNA, 20 nt, Human
ugaauccaugaguggcugcc

SEQ ID NO: 260320 - RNA, 19 nt, Human
ugaccgauccgcaaaugcu

SEQ ID NO: 260321 - RNA, 18 nt, Human
uggcagccaggagcggaa

SEQ ID NO: 260322 - RNA, 21 nt, Human
uggcagccaggagcggaaggu

SEQ ID NO: 260323 - RNA, 21 nt, Human
uggcugccucuagaggcgcaa

SEQ ID NO: 260324 - RNA, 22 nt, Human
uguugacagaggggcacccuuu

SEQ ID NO: 260325 - RNA, 23 nt, Human
uucccgagggcccaaccacucuc

SEQ ID NO: 260326 - RNA, 18 nt, Human
uuuuuuacaucacaagcg

SEQ ID NO: 260327 - RNA, 23 nt, Human
aaacaaaauauucuuaucaggcg

SEQ ID NO: 260328 - RNA, 24 nt, Human
aaagggcugggauuacaggcguga

SEQ ID NO: 260329 - RNA, 21 nt, Human
aaaguuccccacuuccuacuu

SEQ ID NO: 260330 - RNA, 21 nt, Human
aaccuauuuaccuccccagac

SEQ ID NO: 260331 - RNA, 18 nt, Human
aaggucuuugcaaauguu

SEQ ID NO: 260332 - RNA, 19 nt, Human
aaguagcugggacuacagg

SEQ ID NO: 260333 - RNA, 20 nt, Human
aaguagcugggacuacaggu

SEQ ID NO: 260334 - RNA, 26 nt, Human
aaguagcugggacuacaggugacugc

SEQ ID NO: 260335 - RNA, 19 nt, Human
aaguuccccacuuccuacu

SEQ ID NO: 260336 - RNA, 18 nt, Human
acgggguuucacuauguu

SEQ ID NO: 260337 - RNA, 23 nt, Human
acgggguuucacuauguuggcca

SEQ ID NO: 260338 - RNA, 24 nt, Human
acgggguuucacuauguuggccag

SEQ ID NO: 260339 - RNA, 18 nt, Human
acuauguuggccaggcug

SEQ ID NO: 260340 - RNA, 23 nt, Human
acugauuuuuuucaguccaucug

SEQ ID NO: 260341 - RNA, 25 nt, Human
aggcgaauaaaucuaauguaaaacc

SEQ ID NO: 260342 - RNA, 24 nt, Human
agggcugggauuacaggcgugagc

SEQ ID NO: 260343 - RNA, 20 nt, Human
agugcacuggugcgaucucg

SEQ ID NO: 260344 - RNA, 24 nt, Human
agugcacuggugcgaucucggcuc

SEQ ID NO: 260345 - RNA, 19 nt, Human
auacugcaucgugggauag

SEQ ID NO: 260346 - RNA, 18 nt, Human
auuaaggcuggaugaaaa

SEQ ID NO: 260347 - RNA, 20 nt, Human
auucugcugucaaauuugga

SEQ ID NO: 260348 - RNA, 19 nt, Human
caaaaucuaccaguuacuc

SEQ ID NO: 260349 - RNA, 24 nt, Human
caaagggcugggauuacaggcgug

SEQ ID NO: 260350 - RNA, 18 nt, Human
caaauagaaggagcauau

SEQ ID NO: 260351 - RNA, 28 nt, Human
caagcgauucuccugccucauccuccca

SEQ ID NO: 260352 - RNA, 22 nt, Human
caccaaggcuggagugcacugg

SEQ ID NO: 260353 - RNA, 24 nt, Human
caccucggccucccaaagggcugg

SEQ ID NO: 260354 - RNA, 21 nt, Human
cacuauguuggccaggcuggu

SEQ ID NO: 260355 - RNA, 24 nt, Human
cacuauguuggccaggcuggucuc

SEQ ID NO: 260356 - RNA, 21 nt, Human
cacugcaaccuccgccuccca

SEQ ID NO: 260357 - RNA, 18 nt, Human
cacuuauaauuucccugu

SEQ ID NO: 260358 - RNA, 19 nt, Human
cagacugauuuuuuucagu

SEQ ID NO: 260359 - RNA, 22 nt, Human
cagcagaaacaaaauauucuua

SEQ ID NO: 260360 - RNA, 24 nt, Human
cagcagaaacaaaauauucuuauc

SEQ ID NO: 260361 - RNA, 21 nt, Human
cauaccaagucacuuaauuau

SEQ ID NO: 260362 - RNA, 24 nt, Human
cauugugcucugugucugccugag

SEQ ID NO: 260363 - RNA, 20 nt, Human
ccaaagggcugggauuacag

SEQ ID NO: 260364 - RNA, 22 nt, Human
ccaaagggcugggauuacaggc

SEQ ID NO: 260365 - RNA, 23 nt, Human
ccaaagggcugggauuacaggcg

SEQ ID NO: 260366 - RNA, 24 nt, Human
ccaaagggcugggauuacaggcgu

SEQ ID NO: 260367 - RNA, 22 nt, Human
ccaacuguaacuauuaagaaug

SEQ ID NO: 260368 - RNA, 23 nt, Human
ccaguagccccuuaacaaaaccu

SEQ ID NO: 260369 - RNA, 18 nt, Human
ccauucucuuucucuaaa

SEQ ID NO: 260370 - RNA, 23 nt, Human
cccaaguagcugggacuacaggu

SEQ ID NO: 260371 - RNA, 24 nt, Human
cccaaguagcugggacuacaggug

SEQ ID NO: 260372 - RNA, 23 nt, Human
cccaccucggccucccaaagggc

SEQ ID NO: 260373 - RNA, 23 nt, Human
cccagguucaagcgauucuccug

SEQ ID NO: 260374 - RNA, 23 nt, Human
ccccaaaaucaaagccaaaaaau

SEQ ID NO: 260375 - RNA, 24 nt, Human
ccccauuaucuugauaaguaccua

SEQ ID NO: 260376 - RNA, 21 nt, Human
ccccuuaacaaaaccuuggcc

SEQ ID NO: 260377 - RNA, 23 nt, Human
cccuuugucuccccaaaaucaaa

SEQ ID NO: 260378 - RNA, 24 nt, Human
ccgccucccagguucaagcgauuc

SEQ ID NO: 260379 - RNA, 25 nt, Human
ccuagagguccugguaaaccagggu

SEQ ID NO: 260380 - RNA, 24 nt, Human
ccucccagguucaagcgauucucc

SEQ ID NO: 260381 - RNA, 21 nt, Human
ccugucaccuuuuaaucuugg

SEQ ID NO: 260382 - RNA, 24 nt, Human
cgggguuucacuauguuggccagg

SEQ ID NO: 260383 - RNA, 22 nt, Human
cuacugacuucgugaucugccc

SEQ ID NO: 260384 - RNA, 24 nt, Human
cucacugcaaccuccgccucccag

SEQ ID NO: 260385 - RNA, 23 nt, Human
cucaugcacaauacucaugugug

SEQ ID NO: 260386 - RNA, 23 nt, Human
cugcaaccuccgccucccagguu

SEQ ID NO: 260387 - RNA, 24 nt, Human
cugcaaccuccgccucccagguuc

SEQ ID NO: 260388 - RNA, 25 nt, Human
cugccucauccucccaaguagcugg

SEQ ID NO: 260389 - RNA, 23 nt, Human
cugucaaauuuggagaaacaaaa

SEQ ID NO: 260390 - RNA, 21 nt, Human
cuuggccuucuggauccuugg

SEQ ID NO: 260391 - RNA, 22 nt, Human
gacuucgugaucugcccaccuc

SEQ ID NO: 260392 - RNA, 24 nt, Human
gacuucgugaucugcccaccucgg

SEQ ID NO: 260393 - RNA, 24 nt, Human
gagacgggguuucacuauguuggc

SEQ ID NO: 260394 - RNA, 18 nt, Human
gauuacaggcgugagccc

SEQ ID NO: 260395 - RNA, 21 nt, Human
gauuacaggcgugagccuccg

SEQ ID NO: 260396 - RNA, 18 nt, Human
gcucccauucucuuucuc

SEQ ID NO: 260397 - RNA, 22 nt, Human
ggagucuaucauaucuacaaau

SEQ ID NO: 260398 - RNA, 23 nt, Human
gggguuucacuauguuggccagg

SEQ ID NO: 260399 - RNA, 23 nt, Human
guaacuauuaagaaugcuaaaaa

SEQ ID NO: 260400 - RNA, 23 nt, Human
guagagacgggguuucacuaugu

SEQ ID NO: 260401 - RNA, 24 nt, Human
gugaucugcccaccucggccuccc

SEQ ID NO: 260402 - RNA, 21 nt, Human
guggaguugcuuaucacugug

SEQ ID NO: 260403 - RNA, 20 nt, Human
uaaaaccagcaggcugugga

SEQ ID NO: 260404 - RNA, 24 nt, Human
uaaaucuaauguaaaaccagcagg

SEQ ID NO: 260405 - RNA, 25 nt, Human
uaagaaugcuaaaaaaaaaaaaaaa

SEQ ID NO: 260406 - RNA, 18 nt, Human
uaauacauaugugugugu

SEQ ID NO: 260407 - RNA, 18 nt, Human
uaauuuaggucuauuugu

SEQ ID NO: 260408 - RNA, 30 nt, Human
uaauuuuuuuuuuguauuuuuaguagagaa

SEQ ID NO: 260409 - RNA, 24 nt, Human
uacaggugacugccaccacaccca

SEQ ID NO: 260410 - RNA, 20 nt, Human
uaccuaaaucuugcaugcca

SEQ ID NO: 260411 - RNA, 21 nt, Human
uacuauaaaaggcagguaggg

SEQ ID NO: 260412 - RNA, 21 nt, Human
uacuauacaacuguaaagaua

SEQ ID NO: 260413 - RNA, 20 nt, Human
uacucaugcacaauacucau

SEQ ID NO: 260414 - RNA, 20 nt, Human
uacuuaggcuaaaaacauaa

SEQ ID NO: 260415 - RNA, 22 nt, Human
uagagacgggguuucacuaugu

SEQ ID NO: 260416 - RNA, 18 nt, Human
uagcuuagcuucacuucu

SEQ ID NO: 260417 - RNA, 20 nt, Human
uaggcuaaaaacauaaacua

SEQ ID NO: 260418 - RNA, 22 nt, Human
uaggguggggcaacucucagaa

SEQ ID NO: 260419 - RNA, 24 nt, Human
uaguagagacgggguuucacuaug

SEQ ID NO: 260420 - RNA, 24 nt, Human
uaguguaaguaauacauaugugug

SEQ ID NO: 260421 - RNA, 22 nt, Human
uauacaacuguaaagauauaga

SEQ ID NO: 260422 - RNA, 22 nt, Human
uauggagcaagaaauuaaggcu

SEQ ID NO: 260423 - RNA, 23 nt, Human
uauguuggccaggcuggucucaa

SEQ ID NO: 260424 - RNA, 24 nt, Human
uauguuggccaggcuggucucaaa

SEQ ID NO: 260425 - RNA, 22 nt, Human
ucacuauguuggccaggcuggu

SEQ ID NO: 260426 - RNA, 19 nt, Human
ucacugcaaccuccgccuc

SEQ ID NO: 260427 - RNA, 24 nt, Human
ucacugcaaccuccgccucccagg

SEQ ID NO: 260428 - RNA, 25 nt, Human
ucacugcaaccuccgccucccaggu

SEQ ID NO: 260429 - RNA, 27 nt, Human
ucacugcaaccuccgccucccagguuc

SEQ ID NO: 260430 - RNA, 22 nt, Human
ucagccagccuucuuuuuuucu

SEQ ID NO: 260431 - RNA, 23 nt, Human
ucauuuacucaugcacaauacuc

SEQ ID NO: 260432 - RNA, 19 nt, Human
ucccaaagggcugggauua

SEQ ID NO: 260433 - RNA, 23 nt, Human
ucccaaagggcugggauuacagg

SEQ ID NO: 260434 - RNA, 24 nt, Human
ucccaaagggcugggauuacaggc

SEQ ID NO: 260435 - RNA, 23 nt, Human
ucccaaguagcugggacuacagg

SEQ ID NO: 260436 - RNA, 21 nt, Human
ucccagguucaagcgauucuc

SEQ ID NO: 260437 - RNA, 24 nt, Human
ucccagguucaagcgauucuccug

SEQ ID NO: 260438 - RNA, 24 nt, Human
ucccauugucaccaaggcuggagu

SEQ ID NO: 260439 - RNA, 19 nt, Human
uccccaaaaucaaagccaa

SEQ ID NO: 260440 - RNA, 23 nt, Human
uccccaaaaucaaagccaaaaaa

SEQ ID NO: 260441 - RNA, 18 nt, Human
ucccuuugucuccccaaa

SEQ ID NO: 260442 - RNA, 21 nt, Human
uccuagagguccugguaaacc

SEQ ID NO: 260443 - RNA, 18 nt, Human
ucuacaguuucacaaugc

SEQ ID NO: 260444 - RNA, 22 nt, Human
ucucuuauaaugacaccaaacc

SEQ ID NO: 260445 - RNA, 23 nt, Human
ugaaaagguguucauucaguggu

SEQ ID NO: 260446 - RNA, 23 nt, Human
ugacuucgugaucugcccaccuc

SEQ ID NO: 260447 - RNA, 22 nt, Human
ugagaauacauaaggaggucac

SEQ ID NO: 260448 - RNA, 23 nt, Human
ugagaauggaaaaccucaggccc

SEQ ID NO: 260449 - RNA, 19 nt, Human
ugagccuccgcgcccgacc

SEQ ID NO: 260450 - RNA, 24 nt, Human
ugaucugcccaccucggccuccca

SEQ ID NO: 260451 - RNA, 23 nt, Human
ugccucauccucccaaguagcug

SEQ ID NO: 260452 - RNA, 24 nt, Human
ugccucauccucccaaguagcugg

SEQ ID NO: 260453 - RNA, 18 nt, Human
uggagugcacuggugcga

SEQ ID NO: 260454 - RNA, 24 nt, Human
uggagugcacuggugcgaucucgg

SEQ ID NO: 260455 - RNA, 26 nt, Human
uggaugguacaaaucaugcccaacug

SEQ ID NO: 260456 - RNA, 21 nt, Human
uggccaggcuggucucaaacu

SEQ ID NO: 260457 - RNA, 19 nt, Human
uggccuucuggauccuugg

SEQ ID NO: 260458 - RNA, 21 nt, Human
uggcugcauuucccuuugucu

SEQ ID NO: 260459 - RNA, 18 nt, Human
ugggacuacaggugacug

SEQ ID NO: 260460 - RNA, 21 nt, Human
ugggacuacaggugacugcca

SEQ ID NO: 260461 - RNA, 22 nt, Human
ugggacuacaggugacugccac

SEQ ID NO: 260462 - RNA, 24 nt, Human
ugggacuacaggugacugccacca

SEQ ID NO: 260463 - RNA, 18 nt, Human
ugggauuacaggcgugag

SEQ ID NO: 260464 - RNA, 19 nt, Human
ugggauuacaggcgugagc

SEQ ID NO: 260465 - RNA, 19 nt, Human
ugggauuacaggcgugagc

SEQ ID NO: 260466 - RNA, 20 nt, Human
ugggauuacaggcgugagcc

SEQ ID NO: 260467 - RNA, 23 nt, Human
ugggauuacaggcgugagccucc

SEQ ID NO: 260468 - RNA, 24 nt, Human
ugggauuacaggcgugagccuccg

SEQ ID NO: 260469 - RNA, 20 nt, Human
uguaaaaccagcaggcugug

SEQ ID NO: 260470 - RNA, 20 nt, Human
uguauuggaugucaucaggc

SEQ ID NO: 260471 - RNA, 21 nt, Human
uguauuuuuaguagagacggg

SEQ ID NO: 260472 - RNA, 18 nt, Human
ugugacuaauacucucag

SEQ ID NO: 260473 - RNA, 19 nt, Human
uguuaacaaaaucuaccag

SEQ ID NO: 260474 - RNA, 18 nt, Human
uuaguagagacgggguuu

SEQ ID NO: 260475 - RNA, 21 nt, Human
uuaguagagacgggguuucac

SEQ ID NO: 260476 - RNA, 21 nt, Human
uuaguagagacgggguuucac

SEQ ID NO: 260477 - RNA, 24 nt, Human
uuaguagagacgggguuucacuau

SEQ ID NO: 260478 - RNA, 21 nt, Human
uucaagcgauucuccugccuc

SEQ ID NO: 260479 - RNA, 24 nt, Human
uucaagcgauucuccugccucauc

SEQ ID NO: 260480 - RNA, 20 nt, Human
uucacuucuaucucaaaaua

SEQ ID NO: 260481 - RNA, 24 nt, Human
uuucacuauguuggccaggcuggu

SEQ ID NO: 260482 - RNA, 24 nt, Human
uuucagccagccuucuuuuuuucu

SEQ ID NO: 260483 - RNA, 23 nt, Human
uuugugaaauguuaaucucugca

SEQ ID NO: 260484 - RNA, 24 nt, Human
uuuuuaguagagacgggguuucac

SEQ ID NO: 260485 - RNA, 22 nt, Human
uuuuuguauuuuuaguagagaa

SEQ ID NO: 260486 - RNA, 21 nt, Human
uuuuuuguauuuuuaguagag

SEQ ID NO: 260487 - RNA, 24 nt, Human
uuuuuuguauuuuuaguagagacg

SEQ ID NO: 260488 - RNA, 25 nt, Human
aaagacuagaaaucauuguagacaa

SEQ ID NO: 260489 - RNA, 25 nt, Human
aagagacagugaagggagauacagc

SEQ ID NO: 260490 - RNA, 24 nt, Human
acauuuuauuaaggaaaaaguaau

SEQ ID NO: 260491 - RNA, 23 nt, Human
accaaccuaaaaacaaaucucaa

SEQ ID NO: 260492 - RNA, 20 nt, Human
acuuuaagagaguugcagaa

SEQ ID NO: 260493 - RNA, 21 nt, Human
agacugauaccccuuuuucuu

SEQ ID NO: 260494 - RNA, 23 nt, Human
aggaaaaaguaauaugaacagaa

SEQ ID NO: 260495 - RNA, 28 nt, Human
cauuucuaacuuuaagagaguugcagaa

SEQ ID NO: 260496 - RNA, 21 nt, Human
ccagcauguaguagugguaau

SEQ ID NO: 260497 - RNA, 20 nt, Human
ccuuugccagcauguaguag

SEQ ID NO: 260498 - RNA, 21 nt, Human
cuaaaaacaaaucucaaacac

SEQ ID NO: 260499 - RNA, 19 nt, Human
ggaagagacagugaaggga

SEQ ID NO: 260500 - RNA, 25 nt, Human
uacagccaucauuagcgaccaaccu

SEQ ID NO: 260501 - RNA, 18 nt, Human
uaggaagagacagugaag

SEQ ID NO: 260502 - RNA, 23 nt, Human
ucuuuguuccuuuggcaccucua

SEQ ID NO: 260503 - RNA, 24 nt, Human
ugcaaguaguuuuucuccaugaga

SEQ ID NO: 260504 - RNA, 22 nt, Human
uuuuuuguuucuaaugacauuu

SEQ ID NO: 260505 - RNA, 18 nt, Human
uuuuuuuuuuuuuguuuc

SEQ ID NO: 260506 - RNA, 24 nt, Human
uuuuuuuuuuuuuuuuguuucuaa

SEQ ID NO: 260507 - RNA, 18 nt, Human
uuuuuuuuuuuuuuuuug

SEQ ID NO: 260508 - RNA, 22 nt, Human
uuuuuuuuuuuuuuuuuuguuu

SEQ ID NO: 260509 - RNA, 18 nt, Human
aaaaaaggaaacagaaaa

SEQ ID NO: 260510 - RNA, 20 nt, Human
aaaaagccuauccaaggaac

SEQ ID NO: 260511 - RNA, 22 nt, Human
aaaaaggaaacagaaaacagaa

SEQ ID NO: 260512 - RNA, 24 nt, Human
aaaaaggaaacagaaaacagaaga

SEQ ID NO: 260513 - RNA, 25 nt, Human
aaaagaagaagcgugacaacacaag

SEQ ID NO: 260514 - RNA, 19 nt, Human
aaaagccuauccaaggaac

SEQ ID NO: 260515 - RNA, 21 nt, Human
aaacagaaaacagaagaaauc

SEQ ID NO: 260516 - RNA, 24 nt, Human
aaaggaaacagaaaacagaagaaa

SEQ ID NO: 260517 - RNA, 21 nt, Human
aagaagcgugacaacacaagc

SEQ ID NO: 260518 - RNA, 18 nt, Human
aauggcuacauucucuac

SEQ ID NO: 260519 - RNA, 19 nt, Human
acucauucugccuuucuuc

SEQ ID NO: 260520 - RNA, 20 nt, Human
acucuaagaaugugccacaa

SEQ ID NO: 260521 - RNA, 20 nt, Human
agagauguggugcguaugug

SEQ ID NO: 260522 - RNA, 20 nt, Human
aggugcagucucccugguug

SEQ ID NO: 260523 - RNA, 22 nt, Human
aguucagugggugcaguuuguu

SEQ ID NO: 260524 - RNA, 21 nt, Human
augacaaaaaaaaauacuaua

SEQ ID NO: 260525 - RNA, 23 nt, Human
caaaagaagaagcgugacaacac

SEQ ID NO: 260526 - RNA, 24 nt, Human
caaaagaagaagcgugacaacaca

SEQ ID NO: 260527 - RNA, 22 nt, Human
caccaaaaacguagauguggaa

SEQ ID NO: 260528 - RNA, 20 nt, Human
cagaguaccucaagaaauga

SEQ ID NO: 260529 - RNA, 19 nt, Human
cagucauauaucuuuucca

SEQ ID NO: 260530 - RNA, 21 nt, Human
cauucugccuuucuucagugu

SEQ ID NO: 260531 - RNA, 18 nt, Human
ccucaagaaaugaaaguc

SEQ ID NO: 260532 - RNA, 23 nt, Human
cucaaaacuccugagucuccaag

SEQ ID NO: 260533 - RNA, 19 nt, Human
cucaagaaaugaaagucag

SEQ ID NO: 260534 - RNA, 20 nt, Human
cucaagaaaugaaagucagc

SEQ ID NO: 260535 - RNA, 22 nt, Human
cucccugguugcugauggagaa

SEQ ID NO: 260536 - RNA, 26 nt, Human
gaaacagaaaacagaagaagggaccc

SEQ ID NO: 260537 - RNA, 21 nt, Human
gaagcuaugaacacuaauguu

SEQ ID NO: 260538 - RNA, 21 nt, Human
gacaacacaagcugcuacaau

SEQ ID NO: 260539 - RNA, 25 nt, Human
gauguggaauaaaaaaaagauagaa

SEQ ID NO: 260540 - RNA, 18 nt, Human
gauguggugcguaugugc

SEQ ID NO: 260541 - RNA, 21 nt, Human
gcaaaagggacuccaccaaaa

SEQ ID NO: 260542 - RNA, 25 nt, Human
gcaaaagggacuccaccaaaaacgu

SEQ ID NO: 260543 - RNA, 18 nt, Human
ggcuacauucucuacauu

SEQ ID NO: 260544 - RNA, 22 nt, Human
ggguguuggcuauuuagagcuu

SEQ ID NO: 260545 - RNA, 20 nt, Human
guggaauaaaaaaaagauag

SEQ ID NO: 260546 - RNA, 18 nt, Human
gugugguaacucuaagaa

SEQ ID NO: 260547 - RNA, 22 nt, Human
uaaaaagccuauccaaggaaca

SEQ ID NO: 260548 - RNA, 19 nt, Human
uaaauggaauggguucugu

SEQ ID NO: 260549 - RNA, 19 nt, Human
uaagaaugugccacaaugu

SEQ ID NO: 260550 - RNA, 23 nt, Human
uauuuagagcuucccucaugggg

SEQ ID NO: 260551 - RNA, 20 nt, Human
uccugagucuccaaggccuc

SEQ ID NO: 260552 - RNA, 22 nt, Human
ucucaagggcugauuuggaugc

SEQ ID NO: 260553 - RNA, 20 nt, Human
ugcaaaagggacuccaccaa

SEQ ID NO: 260554 - RNA, 24 nt, Human
ugcagaguaccucaagaaaugaaa

SEQ ID NO: 260555 - RNA, 23 nt, Human
uggagaaaaugacaaaaaaaaau

SEQ ID NO: 260556 - RNA, 23 nt, Human
uuaaaacaaugaugcaaaaggga

SEQ ID NO: 260557 - RNA, 22 nt, Human
uuggcuauuuagagcuucccuc

SEQ ID NO: 260558 - RNA, 20 nt, Human
uuucuucaguguaagaaagu

SEQ ID NO: 260559 - RNA, 20 nt, Human
aaaaucccugagccuuaacc

SEQ ID NO: 260560 - RNA, 24 nt, Human
aaagaaauauaucuguccuuccau

SEQ ID NO: 260561 - RNA, 19 nt, Human
aaggauagagucagucaaa

SEQ ID NO: 260562 - RNA, 21 nt, Human
acuuuacaguuucccauuguc

SEQ ID NO: 260563 - RNA, 18 nt, Human
agaaauauaucuguccuu

SEQ ID NO: 260564 - RNA, 18 nt, Human
aguaaugaucauagaagu

SEQ ID NO: 260565 - RNA, 19 nt, Human
caugcucucagaauuaagg

SEQ ID NO: 260566 - RNA, 24 nt, Human
cauuuacauaucagggcaugugug

SEQ ID NO: 260567 - RNA, 19 nt, Human
cccugagccuuaacccucc

SEQ ID NO: 260568 - RNA, 22 nt, Human
ccugagccuuaacccucccauc

SEQ ID NO: 260569 - RNA, 21 nt, Human
cucauuuuucuuccuacuggg

SEQ ID NO: 260570 - RNA, 23 nt, Human
cuuccauacccacgacacacaaa

SEQ ID NO: 260571 - RNA, 18 nt, Human
gaaauaaaaucccugagc

SEQ ID NO: 260572 - RNA, 21 nt, Human
gagccuuaacccucccaucuc

SEQ ID NO: 260573 - RNA, 18 nt, Human
gauuauaccgccuuccuu

SEQ ID NO: 260574 - RNA, 19 nt, Human
ggccuuauucuuuaguucu

SEQ ID NO: 260575 - RNA, 23 nt, Human
gguaauaagugacaguuucagaa

SEQ ID NO: 260576 - RNA, 19 nt, Human
ggucaaauauucaugcucu

SEQ ID NO: 260577 - RNA, 22 nt, Human
guuucacauuuucuuuuuauuu

SEQ ID NO: 260578 - RNA, 21 nt, Human
uaacccucagagcaaccgaca

SEQ ID NO: 260579 - RNA, 18 nt, Human
uacagaugaggaaaaaua

SEQ ID NO: 260580 - RNA, 26 nt, Human
uacccacgacacacaaauaggauuua

SEQ ID NO: 260581 - RNA, 20 nt, Human
uaggauuuauaguuaggaga

SEQ ID NO: 260582 - RNA, 22 nt, Human
uccaagaaugccuaaagaaaua

SEQ ID NO: 260583 - RNA, 22 nt, Human
uccagcaguucacugaaauaaa

SEQ ID NO: 260584 - RNA, 23 nt, Human
uccagcaguucacugaaauaaaa

SEQ ID NO: 260585 - RNA, 24 nt, Human
ucccaaguccaccuugucgcaagg

SEQ ID NO: 260586 - RNA, 23 nt, Human
ugaaauaaaaucccugagccuua

SEQ ID NO: 260587 - RNA, 18 nt, Human
ugucucauuuuucuuccu

SEQ ID NO: 260588 - RNA, 19 nt, Human
uucagaauuugaacccaga

SEQ ID NO: 260589 - RNA, 21 nt, Human
uuuacagaugaggaaaaauag

SEQ ID NO: 260590 - RNA, 21 nt, Human
uuuacaguuucccauuguccu

SEQ ID NO: 260591 - RNA, 18 nt, Human
uuuauaguuaggagagaa

SEQ ID NO: 260592 - RNA, 25 nt, Human
uuuuuuuuuuuuuuuuuuguuguuu

SEQ ID NO: 260593 - RNA, 27 nt, Human
uuuuuuuuuuuuuuuuuuuuuuugggg

SEQ ID NO: 260594 - RNA, 20 nt, Human
aaagcacuuugguccccaua

SEQ ID NO: 260595 - RNA, 18 nt, Human
aacuucuaguacucucga

SEQ ID NO: 260596 - RNA, 20 nt, Human
aagcaggagaaggaaaaagg

SEQ ID NO: 260597 - RNA, 18 nt, Human
agaagggaaaggaagaag

SEQ ID NO: 260598 - RNA, 19 nt, Human
aggaagaagaugaaauaga

SEQ ID NO: 260599 - RNA, 22 nt, Human
aggaagaagaugaaauagaaaa

SEQ ID NO: 260600 - RNA, 27 nt, Human
aggaagaagaugaaauagaagggaccc

SEQ ID NO: 260601 - RNA, 24 nt, Human
aggcucuugugucacagucagcau

SEQ ID NO: 260602 - RNA, 21 nt, Human
aggugcucgaaucucucuccu

SEQ ID NO: 260603 - RNA, 24 nt, Human
auaaaaacaaacguauuuaacaaa

SEQ ID NO: 260604 - RNA, 23 nt, Human
auuucauuccuauaucgagacau

SEQ ID NO: 260605 - RNA, 24 nt, Human
cagcagaaaaggugcucgaaucuc

SEQ ID NO: 260606 - RNA, 22 nt, Human
caguaucgaaguuggauacugg

SEQ ID NO: 260607 - RNA, 23 nt, Human
cucgaaucucucuccuuuuaauu

SEQ ID NO: 260608 - RNA, 24 nt, Human
gaaaagcaggagaaggaaaaaggg

SEQ ID NO: 260609 - RNA, 25 nt, Human
gaaaagcaggagaaggaaaaaggga

SEQ ID NO: 260610 - RNA, 18 nt, Human
gaaagaaaagcaggagaa

SEQ ID NO: 260611 - RNA, 23 nt, Human
ggggagauggccaugcaucucca

SEQ ID NO: 260612 - RNA, 23 nt, Human
uaaaaacaaacguauuuaacaaa

SEQ ID NO: 260613 - RNA, 18 nt, Human
uaaaugggagggaaguau

SEQ ID NO: 260614 - RNA, 19 nt, Human
uauacacacacaguucaua

SEQ ID NO: 260615 - RNA, 23 nt, Human
uauguugcacauuuccauauaug

SEQ ID NO: 260616 - RNA, 18 nt, Human
uccagggaaaaaaaugag

SEQ ID NO: 260617 - RNA, 19 nt, Human
uccagggaaaaaaaugaga

SEQ ID NO: 260618 - RNA, 24 nt, Human
ucucuauacacacacaguucauaa

SEQ ID NO: 260619 - RNA, 21 nt, Human
ugggagaagggaaaggaagaa

SEQ ID NO: 260620 - RNA, 24 nt, Human
uguaaugccuuuauauaaaguucu

SEQ ID NO: 260621 - RNA, 23 nt, Human
uuuuuuauugcuucuaauuugau

SEQ ID NO: 260622 - RNA, 24 nt, Human
uuuuuuuuuuuuauugcuucuaau

SEQ ID NO: 260623 - RNA, 24 nt, Human
aaggagaugacuuaguugguacuu

SEQ ID NO: 260624 - RNA, 20 nt, Human
uaauuugaaaggagaugacu

SEQ ID NO: 260625 - RNA, 22 nt, Human
ugaaaggagaugacuuaguugg

SEQ ID NO: 260626 - RNA, 24 nt, Human
ugaaaggagaugacuuaguuggua

SEQ ID NO: 260627 - RNA, 18 nt, Human
aaagagacuagugguugu

SEQ ID NO: 260628 - RNA, 24 nt, Human
aaaggcaaacgaauuuuaagauca

SEQ ID NO: 260629 - RNA, 19 nt, Human
aacacagugcagggauaag

SEQ ID NO: 260630 - RNA, 20 nt, Human
aauacuauuaaagagacuag

SEQ ID NO: 260631 - RNA, 21 nt, Human
agcuuuaaaaaggcaaacgaa

SEQ ID NO: 260632 - RNA, 21 nt, Human
aucucgugauuggcugguugu

SEQ ID NO: 260633 - RNA, 19 nt, Human
cagcugaguccucagaagc

SEQ ID NO: 260634 - RNA, 24 nt, Human
caggccagucauuuaacuucccag

SEQ ID NO: 260635 - RNA, 24 nt, Human
caucacaaugcaaaugcccuccca

SEQ ID NO: 260636 - RNA, 25 nt, Human
caucugcuuuucuucucugucuucc

SEQ ID NO: 260637 - RNA, 26 nt, Human
ccagagucucauucccuucgcugacc

SEQ ID NO: 260638 - RNA, 22 nt, Human
cugacaaaauaggaagauugaa

SEQ ID NO: 260639 - RNA, 23 nt, Human
gguuccagcugaguccucagaag

SEQ ID NO: 260640 - RNA, 24 nt, Human
gguuguggcagaaauuguuucugc

SEQ ID NO: 260641 - RNA, 21 nt, Human
ucauucccuucgcugacaaaa

SEQ ID NO: 260642 - RNA, 22 nt, Human
uccaucacaaugcaaaugcccu

SEQ ID NO: 260643 - RNA, 19 nt, Human
ucccagagucucauucccu

SEQ ID NO: 260644 - RNA, 21 nt, Human
ucucaugauuaacuauuuuca

SEQ ID NO: 260645 - RNA, 22 nt, Human
ucugucuuccaucacaaugcaa

SEQ ID NO: 260646 - RNA, 25 nt, Human
ugaauuuucagcuuaucagcuacuc

SEQ ID NO: 260647 - RNA, 20 nt, Human
ugacaaaauaggaagauuga

SEQ ID NO: 260648 - RNA, 18 nt, Human
ugacauacucaacacagu

SEQ ID NO: 260649 - RNA, 22 nt, Human
ugguuccagcugaguccucaga

SEQ ID NO: 260650 - RNA, 22 nt, Human
uguguaaaugcccuuuaccaag

SEQ ID NO: 260651 - RNA, 20 nt, Human
uuaaagagacuagugguugu

SEQ ID NO: 260652 - RNA, 23 nt, Human
uucucagucccaucaacgguuuc

SEQ ID NO: 260653 - RNA, 23 nt, Human
uugccaucugcuuuucuucucug

SEQ ID NO: 260654 - RNA, 26 nt, Human
uuguggcagaaauuguuucugcuuau

SEQ ID NO: 260655 - RNA, 19 nt, Human
aagucuaaucacacuugac

SEQ ID NO: 260656 - RNA, 18 nt, Human
accuucugcucaguuuac

SEQ ID NO: 260657 - RNA, 19 nt, Human
auaauacagaaacagccug

SEQ ID NO: 260658 - RNA, 23 nt, Human
ccaaagcaguuuauaaaguuuau

SEQ ID NO: 260659 - RNA, 24 nt, Human
cugguccugugugcuguggcuggg

SEQ ID NO: 260660 - RNA, 21 nt, Human
cugguccugugugcuguggga

SEQ ID NO: 260661 - RNA, 19 nt, Human
gaucagcucaccucugggg

SEQ ID NO: 260662 - RNA, 18 nt, Human
gccugguccugugugcug

SEQ ID NO: 260663 - RNA, 20 nt, Human
gguccugugugcuguggcug

SEQ ID NO: 260664 - RNA, 18 nt, Human
uaucaccuucugcucagu

SEQ ID NO: 260665 - RNA, 20 nt, Human
uaucuaaaauggcagagauu

SEQ ID NO: 260666 - RNA, 22 nt, Human
uccugugugcuguggcugggga

SEQ ID NO: 260667 - RNA, 21 nt, Human
ugaggaaauuauuuucaagag

SEQ ID NO: 260668 - RNA, 20 nt, Human
uuucaggaaagucuaaucac

SEQ ID NO: 260669 - RNA, 25 nt, Human
acaaacagugggagagaccgguacc

SEQ ID NO: 260670 - RNA, 26 nt, Human
acgaaugugugugugccaaggcccca

SEQ ID NO: 260671 - RNA, 21 nt, Human
aggccccagaggcuggaugcc

SEQ ID NO: 260672 - RNA, 24 nt, Human
agugaagauugaaugucuagauau

SEQ ID NO: 260673 - RNA, 24 nt, Human
aucuguuuaaaaucucugucuucu

SEQ ID NO: 260674 - RNA, 20 nt, Human
cagugaaagaugcuuccaga

SEQ ID NO: 260675 - RNA, 24 nt, Human
caguugggugguaggguuagaagg

SEQ ID NO: 260676 - RNA, 18 nt, Human
ccagcagccacguaucuc

SEQ ID NO: 260677 - RNA, 22 nt, Human
cccagaaagggaggaggacuuc

SEQ ID NO: 260678 - RNA, 19 nt, Human
ccccagaggcuggaugccu

SEQ ID NO: 260679 - RNA, 19 nt, Human
cuggaugcccacauaugug

SEQ ID NO: 260680 - RNA, 20 nt, Human
cuggaugcccacauaugugc

SEQ ID NO: 260681 - RNA, 22 nt, Human
gaaugcacaauugaaagaguga

SEQ ID NO: 260682 - RNA, 21 nt, Human
gaggcuggaugcccacauaug

SEQ ID NO: 260683 - RNA, 20 nt, Human
ggaccuuguuuuuuuuccug

SEQ ID NO: 260684 - RNA, 22 nt, Human
gguuauggaagcccagaaaggg

SEQ ID NO: 260685 - RNA, 18 nt, Human
gucccagugaaagaugcu

SEQ ID NO: 260686 - RNA, 20 nt, Human
uacuggggccaguugggugg

SEQ ID NO: 260687 - RNA, 19 nt, Human
ucccucuugguuaacaucu

SEQ ID NO: 260688 - RNA, 22 nt, Human
uccgaaguccucuauuuccugg

SEQ ID NO: 260689 - RNA, 23 nt, Human
ucucuugauccuauuccuuuucu

SEQ ID NO: 260690 - RNA, 24 nt, Human
ugaaugcacaauugaaagagugaa

SEQ ID NO: 260691 - RNA, 20 nt, Human
ugagagaaugaauguacugg

SEQ ID NO: 260692 - RNA, 26 nt, Human
ugagaguacaaacagugggagagacg

SEQ ID NO: 260693 - RNA, 23 nt, Human
ugcugcuuagagcucaguuucau

SEQ ID NO: 260694 - RNA, 26 nt, Human
ugcuguggggaccuuguuuuuuuucc

SEQ ID NO: 260695 - RNA, 24 nt, Human
ugugugugccaaggccccagaggc

SEQ ID NO: 260696 - RNA, 27 nt, Human
uguuccucuaacccacaagcucacaug

SEQ ID NO: 260697 - RNA, 24 nt, Human
uugaaugucuagauauuuguuccu

SEQ ID NO: 260698 - RNA, 23 nt, Human
uugguuaacaucuguuuaaaauc

SEQ ID NO: 260699 - RNA, 24 nt, Human
uuuccuagacugaauugaagaaug

SEQ ID NO: 260700 - RNA, 20 nt, Human
uuuuuuuuuuuuuuuuuugg

SEQ ID NO: 260701 - RNA, 24 nt, Human
aagcgcccccggcggggcccgggc

SEQ ID NO: 260702 - RNA, 18 nt, Human
acaccgaagcugcucuuc

SEQ ID NO: 260703 - RNA, 19 nt, Human
accccaaggccuccggcac

SEQ ID NO: 260704 - RNA, 23 nt, Human
accuuuucaaaacugggggauga

SEQ ID NO: 260705 - RNA, 23 nt, Human
acgcccagugccccaacuuccau

SEQ ID NO: 260706 - RNA, 21 nt, Human
agacagacagacggacacgca

SEQ ID NO: 260707 - RNA, 21 nt, Human
agagagucagcaaggccuggg

SEQ ID NO: 260708 - RNA, 23 nt, Human
agagucaggcucgccuggccucc

SEQ ID NO: 260709 - RNA, 20 nt, Human
agcagcaccugcagcccagu

SEQ ID NO: 260710 - RNA, 19 nt, Human
aggagcaagacagguaaca

SEQ ID NO: 260711 - RNA, 20 nt, Human
aggaggggugaguggcaggg

SEQ ID NO: 260712 - RNA, 18 nt, Human
aggccuggggacagaggg

SEQ ID NO: 260713 - RNA, 24 nt, Human
aggcgccgggcagcucacgccacu

SEQ ID NO: 260714 - RNA, 21 nt, Human
agggcaggcgccgggcagcuc

SEQ ID NO: 260715 - RNA, 20 nt, Human
aggggagcgugcagcccacu

SEQ ID NO: 260716 - RNA, 22 nt, Human
aggggcagcugccagggggcuu

SEQ ID NO: 260717 - RNA, 18 nt, Human
aggggcugagugauggcc

SEQ ID NO: 260718 - RNA, 21 nt, Human
agucagacgcccagugcccca

SEQ ID NO: 260719 - RNA, 23 nt, Human
agucagcaaggccugggccagga

SEQ ID NO: 260720 - RNA, 20 nt, Human
agugaagcaucucaaggcug

SEQ ID NO: 260721 - RNA, 21 nt, Human
auccucaaucagaucccaccg

SEQ ID NO: 260722 - RNA, 28 nt, Human
caagcagccagcccggugcuguaaugac

SEQ ID NO: 260723 - RNA, 20 nt, Human
cacacgugcccccgccaacc

SEQ ID NO: 260724 - RNA, 21 nt, Human
caccauguggcgggcaggggg

SEQ ID NO: 260725 - RNA, 23 nt, Human
cacccccaccccaccccgccgcc

SEQ ID NO: 260726 - RNA, 21 nt, Human
cacccgcaccggccucccugu

SEQ ID NO: 260727 - RNA, 25 nt, Human
caccgaagcugcucuucugagcccu

SEQ ID NO: 260728 - RNA, 21 nt, Human
caccugcagcccagugggggc

SEQ ID NO: 260729 - RNA, 21 nt, Human
cacggcccacacgugcccccg

SEQ ID NO: 260730 - RNA, 18 nt, Human
cacuccaggggacagggc

SEQ ID NO: 260731 - RNA, 20 nt, Human
cacuccuucucgcugaccuu

SEQ ID NO: 260732 - RNA, 22 nt, Human
cacuucccuggucacuugggca

SEQ ID NO: 260733 - RNA, 22 nt, Human
cagaugcaccuggugaugugug

SEQ ID NO: 260734 - RNA, 18 nt, Human
cagcaccugcagcccagu

SEQ ID NO: 260735 - RNA, 18 nt, Human
cagcccaagccacggccc

SEQ ID NO: 260736 - RNA, 19 nt, Human
cagcucagagagucagcaa

SEQ ID NO: 260737 - RNA, 19 nt, Human
cagcugccagggggcuugg

SEQ ID NO: 260738 - RNA, 21 nt, Human
cagcugccagggggcuuggag

SEQ ID NO: 260739 - RNA, 22 nt, Human
cagugcagccuccccacaaccu

SEQ ID NO: 260740 - RNA, 27 nt, Human
cauacacauggacacacacacacuucc

SEQ ID NO: 260741 - RNA, 18 nt, Human
ccaagccacggcccacac

SEQ ID NO: 260742 - RNA, 22 nt, Human
ccagcccaagccacggcccaca

SEQ ID NO: 260743 - RNA, 19 nt, Human
ccagcccggugccugcaga

SEQ ID NO: 260744 - RNA, 18 nt, Human
ccaggaggggugaguggc

SEQ ID NO: 260745 - RNA, 22 nt, Human
ccagugggggcggggguggcgu

SEQ ID NO: 260746 - RNA, 22 nt, Human
ccaguggggguggugagggguc

SEQ ID NO: 260747 - RNA, 28 nt, Human
cccaagccacggcccacacgugcccccg

SEQ ID NO: 260748 - RNA, 20 nt, Human
cccacacgugcccccgccaa

SEQ ID NO: 260749 - RNA, 18 nt, Human
cccacccccaccccaccc

SEQ ID NO: 260750 - RNA, 27 nt, Human
cccacccccaccccaccccgccgccaa

SEQ ID NO: 260751 - RNA, 19 nt, Human
cccacugggcuccucugca

SEQ ID NO: 260752 - RNA, 22 nt, Human
ccccaaggccuccggcacugag

SEQ ID NO: 260753 - RNA, 18 nt, Human
ccccaccccgccgccaag

SEQ ID NO: 260754 - RNA, 18 nt, Human
cccccgccccgcccccgc

SEQ ID NO: 260755 - RNA, 22 nt, Human
cccccgccccgcccccgccucc

SEQ ID NO: 260756 - RNA, 26 nt, Human
cccccgccccgcccccgccucccggg

SEQ ID NO: 260757 - RNA, 19 nt, Human
ccccgccccgcccccgccu

SEQ ID NO: 260758 - RNA, 21 nt, Human
ccccgcgcgcugcgcccccgc

SEQ ID NO: 260759 - RNA, 22 nt, Human
cccgcacccgcaccggccuccc

SEQ ID NO: 260760 - RNA, 21 nt, Human
cccgggcggaucagguucccg

SEQ ID NO: 260761 - RNA, 18 nt, Human
cccuaggcccccuggcuc

SEQ ID NO: 260762 - RNA, 21 nt, Human
cccuaggcccccuggcucagc

SEQ ID NO: 260763 - RNA, 23 nt, Human
cccucagcuccuccaccagacuc

SEQ ID NO: 260764 - RNA, 19 nt, Human
ccgccccgcccccgccucc

SEQ ID NO: 260765 - RNA, 24 nt, Human
ccgccccgcccccgccucccgggc

SEQ ID NO: 260766 - RNA, 22 nt, Human
ccgcgcgcugcgcccccgcccc

SEQ ID NO: 260767 - RNA, 22 nt, Human
ccucccaccuccccagcucaga

SEQ ID NO: 260768 - RNA, 22 nt, Human
ccuccggcacugagaaccccac

SEQ ID NO: 260769 - RNA, 27 nt, Human
ccuggcccccaccccaaggccuccggc

SEQ ID NO: 260770 - RNA, 21 nt, Human
ccuggcgcuggccacucauuu

SEQ ID NO: 260771 - RNA, 18 nt, Human
ccugucaaggccaggccu

SEQ ID NO: 260772 - RNA, 19 nt, Human
ccuugcucuucagcugugg

SEQ ID NO: 260773 - RNA, 21 nt, Human
ccuugcucuucagcuguggac

SEQ ID NO: 260774 - RNA, 23 nt, Human
cgcaccggccucccugucucgca

SEQ ID NO: 260775 - RNA, 18 nt, Human
cgccaaccuuccuucugg

SEQ ID NO: 260776 - RNA, 19 nt, Human
cgcccccgccucccgggcg

SEQ ID NO: 260777 - RNA, 18 nt, Human
cggagggcagcggcgagg

SEQ ID NO: 260778 - RNA, 22 nt, Human
cggcggggcccgggcccugcgc

SEQ ID NO: 260779 - RNA, 22 nt, Human
cuccagugcagccuccccacaa

SEQ ID NO: 260780 - RNA, 22 nt, Human
cugcacaccgaagcugcucuuc

SEQ ID NO: 260781 - RNA, 18 nt, Human
cugccagggggcuuggag

SEQ ID NO: 260782 - RNA, 20 nt, Human
cuggcugcuccgcccgccug

SEQ ID NO: 260783 - RNA, 23 nt, Human
cugggcuccucugcaagugcgag

SEQ ID NO: 260784 - RNA, 24 nt, Human
cuuaggagcagggcagggguaggg

SEQ ID NO: 260785 - RNA, 18 nt, Human
cuugcuuagaccuuuuca

SEQ ID NO: 260786 - RNA, 19 nt, Human
gacagggccgauggggaug

SEQ ID NO: 260787 - RNA, 20 nt, Human
gagaugaagacgccucccuc

SEQ ID NO: 260788 - RNA, 22 nt, Human
gagggaggccccuucccuuguu

SEQ ID NO: 260789 - RNA, 23 nt, Human
gaguggagucucaucaggccccu

SEQ ID NO: 260790 - RNA, 22 nt, Human
gcccacccccaccccaccccgc

SEQ ID NO: 260791 - RNA, 23 nt, Human
gccccaacuuccaugcacacaca

SEQ ID NO: 260792 - RNA, 25 nt, Human
gcccggugccugcagaugcaccugg

SEQ ID NO: 260793 - RNA, 22 nt, Human
gccuggggacagagggucaugu

SEQ ID NO: 260794 - RNA, 18 nt, Human
gcgccggccccuccccgc

SEQ ID NO: 260795 - RNA, 18 nt, Human
gcggggcccgggcccugc

SEQ ID NO: 260796 - RNA, 22 nt, Human
gcggggguggcgugagaggggg

SEQ ID NO: 260797 - RNA, 23 nt, Human
gcucccucccucagcuccuccac

SEQ ID NO: 260798 - RNA, 22 nt, Human
gcugcccacccccaccccaccc

SEQ ID NO: 260799 - RNA, 19 nt, Human
ggacacacacacacuuccc

SEQ ID NO: 260800 - RNA, 18 nt, Human
ggacagggccgaugggga

SEQ ID NO: 260801 - RNA, 20 nt, Human
ggacccuggaguuuucuacc

SEQ ID NO: 260802 - RNA, 20 nt, Human
ggagggcagcggcgaggaag

SEQ ID NO: 260803 - RNA, 21 nt, Human
ggcuggugggcagcgggucgc

SEQ ID NO: 260804 - RNA, 19 nt, Human
gggacagggccgaugggga

SEQ ID NO: 260805 - RNA, 22 nt, Human
gggacggaaaugacuugggggc

SEQ ID NO: 260806 - RNA, 20 nt, Human
gggcaggggguccaggugcu

SEQ ID NO: 260807 - RNA, 20 nt, Human
gggcccugcgcgcuggcugg

SEQ ID NO: 260808 - RNA, 21 nt, Human
gggggggacggaaaugacuug

SEQ ID NO: 260809 - RNA, 24 nt, Human
gggguccgacaugauggcuggugg

SEQ ID NO: 260810 - RNA, 22 nt, Human
gggguggugggagggccugggg

SEQ ID NO: 260811 - RNA, 19 nt, Human
ggguaggggcugagugaug

SEQ ID NO: 260812 - RNA, 19 nt, Human
gggucgcgcggagggcagc

SEQ ID NO: 260813 - RNA, 18 nt, Human
ggguggggagggagucag

SEQ ID NO: 260814 - RNA, 22 nt, Human
gguaacaggaagcaggaaggga

SEQ ID NO: 260815 - RNA, 24 nt, Human
gguggugggagggccugggggggg

SEQ ID NO: 260816 - RNA, 20 nt, Human
guggcaggggacccuggagu

SEQ ID NO: 260817 - RNA, 21 nt, Human
guggcaggggacccuggaguu

SEQ ID NO: 260818 - RNA, 21 nt, Human
guggcagggguggcuggcugg

SEQ ID NO: 260819 - RNA, 22 nt, Human
guuucugcauuugaaacauuua

SEQ ID NO: 260820 - RNA, 19 nt, Human
uacacauggacacacacac

SEQ ID NO: 260821 - RNA, 18 nt, Human
ucaaggccaggccugggg

SEQ ID NO: 260822 - RNA, 18 nt, Human
ucagcugaaugaaugggg

SEQ ID NO: 260823 - RNA, 21 nt, Human
ucagguucccgcacccgcacc

SEQ ID NO: 260824 - RNA, 23 nt, Human
ucagugggugcucucaccccugc

SEQ ID NO: 260825 - RNA, 18 nt, Human
ucauacacuccuucucgc

SEQ ID NO: 260826 - RNA, 23 nt, Human
ucauacacuccuucucgcugacc

SEQ ID NO: 260827 - RNA, 20 nt, Human
uccaugcacacacacucaca

SEQ ID NO: 260828 - RNA, 21 nt, Human
uccccgcgcgcugcgcccccg

SEQ ID NO: 260829 - RNA, 23 nt, Human
uccucucuuggguggggagggag

SEQ ID NO: 260830 - RNA, 21 nt, Human
uccuuuuuauccucaaucaga

SEQ ID NO: 260831 - RNA, 22 nt, Human
ucgcugaccuucuccuggcugc

SEQ ID NO: 260832 - RNA, 21 nt, Human
ucucaaggcugggaugcugcu

SEQ ID NO: 260833 - RNA, 23 nt, Human
ucugcaagugcgaggccuggccc

SEQ ID NO: 260834 - RNA, 19 nt, Human
ucuugguuuuggcaaaaac

SEQ ID NO: 260835 - RNA, 23 nt, Human
ugaaacgaacaauuuuucaaagu

SEQ ID NO: 260836 - RNA, 23 nt, Human
ugaaugaaugggggaggaagggc

SEQ ID NO: 260837 - RNA, 18 nt, Human
ugagauaaaggcacuuuc

SEQ ID NO: 260838 - RNA, 22 nt, Human
ugagauaaaggcacuuucugcu

SEQ ID NO: 260839 - RNA, 19 nt, Human
ugcccacccccaccccacc

SEQ ID NO: 260840 - RNA, 19 nt, Human
ugccccaacuuccaugcac

SEQ ID NO: 260841 - RNA, 21 nt, Human
ugcccugcaaagacagccccc

SEQ ID NO: 260842 - RNA, 23 nt, Human
ugccuguggcuccagugcagccu

SEQ ID NO: 260843 - RNA, 20 nt, Human
uggccacaccauguggcggg

SEQ ID NO: 260844 - RNA, 22 nt, Human
uggcccccaccccaaggccucc

SEQ ID NO: 260845 - RNA, 19 nt, Human
uggcucagcugaaugaaug

SEQ ID NO: 260846 - RNA, 21 nt, Human
uggcucagcugaaugaauggg

SEQ ID NO: 260847 - RNA, 22 nt, Human
uggcucccucccucagcuccuc

SEQ ID NO: 260848 - RNA, 23 nt, Human
uggcucccucccucagcuccucc

SEQ ID NO: 260849 - RNA, 19 nt, Human
uggcuggugggcagcgggu

SEQ ID NO: 260850 - RNA, 22 nt, Human
ugggcaggccacauggccuggg

SEQ ID NO: 260851 - RNA, 19 nt, Human
ugggccaaaccuagacacu

SEQ ID NO: 260852 - RNA, 20 nt, Human
ugggcccuggcgcuggccac

SEQ ID NO: 260853 - RNA, 22 nt, Human
ugggcugcauucuccccugggc

SEQ ID NO: 260854 - RNA, 22 nt, Human
uggggacagagggucaugucaa

SEQ ID NO: 260855 - RNA, 24 nt, Human
uggggacagagggugaggggccgg

SEQ ID NO: 260856 - RNA, 21 nt, Human
uggggagggagucagacgccc

SEQ ID NO: 260857 - RNA, 18 nt, Human
ugggggaggaagggcggg

SEQ ID NO: 260858 - RNA, 23 nt, Human
ugggggggggacggaaaugacuu

SEQ ID NO: 260859 - RNA, 19 nt, Human
ugggguggugggagggccu

SEQ ID NO: 260860 - RNA, 21 nt, Human
ugggguggugggagggccugg

SEQ ID NO: 260861 - RNA, 22 nt, Human
ugggguggugggagggccuggg

SEQ ID NO: 260862 - RNA, 25 nt, Human
ugggguggugggagggccugggggg

SEQ ID NO: 260863 - RNA, 21 nt, Human
ugggugcucucaccccugccu

SEQ ID NO: 260864 - RNA, 23 nt, Human
ugucauuuauacaaaaagacaaa

SEQ ID NO: 260865 - RNA, 25 nt, Human
ugugcaccugaguggagucucauca

SEQ ID NO: 260866 - RNA, 19 nt, Human
uguggacugugcaccccug

SEQ ID NO: 260867 - RNA, 22 nt, Human
uucaaaacugggggaugagggg

SEQ ID NO: 260868 - RNA, 24 nt, Human
uucugcauuugaaacauuuauuuc

SEQ ID NO: 260869 - RNA, 25 nt, Human
aaacaguccucaguuacagcucuca

SEQ ID NO: 260870 - RNA, 22 nt, Human
aaaugcgcgaccccacacccac

SEQ ID NO: 260871 - RNA, 22 nt, Human
agaaaaugcgcgaccccacacc

SEQ ID NO: 260872 - RNA, 21 nt, Human
auagcccaugggcacugacag

SEQ ID NO: 260873 - RNA, 22 nt, Human
gaaaaugcgcgaccccacaccc

SEQ ID NO: 260874 - RNA, 21 nt, Human
gaaaauguccucaaaguaaaa

SEQ ID NO: 260875 - RNA, 19 nt, Human
gaccccacacccacuaagc

SEQ ID NO: 260876 - RNA, 23 nt, Human
uugaagaaaaugcgcgaccccac

SEQ ID NO: 260877 - RNA, 24 nt, Human
aaagugcugggauuacaggcauga

SEQ ID NO: 260878 - RNA, 19 nt, Human
aagugcugggauuacaggc

SEQ ID NO: 260879 - RNA, 21 nt, Human
aagugcugggauuacaggcau

SEQ ID NO: 260880 - RNA, 26 nt, Human
aagugcugggauuacaggcaugagcc

SEQ ID NO: 260881 - RNA, 18 nt, Human
acaaauaaaaauaucaag

SEQ ID NO: 260882 - RNA, 22 nt, Human
accuuauuccuucugugcucua

SEQ ID NO: 260883 - RNA, 19 nt, Human
acuacaggugugcgccacc

SEQ ID NO: 260884 - RNA, 21 nt, Human
agacagaaacuugaaaaagac

SEQ ID NO: 260885 - RNA, 24 nt, Human
agagauucuccugccucagccucc

SEQ ID NO: 260886 - RNA, 24 nt, Human
aggaagacagaaacuugaaaaaga

SEQ ID NO: 260887 - RNA, 24 nt, Human
aggugaucugccuaccuuggccuc

SEQ ID NO: 260888 - RNA, 18 nt, Human
aguagcugggacuacagg

SEQ ID NO: 260889 - RNA, 20 nt, Human
agugcagugacgugaucucg

SEQ ID NO: 260890 - RNA, 24 nt, Human
agugcagugacgugaucucggcuc

SEQ ID NO: 260891 - RNA, 23 nt, Human
augggguuuugccauguuggcca

SEQ ID NO: 260892 - RNA, 24 nt, Human
augggguuuugccauguuggccag

SEQ ID NO: 260893 - RNA, 24 nt, Human
caaagugcugggauuacaggcaug

SEQ ID NO: 260894 - RNA, 22 nt, Human
caagagauucuccugccucagc

SEQ ID NO: 260895 - RNA, 22 nt, Human
caauuaucugaacugaaacaaa

SEQ ID NO: 260896 - RNA, 19 nt, Human
caccaugccuggccaauuc

SEQ ID NO: 260897 - RNA, 19 nt, Human
cacccuccaaaagcuuggg

SEQ ID NO: 260898 - RNA, 24 nt, Human
cauguuggccaggcuggucuugaa

SEQ ID NO: 260899 - RNA, 21 nt, Human
cauugcaaccuccgccuccca

SEQ ID NO: 260900 - RNA, 23 nt, Human
ccaaagugcugggauuacaggca

SEQ ID NO: 260901 - RNA, 24 nt, Human
ccaaagugcugggauuacaggcau

SEQ ID NO: 260902 - RNA, 19 nt, Human
ccauguuggccaggcuggu

SEQ ID NO: 260903 - RNA, 24 nt, Human
cccaaagugcugggauuacaggca

SEQ ID NO: 260904 - RNA, 22 nt, Human
cccaagcuggagugcagugacg

SEQ ID NO: 260905 - RNA, 21 nt, Human
cccagguucaagagauucucc

SEQ ID NO: 260906 - RNA, 24 nt, Human
ccggaguagcugggacuacaggug

SEQ ID NO: 260907 - RNA, 24 nt, Human
ccucccagguucaagagauucucc

SEQ ID NO: 260908 - RNA, 24 nt, Human
ccugaccucaggugaucugccuac

SEQ ID NO: 260909 - RNA, 24 nt, Human
cucagccuccggaguagcugggac

SEQ ID NO: 260910 - RNA, 24 nt, Human
cucaggugaucugccuaccuuggc

SEQ ID NO: 260911 - RNA, 19 nt, Human
cucauugcaaccuccgccu

SEQ ID NO: 260912 - RNA, 20 nt, Human
cucuguugcccaagcuggag

SEQ ID NO: 260913 - RNA, 23 nt, Human
cucuguugcccaagcuggagugc

SEQ ID NO: 260914 - RNA, 21 nt, Human
cugccagauucacccaguugc

SEQ ID NO: 260915 - RNA, 23 nt, Human
cugccucagccuccggaguagcu

SEQ ID NO: 260916 - RNA, 24 nt, Human
gaacugaaacaaauaaaaauauca

SEQ ID NO: 260917 - RNA, 24 nt, Human
gaccucaggugaucugccuaccuu

SEQ ID NO: 260918 - RNA, 23 nt, Human
gaccuuauuccuucugugcucua

SEQ ID NO: 260919 - RNA, 24 nt, Human
gacuacaggugugcgccaccaugc

SEQ ID NO: 260920 - RNA, 24 nt, Human
gaguagcugggacuacaggugugc

SEQ ID NO: 260921 - RNA, 20 nt, Human
gagugcagugacgugaucuc

SEQ ID NO: 260922 - RNA, 18 nt, Human
gauuacaggcaugagcca

SEQ ID NO: 260923 - RNA, 21 nt, Human
gauuacaggcaugagccacca

SEQ ID NO: 260924 - RNA, 24 nt, Human
gauuacaggcaugagccaccaugc

SEQ ID NO: 260925 - RNA, 20 nt, Human
gccauguuggccaggcuggu

SEQ ID NO: 260926 - RNA, 24 nt, Human
gccauguuggccaggcuggucuug

SEQ ID NO: 260927 - RNA, 20 nt, Human
gccucagccuccggaguagc

SEQ ID NO: 260928 - RNA, 23 nt, Human
gcuggucuugaacuccugaccuc

SEQ ID NO: 260929 - RNA, 24 nt, Human
ggacuacaggugugcgccaccaug

SEQ ID NO: 260930 - RNA, 24 nt, Human
ggauuacaggcaugagccaccaug

SEQ ID NO: 260931 - RNA, 24 nt, Human
ggcuggucuugaacuccugaccuc

SEQ ID NO: 260932 - RNA, 22 nt, Human
gggguuuugccauguuggccag

SEQ ID NO: 260933 - RNA, 22 nt, Human
ggguuuugccauguuggccagg

SEQ ID NO: 260934 - RNA, 19 nt, Human
ggucuugaacuccugaccu

SEQ ID NO: 260935 - RNA, 23 nt, Human
guaaagaugggguuuugccaugu

SEQ ID NO: 260936 - RNA, 21 nt, Human
gugugcgccaccaugcccagc

SEQ ID NO: 260937 - RNA, 22 nt, Human
uaaagaugggguuuugccaugu

SEQ ID NO: 260938 - RNA, 26 nt, Human
uaauuuuuucguauuuuuaguagaga

SEQ ID NO: 260939 - RNA, 22 nt, Human
uacaggcaugagccaccaugcc

SEQ ID NO: 260940 - RNA, 23 nt, Human
uacuguccauaaaauuuucuaau

SEQ ID NO: 260941 - RNA, 21 nt, Human
uaggaagacagaaacuugaaa

SEQ ID NO: 260942 - RNA, 24 nt, Human
uaguaaagaugggguuuugccaug

SEQ ID NO: 260943 - RNA, 21 nt, Human
uaguagagauguacuuuauau

SEQ ID NO: 260944 - RNA, 24 nt, Human
uaguagagauguacuuuauauuuu

SEQ ID NO: 260945 - RNA, 21 nt, Human
uauaucacccuccaaaagcuu

SEQ ID NO: 260946 - RNA, 22 nt, Human
uauucugccacuuaaggcuuua

SEQ ID NO: 260947 - RNA, 19 nt, Human
ucauugcaaccuccgccuc

SEQ ID NO: 260948 - RNA, 24 nt, Human
ucauugcaaccuccgccucccagg

SEQ ID NO: 260949 - RNA, 25 nt, Human
ucauugcaaccuccgccucccaggu

SEQ ID NO: 260950 - RNA, 24 nt, Human
ucccaaagugcugggauuacaggc

SEQ ID NO: 260951 - RNA, 21 nt, Human
ucccagguucaagagauucuc

SEQ ID NO: 260952 - RNA, 24 nt, Human
ucccagguucaagagauucuccug

SEQ ID NO: 260953 - RNA, 24 nt, Human
uccggaguagcugggacuacaggu

SEQ ID NO: 260954 - RNA, 24 nt, Human
ucuccugccucagccuccggagua

SEQ ID NO: 260955 - RNA, 24 nt, Human
ucuguugcccaagcuggagugcag

SEQ ID NO: 260956 - RNA, 23 nt, Human
ucuugaacuccugaccucaggug

SEQ ID NO: 260957 - RNA, 23 nt, Human
ucuugcucuguugcccaagcugg

SEQ ID NO: 260958 - RNA, 24 nt, Human
ucuugcucuguugcccaagcugga

SEQ ID NO: 260959 - RNA, 22 nt, Human
ucuuuucuuuuuucuuuuuuga

SEQ ID NO: 260960 - RNA, 24 nt, Human
ugaaaaagacugucuucagaaaaa

SEQ ID NO: 260961 - RNA, 24 nt, Human
ugaaacaaauaaaaauaucaagua

SEQ ID NO: 260962 - RNA, 18 nt, Human
ugaaugaaugacaaauaa

SEQ ID NO: 260963 - RNA, 18 nt, Human
ugaccucaggugaucugc

SEQ ID NO: 260964 - RNA, 19 nt, Human
ugaccucaggugaucugcc

SEQ ID NO: 260965 - RNA, 20 nt, Human
ugaccucaggugaucugccu

SEQ ID NO: 260966 - RNA, 22 nt, Human
ugagauggagucuugcucuguu

SEQ ID NO: 260967 - RNA, 24 nt, Human
ugaucugccuaccuuggccuccca

SEQ ID NO: 260968 - RNA, 24 nt, Human
ugccauguuggccaggcuggucuu

SEQ ID NO: 260969 - RNA, 27 nt, Human
ugccauguuggccaggcuggucuugaa

SEQ ID NO: 260970 - RNA, 23 nt, Human
ugcccaagcuggagugcagugac

SEQ ID NO: 260971 - RNA, 24 nt, Human
ugccucagccuccggaguagcugg

SEQ ID NO: 260972 - RNA, 22 nt, Human
uggagaguuauuuuguacaguu

SEQ ID NO: 260973 - RNA, 19 nt, Human
uggagugcagugacgugau

SEQ ID NO: 260974 - RNA, 24 nt, Human
uggagugcagugacgugaucucgg

SEQ ID NO: 260975 - RNA, 24 nt, Human
uggccaggcuggucuugaacuccu

SEQ ID NO: 260976 - RNA, 21 nt, Human
ugggacuacaggugugcgcca

SEQ ID NO: 260977 - RNA, 22 nt, Human
ugggacuacaggugugcgccac

SEQ ID NO: 260978 - RNA, 24 nt, Human
ugggacuacaggugugcgccacca

SEQ ID NO: 260979 - RNA, 25 nt, Human
ugggacuacaggugugcgccaccau

SEQ ID NO: 260980 - RNA, 18 nt, Human
ugggauuacaggcaugag

SEQ ID NO: 260981 - RNA, 22 nt, Human
ugggauuacaggcaugagccac

SEQ ID NO: 260982 - RNA, 23 nt, Human
ugggauuacaggcaugagccacc

SEQ ID NO: 260983 - RNA, 24 nt, Human
ugggauuacaggcaugagccacca

SEQ ID NO: 260984 - RNA, 25 nt, Human
ugggauuacaggcaugagccaccau

SEQ ID NO: 260985 - RNA, 24 nt, Human
ugggguuuugccauguuggccagg

SEQ ID NO: 260986 - RNA, 20 nt, Human
uguucuugguggauaaacug

SEQ ID NO: 260987 - RNA, 18 nt, Human
uuaguaaagaugggguuu

SEQ ID NO: 260988 - RNA, 22 nt, Human
uuaguaaagaugggguuuugcc

SEQ ID NO: 260989 - RNA, 24 nt, Human
uuaguaaagaugggguuuugccau

SEQ ID NO: 260990 - RNA, 23 nt, Human
uucaagagauucuccugccucag

SEQ ID NO: 260991 - RNA, 23 nt, Human
uugcaaccuccgccucccagguu

SEQ ID NO: 260992 - RNA, 24 nt, Human
uugcaaccuccgccucccagguuc

SEQ ID NO: 260993 - RNA, 24 nt, Human
uugccauguuggccaggcuggucu

SEQ ID NO: 260994 - RNA, 18 nt, Human
uugcccaagcuggagugc

SEQ ID NO: 260995 - RNA, 18 nt, Human
uuggccucccaaagugcu

SEQ ID NO: 260996 - RNA, 21 nt, Human
uuuucguauuuuuaguagaga

SEQ ID NO: 260997 - RNA, 23 nt, Human
uuuugccauguuggccaggcugg

SEQ ID NO: 260998 - RNA, 21 nt, Human
uuuuuaguaaagaugggguuu

SEQ ID NO: 260999 - RNA, 21 nt, Human
uuuuuaguaaagaugggguuu

SEQ ID NO: 261000 - RNA, 21 nt, Human
uuuuucguauuuuuaguagag

SEQ ID NO: 261001 - RNA, 24 nt, Human
uuuuucguauuuuuaguagagaug

SEQ ID NO: 261002 - RNA, 24 nt, Human
uuuuucuuuuuugagauggagucu

SEQ ID NO: 261003 - RNA, 24 nt, Human
uuuuugagauggagucuugcucug

SEQ ID NO: 261004 - RNA, 20 nt, Human
uuuuuuuuuuauagcaagua

SEQ ID NO: 261005 - RNA, 19 nt, Human
cccaaaccuucccugaccc

SEQ ID NO: 261006 - RNA, 23 nt, Human
cccaaaccuucccugacccgaga

SEQ ID NO: 261007 - RNA, 21 nt, Human
gcgaccccuccaguagcccaa

SEQ ID NO: 261008 - RNA, 18 nt, Human
uagcccaacuacagaagc

SEQ ID NO: 261009 - RNA, 20 nt, Human
ucuaaggagaaaaauaaauu

SEQ ID NO: 261010 - RNA, 19 nt, Human
ugacccgagaaguaugagg

SEQ ID NO: 261011 - RNA, 23 nt, Human
ugagcgaccccuccaguagccca

SEQ ID NO: 261012 - RNA, 27 nt, Human
uuauuuuccuuaucucuaaccuucagg

SEQ ID NO: 261013 - RNA, 19 nt, Human
uuguauuuucuccuaacau

SEQ ID NO: 261014 - RNA, 18 nt, Human
accgacagccggcaaggc

SEQ ID NO: 261015 - RNA, 21 nt, Human
acggagcuccuaaaagcaccg

SEQ ID NO: 261016 - RNA, 19 nt, Human
gacagccggcaaggcccaa

SEQ ID NO: 261017 - RNA, 23 nt, Human
gaucauaauguugucugaauuua

SEQ ID NO: 261018 - RNA, 19 nt, Human
uaaaagcaccgcaucuacc

SEQ ID NO: 261019 - RNA, 20 nt, Human
uaauguugucugaauuuacc

SEQ ID NO: 261020 - RNA, 24 nt, Human
aaaaaaaaaaaaaaaaaaaaggga

SEQ ID NO: 261021 - RNA, 25 nt, Human
aaaaaaaaaaaaaaaaaagggaaag

SEQ ID NO: 261022 - RNA, 21 nt, Human
aaaaaaaaaaagggaaagggu

SEQ ID NO: 261023 - RNA, 23 nt, Human
aaaaaagguuucuuuaaacaaaa

SEQ ID NO: 261024 - RNA, 20 nt, Human
aaaagccuuuuggggagggg

SEQ ID NO: 261025 - RNA, 20 nt, Human
aaagggaaaggguaaaggag

SEQ ID NO: 261026 - RNA, 20 nt, Human
aagcagggccgggagagggg

SEQ ID NO: 261027 - RNA, 23 nt, Human
acaaaaaaaaaaaaaaaaaaaaa

SEQ ID NO: 261028 - RNA, 23 nt, Human
acacuuuguucucagcugguggg

SEQ ID NO: 261029 - RNA, 21 nt, Human
agaaacaggggaggggggagc

SEQ ID NO: 261030 - RNA, 24 nt, Human
agaaacaggggaggggggagcccc

SEQ ID NO: 261031 - RNA, 25 nt, Human
agcggagcggcggcggcggcggcgg

SEQ ID NO: 261032 - RNA, 18 nt, Human
agcggcggcggcggcggc

SEQ ID NO: 261033 - RNA, 23 nt, Human
agcggcggcggcggcggcggcgg

SEQ ID NO: 261034 - RNA, 19 nt, Human
aggcucccuccgccuucac

SEQ ID NO: 261035 - RNA, 25 nt, Human
agggauggaccagagggcuggggug

SEQ ID NO: 261036 - RNA, 22 nt, Human
aggggacagaaacaggggaggg

SEQ ID NO: 261037 - RNA, 18 nt, Human
aggggagggggcggcggc

SEQ ID NO: 261038 - RNA, 21 nt, Human
aggggcggguggggauggggg

SEQ ID NO: 261039 - RNA, 18 nt, Human
aggggugggcacaucacc

SEQ ID NO: 261040 - RNA, 22 nt, Human
caaaauaaauaaaagcagggcc

SEQ ID NO: 261041 - RNA, 24 nt, Human
cagcuaugcacaaauccaaaagcc

SEQ ID NO: 261042 - RNA, 21 nt, Human
cagggccgggagaggggcggg

SEQ ID NO: 261043 - RNA, 22 nt, Human
caggggagggggcggcggcugc

SEQ ID NO: 261044 - RNA, 22 nt, Human
cccagauagacacuuuguucuc

SEQ ID NO: 261045 - RNA, 23 nt, Human
ccccgaggggucuuagagagggg

SEQ ID NO: 261046 - RNA, 22 nt, Human
ccccugcggccuggggcuucac

SEQ ID NO: 261047 - RNA, 21 nt, Human
ccccuugcccccugcggccug

SEQ ID NO: 261048 - RNA, 19 nt, Human
ccuggccccuugcccccug

SEQ ID NO: 261049 - RNA, 21 nt, Human
ccuugcccccugcggccuggg

SEQ ID NO: 261050 - RNA, 21 nt, Human
ccuuuuggggagggggcgguc

SEQ ID NO: 261051 - RNA, 23 nt, Human
cgcgggcggcgcgggcagcggag

SEQ ID NO: 261052 - RNA, 21 nt, Human
cggcacggagggagggaugga

SEQ ID NO: 261053 - RNA, 22 nt, Human
cggccuggggcuucacauucac

SEQ ID NO: 261054 - RNA, 19 nt, Human
cggcggcggcggcggcgcu

SEQ ID NO: 261055 - RNA, 22 nt, Human
cuaauccaaaauaaauaaaagc

SEQ ID NO: 261056 - RNA, 21 nt, Human
cuccccgcagcccugcccucc

SEQ ID NO: 261057 - RNA, 22 nt, Human
cucggccuggccuccccgcagc

SEQ ID NO: 261058 - RNA, 21 nt, Human
cugcaggcuggggcgcuccug

SEQ ID NO: 261059 - RNA, 21 nt, Human
gagaggggugggcacaucacc

SEQ ID NO: 261060 - RNA, 23 nt, Human
gagggaggcggccaggggcccac

SEQ ID NO: 261061 - RNA, 23 nt, Human
gaggucucccgcccccucgcugg

SEQ ID NO: 261062 - RNA, 18 nt, Human
gcacaaauccaaaagccu

SEQ ID NO: 261063 - RNA, 24 nt, Human
gcacaaauccaaaagccuuuuggg

SEQ ID NO: 261064 - RNA, 19 nt, Human
gcagggccgggagaggggc

SEQ ID NO: 261065 - RNA, 19 nt, Human
gcccccucgcuggcucacu

SEQ ID NO: 261066 - RNA, 19 nt, Human
gcggcgcgggcagcggagc

SEQ ID NO: 261067 - RNA, 21 nt, Human
gcggcggcggcggcgcucggc

SEQ ID NO: 261068 - RNA, 20 nt, Human
gcggcggcggcggcggcggc

SEQ ID NO: 261069 - RNA, 20 nt, Human
gcggcggcggcggcggcggc

SEQ ID NO: 261070 - RNA, 20 nt, Human
gcggcggcggcggcggcggc

SEQ ID NO: 261071 - RNA, 24 nt, Human
gcggcggcggcggcggcggcgcuc

SEQ ID NO: 261072 - RNA, 23 nt, Human
gcggcggcggcggcggcggcggc

SEQ ID NO: 261073 - RNA, 24 nt, Human
gcggcggcggcggcggcggcggcg

SEQ ID NO: 261074 - RNA, 20 nt, Human
gcucccuccgccuucacucc

SEQ ID NO: 261075 - RNA, 20 nt, Human
gcuggggugggcaaccggcu

SEQ ID NO: 261076 - RNA, 22 nt, Human
ggaaaggguaaaggaggggaaa

SEQ ID NO: 261077 - RNA, 19 nt, Human
ggacagaaacaggggaggg

SEQ ID NO: 261078 - RNA, 19 nt, Human
ggacagaaacaggggaggg

SEQ ID NO: 261079 - RNA, 23 nt, Human
ggacagaaacaggggagggggga

SEQ ID NO: 261080 - RNA, 20 nt, Human
ggaccagagggcuggggugg

SEQ ID NO: 261081 - RNA, 21 nt, Human
ggagggagggauggaccagag

SEQ ID NO: 261082 - RNA, 23 nt, Human
ggagggauggaccagagggcugg

SEQ ID NO: 261083 - RNA, 18 nt, Human
ggcaggcaguagcggguc

SEQ ID NO: 261084 - RNA, 20 nt, Human
ggcaggggccgggcccgggg

SEQ ID NO: 261085 - RNA, 19 nt, Human
ggccgggagaggggcgggu

SEQ ID NO: 261086 - RNA, 21 nt, Human
ggccuggccuccccgcagccc

SEQ ID NO: 261087 - RNA, 20 nt, Human
ggcggcgcgggcagcggagc

SEQ ID NO: 261088 - RNA, 23 nt, Human
ggcggcggcggcggcggcggcgg

SEQ ID NO: 261089 - RNA, 19 nt, Human
ggcggguggggaugggggc

SEQ ID NO: 261090 - RNA, 19 nt, Human
gggagggggcgguccuagg

SEQ ID NO: 261091 - RNA, 19 nt, Human
gggaguugggggcaggcag

SEQ ID NO: 261092 - RNA, 18 nt, Human
gggcaccuggccccuugc

SEQ ID NO: 261093 - RNA, 23 nt, Human
gggcagcagggcaggggccgggc

SEQ ID NO: 261094 - RNA, 30 nt, Human
gggcagcggagcggcggcggcggcggcgac

SEQ ID NO: 261095 - RNA, 22 nt, Human
gggcaggggccgggcccgggga

SEQ ID NO: 261096 - RNA, 20 nt, Human
gggccgggagaggggcgggu

SEQ ID NO: 261097 - RNA, 23 nt, Human
gggccgggagaggggcggguggg

SEQ ID NO: 261098 - RNA, 19 nt, Human
gggcgcggcacggagggag

SEQ ID NO: 261099 - RNA, 24 nt, Human
gggcgcggcacggagggagggaug

SEQ ID NO: 261100 - RNA, 18 nt, Human
gggcggcgcgggcagcgg

SEQ ID NO: 261101 - RNA, 20 nt, Human
gggcggcgcgggcagcggag

SEQ ID NO: 261102 - RNA, 22 nt, Human
gggcgguccuaggggggcgcgg

SEQ ID NO: 261103 - RNA, 20 nt, Human
gggcuggggugggcaaccgg

SEQ ID NO: 261104 - RNA, 20 nt, Human
ggggagggggcgguccuagg

SEQ ID NO: 261105 - RNA, 21 nt, Human
uaaacaaaaaaaaaaaaaaaa

SEQ ID NO: 261106 - RNA, 21 nt, Human
uaugcacaaauccaaaagccu

SEQ ID NO: 261107 - RNA, 21 nt, Human
ucacaguauuuacauaugaua

SEQ ID NO: 261108 - RNA, 23 nt, Human
uccaaaauaaauaaaagcagggc

SEQ ID NO: 261109 - RNA, 18 nt, Human
uccagggcuggagggagg

SEQ ID NO: 261110 - RNA, 20 nt, Human
uccaggggcucggccuggcc

SEQ ID NO: 261111 - RNA, 22 nt, Human
uccgccuucacuccagcuaugc

SEQ ID NO: 261112 - RNA, 23 nt, Human
ucucccgcccccucgcuggcuca

SEQ ID NO: 261113 - RNA, 24 nt, Human
ucuuuaaacaaaaaaaaaaaaaaa

SEQ ID NO: 261114 - RNA, 26 nt, Human
ugaggggacagaaacaggggaggggg

SEQ ID NO: 261115 - RNA, 22 nt, Human
uggccuccccgcagcccugccc

SEQ ID NO: 261116 - RNA, 22 nt, Human
uggggagggggcgguccuaggg

SEQ ID NO: 261117 - RNA, 18 nt, Human
aaaaaagaaaggcugagg

SEQ ID NO: 261118 - RNA, 18 nt, Human
aaaauuuucccagcugac

SEQ ID NO: 261119 - RNA, 19 nt, Human
aaacaaaaagcuaaacaac

SEQ ID NO: 261120 - RNA, 27 nt, Human
aaacaaaaagcuaaacaacccauuagc

SEQ ID NO: 261121 - RNA, 18 nt, Human
aaacaacagagccccaag

SEQ ID NO: 261122 - RNA, 22 nt, Human
aaacauuccagcucaaaaucaa

SEQ ID NO: 261123 - RNA, 26 nt, Human
aaaggcugaggaaacagcccaguccu

SEQ ID NO: 261124 - RNA, 23 nt, Human
aaauaaagagacaaugugguucu

SEQ ID NO: 261125 - RNA, 20 nt, Human
aacaaaaagcuaaacaaccc

SEQ ID NO: 261126 - RNA, 19 nt, Human
aagauacaccuacuggggc

SEQ ID NO: 261127 - RNA, 18 nt, Human
aagcaaaugcauagcugc

SEQ ID NO: 261128 - RNA, 22 nt, Human
aagcaaaugcauagcugcaaau

SEQ ID NO: 261129 - RNA, 26 nt, Human
aagcuguuuuaaaaaagcaccugauu

SEQ ID NO: 261130 - RNA, 19 nt, Human
aaguagcugggacuauagg

SEQ ID NO: 261131 - RNA, 20 nt, Human
aaguagcugggacuauaggu

SEQ ID NO: 261132 - RNA, 24 nt, Human
aauaacaucaacaaucugaaacga

SEQ ID NO: 261133 - RNA, 19 nt, Human
acaaucaacaagucagacc

SEQ ID NO: 261134 - RNA, 26 nt, Human
acacauuuuuggcagucaagggugga

SEQ ID NO: 261135 - RNA, 22 nt, Human
acagagacagaguacaaagaaa

SEQ ID NO: 261136 - RNA, 18 nt, Human
acagcugcagccucccaa

SEQ ID NO: 261137 - RNA, 19 nt, Human
accugauucauggcaccug

SEQ ID NO: 261138 - RNA, 22 nt, Human
accuggaacuaugccaccaaca

SEQ ID NO: 261139 - RNA, 21 nt, Human
acuaaaccuuuuuggacagag

SEQ ID NO: 261140 - RNA, 25 nt, Human
acuauauugcccaggcugaucuuga

SEQ ID NO: 261141 - RNA, 22 nt, Human
acuucagucuuuucuucaauau

SEQ ID NO: 261142 - RNA, 19 nt, Human
agaaagcaggcagcaugac

SEQ ID NO: 261143 - RNA, 20 nt, Human
agaaagcaggcagcaugaca

SEQ ID NO: 261144 - RNA, 26 nt, Human
agacaaauagauuagugguugucagg

SEQ ID NO: 261145 - RNA, 21 nt, Human
agacagaguacaaagaaaaca

SEQ ID NO: 261146 - RNA, 23 nt, Human
agacagaguccacaccaggcaac

SEQ ID NO: 261147 - RNA, 23 nt, Human
agcugcagccucccaaguagcug

SEQ ID NO: 261148 - RNA, 20 nt, Human
aggcaaccugcagcgcuucu

SEQ ID NO: 261149 - RNA, 24 nt, Human
agguauguggauuauaucucaauc

SEQ ID NO: 261150 - RNA, 23 nt, Human
agucucacaggcaugaaccacug

SEQ ID NO: 261151 - RNA, 21 nt, Human
aucaagcuguuuuaaaaaagc

SEQ ID NO: 261152 - RNA, 23 nt, Human
aucacacgcacuguacacacaca

SEQ ID NO: 261153 - RNA, 19 nt, Human
aucucaaucaagcuguuuu

SEQ ID NO: 261154 - RNA, 18 nt, Human
augggguuucacuauauu

SEQ ID NO: 261155 - RNA, 24 nt, Human
augggguuucacuauauugcccag

SEQ ID NO: 261156 - RNA, 20 nt, Human
caacaagucagaccuuucuc

SEQ ID NO: 261157 - RNA, 23 nt, Human
caacucaaacaacagagccccaa

SEQ ID NO: 261158 - RNA, 21 nt, Human
caagauacaccuacuggggca

SEQ ID NO: 261159 - RNA, 19 nt, Human
cacaaggaaaugggcaccu

SEQ ID NO: 261160 - RNA, 19 nt, Human
cacaucaucacaccuggcu

SEQ ID NO: 261161 - RNA, 23 nt, Human
caccaggcaaccugcagcgcuuc

SEQ ID NO: 261162 - RNA, 21 nt, Human
caccugaacacagaauggcac

SEQ ID NO: 261163 - RNA, 20 nt, Human
caccuuguuaguuauucacc

SEQ ID NO: 261164 - RNA, 27 nt, Human
cacuauauugcccaggcugaucuugaa

SEQ ID NO: 261165 - RNA, 20 nt, Human
cacucgcgccuugguggggu

SEQ ID NO: 261166 - RNA, 19 nt, Human
cacugcagucuuagacucu

SEQ ID NO: 261167 - RNA, 18 nt, Human
cagagcacccuguauuug

SEQ ID NO: 261168 - RNA, 21 nt, Human
cagagccccaaggugggcauu

SEQ ID NO: 261169 - RNA, 20 nt, Human
cagcaugacagcacuuugga

SEQ ID NO: 261170 - RNA, 23 nt, Human
cagccacagccacagcugcagcc

SEQ ID NO: 261171 - RNA, 24 nt, Human
cagccugcgagcagcugagcucug

SEQ ID NO: 261172 - RNA, 21 nt, Human
caggcucgaagcacagcacuu

SEQ ID NO: 261173 - RNA, 23 nt, Human
caguugcucuuacagaaccaaca

SEQ ID NO: 261174 - RNA, 24 nt, Human
caucaacaaucugaaacgaagaaa

SEQ ID NO: 261175 - RNA, 25 nt, Human
cauuacacaacaaaguauagcugua

SEQ ID NO: 261176 - RNA, 18 nt, Human
cauuuuacagaaagggaa

SEQ ID NO: 261177 - RNA, 19 nt, Human
cauuuuacagaaagggaac

SEQ ID NO: 261178 - RNA, 20 nt, Human
cauuuugaaugcuucauuag

SEQ ID NO: 261179 - RNA, 23 nt, Human
ccacagcugcagccucccaagua

SEQ ID NO: 261180 - RNA, 19 nt, Human
cccaaguagcugggacuau

SEQ ID NO: 261181 - RNA, 22 nt, Human
cccaaguagcugggacuauagg

SEQ ID NO: 261182 - RNA, 22 nt, Human
ccucaagcgauccgccagcuuu

SEQ ID NO: 261183 - RNA, 23 nt, Human
ccuccugccccagucucacaggc

SEQ ID NO: 261184 - RNA, 18 nt, Human
ccucuaaaauacuuugag

SEQ ID NO: 261185 - RNA, 18 nt, Human
ccuggaacccagagcgcc

SEQ ID NO: 261186 - RNA, 21 nt, Human
ccuggaacccagagcgccaaa

SEQ ID NO: 261187 - RNA, 18 nt, Human
ccuggccucaagugaucc

SEQ ID NO: 261188 - RNA, 21 nt, Human
ccuggccucaagugauccucc

SEQ ID NO: 261189 - RNA, 22 nt, Human
ccuggccucaagugauccuccu

SEQ ID NO: 261190 - RNA, 23 nt, Human
ccuggccucaagugauccuccug

SEQ ID NO: 261191 - RNA, 18 nt, Human
cgcggugggggagggcgg

SEQ ID NO: 261192 - RNA, 26 nt, Human
cucaagugauccuccugccccagucu

SEQ ID NO: 261193 - RNA, 23 nt, Human
cucacugcagucuuagacucugg

SEQ ID NO: 261194 - RNA, 20 nt, Human
cugccuccccugcugcugac

SEQ ID NO: 261195 - RNA, 19 nt, Human
cugcgcugcaaucugcgcc

SEQ ID NO: 261196 - RNA, 20 nt, Human
cugcugccaucaacuuucca

SEQ ID NO: 261197 - RNA, 21 nt, Human
cugcugcccaucuaucccagc

SEQ ID NO: 261198 - RNA, 23 nt, Human
cugcugcccaucuaucccagcuu

SEQ ID NO: 261199 - RNA, 18 nt, Human
cuguuuccaccuccacac

SEQ ID NO: 261200 - RNA, 20 nt, Human
cuuccaucucuggaguuggg

SEQ ID NO: 261201 - RNA, 24 nt, Human
cuuuaagagaugggguuucacuau

SEQ ID NO: 261202 - RNA, 18 nt, Human
gacaggauguacacaagg

SEQ ID NO: 261203 - RNA, 22 nt, Human
gagaugggguuucacuauauug

SEQ ID NO: 261204 - RNA, 20 nt, Human
gaggaaacagcccaguccug

SEQ ID NO: 261205 - RNA, 18 nt, Human
gaguauucuuacuuugau

SEQ ID NO: 261206 - RNA, 23 nt, Human
gcaaugcuuucuuuagaucacca

SEQ ID NO: 261207 - RNA, 24 nt, Human
gcaaugcuuucuuuagaucaccaa

SEQ ID NO: 261208 - RNA, 20 nt, Human
gccagguguuucaacuuucu

SEQ ID NO: 261209 - RNA, 19 nt, Human
gcgaggcuccggggcgggc

SEQ ID NO: 261210 - RNA, 23 nt, Human
gcgggcgggggcggggaggcggu

SEQ ID NO: 261211 - RNA, 18 nt, Human
gcuacacaauacauagaa

SEQ ID NO: 261212 - RNA, 22 nt, Human
gcucuguuuccaccuccacaca

SEQ ID NO: 261213 - RNA, 23 nt, Human
gcugaucuugaacuccuggccuc

SEQ ID NO: 261214 - RNA, 19 nt, Human
gcuuccaucucuggaguug

SEQ ID NO: 261215 - RNA, 29 nt, Human
ggaagaacagggcacaggucauacacaag

SEQ ID NO: 261216 - RNA, 24 nt, Human
ggacaggcaugcaagcugccuccc

SEQ ID NO: 261217 - RNA, 19 nt, Human
ggcaaaaaagaaaggcuga

SEQ ID NO: 261218 - RNA, 22 nt, Human
ggccucaagugauccuccugcc

SEQ ID NO: 261219 - RNA, 21 nt, Human
ggcgggggcggggaggcggug

SEQ ID NO: 261220 - RNA, 24 nt, Human
ggcugaucuugaacuccuggccuc

SEQ ID NO: 261221 - RNA, 20 nt, Human
gggcacaggucauacacaag

SEQ ID NO: 261222 - RNA, 18 nt, Human
gggcgaggcuccggggcg

SEQ ID NO: 261223 - RNA, 26 nt, Human
gggcgggcgggggcggggaggcggug

SEQ ID NO: 261224 - RNA, 21 nt, Human
gggcgggggcggggaggcggu

SEQ ID NO: 261225 - RNA, 22 nt, Human
gggcuaagaggaggugagaaga

SEQ ID NO: 261226 - RNA, 20 nt, Human
guuucuuuuuuggaguggug

SEQ ID NO: 261227 - RNA, 23 nt, Human
uaagaaaggcaaugcuuucuuua

SEQ ID NO: 261228 - RNA, 22 nt, Human
uacaaagaaaacaaaaagcuaa

SEQ ID NO: 261229 - RNA, 20 nt, Human
uacagaaagggaaccauaac

SEQ ID NO: 261230 - RNA, 23 nt, Human
uacagcaaaucaaccugugugua

SEQ ID NO: 261231 - RNA, 24 nt, Human
uacagcaaaucaaccuguguguau

SEQ ID NO: 261232 - RNA, 23 nt, Human
uacagcacucgcgccuugguggg

SEQ ID NO: 261233 - RNA, 18 nt, Human
uacagcuccagaaagcag

SEQ ID NO: 261234 - RNA, 18 nt, Human
uagaaggaccccugaagg

SEQ ID NO: 261235 - RNA, 20 nt, Human
uagaaguuagaucaggaaaa

SEQ ID NO: 261236 - RNA, 24 nt, Human
uagaauggagagacuacagagaca

SEQ ID NO: 261237 - RNA, 20 nt, Human
uagaucaccaaaaauaacau

SEQ ID NO: 261238 - RNA, 23 nt, Human
uauauugcccaggcugaucuuga

SEQ ID NO: 261239 - RNA, 24 nt, Human
uauauugcccaggcugaucuugaa

SEQ ID NO: 261240 - RNA, 19 nt, Human
ucaauaucgauucccucua

SEQ ID NO: 261241 - RNA, 20 nt, Human
ucaauuugcucacaaguggu

SEQ ID NO: 261242 - RNA, 31 nt, Human
ucacacgcacuguacacacacacauguagug

SEQ ID NO: 261243 - RNA, 23 nt, Human
ucacugcagucuuagacucuggg

SEQ ID NO: 261244 - RNA, 19 nt, Human
ucagaggaacugcuuaaug

SEQ ID NO: 261245 - RNA, 23 nt, Human
ucaggcgagcuacagcuuuucuu

SEQ ID NO: 261246 - RNA, 28 nt, Human
ucauccuuguuuucacuacagucagagg

SEQ ID NO: 261247 - RNA, 21 nt, Human
uccacacagugugccggggga

SEQ ID NO: 261248 - RNA, 24 nt, Human
ucccaaguagcugggacuauaggu

SEQ ID NO: 261249 - RNA, 18 nt, Human
ucugggaucuuucugccu

SEQ ID NO: 261250 - RNA, 21 nt, Human
ucuugaacuccuggccucaag

SEQ ID NO: 261251 - RNA, 22 nt, Human
ucuuuaagagaugggguuucac

SEQ ID NO: 261252 - RNA, 25 nt, Human
ugacacaaucaacaagucagaccuu

SEQ ID NO: 261253 - RNA, 23 nt, Human
ugacuuccuaacucacugagccc

SEQ ID NO: 261254 - RNA, 19 nt, Human
ugaggaaacagcccagucc

SEQ ID NO: 261255 - RNA, 22 nt, Human
ugaggaaacagcccaguccugc

SEQ ID NO: 261256 - RNA, 19 nt, Human
ugccaccaacacugagcug

SEQ ID NO: 261257 - RNA, 24 nt, Human
ugcccaggcugaucuugaacuccu

SEQ ID NO: 261258 - RNA, 24 nt, Human
ugccgggggacaggcaugcaagcu

SEQ ID NO: 261259 - RNA, 21 nt, Human
ugcucacaagugguagaguga

SEQ ID NO: 261260 - RNA, 23 nt, Human
uggacaugggaaucacacgcacu

SEQ ID NO: 261261 - RNA, 19 nt, Human
uggcagaacauacagaaaa

SEQ ID NO: 261262 - RNA, 22 nt, Human
uggcagucaaggguggaaggau

SEQ ID NO: 261263 - RNA, 23 nt, Human
uggcccaaugagagcucacugca

SEQ ID NO: 261264 - RNA, 18 nt, Human
uggccucaagugauccuc

SEQ ID NO: 261265 - RNA, 20 nt, Human
uggccucaagugauccuccu

SEQ ID NO: 261266 - RNA, 23 nt, Human
uggccucaagugauccuccugcc

SEQ ID NO: 261267 - RNA, 22 nt, Human
ugggacuauaggugcacaucau

SEQ ID NO: 261268 - RNA, 24 nt, Human
ugggacuauaggugcacaucauca

SEQ ID NO: 261269 - RNA, 20 nt, Human
ugggaucuuucugccuuuuu

SEQ ID NO: 261270 - RNA, 18 nt, Human
ugggaugacuuuugggag

SEQ ID NO: 261271 - RNA, 21 nt, Human
ugggcaacucaaacaacagag

SEQ ID NO: 261272 - RNA, 24 nt, Human
ugggguuucacuauauugcccagg

SEQ ID NO: 261273 - RNA, 18 nt, Human
uguacacacacacaugua

SEQ ID NO: 261274 - RNA, 19 nt, Human
ugucuuagauuucacagcc

SEQ ID NO: 261275 - RNA, 24 nt, Human
ugugucgcccaggcucgacugcag

SEQ ID NO: 261276 - RNA, 30 nt, Human
uuaaaaacagucuuuuuaaaaauuuucccu

SEQ ID NO: 261277 - RNA, 21 nt, Human
uuauucaaagggcuucucuua

SEQ ID NO: 261278 - RNA, 21 nt, Human
uucaacuuucuacagcuccag

SEQ ID NO: 261279 - RNA, 19 nt, Human
uucacagagagggaaccgu

SEQ ID NO: 261280 - RNA, 24 nt, Human
uuccauuucacacauuuuuggcag

SEQ ID NO: 261281 - RNA, 19 nt, Human
uucccacaaauggcagaac

SEQ ID NO: 261282 - RNA, 19 nt, Human
uuccuugccaucacagaug

SEQ ID NO: 261283 - RNA, 19 nt, Human
uugaagcucugguucuucu

SEQ ID NO: 261284 - RNA, 20 nt, Human
uugauauuuaugaggggugu

SEQ ID NO: 261285 - RNA, 24 nt, Human
uugcgcuguggguaaagacccacc

SEQ ID NO: 261286 - RNA, 30 nt, Human
uuuaaaaauuuucccagcugacccuuuucu

SEQ ID NO: 261287 - RNA, 18 nt, Human
uuucacagagagggaacc

SEQ ID NO: 261288 - RNA, 30 nt, Human
uuucccaacaauaacaucaacaaucugagg

SEQ ID NO: 261289 - RNA, 19 nt, Human
uuucccagcugacccuuuu

SEQ ID NO: 261290 - RNA, 23 nt, Human
uuuuuuuuuuuuuuuuuuaacag

SEQ ID NO: 261291 - RNA, 20 nt, Human
agggagggaggcaccguggg

SEQ ID NO: 261292 - RNA, 20 nt, Human
agggagggaggcaccguggg

SEQ ID NO: 261293 - RNA, 23 nt, Human
agggcuggggccagcaagggagu

SEQ ID NO: 261294 - RNA, 22 nt, Human
cccgugccugcuccuggccagg

SEQ ID NO: 261295 - RNA, 22 nt, Human
cgcgucacagcagacgggagug

SEQ ID NO: 261296 - RNA, 22 nt, Human
cgcgucacagcagacgggagug

SEQ ID NO: 261297 - RNA, 21 nt, Human
gcagacgggaguggccggcca

SEQ ID NO: 261298 - RNA, 24 nt, Human
gugccugcuccuggccaggcggga

SEQ ID NO: 261299 - RNA, 19 nt, Human
uccccagcagggcuggggc

SEQ ID NO: 261300 - RNA, 22 nt, Human
ucucuugggguggaacggggau

SEQ ID NO: 261301 - RNA, 24 nt, Human
ucuugggguggaacggggaucacc

SEQ ID NO: 261302 - RNA, 26 nt, Human
ugccugcuccuggccaggcggggauc

SEQ ID NO: 261303 - RNA, 21 nt, Human
aaaaggacacacauauucaag

SEQ ID NO: 261304 - RNA, 21 nt, Human
aaaaggacacacauauucaag

SEQ ID NO: 261305 - RNA, 21 nt, Human
aggccuggccugggagcccug

SEQ ID NO: 261306 - RNA, 21 nt, Human
aggccuggccugggagcccug

SEQ ID NO: 261307 - RNA, 20 nt, Human
caaugcauacauaaauuaua

SEQ ID NO: 261308 - RNA, 20 nt, Human
caaugcauacauaaauuaua

SEQ ID NO: 261309 - RNA, 19 nt, Human
cauauucaaguguuugcuc

SEQ ID NO: 261310 - RNA, 19 nt, Human
cauauucaaguguuugcuc

SEQ ID NO: 261311 - RNA, 23 nt, Human
gccugggagcccugugccuacua

SEQ ID NO: 261312 - RNA, 23 nt, Human
gccugggagcccugugccuacua

SEQ ID NO: 261313 - RNA, 19 nt, Human
ugccuacuagaagcacauu

SEQ ID NO: 261314 - RNA, 20 nt, Human
uguuuuguauucuuuauaau

SEQ ID NO: 261315 - RNA, 20 nt, Human
uguuuuguauucuuuauaau

SEQ ID NO: 261316 - RNA, 25 nt, Human
aaaaacccaaaaaguacacaaaaaa

SEQ ID NO: 261317 - RNA, 31 nt, Human
aaagaagaagagcacacaugagacagagaag

SEQ ID NO: 261318 - RNA, 22 nt, Human
aacacuccaaccguguaaaucu

SEQ ID NO: 261319 - RNA, 20 nt, Human
aacagagaagagaaaggagg

SEQ ID NO: 261320 - RNA, 18 nt, Human
aacccuggggagaagaca

SEQ ID NO: 261321 - RNA, 22 nt, Human
aaccuuuucccccagccucccu

SEQ ID NO: 261322 - RNA, 24 nt, Human
aagggaggaggggucccuagaggc

SEQ ID NO: 261323 - RNA, 22 nt, Human
aaguagcucugagaggggaaga

SEQ ID NO: 261324 - RNA, 18 nt, Human
aaucaaguggaaaguacc

SEQ ID NO: 261325 - RNA, 19 nt, Human
acaaaaaaccccugaauac

SEQ ID NO: 261326 - RNA, 20 nt, Human
acaauagaauggccaaugcc

SEQ ID NO: 261327 - RNA, 22 nt, Human
acagugguaggggagaggaggg

SEQ ID NO: 261328 - RNA, 21 nt, Human
acucuaaacgggaugggaggg

SEQ ID NO: 261329 - RNA, 19 nt, Human
agacagugguaggggagag

SEQ ID NO: 261330 - RNA, 24 nt, Human
agaccuaaaaccccuagcagggaa

SEQ ID NO: 261331 - RNA, 21 nt, Human
agagaccuaaaaccccuagca

SEQ ID NO: 261332 - RNA, 21 nt, Human
agagcaaggggugggggugug

SEQ ID NO: 261333 - RNA, 19 nt, Human
agaguccugauggggcugg

SEQ ID NO: 261334 - RNA, 22 nt, Human
agaugccaaggcugggauggcu

SEQ ID NO: 261335 - RNA, 20 nt, Human
agcaaggaaggcagaaauca

SEQ ID NO: 261336 - RNA, 22 nt, Human
agcacaguaugaguuaggugag

SEQ ID NO: 261337 - RNA, 18 nt, Human
aggaaaaagggaggaggg

SEQ ID NO: 261338 - RNA, 18 nt, Human
agggaagugggugggggc

SEQ ID NO: 261339 - RNA, 20 nt, Human
agggaagugggugggggcua

SEQ ID NO: 261340 - RNA, 18 nt, Human
agggaggaggggucccua

SEQ ID NO: 261341 - RNA, 20 nt, Human
agggaggaggggucccuaga

SEQ ID NO: 261342 - RNA, 23 nt, Human
agggaggaggggucccuagaggc

SEQ ID NO: 261343 - RNA, 19 nt, Human
aggggagaggaggggagcu

SEQ ID NO: 261344 - RNA, 23 nt, Human
agggggaauugagggaggcucua

SEQ ID NO: 261345 - RNA, 20 nt, Human
aguggggggugguggccagg

SEQ ID NO: 261346 - RNA, 21 nt, Human
agugguaggggagaggagggg

SEQ ID NO: 261347 - RNA, 24 nt, Human
aguguggggacaaggaaaaaggga

SEQ ID NO: 261348 - RNA, 18 nt, Human
auagaauggccaaugccc

SEQ ID NO: 261349 - RNA, 20 nt, Human
auagagcucacuuuagaccg

SEQ ID NO: 261350 - RNA, 22 nt, Human
auaggacaacaguaaguguaag

SEQ ID NO: 261351 - RNA, 19 nt, Human
augcuccuggguugagagc

SEQ ID NO: 261352 - RNA, 18 nt, Human
augcuuuccagguguggg

SEQ ID NO: 261353 - RNA, 25 nt, Human
auugccccacaauuccagguuucaa

SEQ ID NO: 261354 - RNA, 23 nt, Human
caaaggcagcggaguuggcgaag

SEQ ID NO: 261355 - RNA, 19 nt, Human
caaggucaggcacagagug

SEQ ID NO: 261356 - RNA, 22 nt, Human
caauuccagguuucaauuuagc

SEQ ID NO: 261357 - RNA, 21 nt, Human
cacaauagaauggccaaugcc

SEQ ID NO: 261358 - RNA, 21 nt, Human
cacugcauggugggacaggau

SEQ ID NO: 261359 - RNA, 20 nt, Human
cagaauccccagcagcucuc

SEQ ID NO: 261360 - RNA, 21 nt, Human
cagaggcagggcccagucacc

SEQ ID NO: 261361 - RNA, 24 nt, Human
cagaugacaucacuaauacugaaa

SEQ ID NO: 261362 - RNA, 21 nt, Human
cagcaaugcacacaagacucc

SEQ ID NO: 261363 - RNA, 18 nt, Human
caggagcuauggcccaag

SEQ ID NO: 261364 - RNA, 24 nt, Human
caggauggccccuugaggacugaa

SEQ ID NO: 261365 - RNA, 27 nt, Human
caggcuucucucaccauacucagcuuu

SEQ ID NO: 261366 - RNA, 19 nt, Human
ccaagggacagaacagcug

SEQ ID NO: 261367 - RNA, 20 nt, Human
ccagggggaauugagggagg

SEQ ID NO: 261368 - RNA, 23 nt, Human
ccauaggacaacaguaaguguaa

SEQ ID NO: 261369 - RNA, 20 nt, Human
ccauucauuugcccagggaa

SEQ ID NO: 261370 - RNA, 19 nt, Human
ccauuucccccauccaccc

SEQ ID NO: 261371 - RNA, 20 nt, Human
cccacaauuccagguuucaa

SEQ ID NO: 261372 - RNA, 24 nt, Human
cccccaaucguuacaaagccuaaa

SEQ ID NO: 261373 - RNA, 26 nt, Human
cccccagccucccuaaggguaaguua

SEQ ID NO: 261374 - RNA, 23 nt, Human
ccccuccaaaaacaauuuuuaaa

SEQ ID NO: 261375 - RNA, 22 nt, Human
ccccuugaggacugaacccugg

SEQ ID NO: 261376 - RNA, 19 nt, Human
cccuagaggcugggugccu

SEQ ID NO: 261377 - RNA, 25 nt, Human
ccgcauaacacuccaaccguguaaa

SEQ ID NO: 261378 - RNA, 21 nt, Human
ccuacuccacacuugacuccc

SEQ ID NO: 261379 - RNA, 22 nt, Human
ccuacuggcaucaagcucuaga

SEQ ID NO: 261380 - RNA, 21 nt, Human
ccuggguugagagcaaggggu

SEQ ID NO: 261381 - RNA, 22 nt, Human
ccuugaggacugaacccugggg

SEQ ID NO: 261382 - RNA, 25 nt, Human
cuaaccuuuucccccagccucccua

SEQ ID NO: 261383 - RNA, 22 nt, Human
cuagcuuccaaccuacuccaca

SEQ ID NO: 261384 - RNA, 18 nt, Human
cuccaagggacagaacag

SEQ ID NO: 261385 - RNA, 22 nt, Human
cuuccaaccuacuccacacuug

SEQ ID NO: 261386 - RNA, 22 nt, Human
cuucuacucagccuugccacaa

SEQ ID NO: 261387 - RNA, 18 nt, Human
cuuggaucagggcacagg

SEQ ID NO: 261388 - RNA, 18 nt, Human
gaauccccagcagcucuc

SEQ ID NO: 261389 - RNA, 24 nt, Human
gaccgcauaacacuccaaccguga

SEQ ID NO: 261390 - RNA, 20 nt, Human
gagagcaaggggugggggug

SEQ ID NO: 261391 - RNA, 24 nt, Human
gagagcaaggggugggggugugga

SEQ ID NO: 261392 - RNA, 21 nt, Human
gaggcucuaagcuaggggcac

SEQ ID NO: 261393 - RNA, 22 nt, Human
ggaggcucuaagcuaggggcac

SEQ ID NO: 261394 - RNA, 20 nt, Human
ggcauuugcaaaaucaagug

SEQ ID NO: 261395 - RNA, 19 nt, Human
ggccagaauccccagcagc

SEQ ID NO: 261396 - RNA, 20 nt, Human
ggggagaggaggggagcuag

SEQ ID NO: 261397 - RNA, 22 nt, Human
ggggagaggaggggagcuagcu

SEQ ID NO: 261398 - RNA, 18 nt, Human
ggggggugguggccaggg

SEQ ID NO: 261399 - RNA, 18 nt, Human
gggugggggcuaaggggc

SEQ ID NO: 261400 - RNA, 20 nt, Human
gggugggggcuaaggggcua

SEQ ID NO: 261401 - RNA, 19 nt, Human
ggguggggguguggaaggg

SEQ ID NO: 261402 - RNA, 20 nt, Human
ggguggggguguggaaggga

SEQ ID NO: 261403 - RNA, 19 nt, Human
gguggggguguggaaggga

SEQ ID NO: 261404 - RNA, 18 nt, Human
gguuuacagcuccaaggg

SEQ ID NO: 261405 - RNA, 21 nt, Human
gugaaggucuugaaggcacca

SEQ ID NO: 261406 - RNA, 21 nt, Human
gugaguuagguguaggagugu

SEQ ID NO: 261407 - RNA, 21 nt, Human
guggcggcaaaggcagcggag

SEQ ID NO: 261408 - RNA, 19 nt, Human
guggggacaaggaaaaagg

SEQ ID NO: 261409 - RNA, 21 nt, Human
guggggacaaggaaaaaggga

SEQ ID NO: 261410 - RNA, 22 nt, Human
uaaaguaaugaggccaaaauca

SEQ ID NO: 261411 - RNA, 22 nt, Human
uacacaaaaaaccccugaauac

SEQ ID NO: 261412 - RNA, 20 nt, Human
uacuccacacuugacuccca

SEQ ID NO: 261413 - RNA, 22 nt, Human
uacugacuuuaaggcagcuauu

SEQ ID NO: 261414 - RNA, 24 nt, Human
uagaaacaaaaaugacugaacauc

SEQ ID NO: 261415 - RNA, 20 nt, Human
uagaauggccaaugcccuuc

SEQ ID NO: 261416 - RNA, 23 nt, Human
uagaccgcauaacacuccaaccg

SEQ ID NO: 261417 - RNA, 22 nt, Human
uaguauguuuggugaaggucuu

SEQ ID NO: 261418 - RNA, 25 nt, Human
uaugaccuauagugacagaugacau

SEQ ID NO: 261419 - RNA, 22 nt, Human
uauguuuggugaaggucuugaa

SEQ ID NO: 261420 - RNA, 19 nt, Human
ucaguagaguacauaauac

SEQ ID NO: 261421 - RNA, 24 nt, Human
ucauuugcccagggaagugggugg

SEQ ID NO: 261422 - RNA, 21 nt, Human
uccaaccuacuccacacuuga

SEQ ID NO: 261423 - RNA, 23 nt, Human
uccaagggacagaacagcuggug

SEQ ID NO: 261424 - RNA, 24 nt, Human
uccaagggacagaacagcuggugu

SEQ ID NO: 261425 - RNA, 18 nt, Human
uccagguuucaauuuagc

SEQ ID NO: 261426 - RNA, 22 nt, Human
ucccauggcuacauuaaaugcu

SEQ ID NO: 261427 - RNA, 19 nt, Human
ucccuaaggguaaguuacu

SEQ ID NO: 261428 - RNA, 31 nt, Human
ucccuagaccgcauaacacuccaaccguguu

SEQ ID NO: 261429 - RNA, 21 nt, Human
uccuggguugagagcaagggg

SEQ ID NO: 261430 - RNA, 20 nt, Human
ucucucaccauacucagcuu

SEQ ID NO: 261431 - RNA, 23 nt, Human
ugaaauagaacauggauugagca

SEQ ID NO: 261432 - RNA, 22 nt, Human
ugaagcagggaggggcagaucc

SEQ ID NO: 261433 - RNA, 27 nt, Human
ugaauacaaaaucuaaccuuuuccccc

SEQ ID NO: 261434 - RNA, 18 nt, Human
ugacagaugacaucacua

SEQ ID NO: 261435 - RNA, 21 nt, Human
ugacaucacuaauacugaaag

SEQ ID NO: 261436 - RNA, 23 nt, Human
ugaccuauagugacagaugacau

SEQ ID NO: 261437 - RNA, 19 nt, Human
ugagagcaagggguggggg

SEQ ID NO: 261438 - RNA, 21 nt, Human
ugagagcaaggggugggggug

SEQ ID NO: 261439 - RNA, 21 nt, Human
ugagcuaauucacagcaaugc

SEQ ID NO: 261440 - RNA, 23 nt, Human
ugcauggugggacaggauggccc

SEQ ID NO: 261441 - RNA, 19 nt, Human
ugccaaggcugggauggcu

SEQ ID NO: 261442 - RNA, 19 nt, Human
ugccaaggcugggauggcu

SEQ ID NO: 261443 - RNA, 21 nt, Human
ugccaaggcugggauggcugu

SEQ ID NO: 261444 - RNA, 25 nt, Human
ugccaaggcugggauggcuguggag

SEQ ID NO: 261445 - RNA, 18 nt, Human
ugcuuuccaggugugggg

SEQ ID NO: 261446 - RNA, 22 nt, Human
uggaaaguaccucuaggcugga

SEQ ID NO: 261447 - RNA, 21 nt, Human
uggaauaauaaguaaggggua

SEQ ID NO: 261448 - RNA, 18 nt, Human
uggcugagcuuuugggua

SEQ ID NO: 261449 - RNA, 18 nt, Human
ugggacaggauggccccu

SEQ ID NO: 261450 - RNA, 18 nt, Human
uggggcuggcugagcuuu

SEQ ID NO: 261451 - RNA, 20 nt, Human
uggggggugguggccagggg

SEQ ID NO: 261452 - RNA, 23 nt, Human
ugggugggggcuaaggggcuagg

SEQ ID NO: 261453 - RNA, 24 nt, Human
ugggugggggcuaaggggcuaggu

SEQ ID NO: 261454 - RNA, 18 nt, Human
uggguugagagcaagggg

SEQ ID NO: 261455 - RNA, 25 nt, Human
uggguugagagcaaggggugggggu

SEQ ID NO: 261456 - RNA, 22 nt, Human
ugguaaaguaaugaggccaaaa

SEQ ID NO: 261457 - RNA, 18 nt, Human
ugguaggggagaggaggg

SEQ ID NO: 261458 - RNA, 25 nt, Human
uggugaaggucuugaaggcaccauu

SEQ ID NO: 261459 - RNA, 19 nt, Human
uguggaagggacuaggcca

SEQ ID NO: 261460 - RNA, 18 nt, Human
uguggagcaggagcuaug

SEQ ID NO: 261461 - RNA, 20 nt, Human
uuaaaugcuuggcaugacuc

SEQ ID NO: 261462 - RNA, 24 nt, Human
uuuggaggggagugaugagaaggg

SEQ ID NO: 261463 - RNA, 21 nt, Human
aaaaagaaaaaaaaaaagccc

SEQ ID NO: 261464 - RNA, 22 nt, Human
aaaaaugcauuuucaguaggcu

SEQ ID NO: 261465 - RNA, 19 nt, Human
aaaaaugcugagauacaca

SEQ ID NO: 261466 - RNA, 23 nt, Human
aaaagaaaaaaaaaaagcccuug

SEQ ID NO: 261467 - RNA, 19 nt, Human
aaagaacucucauauuauc

SEQ ID NO: 261468 - RNA, 21 nt, Human
aaagacgcaccccccaccccc

SEQ ID NO: 261469 - RNA, 20 nt, Human
aaaugauucuuucagaaacc

SEQ ID NO: 261470 - RNA, 22 nt, Human
aaaugcaauucaacauuccaaa

SEQ ID NO: 261471 - RNA, 21 nt, Human
aaccacauauugguaauugag

SEQ ID NO: 261472 - RNA, 23 nt, Human
aagaagagcaaaaaauuguaauc

SEQ ID NO: 261473 - RNA, 23 nt, Human
aagacgcaccccccacccccccc

SEQ ID NO: 261474 - RNA, 21 nt, Human
aagcccuugacucagucuuua

SEQ ID NO: 261475 - RNA, 22 nt, Human
aagcucgacuacacuucaaaac

SEQ ID NO: 261476 - RNA, 21 nt, Human
aauacaaaaaggauuuuuaga

SEQ ID NO: 261477 - RNA, 23 nt, Human
aauacuaauaguuaauacuaaca

SEQ ID NO: 261478 - RNA, 24 nt, Human
acacagcaguucuccuagaaccca

SEQ ID NO: 261479 - RNA, 20 nt, Human
acagaggcauaccaucuaga

SEQ ID NO: 261480 - RNA, 22 nt, Human
acgcaccccccacccccccccc

SEQ ID NO: 261481 - RNA, 24 nt, Human
acgcaccccccacccccccccccg

SEQ ID NO: 261482 - RNA, 28 nt, Human
acuaaagacgcaccccccaccccccccc

SEQ ID NO: 261483 - RNA, 22 nt, Human
acuaaauagauuacaaagacaa

SEQ ID NO: 261484 - RNA, 23 nt, Human
acuaaauagauuacaaagacaag

SEQ ID NO: 261485 - RNA, 19 nt, Human
acugguaugcauuucuauu

SEQ ID NO: 261486 - RNA, 20 nt, Human
agaaaaagaaaaaaaaaaag

SEQ ID NO: 261487 - RNA, 22 nt, Human
agaaagcagcacugauuuaucc

SEQ ID NO: 261488 - RNA, 23 nt, Human
agaaagcagcacugauuuaucca

SEQ ID NO: 261489 - RNA, 19 nt, Human
agaaauacuaccaaaccac

SEQ ID NO: 261490 - RNA, 18 nt, Human
agaacaaggcucugucuc

SEQ ID NO: 261491 - RNA, 22 nt, Human
agaagagcaaaaaauuguaauc

SEQ ID NO: 261492 - RNA, 24 nt, Human
agaauucauucucuuaaccacaaa

SEQ ID NO: 261493 - RNA, 23 nt, Human
agacagaaaguguacauucagaa

SEQ ID NO: 261494 - RNA, 23 nt, Human
agacaucccaaacaggcugauaa

SEQ ID NO: 261495 - RNA, 20 nt, Human
agacgcaccccccacccccc

SEQ ID NO: 261496 - RNA, 24 nt, Human
agacgcaccccccacccccccccc

SEQ ID NO: 261497 - RNA, 21 nt, Human
agacuccaaacaguugaaacc

SEQ ID NO: 261498 - RNA, 20 nt, Human
agcaauauaguauuaacaac

SEQ ID NO: 261499 - RNA, 21 nt, Human
agcaccagggaccaggagaga

SEQ ID NO: 261500 - RNA, 19 nt, Human
agcaugggagcagaggccc

SEQ ID NO: 261501 - RNA, 24 nt, Human
aggaaagaagaguugugaaaaugu

SEQ ID NO: 261502 - RNA, 27 nt, Human
aggcccaaacagcaccagggaccagga

SEQ ID NO: 261503 - RNA, 18 nt, Human
aguacuagcaauaguacu

SEQ ID NO: 261504 - RNA, 19 nt, Human
auaggcacugaucucagac

SEQ ID NO: 261505 - RNA, 19 nt, Human
auaggcacugauuucagac

SEQ ID NO: 261506 - RNA, 22 nt, Human
augacaguucuccuagaaccca

SEQ ID NO: 261507 - RNA, 21 nt, Human
auuguguucuagacucuaggu

SEQ ID NO: 261508 - RNA, 22 nt, Human
caaaugauucuuucagaaacca

SEQ ID NO: 261509 - RNA, 23 nt, Human
caaaugcaauucaacauuccaaa

SEQ ID NO: 261510 - RNA, 23 nt, Human
caagaaaaagaaaaaaaaaaagc

SEQ ID NO: 261511 - RNA, 20 nt, Human
caauacaguauuaacaaccc

SEQ ID NO: 261512 - RNA, 26 nt, Human
caauagaacaaggcucugucucuuaa

SEQ ID NO: 261513 - RNA, 22 nt, Human
cacaaaaggaucuuggaaguca

SEQ ID NO: 261514 - RNA, 22 nt, Human
cacaacaacccugugagguagg

SEQ ID NO: 261515 - RNA, 21 nt, Human
cacccccccccccgcccuuug

SEQ ID NO: 261516 - RNA, 20 nt, Human
cagagccucacacaaguguu

SEQ ID NO: 261517 - RNA, 19 nt, Human
cagaggcacugaucucaga

SEQ ID NO: 261518 - RNA, 21 nt, Human
cagcaauauaguauuaacaac

SEQ ID NO: 261519 - RNA, 21 nt, Human
cagcaguucuccuagaaccca

SEQ ID NO: 261520 - RNA, 19 nt, Human
cauaacaaacuaaacuucc

SEQ ID NO: 261521 - RNA, 22 nt, Human
caucccuaucucugguugagaa

SEQ ID NO: 261522 - RNA, 19 nt, Human
caugaagaaaggaaaugac

SEQ ID NO: 261523 - RNA, 24 nt, Human
cauucagaauucauucucuuaacc

SEQ ID NO: 261524 - RNA, 25 nt, Human
cauucagaauucauucucuuaacca

SEQ ID NO: 261525 - RNA, 19 nt, Human
cauugcgcaugagcaaagc

SEQ ID NO: 261526 - RNA, 26 nt, Human
ccacuucucucucuuuacaauugaaa

SEQ ID NO: 261527 - RNA, 21 nt, Human
cccauaggcacugauuucaga

SEQ ID NO: 261528 - RNA, 24 nt, Human
cccaugcauaccacuuacgcauag

SEQ ID NO: 261529 - RNA, 20 nt, Human
cccccacccccccccccgcc

SEQ ID NO: 261530 - RNA, 22 nt, Human
ccccccacccccccccccgccc

SEQ ID NO: 261531 - RNA, 18 nt, Human
cccccccccgcccuuugg

SEQ ID NO: 261532 - RNA, 25 nt, Human
ccuguaaucuaaaauauuauuuggg

SEQ ID NO: 261533 - RNA, 23 nt, Human
cuagaaucuuaauaguaugaauc

SEQ ID NO: 261534 - RNA, 20 nt, Human
cuaguacuagcaauaguacu

SEQ ID NO: 261535 - RNA, 19 nt, Human
cucauaguauuucagcauc

SEQ ID NO: 261536 - RNA, 22 nt, Human
cucauauguccugcuuucaauu

SEQ ID NO: 261537 - RNA, 19 nt, Human
cucaugacaguucuccuag

SEQ ID NO: 261538 - RNA, 19 nt, Human
cugguacaugaagaaagga

SEQ ID NO: 261539 - RNA, 23 nt, Human
cugguaugcauuucuauuacccu

SEQ ID NO: 261540 - RNA, 20 nt, Human
cuguuuuuuuuaauggaaca

SEQ ID NO: 261541 - RNA, 28 nt, Human
cuucagaauucuguuauuucucauuuga

SEQ ID NO: 261542 - RNA, 21 nt, Human
gaaccaaagucauuuggagga

SEQ ID NO: 261543 - RNA, 21 nt, Human
gaagagcaaaaaauuguaauc

SEQ ID NO: 261544 - RNA, 21 nt, Human
gaagucaguugugcagaugac

SEQ ID NO: 261545 - RNA, 19 nt, Human
gaccaggagagaaggccau

SEQ ID NO: 261546 - RNA, 20 nt, Human
gacgcaccccccaccccccc

SEQ ID NO: 261547 - RNA, 24 nt, Human
gcaccccccacccccccccccgcc

SEQ ID NO: 261548 - RNA, 19 nt, Human
gcagagaacugaggacugg

SEQ ID NO: 261549 - RNA, 21 nt, Human
gcugugagucuaccacuuggu

SEQ ID NO: 261550 - RNA, 20 nt, Human
gcuuuaauaucaacugcugg

SEQ ID NO: 261551 - RNA, 20 nt, Human
gggugagaacacagcaguuc

SEQ ID NO: 261552 - RNA, 25 nt, Human
guaaaaaucaaaugaaaaacaaaug

SEQ ID NO: 261553 - RNA, 21 nt, Human
gugaagggccuuuuaaugaga

SEQ ID NO: 261554 - RNA, 22 nt, Human
uaaaaccagagacaauuaucuc

SEQ ID NO: 261555 - RNA, 22 nt, Human
uaaaagacuccaaacaguugaa

SEQ ID NO: 261556 - RNA, 22 nt, Human
uaaaauaguaagcaugaaggug

SEQ ID NO: 261557 - RNA, 25 nt, Human
uaaagaaagcagcacugauuuaucc

SEQ ID NO: 261558 - RNA, 23 nt, Human
uaaagacgcaccccccacccccc

SEQ ID NO: 261559 - RNA, 19 nt, Human
uaacaaacuaaacuuccug

SEQ ID NO: 261560 - RNA, 20 nt, Human
uaacaaacuaaacuuccugu

SEQ ID NO: 261561 - RNA, 23 nt, Human
uaauagcaauaguacuaguacua

SEQ ID NO: 261562 - RNA, 20 nt, Human
uaauaguaauaguacuauua

SEQ ID NO: 261563 - RNA, 18 nt, Human
uacaacacgggaaccaaa

SEQ ID NO: 261564 - RNA, 20 nt, Human
uacacaaguuauugcacauu

SEQ ID NO: 261565 - RNA, 19 nt, Human
uacacagaggcauaccauc

SEQ ID NO: 261566 - RNA, 20 nt, Human
uacuauugacaacccauagg

SEQ ID NO: 261567 - RNA, 19 nt, Human
uacucaugacaguucuccu

SEQ ID NO: 261568 - RNA, 21 nt, Human
uagaacaaggcucugucucuu

SEQ ID NO: 261569 - RNA, 18 nt, Human
uagagagaaaccaaaaau

SEQ ID NO: 261570 - RNA, 22 nt, Human
uaggggagagaggugauggugg

SEQ ID NO: 261571 - RNA, 19 nt, Human
uagggugagaacacagcag

SEQ ID NO: 261572 - RNA, 22 nt, Human
uaguccagccugugcaauagaa

SEQ ID NO: 261573 - RNA, 23 nt, Human
uaguuaauacuaacaguuaacac

SEQ ID NO: 261574 - RNA, 24 nt, Human
uauccagcccuguuccucccccaa

SEQ ID NO: 261575 - RNA, 25 nt, Human
uaucuaauacacaaguuauugcaca

SEQ ID NO: 261576 - RNA, 20 nt, Human
uauuagaaaauuccauuuaa

SEQ ID NO: 261577 - RNA, 24 nt, Human
ucaauggguggcagagaacugagg

SEQ ID NO: 261578 - RNA, 22 nt, Human
ucagacaucccaaacaggcuga

SEQ ID NO: 261579 - RNA, 26 nt, Human
uccuguaaucuaaaauauuauuuggg

SEQ ID NO: 261580 - RNA, 19 nt, Human
ucuaaaauauuauuugggc

SEQ ID NO: 261581 - RNA, 21 nt, Human
ucugcauaccuauccagcccu

SEQ ID NO: 261582 - RNA, 24 nt, Human
ugaaaaacaaauggauuuuuccua

SEQ ID NO: 261583 - RNA, 19 nt, Human
ugaaacaucacucuuccaa

SEQ ID NO: 261584 - RNA, 20 nt, Human
ugaaaugaccagguaauaca

SEQ ID NO: 261585 - RNA, 22 nt, Human
ugaaaugaccagguaauacaug

SEQ ID NO: 261586 - RNA, 20 nt, Human
ugacaagaaaaauaagcucc

SEQ ID NO: 261587 - RNA, 21 nt, Human
ugacaguucuccuagaaccca

SEQ ID NO: 261588 - RNA, 19 nt, Human
ugacuggacugaacuuagu

SEQ ID NO: 261589 - RNA, 22 nt, Human
ugagaagguaaaauaagaauca

SEQ ID NO: 261590 - RNA, 22 nt, Human
ugagacagaaaguguacauuca

SEQ ID NO: 261591 - RNA, 18 nt, Human
ugccagagaaaaucagca

SEQ ID NO: 261592 - RNA, 22 nt, Human
ugcccaagcucgacuacacuuc

SEQ ID NO: 261593 - RNA, 21 nt, Human
ugcguguaguccagccugugc

SEQ ID NO: 261594 - RNA, 20 nt, Human
ugcugccagagaaaaucagc

SEQ ID NO: 261595 - RNA, 24 nt, Human
uggaaaauaagaagaugagaaggu

SEQ ID NO: 261596 - RNA, 21 nt, Human
uggaaagagaccaguauucau

SEQ ID NO: 261597 - RNA, 22 nt, Human
uggaacaaaugcaauucaacau

SEQ ID NO: 261598 - RNA, 21 nt, Human
uggcagagaacugaggacugg

SEQ ID NO: 261599 - RNA, 18 nt, Human
ugggagcagaggcccaaa

SEQ ID NO: 261600 - RNA, 22 nt, Human
ugggauacuuaaaauuuacacc

SEQ ID NO: 261601 - RNA, 20 nt, Human
uggguggcagagaacugagg

SEQ ID NO: 261602 - RNA, 25 nt, Human
ugguagcagaggaugucccgcccaa

SEQ ID NO: 261603 - RNA, 22 nt, Human
uguaaaaccagagacaauuauc

SEQ ID NO: 261604 - RNA, 23 nt, Human
ugucucuuaaaacaagaaaaaga

SEQ ID NO: 261605 - RNA, 23 nt, Human
uuaaaacaagaaaaagaaaaaaa

SEQ ID NO: 261606 - RNA, 22 nt, Human
uuaacagugucauaguacuagu

SEQ ID NO: 261607 - RNA, 20 nt, Human
uuacuggguuucaggguagc

SEQ ID NO: 261608 - RNA, 23 nt, Human
uuacuugauccucacaacaaccc

SEQ ID NO: 261609 - RNA, 21 nt, Human
uuagcucuguaaaaccagaga

SEQ ID NO: 261610 - RNA, 21 nt, Human
uucaaaauguucaauucagca

SEQ ID NO: 261611 - RNA, 20 nt, Human
uucagaauaugaaaaaaugc

SEQ ID NO: 261612 - RNA, 19 nt, Human
uucauaaaagacuccaaac

SEQ ID NO: 261613 - RNA, 18 nt, Human
uuggaaagagaccaguau

SEQ ID NO: 261614 - RNA, 22 nt, Human
uuggagcagcccuccaguccgu

SEQ ID NO: 261615 - RNA, 21 nt, Human
uuuggaggagucacaaaagga

SEQ ID NO: 261616 - RNA, 20 nt, Human
uuuuuguuugaaaugaccag

SEQ ID NO: 261617 - RNA, 22 nt, Human
uccccaaggcauauggcaucaa

SEQ ID NO: 261618 - RNA, 21 nt, Human
aggcagccuugggguuagcuc

SEQ ID NO: 261619 - RNA, 21 nt, Human
auaaauacauguugcaggacu

SEQ ID NO: 261620 - RNA, 22 nt, Human
cacugugcccagaagacagggu

SEQ ID NO: 261621 - RNA, 21 nt, Human
cagaagacaggguccacagca

SEQ ID NO: 261622 - RNA, 26 nt, Human
cagaagacaggguccacagcaggcac

SEQ ID NO: 261623 - RNA, 21 nt, Human
cagguccagcccaagaacuaa

SEQ ID NO: 261624 - RNA, 22 nt, Human
cauuuguuccuuuauugguuca

SEQ ID NO: 261625 - RNA, 22 nt, Human
ccucugaaaguuaaagggcagg

SEQ ID NO: 261626 - RNA, 25 nt, Human
ccucugaaaguuaaagggcaggaac

SEQ ID NO: 261627 - RNA, 20 nt, Human
guguggucacugcugagucc

SEQ ID NO: 261628 - RNA, 21 nt, Human
uagcucaaggcagcuaagcag

SEQ ID NO: 261629 - RNA, 19 nt, Human
ucaagggucaguguuggug

SEQ ID NO: 261630 - RNA, 24 nt, Human
uccacugugcccagaagacagggu

SEQ ID NO: 261631 - RNA, 21 nt, Human
ugcucuggccuggcauggccc

SEQ ID NO: 261632 - RNA, 22 nt, Human
uggccuggcauggcccagaggc

SEQ ID NO: 261633 - RNA, 26 nt, Human
uggccuggcauggcccagaggcagcc

SEQ ID NO: 261634 - RNA, 18 nt, Human
aacacaucuguguuuucc

SEQ ID NO: 261635 - RNA, 23 nt, Human
acuucggagagugaacucaggga

SEQ ID NO: 261636 - RNA, 22 nt, Human
agcagccggggccaugcagagc

SEQ ID NO: 261637 - RNA, 18 nt, Human
agccgggcccccccuucu

SEQ ID NO: 261638 - RNA, 21 nt, Human
aggacagggaaaagcuaugca

SEQ ID NO: 261639 - RNA, 22 nt, Human
caaagaggugaaacuggagcag

SEQ ID NO: 261640 - RNA, 24 nt, Human
cagagccgggcccccccuucugcc

SEQ ID NO: 261641 - RNA, 18 nt, Human
cagcagccggggccaugc

SEQ ID NO: 261642 - RNA, 18 nt, Human
caugcagagccgggcccc

SEQ ID NO: 261643 - RNA, 22 nt, Human
cccacagguggggaccugggac

SEQ ID NO: 261644 - RNA, 20 nt, Human
cccgccccuccccagcaggc

SEQ ID NO: 261645 - RNA, 22 nt, Human
cccgccccuccccagcaggcca

SEQ ID NO: 261646 - RNA, 21 nt, Human
ccgccccuccccagcaggcca

SEQ ID NO: 261647 - RNA, 22 nt, Human
ccgcgcgcgccucccgccccuc

SEQ ID NO: 261648 - RNA, 22 nt, Human
ccggcgugcugggccuggccuc

SEQ ID NO: 261649 - RNA, 22 nt, Human
ccucaguuuccccaucuuuaac

SEQ ID NO: 261650 - RNA, 18 nt, Human
ccucccgccccuccccag

SEQ ID NO: 261651 - RNA, 20 nt, Human
ccuccggucgcugccgccgc

SEQ ID NO: 261652 - RNA, 18 nt, Human
cgggcaugggcuccgggc

SEQ ID NO: 261653 - RNA, 25 nt, Human
cucauuuccaaaaucgucagacacc

SEQ ID NO: 261654 - RNA, 23 nt, Human
cuccccagcaggccagcuccggc

SEQ ID NO: 261655 - RNA, 18 nt, Human
cuuaaauuuuccaaugga

SEQ ID NO: 261656 - RNA, 21 nt, Human
cuucugccgcagcacuggcca

SEQ ID NO: 261657 - RNA, 23 nt, Human
gaagaagcuaggauucaucuucc

SEQ ID NO: 261658 - RNA, 20 nt, Human
gauuucucugcgcuuuucuu

SEQ ID NO: 261659 - RNA, 19 nt, Human
gcagagccgggcccccccu

SEQ ID NO: 261660 - RNA, 19 nt, Human
ggcgugcugggccuggccu

SEQ ID NO: 261661 - RNA, 27 nt, Human
gggcuccgggcgggcugggagcgacaa

SEQ ID NO: 261662 - RNA, 21 nt, Human
gugaggguuaaagggaaggcg

SEQ ID NO: 261663 - RNA, 22 nt, Human
uaaauuuuccaauggaagaagc

SEQ ID NO: 261664 - RNA, 19 nt, Human
uacagcaccagggcuggag

SEQ ID NO: 261665 - RNA, 24 nt, Human
uagucuuuuuuuucucuuuucuuu

SEQ ID NO: 261666 - RNA, 23 nt, Human
ucagacaccgauuucucugcgcu

SEQ ID NO: 261667 - RNA, 24 nt, Human
ucagcagccggggccaugcagagc

SEQ ID NO: 261668 - RNA, 18 nt, Human
ucccgcgcgcgccucccg

SEQ ID NO: 261669 - RNA, 19 nt, Human
ucccgcgcgcgccucccgc

SEQ ID NO: 261670 - RNA, 22 nt, Human
ucccgcgcgcgccucccgcccc

SEQ ID NO: 261671 - RNA, 23 nt, Human
ucccgcgcgcgccucccgccccu

SEQ ID NO: 261672 - RNA, 20 nt, Human
ucccugccccccagagcaaa

SEQ ID NO: 261673 - RNA, 21 nt, Human
ucucugcccucaguuucccca

SEQ ID NO: 261674 - RNA, 22 nt, Human
ucugcgcuuuucuugccuggug

SEQ ID NO: 261675 - RNA, 21 nt, Human
ucuguguuuucccugcccccc

SEQ ID NO: 261676 - RNA, 18 nt, Human
ucuuuuuuuuuuuuuuuu

SEQ ID NO: 261677 - RNA, 18 nt, Human
ugccgcagcacuggccag

SEQ ID NO: 261678 - RNA, 19 nt, Human
ugccgccgcgcaggcagag

SEQ ID NO: 261679 - RNA, 23 nt, Human
uggcccacagguggggaccuggg

SEQ ID NO: 261680 - RNA, 19 nt, Human
uggccucuagcucuguuca

SEQ ID NO: 261681 - RNA, 18 nt, Human
uggugucaggacagggaa

SEQ ID NO: 261682 - RNA, 22 nt, Human
uuccuggcuggcuagucuuuuu

SEQ ID NO: 261683 - RNA, 26 nt, Human
uuuuuuuuuuuuugagauuguucuca

SEQ ID NO: 261684 - RNA, 18 nt, Human
uuuuuuuuuuuuuuuuug

SEQ ID NO: 261685 - RNA, 25 nt, Human
aaaaaaggaaaaacuuuaaaaauau

SEQ ID NO: 261686 - RNA, 23 nt, Human
aaauuguacaagcacccuuucaa

SEQ ID NO: 261687 - RNA, 23 nt, Human
aacauguaaaaaaguauauaaaa

SEQ ID NO: 261688 - RNA, 24 nt, Human
aauaaaauauaucaaauuguacaa

SEQ ID NO: 261689 - RNA, 29 nt, Human
aauaaucucuccauaucuaauauuuucuu

SEQ ID NO: 261690 - RNA, 18 nt, Human
aauguaccuaguauuucu

SEQ ID NO: 261691 - RNA, 23 nt, Human
aauuacuaaacccccacccaaau

SEQ ID NO: 261692 - RNA, 22 nt, Human
acuaaacccccacccaaaucac

SEQ ID NO: 261693 - RNA, 21 nt, Human
agaaaauuacuaaacccccac

SEQ ID NO: 261694 - RNA, 21 nt, Human
agagggagaggaaacccuuug

SEQ ID NO: 261695 - RNA, 19 nt, Human
agcacccuuucaaagggau

SEQ ID NO: 261696 - RNA, 21 nt, Human
aggaaacccuuugaaacaagc

SEQ ID NO: 261697 - RNA, 22 nt, Human
auaaagguauaccggagggagg

SEQ ID NO: 261698 - RNA, 20 nt, Human
auuuuauuauauauauauau

SEQ ID NO: 261699 - RNA, 23 nt, Human
caacagguuuuaacauuuuacuc

SEQ ID NO: 261700 - RNA, 22 nt, Human
cagccuugagaagaauuaggaa

SEQ ID NO: 261701 - RNA, 18 nt, Human
cauaaaaaccaucagagc

SEQ ID NO: 261702 - RNA, 22 nt, Human
cauaaaaaccaucagagccaau

SEQ ID NO: 261703 - RNA, 24 nt, Human
cauugugucuguuucuuuguuuuc

SEQ ID NO: 261704 - RNA, 20 nt, Human
ccaaaucaccuuugcaaucu

SEQ ID NO: 261705 - RNA, 18 nt, Human
ccaagucaaaacauggcu

SEQ ID NO: 261706 - RNA, 18 nt, Human
ccccccaacauguaaaaa

SEQ ID NO: 261707 - RNA, 21 nt, Human
cccuuucaaagggauaaaggu

SEQ ID NO: 261708 - RNA, 23 nt, Human
cuaaacccccacccaaaucaccu

SEQ ID NO: 261709 - RNA, 22 nt, Human
cuaauuuucuaccucaccucca

SEQ ID NO: 261710 - RNA, 28 nt, Human
cucccgacgcgcgacuccgcuggcaacc

SEQ ID NO: 261711 - RNA, 26 nt, Human
cuuucuggaucuacuaauuguucaag

SEQ ID NO: 261712 - RNA, 24 nt, Human
gaaaauacaacaaauggacuuaca

SEQ ID NO: 261713 - RNA, 18 nt, Human
gaaauaugaugugucccc

SEQ ID NO: 261714 - RNA, 24 nt, Human
gauaacucuucaauaaaauauauc

SEQ ID NO: 261715 - RNA, 20 nt, Human
ggcgguggggggcgggggag

SEQ ID NO: 261716 - RNA, 18 nt, Human
gggacagauggacaggaa

SEQ ID NO: 261717 - RNA, 21 nt, Human
gggggcgggggagagauagga

SEQ ID NO: 261718 - RNA, 20 nt, Human
gguggggggcgggggagaga

SEQ ID NO: 261719 - RNA, 21 nt, Human
gugcauugugucuguuucuuu

SEQ ID NO: 261720 - RNA, 21 nt, Human
guggagagggagaggaaaccc

SEQ ID NO: 261721 - RNA, 19 nt, Human
guggggcgguggggggcgg

SEQ ID NO: 261722 - RNA, 21 nt, Human
uaauaaguuuaggacauacaa

SEQ ID NO: 261723 - RNA, 21 nt, Human
uacaagcacccuuucaaaggg

SEQ ID NO: 261724 - RNA, 21 nt, Human
uacacacacagagaaagcaua

SEQ ID NO: 261725 - RNA, 20 nt, Human
uacacagugucuuuugggaa

SEQ ID NO: 261726 - RNA, 22 nt, Human
uaccagggaacuuaaugggcug

SEQ ID NO: 261727 - RNA, 23 nt, Human
uaccucaccuccaggcagucuca

SEQ ID NO: 261728 - RNA, 22 nt, Human
uacuaaacccccacccaaauca

SEQ ID NO: 261729 - RNA, 24 nt, Human
uauaucaaauuguacaagcacccu

SEQ ID NO: 261730 - RNA, 20 nt, Human
ugaaacaagcauccaucaug

SEQ ID NO: 261731 - RNA, 21 nt, Human
ugagauauagaaaaaaagcac

SEQ ID NO: 261732 - RNA, 21 nt, Human
uggcugguacugccuucgugg

SEQ ID NO: 261733 - RNA, 23 nt, Human
uggggcgguggggggcgggggag

SEQ ID NO: 261734 - RNA, 20 nt, Human
ugugguggggcggugggggg

SEQ ID NO: 261735 - RNA, 21 nt, Human
ugugguggggcgguggggggc

SEQ ID NO: 261736 - RNA, 22 nt, Human
uuaagcagaaaauuacuaaacc

SEQ ID NO: 261737 - RNA, 24 nt, Human
uuauauuuuauuauauauauauau

SEQ ID NO: 261738 - RNA, 22 nt, Human
uucaaagggauaaagguauacc

SEQ ID NO: 261739 - RNA, 25 nt, Human
uucucugcccuacguagcucccgac

SEQ ID NO: 261740 - RNA, 24 nt, Human
uugaauaaucucuccauaucuaau

SEQ ID NO: 261741 - RNA, 24 nt, Human
uuugcaaauaauuugucucccucu

SEQ ID NO: 261742 - RNA, 23 nt, Human
aaacaaaaaauccuagauuuuac

SEQ ID NO: 261743 - RNA, 20 nt, Human
aagcgagaagggaagaggca

SEQ ID NO: 261744 - RNA, 23 nt, Human
aagcgagaagggaagaggcagug

SEQ ID NO: 261745 - RNA, 25 nt, Human
agaaaaaagggaauguagcaaaggg

SEQ ID NO: 261746 - RNA, 19 nt, Human
aggcagugggugcacgugg

SEQ ID NO: 261747 - RNA, 23 nt, Human
aggcagugggugcacguggaagg

SEQ ID NO: 261748 - RNA, 21 nt, Human
cagaaaaaagggaauguagca

SEQ ID NO: 261749 - RNA, 18 nt, Human
ccaagcgagaagggaaga

SEQ ID NO: 261750 - RNA, 18 nt, Human
cgagaagggaagaggcag

SEQ ID NO: 261751 - RNA, 18 nt, Human
ggucacucuauuuguacu

SEQ ID NO: 261752 - RNA, 24 nt, Human
guagcaaaaaacaaaaaauccuag

SEQ ID NO: 261753 - RNA, 20 nt, Human
uagcaaaaaacaaaaaaucc

SEQ ID NO: 261754 - RNA, 22 nt, Human
uagcaaaaaacaaaaaauccua

SEQ ID NO: 261755 - RNA, 22 nt, Human
uagcaaaaaacaaaaaauccua

SEQ ID NO: 261756 - RNA, 23 nt, Human
uagcaaaaaacaaaaaauccuag

SEQ ID NO: 261757 - RNA, 24 nt, Human
uagcaaaaaacaaaaaauccuaga

SEQ ID NO: 261758 - RNA, 25 nt, Human
agaaaaaaaggaauguagcaaauga

SEQ ID NO: 261759 - RNA, 21 nt, Human
cagaaaaaaaggaauguagca

SEQ ID NO: 261760 - RNA, 23 nt, Human
uguagaaaaaaaaaaccucggau

SEQ ID NO: 261761 - RNA, 18 nt, Human
uuguagaaaaaaaaaacc

SEQ ID NO: 261762 - RNA, 23 nt, Human
uuuuuuuuuuuuuuuuuuucaag

SEQ ID NO: 261763 - RNA, 21 nt, Human
caucugagagcacagcugucc

SEQ ID NO: 261764 - RNA, 24 nt, Human
ggagaagcaggaguucccgaucaa

SEQ ID NO: 261765 - RNA, 22 nt, Human
ggguuguacaaaaaaaaaaaaa

SEQ ID NO: 261766 - RNA, 18 nt, Human
uacaaaaaaaaaaaaaaa

SEQ ID NO: 261767 - RNA, 19 nt, Human
uagcaaacgggucaggguc

SEQ ID NO: 261768 - RNA, 31 nt, Human
ucaggguuguacaaaaaaaaaaaaaaaaaaa

SEQ ID NO: 261769 - RNA, 25 nt, Human
ucauagaaaaaaagauguagcaaac

SEQ ID NO: 261770 - RNA, 26 nt, Human
uguacaaaaaaaaaaaaaaaaaaaau

SEQ ID NO: 261771 - RNA, 26 nt, Human
uuguacaaaaaaaaaaaaaaaaaaaa

SEQ ID NO: 261772 - RNA, 28 nt, Human
uuguacaaaaaaaaaaaaaaaaaaaauc

SEQ ID NO: 261773 - RNA, 21 nt, Human
agccaccuggcacuaucucca

SEQ ID NO: 261774 - RNA, 22 nt, Human
cgaggagagcagcagcuggagg

SEQ ID NO: 261775 - RNA, 25 nt, Human
cuggaggcggugaacgggcuucuuc

SEQ ID NO: 261776 - RNA, 23 nt, Human
gggaaagggaacaccaggaacac

SEQ ID NO: 261777 - RNA, 21 nt, Human
uccaaggucagcagggaaagg

SEQ ID NO: 261778 - RNA, 27 nt, Human
aaaaaaaaaaaaaaagacauggcagga

SEQ ID NO: 261779 - RNA, 19 nt, Human
aaaaaaaaagacauggcag

SEQ ID NO: 261780 - RNA, 20 nt, Human
aaaaaaaagacauggcagug

SEQ ID NO: 261781 - RNA, 23 nt, Human
aaaaaaaagacauggcagugcaa

SEQ ID NO: 261782 - RNA, 24 nt, Human
aaaaaacccuccccccaaaacugu

SEQ ID NO: 261783 - RNA, 24 nt, Human
aaaaacccuccccccaaaacuguc

SEQ ID NO: 261784 - RNA, 18 nt, Human
aaacagcuuuuuauuugu

SEQ ID NO: 261785 - RNA, 23 nt, Human
aacaagcucggcuccugccaggc

SEQ ID NO: 261786 - RNA, 19 nt, Human
aaccccuccagggacacac

SEQ ID NO: 261787 - RNA, 23 nt, Human
aacccuccccccaaaacugucca

SEQ ID NO: 261788 - RNA, 22 nt, Human
acccccgcccccgcggaguccc

SEQ ID NO: 261789 - RNA, 21 nt, Human
accucucagcccaccucccuu

SEQ ID NO: 261790 - RNA, 24 nt, Human
acucacuugcucucuuccuuaauu

SEQ ID NO: 261791 - RNA, 20 nt, Human
agaaaacagcuuuuuauuug

SEQ ID NO: 261792 - RNA, 22 nt, Human
agaagcugaagaaaacagcuuu

SEQ ID NO: 261793 - RNA, 22 nt, Human
agacauggcagugcacgccccc

SEQ ID NO: 261794 - RNA, 22 nt, Human
agcguggccugggguugaugcc

SEQ ID NO: 261795 - RNA, 22 nt, Human
aggaaagagcgagcguggccug

SEQ ID NO: 261796 - RNA, 22 nt, Human
agggagguuugggugcccuggg

SEQ ID NO: 261797 - RNA, 22 nt, Human
agggguccgggaggcucgcggg

SEQ ID NO: 261798 - RNA, 24 nt, Human
agggguccgggaggcucgcggggg

SEQ ID NO: 261799 - RNA, 18 nt, Human
aggugguaacaccagagg

SEQ ID NO: 261800 - RNA, 18 nt, Human
aucuguuuacucuucccc

SEQ ID NO: 261801 - RNA, 20 nt, Human
auuaaaaaacccucccccca

SEQ ID NO: 261802 - RNA, 27 nt, Human
caagucucgaggugguaacaccagagg

SEQ ID NO: 261803 - RNA, 23 nt, Human
cacccucuaccucucagcccacc

SEQ ID NO: 261804 - RNA, 20 nt, Human
caccggacagaaagagaaac

SEQ ID NO: 261805 - RNA, 20 nt, Human
cagagccaggcuccagcuac

SEQ ID NO: 261806 - RNA, 23 nt, Human
cagcuacccccgcccccgcggag

SEQ ID NO: 261807 - RNA, 18 nt, Human
cauggcagugcacgcccc

SEQ ID NO: 261808 - RNA, 27 nt, Human
ccaauuaggaaaaaaaaaaaaaaaaaa

SEQ ID NO: 261809 - RNA, 21 nt, Human
cccccaaaacuguccaagaca

SEQ ID NO: 261810 - RNA, 20 nt, Human
ccccccaaaacaggcuaggu

SEQ ID NO: 261811 - RNA, 23 nt, Human
ccccccaaaacaggcuagguucc

SEQ ID NO: 261812 - RNA, 23 nt, Human
cccuccccauccccuuucacaaa

SEQ ID NO: 261813 - RNA, 20 nt, Human
ccgccgccgccuccggccgc

SEQ ID NO: 261814 - RNA, 18 nt, Human
ccgccgccuccggccgca

SEQ ID NO: 261815 - RNA, 20 nt, Human
ccguucccgccgccgccucc

SEQ ID NO: 261816 - RNA, 21 nt, Human
ccguucccgccgccgccuccg

SEQ ID NO: 261817 - RNA, 18 nt, Human
cgaggcaaagccccgaac

SEQ ID NO: 261818 - RNA, 22 nt, Human
cgcagccggcaccuccgcugcc

SEQ ID NO: 261819 - RNA, 22 nt, Human
cgcccaaccccuccagggacac

SEQ ID NO: 261820 - RNA, 18 nt, Human
cgcgguucaucccggccc

SEQ ID NO: 261821 - RNA, 22 nt, Human
cggaacaagcucggcuccugcc

SEQ ID NO: 261822 - RNA, 21 nt, Human
cggacaccggacagaaagaga

SEQ ID NO: 261823 - RNA, 19 nt, Human
cggccgcagggaaggcuug

SEQ ID NO: 261824 - RNA, 26 nt, Human
cggcucgaggcaaagccccgaacggg

SEQ ID NO: 261825 - RNA, 23 nt, Human
cucacuugcucucuuccuuaauu

SEQ ID NO: 261826 - RNA, 20 nt, Human
cugagaacuggcguacaaaa

SEQ ID NO: 261827 - RNA, 19 nt, Human
cugccucagccgucgcggu

SEQ ID NO: 261828 - RNA, 22 nt, Human
gaaagagcgagcguggccuggg

SEQ ID NO: 261829 - RNA, 19 nt, Human
gaagaaaacagcuuuuuau

SEQ ID NO: 261830 - RNA, 20 nt, Human
gacagaaagagaaaccccca

SEQ ID NO: 261831 - RNA, 22 nt, Human
gacagaaagagaaacccccaau

SEQ ID NO: 261832 - RNA, 19 nt, Human
gagggggaggggagggaag

SEQ ID NO: 261833 - RNA, 18 nt, Human
gcaaagccccgaacggug

SEQ ID NO: 261834 - RNA, 21 nt, Human
gcagccggcaccuccgcugcc

SEQ ID NO: 261835 - RNA, 24 nt, Human
gccgcagcuaucgccucacucccg

SEQ ID NO: 261836 - RNA, 18 nt, Human
gccguucccgccgccgcc

SEQ ID NO: 261837 - RNA, 19 nt, Human
ggaggggagggaaggaaag

SEQ ID NO: 261838 - RNA, 22 nt, Human
ggaggggagggaaggaaagagc

SEQ ID NO: 261839 - RNA, 19 nt, Human
ggccguucccgccgccgcc

SEQ ID NO: 261840 - RNA, 21 nt, Human
gggguugaugccagcuuaggg

SEQ ID NO: 261841 - RNA, 19 nt, Human
guccggacaccggacagaa

SEQ ID NO: 261842 - RNA, 21 nt, Human
guggguccuaccccccaaaac

SEQ ID NO: 261843 - RNA, 18 nt, Human
guuuacucuuccccuccc

SEQ ID NO: 261844 - RNA, 23 nt, Human
guuuacucuuccccuccccaucc

SEQ ID NO: 261845 - RNA, 19 nt, Human
uaaaaaacccuccccccaa

SEQ ID NO: 261846 - RNA, 24 nt, Human
uaaaaaacccuccccccaaaacug

SEQ ID NO: 261847 - RNA, 26 nt, Human
uacaaaaggcagagggggaggggagg

SEQ ID NO: 261848 - RNA, 22 nt, Human
uacccccgcccccgcggagucc

SEQ ID NO: 261849 - RNA, 24 nt, Human
uacccccgcccccgcggaguccca

SEQ ID NO: 261850 - RNA, 24 nt, Human
uagguucccacaugggccaaguuc

SEQ ID NO: 261851 - RNA, 18 nt, Human
ucagcccaccucccuucc

SEQ ID NO: 261852 - RNA, 24 nt, Human
ucccggcccgcgcugucgccgccg

SEQ ID NO: 261853 - RNA, 20 nt, Human
uccgggaggcucgcgggggc

SEQ ID NO: 261854 - RNA, 21 nt, Human
ucgaggugguaacaccagagg

SEQ ID NO: 261855 - RNA, 19 nt, Human
ucgcgguucaucccggccc

SEQ ID NO: 261856 - RNA, 23 nt, Human
ucucgaggugguaacaccagagg

SEQ ID NO: 261857 - RNA, 21 nt, Human
ucuguuuacucuuccccuccc

SEQ ID NO: 261858 - RNA, 23 nt, Human
ucuguuuacucuuccccucccca

SEQ ID NO: 261859 - RNA, 24 nt, Human
uuaaaaaauuaaaaaacccucccc

SEQ ID NO: 261860 - RNA, 19 nt, Human
uuaauucacuccucacucc

SEQ ID NO: 261861 - RNA, 19 nt, Human
uuaauucacuccucacucc

SEQ ID NO: 261862 - RNA, 22 nt, Human
uuaggaaaaaaaaaaaaaaaaa

SEQ ID NO: 261863 - RNA, 23 nt, Human
uuccugcagucuguccuccaucg

SEQ ID NO: 261864 - RNA, 21 nt, Human
aaaaauuaucccaguaucccu

SEQ ID NO: 261865 - RNA, 19 nt, Human
aagggcaugaaagcugcau

SEQ ID NO: 261866 - RNA, 19 nt, Human
aaguagagauuacccucca

SEQ ID NO: 261867 - RNA, 18 nt, Human
acccuccacccuuuauug

SEQ ID NO: 261868 - RNA, 22 nt, Human
agaaaaaugugaagacacagaa

SEQ ID NO: 261869 - RNA, 18 nt, Human
agagucccauuucuuccu

SEQ ID NO: 261870 - RNA, 18 nt, Human
aggacauugaaauaugca

SEQ ID NO: 261871 - RNA, 19 nt, Human
aggagucucuaauacacac

SEQ ID NO: 261872 - RNA, 22 nt, Human
aggcaagggcaugaaagcugca

SEQ ID NO: 261873 - RNA, 25 nt, Human
agggggagaagagaauggugggguu

SEQ ID NO: 261874 - RNA, 21 nt, Human
aucccaguaucccucccccaa

SEQ ID NO: 261875 - RNA, 19 nt, Human
auggugggguuuuuuuuuu

SEQ ID NO: 261876 - RNA, 22 nt, Human
cccuccagaaauacuguaccaa

SEQ ID NO: 261877 - RNA, 18 nt, Human
cucuuugauaggcaaggg

SEQ ID NO: 261878 - RNA, 22 nt, Human
cugugccaaccucacugcgcgg

SEQ ID NO: 261879 - RNA, 18 nt, Human
gaagacacagaaagauuc

SEQ ID NO: 261880 - RNA, 18 nt, Human
gagaagagaauggugggg

SEQ ID NO: 261881 - RNA, 22 nt, Human
gagcaaccgugucuuuuuagga

SEQ ID NO: 261882 - RNA, 18 nt, Human
gggaaaggaaucugcagu

SEQ ID NO: 261883 - RNA, 18 nt, Human
ggggagaagagaauggug

SEQ ID NO: 261884 - RNA, 22 nt, Human
ggggagaagagaauggugggga

SEQ ID NO: 261885 - RNA, 21 nt, Human
guagaguucccagcaccaaag

SEQ ID NO: 261886 - RNA, 19 nt, Human
gucuugucuuucuuacaac

SEQ ID NO: 261887 - RNA, 26 nt, Human
gugggguuuuuuuuuucccccuuaaa

SEQ ID NO: 261888 - RNA, 21 nt, Human
uaagacauaauuuaccuccaa

SEQ ID NO: 261889 - RNA, 19 nt, Human
uaauagggggagaagagaa

SEQ ID NO: 261890 - RNA, 27 nt, Human
uacacacaaugucuugucuuucuuaca

SEQ ID NO: 261891 - RNA, 20 nt, Human
uacaccuagcuuuucucaga

SEQ ID NO: 261892 - RNA, 20 nt, Human
uagaaaaaugugaagacaca

SEQ ID NO: 261893 - RNA, 23 nt, Human
uagaaaaaugugaagacacagaa

SEQ ID NO: 261894 - RNA, 19 nt, Human
uaggcaagggcaugaaagc

SEQ ID NO: 261895 - RNA, 22 nt, Human
uaguacuauaaaaugcuaccau

SEQ ID NO: 261896 - RNA, 20 nt, Human
uaucccaguaucccuccccc

SEQ ID NO: 261897 - RNA, 25 nt, Human
ugaagacacagaaagauuggagacc

SEQ ID NO: 261898 - RNA, 20 nt, Human
uguaugcaucucugauaugg

SEQ ID NO: 261899 - RNA, 23 nt, Human
ugucuugucuuucuuacaacaua

SEQ ID NO: 261900 - RNA, 21 nt, Human
uuaaaauaucagauaccauaa

SEQ ID NO: 261901 - RNA, 25 nt, Human
uuaccaaauugcccuccagaaauac

SEQ ID NO: 261902 - RNA, 19 nt, Human
uugcccuccagaaauacug

SEQ ID NO: 261903 - RNA, 19 nt, Human
uuuagcagaauaaagaugu

SEQ ID NO: 261904 - RNA, 19 nt, Human
uuuuuuuuaaaaagcaagc

SEQ ID NO: 261905 - RNA, 24 nt, Human
uuuuuuuuuuuuaaaaagcaagcu

SEQ ID NO: 261906 - RNA, 23 nt, Human
aaaaaaaauucuguuuauuguaa

SEQ ID NO: 261907 - RNA, 24 nt, Human
aaacauauaaaaauaacuuuaaaa

SEQ ID NO: 261908 - RNA, 24 nt, Human
aaauauaguaacacuuuacaaaau

SEQ ID NO: 261909 - RNA, 21 nt, Human
acacuuuacaaaauauguauc

SEQ ID NO: 261910 - RNA, 23 nt, Human
cccccaacuuuaggucucggcuu

SEQ ID NO: 261911 - RNA, 25 nt, Human
ugaaauucuuuagaaauauaacauc

SEQ ID NO: 261912 - RNA, 19 nt, Human
uuaaagagaaugauuaugu

SEQ ID NO: 261913 - RNA, 21 nt, Human
aacccacucccuccccccagg

SEQ ID NO: 261914 - RNA, 26 nt, Human
aacccagaggugaucggguggagccc

SEQ ID NO: 261915 - RNA, 19 nt, Human
acagaacaaaggagcauau

SEQ ID NO: 261916 - RNA, 26 nt, Human
acagaguacguccgccugcggccccc

SEQ ID NO: 261917 - RNA, 23 nt, Human
acccacucccuccccccaggccc

SEQ ID NO: 261918 - RNA, 18 nt, Human
acccugggccacucaagc

SEQ ID NO: 261919 - RNA, 23 nt, Human
acgugagcccggggugagccgag

SEQ ID NO: 261920 - RNA, 22 nt, Human
acuuuuguagcugacuuuuuuu

SEQ ID NO: 261921 - RNA, 20 nt, Human
agagcgccgccucccugccg

SEQ ID NO: 261922 - RNA, 25 nt, Human
agagguagcugggagguaagaaggu

SEQ ID NO: 261923 - RNA, 19 nt, Human
agaguuguuauccauguag

SEQ ID NO: 261924 - RNA, 19 nt, Human
agaguuguuauccauguag

SEQ ID NO: 261925 - RNA, 21 nt, Human
agauacccucuuggugaaccc

SEQ ID NO: 261926 - RNA, 20 nt, Human
agcugggagguaagaaggug

SEQ ID NO: 261927 - RNA, 19 nt, Human
aggagcugcucucuucucu

SEQ ID NO: 261928 - RNA, 22 nt, Human
aggcaaaagcuuaagcaacagc

SEQ ID NO: 261929 - RNA, 19 nt, Human
agguaagaaggugacuugg

SEQ ID NO: 261930 - RNA, 25 nt, Human
auaaaacaaaauaaaauaaaaccuu

SEQ ID NO: 261931 - RNA, 19 nt, Human
augacccuugcuaaacuuc

SEQ ID NO: 261932 - RNA, 19 nt, Human
augcugcuaggagcugcuc

SEQ ID NO: 261933 - RNA, 23 nt, Human
caaaagagcgucccccuggcuca

SEQ ID NO: 261934 - RNA, 23 nt, Human
caccgcccuccgccccgacggcc

SEQ ID NO: 261935 - RNA, 23 nt, Human
cacucccuccccccaggcccaag

SEQ ID NO: 261936 - RNA, 23 nt, Human
cacucgaaccgaaguuaugaggc

SEQ ID NO: 261937 - RNA, 22 nt, Human
cagaacaaaggagcauaucuuc

SEQ ID NO: 261938 - RNA, 19 nt, Human
caggcccaagggugggugc

SEQ ID NO: 261939 - RNA, 25 nt, Human
caucccgggccgaggucacucgaac

SEQ ID NO: 261940 - RNA, 20 nt, Human
ccaaauacugaacagaacaa

SEQ ID NO: 261941 - RNA, 20 nt, Human
ccagagcgccgccucccugc

SEQ ID NO: 261942 - RNA, 21 nt, Human
ccauguagcgcuccuccgggu

SEQ ID NO: 261943 - RNA, 19 nt, Human
ccccagagcgccgccuccc

SEQ ID NO: 261944 - RNA, 23 nt, Human
ccccagagcgccgccucccugcc

SEQ ID NO: 261945 - RNA, 18 nt, Human
cccccacauccucuccug

SEQ ID NO: 261946 - RNA, 19 nt, Human
cccccaggcccaagggugg

SEQ ID NO: 261947 - RNA, 22 nt, Human
cccccaggcccaagggugggug

SEQ ID NO: 261948 - RNA, 21 nt, Human
ccccccaggcccaaggguggg

SEQ ID NO: 261949 - RNA, 24 nt, Human
cccccuggcucaagaggccggcgu

SEQ ID NO: 261950 - RNA, 18 nt, Human
cccggaccgcggccggcc

SEQ ID NO: 261951 - RNA, 18 nt, Human
cccuccccccaggcccaa

SEQ ID NO: 261952 - RNA, 19 nt, Human
cccuccccccaggcccaag

SEQ ID NO: 261953 - RNA, 23 nt, Human
ccgacggccacgccugccccaaa

SEQ ID NO: 261954 - RNA, 19 nt, Human
ccgacggccacgccugccu

SEQ ID NO: 261955 - RNA, 19 nt, Human
ccggaagugguccagggag

SEQ ID NO: 261956 - RNA, 19 nt, Human
ccuuggugaucagggcauc

SEQ ID NO: 261957 - RNA, 25 nt, Human
cgccugcggccccagagcgccgccu

SEQ ID NO: 261958 - RNA, 23 nt, Human
cggccggccaccgcccuccgccc

SEQ ID NO: 261959 - RNA, 20 nt, Human
cgggggcugugacuuggaaa

SEQ ID NO: 261960 - RNA, 18 nt, Human
cggggugagccgaggggc

SEQ ID NO: 261961 - RNA, 18 nt, Human
cuaagcaugaauauaaug

SEQ ID NO: 261962 - RNA, 22 nt, Human
cucuaaaucaguaccaaguccu

SEQ ID NO: 261963 - RNA, 18 nt, Human
cugccgcccccgccgccc

SEQ ID NO: 261964 - RNA, 23 nt, Human
cugccgcccccgccgcccggccu

SEQ ID NO: 261965 - RNA, 22 nt, Human
gaaggugcugacuuuuguggga

SEQ ID NO: 261966 - RNA, 20 nt, Human
gaccgcggccggccaccgcc

SEQ ID NO: 261967 - RNA, 19 nt, Human
gagcagcacuucagaagaa

SEQ ID NO: 261968 - RNA, 18 nt, Human
gagcccccacauccucuc

SEQ ID NO: 261969 - RNA, 27 nt, Human
gagucaauuucaaguuacggauccuga

SEQ ID NO: 261970 - RNA, 19 nt, Human
gccaccgcccuccgccccg

SEQ ID NO: 261971 - RNA, 19 nt, Human
gggugggugcacugcagua

SEQ ID NO: 261972 - RNA, 21 nt, Human
guccagggagaguuguacgag

SEQ ID NO: 261973 - RNA, 24 nt, Human
uaaaaccuuaacuguuuugggacu

SEQ ID NO: 261974 - RNA, 22 nt, Human
uaaaugaugcuguaucugccac

SEQ ID NO: 261975 - RNA, 22 nt, Human
uaagugcuuuuguugacuugcu

SEQ ID NO: 261976 - RNA, 18 nt, Human
uaccuggccugaagaguc

SEQ ID NO: 261977 - RNA, 18 nt, Human
uauauuacauucuacaua

SEQ ID NO: 261978 - RNA, 18 nt, Human
uccaauucuagcccugcu

SEQ ID NO: 261979 - RNA, 20 nt, Human
uccaggucucccacccuggg

SEQ ID NO: 261980 - RNA, 24 nt, Human
ucccagguccagccgaugaugucc

SEQ ID NO: 261981 - RNA, 21 nt, Human
ucccugccgcccccgccgccc

SEQ ID NO: 261982 - RNA, 21 nt, Human
ucuagcccugcuuuucuccac

SEQ ID NO: 261983 - RNA, 20 nt, Human
ugaacagaacaaaggagcau

SEQ ID NO: 261984 - RNA, 18 nt, Human
ugaauauaauguuucuug

SEQ ID NO: 261985 - RNA, 18 nt, Human
ugaauauaauguuucuug

SEQ ID NO: 261986 - RNA, 18 nt, Human
ugagcaguuuuucaaccc

SEQ ID NO: 261987 - RNA, 18 nt, Human
ugagccgaggggcauccc

SEQ ID NO: 261988 - RNA, 18 nt, Human
ugcauagauggcauauuc

SEQ ID NO: 261989 - RNA, 22 nt, Human
ugcuuucugccuacguaaccuc

SEQ ID NO: 261990 - RNA, 19 nt, Human
ugggagaaggaaaggcagg

SEQ ID NO: 261991 - RNA, 21 nt, Human
ugggagaaggaaaggcaggug

SEQ ID NO: 261992 - RNA, 23 nt, Human
ugggagguaagaaggugacuugg

SEQ ID NO: 261993 - RNA, 21 nt, Human
ugggauucaucagaucccagg

SEQ ID NO: 261994 - RNA, 23 nt, Human
ugucgucuuaaagggcugucccc

SEQ ID NO: 261995 - RNA, 21 nt, Human
uuaagcaacagcuccuguacu

SEQ ID NO: 261996 - RNA, 22 nt, Human
uuagcgggcgggcaaaaugggc

SEQ ID NO: 261997 - RNA, 23 nt, Human
uucacuugcaguauucuucauga

SEQ ID NO: 261998 - RNA, 20 nt, Human
uugcugcagggcaaauaagc

SEQ ID NO: 261999 - RNA, 21 nt, Human
aaauuaaucacuucugcaaaa

SEQ ID NO: 262000 - RNA, 24 nt, Human
acaguuccugagaauuaaaaacau

SEQ ID NO: 262001 - RNA, 27 nt, Human
acucuuauaaaaggaagaaauagagac

SEQ ID NO: 262002 - RNA, 24 nt, Human
agaaauagagacuuuacuaaagga

SEQ ID NO: 262003 - RNA, 18 nt, Human
agcaauuccagaagggua

SEQ ID NO: 262004 - RNA, 22 nt, Human
caaagccaccuuuuaacuuccu

SEQ ID NO: 262005 - RNA, 19 nt, Human
caaucuuuuuuuacaggcc

SEQ ID NO: 262006 - RNA, 24 nt, Human
cacucugaccuccucuuuuggcuc

SEQ ID NO: 262007 - RNA, 19 nt, Human
cacuguaguucgcuuuuac

SEQ ID NO: 262008 - RNA, 19 nt, Human
cauuccuuggcucaaggug

SEQ ID NO: 262009 - RNA, 19 nt, Human
ccuccagaaaggcuggaga

SEQ ID NO: 262010 - RNA, 23 nt, Human
cuccugaacugcacccauccacu

SEQ ID NO: 262011 - RNA, 18 nt, Human
cuuuuaaagaucccuaca

SEQ ID NO: 262012 - RNA, 19 nt, Human
gagaaucuguuuccuugcc

SEQ ID NO: 262013 - RNA, 23 nt, Human
gcucaaggugucuuccuccuuca

SEQ ID NO: 262014 - RNA, 20 nt, Human
uaggcccuccaaaguaauuc

SEQ ID NO: 262015 - RNA, 23 nt, Human
uauacaggaucacucugaccucc

SEQ ID NO: 262016 - RNA, 19 nt, Human
ucaaggugucuuccuccuu

SEQ ID NO: 262017 - RNA, 24 nt, Human
ucccuacaauuauauuaggcccuc

SEQ ID NO: 262018 - RNA, 22 nt, Human
ugacucagugguuuaaaacaag

SEQ ID NO: 262019 - RNA, 21 nt, Human
ugucuuccuccuucaaagcca

SEQ ID NO: 262020 - RNA, 20 nt, Human
uguggcauaacauauucaca

SEQ ID NO: 262021 - RNA, 24 nt, Human
uucacaguuccugagaauuaaaaa

SEQ ID NO: 262022 - RNA, 21 nt, Human
aaaacuccugcccgauccaca

SEQ ID NO: 262023 - RNA, 21 nt, Human
aaaagaaggcagaccaccaaa

SEQ ID NO: 262024 - RNA, 18 nt, Human
aaaugacaacaccaucuc

SEQ ID NO: 262025 - RNA, 18 nt, Human
aaccaggaaggcaaggac

SEQ ID NO: 262026 - RNA, 19 nt, Human
aagaaggcagaccaccaaa

SEQ ID NO: 262027 - RNA, 22 nt, Human
aagcccuggcaaccaaccgaga

SEQ ID NO: 262028 - RNA, 22 nt, Human
aagcugccuagggccucugcag

SEQ ID NO: 262029 - RNA, 23 nt, Human
aagcugccuauuugugcugaagc

SEQ ID NO: 262030 - RNA, 21 nt, Human
aauaaagaaaauacgucugaa

SEQ ID NO: 262031 - RNA, 19 nt, Human
acaaaacagcgauguuccc

SEQ ID NO: 262032 - RNA, 21 nt, Human
accaaacagcacuggccauaa

SEQ ID NO: 262033 - RNA, 18 nt, Human
agacagcagucaacaagc

SEQ ID NO: 262034 - RNA, 22 nt, Human
agcaagggucuggccuuccaag

SEQ ID NO: 262035 - RNA, 18 nt, Human
agccagaucaaccccaca

SEQ ID NO: 262036 - RNA, 25 nt, Human
aggaagaaaauaccauuaaaaagaa

SEQ ID NO: 262037 - RNA, 19 nt, Human
aucaaccccacagccugug

SEQ ID NO: 262038 - RNA, 25 nt, Human
augacaacaagcaaaagugacauac

SEQ ID NO: 262039 - RNA, 19 nt, Human
caaaaugcagcccuucugc

SEQ ID NO: 262040 - RNA, 25 nt, Human
caaauuucugacccaugauggcaau

SEQ ID NO: 262041 - RNA, 23 nt, Human
caacacacugaaaacuccugccc

SEQ ID NO: 262042 - RNA, 26 nt, Human
cacaaagaccccagugcaagcgaugg

SEQ ID NO: 262043 - RNA, 23 nt, Human
cacacgucaucaacagacagcag

SEQ ID NO: 262044 - RNA, 19 nt, Human
cacccuuucauuuagaauu

SEQ ID NO: 262045 - RNA, 21 nt, Human
cagauugauggaaaccacacc

SEQ ID NO: 262046 - RNA, 19 nt, Human
cagccugugagccaggccu

SEQ ID NO: 262047 - RNA, 27 nt, Human
caguagauuucuucauccuucaaauuu

SEQ ID NO: 262048 - RNA, 18 nt, Human
ccacaaagaccccagugc

SEQ ID NO: 262049 - RNA, 21 nt, Human
cccaaggaaaauucacugcga

SEQ ID NO: 262050 - RNA, 19 nt, Human
cccugagcaccaccaacac

SEQ ID NO: 262051 - RNA, 20 nt, Human
ccgcuuuucccagaggugag

SEQ ID NO: 262052 - RNA, 24 nt, Human
ccuccugcucacccgcuuuuccca

SEQ ID NO: 262053 - RNA, 23 nt, Human
ccucucugauggagcaaggguug

SEQ ID NO: 262054 - RNA, 21 nt, Human
cgucugaaaggugaggauuuc

SEQ ID NO: 262055 - RNA, 19 nt, Human
cugagcaccaccaacacua

SEQ ID NO: 262056 - RNA, 24 nt, Human
cugcaagcccuggcaaccaaccga

SEQ ID NO: 262057 - RNA, 20 nt, Human
cugcccgauccacaaagacc

SEQ ID NO: 262058 - RNA, 20 nt, Human
gaaaccacacccuuucauuu

SEQ ID NO: 262059 - RNA, 23 nt, Human
gagcaagggucuggccuuccaag

SEQ ID NO: 262060 - RNA, 24 nt, Human
gagcaccaccaacacuaagcacaa

SEQ ID NO: 262061 - RNA, 26 nt, Human
gaggaagaaaauaccauuaaaaagaa

SEQ ID NO: 262062 - RNA, 24 nt, Human
gccuuugccacugcccucucugau

SEQ ID NO: 262063 - RNA, 24 nt, Human
ggaaaauucacugcgaucugcaag

SEQ ID NO: 262064 - RNA, 21 nt, Human
ggacaaaacagcgauguuccc

SEQ ID NO: 262065 - RNA, 21 nt, Human
ggagcaacacccaacacacug

SEQ ID NO: 262066 - RNA, 25 nt, Human
ggccuuaagcugccuauuugugcug

SEQ ID NO: 262067 - RNA, 20 nt, Human
gggcagcaucagauugaugg

SEQ ID NO: 262068 - RNA, 22 nt, Human
guaccucaugccuccugcucac

SEQ ID NO: 262069 - RNA, 25 nt, Human
guugcuagagccugcuuugcacaca

SEQ ID NO: 262070 - RNA, 22 nt, Human
uaaaaagaaggcagaccaccaa

SEQ ID NO: 262071 - RNA, 20 nt, Human
uaaccuuaguuuccaaguuc

SEQ ID NO: 262072 - RNA, 19 nt, Human
uaggacaaaacagcgaugu

SEQ ID NO: 262073 - RNA, 24 nt, Human
ucaaaagacacauaggaaggagca

SEQ ID NO: 262074 - RNA, 25 nt, Human
ucacuggccuuugccacugcccucu

SEQ ID NO: 262075 - RNA, 19 nt, Human
ucugcaagcccuggcaacc

SEQ ID NO: 262076 - RNA, 24 nt, Human
ucugcaagcccuggcaaccaaggu

SEQ ID NO: 262077 - RNA, 19 nt, Human
ucugcagagccagaucaac

SEQ ID NO: 262078 - RNA, 23 nt, Human
ugaaaggugaggauuucaaacag

SEQ ID NO: 262079 - RNA, 23 nt, Human
ugaagcgggcugcagaacgaccc

SEQ ID NO: 262080 - RNA, 20 nt, Human
ugagaaaugaaaacguaaug

SEQ ID NO: 262081 - RNA, 18 nt, Human
ugagccaggccuuaagcu

SEQ ID NO: 262082 - RNA, 20 nt, Human
ugcaagcccuggcaaccaac

SEQ ID NO: 262083 - RNA, 25 nt, Human
ugcagccaaacaguucacuuauaac

SEQ ID NO: 262084 - RNA, 18 nt, Human
ugccuagggccucugcag

SEQ ID NO: 262085 - RNA, 21 nt, Human
ugccuagggccucugcagagc

SEQ ID NO: 262086 - RNA, 18 nt, Human
ugcucagcccaguuguga

SEQ ID NO: 262087 - RNA, 20 nt, Human
uguuguuuuuuuuguuuuuu

SEQ ID NO: 262088 - RNA, 19 nt, Human
uucacugcgaucugcaagc

SEQ ID NO: 262089 - RNA, 20 nt, Human
uuccaaagaauaguuccuua

SEQ ID NO: 262090 - RNA, 21 nt, Human
uuguuguuuuuuuuguuuuuu

SEQ ID NO: 262091 - RNA, 21 nt, Human
uuuuuuuuguuuuuuguuuuu

SEQ ID NO: 262092 - RNA, 22 nt, Human
aaaaggaaacggaaauccagaa

SEQ ID NO: 262093 - RNA, 23 nt, Human
aaacggaaauccagaagggucaa

SEQ ID NO: 262094 - RNA, 23 nt, Human
aaacggaaauccagaaggguccu

SEQ ID NO: 262095 - RNA, 21 nt, Human
aaagcuucuccaaugucauac

SEQ ID NO: 262096 - RNA, 24 nt, Human
aauccagaagggucaaaaaagcuu

SEQ ID NO: 262097 - RNA, 25 nt, Human
acagaaaaggaaacggaaauccaga

SEQ ID NO: 262098 - RNA, 21 nt, Human
ccccgggccccuggauucugc

SEQ ID NO: 262099 - RNA, 23 nt, Human
ccccgggccccuggauucugcuc

SEQ ID NO: 262100 - RNA, 21 nt, Human
ccccuggauucugcucgugcc

SEQ ID NO: 262101 - RNA, 23 nt, Human
cuacagccccgggccccuggauu

SEQ ID NO: 262102 - RNA, 22 nt, Human
gaaauccagaagggucaaaaaa

SEQ ID NO: 262103 - RNA, 24 nt, Human
gaaucuacagccccgggccccugg

SEQ ID NO: 262104 - RNA, 18 nt, Human
uaauggcagucaagacua

SEQ ID NO: 262105 - RNA, 21 nt, Human
ugaguuauuuacauuuuuaau

SEQ ID NO: 262106 - RNA, 22 nt, Human
uuuccggaucuuccaagcuccu

SEQ ID NO: 262107 - RNA, 24 nt, Human
uuuuccggaucuuccaagcuccuc

SEQ ID NO: 262108 - RNA, 22 nt, Human
aaaacaaacaagaaaccauuag

SEQ ID NO: 262109 - RNA, 20 nt, Human
aaaacacccgcgggcugcgg

SEQ ID NO: 262110 - RNA, 18 nt, Human
aaacaaacaagaaaccau

SEQ ID NO: 262111 - RNA, 21 nt, Human
aaguagaaacacagaagaaac

SEQ ID NO: 262112 - RNA, 20 nt, Human
acaacagcccauccggagaa

SEQ ID NO: 262113 - RNA, 23 nt, Human
acacagaagaaacuggauaauuu

SEQ ID NO: 262114 - RNA, 18 nt, Human
acagaaccaaaagcguca

SEQ ID NO: 262115 - RNA, 22 nt, Human
accugcuuaccuugauuucaac

SEQ ID NO: 262116 - RNA, 21 nt, Human
agaagauucugcaaaguugcu

SEQ ID NO: 262117 - RNA, 18 nt, Human
agacaaaaucaacaugca

SEQ ID NO: 262118 - RNA, 22 nt, Human
aggagcuccccgccgucgcugu

SEQ ID NO: 262119 - RNA, 18 nt, Human
aguaaacucccugggccc

SEQ ID NO: 262120 - RNA, 23 nt, Human
aucccgggguacuccccccgagg

SEQ ID NO: 262121 - RNA, 20 nt, Human
caaacaaugcucaggccaug

SEQ ID NO: 262122 - RNA, 19 nt, Human
caacaugcauucacacuuu

SEQ ID NO: 262123 - RNA, 21 nt, Human
caacauucucugagaggaaga

SEQ ID NO: 262124 - RNA, 19 nt, Human
cagaaccaaaagcgucaac

SEQ ID NO: 262125 - RNA, 24 nt, Human
caggcgggcggcugcggggccugc

SEQ ID NO: 262126 - RNA, 24 nt, Human
caggggagccugguuguugcugca

SEQ ID NO: 262127 - RNA, 19 nt, Human
caguaguucucuagagauu

SEQ ID NO: 262128 - RNA, 29 nt, Human
caucuuugcuuuacaacagaaccaaaagg

SEQ ID NO: 262129 - RNA, 19 nt, Human
ccaccugcuuaccuugauu

SEQ ID NO: 262130 - RNA, 25 nt, Human
ccagagcaacauucuccuccuacgg

SEQ ID NO: 262131 - RNA, 18 nt, Human
cccaggacuaugggaacc

SEQ ID NO: 262132 - RNA, 18 nt, Human
ccccaggggcaaaacacc

SEQ ID NO: 262133 - RNA, 19 nt, Human
ccccauugccugcgucucc

SEQ ID NO: 262134 - RNA, 23 nt, Human
ccccgccgucgcugucgcccccc

SEQ ID NO: 262135 - RNA, 18 nt, Human
ccccuaaacauccuuucu

SEQ ID NO: 262136 - RNA, 18 nt, Human
cccugggcccagggaugc

SEQ ID NO: 262137 - RNA, 19 nt, Human
cccugggcccagggaugca

SEQ ID NO: 262138 - RNA, 20 nt, Human
cgcugucgccccccgcgagc

SEQ ID NO: 262139 - RNA, 19 nt, Human
cggggggccuuagaaagac

SEQ ID NO: 262140 - RNA, 23 nt, Human
cguugcaggcgggcggcugcggg

SEQ ID NO: 262141 - RNA, 23 nt, Human
cucaggccaugcaccuccucaga

SEQ ID NO: 262142 - RNA, 23 nt, Human
cucccaggacuaugggaacccaa

SEQ ID NO: 262143 - RNA, 23 nt, Human
cuccccgccgucgcugucgcccc

SEQ ID NO: 262144 - RNA, 19 nt, Human
cucugaguaaacucccugg

SEQ ID NO: 262145 - RNA, 19 nt, Human
cugcucugcccuccgccgc

SEQ ID NO: 262146 - RNA, 20 nt, Human
gaacuugcaacaggauuccu

SEQ ID NO: 262147 - RNA, 21 nt, Human
gaagauucugcaaaguugcuu

SEQ ID NO: 262148 - RNA, 27 nt, Human
gagaacagcaggaggcauccgguaccc

SEQ ID NO: 262149 - RNA, 19 nt, Human
gcagagcagccuccagagc

SEQ ID NO: 262150 - RNA, 21 nt, Human
gcccagggaugcaggggagcc

SEQ ID NO: 262151 - RNA, 22 nt, Human
gcccagggaugcaggggagccu

SEQ ID NO: 262152 - RNA, 21 nt, Human
gcuccccgccgucgcugucgc

SEQ ID NO: 262153 - RNA, 20 nt, Human
gcucugcccuccgccgcccu

SEQ ID NO: 262154 - RNA, 21 nt, Human
ggccuuagaaagacugacagu

SEQ ID NO: 262155 - RNA, 19 nt, Human
ggggagccugguuguugcu

SEQ ID NO: 262156 - RNA, 22 nt, Human
ggguuuucaugcagagcagccu

SEQ ID NO: 262157 - RNA, 21 nt, Human
uaauuugaaaaacaaacaaga

SEQ ID NO: 262158 - RNA, 22 nt, Human
uacaacaauaauuauggagaag

SEQ ID NO: 262159 - RNA, 26 nt, Human
uaucacaacagcccauccggagaacc

SEQ ID NO: 262160 - RNA, 20 nt, Human
uccccgaggagcuccccgcc

SEQ ID NO: 262161 - RNA, 21 nt, Human
uccccgccgucgcugucgccc

SEQ ID NO: 262162 - RNA, 22 nt, Human
ucccgggguacuccccgaggag

SEQ ID NO: 262163 - RNA, 20 nt, Human
uccucugggccagacaaaca

SEQ ID NO: 262164 - RNA, 19 nt, Human
ucuagacuaagacaaaauc

SEQ ID NO: 262165 - RNA, 18 nt, Human
ucucccaggacuauggga

SEQ ID NO: 262166 - RNA, 22 nt, Human
ugcagagcagccuccagagcaa

SEQ ID NO: 262167 - RNA, 27 nt, Human
ugcccuccgccgcccugcagacacucu

SEQ ID NO: 262168 - RNA, 19 nt, Human
ugggaccaugggaacuugc

SEQ ID NO: 262169 - RNA, 22 nt, Human
ugggaggcuccuucgcaggacc

SEQ ID NO: 262170 - RNA, 19 nt, Human
uguugcugcagagccagcc

SEQ ID NO: 262171 - RNA, 23 nt, Human
uuccccuaaacauccuuucuaaa

SEQ ID NO: 262172 - RNA, 22 nt, Human
uucgcaggacccaggcgcccca

SEQ ID NO: 262173 - RNA, 21 nt, Human
uugccugcgucucccgggggg

SEQ ID NO: 262174 - RNA, 23 nt, Human
uuuaagugguaucacaacagccc

SEQ ID NO: 262175 - RNA, 24 nt, Human
uuuuuuuuuuuuuucgacauugga

SEQ ID NO: 262176 - RNA, 24 nt, Human
uuuuuuuuuuuuuuuuucgacauu

SEQ ID NO: 262177 - RNA, 27 nt, Human
uuuuuuuuuuuuuuuuuuuuuucgggg

SEQ ID NO: 262178 - RNA, 23 nt, Human
aaaaauuuguagaaccaguuuuu

SEQ ID NO: 262179 - RNA, 23 nt, Human
aaaacaaaacaaccugaaaaagc

SEQ ID NO: 262180 - RNA, 18 nt, Human
aaaacauuuucuaccccu

SEQ ID NO: 262181 - RNA, 23 nt, Human
aaacaaaacaaccugaaaaagca

SEQ ID NO: 262182 - RNA, 24 nt, Human
aaacaaaacaaccugaaaaagcaa

SEQ ID NO: 262183 - RNA, 19 nt, Human
aaagcaaacggccugguac

SEQ ID NO: 262184 - RNA, 18 nt, Human
aaaugccccaaaugaaag

SEQ ID NO: 262185 - RNA, 20 nt, Human
accgccguugccaggcugcu

SEQ ID NO: 262186 - RNA, 19 nt, Human
agaaugucuaauaaaauuu

SEQ ID NO: 262187 - RNA, 25 nt, Human
agauagcaaauagaacugugcauuu

SEQ ID NO: 262188 - RNA, 22 nt, Human
aggugucaggguuuuccaaaac

SEQ ID NO: 262189 - RNA, 23 nt, Human
aggugucaggguuuuccaaaacc

SEQ ID NO: 262190 - RNA, 20 nt, Human
auuugcgaaaacauuccccu

SEQ ID NO: 262191 - RNA, 18 nt, Human
caagaguuuaagauuaug

SEQ ID NO: 262192 - RNA, 24 nt, Human
cacaauacuucaagaauacgcuca

SEQ ID NO: 262193 - RNA, 21 nt, Human
cauuaaaaaguuuucaugaaa

SEQ ID NO: 262194 - RNA, 22 nt, Human
ccacucaugaugguauaaaagc

SEQ ID NO: 262195 - RNA, 23 nt, Human
ccauauuaguuauaaauaguccu

SEQ ID NO: 262196 - RNA, 21 nt, Human
ccccuaagcagcaggaugcuc

SEQ ID NO: 262197 - RNA, 24 nt, Human
ccccuaagcagcaggaugcucccg

SEQ ID NO: 262198 - RNA, 23 nt, Human
ccgccguugccaggcugcucggc

SEQ ID NO: 262199 - RNA, 18 nt, Human
cgccguugccaggcugcu

SEQ ID NO: 262200 - RNA, 20 nt, Human
cuacuuuuuacaaaugcccc

SEQ ID NO: 262201 - RNA, 22 nt, Human
cucaugcauccaagacgguagc

SEQ ID NO: 262202 - RNA, 24 nt, Human
cuuaauucauugaaaacaaaacca

SEQ ID NO: 262203 - RNA, 19 nt, Human
cuucucuggaaaauuaggg

SEQ ID NO: 262204 - RNA, 23 nt, Human
cuuuuaggcuauuaguauuagcu

SEQ ID NO: 262205 - RNA, 19 nt, Human
gagaccaauuaaacuauga

SEQ ID NO: 262206 - RNA, 18 nt, Human
gaggggaagccaacacca

SEQ ID NO: 262207 - RNA, 21 nt, Human
gcccugucaguuuuuuaaaaa

SEQ ID NO: 262208 - RNA, 22 nt, Human
guuucaauuaagccccccccau

SEQ ID NO: 262209 - RNA, 23 nt, Human
uaaaacaaaacaaccugaaaaag

SEQ ID NO: 262210 - RNA, 26 nt, Human
uaaaacaaaacaaccugaaaaagcaa

SEQ ID NO: 262211 - RNA, 27 nt, Human
uaaaacaaaacaaccugaaaaagcaaa

SEQ ID NO: 262212 - RNA, 21 nt, Human
uaagcagcuucaggaaaaucc

SEQ ID NO: 262213 - RNA, 20 nt, Human
uaaugcggugccaggguccc

SEQ ID NO: 262214 - RNA, 20 nt, Human
uacaucuggggcacugauuu

SEQ ID NO: 262215 - RNA, 22 nt, Human
uacuacuguauuugagaugucu

SEQ ID NO: 262216 - RNA, 19 nt, Human
uacuucaagaauacgcuca

SEQ ID NO: 262217 - RNA, 21 nt, Human
uagcaauagcucaugcaucca

SEQ ID NO: 262218 - RNA, 23 nt, Human
uagcuuuuacaaauauacuuaau

SEQ ID NO: 262219 - RNA, 23 nt, Human
uccaaaaccucaucucagcuccu

SEQ ID NO: 262220 - RNA, 23 nt, Human
uccacaaacauauauccccuuug

SEQ ID NO: 262221 - RNA, 26 nt, Human
ucuuucaaaaacugcuuuuuaaaggu

SEQ ID NO: 262222 - RNA, 23 nt, Human
ugaaaaacucaucuauacagcua

SEQ ID NO: 262223 - RNA, 20 nt, Human
ugaauuaguucagauagcaa

SEQ ID NO: 262224 - RNA, 21 nt, Human
ugacuagagcaacauuugcga

SEQ ID NO: 262225 - RNA, 21 nt, Human
ugagaugucuuacuugggaga

SEQ ID NO: 262226 - RNA, 19 nt, Human
ugagcucaauuugguuuug

SEQ ID NO: 262227 - RNA, 21 nt, Human
ugagcuggacugacuagagca

SEQ ID NO: 262228 - RNA, 22 nt, Human
ugcauccaagacgguagcccua

SEQ ID NO: 262229 - RNA, 20 nt, Human
ugcauuuaaaauuucacuua

SEQ ID NO: 262230 - RNA, 19 nt, Human
uggcaauuacuuaaacacc

SEQ ID NO: 262231 - RNA, 24 nt, Human
uggggaggggaagccaacaccauu

SEQ ID NO: 262232 - RNA, 22 nt, Human
uggggcacugauuucuaaggau

SEQ ID NO: 262233 - RNA, 20 nt, Human
ugggguggggaggggaagcc

SEQ ID NO: 262234 - RNA, 19 nt, Human
ugugcauuuaaaauuucac

SEQ ID NO: 262235 - RNA, 21 nt, Human
uguuucaauuaagcccccccc

SEQ ID NO: 262236 - RNA, 25 nt, Human
uuaaaaauauaaaaauaggcuucuc

SEQ ID NO: 262237 - RNA, 21 nt, Human
uuccgaauuuuaggcaagcuc

SEQ ID NO: 262238 - RNA, 24 nt, Human
uucuuguaauauguauucuagaag

SEQ ID NO: 262239 - RNA, 20 nt, Human
uugccaggcugcucggcugc

SEQ ID NO: 262240 - RNA, 22 nt, Human
uugguuuuggcaguaacaugca

SEQ ID NO: 262241 - RNA, 23 nt, Human
uuucacauuuggauucaucuuag

SEQ ID NO: 262242 - RNA, 25 nt, Human
uuugccacaacccgaaaaccauucc

SEQ ID NO: 262243 - RNA, 18 nt, Human
uuugcgaaaacauucccc

SEQ ID NO: 262244 - RNA, 20 nt, Human
uuuuccaaaaccucaucuca

SEQ ID NO: 262245 - RNA, 18 nt, Human
aaaaaagaccagggagca

SEQ ID NO: 262246 - RNA, 21 nt, Human
aaacaguucugcgcuaggaac

SEQ ID NO: 262247 - RNA, 25 nt, Human
acagagccccccccagccuccgcca

SEQ ID NO: 262248 - RNA, 23 nt, Human
aggaacauacaaaggaaaaugac

SEQ ID NO: 262249 - RNA, 19 nt, Human
auguuauuuuauuaccgau

SEQ ID NO: 262250 - RNA, 24 nt, Human
cacuccaggcaccagcucccccca

SEQ ID NO: 262251 - RNA, 20 nt, Human
cagagccccccccagccucc

SEQ ID NO: 262252 - RNA, 23 nt, Human
cagagccccccccagccuccgcc

SEQ ID NO: 262253 - RNA, 20 nt, Human
cagaugagacaaauacaaua

SEQ ID NO: 262254 - RNA, 19 nt, Human
cagcuuauuuccaucccuu

SEQ ID NO: 262255 - RNA, 20 nt, Human
caggugaggugcacagggcc

SEQ ID NO: 262256 - RNA, 20 nt, Human
cauacaaaggaaaaugaccc

SEQ ID NO: 262257 - RNA, 23 nt, Human
cccgaggaggccuccugccgccc

SEQ ID NO: 262258 - RNA, 19 nt, Human
cccgccgccgccgccgccg

SEQ ID NO: 262259 - RNA, 21 nt, Human
ccgccgcccucgcagcccgcc

SEQ ID NO: 262260 - RNA, 22 nt, Human
ccgccgccgccgccgccgccgg

SEQ ID NO: 262261 - RNA, 21 nt, Human
ccugccgcccgccggccccgg

SEQ ID NO: 262262 - RNA, 24 nt, Human
cgccggccccggguucgggccccc

SEQ ID NO: 262263 - RNA, 21 nt, Human
cggccccggguucgggccccc

SEQ ID NO: 262264 - RNA, 18 nt, Human
cggcgguggcgccccccu

SEQ ID NO: 262265 - RNA, 22 nt, Human
cuccacgcugggcugccgggag

SEQ ID NO: 262266 - RNA, 25 nt, Human
cuuguaaucucuggacacauuuucu

SEQ ID NO: 262267 - RNA, 22 nt, Human
gacagagccccccccagccucc

SEQ ID NO: 262268 - RNA, 20 nt, Human
gauccugugggacuguccag

SEQ ID NO: 262269 - RNA, 22 nt, Human
gauccugugggacuguccaggg

SEQ ID NO: 262270 - RNA, 20 nt, Human
gccccggguucgggcccccg

SEQ ID NO: 262271 - RNA, 19 nt, Human
gccggcgguggcgcccccc

SEQ ID NO: 262272 - RNA, 23 nt, Human
gcgguggcgccccccgcggcccg

SEQ ID NO: 262273 - RNA, 26 nt, Human
ggcgguggcgccccccgcggcccgag

SEQ ID NO: 262274 - RNA, 23 nt, Human
guagcagcuauaagcuguuuaca

SEQ ID NO: 262275 - RNA, 25 nt, Human
uaaaaaagaccagggagcaaacaua

SEQ ID NO: 262276 - RNA, 23 nt, Human
uaaaacaaaaauugcuuagauaa

SEQ ID NO: 262277 - RNA, 24 nt, Human
uaaaucacauaaaguuaguuacuu

SEQ ID NO: 262278 - RNA, 18 nt, Human
uacaaaggaaaaugaccc

SEQ ID NO: 262279 - RNA, 18 nt, Human
uacaccauucaacaugug

SEQ ID NO: 262280 - RNA, 20 nt, Human
uacacuuacuuacuuaaaac

SEQ ID NO: 262281 - RNA, 18 nt, Human
uacagugcaacagaugag

SEQ ID NO: 262282 - RNA, 22 nt, Human
uagaaacaguucugcgcuagga

SEQ ID NO: 262283 - RNA, 20 nt, Human
uaggguccugcugacagagc

SEQ ID NO: 262284 - RNA, 22 nt, Human
ucaacaugugauccugugggac

SEQ ID NO: 262285 - RNA, 28 nt, Human
ucccuuagagccuuguaaucccaaaccg

SEQ ID NO: 262286 - RNA, 27 nt, Human
ucccuuagagccuuguaaucccaaacg

SEQ ID NO: 262287 - RNA, 29 nt, Human
ucgcagcccgccgccgccgccgccgccgg

SEQ ID NO: 262288 - RNA, 20 nt, Human
ucgggcccccgccgcccucg

SEQ ID NO: 262289 - RNA, 20 nt, Human
ucuccucuaggguccugcug

SEQ ID NO: 262290 - RNA, 23 nt, Human
ucugcgcuaggaacauacaaagg

SEQ ID NO: 262291 - RNA, 19 nt, Human
ugaaccugaaaucugacua

SEQ ID NO: 262292 - RNA, 20 nt, Human
uguccagggucuccacgcug

SEQ ID NO: 262293 - RNA, 19 nt, Human
uuagaaacaguucugcgcu

SEQ ID NO: 262294 - RNA, 19 nt, Human
uucaaguuguuuuagaaac

SEQ ID NO: 262295 - RNA, 23 nt, Human
uugacgcacaguaaacauucaau

SEQ ID NO: 262296 - RNA, 27 nt, Human
aaaaaagaaaaaccuagaauggagaaa

SEQ ID NO: 262297 - RNA, 24 nt, Human
aaaaguugagguaugcagagacua

SEQ ID NO: 262298 - RNA, 19 nt, Human
aaauaggaauuagucacaa

SEQ ID NO: 262299 - RNA, 21 nt, Human
aaauuacaccugcacaaccaa

SEQ ID NO: 262300 - RNA, 19 nt, Human
aacuucccaaaggaagaga

SEQ ID NO: 262301 - RNA, 22 nt, Human
aagugaucaagguaaaucaguu

SEQ ID NO: 262302 - RNA, 19 nt, Human
aauacaucuuuuacaugca

SEQ ID NO: 262303 - RNA, 23 nt, Human
aauugggcuaaucugaagggcau

SEQ ID NO: 262304 - RNA, 18 nt, Human
aauuuuguaacccuaauc

SEQ ID NO: 262305 - RNA, 22 nt, Human
acagaauucagaaaaaauguca

SEQ ID NO: 262306 - RNA, 19 nt, Human
accagcaccaaacucuuac

SEQ ID NO: 262307 - RNA, 21 nt, Human
agaaauggcaacuuuggacaa

SEQ ID NO: 262308 - RNA, 23 nt, Human
agaggaagguggggaugucagag

SEQ ID NO: 262309 - RNA, 19 nt, Human
agagugcaccgcgccugua

SEQ ID NO: 262310 - RNA, 22 nt, Human
agcauugguacguaaaaguuga

SEQ ID NO: 262311 - RNA, 18 nt, Human
agcgccggcccgggaggg

SEQ ID NO: 262312 - RNA, 24 nt, Human
aggaaucugcagauuacaugaggc

SEQ ID NO: 262313 - RNA, 21 nt, Human
aggcaggaaucugcagauuac

SEQ ID NO: 262314 - RNA, 26 nt, Human
aggcaggaaucugcagauuacaugag

SEQ ID NO: 262315 - RNA, 23 nt, Human
aguaagauuuuuaaauacuucuu

SEQ ID NO: 262316 - RNA, 20 nt, Human
aguagaaagcuuaauuuuua

SEQ ID NO: 262317 - RNA, 23 nt, Human
agucaaauguuucuaccagcacc

SEQ ID NO: 262318 - RNA, 19 nt, Human
auagaaauuuccucacugc

SEQ ID NO: 262319 - RNA, 22 nt, Human
auagaaauuuccucacugcaag

SEQ ID NO: 262320 - RNA, 24 nt, Human
aucaguuacugaaaaaaagaaaaa

SEQ ID NO: 262321 - RNA, 26 nt, Human
aucaguuacugaaaaaaagaaaaacc

SEQ ID NO: 262322 - RNA, 20 nt, Human
augaugccccugaucuuaca

SEQ ID NO: 262323 - RNA, 21 nt, Human
caagaacaaaguuuaaaaguc

SEQ ID NO: 262324 - RNA, 19 nt, Human
caagacaagugaaauacac

SEQ ID NO: 262325 - RNA, 20 nt, Human
caagacaagugaaauacacu

SEQ ID NO: 262326 - RNA, 18 nt, Human
caagacagacugaaccaa

SEQ ID NO: 262327 - RNA, 22 nt, Human
caagacagacugaaccaaagug

SEQ ID NO: 262328 - RNA, 21 nt, Human
caagaccaagagggaggcuaa

SEQ ID NO: 262329 - RNA, 26 nt, Human
cacaagacagacugaaccaaaguggg

SEQ ID NO: 262330 - RNA, 19 nt, Human
cacacaagacaagugaaau

SEQ ID NO: 262331 - RNA, 26 nt, Human
cacugcgcagcucagacgccggcugg

SEQ ID NO: 262332 - RNA, 18 nt, Human
cagcacagggaaaggcug

SEQ ID NO: 262333 - RNA, 22 nt, Human
cagugcuaugggggcacagagg

SEQ ID NO: 262334 - RNA, 20 nt, Human
caucuggucuuggggaaagg

SEQ ID NO: 262335 - RNA, 23 nt, Human
ccaaaggaagagaugaugccuaa

SEQ ID NO: 262336 - RNA, 19 nt, Human
cccaagugcauguacucca

SEQ ID NO: 262337 - RNA, 21 nt, Human
cccacacacaccagugguaua

SEQ ID NO: 262338 - RNA, 22 nt, Human
ccggaagcggccauguuccccc

SEQ ID NO: 262339 - RNA, 21 nt, Human
ccggcaucgacucuccgugcu

SEQ ID NO: 262340 - RNA, 18 nt, Human
ccuccucccucccuccca

SEQ ID NO: 262341 - RNA, 25 nt, Human
ccugcacaaccaauagacauacgaa

SEQ ID NO: 262342 - RNA, 19 nt, Human
cggcccgggagggagaccg

SEQ ID NO: 262343 - RNA, 19 nt, Human
cggcucccagggugagggg

SEQ ID NO: 262344 - RNA, 21 nt, Human
cgggagggaugaaggaccaga

SEQ ID NO: 262345 - RNA, 22 nt, Human
cucagcagagaagugguagggu

SEQ ID NO: 262346 - RNA, 19 nt, Human
cuccccuucauuuuccccc

SEQ ID NO: 262347 - RNA, 22 nt, Human
cuguaggcugcugggcagcggg

SEQ ID NO: 262348 - RNA, 18 nt, Human
gaaaaaaaagaaauggca

SEQ ID NO: 262349 - RNA, 18 nt, Human
gaagcggagggcggagug

SEQ ID NO: 262350 - RNA, 19 nt, Human
gaccggggccgcagucagg

SEQ ID NO: 262351 - RNA, 23 nt, Human
gaggaaaauggcagaugcauuug

SEQ ID NO: 262352 - RNA, 18 nt, Human
gagggggucuggugaagc

SEQ ID NO: 262353 - RNA, 22 nt, Human
gcacagggaaaggcugaagcag

SEQ ID NO: 262354 - RNA, 19 nt, Human
gcggagggcggagugcuac

SEQ ID NO: 262355 - RNA, 25 nt, Human
ggaaaaaaaagaaauggcaacuuug

SEQ ID NO: 262356 - RNA, 25 nt, Human
ggagggcggagugcuacggaccggg

SEQ ID NO: 262357 - RNA, 21 nt, Human
ggagguggcggcucccagggu

SEQ ID NO: 262358 - RNA, 20 nt, Human
ggcacagaggaaggugggga

SEQ ID NO: 262359 - RNA, 20 nt, Human
ggcaggggcagcacagggaa

SEQ ID NO: 262360 - RNA, 18 nt, Human
gggcacagaggaaggugg

SEQ ID NO: 262361 - RNA, 19 nt, Human
gggccgcagucaggccagc

SEQ ID NO: 262362 - RNA, 22 nt, Human
ggggaaaaaaaagaaauggcaa

SEQ ID NO: 262363 - RNA, 18 nt, Human
ggggaaagggagguggcg

SEQ ID NO: 262364 - RNA, 20 nt, Human
ggggaugucagagaaggcag

SEQ ID NO: 262365 - RNA, 24 nt, Human
gguguugguuaaggaaaaaugggu

SEQ ID NO: 262366 - RNA, 23 nt, Human
uaaaauaucuuucaugauguuuc

SEQ ID NO: 262367 - RNA, 18 nt, Human
uaaagugacugaacuuuc

SEQ ID NO: 262368 - RNA, 19 nt, Human
uaaaugcccuguuaaaaag

SEQ ID NO: 262369 - RNA, 21 nt, Human
uaaggaaaaauggguacaaac

SEQ ID NO: 262370 - RNA, 21 nt, Human
uacuucacuuaagccaccugc

SEQ ID NO: 262371 - RNA, 24 nt, Human
uacuucacuuaagccaccugcacu

SEQ ID NO: 262372 - RNA, 24 nt, Human
uacuuggaguagaaagcuuaauuu

SEQ ID NO: 262373 - RNA, 26 nt, Human
uagaauaaaauagacaucagagucaa

SEQ ID NO: 262374 - RNA, 26 nt, Human
uagaauggagaaagggauaucaaaug

SEQ ID NO: 262375 - RNA, 22 nt, Human
uauguagaauaaaauagacauc

SEQ ID NO: 262376 - RNA, 24 nt, Human
uauguuuacagacuugugguagac

SEQ ID NO: 262377 - RNA, 22 nt, Human
uauuccuccucccucccuccca

SEQ ID NO: 262378 - RNA, 22 nt, Human
ucagaaaaaaugucaauccuag

SEQ ID NO: 262379 - RNA, 25 nt, Human
ucccccaagcacaucuauaaggccu

SEQ ID NO: 262380 - RNA, 26 nt, Human
ucccccagagugcaccgcgccuguag

SEQ ID NO: 262381 - RNA, 20 nt, Human
uccgugcuggcuguguccgg

SEQ ID NO: 262382 - RNA, 21 nt, Human
uccucacugcaagaccaagag

SEQ ID NO: 262383 - RNA, 23 nt, Human
ucuagaaaauaggaauuagucac

SEQ ID NO: 262384 - RNA, 18 nt, Human
ucuggggaaaaaaaagaa

SEQ ID NO: 262385 - RNA, 19 nt, Human
ucuuuggauacuuaaaaga

SEQ ID NO: 262386 - RNA, 21 nt, Human
ucuuuggauacuuaaaagauu

SEQ ID NO: 262387 - RNA, 18 nt, Human
ugaacagcagaguagcau

SEQ ID NO: 262388 - RNA, 21 nt, Human
ugaaguggaugcaaguauguu

SEQ ID NO: 262389 - RNA, 23 nt, Human
ugaggcaauugugaacagcagag

SEQ ID NO: 262390 - RNA, 23 nt, Human
ugagggggucuggugaagcggga

SEQ ID NO: 262391 - RNA, 20 nt, Human
ugauuuggguguugguuaag

SEQ ID NO: 262392 - RNA, 22 nt, Human
ugcacaaccaauagacauacga

SEQ ID NO: 262393 - RNA, 18 nt, Human
ugccacagaauuucagug

SEQ ID NO: 262394 - RNA, 22 nt, Human
ugccacagaauuucaguguugg

SEQ ID NO: 262395 - RNA, 21 nt, Human
ugcugggcagcgggaagaccc

SEQ ID NO: 262396 - RNA, 19 nt, Human
uggggaaagggagguggcg

SEQ ID NO: 262397 - RNA, 18 nt, Human
ugggggcacagaggaagg

SEQ ID NO: 262398 - RNA, 23 nt, Human
ugguaguagcgguauacacagug

SEQ ID NO: 262399 - RNA, 18 nt, Human
ugugguaucaggccaaga

SEQ ID NO: 262400 - RNA, 24 nt, Human
uucaaauaagguuauguuuacaga

SEQ ID NO: 262401 - RNA, 25 nt, Human
uucucacuauaagcuauuuauacag

SEQ ID NO: 262402 - RNA, 29 nt, Human
uugccuuuuaauagaaacuuguucccacu

SEQ ID NO: 262403 - RNA, 24 nt, Human
uuuaauauuaccagaugccaaaaa

SEQ ID NO: 262404 - RNA, 24 nt, Human
uuucacacaauuaccaaagaaauc

SEQ ID NO: 262405 - RNA, 19 nt, Human
uuuccaaauauuucugggg

SEQ ID NO: 262406 - RNA, 21 nt, Human
uuuuuaauuacugauuugcua

SEQ ID NO: 262407 - RNA, 24 nt, Human
aaacauuuugaccagucuguacuc

SEQ ID NO: 262408 - RNA, 22 nt, Human
aaccuaacucuucuccaaccuu

SEQ ID NO: 262409 - RNA, 19 nt, Human
aagaaacaagccaucccuc

SEQ ID NO: 262410 - RNA, 20 nt, Human
aagacaaucugggucaaguu

SEQ ID NO: 262411 - RNA, 22 nt, Human
aagauuacaaagcacaaaccua

SEQ ID NO: 262412 - RNA, 18 nt, Human
aagcauggccuccccaag

SEQ ID NO: 262413 - RNA, 24 nt, Human
aaggagcccaagacaaucuggguc

SEQ ID NO: 262414 - RNA, 23 nt, Human
aaguggcccuucacugcuggcca

SEQ ID NO: 262415 - RNA, 18 nt, Human
acaagugcccacucagac

SEQ ID NO: 262416 - RNA, 24 nt, Human
acagcaggcagcucggcaguuaca

SEQ ID NO: 262417 - RNA, 20 nt, Human
acaggugguuccacgcuccc

SEQ ID NO: 262418 - RNA, 21 nt, Human
acccaggugugucugggcuca

SEQ ID NO: 262419 - RNA, 24 nt, Human
acugcauaaacauuuugaccaguc

SEQ ID NO: 262420 - RNA, 21 nt, Human
agacagccaggaguggcaaag

SEQ ID NO: 262421 - RNA, 23 nt, Human
agacagccaggaguggcaaaggg

SEQ ID NO: 262422 - RNA, 22 nt, Human
agagaagaggagaaaggcugau

SEQ ID NO: 262423 - RNA, 20 nt, Human
agcaccagggaagccuucug

SEQ ID NO: 262424 - RNA, 21 nt, Human
agccaggaguggcaaaggggg

SEQ ID NO: 262425 - RNA, 22 nt, Human
aggccccagaauggggacccag

SEQ ID NO: 262426 - RNA, 25 nt, Human
agucuggauuucccugugcuggcug

SEQ ID NO: 262427 - RNA, 22 nt, Human
agugcccacucagacagccagg

SEQ ID NO: 262428 - RNA, 21 nt, Human
aucaaaaaagagcuaagagcu

SEQ ID NO: 262429 - RNA, 22 nt, Human
aucuacaauccaguggugcauc

SEQ ID NO: 262430 - RNA, 18 nt, Human
augccaagauuacaaagc

SEQ ID NO: 262431 - RNA, 24 nt, Human
caaaaaaugaaaaauauaggagca

SEQ ID NO: 262432 - RNA, 22 nt, Human
caaaccuaacucuucuccaacc

SEQ ID NO: 262433 - RNA, 26 nt, Human
caagaacuuuuucuacuaggagguuu

SEQ ID NO: 262434 - RNA, 21 nt, Human
cacacccaggcaugcacagaa

SEQ ID NO: 262435 - RNA, 27 nt, Human
cacacccaggcaugcacagaaccaccu

SEQ ID NO: 262436 - RNA, 24 nt, Human
cacagaaccaccuuccugagacac

SEQ ID NO: 262437 - RNA, 26 nt, Human
cacagccuggcccaggaaagcagccc

SEQ ID NO: 262438 - RNA, 21 nt, Human
caccauccucccacccggaag

SEQ ID NO: 262439 - RNA, 24 nt, Human
caccaugauccacccugucaccag

SEQ ID NO: 262440 - RNA, 21 nt, Human
caccccaccaggcucccugcc

SEQ ID NO: 262441 - RNA, 20 nt, Human
cacugcuggccagcagccag

SEQ ID NO: 262442 - RNA, 24 nt, Human
cacuguacaucagacccaagaaac

SEQ ID NO: 262443 - RNA, 23 nt, Human
cagaauggggacccagguguguc

SEQ ID NO: 262444 - RNA, 19 nt, Human
cagcagcaaaggguuccca

SEQ ID NO: 262445 - RNA, 23 nt, Human
cagcuuggccacugcccacccag

SEQ ID NO: 262446 - RNA, 18 nt, Human
caggcaugcacagaacca

SEQ ID NO: 262447 - RNA, 18 nt, Human
caggugguuccacgcucc

SEQ ID NO: 262448 - RNA, 21 nt, Human
caucccucagugucacgugac

SEQ ID NO: 262449 - RNA, 21 nt, Human
ccaagagggagggcaggcaca

SEQ ID NO: 262450 - RNA, 24 nt, Human
ccacacccaggcaugcacagaacc

SEQ ID NO: 262451 - RNA, 22 nt, Human
ccaccccaccaggcucccugcc

SEQ ID NO: 262452 - RNA, 22 nt, Human
cccaagacaaucugggucaagu

SEQ ID NO: 262453 - RNA, 20 nt, Human
cccacaccuaccuccacaaa

SEQ ID NO: 262454 - RNA, 23 nt, Human
cccaggaaagcagcccccugaaa

SEQ ID NO: 262455 - RNA, 18 nt, Human
cccaggugugucugggcu

SEQ ID NO: 262456 - RNA, 22 nt, Human
ccccaccaggcucccugccagg

SEQ ID NO: 262457 - RNA, 19 nt, Human
cccccuccgccaccccacc

SEQ ID NO: 262458 - RNA, 18 nt, Human
ccccucgccugccucaaa

SEQ ID NO: 262459 - RNA, 24 nt, Human
cccuaguccucaccaugauccacc

SEQ ID NO: 262460 - RNA, 18 nt, Human
cccugaaaguaaaaggag

SEQ ID NO: 262461 - RNA, 21 nt, Human
ccucuuggcaccugucacuag

SEQ ID NO: 262462 - RNA, 20 nt, Human
ccugucauaggaacagcagc

SEQ ID NO: 262463 - RNA, 24 nt, Human
cgaggcccuccacggcacagucuc

SEQ ID NO: 262464 - RNA, 24 nt, Human
cgcugggcagcgccugagccgcug

SEQ ID NO: 262465 - RNA, 20 nt, Human
cggcuacccacucccagccc

SEQ ID NO: 262466 - RNA, 19 nt, Human
cuccaaccuuccccacacc

SEQ ID NO: 262467 - RNA, 19 nt, Human
cucccacccggaagaaaca

SEQ ID NO: 262468 - RNA, 19 nt, Human
cucccagccccucgccugc

SEQ ID NO: 262469 - RNA, 18 nt, Human
cuccgccaccccaccagg

SEQ ID NO: 262470 - RNA, 18 nt, Human
cuccuggcucugaccacc

SEQ ID NO: 262471 - RNA, 28 nt, Human
cuccuggcucugaccaccauccucccac

SEQ ID NO: 262472 - RNA, 22 nt, Human
cucucuucuuucccuuauggug

SEQ ID NO: 262473 - RNA, 21 nt, Human
cugaccaccauccucccaccc

SEQ ID NO: 262474 - RNA, 18 nt, Human
cugcccagguugaguggg

SEQ ID NO: 262475 - RNA, 21 nt, Human
cuggcccaggaaagcagcccc

SEQ ID NO: 262476 - RNA, 20 nt, Human
cuggcugaggaagagauugu

SEQ ID NO: 262477 - RNA, 22 nt, Human
cugggccacgccuuaaccacac

SEQ ID NO: 262478 - RNA, 24 nt, Human
cugggccacgccuuaaccacaccc

SEQ ID NO: 262479 - RNA, 23 nt, Human
gacaaaaaaugaaaaauauagga

SEQ ID NO: 262480 - RNA, 24 nt, Human
gaggauggaaaagguagggaggga

SEQ ID NO: 262481 - RNA, 19 nt, Human
gagugggccugucauagga

SEQ ID NO: 262482 - RNA, 23 nt, Human
gaugacacagaauguggaaaaga

SEQ ID NO: 262483 - RNA, 26 nt, Human
ggaaaugcacaaucuucaauuagacc

SEQ ID NO: 262484 - RNA, 23 nt, Human
ggaagaggaauacagggcagggc

SEQ ID NO: 262485 - RNA, 22 nt, Human
ggaagucagagacgugcucaga

SEQ ID NO: 262486 - RNA, 20 nt, Human
ggagcacugacugacuccuc

SEQ ID NO: 262487 - RNA, 22 nt, Human
ggcacagucucccccuccgcca

SEQ ID NO: 262488 - RNA, 23 nt, Human
ggcagugcucuuggggaauaugc

SEQ ID NO: 262489 - RNA, 21 nt, Human
gggaagaggaauacagggcag

SEQ ID NO: 262490 - RNA, 21 nt, Human
gggacccaggugugucugggc

SEQ ID NO: 262491 - RNA, 19 nt, Human
gggcagugcucuuggggaa

SEQ ID NO: 262492 - RNA, 20 nt, Human
gggccucucggucugcccag

SEQ ID NO: 262493 - RNA, 20 nt, Human
ggggaauaugcuuccagccu

SEQ ID NO: 262494 - RNA, 22 nt, Human
guacaggugguuccacgcuccc

SEQ ID NO: 262495 - RNA, 21 nt, Human
gucaagcauggccuccccaag

SEQ ID NO: 262496 - RNA, 20 nt, Human
gucugcccagguugaguggg

SEQ ID NO: 262497 - RNA, 23 nt, Human
gugccucucccuccaaacaucag

SEQ ID NO: 262498 - RNA, 21 nt, Human
ucagcagagucaagcauggcc

SEQ ID NO: 262499 - RNA, 20 nt, Human
ucagccucauuuauccaucu

SEQ ID NO: 262500 - RNA, 19 nt, Human
ucaucgaucaaaaaagagc

SEQ ID NO: 262501 - RNA, 18 nt, Human
uccaaagugcacgggccu

SEQ ID NO: 262502 - RNA, 23 nt, Human
uccacggcacagucucccccucc

SEQ ID NO: 262503 - RNA, 24 nt, Human
uccaucaaaaaaaaaaaaaauuaa

SEQ ID NO: 262504 - RNA, 22 nt, Human
uccccacaccuaccuccacaaa

SEQ ID NO: 262505 - RNA, 23 nt, Human
uccccagcagcaaaggguuccca

SEQ ID NO: 262506 - RNA, 23 nt, Human
ucccugaccuuaccccuaguccu

SEQ ID NO: 262507 - RNA, 25 nt, Human
ucuaaaguauuuacuucuugcuuug

SEQ ID NO: 262508 - RNA, 18 nt, Human
ucugauguggcgguggcg

SEQ ID NO: 262509 - RNA, 20 nt, Human
ucuggaacccugagucugga

SEQ ID NO: 262510 - RNA, 26 nt, Human
ucuggaacccugagucuggauuuccc

SEQ ID NO: 262511 - RNA, 23 nt, Human
ucuuccaucaaaaaaaaaaaaaa

SEQ ID NO: 262512 - RNA, 21 nt, Human
ucuucuccaaccuuccccaca

SEQ ID NO: 262513 - RNA, 22 nt, Human
ugacaaaaaaugaaaaauauag

SEQ ID NO: 262514 - RNA, 24 nt, Human
ugacaaaaaaugaaaaauauagga

SEQ ID NO: 262515 - RNA, 21 nt, Human
ugacacagaauguggaaaaga

SEQ ID NO: 262516 - RNA, 25 nt, Human
ugacacagaauguggaaaagaacua

SEQ ID NO: 262517 - RNA, 20 nt, Human
ugaccuuaccccuaguccuc

SEQ ID NO: 262518 - RNA, 19 nt, Human
ugagggugggaagugcuac

SEQ ID NO: 262519 - RNA, 20 nt, Human
ugaugcccagggcagugcuc

SEQ ID NO: 262520 - RNA, 22 nt, Human
ugccaagauuacaaagcacaaa

SEQ ID NO: 262521 - RNA, 26 nt, Human
ugccaagauuacaaagcacaaaccua

SEQ ID NO: 262522 - RNA, 21 nt, Human
ugcccagguugagugggccug

SEQ ID NO: 262523 - RNA, 21 nt, Human
ugcccugaaucuccucaaggc

SEQ ID NO: 262524 - RNA, 23 nt, Human
ugccuggacugagagcaccaggg

SEQ ID NO: 262525 - RNA, 27 nt, Human
ugccuggacugagagcaccagggaagc

SEQ ID NO: 262526 - RNA, 19 nt, Human
ugcuacacagccuggccca

SEQ ID NO: 262527 - RNA, 19 nt, Human
ugcucccuuuuccaggggc

SEQ ID NO: 262528 - RNA, 22 nt, Human
uggagaguuacgguuccuccuu

SEQ ID NO: 262529 - RNA, 18 nt, Human
uggcucugaccaccaucc

SEQ ID NO: 262530 - RNA, 18 nt, Human
uggcuuucuucccugcuc

SEQ ID NO: 262531 - RNA, 19 nt, Human
ugggaagugcuacacagcc

SEQ ID NO: 262532 - RNA, 22 nt, Human
uguacagcuauggagaguuacg

SEQ ID NO: 262533 - RNA, 26 nt, Human
ugugcuggcugaggaagagauuguuu

SEQ ID NO: 262534 - RNA, 25 nt, Human
uguggaaaagaacuacacccuguuu

SEQ ID NO: 262535 - RNA, 24 nt, Human
uuaccgugugccucucccuccaaa

SEQ ID NO: 262536 - RNA, 23 nt, Human
uuuaccgugugccucucccucca

SEQ ID NO: 262537 - RNA, 20 nt, Human
uuucagcagagucaagcaug

SEQ ID NO: 262538 - RNA, 18 nt, Human
aaaacaaaacaaaaaauc

SEQ ID NO: 262539 - RNA, 23 nt, Human
aaacaaaacaaggcugaccagaa

SEQ ID NO: 262540 - RNA, 26 nt, Human
aaccacaaaauaagaaucaauggaau

SEQ ID NO: 262541 - RNA, 21 nt, Human
aaccagaguugaauacaagaa

SEQ ID NO: 262542 - RNA, 21 nt, Human
aagaagaaaaauaaugcucca

SEQ ID NO: 262543 - RNA, 24 nt, Human
aauacaaaaguggggcaggcuaaa

SEQ ID NO: 262544 - RNA, 22 nt, Human
acaaaauaagaaucaauggaau

SEQ ID NO: 262545 - RNA, 21 nt, Human
acacuaugcaaauugccuaau

SEQ ID NO: 262546 - RNA, 25 nt, Human
acacuuccaaacacacugaacauaa

SEQ ID NO: 262547 - RNA, 25 nt, Human
accauacggcuacagaaacagggcu

SEQ ID NO: 262548 - RNA, 22 nt, Human
agaagaaaaacaaaacaaaaaa

SEQ ID NO: 262549 - RNA, 21 nt, Human
agcgacagagagcaagcggga

SEQ ID NO: 262550 - RNA, 18 nt, Human
agcguguguggaccgaga

SEQ ID NO: 262551 - RNA, 21 nt, Human
auauaaacacacaaauauaug

SEQ ID NO: 262552 - RNA, 24 nt, Human
aucauugcagaaaaaacucuauga

SEQ ID NO: 262553 - RNA, 23 nt, Human
caaaccccgcggccucccggggg

SEQ ID NO: 262554 - RNA, 26 nt, Human
caaauaccacucauuucuuacagaac

SEQ ID NO: 262555 - RNA, 21 nt, Human
caagaagaaaaauaaugcucc

SEQ ID NO: 262556 - RNA, 18 nt, Human
caccauguuauuuaaauu

SEQ ID NO: 262557 - RNA, 24 nt, Human
cacccccagcaguaaugagagcac

SEQ ID NO: 262558 - RNA, 18 nt, Human
cagaaaaaacucuaugag

SEQ ID NO: 262559 - RNA, 19 nt, Human
cagaagauucuaaaaccac

SEQ ID NO: 262560 - RNA, 18 nt, Human
cagccacagaagauucua

SEQ ID NO: 262561 - RNA, 19 nt, Human
cagcgcccccugcuggagg

SEQ ID NO: 262562 - RNA, 19 nt, Human
cagucugcuuuugccaaca

SEQ ID NO: 262563 - RNA, 29 nt, Human
caugcuauacacuuccaaacacacugaac

SEQ ID NO: 262564 - RNA, 23 nt, Human
ccaaaaguuuuugaguaaacuga

SEQ ID NO: 262565 - RNA, 19 nt, Human
cccgggggacucggggcag

SEQ ID NO: 262566 - RNA, 28 nt, Human
ccuacuguuaaacccuaaaagguuuucc

SEQ ID NO: 262567 - RNA, 22 nt, Human
cggaucccacagcgcccccugc

SEQ ID NO: 262568 - RNA, 24 nt, Human
cggaucccacagcgcccccugcug

SEQ ID NO: 262569 - RNA, 22 nt, Human
cggcuacagaaacagggcggug

SEQ ID NO: 262570 - RNA, 22 nt, Human
cgucaacggcgcaggugcagcc

SEQ ID NO: 262571 - RNA, 18 nt, Human
cuaaaaccacaaucagug

SEQ ID NO: 262572 - RNA, 22 nt, Human
cuaaaaccacaaucagugacug

SEQ ID NO: 262573 - RNA, 25 nt, Human
cucagaacaguuuuagagcuuuagc

SEQ ID NO: 262574 - RNA, 18 nt, Human
cucccgggggacucgggg

SEQ ID NO: 262575 - RNA, 24 nt, Human
cucccgggggacucggggcaggca

SEQ ID NO: 262576 - RNA, 20 nt, Human
cugccggccccgguggcguc

SEQ ID NO: 262577 - RNA, 21 nt, Human
cugcuuuugccaacauauacc

SEQ ID NO: 262578 - RNA, 20 nt, Human
cuguacuucccuuuuuuauu

SEQ ID NO: 262579 - RNA, 24 nt, Human
cuuguacugcaaucauugcagaaa

SEQ ID NO: 262580 - RNA, 22 nt, Human
gaacagcaacucauugagcaau

SEQ ID NO: 262581 - RNA, 19 nt, Human
gagcaagcgggaacucccu

SEQ ID NO: 262582 - RNA, 23 nt, Human
gagcaagcgggaacucccuccac

SEQ ID NO: 262583 - RNA, 19 nt, Human
gcgcaggugcagccgguga

SEQ ID NO: 262584 - RNA, 18 nt, Human
gcuggaggaggccgguac

SEQ ID NO: 262585 - RNA, 21 nt, Human
ggaacucccuccaccagccag

SEQ ID NO: 262586 - RNA, 18 nt, Human
ggaucccacagcgccccc

SEQ ID NO: 262587 - RNA, 20 nt, Human
guagcaugcacccccagcag

SEQ ID NO: 262588 - RNA, 18 nt, Human
uaaaaccacaaucaguga

SEQ ID NO: 262589 - RNA, 21 nt, Human
uaaacgugaacaguguacuuc

SEQ ID NO: 262590 - RNA, 21 nt, Human
uaaauacaucaaauaccacuc

SEQ ID NO: 262591 - RNA, 21 nt, Human
uaaauaucacuaaaaggcaaa

SEQ ID NO: 262592 - RNA, 28 nt, Human
uaacauaaaucauaaacgucaauucacu

SEQ ID NO: 262593 - RNA, 23 nt, Human
uaagauaauaaaccagaguugaa

SEQ ID NO: 262594 - RNA, 18 nt, Human
uacaaaaguggggcaggc

SEQ ID NO: 262595 - RNA, 20 nt, Human
uacaaacaaaacaaggcuga

SEQ ID NO: 262596 - RNA, 24 nt, Human
uacagaccauccucacaauaaucc

SEQ ID NO: 262597 - RNA, 18 nt, Human
uaccauacggcuacagaa

SEQ ID NO: 262598 - RNA, 26 nt, Human
uaccauacggcuacagaaacagggcg

SEQ ID NO: 262599 - RNA, 21 nt, Human
uagaaacacuuccccaaaccc

SEQ ID NO: 262600 - RNA, 22 nt, Human
uagaaacacuuccccaaacccc

SEQ ID NO: 262601 - RNA, 19 nt, Human
uagugcauuucuguugcug

SEQ ID NO: 262602 - RNA, 19 nt, Human
uaguuauuauccuuccuuc

SEQ ID NO: 262603 - RNA, 22 nt, Human
uaucuguacuucccuuuuuuau

SEQ ID NO: 262604 - RNA, 22 nt, Human
uaugcuuacagaccauccucac

SEQ ID NO: 262605 - RNA, 23 nt, Human
ucaaauguagcacuaaacaaauu

SEQ ID NO: 262606 - RNA, 18 nt, Human
ucacuaguguacagugca

SEQ ID NO: 262607 - RNA, 22 nt, Human
ucagccacagaagauucuaaaa

SEQ ID NO: 262608 - RNA, 18 nt, Human
ucagccggcagccggucu

SEQ ID NO: 262609 - RNA, 22 nt, Human
ucagugacuggaacaccaaggc

SEQ ID NO: 262610 - RNA, 19 nt, Human
uccaggaacagcaacucau

SEQ ID NO: 262611 - RNA, 22 nt, Human
uccauauauaaaagacagucaa

SEQ ID NO: 262612 - RNA, 23 nt, Human
ucuauauuuaacaagaagaaaaa

SEQ ID NO: 262613 - RNA, 24 nt, Human
ucuccuagaaacacuuccccaaac

SEQ ID NO: 262614 - RNA, 25 nt, Human
ucuccuagaaacacuuccccaaacc

SEQ ID NO: 262615 - RNA, 22 nt, Human
ugaaagaaauaaagccaaccac

SEQ ID NO: 262616 - RNA, 18 nt, Human
ugaaugucauuccuugcu

SEQ ID NO: 262617 - RNA, 23 nt, Human
ugaccagaagaaaaacaaaacaa

SEQ ID NO: 262618 - RNA, 19 nt, Human
ugacuucaaaauucaugca

SEQ ID NO: 262619 - RNA, 19 nt, Human
ugaucagaauaaaccuuca

SEQ ID NO: 262620 - RNA, 23 nt, Human
ugcaaucauugcagaaaaaacuc

SEQ ID NO: 262621 - RNA, 21 nt, Human
ugcuccacauagaaaugacuu

SEQ ID NO: 262622 - RNA, 20 nt, Human
uggaacaccaaggcacaaaa

SEQ ID NO: 262623 - RNA, 22 nt, Human
uggaacaccaaggcacaaaaac

SEQ ID NO: 262624 - RNA, 24 nt, Human
uggaacaccaaggcacaaaaacuu

SEQ ID NO: 262625 - RNA, 24 nt, Human
uggcaaaaugaaaucuuucccaga

SEQ ID NO: 262626 - RNA, 21 nt, Human
uggcugaauuaacauaaauca

SEQ ID NO: 262627 - RNA, 23 nt, Human
ugucugccggccccgguggcguc

SEQ ID NO: 262628 - RNA, 19 nt, Human
ugugcuuauacguauucaa

SEQ ID NO: 262629 - RNA, 21 nt, Human
uguuguaggcuguaaaacuua

SEQ ID NO: 262630 - RNA, 21 nt, Human
uuauagugcauuucuguugcu

SEQ ID NO: 262631 - RNA, 27 nt, Human
uucaagaaaucaauauucuaagcugua

SEQ ID NO: 262632 - RNA, 21 nt, Human
uugguuaugcuuacagaccau

SEQ ID NO: 262633 - RNA, 18 nt, Human
uuucucaguccaccugug

SEQ ID NO: 262634 - RNA, 20 nt, Human
uuuguuucuuguuuuuugga

SEQ ID NO: 262635 - RNA, 23 nt, Human
uuuuauagugcauuucuguugcu

SEQ ID NO: 262636 - RNA, 24 nt, Human
uuuuuggucugaaaaagauguuua

SEQ ID NO: 262637 - RNA, 21 nt, Human
aaaauaaggaacaaccaaaaa

SEQ ID NO: 262638 - RNA, 19 nt, Human
aacaguaaccaaacaaguu

SEQ ID NO: 262639 - RNA, 19 nt, Human
agaagccaaaagauaagac

SEQ ID NO: 262640 - RNA, 18 nt, Human
augaugugugccguggcc

SEQ ID NO: 262641 - RNA, 19 nt, Human
cacugaaucuuaagaggcu

SEQ ID NO: 262642 - RNA, 21 nt, Human
cugaagccggacaggggcugg

SEQ ID NO: 262643 - RNA, 18 nt, Human
gaacugagccacaaacca

SEQ ID NO: 262644 - RNA, 22 nt, Human
ggaaaagcauuuuauuauaacc

SEQ ID NO: 262645 - RNA, 22 nt, Human
uaaccaaacaaguugaccuaaa

SEQ ID NO: 262646 - RNA, 21 nt, Human
uaagaggcuuucaugaagccu

SEQ ID NO: 262647 - RNA, 26 nt, Human
uauaauaguaagaaaggacaggaaau

SEQ ID NO: 262648 - RNA, 19 nt, Human
ucacacuuuccagaaaaaa

SEQ ID NO: 262649 - RNA, 21 nt, Human
uccaaguacagggaaguucau

SEQ ID NO: 262650 - RNA, 21 nt, Human
ugugccguggccgauuuggga

SEQ ID NO: 262651 - RNA, 19 nt, Human
uguggaacugagccacaaa

SEQ ID NO: 262652 - RNA, 24 nt, Human
uucacacuuuccagaaaaaaauua

SEQ ID NO: 262653 - RNA, 23 nt, Human
uucauagaagccaaaagauaaga

SEQ ID NO: 262654 - RNA, 19 nt, Human
aaaaaacacacaauaaaac

SEQ ID NO: 262655 - RNA, 25 nt, Human
aaaaagcucagcuguauuaacagac

SEQ ID NO: 262656 - RNA, 22 nt, Human
aaaacugauaccauaagaaagu

SEQ ID NO: 262657 - RNA, 25 nt, Human
aaacaacaacaacaacaacaacaac

SEQ ID NO: 262658 - RNA, 20 nt, Human
aaacaacaauguucuucuga

SEQ ID NO: 262659 - RNA, 23 nt, Human
aaacacacauacacauauaaacc

SEQ ID NO: 262660 - RNA, 23 nt, Human
aaacucccucacaaguuuccacc

SEQ ID NO: 262661 - RNA, 20 nt, Human
aaagugcugggauuacaggc

SEQ ID NO: 262662 - RNA, 23 nt, Human
aaagugcugggauuacaggcgua

SEQ ID NO: 262663 - RNA, 25 nt, Human
aacaacaacaacaaaacuuuaucag

SEQ ID NO: 262664 - RNA, 22 nt, Human
aacacacaauaaaacacacaua

SEQ ID NO: 262665 - RNA, 26 nt, Human
aagcaauaaaaucccaccccuaaauc

SEQ ID NO: 262666 - RNA, 20 nt, Human
aagcagugggagucacuucu

SEQ ID NO: 262667 - RNA, 20 nt, Human
aaggaagaugcuguggacag

SEQ ID NO: 262668 - RNA, 19 nt, Human
aagggcacaaggagagaac

SEQ ID NO: 262669 - RNA, 19 nt, Human
aagugcugggauuacaggc

SEQ ID NO: 262670 - RNA, 19 nt, Human
aagugcugggauuacaggc

SEQ ID NO: 262671 - RNA, 24 nt, Human
aaucacuuuaaaaucuugcuuuga

SEQ ID NO: 262672 - RNA, 23 nt, Human
acaacaacaacaacaaaacuuua

SEQ ID NO: 262673 - RNA, 19 nt, Human
acaacaacaacaacaacaa

SEQ ID NO: 262674 - RNA, 19 nt, Human
acaacaacaacaacaacaa

SEQ ID NO: 262675 - RNA, 21 nt, Human
acaacaacaacaacaacaaaa

SEQ ID NO: 262676 - RNA, 22 nt, Human
acaacaacaacaacaacaacaa

SEQ ID NO: 262677 - RNA, 24 nt, Human
acaacaacaacaacaacaacaaaa

SEQ ID NO: 262678 - RNA, 30 nt, Human
acacaccaccacaccaggcuaaugggaguu

SEQ ID NO: 262679 - RNA, 28 nt, Human
acacagcucuaaagcaggggggaacgcc

SEQ ID NO: 262680 - RNA, 18 nt, Human
acagcaaagaaaguaagu

SEQ ID NO: 262681 - RNA, 21 nt, Human
acaggcgcccgccaccacacc

SEQ ID NO: 262682 - RNA, 18 nt, Human
acaggcguaagccaccau

SEQ ID NO: 262683 - RNA, 23 nt, Human
accguuuuuggauuugggaaaac

SEQ ID NO: 262684 - RNA, 24 nt, Human
accucaugauccgcccgccuuggc

SEQ ID NO: 262685 - RNA, 23 nt, Human
acgcaggaaucugauuaucccuc

SEQ ID NO: 262686 - RNA, 20 nt, Human
acugcaagcucugccucccg

SEQ ID NO: 262687 - RNA, 19 nt, Human
acugcagccucaaccuccu

SEQ ID NO: 262688 - RNA, 23 nt, Human
agaaaagccuccuucauauacaa

SEQ ID NO: 262689 - RNA, 21 nt, Human
agaacaguaccacauucgaca

SEQ ID NO: 262690 - RNA, 21 nt, Human
agaauuucagagggucucuuc

SEQ ID NO: 262691 - RNA, 21 nt, Human
agacaaaaagagaagaaaaca

SEQ ID NO: 262692 - RNA, 18 nt, Human
agcaaagaaaguaaguca

SEQ ID NO: 262693 - RNA, 18 nt, Human
agccagggaaccgagccc

SEQ ID NO: 262694 - RNA, 21 nt, Human
aggcacacaccaccacaccag

SEQ ID NO: 262695 - RNA, 25 nt, Human
aggcuggagugcaguggugcgaucu

SEQ ID NO: 262696 - RNA, 24 nt, Human
agggauccuucugccucagcuuuc

SEQ ID NO: 262697 - RNA, 18 nt, Human
aguaaacucucaucagaa

SEQ ID NO: 262698 - RNA, 18 nt, Human
aguagcugggacuacagg

SEQ ID NO: 262699 - RNA, 20 nt, Human
agugcaguggugcgaucucg

SEQ ID NO: 262700 - RNA, 23 nt, Human
agugcaguggugcgaucucggcu

SEQ ID NO: 262701 - RNA, 24 nt, Human
agugcaguggugcgaucucggcuc

SEQ ID NO: 262702 - RNA, 18 nt, Human
agugcugggauuacaggc

SEQ ID NO: 262703 - RNA, 19 nt, Human
auagacuagcagagcauga

SEQ ID NO: 262704 - RNA, 24 nt, Human
auagcucacugcagccucaaccuc

SEQ ID NO: 262705 - RNA, 21 nt, Human
auauuacaaacaauauuaaaa

SEQ ID NO: 262706 - RNA, 19 nt, Human
auccgcccgccuuggccuc

SEQ ID NO: 262707 - RNA, 24 nt, Human
auggaaaugguuuuaaagauuacu

SEQ ID NO: 262708 - RNA, 19 nt, Human
augucuuggccagacaaac

SEQ ID NO: 262709 - RNA, 24 nt, Human
auuaaaaaaaaaaaaaguacuuau

SEQ ID NO: 262710 - RNA, 22 nt, Human
caaaaagcaauaaaaucccacc

SEQ ID NO: 262711 - RNA, 20 nt, Human
caaaacuuuaucagauguac

SEQ ID NO: 262712 - RNA, 22 nt, Human
caaagaaauguuuaaaaauccc

SEQ ID NO: 262713 - RNA, 21 nt, Human
caaagcaaauuugcaaaaggc

SEQ ID NO: 262714 - RNA, 21 nt, Human
caaaucaauagagccaaagca

SEQ ID NO: 262715 - RNA, 23 nt, Human
caaaugaagguagaaguaauuuu

SEQ ID NO: 262716 - RNA, 23 nt, Human
caaauuaaaaaaacacacaauaa

SEQ ID NO: 262717 - RNA, 20 nt, Human
caaccuguaaacagaucuga

SEQ ID NO: 262718 - RNA, 21 nt, Human
caagaaaauaaagaaaacuga

SEQ ID NO: 262719 - RNA, 22 nt, Human
caagggauccuucugccucagc

SEQ ID NO: 262720 - RNA, 27 nt, Human
caaucuugagacaaaaagagaagaaaa

SEQ ID NO: 262721 - RNA, 22 nt, Human
caauuaaaacaacaacaacaac

SEQ ID NO: 262722 - RNA, 22 nt, Human
cacacaauaaaacacacauaca

SEQ ID NO: 262723 - RNA, 19 nt, Human
cacacaccaccacaccagg

SEQ ID NO: 262724 - RNA, 20 nt, Human
cacacaccaccacaccaggc

SEQ ID NO: 262725 - RNA, 31 nt, Human
cacacaccaccacaccaggcuaaugggaguu

SEQ ID NO: 262726 - RNA, 22 nt, Human
cacaccauucuccugccucagc

SEQ ID NO: 262727 - RNA, 21 nt, Human
cacacuaagaacaguaccacu

SEQ ID NO: 262728 - RNA, 23 nt, Human
cacagguucacaauauggaaacc

SEQ ID NO: 262729 - RNA, 21 nt, Human
caccaggcuaaugggagucac

SEQ ID NO: 262730 - RNA, 23 nt, Human
caccaguaacaauucucaaucag

SEQ ID NO: 262731 - RNA, 20 nt, Human
caccauucucuucauucaag

SEQ ID NO: 262732 - RNA, 24 nt, Human
caccguguuagccaggauggucuc

SEQ ID NO: 262733 - RNA, 23 nt, Human
cacugcaagcucugccucccggg

SEQ ID NO: 262734 - RNA, 19 nt, Human
cacugcagccucaaccucc

SEQ ID NO: 262735 - RNA, 19 nt, Human
cacuucuggcuuuuucuuu

SEQ ID NO: 262736 - RNA, 24 nt, Human
cagccucaaccuccuaggcucaag

SEQ ID NO: 262737 - RNA, 20 nt, Human
cagccuccugaguagcuggg

SEQ ID NO: 262738 - RNA, 20 nt, Human
cagugggagucacuucuggc

SEQ ID NO: 262739 - RNA, 21 nt, Human
cauaaaccaaauacugacuga

SEQ ID NO: 262740 - RNA, 24 nt, Human
caugauacugauuuuuuauuuaac

SEQ ID NO: 262741 - RNA, 26 nt, Human
ccaaaaaagcuucagguuuuuaaaaa

SEQ ID NO: 262742 - RNA, 20 nt, Human
ccaaagugcugggauuacag

SEQ ID NO: 262743 - RNA, 22 nt, Human
ccaaagugcugggauuacaggc

SEQ ID NO: 262744 - RNA, 22 nt, Human
ccaaagugcugggauuacaggc

SEQ ID NO: 262745 - RNA, 24 nt, Human
ccaaagugcugggauuacaggcgu

SEQ ID NO: 262746 - RNA, 26 nt, Human
ccacaaacauuuggaguugcaggcau

SEQ ID NO: 262747 - RNA, 21 nt, Human
ccagacaacuacacgaguuau

SEQ ID NO: 262748 - RNA, 19 nt, Human
ccauuuucaaaggcuucuc

SEQ ID NO: 262749 - RNA, 18 nt, Human
cccaauuaaaacaacaac

SEQ ID NO: 262750 - RNA, 18 nt, Human
cccacaaaauuucauccu

SEQ ID NO: 262751 - RNA, 20 nt, Human
ccccacaaaauuucauccuu

SEQ ID NO: 262752 - RNA, 22 nt, Human
cccgccuuggccucccaaagug

SEQ ID NO: 262753 - RNA, 20 nt, Human
cccgcggccggagccaggga

SEQ ID NO: 262754 - RNA, 19 nt, Human
cccuuuuuuuaaaccacca

SEQ ID NO: 262755 - RNA, 19 nt, Human
ccuaggcucaagggauccu

SEQ ID NO: 262756 - RNA, 20 nt, Human
ccuaggcucaagggauccuu

SEQ ID NO: 262757 - RNA, 24 nt, Human
ccucccggguucacaccauucucc

SEQ ID NO: 262758 - RNA, 20 nt, Human
ccugaaaccagacaacuaca

SEQ ID NO: 262759 - RNA, 23 nt, Human
ccugaguagcugggacuacaggc

SEQ ID NO: 262760 - RNA, 23 nt, Human
ccugaguagcugggacuacaggc

SEQ ID NO: 262761 - RNA, 22 nt, Human
ccuggaaaguucucugaaccuc

SEQ ID NO: 262762 - RNA, 21 nt, Human
ccuucugccucagcuuuccua

SEQ ID NO: 262763 - RNA, 24 nt, Human
ccuuucgcccaggcuggagugcag

SEQ ID NO: 262764 - RNA, 24 nt, Human
cgcccaggcuggagugcaguggug

SEQ ID NO: 262765 - RNA, 23 nt, Human
cuaauuuuuuguauuuuuaguag

SEQ ID NO: 262766 - RNA, 30 nt, Human
cucaaaguucaaagaaauguuuaaaaaucc

SEQ ID NO: 262767 - RNA, 18 nt, Human
cucaagggauccuucugc

SEQ ID NO: 262768 - RNA, 24 nt, Human
cucacugcaagcucugccucccgg

SEQ ID NO: 262769 - RNA, 21 nt, Human
cucacugcagccucaaccucc

SEQ ID NO: 262770 - RNA, 24 nt, Human
cucagccuccugaguagcugggac

SEQ ID NO: 262771 - RNA, 24 nt, Human
cucagcuuuccuaguggcugggac

SEQ ID NO: 262772 - RNA, 24 nt, Human
cucccccgcggccggagccaggga

SEQ ID NO: 262773 - RNA, 21 nt, Human
cucccggguucacaccauucu

SEQ ID NO: 262774 - RNA, 24 nt, Human
cuccugaccucaugauccgcccgc

SEQ ID NO: 262775 - RNA, 24 nt, Human
cucgcucuguugcucaggcuggag

SEQ ID NO: 262776 - RNA, 21 nt, Human
cugaaaccagacaacuacacg

SEQ ID NO: 262777 - RNA, 19 nt, Human
cugaccguuuuuggauuug

SEQ ID NO: 262778 - RNA, 23 nt, Human
cugccucagccuccugaguagcu

SEQ ID NO: 262779 - RNA, 19 nt, Human
cuuucgcccaggcuggagu

SEQ ID NO: 262780 - RNA, 23 nt, Human
cuuuuccaugauacugauuuuuu

SEQ ID NO: 262781 - RNA, 18 nt, Human
gacaaaccggccaaccca

SEQ ID NO: 262782 - RNA, 20 nt, Human
gaccucaugauccgcccgcc

SEQ ID NO: 262783 - RNA, 18 nt, Human
gacuguauguauaugugu

SEQ ID NO: 262784 - RNA, 21 nt, Human
gagaagaaaagccuccuucau

SEQ ID NO: 262785 - RNA, 20 nt, Human
gaguagcugggacuacaggc

SEQ ID NO: 262786 - RNA, 19 nt, Human
gaucauagcucacugcagc

SEQ ID NO: 262787 - RNA, 18 nt, Human
gauuacaggcguaagcca

SEQ ID NO: 262788 - RNA, 21 nt, Human
gauuacaggcguaagccacca

SEQ ID NO: 262789 - RNA, 22 nt, Human
gauuacaggcguaagccaccau

SEQ ID NO: 262790 - RNA, 18 nt, Human
gcccaauuaaaacaacaa

SEQ ID NO: 262791 - RNA, 19 nt, Human
gcccaggcuggagugcagu

SEQ ID NO: 262792 - RNA, 20 nt, Human
gcccaggcuggagugcagug

SEQ ID NO: 262793 - RNA, 23 nt, Human
gcccaggcuggagugcaguggug

SEQ ID NO: 262794 - RNA, 24 nt, Human
gcccaugugaaagaauaagcagua

SEQ ID NO: 262795 - RNA, 18 nt, Human
gcccauuucugguccagg

SEQ ID NO: 262796 - RNA, 21 nt, Human
gccgaucaacagaagcagugg

SEQ ID NO: 262797 - RNA, 21 nt, Human
gccgcagggaaguagcggaaa

SEQ ID NO: 262798 - RNA, 18 nt, Human
gccggagccagggaaccg

SEQ ID NO: 262799 - RNA, 18 nt, Human
gccucaaccuccuaggcu

SEQ ID NO: 262800 - RNA, 24 nt, Human
gccucagcuuuccuaguggcuggg

SEQ ID NO: 262801 - RNA, 22 nt, Human
gccuuggccucccaaagugcug

SEQ ID NO: 262802 - RNA, 19 nt, Human
gcgaucauagcucacugca

SEQ ID NO: 262803 - RNA, 18 nt, Human
gcuugcuuucuucccauu

SEQ ID NO: 262804 - RNA, 18 nt, Human
ggaaaugguuuuaaagau

SEQ ID NO: 262805 - RNA, 18 nt, Human
ggagccagggaaccgagc

SEQ ID NO: 262806 - RNA, 24 nt, Human
ggauuacaggcguaagccaccaug

SEQ ID NO: 262807 - RNA, 24 nt, Human
gggauccuucugccucagcuuucc

SEQ ID NO: 262808 - RNA, 23 nt, Human
gggcaaucugcuugcucacucau

SEQ ID NO: 262809 - RNA, 18 nt, Human
ggguuuucaccguguuag

SEQ ID NO: 262810 - RNA, 20 nt, Human
ggucucgaucuccugaccuc

SEQ ID NO: 262811 - RNA, 20 nt, Human
gucacuucuggcuuuuucuu

SEQ ID NO: 262812 - RNA, 24 nt, Human
gucucgcucuguugcucaggcugg

SEQ ID NO: 262813 - RNA, 24 nt, Human
uaaaacaaaaagcaauaaaauccc

SEQ ID NO: 262814 - RNA, 18 nt, Human
uaaaacaacaacaacaac

SEQ ID NO: 262815 - RNA, 23 nt, Human
uaaaaugagcaaugucaccaaac

SEQ ID NO: 262816 - RNA, 23 nt, Human
uaacaggccacaugaaacauggu

SEQ ID NO: 262817 - RNA, 22 nt, Human
uaacauaaaccaaauacugacu

SEQ ID NO: 262818 - RNA, 23 nt, Human
uaauuuuuuguauuuuuaguaga

SEQ ID NO: 262819 - RNA, 31 nt, Human
uacaaauuaaaaaaacacacaauaaaacacc

SEQ ID NO: 262820 - RNA, 18 nt, Human
uacaagcagcauuugaaa

SEQ ID NO: 262821 - RNA, 23 nt, Human
uacaagcagcauuugaaacacau

SEQ ID NO: 262822 - RNA, 22 nt, Human
uacacacuaagaacaguaccac

SEQ ID NO: 262823 - RNA, 22 nt, Human
uacaggcgcccgccaccacacc

SEQ ID NO: 262824 - RNA, 24 nt, Human
uacaggcguaagccaccaugccca

SEQ ID NO: 262825 - RNA, 23 nt, Human
uacguaucuccuguauaaaaacc

SEQ ID NO: 262826 - RNA, 22 nt, Human
uacugaaccacaaacauuugga

SEQ ID NO: 262827 - RNA, 19 nt, Human
uagauuguugucucaguga

SEQ ID NO: 262828 - RNA, 24 nt, Human
uagcucacugcagccucaaccucc

SEQ ID NO: 262829 - RNA, 25 nt, Human
uagcuugauuauaauaaauuaacuc

SEQ ID NO: 262830 - RNA, 22 nt, Human
uauauucauaaacuucccccuc

SEQ ID NO: 262831 - RNA, 18 nt, Human
uaucccagauuaaggucg

SEQ ID NO: 262832 - RNA, 18 nt, Human
uaugcucaaaaccugaaa

SEQ ID NO: 262833 - RNA, 20 nt, Human
uaugcucaaaaccugaaaac

SEQ ID NO: 262834 - RNA, 22 nt, Human
uauguauaugugugugugcgua

SEQ ID NO: 262835 - RNA, 27 nt, Human
uauuauugucccccccaagucuucuca

SEQ ID NO: 262836 - RNA, 20 nt, Human
uauugcccauuucuggucca

SEQ ID NO: 262837 - RNA, 21 nt, Human
ucaaacagcuaucccugaaac

SEQ ID NO: 262838 - RNA, 19 nt, Human
ucaaaggcagcucuccgau

SEQ ID NO: 262839 - RNA, 24 nt, Human
ucaccguguuagccaggauggucu

SEQ ID NO: 262840 - RNA, 18 nt, Human
ucacugcaagcucugccu

SEQ ID NO: 262841 - RNA, 18 nt, Human
ucacugcaagcucugccu

SEQ ID NO: 262842 - RNA, 24 nt, Human
ucacugcaagcucugccucccggg

SEQ ID NO: 262843 - RNA, 19 nt, Human
ucacugcagccucaaccuc

SEQ ID NO: 262844 - RNA, 23 nt, Human
ucacugcagccucaaccuccuag

SEQ ID NO: 262845 - RNA, 24 nt, Human
ucacugcagccucaaccuccuagg

SEQ ID NO: 262846 - RNA, 21 nt, Human
ucagagggucucuucugggac

SEQ ID NO: 262847 - RNA, 23 nt, Human
ucagccuccugaguagcugggac

SEQ ID NO: 262848 - RNA, 18 nt, Human
ucagguuuuuaaaaacau

SEQ ID NO: 262849 - RNA, 23 nt, Human
ucccaaaaagacuguggacugug

SEQ ID NO: 262850 - RNA, 24 nt, Human
ucccaaagugcugggauuacaggc

SEQ ID NO: 262851 - RNA, 24 nt, Human
ucccaccccuaaaucaggccucaa

SEQ ID NO: 262852 - RNA, 21 nt, Human
ucccggguucacaccauucuc

SEQ ID NO: 262853 - RNA, 24 nt, Human
ucccggguucacaccauucuccug

SEQ ID NO: 262854 - RNA, 19 nt, Human
ucccuccaugaccagaccu

SEQ ID NO: 262855 - RNA, 26 nt, Human
ucccuccaugaccagaccuaauacaa

SEQ ID NO: 262856 - RNA, 18 nt, Human
uccuaggcucaagggauc

SEQ ID NO: 262857 - RNA, 24 nt, Human
uccuaguggcugggacuauaggca

SEQ ID NO: 262858 - RNA, 24 nt, Human
uccugaguagcugggacuacaggc

SEQ ID NO: 262859 - RNA, 18 nt, Human
uccuugcgaagggugcga

SEQ ID NO: 262860 - RNA, 24 nt, Human
ucgcccaggcuggagugcaguggu

SEQ ID NO: 262861 - RNA, 24 nt, Human
ucgcucuguugcucaggcuggagu

SEQ ID NO: 262862 - RNA, 22 nt, Human
ucuaaagccuucacuucaaggc

SEQ ID NO: 262863 - RNA, 22 nt, Human
ucuagaagugggcaaauaccaa

SEQ ID NO: 262864 - RNA, 19 nt, Human
ucucgcucuguugcucagg

SEQ ID NO: 262865 - RNA, 22 nt, Human
ucucgcucuguugcucaggcug

SEQ ID NO: 262866 - RNA, 23 nt, Human
ucucgcucuguugcucaggcugg

SEQ ID NO: 262867 - RNA, 24 nt, Human
ucucgcucuguugcucaggcugga

SEQ ID NO: 262868 - RNA, 20 nt, Human
ucucugaaccucuucaguuc

SEQ ID NO: 262869 - RNA, 18 nt, Human
ucucuucugggacuauug

SEQ ID NO: 262870 - RNA, 24 nt, Human
ucugccucagcuuuccuaguggcu

SEQ ID NO: 262871 - RNA, 22 nt, Human
ucuguugcucaggcuggagugg

SEQ ID NO: 262872 - RNA, 23 nt, Human
ucuucugauuaaaaaaaaaaaaa

SEQ ID NO: 262873 - RNA, 22 nt, Human
ucuugcccuuucgcccaggcug

SEQ ID NO: 262874 - RNA, 23 nt, Human
ucuugcccuuucgcccaggcugg

SEQ ID NO: 262875 - RNA, 24 nt, Human
ucuugcccuuucgcccaggcugga

SEQ ID NO: 262876 - RNA, 24 nt, Human
ugaaacacaaauggcauuaaauag

SEQ ID NO: 262877 - RNA, 24 nt, Human
ugaaucaaagacuaaaaccccaca

SEQ ID NO: 262878 - RNA, 20 nt, Human
ugacaggcccuaacaggcca

SEQ ID NO: 262879 - RNA, 19 nt, Human
ugacugaaucaaagacuaa

SEQ ID NO: 262880 - RNA, 20 nt, Human
ugagaauagauuucagcuuc

SEQ ID NO: 262881 - RNA, 22 nt, Human
ugagacaaaaagagaagaaaac

SEQ ID NO: 262882 - RNA, 24 nt, Human
ugagacccuaaguuuucuuggaaa

SEQ ID NO: 262883 - RNA, 23 nt, Human
ugagcaaugucaccaaacagaaa

SEQ ID NO: 262884 - RNA, 24 nt, Human
ugccaccauucucuucauucaagu

SEQ ID NO: 262885 - RNA, 24 nt, Human
ugcccuuucgcccaggcuggagug

SEQ ID NO: 262886 - RNA, 24 nt, Human
ugccucagccuccugaguagcugg

SEQ ID NO: 262887 - RNA, 24 nt, Human
ugccucagcuuuccuaguggcugg

SEQ ID NO: 262888 - RNA, 21 nt, Human
ugcucaggcuggaguggacug

SEQ ID NO: 262889 - RNA, 24 nt, Human
ugcucaggcuggaguggacugaug

SEQ ID NO: 262890 - RNA, 24 nt, Human
ugcugggauuacaggcguaagcca

SEQ ID NO: 262891 - RNA, 18 nt, Human
uggagaguggacacagag

SEQ ID NO: 262892 - RNA, 18 nt, Human
uggagucuugcccuuucg

SEQ ID NO: 262893 - RNA, 23 nt, Human
uggagugcaguggugcgaucucg

SEQ ID NO: 262894 - RNA, 24 nt, Human
uggagugcaguggugcgaucucgg

SEQ ID NO: 262895 - RNA, 21 nt, Human
uggauuaccaaauaacacuuc

SEQ ID NO: 262896 - RNA, 19 nt, Human
uggccagacaaacacaggc

SEQ ID NO: 262897 - RNA, 29 nt, Human
uggccgaucaacagaagcagugggagucc

SEQ ID NO: 262898 - RNA, 21 nt, Human
ugggacuacaggcgcccgcca

SEQ ID NO: 262899 - RNA, 22 nt, Human
ugggacuacaggcgcccgccac

SEQ ID NO: 262900 - RNA, 24 nt, Human
ugggacuacaggcgcccgccacca

SEQ ID NO: 262901 - RNA, 24 nt, Human
ugggacuauaggcacacaccacca

SEQ ID NO: 262902 - RNA, 18 nt, Human
ugggaucugacaugaaug

SEQ ID NO: 262903 - RNA, 18 nt, Human
ugggauuacaggcguaag

SEQ ID NO: 262904 - RNA, 22 nt, Human
ugggauuacaggcguaagccac

SEQ ID NO: 262905 - RNA, 24 nt, Human
ugggauuacaggcguaagccacca

SEQ ID NO: 262906 - RNA, 25 nt, Human
ugggauuacaggcguaagccaccau

SEQ ID NO: 262907 - RNA, 24 nt, Human
uggguuuucaccguguuagccagg

SEQ ID NO: 262908 - RNA, 18 nt, Human
uggucagaguguuuaaaa

SEQ ID NO: 262909 - RNA, 20 nt, Human
uguacaacucaguuuuauua

SEQ ID NO: 262910 - RNA, 20 nt, Human
uguauaaaaaccagcuuuca

SEQ ID NO: 262911 - RNA, 19 nt, Human
uguauguauaugugugugu

SEQ ID NO: 262912 - RNA, 20 nt, Human
uguauguauaugugugugug

SEQ ID NO: 262913 - RNA, 24 nt, Human
uguguagccuuugcuacaaggcug

SEQ ID NO: 262914 - RNA, 23 nt, Human
uguuguuuucauucauucuaucu

SEQ ID NO: 262915 - RNA, 25 nt, Human
uguuuacagugagccucauuaucuu

SEQ ID NO: 262916 - RNA, 22 nt, Human
uuacaagcagcauuugaaacac

SEQ ID NO: 262917 - RNA, 20 nt, Human
uuagcucaacacacagcucu

SEQ ID NO: 262918 - RNA, 22 nt, Human
uuaguagacauggguuuucacc

SEQ ID NO: 262919 - RNA, 24 nt, Human
uuaguagacauggguuuucaccgu

SEQ ID NO: 262920 - RNA, 24 nt, Human
uuauauucauaaacuucccccucc

SEQ ID NO: 262921 - RNA, 18 nt, Human
uucauucuaucuagaagu

SEQ ID NO: 262922 - RNA, 24 nt, Human
uuccuaguggcugggacuauaggc

SEQ ID NO: 262923 - RNA, 26 nt, Human
uugaacaaucccuaauuauaaauuaa

SEQ ID NO: 262924 - RNA, 22 nt, Human
uugcuagucaauuuuuaaaaaa

SEQ ID NO: 262925 - RNA, 20 nt, Human
uugcucaggcuggaguggac

SEQ ID NO: 262926 - RNA, 18 nt, Human
uuggccucccaaagugcu

SEQ ID NO: 262927 - RNA, 18 nt, Human
uuuagcucaacacacagc

SEQ ID NO: 262928 - RNA, 22 nt, Human
uuuaucagauguacugaaugac

SEQ ID NO: 262929 - RNA, 18 nt, Human
uuucacacaacgcagagc

SEQ ID NO: 262930 - RNA, 19 nt, Human
uuucaccguguuagccagg

SEQ ID NO: 262931 - RNA, 21 nt, Human
uuucagagggucucuucuggg

SEQ ID NO: 262932 - RNA, 24 nt, Human
uuucuuuacuuagacacagggucu

SEQ ID NO: 262933 - RNA, 22 nt, Human
uuuguuaaaaugagcaauguca

SEQ ID NO: 262934 - RNA, 18 nt, Human
uuuuguauuuuuaguaga

SEQ ID NO: 262935 - RNA, 24 nt, Human
uuuuuaguagacauggguuuucac

SEQ ID NO: 262936 - RNA, 19 nt, Human
uuuuuguauuuuuaguaga

SEQ ID NO: 262937 - RNA, 24 nt, Human
aaagugcugagauuacagguguga

SEQ ID NO: 262938 - RNA, 20 nt, Human
aacauguaacucuccauaca

SEQ ID NO: 262939 - RNA, 20 nt, Human
aaccucugccucuggggcuc

SEQ ID NO: 262940 - RNA, 18 nt, Human
aacucugccagcugaaag

SEQ ID NO: 262941 - RNA, 19 nt, Human
aagaagaaugcaauuaccc

SEQ ID NO: 262942 - RNA, 19 nt, Human
aagugcugagauuacaggu

SEQ ID NO: 262943 - RNA, 18 nt, Human
acuaguagauuggagggg

SEQ ID NO: 262944 - RNA, 25 nt, Human
acucucaccccagcccugaaccgca

SEQ ID NO: 262945 - RNA, 22 nt, Human
agauuacaggugugagcgacug

SEQ ID NO: 262946 - RNA, 22 nt, Human
agcucagaaacuauggcagcag

SEQ ID NO: 262947 - RNA, 20 nt, Human
aggcacucaccccacuuuca

SEQ ID NO: 262948 - RNA, 21 nt, Human
aggcacucaccccacuuucau

SEQ ID NO: 262949 - RNA, 22 nt, Human
agguaaaaguuggaaguuuccu

SEQ ID NO: 262950 - RNA, 23 nt, Human
aggugugagcgacugugcccggc

SEQ ID NO: 262951 - RNA, 21 nt, Human
aguagcugggauuacaggcgu

SEQ ID NO: 262952 - RNA, 23 nt, Human
aguagcugggauuacaggcgugu

SEQ ID NO: 262953 - RNA, 22 nt, Human
aucauguugccccagggugguc

SEQ ID NO: 262954 - RNA, 18 nt, Human
augggauuucaucauguu

SEQ ID NO: 262955 - RNA, 19 nt, Human
augggauuucaucauguug

SEQ ID NO: 262956 - RNA, 25 nt, Human
augggauuucaucauguugccccag

SEQ ID NO: 262957 - RNA, 25 nt, Human
auuuaugaccaugaguauagcuacc

SEQ ID NO: 262958 - RNA, 24 nt, Human
caaagugcugagauuacaggugug

SEQ ID NO: 262959 - RNA, 20 nt, Human
caccacaaccucugccucug

SEQ ID NO: 262960 - RNA, 24 nt, Human
caccccagcccugaaccgcauucc

SEQ ID NO: 262961 - RNA, 24 nt, Human
caccucagccucccaaagugcuga

SEQ ID NO: 262962 - RNA, 20 nt, Human
cagggccaucgcccgccucg

SEQ ID NO: 262963 - RNA, 20 nt, Human
cagucuccugaguagcuggg

SEQ ID NO: 262964 - RNA, 21 nt, Human
ccaaagugcugagauuacagg

SEQ ID NO: 262965 - RNA, 21 nt, Human
ccaaagugcugagauuacagg

SEQ ID NO: 262966 - RNA, 24 nt, Human
ccaaagugcugagauuacaggugu

SEQ ID NO: 262967 - RNA, 22 nt, Human
ccacaaccucugccucuggggc

SEQ ID NO: 262968 - RNA, 25 nt, Human
ccaucgcccgccucguccgcccgcc

SEQ ID NO: 262969 - RNA, 21 nt, Human
ccucuggggcucaagggauuc

SEQ ID NO: 262970 - RNA, 23 nt, Human
ccucuggggcucaagggauucuc

SEQ ID NO: 262971 - RNA, 23 nt, Human
ccugaguagcugggauuacaggc

SEQ ID NO: 262972 - RNA, 24 nt, Human
ccugaguagcugggauuacaggcg

SEQ ID NO: 262973 - RNA, 19 nt, Human
cgcgucccggccgcagggc

SEQ ID NO: 262974 - RNA, 23 nt, Human
cggccuaugauuuaguucuuuau

SEQ ID NO: 262975 - RNA, 23 nt, Human
cuaacucagucuccugaguagcu

SEQ ID NO: 262976 - RNA, 24 nt, Human
cuaacucagucuccugaguagcug

SEQ ID NO: 262977 - RNA, 19 nt, Human
cucaagggauucuccuaac

SEQ ID NO: 262978 - RNA, 20 nt, Human
cucaagggauucuccuaacu

SEQ ID NO: 262979 - RNA, 18 nt, Human
cucaccccacuuucauug

SEQ ID NO: 262980 - RNA, 24 nt, Human
cucagucuccugaguagcugggau

SEQ ID NO: 262981 - RNA, 21 nt, Human
cucccaaagugcugagauuac

SEQ ID NO: 262982 - RNA, 22 nt, Human
cugaguagcugggauuacaggc

SEQ ID NO: 262983 - RNA, 24 nt, Human
cugaguagcugggauuacaggcgu

SEQ ID NO: 262984 - RNA, 20 nt, Human
cuucaaaaagugaagaagaa

SEQ ID NO: 262985 - RNA, 24 nt, Human
gaacucaguugaucugcccaccuc

SEQ ID NO: 262986 - RNA, 24 nt, Human
gaaguuuccuccaccacucugcuu

SEQ ID NO: 262987 - RNA, 18 nt, Human
gagaugggauuucaucau

SEQ ID NO: 262988 - RNA, 24 nt, Human
gagaugggauuucaucauguugcc

SEQ ID NO: 262989 - RNA, 20 nt, Human
gaguagcugggauuacaggc

SEQ ID NO: 262990 - RNA, 25 nt, Human
gaguagcugggauuacaggcgugug

SEQ ID NO: 262991 - RNA, 23 nt, Human
gauuacaggcgugugcaccaugc

SEQ ID NO: 262992 - RNA, 24 nt, Human
gauuacaggugugagcgacugugc

SEQ ID NO: 262993 - RNA, 20 nt, Human
gcccgcccgaccacuuguua

SEQ ID NO: 262994 - RNA, 22 nt, Human
ggauucuccuaacucagucucc

SEQ ID NO: 262995 - RNA, 23 nt, Human
guaauaagaggcacucaccccac

SEQ ID NO: 262996 - RNA, 18 nt, Human
guagcugggauuacaggc

SEQ ID NO: 262997 - RNA, 18 nt, Human
guagcugggauuacaggc

SEQ ID NO: 262998 - RNA, 18 nt, Human
guauuuuuuuagagaugg

SEQ ID NO: 262999 - RNA, 23 nt, Human
gugaagaagaaugcaauuacccc

SEQ ID NO: 263000 - RNA, 20 nt, Human
uaacucagucuccugaguag

SEQ ID NO: 263001 - RNA, 23 nt, Human
uaauuuuuuguauuuuuuuagag

SEQ ID NO: 263002 - RNA, 24 nt, Human
uaauuuuuuguauuuuuuuagaga

SEQ ID NO: 263003 - RNA, 20 nt, Human
uagagaugggauuucaucau

SEQ ID NO: 263004 - RNA, 22 nt, Human
ucaccacaaccucugccucugg

SEQ ID NO: 263005 - RNA, 23 nt, Human
ucaccacaaccucugccucuggg

SEQ ID NO: 263006 - RNA, 18 nt, Human
ucagccucccaaagugcu

SEQ ID NO: 263007 - RNA, 23 nt, Human
ucagucuccugaguagcugggau

SEQ ID NO: 263008 - RNA, 18 nt, Human
uccauacauucuguacuu

SEQ ID NO: 263009 - RNA, 23 nt, Human
ucccaaagugcugagauuacagg

SEQ ID NO: 263010 - RNA, 21 nt, Human
ucccagacaucugucaagagc

SEQ ID NO: 263011 - RNA, 22 nt, Human
uccccugaaugcauucagcagc

SEQ ID NO: 263012 - RNA, 24 nt, Human
uccugaguagcugggauuacaggc

SEQ ID NO: 263013 - RNA, 23 nt, Human
ucguccgcccgcccgaccacuug

SEQ ID NO: 263014 - RNA, 21 nt, Human
ucugcccaccucagccuccca

SEQ ID NO: 263015 - RNA, 19 nt, Human
ugagauuacaggugugagc

SEQ ID NO: 263016 - RNA, 19 nt, Human
ugagauuacaggugugagc

SEQ ID NO: 263017 - RNA, 21 nt, Human
ugagauuacaggugugagcga

SEQ ID NO: 263018 - RNA, 22 nt, Human
ugagauuacaggugugagcgac

SEQ ID NO: 263019 - RNA, 24 nt, Human
ugagauuacaggugugagcgacug

SEQ ID NO: 263020 - RNA, 23 nt, Human
ugagccauuaacugauuuauguu

SEQ ID NO: 263021 - RNA, 23 nt, Human
ugaucugcccaccucagccuccc

SEQ ID NO: 263022 - RNA, 24 nt, Human
ugaucugcccaccucagccuccca

SEQ ID NO: 263023 - RNA, 23 nt, Human
ugauuuauguucagccuuucccu

SEQ ID NO: 263024 - RNA, 22 nt, Human
ugcaauuaccccuuuuguggca

SEQ ID NO: 263025 - RNA, 22 nt, Human
ugcaugcacaacuuguaauaua

SEQ ID NO: 263026 - RNA, 19 nt, Human
ugccccaggguggucucaa

SEQ ID NO: 263027 - RNA, 25 nt, Human
ugcuagaagucuucaaaaagugaag

SEQ ID NO: 263028 - RNA, 20 nt, Human
ugcugagauuacagguguga

SEQ ID NO: 263029 - RNA, 18 nt, Human
uggaauguacuggcgcga

SEQ ID NO: 263030 - RNA, 24 nt, Human
uggaauguacuggcgcgaucucgg

SEQ ID NO: 263031 - RNA, 24 nt, Human
uggcgcgaucucggcucaccacaa

SEQ ID NO: 263032 - RNA, 18 nt, Human
ugggauuacaggcgugug

SEQ ID NO: 263033 - RNA, 23 nt, Human
ugggauuacaggcgugugcacca

SEQ ID NO: 263034 - RNA, 24 nt, Human
ugggauuacaggcgugugcaccau

SEQ ID NO: 263035 - RNA, 25 nt, Human
ugggauuucaucauguugccccagg

SEQ ID NO: 263036 - RNA, 21 nt, Human
ugugcaccaugcccagauaau

SEQ ID NO: 263037 - RNA, 18 nt, Human
uuacaggcgugugcacca

SEQ ID NO: 263038 - RNA, 21 nt, Human
uugguugugguugugauuguu

SEQ ID NO: 263039 - RNA, 20 nt, Human
uuugugguguugguuguggu

SEQ ID NO: 263040 - RNA, 20 nt, Human
uuuuuguauuuuuuuagaga

SEQ ID NO: 263041 - RNA, 23 nt, Human
uuuuuuguauuuuuuuagagaug

SEQ ID NO: 263042 - RNA, 25 nt, Human
uuuuuuuuuuuugggcagagucuca

SEQ ID NO: 263043 - RNA, 21 nt, Human
uuuuuuuuuuuuuugggcaga

SEQ ID NO: 263044 - RNA, 18 nt, Human
uuuuuuuuuuuuuuuuug

SEQ ID NO: 263045 - RNA, 20 nt, Human
aaauccccaagacaccacca

SEQ ID NO: 263046 - RNA, 23 nt, Human
aagcagccaggaggccaaggcag

SEQ ID NO: 263047 - RNA, 19 nt, Human
aaggcaggaggaugagggu

SEQ ID NO: 263048 - RNA, 23 nt, Human
accaaauccccaagacaccacca

SEQ ID NO: 263049 - RNA, 22 nt, Human
agaaagcagccaggaggccaag

SEQ ID NO: 263050 - RNA, 19 nt, Human
agccaggaggccaaggcag

SEQ ID NO: 263051 - RNA, 25 nt, Human
caaauccccaagacaccaccaagag

SEQ ID NO: 263052 - RNA, 22 nt, Human
caaggcaggaggaugaggguca

SEQ ID NO: 263053 - RNA, 19 nt, Human
caccgcgcggccccggacu

SEQ ID NO: 263054 - RNA, 19 nt, Human
caccugccccaccugaggc

SEQ ID NO: 263055 - RNA, 23 nt, Human
cagcagacucucucccaccauuu

SEQ ID NO: 263056 - RNA, 19 nt, Human
ccccaagacaccaccaaga

SEQ ID NO: 263057 - RNA, 23 nt, Human
ccgcgcggccccggacagccgca

SEQ ID NO: 263058 - RNA, 18 nt, Human
ccugugagcaucuccugg

SEQ ID NO: 263059 - RNA, 21 nt, Human
ccuugcagcagacucucuccc

SEQ ID NO: 263060 - RNA, 18 nt, Human
ccuugcuaacaggaagag

SEQ ID NO: 263061 - RNA, 21 nt, Human
cguugaugggcugcuuguccc

SEQ ID NO: 263062 - RNA, 19 nt, Human
cucucucccaccauuucau

SEQ ID NO: 263063 - RNA, 20 nt, Human
gaggccaaggcaggaggaug

SEQ ID NO: 263064 - RNA, 23 nt, Human
gcccuuguaguuaccaaguucca

SEQ ID NO: 263065 - RNA, 21 nt, Human
ggggagaaagcagccaggagg

SEQ ID NO: 263066 - RNA, 23 nt, Human
guccuacugaccucucucuuuca

SEQ ID NO: 263067 - RNA, 22 nt, Human
guccuguggccugugagcaucu

SEQ ID NO: 263068 - RNA, 20 nt, Human
uccuggaucagccugaaccc

SEQ ID NO: 263069 - RNA, 18 nt, Human
ucucccgcgcugugcuuu

SEQ ID NO: 263070 - RNA, 23 nt, Human
ucugcaccugccccaccugaggc

SEQ ID NO: 263071 - RNA, 20 nt, Human
ugagaaggaguugggcucuu

SEQ ID NO: 263072 - RNA, 24 nt, Human
ugcaccaaauccccaagacaccac

SEQ ID NO: 263073 - RNA, 21 nt, Human
ugccuggucucacccuugcag

SEQ ID NO: 263074 - RNA, 19 nt, Human
uggccugugagcaucuccu

SEQ ID NO: 263075 - RNA, 22 nt, Human
uggcguugaugggcugcuuguc

SEQ ID NO: 263076 - RNA, 20 nt, Human
uggggcugugaugccaacag

SEQ ID NO: 263077 - RNA, 27 nt, Human
acaauaacagagacauaaauauuaauu

SEQ ID NO: 263078 - RNA, 22 nt, Human
acuuuuuuuuuuuuuuuuuuuu

SEQ ID NO: 263079 - RNA, 20 nt, Human
agccuugucccuucucccug

SEQ ID NO: 263080 - RNA, 22 nt, Human
ccaaauuugaucaaacugcagu

SEQ ID NO: 263081 - RNA, 22 nt, Human
ccugggcccccaacuccaaaaa

SEQ ID NO: 263082 - RNA, 19 nt, Human
ccuugucccuucucccugg

SEQ ID NO: 263083 - RNA, 19 nt, Human
gagauuugagagagguaua

SEQ ID NO: 263084 - RNA, 19 nt, Human
gguuuuguuuuuauuuuug

SEQ ID NO: 263085 - RNA, 22 nt, Human
uaaaagccuugucccuucuccc

SEQ ID NO: 263086 - RNA, 22 nt, Human
uaacaagucuuuuaaaagccuu

SEQ ID NO: 263087 - RNA, 24 nt, Human
uaacaagucuuuuaaaagccuugu

SEQ ID NO: 263088 - RNA, 22 nt, Human
uaacagagacauaaauauuaau

SEQ ID NO: 263089 - RNA, 23 nt, Human
uaagaacguuguugaaagcguca

SEQ ID NO: 263090 - RNA, 21 nt, Human
uaccaaaugagauuugagaga

SEQ ID NO: 263091 - RNA, 25 nt, Human
uacugcauauacccaaauuugauca

SEQ ID NO: 263092 - RNA, 27 nt, Human
uauacauugaucaaaaauuguugaaac

SEQ ID NO: 263093 - RNA, 19 nt, Human
uccagugcccagcuaggag

SEQ ID NO: 263094 - RNA, 20 nt, Human
uccucaacugcauccagugc

SEQ ID NO: 263095 - RNA, 18 nt, Human
ugaugauucaaaaugacg

SEQ ID NO: 263096 - RNA, 22 nt, Human
ugucccuucucccugggccccc

SEQ ID NO: 263097 - RNA, 24 nt, Human
ugugugguuuuguuuuuauuuuug

SEQ ID NO: 263098 - RNA, 22 nt, Human
uuccugauuagggaacguguuu

SEQ ID NO: 263099 - RNA, 24 nt, Human
uucucccugggcccccaacuccaa

SEQ ID NO: 263100 - RNA, 18 nt, Human
uuuuuuuuuuuuuuccug

SEQ ID NO: 263101 - RNA, 25 nt, Human
uuuuuuuuuuuuuuccugauuaggg

SEQ ID NO: 263102 - RNA, 23 nt, Human
uuuuuuuuuuuuuuuuccugauu

SEQ ID NO: 263103 - RNA, 23 nt, Human
aaaaaaaccaaaacaaaacaaaa

SEQ ID NO: 263104 - RNA, 23 nt, Human
aaaaaaccaaaacaaaacaaaac

SEQ ID NO: 263105 - RNA, 21 nt, Human
aaaaaauguuaaccacccuua

SEQ ID NO: 263106 - RNA, 23 nt, Human
aaaaagaugacaugguugaguuu

SEQ ID NO: 263107 - RNA, 23 nt, Human
aaaacaaaacaaaacaaaaaaaa

SEQ ID NO: 263108 - RNA, 19 nt, Human
aaacaaaacaaaacaaaaa

SEQ ID NO: 263109 - RNA, 22 nt, Human
aaacagaaaaaagcagguugag

SEQ ID NO: 263110 - RNA, 23 nt, Human
aaaccaaaacaaaacaaaacaaa

SEQ ID NO: 263111 - RNA, 26 nt, Human
aaaccaaaacaaaacaaaacaaaaaa

SEQ ID NO: 263112 - RNA, 21 nt, Human
aaagacgacuaaguggccucc

SEQ ID NO: 263113 - RNA, 19 nt, Human
aacacagugaaauccuguc

SEQ ID NO: 263114 - RNA, 20 nt, Human
aacacagugaaauccugucu

SEQ ID NO: 263115 - RNA, 21 nt, Human
aacacagugaaauccugucuc

SEQ ID NO: 263116 - RNA, 21 nt, Human
aacaucuauuuauuuaaaagc

SEQ ID NO: 263117 - RNA, 27 nt, Human
aaccaaaacaaaacaaaacaaaaaaaa

SEQ ID NO: 263118 - RNA, 25 nt, Human
aaccaggacuccaauguuaccuucu

SEQ ID NO: 263119 - RNA, 23 nt, Human
aaccugcucaauccuggaaacaa

SEQ ID NO: 263120 - RNA, 18 nt, Human
aacuuucucuccucauuu

SEQ ID NO: 263121 - RNA, 18 nt, Human
aagacccugcuccucuac

SEQ ID NO: 263122 - RNA, 22 nt, Human
aagaggaaaaaaagacgacuaa

SEQ ID NO: 263123 - RNA, 21 nt, Human
aagcaagaucauaacgucugc

SEQ ID NO: 263124 - RNA, 22 nt, Human
aagcagguaagugucagccaga

SEQ ID NO: 263125 - RNA, 22 nt, Human
aagcagguugacuugcuuugaa

SEQ ID NO: 263126 - RNA, 22 nt, Human
aagcauggcugcuugaccacac

SEQ ID NO: 263127 - RNA, 20 nt, Human
aagggccacgccagccagcg

SEQ ID NO: 263128 - RNA, 18 nt, Human
aaggucccaaaaaaacag

SEQ ID NO: 263129 - RNA, 23 nt, Human
aaugccuaccucugcaccaugac

SEQ ID NO: 263130 - RNA, 24 nt, Human
acaaaacaaaacaaaaaaaauguu

SEQ ID NO: 263131 - RNA, 24 nt, Human
acagagccagacucugucucaaaa

SEQ ID NO: 263132 - RNA, 24 nt, Human
acagcgccuguuuuccaggcacug

SEQ ID NO: 263133 - RNA, 22 nt, Human
accaggucauuuugcaaagguc

SEQ ID NO: 263134 - RNA, 19 nt, Human
acccugcucacugcucuuc

SEQ ID NO: 263135 - RNA, 20 nt, Human
accugcucaauccuggaaac

SEQ ID NO: 263136 - RNA, 21 nt, Human
acgcaaggucccaaaaaaaca

SEQ ID NO: 263137 - RNA, 18 nt, Human
agaaaaaagcagguugaa

SEQ ID NO: 263138 - RNA, 18 nt, Human
agagccagacucugucuc

SEQ ID NO: 263139 - RNA, 22 nt, Human
agcagguugacuugcuuugaaa

SEQ ID NO: 263140 - RNA, 18 nt, Human
agcauuuugggaggcuga

SEQ ID NO: 263141 - RNA, 24 nt, Human
agcauuuugggaggcugagguggg

SEQ ID NO: 263142 - RNA, 20 nt, Human
agccgggugugguggugggc

SEQ ID NO: 263143 - RNA, 24 nt, Human
agccugggcgacagagccagacuc

SEQ ID NO: 263144 - RNA, 18 nt, Human
agcgcccuagggccucuc

SEQ ID NO: 263145 - RNA, 22 nt, Human
aggcacugcaggaagacccugc

SEQ ID NO: 263146 - RNA, 27 nt, Human
aggcaggagaauggcaugaacccagga

SEQ ID NO: 263147 - RNA, 24 nt, Human
aggcggagcuugcuaugagccgag

SEQ ID NO: 263148 - RNA, 24 nt, Human
aggcucgguggcucacgccuguaa

SEQ ID NO: 263149 - RNA, 19 nt, Human
aggcugaggcaggagaaug

SEQ ID NO: 263150 - RNA, 21 nt, Human
aggcugaggugggcagaucac

SEQ ID NO: 263151 - RNA, 19 nt, Human
agggagugguccuuccugu

SEQ ID NO: 263152 - RNA, 24 nt, Human
aggugggcagaucacgaggucggg

SEQ ID NO: 263153 - RNA, 21 nt, Human
auaaaaaaggcaaaaaaaaaa

SEQ ID NO: 263154 - RNA, 20 nt, Human
auauucuuugguuuugcuug

SEQ ID NO: 263155 - RNA, 24 nt, Human
auugcgccccugcacuccagccug

SEQ ID NO: 263156 - RNA, 24 nt, Human
auuuugggaggcugaggugggcag

SEQ ID NO: 263157 - RNA, 21 nt, Human
caaaacaaaacaaaacaaaaa

SEQ ID NO: 263158 - RNA, 20 nt, Human
caacugguacugucagaccc

SEQ ID NO: 263159 - RNA, 24 nt, Human
caagaccauccuggcuaacacagu

SEQ ID NO: 263160 - RNA, 31 nt, Human
caauaaaaucuguuggaauuuccauugaaaa

SEQ ID NO: 263161 - RNA, 24 nt, Human
caccuguagucccagcuacucugg

SEQ ID NO: 263162 - RNA, 24 nt, Human
cacgccuguaaucccagcauuuug

SEQ ID NO: 263163 - RNA, 20 nt, Human
cacugcucuucacgcaaggu

SEQ ID NO: 263164 - RNA, 21 nt, Human
cacuguaaaaacagaaaaaag

SEQ ID NO: 263165 - RNA, 21 nt, Human
cacuuguaagccuaccaggag

SEQ ID NO: 263166 - RNA, 24 nt, Human
cagcauuuugggaggcugaggugg

SEQ ID NO: 263167 - RNA, 22 nt, Human
caucaagaauaaaaaaggcaaa

SEQ ID NO: 263168 - RNA, 20 nt, Human
cauccaagaaaaagaugaca

SEQ ID NO: 263169 - RNA, 21 nt, Human
caugaacccaggaggcggagc

SEQ ID NO: 263170 - RNA, 23 nt, Human
ccacuuugccuuuauuuuuuaua

SEQ ID NO: 263171 - RNA, 23 nt, Human
ccagccuuuagaaaacgaggucu

SEQ ID NO: 263172 - RNA, 19 nt, Human
ccccgaaagcccgcagcgc

SEQ ID NO: 263173 - RNA, 24 nt, Human
ccccugcacuccagccugggcgac

SEQ ID NO: 263174 - RNA, 19 nt, Human
cccgcagcgcccuagggcc

SEQ ID NO: 263175 - RNA, 22 nt, Human
cccgcagcgcccuagggccucu

SEQ ID NO: 263176 - RNA, 20 nt, Human
cccgggucuuuugacgccuc

SEQ ID NO: 263177 - RNA, 19 nt, Human
cccugcacuccagccuggg

SEQ ID NO: 263178 - RNA, 19 nt, Human
cccugcacuccagccuggg

SEQ ID NO: 263179 - RNA, 20 nt, Human
cccugcacuccagccugggc

SEQ ID NO: 263180 - RNA, 24 nt, Human
cccugcacuccagccugggcgaca

SEQ ID NO: 263181 - RNA, 23 nt, Human
ccggccaggcucgguggcucacg

SEQ ID NO: 263182 - RNA, 19 nt, Human
ccucccuugcuucuucguc

SEQ ID NO: 263183 - RNA, 27 nt, Human
ccuccuaguggccacaugcaagaguuu

SEQ ID NO: 263184 - RNA, 24 nt, Human
ccugcacuccagccugggcgacag

SEQ ID NO: 263185 - RNA, 22 nt, Human
ccuggcuaacacagugaaaucc

SEQ ID NO: 263186 - RNA, 24 nt, Human
ccuggcuaacacagugaaauccug

SEQ ID NO: 263187 - RNA, 22 nt, Human
ccuguagucccagcuacucugg

SEQ ID NO: 263188 - RNA, 23 nt, Human
ccuguagucccagcuacucugga

SEQ ID NO: 263189 - RNA, 18 nt, Human
cgcaugccuuuugccaaa

SEQ ID NO: 263190 - RNA, 24 nt, Human
cgccuguaaucccagcauuuuggg

SEQ ID NO: 263191 - RNA, 24 nt, Human
cgucuucauccuucgaaucaaacc

SEQ ID NO: 263192 - RNA, 24 nt, Human
cucaaaaaaaaaaaaccaaaacaa

SEQ ID NO: 263193 - RNA, 21 nt, Human
cucacgccuguaaucccagca

SEQ ID NO: 263194 - RNA, 21 nt, Human
cucacgccuguaaucccagca

SEQ ID NO: 263195 - RNA, 21 nt, Human
cucagaaugccuaccucugca

SEQ ID NO: 263196 - RNA, 19 nt, Human
cuccuucauauuuagaagc

SEQ ID NO: 263197 - RNA, 21 nt, Human
cucuccuucauauuuagaagc

SEQ ID NO: 263198 - RNA, 23 nt, Human
cucugucucaaaaaaaaaaaacc

SEQ ID NO: 263199 - RNA, 20 nt, Human
cugauaccuuuauaaucuug

SEQ ID NO: 263200 - RNA, 25 nt, Human
cugcacuccagccugggcgacagag

SEQ ID NO: 263201 - RNA, 18 nt, Human
cuggcuaacacagugaaa

SEQ ID NO: 263202 - RNA, 24 nt, Human
cuggcuaacacagugaaauccugu

SEQ ID NO: 263203 - RNA, 20 nt, Human
cugucuucagucugucccca

SEQ ID NO: 263204 - RNA, 27 nt, Human
cuuccgaagagaacagagcuacaccuu

SEQ ID NO: 263205 - RNA, 22 nt, Human
cuugaguuuuaacagaauugac

SEQ ID NO: 263206 - RNA, 22 nt, Human
gaacagagcuacaccuuccccg

SEQ ID NO: 263207 - RNA, 18 nt, Human
gaacccugcucacugcuc

SEQ ID NO: 263208 - RNA, 23 nt, Human
gaaucaaaccaggacuccaaugu

SEQ ID NO: 263209 - RNA, 24 nt, Human
gacagagccagacucugucucaaa

SEQ ID NO: 263210 - RNA, 26 nt, Human
gacccugcuccucuacaagguuccac

SEQ ID NO: 263211 - RNA, 23 nt, Human
gaccugauaccuuuauaaucuug

SEQ ID NO: 263212 - RNA, 23 nt, Human
gagauugcgccccugcacuccag

SEQ ID NO: 263213 - RNA, 24 nt, Human
gcaaauuuuugaaauaacugcaag

SEQ ID NO: 263214 - RNA, 27 nt, Human
gcaagaguuugcuggacauacaggugg

SEQ ID NO: 263215 - RNA, 24 nt, Human
gcacuccagccugggcgacagagc

SEQ ID NO: 263216 - RNA, 22 nt, Human
gcaggagaauggcaugaaccca

SEQ ID NO: 263217 - RNA, 22 nt, Human
gccccugcacuccagccugggc

SEQ ID NO: 263218 - RNA, 24 nt, Human
gccccugcacuccagccugggcga

SEQ ID NO: 263219 - RNA, 23 nt, Human
gcccuagggccucucucggggcu

SEQ ID NO: 263220 - RNA, 19 nt, Human
gcgccccugcacuccagcc

SEQ ID NO: 263221 - RNA, 24 nt, Human
gcuaacacagugaaauccugucuc

SEQ ID NO: 263222 - RNA, 24 nt, Human
ggagcuugcuaugagccgagauug

SEQ ID NO: 263223 - RNA, 25 nt, Human
ggcaccuguagucccagcuacucug

SEQ ID NO: 263224 - RNA, 21 nt, Human
ggcagaucacgaggucgggag

SEQ ID NO: 263225 - RNA, 21 nt, Human
ggcucacgccuguaaucccag

SEQ ID NO: 263226 - RNA, 20 nt, Human
gggcaccuguagucccagcu

SEQ ID NO: 263227 - RNA, 23 nt, Human
gguggcucacgccuguaauccca

SEQ ID NO: 263228 - RNA, 24 nt, Human
gguggcucacgccuguaaucccag

SEQ ID NO: 263229 - RNA, 24 nt, Human
gguggugggcaccuguagucccag

SEQ ID NO: 263230 - RNA, 20 nt, Human
guagucuucacuauuuuucu

SEQ ID NO: 263231 - RNA, 21 nt, Human
gugguccuuccuguccccacu

SEQ ID NO: 263232 - RNA, 18 nt, Human
uaaaaugccccauuuuuc

SEQ ID NO: 263233 - RNA, 21 nt, Human
uaaaaugguaagaaaugagug

SEQ ID NO: 263234 - RNA, 23 nt, Human
uaaauagucuucgaaaaccagaa

SEQ ID NO: 263235 - RNA, 21 nt, Human
uaaauccauagaucaauuuua

SEQ ID NO: 263236 - RNA, 21 nt, Human
uaacacagugaaauccugucu

SEQ ID NO: 263237 - RNA, 22 nt, Human
uaacacagugaaauccugucuc

SEQ ID NO: 263238 - RNA, 24 nt, Human
uaacacagugaaauccugucucua

SEQ ID NO: 263239 - RNA, 22 nt, Human
uaacagaauugacuuaaccauc

SEQ ID NO: 263240 - RNA, 19 nt, Human
uaacuuucucuccucauuu

SEQ ID NO: 263241 - RNA, 20 nt, Human
uaagaaaugagugacuuuau

SEQ ID NO: 263242 - RNA, 21 nt, Human
uaccaggaggaaccagaacag

SEQ ID NO: 263243 - RNA, 19 nt, Human
uacucuggaggcugaggca

SEQ ID NO: 263244 - RNA, 25 nt, Human
uauaguaaacacuuguaagccuacc

SEQ ID NO: 263245 - RNA, 23 nt, Human
uauuuuguaaaaacacaaaaaau

SEQ ID NO: 263246 - RNA, 30 nt, Human
ucaaaaaaaaaaaaccaaaacaaaacaaag

SEQ ID NO: 263247 - RNA, 18 nt, Human
ucacgaggucgggagauc

SEQ ID NO: 263248 - RNA, 24 nt, Human
ucacgaggucgggagaucaagacc

SEQ ID NO: 263249 - RNA, 21 nt, Human
ucacgccuguaaucccagcau

SEQ ID NO: 263250 - RNA, 23 nt, Human
ucagagcccagcugagaaccugc

SEQ ID NO: 263251 - RNA, 21 nt, Human
uccaacuccgcacgggauauc

SEQ ID NO: 263252 - RNA, 19 nt, Human
uccaagaaaaagaugacau

SEQ ID NO: 263253 - RNA, 24 nt, Human
uccagccugggcgacagagccaga

SEQ ID NO: 263254 - RNA, 20 nt, Human
ucccaaaaaaacagcgccug

SEQ ID NO: 263255 - RNA, 18 nt, Human
uccccugcucagaaugcc

SEQ ID NO: 263256 - RNA, 21 nt, Human
uccucauuuccuuuuuguuuc

SEQ ID NO: 263257 - RNA, 23 nt, Human
ucgcgucgcggggggacugcgga

SEQ ID NO: 263258 - RNA, 23 nt, Human
ucuaauuauucaccuauuuuccu

SEQ ID NO: 263259 - RNA, 30 nt, Human
ucuaggcccuuauuuuguuccccuggucgg

SEQ ID NO: 263260 - RNA, 18 nt, Human
ucucaaaaaaaaaaaacc

SEQ ID NO: 263261 - RNA, 23 nt, Human
ucugcagccauuuaguccagccu

SEQ ID NO: 263262 - RNA, 19 nt, Human
ucuguccccaucucagagg

SEQ ID NO: 263263 - RNA, 20 nt, Human
ucugucucaaaaaaaaaaaa

SEQ ID NO: 263264 - RNA, 24 nt, Human
ucuuugguuuugcuuguuuuuggg

SEQ ID NO: 263265 - RNA, 26 nt, Human
ugacaagcaagcagugagcgcaugcc

SEQ ID NO: 263266 - RNA, 18 nt, Human
ugacaugguugaguuuga

SEQ ID NO: 263267 - RNA, 21 nt, Human
ugagccgagauugcgccccug

SEQ ID NO: 263268 - RNA, 22 nt, Human
ugagccgagauugcgccccugc

SEQ ID NO: 263269 - RNA, 21 nt, Human
ugaggaucaucaagaauaaaa

SEQ ID NO: 263270 - RNA, 23 nt, Human
ugaggcaggagaauggcaugaac

SEQ ID NO: 263271 - RNA, 24 nt, Human
ugaggcaggagaauggcaugaacc

SEQ ID NO: 263272 - RNA, 25 nt, Human
ugaggcaggagaauggcaugaaccc

SEQ ID NO: 263273 - RNA, 26 nt, Human
ugaggugggcagaucacgaggucggg

SEQ ID NO: 263274 - RNA, 21 nt, Human
ugagugacuuuaugcugccca

SEQ ID NO: 263275 - RNA, 23 nt, Human
ugaguuugaggcuuguugcuuga

SEQ ID NO: 263276 - RNA, 24 nt, Human
ugaguuugaggcuuguugcuugag

SEQ ID NO: 263277 - RNA, 25 nt, Human
ugcccagaaagcauggcugcuugac

SEQ ID NO: 263278 - RNA, 18 nt, Human
ugcucacugcucuucacg

SEQ ID NO: 263279 - RNA, 24 nt, Human
ugcuccugucccuuccacuuccuc

SEQ ID NO: 263280 - RNA, 18 nt, Human
uggagcacgugcuuucuu

SEQ ID NO: 263281 - RNA, 21 nt, Human
uggcaucuaccuaugugcucc

SEQ ID NO: 263282 - RNA, 21 nt, Human
uggccuccuagauuccacugu

SEQ ID NO: 263283 - RNA, 22 nt, Human
uggcucacgccuguaaucccag

SEQ ID NO: 263284 - RNA, 24 nt, Human
uggcucacgccuguaaucccagca

SEQ ID NO: 263285 - RNA, 20 nt, Human
ugggaggcugaggugggcag

SEQ ID NO: 263286 - RNA, 24 nt, Human
ugggaggcugaggugggcagauca

SEQ ID NO: 263287 - RNA, 18 nt, Human
ugggaguuggaagcaaga

SEQ ID NO: 263288 - RNA, 22 nt, Human
uggugggcaccuguagucccag

SEQ ID NO: 263289 - RNA, 24 nt, Human
ugguggugggcaccuguaguccca

SEQ ID NO: 263290 - RNA, 20 nt, Human
ugucacagggucacacuucu

SEQ ID NO: 263291 - RNA, 19 nt, Human
uguccccaaccucuccuuc

SEQ ID NO: 263292 - RNA, 21 nt, Human
ugucuugacaauaaaacuugg

SEQ ID NO: 263293 - RNA, 18 nt, Human
uuagccgggugugguggu

SEQ ID NO: 263294 - RNA, 24 nt, Human
uuagccgggugugguggugggcac

SEQ ID NO: 263295 - RNA, 21 nt, Human
uuccacuuccuccuucugugg

SEQ ID NO: 263296 - RNA, 19 nt, Human
uuccucagggguacggaaa

SEQ ID NO: 263297 - RNA, 22 nt, Human
uuccuugaggaucaucaagaau

SEQ ID NO: 263298 - RNA, 24 nt, Human
uugcuuuuuuccuuaauauuuucu

SEQ ID NO: 263299 - RNA, 25 nt, Human
uugggaggcugaggugggcagauca

SEQ ID NO: 263300 - RNA, 20 nt, Human
uugggcccaauaaaaauagg

SEQ ID NO: 263301 - RNA, 24 nt, Human
uugugguccuaauucauauuuccc

SEQ ID NO: 263302 - RNA, 21 nt, Human
uuuccugcccuaaggcuuuuu

SEQ ID NO: 263303 - RNA, 21 nt, Human
uuuuccaggcacugcaggaag

SEQ ID NO: 263304 - RNA, 21 nt, Human
uuuuuuuuuuaauagcauagu

SEQ ID NO: 263305 - RNA, 22 nt, Human
agaaaaagaagaauacacguua

SEQ ID NO: 263306 - RNA, 23 nt, Human
auguguucuuaaagcuguaauuu

SEQ ID NO: 263307 - RNA, 18 nt, Human
cauaaugauuuccaagcu

SEQ ID NO: 263308 - RNA, 24 nt, Human
cucagcaucuaagaaaaagaagaa

SEQ ID NO: 263309 - RNA, 19 nt, Human
uauauuuauguguaaugug

SEQ ID NO: 263310 - RNA, 19 nt, Human
uuuccaagcuucagucugc

SEQ ID NO: 263311 - RNA, 23 nt, Human
aaaaauacaauauauauuagaac

SEQ ID NO: 263312 - RNA, 27 nt, Human
aaacucaaaaaugugccaagcagcagg

SEQ ID NO: 263313 - RNA, 27 nt, Human
agccuuugcauggaaggacagagucuc

SEQ ID NO: 263314 - RNA, 24 nt, Human
agggacugaaggcugccuuuagcu

SEQ ID NO: 263315 - RNA, 23 nt, Human
agguuuggcacuaguaaagcuga

SEQ ID NO: 263316 - RNA, 19 nt, Human
agucaaaaaagcuuaaucc

SEQ ID NO: 263317 - RNA, 21 nt, Human
auaacagauaugcucuacaug

SEQ ID NO: 263318 - RNA, 18 nt, Human
aucaggaaguuuuguuau

SEQ ID NO: 263319 - RNA, 23 nt, Human
caaaaaugugccaagcagcagaa

SEQ ID NO: 263320 - RNA, 19 nt, Human
cacuggggaaucuaaaaau

SEQ ID NO: 263321 - RNA, 23 nt, Human
cagcagaaauaaaaggagugaaa

SEQ ID NO: 263322 - RNA, 19 nt, Human
caggaccaauagaaagcuc

SEQ ID NO: 263323 - RNA, 22 nt, Human
ccaaucuccacuccauguccuu

SEQ ID NO: 263324 - RNA, 20 nt, Human
cccaagcuaucaaauaaaaa

SEQ ID NO: 263325 - RNA, 21 nt, Human
cccaggaccaauagaaagcuc

SEQ ID NO: 263326 - RNA, 21 nt, Human
gagcucaaggcaacagggcaa

SEQ ID NO: 263327 - RNA, 18 nt, Human
gcacaacgcgacuuccac

SEQ ID NO: 263328 - RNA, 18 nt, Human
gccaagcagcagaaauaa

SEQ ID NO: 263329 - RNA, 21 nt, Human
ggaaaacucaaaaaugugcca

SEQ ID NO: 263330 - RNA, 19 nt, Human
ggaaucuaaaaauccaagg

SEQ ID NO: 263331 - RNA, 21 nt, Human
ggcaacagggcaauuugggga

SEQ ID NO: 263332 - RNA, 24 nt, Human
ggcacuguaagucacaagaaugag

SEQ ID NO: 263333 - RNA, 26 nt, Human
uaaaaaaaaguaauggugauagauaa

SEQ ID NO: 263334 - RNA, 22 nt, Human
uaaaaauaaaucccucuguagg

SEQ ID NO: 263335 - RNA, 23 nt, Human
uaaaaauaaaucccucuguaggc

SEQ ID NO: 263336 - RNA, 24 nt, Human
uaaaaauccaaggauacuaacuaa

SEQ ID NO: 263337 - RNA, 19 nt, Human
uaaauccauaugcccagag

SEQ ID NO: 263338 - RNA, 21 nt, Human
uaaugugggaaaacucaaaaa

SEQ ID NO: 263339 - RNA, 18 nt, Human
uacaauauauauuagaac

SEQ ID NO: 263340 - RNA, 28 nt, Human
uagaacaguggagaaagauuaucauaac

SEQ ID NO: 263341 - RNA, 22 nt, Human
uauaacagggaauuagacacug

SEQ ID NO: 263342 - RNA, 22 nt, Human
uaugccauuucuuucagaucuu

SEQ ID NO: 263343 - RNA, 18 nt, Human
ucaaaaaagcuuaauccu

SEQ ID NO: 263344 - RNA, 21 nt, Human
ucagaagagcucaaggcaaca

SEQ ID NO: 263345 - RNA, 18 nt, Human
ucauggagacaaauaaug

SEQ ID NO: 263346 - RNA, 21 nt, Human
ucauggagacaaauaaugugg

SEQ ID NO: 263347 - RNA, 19 nt, Human
uccagcacacugcuugagu

SEQ ID NO: 263348 - RNA, 22 nt, Human
ugccuuuagcucagaagagcuc

SEQ ID NO: 263349 - RNA, 18 nt, Human
uggcacuaguaaagcuga

SEQ ID NO: 263350 - RNA, 19 nt, Human
uggcacuguaagucacaag

SEQ ID NO: 263351 - RNA, 20 nt, Human
uggcacuguaagucacaaga

SEQ ID NO: 263352 - RNA, 18 nt, Human
ugggaaaacucaaaaaug

SEQ ID NO: 263353 - RNA, 20 nt, Human
ugugaaguucucugggaagu

SEQ ID NO: 263354 - RNA, 24 nt, Human
uuggcacuaguaaagcugacuuuu

SEQ ID NO: 263355 - RNA, 20 nt, Human
uuggggagagucacaggcac

SEQ ID NO: 263356 - RNA, 18 nt, Human
uuucaggaagccuuugca

SEQ ID NO: 263357 - RNA, 24 nt, Human
uuucucaaaaggaucaaaagccuu

SEQ ID NO: 263358 - RNA, 26 nt, Human
agaaaaaccagucuugggagcgugag

SEQ ID NO: 263359 - RNA, 20 nt, Human
aggaggcacgggggccucug

SEQ ID NO: 263360 - RNA, 23 nt, Human
ccucuggaaugcaugagaguaga

SEQ ID NO: 263361 - RNA, 20 nt, Human
uggcagcaccccguguccgg

SEQ ID NO: 263362 - RNA, 22 nt, Human
acacugagaaguguccgagaaa

SEQ ID NO: 263363 - RNA, 23 nt, Human
acacugagaaguguccgagaaau

SEQ ID NO: 263364 - RNA, 20 nt, Human
accacaacacuucccaggca

SEQ ID NO: 263365 - RNA, 23 nt, Human
accugaacucccagcucaccagc

SEQ ID NO: 263366 - RNA, 22 nt, Human
agcagcccaccugaacucccag

SEQ ID NO: 263367 - RNA, 19 nt, Human
agcucagcgggcgacgugc

SEQ ID NO: 263368 - RNA, 18 nt, Human
aggaggcugugagcagcc

SEQ ID NO: 263369 - RNA, 21 nt, Human
caaacagggugcaggggcucu

SEQ ID NO: 263370 - RNA, 18 nt, Human
caccagcccaaacagggu

SEQ ID NO: 263371 - RNA, 23 nt, Human
cagcccaccugaacucccagcuc

SEQ ID NO: 263372 - RNA, 19 nt, Human
ccaccacaacacuucccag

SEQ ID NO: 263373 - RNA, 19 nt, Human
ccagcccaaacagggugca

SEQ ID NO: 263374 - RNA, 23 nt, Human
cccaccugaacucccagcucacc

SEQ ID NO: 263375 - RNA, 23 nt, Human
ccccaccacaacacuucccaggc

SEQ ID NO: 263376 - RNA, 19 nt, Human
ccucugaaggaggcuguga

SEQ ID NO: 263377 - RNA, 24 nt, Human
cugaacucccagcucaccagccca

SEQ ID NO: 263378 - RNA, 24 nt, Human
gcucucugggccaguccuccuggg

SEQ ID NO: 263379 - RNA, 21 nt, Human
ggagcccccaccacaacacuu

SEQ ID NO: 263380 - RNA, 20 nt, Human
ggcugcuugagagguggagc

SEQ ID NO: 263381 - RNA, 20 nt, Human
gguggggagggggcagaaca

SEQ ID NO: 263382 - RNA, 22 nt, Human
ucucagggcucucugggccagu

SEQ ID NO: 263383 - RNA, 22 nt, Human
ugaacucccagcucaccagccc

SEQ ID NO: 263384 - RNA, 23 nt, Human
ugagcagcccaccugaacuccca

SEQ ID NO: 263385 - RNA, 20 nt, Human
ugagcccucaggggcccaca

SEQ ID NO: 263386 - RNA, 19 nt, Human
ugaguggaguggaauggca

SEQ ID NO: 263387 - RNA, 18 nt, Human
ugcaggggcucuggcccu

SEQ ID NO: 263388 - RNA, 19 nt, Human
uggcccugaagaaccugag

SEQ ID NO: 263389 - RNA, 21 nt, Human
uugguggggccucugaaggag

SEQ ID NO: 263390 - RNA, 24 nt, Human
agacaggggugccgaggcuucugg

SEQ ID NO: 263391 - RNA, 19 nt, Human
agcccccagccuuccccag

SEQ ID NO: 263392 - RNA, 18 nt, Human
aggcaggggacuggccaa

SEQ ID NO: 263393 - RNA, 23 nt, Human
aggcaggggacuggccaagucug

SEQ ID NO: 263394 - RNA, 22 nt, Human
agggccugacuucggucuccuc

SEQ ID NO: 263395 - RNA, 19 nt, Human
cagcccccagccuucccca

SEQ ID NO: 263396 - RNA, 19 nt, Human
cagcucagagcaggaccgg

SEQ ID NO: 263397 - RNA, 20 nt, Human
ccccggaggcuugugguggg

SEQ ID NO: 263398 - RNA, 21 nt, Human
gagcacaggcaggggacuggc

SEQ ID NO: 263399 - RNA, 23 nt, Human
gauggagaggcuuacagccccca

SEQ ID NO: 263400 - RNA, 26 nt, Human
ggagaggcuuacagcccccagccuuc

SEQ ID NO: 263401 - RNA, 22 nt, Human
gggcucuguguuugcagcucuc

SEQ ID NO: 263402 - RNA, 18 nt, Human
ggggagccacccaggagg

SEQ ID NO: 263403 - RNA, 24 nt, Human
ggugccgaggcuucugggagucug

SEQ ID NO: 263404 - RNA, 23 nt, Human
ggugggcucuguguuugcagcuc

SEQ ID NO: 263405 - RNA, 24 nt, Human
uucagggccugacuucggucuccu

SEQ ID NO: 263406 - RNA, 18 nt, Human
uucugggagucuggaagc

SEQ ID NO: 263407 - RNA, 20 nt, Human
aaccaccgaugaauggacag

SEQ ID NO: 263408 - RNA, 20 nt, Human
aagaaacaggcaguagggaa

SEQ ID NO: 263409 - RNA, 18 nt, Human
aagaacagcaggagccug

SEQ ID NO: 263410 - RNA, 24 nt, Human
acugaggauuucagggcucagagu

SEQ ID NO: 263411 - RNA, 23 nt, Human
agaaaauaagaaccagggccaga

SEQ ID NO: 263412 - RNA, 18 nt, Human
agaacagcaggagccugg

SEQ ID NO: 263413 - RNA, 22 nt, Human
agacacagaggcuaucuauacc

SEQ ID NO: 263414 - RNA, 24 nt, Human
agagaggggggaggaggggaaucg

SEQ ID NO: 263415 - RNA, 19 nt, Human
agagcaagagaaacgggga

SEQ ID NO: 263416 - RNA, 19 nt, Human
agagcaagagaaacgggga

SEQ ID NO: 263417 - RNA, 21 nt, Human
agagggcaggagaugggaugg

SEQ ID NO: 263418 - RNA, 20 nt, Human
agcaagagaugcagcaggga

SEQ ID NO: 263419 - RNA, 26 nt, Human
agccaaucuuccccgccaaggagacu

SEQ ID NO: 263420 - RNA, 21 nt, Human
aggagggaggauuuagggcug

SEQ ID NO: 263421 - RNA, 19 nt, Human
aggcagaggggagggagau

SEQ ID NO: 263422 - RNA, 20 nt, Human
agggagagaggggggaggag

SEQ ID NO: 263423 - RNA, 20 nt, Human
aggggggaggaggggaaucc

SEQ ID NO: 263424 - RNA, 18 nt, Human
aggucagggggagucggg

SEQ ID NO: 263425 - RNA, 20 nt, Human
aguaaaaugugaggugaugg

SEQ ID NO: 263426 - RNA, 20 nt, Human
augaagugcuggugcccaca

SEQ ID NO: 263427 - RNA, 20 nt, Human
auggggcugcaggcugccuc

SEQ ID NO: 263428 - RNA, 22 nt, Human
auggggcugcaggcugccucca

SEQ ID NO: 263429 - RNA, 19 nt, Human
caaagccaaucuuccccgc

SEQ ID NO: 263430 - RNA, 20 nt, Human
caagagaugcagcagggagu

SEQ ID NO: 263431 - RNA, 18 nt, Human
cacaguggaagagccugg

SEQ ID NO: 263432 - RNA, 23 nt, Human
cagaguaggaccgagaauugacc

SEQ ID NO: 263433 - RNA, 25 nt, Human
cagcagcugggguauuuagggcugg

SEQ ID NO: 263434 - RNA, 27 nt, Human
cagcagcugggguauuuagggcugggg

SEQ ID NO: 263435 - RNA, 19 nt, Human
cagcugggguauuuagggc

SEQ ID NO: 263436 - RNA, 25 nt, Human
cagcugggguauuuagggcuggggg

SEQ ID NO: 263437 - RNA, 19 nt, Human
caggaugugaggagaggag

SEQ ID NO: 263438 - RNA, 23 nt, Human
cagggagagaggggggaggaggg

SEQ ID NO: 263439 - RNA, 24 nt, Human
ccacccacggggcuccagggguug

SEQ ID NO: 263440 - RNA, 20 nt, Human
ccagggccagagaccaggug

SEQ ID NO: 263441 - RNA, 22 nt, Human
cccacaagggaugagguuucug

SEQ ID NO: 263442 - RNA, 22 nt, Human
cccacccacggggcuccagggg

SEQ ID NO: 263443 - RNA, 21 nt, Human
cccugcccccacccacggggc

SEQ ID NO: 263444 - RNA, 25 nt, Human
cggggcuccaggggugagagaaagg

SEQ ID NO: 263445 - RNA, 24 nt, Human
cucuauauugugcacauggagacc

SEQ ID NO: 263446 - RNA, 24 nt, Human
cugaggcucguuacugacuugccc

SEQ ID NO: 263447 - RNA, 21 nt, Human
cugcaggcugccuccagguuc

SEQ ID NO: 263448 - RNA, 22 nt, Human
cuuuuuacaauaaacucuauau

SEQ ID NO: 263449 - RNA, 25 nt, Human
gaaccagggccagagaccaggugaa

SEQ ID NO: 263450 - RNA, 19 nt, Human
gaagggaaugaggaggagg

SEQ ID NO: 263451 - RNA, 20 nt, Human
gaagggaaugaggaggaggg

SEQ ID NO: 263452 - RNA, 20 nt, Human
gacuggggugcaggauggau

SEQ ID NO: 263453 - RNA, 23 nt, Human
gagagcaagagaugcagcaggga

SEQ ID NO: 263454 - RNA, 21 nt, Human
gagaugggauggggcugcagg

SEQ ID NO: 263455 - RNA, 23 nt, Human
gaggagggaggauuuagggcugg

SEQ ID NO: 263456 - RNA, 22 nt, Human
gaggaggggaaucggaggggau

SEQ ID NO: 263457 - RNA, 22 nt, Human
gagggggcugccuuuccuuggg

SEQ ID NO: 263458 - RNA, 21 nt, Human
gagguaguaaaaugugaggug

SEQ ID NO: 263459 - RNA, 21 nt, Human
gaguugacaccagggagagag

SEQ ID NO: 263460 - RNA, 19 nt, Human
gauacaaggaaugagagca

SEQ ID NO: 263461 - RNA, 19 nt, Human
gauacaaggaaugagagca

SEQ ID NO: 263462 - RNA, 21 nt, Human
gaugugcugacuguggaguag

SEQ ID NO: 263463 - RNA, 19 nt, Human
gcugggggaguaggggcag

SEQ ID NO: 263464 - RNA, 23 nt, Human
gcugggugauggggaggaacagc

SEQ ID NO: 263465 - RNA, 24 nt, Human
ggaaugagagcaagagaaacgggg

SEQ ID NO: 263466 - RNA, 24 nt, Human
ggaaugagagcaagagaaacgggg

SEQ ID NO: 263467 - RNA, 23 nt, Human
ggaauugagcaacggggugaggg

SEQ ID NO: 263468 - RNA, 24 nt, Human
ggaauugagcaacggggugagggg

SEQ ID NO: 263469 - RNA, 22 nt, Human
ggagaaggaugggauuuggggg

SEQ ID NO: 263470 - RNA, 22 nt, Human
ggagaggagggaggauuuaggg

SEQ ID NO: 263471 - RNA, 23 nt, Human
ggagaggagggaggauuuagggc

SEQ ID NO: 263472 - RNA, 19 nt, Human
ggaggagggagacugaggg

SEQ ID NO: 263473 - RNA, 21 nt, Human
ggagggagacugagggggcug

SEQ ID NO: 263474 - RNA, 24 nt, Human
ggauacaaggaaugagagcaagag

SEQ ID NO: 263475 - RNA, 20 nt, Human
ggauggguuuaaaaggcaga

SEQ ID NO: 263476 - RNA, 25 nt, Human
ggcaggagaugggaugggggggacc

SEQ ID NO: 263477 - RNA, 21 nt, Human
ggcagggcggaggggguggug

SEQ ID NO: 263478 - RNA, 22 nt, Human
ggcaguagggaauugagagaaa

SEQ ID NO: 263479 - RNA, 23 nt, Human
ggccagagaccaggugaaggacg

SEQ ID NO: 263480 - RNA, 24 nt, Human
ggccagagaccaggugaaggacga

SEQ ID NO: 263481 - RNA, 20 nt, Human
ggcugggggaguaggggcag

SEQ ID NO: 263482 - RNA, 18 nt, Human
gggaaugaggaggaggga

SEQ ID NO: 263483 - RNA, 19 nt, Human
gggagagguggugcccaca

SEQ ID NO: 263484 - RNA, 26 nt, Human
gggaggauuuagggcugggggacugg

SEQ ID NO: 263485 - RNA, 24 nt, Human
gggauggguuuaaaaggcagaggg

SEQ ID NO: 263486 - RNA, 27 nt, Human
gggcaggagaugggaugggggggaccc

SEQ ID NO: 263487 - RNA, 18 nt, Human
gggcagggcggagggggu

SEQ ID NO: 263488 - RNA, 22 nt, Human
gggcagggcggaggggguggug

SEQ ID NO: 263489 - RNA, 24 nt, Human
gggcggaggggguggugaaggggc

SEQ ID NO: 263490 - RNA, 21 nt, Human
ggggaaucggaggggaugggu

SEQ ID NO: 263491 - RNA, 18 nt, Human
ggggacuggggugcagga

SEQ ID NO: 263492 - RNA, 20 nt, Human
ggggaggaggggaaucggag

SEQ ID NO: 263493 - RNA, 25 nt, Human
ggggguggugaaggggccccgcagg

SEQ ID NO: 263494 - RNA, 26 nt, Human
gggugaggggggaauuaggagcuggg

SEQ ID NO: 263495 - RNA, 25 nt, Human
ggguggugaaggggccccgcagggc

SEQ ID NO: 263496 - RNA, 24 nt, Human
ggugauggcaguuguggaugugcu

SEQ ID NO: 263497 - RNA, 18 nt, Human
gucaaaaggggaggacgu

SEQ ID NO: 263498 - RNA, 20 nt, Human
gucgggaugucuguacucag

SEQ ID NO: 263499 - RNA, 22 nt, Human
gugaaggacgugaggauuggag

SEQ ID NO: 263500 - RNA, 18 nt, Human
gugaggugauggcaguug

SEQ ID NO: 263501 - RNA, 22 nt, Human
guuacaggugugggagucaccg

SEQ ID NO: 263502 - RNA, 20 nt, Human
uaagaaccagggccagagac

SEQ ID NO: 263503 - RNA, 18 nt, Human
uacaggaaugcuguaccc

SEQ ID NO: 263504 - RNA, 21 nt, Human
uagggcugggggaguaggggc

SEQ ID NO: 263505 - RNA, 18 nt, Human
ucagccaaguuggaagga

SEQ ID NO: 263506 - RNA, 20 nt, Human
ucaguggguauagagggaaa

SEQ ID NO: 263507 - RNA, 20 nt, Human
uccagguggguuucagccaa

SEQ ID NO: 263508 - RNA, 24 nt, Human
uccagguucaaaguaagaaacagg

SEQ ID NO: 263509 - RNA, 22 nt, Human
ucuguacuuuggauggagggag

SEQ ID NO: 263510 - RNA, 23 nt, Human
ugaaauggacgcaaugcagaccc

SEQ ID NO: 263511 - RNA, 25 nt, Human
ugaacugcgucuccagguggguuuc

SEQ ID NO: 263512 - RNA, 19 nt, Human
ugaaggacgugaggauugg

SEQ ID NO: 263513 - RNA, 19 nt, Human
ugaauggacaggcucagaa

SEQ ID NO: 263514 - RNA, 22 nt, Human
ugagagaaaggggugaauggag

SEQ ID NO: 263515 - RNA, 20 nt, Human
ugagagcaagagaugcagca

SEQ ID NO: 263516 - RNA, 24 nt, Human
ugaggaaacugaggcucguuacug

SEQ ID NO: 263517 - RNA, 19 nt, Human
ugaggaggagggagacuga

SEQ ID NO: 263518 - RNA, 23 nt, Human
ugaggaggagggagacugagggg

SEQ ID NO: 263519 - RNA, 21 nt, Human
ugaggugauggcaguugugga

SEQ ID NO: 263520 - RNA, 21 nt, Human
ugagguuucuguacuuuggau

SEQ ID NO: 263521 - RNA, 19 nt, Human
ugauggggaggaacagcag

SEQ ID NO: 263522 - RNA, 23 nt, Human
ugcccaagaacagcaggagccug

SEQ ID NO: 263523 - RNA, 21 nt, Human
ugcuagggaccaggaugugag

SEQ ID NO: 263524 - RNA, 19 nt, Human
uggaagggaaugaggagga

SEQ ID NO: 263525 - RNA, 22 nt, Human
ugggauuugggggaacagucuc

SEQ ID NO: 263526 - RNA, 19 nt, Human
ugggguuacagguguggga

SEQ ID NO: 263527 - RNA, 24 nt, Human
ugggguuacaggugugggagucac

SEQ ID NO: 263528 - RNA, 24 nt, Human
uggugcccacaagggaugagguuu

SEQ ID NO: 263529 - RNA, 24 nt, Human
uguagucaaugaagugcuggugcc

SEQ ID NO: 263530 - RNA, 20 nt, Human
ugugaggagaggagggagga

SEQ ID NO: 263531 - RNA, 23 nt, Human
uuacaggugugggagucaccgca

SEQ ID NO: 263532 - RNA, 22 nt, Human
uuagggcugggggaguaggggc

SEQ ID NO: 263533 - RNA, 20 nt, Human
uuaggucagggggagucggg

SEQ ID NO: 263534 - RNA, 20 nt, Human
uucagggcucagaguuaccg

SEQ ID NO: 263535 - RNA, 23 nt, Human
uugaaauggacgcaaugcagacc

SEQ ID NO: 263536 - RNA, 23 nt, Human
uugcaggugaggaaacugaggcu

SEQ ID NO: 263537 - RNA, 21 nt, Human
uuguagucaaugaagugcugg

SEQ ID NO: 263538 - RNA, 22 nt, Human
aaacaggggugaaguuggaagg

SEQ ID NO: 263539 - RNA, 19 nt, Human
aaagggccccagagggagc

SEQ ID NO: 263540 - RNA, 18 nt, Human
aaagucccccuggcuccc

SEQ ID NO: 263541 - RNA, 21 nt, Human
aagaggacaaaagagggcggg

SEQ ID NO: 263542 - RNA, 21 nt, Human
aagcagcggcugucagugaag

SEQ ID NO: 263543 - RNA, 19 nt, Human
aaguuguucccagccagga

SEQ ID NO: 263544 - RNA, 20 nt, Human
aauggcgccuuaaaugugcg

SEQ ID NO: 263545 - RNA, 20 nt, Human
aauggcgccuuaaaugugcg

SEQ ID NO: 263546 - RNA, 21 nt, Human
aauggcgccuuaaaugugcgg

SEQ ID NO: 263547 - RNA, 21 nt, Human
aauggcgccuuaaaugugcgg

SEQ ID NO: 263548 - RNA, 24 nt, Human
acacuugcagccagccaccuccag

SEQ ID NO: 263549 - RNA, 21 nt, Human
acagccuucagucaccuuccc

SEQ ID NO: 263550 - RNA, 20 nt, Human
acaggaaagagcuccccaga

SEQ ID NO: 263551 - RNA, 25 nt, Human
accccagaagcgcaggaccacgaac

SEQ ID NO: 263552 - RNA, 21 nt, Human
acgcugcacgugccagccuuc

SEQ ID NO: 263553 - RNA, 22 nt, Human
acuaccccaccaggaaagaaaa

SEQ ID NO: 263554 - RNA, 19 nt, Human
acugcagcccuuggaggcc

SEQ ID NO: 263555 - RNA, 18 nt, Human
agaaaggcccgcaugucc

SEQ ID NO: 263556 - RNA, 21 nt, Human
agaagcgcaggaccacgaacg

SEQ ID NO: 263557 - RNA, 24 nt, Human
agaauggggaagaaagggccccag

SEQ ID NO: 263558 - RNA, 20 nt, Human
agacgugagcccguccccuc

SEQ ID NO: 263559 - RNA, 20 nt, Human
agagcuccccagagccgcac

SEQ ID NO: 263560 - RNA, 24 nt, Human
agcacagcccacguggggccgccu

SEQ ID NO: 263561 - RNA, 22 nt, Human
agcagacgugagcccguccccu

SEQ ID NO: 263562 - RNA, 21 nt, Human
agcccguagaacugcagcccu

SEQ ID NO: 263563 - RNA, 18 nt, Human
agcccuuggaggccugag

SEQ ID NO: 263564 - RNA, 19 nt, Human
agcggcagcaccagcucug

SEQ ID NO: 263565 - RNA, 19 nt, Human
agcugcagcacacgccucc

SEQ ID NO: 263566 - RNA, 19 nt, Human
aggacaaaagagggcgggg

SEQ ID NO: 263567 - RNA, 18 nt, Human
aggagaccugguuccagc

SEQ ID NO: 263568 - RNA, 18 nt, Human
aggccgcccagggcccca

SEQ ID NO: 263569 - RNA, 18 nt, Human
aggccucagagccguugc

SEQ ID NO: 263570 - RNA, 21 nt, Human
aggccucgcagcccuucccag

SEQ ID NO: 263571 - RNA, 19 nt, Human
aggcggcuggcccgaacca

SEQ ID NO: 263572 - RNA, 23 nt, Human
aggcugcuggagcgguacugagc

SEQ ID NO: 263573 - RNA, 27 nt, Human
agggccccagagggagcgaccuugggg

SEQ ID NO: 263574 - RNA, 19 nt, Human
agggcggguacugauugag

SEQ ID NO: 263575 - RNA, 23 nt, Human
aggggcugccccugucccaccag

SEQ ID NO: 263576 - RNA, 25 nt, Human
agucugggagauguagcaguggccu

SEQ ID NO: 263577 - RNA, 21 nt, Human
agugaaggcuggggggcaggu

SEQ ID NO: 263578 - RNA, 23 nt, Human
aguggaaaagcaucuccucaggg

SEQ ID NO: 263579 - RNA, 21 nt, Human
aguggcgggagggaugggagg

SEQ ID NO: 263580 - RNA, 22 nt, Human
aguugguggccugggcugagcc

SEQ ID NO: 263581 - RNA, 30 nt, Human
augaacucgugugugugugugugugugugg

SEQ ID NO: 263582 - RNA, 30 nt, Human; identical to SEQ ID NO: 263581

SEQ ID NO: 263583 - RNA, 19 nt, Human
augaaguugguggccuggg

SEQ ID NO: 263584 - RNA, 21 nt, Human
cacaguccugggcuggagugc

SEQ ID NO: 263585 - RNA, 19 nt, Human
cacaucgcgcacgucuucc

SEQ ID NO: 263586 - RNA, 23 nt, Human
caccagcucuguggcuccaguuc

SEQ ID NO: 263587 - RNA, 22 nt, Human
cacccuuuucucuccucagccc

SEQ ID NO: 263588 - RNA, 24 nt, Human
cacgucguuccugggcuccucacu

SEQ ID NO: 263589 - RNA, 19 nt, Human
cacguucagggcugucaca

SEQ ID NO: 263590 - RNA, 18 nt, Human
cacugggcaggugcuggc

SEQ ID NO: 263591 - RNA, 21 nt, Human
cagagccgcacagugccgccc

SEQ ID NO: 263592 - RNA, 19 nt, Human
cagagucugggagauguag

SEQ ID NO: 263593 - RNA, 19 nt, Human
cagcaagaggccgcccagg

SEQ ID NO: 263594 - RNA, 21 nt, Human
cagcccagagucugggagaug

SEQ ID NO: 263595 - RNA, 22 nt, Human
cagcugccuacugccgaggccc

SEQ ID NO: 263596 - RNA, 21 nt, Human
caggagaccugguuccagccc

SEQ ID NO: 263597 - RNA, 22 nt, Human
cagggccccaaagaagagggag

SEQ ID NO: 263598 - RNA, 19 nt, Human
cagggcgauaccucuccca

SEQ ID NO: 263599 - RNA, 25 nt, Human
caugcucaggugcucacagugcucg

SEQ ID NO: 263600 - RNA, 24 nt, Human
cauuccagcggcagcaccagcucu

SEQ ID NO: 263601 - RNA, 19 nt, Human
ccaccgaggcguugaccuc

SEQ ID NO: 263602 - RNA, 22 nt, Human
ccacgcuaaucacccuuuucuc

SEQ ID NO: 263603 - RNA, 24 nt, Human
ccacuuggcuguugcggagaaagg

SEQ ID NO: 263604 - RNA, 19 nt, Human
ccagagugaauggcuccag

SEQ ID NO: 263605 - RNA, 21 nt, Human
ccagcagcaagaggccgccca

SEQ ID NO: 263606 - RNA, 24 nt, Human
cccacuaccccaccaggaaagaaa

SEQ ID NO: 263607 - RNA, 23 nt, Human
ccccaccccacuaccccaccagg

SEQ ID NO: 263608 - RNA, 18 nt, Human
ccccagaagcgcaggacc

SEQ ID NO: 263609 - RNA, 23 nt, Human
ccccagagggagcgaccuugggg

SEQ ID NO: 263610 - RNA, 21 nt, Human
ccccagcugggccaccgaggc

SEQ ID NO: 263611 - RNA, 21 nt, Human
ccccaggggcugccccugucc

SEQ ID NO: 263612 - RNA, 25 nt, Human
ccccaggggcugccccugucccacc

SEQ ID NO: 263613 - RNA, 21 nt, Human
cccccagcccauugaaggugu

SEQ ID NO: 263614 - RNA, 21 nt, Human
ccccggagcaaccccagaagc

SEQ ID NO: 263615 - RNA, 23 nt, Human
ccccggagcaaccccagaagcgc

SEQ ID NO: 263616 - RNA, 20 nt, Human
cccgacccccagcagcaaga

SEQ ID NO: 263617 - RNA, 18 nt, Human
cccgcauguccagggucc

SEQ ID NO: 263618 - RNA, 19 nt, Human
cccgucacacuugcagcca

SEQ ID NO: 263619 - RNA, 19 nt, Human
cccuggggaagcuccacgg

SEQ ID NO: 263620 - RNA, 23 nt, Human
ccgggccccgagggcgguacugg

SEQ ID NO: 263621 - RNA, 20 nt, Human
ccucagggcucccuggggga

SEQ ID NO: 263622 - RNA, 20 nt, Human
ccugggcuggagugcagaug

SEQ ID NO: 263623 - RNA, 21 nt, Human
ccuggguccucuccucccucc

SEQ ID NO: 263624 - RNA, 22 nt, Human
cgcaguagcggccgaaggugcc

SEQ ID NO: 263625 - RNA, 20 nt, Human
cgccuccaccaccgcggcca

SEQ ID NO: 263626 - RNA, 19 nt, Human
cggcucaggaggacuccgg

SEQ ID NO: 263627 - RNA, 20 nt, Human
cgucgaagcuggcggaggcc

SEQ ID NO: 263628 - RNA, 20 nt, Human
cgucuugggccccgaccagc

SEQ ID NO: 263629 - RNA, 21 nt, Human
cgugugugugugugugugugu

SEQ ID NO: 263630 - RNA, 21 nt, Human
cgugugugugugugugugugu

SEQ ID NO: 263631 - RNA, 23 nt, Human
cgugugugugugugugugugugu

SEQ ID NO: 263632 - RNA, 23 nt, Human
cgugugugugugugugugugugu

SEQ ID NO: 263633 - RNA, 20 nt, Human
cucagccccaccccacuacc

SEQ ID NO: 263634 - RNA, 19 nt, Human
cuccucccuccccaggggc

SEQ ID NO: 263635 - RNA, 21 nt, Human
cugcagaaucgauucguucca

SEQ ID NO: 263636 - RNA, 23 nt, Human
cugcagcggggcccacugggcag

SEQ ID NO: 263637 - RNA, 20 nt, Human
cugccaggucauuccaaagu

SEQ ID NO: 263638 - RNA, 18 nt, Human
cuggccccggagcaaccc

SEQ ID NO: 263639 - RNA, 19 nt, Human
cuggcggaggaguggagga

SEQ ID NO: 263640 - RNA, 22 nt, Human
cuguggcuccaguuccugggcc

SEQ ID NO: 263641 - RNA, 23 nt, Human
cuucaaggcaaggccucagcuga

SEQ ID NO: 263642 - RNA, 24 nt, Human
gaagaggacaaaagagggcggggc

SEQ ID NO: 263643 - RNA, 21 nt, Human
gaaggcagcuggucauuccuc

SEQ ID NO: 263644 - RNA, 22 nt, Human
gacagccuucagucaccuuccc

SEQ ID NO: 263645 - RNA, 19 nt, Human
gcagaccacaguccugggc

SEQ ID NO: 263646 - RNA, 18 nt, Human
gcaggaccacgaacgucc

SEQ ID NO: 263647 - RNA, 25 nt, Human
gccccaccccacuaccccaccagga

SEQ ID NO: 263648 - RNA, 23 nt, Human
gcccccgucacacuugcagccag

SEQ ID NO: 263649 - RNA, 19 nt, Human
gccccuuguaggcuucaau

SEQ ID NO: 263650 - RNA, 20 nt, Human
gccgcucugggggcuguaga

SEQ ID NO: 263651 - RNA, 24 nt, Human
gccucagagccguugcggcucagg

SEQ ID NO: 263652 - RNA, 21 nt, Human
gcucugggggcuguagaccag

SEQ ID NO: 263653 - RNA, 23 nt, Human
gcuggagugcagaugccaagcca

SEQ ID NO: 263654 - RNA, 18 nt, Human
gcuggcacuggccuccau

SEQ ID NO: 263655 - RNA, 21 nt, Human
ggaacaagggcaggagaccug

SEQ ID NO: 263656 - RNA, 18 nt, Human
ggaagaggacaaaagagg

SEQ ID NO: 263657 - RNA, 18 nt, Human
ggagcgaccuuggggcug

SEQ ID NO: 263658 - RNA, 22 nt, Human
ggaggagacaugggggaauggg

SEQ ID NO: 263659 - RNA, 19 nt, Human
ggccaucaccacauuauga

SEQ ID NO: 263660 - RNA, 19 nt, Human
ggcccaggcugcuggagcg

SEQ ID NO: 263661 - RNA, 23 nt, Human
ggcuggcggaggaguggaggaug

SEQ ID NO: 263662 - RNA, 21 nt, Human
ggcugggacaucagugggcug

SEQ ID NO: 263663 - RNA, 23 nt, Human
gggaagaauggggaagaaagggc

SEQ ID NO: 263664 - RNA, 20 nt, Human
gggaagaggacaaaagaggg

SEQ ID NO: 263665 - RNA, 20 nt, Human
gggcccaggcugcuggagcg

SEQ ID NO: 263666 - RNA, 21 nt, Human
gggcgggaggcuggcggagga

SEQ ID NO: 263667 - RNA, 19 nt, Human
gggcugagccagucugggc

SEQ ID NO: 263668 - RNA, 18 nt, Human
gucacacuggaaaugggu

SEQ ID NO: 263669 - RNA, 23 nt, Human
gucaccuucccuuuuccagucuc

SEQ ID NO: 263670 - RNA, 18 nt, Human
gugaagcugcacagcugc

SEQ ID NO: 263671 - RNA, 20 nt, Human
gugaagcugcacagcugccu

SEQ ID NO: 263672 - RNA, 23 nt, Human
uaacugacaccauccaagguggu

SEQ ID NO: 263673 - RNA, 21 nt, Human
uaagaacgccuccaccaccgc

SEQ ID NO: 263674 - RNA, 18 nt, Human
uaccucucccacacuggc

SEQ ID NO: 263675 - RNA, 19 nt, Human
uauaagaacgccuccacca

SEQ ID NO: 263676 - RNA, 19 nt, Human
uauguagcacagcccacgu

SEQ ID NO: 263677 - RNA, 25 nt, Human
ucacccuuuucucuccucagcccca

SEQ ID NO: 263678 - RNA, 19 nt, Human
ucagugaaggcuggggggc

SEQ ID NO: 263679 - RNA, 21 nt, Human
ucccaaaagcaauggcgccuc

SEQ ID NO: 263680 - RNA, 21 nt, Human
ucccaaaagcaauggcgccuc

SEQ ID NO: 263681 - RNA, 21 nt, Human
ucccaguauucauucuccuug

SEQ ID NO: 263682 - RNA, 21 nt, Human
ucccaguauucauucuccuug

SEQ ID NO: 263683 - RNA, 20 nt, Human
ucccuggggaagcuccacgg

SEQ ID NO: 263684 - RNA, 20 nt, Human
ucccugggggaaugguggag

SEQ ID NO: 263685 - RNA, 19 nt, Human
uccgagaugaccauccagu

SEQ ID NO: 263686 - RNA, 21 nt, Human
uccucacaggcauccucggag

SEQ ID NO: 263687 - RNA, 24 nt, Human
uccucagccccaccccacuacccc

SEQ ID NO: 263688 - RNA, 18 nt, Human
ucgaagcuggcggaggcc

SEQ ID NO: 263689 - RNA, 19 nt, Human
ucgaagcuggcggaggccu

SEQ ID NO: 263690 - RNA, 21 nt, Human
ucggugcagcugucucugagc

SEQ ID NO: 263691 - RNA, 20 nt, Human
ucucaaagagcuccaagucg

SEQ ID NO: 263692 - RNA, 19 nt, Human
ucuccgaaggggccaggga

SEQ ID NO: 263693 - RNA, 18 nt, Human
ugaagucguccucuggau

SEQ ID NO: 263694 - RNA, 18 nt, Human
ugaaucagcguggucugc

SEQ ID NO: 263695 - RNA, 23 nt, Human
ugaaucagcguggucugccccuu

SEQ ID NO: 263696 - RNA, 21 nt, Human
ugacggggcccaggcugcugg

SEQ ID NO: 263697 - RNA, 20 nt, Human
ugagcaagagcuggaugacu

SEQ ID NO: 263698 - RNA, 20 nt, Human
ugagcugaguggcgggaggg

SEQ ID NO: 263699 - RNA, 24 nt, Human
ugaggugagucuugaggucggaac

SEQ ID NO: 263700 - RNA, 24 nt, Human
ugaggugagucuugaggucggaac

SEQ ID NO: 263701 - RNA, 25 nt, Human
ugaguagaaaacaggggugaaguug

SEQ ID NO: 263702 - RNA, 20 nt, Human
ugaguuggaauucaggaauc

SEQ ID NO: 263703 - RNA, 24 nt, Human
ugaguuggaauucaggaaucuauc

SEQ ID NO: 263704 - RNA, 22 nt, Human
ugcagccagccaccuccaggga

SEQ ID NO: 263705 - RNA, 22 nt, Human
ugccaaggacgcugcacgugcc

SEQ ID NO: 263706 - RNA, 22 nt, Human
ugcggcaaaagucccccuggcu

SEQ ID NO: 263707 - RNA, 24 nt, Human
ugcuagaaucuccagagugaaugg

SEQ ID NO: 263708 - RNA, 19 nt, Human
ugcugccaggaacaagggc

SEQ ID NO: 263709 - RNA, 20 nt, Human
ugcuucucaucagccugagc

SEQ ID NO: 263710 - RNA, 26 nt, Human
uggaaaugggugggccacccuccucu

SEQ ID NO: 263711 - RNA, 19 nt, Human
uggaacuccgagaugacca

SEQ ID NO: 263712 - RNA, 23 nt, Human
uggaaggcagcuggucauuccuc

SEQ ID NO: 263713 - RNA, 20 nt, Human
uggacugaaguuguucccag

SEQ ID NO: 263714 - RNA, 18 nt, Human
uggaggccugaguuggaa

SEQ ID NO: 263715 - RNA, 23 nt, Human
uggaggccugaguuggaauucag

SEQ ID NO: 263716 - RNA, 27 nt, Human
uggagugcagaugccaagccaaucuug

SEQ ID NO: 263717 - RNA, 28 nt, Human
uggagugcagaugccaagccaaucuugg

SEQ ID NO: 263718 - RNA, 22 nt, Human
uggccugggcugagccagucug

SEQ ID NO: 263719 - RNA, 22 nt, Human
ugggaacaggucacacuggaaa

SEQ ID NO: 263720 - RNA, 25 nt, Human
ugggaggagacaugggggaauggga

SEQ ID NO: 263721 - RNA, 22 nt, Human
ugggcaggugcuggcacuggcc

SEQ ID NO: 263722 - RNA, 18 nt, Human
ugggggaaugggaacagg

SEQ ID NO: 263723 - RNA, 21 nt, Human
ugggggccuguauguagcaca

SEQ ID NO: 263724 - RNA, 24 nt, Human
ugggggccuguauguagcacagcc

SEQ ID NO: 263725 - RNA, 23 nt, Human
uggggguccccgaacauccaggc

SEQ ID NO: 263726 - RNA, 18 nt, Human
uggguccucuccucccuc

SEQ ID NO: 263727 - RNA, 19 nt, Human
uguaacugacaccauccaa

SEQ ID NO: 263728 - RNA, 24 nt, Human
ugucacagucugguuauccagcag

SEQ ID NO: 263729 - RNA, 19 nt, Human
ugugucugcgugaggaccc

SEQ ID NO: 263730 - RNA, 19 nt, Human
ugugucugcgugaggaccc

SEQ ID NO: 263731 - RNA, 22 nt, Human
ugugugcacgcgcgcgugcaca

SEQ ID NO: 263732 - RNA, 22 nt, Human
ugugugcacgcgcgcgugcaca

SEQ ID NO: 263733 - RNA, 22 nt, Human
ugugugcacgcgcgcgugcaca

SEQ ID NO: 263734 - RNA, 25 nt, Human
ugugugugugcacgcgcgcgugcag

SEQ ID NO: 263735 - RNA, 18 nt, Human
ugugugugugugcacgcg

SEQ ID NO: 263736 - RNA, 18 nt, Human
ugugugugugugcacgcg

SEQ ID NO: 263737 - RNA, 18 nt, Human
ugugugugugugugcacg

SEQ ID NO: 263738 - RNA, 18 nt, Human
ugugugugugugugcacg

SEQ ID NO: 263739 - RNA, 18 nt, Human
ugugugugugugugugug

SEQ ID NO: 263740 - RNA, 18 nt, Human
ugugugugugugugugug

SEQ ID NO: 263741 - RNA, 24 nt, Human
uucaaggcaaggccucagcugagu

SEQ ID NO: 263742 - RNA, 20 nt, Human
uuccagacccccaggagccc

SEQ ID NO: 263743 - RNA, 23 nt, Human
uuccugggccaacugccaaggac

SEQ ID NO: 263744 - RNA, 22 nt, Human
uuccugggcuccucacuccucc

SEQ ID NO: 263745 - RNA, 18 nt, Human
uuccuggguccucuccuc

SEQ ID NO: 263746 - RNA, 21 nt, Human
uucuagguugacaguuggacu

SEQ ID NO: 263747 - RNA, 19 nt, Human
uuggcacuucuugcuagaa

SEQ ID NO: 263748 - RNA, 19 nt, Human
uuuccagucucccaaaagc

SEQ ID NO: 263749 - RNA, 22 nt, Human
caugaucagacaaugcacaucc

SEQ ID NO: 263750 - RNA, 27 nt, Human
ccccucacccuucuggggccgguuuca

SEQ ID NO: 263751 - RNA, 22 nt, Human
ccgcagaggaggcccaagguuu

SEQ ID NO: 263752 - RNA, 22 nt, Human
cuggggccgguuucacccacgg

SEQ ID NO: 263753 - RNA, 21 nt, Human
gacaaugcacauccuggcucc

SEQ ID NO: 263754 - RNA, 22 nt, Human
gacuccugaguggcgcccuccc

SEQ ID NO: 263755 - RNA, 19 nt, Human
gaggaggcccaagguuuuc

SEQ ID NO: 263756 - RNA, 18 nt, Human
gccccucacccuucuggg

SEQ ID NO: 263757 - RNA, 21 nt, Human
ggccgguuucacccacggggu

SEQ ID NO: 263758 - RNA, 20 nt, Human
gggcagcaggagcacggagc

SEQ ID NO: 263759 - RNA, 25 nt, Human
gggcagcaggagcacggagcgcggg

SEQ ID NO: 263760 - RNA, 18 nt, Human
gggggugugagcuguucc

SEQ ID NO: 263761 - RNA, 18 nt, Human
gugagcuguucccagagu

SEQ ID NO: 263762 - RNA, 24 nt, Human
uggcuccagguggacagagcaugg

SEQ ID NO: 263763 - RNA, 19 nt, Human
aagugcugacaagccgcaa

SEQ ID NO: 263764 - RNA, 20 nt, Human
acaaccucucccuccauccg

SEQ ID NO: 263765 - RNA, 21 nt, Human
acagccuuguacccgcccucu

SEQ ID NO: 263766 - RNA, 25 nt, Human
accucagcgaccuucgccccagcca

SEQ ID NO: 263767 - RNA, 19 nt, Human
acuuucguguccuccucca

SEQ ID NO: 263768 - RNA, 20 nt, Human
agaagggacuacaugggccc

SEQ ID NO: 263769 - RNA, 22 nt, Human
agacugaggccaagugggcagg

SEQ ID NO: 263770 - RNA, 18 nt, Human
agaggguguccgggaucc

SEQ ID NO: 263771 - RNA, 19 nt, Human
agcacaaccucucccucca

SEQ ID NO: 263772 - RNA, 18 nt, Human
agcagcacuugagcggcg

SEQ ID NO: 263773 - RNA, 20 nt, Human
agcagcagcagcgcacccag

SEQ ID NO: 263774 - RNA, 21 nt, Human
agccagaaggucauguucggc

SEQ ID NO: 263775 - RNA, 18 nt, Human
agccagcagcagcagcgc

SEQ ID NO: 263776 - RNA, 20 nt, Human
agccuuggggcuggggcucc

SEQ ID NO: 263777 - RNA, 18 nt, Human
agccuuguacccgcccuc

SEQ ID NO: 263778 - RNA, 19 nt, Human
agcgagaccuccagugccc

SEQ ID NO: 263779 - RNA, 19 nt, Human
agcgagaccuccagugccc

SEQ ID NO: 263780 - RNA, 23 nt, Human
agcgggcaaggucggccuguugg

SEQ ID NO: 263781 - RNA, 25 nt, Human
aggaaggucauggggcuggggacac

SEQ ID NO: 263782 - RNA, 23 nt, Human
aggacggcgaggccaaggagagc

SEQ ID NO: 263783 - RNA, 23 nt, Human
aggggagauggcaguaugugccc

SEQ ID NO: 263784 - RNA, 21 nt, Human
agggucccugggagggcucag

SEQ ID NO: 263785 - RNA, 19 nt, Human
aggucauggggcuggggac

SEQ ID NO: 263786 - RNA, 22 nt, Human
aggucauggggcuggggacacu

SEQ ID NO: 263787 - RNA, 22 nt, Human
aggugcugguucccacaccggg

SEQ ID NO: 263788 - RNA, 22 nt, Human
aggugcugguucccauaccggg

SEQ ID NO: 263789 - RNA, 22 nt, Human
aggugcugguucccauacuggg

SEQ ID NO: 263790 - RNA, 19 nt, Human
agguggggagacugaggcc

SEQ ID NO: 263791 - RNA, 22 nt, Human
agucacuggcaccugcugucau

SEQ ID NO: 263792 - RNA, 23 nt, Human
aguggugcugguccagggcccag

SEQ ID NO: 263793 - RNA, 22 nt, Human
aucaccaccgggcgcaucguag

SEQ ID NO: 263794 - RNA, 21 nt, Human
auggggcuggggacacuccug

SEQ ID NO: 263795 - RNA, 23 nt, Human
caaccucugcguagaaggcuccc

SEQ ID NO: 263796 - RNA, 22 nt, Human
cacaaccucucccuccauccgg

SEQ ID NO: 263797 - RNA, 18 nt, Human
caccagcagccagaaggu

SEQ ID NO: 263798 - RNA, 21 nt, Human
caccccuaggccuccuggucu

SEQ ID NO: 263799 - RNA, 19 nt, Human
cacccuuaucuccuugguc

SEQ ID NO: 263800 - RNA, 18 nt, Human
caccugaagauggggugc

SEQ ID NO: 263801 - RNA, 20 nt, Human
cacugaguagcgggcaaggu

SEQ ID NO: 263802 - RNA, 22 nt, Human
cagaagggacuacaugggcccc

SEQ ID NO: 263803 - RNA, 24 nt, Human
cagaagggacuacaugggcccccg

SEQ ID NO: 263804 - RNA, 21 nt, Human
cagcagcagcagcgcacccag

SEQ ID NO: 263805 - RNA, 26 nt, Human
cagccugcaguugcgucucggggaug

SEQ ID NO: 263806 - RNA, 27 nt, Human
cagccugcaguugcgucucggggauga

SEQ ID NO: 263807 - RNA, 23 nt, Human
cagcgcacccagcaccccgcccu

SEQ ID NO: 263808 - RNA, 22 nt, Human
cagcgccacgcgccacggugcc

SEQ ID NO: 263809 - RNA, 25 nt, Human
caggcaccgaggcacagggcagaag

SEQ ID NO: 263810 - RNA, 21 nt, Human
cagggucaaccaaggggcuca

SEQ ID NO: 263811 - RNA, 23 nt, Human
caucguagggacccccaccccuc

SEQ ID NO: 263812 - RNA, 19 nt, Human
cauggggcuggggacacuc

SEQ ID NO: 263813 - RNA, 22 nt, Human
ccaccccuccccgcgcccucgc

SEQ ID NO: 263814 - RNA, 18 nt, Human
ccacuggguguggcuggu

SEQ ID NO: 263815 - RNA, 22 nt, Human
ccagcagcagcagcgcacccag

SEQ ID NO: 263816 - RNA, 23 nt, Human
ccagcagcagcagcgcacccagc

SEQ ID NO: 263817 - RNA, 18 nt, Human
ccagcgccacgcgccacg

SEQ ID NO: 263818 - RNA, 20 nt, Human
ccaguuggccuuguggucag

SEQ ID NO: 263819 - RNA, 19 nt, Human
cccccagcgcgccucaguc

SEQ ID NO: 263820 - RNA, 25 nt, Human
cccccagcgcgccucaguccagguu

SEQ ID NO: 263821 - RNA, 18 nt, Human
ccccggagugucccgcac

SEQ ID NO: 263822 - RNA, 25 nt, Human
cccggagugucccgcaccagcagcc

SEQ ID NO: 263823 - RNA, 19 nt, Human
cccggggaccccccgggug

SEQ ID NO: 263824 - RNA, 20 nt, Human
ccgggcaggagcugagaggg

SEQ ID NO: 263825 - RNA, 18 nt, Human
ccgguccagccucagggc

SEQ ID NO: 263826 - RNA, 24 nt, Human
ccucagaggcugagaaggggcagc

SEQ ID NO: 263827 - RNA, 19 nt, Human
ccuccgaggggccgccacc

SEQ ID NO: 263828 - RNA, 25 nt, Human
ccucgcccucaucgccgcugccgga

SEQ ID NO: 263829 - RNA, 19 nt, Human
ccucucccuccauccggaa

SEQ ID NO: 263830 - RNA, 21 nt, Human
ccucuggccgccgcuccuugg

SEQ ID NO: 263831 - RNA, 22 nt, Human
ccugagccuggauccucagagg

SEQ ID NO: 263832 - RNA, 23 nt, Human
ccugagccuggauccucagaggc

SEQ ID NO: 263833 - RNA, 21 nt, Human
ccuuggggcuggggcuccgga

SEQ ID NO: 263834 - RNA, 19 nt, Human
ccuuggucaggauggaccu

SEQ ID NO: 263835 - RNA, 22 nt, Human
cgaccacgucugccuccguccc

SEQ ID NO: 263836 - RNA, 24 nt, Human
cgauaugugauggccgaguugagg

SEQ ID NO: 263837 - RNA, 18 nt, Human
cgcgaggccaaggagagc

SEQ ID NO: 263838 - RNA, 22 nt, Human
cgcugccggagucacuggcgcc

SEQ ID NO: 263839 - RNA, 22 nt, Human
cggagcuuugccagagcagcac

SEQ ID NO: 263840 - RNA, 22 nt, Human
cggagcuuugccagagcagcac

SEQ ID NO: 263841 - RNA, 19 nt, Human
cggcgaggccaaggagagc

SEQ ID NO: 263842 - RNA, 19 nt, Human
cgggaucccccgagcccca

SEQ ID NO: 263843 - RNA, 21 nt, Human
cggguccugagccuggauccu

SEQ ID NO: 263844 - RNA, 20 nt, Human
cgguccagccucagggcggg

SEQ ID NO: 263845 - RNA, 19 nt, Human
cggugccagaggucaccgu

SEQ ID NO: 263846 - RNA, 19 nt, Human
cguagaaguccaggggccg

SEQ ID NO: 263847 - RNA, 22 nt, Human
cguccagcacugacacgaacac

SEQ ID NO: 263848 - RNA, 19 nt, Human
cguugagaacgaccacguc

SEQ ID NO: 263849 - RNA, 24 nt, Human
cucaggccacacggcgcacccacc

SEQ ID NO: 263850 - RNA, 22 nt, Human
cuccaacccaagcauguagauu

SEQ ID NO: 263851 - RNA, 22 nt, Human
cuccacggugaccugggucacu

SEQ ID NO: 263852 - RNA, 24 nt, Human
cucccgccugugccaguguggugg

SEQ ID NO: 263853 - RNA, 19 nt, Human
cuccuccacccuuaucucc

SEQ ID NO: 263854 - RNA, 20 nt, Human
cucuggcuuugggagcagcg

SEQ ID NO: 263855 - RNA, 21 nt, Human
cugagcuugaaugcagacgua

SEQ ID NO: 263856 - RNA, 19 nt, Human
cugcagucaccguccugcc

SEQ ID NO: 263857 - RNA, 18 nt, Human
cugcgcuccaacccaagc

SEQ ID NO: 263858 - RNA, 18 nt, Human
cuggccgccgcuccuugg

SEQ ID NO: 263859 - RNA, 18 nt, Human
cuggggacacuccuggcc

SEQ ID NO: 263860 - RNA, 19 nt, Human
cuggggaggcagggccggg

SEQ ID NO: 263861 - RNA, 21 nt, Human
cugugccucccccagagcugg

SEQ ID NO: 263862 - RNA, 18 nt, Human
cugugcugugcccccacc

SEQ ID NO: 263863 - RNA, 18 nt, Human
cugugcugugcccccacc

SEQ ID NO: 263864 - RNA, 18 nt, Human
cugugcuguguccccacc

SEQ ID NO: 263865 - RNA, 22 nt, Human
gaagggacuacaugggcccccg

SEQ ID NO: 263866 - RNA, 23 nt, Human
gaaggucauggggcuggggacac

SEQ ID NO: 263867 - RNA, 22 nt, Human
gaccggcuucugccaagggggc

SEQ ID NO: 263868 - RNA, 21 nt, Human
gaccugggucacugaguagcg

SEQ ID NO: 263869 - RNA, 19 nt, Human
gagaaggugcagggcagga

SEQ ID NO: 263870 - RNA, 20 nt, Human
gagcagcacuugagccgggg

SEQ ID NO: 263871 - RNA, 20 nt, Human
gagcagcacuugagcggcgg

SEQ ID NO: 263872 - RNA, 22 nt, Human
gagguugguggccucagaguug

SEQ ID NO: 263873 - RNA, 19 nt, Human
gauccucagaggcugagaa

SEQ ID NO: 263874 - RNA, 20 nt, Human
gcacccagcaccccgcccag

SEQ ID NO: 263875 - RNA, 18 nt, Human
gcaggcgcuggcccaggg

SEQ ID NO: 263876 - RNA, 24 nt, Human
gccagaggucaccguguugugggc

SEQ ID NO: 263877 - RNA, 23 nt, Human
gccagcagcagcagcgcacccag

SEQ ID NO: 263878 - RNA, 20 nt, Human
gccguggggcuuccgccagc

SEQ ID NO: 263879 - RNA, 21 nt, Human
gccuccgucccgauguccucg

SEQ ID NO: 263880 - RNA, 26 nt, Human
gcucugggggaagcggggcgggcucc

SEQ ID NO: 263881 - RNA, 21 nt, Human
gcugccggagucacuggcgcc

SEQ ID NO: 263882 - RNA, 21 nt, Human
gcugguucccacaccgggggg

SEQ ID NO: 263883 - RNA, 21 nt, Human
gcugguucccauaccgggggg

SEQ ID NO: 263884 - RNA, 24 nt, Human
ggaacgccugguugucaaagccuu

SEQ ID NO: 263885 - RNA, 24 nt, Human
ggacaaggacgcgaggccaaggag

SEQ ID NO: 263886 - RNA, 18 nt, Human
ggacgagguugguggccu

SEQ ID NO: 263887 - RNA, 22 nt, Human
ggaggugcugguucccacaccg

SEQ ID NO: 263888 - RNA, 22 nt, Human
ggaggugcugguucccauaccg

SEQ ID NO: 263889 - RNA, 21 nt, Human
ggaguggcugguuggugggag

SEQ ID NO: 263890 - RNA, 20 nt, Human
ggaucccuugaugguucugg

SEQ ID NO: 263891 - RNA, 19 nt, Human
ggcaggagcugagagggug

SEQ ID NO: 263892 - RNA, 20 nt, Human
ggcaggguguuuacugcugc

SEQ ID NO: 263893 - RNA, 20 nt, Human
ggccaaggagagccagcagc

SEQ ID NO: 263894 - RNA, 23 nt, Human
ggcccaguuguuccuccagccuc

SEQ ID NO: 263895 - RNA, 19 nt, Human
ggccggggggugcgggcuc

SEQ ID NO: 263896 - RNA, 19 nt, Human
ggcugggggagcgagaccu

SEQ ID NO: 263897 - RNA, 19 nt, Human
ggcugggggagcgagaccu

SEQ ID NO: 263898 - RNA, 23 nt, Human
gggaguggcugguuggugggagg

SEQ ID NO: 263899 - RNA, 20 nt, Human
gggcaggagcugagagggug

SEQ ID NO: 263900 - RNA, 26 nt, Human
gggcaggagcugagaggguguccggg

SEQ ID NO: 263901 - RNA, 20 nt, Human
gggcaggcgcuggcccaggg

SEQ ID NO: 263902 - RNA, 26 nt, Human
gggcaucggugccuccgcgggcuugg

SEQ ID NO: 263903 - RNA, 21 nt, Human
ggggaaugugucucucacccc

SEQ ID NO: 263904 - RNA, 19 nt, Human
ggggauggggggacaucug

SEQ ID NO: 263905 - RNA, 18 nt, Human
ggggcuggggcuccggag

SEQ ID NO: 263906 - RNA, 19 nt, Human
ggggucuguacugugcccc

SEQ ID NO: 263907 - RNA, 19 nt, Human
ggggucugugcugugcccc

SEQ ID NO: 263908 - RNA, 19 nt, Human
ggggucugugcugugcccc

SEQ ID NO: 263909 - RNA, 19 nt, Human
ggggucugugcugugcccc

SEQ ID NO: 263910 - RNA, 21 nt, Human
gggucggaggcugggggagcg

SEQ ID NO: 263911 - RNA, 21 nt, Human
gggucggaggcugggggagcg

SEQ ID NO: 263912 - RNA, 20 nt, Human
gggucgugcguggggcuggg

SEQ ID NO: 263913 - RNA, 18 nt, Human
ggucacaggcaccgaggc

SEQ ID NO: 263914 - RNA, 19 nt, Human
gguugguggccucagaguu

SEQ ID NO: 263915 - RNA, 19 nt, Human
guccagggcccaguuguuc

SEQ ID NO: 263916 - RNA, 20 nt, Human
guccgggaucccccgagccc

SEQ ID NO: 263917 - RNA, 19 nt, Human
guccucgccaaaccagaca

SEQ ID NO: 263918 - RNA, 21 nt, Human
gucuggguggaugaugaaugu

SEQ ID NO: 263919 - RNA, 24 nt, Human
gugcccgugcggcugggggagagg

SEQ ID NO: 263920 - RNA, 24 nt, Human
gugcccgugcggcugggggagagg

SEQ ID NO: 263921 - RNA, 19 nt, Human
gugccuccgcucugacaca

SEQ ID NO: 263922 - RNA, 19 nt, Human
gugguugguuggugggagg

SEQ ID NO: 263923 - RNA, 19 nt, Human
guugguggccucagaguug

SEQ ID NO: 263924 - RNA, 18 nt, Human
uagaaggcucccgccugu

SEQ ID NO: 263925 - RNA, 23 nt, Human
uagcugggucaccaaugugccuc

SEQ ID NO: 263926 - RNA, 24 nt, Human
uagggaaagugcugacaagccgca

SEQ ID NO: 263927 - RNA, 18 nt, Human
ucacaggcaccgaggcac

SEQ ID NO: 263928 - RNA, 20 nt, Human
ucacuggcaccugcugucau

SEQ ID NO: 263929 - RNA, 23 nt, Human
ucacuuucguguccuccuccacc

SEQ ID NO: 263930 - RNA, 25 nt, Human
ucaguccaggucacugggcagggug

SEQ ID NO: 263931 - RNA, 18 nt, Human
uccaccaccgagaagcgc

SEQ ID NO: 263932 - RNA, 22 nt, Human
uccacguccagggugggcgcgu

SEQ ID NO: 263933 - RNA, 18 nt, Human
uccagcacugacacgaac

SEQ ID NO: 263934 - RNA, 21 nt, Human
uccagcacugacacgaacacc

SEQ ID NO: 263935 - RNA, 25 nt, Human
uccagcccacugccagaaggagggg

SEQ ID NO: 263936 - RNA, 18 nt, Human
ucccugggagggcucagg

SEQ ID NO: 263937 - RNA, 18 nt, Human
ucccugggagggcucagg

SEQ ID NO: 263938 - RNA, 20 nt, Human
ucccugggagggcucagggg

SEQ ID NO: 263939 - RNA, 27 nt, Human
uccucagaggcugagaaggggcagcug

SEQ ID NO: 263940 - RNA, 24 nt, Human
uccugagccuggauccucagaggc

SEQ ID NO: 263941 - RNA, 20 nt, Human
ucgccaaaccagacagccuu

SEQ ID NO: 263942 - RNA, 20 nt, Human
ucugcagucaccguccugcc

SEQ ID NO: 263943 - RNA, 21 nt, Human
ucuggcuuugggagcagcgag

SEQ ID NO: 263944 - RNA, 22 nt, Human
ucugggcaugggcgcccagccu

SEQ ID NO: 263945 - RNA, 21 nt, Human
ugacaagccgcaagggauccc

SEQ ID NO: 263946 - RNA, 18 nt, Human
ugacacagcagcugagcc

SEQ ID NO: 263947 - RNA, 21 nt, Human
ugaccugggucacugaguagc

SEQ ID NO: 263948 - RNA, 22 nt, Human
ugagaaggggcagcugcauccu

SEQ ID NO: 263949 - RNA, 19 nt, Human
ugagagguuccuggcuuug

SEQ ID NO: 263950 - RNA, 24 nt, Human
ugagccuggauccucagaggcuga

SEQ ID NO: 263951 - RNA, 22 nt, Human
ugcagggcaggaaccacggggg

SEQ ID NO: 263952 - RNA, 18 nt, Human
ugccaagggggcucccgc

SEQ ID NO: 263953 - RNA, 18 nt, Human
ugccaagggggcucccgc

SEQ ID NO: 263954 - RNA, 22 nt, Human
ugccgcggucuccguccucagc

SEQ ID NO: 263955 - RNA, 21 nt, Human
ugccuccgucccgauguccuc

SEQ ID NO: 263956 - RNA, 21 nt, Human
ugcugugcccccaccgggugu

SEQ ID NO: 263957 - RNA, 21 nt, Human
ugcugugcccccaccgggugu

SEQ ID NO: 263958 - RNA, 21 nt, Human
ugcuguuuucugcacccgggg

SEQ ID NO: 263959 - RNA, 19 nt, Human
uggaaaggaauuaauggug

SEQ ID NO: 263960 - RNA, 21 nt, Human
uggaggggggcuccuguucgg

SEQ ID NO: 263961 - RNA, 20 nt, Human
uggaguucacuuucgugucc

SEQ ID NO: 263962 - RNA, 19 nt, Human
uggauguagacaggucugc

SEQ ID NO: 263963 - RNA, 21 nt, Human
uggcaguaugugccccguggg

SEQ ID NO: 263964 - RNA, 24 nt, Human
uggcucuggggucuguacugugcc

SEQ ID NO: 263965 - RNA, 26 nt, Human
uggcugguuggugggaggugcugguu

SEQ ID NO: 263966 - RNA, 26 nt, Human
uggcugguuggugggaggugcugguu

SEQ ID NO: 263967 - RNA, 25 nt, Human
uggcugguuggugggaggugcuguu

SEQ ID NO: 263968 - RNA, 19 nt, Human
ugggagcagcgaggggaau

SEQ ID NO: 263969 - RNA, 21 nt, Human
ugggagggcucagggggucug

SEQ ID NO: 263970 - RNA, 23 nt, Human
ugggcaggcgcuggcccaggguc

SEQ ID NO: 263971 - RNA, 21 nt, Human
uggggagacugaggccaagug

SEQ ID NO: 263972 - RNA, 21 nt, Human
uggggaggcagggccgggggg

SEQ ID NO: 263973 - RNA, 18 nt, Human
uggggcuggggacgggcg

SEQ ID NO: 263974 - RNA, 18 nt, Human
ugggggaagcggggcggg

SEQ ID NO: 263975 - RNA, 25 nt, Human
ugguccagcccacugccagaaggag

SEQ ID NO: 263976 - RNA, 18 nt, Human
uggucuggcuccugcuca

SEQ ID NO: 263977 - RNA, 18 nt, Human
ugguuggugggaggugcu

SEQ ID NO: 263978 - RNA, 18 nt, Human
ugguuggugggaggugcu

SEQ ID NO: 263979 - RNA, 18 nt, Human
ugguuggugggaggugcu

SEQ ID NO: 263980 - RNA, 21 nt, Human
ugguuggugggaggugcuguu

SEQ ID NO: 263981 - RNA, 21 nt, Human
ugguugucaaagccuuggggc

SEQ ID NO: 263982 - RNA, 19 nt, Human
ugucaaagccuuggggcug

SEQ ID NO: 263983 - RNA, 20 nt, Human
ugucaaagccuuggggcugg

SEQ ID NO: 263984 - RNA, 20 nt, Human
uguccuccuccacccuuauc

SEQ ID NO: 263985 - RNA, 19 nt, Human
uguggacgagguugguggc

SEQ ID NO: 263986 - RNA, 19 nt, Human
uguggcugguuggugggag

SEQ ID NO: 263987 - RNA, 19 nt, Human
uguggcugguuggugggag

SEQ ID NO: 263988 - RNA, 19 nt, Human
uguggugguggucagcaca

SEQ ID NO: 263989 - RNA, 18 nt, Human
uguugugggccucaaccu

SEQ ID NO: 263990 - RNA, 19 nt, Human
uuaaaggggaauucggggg

SEQ ID NO: 263991 - RNA, 19 nt, Human
uuccuggcucuggggucug

SEQ ID NO: 263992 - RNA, 19 nt, Human
uuccuggcucuggggucug

SEQ ID NO: 263993 - RNA, 23 nt, Human
uuccuggcucuggggucuguacu

SEQ ID NO: 263994 - RNA, 19 nt, Human
uuccuggcuuuggggucug

SEQ ID NO: 263995 - RNA, 24 nt, Human
uucguguccuccuccacccuuauc

SEQ ID NO: 263996 - RNA, 18 nt, Human
uugcccgagucugggugg

SEQ ID NO: 263997 - RNA, 21 nt, Human
uuuccuggaggguguagaaca

SEQ ID NO: 263998 - RNA, 23 nt, Human
uuuuuuuuuuuuucauuuggaaa

SEQ ID NO: 263999 - RNA, 24 nt, Human
uuuuuuuuuuuuuucgggagccuu

SEQ ID NO: 264000 - RNA, 18 nt, Human
uuuuuuuuuuuuuugggu

SEQ ID NO: 264001 - RNA, 23 nt, Human
uuuuuuuuuuuuuuggguuucgg

SEQ ID NO: 264002 - RNA, 23 nt, Human
uuuuuuuuuuuuuuuuggguuuc

SEQ ID NO: 264003 - RNA, 22 nt, Human
uuuuuuuuuuuuuuuuucauuu

SEQ ID NO: 264004 - RNA, 26 nt, Human
uuuuuuuuuuuuuuuuuuuuuucggg

SEQ ID NO: 264005 - RNA, 22 nt, Human
aagcagcuuuguuuaaaaacca

SEQ ID NO: 264006 - RNA, 20 nt, Human
acacuuagauucuaauugua

SEQ ID NO: 264007 - RNA, 24 nt, Human
accccaaaagauguuguuaaaagg

SEQ ID NO: 264008 - RNA, 21 nt, Human
acugacuccaucucccugacc

SEQ ID NO: 264009 - RNA, 19 nt, Human
acuuagauucuaauuguac

SEQ ID NO: 264010 - RNA, 24 nt, Human
agaccgagggcaggaccguugaga

SEQ ID NO: 264011 - RNA, 20 nt, Human
aggcaggcagcgggcgcuuc

SEQ ID NO: 264012 - RNA, 24 nt, Human
cacuggaccagaugguaucccugg

SEQ ID NO: 264013 - RNA, 21 nt, Human
caugacacauauggcugcaaa

SEQ ID NO: 264014 - RNA, 18 nt, Human
caugagcccgagggcggg

SEQ ID NO: 264015 - RNA, 21 nt, Human
ccagggcggggcgggggaaga

SEQ ID NO: 264016 - RNA, 18 nt, Human
ccaggugcuaagcagcuu

SEQ ID NO: 264017 - RNA, 19 nt, Human
ccccacugacuccaucucc

SEQ ID NO: 264018 - RNA, 21 nt, Human
ccccacugacuccaucucccu

SEQ ID NO: 264019 - RNA, 21 nt, Human
ccgccaguucuggagucggga

SEQ ID NO: 264020 - RNA, 22 nt, Human
ccgccaugagcccgagggcggg

SEQ ID NO: 264021 - RNA, 18 nt, Human
cgcccucccaccccugcg

SEQ ID NO: 264022 - RNA, 25 nt, Human
cgccucgucccgccacucggucaau

SEQ ID NO: 264023 - RNA, 20 nt, Human
cgcugcucuaagugguuggu

SEQ ID NO: 264024 - RNA, 19 nt, Human
cggcaguggguaccgucgg

SEQ ID NO: 264025 - RNA, 22 nt, Human
cuaagcagcuuuguuuaaaaac

SEQ ID NO: 264026 - RNA, 22 nt, Human
cucccugaccagggaauuccag

SEQ ID NO: 264027 - RNA, 24 nt, Human
cucgucccgccacucggucagcca

SEQ ID NO: 264028 - RNA, 19 nt, Human
cuggaccagaugguauccc

SEQ ID NO: 264029 - RNA, 20 nt, Human
cuggcccagggcggggcggg

SEQ ID NO: 264030 - RNA, 23 nt, Human
cuucuacaugacacauauggcug

SEQ ID NO: 264031 - RNA, 19 nt, Human
gaccggggccgccaugagc

SEQ ID NO: 264032 - RNA, 19 nt, Human
gccaugagcccgagggccg

SEQ ID NO: 264033 - RNA, 20 nt, Human
gcggccgcccucccaccccu

SEQ ID NO: 264034 - RNA, 21 nt, Human
gcuagccuggguugggggaca

SEQ ID NO: 264035 - RNA, 18 nt, Human
ggacugggacgccgccag

SEQ ID NO: 264036 - RNA, 18 nt, Human
ggcuggcuagccuggguu

SEQ ID NO: 264037 - RNA, 18 nt, Human
gggacaggcaggcagcgg

SEQ ID NO: 264038 - RNA, 21 nt, Human
ggguugggggacagacggggg

SEQ ID NO: 264039 - RNA, 24 nt, Human
gguugggggacagacgggggcugg

SEQ ID NO: 264040 - RNA, 26 nt, Human
uaaaaggcuggcuagccuggguuggg

SEQ ID NO: 264041 - RNA, 21 nt, Human
uaaaauagauuccaagcugca

SEQ ID NO: 264042 - RNA, 23 nt, Human
uagauuccaagcugcaaugcccc

SEQ ID NO: 264043 - RNA, 20 nt, Human
uagccuggguugggggacaa

SEQ ID NO: 264044 - RNA, 21 nt, Human
ucccgccacucggucagccag

SEQ ID NO: 264045 - RNA, 21 nt, Human
uccuaaggaaauuuuauuuga

SEQ ID NO: 264046 - RNA, 21 nt, Human
ugaaauacgaagcgcgugcgg

SEQ ID NO: 264047 - RNA, 23 nt, Human
ugacauaaaauagauuccaagcu

SEQ ID NO: 264048 - RNA, 21 nt, Human
ugaccagggaauuccaggugc

SEQ ID NO: 264049 - RNA, 21 nt, Human
ugaccagggaauuccaggugc

SEQ ID NO: 264050 - RNA, 21 nt, Human
ugagcccucugcacuccuaag

SEQ ID NO: 264051 - RNA, 24 nt, Human
ugccugcugcgggucgccucgucc

SEQ ID NO: 264052 - RNA, 20 nt, Human
ugcucuaagugguuggucag

SEQ ID NO: 264053 - RNA, 18 nt, Human
uggcccagggcggggcgg

SEQ ID NO: 264054 - RNA, 22 nt, Human
ugggggacagacgggggcuggg

SEQ ID NO: 264055 - RNA, 22 nt, Human
uugaugaggaccaacuggugac

SEQ ID NO: 264056 - RNA, 19 nt, Human
uugggggacagacgggggc

SEQ ID NO: 264057 - RNA, 19 nt, Human
uuucccaaugagcccucug

SEQ ID NO: 264058 - RNA, 24 nt, Human
uuuuuuuuuuuuuuuuggguuuca

SEQ ID NO: 264059 - RNA, 24 nt, Human
uuuuuuuuuuuuuuuuuuggguuu

SEQ ID NO: 264060 - RNA, 23 nt, Human
uuuuuuuuuuuuuuuuuuugggu

SEQ ID NO: 264061 - RNA, 26 nt, Human
uuuuuuuuuuuuuuuuuuuuuuuggg

SEQ ID NO: 264062 - RNA, 24 nt, Human
aauucuuaauauaaaaaugaaaga

SEQ ID NO: 264063 - RNA, 27 nt, Human
agacaaaagcuaaaacaaaagggaccc

SEQ ID NO: 264064 - RNA, 22 nt, Human
agacaauguaaugcuaaacuga

SEQ ID NO: 264065 - RNA, 21 nt, Human
agguauuuuaaaguaaagcuu

SEQ ID NO: 264066 - RNA, 19 nt, Human
cauggaaacacccaauaga

SEQ ID NO: 264067 - RNA, 20 nt, Human
uaauaaauacaucaccauga

SEQ ID NO: 264068 - RNA, 20 nt, Human
uaccauuguccagaguucuu

SEQ ID NO: 264069 - RNA, 23 nt, Human
uauguacauacuuauagcauggu

SEQ ID NO: 264070 - RNA, 23 nt, Human
ucaaggaaaguacaaaucaggua

SEQ ID NO: 264071 - RNA, 19 nt, Human
uguuauagagaguauagag

SEQ ID NO: 264072 - RNA, 26 nt, Human
uuaauauaaaaaugaaagagauuuau

SEQ ID NO: 264073 - RNA, 21 nt, Human
uuuuuuuuuuucaagauaggu

SEQ ID NO: 264074 - RNA, 24 nt, Human
uuuuuuuuuuuuuuuuuuuucaag

SEQ ID NO: 264075 - RNA, 20 nt, Human
agggaaugggggcuuucaga

SEQ ID NO: 264076 - RNA, 24 nt, Human
cccgcagcuuccgacggugagcgg

SEQ ID NO: 264077 - RNA, 20 nt, Human
ccgacggugagcggcuuccc

SEQ ID NO: 264078 - RNA, 21 nt, Human
gggaaugggggcuuucagagg

SEQ ID NO: 264079 - RNA, 26 nt, Human
uaacaacaggauucucagggaauggg

SEQ ID NO: 264080 - RNA, 26 nt, Human
ucccagagguagccuucaaagccucu

SEQ ID NO: 264081 - RNA, 19 nt, Human
aagcagaugggacuguggg

SEQ ID NO: 264082 - RNA, 18 nt, Human
aagggaaggccacaccaa

SEQ ID NO: 264083 - RNA, 23 nt, Human
aaggggcaucuggguggggcugc

SEQ ID NO: 264084 - RNA, 25 nt, Human
agaugggacugugggagcuucaggg

SEQ ID NO: 264085 - RNA, 20 nt, Human
aggaagaacacaggccaagg

SEQ ID NO: 264086 - RNA, 23 nt, Human
agggaggggcgacaagggguagg

SEQ ID NO: 264087 - RNA, 22 nt, Human
caaaaucuuuuuauuccccauu

SEQ ID NO: 264088 - RNA, 19 nt, Human
caaggcgggggccugaagc

SEQ ID NO: 264089 - RNA, 26 nt, Human
cacaggccaaggcgggggccugaagc

SEQ ID NO: 264090 - RNA, 21 nt, Human
cagcccccagaauaauccaga

SEQ ID NO: 264091 - RNA, 25 nt, Human
cagcccccagaauaauccagaaagg

SEQ ID NO: 264092 - RNA, 19 nt, Human
cagggaagcagcccuucuc

SEQ ID NO: 264093 - RNA, 22 nt, Human
ccaaggcgggggccugaagcag

SEQ ID NO: 264094 - RNA, 25 nt, Human
ccagaaaggggcaucuggguggggc

SEQ ID NO: 264095 - RNA, 22 nt, Human
cccaccgcugggacugcagagc

SEQ ID NO: 264096 - RNA, 19 nt, Human
cccaucccgcuagguagaa

SEQ ID NO: 264097 - RNA, 25 nt, Human
cccuccuaggccuccugcucggcug

SEQ ID NO: 264098 - RNA, 21 nt, Human
ccgaagccggagcagcucccc

SEQ ID NO: 264099 - RNA, 18 nt, Human
ccgccgccccuccgcgcc

SEQ ID NO: 264100 - RNA, 21 nt, Human
ccgccgccgccgccuccccgg

SEQ ID NO: 264101 - RNA, 19 nt, Human
ccgccgccgccuccccggc

SEQ ID NO: 264102 - RNA, 27 nt, Human
ccgccgccgccuccccggccgccgccc

SEQ ID NO: 264103 - RNA, 18 nt, Human
ccgccgccuccccggccg

SEQ ID NO: 264104 - RNA, 24 nt, Human
ccgccgccuccccggccgccgccc

SEQ ID NO: 264105 - RNA, 20 nt, Human
ccgccuccgggacagccccu

SEQ ID NO: 264106 - RNA, 18 nt, Human
ccugccgccgccgccgcc

SEQ ID NO: 264107 - RNA, 25 nt, Human
cggaagaaagugcauauaaacccug

SEQ ID NO: 264108 - RNA, 21 nt, Human
cggcuggggccucuccagcag

SEQ ID NO: 264109 - RNA, 29 nt, Human
cuccgcgccgaagccggagcagcuccccc

SEQ ID NO: 264110 - RNA, 19 nt, Human
cuggcccugagagacaggg

SEQ ID NO: 264111 - RNA, 22 nt, Human
gaagaacacaggccaaggcggg

SEQ ID NO: 264112 - RNA, 21 nt, Human
gaagcagaugggacuguggga

SEQ ID NO: 264113 - RNA, 23 nt, Human
gaccaugccucccuaggucccac

SEQ ID NO: 264114 - RNA, 18 nt, Human
gacugcagagcuuggcug

SEQ ID NO: 264115 - RNA, 24 nt, Human
gaugcagagggcagaccaugccuc

SEQ ID NO: 264116 - RNA, 25 nt, Human
gcaggugcucugggagggaggggcg

SEQ ID NO: 264117 - RNA, 20 nt, Human
gcccaccgccuccgggacag

SEQ ID NO: 264118 - RNA, 21 nt, Human
gccgccgccgccgccuccccg

SEQ ID NO: 264119 - RNA, 22 nt, Human
ggcuggggccucuccagcagug

SEQ ID NO: 264120 - RNA, 22 nt, Human
gggaaggccacaccaagugcug

SEQ ID NO: 264121 - RNA, 21 nt, Human
gggaaggcuuccuggaggagg

SEQ ID NO: 264122 - RNA, 21 nt, Human
gggacugcagagcuuggcugg

SEQ ID NO: 264123 - RNA, 20 nt, Human
ggguaggggaaggcuuccug

SEQ ID NO: 264124 - RNA, 18 nt, Human
uccagcagugucaggagc

SEQ ID NO: 264125 - RNA, 23 nt, Human
uccagcagugucaggagcugggc

SEQ ID NO: 264126 - RNA, 25 nt, Human
uccagcagugucaggagcugggcgc

SEQ ID NO: 264127 - RNA, 24 nt, Human
ucccugaaaagggagagagaaggc

SEQ ID NO: 264128 - RNA, 21 nt, Human
uccgggacagccccuggggga

SEQ ID NO: 264129 - RNA, 19 nt, Human
uccugccgccgccgccgcc

SEQ ID NO: 264130 - RNA, 23 nt, Human
uccugccgccgccgccgccuccc

SEQ ID NO: 264131 - RNA, 18 nt, Human
ucuccgggaaccaggccc

SEQ ID NO: 264132 - RNA, 20 nt, Human
ucuggagucucagaggaccc

SEQ ID NO: 264133 - RNA, 25 nt, Human
ugccaucuuuuccacaaaccucuca

SEQ ID NO: 264134 - RNA, 24 nt, Human
ugggagggaggggcgacaaggggu

SEQ ID NO: 264135 - RNA, 18 nt, Human
uuuaaccaggcccaccgc

SEQ ID NO: 264136 - RNA, 25 nt, Human
uuuuccacaaaccucucagguacag

SEQ ID NO: 264137 - RNA, 24 nt, Human
aacuuccauuguauuaaucaggag

SEQ ID NO: 264138 - RNA, 21 nt, Human
aagaagaugaaucuagaagug

SEQ ID NO: 264139 - RNA, 18 nt, Human
agcaucuagaagugcagg

SEQ ID NO: 264140 - RNA, 20 nt, Human
caagaagaugaaucuagaag

SEQ ID NO: 264141 - RNA, 21 nt, Human
caucuagaagugcagguagcu

SEQ ID NO: 264142 - RNA, 20 nt, Human
cuuuuuuuuuuuuuuuuugg

SEQ ID NO: 264143 - RNA, 18 nt, Human
ggugacuccuaagcccag

SEQ ID NO: 264144 - RNA, 18 nt, Human
ggugacuccuaagcccag

SEQ ID NO: 264145 - RNA, 27 nt, Human
uagaagugcagguagcugcaacaaacg

SEQ ID NO: 264146 - RNA, 27 nt, Human
uagaagugcagguagcugcaacaaacg

SEQ ID NO: 264147 - RNA, 21 nt, Human
uaggugggggagacgacacag

SEQ ID NO: 264148 - RNA, 20 nt, Human
ugacuccuaagcccagggcu

SEQ ID NO: 264149 - RNA, 20 nt, Human
ugacuccuaagcccagggcu

SEQ ID NO: 264150 - RNA, 23 nt, Human
ugcccagaaacuuccauuguauu

SEQ ID NO: 264151 - RNA, 21 nt, Human
uggaaacuuuuuuuuuuuuuu

SEQ ID NO: 264152 - RNA, 23 nt, Human
uggaaacuuuuuuuuuuuuuuuu

SEQ ID NO: 264153 - RNA, 24 nt, Human
uggaaacuuuuuuuuuuuuuuuuu

SEQ ID NO: 264154 - RNA, 29 nt, Human
ugguaggugggggagacgacaacaacggu

SEQ ID NO: 264155 - RNA, 19 nt, Human
uuuuuuuuuuuuuugccca

SEQ ID NO: 264156 - RNA, 23 nt, Human
uuuuuuuuuuuuuuuuugcccag

SEQ ID NO: 264157 - RNA, 21 nt, Human
aacugcgguccaaggcggucc

SEQ ID NO: 264158 - RNA, 26 nt, Human
agaaggggagagcugcaagguggagc

SEQ ID NO: 264159 - RNA, 18 nt, Human
agagagaggagacagggc

SEQ ID NO: 264160 - RNA, 23 nt, Human
aggaauacagagaaggggagagc

SEQ ID NO: 264161 - RNA, 20 nt, Human
agguggagcgauucugaggg

SEQ ID NO: 264162 - RNA, 22 nt, Human
agguggagcgauucugagggcu

SEQ ID NO: 264163 - RNA, 19 nt, Human
cacggcacucaugcuccua

SEQ ID NO: 264164 - RNA, 20 nt, Human
caguguggccacagaauucc

SEQ ID NO: 264165 - RNA, 20 nt, Human
ccugcgcagugcuggagugc

SEQ ID NO: 264166 - RNA, 21 nt, Human
ccuguagccuccgacccagaa

SEQ ID NO: 264167 - RNA, 22 nt, Human
ccuguagccuccgacccagaac

SEQ ID NO: 264168 - RNA, 21 nt, Human
cggcuaacggauaagcagaga

SEQ ID NO: 264169 - RNA, 19 nt, Human
cgguccaaggcggucccug

SEQ ID NO: 264170 - RNA, 21 nt, Human
cggucccugcgcagugcugga

SEQ ID NO: 264171 - RNA, 20 nt, Human
cuacccgggaacgggggcag

SEQ ID NO: 264172 - RNA, 20 nt, Human
cuccuuggaaugguggcugg

SEQ ID NO: 264173 - RNA, 20 nt, Human
gaaaaucccuuucccaguac

SEQ ID NO: 264174 - RNA, 18 nt, Human
gaaaccaaacugcucuca

SEQ ID NO: 264175 - RNA, 19 nt, Human
gaaaugaguuuauuacaga

SEQ ID NO: 264176 - RNA, 21 nt, Human
gaagacagcauccuucaaucc

SEQ ID NO: 264177 - RNA, 19 nt, Human
gagcugggugagcaggugg

SEQ ID NO: 264178 - RNA, 21 nt, Human
gcugaaaaucccuuucccagu

SEQ ID NO: 264179 - RNA, 22 nt, Human
gcugugauguucagcauguguc

SEQ ID NO: 264180 - RNA, 21 nt, Human
ggcgcgagggaggcgugucca

SEQ ID NO: 264181 - RNA, 20 nt, Human
ggcuaacggauaagcagaga

SEQ ID NO: 264182 - RNA, 21 nt, Human
gggagagcugcaagguggagc

SEQ ID NO: 264183 - RNA, 21 nt, Human
gggagucuuccuguagccucc

SEQ ID NO: 264184 - RNA, 18 nt, Human
gggcgcgagggaggcgug

SEQ ID NO: 264185 - RNA, 22 nt, Human
gguggggcucugucuucaugcu

SEQ ID NO: 264186 - RNA, 22 nt, Human
uaaaacacuggguuugugaagg

SEQ ID NO: 264187 - RNA, 20 nt, Human
uacagagagaggagacaggg

SEQ ID NO: 264188 - RNA, 20 nt, Human
uacccgggaacgggggcaga

SEQ ID NO: 264189 - RNA, 24 nt, Human
uagaaaccaaacugcucucacagc

SEQ ID NO: 264190 - RNA, 19 nt, Human
uagccuccgacccagaacc

SEQ ID NO: 264191 - RNA, 21 nt, Human
uauccagucugacuacugagc

SEQ ID NO: 264192 - RNA, 20 nt, Human
ucacagagcuguucuccugc

SEQ ID NO: 264193 - RNA, 18 nt, Human
ugagcugggugagcaggu

SEQ ID NO: 264194 - RNA, 20 nt, Human
ugagcugggugagcaggugg

SEQ ID NO: 264195 - RNA, 18 nt, Human
ugaggaaauaagcuguga

SEQ ID NO: 264196 - RNA, 23 nt, Human
uggcuggauggcggcguucuuca

SEQ ID NO: 264197 - RNA, 20 nt, Human
ugggugagcaggugggcggc

SEQ ID NO: 264198 - RNA, 28 nt, Human
uuucagggagugggagucuuccuguaau

SEQ ID NO: 264199 - RNA, 19 nt, Human
aaacaaccacaggcaucgc

SEQ ID NO: 264200 - RNA, 20 nt, Human
aacacaaugacagugaacca

SEQ ID NO: 264201 - RNA, 19 nt, Human
aaccacaggcaucgccgcc

SEQ ID NO: 264202 - RNA, 19 nt, Human
aagaaaacaaccacaggca

SEQ ID NO: 264203 - RNA, 23 nt, Human
aagaagaaaagagaaucacucag

SEQ ID NO: 264204 - RNA, 23 nt, Human
aagcagggggcauggccacugga

SEQ ID NO: 264205 - RNA, 19 nt, Human
aaggucagggaagagcugg

SEQ ID NO: 264206 - RNA, 23 nt, Human
acaaaagaagaauuugacccaga

SEQ ID NO: 264207 - RNA, 19 nt, Human
acaagaaaacaaccacagg

SEQ ID NO: 264208 - RNA, 18 nt, Human
agaaaagagaaucacuca

SEQ ID NO: 264209 - RNA, 18 nt, Human
agagcugagccugugugg

SEQ ID NO: 264210 - RNA, 21 nt, Human
agcugggugguggagagagcu

SEQ ID NO: 264211 - RNA, 19 nt, Human
agggaagagcuggguggug

SEQ ID NO: 264212 - RNA, 19 nt, Human
aggucagggaagagcuggg

SEQ ID NO: 264213 - RNA, 24 nt, Human
aggucagggaagagcuggguggug

SEQ ID NO: 264214 - RNA, 27 nt, Human
agugacagaagaguuugguggauuacc

SEQ ID NO: 264215 - RNA, 22 nt, Human
auacaaaagaagaauuugaccc

SEQ ID NO: 264216 - RNA, 23 nt, Human
caaauuagcgaagaaugauagca

SEQ ID NO: 264217 - RNA, 22 nt, Human
caggcuccuuucuggcggggga

SEQ ID NO: 264218 - RNA, 20 nt, Human
cagguaucuccaucacuuuu

SEQ ID NO: 264219 - RNA, 21 nt, Human
caucccuucgugaaggucagg

SEQ ID NO: 264220 - RNA, 21 nt, Human
ccaugggaagcagggggcaug

SEQ ID NO: 264221 - RNA, 18 nt, Human
cccuucgugaaggucagg

SEQ ID NO: 264222 - RNA, 20 nt, Human
cgcacaagaaaacaaccaca

SEQ ID NO: 264223 - RNA, 22 nt, Human
cggcuaacagucacuaaauguc

SEQ ID NO: 264224 - RNA, 22 nt, Human
cgugaaggucagggaagagcug

SEQ ID NO: 264225 - RNA, 23 nt, Human
cgugaaggucagggaagagcugg

SEQ ID NO: 264226 - RNA, 18 nt, Human
cucuggggucucauaauc

SEQ ID NO: 264227 - RNA, 23 nt, Human
cucuucaagacuuaacagaacaa

SEQ ID NO: 264228 - RNA, 23 nt, Human
cugcaccgacuccccuuagaaug

SEQ ID NO: 264229 - RNA, 21 nt, Human
gaaacacaaugacagugaacc

SEQ ID NO: 264230 - RNA, 20 nt, Human
gccccaaagcagaagcggca

SEQ ID NO: 264231 - RNA, 23 nt, Human
ggaucugaaagggaccggcuaac

SEQ ID NO: 264232 - RNA, 20 nt, Human
gggggcauggccacuggauc

SEQ ID NO: 264233 - RNA, 21 nt, Human
gugguggagagagcugagccu

SEQ ID NO: 264234 - RNA, 18 nt, Human
uaacagucacuaaauguc

SEQ ID NO: 264235 - RNA, 22 nt, Human
uacacagcacucauucguucag

SEQ ID NO: 264236 - RNA, 23 nt, Human
uacaguagagauggacacugaua

SEQ ID NO: 264237 - RNA, 24 nt, Human
uagcaguaucuuaggacacuguaa

SEQ ID NO: 264238 - RNA, 21 nt, Human
uaggacacuguaacugugugc

SEQ ID NO: 264239 - RNA, 22 nt, Human
ucaagacuuaacagaacaaugg

SEQ ID NO: 264240 - RNA, 20 nt, Human
ucacucaggcuccuuucugg

SEQ ID NO: 264241 - RNA, 19 nt, Human
ucagggaagagcugggugg

SEQ ID NO: 264242 - RNA, 18 nt, Human
ucucccugucagagcugg

SEQ ID NO: 264243 - RNA, 19 nt, Human
ugagcaauagccucaggua

SEQ ID NO: 264244 - RNA, 23 nt, Human
ugaguacgcacaagaaaacaacc

SEQ ID NO: 264245 - RNA, 20 nt, Human
ugauagugacagaagaguuu

SEQ ID NO: 264246 - RNA, 24 nt, Human
ugcuacgggacccaaggacuggag

SEQ ID NO: 264247 - RNA, 22 nt, Human
ugcugcaggugcugugcaggag

SEQ ID NO: 264248 - RNA, 20 nt, Human
uggagagagcugagccugug

SEQ ID NO: 264249 - RNA, 24 nt, Human
uggagagccaucccuucgugaagg

SEQ ID NO: 264250 - RNA, 23 nt, Human
uggagaggcugggaaacacaaug

SEQ ID NO: 264251 - RNA, 18 nt, Human
ugggaaacacaaugacag

SEQ ID NO: 264252 - RNA, 22 nt, Human
ugggugguggagagagcugagc

SEQ ID NO: 264253 - RNA, 22 nt, Human
ugugugcuacgggacccaagga

SEQ ID NO: 264254 - RNA, 25 nt, Human
uucucugcuacuuggcaccuccgau

SEQ ID NO: 264255 - RNA, 21 nt, Human
uuggccccaaagcagaagcgg

SEQ ID NO: 264256 - RNA, 25 nt, Human
aaaaaaaaaaaauaauaauaaagga

SEQ ID NO: 264257 - RNA, 25 nt, Human
aaaaaaaaaaaauaauaauaaagga

SEQ ID NO: 264258 - RNA, 24 nt, Human
aaaaaaaaaaauaauaauaaagga

SEQ ID NO: 264259 - RNA, 24 nt, Human
aaaaaaaaaaauaauaauaaagga

SEQ ID NO: 264260 - RNA, 23 nt, Human
aaacauaaaauaaaacuacagga

SEQ ID NO: 264261 - RNA, 23 nt, Human
aaacauaaaauaaaacuacagga

SEQ ID NO: 264262 - RNA, 23 nt, Human
aagagaaagaggauggcaucucc

SEQ ID NO: 264263 - RNA, 23 nt, Human
aagagaaagaggauggcaucucc

SEQ ID NO: 264264 - RNA, 27 nt, Human
aagggcagcaggauggagagguggcag

SEQ ID NO: 264265 - RNA, 27 nt, Human
aagggcagcaggauggagagguggcag

SEQ ID NO: 264266 - RNA, 26 nt, Human
aaucugaaauaaaaaugcugcugugg

SEQ ID NO: 264267 - RNA, 26 nt, Human
aaucugaaauaaaaaugcugcugugg

SEQ ID NO: 264268 - RNA, 18 nt, Human
acccuuuuguucaaguau

SEQ ID NO: 264269 - RNA, 18 nt, Human
acccuuuuguucaaguau

SEQ ID NO: 264270 - RNA, 21 nt, Human
agaaaagagaaagaggauggc

SEQ ID NO: 264271 - RNA, 21 nt, Human
agaaaagagaaagaggauggc

SEQ ID NO: 264272 - RNA, 19 nt, Human
agaaaauuucacacaaguu

SEQ ID NO: 264273 - RNA, 18 nt, Human
agagagagacugccugua

SEQ ID NO: 264274 - RNA, 18 nt, Human
agagagagacugccugua

SEQ ID NO: 264275 - RNA, 19 nt, Human
agauaucagaugguuaaaa

SEQ ID NO: 264276 - RNA, 19 nt, Human
agauaucagaugguuaaaa

SEQ ID NO: 264277 - RNA, 22 nt, Human
agauaucagaugguuaaaagcu

SEQ ID NO: 264278 - RNA, 22 nt, Human
agauaucagaugguuaaaagcu

SEQ ID NO: 264279 - RNA, 19 nt, Human
agccagggguaaggucucc

SEQ ID NO: 264280 - RNA, 19 nt, Human
agccagggguaaggucucc

SEQ ID NO: 264281 - RNA, 21 nt, Human
aggaaggguucauaaccccau

SEQ ID NO: 264282 - RNA, 21 nt, Human
aggaaggguucauaaccccau

SEQ ID NO: 264283 - RNA, 18 nt, Human
aggcggcuacggccgggc

SEQ ID NO: 264284 - RNA, 19 nt, Human
aguuuuuauuuugcuuuua

SEQ ID NO: 264285 - RNA, 19 nt, Human
aguuuuuauuuugcuuuua

SEQ ID NO: 264286 - RNA, 23 nt, Human
auaaaauaaaacuacaggacuga

SEQ ID NO: 264287 - RNA, 23 nt, Human
auaaaauaaaacuacaggacuga

SEQ ID NO: 264288 - RNA, 21 nt, Human
auaaaggauugaucauccaca

SEQ ID NO: 264289 - RNA, 21 nt, Human
auaaaggauugaucauccaca

SEQ ID NO: 264290 - RNA, 21 nt, Human
augauuuuuuuccccaugugu

SEQ ID NO: 264291 - RNA, 21 nt, Human
augauuuuuuuccccaugugu

SEQ ID NO: 264292 - RNA, 22 nt, Human
auguggccuaagggcagcagga

SEQ ID NO: 264293 - RNA, 22 nt, Human
auguggccuaagggcagcagga

SEQ ID NO: 264294 - RNA, 22 nt, Human
auuucacacaaguuuucugcug

SEQ ID NO: 264295 - RNA, 22 nt, Human
auuucacacaaguuuucugcug

SEQ ID NO: 264296 - RNA, 20 nt, Human
cacaaguuuucugcugccau

SEQ ID NO: 264297 - RNA, 22 nt, Human
cacacaaguuuucugcugccau

SEQ ID NO: 264298 - RNA, 18 nt, Human
caccugcacagugggacu

SEQ ID NO: 264299 - RNA, 18 nt, Human
caccugcacagugggacu

SEQ ID NO: 264300 - RNA, 20 nt, Human
cagagcaugaaaugagcuuu

SEQ ID NO: 264301 - RNA, 20 nt, Human
cagagcaugaaaugagcuuu

SEQ ID NO: 264302 - RNA, 21 nt, Human
cagcgccggggcccgcccccu

SEQ ID NO: 264303 - RNA, 24 nt, Human
caggacugaaauuaacaauccauu

SEQ ID NO: 264304 - RNA, 24 nt, Human
caggacugaaauuaacaauccauu

SEQ ID NO: 264305 - RNA, 23 nt, Human
caggaggcgccgcaggcggcuac

SEQ ID NO: 264306 - RNA, 23 nt, Human
caucuccaauguccucuucucaa

SEQ ID NO: 264307 - RNA, 23 nt, Human
caucuccaauguccucuucucaa

SEQ ID NO: 264308 - RNA, 26 nt, Human
ccacgcagacaaagaggcacauggag

SEQ ID NO: 264309 - RNA, 26 nt, Human
ccacgcagacaaagaggcacauggag

SEQ ID NO: 264310 - RNA, 27 nt, Human
ccagcucggccgcggcucggcgcgcuc

SEQ ID NO: 264311 - RNA, 18 nt, Human
cccauguggccuaagggc

SEQ ID NO: 264312 - RNA, 18 nt, Human
cccauguggccuaagggc

SEQ ID NO: 264313 - RNA, 24 nt, Human
ccccaauccauacucauaggccuu

SEQ ID NO: 264314 - RNA, 24 nt, Human
ccccaauccauacucauaggccuu

SEQ ID NO: 264315 - RNA, 21 nt, Human
ccccauccuuaaaugugucua

SEQ ID NO: 264316 - RNA, 21 nt, Human
ccccauccuuaaaugugucua

SEQ ID NO: 264317 - RNA, 19 nt, Human
ccccugccgccccagccgc

SEQ ID NO: 264318 - RNA, 21 nt, Human
ccccugccgccccagccgcgc

SEQ ID NO: 264319 - RNA, 18 nt, Human
ccccugccucugcccccu

SEQ ID NO: 264320 - RNA, 18 nt, Human
cccgcccccucccgcccc

SEQ ID NO: 264321 - RNA, 21 nt, Human
cccgccgugccgcgggcagcc

SEQ ID NO: 264322 - RNA, 19 nt, Human
ccgcaggcggcuacggccg

SEQ ID NO: 264323 - RNA, 19 nt, Human
ccgccccugccucugcccc

SEQ ID NO: 264324 - RNA, 18 nt, Human
ccgccgccccugccgccc

SEQ ID NO: 264325 - RNA, 21 nt, Human
ccgccgccccugccgccccag

SEQ ID NO: 264326 - RNA, 19 nt, Human
ccgcgccagccgcgcccgc

SEQ ID NO: 264327 - RNA, 21 nt, Human
ccgcgccagccgcgcccgccg

SEQ ID NO: 264328 - RNA, 18 nt, Human
ccgcgcccgccgugccgc

SEQ ID NO: 264329 - RNA, 22 nt, Human
ccuagcccagaccucauucauu

SEQ ID NO: 264330 - RNA, 18 nt, Human
ccucccgccccugccucu

SEQ ID NO: 264331 - RNA, 20 nt, Human
ccucccgccccugccucugc

SEQ ID NO: 264332 - RNA, 21 nt, Human
ccucuccgcacucccuucucg

SEQ ID NO: 264333 - RNA, 18 nt, Human
ccugccucugcccccugg

SEQ ID NO: 264334 - RNA, 23 nt, Human
cgaccggcgccucuccgcacucc

SEQ ID NO: 264335 - RNA, 21 nt, Human
cgcacucccuucucgggccga

SEQ ID NO: 264336 - RNA, 23 nt, Human
cgccccugccgccccagccgcgc

SEQ ID NO: 264337 - RNA, 20 nt, Human
cggcgcgcucuccgccgccc

SEQ ID NO: 264338 - RNA, 22 nt, Human
cggcgcgcucuccgccgccccu

SEQ ID NO: 264339 - RNA, 21 nt, Human
cgggagcagcgccggggcccg

SEQ ID NO: 264340 - RNA, 25 nt, Human
cuaccuagcccagaccucauucauu

SEQ ID NO: 264341 - RNA, 22 nt, Human
cuccaauguccucuucucaauc

SEQ ID NO: 264342 - RNA, 22 nt, Human
cuccaauguccucuucucaauc

SEQ ID NO: 264343 - RNA, 18 nt, Human
cucuccgccgccccugcc

SEQ ID NO: 264344 - RNA, 20 nt, Human
cucucgggggcuggcagauu

SEQ ID NO: 264345 - RNA, 24 nt, Human
cugcgugcacaacucuucugaccc

SEQ ID NO: 264346 - RNA, 24 nt, Human
cugcgugcacaacucuucugaccc

SEQ ID NO: 264347 - RNA, 20 nt, Human
gaaaauggaagcaaaucuuu

SEQ ID NO: 264348 - RNA, 20 nt, Human
gaccuuggccugcuaaucug

SEQ ID NO: 264349 - RNA, 20 nt, Human
gaccuuggccugcuaaucug

SEQ ID NO: 264350 - RNA, 22 nt, Human
gaggcgccgcaggcggcuacgg

SEQ ID NO: 264351 - RNA, 18 nt, Human
gcugcuguggcucagacc

SEQ ID NO: 264352 - RNA, 18 nt, Human
gcugcuguggcucagacc

SEQ ID NO: 264353 - RNA, 21 nt, Human
gcuguggcucagaccuuggcc

SEQ ID NO: 264354 - RNA, 21 nt, Human
gcuguggcucagaccuuggcc

SEQ ID NO: 264355 - RNA, 21 nt, Human
ggaaaauggaagcaaaucuuu

SEQ ID NO: 264356 - RNA, 22 nt, Human
ggaaaauggaagcaaaucuuua

SEQ ID NO: 264357 - RNA, 21 nt, Human
ggccgacaggaggcgccgcag

SEQ ID NO: 264358 - RNA, 18 nt, Human
ggcucggcgcgcucuccg

SEQ ID NO: 264359 - RNA, 19 nt, Human
gggcgggccagcucggccg

SEQ ID NO: 264360 - RNA, 22 nt, Human
ggggcccgcccccucccgcccc

SEQ ID NO: 264361 - RNA, 23 nt, Human
ggggcgggagcagcgccggggcc

SEQ ID NO: 264362 - RNA, 22 nt, Human
ggguaguuaaauuauuuaaagu

SEQ ID NO: 264363 - RNA, 22 nt, Human
ggguaguuaaauuauuuaaagu

SEQ ID NO: 264364 - RNA, 24 nt, Human
gugcacaacucuucugacccacgc

SEQ ID NO: 264365 - RNA, 24 nt, Human
gugcacaacucuucugacccacgc

SEQ ID NO: 264366 - RNA, 21 nt, Human
gugcaggcuagaaauuucacu

SEQ ID NO: 264367 - RNA, 21 nt, Human
gugcaggcuagaaauuucacu

SEQ ID NO: 264368 - RNA, 18 nt, Human
uaaaaacaaaaauagcau

SEQ ID NO: 264369 - RNA, 18 nt, Human
uaaaaacaaaaauagcau

SEQ ID NO: 264370 - RNA, 22 nt, Human
uaaagcuuuuuuuuuuuuuuaa

SEQ ID NO: 264371 - RNA, 22 nt, Human
uaacaauccauuaaaaucagca

SEQ ID NO: 264372 - RNA, 22 nt, Human
uaacaauccauuaaaaucagca

SEQ ID NO: 264373 - RNA, 20 nt, Human
uaaggucuccaagaggccuu

SEQ ID NO: 264374 - RNA, 20 nt, Human
uaaggucuccaagaggccuu

SEQ ID NO: 264375 - RNA, 19 nt, Human
uaaguaauuaaggguaguu

SEQ ID NO: 264376 - RNA, 19 nt, Human
uaaguaauuaaggguaguu

SEQ ID NO: 264377 - RNA, 23 nt, Human
uagcaccugcacagugggacugu

SEQ ID NO: 264378 - RNA, 23 nt, Human
uagcaccugcacagugggacugu

SEQ ID NO: 264379 - RNA, 19 nt, Human
uaggaaaauggaagcaaau

SEQ ID NO: 264380 - RNA, 24 nt, Human
uaggaaaauggaagcaaaucuuua

SEQ ID NO: 264381 - RNA, 23 nt, Human
uaucauuaucaaaugcugcauca

SEQ ID NO: 264382 - RNA, 23 nt, Human
uaucauuaucaaaugcugcauca

SEQ ID NO: 264383 - RNA, 21 nt, Human
uauccaagauuaauaccugau

SEQ ID NO: 264384 - RNA, 21 nt, Human
uauccaagauuaauaccugau

SEQ ID NO: 264385 - RNA, 20 nt, Human
uaucuaaacauaaaauaaaa

SEQ ID NO: 264386 - RNA, 20 nt, Human
uaucuaaacauaaaauaaaa

SEQ ID NO: 264387 - RNA, 21 nt, Human
ucaagaaaauuucacacaagu

SEQ ID NO: 264388 - RNA, 21 nt, Human
ucaagaaaauuucacacaagu

SEQ ID NO: 264389 - RNA, 19 nt, Human
ucacacaaguuuucugcug

SEQ ID NO: 264390 - RNA, 19 nt, Human
ucacacaaguuuucugcug

SEQ ID NO: 264391 - RNA, 23 nt, Human
ucacacuaugaaguugacuuaga

SEQ ID NO: 264392 - RNA, 26 nt, Human
ucauaaagcuuuuuuuuuuuuuuaag

SEQ ID NO: 264393 - RNA, 21 nt, Human
uccaagauuaauaccugauuu

SEQ ID NO: 264394 - RNA, 21 nt, Human
uccaagauuaauaccugauuu

SEQ ID NO: 264395 - RNA, 23 nt, Human
uccaagauuaauaccugauuuuc

SEQ ID NO: 264396 - RNA, 23 nt, Human
uccaagauuaauaccugauuuuc

SEQ ID NO: 264397 - RNA, 18 nt, Human
uccacaggcuucaugaua

SEQ ID NO: 264398 - RNA, 18 nt, Human
uccacaggcuucaugaua

SEQ ID NO: 264399 - RNA, 22 nt, Human
ucccauguggccuaagggcagc

SEQ ID NO: 264400 - RNA, 22 nt, Human
ucccauguggccuaagggcagc

SEQ ID NO: 264401 - RNA, 18 nt, Human
ucccuuucaaaaggcuuc

SEQ ID NO: 264402 - RNA, 19 nt, Human
ucccuuucaaaaggcuuca

SEQ ID NO: 264403 - RNA, 21 nt, Human
ucggcgcgcucuccgccgccc

SEQ ID NO: 264404 - RNA, 23 nt, Human
ucgggggcuggcagauuccguag

SEQ ID NO: 264405 - RNA, 21 nt, Human
ucuccgccgccccugccgccc

SEQ ID NO: 264406 - RNA, 21 nt, Human
ucugaauauuuguucuccuug

SEQ ID NO: 264407 - RNA, 21 nt, Human
ucugaauauuuguucuccuug

SEQ ID NO: 264408 - RNA, 20 nt, Human
ugaaaaucauaaagcuuuuu

SEQ ID NO: 264409 - RNA, 18 nt, Human
ugacuuagacuugggugc

SEQ ID NO: 264410 - RNA, 20 nt, Human
ugaggaagagagagacugcc

SEQ ID NO: 264411 - RNA, 20 nt, Human
ugaggaagagagagacugcc

SEQ ID NO: 264412 - RNA, 24 nt, Human
ugaggaagagagagacugccugua

SEQ ID NO: 264413 - RNA, 18 nt, Human
ugagguguuuuaucauua

SEQ ID NO: 264414 - RNA, 18 nt, Human
ugagguguuuuaucauua

SEQ ID NO: 264415 - RNA, 24 nt, Human
ugcauggacugcucccauguggcc

SEQ ID NO: 264416 - RNA, 24 nt, Human
ugcauggacugcucccauguggcc

SEQ ID NO: 264417 - RNA, 26 nt, Human
ugccgccccagccgcgccagccgcgc

SEQ ID NO: 264418 - RNA, 18 nt, Human
ugcgacgggcgggcgggc

SEQ ID NO: 264419 - RNA, 21 nt, Human
ugcuaaauaugguugucuuua

SEQ ID NO: 264420 - RNA, 21 nt, Human
ugcuaaauaugguugucuuua

SEQ ID NO: 264421 - RNA, 19 nt, Human
uggcaucuccaauguccuc

SEQ ID NO: 264422 - RNA, 19 nt, Human
uggcaucuccaauguccuc

SEQ ID NO: 264423 - RNA, 18 nt, Human
uggcucagaccuuggccu

SEQ ID NO: 264424 - RNA, 18 nt, Human
uggcucagaccuuggccu

SEQ ID NO: 264425 - RNA, 20 nt, Human
ugguuuguuuaccucucccc

SEQ ID NO: 264426 - RNA, 26 nt, Human
ugguuuguuuaccucuccccgcgagc

SEQ ID NO: 264427 - RNA, 21 nt, Human
uguaggaaaauggaagcaaau

SEQ ID NO: 264428 - RNA, 23 nt, Human
uguccucuucucaaucaacucaa

SEQ ID NO: 264429 - RNA, 23 nt, Human
uguccucuucucaaucaacucaa

SEQ ID NO: 264430 - RNA, 24 nt, Human
uguggccuaagggcagcaggaugg

SEQ ID NO: 264431 - RNA, 24 nt, Human
uguggccuaagggcagcaggaugg

SEQ ID NO: 264432 - RNA, 25 nt, Human
uguuuuguuuuguuuuguuuuaauu

SEQ ID NO: 264433 - RNA, 20 nt, Human
uuagaagaaaauaacauuac

SEQ ID NO: 264434 - RNA, 20 nt, Human
uuagaagaaaauaacauuac

SEQ ID NO: 264435 - RNA, 21 nt, Human
uucaugauaaacugucccagg

SEQ ID NO: 264436 - RNA, 21 nt, Human
uucaugauaaacugucccagg

SEQ ID NO: 264437 - RNA, 19 nt, Human
uuccuuuuggcccccccaa

SEQ ID NO: 264438 - RNA, 19 nt, Human
uuccuuuuggcccccccaa

SEQ ID NO: 264439 - RNA, 18 nt, Human
uugcagggcggacgccuc

SEQ ID NO: 264440 - RNA, 23 nt, Human
uuuaaagaggagacugcaucaug

SEQ ID NO: 264441 - RNA, 20 nt, Human
uuucacacaaguuuucugcu

SEQ ID NO: 264442 - RNA, 20 nt, Human
uuucacacaaguuuucugcu

SEQ ID NO: 264443 - RNA, 18 nt, Human
uuuguuuuguuuuguuuu

SEQ ID NO: 264444 - RNA, 19 nt, Human
uuuguuuuguuuuguuuug

SEQ ID NO: 264445 - RNA, 20 nt, Human
uuuucuugucuuuucauucg

SEQ ID NO: 264446 - RNA, 20 nt, Human
uuuucuugucuuuucauucg

SEQ ID NO: 264447 - RNA, 21 nt, Human
aaauagguucuucucccauuc

SEQ ID NO: 264448 - RNA, 20 nt, Human
aacaaaaauagguucuucuc

SEQ ID NO: 264449 - RNA, 22 nt, Human
aacacacaucucccaaaaaaga

SEQ ID NO: 264450 - RNA, 19 nt, Human
aaccacaguuucugucucc

SEQ ID NO: 264451 - RNA, 19 nt, Human
aagaagacuucauucaacu

SEQ ID NO: 264452 - RNA, 19 nt, Human
aagaccauagcagcaaaaa

SEQ ID NO: 264453 - RNA, 21 nt, Human
acaaaaauagguucuucuccc

SEQ ID NO: 264454 - RNA, 20 nt, Human
acaaaacauagaacaucaac

SEQ ID NO: 264455 - RNA, 22 nt, Human
acaaaacauagaacaucaacaa

SEQ ID NO: 264456 - RNA, 19 nt, Human
accgcaccgggcugccgcc

SEQ ID NO: 264457 - RNA, 22 nt, Human
agaacucccaaauuauaaaaca

SEQ ID NO: 264458 - RNA, 24 nt, Human
agaccauagcagcaaaaaacguuu

SEQ ID NO: 264459 - RNA, 21 nt, Human
agcaagcuaacagaaaacuca

SEQ ID NO: 264460 - RNA, 24 nt, Human
augcacuuggugcugcucucaacu

SEQ ID NO: 264461 - RNA, 19 nt, Human
caaaaaagaagugcaacgc

SEQ ID NO: 264462 - RNA, 24 nt, Human
caacaaaaauagguucuucuccca

SEQ ID NO: 264463 - RNA, 19 nt, Human
caacaauaacaaaaaaacc

SEQ ID NO: 264464 - RNA, 21 nt, Human
caacaauaacaaaaaaaccac

SEQ ID NO: 264465 - RNA, 23 nt, Human
caacuguuguaccacaacaaaaa

SEQ ID NO: 264466 - RNA, 19 nt, Human
caauaacaaaaaaaccaca

SEQ ID NO: 264467 - RNA, 24 nt, Human
caauaacaaaaaaaccacaauaaa

SEQ ID NO: 264468 - RNA, 31 nt, Human
caauaacaaaaaaaccacaauaaaaaaugcc

SEQ ID NO: 264469 - RNA, 25 nt, Human
caccaaguuucuuuucuuucugucc

SEQ ID NO: 264470 - RNA, 22 nt, Human
cagaacucccaaauuauaaaac

SEQ ID NO: 264471 - RNA, 22 nt, Human
cagagucucccaaacaaguuuu

SEQ ID NO: 264472 - RNA, 23 nt, Human
cagagucucccaaacaaguuuuc

SEQ ID NO: 264473 - RNA, 22 nt, Human
caggggaugcggaucaaaugca

SEQ ID NO: 264474 - RNA, 24 nt, Human
caucaacaacacacaucucccaaa

SEQ ID NO: 264475 - RNA, 20 nt, Human
cauucaacuaaaugcacuug

SEQ ID NO: 264476 - RNA, 18 nt, Human
ccaagaagacuucauuca

SEQ ID NO: 264477 - RNA, 19 nt, Human
ccgcggggaccgcaccggg

SEQ ID NO: 264478 - RNA, 18 nt, Human
ccgcugcccgccgccugc

SEQ ID NO: 264479 - RNA, 18 nt, Human
ccgcugcccgccgccugc

SEQ ID NO: 264480 - RNA, 20 nt, Human
ccgcugcccgccgccugccu

SEQ ID NO: 264481 - RNA, 21 nt, Human
ccgcugcccgccgccugccug

SEQ ID NO: 264482 - RNA, 19 nt, Human
ccucccgcugcccgccgcc

SEQ ID NO: 264483 - RNA, 22 nt, Human
ccucccgcugcccgccgccugc

SEQ ID NO: 264484 - RNA, 23 nt, Human
cucccauucaugaaaaguuucau

SEQ ID NO: 264485 - RNA, 22 nt, Human
cugccgccucccgcugcccgcc

SEQ ID NO: 264486 - RNA, 20 nt, Human
cuguuguaccacaacaaaaa

SEQ ID NO: 264487 - RNA, 19 nt, Human
gaaaaccauaaugcuuuuc

SEQ ID NO: 264488 - RNA, 20 nt, Human
gccgccucccgcugcccgcc

SEQ ID NO: 264489 - RNA, 18 nt, Human
ggcgcggcgggcgcgggg

SEQ ID NO: 264490 - RNA, 22 nt, Human
uaaaaaaugcagagucucccaa

SEQ ID NO: 264491 - RNA, 20 nt, Human
uaaagcaagcuaacagaaaa

SEQ ID NO: 264492 - RNA, 20 nt, Human
uaaaugagcauuuacaaucu

SEQ ID NO: 264493 - RNA, 19 nt, Human
uaaaugcacuuggugcugc

SEQ ID NO: 264494 - RNA, 19 nt, Human
uaacagaaaacucauaaaa

SEQ ID NO: 264495 - RNA, 21 nt, Human
uaccuucaaugucauuaacca

SEQ ID NO: 264496 - RNA, 19 nt, Human
uagaaaccacaggggaugc

SEQ ID NO: 264497 - RNA, 21 nt, Human
uauuaagucuacacuuagagu

SEQ ID NO: 264498 - RNA, 19 nt, Human
ucccaaacaaguuuucaaa

SEQ ID NO: 264499 - RNA, 26 nt, Human
uccccaguugcaaacacaggauccau

SEQ ID NO: 264500 - RNA, 20 nt, Human
ucccgcugcccgccgccugc

SEQ ID NO: 264501 - RNA, 23 nt, Human
ucuacugccccucugauacuagc

SEQ ID NO: 264502 - RNA, 19 nt, Human
ucuucucccauucaugaaa

SEQ ID NO: 264503 - RNA, 26 nt, Human
ugaaguguucugaaaaccauaaugcu

SEQ ID NO: 264504 - RNA, 18 nt, Human
ugccgccucccgcugccc

SEQ ID NO: 264505 - RNA, 19 nt, Human
ugguacaauaaauguaccu

SEQ ID NO: 264506 - RNA, 21 nt, Human
ugucauuaaccauaaaugagc

SEQ ID NO: 264507 - RNA, 23 nt, Human
uuaaagcaagcuaacagaaaacu

SEQ ID NO: 264508 - RNA, 19 nt, Human
uuacugauuuuuaaaaaua

SEQ ID NO: 264509 - RNA, 24 nt, Human
uucaaaaaacccaucacaggaaaa

SEQ ID NO: 264510 - RNA, 21 nt, Human
uucauuuggcauuuacaaaau

SEQ ID NO: 264511 - RNA, 18 nt, Human
aaaaaaaaaaaaauaggc

SEQ ID NO: 264512 - RNA, 23 nt, Human
acaccagagcccuggacauggcc

SEQ ID NO: 264513 - RNA, 19 nt, Human
acagcaaaaaagccugggg

SEQ ID NO: 264514 - RNA, 24 nt, Human
acagcaaaaaagccugggggcaaa

SEQ ID NO: 264515 - RNA, 19 nt, Human
acaucaacaugcaccaacc

SEQ ID NO: 264516 - RNA, 20 nt, Human
accaacccaggcaaacacca

SEQ ID NO: 264517 - RNA, 18 nt, Human
agagagaagccaaauaua

SEQ ID NO: 264518 - RNA, 18 nt, Human
agccuccucuuccuuccg

SEQ ID NO: 264519 - RNA, 20 nt, Human
aggcagauggaggcaggggc

SEQ ID NO: 264520 - RNA, 21 nt, Human
aggcaggggcugaggggggcc

SEQ ID NO: 264521 - RNA, 20 nt, Human
auggucacaccugccugcag

SEQ ID NO: 264522 - RNA, 20 nt, Human
caaacaccagagcccuggac

SEQ ID NO: 264523 - RNA, 19 nt, Human
caacccaggcaaacaccag

SEQ ID NO: 264524 - RNA, 21 nt, Human
cacaucaacaugcaccaaccc

SEQ ID NO: 264525 - RNA, 25 nt, Human
caccugccugcagccagcacaucaa

SEQ ID NO: 264526 - RNA, 23 nt, Human
cagagucuuaagagagaagccaa

SEQ ID NO: 264527 - RNA, 24 nt, Human
caggcggcaacagccacccucccc

SEQ ID NO: 264528 - RNA, 18 nt, Human
caugcaccaacccaggca

SEQ ID NO: 264529 - RNA, 18 nt, Human
cauggcccuggagccagg

SEQ ID NO: 264530 - RNA, 25 nt, Human
cccccugguggcucccucacagcaa

SEQ ID NO: 264531 - RNA, 18 nt, Human
cccugggacccccgcagg

SEQ ID NO: 264532 - RNA, 19 nt, Human
ccucacagcaaaaaagccu

SEQ ID NO: 264533 - RNA, 27 nt, Human
ccuggagccaggaucccagcccagaac

SEQ ID NO: 264534 - RNA, 19 nt, Human
cgccacacucaccgaaaca

SEQ ID NO: 264535 - RNA, 20 nt, Human
cucacagcaaaaaagccugg

SEQ ID NO: 264536 - RNA, 20 nt, Human
cugcacccugggacccccgc

SEQ ID NO: 264537 - RNA, 21 nt, Human
gcaaaaaagccugggggcaaa

SEQ ID NO: 264538 - RNA, 18 nt, Human
gcaacagccacccucccc

SEQ ID NO: 264539 - RNA, 18 nt, Human
gccuuagaaacagcuugc

SEQ ID NO: 264540 - RNA, 22 nt, Human
ggaggcaggggcugaggggggc

SEQ ID NO: 264541 - RNA, 24 nt, Human
ggaggcaggggcugaggggggccc

SEQ ID NO: 264542 - RNA, 22 nt, Human
ggaggucucugcacccugggac

SEQ ID NO: 264543 - RNA, 24 nt, Human
ggcaggcggcaacagccacccucc

SEQ ID NO: 264544 - RNA, 24 nt, Human
ucaugguuuuaaaaaaaaaaaaau

SEQ ID NO: 264545 - RNA, 18 nt, Human
uccccaguggcagcgccu

SEQ ID NO: 264546 - RNA, 27 nt, Human
ucccucacagcaaaaaagccugggggc

SEQ ID NO: 264547 - RNA, 23 nt, Human
uccgccacacucaccgaaacacg

SEQ ID NO: 264548 - RNA, 26 nt, Human
uccucuuguaaaugaagaaauaaacc

SEQ ID NO: 264549 - RNA, 25 nt, Human
ugaagaaauaaaccuauuuaaauca

SEQ ID NO: 264550 - RNA, 22 nt, Human
ugcaccaacccaggcaaacacc

SEQ ID NO: 264551 - RNA, 25 nt, Human
ugcagccagcacaucaacaugcacc

SEQ ID NO: 264552 - RNA, 18 nt, Human
ugcccgggcaggcggcaa

SEQ ID NO: 264553 - RNA, 19 nt, Human
uggcucaggcugugcuugc

SEQ ID NO: 264554 - RNA, 20 nt, Human
uggcucaggcugugcuugcc

SEQ ID NO: 264555 - RNA, 20 nt, Human
ugggggcaaagagguggcag

SEQ ID NO: 264556 - RNA, 19 nt, Human
uggggguggggaggucucu

SEQ ID NO: 264557 - RNA, 20 nt, Human
ugguuuuaaaaaaaaaaaaa

SEQ ID NO: 264558 - RNA, 24 nt, Human
uguaaaugaagaaauaaaccuauu

SEQ ID NO: 264559 - RNA, 21 nt, Human
uuaaaaaaaaaaaaauaggcg

SEQ ID NO: 264560 - RNA, 25 nt, Human
uuuaaaaaaaaaaaaauaggcgucu

SEQ ID NO: 264561 - RNA, 23 nt, Human
uuuaaaucacccccugguggcuc

SEQ ID NO: 264562 - RNA, 22 nt, Human
aaaaacuagcaaguagauuuaa

SEQ ID NO: 264563 - RNA, 21 nt, Human
aaacaacaacaacaaaaaacc

SEQ ID NO: 264564 - RNA, 24 nt, Human
aaacaacuaauugagaaaaauuuc

SEQ ID NO: 264565 - RNA, 19 nt, Human
aaauaaauacauuuaacac

SEQ ID NO: 264566 - RNA, 19 nt, Human
aaauagcuuaaaacccuuu

SEQ ID NO: 264567 - RNA, 22 nt, Human
aacauacuuaaacaugcuaaga

SEQ ID NO: 264568 - RNA, 18 nt, Human
aacuaauucaauaacccu

SEQ ID NO: 264569 - RNA, 22 nt, Human
aagaagaaauaaaauaagugca

SEQ ID NO: 264570 - RNA, 22 nt, Human
aaguagauuuaaauagcuuaaa

SEQ ID NO: 264571 - RNA, 19 nt, Human
aauuuacaaaguucuccug

SEQ ID NO: 264572 - RNA, 27 nt, Human
acaacaacaaaaaaccauuaugugcua

SEQ ID NO: 264573 - RNA, 25 nt, Human
acagagcagaaaaucuuaaccugcu

SEQ ID NO: 264574 - RNA, 22 nt, Human
accaacuucuuuaauuuaucau

SEQ ID NO: 264575 - RNA, 21 nt, Human
acuaauucaauaacccucuga

SEQ ID NO: 264576 - RNA, 20 nt, Human
agaaaaaacucuuuuuugaa

SEQ ID NO: 264577 - RNA, 23 nt, Human
agaccaucuuuuuggcccauauu

SEQ ID NO: 264578 - RNA, 25 nt, Human
agcaacaaagcaguuaacugaagga

SEQ ID NO: 264579 - RNA, 19 nt, Human
aggcugggcggggacgcgg

SEQ ID NO: 264580 - RNA, 23 nt, Human
agggaccaagguaccauauuauu

SEQ ID NO: 264581 - RNA, 18 nt, Human
aguuaacuugagaacuug

SEQ ID NO: 264582 - RNA, 21 nt, Human
auaaaaacagacuucuuuccu

SEQ ID NO: 264583 - RNA, 24 nt, Human
auacaccuaucuauaacaaaacug

SEQ ID NO: 264584 - RNA, 22 nt, Human
caaacagagcagaaaaucuuaa

SEQ ID NO: 264585 - RNA, 18 nt, Human
caacaacaacaaaaaacc

SEQ ID NO: 264586 - RNA, 21 nt, Human
caacauacuuaaacaugcuaa

SEQ ID NO: 264587 - RNA, 23 nt, Human
caacauauaucuugugaagaaaa

SEQ ID NO: 264588 - RNA, 24 nt, Human
caagaagaaauaaaauaagugcaa

SEQ ID NO: 264589 - RNA, 23 nt, Human
caauuuagucaggguaauugcug

SEQ ID NO: 264590 - RNA, 19 nt, Human
cacaaaacucaauuuaguc

SEQ ID NO: 264591 - RNA, 18 nt, Human
cacacagugcaaguggug

SEQ ID NO: 264592 - RNA, 18 nt, Human
cagcauacuucaggagug

SEQ ID NO: 264593 - RNA, 23 nt, Human
cauauauacucauacaccuaucu

SEQ ID NO: 264594 - RNA, 22 nt, Human
cauucuauuauuuucccaucuu

SEQ ID NO: 264595 - RNA, 22 nt, Human
cccuuaagugacuuacuagcuu

SEQ ID NO: 264596 - RNA, 21 nt, Human
ccuguccuccucuucugucca

SEQ ID NO: 264597 - RNA, 25 nt, Human
ccuguccuccucuucuguccaggaa

SEQ ID NO: 264598 - RNA, 22 nt, Human
cuaagcauuaaaauacuuagua

SEQ ID NO: 264599 - RNA, 18 nt, Human
cuaccacaaaagcaaaua

SEQ ID NO: 264600 - RNA, 20 nt, Human
cuaucuaccccuuaagugac

SEQ ID NO: 264601 - RNA, 18 nt, Human
cuccuacauacuguacaa

SEQ ID NO: 264602 - RNA, 24 nt, Human
cugaaaaaaaaaacaaaaaauuag

SEQ ID NO: 264603 - RNA, 28 nt, Human
cuucucacuauauauauauauaaauaua

SEQ ID NO: 264604 - RNA, 23 nt, Human
cuuucugccaucgaugcuggcac

SEQ ID NO: 264605 - RNA, 24 nt, Human
gaccaccccccgauauaauuuaaa

SEQ ID NO: 264606 - RNA, 22 nt, Human
gcaggcugggcggggacgcggg

SEQ ID NO: 264607 - RNA, 21 nt, Human
gcauaggagcaggcugggcgg

SEQ ID NO: 264608 - RNA, 24 nt, Human
gccaucuuucucuacacugcuugc

SEQ ID NO: 264609 - RNA, 19 nt, Human
gugaagaaaauauaugaga

SEQ ID NO: 264610 - RNA, 23 nt, Human
uaaaaacaacaacaacaaaaaac

SEQ ID NO: 264611 - RNA, 24 nt, Human
uaaaacuuucugccaucgaugcug

SEQ ID NO: 264612 - RNA, 21 nt, Human
uaaaauaagugcaaacacuua

SEQ ID NO: 264613 - RNA, 21 nt, Human
uaaaauaugcaaaaacuagca

SEQ ID NO: 264614 - RNA, 22 nt, Human
uaaagaccaucuuuuuggccca

SEQ ID NO: 264615 - RNA, 23 nt, Human
uaaauaucuacauuuaagcuuua

SEQ ID NO: 264616 - RNA, 19 nt, Human
uaaauuauaaaaacagacu

SEQ ID NO: 264617 - RNA, 20 nt, Human
uacaaaguucuccugcuccu

SEQ ID NO: 264618 - RNA, 22 nt, Human
uacauuaaaaacaacaacaaca

SEQ ID NO: 264619 - RNA, 26 nt, Human
uacauuaaaaacaacaacaacaaaaa

SEQ ID NO: 264620 - RNA, 18 nt, Human
uaccacaaaagcaaauaa

SEQ ID NO: 264621 - RNA, 21 nt, Human
uacuacuguuucauacuuaaa

SEQ ID NO: 264622 - RNA, 22 nt, Human
uagaaagcaaucaacauacuua

SEQ ID NO: 264623 - RNA, 19 nt, Human
uauaaauauauauauauau

SEQ ID NO: 264624 - RNA, 20 nt, Human
uauauaaauauauauauaua

SEQ ID NO: 264625 - RNA, 20 nt, Human
uauauaaauauauauauaua

SEQ ID NO: 264626 - RNA, 22 nt, Human
uauauauaaauauauauauaua

SEQ ID NO: 264627 - RNA, 20 nt, Human
uauuuuuuaaacaaaaugca

SEQ ID NO: 264628 - RNA, 19 nt, Human
ucaguccuuccuggaagua

SEQ ID NO: 264629 - RNA, 21 nt, Human
ucaguccuuccuggaaguaac

SEQ ID NO: 264630 - RNA, 21 nt, Human
ucauacuuaaagucaaaauua

SEQ ID NO: 264631 - RNA, 24 nt, Human
uccaauaagcccagacuuauccac

SEQ ID NO: 264632 - RNA, 19 nt, Human
uccaggaagauuucuuuac

SEQ ID NO: 264633 - RNA, 20 nt, Human
uccauauaucacaaaacuca

SEQ ID NO: 264634 - RNA, 26 nt, Human
ucccuuguccauuuuacucuguucca

SEQ ID NO: 264635 - RNA, 20 nt, Human
ucugaacuaauucaauaacc

SEQ ID NO: 264636 - RNA, 18 nt, Human
ugaaagaaacucagagga

SEQ ID NO: 264637 - RNA, 21 nt, Human
ugaaugcuuuuuguuuucagu

SEQ ID NO: 264638 - RNA, 25 nt, Human
ugacagcacaccauuauaugacugg

SEQ ID NO: 264639 - RNA, 21 nt, Human
ugcaaacacuuaauacaugca

SEQ ID NO: 264640 - RNA, 24 nt, Human
ugcaacugaagcaacuguuguaac

SEQ ID NO: 264641 - RNA, 18 nt, Human
ugcaagugguggucgcuc

SEQ ID NO: 264642 - RNA, 25 nt, Human
ugcuccuacauacuguacaauacau

SEQ ID NO: 264643 - RNA, 22 nt, Human
uggaaguaguuuggcaauuucu

SEQ ID NO: 264644 - RNA, 24 nt, Human
ugguuucacuaagugaaauuucug

SEQ ID NO: 264645 - RNA, 19 nt, Human
uguuuucaguacuaugcuc

SEQ ID NO: 264646 - RNA, 21 nt, Human
uuaaaacccuuuuaggucuac

SEQ ID NO: 264647 - RNA, 22 nt, Human
uuaaaacuuucugccaucgaug

SEQ ID NO: 264648 - RNA, 21 nt, Human
uuaggauaauuuaaugcucaa

SEQ ID NO: 264649 - RNA, 22 nt, Human
uuaggucuacuguucaagagcu

SEQ ID NO: 264650 - RNA, 20 nt, Human
uuaguacauuuuuagaacua

SEQ ID NO: 264651 - RNA, 18 nt, Human
uuaguuaacuugagaacu

SEQ ID NO: 264652 - RNA, 25 nt, Human
uuaucuauuuaucaauaaggcauag

SEQ ID NO: 264653 - RNA, 25 nt, Human
uucacuucucacuauauauauauau

SEQ ID NO: 264654 - RNA, 20 nt, Human
uucaggaguggagagggaga

SEQ ID NO: 264655 - RNA, 22 nt, Human
uuccagaguuucuucaguccuu

SEQ ID NO: 264656 - RNA, 19 nt, Human
uuuaaaacuuucugccauc

SEQ ID NO: 264657 - RNA, 25 nt, Human
uuuccaugcaaguauggcugcuaca

SEQ ID NO: 264658 - RNA, 23 nt, Human
uuucugaacuaauucaauaaccc

SEQ ID NO: 264659 - RNA, 25 nt, Human
aaaugcaccaagagagggugagcac

SEQ ID NO: 264660 - RNA, 20 nt, Human
aacagggcagcacauggccc

SEQ ID NO: 264661 - RNA, 21 nt, Human
aacagggcagcacauggcccu

SEQ ID NO: 264662 - RNA, 18 nt, Human
aagagagggugagcacag

SEQ ID NO: 264663 - RNA, 19 nt, Human
aagcagggucugagaugag

SEQ ID NO: 264664 - RNA, 23 nt, Human
aagcugacggagcucccuguggc

SEQ ID NO: 264665 - RNA, 20 nt, Human
aaugggcucgugacacccuc

SEQ ID NO: 264666 - RNA, 23 nt, Human
acagacccccucugcccccacaa

SEQ ID NO: 264667 - RNA, 24 nt, Human
acccccucugcccccacaaccccu

SEQ ID NO: 264668 - RNA, 20 nt, Human
agagagggugagcacaggag

SEQ ID NO: 264669 - RNA, 21 nt, Human
agcacauggcccuguugccuc

SEQ ID NO: 264670 - RNA, 22 nt, Human
agcccggagcgggagccgggcc

SEQ ID NO: 264671 - RNA, 18 nt, Human
agcgggagccgggccggg

SEQ ID NO: 264672 - RNA, 22 nt, Human
caaaaaaaugcaccaagagagg

SEQ ID NO: 264673 - RNA, 22 nt, Human
caacagggcagcacauggcccu

SEQ ID NO: 264674 - RNA, 20 nt, Human
caccaggagccgcccacagc

SEQ ID NO: 264675 - RNA, 23 nt, Human
caccugaaugacucucagauuca

SEQ ID NO: 264676 - RNA, 19 nt, Human
cagagcccggagcgggagc

SEQ ID NO: 264677 - RNA, 18 nt, Human
caggagcaccccuggcca

SEQ ID NO: 264678 - RNA, 22 nt, Human
caggagccgcccacagcugggc

SEQ ID NO: 264679 - RNA, 22 nt, Human
cccccacaaccccuguaaacau

SEQ ID NO: 264680 - RNA, 21 nt, Human
cccccucugcccccacaaccc

SEQ ID NO: 264681 - RNA, 21 nt, Human
ccccgggccgcgcucgaaggc

SEQ ID NO: 264682 - RNA, 23 nt, Human
ccccucugcccccacaaccccug

SEQ ID NO: 264683 - RNA, 21 nt, Human
ccccuggccacaucccccauc

SEQ ID NO: 264684 - RNA, 22 nt, Human
ccccuguaaacaugagaauggg

SEQ ID NO: 264685 - RNA, 18 nt, Human
cccuguugccuccaccug

SEQ ID NO: 264686 - RNA, 19 nt, Human
ccgcgcucgcccgcccgcc

SEQ ID NO: 264687 - RNA, 25 nt, Human
ccggagcgggagccgggccgggguc

SEQ ID NO: 264688 - RNA, 18 nt, Human
ccggcagagcccggagcg

SEQ ID NO: 264689 - RNA, 24 nt, Human
ccgggccggggucaggacccgggc

SEQ ID NO: 264690 - RNA, 20 nt, Human
ccuggccacaucccccaucc

SEQ ID NO: 264691 - RNA, 22 nt, Human
cggggucaggacccgggcugcu

SEQ ID NO: 264692 - RNA, 18 nt, Human
cuccgggccccgggccgc

SEQ ID NO: 264693 - RNA, 22 nt, Human
cuccgggccccgggccgcgcuc

SEQ ID NO: 264694 - RNA, 20 nt, Human
cugguggcagaaggcucccu

SEQ ID NO: 264695 - RNA, 20 nt, Human
gagccgggccggggucagga

SEQ ID NO: 264696 - RNA, 21 nt, Human
gcaccaagagagggugagcac

SEQ ID NO: 264697 - RNA, 18 nt, Human
gccacaucccccauccua

SEQ ID NO: 264698 - RNA, 18 nt, Human
gccggcagagcccggagc

SEQ ID NO: 264699 - RNA, 23 nt, Human
ggaggggcugguggcagaaggcu

SEQ ID NO: 264700 - RNA, 18 nt, Human
ggcagaaggcucccugca

SEQ ID NO: 264701 - RNA, 25 nt, Human
ggcugguggcagaaggcucccugca

SEQ ID NO: 264702 - RNA, 19 nt, Human
gggucaggacccgggcugc

SEQ ID NO: 264703 - RNA, 21 nt, Human
ggucaggacccgggcugcucc

SEQ ID NO: 264704 - RNA, 23 nt, Human
ucaccugaaugacucucagauuc

SEQ ID NO: 264705 - RNA, 18 nt, Human
ucaggacccgggcugcuc

SEQ ID NO: 264706 - RNA, 19 nt, Human
ugagaaugggcucgugaca

SEQ ID NO: 264707 - RNA, 26 nt, Human
ugagaaugggcucgugacacccucaa

SEQ ID NO: 264708 - RNA, 22 nt, Human
ugagagucuggggaggggcugg

SEQ ID NO: 264709 - RNA, 24 nt, Human
ugcccccacaaccccuguaaacau

SEQ ID NO: 264710 - RNA, 22 nt, Human
uggaacuuuguuguuagcacca

SEQ ID NO: 264711 - RNA, 19 nt, Human
uggcagaaggcucccugca

SEQ ID NO: 264712 - RNA, 21 nt, Human
uggcagaaggcucccugcagg

SEQ ID NO: 264713 - RNA, 19 nt, Human
ugggagaagcugacggagc

SEQ ID NO: 264714 - RNA, 25 nt, Human
ugggagaagcugacggagcucccug

SEQ ID NO: 264715 - RNA, 23 nt, Human
uggggagggaaccaggcagaccu

SEQ ID NO: 264716 - RNA, 22 nt, Human
ugguggcagaaggcucccugca

SEQ ID NO: 264717 - RNA, 19 nt, Human
uuccaaaaaaaugcaccaa

SEQ ID NO: 264718 - RNA, 21 nt, Human
aaagcagcagagugcagagag

SEQ ID NO: 264719 - RNA, 19 nt, Human
acaguagccaggcccuccc

SEQ ID NO: 264720 - RNA, 21 nt, Human
accacacuugggggccuggug

SEQ ID NO: 264721 - RNA, 24 nt, Human
agacaguagccaggcccucccuca

SEQ ID NO: 264722 - RNA, 18 nt, Human
aggaaagaaaaagaccac

SEQ ID NO: 264723 - RNA, 19 nt, Human
caaagcagcagagugcaga

SEQ ID NO: 264724 - RNA, 22 nt, Human
cagaaggagagcccaccuuaga

SEQ ID NO: 264725 - RNA, 22 nt, Human
caguagccaggcccucccucag

SEQ ID NO: 264726 - RNA, 18 nt, Human
ccacgacuaguugacaga

SEQ ID NO: 264727 - RNA, 21 nt, Human
cccuccacgacuaguugacag

SEQ ID NO: 264728 - RNA, 20 nt, Human
gacaguagccaggcccuccc

SEQ ID NO: 264729 - RNA, 23 nt, Human
gacuaguugacagaaaccccaca

SEQ ID NO: 264730 - RNA, 21 nt, Human
gaggagucugcagaaggagag

SEQ ID NO: 264731 - RNA, 19 nt, Human
gagucuccuucccuccacg

SEQ ID NO: 264732 - RNA, 23 nt, Human
ggcaaacuuuuuuuuuuuuuuuu

SEQ ID NO: 264733 - RNA, 19 nt, Human
ggggccuggugggaaaaca

SEQ ID NO: 264734 - RNA, 19 nt, Human
gguacgccuugcaagagga

SEQ ID NO: 264735 - RNA, 21 nt, Human
uagccaggcccucccucagua

SEQ ID NO: 264736 - RNA, 24 nt, Human
uagccaggcccucccucaguauuc

SEQ ID NO: 264737 - RNA, 21 nt, Human
uauuccucaggauugcuugag

SEQ ID NO: 264738 - RNA, 18 nt, Human
ucaaagcagcagagugca

SEQ ID NO: 264739 - RNA, 21 nt, Human
ucaaagcagcagagugcagag

SEQ ID NO: 264740 - RNA, 21 nt, Human
uccacgacuaguugacagaaa

SEQ ID NO: 264741 - RNA, 23 nt, Human
ucgcagauaugaaucaauuaugu

SEQ ID NO: 264742 - RNA, 19 nt, Human
ugacagaaaccccacaggc

SEQ ID NO: 264743 - RNA, 21 nt, Human
uggagguacgccuugcaagag

SEQ ID NO: 264744 - RNA, 26 nt, Human
ugggcaaacuuuuuuuuuuuuuuuuu

SEQ ID NO: 264745 - RNA, 21 nt, Human
uucaaagcagcagagugcaga

SEQ ID NO: 264746 - RNA, 19 nt, Human
uuccucaggauugcuugag

SEQ ID NO: 264747 - RNA, 22 nt, Human
uuuaaagagucuccuucccucc

SEQ ID NO: 264748 - RNA, 21 nt, Human
uuucaaccagauuucaaagca

SEQ ID NO: 264749 - RNA, 24 nt, Human
uuuuuuuuguuugcaauuuuuaau

SEQ ID NO: 264750 - RNA, 20 nt, Human
uuuuuuuuuuuuuuuucucu

SEQ ID NO: 264751 - RNA, 22 nt, Human
cacaguccugggagguugggga

SEQ ID NO: 264752 - RNA, 20 nt, Human
caguccugggagguugggga

SEQ ID NO: 264753 - RNA, 21 nt, Human
cgaaaacuccagaaagaacac

SEQ ID NO: 264754 - RNA, 25 nt, Human
gaaaacuccagaaagaacacagucc

SEQ ID NO: 264755 - RNA, 21 nt, Human
ucagcgaaaacuccagaaaga

SEQ ID NO: 264756 - RNA, 18 nt, Human
uuggcagguaggggacag

SEQ ID NO: 264757 - RNA, 24 nt, Human
aacuccgcagggcacuccaaucuc

SEQ ID NO: 264758 - RNA, 24 nt, Human
aaucucugcgccuuccagcacccc

SEQ ID NO: 264759 - RNA, 24 nt, Human
accagccucuggggaagggaggcc

SEQ ID NO: 264760 - RNA, 22 nt, Human
aggcugcagcaccuggcucuca

SEQ ID NO: 264761 - RNA, 22 nt, Human
caccccuugagcccaguuaguc

SEQ ID NO: 264762 - RNA, 19 nt, Human
cccuugagcccaguuaguc

SEQ ID NO: 264763 - RNA, 23 nt, Human
ccucaggcugcagcaccuggcuc

SEQ ID NO: 264764 - RNA, 22 nt, Human
ccugaguucuggacaccagccu

SEQ ID NO: 264765 - RNA, 20 nt, Human
cuggccuggggccuaccagg

SEQ ID NO: 264766 - RNA, 23 nt, Human
gaguuugacuguaggccuggugg

SEQ ID NO: 264767 - RNA, 20 nt, Human
gggaggccagcagguaccag

SEQ ID NO: 264768 - RNA, 20 nt, Human
ggggaagggaggccagcagg

SEQ ID NO: 264769 - RNA, 18 nt, Human
uccagcaccccuugagcc

SEQ ID NO: 264770 - RNA, 20 nt, Human
ucucaucacagccuccuccc

SEQ ID NO: 264771 - RNA, 26 nt, Human
ugagugcuucccacccagagugcaac

SEQ ID NO: 264772 - RNA, 18 nt, Human
ugaguucuggacaccagc

SEQ ID NO: 264773 - RNA, 22 nt, Human
uggaagcgggggucuugggcau

SEQ ID NO: 264774 - RNA, 22 nt, Human
uggacaccagccucuggggaag

SEQ ID NO: 264775 - RNA, 20 nt, Human
uucccacccagagugcaacu

SEQ ID NO: 264776 - RNA, 18 nt, Human
aaaaaaauccagcgucua

SEQ ID NO: 264777 - RNA, 26 nt, Human
aaaaaaauccagcgucuaagcagcug

SEQ ID NO: 264778 - RNA, 23 nt, Human
aaaguucuuuuaugcccaaaguc

SEQ ID NO: 264779 - RNA, 21 nt, Human
agaaaaaaaaaagaugguaag

SEQ ID NO: 264780 - RNA, 19 nt, Human
aggcaggaggggagccagg

SEQ ID NO: 264781 - RNA, 21 nt, Human
auaaagccccgaaaaccggcu

SEQ ID NO: 264782 - RNA, 21 nt, Human
auggcuaaaucuuucagucuc

SEQ ID NO: 264783 - RNA, 19 nt, Human
auugcucaggacauuucug

SEQ ID NO: 264784 - RNA, 20 nt, Human
caaggguugcggaccgcugg

SEQ ID NO: 264785 - RNA, 23 nt, Human
cagcgcgaucccucccuccguuc

SEQ ID NO: 264786 - RNA, 24 nt, Human
ccagggacggccggggcccggcgg

SEQ ID NO: 264787 - RNA, 19 nt, Human
cccgcucgcucccucugcc

SEQ ID NO: 264788 - RNA, 23 nt, Human
cccucccuccguucuuuuuuccc

SEQ ID NO: 264789 - RNA, 18 nt, Human
cccuccguucuuuuuucc

SEQ ID NO: 264790 - RNA, 19 nt, Human
ccggcgguggcggccgcga

SEQ ID NO: 264791 - RNA, 21 nt, Human
ccggcgguggcggccgcgagc

SEQ ID NO: 264792 - RNA, 22 nt, Human
ccugcccuucucgaggcaggag

SEQ ID NO: 264793 - RNA, 21 nt, Human
cgcucgcucccucugccucuc

SEQ ID NO: 264794 - RNA, 23 nt, Human
cucgaggcaggaggggagccagg

SEQ ID NO: 264795 - RNA, 21 nt, Human
cucugagaagcccugcccuuc

SEQ ID NO: 264796 - RNA, 22 nt, Human
gaaaaaaauccagcgucuaagc

SEQ ID NO: 264797 - RNA, 21 nt, Human
gccaagccucugagaagcccu

SEQ ID NO: 264798 - RNA, 18 nt, Human
gggagagucgcguccuug

SEQ ID NO: 264799 - RNA, 26 nt, Human
ggggaaguguccccaaaugggcagaa

SEQ ID NO: 264800 - RNA, 18 nt, Human
guuccagugcaaagugcc

SEQ ID NO: 264801 - RNA, 19 nt, Human
uaaagccccgaaaaccggc

SEQ ID NO: 264802 - RNA, 21 nt, Human
uaagcagcugcaaggagagcc

SEQ ID NO: 264803 - RNA, 22 nt, Human
uccacuacccgaaaaaaaucca

SEQ ID NO: 264804 - RNA, 23 nt, Human
uccccaaaugggcagaauagccu

SEQ ID NO: 264805 - RNA, 23 nt, Human
uccuggcagcggcggggaagugu

SEQ ID NO: 264806 - RNA, 20 nt, Human
ucuuuuuucccgccaagccu

SEQ ID NO: 264807 - RNA, 26 nt, Human
uggccugggggaucaagcgggagggc

SEQ ID NO: 264808 - RNA, 19 nt, Human
uuaaaaacaauucuuaaau

SEQ ID NO: 264809 - RNA, 21 nt, Human
uucguggaugcggcaaggguu

SEQ ID NO: 264810 - RNA, 23 nt, Human
acagcggcagcggcguagcuggc

SEQ ID NO: 264811 - RNA, 20 nt, Human
cagcggcagcggcguagcug

SEQ ID NO: 264812 - RNA, 23 nt, Human
aaauggucguguaaaaguuauuc

SEQ ID NO: 264813 - RNA, 20 nt, Human
aagaugccagaauaagaaca

SEQ ID NO: 264814 - RNA, 21 nt, Human
aagccucaguuuuuccaucug

SEQ ID NO: 264815 - RNA, 25 nt, Human
acccccuucaaucccuuacagucca

SEQ ID NO: 264816 - RNA, 20 nt, Human
accuggagcggaccggcucc

SEQ ID NO: 264817 - RNA, 20 nt, Human
agaaagcuggagcugacuug

SEQ ID NO: 264818 - RNA, 19 nt, Human
agcaagaaggacacuuuuc

SEQ ID NO: 264819 - RNA, 19 nt, Human
aggggccagugaauauuug

SEQ ID NO: 264820 - RNA, 19 nt, Human
agggggagcaagaaggaca

SEQ ID NO: 264821 - RNA, 24 nt, Human
aguaaagccaacuggagaccuagg

SEQ ID NO: 264822 - RNA, 21 nt, Human
aguggugguggggaggcacga

SEQ ID NO: 264823 - RNA, 25 nt, Human
aguggugguggggaggcacgagaag

SEQ ID NO: 264824 - RNA, 23 nt, Human
caaacuguuuaccaacacaccca

SEQ ID NO: 264825 - RNA, 23 nt, Human
caaaguaggggccagugaauauu

SEQ ID NO: 264826 - RNA, 23 nt, Human
caacacacccacgugccagacag

SEQ ID NO: 264827 - RNA, 24 nt, Human
caagaaggacacuuuuccaucuca

SEQ ID NO: 264828 - RNA, 21 nt, Human
cacaaagaccccaaacaucaa

SEQ ID NO: 264829 - RNA, 18 nt, Human
cacacacgcacaugcgcg

SEQ ID NO: 264830 - RNA, 18 nt, Human
cagcaaggcaagguguag

SEQ ID NO: 264831 - RNA, 18 nt, Human
cagccgcccgccaccugg

SEQ ID NO: 264832 - RNA, 19 nt, Human
cagccgcccgccaccugga

SEQ ID NO: 264833 - RNA, 18 nt, Human
caucaaggaagaggugcc

SEQ ID NO: 264834 - RNA, 19 nt, Human
caucaaggaagaggugccu

SEQ ID NO: 264835 - RNA, 20 nt, Human
caucucaggacaaacagcaa

SEQ ID NO: 264836 - RNA, 25 nt, Human
cauucuucccucccugucucaggga

SEQ ID NO: 264837 - RNA, 18 nt, Human
ccaaacaucaaggaagag

SEQ ID NO: 264838 - RNA, 24 nt, Human
ccaacccucaccucaaaucccuug

SEQ ID NO: 264839 - RNA, 22 nt, Human
ccacaaagaccccaaacaucaa

SEQ ID NO: 264840 - RNA, 22 nt, Human
ccagcacacacgcacaugcgcg

SEQ ID NO: 264841 - RNA, 25 nt, Human
ccagugaauauuuguugaaugccag

SEQ ID NO: 264842 - RNA, 22 nt, Human
ccccuucaaucccuuacagucc

SEQ ID NO: 264843 - RNA, 19 nt, Human
ccuaaaagcuacagugagc

SEQ ID NO: 264844 - RNA, 24 nt, Human
ccucgcuccagccgcccgccaccu

SEQ ID NO: 264845 - RNA, 27 nt, Human
ccucgcuccagccgcccgccaccugga

SEQ ID NO: 264846 - RNA, 28 nt, Human
cggcagccagcacacacgcacaugcgcg

SEQ ID NO: 264847 - RNA, 21 nt, Human
cggcucggggcagcccggcag

SEQ ID NO: 264848 - RNA, 19 nt, Human
cuaagcgccaacccucacc

SEQ ID NO: 264849 - RNA, 25 nt, Human
cucaaaucccuuguccccuggggcu

SEQ ID NO: 264850 - RNA, 23 nt, Human
cucggcuucuucucccccuaggg

SEQ ID NO: 264851 - RNA, 21 nt, Human
cuggaguucuacugccuugac

SEQ ID NO: 264852 - RNA, 24 nt, Human
cuuacaguccaaccccaguauugu

SEQ ID NO: 264853 - RNA, 23 nt, Human
gaagaggggcuggcuagauggca

SEQ ID NO: 264854 - RNA, 18 nt, Human
gcagcaaaaaaacuucag

SEQ ID NO: 264855 - RNA, 22 nt, Human
gccaacccucaccucaaauccc

SEQ ID NO: 264856 - RNA, 18 nt, Human
gcuucuucucccccuagg

SEQ ID NO: 264857 - RNA, 21 nt, Human
ggagaggagggccuggaguuc

SEQ ID NO: 264858 - RNA, 18 nt, Human
ggagcagcugacgcugga

SEQ ID NO: 264859 - RNA, 22 nt, Human
gggagugugaguuuccuaggga

SEQ ID NO: 264860 - RNA, 20 nt, Human
ggguguggaggucuaagaug

SEQ ID NO: 264861 - RNA, 23 nt, Human
uaaaaguuauuccuaaaagcuac

SEQ ID NO: 264862 - RNA, 23 nt, Human
uaaaguaaagccaacuggagacc

SEQ ID NO: 264863 - RNA, 24 nt, Human
uaagauaagcuaccacaaagaccc

SEQ ID NO: 264864 - RNA, 21 nt, Human
uaagcuaccacaaagacccca

SEQ ID NO: 264865 - RNA, 28 nt, Human
uacaguccaaccccaguauuguccucuu

SEQ ID NO: 264866 - RNA, 22 nt, Human
uaccaacacacccacgugccag

SEQ ID NO: 264867 - RNA, 26 nt, Human
uaccacaaagaccccaaacaucaagg

SEQ ID NO: 264868 - RNA, 21 nt, Human
uagcccacagauugccacaaa

SEQ ID NO: 264869 - RNA, 18 nt, Human
uauccuauuuuuucucuc

SEQ ID NO: 264870 - RNA, 23 nt, Human
uccaaacuguuuaccaacacacc

SEQ ID NO: 264871 - RNA, 23 nt, Human
uccaaccccaguauuguccucuc

SEQ ID NO: 264872 - RNA, 21 nt, Human
uccaggauuucucacgggugu

SEQ ID NO: 264873 - RNA, 20 nt, Human
ucccuuguccccuggggcuc

SEQ ID NO: 264874 - RNA, 22 nt, Human
ucccuuguccccuggggcucca

SEQ ID NO: 264875 - RNA, 19 nt, Human
ucuaagccucaguuuuucc

SEQ ID NO: 264876 - RNA, 21 nt, Human
ucuacaaaaauauccucucca

SEQ ID NO: 264877 - RNA, 20 nt, Human
ucucagggaugcacgagugg

SEQ ID NO: 264878 - RNA, 23 nt, Human
ucugcccucagcgagguugcacc

SEQ ID NO: 264879 - RNA, 19 nt, Human
ugaguuuccuagggaaaga

SEQ ID NO: 264880 - RNA, 21 nt, Human
ugaguuuccuagggaaagagg

SEQ ID NO: 264881 - RNA, 20 nt, Human
ugccccagucugcccucagc

SEQ ID NO: 264882 - RNA, 22 nt, Human
ugccuugaccccagcauguagc

SEQ ID NO: 264883 - RNA, 24 nt, Human
ugccuugaccccagcauguagccc

SEQ ID NO: 264884 - RNA, 25 nt, Human
uggagcauuggggaagaggggcugg

SEQ ID NO: 264885 - RNA, 22 nt, Human
uggagcggaccggcuccccgcc

SEQ ID NO: 264886 - RNA, 22 nt, Human
uggcuagauggcagaaagcugg

SEQ ID NO: 264887 - RNA, 24 nt, Human
uggcuagauggcagaaagcuggag

SEQ ID NO: 264888 - RNA, 20 nt, Human
ugggauggagcauuggggaa

SEQ ID NO: 264889 - RNA, 18 nt, Human
ugucacuagccacagucu

SEQ ID NO: 264890 - RNA, 20 nt, Human
uguggaggucuaagaugcca

SEQ ID NO: 264891 - RNA, 21 nt, Human
uuuuuuuuuuuuuuuuuccag

SEQ ID NO: 264892 - RNA, 23 nt, Human
uuuuuuuuuuuuuuuuuuccagg

SEQ ID NO: 264893 - RNA, 24 nt, Human
aaaaagaaaacuugugucuuuuua

SEQ ID NO: 264894 - RNA, 19 nt, Human
aaacacaccaggaggcaag

SEQ ID NO: 264895 - RNA, 24 nt, Human
aaaggugccagaaaacacaaagca

SEQ ID NO: 264896 - RNA, 19 nt, Human
aaggugccagaaaacacaa

SEQ ID NO: 264897 - RNA, 24 nt, Human
aaucgcuugaacccgggaggcaga

SEQ ID NO: 264898 - RNA, 21 nt, Human
aauguggugaaaccccaucuc

SEQ ID NO: 264899 - RNA, 19 nt, Human
acaccaggaggcaagucca

SEQ ID NO: 264900 - RNA, 21 nt, Human
acccacaugacaagcugcggg

SEQ ID NO: 264901 - RNA, 23 nt, Human
accccaucucuacuaaaaauaca

SEQ ID NO: 264902 - RNA, 20 nt, Human
acuguccagaguguccugcu

SEQ ID NO: 264903 - RNA, 22 nt, Human
acuuuccccaggccccaggcua

SEQ ID NO: 264904 - RNA, 23 nt, Human
agaaaacuucagagaggcccaga

SEQ ID NO: 264905 - RNA, 18 nt, Human
agaaaguucccucacuca

SEQ ID NO: 264906 - RNA, 22 nt, Human
agagagagcuggguuucaaagu

SEQ ID NO: 264907 - RNA, 21 nt, Human
agagccagcaagcuccuugga

SEQ ID NO: 264908 - RNA, 23 nt, Human
agagccagcaagcuccuuggaga

SEQ ID NO: 264909 - RNA, 18 nt, Human
agagguugcagugagccg

SEQ ID NO: 264910 - RNA, 23 nt, Human
agagguugcagugagccgagauc

SEQ ID NO: 264911 - RNA, 24 nt, Human
agagguugcagugagccgagauca

SEQ ID NO: 264912 - RNA, 22 nt, Human
agaguugagacuccgucucaaa

SEQ ID NO: 264913 - RNA, 19 nt, Human
agcauugagagugggagga

SEQ ID NO: 264914 - RNA, 22 nt, Human
agccaggaagaccccaagucuc

SEQ ID NO: 264915 - RNA, 19 nt, Human
agccuggccaaugugguga

SEQ ID NO: 264916 - RNA, 22 nt, Human
agccuggccaauguggugaaac

SEQ ID NO: 264917 - RNA, 24 nt, Human
agccuggccaauguggugaaaccc

SEQ ID NO: 264918 - RNA, 26 nt, Human
agccugggcgacaagaguugagacuc

SEQ ID NO: 264919 - RNA, 23 nt, Human
agcuaggcgugguggcaggcgcc

SEQ ID NO: 264920 - RNA, 23 nt, Human
aggaacaaguuuucaugguucua

SEQ ID NO: 264921 - RNA, 18 nt, Human
aggaggucaagaccagcc

SEQ ID NO: 264922 - RNA, 21 nt, Human
aggcagagguugcagugagcc

SEQ ID NO: 264923 - RNA, 24 nt, Human
aggcagagguugcagugagccgag

SEQ ID NO: 264924 - RNA, 22 nt, Human
aggcagcuugugugucuccugg

SEQ ID NO: 264925 - RNA, 24 nt, Human
aggcaggagaaucgcuugaacccg

SEQ ID NO: 264926 - RNA, 24 nt, Human
aggcaguggaucaccuaggucagg

SEQ ID NO: 264927 - RNA, 24 nt, Human
aggcucaggcaggagaaucgcuug

SEQ ID NO: 264928 - RNA, 20 nt, Human
aggcuggagcccccaacaac

SEQ ID NO: 264929 - RNA, 23 nt, Human
agggaagagagagagcuggguuu

SEQ ID NO: 264930 - RNA, 22 nt, Human
agggcuugggaacuuuccccag

SEQ ID NO: 264931 - RNA, 21 nt, Human
aggugccagaaaacacaaagc

SEQ ID NO: 264932 - RNA, 20 nt, Human
auaauauauacauauauaca

SEQ ID NO: 264933 - RNA, 20 nt, Human
auacauacauauauauauac

SEQ ID NO: 264934 - RNA, 20 nt, Human
auacauacauauauauauac

SEQ ID NO: 264935 - RNA, 25 nt, Human
auauauacauacauauauauauaca

SEQ ID NO: 264936 - RNA, 30 nt, Human
auauauacauauauacauacauauauauag

SEQ ID NO: 264937 - RNA, 30 nt, Human; identical to SEQ ID NO: 264936

SEQ ID NO: 264938 - RNA, 25 nt, Human
auauauacauauauacauauauaca

SEQ ID NO: 264939 - RNA, 25 nt, Human
auauauacauauauacauauauaca

SEQ ID NO: 264940 - RNA, 25 nt, Human
auauauacauauauacauauauaca

SEQ ID NO: 264941 - RNA, 24 nt, Human
aucaugccauuaaccuccagccug

SEQ ID NO: 264942 - RNA, 20 nt, Human
caaaggugccagaaaacaca

SEQ ID NO: 264943 - RNA, 25 nt, Human
caacagcucuccagaaaacuucaga

SEQ ID NO: 264944 - RNA, 24 nt, Human
caagaccagccuggccaauguggu

SEQ ID NO: 264945 - RNA, 22 nt, Human
caagucucugagcuuguuuuca

SEQ ID NO: 264946 - RNA, 24 nt, Human
caauguggugaaaccccaucucua

SEQ ID NO: 264947 - RNA, 21 nt, Human
cacacacgcgcacaacggcca

SEQ ID NO: 264948 - RNA, 23 nt, Human
caccaccuguugcauaccaucug

SEQ ID NO: 264949 - RNA, 21 nt, Human
caccccagagacauccuuucc

SEQ ID NO: 264950 - RNA, 28 nt, Human
caccccagagacauccuuuccuagccua

SEQ ID NO: 264951 - RNA, 18 nt, Human
caccugggcagggauuga

SEQ ID NO: 264952 - RNA, 23 nt, Human
cacucccauaagucagggaagag

SEQ ID NO: 264953 - RNA, 22 nt, Human
cagaaaacacaaagcacuccca

SEQ ID NO: 264954 - RNA, 24 nt, Human
cagaaaacuucagagaggcccaga

SEQ ID NO: 264955 - RNA, 19 nt, Human
cagaaguuacccacaugac

SEQ ID NO: 264956 - RNA, 18 nt, Human
cagcauugagagugggag

SEQ ID NO: 264957 - RNA, 26 nt, Human
cagcucuccagaaaacuucagagagg

SEQ ID NO: 264958 - RNA, 23 nt, Human
caggaagaccccaagucuccuca

SEQ ID NO: 264959 - RNA, 21 nt, Human
cauaacagaggcagaaugaga

SEQ ID NO: 264960 - RNA, 18 nt, Human
cauacauauauauauaca

SEQ ID NO: 264961 - RNA, 18 nt, Human
cauacauauauauauaca

SEQ ID NO: 264962 - RNA, 18 nt, Human
cauacauauauauauaca

SEQ ID NO: 264963 - RNA, 18 nt, Human
cauacauauauauauaca

SEQ ID NO: 264964 - RNA, 19 nt, Human
cauauauacauacauauau

SEQ ID NO: 264965 - RNA, 19 nt, Human
cauauauacauacauauau

SEQ ID NO: 264966 - RNA, 19 nt, Human
cauauauacauacauauau

SEQ ID NO: 264967 - RNA, 19 nt, Human
cauauauacauacauauau

SEQ ID NO: 264968 - RNA, 20 nt, Human
caugccauuaaccuccagcc

SEQ ID NO: 264969 - RNA, 24 nt, Human
cauuaaccuccagccugggcgaca

SEQ ID NO: 264970 - RNA, 22 nt, Human
cauugcauaacagaggcagaau

SEQ ID NO: 264971 - RNA, 25 nt, Human
ccaaaggugccagaaaacacaaagc

SEQ ID NO: 264972 - RNA, 24 nt, Human
ccaccaccuguugcauaccaucug

SEQ ID NO: 264973 - RNA, 22 nt, Human
ccaggccccaggcuaagaccca

SEQ ID NO: 264974 - RNA, 24 nt, Human
ccaucugucagccuuuucuuugga

SEQ ID NO: 264975 - RNA, 23 nt, Human
ccauuaaccuccagccugggcga

SEQ ID NO: 264976 - RNA, 21 nt, Human
cccacaugacaagcugcgggu

SEQ ID NO: 264977 - RNA, 23 nt, Human
ccccaggccccaggcuaagaccc

SEQ ID NO: 264978 - RNA, 23 nt, Human
ccuccagccugggcgacaagagu

SEQ ID NO: 264979 - RNA, 23 nt, Human
ccuccagcugggggcagcagggc

SEQ ID NO: 264980 - RNA, 21 nt, Human
ccugcgaucccagcuacucgg

SEQ ID NO: 264981 - RNA, 23 nt, Human
ccuggccaauguggugaaacccc

SEQ ID NO: 264982 - RNA, 24 nt, Human
ccuggccaauguggugaaacccca

SEQ ID NO: 264983 - RNA, 22 nt, Human
cgagaucaugccauuaaccucc

SEQ ID NO: 264984 - RNA, 19 nt, Human
cgagggcccaagcguggcu

SEQ ID NO: 264985 - RNA, 23 nt, Human
cgccugcgaucccagcuacucgg

SEQ ID NO: 264986 - RNA, 24 nt, Human
cgggaggcagagguugcagugagc

SEQ ID NO: 264987 - RNA, 18 nt, Human
cuacuaaaaauacagaaa

SEQ ID NO: 264988 - RNA, 18 nt, Human
cucaaaaaaaaaaaaaaa

SEQ ID NO: 264989 - RNA, 24 nt, Human
cuccacacacgcgcacaacggcca

SEQ ID NO: 264990 - RNA, 27 nt, Human
cuccgucucaaaaaaaaaaaaaaaaau

SEQ ID NO: 264991 - RNA, 23 nt, Human
cugagaagccaaaggugccagaa

SEQ ID NO: 264992 - RNA, 21 nt, Human
cugcggguuggugacuuuccc

SEQ ID NO: 264993 - RNA, 22 nt, Human
cuggagcagacuaguuccccuc

SEQ ID NO: 264994 - RNA, 22 nt, Human
cuggagcccccaacaacaucca

SEQ ID NO: 264995 - RNA, 21 nt, Human
cuuuggagauagugagccagg

SEQ ID NO: 264996 - RNA, 23 nt, Human
gagaaucgcuugaacccgggagg

SEQ ID NO: 264997 - RNA, 18 nt, Human
gagacaaagucccuugug

SEQ ID NO: 264998 - RNA, 25 nt, Human
gaggcaggcaccuggauuccccaag

SEQ ID NO: 264999 - RNA, 23 nt, Human
gaucaccuaggucaggaggucaa

SEQ ID NO: 265000 - RNA, 24 nt, Human
gaugagaggcaggugcgaaagaga

SEQ ID NO: 265001 - RNA, 24 nt, Human
gccaauguggugaaaccccaucuc

SEQ ID NO: 265002 - RNA, 22 nt, Human
gccagggcuugggaacuuuccc

SEQ ID NO: 265003 - RNA, 22 nt, Human
gccauuaaccuccagccugggc

SEQ ID NO: 265004 - RNA, 19 nt, Human
gccuaaaguucauguagag

SEQ ID NO: 265005 - RNA, 21 nt, Human
gcugcaaucgauucugcaauc

SEQ ID NO: 265006 - RNA, 19 nt, Human
gcuggugcgagggcccaag

SEQ ID NO: 265007 - RNA, 18 nt, Human
gcuguagaacccauugca

SEQ ID NO: 265008 - RNA, 19 nt, Human
ggaagagagagagcugggu

SEQ ID NO: 265009 - RNA, 21 nt, Human
gggaagagagagagcuggguu

SEQ ID NO: 265010 - RNA, 20 nt, Human
gggcgacaagaguugagacu

SEQ ID NO: 265011 - RNA, 22 nt, Human
ggucaggaggucaagaccagcc

SEQ ID NO: 265012 - RNA, 19 nt, Human
ggugacuuucccagacugg

SEQ ID NO: 265013 - RNA, 20 nt, Human
gugccagaaaacacaaagca

SEQ ID NO: 265014 - RNA, 22 nt, Human
guggagcacuggaugaguccca

SEQ ID NO: 265015 - RNA, 24 nt, Human
uaaaacacaccaggaggcaagucc

SEQ ID NO: 265016 - RNA, 20 nt, Human
uacaaguuacuaaaggggag

SEQ ID NO: 265017 - RNA, 20 nt, Human
uacauacauauauauauaca

SEQ ID NO: 265018 - RNA, 20 nt, Human
uacauacauauauauauaca

SEQ ID NO: 265019 - RNA, 20 nt, Human
uacauacauauauauauaca

SEQ ID NO: 265020 - RNA, 20 nt, Human
uacauacauauauauauaca

SEQ ID NO: 265021 - RNA, 19 nt, Human
uacauauauacauauauac

SEQ ID NO: 265022 - RNA, 19 nt, Human
uacauauauacauauauac

SEQ ID NO: 265023 - RNA, 19 nt, Human
uacauauauacauauauac

SEQ ID NO: 265024 - RNA, 28 nt, Human
uacauauauacauauauacauacauaua

SEQ ID NO: 265025 - RNA, 21 nt, Human
uacauauauauauacauauau

SEQ ID NO: 265026 - RNA, 24 nt, Human
uacauauauauauacauauauaca

SEQ ID NO: 265027 - RNA, 24 nt, Human
uacauauauauauacauauauaca

SEQ ID NO: 265028 - RNA, 24 nt, Human
uacauauauauauacauauauaca

SEQ ID NO: 265029 - RNA, 18 nt, Human
uauacauacauauauaua

SEQ ID NO: 265030 - RNA, 18 nt, Human
uauacauacauauauaua

SEQ ID NO: 265031 - RNA, 18 nt, Human
uauacauacauauauaua

SEQ ID NO: 265032 - RNA, 22 nt, Human
uauacauacauauauauauaca

SEQ ID NO: 265033 - RNA, 22 nt, Human
uauacauacauauauauauaca

SEQ ID NO: 265034 - RNA, 22 nt, Human
uauacauacauauauauauaca

SEQ ID NO: 265035 - RNA, 22 nt, Human
uauacauacauauauauauaca

SEQ ID NO: 265036 - RNA, 22 nt, Human
uauacauacauauauauauaca

SEQ ID NO: 265037 - RNA, 23 nt, Human
uauacauacauauauauauacau

SEQ ID NO: 265038 - RNA, 23 nt, Human
uauacauacauauauauauacau

SEQ ID NO: 265039 - RNA, 18 nt, Human
uauauacauacauauaua

SEQ ID NO: 265040 - RNA, 18 nt, Human
uauauacauacauauaua

SEQ ID NO: 265041 - RNA, 18 nt, Human
uauauacauacauauaua

SEQ ID NO: 265042 - RNA, 18 nt, Human
uauauacauacauauaua

SEQ ID NO: 265043 - RNA, 19 nt, Human
uauauacauacauauauau

SEQ ID NO: 265044 - RNA, 19 nt, Human
uauauacauacauauauau

SEQ ID NO: 265045 - RNA, 19 nt, Human
uauauacauacauauauau

SEQ ID NO: 265046 - RNA, 20 nt, Human
uauauacauacauauauaua

SEQ ID NO: 265047 - RNA, 24 nt, Human
uauauacauacauauauauauaca

SEQ ID NO: 265048 - RNA, 24 nt, Human
uauauacauacauauauauauaca

SEQ ID NO: 265049 - RNA, 24 nt, Human
uauauacauacauauauauauaca

SEQ ID NO: 265050 - RNA, 25 nt, Human
uauauacauacauauauauauacau

SEQ ID NO: 265051 - RNA, 25 nt, Human
uauauacauacauauauauauacau

SEQ ID NO: 265052 - RNA, 24 nt, Human
uauauacauauauacauacauaua

SEQ ID NO: 265053 - RNA, 24 nt, Human
uauauacauauauacauacauaua

SEQ ID NO: 265054 - RNA, 29 nt, Human
uauauacauauauacauacauauauauag

SEQ ID NO: 265055 - RNA, 29 nt, Human
uauauacauauauacauacauauauauag

SEQ ID NO: 265056 - RNA, 24 nt, Human
uauauacauauauacauauauaca

SEQ ID NO: 265057 - RNA, 24 nt, Human
uauauacauauauacauauauaca

SEQ ID NO: 265058 - RNA, 24 nt, Human
uauauacauauauacauauauaca

SEQ ID NO: 265059 - RNA, 18 nt, Human
uauauauacauauauaca

SEQ ID NO: 265060 - RNA, 18 nt, Human
uauauauacauauauaca

SEQ ID NO: 265061 - RNA, 18 nt, Human
uauauauacauauauaca

SEQ ID NO: 265062 - RNA, 20 nt, Human
uauauauauacauauauaca

SEQ ID NO: 265063 - RNA, 20 nt, Human
uauauauauacauauauaca

SEQ ID NO: 265064 - RNA, 20 nt, Human
uauauauauacauauauaca

SEQ ID NO: 265065 - RNA, 22 nt, Human
ucaaaaagaaaacuugugucuu

SEQ ID NO: 265066 - RNA, 24 nt, Human
ucaaggauugagaugagaggcagg

SEQ ID NO: 265067 - RNA, 24 nt, Human
ucaggcaggagaaucgcuugaacc

SEQ ID NO: 265068 - RNA, 24 nt, Human
ucagggaagagagagagcuggguu

SEQ ID NO: 265069 - RNA, 23 nt, Human
uccacacacgcgcacaacggcca

SEQ ID NO: 265070 - RNA, 24 nt, Human
uccccaggccccaggcuaagaccc

SEQ ID NO: 265071 - RNA, 26 nt, Human
uccccaggccccaggcuaagacccau

SEQ ID NO: 265072 - RNA, 23 nt, Human
uccgucucaaaaaaaaaaaaaaa

SEQ ID NO: 265073 - RNA, 25 nt, Human
uccgucucaaaaaaaaaaaaaaaaa

SEQ ID NO: 265074 - RNA, 18 nt, Human
ucgcuugaacccgggagg

SEQ ID NO: 265075 - RNA, 22 nt, Human
ucuccagaaaacuucagagagg

SEQ ID NO: 265076 - RNA, 19 nt, Human
ugaaaccccaucucuacua

SEQ ID NO: 265077 - RNA, 20 nt, Human
ugaagacagaaaguucccuc

SEQ ID NO: 265078 - RNA, 18 nt, Human
ugagagugggaggaaggg

SEQ ID NO: 265079 - RNA, 18 nt, Human
ugagccgagaucaugcca

SEQ ID NO: 265080 - RNA, 23 nt, Human
ugaguucaugagccagggcuugg

SEQ ID NO: 265081 - RNA, 21 nt, Human
ugcaagccuuuauauuguuug

SEQ ID NO: 265082 - RNA, 18 nt, Human
ugcagagccagcaagcuc

SEQ ID NO: 265083 - RNA, 20 nt, Human
ugcagagccagcaagcuccu

SEQ ID NO: 265084 - RNA, 21 nt, Human
ugcagaguccagcuggggcaa

SEQ ID NO: 265085 - RNA, 18 nt, Human
ugcauaacagaggcagaa

SEQ ID NO: 265086 - RNA, 19 nt, Human
ugcauaccaucugucagcc

SEQ ID NO: 265087 - RNA, 19 nt, Human
ugccagaaaacacaaagca

SEQ ID NO: 265088 - RNA, 18 nt, Human
uggaucaccuaggucagg

SEQ ID NO: 265089 - RNA, 23 nt, Human
uggaucaccuaggucaggagguc

SEQ ID NO: 265090 - RNA, 24 nt, Human
uggccaauguggugaaaccccauc

SEQ ID NO: 265091 - RNA, 19 nt, Human
uggcuaagcagagcuccug

SEQ ID NO: 265092 - RNA, 22 nt, Human
uggcuaagcagagcuccuggag

SEQ ID NO: 265093 - RNA, 18 nt, Human
uggcugcagagccagcaa

SEQ ID NO: 265094 - RNA, 19 nt, Human
uggcugcagagccagcaag

SEQ ID NO: 265095 - RNA, 21 nt, Human
uggcuugcuugcucacgcagc

SEQ ID NO: 265096 - RNA, 19 nt, Human
ugggaggaagggggucaga

SEQ ID NO: 265097 - RNA, 21 nt, Human
ugggaggaagggggucagcca

SEQ ID NO: 265098 - RNA, 25 nt, Human
ugggaggaagggggucagccaacau

SEQ ID NO: 265099 - RNA, 19 nt, Human
uggugaaaccccaucucua

SEQ ID NO: 265100 - RNA, 18 nt, Human
uuagcuaggcgugguggc

SEQ ID NO: 265101 - RNA, 24 nt, Human
uuagcuaggcgugguggcaggcgc

SEQ ID NO: 265102 - RNA, 20 nt, Human
uuccuccaggcuggagcccc

SEQ ID NO: 265103 - RNA, 20 nt, Human
uugcagugagccgagaucau

SEQ ID NO: 265104 - RNA, 21 nt, Human
uugcagugagccgagaucaug

SEQ ID NO: 265105 - RNA, 23 nt, Human
uugcagugagccgagaucaugcc

SEQ ID NO: 265106 - RNA, 19 nt, Human
uugcaucaccccagagaca

SEQ ID NO: 265107 - RNA, 23 nt, Human
uuggccucaagggccccucagaa

SEQ ID NO: 265108 - RNA, 21 nt, Human
aaacuuggaacacacaaggug

SEQ ID NO: 265109 - RNA, 22 nt, Human
aaaguaaaccaacauucuuaau

SEQ ID NO: 265110 - RNA, 20 nt, Human
aaaucaaaaugugcaaagug

SEQ ID NO: 265111 - RNA, 18 nt, Human
aaccgacagacacaccgg

SEQ ID NO: 265112 - RNA, 22 nt, Human
acacuggugguccuacugccca

SEQ ID NO: 265113 - RNA, 24 nt, Human
acaguacauaacagagauuaacaa

SEQ ID NO: 265114 - RNA, 18 nt, Human
acccagagccgaacucga

SEQ ID NO: 265115 - RNA, 21 nt, Human
agagccgaacucgacagggga

SEQ ID NO: 265116 - RNA, 19 nt, Human
agcagaaccccacacuggu

SEQ ID NO: 265117 - RNA, 23 nt, Human
aggaagaaacaggcuaggaaaaa

SEQ ID NO: 265118 - RNA, 21 nt, Human
aggcuaggaaaaaggcauaua

SEQ ID NO: 265119 - RNA, 21 nt, Human
agguggaggaggcugcagggc

SEQ ID NO: 265120 - RNA, 24 nt, Human
auacaaaacaugcuccucaaacau

SEQ ID NO: 265121 - RNA, 20 nt, Human
caaagugcuauaagaugcag

SEQ ID NO: 265122 - RNA, 19 nt, Human
caaaguggcagugacuguc

SEQ ID NO: 265123 - RNA, 23 nt, Human
caaggucccagcagaaccccaca

SEQ ID NO: 265124 - RNA, 22 nt, Human
cagaaccccacacugguggucc

SEQ ID NO: 265125 - RNA, 18 nt, Human
caggaagaaacaggcuag

SEQ ID NO: 265126 - RNA, 18 nt, Human
caggcucuccaagguccc

SEQ ID NO: 265127 - RNA, 18 nt, Human
ccagaggcucccaaccgu

SEQ ID NO: 265128 - RNA, 21 nt, Human
ccgacagacacaccggagccu

SEQ ID NO: 265129 - RNA, 26 nt, Human
ccggccggcgacugagggcuucuuuc

SEQ ID NO: 265130 - RNA, 19 nt, Human
cgaacucgacaggggaccg

SEQ ID NO: 265131 - RNA, 18 nt, Human
cgcggaaggcgggggccg

SEQ ID NO: 265132 - RNA, 24 nt, Human
cggcgccgaccuccaacacugcaa

SEQ ID NO: 265133 - RNA, 18 nt, Human
cugcaaccgacagacaca

SEQ ID NO: 265134 - RNA, 22 nt, Human
cugcuggaacuuaagcaccauu

SEQ ID NO: 265135 - RNA, 22 nt, Human
gaagaaacaggcuaggaaaaag

SEQ ID NO: 265136 - RNA, 21 nt, Human
gaggaggcugcagggccaccc

SEQ ID NO: 265137 - RNA, 22 nt, Human
gccccagaggcucccaaccguc

SEQ ID NO: 265138 - RNA, 18 nt, Human
gccccguucguuuuaaua

SEQ ID NO: 265139 - RNA, 24 nt, Human
ggaaaaaggcauauauauauagua

SEQ ID NO: 265140 - RNA, 23 nt, Human
ggugagguggaggaggcugcagg

SEQ ID NO: 265141 - RNA, 18 nt, Human
uacaguacuuagguauga

SEQ ID NO: 265142 - RNA, 19 nt, Human
uacccaggauguauacaaa

SEQ ID NO: 265143 - RNA, 24 nt, Human
uaguaaauuucuuuacaaaaguuu

SEQ ID NO: 265144 - RNA, 22 nt, Human
uauacaaaacaugcuccucaaa

SEQ ID NO: 265145 - RNA, 19 nt, Human
ucaaaacuuucacaacuca

SEQ ID NO: 265146 - RNA, 21 nt, Human
ucaaagugcuauaagaugcag

SEQ ID NO: 265147 - RNA, 27 nt, Human
ucaaugguauuuacagaaauguucccc

SEQ ID NO: 265148 - RNA, 22 nt, Human
uccaacacugcaaccgacagac

SEQ ID NO: 265149 - RNA, 21 nt, Human
uccaaggucccagcagaaccc

SEQ ID NO: 265150 - RNA, 23 nt, Human
ucuacucaaaacuuucacaacuc

SEQ ID NO: 265151 - RNA, 21 nt, Human
ucuaugcaccaaacaugaaca

SEQ ID NO: 265152 - RNA, 23 nt, Human
ugcaaccgacagacacaccggag

SEQ ID NO: 265153 - RNA, 21 nt, Human
ugcccacccagagccgaacuc

SEQ ID NO: 265154 - RNA, 18 nt, Human
uggcaaaccccuuaugug

SEQ ID NO: 265155 - RNA, 19 nt, Human
uggccgcaaaagccaccuc

SEQ ID NO: 265156 - RNA, 22 nt, Human
ugggaugcaggcucuccaaggu

SEQ ID NO: 265157 - RNA, 22 nt, Human
ugguauuuacagaaauguuccc

SEQ ID NO: 265158 - RNA, 20 nt, Human
ugguccuacugcccacccag

SEQ ID NO: 265159 - RNA, 20 nt, Human
uggugguccuacugcccacc

SEQ ID NO: 265160 - RNA, 23 nt, Human
uuaauaccgggggugcuuccuuc

SEQ ID NO: 265161 - RNA, 20 nt, Human
uuauguaucagcgucauacu

SEQ ID NO: 265162 - RNA, 20 nt, Human
uucaaaaagugauaaaguaa

SEQ ID NO: 265163 - RNA, 20 nt, Human
uuuacagaaauguuccccag

SEQ ID NO: 265164 - RNA, 21 nt, Human
uuuacagaaauguuccccaga

SEQ ID NO: 265165 - RNA, 24 nt, Human
uuuuuuuuuuuuuuuuuuaauuuu

SEQ ID NO: 265166 - RNA, 23 nt, Human
aaacugcuuccccaccugcccug

SEQ ID NO: 265167 - RNA, 19 nt, Human
aaagauaugcauuuucuau

SEQ ID NO: 265168 - RNA, 20 nt, Human
aaaugccucaacaagaucau

SEQ ID NO: 265169 - RNA, 19 nt, Human
aacugcuuccccaccugcc

SEQ ID NO: 265170 - RNA, 22 nt, Human
aacugcuuccccaccugcccug

SEQ ID NO: 265171 - RNA, 20 nt, Human
aagagaaaaggaauagauga

SEQ ID NO: 265172 - RNA, 23 nt, Human
aaugaguagggacacaagagaaa

SEQ ID NO: 265173 - RNA, 21 nt, Human
acaaaacauguagaagaugcc

SEQ ID NO: 265174 - RNA, 20 nt, Human
acagccagcucucccgcagc

SEQ ID NO: 265175 - RNA, 20 nt, Human
acaugucuguacauauaugu

SEQ ID NO: 265176 - RNA, 20 nt, Human
accauggcaccuucucccca

SEQ ID NO: 265177 - RNA, 19 nt, Human
acccagagcuaugcuucac

SEQ ID NO: 265178 - RNA, 20 nt, Human
accuagcuguuccugggagc

SEQ ID NO: 265179 - RNA, 20 nt, Human
accuugcuccagccuggcug

SEQ ID NO: 265180 - RNA, 18 nt, Human
agacaccuaagaccaugg

SEQ ID NO: 265181 - RNA, 25 nt, Human
agacagauacacacacacccagggc

SEQ ID NO: 265182 - RNA, 26 nt, Human
agacagauacacacacacccagggcc

SEQ ID NO: 265183 - RNA, 18 nt, Human
agagcugagcuggcucug

SEQ ID NO: 265184 - RNA, 18 nt, Human
agaugugugaauggcuca

SEQ ID NO: 265185 - RNA, 18 nt, Human
agcaacagccagcucucc

SEQ ID NO: 265186 - RNA, 20 nt, Human
agcaacagccagcucucccg

SEQ ID NO: 265187 - RNA, 19 nt, Human
aggaggcagggcagaagua

SEQ ID NO: 265188 - RNA, 27 nt, Human
aggcagacagauacacacacacccagg

SEQ ID NO: 265189 - RNA, 23 nt, Human
aggcauccugacagguggaaaug

SEQ ID NO: 265190 - RNA, 21 nt, Human
auaguguccuggcugauaauc

SEQ ID NO: 265191 - RNA, 20 nt, Human
auauaugugugugucuguau

SEQ ID NO: 265192 - RNA, 23 nt, Human
augaaaagcagcccaagcugcuc

SEQ ID NO: 265193 - RNA, 18 nt, Human
augugugugucuguaugu

SEQ ID NO: 265194 - RNA, 21 nt, Human
caagagaaaaggaauagauga

SEQ ID NO: 265195 - RNA, 18 nt, Human
caagauggggucuccuug

SEQ ID NO: 265196 - RNA, 19 nt, Human
cacugguuccaugcaggac

SEQ ID NO: 265197 - RNA, 24 nt, Human
cagacaccuaagaccauggcaccu

SEQ ID NO: 265198 - RNA, 22 nt, Human
cagcaguggccagcauguaguc

SEQ ID NO: 265199 - RNA, 21 nt, Human
cagccaagccuggucuccccc

SEQ ID NO: 265200 - RNA, 19 nt, Human
cagccuggcugaaagugga

SEQ ID NO: 265201 - RNA, 19 nt, Human
caggacaugaaaugugaug

SEQ ID NO: 265202 - RNA, 20 nt, Human
cagggacaugguuaggcucc

SEQ ID NO: 265203 - RNA, 20 nt, Human
caugcaggacaugaaaugug

SEQ ID NO: 265204 - RNA, 20 nt, Human
cauguaguccagcaacagcc

SEQ ID NO: 265205 - RNA, 23 nt, Human
ccacaagcuuuggggcaggaggc

SEQ ID NO: 265206 - RNA, 18 nt, Human
ccagcaacagccagcucu

SEQ ID NO: 265207 - RNA, 21 nt, Human
ccagcagugucguggucacag

SEQ ID NO: 265208 - RNA, 18 nt, Human
cccauuaggaaauaaggc

SEQ ID NO: 265209 - RNA, 26 nt, Human
ccuaagaccauggcaccuucucccca

SEQ ID NO: 265210 - RNA, 21 nt, Human
ccuccuacaacgaaaggagga

SEQ ID NO: 265211 - RNA, 24 nt, Human
ccuugggcugggccaaacugcuuc

SEQ ID NO: 265212 - RNA, 22 nt, Human
cgcagccaagccuggucucccc

SEQ ID NO: 265213 - RNA, 22 nt, Human
cucagagcugagcuggcucugc

SEQ ID NO: 265214 - RNA, 21 nt, Human
cucauccccagaacucauacu

SEQ ID NO: 265215 - RNA, 18 nt, Human
cuccagccuggcugaaag

SEQ ID NO: 265216 - RNA, 20 nt, Human
cuccagccuggcugaaagug

SEQ ID NO: 265217 - RNA, 24 nt, Human
cuccagccuggcugaaaguggagc

SEQ ID NO: 265218 - RNA, 19 nt, Human
cugcagguggcccagggag

SEQ ID NO: 265219 - RNA, 18 nt, Human
cuguccuggggcacagac

SEQ ID NO: 265220 - RNA, 18 nt, Human
cuuagucucagcuggucc

SEQ ID NO: 265221 - RNA, 21 nt, Human
cuucuuagucucagcuggucc

SEQ ID NO: 265222 - RNA, 22 nt, Human
gaaggagagagggagagaacag

SEQ ID NO: 265223 - RNA, 19 nt, Human
gaccauggcaccuucuccc

SEQ ID NO: 265224 - RNA, 18 nt, Human
gagagcaugaccacaggc

SEQ ID NO: 265225 - RNA, 19 nt, Human
gagagggagagaacagcug

SEQ ID NO: 265226 - RNA, 18 nt, Human
gagcugagcuggcucugc

SEQ ID NO: 265227 - RNA, 19 nt, Human
gccucagcgcggucggguc

SEQ ID NO: 265228 - RNA, 20 nt, Human
gcuacucucuguucucccca

SEQ ID NO: 265229 - RNA, 18 nt, Human
ggaaggagagagggagag

SEQ ID NO: 265230 - RNA, 21 nt, Human
ggaaggaggaaguggaauggg

SEQ ID NO: 265231 - RNA, 18 nt, Human
gggaaagcucucugcagg

SEQ ID NO: 265232 - RNA, 20 nt, Human
gggcacagacaccuaagacc

SEQ ID NO: 265233 - RNA, 22 nt, Human
guaaggcaaucaagguacaaag

SEQ ID NO: 265234 - RNA, 23 nt, Human
guacaugucuguacauauaugug

SEQ ID NO: 265235 - RNA, 19 nt, Human
guagagcacagauuccucc

SEQ ID NO: 265236 - RNA, 18 nt, Human
uaaaguauaaauugcucu

SEQ ID NO: 265237 - RNA, 23 nt, Human
uacagugacucauccccagaacu

SEQ ID NO: 265238 - RNA, 24 nt, Human
uacauauaugugugugucuguaug

SEQ ID NO: 265239 - RNA, 20 nt, Human
uaugugugugucuguaugug

SEQ ID NO: 265240 - RNA, 21 nt, Human
ucagagcugagcuggcucugc

SEQ ID NO: 265241 - RNA, 18 nt, Human
ucaguaggcaucacugug

SEQ ID NO: 265242 - RNA, 18 nt, Human
ucauuguugugugaguuu

SEQ ID NO: 265243 - RNA, 18 nt, Human
uccagaguuugguuucaa

SEQ ID NO: 265244 - RNA, 20 nt, Human
uccagcugcugcagacgugu

SEQ ID NO: 265245 - RNA, 18 nt, Human
ucccaccuagcuguuccu

SEQ ID NO: 265246 - RNA, 21 nt, Human
uccccaccugcccugugggga

SEQ ID NO: 265247 - RNA, 21 nt, Human
ucccccaggagacccagagcu

SEQ ID NO: 265248 - RNA, 23 nt, Human
ucccucagugaugggacuuuccu

SEQ ID NO: 265249 - RNA, 19 nt, Human
uccuggcugauaauccagc

SEQ ID NO: 265250 - RNA, 18 nt, Human
ucucaugccagguggagc

SEQ ID NO: 265251 - RNA, 24 nt, Human
ucucccgcagccaagccuggucuc

SEQ ID NO: 265252 - RNA, 21 nt, Human
ucuccuugggcugggccaaac

SEQ ID NO: 265253 - RNA, 18 nt, Human
ucugcagguggcccaggg

SEQ ID NO: 265254 - RNA, 22 nt, Human
ucugcaguucauuguuguguga

SEQ ID NO: 265255 - RNA, 23 nt, Human
ucugcaguucauuguugugugag

SEQ ID NO: 265256 - RNA, 20 nt, Human
ucuguacauauaugugugug

SEQ ID NO: 265257 - RNA, 18 nt, Human
ugaaagaugcagaugaga

SEQ ID NO: 265258 - RNA, 20 nt, Human
ugaccacaggcauccugaca

SEQ ID NO: 265259 - RNA, 24 nt, Human
ugaggaaacugagggugaagaugu

SEQ ID NO: 265260 - RNA, 18 nt, Human
ugccucaacaagaucaug

SEQ ID NO: 265261 - RNA, 19 nt, Human
ugcucaggcgagucucuug

SEQ ID NO: 265262 - RNA, 24 nt, Human
ugcucaggcgagucucuuggggac

SEQ ID NO: 265263 - RNA, 21 nt, Human
ugcuccagccuggcugaaagu

SEQ ID NO: 265264 - RNA, 23 nt, Human
uggaagaagcugccccagcagug

SEQ ID NO: 265265 - RNA, 20 nt, Human
uggaaugggcggugugcaga

SEQ ID NO: 265266 - RNA, 21 nt, Human
uggaaugggcggugugcagag

SEQ ID NO: 265267 - RNA, 19 nt, Human
uggcucagagcugagcugg

SEQ ID NO: 265268 - RNA, 19 nt, Human
ugggaaagcucucugcagg

SEQ ID NO: 265269 - RNA, 21 nt, Human
uggguccuuuccagaguuugg

SEQ ID NO: 265270 - RNA, 22 nt, Human
uguaugcuggugccugugugug

SEQ ID NO: 265271 - RNA, 18 nt, Human
ugucguggucacagcagu

SEQ ID NO: 265272 - RNA, 20 nt, Human
ugucguggucacagcagugg

SEQ ID NO: 265273 - RNA, 22 nt, Human
ugugcagaggcacugaagcauc

SEQ ID NO: 265274 - RNA, 22 nt, Human
uguggggaaggaggaaguggaa

SEQ ID NO: 265275 - RNA, 23 nt, Human
uguucuccccaucccacuccuca

SEQ ID NO: 265276 - RNA, 21 nt, Human
uuuuuuuuuuuuuuuccaagg

SEQ ID NO: 265277 - RNA, 18 nt, Human
aaaggagacggcgacaaa

SEQ ID NO: 265278 - RNA, 18 nt, Human
aaaggcaacgagcagaag

SEQ ID NO: 265279 - RNA, 20 nt, Human
aaaugcccaaaccccugagc

SEQ ID NO: 265280 - RNA, 19 nt, Human
aaccacuuggcacacagga

SEQ ID NO: 265281 - RNA, 23 nt, Human
aagaaugggagaaaggagaagga

SEQ ID NO: 265282 - RNA, 20 nt, Human
aagaggagaggguaggagag

SEQ ID NO: 265283 - RNA, 28 nt, Human
aagcacagcagggaggagaccgguaccc

SEQ ID NO: 265284 - RNA, 21 nt, Human
aagcguccagaaaucacacag

SEQ ID NO: 265285 - RNA, 24 nt, Human
aaggaagaggagaggguaggagag

SEQ ID NO: 265286 - RNA, 20 nt, Human
aaugggagaaaggagaagga

SEQ ID NO: 265287 - RNA, 25 nt, Human
accuggacccgagucacccagcagc

SEQ ID NO: 265288 - RNA, 20 nt, Human
acucugcucagaucccacca

SEQ ID NO: 265289 - RNA, 27 nt, Human
agaaaaccagggacccuggagccuggg

SEQ ID NO: 265290 - RNA, 18 nt, Human
agaaggaagaggagaggg

SEQ ID NO: 265291 - RNA, 24 nt, Human
agacggcgacaaaaaugcccaaac

SEQ ID NO: 265292 - RNA, 21 nt, Human
agaggaaacuuggaacuuagg

SEQ ID NO: 265293 - RNA, 23 nt, Human
agaggguaggagaguugggagag

SEQ ID NO: 265294 - RNA, 24 nt, Human
aggcagggaagaaugggagaaagg

SEQ ID NO: 265295 - RNA, 19 nt, Human
aggccucaguuuccucauc

SEQ ID NO: 265296 - RNA, 25 nt, Human
agggaaggagccagacgcuguccua

SEQ ID NO: 265297 - RNA, 22 nt, Human
agggaggagacagagcccaaag

SEQ ID NO: 265298 - RNA, 23 nt, Human
aggguaggagaguugggagagga

SEQ ID NO: 265299 - RNA, 26 nt, Human
agguggggaaaaagucagcuucaggu

SEQ ID NO: 265300 - RNA, 21 nt, Human
aguuguuagagguguuaagcg

SEQ ID NO: 265301 - RNA, 21 nt, Human
augcauuucagaggccccacc

SEQ ID NO: 265302 - RNA, 20 nt, Human
caaaggcaacgagcagaagc

SEQ ID NO: 265303 - RNA, 22 nt, Human
caagcauacuuuccugcuuugu

SEQ ID NO: 265304 - RNA, 19 nt, Human
cacagaaaaccagggaccc

SEQ ID NO: 265305 - RNA, 20 nt, Human
cacagaaaaccagggacccu

SEQ ID NO: 265306 - RNA, 18 nt, Human
cacagugucuggaugcau

SEQ ID NO: 265307 - RNA, 20 nt, Human
cagagcucagcaggugguga

SEQ ID NO: 265308 - RNA, 22 nt, Human
cagcagccaaagcaaagagaga

SEQ ID NO: 265309 - RNA, 21 nt, Human
cagcagggaggagacagagcc

SEQ ID NO: 265310 - RNA, 24 nt, Human
cagcaugaugucacagaaaaccag

SEQ ID NO: 265311 - RNA, 22 nt, Human
caguacaggcgccucacucucc

SEQ ID NO: 265312 - RNA, 20 nt, Human
caugaugucacagaaaacca

SEQ ID NO: 265313 - RNA, 21 nt, Human
cauugcacaaugucuccaggg

SEQ ID NO: 265314 - RNA, 24 nt, Human
cauugcacaaugucuccaggggcu

SEQ ID NO: 265315 - RNA, 21 nt, Human
ccacucacuuggccucuccca

SEQ ID NO: 265316 - RNA, 21 nt, Human
ccagcugagaaaaugaccaga

SEQ ID NO: 265317 - RNA, 23 nt, Human
ccccacucacuuggccucuccca

SEQ ID NO: 265318 - RNA, 20 nt, Human
cccgcccucuguccaaggug

SEQ ID NO: 265319 - RNA, 22 nt, Human
cggcgacaaaaaugcccaaacc

SEQ ID NO: 265320 - RNA, 23 nt, Human
cuaggccucaguuuccucaucug

SEQ ID NO: 265321 - RNA, 24 nt, Human
cucagcagguggugaggcaccugg

SEQ ID NO: 265322 - RNA, 21 nt, Human
cuccaggggcuaccaccaaug

SEQ ID NO: 265323 - RNA, 25 nt, Human
cuccaggggcuaccaccaaugcccc

SEQ ID NO: 265324 - RNA, 23 nt, Human
cucuucacugagcccaaaggccu

SEQ ID NO: 265325 - RNA, 21 nt, Human
cuuacauccggccugcuccuc

SEQ ID NO: 265326 - RNA, 21 nt, Human
gaagaggagaggguaggagag

SEQ ID NO: 265327 - RNA, 22 nt, Human
gagaggguaggagaguugggag

SEQ ID NO: 265328 - RNA, 20 nt, Human
gagcccaaaggagacggcga

SEQ ID NO: 265329 - RNA, 26 nt, Human
gagggagacccuggacgccuggcuuu

SEQ ID NO: 265330 - RNA, 23 nt, Human
gccaccucacuccagauaaacuc

SEQ ID NO: 265331 - RNA, 20 nt, Human
gccuuagauuucucccugga

SEQ ID NO: 265332 - RNA, 20 nt, Human
ggacccgagucacccagcag

SEQ ID NO: 265333 - RNA, 19 nt, Human
ggagaaggaagaggagagg

SEQ ID NO: 265334 - RNA, 22 nt, Human
ggaggagacagagcccaaagga

SEQ ID NO: 265335 - RNA, 20 nt, Human
ggcuaccaccaaugccccag

SEQ ID NO: 265336 - RNA, 21 nt, Human
gguaggagaguugggagagga

SEQ ID NO: 265337 - RNA, 19 nt, Human
uaagaaccuuacauucuga

SEQ ID NO: 265338 - RNA, 22 nt, Human
ucagaggccccaccagucuagg

SEQ ID NO: 265339 - RNA, 22 nt, Human
uccaagguggggaaaaagucag

SEQ ID NO: 265340 - RNA, 20 nt, Human
ucccaagcauacuuuccugc

SEQ ID NO: 265341 - RNA, 24 nt, Human
ucccagcaccuggcucaugccugc

SEQ ID NO: 265342 - RNA, 24 nt, Human
uccccagcagccaaagcaaagaga

SEQ ID NO: 265343 - RNA, 22 nt, Human
ucccuggaaaauggggagaaaa

SEQ ID NO: 265344 - RNA, 24 nt, Human
ucugcucagaucccaccaagaacc

SEQ ID NO: 265345 - RNA, 20 nt, Human
ugaaagcacuggguucagug

SEQ ID NO: 265346 - RNA, 26 nt, Human
ugaaagcacuggguucaguggggaug

SEQ ID NO: 265347 - RNA, 22 nt, Human
ugaacaggccaucccugaggcc

SEQ ID NO: 265348 - RNA, 24 nt, Human
ugacguggcuggauuuagggucug

SEQ ID NO: 265349 - RNA, 18 nt, Human
ugcguguccucccagccu

SEQ ID NO: 265350 - RNA, 19 nt, Human
uggcuuugggcugauuccc

SEQ ID NO: 265351 - RNA, 19 nt, Human
ugggagaaaggagaaggaa

SEQ ID NO: 265352 - RNA, 18 nt, Human
ugggagggccaugcaaca

SEQ ID NO: 265353 - RNA, 19 nt, Human
uggggauggcaucucccgc

SEQ ID NO: 265354 - RNA, 20 nt, Human
uguagggauguggguucgcg

SEQ ID NO: 265355 - RNA, 19 nt, Human
ugucuccaggggcuaccac

SEQ ID NO: 265356 - RNA, 24 nt, Human
uuaggcaacuuguugagcuucucu

SEQ ID NO: 265357 - RNA, 22 nt, Human
uucaggugagggagacccugga

SEQ ID NO: 265358 - RNA, 18 nt, Human
uuucagaggccccaccag

SEQ ID NO: 265359 - RNA, 24 nt, Human
aaagaaaaaaauaaagcucuaaac

SEQ ID NO: 265360 - RNA, 26 nt, Human
aaauauauacauuaggcaguauuaua

SEQ ID NO: 265361 - RNA, 23 nt, Human
aauacacuuucuuauaaaguggc

SEQ ID NO: 265362 - RNA, 28 nt, Human
agaggcaggcggugcaccucccaagggg

SEQ ID NO: 265363 - RNA, 19 nt, Human
aucaauggcccccuaucag

SEQ ID NO: 265364 - RNA, 22 nt, Human
caaagaauaauaaagaagaaga

SEQ ID NO: 265365 - RNA, 19 nt, Human
caccuggacggcagcgaga

SEQ ID NO: 265366 - RNA, 18 nt, Human
cuccuggaagaagucaua

SEQ ID NO: 265367 - RNA, 22 nt, Human
gagaaaagaaauaguuaaauau

SEQ ID NO: 265368 - RNA, 24 nt, Human
gagaaaagaaauaguuaaauauau

SEQ ID NO: 265369 - RNA, 19 nt, Human
gcaguauuauauuuuuauu

SEQ ID NO: 265370 - RNA, 23 nt, Human
guccuguguauuaggcccuccug

SEQ ID NO: 265371 - RNA, 25 nt, Human
guugucuugguuugggacuuuuuga

SEQ ID NO: 265372 - RNA, 22 nt, Human
uaagcaaagaauaauaaagaag

SEQ ID NO: 265373 - RNA, 21 nt, Human
uaauguuuuaaagaaaaaaau

SEQ ID NO: 265374 - RNA, 18 nt, Human
uacaagaaaagaucaaaa

SEQ ID NO: 265375 - RNA, 24 nt, Human
uaguuaaauauauuuaaaauucca

SEQ ID NO: 265376 - RNA, 18 nt, Human
uauauauauguauauaua

SEQ ID NO: 265377 - RNA, 23 nt, Human
uauuuauaauauauauauaugua

SEQ ID NO: 265378 - RNA, 21 nt, Human
uccaaaauuucuuauaucuug

SEQ ID NO: 265379 - RNA, 20 nt, Human
ucuaaacaccagagacauuu

SEQ ID NO: 265380 - RNA, 20 nt, Human
ugaagccuucuucguccugu

SEQ ID NO: 265381 - RNA, 23 nt, Human
ugagaggcaggcggugcaccugg

SEQ ID NO: 265382 - RNA, 18 nt, Human
ugucuugguuugggacuu

SEQ ID NO: 265383 - RNA, 19 nt, Human
uuugaagccuucuucgucc

SEQ ID NO: 265384 - RNA, 24 nt, Human
aaacaaaaacaaaaugaggcuaga

SEQ ID NO: 265385 - RNA, 29 nt, Human
aaacaaaaacaaaaugaggcuagaccuag

SEQ ID NO: 265386 - RNA, 23 nt, Human
aaacaaaaugaggcuagaccuaa

SEQ ID NO: 265387 - RNA, 23 nt, Human
aacaaaaacaaaaugaggcuaga

SEQ ID NO: 265388 - RNA, 22 nt, Human
aacaaaaugaggcuagaccuaa

SEQ ID NO: 265389 - RNA, 18 nt, Human
aauaaaagcccaaagccg

SEQ ID NO: 265390 - RNA, 20 nt, Human
acaaaaugaggcuagaccua

SEQ ID NO: 265391 - RNA, 22 nt, Human
auaaaaccaaccaaacaaaaac

SEQ ID NO: 265392 - RNA, 24 nt, Human
cagauuucgcaauuuucgcaacuu

SEQ ID NO: 265393 - RNA, 21 nt, Human
cagcaacuuuucggucugggu

SEQ ID NO: 265394 - RNA, 18 nt, Human
ccaaccaaacaaaaacaa

SEQ ID NO: 265395 - RNA, 21 nt, Human
uaccaggauccucgcacauuu

SEQ ID NO: 265396 - RNA, 22 nt, Human
uaccccuaacauuaaaugcaac

SEQ ID NO: 265397 - RNA, 19 nt, Human
uacguaaaaaaagaaagug

SEQ ID NO: 265398 - RNA, 26 nt, Human
uacguaaaaaaagaaagugcuaaacu

SEQ ID NO: 265399 - RNA, 18 nt, Human
uccaaaaaaauaaaagcc

SEQ ID NO: 265400 - RNA, 22 nt, Human
uccaaaaaaauaaaagcccaaa

SEQ ID NO: 265401 - RNA, 21 nt, Human
ucccuuucagcaacuuuucgg

SEQ ID NO: 265402 - RNA, 21 nt, Human
uccuuggccucugacucgauc

SEQ ID NO: 265403 - RNA, 21 nt, Human
uucuccuccuuggccucugac

SEQ ID NO: 265404 - RNA, 21 nt, Human
uugugaaugugucuccuuccc

SEQ ID NO: 265405 - RNA, 23 nt, Human
uuucccacuucagacaggaauug

SEQ ID NO: 265406 - RNA, 22 nt, Human
aaagucauaaguacaaaaugga

SEQ ID NO: 265407 - RNA, 19 nt, Human
caaaauggagugacaaaga

SEQ ID NO: 265408 - RNA, 21 nt, Human
gugacaaagauuuucacauuu

SEQ ID NO: 265409 - RNA, 28 nt, Human
uuugugcauuucuuuggucaccuuucag

SEQ ID NO: 265410 - RNA, 22 nt, Human
aacucuacguccuccagaccuu

SEQ ID NO: 265411 - RNA, 26 nt, Human
aagcacagucaggguguaaacagugc

SEQ ID NO: 265412 - RNA, 26 nt, Human
aagcacagucaggguguaaacagugc

SEQ ID NO: 265413 - RNA, 26 nt, Human
aagcacagucaggguguaaacagugc

SEQ ID NO: 265414 - RNA, 24 nt, Human
accuugaauacagggguaguaggg

SEQ ID NO: 265415 - RNA, 24 nt, Human
accuugaauacagggguaguaggg

SEQ ID NO: 265416 - RNA, 19 nt, Human
acuacguugcccaggcugg

SEQ ID NO: 265417 - RNA, 20 nt, Human
acuacguugcccaggcugga

SEQ ID NO: 265418 - RNA, 20 nt, Human
acuacguugcccaggcugga

SEQ ID NO: 265419 - RNA, 26 nt, Human
acuacguugcccaggcuggagggugg

SEQ ID NO: 265420 - RNA, 26 nt, Human
acuacguugcccaggcuggagggugg

SEQ ID NO: 265421 - RNA, 18 nt, Human
agacagggucucuguugc

SEQ ID NO: 265422 - RNA, 18 nt, Human
agacagggucucuguugc

SEQ ID NO: 265423 - RNA, 26 nt, Human
aggagagggggaaagaauucucaaag

SEQ ID NO: 265424 - RNA, 26 nt, Human
aggagagggggaaagaauucucaaag

SEQ ID NO: 265425 - RNA, 26 nt, Human
aggagagggggaaagaauucucaaag

SEQ ID NO: 265426 - RNA, 24 nt, Human
agggucucuguugcccaggcugga

SEQ ID NO: 265427 - RNA, 24 nt, Human
agggucucuguugcccaggcugga

SEQ ID NO: 265428 - RNA, 22 nt, Human
agguuuuacuacguugcccagg

SEQ ID NO: 265429 - RNA, 22 nt, Human
agguuuuacuacguugcccagg

SEQ ID NO: 265430 - RNA, 23 nt, Human
aguagcugggaccacaggugugu

SEQ ID NO: 265431 - RNA, 23 nt, Human
aguagcugggaccacaggugugu

SEQ ID NO: 265432 - RNA, 18 nt, Human
auagcucauugcagccuc

SEQ ID NO: 265433 - RNA, 18 nt, Human
auagcucauugcagccuc

SEQ ID NO: 265434 - RNA, 24 nt, Human
cacagguguguaccaccacgccca

SEQ ID NO: 265435 - RNA, 24 nt, Human
cacagguguguaccaccacgccca

SEQ ID NO: 265436 - RNA, 20 nt, Human
cagccucgaaguccugggcu

SEQ ID NO: 265437 - RNA, 19 nt, Human
cagggucucuguugcccag

SEQ ID NO: 265438 - RNA, 19 nt, Human
cagggucucuguugcccag

SEQ ID NO: 265439 - RNA, 24 nt, Human
cauuccugcuccccuccgugggag

SEQ ID NO: 265440 - RNA, 24 nt, Human
cauuccugcuccccuccgugggag

SEQ ID NO: 265441 - RNA, 24 nt, Human
cauuccugcuccccuccgugggag

SEQ ID NO: 265442 - RNA, 18 nt, Human
ccaggagagggggaaaga

SEQ ID NO: 265443 - RNA, 18 nt, Human
ccaggagagggggaaaga

SEQ ID NO: 265444 - RNA, 18 nt, Human
ccaggagagggggaaaga

SEQ ID NO: 265445 - RNA, 18 nt, Human
ccagggaccgguuaccgu

SEQ ID NO: 265446 - RNA, 18 nt, Human
ccagggaccgguuaccgu

SEQ ID NO: 265447 - RNA, 18 nt, Human
ccagggaccgguuaccgu

SEQ ID NO: 265448 - RNA, 22 nt, Human
ccagggaccgguuaccguggau

SEQ ID NO: 265449 - RNA, 22 nt, Human
ccagggaccgguuaccguggau

SEQ ID NO: 265450 - RNA, 22 nt, Human
ccagggaccgguuaccguggau

SEQ ID NO: 265451 - RNA, 20 nt, Human
cccauuucggugacuuucuc

SEQ ID NO: 265452 - RNA, 20 nt, Human
cccauuucggugacuuucuc

SEQ ID NO: 265453 - RNA, 20 nt, Human
cccauuucggugacuuucuc

SEQ ID NO: 265454 - RNA, 19 nt, Human
ccuggcucagccucccuag

SEQ ID NO: 265455 - RNA, 20 nt, Human
ccuggcucagccucccuagu

SEQ ID NO: 265456 - RNA, 19 nt, Human
cuacguugcccaggcugga

SEQ ID NO: 265457 - RNA, 24 nt, Human
cucagccucccuaguagcugggac

SEQ ID NO: 265458 - RNA, 24 nt, Human
cucagccucccuaguagcugggac

SEQ ID NO: 265459 - RNA, 21 nt, Human
cucauugcagccucgaagucc

SEQ ID NO: 265460 - RNA, 21 nt, Human
cucauugcagccucgaagucc

SEQ ID NO: 265461 - RNA, 24 nt, Human
cucccuaguagcugggaccacagg

SEQ ID NO: 265462 - RNA, 24 nt, Human
cucccuaguagcugggaccacagg

SEQ ID NO: 265463 - RNA, 19 nt, Human
cucuguugcccaggcugga

SEQ ID NO: 265464 - RNA, 19 nt, Human
cucuguugcccaggcugga

SEQ ID NO: 265465 - RNA, 22 nt, Human
cugggcuggagcguucuuccug

SEQ ID NO: 265466 - RNA, 22 nt, Human
cugggcuggagcguucuuccug

SEQ ID NO: 265467 - RNA, 19 nt, Human
gagaggaaacuggauggcg

SEQ ID NO: 265468 - RNA, 20 nt, Human
gaggggugucugugauauuu

SEQ ID NO: 265469 - RNA, 20 nt, Human
gaggggugucugugauauuu

SEQ ID NO: 265470 - RNA, 24 nt, Human
gcacaauccauugauagaacugga

SEQ ID NO: 265471 - RNA, 24 nt, Human
gcacaauccauugauagaacugga

SEQ ID NO: 265472 - RNA, 20 nt, Human
gcagccucgaaguccugggc

SEQ ID NO: 265473 - RNA, 20 nt, Human
gcagccucgaaguccugggc

SEQ ID NO: 265474 - RNA, 19 nt, Human
gcccaggcuggagugcaau

SEQ ID NO: 265475 - RNA, 19 nt, Human
gcccaggcuggagugcaau

SEQ ID NO: 265476 - RNA, 20 nt, Human
ggagaggaaacuggauggcg

SEQ ID NO: 265477 - RNA, 28 nt, Human
gggacuaguggagaggaaaccgguaccc

SEQ ID NO: 265478 - RNA, 20 nt, Human
ggguggugguggugguggug

SEQ ID NO: 265479 - RNA, 20 nt, Human
ggguggugguggugguggug

SEQ ID NO: 265480 - RNA, 24 nt, Human
ggucucuguugcccaggcuggagu

SEQ ID NO: 265481 - RNA, 25 nt, Human
gguuuuuuuuguuuguuuguuuugg

SEQ ID NO: 265482 - RNA, 21 nt, Human
gucucuguugcccaggcugga

SEQ ID NO: 265483 - RNA, 21 nt, Human
gucucuguugcccaggcugga

SEQ ID NO: 265484 - RNA, 24 nt, Human
gucucuguugcccaggcuggagug

SEQ ID NO: 265485 - RNA, 24 nt, Human
gucucuguugcccaggcuggagug

SEQ ID NO: 265486 - RNA, 23 nt, Human
guugagacagggucucuguugcc

SEQ ID NO: 265487 - RNA, 20 nt, Human
uaaacagaauugccagggac

SEQ ID NO: 265488 - RNA, 20 nt, Human
uaaacagaauugccagggac

SEQ ID NO: 265489 - RNA, 20 nt, Human
uaaacagaauugccagggac

SEQ ID NO: 265490 - RNA, 18 nt, Human
uacagggguaguaggggu

SEQ ID NO: 265491 - RNA, 18 nt, Human
uacagggguaguaggggu

SEQ ID NO: 265492 - RNA, 18 nt, Human
uacguugcccaggcugga

SEQ ID NO: 265493 - RNA, 18 nt, Human
uacguugcccaggcugga

SEQ ID NO: 265494 - RNA, 24 nt, Human
uacguugcccaggcuggagggugg

SEQ ID NO: 265495 - RNA, 24 nt, Human
uacguugcccaggcuggagggugg

SEQ ID NO: 265496 - RNA, 22 nt, Human
uacuacguugcccaggcuggag

SEQ ID NO: 265497 - RNA, 22 nt, Human
uacuacguugcccaggcuggag

SEQ ID NO: 265498 - RNA, 24 nt, Human
uagcucauugcagccucgaagucc

SEQ ID NO: 265499 - RNA, 24 nt, Human
uagcucauugcagccucgaagucc

SEQ ID NO: 265500 - RNA, 25 nt, Human
uaguagcugggaccacaggugugua

SEQ ID NO: 265501 - RNA, 25 nt, Human
uaguagcugggaccacaggugugua

SEQ ID NO: 265502 - RNA, 19 nt, Human
uaguagggguggugguggu

SEQ ID NO: 265503 - RNA, 19 nt, Human
uaguagggguggugguggu

SEQ ID NO: 265504 - RNA, 18 nt, Human
uaguggagaggaaacugg

SEQ ID NO: 265505 - RNA, 24 nt, Human
ucauugcagccucgaaguccuggg

SEQ ID NO: 265506 - RNA, 24 nt, Human
ucauugcagccucgaaguccuggg

SEQ ID NO: 265507 - RNA, 22 nt, Human
ucccuaguagcugggaccacag

SEQ ID NO: 265508 - RNA, 22 nt, Human
ucccuaguagcugggaccacag

SEQ ID NO: 265509 - RNA, 18 nt, Human
ucucuguugcccaggcug

SEQ ID NO: 265510 - RNA, 22 nt, Human
ucucuguugcccaggcuggagu

SEQ ID NO: 265511 - RNA, 23 nt, Human
ucucuguugcccaggcuggagug

SEQ ID NO: 265512 - RNA, 23 nt, Human
ucucuguugcccaggcuggagug

SEQ ID NO: 265513 - RNA, 27 nt, Human
ucucuguugcccaggcuggagugcaau

SEQ ID NO: 265514 - RNA, 27 nt, Human
ucucuguugcccaggcuggagugcaau

SEQ ID NO: 265515 - RNA, 18 nt, Human
ucuguugcccaggcugga

SEQ ID NO: 265516 - RNA, 24 nt, Human
ucuguugcccaggcuggagugcaa

SEQ ID NO: 265517 - RNA, 24 nt, Human
ucuguugcccaggcuggagugcaa

SEQ ID NO: 265518 - RNA, 20 nt, Human
ucuuacaucauacaaacuuc

SEQ ID NO: 265519 - RNA, 20 nt, Human
ucuuacaucauacaaacuuc

SEQ ID NO: 265520 - RNA, 21 nt, Human
ugagaaguuggaaagguuugc

SEQ ID NO: 265521 - RNA, 21 nt, Human
ugagaaguuggaaagguuugc

SEQ ID NO: 265522 - RNA, 21 nt, Human
ugagaaguuggaaagguuugc

SEQ ID NO: 265523 - RNA, 24 nt, Human
ugagguuuuacuacguugcccagg

SEQ ID NO: 265524 - RNA, 24 nt, Human
ugagguuuuacuacguugcccagg

SEQ ID NO: 265525 - RNA, 18 nt, Human
ugcccaggcuggagggug

SEQ ID NO: 265526 - RNA, 18 nt, Human
ugcccaggcuggagggug

SEQ ID NO: 265527 - RNA, 21 nt, Human
ugcccaggcuggaggguggug

SEQ ID NO: 265528 - RNA, 21 nt, Human
ugcccaggcuggaggguggug

SEQ ID NO: 265529 - RNA, 18 nt, Human
ugcccaggcuggagugca

SEQ ID NO: 265530 - RNA, 18 nt, Human
ugcccaggcuggagugca

SEQ ID NO: 265531 - RNA, 21 nt, Human
ugcccaggcuggagugcaaug

SEQ ID NO: 265532 - RNA, 21 nt, Human
ugcccaggcuggagugcaaug

SEQ ID NO: 265533 - RNA, 22 nt, Human
ugcccaggcuggagugcaauga

SEQ ID NO: 265534 - RNA, 22 nt, Human
ugcccaggcuggagugcaauga

SEQ ID NO: 265535 - RNA, 24 nt, Human
ugcccaggcuggagugcaaugaug

SEQ ID NO: 265536 - RNA, 24 nt, Human
ugcccaggcuggagugcaaugaug

SEQ ID NO: 265537 - RNA, 18 nt, Human
uggaaagguuugcagguu

SEQ ID NO: 265538 - RNA, 20 nt, Human
uggcucagccucccuaguag

SEQ ID NO: 265539 - RNA, 20 nt, Human
uggcucagccucccuaguag

SEQ ID NO: 265540 - RNA, 24 nt, Human
uggcucagccucccuaguagcugg

SEQ ID NO: 265541 - RNA, 24 nt, Human
uggcucagccucccuaguagcugg

SEQ ID NO: 265542 - RNA, 21 nt, Human
ugggaccacagguguguacca

SEQ ID NO: 265543 - RNA, 21 nt, Human
ugggaccacagguguguacca

SEQ ID NO: 265544 - RNA, 24 nt, Human
ugggaccacagguguguaccacca

SEQ ID NO: 265545 - RNA, 24 nt, Human
ugggaccacagguguguaccacca

SEQ ID NO: 265546 - RNA, 20 nt, Human
uggugguggugguggugguc

SEQ ID NO: 265547 - RNA, 20 nt, Human
uggugguggugguggugguc

SEQ ID NO: 265548 - RNA, 20 nt, Human
uguaaacagugcagcauucc

SEQ ID NO: 265549 - RNA, 20 nt, Human
uguaaacagugcagcauucc

SEQ ID NO: 265550 - RNA, 20 nt, Human
uguaaacagugcagcauucc

SEQ ID NO: 265551 - RNA, 21 nt, Human
uguaaacagugcagcauuccu

SEQ ID NO: 265552 - RNA, 21 nt, Human
uguaaacagugcagcauuccu

SEQ ID NO: 265553 - RNA, 21 nt, Human
uguaaacagugcagcauuccu

SEQ ID NO: 265554 - RNA, 19 nt, Human
uguguaccaccacgcccag

SEQ ID NO: 265555 - RNA, 19 nt, Human
uguguaccaccacgcccag

SEQ ID NO: 265556 - RNA, 21 nt, Human
uguguaccaccacgcccagcu

SEQ ID NO: 265557 - RNA, 19 nt, Human
ugugucuguguuuccuguu

SEQ ID NO: 265558 - RNA, 19 nt, Human
ugugucuguguuuccuguu

SEQ ID NO: 265559 - RNA, 20 nt, Human
uguugcccaggcuggagugc

SEQ ID NO: 265560 - RNA, 20 nt, Human
uguugcccaggcuggagugc

SEQ ID NO: 265561 - RNA, 22 nt, Human
uuacuacguugcccaggcugga

SEQ ID NO: 265562 - RNA, 22 nt, Human
uuacuacguugcccaggcugga

SEQ ID NO: 265563 - RNA, 21 nt, Human
uuccauugaagucugcgucuc

SEQ ID NO: 265564 - RNA, 23 nt, Human
uucuuguauagaugagguuuuac

SEQ ID NO: 265565 - RNA, 23 nt, Human
uucuuguauagaugagguuuuac

SEQ ID NO: 265566 - RNA, 18 nt, Human
uugagacagggucucugu

SEQ ID NO: 265567 - RNA, 20 nt, Human
uugagacagggucucuguug

SEQ ID NO: 265568 - RNA, 22 nt, Human
uugagacagggucucuguugcc

SEQ ID NO: 265569 - RNA, 23 nt, Human
uugcagccucgaaguccugggcu

SEQ ID NO: 265570 - RNA, 18 nt, Human
uugcccaggcuggagugc

SEQ ID NO: 265571 - RNA, 22 nt, Human
uuguuuguuuguuuugguuuuu

SEQ ID NO: 265572 - RNA, 22 nt, Human
uuguuuguuuguuuugguuuuu

SEQ ID NO: 265573 - RNA, 20 nt, Human
uuuaagcacagucagggugu

SEQ ID NO: 265574 - RNA, 20 nt, Human
uuuaagcacagucagggugu

SEQ ID NO: 265575 - RNA, 20 nt, Human
uuuaagcacagucagggugu

SEQ ID NO: 265576 - RNA, 23 nt, Human
uuuuacuacguugcccaggcugg

SEQ ID NO: 265577 - RNA, 23 nt, Human
uuuuacuacguugcccaggcugg

SEQ ID NO: 265578 - RNA, 24 nt, Human
uuuuacuacguugcccaggcugga

SEQ ID NO: 265579 - RNA, 24 nt, Human
uuuuacuacguugcccaggcugga

SEQ ID NO: 265580 - RNA, 21 nt, Human
uuuuuuuguuuguuuguuuug

SEQ ID NO: 265581 - RNA, 20 nt, Human
acugcagagggcuucuuggu

SEQ ID NO: 265582 - RNA, 19 nt, Human
agagggcuucuugguuccc

SEQ ID NO: 265583 - RNA, 20 nt, Human
auuucucacacauuuucccu

SEQ ID NO: 265584 - RNA, 19 nt, Human
caggaauaaagcgucuucc

SEQ ID NO: 265585 - RNA, 26 nt, Human
cccuccacucucucggagguguccca

SEQ ID NO: 265586 - RNA, 18 nt, Human
cugcagagggcuucuugg

SEQ ID NO: 265587 - RNA, 22 nt, Human
ugacagucaguguccuucagga

SEQ ID NO: 265588 - RNA, 20 nt, Human
uugguucccaagugacaguc

SEQ ID NO: 265589 - RNA, 20 nt, Human
cagagggaaaugaccaaaga

SEQ ID NO: 265590 - RNA, 21 nt, Human
ucuucagucauuccauggcau

SEQ ID NO: 265591 - RNA, 21 nt, Human
aagcaaaguuuauugcaugug

SEQ ID NO: 265592 - RNA, 18 nt, Human
acagcaacagccaggaga

SEQ ID NO: 265593 - RNA, 23 nt, Human
agaagacagcaacagccaggaga

SEQ ID NO: 265594 - RNA, 24 nt, Human
auuaaguaucaauggucaggaauc

SEQ ID NO: 265595 - RNA, 18 nt, Human
caagaaaauauacauuuu

SEQ ID NO: 265596 - RNA, 22 nt, Human
cagaagacagcaacagccagga

SEQ ID NO: 265597 - RNA, 19 nt, Human
cagcugagagucccaccug

SEQ ID NO: 265598 - RNA, 18 nt, Human
cuccugcuccagaagggc

SEQ ID NO: 265599 - RNA, 21 nt, Human
ggagaucccagaccuccgccc

SEQ ID NO: 265600 - RNA, 23 nt, Human
uaucuucuguccugcuccugcuc

SEQ ID NO: 265601 - RNA, 26 nt, Human
uccugcuccugcuccagaagggcugg

SEQ ID NO: 265602 - RNA, 24 nt, Human
ucuguccugcuccugcuccagaag

SEQ ID NO: 265603 - RNA, 19 nt, Human
ugagagucccaccugcagg

SEQ ID NO: 265604 - RNA, 19 nt, Human
ugcaugugaaaaagaguca

SEQ ID NO: 265605 - RNA, 18 nt, Human
uggacauuaaguaucaau

SEQ ID NO: 265606 - RNA, 18 nt, Human
uuugcauaucuucugucc

SEQ ID NO: 265607 - RNA, 19 nt, Human
acaggacagugacaaagaa

SEQ ID NO: 265608 - RNA, 27 nt, Human
agaagguggcaggcucaaagcagacaa

SEQ ID NO: 265609 - RNA, 22 nt, Human
cagacaacuacuucaagaauuu

SEQ ID NO: 265610 - RNA, 25 nt, Human
cucaaagcagacaacuacuucaaga

SEQ ID NO: 265611 - RNA, 20 nt, Human
cuuuggucacauuuucuuuc

SEQ ID NO: 265612 - RNA, 24 nt, Human
ucaaagcagacaacuacuucaaga

SEQ ID NO: 265613 - RNA, 19 nt, Human
ugcauuucuuuggucacau

SEQ ID NO: 265614 - RNA, 19 nt, Human
agaugggcucaggcagagu

SEQ ID NO: 265615 - RNA, 26 nt, Human
aggacagaugggcucaggcagaguuu

SEQ ID NO: 265616 - RNA, 19 nt, Human
gacagaugggcucaggcag

SEQ ID NO: 265617 - RNA, 19 nt, Human
uggcaggaaggacagaugg

SEQ ID NO: 265618 - RNA, 23 nt, Human
uggcaggaaggacagaugggcuc

SEQ ID NO: 265619 - RNA, 21 nt, Human
aggggaccugagagcagcagg

SEQ ID NO: 265620 - RNA, 19 nt, Human
cacaggcuccagcaugggg

SEQ ID NO: 265621 - RNA, 19 nt, Human
ccagggcugagcagaucaa

SEQ ID NO: 265622 - RNA, 23 nt, Human
cccaaggagcuguuacacaggcu

SEQ ID NO: 265623 - RNA, 27 nt, Human
gagagcagcagggaaagaccgguaccc

SEQ ID NO: 265624 - RNA, 22 nt, Human
gggaccugagagcagcagggaa

SEQ ID NO: 265625 - RNA, 21 nt, Human
ggggccaaggccugcagggga

SEQ ID NO: 265626 - RNA, 20 nt, Human
uacacaggcuccagcauggg

SEQ ID NO: 265627 - RNA, 28 nt, Human
ucuacagaugaggaaaggggccaaggcc

SEQ ID NO: 265628 - RNA, 20 nt, Human
ugagagcagcagggaaagac

SEQ ID NO: 265629 - RNA, 21 nt, Human
ugagagcagcagggaaagaca

SEQ ID NO: 265630 - RNA, 18 nt, Human
agcaagugaccaaaaaua

SEQ ID NO: 265631 - RNA, 24 nt, Human
ccaaaaauagcacauuuugugccu

SEQ ID NO: 265632 - RNA, 18 nt, Human
gcaagugaccaaaaauag

SEQ ID NO: 265633 - RNA, 21 nt, Human
uaaagcaagugaccaaaaaua

SEQ ID NO: 265634 - RNA, 24 nt, Human
aaugaugguaaacagaucuggaga

SEQ ID NO: 265635 - RNA, 20 nt, Human
aauucagagaaaaacugaag

SEQ ID NO: 265636 - RNA, 18 nt, Human
agagaaaaacugaagaug

SEQ ID NO: 265637 - RNA, 24 nt, Human
agauugcuuuguuuuccugaauga

SEQ ID NO: 265638 - RNA, 21 nt, Human
agucuugaaccguccagauug

SEQ ID NO: 265639 - RNA, 19 nt, Human
ccagauugcuuuguuuucc

SEQ ID NO: 265640 - RNA, 19 nt, Human
gaagaggauggugguuggg

SEQ ID NO: 265641 - RNA, 24 nt, Human
gaauucaauucagagaaaaacuga

SEQ ID NO: 265642 - RNA, 23 nt, Human
ggaguuccuccaaaagaaccuuu

SEQ ID NO: 265643 - RNA, 22 nt, Human
gucuugaagauggacccagagu

SEQ ID NO: 265644 - RNA, 21 nt, Human
gugguuggguugauccacagc

SEQ ID NO: 265645 - RNA, 24 nt, Human
uaaguuuccagccagucuuccuaa

SEQ ID NO: 265646 - RNA, 18 nt, Human
uauucuucucaucuagag

SEQ ID NO: 265647 - RNA, 20 nt, Human
uauuuuauucuucucaucua

SEQ ID NO: 265648 - RNA, 22 nt, Human
ucaauucagagaaaaacugaag

SEQ ID NO: 265649 - RNA, 21 nt, Human
ucuggagaguuugucaugggu

SEQ ID NO: 265650 - RNA, 18 nt, Human
ugaagauggacccagagu

SEQ ID NO: 265651 - RNA, 21 nt, Human
ugcuuguucuugagagcucca

SEQ ID NO: 265652 - RNA, 19 nt, Human
uggaagaggauggugguug

SEQ ID NO: 265653 - RNA, 25 nt, Human
uggaagaggauggugguuggguuga

SEQ ID NO: 265654 - RNA, 20 nt, Human
uguauaaaaauucagggagu

SEQ ID NO: 265655 - RNA, 24 nt, Human
uucaauucagagaaaaacugaaga

SEQ ID NO: 265656 - RNA, 21 nt, Human
uuuccugaaugaugguaaaca

SEQ ID NO: 265657 - RNA, 18 nt, Human
uuuuuuuuaaaagggugg

SEQ ID NO: 265658 - RNA, 25 nt, Human
aaauaaccccaugaccgcuuuuggc

SEQ ID NO: 265659 - RNA, 21 nt, Human
aacaauaaauacuuccucccc

SEQ ID NO: 265660 - RNA, 19 nt, Human
aagaauuccacacuccgcc

SEQ ID NO: 265661 - RNA, 18 nt, Human
aaggacccagcacugccu

SEQ ID NO: 265662 - RNA, 22 nt, Human
aaggcccccccaccccaugccg

SEQ ID NO: 265663 - RNA, 22 nt, Human
accaccuaaggcccccccaccc

SEQ ID NO: 265664 - RNA, 18 nt, Human
agaauuccacacuccgcc

SEQ ID NO: 265665 - RNA, 20 nt, Human
agcccagggcgcagcagcga

SEQ ID NO: 265666 - RNA, 20 nt, Human
aggcccccccaccccaugcc

SEQ ID NO: 265667 - RNA, 22 nt, Human
caaagacgagcccagggcgcag

SEQ ID NO: 265668 - RNA, 22 nt, Human
caccaccuaaggcccccccacc

SEQ ID NO: 265669 - RNA, 25 nt, Human
caccaccuaaggcccccccacccca

SEQ ID NO: 265670 - RNA, 24 nt, Human
caccuaaggcccccccaccccaug

SEQ ID NO: 265671 - RNA, 24 nt, Human
cacuccgcccagcucucugcagcc

SEQ ID NO: 265672 - RNA, 23 nt, Human
cacucugcaaagacgagcccagg

SEQ ID NO: 265673 - RNA, 20 nt, Human
caugccguucuucugaagua

SEQ ID NO: 265674 - RNA, 27 nt, Human
ccaccuaaggcccccccaccccaugcc

SEQ ID NO: 265675 - RNA, 25 nt, Human
ccccaccccaugccguucuucugaa

SEQ ID NO: 265676 - RNA, 19 nt, Human
ccuaaggcccccccacccc

SEQ ID NO: 265677 - RNA, 23 nt, Human
ccucuggauggauuuccaacugu

SEQ ID NO: 265678 - RNA, 19 nt, Human
cgaaguacccauagccacc

SEQ ID NO: 265679 - RNA, 21 nt, Human
cgugaccaaauacacgaccuc

SEQ ID NO: 265680 - RNA, 21 nt, Human
cucucugcagcccaggaacaa

SEQ ID NO: 265681 - RNA, 19 nt, Human
gagggcagggaccacucug

SEQ ID NO: 265682 - RNA, 22 nt, Human
ggcaccaccuaaggccccccca

SEQ ID NO: 265683 - RNA, 21 nt, Human
ggccacgaaguacccauagcc

SEQ ID NO: 265684 - RNA, 19 nt, Human
uaaaaauaaccccaugacc

SEQ ID NO: 265685 - RNA, 21 nt, Human
uauuggaacauggccucugga

SEQ ID NO: 265686 - RNA, 24 nt, Human
ugaggcgggcaccaccuaaggccc

SEQ ID NO: 265687 - RNA, 22 nt, Human
ugagggcagggaccacucugca

SEQ ID NO: 265688 - RNA, 21 nt, Human
ugcaaagacgagcccagggcc

SEQ ID NO: 265689 - RNA, 21 nt, Human
uggaaaggacccagcacugcc

SEQ ID NO: 265690 - RNA, 24 nt, Human
uggaaaggacccagcacugccucc

SEQ ID NO: 265691 - RNA, 26 nt, Human
uggaaaggacccagcacugccucccg

SEQ ID NO: 265692 - RNA, 25 nt, Human
uggagguggauaaauggggcagcca

SEQ ID NO: 265693 - RNA, 18 nt, Human
aaccacguggagaggucc

SEQ ID NO: 265694 - RNA, 19 nt, Human
caggagucuugguaaggcu

SEQ ID NO: 265695 - RNA, 20 nt, Human
ccccuccuucccacgacucc

SEQ ID NO: 265696 - RNA, 19 nt, Human
cccugggcuuccugggcac

SEQ ID NO: 265697 - RNA, 22 nt, Human
cuccuucccacgacuccaggcc

SEQ ID NO: 265698 - RNA, 23 nt, Human
gcacagccugagaggggccagag

SEQ ID NO: 265699 - RNA, 24 nt, Human
uaagcacagccugagaggggccag

SEQ ID NO: 265700 - RNA, 18 nt, Human
uacagagagggaugugga

SEQ ID NO: 265701 - RNA, 20 nt, Human
ucacacaugggagaugagac

SEQ ID NO: 265702 - RNA, 21 nt, Human
uccaaggguuuuugcaggagu

SEQ ID NO: 265703 - RNA, 21 nt, Human
ugagaggggccagagacggca

SEQ ID NO: 265704 - RNA, 23 nt, Human
uucccugggcuuccugggcacga

SEQ ID NO: 265705 - RNA, 26 nt, Human
aagccaagggccaggcaccuggaaga

SEQ ID NO: 265706 - RNA, 23 nt, Human
aaucccagagcccagccuggccg

SEQ ID NO: 265707 - RNA, 20 nt, Human
cagaaucccagagcccagcc

SEQ ID NO: 265708 - RNA, 20 nt, Human
caucucagcucacccagccg

SEQ ID NO: 265709 - RNA, 18 nt, Human
ccagccuggccguguuag

SEQ ID NO: 265710 - RNA, 19 nt, Human
cccagagcccagccuggcc

SEQ ID NO: 265711 - RNA, 20 nt, Human
ccuggccguguuagagcugu

SEQ ID NO: 265712 - RNA, 21 nt, Human
cgaggacuccaucucagcuca

SEQ ID NO: 265713 - RNA, 18 nt, Human
cuaagaagaaaccgagag

SEQ ID NO: 265714 - RNA, 18 nt, Human
cucagcucacccagccgg

SEQ ID NO: 265715 - RNA, 22 nt, Human
gagugaucuaagaagaaaccga

SEQ ID NO: 265716 - RNA, 25 nt, Human
gcuaaagccaagggccaggcaccug

SEQ ID NO: 265717 - RNA, 25 nt, Human
uaagaagaaaccgagagacguggcg

SEQ ID NO: 265718 - RNA, 22 nt, Human
uauggcuaaagccaagggccag

SEQ ID NO: 265719 - RNA, 20 nt, Human
ucccagagcccagccuggcc

SEQ ID NO: 265720 - RNA, 24 nt, Human
uggcagaggagugaucuaagaaga

SEQ ID NO: 265721 - RNA, 24 nt, Human
uggggcagugguguggugauaagu

SEQ ID NO: 265722 - RNA, 21 nt, Human
ugguauggcuaaagccaaggg

SEQ ID NO: 265723 - RNA, 22 nt, Human
cccagggccccaggucuugccc

SEQ ID NO: 265724 - RNA, 21 nt, Human
cugcuucugccugcuuugaug

SEQ ID NO: 265725 - RNA, 21 nt, Human
cuugcccaucuuaagcuccug

SEQ ID NO: 265726 - RNA, 23 nt, Human
gcccagggccccaggucuugccc

SEQ ID NO: 265727 - RNA, 24 nt, Human
uaagcuccugcuuggucccccagg

SEQ ID NO: 265728 - RNA, 18 nt, Human
ucagacuccggcugccac

SEQ ID NO: 265729 - RNA, 21 nt, Human
ucuuaagcuccugcuuggucc

SEQ ID NO: 265730 - RNA, 21 nt, Human
ugcccaucuuaagcuccugcu

SEQ ID NO: 265731 - RNA, 23 nt, Human
aaaaacccuuuauuauaauaaac

SEQ ID NO: 265732 - RNA, 18 nt, Human
aaaaagcagauaaaaaua

SEQ ID NO: 265733 - RNA, 23 nt, Human
aaaaagcagauaaaaauagaaug

SEQ ID NO: 265734 - RNA, 21 nt, Human
aaaaagcuuugaaugcgcuaa

SEQ ID NO: 265735 - RNA, 20 nt, Human
aaacaaggucaacaugagac

SEQ ID NO: 265736 - RNA, 24 nt, Human
aaacaguggaaaagaaaaaaaaag

SEQ ID NO: 265737 - RNA, 23 nt, Human
aaagcaacugcaggcugagacag

SEQ ID NO: 265738 - RNA, 22 nt, Human
aaagguugggggcaaggcauga

SEQ ID NO: 265739 - RNA, 21 nt, Human
aacaaggucaacaugagacaa

SEQ ID NO: 265740 - RNA, 21 nt, Human
aacacacauauacgccacaca

SEQ ID NO: 265741 - RNA, 19 nt, Human
aacagcacaaauaagaauc

SEQ ID NO: 265742 - RNA, 18 nt, Human
aaccuugcucugcucagc

SEQ ID NO: 265743 - RNA, 20 nt, Human
aaccuugcucugcucagcac

SEQ ID NO: 265744 - RNA, 19 nt, Human
aagcaaaaggaaaaauacu

SEQ ID NO: 265745 - RNA, 21 nt, Human
aagcaaaaggaaaaauacugg

SEQ ID NO: 265746 - RNA, 29 nt, Human
aagcaaaaggaaaaauacugggggacccc

SEQ ID NO: 265747 - RNA, 23 nt, Human
aaguaauuuuaaauugguucuua

SEQ ID NO: 265748 - RNA, 22 nt, Human
aauggaagauaacauaagacua

SEQ ID NO: 265749 - RNA, 23 nt, Human
aauggaauggggccuggaacuga

SEQ ID NO: 265750 - RNA, 23 nt, Human
acaaacaguggaaaagaaaaaaa

SEQ ID NO: 265751 - RNA, 21 nt, Human
acaaagguuauauucugaaca

SEQ ID NO: 265752 - RNA, 22 nt, Human
acacacagaggaaauguauuag

SEQ ID NO: 265753 - RNA, 28 nt, Human
acacaugcacacacacaacauacacgca

SEQ ID NO: 265754 - RNA, 18 nt, Human
acagcauugcccguuuuc

SEQ ID NO: 265755 - RNA, 18 nt, Human
acaggaaaggcguccuga

SEQ ID NO: 265756 - RNA, 18 nt, Human
acaggaaaggcguccuga

SEQ ID NO: 265757 - RNA, 24 nt, Human
acaguggaaaagaaaaaaaaagua

SEQ ID NO: 265758 - RNA, 22 nt, Human
agagaagcagcuguucccugga

SEQ ID NO: 265759 - RNA, 22 nt, Human
agagaauggaauggggccugga

SEQ ID NO: 265760 - RNA, 21 nt, Human
agcgaacccaaccuugcucug

SEQ ID NO: 265761 - RNA, 18 nt, Human
aggggcugcagggaguag

SEQ ID NO: 265762 - RNA, 18 nt, Human
aggguuggacucaggcgu

SEQ ID NO: 265763 - RNA, 20 nt, Human
aggucaaguucuuuggagag

SEQ ID NO: 265764 - RNA, 26 nt, Human
augcacacacacaacauacacgcaca

SEQ ID NO: 265765 - RNA, 24 nt, Human
augcacacacacaacauacacggg

SEQ ID NO: 265766 - RNA, 22 nt, Human
auggaauggggccuggaacuga

SEQ ID NO: 265767 - RNA, 23 nt, Human
caaacaguggaaaagaaaaaaaa

SEQ ID NO: 265768 - RNA, 21 nt, Human
caacaugagacaaaaacccuu

SEQ ID NO: 265769 - RNA, 25 nt, Human
caagagaacauuaacacaauuccaa

SEQ ID NO: 265770 - RNA, 26 nt, Human
caaggaccuccugagagccgagguuc

SEQ ID NO: 265771 - RNA, 24 nt, Human
caaggauuuuuuuuuucccauggg

SEQ ID NO: 265772 - RNA, 21 nt, Human
cacaacauacacgcacacaaa

SEQ ID NO: 265773 - RNA, 30 nt, Human
cacacaacauacacgcacacaaagguuaua

SEQ ID NO: 265774 - RNA, 24 nt, Human
cacacacacagaggaaauguauua

SEQ ID NO: 265775 - RNA, 26 nt, Human
cacauuuaagaagaaaaauauggaac

SEQ ID NO: 265776 - RNA, 18 nt, Human
cagcagaggcagccgggc

SEQ ID NO: 265777 - RNA, 19 nt, Human
cagcagaggcagccgggcu

SEQ ID NO: 265778 - RNA, 21 nt, Human
cagcagaggcagccgggcucu

SEQ ID NO: 265779 - RNA, 18 nt, Human
caugaaaaauauuguaac

SEQ ID NO: 265780 - RNA, 21 nt, Human
cccaaccuugcucugcucagc

SEQ ID NO: 265781 - RNA, 19 nt, Human
cccagauaaauauuugguu

SEQ ID NO: 265782 - RNA, 21 nt, Human
ccuggaacaaggaccuccuga

SEQ ID NO: 265783 - RNA, 21 nt, Human
cgccacacaugcacacacaca

SEQ ID NO: 265784 - RNA, 23 nt, Human
cguccugaagcucucggcuggga

SEQ ID NO: 265785 - RNA, 23 nt, Human
cguccugaagcucucggcuggga

SEQ ID NO: 265786 - RNA, 23 nt, Human
cuagcagcaaaaagcagauaaaa

SEQ ID NO: 265787 - RNA, 24 nt, Human
cuggaacugaugugugcguuaaug

SEQ ID NO: 265788 - RNA, 23 nt, Human
cuguuguuuguuguggcaacugg

SEQ ID NO: 265789 - RNA, 23 nt, Human
cuguuguuuguuguggcaacugg

SEQ ID NO: 265790 - RNA, 19 nt, Human
cuuagaaacugcuuuucuc

SEQ ID NO: 265791 - RNA, 19 nt, Human
gaagcuccugaaguugcuc

SEQ ID NO: 265792 - RNA, 19 nt, Human
gaagcuccugaaguugcuc

SEQ ID NO: 265793 - RNA, 23 nt, Human
gagcugauauucuauaacagcac

SEQ ID NO: 265794 - RNA, 22 nt, Human
gaggagauuccaaaguacaugg

SEQ ID NO: 265795 - RNA, 23 nt, Human
gauguucagagaauggaaugggg

SEQ ID NO: 265796 - RNA, 23 nt, Human
gcaaaaagcagauaaaaauagaa

SEQ ID NO: 265797 - RNA, 19 nt, Human
gcugggaagcuccugaagu

SEQ ID NO: 265798 - RNA, 19 nt, Human
gcugggaagcuccugaagu

SEQ ID NO: 265799 - RNA, 22 nt, Human
ggcugcagggaguagagcccag

SEQ ID NO: 265800 - RNA, 21 nt, Human
gguagugcgaggggcugcagg

SEQ ID NO: 265801 - RNA, 24 nt, Human
uaaaccaagagaacauuaacacaa

SEQ ID NO: 265802 - RNA, 22 nt, Human
uaaagcaacugcaggcugagac

SEQ ID NO: 265803 - RNA, 25 nt, Human
uacacacacacacagaggaaaugua

SEQ ID NO: 265804 - RNA, 26 nt, Human
uauaaagcaacugcaggcugagacag

SEQ ID NO: 265805 - RNA, 18 nt, Human
uauaacagcacaaauaag

SEQ ID NO: 265806 - RNA, 26 nt, Human
uauacgccacacaugcacacacacag

SEQ ID NO: 265807 - RNA, 19 nt, Human
ucaaaauucuaauguugau

SEQ ID NO: 265808 - RNA, 20 nt, Human
ucagugugucagaagauguu

SEQ ID NO: 265809 - RNA, 18 nt, Human
uccaaaguacauggaguu

SEQ ID NO: 265810 - RNA, 22 nt, Human
ucccuaaaugaaaucuagcugc

SEQ ID NO: 265811 - RNA, 24 nt, Human
ucccuaaaugaaaucuagcugcac

SEQ ID NO: 265812 - RNA, 24 nt, Human
ucggcugggaagcuccugaaguug

SEQ ID NO: 265813 - RNA, 24 nt, Human
ucggcugggaagcuccugaaguug

SEQ ID NO: 265814 - RNA, 19 nt, Human
ucuggaaaauagacacgag

SEQ ID NO: 265815 - RNA, 18 nt, Human
ucuguuucaucguggcca

SEQ ID NO: 265816 - RNA, 22 nt, Human
ucuucucuguuguuuguugugg

SEQ ID NO: 265817 - RNA, 22 nt, Human
ucuucucuguuguuuguugugg

SEQ ID NO: 265818 - RNA, 20 nt, Human
ugaaacuagcagcaaaaagc

SEQ ID NO: 265819 - RNA, 18 nt, Human
ugaagcucucggcuggga

SEQ ID NO: 265820 - RNA, 18 nt, Human
ugaagcucucggcuggga

SEQ ID NO: 265821 - RNA, 22 nt, Human
ugcaaagaggggauaaguuuag

SEQ ID NO: 265822 - RNA, 19 nt, Human
ugccagaggagcgaaccca

SEQ ID NO: 265823 - RNA, 21 nt, Human
ugcgaggggcugcagggagua

SEQ ID NO: 265824 - RNA, 20 nt, Human
uggaaaauagacacgagggu

SEQ ID NO: 265825 - RNA, 19 nt, Human
uggguucuuaaccaaaugu

SEQ ID NO: 265826 - RNA, 23 nt, Human
ugguuugguuacuuucucucuaa

SEQ ID NO: 265827 - RNA, 19 nt, Human
ugucccugguuccagcugg

SEQ ID NO: 265828 - RNA, 21 nt, Human
ugugucagaagauguucagag

SEQ ID NO: 265829 - RNA, 28 nt, Human
uguuacacacacacacagaggaaaugua

SEQ ID NO: 265830 - RNA, 18 nt, Human
uguugauacuguguagga

SEQ ID NO: 265831 - RNA, 21 nt, Human
uucagagaauggaauggggcc

SEQ ID NO: 265832 - RNA, 24 nt, Human
uucccuggaacaaggaccuccuga

SEQ ID NO: 265833 - RNA, 24 nt, Human
uucucuguuguuuguuguggcaac

SEQ ID NO: 265834 - RNA, 24 nt, Human
uucucuguuguuuguuguggcaac

SEQ ID NO: 265835 - RNA, 22 nt, Human
uugauacuguguaggauugcac

SEQ ID NO: 265836 - RNA, 23 nt, Human
uugaugcacauuuaagaagaaaa

SEQ ID NO: 265837 - RNA, 20 nt, Human
uugucccugguuccagcugg

SEQ ID NO: 265838 - RNA, 25 nt, Human
uuucuggaaaauagacacgaggguu

SEQ ID NO: 265839 - RNA, 23 nt, Human
aaagacgaggagcuggggaggga

SEQ ID NO: 265840 - RNA, 19 nt, Human
aaccacagaagcccuacau

SEQ ID NO: 265841 - RNA, 19 nt, Human
agacgaggagcuggggagg

SEQ ID NO: 265842 - RNA, 21 nt, Human
aggagcuggggagggaaccgg

SEQ ID NO: 265843 - RNA, 18 nt, Human
aggcggcucacaucgggg

SEQ ID NO: 265844 - RNA, 19 nt, Human
aggcugcccuggggaucug

SEQ ID NO: 265845 - RNA, 19 nt, Human
aucaucugaggccaugggu

SEQ ID NO: 265846 - RNA, 19 nt, Human
augggggcguggggagccc

SEQ ID NO: 265847 - RNA, 22 nt, Human
cacuguguggcugcguccaggc

SEQ ID NO: 265848 - RNA, 19 nt, Human
caucaucugaggccaugga

SEQ ID NO: 265849 - RNA, 25 nt, Human
cauccacaaccacagaagcccuaca

SEQ ID NO: 265850 - RNA, 21 nt, Human
caugcugagaccccccagcca

SEQ ID NO: 265851 - RNA, 20 nt, Human
cauggcacuccagcuaggag

SEQ ID NO: 265852 - RNA, 19 nt, Human
ccacagaagcccuacaugc

SEQ ID NO: 265853 - RNA, 23 nt, Human
ccacagaagcccuacaugcugag

SEQ ID NO: 265854 - RNA, 27 nt, Human
ccaggccacacuccgaggcggcucaca

SEQ ID NO: 265855 - RNA, 19 nt, Human
ccauggcacuccagcuagg

SEQ ID NO: 265856 - RNA, 24 nt, Human
ccauggcacuccagcuaggaggag

SEQ ID NO: 265857 - RNA, 22 nt, Human
cccaccaggagccucccaucca

SEQ ID NO: 265858 - RNA, 22 nt, Human
ccccggccacuguguggcugcg

SEQ ID NO: 265859 - RNA, 21 nt, Human
cccggccacuguguggcugcg

SEQ ID NO: 265860 - RNA, 26 nt, Human
ccucccagccuggcacagccuugucc

SEQ ID NO: 265861 - RNA, 24 nt, Human
ccucccauccacaaccacagaagc

SEQ ID NO: 265862 - RNA, 23 nt, Human
cuccugggccugcugaccccauc

SEQ ID NO: 265863 - RNA, 20 nt, Human
cucugucuucccuggcagcu

SEQ ID NO: 265864 - RNA, 28 nt, Human
cugggccagauggugugggcucggccuu

SEQ ID NO: 265865 - RNA, 25 nt, Human
cugggccugcugaccccaucaucug

SEQ ID NO: 265866 - RNA, 23 nt, Human
cuuggcuucuccccucccccucc

SEQ ID NO: 265867 - RNA, 21 nt, Human
gaaggugggugggggccagcc

SEQ ID NO: 265868 - RNA, 21 nt, Human
gagccucccagccuggcacag

SEQ ID NO: 265869 - RNA, 24 nt, Human
gagccucccagccuggcacagccu

SEQ ID NO: 265870 - RNA, 21 nt, Human
gaggcugcccuggggaucugg

SEQ ID NO: 265871 - RNA, 24 nt, Human
gaugggggccccgagugguugggu

SEQ ID NO: 265872 - RNA, 23 nt, Human
gccuggagucugggguguggccg

SEQ ID NO: 265873 - RNA, 20 nt, Human
gcuucuccccucccccucca

SEQ ID NO: 265874 - RNA, 18 nt, Human
ggagccucccauccacaa

SEQ ID NO: 265875 - RNA, 21 nt, Human
ggaguggggagguggcggggg

SEQ ID NO: 265876 - RNA, 22 nt, Human
ggcaaagcaggggucaccacgg

SEQ ID NO: 265877 - RNA, 19 nt, Human
ggcuguguggcuucagccc

SEQ ID NO: 265878 - RNA, 25 nt, Human
gggaaccgggagcggcuucaacggg

SEQ ID NO: 265879 - RNA, 22 nt, Human
ggggccagccugggccagaugg

SEQ ID NO: 265880 - RNA, 24 nt, Human
ggggguggucuccugugucccuug

SEQ ID NO: 265881 - RNA, 18 nt, Human
ggguugggccggcuuggc

SEQ ID NO: 265882 - RNA, 23 nt, Human
uacaaggcacaagcugagagcag

SEQ ID NO: 265883 - RNA, 18 nt, Human
uccccucccccuccacca

SEQ ID NO: 265884 - RNA, 23 nt, Human
ucccuuggcuucuccccuccccc

SEQ ID NO: 265885 - RNA, 25 nt, Human
ucucccaguggggcaaagcaggggu

SEQ ID NO: 265886 - RNA, 19 nt, Human
ugacccccaagaugggggc

SEQ ID NO: 265887 - RNA, 26 nt, Human
ugacccccaagaugggggccccuccu

SEQ ID NO: 265888 - RNA, 19 nt, Human
ugagaccccccagccaugg

SEQ ID NO: 265889 - RNA, 25 nt, Human
ugagaccccccagccauggcacucc

SEQ ID NO: 265890 - RNA, 24 nt, Human
ugagagcagacuggaggcugcccc

SEQ ID NO: 265891 - RNA, 19 nt, Human
ugaggcaagcucgggggug

SEQ ID NO: 265892 - RNA, 20 nt, Human
uggaggcugccccauggccu

SEQ ID NO: 265893 - RNA, 20 nt, Human
uggcagcugggccuuaggaa

SEQ ID NO: 265894 - RNA, 19 nt, Human
uggccuuccuaauucuccu

SEQ ID NO: 265895 - RNA, 24 nt, Human
uggcugccuuuucuggccuucugg

SEQ ID NO: 265896 - RNA, 21 nt, Human
uggcuucuccccucccccucc

SEQ ID NO: 265897 - RNA, 18 nt, Human
uggggagggaaccgggag

SEQ ID NO: 265898 - RNA, 21 nt, Human
uggggagggaaccgggagcgg

SEQ ID NO: 265899 - RNA, 24 nt, Human
uggggagggaaccgggagcggcuu

SEQ ID NO: 265900 - RNA, 23 nt, Human
ugggggccccgagugguuggguu

SEQ ID NO: 265901 - RNA, 21 nt, Human
uucuccccucccccuccacca

SEQ ID NO: 265902 - RNA, 26 nt, Human
uugguggucgcaaggaaggugggugg

SEQ ID NO: 265903 - RNA, 20 nt, Human
aaaagaugaaacaaagaaaa

SEQ ID NO: 265904 - RNA, 18 nt, Human
aaacaauggagucaacac

SEQ ID NO: 265905 - RNA, 22 nt, Human
aagcuaaccuuccaaguaacac

SEQ ID NO: 265906 - RNA, 19 nt, Human
aaggcaguucccuucagua

SEQ ID NO: 265907 - RNA, 21 nt, Human
aagucccuaacucgcccgucc

SEQ ID NO: 265908 - RNA, 23 nt, Human
aaugauagaagcuaaccuuccaa

SEQ ID NO: 265909 - RNA, 18 nt, Human
acagagaaugccccccuu

SEQ ID NO: 265910 - RNA, 26 nt, Human
acaugcacgaacaggcaagcacguac

SEQ ID NO: 265911 - RNA, 19 nt, Human
acuccagcucaaacacacu

SEQ ID NO: 265912 - RNA, 22 nt, Human
acucccucaccuucccucagau

SEQ ID NO: 265913 - RNA, 19 nt, Human
agacaugaaagacuccaaa

SEQ ID NO: 265914 - RNA, 19 nt, Human
agcaaagacaggaaaaucc

SEQ ID NO: 265915 - RNA, 21 nt, Human
agcaaagacaggaaaauccag

SEQ ID NO: 265916 - RNA, 18 nt, Human
agcuuccagaaagccugg

SEQ ID NO: 265917 - RNA, 23 nt, Human
agcuuccagaaagccugggcagc

SEQ ID NO: 265918 - RNA, 19 nt, Human
aggaucaaugaaggcggcc

SEQ ID NO: 265919 - RNA, 21 nt, Human
agguagcaaagacaggugggc

SEQ ID NO: 265920 - RNA, 22 nt, Human
auuaaaauauacagacugugua

SEQ ID NO: 265921 - RNA, 24 nt, Human
caaacccaagucccuaacucgccc

SEQ ID NO: 265922 - RNA, 25 nt, Human
caagucccuaacucgcccgucccga

SEQ ID NO: 265923 - RNA, 22 nt, Human
cacacuguccccucgagcucuc

SEQ ID NO: 265924 - RNA, 22 nt, Human
caccuucccucagauucgggga

SEQ ID NO: 265925 - RNA, 24 nt, Human
caccuuuuguucgcccaaacccaa

SEQ ID NO: 265926 - RNA, 22 nt, Human
cacguacacuuaaaagaugaaa

SEQ ID NO: 265927 - RNA, 22 nt, Human
cacucccgaggacgcgcgcccg

SEQ ID NO: 265928 - RNA, 18 nt, Human
cacuggagccagccuagg

SEQ ID NO: 265929 - RNA, 21 nt, Human
cacuggagccagccuaggcca

SEQ ID NO: 265930 - RNA, 18 nt, Human
cagaagggggaaaggcag

SEQ ID NO: 265931 - RNA, 18 nt, Human
cagccuaggccagagggu

SEQ ID NO: 265932 - RNA, 22 nt, Human
cagcucaaacacacuguccccu

SEQ ID NO: 265933 - RNA, 19 nt, Human
caguagcacaguuacgguc

SEQ ID NO: 265934 - RNA, 20 nt, Human
cauuacacauccuuuuuccc

SEQ ID NO: 265935 - RNA, 20 nt, Human
cauucuuguucuaaaaccag

SEQ ID NO: 265936 - RNA, 28 nt, Human
cauucuuguucuaaaaccagcacuggag

SEQ ID NO: 265937 - RNA, 19 nt, Human
ccagcucaaacacacuguc

SEQ ID NO: 265938 - RNA, 19 nt, Human
cccaaacccaagucccuaa

SEQ ID NO: 265939 - RNA, 22 nt, Human
cccaaacccaagucccuaacuc

SEQ ID NO: 265940 - RNA, 22 nt, Human
cccgcagcacuccagcucaaac

SEQ ID NO: 265941 - RNA, 21 nt, Human
ccgcagcacuccagcucaaac

SEQ ID NO: 265942 - RNA, 25 nt, Human
cucagaccagaagcuuccagaaagc

SEQ ID NO: 265943 - RNA, 22 nt, Human
cuggagccagccuaggccagag

SEQ ID NO: 265944 - RNA, 23 nt, Human
cuguccccucgagcucuccaucc

SEQ ID NO: 265945 - RNA, 20 nt, Human
gacucgcggaagucagcgcc

SEQ ID NO: 265946 - RNA, 19 nt, Human
gagcucuccaucccccuuc

SEQ ID NO: 265947 - RNA, 21 nt, Human
gcacuccagcucaaacacacu

SEQ ID NO: 265948 - RNA, 25 nt, Human
gcggcaggcaaaaggauccucggag

SEQ ID NO: 265949 - RNA, 23 nt, Human
gcgugguuccuccccuccuuuuu

SEQ ID NO: 265950 - RNA, 23 nt, Human
gcucuccaucccccuucccacuc

SEQ ID NO: 265951 - RNA, 20 nt, Human
gcucuguuaagucuccccca

SEQ ID NO: 265952 - RNA, 18 nt, Human
ggagccagcuguugaaga

SEQ ID NO: 265953 - RNA, 19 nt, Human
ggcaguucccuucaguagc

SEQ ID NO: 265954 - RNA, 21 nt, Human
uaaaagaugaaacaaagaaaa

SEQ ID NO: 265955 - RNA, 24 nt, Human
uaacaauugagacuauagcucugc

SEQ ID NO: 265956 - RNA, 26 nt, Human
uaagaguaguaaagcuuuggaaacug

SEQ ID NO: 265957 - RNA, 19 nt, Human
uaaugucaggguccuuuga

SEQ ID NO: 265958 - RNA, 19 nt, Human
uacacauccuuuuucccuu

SEQ ID NO: 265959 - RNA, 24 nt, Human
uacaccauuacacauccuuuuucc

SEQ ID NO: 265960 - RNA, 18 nt, Human
uacagacuguguacacca

SEQ ID NO: 265961 - RNA, 20 nt, Human
uagaagcuaaccuuccaagu

SEQ ID NO: 265962 - RNA, 21 nt, Human
uagugcaucauugacagagaa

SEQ ID NO: 265963 - RNA, 19 nt, Human
uauccagaaugauagaagc

SEQ ID NO: 265964 - RNA, 19 nt, Human
uaugaacacaugcacgaac

SEQ ID NO: 265965 - RNA, 19 nt, Human
ucaaaauacagcaaagaca

SEQ ID NO: 265966 - RNA, 21 nt, Human
ucaccuucccucagauucggg

SEQ ID NO: 265967 - RNA, 25 nt, Human
uccaaaaugacuucauucuuguucu

SEQ ID NO: 265968 - RNA, 18 nt, Human
uccagaaagccugggcag

SEQ ID NO: 265969 - RNA, 24 nt, Human
uccagcucaaacacacuguccccu

SEQ ID NO: 265970 - RNA, 25 nt, Human
ucccacucccucaccuucccucaga

SEQ ID NO: 265971 - RNA, 24 nt, Human
uccccucgagcucuccaucccccu

SEQ ID NO: 265972 - RNA, 22 nt, Human
uccccugcugccaucgcccggu

SEQ ID NO: 265973 - RNA, 22 nt, Human
ucccucagaccagaagcuucca

SEQ ID NO: 265974 - RNA, 21 nt, Human
ucgcccaaacccaagucccua

SEQ ID NO: 265975 - RNA, 19 nt, Human
ucuggucauaaaugcugau

SEQ ID NO: 265976 - RNA, 20 nt, Human
ugaacacaugcacgaacaga

SEQ ID NO: 265977 - RNA, 23 nt, Human
ugaacacaugcacgaacaggcaa

SEQ ID NO: 265978 - RNA, 21 nt, Human
ugagaaaggcugcccgcagca

SEQ ID NO: 265979 - RNA, 22 nt, Human
ugagccaacaaacaguuuugca

SEQ ID NO: 265980 - RNA, 21 nt, Human
uggcagacuuugcuacaugua

SEQ ID NO: 265981 - RNA, 23 nt, Human
ugggauaaaauauguguguauua

SEQ ID NO: 265982 - RNA, 21 nt, Human
ugggcauggcacacuggagcc

SEQ ID NO: 265983 - RNA, 21 nt, Human
uguguacaccauuacacaucc

SEQ ID NO: 265984 - RNA, 22 nt, Human
uguguguauuaaagccucagca

SEQ ID NO: 265985 - RNA, 20 nt, Human
uuaaaucuuuuagacaugaa

SEQ ID NO: 265986 - RNA, 19 nt, Human
uucaaaauacagcaaagac

SEQ ID NO: 265987 - RNA, 23 nt, Human
uucugugagccaacaaacaguuu

SEQ ID NO: 265988 - RNA, 18 nt, Human
uuuggaaacugugcagac

SEQ ID NO: 265989 - RNA, 22 nt, Human
aaccaaagaccagaaauccagg

SEQ ID NO: 265990 - RNA, 19 nt, Human
aacuccugccuccucccuc

SEQ ID NO: 265991 - RNA, 19 nt, Human
aagaaggcuuuucccaaac

SEQ ID NO: 265992 - RNA, 26 nt, Human
accaaaggcagaggccaguucaucug

SEQ ID NO: 265993 - RNA, 18 nt, Human
acuuggagacacagggac

SEQ ID NO: 265994 - RNA, 21 nt, Human
agacccugaguaaaccaaagg

SEQ ID NO: 265995 - RNA, 28 nt, Human
agauacagcagggaauaaaccgguaccc

SEQ ID NO: 265996 - RNA, 18 nt, Human
aggcaggaguuaggggca

SEQ ID NO: 265997 - RNA, 19 nt, Human
aggcaggaguuaggggcag

SEQ ID NO: 265998 - RNA, 21 nt, Human
aggcaggaguuaggggcaggg

SEQ ID NO: 265999 - RNA, 25 nt, Human
aggcaggaguuaggggcagggucug

SEQ ID NO: 266000 - RNA, 21 nt, Human
aggcauccuccuagguucugg

SEQ ID NO: 266001 - RNA, 19 nt, Human
aggcucuggccccuuacag

SEQ ID NO: 266002 - RNA, 18 nt, Human
agguacuggagggcuggg

SEQ ID NO: 266003 - RNA, 22 nt, Human
agguacuggagggcugggggcu

SEQ ID NO: 266004 - RNA, 25 nt, Human
aguuaggggcagggucugcaauggg

SEQ ID NO: 266005 - RNA, 22 nt, Human
auagccagugaaucaggggccu

SEQ ID NO: 266006 - RNA, 24 nt, Human
aucagacccugaguaaaccggcgc

SEQ ID NO: 266007 - RNA, 24 nt, Human
caaagaccagaaauccaggcugac

SEQ ID NO: 266008 - RNA, 24 nt, Human
cacagaaauaaccaaagaccagaa

SEQ ID NO: 266009 - RNA, 20 nt, Human
cacgguuggcccagcagagc

SEQ ID NO: 266010 - RNA, 26 nt, Human
cagacccugaguaaaccaaaggcaga

SEQ ID NO: 266011 - RNA, 21 nt, Human
caucugggcaacugguguggg

SEQ ID NO: 266012 - RNA, 22 nt, Human
caugguccugccuucugcucca

SEQ ID NO: 266013 - RNA, 21 nt, Human
ccauggagaaauggcugccag

SEQ ID NO: 266014 - RNA, 19 nt, Human
cccgcggcuggacacgcgg

SEQ ID NO: 266015 - RNA, 22 nt, Human
ccucaugguccugccuucugcu

SEQ ID NO: 266016 - RNA, 23 nt, Human
ccuccugccuccucuuagugucc

SEQ ID NO: 266017 - RNA, 23 nt, Human
ccugcucucuacagggccugggg

SEQ ID NO: 266018 - RNA, 18 nt, Human
cgcggccuccucgggcug

SEQ ID NO: 266019 - RNA, 21 nt, Human
cucaugguccugccuucugcu

SEQ ID NO: 266020 - RNA, 18 nt, Human
cucccuuguaccacucuc

SEQ ID NO: 266021 - RNA, 19 nt, Human
cuguggccugcuccccgcc

SEQ ID NO: 266022 - RNA, 22 nt, Human
cuuacucucuguuaggcauccu

SEQ ID NO: 266023 - RNA, 21 nt, Human
cuuagcaaacuccuacucauc

SEQ ID NO: 266024 - RNA, 21 nt, Human
gagggcggauccauaauucau

SEQ ID NO: 266025 - RNA, 22 nt, Human
gcagcucaguguuauggggaag

SEQ ID NO: 266026 - RNA, 22 nt, Human
gcggauccauaauucaucuccu

SEQ ID NO: 266027 - RNA, 22 nt, Human
ggcccaucaagugauggggguc

SEQ ID NO: 266028 - RNA, 21 nt, Human
gggauggucuguucauagcca

SEQ ID NO: 266029 - RNA, 22 nt, Human
gggccgagccaggauuccggga

SEQ ID NO: 266030 - RNA, 23 nt, Human
gggccuaagguaacuccaacucc

SEQ ID NO: 266031 - RNA, 24 nt, Human
guggcugccugcucucuacagggc

SEQ ID NO: 266032 - RNA, 19 nt, Human
guucuguggccugcucccc

SEQ ID NO: 266033 - RNA, 21 nt, Human
uaaaccaaaggcagaggccag

SEQ ID NO: 266034 - RNA, 19 nt, Human
uaaccaaagaccagaaauc

SEQ ID NO: 266035 - RNA, 23 nt, Human
uaaccaaagaccagaaauccagg

SEQ ID NO: 266036 - RNA, 20 nt, Human
uacucucuguuaggcauccu

SEQ ID NO: 266037 - RNA, 24 nt, Human
uccaacaucagacccugaguaaac

SEQ ID NO: 266038 - RNA, 24 nt, Human
uccauaauucaucuccucuagagc

SEQ ID NO: 266039 - RNA, 23 nt, Human
uccuacucaucuuucaaaacuca

SEQ ID NO: 266040 - RNA, 20 nt, Human
uccuccaaggcucuggcccc

SEQ ID NO: 266041 - RNA, 25 nt, Human
uccuccugccuccucuuaguguccu

SEQ ID NO: 266042 - RNA, 19 nt, Human
ucuacagggccuggggccg

SEQ ID NO: 266043 - RNA, 26 nt, Human
ucugcuccacugcacagugggccaga

SEQ ID NO: 266044 - RNA, 21 nt, Human
ucuggaauguuuauccugcug

SEQ ID NO: 266045 - RNA, 21 nt, Human
ucuguucauagccagugaauc

SEQ ID NO: 266046 - RNA, 22 nt, Human
ucuuccaucuauucuuagcaaa

SEQ ID NO: 266047 - RNA, 18 nt, Human
ugaaucaggggccuaagg

SEQ ID NO: 266048 - RNA, 20 nt, Human
ugaguaaaccaaaggcagag

SEQ ID NO: 266049 - RNA, 25 nt, Human
ugcaauggguacauggcaggaggcc

SEQ ID NO: 266050 - RNA, 19 nt, Human
uggcccuggguggcguggg

SEQ ID NO: 266051 - RNA, 21 nt, Human
ugggccagacuuuugaaaguu

SEQ ID NO: 266052 - RNA, 22 nt, Human
uggggaagggaggcccagcccc

SEQ ID NO: 266053 - RNA, 19 nt, Human
uggguggcguggggagggc

SEQ ID NO: 266054 - RNA, 21 nt, Human
uguaagggcuaggguguggag

SEQ ID NO: 266055 - RNA, 23 nt, Human
uucagugauuucucugaggccac

SEQ ID NO: 266056 - RNA, 20 nt, Human
uucuggcagaagguacugga

SEQ ID NO: 266057 - RNA, 21 nt, Human
uucuggcagaagguacuggag

SEQ ID NO: 266058 - RNA, 19 nt, Human
aaaaaggcugcccuccucu

SEQ ID NO: 266059 - RNA, 22 nt, Human
accuuuccaagccacauguuuu

SEQ ID NO: 266060 - RNA, 18 nt, Human
acuguccuuggagaaugg

SEQ ID NO: 266061 - RNA, 24 nt, Human
ccaagccaugcgccacgaucagag

SEQ ID NO: 266062 - RNA, 20 nt, Human
cccaggauggagagguggcu

SEQ ID NO: 266063 - RNA, 19 nt, Human
cccuccucuugccaguguc

SEQ ID NO: 266064 - RNA, 21 nt, Human
ccuggccccaggauggagagg

SEQ ID NO: 266065 - RNA, 22 nt, Human
cucuugccaguguccacucuuc

SEQ ID NO: 266066 - RNA, 18 nt, Human
cugcauggugcccccucc

SEQ ID NO: 266067 - RNA, 22 nt, Human
gaggcugcggguuggaggaagc

SEQ ID NO: 266068 - RNA, 19 nt, Human
ggaccuuuccaagccacau

SEQ ID NO: 266069 - RNA, 20 nt, Human
ggcagagggggauuagugcu

SEQ ID NO: 266070 - RNA, 23 nt, Human
gggcagagggggauuagugcugg

SEQ ID NO: 266071 - RNA, 22 nt, Human
ggugcaaggaagcugggaaaaa

SEQ ID NO: 266072 - RNA, 21 nt, Human
uccauggugcaaggaagcugg

SEQ ID NO: 266073 - RNA, 21 nt, Human
ugacaggaauggggcauaaga

SEQ ID NO: 266074 - RNA, 18 nt, Human
ugcagagaggcugcgggu

SEQ ID NO: 266075 - RNA, 22 nt, Human
uggaggaagcuacuuuuggagg

SEQ ID NO: 266076 - RNA, 19 nt, Human
uucaggaggaagcaacugc

SEQ ID NO: 266077 - RNA, 19 nt, Human
uugggacaaggguccucuu

SEQ ID NO: 266078 - RNA, 21 nt, Human
aaacacugaccagaaaaaaca

SEQ ID NO: 266079 - RNA, 23 nt, Human
aaacagaaaagcuagaaacaaag

SEQ ID NO: 266080 - RNA, 22 nt, Human
aaacagaaaagcuagaaacaau

SEQ ID NO: 266081 - RNA, 19 nt, Human
aaaccccuaggucucaacc

SEQ ID NO: 266082 - RNA, 24 nt, Human
aaccucugccuccaagcgauucuc

SEQ ID NO: 266083 - RNA, 23 nt, Human
aagaaucccaaaugaagccaaca

SEQ ID NO: 266084 - RNA, 18 nt, Human
aagcaccccaaacagaaa

SEQ ID NO: 266085 - RNA, 23 nt, Human
aagcaccccaaacagaaaagcua

SEQ ID NO: 266086 - RNA, 24 nt, Human
aagcaccccaaacagaaaagcuag

SEQ ID NO: 266087 - RNA, 31 nt, Human
aagcaccccaaacagaaaagcuagaaacaag

SEQ ID NO: 266088 - RNA, 19 nt, Human
aagccaaucccagauaagg

SEQ ID NO: 266089 - RNA, 25 nt, Human
aagcgauucuccugccucagccucc

SEQ ID NO: 266090 - RNA, 25 nt, Human
aaggaucagcaaagacacagugagc

SEQ ID NO: 266091 - RNA, 19 nt, Human
aaguaguugggauuauagg

SEQ ID NO: 266092 - RNA, 21 nt, Human
aaguguugggauuauaggugu

SEQ ID NO: 266093 - RNA, 23 nt, Human
aaguguugggauuauagguguga

SEQ ID NO: 266094 - RNA, 26 nt, Human
aaguguugggauuauaggugugagcc

SEQ ID NO: 266095 - RNA, 18 nt, Human
acaggguuuugccauguu

SEQ ID NO: 266096 - RNA, 21 nt, Human
acaggguuuugccauguuggc

SEQ ID NO: 266097 - RNA, 24 nt, Human
acaggguuuugccauguuggccag

SEQ ID NO: 266098 - RNA, 24 nt, Human
accccaaacagaaaagcuagaaac

SEQ ID NO: 266099 - RNA, 24 nt, Human
acccgggcuggagugcaguggcgu

SEQ ID NO: 266100 - RNA, 18 nt, Human
accugccuccgccucccu

SEQ ID NO: 266101 - RNA, 20 nt, Human
acucugucaccaaguucuga

SEQ ID NO: 266102 - RNA, 18 nt, Human
agacaggguuuugccaug

SEQ ID NO: 266103 - RNA, 21 nt, Human
agagaagcaccccaaacagaa

SEQ ID NO: 266104 - RNA, 23 nt, Human
agagaagcaccccaaacagaaaa

SEQ ID NO: 266105 - RNA, 19 nt, Human
agcaaagacacagugagcu

SEQ ID NO: 266106 - RNA, 25 nt, Human
agcaaagacacagugagcuccacaa

SEQ ID NO: 266107 - RNA, 18 nt, Human
agcaccccaaacagaaaa

SEQ ID NO: 266108 - RNA, 24 nt, Human
agcgauucuccugccucagccucc

SEQ ID NO: 266109 - RNA, 21 nt, Human
aggucccugccaccacgccca

SEQ ID NO: 266110 - RNA, 21 nt, Human
aggugugagccaccacgccca

SEQ ID NO: 266111 - RNA, 18 nt, Human
aguaagugaaugaaugaa

SEQ ID NO: 266112 - RNA, 22 nt, Human
aguagagacaggguuuugccau

SEQ ID NO: 266113 - RNA, 19 nt, Human
agugcaguggcgugaccuc

SEQ ID NO: 266114 - RNA, 20 nt, Human
agugcaguggcgugaccucg

SEQ ID NO: 266115 - RNA, 23 nt, Human
agugcaguggcgugaccucggcu

SEQ ID NO: 266116 - RNA, 24 nt, Human
agugcaguggcgugaccucggcuc

SEQ ID NO: 266117 - RNA, 24 nt, Human
auugucacccgggcuggagugcag

SEQ ID NO: 266118 - RNA, 24 nt, Human
auuuuuauauuuuuaguagagaca

SEQ ID NO: 266119 - RNA, 21 nt, Human
caagaaucccaaaugaagcca

SEQ ID NO: 266120 - RNA, 22 nt, Human
caagcgauucuccugccucagc

SEQ ID NO: 266121 - RNA, 21 nt, Human
caaucccagauaagguauuau

SEQ ID NO: 266122 - RNA, 24 nt, Human
caaucucacuuccuuugcugaagg

SEQ ID NO: 266123 - RNA, 27 nt, Human
caccccaaacagaaaagcuagaaacaa

SEQ ID NO: 266124 - RNA, 24 nt, Human
cacccgggcuggagugcaguggcg

SEQ ID NO: 266125 - RNA, 18 nt, Human
cacugcaaccucugccuc

SEQ ID NO: 266126 - RNA, 26 nt, Human
cagcaaagacacagugagcuccacag

SEQ ID NO: 266127 - RNA, 24 nt, Human
caggguuuugccauguuggccagg

SEQ ID NO: 266128 - RNA, 24 nt, Human
cauguuggccaggcuagucucgaa

SEQ ID NO: 266129 - RNA, 22 nt, Human
cauuacuuucuccaggccuaca

SEQ ID NO: 266130 - RNA, 19 nt, Human
cauugcaggcacucgagga

SEQ ID NO: 266131 - RNA, 22 nt, Human
ccaaacagaaaagcuagaaaca

SEQ ID NO: 266132 - RNA, 20 nt, Human
ccaccacgcccagcuaauuu

SEQ ID NO: 266133 - RNA, 19 nt, Human
ccauguuggccaggcuagu

SEQ ID NO: 266134 - RNA, 22 nt, Human
ccauguuggccaggcuagucuc

SEQ ID NO: 266135 - RNA, 23 nt, Human
ccauguuggccaggcuagucucg

SEQ ID NO: 266136 - RNA, 22 nt, Human
cccaaguaguugggauuauagg

SEQ ID NO: 266137 - RNA, 23 nt, Human
cccaaguaguugggauuauaggu

SEQ ID NO: 266138 - RNA, 22 nt, Human
cccauugcaggcacucgaggag

SEQ ID NO: 266139 - RNA, 25 nt, Human
ccccuuauuguccccauccagggac

SEQ ID NO: 266140 - RNA, 23 nt, Human
ccuaaguguugggauuauaggug

SEQ ID NO: 266141 - RNA, 24 nt, Human
ccuaaguguugggauuauaggugu

SEQ ID NO: 266142 - RNA, 20 nt, Human
ccucucacagggaagaaaaa

SEQ ID NO: 266143 - RNA, 21 nt, Human
ccugaccugaggugauccacc

SEQ ID NO: 266144 - RNA, 23 nt, Human
ccugaccugaggugauccaccug

SEQ ID NO: 266145 - RNA, 24 nt, Human
ccugccucagccucccaaguaguu

SEQ ID NO: 266146 - RNA, 18 nt, Human
cuaggucucaaccacuga

SEQ ID NO: 266147 - RNA, 24 nt, Human
cucacugcaaccucugccuccaag

SEQ ID NO: 266148 - RNA, 24 nt, Human
cucagccucccaaguaguugggau

SEQ ID NO: 266149 - RNA, 24 nt, Human
cucugccuccaagcgauucuccug

SEQ ID NO: 266150 - RNA, 24 nt, Human
cugaccagaaaaaacacuugcauu

SEQ ID NO: 266151 - RNA, 19 nt, Human
cugcaaccucugccuccaa

SEQ ID NO: 266152 - RNA, 20 nt, Human
cugcaaccucugccuccaag

SEQ ID NO: 266153 - RNA, 21 nt, Human
cugcaaccucugccuccaagc

SEQ ID NO: 266154 - RNA, 25 nt, Human
cuuuuuuacuuucuuauuuuagggg

SEQ ID NO: 266155 - RNA, 18 nt, Human
gaagcaccccaaacagaa

SEQ ID NO: 266156 - RNA, 19 nt, Human
gaagucccccugaacugac

SEQ ID NO: 266157 - RNA, 19 nt, Human
gacaggguuuugccauguu

SEQ ID NO: 266158 - RNA, 19 nt, Human
gaccucggcucacugcaac

SEQ ID NO: 266159 - RNA, 24 nt, Human
gaccugaggugauccaccugccuc

SEQ ID NO: 266160 - RNA, 22 nt, Human
gagcucaaggaagucccccuga

SEQ ID NO: 266161 - RNA, 18 nt, Human
gauuauaggugugagcca

SEQ ID NO: 266162 - RNA, 21 nt, Human
gauuauaggugugagccacca

SEQ ID NO: 266163 - RNA, 22 nt, Human
gauuauaggugugagccaccac

SEQ ID NO: 266164 - RNA, 24 nt, Human
gcaaaacacugaccagaaaaaaca

SEQ ID NO: 266165 - RNA, 24 nt, Human
gcgauucuccugccucagccuccc

SEQ ID NO: 266166 - RNA, 19 nt, Human
gcuggagugcaguggcgug

SEQ ID NO: 266167 - RNA, 21 nt, Human
gcuugcccauugcaggcacuc

SEQ ID NO: 266168 - RNA, 22 nt, Human
ggguuuugccauguuggccagg

SEQ ID NO: 266169 - RNA, 21 nt, Human
ggugaaacuucagagcucaag

SEQ ID NO: 266170 - RNA, 23 nt, Human
guagagacaggguuuugccaugu

SEQ ID NO: 266171 - RNA, 24 nt, Human
gugauccaccugccuccgccuccc

SEQ ID NO: 266172 - RNA, 19 nt, Human
guggcccagcacacggcuc

SEQ ID NO: 266173 - RNA, 24 nt, Human
uaauuuuuauauuuuuaguagaga

SEQ ID NO: 266174 - RNA, 24 nt, Human
uagaacaagaaucccaaaugaagc

SEQ ID NO: 266175 - RNA, 22 nt, Human
uagagacaggguuuugccaugu

SEQ ID NO: 266176 - RNA, 19 nt, Human
uaggucccugccaccacgc

SEQ ID NO: 266177 - RNA, 24 nt, Human
uaguagagacaggguuuugccaug

SEQ ID NO: 266178 - RNA, 22 nt, Human
ucacccgggcuggagugcagug

SEQ ID NO: 266179 - RNA, 20 nt, Human
ucacucugacucuugcaucc

SEQ ID NO: 266180 - RNA, 19 nt, Human
ucacugcaaccucugccuc

SEQ ID NO: 266181 - RNA, 23 nt, Human
ucacugcaaccucugccuccaag

SEQ ID NO: 266182 - RNA, 24 nt, Human
uccaagcgauucuccugccucagc

SEQ ID NO: 266183 - RNA, 23 nt, Human
ucccaaguaguugggauuauagg

SEQ ID NO: 266184 - RNA, 24 nt, Human
ucccaaguaguugggauuauaggu

SEQ ID NO: 266185 - RNA, 18 nt, Human
uccccauccagggacaga

SEQ ID NO: 266186 - RNA, 24 nt, Human
uccccauccagggacagaucccuc

SEQ ID NO: 266187 - RNA, 18 nt, Human
ucccccugaacugacccc

SEQ ID NO: 266188 - RNA, 23 nt, Human
ucccuaaguguugggauuauagg

SEQ ID NO: 266189 - RNA, 19 nt, Human
ucuccugccucagccuccc

SEQ ID NO: 266190 - RNA, 24 nt, Human
ucuuguauugucacccgggcugga

SEQ ID NO: 266191 - RNA, 25 nt, Human
ucuuguauugucacccgggcuggag

SEQ ID NO: 266192 - RNA, 21 nt, Human
ugaaugaaguauacacaaaug

SEQ ID NO: 266193 - RNA, 20 nt, Human
ugaccagaaaaaacacuugc

SEQ ID NO: 266194 - RNA, 24 nt, Human
ugaccugaggugauccaccugccu

SEQ ID NO: 266195 - RNA, 20 nt, Human
ugagccaccacgcccagccc

SEQ ID NO: 266196 - RNA, 22 nt, Human
ugcaaaacacugaccagaaaaa

SEQ ID NO: 266197 - RNA, 24 nt, Human
ugcaaaacacugaccagaaaaaac

SEQ ID NO: 266198 - RNA, 20 nt, Human
ugcaaaacacugaccagaag

SEQ ID NO: 266199 - RNA, 20 nt, Human
ugcaguggcgugaccucggc

SEQ ID NO: 266200 - RNA, 24 nt, Human
ugccauguuggccaggcuagucuc

SEQ ID NO: 266201 - RNA, 24 nt, Human
ugccucagccucccaaguaguugg

SEQ ID NO: 266202 - RNA, 24 nt, Human
ugccuccaagcgauucuccugccu

SEQ ID NO: 266203 - RNA, 24 nt, Human
ugcuuuaggaaucauuacuuucuc

SEQ ID NO: 266204 - RNA, 23 nt, Human
uggagugcaguggcgugaccucg

SEQ ID NO: 266205 - RNA, 24 nt, Human
uggagugcaguggcgugaccucgg

SEQ ID NO: 266206 - RNA, 24 nt, Human
uggccaggcuagucucgaauuccu

SEQ ID NO: 266207 - RNA, 24 nt, Human
ugggauuauaggucccugccacca

SEQ ID NO: 266208 - RNA, 18 nt, Human
ugggauuauaggugugag

SEQ ID NO: 266209 - RNA, 19 nt, Human
ugggauuauaggugugagc

SEQ ID NO: 266210 - RNA, 22 nt, Human
ugggauuauaggugugagccac

SEQ ID NO: 266211 - RNA, 23 nt, Human
ugggauuauaggugugagccacc

SEQ ID NO: 266212 - RNA, 24 nt, Human
ugggauuauaggugugagccacca

SEQ ID NO: 266213 - RNA, 24 nt, Human
ugucaccaaguucugaaucuccca

SEQ ID NO: 266214 - RNA, 24 nt, Human
uuaguagagacaggguuuugccau

SEQ ID NO: 266215 - RNA, 18 nt, Human
uugcauuuuguuuuuuaa

SEQ ID NO: 266216 - RNA, 24 nt, Human
uugccauguuggccaggcuagucu

SEQ ID NO: 266217 - RNA, 21 nt, Human
uugggauuauaggugugagcc

SEQ ID NO: 266218 - RNA, 24 nt, Human
uuguauugucacccgggcuggagu

SEQ ID NO: 266219 - RNA, 23 nt, Human
uuuauauuuuuaguagagacagg

SEQ ID NO: 266220 - RNA, 24 nt, Human
uuuauauuuuuaguagagacaggg

SEQ ID NO: 266221 - RNA, 19 nt, Human
uuuuaagaaggucuuucua

SEQ ID NO: 266222 - RNA, 21 nt, Human
uuuuuaguagagacaggguuu

SEQ ID NO: 266223 - RNA, 21 nt, Human
uuuuuaguagagacaggguuu

SEQ ID NO: 266224 - RNA, 20 nt, Human
uuuuuauauuuuuaguagag

SEQ ID NO: 266225 - RNA, 24 nt, Human
aaaccugcaacacgaggcccuugg

SEQ ID NO: 266226 - RNA, 19 nt, Human
aaagugcugggguuacagg

SEQ ID NO: 266227 - RNA, 24 nt, Human
aaagugcugggguuacaggcguga

SEQ ID NO: 266228 - RNA, 21 nt, Human
aaccucagagaaaaccucagc

SEQ ID NO: 266229 - RNA, 19 nt, Human
aagaagggggcaggcaagg

SEQ ID NO: 266230 - RNA, 18 nt, Human
aagacaugauguggguuu

SEQ ID NO: 266231 - RNA, 19 nt, Human
aagugcugggguuacaggc

SEQ ID NO: 266232 - RNA, 26 nt, Human
aagugcugggguuacaggcgugagcc

SEQ ID NO: 266233 - RNA, 21 nt, Human
aagugucagcagugggcugag

SEQ ID NO: 266234 - RNA, 24 nt, Human
aauuuuguauuuuuacuagaggcg

SEQ ID NO: 266235 - RNA, 21 nt, Human
accugccguaugaccgugggc

SEQ ID NO: 266236 - RNA, 18 nt, Human
agaaaagcaaagcauugg

SEQ ID NO: 266237 - RNA, 20 nt, Human
agaaagaagggggcaggcaa

SEQ ID NO: 266238 - RNA, 20 nt, Human
agacagaaagacaaggugcc

SEQ ID NO: 266239 - RNA, 24 nt, Human
agacagaaagacaaggugccaagg

SEQ ID NO: 266240 - RNA, 18 nt, Human
agacagguaaacagacag

SEQ ID NO: 266241 - RNA, 26 nt, Human
agacagguaaacagacagaagggacc

SEQ ID NO: 266242 - RNA, 20 nt, Human
agagggcaccagagcccagc

SEQ ID NO: 266243 - RNA, 21 nt, Human
agcaaaaguucccuucucuca

SEQ ID NO: 266244 - RNA, 23 nt, Human
agcagggagaagcagcagaagga

SEQ ID NO: 266245 - RNA, 19 nt, Human
agcugggcagcccccaggc

SEQ ID NO: 266246 - RNA, 22 nt, Human
agcugggcagcccccaggcccu

SEQ ID NO: 266247 - RNA, 23 nt, Human
aggcagcugggcagcccccaggc

SEQ ID NO: 266248 - RNA, 24 nt, Human
aggucagguuggucucgaaauccu

SEQ ID NO: 266249 - RNA, 23 nt, Human
aggugggcuucggggugucccug

SEQ ID NO: 266250 - RNA, 19 nt, Human
aguagcugggauuagaggc

SEQ ID NO: 266251 - RNA, 24 nt, Human
aguagggcuggcauggcucgcucu

SEQ ID NO: 266252 - RNA, 24 nt, Human
agugauucuccugccucagccucc

SEQ ID NO: 266253 - RNA, 20 nt, Human
agugcagugguguacucuug

SEQ ID NO: 266254 - RNA, 23 nt, Human
agugcagugguguacucuuggcu

SEQ ID NO: 266255 - RNA, 24 nt, Human
agugcagugguguacucuuggcuc

SEQ ID NO: 266256 - RNA, 18 nt, Human
aguggcagugaggcacgc

SEQ ID NO: 266257 - RNA, 21 nt, Human
aguuucuccauguaggucagg

SEQ ID NO: 266258 - RNA, 25 nt, Human
auaaagcaucaaaaaaaccucagag

SEQ ID NO: 266259 - RNA, 24 nt, Human
auagaggcagcugggcagccccca

SEQ ID NO: 266260 - RNA, 26 nt, Human
auccugaccucagguuaucugcccgu

SEQ ID NO: 266261 - RNA, 24 nt, Human
caaagugcugggguuacaggcgug

SEQ ID NO: 266262 - RNA, 21 nt, Human
caaccucucggcuacauuccu

SEQ ID NO: 266263 - RNA, 19 nt, Human
caaggccagccccgucccc

SEQ ID NO: 266264 - RNA, 20 nt, Human
caagugauucuccugccuca

SEQ ID NO: 266265 - RNA, 22 nt, Human
caagugauucuccugccucagc

SEQ ID NO: 266266 - RNA, 22 nt, Human
caccaccaugcccggcuaauuu

SEQ ID NO: 266267 - RNA, 22 nt, Human
cacccgaaccccgucacugccc

SEQ ID NO: 266268 - RNA, 19 nt, Human
cacuccugggguagcuccu

SEQ ID NO: 266269 - RNA, 23 nt, Human
cacugcaaccuccacuucccggg

SEQ ID NO: 266270 - RNA, 20 nt, Human
cacugccucaaacugggaug

SEQ ID NO: 266271 - RNA, 20 nt, Human
cagagcccagcccacacaac

SEQ ID NO: 266272 - RNA, 24 nt, Human
cagagcccagcccacacaaccucu

SEQ ID NO: 266273 - RNA, 24 nt, Human
cagcacugccucaaacugggauga

SEQ ID NO: 266274 - RNA, 23 nt, Human
cagcagugggcugagacccccag

SEQ ID NO: 266275 - RNA, 24 nt, Human
cagcugggcagcccccaggcccuu

SEQ ID NO: 266276 - RNA, 25 nt, Human
caggaggugggagauugcagguggg

SEQ ID NO: 266277 - RNA, 19 nt, Human
cagggagacagguaaacag

SEQ ID NO: 266278 - RNA, 18 nt, Human
cauucuuaaggcagaaag

SEQ ID NO: 266279 - RNA, 19 nt, Human
cauugggcguugggagggu

SEQ ID NO: 266280 - RNA, 20 nt, Human
ccaaagugcugggguuacag

SEQ ID NO: 266281 - RNA, 22 nt, Human
ccaaagugcugggguuacaggc

SEQ ID NO: 266282 - RNA, 22 nt, Human
ccaaagugcugggguuacaggc

SEQ ID NO: 266283 - RNA, 24 nt, Human
ccaaagugcugggguuacaggcgu

SEQ ID NO: 266284 - RNA, 22 nt, Human
ccaccugguggcucccagggcc

SEQ ID NO: 266285 - RNA, 23 nt, Human
ccauguaggucagguuggucucg

SEQ ID NO: 266286 - RNA, 19 nt, Human
cccaggcuggagugcagug

SEQ ID NO: 266287 - RNA, 20 nt, Human
cccaggcuggagugcagugg

SEQ ID NO: 266288 - RNA, 18 nt, Human
ccccacgcucccaugcca

SEQ ID NO: 266289 - RNA, 24 nt, Human
ccccacuccagcacugccucaaaa

SEQ ID NO: 266290 - RNA, 25 nt, Human
ccccacuccagcacugccucaaaag

SEQ ID NO: 266291 - RNA, 23 nt, Human
cccccaggcccuugaggguagga

SEQ ID NO: 266292 - RNA, 19 nt, Human
cccgaguagcugggauuag

SEQ ID NO: 266293 - RNA, 23 nt, Human
cccggguucaagugauucuccuc

SEQ ID NO: 266294 - RNA, 23 nt, Human
cccggguucaagugauucuccug

SEQ ID NO: 266295 - RNA, 18 nt, Human
cccgucuccgccucccaa

SEQ ID NO: 266296 - RNA, 24 nt, Human
cccuugaggguaggagcagggaga

SEQ ID NO: 266297 - RNA, 22 nt, Human
ccgcuccucccaaggccagccc

SEQ ID NO: 266298 - RNA, 24 nt, Human
ccgucuccgccucccaaagugcug

SEQ ID NO: 266299 - RNA, 20 nt, Human
ccuauaaagcaucaaaaaaa

SEQ ID NO: 266300 - RNA, 23 nt, Human
ccugccucagccucccgaguagc

SEQ ID NO: 266301 - RNA, 18 nt, Human
ccuggcucugggaguggc

SEQ ID NO: 266302 - RNA, 21 nt, Human
ccuggcuuuccuauugcugug

SEQ ID NO: 266303 - RNA, 20 nt, Human
cgaaccccgucacugcccag

SEQ ID NO: 266304 - RNA, 24 nt, Human
cgcucuguugcccaggcuggagug

SEQ ID NO: 266305 - RNA, 24 nt, Human
cggagucucgcucuguugcccagg

SEQ ID NO: 266306 - RNA, 23 nt, Human
cggaguuucuccauguaggucag

SEQ ID NO: 266307 - RNA, 22 nt, Human
cggccuggcccacuccuggggu

SEQ ID NO: 266308 - RNA, 23 nt, Human
cgugcaccaccaugcccggcuaa

SEQ ID NO: 266309 - RNA, 24 nt, Human
cucacugcaaccuccacuucccgg

SEQ ID NO: 266310 - RNA, 23 nt, Human
cucagccucccgaguagcuggga

SEQ ID NO: 266311 - RNA, 24 nt, Human
cucgcucuguugcccaggcuggag

SEQ ID NO: 266312 - RNA, 21 nt, Human
cucucaaauauuuggcaucgg

SEQ ID NO: 266313 - RNA, 23 nt, Human
cucuguugcccaggcuggagugc

SEQ ID NO: 266314 - RNA, 23 nt, Human
cugcaaccuccacuucccggguu

SEQ ID NO: 266315 - RNA, 19 nt, Human
cugcccggccggccuggcg

SEQ ID NO: 266316 - RNA, 22 nt, Human
cugcccggccggccuggcgccc

SEQ ID NO: 266317 - RNA, 23 nt, Human
cugccucagccucccgaguagcu

SEQ ID NO: 266318 - RNA, 18 nt, Human
cuggaaguucgagucuuu

SEQ ID NO: 266319 - RNA, 21 nt, Human
cuucccggguucaagugauuc

SEQ ID NO: 266320 - RNA, 24 nt, Human
cuucccggguucaagugauucucc

SEQ ID NO: 266321 - RNA, 18 nt, Human
gaaagaagggggcaggca

SEQ ID NO: 266322 - RNA, 24 nt, Human
gaccucagguuaucugcccgucuc

SEQ ID NO: 266323 - RNA, 21 nt, Human
gaggacaguaaaagggcguuc

SEQ ID NO: 266324 - RNA, 20 nt, Human
gaggcggaguuucuccaugu

SEQ ID NO: 266325 - RNA, 24 nt, Human
gauuagaggcgugcaccaccaugc

SEQ ID NO: 266326 - RNA, 22 nt, Human
gcaaccuccacuucccggguuc

SEQ ID NO: 266327 - RNA, 19 nt, Human
gcaucaaaaaaaccucaga

SEQ ID NO: 266328 - RNA, 19 nt, Human
gccuuccggggcccucuuc

SEQ ID NO: 266329 - RNA, 25 nt, Human
gcuggagucagggaaaacacaucca

SEQ ID NO: 266330 - RNA, 23 nt, Human
ggacaguaaaagggcguucuuuu

SEQ ID NO: 266331 - RNA, 23 nt, Human
ggagucucgcucuguugcccagg

SEQ ID NO: 266332 - RNA, 20 nt, Human
ggaugaucucucagcgucuu

SEQ ID NO: 266333 - RNA, 23 nt, Human
ggauugcagaagugucagcagug

SEQ ID NO: 266334 - RNA, 25 nt, Human
ggcaggaggugggagauuggggacc

SEQ ID NO: 266335 - RNA, 24 nt, Human
ggcccuggcuuuccuauugcugug

SEQ ID NO: 266336 - RNA, 22 nt, Human
ggcguucuuuuuuuuuuuuuuu

SEQ ID NO: 266337 - RNA, 20 nt, Human
ggcucgcucuggcccuggcu

SEQ ID NO: 266338 - RNA, 20 nt, Human
ggcugcaaaagaugcagaug

SEQ ID NO: 266339 - RNA, 18 nt, Human
ggcuggaugaucucucag

SEQ ID NO: 266340 - RNA, 20 nt, Human
gggaagagggcaccagagcc

SEQ ID NO: 266341 - RNA, 19 nt, Human
gggcaggaggugggagauu

SEQ ID NO: 266342 - RNA, 22 nt, Human
gggcaggcaaggguggucucag

SEQ ID NO: 266343 - RNA, 22 nt, Human
gggccagaaaaggcccuacauc

SEQ ID NO: 266344 - RNA, 20 nt, Human
ggguagcuccuggccccugc

SEQ ID NO: 266345 - RNA, 24 nt, Human
ggguuacaggcgugagccaccaug

SEQ ID NO: 266346 - RNA, 22 nt, Human
ggguucaagugauucuccugcc

SEQ ID NO: 266347 - RNA, 18 nt, Human
gguuacaggcgugagcca

SEQ ID NO: 266348 - RNA, 24 nt, Human
gguuacaggcgugagccaccaugc

SEQ ID NO: 266349 - RNA, 24 nt, Human
gugauucuccugccucagccuccc

SEQ ID NO: 266350 - RNA, 24 nt, Human
uaaacagacagaaagacaaggugc

SEQ ID NO: 266351 - RNA, 22 nt, Human
uaagacggagucucgcucuguu

SEQ ID NO: 266352 - RNA, 22 nt, Human
uaaggagaccacauuggcaaac

SEQ ID NO: 266353 - RNA, 23 nt, Human
uaauuuuguauuuuuacuagagg

SEQ ID NO: 266354 - RNA, 24 nt, Human
uacaggcgugagccaccaugccca

SEQ ID NO: 266355 - RNA, 24 nt, Human
uagcuccuggccccugcugcuccc

SEQ ID NO: 266356 - RNA, 24 nt, Human
uaggagcagggagaagcagcagaa

SEQ ID NO: 266357 - RNA, 18 nt, Human
uauaaagcaucaaaaaaa

SEQ ID NO: 266358 - RNA, 19 nt, Human
ucaagugauucuccugccu

SEQ ID NO: 266359 - RNA, 24 nt, Human
ucacugcaaccuccacuucccggg

SEQ ID NO: 266360 - RNA, 25 nt, Human
ucacugcaaccuccacuucccgggu

SEQ ID NO: 266361 - RNA, 18 nt, Human
ucagagugggcugcaaaa

SEQ ID NO: 266362 - RNA, 20 nt, Human
ucagccucccgaguagcugg

SEQ ID NO: 266363 - RNA, 18 nt, Human
uccacuguguccuugggu

SEQ ID NO: 266364 - RNA, 24 nt, Human
ucccaaagugcugggguuacaggc

SEQ ID NO: 266365 - RNA, 18 nt, Human
ucccaugccagggagggg

SEQ ID NO: 266366 - RNA, 24 nt, Human
ucccgaguagcugggauuagaggc

SEQ ID NO: 266367 - RNA, 21 nt, Human
ucccggguucaagugauucuc

SEQ ID NO: 266368 - RNA, 24 nt, Human
ucccggguucaagugauucuccug

SEQ ID NO: 266369 - RNA, 19 nt, Human
uccuggccagggaagaggg

SEQ ID NO: 266370 - RNA, 21 nt, Human
uccuugggugggaaauggcuu

SEQ ID NO: 266371 - RNA, 24 nt, Human
ucgcucuguugcccaggcuggagu

SEQ ID NO: 266372 - RNA, 24 nt, Human
ucuccugccucagccucccgagua

SEQ ID NO: 266373 - RNA, 19 nt, Human
ucucgcucuguugcccagg

SEQ ID NO: 266374 - RNA, 23 nt, Human
ucucgcucuguugcccaggcugg

SEQ ID NO: 266375 - RNA, 24 nt, Human
ucucgcucuguugcccaggcugga

SEQ ID NO: 266376 - RNA, 26 nt, Human
ucucgcucuguugcccaggcuggagu

SEQ ID NO: 266377 - RNA, 27 nt, Human
ucucgcucuguugcccaggcuggagug

SEQ ID NO: 266378 - RNA, 18 nt, Human
ucuguugcccaggcugga

SEQ ID NO: 266379 - RNA, 24 nt, Human
ucuguugcccaggcuggagugcag

SEQ ID NO: 266380 - RNA, 20 nt, Human
ucuugguuuuguggcaaccu

SEQ ID NO: 266381 - RNA, 18 nt, Human
ugaccucagguuaucugc

SEQ ID NO: 266382 - RNA, 24 nt, Human
ugaccucagguuaucugcccgucu

SEQ ID NO: 266383 - RNA, 23 nt, Human
ugaggaagggcugccaucuuggu

SEQ ID NO: 266384 - RNA, 23 nt, Human
ugaggacaguaaaagggcguucu

SEQ ID NO: 266385 - RNA, 20 nt, Human
ugauucuccugccucagccu

SEQ ID NO: 266386 - RNA, 22 nt, Human
ugcagugguguacucuuggcuc

SEQ ID NO: 266387 - RNA, 18 nt, Human
ugcccaggcuggagugca

SEQ ID NO: 266388 - RNA, 21 nt, Human
ugcccaggcuggagugcagug

SEQ ID NO: 266389 - RNA, 24 nt, Human
ugcccaggcuggagugcaguggug

SEQ ID NO: 266390 - RNA, 23 nt, Human
ugcccggcuaauuuuguauuuuu

SEQ ID NO: 266391 - RNA, 19 nt, Human
ugccguaugaccgugggca

SEQ ID NO: 266392 - RNA, 18 nt, Human
ugccucaaacugggauga

SEQ ID NO: 266393 - RNA, 24 nt, Human
ugccucagccucccgaguagcugg

SEQ ID NO: 266394 - RNA, 21 nt, Human
ugcucccucaagagagggaug

SEQ ID NO: 266395 - RNA, 21 nt, Human
ugcucuguaacaucaaggggc

SEQ ID NO: 266396 - RNA, 20 nt, Human
uggagugcagugguguacuc

SEQ ID NO: 266397 - RNA, 21 nt, Human
uggagugcagugguguacucu

SEQ ID NO: 266398 - RNA, 24 nt, Human
uggagugcagugguguacucuugg

SEQ ID NO: 266399 - RNA, 21 nt, Human
uggaugaucucucagcgucuu

SEQ ID NO: 266400 - RNA, 22 nt, Human
uggcagugaggcacgcugagga

SEQ ID NO: 266401 - RNA, 22 nt, Human
uggcauggcucgcucuggcccu

SEQ ID NO: 266402 - RNA, 20 nt, Human
uggcccacuccugggguagc

SEQ ID NO: 266403 - RNA, 19 nt, Human
ugggaggguccagugggcg

SEQ ID NO: 266404 - RNA, 19 nt, Human
ugggaguggcagugaggca

SEQ ID NO: 266405 - RNA, 24 nt, Human
ugggauuagaggcgugcaccacca

SEQ ID NO: 266406 - RNA, 25 nt, Human
ugggauuagaggcgugcaccaccau

SEQ ID NO: 266407 - RNA, 18 nt, Human
ugggguuacaggcgugag

SEQ ID NO: 266408 - RNA, 22 nt, Human
ugggguuacaggcgugagccac

SEQ ID NO: 266409 - RNA, 23 nt, Human
ugggguuacaggcgugagccacc

SEQ ID NO: 266410 - RNA, 24 nt, Human
ugggguuacaggcgugagccacca

SEQ ID NO: 266411 - RNA, 25 nt, Human
ugggguuacaggcgugagccaccau

SEQ ID NO: 266412 - RNA, 24 nt, Human
uguacucuuggcucacugcaaccu

SEQ ID NO: 266413 - RNA, 22 nt, Human
ugucaucccaaggccuggacuc

SEQ ID NO: 266414 - RNA, 19 nt, Human
uguccuggccagggaagag

SEQ ID NO: 266415 - RNA, 23 nt, Human
uguccuugggugggaaauggcuu

SEQ ID NO: 266416 - RNA, 21 nt, Human
ugugcgggcaagcugucuguc

SEQ ID NO: 266417 - RNA, 19 nt, Human
uuacaggcgugagccacca

SEQ ID NO: 266418 - RNA, 26 nt, Human
uuauggggcucccuggcucugggagu

SEQ ID NO: 266419 - RNA, 21 nt, Human
uucaagugauucuccugccuc

SEQ ID NO: 266420 - RNA, 23 nt, Human
uucaagugauucuccugccucag

SEQ ID NO: 266421 - RNA, 24 nt, Human
uucaagugauucuccugccucagc

SEQ ID NO: 266422 - RNA, 21 nt, Human
uucuuuuuuuuuuuuuuuaag

SEQ ID NO: 266423 - RNA, 24 nt, Human
uugcccaggcuggagugcaguggu

SEQ ID NO: 266424 - RNA, 18 nt, Human
uugggcaucugucuucug

SEQ ID NO: 266425 - RNA, 21 nt, Human
uugguugccuuccggggcccu

SEQ ID NO: 266426 - RNA, 19 nt, Human
uuuuguauuuuuacuagag

SEQ ID NO: 266427 - RNA, 25 nt, Human
uuuuuuuuuuuuaagacggagucuc

SEQ ID NO: 266428 - RNA, 22 nt, Human
uuuuuuuuuuuuuuaagacgga

SEQ ID NO: 266429 - RNA, 18 nt, Human
aaagaacccaaacccagg

SEQ ID NO: 266430 - RNA, 18 nt, Human
aaagaacccaaacccagg

SEQ ID NO: 266431 - RNA, 18 nt, Human
aagaacccaaacccaggc

SEQ ID NO: 266432 - RNA, 21 nt, Human
aagaacccaaacccaggcccu

SEQ ID NO: 266433 - RNA, 21 nt, Human
aaggguucccaaggacaggau

SEQ ID NO: 266434 - RNA, 19 nt, Human
aagugcuuguccuguggcc

SEQ ID NO: 266435 - RNA, 22 nt, Human
aauaaguggaaggagagaggaa

SEQ ID NO: 266436 - RNA, 19 nt, Human
acaccgagacggagacggc

SEQ ID NO: 266437 - RNA, 18 nt, Human
accaaaccauaaaauugc

SEQ ID NO: 266438 - RNA, 18 nt, Human
acccaaacccaggcccuc

SEQ ID NO: 266439 - RNA, 24 nt, Human
acucugcuggaugggcuguuccgc

SEQ ID NO: 266440 - RNA, 25 nt, Human
acucugcuggaugggcuguuccgcu

SEQ ID NO: 266441 - RNA, 22 nt, Human
acuguccucuccagagcggugg

SEQ ID NO: 266442 - RNA, 21 nt, Human
agagaggaaguuccaguuaga

SEQ ID NO: 266443 - RNA, 24 nt, Human
agcaacccugcaaacggugaaagu

SEQ ID NO: 266444 - RNA, 18 nt, Human
agcgcgggggcucaggug

SEQ ID NO: 266445 - RNA, 21 nt, Human
agcgggaggugguccagaggg

SEQ ID NO: 266446 - RNA, 19 nt, Human
aggaaguuccaguuagaug

SEQ ID NO: 266447 - RNA, 27 nt, Human
aggcacaggaggcugcacacaggcacu

SEQ ID NO: 266448 - RNA, 22 nt, Human
aggcuccccucauccucucacc

SEQ ID NO: 266449 - RNA, 18 nt, Human
agggauggggagugggca

SEQ ID NO: 266450 - RNA, 19 nt, Human
auaccaaaggcagaaaacc

SEQ ID NO: 266451 - RNA, 23 nt, Human
auccccaccccuucccucugcag

SEQ ID NO: 266452 - RNA, 24 nt, Human
caaacccaggcccuccuccugccc

SEQ ID NO: 266453 - RNA, 19 nt, Human
caaggcaccauccaaaggc

SEQ ID NO: 266454 - RNA, 19 nt, Human
caaggcaccauccaaaggc

SEQ ID NO: 266455 - RNA, 24 nt, Human
cagagugggguccugcauccccac

SEQ ID NO: 266456 - RNA, 18 nt, Human
cagcagcagggaggacac

SEQ ID NO: 266457 - RNA, 21 nt, Human
cagcagcuggggcucaguggg

SEQ ID NO: 266458 - RNA, 21 nt, Human
cagcccaggggucugggcggg

SEQ ID NO: 266459 - RNA, 23 nt, Human
cagcgggaggugguccaggacca

SEQ ID NO: 266460 - RNA, 18 nt, Human
caggacucggaguguggc

SEQ ID NO: 266461 - RNA, 21 nt, Human
caggaggcugcacacaggcac

SEQ ID NO: 266462 - RNA, 19 nt, Human
caggccccaaggggccgug

SEQ ID NO: 266463 - RNA, 25 nt, Human
caggccccaaggggccguguagagg

SEQ ID NO: 266464 - RNA, 21 nt, Human
caggcccuccuccugcccucc

SEQ ID NO: 266465 - RNA, 21 nt, Human
cagggucagcagcagggagga

SEQ ID NO: 266466 - RNA, 20 nt, Human
cauuacaucaagagaacccc

SEQ ID NO: 266467 - RNA, 19 nt, Human
ccaaggcaccauccaaagg

SEQ ID NO: 266468 - RNA, 22 nt, Human
ccaaggcaccauccaaaggcug

SEQ ID NO: 266469 - RNA, 21 nt, Human
ccacagccacaggcugcgagu

SEQ ID NO: 266470 - RNA, 19 nt, Human
cccagccucuacuucccuc

SEQ ID NO: 266471 - RNA, 21 nt, Human
cccaggacucggaguguggcc

SEQ ID NO: 266472 - RNA, 21 nt, Human
ccccaccccuucccucugcag

SEQ ID NO: 266473 - RNA, 22 nt, Human
ccccacgcugugcugcugcccc

SEQ ID NO: 266474 - RNA, 27 nt, Human
cccccucauccucucaccacaugccug

SEQ ID NO: 266475 - RNA, 27 nt, Human
ccccucauccucucaccacaugccuga

SEQ ID NO: 266476 - RNA, 24 nt, Human
ccccucauccucucaccgcauggg

SEQ ID NO: 266477 - RNA, 23 nt, Human
cccgacaguuuccgcuccucccg

SEQ ID NO: 266478 - RNA, 19 nt, Human
cccgcgaugagcucgggag

SEQ ID NO: 266479 - RNA, 18 nt, Human
cccuaaauuccugauccu

SEQ ID NO: 266480 - RNA, 22 nt, Human
cccucaaggccuucucagcagc

SEQ ID NO: 266481 - RNA, 18 nt, Human
cccucgcagcagguuucu

SEQ ID NO: 266482 - RNA, 18 nt, Human
cccugggugaggcacagg

SEQ ID NO: 266483 - RNA, 18 nt, Human
cccuggugggggccuugg

SEQ ID NO: 266484 - RNA, 20 nt, Human
ccgcauggggcauuugcucc

SEQ ID NO: 266485 - RNA, 20 nt, Human
ccucacccuggcagcucccc

SEQ ID NO: 266486 - RNA, 24 nt, Human
ccucauugucuacaaucaugcccg

SEQ ID NO: 266487 - RNA, 27 nt, Human
ccuccagccuuugacaggcaacucauu

SEQ ID NO: 266488 - RNA, 23 nt, Human
ccucccccucauccucucaccac

SEQ ID NO: 266489 - RNA, 20 nt, Human
ccuccuccugcccuccagcc

SEQ ID NO: 266490 - RNA, 21 nt, Human
ccucuggggugagauuggucu

SEQ ID NO: 266491 - RNA, 21 nt, Human
ccugagcuggguccccagggc

SEQ ID NO: 266492 - RNA, 18 nt, Human
ccugcauccccaccccuu

SEQ ID NO: 266493 - RNA, 21 nt, Human
ccugcauccccaccccuuccc

SEQ ID NO: 266494 - RNA, 24 nt, Human
ccuggcugaggggcugggagcucu

SEQ ID NO: 266495 - RNA, 20 nt, Human
ccuucucggccggcgcggcu

SEQ ID NO: 266496 - RNA, 22 nt, Human
ccuucucggccggcgcggcucc

SEQ ID NO: 266497 - RNA, 22 nt, Human
ccuuuccccucagcgcccggga

SEQ ID NO: 266498 - RNA, 22 nt, Human
cgcacccgacaguuuccgcucc

SEQ ID NO: 266499 - RNA, 22 nt, Human
cgccgaacucugagcagagccu

SEQ ID NO: 266500 - RNA, 20 nt, Human
cggggagggggcgcgcacgc

SEQ ID NO: 266501 - RNA, 21 nt, Human
cguaggcuccccucauccucu

SEQ ID NO: 266502 - RNA, 22 nt, Human
cucaccuugggcaagagaggug

SEQ ID NO: 266503 - RNA, 19 nt, Human
cucagcagcuggggcucag

SEQ ID NO: 266504 - RNA, 21 nt, Human
cuccagccuuugacaggcaac

SEQ ID NO: 266505 - RNA, 22 nt, Human
cucccucccccucauccucuca

SEQ ID NO: 266506 - RNA, 19 nt, Human
cucugcccacuccaccuga

SEQ ID NO: 266507 - RNA, 22 nt, Human
cucuugcaccucugcccacucc

SEQ ID NO: 266508 - RNA, 22 nt, Human
cugccgggcgcuguaggggccg

SEQ ID NO: 266509 - RNA, 22 nt, Human
cuggcagugcucccuggcacca

SEQ ID NO: 266510 - RNA, 21 nt, Human
cuggcucaccuugggcaagag

SEQ ID NO: 266511 - RNA, 19 nt, Human
cuggcuccuggcugagggg

SEQ ID NO: 266512 - RNA, 26 nt, Human
cuggugggggccuuggugggguaguc

SEQ ID NO: 266513 - RNA, 21 nt, Human
cuucccgucaucccgugucuu

SEQ ID NO: 266514 - RNA, 20 nt, Human
cuuguccuguggccucagcc

SEQ ID NO: 266515 - RNA, 21 nt, Human
gaaggagagaggaaguuccag

SEQ ID NO: 266516 - RNA, 18 nt, Human
gaccacagccacaggcug

SEQ ID NO: 266517 - RNA, 19 nt, Human
gagaacccccucauugucu

SEQ ID NO: 266518 - RNA, 19 nt, Human
gagaccggguuguugggac

SEQ ID NO: 266519 - RNA, 18 nt, Human
gaggaaagaacccaaacc

SEQ ID NO: 266520 - RNA, 20 nt, Human
gaggggcuggcccugugggu

SEQ ID NO: 266521 - RNA, 24 nt, Human
gagguggcuauggggcucccgcag

SEQ ID NO: 266522 - RNA, 24 nt, Human
gagucucccaggggagaaccuggg

SEQ ID NO: 266523 - RNA, 20 nt, Human
gauaccaaaggcagaaaacc

SEQ ID NO: 266524 - RNA, 21 nt, Human
gauaccaaaggcagaaaacca

SEQ ID NO: 266525 - RNA, 28 nt, Human
gauaccaaaggcagaaaaccaggaagga

SEQ ID NO: 266526 - RNA, 21 nt, Human
gaucauacccuaaauuccuga

SEQ ID NO: 266527 - RNA, 20 nt, Human
gcacuugguggguucugccg

SEQ ID NO: 266528 - RNA, 22 nt, Human
gcacuugguggguucugccggc

SEQ ID NO: 266529 - RNA, 24 nt, Human
gccacggggcauccgcaccaacua

SEQ ID NO: 266530 - RNA, 19 nt, Human
gcgggggcucaggugggcg

SEQ ID NO: 266531 - RNA, 20 nt, Human
gcucccagccucuacuuccc

SEQ ID NO: 266532 - RNA, 19 nt, Human
gcuggcggcugggaguugg

SEQ ID NO: 266533 - RNA, 20 nt, Human
gcuuuggcuggcggcuggga

SEQ ID NO: 266534 - RNA, 22 nt, Human
ggaaggagagaggaaguuccag

SEQ ID NO: 266535 - RNA, 24 nt, Human
ggacucacucugcuggaugggcug

SEQ ID NO: 266536 - RNA, 21 nt, Human
ggcagugcucccuggcaccag

SEQ ID NO: 266537 - RNA, 18 nt, Human
ggcccuccuccugcccuc

SEQ ID NO: 266538 - RNA, 18 nt, Human
ggccggggcgaggccgcg

SEQ ID NO: 266539 - RNA, 22 nt, Human
ggcuaaggggcccaaggcacca

SEQ ID NO: 266540 - RNA, 23 nt, Human
ggcugccgggcgcuguaggggcc

SEQ ID NO: 266541 - RNA, 24 nt, Human
ggcugggaggaaagaacccaaacc

SEQ ID NO: 266542 - RNA, 20 nt, Human
gggaaggcaggagaaguguc

SEQ ID NO: 266543 - RNA, 21 nt, Human
gggaaggcaggagaagugucu

SEQ ID NO: 266544 - RNA, 22 nt, Human
gggaccguggacaguaaggaaa

SEQ ID NO: 266545 - RNA, 19 nt, Human
gggcaugagaccggguugu

SEQ ID NO: 266546 - RNA, 19 nt, Human
gggcauggguugggaggca

SEQ ID NO: 266547 - RNA, 22 nt, Human
gggcgcuguaggggccgggaca

SEQ ID NO: 266548 - RNA, 19 nt, Human
gggcucaggugggcgcgcu

SEQ ID NO: 266549 - RNA, 18 nt, Human
ggggaagguggucucaga

SEQ ID NO: 266550 - RNA, 23 nt, Human
ggggucugggcggggcaccaggg

SEQ ID NO: 266551 - RNA, 23 nt, Human
ggguuguugggaccacucugggg

SEQ ID NO: 266552 - RNA, 23 nt, Human
ggucugggcggggcaccaggguc

SEQ ID NO: 266553 - RNA, 22 nt, Human
guagagggcggggugggcaucc

SEQ ID NO: 266554 - RNA, 24 nt, Human
guagagggcggggugggcauccug

SEQ ID NO: 266555 - RNA, 23 nt, Human
gucagaggcccuggugggggccu

SEQ ID NO: 266556 - RNA, 22 nt, Human
guccuguggccucagcugggag

SEQ ID NO: 266557 - RNA, 20 nt, Human
gucuggacgucagcccaggg

SEQ ID NO: 266558 - RNA, 25 nt, Human
gugggggccuugguggcaaagggag

SEQ ID NO: 266559 - RNA, 22 nt, Human
uaaaggcaccauccaguugccu

SEQ ID NO: 266560 - RNA, 21 nt, Human
uaaaguuaauuuacuggaaaa

SEQ ID NO: 266561 - RNA, 19 nt, Human
uaagaggaccacagccaca

SEQ ID NO: 266562 - RNA, 20 nt, Human
uaagaggaccacagccacag

SEQ ID NO: 266563 - RNA, 21 nt, Human
uaaggggcccaaggcaccauc

SEQ ID NO: 266564 - RNA, 20 nt, Human
uacggggagggggcgcgcac

SEQ ID NO: 266565 - RNA, 20 nt, Human
uagagggcggggugggcauc

SEQ ID NO: 266566 - RNA, 24 nt, Human
uaggguuccugacccaaguguggu

SEQ ID NO: 266567 - RNA, 25 nt, Human
ucagcgcccgggacacgugaccgag

SEQ ID NO: 266568 - RNA, 24 nt, Human
ucaguacaucccucucuugcaccu

SEQ ID NO: 266569 - RNA, 22 nt, Human
uccaggugcucugacuugaccu

SEQ ID NO: 266570 - RNA, 24 nt, Human
ucccgugucuugaccccgcccuug

SEQ ID NO: 266571 - RNA, 18 nt, Human
ucccucucuugcaccucu

SEQ ID NO: 266572 - RNA, 19 nt, Human
ucccugagcugggucccca

SEQ ID NO: 266573 - RNA, 23 nt, Human
ucuguggcaggacgggaagaagc

SEQ ID NO: 266574 - RNA, 23 nt, Human
ugacccaaguguggugacagcag

SEQ ID NO: 266575 - RNA, 23 nt, Human
ugagaaaggguucccaaggacag

SEQ ID NO: 266576 - RNA, 18 nt, Human
ugagcucgggaggggccg

SEQ ID NO: 266577 - RNA, 21 nt, Human
ugagcucgggaggggccgggg

SEQ ID NO: 266578 - RNA, 22 nt, Human
ugaggaaauaaguggaaggaga

SEQ ID NO: 266579 - RNA, 21 nt, Human
ugcacacaggcacuugguggg

SEQ ID NO: 266580 - RNA, 24 nt, Human
ugcacacaggcacuugguggguuc

SEQ ID NO: 266581 - RNA, 20 nt, Human
ugcaccucugcccacuccag

SEQ ID NO: 266582 - RNA, 22 nt, Human
ugcuaaucugggcugagggcac

SEQ ID NO: 266583 - RNA, 23 nt, Human
ugcugcugccccgcuuccugcuu

SEQ ID NO: 266584 - RNA, 19 nt, Human
uggaugggcuguuccgcuu

SEQ ID NO: 266585 - RNA, 24 nt, Human
uggcaaaacuaugaguguugcuaa

SEQ ID NO: 266586 - RNA, 22 nt, Human
uggcaagcuggcagugcucccu

SEQ ID NO: 266587 - RNA, 23 nt, Human
uggcaagcuggcagugcucccug

SEQ ID NO: 266588 - RNA, 22 nt, Human
uggccgggcuccgggccaggcc

SEQ ID NO: 266589 - RNA, 24 nt, Human
uggccucagcugggaggcccuggc

SEQ ID NO: 266590 - RNA, 21 nt, Human
ugggaggcccuggcgcugggg

SEQ ID NO: 266591 - RNA, 24 nt, Human
ugggcagaaacuggcaagcuggca

SEQ ID NO: 266592 - RNA, 20 nt, Human
ugggcauccuggccuggccu

SEQ ID NO: 266593 - RNA, 21 nt, Human
uggggcuaaggggcccaaggc

SEQ ID NO: 266594 - RNA, 20 nt, Human
uggggcucaguggggaaggu

SEQ ID NO: 266595 - RNA, 22 nt, Human
uguaaagcaacaaguuugagga

SEQ ID NO: 266596 - RNA, 22 nt, Human
uguccaggugcucugacuugac

SEQ ID NO: 266597 - RNA, 19 nt, Human
uguccuguggccucagcug

SEQ ID NO: 266598 - RNA, 18 nt, Human
ugucuaguguaaagcaac

SEQ ID NO: 266599 - RNA, 23 nt, Human
uguggccgggcuccgggccaggc

SEQ ID NO: 266600 - RNA, 19 nt, Human
uuccugcuucccgucaucc

SEQ ID NO: 266601 - RNA, 23 nt, Human
uugcugggcagaaacuggcaagc

SEQ ID NO: 266602 - RNA, 22 nt, Human
uugggaagcagggauggggagu

SEQ ID NO: 266603 - RNA, 20 nt, Human
aaaccuaccuuaugaaugag

SEQ ID NO: 266604 - RNA, 18 nt, Human
aaauguacaugcuugaaa

SEQ ID NO: 266605 - RNA, 18 nt, Human
aagaguccacucguacuc

SEQ ID NO: 266606 - RNA, 20 nt, Human
acccuuggcacguacauggg

SEQ ID NO: 266607 - RNA, 21 nt, Human
acuuauggagugauacucccu

SEQ ID NO: 266608 - RNA, 18 nt, Human
agagaaaucaaagccagc

SEQ ID NO: 266609 - RNA, 20 nt, Human
agaggggacuccauccaggc

SEQ ID NO: 266610 - RNA, 20 nt, Human
agcaggcggggcgcaugcug

SEQ ID NO: 266611 - RNA, 22 nt, Human
aggcgggauuggcggugcuagg

SEQ ID NO: 266612 - RNA, 24 nt, Human
aggcucccgaacacccaagcacuc

SEQ ID NO: 266613 - RNA, 21 nt, Human
aggugagggcgagacggcggc

SEQ ID NO: 266614 - RNA, 21 nt, Human
aggugagggcgagacggcggc

SEQ ID NO: 266615 - RNA, 19 nt, Human
augcugcggagggcaagag

SEQ ID NO: 266616 - RNA, 27 nt, Human
caaaaacaggcucccgaacacccaagc

SEQ ID NO: 266617 - RNA, 26 nt, Human
caacccagccuuuucaguguccuccu

SEQ ID NO: 266618 - RNA, 20 nt, Human
caagagagaugaaagaaaug

SEQ ID NO: 266619 - RNA, 18 nt, Human
cacccaagcacucacagg

SEQ ID NO: 266620 - RNA, 21 nt, Human
cacccaagcacucacaggagc

SEQ ID NO: 266621 - RNA, 25 nt, Human
caccuacagccauucucuaggccug

SEQ ID NO: 266622 - RNA, 21 nt, Human
cacuccucuuucuucggcccc

SEQ ID NO: 266623 - RNA, 23 nt, Human
cacuuguccucucaccagguuua

SEQ ID NO: 266624 - RNA, 20 nt, Human
cagaauagcuccaggccuug

SEQ ID NO: 266625 - RNA, 24 nt, Human
cagagggcggguccucccugaagg

SEQ ID NO: 266626 - RNA, 24 nt, Human
cagcaggaccagcccccagccccu

SEQ ID NO: 266627 - RNA, 19 nt, Human
caggaccagcccccagccc

SEQ ID NO: 266628 - RNA, 28 nt, Human
ccaaaaacaggcucccgaacacccaagc

SEQ ID NO: 266629 - RNA, 18 nt, Human
ccagagaaaucaaagcca

SEQ ID NO: 266630 - RNA, 20 nt, Human
ccagagaaaucaaagccagc

SEQ ID NO: 266631 - RNA, 18 nt, Human
cccccagccccugaccug

SEQ ID NO: 266632 - RNA, 22 nt, Human
ccccucaccuggucugugccug

SEQ ID NO: 266633 - RNA, 22 nt, Human
cccugaaggaagguggcagaga

SEQ ID NO: 266634 - RNA, 21 nt, Human
cccugccucacuccucuuucu

SEQ ID NO: 266635 - RNA, 22 nt, Human
cccugccucacuccucuuucuu

SEQ ID NO: 266636 - RNA, 19 nt, Human
cccugggcucagcaggcca

SEQ ID NO: 266637 - RNA, 23 nt, Human
ccuacagccauucucuaggccug

SEQ ID NO: 266638 - RNA, 25 nt, Human
ccuccgccaaaaacaggcucccgaa

SEQ ID NO: 266639 - RNA, 28 nt, Human
ccucgcuccccugccucacuccucuuuc

SEQ ID NO: 266640 - RNA, 22 nt, Human
ccugaccugcuuggcggcccug

SEQ ID NO: 266641 - RNA, 20 nt, Human
ccugauggucccggcaaagu

SEQ ID NO: 266642 - RNA, 20 nt, Human
cgcgucuucgccgggucccg

SEQ ID NO: 266643 - RNA, 21 nt, Human
cggcccaggugaguccgaugc

SEQ ID NO: 266644 - RNA, 22 nt, Human
cggccccuuaauccguacuccu

SEQ ID NO: 266645 - RNA, 20 nt, Human
cggggcgcaugcugcggagg

SEQ ID NO: 266646 - RNA, 20 nt, Human
cucauuguggauuguaaggg

SEQ ID NO: 266647 - RNA, 19 nt, Human
cuccauggggaagguacca

SEQ ID NO: 266648 - RNA, 19 nt, Human
cuccucuuucuucggcccc

SEQ ID NO: 266649 - RNA, 20 nt, Human
cugcagggacugaccuagaa

SEQ ID NO: 266650 - RNA, 22 nt, Human
cugccucacuccucuuucuucg

SEQ ID NO: 266651 - RNA, 23 nt, Human
cuggagcuccucugccccaugug

SEQ ID NO: 266652 - RNA, 22 nt, Human
cuucaaaaguugguuccccucc

SEQ ID NO: 266653 - RNA, 19 nt, Human
cuuggagaagcaauugcuc

SEQ ID NO: 266654 - RNA, 22 nt, Human
gacccagagaaaucaaagccag

SEQ ID NO: 266655 - RNA, 21 nt, Human
gacugaccuagaaagcaguga

SEQ ID NO: 266656 - RNA, 22 nt, Human
gagggcggguccucccugaagg

SEQ ID NO: 266657 - RNA, 22 nt, Human
gcaaaguguaaaccagugcccc

SEQ ID NO: 266658 - RNA, 18 nt, Human
gccucgcuccccugccuc

SEQ ID NO: 266659 - RNA, 21 nt, Human
gcgggauuggcggugcuaggu

SEQ ID NO: 266660 - RNA, 21 nt, Human
ggcaagaguccacucguacuc

SEQ ID NO: 266661 - RNA, 19 nt, Human
ggcggcccugauggucccg

SEQ ID NO: 266662 - RNA, 20 nt, Human
gguuuuguccuccugguucc

SEQ ID NO: 266663 - RNA, 22 nt, Human
gguuuuguccuccugguuccua

SEQ ID NO: 266664 - RNA, 20 nt, Human
gucugugccuggagcuccuc

SEQ ID NO: 266665 - RNA, 20 nt, Human
uacagcauuuaacacaaacc

SEQ ID NO: 266666 - RNA, 21 nt, Human
uauagggaaagaguugagaag

SEQ ID NO: 266667 - RNA, 23 nt, Human
uauccccucaccuggucugugcc

SEQ ID NO: 266668 - RNA, 22 nt, Human
ucaaagccagcaggaccagccc

SEQ ID NO: 266669 - RNA, 19 nt, Human
ucacuuguccucucaccag

SEQ ID NO: 266670 - RNA, 25 nt, Human
ucacuuguccucucaccagguuuaa

SEQ ID NO: 266671 - RNA, 19 nt, Human
uccacucguacucgccgcu

SEQ ID NO: 266672 - RNA, 20 nt, Human
ucccgaacacccaagcacuc

SEQ ID NO: 266673 - RNA, 23 nt, Human
ucccgaacacccaagcacucaca

SEQ ID NO: 266674 - RNA, 22 nt, Human
ucccugaaggaagguggcagag

SEQ ID NO: 266675 - RNA, 24 nt, Human
uccguaguuggaaaaaagcagagc

SEQ ID NO: 266676 - RNA, 25 nt, Human
ucgccgggucccgcugccggggaaa

SEQ ID NO: 266677 - RNA, 24 nt, Human
ucugcagagggcggguccucccuu

SEQ ID NO: 266678 - RNA, 18 nt, Human
ugaccuagaaagcaguga

SEQ ID NO: 266679 - RNA, 18 nt, Human
ugccucacuccucuuucu

SEQ ID NO: 266680 - RNA, 23 nt, Human
ugccuggagcuccucugccccau

SEQ ID NO: 266681 - RNA, 24 nt, Human
uggaaaaaagcagagcacaucuuu

SEQ ID NO: 266682 - RNA, 21 nt, Human
uggaauacuacuuaguacauu

SEQ ID NO: 266683 - RNA, 24 nt, Human
uggugguuuuguccuccugguucc

SEQ ID NO: 266684 - RNA, 25 nt, Human
uuaacacaaaccaauaugggcccag

SEQ ID NO: 266685 - RNA, 19 nt, Human
uuguccucucaccagguuu

SEQ ID NO: 266686 - RNA, 23 nt, Human
uuuguccuccugguuccuaugaa

SEQ ID NO: 266687 - RNA, 22 nt, Human
aaagagaaggcaguaucccagg

SEQ ID NO: 266688 - RNA, 23 nt, Human
aaagagaaggcaguaucccaggg

SEQ ID NO: 266689 - RNA, 23 nt, Human
aaggaccccccccuccccaacug

SEQ ID NO: 266690 - RNA, 20 nt, Human
accuggugacccagggccug

SEQ ID NO: 266691 - RNA, 18 nt, Human
agaaugggcagcaggugu

SEQ ID NO: 266692 - RNA, 20 nt, Human
aggaagaccagggcccaggg

SEQ ID NO: 266693 - RNA, 18 nt, Human
aggacuggacuuuuaggc

SEQ ID NO: 266694 - RNA, 22 nt, Human
aggcaguaucccagggcccagc

SEQ ID NO: 266695 - RNA, 22 nt, Human
aguggaagcgcuccuugcugcc

SEQ ID NO: 266696 - RNA, 24 nt, Human
auguuggaggaagaccagggccca

SEQ ID NO: 266697 - RNA, 19 nt, Human
caacugugccuggcacuuu

SEQ ID NO: 266698 - RNA, 24 nt, Human
ccccuccccaacugugccuggcac

SEQ ID NO: 266699 - RNA, 22 nt, Human
cucugcuucacguuguggcucu

SEQ ID NO: 266700 - RNA, 23 nt, Human
cugcagcagugaccuggugaccc

SEQ ID NO: 266701 - RNA, 18 nt, Human
cugugccuggcacuuugc

SEQ ID NO: 266702 - RNA, 25 nt, Human
cuuguuaaggaccccccccucccca

SEQ ID NO: 266703 - RNA, 25 nt, Human
gccaacagcacaggacucaagaccc

SEQ ID NO: 266704 - RNA, 25 nt, Human
ggaccccccccuccccaacugugcc

SEQ ID NO: 266705 - RNA, 23 nt, Human
ggcagauaggcgggcgaaagaga

SEQ ID NO: 266706 - RNA, 24 nt, Human
ggcagcaggugugauguuggagga

SEQ ID NO: 266707 - RNA, 20 nt, Human
gggcccaggggcgggggcug

SEQ ID NO: 266708 - RNA, 25 nt, Human
guuaaggaccccccccuccccaacu

SEQ ID NO: 266709 - RNA, 18 nt, Human
ucacguuguggcucugcc

SEQ ID NO: 266710 - RNA, 28 nt, Human
ugacacacacagaaauggagaaugggca

SEQ ID NO: 266711 - RNA, 19 nt, Human
ugacccagggccugggcag

SEQ ID NO: 266712 - RNA, 22 nt, Human
ugaccuggugacccagggccug

SEQ ID NO: 266713 - RNA, 22 nt, Human
ugauguuggaggaagaccaggg

SEQ ID NO: 266714 - RNA, 19 nt, Human
ugccuggcacuuugccaac

SEQ ID NO: 266715 - RNA, 24 nt, Human
uggacuuuuaggcuauugcagccc

SEQ ID NO: 266716 - RNA, 18 nt, Human
uggcacuuugccaacagc

SEQ ID NO: 266717 - RNA, 21 nt, Human
uuaaggaccccccccucccca

SEQ ID NO: 266718 - RNA, 19 nt, Human
aaaagaacaaagugauaga

SEQ ID NO: 266719 - RNA, 21 nt, Human
aaaggaagagaaagagcaagc

SEQ ID NO: 266720 - RNA, 18 nt, Human
aaauucuccccaccccuc

SEQ ID NO: 266721 - RNA, 21 nt, Human
aacuggcgggcuggugagaaa

SEQ ID NO: 266722 - RNA, 23 nt, Human
aagagcaagcuugagaugaaaua

SEQ ID NO: 266723 - RNA, 23 nt, Human
agaaagagcaagcuugagaugaa

SEQ ID NO: 266724 - RNA, 23 nt, Human
agagcaagcuugagaugaaauac

SEQ ID NO: 266725 - RNA, 18 nt, Human
agagggguuggcgagauc

SEQ ID NO: 266726 - RNA, 21 nt, Human
agcaagcuugagaugaaauac

SEQ ID NO: 266727 - RNA, 22 nt, Human
cagucaccccaaaugagagagg

SEQ ID NO: 266728 - RNA, 22 nt, Human
caucuucgaaauucuccccacc

SEQ ID NO: 266729 - RNA, 22 nt, Human
ccaaaacuuugaauacuguguc

SEQ ID NO: 266730 - RNA, 25 nt, Human
ccacaggagucacaaaaaaaaagaa

SEQ ID NO: 266731 - RNA, 18 nt, Human
ccaggcugcacuggggcc

SEQ ID NO: 266732 - RNA, 26 nt, Human
ccccaccccucccgggcuuuuuucuc

SEQ ID NO: 266733 - RNA, 19 nt, Human
ccccgcaggcuccagcgcc

SEQ ID NO: 266734 - RNA, 20 nt, Human
ccgacggcggugacugccuc

SEQ ID NO: 266735 - RNA, 23 nt, Human
ccgacggcggugacugccucguu

SEQ ID NO: 266736 - RNA, 18 nt, Human
ccgcagcuucagugccug

SEQ ID NO: 266737 - RNA, 23 nt, Human
ccgggcuuuuuucucuaagauuc

SEQ ID NO: 266738 - RNA, 18 nt, Human
cuccccaccccucccggg

SEQ ID NO: 266739 - RNA, 24 nt, Human
cugggcgggaagccgggcgccucc

SEQ ID NO: 266740 - RNA, 20 nt, Human
cuucgaaauucuccccaccc

SEQ ID NO: 266741 - RNA, 18 nt, Human
gaaauucuccccaccccu

SEQ ID NO: 266742 - RNA, 23 nt, Human
gaaauucuccccaccccucccgg

SEQ ID NO: 266743 - RNA, 27 nt, Human
gaaauucuccccaccccucccgggcuu

SEQ ID NO: 266744 - RNA, 24 nt, Human
gcagcuucagugccugcuggugcc

SEQ ID NO: 266745 - RNA, 23 nt, Human
gcccugggccugggcgggaagcc

SEQ ID NO: 266746 - RNA, 22 nt, Human
gccgcagcuucagugccugcug

SEQ ID NO: 266747 - RNA, 23 nt, Human
gccugcuggugccagccccagag

SEQ ID NO: 266748 - RNA, 22 nt, Human
ggcgcaguggaguccacaggag

SEQ ID NO: 266749 - RNA, 18 nt, Human
gggaacaaggacaggguu

SEQ ID NO: 266750 - RNA, 21 nt, Human
gggaacaaggacaggguugcc

SEQ ID NO: 266751 - RNA, 20 nt, Human
gggcuggugagaaaggaggg

SEQ ID NO: 266752 - RNA, 18 nt, Human
gggggagguuucccgagg

SEQ ID NO: 266753 - RNA, 22 nt, Human
ggugcgggaguuccgagagaga

SEQ ID NO: 266754 - RNA, 23 nt, Human
uaaaaaccguuagcaaagcuuga

SEQ ID NO: 266755 - RNA, 27 nt, Human
uaacaaugcucagacgccaaaacuuuu

SEQ ID NO: 266756 - RNA, 18 nt, Human
uacuguguccaggcugca

SEQ ID NO: 266757 - RNA, 22 nt, Human
ucccaggcgcaguggaguccac

SEQ ID NO: 266758 - RNA, 18 nt, Human
uccccaccccucccgggc

SEQ ID NO: 266759 - RNA, 19 nt, Human
uccccaccccucccgggcu

SEQ ID NO: 266760 - RNA, 20 nt, Human
uccuuauuucuuuacggggg

SEQ ID NO: 266761 - RNA, 23 nt, Human
ugaaauacaucuucgaaauucuc

SEQ ID NO: 266762 - RNA, 19 nt, Human
ugagggccgagcgcagcag

SEQ ID NO: 266763 - RNA, 23 nt, Human
ugcacuggggcccugggccuggg

SEQ ID NO: 266764 - RNA, 23 nt, Human
uggcgggcuggugagaaaggagg

SEQ ID NO: 266765 - RNA, 21 nt, Human
ugggccugggcgggaagccgg

SEQ ID NO: 266766 - RNA, 19 nt, Human
uucuccccaccccucccgg

SEQ ID NO: 266767 - RNA, 22 nt, Human
uucuccccaccccucccgggcu

SEQ ID NO: 266768 - RNA, 22 nt, Human
uuggccccugcugccccgcagg

SEQ ID NO: 266769 - RNA, 21 nt, Human
uuuuucucuaagauucaaccg

SEQ ID NO: 266770 - RNA, 20 nt, Human
aacauuccuuuaauaucucu

SEQ ID NO: 266771 - RNA, 22 nt, Human
acucacuggaaauaauggguuc

SEQ ID NO: 266772 - RNA, 20 nt, Human
agggagcagggcagggcagg

SEQ ID NO: 266773 - RNA, 22 nt, Human
auaacacagcacgaaagagccu

SEQ ID NO: 266774 - RNA, 18 nt, Human
auugccaguuuauuucuu

SEQ ID NO: 266775 - RNA, 20 nt, Human
cagcacgaaagagccuaucu

SEQ ID NO: 266776 - RNA, 18 nt, Human
cagggccgggcggggagg

SEQ ID NO: 266777 - RNA, 26 nt, Human
cagggccgggcggggagggccgcgcg

SEQ ID NO: 266778 - RNA, 23 nt, Human
cagugcuaaggauuuaaaauaaa

SEQ ID NO: 266779 - RNA, 21 nt, Human
ccauucaaacucagugcuaag

SEQ ID NO: 266780 - RNA, 23 nt, Human
ccccgcgcgccuacgccccccgc

SEQ ID NO: 266781 - RNA, 20 nt, Human
cccgcgcgccuacgcccccc

SEQ ID NO: 266782 - RNA, 25 nt, Human
ccuccuuuccuuccucccuuccccc

SEQ ID NO: 266783 - RNA, 18 nt, Human
ccuuccucccuuccuucc

SEQ ID NO: 266784 - RNA, 21 nt, Human
cgcccgagcggacuaggaagc

SEQ ID NO: 266785 - RNA, 19 nt, Human
cgccuacgccccccgccug

SEQ ID NO: 266786 - RNA, 20 nt, Human
cgcgagcgcuccaccugccu

SEQ ID NO: 266787 - RNA, 21 nt, Human
cggggcggggcggggcggggc

SEQ ID NO: 266788 - RNA, 22 nt, Human
cuacgccccccgccugugcgga

SEQ ID NO: 266789 - RNA, 19 nt, Human
gacacauuuuucuccuccu

SEQ ID NO: 266790 - RNA, 22 nt, Human
gccccgcgcgccuacgcccccc

SEQ ID NO: 266791 - RNA, 24 nt, Human
gcgcggggcggggcggggcggggc

SEQ ID NO: 266792 - RNA, 19 nt, Human
gggcagggcagggccgggc

SEQ ID NO: 266793 - RNA, 20 nt, Human
gggcagggcagggccgggcg

SEQ ID NO: 266794 - RNA, 23 nt, Human
gggcggggagggccgcgcggggc

SEQ ID NO: 266795 - RNA, 18 nt, Human
gggcggggcggggcgccu

SEQ ID NO: 266796 - RNA, 18 nt, Human
ggggagggccgcgcgggg

SEQ ID NO: 266797 - RNA, 19 nt, Human
uaaaauaaaugcugccagc

SEQ ID NO: 266798 - RNA, 23 nt, Human
uaaaugcugccagcugaagacac

SEQ ID NO: 266799 - RNA, 21 nt, Human
ucuuugaaccaguuuaacaau

SEQ ID NO: 266800 - RNA, 21 nt, Human
ugauauguacucaauggagac

SEQ ID NO: 266801 - RNA, 19 nt, Human
uguaaacucacgguaccua

SEQ ID NO: 266802 - RNA, 24 nt, Human
uuaaaaauguauuuucaguaacuc

SEQ ID NO: 266803 - RNA, 22 nt, Human
uuacuaaacugacaugauaugu

SEQ ID NO: 266804 - RNA, 18 nt, Human
aaacaucagaauaugccc

SEQ ID NO: 266805 - RNA, 26 nt, Human
aacacacauugugcuagcaaagaaaa

SEQ ID NO: 266806 - RNA, 18 nt, Human
aacaugauuauggaaugg

SEQ ID NO: 266807 - RNA, 20 nt, Human
aagaauauucugacagcaac

SEQ ID NO: 266808 - RNA, 18 nt, Human
acaauuaccaaaaccuca

SEQ ID NO: 266809 - RNA, 19 nt, Human
acuaaauacaaggauuucu

SEQ ID NO: 266810 - RNA, 22 nt, Human
agaaaagcaaaucugugcugga

SEQ ID NO: 266811 - RNA, 23 nt, Human
agaaaagcaaaucugugcuggau

SEQ ID NO: 266812 - RNA, 21 nt, Human
agagaauaaugagaguuuugg

SEQ ID NO: 266813 - RNA, 21 nt, Human
agauguuggaagcagaacacu

SEQ ID NO: 266814 - RNA, 23 nt, Human
aggcaggugcgcggcggcggggc

SEQ ID NO: 266815 - RNA, 23 nt, Human
aucaguuauguaaaacaagcacu

SEQ ID NO: 266816 - RNA, 22 nt, Human
auuaccaaaaccucaaaggcca

SEQ ID NO: 266817 - RNA, 25 nt, Human
caaaaaagacacuaggaauuucuua

SEQ ID NO: 266818 - RNA, 23 nt, Human
caaaaccucaaaggccaaaaaag

SEQ ID NO: 266819 - RNA, 21 nt, Human
caaaagccgugauuaauaaaa

SEQ ID NO: 266820 - RNA, 18 nt, Human
caaagaaaagcaaaucug

SEQ ID NO: 266821 - RNA, 19 nt, Human
caaaggccaaaaaagacac

SEQ ID NO: 266822 - RNA, 20 nt, Human
caaauucaccaaaagccgug

SEQ ID NO: 266823 - RNA, 18 nt, Human
caauacuaacagcacaca

SEQ ID NO: 266824 - RNA, 22 nt, Human
caauuaccaaaaccucaaaggc

SEQ ID NO: 266825 - RNA, 26 nt, Human
caauuaccaaaaccucaaaggccaaa

SEQ ID NO: 266826 - RNA, 21 nt, Human
cacacacccuaccuaaguacc

SEQ ID NO: 266827 - RNA, 20 nt, Human
caccuaaaaccuauuuccuu

SEQ ID NO: 266828 - RNA, 20 nt, Human
cacuaugccaccuaaaaccu

SEQ ID NO: 266829 - RNA, 21 nt, Human
cacugcaaaggaggaaaaaaa

SEQ ID NO: 266830 - RNA, 20 nt, Human
cagaacacuuacuaaaucaa

SEQ ID NO: 266831 - RNA, 21 nt, Human
cagaauacaucaaauacauua

SEQ ID NO: 266832 - RNA, 19 nt, Human
caguuaagccacuaugcca

SEQ ID NO: 266833 - RNA, 22 nt, Human
cauugugcuagcaaagaaaagc

SEQ ID NO: 266834 - RNA, 23 nt, Human
ccucaaaggccaaaaaagacacu

SEQ ID NO: 266835 - RNA, 22 nt, Human
cuacaauuaccaaaaccucaaa

SEQ ID NO: 266836 - RNA, 24 nt, Human
cuccuguuuccacuauccacuguc

SEQ ID NO: 266837 - RNA, 22 nt, Human
cugaauuacaaagcuuaugaaa

SEQ ID NO: 266838 - RNA, 19 nt, Human
gguccaaaauuugcuacca

SEQ ID NO: 266839 - RNA, 20 nt, Human
uaaaauacaacaaaacuccu

SEQ ID NO: 266840 - RNA, 21 nt, Human
uaaaauuaucaguuauguaaa

SEQ ID NO: 266841 - RNA, 24 nt, Human
uaaaucaaugaaacaacuuggaca

SEQ ID NO: 266842 - RNA, 19 nt, Human
uaacagcacacaaagaaaa

SEQ ID NO: 266843 - RNA, 18 nt, Human
uaccauggcaaaggcucc

SEQ ID NO: 266844 - RNA, 21 nt, Human
uaguaccucuuaucacagaau

SEQ ID NO: 266845 - RNA, 25 nt, Human
uaugaaacaggucuacaauuaccaa

SEQ ID NO: 266846 - RNA, 19 nt, Human
uauucugacagcaacacac

SEQ ID NO: 266847 - RNA, 21 nt, Human
uauuugaauucaguccaguua

SEQ ID NO: 266848 - RNA, 18 nt, Human
ucaauacuaacagcacac

SEQ ID NO: 266849 - RNA, 24 nt, Human
uccaaaaaugucugaaaaugucua

SEQ ID NO: 266850 - RNA, 23 nt, Human
ugaaacaaaacuuaucucaaaac

SEQ ID NO: 266851 - RNA, 24 nt, Human
ugaaacaaaacuuaucucaaaacu

SEQ ID NO: 266852 - RNA, 26 nt, Human
ugaaggaggauccacgaucuccuguu

SEQ ID NO: 266853 - RNA, 23 nt, Human
ugagaagugaugagggccaguga

SEQ ID NO: 266854 - RNA, 21 nt, Human
uggaagcagaacacuuacuaa

SEQ ID NO: 266855 - RNA, 23 nt, Human
uggaaugguuaaaucugggggca

SEQ ID NO: 266856 - RNA, 24 nt, Human
uggcaaaggaugagaaacaucaga

SEQ ID NO: 266857 - RNA, 19 nt, Human
uguaaaacaagcacuuacu

SEQ ID NO: 266858 - RNA, 21 nt, Human
uguaaaacaagcacuuacuaa

SEQ ID NO: 266859 - RNA, 26 nt, Human
ugucugaaaaugucuauaaaguacac

SEQ ID NO: 266860 - RNA, 25 nt, Human
uugaaacaaaacuuaucucaaaacu

SEQ ID NO: 266861 - RNA, 19 nt, Human
uugaaucaauacuaacagc

SEQ ID NO: 266862 - RNA, 19 nt, Human
uuggacaagauucugauac

SEQ ID NO: 266863 - RNA, 25 nt, Human
uuuauuacuccaguuauaugguacu

SEQ ID NO: 266864 - RNA, 19 nt, Human
aaacacacguccccucuuc

SEQ ID NO: 266865 - RNA, 22 nt, Human
aaacaggagacacaucuaagga

SEQ ID NO: 266866 - RNA, 19 nt, Human
agcaggggcccagcauuca

SEQ ID NO: 266867 - RNA, 19 nt, Human
aggaaguugcauggugggg

SEQ ID NO: 266868 - RNA, 18 nt, Human
aggagacacaucuaagga

SEQ ID NO: 266869 - RNA, 18 nt, Human
aggcauggaaccagcacc

SEQ ID NO: 266870 - RNA, 22 nt, Human
aggcgucccucugggucuuucc

SEQ ID NO: 266871 - RNA, 23 nt, Human
agugguggcuggccagcccagcc

SEQ ID NO: 266872 - RNA, 21 nt, Human
auaagucuuccccagcugcag

SEQ ID NO: 266873 - RNA, 21 nt, Human
cacggaggacucaggaagcug

SEQ ID NO: 266874 - RNA, 22 nt, Human
cacgggcccagccagucugcaa

SEQ ID NO: 266875 - RNA, 18 nt, Human
cagcugccaccugcacgg

SEQ ID NO: 266876 - RNA, 22 nt, Human
cagcugcccacucucagugacc

SEQ ID NO: 266877 - RNA, 23 nt, Human
caggcauggaaccagcaccuccc

SEQ ID NO: 266878 - RNA, 18 nt, Human
cagugaccugccagccug

SEQ ID NO: 266879 - RNA, 23 nt, Human
caucagaggcccaguugguauag

SEQ ID NO: 266880 - RNA, 19 nt, Human
ccagcccagccucgcugcc

SEQ ID NO: 266881 - RNA, 18 nt, Human
ccagcugcccacucucag

SEQ ID NO: 266882 - RNA, 19 nt, Human
cccaagucaggagcuccug

SEQ ID NO: 266883 - RNA, 23 nt, Human
ccgggauggcauaagucuucccc

SEQ ID NO: 266884 - RNA, 20 nt, Human
ccugaacccacugcugccuc

SEQ ID NO: 266885 - RNA, 21 nt, Human
ccugaacccacugcugccucg

SEQ ID NO: 266886 - RNA, 19 nt, Human
cucccucaucccaccugca

SEQ ID NO: 266887 - RNA, 21 nt, Human
cucugggucuuucccuuccuc

SEQ ID NO: 266888 - RNA, 21 nt, Human
cucugugugugucucuugucu

SEQ ID NO: 266889 - RNA, 18 nt, Human
cuggggcccagcugccca

SEQ ID NO: 266890 - RNA, 21 nt, Human
gagcaggcauggaaccagcac

SEQ ID NO: 266891 - RNA, 19 nt, Human
gaucaggguagacuugagc

SEQ ID NO: 266892 - RNA, 23 nt, Human
gauccagucccuucgguuucaga

SEQ ID NO: 266893 - RNA, 25 nt, Human
gcacaguucuggggcccagcugccc

SEQ ID NO: 266894 - RNA, 23 nt, Human
ggcccaguugguauagucagugg

SEQ ID NO: 266895 - RNA, 23 nt, Human
ggggcccagcugcccacucucag

SEQ ID NO: 266896 - RNA, 19 nt, Human
gucaggagcuccugcugcc

SEQ ID NO: 266897 - RNA, 24 nt, Human
uaucccagugguacacagaaaguc

SEQ ID NO: 266898 - RNA, 20 nt, Human
uaugcccugaggugaucagg

SEQ ID NO: 266899 - RNA, 23 nt, Human
ucacacugcaauauagaaaagug

SEQ ID NO: 266900 - RNA, 19 nt, Human
ucacaggcucucacaaccg

SEQ ID NO: 266901 - RNA, 19 nt, Human
ucacuggaagaacaucaga

SEQ ID NO: 266902 - RNA, 18 nt, Human
ucaggaagcugggucacg

SEQ ID NO: 266903 - RNA, 18 nt, Human
ucaggagcuccugcugcc

SEQ ID NO: 266904 - RNA, 18 nt, Human
ucaucccaccugcagauc

SEQ ID NO: 266905 - RNA, 21 nt, Human
ucccucugggucuuucccuuc

SEQ ID NO: 266906 - RNA, 21 nt, Human
ucucagugaccugccagccug

SEQ ID NO: 266907 - RNA, 18 nt, Human
ucucuugucucucacucu

SEQ ID NO: 266908 - RNA, 18 nt, Human
ugagcaggggcccagcau

SEQ ID NO: 266909 - RNA, 22 nt, Human
ugagcaggggcccagcauucac

SEQ ID NO: 266910 - RNA, 20 nt, Human
ugcaaacacacguccccucu

SEQ ID NO: 266911 - RNA, 23 nt, Human
ugcaaacacacguccccucuucc

SEQ ID NO: 266912 - RNA, 25 nt, Human
ugccaccugcacggaggacucagga

SEQ ID NO: 266913 - RNA, 23 nt, Human
uggcuccaagucucguucuaggc

SEQ ID NO: 266914 - RNA, 22 nt, Human
ugguauagucagugguggcugg

SEQ ID NO: 266915 - RNA, 21 nt, Human
uucaaaguauggagagcuaga

SEQ ID NO: 266916 - RNA, 23 nt, Human
aaaaaucucaauucaaauacaac

SEQ ID NO: 266917 - RNA, 22 nt, Human
aaauacaacagccaaggcacag

SEQ ID NO: 266918 - RNA, 23 nt, Human
aacugacccaaauccccaggccc

SEQ ID NO: 266919 - RNA, 20 nt, Human
acaacugacccaaauccccc

SEQ ID NO: 266920 - RNA, 23 nt, Human
acagccaaggcacagcuggcacc

SEQ ID NO: 266921 - RNA, 28 nt, Human
acgcagccccaaaggugaggggaacgcc

SEQ ID NO: 266922 - RNA, 20 nt, Human
auccccaggcccuagguggc

SEQ ID NO: 266923 - RNA, 20 nt, Human
caacagccaaggcacagcug

SEQ ID NO: 266924 - RNA, 25 nt, Human
caacagccaaggcacagcuggcacc

SEQ ID NO: 266925 - RNA, 25 nt, Human
caauauccccccuaguucaacaccc

SEQ ID NO: 266926 - RNA, 24 nt, Human
cagcaauauccccccuaguucaac

SEQ ID NO: 266927 - RNA, 21 nt, Human
cagcaggcuuucugcuucuuu

SEQ ID NO: 266928 - RNA, 22 nt, Human
ccaaaggcuuuugcuuucacgg

SEQ ID NO: 266929 - RNA, 23 nt, Human
ccacucuguagccacggagggac

SEQ ID NO: 266930 - RNA, 22 nt, Human
ccauccccagcaggcuuucugc

SEQ ID NO: 266931 - RNA, 22 nt, Human
cccuagcuccuaacuaucccaa

SEQ ID NO: 266932 - RNA, 22 nt, Human
cgccgcgguggccaccgcagcc

SEQ ID NO: 266933 - RNA, 18 nt, Human
cuacaacugacccaaauc

SEQ ID NO: 266934 - RNA, 19 nt, Human
cuaguucaacacccaccuu

SEQ ID NO: 266935 - RNA, 19 nt, Human
cuuucugcuucugcaggag

SEQ ID NO: 266936 - RNA, 24 nt, Human
gaagcugccuuccacccuccgccc

SEQ ID NO: 266937 - RNA, 27 nt, Human
gaagggaaaagagggugggggagaggg

SEQ ID NO: 266938 - RNA, 19 nt, Human
gagggugggggagaggcaa

SEQ ID NO: 266939 - RNA, 21 nt, Human
gcaauauccccccuaguucaa

SEQ ID NO: 266940 - RNA, 18 nt, Human
gggggagaggcaacuaca

SEQ ID NO: 266941 - RNA, 22 nt, Human
gguggccaccgcagcccccucc

SEQ ID NO: 266942 - RNA, 21 nt, Human
ggugggggagaggcaacuaca

SEQ ID NO: 266943 - RNA, 20 nt, Human
uaacucgggcuccgccgcgg

SEQ ID NO: 266944 - RNA, 18 nt, Human
uagcuccuaacuaucccu

SEQ ID NO: 266945 - RNA, 19 nt, Human
ucccaaaauaaacccaagg

SEQ ID NO: 266946 - RNA, 18 nt, Human
ucuguagccacggaggga

SEQ ID NO: 266947 - RNA, 19 nt, Human
ucuguagccacggagggac

SEQ ID NO: 266948 - RNA, 24 nt, Human
ugaugaaacgcagccccaaaggug

SEQ ID NO: 266949 - RNA, 18 nt, Human
ugggaagggaaaagaggg

SEQ ID NO: 266950 - RNA, 20 nt, Human
ugucagaaaugagagggucc

SEQ ID NO: 266951 - RNA, 23 nt, Human
uucaaaugucagaaaugagaggg

SEQ ID NO: 266952 - RNA, 22 nt, Human
uuuuuuuuuuuguuuuugcuuu

SEQ ID NO: 266953 - RNA, 18 nt, Human
uuuuuuuuuuuuuuuuug

SEQ ID NO: 266954 - RNA, 25 nt, Human
uuuuuuuuuuuuuuuuuuguuuuuu

SEQ ID NO: 266955 - RNA, 21 nt, Human
aaccauguaacaugcaagagc

SEQ ID NO: 266956 - RNA, 21 nt, Human
aacuguauucuaucugaagca

SEQ ID NO: 266957 - RNA, 25 nt, Human
aacuguauucuaucugaagcauuag

SEQ ID NO: 266958 - RNA, 20 nt, Human
aagcauuagaagccaacugu

SEQ ID NO: 266959 - RNA, 21 nt, Human
agcaaugguuuucaggaagaa

SEQ ID NO: 266960 - RNA, 22 nt, Human
caauguaaaggguuaugugaga

SEQ ID NO: 266961 - RNA, 18 nt, Human
cagaggcuuggugaggcu

SEQ ID NO: 266962 - RNA, 22 nt, Human
cagccugcuccccccaggagcc

SEQ ID NO: 266963 - RNA, 23 nt, Human
caggaagaaacuauuaugccuua

SEQ ID NO: 266964 - RNA, 19 nt, Human
caucuccuucugccauugc

SEQ ID NO: 266965 - RNA, 23 nt, Human
cccaaaucacaagaaaacuugaa

SEQ ID NO: 266966 - RNA, 23 nt, Human
ccccaaaucacaagaaaacuuga

SEQ ID NO: 266967 - RNA, 23 nt, Human
ccccaggagcccugagcaucucc

SEQ ID NO: 266968 - RNA, 20 nt, Human
cccucagacuacaauuccug

SEQ ID NO: 266969 - RNA, 20 nt, Human
cccuggcuggcuggcucucc

SEQ ID NO: 266970 - RNA, 23 nt, Human
ccuggcuggcuggcucucccuuc

SEQ ID NO: 266971 - RNA, 20 nt, Human
ccuucagccugcucccccca

SEQ ID NO: 266972 - RNA, 21 nt, Human
ccuucugccauugccuguacu

SEQ ID NO: 266973 - RNA, 21 nt, Human
cuugaacuaugucauuaaaca

SEQ ID NO: 266974 - RNA, 19 nt, Human
gcccugagcaucuccuucu

SEQ ID NO: 266975 - RNA, 21 nt, Human
gcccugagcaucuccuucuga

SEQ ID NO: 266976 - RNA, 23 nt, Human
uauucugcuuccuuuagaaguua

SEQ ID NO: 266977 - RNA, 19 nt, Human
ucuacgcccucagacuaca

SEQ ID NO: 266978 - RNA, 19 nt, Human
ugaaauugucuacgcccuc

SEQ ID NO: 266979 - RNA, 22 nt, Human
ugaauaguuagauggugaccau

SEQ ID NO: 266980 - RNA, 24 nt, Human
ugacagaagauaaaggauauuuau

SEQ ID NO: 266981 - RNA, 21 nt, Human
ugagcaucuccuucugccauu

SEQ ID NO: 266982 - RNA, 22 nt, Human
ugccugggcccuggcuggcugg

SEQ ID NO: 266983 - RNA, 19 nt, Human
ugccuguacagcuuggagg

SEQ ID NO: 266984 - RNA, 23 nt, Human
uggaaagcagucaaagcugccug

SEQ ID NO: 266985 - RNA, 20 nt, Human
ugugguaaccauguaacaug

SEQ ID NO: 266986 - RNA, 19 nt, Human
uuccugaauaguuagaugg

SEQ ID NO: 266987 - RNA, 21 nt, Human
uuuuuuuuuuuuuuuuugggu

SEQ ID NO: 266988 - RNA, 21 nt, Human
uuuuuuuuuuuuuuuuuuggg

SEQ ID NO: 266989 - RNA, 19 nt, Human
aaaccgcgcuguguccuug

SEQ ID NO: 266990 - RNA, 29 nt, Human
aaccuagccccucaagguucagcucuggu

SEQ ID NO: 266991 - RNA, 23 nt, Human
aaugcccacccacugucccccac

SEQ ID NO: 266992 - RNA, 18 nt, Human
accacacaccaugccuca

SEQ ID NO: 266993 - RNA, 24 nt, Human
acccuaggggcaccaucccucggg

SEQ ID NO: 266994 - RNA, 22 nt, Human
acggguuggggguggguuacgg

SEQ ID NO: 266995 - RNA, 20 nt, Human
auaaauacagccccaggggc

SEQ ID NO: 266996 - RNA, 24 nt, Human
cacacaccaugccucagagauaaa

SEQ ID NO: 266997 - RNA, 18 nt, Human
cacccacugucccccacc

SEQ ID NO: 266998 - RNA, 20 nt, Human
cacgcccccccaaauaaccg

SEQ ID NO: 266999 - RNA, 22 nt, Human
cacugggucucacgccccccca

SEQ ID NO: 267000 - RNA, 23 nt, Human
cacugucccccaccccucccucu

SEQ ID NO: 267001 - RNA, 24 nt, Human
caggaauagauuacaaaaguauua

SEQ ID NO: 267002 - RNA, 23 nt, Human
ccaagcggcagagaguggccgga

SEQ ID NO: 267003 - RNA, 18 nt, Human
ccacugucccccaccccu

SEQ ID NO: 267004 - RNA, 21 nt, Human
cccaaauaaccggugcauccc

SEQ ID NO: 267005 - RNA, 18 nt, Human
cccacccacuguccccca

SEQ ID NO: 267006 - RNA, 19 nt, Human
ccccaaauaaccggugcau

SEQ ID NO: 267007 - RNA, 19 nt, Human
ccccaccccucccucuccu

SEQ ID NO: 267008 - RNA, 19 nt, Human
cccccaccccucccucucc

SEQ ID NO: 267009 - RNA, 18 nt, Human
cccuguagcaccacacac

SEQ ID NO: 267010 - RNA, 19 nt, Human
ccuguggggcgggggcgga

SEQ ID NO: 267011 - RNA, 22 nt, Human
ccuugcccuguggggcgggggc

SEQ ID NO: 267012 - RNA, 18 nt, Human
cgagggacccuaggggca

SEQ ID NO: 267013 - RNA, 21 nt, Human
cgagggucucacccccauggg

SEQ ID NO: 267014 - RNA, 20 nt, Human
cggcagagaguggccggaac

SEQ ID NO: 267015 - RNA, 23 nt, Human
cucaagagaggucgcuuuuaaag

SEQ ID NO: 267016 - RNA, 23 nt, Human
cucacgcccccccaaauaaccgg

SEQ ID NO: 267017 - RNA, 23 nt, Human
cuggcgguggcgcggcacggucc

SEQ ID NO: 267018 - RNA, 21 nt, Human
gaaugcccacccacugucccc

SEQ ID NO: 267019 - RNA, 18 nt, Human
gagcgcccgcggcucgcc

SEQ ID NO: 267020 - RNA, 18 nt, Human
gcccaacccaagcggcag

SEQ ID NO: 267021 - RNA, 18 nt, Human
gccccaggggcuccugcu

SEQ ID NO: 267022 - RNA, 18 nt, Human
ggcauuuaaguucaaucu

SEQ ID NO: 267023 - RNA, 21 nt, Human
gggcagggcuuaggucugcga

SEQ ID NO: 267024 - RNA, 18 nt, Human
gugguccugaaccgggaa

SEQ ID NO: 267025 - RNA, 19 nt, Human
uaaauacagccccaggggc

SEQ ID NO: 267026 - RNA, 21 nt, Human
ucaguucucccgccucuccua

SEQ ID NO: 267027 - RNA, 18 nt, Human
ucccccaccccucccucu

SEQ ID NO: 267028 - RNA, 22 nt, Human
ucccucgggcgggugggcggcc

SEQ ID NO: 267029 - RNA, 26 nt, Human
ucccuguagcaccacacaccaugccu

SEQ ID NO: 267030 - RNA, 18 nt, Human
uccuggcgguggcgcggc

SEQ ID NO: 267031 - RNA, 22 nt, Human
ucucccgccucuccuaccucaa

SEQ ID NO: 267032 - RNA, 24 nt, Human
ucuuuugggcgcgagggacccuag

SEQ ID NO: 267033 - RNA, 21 nt, Human
ugaaugcccacccacuguccc

SEQ ID NO: 267034 - RNA, 25 nt, Human
ugcccuguggggcgggggcggaaac

SEQ ID NO: 267035 - RNA, 21 nt, Human
ugccucagagauaaauacagc

SEQ ID NO: 267036 - RNA, 19 nt, Human
uggaaaaaaccgcgcugug

SEQ ID NO: 267037 - RNA, 19 nt, Human
uggcccaccgaggaacacg

SEQ ID NO: 267038 - RNA, 18 nt, Human
uggccggaacuuucugcc

SEQ ID NO: 267039 - RNA, 26 nt, Human
uguggggcgggggcggaaacuucagu

SEQ ID NO: 267040 - RNA, 28 nt, Human
uguguccuugcccuguggggagugcccu

SEQ ID NO: 267041 - RNA, 21 nt, Human
aaaaaaaaaaaaaauacaaaa

SEQ ID NO: 267042 - RNA, 22 nt, Human
aaaaaaaaaaaaaauacaaaac

SEQ ID NO: 267043 - RNA, 27 nt, Human
aaacaaaacaaaacauaaaaccacugg

SEQ ID NO: 267044 - RNA, 22 nt, Human
aaacaacacacgaaacaaaaca

SEQ ID NO: 267045 - RNA, 21 nt, Human
aacaauggcaaaaccacacaa

SEQ ID NO: 267046 - RNA, 22 nt, Human
aagaaaucacccccaagaggcc

SEQ ID NO: 267047 - RNA, 21 nt, Human
aagagaccagaacaggagacg

SEQ ID NO: 267048 - RNA, 19 nt, Human
aaggcuuguuccugccacc

SEQ ID NO: 267049 - RNA, 22 nt, Human
aaugcuuuguuaacaaaagaaa

SEQ ID NO: 267050 - RNA, 20 nt, Human
acaaaacaaaacauaaaacc

SEQ ID NO: 267051 - RNA, 18 nt, Human
acaaacaacacacgaaac

SEQ ID NO: 267052 - RNA, 18 nt, Human
acaauggcaaaaccacac

SEQ ID NO: 267053 - RNA, 19 nt, Human
acacacgaaacaaaacaaa

SEQ ID NO: 267054 - RNA, 22 nt, Human
acaggagaccuuggucggaugg

SEQ ID NO: 267055 - RNA, 20 nt, Human
acauggaugaggaaggggau

SEQ ID NO: 267056 - RNA, 18 nt, Human
acccccaagaggccccaa

SEQ ID NO: 267057 - RNA, 23 nt, Human
acccccaagaggccccaaccccu

SEQ ID NO: 267058 - RNA, 22 nt, Human
accccuuuucccugccuguccc

SEQ ID NO: 267059 - RNA, 24 nt, Human
accccuuuucccugccuguccccg

SEQ ID NO: 267060 - RNA, 21 nt, Human
agcaaaaaaaaaaaaaaaaaa

SEQ ID NO: 267061 - RNA, 22 nt, Human
agcccccaagcuccagcagccc

SEQ ID NO: 267062 - RNA, 18 nt, Human
agccuggcuuaggaggcc

SEQ ID NO: 267063 - RNA, 19 nt, Human
agcuccugaguuugccccc

SEQ ID NO: 267064 - RNA, 18 nt, Human
aggaaggggauagucugg

SEQ ID NO: 267065 - RNA, 23 nt, Human
aggccccaaccccuuuucccugc

SEQ ID NO: 267066 - RNA, 22 nt, Human
agggacuugggaacagagggcu

SEQ ID NO: 267067 - RNA, 18 nt, Human
aguggcaucuguggccag

SEQ ID NO: 267068 - RNA, 23 nt, Human
auaaaaccacuggaagguuccca

SEQ ID NO: 267069 - RNA, 18 nt, Human
auggcaccccagagcugg

SEQ ID NO: 267070 - RNA, 19 nt, Human
caaaacaaaacauaaaacc

SEQ ID NO: 267071 - RNA, 19 nt, Human
caaaacaauggcaaaacca

SEQ ID NO: 267072 - RNA, 18 nt, Human
cacacaaugcuuuguuaa

SEQ ID NO: 267073 - RNA, 27 nt, Human
cacacgaaacaaaacaaaacauaaaac

SEQ ID NO: 267074 - RNA, 24 nt, Human
cacgaaacaaaacaaaacauaaaa

SEQ ID NO: 267075 - RNA, 20 nt, Human
cagcccagccacuggcaucu

SEQ ID NO: 267076 - RNA, 21 nt, Human
cagcccccaagcuccagcagc

SEQ ID NO: 267077 - RNA, 24 nt, Human
cagcccccaagcuccagcagcccc

SEQ ID NO: 267078 - RNA, 25 nt, Human
ccaaauaaguuagcaaaaaaaaaaa

SEQ ID NO: 267079 - RNA, 31 nt, Human
ccaaauaaguuagcaaaaaaaaaaaaaaaaa

SEQ ID NO: 267080 - RNA, 21 nt, Human
ccagaacaggagacgugcaca

SEQ ID NO: 267081 - RNA, 18 nt, Human
cccagcccagccacuggc

SEQ ID NO: 267082 - RNA, 23 nt, Human
ccccaagaggccccaaccccuuu

SEQ ID NO: 267083 - RNA, 19 nt, Human
ccccaagcuccagcagccc

SEQ ID NO: 267084 - RNA, 22 nt, Human
cccccagggacuugggaacaga

SEQ ID NO: 267085 - RNA, 21 nt, Human
ccccuucuucucucucaauuc

SEQ ID NO: 267086 - RNA, 21 nt, Human
ccccuuuucccugccuguccc

SEQ ID NO: 267087 - RNA, 22 nt, Human
ccucuccccuucuucucucuca

SEQ ID NO: 267088 - RNA, 19 nt, Human
ccugccaccagcccccaag

SEQ ID NO: 267089 - RNA, 21 nt, Human
ccugccaccagcccccaagcu

SEQ ID NO: 267090 - RNA, 24 nt, Human
ccuuacauggaugaggaaggggau

SEQ ID NO: 267091 - RNA, 23 nt, Human
cgggaagagaccagaacaggaga

SEQ ID NO: 267092 - RNA, 19 nt, Human
cuccugaguuugcccccug

SEQ ID NO: 267093 - RNA, 21 nt, Human
cugggggguggguuaaccuua

SEQ ID NO: 267094 - RNA, 23 nt, Human
cuguggccagcuuggggggcucg

SEQ ID NO: 267095 - RNA, 18 nt, Human
cuucucucucaauucagg

SEQ ID NO: 267096 - RNA, 23 nt, Human
gaaacaaaacaaaacauaaaacc

SEQ ID NO: 267097 - RNA, 23 nt, Human
gcaaaaaaaaaaaaaaaaaaaaa

SEQ ID NO: 267098 - RNA, 21 nt, Human
ggccuauggcaccccagagcu

SEQ ID NO: 267099 - RNA, 19 nt, Human
ggcgcucugguccccugcu

SEQ ID NO: 267100 - RNA, 25 nt, Human
ggcuguuccucuccccuucuucucu

SEQ ID NO: 267101 - RNA, 19 nt, Human
gggggcucgcaaggaugcc

SEQ ID NO: 267102 - RNA, 27 nt, Human
uaaaaaaggaaauccaaauaaguuagc

SEQ ID NO: 267103 - RNA, 18 nt, Human
uaacaaaagaaaucaccc

SEQ ID NO: 267104 - RNA, 18 nt, Human
uacaaaacaauggcaaaa

SEQ ID NO: 267105 - RNA, 23 nt, Human
uacaaacaacacacgaaacaaaa

SEQ ID NO: 267106 - RNA, 24 nt, Human
ucacccccaagaggccccaacccc

SEQ ID NO: 267107 - RNA, 24 nt, Human
uccaaauaaguuagcaaaaaaaaa

SEQ ID NO: 267108 - RNA, 21 nt, Human
ucccaauauucacugcaaaag

SEQ ID NO: 267109 - RNA, 19 nt, Human
uccccugcuuuaccucccu

SEQ ID NO: 267110 - RNA, 18 nt, Human
ucgggaagagaccagaac

SEQ ID NO: 267111 - RNA, 24 nt, Human
ugccaccagcccccaagcuccagc

SEQ ID NO: 267112 - RNA, 22 nt, Human
ugcccucuccucuaaggaggca

SEQ ID NO: 267113 - RNA, 21 nt, Human
ugccuguccccggcaacuuca

SEQ ID NO: 267114 - RNA, 18 nt, Human
uggcaccccagagcuggc

SEQ ID NO: 267115 - RNA, 22 nt, Human
uggccccccagggacuugggaa

SEQ ID NO: 267116 - RNA, 25 nt, Human
uggcuuccuagcaucagggcagccu

SEQ ID NO: 267117 - RNA, 26 nt, Human
ugggaacagagggcuguuccucuccc

SEQ ID NO: 267118 - RNA, 21 nt, Human
uguccccggcaacuucagcac

SEQ ID NO: 267119 - RNA, 26 nt, Human
uguuccucuccccuucuucucucuca

SEQ ID NO: 267120 - RNA, 23 nt, Human
uuccugccaccagcccccaagcu

SEQ ID NO: 267121 - RNA, 19 nt, Human
aaagcaagagaaaacaagc

SEQ ID NO: 267122 - RNA, 22 nt, Human
aaugcaaaaaucaaaagcacaa

SEQ ID NO: 267123 - RNA, 24 nt, Human
acccaugugcccacacccgugaaa

SEQ ID NO: 267124 - RNA, 19 nt, Human
agaaaggaaaauugcaagg

SEQ ID NO: 267125 - RNA, 18 nt, Human
agacagaaaggaaaauug

SEQ ID NO: 267126 - RNA, 23 nt, Human
agacagaaaggaaaauugcaagg

SEQ ID NO: 267127 - RNA, 19 nt, Human
agagaagcacgguggcuuc

SEQ ID NO: 267128 - RNA, 19 nt, Human
augcuucaaagccucgaca

SEQ ID NO: 267129 - RNA, 20 nt, Human
caaaagcacaaugugugauc

SEQ ID NO: 267130 - RNA, 22 nt, Human
caaaugcaaaaaucaaaagcac

SEQ ID NO: 267131 - RNA, 27 nt, Human
caagagaaaacaagcuuaaccagguaa

SEQ ID NO: 267132 - RNA, 23 nt, Human
cacaugcugcacacguccaggug

SEQ ID NO: 267133 - RNA, 26 nt, Human
caccaaaugcaaaaaucaaaagcaca

SEQ ID NO: 267134 - RNA, 23 nt, Human
ccaaaugcaaaaaucaaaagcac

SEQ ID NO: 267135 - RNA, 21 nt, Human
ccacacccaugugcccacacc

SEQ ID NO: 267136 - RNA, 21 nt, Human
ccacacccgugaaaaugcuag

SEQ ID NO: 267137 - RNA, 22 nt, Human
ccacaugcugcacacguccagg

SEQ ID NO: 267138 - RNA, 23 nt, Human
cccacucucugucaggcaucugc

SEQ ID NO: 267139 - RNA, 18 nt, Human
ccuaaagcaagagaaaac

SEQ ID NO: 267140 - RNA, 23 nt, Human
cgacagccaggauuucagagaug

SEQ ID NO: 267141 - RNA, 18 nt, Human
cgccacaugcugcacacg

SEQ ID NO: 267142 - RNA, 20 nt, Human
cucccagacagaaaggaaaa

SEQ ID NO: 267143 - RNA, 23 nt, Human
cugccaacccacucucugucagg

SEQ ID NO: 267144 - RNA, 20 nt, Human
gccagcugcucauuuggaac

SEQ ID NO: 267145 - RNA, 22 nt, Human
uaaccagguaacacaugcuuca

SEQ ID NO: 267146 - RNA, 18 nt, Human
uauuuucccaucuccagg

SEQ ID NO: 267147 - RNA, 23 nt, Human
ucacacagagaccgccacaugcu

SEQ ID NO: 267148 - RNA, 21 nt, Human
ucagcccacacaggacaccac

SEQ ID NO: 267149 - RNA, 20 nt, Human
ucaggcaucugccgucuacc

SEQ ID NO: 267150 - RNA, 21 nt, Human
ucuacccucguguaaauacac

SEQ ID NO: 267151 - RNA, 19 nt, Human
ucugucaggcaucugccgu

SEQ ID NO: 267152 - RNA, 24 nt, Human
ucuuguggaaaacauuagcuuucu

SEQ ID NO: 267153 - RNA, 20 nt, Human
ugcaaaaaucaaaagcacaa

SEQ ID NO: 267154 - RNA, 21 nt, Human
ugcacacguccaggugccaca

SEQ ID NO: 267155 - RNA, 22 nt, Human
ugccacacccaugugcccacac

SEQ ID NO: 267156 - RNA, 18 nt, Human
uggaacaagcacacagca

SEQ ID NO: 267157 - RNA, 18 nt, Human
uuuuuuuuuuuuuuuuug

SEQ ID NO: 267158 - RNA, 24 nt, Human
uuuuuuuuuuuuuuuuugauuuuu

SEQ ID NO: 267159 - RNA, 23 nt, Human
aaugaugcaaaucagaggaggaa

SEQ ID NO: 267160 - RNA, 18 nt, Human
accuagagccugagaucc

SEQ ID NO: 267161 - RNA, 20 nt, Human
acugagacccuggaaccaag

SEQ ID NO: 267162 - RNA, 22 nt, Human
agcugggcaggcgugggggcag

SEQ ID NO: 267163 - RNA, 18 nt, Human
aggauacuggauuaacaa

SEQ ID NO: 267164 - RNA, 18 nt, Human
aguuuauugacuguuacu

SEQ ID NO: 267165 - RNA, 20 nt, Human
caaaucagaggaggaaacac

SEQ ID NO: 267166 - RNA, 23 nt, Human
caguggucagcucucccuggggu

SEQ ID NO: 267167 - RNA, 28 nt, Human
cauucccucuccaaauuggagccagaga

SEQ ID NO: 267168 - RNA, 20 nt, Human
cauugcaccuagagccugag

SEQ ID NO: 267169 - RNA, 18 nt, Human
ccauaaacgagcagguuc

SEQ ID NO: 267170 - RNA, 24 nt, Human
cccuggaaccaagaucccucccuc

SEQ ID NO: 267171 - RNA, 23 nt, Human
ccugggguccagcagcuuuggag

SEQ ID NO: 267172 - RNA, 24 nt, Human
cuccaaauuggagccagagagggg

SEQ ID NO: 267173 - RNA, 19 nt, Human
cucccugggguccagcagc

SEQ ID NO: 267174 - RNA, 25 nt, Human
cucuccuuuuucccuccauucccau

SEQ ID NO: 267175 - RNA, 23 nt, Human
cugcucagcauucccucuccaaa

SEQ ID NO: 267176 - RNA, 20 nt, Human
cuggaaccaagaucccuccc

SEQ ID NO: 267177 - RNA, 20 nt, Human
gagggaaaaggccuuuggga

SEQ ID NO: 267178 - RNA, 19 nt, Human
gaucccucccuccuugccc

SEQ ID NO: 267179 - RNA, 21 nt, Human
gcugggcaggcgugggggcag

SEQ ID NO: 267180 - RNA, 23 nt, Human
ggaguaaaggauggaaagguaga

SEQ ID NO: 267181 - RNA, 19 nt, Human
ggggcagcacuggcagugg

SEQ ID NO: 267182 - RNA, 18 nt, Human
gguccagcagcuuuggag

SEQ ID NO: 267183 - RNA, 23 nt, Human
uccuuuuucccuccauucccaua

SEQ ID NO: 267184 - RNA, 23 nt, Human
ucgggcaguggucagcucucccu

SEQ ID NO: 267185 - RNA, 22 nt, Human
ucugcccagggacuccccuuca

SEQ ID NO: 267186 - RNA, 24 nt, Human
ugagacccuggaaccaagaucccu

SEQ ID NO: 267187 - RNA, 19 nt, Human
ugagcgcaagcagcucaaa

SEQ ID NO: 267188 - RNA, 20 nt, Human
ugaugcaaaucagaggagga

SEQ ID NO: 267189 - RNA, 21 nt, Human
ugcccagggacuccccuucac

SEQ ID NO: 267190 - RNA, 18 nt, Human
ugcccggaggcucaggaa

SEQ ID NO: 267191 - RNA, 22 nt, Human
uggcagugggggagggaaguug

SEQ ID NO: 267192 - RNA, 22 nt, Human
ugggggcagcacuggcaguggg

SEQ ID NO: 267193 - RNA, 23 nt, Human
uuuuuuuuuuuuuuuuucauuuu

SEQ ID NO: 267194 - RNA, 21 nt, Human
acacuuugauauuuccuuugu

SEQ ID NO: 267195 - RNA, 23 nt, Human
acgccugcccggccagccuccgg

SEQ ID NO: 267196 - RNA, 23 nt, Human
agucaggaacaguuuaucuucau

SEQ ID NO: 267197 - RNA, 21 nt, Human
caaaauaguauaaagucagga

SEQ ID NO: 267198 - RNA, 21 nt, Human
caagaauaagcuagcugauca

SEQ ID NO: 267199 - RNA, 22 nt, Human
caccacgccugcccggccagcc

SEQ ID NO: 267200 - RNA, 23 nt, Human
caugguaaacauucacuuuaugc

SEQ ID NO: 267201 - RNA, 24 nt, Human
cccggccagccuccgggagcccgc

SEQ ID NO: 267202 - RNA, 21 nt, Human
ccgggauggcagcggcuuugc

SEQ ID NO: 267203 - RNA, 18 nt, Human
ccuccgggagcccgcugg

SEQ ID NO: 267204 - RNA, 21 nt, Human
ccuccgggauggcagcggcuu

SEQ ID NO: 267205 - RNA, 23 nt, Human
ccugcccggccagccuccgggag

SEQ ID NO: 267206 - RNA, 19 nt, Human
cugcccggccagccuccgg

SEQ ID NO: 267207 - RNA, 20 nt, Human
gagcccgcuggcugggcccu

SEQ ID NO: 267208 - RNA, 24 nt, Human
gagcccgcuggcugggcccuccgg

SEQ ID NO: 267209 - RNA, 19 nt, Human
gagggacccgggccgcggc

SEQ ID NO: 267210 - RNA, 21 nt, Human
ggcuugaaaaacacuuugaua

SEQ ID NO: 267211 - RNA, 22 nt, Human
gucaggaacaguuuaucuucau

SEQ ID NO: 267212 - RNA, 27 nt, Human
uaaaaaaaguacacaagaauaagcuag

SEQ ID NO: 267213 - RNA, 22 nt, Human
uaacaggcuugaaaaacacuuu

SEQ ID NO: 267214 - RNA, 18 nt, Human
uccacgcgcgguagccgu

SEQ ID NO: 267215 - RNA, 22 nt, Human
uccgggagcccgcuggcugggc

SEQ ID NO: 267216 - RNA, 18 nt, Human
uccgggauggcagcggcu

SEQ ID NO: 267217 - RNA, 20 nt, Human
ugcccggccagccuccggga

SEQ ID NO: 267218 - RNA, 22 nt, Human
ugcccggccagccuccgggagc

SEQ ID NO: 267219 - RNA, 21 nt, Human
uuaaaaagcugagguuauaga

SEQ ID NO: 267220 - RNA, 25 nt, Human
cccgcgcacgaugccguguccaccg

SEQ ID NO: 267221 - RNA, 20 nt, Human
cugcgugcugcccucuuccc

SEQ ID NO: 267222 - RNA, 18 nt, Human
gcccggcgcucggcgccu

SEQ ID NO: 267223 - RNA, 23 nt, Human
ugcgugcugcccucuuccccgcg

SEQ ID NO: 267224 - RNA, 18 nt, Human
ugcugcccucuuccccgc

SEQ ID NO: 267225 - RNA, 25 nt, Human
accaagcugcaguuacuccuuugag

SEQ ID NO: 267226 - RNA, 21 nt, Human
ucaaaccaagcugcaguuacu

SEQ ID NO: 267227 - RNA, 18 nt, Human
ugcaguuacuccuuugag

SEQ ID NO: 267228 - RNA, 21 nt, Human
uuacuccuuugagacaccaaa

SEQ ID NO: 267229 - RNA, 25 nt, Human
uuccaacaagaagccauaagguacc

SEQ ID NO: 267230 - RNA, 19 nt, Human
uuucaaaccaagcugcagu

SEQ ID NO: 267231 - RNA, 23 nt, Human
uuuuuuuuuuuuuuuuuuuucca

SEQ ID NO: 267232 - RNA, 24 nt, Human
uuuuuuuuuuuuuuuuuuuuuccu

SEQ ID NO: 267233 - RNA, 23 nt, Human
aaaagccaaucacaugauccaug

SEQ ID NO: 267234 - RNA, 26 nt, Human
aacucauuucccacaaagccuuccug

SEQ ID NO: 267235 - RNA, 22 nt, Human
aagaaagagcggaggggcgggg

SEQ ID NO: 267236 - RNA, 21 nt, Human
aagaggguuuacgcuuggaca

SEQ ID NO: 267237 - RNA, 18 nt, Human
aagcugcaggaccuggga

SEQ ID NO: 267238 - RNA, 21 nt, Human
acagcaggggcagcuccuggg

SEQ ID NO: 267239 - RNA, 21 nt, Human
accauacccuaaauacaagga

SEQ ID NO: 267240 - RNA, 21 nt, Human
acccuguacuuaaccaguaaa

SEQ ID NO: 267241 - RNA, 26 nt, Human
accgcagagcccccucccaccgcacu

SEQ ID NO: 267242 - RNA, 22 nt, Human
accuugcguccaaacaagucug

SEQ ID NO: 267243 - RNA, 18 nt, Human
acgucugaaaagcacugg

SEQ ID NO: 267244 - RNA, 23 nt, Human
agaaaaaggcagccacuggcuua

SEQ ID NO: 267245 - RNA, 22 nt, Human
agaaagagcggaggggcggggc

SEQ ID NO: 267246 - RNA, 23 nt, Human
agaaguagggguugggguggagc

SEQ ID NO: 267247 - RNA, 24 nt, Human
agaaugaagggugaagagauaggg

SEQ ID NO: 267248 - RNA, 19 nt, Human
agagcccccucccaccgca

SEQ ID NO: 267249 - RNA, 20 nt, Human
agagcccccucccaccgcac

SEQ ID NO: 267250 - RNA, 21 nt, Human
agcaagacaggcaagaaccca

SEQ ID NO: 267251 - RNA, 22 nt, Human
agcacuaugaacaagacccaaa

SEQ ID NO: 267252 - RNA, 20 nt, Human
agcaggcugaggugcuggcc

SEQ ID NO: 267253 - RNA, 18 nt, Human
aggaggggccagacgaug

SEQ ID NO: 267254 - RNA, 24 nt, Human
aggcaagaacccaucauuccuuca

SEQ ID NO: 267255 - RNA, 18 nt, Human
aggccuggggagcagaga

SEQ ID NO: 267256 - RNA, 21 nt, Human
aggggacugcugggcagagca

SEQ ID NO: 267257 - RNA, 22 nt, Human
aggguuuacgcuuggacagggc

SEQ ID NO: 267258 - RNA, 18 nt, Human
auagaggugagauuugaa

SEQ ID NO: 267259 - RNA, 19 nt, Human
augcacggaggggcaggcc

SEQ ID NO: 267260 - RNA, 20 nt, Human
auggucucaacucauuuccc

SEQ ID NO: 267261 - RNA, 20 nt, Human
caaagcaagacaggcaagaa

SEQ ID NO: 267262 - RNA, 23 nt, Human
caaagcaagacaggcaagaacca

SEQ ID NO: 267263 - RNA, 23 nt, Human
caaagcaagacaggcaagaaccc

SEQ ID NO: 267264 - RNA, 25 nt, Human
caacucccaaguccauggucucaac

SEQ ID NO: 267265 - RNA, 21 nt, Human
caacuccuggacagguuugug

SEQ ID NO: 267266 - RNA, 25 nt, Human
caacuccuggacagguuuguggaca

SEQ ID NO: 267267 - RNA, 18 nt, Human
caaucaggcacccccagg

SEQ ID NO: 267268 - RNA, 22 nt, Human
cacauggaaguagaggccagga

SEQ ID NO: 267269 - RNA, 23 nt, Human
caccaagaaagagcggaggggcg

SEQ ID NO: 267270 - RNA, 24 nt, Human
caccacagccugucacauguccca

SEQ ID NO: 267271 - RNA, 23 nt, Human
caccauacccuaaauacaaggac

SEQ ID NO: 267272 - RNA, 24 nt, Human
cacuuuggaaaaggaggggccaga

SEQ ID NO: 267273 - RNA, 21 nt, Human
cagagaaccuccccacuugcc

SEQ ID NO: 267274 - RNA, 19 nt, Human
cagcaccccguguagugcc

SEQ ID NO: 267275 - RNA, 22 nt, Human
cagcuuccgaggaccugaccag

SEQ ID NO: 267276 - RNA, 25 nt, Human
caggcucaacucuggcccccaacuc

SEQ ID NO: 267277 - RNA, 23 nt, Human
ccaaaaccgcagagcccccuccc

SEQ ID NO: 267278 - RNA, 24 nt, Human
ccaaagcaagacaggcaagaaccc

SEQ ID NO: 267279 - RNA, 28 nt, Human
ccaacucccaaguccauggucucaacuc

SEQ ID NO: 267280 - RNA, 19 nt, Human
ccacaaagccuuccuggag

SEQ ID NO: 267281 - RNA, 21 nt, Human
ccagaaaauacuccuugggca

SEQ ID NO: 267282 - RNA, 18 nt, Human
ccagggaagacaagugcc

SEQ ID NO: 267283 - RNA, 20 nt, Human
cccacaaagccuuccuggag

SEQ ID NO: 267284 - RNA, 26 nt, Human
cccaggacaaaaggaaaacuuauaca

SEQ ID NO: 267285 - RNA, 24 nt, Human
ccccaaaaccgcagagcccccucc

SEQ ID NO: 267286 - RNA, 18 nt, Human
ccccagccaucacuuccc

SEQ ID NO: 267287 - RNA, 19 nt, Human
cccccaacucccaagucca

SEQ ID NO: 267288 - RNA, 20 nt, Human
cccccaacucccaaguccau

SEQ ID NO: 267289 - RNA, 19 nt, Human
cccugggcaugccaaggcu

SEQ ID NO: 267290 - RNA, 20 nt, Human
cccugggcaugccaaggcuc

SEQ ID NO: 267291 - RNA, 28 nt, Human
cccuggguccccaaaaccgcagagcccc

SEQ ID NO: 267292 - RNA, 20 nt, Human
ccguguagugccaccagagu

SEQ ID NO: 267293 - RNA, 21 nt, Human
ccuucagaaauacgaaacaac

SEQ ID NO: 267294 - RNA, 21 nt, Human
ccuuggcuaaaagaggagggc

SEQ ID NO: 267295 - RNA, 21 nt, Human
cgaaacaacgugucuuggaug

SEQ ID NO: 267296 - RNA, 21 nt, Human
cgcccgggcucagaaaaaggc

SEQ ID NO: 267297 - RNA, 20 nt, Human
cgcccuggguccccaaaacc

SEQ ID NO: 267298 - RNA, 23 nt, Human
cgccuucggccccgcccgggcuc

SEQ ID NO: 267299 - RNA, 22 nt, Human
cggaccaaagcaagacaggcaa

SEQ ID NO: 267300 - RNA, 21 nt, Human
cggaggggcggggcugcggca

SEQ ID NO: 267301 - RNA, 21 nt, Human
cggcaggcuccggacuuccag

SEQ ID NO: 267302 - RNA, 21 nt, Human
cuaagaaacgucugaaaagca

SEQ ID NO: 267303 - RNA, 23 nt, Human
cucucuaccauuuuauuuuugua

SEQ ID NO: 267304 - RNA, 21 nt, Human
cucugccacuagcucucucca

SEQ ID NO: 267305 - RNA, 18 nt, Human
cuguccuaaguuucucaa

SEQ ID NO: 267306 - RNA, 19 nt, Human
cuuggccucauuguguugu

SEQ ID NO: 267307 - RNA, 24 nt, Human
gaaaaaggcagccacuggcuuaag

SEQ ID NO: 267308 - RNA, 23 nt, Human
gaccucacacccucugcagugcu

SEQ ID NO: 267309 - RNA, 19 nt, Human
gacucagcuuccgaggacc

SEQ ID NO: 267310 - RNA, 19 nt, Human
gagcucaggaggcuggcga

SEQ ID NO: 267311 - RNA, 23 nt, Human
gaggcuggcgaguugcucagcaa

SEQ ID NO: 267312 - RNA, 23 nt, Human
gauaugaaccuccuuugcagcca

SEQ ID NO: 267313 - RNA, 24 nt, Human
gauuugaauccagcaccccgugua

SEQ ID NO: 267314 - RNA, 20 nt, Human
gcaagacaggcaagaaccca

SEQ ID NO: 267315 - RNA, 20 nt, Human
gcagagcccccucccaccgc

SEQ ID NO: 267316 - RNA, 23 nt, Human
gcagcacagugcaaggccugggg

SEQ ID NO: 267317 - RNA, 24 nt, Human
gcauauguaaguuuuuacaccaua

SEQ ID NO: 267318 - RNA, 24 nt, Human
gcauguuuguugaaagaaugaagg

SEQ ID NO: 267319 - RNA, 20 nt, Human
gccccauccccagccaucac

SEQ ID NO: 267320 - RNA, 19 nt, Human
gcccuggguccccaaaacc

SEQ ID NO: 267321 - RNA, 22 nt, Human
gcuagcucggccgcccucaacc

SEQ ID NO: 267322 - RNA, 19 nt, Human
gcuuggacagggcauagaa

SEQ ID NO: 267323 - RNA, 20 nt, Human
ggacaaaaggaaaacuuaua

SEQ ID NO: 267324 - RNA, 20 nt, Human
ggacagguuuguggacacau

SEQ ID NO: 267325 - RNA, 22 nt, Human
ggacagguuuguggacacaucu

SEQ ID NO: 267326 - RNA, 24 nt, Human
ggaccaaagcaagacaggcaagaa

SEQ ID NO: 267327 - RNA, 23 nt, Human
ggcacccccaggacaaaaggaaa

SEQ ID NO: 267328 - RNA, 19 nt, Human
ggcaggcuccggacuucca

SEQ ID NO: 267329 - RNA, 21 nt, Human
gggaagacaagugcccuguag

SEQ ID NO: 267330 - RNA, 19 nt, Human
gggacugcugggcagagca

SEQ ID NO: 267331 - RNA, 19 nt, Human
gggagucccgagggccuac

SEQ ID NO: 267332 - RNA, 18 nt, Human
gggcagagcacaagcugc

SEQ ID NO: 267333 - RNA, 18 nt, Human
gggcauggagcucaggag

SEQ ID NO: 267334 - RNA, 23 nt, Human
gucuguauuuaacugaaaaaaaa

SEQ ID NO: 267335 - RNA, 18 nt, Human
uaacaaaaugugcauaug

SEQ ID NO: 267336 - RNA, 18 nt, Human
uacaaucuucuggucacu

SEQ ID NO: 267337 - RNA, 27 nt, Human
uacggaccaaagcaagacaggcaagaa

SEQ ID NO: 267338 - RNA, 19 nt, Human
uaggaucaaucaggcaccc

SEQ ID NO: 267339 - RNA, 22 nt, Human
uaggaucaaucaggcaccccca

SEQ ID NO: 267340 - RNA, 19 nt, Human
uaugaacaagacccaaagg

SEQ ID NO: 267341 - RNA, 19 nt, Human
uauuacaacuacuugauua

SEQ ID NO: 267342 - RNA, 23 nt, Human
ucaacucauuucccacaaagccu

SEQ ID NO: 267343 - RNA, 19 nt, Human
ucacaugauccaugggcau

SEQ ID NO: 267344 - RNA, 19 nt, Human
ucaccaucaccacugccag

SEQ ID NO: 267345 - RNA, 21 nt, Human
ucacuuuggaaaaggaggggc

SEQ ID NO: 267346 - RNA, 19 nt, Human
uccaaaggggagagccacc

SEQ ID NO: 267347 - RNA, 21 nt, Human
uccagcaccccguguagugcc

SEQ ID NO: 267348 - RNA, 18 nt, Human
uccauauuacaacuacuu

SEQ ID NO: 267349 - RNA, 19 nt, Human
uccauggucucaacucauu

SEQ ID NO: 267350 - RNA, 20 nt, Human
ucccacaaagccuuccugga

SEQ ID NO: 267351 - RNA, 23 nt, Human
uccccaaaaccgcagagcccccu

SEQ ID NO: 267352 - RNA, 19 nt, Human
uccuuaggaagagggacag

SEQ ID NO: 267353 - RNA, 18 nt, Human
ucgaaaacuuccaaaucc

SEQ ID NO: 267354 - RNA, 23 nt, Human
ucucugccacuagcucucuccaa

SEQ ID NO: 267355 - RNA, 25 nt, Human
ucugcagugcugggagucccgaggg

SEQ ID NO: 267356 - RNA, 23 nt, Human
ugaacaagacccaaaggcagagc

SEQ ID NO: 267357 - RNA, 22 nt, Human
ugaccugagggagccaaggucu

SEQ ID NO: 267358 - RNA, 18 nt, Human
ugauccaugggcauuccu

SEQ ID NO: 267359 - RNA, 21 nt, Human
ugcaaggccuggggcacuggg

SEQ ID NO: 267360 - RNA, 20 nt, Human
ugccccaaaagaaguuucca

SEQ ID NO: 267361 - RNA, 20 nt, Human
ugccugaacagcacuaugaa

SEQ ID NO: 267362 - RNA, 19 nt, Human
ugcugggagucccgagggc

SEQ ID NO: 267363 - RNA, 21 nt, Human
uggaaaaggaggggccagacg

SEQ ID NO: 267364 - RNA, 21 nt, Human
uggcccccaacucccaagucc

SEQ ID NO: 267365 - RNA, 19 nt, Human
ugggcauuccuggcaagag

SEQ ID NO: 267366 - RNA, 24 nt, Human
uggguccccaaaaccgcagagccc

SEQ ID NO: 267367 - RNA, 19 nt, Human
ugggugcuccugcauucaa

SEQ ID NO: 267368 - RNA, 18 nt, Human
uggugccaccacagccug

SEQ ID NO: 267369 - RNA, 20 nt, Human
uguaacaaaaugugcauaug

SEQ ID NO: 267370 - RNA, 21 nt, Human
uguccuaaguuucucaacagc

SEQ ID NO: 267371 - RNA, 24 nt, Human
uguguugggcucuggaagcuaaga

SEQ ID NO: 267372 - RNA, 20 nt, Human
uuaagacacaacuccuggac

SEQ ID NO: 267373 - RNA, 19 nt, Human
uuaccccuguccuuaggaa

SEQ ID NO: 267374 - RNA, 24 nt, Human
uugaaagaaugaagggugaagaga

SEQ ID NO: 267375 - RNA, 20 nt, Human
uuucccacaaagccuuccug

SEQ ID NO: 267376 - RNA, 23 nt, Human
uuucccacaaagccuuccuggag

SEQ ID NO: 267377 - RNA, 20 nt, Human
uuuuuacaccauacccuaaa

SEQ ID NO: 267378 - RNA, 22 nt, Human
aagcccgggcucagggccagga

SEQ ID NO: 267379 - RNA, 20 nt, Human
acaguacuuuaaucccacac

SEQ ID NO: 267380 - RNA, 26 nt, Human
acuuuggguggugguggagggcaggu

SEQ ID NO: 267381 - RNA, 19 nt, Human
agagcgccuucggguaaaa

SEQ ID NO: 267382 - RNA, 24 nt, Human
auccccccaggucagaccccacca

SEQ ID NO: 267383 - RNA, 20 nt, Human
cacgcgguggggagcgugug

SEQ ID NO: 267384 - RNA, 22 nt, Human
cacguggacccgaaggcuaagc

SEQ ID NO: 267385 - RNA, 25 nt, Human
cagcugccgccuccggccacgugga

SEQ ID NO: 267386 - RNA, 23 nt, Human
cagggccgaaggggacccgcugg

SEQ ID NO: 267387 - RNA, 21 nt, Human
ccaauccccccaggucagacc

SEQ ID NO: 267388 - RNA, 22 nt, Human
ccccccaggucagaccccacca

SEQ ID NO: 267389 - RNA, 20 nt, Human
cgcaaauaacuuccauccaa

SEQ ID NO: 267390 - RNA, 27 nt, Human
cggcuuccggguaccaggauacucccu

SEQ ID NO: 267391 - RNA, 22 nt, Human
cguggacccgaaggcuaagccc

SEQ ID NO: 267392 - RNA, 19 nt, Human
cugccgccuccggccacgu

SEQ ID NO: 267393 - RNA, 22 nt, Human
cuguccagcucugggcccugga

SEQ ID NO: 267394 - RNA, 20 nt, Human
cuuuaaucccacacuuuggg

SEQ ID NO: 267395 - RNA, 18 nt, Human
gccuccggccacguggac

SEQ ID NO: 267396 - RNA, 21 nt, Human
gcgugugaccccggcuccagg

SEQ ID NO: 267397 - RNA, 21 nt, Human
ggaauuagcggaaaacaaggc

SEQ ID NO: 267398 - RNA, 18 nt, Human
ggagggcaggucauuucc

SEQ ID NO: 267399 - RNA, 21 nt, Human
gggccaggagucgcggcuucc

SEQ ID NO: 267400 - RNA, 19 nt, Human
guggggcggcccgcgucca

SEQ ID NO: 267401 - RNA, 19 nt, Human
uaacuuccauccaaccauc

SEQ ID NO: 267402 - RNA, 21 nt, Human
uaagcccgggcucagggccag

SEQ ID NO: 267403 - RNA, 23 nt, Human
uaccaggauacucccuugggggc

SEQ ID NO: 267404 - RNA, 19 nt, Human
ucauuucccuccaaucccc

SEQ ID NO: 267405 - RNA, 19 nt, Human
uccccccaggucagacccc

SEQ ID NO: 267406 - RNA, 18 nt, Human
ucccuugggggcgucucg

SEQ ID NO: 267407 - RNA, 21 nt, Human
ugcgggucccgcgacggccag

SEQ ID NO: 267408 - RNA, 27 nt, Human
uggaaagaaaacaguacuuuaauccca

SEQ ID NO: 267409 - RNA, 24 nt, Human
uggaauuagcggaaaacaaggccc

SEQ ID NO: 267410 - RNA, 20 nt, Human
uggggagcgugugaccccgg

SEQ ID NO: 267411 - RNA, 19 nt, Human
uguccagcucugggcccug

SEQ ID NO: 267412 - RNA, 22 nt, Human
uucccuccaauccccccagguc

SEQ ID NO: 267413 - RNA, 18 nt, Human
cugcgcaugcgcuucacu

SEQ ID NO: 267414 - RNA, 22 nt, Human
uagcaggaccuccgcgaccacc

SEQ ID NO: 267415 - RNA, 22 nt, Human
ucaauggaaauaguggauuuuu

SEQ ID NO: 267416 - RNA, 18 nt, Human
uccgcgaccacccgcugc

SEQ ID NO: 267417 - RNA, 20 nt, Human
ugaacccagguguccugggg

SEQ ID NO: 267418 - RNA, 23 nt, Human
ugggugugaacccaggugucccc

SEQ ID NO: 267419 - RNA, 22 nt, Human
uuuuuuuuuuuuuuuucaaugg

SEQ ID NO: 267420 - RNA, 21 nt, Human
aaacaugaccaaaggacauca

SEQ ID NO: 267421 - RNA, 25 nt, Human
aaacucuaccagggagaccgcgcga

SEQ ID NO: 267422 - RNA, 19 nt, Human
aaaucaacacuguguagca

SEQ ID NO: 267423 - RNA, 21 nt, Human
aacacuguguagcaccaaacu

SEQ ID NO: 267424 - RNA, 20 nt, Human
aagguagaacacaauacaaa

SEQ ID NO: 267425 - RNA, 21 nt, Human
acaaacucuaccagggagacc

SEQ ID NO: 267426 - RNA, 18 nt, Human
accagagaugggcagaaa

SEQ ID NO: 267427 - RNA, 21 nt, Human
acuaccaagaaaccacaaaaa

SEQ ID NO: 267428 - RNA, 20 nt, Human
agcggagcuggagcugggga

SEQ ID NO: 267429 - RNA, 25 nt, Human
agcgguggcggcaaggccucucccu

SEQ ID NO: 267430 - RNA, 23 nt, Human
agguggcagcggcaguggaggcu

SEQ ID NO: 267431 - RNA, 21 nt, Human
aguggcggcggcggaggcccg

SEQ ID NO: 267432 - RNA, 22 nt, Human
aguguucagguuacaggucagg

SEQ ID NO: 267433 - RNA, 19 nt, Human
aguuucacagcuacagucu

SEQ ID NO: 267434 - RNA, 24 nt, Human
auagaauaaacuggcacuuagaca

SEQ ID NO: 267435 - RNA, 19 nt, Human
augaagugaucauuuucag

SEQ ID NO: 267436 - RNA, 21 nt, Human
auuuguuucaguuaacaauuc

SEQ ID NO: 267437 - RNA, 23 nt, Human
caaacuaaugaaggcacagcuag

SEQ ID NO: 267438 - RNA, 21 nt, Human
caaaggacaucacaaaaauca

SEQ ID NO: 267439 - RNA, 20 nt, Human
caagaaaccacaaaaacuug

SEQ ID NO: 267440 - RNA, 19 nt, Human
caagcagauuuaaacccuu

SEQ ID NO: 267441 - RNA, 24 nt, Human
cacuauaugucacauacacaaggu

SEQ ID NO: 267442 - RNA, 18 nt, Human
cacuguguagcaccaaac

SEQ ID NO: 267443 - RNA, 19 nt, Human
cagaggccggcgcugaggu

SEQ ID NO: 267444 - RNA, 23 nt, Human
cagcagcggcgcagagcggagcu

SEQ ID NO: 267445 - RNA, 25 nt, Human
cagcggcgcagagcggagcuggagc

SEQ ID NO: 267446 - RNA, 27 nt, Human
ccuacaaacucuaccagggagaccgcc

SEQ ID NO: 267447 - RNA, 27 nt, Human
cgauggcagcagcggcgcagagcggag

SEQ ID NO: 267448 - RNA, 20 nt, Human
cuugcaagccuacaaacucu

SEQ ID NO: 267449 - RNA, 21 nt, Human
cuuuagauaauugacaacagc

SEQ ID NO: 267450 - RNA, 23 nt, Human
gaaucaaauguggucuuuucaca

SEQ ID NO: 267451 - RNA, 19 nt, Human
gaccaaaggacaucacaaa

SEQ ID NO: 267452 - RNA, 22 nt, Human
gaccgcgcgaccagagaugggc

SEQ ID NO: 267453 - RNA, 20 nt, Human
gagaugggcagaaaaugacu

SEQ ID NO: 267454 - RNA, 19 nt, Human
gagcuggggaugcagaggc

SEQ ID NO: 267455 - RNA, 26 nt, Human
gaguggcggcggcggaggcccgggcu

SEQ ID NO: 267456 - RNA, 22 nt, Human
gcaguggaggcuugggcgacag

SEQ ID NO: 267457 - RNA, 22 nt, Human
gcgaccagagaugggcagaaaa

SEQ ID NO: 267458 - RNA, 19 nt, Human
gcggaggcccgggcugcgg

SEQ ID NO: 267459 - RNA, 20 nt, Human
gcggcggcggaggcccgggc

SEQ ID NO: 267460 - RNA, 19 nt, Human
ggagcuggggaugcagagg

SEQ ID NO: 267461 - RNA, 18 nt, Human
ggcagcggcaguggaggc

SEQ ID NO: 267462 - RNA, 18 nt, Human
ggcggcggcggaggcccg

SEQ ID NO: 267463 - RNA, 20 nt, Human
gggcgacagcgguggcggca

SEQ ID NO: 267464 - RNA, 19 nt, Human
gggcugcggagguggcagc

SEQ ID NO: 267465 - RNA, 21 nt, Human
guggcagcggcgauggcagca

SEQ ID NO: 267466 - RNA, 20 nt, Human
guggcggcggcggaggcccg

SEQ ID NO: 267467 - RNA, 18 nt, Human
uaacagaaacaugaccaa

SEQ ID NO: 267468 - RNA, 21 nt, Human
uacaagaacaugaaaaacagu

SEQ ID NO: 267469 - RNA, 26 nt, Human
uagcaaacuaaugaaggcacagcuag

SEQ ID NO: 267470 - RNA, 18 nt, Human
uauguuauauuaacaccu

SEQ ID NO: 267471 - RNA, 19 nt, Human
ucacggaugcuugaguggc

SEQ ID NO: 267472 - RNA, 24 nt, Human
ugaaagggaagguagaacacaaua

SEQ ID NO: 267473 - RNA, 19 nt, Human
ugaccaaaggacaucacaa

SEQ ID NO: 267474 - RNA, 18 nt, Human
ugccgagauguaccgcag

SEQ ID NO: 267475 - RNA, 22 nt, Human
ugcuuuagauaauugacaacag

SEQ ID NO: 267476 - RNA, 18 nt, Human
uggcagcggcaguggagg

SEQ ID NO: 267477 - RNA, 19 nt, Human
uggcagcggcaguggaggc

SEQ ID NO: 267478 - RNA, 22 nt, Human
uggcggcggcggaggcccgggc

SEQ ID NO: 267479 - RNA, 19 nt, Human
ugggcuggaaaaaagaaaa

SEQ ID NO: 267480 - RNA, 30 nt, Human
uguuucaguuaacaauucugacaguuucaa

SEQ ID NO: 267481 - RNA, 20 nt, Human
uuauuuauuuuagguugcaa

SEQ ID NO: 267482 - RNA, 19 nt, Human
uucacauuagauguaugcu

SEQ ID NO: 267483 - RNA, 25 nt, Human
uugaguggcggcggcggaggcccuu

SEQ ID NO: 267484 - RNA, 24 nt, Human
uuuagauaauugacaacagcuuac

SEQ ID NO: 267485 - RNA, 23 nt, Human
uuucaaggcuguaugaaucugcu

SEQ ID NO: 267486 - RNA, 18 nt, Human
cgccguggccuccaacaa

SEQ ID NO: 267487 - RNA, 21 nt, Human
gccgaggcuccuagcuccucu

SEQ ID NO: 267488 - RNA, 21 nt, Human
ggcaguggcggcgacccuagc

SEQ ID NO: 267489 - RNA, 21 nt, Human
ggcaguggcggcgacccuagc

SEQ ID NO: 267490 - RNA, 20 nt, Human
ucacgccuccugcggcagug

SEQ ID NO: 267491 - RNA, 19 nt, Human
ucgcucgcuuuggggcugc

SEQ ID NO: 267492 - RNA, 18 nt, Human
uuuuuauccccucacgcc

SEQ ID NO: 267493 - RNA, 24 nt, Human
aaaaagcaaaacuuuccucuaaga

SEQ ID NO: 267494 - RNA, 22 nt, Human
aaagaacauauucagaugccaa

SEQ ID NO: 267495 - RNA, 24 nt, Human
aaauaccccuucagacgggucccu

SEQ ID NO: 267496 - RNA, 20 nt, Human
aacaaaaaggacauaaaaac

SEQ ID NO: 267497 - RNA, 22 nt, Human
aacaaaaaggacauaaaaacac

SEQ ID NO: 267498 - RNA, 19 nt, Human
aacaacacaaaaagcaaag

SEQ ID NO: 267499 - RNA, 22 nt, Human
aacagaucuugugauaugugug

SEQ ID NO: 267500 - RNA, 22 nt, Human
aacaucauuccaauacuacuua

SEQ ID NO: 267501 - RNA, 22 nt, Human
aaccccacuuuucucucugauc

SEQ ID NO: 267502 - RNA, 18 nt, Human
aagacaaaacuaaagagg

SEQ ID NO: 267503 - RNA, 21 nt, Human
aagcguaugucuaaaguacaa

SEQ ID NO: 267504 - RNA, 19 nt, Human
aaggacauaaaaacacgug

SEQ ID NO: 267505 - RNA, 24 nt, Human
aaguagaaacaaacuacuuaaaac

SEQ ID NO: 267506 - RNA, 18 nt, Human
aagugacccucuaauuga

SEQ ID NO: 267507 - RNA, 19 nt, Human
aauauaaaucauuuaacua

SEQ ID NO: 267508 - RNA, 24 nt, Human
aaucacaggauaacaaaaauagaa

SEQ ID NO: 267509 - RNA, 22 nt, Human
acaaaaaggacauaaaaacacg

SEQ ID NO: 267510 - RNA, 21 nt, Human
acaaagguuugcauuuggaca

SEQ ID NO: 267511 - RNA, 23 nt, Human
acaaucaaguccccugagaaaca

SEQ ID NO: 267512 - RNA, 19 nt, Human
accccacuuuucucucugg

SEQ ID NO: 267513 - RNA, 18 nt, Human
acccucccucuggcggcc

SEQ ID NO: 267514 - RNA, 24 nt, Human
acggaacaacacaaaaagcaaagg

SEQ ID NO: 267515 - RNA, 23 nt, Human
acuaaagaggaguuagcugcaug

SEQ ID NO: 267516 - RNA, 24 nt, Human
acuacagugcaccuguagucccag

SEQ ID NO: 267517 - RNA, 24 nt, Human
acuguccuaaacuaaacacacauu

SEQ ID NO: 267518 - RNA, 19 nt, Human
agaaaacgcuggggguucu

SEQ ID NO: 267519 - RNA, 20 nt, Human
agaacacaccaccucaacgu

SEQ ID NO: 267520 - RNA, 18 nt, Human
agagcuuccugcucuacc

SEQ ID NO: 267521 - RNA, 19 nt, Human
agaggacucaagcugcaga

SEQ ID NO: 267522 - RNA, 23 nt, Human
agauaaucuauccagcccugacc

SEQ ID NO: 267523 - RNA, 22 nt, Human
agcaacacagacuuggcgagcu

SEQ ID NO: 267524 - RNA, 21 nt, Human
aggaaugagauucugaaguac

SEQ ID NO: 267525 - RNA, 19 nt, Human
aggcaggucacgggggcau

SEQ ID NO: 267526 - RNA, 20 nt, Human
aggcaggucacgggggcaug

SEQ ID NO: 267527 - RNA, 22 nt, Human
aggcaggucacgggggcaugcu

SEQ ID NO: 267528 - RNA, 21 nt, Human
aggcuccacaaauaccaauga

SEQ ID NO: 267529 - RNA, 18 nt, Human
agugcaccuguaguccca

SEQ ID NO: 267530 - RNA, 20 nt, Human
aguucaaacacauaagccaa

SEQ ID NO: 267531 - RNA, 18 nt, Human
auacaggacauuccugua

SEQ ID NO: 267532 - RNA, 21 nt, Human
auacuacuuacuacuaccuga

SEQ ID NO: 267533 - RNA, 19 nt, Human
aucacaggauaacaaaaau

SEQ ID NO: 267534 - RNA, 23 nt, Human
aucuucuggcaggucucuucuag

SEQ ID NO: 267535 - RNA, 22 nt, Human
augaacuaacuccagauuugcu

SEQ ID NO: 267536 - RNA, 19 nt, Human
auuaaauaaaaaagaacuc

SEQ ID NO: 267537 - RNA, 22 nt, Human
auuccuguaccacauucacccc

SEQ ID NO: 267538 - RNA, 25 nt, Human
caaacuacuuaaaaccagaggacuc

SEQ ID NO: 267539 - RNA, 24 nt, Human
caaagcacagagaaaaugcaaagc

SEQ ID NO: 267540 - RNA, 18 nt, Human
caacacaaaaagcaaaga

SEQ ID NO: 267541 - RNA, 23 nt, Human
caagaugaacaggagccucuccu

SEQ ID NO: 267542 - RNA, 24 nt, Human
caagcuauaaaaauguugccacaa

SEQ ID NO: 267543 - RNA, 22 nt, Human
caagcugcagaaccacuccuca

SEQ ID NO: 267544 - RNA, 21 nt, Human
caaguacuuccagaaagcucc

SEQ ID NO: 267545 - RNA, 21 nt, Human
caaguagaaacaaacuacuua

SEQ ID NO: 267546 - RNA, 21 nt, Human
caauacuacuuacuacuaccu

SEQ ID NO: 267547 - RNA, 20 nt, Human
cacaaaaagcaaagaaacua

SEQ ID NO: 267548 - RNA, 23 nt, Human
cacaaaaucaggagaaacaauaa

SEQ ID NO: 267549 - RNA, 22 nt, Human
cacaacaaaauguuacaaacau

SEQ ID NO: 267550 - RNA, 23 nt, Human
cacagcaacacagacuuggcgag

SEQ ID NO: 267551 - RNA, 24 nt, Human
caccaaaaaugaaaacaucauucc

SEQ ID NO: 267552 - RNA, 24 nt, Human
cacccccaguaguggggacuacag

SEQ ID NO: 267553 - RNA, 27 nt, Human
caccuguagucccaguagaugcucuga

SEQ ID NO: 267554 - RNA, 21 nt, Human
cagcacagaacacaccaccuc

SEQ ID NO: 267555 - RNA, 21 nt, Human
caggcuaugccaauuaaaaua

SEQ ID NO: 267556 - RNA, 21 nt, Human
caguaguggggacuacagugc

SEQ ID NO: 267557 - RNA, 20 nt, Human
caugccacaaagacaaaaac

SEQ ID NO: 267558 - RNA, 23 nt, Human
cauuaccacaagaugaacaggag

SEQ ID NO: 267559 - RNA, 18 nt, Human
ccaacauauuccaccagc

SEQ ID NO: 267560 - RNA, 18 nt, Human
ccacaaagacaaaaacau

SEQ ID NO: 267561 - RNA, 22 nt, Human
ccagaaaaagagaaaaauucca

SEQ ID NO: 267562 - RNA, 22 nt, Human
cccaccucaugcaugucaccac

SEQ ID NO: 267563 - RNA, 22 nt, Human
cccauaaagaucacuugacccu

SEQ ID NO: 267564 - RNA, 22 nt, Human
cccccaguaguggggacuacag

SEQ ID NO: 267565 - RNA, 21 nt, Human
ccccggaacuggucccagugu

SEQ ID NO: 267566 - RNA, 24 nt, Human
ccuacagacccuggcuauucuaaa

SEQ ID NO: 267567 - RNA, 21 nt, Human
ccucacaccccauuuucacaa

SEQ ID NO: 267568 - RNA, 21 nt, Human
ccucuagaagacagccagcuc

SEQ ID NO: 267569 - RNA, 18 nt, Human
ccucuggcggccgcaggg

SEQ ID NO: 267570 - RNA, 20 nt, Human
ccugcagucgacccuuggcc

SEQ ID NO: 267571 - RNA, 21 nt, Human
ccugcagucgacccuuggccu

SEQ ID NO: 267572 - RNA, 22 nt, Human
cuagucacuagcaccaucaaaa

SEQ ID NO: 267573 - RNA, 23 nt, Human
cuaugaacuaacuccagauuugc

SEQ ID NO: 267574 - RNA, 23 nt, Human
cuccagaaaaagagaaaaauucc

SEQ ID NO: 267575 - RNA, 18 nt, Human
cucuccuucauucauuuc

SEQ ID NO: 267576 - RNA, 24 nt, Human
cugcuggguuaagucuggcaacac

SEQ ID NO: 267577 - RNA, 18 nt, Human
cuggcccuucccacuucc

SEQ ID NO: 267578 - RNA, 22 nt, Human
cuguccuuggcuggcccuuccc

SEQ ID NO: 267579 - RNA, 18 nt, Human
cuuuccugcuacuuucuc

SEQ ID NO: 267580 - RNA, 19 nt, Human
gaacucacacaagcuauaa

SEQ ID NO: 267581 - RNA, 21 nt, Human
gcaauacaaacaagugacccu

SEQ ID NO: 267582 - RNA, 21 nt, Human
gcagucgacccuuggccugga

SEQ ID NO: 267583 - RNA, 27 nt, Human
gccacaaagacaaaaacagcagggacu

SEQ ID NO: 267584 - RNA, 23 nt, Human
gcuaaaguacaagaauuguacca

SEQ ID NO: 267585 - RNA, 19 nt, Human
ggaaacaaaaccccacuuu

SEQ ID NO: 267586 - RNA, 24 nt, Human
ggaaaguguauaaacaugaaaaua

SEQ ID NO: 267587 - RNA, 23 nt, Human
ggaacaacacaaaaagcaaagaa

SEQ ID NO: 267588 - RNA, 19 nt, Human
gucacagcacagaacacac

SEQ ID NO: 267589 - RNA, 20 nt, Human
gucacuagcaccaucaaaau

SEQ ID NO: 267590 - RNA, 22 nt, Human
gugaaauauuaaaaacaaaaau

SEQ ID NO: 267591 - RNA, 21 nt, Human
guguguguguguaaacgcgug

SEQ ID NO: 267592 - RNA, 20 nt, Human
uaaaaaaaaauaccccuuca

SEQ ID NO: 267593 - RNA, 21 nt, Human
uaaaaaagaacucacacaagc

SEQ ID NO: 267594 - RNA, 25 nt, Human
uaaaaacaaaaauuaauucuuaacc

SEQ ID NO: 267595 - RNA, 22 nt, Human
uaaaaauguugccacaaaaagc

SEQ ID NO: 267596 - RNA, 22 nt, Human
uaaacacgacagaguucaaaca

SEQ ID NO: 267597 - RNA, 23 nt, Human
uaaagaacauauucagaugccaa

SEQ ID NO: 267598 - RNA, 18 nt, Human
uaacaaaaauagaaauga

SEQ ID NO: 267599 - RNA, 22 nt, Human
uaagacaaaacuaaagaggagu

SEQ ID NO: 267600 - RNA, 23 nt, Human
uaaguggucagaccagaagauuc

SEQ ID NO: 267601 - RNA, 18 nt, Human
uaauaggaucaaguucau

SEQ ID NO: 267602 - RNA, 28 nt, Human
uacacaggccgucuggcucauaugcaac

SEQ ID NO: 267603 - RNA, 20 nt, Human
uacagacccuggcuauucua

SEQ ID NO: 267604 - RNA, 21 nt, Human
uaccucuagaagacagccagc

SEQ ID NO: 267605 - RNA, 18 nt, Human
uacucaaguccaacaaaa

SEQ ID NO: 267606 - RNA, 18 nt, Human
uacuucucagaaaacgcu

SEQ ID NO: 267607 - RNA, 20 nt, Human
uagcauacggaacaacacaa

SEQ ID NO: 267608 - RNA, 24 nt, Human
uauagucacagcacagaacacacc

SEQ ID NO: 267609 - RNA, 25 nt, Human
uauguguguguguguaaacgcgugu

SEQ ID NO: 267610 - RNA, 18 nt, Human
uauucagaugccaaagca

SEQ ID NO: 267611 - RNA, 20 nt, Human
uccacaaauaccaaugaaau

SEQ ID NO: 267612 - RNA, 22 nt, Human
uccucguggccaccugaugugg

SEQ ID NO: 267613 - RNA, 20 nt, Human
uccugcuacuuucucuuucu

SEQ ID NO: 267614 - RNA, 21 nt, Human
ucuauagucacagcacagaac

SEQ ID NO: 267615 - RNA, 20 nt, Human
ucucaaacaaccugcagucg

SEQ ID NO: 267616 - RNA, 25 nt, Human
ucuccagaaaaagagaaaaauucca

SEQ ID NO: 267617 - RNA, 19 nt, Human
ucuuuuuuuuaaucuucug

SEQ ID NO: 267618 - RNA, 20 nt, Human
ugacccucuaauugacacaa

SEQ ID NO: 267619 - RNA, 23 nt, Human
ugauucuuuucaugugaaauauu

SEQ ID NO: 267620 - RNA, 20 nt, Human
ugcaugucaccaccauaacu

SEQ ID NO: 267621 - RNA, 20 nt, Human
ugccacaaagacaaaaacau

SEQ ID NO: 267622 - RNA, 23 nt, Human
ugccacccccaguaguggggacu

SEQ ID NO: 267623 - RNA, 18 nt, Human
ugccccagagcaacucag

SEQ ID NO: 267624 - RNA, 19 nt, Human
ugcgcccaggcgccuuaac

SEQ ID NO: 267625 - RNA, 23 nt, Human
uggcccuucccacuuccuuuccu

SEQ ID NO: 267626 - RNA, 22 nt, Human
uggcuggcccuucccacuuccu

SEQ ID NO: 267627 - RNA, 21 nt, Human
ugggguucuugcccacuuggg

SEQ ID NO: 267628 - RNA, 19 nt, Human
uggugcauauacuuugguu

SEQ ID NO: 267629 - RNA, 18 nt, Human
ugucaucagugaagcucc

SEQ ID NO: 267630 - RNA, 21 nt, Human
ugugauaugugugugugugua

SEQ ID NO: 267631 - RNA, 21 nt, Human
uguguguguguaaacgcgugu

SEQ ID NO: 267632 - RNA, 22 nt, Human
uguguguguguaaacgcgugug

SEQ ID NO: 267633 - RNA, 20 nt, Human
uguugccacaaaaagcaaaa

SEQ ID NO: 267634 - RNA, 23 nt, Human
uguugccacaaaaagcaaaacuu

SEQ ID NO: 267635 - RNA, 24 nt, Human
uuaaagaacauauucagaugccaa

SEQ ID NO: 267636 - RNA, 21 nt, Human
uuaaauccacaaaaucaggag

SEQ ID NO: 267637 - RNA, 20 nt, Human
uuaauaggaucaaguucaug

SEQ ID NO: 267638 - RNA, 24 nt, Human
uuagcugcaugccacaaagacaaa

SEQ ID NO: 267639 - RNA, 21 nt, Human
uucacuuugacacucauccau

SEQ ID NO: 267640 - RNA, 23 nt, Human
uuccaguugagagccaccaaaaa

SEQ ID NO: 267641 - RNA, 21 nt, Human
uuccuuuccugcuacuuucuc

SEQ ID NO: 267642 - RNA, 23 nt, Human
uucugaaguacuucucagaaaac

SEQ ID NO: 267643 - RNA, 22 nt, Human
uugacccuaagacaaaacuaaa

SEQ ID NO: 267644 - RNA, 21 nt, Human
uuugcacaccacuaacugggc

SEQ ID NO: 267645 - RNA, 19 nt, Human
uuuggcugguuguaggaua

SEQ ID NO: 267646 - RNA, 24 nt, Human
aaacaaaaaaaaggaagauucugg

SEQ ID NO: 267647 - RNA, 18 nt, Human
aaacagaaagagaaaccc

SEQ ID NO: 267648 - RNA, 19 nt, Human
aaacagaaagagaaacccc

SEQ ID NO: 267649 - RNA, 20 nt, Human
aaacagaaagagaaacccca

SEQ ID NO: 267650 - RNA, 24 nt, Human
aaacagaaagagaaaccccaauga

SEQ ID NO: 267651 - RNA, 30 nt, Human
aaacagaaagagaaaccccaaugaaacaaa

SEQ ID NO: 267652 - RNA, 24 nt, Human
aaccccaaugaaacaaaaaaaagg

SEQ ID NO: 267653 - RNA, 23 nt, Human
aauuaccaggaaagagggaaaau

SEQ ID NO: 267654 - RNA, 20 nt, Human
agaaagaaaaacagaaagag

SEQ ID NO: 267655 - RNA, 22 nt, Human
agaaagaaaaacagaaagagaa

SEQ ID NO: 267656 - RNA, 21 nt, Human
aucacuaaaaaacucucccca

SEQ ID NO: 267657 - RNA, 19 nt, Human
auuaagauuccagcuacaa

SEQ ID NO: 267658 - RNA, 18 nt, Human
caaugaaacaaaaaaaag

SEQ ID NO: 267659 - RNA, 20 nt, Human
cacagauuagaucuaaggac

SEQ ID NO: 267660 - RNA, 18 nt, Human
caccauaaucuaaaauug

SEQ ID NO: 267661 - RNA, 23 nt, Human
cagaaagauaaguuacuggagua

SEQ ID NO: 267662 - RNA, 22 nt, Human
cagccuauugagaauacaugac

SEQ ID NO: 267663 - RNA, 22 nt, Human
ccaaugaaacaaaaaaaaggaa

SEQ ID NO: 267664 - RNA, 20 nt, Human
ccaggaaagagggaaaauca

SEQ ID NO: 267665 - RNA, 18 nt, Human
cuaaaucugaaaugaagc

SEQ ID NO: 267666 - RNA, 22 nt, Human
cugaaaugaagccauucaguaa

SEQ ID NO: 267667 - RNA, 21 nt, Human
gauuccagcuacaauuucuuu

SEQ ID NO: 267668 - RNA, 19 nt, Human
uaaggacauggugggggca

SEQ ID NO: 267669 - RNA, 23 nt, Human
uagaaagaaaaacagaaagagaa

SEQ ID NO: 267670 - RNA, 23 nt, Human
uagcacagauuagaucuaaggac

SEQ ID NO: 267671 - RNA, 18 nt, Human
uaucuuacaccauaaucu

SEQ ID NO: 267672 - RNA, 27 nt, Human
uauugccaauuucuucccccaagauuu

SEQ ID NO: 267673 - RNA, 24 nt, Human
uccaaggacacagacugcaacacc

SEQ ID NO: 267674 - RNA, 19 nt, Human
uccccgaacuuuguuuccc

SEQ ID NO: 267675 - RNA, 23 nt, Human
ugaaucacuaaaaaacucucccc

SEQ ID NO: 267676 - RNA, 19 nt, Human
ugaauuauacauacauaua

SEQ ID NO: 267677 - RNA, 22 nt, Human
ugacaaccuuaauaucacuuga

SEQ ID NO: 267678 - RNA, 18 nt, Human
ugcugggaauacagccua

SEQ ID NO: 267679 - RNA, 21 nt, Human
uggaguaucuuacaccauaau

SEQ ID NO: 267680 - RNA, 24 nt, Human
uguuauuaagauuccagcuacaau

SEQ ID NO: 267681 - RNA, 18 nt, Human
uucaguaagccugcugug

SEQ ID NO: 267682 - RNA, 25 nt, Human
uucauaaucuuuccuccacgcuucu

SEQ ID NO: 267683 - RNA, 18 nt, Human
uucccgaacuuaagaaaa

SEQ ID NO: 267684 - RNA, 25 nt, Human
uugaauaaaaugaauaacuuggaua

SEQ ID NO: 267685 - RNA, 22 nt, Human
uuucuuuuuuaaagagccuguu

SEQ ID NO: 267686 - RNA, 21 nt, Human
uuuuccccgaacuuuguuucc

SEQ ID NO: 267687 - RNA, 21 nt, Human
aaaagcuuucuagcauaaauc

SEQ ID NO: 267688 - RNA, 19 nt, Human
aagguaaggguacagaaga

SEQ ID NO: 267689 - RNA, 18 nt, Human
aagucacuuuuguggaca

SEQ ID NO: 267690 - RNA, 20 nt, Human
acauccaggcugcagcuggg

SEQ ID NO: 267691 - RNA, 20 nt, Human
agacucucuuuggaggacuc

SEQ ID NO: 267692 - RNA, 27 nt, Human
caaccaggaacuagacugaaugcaauc

SEQ ID NO: 267693 - RNA, 24 nt, Human
cccuagacucucuuuggaggacuc

SEQ ID NO: 267694 - RNA, 22 nt, Human
cucacagugccccuggccugcc

SEQ ID NO: 267695 - RNA, 23 nt, Human
cuccugaagcugcuuugcccucc

SEQ ID NO: 267696 - RNA, 21 nt, Human
cucucccagcacuuccuucag

SEQ ID NO: 267697 - RNA, 20 nt, Human
cugcuuugcccuccuuugca

SEQ ID NO: 267698 - RNA, 22 nt, Human
cuugaauucuggaucccuucag

SEQ ID NO: 267699 - RNA, 22 nt, Human
gaggacucccaagggcuccuga

SEQ ID NO: 267700 - RNA, 18 nt, Human
gaggugccagggauuuau

SEQ ID NO: 267701 - RNA, 21 nt, Human
gcaaccaggaacuagacugaa

SEQ ID NO: 267702 - RNA, 23 nt, Human
gccugccuucuguguucuucuac

SEQ ID NO: 267703 - RNA, 19 nt, Human
gggaaccugacuuaaguca

SEQ ID NO: 267704 - RNA, 20 nt, Human
gguuugggggaaccugacuu

SEQ ID NO: 267705 - RNA, 19 nt, Human
gucuggacacacuuuggag

SEQ ID NO: 267706 - RNA, 19 nt, Human
guuugugguuauguuucuu

SEQ ID NO: 267707 - RNA, 20 nt, Human
uaaguugaaaguagguugau

SEQ ID NO: 267708 - RNA, 19 nt, Human
uacagaagauacaugauag

SEQ ID NO: 267709 - RNA, 22 nt, Human
ucaaaauaagguaaggguacag

SEQ ID NO: 267710 - RNA, 24 nt, Human
ucaacaauaaaccaacauuaaaag

SEQ ID NO: 267711 - RNA, 21 nt, Human
ucugguuugggggaaccugac

SEQ ID NO: 267712 - RNA, 21 nt, Human
ucuuccuggcuugaauucugg

SEQ ID NO: 267713 - RNA, 21 nt, Human
ucuuuggaggacucccaaggg

SEQ ID NO: 267714 - RNA, 23 nt, Human
ugaaaguagguugaucuucaguu

SEQ ID NO: 267715 - RNA, 21 nt, Human
ugacuuaagucacuuuugugg

SEQ ID NO: 267716 - RNA, 19 nt, Human
ugacuuaguaggaggucug

SEQ ID NO: 267717 - RNA, 21 nt, Human
uggaguugcaguucacaucca

SEQ ID NO: 267718 - RNA, 21 nt, Human
uugaugucuaggauuuucuuc

SEQ ID NO: 267719 - RNA, 18 nt, Human
uugccuugagucuggaca

SEQ ID NO: 267720 - RNA, 19 nt, Human
acucugcuucccaagauaa

SEQ ID NO: 267721 - RNA, 20 nt, Human
caaccaggaacuaggcugaa

SEQ ID NO: 267722 - RNA, 27 nt, Human
caaccaggaacuaggcugaaugcaauc

SEQ ID NO: 267723 - RNA, 22 nt, Human
cagcaaccaggaacuaggcuga

SEQ ID NO: 267724 - RNA, 26 nt, Human
cagcaaccaggaacuaggcugaaugc

SEQ ID NO: 267725 - RNA, 30 nt, Human
gugaggguagagaggauaucugauagcacc

SEQ ID NO: 267726 - RNA, 18 nt, Human
ucacaggccauccuuaaa

SEQ ID NO: 267727 - RNA, 25 nt, Human
uuagugaguugggugauacauuaga

SEQ ID NO: 267728 - RNA, 21 nt, Human
uugauguuuaggauuuucuuc

SEQ ID NO: 267729 - RNA, 23 nt, Human
aaucucuaaguccaggagacaga

SEQ ID NO: 267730 - RNA, 19 nt, Human
acugucaccacaagagccu

SEQ ID NO: 267731 - RNA, 22 nt, Human
cagacugucaccacaagagccu

SEQ ID NO: 267732 - RNA, 22 nt, Human
cagagcuaggccucccugcacg

SEQ ID NO: 267733 - RNA, 20 nt, Human
ccaauacacacagaaagaga

SEQ ID NO: 267734 - RNA, 22 nt, Human
cugaauggauucuauucugacc

SEQ ID NO: 267735 - RNA, 24 nt, Human
uccagggagcuucagcucucagcc

SEQ ID NO: 267736 - RNA, 26 nt, Human
ucuauucugaccaauacacacagaaa

SEQ ID NO: 267737 - RNA, 24 nt, Human
uggcauccaggagauaccgucugg

SEQ ID NO: 267738 - RNA, 19 nt, Human
uuuuuuuuuuugaauggac

SEQ ID NO: 267739 - RNA, 21 nt, Human
uuuuuuuuuuuuuugaaugga

SEQ ID NO: 267740 - RNA, 22 nt, Human
uuuuuuuuuuuuuuuugaaugg

SEQ ID NO: 267741 - RNA, 18 nt, Human
uuuuuuuuuuuuuuuuug

SEQ ID NO: 267742 - RNA, 19 nt, Human
aaaaaaaaaccugauucau

SEQ ID NO: 267743 - RNA, 22 nt, Human
aaaaaaacaaaccccaggcagg

SEQ ID NO: 267744 - RNA, 21 nt, Human
aaaaagaaaaacagaacaaga

SEQ ID NO: 267745 - RNA, 22 nt, Human
aaaaagaugccaagagacaaac

SEQ ID NO: 267746 - RNA, 22 nt, Human
aaaacaaugacaaaaaaaacaa

SEQ ID NO: 267747 - RNA, 18 nt, Human
aaaacagaaacaaacaac

SEQ ID NO: 267748 - RNA, 20 nt, Human
aaaacccugaucauuaaaac

SEQ ID NO: 267749 - RNA, 18 nt, Human
aaaagaaaaacagaacaa

SEQ ID NO: 267750 - RNA, 19 nt, Human
aaaauuggccuaacuguag

SEQ ID NO: 267751 - RNA, 24 nt, Human
aaacaaacaacucaaaaauuuacc

SEQ ID NO: 267752 - RNA, 19 nt, Human
aaacaaugacaaaaaaaac

SEQ ID NO: 267753 - RNA, 21 nt, Human
aaacagaaacaaacaacucaa

SEQ ID NO: 267754 - RNA, 19 nt, Human
aaacugagcaggaccaaac

SEQ ID NO: 267755 - RNA, 23 nt, Human
aaacugagcaggaccaaaccaaa

SEQ ID NO: 267756 - RNA, 23 nt, Human
aaagguuucaaacaauauuggca

SEQ ID NO: 267757 - RNA, 21 nt, Human
aaccucaugacaaaugaaaau

SEQ ID NO: 267758 - RNA, 18 nt, Human
aaccuguucuccaaagua

SEQ ID NO: 267759 - RNA, 20 nt, Human
aacuugaguucuccuaauga

SEQ ID NO: 267760 - RNA, 25 nt, Human
aagagagagagaggaggggaggagg

SEQ ID NO: 267761 - RNA, 21 nt, Human
aagcagggauaguguugaaaa

SEQ ID NO: 267762 - RNA, 23 nt, Human
aaggggagaagagaaugacaaga

SEQ ID NO: 267763 - RNA, 29 nt, Human
aaugcaaaagauggaauaaaagggacccc

SEQ ID NO: 267764 - RNA, 24 nt, Human
aaugcggugaggagaagaggaggg

SEQ ID NO: 267765 - RNA, 20 nt, Human
acaaaaaaaacaaaccccag

SEQ ID NO: 267766 - RNA, 19 nt, Human
acaaaaccaguaaggcauc

SEQ ID NO: 267767 - RNA, 22 nt, Human
acaaagucacuuuguaaaaggu

SEQ ID NO: 267768 - RNA, 20 nt, Human
acagcaacaaggcaaaacaa

SEQ ID NO: 267769 - RNA, 22 nt, Human
accggaagcuggggcggggacg

SEQ ID NO: 267770 - RNA, 18 nt, Human
acgcuggagguguuggug

SEQ ID NO: 267771 - RNA, 20 nt, Human
acuagaucaaaacagcaaac

SEQ ID NO: 267772 - RNA, 21 nt, Human
acuagaucaaaacagcaaacc

SEQ ID NO: 267773 - RNA, 24 nt, Human
agaaaggaagaaacucaaccucau

SEQ ID NO: 267774 - RNA, 22 nt, Human
agaaauagaagaaaugcaaaag

SEQ ID NO: 267775 - RNA, 23 nt, Human
agaaaucuuaggguuuggccccc

SEQ ID NO: 267776 - RNA, 18 nt, Human
agaagagaaugacaagag

SEQ ID NO: 267777 - RNA, 20 nt, Human
agaagagaaugacaagagag

SEQ ID NO: 267778 - RNA, 20 nt, Human
agacaacccugcuucccgaa

SEQ ID NO: 267779 - RNA, 23 nt, Human
agagagagagaggaggggaggag

SEQ ID NO: 267780 - RNA, 18 nt, Human
agagagaggaggggagga

SEQ ID NO: 267781 - RNA, 25 nt, Human
agagaggaggggaggaggaagggga

SEQ ID NO: 267782 - RNA, 23 nt, Human
agagcaggcgccgggccucccaa

SEQ ID NO: 267783 - RNA, 22 nt, Human
agaggaggggaggaggaagggg

SEQ ID NO: 267784 - RNA, 20 nt, Human
agcccuagcaggaggaggcg

SEQ ID NO: 267785 - RNA, 19 nt, Human
agcucuaaggcuguggcug

SEQ ID NO: 267786 - RNA, 23 nt, Human
aggaggggaggaggaaggggagg

SEQ ID NO: 267787 - RNA, 18 nt, Human
aggauggaaacauaccgu

SEQ ID NO: 267788 - RNA, 22 nt, Human
aggcaaaacaauaauuaaagua

SEQ ID NO: 267789 - RNA, 25 nt, Human
aggcagcuggcccgggaugccugca

SEQ ID NO: 267790 - RNA, 23 nt, Human
aggggagaagagaaugacaagag

SEQ ID NO: 267791 - RNA, 19 nt, Human
agguaggaagagagagaga

SEQ ID NO: 267792 - RNA, 19 nt, Human
aguacaaaaccaguaaggc

SEQ ID NO: 267793 - RNA, 19 nt, Human
agucuggagggucugugcu

SEQ ID NO: 267794 - RNA, 27 nt, Human
auagguaggaagagagagagaggaggg

SEQ ID NO: 267795 - RNA, 25 nt, Human
aucagaaaggaagaaacucaaccuc

SEQ ID NO: 267796 - RNA, 19 nt, Human
augacaaaaaaaacaaacc

SEQ ID NO: 267797 - RNA, 20 nt, Human
augacuuuuuagcccuguuu

SEQ ID NO: 267798 - RNA, 24 nt, Human
auuaaaacagagacaccuucacug

SEQ ID NO: 267799 - RNA, 21 nt, Human
caaaaaaaacaaaccccaggc

SEQ ID NO: 267800 - RNA, 23 nt, Human
caaaaaaaacaaaccccaggcag

SEQ ID NO: 267801 - RNA, 20 nt, Human
caaaacagaaacaaacaacu

SEQ ID NO: 267802 - RNA, 20 nt, Human
caaaagauggaauaaaaacc

SEQ ID NO: 267803 - RNA, 21 nt, Human
caaaagauggaauaaaaaccc

SEQ ID NO: 267804 - RNA, 20 nt, Human
caaaaugcagcacuuuaauc

SEQ ID NO: 267805 - RNA, 19 nt, Human
caaagcaagcacccugguu

SEQ ID NO: 267806 - RNA, 21 nt, Human
caacaaaguaaaaguccccaa

SEQ ID NO: 267807 - RNA, 20 nt, Human
caacagaagguagugcaguu

SEQ ID NO: 267808 - RNA, 18 nt, Human
caacuagaucaaaacagc

SEQ ID NO: 267809 - RNA, 24 nt, Human
caaggcaaaacaauaauuaaagua

SEQ ID NO: 267810 - RNA, 23 nt, Human
caaugacaaaaaaaacaaacccc

SEQ ID NO: 267811 - RNA, 18 nt, Human
cacagcaacaaggcaaaa

SEQ ID NO: 267812 - RNA, 20 nt, Human
cacaguacgcgaguguagua

SEQ ID NO: 267813 - RNA, 25 nt, Human
cacaguguuugcagaaaaaaaaaaa

SEQ ID NO: 267814 - RNA, 26 nt, Human
caccaccagcggcuaaaaaaaaaauc

SEQ ID NO: 267815 - RNA, 26 nt, Human
caccagcggcuaaaaaaaaaaucccc

SEQ ID NO: 267816 - RNA, 22 nt, Human
cacccagaugacuaaugaaggc

SEQ ID NO: 267817 - RNA, 23 nt, Human
cacccaggucgaggcugaaggac

SEQ ID NO: 267818 - RNA, 20 nt, Human
caccccuaaugaaacuuaaa

SEQ ID NO: 267819 - RNA, 25 nt, Human
cacccugguuagcaccaguucuccc

SEQ ID NO: 267820 - RNA, 27 nt, Human
caccuggacggaugcugccgccggggg

SEQ ID NO: 267821 - RNA, 19 nt, Human
cacuccgucacucacucuc

SEQ ID NO: 267822 - RNA, 22 nt, Human
cagaaggaaagagacacaugcc

SEQ ID NO: 267823 - RNA, 18 nt, Human
cagagcaggcgccgggcc

SEQ ID NO: 267824 - RNA, 21 nt, Human
caggaccaaaccaaaacucaa

SEQ ID NO: 267825 - RNA, 24 nt, Human
caggaccaaaccaaaacucaacuc

SEQ ID NO: 267826 - RNA, 18 nt, Human
cagggauaguguugaaaa

SEQ ID NO: 267827 - RNA, 19 nt, Human
cauggggcaugauguccag

SEQ ID NO: 267828 - RNA, 19 nt, Human
cauuucaauuauggccugu

SEQ ID NO: 267829 - RNA, 18 nt, Human
ccaaaacucaacuccugc

SEQ ID NO: 267830 - RNA, 26 nt, Human
ccaaagcaagcacccugguuagcacc

SEQ ID NO: 267831 - RNA, 19 nt, Human
ccacucccaccccaccccu

SEQ ID NO: 267832 - RNA, 24 nt, Human
ccagcagaucauuggcaaauccaa

SEQ ID NO: 267833 - RNA, 22 nt, Human
ccaggcaggcacgacacuuaug

SEQ ID NO: 267834 - RNA, 19 nt, Human
ccagucucuucugucucug

SEQ ID NO: 267835 - RNA, 20 nt, Human
ccauggcucacccacauguc

SEQ ID NO: 267836 - RNA, 22 nt, Human
cccacucccaccccaccccuaa

SEQ ID NO: 267837 - RNA, 23 nt, Human
cccacucccaccccaccccuaau

SEQ ID NO: 267838 - RNA, 21 nt, Human
cccaggucgaggcugaaggac

SEQ ID NO: 267839 - RNA, 22 nt, Human
cccaggucggggaacucgaagc

SEQ ID NO: 267840 - RNA, 24 nt, Human
cccccagcccuagcaggaggaggc

SEQ ID NO: 267841 - RNA, 23 nt, Human
ccccuuuucuuuucaaagaggaa

SEQ ID NO: 267842 - RNA, 22 nt, Human
cccuggcagcggcggcgggggc

SEQ ID NO: 267843 - RNA, 19 nt, Human
ccgcaggcagcuggcccgg

SEQ ID NO: 267844 - RNA, 27 nt, Human
ccugcacccaggucgaggccggggucc

SEQ ID NO: 267845 - RNA, 21 nt, Human
ccuggacccaggagggaaguc

SEQ ID NO: 267846 - RNA, 20 nt, Human
ccugucccacucccaccccc

SEQ ID NO: 267847 - RNA, 19 nt, Human
cgaaaagaaccuaaaaaau

SEQ ID NO: 267848 - RNA, 20 nt, Human
cgaaacuuuaggaaggacac

SEQ ID NO: 267849 - RNA, 20 nt, Human
cgcuggagguguuggugugu

SEQ ID NO: 267850 - RNA, 22 nt, Human
cggcuaaaaaaaaaauccccag

SEQ ID NO: 267851 - RNA, 18 nt, Human
cgggaugggaauggggga

SEQ ID NO: 267852 - RNA, 22 nt, Human
cgggcgagcgcgccuuuggggu

SEQ ID NO: 267853 - RNA, 19 nt, Human
cucacaccucuccugggug

SEQ ID NO: 267854 - RNA, 23 nt, Human
cucacaccucuccuggguggccu

SEQ ID NO: 267855 - RNA, 22 nt, Human
cucaugacaaaugaaaauuaaa

SEQ ID NO: 267856 - RNA, 21 nt, Human
cucuaaggcuguggcuggggg

SEQ ID NO: 267857 - RNA, 21 nt, Human
cugguacaaucaucagcuuua

SEQ ID NO: 267858 - RNA, 23 nt, Human
cuguggccggcugugugggaggg

SEQ ID NO: 267859 - RNA, 18 nt, Human
cuguguuuccgacuuugc

SEQ ID NO: 267860 - RNA, 20 nt, Human
cuuuggggugccgggauggg

SEQ ID NO: 267861 - RNA, 21 nt, Human
gaaaagaaccuaaaaaaugga

SEQ ID NO: 267862 - RNA, 20 nt, Human
gaaaaggcaaaauggaagca

SEQ ID NO: 267863 - RNA, 18 nt, Human
gaaacaacuagaucaaaa

SEQ ID NO: 267864 - RNA, 21 nt, Human
gaacucgaagcaaucgggcga

SEQ ID NO: 267865 - RNA, 23 nt, Human
gaaggaagcgguccgcaggcagc

SEQ ID NO: 267866 - RNA, 19 nt, Human
gaaggacacggaguuguga

SEQ ID NO: 267867 - RNA, 20 nt, Human
gacaaaaaaaacaaacccca

SEQ ID NO: 267868 - RNA, 26 nt, Human
gacacacucacacccagaugacuaau

SEQ ID NO: 267869 - RNA, 18 nt, Human
gagacccagucuggaggg

SEQ ID NO: 267870 - RNA, 19 nt, Human
gaggauggaaacauaccgu

SEQ ID NO: 267871 - RNA, 21 nt, Human
gaggggaggaggaaggggagg

SEQ ID NO: 267872 - RNA, 21 nt, Human
gcaaaauggaagcauuuccga

SEQ ID NO: 267873 - RNA, 18 nt, Human
gcagcggcggcgggggcg

SEQ ID NO: 267874 - RNA, 22 nt, Human
gcccaccaccagcggcuaaaaa

SEQ ID NO: 267875 - RNA, 21 nt, Human
gccgggucucacaccucuccu

SEQ ID NO: 267876 - RNA, 22 nt, Human
gcgcucaggggcugccgccucu

SEQ ID NO: 267877 - RNA, 20 nt, Human
gcggugaggagaagaggagg

SEQ ID NO: 267878 - RNA, 21 nt, Human
gcggugaggagaagaggaggg

SEQ ID NO: 267879 - RNA, 20 nt, Human
gcucugggcgcucaggggcu

SEQ ID NO: 267880 - RNA, 26 nt, Human
ggaaaaaaaaaucuucaaaaaucaau

SEQ ID NO: 267881 - RNA, 18 nt, Human
ggaaaacaaugacaaaaa

SEQ ID NO: 267882 - RNA, 23 nt, Human
ggaagcauuuccgauagagcccu

SEQ ID NO: 267883 - RNA, 20 nt, Human
ggaaggaagcgguccgcagg

SEQ ID NO: 267884 - RNA, 23 nt, Human
ggaggaggaaggggagggaggau

SEQ ID NO: 267885 - RNA, 23 nt, Human
ggaggggaggaggaaggggaggg

SEQ ID NO: 267886 - RNA, 23 nt, Human
gggagaagagaaugacaagagag

SEQ ID NO: 267887 - RNA, 23 nt, Human
ggggagaagagaaugacaagaga

SEQ ID NO: 267888 - RNA, 21 nt, Human
gggugaugugggggaugcagg

SEQ ID NO: 267889 - RNA, 21 nt, Human
gguaaccuguucuccaaagua

SEQ ID NO: 267890 - RNA, 18 nt, Human
gguccgcaggcagcuggc

SEQ ID NO: 267891 - RNA, 23 nt, Human
ggugaccgcaucaccccaccgga

SEQ ID NO: 267892 - RNA, 22 nt, Human
gucuggagggucugugcugagg

SEQ ID NO: 267893 - RNA, 18 nt, Human
gugaggagaagaggaggg

SEQ ID NO: 267894 - RNA, 26 nt, Human
gugcuucucuguguuuccgacuuugc

SEQ ID NO: 267895 - RNA, 20 nt, Human
uaaaacagagacaccuucac

SEQ ID NO: 267896 - RNA, 18 nt, Human
uaaaguaaaaauaugacc

SEQ ID NO: 267897 - RNA, 19 nt, Human
uaagcaucaaacaacaaag

SEQ ID NO: 267898 - RNA, 21 nt, Human
uacaacaaagaucuaggcaag

SEQ ID NO: 267899 - RNA, 23 nt, Human
uagaacaaguaucagcaagguca

SEQ ID NO: 267900 - RNA, 21 nt, Human
uagaacaagucucacuauaca

SEQ ID NO: 267901 - RNA, 24 nt, Human
uagaucaaaacagcaaaccuucca

SEQ ID NO: 267902 - RNA, 21 nt, Human
uaugguaagaaacuaaaaaaa

SEQ ID NO: 267903 - RNA, 22 nt, Human
uauuaaaaagaaaaacagaaca

SEQ ID NO: 267904 - RNA, 21 nt, Human
ucaaaaaucaaugcaucagaa

SEQ ID NO: 267905 - RNA, 23 nt, Human
ucaaaauuggccuaacuguagaa

SEQ ID NO: 267906 - RNA, 25 nt, Human
ucaacggcgaugauccuuucccgag

SEQ ID NO: 267907 - RNA, 18 nt, Human
ucacuccgucacucacuc

SEQ ID NO: 267908 - RNA, 20 nt, Human
ucauguugguucugaggaaa

SEQ ID NO: 267909 - RNA, 21 nt, Human
ucccaccccaccccuaaugaa

SEQ ID NO: 267910 - RNA, 19 nt, Human
ucccacucccaccccaccc

SEQ ID NO: 267911 - RNA, 24 nt, Human
ucccacucccaccccaccccuaau

SEQ ID NO: 267912 - RNA, 18 nt, Human
ucccgagaaguaucuuca

SEQ ID NO: 267913 - RNA, 21 nt, Human
ucggguaaggaaagcaccauu

SEQ ID NO: 267914 - RNA, 23 nt, Human
ucgggucaaacucuuaugguaag

SEQ ID NO: 267915 - RNA, 19 nt, Human
ucguccagacggggcuucu

SEQ ID NO: 267916 - RNA, 27 nt, Human
ucucacuccgucacucacucucacgga

SEQ ID NO: 267917 - RNA, 18 nt, Human
ucucugggaagcucaugg

SEQ ID NO: 267918 - RNA, 24 nt, Human
ucucugggaagcucauggcaggau

SEQ ID NO: 267919 - RNA, 20 nt, Human
ucucuuuacaaaacagaaac

SEQ ID NO: 267920 - RNA, 20 nt, Human
ucugucucucuuuucauuuc

SEQ ID NO: 267921 - RNA, 21 nt, Human
ucugugcugaggggaagccgu

SEQ ID NO: 267922 - RNA, 21 nt, Human
ucuuggcaguuugggaagaga

SEQ ID NO: 267923 - RNA, 18 nt, Human
ucuugguucugaaccugg

SEQ ID NO: 267924 - RNA, 21 nt, Human
ugaagacacagcagacugggu

SEQ ID NO: 267925 - RNA, 22 nt, Human
ugaagugagcaguuucggguca

SEQ ID NO: 267926 - RNA, 20 nt, Human
ugacacuaaaguaaaaauau

SEQ ID NO: 267927 - RNA, 19 nt, Human
ugacagccacauccacucg

SEQ ID NO: 267928 - RNA, 19 nt, Human
ugaggagggccacccuuca

SEQ ID NO: 267929 - RNA, 23 nt, Human
ugaggauggacaacuaaaaacca

SEQ ID NO: 267930 - RNA, 19 nt, Human
ugauccuuucccgagaagu

SEQ ID NO: 267931 - RNA, 22 nt, Human
ugcaaaagauggaauaaaaacc

SEQ ID NO: 267932 - RNA, 20 nt, Human
ugcugagacuaaagcaggga

SEQ ID NO: 267933 - RNA, 18 nt, Human
uggaaacaacuagaucaa

SEQ ID NO: 267934 - RNA, 21 nt, Human
uggaagcauuuccgauagagc

SEQ ID NO: 267935 - RNA, 19 nt, Human
uggaaggaagcgguccgca

SEQ ID NO: 267936 - RNA, 19 nt, Human
uggcaaauccaaaaaccuc

SEQ ID NO: 267937 - RNA, 18 nt, Human
uggcacggcucugagacc

SEQ ID NO: 267938 - RNA, 19 nt, Human
uggcagcggcggcgggggc

SEQ ID NO: 267939 - RNA, 21 nt, Human
uggcuagaaaaaauucaucaa

SEQ ID NO: 267940 - RNA, 18 nt, Human
uggcugggggcuggcuca

SEQ ID NO: 267941 - RNA, 21 nt, Human
ugggaaggucagcaccgaaga

SEQ ID NO: 267942 - RNA, 19 nt, Human
uggguggccuuucaagagc

SEQ ID NO: 267943 - RNA, 22 nt, Human
uggguggccuuucaagagcucu

SEQ ID NO: 267944 - RNA, 27 nt, Human
ugguaagaaacuaaaaaaagaugccaa

SEQ ID NO: 267945 - RNA, 21 nt, Human
uggucacaggcuaaauauaug

SEQ ID NO: 267946 - RNA, 21 nt, Human
ugguucugaaccuggacccag

SEQ ID NO: 267947 - RNA, 24 nt, Human
uguaaaaggugagugacacuaaag

SEQ ID NO: 267948 - RNA, 21 nt, Human
uguccaguuggguugucagcu

SEQ ID NO: 267949 - RNA, 22 nt, Human
ugugaagugagcaguuucgggu

SEQ ID NO: 267950 - RNA, 20 nt, Human
uguggcugggggcuggcuca

SEQ ID NO: 267951 - RNA, 18 nt, Human
ugugggaaaggggagaag

SEQ ID NO: 267952 - RNA, 23 nt, Human
uguuccugucccacucccacccc

SEQ ID NO: 267953 - RNA, 19 nt, Human
uguugaagacacagcagac

SEQ ID NO: 267954 - RNA, 22 nt, Human
uucagaaauagaagaaaugcaa

SEQ ID NO: 267955 - RNA, 25 nt, Human
uucauauaucagaaggaaagagaca

SEQ ID NO: 267956 - RNA, 18 nt, Human
uucuuggcaguuugggaa

SEQ ID NO: 267957 - RNA, 25 nt, Human
uugcagaaaaaaaaaaaaaaaaacc

SEQ ID NO: 267958 - RNA, 25 nt, Human
uuggccuaacuguagaaaaggcaaa

SEQ ID NO: 267959 - RNA, 19 nt, Human
uuuaccauacuuuguaaug

SEQ ID NO: 267960 - RNA, 24 nt, Human
uuugcagaaaaaaaaaaaaaaaaa

SEQ ID NO: 267961 - RNA, 18 nt, Human
aaaaacacacaaaguaaa

SEQ ID NO: 267962 - RNA, 25 nt, Human
aaaaaccaggaccucaucccuaagc

SEQ ID NO: 267963 - RNA, 20 nt, Human
aaaagaauaacuucaguuau

SEQ ID NO: 267964 - RNA, 26 nt, Human
aaagaaacuaagcuauucaagaacca

SEQ ID NO: 267965 - RNA, 18 nt, Human
aaagaagaaacaugaaga

SEQ ID NO: 267966 - RNA, 21 nt, Human
aaagaagaaacaugaagaaag

SEQ ID NO: 267967 - RNA, 26 nt, Human
aaaugucaaaaauuacugauggagcc

SEQ ID NO: 267968 - RNA, 24 nt, Human
aacaugguuacaauagcuuaagga

SEQ ID NO: 267969 - RNA, 19 nt, Human
aacccuuucauacaagcug

SEQ ID NO: 267970 - RNA, 23 nt, Human
aacuaagcuauucaagaaccaaa

SEQ ID NO: 267971 - RNA, 20 nt, Human
aagaacccauuaucuuguuu

SEQ ID NO: 267972 - RNA, 19 nt, Human
aagaagaaacaugaagaaa

SEQ ID NO: 267973 - RNA, 20 nt, Human
aagaagaaacaugaagaaag

SEQ ID NO: 267974 - RNA, 19 nt, Human
aagaggcuggaaaugggau

SEQ ID NO: 267975 - RNA, 22 nt, Human
acgagaaccuaaaagaauaacu

SEQ ID NO: 267976 - RNA, 20 nt, Human
acucuggaagagauguccag

SEQ ID NO: 267977 - RNA, 22 nt, Human
aggugcugggaaguuauuacuu

SEQ ID NO: 267978 - RNA, 18 nt, Human
agguggauaacaaauaag

SEQ ID NO: 267979 - RNA, 24 nt, Human
auauugcuuacagccuggugauga

SEQ ID NO: 267980 - RNA, 23 nt, Human
aucccuaagcccccuuucugcug

SEQ ID NO: 267981 - RNA, 19 nt, Human
auuguuguaauaaaguuug

SEQ ID NO: 267982 - RNA, 20 nt, Human
auuucacucagaagggauga

SEQ ID NO: 267983 - RNA, 25 nt, Human
caaaauggcaaauaauggcuuagua

SEQ ID NO: 267984 - RNA, 19 nt, Human
caaauaauggcuuaguauc

SEQ ID NO: 267985 - RNA, 25 nt, Human
caauaaacaacaauauaugaaauaa

SEQ ID NO: 267986 - RNA, 19 nt, Human
cagcuugaaaagaggcugg

SEQ ID NO: 267987 - RNA, 24 nt, Human
cauaaauacaaacaacagugaaga

SEQ ID NO: 267988 - RNA, 21 nt, Human
ccaaaacaucuccuaauucau

SEQ ID NO: 267989 - RNA, 22 nt, Human
ccagauguuaaguauccuccca

SEQ ID NO: 267990 - RNA, 20 nt, Human
ccagugggauaacucuggaa

SEQ ID NO: 267991 - RNA, 20 nt, Human
cgagaaccuaaaagaauaac

SEQ ID NO: 267992 - RNA, 19 nt, Human
cgcccaugacuccuauuua

SEQ ID NO: 267993 - RNA, 20 nt, Human
cucccaauucuaagcuacaa

SEQ ID NO: 267994 - RNA, 21 nt, Human
gaaaaaacacacaaaguaaaa

SEQ ID NO: 267995 - RNA, 19 nt, Human
gagaaccuaaaagaauaac

SEQ ID NO: 267996 - RNA, 19 nt, Human
gggauaacucuggaagaga

SEQ ID NO: 267997 - RNA, 19 nt, Human
gugaaaaaacacacaaagu

SEQ ID NO: 267998 - RNA, 18 nt, Human
uaaaaugguugcugacua

SEQ ID NO: 267999 - RNA, 19 nt, Human
uaaauaaaugacugcgagu

SEQ ID NO: 268000 - RNA, 24 nt, Human
uaaggaacaugcaaguuguaacuc

SEQ ID NO: 268001 - RNA, 24 nt, Human
uacaaacaacagugaagaaggaau

SEQ ID NO: 268002 - RNA, 23 nt, Human
uacaagaaaaaccaggaccucau

SEQ ID NO: 268003 - RNA, 21 nt, Human
uacuacagaacuaacgcccau

SEQ ID NO: 268004 - RNA, 25 nt, Human
uauacaaagaagaaacaugaagaaa

SEQ ID NO: 268005 - RNA, 19 nt, Human
uauccaaaauauuucacca

SEQ ID NO: 268006 - RNA, 20 nt, Human
uauccaaaugcuuuaugagc

SEQ ID NO: 268007 - RNA, 23 nt, Human
uauggaaaaucauuugauagcca

SEQ ID NO: 268008 - RNA, 18 nt, Human
ucauacaagcuguguccu

SEQ ID NO: 268009 - RNA, 22 nt, Human
ucauagugugaaugcaccuguu

SEQ ID NO: 268010 - RNA, 19 nt, Human
uccacaauaaaauuaagaa

SEQ ID NO: 268011 - RNA, 20 nt, Human
uccacaauaaaauuaagaaa

SEQ ID NO: 268012 - RNA, 23 nt, Human
uccccauaauuucagaauuucau

SEQ ID NO: 268013 - RNA, 20 nt, Human
ucccuaagcccccuuucugc

SEQ ID NO: 268014 - RNA, 20 nt, Human
ucuuugcaauaaaacauggu

SEQ ID NO: 268015 - RNA, 23 nt, Human
ugacacauccuacaaccuuuucu

SEQ ID NO: 268016 - RNA, 19 nt, Human
ugagcaaauuucacucaga

SEQ ID NO: 268017 - RNA, 21 nt, Human
ugccuuuccaugcagcacuug

SEQ ID NO: 268018 - RNA, 23 nt, Human
ugcucucagcuuuaacuuggcuu

SEQ ID NO: 268019 - RNA, 19 nt, Human
uggaagagauguccaggug

SEQ ID NO: 268020 - RNA, 23 nt, Human
uggaagagauguccaggugcugg

SEQ ID NO: 268021 - RNA, 24 nt, Human
uggaagagauguccaggugcuggg

SEQ ID NO: 268022 - RNA, 19 nt, Human
uggagcccaaauucaaccc

SEQ ID NO: 268023 - RNA, 19 nt, Human
uguccaggugcugggaagu

SEQ ID NO: 268024 - RNA, 19 nt, Human
ugugacacauccuacaacc

SEQ ID NO: 268025 - RNA, 20 nt, Human
uguuuuuuuuuuuuuuucuc

SEQ ID NO: 268026 - RNA, 22 nt, Human
uguuuuuuuuuuuuuuucucag

SEQ ID NO: 268027 - RNA, 28 nt, Human
uguuuuuuuuuuuuuuucucagcuugaa

SEQ ID NO: 268028 - RNA, 21 nt, Human
uucaacccuuucauacaagcu

SEQ ID NO: 268029 - RNA, 22 nt, Human
uugauuuccaacucacacacau

SEQ ID NO: 268030 - RNA, 24 nt, Human
uuuccaugcagcacuugugcucuc

SEQ ID NO: 268031 - RNA, 26 nt, Human
uuuuuuuuuuuuuucucagcuugauu

SEQ ID NO: 268032 - RNA, 19 nt, Human
aaaaaagaacccugaucca

SEQ ID NO: 268033 - RNA, 18 nt, Human
aaaacauuguaacuuaaa

SEQ ID NO: 268034 - RNA, 24 nt, Human
aaacacauuuaaaaaugaaaaaaa

SEQ ID NO: 268035 - RNA, 21 nt, Human
aaagaaaacagucaagccaca

SEQ ID NO: 268036 - RNA, 24 nt, Human
aaagaugcaaugacaaagccugaa

SEQ ID NO: 268037 - RNA, 22 nt, Human
aaaucacuugucaauaaaguuu

SEQ ID NO: 268038 - RNA, 22 nt, Human
aagaaaacaaucucaccauuuc

SEQ ID NO: 268039 - RNA, 22 nt, Human
aagcagccagaacuuggaagua

SEQ ID NO: 268040 - RNA, 23 nt, Human
agaacccugauccauaauucacc

SEQ ID NO: 268041 - RNA, 22 nt, Human
agacuugaaaaucacuugucaa

SEQ ID NO: 268042 - RNA, 22 nt, Human
agagaaaaaauaucaaacaaaa

SEQ ID NO: 268043 - RNA, 24 nt, Human
agagaaaaaauaucaaacaaaaga

SEQ ID NO: 268044 - RNA, 26 nt, Human
agagaaaaaauaucaaacaaaagaaa

SEQ ID NO: 268045 - RNA, 20 nt, Human
agaucacaaauauaaaaaua

SEQ ID NO: 268046 - RNA, 21 nt, Human
agaugcuuacuaggaaguuuu

SEQ ID NO: 268047 - RNA, 24 nt, Human
agauuuggaaggugagagugaugu

SEQ ID NO: 268048 - RNA, 21 nt, Human
agcuggaguuccaccugcaag

SEQ ID NO: 268049 - RNA, 25 nt, Human
agucuuuaccuuacguauauuuaga

SEQ ID NO: 268050 - RNA, 20 nt, Human
cagaauaucugaaaucuugg

SEQ ID NO: 268051 - RNA, 23 nt, Human
cagcauaauggaaaagaaaaaau

SEQ ID NO: 268052 - RNA, 18 nt, Human
cagccagaacuuggaagu

SEQ ID NO: 268053 - RNA, 19 nt, Human
ccaaugucuguucccuagg

SEQ ID NO: 268054 - RNA, 23 nt, Human
ccauauguuccaccagcuucacu

SEQ ID NO: 268055 - RNA, 19 nt, Human
cccuaggaaggcugagaag

SEQ ID NO: 268056 - RNA, 20 nt, Human
ccuccauuccucacuguucc

SEQ ID NO: 268057 - RNA, 22 nt, Human
ccugauccauaauucacaacau

SEQ ID NO: 268058 - RNA, 23 nt, Human
cucaaaacagacacccacccagc

SEQ ID NO: 268059 - RNA, 25 nt, Human
cucaaaacagacacccacccagcuc

SEQ ID NO: 268060 - RNA, 19 nt, Human
cucaguaagaccaccaaaa

SEQ ID NO: 268061 - RNA, 23 nt, Human
cucccuugcagcuggaguuccac

SEQ ID NO: 268062 - RNA, 24 nt, Human
cuggucucaaugccuguaguagaa

SEQ ID NO: 268063 - RNA, 22 nt, Human
cuucuauucaucaaaagacaua

SEQ ID NO: 268064 - RNA, 23 nt, Human
gacuagguguaauaucucaauac

SEQ ID NO: 268065 - RNA, 20 nt, Human
gaguaucaugaauuuuuuuc

SEQ ID NO: 268066 - RNA, 20 nt, Human
gaguuccaccugcaagcagc

SEQ ID NO: 268067 - RNA, 22 nt, Human
gcucacccaaugucuguucccu

SEQ ID NO: 268068 - RNA, 22 nt, Human
ggaaaaaaagaacccugaucca

SEQ ID NO: 268069 - RNA, 25 nt, Human
ggaaaagaaaaaauauuaaaaacau

SEQ ID NO: 268070 - RNA, 27 nt, Human
uaaaaaagcaagguguagaacacugca

SEQ ID NO: 268071 - RNA, 21 nt, Human
uaaaaacugcuauaguagggc

SEQ ID NO: 268072 - RNA, 25 nt, Human
uaaaauggagaccauauguuccacc

SEQ ID NO: 268073 - RNA, 24 nt, Human
uaaagaaaacagucaagccacaga

SEQ ID NO: 268074 - RNA, 27 nt, Human
uaaagaaaacagucaagccacagacua

SEQ ID NO: 268075 - RNA, 23 nt, Human
uaaauaagcucaaaacagacacc

SEQ ID NO: 268076 - RNA, 26 nt, Human
uaaauaagcucaaaacagacacccac

SEQ ID NO: 268077 - RNA, 22 nt, Human
uaaauugacaaauauaaaaacu

SEQ ID NO: 268078 - RNA, 24 nt, Human
uaauaugcccugucaauucuacuu

SEQ ID NO: 268079 - RNA, 19 nt, Human
uacuuuauaaguaggaaaa

SEQ ID NO: 268080 - RNA, 20 nt, Human
uaggacucuaaauaagcuca

SEQ ID NO: 268081 - RNA, 22 nt, Human
uaguagggcagucuuccuuaga

SEQ ID NO: 268082 - RNA, 24 nt, Human
uauuaagagacucaaaugacucca

SEQ ID NO: 268083 - RNA, 22 nt, Human
ucaaaacagacacccacccagc

SEQ ID NO: 268084 - RNA, 21 nt, Human
ucacaaauauaaaaauauaaa

SEQ ID NO: 268085 - RNA, 19 nt, Human
ucacuugucaauaaaguuu

SEQ ID NO: 268086 - RNA, 22 nt, Human
ucauucauuauauucauaaauu

SEQ ID NO: 268087 - RNA, 20 nt, Human
uccacauggucuucaguuuc

SEQ ID NO: 268088 - RNA, 19 nt, Human
ugaaaaaagacauucauug

SEQ ID NO: 268089 - RNA, 18 nt, Human
ugaaacaucacuacacac

SEQ ID NO: 268090 - RNA, 25 nt, Human
ugaagucuccacauggucuucaguu

SEQ ID NO: 268091 - RNA, 21 nt, Human
ugaauauauuuuugaacacag

SEQ ID NO: 268092 - RNA, 21 nt, Human
ugaggaaaggauaauucuuuc

SEQ ID NO: 268093 - RNA, 20 nt, Human
ugcaaugacaaagccugaaa

SEQ ID NO: 268094 - RNA, 21 nt, Human
ugccuguaguagaaauugcag

SEQ ID NO: 268095 - RNA, 22 nt, Human
uggaaggugagagugauguaga

SEQ ID NO: 268096 - RNA, 23 nt, Human
uguaugggggaaaaaaagaaccc

SEQ ID NO: 268097 - RNA, 22 nt, Human
ugucaauucuacuucuaaagua

SEQ ID NO: 268098 - RNA, 24 nt, Human
uguuacauacaaaagaaucaaagu

SEQ ID NO: 268099 - RNA, 20 nt, Human
uuagaauuuugaacugugac

SEQ ID NO: 268100 - RNA, 21 nt, Human
uucccuaggaaggcugagaag

SEQ ID NO: 268101 - RNA, 19 nt, Human
uucuguuuacaagggaagu

SEQ ID NO: 268102 - RNA, 18 nt, Human
uugaugaagucuccacau

SEQ ID NO: 268103 - RNA, 21 nt, Human
uuggaaguaaguuaauuuggu

SEQ ID NO: 268104 - RNA, 19 nt, Human
uuggaaugguuaaaaagga

SEQ ID NO: 268105 - RNA, 21 nt, Human
uuguaugggggaaaaaaagaa

SEQ ID NO: 268106 - RNA, 19 nt, Human
uuuuccauggcuucuuuuu

SEQ ID NO: 268107 - RNA, 18 nt, Human
uuuugaacacagacuuga

SEQ ID NO: 268108 - RNA, 20 nt, Human
aaacaaaagccccuugaagc

SEQ ID NO: 268109 - RNA, 22 nt, Human
aaacagcaguagcagcagcagc

SEQ ID NO: 268110 - RNA, 22 nt, Human
aaagacacgcauauuagcucaa

SEQ ID NO: 268111 - RNA, 20 nt, Human
aacacagcaaugacaaugaa

SEQ ID NO: 268112 - RNA, 21 nt, Human
aagaagaaucaaaagggaaca

SEQ ID NO: 268113 - RNA, 18 nt, Human
aaggcgucacggaggaag

SEQ ID NO: 268114 - RNA, 19 nt, Human
aagggcagagcccaggcag

SEQ ID NO: 268115 - RNA, 25 nt, Human
aagucauauauaaaaaccuggaggu

SEQ ID NO: 268116 - RNA, 19 nt, Human
aagucuguccaugcucucc

SEQ ID NO: 268117 - RNA, 21 nt, Human
aauagccucaccccagagggu

SEQ ID NO: 268118 - RNA, 24 nt, Human
aaugacaaugaacagcccagcaga

SEQ ID NO: 268119 - RNA, 21 nt, Human
acaauucgauuggugggcgca

SEQ ID NO: 268120 - RNA, 22 nt, Human
acccagucugccuucugugucu

SEQ ID NO: 268121 - RNA, 27 nt, Human
agaacagagacauuagaauaaaaagaa

SEQ ID NO: 268122 - RNA, 23 nt, Human
agaagaagugcaagauuuaacag

SEQ ID NO: 268123 - RNA, 23 nt, Human
agaccgcacaggggacggcauca

SEQ ID NO: 268124 - RNA, 21 nt, Human
agcagacucaagucauauaua

SEQ ID NO: 268125 - RNA, 24 nt, Human
aggaacuaggacuucgauucagag

SEQ ID NO: 268126 - RNA, 20 nt, Human
agugggcccccauggggaaa

SEQ ID NO: 268127 - RNA, 19 nt, Human
aguugucuuacuucacaau

SEQ ID NO: 268128 - RNA, 23 nt, Human
aucacaggcugguuuuauuuggg

SEQ ID NO: 268129 - RNA, 24 nt, Human
auuagugcucacuaaacaugcauu

SEQ ID NO: 268130 - RNA, 20 nt, Human
caaacaaaagccccuugaag

SEQ ID NO: 268131 - RNA, 20 nt, Human
caaauauacccacuagggac

SEQ ID NO: 268132 - RNA, 23 nt, Human
caacuaguguaaaccugugaaaa

SEQ ID NO: 268133 - RNA, 20 nt, Human
caagcagcucuacaauucga

SEQ ID NO: 268134 - RNA, 18 nt, Human
caauauguuauauacagc

SEQ ID NO: 268135 - RNA, 26 nt, Human
caaugacaaugaacagcccagcagag

SEQ ID NO: 268136 - RNA, 21 nt, Human
caaugggcugcugggccugag

SEQ ID NO: 268137 - RNA, 18 nt, Human
cacaauaggcaacaagau

SEQ ID NO: 268138 - RNA, 19 nt, Human
caccagaccaaacagcaac

SEQ ID NO: 268139 - RNA, 23 nt, Human
cagcaaugacaaugaacagccca

SEQ ID NO: 268140 - RNA, 19 nt, Human
cagcaguagcagcagcagc

SEQ ID NO: 268141 - RNA, 18 nt, Human
cagcuccugagcacugcc

SEQ ID NO: 268142 - RNA, 19 nt, Human
caggggacggcaucaccau

SEQ ID NO: 268143 - RNA, 19 nt, Human
cauacaaagaccuuccugg

SEQ ID NO: 268144 - RNA, 20 nt, Human
ccagaccaaacagcaacuca

SEQ ID NO: 268145 - RNA, 19 nt, Human
ccaggacagggacuauuuc

SEQ ID NO: 268146 - RNA, 20 nt, Human
ccccauggggaaauguccca

SEQ ID NO: 268147 - RNA, 24 nt, Human
cccccgagucuuacguuuuagaac

SEQ ID NO: 268148 - RNA, 18 nt, Human
cccuggaggaagacuagg

SEQ ID NO: 268149 - RNA, 22 nt, Human
ccucuaggcauggccacucugg

SEQ ID NO: 268150 - RNA, 23 nt, Human
ccucuaggcauggccacucugga

SEQ ID NO: 268151 - RNA, 21 nt, Human
cgcacaggggacggcaucacc

SEQ ID NO: 268152 - RNA, 21 nt, Human
cuaaaaacagucuucuggaau

SEQ ID NO: 268153 - RNA, 19 nt, Human
cuaaugcugucaaugggcu

SEQ ID NO: 268154 - RNA, 21 nt, Human
cuaccaccugcucugcaucug

SEQ ID NO: 268155 - RNA, 24 nt, Human
cucaaaauuucacccuauggauuu

SEQ ID NO: 268156 - RNA, 21 nt, Human
cucaacuaguguaaaccugug

SEQ ID NO: 268157 - RNA, 18 nt, Human
cuccucacuccagcucua

SEQ ID NO: 268158 - RNA, 18 nt, Human
cucuccacaagcacacug

SEQ ID NO: 268159 - RNA, 23 nt, Human
cugaacacagcaaugacaaugaa

SEQ ID NO: 268160 - RNA, 20 nt, Human
cuggcucccuaaccaugcac

SEQ ID NO: 268161 - RNA, 21 nt, Human
cuugcccaugucuuuaugaug

SEQ ID NO: 268162 - RNA, 23 nt, Human
gaaaccacagacacacuugccca

SEQ ID NO: 268163 - RNA, 23 nt, Human
gaaauagaagucugcauucaaag

SEQ ID NO: 268164 - RNA, 18 nt, Human
gaacacagcaaugacaau

SEQ ID NO: 268165 - RNA, 21 nt, Human
gagcacggcaauggaaaauac

SEQ ID NO: 268166 - RNA, 24 nt, Human
gaggggagugggcccccaugggga

SEQ ID NO: 268167 - RNA, 21 nt, Human
gauucuccauaggggggccuu

SEQ ID NO: 268168 - RNA, 21 nt, Human
gcaauggaaaauacuuuugga

SEQ ID NO: 268169 - RNA, 20 nt, Human
gcagccccuggaaacagcag

SEQ ID NO: 268170 - RNA, 20 nt, Human
ggaagagaggggagugggcc

SEQ ID NO: 268171 - RNA, 23 nt, Human
ggauucuccauaggggggccuug

SEQ ID NO: 268172 - RNA, 21 nt, Human
ggcaaguuuugguacagaacc

SEQ ID NO: 268173 - RNA, 23 nt, Human
gggaauccagcauccggugccau

SEQ ID NO: 268174 - RNA, 21 nt, Human
gggcagagcccaggcagguuu

SEQ ID NO: 268175 - RNA, 23 nt, Human
guagcagcagcagcaagguccag

SEQ ID NO: 268176 - RNA, 18 nt, Human
guuuuauuugggacagaa

SEQ ID NO: 268177 - RNA, 21 nt, Human
uaacaguccaugcucugcagc

SEQ ID NO: 268178 - RNA, 22 nt, Human
uaauuuggucugcauuacccaa

SEQ ID NO: 268179 - RNA, 18 nt, Human
uaccauacaaauuuggau

SEQ ID NO: 268180 - RNA, 19 nt, Human
uacuugucgauugguacau

SEQ ID NO: 268181 - RNA, 18 nt, Human
uagcugagccaucuuuuu

SEQ ID NO: 268182 - RNA, 20 nt, Human
uauuccaggccuggcucccu

SEQ ID NO: 268183 - RNA, 25 nt, Human
ucaaagagcacggcaauggaaaaua

SEQ ID NO: 268184 - RNA, 19 nt, Human
ucacuucuggaaauagaag

SEQ ID NO: 268185 - RNA, 23 nt, Human
ucagcucacucagaagaagugca

SEQ ID NO: 268186 - RNA, 20 nt, Human
uccaaggaacagaguggguc

SEQ ID NO: 268187 - RNA, 21 nt, Human
uccaugcucuccacaagcaca

SEQ ID NO: 268188 - RNA, 26 nt, Human
uccccugucauacauguuaacauucc

SEQ ID NO: 268189 - RNA, 22 nt, Human
ucccuuugcuaacuacuugcaa

SEQ ID NO: 268190 - RNA, 19 nt, Human
uccugugcuccaauugucc

SEQ ID NO: 268191 - RNA, 18 nt, Human
ucgauucagagcagggaa

SEQ ID NO: 268192 - RNA, 24 nt, Human
ucuccuggucaugaugucucucuu

SEQ ID NO: 268193 - RNA, 18 nt, Human
ucugcagccccuggaaac

SEQ ID NO: 268194 - RNA, 19 nt, Human
ucuucuggaauaagauugu

SEQ ID NO: 268195 - RNA, 22 nt, Human
ucuuucuggaauagccggagac

SEQ ID NO: 268196 - RNA, 20 nt, Human
ugaaaaaauagcugagccau

SEQ ID NO: 268197 - RNA, 22 nt, Human
ugaaauguucacagcuuagaaa

SEQ ID NO: 268198 - RNA, 22 nt, Human
ugacuuccaaacaagacagaca

SEQ ID NO: 268199 - RNA, 19 nt, Human
ugaggcaugcaguccucug

SEQ ID NO: 268200 - RNA, 18 nt, Human
uggaagugucggcauuca

SEQ ID NO: 268201 - RNA, 24 nt, Human
uggaagugucggcauucaucagcc

SEQ ID NO: 268202 - RNA, 23 nt, Human
uggaauagccucaccccagaggg

SEQ ID NO: 268203 - RNA, 20 nt, Human
uggcaaaaaaaaaaaaaaau

SEQ ID NO: 268204 - RNA, 26 nt, Human
uggcucccuaaccaugcacauagauu

SEQ ID NO: 268205 - RNA, 18 nt, Human
ugggaaguuccaagaaug

SEQ ID NO: 268206 - RNA, 24 nt, Human
uguaaaccugugaaaaaauagcug

SEQ ID NO: 268207 - RNA, 18 nt, Human
ugucccacuaccaccugc

SEQ ID NO: 268208 - RNA, 18 nt, Human
ugugguuccucuucuuug

SEQ ID NO: 268209 - RNA, 21 nt, Human
uucacaauaagcuacuaaaaa

SEQ ID NO: 268210 - RNA, 22 nt, Human
uucagagcagggaaaaguggga

SEQ ID NO: 268211 - RNA, 19 nt, Human
uucaucagccugcaugugg

SEQ ID NO: 268212 - RNA, 21 nt, Human
uuccaaacaagacagacauuc

SEQ ID NO: 268213 - RNA, 18 nt, Human
uuggaaaccacagacaca

SEQ ID NO: 268214 - RNA, 18 nt, Human
uugguucuuuuuggucua

SEQ ID NO: 268215 - RNA, 22 nt, Human
uuucuccuggucaugaugucuc

SEQ ID NO: 268216 - RNA, 18 nt, Human
uuucugcugccaauuaca

SEQ ID NO: 268217 - RNA, 21 nt, Human
uuuuggaauauguuaccauuu

SEQ ID NO: 268218 - RNA, 18 nt, Human
accagaaacuagccuaga

SEQ ID NO: 268219 - RNA, 23 nt, Human
auucugugccccccccccugcag

SEQ ID NO: 268220 - RNA, 18 nt, Human
ccaggcugaguaugauua

SEQ ID NO: 268221 - RNA, 21 nt, Human
ccggguaccaugguuuuuuuu

SEQ ID NO: 268222 - RNA, 24 nt, Human
cugcagcgaguguggacggcggcu

SEQ ID NO: 268223 - RNA, 19 nt, Human
gagcgacagaccuaggggc

SEQ ID NO: 268224 - RNA, 20 nt, Human
gcgugugugugucuguggug

SEQ ID NO: 268225 - RNA, 25 nt, Human
gugcgugugugugucugugguguug

SEQ ID NO: 268226 - RNA, 21 nt, Human
gugugugugugcgugugugug

SEQ ID NO: 268227 - RNA, 23 nt, Human
gugugugugugugcgugugugug

SEQ ID NO: 268228 - RNA, 20 nt, Human
guuuuuuuuuuuuuuuguuu

SEQ ID NO: 268229 - RNA, 25 nt, Human
uaccaugguuuuuuuuuuuuuuugu

SEQ ID NO: 268230 - RNA, 24 nt, Human
uagaauugugugugugugugcgug

SEQ ID NO: 268231 - RNA, 20 nt, Human
ucacuuuuuauuuugaucuu

SEQ ID NO: 268232 - RNA, 21 nt, Human
ucacuuuuuauuuugaucuuu

SEQ ID NO: 268233 - RNA, 22 nt, Human
ucacuuuuuauuuugaucuuug

SEQ ID NO: 268234 - RNA, 21 nt, Human
ugccagcggcagccgagcugc

SEQ ID NO: 268235 - RNA, 21 nt, Human
uggcugggagggauguucuug

SEQ ID NO: 268236 - RNA, 18 nt, Human
ugugccccccccccugca

SEQ ID NO: 268237 - RNA, 22 nt, Human
ugugccccccccccugcagcga

SEQ ID NO: 268238 - RNA, 21 nt, Human
ugugugcgugugugugucugu

SEQ ID NO: 268239 - RNA, 20 nt, Human
ugugugugugugcgugugug

SEQ ID NO: 268240 - RNA, 21 nt, Human
ugugugugugugugcgugugu

SEQ ID NO: 268241 - RNA, 21 nt, Human
ugugugugugugugcgugugu

SEQ ID NO: 268242 - RNA, 22 nt, Human
uucugugccccccccccugcag

SEQ ID NO: 268243 - RNA, 20 nt, Human
uuguuuguuuguuuugucuu

SEQ ID NO: 268244 - RNA, 20 nt, Human
uuuuuguuuguuuguuuugu

SEQ ID NO: 268245 - RNA, 20 nt, Human
aaaccaaaccaaccaccaaa

SEQ ID NO: 268246 - RNA, 21 nt, Human
aacaaaauuaacaacaacagc

SEQ ID NO: 268247 - RNA, 21 nt, Human
aacaacaacagcaacaacaaa

SEQ ID NO: 268248 - RNA, 26 nt, Human
aacaacaacagcaacaacaacaacaa

SEQ ID NO: 268249 - RNA, 21 nt, Human
aacaacagcaacaacaacaac

SEQ ID NO: 268250 - RNA, 18 nt, Human
aagcuccuucaucuugaa

SEQ ID NO: 268251 - RNA, 20 nt, Human
aagguggucauauucugucc

SEQ ID NO: 268252 - RNA, 23 nt, Human
aaucaauguugaaaaugcacuga

SEQ ID NO: 268253 - RNA, 18 nt, Human
aaugaccuaacugcuuug

SEQ ID NO: 268254 - RNA, 22 nt, Human
acaacaacaauaacaaaaggga

SEQ ID NO: 268255 - RNA, 23 nt, Human
acaacaacaauaacaaaagggaa

SEQ ID NO: 268256 - RNA, 19 nt, Human
acagcaacaacaacaacaa

SEQ ID NO: 268257 - RNA, 25 nt, Human
acagcaacaacaacaacaauaacaa

SEQ ID NO: 268258 - RNA, 25 nt, Human
acaggaacgcaaggagagauuuccg

SEQ ID NO: 268259 - RNA, 21 nt, Human
accaaauuaaacacagccaaa

SEQ ID NO: 268260 - RNA, 20 nt, Human
acuucagucuaucaaaaauc

SEQ ID NO: 268261 - RNA, 18 nt, Human
agagagacacacccagag

SEQ ID NO: 268262 - RNA, 20 nt, Human
agagagacacacccagagca

SEQ ID NO: 268263 - RNA, 30 nt, Human
agcaacaacaacaacaauaacaaaagggaa

SEQ ID NO: 268264 - RNA, 19 nt, Human
aggacucauacacaugcag

SEQ ID NO: 268265 - RNA, 21 nt, Human
auaacccuaacaaaagauauu

SEQ ID NO: 268266 - RNA, 22 nt, Human
augcagggccuucuuacacaug

SEQ ID NO: 268267 - RNA, 23 nt, Human
auuagccaauuauauuuaauggu

SEQ ID NO: 268268 - RNA, 21 nt, Human
caaaccaaaccaaccaccaaa

SEQ ID NO: 268269 - RNA, 23 nt, Human
caaacgaagguggucauauucug

SEQ ID NO: 268270 - RNA, 18 nt, Human
caacaacaacaacaauaa

SEQ ID NO: 268271 - RNA, 22 nt, Human
caacaacagcaacaacaacaac

SEQ ID NO: 268272 - RNA, 23 nt, Human
caacaacagcaacaacaacaaca

SEQ ID NO: 268273 - RNA, 26 nt, Human
caacagcaacaacaacaacaauaaca

SEQ ID NO: 268274 - RNA, 22 nt, Human
caaccaccaaauuaaacacagc

SEQ ID NO: 268275 - RNA, 20 nt, Human
caacuuauggcaaagacacu

SEQ ID NO: 268276 - RNA, 21 nt, Human
caagacaccauauugauauug

SEQ ID NO: 268277 - RNA, 18 nt, Human
caagccccuguaauauug

SEQ ID NO: 268278 - RNA, 22 nt, Human
cacaaacaaacuaauucaagua

SEQ ID NO: 268279 - RNA, 21 nt, Human
caccauauugauauuguuccc

SEQ ID NO: 268280 - RNA, 21 nt, Human
cagguuucugcaauguuaaaa

SEQ ID NO: 268281 - RNA, 25 nt, Human
cauacacaugcagggccuucuuaca

SEQ ID NO: 268282 - RNA, 22 nt, Human
ccaaauuaaacacagccaaaua

SEQ ID NO: 268283 - RNA, 23 nt, Human
ccaaauuaaacacagccaaauaa

SEQ ID NO: 268284 - RNA, 23 nt, Human
ccaaccaccaaauuaaacacagc

SEQ ID NO: 268285 - RNA, 21 nt, Human
ccaagcuagaaguuucccaag

SEQ ID NO: 268286 - RNA, 22 nt, Human
ccucugggagcuugcauagcuu

SEQ ID NO: 268287 - RNA, 18 nt, Human
ccuuuggaacgcauuccc

SEQ ID NO: 268288 - RNA, 18 nt, Human
cucaagguuaauaaaccu

SEQ ID NO: 268289 - RNA, 21 nt, Human
cucauacacaugcagggccuu

SEQ ID NO: 268290 - RNA, 22 nt, Human
cuuuucuucagaauacgccaga

SEQ ID NO: 268291 - RNA, 18 nt, Human
gacaccauauugauauug

SEQ ID NO: 268292 - RNA, 18 nt, Human
gaguucuccaaaguuuuc

SEQ ID NO: 268293 - RNA, 24 nt, Human
gcaacaacaacaacaauaacaaaa

SEQ ID NO: 268294 - RNA, 18 nt, Human
gcaauccaaauacucuuc

SEQ ID NO: 268295 - RNA, 24 nt, Human
gcucaacguuuuuuuuccuuaacc

SEQ ID NO: 268296 - RNA, 21 nt, Human
gcuucauggacacuuuacuaa

SEQ ID NO: 268297 - RNA, 22 nt, Human
ggaauggauccaugggccagga

SEQ ID NO: 268298 - RNA, 22 nt, Human
guauuugaacacuaaagacuug

SEQ ID NO: 268299 - RNA, 25 nt, Human
uaacaaaauuaacaacaacagcaac

SEQ ID NO: 268300 - RNA, 24 nt, Human
uaacaacaacagcaacaacaacaa

SEQ ID NO: 268301 - RNA, 25 nt, Human
uaacaacaacagcaacaacaacaac

SEQ ID NO: 268302 - RNA, 19 nt, Human
uaagcuccuucaucuugaa

SEQ ID NO: 268303 - RNA, 24 nt, Human
uagaacauccggaauagaacacau

SEQ ID NO: 268304 - RNA, 19 nt, Human
uagcuagaacauccggaau

SEQ ID NO: 268305 - RNA, 24 nt, Human
uaggacucauacacaugcagggcc

SEQ ID NO: 268306 - RNA, 18 nt, Human
ucacucuauuaccucugg

SEQ ID NO: 268307 - RNA, 22 nt, Human
ucaugugucacucuauuaccuc

SEQ ID NO: 268308 - RNA, 23 nt, Human
uccagcccuggagagagaccgga

SEQ ID NO: 268309 - RNA, 19 nt, Human
ucuguccugcuguagccag

SEQ ID NO: 268310 - RNA, 22 nt, Human
ucuguccugcuguagccagaaa

SEQ ID NO: 268311 - RNA, 24 nt, Human
ugaaaaugcacugaaucauaacuu

SEQ ID NO: 268312 - RNA, 20 nt, Human
ugaaguauuugaacacuaaa

SEQ ID NO: 268313 - RNA, 22 nt, Human
ugaggauaugauuugaaguauu

SEQ ID NO: 268314 - RNA, 21 nt, Human
ugcuccaauauuccuuuggaa

SEQ ID NO: 268315 - RNA, 20 nt, Human
ugcuucauggacacuuuacu

SEQ ID NO: 268316 - RNA, 20 nt, Human
ugucacucuauuaccucugg

SEQ ID NO: 268317 - RNA, 24 nt, Human
uuaaacacagccaaauaaagcaaa

SEQ ID NO: 268318 - RNA, 23 nt, Human
uugaaaaugcacugaaucauaac

SEQ ID NO: 268319 - RNA, 24 nt, Human
uugaaguauuugaacacuaaagac

SEQ ID NO: 268320 - RNA, 24 nt, Human
uugcacaaacaaacuaauucaagu

SEQ ID NO: 268321 - RNA, 21 nt, Human
uugcuccaauauuccuuugga

SEQ ID NO: 268322 - RNA, 23 nt, Human
uuugaagcugagggcagaaauca

SEQ ID NO: 268323 - RNA, 22 nt, Human
aaugcacuggaaagaggaaguc

SEQ ID NO: 268324 - RNA, 21 nt, Human
acacuggacaaugaggucaca

SEQ ID NO: 268325 - RNA, 19 nt, Human
agggauggugaggacacag

SEQ ID NO: 268326 - RNA, 18 nt, Human
cacuggaaagaggaaguc

SEQ ID NO: 268327 - RNA, 21 nt, Human
cagaaccaccaaccugugcca

SEQ ID NO: 268328 - RNA, 22 nt, Human
caugcacacaugcucacagaau

SEQ ID NO: 268329 - RNA, 22 nt, Human
ccuuaaaugcacuggaaagagg

SEQ ID NO: 268330 - RNA, 22 nt, Human
gacacagacacacugauguccc

SEQ ID NO: 268331 - RNA, 19 nt, Human
gauggugaggacacaggga

SEQ ID NO: 268332 - RNA, 22 nt, Human
ggcccagcggcucccugcagcc

SEQ ID NO: 268333 - RNA, 18 nt, Human
gggaaugugacugagggg

SEQ ID NO: 268334 - RNA, 24 nt, Human
gggcccagcggcucccugcagcca

SEQ ID NO: 268335 - RNA, 28 nt, Human
ucacaugcaugcaugcacacaugcucac

SEQ ID NO: 268336 - RNA, 21 nt, Human
ucagggauggugaggacacag

SEQ ID NO: 268337 - RNA, 23 nt, Human
ucgaggaaggacgcugggaucca

SEQ ID NO: 268338 - RNA, 23 nt, Human
ugacagaaccaccaaccugugcc

SEQ ID NO: 268339 - RNA, 27 nt, Human
ugaggucacaugcaugcaugcacacag

SEQ ID NO: 268340 - RNA, 22 nt, Human
ugcaugcacacaugcucacaga

SEQ ID NO: 268341 - RNA, 18 nt, Human
ugugccagaggugcggga

SEQ ID NO: 268342 - RNA, 21 nt, Human
aacuaggaggccaagagagcu

SEQ ID NO: 268343 - RNA, 20 nt, Human
acagggaauaaauaguuaac

SEQ ID NO: 268344 - RNA, 20 nt, Human
agaaacaggaauauuuguac

SEQ ID NO: 268345 - RNA, 18 nt, Human
agguagaaacuaggaggc

SEQ ID NO: 268346 - RNA, 18 nt, Human
augaugauagguuuuuuu

SEQ ID NO: 268347 - RNA, 20 nt, Human
caagccaaaaacagccugaa

SEQ ID NO: 268348 - RNA, 19 nt, Human
cacucagagcaagaaacag

SEQ ID NO: 268349 - RNA, 25 nt, Human
cacuuuuccucuccccuaacuccuc

SEQ ID NO: 268350 - RNA, 19 nt, Human
cagaagggugcuaaaucuu

SEQ ID NO: 268351 - RNA, 23 nt, Human
cagccugaaggcugaaagacuag

SEQ ID NO: 268352 - RNA, 19 nt, Human
caguauacagcagaagggu

SEQ ID NO: 268353 - RNA, 21 nt, Human
caguauacagcagaagggugc

SEQ ID NO: 268354 - RNA, 20 nt, Human
ccacuuuuccucuccccuaa

SEQ ID NO: 268355 - RNA, 18 nt, Human
ccagacacuuccauccac

SEQ ID NO: 268356 - RNA, 20 nt, Human
ccuccauucaccugucccca

SEQ ID NO: 268357 - RNA, 20 nt, Human
ccuguccccaucuccucacc

SEQ ID NO: 268358 - RNA, 18 nt, Human
cuccauucaccugucccc

SEQ ID NO: 268359 - RNA, 21 nt, Human
gagagcuucaagccaaaaaca

SEQ ID NO: 268360 - RNA, 22 nt, Human
gagccaauuacaguaaugguuc

SEQ ID NO: 268361 - RNA, 24 nt, Human
ggaauaaauaguuaacacuuccaa

SEQ ID NO: 268362 - RNA, 24 nt, Human
uacaguaaugguucagaaacagga

SEQ ID NO: 268363 - RNA, 18 nt, Human
uacuucaagccuuaagag

SEQ ID NO: 268364 - RNA, 21 nt, Human
uaggaggccaagagagcuuca

SEQ ID NO: 268365 - RNA, 20 nt, Human
uauugugguaugacacagaa

SEQ ID NO: 268366 - RNA, 21 nt, Human
uccauccacuuuuccucuccc

SEQ ID NO: 268367 - RNA, 18 nt, Human
uccccaucuccucaccca

SEQ ID NO: 268368 - RNA, 19 nt, Human
ucuucagcuuuguaguuug

SEQ ID NO: 268369 - RNA, 20 nt, Human
ugcaccaaauguacagcuug

SEQ ID NO: 268370 - RNA, 23 nt, Human
uggguacucacaucauugucuag

SEQ ID NO: 268371 - RNA, 20 nt, Human
uugugguaugacacagaaaa

SEQ ID NO: 268372 - RNA, 22 nt, Human
uuuguacuuacuccuugggccu

SEQ ID NO: 268373 - RNA, 23 nt, Human
agucccaggcugaguucaccucu

SEQ ID NO: 268374 - RNA, 23 nt, Human
cagccacccugcgucucgucuca

SEQ ID NO: 268375 - RNA, 21 nt, Human
cagccgaaccagaucccccuc

SEQ ID NO: 268376 - RNA, 23 nt, Human
cagccgaaccagaucccccucag

SEQ ID NO: 268377 - RNA, 22 nt, Human
ccagccagucccaggcugaguu

SEQ ID NO: 268378 - RNA, 23 nt, Human
ccagccagucccaggcugaguuc

SEQ ID NO: 268379 - RNA, 18 nt, Human
ccaggagcugccuuuggg

SEQ ID NO: 268380 - RNA, 23 nt, Human
cccagggagcagguggagagucu

SEQ ID NO: 268381 - RNA, 24 nt, Human
cccccucagcgucccgguaauuca

SEQ ID NO: 268382 - RNA, 20 nt, Human
cccucagcgucccgguaauu

SEQ ID NO: 268383 - RNA, 19 nt, Human
ccuugugagcuccagcagg

SEQ ID NO: 268384 - RNA, 22 nt, Human
cgccuugugagcuccagcaggu

SEQ ID NO: 268385 - RNA, 21 nt, Human
cgucucgucucagccuguggu

SEQ ID NO: 268386 - RNA, 23 nt, Human
cucacugcuccagggacaccguc

SEQ ID NO: 268387 - RNA, 21 nt, Human
cucucacuuccuccagccacc

SEQ ID NO: 268388 - RNA, 19 nt, Human
cugccuuuggggaggcuca

SEQ ID NO: 268389 - RNA, 18 nt, Human
cuguaguuguccuucugc

SEQ ID NO: 268390 - RNA, 24 nt, Human
gacagcagccgaaccagauccccc

SEQ ID NO: 268391 - RNA, 24 nt, Human
gagcugaagguuuuugcugguguc

SEQ ID NO: 268392 - RNA, 24 nt, Human
gaguccccaggagcugccuuuggg

SEQ ID NO: 268393 - RNA, 22 nt, Human
gccuuuggggaggcucaggccu

SEQ ID NO: 268394 - RNA, 20 nt, Human
gucucgucucagccuguggu

SEQ ID NO: 268395 - RNA, 20 nt, Human
ucucucuggaacucccgccu

SEQ ID NO: 268396 - RNA, 25 nt, Human
ucugcccauccucccagguuuuccu

SEQ ID NO: 268397 - RNA, 21 nt, Human
ugagagcugaagguuuuugcu

SEQ ID NO: 268398 - RNA, 21 nt, Human
ugccuuuggggaggcucaggc

SEQ ID NO: 268399 - RNA, 21 nt, Human
ugggaggggaggccacgagcc

SEQ ID NO: 268400 - RNA, 27 nt, Human
ugggaguccccaggagcugccuuuggg

SEQ ID NO: 268401 - RNA, 23 nt, Human
ugugcagcuuccaggggaagagg

SEQ ID NO: 268402 - RNA, 24 nt, Human
uuugcugguguccccucacugcuc

SEQ ID NO: 268403 - RNA, 21 nt, Human
uuuggggaggcucaggccugc

SEQ ID NO: 268404 - RNA, 23 nt, Human
uuuggggaggcucaggccugcuu

SEQ ID NO: 268405 - RNA, 21 nt, Human
aggccgggcgggcagcuccac

SEQ ID NO: 268406 - RNA, 25 nt, Human
cucugccacaaggccgggcgggcag

SEQ ID NO: 268407 - RNA, 20 nt, Human
gggcgggcagcuccaccgug

SEQ ID NO: 268408 - RNA, 19 nt, Human
ggggcccgggaggcgagug

SEQ ID NO: 268409 - RNA, 22 nt, Human
uccaccguggggcccgggaggc

SEQ ID NO: 268410 - RNA, 21 nt, Human
uccccgcgggaggagccucug

SEQ ID NO: 268411 - RNA, 23 nt, Human
uggggcccgggaggcgagugugg

SEQ ID NO: 268412 - RNA, 20 nt, Human
aagaaaccaaugaucagaaa

SEQ ID NO: 268413 - RNA, 23 nt, Human
acaaaacuuuuucaggucuuaag

SEQ ID NO: 268414 - RNA, 21 nt, Human
acacacagaugaauacuauaa

SEQ ID NO: 268415 - RNA, 23 nt, Human
accaaugaucagaaaauacaacc

SEQ ID NO: 268416 - RNA, 20 nt, Human
aggcuuuauacaagcaacaa

SEQ ID NO: 268417 - RNA, 19 nt, Human
agguaaaaccaaggcaaca

SEQ ID NO: 268418 - RNA, 24 nt, Human
aguacaaccauauuaagaaaccaa

SEQ ID NO: 268419 - RNA, 22 nt, Human
aucacuaucuaaaauaaucacu

SEQ ID NO: 268420 - RNA, 22 nt, Human
caaaacuuuuucaggucuuaag

SEQ ID NO: 268421 - RNA, 24 nt, Human
caaccauauuaagaaaccaaugau

SEQ ID NO: 268422 - RNA, 22 nt, Human
caaugaucagaaaauacaaccg

SEQ ID NO: 268423 - RNA, 21 nt, Human
cagaaaauacaaccguaugaa

SEQ ID NO: 268424 - RNA, 22 nt, Human
cagcagcccgcgccccggcagc

SEQ ID NO: 268425 - RNA, 19 nt, Human
cccauggcccucgcgcccc

SEQ ID NO: 268426 - RNA, 21 nt, Human
ccccaaucccgcgccggcgac

SEQ ID NO: 268427 - RNA, 20 nt, Human
ccccacccccggcgcucucc

SEQ ID NO: 268428 - RNA, 27 nt, Human
cccgcagcagcccgcgccccggcagcc

SEQ ID NO: 268429 - RNA, 19 nt, Human
cccgcccgcgaccuccgcc

SEQ ID NO: 268430 - RNA, 24 nt, Human
cccgccgcccuuccgcccccaccc

SEQ ID NO: 268431 - RNA, 19 nt, Human
cccgcgccggcgacagagc

SEQ ID NO: 268432 - RNA, 27 nt, Human
cccgcggccuucgcagcagccucucuc

SEQ ID NO: 268433 - RNA, 18 nt, Human
ccgccgccgccggccgcc

SEQ ID NO: 268434 - RNA, 22 nt, Human
ccuccccucccgcccgcgaccc

SEQ ID NO: 268435 - RNA, 24 nt, Human
ccuccugccuuccgcccgccgccc

SEQ ID NO: 268436 - RNA, 25 nt, Human
ccuuccgcccccacccccggcgcuc

SEQ ID NO: 268437 - RNA, 20 nt, Human
ccuuccgcccgccgcccuuc

SEQ ID NO: 268438 - RNA, 25 nt, Human
cgcagcagccucucucgggccuccu

SEQ ID NO: 268439 - RNA, 19 nt, Human
cgcccuuccgcccccaccc

SEQ ID NO: 268440 - RNA, 21 nt, Human
cgcccuuccgcccccaccccc

SEQ ID NO: 268441 - RNA, 20 nt, Human
cggcagccuccugccuuccg

SEQ ID NO: 268442 - RNA, 20 nt, Human
cuaaugccaacagggcacca

SEQ ID NO: 268443 - RNA, 21 nt, Human
cuaaugccaacagggcaccau

SEQ ID NO: 268444 - RNA, 20 nt, Human
cucccgcagcagcccgcgcc

SEQ ID NO: 268445 - RNA, 23 nt, Human
gccccuucucccgcagcagcccg

SEQ ID NO: 268446 - RNA, 23 nt, Human
gccgccgccgccggccgccucgg

SEQ ID NO: 268447 - RNA, 22 nt, Human
gcuggugccgccgccgccgccg

SEQ ID NO: 268448 - RNA, 25 nt, Human
ggagccccuucucccgcagcagccc

SEQ ID NO: 268449 - RNA, 22 nt, Human
guacaaccauauuaagaaacca

SEQ ID NO: 268450 - RNA, 21 nt, Human
uaaaaccaaggcaacaaaaau

SEQ ID NO: 268451 - RNA, 23 nt, Human
uaaaaccaaggcaacaaaaaugc

SEQ ID NO: 268452 - RNA, 20 nt, Human
uaaaguagaaauguauucau

SEQ ID NO: 268453 - RNA, 18 nt, Human
uaacaucacagaaaugca

SEQ ID NO: 268454 - RNA, 24 nt, Human
uaacaucacagaaaugcacaucca

SEQ ID NO: 268455 - RNA, 19 nt, Human
uaagaaaccaaugaucaga

SEQ ID NO: 268456 - RNA, 21 nt, Human
uacagguaaaaccaaggcaac

SEQ ID NO: 268457 - RNA, 24 nt, Human
uauaggaauaaucucagugaauuc

SEQ ID NO: 268458 - RNA, 22 nt, Human
ucaacaguugauaaaugucuaa

SEQ ID NO: 268459 - RNA, 20 nt, Human
ucagaaauaaacaagcaaag

SEQ ID NO: 268460 - RNA, 22 nt, Human
uccacaaaacuuuuucaggucu

SEQ ID NO: 268461 - RNA, 20 nt, Human
ucgggccuccuccccucccg

SEQ ID NO: 268462 - RNA, 24 nt, Human
ucuaauacuaagcaguucuuuaac

SEQ ID NO: 268463 - RNA, 25 nt, Human
ucuacagguaaaaccaaggcaacaa

SEQ ID NO: 268464 - RNA, 23 nt, Human
ucucccgcagcagcccgcgcccc

SEQ ID NO: 268465 - RNA, 24 nt, Human
ugaaagaaauuuauaauccacaaa

SEQ ID NO: 268466 - RNA, 18 nt, Human
ugaaauaauuuacacaca

SEQ ID NO: 268467 - RNA, 18 nt, Human
ugaucagaaaauacaacc

SEQ ID NO: 268468 - RNA, 20 nt, Human
ugaucagaaaauacaaccgu

SEQ ID NO: 268469 - RNA, 19 nt, Human
ugccuuccgcccgccgccc

SEQ ID NO: 268470 - RNA, 21 nt, Human
uggcccucgcgccccaauccc

SEQ ID NO: 268471 - RNA, 21 nt, Human
ugggaaaugaucugcuucuaa

SEQ ID NO: 268472 - RNA, 22 nt, Human
uuaaauguuauacaguguuaca

SEQ ID NO: 268473 - RNA, 25 nt, Human
uuccgcccgccgcccuuccgccccc

SEQ ID NO: 268474 - RNA, 18 nt, Human
aagaagccaagcgacggc

SEQ ID NO: 268475 - RNA, 21 nt, Human
agggaaagcagagggacagaa

SEQ ID NO: 268476 - RNA, 18 nt, Human
agguaacaguaaaaaccc

SEQ ID NO: 268477 - RNA, 23 nt, Human
agguaacaguaaaaaccccagag

SEQ ID NO: 268478 - RNA, 23 nt, Human
augaaacaauauaaauucaaaac

SEQ ID NO: 268479 - RNA, 20 nt, Human
cacgguauugcccuugaaau

SEQ ID NO: 268480 - RNA, 22 nt, Human
cagaagaagccaagcgacggcg

SEQ ID NO: 268481 - RNA, 22 nt, Human
ugaagcggacaaguggcgcaga

SEQ ID NO: 268482 - RNA, 24 nt, Human
ugaagcggacaaguggcgcagaug

SEQ ID NO: 268483 - RNA, 21 nt, Human
uggaauguccucagaaggcuc

SEQ ID NO: 268484 - RNA, 18 nt, Human
cgaccugaagaauggcug

SEQ ID NO: 268485 - RNA, 19 nt, Human
ugcuccaaaugcuacgacc

SEQ ID NO: 268486 - RNA, 23 nt, Human
uuaaauuucacauuccuuuaaaa

SEQ ID NO: 268487 - RNA, 19 nt, Human
uuuuuuuuuuuuuugcucc

SEQ ID NO: 268488 - RNA, 20 nt, Human
uuuuuuuuuuuuuugcucca

SEQ ID NO: 268489 - RNA, 18 nt, Human
uuuuuuuuuuuuuuuuug

SEQ ID NO: 268490 - RNA, 20 nt, Human
uuuuuuuuuuuuuuuuugcu

SEQ ID NO: 268491 - RNA, 20 nt, Human
aaaaugccuacaucuaaaca

SEQ ID NO: 268492 - RNA, 22 nt, Human
aaaauuaaaaugccuacaucua

SEQ ID NO: 268493 - RNA, 19 nt, Human
aaagcauuauugcucuacc

SEQ ID NO: 268494 - RNA, 20 nt, Human
aaaggucauauuuacaaaaa

SEQ ID NO: 268495 - RNA, 18 nt, Human
aacacuccaugucuccag

SEQ ID NO: 268496 - RNA, 22 nt, Human
aacagcagaaaagugguagggg

SEQ ID NO: 268497 - RNA, 19 nt, Human
aacucaacaccauuaguaa

SEQ ID NO: 268498 - RNA, 23 nt, Human
aaggcagaaaaaagugacacaaa

SEQ ID NO: 268499 - RNA, 23 nt, Human
aauucacagacauucagaaaccc

SEQ ID NO: 268500 - RNA, 23 nt, Human
acacacacacacacacacauaca

SEQ ID NO: 268501 - RNA, 23 nt, Human
acacacacacacacacauacaca

SEQ ID NO: 268502 - RNA, 25 nt, Human
acacacacacacacauacacacaca

SEQ ID NO: 268503 - RNA, 23 nt, Human
acacacacacauacacacacaca

SEQ ID NO: 268504 - RNA, 23 nt, Human
acacacacauacacacacacaca

SEQ ID NO: 268505 - RNA, 22 nt, Human
acacagaacuacuacaccugaa

SEQ ID NO: 268506 - RNA, 18 nt, Human
acacagcccaugaauugc

SEQ ID NO: 268507 - RNA, 19 nt, Human
acagagcaacucaacacca

SEQ ID NO: 268508 - RNA, 24 nt, Human
acagcugagcagacaccagaaacc

SEQ ID NO: 268509 - RNA, 18 nt, Human
accauauaggcaaagggu

SEQ ID NO: 268510 - RNA, 18 nt, Human
accccucccccaggccac

SEQ ID NO: 268511 - RNA, 18 nt, Human
accugguucuuccucugu

SEQ ID NO: 268512 - RNA, 21 nt, Human
agaaucaccaauuccacugga

SEQ ID NO: 268513 - RNA, 23 nt, Human
agcaccauucuauuucuccccac

SEQ ID NO: 268514 - RNA, 25 nt, Human
agcagacaccagaaaccacaccaag

SEQ ID NO: 268515 - RNA, 19 nt, Human
agcugguccuuucuuccaa

SEQ ID NO: 268516 - RNA, 20 nt, Human
aggcagaaaaaagugacaca

SEQ ID NO: 268517 - RNA, 20 nt, Human
aggcugggggguggggaagg

SEQ ID NO: 268518 - RNA, 33 nt, Human
auaauuaaacauacacacacacacacacacagu

SEQ ID NO: 268519 - RNA, 23 nt, Human
auacacacacacacacacacaua

SEQ ID NO: 268520 - RNA, 21 nt, Human
auacugcaacuagagaaacca

SEQ ID NO: 268521 - RNA, 21 nt, Human
aucaccaauuccacuggacaa

SEQ ID NO: 268522 - RNA, 20 nt, Human
aucacuuaaaauacccuuga

SEQ ID NO: 268523 - RNA, 19 nt, Human
aucucauuuccuuucugca

SEQ ID NO: 268524 - RNA, 31 nt, Human
auuaaacauacacacacacacacacacauag

SEQ ID NO: 268525 - RNA, 24 nt, Human
caaaaaacauuucuguuuugaaca

SEQ ID NO: 268526 - RNA, 22 nt, Human
caaaggauguucaagcaguuua

SEQ ID NO: 268527 - RNA, 24 nt, Human
caaaugacaucacuuaaaauaccc

SEQ ID NO: 268528 - RNA, 25 nt, Human
caauacugcaacuagagaaaccaga

SEQ ID NO: 268529 - RNA, 20 nt, Human
cacacacacacacacacaua

SEQ ID NO: 268530 - RNA, 26 nt, Human
cacacacacacacacacauacacaca

SEQ ID NO: 268531 - RNA, 19 nt, Human
cacacacacacacacauac

SEQ ID NO: 268532 - RNA, 28 nt, Human
cacacacacacacacauacacacacaca

SEQ ID NO: 268533 - RNA, 21 nt, Human
cacacacacacacagcccaug

SEQ ID NO: 268534 - RNA, 24 nt, Human
cacacacacacauacacacacaca

SEQ ID NO: 268535 - RNA, 28 nt, Human
cacacacacacauacacacacacacaca

SEQ ID NO: 268536 - RNA, 29 nt, Human
cacacacauacacacacacacacagccca

SEQ ID NO: 268537 - RNA, 22 nt, Human
cacacauacacacacacacaca

SEQ ID NO: 268538 - RNA, 20 nt, Human
caccaguacuuuaaaaaaaa

SEQ ID NO: 268539 - RNA, 19 nt, Human
cacuggacaaagggucaac

SEQ ID NO: 268540 - RNA, 23 nt, Human
cagaaaccacaccaaggauucua

SEQ ID NO: 268541 - RNA, 24 nt, Human
cagcugagcagacaccagaaacca

SEQ ID NO: 268542 - RNA, 19 nt, Human
caggccacaaaagucaagg

SEQ ID NO: 268543 - RNA, 18 nt, Human
caguaccuggccuugggu

SEQ ID NO: 268544 - RNA, 22 nt, Human
cauauaggcaaagggugacacc

SEQ ID NO: 268545 - RNA, 21 nt, Human
caugacaguuccuggagguga

SEQ ID NO: 268546 - RNA, 21 nt, Human
ccaaaugaauuaacccagaua

SEQ ID NO: 268547 - RNA, 24 nt, Human
cccacacacauaacuuaaagaagg

SEQ ID NO: 268548 - RNA, 22 nt, Human
cccaccuacguguauuuaagag

SEQ ID NO: 268549 - RNA, 22 nt, Human
cccaggccacaaaagucaaggg

SEQ ID NO: 268550 - RNA, 27 nt, Human
cccccaaauuaacaaagugcuuaguuc

SEQ ID NO: 268551 - RNA, 20 nt, Human
ccucaccacacagcuuacug

SEQ ID NO: 268552 - RNA, 25 nt, Human
ccucccgccgccauuuuccucgcag

SEQ ID NO: 268553 - RNA, 20 nt, Human
ccuuaagagguccuggugca

SEQ ID NO: 268554 - RNA, 24 nt, Human
cgaggcaucuaaggcuggggggug

SEQ ID NO: 268555 - RNA, 23 nt, Human
cuacguguauuuaagagauuuug

SEQ ID NO: 268556 - RNA, 25 nt, Human
cuagagaaaccagauauucuaaucu

SEQ ID NO: 268557 - RNA, 20 nt, Human
cuauuucuccccacacacau

SEQ ID NO: 268558 - RNA, 23 nt, Human
cucagcccgcagccgccgccggc

SEQ ID NO: 268559 - RNA, 19 nt, Human
cuccuaaaggggaugaaaa

SEQ ID NO: 268560 - RNA, 19 nt, Human
cucuugauucuuccaaugu

SEQ ID NO: 268561 - RNA, 18 nt, Human
cugaguccaccauccagc

SEQ ID NO: 268562 - RNA, 22 nt, Human
cuugauucuuccaauguucucu

SEQ ID NO: 268563 - RNA, 20 nt, Human
gaaaagcacaggccacuaca

SEQ ID NO: 268564 - RNA, 26 nt, Human
gacaccagaaaccacaccaaggauuc

SEQ ID NO: 268565 - RNA, 21 nt, Human
gagaaagccuagggcaaauaa

SEQ ID NO: 268566 - RNA, 26 nt, Human
gcaaggcagaaaaaagugacacaaaa

SEQ ID NO: 268567 - RNA, 18 nt, Human
gccuuggguuuucagaag

SEQ ID NO: 268568 - RNA, 21 nt, Human
gcuuaaaauccaguccugcuc

SEQ ID NO: 268569 - RNA, 19 nt, Human
ggacauaaugaaagcauca

SEQ ID NO: 268570 - RNA, 21 nt, Human
ggccacaaaagucaagggaug

SEQ ID NO: 268571 - RNA, 19 nt, Human
ggccuuggguuuucagaag

SEQ ID NO: 268572 - RNA, 19 nt, Human
gggcagaagagggaggggu

SEQ ID NO: 268573 - RNA, 21 nt, Human
ggugucaaagagaggcaacag

SEQ ID NO: 268574 - RNA, 20 nt, Human
guacuuuaaaaaaaaaaauc

SEQ ID NO: 268575 - RNA, 19 nt, Human
gugcucaguuagacugugg

SEQ ID NO: 268576 - RNA, 24 nt, Human
guuuucggauuuacaaucuuucuu

SEQ ID NO: 268577 - RNA, 26 nt, Human
uaaaauacccuugauggagcucaaag

SEQ ID NO: 268578 - RNA, 26 nt, Human
uaacacguaaguguaggcaaaaacca

SEQ ID NO: 268579 - RNA, 23 nt, Human
uaacuuaaagaagggucagauac

SEQ ID NO: 268580 - RNA, 22 nt, Human
uaagagcaccauucuauuucuc

SEQ ID NO: 268581 - RNA, 18 nt, Human
uaaguguaggcaaaaacc

SEQ ID NO: 268582 - RNA, 20 nt, Human
uacacacacacacacacaca

SEQ ID NO: 268583 - RNA, 24 nt, Human
uacacacacacacacagcccaugg

SEQ ID NO: 268584 - RNA, 20 nt, Human
uacaggacaugaauggcaaa

SEQ ID NO: 268585 - RNA, 22 nt, Human
uacuuaagaaauaacugacacu

SEQ ID NO: 268586 - RNA, 21 nt, Human
uagcagagaccucugaaauuc

SEQ ID NO: 268587 - RNA, 24 nt, Human
uaggagguggaaugccaaaaaaca

SEQ ID NO: 268588 - RNA, 21 nt, Human
uagggggcagaagagggaggg

SEQ ID NO: 268589 - RNA, 19 nt, Human
ucacauuaguagaaugagg

SEQ ID NO: 268590 - RNA, 22 nt, Human
ucagaaacccaauuccgucaac

SEQ ID NO: 268591 - RNA, 21 nt, Human
uccaagauggaugccuggaac

SEQ ID NO: 268592 - RNA, 20 nt, Human
uccucccgccgccauuuucc

SEQ ID NO: 268593 - RNA, 18 nt, Human
ucggaaacucgccgcuca

SEQ ID NO: 268594 - RNA, 24 nt, Human
ucuaaacaaauaaucucuuuaaaa

SEQ ID NO: 268595 - RNA, 20 nt, Human
ucuccccacacacauaacuu

SEQ ID NO: 268596 - RNA, 23 nt, Human
ucuuccucugucuccaaacagga

SEQ ID NO: 268597 - RNA, 23 nt, Human
ugaaaaagagacagacugaccug

SEQ ID NO: 268598 - RNA, 22 nt, Human
ugaaguauuacaggacaugaau

SEQ ID NO: 268599 - RNA, 18 nt, Human
ugaccuacaaaaaaaggu

SEQ ID NO: 268600 - RNA, 18 nt, Human
ugagcagacaccagaaac

SEQ ID NO: 268601 - RNA, 20 nt, Human
ugagcagacaccagaaacca

SEQ ID NO: 268602 - RNA, 20 nt, Human
ugauacacagcagaaggagg

SEQ ID NO: 268603 - RNA, 18 nt, Human
ugauggagcucaaagcug

SEQ ID NO: 268604 - RNA, 19 nt, Human
ugauggagcucaaagcugg

SEQ ID NO: 268605 - RNA, 19 nt, Human
ugauuccuucccaauaauc

SEQ ID NO: 268606 - RNA, 19 nt, Human
ugcaacuagagaaaccaga

SEQ ID NO: 268607 - RNA, 22 nt, Human
uggaaugccaaaaaacauuucu

SEQ ID NO: 268608 - RNA, 22 nt, Human
uggcuagcaaggcagaaaaaag

SEQ ID NO: 268609 - RNA, 24 nt, Human
ugguagaggaauuuuuaaaaaauu

SEQ ID NO: 268610 - RNA, 19 nt, Human
uggucucugaguccaccau

SEQ ID NO: 268611 - RNA, 22 nt, Human
uuaaaaugccuacaucuaaaca

SEQ ID NO: 268612 - RNA, 22 nt, Human
uuaaauaaagugcacucagcug

SEQ ID NO: 268613 - RNA, 21 nt, Human
uuaguucugguagaggaauuu

SEQ ID NO: 268614 - RNA, 23 nt, Human
uucacuauucccucaagaccuca

SEQ ID NO: 268615 - RNA, 21 nt, Human
uuccucgcagcucagcuuuaa

SEQ ID NO: 268616 - RNA, 18 nt, Human
uugguaggggaaagaggg

SEQ ID NO: 268617 - RNA, 20 nt, Human
uugguaggggaaagagggca

SEQ ID NO: 268618 - RNA, 21 nt, Human
aaacaguaacucauaaucuga

SEQ ID NO: 268619 - RNA, 25 nt, Human
aaacaucaguaguuuucacaaagcu

SEQ ID NO: 268620 - RNA, 21 nt, Human
aacugaaucaccucagcauga

SEQ ID NO: 268621 - RNA, 20 nt, Human
aagaaacuacagagcugcaa

SEQ ID NO: 268622 - RNA, 23 nt, Human
aagaacucuagugaagcuguaug

SEQ ID NO: 268623 - RNA, 18 nt, Human
aagaagcuuaauaguuuc

SEQ ID NO: 268624 - RNA, 20 nt, Human
aagaauaauguagaacuaac

SEQ ID NO: 268625 - RNA, 24 nt, Human
aagcgacaggcugcuuuaccccug

SEQ ID NO: 268626 - RNA, 21 nt, Human
aaggcacaaguguugaaaacg

SEQ ID NO: 268627 - RNA, 20 nt, Human
aagguccccgagcccgggcc

SEQ ID NO: 268628 - RNA, 25 nt, Human
aaguguugaaaacggccuguucacu

SEQ ID NO: 268629 - RNA, 19 nt, Human
acacaggaugcaccaauua

SEQ ID NO: 268630 - RNA, 24 nt, Human
accccaaggcacaaguguugaaaa

SEQ ID NO: 268631 - RNA, 22 nt, Human
accccacuucucuccuacacag

SEQ ID NO: 268632 - RNA, 23 nt, Human
acuaacaaaagaaaacccacagc

SEQ ID NO: 268633 - RNA, 18 nt, Human
agcccgggccucgucccg

SEQ ID NO: 268634 - RNA, 20 nt, Human
agcugcccggcaagcgacag

SEQ ID NO: 268635 - RNA, 19 nt, Human
aggcacaaguguugaaaac

SEQ ID NO: 268636 - RNA, 23 nt, Human
aggcaggagaagaacuaagcuaa

SEQ ID NO: 268637 - RNA, 26 nt, Human
aggcaggagaagaacuaaggggaccc

SEQ ID NO: 268638 - RNA, 26 nt, Human
auagugauuaauguaaauuauauuuu

SEQ ID NO: 268639 - RNA, 22 nt, Human
caaaauucaucaaugcaaaaga

SEQ ID NO: 268640 - RNA, 23 nt, Human
cacaaagcuucaaugaacacccc

SEQ ID NO: 268641 - RNA, 22 nt, Human
cagaaagacaaaauuugcagua

SEQ ID NO: 268642 - RNA, 20 nt, Human
cagacccagaaacacaaaga

SEQ ID NO: 268643 - RNA, 19 nt, Human
cagcagaaaggcugcucaa

SEQ ID NO: 268644 - RNA, 20 nt, Human
cagcaugaauaaacagcauu

SEQ ID NO: 268645 - RNA, 21 nt, Human
caggagaagaacuaagcuaau

SEQ ID NO: 268646 - RNA, 24 nt, Human
ccacgcgucacacggcaacuccag

SEQ ID NO: 268647 - RNA, 24 nt, Human
ccaggugucaagcucagcuuccau

SEQ ID NO: 268648 - RNA, 22 nt, Human
gaaacacaaagauuuggcaagc

SEQ ID NO: 268649 - RNA, 21 nt, Human
gcccggcaagcgacaggcugc

SEQ ID NO: 268650 - RNA, 20 nt, Human
gucaaaaauugccaagauua

SEQ ID NO: 268651 - RNA, 18 nt, Human
gugaaaaagacguccaca

SEQ ID NO: 268652 - RNA, 24 nt, Human
uaaaauguuucauaauuaaugucc

SEQ ID NO: 268653 - RNA, 21 nt, Human
uaacaaaagaaaacccacagc

SEQ ID NO: 268654 - RNA, 22 nt, Human
uacacaggaugcaccaauuauc

SEQ ID NO: 268655 - RNA, 23 nt, Human
uacugaguccuucuaaagagcuc

SEQ ID NO: 268656 - RNA, 19 nt, Human
uagaacaggaaaauaauua

SEQ ID NO: 268657 - RNA, 23 nt, Human
ucaaugaacaccccaaggcacaa

SEQ ID NO: 268658 - RNA, 20 nt, Human
ucagaccacuaacaaaagaa

SEQ ID NO: 268659 - RNA, 23 nt, Human
ucagcuuccauuuacacaggaug

SEQ ID NO: 268660 - RNA, 19 nt, Human
ucaguaguuuucacaaagc

SEQ ID NO: 268661 - RNA, 18 nt, Human
ucccgcccacgcgucaca

SEQ ID NO: 268662 - RNA, 20 nt, Human
ucccuacuuaaaagcaccag

SEQ ID NO: 268663 - RNA, 19 nt, Human
ucuggaaagcagcaaagau

SEQ ID NO: 268664 - RNA, 24 nt, Human
ugaaaaagacguccacaaagaugc

SEQ ID NO: 268665 - RNA, 21 nt, Human
ugaagaauaauguagaacuaa

SEQ ID NO: 268666 - RNA, 23 nt, Human
ugaccagguuaauuuuuuugugc

SEQ ID NO: 268667 - RNA, 18 nt, Human
ugaguuuaagugaagaau

SEQ ID NO: 268668 - RNA, 22 nt, Human
ugcuccucacaggccaggucac

SEQ ID NO: 268669 - RNA, 23 nt, Human
uggaaagcagcaaagauaucuua

SEQ ID NO: 268670 - RNA, 18 nt, Human
uggaaaggcuccuuacau

SEQ ID NO: 268671 - RNA, 21 nt, Human
uggcaaugacauuuugggacc

SEQ ID NO: 268672 - RNA, 27 nt, Human
uguaagaaggagggaacugaaucaccu

SEQ ID NO: 268673 - RNA, 18 nt, Human
ugucaagcucagcuucca

SEQ ID NO: 268674 - RNA, 20 nt, Human
uucaaaauuaggcaggagaa

SEQ ID NO: 268675 - RNA, 20 nt, Human
uugggaccaugaaguuuccc

SEQ ID NO: 268676 - RNA, 18 nt, Human
uuuaaggagacugagaaa

SEQ ID NO: 268677 - RNA, 22 nt, Human
uuuaucccuacuuaaaagcacc

SEQ ID NO: 268678 - RNA, 26 nt, Human
uuucauaauuaaugucaaaaauugcc

SEQ ID NO: 268679 - RNA, 19 nt, Human
uuuuuuuuuuuuuuuuugu

SEQ ID NO: 268680 - RNA, 22 nt, Human
uuuuuuuuuuuuuuuuuugugg

SEQ ID NO: 268681 - RNA, 21 nt, Human
aaaaaaaaugaaacuggaccc

SEQ ID NO: 268682 - RNA, 21 nt, Human
aaaaaauggcaaaacaagccc

SEQ ID NO: 268683 - RNA, 19 nt, Human
aaaaaugaaacuggacccg

SEQ ID NO: 268684 - RNA, 20 nt, Human
aaaacuaguaacauuuauaa

SEQ ID NO: 268685 - RNA, 19 nt, Human
aaacaacaguagguauucc

SEQ ID NO: 268686 - RNA, 20 nt, Human
aaacuacaccacacuugaca

SEQ ID NO: 268687 - RNA, 24 nt, Human
aaacucuauuacucugccaaaaaa

SEQ ID NO: 268688 - RNA, 20 nt, Human
aaagaucuaaccauugaaaa

SEQ ID NO: 268689 - RNA, 20 nt, Human
aaagauugauaaaguugaua

SEQ ID NO: 268690 - RNA, 24 nt, Human
aacaaauacauccaaaaaggguuc

SEQ ID NO: 268691 - RNA, 18 nt, Human
aacaaauacauccaaaac

SEQ ID NO: 268692 - RNA, 18 nt, Human
aacaugaugaaaccccau

SEQ ID NO: 268693 - RNA, 19 nt, Human
aacaugaugaaaccccauc

SEQ ID NO: 268694 - RNA, 22 nt, Human
aacaugaugaaaccccaucccc

SEQ ID NO: 268695 - RNA, 18 nt, Human
aacauggcgaaaccccgc

SEQ ID NO: 268696 - RNA, 20 nt, Human
aacauggcgaaaccccgccu

SEQ ID NO: 268697 - RNA, 21 nt, Human
aacauggcgaaaccccgccuc

SEQ ID NO: 268698 - RNA, 21 nt, Human
aacccaauaaaaaaaauggca

SEQ ID NO: 268699 - RNA, 19 nt, Human
aacugggaaaugacaucug

SEQ ID NO: 268700 - RNA, 18 nt, Human
aagcaacaggccaggcgc

SEQ ID NO: 268701 - RNA, 23 nt, Human
aagcagcagugcuucauaaggac

SEQ ID NO: 268702 - RNA, 21 nt, Human
acaaaagaagauauggacaau

SEQ ID NO: 268703 - RNA, 24 nt, Human
acaaaagaagauauggacaauaua

SEQ ID NO: 268704 - RNA, 20 nt, Human
acaacaguagguauuccaga

SEQ ID NO: 268705 - RNA, 19 nt, Human
acacuccagaacaauagac

SEQ ID NO: 268706 - RNA, 24 nt, Human
acagagcaagacuucaucucaaaa

SEQ ID NO: 268707 - RNA, 24 nt, Human
acagagcgagacccugccucaaaa

SEQ ID NO: 268708 - RNA, 24 nt, Human
acaggccaggcgcaguggcucaca

SEQ ID NO: 268709 - RNA, 28 nt, Human
acaguuaccacacaguacacuccagaac

SEQ ID NO: 268710 - RNA, 20 nt, Human
accacacuugacagcuuugc

SEQ ID NO: 268711 - RNA, 20 nt, Human
accacaguuaccacacagua

SEQ ID NO: 268712 - RNA, 24 nt, Human
accacaguuaccacacaguacacu

SEQ ID NO: 268713 - RNA, 18 nt, Human
acccuguacucuaggcug

SEQ ID NO: 268714 - RNA, 18 nt, Human
acugcacuccagccucgg

SEQ ID NO: 268715 - RNA, 24 nt, Human
acugcacuccagccucggugacag

SEQ ID NO: 268716 - RNA, 26 nt, Human
acugcacuccagccucggugacagag

SEQ ID NO: 268717 - RNA, 18 nt, Human
acugcacuccagccuggg

SEQ ID NO: 268718 - RNA, 19 nt, Human
acugcacuccagccugggc

SEQ ID NO: 268719 - RNA, 21 nt, Human
acugcacuccagccugggcga

SEQ ID NO: 268720 - RNA, 22 nt, Human
acugcacuccagccugggcgac

SEQ ID NO: 268721 - RNA, 24 nt, Human
acugcacuccagccugggcgacag

SEQ ID NO: 268722 - RNA, 26 nt, Human
acugcacuccagccugggcgacagag

SEQ ID NO: 268723 - RNA, 19 nt, Human
acugguccauuucuacaac

SEQ ID NO: 268724 - RNA, 28 nt, Human
acuucaucucaaaaaaaaaaaaaaaaaa

SEQ ID NO: 268725 - RNA, 24 nt, Human
acuugaggucaggaguuugagacc

SEQ ID NO: 268726 - RNA, 18 nt, Human
acuuuguggacugcuuga

SEQ ID NO: 268727 - RNA, 26 nt, Human
agaaaacuucaaaaucucuuucuuaa

SEQ ID NO: 268728 - RNA, 21 nt, Human
agacggagguuacaaugagcc

SEQ ID NO: 268729 - RNA, 24 nt, Human
agacggagguuacaaugagccgag

SEQ ID NO: 268730 - RNA, 26 nt, Human
agacggguggaucacuugaggucagg

SEQ ID NO: 268731 - RNA, 25 nt, Human
agacuccaccaaaaagagcucacaa

SEQ ID NO: 268732 - RNA, 20 nt, Human
agaucagggguuggcaaaug

SEQ ID NO: 268733 - RNA, 23 nt, Human
agcagggcaugguggcgcaugcc

SEQ ID NO: 268734 - RNA, 23 nt, Human
agccaggcgugguggcacaugcc

SEQ ID NO: 268735 - RNA, 21 nt, Human
agcccagcagccaaaucaaaa

SEQ ID NO: 268736 - RNA, 24 nt, Human
agccuggccaacaugaugaaaccc

SEQ ID NO: 268737 - RNA, 22 nt, Human
agccugggcaacauggcgaaac

SEQ ID NO: 268738 - RNA, 24 nt, Human
agccugggcaacauggcgaaaccc

SEQ ID NO: 268739 - RNA, 24 nt, Human
agccugggcgacagagcaagacuu

SEQ ID NO: 268740 - RNA, 20 nt, Human
aggaguuugagaccagccug

SEQ ID NO: 268741 - RNA, 22 nt, Human
aggcaagagaaucacuugaacc

SEQ ID NO: 268742 - RNA, 24 nt, Human
aggcaagagaaucacuugaaccug

SEQ ID NO: 268743 - RNA, 24 nt, Human
aggcgcaguggcucacaccuguaa

SEQ ID NO: 268744 - RNA, 22 nt, Human
aggcgugguggcacaugccugc

SEQ ID NO: 268745 - RNA, 23 nt, Human
aggcgugguggcacaugccugca

SEQ ID NO: 268746 - RNA, 24 nt, Human
aggcugaggcaagagaaucacuug

SEQ ID NO: 268747 - RNA, 24 nt, Human
agguugaggcugcagugagccgag

SEQ ID NO: 268748 - RNA, 20 nt, Human
agguugccaguuugcaaccu

SEQ ID NO: 268749 - RNA, 24 nt, Human
aguagcucacaccuguaaucccag

SEQ ID NO: 268750 - RNA, 22 nt, Human
aguccugcuuuccccauugcac

SEQ ID NO: 268751 - RNA, 24 nt, Human
aguggcucacaccuguaaucccag

SEQ ID NO: 268752 - RNA, 21 nt, Human
auaauggcauuagcuccuuuc

SEQ ID NO: 268753 - RNA, 22 nt, Human
aucccagcacucuaggaggcca

SEQ ID NO: 268754 - RNA, 23 nt, Human
aucgcgccacugcacuccagccu

SEQ ID NO: 268755 - RNA, 20 nt, Human
augccugcagucccagccac

SEQ ID NO: 268756 - RNA, 24 nt, Human
auggcacgacugcacuccagccug

SEQ ID NO: 268757 - RNA, 22 nt, Human
auguucuaggugccaagcacug

SEQ ID NO: 268758 - RNA, 22 nt, Human
auucacacacaguacuuccacc

SEQ ID NO: 268759 - RNA, 21 nt, Human
caaaaaaugcaaaaaauagca

SEQ ID NO: 268760 - RNA, 22 nt, Human
caaaaacuacaccacacuugac

SEQ ID NO: 268761 - RNA, 24 nt, Human
caaaaagagcucacaauuugaaag

SEQ ID NO: 268762 - RNA, 22 nt, Human
caaauuagagguugaacaucca

SEQ ID NO: 268763 - RNA, 25 nt, Human
caacaacaaaggauuaauaaucaga

SEQ ID NO: 268764 - RNA, 25 nt, Human
caacacucagcccaacucucaccau

SEQ ID NO: 268765 - RNA, 27 nt, Human
caacccaauaaaaaaaauggcaaaaca

SEQ ID NO: 268766 - RNA, 24 nt, Human
caagacggguggaucacuugaggu

SEQ ID NO: 268767 - RNA, 26 nt, Human
caagacggguggaucacuugagguca

SEQ ID NO: 268768 - RNA, 21 nt, Human
caagacuucaucucaaaaaaa

SEQ ID NO: 268769 - RNA, 19 nt, Human
caauacaucauuaggagau

SEQ ID NO: 268770 - RNA, 24 nt, Human
caauuugaaagcaagccccauuca

SEQ ID NO: 268771 - RNA, 21 nt, Human
cacaauuugaaagcaagcccc

SEQ ID NO: 268772 - RNA, 22 nt, Human
cacacaguacuuccacggcaca

SEQ ID NO: 268773 - RNA, 19 nt, Human
cacaccuguaaucccagca

SEQ ID NO: 268774 - RNA, 24 nt, Human
cacaccuguaaucccagcacuuug

SEQ ID NO: 268775 - RNA, 18 nt, Human
caccuguaaucccagcac

SEQ ID NO: 268776 - RNA, 18 nt, Human
caccuguaaucccagcac

SEQ ID NO: 268777 - RNA, 19 nt, Human
caccuguaaucccagcacu

SEQ ID NO: 268778 - RNA, 20 nt, Human
caccuguaaucccagcacuc

SEQ ID NO: 268779 - RNA, 24 nt, Human
cacuccagccucggugacagagcg

SEQ ID NO: 268780 - RNA, 23 nt, Human
cacuccagccugggcgacagagc

SEQ ID NO: 268781 - RNA, 19 nt, Human
cacugcacuccagccucgg

SEQ ID NO: 268782 - RNA, 19 nt, Human
cacugcacuccagccucgg

SEQ ID NO: 268783 - RNA, 23 nt, Human
cacugcacuccagccucggugac

SEQ ID NO: 268784 - RNA, 24 nt, Human
cacugcacuccagccucggugaca

SEQ ID NO: 268785 - RNA, 25 nt, Human
cacugcacuccagccucggugacag

SEQ ID NO: 268786 - RNA, 21 nt, Human
cacuucccauguuuuccccug

SEQ ID NO: 268787 - RNA, 23 nt, Human
cacuugaggucaggaguuugaga

SEQ ID NO: 268788 - RNA, 21 nt, Human
cagcacucuaggaggccaaga

SEQ ID NO: 268789 - RNA, 19 nt, Human
cagcagugcuucauaagga

SEQ ID NO: 268790 - RNA, 21 nt, Human
cagcagugcuucauaaggacc

SEQ ID NO: 268791 - RNA, 20 nt, Human
cagccaaaucaaaauucugc

SEQ ID NO: 268792 - RNA, 24 nt, Human
cagccaaaucaaaauucugcuuaa

SEQ ID NO: 268793 - RNA, 22 nt, Human
cagccaggcgugguggcacaug

SEQ ID NO: 268794 - RNA, 23 nt, Human
caggcugggcacaguagcucaca

SEQ ID NO: 268795 - RNA, 19 nt, Human
cagguacacagagcauggg

SEQ ID NO: 268796 - RNA, 20 nt, Human
caggugcugaggaaucagaa

SEQ ID NO: 268797 - RNA, 20 nt, Human
caucaucuucuaguccagag

SEQ ID NO: 268798 - RNA, 20 nt, Human
ccacacuugacagcuuugca

SEQ ID NO: 268799 - RNA, 21 nt, Human
ccacuaaaaacacaaaaauca

SEQ ID NO: 268800 - RNA, 20 nt, Human
ccacugcacuccagccucgg

SEQ ID NO: 268801 - RNA, 20 nt, Human
ccacugcacuccagccucgg

SEQ ID NO: 268802 - RNA, 21 nt, Human
ccacugcacuccagccucggu

SEQ ID NO: 268803 - RNA, 24 nt, Human
ccacugcacuccagccucggugac

SEQ ID NO: 268804 - RNA, 22 nt, Human
ccagcccaaagggcagagccaa

SEQ ID NO: 268805 - RNA, 20 nt, Human
ccauugcacuuuaugaaaca

SEQ ID NO: 268806 - RNA, 25 nt, Human
cccaauaaaaaaaauggcaaaacaa

SEQ ID NO: 268807 - RNA, 21 nt, Human
cccauccccacuaaaaacaca

SEQ ID NO: 268808 - RNA, 21 nt, Human
cccgccucuacaaaaaaugca

SEQ ID NO: 268809 - RNA, 25 nt, Human
ccgccucuacaaaaaaugcaaaaag

SEQ ID NO: 268810 - RNA, 24 nt, Human
ccuggccaacaugaugaaacccca

SEQ ID NO: 268811 - RNA, 23 nt, Human
ccugggcaacauggcgaaacccc

SEQ ID NO: 268812 - RNA, 24 nt, Human
ccugggcaacauggcgaaaccccg

SEQ ID NO: 268813 - RNA, 21 nt, Human
ccugggcgacagagcaagacu

SEQ ID NO: 268814 - RNA, 19 nt, Human
ccuuaaagacugaggcgca

SEQ ID NO: 268815 - RNA, 22 nt, Human
ccuuacacuacacauaagaauc

SEQ ID NO: 268816 - RNA, 24 nt, Human
cgacugcacuccagccugggcgac

SEQ ID NO: 268817 - RNA, 26 nt, Human
cgccacugcacuccagccucggugac

SEQ ID NO: 268818 - RNA, 24 nt, Human
cggguggaucacuugaggucagga

SEQ ID NO: 268819 - RNA, 18 nt, Human
cuaaaguacagcuaauau

SEQ ID NO: 268820 - RNA, 22 nt, Human
cuaaggcagccccuaaaacuaa

SEQ ID NO: 268821 - RNA, 18 nt, Human
cucaaaaaaaaaaaaaaa

SEQ ID NO: 268822 - RNA, 18 nt, Human
cucaaaaaaaaaaaaaaa

SEQ ID NO: 268823 - RNA, 23 nt, Human
cucacaaaacccuaugagauuac

SEQ ID NO: 268824 - RNA, 22 nt, Human
cucacaccuguaaucccagcac

SEQ ID NO: 268825 - RNA, 23 nt, Human
cucacaccuguaaucccagcacu

SEQ ID NO: 268826 - RNA, 24 nt, Human
cucacaccuguaaucccagcacuc

SEQ ID NO: 268827 - RNA, 24 nt, Human
cucacaccuguaaucccagcacuu

SEQ ID NO: 268828 - RNA, 19 nt, Human
cugcagguacacagagcag

SEQ ID NO: 268829 - RNA, 22 nt, Human
cugcagugagccgagaucgcgc

SEQ ID NO: 268830 - RNA, 24 nt, Human
cugucuuuuaugucugcugacacc

SEQ ID NO: 268831 - RNA, 18 nt, Human
cuuaagaacucucugacc

SEQ ID NO: 268832 - RNA, 21 nt, Human
cuugaacuucaacucgcaaca

SEQ ID NO: 268833 - RNA, 18 nt, Human
gaaaugugaaaacuagua

SEQ ID NO: 268834 - RNA, 18 nt, Human
gacaacccaauaaaaaaa

SEQ ID NO: 268835 - RNA, 22 nt, Human
gacagcuuugcaaugguuucca

SEQ ID NO: 268836 - RNA, 21 nt, Human
gacccgaccuuacacuacaca

SEQ ID NO: 268837 - RNA, 21 nt, Human
gacggguggaucacuugaggu

SEQ ID NO: 268838 - RNA, 24 nt, Human
gacugcacuccagccugggcgaca

SEQ ID NO: 268839 - RNA, 23 nt, Human
gagaaucacuugaaccugggaga

SEQ ID NO: 268840 - RNA, 20 nt, Human
gagaccagccuggccaacau

SEQ ID NO: 268841 - RNA, 23 nt, Human
gagaucgcgccacugcacuccag

SEQ ID NO: 268842 - RNA, 24 nt, Human
gaggcugcagugagccgagaucgg

SEQ ID NO: 268843 - RNA, 23 nt, Human
gaggugggaggguugcuugagcc

SEQ ID NO: 268844 - RNA, 24 nt, Human
gaggugggaggguugcuugagccc

SEQ ID NO: 268845 - RNA, 22 nt, Human
gauaaucuaaggcagccccuaa

SEQ ID NO: 268846 - RNA, 24 nt, Human
gaucacuugaggucaggaguuuga

SEQ ID NO: 268847 - RNA, 23 nt, Human
gcaagagaaucacuugaaccugg

SEQ ID NO: 268848 - RNA, 24 nt, Human
gcacuccagccucggugacagagc

SEQ ID NO: 268849 - RNA, 24 nt, Human
gcacuccagccugggcgacagagc

SEQ ID NO: 268850 - RNA, 23 nt, Human
gcaugggaggugggaggguugcu

SEQ ID NO: 268851 - RNA, 22 nt, Human
gccaacaugaugaaaccccauc

SEQ ID NO: 268852 - RNA, 24 nt, Human
gcccaggagguugaggcugcagug

SEQ ID NO: 268853 - RNA, 20 nt, Human
gccgagaucgcgccacugca

SEQ ID NO: 268854 - RNA, 18 nt, Human
gcgcaguggcucacaccu

SEQ ID NO: 268855 - RNA, 21 nt, Human
gcugcagugagccgagaucgc

SEQ ID NO: 268856 - RNA, 24 nt, Human
gcuugagcccaggagguugaggcu

SEQ ID NO: 268857 - RNA, 18 nt, Human
ggaggugggaggguugcu

SEQ ID NO: 268858 - RNA, 22 nt, Human
ggaucacuugaggucaggaguu

SEQ ID NO: 268859 - RNA, 19 nt, Human
ggcaaaacaagcccgagca

SEQ ID NO: 268860 - RNA, 22 nt, Human
gggaggguugcuugagcccagg

SEQ ID NO: 268861 - RNA, 24 nt, Human
gggcacaguagcucacaccuguaa

SEQ ID NO: 268862 - RNA, 19 nt, Human
ggucaggaguuugagacca

SEQ ID NO: 268863 - RNA, 24 nt, Human
guaauccagcccaaagggcagagc

SEQ ID NO: 268864 - RNA, 21 nt, Human
guuccagacuagccugggcaa

SEQ ID NO: 268865 - RNA, 21 nt, Human
uaaaaacacaaaaaucagcca

SEQ ID NO: 268866 - RNA, 25 nt, Human
uaaaagacaacccaauaaaaaaaaa

SEQ ID NO: 268867 - RNA, 23 nt, Human
uaaaauaagcaacaggccaggcg

SEQ ID NO: 268868 - RNA, 23 nt, Human
uaaaauaagcaacaggccaggcg

SEQ ID NO: 268869 - RNA, 26 nt, Human
uaaccaaaaacuacaccaaccccggg

SEQ ID NO: 268870 - RNA, 19 nt, Human
uaaccaaaaacuacaccac

SEQ ID NO: 268871 - RNA, 21 nt, Human
uaaggcagccccuaaaacuaa

SEQ ID NO: 268872 - RNA, 18 nt, Human
uaauaucuaccaacaaca

SEQ ID NO: 268873 - RNA, 21 nt, Human
uacacuccagaacaauagacc

SEQ ID NO: 268874 - RNA, 24 nt, Human
uacauagggaaaaaaaaugaaacu

SEQ ID NO: 268875 - RNA, 24 nt, Human
uaccacaaaagaagauauggacaa

SEQ ID NO: 268876 - RNA, 18 nt, Human
uaccacacaguacacucc

SEQ ID NO: 268877 - RNA, 25 nt, Human
uacucaacucugcuauugguaccac

SEQ ID NO: 268878 - RNA, 21 nt, Human
uacuuccacggcacaauacau

SEQ ID NO: 268879 - RNA, 22 nt, Human
uagcucacaccuguaaucccag

SEQ ID NO: 268880 - RNA, 24 nt, Human
uagcucacaccuguaaucccagca

SEQ ID NO: 268881 - RNA, 22 nt, Human
uagcuccuuggaagcaucuccu

SEQ ID NO: 268882 - RNA, 24 nt, Human
uaggaggccaagacggguggauca

SEQ ID NO: 268883 - RNA, 22 nt, Human
uauaaagaauaauugcaggcug

SEQ ID NO: 268884 - RNA, 24 nt, Human
uauacauagggaaaaaaaaugaaa

SEQ ID NO: 268885 - RNA, 21 nt, Human
uaucaagucgcaguccugcuu

SEQ ID NO: 268886 - RNA, 23 nt, Human
ucacgcucuguugccugggcugg

SEQ ID NO: 268887 - RNA, 24 nt, Human
ucacgcucuguugccugggcugga

SEQ ID NO: 268888 - RNA, 18 nt, Human
ucacuugaaccugggaga

SEQ ID NO: 268889 - RNA, 25 nt, Human
ucacuugaaccugggagacggaggu

SEQ ID NO: 268890 - RNA, 19 nt, Human
ucacuugaggucaggaguu

SEQ ID NO: 268891 - RNA, 18 nt, Human
ucagcaagcagcagugcu

SEQ ID NO: 268892 - RNA, 23 nt, Human
ucagccaggcgugguggcacaug

SEQ ID NO: 268893 - RNA, 22 nt, Human
ucaucucaaaaaaaaaaaaaaa

SEQ ID NO: 268894 - RNA, 22 nt, Human
uccaacacucaaacacauagau

SEQ ID NO: 268895 - RNA, 23 nt, Human
uccaacacucaaacacauagauc

SEQ ID NO: 268896 - RNA, 26 nt, Human
uccacggcacaauacaucauuaggag

SEQ ID NO: 268897 - RNA, 23 nt, Human
uccagaauauaaagaauaauugc

SEQ ID NO: 268898 - RNA, 23 nt, Human
uccagccucggugacagagcgag

SEQ ID NO: 268899 - RNA, 24 nt, Human
uccagccucggugacagagcgaga

SEQ ID NO: 268900 - RNA, 24 nt, Human
uccagccugggcgacagagcaaga

SEQ ID NO: 268901 - RNA, 18 nt, Human
uccaucucugagucuucc

SEQ ID NO: 268902 - RNA, 18 nt, Human
ucccagccacuugggagg

SEQ ID NO: 268903 - RNA, 22 nt, Human
ucucugucacgacuacucaacu

SEQ ID NO: 268904 - RNA, 23 nt, Human
ucugccaaaaaaaccuuuucacc

SEQ ID NO: 268905 - RNA, 25 nt, Human
ucugccaaaaaaaccuuuucacccu

SEQ ID NO: 268906 - RNA, 22 nt, Human
ucuguaauaucuaccaacaaca

SEQ ID NO: 268907 - RNA, 21 nt, Human
ucuguaccaggugcugaggaa

SEQ ID NO: 268908 - RNA, 23 nt, Human
ucuuaauuuuuaucauuuaucca

SEQ ID NO: 268909 - RNA, 21 nt, Human
ugaaaaccaaauuaauuuggc

SEQ ID NO: 268910 - RNA, 19 nt, Human
ugaaaccccauccccacua

SEQ ID NO: 268911 - RNA, 22 nt, Human
ugaaaccccauccccacuaaaa

SEQ ID NO: 268912 - RNA, 20 nt, Human
ugacauagauaguugugcuu

SEQ ID NO: 268913 - RNA, 18 nt, Human
ugaccacucucagaaaag

SEQ ID NO: 268914 - RNA, 18 nt, Human
ugagaagauugcuuuugc

SEQ ID NO: 268915 - RNA, 23 nt, Human
ugagaccagccuggccaacauga

SEQ ID NO: 268916 - RNA, 22 nt, Human
ugagacggagucacgcucuguu

SEQ ID NO: 268917 - RNA, 22 nt, Human
ugagcccaggagguugaggcug

SEQ ID NO: 268918 - RNA, 21 nt, Human
ugagccccugcucuguaccag

SEQ ID NO: 268919 - RNA, 22 nt, Human
ugagccgagaucgcgccacugc

SEQ ID NO: 268920 - RNA, 18 nt, Human
ugaggcaagagaaucacu

SEQ ID NO: 268921 - RNA, 20 nt, Human
ugaggcaagagaaucacuug

SEQ ID NO: 268922 - RNA, 24 nt, Human
ugaggcaagagaaucacuugaacc

SEQ ID NO: 268923 - RNA, 24 nt, Human
ugaggcaagagaaucacuugaacc

SEQ ID NO: 268924 - RNA, 18 nt, Human
ugaggucaggaguuugag

SEQ ID NO: 268925 - RNA, 20 nt, Human
ugccaaaaaaaccuuuucac

SEQ ID NO: 268926 - RNA, 20 nt, Human
ugccaucacugacugauaua

SEQ ID NO: 268927 - RNA, 21 nt, Human
ugccaucacugacugauauaa

SEQ ID NO: 268928 - RNA, 22 nt, Human
ugcccccacuacugcuauucac

SEQ ID NO: 268929 - RNA, 23 nt, Human
ugccugcagucccagccacuugg

SEQ ID NO: 268930 - RNA, 24 nt, Human
ugccugcagucccagccacuuggg

SEQ ID NO: 268931 - RNA, 23 nt, Human
ugcuacagaaguucucugcaaaa

SEQ ID NO: 268932 - RNA, 18 nt, Human
ugcugacaccucugauuu

SEQ ID NO: 268933 - RNA, 24 nt, Human
ugcugcagguacacagagcauggg

SEQ ID NO: 268934 - RNA, 24 nt, Human
ugcuguugacagaucuuccaauuu

SEQ ID NO: 268935 - RNA, 24 nt, Human
uggaauccuccaaaauacuaucac

SEQ ID NO: 268936 - RNA, 24 nt, Human
uggacugcuugagcucaggaguuc

SEQ ID NO: 268937 - RNA, 23 nt, Human
uggaucacuugaggucaggaguu

SEQ ID NO: 268938 - RNA, 24 nt, Human
uggaucacuugaggucaggaguuu

SEQ ID NO: 268939 - RNA, 26 nt, Human
uggaucacuugaggucaggaguuuga

SEQ ID NO: 268940 - RNA, 21 nt, Human
uggcaaaacaagcccgagcau

SEQ ID NO: 268941 - RNA, 24 nt, Human
uggcaaauguuuuuguaaagagua

SEQ ID NO: 268942 - RNA, 21 nt, Human
uggcucacaccuguaauccca

SEQ ID NO: 268943 - RNA, 22 nt, Human
uggcucacaccuguaaucccag

SEQ ID NO: 268944 - RNA, 24 nt, Human
uggcucacaccuguaaucccagca

SEQ ID NO: 268945 - RNA, 20 nt, Human
ugggaggcugaggcaagaga

SEQ ID NO: 268946 - RNA, 24 nt, Human
ugggaggcugaggcaagagaauca

SEQ ID NO: 268947 - RNA, 24 nt, Human
ugguggcacaugccugcaguccca

SEQ ID NO: 268948 - RNA, 24 nt, Human
ugguggcgcaugccuguggucuca

SEQ ID NO: 268949 - RNA, 23 nt, Human
uuaaaauaagcaacaggccaggc

SEQ ID NO: 268950 - RNA, 23 nt, Human
uuaaagaucuaaccauugaaaac

SEQ ID NO: 268951 - RNA, 23 nt, Human
uuauccuuaaagacugaggcgca

SEQ ID NO: 268952 - RNA, 24 nt, Human
uucacugguccauuucuacaacaa

SEQ ID NO: 268953 - RNA, 26 nt, Human
uugauacuaaaauucagaacuuuuua

SEQ ID NO: 268954 - RNA, 18 nt, Human
uugcuugagcccaggagg

SEQ ID NO: 268955 - RNA, 24 nt, Human
uugcuugagcccaggagguugagg

SEQ ID NO: 268956 - RNA, 27 nt, Human
uuggcaaauguuuuuguaaggagaagc

SEQ ID NO: 268957 - RNA, 25 nt, Human
uugggaggcugaggcaagagaauca

SEQ ID NO: 268958 - RNA, 23 nt, Human
aaaggagagcugccccugccccu

SEQ ID NO: 268959 - RNA, 20 nt, Human
aagccaauuccagaugaagc

SEQ ID NO: 268960 - RNA, 18 nt, Human
acaccagccugggcaaca

SEQ ID NO: 268961 - RNA, 24 nt, Human
accucgucucuacaaaaaauacaa

SEQ ID NO: 268962 - RNA, 22 nt, Human
acucagaaggcugaaccugcag

SEQ ID NO: 268963 - RNA, 24 nt, Human
acugagcccaggaguuugacacca

SEQ ID NO: 268964 - RNA, 18 nt, Human
acugcacuccagccuggg

SEQ ID NO: 268965 - RNA, 19 nt, Human
acugcacuccagccugggc

SEQ ID NO: 268966 - RNA, 20 nt, Human
acugcacuccagccugggcg

SEQ ID NO: 268967 - RNA, 21 nt, Human
acugcacuccagccugggcgg

SEQ ID NO: 268968 - RNA, 23 nt, Human
acugcacuccagccugggcggua

SEQ ID NO: 268969 - RNA, 24 nt, Human
agacugagacagaaggauugcuug

SEQ ID NO: 268970 - RNA, 22 nt, Human
agagcugccccugccccugccc

SEQ ID NO: 268971 - RNA, 18 nt, Human
agccugggcaacauggug

SEQ ID NO: 268972 - RNA, 23 nt, Human
agccugggcaacauggugggacc

SEQ ID NO: 268973 - RNA, 23 nt, Human
agccugggcaacauggugggacc

SEQ ID NO: 268974 - RNA, 24 nt, Human
agccugggcaacauggugggaccu

SEQ ID NO: 268975 - RNA, 22 nt, Human
agcugccccugccccugccccc

SEQ ID NO: 268976 - RNA, 22 nt, Human
aggaaaguucuagaaaaagucu

SEQ ID NO: 268977 - RNA, 22 nt, Human
aggaagacaugccaaaugucuc

SEQ ID NO: 268978 - RNA, 24 nt, Human
aggcagcucugacguacgcagccc

SEQ ID NO: 268979 - RNA, 22 nt, Human
aggguguuaagccaauuccaga

SEQ ID NO: 268980 - RNA, 24 nt, Human
aguagcucacgccuguaauuccag

SEQ ID NO: 268981 - RNA, 24 nt, Human
agugaaaaagauaauucaaaagga

SEQ ID NO: 268982 - RNA, 24 nt, Human
aucauggcacugcacuccagccug

SEQ ID NO: 268983 - RNA, 19 nt, Human
auugcuugaacucagaagg

SEQ ID NO: 268984 - RNA, 24 nt, Human
caacauggugggaccucgucucua

SEQ ID NO: 268985 - RNA, 23 nt, Human
cacgccuguaauuccagcacuug

SEQ ID NO: 268986 - RNA, 18 nt, Human
cacuccagccugggcggu

SEQ ID NO: 268987 - RNA, 19 nt, Human
cacugcacuccagccuggg

SEQ ID NO: 268988 - RNA, 19 nt, Human
cacugcacuccagccuggg

SEQ ID NO: 268989 - RNA, 20 nt, Human
cacugcacuccagccugggc

SEQ ID NO: 268990 - RNA, 20 nt, Human
cacugcacuccagccugggc

SEQ ID NO: 268991 - RNA, 21 nt, Human
cacugcacuccagccugggcg

SEQ ID NO: 268992 - RNA, 23 nt, Human
cacugcacuccagccugggcggu

SEQ ID NO: 268993 - RNA, 24 nt, Human
cacugcacuccagccugggcggua

SEQ ID NO: 268994 - RNA, 22 nt, Human
cagaaggcugaaccugcaguga

SEQ ID NO: 268995 - RNA, 22 nt, Human
cagcccggcaucgggucuggcg

SEQ ID NO: 268996 - RNA, 22 nt, Human
cagccuccgcuuggcuucuuuc

SEQ ID NO: 268997 - RNA, 21 nt, Human
cagcucugacguacgcagccc

SEQ ID NO: 268998 - RNA, 18 nt, Human
caucgggucuggcgggac

SEQ ID NO: 268999 - RNA, 22 nt, Human
caucugaauauuuugaccacuc

SEQ ID NO: 269000 - RNA, 18 nt, Human
cccaccuaaagccccagc

SEQ ID NO: 269001 - RNA, 18 nt, Human
cccccgcgcuucuccagc

SEQ ID NO: 269002 - RNA, 20 nt, Human
cccccgcgcuucuccagccc

SEQ ID NO: 269003 - RNA, 21 nt, Human
ccccgaagagcuucugucgcc

SEQ ID NO: 269004 - RNA, 19 nt, Human
ccccugcccccgccuaucc

SEQ ID NO: 269005 - RNA, 23 nt, Human
ccccuuggccacugaucccccga

SEQ ID NO: 269006 - RNA, 19 nt, Human
cccgcaagcccuggaugag

SEQ ID NO: 269007 - RNA, 24 nt, Human
ccgaggggccacgggaaggggcgg

SEQ ID NO: 269008 - RNA, 21 nt, Human
ccugggcaacauggugggacc

SEQ ID NO: 269009 - RNA, 23 nt, Human
ccugggcgguaaaagugagaucc

SEQ ID NO: 269010 - RNA, 25 nt, Human
cgaagagcuucugucgccgcucuag

SEQ ID NO: 269011 - RNA, 22 nt, Human
cgccgcucuaggguaaaggaga

SEQ ID NO: 269012 - RNA, 23 nt, Human
cgccuguaauuccagcacuuggg

SEQ ID NO: 269013 - RNA, 20 nt, Human
cggaggccgcgcgcguccgg

SEQ ID NO: 269014 - RNA, 18 nt, Human
cggcccccgcgcuucucc

SEQ ID NO: 269015 - RNA, 24 nt, Human
cgguaaaagugagauccugucucc

SEQ ID NO: 269016 - RNA, 19 nt, Human
cggugucacccccaucgcg

SEQ ID NO: 269017 - RNA, 25 nt, Human
cgguguggcagugcccaccuaaagc

SEQ ID NO: 269018 - RNA, 18 nt, Human
cuaaagccccagcuacug

SEQ ID NO: 269019 - RNA, 18 nt, Human
cuagaaaaagucuaaaua

SEQ ID NO: 269020 - RNA, 24 nt, Human
cucacgccuguaauuccagcacuu

SEQ ID NO: 269021 - RNA, 23 nt, Human
cuccuauauuacaaaauauauug

SEQ ID NO: 269022 - RNA, 18 nt, Human
cugccccugccccugccc

SEQ ID NO: 269023 - RNA, 19 nt, Human
cugccccugccccugcccc

SEQ ID NO: 269024 - RNA, 22 nt, Human
cuggagacuuaaaacaggccuc

SEQ ID NO: 269025 - RNA, 19 nt, Human
cugggagcggcggaggccg

SEQ ID NO: 269026 - RNA, 21 nt, Human
gaaaaagauaauucaaaagga

SEQ ID NO: 269027 - RNA, 18 nt, Human
gacaccagccugggcaac

SEQ ID NO: 269028 - RNA, 20 nt, Human
gagcugccccugccccugcc

SEQ ID NO: 269029 - RNA, 21 nt, Human
gcacugcacuccagccugggc

SEQ ID NO: 269030 - RNA, 24 nt, Human
gcacugcacuccagccugggcggu

SEQ ID NO: 269031 - RNA, 19 nt, Human
gcagccuccgcuuggcuuc

SEQ ID NO: 269032 - RNA, 22 nt, Human
gcccaggaguuugacaccagcc

SEQ ID NO: 269033 - RNA, 24 nt, Human
gcgguaaaagugagauccugucuc

SEQ ID NO: 269034 - RNA, 21 nt, Human
gggacugggagcggcggaggc

SEQ ID NO: 269035 - RNA, 24 nt, Human
gggcacaguagcucacgccuguaa

SEQ ID NO: 269036 - RNA, 22 nt, Human
gggucgcgccugccgggccucc

SEQ ID NO: 269037 - RNA, 21 nt, Human
gggucuggcgggacugggagc

SEQ ID NO: 269038 - RNA, 21 nt, Human
uaaagccccagcuacugagga

SEQ ID NO: 269039 - RNA, 24 nt, Human
uaaggcugggcacaguagcucacg

SEQ ID NO: 269040 - RNA, 21 nt, Human
uagaaaaagucuaaauaaaug

SEQ ID NO: 269041 - RNA, 24 nt, Human
uagcucacgccuguaauuccagca

SEQ ID NO: 269042 - RNA, 22 nt, Human
ucacgccuguaauuccagcacu

SEQ ID NO: 269043 - RNA, 20 nt, Human
ucaucugaauauuuugaccc

SEQ ID NO: 269044 - RNA, 25 nt, Human
uccagccugggcgguaaaagugaga

SEQ ID NO: 269045 - RNA, 23 nt, Human
ugagacagaaggauugcuugaac

SEQ ID NO: 269046 - RNA, 19 nt, Human
ugagauggggggacugacu

SEQ ID NO: 269047 - RNA, 21 nt, Human
ugagauggggggacugacuga

SEQ ID NO: 269048 - RNA, 24 nt, Human
ugagauggggggacugacugagcc

SEQ ID NO: 269049 - RNA, 23 nt, Human
ugagcccaggaguuugacaccag

SEQ ID NO: 269050 - RNA, 19 nt, Human
ugaucuuuuguccucgcac

SEQ ID NO: 269051 - RNA, 19 nt, Human
ugcccaccuaaagccccag

SEQ ID NO: 269052 - RNA, 23 nt, Human
uggcagugcccaccuaaagcccc

SEQ ID NO: 269053 - RNA, 23 nt, Human
uggcgggacugggagcggcggag

SEQ ID NO: 269054 - RNA, 21 nt, Human
uggggagggugagaugggggg

SEQ ID NO: 269055 - RNA, 26 nt, Human
ugucacaauggaaauuuuacaaacac

SEQ ID NO: 269056 - RNA, 18 nt, Human
uguccgcccccuuggcca

SEQ ID NO: 269057 - RNA, 23 nt, Human
uucggaggaauccgccgugcaaa

SEQ ID NO: 269058 - RNA, 26 nt, Human
uuuuuugcuuucauugccauuuuaau

SEQ ID NO: 269059 - RNA, 23 nt, Human
uuuuuuuuuuuuuuuugcuuuca

SEQ ID NO: 269060 - RNA, 23 nt, Human
uuuuuuuuuuuuuuuuuugcuuu

SEQ ID NO: 269061 - RNA, 20 nt, Human
uuuuuuuuuuuuuuuuuugg

SEQ ID NO: 269062 - RNA, 21 nt, Human
aaaauauacccuguaaaccaa

SEQ ID NO: 269063 - RNA, 20 nt, Human
acagcagcaguaauacuggg

SEQ ID NO: 269064 - RNA, 21 nt, Human
acccuguaaaccaacacauca

SEQ ID NO: 269065 - RNA, 23 nt, Human
acucaggggcuccuuccuugguu

SEQ ID NO: 269066 - RNA, 21 nt, Human
agaacgacguguguaaaugac

SEQ ID NO: 269067 - RNA, 23 nt, Human
agaauaccaccacccugcgcaaa

SEQ ID NO: 269068 - RNA, 24 nt, Human
aggcaguggcguggaggugcgugg

SEQ ID NO: 269069 - RNA, 23 nt, Human
aggcggagggagggcgcgggggc

SEQ ID NO: 269070 - RNA, 19 nt, Human
agggagggaggacacagcg

SEQ ID NO: 269071 - RNA, 21 nt, Human
agggagggaggacacagcggg

SEQ ID NO: 269072 - RNA, 27 nt, Human
agguaucaaaaauauacccuguaaacc

SEQ ID NO: 269073 - RNA, 19 nt, Human
agucuguggggaccggaac

SEQ ID NO: 269074 - RNA, 21 nt, Human
agucuguggggaccggaacga

SEQ ID NO: 269075 - RNA, 25 nt, Human
caaaagcacagcagcaguuggagac

SEQ ID NO: 269076 - RNA, 20 nt, Human
caaauggcggccacagaaua

SEQ ID NO: 269077 - RNA, 23 nt, Human
caacacaucauuuacaucugccu

SEQ ID NO: 269078 - RNA, 20 nt, Human
caccgcccgcccccccccgc

SEQ ID NO: 269079 - RNA, 20 nt, Human
cacugggggcuggacagggc

SEQ ID NO: 269080 - RNA, 23 nt, Human
ccaaggaagggagggagggagga

SEQ ID NO: 269081 - RNA, 18 nt, Human
ccagcaaucucguuggcu

SEQ ID NO: 269082 - RNA, 21 nt, Human
ccccaggccgcaccuggcccu

SEQ ID NO: 269083 - RNA, 21 nt, Human
cccccaggccgcaccuggccc

SEQ ID NO: 269084 - RNA, 23 nt, Human
cccccaggccgcaccuggcccuu

SEQ ID NO: 269085 - RNA, 20 nt, Human
ccccggccccuuccccuccc

SEQ ID NO: 269086 - RNA, 22 nt, Human
cccggccccuuccccucccuuc

SEQ ID NO: 269087 - RNA, 20 nt, Human
cccugcgcaaauggcggcca

SEQ ID NO: 269088 - RNA, 20 nt, Human
ccgcccgcccccccccgccc

SEQ ID NO: 269089 - RNA, 23 nt, Human
ccggccccuuccccucccuuccc

SEQ ID NO: 269090 - RNA, 20 nt, Human
ccgugcccccuccccggccc

SEQ ID NO: 269091 - RNA, 25 nt, Human
ccucuugaacgguaagcagagauug

SEQ ID NO: 269092 - RNA, 20 nt, Human
ccugacaccgcccgcccccc

SEQ ID NO: 269093 - RNA, 22 nt, Human
ccuggcccuuuuguccgcccac

SEQ ID NO: 269094 - RNA, 24 nt, Human
ccuguggcucgcugggaccggggc

SEQ ID NO: 269095 - RNA, 21 nt, Human
cgcugggaccugacaccgccc

SEQ ID NO: 269096 - RNA, 23 nt, Human
cguaaaacaucugaauuaauuca

SEQ ID NO: 269097 - RNA, 18 nt, Human
cuccugcagggccguucc

SEQ ID NO: 269098 - RNA, 19 nt, Human
cuggggcagucugugggga

SEQ ID NO: 269099 - RNA, 23 nt, Human
cuucccaccgcugcggcaacgau

SEQ ID NO: 269100 - RNA, 22 nt, Human
cuucccgagcaccagguaaaca

SEQ ID NO: 269101 - RNA, 24 nt, Human
gaaaaaaacaguccaguccucgga

SEQ ID NO: 269102 - RNA, 18 nt, Human
gaagggagggagggagga

SEQ ID NO: 269103 - RNA, 24 nt, Human
gaagggagggagggaggacacagc

SEQ ID NO: 269104 - RNA, 27 nt, Human
gaggcaguggcguggaggucgagucuc

SEQ ID NO: 269105 - RNA, 21 nt, Human
gaggugcguggucauccugcu

SEQ ID NO: 269106 - RNA, 20 nt, Human
gagucuuaguuaaggcuuua

SEQ ID NO: 269107 - RNA, 20 nt, Human
gcccuggccgccugugugug

SEQ ID NO: 269108 - RNA, 19 nt, Human
ggagggagggaggacacag

SEQ ID NO: 269109 - RNA, 21 nt, Human
ggccacagaauacgcaucgaa

SEQ ID NO: 269110 - RNA, 18 nt, Human
gggaccugacaccgcccg

SEQ ID NO: 269111 - RNA, 20 nt, Human
gggaugggaggcggagggag

SEQ ID NO: 269112 - RNA, 22 nt, Human
gguaagcagagaucaaaagcac

SEQ ID NO: 269113 - RNA, 18 nt, Human
gucccuggccgcccuggc

SEQ ID NO: 269114 - RNA, 18 nt, Human
guguguggcugccacacg

SEQ ID NO: 269115 - RNA, 18 nt, Human
uaagcagagaucaaaagc

SEQ ID NO: 269116 - RNA, 19 nt, Human
uacuggguaaguccuuccu

SEQ ID NO: 269117 - RNA, 22 nt, Human
ucaggggcuccuuccuugguug

SEQ ID NO: 269118 - RNA, 20 nt, Human
uccagagcgcuaagcgggau

SEQ ID NO: 269119 - RNA, 24 nt, Human
uccagcaaucucguuggcuggggc

SEQ ID NO: 269120 - RNA, 19 nt, Human
uccccgcccccuugguccu

SEQ ID NO: 269121 - RNA, 21 nt, Human
uccccgcccccuugguccugc

SEQ ID NO: 269122 - RNA, 24 nt, Human
uccccucccuucccgagcaccagg

SEQ ID NO: 269123 - RNA, 19 nt, Human
ucccuggccgcccuggccg

SEQ ID NO: 269124 - RNA, 21 nt, Human
uccuugguugggggagucggc

SEQ ID NO: 269125 - RNA, 19 nt, Human
ucuuaguuaaggcuuuaga

SEQ ID NO: 269126 - RNA, 21 nt, Human
ugaaaaaaacaguccaguccu

SEQ ID NO: 269127 - RNA, 23 nt, Human
ugaacgguaagcagagaucaaaa

SEQ ID NO: 269128 - RNA, 22 nt, Human
ugacgagcaguccccgcccccu

SEQ ID NO: 269129 - RNA, 18 nt, Human
ugacuugguuuccagcaa

SEQ ID NO: 269130 - RNA, 26 nt, Human
ugacuugguuuccagcaaucucgacu

SEQ ID NO: 269131 - RNA, 21 nt, Human
ugcacagggccagcccggggc

SEQ ID NO: 269132 - RNA, 18 nt, Human
uggcguggaggugcgugg

SEQ ID NO: 269133 - RNA, 19 nt, Human
uggcuggggcagucugugg

SEQ ID NO: 269134 - RNA, 22 nt, Human
uggcuggggcagucugugggga

SEQ ID NO: 269135 - RNA, 21 nt, Human
uguguaaaugacagaauacca

SEQ ID NO: 269136 - RNA, 23 nt, Human
uuccuugguugggggagucggca

SEQ ID NO: 269137 - RNA, 23 nt, Human
uuggcuggggcagucugugggga

SEQ ID NO: 269138 - RNA, 21 nt, Human
uugguuccaaaugcauucggg

SEQ ID NO: 269139 - RNA, 19 nt, Human
uugguugggggagucggca

SEQ ID NO: 269140 - RNA, 19 nt, Human
uugguugggggagucggca

SEQ ID NO: 269141 - RNA, 24 nt, Human
uuugguuccaaaugcauucggggg

SEQ ID NO: 269142 - RNA, 18 nt, Human
uuuuuuuuuuuuuuuuug

SEQ ID NO: 269143 - RNA, 22 nt, Human
uuuuuuuuuuuuuuuuuuuggg

SEQ ID NO: 269144 - RNA, 21 nt, Human
aaaaagaauaaaggaaaaaga

SEQ ID NO: 269145 - RNA, 22 nt, Human
aaaaagacaaaaacaaaaauag

SEQ ID NO: 269146 - RNA, 18 nt, Human
aaacaggagcaagaagcu

SEQ ID NO: 269147 - RNA, 22 nt, Human
aaacaggagcaagaagcuucua

SEQ ID NO: 269148 - RNA, 22 nt, Human
aagaagcuucuauuuguaaucc

SEQ ID NO: 269149 - RNA, 19 nt, Human
aaggaaaaagacaaaaaca

SEQ ID NO: 269150 - RNA, 21 nt, Human
acacagggagcuguuuuauuu

SEQ ID NO: 269151 - RNA, 21 nt, Human
acagggcaggaaggaaaaagu

SEQ ID NO: 269152 - RNA, 23 nt, Human
acguggauaaccccugugucucc

SEQ ID NO: 269153 - RNA, 20 nt, Human
acugagcacugugggcugga

SEQ ID NO: 269154 - RNA, 21 nt, Human
acugcugagcuggcaagaaaa

SEQ ID NO: 269155 - RNA, 18 nt, Human
agaaagacagaaggcgaa

SEQ ID NO: 269156 - RNA, 20 nt, Human
agacaaaaacaaaaauagau

SEQ ID NO: 269157 - RNA, 22 nt, Human
agacaaaaacaaaaauagauau

SEQ ID NO: 269158 - RNA, 22 nt, Human
agacagaaggcgaaggagggac

SEQ ID NO: 269159 - RNA, 22 nt, Human
agcacugugggcuggagguggg

SEQ ID NO: 269160 - RNA, 21 nt, Human
agccacccccugccguagcca

SEQ ID NO: 269161 - RNA, 22 nt, Human
aggaaaaagacaaaaacaaaaa

SEQ ID NO: 269162 - RNA, 28 nt, Human
aggaaaaagacaaaaacaaaagggaccc

SEQ ID NO: 269163 - RNA, 18 nt, Human
aggaaggaaaaaguagaa

SEQ ID NO: 269164 - RNA, 18 nt, Human
aggggugggggugaggag

SEQ ID NO: 269165 - RNA, 20 nt, Human
agguccuccucuuucucuac

SEQ ID NO: 269166 - RNA, 25 nt, Human
agguggcuggguacagggguggggg

SEQ ID NO: 269167 - RNA, 19 nt, Human
agugguugugucccagugg

SEQ ID NO: 269168 - RNA, 26 nt, Human
aguuccacucuuuuauguuaauccca

SEQ ID NO: 269169 - RNA, 21 nt, Human
cacgcccacccuaaugugcca

SEQ ID NO: 269170 - RNA, 24 nt, Human
cagaaagacagaaggcgaaggaga

SEQ ID NO: 269171 - RNA, 22 nt, Human
cagaaggcgaaggagaccccga

SEQ ID NO: 269172 - RNA, 18 nt, Human
cagcacgcccacccuaau

SEQ ID NO: 269173 - RNA, 20 nt, Human
cagcacgcccacccuaaugu

SEQ ID NO: 269174 - RNA, 19 nt, Human
cagccccagagccaccccc

SEQ ID NO: 269175 - RNA, 24 nt, Human
caggagcaagaagcuucuauuugu

SEQ ID NO: 269176 - RNA, 23 nt, Human
caggggugggggugaggagcaga

SEQ ID NO: 269177 - RNA, 22 nt, Human
ccagagaugccccuguccucag

SEQ ID NO: 269178 - RNA, 20 nt, Human
ccaucagucaauacccacug

SEQ ID NO: 269179 - RNA, 24 nt, Human
cccacccgcagcacgcccacccua

SEQ ID NO: 269180 - RNA, 22 nt, Human
cccccguucggcuccugucugu

SEQ ID NO: 269181 - RNA, 22 nt, Human
cccccugccguagccaucuugc

SEQ ID NO: 269182 - RNA, 19 nt, Human
ccccugccguagccaucuu

SEQ ID NO: 269183 - RNA, 18 nt, Human
cccugcacaaaccugcua

SEQ ID NO: 269184 - RNA, 24 nt, Human
ccguucggcuccugucuuccucgg

SEQ ID NO: 269185 - RNA, 19 nt, Human
ccucucugcugagcggaag

SEQ ID NO: 269186 - RNA, 20 nt, Human
cgacuucccgggucagcccc

SEQ ID NO: 269187 - RNA, 19 nt, Human
cucucuaggcuaccacuga

SEQ ID NO: 269188 - RNA, 23 nt, Human
cucucugcugagcggaagccccc

SEQ ID NO: 269189 - RNA, 21 nt, Human
cuggguacaggggugggggug

SEQ ID NO: 269190 - RNA, 18 nt, Human
cuucccgggucagcccca

SEQ ID NO: 269191 - RNA, 21 nt, Human
gaagaggaaauggggaagggg

SEQ ID NO: 269192 - RNA, 21 nt, Human
gaagaggaaauggggaagggg

SEQ ID NO: 269193 - RNA, 19 nt, Human
gaaggcgaaggagaccccg

SEQ ID NO: 269194 - RNA, 22 nt, Human
gaagugaacugcugagcuggca

SEQ ID NO: 269195 - RNA, 22 nt, Human
gaggaaauggggaaggggugau

SEQ ID NO: 269196 - RNA, 21 nt, Human
gccccagagccacccccugcc

SEQ ID NO: 269197 - RNA, 18 nt, Human
ggggaaggggugauggga

SEQ ID NO: 269198 - RNA, 19 nt, Human
ggggaaggggugaugggaa

SEQ ID NO: 269199 - RNA, 19 nt, Human
gggugaugggaaaggggag

SEQ ID NO: 269200 - RNA, 21 nt, Human
guaaucccaaaaucuggcaug

SEQ ID NO: 269201 - RNA, 21 nt, Human
gucagccccagagccaccccc

SEQ ID NO: 269202 - RNA, 20 nt, Human
gucccagugggacagaugcu

SEQ ID NO: 269203 - RNA, 24 nt, Human
uaaaaaguacaacugagccggggc

SEQ ID NO: 269204 - RNA, 20 nt, Human
uaaucccaaaaucuggcaug

SEQ ID NO: 269205 - RNA, 20 nt, Human
uagggaguuaaacaggagca

SEQ ID NO: 269206 - RNA, 22 nt, Human
uauaucuuccucuccacugagu

SEQ ID NO: 269207 - RNA, 21 nt, Human
ucagccccagagccacccccu

SEQ ID NO: 269208 - RNA, 18 nt, Human
ucuauuuguaaucccaaa

SEQ ID NO: 269209 - RNA, 25 nt, Human
ucucugcugagcggaagcccccguu

SEQ ID NO: 269210 - RNA, 20 nt, Human
ucugagggccuggagaaagg

SEQ ID NO: 269211 - RNA, 21 nt, Human
ucuguggcccggagccuaaga

SEQ ID NO: 269212 - RNA, 21 nt, Human
ugagacaggcccagggagguu

SEQ ID NO: 269213 - RNA, 23 nt, Human
ugagacaggcccagggagguucc

SEQ ID NO: 269214 - RNA, 21 nt, Human
ugagcuggcaagaaaagcugg

SEQ ID NO: 269215 - RNA, 19 nt, Human
ugaguagagaaggaagagg

SEQ ID NO: 269216 - RNA, 19 nt, Human
ugccaucugagggccugga

SEQ ID NO: 269217 - RNA, 21 nt, Human
ugccccuguccucaggggcuc

SEQ ID NO: 269218 - RNA, 21 nt, Human
uggauaaccccugugucucca

SEQ ID NO: 269219 - RNA, 22 nt, Human
uggcaagaaaagcugggguccu

SEQ ID NO: 269220 - RNA, 23 nt, Human
uggcccggagccuaagagaccgg

SEQ ID NO: 269221 - RNA, 20 nt, Human
uggcuggguacagggguggg

SEQ ID NO: 269222 - RNA, 24 nt, Human
ugggaaggagacaguaggcucagc

SEQ ID NO: 269223 - RNA, 19 nt, Human
uguaguuugacccugacau

SEQ ID NO: 269224 - RNA, 21 nt, Human
ugucucuuuuggauaguucca

SEQ ID NO: 269225 - RNA, 20 nt, Human
uuaggguggguaacuaggga

SEQ ID NO: 269226 - RNA, 25 nt, Human
uuccacucuuuuauguuaaucccaa

SEQ ID NO: 269227 - RNA, 27 nt, Human
acagcccccucccccaggcagugccuu

SEQ ID NO: 269228 - RNA, 21 nt, Human
agccaggaacagcccccuccc

SEQ ID NO: 269229 - RNA, 21 nt, Human
agccggugcaagcccgggggu

SEQ ID NO: 269230 - RNA, 23 nt, Human
agcugggucggagagccuggggc

SEQ ID NO: 269231 - RNA, 23 nt, Human
aguaauggcuucugcgaaaagaa

SEQ ID NO: 269232 - RNA, 18 nt, Human
caaagggugccccauucc

SEQ ID NO: 269233 - RNA, 18 nt, Human
cagccaggaacagccccc

SEQ ID NO: 269234 - RNA, 20 nt, Human
cagcccccucccccaggcaa

SEQ ID NO: 269235 - RNA, 20 nt, Human
caggaacagcccccuccccc

SEQ ID NO: 269236 - RNA, 22 nt, Human
ccaggaacagcccccuccccca

SEQ ID NO: 269237 - RNA, 18 nt, Human
ccccugagcagccggccc

SEQ ID NO: 269238 - RNA, 19 nt, Human
ccccugagcagccggcccc

SEQ ID NO: 269239 - RNA, 21 nt, Human
cccggggguccaaaagggcgg

SEQ ID NO: 269240 - RNA, 24 nt, Human
cugcagccaggaacagcccccucc

SEQ ID NO: 269241 - RNA, 20 nt, Human
cuugugugaaugaaauggca

SEQ ID NO: 269242 - RNA, 19 nt, Human
gaacagcccccucccccag

SEQ ID NO: 269243 - RNA, 19 nt, Human
gagccucgccaccaccccc

SEQ ID NO: 269244 - RNA, 20 nt, Human
gccuggggcuuccccugagc

SEQ ID NO: 269245 - RNA, 25 nt, Human
ggccccacaccgcugcgagugcggu

SEQ ID NO: 269246 - RNA, 18 nt, Human
uagaagaucugucugugu

SEQ ID NO: 269247 - RNA, 21 nt, Human
uagaauucugcagccaggaac

SEQ ID NO: 269248 - RNA, 22 nt, Human
uagaauucugcagccaggaaca

SEQ ID NO: 269249 - RNA, 28 nt, Human
uagaauucugcagccaggaacagccccc

SEQ ID NO: 269250 - RNA, 23 nt, Human
ucgugagagcuagaauucugcag

SEQ ID NO: 269251 - RNA, 19 nt, Human
ucuagaagaucugucugug

SEQ ID NO: 269252 - RNA, 21 nt, Human
ucugcagccaggaacagcccc

SEQ ID NO: 269253 - RNA, 20 nt, Human
ugaaauggcaguuuccaaag

SEQ ID NO: 269254 - RNA, 23 nt, Human
ugggcuucccagcuuugcagccu

SEQ ID NO: 269255 - RNA, 21 nt, Human
uuccccugagcagccggcccc

SEQ ID NO: 269256 - RNA, 22 nt, Human
uucccucggcucuagaagaucu

SEQ ID NO: 269257 - RNA, 21 nt, Human
aaagacaauagaacuauaaac

SEQ ID NO: 269258 - RNA, 22 nt, Human
acaauaguacccaaaugaauac

SEQ ID NO: 269259 - RNA, 24 nt, Human
agagaauugucucauucccaacca

SEQ ID NO: 269260 - RNA, 27 nt, Human
agcacaaaagcgaaagcaccaaccaag

SEQ ID NO: 269261 - RNA, 21 nt, Human
agggccuugacuuuucuuggu

SEQ ID NO: 269262 - RNA, 22 nt, Human
caaaagcgaaagcaccaaccaa

SEQ ID NO: 269263 - RNA, 18 nt, Human
cacccccacccuuccaca

SEQ ID NO: 269264 - RNA, 21 nt, Human
caggagcagucuaccccaaca

SEQ ID NO: 269265 - RNA, 21 nt, Human
cauacauccuaaauacuacac

SEQ ID NO: 269266 - RNA, 18 nt, Human
cccacccccacccuucca

SEQ ID NO: 269267 - RNA, 24 nt, Human
cccacccccacccuuccacagccc

SEQ ID NO: 269268 - RNA, 20 nt, Human
ccuuccacagcccuggugag

SEQ ID NO: 269269 - RNA, 23 nt, Human
ccuuccacagcccuggugagggu

SEQ ID NO: 269270 - RNA, 22 nt, Human
cuaaauacuacacaauaguacc

SEQ ID NO: 269271 - RNA, 22 nt, Human
cucacacugagaccaguccagu

SEQ ID NO: 269272 - RNA, 21 nt, Human
cucauucccaaccauacugcu

SEQ ID NO: 269273 - RNA, 18 nt, Human
cucccuccgcggauuccu

SEQ ID NO: 269274 - RNA, 22 nt, Human
cugaauacuauaaugacccacc

SEQ ID NO: 269275 - RNA, 22 nt, Human
cugguacaaaaauccaagaaag

SEQ ID NO: 269276 - RNA, 19 nt, Human
gaaacuuucucaauguauu

SEQ ID NO: 269277 - RNA, 18 nt, Human
guaaagugugccaagugc

SEQ ID NO: 269278 - RNA, 27 nt, Human
uaaauacuacacaauaguacccaaaug

SEQ ID NO: 269279 - RNA, 22 nt, Human
uacacaauaguacccaaaugaa

SEQ ID NO: 269280 - RNA, 25 nt, Human
uacauauaaacaaacaugcauacag

SEQ ID NO: 269281 - RNA, 19 nt, Human
uagcacaaaagcgaaagca

SEQ ID NO: 269282 - RNA, 23 nt, Human
uaggaguaaucaugaguagcgau

SEQ ID NO: 269283 - RNA, 21 nt, Human
uauaaaagaauaagauggaaa

SEQ ID NO: 269284 - RNA, 24 nt, Human
uauaaugacccacccccacccuuc

SEQ ID NO: 269285 - RNA, 21 nt, Human
ucccauauaaaagaauaagau

SEQ ID NO: 269286 - RNA, 27 nt, Human
ucccauauaaaagaauaagauggaaac

SEQ ID NO: 269287 - RNA, 18 nt, Human
ucuggcaagggcagggcc

SEQ ID NO: 269288 - RNA, 18 nt, Human
ugcaggagcagucuaccc

SEQ ID NO: 269289 - RNA, 25 nt, Human
ugugccaagugcucacacugagacc

SEQ ID NO: 269290 - RNA, 18 nt, Human
uguuuaguaaagugugcc

SEQ ID NO: 269291 - RNA, 20 nt, Human
uuaaaaguuacacgugaaua

SEQ ID NO: 269292 - RNA, 21 nt, Human
uucccaaccauacugcuuugu

SEQ ID NO: 269293 - RNA, 20 nt, Human
uucccauaugaugugauuac

SEQ ID NO: 269294 - RNA, 18 nt, Human
uugcuggugacuucuucc

SEQ ID NO: 269295 - RNA, 18 nt, Human
uuucuugguuaggccggc

SEQ ID NO: 269296 - RNA, 18 nt, Human
uuuguuaaaaugauaaag

SEQ ID NO: 269297 - RNA, 27 nt, Human
aaaaaaaacaucaacaauaacagaaga

SEQ ID NO: 269298 - RNA, 20 nt, Human
aaaaacaucaacaauaacag

SEQ ID NO: 269299 - RNA, 19 nt, Human
aacaagcauguagagucuu

SEQ ID NO: 269300 - RNA, 24 nt, Human
aaccuuuagcagcaauggcaaccu

SEQ ID NO: 269301 - RNA, 23 nt, Human
aagaacagcagagggaggcagag

SEQ ID NO: 269302 - RNA, 27 nt, Human
aagaacagcagagggaggccgguaccc

SEQ ID NO: 269303 - RNA, 27 nt, Human
aagcuauagcacacccacaaauagauu

SEQ ID NO: 269304 - RNA, 23 nt, Human
aauaacagaagaugucccaggaa

SEQ ID NO: 269305 - RNA, 18 nt, Human
acacgcuuguguaugagg

SEQ ID NO: 269306 - RNA, 20 nt, Human
acgcuaaagcuauagcacac

SEQ ID NO: 269307 - RNA, 24 nt, Human
agaacagcagagggaggcagagga

SEQ ID NO: 269308 - RNA, 20 nt, Human
agcuauagcacacccacaaa

SEQ ID NO: 269309 - RNA, 23 nt, Human
aggaccaaaacacauuugaacca

SEQ ID NO: 269310 - RNA, 21 nt, Human
auaacagaagaugucccagga

SEQ ID NO: 269311 - RNA, 21 nt, Human
caauaacagaagaugucccag

SEQ ID NO: 269312 - RNA, 22 nt, Human
cagcaauggcaaccuuagacca

SEQ ID NO: 269313 - RNA, 23 nt, Human
cagcaauggcaaccuuagaccaa

SEQ ID NO: 269314 - RNA, 18 nt, Human
cagcagagggaggcagag

SEQ ID NO: 269315 - RNA, 19 nt, Human
cagucuuucccuggcuggu

SEQ ID NO: 269316 - RNA, 22 nt, Human
ccaaaagaaauuguaccagaga

SEQ ID NO: 269317 - RNA, 24 nt, Human
ccaaaagaaauuguaccagagaaa

SEQ ID NO: 269318 - RNA, 18 nt, Human
cccagcgugcaccaaaca

SEQ ID NO: 269319 - RNA, 20 nt, Human
ccuaggauccagucccguuc

SEQ ID NO: 269320 - RNA, 23 nt, Human
ccuccaggaccaaaacacauuug

SEQ ID NO: 269321 - RNA, 27 nt, Human
cguucagaagacaagccaggccaccau

SEQ ID NO: 269322 - RNA, 19 nt, Human
cuaaagcuauagcacaccc

SEQ ID NO: 269323 - RNA, 24 nt, Human
cuacaguugucccauccagaagcc

SEQ ID NO: 269324 - RNA, 21 nt, Human
cucaaaauuugagccuccagg

SEQ ID NO: 269325 - RNA, 21 nt, Human
cuccuaggauccagucccguu

SEQ ID NO: 269326 - RNA, 23 nt, Human
cugaauuguuggaaacccaaaca

SEQ ID NO: 269327 - RNA, 18 nt, Human
cugagagcuagaaagagg

SEQ ID NO: 269328 - RNA, 19 nt, Human
cugcucccuuacaaaauuu

SEQ ID NO: 269329 - RNA, 25 nt, Human
cuggaguuuugucuuacucuuugca

SEQ ID NO: 269330 - RNA, 19 nt, Human
cuuagaccaaaaugacaag

SEQ ID NO: 269331 - RNA, 26 nt, Human
gaaacccaaacagcauugagagccaa

SEQ ID NO: 269332 - RNA, 19 nt, Human
gacacgcuuguguaugagg

SEQ ID NO: 269333 - RNA, 23 nt, Human
gcacagcuuaggggaacgcaggg

SEQ ID NO: 269334 - RNA, 19 nt, Human
gcuccuuucuucucagacu

SEQ ID NO: 269335 - RNA, 26 nt, Human
ggaaacccaaacagcauugagagcca

SEQ ID NO: 269336 - RNA, 21 nt, Human
ggacaaguggauauuagagaa

SEQ ID NO: 269337 - RNA, 21 nt, Human
ggagaugggaacugcaaagaa

SEQ ID NO: 269338 - RNA, 21 nt, Human
gggcaggaucgggcugaagcu

SEQ ID NO: 269339 - RNA, 24 nt, Human
gggcaggaucgggcugaagcuuuc

SEQ ID NO: 269340 - RNA, 28 nt, Human
uaaaaaaaaacaucaacaauaacagaag

SEQ ID NO: 269341 - RNA, 22 nt, Human
uaaagcuauagcacacccacaa

SEQ ID NO: 269342 - RNA, 22 nt, Human
uaacucuuuucuugccagucuu

SEQ ID NO: 269343 - RNA, 21 nt, Human
uagaagaacagcagagggagg

SEQ ID NO: 269344 - RNA, 28 nt, Human
uagcagcaauggcaaccuuagaccaaaa

SEQ ID NO: 269345 - RNA, 24 nt, Human
uaggauccagucccguucaaggaa

SEQ ID NO: 269346 - RNA, 19 nt, Human
uauuacuagaauaugcaga

SEQ ID NO: 269347 - RNA, 24 nt, Human
ucaacaauaacagaagauguccca

SEQ ID NO: 269348 - RNA, 20 nt, Human
ucaguucgcuggcugugagu

SEQ ID NO: 269349 - RNA, 21 nt, Human
uccaaaguaaauucuucccca

SEQ ID NO: 269350 - RNA, 22 nt, Human
uccagcaucacauaaaagaauc

SEQ ID NO: 269351 - RNA, 19 nt, Human
ugacacgcuaaagcuauag

SEQ ID NO: 269352 - RNA, 22 nt, Human
ugagagccaagggggaaaaugc

SEQ ID NO: 269353 - RNA, 21 nt, Human
ugcaagucuuuaaaagucugc

SEQ ID NO: 269354 - RNA, 18 nt, Human
ugccagucuuucccuggc

SEQ ID NO: 269355 - RNA, 18 nt, Human
ugccagucuuucccuggc

SEQ ID NO: 269356 - RNA, 22 nt, Human
ugccagucuuucccuggcuggu

SEQ ID NO: 269357 - RNA, 21 nt, Human
ugccugaaucugaaaaugaac

SEQ ID NO: 269358 - RNA, 22 nt, Human
ugcugcacagcuuaggggaacg

SEQ ID NO: 269359 - RNA, 24 nt, Human
uggaaacccaaacagcauugagag

SEQ ID NO: 269360 - RNA, 19 nt, Human
uggaaauggcuucaccucc

SEQ ID NO: 269361 - RNA, 23 nt, Human
ugggaauaacucaaaauuugagc

SEQ ID NO: 269362 - RNA, 24 nt, Human
uguagagucuuuauuacuagaaua

SEQ ID NO: 269363 - RNA, 19 nt, Human
ugucaacaagcauguagag

SEQ ID NO: 269364 - RNA, 27 nt, Human
ugucaagaguuccagcaucacauaaaa

SEQ ID NO: 269365 - RNA, 22 nt, Human
uguuaguuauuuuaaugucagu

SEQ ID NO: 269366 - RNA, 18 nt, Human
uucccacuaaugcugaau

SEQ ID NO: 269367 - RNA, 18 nt, Human
uuuaugcugcuuuuacuu

SEQ ID NO: 269368 - RNA, 24 nt, Human
uuucugguugucauuguccuuuau

SEQ ID NO: 269369 - RNA, 20 nt, Human
uuuucccacuaaugcugaau

SEQ ID NO: 269370 - RNA, 22 nt, Human
uuuuuauuucaaaacgugggaa

SEQ ID NO: 269371 - RNA, 20 nt, Human
uuuuuuuuuuuuuuuuuugg

SEQ ID NO: 269372 - RNA, 20 nt, Human
aaaaugaaaaguacaaggca

SEQ ID NO: 269373 - RNA, 19 nt, Human
aaagcagaacuaaagccuu

SEQ ID NO: 269374 - RNA, 22 nt, Human
aaauaucucauuaagaaacucc

SEQ ID NO: 269375 - RNA, 20 nt, Human
aacacaacaacaaggaaucc

SEQ ID NO: 269376 - RNA, 22 nt, Human
aacacaacaacaaggaaucccu

SEQ ID NO: 269377 - RNA, 24 nt, Human
aacacaacaacaaggaaucccuua

SEQ ID NO: 269378 - RNA, 22 nt, Human
aaccaagcugggauccacagaa

SEQ ID NO: 269379 - RNA, 23 nt, Human
aacugcacuggaucucaacacaa

SEQ ID NO: 269380 - RNA, 24 nt, Human
aagauugaaaacuggauuuaagcc

SEQ ID NO: 269381 - RNA, 21 nt, Human
aagcaggagagggaaggaaag

SEQ ID NO: 269382 - RNA, 28 nt, Human
aagcaggagagggaaggaaaggggaccc

SEQ ID NO: 269383 - RNA, 23 nt, Human
aagcuuguuugcuucugcauuca

SEQ ID NO: 269384 - RNA, 20 nt, Human
aaucccaccuuuucccccuu

SEQ ID NO: 269385 - RNA, 21 nt, Human
accccgacaagagcaaagagu

SEQ ID NO: 269386 - RNA, 19 nt, Human
accucauuugucuccacca

SEQ ID NO: 269387 - RNA, 22 nt, Human
acuaaagccuucaaaaaccaug

SEQ ID NO: 269388 - RNA, 21 nt, Human
agaaagcagaacuaaagccuu

SEQ ID NO: 269389 - RNA, 21 nt, Human
agcugucgaagauugaaaacu

SEQ ID NO: 269390 - RNA, 18 nt, Human
aggaaacgggaagugggc

SEQ ID NO: 269391 - RNA, 24 nt, Human
aggaaucccuuacaucgaguaacc

SEQ ID NO: 269392 - RNA, 19 nt, Human
aggagaggcagaaagcaga

SEQ ID NO: 269393 - RNA, 22 nt, Human
aggcagaaagcagaacuaaagc

SEQ ID NO: 269394 - RNA, 20 nt, Human
aggcagggggcgaaaagggg

SEQ ID NO: 269395 - RNA, 21 nt, Human
aggcagggggcgaaaaggggc

SEQ ID NO: 269396 - RNA, 19 nt, Human
aggcaguaguacaggaacc

SEQ ID NO: 269397 - RNA, 19 nt, Human
aggcgcaguauggcaggca

SEQ ID NO: 269398 - RNA, 21 nt, Human
aggggugggagguuggggcug

SEQ ID NO: 269399 - RNA, 18 nt, Human
aguacaggaaccuggcag

SEQ ID NO: 269400 - RNA, 24 nt, Human
aucccaccuuuucccccuuccugu

SEQ ID NO: 269401 - RNA, 22 nt, Human
aucucauuaagaaacuccucug

SEQ ID NO: 269402 - RNA, 25 nt, Human
augucacuauuaccccccuccccaa

SEQ ID NO: 269403 - RNA, 23 nt, Human
auuuuugucuguaaagccaggag

SEQ ID NO: 269404 - RNA, 25 nt, Human
caaaauuccuggaaccaagcuggga

SEQ ID NO: 269405 - RNA, 19 nt, Human
cacaauaguuucccauccg

SEQ ID NO: 269406 - RNA, 18 nt, Human
cacagaaaucacaacugc

SEQ ID NO: 269407 - RNA, 18 nt, Human
cacccccaccccagugcu

SEQ ID NO: 269408 - RNA, 19 nt, Human
cacuggaucucaacacaac

SEQ ID NO: 269409 - RNA, 20 nt, Human
cagccaccgcuccccacgug

SEQ ID NO: 269410 - RNA, 18 nt, Human
cagcgccccgcggaagcc

SEQ ID NO: 269411 - RNA, 21 nt, Human
cagcgccccgcggaagccgag

SEQ ID NO: 269412 - RNA, 23 nt, Human
cagcgccccgcggaagccgaggg

SEQ ID NO: 269413 - RNA, 21 nt, Human
cagcuacugaguucacguucc

SEQ ID NO: 269414 - RNA, 24 nt, Human
ccaauuccacccccaccccagugc

SEQ ID NO: 269415 - RNA, 21 nt, Human
ccaccgccaccccgccuuugg

SEQ ID NO: 269416 - RNA, 24 nt, Human
ccaccuuuucccccuuccuguuuu

SEQ ID NO: 269417 - RNA, 21 nt, Human
ccagaaauccucgggucccag

SEQ ID NO: 269418 - RNA, 21 nt, Human
ccagcgccccgcggaagccga

SEQ ID NO: 269419 - RNA, 22 nt, Human
cccaacugcggggucccagaaa

SEQ ID NO: 269420 - RNA, 22 nt, Human
cccacgugaguucccaccccca

SEQ ID NO: 269421 - RNA, 23 nt, Human
cccacgugaguucccacccccac

SEQ ID NO: 269422 - RNA, 20 nt, Human
ccccaauuccacccccaccc

SEQ ID NO: 269423 - RNA, 21 nt, Human
ccccaauuccacccccacccc

SEQ ID NO: 269424 - RNA, 22 nt, Human
ccccagugcuccuacuccggcc

SEQ ID NO: 269425 - RNA, 20 nt, Human
cccccaccccgacaagagca

SEQ ID NO: 269426 - RNA, 23 nt, Human
cccccaccccgacaagagcaaag

SEQ ID NO: 269427 - RNA, 18 nt, Human
cccccuuccuguuuugcc

SEQ ID NO: 269428 - RNA, 22 nt, Human
ccccgcggaagccgagggcgga

SEQ ID NO: 269429 - RNA, 26 nt, Human
ccgcccagaaacgucaguggugcugc

SEQ ID NO: 269430 - RNA, 18 nt, Human
ccgggggcggcagcuggg

SEQ ID NO: 269431 - RNA, 24 nt, Human
cgcccagaaacgucaguggugcug

SEQ ID NO: 269432 - RNA, 21 nt, Human
cgccccgcggaagccgagggc

SEQ ID NO: 269433 - RNA, 18 nt, Human
cggccccugcaaggacac

SEQ ID NO: 269434 - RNA, 19 nt, Human
cgggaagugggcggcuggc

SEQ ID NO: 269435 - RNA, 19 nt, Human
cuccccacgugaguuccca

SEQ ID NO: 269436 - RNA, 24 nt, Human
cucuagccucgacaugaaucccac

SEQ ID NO: 269437 - RNA, 22 nt, Human
cucucacgccaccuggaaggcu

SEQ ID NO: 269438 - RNA, 19 nt, Human
cuggacuacuuccuccucc

SEQ ID NO: 269439 - RNA, 20 nt, Human
cuucaaaaaccaugaugccc

SEQ ID NO: 269440 - RNA, 22 nt, Human
cuucaaaaaccaugaugcccaa

SEQ ID NO: 269441 - RNA, 18 nt, Human
cuuuucccccuuccuguu

SEQ ID NO: 269442 - RNA, 22 nt, Human
cuuuucuacucaaggccaggga

SEQ ID NO: 269443 - RNA, 20 nt, Human
gaauauguauuccagaaucc

SEQ ID NO: 269444 - RNA, 18 nt, Human
gaccucauuugucuccac

SEQ ID NO: 269445 - RNA, 19 nt, Human
gaggauccaagaacgugac

SEQ ID NO: 269446 - RNA, 25 nt, Human
gaggauccaagaacgugaccggguu

SEQ ID NO: 269447 - RNA, 24 nt, Human
gagucauugccucucacgccaccu

SEQ ID NO: 269448 - RNA, 20 nt, Human
gaugcuagaaaaaucaagcu

SEQ ID NO: 269449 - RNA, 19 nt, Human
gcagaaagcagaacuaaag

SEQ ID NO: 269450 - RNA, 21 nt, Human
gccgcacuggccgcccagaaa

SEQ ID NO: 269451 - RNA, 21 nt, Human
ggaauauguauuccagaaucc

SEQ ID NO: 269452 - RNA, 24 nt, Human
ggaaucccuuacaucgaguaaccc

SEQ ID NO: 269453 - RNA, 18 nt, Human
ggagaggcagaaagcaga

SEQ ID NO: 269454 - RNA, 21 nt, Human
ggagagggcacccacguaaua

SEQ ID NO: 269455 - RNA, 18 nt, Human
ggccggggaggagggggc

SEQ ID NO: 269456 - RNA, 19 nt, Human
ggccggggaggagggggcc

SEQ ID NO: 269457 - RNA, 23 nt, Human
gggaagugggcggcuggccuucu

SEQ ID NO: 269458 - RNA, 23 nt, Human
gggccggggaggagggggccacu

SEQ ID NO: 269459 - RNA, 23 nt, Human
ggggaggagggggccacuacaga

SEQ ID NO: 269460 - RNA, 20 nt, Human
ggggugggagguuggggcug

SEQ ID NO: 269461 - RNA, 18 nt, Human
gguuggggcuguggagga

SEQ ID NO: 269462 - RNA, 20 nt, Human
guaauagaccucauuugucu

SEQ ID NO: 269463 - RNA, 23 nt, Human
gucccugcugucaccugccuaac

SEQ ID NO: 269464 - RNA, 18 nt, Human
gucucugagggaggggag

SEQ ID NO: 269465 - RNA, 24 nt, Human
uaaccccaauuccacccccacccc

SEQ ID NO: 269466 - RNA, 22 nt, Human
uaagaggaugcuagaaaaauca

SEQ ID NO: 269467 - RNA, 22 nt, Human
uaccccccuccccaaaugagaa

SEQ ID NO: 269468 - RNA, 27 nt, Human
uaccccccuccccaaaugagaaaagga

SEQ ID NO: 269469 - RNA, 26 nt, Human
uaugagaaaauccacggugagccaaa

SEQ ID NO: 269470 - RNA, 24 nt, Human
uauuaccccccuccccaaaugaga

SEQ ID NO: 269471 - RNA, 23 nt, Human
ucaguggugcugccccauucggc

SEQ ID NO: 269472 - RNA, 25 nt, Human
ucaguggugcugccccauucggccg

SEQ ID NO: 269473 - RNA, 24 nt, Human
ucaguggugcugccccauucggcg

SEQ ID NO: 269474 - RNA, 23 nt, Human
ucaguuaaagaggaaacgggaag

SEQ ID NO: 269475 - RNA, 21 nt, Human
uccacagaaaucacaacugca

SEQ ID NO: 269476 - RNA, 24 nt, Human
uccacggugagccaaaaugaaaag

SEQ ID NO: 269477 - RNA, 22 nt, Human
uccccgacuuuucuacucaagg

SEQ ID NO: 269478 - RNA, 19 nt, Human
uccuggaaccaagcuggga

SEQ ID NO: 269479 - RNA, 23 nt, Human
ucggcgaaagguuagggagcagg

SEQ ID NO: 269480 - RNA, 21 nt, Human
ucuaaggaaugcaaaacaaau

SEQ ID NO: 269481 - RNA, 18 nt, Human
ucuacucaaggccaggga

SEQ ID NO: 269482 - RNA, 24 nt, Human
ucucacgccaccuggaaggcugga

SEQ ID NO: 269483 - RNA, 19 nt, Human
ucugaggauccaagaacgu

SEQ ID NO: 269484 - RNA, 25 nt, Human
ugaccaaacuuccuaugagaaaauc

SEQ ID NO: 269485 - RNA, 22 nt, Human
ugagaaaaggauuuuguuuccg

SEQ ID NO: 269486 - RNA, 26 nt, Human
ugagaaaaggauuuuguuuccggaaa

SEQ ID NO: 269487 - RNA, 22 nt, Human
ugaggauccaagaacgugaccg

SEQ ID NO: 269488 - RNA, 18 nt, Human
ugagggaggggaggagag

SEQ ID NO: 269489 - RNA, 21 nt, Human
ugagggaggggaggagagugg

SEQ ID NO: 269490 - RNA, 22 nt, Human
ugccccauucggcgaaagguua

SEQ ID NO: 269491 - RNA, 25 nt, Human
ugccccauucggcgaaagguuaggg

SEQ ID NO: 269492 - RNA, 20 nt, Human
ugccgaggcuggcggcccag

SEQ ID NO: 269493 - RNA, 23 nt, Human
ugccucuagccucgacaugaauc

SEQ ID NO: 269494 - RNA, 21 nt, Human
ugcuccuacuccggccccugc

SEQ ID NO: 269495 - RNA, 24 nt, Human
uggaaggcuggacuacuuccuccu

SEQ ID NO: 269496 - RNA, 23 nt, Human
uggaauauguauuccagaauccu

SEQ ID NO: 269497 - RNA, 21 nt, Human
uggcucauguaucaggggugg

SEQ ID NO: 269498 - RNA, 23 nt, Human
ugucacuauuaccccccucccca

SEQ ID NO: 269499 - RNA, 20 nt, Human
uuaauggaagaggaugcgau

SEQ ID NO: 269500 - RNA, 22 nt, Human
uuaauggaagaggaugcgaugc

SEQ ID NO: 269501 - RNA, 23 nt, Human
uuacaucgaguaaccccaauucc

SEQ ID NO: 269502 - RNA, 21 nt, Human
uuaggcgcaguauggcaggca

SEQ ID NO: 269503 - RNA, 21 nt, Human
uucaaaaaccaugaugcccaa

SEQ ID NO: 269504 - RNA, 24 nt, Human
uucaaagcuuucuagaugcaccaa

SEQ ID NO: 269505 - RNA, 22 nt, Human
uucacguuccagcccagcuguc

SEQ ID NO: 269506 - RNA, 20 nt, Human
uuccggaaacuggaucagcu

SEQ ID NO: 269507 - RNA, 20 nt, Human
uucuucaaguuaacuacgua

SEQ ID NO: 269508 - RNA, 19 nt, Human
uuucucagccaccgcuccc

SEQ ID NO: 269509 - RNA, 23 nt, Human
aagcagcccagcccaagcuuagc

SEQ ID NO: 269510 - RNA, 18 nt, Human
aagccccaagcagcccag

SEQ ID NO: 269511 - RNA, 21 nt, Human
aagccccaagcagcccagccc

SEQ ID NO: 269512 - RNA, 22 nt, Human
acacugagcuaccaaaguuagu

SEQ ID NO: 269513 - RNA, 22 nt, Human
agcaaucaaagaucaaggucau

SEQ ID NO: 269514 - RNA, 22 nt, Human
agcaccaauccuuccccacacu

SEQ ID NO: 269515 - RNA, 26 nt, Human
agcagaaguugugggagacgggaggg

SEQ ID NO: 269516 - RNA, 21 nt, Human
agccaaacggccccaggcccc

SEQ ID NO: 269517 - RNA, 23 nt, Human
agccccaaauccccuccccuugc

SEQ ID NO: 269518 - RNA, 22 nt, Human
aggggggucagaagccccaggg

SEQ ID NO: 269519 - RNA, 23 nt, Human
agugcagccaaacggccccaggc

SEQ ID NO: 269520 - RNA, 22 nt, Human
aguugugggagacgggagggaa

SEQ ID NO: 269521 - RNA, 25 nt, Human
auggagccccagccccaaauccccu

SEQ ID NO: 269522 - RNA, 19 nt, Human
caacaaccucuuaccccuc

SEQ ID NO: 269523 - RNA, 22 nt, Human
caacaaccucuuaccccucagc

SEQ ID NO: 269524 - RNA, 23 nt, Human
caacuacaacaaccucuuacccc

SEQ ID NO: 269525 - RNA, 19 nt, Human
caagccccaagcagcccag

SEQ ID NO: 269526 - RNA, 19 nt, Human
caagcuuagcucccucccc

SEQ ID NO: 269527 - RNA, 19 nt, Human
cacucuagggcaacaaggg

SEQ ID NO: 269528 - RNA, 21 nt, Human
cacucuagggcaacaagggcc

SEQ ID NO: 269529 - RNA, 23 nt, Human
cacuggauguuuuuaucacaucc

SEQ ID NO: 269530 - RNA, 23 nt, Human
cacuuuagaugcacacugagcua

SEQ ID NO: 269531 - RNA, 19 nt, Human
cagccccaaauccccuccc

SEQ ID NO: 269532 - RNA, 22 nt, Human
caucucuuccaggagcuggggg

SEQ ID NO: 269533 - RNA, 22 nt, Human
ccaaauccccuccccuugcaaa

SEQ ID NO: 269534 - RNA, 25 nt, Human
ccaacucccauuccaacuuccuuuu

SEQ ID NO: 269535 - RNA, 26 nt, Human
ccaacucccauuccaacuuccuuuuu

SEQ ID NO: 269536 - RNA, 21 nt, Human
ccaauccuuccccacacucgu

SEQ ID NO: 269537 - RNA, 24 nt, Human
ccacacucguucacugcccgccaa

SEQ ID NO: 269538 - RNA, 18 nt, Human
cccaaauccccuccccuu

SEQ ID NO: 269539 - RNA, 24 nt, Human
cccaaauccccuccccuugcaaau

SEQ ID NO: 269540 - RNA, 21 nt, Human
ccccaaauccccuccccuugc

SEQ ID NO: 269541 - RNA, 24 nt, Human
ccccaaauccccuccccuugcaaa

SEQ ID NO: 269542 - RNA, 22 nt, Human
ccccaagcagcccagcccaagc

SEQ ID NO: 269543 - RNA, 20 nt, Human
ccccagccccaaauccccuc

SEQ ID NO: 269544 - RNA, 22 nt, Human
ccccagccccaaauccccuccc

SEQ ID NO: 269545 - RNA, 27 nt, Human
cccuaugccaagccccaagcagccccu

SEQ ID NO: 269546 - RNA, 18 nt, Human
cccuccacacauacuaca

SEQ ID NO: 269547 - RNA, 19 nt, Human
cccuccccagucccacuuu

SEQ ID NO: 269548 - RNA, 23 nt, Human
cccucuccaccuuaacaucaaaa

SEQ ID NO: 269549 - RNA, 18 nt, Human
ccuagaucaggacagagg

SEQ ID NO: 269550 - RNA, 19 nt, Human
ccugaggaccacuaaccca

SEQ ID NO: 269551 - RNA, 19 nt, Human
cggccccaggccccuuccu

SEQ ID NO: 269552 - RNA, 22 nt, Human
cucuccaccuuaacaucaaaau

SEQ ID NO: 269553 - RNA, 23 nt, Human
cucuccucucuuugcugcguccc

SEQ ID NO: 269554 - RNA, 21 nt, Human
gacgggagggcacccuccaca

SEQ ID NO: 269555 - RNA, 18 nt, Human
gagacgggagggcacccu

SEQ ID NO: 269556 - RNA, 19 nt, Human
gagcuaccaaaguuagugc

SEQ ID NO: 269557 - RNA, 25 nt, Human
gccccaggccccuuccuguugcccc

SEQ ID NO: 269558 - RNA, 18 nt, Human
ggacagaggaugcauaug

SEQ ID NO: 269559 - RNA, 22 nt, Human
ggagcuggggggaaucacgggu

SEQ ID NO: 269560 - RNA, 23 nt, Human
ggccccaggccccuuccuguugc

SEQ ID NO: 269561 - RNA, 26 nt, Human
gggcacccuccacacauacuacaggg

SEQ ID NO: 269562 - RNA, 21 nt, Human
guucacugcccgccaacuccc

SEQ ID NO: 269563 - RNA, 19 nt, Human
uaacaucaaaaugggggag

SEQ ID NO: 269564 - RNA, 25 nt, Human
uaacccaccagcaagucucccccug

SEQ ID NO: 269565 - RNA, 19 nt, Human
uaccaaaguuagugcagcc

SEQ ID NO: 269566 - RNA, 18 nt, Human
uagacaccuagaucagga

SEQ ID NO: 269567 - RNA, 18 nt, Human
uagcucccuccccagucc

SEQ ID NO: 269568 - RNA, 27 nt, Human
uaugccaagccccaagcagcccagccc

SEQ ID NO: 269569 - RNA, 21 nt, Human
ucacggguuaaaggucaaggu

SEQ ID NO: 269570 - RNA, 25 nt, Human
ucacugcccgccaacucccauucca

SEQ ID NO: 269571 - RNA, 23 nt, Human
uccacacauacuacagggggguc

SEQ ID NO: 269572 - RNA, 22 nt, Human
uccacccuaugccaagccccaa

SEQ ID NO: 269573 - RNA, 20 nt, Human
uccaccuuaacaucaaaaug

SEQ ID NO: 269574 - RNA, 23 nt, Human
uccauacccuucagaguccuaag

SEQ ID NO: 269575 - RNA, 22 nt, Human
uccccacacucguucacugccc

SEQ ID NO: 269576 - RNA, 19 nt, Human
ucccuaagagauauuagga

SEQ ID NO: 269577 - RNA, 19 nt, Human
ugacuuggggucucuccuc

SEQ ID NO: 269578 - RNA, 21 nt, Human
ugaggaccacuaacccaccag

SEQ ID NO: 269579 - RNA, 19 nt, Human
ugaucugcccuuuuucccu

SEQ ID NO: 269580 - RNA, 20 nt, Human
ugccaagccccaagcagccc

SEQ ID NO: 269581 - RNA, 20 nt, Human
uggcugggcuccuauuggcu

SEQ ID NO: 269582 - RNA, 23 nt, Human
ugggggaggaggagaauuuaggg

SEQ ID NO: 269583 - RNA, 24 nt, Human
ugggggaggaggagaauuuagggg

SEQ ID NO: 269584 - RNA, 21 nt, Human
uuuuuuuuuuuuuuuuuccga

SEQ ID NO: 269585 - RNA, 23 nt, Human
uuuuuuuuuuuuuuuuuccgauu

SEQ ID NO: 269586 - RNA, 27 nt, Human
uuuuuuuuuuuuuuuuuuuuuccgggg

SEQ ID NO: 269587 - RNA, 24 nt, Human
aaaaaaaaaaaaaaagacucugag

SEQ ID NO: 269588 - RNA, 25 nt, Human
aaacaaaagagaaugcaguggccua

SEQ ID NO: 269589 - RNA, 24 nt, Human
aaacacagacacgcgugcucgcac

SEQ ID NO: 269590 - RNA, 19 nt, Human
aacauggugaaacuccauc

SEQ ID NO: 269591 - RNA, 20 nt, Human
aacauggugaaacuccaucu

SEQ ID NO: 269592 - RNA, 21 nt, Human
aacauggugaaacuccaucuc

SEQ ID NO: 269593 - RNA, 19 nt, Human
aaggauggacuugcaaugg

SEQ ID NO: 269594 - RNA, 20 nt, Human
aagggggugggcaggcagag

SEQ ID NO: 269595 - RNA, 23 nt, Human
aaguuugcgccauugcacuccag

SEQ ID NO: 269596 - RNA, 18 nt, Human
aauacucucugucuggcu

SEQ ID NO: 269597 - RNA, 24 nt, Human
aaucgcuugaacccagggggcaga

SEQ ID NO: 269598 - RNA, 23 nt, Human
aaugacucaugccuguaauccca

SEQ ID NO: 269599 - RNA, 24 nt, Human
aaugacucaugccuguaaucccag

SEQ ID NO: 269600 - RNA, 23 nt, Human
acacaaacacagacacgcgugcu

SEQ ID NO: 269601 - RNA, 18 nt, Human
acagagucgggaucaaag

SEQ ID NO: 269602 - RNA, 20 nt, Human
acccugagcuuacaucucaa

SEQ ID NO: 269603 - RNA, 24 nt, Human
accugaggucaggaguuugagacc

SEQ ID NO: 269604 - RNA, 19 nt, Human
accuggacagggcuacccc

SEQ ID NO: 269605 - RNA, 18 nt, Human
acuccaucucuacuaaaa

SEQ ID NO: 269606 - RNA, 18 nt, Human
acuuagcuggguauggug

SEQ ID NO: 269607 - RNA, 20 nt, Human
agaaauucauuuggacagaa

SEQ ID NO: 269608 - RNA, 18 nt, Human
agagguugcagugagcca

SEQ ID NO: 269609 - RNA, 20 nt, Human
agagguugcagugagccaag

SEQ ID NO: 269610 - RNA, 24 nt, Human
agagguugcagugagccaaguuug

SEQ ID NO: 269611 - RNA, 20 nt, Human
agauguuggaauguuacagu

SEQ ID NO: 269612 - RNA, 24 nt, Human
agcacuuugggaggcugaggcagg

SEQ ID NO: 269613 - RNA, 20 nt, Human
agcagaggccuggcauuuug

SEQ ID NO: 269614 - RNA, 22 nt, Human
agccuggccaacauggugaaac

SEQ ID NO: 269615 - RNA, 24 nt, Human
agccuggccaacauggugaaacuc

SEQ ID NO: 269616 - RNA, 22 nt, Human
agccuggguaacagcgagacuc

SEQ ID NO: 269617 - RNA, 23 nt, Human
agcuggguaugguggcaggugcc

SEQ ID NO: 269618 - RNA, 20 nt, Human
aggaguuugagaccagccug

SEQ ID NO: 269619 - RNA, 23 nt, Human
aggcaggagaaucgcuugaaccc

SEQ ID NO: 269620 - RNA, 24 nt, Human
aggcaggagaaucgcuugaaccca

SEQ ID NO: 269621 - RNA, 18 nt, Human
aggcagguggaucaccug

SEQ ID NO: 269622 - RNA, 22 nt, Human
aggcagguggaucaccugaggu

SEQ ID NO: 269623 - RNA, 26 nt, Human
aggcagguggaucaccugaggucagg

SEQ ID NO: 269624 - RNA, 20 nt, Human
aggcugaggcaggagaaucg

SEQ ID NO: 269625 - RNA, 24 nt, Human
aggcugaggcaggagaaucgcuug

SEQ ID NO: 269626 - RNA, 21 nt, Human
aggcugaggcagguggaucac

SEQ ID NO: 269627 - RNA, 24 nt, Human
aggcugaggcagguggaucaccug

SEQ ID NO: 269628 - RNA, 18 nt, Human
agggggugggcaggcaga

SEQ ID NO: 269629 - RNA, 18 nt, Human
agggggugggcaggcaga

SEQ ID NO: 269630 - RNA, 22 nt, Human
agguggaucaccugaggucagg

SEQ ID NO: 269631 - RNA, 18 nt, Human
aguuaaagauaguagagg

SEQ ID NO: 269632 - RNA, 20 nt, Human
aucaccugaggucaggaguu

SEQ ID NO: 269633 - RNA, 19 nt, Human
augccuguaaucccagcac

SEQ ID NO: 269634 - RNA, 19 nt, Human
auggaagugguucuugggc

SEQ ID NO: 269635 - RNA, 20 nt, Human
auucccuuaaaaacaccauu

SEQ ID NO: 269636 - RNA, 21 nt, Human
auugcacuccagccuggguaa

SEQ ID NO: 269637 - RNA, 24 nt, Human
caacauggugaaacuccaucucua

SEQ ID NO: 269638 - RNA, 25 nt, Human
cacacaaacacagacacgcgugcuc

SEQ ID NO: 269639 - RNA, 22 nt, Human
cacagaacuaugcacacacaaa

SEQ ID NO: 269640 - RNA, 21 nt, Human
cacagacacgcgugcucgcac

SEQ ID NO: 269641 - RNA, 23 nt, Human
caccugaggucaggaguuugaga

SEQ ID NO: 269642 - RNA, 20 nt, Human
cacuccagccuggguaacag

SEQ ID NO: 269643 - RNA, 20 nt, Human
cacuccagccuggguaacag

SEQ ID NO: 269644 - RNA, 21 nt, Human
cacuccagccuggguaacagc

SEQ ID NO: 269645 - RNA, 21 nt, Human
cacucucugucacagaccuaa

SEQ ID NO: 269646 - RNA, 21 nt, Human
cagaagcacuacaagaaagcg

SEQ ID NO: 269647 - RNA, 21 nt, Human
cagcaauacucucugucuggc

SEQ ID NO: 269648 - RNA, 24 nt, Human
cagcacuuugggaggcugaggcag

SEQ ID NO: 269649 - RNA, 26 nt, Human
cagcacuuugggaggcugaggcaggu

SEQ ID NO: 269650 - RNA, 22 nt, Human
cagcagaauauauuccucccuu

SEQ ID NO: 269651 - RNA, 24 nt, Human
cagcgaugguucaugggcuuccag

SEQ ID NO: 269652 - RNA, 24 nt, Human
cagcuacucgggaggcugaggcag

SEQ ID NO: 269653 - RNA, 24 nt, Human
cagguggaucaccugaggucagga

SEQ ID NO: 269654 - RNA, 21 nt, Human
caguaauuaaaccacauucac

SEQ ID NO: 269655 - RNA, 23 nt, Human
caguagacaugaggcugaaaaca

SEQ ID NO: 269656 - RNA, 20 nt, Human
caugccuguaaucccagcac

SEQ ID NO: 269657 - RNA, 24 nt, Human
caugccuguaaucccagcacuuug

SEQ ID NO: 269658 - RNA, 19 nt, Human
cauugcacuccagccuggg

SEQ ID NO: 269659 - RNA, 21 nt, Human
cauugcacuccagccugggua

SEQ ID NO: 269660 - RNA, 22 nt, Human
cauugcacuccagccuggguaa

SEQ ID NO: 269661 - RNA, 24 nt, Human
cauugcacuccagccuggguaaca

SEQ ID NO: 269662 - RNA, 19 nt, Human
ccaggggaggagcaucugc

SEQ ID NO: 269663 - RNA, 18 nt, Human
ccauugcacuccagccug

SEQ ID NO: 269664 - RNA, 20 nt, Human
ccauugcacuccagccuggg

SEQ ID NO: 269665 - RNA, 21 nt, Human
ccauugcacuccagccugggu

SEQ ID NO: 269666 - RNA, 22 nt, Human
ccauugcacuccagccugggua

SEQ ID NO: 269667 - RNA, 23 nt, Human
ccauugcacuccagccuggguaa

SEQ ID NO: 269668 - RNA, 24 nt, Human
ccauugcacuccagccuggguaac

SEQ ID NO: 269669 - RNA, 21 nt, Human
cccccacccauuucuccccca

SEQ ID NO: 269670 - RNA, 22 nt, Human
cccccacccauuucucccccau

SEQ ID NO: 269671 - RNA, 19 nt, Human
ccccccacccauuucuccc

SEQ ID NO: 269672 - RNA, 22 nt, Human
ccugaggucaggaguuugagac

SEQ ID NO: 269673 - RNA, 23 nt, Human
ccuggccaacauggugaaacucc

SEQ ID NO: 269674 - RNA, 24 nt, Human
ccuggccaacauggugaaacucca

SEQ ID NO: 269675 - RNA, 20 nt, Human
ccuggguaacagcgagacuc

SEQ ID NO: 269676 - RNA, 22 nt, Human
ccuguaaucccagcacuuuggg

SEQ ID NO: 269677 - RNA, 19 nt, Human
ccuguagucucagcuacuc

SEQ ID NO: 269678 - RNA, 21 nt, Human
ccuguagucucagcuacucgg

SEQ ID NO: 269679 - RNA, 26 nt, Human
cgccauugcacuccagccuggguaac

SEQ ID NO: 269680 - RNA, 24 nt, Human
cgcgugcucgcacacacagagucg

SEQ ID NO: 269681 - RNA, 26 nt, Human
cgggaaaaagcuggcaagagaggaua

SEQ ID NO: 269682 - RNA, 24 nt, Human
cuaugcacacacaaacacagacac

SEQ ID NO: 269683 - RNA, 22 nt, Human
cucaagaauaaaucaguaacuc

SEQ ID NO: 269684 - RNA, 21 nt, Human
cucagcagaaagcaaacaguc

SEQ ID NO: 269685 - RNA, 24 nt, Human
cucaugccuguaaucccagcacuu

SEQ ID NO: 269686 - RNA, 21 nt, Human
cucccccaucuacaugcuuuu

SEQ ID NO: 269687 - RNA, 23 nt, Human
cuccccccacccauuucuccccc

SEQ ID NO: 269688 - RNA, 22 nt, Human
cucuauguaacaggcacccuuc

SEQ ID NO: 269689 - RNA, 27 nt, Human
cucugucucaaaaaaaaaaaaaaagac

SEQ ID NO: 269690 - RNA, 23 nt, Human
cuggccaacauggugaaacucca

SEQ ID NO: 269691 - RNA, 23 nt, Human
cugucugaaaagccccuucccaa

SEQ ID NO: 269692 - RNA, 21 nt, Human
cugugcuaagagaguccaguu

SEQ ID NO: 269693 - RNA, 18 nt, Human
cuucugcuacuggucaca

SEQ ID NO: 269694 - RNA, 23 nt, Human
gagaaucgcuugaacccaggggg

SEQ ID NO: 269695 - RNA, 18 nt, Human
gagcacgggaaaaagcug

SEQ ID NO: 269696 - RNA, 18 nt, Human
gagguugcagugagccaa

SEQ ID NO: 269697 - RNA, 24 nt, Human
gaguggucauuugaaggauggacu

SEQ ID NO: 269698 - RNA, 18 nt, Human
gauaacgagaguagagga

SEQ ID NO: 269699 - RNA, 24 nt, Human
gaucaccugaggucaggaguuuga

SEQ ID NO: 269700 - RNA, 19 nt, Human
gauuggcccuuucucuccu

SEQ ID NO: 269701 - RNA, 22 nt, Human
gcaggagaaucgcuugaaccca

SEQ ID NO: 269702 - RNA, 26 nt, Human
gccaaaccucuccccuuucugggaac

SEQ ID NO: 269703 - RNA, 24 nt, Human
gccaacauggugaaacuccaucuc

SEQ ID NO: 269704 - RNA, 19 nt, Human
gccauugcacuccagccug

SEQ ID NO: 269705 - RNA, 24 nt, Human
gccauugcacuccagccuggguaa

SEQ ID NO: 269706 - RNA, 21 nt, Human
gcugcucucuccugaaaucac

SEQ ID NO: 269707 - RNA, 23 nt, Human
ggagcaaugacucaugccuguaa

SEQ ID NO: 269708 - RNA, 22 nt, Human
ggaucaccugaggucaggaguu

SEQ ID NO: 269709 - RNA, 22 nt, Human
ggcaagagaggauauggagaga

SEQ ID NO: 269710 - RNA, 19 nt, Human
ggcagagguugcagugagc

SEQ ID NO: 269711 - RNA, 23 nt, Human
ggcagagguugcagugagccaag

SEQ ID NO: 269712 - RNA, 22 nt, Human
ggccaguuuacuggaugaaaug

SEQ ID NO: 269713 - RNA, 19 nt, Human
ggucaggaguuugagacca

SEQ ID NO: 269714 - RNA, 22 nt, Human
guaacagcgagacucugucuca

SEQ ID NO: 269715 - RNA, 24 nt, Human
guaacagcgagacucugucucaaa

SEQ ID NO: 269716 - RNA, 21 nt, Human
gucucaaaaaaaaaaaaaaag

SEQ ID NO: 269717 - RNA, 24 nt, Human
uaacagcgagacucugucucaaaa

SEQ ID NO: 269718 - RNA, 19 nt, Human
uacccaaccuagaaaucug

SEQ ID NO: 269719 - RNA, 20 nt, Human
uaccuggacagggcuacccc

SEQ ID NO: 269720 - RNA, 19 nt, Human
uagagagagguucaguggc

SEQ ID NO: 269721 - RNA, 21 nt, Human
uauacaaaaaagggggugggc

SEQ ID NO: 269722 - RNA, 23 nt, Human
uaugauuuuccacauuccucaaa

SEQ ID NO: 269723 - RNA, 26 nt, Human
uaugcacacacaaacacagacacgcg

SEQ ID NO: 269724 - RNA, 28 nt, Human
uaugcacacacaaacacagacacgcgug

SEQ ID NO: 269725 - RNA, 21 nt, Human
ucaaaaaaaaaaaaaaagacu

SEQ ID NO: 269726 - RNA, 19 nt, Human
ucaccugaggucaggaguu

SEQ ID NO: 269727 - RNA, 22 nt, Human
ucaugccuguaaucccagcacu

SEQ ID NO: 269728 - RNA, 21 nt, Human
uccagccuggguaacagcgag

SEQ ID NO: 269729 - RNA, 22 nt, Human
uccagccuggguaacagcgaga

SEQ ID NO: 269730 - RNA, 24 nt, Human
ucgggaggcugaggcaggagaauc

SEQ ID NO: 269731 - RNA, 22 nt, Human
ucuccacaauucucucacccuc

SEQ ID NO: 269732 - RNA, 22 nt, Human
ucucuacuaaaaauacauaacu

SEQ ID NO: 269733 - RNA, 18 nt, Human
ucugaaaagccccuuccc

SEQ ID NO: 269734 - RNA, 23 nt, Human
ucugucucaaaaaaaaaaaaaaa

SEQ ID NO: 269735 - RNA, 20 nt, Human
ucuugcuaugugguaguugg

SEQ ID NO: 269736 - RNA, 21 nt, Human
ugaaaacaacuuuaccuggac

SEQ ID NO: 269737 - RNA, 22 nt, Human
ugaaaacaacuuuaccuggaca

SEQ ID NO: 269738 - RNA, 21 nt, Human
ugacucaugccuguaauccca

SEQ ID NO: 269739 - RNA, 24 nt, Human
ugacucaugccuguaaucccagca

SEQ ID NO: 269740 - RNA, 21 nt, Human
ugagaaugcaaaauaaguccc

SEQ ID NO: 269741 - RNA, 23 nt, Human
ugagaccagccuggccaacaugg

SEQ ID NO: 269742 - RNA, 24 nt, Human
ugagaccagccuggccaacauggu

SEQ ID NO: 269743 - RNA, 23 nt, Human
ugaggaauggagacacacucucu

SEQ ID NO: 269744 - RNA, 20 nt, Human
ugaggcaggagaaucgcuug

SEQ ID NO: 269745 - RNA, 24 nt, Human
ugaggcaggagaaucgcuugaacc

SEQ ID NO: 269746 - RNA, 25 nt, Human
ugaggcaggagaaucgcuugaaccc

SEQ ID NO: 269747 - RNA, 20 nt, Human
ugaggcagguggaucaccug

SEQ ID NO: 269748 - RNA, 24 nt, Human
ugaggcagguggaucaccugaggu

SEQ ID NO: 269749 - RNA, 26 nt, Human
ugaggcagguggaucaccugagguca

SEQ ID NO: 269750 - RNA, 18 nt, Human
ugaggucaggaguuugag

SEQ ID NO: 269751 - RNA, 20 nt, Human
ugcaaacaaaagagaaugca

SEQ ID NO: 269752 - RNA, 22 nt, Human
ugcacuccagccuggguaacag

SEQ ID NO: 269753 - RNA, 22 nt, Human
ugcagcuuuauuuaauaaucug

SEQ ID NO: 269754 - RNA, 19 nt, Human
ugccuaauucccuuaaaaa

SEQ ID NO: 269755 - RNA, 23 nt, Human
ugccuguaaucccagcacuuugg

SEQ ID NO: 269756 - RNA, 23 nt, Human
ugccuguaaucccagcacuuugg

SEQ ID NO: 269757 - RNA, 24 nt, Human
ugccuguagucucagcuacucggg

SEQ ID NO: 269758 - RNA, 18 nt, Human
uggaagugguucuugggc

SEQ ID NO: 269759 - RNA, 26 nt, Human
uggaauguuacaguauggcauggaag

SEQ ID NO: 269760 - RNA, 19 nt, Human
uggauauguggaugucugg

SEQ ID NO: 269761 - RNA, 23 nt, Human
uggaucaccugaggucaggaguu

SEQ ID NO: 269762 - RNA, 24 nt, Human
uggaucaccugaggucaggaguuu

SEQ ID NO: 269763 - RNA, 27 nt, Human
uggaucaccugaggucaggaguuugag

SEQ ID NO: 269764 - RNA, 18 nt, Human
uggcaagagaggauaugg

SEQ ID NO: 269765 - RNA, 24 nt, Human
uggccaacauggugaaacuccauc

SEQ ID NO: 269766 - RNA, 18 nt, Human
ugggaggcugaggcaggu

SEQ ID NO: 269767 - RNA, 24 nt, Human
ugggaggcugaggcagguggauca

SEQ ID NO: 269768 - RNA, 21 nt, Human
ugggcaggcagagagaaugau

SEQ ID NO: 269769 - RNA, 24 nt, Human
ugguggcaggugccuguagucuca

SEQ ID NO: 269770 - RNA, 22 nt, Human
uguaaaaagucauacucuggca

SEQ ID NO: 269771 - RNA, 26 nt, Human
uguguaacccugagcuuaccggcgcc

SEQ ID NO: 269772 - RNA, 18 nt, Human
uguuaauggcuguuccuc

SEQ ID NO: 269773 - RNA, 21 nt, Human
uuacuggaugaaauguuauau

SEQ ID NO: 269774 - RNA, 24 nt, Human
uuagcuggguaugguggcaggugc

SEQ ID NO: 269775 - RNA, 23 nt, Human
uuaggccaaaccucuccccuuuc

SEQ ID NO: 269776 - RNA, 19 nt, Human
uuccagcagaauauauucc

SEQ ID NO: 269777 - RNA, 19 nt, Human
uugcagugagccaaguuuc

SEQ ID NO: 269778 - RNA, 22 nt, Human
uugcagugagccaaguuugcgc

SEQ ID NO: 269779 - RNA, 25 nt, Human
uugggaggcugaggcagguggauca

SEQ ID NO: 269780 - RNA, 24 nt, Human
uuugcgccauugcacuccagccug

SEQ ID NO: 269781 - RNA, 22 nt, Human
aacguucagucuggcuguggug

SEQ ID NO: 269782 - RNA, 22 nt, Human
aagugccccagggcgucagggc

SEQ ID NO: 269783 - RNA, 22 nt, Human
agccaggggcgcaguccacagg

SEQ ID NO: 269784 - RNA, 22 nt, Human
agcuccaggcaguggcgugagg

SEQ ID NO: 269785 - RNA, 23 nt, Human
agcuggccccuuggaagagccug

SEQ ID NO: 269786 - RNA, 18 nt, Human
aggcugggaguccucuug

SEQ ID NO: 269787 - RNA, 18 nt, Human
agugagggacagaaaaga

SEQ ID NO: 269788 - RNA, 24 nt, Human
caacaaauucacagagacuuagga

SEQ ID NO: 269789 - RNA, 18 nt, Human
cacaggaggagacacgag

SEQ ID NO: 269790 - RNA, 18 nt, Human
cacccucccauccagccu

SEQ ID NO: 269791 - RNA, 18 nt, Human
cagagcagaagugcccca

SEQ ID NO: 269792 - RNA, 19 nt, Human
cauggcaaacccccgcgug

SEQ ID NO: 269793 - RNA, 22 nt, Human
ccagaggacacuggacaggccc

SEQ ID NO: 269794 - RNA, 24 nt, Human
ccagccccaccagaccuccucaga

SEQ ID NO: 269795 - RNA, 21 nt, Human
ccaggaagcggccuccccagg

SEQ ID NO: 269796 - RNA, 26 nt, Human
ccaggcaguggcgugagguuccucuu

SEQ ID NO: 269797 - RNA, 19 nt, Human
ccaguccuuccucccagcc

SEQ ID NO: 269798 - RNA, 23 nt, Human
ccccgcgugguccugugcagagc

SEQ ID NO: 269799 - RNA, 22 nt, Human
ccccuacagccuggaggacagg

SEQ ID NO: 269800 - RNA, 22 nt, Human
ccgccugggugcucccccagcc

SEQ ID NO: 269801 - RNA, 19 nt, Human
ccggaggcccggccugccc

SEQ ID NO: 269802 - RNA, 23 nt, Human
ccuaccaggaagcggccucccca

SEQ ID NO: 269803 - RNA, 19 nt, Human
ccuaggacugacuccgggg

SEQ ID NO: 269804 - RNA, 19 nt, Human
ccucccauccagccuagga

SEQ ID NO: 269805 - RNA, 20 nt, Human
ccuccgagaccuuggccacc

SEQ ID NO: 269806 - RNA, 23 nt, Human
ccuccgagaccuuggccaccgga

SEQ ID NO: 269807 - RNA, 21 nt, Human
ccuggccuccgagaccuuggc

SEQ ID NO: 269808 - RNA, 20 nt, Human
ccugggugcucccccagccc

SEQ ID NO: 269809 - RNA, 21 nt, Human
ccugggugcucccccagcccc

SEQ ID NO: 269810 - RNA, 20 nt, Human
ccuuccucccagccaggggc

SEQ ID NO: 269811 - RNA, 20 nt, Human
ccuucugggggugcagggca

SEQ ID NO: 269812 - RNA, 21 nt, Human
cgagaaucguccacugaccaa

SEQ ID NO: 269813 - RNA, 18 nt, Human
cggaggcccggccugccc

SEQ ID NO: 269814 - RNA, 18 nt, Human
cggggcuaaggcggagcu

SEQ ID NO: 269815 - RNA, 24 nt, Human
cucccagccaggggcgcaguccac

SEQ ID NO: 269816 - RNA, 22 nt, Human
cucccccagccccaccagaccu

SEQ ID NO: 269817 - RNA, 18 nt, Human
cuccucagagucuugcuc

SEQ ID NO: 269818 - RNA, 22 nt, Human
cucuccuccccuacagccugga

SEQ ID NO: 269819 - RNA, 23 nt, Human
cuugcucauaagugugcagcugc

SEQ ID NO: 269820 - RNA, 21 nt, Human
gaggcugggaguccucuugag

SEQ ID NO: 269821 - RNA, 21 nt, Human
gagggggccacccucccaucc

SEQ ID NO: 269822 - RNA, 19 nt, Human
gcagacccagcggugggug

SEQ ID NO: 269823 - RNA, 18 nt, Human
gcagggcagcaggccaga

SEQ ID NO: 269824 - RNA, 22 nt, Human
gcaguccacaggcuggucacgc

SEQ ID NO: 269825 - RNA, 18 nt, Human
gccacccucccauccagc

SEQ ID NO: 269826 - RNA, 20 nt, Human
gccuccgagaccuuggccac

SEQ ID NO: 269827 - RNA, 18 nt, Human
ggacagaaaagagucucg

SEQ ID NO: 269828 - RNA, 19 nt, Human
ggacaggcccgggggugcu

SEQ ID NO: 269829 - RNA, 25 nt, Human
ggccaggcucuccuccccuacagcc

SEQ ID NO: 269830 - RNA, 21 nt, Human
ggcggaacacagugagggaca

SEQ ID NO: 269831 - RNA, 18 nt, Human
gggaguggaggaucuggg

SEQ ID NO: 269832 - RNA, 22 nt, Human
uaagugugcagcugcccugguc

SEQ ID NO: 269833 - RNA, 20 nt, Human
uaccccaaggccccacacag

SEQ ID NO: 269834 - RNA, 19 nt, Human
ucacaaacguucagucugg

SEQ ID NO: 269835 - RNA, 20 nt, Human
ucagggccuucugggggugc

SEQ ID NO: 269836 - RNA, 21 nt, Human
ucagggccuucugggggugca

SEQ ID NO: 269837 - RNA, 26 nt, Human
uccccuacagccuggaggacagggac

SEQ ID NO: 269838 - RNA, 22 nt, Human
uccuuccuuccuccgcgccccu

SEQ ID NO: 269839 - RNA, 25 nt, Human
ugacgacaggggacagucggcggaa

SEQ ID NO: 269840 - RNA, 22 nt, Human
ugcagggcagcaggccagagga

SEQ ID NO: 269841 - RNA, 24 nt, Human
ugcuugcagauccgccugggugcu

SEQ ID NO: 269842 - RNA, 20 nt, Human
uggaagagccuggcucgaaa

SEQ ID NO: 269843 - RNA, 19 nt, Human
uggacucccuccuaccagg

SEQ ID NO: 269844 - RNA, 20 nt, Human
uggccuccgagaccuuggcc

SEQ ID NO: 269845 - RNA, 19 nt, Human
uggcuaccccaaggcccca

SEQ ID NO: 269846 - RNA, 19 nt, Human
ugggaguggaggaucuggg

SEQ ID NO: 269847 - RNA, 24 nt, Human
ugggcccccaguccuuccucccag

SEQ ID NO: 269848 - RNA, 19 nt, Human
ugggggugcagggcagcag

SEQ ID NO: 269849 - RNA, 22 nt, Human
ugucaccauggcaaacccccgc

SEQ ID NO: 269850 - RNA, 21 nt, Human
uguccagucugucucccccgg

SEQ ID NO: 269851 - RNA, 21 nt, Human
acccucucauuccuccccacc

SEQ ID NO: 269852 - RNA, 19 nt, Human
acccuucccuucucagcca

SEQ ID NO: 269853 - RNA, 20 nt, Human
agguaccuagcacuauuaug

SEQ ID NO: 269854 - RNA, 22 nt, Human
agguagagggggaggggccagg

SEQ ID NO: 269855 - RNA, 23 nt, Human
auagccagguauagaauagauac

SEQ ID NO: 269856 - RNA, 21 nt, Human
ccauagcaaggggucccuccc

SEQ ID NO: 269857 - RNA, 18 nt, Human
ccauagccagguauagaa

SEQ ID NO: 269858 - RNA, 24 nt, Human
ccccuacacccugccuggacccuc

SEQ ID NO: 269859 - RNA, 23 nt, Human
cccugccuggacccucucauucc

SEQ ID NO: 269860 - RNA, 20 nt, Human
cccugcucuggaccugaccc

SEQ ID NO: 269861 - RNA, 18 nt, Human
ccugccuggacccucuca

SEQ ID NO: 269862 - RNA, 21 nt, Human
cuaauacauuccccuacaccc

SEQ ID NO: 269863 - RNA, 21 nt, Human
cuacacccugccuggacccuc

SEQ ID NO: 269864 - RNA, 24 nt, Human
cucucauuccuccccaccucccaa

SEQ ID NO: 269865 - RNA, 18 nt, Human
cuggacccucucauuccu

SEQ ID NO: 269866 - RNA, 20 nt, Human
gaccugacccuuagggaagc

SEQ ID NO: 269867 - RNA, 18 nt, Human
gagguagagggggagggg

SEQ ID NO: 269868 - RNA, 22 nt, Human
gccugggggcuacugagguaga

SEQ ID NO: 269869 - RNA, 22 nt, Human
ggaagccccuuuauuuguccca

SEQ ID NO: 269870 - RNA, 24 nt, Human
ggacccucucauuccuccccaccu

SEQ ID NO: 269871 - RNA, 19 nt, Human
ggaggaagggagggaggaa

SEQ ID NO: 269872 - RNA, 18 nt, Human
gggggaggaagggaggga

SEQ ID NO: 269873 - RNA, 18 nt, Human
ggucccucccaugcaagg

SEQ ID NO: 269874 - RNA, 25 nt, Human
uaauacauuccccuacacccugccu

SEQ ID NO: 269875 - RNA, 27 nt, Human
uacccuucccuucucagccaucucagg

SEQ ID NO: 269876 - RNA, 23 nt, Human
uagaauagauacacugcugcgga

SEQ ID NO: 269877 - RNA, 25 nt, Human
uagaauagauacacugcugcggaug

SEQ ID NO: 269878 - RNA, 18 nt, Human
uagcaaggggucccuccc

SEQ ID NO: 269879 - RNA, 18 nt, Human
uauuaaggacauuucuag

SEQ ID NO: 269880 - RNA, 22 nt, Human
ucauuccuccccaccucccaag

SEQ ID NO: 269881 - RNA, 18 nt, Human
uccuccccaccucccaag

SEQ ID NO: 269882 - RNA, 23 nt, Human
ucuaaucccccuugugggcccug

SEQ ID NO: 269883 - RNA, 21 nt, Human
ucucauuccuccccaccuccc

SEQ ID NO: 269884 - RNA, 23 nt, Human
ucucccauagccagguauagaau

SEQ ID NO: 269885 - RNA, 23 nt, Human
uggacccucucauuccuccccac

SEQ ID NO: 269886 - RNA, 18 nt, Human
uggcuaaaggggccauag

SEQ ID NO: 269887 - RNA, 24 nt, Human
ugucccagaacugugggaaaagga

SEQ ID NO: 269888 - RNA, 21 nt, Human
ugugggcccugcucuggaccu

SEQ ID NO: 269889 - RNA, 19 nt, Human
uuaaggacauuucuagccc

SEQ ID NO: 269890 - RNA, 24 nt, Human
uuaaggacauuucuagcccacagg

SEQ ID NO: 269891 - RNA, 22 nt, Human
auaaacacauuugcaugcuaca

SEQ ID NO: 269892 - RNA, 23 nt, Human
cacuacauaaacacauuugcaug

SEQ ID NO: 269893 - RNA, 22 nt, Human
ccccgcggucgcccgcgaggcg

SEQ ID NO: 269894 - RNA, 21 nt, Human
ccuaggccaaaacccuacuuc

SEQ ID NO: 269895 - RNA, 19 nt, Human
cucuucccagcaagccccg

SEQ ID NO: 269896 - RNA, 27 nt, Human
gccauaacugaguuauuuuuuucauca

SEQ ID NO: 269897 - RNA, 21 nt, Human
gccccguuaccuaggccaaaa

SEQ ID NO: 269898 - RNA, 25 nt, Human
gccccguuaccuaggccaaaacccu

SEQ ID NO: 269899 - RNA, 19 nt, Human
uaccuaggccaaaacccua

SEQ ID NO: 269900 - RNA, 19 nt, Human
uaggccaaaacccuacuuc

SEQ ID NO: 269901 - RNA, 23 nt, Human
ucugccccguuaccuaggccaaa

SEQ ID NO: 269902 - RNA, 21 nt, Human
ucuucccagcaagccccgcgg

SEQ ID NO: 269903 - RNA, 21 nt, Human
ugaaaggugaccuggcuucgc

SEQ ID NO: 269904 - RNA, 23 nt, Human
uggcuucgccucucuucccagca

SEQ ID NO: 269905 - RNA, 20 nt, Human
aaacaaugugcacaaccuga

SEQ ID NO: 269906 - RNA, 21 nt, Human
aaugugcacaaccugaaugac

SEQ ID NO: 269907 - RNA, 20 nt, Human
acagcagaccacuguuuucc

SEQ ID NO: 269908 - RNA, 20 nt, Human
acugugaugcagcuggagca

SEQ ID NO: 269909 - RNA, 25 nt, Human
agaaaaacaaugugcacaaccugaa

SEQ ID NO: 269910 - RNA, 25 nt, Human
cacuuuuauuucuggaagucagaag

SEQ ID NO: 269911 - RNA, 20 nt, Human
cagcagaccacuguuuucca

SEQ ID NO: 269912 - RNA, 22 nt, Human
caggggcugccgagagcuggcc

SEQ ID NO: 269913 - RNA, 20 nt, Human
cauuccaaaacaaagcuaaa

SEQ ID NO: 269914 - RNA, 19 nt, Human
cccccaacuccauuaccua

SEQ ID NO: 269915 - RNA, 22 nt, Human
gcugaaaccacaggggcugccg

SEQ ID NO: 269916 - RNA, 24 nt, Human
gcugaaaccacaggggcugccgag

SEQ ID NO: 269917 - RNA, 22 nt, Human
gcuggagcagaaggcggcccgg

SEQ ID NO: 269918 - RNA, 19 nt, Human
uacuacaggauggauugcu

SEQ ID NO: 269919 - RNA, 18 nt, Human
ucccccaacuccauuacc

SEQ ID NO: 269920 - RNA, 19 nt, Human
ugaaaccacaggggcugcc

SEQ ID NO: 269921 - RNA, 20 nt, Human
ugaaugacacagagcggcac

SEQ ID NO: 269922 - RNA, 18 nt, Human
ugcacaaccugaaugaca

SEQ ID NO: 269923 - RNA, 22 nt, Human
ugcauuauuuacccucccccga

SEQ ID NO: 269924 - RNA, 22 nt, Human
ugccgagagcuggccuuucaca

SEQ ID NO: 269925 - RNA, 19 nt, Human
uucccccaacuccauuacc

SEQ ID NO: 269926 - RNA, 22 nt, Human
uucuggaagucagaagaaaaac

SEQ ID NO: 269927 - RNA, 23 nt, Human
uuugcauuauuuacccucccccg

SEQ ID NO: 269928 - RNA, 21 nt, Human
uuugugagaccccuucuucca

SEQ ID NO: 269929 - RNA, 20 nt, Human
uuuuugugagaccccuucuu

SEQ ID NO: 269930 - RNA, 25 nt, Human
uuuuuuuuuucccauggaaacacuu

SEQ ID NO: 269931 - RNA, 23 nt, Human
agagcccaggcucuggggcuguu

SEQ ID NO: 269932 - RNA, 20 nt, Human
aggagaacacauuuuuuuca

SEQ ID NO: 269933 - RNA, 24 nt, Human
auaggagaacacauuuuuuucaca

SEQ ID NO: 269934 - RNA, 18 nt, Human
cccaggcucuggggcugu

SEQ ID NO: 269935 - RNA, 23 nt, Human
gaggacaagaacacccugagaaa

SEQ ID NO: 269936 - RNA, 23 nt, Human
gaggguagaugaggacaagaaca

SEQ ID NO: 269937 - RNA, 23 nt, Human
gcucuggggcuguugcucuuaau

SEQ ID NO: 269938 - RNA, 22 nt, Human
gcuuuaugaggaauaggagaac

SEQ ID NO: 269939 - RNA, 20 nt, Human
uacuaaguccagcagagccc

SEQ ID NO: 269940 - RNA, 18 nt, Human
uagaugaggacaagaaca

SEQ ID NO: 269941 - RNA, 23 nt, Human
uauauuaagcuacuuugccucag

SEQ ID NO: 269942 - RNA, 21 nt, Human
uauuaagcuacuuugccucag

SEQ ID NO: 269943 - RNA, 19 nt, Human
ugaugaggccagaauaaag

SEQ ID NO: 269944 - RNA, 20 nt, Human
ugccucagugguugcaccau

SEQ ID NO: 269945 - RNA, 21 nt, Human
ugccucagugguugcaccauu

SEQ ID NO: 269946 - RNA, 20 nt, Human
uuuuuuuuuuugaugaggcc

SEQ ID NO: 269947 - RNA, 21 nt, Human
uuuuuuuuuuuugaugaggcc

SEQ ID NO: 269948 - RNA, 22 nt, Human
uuuuuuuuuuuuuuugaugagg

SEQ ID NO: 269949 - RNA, 22 nt, Human
aaaauuucuccaauaaccugua

SEQ ID NO: 269950 - RNA, 23 nt, Human
aacacgcucuuaauauaacagaa

SEQ ID NO: 269951 - RNA, 21 nt, Human
aagaaaacagaguaaauggua

SEQ ID NO: 269952 - RNA, 24 nt, Human
aagcuugccaacuucuuucccuga

SEQ ID NO: 269953 - RNA, 23 nt, Human
aauuuuaucaccagccacuugug

SEQ ID NO: 269954 - RNA, 22 nt, Human
acagaaauaucaucuuugaaac

SEQ ID NO: 269955 - RNA, 19 nt, Human
acucugucacccuggaaac

SEQ ID NO: 269956 - RNA, 18 nt, Human
agcugagguuaaccauaa

SEQ ID NO: 269957 - RNA, 23 nt, Human
caacaaaaggaaaauuucuccaa

SEQ ID NO: 269958 - RNA, 18 nt, Human
caacccuuugggaacaau

SEQ ID NO: 269959 - RNA, 23 nt, Human
caacuugugugaguacuuuauaa

SEQ ID NO: 269960 - RNA, 20 nt, Human
cacaaaugcaacaaaaggaa

SEQ ID NO: 269961 - RNA, 25 nt, Human
cacgggccagaaaacuaacuuccac

SEQ ID NO: 269962 - RNA, 22 nt, Human
cauugaaaaucuguaggaauuu

SEQ ID NO: 269963 - RNA, 19 nt, Human
cccugaacagcauuugucu

SEQ ID NO: 269964 - RNA, 19 nt, Human
cgccacucugucacccugg

SEQ ID NO: 269965 - RNA, 22 nt, Human
cucagaccugcucaaucgacca

SEQ ID NO: 269966 - RNA, 23 nt, Human
cucugucacccuggaaacagcuu

SEQ ID NO: 269967 - RNA, 18 nt, Human
gaaauaucaucuuugaaa

SEQ ID NO: 269968 - RNA, 19 nt, Human
gacuauaagaaaacagagu

SEQ ID NO: 269969 - RNA, 18 nt, Human
gcauuugucuuguuuuga

SEQ ID NO: 269970 - RNA, 18 nt, Human
gccagaaaacuaacuucc

SEQ ID NO: 269971 - RNA, 27 nt, Human
guaccaagucaauuucuuuaacuguac

SEQ ID NO: 269972 - RNA, 24 nt, Human
uaaaauuaagacuauaagaaaaca

SEQ ID NO: 269973 - RNA, 19 nt, Human
uaaaugauguauugaaccc

SEQ ID NO: 269974 - RNA, 22 nt, Human
uaaccuuaagcuugccaacuuc

SEQ ID NO: 269975 - RNA, 24 nt, Human
uaaguaccaagucaauuucuuuaa

SEQ ID NO: 269976 - RNA, 19 nt, Human
uaauuaaggaccuuuccuu

SEQ ID NO: 269977 - RNA, 24 nt, Human
uauaauaaaauuaagacuauaaga

SEQ ID NO: 269978 - RNA, 24 nt, Human
uauaauacaguaacaacaaaauau

SEQ ID NO: 269979 - RNA, 19 nt, Human
uauauuagaaacguacugc

SEQ ID NO: 269980 - RNA, 19 nt, Human
ucaccaauuuuaacagucu

SEQ ID NO: 269981 - RNA, 21 nt, Human
ucacuuuucuugauuacaaaa

SEQ ID NO: 269982 - RNA, 21 nt, Human
uccacaaaugcaacaaaagga

SEQ ID NO: 269983 - RNA, 19 nt, Human
ucccugaacagcauuuguc

SEQ ID NO: 269984 - RNA, 19 nt, Human
ucucagaccugcucaaucg

SEQ ID NO: 269985 - RNA, 24 nt, Human
ugaaacaacuugugugaguacuuu

SEQ ID NO: 269986 - RNA, 21 nt, Human
ugacgcacaacccuuugggaa

SEQ ID NO: 269987 - RNA, 20 nt, Human
ugauuaagaaaauuaaaggc

SEQ ID NO: 269988 - RNA, 24 nt, Human
uuaacagucuccuacauauuuucu

SEQ ID NO: 269989 - RNA, 22 nt, Human
uucaaauauaauacaguaacaa

SEQ ID NO: 269990 - RNA, 21 nt, Human
uucaauaaugacuaaaauaaa

SEQ ID NO: 269991 - RNA, 20 nt, Human
uucacagaaauaucaucuuu

SEQ ID NO: 269992 - RNA, 18 nt, Human
uuuacagaaacucuaccu

SEQ ID NO: 269993 - RNA, 24 nt, Human
uuucuauaucacuuuucuugauua

SEQ ID NO: 269994 - RNA, 19 nt, Human
aacccaaggaaaacuagcc

SEQ ID NO: 269995 - RNA, 19 nt, Human
aagugucuaaucauagggg

SEQ ID NO: 269996 - RNA, 21 nt, Human
aauggaauucuaucacaaagu

SEQ ID NO: 269997 - RNA, 18 nt, Human
acagauggccuccuuccu

SEQ ID NO: 269998 - RNA, 19 nt, Human
acugacaugcaaggcucug

SEQ ID NO: 269999 - RNA, 22 nt, Human
agaacccaaggaaaacuagccc

SEQ ID NO: 270000 - RNA, 24 nt, Human
agagguacaccaggguuuccaaag

SEQ ID NO: 270001 - RNA, 23 nt, Human
agauggccuccuuccuuccuguu

SEQ ID NO: 270002 - RNA, 23 nt, Human
agccuuugcacauccauuuucuu

SEQ ID NO: 270003 - RNA, 21 nt, Human
aggcaaaaagaggcugcagaa

SEQ ID NO: 270004 - RNA, 21 nt, Human
aggcaaaaagaggcugcaggg

SEQ ID NO: 270005 - RNA, 18 nt, Human
aggguuuccaaagacagu

SEQ ID NO: 270006 - RNA, 22 nt, Human
auccauuuucuucagaacccaa

SEQ ID NO: 270007 - RNA, 20 nt, Human
auguguauaccaagguccca

SEQ ID NO: 270008 - RNA, 23 nt, Human
cacugagagguacaccaggguuu

SEQ ID NO: 270009 - RNA, 19 nt, Human
cagcugugcaccuaagcag

SEQ ID NO: 270010 - RNA, 22 nt, Human
caggaagagcuggcuaauuuua

SEQ ID NO: 270011 - RNA, 19 nt, Human
ccuuugcacauccauuuuc

SEQ ID NO: 270012 - RNA, 24 nt, Human
gaaaaauaauucaauccaauuuac

SEQ ID NO: 270013 - RNA, 22 nt, Human
gaacccaaggaaaacuagccca

SEQ ID NO: 270014 - RNA, 18 nt, Human
ggaaagaacaggugaugu

SEQ ID NO: 270015 - RNA, 18 nt, Human
gggaaagaacaggugaug

SEQ ID NO: 270016 - RNA, 20 nt, Human
uaaaauaguaucaacgugca

SEQ ID NO: 270017 - RNA, 21 nt, Human
uacaccaggguuuccaaagac

SEQ ID NO: 270018 - RNA, 23 nt, Human
uacaccaggguuuccaaagacag

SEQ ID NO: 270019 - RNA, 19 nt, Human
uaccaaggucccacuugcu

SEQ ID NO: 270020 - RNA, 21 nt, Human
uagcccaucuugacagcucua

SEQ ID NO: 270021 - RNA, 25 nt, Human
uauugaacagcugugcaccuaagca

SEQ ID NO: 270022 - RNA, 20 nt, Human
ucaagaaaagggaaagaaca

SEQ ID NO: 270023 - RNA, 23 nt, Human
ugacaugcaaggcucugagaaaa

SEQ ID NO: 270024 - RNA, 21 nt, Human
uucucuguguauauugaacag

SEQ ID NO: 270025 - RNA, 24 nt, Human
uugaacagcugugcaccuaagcag

SEQ ID NO: 270026 - RNA, 21 nt, Human
uuucuguucucuguguauauu

SEQ ID NO: 270027 - RNA, 22 nt, Human
uuugaacagauggccuccuucc

SEQ ID NO: 270028 - RNA, 22 nt, Human
uuuuuuuuuuuuuuuuuuucag

SEQ ID NO: 270029 - RNA, 24 nt, Human
aaaacuagaagugauaccugagcu

SEQ ID NO: 270030 - RNA, 19 nt, Human
cccuggaggaaauccaagg

SEQ ID NO: 270031 - RNA, 22 nt, Human
uuaaaguaaaacuagaagugau

SEQ ID NO: 270032 - RNA, 21 nt, Human
uuuuuuuuuuuuuuuuuuugg

SEQ ID NO: 270033 - RNA, 22 nt, Human
agccccgaccccgacgagaagc

SEQ ID NO: 270034 - RNA, 23 nt, Human
agccgcgucgcccccgucuccuu

SEQ ID NO: 270035 - RNA, 22 nt, Human
ccccgaccccgacgagaagccc

SEQ ID NO: 270036 - RNA, 24 nt, Human
gagaagcccucagccgcgucgccc

SEQ ID NO: 270037 - RNA, 18 nt, Human
gagugugggccacggacc

SEQ ID NO: 270038 - RNA, 19 nt, Human
gcugcagccccgaccccga

SEQ ID NO: 270039 - RNA, 19 nt, Human
aaaagacgccaaaaccaag

SEQ ID NO: 270040 - RNA, 18 nt, Human
aaagagaccgccuggcug

SEQ ID NO: 270041 - RNA, 21 nt, Human
accacaugggccgacccaaaa

SEQ ID NO: 270042 - RNA, 19 nt, Human
auccucuaaagagaccgcc

SEQ ID NO: 270043 - RNA, 24 nt, Human
cccaaaagacgccaaaaccaagag

SEQ ID NO: 270044 - RNA, 23 nt, Human
cgacccaaaagacgccaaaacca

SEQ ID NO: 270045 - RNA, 21 nt, Human
gccaaaaccaagagcugcuca

SEQ ID NO: 270046 - RNA, 19 nt, Human
guggaacuguguacaggau

SEQ ID NO: 270047 - RNA, 20 nt, Human
ucaaaccacaugggccgacc

SEQ ID NO: 270048 - RNA, 22 nt, Human
ugcucaaaccacaugggccgac

SEQ ID NO: 270049 - RNA, 27 nt, Human
aacacauacaauuuaaauacaagucca

SEQ ID NO: 270050 - RNA, 19 nt, Human
aagaaugccaaaauguguc

SEQ ID NO: 270051 - RNA, 22 nt, Human
aagaaugccaaaauguguccuc

SEQ ID NO: 270052 - RNA, 18 nt, Human
agacauucgucacuauca

SEQ ID NO: 270053 - RNA, 18 nt, Human
aucagaaucacucuguca

SEQ ID NO: 270054 - RNA, 21 nt, Human
caaagaguaaaacacauacaa

SEQ ID NO: 270055 - RNA, 22 nt, Human
caagaaugccaaaauguguccu

SEQ ID NO: 270056 - RNA, 21 nt, Human
cucucucagcaaagccaaagg

SEQ ID NO: 270057 - RNA, 26 nt, Human
ucacuaucaucugaguccucucucag

SEQ ID NO: 270058 - RNA, 22 nt, Human
ucagcaaagccaaagggucuga

SEQ ID NO: 270059 - RNA, 19 nt, Human
ucaucugaguccucucuca

SEQ ID NO: 270060 - RNA, 18 nt, Human
accuccguccgggucccg

SEQ ID NO: 270061 - RNA, 19 nt, Human
cagcaggggcacccacagc

SEQ ID NO: 270062 - RNA, 22 nt, Human
cagcaggggcacccacagcugc

SEQ ID NO: 270063 - RNA, 20 nt, Human
cagucauacagagccacacc

SEQ ID NO: 270064 - RNA, 18 nt, Human
cauacagagccacacagc

SEQ ID NO: 270065 - RNA, 23 nt, Human
ccacacagcaggggcacccacag

SEQ ID NO: 270066 - RNA, 22 nt, Human
ccuaggucgcccgcuacagagg

SEQ ID NO: 270067 - RNA, 23 nt, Human
cucccggacgcgcugcccuggcc

SEQ ID NO: 270068 - RNA, 24 nt, Human
cuggccucuaccuccguccggguc

SEQ ID NO: 270069 - RNA, 23 nt, Human
ggcggcgggcgcggacuccgcuc

SEQ ID NO: 270070 - RNA, 20 nt, Human
ucauacagagccacacagca

SEQ ID NO: 270071 - RNA, 24 nt, Human
ucccggacgcgcugcccuggccuc

SEQ ID NO: 270072 - RNA, 27 nt, Human
uuuuuuuuuuuuuuucagguugcaggg

SEQ ID NO: 270073 - RNA, 23 nt, Human
uuuuuuuuuuuuuuuuuuucagg

SEQ ID NO: 270074 - RNA, 19 nt, Human
aaacggagguuggucaccu

SEQ ID NO: 270075 - RNA, 22 nt, Human
aaccacuaugaugcuuccaggu

SEQ ID NO: 270076 - RNA, 18 nt, Human
agaaaagagaagggcggg

SEQ ID NO: 270077 - RNA, 23 nt, Human
aggaaagcggagaagccgcuuaa

SEQ ID NO: 270078 - RNA, 22 nt, Human
caaccggaaacggagguugguc

SEQ ID NO: 270079 - RNA, 20 nt, Human
caaccggagccaaccggaaa

SEQ ID NO: 270080 - RNA, 21 nt, Human
cacggcaggaaagcggagaag

SEQ ID NO: 270081 - RNA, 25 nt, Human
ccaaccggaaacggagguuggucac

SEQ ID NO: 270082 - RNA, 19 nt, Human
ccucucaggacacucaacu

SEQ ID NO: 270083 - RNA, 21 nt, Human
cucaacucugcaaccggagcc

SEQ ID NO: 270084 - RNA, 22 nt, Human
cucacggcaggaaagcggagaa

SEQ ID NO: 270085 - RNA, 23 nt, Human
gguaacagauacuguagaaaaga

SEQ ID NO: 270086 - RNA, 19 nt, Human
uacaugagggacgcuggaa

SEQ ID NO: 270087 - RNA, 20 nt, Human
uacuguagaaaagagaaggg

SEQ ID NO: 270088 - RNA, 25 nt, Human
ucugcaaccggagccaaccggaaac

SEQ ID NO: 270089 - RNA, 21 nt, Human
ucuguaagggauaaaccagac

SEQ ID NO: 270090 - RNA, 25 nt, Human
uggaagucgauuauuuucccaacug

SEQ ID NO: 270091 - RNA, 25 nt, Human
uggguuagagauuccugaaucaggu

SEQ ID NO: 270092 - RNA, 19 nt, Human
agcagccgagggucaccua

SEQ ID NO: 270093 - RNA, 20 nt, Human
aucccugcagcagccgaggg

SEQ ID NO: 270094 - RNA, 22 nt, Human
cugaaggcuuuuauuugacugg

SEQ ID NO: 270095 - RNA, 22 nt, Human
cugcagucgcugcagaucccug

SEQ ID NO: 270096 - RNA, 20 nt, Human
cugguccauagggugggggg

SEQ ID NO: 270097 - RNA, 21 nt, Human
gcugcagucgcugcagauccc

SEQ ID NO: 270098 - RNA, 25 nt, Human
ucccugcagcagccgagggucaccu

SEQ ID NO: 270099 - RNA, 19 nt, Human
uccuacccggaaccacccu

SEQ ID NO: 270100 - RNA, 19 nt, Human
ugacugguccauagggugg

SEQ ID NO: 270101 - RNA, 22 nt, Human
ugacugguccauaggguggggg

SEQ ID NO: 270102 - RNA, 23 nt, Human
ugacugguccauagggugggggg

SEQ ID NO: 270103 - RNA, 20 nt, Human
ugaggggccugaaggcuuuu

SEQ ID NO: 270104 - RNA, 24 nt, Human
uuuuugaggggccugaaggcuuuu

SEQ ID NO: 270105 - RNA, 21 nt, Human
uuuuuugaggggccugaaggc

SEQ ID NO: 270106 - RNA, 20 nt, Human
uuuuuuuuuugaggggccug

SEQ ID NO: 270107 - RNA, 19 nt, Human
uuuuuuuuuuuuugagggg

SEQ ID NO: 270108 - RNA, 22 nt, Human
uuuuuuuuuuuuuuuuugaggg

SEQ ID NO: 270109 - RNA, 22 nt, Human
cccaaaagcccacgaagccucc

SEQ ID NO: 270110 - RNA, 18 nt, Human
guccuaguuagaggaccc

SEQ ID NO: 270111 - RNA, 20 nt, Human
uagaggacccaaaagcccac

SEQ ID NO: 270112 - RNA, 23 nt, Human
uagaggacccaaaagcccacgaa

SEQ ID NO: 270113 - RNA, 18 nt, Human
uaggaaugagggaguccu

SEQ ID NO: 270114 - RNA, 21 nt, Human
uccuaguuagaggacccaaaa

SEQ ID NO: 270115 - RNA, 21 nt, Human
gaccuuccccggccgcgcgga

SEQ ID NO: 270116 - RNA, 21 nt, Human
gcugaccuuccccggccgcgc

SEQ ID NO: 270117 - RNA, 18 nt, Human
uuuccauuucacugauuu

SEQ ID NO: 270118 - RNA, 22 nt, Human
uuuuuuuuuuuuuuuuccauuu

SEQ ID NO: 270119 - RNA, 26 nt, Human
uuuuuuuuuuuuuuuuuuuuccauuu

SEQ ID NO: 270120 - RNA, 24 nt, Human
uuuuuuuuuuuuuuuuuuuuuccu

SEQ ID NO: 270121 - RNA, 23 nt, Human
aguauuuuuauuucuuuuuauuu

SEQ ID NO: 270122 - RNA, 25 nt, Human
cagcuacaaucacuauacggagcaa

SEQ ID NO: 270123 - RNA, 24 nt, Human
uauuucuuuuuauuuaaugaugca

SEQ ID NO: 270124 - RNA, 24 nt, Human
ucacauauaacuuuuucucucaca

SEQ ID NO: 270125 - RNA, 23 nt, Human
uccagaggaacagcuacaaucac

SEQ ID NO: 270126 - RNA, 24 nt, Human
ucucacauuuacaacucaacagau

SEQ ID NO: 270127 - RNA, 21 nt, Human
aaagaaauaaaccuguaaagg

SEQ ID NO: 270128 - RNA, 25 nt, Human
aaagaaauaaaccuguaaaggauca

SEQ ID NO: 270129 - RNA, 21 nt, Human
auaaaccuguaaaggaucacu

SEQ ID NO: 270130 - RNA, 21 nt, Human
aucaaugcuuuuaagagcauc

SEQ ID NO: 270131 - RNA, 22 nt, Human
caaaacugggauccuaguagaa

SEQ ID NO: 270132 - RNA, 26 nt, Human
ccccggagccgcggaggcuguucugc

SEQ ID NO: 270133 - RNA, 19 nt, Human
cugcggcaaaacugggauc

SEQ ID NO: 270134 - RNA, 23 nt, Human
uaaaccuguaaaggaucacugca

SEQ ID NO: 270135 - RNA, 18 nt, Human
ucacugcacuacaguugu

SEQ ID NO: 270136 - RNA, 18 nt, Human
uccauuaauuaucugcgg

SEQ ID NO: 270137 - RNA, 21 nt, Human
ucuccccggagccgcggaggc

SEQ ID NO: 270138 - RNA, 18 nt, Human
ugggauccuaguagaagc

SEQ ID NO: 270139 - RNA, 21 nt, Human
uuaaccuuuacacacaauaca

SEQ ID NO: 270140 - RNA, 18 nt, Human
uuaauuaucugcggcaaa

SEQ ID NO: 270141 - RNA, 23 nt, Human
uuuucaaacugcaaaguugauaa

SEQ ID NO: 270142 - RNA, 22 nt, Human
aagccgcccucuuggaagcugg

SEQ ID NO: 270143 - RNA, 23 nt, Human
acacacacacacacacacacaca

SEQ ID NO: 270144 - RNA, 23 nt, Human
acacacacacacacacacacaca

SEQ ID NO: 270145 - RNA, 23 nt, Human
acacacacacacacacacacaca

SEQ ID NO: 270146 - RNA, 23 nt, Human
acacacacacacacacacacaca

SEQ ID NO: 270147 - RNA, 23 nt, Human
acacacacacacacacacacaca

SEQ ID NO: 270148 - RNA, 28 nt, Human
acacacacacacacacacacacagaggc

SEQ ID NO: 270149 - RNA, 25 nt, Human
acauacacacacacacacacacagu

SEQ ID NO: 270150 - RNA, 25 nt, Human
acccucuuuucucaggcagcucacu

SEQ ID NO: 270151 - RNA, 20 nt, Human
agaagccaugguagguuaga

SEQ ID NO: 270152 - RNA, 23 nt, Human
aggcagcucacucaguccccuca

SEQ ID NO: 270153 - RNA, 19 nt, Human
aggcaggggggaucaaacg

SEQ ID NO: 270154 - RNA, 23 nt, Human
auacacacacacacacacacaca

SEQ ID NO: 270155 - RNA, 19 nt, Human
caaagggcagcaugaggga

SEQ ID NO: 270156 - RNA, 20 nt, Human
cacacacacacacacacaca

SEQ ID NO: 270157 - RNA, 20 nt, Human
cacacacacacacacacaca

SEQ ID NO: 270158 - RNA, 20 nt, Human
cacacacacacacacacaca

SEQ ID NO: 270159 - RNA, 20 nt, Human
cacacacacacacacacaca

SEQ ID NO: 270160 - RNA, 20 nt, Human
cacacacacacacacacaca

SEQ ID NO: 270161 - RNA, 20 nt, Human
cacacacacacacacacaca

SEQ ID NO: 270162 - RNA, 20 nt, Human
cacacacacacacacacaca

SEQ ID NO: 270163 - RNA, 22 nt, Human
cacacacacacacacacacaca

SEQ ID NO: 270164 - RNA, 22 nt, Human
cacacacacacacacacacaca

SEQ ID NO: 270165 - RNA, 22 nt, Human
cacacacacacacacacacaca

SEQ ID NO: 270166 - RNA, 26 nt, Human
cacacacacacacacacacacacaca

SEQ ID NO: 270167 - RNA, 19 nt, Human
cacagaaagccugacagcc

SEQ ID NO: 270168 - RNA, 18 nt, Human
cacagugaagccgcccuc

SEQ ID NO: 270169 - RNA, 19 nt, Human
cacagugaagccgcccucu

SEQ ID NO: 270170 - RNA, 31 nt, Human
cacgaacauacacacacacacacacacacag

SEQ ID NO: 270171 - RNA, 19 nt, Human
cagaagaagcugauaggca

SEQ ID NO: 270172 - RNA, 22 nt, Human
cagcgcgccuccuucuuggcuu

SEQ ID NO: 270173 - RNA, 19 nt, Human
cagcucacucaguccccuc

SEQ ID NO: 270174 - RNA, 23 nt, Human
cagcuccuggcuggcuuuucugu

SEQ ID NO: 270175 - RNA, 22 nt, Human
ccaauuuccagugaggaacagg

SEQ ID NO: 270176 - RNA, 25 nt, Human
ccagcgcgccuccuucuuggcuucu

SEQ ID NO: 270177 - RNA, 20 nt, Human
cccacagcuccuggcuggcu

SEQ ID NO: 270178 - RNA, 21 nt, Human
cccucagcccuggaaaccagc

SEQ ID NO: 270179 - RNA, 21 nt, Human
ccucacucucugccucuccug

SEQ ID NO: 270180 - RNA, 21 nt, Human
ccuggcuggcuuuucuguucc

SEQ ID NO: 270181 - RNA, 22 nt, Human
cuccggcugcagacugcgggaa

SEQ ID NO: 270182 - RNA, 18 nt, Human
cuguucccuacccucuuu

SEQ ID NO: 270183 - RNA, 20 nt, Human
gcucacucaguccccucagc

SEQ ID NO: 270184 - RNA, 22 nt, Human
ggguccugugacucggcuucac

SEQ ID NO: 270185 - RNA, 25 nt, Human
guguacacgaacauacacacacaca

SEQ ID NO: 270186 - RNA, 27 nt, Human
guguacacgaacauacacacacacaca

SEQ ID NO: 270187 - RNA, 20 nt, Human
uacacacacacacacacaca

SEQ ID NO: 270188 - RNA, 25 nt, Human
uacacacacacacacacacacacac

SEQ ID NO: 270189 - RNA, 18 nt, Human
ucacucucugccucuccu

SEQ ID NO: 270190 - RNA, 24 nt, Human
uccccucagcccuggaaaccagcc

SEQ ID NO: 270191 - RNA, 22 nt, Human
uccggguccugugacucggcuu

SEQ ID NO: 270192 - RNA, 23 nt, Human
ucgcacagugaagccgcccucuu

SEQ ID NO: 270193 - RNA, 22 nt, Human
ucucaggcagcucacucagucc

SEQ ID NO: 270194 - RNA, 25 nt, Human
ugagaaaagagaagccaugguaggu

SEQ ID NO: 270195 - RNA, 25 nt, Human
uggaagcuggcagggucggggucgc

SEQ ID NO: 270196 - RNA, 19 nt, Human
uggaagcuggcagggucgu

SEQ ID NO: 270197 - RNA, 20 nt, Human
uggaagcuggcagggucguu

SEQ ID NO: 270198 - RNA, 18 nt, Human
ugugcaugccggccaggc

SEQ ID NO: 270199 - RNA, 23 nt, Human
ugugcaugccggccaggcccuuu

SEQ ID NO: 270200 - RNA, 20 nt, Human
uuccagugaggaacaggcuc

SEQ ID NO: 270201 - RNA, 25 nt, Human
uuccagugaggaacaggcuccacag

SEQ ID NO: 270202 - RNA, 18 nt, Human
uuuuuuuuuuuuaggccu

SEQ ID NO: 270203 - RNA, 26 nt, Human
uuuuuuuuuuuuuuuuaggccuaggg

SEQ ID NO: 270204 - RNA, 23 nt, Human
uuuuuuuuuuuuuuuuuuuuagg

SEQ ID NO: 270205 - RNA, 21 nt, Human
gucuaggauccacaugcguuc

SEQ ID NO: 270206 - RNA, 24 nt, Human
uuuuuuuuuuuuaagucuaaguag

SEQ ID NO: 270207 - RNA, 18 nt, Human
gagauauagucagugcca

SEQ ID NO: 270208 - RNA, 22 nt, Human
uuuuuuuuuuuuuuuuguaguu

SEQ ID NO: 270209 - RNA, 19 nt, Human
cucgugcccuugacucuuc

SEQ ID NO: 270210 - RNA, 21 nt, Human
uacacacuuugacaaggaggu

SEQ ID NO: 270211 - RNA, 24 nt, Human
uaggauggagcaauccuuuauuuu

SEQ ID NO: 270212 - RNA, 27 nt, Human
uccaguggagaacagagaacaggaaaa

SEQ ID NO: 270213 - RNA, 22 nt, Human
ucucuggccgccgcuucagaac

SEQ ID NO: 270214 - RNA, 23 nt, Human
uucucuggccgccgcuucagaac

SEQ ID NO: 270215 - RNA, 25 nt, Human
uuuuuuuuuuuuuuuuuuuuuuagg

SEQ ID NO: 270216 - RNA, 22 nt, Human
acagcaacacccuuuauucagc

SEQ ID NO: 270217 - RNA, 19 nt, Human
agcaccaggaauacccuuc

SEQ ID NO: 270218 - RNA, 20 nt, Human
agcaccaggaauacccuucg

SEQ ID NO: 270219 - RNA, 27 nt, Human
cagcaacacccuuuauucagcaccagu

SEQ ID NO: 270220 - RNA, 18 nt, Human
cagcaccaggaauacccu

SEQ ID NO: 270221 - RNA, 23 nt, Human
cagcaccaggaauacccuucgca

SEQ ID NO: 270222 - RNA, 21 nt, Human
cgcacagaaccagcgagcuuc

SEQ ID NO: 270223 - RNA, 23 nt, Human
cggaaaugcucacaggaugcugc

SEQ ID NO: 270224 - RNA, 23 nt, Human
cgggacccccggcgugccacacg

SEQ ID NO: 270225 - RNA, 24 nt, Human
cuucgcacagaaccagcgagcuuc

SEQ ID NO: 270226 - RNA, 24 nt, Human
ucagccaugacagcaacacccuuu

SEQ ID NO: 270227 - RNA, 27 nt, Human
uccccgcggaaaugcucacaggaugcu

SEQ ID NO: 270228 - RNA, 23 nt, Human
uuuucagccaugacagcaacacc

SEQ ID NO: 270229 - RNA, 24 nt, Human
uuuuuuuuuuuuuuuuucagccau

SEQ ID NO: 270230 - RNA, 24 nt, Human
uuuuuuuuuuuuuuuuuuuuucag

SEQ ID NO: 270231 - RNA, 24 nt, Human
aggcuccggcggcggcggcggcgg

SEQ ID NO: 270232 - RNA, 21 nt, Human
cggcagcccgagggcagguuu

SEQ ID NO: 270233 - RNA, 19 nt, Human
cggcggcggcggcggcggc

SEQ ID NO: 270234 - RNA, 21 nt, Human
cucacgggacacaagcaggcu

SEQ ID NO: 270235 - RNA, 19 nt, Human
ggcuccggcggcggcggcg

SEQ ID NO: 270236 - RNA, 23 nt, Human
gggacacaagcaggcuggggaca

SEQ ID NO: 270237 - RNA, 18 nt, Human
ugacaaccucacgggaca

SEQ ID NO: 270238 - RNA, 21 nt, Human
uggcggcagcccgagggcagg

SEQ ID NO: 270239 - RNA, 21 nt, Human
uuuuuuuuuuuggcggcagcc

SEQ ID NO: 270240 - RNA, 18 nt, Human
uuuuuuuuuuuuuuuuug

SEQ ID NO: 270241 - RNA, 22 nt, Human
uuuuuuuuuuuuuuuuuggcgg

SEQ ID NO: 270242 - RNA, 22 nt, Human
uuuuuuuuuuuuuuuuuuuggc

SEQ ID NO: 270243 - RNA, 21 nt, Human
agcaggggcugcaggccggug

SEQ ID NO: 270244 - RNA, 19 nt, Human
ggcagcaggggcugcaggc

SEQ ID NO: 270245 - RNA, 24 nt, Human
gggaggcggaggcuacacuguagg

SEQ ID NO: 270246 - RNA, 22 nt, Human
ggggcugcaggccgguggggcg

SEQ ID NO: 270247 - RNA, 18 nt, Human
gguuuuauugggcagcag

SEQ ID NO: 270248 - RNA, 24 nt, Human
ugggcagcaggggcugcaggccgg

SEQ ID NO: 270249 - RNA, 23 nt, Human
uuauugggcagcaggggcugcag

SEQ ID NO: 270250 - RNA, 19 nt, Human
ccacauggauagacgcagg

SEQ ID NO: 270251 - RNA, 19 nt, Human
ucaccuucauagcacugag

SEQ ID NO: 270252 - RNA, 22 nt, Human
uccacauggauagacgcaggac

SEQ ID NO: 270253 - RNA, 21 nt, Human
uuggagggugggcagcacucg

SEQ ID NO: 270254 - RNA, 19 nt, Human
uuuuuuuuuuuggagggug

SEQ ID NO: 270255 - RNA, 18 nt, Human
uuuuuuuuuuuuggaggg

SEQ ID NO: 270256 - RNA, 19 nt, Human
uuuuuuuuuuuuuuggagg

SEQ ID NO: 270257 - RNA, 24 nt, Human
uuuuuuuuuuuuuuuuuuggaggg

SEQ ID NO: 270258 - RNA, 28 nt, Human
uuuuuuuuuuuuuuuuuuuuuuuggggg

SEQ ID NO: 270259 - RNA, 23 nt, Human
aaacaccgaaggccaccagccac

SEQ ID NO: 270260 - RNA, 25 nt, Human
aaacaccgaaggccaccagccacaa

SEQ ID NO: 270261 - RNA, 25 nt, Human
aagucugaagucaggguguuggcug

SEQ ID NO: 270262 - RNA, 22 nt, Human
aaugaacacccuuguuucucuu

SEQ ID NO: 270263 - RNA, 22 nt, Human
accagccacaacccggagggcg

SEQ ID NO: 270264 - RNA, 20 nt, Human
accgcggaaaaagauccaga

SEQ ID NO: 270265 - RNA, 22 nt, Human
agaauucuuccucaucuuucuc

SEQ ID NO: 270266 - RNA, 19 nt, Human
caaacccgaaacaccgaag

SEQ ID NO: 270267 - RNA, 20 nt, Human
cagaaccagcccuaccccgu

SEQ ID NO: 270268 - RNA, 20 nt, Human
caggaugcagugaagacggu

SEQ ID NO: 270269 - RNA, 21 nt, Human
caggcuuucagugggcugggg

SEQ ID NO: 270270 - RNA, 27 nt, Human
cccucugugggcuuguccagcaggagc

SEQ ID NO: 270271 - RNA, 19 nt, Human
cgaaacaccgaaggccacc

SEQ ID NO: 270272 - RNA, 18 nt, Human
cucaucuuucucuuggcu

SEQ ID NO: 270273 - RNA, 19 nt, Human
cucaucuuucucuuggcuu

SEQ ID NO: 270274 - RNA, 20 nt, Human
cugggccacgcuccuucuga

SEQ ID NO: 270275 - RNA, 20 nt, Human
cuugaauuauggccacauaa

SEQ ID NO: 270276 - RNA, 24 nt, Human
cuuguuucucuucccuuucugguc

SEQ ID NO: 270277 - RNA, 24 nt, Human
cuuucugcucaccaggcuuucagu

SEQ ID NO: 270278 - RNA, 18 nt, Human
gaaacaccgaaggccacc

SEQ ID NO: 270279 - RNA, 18 nt, Human
gaaaggaugaacauuagg

SEQ ID NO: 270280 - RNA, 20 nt, Human
gaagcugggcccucuguggg

SEQ ID NO: 270281 - RNA, 21 nt, Human
gagcaggagccguucaggaaa

SEQ ID NO: 270282 - RNA, 20 nt, Human
gccaaacccgaaacaccgaa

SEQ ID NO: 270283 - RNA, 21 nt, Human
gccaaacccgaaacaccgaag

SEQ ID NO: 270284 - RNA, 23 nt, Human
ggaaaaagauccagaaccagccc

SEQ ID NO: 270285 - RNA, 24 nt, Human
ggcuucugguguugccagcaaucc

SEQ ID NO: 270286 - RNA, 19 nt, Human
uaccgcggaaaaagaucca

SEQ ID NO: 270287 - RNA, 19 nt, Human
uaggcaaguacuuggaauc

SEQ ID NO: 270288 - RNA, 18 nt, Human
uauuuuugcacuccagga

SEQ ID NO: 270289 - RNA, 20 nt, Human
ucaggguguuggcugggcca

SEQ ID NO: 270290 - RNA, 23 nt, Human
uccuaccagugaaugaacacccu

SEQ ID NO: 270291 - RNA, 20 nt, Human
ucuagaggaaaggaugaaca

SEQ ID NO: 270292 - RNA, 24 nt, Human
ucucuucccuuucugcucaccagg

SEQ ID NO: 270293 - RNA, 22 nt, Human
ucucuuggcuucugguguugcc

SEQ ID NO: 270294 - RNA, 22 nt, Human
ucugcucaccaggcuuucagug

SEQ ID NO: 270295 - RNA, 21 nt, Human
ucugucuucucccuucucagg

SEQ ID NO: 270296 - RNA, 19 nt, Human
ugaacugccaaacccgaaa

SEQ ID NO: 270297 - RNA, 18 nt, Human
ugagugaacugccaaacc

SEQ ID NO: 270298 - RNA, 23 nt, Human
ugaguucuggaggccagaagucu

SEQ ID NO: 270299 - RNA, 21 nt, Human
uggauuuuauuuuugcacucc

SEQ ID NO: 270300 - RNA, 18 nt, Human
uggcugggccacgcuccu

SEQ ID NO: 270301 - RNA, 18 nt, Human
uggcuucugguguugccu

SEQ ID NO: 270302 - RNA, 18 nt, Human
ugggcuggggcuauuggc

SEQ ID NO: 270303 - RNA, 19 nt, Human
uuccucaucuuucucuugg

SEQ ID NO: 270304 - RNA, 20 nt, Human
uucugcucaccaggcuuuca

SEQ ID NO: 270305 - RNA, 22 nt, Human
uugcacuccaggaugcagugaa

SEQ ID NO: 270306 - RNA, 21 nt, Human
uuuuauuuuugcacuccagga

SEQ ID NO: 270307 - RNA, 20 nt, Human
uuuugcacuccaggaugcag

SEQ ID NO: 270308 - RNA, 20 nt, Human
aaagaagacuaugaaaagaa

SEQ ID NO: 270309 - RNA, 20 nt, Human
aacauguuuauaauggagaa

SEQ ID NO: 270310 - RNA, 18 nt, Human
aagacaaaagcaaagagc

SEQ ID NO: 270311 - RNA, 18 nt, Human
aagcagauuauaaugugc

SEQ ID NO: 270312 - RNA, 19 nt, Human
aaggaaaacuaugaaaaga

SEQ ID NO: 270313 - RNA, 24 nt, Human
aaggaaaacuaugaaaagacaaaa

SEQ ID NO: 270314 - RNA, 21 nt, Human
aaggaaaagcagauuauaaug

SEQ ID NO: 270315 - RNA, 23 nt, Human
aagugacaaacuauacaaggaaa

SEQ ID NO: 270316 - RNA, 23 nt, Human
aauuagaaauaauaagcauuagc

SEQ ID NO: 270317 - RNA, 22 nt, Human
acaaagaagacuaugaaaagaa

SEQ ID NO: 270318 - RNA, 21 nt, Human
accaaauaaauuuccucagca

SEQ ID NO: 270319 - RNA, 21 nt, Human
acuaugaaaagaauaaaggaa

SEQ ID NO: 270320 - RNA, 21 nt, Human
agaaauaauaagcauuagccg

SEQ ID NO: 270321 - RNA, 21 nt, Human
agaacccacagcuuaggcagc

SEQ ID NO: 270322 - RNA, 20 nt, Human
agaacuuagguaacagugga

SEQ ID NO: 270323 - RNA, 18 nt, Human
agagaacccacagcuuag

SEQ ID NO: 270324 - RNA, 23 nt, Human
aggcagcugaaggcagcaggaga

SEQ ID NO: 270325 - RNA, 24 nt, Human
auaauggagaaagacucuaggcac

SEQ ID NO: 270326 - RNA, 22 nt, Human
auuagaaauaauaagcauuagc

SEQ ID NO: 270327 - RNA, 22 nt, Human
caaaagcaaagagcauaaauua

SEQ ID NO: 270328 - RNA, 23 nt, Human
cacagaaauaauauugcagaagc

SEQ ID NO: 270329 - RNA, 24 nt, Human
cagaaaaaccauaggcagcuugag

SEQ ID NO: 270330 - RNA, 21 nt, Human
cagaaauaauauugcagaagc

SEQ ID NO: 270331 - RNA, 24 nt, Human
cagcaaaauacaaagaagacuaug

SEQ ID NO: 270332 - RNA, 20 nt, Human
caggagaugcccuaagugac

SEQ ID NO: 270333 - RNA, 24 nt, Human
cccacagcuuaggcagcugaaggc

SEQ ID NO: 270334 - RNA, 24 nt, Human
ccgaaacauugacugcaggaucug

SEQ ID NO: 270335 - RNA, 22 nt, Human
ccugcuucagagaacccacagc

SEQ ID NO: 270336 - RNA, 22 nt, Human
cuaccaaauaaauuuccucagc

SEQ ID NO: 270337 - RNA, 22 nt, Human
cugaaggcagcaggagaugccc

SEQ ID NO: 270338 - RNA, 23 nt, Human
cugaaggcagcaggagaugcccc

SEQ ID NO: 270339 - RNA, 21 nt, Human
cugcuucagagaacccacagc

SEQ ID NO: 270340 - RNA, 22 nt, Human
cuucagagaacccacagcuuag

SEQ ID NO: 270341 - RNA, 23 nt, Human
gaaaacuaugaaaagacaaaagc

SEQ ID NO: 270342 - RNA, 21 nt, Human
gaaaagacaaaagcaaagagc

SEQ ID NO: 270343 - RNA, 21 nt, Human
gagaacuuagguaacagugga

SEQ ID NO: 270344 - RNA, 20 nt, Human
gcagcaaaauacaaagaaga

SEQ ID NO: 270345 - RNA, 21 nt, Human
ggaaaaggugaacaucucugc

SEQ ID NO: 270346 - RNA, 19 nt, Human
ggucugagggaagaagccu

SEQ ID NO: 270347 - RNA, 19 nt, Human
uaaaggaaaagcagauuau

SEQ ID NO: 270348 - RNA, 22 nt, Human
uaaagugucuguucugcaacuu

SEQ ID NO: 270349 - RNA, 25 nt, Human
uaaaucacauugacacagaaaaacc

SEQ ID NO: 270350 - RNA, 18 nt, Human
uaagcauuagcaaucagc

SEQ ID NO: 270351 - RNA, 19 nt, Human
uaccauaaaucacauugac

SEQ ID NO: 270352 - RNA, 24 nt, Human
uaugaaaagacaaaagcaaagagc

SEQ ID NO: 270353 - RNA, 20 nt, Human
uauucugcuuuguaguuuua

SEQ ID NO: 270354 - RNA, 22 nt, Human
uauugcagaagcuuuuaaagug

SEQ ID NO: 270355 - RNA, 25 nt, Human
ucaaggcaaugggguuauuuucuuc

SEQ ID NO: 270356 - RNA, 18 nt, Human
uccugcuucagagaaccc

SEQ ID NO: 270357 - RNA, 24 nt, Human
ucuaaaccgaaacauugacugcag

SEQ ID NO: 270358 - RNA, 18 nt, Human
ucuguaaguccugcagac

SEQ ID NO: 270359 - RNA, 22 nt, Human
ugaaaagaauaaaggaaaagca

SEQ ID NO: 270360 - RNA, 25 nt, Human
ugaaaagaauaaaggaaaagcagau

SEQ ID NO: 270361 - RNA, 23 nt, Human
ugaaaagacaaaagcaaagagca

SEQ ID NO: 270362 - RNA, 22 nt, Human
ugaauuagaaauaauaagcauu

SEQ ID NO: 270363 - RNA, 23 nt, Human
ugaauuagaaauaauaagcauua

SEQ ID NO: 270364 - RNA, 19 nt, Human
ugaguuauggucugaggga

SEQ ID NO: 270365 - RNA, 20 nt, Human
ugcuucagagaacccacagc

SEQ ID NO: 270366 - RNA, 20 nt, Human
ugggguuauuuucuucccga

SEQ ID NO: 270367 - RNA, 23 nt, Human
uuagagguuuuauuaguugcugg

SEQ ID NO: 270368 - RNA, 23 nt, Human
uuccugcuucagagaacccacag

SEQ ID NO: 270369 - RNA, 19 nt, Human
uuuaaagugucuguucugc

SEQ ID NO: 270370 - RNA, 22 nt, Human
aaaagcaaaaaaaacggaaaag

SEQ ID NO: 270371 - RNA, 22 nt, Human
aaacagaagccaaacuguacaa

SEQ ID NO: 270372 - RNA, 19 nt, Human
aaacagauaugggguuuua

SEQ ID NO: 270373 - RNA, 27 nt, Human
aaaccaugaacacaauuagcagcacca

SEQ ID NO: 270374 - RNA, 21 nt, Human
aaagcucucccaccuccauau

SEQ ID NO: 270375 - RNA, 24 nt, Human
aaaggaaaccaugaacacaauuag

SEQ ID NO: 270376 - RNA, 22 nt, Human
aaaugcccuugcccaagccuca

SEQ ID NO: 270377 - RNA, 23 nt, Human
aacaacugccaacacuaccaaau

SEQ ID NO: 270378 - RNA, 23 nt, Human
aacauauaaggcagauaucccca

SEQ ID NO: 270379 - RNA, 22 nt, Human
aagagcauaaaaaggacuuaga

SEQ ID NO: 270380 - RNA, 26 nt, Human
aagcaaacagaagccaaacuguacaa

SEQ ID NO: 270381 - RNA, 19 nt, Human
aagcaucuuuucaaaguau

SEQ ID NO: 270382 - RNA, 21 nt, Human
aauccguuaaacacaggguug

SEQ ID NO: 270383 - RNA, 19 nt, Human
aaugggacugugaugcagu

SEQ ID NO: 270384 - RNA, 22 nt, Human
acagaauaauaaccacagaagc

SEQ ID NO: 270385 - RNA, 22 nt, Human
acagcuaagaaguuucaaacac

SEQ ID NO: 270386 - RNA, 19 nt, Human
accacagaagcaacauaca

SEQ ID NO: 270387 - RNA, 21 nt, Human
accagacuguccuucugccac

SEQ ID NO: 270388 - RNA, 26 nt, Human
acugcaaguguguaaacaauaacaag

SEQ ID NO: 270389 - RNA, 21 nt, Human
acuggcuucuguuacauuuuc

SEQ ID NO: 270390 - RNA, 21 nt, Human
agaauaauaaccacagaagca

SEQ ID NO: 270391 - RNA, 20 nt, Human
agagauucugggaaaacuac

SEQ ID NO: 270392 - RNA, 23 nt, Human
agauaccuguugccaaaccaaag

SEQ ID NO: 270393 - RNA, 25 nt, Human
agcaaacagaagccaaacuguacaa

SEQ ID NO: 270394 - RNA, 18 nt, Human
aggcagauauccccaaga

SEQ ID NO: 270395 - RNA, 22 nt, Human
agggaacaaggaaauuucucug

SEQ ID NO: 270396 - RNA, 18 nt, Human
aguggacagagaggggcu

SEQ ID NO: 270397 - RNA, 19 nt, Human
auaaaagagcauaaaaagg

SEQ ID NO: 270398 - RNA, 27 nt, Human
auaaccacagaagcaacauacaaugcc

SEQ ID NO: 270399 - RNA, 23 nt, Human
aucagucacccuuuuugcuucaa

SEQ ID NO: 270400 - RNA, 23 nt, Human
augacauuccuguuucauucccu

SEQ ID NO: 270401 - RNA, 24 nt, Human
auggagaggauaaggaaagacugu

SEQ ID NO: 270402 - RNA, 23 nt, Human
auucccuuaaaaaugauuuagaa

SEQ ID NO: 270403 - RNA, 21 nt, Human
caaaagaagacaccagaucau

SEQ ID NO: 270404 - RNA, 22 nt, Human
caaagcuguucaauggaacacc

SEQ ID NO: 270405 - RNA, 24 nt, Human
caaaggugggagggaagcacgugg

SEQ ID NO: 270406 - RNA, 25 nt, Human
caacucuauauaaauccacaaagaa

SEQ ID NO: 270407 - RNA, 21 nt, Human
caaguucaguuuauuuuugua

SEQ ID NO: 270408 - RNA, 21 nt, Human
cacacuucacuccuuaucuca

SEQ ID NO: 270409 - RNA, 23 nt, Human
caccuuuaauaucugaggagcau

SEQ ID NO: 270410 - RNA, 24 nt, Human
cagaaggguucaauagccaaucaa

SEQ ID NO: 270411 - RNA, 18 nt, Human
cagacuguccuucugcca

SEQ ID NO: 270412 - RNA, 22 nt, Human
cagaguuaagagaauuggcuug

SEQ ID NO: 270413 - RNA, 24 nt, Human
cagcaccaggcguccagacacaaa

SEQ ID NO: 270414 - RNA, 20 nt, Human
cagcauggagaggauaagga

SEQ ID NO: 270415 - RNA, 25 nt, Human
cagccaaacccccuuaaaagaaguc

SEQ ID NO: 270416 - RNA, 21 nt, Human
caggucacaguaaacggcaca

SEQ ID NO: 270417 - RNA, 23 nt, Human
caggucacaguaaacggcacaaa

SEQ ID NO: 270418 - RNA, 18 nt, Human
caucaaccacaauucuac

SEQ ID NO: 270419 - RNA, 21 nt, Human
caugaaggauucauuuugcca

SEQ ID NO: 270420 - RNA, 19 nt, Human
caugcacgagauaccuguu

SEQ ID NO: 270421 - RNA, 22 nt, Human
ccaagccucagcccuauuuagc

SEQ ID NO: 270422 - RNA, 24 nt, Human
cccaagccucagcccuauuuagcc

SEQ ID NO: 270423 - RNA, 22 nt, Human
cccacacuucacuccuuaucuc

SEQ ID NO: 270424 - RNA, 22 nt, Human
ccugcauuuauuuuuucaacuu

SEQ ID NO: 270425 - RNA, 20 nt, Human
ccuugcccaagccucagccc

SEQ ID NO: 270426 - RNA, 18 nt, Human
cucaagagagagaggauc

SEQ ID NO: 270427 - RNA, 19 nt, Human
cucaagagagagaggaucc

SEQ ID NO: 270428 - RNA, 22 nt, Human
cucuauauaaauccacaaagaa

SEQ ID NO: 270429 - RNA, 19 nt, Human
cugcaucuucuucaagaaa

SEQ ID NO: 270430 - RNA, 26 nt, Human
gacaaacaagaguaaucaaaaaggca

SEQ ID NO: 270431 - RNA, 18 nt, Human
gacccguacaucuuagca

SEQ ID NO: 270432 - RNA, 22 nt, Human
gagaaaauuugcucaaagauuc

SEQ ID NO: 270433 - RNA, 19 nt, Human
gagauucugggaaaacuac

SEQ ID NO: 270434 - RNA, 22 nt, Human
gagcauacuagacaaacaagag

SEQ ID NO: 270435 - RNA, 19 nt, Human
gauaugggguuuuaucacu

SEQ ID NO: 270436 - RNA, 22 nt, Human
gaucccuaaggccaccagucaa

SEQ ID NO: 270437 - RNA, 19 nt, Human
gauucugggaaaacuacuc

SEQ ID NO: 270438 - RNA, 20 nt, Human
gcaaaaaaaacggaaaagga

SEQ ID NO: 270439 - RNA, 22 nt, Human
gccaacacuaccaaauuauggc

SEQ ID NO: 270440 - RNA, 18 nt, Human
gccaaguugucuuaaaag

SEQ ID NO: 270441 - RNA, 18 nt, Human
gcccuugcccaagccuca

SEQ ID NO: 270442 - RNA, 24 nt, Human
gcuacacugcaaguguguaaacag

SEQ ID NO: 270443 - RNA, 20 nt, Human
gcucagcaauucauugcaug

SEQ ID NO: 270444 - RNA, 23 nt, Human
ggaaaacuacucagcucuaacac

SEQ ID NO: 270445 - RNA, 19 nt, Human
ggaagaagucggcauuuuc

SEQ ID NO: 270446 - RNA, 19 nt, Human
ggaagcacguggaaagugg

SEQ ID NO: 270447 - RNA, 22 nt, Human
gggugauuccaaagugacagcu

SEQ ID NO: 270448 - RNA, 23 nt, Human
gguccugacauucuguggaacug

SEQ ID NO: 270449 - RNA, 20 nt, Human
ggugcugcuuccuaaaugcu

SEQ ID NO: 270450 - RNA, 21 nt, Human
gugcuuguggaaacugugcuu

SEQ ID NO: 270451 - RNA, 18 nt, Human
guggcuagauuuccauuc

SEQ ID NO: 270452 - RNA, 18 nt, Human
gugugucuaauugucaaa

SEQ ID NO: 270453 - RNA, 19 nt, Human
uaaaaaggacuuagagauu

SEQ ID NO: 270454 - RNA, 25 nt, Human
uaaaagcaaaaaaaacggaaaagga

SEQ ID NO: 270455 - RNA, 24 nt, Human
uaaaauauuacuauagaauaggca

SEQ ID NO: 270456 - RNA, 18 nt, Human
uaaaucgcuuauuuacua

SEQ ID NO: 270457 - RNA, 21 nt, Human
uaacaacugccaacacuacca

SEQ ID NO: 270458 - RNA, 22 nt, Human
uaacagcaacuggauuacaaag

SEQ ID NO: 270459 - RNA, 21 nt, Human
uaaccagacuguccuucugcc

SEQ ID NO: 270460 - RNA, 27 nt, Human
uaaggaaagacuguggcacauuggaaa

SEQ ID NO: 270461 - RNA, 21 nt, Human
uaagugaaugccaccccguug

SEQ ID NO: 270462 - RNA, 21 nt, Human
uacaaaaauacauuucccaga

SEQ ID NO: 270463 - RNA, 22 nt, Human
uacacugcaaguguguaaacaa

SEQ ID NO: 270464 - RNA, 18 nt, Human
uaccagucagccuaggga

SEQ ID NO: 270465 - RNA, 22 nt, Human
uacuuugcucaagagagagagg

SEQ ID NO: 270466 - RNA, 18 nt, Human
uagagugcgaugcagcag

SEQ ID NO: 270467 - RNA, 18 nt, Human
uagaucccuaaggccacc

SEQ ID NO: 270468 - RNA, 24 nt, Human
uauaaggcagauauccccaagacc

SEQ ID NO: 270469 - RNA, 21 nt, Human
ucaacucuauauaaauccaca

SEQ ID NO: 270470 - RNA, 24 nt, Human
ucaauaauaggaacgcgcagugca

SEQ ID NO: 270471 - RNA, 21 nt, Human
ucagcccagaggucauuccuu

SEQ ID NO: 270472 - RNA, 22 nt, Human
ucaguuuucauugcgguucuua

SEQ ID NO: 270473 - RNA, 18 nt, Human
uccaaaaggcauggaaua

SEQ ID NO: 270474 - RNA, 19 nt, Human
uccagaauuugaauaccau

SEQ ID NO: 270475 - RNA, 19 nt, Human
uccauaccacagugcccuu

SEQ ID NO: 270476 - RNA, 22 nt, Human
uccauaccacagugcccuugag

SEQ ID NO: 270477 - RNA, 20 nt, Human
uccaugggcaguugauaacc

SEQ ID NO: 270478 - RNA, 19 nt, Human
uccuacaaggugcuugugg

SEQ ID NO: 270479 - RNA, 20 nt, Human
uccuuuuccauaccacagug

SEQ ID NO: 270480 - RNA, 25 nt, Human
ucuacaaaaauacauuucccagaag

SEQ ID NO: 270481 - RNA, 21 nt, Human
ucuccugagaugcuuaacauc

SEQ ID NO: 270482 - RNA, 20 nt, Human
ucucugaugacauuccuguu

SEQ ID NO: 270483 - RNA, 24 nt, Human
ucucuggugcucuggcagaaauug

SEQ ID NO: 270484 - RNA, 18 nt, Human
ucugaggagcaucccacu

SEQ ID NO: 270485 - RNA, 23 nt, Human
ugaaaacgagguacaucccuuga

SEQ ID NO: 270486 - RNA, 18 nt, Human
ugaacacaauuagcagca

SEQ ID NO: 270487 - RNA, 21 nt, Human
ugaaguucaucuuguguagug

SEQ ID NO: 270488 - RNA, 19 nt, Human
ugacucaaaagcaaaacgg

SEQ ID NO: 270489 - RNA, 21 nt, Human
ugagagaaaccagccaaaccc

SEQ ID NO: 270490 - RNA, 19 nt, Human
ugagcauagacuugggucc

SEQ ID NO: 270491 - RNA, 24 nt, Human
ugcaacaucuuguucaguuuuagu

SEQ ID NO: 270492 - RNA, 21 nt, Human
ugcacgagauaccuguugcca

SEQ ID NO: 270493 - RNA, 21 nt, Human
ugcccuugcccaagccucagc

SEQ ID NO: 270494 - RNA, 18 nt, Human
ugccugugugguguaugg

SEQ ID NO: 270495 - RNA, 22 nt, Human
ugcucucugugcuuggacauuu

SEQ ID NO: 270496 - RNA, 22 nt, Human
uggagaggauaaggaaagacug

SEQ ID NO: 270497 - RNA, 21 nt, Human
uggcguccuuuuccauaccac

SEQ ID NO: 270498 - RNA, 19 nt, Human
ugggaucaucaagagccuc

SEQ ID NO: 270499 - RNA, 27 nt, Human
uguaaaauaauggccaaguugucuuaa

SEQ ID NO: 270500 - RNA, 22 nt, Human
uguaaacaauaacaagaagaca

SEQ ID NO: 270501 - RNA, 24 nt, Human
uguaucaaacuguuccuugugcuu

SEQ ID NO: 270502 - RNA, 18 nt, Human
uguccuauauuuagucug

SEQ ID NO: 270503 - RNA, 24 nt, Human
uguggcacauuggaaaaaccagau

SEQ ID NO: 270504 - RNA, 19 nt, Human
uguguaaacaauaacaaga

SEQ ID NO: 270505 - RNA, 21 nt, Human
uguguuauuaaagaucacaca

SEQ ID NO: 270506 - RNA, 19 nt, Human
uuaaaaacagcacuuuggu

SEQ ID NO: 270507 - RNA, 18 nt, Human
uuaaaauuuuaggagacu

SEQ ID NO: 270508 - RNA, 23 nt, Human
uuacaauaggcauuuuaaauccc

SEQ ID NO: 270509 - RNA, 24 nt, Human
uuagaaaaagucuuguuccucauu

SEQ ID NO: 270510 - RNA, 21 nt, Human
uuagauuaucagaagcaaauc

SEQ ID NO: 270511 - RNA, 19 nt, Human
uuagcccacacuucacucc

SEQ ID NO: 270512 - RNA, 20 nt, Human
uucaacuuuaugucagugac

SEQ ID NO: 270513 - RNA, 19 nt, Human
uucagaaccuuuuaaaagu

SEQ ID NO: 270514 - RNA, 25 nt, Human
uucaucuuguguaguccgucucgac

SEQ ID NO: 270515 - RNA, 24 nt, Human
uucaugcacgagauaccuguugcc

SEQ ID NO: 270516 - RNA, 18 nt, Human
uugaucacaggucaaaca

SEQ ID NO: 270517 - RNA, 18 nt, Human
uuguagguuuguguacaa

SEQ ID NO: 270518 - RNA, 19 nt, Human
uuuaugcucagugaaucug

SEQ ID NO: 270519 - RNA, 18 nt, Human
uuucauugcgguucuuau

SEQ ID NO: 270520 - RNA, 22 nt, Human
uuuuagaaaaagucuuguuccu

SEQ ID NO: 270521 - RNA, 18 nt, Human
uuuugcuuuuucgguuuu

SEQ ID NO: 270522 - RNA, 20 nt, Human
aaaaacccaaaacaaacacc

SEQ ID NO: 270523 - RNA, 19 nt, Human
aaaacccaaaacaaacacc

SEQ ID NO: 270524 - RNA, 21 nt, Human
aaaacccaaaacaaacaccau

SEQ ID NO: 270525 - RNA, 20 nt, Human
aaacaguauuuuaaaaggca

SEQ ID NO: 270526 - RNA, 19 nt, Human
aaagacagcaugaaacaac

SEQ ID NO: 270527 - RNA, 25 nt, Human
aaaguacuuuuugcuuucucaucug

SEQ ID NO: 270528 - RNA, 25 nt, Human
aacaaaaauaauuuucacauuccau

SEQ ID NO: 270529 - RNA, 19 nt, Human
aaccuagaacacuuucccu

SEQ ID NO: 270530 - RNA, 20 nt, Human
aagaagauucguaacauaua

SEQ ID NO: 270531 - RNA, 20 nt, Human
aagcugacaacucuuacccc

SEQ ID NO: 270532 - RNA, 22 nt, Human
aagcugacaacucuuaccccag

SEQ ID NO: 270533 - RNA, 20 nt, Human
aagugugcaauaaauuuuga

SEQ ID NO: 270534 - RNA, 20 nt, Human
acaaaauaauaaauagcugc

SEQ ID NO: 270535 - RNA, 21 nt, Human
acaauggugaagacaaaacgc

SEQ ID NO: 270536 - RNA, 25 nt, Human
accccaacaaacuuaaaccaagaac

SEQ ID NO: 270537 - RNA, 20 nt, Human
accccagagcauagcacagc

SEQ ID NO: 270538 - RNA, 18 nt, Human
agaaaaaacugccuggca

SEQ ID NO: 270539 - RNA, 26 nt, Human
agaaggaauucuucuaacuacacuaa

SEQ ID NO: 270540 - RNA, 25 nt, Human
agacaaaacgcaggguacauuaauc

SEQ ID NO: 270541 - RNA, 21 nt, Human
agcauuauaaauaaaaaccca

SEQ ID NO: 270542 - RNA, 18 nt, Human
agccaggugugguggugc

SEQ ID NO: 270543 - RNA, 18 nt, Human
aggcaagagaaaggcuuu

SEQ ID NO: 270544 - RNA, 21 nt, Human
aggugugcuggaaccuagaac

SEQ ID NO: 270545 - RNA, 22 nt, Human
auacaagagguaaauguuaagg

SEQ ID NO: 270546 - RNA, 23 nt, Human
auauacagauauacacaugugua

SEQ ID NO: 270547 - RNA, 20 nt, Human
auguacauggucuuuaugua

SEQ ID NO: 270548 - RNA, 19 nt, Human
caaaaugcauuggcccaca

SEQ ID NO: 270549 - RNA, 23 nt, Human
caaaccggacgcgcucgcccccg

SEQ ID NO: 270550 - RNA, 21 nt, Human
caaacuuaaaccaagaaccag

SEQ ID NO: 270551 - RNA, 18 nt, Human
caagaaccagagguacuu

SEQ ID NO: 270552 - RNA, 21 nt, Human
cacaggguguguauauauaua

SEQ ID NO: 270553 - RNA, 20 nt, Human
cagaaauguuccuacuuccu

SEQ ID NO: 270554 - RNA, 21 nt, Human
cagcaaaccggacgcgcucgc

SEQ ID NO: 270555 - RNA, 22 nt, Human
cagcaugaaacaacuguguaaa

SEQ ID NO: 270556 - RNA, 27 nt, Human
cagcaugaaacaacuguguaaaugcaa

SEQ ID NO: 270557 - RNA, 20 nt, Human
caucucaaaaugcaucaaac

SEQ ID NO: 270558 - RNA, 23 nt, Human
ccagggcaggcaacuguggagga

SEQ ID NO: 270559 - RNA, 20 nt, Human
cccaacaaacuuaaaccaag

SEQ ID NO: 270560 - RNA, 22 nt, Human
ccccaacaaacuuaaaccaaga

SEQ ID NO: 270561 - RNA, 18 nt, Human
cccccgcccagggcaggc

SEQ ID NO: 270562 - RNA, 21 nt, Human
ccccuaaaccaugcugaugcu

SEQ ID NO: 270563 - RNA, 24 nt, Human
cccgcaguagaaugcauuugagac

SEQ ID NO: 270564 - RNA, 23 nt, Human
ccgcccagggcaggcaacugugg

SEQ ID NO: 270565 - RNA, 19 nt, Human
cggucagcacaaagcaccu

SEQ ID NO: 270566 - RNA, 23 nt, Human
cguuugaugaauacauguacaug

SEQ ID NO: 270567 - RNA, 26 nt, Human
cucacaggguguguauauauauauau

SEQ ID NO: 270568 - RNA, 23 nt, Human
cucaugcuuagauaguucacaaa

SEQ ID NO: 270569 - RNA, 24 nt, Human
cugaagcugacaacucuuacccca

SEQ ID NO: 270570 - RNA, 20 nt, Human
cugacggucagcacaaagca

SEQ ID NO: 270571 - RNA, 24 nt, Human
cugguugacaauggugaagacaaa

SEQ ID NO: 270572 - RNA, 21 nt, Human
cuguaaacauacauuuacuac

SEQ ID NO: 270573 - RNA, 18 nt, Human
gaacucuaaagccaggug

SEQ ID NO: 270574 - RNA, 26 nt, Human
gacaaaacgcaggguacauuaaucug

SEQ ID NO: 270575 - RNA, 21 nt, Human
gagcauagcacagcgcuaggc

SEQ ID NO: 270576 - RNA, 24 nt, Human
gagcauagcacagcgcuaggcacg

SEQ ID NO: 270577 - RNA, 19 nt, Human
gcaccuaacucuaaagaca

SEQ ID NO: 270578 - RNA, 18 nt, Human
gcccagggcaggcaacug

SEQ ID NO: 270579 - RNA, 20 nt, Human
ggacaaaauucacuauuuaa

SEQ ID NO: 270580 - RNA, 20 nt, Human
gggaugaaggucugcagcug

SEQ ID NO: 270581 - RNA, 22 nt, Human
guuuggaaaguagaaagugguu

SEQ ID NO: 270582 - RNA, 23 nt, Human
uaaaaacccaaaacaaacaccau

SEQ ID NO: 270583 - RNA, 18 nt, Human
uaaaaaugcgacuacaga

SEQ ID NO: 270584 - RNA, 22 nt, Human
uaaagccaggugugguggugcc

SEQ ID NO: 270585 - RNA, 22 nt, Human
uaaauaaaaacccaaaacaaac

SEQ ID NO: 270586 - RNA, 18 nt, Human
uaaauaauuguggcaaaa

SEQ ID NO: 270587 - RNA, 21 nt, Human
uaaauaauuguggcaaaaucc

SEQ ID NO: 270588 - RNA, 18 nt, Human
uaaauagcugcgaguagc

SEQ ID NO: 270589 - RNA, 21 nt, Human
uaacuacacuaaaauaugaaa

SEQ ID NO: 270590 - RNA, 23 nt, Human
uaauaaauagcugcgaguagcac

SEQ ID NO: 270591 - RNA, 24 nt, Human
uaaucuguaaacaugauaaacccu

SEQ ID NO: 270592 - RNA, 22 nt, Human
uaaucugugaauugcuuccccu

SEQ ID NO: 270593 - RNA, 22 nt, Human
uacaaaguacuuuuugcuuucu

SEQ ID NO: 270594 - RNA, 24 nt, Human
uaccccaacaaacuuaaaccaaga

SEQ ID NO: 270595 - RNA, 18 nt, Human
uaccccagagcauagcac

SEQ ID NO: 270596 - RNA, 18 nt, Human
uacuauuucuucaaaugc

SEQ ID NO: 270597 - RNA, 20 nt, Human
uacuucaguuugguuaaagg

SEQ ID NO: 270598 - RNA, 20 nt, Human
uaggauaugcaggcaagaga

SEQ ID NO: 270599 - RNA, 18 nt, Human
uauagguaacacacuuuc

SEQ ID NO: 270600 - RNA, 18 nt, Human
ucacaguuaucaucucag

SEQ ID NO: 270601 - RNA, 22 nt, Human
uccaaaguuuuuucccaaaaau

SEQ ID NO: 270602 - RNA, 20 nt, Human
uccuaaaucaccaagauacc

SEQ ID NO: 270603 - RNA, 25 nt, Human
ucucaugcuuagauaguucacaaac

SEQ ID NO: 270604 - RNA, 22 nt, Human
ucugcagcuggggacugguggc

SEQ ID NO: 270605 - RNA, 23 nt, Human
ucugcagcuggggacugguggca

SEQ ID NO: 270606 - RNA, 22 nt, Human
ucuguaaacaugauaaacccug

SEQ ID NO: 270607 - RNA, 25 nt, Human
ugaaaugcauuuguaauacaauuuu

SEQ ID NO: 270608 - RNA, 21 nt, Human
ugaagaaguaaacaguuuuuc

SEQ ID NO: 270609 - RNA, 21 nt, Human
ugaaggucugcagcuggggac

SEQ ID NO: 270610 - RNA, 21 nt, Human
ugcugaugcugugguguuugg

SEQ ID NO: 270611 - RNA, 20 nt, Human
uggaaaguagaaagugguuu

SEQ ID NO: 270612 - RNA, 27 nt, Human
uggaacuucugacaaucuggcauuaca

SEQ ID NO: 270613 - RNA, 18 nt, Human
uggaggaggaggaggaga

SEQ ID NO: 270614 - RNA, 21 nt, Human
uggaggaggaggaggagaagc

SEQ ID NO: 270615 - RNA, 21 nt, Human
uggcaaaauccuguuuuaaca

SEQ ID NO: 270616 - RNA, 22 nt, Human
uggcuagaaauauagguaacac

SEQ ID NO: 270617 - RNA, 21 nt, Human
ugggauaaggggcuguguugc

SEQ ID NO: 270618 - RNA, 22 nt, Human
uggugagauaucaaaccaggac

SEQ ID NO: 270619 - RNA, 26 nt, Human
uguaaacauacauuuacuacauagug

SEQ ID NO: 270620 - RNA, 20 nt, Human
uguauccauauuauuuauau

SEQ ID NO: 270621 - RNA, 20 nt, Human
uguguauauauauauauuua

SEQ ID NO: 270622 - RNA, 23 nt, Human
uucagcauuauaaauaaaaaccc

SEQ ID NO: 270623 - RNA, 18 nt, Human
uucaguuugguuaaagga

SEQ ID NO: 270624 - RNA, 22 nt, Human
uugcacaccugacuugacacaa

SEQ ID NO: 270625 - RNA, 24 nt, Human
uuucacaguuaucaucucaguagu

SEQ ID NO: 270626 - RNA, 20 nt, Human
aaaaaaaaaaaaaaugcuca

SEQ ID NO: 270627 - RNA, 25 nt, Human
aaaaaaccccaaaacaaaaacguaa

SEQ ID NO: 270628 - RNA, 23 nt, Human
aaaacaaaaccagauaugaccuc

SEQ ID NO: 270629 - RNA, 19 nt, Human
aaaaugucauugacauuaa

SEQ ID NO: 270630 - RNA, 19 nt, Human
aaacaggagacuaaacaga

SEQ ID NO: 270631 - RNA, 22 nt, Human
aaacaguuggugaggacagguc

SEQ ID NO: 270632 - RNA, 24 nt, Human
aaaugucucuacuacaaacagcaa

SEQ ID NO: 270633 - RNA, 24 nt, Human
aaauuuguacaaaaaaaccccaaa

SEQ ID NO: 270634 - RNA, 18 nt, Human
aacgcauacaaacaggag

SEQ ID NO: 270635 - RNA, 20 nt, Human
acaaaaaaaccccaaaacaa

SEQ ID NO: 270636 - RNA, 21 nt, Human
acaaaaccagauaugaccucc

SEQ ID NO: 270637 - RNA, 23 nt, Human
acaaaaccagauaugaccuccau

SEQ ID NO: 270638 - RNA, 18 nt, Human
agaggguggaggugucag

SEQ ID NO: 270639 - RNA, 23 nt, Human
agcagugccaaguuucauucaaa

SEQ ID NO: 270640 - RNA, 18 nt, Human
agcauuaaguccuccuga

SEQ ID NO: 270641 - RNA, 20 nt, Human
agcucagaggaucaagucaa

SEQ ID NO: 270642 - RNA, 19 nt, Human
aggaacucaagcugggacc

SEQ ID NO: 270643 - RNA, 19 nt, Human
agguccccccggucccgca

SEQ ID NO: 270644 - RNA, 23 nt, Human
agugcguggugaaggcucggcuc

SEQ ID NO: 270645 - RNA, 24 nt, Human
aucacuaccagguaauuuucaacc

SEQ ID NO: 270646 - RNA, 19 nt, Human
auggugugauuccuuucaa

SEQ ID NO: 270647 - RNA, 23 nt, Human
caaaaaaaccccaaaacaaaaac

SEQ ID NO: 270648 - RNA, 23 nt, Human
caaaaccagauaugaccuccaug

SEQ ID NO: 270649 - RNA, 18 nt, Human
caacccugucucaaaugu

SEQ ID NO: 270650 - RNA, 19 nt, Human
caacucaggcaguacacgg

SEQ ID NO: 270651 - RNA, 18 nt, Human
caagaggcacaacucagg

SEQ ID NO: 270652 - RNA, 22 nt, Human
caccagcagccagauucacaau

SEQ ID NO: 270653 - RNA, 24 nt, Human
cagaggcacaacauaaauagcauu

SEQ ID NO: 270654 - RNA, 19 nt, Human
cagaguacuucaaaaauaa

SEQ ID NO: 270655 - RNA, 19 nt, Human
cagcagccagauucacaau

SEQ ID NO: 270656 - RNA, 22 nt, Human
cagcagccagauucacaauuga

SEQ ID NO: 270657 - RNA, 25 nt, Human
ccaauaagaaaaaggaaccaacacu

SEQ ID NO: 270658 - RNA, 19 nt, Human
ccagcagccagauucacaa

SEQ ID NO: 270659 - RNA, 19 nt, Human
ccagcggcugugcugcggc

SEQ ID NO: 270660 - RNA, 21 nt, Human
cccccggucccgcacccuacc

SEQ ID NO: 270661 - RNA, 20 nt, Human
ccccgcgcggggucugaggc

SEQ ID NO: 270662 - RNA, 21 nt, Human
ccccggucccgcacccuaccc

SEQ ID NO: 270663 - RNA, 19 nt, Human
ccccucugccuccaggucc

SEQ ID NO: 270664 - RNA, 19 nt, Human
cccgcacccuacccugcgg

SEQ ID NO: 270665 - RNA, 20 nt, Human
ccugacugccccgacagggu

SEQ ID NO: 270666 - RNA, 19 nt, Human
ccugcagcugcucucugcc

SEQ ID NO: 270667 - RNA, 21 nt, Human
ccugcagcugcucucugccau

SEQ ID NO: 270668 - RNA, 21 nt, Human
ccugucucaaauguguuagaa

SEQ ID NO: 270669 - RNA, 19 nt, Human
cgguucuccccucugccuc

SEQ ID NO: 270670 - RNA, 19 nt, Human
cuacuacaaacagcaaaga

SEQ ID NO: 270671 - RNA, 21 nt, Human
cugccaucgccucugcaaaag

SEQ ID NO: 270672 - RNA, 24 nt, Human
cugccuccagguccccccgguccc

SEQ ID NO: 270673 - RNA, 18 nt, Human
cuguagguuuuuggacaa

SEQ ID NO: 270674 - RNA, 20 nt, Human
gaaauucucucaaaguacuu

SEQ ID NO: 270675 - RNA, 22 nt, Human
gaacuuggacgagugcguggug

SEQ ID NO: 270676 - RNA, 20 nt, Human
gaagaacaaccacccccggu

SEQ ID NO: 270677 - RNA, 19 nt, Human
gcagguacccucaguccuc

SEQ ID NO: 270678 - RNA, 24 nt, Human
gccagggcaggguaaaaacggcaa

SEQ ID NO: 270679 - RNA, 24 nt, Human
gccccgacagggucuaggacaaca

SEQ ID NO: 270680 - RNA, 19 nt, Human
gcgccccgcgcggggucug

SEQ ID NO: 270681 - RNA, 25 nt, Human
gcucagaggaucaagucaagucucu

SEQ ID NO: 270682 - RNA, 18 nt, Human
gcugugcugcggcgcgga

SEQ ID NO: 270683 - RNA, 23 nt, Human
ggacaggucuguaggcucagcuu

SEQ ID NO: 270684 - RNA, 23 nt, Human
guacaugagacaucuuuaaucau

SEQ ID NO: 270685 - RNA, 24 nt, Human
guagaggguggaggugucagagua

SEQ ID NO: 270686 - RNA, 24 nt, Human
gugcagguacccucaguccucugc

SEQ ID NO: 270687 - RNA, 20 nt, Human
uaaaagaugacuguacagcg

SEQ ID NO: 270688 - RNA, 18 nt, Human
uacaaaaaaaccccaaaa

SEQ ID NO: 270689 - RNA, 21 nt, Human
uacacguggaaaagaaucaaa

SEQ ID NO: 270690 - RNA, 18 nt, Human
uacuacaaacagcaaaga

SEQ ID NO: 270691 - RNA, 21 nt, Human
ucacuaccagguaauuuucaa

SEQ ID NO: 270692 - RNA, 20 nt, Human
uccccccggucccgcacccu

SEQ ID NO: 270693 - RNA, 22 nt, Human
uccuuuuuauguaacaaacaga

SEQ ID NO: 270694 - RNA, 20 nt, Human
ucgccucugcaaaagucugu

SEQ ID NO: 270695 - RNA, 22 nt, Human
ucucuacuacaaacagcaaaga

SEQ ID NO: 270696 - RNA, 19 nt, Human
ucugccacuaccagcucaa

SEQ ID NO: 270697 - RNA, 20 nt, Human
ucuuuuagaaaccucaggcc

SEQ ID NO: 270698 - RNA, 19 nt, Human
ugagcucagaggaucaagu

SEQ ID NO: 270699 - RNA, 24 nt, Human
ugauaaaaaaauaaaaacaaaacc

SEQ ID NO: 270700 - RNA, 18 nt, Human
ugcagguacccucagucc

SEQ ID NO: 270701 - RNA, 21 nt, Human
ugccacuaccagcucaauagc

SEQ ID NO: 270702 - RNA, 19 nt, Human
ugcucucugccaucgccuc

SEQ ID NO: 270703 - RNA, 25 nt, Human
ugggaaaggcaggaacucaagcugg

SEQ ID NO: 270704 - RNA, 24 nt, Human
uggugaaggcucggcuccagggac

SEQ ID NO: 270705 - RNA, 18 nt, Human
uguagaaaucuaccuucu

SEQ ID NO: 270706 - RNA, 18 nt, Human
ugucuguagguuuuugga

SEQ ID NO: 270707 - RNA, 24 nt, Human
uucaaaaugucucuacuacaaaca

SEQ ID NO: 270708 - RNA, 23 nt, Human
uucauugucauuagaaaggaugu

SEQ ID NO: 270709 - RNA, 21 nt, Human
uugaagaacaaccacccccga

SEQ ID NO: 270710 - RNA, 18 nt, Human
uugaagcaugcaacaggu

SEQ ID NO: 270711 - RNA, 21 nt, Human
uuucaaccaauaagaaaaagg

SEQ ID NO: 270712 - RNA, 25 nt, Human
aagacauccccccuuaagugacccc

SEQ ID NO: 270713 - RNA, 23 nt, Human
aagcugccaaucacaugcauuuu

SEQ ID NO: 270714 - RNA, 21 nt, Human
aaguccauuuuaaaugcaccg

SEQ ID NO: 270715 - RNA, 24 nt, Human
aauuucccagguacauacaauauc

SEQ ID NO: 270716 - RNA, 22 nt, Human
acaucucaagacauccccccuu

SEQ ID NO: 270717 - RNA, 18 nt, Human
acccccuuccaacagcuu

SEQ ID NO: 270718 - RNA, 24 nt, Human
acugugcaugucaacgagguucuc

SEQ ID NO: 270719 - RNA, 19 nt, Human
aucucaagacauccccccu

SEQ ID NO: 270720 - RNA, 23 nt, Human
cagcuuaggaaaucggcaaauuu

SEQ ID NO: 270721 - RNA, 18 nt, Human
cauccccccuuaagugac

SEQ ID NO: 270722 - RNA, 19 nt, Human
cauccccccuuaagugacc

SEQ ID NO: 270723 - RNA, 27 nt, Human
ccccaaagacugaggagggagcaccuc

SEQ ID NO: 270724 - RNA, 23 nt, Human
cugagcuugcaugcaguccccuc

SEQ ID NO: 270725 - RNA, 22 nt, Human
cuuugcauaauacaucucaaga

SEQ ID NO: 270726 - RNA, 19 nt, Human
guacauacaauaucaugca

SEQ ID NO: 270727 - RNA, 24 nt, Human
gucuggagcccccaugggagaacc

SEQ ID NO: 270728 - RNA, 18 nt, Human
gugcaugucaacgagguu

SEQ ID NO: 270729 - RNA, 19 nt, Human
uaaaauacaaugucuggag

SEQ ID NO: 270730 - RNA, 20 nt, Human
uacaauaucaugcauuugaa

SEQ ID NO: 270731 - RNA, 24 nt, Human
uaucaugcauuugaaucccccaaa

SEQ ID NO: 270732 - RNA, 27 nt, Human
ucauauggcuuaaccuuuugcaaugga

SEQ ID NO: 270733 - RNA, 18 nt, Human
ucucaagacauccccccu

SEQ ID NO: 270734 - RNA, 27 nt, Human
ucucccaugaacaaaaguccauuuuaa

SEQ ID NO: 270735 - RNA, 19 nt, Human
ugucuggagcccccauggg

SEQ ID NO: 270736 - RNA, 23 nt, Human
uucucccaugaacaaaaguccau

SEQ ID NO: 270737 - RNA, 26 nt, Human
aauaacagcauuuuuuuuuuuuuuuu

SEQ ID NO: 270738 - RNA, 27 nt, Human
agaaaaagugaaaauuguguuacucug

SEQ ID NO: 270739 - RNA, 20 nt, Human
auaaagacagaaaaagugaa

SEQ ID NO: 270740 - RNA, 21 nt, Human
auuucuaacugcucauucauu

SEQ ID NO: 270741 - RNA, 23 nt, Human
auuuuuuuuuuuuuuuucauuuu

SEQ ID NO: 270742 - RNA, 22 nt, Human
cacauccagaccuccccugccc

SEQ ID NO: 270743 - RNA, 21 nt, Human
cagaauagagagcucugggca

SEQ ID NO: 270744 - RNA, 25 nt, Human
cagccuucccagggaaagagaauaa

SEQ ID NO: 270745 - RNA, 21 nt, Human
cauaauucaguggccagugcc

SEQ ID NO: 270746 - RNA, 24 nt, Human
cccggccccaccuggaccgcucuu

SEQ ID NO: 270747 - RNA, 18 nt, Human
ccgggacucuucugaguu

SEQ ID NO: 270748 - RNA, 21 nt, Human
cuaucauaauuguccaucgcc

SEQ ID NO: 270749 - RNA, 22 nt, Human
cuggaccgcucuuccagaauag

SEQ ID NO: 270750 - RNA, 22 nt, Human
cuguuugaagaaggaggccccg

SEQ ID NO: 270751 - RNA, 22 nt, Human
gagcucugggcaagggcuugac

SEQ ID NO: 270752 - RNA, 18 nt, Human
gcauuugggaauagguua

SEQ ID NO: 270753 - RNA, 19 nt, Human
gccuggggagggcaugggg

SEQ ID NO: 270754 - RNA, 20 nt, Human
gcuccgggacucuucugagu

SEQ ID NO: 270755 - RNA, 18 nt, Human
gggagggcaugggggcag

SEQ ID NO: 270756 - RNA, 24 nt, Human
gggcaagggcuugaccacuccuuu

SEQ ID NO: 270757 - RNA, 23 nt, Human
uaaaugcacuuauuuggaaagga

SEQ ID NO: 270758 - RNA, 19 nt, Human
uacauaaagacagaaaaag

SEQ ID NO: 270759 - RNA, 24 nt, Human
uauagucaaguguuuacguguggc

SEQ ID NO: 270760 - RNA, 25 nt, Human
uauuuggaaaggaggggggcaguua

SEQ ID NO: 270761 - RNA, 22 nt, Human
uccuuuggaaaacagaaggcau

SEQ ID NO: 270762 - RNA, 22 nt, Human
ucuucugaguuucuuuggcugu

SEQ ID NO: 270763 - RNA, 18 nt, Human
uggaaaggaggggggcag

SEQ ID NO: 270764 - RNA, 23 nt, Human
uggaaaggaggggggcaguuuuu

SEQ ID NO: 270765 - RNA, 19 nt, Human
uggcuguuccggauguucc

SEQ ID NO: 270766 - RNA, 21 nt, Human
uggggagggcaugggggcagg

SEQ ID NO: 270767 - RNA, 18 nt, Human
aaaagaagaaagaaaaau

SEQ ID NO: 270768 - RNA, 26 nt, Human
aacauuuuguacaauaguugcugaag

SEQ ID NO: 270769 - RNA, 20 nt, Human
aagaauucuuuuauuuagug

SEQ ID NO: 270770 - RNA, 23 nt, Human
aagcccccgagcagcacugaccc

SEQ ID NO: 270771 - RNA, 21 nt, Human
aagugcggagcuccagggacc

SEQ ID NO: 270772 - RNA, 19 nt, Human
acugacccgccaccccuac

SEQ ID NO: 270773 - RNA, 19 nt, Human
cacucagucauuuaaaacu

SEQ ID NO: 270774 - RNA, 19 nt, Human
cagcacugacccgccaccc

SEQ ID NO: 270775 - RNA, 18 nt, Human
caggauuaaaagcccaac

SEQ ID NO: 270776 - RNA, 20 nt, Human
cccccgagcagcacugaccc

SEQ ID NO: 270777 - RNA, 21 nt, Human
cccccgagcagcacugacccg

SEQ ID NO: 270778 - RNA, 27 nt, Human
cccccgagcagcacugacccgccaccc

SEQ ID NO: 270779 - RNA, 21 nt, Human
cccgccaccccuacucgugcc

SEQ ID NO: 270780 - RNA, 18 nt, Human
cugaagaacaguaaaacc

SEQ ID NO: 270781 - RNA, 24 nt, Human
gaccaaauugcaucuaacuggguu

SEQ ID NO: 270782 - RNA, 19 nt, Human
gaccaggaacuccagggac

SEQ ID NO: 270783 - RNA, 23 nt, Human
gagaagcccccgagcagcacuga

SEQ ID NO: 270784 - RNA, 19 nt, Human
gauggagaagcccccgagc

SEQ ID NO: 270785 - RNA, 22 nt, Human
uaaaagcccaaccaagaaagua

SEQ ID NO: 270786 - RNA, 20 nt, Human
uaaacagaaaaaaaaaaaga

SEQ ID NO: 270787 - RNA, 20 nt, Human
uaacuggguuuucuaagcuc

SEQ ID NO: 270788 - RNA, 26 nt, Human
uaauauuauuuuuucucccaagauuu

SEQ ID NO: 270789 - RNA, 21 nt, Human
uauguucuuaaaagaagaaag

SEQ ID NO: 270790 - RNA, 22 nt, Human
ucacagugaugaauuuucacaa

SEQ ID NO: 270791 - RNA, 21 nt, Human
ucagugagugcuacucuuccu

SEQ ID NO: 270792 - RNA, 18 nt, Human
uccagggaccuggaugga

SEQ ID NO: 270793 - RNA, 20 nt, Human
uccagggaccuggauggaga

SEQ ID NO: 270794 - RNA, 26 nt, Human
ucuguuaaacagaaaaaaaaaaagaa

SEQ ID NO: 270795 - RNA, 19 nt, Human
ugaagaacaguaaaaccaa

SEQ ID NO: 270796 - RNA, 19 nt, Human
ugacaauuguaagcauacc

SEQ ID NO: 270797 - RNA, 21 nt, Human
ugacccgccaccccuacucgu

SEQ ID NO: 270798 - RNA, 18 nt, Human
ugcgcgccaagugcggag

SEQ ID NO: 270799 - RNA, 19 nt, Human
uuacauccuguacacagcu

SEQ ID NO: 270800 - RNA, 23 nt, Human
uucacaaagcuaacagauuugaa

SEQ ID NO: 270801 - RNA, 20 nt, Human
uugguaauauuacauccugu

SEQ ID NO: 270802 - RNA, 19 nt, Human
uuuaaaaucucagacuuaa

SEQ ID NO: 270803 - RNA, 19 nt, Human
aaaaaagagauauaaaaca

SEQ ID NO: 270804 - RNA, 21 nt, Human
aaaaaagagauauaaaacagu

SEQ ID NO: 270805 - RNA, 22 nt, Human
aaaagaaauacagcugcucaag

SEQ ID NO: 270806 - RNA, 23 nt, Human
aaacaaacaacagauuuguccuc

SEQ ID NO: 270807 - RNA, 24 nt, Human
aaacaaacaacagauuuguccuca

SEQ ID NO: 270808 - RNA, 19 nt, Human
aaagagaauaugaaagcca

SEQ ID NO: 270809 - RNA, 21 nt, Human
aacaauagcaggaauuaugac

SEQ ID NO: 270810 - RNA, 21 nt, Human
aacauggaaagacaacuaaua

SEQ ID NO: 270811 - RNA, 26 nt, Human
acaaaaccauuauguaaaaacauacu

SEQ ID NO: 270812 - RNA, 20 nt, Human
acagaagugaaaauguacua

SEQ ID NO: 270813 - RNA, 18 nt, Human
agccgggcccgggcggga

SEQ ID NO: 270814 - RNA, 19 nt, Human
aggcagccgggcccgggcg

SEQ ID NO: 270815 - RNA, 21 nt, Human
agggcagcgggcggcaacaag

SEQ ID NO: 270816 - RNA, 18 nt, Human
auuauucuguucugucca

SEQ ID NO: 270817 - RNA, 18 nt, Human
auugcuggggcccggccc

SEQ ID NO: 270818 - RNA, 21 nt, Human
caaagagaauaugaaagccaa

SEQ ID NO: 270819 - RNA, 23 nt, Human
caacaagaagcucgguucaugcc

SEQ ID NO: 270820 - RNA, 22 nt, Human
caauauaaaauuuucaauccag

SEQ ID NO: 270821 - RNA, 21 nt, Human
cccgagagggggcaguggggg

SEQ ID NO: 270822 - RNA, 18 nt, Human
ccggcccgcgacgacgcc

SEQ ID NO: 270823 - RNA, 19 nt, Human
ccucgaauacagaagugaa

SEQ ID NO: 270824 - RNA, 25 nt, Human
ccucuuauuaaacaacuaauaaaau

SEQ ID NO: 270825 - RNA, 19 nt, Human
cggcggcagcggcggguag

SEQ ID NO: 270826 - RNA, 23 nt, Human
cucacaaagagaauaugaaagcc

SEQ ID NO: 270827 - RNA, 20 nt, Human
cuguccaauuucuuuucugu

SEQ ID NO: 270828 - RNA, 21 nt, Human
cuuacaguacaugaagacaaa

SEQ ID NO: 270829 - RNA, 22 nt, Human
gaagugaaaauguacuauucaa

SEQ ID NO: 270830 - RNA, 25 nt, Human
gaagugaaaauguacuauucaagga

SEQ ID NO: 270831 - RNA, 20 nt, Human
gacuuugcuuacaaauugcu

SEQ ID NO: 270832 - RNA, 22 nt, Human
ggaugcggcggcagcggcgggu

SEQ ID NO: 270833 - RNA, 27 nt, Human
uaaaaacauacugauuuacaaagccaa

SEQ ID NO: 270834 - RNA, 20 nt, Human
uaaaaauaggucuuuaauuc

SEQ ID NO: 270835 - RNA, 19 nt, Human
uaaaauuucuuuccuagau

SEQ ID NO: 270836 - RNA, 20 nt, Human
uaauuuaucaacuacuccuu

SEQ ID NO: 270837 - RNA, 20 nt, Human
uacagaagugaaaauguacu

SEQ ID NO: 270838 - RNA, 24 nt, Human
uagaaaagaaauacagcugcucaa

SEQ ID NO: 270839 - RNA, 20 nt, Human
uaguaccuuaaaaaaauaaa

SEQ ID NO: 270840 - RNA, 23 nt, Human
uauuaugucauuuguuucuccua

SEQ ID NO: 270841 - RNA, 21 nt, Human
uccaaaaacuaaauggaccug

SEQ ID NO: 270842 - RNA, 19 nt, Human
ucccucgaauacagaagug

SEQ ID NO: 270843 - RNA, 24 nt, Human
ucccucgaauacagaagugaaaau

SEQ ID NO: 270844 - RNA, 23 nt, Human
ugaagacaaacuucaggagacaa

SEQ ID NO: 270845 - RNA, 24 nt, Human
uggaaaaauaaaucuaacaaaacc

SEQ ID NO: 270846 - RNA, 18 nt, Human
uggaaagacaacuaauau

SEQ ID NO: 270847 - RNA, 22 nt, Human
uggaaagacaacuaauaucuua

SEQ ID NO: 270848 - RNA, 24 nt, Human
uggcccagagucgggaugcggcgg

SEQ ID NO: 270849 - RNA, 22 nt, Human
ugggggcggcuguugaggcagc

SEQ ID NO: 270850 - RNA, 18 nt, Human
uguugaggcagccgggcc

SEQ ID NO: 270851 - RNA, 25 nt, Human
uuaguaccuuaaaaaaauaaaauuc

SEQ ID NO: 270852 - RNA, 22 nt, Human
uucauaaaauuucuuuccuaga

SEQ ID NO: 270853 - RNA, 23 nt, Human
uuuaaaacauggaaagacaacua

SEQ ID NO: 270854 - RNA, 23 nt, Human
uuuauaauuuaucaacuacuccu

SEQ ID NO: 270855 - RNA, 18 nt, Human
uuucuuuugugauccugc

SEQ ID NO: 270856 - RNA, 23 nt, Human
aaaagauaccaagaacuaaacug

SEQ ID NO: 270857 - RNA, 21 nt, Human
aagagaagacgacucaaguaa

SEQ ID NO: 270858 - RNA, 25 nt, Human
aaggcugggcagccuuuuggggaac

SEQ ID NO: 270859 - RNA, 20 nt, Human
aaguugcagaaccagaauuu

SEQ ID NO: 270860 - RNA, 20 nt, Human
acagguguacauuaauucuc

SEQ ID NO: 270861 - RNA, 20 nt, Human
accaagaacuaaacugaacc

SEQ ID NO: 270862 - RNA, 23 nt, Human
accaccugcccuuauugacccag

SEQ ID NO: 270863 - RNA, 24 nt, Human
agauaccaagaacuaaacugaacc

SEQ ID NO: 270864 - RNA, 23 nt, Human
agcuguucuaggcuaccaggugg

SEQ ID NO: 270865 - RNA, 19 nt, Human
aggugucaggaaucaccug

SEQ ID NO: 270866 - RNA, 19 nt, Human
agucuucacaguuaauccu

SEQ ID NO: 270867 - RNA, 21 nt, Human
aguuugugaagggugaguggc

SEQ ID NO: 270868 - RNA, 22 nt, Human
auacagguguacauuaauucuc

SEQ ID NO: 270869 - RNA, 18 nt, Human
caaauucugucugucagc

SEQ ID NO: 270870 - RNA, 19 nt, Human
caagcccaaagucacgcua

SEQ ID NO: 270871 - RNA, 20 nt, Human
caccacuccacggaaaaaaa

SEQ ID NO: 270872 - RNA, 20 nt, Human
cagaacggcuaagaaacuug

SEQ ID NO: 270873 - RNA, 24 nt, Human
cagcagccgcccggcccugggugu

SEQ ID NO: 270874 - RNA, 22 nt, Human
cagcugagauuguccacaacag

SEQ ID NO: 270875 - RNA, 22 nt, Human
cagcuugauugaaaagauaccc

SEQ ID NO: 270876 - RNA, 20 nt, Human
caggaaaggccuggucagug

SEQ ID NO: 270877 - RNA, 27 nt, Human
cagguggccacucgaagagaagacgac

SEQ ID NO: 270878 - RNA, 21 nt, Human
caggugucaggaaucaccuga

SEQ ID NO: 270879 - RNA, 22 nt, Human
cauuacaauccagauacagggg

SEQ ID NO: 270880 - RNA, 21 nt, Human
ccaagcccaaagucacgcuag

SEQ ID NO: 270881 - RNA, 20 nt, Human
ccacggaaaaaaaugauuuc

SEQ ID NO: 270882 - RNA, 21 nt, Human
ccacggaaaaaaaugauuucc

SEQ ID NO: 270883 - RNA, 19 nt, Human
ccacucgaagagaagacga

SEQ ID NO: 270884 - RNA, 19 nt, Human
ccagcgcugcucuugucug

SEQ ID NO: 270885 - RNA, 21 nt, Human
cccaaagucacgcuaggaagu

SEQ ID NO: 270886 - RNA, 22 nt, Human
cgagggcacgaacggcgcgcgg

SEQ ID NO: 270887 - RNA, 24 nt, Human
cgagggcacgaacggcgcgcgggc

SEQ ID NO: 270888 - RNA, 19 nt, Human
cgggcucggcugccgcugg

SEQ ID NO: 270889 - RNA, 18 nt, Human
cguggcucgcugaaccac

SEQ ID NO: 270890 - RNA, 22 nt, Human
cuaggaaguugcagaaccagaa

SEQ ID NO: 270891 - RNA, 24 nt, Human
cuuaacacugaucaugaaaugaac

SEQ ID NO: 270892 - RNA, 25 nt, Human
gaaacuugcccaagcccaaagucac

SEQ ID NO: 270893 - RNA, 20 nt, Human
gaggugacgaaguuccuggu

SEQ ID NO: 270894 - RNA, 23 nt, Human
gaguuuucuuagguucacauuua

SEQ ID NO: 270895 - RNA, 21 nt, Human
gccagccucacgagggcacga

SEQ ID NO: 270896 - RNA, 19 nt, Human
gccugugacacucuggccc

SEQ ID NO: 270897 - RNA, 21 nt, Human
gcgccccucccucagcugcuc

SEQ ID NO: 270898 - RNA, 18 nt, Human
gcuggcuuugauaaggca

SEQ ID NO: 270899 - RNA, 18 nt, Human
guggaguuuucuuagguu

SEQ ID NO: 270900 - RNA, 22 nt, Human
guggccagcgccccucccucag

SEQ ID NO: 270901 - RNA, 19 nt, Human
uaaggcaaaguggugcugg

SEQ ID NO: 270902 - RNA, 22 nt, Human
uaccaagaacuaaacugaaccc

SEQ ID NO: 270903 - RNA, 22 nt, Human
uaggaaguugcagaaccagaau

SEQ ID NO: 270904 - RNA, 19 nt, Human
ucacuggaggaauuacccu

SEQ ID NO: 270905 - RNA, 18 nt, Human
ucagugaaugccugcagg

SEQ ID NO: 270906 - RNA, 24 nt, Human
ucagugaaugccugcaggcagcag

SEQ ID NO: 270907 - RNA, 20 nt, Human
uccaggaaaggccuggucag

SEQ ID NO: 270908 - RNA, 22 nt, Human
ucccaugcuuccuucccaugga

SEQ ID NO: 270909 - RNA, 18 nt, Human
ucccucagcugcucugcc

SEQ ID NO: 270910 - RNA, 21 nt, Human
ucccucagcugcucugccuuc

SEQ ID NO: 270911 - RNA, 24 nt, Human
ucccucagcugcucugccuucagc

SEQ ID NO: 270912 - RNA, 24 nt, Human
uccgugguccauggacuucaguuu

SEQ ID NO: 270913 - RNA, 21 nt, Human
ucuccugcaagucuccuguua

SEQ ID NO: 270914 - RNA, 22 nt, Human
ucuccugcaagucuccuguuag

SEQ ID NO: 270915 - RNA, 21 nt, Human
ucuuagcuguucuaggcuacc

SEQ ID NO: 270916 - RNA, 21 nt, Human
ugaaaagauaccaagaacuaa

SEQ ID NO: 270917 - RNA, 24 nt, Human
ugaaaagauaccaagaacuaaacu

SEQ ID NO: 270918 - RNA, 19 nt, Human
ugaauucuaaguaacuccc

SEQ ID NO: 270919 - RNA, 19 nt, Human
ugaauucuaaguaacuccc

SEQ ID NO: 270920 - RNA, 24 nt, Human
ugauugaaaagauaccaagaacua

SEQ ID NO: 270921 - RNA, 23 nt, Human
ugccaagaagaugcuccugcuuc

SEQ ID NO: 270922 - RNA, 19 nt, Human
ugccagccucacgagggca

SEQ ID NO: 270923 - RNA, 22 nt, Human
ugcccgaugccagcgcugcucu

SEQ ID NO: 270924 - RNA, 19 nt, Human
ugcuggcuuugauaaggca

SEQ ID NO: 270925 - RNA, 19 nt, Human
uggagagacugucgggcug

SEQ ID NO: 270926 - RNA, 19 nt, Human
uggcccgcgggcggcugga

SEQ ID NO: 270927 - RNA, 19 nt, Human
ugggaacaagaaauaagga

SEQ ID NO: 270928 - RNA, 21 nt, Human
uggggaaccugcugaacccug

SEQ ID NO: 270929 - RNA, 25 nt, Human
ugguccauggacuucaguuugugaa

SEQ ID NO: 270930 - RNA, 23 nt, Human
uucccgaugccuuuugccuguga

SEQ ID NO: 270931 - RNA, 19 nt, Human
uucugucugucagcaaucc

SEQ ID NO: 270932 - RNA, 22 nt, Human
uuuccuccaggaaaggccuggu

SEQ ID NO: 270933 - RNA, 22 nt, Human
aagcaacaggaacuuuagaacu

SEQ ID NO: 270934 - RNA, 18 nt, Human
acuuugguuacacucuuc

SEQ ID NO: 270935 - RNA, 22 nt, Human
auuaaucuuaacaccagacaua

SEQ ID NO: 270936 - RNA, 21 nt, Human
caaagcacacuagcucugaaa

SEQ ID NO: 270937 - RNA, 23 nt, Human
cugaagcaacaggaacuuuagaa

SEQ ID NO: 270938 - RNA, 18 nt, Human
cuucaugaucuugcaugu

SEQ ID NO: 270939 - RNA, 21 nt, Human
uacuuucaauuacuuugguua

SEQ ID NO: 270940 - RNA, 18 nt, Human
uagaacucagcucgugcc

SEQ ID NO: 270941 - RNA, 21 nt, Human
uuaaucuuaacaccagacaua

SEQ ID NO: 270942 - RNA, 18 nt, Human
uuagaacucagcucgugc

SEQ ID NO: 270943 - RNA, 30 nt, Human
aaaaaaacaaaacaaacaaaaaaaccaagg

SEQ ID NO: 270944 - RNA, 24 nt, Human
aaaaggagcugagucucucucuau

SEQ ID NO: 270945 - RNA, 20 nt, Human
aaaaggcaaccuccgaaaca

SEQ ID NO: 270946 - RNA, 21 nt, Human
aaacaaaaaaaccaaacuacc

SEQ ID NO: 270947 - RNA, 24 nt, Human
aaacaaaacaaacaaaaaaaccaa

SEQ ID NO: 270948 - RNA, 23 nt, Human
aacaaaacaaacaaaaaaaccaa

SEQ ID NO: 270949 - RNA, 23 nt, Human
acaaaacaaacaaaaaaaccaaa

SEQ ID NO: 270950 - RNA, 24 nt, Human
acaaaacaaacaaaaaaaccaaac

SEQ ID NO: 270951 - RNA, 20 nt, Human
acaaaauaaauaaaaggagc

SEQ ID NO: 270952 - RNA, 19 nt, Human
agaucauuuaaauguauuu

SEQ ID NO: 270953 - RNA, 20 nt, Human
agggggcaccgaagcuaggu

SEQ ID NO: 270954 - RNA, 21 nt, Human
aguacacaaaauaaacccaaa

SEQ ID NO: 270955 - RNA, 23 nt, Human
augagcaaagugguagguccaaa

SEQ ID NO: 270956 - RNA, 20 nt, Human
caaaaaaaccaaacuaccga

SEQ ID NO: 270957 - RNA, 18 nt, Human
caaaaggcaaccuccgaa

SEQ ID NO: 270958 - RNA, 21 nt, Human
caaaaggcaaccuccgaaaca

SEQ ID NO: 270959 - RNA, 22 nt, Human
caaaaggcaaccuccgaaacac

SEQ ID NO: 270960 - RNA, 22 nt, Human
caaacaaaaaaaccaaacuacc

SEQ ID NO: 270961 - RNA, 25 nt, Human
caacaaaauaaauaaaaggagcuga

SEQ ID NO: 270962 - RNA, 23 nt, Human
caacaggcaacuuuauuuuagaa

SEQ ID NO: 270963 - RNA, 21 nt, Human
caaccuccgaaacaccguccu

SEQ ID NO: 270964 - RNA, 22 nt, Human
caccuagacuagguuagcaaga

SEQ ID NO: 270965 - RNA, 26 nt, Human
ccuccgaaacaccguccucaggugga

SEQ ID NO: 270966 - RNA, 19 nt, Human
gcuuggagccgccaaacuu

SEQ ID NO: 270967 - RNA, 22 nt, Human
guccucagguggaaacuuuggc

SEQ ID NO: 270968 - RNA, 22 nt, Human
uaaaaaaacaaaacaaacaaaa

SEQ ID NO: 270969 - RNA, 25 nt, Human
uaaaucaacaaaauaaauaaaagga

SEQ ID NO: 270970 - RNA, 26 nt, Human
uagcagggggcaccgaagcuaggugg

SEQ ID NO: 270971 - RNA, 19 nt, Human
uaguacacaaaauaaaccc

SEQ ID NO: 270972 - RNA, 26 nt, Human
ucaaccauuuaccaugagaucauuua

SEQ ID NO: 270973 - RNA, 23 nt, Human
uccaaaaggcaaccuccgaaaca

SEQ ID NO: 270974 - RNA, 19 nt, Human
uuaguacacaaaauaaacc

SEQ ID NO: 270975 - RNA, 20 nt, Human
aacgagcuuauacugaacaa

SEQ ID NO: 270976 - RNA, 20 nt, Human
acccaauuuaaguuuuaacu

SEQ ID NO: 270977 - RNA, 20 nt, Human
acgguauauacuguacgccc

SEQ ID NO: 270978 - RNA, 21 nt, Human
agguaagagaaauauuuauuu

SEQ ID NO: 270979 - RNA, 24 nt, Human
aguaauuuuccuuuugugauuuug

SEQ ID NO: 270980 - RNA, 21 nt, Human
caaaucacccaauuuaaguuu

SEQ ID NO: 270981 - RNA, 22 nt, Human
caagaacgagcuuauacugaac

SEQ ID NO: 270982 - RNA, 20 nt, Human
caauggagaaagcuccggga

SEQ ID NO: 270983 - RNA, 24 nt, Human
cacaagaacgagcuuauacugaac

SEQ ID NO: 270984 - RNA, 23 nt, Human
caccagugaagcuagaggcuuuc

SEQ ID NO: 270985 - RNA, 19 nt, Human
ccucuguuguaaaggcaga

SEQ ID NO: 270986 - RNA, 20 nt, Human
cuagaggcuuucacagaucc

SEQ ID NO: 270987 - RNA, 24 nt, Human
cugacauuuuauuucuugcaguga

SEQ ID NO: 270988 - RNA, 20 nt, Human
cuugaggucuaauuuugccc

SEQ ID NO: 270989 - RNA, 22 nt, Human
gacaauggagaaagcuccggga

SEQ ID NO: 270990 - RNA, 25 nt, Human
gaggcuuucacagauccaaugggcu

SEQ ID NO: 270991 - RNA, 21 nt, Human
gggcucaggcuuucuauccag

SEQ ID NO: 270992 - RNA, 23 nt, Human
guaaaacaaggaaauagggauga

SEQ ID NO: 270993 - RNA, 23 nt, Human
gucaagcuccacaaauuucauaa

SEQ ID NO: 270994 - RNA, 18 nt, Human
guuuuaacuucuuuuugg

SEQ ID NO: 270995 - RNA, 24 nt, Human
uaacauguuauagcuucuuugcuu

SEQ ID NO: 270996 - RNA, 22 nt, Human
uaacuucuuuuuggucuuuuaa

SEQ ID NO: 270997 - RNA, 22 nt, Human
uaaugaaagaacauucuuuuaa

SEQ ID NO: 270998 - RNA, 21 nt, Human
uagaaaauauuaaguaaccau

SEQ ID NO: 270999 - RNA, 24 nt, Human
uagaaaauauuaaguaaccaugcc

SEQ ID NO: 271000 - RNA, 24 nt, Human
uagggaugacuuuuccuguuagaa

SEQ ID NO: 271001 - RNA, 30 nt, Human
ucucccucuguuguaaaggcagagacuggg

SEQ ID NO: 271002 - RNA, 21 nt, Human
ucuuugcuuuacuucugaaaa

SEQ ID NO: 271003 - RNA, 18 nt, Human
ugaggaaccuaacugauu

SEQ ID NO: 271004 - RNA, 20 nt, Human
uuaaguaaccaugccugugc

SEQ ID NO: 271005 - RNA, 21 nt, Human
uucauucacugccugacauuu

SEQ ID NO: 271006 - RNA, 26 nt, Human
uugaggucuaauuuugccccaguaau

SEQ ID NO: 271007 - RNA, 21 nt, Human
aaaauaauaaaaaaagcuuac

SEQ ID NO: 271008 - RNA, 18 nt, Human
aaacaagccaaccccagg

SEQ ID NO: 271009 - RNA, 21 nt, Human
aaacagcaaugcaacauuucc

SEQ ID NO: 271010 - RNA, 27 nt, Human
aaaccaaaaaacaagccaaccccagga

SEQ ID NO: 271011 - RNA, 19 nt, Human
aacaagcagucaaauguca

SEQ ID NO: 271012 - RNA, 20 nt, Human
aaccaaaaaacaagccaacc

SEQ ID NO: 271013 - RNA, 22 nt, Human
aagccaaccccaggaacgaccc

SEQ ID NO: 271014 - RNA, 19 nt, Human
aaugaaaccaaaaaacaag

SEQ ID NO: 271015 - RNA, 21 nt, Human
accaaaaaacaagccaacccc

SEQ ID NO: 271016 - RNA, 20 nt, Human
accccaggaacgacccacac

SEQ ID NO: 271017 - RNA, 22 nt, Human
accccaggaacgacccacacug

SEQ ID NO: 271018 - RNA, 19 nt, Human
agaucuguaaucucacagu

SEQ ID NO: 271019 - RNA, 18 nt, Human
agguggccaugccuggag

SEQ ID NO: 271020 - RNA, 18 nt, Human
agucugcuggcucauucu

SEQ ID NO: 271021 - RNA, 21 nt, Human
auaaaaaaagcuuacaaacag

SEQ ID NO: 271022 - RNA, 21 nt, Human
auaauuggaacaagccggggc

SEQ ID NO: 271023 - RNA, 23 nt, Human
augaaaccaaaaaacaagccaac

SEQ ID NO: 271024 - RNA, 21 nt, Human
caaaaaacaagccaaccccag

SEQ ID NO: 271025 - RNA, 23 nt, Human
caaaaaacaagccaaccccagga

SEQ ID NO: 271026 - RNA, 20 nt, Human
caaagacacggccugaccac

SEQ ID NO: 271027 - RNA, 18 nt, Human
cacugucaaagacuuucc

SEQ ID NO: 271028 - RNA, 24 nt, Human
cagccggucccucgcugcaagcuc

SEQ ID NO: 271029 - RNA, 22 nt, Human
caggaacgacccacacugucaa

SEQ ID NO: 271030 - RNA, 20 nt, Human
cauucuguguucucaagugc

SEQ ID NO: 271031 - RNA, 21 nt, Human
ccaguccugcagaauaucagc

SEQ ID NO: 271032 - RNA, 19 nt, Human
ccccaggaacgacccacac

SEQ ID NO: 271033 - RNA, 22 nt, Human
cccgggcgccgcugcuccagcc

SEQ ID NO: 271034 - RNA, 24 nt, Human
ccuccuucccucccgcgcgccuca

SEQ ID NO: 271035 - RNA, 23 nt, Human
ccucgcugcaagcucggcucccg

SEQ ID NO: 271036 - RNA, 18 nt, Human
ccucuucccuggacacaa

SEQ ID NO: 271037 - RNA, 18 nt, Human
cgccgcggagcccuugcc

SEQ ID NO: 271038 - RNA, 19 nt, Human
cgcugcuccagcccagccc

SEQ ID NO: 271039 - RNA, 18 nt, Human
cggcucccgggcgccgcu

SEQ ID NO: 271040 - RNA, 26 nt, Human
cucagaauuaaaaaauaaaaaugaaa

SEQ ID NO: 271041 - RNA, 18 nt, Human
cuccagcccagcccggcc

SEQ ID NO: 271042 - RNA, 24 nt, Human
cucccgggcgccgcugcuccagcc

SEQ ID NO: 271043 - RNA, 22 nt, Human
cuggagccagcccuacacagag

SEQ ID NO: 271044 - RNA, 18 nt, Human
cuuccaggcugaccaggg

SEQ ID NO: 271045 - RNA, 24 nt, Human
gaaaccaaaaaacaagccaacccc

SEQ ID NO: 271046 - RNA, 25 nt, Human
gccaaccccaggaacgagggaacgc

SEQ ID NO: 271047 - RNA, 19 nt, Human
gccgcggagcccuugccuc

SEQ ID NO: 271048 - RNA, 20 nt, Human
gcucccgggcgccgcugcuc

SEQ ID NO: 271049 - RNA, 23 nt, Human
ggcagcgcgacagcgccgcggag

SEQ ID NO: 271050 - RNA, 24 nt, Human
guugcacuucucgccucuucccug

SEQ ID NO: 271051 - RNA, 25 nt, Human
uaaaaaaagcuuacaaacagcaaug

SEQ ID NO: 271052 - RNA, 20 nt, Human
uacaauuccuuguuuucaag

SEQ ID NO: 271053 - RNA, 18 nt, Human
ucacagcacaaagacacg

SEQ ID NO: 271054 - RNA, 18 nt, Human
ucccgcgcgccucagccg

SEQ ID NO: 271055 - RNA, 18 nt, Human
ucccgggcgccgcugcuc

SEQ ID NO: 271056 - RNA, 22 nt, Human
ucgcugcaagcucggcucccgg

SEQ ID NO: 271057 - RNA, 23 nt, Human
ucgcugcaagcucggcucccggg

SEQ ID NO: 271058 - RNA, 19 nt, Human
ucuguguucucaagugcug

SEQ ID NO: 271059 - RNA, 21 nt, Human
ucuguguucucaagugcuguc

SEQ ID NO: 271060 - RNA, 21 nt, Human
ucuuccaggcugaccagggga

SEQ ID NO: 271061 - RNA, 22 nt, Human
ugaaaccaaaaaacaagccaac

SEQ ID NO: 271062 - RNA, 22 nt, Human
ugcagguugcacuucucgccuc

SEQ ID NO: 271063 - RNA, 21 nt, Human
ugcuccagcccagcccggccc

SEQ ID NO: 271064 - RNA, 23 nt, Human
uuaaaaaauaaaaaugaaaccaa

SEQ ID NO: 271065 - RNA, 19 nt, Human
uuuggcccauggugcccag

SEQ ID NO: 271066 - RNA, 24 nt, Human
uuuuuuuuuuuuuuuuuuucaaug

SEQ ID NO: 271067 - RNA, 18 nt, Human
ccuggucccuggccucaa

SEQ ID NO: 271068 - RNA, 20 nt, Human
ccuucuccuucuugaaggcc

SEQ ID NO: 271069 - RNA, 19 nt, Human
cgauagcgagccuuauucc

SEQ ID NO: 271070 - RNA, 21 nt, Human
cgcccugacuccggacuucug

SEQ ID NO: 271071 - RNA, 23 nt, Human
cgcucuggcccugggcuggggac

SEQ ID NO: 271072 - RNA, 22 nt, Human
cucagcuucaaugcaguacuuc

SEQ ID NO: 271073 - RNA, 23 nt, Human
cugaugauuagggacuccccgga

SEQ ID NO: 271074 - RNA, 18 nt, Human
cugcugccgccccggcgc

SEQ ID NO: 271075 - RNA, 19 nt, Human
cugggcagaaucugucccc

SEQ ID NO: 271076 - RNA, 23 nt, Human
cuucucgggaaggccaguggcuc

SEQ ID NO: 271077 - RNA, 18 nt, Human
gagcagcacaauggggcu

SEQ ID NO: 271078 - RNA, 19 nt, Human
gagcagcacaauggggcug

SEQ ID NO: 271079 - RNA, 19 nt, Human
gagcucacggcuuuggucc

SEQ ID NO: 271080 - RNA, 22 nt, Human
gccucaaguucuucucugguca

SEQ ID NO: 271081 - RNA, 22 nt, Human
uagauuuaaucuguaacuauga

SEQ ID NO: 271082 - RNA, 18 nt, Human
uagcagcaauuauggaug

SEQ ID NO: 271083 - RNA, 23 nt, Human
uagcgagccuuauuccuugaccu

SEQ ID NO: 271084 - RNA, 21 nt, Human
uccccucaguucacagagguu

SEQ ID NO: 271085 - RNA, 20 nt, Human
ucgcucuggcccugggcugg

SEQ ID NO: 271086 - RNA, 19 nt, Human
ucggagcagcacaaugggg

SEQ ID NO: 271087 - RNA, 23 nt, Human
ucuccaaagaggcucucauccac

SEQ ID NO: 271088 - RNA, 18 nt, Human
ucuggucaggacauggga

SEQ ID NO: 271089 - RNA, 19 nt, Human
ucuguaacuaugaaauguc

SEQ ID NO: 271090 - RNA, 19 nt, Human
ugaaaugucuagguuagca

SEQ ID NO: 271091 - RNA, 20 nt, Human
ugaccuguuggaagcggcag

SEQ ID NO: 271092 - RNA, 18 nt, Human
ugaguucucggaccaugu

SEQ ID NO: 271093 - RNA, 19 nt, Human
ugcgauccaagcccaaagc

SEQ ID NO: 271094 - RNA, 18 nt, Human
uggaagcggcagaagagg

SEQ ID NO: 271095 - RNA, 21 nt, Human
uggggcugucgcucuggcccu

SEQ ID NO: 271096 - RNA, 23 nt, Human
ugucgcucuggcccugggcuggg

SEQ ID NO: 271097 - RNA, 20 nt, Human
uucacagagguagcuggcag

SEQ ID NO: 271098 - RNA, 20 nt, Human
uuccuucuccuucuugaagg

SEQ ID NO: 271099 - RNA, 24 nt, Human
uuugcgcucagcuucaaugcagua

SEQ ID NO: 271100 - RNA, 21 nt, Human
acacagcucacagcccaagag

SEQ ID NO: 271101 - RNA, 24 nt, Human
agaggaagggggaagccaggggcc

SEQ ID NO: 271102 - RNA, 19 nt, Human
agaggggugucuggggucc

SEQ ID NO: 271103 - RNA, 25 nt, Human
agcagcagccuuagaacugggaugc

SEQ ID NO: 271104 - RNA, 18 nt, Human
agcugguuuuggcuuggg

SEQ ID NO: 271105 - RNA, 20 nt, Human
aggaaacuggucggcugggg

SEQ ID NO: 271106 - RNA, 22 nt, Human
agggggaagccaggggcccauu

SEQ ID NO: 271107 - RNA, 22 nt, Human
agggggcuggccugcuauaggg

SEQ ID NO: 271108 - RNA, 19 nt, Human
agugcagacaucagcugcc

SEQ ID NO: 271109 - RNA, 19 nt, Human
aucccacccagcagaggaa

SEQ ID NO: 271110 - RNA, 21 nt, Human
caagaggaagucaguccugcu

SEQ ID NO: 271111 - RNA, 19 nt, Human
caaucccacccagcagagg

SEQ ID NO: 271112 - RNA, 22 nt, Human
cacagcucacagcccaagaggu

SEQ ID NO: 271113 - RNA, 23 nt, Human
cacccccagccucugucuggcuc

SEQ ID NO: 271114 - RNA, 18 nt, Human
cagaacacagcucacagc

SEQ ID NO: 271115 - RNA, 18 nt, Human
cagcccccaaucccaccc

SEQ ID NO: 271116 - RNA, 20 nt, Human
cagcccccaaucccacccag

SEQ ID NO: 271117 - RNA, 24 nt, Human
caggggcccauuugggggcccagc

SEQ ID NO: 271118 - RNA, 21 nt, Human
caucagcugcccagagagccc

SEQ ID NO: 271119 - RNA, 18 nt, Human
ccaagaggugggcagacc

SEQ ID NO: 271120 - RNA, 22 nt, Human
ccaaucccacccagcagaggaa

SEQ ID NO: 271121 - RNA, 19 nt, Human
cccaagaggugggcagacc

SEQ ID NO: 271122 - RNA, 22 nt, Human
cccagcagaggaagccaagguc

SEQ ID NO: 271123 - RNA, 19 nt, Human
ccgggacaagaggaaguca

SEQ ID NO: 271124 - RNA, 21 nt, Human
ccugcuauagggggcggaggu

SEQ ID NO: 271125 - RNA, 18 nt, Human
cucccugguccuggagag

SEQ ID NO: 271126 - RNA, 22 nt, Human
cucucuguccccugcccagagg

SEQ ID NO: 271127 - RNA, 23 nt, Human
cugugacuggagcugguuuuggc

SEQ ID NO: 271128 - RNA, 23 nt, Human
cuugcaaagggcaggcaugcuca

SEQ ID NO: 271129 - RNA, 20 nt, Human
gaagccaggggcccauuugg

SEQ ID NO: 271130 - RNA, 19 nt, Human
gaaggcgggaggaaagggc

SEQ ID NO: 271131 - RNA, 18 nt, Human
gacccaguccagcuguga

SEQ ID NO: 271132 - RNA, 21 nt, Human
gaggaaacuggucggcugggg

SEQ ID NO: 271133 - RNA, 19 nt, Human
gaggugggcagacccaguc

SEQ ID NO: 271134 - RNA, 18 nt, Human
gagucaccaagggacagg

SEQ ID NO: 271135 - RNA, 23 nt, Human
gcuccccgagccugugucucucu

SEQ ID NO: 271136 - RNA, 18 nt, Human
gcugugacuggagcuggu

SEQ ID NO: 271137 - RNA, 18 nt, Human
ggaaaugggaagaugcug

SEQ ID NO: 271138 - RNA, 24 nt, Human
ggaaggacagaacacagcucacag

SEQ ID NO: 271139 - RNA, 18 nt, Human
ggaaggcgggaggaaagg

SEQ ID NO: 271140 - RNA, 25 nt, Human
ggacagaacacagcucacagcccaa

SEQ ID NO: 271141 - RNA, 20 nt, Human
ggagacuggggaggaagggg

SEQ ID NO: 271142 - RNA, 21 nt, Human
ggagguggauuuuccacucau

SEQ ID NO: 271143 - RNA, 25 nt, Human
ggcuuccuugggaagcucagggaug

SEQ ID NO: 271144 - RNA, 19 nt, Human
gggaguggaggguggauag

SEQ ID NO: 271145 - RNA, 18 nt, Human
gggcagucacaggacauc

SEQ ID NO: 271146 - RNA, 18 nt, Human
uauugcuuuugguuuccu

SEQ ID NO: 271147 - RNA, 21 nt, Human
ucaaucccuccuggccccuua

SEQ ID NO: 271148 - RNA, 22 nt, Human
uccccgagccugugucucucug

SEQ ID NO: 271149 - RNA, 18 nt, Human
uccuggagaggaaacugg

SEQ ID NO: 271150 - RNA, 20 nt, Human
uccuugggaagcucagggau

SEQ ID NO: 271151 - RNA, 18 nt, Human
ucggcugggggauggggu

SEQ ID NO: 271152 - RNA, 18 nt, Human
ucuaggucagcugguggg

SEQ ID NO: 271153 - RNA, 21 nt, Human
ucuccccaggaccccuucucc

SEQ ID NO: 271154 - RNA, 21 nt, Human
ucucccuccgaugggaggaag

SEQ ID NO: 271155 - RNA, 18 nt, Human
ucucucuguccccugccc

SEQ ID NO: 271156 - RNA, 18 nt, Human
ucugccuucccucccucu

SEQ ID NO: 271157 - RNA, 18 nt, Human
ucugccuucccucccucu

SEQ ID NO: 271158 - RNA, 18 nt, Human
ucuguccccugcccagag

SEQ ID NO: 271159 - RNA, 22 nt, Human
ugacaaacuucuugguuuccag

SEQ ID NO: 271160 - RNA, 19 nt, Human
ugacuggagcugguuuugg

SEQ ID NO: 271161 - RNA, 22 nt, Human
ugcagaggggugucuggggucc

SEQ ID NO: 271162 - RNA, 19 nt, Human
ugcccagagagcccugggc

SEQ ID NO: 271163 - RNA, 20 nt, Human
ugcccagagagcccugggcu

SEQ ID NO: 271164 - RNA, 23 nt, Human
ugcccuugauugguugcucugcc

SEQ ID NO: 271165 - RNA, 22 nt, Human
ugcucugccuucccucccucuu

SEQ ID NO: 271166 - RNA, 20 nt, Human
uggcugcagaggggugucug

SEQ ID NO: 271167 - RNA, 19 nt, Human
ugggacuugcagcaggaga

SEQ ID NO: 271168 - RNA, 19 nt, Human
uggggaggaagggggcugg

SEQ ID NO: 271169 - RNA, 24 nt, Human
uggggaggaagggggcuggccugc

SEQ ID NO: 271170 - RNA, 18 nt, Human
ugggggauggggucggag

SEQ ID NO: 271171 - RNA, 21 nt, Human
uguccugcauggaguaggggu

SEQ ID NO: 271172 - RNA, 20 nt, Human
uuuugagucucacccugccc

SEQ ID NO: 271173 - RNA, 19 nt, Human
uuuuuuuuuuuuaaugggc

SEQ ID NO: 271174 - RNA, 23 nt, Human
uuuuuuuuuuuuuuuuuaauggg

SEQ ID NO: 271175 - RNA, 26 nt, Human
aaaaaaagaaaaaagaacaaccaaaa

SEQ ID NO: 271176 - RNA, 20 nt, Human
aaaaaaagaaaaaagaacac

SEQ ID NO: 271177 - RNA, 25 nt, Human
aaaaaagaaaaaagaacaaccaaaa

SEQ ID NO: 271178 - RNA, 18 nt, Human
aaaaagaaaaaagaacaa

SEQ ID NO: 271179 - RNA, 19 nt, Human
aaacaaacagucucuccca

SEQ ID NO: 271180 - RNA, 21 nt, Human
aaauguuacaacugguauaaa

SEQ ID NO: 271181 - RNA, 22 nt, Human
aagaaacacuggcagaauucca

SEQ ID NO: 271182 - RNA, 31 nt, Human
aauauauauauauacacacacacacacagug

SEQ ID NO: 271183 - RNA, 19 nt, Human
acaacugguauaaaguaac

SEQ ID NO: 271184 - RNA, 19 nt, Human
acacacacacacacacaua

SEQ ID NO: 271185 - RNA, 27 nt, Human
acacacacacacacacauacacacaca

SEQ ID NO: 271186 - RNA, 23 nt, Human
acacacacacacacauacacaca

SEQ ID NO: 271187 - RNA, 28 nt, Human
acacacacacacauacacacacauuuuu

SEQ ID NO: 271188 - RNA, 19 nt, Human
acuccuccuccccccuuuc

SEQ ID NO: 271189 - RNA, 25 nt, Human
agaaaaaagaacaaccaaaaacaau

SEQ ID NO: 271190 - RNA, 20 nt, Human
aggaagaaaaauacuuuaaa

SEQ ID NO: 271191 - RNA, 22 nt, Human
aggaagaaaaauacuuuaaaga

SEQ ID NO: 271192 - RNA, 22 nt, Human
aggcaaauaaguccacgucccc

SEQ ID NO: 271193 - RNA, 23 nt, Human
auaaaaaccuccucaggcuuaug

SEQ ID NO: 271194 - RNA, 23 nt, Human
auaaagcauuccaguugauaaaa

SEQ ID NO: 271195 - RNA, 19 nt, Human
auccagaauuaagagaaaa

SEQ ID NO: 271196 - RNA, 20 nt, Human
aucuguauaucuuuagcugc

SEQ ID NO: 271197 - RNA, 24 nt, Human
caaaccuuuccaaucaauccacac

SEQ ID NO: 271198 - RNA, 25 nt, Human
caaauuuuuaacacauuucauuguu

SEQ ID NO: 271199 - RNA, 24 nt, Human
caaccagacauuuuacuugaagac

SEQ ID NO: 271200 - RNA, 21 nt, Human
caauccacaccgagucagcgc

SEQ ID NO: 271201 - RNA, 19 nt, Human
cacacacacacacacauac

SEQ ID NO: 271202 - RNA, 24 nt, Human
cacgggcuuuucuucccagagcuc

SEQ ID NO: 271203 - RNA, 19 nt, Human
cagguuaaaugaauguaaa

SEQ ID NO: 271204 - RNA, 23 nt, Human
cagguuaaaugaauguaaaauga

SEQ ID NO: 271205 - RNA, 20 nt, Human
cauuccauguagguuuuggg

SEQ ID NO: 271206 - RNA, 21 nt, Human
cauuccauguagguuuugggu

SEQ ID NO: 271207 - RNA, 23 nt, Human
cauuuggauggaucuauuuacag

SEQ ID NO: 271208 - RNA, 18 nt, Human
cccuaugaugcuccccuu

SEQ ID NO: 271209 - RNA, 21 nt, Human
ccuccuccccccuuucaaaga

SEQ ID NO: 271210 - RNA, 22 nt, Human
ccuuuccaaucaauccacaccg

SEQ ID NO: 271211 - RNA, 21 nt, Human
cuacucucuuuuccucucuuu

SEQ ID NO: 271212 - RNA, 23 nt, Human
cugccauuaaaaaaagaaaaaag

SEQ ID NO: 271213 - RNA, 21 nt, Human
cuucccagagcucggccaccc

SEQ ID NO: 271214 - RNA, 24 nt, Human
cuuuaaaaaaaaaaaggacugcaa

SEQ ID NO: 271215 - RNA, 18 nt, Human
cuuuuccucucuuuuucu

SEQ ID NO: 271216 - RNA, 24 nt, Human
gaaacauuuuguaauaaaagauuc

SEQ ID NO: 271217 - RNA, 22 nt, Human
gaaagccaugaugaauccagaa

SEQ ID NO: 271218 - RNA, 19 nt, Human
gcaaggcuuagcaaagaaa

SEQ ID NO: 271219 - RNA, 19 nt, Human
gcugccauuaaaaaaagaa

SEQ ID NO: 271220 - RNA, 21 nt, Human
ggcaaauaaguccacgucccc

SEQ ID NO: 271221 - RNA, 21 nt, Human
ggccaaauauauuucacagaa

SEQ ID NO: 271222 - RNA, 26 nt, Human
uaaaaaaagaaaaaagaacaaccaaa

SEQ ID NO: 271223 - RNA, 22 nt, Human
uaaaaaauaccaggcuuaccau

SEQ ID NO: 271224 - RNA, 25 nt, Human
uaaaagcaaaugcuaaaaacuacuu

SEQ ID NO: 271225 - RNA, 18 nt, Human
uaaauaauucaagaaaau

SEQ ID NO: 271226 - RNA, 25 nt, Human
uaacaguaaucuguauaucuuuagc

SEQ ID NO: 271227 - RNA, 21 nt, Human
uaacccuaugaugcuccccuu

SEQ ID NO: 271228 - RNA, 21 nt, Human
uaauauggucaaauuuuuaac

SEQ ID NO: 271229 - RNA, 20 nt, Human
uacaacugguauaaaguaac

SEQ ID NO: 271230 - RNA, 25 nt, Human
uacacacacacacacacauacacac

SEQ ID NO: 271231 - RNA, 23 nt, Human
uacaucaagccauuucauggguc

SEQ ID NO: 271232 - RNA, 21 nt, Human
uacuuuaaagacaugccaauu

SEQ ID NO: 271233 - RNA, 19 nt, Human
uagcugccauuaaaaaaag

SEQ ID NO: 271234 - RNA, 23 nt, Human
uagcugccauuaaaaaaagaaaa

SEQ ID NO: 271235 - RNA, 27 nt, Human
uagcugccauuaaaaaaagaaaaaaga

SEQ ID NO: 271236 - RNA, 19 nt, Human
uaguaucauucauuuguac

SEQ ID NO: 271237 - RNA, 20 nt, Human
uauaaucgggcuuuuacucc

SEQ ID NO: 271238 - RNA, 25 nt, Human
uauacacacacacacacacauacac

SEQ ID NO: 271239 - RNA, 25 nt, Human
uauauacacacacacacacacauac

SEQ ID NO: 271240 - RNA, 31 nt, Human; identical to SEQ ID NO: 251951

SEQ ID NO: 271241 - RNA, 20 nt, Human
ucaaaccuuuccaaucaauc

SEQ ID NO: 271242 - RNA, 19 nt, Human
ucaaagaugaugaucccau

SEQ ID NO: 271243 - RNA, 20 nt, Human
ucaccagucuuuuuccaucu

SEQ ID NO: 271244 - RNA, 21 nt, Human
ucaccagucuuuuuccaucuu

SEQ ID NO: 271245 - RNA, 22 nt, Human
ucauucauuuguacagagaaau

SEQ ID NO: 271246 - RNA, 21 nt, Human
uccagaauuaagagaaaaccc

SEQ ID NO: 271247 - RNA, 23 nt, Human
ucccaaguacucccucaaaccuu

SEQ ID NO: 271248 - RNA, 21 nt, Human
ucccagagcucggccacccuc

SEQ ID NO: 271249 - RNA, 20 nt, Human
uccccucgagccuucuacaa

SEQ ID NO: 271250 - RNA, 20 nt, Human
uccuccuccccccuuucaaa

SEQ ID NO: 271251 - RNA, 20 nt, Human
ucuacaacuuacuacacgcc

SEQ ID NO: 271252 - RNA, 22 nt, Human
ugaaaaacaaacuaauauaaaa

SEQ ID NO: 271253 - RNA, 24 nt, Human
ugaaaaacaaacuaauauaaagca

SEQ ID NO: 271254 - RNA, 26 nt, Human
ugaaaaggcaucaaaguaaaaaaaua

SEQ ID NO: 271255 - RNA, 21 nt, Human
ugaggaauguacagugaaaaa

SEQ ID NO: 271256 - RNA, 21 nt, Human
ugcaaaccaaggcaaauaagu

SEQ ID NO: 271257 - RNA, 24 nt, Human
ugcagguauugcaaaccaaggcaa

SEQ ID NO: 271258 - RNA, 23 nt, Human
ugccauuaaaaaaagaaaaaaga

SEQ ID NO: 271259 - RNA, 23 nt, Human
uuaacagaaacauuuuguaauaa

SEQ ID NO: 271260 - RNA, 19 nt, Human
uucacagaauagucaacac

SEQ ID NO: 271261 - RNA, 22 nt, Human
uuccaaucaauccacaccgagu

SEQ ID NO: 271262 - RNA, 23 nt, Human
uugggugccaauguuaaaauuuc

SEQ ID NO: 271263 - RNA, 22 nt, Human
uuuaaucaggaagaaaaauacu

SEQ ID NO: 271264 - RNA, 19 nt, Human
uuucaugggucuuuacccu

SEQ ID NO: 271265 - RNA, 19 nt, Human
uuuguaauaaaagauucac

SEQ ID NO: 271266 - RNA, 21 nt, Human
uuuuuuuuuuuuuuuuaauag

SEQ ID NO: 271267 - RNA, 19 nt, Human
aaaccaaauauccugccau

SEQ ID NO: 271268 - RNA, 23 nt, Human
aacugucuuucaggcgucuccag

SEQ ID NO: 271269 - RNA, 21 nt, Human
aaggcagaguccugaaggcag

SEQ ID NO: 271270 - RNA, 21 nt, Human
acccguguuccugaaggcaga

SEQ ID NO: 271271 - RNA, 23 nt, Human
acccuggcagcuagacuccacag

SEQ ID NO: 271272 - RNA, 18 nt, Human
agcuagacuccacagagu

SEQ ID NO: 271273 - RNA, 22 nt, Human
aggaagugauuucccugguaaa

SEQ ID NO: 271274 - RNA, 19 nt, Human
aggcagagagggugguggg

SEQ ID NO: 271275 - RNA, 20 nt, Human
aggcagagaggguggugggg

SEQ ID NO: 271276 - RNA, 21 nt, Human
aggcagagagggugguggggc

SEQ ID NO: 271277 - RNA, 21 nt, Human
agucagucaugguggugcacc

SEQ ID NO: 271278 - RNA, 22 nt, Human
caagacaggaccaaucaauguc

SEQ ID NO: 271279 - RNA, 23 nt, Human
cacccuuaagcccgccccggucu

SEQ ID NO: 271280 - RNA, 21 nt, Human
ccaaauauccugccaucuggg

SEQ ID NO: 271281 - RNA, 18 nt, Human
ccccggucuggaggcccc

SEQ ID NO: 271282 - RNA, 22 nt, Human
cccugaguucacauugauucaa

SEQ ID NO: 271283 - RNA, 21 nt, Human
ccgcacugccgcgacccuggc

SEQ ID NO: 271284 - RNA, 22 nt, Human
cuagacuccacagagucgggag

SEQ ID NO: 271285 - RNA, 19 nt, Human
cugaaggcagaauaccccu

SEQ ID NO: 271286 - RNA, 20 nt, Human
cugaaggcagaguccugaag

SEQ ID NO: 271287 - RNA, 25 nt, Human
cuuaccgcaacaccaaagaggaggc

SEQ ID NO: 271288 - RNA, 23 nt, Human
gaggcagagagggugguggggcc

SEQ ID NO: 271289 - RNA, 20 nt, Human
ggcagagagggugguggggc

SEQ ID NO: 271290 - RNA, 19 nt, Human
ggccccgccgcgcuucccg

SEQ ID NO: 271291 - RNA, 25 nt, Human
uaaaggaagauggaacugucuuuca

SEQ ID NO: 271292 - RNA, 24 nt, Human
uauccugccaucuggggacuuuca

SEQ ID NO: 271293 - RNA, 18 nt, Human
ucacuagaccugcccaag

SEQ ID NO: 271294 - RNA, 22 nt, Human
uccagcagacccucuacagacc

SEQ ID NO: 271295 - RNA, 21 nt, Human
uccccaguucccugaguucac

SEQ ID NO: 271296 - RNA, 18 nt, Human
uccugaaggcagaauacc

SEQ ID NO: 271297 - RNA, 20 nt, Human
ucuacagacccguguuccug

SEQ ID NO: 271298 - RNA, 22 nt, Human
ucuacagacccguguuccugaa

SEQ ID NO: 271299 - RNA, 22 nt, Human
ucuacagcucacuagaccugcc

SEQ ID NO: 271300 - RNA, 19 nt, Human
ucuuaccgcaacaccaaag

SEQ ID NO: 271301 - RNA, 19 nt, Human
ugaaggcagaguccugaag

SEQ ID NO: 271302 - RNA, 23 nt, Human
ugaaggcagaguccugaaggcag

SEQ ID NO: 271303 - RNA, 19 nt, Human
ugacccggacccuuuaaag

SEQ ID NO: 271304 - RNA, 18 nt, Human
ugauugauagucaguccu

SEQ ID NO: 271305 - RNA, 23 nt, Human
ugcccaagacaggaccaaucaau

SEQ ID NO: 271306 - RNA, 18 nt, Human
ugccgcgacccuggcagc

SEQ ID NO: 271307 - RNA, 23 nt, Human
ugccgcgacccuggcagcuagac

SEQ ID NO: 271308 - RNA, 23 nt, Human
uggaaagacaguauucucagaug

SEQ ID NO: 271309 - RNA, 25 nt, Human
uuccugaaggcagaguccugaaggc

SEQ ID NO: 271310 - RNA, 18 nt, Human
aaaaggguguggauauuu

SEQ ID NO: 271311 - RNA, 22 nt, Human
aaaauggaacaaaucauacaga

SEQ ID NO: 271312 - RNA, 18 nt, Human
aaccugagguccagagag

SEQ ID NO: 271313 - RNA, 21 nt, Human
aagaggaaaggacugaucuaa

SEQ ID NO: 271314 - RNA, 22 nt, Human
aagcagaacuacaaggcuguag

SEQ ID NO: 271315 - RNA, 19 nt, Human
aaggaguagcugggccagg

SEQ ID NO: 271316 - RNA, 23 nt, Human
acacauccaagguccaaaagcaa

SEQ ID NO: 271317 - RNA, 18 nt, Human
acagagcgagacccuguc

SEQ ID NO: 271318 - RNA, 20 nt, Human
acagagcgagacccugucuc

SEQ ID NO: 271319 - RNA, 25 nt, Human
acagagcgagacccugucucuaaaa

SEQ ID NO: 271320 - RNA, 19 nt, Human
accacugcacuccagccug

SEQ ID NO: 271321 - RNA, 24 nt, Human
accacugcacuccagccuggguga

SEQ ID NO: 271322 - RNA, 22 nt, Human
acccuaauaaaugaacuucagc

SEQ ID NO: 271323 - RNA, 21 nt, Human
acuccuugagggcaaagacug

SEQ ID NO: 271324 - RNA, 22 nt, Human
acucucauuuuacagauggaaa

SEQ ID NO: 271325 - RNA, 24 nt, Human
acugcacuccagccugggugacag

SEQ ID NO: 271326 - RNA, 26 nt, Human
acugcacuccagccugggugacagag

SEQ ID NO: 271327 - RNA, 20 nt, Human
agaaaaacaaacuugagaga

SEQ ID NO: 271328 - RNA, 28 nt, Human
agaaaaacaaacuugagagaaacccaga

SEQ ID NO: 271329 - RNA, 21 nt, Human
agagaaacccagaagccugga

SEQ ID NO: 271330 - RNA, 19 nt, Human
agccccccucuccccagcc

SEQ ID NO: 271331 - RNA, 24 nt, Human
agcgcuuuggaaggccuacguggg

SEQ ID NO: 271332 - RNA, 20 nt, Human
aggaagagaagguaagcaga

SEQ ID NO: 271333 - RNA, 21 nt, Human
aggaagagaagguaagcagaa

SEQ ID NO: 271334 - RNA, 24 nt, Human
aggaguuggaggcuguggugagcu

SEQ ID NO: 271335 - RNA, 24 nt, Human
agugcucuuuccacugcaguagcu

SEQ ID NO: 271336 - RNA, 22 nt, Human
aguuggaggcuguggugagcug

SEQ ID NO: 271337 - RNA, 23 nt, Human
augaggaagagaagguaagcaga

SEQ ID NO: 271338 - RNA, 24 nt, Human
auugcaccacugcacuccagccug

SEQ ID NO: 271339 - RNA, 23 nt, Human
auuuucauuuugcucuuuggagg

SEQ ID NO: 271340 - RNA, 20 nt, Human
caagccaguggcagagccag

SEQ ID NO: 271341 - RNA, 24 nt, Human
caagccuuggacagacgacuccag

SEQ ID NO: 271342 - RNA, 20 nt, Human
caauacgcacuauuauccaa

SEQ ID NO: 271343 - RNA, 22 nt, Human
cacauccaagguccaaaagcaa

SEQ ID NO: 271344 - RNA, 20 nt, Human
caccacugcacuccagccug

SEQ ID NO: 271345 - RNA, 26 nt, Human
caccacugcacuccagccugggugac

SEQ ID NO: 271346 - RNA, 22 nt, Human
cacuccagccugggugacagag

SEQ ID NO: 271347 - RNA, 24 nt, Human
cacuccagccugggugacagagcg

SEQ ID NO: 271348 - RNA, 19 nt, Human
cacugcacuccagccuggg

SEQ ID NO: 271349 - RNA, 21 nt, Human
cacugcacuccagccugggug

SEQ ID NO: 271350 - RNA, 22 nt, Human
cacugcacuccagccuggguga

SEQ ID NO: 271351 - RNA, 23 nt, Human
cacugcacuccagccugggugac

SEQ ID NO: 271352 - RNA, 24 nt, Human
cacugcacuccagccugggugaca

SEQ ID NO: 271353 - RNA, 24 nt, Human
cacugcacuccagccugggugaca

SEQ ID NO: 271354 - RNA, 24 nt, Human
cagagcgagacccugucucuaaaa

SEQ ID NO: 271355 - RNA, 22 nt, Human
cagcgcuuuggaaggccuacgu

SEQ ID NO: 271356 - RNA, 24 nt, Human
cagcgcuuuggaaggccuacgugg

SEQ ID NO: 271357 - RNA, 23 nt, Human
caggaccacauccuugucuucca

SEQ ID NO: 271358 - RNA, 18 nt, Human
caggaguuggaggcugug

SEQ ID NO: 271359 - RNA, 20 nt, Human
caggcacuaugcuugucccc

SEQ ID NO: 271360 - RNA, 21 nt, Human
caggugacacauccaaggucc

SEQ ID NO: 271361 - RNA, 19 nt, Human
caguagcuucuguuaaccu

SEQ ID NO: 271362 - RNA, 20 nt, Human
caucaccccaacauauagcc

SEQ ID NO: 271363 - RNA, 23 nt, Human
caucagaguccuuuaugcagcca

SEQ ID NO: 271364 - RNA, 21 nt, Human
caugacaccugcuuguaaccu

SEQ ID NO: 271365 - RNA, 22 nt, Human
ccaacaucuacaaagucuccca

SEQ ID NO: 271366 - RNA, 28 nt, Human
ccaacaucuacaaagucucccaccagcu

SEQ ID NO: 271367 - RNA, 20 nt, Human
ccacugcacuccagccuggg

SEQ ID NO: 271368 - RNA, 20 nt, Human
ccacugcacuccagccuggg

SEQ ID NO: 271369 - RNA, 21 nt, Human
ccacugcacuccagccugggu

SEQ ID NO: 271370 - RNA, 21 nt, Human
ccacugcacuccagccugggu

SEQ ID NO: 271371 - RNA, 24 nt, Human
ccacugcacuccagccugggugac

SEQ ID NO: 271372 - RNA, 25 nt, Human
ccacugcacuccagccugggugaca

SEQ ID NO: 271373 - RNA, 23 nt, Human
ccagccaaagaggaaaggacuga

SEQ ID NO: 271374 - RNA, 25 nt, Human
ccaugacaccugcuuguaaccucac

SEQ ID NO: 271375 - RNA, 23 nt, Human
cccaacaucuacaaagucuccca

SEQ ID NO: 271376 - RNA, 23 nt, Human
ccccauaaacuggugaacuccuu

SEQ ID NO: 271377 - RNA, 20 nt, Human
ccccccucuccccagccaaa

SEQ ID NO: 271378 - RNA, 26 nt, Human
ccggaauuuaagccccccucucccca

SEQ ID NO: 271379 - RNA, 19 nt, Human
ccucuaggauagagagccu

SEQ ID NO: 271380 - RNA, 20 nt, Human
ccugggugacagagcgagac

SEQ ID NO: 271381 - RNA, 19 nt, Human
ccugguggcuuaugccuac

SEQ ID NO: 271382 - RNA, 23 nt, Human
ccugucucuaaaauauaacaauu

SEQ ID NO: 271383 - RNA, 18 nt, Human
ccuuccugccaugacacc

SEQ ID NO: 271384 - RNA, 18 nt, Human
cggaauuuaagccccccu

SEQ ID NO: 271385 - RNA, 20 nt, Human
cuagagaucuuccuaauggu

SEQ ID NO: 271386 - RNA, 19 nt, Human
cucacagguaaaggaguag

SEQ ID NO: 271387 - RNA, 25 nt, Human
gaacaaaucauacagaucuggucuu

SEQ ID NO: 271388 - RNA, 20 nt, Human
gagaaaucuuagaaccaaua

SEQ ID NO: 271389 - RNA, 18 nt, Human
gagagaaacccagaagcc

SEQ ID NO: 271390 - RNA, 18 nt, Human
gaggaugccuugagccca

SEQ ID NO: 271391 - RNA, 24 nt, Human
gaugccuugagcccaggaguugga

SEQ ID NO: 271392 - RNA, 24 nt, Human
gcacuccagccugggugacagagc

SEQ ID NO: 271393 - RNA, 19 nt, Human
gccuacaaucucagcgcuu

SEQ ID NO: 271394 - RNA, 18 nt, Human
ggaggcuguggugagcug

SEQ ID NO: 271395 - RNA, 22 nt, Human
ggaggcuguggugagcugugau

SEQ ID NO: 271396 - RNA, 24 nt, Human
ggaggcuguggugagcugugauug

SEQ ID NO: 271397 - RNA, 23 nt, Human
ggccugguggcuuaugccuacaa

SEQ ID NO: 271398 - RNA, 24 nt, Human
gguggcuuaugccuacaaucucag

SEQ ID NO: 271399 - RNA, 24 nt, Human
uaagcagaacuacaaggcuguaga

SEQ ID NO: 271400 - RNA, 23 nt, Human
uaagccccccucuccccagccaa

SEQ ID NO: 271401 - RNA, 19 nt, Human
uacauacauagauuuguca

SEQ ID NO: 271402 - RNA, 20 nt, Human
uacauacauagauuugucac

SEQ ID NO: 271403 - RNA, 24 nt, Human
uacucucauuuuacagauggaaac

SEQ ID NO: 271404 - RNA, 19 nt, Human
uagccccauaaacugguga

SEQ ID NO: 271405 - RNA, 27 nt, Human
uauauauaauuuauguguguguauaua

SEQ ID NO: 271406 - RNA, 25 nt, Human
uauauucauauauauaauuuaugug

SEQ ID NO: 271407 - RNA, 24 nt, Human
uaugccuacaaucucagcgcuuug

SEQ ID NO: 271408 - RNA, 22 nt, Human
uauguguguguauauacacaca

SEQ ID NO: 271409 - RNA, 25 nt, Human
uauguguguguauauacacacauuu

SEQ ID NO: 271410 - RNA, 27 nt, Human
ucagcccaucaucaggguaaugccacc

SEQ ID NO: 271411 - RNA, 20 nt, Human
ucaggagcuaccaucacccc

SEQ ID NO: 271412 - RNA, 20 nt, Human
uccacugcaguagcuaaggc

SEQ ID NO: 271413 - RNA, 28 nt, Human
uccagagaguucaggugacagcggaccg

SEQ ID NO: 271414 - RNA, 23 nt, Human
uccagccugggugacagagcgag

SEQ ID NO: 271415 - RNA, 24 nt, Human
uccagccugggugacagagcgaga

SEQ ID NO: 271416 - RNA, 23 nt, Human
uccccagccaaagaggaaaggac

SEQ ID NO: 271417 - RNA, 19 nt, Human
uccccugguuuccauuuug

SEQ ID NO: 271418 - RNA, 19 nt, Human
uccugagaaaaacaaacuu

SEQ ID NO: 271419 - RNA, 25 nt, Human
ucuaggauagagagccuacagaacu

SEQ ID NO: 271420 - RNA, 24 nt, Human
ucuccuugcaaaauaugaaaauga

SEQ ID NO: 271421 - RNA, 21 nt, Human
ucuggucuuccuuccugccau

SEQ ID NO: 271422 - RNA, 22 nt, Human
ugacagagcgagacccugucuc

SEQ ID NO: 271423 - RNA, 19 nt, Human
ugagaagaugagaaaucuu

SEQ ID NO: 271424 - RNA, 21 nt, Human
ugcaccacugcacuccagccu

SEQ ID NO: 271425 - RNA, 21 nt, Human
ugcagccaggacuuacugauc

SEQ ID NO: 271426 - RNA, 20 nt, Human
ugcucaauuccucuaggaua

SEQ ID NO: 271427 - RNA, 21 nt, Human
uggaacaaaucauacagaucu

SEQ ID NO: 271428 - RNA, 19 nt, Human
uggaggcuguggugagcug

SEQ ID NO: 271429 - RNA, 24 nt, Human
uggcuuaugccuacaaucucagcg

SEQ ID NO: 271430 - RNA, 24 nt, Human
ugguggcuuaugccuacaaucuca

SEQ ID NO: 271431 - RNA, 19 nt, Human
uguagacuucaguagcuuc

SEQ ID NO: 271432 - RNA, 18 nt, Human
ugugaaaagguaaguccc

SEQ ID NO: 271433 - RNA, 25 nt, Human
uguguauauacacacauuuacauac

SEQ ID NO: 271434 - RNA, 24 nt, Human
uuaucuguagacuucaguagcuuc

SEQ ID NO: 271435 - RNA, 26 nt, Human
uucagcccaucaucaggguaaugcca

SEQ ID NO: 271436 - RNA, 22 nt, Human
uucagugcucuuuccacugcag

SEQ ID NO: 271437 - RNA, 21 nt, Human
uuccaugggccuacacaaaua

SEQ ID NO: 271438 - RNA, 21 nt, Human
uuccucuaggauagagagccu

SEQ ID NO: 271439 - RNA, 21 nt, Human
uuucucgcucuucuagcccca

SEQ ID NO: 271440 - RNA, 23 nt, Human
aaaaaggcucuguccaugccccu

SEQ ID NO: 271441 - RNA, 18 nt, Human
aaaaggcucuguccaugc

SEQ ID NO: 271442 - RNA, 22 nt, Human
acccacagggcagacauuccac

SEQ ID NO: 271443 - RNA, 26 nt, Human
acccaccaccccccaugcccgcccag

SEQ ID NO: 271444 - RNA, 22 nt, Human
agagggagggagggagggagag

SEQ ID NO: 271445 - RNA, 21 nt, Human
agcccccucucggcuuccccc

SEQ ID NO: 271446 - RNA, 19 nt, Human
aggagcucggagaggcagg

SEQ ID NO: 271447 - RNA, 28 nt, Human
aggcagguaggcgagcaccaccccagag

SEQ ID NO: 271448 - RNA, 18 nt, Human
agggacagagagggaggg

SEQ ID NO: 271449 - RNA, 20 nt, Human
agggagggagggagaggccc

SEQ ID NO: 271450 - RNA, 22 nt, Human
cacccacagggcagacauucca

SEQ ID NO: 271451 - RNA, 20 nt, Human
cacccaccaccccccaugcc

SEQ ID NO: 271452 - RNA, 25 nt, Human
cacccaccaccccccaugcccgccc

SEQ ID NO: 271453 - RNA, 20 nt, Human
ccaccaccccccaugcccgc

SEQ ID NO: 271454 - RNA, 22 nt, Human
cccaccaccccccaugcccgcc

SEQ ID NO: 271455 - RNA, 18 nt, Human
ccccucucccccuccccc

SEQ ID NO: 271456 - RNA, 24 nt, Human
ccccuggcuggcacccaccacccc

SEQ ID NO: 271457 - RNA, 20 nt, Human
cccuggccgggcccacccac

SEQ ID NO: 271458 - RNA, 25 nt, Human
cccuggcuggcacccaccacccccc

SEQ ID NO: 271459 - RNA, 21 nt, Human
cgcccagaggcguauggcuuu

SEQ ID NO: 271460 - RNA, 22 nt, Human
cggcuucccccucucccccucc

SEQ ID NO: 271461 - RNA, 23 nt, Human
gagaggcccuggccgggcccacc

SEQ ID NO: 271462 - RNA, 20 nt, Human
gaggagcucggagaggcagg

SEQ ID NO: 271463 - RNA, 20 nt, Human
gagggagggagggagaggcc

SEQ ID NO: 271464 - RNA, 19 nt, Human
gagggagggagggagggag

SEQ ID NO: 271465 - RNA, 18 nt, Human
ggcagacauuccacuugc

SEQ ID NO: 271466 - RNA, 18 nt, Human
ggggagaagccccuggug

SEQ ID NO: 271467 - RNA, 20 nt, Human
uagaaaaaggcucuguccau

SEQ ID NO: 271468 - RNA, 22 nt, Human
uccacuugcacagaggggaggg

SEQ ID NO: 271469 - RNA, 24 nt, Human
uccacuugcacagaggggaggggg

SEQ ID NO: 271470 - RNA, 19 nt, Human
ucccccucucccccucccc

SEQ ID NO: 271471 - RNA, 24 nt, Human
ucuuuagaaaaaggcucuguccau

SEQ ID NO: 271472 - RNA, 21 nt, Human
ugccaagggacagagagggag

SEQ ID NO: 271473 - RNA, 20 nt, Human
uggcacccaccaccccccau

SEQ ID NO: 271474 - RNA, 20 nt, Human
uguccauuugccaagggaca

SEQ ID NO: 271475 - RNA, 24 nt, Human
uucagggugggggagaauugagga

SEQ ID NO: 271476 - RNA, 22 nt, Human
aaaaaaaaacaaaaacaaaaag

SEQ ID NO: 271477 - RNA, 25 nt, Human
aaaaaaaaacaaaaacaaaaagcca

SEQ ID NO: 271478 - RNA, 23 nt, Human
aaaaacaaaaagccaucugaggg

SEQ ID NO: 271479 - RNA, 21 nt, Human
aaaaacccaaaaccacaaacc

SEQ ID NO: 271480 - RNA, 26 nt, Human
aaaaagccaucugagggggcagaggg

SEQ ID NO: 271481 - RNA, 19 nt, Human
aaacaaaaacaaaaagcca

SEQ ID NO: 271482 - RNA, 23 nt, Human
aaacaaaaacaaaaagccaucug

SEQ ID NO: 271483 - RNA, 24 nt, Human
aaacaaaaacaaaaagccaucuga

SEQ ID NO: 271484 - RNA, 20 nt, Human
aaacaaacaaaaaaaaccca

SEQ ID NO: 271485 - RNA, 22 nt, Human
aaacaaacaaaaaaaacccaaa

SEQ ID NO: 271486 - RNA, 23 nt, Human
aaacaaacaaaaaaaacccaaaa

SEQ ID NO: 271487 - RNA, 23 nt, Human
aaacaaacaaaaaaaacccaaaa

SEQ ID NO: 271488 - RNA, 23 nt, Human
aaacaaacaaacaaaaaaaaccc

SEQ ID NO: 271489 - RNA, 26 nt, Human
aacaaaaaaaacccaaaaccacaaac

SEQ ID NO: 271490 - RNA, 21 nt, Human
aaccaugauaacccagcucug

SEQ ID NO: 271491 - RNA, 22 nt, Human
aacccaaaaccacaaaccaaau

SEQ ID NO: 271492 - RNA, 18 nt, Human
aacccuucuccccagccc

SEQ ID NO: 271493 - RNA, 19 nt, Human
aacccuucuccccagccca

SEQ ID NO: 271494 - RNA, 23 nt, Human
aacucaccuacaaacaaacaaac

SEQ ID NO: 271495 - RNA, 18 nt, Human
aagaaagagaagguaggc

SEQ ID NO: 271496 - RNA, 19 nt, Human
aagaacucccgagucacac

SEQ ID NO: 271497 - RNA, 21 nt, Human
aagcagcagccaccccugcac

SEQ ID NO: 271498 - RNA, 24 nt, Human
aagccaaccaugauaacccagcuc

SEQ ID NO: 271499 - RNA, 22 nt, Human
acaaacaaaaaaaacccaaaac

SEQ ID NO: 271500 - RNA, 26 nt, Human
acaaacaaaaaaaacccaaaaccaca

SEQ ID NO: 271501 - RNA, 25 nt, Human
acaaacaaacaaacaaaaaaaaccc

SEQ ID NO: 271502 - RNA, 19 nt, Human
acccacaccuccccaccca

SEQ ID NO: 271503 - RNA, 18 nt, Human
acccacugcaaggccagc

SEQ ID NO: 271504 - RNA, 22 nt, Human
accccccucuccccaaaccuuc

SEQ ID NO: 271505 - RNA, 20 nt, Human
accuacaaacaaacaaacaa

SEQ ID NO: 271506 - RNA, 22 nt, Human
agaagaccaacccuucucccca

SEQ ID NO: 271507 - RNA, 21 nt, Human
agaagguaggcauaggucaga

SEQ ID NO: 271508 - RNA, 23 nt, Human
agacauggcaugaggcugcagcc

SEQ ID NO: 271509 - RNA, 23 nt, Human
agagagacauggcaugaggcugc

SEQ ID NO: 271510 - RNA, 22 nt, Human
agaggcagcccuugccuccuca

SEQ ID NO: 271511 - RNA, 24 nt, Human
agagguaaugagaugauggcuucc

SEQ ID NO: 271512 - RNA, 23 nt, Human
agauuagggcaggcugagauccc

SEQ ID NO: 271513 - RNA, 21 nt, Human
agcacaaaggcccagccugag

SEQ ID NO: 271514 - RNA, 20 nt, Human
agcagcagccaccccugcac

SEQ ID NO: 271515 - RNA, 19 nt, Human
agccaggacaggauccucc

SEQ ID NO: 271516 - RNA, 20 nt, Human
aggaaaaguuuccaaaauga

SEQ ID NO: 271517 - RNA, 24 nt, Human
aggagcugggugcagagacgggag

SEQ ID NO: 271518 - RNA, 27 nt, Human
aggccagggcaggcagggcugagagga

SEQ ID NO: 271519 - RNA, 19 nt, Human
agggcaaaugagccuaaaa

SEQ ID NO: 271520 - RNA, 19 nt, Human
aggggcccagaaccuggag

SEQ ID NO: 271521 - RNA, 19 nt, Human
agggggcagagggcuggga

SEQ ID NO: 271522 - RNA, 21 nt, Human
agggggcuacgacucggccag

SEQ ID NO: 271523 - RNA, 23 nt, Human
agguguuagaggcagcccuugcc

SEQ ID NO: 271524 - RNA, 18 nt, Human
agugggagagagacaugg

SEQ ID NO: 271525 - RNA, 24 nt, Human
caaaaaaaaacaaaaacaaaaagc

SEQ ID NO: 271526 - RNA, 19 nt, Human
caaaaaaaacccaaaacca

SEQ ID NO: 271527 - RNA, 25 nt, Human
caaaaaaaacccaaaaccacaaacc

SEQ ID NO: 271528 - RNA, 19 nt, Human
caaaaacaaaaagccaucu

SEQ ID NO: 271529 - RNA, 22 nt, Human
caaacaaaaaaaacccaaaacc

SEQ ID NO: 271530 - RNA, 24 nt, Human
caaacaaaaaaaacccaaaaccac

SEQ ID NO: 271531 - RNA, 24 nt, Human
caaacaaacaaaaaaaacccaaaa

SEQ ID NO: 271532 - RNA, 21 nt, Human
caaaugagccuaaaauccacu

SEQ ID NO: 271533 - RNA, 25 nt, Human
caaccaccagccucucacccccagc

SEQ ID NO: 271534 - RNA, 18 nt, Human
caacccuucuccccagcc

SEQ ID NO: 271535 - RNA, 19 nt, Human
caaucacagcgacccaagu

SEQ ID NO: 271536 - RNA, 21 nt, Human
cacacagaaagccugccccuc

SEQ ID NO: 271537 - RNA, 19 nt, Human
cacacagcuggucaguggc

SEQ ID NO: 271538 - RNA, 22 nt, Human
cacacagcuggucaguggccag

SEQ ID NO: 271539 - RNA, 21 nt, Human
cacacccuuucccagguaccc

SEQ ID NO: 271540 - RNA, 22 nt, Human
cacccagggcccuggcccaucc

SEQ ID NO: 271541 - RNA, 23 nt, Human
caccuacaaacaaacaaacaaaa

SEQ ID NO: 271542 - RNA, 24 nt, Human
caccugagguaccuaagccaaccu

SEQ ID NO: 271543 - RNA, 23 nt, Human
cacugacagagguaaugagauga

SEQ ID NO: 271544 - RNA, 23 nt, Human
cacugcaaggccagcacaaaggc

SEQ ID NO: 271545 - RNA, 23 nt, Human
cagaagaccaacccuucucccca

SEQ ID NO: 271546 - RNA, 21 nt, Human
cagacaccuccuagaaaccug

SEQ ID NO: 271547 - RNA, 21 nt, Human
cagccaggacaggauccuccc

SEQ ID NO: 271548 - RNA, 23 nt, Human
cagccaggacaggauccuccccu

SEQ ID NO: 271549 - RNA, 30 nt, Human
cagccaggacaggauccuccccuucucagg

SEQ ID NO: 271550 - RNA, 20 nt, Human
cagccucugggaucccuggc

SEQ ID NO: 271551 - RNA, 24 nt, Human
caggacuaaaacccaugcccugcc

SEQ ID NO: 271552 - RNA, 19 nt, Human
caggggcccagaaccugga

SEQ ID NO: 271553 - RNA, 21 nt, Human
cagggucagugacuggguagu

SEQ ID NO: 271554 - RNA, 20 nt, Human
cagguagugggagagagaca

SEQ ID NO: 271555 - RNA, 25 nt, Human
caguggccaggacuaaaacccaugc

SEQ ID NO: 271556 - RNA, 24 nt, Human
caucagguagugggagagagacca

SEQ ID NO: 271557 - RNA, 25 nt, Human
ccacacacccacugcaaggccagca

SEQ ID NO: 271558 - RNA, 19 nt, Human
ccacauguccuggcucagg

SEQ ID NO: 271559 - RNA, 19 nt, Human
ccacccccuggcagcccuc

SEQ ID NO: 271560 - RNA, 22 nt, Human
ccagccucucacccccagcugc

SEQ ID NO: 271561 - RNA, 19 nt, Human
ccaggacgggaggcaacca

SEQ ID NO: 271562 - RNA, 22 nt, Human
ccagggaacccacaccucccca

SEQ ID NO: 271563 - RNA, 24 nt, Human
cccaaaaccacaaaccaaauaaau

SEQ ID NO: 271564 - RNA, 21 nt, Human
cccaacccucagccucuggga

SEQ ID NO: 271565 - RNA, 30 nt, Human
cccaacccucagccucugggaucccuggcc

SEQ ID NO: 271566 - RNA, 22 nt, Human
cccacacacccacugcaaggcc

SEQ ID NO: 271567 - RNA, 23 nt, Human
cccacacacccacugcaaggcca

SEQ ID NO: 271568 - RNA, 27 nt, Human
cccacacacccacugcaaggccagcac

SEQ ID NO: 271569 - RNA, 22 nt, Human
cccaggccagggcaggcagggc

SEQ ID NO: 271570 - RNA, 22 nt, Human
cccagggaacccacaccucccc

SEQ ID NO: 271571 - RNA, 19 nt, Human
cccagggcgguuguugagc

SEQ ID NO: 271572 - RNA, 19 nt, Human
cccagggucagugacuggg

SEQ ID NO: 271573 - RNA, 21 nt, Human
cccauaccgaagggcuacccc

SEQ ID NO: 271574 - RNA, 20 nt, Human
cccaugcccugccugccaca

SEQ ID NO: 271575 - RNA, 23 nt, Human
ccccaacccucagccucugggau

SEQ ID NO: 271576 - RNA, 20 nt, Human
ccccacacacaaaggcagca

SEQ ID NO: 271577 - RNA, 19 nt, Human
ccccagaacuuagagaacc

SEQ ID NO: 271578 - RNA, 21 nt, Human
ccccagaacuuagagaaccuc

SEQ ID NO: 271579 - RNA, 21 nt, Human
ccccccaacccucagccucug

SEQ ID NO: 271580 - RNA, 23 nt, Human
ccccccaacccucagccucuggg

SEQ ID NO: 271581 - RNA, 27 nt, Human
ccccccucuccccaaaccggguccuuc

SEQ ID NO: 271582 - RNA, 23 nt, Human
ccccccucuccccaaaccuucaa

SEQ ID NO: 271583 - RNA, 24 nt, Human
ccccucccucugcccggugauuug

SEQ ID NO: 271584 - RNA, 24 nt, Human
ccccuccuuauggaguuccaauuc

SEQ ID NO: 271585 - RNA, 20 nt, Human
ccccugggcaauggcaucca

SEQ ID NO: 271586 - RNA, 22 nt, Human
ccccugggcaauggcauccagc

SEQ ID NO: 271587 - RNA, 20 nt, Human
cccucagccucugggauccc

SEQ ID NO: 271588 - RNA, 18 nt, Human
cccucccugccugauacc

SEQ ID NO: 271589 - RNA, 20 nt, Human
cccugccugccacacagagg

SEQ ID NO: 271590 - RNA, 20 nt, Human
ccgaagggcuaccccugggc

SEQ ID NO: 271591 - RNA, 22 nt, Human
ccuacgaacaggcucccugccc

SEQ ID NO: 271592 - RNA, 22 nt, Human
ccuaggcccuggacagcacaag

SEQ ID NO: 271593 - RNA, 20 nt, Human
ccucagccacacccuuuccc

SEQ ID NO: 271594 - RNA, 21 nt, Human
ccugagguaccuaagccaagg

SEQ ID NO: 271595 - RNA, 20 nt, Human
ccugauaccccccucucccc

SEQ ID NO: 271596 - RNA, 19 nt, Human
ccuggcacaccacccccug

SEQ ID NO: 271597 - RNA, 23 nt, Human
ccuggcccacacuaggaacacug

SEQ ID NO: 271598 - RNA, 20 nt, Human
cggccuccucuccuccccuc

SEQ ID NO: 271599 - RNA, 21 nt, Human
cggccuccucuccuccccucc

SEQ ID NO: 271600 - RNA, 24 nt, Human
cuaaaacccaugcccugccugcca

SEQ ID NO: 271601 - RNA, 25 nt, Human
cuaaaacccaugcccugccugccac

SEQ ID NO: 271602 - RNA, 23 nt, Human
cuaaaauccacuccaugcugcac

SEQ ID NO: 271603 - RNA, 28 nt, Human
cuacaaacaaacaaacaaaaaaaaccca

SEQ ID NO: 271604 - RNA, 19 nt, Human
cuaggaacacuggcccucc

SEQ ID NO: 271605 - RNA, 20 nt, Human
cucugcagccuguccaugug

SEQ ID NO: 271606 - RNA, 20 nt, Human
cucugggugaccaucagccc

SEQ ID NO: 271607 - RNA, 25 nt, Human
cugagguccuggcacaccacccccu

SEQ ID NO: 271608 - RNA, 20 nt, Human
cugcccaggacgggaggcaa

SEQ ID NO: 271609 - RNA, 23 nt, Human
cugccugauaccccccucucccc

SEQ ID NO: 271610 - RNA, 23 nt, Human
cuggagcccucugcagccugucc

SEQ ID NO: 271611 - RNA, 24 nt, Human
cuggagcccucugcagccugucca

SEQ ID NO: 271612 - RNA, 20 nt, Human
cuggcccacacuaggaacac

SEQ ID NO: 271613 - RNA, 21 nt, Human
cuggcccaggaggaagggugc

SEQ ID NO: 271614 - RNA, 18 nt, Human
cuuggcccagggaaccca

SEQ ID NO: 271615 - RNA, 19 nt, Human
gaacccacaccuccccacc

SEQ ID NO: 271616 - RNA, 20 nt, Human
gaacccacaccuccccaccc

SEQ ID NO: 271617 - RNA, 22 nt, Human
gaacuuagagaaccuggaggug

SEQ ID NO: 271618 - RNA, 20 nt, Human
gacccaagugcacaagggaa

SEQ ID NO: 271619 - RNA, 20 nt, Human
gagcccucugcagccugucc

SEQ ID NO: 271620 - RNA, 18 nt, Human
gagggggcagagggcugg

SEQ ID NO: 271621 - RNA, 20 nt, Human
gaguaaaaaggcuggucuug

SEQ ID NO: 271622 - RNA, 22 nt, Human
gauccuccccuucucagccagg

SEQ ID NO: 271623 - RNA, 23 nt, Human
gauggaugcaaaaaaaaacaaaa

SEQ ID NO: 271624 - RNA, 19 nt, Human
gcaggagcugaggugcggu

SEQ ID NO: 271625 - RNA, 19 nt, Human
gcagggaacgaagaaagag

SEQ ID NO: 271626 - RNA, 20 nt, Human
gcaugcagagaggagcuggg

SEQ ID NO: 271627 - RNA, 18 nt, Human
gccagcccccgcucccuc

SEQ ID NO: 271628 - RNA, 18 nt, Human
gcccagaggaagguacau

SEQ ID NO: 271629 - RNA, 19 nt, Human
gcccggugauuugccucug

SEQ ID NO: 271630 - RNA, 20 nt, Human
gcccuggacagcacaagaua

SEQ ID NO: 271631 - RNA, 22 nt, Human
gccucucacccccagcugccau

SEQ ID NO: 271632 - RNA, 19 nt, Human
gccugagguccuggcacac

SEQ ID NO: 271633 - RNA, 23 nt, Human
gccugauaccccccucuccccaa

SEQ ID NO: 271634 - RNA, 24 nt, Human
gcuucaguuucccauguuuaauag

SEQ ID NO: 271635 - RNA, 26 nt, Human
ggaaggcuacagccaggacaggaucc

SEQ ID NO: 271636 - RNA, 18 nt, Human
ggacaggauccuccccuu

SEQ ID NO: 271637 - RNA, 21 nt, Human
ggagucaggggaagauacugc

SEQ ID NO: 271638 - RNA, 21 nt, Human
gggagagacagggagagugcg

SEQ ID NO: 271639 - RNA, 19 nt, Human
gggcccuggcccaucccag

SEQ ID NO: 271640 - RNA, 20 nt, Human
gguagggcuggguaugagcu

SEQ ID NO: 271641 - RNA, 21 nt, Human
ggugcagagacgggagagaca

SEQ ID NO: 271642 - RNA, 20 nt, Human
gugcagucucugauggaugc

SEQ ID NO: 271643 - RNA, 19 nt, Human
gugcggccuccucuccucc

SEQ ID NO: 271644 - RNA, 23 nt, Human
uacaaacaaacaaacaaaaaaaa

SEQ ID NO: 271645 - RNA, 24 nt, Human
uacaaacaaacaaacaaaaaaaac

SEQ ID NO: 271646 - RNA, 23 nt, Human
uacagccaggacaggauccuccc

SEQ ID NO: 271647 - RNA, 20 nt, Human
uaccccccucuccccaaacc

SEQ ID NO: 271648 - RNA, 24 nt, Human
uagggacccuggcagaagaccaac

SEQ ID NO: 271649 - RNA, 22 nt, Human
ucacacagaaagccugccccuc

SEQ ID NO: 271650 - RNA, 21 nt, Human
ucacagcgacccaagugcaca

SEQ ID NO: 271651 - RNA, 21 nt, Human
ucagcagguggggcgcucccu

SEQ ID NO: 271652 - RNA, 19 nt, Human
ucagccacacccuuuccca

SEQ ID NO: 271653 - RNA, 28 nt, Human
ucaguggccaggacuaaaaccggggucc

SEQ ID NO: 271654 - RNA, 23 nt, Human
uccaugugcccaucagguagugg

SEQ ID NO: 271655 - RNA, 22 nt, Human
ucccagguaccccacacacaaa

SEQ ID NO: 271656 - RNA, 24 nt, Human
uccccaaaccuucaagggcuucag

SEQ ID NO: 271657 - RNA, 22 nt, Human
uccccacccagggcccuggccc

SEQ ID NO: 271658 - RNA, 25 nt, Human
uccucagcugggacugggcugaagc

SEQ ID NO: 271659 - RNA, 19 nt, Human
uccuggcucagggcugcag

SEQ ID NO: 271660 - RNA, 28 nt, Human
ucucagccaggggcccagaaccuggagc

SEQ ID NO: 271661 - RNA, 24 nt, Human
ucuuagggacccuggcagaagacc

SEQ ID NO: 271662 - RNA, 26 nt, Human
ucuuagggacccuggcagaagaccaa

SEQ ID NO: 271663 - RNA, 20 nt, Human
ugacagagguaaugagauga

SEQ ID NO: 271664 - RNA, 23 nt, Human
ugagaugauggcuuccucccccc

SEQ ID NO: 271665 - RNA, 23 nt, Human
ugaggaagagaaggggccccacu

SEQ ID NO: 271666 - RNA, 20 nt, Human
ugaggcugcagccugcccag

SEQ ID NO: 271667 - RNA, 19 nt, Human
ugagggggcagagggcugg

SEQ ID NO: 271668 - RNA, 19 nt, Human
ugagggggcagagggcugg

SEQ ID NO: 271669 - RNA, 20 nt, Human
ugagggggcagagggcuggg

SEQ ID NO: 271670 - RNA, 18 nt, Human
ugaggugcggugugcgag

SEQ ID NO: 271671 - RNA, 20 nt, Human
ugcaaaaaaaaacaaaaaca

SEQ ID NO: 271672 - RNA, 21 nt, Human
ugcaaaaaaaaacaaaaacaa

SEQ ID NO: 271673 - RNA, 19 nt, Human
ugcacugacagagguaaug

SEQ ID NO: 271674 - RNA, 24 nt, Human
ugcccaggacgggaggcaaccacc

SEQ ID NO: 271675 - RNA, 21 nt, Human
ugcccagggcgguuguugagc

SEQ ID NO: 271676 - RNA, 21 nt, Human
ugccccgccaucacaaggucu

SEQ ID NO: 271677 - RNA, 21 nt, Human
ugccccucucucccgaaacaa

SEQ ID NO: 271678 - RNA, 23 nt, Human
ugccuccucaucuucccuacgaa

SEQ ID NO: 271679 - RNA, 23 nt, Human
ugccucugcccccucccugccug

SEQ ID NO: 271680 - RNA, 27 nt, Human
uggacuacagacaccuccuagaaaccc

SEQ ID NO: 271681 - RNA, 22 nt, Human
uggagucaggggaagauacugc

SEQ ID NO: 271682 - RNA, 19 nt, Human
uggcacaccacccccuggc

SEQ ID NO: 271683 - RNA, 20 nt, Human
uggcagaagaccaacccuuc

SEQ ID NO: 271684 - RNA, 23 nt, Human
uggcagcccucacggaagaacuc

SEQ ID NO: 271685 - RNA, 26 nt, Human
uggcauccagcgagaugauuggggca

SEQ ID NO: 271686 - RNA, 23 nt, Human
uggccaggacuaaaacccaugcc

SEQ ID NO: 271687 - RNA, 18 nt, Human
uggcccaucccaggugug

SEQ ID NO: 271688 - RNA, 19 nt, Human
uggcucagggcugcagcug

SEQ ID NO: 271689 - RNA, 21 nt, Human
uggcuuccuccccccaacccu

SEQ ID NO: 271690 - RNA, 23 nt, Human
uggcuuccuccccccaacccuca

SEQ ID NO: 271691 - RNA, 20 nt, Human
uggcuuguuccucagcuggg

SEQ ID NO: 271692 - RNA, 24 nt, Human
ugggacugggcugaagcccgagaa

SEQ ID NO: 271693 - RNA, 22 nt, Human
ugggcagggaacgaagaaagag

SEQ ID NO: 271694 - RNA, 23 nt, Human
ugguagggcuggguaugagcuuc

SEQ ID NO: 271695 - RNA, 22 nt, Human
ugugcgagugugcgcgcgcggg

SEQ ID NO: 271696 - RNA, 23 nt, Human
uucggcgcucgcgggugggggcg

SEQ ID NO: 271697 - RNA, 19 nt, Human
uuucuaggggcccagagga

SEQ ID NO: 271698 - RNA, 18 nt, Human
uuugccucugcccccucc

SEQ ID NO: 271699 - RNA, 22 nt, Human
aaacaaaauuacaguacagauc

SEQ ID NO: 271700 - RNA, 18 nt, Human
aaacacgacagucacugu

SEQ ID NO: 271701 - RNA, 26 nt, Human
aagcagcuugugauuuaaagaagggu

SEQ ID NO: 271702 - RNA, 23 nt, Human
aauuacaguacagaucgauucca

SEQ ID NO: 271703 - RNA, 23 nt, Human
acaacaaaauaauucagcauggg

SEQ ID NO: 271704 - RNA, 18 nt, Human
acccuggggccuccggac

SEQ ID NO: 271705 - RNA, 19 nt, Human
agauaauuaauacgaucug

SEQ ID NO: 271706 - RNA, 21 nt, Human
agauauaacucccaacauuaa

SEQ ID NO: 271707 - RNA, 20 nt, Human
agcacuuauucuggacugca

SEQ ID NO: 271708 - RNA, 21 nt, Human
agcagugauagucucauaacc

SEQ ID NO: 271709 - RNA, 25 nt, Human
aggcaacacaauaacuuucuaagca

SEQ ID NO: 271710 - RNA, 24 nt, Human
auacgaucugaauacagccacacc

SEQ ID NO: 271711 - RNA, 24 nt, Human
caaagggcugccuuuuguaaacac

SEQ ID NO: 271712 - RNA, 18 nt, Human
caauagcuucagauucuc

SEQ ID NO: 271713 - RNA, 21 nt, Human
caggauuacaaacaaaauuac

SEQ ID NO: 271714 - RNA, 18 nt, Human
cauuuuacaugcaauagc

SEQ ID NO: 271715 - RNA, 24 nt, Human
ccuccggacgccgugccuccugcg

SEQ ID NO: 271716 - RNA, 18 nt, Human
cuaaaaaguaacagugca

SEQ ID NO: 271717 - RNA, 19 nt, Human
cuugugcaaguaauguguu

SEQ ID NO: 271718 - RNA, 18 nt, Human
gcaauuuuuuuuuuuuuu

SEQ ID NO: 271719 - RNA, 26 nt, Human
gggaaagguaacaaguaguaaaaugc

SEQ ID NO: 271720 - RNA, 22 nt, Human
uaaaaucauggaaugcaaagga

SEQ ID NO: 271721 - RNA, 28 nt, Human
uaacaaguaguaaaaugcugguugaaaa

SEQ ID NO: 271722 - RNA, 23 nt, Human
uaacagugcaaauuguaugugau

SEQ ID NO: 271723 - RNA, 24 nt, Human
uaaggcaacacaauaacuuucuaa

SEQ ID NO: 271724 - RNA, 24 nt, Human
uaaggugaacaggaacuuugaucc

SEQ ID NO: 271725 - RNA, 18 nt, Human
uaauauguauauacaagc

SEQ ID NO: 271726 - RNA, 22 nt, Human
uaauucuacuuuucugauaugu

SEQ ID NO: 271727 - RNA, 19 nt, Human
uacaggauuacaaacaaaa

SEQ ID NO: 271728 - RNA, 27 nt, Human
uacaggauuacaaacaaaaggacauac

SEQ ID NO: 271729 - RNA, 24 nt, Human
uacaggauuacaaacaaaauuaca

SEQ ID NO: 271730 - RNA, 22 nt, Human
uacgaucugaauacagccacac

SEQ ID NO: 271731 - RNA, 23 nt, Human
uagaagagcuauagaaaauaaua

SEQ ID NO: 271732 - RNA, 22 nt, Human
uauguauauacaagcuugugca

SEQ ID NO: 271733 - RNA, 18 nt, Human
ucacuguaagcacagugg

SEQ ID NO: 271734 - RNA, 18 nt, Human
ucacuguaagcacagugg

SEQ ID NO: 271735 - RNA, 23 nt, Human
ucuuccaaaggcaguaaugacaa

SEQ ID NO: 271736 - RNA, 23 nt, Human
ugauauguugugauagggaaugu

SEQ ID NO: 271737 - RNA, 24 nt, Human
ugauauguugugauagggaaugua

SEQ ID NO: 271738 - RNA, 23 nt, Human
ugauuagauuuaggcucagauuu

SEQ ID NO: 271739 - RNA, 26 nt, Human
ugauucugguuuuuauuuuaggggga

SEQ ID NO: 271740 - RNA, 21 nt, Human
ugggaaagguaacaaguagua

SEQ ID NO: 271741 - RNA, 26 nt, Human
ugguugaaaaauauauauuuauauau

SEQ ID NO: 271742 - RNA, 22 nt, Human
uguaaacacgacagucacugua

SEQ ID NO: 271743 - RNA, 25 nt, Human
ugugcaauuuuuuuuuuuuuuuuuu

SEQ ID NO: 271744 - RNA, 18 nt, Human
uuuaagcuacuguacuaa

SEQ ID NO: 271745 - RNA, 23 nt, Human
uuuguaaacacgacagucacugu

SEQ ID NO: 271746 - RNA, 25 nt, Human
uuuguaaacacgacagucacuguaa

SEQ ID NO: 271747 - RNA, 25 nt, Human
uuuuuuuuuuuuuuuuuuacaauug

SEQ ID NO: 271748 - RNA, 26 nt, Human
uuuuuuuuuuuuuuuuuuacaauugg

SEQ ID NO: 271749 - RNA, 18 nt, Human
aaagaagggagccggccc

SEQ ID NO: 271750 - RNA, 23 nt, Human
aaaggcaaaagaaaaagaaggga

SEQ ID NO: 271751 - RNA, 21 nt, Human
aaauaauaaugagagggggaa

SEQ ID NO: 271752 - RNA, 24 nt, Human
aaggggagaggggaggggaggggg

SEQ ID NO: 271753 - RNA, 24 nt, Human
agagagaggggggagaagagggau

SEQ ID NO: 271754 - RNA, 20 nt, Human
agagaggggggagaagaggg

SEQ ID NO: 271755 - RNA, 20 nt, Human
agagaggggggagaagaggg

SEQ ID NO: 271756 - RNA, 21 nt, Human
agaggagucaaggggagaggg

SEQ ID NO: 271757 - RNA, 19 nt, Human
agaggggaggggagggggg

SEQ ID NO: 271758 - RNA, 18 nt, Human
agaggggggagaagaggg

SEQ ID NO: 271759 - RNA, 23 nt, Human
agaggucccuggagaagcacucc

SEQ ID NO: 271760 - RNA, 19 nt, Human
aggagggggaggaggaaac

SEQ ID NO: 271761 - RNA, 21 nt, Human
aggcggcgggcgccggcgucu

SEQ ID NO: 271762 - RNA, 19 nt, Human
agggagcccccggagagag

SEQ ID NO: 271763 - RNA, 19 nt, Human
agggggaggaggaaaccuc

SEQ ID NO: 271764 - RNA, 19 nt, Human
auccacuuccccucccgcc

SEQ ID NO: 271765 - RNA, 23 nt, Human
caauccacuuccccucccgccaa

SEQ ID NO: 271766 - RNA, 24 nt, Human
cagggagcccccggagagaggucc

SEQ ID NO: 271767 - RNA, 20 nt, Human
ccacagguaacaggacugcg

SEQ ID NO: 271768 - RNA, 20 nt, Human
ccacuuccccucccgccaaa

SEQ ID NO: 271769 - RNA, 21 nt, Human
ccauugcucagcugcccccuu

SEQ ID NO: 271770 - RNA, 21 nt, Human
ccccaggagagcggcaggacc

SEQ ID NO: 271771 - RNA, 24 nt, Human
ccccugggggaagcgaggccccug

SEQ ID NO: 271772 - RNA, 21 nt, Human
ccccuugcggagagagaaggc

SEQ ID NO: 271773 - RNA, 19 nt, Human
ccgcgcccggcgccggggu

SEQ ID NO: 271774 - RNA, 22 nt, Human
ccucaaggcggcgggcgccggc

SEQ ID NO: 271775 - RNA, 18 nt, Human
ccuggagaagcacuccuu

SEQ ID NO: 271776 - RNA, 20 nt, Human
cgccaaaauuaaaaucgcaa

SEQ ID NO: 271777 - RNA, 24 nt, Human
cggcgcccuaacuucuacccucuu

SEQ ID NO: 271778 - RNA, 23 nt, Human
cgggcaaaggcaaaagaaaaaga

SEQ ID NO: 271779 - RNA, 26 nt, Human
cucuucaagaaagagggagcgccugg

SEQ ID NO: 271780 - RNA, 23 nt, Human
cuuggccucucucuuuccucuca

SEQ ID NO: 271781 - RNA, 24 nt, Human
gaaugggggaggggugccuccagg

SEQ ID NO: 271782 - RNA, 21 nt, Human
gcccccggagagaggucccug

SEQ ID NO: 271783 - RNA, 20 nt, Human
gcgcugccccaggagagcgg

SEQ ID NO: 271784 - RNA, 25 nt, Human
gcgcugccccaggagagcggcagga

SEQ ID NO: 271785 - RNA, 20 nt, Human
gcggagacuggagguugggg

SEQ ID NO: 271786 - RNA, 19 nt, Human
ggagacuggagguuggggg

SEQ ID NO: 271787 - RNA, 20 nt, Human
ggaggagggggaggaggaaa

SEQ ID NO: 271788 - RNA, 23 nt, Human
ggagguugggggugagggcguuc

SEQ ID NO: 271789 - RNA, 22 nt, Human
ggcgggcaaaggcaaaagaaaa

SEQ ID NO: 271790 - RNA, 18 nt, Human
gggaggagggggaggagg

SEQ ID NO: 271791 - RNA, 18 nt, Human
gggcuccggcgcccuaac

SEQ ID NO: 271792 - RNA, 19 nt, Human
gggcuggggacaggggggg

SEQ ID NO: 271793 - RNA, 20 nt, Human
ggggagaggggaggggaggg

SEQ ID NO: 271794 - RNA, 21 nt, Human
ggggaggggagggggggaggg

SEQ ID NO: 271795 - RNA, 21 nt, Human
ggggaggggagggggggaggg

SEQ ID NO: 271796 - RNA, 24 nt, Human
ggggaggggagggggggagggggc

SEQ ID NO: 271797 - RNA, 21 nt, Human
ggggcuggggacagggggggc

SEQ ID NO: 271798 - RNA, 21 nt, Human
ggggcuggggacagggggggc

SEQ ID NO: 271799 - RNA, 24 nt, Human
ggggugccuccagggagcccccgg

SEQ ID NO: 271800 - RNA, 19 nt, Human
gggugccuccagggagccc

SEQ ID NO: 271801 - RNA, 18 nt, Human
gucaaggggagaggggag

SEQ ID NO: 271802 - RNA, 27 nt, Human
gucaaggggagaggggaggggagggag

SEQ ID NO: 271803 - RNA, 21 nt, Human
gugccuccagggagcccccgg

SEQ ID NO: 271804 - RNA, 20 nt, Human
ucaagaaagagggagcgccu

SEQ ID NO: 271805 - RNA, 26 nt, Human
ucaaggggagaggggaggggaggggg

SEQ ID NO: 271806 - RNA, 22 nt, Human
ucaauccacuuccccucccgcc

SEQ ID NO: 271807 - RNA, 25 nt, Human
ucccccaucuucagggagcgggggc

SEQ ID NO: 271808 - RNA, 20 nt, Human
ucccuggagaagcacuccuu

SEQ ID NO: 271809 - RNA, 20 nt, Human
uccucaaggcggcgggcgcc

SEQ ID NO: 271810 - RNA, 20 nt, Human
uccuugggagagaggaggag

SEQ ID NO: 271811 - RNA, 19 nt, Human
ugccccaggagagcggcag

SEQ ID NO: 271812 - RNA, 22 nt, Human
uggagguugggggugagggcgu

SEQ ID NO: 271813 - RNA, 22 nt, Human
uggagguugggggugagggcgu

SEQ ID NO: 271814 - RNA, 18 nt, Human
uggccucucucuuuccuc

SEQ ID NO: 271815 - RNA, 22 nt, Human
ugggggaagcgaggccccuggg

SEQ ID NO: 271816 - RNA, 20 nt, Human
ugggggcuggggacaggggg

SEQ ID NO: 271817 - RNA, 18 nt, Human
uguuuaaaaaaaggaaaa

SEQ ID NO: 271818 - RNA, 21 nt, Human
uguuuguuuaaaaaaaggaaa

SEQ ID NO: 271819 - RNA, 23 nt, Human
uucauuguucccccaucuucagg

SEQ ID NO: 271820 - RNA, 22 nt, Human
uuuuuuuuuuuuuuuuguaugu

SEQ ID NO: 271821 - RNA, 21 nt, Human
aaagggcaaggacagggaagg

SEQ ID NO: 271822 - RNA, 25 nt, Human
aaaguagaagaaaaaaaguuaaaga

SEQ ID NO: 271823 - RNA, 19 nt, Human
aagaaaaggcagcauuaaa

SEQ ID NO: 271824 - RNA, 21 nt, Human
agaagaaaaaaaguuaaagaa

SEQ ID NO: 271825 - RNA, 23 nt, Human
agaagaaaaaaaguuaaagaaaa

SEQ ID NO: 271826 - RNA, 24 nt, Human
aggaagugcagcauuacaacaugg

SEQ ID NO: 271827 - RNA, 19 nt, Human
aggcaaggagagggucugu

SEQ ID NO: 271828 - RNA, 21 nt, Human
aggcaaggagagggucugugg

SEQ ID NO: 271829 - RNA, 25 nt, Human
aggcaaggagagggucuguggagug

SEQ ID NO: 271830 - RNA, 22 nt, Human
agggggagagggaaagggggcg

SEQ ID NO: 271831 - RNA, 24 nt, Human
aguagaagaaaaaaaguuaaagaa

SEQ ID NO: 271832 - RNA, 19 nt, Human
caacauggcaaaccggaug

SEQ ID NO: 271833 - RNA, 24 nt, Human
ccggcgcccugggccgggaagagg

SEQ ID NO: 271834 - RNA, 21 nt, Human
gagagggaaagggggcguugg

SEQ ID NO: 271835 - RNA, 22 nt, Human
gagggggagagggaaagggggc

SEQ ID NO: 271836 - RNA, 20 nt, Human
gcguuggcaaggaggcuggg

SEQ ID NO: 271837 - RNA, 23 nt, Human
ggacagggaaggggucacuagug

SEQ ID NO: 271838 - RNA, 23 nt, Human
ggcggcggagggaagggugggcc

SEQ ID NO: 271839 - RNA, 23 nt, Human
gggggcggcggagggaagggugg

SEQ ID NO: 271840 - RNA, 27 nt, Human
ggggggcggcggagggaagggugggcc

SEQ ID NO: 271841 - RNA, 18 nt, Human
uaccagauacacgccaaa

SEQ ID NO: 271842 - RNA, 24 nt, Human
uagaagaaaaaaaguuaaagaaaa

SEQ ID NO: 271843 - RNA, 19 nt, Human
uauaaaacaggaagugcag

SEQ ID NO: 271844 - RNA, 18 nt, Human
uggcaacauggcaaaccg

SEQ ID NO: 271845 - RNA, 23 nt, Human
ugggccgggaagagggcggggag

SEQ ID NO: 271846 - RNA, 19 nt, Human
uuaaaaguuuccugaccuc

SEQ ID NO: 271847 - RNA, 21 nt, Human
aaaacaaagacucaggucaga

SEQ ID NO: 271848 - RNA, 19 nt, Human
aaacaaagacucaggucag

SEQ ID NO: 271849 - RNA, 18 nt, Human
acggucugggcugcgcgg

SEQ ID NO: 271850 - RNA, 24 nt, Human
aggcccgggacccucgcgccccac

SEQ ID NO: 271851 - RNA, 26 nt, Human
cacggaaacccccagccagcucccua

SEQ ID NO: 271852 - RNA, 18 nt, Human
cacucugagcccuuuagc

SEQ ID NO: 271853 - RNA, 20 nt, Human
cagguccugggguggcuggg

SEQ ID NO: 271854 - RNA, 19 nt, Human
caugggccgcgaggacccu

SEQ ID NO: 271855 - RNA, 26 nt, Human
cccacggaaacccccagccagcuccc

SEQ ID NO: 271856 - RNA, 23 nt, Human
ccccacggccugcacucugagcc

SEQ ID NO: 271857 - RNA, 20 nt, Human
ccuggaguugcugcacaggc

SEQ ID NO: 271858 - RNA, 20 nt, Human
cucgcgccccacggccugca

SEQ ID NO: 271859 - RNA, 18 nt, Human
cucuucacucagcugggg

SEQ ID NO: 271860 - RNA, 19 nt, Human
cugggguggcugggucacc

SEQ ID NO: 271861 - RNA, 20 nt, Human
gagcucccacggaaaccccc

SEQ ID NO: 271862 - RNA, 22 nt, Human
gccaugagagaaaucucuacag

SEQ ID NO: 271863 - RNA, 19 nt, Human
gcccgggacccucgcgccc

SEQ ID NO: 271864 - RNA, 20 nt, Human
gccugagcggaaaggggagu

SEQ ID NO: 271865 - RNA, 21 nt, Human
uccugggguggcugggucacc

SEQ ID NO: 271866 - RNA, 23 nt, Human
ugcacauaagaggggcugggcuc

SEQ ID NO: 271867 - RNA, 21 nt, Human
uggauggcucucuugauaucu

SEQ ID NO: 271868 - RNA, 22 nt, Human
uggcagguccugggguggcugg

SEQ ID NO: 271869 - RNA, 18 nt, Human
uggcucucuugauaucug

SEQ ID NO: 271870 - RNA, 21 nt, Human
aaacaaagaugcgagcaugcg

SEQ ID NO: 271871 - RNA, 23 nt, Human
aaacacacaacgcagggcugagc

SEQ ID NO: 271872 - RNA, 24 nt, Human
aaacguuccaaauguuggagacuc

SEQ ID NO: 271873 - RNA, 19 nt, Human
aaagagcugagaugacaga

SEQ ID NO: 271874 - RNA, 20 nt, Human
aaauguuggagacucauacu

SEQ ID NO: 271875 - RNA, 18 nt, Human
aagggaagcauguuacaa

SEQ ID NO: 271876 - RNA, 20 nt, Human
aaucacagcuccuggcuuuc

SEQ ID NO: 271877 - RNA, 19 nt, Human
aaugaaauguguuugcagu

SEQ ID NO: 271878 - RNA, 20 nt, Human
acaguccccugagaaaggcu

SEQ ID NO: 271879 - RNA, 19 nt, Human
acgugcagaccgacgggau

SEQ ID NO: 271880 - RNA, 24 nt, Human
agacagcugacacagacaucaaac

SEQ ID NO: 271881 - RNA, 23 nt, Human
agggaagcauguuacaaaagagc

SEQ ID NO: 271882 - RNA, 18 nt, Human
auaaauagaugccuagau

SEQ ID NO: 271883 - RNA, 28 nt, Human
auacuagaguccucucgcaaccggaggg

SEQ ID NO: 271884 - RNA, 23 nt, Human
auagaugccuagauauguacaca

SEQ ID NO: 271885 - RNA, 24 nt, Human
aucugaaaacacacaacgcagggg

SEQ ID NO: 271886 - RNA, 20 nt, Human
caaagacagcugacacagac

SEQ ID NO: 271887 - RNA, 21 nt, Human
cacagcuccuggcuuucuagg

SEQ ID NO: 271888 - RNA, 21 nt, Human
cagcaagagcagcgacuggag

SEQ ID NO: 271889 - RNA, 20 nt, Human
cagcaaggccuacacgaacc

SEQ ID NO: 271890 - RNA, 24 nt, Human
caggguacccagccgcagguggga

SEQ ID NO: 271891 - RNA, 22 nt, Human
cagguuccaaaacggaugccgg

SEQ ID NO: 271892 - RNA, 19 nt, Human
caugaaaggccccugcacg

SEQ ID NO: 271893 - RNA, 25 nt, Human
ccaguaaccuauugaugugcuauuc

SEQ ID NO: 271894 - RNA, 20 nt, Human
cccccgccuccccgccggcc

SEQ ID NO: 271895 - RNA, 18 nt, Human
ccccgccuccccgccggc

SEQ ID NO: 271896 - RNA, 20 nt, Human
ccccggugcccgcgcccugc

SEQ ID NO: 271897 - RNA, 20 nt, Human
cccggccaccucccuucugu

SEQ ID NO: 271898 - RNA, 20 nt, Human
ccgucugguaaccuacagcu

SEQ ID NO: 271899 - RNA, 22 nt, Human
ccuccaggugacacaguggucu

SEQ ID NO: 271900 - RNA, 18 nt, Human
ccucccccgccuccccgc

SEQ ID NO: 271901 - RNA, 25 nt, Human
ccuccugccuuuuuaaagcuggaaa

SEQ ID NO: 271902 - RNA, 21 nt, Human
ccugccuuuuuaaagcuggaa

SEQ ID NO: 271903 - RNA, 19 nt, Human
cgcgcguggcggggcccgg

SEQ ID NO: 271904 - RNA, 18 nt, Human
cgcggcggcggcggggag

SEQ ID NO: 271905 - RNA, 22 nt, Human
cgcucugccuccugccuuuuua

SEQ ID NO: 271906 - RNA, 21 nt, Human
cggcggggaguggagcggcgg

SEQ ID NO: 271907 - RNA, 22 nt, Human
cgggaagacagcccucgccccg

SEQ ID NO: 271908 - RNA, 23 nt, Human
cuagaguccucucgcagccuucc

SEQ ID NO: 271909 - RNA, 23 nt, Human
cucccccgccuccccgccggccc

SEQ ID NO: 271910 - RNA, 20 nt, Human
cuccgagcccugcccgcgcc

SEQ ID NO: 271911 - RNA, 23 nt, Human
cucgcagccuuccagcauucucu

SEQ ID NO: 271912 - RNA, 22 nt, Human
cucugccuccugccuuuuuaaa

SEQ ID NO: 271913 - RNA, 19 nt, Human
cugaagucagcauaccccu

SEQ ID NO: 271914 - RNA, 20 nt, Human
cugcuccuaaaaauacuccu

SEQ ID NO: 271915 - RNA, 20 nt, Human
cugguuaaauaaggcacuuc

SEQ ID NO: 271916 - RNA, 21 nt, Human
cuucacgguuacgugcagacc

SEQ ID NO: 271917 - RNA, 24 nt, Human
cuuuccgugagugagacacaagag

SEQ ID NO: 271918 - RNA, 23 nt, Human
gagcaugcgacuaugaacaagcc

SEQ ID NO: 271919 - RNA, 19 nt, Human
gagguucugagugguacca

SEQ ID NO: 271920 - RNA, 21 nt, Human
gcacggugggucucccgugcu

SEQ ID NO: 271921 - RNA, 20 nt, Human
gccggagccuccacccgcag

SEQ ID NO: 271922 - RNA, 19 nt, Human
gccgggugcaggguaccca

SEQ ID NO: 271923 - RNA, 22 nt, Human
gcgcgguggcuccgagcccugc

SEQ ID NO: 271924 - RNA, 19 nt, Human
gcugaagucagcauacccc

SEQ ID NO: 271925 - RNA, 18 nt, Human
gcugggaucuggcgcggc

SEQ ID NO: 271926 - RNA, 25 nt, Human
ggcauucagucaguuggagguucug

SEQ ID NO: 271927 - RNA, 18 nt, Human
gggaguggagcggcgggc

SEQ ID NO: 271928 - RNA, 24 nt, Human
ggggucgggucuccgggaagacag

SEQ ID NO: 271929 - RNA, 21 nt, Human
gggucuccgggaagacagccc

SEQ ID NO: 271930 - RNA, 18 nt, Human
guaaggcagcaggagugg

SEQ ID NO: 271931 - RNA, 22 nt, Human
guaauaagcaacuaauuguaca

SEQ ID NO: 271932 - RNA, 21 nt, Human
gugcccagcaaggccuacacg

SEQ ID NO: 271933 - RNA, 19 nt, Human
guggcuccgagcccugccc

SEQ ID NO: 271934 - RNA, 23 nt, Human
guguacgugacagcccaggaaac

SEQ ID NO: 271935 - RNA, 21 nt, Human
uaaaaauacuccuacaguagc

SEQ ID NO: 271936 - RNA, 27 nt, Human
uaacuacaaagacagcugacacagaca

SEQ ID NO: 271937 - RNA, 20 nt, Human
uaagcaacuaauuguacaga

SEQ ID NO: 271938 - RNA, 21 nt, Human
uacaaagacagcugacacaga

SEQ ID NO: 271939 - RNA, 22 nt, Human
uagaguccucucgcagccuucc

SEQ ID NO: 271940 - RNA, 24 nt, Human
uauauuacacuuagguugcauguu

SEQ ID NO: 271941 - RNA, 20 nt, Human
uauggaacaauagaucgcug

SEQ ID NO: 271942 - RNA, 22 nt, Human
uauguacacacaugcaaaugca

SEQ ID NO: 271943 - RNA, 26 nt, Human
uauguacacacaugcaaaugcaggcu

SEQ ID NO: 271944 - RNA, 21 nt, Human
ucaaaagucuuugucugcuga

SEQ ID NO: 271945 - RNA, 21 nt, Human
ucagucaguuggagguucuga

SEQ ID NO: 271946 - RNA, 23 nt, Human
uccauaagggggcauuaauuccc

SEQ ID NO: 271947 - RNA, 22 nt, Human
ucccgugcucagcccggccacc

SEQ ID NO: 271948 - RNA, 21 nt, Human
ucgcagccuuccagcauucuc

SEQ ID NO: 271949 - RNA, 21 nt, Human
ucucccuuccucccugcuuuc

SEQ ID NO: 271950 - RNA, 24 nt, Human
ucuguuauuauuuauacauaaaua

SEQ ID NO: 271951 - RNA, 24 nt, Human
ugaaacaaucaucuuauaacugaa

SEQ ID NO: 271952 - RNA, 22 nt, Human
ugaagucagcauaccccugcug

SEQ ID NO: 271953 - RNA, 24 nt, Human
ugacacagacaucaaacguuuccc

SEQ ID NO: 271954 - RNA, 18 nt, Human
ugacacaguggucucccu

SEQ ID NO: 271955 - RNA, 19 nt, Human
ugacacaguggucucccuu

SEQ ID NO: 271956 - RNA, 24 nt, Human
ugacacaguggucucccuuccucc

SEQ ID NO: 271957 - RNA, 22 nt, Human
ugacgcagggccgcgcucugcc

SEQ ID NO: 271958 - RNA, 23 nt, Human
ugacuucacagccggagccucca

SEQ ID NO: 271959 - RNA, 19 nt, Human
ugagacacaagagacgcga

SEQ ID NO: 271960 - RNA, 20 nt, Human
ugccagaagggcugggcgug

SEQ ID NO: 271961 - RNA, 24 nt, Human
uggaaaacaccucccccgccuccc

SEQ ID NO: 271962 - RNA, 24 nt, Human
uggaacaauagaucgcugcgagua

SEQ ID NO: 271963 - RNA, 18 nt, Human
uggagcggcgggcggagg

SEQ ID NO: 271964 - RNA, 21 nt, Human
uggagcggcgggcggaggcac

SEQ ID NO: 271965 - RNA, 18 nt, Human
uggcuccgagcccugccc

SEQ ID NO: 271966 - RNA, 20 nt, Human
uggcuuucuaggguccuccu

SEQ ID NO: 271967 - RNA, 21 nt, Human
ugggcgaggacacgucggcuc

SEQ ID NO: 271968 - RNA, 21 nt, Human
ugguuuucuuagaugaagcag

SEQ ID NO: 271969 - RNA, 24 nt, Human
ugucaugagaugacuucuccucca

SEQ ID NO: 271970 - RNA, 20 nt, Human
ugugaguucaguuuauuuau

SEQ ID NO: 271971 - RNA, 21 nt, Human
uguucagugacuucacagccg

SEQ ID NO: 271972 - RNA, 22 nt, Human
uucaggcagguuccauaagggg

SEQ ID NO: 271973 - RNA, 22 nt, Human
uugaaccccaggggugccagaa

SEQ ID NO: 271974 - RNA, 21 nt, Human
uuucuaauguugccgucuggu

SEQ ID NO: 271975 - RNA, 21 nt, Human
uuuuugguauugguuuucuua

SEQ ID NO: 271976 - RNA, 22 nt, Human
uuuuuuuuuuuuuuuuuuccag

SEQ ID NO: 271977 - RNA, 19 nt, Human
cagcggguccuggacgcgc

SEQ ID NO: 271978 - RNA, 26 nt, Human
ccccucgcaguggggcuggcggaggc

SEQ ID NO: 271979 - RNA, 21 nt, Human
cgacggcggcgcgagcuuccu

SEQ ID NO: 271980 - RNA, 21 nt, Human
cggcggcgacggcggcgcgag

SEQ ID NO: 271981 - RNA, 18 nt, Human
cgggaaggcugcggggcc

SEQ ID NO: 271982 - RNA, 18 nt, Human
cggggaagcugagcggcg

SEQ ID NO: 271983 - RNA, 21 nt, Human
gagcggcggcggcgacggcgg

SEQ ID NO: 271984 - RNA, 22 nt, Human
gcccggggaagcugagcggcgg

SEQ ID NO: 271985 - RNA, 21 nt, Human
gcggcggcggcgacggcggcg

SEQ ID NO: 271986 - RNA, 23 nt, Human
gcgggcgcggcuggcucugggac

SEQ ID NO: 271987 - RNA, 20 nt, Human
gcggggccgggggcgagggc

SEQ ID NO: 271988 - RNA, 25 nt, Human
gggaagcugagcggcgggacagagg

SEQ ID NO: 271989 - RNA, 21 nt, Human
gggcgggaaggcugcggggcc

SEQ ID NO: 271990 - RNA, 19 nt, Human
uggacgcgcccggggaagc

SEQ ID NO: 271991 - RNA, 18 nt, Human
aaacagaaaucugggaca

SEQ ID NO: 271992 - RNA, 26 nt, Human
aagcaaaguucauuuccccaaagcuc

SEQ ID NO: 271993 - RNA, 20 nt, Human
aagcacccaucauauaaaag

SEQ ID NO: 271994 - RNA, 18 nt, Human
agaccugaaggcugcaga

SEQ ID NO: 271995 - RNA, 19 nt, Human
agaccugaaggcugcagag

SEQ ID NO: 271996 - RNA, 23 nt, Human
agcggcggcagcagcuccucaac

SEQ ID NO: 271997 - RNA, 21 nt, Human
aggagagaaacaugcugagaa

SEQ ID NO: 271998 - RNA, 21 nt, Human
aggccugagguggaggaaugc

SEQ ID NO: 271999 - RNA, 21 nt, Human
aggcggcggcggcggcagcgg

SEQ ID NO: 272000 - RNA, 18 nt, Human
aggcugcagaguuggaaa

SEQ ID NO: 272001 - RNA, 21 nt, Human
caaaucaccaauccuagcuaa

SEQ ID NO: 272002 - RNA, 24 nt, Human
cacuccuggccccagaccugaagg

SEQ ID NO: 272003 - RNA, 18 nt, Human
cagcaccaggaaccgcag

SEQ ID NO: 272004 - RNA, 22 nt, Human
ccaaagcucaaacagccuaugc

SEQ ID NO: 272005 - RNA, 23 nt, Human
ccaauccuagcuaaguaaccagg

SEQ ID NO: 272006 - RNA, 22 nt, Human
ccagggugcugcagcuccuccu

SEQ ID NO: 272007 - RNA, 21 nt, Human
cccacaaauggugggucccac

SEQ ID NO: 272008 - RNA, 18 nt, Human
ccccaaagcucaaacagc

SEQ ID NO: 272009 - RNA, 25 nt, Human
ccccaaagcucaaacagccuaugcu

SEQ ID NO: 272010 - RNA, 20 nt, Human
ccccacaaaugguggguccc

SEQ ID NO: 272011 - RNA, 19 nt, Human
ccguuccgaaagcuggccg

SEQ ID NO: 272012 - RNA, 21 nt, Human
ccuccucaggcggcggcggcg

SEQ ID NO: 272013 - RNA, 21 nt, Human
ccuggccccagaccugaaggc

SEQ ID NO: 272014 - RNA, 24 nt, Human
cgagcagcaccaggaaccgcagcc

SEQ ID NO: 272015 - RNA, 20 nt, Human
cggcagcggcaagcggcggc

SEQ ID NO: 272016 - RNA, 22 nt, Human
cguggcccagggugcugcagcu

SEQ ID NO: 272017 - RNA, 23 nt, Human
cucgggaggggagccugccugcu

SEQ ID NO: 272018 - RNA, 23 nt, Human
cuucaugccgggccgcgcgggcc

SEQ ID NO: 272019 - RNA, 23 nt, Human
gcggcggcagcggcaagcggcgg

SEQ ID NO: 272020 - RNA, 26 nt, Human
gcggcggcagcggcaagcggcggcag

SEQ ID NO: 272021 - RNA, 18 nt, Human
gcuacuuuccccacaaau

SEQ ID NO: 272022 - RNA, 18 nt, Human
ggcggcggcggcggcagc

SEQ ID NO: 272023 - RNA, 21 nt, Human
ggugguggacacaaggcugca

SEQ ID NO: 272024 - RNA, 22 nt, Human
ucaccccugcuccuugggaaac

SEQ ID NO: 272025 - RNA, 25 nt, Human
uccaaggagagaaacaugcugagaa

SEQ ID NO: 272026 - RNA, 18 nt, Human
uccacggcaaacuuuccg

SEQ ID NO: 272027 - RNA, 21 nt, Human
uccguuccgaaagcuggccgc

SEQ ID NO: 272028 - RNA, 25 nt, Human
uccuaaauccagggacucaggacuc

SEQ ID NO: 272029 - RNA, 23 nt, Human
ugagaaguuggugguggacacaa

SEQ ID NO: 272030 - RNA, 18 nt, Human
ugcuacuuuccccacaaa

SEQ ID NO: 272031 - RNA, 20 nt, Human
ugcuccuguucuuuugccaa

SEQ ID NO: 272032 - RNA, 18 nt, Human
ugcugcagcuccuccuca

SEQ ID NO: 272033 - RNA, 18 nt, Human
uggcccagggugcugcag

SEQ ID NO: 272034 - RNA, 18 nt, Human
ugggaaacagaaaucugg

SEQ ID NO: 272035 - RNA, 24 nt, Human
uuccccacaaauggugggucccac

SEQ ID NO: 272036 - RNA, 23 nt, Human
uuggugguggacacaaggcugca

SEQ ID NO: 272037 - RNA, 19 nt, Human
agcccccaggucccggccu

SEQ ID NO: 272038 - RNA, 21 nt, Human
caggagcccccaggucccggc

SEQ ID NO: 272039 - RNA, 21 nt, Human
cgucgcugccgccucccucca

SEQ ID NO: 272040 - RNA, 24 nt, Human
cucccucccucccuuucucugaga

SEQ ID NO: 272041 - RNA, 23 nt, Human
cuccuccgucgcugccgccuccc

SEQ ID NO: 272042 - RNA, 22 nt, Human
cugcuguaucuucacccgggug

SEQ ID NO: 272043 - RNA, 24 nt, Human
cugcuguaucuucacccggguggc

SEQ ID NO: 272044 - RNA, 23 nt, Human
ggaggggggaguucaggaggcug

SEQ ID NO: 272045 - RNA, 24 nt, Human
ggccugggugggaggggggaguuc

SEQ ID NO: 272046 - RNA, 19 nt, Human
gggggaguucaggaggcug

SEQ ID NO: 272047 - RNA, 21 nt, Human
ucacccggguggcucccuccc

SEQ ID NO: 272048 - RNA, 23 nt, Human
ucacccggguggcucccucccuc

SEQ ID NO: 272049 - RNA, 23 nt, Human
uccuccgucgcugccgccucccu

SEQ ID NO: 272050 - RNA, 20 nt, Human
ugccgccucccuccagaagc

SEQ ID NO: 272051 - RNA, 23 nt, Human
ugggaggggggaguucaggaggc

SEQ ID NO: 272052 - RNA, 25 nt, Human
ugggaggggggaguucaggaggccg

SEQ ID NO: 272053 - RNA, 24 nt, Human
uugccaggugaugacaguucacgu

SEQ ID NO: 272054 - RNA, 22 nt, Human
acccugcuuuccuccucugucc

SEQ ID NO: 272055 - RNA, 20 nt, Human
accuuggaacuuccaaacac

SEQ ID NO: 272056 - RNA, 19 nt, Human
acuuguugccauugucauc

SEQ ID NO: 272057 - RNA, 19 nt, Human
agacagauuccagcccucc

SEQ ID NO: 272058 - RNA, 23 nt, Human
agacagauuccagcccucccuca

SEQ ID NO: 272059 - RNA, 24 nt, Human
agguggaggcuaaagaccugagga

SEQ ID NO: 272060 - RNA, 21 nt, Human
caaaaugcccacucuuuuccc

SEQ ID NO: 272061 - RNA, 22 nt, Human
caagguggaggcuaaagaccug

SEQ ID NO: 272062 - RNA, 20 nt, Human
cagcccucccucaaggcaag

SEQ ID NO: 272063 - RNA, 23 nt, Human
cagccuuuucuuuccaagaugau

SEQ ID NO: 272064 - RNA, 18 nt, Human
caucaggggucacccugc

SEQ ID NO: 272065 - RNA, 20 nt, Human
ccagcccucccucaaggcaa

SEQ ID NO: 272066 - RNA, 21 nt, Human
cccuaauacuuuuuacucccc

SEQ ID NO: 272067 - RNA, 18 nt, Human
cccucaaggcaagccucu

SEQ ID NO: 272068 - RNA, 20 nt, Human
cccucaaggcaagccucuuu

SEQ ID NO: 272069 - RNA, 21 nt, Human
cccugcuuuccuccucugucc

SEQ ID NO: 272070 - RNA, 24 nt, Human
ccuuuucuuuccaagaugaugaca

SEQ ID NO: 272071 - RNA, 24 nt, Human
gaaaucccaucagcaguuccaccc

SEQ ID NO: 272072 - RNA, 26 nt, Human
gaacacaccuuggaacuuccaaacac

SEQ ID NO: 272073 - RNA, 22 nt, Human
gcaacaucaggggucacccugc

SEQ ID NO: 272074 - RNA, 21 nt, Human
gcaguuccaccccucugggcc

SEQ ID NO: 272075 - RNA, 18 nt, Human
ggacucaggguuggggag

SEQ ID NO: 272076 - RNA, 23 nt, Human
gggacucaggguuggggaguacc

SEQ ID NO: 272077 - RNA, 18 nt, Human
uaaagaccugaggagccg

SEQ ID NO: 272078 - RNA, 24 nt, Human
uaauacuuuuuacucccccaaacu

SEQ ID NO: 272079 - RNA, 25 nt, Human
uagggcaacaucaggggucacccug

SEQ ID NO: 272080 - RNA, 23 nt, Human
ucagcuccuucugggacucaggg

SEQ ID NO: 272081 - RNA, 20 nt, Human
uccagguucccggaaagccc

SEQ ID NO: 272082 - RNA, 19 nt, Human
ucccccaaacuguuuuccu

SEQ ID NO: 272083 - RNA, 21 nt, Human
ucccucaaggcaagccucuuu

SEQ ID NO: 272084 - RNA, 27 nt, Human
ugcuuuccuccucuguccucaguuuua

SEQ ID NO: 272085 - RNA, 22 nt, Human
uguugccauugucauccucuuc

SEQ ID NO: 272086 - RNA, 20 nt, Human
uuacucccccaaacuguuuu

SEQ ID NO: 272087 - RNA, 21 nt, Human
uucuggucuagagaacucagc

SEQ ID NO: 272088 - RNA, 23 nt, Human
uuguugccauugucauccucuuc

SEQ ID NO: 272089 - RNA, 18 nt, Human
uuucuguuuugcuguguu

SEQ ID NO: 272090 - RNA, 18 nt, Human
uuuuuuuuuuuuuuucug

SEQ ID NO: 272091 - RNA, 19 nt, Human
uuuuuuuuuuuuuuucugu

SEQ ID NO: 272092 - RNA, 22 nt, Human
aaaaauaaaaucuacaaggaaa

SEQ ID NO: 272093 - RNA, 18 nt, Human
aaacccccuucuucccca

SEQ ID NO: 272094 - RNA, 23 nt, Human
aaagaaacccaaaaaagaaagca

SEQ ID NO: 272095 - RNA, 20 nt, Human
aacaccgccccuccccaccc

SEQ ID NO: 272096 - RNA, 23 nt, Human
aacaccgccccuccccaccccca

SEQ ID NO: 272097 - RNA, 24 nt, Human
aacaccgccccuccccacccccac

SEQ ID NO: 272098 - RNA, 19 nt, Human
aaccccguaccccacccug

SEQ ID NO: 272099 - RNA, 21 nt, Human
aaccccguaccccacccuggc

SEQ ID NO: 272100 - RNA, 20 nt, Human
aagaaacccaaaaaagaaag

SEQ ID NO: 272101 - RNA, 24 nt, Human
aagcacacccuguggagccaaggc

SEQ ID NO: 272102 - RNA, 23 nt, Human
acaccgccccuccccacccccac

SEQ ID NO: 272103 - RNA, 20 nt, Human
acacuagauucuccaucauu

SEQ ID NO: 272104 - RNA, 23 nt, Human
accccguaccccacccuggcaga

SEQ ID NO: 272105 - RNA, 20 nt, Human
acccuguggagccaaggcca

SEQ ID NO: 272106 - RNA, 20 nt, Human
acccuuugacucuaaaucuc

SEQ ID NO: 272107 - RNA, 22 nt, Human
agaaaaaucccaaguguucaca

SEQ ID NO: 272108 - RNA, 21 nt, Human
agaaacccaaaaaagaaagca

SEQ ID NO: 272109 - RNA, 20 nt, Human
agaaagaaacccaaaaaaga

SEQ ID NO: 272110 - RNA, 24 nt, Human
agauucuccaucauuccucugccu

SEQ ID NO: 272111 - RNA, 19 nt, Human
agcaacuccaccaccaccc

SEQ ID NO: 272112 - RNA, 21 nt, Human
agcccuaaaaaaaucaaagcg

SEQ ID NO: 272113 - RNA, 18 nt, Human
agcugccuguggcugaga

SEQ ID NO: 272114 - RNA, 25 nt, Human
aggcagucugugagggguggggaac

SEQ ID NO: 272115 - RNA, 19 nt, Human
aggcagugaaugacaugcg

SEQ ID NO: 272116 - RNA, 19 nt, Human
aggcccaccagucacucca

SEQ ID NO: 272117 - RNA, 21 nt, Human
aggggaggacggcauacacau

SEQ ID NO: 272118 - RNA, 27 nt, Human
agguccagguccagcccuucuccaguu

SEQ ID NO: 272119 - RNA, 22 nt, Human
agguccagguccagguccagcc

SEQ ID NO: 272120 - RNA, 22 nt, Human
agguccagguccagguccaggu

SEQ ID NO: 272121 - RNA, 21 nt, Human
auacagucacuuccucacuca

SEQ ID NO: 272122 - RNA, 20 nt, Human
auggccaaugauauccaaga

SEQ ID NO: 272123 - RNA, 22 nt, Human
caaaagacaaaucaaggccacu

SEQ ID NO: 272124 - RNA, 22 nt, Human
caaacccccuucuuccccaggc

SEQ ID NO: 272125 - RNA, 23 nt, Human
cacacccuguggagccaaggcca

SEQ ID NO: 272126 - RNA, 22 nt, Human
cacauucacuuucccuucucga

SEQ ID NO: 272127 - RNA, 21 nt, Human
caccccugccucacaggaaag

SEQ ID NO: 272128 - RNA, 24 nt, Human
cacccugugucuguguaccccacc

SEQ ID NO: 272129 - RNA, 19 nt, Human
caccggaccaggggaggac

SEQ ID NO: 272130 - RNA, 19 nt, Human
caccuucuaucccuacugc

SEQ ID NO: 272131 - RNA, 21 nt, Human
cacuagauucuccaucauucc

SEQ ID NO: 272132 - RNA, 19 nt, Human
cagagugucccgccuccuc

SEQ ID NO: 272133 - RNA, 24 nt, Human
cagcagguuacccuccucaguguc

SEQ ID NO: 272134 - RNA, 24 nt, Human
cagccagcagguuacccuccucag

SEQ ID NO: 272135 - RNA, 18 nt, Human
caggagccugugcgaagc

SEQ ID NO: 272136 - RNA, 20 nt, Human
caggcccuaagcccgagucc

SEQ ID NO: 272137 - RNA, 25 nt, Human
caggggaggacggcauacacaugca

SEQ ID NO: 272138 - RNA, 19 nt, Human
cagucacuccaaccugcug

SEQ ID NO: 272139 - RNA, 23 nt, Human
caguccacauacagucacuuccu

SEQ ID NO: 272140 - RNA, 19 nt, Human
cagugcuuccccccacccc

SEQ ID NO: 272141 - RNA, 24 nt, Human
caguguugugcugaauccugccug

SEQ ID NO: 272142 - RNA, 22 nt, Human
cauacacaugcaggcucugaug

SEQ ID NO: 272143 - RNA, 20 nt, Human
cauagcuccucuaccuccag

SEQ ID NO: 272144 - RNA, 19 nt, Human
caugucugccucccccagg

SEQ ID NO: 272145 - RNA, 20 nt, Human
cauuguaguccuggaaccau

SEQ ID NO: 272146 - RNA, 25 nt, Human
ccaaguguucacacaguuacacgga

SEQ ID NO: 272147 - RNA, 19 nt, Human
ccacccccauuucacuccc

SEQ ID NO: 272148 - RNA, 19 nt, Human
ccagaagaggaaggcugca

SEQ ID NO: 272149 - RNA, 20 nt, Human
ccagaccacauucacuuucc

SEQ ID NO: 272150 - RNA, 19 nt, Human
ccagagccaaccuuaaccu

SEQ ID NO: 272151 - RNA, 21 nt, Human
ccagcaacuccaccaccaccc

SEQ ID NO: 272152 - RNA, 19 nt, Human
cccaaaaaagaaagcagac

SEQ ID NO: 272153 - RNA, 23 nt, Human
cccaaaaaagaaagcagacgacg

SEQ ID NO: 272154 - RNA, 23 nt, Human
cccaccagucacuccaaccugcu

SEQ ID NO: 272155 - RNA, 21 nt, Human
cccacccccauuucacuccca

SEQ ID NO: 272156 - RNA, 22 nt, Human
ccccacccccacccugugucug

SEQ ID NO: 272157 - RNA, 23 nt, Human
ccccacccccauuucacucccac

SEQ ID NO: 272158 - RNA, 21 nt, Human
ccccagcuuacagaagagcuc

SEQ ID NO: 272159 - RNA, 21 nt, Human
cccccacccccauuucacucc

SEQ ID NO: 272160 - RNA, 22 nt, Human
cccccacccugugucuguguac

SEQ ID NO: 272161 - RNA, 19 nt, Human
ccccccacccccauuucac

SEQ ID NO: 272162 - RNA, 21 nt, Human
ccccccacccccauuucacuc

SEQ ID NO: 272163 - RNA, 19 nt, Human
ccccggggugaaauggggu

SEQ ID NO: 272164 - RNA, 19 nt, Human
ccccuccccacccccaccc

SEQ ID NO: 272165 - RNA, 19 nt, Human
ccccuccccacccccaccc

SEQ ID NO: 272166 - RNA, 24 nt, Human
cccguaccccacccuggcagaaca

SEQ ID NO: 272167 - RNA, 21 nt, Human
cccuaagcccgaguccagccc

SEQ ID NO: 272168 - RNA, 20 nt, Human
cccuauaagugaaacagggc

SEQ ID NO: 272169 - RNA, 25 nt, Human
ccgccgccaccgccggggccucggc

SEQ ID NO: 272170 - RNA, 23 nt, Human
ccgcugccuccacagcaggcccu

SEQ ID NO: 272171 - RNA, 20 nt, Human
ccgucuaaauggucuggccc

SEQ ID NO: 272172 - RNA, 24 nt, Human
ccuaaaaaaaucaaagcgcaagaa

SEQ ID NO: 272173 - RNA, 21 nt, Human
ccuauaagugaaacagggcac

SEQ ID NO: 272174 - RNA, 23 nt, Human
ccuccacagcaggcccuaagccc

SEQ ID NO: 272175 - RNA, 20 nt, Human
ccuccagcaacuccaccacc

SEQ ID NO: 272176 - RNA, 22 nt, Human
ccuccagcaacuccaccaccac

SEQ ID NO: 272177 - RNA, 24 nt, Human
ccuccccacccccacccugugucu

SEQ ID NO: 272178 - RNA, 21 nt, Human
ccucgccgccgccaccgccgg

SEQ ID NO: 272179 - RNA, 21 nt, Human
ccugugcgaagcuggggcugu

SEQ ID NO: 272180 - RNA, 23 nt, Human
ccuuccuuccuuccuucuauccc

SEQ ID NO: 272181 - RNA, 21 nt, Human
ccuuugcuccacauagcuccu

SEQ ID NO: 272182 - RNA, 23 nt, Human
cuacaaggaaaauaauuuauaaa

SEQ ID NO: 272183 - RNA, 22 nt, Human
cuaggcccaccagucacuccaa

SEQ ID NO: 272184 - RNA, 24 nt, Human
cucaaucuucuagaaagaaaccca

SEQ ID NO: 272185 - RNA, 24 nt, Human
cuccacaguccacauacagucacu

SEQ ID NO: 272186 - RNA, 20 nt, Human
cuccacauagcuccucuacc

SEQ ID NO: 272187 - RNA, 22 nt, Human
cuccagcaacuccaccaccacc

SEQ ID NO: 272188 - RNA, 27 nt, Human
cuccagcaacuccaccaccaccccugc

SEQ ID NO: 272189 - RNA, 23 nt, Human
cuccaucauuccucugccucaca

SEQ ID NO: 272190 - RNA, 22 nt, Human
cuccucuaccuccagcaacucc

SEQ ID NO: 272191 - RNA, 19 nt, Human
cuccuuuuuacucaacaca

SEQ ID NO: 272192 - RNA, 24 nt, Human
cucucagccugucauaugcacuuc

SEQ ID NO: 272193 - RNA, 18 nt, Human
cucucucuccccucuccc

SEQ ID NO: 272194 - RNA, 21 nt, Human
cugaaaguacaacuguuccua

SEQ ID NO: 272195 - RNA, 19 nt, Human
cugccaucacccuacccca

SEQ ID NO: 272196 - RNA, 19 nt, Human
cugugcgaagcuggggcug

SEQ ID NO: 272197 - RNA, 18 nt, Human
cuguguaccccacccccc

SEQ ID NO: 272198 - RNA, 24 nt, Human
cuucaaacccccuucuuccccagg

SEQ ID NO: 272199 - RNA, 19 nt, Human
cuuccccccacccccauuu

SEQ ID NO: 272200 - RNA, 18 nt, Human
cuucuaucccuacugcuc

SEQ ID NO: 272201 - RNA, 22 nt, Human
cuucucgacaccucaccucuga

SEQ ID NO: 272202 - RNA, 20 nt, Human
gaacauuuagcagcuuugaa

SEQ ID NO: 272203 - RNA, 20 nt, Human
gacuuucugccaccuucccu

SEQ ID NO: 272204 - RNA, 25 nt, Human
gagccaaccuuaaccuucccucuga

SEQ ID NO: 272205 - RNA, 24 nt, Human
gagccaaggccaaggacacacucc

SEQ ID NO: 272206 - RNA, 21 nt, Human
gagggcagcaguggcaaacag

SEQ ID NO: 272207 - RNA, 20 nt, Human
gauggauuuuuuuuuuuccu

SEQ ID NO: 272208 - RNA, 19 nt, Human
gcacucccagguucacacc

SEQ ID NO: 272209 - RNA, 19 nt, Human
gcacugccaucacccuacc

SEQ ID NO: 272210 - RNA, 23 nt, Human
gcccuaagcccgaguccagcccu

SEQ ID NO: 272211 - RNA, 20 nt, Human
gcccucgccgccgccaccgc

SEQ ID NO: 272212 - RNA, 22 nt, Human
gcucggcguccgccgcugccuc

SEQ ID NO: 272213 - RNA, 18 nt, Human
gcuuccccccacccccau

SEQ ID NO: 272214 - RNA, 20 nt, Human
ggaaaauaauuuauaaaagc

SEQ ID NO: 272215 - RNA, 20 nt, Human
ggaauccuggccagagccaa

SEQ ID NO: 272216 - RNA, 18 nt, Human
ggaccagaauguuuaugc

SEQ ID NO: 272217 - RNA, 21 nt, Human
ggagacaaugggagccucagc

SEQ ID NO: 272218 - RNA, 19 nt, Human
ggcaaagagaacauuuagc

SEQ ID NO: 272219 - RNA, 21 nt, Human
ggcccuaagcccgaguccagc

SEQ ID NO: 272220 - RNA, 21 nt, Human
gggaacacaaacaccggacca

SEQ ID NO: 272221 - RNA, 25 nt, Human
gggcagcaguggcaaacaguuaaaa

SEQ ID NO: 272222 - RNA, 18 nt, Human
guaccccacccuggcaga

SEQ ID NO: 272223 - RNA, 22 nt, Human
guccagguccucaagggcccac

SEQ ID NO: 272224 - RNA, 23 nt, Human
gugaaacagggcacaagcccuaa

SEQ ID NO: 272225 - RNA, 22 nt, Human
guggagccaaggccaaggacac

SEQ ID NO: 272226 - RNA, 19 nt, Human
guguuggggcccaguggcu

SEQ ID NO: 272227 - RNA, 21 nt, Human
uaaaaauaaaaucuacaagga

SEQ ID NO: 272228 - RNA, 21 nt, Human
uaagcccgaguccagcccucg

SEQ ID NO: 272229 - RNA, 21 nt, Human
uaagguuuauuuucuuuggcu

SEQ ID NO: 272230 - RNA, 20 nt, Human
uacacggagucuuuauggca

SEQ ID NO: 272231 - RNA, 22 nt, Human
uacuccagagccgggcaggggu

SEQ ID NO: 272232 - RNA, 18 nt, Human
uagaaagaaacccaaaaa

SEQ ID NO: 272233 - RNA, 21 nt, Human
uagaaagaaacccaaaaaaga

SEQ ID NO: 272234 - RNA, 22 nt, Human
uagcuccucuaccuccagcaac

SEQ ID NO: 272235 - RNA, 22 nt, Human
uagggugaggacccuguccguc

SEQ ID NO: 272236 - RNA, 18 nt, Human
ucacauuaguuguccucu

SEQ ID NO: 272237 - RNA, 21 nt, Human
ucacuuucccuucucgacacc

SEQ ID NO: 272238 - RNA, 22 nt, Human
ucagcucagggguggcuggagc

SEQ ID NO: 272239 - RNA, 25 nt, Human
uccacacuuaccagggggguuucca

SEQ ID NO: 272240 - RNA, 22 nt, Human
uccacaguccacauacagucac

SEQ ID NO: 272241 - RNA, 24 nt, Human
uccacauacagucacuuccucacu

SEQ ID NO: 272242 - RNA, 21 nt, Human
uccagguccucaagggcccac

SEQ ID NO: 272243 - RNA, 25 nt, Human
ucccagugauaagcccaguuguugg

SEQ ID NO: 272244 - RNA, 23 nt, Human
uccccacccccacccugugucug

SEQ ID NO: 272245 - RNA, 28 nt, Human
ucccccaggcagcccuccaggagccugu

SEQ ID NO: 272246 - RNA, 24 nt, Human
uccccgcuguagguccagguccag

SEQ ID NO: 272247 - RNA, 25 nt, Human
uccucagugucaaaccccguacccc

SEQ ID NO: 272248 - RNA, 23 nt, Human
uccuggccagagccaaccuuaac

SEQ ID NO: 272249 - RNA, 21 nt, Human
uccuucuaucccuccuucccc

SEQ ID NO: 272250 - RNA, 24 nt, Human
ucgggacagaggagaaaaauccca

SEQ ID NO: 272251 - RNA, 22 nt, Human
ucucaaagccaguguuggggcc

SEQ ID NO: 272252 - RNA, 23 nt, Human
ucuggggcagacgguacuccaga

SEQ ID NO: 272253 - RNA, 22 nt, Human
ucuuggugggcuucaaaccccc

SEQ ID NO: 272254 - RNA, 21 nt, Human
ucuuuggcuggagcuacaggc

SEQ ID NO: 272255 - RNA, 24 nt, Human
ucuuuggcuggagcuacaggccuu

SEQ ID NO: 272256 - RNA, 18 nt, Human
ucuuuuguuguugcuggg

SEQ ID NO: 272257 - RNA, 18 nt, Human
ugaaacagggcacaagcc

SEQ ID NO: 272258 - RNA, 18 nt, Human
ugagagcuuguguguuug

SEQ ID NO: 272259 - RNA, 24 nt, Human
ugauguuggggcuguugcaacaug

SEQ ID NO: 272260 - RNA, 20 nt, Human
ugccaucacccuaccccagc

SEQ ID NO: 272261 - RNA, 22 nt, Human
ugccucccccaggcagcccucc

SEQ ID NO: 272262 - RNA, 23 nt, Human
ugccugccucuuccuguacacug

SEQ ID NO: 272263 - RNA, 19 nt, Human
ugccuggaauccuggccag

SEQ ID NO: 272264 - RNA, 21 nt, Human
ugccuggaauccuggccagag

SEQ ID NO: 272265 - RNA, 20 nt, Human
uggagaagcugccuguggcu

SEQ ID NO: 272266 - RNA, 18 nt, Human
uggcaaggcagugaauga

SEQ ID NO: 272267 - RNA, 21 nt, Human
uggcaaggcagugaaugacau

SEQ ID NO: 272268 - RNA, 20 nt, Human
uggccacuuccacuccaccc

SEQ ID NO: 272269 - RNA, 19 nt, Human
ugugagggguggggaacac

SEQ ID NO: 272270 - RNA, 21 nt, Human
uguggagaagcugccuguggc

SEQ ID NO: 272271 - RNA, 19 nt, Human
uguggagccaaggccaagg

SEQ ID NO: 272272 - RNA, 18 nt, Human
uguuccuaacccagucca

SEQ ID NO: 272273 - RNA, 21 nt, Human
uguugcuggguuguguaauuu

SEQ ID NO: 272274 - RNA, 24 nt, Human
uucaaacccccuucuuccccaggc

SEQ ID NO: 272275 - RNA, 21 nt, Human
uuccagagaaacugcuuagcu

SEQ ID NO: 272276 - RNA, 18 nt, Human
uucccuuccucucacagg

SEQ ID NO: 272277 - RNA, 19 nt, Human
uuccuucucccuccuaagg

SEQ ID NO: 272278 - RNA, 18 nt, Human
uuuauaaaagcacucccc

SEQ ID NO: 272279 - RNA, 20 nt, Human
uuucccagugauaagcccag

SEQ ID NO: 272280 - RNA, 21 nt, Human
uuuccuguucacucuacccuu

SEQ ID NO: 272281 - RNA, 19 nt, Human
uuucggggggggggggggg

SEQ ID NO: 272282 - RNA, 19 nt, Human
uuuuuucgggggggggggg

SEQ ID NO: 272283 - RNA, 18 nt, Human
uuuuuuguguuuucccag

SEQ ID NO: 272284 - RNA, 19 nt, Human
uuuuuuuuuuccuucuccc

SEQ ID NO: 272285 - RNA, 22 nt, Human
uuuuuuuuuuccuucucccucc

SEQ ID NO: 272286 - RNA, 21 nt, Human
aaaaaacuagcucagaaaagg

SEQ ID NO: 272287 - RNA, 24 nt, Human
aaaaacuagcucagaaaaggucaa

SEQ ID NO: 272288 - RNA, 22 nt, Human
aaagugaaacuacugauucaac

SEQ ID NO: 272289 - RNA, 19 nt, Human
aacuagcucagaaaagguc

SEQ ID NO: 272290 - RNA, 21 nt, Human
aaugguguccuaagaaauugu

SEQ ID NO: 272291 - RNA, 23 nt, Human
acaaaaaaacuagcucagaaaag

SEQ ID NO: 272292 - RNA, 20 nt, Human
acugauucaacauacugaca

SEQ ID NO: 272293 - RNA, 29 nt, Human
agggcggcucugguggcggcggcggcggg

SEQ ID NO: 272294 - RNA, 22 nt, Human
cggcggcccuguuccggcugcc

SEQ ID NO: 272295 - RNA, 20 nt, Human
cggcucugguggcggcggcg

SEQ ID NO: 272296 - RNA, 24 nt, Human
gcggcggcggcggcgguggcggcu

SEQ ID NO: 272297 - RNA, 19 nt, Human
gcggcggcgguggcggcug

SEQ ID NO: 272298 - RNA, 20 nt, Human
gcggcggcgguggcggcugc

SEQ ID NO: 272299 - RNA, 23 nt, Human
ggcggcggcggcggcgguggcgg

SEQ ID NO: 272300 - RNA, 23 nt, Human
ggcggcggcggcgguggcggcug

SEQ ID NO: 272301 - RNA, 20 nt, Human
gguggcggcggcggcggcgg

SEQ ID NO: 272302 - RNA, 23 nt, Human
gguggcggcggcggcggcggugg

SEQ ID NO: 272303 - RNA, 25 nt, Human
gguggcggcggcggcggcgguggcg

SEQ ID NO: 272304 - RNA, 20 nt, Human
guggcggcggcggcggcggu

SEQ ID NO: 272305 - RNA, 18 nt, Human
uacaaaaaaacuagcuca

SEQ ID NO: 272306 - RNA, 23 nt, Human
uauaauaguacaaaaaaacuagc

SEQ ID NO: 272307 - RNA, 20 nt, Human
uggcggcggcggcggcggug

SEQ ID NO: 272308 - RNA, 21 nt, Human
uggcggcggcggcggcggugg

SEQ ID NO: 272309 - RNA, 25 nt, Human
uggcggcggcggcggcgguggcggc

SEQ ID NO: 272310 - RNA, 18 nt, Human
ugguggcggcggcggcgg

SEQ ID NO: 272311 - RNA, 24 nt, Human
uuaaagugaaacuacugauucaac

SEQ ID NO: 272312 - RNA, 25 nt, Human
uuaacagucauaauaauccuuuauu

SEQ ID NO: 272313 - RNA, 23 nt, Human
uuaguuuugcaauaauuucuuuu

SEQ ID NO: 272314 - RNA, 23 nt, Human
uuuauuaguaccagcucuuaaaa

SEQ ID NO: 272315 - RNA, 23 nt, Human
uuuuuuuuuuuuuuuuuuaacag

SEQ ID NO: 272316 - RNA, 20 nt, Human
aaggauggcugccaagaugg

SEQ ID NO: 272317 - RNA, 18 nt, Human
acauaauagaguccaucu

SEQ ID NO: 272318 - RNA, 22 nt, Human
agaguccaucuucaguuucuuc

SEQ ID NO: 272319 - RNA, 19 nt, Human
agauggaaagucuuacugg

SEQ ID NO: 272320 - RNA, 20 nt, Human
agcaguacuuaaagauacaa

SEQ ID NO: 272321 - RNA, 24 nt, Human
agugcuaacaaacuaaaugaaaau

SEQ ID NO: 272322 - RNA, 22 nt, Human
uaaaugaaaauaaggcuauuuu

SEQ ID NO: 272323 - RNA, 21 nt, Human
ugaaaaguuguggcuccccca

SEQ ID NO: 272324 - RNA, 26 nt, Human
ugaaaauaaggcuauuuugcauuuaa

SEQ ID NO: 272325 - RNA, 24 nt, Human
ugaaguccuaaacauuuguccaug

SEQ ID NO: 272326 - RNA, 19 nt, Human
ugauccccaguguuugcuc

SEQ ID NO: 272327 - RNA, 25 nt, Human
uuaaaauaguguuugaaaagcucac

SEQ ID NO: 272328 - RNA, 22 nt, Human
aaaaaaaaaaaaaucccaaaag

SEQ ID NO: 272329 - RNA, 23 nt, Human
aaaaaaaaaaaaaucccaaaagg

SEQ ID NO: 272330 - RNA, 27 nt, Human
aaaaacaaaacaaaacaacauuguuuc

SEQ ID NO: 272331 - RNA, 19 nt, Human
aaaaacaaaauugcuugaa

SEQ ID NO: 272332 - RNA, 19 nt, Human
aaaaagcaaaaauagcucc

SEQ ID NO: 272333 - RNA, 21 nt, Human
aaaacaaaacaaaacaacauu

SEQ ID NO: 272334 - RNA, 25 nt, Human
aaaacaaaacaacauuguuucgggg

SEQ ID NO: 272335 - RNA, 19 nt, Human
aaaacauaaaaagcaaaaa

SEQ ID NO: 272336 - RNA, 18 nt, Human
aaacaaaacaaaacaaca

SEQ ID NO: 272337 - RNA, 18 nt, Human
aaacaaacuaaaggaaca

SEQ ID NO: 272338 - RNA, 21 nt, Human
aaacaccuaaaacacacugcg

SEQ ID NO: 272339 - RNA, 21 nt, Human
aaagcaaaaauagcuccccuu

SEQ ID NO: 272340 - RNA, 20 nt, Human
aaauagagauaaccaguaaa

SEQ ID NO: 272341 - RNA, 18 nt, Human
aacaggaagucagugagc

SEQ ID NO: 272342 - RNA, 18 nt, Human
aacuuuuuuuuuuuuccc

SEQ ID NO: 272343 - RNA, 19 nt, Human
aagcagggucagcuuagug

SEQ ID NO: 272344 - RNA, 23 nt, Human
aagcccaaccauuuccagcacca

SEQ ID NO: 272345 - RNA, 21 nt, Human
aaggaaaaaaaacaaaacaaa

SEQ ID NO: 272346 - RNA, 20 nt, Human
aaggcacauugauauggaau

SEQ ID NO: 272347 - RNA, 21 nt, Human
aaggcacauugauauggaauu

SEQ ID NO: 272348 - RNA, 24 nt, Human
aaguauuuuaaaaaaaaaaaaauc

SEQ ID NO: 272349 - RNA, 21 nt, Human
aagugucuucccaagaauuuc

SEQ ID NO: 272350 - RNA, 21 nt, Human
acugcauuuucuuuuuccaau

SEQ ID NO: 272351 - RNA, 19 nt, Human
agaaaaaaaaaucaagccu

SEQ ID NO: 272352 - RNA, 18 nt, Human
agagggagagaggaagag

SEQ ID NO: 272353 - RNA, 27 nt, Human
agauaaccaguaaacaauuuucagaac

SEQ ID NO: 272354 - RNA, 23 nt, Human
agauguugaaacugacgauggcu

SEQ ID NO: 272355 - RNA, 22 nt, Human
agcugaacuuuaaccccgccua

SEQ ID NO: 272356 - RNA, 18 nt, Human
agggcugaaaaacauagu

SEQ ID NO: 272357 - RNA, 25 nt, Human
agggggcggcugcggcgccgcgcgg

SEQ ID NO: 272358 - RNA, 24 nt, Human
agugugggugagagaggagaaaga

SEQ ID NO: 272359 - RNA, 23 nt, Human
auugguuucaucauuauuauuau

SEQ ID NO: 272360 - RNA, 18 nt, Human
auuucaguuacuugauug

SEQ ID NO: 272361 - RNA, 23 nt, Human
auuuguuuuuuuguuuuuuuuuu

SEQ ID NO: 272362 - RNA, 18 nt, Human
caaagacaaacaccuaaa

SEQ ID NO: 272363 - RNA, 20 nt, Human
caaagacaaacaccuaaaac

SEQ ID NO: 272364 - RNA, 20 nt, Human
cacaaaaaaguacaaagaca

SEQ ID NO: 272365 - RNA, 23 nt, Human
cacaaaaaaguacaaagacaaac

SEQ ID NO: 272366 - RNA, 20 nt, Human
caccgcacagccgccgcccg

SEQ ID NO: 272367 - RNA, 19 nt, Human
caccgcaccgcacagccgc

SEQ ID NO: 272368 - RNA, 20 nt, Human
caccuguguggguaaauuca

SEQ ID NO: 272369 - RNA, 19 nt, Human
cacgucaccuaaugcucac

SEQ ID NO: 272370 - RNA, 24 nt, Human
cacuauacaugccuacuguacgcg

SEQ ID NO: 272371 - RNA, 23 nt, Human
cacuuuuuuuuguuuuuguuucu

SEQ ID NO: 272372 - RNA, 23 nt, Human
caugaaauacugugaaacagcca

SEQ ID NO: 272373 - RNA, 20 nt, Human
cccgcgccggcccggccggg

SEQ ID NO: 272374 - RNA, 20 nt, Human
cccgcucgcgccgccgccgc

SEQ ID NO: 272375 - RNA, 21 nt, Human
cccgcucgcgccgccgccgcg

SEQ ID NO: 272376 - RNA, 24 nt, Human
ccgcaccgcacagccgccgcccgc

SEQ ID NO: 272377 - RNA, 22 nt, Human
ccgcgccggcccggccgggugc

SEQ ID NO: 272378 - RNA, 20 nt, Human
ccgcgcgcccgccuccgccu

SEQ ID NO: 272379 - RNA, 22 nt, Human
ccuagaguuucccuacacuccc

SEQ ID NO: 272380 - RNA, 21 nt, Human
ccuccgcuagccacgucaccu

SEQ ID NO: 272381 - RNA, 20 nt, Human
cgccgcgcggccagccgggu

SEQ ID NO: 272382 - RNA, 20 nt, Human
cgccuccgcucugcaccgca

SEQ ID NO: 272383 - RNA, 19 nt, Human
cgcgcccgccuccgccucc

SEQ ID NO: 272384 - RNA, 18 nt, Human
cgcucugcaccgcaccgc

SEQ ID NO: 272385 - RNA, 19 nt, Human
cgcucugcaccgcaccgca

SEQ ID NO: 272386 - RNA, 23 nt, Human
cggccgggugcccgcgagcugcc

SEQ ID NO: 272387 - RNA, 21 nt, Human
cguuugggggugcaaacuuuu

SEQ ID NO: 272388 - RNA, 18 nt, Human
cuacuacaaaagauuuag

SEQ ID NO: 272389 - RNA, 19 nt, Human
cucagaauagcacugccac

SEQ ID NO: 272390 - RNA, 19 nt, Human
cuccgcuagccacgucacc

SEQ ID NO: 272391 - RNA, 24 nt, Human
cugugguuuuuuguguuuuuuuuu

SEQ ID NO: 272392 - RNA, 22 nt, Human
cuucaaauguuacaaagcccaa

SEQ ID NO: 272393 - RNA, 26 nt, Human
cuucaaauguuacaaagcccaaccaa

SEQ ID NO: 272394 - RNA, 24 nt, Human
gaaauacugugaaacagccaggcu

SEQ ID NO: 272395 - RNA, 21 nt, Human
gaaccaaaacaaacuaaagga

SEQ ID NO: 272396 - RNA, 21 nt, Human
gagagagagagagagagaagg

SEQ ID NO: 272397 - RNA, 18 nt, Human
gagcugaacuuuaacccc

SEQ ID NO: 272398 - RNA, 19 nt, Human
gaggagaaagagggagaga

SEQ ID NO: 272399 - RNA, 20 nt, Human
gaggagaaagagggagagag

SEQ ID NO: 272400 - RNA, 18 nt, Human
gagggagagaggaagaga

SEQ ID NO: 272401 - RNA, 18 nt, Human
gaggugugcgugagugug

SEQ ID NO: 272402 - RNA, 19 nt, Human
gccuagaguuucccuacac

SEQ ID NO: 272403 - RNA, 22 nt, Human
gccuagaguuucccuacacucc

SEQ ID NO: 272404 - RNA, 22 nt, Human
gcgccggcccggccgggugccc

SEQ ID NO: 272405 - RNA, 21 nt, Human
gcgugugcgucugggugugcg

SEQ ID NO: 272406 - RNA, 20 nt, Human
ggagggggugugggggaggg

SEQ ID NO: 272407 - RNA, 20 nt, Human
ggccgggugcccgcgagcug

SEQ ID NO: 272408 - RNA, 18 nt, Human
gggaagcaaaggggugcu

SEQ ID NO: 272409 - RNA, 24 nt, Human
gggaagcaaaggggugcuucgcug

SEQ ID NO: 272410 - RNA, 18 nt, Human
gggagggggcggcugcgg

SEQ ID NO: 272411 - RNA, 19 nt, Human
gggagggggcggcugcggc

SEQ ID NO: 272412 - RNA, 19 nt, Human
ggggagaaaaaaaaaucaa

SEQ ID NO: 272413 - RNA, 19 nt, Human
ggggagggggcggcugcgg

SEQ ID NO: 272414 - RNA, 20 nt, Human
ggggagggggcggcugcggc

SEQ ID NO: 272415 - RNA, 21 nt, Human
ggggagggggcggcugcggcg

SEQ ID NO: 272416 - RNA, 23 nt, Human
ggggagggggugugggggagggg

SEQ ID NO: 272417 - RNA, 19 nt, Human
ggggugcuucgcugucugg

SEQ ID NO: 272418 - RNA, 19 nt, Human
ggggugugggggagggggc

SEQ ID NO: 272419 - RNA, 18 nt, Human
gggugugggggagggggc

SEQ ID NO: 272420 - RNA, 24 nt, Human
ggucagcuuagugcuucacaguuu

SEQ ID NO: 272421 - RNA, 23 nt, Human
gugaaaggacuagaaaaacaaaa

SEQ ID NO: 272422 - RNA, 24 nt, Human
gugcuucacaguuugacugcuucu

SEQ ID NO: 272423 - RNA, 24 nt, Human
uaaaaacaaaauugcuugaagcag

SEQ ID NO: 272424 - RNA, 23 nt, Human
uaaauuguaaaaugcagcaacau

SEQ ID NO: 272425 - RNA, 24 nt, Human
uaagcaucuacagaucucagaaua

SEQ ID NO: 272426 - RNA, 28 nt, Human
uaaugcacucuacuuuauccuacauuaa

SEQ ID NO: 272427 - RNA, 25 nt, Human
uacaacagucccuaaaguauuuuaa

SEQ ID NO: 272428 - RNA, 21 nt, Human
uauaaaauuaacagauaccau

SEQ ID NO: 272429 - RNA, 23 nt, Human
uauaaaauuaacagauaccauga

SEQ ID NO: 272430 - RNA, 25 nt, Human
uauauaaaaauuaguuacuaacacu

SEQ ID NO: 272431 - RNA, 26 nt, Human
ucaaauaaaaaaaaauaaaagaaaaa

SEQ ID NO: 272432 - RNA, 21 nt, Human
ucacaaaaaaguacaaagaca

SEQ ID NO: 272433 - RNA, 18 nt, Human
ucccaaaagguuauggcc

SEQ ID NO: 272434 - RNA, 23 nt, Human
ucccuaacaaguacccuugaucu

SEQ ID NO: 272435 - RNA, 21 nt, Human
uccgcugauagugaaguugua

SEQ ID NO: 272436 - RNA, 24 nt, Human
ucggggagaaagaugaggagcaaa

SEQ ID NO: 272437 - RNA, 19 nt, Human
ucugcaccgcaccgcacag

SEQ ID NO: 272438 - RNA, 21 nt, Human
ucugggggaaaauaaaggaag

SEQ ID NO: 272439 - RNA, 24 nt, Human
ugaaaaacauaguuuaaaggcaag

SEQ ID NO: 272440 - RNA, 19 nt, Human
ugaaacagccaggcuccgu

SEQ ID NO: 272441 - RNA, 22 nt, Human
ugaagggcugaaaaacauaguu

SEQ ID NO: 272442 - RNA, 23 nt, Human
ugaagucgcaugggaagcaaagg

SEQ ID NO: 272443 - RNA, 21 nt, Human
ugacgauggcugacauaaaag

SEQ ID NO: 272444 - RNA, 18 nt, Human
ugagagaggagaaagagg

SEQ ID NO: 272445 - RNA, 22 nt, Human
ugcagcaccgacuuuggucaaa

SEQ ID NO: 272446 - RNA, 19 nt, Human
ugcagucugcuaagaaaaa

SEQ ID NO: 272447 - RNA, 21 nt, Human
ugccaccgaccguacaggaca

SEQ ID NO: 272448 - RNA, 18 nt, Human
ugccgcuccaugagcuga

SEQ ID NO: 272449 - RNA, 27 nt, Human
ugcgcuggguugagguugccgugcauc

SEQ ID NO: 272450 - RNA, 21 nt, Human
ugcgcuggguugagguugcgu

SEQ ID NO: 272451 - RNA, 20 nt, Human
ugcuguuuccauguacaagu

SEQ ID NO: 272452 - RNA, 21 nt, Human
ugcuugaagcagggucagcuu

SEQ ID NO: 272453 - RNA, 21 nt, Human
ugggggugcaaacuuuuuuuu

SEQ ID NO: 272454 - RNA, 23 nt, Human
ugggguaugcgugugcgucuggg

SEQ ID NO: 272455 - RNA, 25 nt, Human
ugggugagagaggagaaagagggaa

SEQ ID NO: 272456 - RNA, 18 nt, Human
uggucaaauaaaaaaaaa

SEQ ID NO: 272457 - RNA, 21 nt, Human
uguaaaaugcagcaacaucca

SEQ ID NO: 272458 - RNA, 22 nt, Human
uguaaaaugcagcaacauccaa

SEQ ID NO: 272459 - RNA, 22 nt, Human
ugucuuaaugcacucuacuuua

SEQ ID NO: 272460 - RNA, 24 nt, Human
uguuacaaagcccaaccauuucca

SEQ ID NO: 272461 - RNA, 22 nt, Human
uguuuuuguuuuuuguuuuuuu

SEQ ID NO: 272462 - RNA, 22 nt, Human
uuaaauagagauaaccaguaaa

SEQ ID NO: 272463 - RNA, 18 nt, Human
uuaaauguaagugcagca

SEQ ID NO: 272464 - RNA, 23 nt, Human
uuacuaacacuagaacaugcaga

SEQ ID NO: 272465 - RNA, 23 nt, Human
uuagucaugugcuuugauaacag

SEQ ID NO: 272466 - RNA, 19 nt, Human
uucaauagaggagcauguu

SEQ ID NO: 272467 - RNA, 19 nt, Human
uucaugaaauacugugaaa

SEQ ID NO: 272468 - RNA, 24 nt, Human
uucuaagcaucuacagaucucaga

SEQ ID NO: 272469 - RNA, 25 nt, Human
uuguuucggggagaaagaugaggag

SEQ ID NO: 272470 - RNA, 25 nt, Human
uuguuuuuguuuuuuguuuuuuuuu

SEQ ID NO: 272471 - RNA, 22 nt, Human
uuuaaccccgccuagaguuucc

SEQ ID NO: 272472 - RNA, 20 nt, Human
uuuaauuuccuucaguuuuu

SEQ ID NO: 272473 - RNA, 28 nt, Human
uuuguuuuuguuucugugguuuuuugug

SEQ ID NO: 272474 - RNA, 23 nt, Human
uuuuaaaaaaaaaaaaaucccaa

SEQ ID NO: 272475 - RNA, 23 nt, Human
uuuucagaacuuggaaguuuaaa

SEQ ID NO: 272476 - RNA, 21 nt, Human
uuuuuaaggcuugcuugugaa

SEQ ID NO: 272477 - RNA, 23 nt, Human
uuuuuguuuuuguuucugugguu

SEQ ID NO: 272478 - RNA, 21 nt, Human
uuuuuguuuuuguuuuuuguu

SEQ ID NO: 272479 - RNA, 23 nt, Human
uuuuuuuuguuuuuguuucugug

SEQ ID NO: 272480 - RNA, 20 nt, Human
aaaccaauaaaacuagcuua

SEQ ID NO: 272481 - RNA, 23 nt, Human
aagaaaaucuucgagaagcaaga

SEQ ID NO: 272482 - RNA, 19 nt, Human
aaucaggacggggcucugc

SEQ ID NO: 272483 - RNA, 25 nt, Human
acccagcaucucugacgccgccucc

SEQ ID NO: 272484 - RNA, 23 nt, Human
agacagaacaucuauuucccagc

SEQ ID NO: 272485 - RNA, 18 nt, Human
auccaugaauucccccuu

SEQ ID NO: 272486 - RNA, 25 nt, Human
caagaauacuaaaccaauaaaacua

SEQ ID NO: 272487 - RNA, 22 nt, Human
cacccagcaucucugacgccgc

SEQ ID NO: 272488 - RNA, 24 nt, Human
caccgcaacuucacaacaaaccca

SEQ ID NO: 272489 - RNA, 18 nt, Human
cacucggcgugcuagagu

SEQ ID NO: 272490 - RNA, 19 nt, Human
cacuuggaaaggaaccaag

SEQ ID NO: 272491 - RNA, 22 nt, Human
caugcagagagaacacuucacc

SEQ ID NO: 272492 - RNA, 23 nt, Human
ccaguccuccuuaaauagccaaa

SEQ ID NO: 272493 - RNA, 19 nt, Human
ccagucuuccucuuuuccu

SEQ ID NO: 272494 - RNA, 23 nt, Human
cccaagaaaaucuucgagaagca

SEQ ID NO: 272495 - RNA, 20 nt, Human
ccccaagggccugaaggacc

SEQ ID NO: 272496 - RNA, 22 nt, Human
ccuuucugccuuuguguuguuu

SEQ ID NO: 272497 - RNA, 23 nt, Human
cuaaaggcuacagagauuucauu

SEQ ID NO: 272498 - RNA, 21 nt, Human
cuuuuuucuuuuuuuccuuuu

SEQ ID NO: 272499 - RNA, 21 nt, Human
gacuucauguaacaaaggcua

SEQ ID NO: 272500 - RNA, 18 nt, Human
gagaacacuucaccuaca

SEQ ID NO: 272501 - RNA, 23 nt, Human
gcagagagaacacuucaccuaca

SEQ ID NO: 272502 - RNA, 18 nt, Human
ggcugcgaucuaccauca

SEQ ID NO: 272503 - RNA, 21 nt, Human
guaaacaacaagaauacuaaa

SEQ ID NO: 272504 - RNA, 23 nt, Human
guuuuuuuccuuuuuucuuuuuu

SEQ ID NO: 272505 - RNA, 19 nt, Human
uaacaaaggcuacguugca

SEQ ID NO: 272506 - RNA, 20 nt, Human
uaauccaugaauucccccuu

SEQ ID NO: 272507 - RNA, 18 nt, Human
uaauuuuggacauuggcc

SEQ ID NO: 272508 - RNA, 25 nt, Human
uagaggcauuucuuccauagagccu

SEQ ID NO: 272509 - RNA, 20 nt, Human
ucaggacggggcucugcgcu

SEQ ID NO: 272510 - RNA, 21 nt, Human
ucauagagacagaacaucuau

SEQ ID NO: 272511 - RNA, 21 nt, Human
uccuuaaauagccaaagauuc

SEQ ID NO: 272512 - RNA, 18 nt, Human
ugccuuuguguuguuuug

SEQ ID NO: 272513 - RNA, 23 nt, Human
ugcguaaacaacaagaauacuaa

SEQ ID NO: 272514 - RNA, 22 nt, Human
uguccuauuugacacuuggaaa

SEQ ID NO: 272515 - RNA, 24 nt, Human
uguuuuguccagucuuccucuuuu

SEQ ID NO: 272516 - RNA, 19 nt, Human
uugcuggucuauuaucuuc

SEQ ID NO: 272517 - RNA, 20 nt, Human
uugcuggucuauuaucuucu

SEQ ID NO: 272518 - RNA, 24 nt, Human
uuuacagucaucugagccccgcga

SEQ ID NO: 272519 - RNA, 25 nt, Human
uuuguguucaaacuguuuuuuuccu

SEQ ID NO: 272520 - RNA, 23 nt, Human
uuuuaagauuucaaacuggguua

SEQ ID NO: 272521 - RNA, 18 nt, Human
uuuuuuccuuuuuuuuuc

SEQ ID NO: 272522 - RNA, 19 nt, Human
acgugggccgggggccggc

SEQ ID NO: 272523 - RNA, 18 nt, Human
cccugggauuccugggac

SEQ ID NO: 272524 - RNA, 21 nt, Human
ccugggacgauggagaagggg

SEQ ID NO: 272525 - RNA, 18 nt, Human
cgggcugggagucggcag

SEQ ID NO: 272526 - RNA, 29 nt, Human
ggcugggagucggcagggguguucuuguu

SEQ ID NO: 272527 - RNA, 24 nt, Human
gggcugggagucggcagggguguu

SEQ ID NO: 272528 - RNA, 20 nt, Human
ugggacgauggagaaggggc

SEQ ID NO: 272529 - RNA, 23 nt, Human
ugucuuuuuggccgggcugggag

SEQ ID NO: 272530 - RNA, 23 nt, Human
uguguuuugucuuuuuggccggg

SEQ ID NO: 272531 - RNA, 18 nt, Human
uucuuguucacucuaauu

SEQ ID NO: 272532 - RNA, 24 nt, Human
uugucuuuuuggccgggcugggag

SEQ ID NO: 272533 - RNA, 23 nt, Human
uuuugucuuuuuggccgggcugg

SEQ ID NO: 272534 - RNA, 21 nt, Human
uuuuuuuuuucuucugccuuu

SEQ ID NO: 272535 - RNA, 29 nt, Human
uuuuuuuuuuuuuucuucugccuuuguuu

SEQ ID NO: 272536 - RNA, 23 nt, Human
uuuuuuuuuuuuuuucuucuggg

SEQ ID NO: 272537 - RNA, 18 nt, Human
aaaaagacaccaaacaga

SEQ ID NO: 272538 - RNA, 21 nt, Human
aaaaagacaccaaacagacaa

SEQ ID NO: 272539 - RNA, 23 nt, Human
aaaauggacugcucuauugcaaa

SEQ ID NO: 272540 - RNA, 20 nt, Human
acaacaugugcacaucacag

SEQ ID NO: 272541 - RNA, 24 nt, Human
aggcagagugauaacacaaucuaa

SEQ ID NO: 272542 - RNA, 19 nt, Human
ccaaacagacaacaugugc

SEQ ID NO: 272543 - RNA, 21 nt, Human
cucuuuaaaaacucugguuua

SEQ ID NO: 272544 - RNA, 21 nt, Human
cugggauaaauccgucaggcc

SEQ ID NO: 272545 - RNA, 19 nt, Human
cuguguuugucaccaaucc

SEQ ID NO: 272546 - RNA, 21 nt, Human
gacaucacagguccagugaaa

SEQ ID NO: 272547 - RNA, 19 nt, Human
gacuauacacaggcagagu

SEQ ID NO: 272548 - RNA, 22 nt, Human
uaacacaaucuaaucuucauca

SEQ ID NO: 272549 - RNA, 19 nt, Human
uagaacaacaaaaauaagg

SEQ ID NO: 272550 - RNA, 20 nt, Human
uccgucaggcuccuuauuga

SEQ ID NO: 272551 - RNA, 21 nt, Human
uccuucguuaucguguuccug

SEQ ID NO: 272552 - RNA, 21 nt, Human
ucgcauggacuaucugacuau

SEQ ID NO: 272553 - RNA, 19 nt, Human
ugaaaugacaucacagguc

SEQ ID NO: 272554 - RNA, 21 nt, Human
ugcacaaaaagacaccaaaca

SEQ ID NO: 272555 - RNA, 22 nt, Human
ugcacaaaaagacaccaaacag

SEQ ID NO: 272556 - RNA, 21 nt, Human
ugcccagcucuuacucaguag

SEQ ID NO: 272557 - RNA, 22 nt, Human
ugucaccaauccuuuauugaaa

SEQ ID NO: 272558 - RNA, 19 nt, Human
uguguuugucaccaauccu

SEQ ID NO: 272559 - RNA, 18 nt, Human
uuuuuuuuuuuuuuucug

SEQ ID NO: 272560 - RNA, 25 nt, Human
uuuuuuuuuuuuuuuuucuguguuu

SEQ ID NO: 272561 - RNA, 20 nt, Human
cccccuuucgaggaaccucu

SEQ ID NO: 272562 - RNA, 19 nt, Human
cgguggggcugggcugggc

SEQ ID NO: 272563 - RNA, 26 nt, Human
cuucucauuuuguuguuucuuuuguc

SEQ ID NO: 272564 - RNA, 18 nt, Human
ggcugggcugggcugggc

SEQ ID NO: 272565 - RNA, 18 nt, Human
gggcugggcugggcuggg

SEQ ID NO: 272566 - RNA, 19 nt, Human
gggcugggcugggcugggc

SEQ ID NO: 272567 - RNA, 20 nt, Human
ggggcgagggaggacgggag

SEQ ID NO: 272568 - RNA, 20 nt, Human
ggggcugggcugggcugggc

SEQ ID NO: 272569 - RNA, 24 nt, Human
ucaaaauuucuucuccccccuuuc

SEQ ID NO: 272570 - RNA, 23 nt, Human
ucucaaaauuucuucuccccccu

SEQ ID NO: 272571 - RNA, 19 nt, Human
ugggcugggcugggcuggg

SEQ ID NO: 272572 - RNA, 22 nt, Human
ugggcugggcugggcuggggga

SEQ ID NO: 272573 - RNA, 20 nt, Human
uggggcugggcugggcuggg

SEQ ID NO: 272574 - RNA, 24 nt, Human
uuguuguuucuuuugucgaucuuu

SEQ ID NO: 272575 - RNA, 25 nt, Human
aaauucauuuaugaaccaagaaagg

SEQ ID NO: 272576 - RNA, 21 nt, Human
aaccucauccccagaugcauc

SEQ ID NO: 272577 - RNA, 21 nt, Human
acagaaagcagcugugaucca

SEQ ID NO: 272578 - RNA, 21 nt, Human
agcagcagcuggcaaagcuua

SEQ ID NO: 272579 - RNA, 20 nt, Human
aggccgagggcugcggcggc

SEQ ID NO: 272580 - RNA, 22 nt, Human
aggccggagcccgggcgggccc

SEQ ID NO: 272581 - RNA, 23 nt, Human
aggccggagcccgggcgggcccg

SEQ ID NO: 272582 - RNA, 23 nt, Human
agggcccgcgguggccgcgggcg

SEQ ID NO: 272583 - RNA, 25 nt, Human
augacaacagaaagcagcugugauc

SEQ ID NO: 272584 - RNA, 23 nt, Human
caaguugaaaaggucucgaguua

SEQ ID NO: 272585 - RNA, 21 nt, Human
caaugacaacagaaagcagcu

SEQ ID NO: 272586 - RNA, 23 nt, Human
cagcagcagcuggcaaagcuuag

SEQ ID NO: 272587 - RNA, 22 nt, Human
cagcagcagcuggcaaagcuuc

SEQ ID NO: 272588 - RNA, 21 nt, Human
ccagcagcagcuggcaaagcu

SEQ ID NO: 272589 - RNA, 23 nt, Human
cccgagugcgggucggggcgagc

SEQ ID NO: 272590 - RNA, 22 nt, Human
cgagcgggagcgcggcggggcc

SEQ ID NO: 272591 - RNA, 20 nt, Human
cgcugggcuccgggagcggg

SEQ ID NO: 272592 - RNA, 20 nt, Human
cggcagggcccgcgguggcc

SEQ ID NO: 272593 - RNA, 19 nt, Human
cggccucggcggcgcuggg

SEQ ID NO: 272594 - RNA, 21 nt, Human
cggcgccgccuuacuggccgg

SEQ ID NO: 272595 - RNA, 18 nt, Human
cggcggcaggccggagcc

SEQ ID NO: 272596 - RNA, 20 nt, Human
cggcggggccugccggcugg

SEQ ID NO: 272597 - RNA, 20 nt, Human
cuccgggagcggggccggug

SEQ ID NO: 272598 - RNA, 22 nt, Human
cuggcgcgggugggcucucccu

SEQ ID NO: 272599 - RNA, 18 nt, Human
cuuuggaugcacuucagc

SEQ ID NO: 272600 - RNA, 20 nt, Human
gaaagcagcugugauccagc

SEQ ID NO: 272601 - RNA, 21 nt, Human
gagcggggccgguggcugcgu

SEQ ID NO: 272602 - RNA, 25 nt, Human
gcagcugugauccagcagcagcugg

SEQ ID NO: 272603 - RNA, 19 nt, Human
gcaggccgagggcugcggc

SEQ ID NO: 272604 - RNA, 18 nt, Human
gcccgagugcgggucggg

SEQ ID NO: 272605 - RNA, 20 nt, Human
gcgaguccgcguucggccuc

SEQ ID NO: 272606 - RNA, 18 nt, Human
gcgcggcggagggaacgg

SEQ ID NO: 272607 - RNA, 23 nt, Human
ggacaacagcaaugacaacagaa

SEQ ID NO: 272608 - RNA, 21 nt, Human
ggccgguggcugcgugcagga

SEQ ID NO: 272609 - RNA, 21 nt, Human
ggcggcgccgccuuacuggcc

SEQ ID NO: 272610 - RNA, 25 nt, Human
gggucggggcgagcgggagcgcggg

SEQ ID NO: 272611 - RNA, 24 nt, Human
guucggccuccuggcgcggguggg

SEQ ID NO: 272612 - RNA, 22 nt, Human
uaagcaaccucauccccagaug

SEQ ID NO: 272613 - RNA, 19 nt, Human
uaguaagcaaccucauccc

SEQ ID NO: 272614 - RNA, 24 nt, Human
uaguaagcaaccucauccccagau

SEQ ID NO: 272615 - RNA, 18 nt, Human
ucgccgggccgcuccggu

SEQ ID NO: 272616 - RNA, 21 nt, Human
ucucugagcaccuuuggaugc

SEQ ID NO: 272617 - RNA, 19 nt, Human
ugaaccaaacuaaaauuca

SEQ ID NO: 272618 - RNA, 21 nt, Human
ugaaccaagaaaggaagccaa

SEQ ID NO: 272619 - RNA, 24 nt, Human
uggcaaagcuuaguaagcaaccuc

SEQ ID NO: 272620 - RNA, 20 nt, Human
uggcugcgugcaggccgagg

SEQ ID NO: 272621 - RNA, 19 nt, Human
uugaaaaggucucgaguua

SEQ ID NO: 272622 - RNA, 21 nt, Human
acgcccgccuccuccagccgc

SEQ ID NO: 272623 - RNA, 21 nt, Human
aguggcuccggccagguucug

SEQ ID NO: 272624 - RNA, 22 nt, Human
auucgggguccuccccuuccca

SEQ ID NO: 272625 - RNA, 20 nt, Human
cgguggagagcgagauccgg

SEQ ID NO: 272626 - RNA, 19 nt, Human
cuccagccgccuguccggg

SEQ ID NO: 272627 - RNA, 21 nt, Human
cuccccuucccaugagaaucc

SEQ ID NO: 272628 - RNA, 20 nt, Human
cucugggcuaggcccggcuc

SEQ ID NO: 272629 - RNA, 18 nt, Human
ggaguugggcuuggccgg

SEQ ID NO: 272630 - RNA, 23 nt, Human
ggcuccggccagguucugcuucc

SEQ ID NO: 272631 - RNA, 20 nt, Human
uaguggcuccggccagguuc

SEQ ID NO: 272632 - RNA, 22 nt, Human
uaguggcuccggccagguucug

SEQ ID NO: 272633 - RNA, 19 nt, Human
uccuccccuucccaugaga

SEQ ID NO: 272634 - RNA, 21 nt, Human
ucucugggcuaggcccggcuc

SEQ ID NO: 272635 - RNA, 24 nt, Human
uucgggguccuccccuucccuaag

SEQ ID NO: 272636 - RNA, 24 nt, Human
acaaauauacaaguccauguucuu

SEQ ID NO: 272637 - RNA, 20 nt, Human
acccuuuaaauuuuuucuuc

SEQ ID NO: 272638 - RNA, 21 nt, Human
acgcuuaacacuccuggcugu

SEQ ID NO: 272639 - RNA, 27 nt, Human
agguaguaacuuuucaccggguggacc

SEQ ID NO: 272640 - RNA, 22 nt, Human
auaaccuucuccaaaaacccca

SEQ ID NO: 272641 - RNA, 25 nt, Human
auaaccuucuccaaaaaccccacaa

SEQ ID NO: 272642 - RNA, 23 nt, Human
caaaaaccccacaaaggugagga

SEQ ID NO: 272643 - RNA, 19 nt, Human
caaaaaguucacaaaagca

SEQ ID NO: 272644 - RNA, 19 nt, Human
caaaaugagggcugauccu

SEQ ID NO: 272645 - RNA, 22 nt, Human
caacaauacauuauguacacca

SEQ ID NO: 272646 - RNA, 21 nt, Human
cagguaguaacuuuucacccc

SEQ ID NO: 272647 - RNA, 23 nt, Human
caucacugaacgcuuaacacucc

SEQ ID NO: 272648 - RNA, 20 nt, Human
ccacuggggucagucacucg

SEQ ID NO: 272649 - RNA, 24 nt, Human
ccccacaucacugaacgcuuaaca

SEQ ID NO: 272650 - RNA, 18 nt, Human
cgagcugcgggcgcugcu

SEQ ID NO: 272651 - RNA, 18 nt, Human
cgcugcugcgggugcgcu

SEQ ID NO: 272652 - RNA, 19 nt, Human
gcaguguggauauaaguac

SEQ ID NO: 272653 - RNA, 23 nt, Human
gcgcugcugcgggugcgcugggc

SEQ ID NO: 272654 - RNA, 21 nt, Human
gcgcugggccgcgggcugcgc

SEQ ID NO: 272655 - RNA, 21 nt, Human
gggcugcgcgcugcuuccucg

SEQ ID NO: 272656 - RNA, 26 nt, Human
guacaaauauacaaguccauguucuu

SEQ ID NO: 272657 - RNA, 24 nt, Human
uaaccuucuccaaaaaccccacaa

SEQ ID NO: 272658 - RNA, 22 nt, Human
uacaaaaaguucacaaaagcaa

SEQ ID NO: 272659 - RNA, 22 nt, Human
uacaaguccauguucuuucagc

SEQ ID NO: 272660 - RNA, 24 nt, Human
uacacccuuuaaauuuuuucuucu

SEQ ID NO: 272661 - RNA, 20 nt, Human
uaccaaaauaauuaccaaca

SEQ ID NO: 272662 - RNA, 20 nt, Human
uaccaaaauaauuaccaaca

SEQ ID NO: 272663 - RNA, 18 nt, Human
ucagucacucgaagcaca

SEQ ID NO: 272664 - RNA, 23 nt, Human
uccaaaaaccccacaaaggugag

SEQ ID NO: 272665 - RNA, 25 nt, Human
uccaaaaaccccacaaaggugaggu

SEQ ID NO: 272666 - RNA, 24 nt, Human
uccccuacaaaaaguucacaaaag

SEQ ID NO: 272667 - RNA, 25 nt, Human
uccccuacaaaaaguucacaaaagc

SEQ ID NO: 272668 - RNA, 22 nt, Human
uccucgcuggggcgcuggcggg

SEQ ID NO: 272669 - RNA, 21 nt, Human
ucgaagcacaauaaauauaaa

SEQ ID NO: 272670 - RNA, 21 nt, Human
ucgcuggggcgcuggcgggcg

SEQ ID NO: 272671 - RNA, 22 nt, Human
ugauaaccuucuccaaaaaccc

SEQ ID NO: 272672 - RNA, 20 nt, Human
ugucacaggauaccacuggg

SEQ ID NO: 272673 - RNA, 20 nt, Human
ugugcaguguggauauaagu

SEQ ID NO: 272674 - RNA, 24 nt, Human
uguggauauaaguacacccuuuaa

SEQ ID NO: 272675 - RNA, 23 nt, Human
uucaaugaucuuucucguccccu

SEQ ID NO: 272676 - RNA, 25 nt, Human
uucaaugaucuuucucguccccuac

SEQ ID NO: 272677 - RNA, 22 nt, Human
uucaccccacaucacugaacgc

SEQ ID NO: 272678 - RNA, 21 nt, Human
uucuccaaaaaccccacaaag

SEQ ID NO: 272679 - RNA, 25 nt, Human
uucuuuuuucuuuuuuuagaaaaau

SEQ ID NO: 272680 - RNA, 20 nt, Human
uugacagguaguaacuuuuc

SEQ ID NO: 272681 - RNA, 19 nt, Human
cccccgccgccucaggggc

SEQ ID NO: 272682 - RNA, 24 nt, Human
cgccucaggggccccccgcagucg

SEQ ID NO: 272683 - RNA, 23 nt, Human
uuuuuuuuuuucagaacuagggu

SEQ ID NO: 272684 - RNA, 25 nt, Human
uuuuuuuuuuuuuucagaacuaggg

SEQ ID NO: 272685 - RNA, 24 nt, Human
uuuuuuuuuuuuuuuuuuuuucag

SEQ ID NO: 272686 - RNA, 21 nt, Human
aaguacccccagagccguagc

SEQ ID NO: 272687 - RNA, 24 nt, Human
acccauauccucugcugagcagca

SEQ ID NO: 272688 - RNA, 19 nt, Human
acccccagagccguagccc

SEQ ID NO: 272689 - RNA, 21 nt, Human
agaccugcccccgccccccca

SEQ ID NO: 272690 - RNA, 19 nt, Human
caaggagcagugguggcgg

SEQ ID NO: 272691 - RNA, 20 nt, Human
cagaccugcccccgcccccc

SEQ ID NO: 272692 - RNA, 23 nt, Human
cccauccuuucccuuacccuucc

SEQ ID NO: 272693 - RNA, 20 nt, Human
ccccaaguacccccagagcc

SEQ ID NO: 272694 - RNA, 19 nt, Human
ccccacccccacuuguuac

SEQ ID NO: 272695 - RNA, 22 nt, Human
ccccacccccacuuguuacaac

SEQ ID NO: 272696 - RNA, 18 nt, Human
cccccaaguacccccaga

SEQ ID NO: 272697 - RNA, 23 nt, Human
cccccaaguacccccagagccgu

SEQ ID NO: 272698 - RNA, 19 nt, Human
cccccagagccguagccca

SEQ ID NO: 272699 - RNA, 21 nt, Human
cccccgcccccccaaguaccc

SEQ ID NO: 272700 - RNA, 22 nt, Human
cccccgcccccccaaguacccc

SEQ ID NO: 272701 - RNA, 18 nt, Human
cccgcaccccccaccccc

SEQ ID NO: 272702 - RNA, 18 nt, Human
ccgcaccccccaccccca

SEQ ID NO: 272703 - RNA, 22 nt, Human
cggcagagucaaggagcagugg

SEQ ID NO: 272704 - RNA, 23 nt, Human
cugagcagcaccuggcucuuccu

SEQ ID NO: 272705 - RNA, 21 nt, Human
cuugugguccccauccuuucc

SEQ ID NO: 272706 - RNA, 21 nt, Human
gcaccccccacccccacuugu

SEQ ID NO: 272707 - RNA, 21 nt, Human
gcccgcaccccccacccccac

SEQ ID NO: 272708 - RNA, 22 nt, Human
gcucccacccauauccucugcu

SEQ ID NO: 272709 - RNA, 20 nt, Human
ggcccgcaccccccaccccc

SEQ ID NO: 272710 - RNA, 22 nt, Human
uacccccagagccguagcccaa

SEQ ID NO: 272711 - RNA, 22 nt, Human
ucugcugagcagcaccuggcuc

SEQ ID NO: 272712 - RNA, 23 nt, Human
uuaggaaacggcagagucaagga

SEQ ID NO: 272713 - RNA, 24 nt, Human
uuuuuuuuuuuuuugagaugugga

SEQ ID NO: 272714 - RNA, 27 nt, Human
uuuuuuuuuuuuuuuuuuuuuuugggg

SEQ ID NO: 272715 - RNA, 24 nt, Human
aaaguguugggauuacaggcguga

SEQ ID NO: 272716 - RNA, 21 nt, Human
aaguguugggauuacaggcgu

SEQ ID NO: 272717 - RNA, 26 nt, Human
aaguguugggauuacaggcgugagcc

SEQ ID NO: 272718 - RNA, 21 nt, Human
acaauagccaagcucuucuca

SEQ ID NO: 272719 - RNA, 23 nt, Human
acaggcuuccaccaccacgcccg

SEQ ID NO: 272720 - RNA, 18 nt, Human
acgggguuucaccauguu

SEQ ID NO: 272721 - RNA, 19 nt, Human
acgggguuucaccauguua

SEQ ID NO: 272722 - RNA, 20 nt, Human
acgggguuucaccauguuag

SEQ ID NO: 272723 - RNA, 24 nt, Human
acgggguuucaccauguuagccag

SEQ ID NO: 272724 - RNA, 20 nt, Human
acugcaagcuccgccucccg

SEQ ID NO: 272725 - RNA, 21 nt, Human
agcuccagguacuggugcugg

SEQ ID NO: 272726 - RNA, 25 nt, Human
aggcuggagugcaguggugcgaucu

SEQ ID NO: 272727 - RNA, 18 nt, Human
agggaaugugccagcucc

SEQ ID NO: 272728 - RNA, 19 nt, Human
aguagcugggacuacaggc

SEQ ID NO: 272729 - RNA, 19 nt, Human
aguagcugggacuacaggc

SEQ ID NO: 272730 - RNA, 23 nt, Human
aguagcugggacuacaggcuucc

SEQ ID NO: 272731 - RNA, 20 nt, Human
agugcaguggugcgaucucg

SEQ ID NO: 272732 - RNA, 23 nt, Human
agugcaguggugcgaucucggcu

SEQ ID NO: 272733 - RNA, 24 nt, Human
agugcaguggugcgaucucggcuc

SEQ ID NO: 272734 - RNA, 20 nt, Human
aguguccccuccagcuccuc

SEQ ID NO: 272735 - RNA, 24 nt, Human
caaaguguugggauuacaggcgug

SEQ ID NO: 272736 - RNA, 18 nt, Human
caccauguuagccaggau

SEQ ID NO: 272737 - RNA, 22 nt, Human
caccauguuagccaggaugguc

SEQ ID NO: 272738 - RNA, 24 nt, Human
caccauguuagccaggauggucuc

SEQ ID NO: 272739 - RNA, 22 nt, Human
cacgccauucuccugccucagc

SEQ ID NO: 272740 - RNA, 20 nt, Human
cacggcacagcccagagggu

SEQ ID NO: 272741 - RNA, 22 nt, Human
cagagggucgucagcgcgcucc

SEQ ID NO: 272742 - RNA, 21 nt, Human
cagcaaagcaucccucgacug

SEQ ID NO: 272743 - RNA, 22 nt, Human
ccaaaguguugggauuacaggc

SEQ ID NO: 272744 - RNA, 22 nt, Human
ccaaaguguugggauuacaggc

SEQ ID NO: 272745 - RNA, 24 nt, Human
ccaaaguguugggauuacaggcgu

SEQ ID NO: 272746 - RNA, 18 nt, Human
ccacaauagccaagcucu

SEQ ID NO: 272747 - RNA, 18 nt, Human
ccagagccucggcguagc

SEQ ID NO: 272748 - RNA, 23 nt, Human
ccagagccucggcguagcggcca

SEQ ID NO: 272749 - RNA, 21 nt, Human
ccaguguccccuccagcuccu

SEQ ID NO: 272750 - RNA, 19 nt, Human
ccaucucggccaggcgcuc

SEQ ID NO: 272751 - RNA, 19 nt, Human
cccaggcuggagugcagug

SEQ ID NO: 272752 - RNA, 24 nt, Human
ccggaguagcugggacuacaggcu

SEQ ID NO: 272753 - RNA, 20 nt, Human
ccugccagugcugcuccaga

SEQ ID NO: 272754 - RNA, 23 nt, Human
ccugccucagccuccggaguagc

SEQ ID NO: 272755 - RNA, 19 nt, Human
ccugugccugcagcaaagc

SEQ ID NO: 272756 - RNA, 19 nt, Human
cgccucccggguucacgcc

SEQ ID NO: 272757 - RNA, 22 nt, Human
cgcgcucccgaagcugcagcuc

SEQ ID NO: 272758 - RNA, 24 nt, Human
cgggguuucaccauguuagccagg

SEQ ID NO: 272759 - RNA, 24 nt, Human
cggucugucgcccaggcuggagug

SEQ ID NO: 272760 - RNA, 24 nt, Human
cucagccuccggaguagcugggac

SEQ ID NO: 272761 - RNA, 21 nt, Human
cucccggguucacgccauucu

SEQ ID NO: 272762 - RNA, 24 nt, Human
cuccugaccucgugauccgcccgc

SEQ ID NO: 272763 - RNA, 21 nt, Human
cucuucgcgccgcugcccggc

SEQ ID NO: 272764 - RNA, 23 nt, Human
cugccucagccuccggaguagcu

SEQ ID NO: 272765 - RNA, 24 nt, Human
cugguggcacagcgcggccucuuc

SEQ ID NO: 272766 - RNA, 20 nt, Human
cuuggcuuucgccuugcuca

SEQ ID NO: 272767 - RNA, 22 nt, Human
cuuggcuuucgccuugcucagc

SEQ ID NO: 272768 - RNA, 23 nt, Human
cuuggcuuucgccuugcucagcu

SEQ ID NO: 272769 - RNA, 20 nt, Human
gaccucgugauccgcccgcc

SEQ ID NO: 272770 - RNA, 21 nt, Human
gaccucgugauccgcccgccu

SEQ ID NO: 272771 - RNA, 23 nt, Human
gaccucgugauccgcccgccugg

SEQ ID NO: 272772 - RNA, 21 nt, Human
gacuggcaguggucauagaug

SEQ ID NO: 272773 - RNA, 24 nt, Human
gagacgggguuucaccauguuagc

SEQ ID NO: 272774 - RNA, 24 nt, Human
gaguagcugggacuacaggcuucc

SEQ ID NO: 272775 - RNA, 18 nt, Human
gauuacaggcgugagcca

SEQ ID NO: 272776 - RNA, 22 nt, Human
gauuacaggcgugagccaccgc

SEQ ID NO: 272777 - RNA, 22 nt, Human
gauuacaggcgugagccaccgc

SEQ ID NO: 272778 - RNA, 22 nt, Human
gcaaagcaucccucgacuggca

SEQ ID NO: 272779 - RNA, 20 nt, Human
gccaagcucuucucaaaggc

SEQ ID NO: 272780 - RNA, 19 nt, Human
gcccaggcuggagugcagu

SEQ ID NO: 272781 - RNA, 20 nt, Human
gcccaggcuggagugcagug

SEQ ID NO: 272782 - RNA, 23 nt, Human
gcccaggcuggagugcaguggug

SEQ ID NO: 272783 - RNA, 25 nt, Human
gccucccggguucacgccauucucc

SEQ ID NO: 272784 - RNA, 21 nt, Human
gccuugcucagcuggcgaagc

SEQ ID NO: 272785 - RNA, 23 nt, Human
ggagcucccccagcugguggcac

SEQ ID NO: 272786 - RNA, 24 nt, Human
ggauggucucgaucuccugaccuc

SEQ ID NO: 272787 - RNA, 22 nt, Human
ggccgaugguggcccaggcccu

SEQ ID NO: 272788 - RNA, 22 nt, Human
ggcuucggugaggguggggaaa

SEQ ID NO: 272789 - RNA, 23 nt, Human
gggguuucaccauguuagccagg

SEQ ID NO: 272790 - RNA, 24 nt, Human
gguuucaccauguuagccaggaug

SEQ ID NO: 272791 - RNA, 23 nt, Human
guagagacgggguuucaccaugu

SEQ ID NO: 272792 - RNA, 20 nt, Human
gugaggguggggaaaggcag

SEQ ID NO: 272793 - RNA, 24 nt, Human
uaauuuuugguauuuuuaguagag

SEQ ID NO: 272794 - RNA, 25 nt, Human
uaauuuuugguauuuuuaguagaga

SEQ ID NO: 272795 - RNA, 23 nt, Human
uacaggcgugagccaccgcgccc

SEQ ID NO: 272796 - RNA, 23 nt, Human
uacaggcuuccaccaccacgccc

SEQ ID NO: 272797 - RNA, 22 nt, Human
uagagacgggguuucaccaugu

SEQ ID NO: 272798 - RNA, 19 nt, Human
uagauguccaggugggugc

SEQ ID NO: 272799 - RNA, 24 nt, Human
uaguagagacgggguuucaccaug

SEQ ID NO: 272800 - RNA, 26 nt, Human
uaguagagacgggguuucaccauguu

SEQ ID NO: 272801 - RNA, 24 nt, Human
ucaccauguuagccaggauggucu

SEQ ID NO: 272802 - RNA, 18 nt, Human
ucacugcaagcuccgccu

SEQ ID NO: 272803 - RNA, 19 nt, Human
ucacugcaagcuccgccuc

SEQ ID NO: 272804 - RNA, 24 nt, Human
ucacugcaagcuccgccucccggg

SEQ ID NO: 272805 - RNA, 23 nt, Human
uccacaauagccaagcucuucuc

SEQ ID NO: 272806 - RNA, 24 nt, Human
ucccaaaguguugggauuacaggc

SEQ ID NO: 272807 - RNA, 20 nt, Human
ucccgaagcugcagcuccug

SEQ ID NO: 272808 - RNA, 21 nt, Human
ucccggguucacgccauucuc

SEQ ID NO: 272809 - RNA, 24 nt, Human
ucccggguucacgccauucuccug

SEQ ID NO: 272810 - RNA, 20 nt, Human
ucccugggccaguguccccu

SEQ ID NO: 272811 - RNA, 20 nt, Human
uccgaucuugcggugggcca

SEQ ID NO: 272812 - RNA, 24 nt, Human
uccggaguagcugggacuacaggc

SEQ ID NO: 272813 - RNA, 24 nt, Human
ucgcccaggcuggagugcaguggu

SEQ ID NO: 272814 - RNA, 24 nt, Human
ucggucugucgcccaggcuggagu

SEQ ID NO: 272815 - RNA, 24 nt, Human
ucuccugccucagccuccggagua

SEQ ID NO: 272816 - RNA, 23 nt, Human
ucucggucugucgcccaggcugg

SEQ ID NO: 272817 - RNA, 24 nt, Human
ucucggucugucgcccaggcugga

SEQ ID NO: 272818 - RNA, 24 nt, Human
ucugucgcccaggcuggagugcag

SEQ ID NO: 272819 - RNA, 19 nt, Human
ucuucgcgccgcugcccgg

SEQ ID NO: 272820 - RNA, 22 nt, Human
ugagacggagucucggucuguc

SEQ ID NO: 272821 - RNA, 22 nt, Human
ugcaguggugcgaucucggcuc

SEQ ID NO: 272822 - RNA, 24 nt, Human
ugccucagccuccggaguagcugg

SEQ ID NO: 272823 - RNA, 22 nt, Human
ugcggugggccacggcacagcc

SEQ ID NO: 272824 - RNA, 27 nt, Human
ugcuccagagccucggcguagcggcca

SEQ ID NO: 272825 - RNA, 23 nt, Human
uggagugcaguggugcgaucucg

SEQ ID NO: 272826 - RNA, 24 nt, Human
uggagugcaguggugcgaucucgg

SEQ ID NO: 272827 - RNA, 20 nt, Human
uggcccaggcccucugcagc

SEQ ID NO: 272828 - RNA, 21 nt, Human
uggcccaggcccucugcagcu

SEQ ID NO: 272829 - RNA, 18 nt, Human
uggcgaagcucgcccucg

SEQ ID NO: 272830 - RNA, 19 nt, Human
ugggacuacaggcuuccac

SEQ ID NO: 272831 - RNA, 21 nt, Human
ugggacuacaggcuuccacca

SEQ ID NO: 272832 - RNA, 24 nt, Human
ugggacuacaggcuuccaccacca

SEQ ID NO: 272833 - RNA, 18 nt, Human
ugggauuacaggcgugag

SEQ ID NO: 272834 - RNA, 19 nt, Human
ugggauuacaggcgugagc

SEQ ID NO: 272835 - RNA, 21 nt, Human
ugggauuacaggcgugagcca

SEQ ID NO: 272836 - RNA, 22 nt, Human
ugggauuacaggcgugagccac

SEQ ID NO: 272837 - RNA, 23 nt, Human
ugggauuacaggcgugagccacc

SEQ ID NO: 272838 - RNA, 24 nt, Human
ugggauuacaggcgugagccaccg

SEQ ID NO: 272839 - RNA, 19 nt, Human
ugggccaguguccccucca

SEQ ID NO: 272840 - RNA, 20 nt, Human
ugggccaguguccccuccag

SEQ ID NO: 272841 - RNA, 21 nt, Human
ugggugcggccgaugguggcc

SEQ ID NO: 272842 - RNA, 18 nt, Human
uuaguagagacgggguuu

SEQ ID NO: 272843 - RNA, 22 nt, Human
uuaguagagacgggguuucacc

SEQ ID NO: 272844 - RNA, 24 nt, Human
uuaguagagacgggguuucaccau

SEQ ID NO: 272845 - RNA, 20 nt, Human
uugcucagcuggcgaagcuc

SEQ ID NO: 272846 - RNA, 19 nt, Human
uuucaccauguuagccagg

SEQ ID NO: 272847 - RNA, 20 nt, Human
uuucaccauguuagccagga

SEQ ID NO: 272848 - RNA, 24 nt, Human
uuuuuaguagagacgggguuucac

SEQ ID NO: 272849 - RNA, 24 nt, Human
uuuuugguauuuuuaguagagacg

SEQ ID NO: 272850 - RNA, 25 nt, Human
uuuuuuuuuuuugagacggagucuc

SEQ ID NO: 272851 - RNA, 22 nt, Human
uuuuuuuuuuuuuugagacgga

SEQ ID NO: 272852 - RNA, 27 nt, Human
uuuuuuuuuuuuuuuuuuuuuuugggg

SEQ ID NO: 272853 - RNA, 20 nt, Human
aacauggcaaaaccccuucu

SEQ ID NO: 272854 - RNA, 21 nt, Human
aaccacuacccacgggucaga

SEQ ID NO: 272855 - RNA, 20 nt, Human
aacccgcagcccuucuccgg

SEQ ID NO: 272856 - RNA, 20 nt, Human
aagaaaaagaaggcauagaa

SEQ ID NO: 272857 - RNA, 21 nt, Human
aagaagaagaagagauggcug

SEQ ID NO: 272858 - RNA, 22 nt, Human
aagaagaagaagagauggcuga

SEQ ID NO: 272859 - RNA, 25 nt, Human
aagaagaagaagagauggcugaaga

SEQ ID NO: 272860 - RNA, 22 nt, Human
aagaagaagagauggcugaaga

SEQ ID NO: 272861 - RNA, 23 nt, Human
aagcaagaauuugcuucagcagc

SEQ ID NO: 272862 - RNA, 19 nt, Human
aagggcggggccacuccgc

SEQ ID NO: 272863 - RNA, 20 nt, Human
aaugggacaacagaagaagg

SEQ ID NO: 272864 - RNA, 18 nt, Human
acccaaaucugacaucag

SEQ ID NO: 272865 - RNA, 18 nt, Human
acccaaaucugacaucag

SEQ ID NO: 272866 - RNA, 18 nt, Human
agaagaagaagagauggc

SEQ ID NO: 272867 - RNA, 20 nt, Human
agaagaagaagagauggcug

SEQ ID NO: 272868 - RNA, 22 nt, Human
agaagaagaagagauggcugaa

SEQ ID NO: 272869 - RNA, 22 nt, Human
agaagaagaggaagaagaagaa

SEQ ID NO: 272870 - RNA, 25 nt, Human
agaagaagaggaagaagaagaagag

SEQ ID NO: 272871 - RNA, 22 nt, Human
agcacugucuucaggaaacugg

SEQ ID NO: 272872 - RNA, 22 nt, Human
aggaugaaggaauugaaaaaga

SEQ ID NO: 272873 - RNA, 20 nt, Human
aguacuuugggagguccagg

SEQ ID NO: 272874 - RNA, 18 nt, Human
auccuauccaucuucuuc

SEQ ID NO: 272875 - RNA, 20 nt, Human
caagaaccacgagcgauucc

SEQ ID NO: 272876 - RNA, 21 nt, Human
cacucccgcuccucaggugug

SEQ ID NO: 272877 - RNA, 20 nt, Human
cacuccucuuucacuucccu

SEQ ID NO: 272878 - RNA, 19 nt, Human
cacugaacaaggcuaagau

SEQ ID NO: 272879 - RNA, 22 nt, Human
cacugaacaaggcuaagaugag

SEQ ID NO: 272880 - RNA, 23 nt, Human
cacugcaacaucacggaauccua

SEQ ID NO: 272881 - RNA, 26 nt, Human
cagaagaagaggaagaagaagaagag

SEQ ID NO: 272882 - RNA, 27 nt, Human
cagaagaagaggaagaagaagaagaga

SEQ ID NO: 272883 - RNA, 24 nt, Human
cagaguuauaaaacagggauuuau

SEQ ID NO: 272884 - RNA, 19 nt, Human
cagaucuuaaaagaaaaag

SEQ ID NO: 272885 - RNA, 25 nt, Human
cagcagggcagcccgcacucgugcc

SEQ ID NO: 272886 - RNA, 24 nt, Human
cagguccucccucccguuauuucc

SEQ ID NO: 272887 - RNA, 24 nt, Human
caguacuuugggagguccaggcgg

SEQ ID NO: 272888 - RNA, 19 nt, Human
caucagaugacagggcugu

SEQ ID NO: 272889 - RNA, 21 nt, Human
ccacacggaccaaguuccaga

SEQ ID NO: 272890 - RNA, 22 nt, Human
cccccaguucuacuuuaucugc

SEQ ID NO: 272891 - RNA, 24 nt, Human
ccccucccgccggagaugagggga

SEQ ID NO: 272892 - RNA, 21 nt, Human
ccccuuccgcgcccggcuccc

SEQ ID NO: 272893 - RNA, 21 nt, Human
cccgcggggcggucgcggccg

SEQ ID NO: 272894 - RNA, 23 nt, Human
cccgcggggcggucgcggccgug

SEQ ID NO: 272895 - RNA, 18 nt, Human
ccgcgccccucccgccgg

SEQ ID NO: 272896 - RNA, 18 nt, Human
ccggccgcgggcucccag

SEQ ID NO: 272897 - RNA, 24 nt, Human
ccggcuccccuuccgcgccccucc

SEQ ID NO: 272898 - RNA, 24 nt, Human
ccuaacccgcagcccuucuccggc

SEQ ID NO: 272899 - RNA, 19 nt, Human
ccucccaggaggcaauccu

SEQ ID NO: 272900 - RNA, 23 nt, Human
ccucccguuauuuccaauucugg

SEQ ID NO: 272901 - RNA, 23 nt, Human
cgccgggccaucuccagcagauc

SEQ ID NO: 272902 - RNA, 21 nt, Human
cggcccccuaacccgcagccc

SEQ ID NO: 272903 - RNA, 18 nt, Human
cggcggcuccgggcccgg

SEQ ID NO: 272904 - RNA, 20 nt, Human
cggcuccgggcccggcuccc

SEQ ID NO: 272905 - RNA, 21 nt, Human
cgucucggaaaagcuucuggg

SEQ ID NO: 272906 - RNA, 26 nt, Human
cuagcgaacauggcaaaaccccuucu

SEQ ID NO: 272907 - RNA, 21 nt, Human
cucacgcuccacugcaacauc

SEQ ID NO: 272908 - RNA, 21 nt, Human
cucagcacugucuucaggaaa

SEQ ID NO: 272909 - RNA, 22 nt, Human
cucccagacgccgaggcuuccg

SEQ ID NO: 272910 - RNA, 25 nt, Human
cucucaggaggguauguauugggug

SEQ ID NO: 272911 - RNA, 21 nt, Human
cuggugccgcagcagggcagc

SEQ ID NO: 272912 - RNA, 22 nt, Human
cugucuucaggaaacuggggca

SEQ ID NO: 272913 - RNA, 23 nt, Human
cuucagaagaagaggaagaagaa

SEQ ID NO: 272914 - RNA, 19 nt, Human
gaagaagagccuauuagug

SEQ ID NO: 272915 - RNA, 20 nt, Human
gacgagcugcacugccaguu

SEQ ID NO: 272916 - RNA, 22 nt, Human
gcagggcagcccgcacucgugc

SEQ ID NO: 272917 - RNA, 19 nt, Human
gccgaggcuuccgcgcccc

SEQ ID NO: 272918 - RNA, 23 nt, Human
gccuauuagugggaaaaagucag

SEQ ID NO: 272919 - RNA, 24 nt, Human
gcuuaacuucucuuuuaaggauaa

SEQ ID NO: 272920 - RNA, 21 nt, Human
ggaaacuggggcagaaacugc

SEQ ID NO: 272921 - RNA, 20 nt, Human
ggaauccuauccaucuucuu

SEQ ID NO: 272922 - RNA, 18 nt, Human
ggagagcgcggcccaggc

SEQ ID NO: 272923 - RNA, 25 nt, Human
ggagaugaggggaagauguccgugu

SEQ ID NO: 272924 - RNA, 19 nt, Human
ggcccaggccggcccgcgg

SEQ ID NO: 272925 - RNA, 22 nt, Human
ggcccggcuccccuuccgcgcc

SEQ ID NO: 272926 - RNA, 22 nt, Human
ggcuccccuuccgcgccccucc

SEQ ID NO: 272927 - RNA, 24 nt, Human
gggucagaaugggacaacagaaga

SEQ ID NO: 272928 - RNA, 21 nt, Human
gucacugucccccaguucuac

SEQ ID NO: 272929 - RNA, 20 nt, Human
guccgccacucccgcuccuc

SEQ ID NO: 272930 - RNA, 19 nt, Human
gugcagaggguuuccaaag

SEQ ID NO: 272931 - RNA, 19 nt, Human
uaagaugaguucauucugc

SEQ ID NO: 272932 - RNA, 18 nt, Human
uaaucauuguugcucagg

SEQ ID NO: 272933 - RNA, 26 nt, Human
uacagaucacagaguuauaaaacagg

SEQ ID NO: 272934 - RNA, 19 nt, Human
uacuaagaacaacaauuug

SEQ ID NO: 272935 - RNA, 24 nt, Human
uagaucaaccacuacccacggguc

SEQ ID NO: 272936 - RNA, 18 nt, Human
uaggagaacgugcuggag

SEQ ID NO: 272937 - RNA, 20 nt, Human
ucaaaagguccgggugaucc

SEQ ID NO: 272938 - RNA, 24 nt, Human
ucacgcuccacugcaacaucacgg

SEQ ID NO: 272939 - RNA, 21 nt, Human
ucagaagaagaggaagaagaa

SEQ ID NO: 272940 - RNA, 24 nt, Human
ucagaagaagaggaagaagaagaa

SEQ ID NO: 272941 - RNA, 22 nt, Human
ucagaucuuaaaagaaaaagaa

SEQ ID NO: 272942 - RNA, 18 nt, Human
uccgccgggccaucucca

SEQ ID NO: 272943 - RNA, 19 nt, Human
uccgugucagggcucaagg

SEQ ID NO: 272944 - RNA, 22 nt, Human
uccucgggcagacuaacucugg

SEQ ID NO: 272945 - RNA, 23 nt, Human
uccugaaccgcgggcgccggccc

SEQ ID NO: 272946 - RNA, 18 nt, Human
ucucauaaucauuguugc

SEQ ID NO: 272947 - RNA, 22 nt, Human
ucucucauaaucauuguugcuc

SEQ ID NO: 272948 - RNA, 21 nt, Human
ucugcaguuuauauaaccuuc

SEQ ID NO: 272949 - RNA, 21 nt, Human
ucuucaggucacuguccccca

SEQ ID NO: 272950 - RNA, 19 nt, Human
ugagaggcugacaacauca

SEQ ID NO: 272951 - RNA, 21 nt, Human
ugaggaagggaagcuggacca

SEQ ID NO: 272952 - RNA, 22 nt, Human
ugaggaagggaagcuggaccag

SEQ ID NO: 272953 - RNA, 19 nt, Human
ugccaguuccuggugccgc

SEQ ID NO: 272954 - RNA, 23 nt, Human
ugcuggagagcucggaagccaug

SEQ ID NO: 272955 - RNA, 22 nt, Human
uggcauguuaacugcagaaggu

SEQ ID NO: 272956 - RNA, 25 nt, Human
uggcugauguuuccgcuucucgugg

SEQ ID NO: 272957 - RNA, 22 nt, Human
uggguccgccacucccgcuccu

SEQ ID NO: 272958 - RNA, 19 nt, Human
uggugcagugucuggguca

SEQ ID NO: 272959 - RNA, 21 nt, Human
uguauggaacuucucacaaaa

SEQ ID NO: 272960 - RNA, 18 nt, Human
ugucagggcucaaggccg

SEQ ID NO: 272961 - RNA, 24 nt, Human
uguggauucugaagacccaaaucu

SEQ ID NO: 272962 - RNA, 22 nt, Human
uguuuaggagacggagcuguag

SEQ ID NO: 272963 - RNA, 18 nt, Human
uucauauccgugguugaa

SEQ ID NO: 272964 - RNA, 23 nt, Human
uuugcuucgucagcaauugaagu

SEQ ID NO: 272965 - RNA, 22 nt, Human
uuuggcaauauuagagaaaauu

SEQ ID NO: 272966 - RNA, 27 nt, Human
uuuguggauucugaagacccaaaucug

SEQ ID NO: 272967 - RNA, 23 nt, Human
agacaaaggcuugcaacuucaau

SEQ ID NO: 272968 - RNA, 23 nt, Human
aggaggcuccagccgccgcugcc

SEQ ID NO: 272969 - RNA, 19 nt, Human
aggcuccagccgccgcugc

SEQ ID NO: 272970 - RNA, 21 nt, Human
aguugaucaauuuccuggaac

SEQ ID NO: 272971 - RNA, 25 nt, Human
aucagcuccaucacauggcgugggg

SEQ ID NO: 272972 - RNA, 21 nt, Human
augugucuccuugcaucaucc

SEQ ID NO: 272973 - RNA, 19 nt, Human
ccagccgccgcugccgccg

SEQ ID NO: 272974 - RNA, 22 nt, Human
ccaugggaaggagugggcugcu

SEQ ID NO: 272975 - RNA, 19 nt, Human
cccccaccagagggauaaa

SEQ ID NO: 272976 - RNA, 20 nt, Human
cccuccaagugagauuccug

SEQ ID NO: 272977 - RNA, 20 nt, Human
ccgaaacccaaucaggaggc

SEQ ID NO: 272978 - RNA, 18 nt, Human
ccgccgcugccgccgcca

SEQ ID NO: 272979 - RNA, 24 nt, Human
ccgccgcugccgccgccacugccg

SEQ ID NO: 272980 - RNA, 19 nt, Human
ccgcugccgccgccacugc

SEQ ID NO: 272981 - RNA, 24 nt, Human
cgaauccaugaaaugucaauguca

SEQ ID NO: 272982 - RNA, 21 nt, Human
cgcugcccgcgcugauuggcu

SEQ ID NO: 272983 - RNA, 19 nt, Human
cuccaguaccggacucccu

SEQ ID NO: 272984 - RNA, 24 nt, Human
cuccaguaccggacuccgaaaccc

SEQ ID NO: 272985 - RNA, 18 nt, Human
cuccgugccucgcucccc

SEQ ID NO: 272986 - RNA, 22 nt, Human
cugggguggcaugugucuccuu

SEQ ID NO: 272987 - RNA, 23 nt, Human
gaauccaugaaaugucaauguca

SEQ ID NO: 272988 - RNA, 21 nt, Human
gauuccuguccacucuggaga

SEQ ID NO: 272989 - RNA, 23 nt, Human
gcugcugcuuuccugauugcagu

SEQ ID NO: 272990 - RNA, 18 nt, Human
ggcuccagccgccgcugc

SEQ ID NO: 272991 - RNA, 20 nt, Human
ggcuccaguaccggacuccg

SEQ ID NO: 272992 - RNA, 21 nt, Human
gguggcaugugucuccuugca

SEQ ID NO: 272993 - RNA, 18 nt, Human
uaccggacuccgaaaccc

SEQ ID NO: 272994 - RNA, 18 nt, Human
uacugcugggguggcaug

SEQ ID NO: 272995 - RNA, 19 nt, Human
uacugcugggguggcaugu

SEQ ID NO: 272996 - RNA, 23 nt, Human
uccaguaccggacuccgaaaccc

SEQ ID NO: 272997 - RNA, 21 nt, Human
uccgaaacccaaucaggaggc

SEQ ID NO: 272998 - RNA, 22 nt, Human
uccgaaacccaaucaggaggcu

SEQ ID NO: 272999 - RNA, 19 nt, Human
uccuagaaggcugugaggu

SEQ ID NO: 273000 - RNA, 20 nt, Human
ugaaagaguaagacaaaggc

SEQ ID NO: 273001 - RNA, 20 nt, Human
ugaauacaaagcguccauuc

SEQ ID NO: 273002 - RNA, 20 nt, Human
ugacugaaagaguaagacaa

SEQ ID NO: 273003 - RNA, 19 nt, Human
ugcugggguggcauguguc

SEQ ID NO: 273004 - RNA, 21 nt, Human
uggaacagugagaaacaugac

SEQ ID NO: 273005 - RNA, 22 nt, Human
uggaacagugagaaacaugacc

SEQ ID NO: 273006 - RNA, 25 nt, Human
uggaagaguugaucaauuuccugga

SEQ ID NO: 273007 - RNA, 24 nt, Human
uuccaugggaaggagugggcugcu

SEQ ID NO: 273008 - RNA, 19 nt, Human
uuccuggaacagugagaaa

SEQ ID NO: 273009 - RNA, 18 nt, Human
caaugcagcccugguugg

SEQ ID NO: 273010 - RNA, 22 nt, Human
cuaaaaaggugucuaaucuuug

SEQ ID NO: 273011 - RNA, 18 nt, Human
uggugcugaagaacaccu

SEQ ID NO: 273012 - RNA, 18 nt, Human
ugucagaaccguguuguc

SEQ ID NO: 273013 - RNA, 23 nt, Human
aaaaaaaaaagaaaaacaaaagg

SEQ ID NO: 273014 - RNA, 25 nt, Human
aaaaaaaaaagaaaaacaaaaggag

SEQ ID NO: 273015 - RNA, 23 nt, Human
aaaaaagaaaaacaaaaggagaa

SEQ ID NO: 273016 - RNA, 23 nt, Human
aaaaagaaaaacaaaaggagaaa

SEQ ID NO: 273017 - RNA, 24 nt, Human
aaaaagaaaaacaaaaggagaaau

SEQ ID NO: 273018 - RNA, 25 nt, Human
aaacaaaaggagaaauauuucuuca

SEQ ID NO: 273019 - RNA, 22 nt, Human
aagaaaaacaaaaggagaaaga

SEQ ID NO: 273020 - RNA, 24 nt, Human
aagaaguggcaguaacaaacaaaa

SEQ ID NO: 273021 - RNA, 19 nt, Human
aagaguguggcaaugaauc

SEQ ID NO: 273022 - RNA, 18 nt, Human
acacucaacauauugaaa

SEQ ID NO: 273023 - RNA, 21 nt, Human
acagggauaaaucugucucuu

SEQ ID NO: 273024 - RNA, 25 nt, Human
agaaaaaaauggaaaaaaaggaaac

SEQ ID NO: 273025 - RNA, 26 nt, Human
agaaaaaaauggaaaaaaagggaccc

SEQ ID NO: 273026 - RNA, 19 nt, Human
agagaaaaaaauggaaaaa

SEQ ID NO: 273027 - RNA, 25 nt, Human
agccugcaggaggcgcugaggucgg

SEQ ID NO: 273028 - RNA, 23 nt, Human
caaaaaaaaaagaaaaacaaaag

SEQ ID NO: 273029 - RNA, 19 nt, Human
caaacaaaaaaaaaagaaa

SEQ ID NO: 273030 - RNA, 21 nt, Human
caagcaagauggcggccacgc

SEQ ID NO: 273031 - RNA, 19 nt, Human
caggaagagcaggagccgc

SEQ ID NO: 273032 - RNA, 22 nt, Human
caugcagcuugaaguccaugca

SEQ ID NO: 273033 - RNA, 20 nt, Human
cauuucaugcagcuugaagu

SEQ ID NO: 273034 - RNA, 18 nt, Human
ccaguguccuagccugca

SEQ ID NO: 273035 - RNA, 22 nt, Human
ccccuggggagauuugcuccua

SEQ ID NO: 273036 - RNA, 21 nt, Human
ccuuggccuugccagcucagg

SEQ ID NO: 273037 - RNA, 20 nt, Human
cugagggcagaacaacgugg

SEQ ID NO: 273038 - RNA, 23 nt, Human
cugaggucggccggguccucugg

SEQ ID NO: 273039 - RNA, 18 nt, Human
cugcucaggaguccagga

SEQ ID NO: 273040 - RNA, 26 nt, Human
gagaaaaaaauggaaaaaaaggaaac

SEQ ID NO: 273041 - RNA, 22 nt, Human
gcagaacaacguggcaagucuu

SEQ ID NO: 273042 - RNA, 20 nt, Human
gcggcggaggggagggggga

SEQ ID NO: 273043 - RNA, 24 nt, Human
ggaaaaaaaggaaacaaaaaauau

SEQ ID NO: 273044 - RNA, 18 nt, Human
ggcacaagcaagauggcg

SEQ ID NO: 273045 - RNA, 18 nt, Human
gggcacaagcaagauggc

SEQ ID NO: 273046 - RNA, 20 nt, Human
guagcagcuguucccagagu

SEQ ID NO: 273047 - RNA, 27 nt, Human
guggcaguaacaaacaaaaaaaaaaga

SEQ ID NO: 273048 - RNA, 21 nt, Human
gugggcagcaaacacacaaag

SEQ ID NO: 273049 - RNA, 22 nt, Human
uaacaaacaaaaaaaaaagaaa

SEQ ID NO: 273050 - RNA, 24 nt, Human
uaacaaacaaaaaaaaaagaaaaa

SEQ ID NO: 273051 - RNA, 24 nt, Human
ucagagcaagggauagggagagga

SEQ ID NO: 273052 - RNA, 22 nt, Human
uccaggaagagcaggagccgcc

SEQ ID NO: 273053 - RNA, 23 nt, Human
ucccugggagaaaagaguguggc

SEQ ID NO: 273054 - RNA, 20 nt, Human
uccugggucccugggagaaa

SEQ ID NO: 273055 - RNA, 20 nt, Human
uccuuagagaaaaaaaugga

SEQ ID NO: 273056 - RNA, 22 nt, Human
uccuuagagaaaaaaauggaaa

SEQ ID NO: 273057 - RNA, 27 nt, Human
uccuuagagaaaaaaauggaaaaaaag

SEQ ID NO: 273058 - RNA, 22 nt, Human
ugaauccacccacucuccacag

SEQ ID NO: 273059 - RNA, 22 nt, Human
ugcuggagaaucucggccccca

SEQ ID NO: 273060 - RNA, 24 nt, Human
uggcaaugaauccacccacucucc

SEQ ID NO: 273061 - RNA, 18 nt, Human
uggcaguaacaaacaaaa

SEQ ID NO: 273062 - RNA, 18 nt, Human
ugggagaaaagagugugg

SEQ ID NO: 273063 - RNA, 18 nt, Human
ugggagaaaagagugugg

SEQ ID NO: 273064 - RNA, 19 nt, Human
ugggagaaaagaguguggc

SEQ ID NO: 273065 - RNA, 20 nt, Human
ugggagaaaagaguguggca

SEQ ID NO: 273066 - RNA, 19 nt, Human
uggggaggaaggcugugcc

SEQ ID NO: 273067 - RNA, 20 nt, Human
uggggucagagcaagggauc

SEQ ID NO: 273068 - RNA, 19 nt, Human
uguccuuggccuugccagc

SEQ ID NO: 273069 - RNA, 21 nt, Human
uguccuuggccuugccagcuc

SEQ ID NO: 273070 - RNA, 24 nt, Human
uguccuuggccuugccagcucagg

SEQ ID NO: 273071 - RNA, 22 nt, Human
ugugcgucacggagcgcgcgcg

SEQ ID NO: 273072 - RNA, 22 nt, Human
uugcaccguuuccccggacgcg

SEQ ID NO: 273073 - RNA, 24 nt, Human
uugccuggggcuguauggcaaaaa

SEQ ID NO: 273074 - RNA, 23 nt, Human
uuuaaaaaauaaaagggaggugg

SEQ ID NO: 273075 - RNA, 22 nt, Human
aaagccgccacggcccccgccc

SEQ ID NO: 273076 - RNA, 22 nt, Human
aacgcaagaaagaggcuacugg

SEQ ID NO: 273077 - RNA, 19 nt, Human
aagaagcaggacagacaga

SEQ ID NO: 273078 - RNA, 21 nt, Human
accacagucagcacagagcaa

SEQ ID NO: 273079 - RNA, 18 nt, Human
acccagaagccccuuccu

SEQ ID NO: 273080 - RNA, 21 nt, Human
acgcgguccccuccgccccuc

SEQ ID NO: 273081 - RNA, 20 nt, Human
agaaaggagggccaggggag

SEQ ID NO: 273082 - RNA, 18 nt, Human
agagccccauccucuccc

SEQ ID NO: 273083 - RNA, 21 nt, Human
agccagaaaggagggccaggg

SEQ ID NO: 273084 - RNA, 27 nt, Human
agcuggacucuaggauacugagaccca

SEQ ID NO: 273085 - RNA, 18 nt, Human
aggaaagcagugaaggga

SEQ ID NO: 273086 - RNA, 23 nt, Human
aggacagaaggcgcuggaagcuc

SEQ ID NO: 273087 - RNA, 21 nt, Human
aggcaggacagaaggcgcugg

SEQ ID NO: 273088 - RNA, 18 nt, Human
aggcgcuggaagcucagc

SEQ ID NO: 273089 - RNA, 22 nt, Human
agggaagcuuggggagccuggg

SEQ ID NO: 273090 - RNA, 20 nt, Human
aucccaccucugccaccaaa

SEQ ID NO: 273091 - RNA, 18 nt, Human
caagugcagauggcuggg

SEQ ID NO: 273092 - RNA, 19 nt, Human
cacagcccgcgagacucaa

SEQ ID NO: 273093 - RNA, 24 nt, Human
caccccagcugugcuuccggggac

SEQ ID NO: 273094 - RNA, 22 nt, Human
cacccccgccuuggccugcacu

SEQ ID NO: 273095 - RNA, 22 nt, Human
cacccccgccuuggccugcacu

SEQ ID NO: 273096 - RNA, 18 nt, Human
caccuccauaccuuucca

SEQ ID NO: 273097 - RNA, 23 nt, Human
caccuccauaccuuuccagcuca

SEQ ID NO: 273098 - RNA, 18 nt, Human
caccuggccagcuagcug

SEQ ID NO: 273099 - RNA, 19 nt, Human
cagaagagccccauccucu

SEQ ID NO: 273100 - RNA, 21 nt, Human
cagcaaggcgcgcgcucccuc

SEQ ID NO: 273101 - RNA, 22 nt, Human
cagccaucucacccccgccuug

SEQ ID NO: 273102 - RNA, 22 nt, Human
cagcgggcagugaaucugagga

SEQ ID NO: 273103 - RNA, 18 nt, Human
cagcugccugaguacugg

SEQ ID NO: 273104 - RNA, 23 nt, Human
cagugaagggacugggcaggcag

SEQ ID NO: 273105 - RNA, 21 nt, Human
caucuccuccgcgacgcgguc

SEQ ID NO: 273106 - RNA, 19 nt, Human
caucuuggggcaggaaagc

SEQ ID NO: 273107 - RNA, 23 nt, Human
ccagcaaggcgcgcgcucccucc

SEQ ID NO: 273108 - RNA, 19 nt, Human
ccagcccugccccaucacc

SEQ ID NO: 273109 - RNA, 21 nt, Human
ccaggccagcaaggcgcgcgc

SEQ ID NO: 273110 - RNA, 21 nt, Human
ccaggucccccuucccuuccc

SEQ ID NO: 273111 - RNA, 19 nt, Human
ccccucguacgccccccgu

SEQ ID NO: 273112 - RNA, 20 nt, Human
cccggcgggggccgcagccg

SEQ ID NO: 273113 - RNA, 20 nt, Human
cccugccccaucaccucucc

SEQ ID NO: 273114 - RNA, 19 nt, Human
cccuggcaguucugauucu

SEQ ID NO: 273115 - RNA, 23 nt, Human
ccuccuuccuggccgguccccag

SEQ ID NO: 273116 - RNA, 24 nt, Human
ccugccccaucaccucuccagugu

SEQ ID NO: 273117 - RNA, 22 nt, Human
ccugggcugggcgcuuuaaagc

SEQ ID NO: 273118 - RNA, 22 nt, Human
ccuuccuggccgguccccagcc

SEQ ID NO: 273119 - RNA, 20 nt, Human
cgccagagccgccccacccc

SEQ ID NO: 273120 - RNA, 20 nt, Human
cgcggccagucguaggugga

SEQ ID NO: 273121 - RNA, 19 nt, Human
cgcgguccccuccgccccu

SEQ ID NO: 273122 - RNA, 23 nt, Human
cuaggauacugagacccagcccu

SEQ ID NO: 273123 - RNA, 18 nt, Human
cucacagucgcugcaggc

SEQ ID NO: 273124 - RNA, 22 nt, Human
cucccacugccugggauuccac

SEQ ID NO: 273125 - RNA, 20 nt, Human
cuccgcgacgcgguccccuc

SEQ ID NO: 273126 - RNA, 21 nt, Human
cucuaggauacugagacccag

SEQ ID NO: 273127 - RNA, 19 nt, Human
cugauucugcucccacugc

SEQ ID NO: 273128 - RNA, 19 nt, Human
cugccaccaaaacacucau

SEQ ID NO: 273129 - RNA, 21 nt, Human
cugcgccccgcagccgccaga

SEQ ID NO: 273130 - RNA, 19 nt, Human
gaagcaggacagacagaag

SEQ ID NO: 273131 - RNA, 18 nt, Human
gagacccagcccugcccc

SEQ ID NO: 273132 - RNA, 24 nt, Human
gagggcgggggccucugcugcugc

SEQ ID NO: 273133 - RNA, 19 nt, Human
gccgcugcgcccugcgccc

SEQ ID NO: 273134 - RNA, 22 nt, Human
gccgcugcgcccugcgccccgc

SEQ ID NO: 273135 - RNA, 25 nt, Human
gcggggcugggacccucagggcucg

SEQ ID NO: 273136 - RNA, 23 nt, Human
ggaaagcagugaagggacugggc

SEQ ID NO: 273137 - RNA, 24 nt, Human
ggacaaggaccaagaugcagggaa

SEQ ID NO: 273138 - RNA, 20 nt, Human
ggacagacagaagagcccca

SEQ ID NO: 273139 - RNA, 18 nt, Human
ggaugggggcugccgggc

SEQ ID NO: 273140 - RNA, 23 nt, Human
ggaugggggcugccgggcggggu

SEQ ID NO: 273141 - RNA, 24 nt, Human
ggcagugaaucugaggagcugugg

SEQ ID NO: 273142 - RNA, 18 nt, Human
ggccucacagucgcugca

SEQ ID NO: 273143 - RNA, 21 nt, Human
gggaagcuuggggagccuggg

SEQ ID NO: 273144 - RNA, 19 nt, Human
gggcagugaaucugaggag

SEQ ID NO: 273145 - RNA, 23 nt, Human
gguaaaaagaaacgcaagaaaga

SEQ ID NO: 273146 - RNA, 20 nt, Human
guucugauucugcucccacu

SEQ ID NO: 273147 - RNA, 25 nt, Human
uaaaaagaaacgcaagaaagaggcu

SEQ ID NO: 273148 - RNA, 21 nt, Human
uacaggccaacagacagacac

SEQ ID NO: 273149 - RNA, 20 nt, Human
uagagaggcacacagaacca

SEQ ID NO: 273150 - RNA, 23 nt, Human
ucacccccgccuuggccugcacu

SEQ ID NO: 273151 - RNA, 21 nt, Human
uccauaccuuuccagcucauc

SEQ ID NO: 273152 - RNA, 23 nt, Human
uccauaccuuuccagcucauccc

SEQ ID NO: 273153 - RNA, 19 nt, Human
uccccagccccuccccacc

SEQ ID NO: 273154 - RNA, 19 nt, Human
ucccccuucccuucccugg

SEQ ID NO: 273155 - RNA, 19 nt, Human
ugaaaagcaagccaucuug

SEQ ID NO: 273156 - RNA, 18 nt, Human
ugaagaagcaggacagac

SEQ ID NO: 273157 - RNA, 20 nt, Human
ugagccagaaaggagggccg

SEQ ID NO: 273158 - RNA, 24 nt, Human
ugcugcugccuucucuucucucca

SEQ ID NO: 273159 - RNA, 25 nt, Human
ugcuuccggggaccccgcuuggccg

SEQ ID NO: 273160 - RNA, 22 nt, Human
uggaggaaaagccacuccuucu

SEQ ID NO: 273161 - RNA, 22 nt, Human
uggccaaggggacaaggaccaa

SEQ ID NO: 273162 - RNA, 24 nt, Human
uggccaaggggacaaggaccaaga

SEQ ID NO: 273163 - RNA, 21 nt, Human
uggggcaggaaagcagugaag

SEQ ID NO: 273164 - RNA, 18 nt, Human
uggggugagggcgggggc

SEQ ID NO: 273165 - RNA, 20 nt, Human
uggggugagggcgggggccu

SEQ ID NO: 273166 - RNA, 18 nt, Human
ugucccggggacgcggag

SEQ ID NO: 273167 - RNA, 18 nt, Human
ugugaaaagcaagccauc

SEQ ID NO: 273168 - RNA, 22 nt, Human
uuccagcucaucccaccucugc

SEQ ID NO: 273169 - RNA, 24 nt, Human
uuggggcaggaaagcagugaaggg

SEQ ID NO: 273170 - RNA, 20 nt, Human
uuuuuauuuuuuagagaggc

SEQ ID NO: 273171 - RNA, 25 nt, Human
uuuuuuuuuuuuuuuuuuuauuuuu

SEQ ID NO: 273172 - RNA, 23 nt, Human
aaacucgcugcgcuccccuccgg

SEQ ID NO: 273173 - RNA, 18 nt, Human
aacucgcugcgcuccccu

SEQ ID NO: 273174 - RNA, 19 nt, Human
aacucgcugcgcuccccuc

SEQ ID NO: 273175 - RNA, 21 nt, Human
acgcuaugcaccucagugugg

SEQ ID NO: 273176 - RNA, 19 nt, Human
agggaggggcccaggagag

SEQ ID NO: 273177 - RNA, 20 nt, Human
agguagggaggggcccagga

SEQ ID NO: 273178 - RNA, 23 nt, Human
augauucuuuaaaacuguauaaa

SEQ ID NO: 273179 - RNA, 23 nt, Human
ccaaaacucgcugcgcuccccuc

SEQ ID NO: 273180 - RNA, 24 nt, Human
cgcugcgcuccccuccggcuccca

SEQ ID NO: 273181 - RNA, 18 nt, Human
cggacgcugagcugagcu

SEQ ID NO: 273182 - RNA, 21 nt, Human
gcacgaccacuggccaaaacu

SEQ ID NO: 273183 - RNA, 19 nt, Human
gcagggggagggagcgugu

SEQ ID NO: 273184 - RNA, 18 nt, Human
gcccaggagaguguagaa

SEQ ID NO: 273185 - RNA, 21 nt, Human
gggagggagcgugucggcagg

SEQ ID NO: 273186 - RNA, 20 nt, Human
gggcagggggagggagcgug

SEQ ID NO: 273187 - RNA, 19 nt, Human
uacagguugagguagggag

SEQ ID NO: 273188 - RNA, 21 nt, Human
uagggaggggcccaggagagu

SEQ ID NO: 273189 - RNA, 22 nt, Human
ugagguagggaggggcccagga

SEQ ID NO: 273190 - RNA, 22 nt, Human
uguauaaacuauaaauuaccau

SEQ ID NO: 273191 - RNA, 21 nt, Human
uuggacugcacgaccacuggc

SEQ ID NO: 273192 - RNA, 23 nt, Human
aaaacauacuugcaagccaccaa

SEQ ID NO: 273193 - RNA, 24 nt, Human
aaauacacccagacucugucccac

SEQ ID NO: 273194 - RNA, 23 nt, Human
aacaguccuuugcaggguugucu

SEQ ID NO: 273195 - RNA, 26 nt, Human
aagccaccaaacccccuccccaccug

SEQ ID NO: 273196 - RNA, 18 nt, Human
aagcucaggaaaaaacag

SEQ ID NO: 273197 - RNA, 19 nt, Human
aaggggaguaaaaaggggc

SEQ ID NO: 273198 - RNA, 24 nt, Human
aauuccuucuugccgcauucccac

SEQ ID NO: 273199 - RNA, 21 nt, Human
acaccugcuguggugggaggg

SEQ ID NO: 273200 - RNA, 21 nt, Human
accaggcccuaggcaagcauc

SEQ ID NO: 273201 - RNA, 19 nt, Human
acggggcaggggcaggguu

SEQ ID NO: 273202 - RNA, 24 nt, Human
agacagacgccagcuccagccucg

SEQ ID NO: 273203 - RNA, 19 nt, Human
agagaaaaaacucauggag

SEQ ID NO: 273204 - RNA, 19 nt, Human
agaggggcugagggagggu

SEQ ID NO: 273205 - RNA, 23 nt, Human
agcauuccuccacguguaagccc

SEQ ID NO: 273206 - RNA, 20 nt, Human
agcguggaaggcaaagcuga

SEQ ID NO: 273207 - RNA, 24 nt, Human
agcucaguucugccaggcgggccc

SEQ ID NO: 273208 - RNA, 20 nt, Human
agcuucgaaaaccccuccca

SEQ ID NO: 273209 - RNA, 21 nt, Human
aggagcucaguucugccaggc

SEQ ID NO: 273210 - RNA, 20 nt, Human
aggaggcaaggaggggaggu

SEQ ID NO: 273211 - RNA, 24 nt, Human
aggaggcaaggaggggaggugaua

SEQ ID NO: 273212 - RNA, 19 nt, Human
aggcaaaacagaacaggcc

SEQ ID NO: 273213 - RNA, 22 nt, Human
aggcaaaacagaacaggccagg

SEQ ID NO: 273214 - RNA, 19 nt, Human
aggcaagcaucccaucucc

SEQ ID NO: 273215 - RNA, 18 nt, Human
aggcaaggaggggaggug

SEQ ID NO: 273216 - RNA, 24 nt, Human
aggcaguggggaaggggugggggu

SEQ ID NO: 273217 - RNA, 21 nt, Human
agggaagcagcacccuuucca

SEQ ID NO: 273218 - RNA, 26 nt, Human
agggaggggguggaaaguccacugag

SEQ ID NO: 273219 - RNA, 22 nt, Human
aggggcugagggaggguugagg

SEQ ID NO: 273220 - RNA, 18 nt, Human
aggugcccaggugagggg

SEQ ID NO: 273221 - RNA, 19 nt, Human
aguaaaaaggggccccaga

SEQ ID NO: 273222 - RNA, 26 nt, Human
aguggggaaggggugggggucuggag

SEQ ID NO: 273223 - RNA, 20 nt, Human
auguggggcggggcgggggc

SEQ ID NO: 273224 - RNA, 20 nt, Human
caccaaacccccuccccacc

SEQ ID NO: 273225 - RNA, 21 nt, Human
cacgaaccccaaaccugacuc

SEQ ID NO: 273226 - RNA, 18 nt, Human
cacuucccccuaguacca

SEQ ID NO: 273227 - RNA, 22 nt, Human
cacuucccccuaguaccauccc

SEQ ID NO: 273228 - RNA, 22 nt, Human
cagcgcacagccugccuggggc

SEQ ID NO: 273229 - RNA, 23 nt, Human
cagcuccagccucggucggcagu

SEQ ID NO: 273230 - RNA, 21 nt, Human
caucgcaaccuucugggccca

SEQ ID NO: 273231 - RNA, 19 nt, Human
caucucagcucaaggggag

SEQ ID NO: 273232 - RNA, 20 nt, Human
cauggcccccagcugggggc

SEQ ID NO: 273233 - RNA, 19 nt, Human
cauggcccccuucuggcca

SEQ ID NO: 273234 - RNA, 23 nt, Human
ccaacuucaggcaaaacagaaca

SEQ ID NO: 273235 - RNA, 24 nt, Human
ccacacgggcugcacugacagggc

SEQ ID NO: 273236 - RNA, 18 nt, Human
ccaccaaacccccucccc

SEQ ID NO: 273237 - RNA, 22 nt, Human
ccacgaaccccaaaccugacuc

SEQ ID NO: 273238 - RNA, 21 nt, Human
ccaucucagcucaaggggagu

SEQ ID NO: 273239 - RNA, 22 nt, Human
cccaagagaaaaaacucaugga

SEQ ID NO: 273240 - RNA, 20 nt, Human
cccagacucugucccacucc

SEQ ID NO: 273241 - RNA, 27 nt, Human
ccccagaaccaaacacaacgauuauuu

SEQ ID NO: 273242 - RNA, 21 nt, Human
ccccagaaccaaacacaugcu

SEQ ID NO: 273243 - RNA, 24 nt, Human
cccccauauaugacaccugcugug

SEQ ID NO: 273244 - RNA, 28 nt, Human
ccccuaggcugauucuaggggccagugu

SEQ ID NO: 273245 - RNA, 18 nt, Human
ccccucaucacagguuga

SEQ ID NO: 273246 - RNA, 18 nt, Human
ccccucgcccucaggcaa

SEQ ID NO: 273247 - RNA, 23 nt, Human
ccccucgcccucaggcaaaccug

SEQ ID NO: 273248 - RNA, 26 nt, Human
ccgccucccgcggcagcgcucgacuu

SEQ ID NO: 273249 - RNA, 20 nt, Human
ccuaggcugauucuaggggc

SEQ ID NO: 273250 - RNA, 19 nt, Human
ccucauggcccccuucugg

SEQ ID NO: 273251 - RNA, 21 nt, Human
ccugccacccuccccucgccc

SEQ ID NO: 273252 - RNA, 18 nt, Human
cgcccucaggcaaaccug

SEQ ID NO: 273253 - RNA, 23 nt, Human
cucccagcucugacaagccuccg

SEQ ID NO: 273254 - RNA, 20 nt, Human
cuccccucaucacagguuga

SEQ ID NO: 273255 - RNA, 19 nt, Human
cuccuccugugugugugug

SEQ ID NO: 273256 - RNA, 25 nt, Human
cuccuccugugugugugugugcgug

SEQ ID NO: 273257 - RNA, 24 nt, Human
cucgauuccucccucugagucucu

SEQ ID NO: 273258 - RNA, 20 nt, Human
cugcacugacagggcugugg

SEQ ID NO: 273259 - RNA, 22 nt, Human
cugcgcugcgcuccagcgcccc

SEQ ID NO: 273260 - RNA, 21 nt, Human
cuuggucccugaccccuaggc

SEQ ID NO: 273261 - RNA, 21 nt, Human
gaaaaaacaguccuuugcagg

SEQ ID NO: 273262 - RNA, 19 nt, Human
gaacccugggcuggggagc

SEQ ID NO: 273263 - RNA, 21 nt, Human
gagcugggagaaauccccaca

SEQ ID NO: 273264 - RNA, 22 nt, Human
gaggaaaauaaauacacccaga

SEQ ID NO: 273265 - RNA, 22 nt, Human
gagggguccuuggucccugacc

SEQ ID NO: 273266 - RNA, 19 nt, Human
gcaggcaguggggaagggg

SEQ ID NO: 273267 - RNA, 26 nt, Human
gcaguggggaaggggugggggucugg

SEQ ID NO: 273268 - RNA, 21 nt, Human
gccaagcucaggaaaaaacag

SEQ ID NO: 273269 - RNA, 20 nt, Human
gccaccaaacccccucccca

SEQ ID NO: 273270 - RNA, 22 nt, Human
gccaccaaacccccuccccacc

SEQ ID NO: 273271 - RNA, 23 nt, Human
gccaccaaacccccuccccaccu

SEQ ID NO: 273272 - RNA, 22 nt, Human
gccccgggcaguauccagucuc

SEQ ID NO: 273273 - RNA, 22 nt, Human
gccgcauucccacacuggcccg

SEQ ID NO: 273274 - RNA, 21 nt, Human
gcggggcgggggcuccccggu

SEQ ID NO: 273275 - RNA, 20 nt, Human
gcucaaggggaguaaaaagg

SEQ ID NO: 273276 - RNA, 21 nt, Human
gcucaaggggaguaaaaaggg

SEQ ID NO: 273277 - RNA, 23 nt, Human
gcuccagcgcccccccugcccgc

SEQ ID NO: 273278 - RNA, 19 nt, Human
gcugugguuuuggggccug

SEQ ID NO: 273279 - RNA, 21 nt, Human
ggacaggaaguguggucagaa

SEQ ID NO: 273280 - RNA, 21 nt, Human
ggacucugagguccugcccag

SEQ ID NO: 273281 - RNA, 21 nt, Human
ggaggggguggaaaguccacu

SEQ ID NO: 273282 - RNA, 19 nt, Human
ggcaggggcaggguugggg

SEQ ID NO: 273283 - RNA, 19 nt, Human
ggcaguauccagucucagc

SEQ ID NO: 273284 - RNA, 25 nt, Human
ggcccagccaaccccauguuugcag

SEQ ID NO: 273285 - RNA, 20 nt, Human
ggcuccacagggguuggcug

SEQ ID NO: 273286 - RNA, 19 nt, Human
gggacaggcagagggaagc

SEQ ID NO: 273287 - RNA, 24 nt, Human
gggcaggcaguggggaaggggugg

SEQ ID NO: 273288 - RNA, 18 nt, Human
ggggaggugauaggaggg

SEQ ID NO: 273289 - RNA, 23 nt, Human
ggggcaggggcaggguuggggag

SEQ ID NO: 273290 - RNA, 22 nt, Human
ggggccaaaaggguuccaucuc

SEQ ID NO: 273291 - RNA, 21 nt, Human
gggggugcgggcuccacaggg

SEQ ID NO: 273292 - RNA, 23 nt, Human
gggggugggcugagcuucgaaaa

SEQ ID NO: 273293 - RNA, 19 nt, Human
ggggugcgggcuccacagg

SEQ ID NO: 273294 - RNA, 25 nt, Human
ggggugcgggcuccacagggguugg

SEQ ID NO: 273295 - RNA, 20 nt, Human
gggguggggggcaagagggg

SEQ ID NO: 273296 - RNA, 20 nt, Human
gguuggggaggcagcagggg

SEQ ID NO: 273297 - RNA, 23 nt, Human
guaaaaaggggccccagaaccaa

SEQ ID NO: 273298 - RNA, 20 nt, Human
gucccacuccccaggugccc

SEQ ID NO: 273299 - RNA, 19 nt, Human
gucuggagacagcguggaa

SEQ ID NO: 273300 - RNA, 31 nt, Human
gugugugugugugcgugugucuguguguugg

SEQ ID NO: 273301 - RNA, 21 nt, Human
guguugcaaggugaggggucc

SEQ ID NO: 273302 - RNA, 19 nt, Human
uaaaaaggggccccagaac

SEQ ID NO: 273303 - RNA, 20 nt, Human
uaaaaaggggccccagaacc

SEQ ID NO: 273304 - RNA, 23 nt, Human
uaaaacauacuugcaagccacca

SEQ ID NO: 273305 - RNA, 18 nt, Human
uaggaggguugcuggggg

SEQ ID NO: 273306 - RNA, 24 nt, Human
ucaucgcaaccuucuggggggccc

SEQ ID NO: 273307 - RNA, 21 nt, Human
uccacgaaccccaaaccugac

SEQ ID NO: 273308 - RNA, 22 nt, Human
uccacgaaccccaaaccugacu

SEQ ID NO: 273309 - RNA, 23 nt, Human
uccacugaggccucauggccccc

SEQ ID NO: 273310 - RNA, 19 nt, Human
ucccagaaggucaccugcc

SEQ ID NO: 273311 - RNA, 19 nt, Human
ucccagcucugacaagccu

SEQ ID NO: 273312 - RNA, 18 nt, Human
ucccugaccccuaggcug

SEQ ID NO: 273313 - RNA, 20 nt, Human
ucccugguguuggccccccc

SEQ ID NO: 273314 - RNA, 23 nt, Human
uccuagucccuuccacagggcug

SEQ ID NO: 273315 - RNA, 28 nt, Human
uccuuggucccugaccccuaggcugauu

SEQ ID NO: 273316 - RNA, 18 nt, Human
ucgcaaccuucugggccc

SEQ ID NO: 273317 - RNA, 21 nt, Human
ucgcaaccuucugggcccagc

SEQ ID NO: 273318 - RNA, 19 nt, Human
ucucuggggccuugucacu

SEQ ID NO: 273319 - RNA, 18 nt, Human
ucugacaagccuccgauc

SEQ ID NO: 273320 - RNA, 22 nt, Human
ucugccaggcgggcccccccca

SEQ ID NO: 273321 - RNA, 20 nt, Human
ucugggcccagccaacccca

SEQ ID NO: 273322 - RNA, 18 nt, Human
ucuggggccuugucacuu

SEQ ID NO: 273323 - RNA, 19 nt, Human
ucuguguguugcaagguga

SEQ ID NO: 273324 - RNA, 19 nt, Human
ugacaccugcugugguggg

SEQ ID NO: 273325 - RNA, 18 nt, Human
ugagagggacaggcagag

SEQ ID NO: 273326 - RNA, 20 nt, Human
ugagauggugacggggcagg

SEQ ID NO: 273327 - RNA, 18 nt, Human
ugaggggggugggcugag

SEQ ID NO: 273328 - RNA, 19 nt, Human
ugauaggaggguugcuggg

SEQ ID NO: 273329 - RNA, 19 nt, Human
ugcaagccaccaaaccccc

SEQ ID NO: 273330 - RNA, 22 nt, Human
ugcacugacagggcugugguuu

SEQ ID NO: 273331 - RNA, 21 nt, Human
ugccagccugcacuuggccuc

SEQ ID NO: 273332 - RNA, 19 nt, Human
ugccaggcgggcccccccc

SEQ ID NO: 273333 - RNA, 18 nt, Human
ugccugagagggacaggc

SEQ ID NO: 273334 - RNA, 19 nt, Human
ugcuccuagucccuuccac

SEQ ID NO: 273335 - RNA, 19 nt, Human
ugcuccuagucccuuccac

SEQ ID NO: 273336 - RNA, 19 nt, Human
ugcuguggugggaggggcu

SEQ ID NO: 273337 - RNA, 22 nt, Human
uggagccaugccacugauguca

SEQ ID NO: 273338 - RNA, 22 nt, Human
uggagggcagcagacuggagcc

SEQ ID NO: 273339 - RNA, 19 nt, Human
uggcagcugccccgggcag

SEQ ID NO: 273340 - RNA, 20 nt, Human
uggccugagauggugacggg

SEQ ID NO: 273341 - RNA, 20 nt, Human
uggcuucaagccauuuccca

SEQ ID NO: 273342 - RNA, 18 nt, Human
ugggagaaauccccacag

SEQ ID NO: 273343 - RNA, 21 nt, Human
ugggagaagggggcagguggc

SEQ ID NO: 273344 - RNA, 22 nt, Human
ugggagaagggggcagguggcc

SEQ ID NO: 273345 - RNA, 27 nt, Human
ugggaugccacccuuguuccccaaguu

SEQ ID NO: 273346 - RNA, 21 nt, Human
uggggaaggggugggggucug

SEQ ID NO: 273347 - RNA, 18 nt, Human
ugggggaacccugggcug

SEQ ID NO: 273348 - RNA, 22 nt, Human
ugggggugcgggcuccacaggg

SEQ ID NO: 273349 - RNA, 23 nt, Human
ugggguggggggcaagaggggcu

SEQ ID NO: 273350 - RNA, 24 nt, Human
ugggguggggggcaagaggggcug

SEQ ID NO: 273351 - RNA, 18 nt, Human
ugugggagaagggggcag

SEQ ID NO: 273352 - RNA, 20 nt, Human
uguggggcggggcgggggcu

SEQ ID NO: 273353 - RNA, 21 nt, Human
ugugugcgugugucugugugu

SEQ ID NO: 273354 - RNA, 21 nt, Human
ugugugugcgugugucugugu

SEQ ID NO: 273355 - RNA, 22 nt, Human
ugugugugugugcgugugucug

SEQ ID NO: 273356 - RNA, 20 nt, Human
ugugugugugugugcgugug

SEQ ID NO: 273357 - RNA, 20 nt, Human
ugugugugugugugcgugug

SEQ ID NO: 273358 - RNA, 21 nt, Human
ugugugugugugugcgugugu

SEQ ID NO: 273359 - RNA, 19 nt, Human
uucacaguguagaguccau

SEQ ID NO: 273360 - RNA, 21 nt, Human
uucacaguguagaguccaugg

SEQ ID NO: 273361 - RNA, 20 nt, Human
uucucuggcagcugccccgg

SEQ ID NO: 273362 - RNA, 19 nt, Human
uugaagacagacgccagcu

SEQ ID NO: 273363 - RNA, 22 nt, Human
uugcggacugauggggcugcgc

SEQ ID NO: 273364 - RNA, 20 nt, Human
uugcugggggucuggagcuc

SEQ ID NO: 273365 - RNA, 26 nt, Human
uuucccagaaggucaccugccacccu

SEQ ID NO: 273366 - RNA, 23 nt, Human
uuuccuccccucaucacagguug

SEQ ID NO: 273367 - RNA, 18 nt, Human
aaacagcgggaaucacag

SEQ ID NO: 273368 - RNA, 22 nt, Human
aaauagaagcuggcaacacaag

SEQ ID NO: 273369 - RNA, 22 nt, Human
aagacaaaggcaaggagagaga

SEQ ID NO: 273370 - RNA, 20 nt, Human
aaggcaaggagagagacuga

SEQ ID NO: 273371 - RNA, 24 nt, Human
acacaagacccacuugacacaugg

SEQ ID NO: 273372 - RNA, 19 nt, Human
accagcaggauucagagcc

SEQ ID NO: 273373 - RNA, 23 nt, Human
agccccucccuccagcuuucucc

SEQ ID NO: 273374 - RNA, 24 nt, Human
caaucuucaaauagaagcuggcaa

SEQ ID NO: 273375 - RNA, 23 nt, Human
cagcaaacggaucaguaaaggca

SEQ ID NO: 273376 - RNA, 21 nt, Human
cagcuuucuccccuuaccucc

SEQ ID NO: 273377 - RNA, 19 nt, Human
caggauucagagcccugau

SEQ ID NO: 273378 - RNA, 19 nt, Human
caggcaccaaaauggagga

SEQ ID NO: 273379 - RNA, 21 nt, Human
caugcaaaugggugaaacuac

SEQ ID NO: 273380 - RNA, 19 nt, Human
ccaauuaaagccccucccu

SEQ ID NO: 273381 - RNA, 19 nt, Human
ccagcuuucuccccuuacc

SEQ ID NO: 273382 - RNA, 24 nt, Human
cccccaaacccaccauuuuucguu

SEQ ID NO: 273383 - RNA, 22 nt, Human
ccccuuaccucccuucccccaa

SEQ ID NO: 273384 - RNA, 23 nt, Human
ccccuuaccucccuucccccaaa

SEQ ID NO: 273385 - RNA, 24 nt, Human
cccuccagcuuucuccccuuaccu

SEQ ID NO: 273386 - RNA, 23 nt, Human
ccuccaauuaaagccccucccuc

SEQ ID NO: 273387 - RNA, 20 nt, Human
ccucccuccagcuuucuccc

SEQ ID NO: 273388 - RNA, 22 nt, Human
cggggccuccaauuaaagcccc

SEQ ID NO: 273389 - RNA, 19 nt, Human
gaaauaacauaggguucac

SEQ ID NO: 273390 - RNA, 22 nt, Human
gagagagacugaaugcuuggug

SEQ ID NO: 273391 - RNA, 19 nt, Human
gcuggcaacacaagaccca

SEQ ID NO: 273392 - RNA, 23 nt, Human
ggaaauaacauaggguucacagc

SEQ ID NO: 273393 - RNA, 18 nt, Human
uaccucccuucccccaaa

SEQ ID NO: 273394 - RNA, 22 nt, Human
uaccucccuucccccaaaccca

SEQ ID NO: 273395 - RNA, 20 nt, Human
uagaaguuccgcgcguccuc

SEQ ID NO: 273396 - RNA, 19 nt, Human
uaggaaaaugcaaggaaaa

SEQ ID NO: 273397 - RNA, 26 nt, Human
uaucaaaggauuuuuuaauuucguuu

SEQ ID NO: 273398 - RNA, 18 nt, Human
ucccagagcuuugcaggc

SEQ ID NO: 273399 - RNA, 23 nt, Human
uccccuuaccucccuucccccaa

SEQ ID NO: 273400 - RNA, 26 nt, Human
ucuacggggccuccaauuaaagcccc

SEQ ID NO: 273401 - RNA, 19 nt, Human
ucuuucccagagcuuugca

SEQ ID NO: 273402 - RNA, 18 nt, Human
ugcaaggaaaaagaaaac

SEQ ID NO: 273403 - RNA, 21 nt, Human
ugcaaggaaaaagaaaacagc

SEQ ID NO: 273404 - RNA, 27 nt, Human
ugcaggcaccaaaauggaggaccgguc

SEQ ID NO: 273405 - RNA, 19 nt, Human
ugcuuggugcucugaccag

SEQ ID NO: 273406 - RNA, 25 nt, Human
uuaaagccccucccuccagcuuucu

SEQ ID NO: 273407 - RNA, 22 nt, Human
uucaaauagaagcuggcaacac

SEQ ID NO: 273408 - RNA, 27 nt, Human
uuugaacacaaguaagacaaaggcaag

SEQ ID NO: 273409 - RNA, 19 nt, Human
aaccccggaaggaacccag

SEQ ID NO: 273410 - RNA, 23 nt, Human
aaccccugccuccccagggccuc

SEQ ID NO: 273411 - RNA, 19 nt, Human
aagaaggagcaagaaaagg

SEQ ID NO: 273412 - RNA, 24 nt, Human
aagagagacccagcuagagcugcu

SEQ ID NO: 273413 - RNA, 18 nt, Human
aagaucugaggucuguau

SEQ ID NO: 273414 - RNA, 18 nt, Human
aagcaagagagacccagc

SEQ ID NO: 273415 - RNA, 23 nt, Human
aagcagaagugagauguggccca

SEQ ID NO: 273416 - RNA, 21 nt, Human
aagcagggaggaagcaagaga

SEQ ID NO: 273417 - RNA, 28 nt, Human
aagcagggaggaagcaagagagacccag

SEQ ID NO: 273418 - RNA, 24 nt, Human
aaggaaagagaaaaaaauguaaua

SEQ ID NO: 273419 - RNA, 20 nt, Human
aaggacauccaggagcccug

SEQ ID NO: 273420 - RNA, 22 nt, Human
aauaaaccccggaaggaaccca

SEQ ID NO: 273421 - RNA, 21 nt, Human
acacagcugaggucuguggug

SEQ ID NO: 273422 - RNA, 20 nt, Human
acaggaacaagauggacaga

SEQ ID NO: 273423 - RNA, 22 nt, Human
accaaguaagaucugaggucug

SEQ ID NO: 273424 - RNA, 23 nt, Human
acccagcuagagcugcugggagc

SEQ ID NO: 273425 - RNA, 18 nt, Human
accccagccuuccucccu

SEQ ID NO: 273426 - RNA, 19 nt, Human
acugagauuccccucacag

SEQ ID NO: 273427 - RNA, 19 nt, Human
agaccccuggggccugcuc

SEQ ID NO: 273428 - RNA, 23 nt, Human
agaggcaagggucacagggcagg

SEQ ID NO: 273429 - RNA, 21 nt, Human
agcaauaaaccccggaaggaa

SEQ ID NO: 273430 - RNA, 23 nt, Human
agcucuagaagucacugccacuu

SEQ ID NO: 273431 - RNA, 25 nt, Human
aggaaagagaaaaaaauguaauaag

SEQ ID NO: 273432 - RNA, 18 nt, Human
aggaacaagauggacaga

SEQ ID NO: 273433 - RNA, 19 nt, Human
aggaagcaagagagaccca

SEQ ID NO: 273434 - RNA, 18 nt, Human
aggagaagcuagaacaga

SEQ ID NO: 273435 - RNA, 19 nt, Human
agggagcacagaaaugcag

SEQ ID NO: 273436 - RNA, 23 nt, Human
agggggaggaagggggaggaagg

SEQ ID NO: 273437 - RNA, 25 nt, Human
agggggaggaagggggaggaagggu

SEQ ID NO: 273438 - RNA, 22 nt, Human
agggggaggaagggucgugggg

SEQ ID NO: 273439 - RNA, 23 nt, Human
agggguacacauugugggggugu

SEQ ID NO: 273440 - RNA, 24 nt, Human
agguuuuuguuuuuuuuuuucucu

SEQ ID NO: 273441 - RNA, 21 nt, Human
auaaaccccggaaggaaccca

SEQ ID NO: 273442 - RNA, 22 nt, Human
caaccccugccuccccagggcc

SEQ ID NO: 273443 - RNA, 22 nt, Human
caauaaaccccggaaggaaccc

SEQ ID NO: 273444 - RNA, 22 nt, Human
caccccucccucugggagcuug

SEQ ID NO: 273445 - RNA, 22 nt, Human
cagaaggaaucacacagagaua

SEQ ID NO: 273446 - RNA, 19 nt, Human
cagagugggcugagaugag

SEQ ID NO: 273447 - RNA, 20 nt, Human
cagauaggauacacagcuga

SEQ ID NO: 273448 - RNA, 24 nt, Human
cagauaggauacacagcugagguc

SEQ ID NO: 273449 - RNA, 19 nt, Human
cagcaauaaaccccggaag

SEQ ID NO: 273450 - RNA, 21 nt, Human
caggagaagcuagaacagaua

SEQ ID NO: 273451 - RNA, 23 nt, Human
caggcuggggagagaaaagaggc

SEQ ID NO: 273452 - RNA, 22 nt, Human
cagggccucaccccucugccaa

SEQ ID NO: 273453 - RNA, 24 nt, Human
cagggugccagucugaagccuaga

SEQ ID NO: 273454 - RNA, 19 nt, Human
cauccuccuugcguugggg

SEQ ID NO: 273455 - RNA, 19 nt, Human
ccaaccacacuagcaaaca

SEQ ID NO: 273456 - RNA, 24 nt, Human
ccagguacuggggccagccacacu

SEQ ID NO: 273457 - RNA, 22 nt, Human
cccaggagaauagcccucgagg

SEQ ID NO: 273458 - RNA, 19 nt, Human
ccccagggccucaccccuc

SEQ ID NO: 273459 - RNA, 18 nt, Human
ccccggaaggaacccagg

SEQ ID NO: 273460 - RNA, 22 nt, Human
ccccucugccaagcacugagag

SEQ ID NO: 273461 - RNA, 25 nt, Human
cccuccccaccccucccucugggag

SEQ ID NO: 273462 - RNA, 20 nt, Human
ccucugccaagcacugagag

SEQ ID NO: 273463 - RNA, 24 nt, Human
ccucugggugcucaaggcucaucc

SEQ ID NO: 273464 - RNA, 25 nt, Human
ccugcgcuauagugcgcaggugggg

SEQ ID NO: 273465 - RNA, 19 nt, Human
ccuggagcugggggaggag

SEQ ID NO: 273466 - RNA, 23 nt, Human
ccugugcccagggccuuugggac

SEQ ID NO: 273467 - RNA, 18 nt, Human
ccuucugcaaauacuccg

SEQ ID NO: 273468 - RNA, 23 nt, Human
cggaaggaacccaggagaauagu

SEQ ID NO: 273469 - RNA, 20 nt, Human
cucaccccucugccaagcac

SEQ ID NO: 273470 - RNA, 19 nt, Human
cuccccacucuaaccccag

SEQ ID NO: 273471 - RNA, 23 nt, Human
cucuaccccaaagugcacaacuc

SEQ ID NO: 273472 - RNA, 20 nt, Human
gaagaaggagcaagaaaagg

SEQ ID NO: 273473 - RNA, 21 nt, Human
gaaguagccaaauagcucaaa

SEQ ID NO: 273474 - RNA, 25 nt, Human
gaggagggagcacagaaaugcagug

SEQ ID NO: 273475 - RNA, 23 nt, Human
gaucaggauccccuccccacccc

SEQ ID NO: 273476 - RNA, 20 nt, Human
gcaaagggcaugcucacaca

SEQ ID NO: 273477 - RNA, 24 nt, Human
gcagcguugacagccccagucucc

SEQ ID NO: 273478 - RNA, 21 nt, Human
gcgguggaaaggggccccaga

SEQ ID NO: 273479 - RNA, 23 nt, Human
gcucacacacaccaggaguugaa

SEQ ID NO: 273480 - RNA, 22 nt, Human
gcucucugccugugcccagggc

SEQ ID NO: 273481 - RNA, 23 nt, Human
ggagaaaauugggacaguaggag

SEQ ID NO: 273482 - RNA, 18 nt, Human
ggagcuugaaagcuggug

SEQ ID NO: 273483 - RNA, 20 nt, Human
ggaggaagggggaggaaggg

SEQ ID NO: 273484 - RNA, 19 nt, Human
ggagggggaggaaggggga

SEQ ID NO: 273485 - RNA, 21 nt, Human
ggccucagcaauaaaccccgg

SEQ ID NO: 273486 - RNA, 21 nt, Human
ggcuggggagagaaaagaggc

SEQ ID NO: 273487 - RNA, 18 nt, Human
ggcuuaguaaagccagca

SEQ ID NO: 273488 - RNA, 23 nt, Human
gggaaguagccaaauagcucaaa

SEQ ID NO: 273489 - RNA, 20 nt, Human
gggaggaaccagugagggug

SEQ ID NO: 273490 - RNA, 21 nt, Human
gggaggaagggucgugggguc

SEQ ID NO: 273491 - RNA, 18 nt, Human
gggaugcaaccagaagga

SEQ ID NO: 273492 - RNA, 21 nt, Human
gggcaugcucacacacaccag

SEQ ID NO: 273493 - RNA, 24 nt, Human
gggcucucugccugugcccagggc

SEQ ID NO: 273494 - RNA, 22 nt, Human
ggggaggaagggggaggaaggg

SEQ ID NO: 273495 - RNA, 23 nt, Human
ggggaggaagggucguggggucu

SEQ ID NO: 273496 - RNA, 21 nt, Human
ggggccccagagaggcccggg

SEQ ID NO: 273497 - RNA, 18 nt, Human
ggggucucuucccuugcc

SEQ ID NO: 273498 - RNA, 19 nt, Human
gguggugggagggggagga

SEQ ID NO: 273499 - RNA, 21 nt, Human
gucacagggcaggcuggggag

SEQ ID NO: 273500 - RNA, 22 nt, Human
gucacagggcaggcuggggaga

SEQ ID NO: 273501 - RNA, 19 nt, Human
gucagagaaaggaagaggc

SEQ ID NO: 273502 - RNA, 23 nt, Human
gugagaucaggauccccucccca

SEQ ID NO: 273503 - RNA, 23 nt, Human
guggugggagggggaggaagggg

SEQ ID NO: 273504 - RNA, 22 nt, Human
guugacagccccagucuccucu

SEQ ID NO: 273505 - RNA, 21 nt, Human
uaaaccccggaaggaacccag

SEQ ID NO: 273506 - RNA, 22 nt, Human
uaaauaaauaaguaaauaaaua

SEQ ID NO: 273507 - RNA, 18 nt, Human
uaagcagggaggaagcaa

SEQ ID NO: 273508 - RNA, 19 nt, Human
uaaggcccuucauuccacu

SEQ ID NO: 273509 - RNA, 22 nt, Human
uaaguaaguccuagggccagga

SEQ ID NO: 273510 - RNA, 21 nt, Human
uaaguccuagggccaggagaa

SEQ ID NO: 273511 - RNA, 23 nt, Human
uaccaaguaagaucugaggucug

SEQ ID NO: 273512 - RNA, 21 nt, Human
uagaacagauaggauacacag

SEQ ID NO: 273513 - RNA, 21 nt, Human
uagaagaggcagcauucagug

SEQ ID NO: 273514 - RNA, 22 nt, Human
uagaaggacccugucaggggau

SEQ ID NO: 273515 - RNA, 22 nt, Human
uagagggcaacaauugggcauc

SEQ ID NO: 273516 - RNA, 22 nt, Human
uagagugucaggacagguggau

SEQ ID NO: 273517 - RNA, 19 nt, Human
uagugaccagcuuucuaga

SEQ ID NO: 273518 - RNA, 24 nt, Human
uauaaauaaauaaauaaauaagua

SEQ ID NO: 273519 - RNA, 21 nt, Human
uaucaggaagaggcaaggguc

SEQ ID NO: 273520 - RNA, 22 nt, Human
ucaaggaaagagaaaaaaaugu

SEQ ID NO: 273521 - RNA, 21 nt, Human
ucacacagagauaugugacac

SEQ ID NO: 273522 - RNA, 20 nt, Human
ucacagggcaggcuggggag

SEQ ID NO: 273523 - RNA, 20 nt, Human
ucagagaaaggaagaggccc

SEQ ID NO: 273524 - RNA, 25 nt, Human
ucaggacagguggaucuggggaaag

SEQ ID NO: 273525 - RNA, 22 nt, Human
ucaggauccccuccccaccccu

SEQ ID NO: 273526 - RNA, 20 nt, Human
ucagugagagagcuuggggg

SEQ ID NO: 273527 - RNA, 25 nt, Human
ucccagcuacugagauuccccucac

SEQ ID NO: 273528 - RNA, 23 nt, Human
uccccagggccucaccccucugc

SEQ ID NO: 273529 - RNA, 19 nt, Human
ucucuucccuugccaaagg

SEQ ID NO: 273530 - RNA, 20 nt, Human
ucugaagccuagaaggaccc

SEQ ID NO: 273531 - RNA, 18 nt, Human
ucuggggaaaggauaugg

SEQ ID NO: 273532 - RNA, 21 nt, Human
ucuguaugugcuaagccacag

SEQ ID NO: 273533 - RNA, 22 nt, Human
ugaaaauuuggacauaggggua

SEQ ID NO: 273534 - RNA, 24 nt, Human
ugaaagcuggugguggggggucgc

SEQ ID NO: 273535 - RNA, 22 nt, Human
ugaauaaauaaauaaauaaaua

SEQ ID NO: 273536 - RNA, 20 nt, Human
ugagagacugagaucuugga

SEQ ID NO: 273537 - RNA, 21 nt, Human
ugagagacugagaucuuggag

SEQ ID NO: 273538 - RNA, 20 nt, Human
ugagaucaggauccccuccc

SEQ ID NO: 273539 - RNA, 23 nt, Human
ugagaucaggauccccuccccac

SEQ ID NO: 273540 - RNA, 24 nt, Human
ugagaucaggauccccuccccacc

SEQ ID NO: 273541 - RNA, 23 nt, Human
ugagggugcugcacauuuucaga

SEQ ID NO: 273542 - RNA, 26 nt, Human
ugcauuuuuagagggcaacaauuggg

SEQ ID NO: 273543 - RNA, 18 nt, Human
ugccugggucagagaaag

SEQ ID NO: 273544 - RNA, 24 nt, Human
ugcugacccugcgcuauagugcgc

SEQ ID NO: 273545 - RNA, 19 nt, Human
uggaaaggggccccagaga

SEQ ID NO: 273546 - RNA, 20 nt, Human
uggaaguggugggcuuggcc

SEQ ID NO: 273547 - RNA, 18 nt, Human
uggagcugggggaggagc

SEQ ID NO: 273548 - RNA, 24 nt, Human
uggaguaggggcgcagaguugggg

SEQ ID NO: 273549 - RNA, 20 nt, Human
uggcaagcaaagggcaugcu

SEQ ID NO: 273550 - RNA, 18 nt, Human
uggcauggcuguacaggc

SEQ ID NO: 273551 - RNA, 19 nt, Human
uggcccacucguugccuga

SEQ ID NO: 273552 - RNA, 24 nt, Human
ugggaccagguaggauugucuagg

SEQ ID NO: 273553 - RNA, 22 nt, Human
ugggagccccucacucuacccc

SEQ ID NO: 273554 - RNA, 20 nt, Human
ugggagcuugaaagcuggug

SEQ ID NO: 273555 - RNA, 21 nt, Human
ugggagcuugaaagcuggugg

SEQ ID NO: 273556 - RNA, 19 nt, Human
ugggcuuggccagguacug

SEQ ID NO: 273557 - RNA, 22 nt, Human
ugggggcagacuccaagugugg

SEQ ID NO: 273558 - RNA, 19 nt, Human
ugguguggcaagcaaaggg

SEQ ID NO: 273559 - RNA, 23 nt, Human
ugugacacagaccccuggggccu

SEQ ID NO: 273560 - RNA, 19 nt, Human
uuccauggucagggugcca

SEQ ID NO: 273561 - RNA, 20 nt, Human
uuccauggucagggugccag

SEQ ID NO: 273562 - RNA, 21 nt, Human
uugacagccccagucuccucu

SEQ ID NO: 273563 - RNA, 18 nt, Human
uuggugcgagggaggagg

SEQ ID NO: 273564 - RNA, 23 nt, Human
uuucagagugggcugagaugagg

SEQ ID NO: 273565 - RNA, 21 nt, Human
aaacagaacaaaaacaacaca

SEQ ID NO: 273566 - RNA, 22 nt, Human
aaacagaacaaaaacaacacaa

SEQ ID NO: 273567 - RNA, 21 nt, Human
aacacaaaaauccagaaacca

SEQ ID NO: 273568 - RNA, 25 nt, Human
aacacaaaaauccagaaaccagauu

SEQ ID NO: 273569 - RNA, 24 nt, Human
aaggaugaaggauggcagagggaa

SEQ ID NO: 273570 - RNA, 22 nt, Human
aaguguccaccaaagaaagucc

SEQ ID NO: 273571 - RNA, 18 nt, Human
acaauagagaguagcuga

SEQ ID NO: 273572 - RNA, 26 nt, Human
acacaaccucaggggggagggaacgc

SEQ ID NO: 273573 - RNA, 19 nt, Human
acagaacacaugcuuccuc

SEQ ID NO: 273574 - RNA, 22 nt, Human
acagaacacaugcuuccucccc

SEQ ID NO: 273575 - RNA, 20 nt, Human
acaggggaagggcucucaga

SEQ ID NO: 273576 - RNA, 18 nt, Human
acuccaccaucucuguua

SEQ ID NO: 273577 - RNA, 19 nt, Human
agagggagggaggaaagga

SEQ ID NO: 273578 - RNA, 24 nt, Human
agcaacccuguaaaacagaacaaa

SEQ ID NO: 273579 - RNA, 22 nt, Human
aggauaaaaggaugaaggaugg

SEQ ID NO: 273580 - RNA, 18 nt, Human
agggagggaggaaaggaa

SEQ ID NO: 273581 - RNA, 19 nt, Human
aguagcugaaaauacuaca

SEQ ID NO: 273582 - RNA, 21 nt, Human
aucccccaagagcaaaugaaa

SEQ ID NO: 273583 - RNA, 20 nt, Human
augaaggauggcagagggag

SEQ ID NO: 273584 - RNA, 26 nt, Human
auggcagagggagggaggaaaggaag

SEQ ID NO: 273585 - RNA, 20 nt, Human
augguuguggguagggggag

SEQ ID NO: 273586 - RNA, 21 nt, Human
caacacaaaaauccagaaacc

SEQ ID NO: 273587 - RNA, 24 nt, Human
caacacaaaaauccagaaaccaga

SEQ ID NO: 273588 - RNA, 21 nt, Human
caaccucacagaacacaugcu

SEQ ID NO: 273589 - RNA, 24 nt, Human
caaguguccaccaaagaaaguccc

SEQ ID NO: 273590 - RNA, 18 nt, Human
cacaaaaauccagaaacc

SEQ ID NO: 273591 - RNA, 18 nt, Human
cacaacaggaagcuagug

SEQ ID NO: 273592 - RNA, 21 nt, Human
caccacaccccgcacacaaca

SEQ ID NO: 273593 - RNA, 22 nt, Human
cagaaaccagauuuaguacuac

SEQ ID NO: 273594 - RNA, 18 nt, Human
ccacaccccgcacacaac

SEQ ID NO: 273595 - RNA, 23 nt, Human
cccagcaccgcaaggacacggau

SEQ ID NO: 273596 - RNA, 22 nt, Human
ccccauggcucacccacccagg

SEQ ID NO: 273597 - RNA, 23 nt, Human
cccccaagagcaaaugaaacccc

SEQ ID NO: 273598 - RNA, 18 nt, Human
cccgcacacaacaggaag

SEQ ID NO: 273599 - RNA, 19 nt, Human
ccucaggggggaagcuggc

SEQ ID NO: 273600 - RNA, 20 nt, Human
ccugcagcacaucucuuugg

SEQ ID NO: 273601 - RNA, 23 nt, Human
ccuggcuccaucagcuuucuccu

SEQ ID NO: 273602 - RNA, 30 nt, Human
cuaacacagauaauaugauacacaaccucu

SEQ ID NO: 273603 - RNA, 23 nt, Human
cuccuggcucuuucugccuuuca

SEQ ID NO: 273604 - RNA, 24 nt, Human
cucucugagcuugucacucccgac

SEQ ID NO: 273605 - RNA, 21 nt, Human
cucuuugguaugcugcugccc

SEQ ID NO: 273606 - RNA, 19 nt, Human
cugcagcacaucucuuugg

SEQ ID NO: 273607 - RNA, 21 nt, Human
cuguuacagcuaccagccagg

SEQ ID NO: 273608 - RNA, 19 nt, Human
cuguuuaauuccaccacac

SEQ ID NO: 273609 - RNA, 22 nt, Human
cuuccuggaauccuucaugcca

SEQ ID NO: 273610 - RNA, 23 nt, Human
gacccacaugguggcaggacaca

SEQ ID NO: 273611 - RNA, 20 nt, Human
gacccaggucaacugcccca

SEQ ID NO: 273612 - RNA, 23 nt, Human
gaguagcugaaaauacuacaugc

SEQ ID NO: 273613 - RNA, 21 nt, Human
gccgaacaaccucacagaaca

SEQ ID NO: 273614 - RNA, 23 nt, Human
ggaagcuaguggcugaaagcugg

SEQ ID NO: 273615 - RNA, 19 nt, Human
ggaauccuucaugccagca

SEQ ID NO: 273616 - RNA, 18 nt, Human
gggaagggcucucagagc

SEQ ID NO: 273617 - RNA, 23 nt, Human
guacaucugacccacaugguggc

SEQ ID NO: 273618 - RNA, 20 nt, Human
uaaaaggaugaaggauggca

SEQ ID NO: 273619 - RNA, 18 nt, Human
uacaugcuaacacagaua

SEQ ID NO: 273620 - RNA, 18 nt, Human
uaccuaaucccccaagag

SEQ ID NO: 273621 - RNA, 22 nt, Human
uaccuaaucccccaagagcaaa

SEQ ID NO: 273622 - RNA, 19 nt, Human
uagagaguagcugaaaaua

SEQ ID NO: 273623 - RNA, 21 nt, Human
uagccgaacaaccucacagaa

SEQ ID NO: 273624 - RNA, 22 nt, Human
uagccgaacaaccucacagaac

SEQ ID NO: 273625 - RNA, 28 nt, Human
uauaacaauagagaguagcugaaaauac

SEQ ID NO: 273626 - RNA, 19 nt, Human
ucaacaucacauuaccaaa

SEQ ID NO: 273627 - RNA, 25 nt, Human
ucaacaucacauuaccaaaagcaaa

SEQ ID NO: 273628 - RNA, 18 nt, Human
ucagcuuucuccuggcuc

SEQ ID NO: 273629 - RNA, 24 nt, Human
uccaccaaagaaagucccauucac

SEQ ID NO: 273630 - RNA, 21 nt, Human
uccccaaaugauaccuaaucc

SEQ ID NO: 273631 - RNA, 20 nt, Human
ucccccaagagcaaaugaaa

SEQ ID NO: 273632 - RNA, 20 nt, Human
uccuuggacuccaccaucuc

SEQ ID NO: 273633 - RNA, 24 nt, Human
ucuccuggcucuuucugccuuuca

SEQ ID NO: 273634 - RNA, 24 nt, Human
ucucuugccggacaccgcgaggau

SEQ ID NO: 273635 - RNA, 22 nt, Human
ucucuuugguaugcugcugccc

SEQ ID NO: 273636 - RNA, 18 nt, Human
ucuuugguaugcugcugc

SEQ ID NO: 273637 - RNA, 23 nt, Human
ugaaugauucugugugccaggca

SEQ ID NO: 273638 - RNA, 20 nt, Human
ugauacacaaccucaggggg

SEQ ID NO: 273639 - RNA, 19 nt, Human
ugccaccacccugcuucug

SEQ ID NO: 273640 - RNA, 20 nt, Human
ugccuccggaguccugcagc

SEQ ID NO: 273641 - RNA, 23 nt, Human
uggaauccuucaugccagcauca

SEQ ID NO: 273642 - RNA, 24 nt, Human
uggcagagggagggaggaaauacg

SEQ ID NO: 273643 - RNA, 24 nt, Human
uggcaggacacaggggaagggcuc

SEQ ID NO: 273644 - RNA, 19 nt, Human
uggcagggagcacguggca

SEQ ID NO: 273645 - RNA, 21 nt, Human
uggcagggagcacguggcaga

SEQ ID NO: 273646 - RNA, 18 nt, Human
uguaaaacagaacaaaaa

SEQ ID NO: 273647 - RNA, 21 nt, Human
uguaaaacagaacaaaaacaa

SEQ ID NO: 273648 - RNA, 19 nt, Human
ugucuugguagucucuugc

SEQ ID NO: 273649 - RNA, 24 nt, Human
uuaauuccaccacaccccgcacac

SEQ ID NO: 273650 - RNA, 20 nt, Human
uuaccaaaagcaaacagcag

SEQ ID NO: 273651 - RNA, 23 nt, Human
uucaagacccaggucaacugccc

SEQ ID NO: 273652 - RNA, 20 nt, Human
aaaaagcagcgcaugaauau

SEQ ID NO: 273653 - RNA, 24 nt, Human
aaaaauccccuauucucaaauauc

SEQ ID NO: 273654 - RNA, 23 nt, Human
aaagguccuaggacacugggaug

SEQ ID NO: 273655 - RNA, 20 nt, Human
aagaagaaauucagagcacc

SEQ ID NO: 273656 - RNA, 23 nt, Human
aagaagaaauucagagcaccaaa

SEQ ID NO: 273657 - RNA, 25 nt, Human
acaaaugccaauauccuacugcuca

SEQ ID NO: 273658 - RNA, 20 nt, Human
acagcaacagagacuagaag

SEQ ID NO: 273659 - RNA, 21 nt, Human
accaaaugcccauagaucucu

SEQ ID NO: 273660 - RNA, 22 nt, Human
agaggaaggcggggauguaacc

SEQ ID NO: 273661 - RNA, 18 nt, Human
aggacuauaauaaagaag

SEQ ID NO: 273662 - RNA, 18 nt, Human
aggacuauaauaaagaag

SEQ ID NO: 273663 - RNA, 20 nt, Human
aggccggaggugagggacug

SEQ ID NO: 273664 - RNA, 21 nt, Human
aggcugggcugggucugggcc

SEQ ID NO: 273665 - RNA, 22 nt, Human
aggggugaggucaugguugagu

SEQ ID NO: 273666 - RNA, 21 nt, Human
aguggccacucagccagagga

SEQ ID NO: 273667 - RNA, 20 nt, Human
augcccauagaucucuagga

SEQ ID NO: 273668 - RNA, 23 nt, Human
cacugggaugggcauguaauccu

SEQ ID NO: 273669 - RNA, 28 nt, Human
cagcaacagagacuagaaccuuggaugc

SEQ ID NO: 273670 - RNA, 22 nt, Human
cagcaguggggcuaaagaccag

SEQ ID NO: 273671 - RNA, 22 nt, Human
caggcugggcugggucugggcc

SEQ ID NO: 273672 - RNA, 19 nt, Human
cauguaauccucacucagg

SEQ ID NO: 273673 - RNA, 19 nt, Human
ccagcaguggggcuaaaga

SEQ ID NO: 273674 - RNA, 24 nt, Human
cccgcggccaggacagaggaaggc

SEQ ID NO: 273675 - RNA, 18 nt, Human
cccuauucucaaauaucu

SEQ ID NO: 273676 - RNA, 24 nt, Human
ccuacaccuugaaauuccuaccau

SEQ ID NO: 273677 - RNA, 23 nt, Human
cuugaaauuccuaccauuggaca

SEQ ID NO: 273678 - RNA, 21 nt, Human
gcaaacccggucccgcggcca

SEQ ID NO: 273679 - RNA, 19 nt, Human
gcaguggggcuaaagacca

SEQ ID NO: 273680 - RNA, 23 nt, Human
gccagaggacacuuuucaaucug

SEQ ID NO: 273681 - RNA, 24 nt, Human
ggagggagaaaccaaggaggggug

SEQ ID NO: 273682 - RNA, 20 nt, Human
gggacaucaucuggugccag

SEQ ID NO: 273683 - RNA, 20 nt, Human
gggcucaggcugggcugggu

SEQ ID NO: 273684 - RNA, 19 nt, Human
ggguuggggguaggggugg

SEQ ID NO: 273685 - RNA, 21 nt, Human
gguagggguggaggguucugu

SEQ ID NO: 273686 - RNA, 22 nt, Human
gugggacaucaucuggugccag

SEQ ID NO: 273687 - RNA, 21 nt, Human
uaacucccaacuuuuccuagu

SEQ ID NO: 273688 - RNA, 26 nt, Human
uaagccuuuaacuaacaaaugccaau

SEQ ID NO: 273689 - RNA, 21 nt, Human
uaaggcacaucaaaaaaaucc

SEQ ID NO: 273690 - RNA, 24 nt, Human
uacuuggaaaggaaauaaggcacu

SEQ ID NO: 273691 - RNA, 19 nt, Human
uaggacuauaauaaagaag

SEQ ID NO: 273692 - RNA, 26 nt, Human
uauaauaaagaagaaauucagagcac

SEQ ID NO: 273693 - RNA, 24 nt, Human
ucaaaaaaauccccuauucucaaa

SEQ ID NO: 273694 - RNA, 22 nt, Human
ucaaagcgaggcugagcucaua

SEQ ID NO: 273695 - RNA, 24 nt, Human
ucagccagaggacacuuuucaauc

SEQ ID NO: 273696 - RNA, 18 nt, Human
ucauguggaggccggagg

SEQ ID NO: 273697 - RNA, 23 nt, Human
ucccgaacugcggucccgcaaac

SEQ ID NO: 273698 - RNA, 20 nt, Human
uccuuguguagggguggaga

SEQ ID NO: 273699 - RNA, 18 nt, Human
ugacaggacgguggguac

SEQ ID NO: 273700 - RNA, 20 nt, Human
ugaggucaugguugagugua

SEQ ID NO: 273701 - RNA, 24 nt, Human
uggaaaggaaauaaggcacucuug

SEQ ID NO: 273702 - RNA, 21 nt, Human
ugggaugggcauguaauccuc

SEQ ID NO: 273703 - RNA, 21 nt, Human
uggggcucaggcugggcuggg

SEQ ID NO: 273704 - RNA, 23 nt, Human
uggggcucaggcugggcuggguc

SEQ ID NO: 273705 - RNA, 19 nt, Human
uggggguagggguggaggg

SEQ ID NO: 273706 - RNA, 18 nt, Human
ugggucugggccuagugg

SEQ ID NO: 273707 - RNA, 20 nt, Human
uggugaggaacugaggagua

SEQ ID NO: 273708 - RNA, 24 nt, Human
uguaaccggacgccccuggcagcc

SEQ ID NO: 273709 - RNA, 24 nt, Human
uguggugggacaucaucuggugcc

SEQ ID NO: 273710 - RNA, 21 nt, Human
uguuggggcucaggcugggcu

SEQ ID NO: 273711 - RNA, 22 nt, Human
uguuguuggggcucaggcuggg

SEQ ID NO: 273712 - RNA, 24 nt, Human
uucccgaacugcggucccgcaaac

SEQ ID NO: 273713 - RNA, 20 nt, Human
uuggggguagggguggaggg

SEQ ID NO: 273714 - RNA, 19 nt, Human
uugguucugucauguggag

SEQ ID NO: 273715 - RNA, 24 nt, Human
aaacagauuuuauucaaucuuucc

SEQ ID NO: 273716 - RNA, 21 nt, Human
caaguuucagucccggaaacu

SEQ ID NO: 273717 - RNA, 23 nt, Human
caccagucccacugacucauguu

SEQ ID NO: 273718 - RNA, 20 nt, Human
ccggaaaugaugauacccuc

SEQ ID NO: 273719 - RNA, 23 nt, Human
ccggaaaugaugauacccucgaa

SEQ ID NO: 273720 - RNA, 21 nt, Human
gaagacacucucuggaagcac

SEQ ID NO: 273721 - RNA, 20 nt, Human
ggaaaugaugauacccucga

SEQ ID NO: 273722 - RNA, 19 nt, Human
uaaguuggcauccagcuga

SEQ ID NO: 273723 - RNA, 21 nt, Human
ucucuggaagcacaccagucc

SEQ ID NO: 273724 - RNA, 20 nt, Human
uggaagcacaccagucccac

SEQ ID NO: 273725 - RNA, 23 nt, Human
uuuccuagaguuuauaaugaaca

SEQ ID NO: 273726 - RNA, 22 nt, Human
agaggcuggggucaccaggggc

SEQ ID NO: 273727 - RNA, 22 nt, Human
aggcacuuuagaccagagccag

SEQ ID NO: 273728 - RNA, 22 nt, Human
agggagguggacaccucacagg

SEQ ID NO: 273729 - RNA, 23 nt, Human
aggucucugcagcuguccaguuc

SEQ ID NO: 273730 - RNA, 20 nt, Human
augugcagggagguggacac

SEQ ID NO: 273731 - RNA, 18 nt, Human
cagcuguccaguucugac

SEQ ID NO: 273732 - RNA, 24 nt, Human
cagggcaggcagcauccagggucc

SEQ ID NO: 273733 - RNA, 23 nt, Human
caguggccauccguagggccaaa

SEQ ID NO: 273734 - RNA, 19 nt, Human
caucuccuuguccuucugg

SEQ ID NO: 273735 - RNA, 22 nt, Human
ccagccugggcucuggcagucu

SEQ ID NO: 273736 - RNA, 28 nt, Human
ccauccguagggccaaaggcaguucugg

SEQ ID NO: 273737 - RNA, 19 nt, Human
ccccguggaggggguuggg

SEQ ID NO: 273738 - RNA, 24 nt, Human
ccucacagguauggcgacuccugg

SEQ ID NO: 273739 - RNA, 24 nt, Human
ccucugggcuauugugccagcccu

SEQ ID NO: 273740 - RNA, 22 nt, Human
ccucuugauggccaccaagccc

SEQ ID NO: 273741 - RNA, 21 nt, Human
ccuuguccuucuggaaugucc

SEQ ID NO: 273742 - RNA, 26 nt, Human
cugagacagaggcuggcccuggucac

SEQ ID NO: 273743 - RNA, 22 nt, Human
cuuguccuucuggaauguccug

SEQ ID NO: 273744 - RNA, 23 nt, Human
gaaguggacagaggcugggguca

SEQ ID NO: 273745 - RNA, 20 nt, Human
gaggggguugggcucugccc

SEQ ID NO: 273746 - RNA, 19 nt, Human
gcagcauccaggguccugg

SEQ ID NO: 273747 - RNA, 21 nt, Human
gccugggcucuggcagucugg

SEQ ID NO: 273748 - RNA, 21 nt, Human
gcugguccggggacauggugc

SEQ ID NO: 273749 - RNA, 21 nt, Human
ggaggcagggacgcuggugcu

SEQ ID NO: 273750 - RNA, 20 nt, Human
ggcacaggucucugcagcug

SEQ ID NO: 273751 - RNA, 20 nt, Human
ggcccacgggaggcagggac

SEQ ID NO: 273752 - RNA, 21 nt, Human
gggcacaggucucugcagcug

SEQ ID NO: 273753 - RNA, 19 nt, Human
gggguugggcucugcccgg

SEQ ID NO: 273754 - RNA, 18 nt, Human
ggugcagaugaggccagc

SEQ ID NO: 273755 - RNA, 23 nt, Human
ggugcugggacccccguggaggg

SEQ ID NO: 273756 - RNA, 22 nt, Human
gugcagggagguggacaccuca

SEQ ID NO: 273757 - RNA, 19 nt, Human
uagggccaaaggcaguucu

SEQ ID NO: 273758 - RNA, 18 nt, Human
uccuugagugggucgaga

SEQ ID NO: 273759 - RNA, 25 nt, Human
ucuccuuguccuucuggaauguccu

SEQ ID NO: 273760 - RNA, 20 nt, Human
ucucugggcacaggucucug

SEQ ID NO: 273761 - RNA, 22 nt, Human
ucucugggcacaggucucugca

SEQ ID NO: 273762 - RNA, 22 nt, Human
ugagacagaggcuggcccuggg

SEQ ID NO: 273763 - RNA, 18 nt, Human
ugagagacaagaguggcc

SEQ ID NO: 273764 - RNA, 24 nt, Human
ugcuguguguccuugagugggucg

SEQ ID NO: 273765 - RNA, 21 nt, Human
uggccaccaagcccaggcacu

SEQ ID NO: 273766 - RNA, 19 nt, Human
ugggagagggagagacauc

SEQ ID NO: 273767 - RNA, 24 nt, Human
ugggcacaggucucugcagcuguc

SEQ ID NO: 273768 - RNA, 23 nt, Human
uggggucaccaggggcaacccgg

SEQ ID NO: 273769 - RNA, 22 nt, Human
uggugcaggguauauacaaggu

SEQ ID NO: 273770 - RNA, 21 nt, Human
aagauauaugaaggccuaaaa

SEQ ID NO: 273771 - RNA, 24 nt, Human
aaggagguggagguguaggcagca

SEQ ID NO: 273772 - RNA, 19 nt, Human
accaagacagcaggaccag

SEQ ID NO: 273773 - RNA, 18 nt, Human
accagguggcccugcaga

SEQ ID NO: 273774 - RNA, 18 nt, Human
accguggugacgagguuu

SEQ ID NO: 273775 - RNA, 25 nt, Human
agaaggacuggaacuacacauuuaa

SEQ ID NO: 273776 - RNA, 23 nt, Human
agacagcaggaccaggagugcca

SEQ ID NO: 273777 - RNA, 20 nt, Human
agacaggauacagggugagg

SEQ ID NO: 273778 - RNA, 18 nt, Human
agagacucugcauagaag

SEQ ID NO: 273779 - RNA, 21 nt, Human
agagccaagacaaaaccaaga

SEQ ID NO: 273780 - RNA, 22 nt, Human
agaguccucccagagccaagac

SEQ ID NO: 273781 - RNA, 23 nt, Human
agcagggggagggaggcaggcag

SEQ ID NO: 273782 - RNA, 18 nt, Human
agccacuggacauacuac

SEQ ID NO: 273783 - RNA, 24 nt, Human
agcccugguggcggagcggggcgc

SEQ ID NO: 273784 - RNA, 20 nt, Human
aggaaggagggagggcagga

SEQ ID NO: 273785 - RNA, 22 nt, Human
aggagggacuuggcucagacug

SEQ ID NO: 273786 - RNA, 18 nt, Human
agggagaaggggaaggag

SEQ ID NO: 273787 - RNA, 24 nt, Human
agucacugaccccucccgccaccu

SEQ ID NO: 273788 - RNA, 27 nt, Human
caaaaccaagacagcaggaccaggagu

SEQ ID NO: 273789 - RNA, 18 nt, Human
caagacaaaaccaagaca

SEQ ID NO: 273790 - RNA, 26 nt, Human
caagacagcaggaccaggagugccac

SEQ ID NO: 273791 - RNA, 18 nt, Human
cacaaguuuuccuggaug

SEQ ID NO: 273792 - RNA, 18 nt, Human
caccccaccucuagccac

SEQ ID NO: 273793 - RNA, 18 nt, Human
cacccggucaggugggcg

SEQ ID NO: 273794 - RNA, 27 nt, Human
caccucuagccacuggacauacuaccu

SEQ ID NO: 273795 - RNA, 18 nt, Human
cagaguccucccagagcc

SEQ ID NO: 273796 - RNA, 25 nt, Human
cagcacaaguuuuccuggaugguag

SEQ ID NO: 273797 - RNA, 19 nt, Human
cagggaaaucagaaacuac

SEQ ID NO: 273798 - RNA, 21 nt, Human
caguuccaggcuuuucuccag

SEQ ID NO: 273799 - RNA, 19 nt, Human
ccaagacagcaggaccagg

SEQ ID NO: 273800 - RNA, 23 nt, Human
ccaauucuguauuccagauucca

SEQ ID NO: 273801 - RNA, 26 nt, Human
ccacacaccagguggcccugcagaau

SEQ ID NO: 273802 - RNA, 21 nt, Human
ccaggcuuuucuccagcagga

SEQ ID NO: 273803 - RNA, 19 nt, Human
ccaucagcaauuccagcac

SEQ ID NO: 273804 - RNA, 20 nt, Human
cccagagccaagacaaaacc

SEQ ID NO: 273805 - RNA, 25 nt, Human
cccagagccaagacaaaaccaagac

SEQ ID NO: 273806 - RNA, 22 nt, Human
ccccagagucacugaccccucc

SEQ ID NO: 273807 - RNA, 26 nt, Human
ccccagagucacugaccccucccgcc

SEQ ID NO: 273808 - RNA, 23 nt, Human
cccccaagcccugguggcggagc

SEQ ID NO: 273809 - RNA, 21 nt, Human
ccccucugggcagaaugucug

SEQ ID NO: 273810 - RNA, 24 nt, Human
ccccucugggcagaaugucugaac

SEQ ID NO: 273811 - RNA, 24 nt, Human
cccucccgccaccuccacacacca

SEQ ID NO: 273812 - RNA, 24 nt, Human
ccucccgccaccuccacacaccag

SEQ ID NO: 273813 - RNA, 19 nt, Human
ccuccggcucgcccgcccc

SEQ ID NO: 273814 - RNA, 20 nt, Human
ccuccucucuucccacccca

SEQ ID NO: 273815 - RNA, 24 nt, Human
ccuggccuccucucuucccacccc

SEQ ID NO: 273816 - RNA, 22 nt, Human
cucccaucccuuuccccagccc

SEQ ID NO: 273817 - RNA, 20 nt, Human
cucuucccaccccaccucua

SEQ ID NO: 273818 - RNA, 24 nt, Human
cugcagaaugaggguugggcugau

SEQ ID NO: 273819 - RNA, 19 nt, Human
cugccccuaaaucuuuccu

SEQ ID NO: 273820 - RNA, 22 nt, Human
cugcgcgcucugcgaccuuggc

SEQ ID NO: 273821 - RNA, 21 nt, Human
gaauucuaaguucuaccuucc

SEQ ID NO: 273822 - RNA, 19 nt, Human
gaccguggugacgagguuu

SEQ ID NO: 273823 - RNA, 25 nt, Human
gacuuggcucagacuguccagcaag

SEQ ID NO: 273824 - RNA, 20 nt, Human
gagccaagacaaaaccaaga

SEQ ID NO: 273825 - RNA, 26 nt, Human
gccaagccacucuccaucugucuagu

SEQ ID NO: 273826 - RNA, 19 nt, Human
gcccgcccccucacucacc

SEQ ID NO: 273827 - RNA, 20 nt, Human
gcgcgaauaaacuccacccc

SEQ ID NO: 273828 - RNA, 24 nt, Human
gcucccaucccuuuccccagcccc

SEQ ID NO: 273829 - RNA, 21 nt, Human
ggaaggagguggagguguagg

SEQ ID NO: 273830 - RNA, 22 nt, Human
ggaaggccccgcccccaagccc

SEQ ID NO: 273831 - RNA, 18 nt, Human
gggcaggagagacucugc

SEQ ID NO: 273832 - RNA, 19 nt, Human
gggggagggaggcaggcag

SEQ ID NO: 273833 - RNA, 23 nt, Human
gggggagggaggcaggcagggaa

SEQ ID NO: 273834 - RNA, 21 nt, Human
guggcccugcagaaugagggu

SEQ ID NO: 273835 - RNA, 19 nt, Human
guuccaggcuuuucuccag

SEQ ID NO: 273836 - RNA, 21 nt, Human
uaaacuccaccccuccggcuc

SEQ ID NO: 273837 - RNA, 21 nt, Human
uacuucuagcagggggaggga

SEQ ID NO: 273838 - RNA, 18 nt, Human
uagcagggggagggaggc

SEQ ID NO: 273839 - RNA, 21 nt, Human
uagccacuggacauacuaccu

SEQ ID NO: 273840 - RNA, 24 nt, Human
uaggaaccucucuucaaguggucu

SEQ ID NO: 273841 - RNA, 21 nt, Human
ucaaguggucuuuugucaucu

SEQ ID NO: 273842 - RNA, 24 nt, Human
ucacugaccccucccgccaccucc

SEQ ID NO: 273843 - RNA, 20 nt, Human
uccacacaccagguggcccu

SEQ ID NO: 273844 - RNA, 19 nt, Human
uccaucagcaauuccagca

SEQ ID NO: 273845 - RNA, 22 nt, Human
uccaucagcaauuccagcacaa

SEQ ID NO: 273846 - RNA, 25 nt, Human
ucccaccccaccucuagccacugga

SEQ ID NO: 273847 - RNA, 25 nt, Human
uccccagccccucugggcagaaugu

SEQ ID NO: 273848 - RNA, 21 nt, Human
uccuggcucccaucccuuucc

SEQ ID NO: 273849 - RNA, 19 nt, Human
ucgcccgcccccucacuca

SEQ ID NO: 273850 - RNA, 24 nt, Human
ucuccagcaggagggacuuggcuc

SEQ ID NO: 273851 - RNA, 18 nt, Human
ucugaacugagcacugcc

SEQ ID NO: 273852 - RNA, 25 nt, Human
ucuuuccuggcucccaucccuuucc

SEQ ID NO: 273853 - RNA, 19 nt, Human
ugaauucuaaguucuaccu

SEQ ID NO: 273854 - RNA, 19 nt, Human
ugaccccucccgccaccuc

SEQ ID NO: 273855 - RNA, 19 nt, Human
ugaccccucccgccaccuc

SEQ ID NO: 273856 - RNA, 19 nt, Human
ugagggagaaggggaagga

SEQ ID NO: 273857 - RNA, 23 nt, Human
ugagggagaaggggaaggaggug

SEQ ID NO: 273858 - RNA, 23 nt, Human
ugcagaaugaggguugggcugau

SEQ ID NO: 273859 - RNA, 18 nt, Human
ugccacugucugucgggg

SEQ ID NO: 273860 - RNA, 23 nt, Human
ugccccuaaaucuuuccuggcuc

SEQ ID NO: 273861 - RNA, 22 nt, Human
uggcaagcccuuugcccacucu

SEQ ID NO: 273862 - RNA, 21 nt, Human
uggcccaguggaaaccaggga

SEQ ID NO: 273863 - RNA, 22 nt, Human
uggccuggccuccucucuuccc

SEQ ID NO: 273864 - RNA, 20 nt, Human
uggcucagacuguccagcaa

SEQ ID NO: 273865 - RNA, 19 nt, Human
uggcucccaucccuuuccc

SEQ ID NO: 273866 - RNA, 19 nt, Human
ugucuccugccccuaaauc

SEQ ID NO: 273867 - RNA, 23 nt, Human
ugucugaaccuccuccugaccgu

SEQ ID NO: 273868 - RNA, 24 nt, Human
uguuuuuuuguuuuggcaguucca

SEQ ID NO: 273869 - RNA, 22 nt, Human
uuacgugucugucuccugcccc

SEQ ID NO: 273870 - RNA, 23 nt, Human
uuagaagauauaugaaggccuaa

SEQ ID NO: 273871 - RNA, 18 nt, Human
uuccuggcucccaucccu

SEQ ID NO: 273872 - RNA, 21 nt, Human
uuguuuccaucagcaauucca

SEQ ID NO: 273873 - RNA, 23 nt, Human
uuguuuuuuuguuuuggcaguuc

SEQ ID NO: 273874 - RNA, 20 nt, Human
uuuuuuguuuuggcaguucc

SEQ ID NO: 273875 - RNA, 31 nt, Human
aaaaaaaccacacacacacacacacacacag

SEQ ID NO: 273876 - RNA, 18 nt, Human
aaaaaaccacacacacac

SEQ ID NO: 273877 - RNA, 31 nt, Human
aaaaaccacacacacacacacacacacacag

SEQ ID NO: 273878 - RNA, 21 nt, Human
aaaacaggaggacgggagaga

SEQ ID NO: 273879 - RNA, 19 nt, Human
aaaagaaaugaggcuucua

SEQ ID NO: 273880 - RNA, 20 nt, Human
aaaaugccccucccacuuuc

SEQ ID NO: 273881 - RNA, 19 nt, Human
aaaccccgcgagagucggg

SEQ ID NO: 273882 - RNA, 24 nt, Human
aaagaaaugaggcuucuagggccu

SEQ ID NO: 273883 - RNA, 20 nt, Human
aaccacccaaagccaugaaa

SEQ ID NO: 273884 - RNA, 21 nt, Human
aaccauuuuuggugccaguga

SEQ ID NO: 273885 - RNA, 19 nt, Human
aacgccgucuccuccccca

SEQ ID NO: 273886 - RNA, 19 nt, Human
aacugaauuccgccaacaa

SEQ ID NO: 273887 - RNA, 20 nt, Human
aagccccccaaauagucaaa

SEQ ID NO: 273888 - RNA, 18 nt, Human
acaagccugaaguaauac

SEQ ID NO: 273889 - RNA, 23 nt, Human
acacacacacacacacacacaca

SEQ ID NO: 273890 - RNA, 23 nt, Human
acacacacacacacacacacaca

SEQ ID NO: 273891 - RNA, 23 nt, Human
acacacacacacacacacacaca

SEQ ID NO: 273892 - RNA, 23 nt, Human
acacacacacacacacacacaca

SEQ ID NO: 273893 - RNA, 23 nt, Human
accaaaaauuaccaagcaccaaa

SEQ ID NO: 273894 - RNA, 20 nt, Human
accacacacacacacacaca

SEQ ID NO: 273895 - RNA, 22 nt, Human
accacacacacacacacacaca

SEQ ID NO: 273896 - RNA, 24 nt, Human
accacacacacacacacacacaca

SEQ ID NO: 273897 - RNA, 18 nt, Human
accccagagccacugccu

SEQ ID NO: 273898 - RNA, 20 nt, Human
acccuguuuucauaccuucu

SEQ ID NO: 273899 - RNA, 23 nt, Human
acccuguuuucauaccuucuuug

SEQ ID NO: 273900 - RNA, 22 nt, Human
agaaagcacugccacugcagcc

SEQ ID NO: 273901 - RNA, 20 nt, Human
agagugaaauagacuuaaaa

SEQ ID NO: 273902 - RNA, 18 nt, Human
agcaaagaacugaauucc

SEQ ID NO: 273903 - RNA, 22 nt, Human
agcaaagaacugaauuccgcca

SEQ ID NO: 273904 - RNA, 22 nt, Human
agccacugccuuauacuccugg

SEQ ID NO: 273905 - RNA, 19 nt, Human
agcuaaucuccagaacccg

SEQ ID NO: 273906 - RNA, 20 nt, Human
aggguggugcugagcucuac

SEQ ID NO: 273907 - RNA, 19 nt, Human
agguggcggcaagagcugg

SEQ ID NO: 273908 - RNA, 22 nt, Human
aguaguaauauucuccuuugca

SEQ ID NO: 273909 - RNA, 23 nt, Human
aguggaaauaggaaaaacaugcu

SEQ ID NO: 273910 - RNA, 22 nt, Human
auaccuucuuugggugauaguu

SEQ ID NO: 273911 - RNA, 18 nt, Human
auagagugaaauagacuu

SEQ ID NO: 273912 - RNA, 22 nt, Human
auagagugaaauagacuuaaaa

SEQ ID NO: 273913 - RNA, 19 nt, Human
aucccucuuccccugucuc

SEQ ID NO: 273914 - RNA, 20 nt, Human
auguuacuuuugaaguccau

SEQ ID NO: 273915 - RNA, 23 nt, Human
caaccuuuggaaaccuuuaauau

SEQ ID NO: 273916 - RNA, 21 nt, Human
caagcaccaaagcaugaaggg

SEQ ID NO: 273917 - RNA, 22 nt, Human
cacaagccugaaguaauacaga

SEQ ID NO: 273918 - RNA, 22 nt, Human
cacaaguugaacgcugcagcag

SEQ ID NO: 273919 - RNA, 20 nt, Human
cacacacacacacacacaca

SEQ ID NO: 273920 - RNA, 20 nt, Human
cacacacacacacacacaca

SEQ ID NO: 273921 - RNA, 20 nt, Human
cacacacacacacacacaca

SEQ ID NO: 273922 - RNA, 20 nt, Human
cacacacacacacacacaca

SEQ ID NO: 273923 - RNA, 20 nt, Human
cacacacacacacacacaca

SEQ ID NO: 273924 - RNA, 20 nt, Human
cacacacacacacacacaca

SEQ ID NO: 273925 - RNA, 20 nt, Human
cacacacacacacacacaca

SEQ ID NO: 273926 - RNA, 22 nt, Human
cacacacacacacacacacaca

SEQ ID NO: 273927 - RNA, 22 nt, Human
cacacacacacacacacacaca

SEQ ID NO: 273928 - RNA, 26 nt, Human
cacacacacacacacacacacacaca

SEQ ID NO: 273929 - RNA, 26 nt, Human
cacacacacacacacacacacacaca

SEQ ID NO: 273930 - RNA, 26 nt, Human
cacacacacacacacacacacacaca

SEQ ID NO: 273931 - RNA, 26 nt, Human
cacacacacacacacacacacacaca

SEQ ID NO: 273932 - RNA, 26 nt, Human
cacacacacacacacacacacacaca

SEQ ID NO: 273933 - RNA, 27 nt, Human
cacacacacacacacacacacacacua

SEQ ID NO: 273934 - RNA, 27 nt, Human
cacacacacacacacacacuaguuuuu

SEQ ID NO: 273935 - RNA, 24 nt, Human
caccaaaaauuaccaagcaccaaa

SEQ ID NO: 273936 - RNA, 23 nt, Human
cagaauaaaccauuuuuggugcc

SEQ ID NO: 273937 - RNA, 21 nt, Human
cagaauuugaaaaugccccuc

SEQ ID NO: 273938 - RNA, 20 nt, Human
cagcaauagaaaacuaauag

SEQ ID NO: 273939 - RNA, 25 nt, Human
cagccuuuaagacccugagcagaga

SEQ ID NO: 273940 - RNA, 21 nt, Human
caggccgggccucccaaugcc

SEQ ID NO: 273941 - RNA, 22 nt, Human
caguggaaauaggaaaaacaug

SEQ ID NO: 273942 - RNA, 23 nt, Human
ccaaaaauuaccaagcaccaaag

SEQ ID NO: 273943 - RNA, 21 nt, Human
ccacacacacacacacacaca

SEQ ID NO: 273944 - RNA, 23 nt, Human
ccaguaacaauuaagaagugucu

SEQ ID NO: 273945 - RNA, 25 nt, Human
ccccagagccacugccuuauacucc

SEQ ID NO: 273946 - RNA, 21 nt, Human
ccccgcgagagucgggacaaa

SEQ ID NO: 273947 - RNA, 21 nt, Human
cccucccuccaccaaggguug

SEQ ID NO: 273948 - RNA, 23 nt, Human
ccugugguaggguggugcugagc

SEQ ID NO: 273949 - RNA, 22 nt, Human
cgagagucgggacaaauaccgc

SEQ ID NO: 273950 - RNA, 21 nt, Human
cggaacgccgucuccuccccc

SEQ ID NO: 273951 - RNA, 24 nt, Human
cuccaccaaggguugucagcuccc

SEQ ID NO: 273952 - RNA, 18 nt, Human
cucccuccaacugagggc

SEQ ID NO: 273953 - RNA, 19 nt, Human
cugcagccaaaccccaacg

SEQ ID NO: 273954 - RNA, 22 nt, Human
cuguccuuuuccauggagaaaa

SEQ ID NO: 273955 - RNA, 23 nt, Human
cugucucuugcaccugggucagg

SEQ ID NO: 273956 - RNA, 23 nt, Human
cugugggcuugagcuaaucauau

SEQ ID NO: 273957 - RNA, 19 nt, Human
gaacgccgucuccuccccc

SEQ ID NO: 273958 - RNA, 20 nt, Human
gaacugaauuccgccaacaa

SEQ ID NO: 273959 - RNA, 19 nt, Human
gaagugucuauuuuugaaa

SEQ ID NO: 273960 - RNA, 19 nt, Human
gaauccagccacacugugc

SEQ ID NO: 273961 - RNA, 18 nt, Human
gaccaccuuacccuguuu

SEQ ID NO: 273962 - RNA, 19 nt, Human
gauaugaagcaugagaaag

SEQ ID NO: 273963 - RNA, 29 nt, Human
gcaccaaaaauuaccaagcaccaaagcaa

SEQ ID NO: 273964 - RNA, 18 nt, Human
gcagauucuuccccagag

SEQ ID NO: 273965 - RNA, 20 nt, Human
gccugugguaggguggugcu

SEQ ID NO: 273966 - RNA, 21 nt, Human
gccuuuaacaguucuccuuca

SEQ ID NO: 273967 - RNA, 20 nt, Human
gcgagagucgggacaaauac

SEQ ID NO: 273968 - RNA, 19 nt, Human
gcuggccuccagccugagc

SEQ ID NO: 273969 - RNA, 20 nt, Human
ggaaaaacaggcaaaaagaa

SEQ ID NO: 273970 - RNA, 21 nt, Human
ggaaggcugguuugaagcugg

SEQ ID NO: 273971 - RNA, 19 nt, Human
ggccgggccucccaaugcc

SEQ ID NO: 273972 - RNA, 23 nt, Human
gggcacccucccuccaccaaggg

SEQ ID NO: 273973 - RNA, 19 nt, Human
gguccaauuauuuuuggag

SEQ ID NO: 273974 - RNA, 19 nt, Human
ggugcugagcucuacauca

SEQ ID NO: 273975 - RNA, 26 nt, Human
uaaaaaauaacuucaaaauguagaac

SEQ ID NO: 273976 - RNA, 23 nt, Human
uaaaaagaacauaaaauaguaag

SEQ ID NO: 273977 - RNA, 21 nt, Human
uaaaauaguaaguccucagag

SEQ ID NO: 273978 - RNA, 23 nt, Human
uaaaauaguaaguccucagagac

SEQ ID NO: 273979 - RNA, 18 nt, Human
uaacggaacgccgucucc

SEQ ID NO: 273980 - RNA, 23 nt, Human
uaacuggauuaaacuggcacuaa

SEQ ID NO: 273981 - RNA, 19 nt, Human
uaauguacuuucugucuau

SEQ ID NO: 273982 - RNA, 21 nt, Human
uacauuucuuaagcuaaguug

SEQ ID NO: 273983 - RNA, 22 nt, Human
uagaaaacuaauacacugccca

SEQ ID NO: 273984 - RNA, 21 nt, Human
uagagugaaauagacuuaaaa

SEQ ID NO: 273985 - RNA, 22 nt, Human
uagagugaaauagacuuaaaau

SEQ ID NO: 273986 - RNA, 21 nt, Human
uaggguggugcugagcucuac

SEQ ID NO: 273987 - RNA, 21 nt, Human
uagucaaagugaagacagcuc

SEQ ID NO: 273988 - RNA, 23 nt, Human
uauaaauauuuggccgccuuuaa

SEQ ID NO: 273989 - RNA, 22 nt, Human
uauaucugugggcuugagcuaa

SEQ ID NO: 273990 - RNA, 19 nt, Human
uaugaauuucuucugcaua

SEQ ID NO: 273991 - RNA, 20 nt, Human
uaugaugaccacuuuccuaa

SEQ ID NO: 273992 - RNA, 20 nt, Human
uaugccccuaaaacaggagg

SEQ ID NO: 273993 - RNA, 19 nt, Human
uauguacaagacucuaugu

SEQ ID NO: 273994 - RNA, 20 nt, Human
ucaaagaaguuaggaaugaa

SEQ ID NO: 273995 - RNA, 19 nt, Human
ucacacagcaauagaaaac

SEQ ID NO: 273996 - RNA, 22 nt, Human
uccaugaaggaauguuguccug

SEQ ID NO: 273997 - RNA, 22 nt, Human
ucccaaugccacgcuaaacccc

SEQ ID NO: 273998 - RNA, 23 nt, Human
ucccaaugccacgcuaaaccccg

SEQ ID NO: 273999 - RNA, 19 nt, Human
ucccccaggccgggccucc

SEQ ID NO: 274000 - RNA, 23 nt, Human
uccccgugagcagaagagaaagc

SEQ ID NO: 274001 - RNA, 18 nt, Human
uccccugucucuugcacc

SEQ ID NO: 274002 - RNA, 21 nt, Human
uccccugucucuugcaccugg

SEQ ID NO: 274003 - RNA, 25 nt, Human
uccccugucucuugcaccuggguca

SEQ ID NO: 274004 - RNA, 18 nt, Human
ucccucuuccccugucuc

SEQ ID NO: 274005 - RNA, 21 nt, Human
ucuagggccuaucuuuucugg

SEQ ID NO: 274006 - RNA, 21 nt, Human
ucucuuacugccaauccugcc

SEQ ID NO: 274007 - RNA, 26 nt, Human
ucugaaugcauuuuuuuccugcugaa

SEQ ID NO: 274008 - RNA, 23 nt, Human
ugaaaauauguaauuuaugcuau

SEQ ID NO: 274009 - RNA, 24 nt, Human
ugaauuccgccaacaaccugaaug

SEQ ID NO: 274010 - RNA, 20 nt, Human
ugagaugagacaguacuccc

SEQ ID NO: 274011 - RNA, 21 nt, Human
ugagaugggcaguuauugccc

SEQ ID NO: 274012 - RNA, 21 nt, Human
ugagcuaaucauaugccccua

SEQ ID NO: 274013 - RNA, 19 nt, Human
ugagucagcugcaggucac

SEQ ID NO: 274014 - RNA, 19 nt, Human
ugccacgcuaaaccccgcg

SEQ ID NO: 274015 - RNA, 18 nt, Human
ugccacugcagccaaacc

SEQ ID NO: 274016 - RNA, 22 nt, Human
ugccacugcagccaaaccccaa

SEQ ID NO: 274017 - RNA, 23 nt, Human
ugccacugcagccaaaccccaac

SEQ ID NO: 274018 - RNA, 22 nt, Human
ugccagauauuuacaaauaaga

SEQ ID NO: 274019 - RNA, 18 nt, Human
uggaggaaccacccaaag

SEQ ID NO: 274020 - RNA, 19 nt, Human
uggaggaaccacccaaagc

SEQ ID NO: 274021 - RNA, 20 nt, Human
uggccuaaguccuguuuucu

SEQ ID NO: 274022 - RNA, 19 nt, Human
uggugccagugauuuuguc

SEQ ID NO: 274023 - RNA, 19 nt, Human
ugucacacagcaauagaaa

SEQ ID NO: 274024 - RNA, 22 nt, Human
uguccugccaacccuuauuuca

SEQ ID NO: 274025 - RNA, 18 nt, Human
ugugccagacucaugagc

SEQ ID NO: 274026 - RNA, 28 nt, Human
uucaaaguaaagauuaaaaaaaaaaacc

SEQ ID NO: 274027 - RNA, 21 nt, Human
uucaagggcacccucccucca

SEQ ID NO: 274028 - RNA, 24 nt, Human
uuggcaguuucugcuuggguucug

SEQ ID NO: 274029 - RNA, 25 nt, Human
uuugaaaaugccccucccacuuuca

SEQ ID NO: 274030 - RNA, 21 nt, Human
uuugaaguccauucuucacuc

SEQ ID NO: 274031 - RNA, 19 nt, Human
uuuguauucaguauccagu

SEQ ID NO: 274032 - RNA, 19 nt, Human
uuuuaaauucuucucccca

SEQ ID NO: 274033 - RNA, 18 nt, Human
aaacauaaauacgggugg

SEQ ID NO: 274034 - RNA, 22 nt, Human
aaacauaaauacgggugggugc

SEQ ID NO: 274035 - RNA, 23 nt, Human
aaucgccgccacaaacucucccg

SEQ ID NO: 274036 - RNA, 20 nt, Human
agagucagggagcuguugag

SEQ ID NO: 274037 - RNA, 20 nt, Human
agggagcuguugagguggga

SEQ ID NO: 274038 - RNA, 23 nt, Human
aggggacucagggucauguuggg

SEQ ID NO: 274039 - RNA, 25 nt, Human
caagaacaaacgcgcgugggacaga

SEQ ID NO: 274040 - RNA, 21 nt, Human
cagcagguagcgcugagcaca

SEQ ID NO: 274041 - RNA, 22 nt, Human
cagcgccaggugggcggcagaa

SEQ ID NO: 274042 - RNA, 19 nt, Human
caggagaggcgggaccagg

SEQ ID NO: 274043 - RNA, 22 nt, Human
ccaggggacucagggucauguu

SEQ ID NO: 274044 - RNA, 23 nt, Human
cccacggccccuggcagcuuccc

SEQ ID NO: 274045 - RNA, 21 nt, Human
ccccacgagagucagggagcu

SEQ ID NO: 274046 - RNA, 19 nt, Human
cccgcgcacccgucggcca

SEQ ID NO: 274047 - RNA, 19 nt, Human
cccgggcgcccggcccugg

SEQ ID NO: 274048 - RNA, 20 nt, Human
cccugcgugcccgagcucag

SEQ ID NO: 274049 - RNA, 20 nt, Human
ccgccgcccgcccgcgcacc

SEQ ID NO: 274050 - RNA, 22 nt, Human
ccgccgcccgcccgcgcacccg

SEQ ID NO: 274051 - RNA, 20 nt, Human
cggccccuggcagcuucccu

SEQ ID NO: 274052 - RNA, 21 nt, Human
cggccccuggcagcuucccug

SEQ ID NO: 274053 - RNA, 24 nt, Human
cgugcgcaagaacaaacgcgcgug

SEQ ID NO: 274054 - RNA, 21 nt, Human
cugcaggaucacucauugcac

SEQ ID NO: 274055 - RNA, 22 nt, Human
gaacaaacgcgcgugggacaga

SEQ ID NO: 274056 - RNA, 21 nt, Human
gcccgcgcacccgucggccag

SEQ ID NO: 274057 - RNA, 19 nt, Human
ggcagaaagcggcgcugcc

SEQ ID NO: 274058 - RNA, 21 nt, Human
ggcccgggcgcccggcccugg

SEQ ID NO: 274059 - RNA, 24 nt, Human
ggcggccagaucucaggcccugcg

SEQ ID NO: 274060 - RNA, 19 nt, Human
gggagcuguugagguggga

SEQ ID NO: 274061 - RNA, 22 nt, Human
gggcagcagguagcgcugagca

SEQ ID NO: 274062 - RNA, 23 nt, Human
gggcaggagaggcgggaccaggc

SEQ ID NO: 274063 - RNA, 21 nt, Human
gggugcgugggcgggcgacgg

SEQ ID NO: 274064 - RNA, 19 nt, Human
guuccaaccgggggugccc

SEQ ID NO: 274065 - RNA, 18 nt, Human
uaaucgccgccacaaacu

SEQ ID NO: 274066 - RNA, 24 nt, Human
uacagcaauagguaaaaacauaaa

SEQ ID NO: 274067 - RNA, 27 nt, Human
uacagcaauagguaaaaacauaaauac

SEQ ID NO: 274068 - RNA, 18 nt, Human
ucaggcccugcgugcccg

SEQ ID NO: 274069 - RNA, 23 nt, Human
ucagucccaguuccaaccggggg

SEQ ID NO: 274070 - RNA, 21 nt, Human
uccaaccgggggugcccaugg

SEQ ID NO: 274071 - RNA, 22 nt, Human
ucccugcauggugccgccgccc

SEQ ID NO: 274072 - RNA, 19 nt, Human
ucgcggaaugggcggccag

SEQ ID NO: 274073 - RNA, 24 nt, Human
ucucccgugcgcaagaacaaacgc

SEQ ID NO: 274074 - RNA, 22 nt, Human
ucuuacagcaauagguaaaaac

SEQ ID NO: 274075 - RNA, 21 nt, Human
ugaaugcaaaauccaggggac

SEQ ID NO: 274076 - RNA, 21 nt, Human
ugcacgcugcauaaucgccgc

SEQ ID NO: 274077 - RNA, 19 nt, Human
ugcgcaagaacaaacgcgc

SEQ ID NO: 274078 - RNA, 18 nt, Human
ugggacagaaaaaguucc

SEQ ID NO: 274079 - RNA, 23 nt, Human
ugggaucggucagggucgcgcca

SEQ ID NO: 274080 - RNA, 19 nt, Human
uugggagccccuucucccc

SEQ ID NO: 274081 - RNA, 23 nt, Human
uugggagccccuucuccccacga

SEQ ID NO: 274082 - RNA, 20 nt, Human
aagcauaaaaucuaacucug

SEQ ID NO: 274083 - RNA, 21 nt, Human
acccuggcgcccaaggagaug

SEQ ID NO: 274084 - RNA, 22 nt, Human
acccuggcgcccaaggagaugg

SEQ ID NO: 274085 - RNA, 23 nt, Human
agggggcucuggcacacgucccu

SEQ ID NO: 274086 - RNA, 22 nt, Human
aggugagggagggggcucuggc

SEQ ID NO: 274087 - RNA, 22 nt, Human
cagggacccuggcgcccaagga

SEQ ID NO: 274088 - RNA, 20 nt, Human
cugcagggaggcggacggag

SEQ ID NO: 274089 - RNA, 22 nt, Human
gaggaggggaaggaggcggggg

SEQ ID NO: 274090 - RNA, 19 nt, Human
gaggggaaggaggcggggg

SEQ ID NO: 274091 - RNA, 19 nt, Human
gaggggcggccgggacgcc

SEQ ID NO: 274092 - RNA, 19 nt, Human
gcgcgcuccaaagucgagg

SEQ ID NO: 274093 - RNA, 21 nt, Human
ggaaggaggcgggggcagggc

SEQ ID NO: 274094 - RNA, 20 nt, Human
ggagauggggcugcagggag

SEQ ID NO: 274095 - RNA, 18 nt, Human
ggaggggaaggaggcggg

SEQ ID NO: 274096 - RNA, 23 nt, Human
ggaggggaaggaggcgggggcag

SEQ ID NO: 274097 - RNA, 18 nt, Human
ggcucuggcacacguccc

SEQ ID NO: 274098 - RNA, 20 nt, Human
gggaaggaggcgggggcagg

SEQ ID NO: 274099 - RNA, 24 nt, Human
uacucuauuuuuuaaaaaaauaac

SEQ ID NO: 274100 - RNA, 19 nt, Human
uagccccaggugccgcccu

SEQ ID NO: 274101 - RNA, 20 nt, Human
uagccccaggugccgcccug

SEQ ID NO: 274102 - RNA, 20 nt, Human
ucggcuccggcccugcucca

SEQ ID NO: 274103 - RNA, 18 nt, Human
ucucuguuuauauaaaca

SEQ ID NO: 274104 - RNA, 21 nt, Human
uggagggaaggugagggaggg

SEQ ID NO: 274105 - RNA, 19 nt, Human
uggcacacgucccucgugu

SEQ ID NO: 274106 - RNA, 19 nt, Human
uggcagccgggauauuagc

SEQ ID NO: 274107 - RNA, 18 nt, Human
ugggaacggaggggcggc

SEQ ID NO: 274108 - RNA, 25 nt, Human
uuuuuaaaaaaauaacuugcuuccu

SEQ ID NO: 274109 - RNA, 19 nt, Human
uuuuuuuuuuuuacgagga

SEQ ID NO: 274110 - RNA, 21 nt, Human
uuuuuuuuuuuuuuuacgagg

SEQ ID NO: 274111 - RNA, 19 nt, Human
aaaaaacacauagaaaaau

SEQ ID NO: 274112 - RNA, 27 nt, Human
aaaaaggaacacaaaauuuuaaaagga

SEQ ID NO: 274113 - RNA, 19 nt, Human
aacacaguucccaaagcau

SEQ ID NO: 274114 - RNA, 21 nt, Human
aacagcagaaccaccagaagg

SEQ ID NO: 274115 - RNA, 22 nt, Human
aagagacucccaggccucagcg

SEQ ID NO: 274116 - RNA, 20 nt, Human
aagcaaaaacuugacgcuac

SEQ ID NO: 274117 - RNA, 18 nt, Human
aaggacagcccagauuuc

SEQ ID NO: 274118 - RNA, 20 nt, Human
aagugcuggaaaauaccacu

SEQ ID NO: 274119 - RNA, 19 nt, Human
aauggaaggacagcccaga

SEQ ID NO: 274120 - RNA, 21 nt, Human
acaaagugcuggaaaauacca

SEQ ID NO: 274121 - RNA, 22 nt, Human
acaaagugcuggaaaauaccac

SEQ ID NO: 274122 - RNA, 22 nt, Human
acacucauauguugcaaaaaac

SEQ ID NO: 274123 - RNA, 19 nt, Human
acagagagagccuuggcca

SEQ ID NO: 274124 - RNA, 23 nt, Human
acguaacagcagaaccaccagaa

SEQ ID NO: 274125 - RNA, 18 nt, Human
acuagcucuucagauguu

SEQ ID NO: 274126 - RNA, 18 nt, Human
acugggcuccccagggcc

SEQ ID NO: 274127 - RNA, 19 nt, Human
agacccuccuuaggccccu

SEQ ID NO: 274128 - RNA, 21 nt, Human
agccaauucagaaucugcccc

SEQ ID NO: 274129 - RNA, 25 nt, Human
agccagaagcaaaaacuugacgcua

SEQ ID NO: 274130 - RNA, 19 nt, Human
agguagccagaagcaaaaa

SEQ ID NO: 274131 - RNA, 18 nt, Human
aguugauauucagugaca

SEQ ID NO: 274132 - RNA, 21 nt, Human
auaaaaaaaugcaacagcccc

SEQ ID NO: 274133 - RNA, 23 nt, Human
auggggugaaauuggccaacuuu

SEQ ID NO: 274134 - RNA, 24 nt, Human
auugcagugguuugacucauggcu

SEQ ID NO: 274135 - RNA, 22 nt, Human
auuuuaaaaggagggaaggaag

SEQ ID NO: 274136 - RNA, 22 nt, Human
caacaguagagacugggucuug

SEQ ID NO: 274137 - RNA, 22 nt, Human
cacaaaccaaguaauuuuaaac

SEQ ID NO: 274138 - RNA, 22 nt, Human
cagccagacuaaaaaucuggac

SEQ ID NO: 274139 - RNA, 21 nt, Human
caggauacaguauauaugaua

SEQ ID NO: 274140 - RNA, 19 nt, Human
caguagagacugggucuug

SEQ ID NO: 274141 - RNA, 20 nt, Human
cauccaaaaucauacaaagu

SEQ ID NO: 274142 - RNA, 20 nt, Human
ccaauaccucuuaccuccuc

SEQ ID NO: 274143 - RNA, 23 nt, Human
ccagacuaaaaaucuggacuaaa

SEQ ID NO: 274144 - RNA, 21 nt, Human
ccagggccuaggcugccuucu

SEQ ID NO: 274145 - RNA, 18 nt, Human
ccaugcaaauaugugcug

SEQ ID NO: 274146 - RNA, 19 nt, Human
ccaugcaaauaugugcuga

SEQ ID NO: 274147 - RNA, 24 nt, Human
cccaaaccacagaaaaugggguga

SEQ ID NO: 274148 - RNA, 19 nt, Human
cccaaagcauuuggacagu

SEQ ID NO: 274149 - RNA, 19 nt, Human
cccaugagcccuccacugg

SEQ ID NO: 274150 - RNA, 20 nt, Human
ccccagggccuaggcugccu

SEQ ID NO: 274151 - RNA, 24 nt, Human
ccccuagcagcaguguggagaccc

SEQ ID NO: 274152 - RNA, 18 nt, Human
cccuccacuggacagcuc

SEQ ID NO: 274153 - RNA, 18 nt, Human
ccuagcagcaguguggag

SEQ ID NO: 274154 - RNA, 25 nt, Human
ccucccacccaucucccccuuccaa

SEQ ID NO: 274155 - RNA, 24 nt, Human
ccucuuaccuccucugcaugcaaa

SEQ ID NO: 274156 - RNA, 20 nt, Human
ccugcgccuucauucugcgc

SEQ ID NO: 274157 - RNA, 20 nt, Human
ccuggcccggcccucccucu

SEQ ID NO: 274158 - RNA, 20 nt, Human
ccugguuguccuuucuccug

SEQ ID NO: 274159 - RNA, 22 nt, Human
cguaacagcagaaccaccagaa

SEQ ID NO: 274160 - RNA, 22 nt, Human
cucccaggccucagcguaccuc

SEQ ID NO: 274161 - RNA, 20 nt, Human
cuccccucuaccagcucacc

SEQ ID NO: 274162 - RNA, 23 nt, Human
cugggucuugcucguugcccagg

SEQ ID NO: 274163 - RNA, 20 nt, Human
cuugcucccugaccuuggcc

SEQ ID NO: 274164 - RNA, 20 nt, Human
cuugcucguugcccaggcug

SEQ ID NO: 274165 - RNA, 20 nt, Human
gaaccauccaauucaccugg

SEQ ID NO: 274166 - RNA, 24 nt, Human
gaguugcagaacagaauccuuggg

SEQ ID NO: 274167 - RNA, 23 nt, Human
gaucauaaugguugucaccugag

SEQ ID NO: 274168 - RNA, 18 nt, Human
gcaucuuguucuauuugg

SEQ ID NO: 274169 - RNA, 21 nt, Human
gcccggcccucccucuugcag

SEQ ID NO: 274170 - RNA, 20 nt, Human
gcugcaaaaaggaacacaaa

SEQ ID NO: 274171 - RNA, 18 nt, Human
gcuguguucuucccucug

SEQ ID NO: 274172 - RNA, 20 nt, Human
gggaaagcaagauggauuca

SEQ ID NO: 274173 - RNA, 21 nt, Human
gggucuugcucguugcccagg

SEQ ID NO: 274174 - RNA, 22 nt, Human
gucccacccaugagcccuccac

SEQ ID NO: 274175 - RNA, 24 nt, Human
gucuugcucguugcccaggcugga

SEQ ID NO: 274176 - RNA, 20 nt, Human
guguggagacccuccuuagg

SEQ ID NO: 274177 - RNA, 22 nt, Human
uaaaaaucuggacuaaaaugaa

SEQ ID NO: 274178 - RNA, 21 nt, Human
uaaauucuccagcccaaggga

SEQ ID NO: 274179 - RNA, 19 nt, Human
uaacagcagaaccaccaga

SEQ ID NO: 274180 - RNA, 19 nt, Human
uacagcuugucuuaaaauc

SEQ ID NO: 274181 - RNA, 24 nt, Human
uacagggacagagagagccuuggc

SEQ ID NO: 274182 - RNA, 24 nt, Human
uacaguauauaugauagccugaaa

SEQ ID NO: 274183 - RNA, 21 nt, Human
uagccagaagcaaaaacuuga

SEQ ID NO: 274184 - RNA, 23 nt, Human
uagccuuuuccugcaaaaggcuc

SEQ ID NO: 274185 - RNA, 20 nt, Human
uaggccccugucuuggacaa

SEQ ID NO: 274186 - RNA, 27 nt, Human
uaugauagccugaaaacuccaggaaac

SEQ ID NO: 274187 - RNA, 18 nt, Human
uauuccaaggccaacagg

SEQ ID NO: 274188 - RNA, 21 nt, Human
ucaaacagguagccagaagca

SEQ ID NO: 274189 - RNA, 19 nt, Human
ucacucagucccuugcuuu

SEQ ID NO: 274190 - RNA, 20 nt, Human
uccaauggggaaagcaagau

SEQ ID NO: 274191 - RNA, 21 nt, Human
ucccacccaucucccccuucc

SEQ ID NO: 274192 - RNA, 20 nt, Human
uccccagggccuaggcugcc

SEQ ID NO: 274193 - RNA, 23 nt, Human
ucuccuguuagguuugcucuuuc

SEQ ID NO: 274194 - RNA, 18 nt, Human
ucuggacuaaaaugaagc

SEQ ID NO: 274195 - RNA, 21 nt, Human
ucuugcucguugcccaggcug

SEQ ID NO: 274196 - RNA, 22 nt, Human
ucuugcucguugcccaggcugg

SEQ ID NO: 274197 - RNA, 23 nt, Human
ucuugcucguugcccaggcugga

SEQ ID NO: 274198 - RNA, 21 nt, Human
ugaaagaauuaaauucagagg

SEQ ID NO: 274199 - RNA, 19 nt, Human
ugaaauguguaacccuugc

SEQ ID NO: 274200 - RNA, 21 nt, Human
ugaccuuggccccuugugcuu

SEQ ID NO: 274201 - RNA, 20 nt, Human
ugacuaaacuucaagucacc

SEQ ID NO: 274202 - RNA, 26 nt, Human
ugagacacccuggggaagggggaguc

SEQ ID NO: 274203 - RNA, 21 nt, Human
ugauucuaaauucuccagccc

SEQ ID NO: 274204 - RNA, 23 nt, Human
ugauuuucccucucuccccuuca

SEQ ID NO: 274205 - RNA, 19 nt, Human
ugcaaaaaggaacacaaaa

SEQ ID NO: 274206 - RNA, 23 nt, Human
ugcagugguuugacucauggcuc

SEQ ID NO: 274207 - RNA, 18 nt, Human
ugcccaggcuggauugca

SEQ ID NO: 274208 - RNA, 24 nt, Human
ugcucccugaccuuggccccuugu

SEQ ID NO: 274209 - RNA, 23 nt, Human
ugcucguugcccaggcuggauug

SEQ ID NO: 274210 - RNA, 20 nt, Human
uggacugggcuccccagggc

SEQ ID NO: 274211 - RNA, 23 nt, Human
uggggagacggaaaaaaaaaaaa

SEQ ID NO: 274212 - RNA, 22 nt, Human
ugggucuugcucguugcccagg

SEQ ID NO: 274213 - RNA, 22 nt, Human
uggguuaaugacuaguuccaau

SEQ ID NO: 274214 - RNA, 18 nt, Human
uguagagaacccaaacua

SEQ ID NO: 274215 - RNA, 20 nt, Human
uguuguguuuuagaaugguu

SEQ ID NO: 274216 - RNA, 18 nt, Human
uuaaaaggagggaaggaa

SEQ ID NO: 274217 - RNA, 24 nt, Human
uucaaacagguagccagaagcaaa

SEQ ID NO: 274218 - RNA, 23 nt, Human
uucauuuuuuucuaaugucuccc

SEQ ID NO: 274219 - RNA, 18 nt, Human
uuccaaggccaacaggag

SEQ ID NO: 274220 - RNA, 19 nt, Human
uucuccuggcccggcccuc

SEQ ID NO: 274221 - RNA, 25 nt, Human
uugcccaggcuggauugcagugguu

SEQ ID NO: 274222 - RNA, 25 nt, Human
uugcucccugaccuuggccccuugu

SEQ ID NO: 274223 - RNA, 22 nt, Human
uuggagacuauuugccccucuc

SEQ ID NO: 274224 - RNA, 24 nt, Human
uuggugugcacaccucuugcuccc

SEQ ID NO: 274225 - RNA, 19 nt, Human
uuuccuuuuucuuagccuu

SEQ ID NO: 274226 - RNA, 23 nt, Human
aaaaaaacacagcaacuuauaga

SEQ ID NO: 274227 - RNA, 23 nt, Human
aaaaacuggugaaaauuaucuga

SEQ ID NO: 274228 - RNA, 21 nt, Human
aaaaagaguaacugaaaagaa

SEQ ID NO: 274229 - RNA, 21 nt, Human
aaaauccuccagauguugacu

SEQ ID NO: 274230 - RNA, 26 nt, Human
aacaaaaaaacacagcaacuuauaga

SEQ ID NO: 274231 - RNA, 20 nt, Human
aacauuuugucaugcagcau

SEQ ID NO: 274232 - RNA, 24 nt, Human
aacggcuccaaauaaaaacuggug

SEQ ID NO: 274233 - RNA, 20 nt, Human
aagaaagacaaaacagcaau

SEQ ID NO: 274234 - RNA, 20 nt, Human
accacgauccagaauccugg

SEQ ID NO: 274235 - RNA, 18 nt, Human
acugcaguuaguuuguca

SEQ ID NO: 274236 - RNA, 24 nt, Human
acuucaccuuaccaaaaggaacaa

SEQ ID NO: 274237 - RNA, 22 nt, Human
agaaagacaaaacagcaauaaa

SEQ ID NO: 274238 - RNA, 20 nt, Human
agaguaacaaaaaaacacag

SEQ ID NO: 274239 - RNA, 18 nt, Human
agaugcaaccacgaucca

SEQ ID NO: 274240 - RNA, 25 nt, Human
agauguugacucuccuagguucugu

SEQ ID NO: 274241 - RNA, 20 nt, Human
agcugaaaugguccaaguau

SEQ ID NO: 274242 - RNA, 26 nt, Human
aggaacaaaauacagaguaacaaaaa

SEQ ID NO: 274243 - RNA, 27 nt, Human
aggaacaaaauacagaguaacaaaaaa

SEQ ID NO: 274244 - RNA, 21 nt, Human
aguauucaccacuauaccuau

SEQ ID NO: 274245 - RNA, 20 nt, Human
auaaaaacuggugaaaauua

SEQ ID NO: 274246 - RNA, 22 nt, Human
auacagaguaacaaaaaaacac

SEQ ID NO: 274247 - RNA, 20 nt, Human
aucaaagaacucagaacuau

SEQ ID NO: 274248 - RNA, 18 nt, Human
aucugaaaaaauguaaaa

SEQ ID NO: 274249 - RNA, 20 nt, Human
augugcucuuuaaguccauc

SEQ ID NO: 274250 - RNA, 23 nt, Human
caaaaggaacaaaauacagagua

SEQ ID NO: 274251 - RNA, 18 nt, Human
cacacaaugaccagugac

SEQ ID NO: 274252 - RNA, 24 nt, Human
cacacaaugaccagugacauggcc

SEQ ID NO: 274253 - RNA, 26 nt, Human
cacacaaugaccagugacauggccaa

SEQ ID NO: 274254 - RNA, 19 nt, Human
cacccccccccuccuuuuu

SEQ ID NO: 274255 - RNA, 25 nt, Human
cagaacaauugcuucaagcaauuga

SEQ ID NO: 274256 - RNA, 21 nt, Human
cagaauccuggggacccaaag

SEQ ID NO: 274257 - RNA, 22 nt, Human
cagaguaacaaaaaaacacagc

SEQ ID NO: 274258 - RNA, 22 nt, Human
cagugagaaagauaagugaugu

SEQ ID NO: 274259 - RNA, 19 nt, Human
caucugaaaaaauguaaaa

SEQ ID NO: 274260 - RNA, 23 nt, Human
caugaaagacuguugcaaguaac

SEQ ID NO: 274261 - RNA, 18 nt, Human
ccacggacacuucuaaaa

SEQ ID NO: 274262 - RNA, 22 nt, Human
ccagaauccuggggacccaaag

SEQ ID NO: 274263 - RNA, 19 nt, Human
ccccaguuuugcacccccc

SEQ ID NO: 274264 - RNA, 18 nt, Human
ccgcaaccccaguuuugc

SEQ ID NO: 274265 - RNA, 22 nt, Human
cgagaaaagcucugaaagaucu

SEQ ID NO: 274266 - RNA, 22 nt, Human
cuaaaauccuccagauguugac

SEQ ID NO: 274267 - RNA, 19 nt, Human
cucagcaagauaaauccac

SEQ ID NO: 274268 - RNA, 18 nt, Human
cuccuagguucuguaucu

SEQ ID NO: 274269 - RNA, 21 nt, Human
cuuauaaacuaucaaaauugc

SEQ ID NO: 274270 - RNA, 22 nt, Human
gaaaaagaguaacugaaaagaa

SEQ ID NO: 274271 - RNA, 19 nt, Human
gacuguauaaugguagaau

SEQ ID NO: 274272 - RNA, 25 nt, Human
gauaaauccacagagggagcccccu

SEQ ID NO: 274273 - RNA, 21 nt, Human
gauccucuaccacauguccaa

SEQ ID NO: 274274 - RNA, 19 nt, Human
gauugauccuuuuuucucu

SEQ ID NO: 274275 - RNA, 22 nt, Human
gcauugacugcagauuucucuc

SEQ ID NO: 274276 - RNA, 22 nt, Human
gccgucaaauucaagcugaaau

SEQ ID NO: 274277 - RNA, 23 nt, Human
gcuuaaucagcagcacagccacc

SEQ ID NO: 274278 - RNA, 24 nt, Human
ggacacacuucaccuuaccaaaag

SEQ ID NO: 274279 - RNA, 21 nt, Human
ggagcccccucaucuuucccu

SEQ ID NO: 274280 - RNA, 22 nt, Human
gggcauugacugcagauuucuc

SEQ ID NO: 274281 - RNA, 23 nt, Human
gggcauugacugcagauuucucu

SEQ ID NO: 274282 - RNA, 23 nt, Human
guaaauuccagugaaugaaccuc

SEQ ID NO: 274283 - RNA, 21 nt, Human
guuguacucuacugagauugc

SEQ ID NO: 274284 - RNA, 23 nt, Human
guuuaaaaucacacauaugugua

SEQ ID NO: 274285 - RNA, 26 nt, Human
uaaaauccuccagauguugacucucc

SEQ ID NO: 274286 - RNA, 19 nt, Human
uaaaaucuucuuuagguuc

SEQ ID NO: 274287 - RNA, 20 nt, Human
uaaacauuuugucaugcagc

SEQ ID NO: 274288 - RNA, 25 nt, Human
uaaaucaaagaacucagaacuauaa

SEQ ID NO: 274289 - RNA, 19 nt, Human
uaaauccacagagggagcc

SEQ ID NO: 274290 - RNA, 19 nt, Human
uaacaaaaaaacacagcaa

SEQ ID NO: 274291 - RNA, 20 nt, Human
uaagcauccgcaaccccagu

SEQ ID NO: 274292 - RNA, 23 nt, Human
uacagaguaacaaaaaaacacag

SEQ ID NO: 274293 - RNA, 18 nt, Human
uacucuacugagauugcg

SEQ ID NO: 274294 - RNA, 21 nt, Human
uacuuuugccccuuaaaaucu

SEQ ID NO: 274295 - RNA, 18 nt, Human
ucacauaauauuccuccu

SEQ ID NO: 274296 - RNA, 19 nt, Human
ucagcaagauaaauccaca

SEQ ID NO: 274297 - RNA, 22 nt, Human
ucauuuuuuucaaaacccccaa

SEQ ID NO: 274298 - RNA, 23 nt, Human
uccacagagggagcccccucauc

SEQ ID NO: 274299 - RNA, 21 nt, Human
ucucuuauaaaucaaauccag

SEQ ID NO: 274300 - RNA, 22 nt, Human
ugaaaaaguaucauucagaaca

SEQ ID NO: 274301 - RNA, 25 nt, Human
ugaaaagaacauuaaaaacaggaaa

SEQ ID NO: 274302 - RNA, 22 nt, Human
ugagaaagacuguauaauggua

SEQ ID NO: 274303 - RNA, 23 nt, Human
ugagagagaaaguauuuaucagg

SEQ ID NO: 274304 - RNA, 22 nt, Human
ugaggcaaacguauuuauaucc

SEQ ID NO: 274305 - RNA, 22 nt, Human
ugaguaaauuccagugaaugaa

SEQ ID NO: 274306 - RNA, 18 nt, Human
ugauauguauauucacau

SEQ ID NO: 274307 - RNA, 21 nt, Human
ugcaggucuauaucccucagc

SEQ ID NO: 274308 - RNA, 23 nt, Human
ugccaauugauggaggaagcuuc

SEQ ID NO: 274309 - RNA, 21 nt, Human
ugguaaacaacagggggauga

SEQ ID NO: 274310 - RNA, 24 nt, Human
ugguguuccacaugccuaauucca

SEQ ID NO: 274311 - RNA, 23 nt, Human
uguaagaaagacuaaaauccucc

SEQ ID NO: 274312 - RNA, 18 nt, Human
uuaagcauccgcaacccc

SEQ ID NO: 274313 - RNA, 25 nt, Human
uuagcaguguggcaagagugggcau

SEQ ID NO: 274314 - RNA, 20 nt, Human
uuauauccacuugagaaaga

SEQ ID NO: 274315 - RNA, 19 nt, Human
uucagacauaguucuuucc

SEQ ID NO: 274316 - RNA, 22 nt, Human
uucauuuuuuucaaaaccccca

SEQ ID NO: 274317 - RNA, 28 nt, Human
uuccagugaaugaaccucaggguacccc

SEQ ID NO: 274318 - RNA, 22 nt, Human
uuccccggucccuuugcaauga

SEQ ID NO: 274319 - RNA, 24 nt, Human
uugcuuuaagcauccgcaacccca

SEQ ID NO: 274320 - RNA, 19 nt, Human
uuguacucuacugagauug

SEQ ID NO: 274321 - RNA, 21 nt, Human
uuguacucuacugagauugcg

SEQ ID NO: 274322 - RNA, 21 nt, Human
uuucacacaaugaccagugac

SEQ ID NO: 274323 - RNA, 24 nt, Human
uuugcacccccccccuccuuuuuu

SEQ ID NO: 274324 - RNA, 22 nt, Human
aacauguuuccgguccccucca

SEQ ID NO: 274325 - RNA, 23 nt, Human
acaccgcgcacucgcccguaggc

SEQ ID NO: 274326 - RNA, 25 nt, Human
acagcaucacaggcuucuucccagg

SEQ ID NO: 274327 - RNA, 24 nt, Human
acaggcagcaugauggcgggcagc

SEQ ID NO: 274328 - RNA, 18 nt, Human
accgcagcuccugccgcc

SEQ ID NO: 274329 - RNA, 21 nt, Human
acgagcuccagccagaaggcc

SEQ ID NO: 274330 - RNA, 21 nt, Human
acugcacgacggggcccagga

SEQ ID NO: 274331 - RNA, 19 nt, Human
agcuggaaauggcggugcc

SEQ ID NO: 274332 - RNA, 21 nt, Human
aggcacccacggccacgguga

SEQ ID NO: 274333 - RNA, 18 nt, Human
aggcagcaugauggcggg

SEQ ID NO: 274334 - RNA, 21 nt, Human
aggcaggcgcguggugguggu

SEQ ID NO: 274335 - RNA, 19 nt, Human
aggcagggcgcagagccuc

SEQ ID NO: 274336 - RNA, 23 nt, Human
aggcaggguggcaggcggcgggg

SEQ ID NO: 274337 - RNA, 24 nt, Human
aggccccugccccggaaccaaaga

SEQ ID NO: 274338 - RNA, 18 nt, Human
aggcggccagcgcguggc

SEQ ID NO: 274339 - RNA, 21 nt, Human
aggcgggcggcaggguggugg

SEQ ID NO: 274340 - RNA, 24 nt, Human
aggcgggcggcagggugguggcgu

SEQ ID NO: 274341 - RNA, 22 nt, Human
agguugacgcaggaggccccug

SEQ ID NO: 274342 - RNA, 21 nt, Human
agucgggcgggcaggcagggc

SEQ ID NO: 274343 - RNA, 21 nt, Human
caaaggccaggauguugagga

SEQ ID NO: 274344 - RNA, 23 nt, Human
caagagaggcacaucguccggug

SEQ ID NO: 274345 - RNA, 25 nt, Human
caaugacguugccauaggguacccc

SEQ ID NO: 274346 - RNA, 18 nt, Human
cacagcuucagcacuguc

SEQ ID NO: 274347 - RNA, 22 nt, Human
cacagcuucagcacuguccucu

SEQ ID NO: 274348 - RNA, 19 nt, Human
caccaccgggaagcgcucc

SEQ ID NO: 274349 - RNA, 23 nt, Human
caccgggaagcgcuccucgccga

SEQ ID NO: 274350 - RNA, 24 nt, Human
cacgacggggcccaggaucucguu

SEQ ID NO: 274351 - RNA, 23 nt, Human
cacggcccgcggcggggagcagg

SEQ ID NO: 274352 - RNA, 22 nt, Human
cacugagccagcgcagggccug

SEQ ID NO: 274353 - RNA, 18 nt, Human
cacuguccucucggucac

SEQ ID NO: 274354 - RNA, 18 nt, Human
cagagccucggcaggguc

SEQ ID NO: 274355 - RNA, 25 nt, Human
cagcgccccgugcagguucugcggg

SEQ ID NO: 274356 - RNA, 23 nt, Human
cagcuccugccgccggucccgcu

SEQ ID NO: 274357 - RNA, 24 nt, Human
caggaggccccugccccggaacca

SEQ ID NO: 274358 - RNA, 22 nt, Human
caucacaggcuucuucccaggg

SEQ ID NO: 274359 - RNA, 25 nt, Human
ccacagcuucagcacuguccucucg

SEQ ID NO: 274360 - RNA, 28 nt, Human
ccacagcuucagcacuguccucucgacc

SEQ ID NO: 274361 - RNA, 21 nt, Human
ccaccaggcacgccagagccu

SEQ ID NO: 274362 - RNA, 20 nt, Human
ccaccuuggcugccagcagc

SEQ ID NO: 274363 - RNA, 18 nt, Human
ccagcucccgggagggcu

SEQ ID NO: 274364 - RNA, 19 nt, Human
cccacggccacggugacgc

SEQ ID NO: 274365 - RNA, 21 nt, Human
cccacggccacggugacgcuc

SEQ ID NO: 274366 - RNA, 23 nt, Human
cccaggccggggccgcccggggc

SEQ ID NO: 274367 - RNA, 22 nt, Human
cccgcggcggggagcagggggc

SEQ ID NO: 274368 - RNA, 19 nt, Human
cccuugggccgggcucggg

SEQ ID NO: 274369 - RNA, 20 nt, Human
ccgaggcugccgaggcccag

SEQ ID NO: 274370 - RNA, 22 nt, Human
ccuccauguaggagccgccaug

SEQ ID NO: 274371 - RNA, 22 nt, Human
ccugcggcaccggcugguuggg

SEQ ID NO: 274372 - RNA, 23 nt, Human
ccugguccaccagcucccgggag

SEQ ID NO: 274373 - RNA, 18 nt, Human
cgaugugguagcgggcag

SEQ ID NO: 274374 - RNA, 20 nt, Human
cgccauggagaaacagcauc

SEQ ID NO: 274375 - RNA, 21 nt, Human
cgcccaagaacugcacgacgg

SEQ ID NO: 274376 - RNA, 21 nt, Human
cgcccccaaagugggcgaugu

SEQ ID NO: 274377 - RNA, 19 nt, Human
cgccccgacgccaccaccc

SEQ ID NO: 274378 - RNA, 21 nt, Human
cgcccguaggccguguucacc

SEQ ID NO: 274379 - RNA, 27 nt, Human
cgcgguaguugucacgcacgcguggug

SEQ ID NO: 274380 - RNA, 21 nt, Human
cggcuggaagcggcgggcgcc

SEQ ID NO: 274381 - RNA, 23 nt, Human
cggggccgcccggggcgccgccg

SEQ ID NO: 274382 - RNA, 18 nt, Human
cgugugcagguugugcag

SEQ ID NO: 274383 - RNA, 23 nt, Human
cucgggcucgggaggcagggugg

SEQ ID NO: 274384 - RNA, 21 nt, Human
cucggucacagcccaccuugg

SEQ ID NO: 274385 - RNA, 18 nt, Human
cugaauggugggagagga

SEQ ID NO: 274386 - RNA, 18 nt, Human
cugguggcagcucacggc

SEQ ID NO: 274387 - RNA, 21 nt, Human
cugguucugcacguagguggc

SEQ ID NO: 274388 - RNA, 20 nt, Human
cuguccucucggucacagcc

SEQ ID NO: 274389 - RNA, 19 nt, Human
gaccagcuggaaauggcgg

SEQ ID NO: 274390 - RNA, 23 nt, Human
gagcguggcuacaaugacguugc

SEQ ID NO: 274391 - RNA, 20 nt, Human
gcacuguccucucggucaca

SEQ ID NO: 274392 - RNA, 18 nt, Human
gcgauguuuucacugagc

SEQ ID NO: 274393 - RNA, 19 nt, Human
gcuggaagcggcgggcgcc

SEQ ID NO: 274394 - RNA, 21 nt, Human
ggcccuugggccgggcucggg

SEQ ID NO: 274395 - RNA, 18 nt, Human
ggcggcguggcguagggc

SEQ ID NO: 274396 - RNA, 21 nt, Human
gggagcagggggcccccacca

SEQ ID NO: 274397 - RNA, 20 nt, Human
gggaggcaggcgcguggugg

SEQ ID NO: 274398 - RNA, 19 nt, Human
gggcggcagggugguggcg

SEQ ID NO: 274399 - RNA, 19 nt, Human
gggcgggcaggcagggcgc

SEQ ID NO: 274400 - RNA, 22 nt, Human
ggugauacgcucggggucgccc

SEQ ID NO: 274401 - RNA, 21 nt, Human
gguggugaagagcuccgugug

SEQ ID NO: 274402 - RNA, 21 nt, Human
ggugguggcguugcgcacgcc

SEQ ID NO: 274403 - RNA, 19 nt, Human
gguguggaugaacuuggua

SEQ ID NO: 274404 - RNA, 23 nt, Human
gugcugagaaaaccgagcacccc

SEQ ID NO: 274405 - RNA, 18 nt, Human
guggugguggugaagagc

SEQ ID NO: 274406 - RNA, 22 nt, Human
uagagggcagcaaaggccagga

SEQ ID NO: 274407 - RNA, 20 nt, Human
uaguagagggcagcaaaggc

SEQ ID NO: 274408 - RNA, 18 nt, Human
uccaccagcucccgggag

SEQ ID NO: 274409 - RNA, 21 nt, Human
uccaccagcucccgggagggc

SEQ ID NO: 274410 - RNA, 18 nt, Human
uccccggggaagcgguca

SEQ ID NO: 274411 - RNA, 23 nt, Human
ucccgugaguccccggggaagcg

SEQ ID NO: 274412 - RNA, 24 nt, Human
ucccgugaguccccggggaagcgg

SEQ ID NO: 274413 - RNA, 21 nt, Human
uccucggugggcacguagagg

SEQ ID NO: 274414 - RNA, 23 nt, Human
ugagaaaaccgagcaccccaaga

SEQ ID NO: 274415 - RNA, 19 nt, Human
ugaggaagaggagggaggc

SEQ ID NO: 274416 - RNA, 20 nt, Human
ugauggcgggcagcgccccc

SEQ ID NO: 274417 - RNA, 20 nt, Human
ugcagguucugcgggcaggc

SEQ ID NO: 274418 - RNA, 21 nt, Human
ugcagguugugcaggugggaa

SEQ ID NO: 274419 - RNA, 18 nt, Human
ugcccggggcgccagcgg

SEQ ID NO: 274420 - RNA, 21 nt, Human
ugcccggggcgccagcggggg

SEQ ID NO: 274421 - RNA, 24 nt, Human
uggaagcggcgggcgcccagggga

SEQ ID NO: 274422 - RNA, 20 nt, Human
uggcaggcggcgggggccgg

SEQ ID NO: 274423 - RNA, 21 nt, Human
uggggcacgagcuccagccag

SEQ ID NO: 274424 - RNA, 22 nt, Human
ugguccaccagcucccgggagg

SEQ ID NO: 274425 - RNA, 23 nt, Human
ugguugggguccccagucuuggc

SEQ ID NO: 274426 - RNA, 19 nt, Human
ugugguagcgggcaggcug

SEQ ID NO: 274427 - RNA, 23 nt, Human
uguugaggaagaggagggaggca

SEQ ID NO: 274428 - RNA, 18 nt, Human
uucaccaccgggaagcgc

SEQ ID NO: 274429 - RNA, 18 nt, Human
uugcuccacaccaccucc

SEQ ID NO: 274430 - RNA, 20 nt, Human
aaaaaaaaaaaaaaaccaac

SEQ ID NO: 274431 - RNA, 33 nt, Human
aaaaaaaaaaaaaaccaacaacaacaaaaaaga

SEQ ID NO: 274432 - RNA, 18 nt, Human
aaaaaaaaaaccaacaac

SEQ ID NO: 274433 - RNA, 24 nt, Human
aaaaaaaaccaacaacaacaaaaa

SEQ ID NO: 274434 - RNA, 20 nt, Human
aaaaaaccaacaacaacaaa

SEQ ID NO: 274435 - RNA, 23 nt, Human
aaaaaaccaacaacaacaaaaaa

SEQ ID NO: 274436 - RNA, 24 nt, Human
aaaaagaaaaaucaacaaaacaag

SEQ ID NO: 274437 - RNA, 24 nt, Human
aaaacaagacccagaaaaaagacc

SEQ ID NO: 274438 - RNA, 23 nt, Human
aacaacaacaaaaaacaccgccu

SEQ ID NO: 274439 - RNA, 24 nt, Human
aagaaaaaucaacaaaacaagacc

SEQ ID NO: 274440 - RNA, 20 nt, Human
aagagaggccgaaggcgagc

SEQ ID NO: 274441 - RNA, 18 nt, Human
acaaaacaagacccagaa

SEQ ID NO: 274442 - RNA, 18 nt, Human
acaaaagacuguaaagaa

SEQ ID NO: 274443 - RNA, 19 nt, Human
acaaaagacuguaaagaaa

SEQ ID NO: 274444 - RNA, 20 nt, Human
acccgaauccccgagaucag

SEQ ID NO: 274445 - RNA, 21 nt, Human
agacaggccuguuccccgggc

SEQ ID NO: 274446 - RNA, 22 nt, Human
agacuccagggucacagcauca

SEQ ID NO: 274447 - RNA, 21 nt, Human
agagaccuucgggccugaagc

SEQ ID NO: 274448 - RNA, 21 nt, Human
agagagaccuucgggccugaa

SEQ ID NO: 274449 - RNA, 21 nt, Human
agagagcaggucguccaagca

SEQ ID NO: 274450 - RNA, 25 nt, Human
agagagcaggucguccaagcaccac

SEQ ID NO: 274451 - RNA, 24 nt, Human
agccccuuucuccuuccaccccau

SEQ ID NO: 274452 - RNA, 20 nt, Human
aggccgaaggcgagcaccaa

SEQ ID NO: 274453 - RNA, 22 nt, Human
aggccgaaggcgagcaccaagg

SEQ ID NO: 274454 - RNA, 23 nt, Human
auauaugugugugugugugugug

SEQ ID NO: 274455 - RNA, 18 nt, Human
augcuguuggccuuuggg

SEQ ID NO: 274456 - RNA, 27 nt, Human
caacaaaacaagacccagaaaaaagaa

SEQ ID NO: 274457 - RNA, 20 nt, Human
caacaacaaaaaacaccgcc

SEQ ID NO: 274458 - RNA, 21 nt, Human
caacaacaacaaaaaacaccg

SEQ ID NO: 274459 - RNA, 24 nt, Human
caacaacaacaaaaaacaccgccu

SEQ ID NO: 274460 - RNA, 20 nt, Human
caagacccagaaaaaagacc

SEQ ID NO: 274461 - RNA, 22 nt, Human
caagacccagaaaaaagaccaa

SEQ ID NO: 274462 - RNA, 24 nt, Human
caagagaggccgaaggcgagcacc

SEQ ID NO: 274463 - RNA, 19 nt, Human
cacagcaucagcccaauag

SEQ ID NO: 274464 - RNA, 23 nt, Human
caccaaaucuaaggucaccuggu

SEQ ID NO: 274465 - RNA, 21 nt, Human
cacccugcaggcucugcagcc

SEQ ID NO: 274466 - RNA, 18 nt, Human
caccuggucuggccaggc

SEQ ID NO: 274467 - RNA, 19 nt, Human
cacugacuugaaccucaaa

SEQ ID NO: 274468 - RNA, 21 nt, Human
caguuccaagagaggccgaag

SEQ ID NO: 274469 - RNA, 23 nt, Human
cauauaugugugugugugugugu

SEQ ID NO: 274470 - RNA, 26 nt, Human
ccacagcuucagaaaggggggaacgc

SEQ ID NO: 274471 - RNA, 22 nt, Human
ccagaaaaaagaccaaguccug

SEQ ID NO: 274472 - RNA, 19 nt, Human
cccagcaauguagagagca

SEQ ID NO: 274473 - RNA, 24 nt, Human
cccauggucuugcuuaaaucuguu

SEQ ID NO: 274474 - RNA, 23 nt, Human
ccccaagggcagaggcaaaaccc

SEQ ID NO: 274475 - RNA, 22 nt, Human
ccccuuucuccuuccaccccau

SEQ ID NO: 274476 - RNA, 20 nt, Human
cccuacgacccuccagcucc

SEQ ID NO: 274477 - RNA, 21 nt, Human
ccgcacccgaauccccgagau

SEQ ID NO: 274478 - RNA, 24 nt, Human
ccuacgacccuccagcuccaucca

SEQ ID NO: 274479 - RNA, 18 nt, Human
ccuagagccagagagacc

SEQ ID NO: 274480 - RNA, 27 nt, Human
ccuccagcuccauccagugcuagcccc

SEQ ID NO: 274481 - RNA, 23 nt, Human
ccugaagcccucccuuccagagg

SEQ ID NO: 274482 - RNA, 20 nt, Human
ccuuuuugaaagagaaauga

SEQ ID NO: 274483 - RNA, 22 nt, Human
cgccuuuuugaaagagaaauga

SEQ ID NO: 274484 - RNA, 24 nt, Human
cguauacauauaugugugugugug

SEQ ID NO: 274485 - RNA, 24 nt, Human
cgugcguauacauauaugugugug

SEQ ID NO: 274486 - RNA, 20 nt, Human
cuccauccagugcuagcccc

SEQ ID NO: 274487 - RNA, 24 nt, Human
cuccccuacgacccuccagcucca

SEQ ID NO: 274488 - RNA, 22 nt, Human
cuccgcacccgaauccccgaga

SEQ ID NO: 274489 - RNA, 22 nt, Human
cuuccauaguacguuguucacc

SEQ ID NO: 274490 - RNA, 18 nt, Human
gaaccgggccacggacca

SEQ ID NO: 274491 - RNA, 23 nt, Human
gacccagaaaaaagaccaagucc

SEQ ID NO: 274492 - RNA, 20 nt, Human
gagaaaugacagacacaaaa

SEQ ID NO: 274493 - RNA, 22 nt, Human
gagggacaccuacaggugccca

SEQ ID NO: 274494 - RNA, 22 nt, Human
gccaaugcuguuggccuuuggg

SEQ ID NO: 274495 - RNA, 23 nt, Human
gcgagcaccaaggggguguccag

SEQ ID NO: 274496 - RNA, 19 nt, Human
gcucccaagucuggaguug

SEQ ID NO: 274497 - RNA, 22 nt, Human
ggacaccuacaggugcccagca

SEQ ID NO: 274498 - RNA, 23 nt, Human
ggcaggagaggcagacuccaggg

SEQ ID NO: 274499 - RNA, 20 nt, Human
ggccgaaggcgagcaccaag

SEQ ID NO: 274500 - RNA, 22 nt, Human
gggcagggggacuggcaggaga

SEQ ID NO: 274501 - RNA, 20 nt, Human
gguccuagagccagagagac

SEQ ID NO: 274502 - RNA, 20 nt, Human
gguggugcaguuccaagaga

SEQ ID NO: 274503 - RNA, 19 nt, Human
ggugugggugcgugcguau

SEQ ID NO: 274504 - RNA, 19 nt, Human
guagagagcaggucgucca

SEQ ID NO: 274505 - RNA, 18 nt, Human
guauacauauaugugugu

SEQ ID NO: 274506 - RNA, 24 nt, Human
gucuauguuugugcagguggaucu

SEQ ID NO: 274507 - RNA, 30 nt, Human
gugucugcgugugugugugugugugugugg

SEQ ID NO: 274508 - RNA, 24 nt, Human
gugugugcauguguuccuggaucu

SEQ ID NO: 274509 - RNA, 19 nt, Human
uacauauaugugugugugu

SEQ ID NO: 274510 - RNA, 23 nt, Human
uagccccuuucuccuuccacccc

SEQ ID NO: 274511 - RNA, 19 nt, Human
uauaugugugugugugugu

SEQ ID NO: 274512 - RNA, 21 nt, Human
uauccugcucuuuaaagcucc

SEQ ID NO: 274513 - RNA, 18 nt, Human
uaugugugugugugugug

SEQ ID NO: 274514 - RNA, 21 nt, Human
uaugugugugugugugugugu

SEQ ID NO: 274515 - RNA, 22 nt, Human
ucaccuggucuggccaggccaa

SEQ ID NO: 274516 - RNA, 25 nt, Human
uccaaaauuaaaaaagaaaaaucaa

SEQ ID NO: 274517 - RNA, 27 nt, Human
uccaaaauuaaaaaagaaaaaucaaca

SEQ ID NO: 274518 - RNA, 19 nt, Human
uccgggcagggggacuggc

SEQ ID NO: 274519 - RNA, 21 nt, Human
uccucgguuuaccgaggacuc

SEQ ID NO: 274520 - RNA, 18 nt, Human
ucgguggugcaguuccaa

SEQ ID NO: 274521 - RNA, 22 nt, Human
ucuguggucagauucagggagc

SEQ ID NO: 274522 - RNA, 22 nt, Human
ugaaagagaaaugacagacaca

SEQ ID NO: 274523 - RNA, 22 nt, Human
ugaaccgggccacggaccaccc

SEQ ID NO: 274524 - RNA, 18 nt, Human
ugaagcccucccuuccag

SEQ ID NO: 274525 - RNA, 20 nt, Human
ugacagacacaaaagacugu

SEQ ID NO: 274526 - RNA, 28 nt, Human
ugacagacacaaaagacuguaaagaaaa

SEQ ID NO: 274527 - RNA, 25 nt, Human
ugcguauacauauaugugugugugu

SEQ ID NO: 274528 - RNA, 25 nt, Human
ugcguauacauauaugugugugugu

SEQ ID NO: 274529 - RNA, 18 nt, Human
ugcgugcguauacauaua

SEQ ID NO: 274530 - RNA, 18 nt, Human
ugcgugcguauacauaua

SEQ ID NO: 274531 - RNA, 19 nt, Human
ugcgugcguauacauauau

SEQ ID NO: 274532 - RNA, 22 nt, Human
ugcgugugugugugugugugag

SEQ ID NO: 274533 - RNA, 21 nt, Human
ugcgugugugugugugugugu

SEQ ID NO: 274534 - RNA, 21 nt, Human
ugcgugugugugugugugugu

SEQ ID NO: 274535 - RNA, 21 nt, Human
ugcgugugugugugugugugu

SEQ ID NO: 274536 - RNA, 22 nt, Human
ugcguguguguguguguguguu

SEQ ID NO: 274537 - RNA, 18 nt, Human
ugcuuucaggccccccag

SEQ ID NO: 274538 - RNA, 21 nt, Human
uggaucugggagggagggagc

SEQ ID NO: 274539 - RNA, 19 nt, Human
uggccaggccaaugcuguu

SEQ ID NO: 274540 - RNA, 24 nt, Human
uggggguccuagagccagagagac

SEQ ID NO: 274541 - RNA, 26 nt, Human
ugggugcgugcguauacauauaugug

SEQ ID NO: 274542 - RNA, 24 nt, Human
uguaaagaaaauggggcgaauuuc

SEQ ID NO: 274543 - RNA, 21 nt, Human
ugucugcgugugugugugugu

SEQ ID NO: 274544 - RNA, 25 nt, Human
ugucugcgugugugugugugugugg

SEQ ID NO: 274545 - RNA, 23 nt, Human
ugugcagguggaucugcuguagg

SEQ ID NO: 274546 - RNA, 21 nt, Human
ugugucugcgugugugugugu

SEQ ID NO: 274547 - RNA, 23 nt, Human
ugugugcauguguuccuggaucu

SEQ ID NO: 274548 - RNA, 21 nt, Human
ugugugucugcgugugugugu

SEQ ID NO: 274549 - RNA, 24 nt, Human
ugugugucugcgugugugugugug

SEQ ID NO: 274550 - RNA, 31 nt, Human
ugugugucugcgugugugugugugugugugg

SEQ ID NO: 274551 - RNA, 21 nt, Human
ugugugugucugcgugugugu

SEQ ID NO: 274552 - RNA, 21 nt, Human
ugugugugucugcgugugugu

SEQ ID NO: 274553 - RNA, 22 nt, Human
ugugugugucugcgugugugug

SEQ ID NO: 274554 - RNA, 23 nt, Human
ugugugugugugucugcgugugu

SEQ ID NO: 274555 - RNA, 20 nt, Human
ugugugugugugugcaugug

SEQ ID NO: 274556 - RNA, 18 nt, Human
ugugugugugugugucug

SEQ ID NO: 274557 - RNA, 20 nt, Human
ugugugugugugugugcaug

SEQ ID NO: 274558 - RNA, 21 nt, Human
ugugugugugugugugcaugu

SEQ ID NO: 274559 - RNA, 21 nt, Human
ugugugugugugugugcaugu

SEQ ID NO: 274560 - RNA, 21 nt, Human
ugugugugugugugugucugc

SEQ ID NO: 274561 - RNA, 24 nt, Human
ugugugugugugugugucugcgug

SEQ ID NO: 274562 - RNA, 18 nt, Human
ugugugugugugugugug

SEQ ID NO: 274563 - RNA, 18 nt, Human
ugugugugugugugugug

SEQ ID NO: 274564 - RNA, 22 nt, Human
ugugugugugugugugugucug

SEQ ID NO: 274565 - RNA, 22 nt, Human
ugugugugugugugugugugca

SEQ ID NO: 274566 - RNA, 24 nt, Human
uguucaccaaaucuaaggucaccu

SEQ ID NO: 274567 - RNA, 19 nt, Human
uucauggccacacugacuu

SEQ ID NO: 274568 - RNA, 24 nt, Human
uuccaaaauuaaaaaagaaaaauc

SEQ ID NO: 274569 - RNA, 20 nt, Human
uuguacaugcgggugcaugu

SEQ ID NO: 274570 - RNA, 27 nt, Human
uuguuccaaaauuaaaaaagaaaaauc

SEQ ID NO: 274571 - RNA, 21 nt, Human
uuuguacaugcgggugcaugg

SEQ ID NO: 274572 - RNA, 19 nt, Human
aaaccaguauuuauuaaca

SEQ ID NO: 274573 - RNA, 20 nt, Human
aagcagacuugaacccuggu

SEQ ID NO: 274574 - RNA, 21 nt, Human
ggaaagcagacuugaacccug

SEQ ID NO: 274575 - RNA, 19 nt, Human
uuaaggauagcagccugca

SEQ ID NO: 274576 - RNA, 20 nt, Human
uuaaggauagcagccugcaa

SEQ ID NO: 274577 - RNA, 20 nt, Human
uuuuuuuuuuuuuuuuuugg

SEQ ID NO: 274578 - RNA, 19 nt, Human
aagcaggaaauacagcagg

SEQ ID NO: 274579 - RNA, 24 nt, Human
acccccuuugggccgcccagagac

SEQ ID NO: 274580 - RNA, 19 nt, Human
agcagcggagccgugcccc

SEQ ID NO: 274581 - RNA, 19 nt, Human
aggcaggggcacccccuuu

SEQ ID NO: 274582 - RNA, 21 nt, Human
agggaagcaggaaauacagca

SEQ ID NO: 274583 - RNA, 20 nt, Human
aucugugucugcaucagcga

SEQ ID NO: 274584 - RNA, 19 nt, Human
cacccucccgcuagguuac

SEQ ID NO: 274585 - RNA, 19 nt, Human
cagagaccugcacacccac

SEQ ID NO: 274586 - RNA, 18 nt, Human
cagcccucugagccucuc

SEQ ID NO: 274587 - RNA, 21 nt, Human
caggaaauacagcaggaacau

SEQ ID NO: 274588 - RNA, 22 nt, Human
caggggcuucuggcggaagccc

SEQ ID NO: 274589 - RNA, 23 nt, Human
caggggcuucuggcggaagcccg

SEQ ID NO: 274590 - RNA, 23 nt, Human
ccagagaccugcacacccacacu

SEQ ID NO: 274591 - RNA, 21 nt, Human
ccccgccguccccacccuccc

SEQ ID NO: 274592 - RNA, 22 nt, Human
ccccgccguccccacccucccg

SEQ ID NO: 274593 - RNA, 23 nt, Human
ccccgcgcccgccgcccuccccg

SEQ ID NO: 274594 - RNA, 19 nt, Human
ccccuuugggccgcccaga

SEQ ID NO: 274595 - RNA, 21 nt, Human
ccgcccuccccgccgucccca

SEQ ID NO: 274596 - RNA, 21 nt, Human
ccgccgcccuccccgccgucc

SEQ ID NO: 274597 - RNA, 18 nt, Human
ccgcgcccgccgcccucc

SEQ ID NO: 274598 - RNA, 21 nt, Human
ccgcggcuucguucgggcgcg

SEQ ID NO: 274599 - RNA, 23 nt, Human
ccggcggcggagccgcuuccccu

SEQ ID NO: 274600 - RNA, 27 nt, Human
ccucccgcuagguuaccaggcaggggc

SEQ ID NO: 274601 - RNA, 19 nt, Human
ccuggcccugccuugccac

SEQ ID NO: 274602 - RNA, 23 nt, Human
ccuggcccugccuugccacucug

SEQ ID NO: 274603 - RNA, 19 nt, Human
cgcccgccgcccuccccgc

SEQ ID NO: 274604 - RNA, 19 nt, Human
cgcuucccggccgcugggc

SEQ ID NO: 274605 - RNA, 23 nt, Human
cggccaaacaggggcccggcccc

SEQ ID NO: 274606 - RNA, 22 nt, Human
cuccccgccguccccacccucc

SEQ ID NO: 274607 - RNA, 23 nt, Human
cuccccgccguccccacccuccc

SEQ ID NO: 274608 - RNA, 18 nt, Human
gcccagagaccugcacac

SEQ ID NO: 274609 - RNA, 21 nt, Human
gccccgcgcccgccgcccucc

SEQ ID NO: 274610 - RNA, 18 nt, Human
gcuuccccuggcccugcc

SEQ ID NO: 274611 - RNA, 22 nt, Human
ggcuccggggcugccuucgauc

SEQ ID NO: 274612 - RNA, 24 nt, Human
uccccuggcccugccuugccacuc

SEQ ID NO: 274613 - RNA, 20 nt, Human
uccgcgccccugggggcgga

SEQ ID NO: 274614 - RNA, 25 nt, Human
ucggccaaauaggcacuucagcccu

SEQ ID NO: 274615 - RNA, 20 nt, Human
ugcacacccacacucuggcc

SEQ ID NO: 274616 - RNA, 22 nt, Human
ugccuucgauccuuuuaaaucc

SEQ ID NO: 274617 - RNA, 18 nt, Human
ugccuugccacucugcca

SEQ ID NO: 274618 - RNA, 18 nt, Human
cuccuuuccagcagaguc

SEQ ID NO: 274619 - RNA, 18 nt, Human
gcgcucggugcccugagg

SEQ ID NO: 274620 - RNA, 24 nt, Human
uacuaaguucucuccagguaguga

SEQ ID NO: 274621 - RNA, 21 nt, Human
aagcauuuuaaucagaugguc

SEQ ID NO: 274622 - RNA, 20 nt, Human
cacccgaaacgcgcccggga

SEQ ID NO: 274623 - RNA, 25 nt, Human
cacccgaaacgcgcccgggacccac

SEQ ID NO: 274624 - RNA, 23 nt, Human
cagcacccgaaacgcgcccggga

SEQ ID NO: 274625 - RNA, 23 nt, Human
ccagcacccgaaacgcgcccggg

SEQ ID NO: 274626 - RNA, 22 nt, Human
ccuacagccugguccucugccc

SEQ ID NO: 274627 - RNA, 21 nt, Human
cgccagcacccgaaacgcgcc

SEQ ID NO: 274628 - RNA, 22 nt, Human
cgccagcacccgaaacgcgccc

SEQ ID NO: 274629 - RNA, 21 nt, Human
cgcccgggacccacgugguuc

SEQ ID NO: 274630 - RNA, 23 nt, Human
cugcagccgccagcacccgaaac

SEQ ID NO: 274631 - RNA, 21 nt, Human
cugcuuagguuugaacuccgg

SEQ ID NO: 274632 - RNA, 19 nt, Human
gggaaggaggggaaaugga

SEQ ID NO: 274633 - RNA, 24 nt, Human
uguaaauaacuagauuuccuacag

SEQ ID NO: 274634 - RNA, 21 nt, Human
uuccuacagccugguccucug

SEQ ID NO: 274635 - RNA, 19 nt, Human
auggaaugaagagcugugu

SEQ ID NO: 274636 - RNA, 21 nt, Human
ccucuaagucaauggaaugaa

SEQ ID NO: 274637 - RNA, 20 nt, Human
cgcugggagagcagaaggga

SEQ ID NO: 274638 - RNA, 20 nt, Human
cuggaggggccgggcggcgg

SEQ ID NO: 274639 - RNA, 24 nt, Human
gcgcugggagagcagaagggauuc

SEQ ID NO: 274640 - RNA, 19 nt, Human
gcuggaggggccgggcggc

SEQ ID NO: 274641 - RNA, 20 nt, Human
gggaagcuggaggggccggg

SEQ ID NO: 274642 - RNA, 22 nt, Human
ucuaagucaauggaaugaagag

SEQ ID NO: 274643 - RNA, 19 nt, Human
aggcacugaaguugguggc

SEQ ID NO: 274644 - RNA, 22 nt, Human
aggcacugaaguugguggcuca

SEQ ID NO: 274645 - RNA, 26 nt, Human
aggcacugaaguugguggcucaaacu

SEQ ID NO: 274646 - RNA, 19 nt, Human
aggcagguuuggauguggg

SEQ ID NO: 274647 - RNA, 22 nt, Human
agugaauuuuaaugccuccccu

SEQ ID NO: 274648 - RNA, 22 nt, Human
cagaaaggcacugaaguuggug

SEQ ID NO: 274649 - RNA, 21 nt, Human
cagugaauuuuaaugccuccc

SEQ ID NO: 274650 - RNA, 23 nt, Human
cagugaauuuuaaugccuccccu

SEQ ID NO: 274651 - RNA, 25 nt, Human
ccccccccaccacaaagguuguccg

SEQ ID NO: 274652 - RNA, 21 nt, Human
ggcugggguggggcagaggug

SEQ ID NO: 274653 - RNA, 22 nt, Human
ggggauggggugguaagggcag

SEQ ID NO: 274654 - RNA, 21 nt, Human
ggggcagaggugaacagggaa

SEQ ID NO: 274655 - RNA, 21 nt, Human
gguuugggacaggcagguuug

SEQ ID NO: 274656 - RNA, 24 nt, Human
gugguuugggacaggcagguuugg

SEQ ID NO: 274657 - RNA, 22 nt, Human
ucuugcugacggagguaguugg

SEQ ID NO: 274658 - RNA, 22 nt, Human
ugggggauggggugguaagggc

SEQ ID NO: 274659 - RNA, 20 nt, Human
ugugaagacccccccccacc

SEQ ID NO: 274660 - RNA, 21 nt, Human
uuggaugugggcuuggguucu

SEQ ID NO: 274661 - RNA, 21 nt, Human
uugguggcucaaacuccucug

SEQ ID NO: 274662 - RNA, 19 nt, Human
caugauuuguucuuucgag

SEQ ID NO: 274663 - RNA, 24 nt, Human
uuacuuaaacccuagaaauaauuu

SEQ ID NO: 274664 - RNA, 23 nt, Human
aaaagaaaaagacagugaaaaag

SEQ ID NO: 274665 - RNA, 24 nt, Human
aaacaugcagcaccauuugaaaca

SEQ ID NO: 274666 - RNA, 23 nt, Human
aaagaagauucagaaacauggaa

SEQ ID NO: 274667 - RNA, 21 nt, Human
aaggcccagcgcgccugcccu

SEQ ID NO: 274668 - RNA, 21 nt, Human
acaugcagcaccauuugaaac

SEQ ID NO: 274669 - RNA, 24 nt, Human
acugcuuuaacggcgauuuuucuu

SEQ ID NO: 274670 - RNA, 19 nt, Human
agcgcagcuccccaaggcc

SEQ ID NO: 274671 - RNA, 27 nt, Human
caaagaagauucagaaacauggaaaua

SEQ ID NO: 274672 - RNA, 19 nt, Human
cagcaccauuugaaacaaa

SEQ ID NO: 274673 - RNA, 24 nt, Human
cagcaccauuugaaacaaagaaga

SEQ ID NO: 274674 - RNA, 19 nt, Human
cccagcgcgccugcccuuc

SEQ ID NO: 274675 - RNA, 22 nt, Human
cccagcgcgccugcccuucccg

SEQ ID NO: 274676 - RNA, 20 nt, Human
ccgccgagcgcagcucccca

SEQ ID NO: 274677 - RNA, 21 nt, Human
ccugcccuucccggaaaacac

SEQ ID NO: 274678 - RNA, 26 nt, Human
cgaaaagaaaaagacagugaaaaaga

SEQ ID NO: 274679 - RNA, 21 nt, Human
cgccugaaacgcgaacccccg

SEQ ID NO: 274680 - RNA, 26 nt, Human
cgccugaaacgcgaacccccggaggc

SEQ ID NO: 274681 - RNA, 18 nt, Human
cgcgaacccccggaggca

SEQ ID NO: 274682 - RNA, 25 nt, Human
gaaaagaaaaagacagugaaaaaga

SEQ ID NO: 274683 - RNA, 22 nt, Human
gcacuuauuguaguugaaaaca

SEQ ID NO: 274684 - RNA, 20 nt, Human
gcgaaaagaaaaagacagug

SEQ ID NO: 274685 - RNA, 18 nt, Human
ggcccggguucucgaaac

SEQ ID NO: 274686 - RNA, 20 nt, Human
gggaggggaaggcccggguu

SEQ ID NO: 274687 - RNA, 25 nt, Human
ugaaaaagaaaacugcuuuaacggc

SEQ ID NO: 274688 - RNA, 23 nt, Human
ugaaacaaagaagauucagaaac

SEQ ID NO: 274689 - RNA, 18 nt, Human
ugggaggggaaggcccgg

SEQ ID NO: 274690 - RNA, 24 nt, Human
ugggaggggaaggcccggguucuc

SEQ ID NO: 274691 - RNA, 18 nt, Human
uucauuuuuuaaggaaaa

SEQ ID NO: 274692 - RNA, 22 nt, Human
uuccccgcgaaaagaaaaagac

SEQ ID NO: 274693 - RNA, 18 nt, Human
uuccugaggagguggccc

SEQ ID NO: 274694 - RNA, 25 nt, Human
uuguaguugaaaacaugcagcacca

SEQ ID NO: 274695 - RNA, 27 nt, Human
uuuucauuuuuuaaggaaaagcauauu

SEQ ID NO: 274696 - RNA, 18 nt, Human
gagcacugcccuccuucu

SEQ ID NO: 274697 - RNA, 26 nt, Human
aaaaaguauucucuccagauuauaaa

SEQ ID NO: 274698 - RNA, 23 nt, Human
aaacacccacacagagcuucuca

SEQ ID NO: 274699 - RNA, 20 nt, Human
aaagauaguucaaaagccuu

SEQ ID NO: 274700 - RNA, 23 nt, Human
aacacacucauuggaguauaaga

SEQ ID NO: 274701 - RNA, 28 nt, Human
aacacccacacagagcuucucaaacagc

SEQ ID NO: 274702 - RNA, 21 nt, Human
aacacgaccgacugaacauuc

SEQ ID NO: 274703 - RNA, 23 nt, Human
aacugagagaguccacagggaca

SEQ ID NO: 274704 - RNA, 24 nt, Human
acacccacacagagcuucucaaac

SEQ ID NO: 274705 - RNA, 22 nt, Human
agaaagagcuuugauuuggagg

SEQ ID NO: 274706 - RNA, 20 nt, Human
agccgacaccauguggagca

SEQ ID NO: 274707 - RNA, 23 nt, Human
agcuuucugcguggcugaagagc

SEQ ID NO: 274708 - RNA, 24 nt, Human
aggcccggagcccagucacagcgg

SEQ ID NO: 274709 - RNA, 19 nt, Human
aguaggaaagguaccgcuc

SEQ ID NO: 274710 - RNA, 24 nt, Human
caaaacuugaccaaauguucuaag

SEQ ID NO: 274711 - RNA, 24 nt, Human
caaauuccuccauggagucaaaga

SEQ ID NO: 274712 - RNA, 19 nt, Human
cacagaaacacccacacag

SEQ ID NO: 274713 - RNA, 21 nt, Human
cacagcccagccuaccugacc

SEQ ID NO: 274714 - RNA, 25 nt, Human
caccagcacuccacgugucuacccu

SEQ ID NO: 274715 - RNA, 21 nt, Human
caccucuucuagagacucugu

SEQ ID NO: 274716 - RNA, 19 nt, Human
cacucccgcugggcagagu

SEQ ID NO: 274717 - RNA, 23 nt, Human
cacucugcacaacucgggaaguc

SEQ ID NO: 274718 - RNA, 20 nt, Human
caggacgccuggacgacauc

SEQ ID NO: 274719 - RNA, 23 nt, Human
caguaggaaagguaccgcucucu

SEQ ID NO: 274720 - RNA, 21 nt, Human
ccacagaaacacccacacaga

SEQ ID NO: 274721 - RNA, 25 nt, Human
cccaggacgccuggacgacaucaaa

SEQ ID NO: 274722 - RNA, 22 nt, Human
ccccuaacgauaaaggcuucug

SEQ ID NO: 274723 - RNA, 18 nt, Human
ccccugggcgcgcggcug

SEQ ID NO: 274724 - RNA, 23 nt, Human
ccccugggcgcgcggcugaggcc

SEQ ID NO: 274725 - RNA, 25 nt, Human
cccggagcccagucacagcggugcc

SEQ ID NO: 274726 - RNA, 18 nt, Human
cccugaucccaggacgcc

SEQ ID NO: 274727 - RNA, 20 nt, Human
ccggagcccagucacagcgg

SEQ ID NO: 274728 - RNA, 19 nt, Human
ccucagccgagaagcggga

SEQ ID NO: 274729 - RNA, 22 nt, Human
ccuggccgcgcggcgccucagc

SEQ ID NO: 274730 - RNA, 22 nt, Human
cgccucagccgagaagcgggac

SEQ ID NO: 274731 - RNA, 19 nt, Human
cgggaugucugcaccucuu

SEQ ID NO: 274732 - RNA, 18 nt, Human
cgugucuacccugauccc

SEQ ID NO: 274733 - RNA, 22 nt, Human
cguuacaaauuccuccauggag

SEQ ID NO: 274734 - RNA, 23 nt, Human
cugaccacagaaacacccacacu

SEQ ID NO: 274735 - RNA, 21 nt, Human
cuggccgcgcggcgccucagc

SEQ ID NO: 274736 - RNA, 18 nt, Human
cugugagccgacaccaug

SEQ ID NO: 274737 - RNA, 19 nt, Human
cugugagccgacaccaugu

SEQ ID NO: 274738 - RNA, 24 nt, Human
cuuucaggucacaccgaucguuac

SEQ ID NO: 274739 - RNA, 23 nt, Human
gagggccccggaggccccugggc

SEQ ID NO: 274740 - RNA, 24 nt, Human
gcccggccccguuugggccucggc

SEQ ID NO: 274741 - RNA, 18 nt, Human
gcugacccgggagggccc

SEQ ID NO: 274742 - RNA, 21 nt, Human
ggagcagugcuguucacagcc

SEQ ID NO: 274743 - RNA, 22 nt, Human
ggaggccccugggcgcgcggcu

SEQ ID NO: 274744 - RNA, 21 nt, Human
gggcuggcgggggacccuuca

SEQ ID NO: 274745 - RNA, 22 nt, Human
guaccauaaaguuucccucuca

SEQ ID NO: 274746 - RNA, 30 nt, Human
uaaguauaaaaaguacagacgucacucugg

SEQ ID NO: 274747 - RNA, 24 nt, Human
uaauacaaaagaaacgaucauuuc

SEQ ID NO: 274748 - RNA, 22 nt, Human
uaauaggaacaaucuugcacaa

SEQ ID NO: 274749 - RNA, 23 nt, Human
uacaaaacuugaccaaaggacau

SEQ ID NO: 274750 - RNA, 20 nt, Human
uaccugaccacagaaacacc

SEQ ID NO: 274751 - RNA, 20 nt, Human
uauaaaaaggaaaaaaggua

SEQ ID NO: 274752 - RNA, 22 nt, Human
ucaaacaggauaaaaacucaca

SEQ ID NO: 274753 - RNA, 24 nt, Human
ucacagcccagccuaccugaccac

SEQ ID NO: 274754 - RNA, 19 nt, Human
uccacacaggcuaccagau

SEQ ID NO: 274755 - RNA, 19 nt, Human
ucucaaacagcucagcacc

SEQ ID NO: 274756 - RNA, 18 nt, Human
ucugcacaacucgggaag

SEQ ID NO: 274757 - RNA, 22 nt, Human
ucugcaccucuucuagagacuc

SEQ ID NO: 274758 - RNA, 22 nt, Human
ugaccacagaaacacccacaca

SEQ ID NO: 274759 - RNA, 19 nt, Human
ugacccgggagggccccgg

SEQ ID NO: 274760 - RNA, 23 nt, Human
ugacccgggagggccccggaggc

SEQ ID NO: 274761 - RNA, 18 nt, Human
ugagccgacaccaugugg

SEQ ID NO: 274762 - RNA, 24 nt, Human
ugugggcuuuuuuuuuuuuuuaaa

SEQ ID NO: 274763 - RNA, 27 nt, Human
uguguuaaaaacacgaccgacugaaca

SEQ ID NO: 274764 - RNA, 21 nt, Human
uguguuaagagaaaauaguga

SEQ ID NO: 274765 - RNA, 23 nt, Human
uguuaaaaacacgaccgacugaa

SEQ ID NO: 274766 - RNA, 27 nt, Human
uuccacacaggcuaccagauauuuuau

SEQ ID NO: 274767 - RNA, 18 nt, Human
uugauggcgcggccgcgg

SEQ ID NO: 274768 - RNA, 20 nt, Human
uuuccuggcccugcaggcac

SEQ ID NO: 274769 - RNA, 22 nt, Human
uuuuuuuuuuuuaaaaaaagau

SEQ ID NO: 274770 - RNA, 24 nt, Human
uuuuuuuuuuuuaaaaaaagauag

SEQ ID NO: 274771 - RNA, 18 nt, Human
uuuuuuuuuuuuuuuuug

SEQ ID NO: 274772 - RNA, 18 nt, Human
uuuuuuuuuuuuuuuuug

SEQ ID NO: 274773 - RNA, 22 nt, Human
acaguagagaaggcauccucac

SEQ ID NO: 274774 - RNA, 19 nt, Human
agaguuccaaccuggugac

SEQ ID NO: 274775 - RNA, 19 nt, Human
aggcaagaguuccaaccug

SEQ ID NO: 274776 - RNA, 23 nt, Human
aggcauccucacagaggcaagag

SEQ ID NO: 274777 - RNA, 22 nt, Human
cagugagccacccgucuaguuu

SEQ ID NO: 274778 - RNA, 25 nt, Human
ccucacagaggcaagaguuccaacc

SEQ ID NO: 274779 - RNA, 19 nt, Human
ucacagaggcaagaguucc

SEQ ID NO: 274780 - RNA, 22 nt, Human
ugacaauggcagugagccaccc

SEQ ID NO: 274781 - RNA, 19 nt, Human
uuucauggguaugcacagu

SEQ ID NO: 274782 - RNA, 18 nt, Human
acccuaaguuccugggca

SEQ ID NO: 274783 - RNA, 23 nt, Human
caagcacaggaccuggaggccaa

SEQ ID NO: 274784 - RNA, 23 nt, Human
cacccuaaguuccugggcaaaca

SEQ ID NO: 274785 - RNA, 21 nt, Human
cagaauccucacugagcuccc

SEQ ID NO: 274786 - RNA, 23 nt, Human
cagaauccucacugagcucccag

SEQ ID NO: 274787 - RNA, 26 nt, Human
cagcagcaucccagguccuauccagc

SEQ ID NO: 274788 - RNA, 21 nt, Human
caguaaugacaaugaugugug

SEQ ID NO: 274789 - RNA, 24 nt, Human
ccagcgguacugggcuggaccgag

SEQ ID NO: 274790 - RNA, 18 nt, Human
ccaguccagagagaagcc

SEQ ID NO: 274791 - RNA, 18 nt, Human
ccccucuucuagucucac

SEQ ID NO: 274792 - RNA, 21 nt, Human
cccuaaguuccugggcaaaca

SEQ ID NO: 274793 - RNA, 18 nt, Human
ccuccugccucucccucg

SEQ ID NO: 274794 - RNA, 22 nt, Human
cguggagagagcccaggucccg

SEQ ID NO: 274795 - RNA, 20 nt, Human
cucaaggucccuuucugcuc

SEQ ID NO: 274796 - RNA, 20 nt, Human
cucacugagcucccagucca

SEQ ID NO: 274797 - RNA, 20 nt, Human
cuucccaaggcugugagcuc

SEQ ID NO: 274798 - RNA, 27 nt, Human
cuuucugcuccccucuucuagucucaa

SEQ ID NO: 274799 - RNA, 22 nt, Human
gcagccuggacuccuaagggca

SEQ ID NO: 274800 - RNA, 18 nt, Human
gcgggcaggagggucagg

SEQ ID NO: 274801 - RNA, 21 nt, Human
ggaaauggguuguguaugcgg

SEQ ID NO: 274802 - RNA, 21 nt, Human
ggcaggagggucagguccuug

SEQ ID NO: 274803 - RNA, 24 nt, Human
gggcaggagggucagguccuuggu

SEQ ID NO: 274804 - RNA, 20 nt, Human
gucccuuucugcuccccucu

SEQ ID NO: 274805 - RNA, 21 nt, Human
uacugggcuggaccgagccuu

SEQ ID NO: 274806 - RNA, 22 nt, Human
ucaaggucccuuucugcucccc

SEQ ID NO: 274807 - RNA, 18 nt, Human
ucagguccuugucccacu

SEQ ID NO: 274808 - RNA, 19 nt, Human
ucccaguccagagagaagc

SEQ ID NO: 274809 - RNA, 21 nt, Human
uccgcaagcacaggaccugga

SEQ ID NO: 274810 - RNA, 25 nt, Human
uccgcaagcacaggaccuggaggcc

SEQ ID NO: 274811 - RNA, 18 nt, Human
uccggaguuuauucacuu

SEQ ID NO: 274812 - RNA, 24 nt, Human
ucuaagcccucccuauguggagag

SEQ ID NO: 274813 - RNA, 18 nt, Human
ugcgugggguugagcugg

SEQ ID NO: 274814 - RNA, 26 nt, Human
ugcuccccucuucuagucucacuucc

SEQ ID NO: 274815 - RNA, 22 nt, Human
uggagagagcccaggucccguc

SEQ ID NO: 274816 - RNA, 19 nt, Human
ugggcuugggccugcccag

SEQ ID NO: 274817 - RNA, 22 nt, Human
ugggcuugggccugcccagguc

SEQ ID NO: 274818 - RNA, 22 nt, Human
ugucggggcucgaucccagccg

SEQ ID NO: 274819 - RNA, 21 nt, Human
uuaaaacaguaaugacaauga

SEQ ID NO: 274820 - RNA, 23 nt, Human
uucacuuccagcgguacugggcu

SEQ ID NO: 274821 - RNA, 24 nt, Human
uucagcuccagcagcaucccaggu

SEQ ID NO: 274822 - RNA, 25 nt, Human
uuuauucacuuccagcgguacuggg

SEQ ID NO: 274823 - RNA, 22 nt, Human
uuuuuuuuuuuuuuuuucauuu

SEQ ID NO: 274824 - RNA, 24 nt, Human
aaaaaaaaaagccaaucacccgcg

SEQ ID NO: 274825 - RNA, 21 nt, Human
aaaaaagccaaucacccgcgg

SEQ ID NO: 274826 - RNA, 21 nt, Human
aaagaccagaaacuugaauaa

SEQ ID NO: 274827 - RNA, 24 nt, Human
aacuggugaugucugucaacuguu

SEQ ID NO: 274828 - RNA, 21 nt, Human
aagcaacacugguuccaaaac

SEQ ID NO: 274829 - RNA, 23 nt, Human
aauaacugguuugccaaaaaaaa

SEQ ID NO: 274830 - RNA, 23 nt, Human
acaagcaacacugguuccaaaac

SEQ ID NO: 274831 - RNA, 20 nt, Human
acccgcggaacaagcaacac

SEQ ID NO: 274832 - RNA, 18 nt, Human
acgcugagccguggaagu

SEQ ID NO: 274833 - RNA, 21 nt, Human
acuuguucaugcucuuuuaga

SEQ ID NO: 274834 - RNA, 19 nt, Human
agauaaccuuaaccacuaa

SEQ ID NO: 274835 - RNA, 21 nt, Human
cacccacagagugccaggcac

SEQ ID NO: 274836 - RNA, 19 nt, Human
cacccgcggaacaagcaac

SEQ ID NO: 274837 - RNA, 23 nt, Human
ccaaaaaaaaaagccaaucaccc

SEQ ID NO: 274838 - RNA, 22 nt, Human
ccauugucauaaaaugaccaag

SEQ ID NO: 274839 - RNA, 20 nt, Human
cccacagagugccaggcacu

SEQ ID NO: 274840 - RNA, 18 nt, Human
ccccucuggcccuggccu

SEQ ID NO: 274841 - RNA, 23 nt, Human
ccgcgcuggaaccuccucgguua

SEQ ID NO: 274842 - RNA, 18 nt, Human
ccucccugacgcugagcc

SEQ ID NO: 274843 - RNA, 25 nt, Human
ccuucaaaugaaaacuccuauccau

SEQ ID NO: 274844 - RNA, 21 nt, Human
ccuuuagcgcuggaaaagugg

SEQ ID NO: 274845 - RNA, 20 nt, Human
cgccgcgcuggaaccuccuc

SEQ ID NO: 274846 - RNA, 18 nt, Human
cucccggcgccacgugcc

SEQ ID NO: 274847 - RNA, 18 nt, Human
cucuccucccugacgcug

SEQ ID NO: 274848 - RNA, 27 nt, Human
cucuggcccuggccuugcgccgguucc

SEQ ID NO: 274849 - RNA, 19 nt, Human
gagcaaaauucacuauucc

SEQ ID NO: 274850 - RNA, 22 nt, Human
gaucuucaagacuuguucaaga

SEQ ID NO: 274851 - RNA, 26 nt, Human
gcccuggccuugcgcacacacccacc

SEQ ID NO: 274852 - RNA, 20 nt, Human
gcgcuggaaccuccucgguu

SEQ ID NO: 274853 - RNA, 18 nt, Human
gcucuuuuagagcaaaau

SEQ ID NO: 274854 - RNA, 24 nt, Human
gggaauaaaacacuuuauuuuaaa

SEQ ID NO: 274855 - RNA, 24 nt, Human
gggaauaaaacacuuuauuuuaaa

SEQ ID NO: 274856 - RNA, 18 nt, Human
uaaaacacuuuauuuuaa

SEQ ID NO: 274857 - RNA, 18 nt, Human
uaaaacacuuuauuuuaa

SEQ ID NO: 274858 - RNA, 20 nt, Human
uaauagauaaccuuaaccac

SEQ ID NO: 274859 - RNA, 24 nt, Human
uagagcaaaauucacuauuccguu

SEQ ID NO: 274860 - RNA, 23 nt, Human
uccauugucauaaaaugaccaag

SEQ ID NO: 274861 - RNA, 18 nt, Human
ucccggcgccacgugccc

SEQ ID NO: 274862 - RNA, 24 nt, Human
ugaccaagaucuucaagacuuguu

SEQ ID NO: 274863 - RNA, 21 nt, Human
ugagcacccacagagugccag

SEQ ID NO: 274864 - RNA, 21 nt, Human
ugccaaaaaaaaaagccaauc

SEQ ID NO: 274865 - RNA, 24 nt, Human
ugccaaaaaaaaaagccaaucacc

SEQ ID NO: 274866 - RNA, 24 nt, Human
ugccaaaaaaaaaagccaaucacc

SEQ ID NO: 274867 - RNA, 21 nt, Human
ugccaggcacuguacaaaaca

SEQ ID NO: 274868 - RNA, 20 nt, Human
ugcgcacacacccacccgcg

SEQ ID NO: 274869 - RNA, 26 nt, Human
ugcuucaaaugaaaacuccuauccau

SEQ ID NO: 274870 - RNA, 23 nt, Human
uggcaauaauagauaaccuuaac

SEQ ID NO: 274871 - RNA, 23 nt, Human
uggugaugucugucaacuguuuc

SEQ ID NO: 274872 - RNA, 23 nt, Human
uguucaagaaacaaguuuccaau

SEQ ID NO: 274873 - RNA, 22 nt, Human
uuaaagaccagaaacuugaaua

SEQ ID NO: 274874 - RNA, 26 nt, Human
uuauugagcacccagagugccaggcc

SEQ ID NO: 274875 - RNA, 18 nt, Human
uuccgccgcgcuggaacc

SEQ ID NO: 274876 - RNA, 18 nt, Human
uugucauaaaaugaccaa

SEQ ID NO: 274877 - RNA, 19 nt, Human
uuuuuuuuuuuuuaaggga

SEQ ID NO: 274878 - RNA, 20 nt, Human
aauagcuuccagcggcaggu

SEQ ID NO: 274879 - RNA, 21 nt, Human
acuuuccccaccccacauucu

SEQ ID NO: 274880 - RNA, 24 nt, Human
aggaaauggcacugauggacagaa

SEQ ID NO: 274881 - RNA, 18 nt, Human
agggcuguuagagcugcc

SEQ ID NO: 274882 - RNA, 24 nt, Human
cacgcgguccacagcuuuaggcau

SEQ ID NO: 274883 - RNA, 24 nt, Human
cagcccaauagcuuccagcggcag

SEQ ID NO: 274884 - RNA, 18 nt, Human
ccagcggcaggugcccag

SEQ ID NO: 274885 - RNA, 22 nt, Human
ccagcggcaggugcccaggugc

SEQ ID NO: 274886 - RNA, 19 nt, Human
ccugggaagaaggcgugcc

SEQ ID NO: 274887 - RNA, 20 nt, Human
ccuuggggaacugggaagau

SEQ ID NO: 274888 - RNA, 19 nt, Human
cuagucccagggaggcgag

SEQ ID NO: 274889 - RNA, 20 nt, Human
gccgcugaaaccuaguccca

SEQ ID NO: 274890 - RNA, 23 nt, Human
ggccgcugaaaccuagucccagg

SEQ ID NO: 274891 - RNA, 20 nt, Human
gggaggcgagcccacgcggu

SEQ ID NO: 274892 - RNA, 22 nt, Human
ucuuagcauuuacuuuccccac

SEQ ID NO: 274893 - RNA, 19 nt, Human
ugggaagaaggcgugccuu

SEQ ID NO: 274894 - RNA, 19 nt, Human
ugggaagaugccgucagug

SEQ ID NO: 274895 - RNA, 22 nt, Human
ugugggugggcaggaggacagc

SEQ ID NO: 274896 - RNA, 20 nt, Human
caguccgaagaguuugguua

SEQ ID NO: 274897 - RNA, 21 nt, Human
cgagagacuggaugccaaaga

SEQ ID NO: 274898 - RNA, 18 nt, Human
cuuuaugggugaugccac

SEQ ID NO: 274899 - RNA, 21 nt, Human
ggguaacagguggcagaaaag

SEQ ID NO: 274900 - RNA, 21 nt, Human
gguaacagguggcagaaaaga

SEQ ID NO: 274901 - RNA, 18 nt, Human
uuuuuuuuuuuuuguuuu

SEQ ID NO: 274902 - RNA, 21 nt, Human
aaaaaauacucaagacagucc

SEQ ID NO: 274903 - RNA, 26 nt, Human
aaacaagauggacaaaaaaaaaaaaa

SEQ ID NO: 274904 - RNA, 20 nt, Human
aaacacaguacaccaaugaa

SEQ ID NO: 274905 - RNA, 23 nt, Human
aaagcugaggagcacaacccuug

SEQ ID NO: 274906 - RNA, 21 nt, Human
aaaugaaacaagauggacaaa

SEQ ID NO: 274907 - RNA, 22 nt, Human
aagaaaagcugugaacagcaac

SEQ ID NO: 274908 - RNA, 24 nt, Human
aagaaaagcugugaacagcaacau

SEQ ID NO: 274909 - RNA, 21 nt, Human
aagcugugaacagcaacauca

SEQ ID NO: 274910 - RNA, 24 nt, Human
aagcuugaacccgggaggcagagg

SEQ ID NO: 274911 - RNA, 19 nt, Human
acaauauaccacacagaau

SEQ ID NO: 274912 - RNA, 24 nt, Human
acacuccagccugggcgacagagu

SEQ ID NO: 274913 - RNA, 20 nt, Human
acagaguaagacuccgucuc

SEQ ID NO: 274914 - RNA, 20 nt, Human
acagaguaagacuccgucuc

SEQ ID NO: 274915 - RNA, 20 nt, Human
acaguacaccaaugaaaaaa

SEQ ID NO: 274916 - RNA, 27 nt, Human
accacaauccaucaaggaccacacacu

SEQ ID NO: 274917 - RNA, 21 nt, Human
accucuccuucuuaugaauuc

SEQ ID NO: 274918 - RNA, 18 nt, Human
acuacacuccagccuggg

SEQ ID NO: 274919 - RNA, 24 nt, Human
acuacacuccagccugggcgacag

SEQ ID NO: 274920 - RNA, 19 nt, Human
acuagacacugcaacuuau

SEQ ID NO: 274921 - RNA, 27 nt, Human
acugcaacuuauuaguaucggcgacgu

SEQ ID NO: 274922 - RNA, 22 nt, Human
agaaagcugaggagcacaaccc

SEQ ID NO: 274923 - RNA, 23 nt, Human
agacacaaaagggucauuccugg

SEQ ID NO: 274924 - RNA, 23 nt, Human
agagauugcagugagccgagauc

SEQ ID NO: 274925 - RNA, 19 nt, Human
agcaacagagaggugaaag

SEQ ID NO: 274926 - RNA, 18 nt, Human
agcauuuugggaggccga

SEQ ID NO: 274927 - RNA, 24 nt, Human
agcauuuugggaggccgagguggg

SEQ ID NO: 274928 - RNA, 24 nt, Human
agccugggcgacagaguaagacuc

SEQ ID NO: 274929 - RNA, 21 nt, Human
aggauaagaagcaagugaggu

SEQ ID NO: 274930 - RNA, 21 nt, Human
aggcagagauugcagugagcc

SEQ ID NO: 274931 - RNA, 24 nt, Human
aggcagagauugcagugagccgag

SEQ ID NO: 274932 - RNA, 21 nt, Human
aggccgagguggguagaucac

SEQ ID NO: 274933 - RNA, 24 nt, Human
agguggguagaucacgaggucagg

SEQ ID NO: 274934 - RNA, 24 nt, Human
agugagguugggcacgguggcuca

SEQ ID NO: 274935 - RNA, 24 nt, Human
aucaugccacuacacuccagccug

SEQ ID NO: 274936 - RNA, 22 nt, Human
augccacuacacuccagccugg

SEQ ID NO: 274937 - RNA, 24 nt, Human
auugcagugagccgagaucaugcc

SEQ ID NO: 274938 - RNA, 22 nt, Human
caaaaaauacucaagacagucc

SEQ ID NO: 274939 - RNA, 24 nt, Human
caaaaaauacucaagacaguccaa

SEQ ID NO: 274940 - RNA, 22 nt, Human
caaacagcacugagaaagcuga

SEQ ID NO: 274941 - RNA, 21 nt, Human
caaaucaaacacaguacacca

SEQ ID NO: 274942 - RNA, 19 nt, Human
caacacgggaaaauugguc

SEQ ID NO: 274943 - RNA, 20 nt, Human
caagaaaagcugugaacagc

SEQ ID NO: 274944 - RNA, 21 nt, Human
caauugccccaauuccuucca

SEQ ID NO: 274945 - RNA, 25 nt, Human
cacagaacugauuaaacaauauacc

SEQ ID NO: 274946 - RNA, 24 nt, Human
cacagcaugacuaccuaagauagg

SEQ ID NO: 274947 - RNA, 19 nt, Human
caccccucccuugcccucu

SEQ ID NO: 274948 - RNA, 24 nt, Human
caccccuguaaucccagcauuuug

SEQ ID NO: 274949 - RNA, 19 nt, Human
caccugggagugaauggag

SEQ ID NO: 274950 - RNA, 19 nt, Human
cacggccucucccgucccg

SEQ ID NO: 274951 - RNA, 27 nt, Human
cacuacacuccagccugggcgacagag

SEQ ID NO: 274952 - RNA, 19 nt, Human
cacugagucuaaacagaau

SEQ ID NO: 274953 - RNA, 18 nt, Human
cagaauacagcagaccca

SEQ ID NO: 274954 - RNA, 22 nt, Human
cagcauuuugggaggccgaggu

SEQ ID NO: 274955 - RNA, 24 nt, Human
cagcauuuugggaggccgaggugg

SEQ ID NO: 274956 - RNA, 20 nt, Human
cagcuccaggagcugcacgg

SEQ ID NO: 274957 - RNA, 20 nt, Human
cagguccuggaggagcuggg

SEQ ID NO: 274958 - RNA, 20 nt, Human
ccaccccucccuugcccucu

SEQ ID NO: 274959 - RNA, 20 nt, Human
ccacuacacuccagccuggg

SEQ ID NO: 274960 - RNA, 21 nt, Human
ccacuacacuccagccugggc

SEQ ID NO: 274961 - RNA, 23 nt, Human
ccacuacacuccagccugggcga

SEQ ID NO: 274962 - RNA, 24 nt, Human
ccacuacacuccagccugggcgac

SEQ ID NO: 274963 - RNA, 18 nt, Human
ccauagccaucugaccca

SEQ ID NO: 274964 - RNA, 23 nt, Human
ccauuuuucagaaaaacuccaaa

SEQ ID NO: 274965 - RNA, 21 nt, Human
cccauagccaucugacccauc

SEQ ID NO: 274966 - RNA, 19 nt, Human
ccccuguaaucccagcauu

SEQ ID NO: 274967 - RNA, 22 nt, Human
cccgucccgagaaaagagcgcg

SEQ ID NO: 274968 - RNA, 21 nt, Human
ccgguaaccuagcagacaauu

SEQ ID NO: 274969 - RNA, 18 nt, Human
ccucacccaagaaaaaga

SEQ ID NO: 274970 - RNA, 21 nt, Human
ccuccagcauacucccuagag

SEQ ID NO: 274971 - RNA, 18 nt, Human
ccucccauagccaucuga

SEQ ID NO: 274972 - RNA, 22 nt, Human
ccugggcgacagaguaagacuc

SEQ ID NO: 274973 - RNA, 22 nt, Human
ccuguaaucccagcauuuuggg

SEQ ID NO: 274974 - RNA, 18 nt, Human
ccuucuuuuaaggguuuu

SEQ ID NO: 274975 - RNA, 24 nt, Human
cgagaucaugccacuacacuccag

SEQ ID NO: 274976 - RNA, 22 nt, Human
cgagguggguagaucacgaggu

SEQ ID NO: 274977 - RNA, 24 nt, Human
cgagguggguagaucacgagguca

SEQ ID NO: 274978 - RNA, 23 nt, Human
cgcuacacggccucucccguccc

SEQ ID NO: 274979 - RNA, 23 nt, Human
cguauguacgcugccugugaccu

SEQ ID NO: 274980 - RNA, 22 nt, Human
cuaagagaaaaugucuucuuua

SEQ ID NO: 274981 - RNA, 21 nt, Human
cuauagucacugagucuaaac

SEQ ID NO: 274982 - RNA, 21 nt, Human
cucaccccuguaaucccagca

SEQ ID NO: 274983 - RNA, 18 nt, Human
cugaagcuccaacuugua

SEQ ID NO: 274984 - RNA, 21 nt, Human
cugacccauccgaaucuccug

SEQ ID NO: 274985 - RNA, 22 nt, Human
cugcucucucugaaaaacaaaa

SEQ ID NO: 274986 - RNA, 22 nt, Human
cuugugaggcaagaucuccucu

SEQ ID NO: 274987 - RNA, 18 nt, Human
gaaaaaaaaaaugcacag

SEQ ID NO: 274988 - RNA, 22 nt, Human
gaaguagauagagugauaacac

SEQ ID NO: 274989 - RNA, 22 nt, Human
gacaaaucaaacacaguacacc

SEQ ID NO: 274990 - RNA, 24 nt, Human
gacagaguaagacuccgucucggg

SEQ ID NO: 274991 - RNA, 22 nt, Human
gagcgcgcgaccgccggaaacg

SEQ ID NO: 274992 - RNA, 18 nt, Human
gagcugggguaccagcug

SEQ ID NO: 274993 - RNA, 22 nt, Human
gaucacgaggucaggaguucaa

SEQ ID NO: 274994 - RNA, 24 nt, Human
gaucacgaggucaggaguucaaga

SEQ ID NO: 274995 - RNA, 22 nt, Human
gccacuacacuccagccugggc

SEQ ID NO: 274996 - RNA, 24 nt, Human
gccagagccuccuauuagcaacag

SEQ ID NO: 274997 - RNA, 22 nt, Human
gcccauagcaccucccauagcc

SEQ ID NO: 274998 - RNA, 20 nt, Human
gccgagaucaugccacuaca

SEQ ID NO: 274999 - RNA, 23 nt, Human
ggcacgguggcucaccccuguaa

SEQ ID NO: 275000 - RNA, 23 nt, Human
gguagaucacgaggucaggaguu

SEQ ID NO: 275001 - RNA, 23 nt, Human
gguggcucaccccuguaauccca

SEQ ID NO: 275002 - RNA, 24 nt, Human
gguggcucaccccuguaaucccag

SEQ ID NO: 275003 - RNA, 26 nt, Human
guaaccuagcagacaauucccucacg

SEQ ID NO: 275004 - RNA, 28 nt, Human
guaacggcgacgcuacacggccucuccc

SEQ ID NO: 275005 - RNA, 19 nt, Human
uaaaaugaaaaucucuaag

SEQ ID NO: 275006 - RNA, 19 nt, Human
uaacuggauccacuuugcc

SEQ ID NO: 275007 - RNA, 20 nt, Human
uaagagaaaaugucuucuuu

SEQ ID NO: 275008 - RNA, 24 nt, Human
uaagagaaaaugucuucuuuagga

SEQ ID NO: 275009 - RNA, 24 nt, Human
uaagagcuacugucagaccuucag

SEQ ID NO: 275010 - RNA, 22 nt, Human
uacgcugccugugaccuuugug

SEQ ID NO: 275011 - RNA, 22 nt, Human
uacucaagacaguccaagacag

SEQ ID NO: 275012 - RNA, 22 nt, Human
uagaucacgaggucaggaguuc

SEQ ID NO: 275013 - RNA, 19 nt, Human
uaucaagaaaagcugugaa

SEQ ID NO: 275014 - RNA, 22 nt, Human
ucaaacacaguacaccaaugaa

SEQ ID NO: 275015 - RNA, 22 nt, Human
ucacccaagaaaaagauggagg

SEQ ID NO: 275016 - RNA, 21 nt, Human
ucacgaggucaggaguucaag

SEQ ID NO: 275017 - RNA, 24 nt, Human
ucacgaggucaggaguucaagauc

SEQ ID NO: 275018 - RNA, 24 nt, Human
uccaaaaaggguccuucuuuuaag

SEQ ID NO: 275019 - RNA, 24 nt, Human
uccagccugggcgacagaguaaga

SEQ ID NO: 275020 - RNA, 22 nt, Human
uccccaggcccucaacagucac

SEQ ID NO: 275021 - RNA, 22 nt, Human
uccgaaucuccugcucucucug

SEQ ID NO: 275022 - RNA, 25 nt, Human
ucuccugcucucucugaaaaacaaa

SEQ ID NO: 275023 - RNA, 20 nt, Human
ucucucugaaaaacaaaaaa

SEQ ID NO: 275024 - RNA, 23 nt, Human
ugaaaaacaaaaaauacucaaga

SEQ ID NO: 275025 - RNA, 26 nt, Human
ugaaaaacaaaaaauacucaagacag

SEQ ID NO: 275026 - RNA, 19 nt, Human
ugagccgagaucaugccac

SEQ ID NO: 275027 - RNA, 19 nt, Human
uggacaaaaaaaaaaaaaa

SEQ ID NO: 275028 - RNA, 23 nt, Human
uggacaaaaaaaaaaaaaaccgg

SEQ ID NO: 275029 - RNA, 24 nt, Human
uggacaaaaaaaaaaaaaaccgga

SEQ ID NO: 275030 - RNA, 22 nt, Human
uggcaguuucucuggggcuggg

SEQ ID NO: 275031 - RNA, 21 nt, Human
uggcucaccccuguaauccca

SEQ ID NO: 275032 - RNA, 22 nt, Human
uggcucaccccuguaaucccag

SEQ ID NO: 275033 - RNA, 24 nt, Human
uggcucaccccuguaaucccagca

SEQ ID NO: 275034 - RNA, 20 nt, Human
ugggaggccgagguggguag

SEQ ID NO: 275035 - RNA, 24 nt, Human
ugggaggccgagguggguagauca

SEQ ID NO: 275036 - RNA, 20 nt, Human
ugggggauguuugguuuuug

SEQ ID NO: 275037 - RNA, 21 nt, Human
uggggucaaucccaaaguucc

SEQ ID NO: 275038 - RNA, 18 nt, Human
uggguguccucacccaag

SEQ ID NO: 275039 - RNA, 24 nt, Human
ugguguauguggcaguuucucugg

SEQ ID NO: 275040 - RNA, 18 nt, Human
uguaaggauaagaagcaa

SEQ ID NO: 275041 - RNA, 21 nt, Human
uguggcaguuucucuggggcu

SEQ ID NO: 275042 - RNA, 25 nt, Human
ugugguguauguggcaguuucucug

SEQ ID NO: 275043 - RNA, 24 nt, Human
uguuuaugcccauagcaccuccca

SEQ ID NO: 275044 - RNA, 24 nt, Human
uuaaggguuuugagaaacuagaca

SEQ ID NO: 275045 - RNA, 21 nt, Human
uucaggaaugcaccacacaga

SEQ ID NO: 275046 - RNA, 18 nt, Human
uugcagugagccgagauc

SEQ ID NO: 275047 - RNA, 20 nt, Human
uugcagugagccgagaucau

SEQ ID NO: 275048 - RNA, 21 nt, Human
uugcagugagccgagaucaug

SEQ ID NO: 275049 - RNA, 25 nt, Human
uugggaggccgagguggguagauca

SEQ ID NO: 275050 - RNA, 21 nt, Human
uuuuaaggguuuugagaaacu

SEQ ID NO: 275051 - RNA, 21 nt, Human
uuuuccaggguagaauucugg

SEQ ID NO: 275052 - RNA, 18 nt, Human
aaacucgcccuacuccua

SEQ ID NO: 275053 - RNA, 19 nt, Human
aaaggcuugcagaucgaga

SEQ ID NO: 275054 - RNA, 21 nt, Human
aacaaacacuuacacacugag

SEQ ID NO: 275055 - RNA, 21 nt, Human
aaccagcccugcuuugaaaau

SEQ ID NO: 275056 - RNA, 19 nt, Human
aacuccuugggcagcaccu

SEQ ID NO: 275057 - RNA, 21 nt, Human
aagaaagacauuuaaaaagaa

SEQ ID NO: 275058 - RNA, 19 nt, Human
aagaacacacagcucuaaa

SEQ ID NO: 275059 - RNA, 24 nt, Human
aagaaggcacuaccagcaguuacu

SEQ ID NO: 275060 - RNA, 20 nt, Human
aaggcacuaccagcaguuac

SEQ ID NO: 275061 - RNA, 22 nt, Human
aaguaagagaacucaaagagga

SEQ ID NO: 275062 - RNA, 19 nt, Human
acacaaccaaagaaggcac

SEQ ID NO: 275063 - RNA, 19 nt, Human
acacaaccaaagaaggcac

SEQ ID NO: 275064 - RNA, 21 nt, Human
acacacugagcaacacaacca

SEQ ID NO: 275065 - RNA, 24 nt, Human
acccauacugaacgcgggcucucc

SEQ ID NO: 275066 - RNA, 21 nt, Human
acucgcccuacuccuauuucu

SEQ ID NO: 275067 - RNA, 23 nt, Human
agaaagaacacacagcucuaaaa

SEQ ID NO: 275068 - RNA, 18 nt, Human
agaaagacauuuaaaaag

SEQ ID NO: 275069 - RNA, 23 nt, Human
agagaggcaacuauuugguuggu

SEQ ID NO: 275070 - RNA, 21 nt, Human
agccagggccagggcaggcug

SEQ ID NO: 275071 - RNA, 21 nt, Human
aggagaagccagcagcagagc

SEQ ID NO: 275072 - RNA, 23 nt, Human
aggcaacuauuugguuggugaaa

SEQ ID NO: 275073 - RNA, 18 nt, Human
agggagagaguuucuaaa

SEQ ID NO: 275074 - RNA, 18 nt, Human
agggagggaagugauaag

SEQ ID NO: 275075 - RNA, 18 nt, Human
agguuccaguuuggugac

SEQ ID NO: 275076 - RNA, 22 nt, Human
aguaagagaacucaaagaggaa

SEQ ID NO: 275077 - RNA, 19 nt, Human
agucgcagugggaggaggg

SEQ ID NO: 275078 - RNA, 24 nt, Human
agugcuggaggccgauggggaacc

SEQ ID NO: 275079 - RNA, 21 nt, Human
auaaacacccuuaucucuuua

SEQ ID NO: 275080 - RNA, 23 nt, Human
caaagaggaaucaaugccagaga

SEQ ID NO: 275081 - RNA, 27 nt, Human
caacacaaccaaagaaggcacuaccag

SEQ ID NO: 275082 - RNA, 21 nt, Human
caaccaaagaaggcacuacca

SEQ ID NO: 275083 - RNA, 20 nt, Human
caaugugggccagggccaga

SEQ ID NO: 275084 - RNA, 23 nt, Human
cacaaccaaagaaggcacuacca

SEQ ID NO: 275085 - RNA, 25 nt, Human
caccgccgccauuguucacuuccug

SEQ ID NO: 275086 - RNA, 19 nt, Human
cacuuacacacugagcaac

SEQ ID NO: 275087 - RNA, 21 nt, Human
cagaaucugugguggggcaca

SEQ ID NO: 275088 - RNA, 20 nt, Human
cagcagcauucacagcgguu

SEQ ID NO: 275089 - RNA, 20 nt, Human
cagcaggagccaugccuucu

SEQ ID NO: 275090 - RNA, 18 nt, Human
cagcauaggccuuggguc

SEQ ID NO: 275091 - RNA, 18 nt, Human
cagcgguugcagcaggag

SEQ ID NO: 275092 - RNA, 24 nt, Human
cagcucuaaaaccuuucuuccuuc

SEQ ID NO: 275093 - RNA, 18 nt, Human
cagcugaacccucgugca

SEQ ID NO: 275094 - RNA, 21 nt, Human
cagcugaacccucgugcaaac

SEQ ID NO: 275095 - RNA, 21 nt, Human
caggcaccuuggggccgcggg

SEQ ID NO: 275096 - RNA, 22 nt, Human
caggggcuuagcucagaccugc

SEQ ID NO: 275097 - RNA, 18 nt, Human
caguucauacgacgaggg

SEQ ID NO: 275098 - RNA, 19 nt, Human
cauaaacacccuuaucucu

SEQ ID NO: 275099 - RNA, 24 nt, Human
caugugcaaugugggccagggcca

SEQ ID NO: 275100 - RNA, 18 nt, Human
cauuacccugcuuucagg

SEQ ID NO: 275101 - RNA, 18 nt, Human
ccagcagcagagcuucag

SEQ ID NO: 275102 - RNA, 24 nt, Human
ccggcuaguggcggcagcuuuggc

SEQ ID NO: 275103 - RNA, 22 nt, Human
ccucgugcaaacacuuguccau

SEQ ID NO: 275104 - RNA, 19 nt, Human
ccugucaauguggucuggu

SEQ ID NO: 275105 - RNA, 20 nt, Human
ccuuucuuccuuccuuugcc

SEQ ID NO: 275106 - RNA, 23 nt, Human
cucuaaaaccuuucuuccuuccu

SEQ ID NO: 275107 - RNA, 21 nt, Human
cuggaaacaaacacuuacaca

SEQ ID NO: 275108 - RNA, 23 nt, Human
cuggggaaggcugaagacagcuu

SEQ ID NO: 275109 - RNA, 22 nt, Human
cuuacacacugagcaacacaac

SEQ ID NO: 275110 - RNA, 23 nt, Human
cuuuauguguauauauacaugac

SEQ ID NO: 275111 - RNA, 21 nt, Human
gaaaggcuugcagaucgagag

SEQ ID NO: 275112 - RNA, 19 nt, Human
gaacacacagcucuaaaac

SEQ ID NO: 275113 - RNA, 26 nt, Human
gagcaugagauggcuaaccagggaga

SEQ ID NO: 275114 - RNA, 19 nt, Human
gagccagccucagcuuugg

SEQ ID NO: 275115 - RNA, 20 nt, Human
gagucgcagugggaggaggg

SEQ ID NO: 275116 - RNA, 21 nt, Human
gcaaauguaagucaggaauuu

SEQ ID NO: 275117 - RNA, 24 nt, Human
gcacugaggucgacggggaggcca

SEQ ID NO: 275118 - RNA, 23 nt, Human
gcagugccgggucuggcccaugc

SEQ ID NO: 275119 - RNA, 19 nt, Human
gcagugcuggaggccgaug

SEQ ID NO: 275120 - RNA, 18 nt, Human
gccagagaaagaacacac

SEQ ID NO: 275121 - RNA, 20 nt, Human
gcuaguggcggcagcuuugg

SEQ ID NO: 275122 - RNA, 20 nt, Human
gcucuaaaaccuuucuuccu

SEQ ID NO: 275123 - RNA, 21 nt, Human
gcugaacccucgugcaaacac

SEQ ID NO: 275124 - RNA, 28 nt, Human
gcugcagcuucucuggagaucucugauc

SEQ ID NO: 275125 - RNA, 20 nt, Human
ggaaaaccagcccugcuuug

SEQ ID NO: 275126 - RNA, 20 nt, Human
ggaagugauaaggcugagca

SEQ ID NO: 275127 - RNA, 20 nt, Human
ggagggaagugauaaggcug

SEQ ID NO: 275128 - RNA, 20 nt, Human
gggaacuucugaagcuacac

SEQ ID NO: 275129 - RNA, 23 nt, Human
gggaaggcagaggauagcaaaga

SEQ ID NO: 275130 - RNA, 25 nt, Human
gggaggagggaggcagugcuggagg

SEQ ID NO: 275131 - RNA, 23 nt, Human
gggcaguauggacucagccuggg

SEQ ID NO: 275132 - RNA, 23 nt, Human
gugcuggaggccgauggggaacc

SEQ ID NO: 275133 - RNA, 20 nt, Human
guggcggcagcuuuggcagc

SEQ ID NO: 275134 - RNA, 22 nt, Human
uaaaaagaaaauauccuggaaa

SEQ ID NO: 275135 - RNA, 19 nt, Human
uaaguaccacacauacgca

SEQ ID NO: 275136 - RNA, 20 nt, Human
uaaguaccacacauacgcag

SEQ ID NO: 275137 - RNA, 21 nt, Human
uaagugugaacaacaggcacc

SEQ ID NO: 275138 - RNA, 18 nt, Human
uaauauacagcagggaga

SEQ ID NO: 275139 - RNA, 23 nt, Human
uaccacacauacgcagauauaug

SEQ ID NO: 275140 - RNA, 20 nt, Human
uaccagcaguuacucccacc

SEQ ID NO: 275141 - RNA, 22 nt, Human
uacccugcuuucaggggcuuag

SEQ ID NO: 275142 - RNA, 21 nt, Human
uagcaaagaaaugguuucuca

SEQ ID NO: 275143 - RNA, 21 nt, Human
uagcuuuauaaacuucccuua

SEQ ID NO: 275144 - RNA, 19 nt, Human
uauaugccuuuauguguau

SEQ ID NO: 275145 - RNA, 26 nt, Human
uauaugccuuuauguguauauauuac

SEQ ID NO: 275146 - RNA, 21 nt, Human
uaucacugauuggagucaaaa

SEQ ID NO: 275147 - RNA, 18 nt, Human
uauguguauauauacaug

SEQ ID NO: 275148 - RNA, 20 nt, Human
uauguguauauauacaugac

SEQ ID NO: 275149 - RNA, 20 nt, Human
ucaaaacagaaaggacucca

SEQ ID NO: 275150 - RNA, 18 nt, Human
ucacaugaguucugaucc

SEQ ID NO: 275151 - RNA, 21 nt, Human
ucagccuaaacaagaagccag

SEQ ID NO: 275152 - RNA, 21 nt, Human
ucaggcacccagaugggaggg

SEQ ID NO: 275153 - RNA, 23 nt, Human
uccaugugcaaugugggccaggg

SEQ ID NO: 275154 - RNA, 18 nt, Human
ucuccaccugcucccuuu

SEQ ID NO: 275155 - RNA, 18 nt, Human
ucucucugaaaacaaaaa

SEQ ID NO: 275156 - RNA, 21 nt, Human
ucucugagccagccucagcuu

SEQ ID NO: 275157 - RNA, 26 nt, Human
ucuguaaucaaggcaacuccuugggc

SEQ ID NO: 275158 - RNA, 24 nt, Human
ucugugguggggcacagccggggc

SEQ ID NO: 275159 - RNA, 21 nt, Human
ugaaaacaaaaaggcacugag

SEQ ID NO: 275160 - RNA, 18 nt, Human
ugaaaauuacaaguccuu

SEQ ID NO: 275161 - RNA, 23 nt, Human
ugaaaauuacaaguccuucuccc

SEQ ID NO: 275162 - RNA, 18 nt, Human
ugaacgcgggcucuccug

SEQ ID NO: 275163 - RNA, 27 nt, Human
ugacgagagaggcaacuauuugguugg

SEQ ID NO: 275164 - RNA, 18 nt, Human
ugacuaaguaccacacau

SEQ ID NO: 275165 - RNA, 20 nt, Human
ugagaaaaagugucuguugc

SEQ ID NO: 275166 - RNA, 23 nt, Human
ugagaaaaagugucuguugcaaa

SEQ ID NO: 275167 - RNA, 20 nt, Human
ugagcaugagauggcuaacc

SEQ ID NO: 275168 - RNA, 19 nt, Human
ugaggucgacggggaggcc

SEQ ID NO: 275169 - RNA, 19 nt, Human
ugcaaaaggaaugugcuac

SEQ ID NO: 275170 - RNA, 24 nt, Human
ugcacuggagugucucugcagucc

SEQ ID NO: 275171 - RNA, 18 nt, Human
ugccacagcuggaacugc

SEQ ID NO: 275172 - RNA, 19 nt, Human
ugccacagcuggaacugcu

SEQ ID NO: 275173 - RNA, 23 nt, Human
ugccagagaaagaacacacagcu

SEQ ID NO: 275174 - RNA, 19 nt, Human
ugccuuuauguguauauau

SEQ ID NO: 275175 - RNA, 18 nt, Human
uggcaggagaagccagca

SEQ ID NO: 275176 - RNA, 19 nt, Human
uggcuucccuuuggggaaa

SEQ ID NO: 275177 - RNA, 25 nt, Human
ugggaggagggaggcagugcuggag

SEQ ID NO: 275178 - RNA, 25 nt, Human
ugggcaggcacaaaugcaccugcca

SEQ ID NO: 275179 - RNA, 18 nt, Human
uggggaaacacaugacga

SEQ ID NO: 275180 - RNA, 22 nt, Human
ugguggggcacagccugggggc

SEQ ID NO: 275181 - RNA, 20 nt, Human
ugugaacaacaggcaccuug

SEQ ID NO: 275182 - RNA, 23 nt, Human
ugugggccagggccagagccagg

SEQ ID NO: 275183 - RNA, 22 nt, Human
ugugguggggcacagccugggg

SEQ ID NO: 275184 - RNA, 24 nt, Human
ugugguggggcacagccugggggc

SEQ ID NO: 275185 - RNA, 21 nt, Human
ugugguuuaaaaaaaucuuag

SEQ ID NO: 275186 - RNA, 20 nt, Human
uuauguguauauauacauga

SEQ ID NO: 275187 - RNA, 21 nt, Human
uuauguguauauauacaugac

SEQ ID NO: 275188 - RNA, 22 nt, Human
uuauguguauauauacaugacc

SEQ ID NO: 275189 - RNA, 22 nt, Human
uucaaaacagaaaggacuccaa

SEQ ID NO: 275190 - RNA, 19 nt, Human
uugaaaauuacaaguccuu

SEQ ID NO: 275191 - RNA, 21 nt, Human
uugccacagcuggaacugcug

SEQ ID NO: 275192 - RNA, 24 nt, Human
uugccacagcuggaacugcugggc

SEQ ID NO: 275193 - RNA, 20 nt, Human
uuggaauuuuuugacuaauu

SEQ ID NO: 275194 - RNA, 19 nt, Human
uugggcagcaccuggagau

SEQ ID NO: 275195 - RNA, 25 nt, Human
uuuaugagcauuacccugcuuucag

SEQ ID NO: 275196 - RNA, 19 nt, Human
uuuauguguauauauacau

SEQ ID NO: 275197 - RNA, 24 nt, Human
aaaaaaguauacaaagggaucccu

SEQ ID NO: 275198 - RNA, 23 nt, Human
aaaccagggcacagcgacaagga

SEQ ID NO: 275199 - RNA, 18 nt, Human
aaagccuuugggaggaaa

SEQ ID NO: 275200 - RNA, 18 nt, Human
aaaggaaggcaggggaga

SEQ ID NO: 275201 - RNA, 18 nt, Human
aacaggacaccggugggg

SEQ ID NO: 275202 - RNA, 23 nt, Human
aacccaggagggccgaggaaacc

SEQ ID NO: 275203 - RNA, 19 nt, Human
aaccccagagaaaaaaacc

SEQ ID NO: 275204 - RNA, 18 nt, Human
aagccuuugggaggaaag

SEQ ID NO: 275205 - RNA, 23 nt, Human
acacacacacacacacacacaca

SEQ ID NO: 275206 - RNA, 23 nt, Human
acacacacacacacacacacaca

SEQ ID NO: 275207 - RNA, 23 nt, Human
acacacacacacacacacacaca

SEQ ID NO: 275208 - RNA, 23 nt, Human
acacacacacacacacacacaca

SEQ ID NO: 275209 - RNA, 31 nt, Human
acacacacacacacacacacaggcacgcaca

SEQ ID NO: 275210 - RNA, 23 nt, Human
acacacacacacacacacacagu

SEQ ID NO: 275211 - RNA, 25 nt, Human
acacacacacacacaggcacgcagu

SEQ ID NO: 275212 - RNA, 21 nt, Human
accacugaggggcgagaagcc

SEQ ID NO: 275213 - RNA, 18 nt, Human
acccaaacugaacaacaa

SEQ ID NO: 275214 - RNA, 23 nt, Human
accccagagaaaaaaacccccac

SEQ ID NO: 275215 - RNA, 20 nt, Human
acccgugaguugcccuuguc

SEQ ID NO: 275216 - RNA, 19 nt, Human
acgucagcucagcgucacc

SEQ ID NO: 275217 - RNA, 19 nt, Human
acugguaucaaaaucuaaa

SEQ ID NO: 275218 - RNA, 18 nt, Human
agacacccaaacugaaca

SEQ ID NO: 275219 - RNA, 19 nt, Human
agagggagugggaacagag

SEQ ID NO: 275220 - RNA, 26 nt, Human
agcgucacccacucauggcugguggc

SEQ ID NO: 275221 - RNA, 22 nt, Human
agcuauaaaggauuggaaagaa

SEQ ID NO: 275222 - RNA, 25 nt, Human
aggcagagcgagggccacagggggu

SEQ ID NO: 275223 - RNA, 18 nt, Human
agggauggcagagcaagg

SEQ ID NO: 275224 - RNA, 22 nt, Human
agggcaacaagccugagggaca

SEQ ID NO: 275225 - RNA, 20 nt, Human
agggcacagcgacaaggaca

SEQ ID NO: 275226 - RNA, 23 nt, Human
agggccacagggggucccagagg

SEQ ID NO: 275227 - RNA, 22 nt, Human
aucacacacacacacacacaca

SEQ ID NO: 275228 - RNA, 20 nt, Human
auuucauccccaagggugaa

SEQ ID NO: 275229 - RNA, 25 nt, Human
caaagugggaagauccuuauugcca

SEQ ID NO: 275230 - RNA, 20 nt, Human
caacaagauaugcccacgua

SEQ ID NO: 275231 - RNA, 18 nt, Human
caagacacaacaaacagg

SEQ ID NO: 275232 - RNA, 22 nt, Human
caaggaguaaacccaggagggc

SEQ ID NO: 275233 - RNA, 23 nt, Human
caagugacccauccaaagucauc

SEQ ID NO: 275234 - RNA, 25 nt, Human
caagugacccauccaaagucaucca

SEQ ID NO: 275235 - RNA, 20 nt, Human
cacacacacacacacacaca

SEQ ID NO: 275236 - RNA, 20 nt, Human
cacacacacacacacacaca

SEQ ID NO: 275237 - RNA, 20 nt, Human
cacacacacacacacacaca

SEQ ID NO: 275238 - RNA, 20 nt, Human
cacacacacacacacacaca

SEQ ID NO: 275239 - RNA, 20 nt, Human
cacacacacacacacacaca

SEQ ID NO: 275240 - RNA, 20 nt, Human
cacacacacacacacacaca

SEQ ID NO: 275241 - RNA, 20 nt, Human
cacacacacacacacacaca

SEQ ID NO: 275242 - RNA, 22 nt, Human
cacacacacacacacacacaca

SEQ ID NO: 275243 - RNA, 22 nt, Human
cacacacacacacacacacaca

SEQ ID NO: 275244 - RNA, 26 nt, Human
cacacacacacacacacacacacaca

SEQ ID NO: 275245 - RNA, 26 nt, Human
cacacacacacacacacacacacaca

SEQ ID NO: 275246 - RNA, 26 nt, Human
cacacacacacacacacacacacaca

SEQ ID NO: 275247 - RNA, 26 nt, Human
cacacacacacacacacacacacaca

SEQ ID NO: 275248 - RNA, 28 nt, Human
cacacacacacacacacacacacaggca

SEQ ID NO: 275249 - RNA, 21 nt, Human
caccaggaggauccaggcuuc

SEQ ID NO: 275250 - RNA, 19 nt, Human
cagauuagaaaagcauugc

SEQ ID NO: 275251 - RNA, 24 nt, Human
cagcgacaaggacaggaggcagag

SEQ ID NO: 275252 - RNA, 23 nt, Human
caggagccggggugacaggugcu

SEQ ID NO: 275253 - RNA, 21 nt, Human
caggcagacgucaagagaggc

SEQ ID NO: 275254 - RNA, 23 nt, Human
caggguagaaccagcagaacauu

SEQ ID NO: 275255 - RNA, 25 nt, Human
cauaaaaaaggagaaagggggacuu

SEQ ID NO: 275256 - RNA, 21 nt, Human
cauccacuuuaaccagcuucc

SEQ ID NO: 275257 - RNA, 19 nt, Human
ccaagaugauuucaccagg

SEQ ID NO: 275258 - RNA, 20 nt, Human
ccaccaggcuucuuugaaca

SEQ ID NO: 275259 - RNA, 22 nt, Human
ccaggcuucaggcuacacggag

SEQ ID NO: 275260 - RNA, 21 nt, Human
ccauccuuggggacccugcag

SEQ ID NO: 275261 - RNA, 20 nt, Human
cccaaacugaacaacaagau

SEQ ID NO: 275262 - RNA, 22 nt, Human
cccacguacaguauauaaaaga

SEQ ID NO: 275263 - RNA, 21 nt, Human
cccagagaaaaaaacccccac

SEQ ID NO: 275264 - RNA, 21 nt, Human
cccaucacacacacacacaca

SEQ ID NO: 275265 - RNA, 19 nt, Human
ccccaagggugaagcagca

SEQ ID NO: 275266 - RNA, 20 nt, Human
ccccagagaaaaaaaccccc

SEQ ID NO: 275267 - RNA, 24 nt, Human
cccccacuguaaagcccuuucaaa

SEQ ID NO: 275268 - RNA, 21 nt, Human
cccuuggaugcuauugcugga

SEQ ID NO: 275269 - RNA, 23 nt, Human
cccuugucggcaagagagggagu

SEQ ID NO: 275270 - RNA, 24 nt, Human
ccguccgcucggccgcugcucgcu

SEQ ID NO: 275271 - RNA, 19 nt, Human
ccucuuuagcagacaccca

SEQ ID NO: 275272 - RNA, 24 nt, Human
ccuucccaccauuuacucugagag

SEQ ID NO: 275273 - RNA, 20 nt, Human
cgacaaggacaggaggcaga

SEQ ID NO: 275274 - RNA, 22 nt, Human
cgacaaggacaggaggcagagc

SEQ ID NO: 275275 - RNA, 24 nt, Human
cgagaagcccgaggagggaaacca

SEQ ID NO: 275276 - RNA, 21 nt, Human
cgaggaaaccacugaggggcg

SEQ ID NO: 275277 - RNA, 21 nt, Human
cgcugcccggccgccccucgg

SEQ ID NO: 275278 - RNA, 23 nt, Human
cuaaaugcagcaaauucugggaa

SEQ ID NO: 275279 - RNA, 23 nt, Human
cuacacggagagcaggagccggg

SEQ ID NO: 275280 - RNA, 22 nt, Human
cuccauguggcaggaacaggac

SEQ ID NO: 275281 - RNA, 18 nt, Human
cugcagucugggaggcca

SEQ ID NO: 275282 - RNA, 19 nt, Human
cugccagggauggcagagc

SEQ ID NO: 275283 - RNA, 20 nt, Human
cugggccuuuggggucuugg

SEQ ID NO: 275284 - RNA, 21 nt, Human
gaaagaaagccuuugggagga

SEQ ID NO: 275285 - RNA, 23 nt, Human
gagcaggagccggggugacaggu

SEQ ID NO: 275286 - RNA, 19 nt, Human
gagggcaacaagccugagg

SEQ ID NO: 275287 - RNA, 23 nt, Human
gagggcaacaagccugagggaca

SEQ ID NO: 275288 - RNA, 19 nt, Human
gaguaaacccaggagggcc

SEQ ID NO: 275289 - RNA, 22 nt, Human
gaugcuauugcuggaggagggg

SEQ ID NO: 275290 - RNA, 22 nt, Human
gauuugcacaauccauuggaug

SEQ ID NO: 275291 - RNA, 19 nt, Human
gcaugaagucaagcuccau

SEQ ID NO: 275292 - RNA, 31 nt, Human
gcccaucacacacacacacacacacacacag

SEQ ID NO: 275293 - RNA, 20 nt, Human
gcccugaacccuuucuaacu

SEQ ID NO: 275294 - RNA, 24 nt, Human
gccuuuggggucuuggugccccca

SEQ ID NO: 275295 - RNA, 19 nt, Human
gcucagagagcuugugccu

SEQ ID NO: 275296 - RNA, 21 nt, Human
ggaauuggggaggcgucucca

SEQ ID NO: 275297 - RNA, 19 nt, Human
ggacaggaggcagagcgag

SEQ ID NO: 275298 - RNA, 21 nt, Human
ggacaggaggcagagcgaggg

SEQ ID NO: 275299 - RNA, 22 nt, Human
ggcacagcgacaaggacaggag

SEQ ID NO: 275300 - RNA, 22 nt, Human
ggccuuuggggucuuggugccc

SEQ ID NO: 275301 - RNA, 21 nt, Human
ggcgagaagcccgaggaggga

SEQ ID NO: 275302 - RNA, 22 nt, Human
ggcuggaaacgcggcauaaaua

SEQ ID NO: 275303 - RNA, 24 nt, Human
gggauuugcacaauccauuggaug

SEQ ID NO: 275304 - RNA, 18 nt, Human
ggguggguuuggggaggg

SEQ ID NO: 275305 - RNA, 22 nt, Human
guauagcaagacacaacaaaca

SEQ ID NO: 275306 - RNA, 18 nt, Human
guccugucugaagaccuc

SEQ ID NO: 275307 - RNA, 19 nt, Human
uaacagguuuaaaacuuug

SEQ ID NO: 275308 - RNA, 23 nt, Human
uaacagguuuaaaacuuuggaga

SEQ ID NO: 275309 - RNA, 21 nt, Human
uaacuagaacaauuauggggc

SEQ ID NO: 275310 - RNA, 22 nt, Human
uaacuuccaggccccuuggaug

SEQ ID NO: 275311 - RNA, 24 nt, Human
uaaguagcuccucacccagcggcu

SEQ ID NO: 275312 - RNA, 24 nt, Human
uaaugucccuccuuuauccuauca

SEQ ID NO: 275313 - RNA, 18 nt, Human
uauaaaggauuggaaaga

SEQ ID NO: 275314 - RNA, 22 nt, Human
uaucuucauugccagccuguua

SEQ ID NO: 275315 - RNA, 24 nt, Human
uaugggccagggacacguuucuug

SEQ ID NO: 275316 - RNA, 19 nt, Human
ucaacagguugccucuuag

SEQ ID NO: 275317 - RNA, 23 nt, Human
ucaacugcagagggcaacaagcc

SEQ ID NO: 275318 - RNA, 21 nt, Human
ucaauuucccacuccucuccc

SEQ ID NO: 275319 - RNA, 21 nt, Human
ucacacacacacacacacaca

SEQ ID NO: 275320 - RNA, 21 nt, Human
ucacuuuaacagucuccuggc

SEQ ID NO: 275321 - RNA, 19 nt, Human
ucagcccucucugucuuug

SEQ ID NO: 275322 - RNA, 21 nt, Human
ucaguggcugagggacuggcu

SEQ ID NO: 275323 - RNA, 21 nt, Human
ucccaccccaaguuguggcuc

SEQ ID NO: 275324 - RNA, 21 nt, Human
ucccuggggaauuggggaggc

SEQ ID NO: 275325 - RNA, 23 nt, Human
uccuuggggacccugcagucugg

SEQ ID NO: 275326 - RNA, 18 nt, Human
ucugauggcugugucuag

SEQ ID NO: 275327 - RNA, 20 nt, Human
ugaggacaagugacccaucc

SEQ ID NO: 275328 - RNA, 18 nt, Human
ugaggcaucaugagcccg

SEQ ID NO: 275329 - RNA, 22 nt, Human
ugaggggcgagaagcccgagga

SEQ ID NO: 275330 - RNA, 20 nt, Human
ugauuucaccaggaggaucc

SEQ ID NO: 275331 - RNA, 24 nt, Human
ugccagggauggcagagcaaggug

SEQ ID NO: 275332 - RNA, 20 nt, Human
ugcccggccgccccucggag

SEQ ID NO: 275333 - RNA, 21 nt, Human
uggagaucaacugcagagggc

SEQ ID NO: 275334 - RNA, 22 nt, Human
uggaugcuauugcuggaggagg

SEQ ID NO: 275335 - RNA, 20 nt, Human
uggcagagcaaggugaguca

SEQ ID NO: 275336 - RNA, 23 nt, Human
uggcaggaacaggacaccggugg

SEQ ID NO: 275337 - RNA, 24 nt, Human
uggcaggaacaggacaccgguggg

SEQ ID NO: 275338 - RNA, 20 nt, Human
uggcaugaagucaagcucca

SEQ ID NO: 275339 - RNA, 19 nt, Human
uggcucagagagcuugugc

SEQ ID NO: 275340 - RNA, 18 nt, Human
ugggaacugccugacacu

SEQ ID NO: 275341 - RNA, 19 nt, Human
ugggaagauccuuauugcc

SEQ ID NO: 275342 - RNA, 23 nt, Human
ugggaaugccucuuucauuggga

SEQ ID NO: 275343 - RNA, 19 nt, Human
ugggacguguccuaagguc

SEQ ID NO: 275344 - RNA, 25 nt, Human
ugggaggaaagcuacuaggagcugg

SEQ ID NO: 275345 - RNA, 21 nt, Human
ugggaggccacuaggauuucu

SEQ ID NO: 275346 - RNA, 22 nt, Human
ugggccagggacacguuucuug

SEQ ID NO: 275347 - RNA, 20 nt, Human
uguggaagagugagcagggg

SEQ ID NO: 275348 - RNA, 24 nt, Human
uguuuguucuuuauaucuguggaa

SEQ ID NO: 275349 - RNA, 19 nt, Human
uuaaaggaaggcaggggag

SEQ ID NO: 275350 - RNA, 19 nt, Human
uuaacagucuccuggccug

SEQ ID NO: 275351 - RNA, 24 nt, Human
uuaaucaauuucccacuccucucc

SEQ ID NO: 275352 - RNA, 21 nt, Human
uuagaaugggcuucccuucag

SEQ ID NO: 275353 - RNA, 22 nt, Human
uucauauucuuuagguucguau

SEQ ID NO: 275354 - RNA, 22 nt, Human
uuccaaccucauccacuuuaac

SEQ ID NO: 275355 - RNA, 19 nt, Human
uuccagugguuucaugcac

SEQ ID NO: 275356 - RNA, 23 nt, Human
uuggacacaacaguuuccuuccc

SEQ ID NO: 275357 - RNA, 21 nt, Human
uuggaugcuauugcuggagga

SEQ ID NO: 275358 - RNA, 23 nt, Human
uuggaugcuauugcuggaggagg

SEQ ID NO: 275359 - RNA, 24 nt, Human
uuggugcccccacuguaaagcccu

SEQ ID NO: 275360 - RNA, 22 nt, Human
uuuauaucuguggaagagugag

SEQ ID NO: 275361 - RNA, 25 nt, Human
uuucagguacaugggcguggacccu

SEQ ID NO: 275362 - RNA, 24 nt, Human
uuuccaaccucauccacuuuaacc

SEQ ID NO: 275363 - RNA, 24 nt, Human
uuuccauccuuggggacccugcag

SEQ ID NO: 275364 - RNA, 19 nt, Human
uuucccacuccucucccca

SEQ ID NO: 275365 - RNA, 18 nt, Human
uuucuuggcauugagggu

SEQ ID NO: 275366 - RNA, 20 nt, Human
aaauaacuguacacaaggca

SEQ ID NO: 275367 - RNA, 18 nt, Human
aggaggcuccgaucaauc

SEQ ID NO: 275368 - RNA, 22 nt, Human
aggaggcuccgaucaauccagg

SEQ ID NO: 275369 - RNA, 20 nt, Human
aggaggucaaguaaagggcu

SEQ ID NO: 275370 - RNA, 21 nt, Human
aguucugugccggcagcuuua

SEQ ID NO: 275371 - RNA, 25 nt, Human
auaucacuuuccuccaucuccccag

SEQ ID NO: 275372 - RNA, 24 nt, Human
auaucuccaucaaggaaucauaca

SEQ ID NO: 275373 - RNA, 18 nt, Human
aucuccccaggcccugug

SEQ ID NO: 275374 - RNA, 24 nt, Human
cacuguggggcuugcagcuggcug

SEQ ID NO: 275375 - RNA, 21 nt, Human
cccaggcccugugaccucaga

SEQ ID NO: 275376 - RNA, 20 nt, Human
cuccgaucaauccagggugc

SEQ ID NO: 275377 - RNA, 27 nt, Human
cucuauggcuuuacaaagcaggucacu

SEQ ID NO: 275378 - RNA, 21 nt, Human
gaaauaagacuugaggcuggg

SEQ ID NO: 275379 - RNA, 22 nt, Human
gccggcagcuuuaaccccuccu

SEQ ID NO: 275380 - RNA, 21 nt, Human
ggaacagacuggguguuaguu

SEQ ID NO: 275381 - RNA, 21 nt, Human
gggaccagggaggccccaguu

SEQ ID NO: 275382 - RNA, 20 nt, Human
uaaauaacuguacacaaggc

SEQ ID NO: 275383 - RNA, 25 nt, Human
uacacaaggcaguuaaauacacagu

SEQ ID NO: 275384 - RNA, 24 nt, Human
uccuccaucuccccaggcccugug

SEQ ID NO: 275385 - RNA, 23 nt, Human
ucuccaagggaccagggaggccc

SEQ ID NO: 275386 - RNA, 20 nt, Human
ugaggaaauaagacuugagg

SEQ ID NO: 275387 - RNA, 18 nt, Human
uggcauuuaagauuuugu

SEQ ID NO: 275388 - RNA, 22 nt, Human
uggggagcaacguugaggaaau

SEQ ID NO: 275389 - RNA, 21 nt, Human
uggucacuugaaguggugcac

SEQ ID NO: 275390 - RNA, 21 nt, Human
ugguggucacuugaaguggug

SEQ ID NO: 275391 - RNA, 22 nt, Human
uucauguaaauaucuccaucaa

SEQ ID NO: 275392 - RNA, 18 nt, Human
uuuuuuuuuuuuuuuugu

SEQ ID NO: 275393 - RNA, 23 nt, Human
cucccggaacuggaagggaaagc

SEQ ID NO: 275394 - RNA, 18 nt, Human
gaacuggaagggaaagcc

SEQ ID NO: 275395 - RNA, 23 nt, Human
uggaagggaaagccaggcggcuc

SEQ ID NO: 275396 - RNA, 21 nt, Human
aagcacuuggggcuccgggac

SEQ ID NO: 275397 - RNA, 22 nt, Human
acacccugagugccccgugggc

SEQ ID NO: 275398 - RNA, 21 nt, Human
agcacuuguagguguugggga

SEQ ID NO: 275399 - RNA, 18 nt, Human
cacagcgcucacccacga

SEQ ID NO: 275400 - RNA, 18 nt, Human
cccccguucuggcagggg

SEQ ID NO: 275401 - RNA, 20 nt, Human
cccguucuggcagggguggg

SEQ ID NO: 275402 - RNA, 22 nt, Human
cgugggcaggagcacuuguagg

SEQ ID NO: 275403 - RNA, 23 nt, Human
gagugccccgugggcaggagcac

SEQ ID NO: 275404 - RNA, 19 nt, Human
gcgggcaggugcagcugua

SEQ ID NO: 275405 - RNA, 21 nt, Human
uagguguuggggaggucgagg

SEQ ID NO: 275406 - RNA, 18 nt, Human
ugcacacccugagugccc

SEQ ID NO: 275407 - RNA, 28 nt, Human
ugccccgugggcaggagcacuuguaggu

SEQ ID NO: 275408 - RNA, 19 nt, Human
uuggggaggucgaggcagg

SEQ ID NO: 275409 - RNA, 21 nt, Human
aaaaacaacaaacucacaccc

SEQ ID NO: 275410 - RNA, 21 nt, Human
aaacaaaaaaaccuaucccca

SEQ ID NO: 275411 - RNA, 24 nt, Human
aaacaaaaaaaccuauccccaaag

SEQ ID NO: 275412 - RNA, 25 nt, Human
aaacaaacaaaaaaaccuaucccca

SEQ ID NO: 275413 - RNA, 20 nt, Human
aaacaaguccaacuuuccaa

SEQ ID NO: 275414 - RNA, 20 nt, Human
aaacagauauaauaucacuu

SEQ ID NO: 275415 - RNA, 19 nt, Human
aaagaaauugccaagagca

SEQ ID NO: 275416 - RNA, 19 nt, Human
aaauuggcaaauucaauaa

SEQ ID NO: 275417 - RNA, 24 nt, Human
aagaaagucaaagaaauugccaag

SEQ ID NO: 275418 - RNA, 20 nt, Human
aagaauguccaaggaggagg

SEQ ID NO: 275419 - RNA, 21 nt, Human
aagagaaauguacacaaggaa

SEQ ID NO: 275420 - RNA, 23 nt, Human
aagcaccaaaugaagacaaaaga

SEQ ID NO: 275421 - RNA, 22 nt, Human
aaggauccaaauuaaaguaguc

SEQ ID NO: 275422 - RNA, 25 nt, Human
aaggcaccuugucccugagcaacca

SEQ ID NO: 275423 - RNA, 19 nt, Human
aauaaaaauaaaccaaaaa

SEQ ID NO: 275424 - RNA, 24 nt, Human
aaucaguagagacugaucaucuga

SEQ ID NO: 275425 - RNA, 19 nt, Human
aauucccaacaggacgcua

SEQ ID NO: 275426 - RNA, 24 nt, Human
aauuucacuuaaggaauguuacaa

SEQ ID NO: 275427 - RNA, 22 nt, Human
acaaacucacacccuucuuccu

SEQ ID NO: 275428 - RNA, 21 nt, Human
acacgcaggguuuccauaugg

SEQ ID NO: 275429 - RNA, 21 nt, Human
accaaucauuuacauaacagc

SEQ ID NO: 275430 - RNA, 21 nt, Human
accauaccaaaguaaaccuug

SEQ ID NO: 275431 - RNA, 22 nt, Human
agaaaacaaguccaacuuucca

SEQ ID NO: 275432 - RNA, 22 nt, Human
agaaaacuauucuuuaucuaca

SEQ ID NO: 275433 - RNA, 26 nt, Human
agacaggaggggaaaggagaccaaag

SEQ ID NO: 275434 - RNA, 26 nt, Human
agagaucaguaaaaaguuugaaaggc

SEQ ID NO: 275435 - RNA, 19 nt, Human
agaggaaaagaaaugguag

SEQ ID NO: 275436 - RNA, 22 nt, Human
agcagcauuuacaaaagucagu

SEQ ID NO: 275437 - RNA, 18 nt, Human
agcauccaucuuauucuc

SEQ ID NO: 275438 - RNA, 22 nt, Human
aggaagaaaaaaagaaguuugg

SEQ ID NO: 275439 - RNA, 23 nt, Human
aggcaggcagaagaggagucaaa

SEQ ID NO: 275440 - RNA, 23 nt, Human
aggcugcuauauaguuccuccuu

SEQ ID NO: 275441 - RNA, 18 nt, Human
agggcagaaaggggcagg

SEQ ID NO: 275442 - RNA, 19 nt, Human
aggggaggaucuauacaug

SEQ ID NO: 275443 - RNA, 24 nt, Human
aguuuggugcuaggcuuuguggga

SEQ ID NO: 275444 - RNA, 24 nt, Human
auaagaacaucuucucuuuccuac

SEQ ID NO: 275445 - RNA, 24 nt, Human
aucacuuuuaagagaaauguacac

SEQ ID NO: 275446 - RNA, 24 nt, Human
auggaccaauuauuaacuggccca

SEQ ID NO: 275447 - RNA, 21 nt, Human
auggagagaauaaagcagaga

SEQ ID NO: 275448 - RNA, 20 nt, Human
augucucuacacuggaggug

SEQ ID NO: 275449 - RNA, 23 nt, Human
caaaaaaaccuauccccaaaggc

SEQ ID NO: 275450 - RNA, 21 nt, Human
caaaagcaccaaaugaagaca

SEQ ID NO: 275451 - RNA, 22 nt, Human
caaaaucccuaaaccaccucuc

SEQ ID NO: 275452 - RNA, 19 nt, Human
caaccuucuuauagggcug

SEQ ID NO: 275453 - RNA, 21 nt, Human
caacuuuccaauuccugcacu

SEQ ID NO: 275454 - RNA, 20 nt, Human
caagaaaaagaaacaagcaa

SEQ ID NO: 275455 - RNA, 18 nt, Human
cacagagguccaugcaga

SEQ ID NO: 275456 - RNA, 24 nt, Human
caccucucaacaaaacauuacacc

SEQ ID NO: 275457 - RNA, 20 nt, Human
cagaaaaacaacaaacucac

SEQ ID NO: 275458 - RNA, 24 nt, Human
cagaauuccagggcauaauuccca

SEQ ID NO: 275459 - RNA, 22 nt, Human
cagccucuugaagggaucuccu

SEQ ID NO: 275460 - RNA, 21 nt, Human
cagcuuucacauucccuuucu

SEQ ID NO: 275461 - RNA, 26 nt, Human
caggcagucaauggaaugcuuggcag

SEQ ID NO: 275462 - RNA, 24 nt, Human
cauaacagcauaauuaauauuaug

SEQ ID NO: 275463 - RNA, 23 nt, Human
cauacaaacagauauaauaucac

SEQ ID NO: 275464 - RNA, 25 nt, Human
caucaugagguaacacugccaggcc

SEQ ID NO: 275465 - RNA, 27 nt, Human
caugcagauagguucuccccaucuucu

SEQ ID NO: 275466 - RNA, 19 nt, Human
ccaaauuaaaguaguccaa

SEQ ID NO: 275467 - RNA, 21 nt, Human
ccaggcccauacacagaaaaa

SEQ ID NO: 275468 - RNA, 19 nt, Human
ccaugcagauagguucucc

SEQ ID NO: 275469 - RNA, 23 nt, Human
cccauacacagaaaaacaacaaa

SEQ ID NO: 275470 - RNA, 25 nt, Human
cccauacacagaaaaacaacaaacu

SEQ ID NO: 275471 - RNA, 22 nt, Human
ccccaaaauuuguugaagaaaa

SEQ ID NO: 275472 - RNA, 20 nt, Human
cccuaaaccaccucucaaca

SEQ ID NO: 275473 - RNA, 22 nt, Human
ccucucaacaaaacauuacacc

SEQ ID NO: 275474 - RNA, 24 nt, Human
ccucucaacaaaacauuacaccuu

SEQ ID NO: 275475 - RNA, 20 nt, Human
ccugcacacagacaagaaaa

SEQ ID NO: 275476 - RNA, 24 nt, Human
cuaaaccaccucucaacaaaacau

SEQ ID NO: 275477 - RNA, 23 nt, Human
cuccaagggauaccgggaagaca

SEQ ID NO: 275478 - RNA, 19 nt, Human
cucuuggucauuccaacau

SEQ ID NO: 275479 - RNA, 19 nt, Human
cuuuacacugaccaggccc

SEQ ID NO: 275480 - RNA, 18 nt, Human
cuuucuccaaacccaaag

SEQ ID NO: 275481 - RNA, 22 nt, Human
gaaaaacaacaaacucacaccc

SEQ ID NO: 275482 - RNA, 22 nt, Human
gagaacauacuggguauaccag

SEQ ID NO: 275483 - RNA, 19 nt, Human
gauaccgggaagacaggag

SEQ ID NO: 275484 - RNA, 21 nt, Human
gaucaguaaaaaguuugaaag

SEQ ID NO: 275485 - RNA, 18 nt, Human
gcaaccaucuguuuguca

SEQ ID NO: 275486 - RNA, 23 nt, Human
gcagaagccugcagggcuuaaaa

SEQ ID NO: 275487 - RNA, 19 nt, Human
gcaguguuguccuccucau

SEQ ID NO: 275488 - RNA, 19 nt, Human
gcuagugcacagaagagug

SEQ ID NO: 275489 - RNA, 22 nt, Human
ggaagaaaaaaagaaguuuggu

SEQ ID NO: 275490 - RNA, 23 nt, Human
ggcagaagccugcagggcuuaaa

SEQ ID NO: 275491 - RNA, 20 nt, Human
ggcaggcagaagaggaguca

SEQ ID NO: 275492 - RNA, 23 nt, Human
ggcccauacacagaaaaacaaca

SEQ ID NO: 275493 - RNA, 19 nt, Human
ggcuccagagauuucuuca

SEQ ID NO: 275494 - RNA, 21 nt, Human
gggaauucaccuguuaauauc

SEQ ID NO: 275495 - RNA, 18 nt, Human
ggguccaagggcagagag

SEQ ID NO: 275496 - RNA, 21 nt, Human
gguaagugggaagcacugaug

SEQ ID NO: 275497 - RNA, 21 nt, Human
guagggcuacaaucacggaga

SEQ ID NO: 275498 - RNA, 20 nt, Human
guccaagcugcaagaauguc

SEQ ID NO: 275499 - RNA, 19 nt, Human
uaaaacaaaacagaggaag

SEQ ID NO: 275500 - RNA, 23 nt, Human
uaaaacaaaacagaggaagcaaa

SEQ ID NO: 275501 - RNA, 22 nt, Human
uaaaaugcaguccaagcugcaa

SEQ ID NO: 275502 - RNA, 21 nt, Human
uaaacaaacaaaaaaaccuau

SEQ ID NO: 275503 - RNA, 23 nt, Human
uaacuagacuaucaaggauaaaa

SEQ ID NO: 275504 - RNA, 23 nt, Human
uaaggaaaagggaggauauaaaa

SEQ ID NO: 275505 - RNA, 20 nt, Human
uaaggaauguuacaaaccaa

SEQ ID NO: 275506 - RNA, 18 nt, Human
uacaaaaugcccaggcag

SEQ ID NO: 275507 - RNA, 20 nt, Human
uacaaaaugcccaggcagaa

SEQ ID NO: 275508 - RNA, 23 nt, Human
uacaaaccaaucauuuacauaac

SEQ ID NO: 275509 - RNA, 24 nt, Human
uacaacaccacugagcuuggcaaa

SEQ ID NO: 275510 - RNA, 22 nt, Human
uacacagaaaaacaacaaacuc

SEQ ID NO: 275511 - RNA, 25 nt, Human
uacagagaguggauucaggugaggg

SEQ ID NO: 275512 - RNA, 18 nt, Human
uacaggcagucaauggaa

SEQ ID NO: 275513 - RNA, 23 nt, Human
uacauaaauguguccucccaaau

SEQ ID NO: 275514 - RNA, 21 nt, Human
uaccacacaauucaagaguuc

SEQ ID NO: 275515 - RNA, 22 nt, Human
uaccacacaauucaagaguucu

SEQ ID NO: 275516 - RNA, 23 nt, Human
uagcagaaaauagcaaaggggac

SEQ ID NO: 275517 - RNA, 22 nt, Human
uaggacugaaaaaaccauuugu

SEQ ID NO: 275518 - RNA, 24 nt, Human
uaguugccaaagggaaugucaugg

SEQ ID NO: 275519 - RNA, 20 nt, Human
uaucaaggauaaaacuuuac

SEQ ID NO: 275520 - RNA, 25 nt, Human
uauuaugccaacagacacgcagggu

SEQ ID NO: 275521 - RNA, 20 nt, Human
ucaaagaaauugccaagagc

SEQ ID NO: 275522 - RNA, 24 nt, Human
ucaggaauaugcggucauuuuauu

SEQ ID NO: 275523 - RNA, 20 nt, Human
ucaguaaaaaguuugaaagg

SEQ ID NO: 275524 - RNA, 24 nt, Human
uccaaagaaacaacauacuugaaa

SEQ ID NO: 275525 - RNA, 23 nt, Human
uccaaauuaaaguaguccaagaa

SEQ ID NO: 275526 - RNA, 18 nt, Human
uccaaccuucuuauaggg

SEQ ID NO: 275527 - RNA, 20 nt, Human
uccaagaaaaagaaacaagc

SEQ ID NO: 275528 - RNA, 22 nt, Human
uccaagaaaaagaaacaagcaa

SEQ ID NO: 275529 - RNA, 20 nt, Human
uccaagggcagagagucacc

SEQ ID NO: 275530 - RNA, 19 nt, Human
uccacagagguccaugcag

SEQ ID NO: 275531 - RNA, 26 nt, Human
ucucccggaugaccuucauuuguucc

SEQ ID NO: 275532 - RNA, 21 nt, Human
ugaaacggaaaaguaaaaaca

SEQ ID NO: 275533 - RNA, 21 nt, Human
ugaaagaggcugacagaaugu

SEQ ID NO: 275534 - RNA, 19 nt, Human
ugaaagguuugugcugaga

SEQ ID NO: 275535 - RNA, 20 nt, Human
ugaagacaaaagaaugucca

SEQ ID NO: 275536 - RNA, 21 nt, Human
ugaagacaaaagaauguccaa

SEQ ID NO: 275537 - RNA, 22 nt, Human
ugaagacaaaagaauguccaag

SEQ ID NO: 275538 - RNA, 19 nt, Human
ugacaaacggaagacaacu

SEQ ID NO: 275539 - RNA, 26 nt, Human
ugacauugugcuuaaggaaaagggag

SEQ ID NO: 275540 - RNA, 18 nt, Human
ugacuuauaucccaguuc

SEQ ID NO: 275541 - RNA, 24 nt, Human
ugaucuaauuaaaggaagaaaaaa

SEQ ID NO: 275542 - RNA, 24 nt, Human
ugcaaaaccaaaagcaccaaauga

SEQ ID NO: 275543 - RNA, 23 nt, Human
uggaaugcuuggcaggaaguagg

SEQ ID NO: 275544 - RNA, 20 nt, Human
uggagcaggagggcagaaag

SEQ ID NO: 275545 - RNA, 18 nt, Human
uggauucaggugaggggc

SEQ ID NO: 275546 - RNA, 20 nt, Human
uggcauaaaagaugugucuc

SEQ ID NO: 275547 - RNA, 18 nt, Human
uggcuggaucaguagcug

SEQ ID NO: 275548 - RNA, 23 nt, Human
ugguagggcuacaaucacggaga

SEQ ID NO: 275549 - RNA, 23 nt, Human
ugucaccagcuauggcuagugca

SEQ ID NO: 275550 - RNA, 26 nt, Human
uguccauuuuccaaagaaacaacaua

SEQ ID NO: 275551 - RNA, 18 nt, Human
ugugauaaaaaugcuuuc

SEQ ID NO: 275552 - RNA, 19 nt, Human
uucuccccuucucucucca

SEQ ID NO: 275553 - RNA, 23 nt, Human
uugcacgaguuaacuugucucuu

SEQ ID NO: 275554 - RNA, 18 nt, Human
uuggauaggacugaaaaa

SEQ ID NO: 275555 - RNA, 21 nt, Human
uuggcaaauucaauaagagga

SEQ ID NO: 275556 - RNA, 19 nt, Human
uuuagaaugauaaaauguu

SEQ ID NO: 275557 - RNA, 19 nt, Human
uuuauuagauaccacacaa

SEQ ID NO: 275558 - RNA, 21 nt, Human
uuucugguuuuaaaaaagugg

SEQ ID NO: 275559 - RNA, 19 nt, Human
aaaaaaaagaaaaagaaaa

SEQ ID NO: 275560 - RNA, 20 nt, Human
aaaauaccucuauucugcca

SEQ ID NO: 275561 - RNA, 21 nt, Human
aaggaagagacagagaaagaa

SEQ ID NO: 275562 - RNA, 25 nt, Human
aaggguggggcuggggcagagggag

SEQ ID NO: 275563 - RNA, 20 nt, Human
aagugagggagguggggugg

SEQ ID NO: 275564 - RNA, 20 nt, Human
aauaauucauucaugucaga

SEQ ID NO: 275565 - RNA, 21 nt, Human
acagggacauaaaggaaugca

SEQ ID NO: 275566 - RNA, 23 nt, Human
accagcagcccccuaguucccaa

SEQ ID NO: 275567 - RNA, 20 nt, Human
acgcugcaaggcaaggaugc

SEQ ID NO: 275568 - RNA, 20 nt, Human
acucuucacaagacugagag

SEQ ID NO: 275569 - RNA, 22 nt, Human
agaaagaaaggaggcaggacgg

SEQ ID NO: 275570 - RNA, 30 nt, Human
agaaaggaggcaggacgggggucucuuuaa

SEQ ID NO: 275571 - RNA, 22 nt, Human
agacugaagcccugggcugaug

SEQ ID NO: 275572 - RNA, 21 nt, Human
agagaaguggggaagaagggg

SEQ ID NO: 275573 - RNA, 19 nt, Human
agagacagagaaagaaagg

SEQ ID NO: 275574 - RNA, 22 nt, Human
agauggccaaggguggggcugg

SEQ ID NO: 275575 - RNA, 22 nt, Human
aggaagagaaaguaccacucag

SEQ ID NO: 275576 - RNA, 20 nt, Human
aggaagagacagagaaagaa

SEQ ID NO: 275577 - RNA, 23 nt, Human
aggaugaaaaagacuaaaaggaa

SEQ ID NO: 275578 - RNA, 25 nt, Human
aggcaaggaugcaggaggguuggug

SEQ ID NO: 275579 - RNA, 19 nt, Human
aggcagcuccucuucuugu

SEQ ID NO: 275580 - RNA, 18 nt, Human
agggagguggggugggga

SEQ ID NO: 275581 - RNA, 24 nt, Human
agggaggugggguggggaggaggc

SEQ ID NO: 275582 - RNA, 21 nt, Human
aucccagucaugccuguguac

SEQ ID NO: 275583 - RNA, 18 nt, Human
aucuggaaugcagugaag

SEQ ID NO: 275584 - RNA, 18 nt, Human
augaaaaagacuaaaagg

SEQ ID NO: 275585 - RNA, 19 nt, Human
caaggcaaggaugcaggag

SEQ ID NO: 275586 - RNA, 19 nt, Human
cacagaauccagcuuggcc

SEQ ID NO: 275587 - RNA, 21 nt, Human
cagaaggagagagaaaggaau

SEQ ID NO: 275588 - RNA, 21 nt, Human
ccaaggguggggcuggggcag

SEQ ID NO: 275589 - RNA, 20 nt, Human
ccagaaggagagagaaagga

SEQ ID NO: 275590 - RNA, 22 nt, Human
ccagcagcccccuaguucccaa

SEQ ID NO: 275591 - RNA, 23 nt, Human
cccacccauuauaaauaaaggaa

SEQ ID NO: 275592 - RNA, 20 nt, Human
cccacgggggcacugggggg

SEQ ID NO: 275593 - RNA, 22 nt, Human
ccccagugggugcgcccaaggg

SEQ ID NO: 275594 - RNA, 24 nt, Human
cccccaagaucuaagaacugacga

SEQ ID NO: 275595 - RNA, 21 nt, Human
cccccacccauuauaaauaaa

SEQ ID NO: 275596 - RNA, 22 nt, Human
cccgaccccuggccccaguggg

SEQ ID NO: 275597 - RNA, 22 nt, Human
cccuccccuccucccuccuucc

SEQ ID NO: 275598 - RNA, 18 nt, Human
cccuccucccuccuuccc

SEQ ID NO: 275599 - RNA, 22 nt, Human
cccugggcuccgggcgcguccc

SEQ ID NO: 275600 - RNA, 23 nt, Human
cccugggcugaugaccuaucucg

SEQ ID NO: 275601 - RNA, 22 nt, Human
ccuccucccuccuucccugggc

SEQ ID NO: 275602 - RNA, 20 nt, Human
ccuccuucccugggcuccgg

SEQ ID NO: 275603 - RNA, 20 nt, Human
ccuggccccagugggugcgc

SEQ ID NO: 275604 - RNA, 20 nt, Human
cucccccgaccccuggcccc

SEQ ID NO: 275605 - RNA, 20 nt, Human
cuccccuccucccuccuucc

SEQ ID NO: 275606 - RNA, 18 nt, Human
cucuucacaagacugaga

SEQ ID NO: 275607 - RNA, 18 nt, Human
cucuuuaggcccccaaga

SEQ ID NO: 275608 - RNA, 19 nt, Human
cucuuuaggcccccaagau

SEQ ID NO: 275609 - RNA, 20 nt, Human
gagaggccagaaggagagag

SEQ ID NO: 275610 - RNA, 18 nt, Human
gccaaggguggggcuggg

SEQ ID NO: 275611 - RNA, 22 nt, Human
gcgacccuccccuccucccucc

SEQ ID NO: 275612 - RNA, 24 nt, Human
ggaaagagaagaggaugaaaaaga

SEQ ID NO: 275613 - RNA, 23 nt, Human
ggaaaugagaggccagaaggaga

SEQ ID NO: 275614 - RNA, 22 nt, Human
ggaaggaagagacagagaaaga

SEQ ID NO: 275615 - RNA, 20 nt, Human
ggaaugcauacaucugcccu

SEQ ID NO: 275616 - RNA, 18 nt, Human
ggaauucagcuacacagg

SEQ ID NO: 275617 - RNA, 18 nt, Human
ggcagagggaguuggcag

SEQ ID NO: 275618 - RNA, 18 nt, Human
gggcuggggcagagggag

SEQ ID NO: 275619 - RNA, 19 nt, Human
gggcuggggcagagggagu

SEQ ID NO: 275620 - RNA, 18 nt, Human
ggggcuggggcagaggga

SEQ ID NO: 275621 - RNA, 23 nt, Human
ggggguucacagggggagggagc

SEQ ID NO: 275622 - RNA, 20 nt, Human
gguugguggaaagagaagag

SEQ ID NO: 275623 - RNA, 22 nt, Human
guaaaaaaaaaaagaaaaagaa

SEQ ID NO: 275624 - RNA, 22 nt, Human
guggggcuggggcagagggagu

SEQ ID NO: 275625 - RNA, 23 nt, Human
uaaaaaaaaaaagaaaaagaaaa

SEQ ID NO: 275626 - RNA, 23 nt, Human
uaaaaauaccucuauucugccau

SEQ ID NO: 275627 - RNA, 27 nt, Human
uacaaaauguaaaaaaaaaaagaaaaa

SEQ ID NO: 275628 - RNA, 21 nt, Human
uacacgggaucccagucaugc

SEQ ID NO: 275629 - RNA, 27 nt, Human
uagccuaaaaauaccucuauucugcca

SEQ ID NO: 275630 - RNA, 20 nt, Human
uaggcccccaagaucuaaga

SEQ ID NO: 275631 - RNA, 21 nt, Human
ucaggcagcuccucuucuugu

SEQ ID NO: 275632 - RNA, 21 nt, Human
ugaaaaagacuaaaaggaagg

SEQ ID NO: 275633 - RNA, 23 nt, Human
ugaagugagggaggugggguggg

SEQ ID NO: 275634 - RNA, 24 nt, Human
ugagagggugggugguagccccca

SEQ ID NO: 275635 - RNA, 21 nt, Human
ugagggaagagagaagugggg

SEQ ID NO: 275636 - RNA, 19 nt, Human
ugagggagguggggugggg

SEQ ID NO: 275637 - RNA, 22 nt, Human
ugaugaccuaucucggucacgc

SEQ ID NO: 275638 - RNA, 18 nt, Human
ugccauaaggcugggcca

SEQ ID NO: 275639 - RNA, 25 nt, Human
uggaaagagaagaggaugaaaaaga

SEQ ID NO: 275640 - RNA, 18 nt, Human
uggcagugggcccuuccc

SEQ ID NO: 275641 - RNA, 21 nt, Human
uggcagugggcccuuccccag

SEQ ID NO: 275642 - RNA, 20 nt, Human
uggccgaaugggcccacaga

SEQ ID NO: 275643 - RNA, 23 nt, Human
ugggcccacagacucagccccac

SEQ ID NO: 275644 - RNA, 21 nt, Human
uggggcagagggaguuggcag

SEQ ID NO: 275645 - RNA, 20 nt, Human
ugggggguucacagggggag

SEQ ID NO: 275646 - RNA, 19 nt, Human
uggugaggggagugggggg

SEQ ID NO: 275647 - RNA, 21 nt, Human
ugucagaguguaaggaaauga

SEQ ID NO: 275648 - RNA, 23 nt, Human
ugucagaguguaaggaaaugaga

SEQ ID NO: 275649 - RNA, 18 nt, Human
uuuuuuuuuuuuuuuuug

SEQ ID NO: 275650 - RNA, 19 nt, Human
agccccuucuccaagcccc

SEQ ID NO: 275651 - RNA, 21 nt, Human
aggcagggacccucagagcuc

SEQ ID NO: 275652 - RNA, 22 nt, Human
caagccccggucccugucccuc

SEQ ID NO: 275653 - RNA, 22 nt, Human
cacagccccuucuccaagcccc

SEQ ID NO: 275654 - RNA, 19 nt, Human
cagccccuucuccaagccc

SEQ ID NO: 275655 - RNA, 18 nt, Human
cccggucccugucccucu

SEQ ID NO: 275656 - RNA, 26 nt, Human
ccucuucaggcagggacccucagagc

SEQ ID NO: 275657 - RNA, 23 nt, Human
ucuccaagccccggucccugucc

SEQ ID NO: 275658 - RNA, 19 nt, Human
aaaaugcacauuugaaaca

SEQ ID NO: 275659 - RNA, 27 nt, Human
aaacagaaaaguaauagucaucucugg

SEQ ID NO: 275660 - RNA, 18 nt, Human
acaccaguccacuuagua

SEQ ID NO: 275661 - RNA, 22 nt, Human
acaggugcucuguaggugugcc

SEQ ID NO: 275662 - RNA, 23 nt, Human
agacuucacugacucauuacagu

SEQ ID NO: 275663 - RNA, 19 nt, Human
aggauucaaggaugaaauc

SEQ ID NO: 275664 - RNA, 19 nt, Human
agggagccaauagagaauc

SEQ ID NO: 275665 - RNA, 23 nt, Human
agugcacaacaaaauaugaugag

SEQ ID NO: 275666 - RNA, 19 nt, Human
auacauguauguauacaca

SEQ ID NO: 275667 - RNA, 19 nt, Human
cacuagugcacaacaaaau

SEQ ID NO: 275668 - RNA, 19 nt, Human
cagcaauaaaaucguguuu

SEQ ID NO: 275669 - RNA, 18 nt, Human
caggugcucuguaggugu

SEQ ID NO: 275670 - RNA, 19 nt, Human
cauuaggaaaauacauagg

SEQ ID NO: 275671 - RNA, 23 nt, Human
ccuuggauuuggagcuuggaagu

SEQ ID NO: 275672 - RNA, 21 nt, Human
cuuccaauauauaaaugucug

SEQ ID NO: 275673 - RNA, 22 nt, Human
gaaucuucccaaugaaccucaa

SEQ ID NO: 275674 - RNA, 20 nt, Human
gagaaucuucccaaugaacc

SEQ ID NO: 275675 - RNA, 19 nt, Human
guagauacaacacguuucc

SEQ ID NO: 275676 - RNA, 22 nt, Human
uaaaagagagaagcggaacacg

SEQ ID NO: 275677 - RNA, 18 nt, Human
uacaacacguuuccuagu

SEQ ID NO: 275678 - RNA, 24 nt, Human
uacaggugcucuguaggugugcuu

SEQ ID NO: 275679 - RNA, 21 nt, Human
uacccaaaaagggagccaaua

SEQ ID NO: 275680 - RNA, 20 nt, Human
uagagaaaucaaacauaaua

SEQ ID NO: 275681 - RNA, 23 nt, Human
ucacugacucauuacagugauau

SEQ ID NO: 275682 - RNA, 24 nt, Human
uccuaagccauauccugagcuuac

SEQ ID NO: 275683 - RNA, 21 nt, Human
ugagcuuaccuugauuccaag

SEQ ID NO: 275684 - RNA, 24 nt, Human
ugcucuauuuuucucaaaauucca

SEQ ID NO: 275685 - RNA, 23 nt, Human
uggaaaggagucaaugugucuua

SEQ ID NO: 275686 - RNA, 21 nt, Human
uggagaaaguuuaugacacca

SEQ ID NO: 275687 - RNA, 19 nt, Human
uguaaaacuaaacagaaaa

SEQ ID NO: 275688 - RNA, 18 nt, Human
uguauguauacacauaua

SEQ ID NO: 275689 - RNA, 23 nt, Human
ugucauguugaagagcugcaugu

SEQ ID NO: 275690 - RNA, 21 nt, Human
ugucuagauuuaauuuugcag

SEQ ID NO: 275691 - RNA, 20 nt, Human
ugugucuuaaauggagaaag

SEQ ID NO: 275692 - RNA, 19 nt, Human
uugaucaugaguuuucaua

SEQ ID NO: 275693 - RNA, 20 nt, Human
uugcagccuaccuuguagcc

SEQ ID NO: 275694 - RNA, 18 nt, Human
uuuuucagcaauaaaauc

SEQ ID NO: 275695 - RNA, 22 nt, Human
uuuuuuuuuuuuuuuuuuucag

SEQ ID NO: 275696 - RNA, 18 nt, Human
aaaaaaaaaaaaaaugag

SEQ ID NO: 275697 - RNA, 24 nt, Human
aaaaaacacauuuccuucugcccu

SEQ ID NO: 275698 - RNA, 22 nt, Human
aaaaacacauuuccuucugccc

SEQ ID NO: 275699 - RNA, 18 nt, Human
aaaacaaaugugcaaccu

SEQ ID NO: 275700 - RNA, 21 nt, Human
aaaagggaaaguucaugagga

SEQ ID NO: 275701 - RNA, 21 nt, Human
aaacaaaugaacaacaaaaaa

SEQ ID NO: 275702 - RNA, 18 nt, Human
aaacacauuuauaaugau

SEQ ID NO: 275703 - RNA, 18 nt, Human
aaacagcuaaaucacaga

SEQ ID NO: 275704 - RNA, 22 nt, Human
aaagccugacaaagguagauaa

SEQ ID NO: 275705 - RNA, 19 nt, Human
aacacauuuccuucugccc

SEQ ID NO: 275706 - RNA, 23 nt, Human
aagcaaaguauagagaacaaaac

SEQ ID NO: 275707 - RNA, 24 nt, Human
aagcaggaaguaagacuuacagga

SEQ ID NO: 275708 - RNA, 21 nt, Human
aagucaguauagcaaagcuaa

SEQ ID NO: 275709 - RNA, 18 nt, Human
aauaaugcugguaaaaug

SEQ ID NO: 275710 - RNA, 20 nt, Human
aauaaugcugguaaaauggc

SEQ ID NO: 275711 - RNA, 22 nt, Human
aaucugauguguaacuggggca

SEQ ID NO: 275712 - RNA, 24 nt, Human
acaacaaaaaacacauuuccuucu

SEQ ID NO: 275713 - RNA, 22 nt, Human
acaagaaacaaaugaacaacaa

SEQ ID NO: 275714 - RNA, 24 nt, Human
acaagaaacaaaugaacaacaaaa

SEQ ID NO: 275715 - RNA, 23 nt, Human
acaggacagugcuuuggccucac

SEQ ID NO: 275716 - RNA, 20 nt, Human
acagugaggauguuaaugga

SEQ ID NO: 275717 - RNA, 19 nt, Human
acagugcuuuuaugcaacu

SEQ ID NO: 275718 - RNA, 24 nt, Human
acgagauacacuauuugucaaaac

SEQ ID NO: 275719 - RNA, 23 nt, Human
acucagagguuaacagauggugu

SEQ ID NO: 275720 - RNA, 21 nt, Human
acuccaugugagaacuuuugu

SEQ ID NO: 275721 - RNA, 20 nt, Human
acuguuggggagaaaauaau

SEQ ID NO: 275722 - RNA, 20 nt, Human
agaacaaaacagaucaagaa

SEQ ID NO: 275723 - RNA, 22 nt, Human
aguauuagaaacugcauuggcu

SEQ ID NO: 275724 - RNA, 21 nt, Human
agugcugagugcacagggcua

SEQ ID NO: 275725 - RNA, 21 nt, Human
aucacaguucagagagaggcu

SEQ ID NO: 275726 - RNA, 20 nt, Human
augaaacaucugguaaaaca

SEQ ID NO: 275727 - RNA, 23 nt, Human
auuacaauuagcuuaagaugauc

SEQ ID NO: 275728 - RNA, 21 nt, Human
caaaacuuacacagcuacaga

SEQ ID NO: 275729 - RNA, 24 nt, Human
caaaagggaaaguucaugaggaca

SEQ ID NO: 275730 - RNA, 20 nt, Human
caaaguacaguacauccuuc

SEQ ID NO: 275731 - RNA, 22 nt, Human
caagaaacaaaugaacaacaaa

SEQ ID NO: 275732 - RNA, 20 nt, Human
caaguucucaauguccaaaa

SEQ ID NO: 275733 - RNA, 23 nt, Human
cacuauuugucaaaacuuacaca

SEQ ID NO: 275734 - RNA, 27 nt, Human
cagaucaagaaaaaauucuuucuauga

SEQ ID NO: 275735 - RNA, 18 nt, Human
caggacagugcuuuggcc

SEQ ID NO: 275736 - RNA, 26 nt, Human
cauauaguucaaugaacaaaagggaa

SEQ ID NO: 275737 - RNA, 18 nt, Human
caucaugggagcaaacag

SEQ ID NO: 275738 - RNA, 20 nt, Human
ccagauaucagaguagcagc

SEQ ID NO: 275739 - RNA, 25 nt, Human
ccuguaccacaguuaugugucuaaa

SEQ ID NO: 275740 - RNA, 19 nt, Human
cgccaugcugcaaagacuc

SEQ ID NO: 275741 - RNA, 19 nt, Human
cggcaaugcuaaccacuga

SEQ ID NO: 275742 - RNA, 21 nt, Human
cuaaaaaaaaaaaaaaugagu

SEQ ID NO: 275743 - RNA, 24 nt, Human
cugaaaacuauacgcauaucccug

SEQ ID NO: 275744 - RNA, 21 nt, Human
cugaauauugacaguccauua

SEQ ID NO: 275745 - RNA, 18 nt, Human
cugaccccaccauacuca

SEQ ID NO: 275746 - RNA, 25 nt, Human
cuuacacagcuacagaguaucgacg

SEQ ID NO: 275747 - RNA, 18 nt, Human
gaaauucagacauggagc

SEQ ID NO: 275748 - RNA, 23 nt, Human
gaguauuagaaacugcauuggcu

SEQ ID NO: 275749 - RNA, 19 nt, Human
gcaucacacucauuguucu

SEQ ID NO: 275750 - RNA, 21 nt, Human
gccagauaucagaguagcagc

SEQ ID NO: 275751 - RNA, 19 nt, Human
gggucuugggaacaaaggc

SEQ ID NO: 275752 - RNA, 23 nt, Human
gugacaguuguugggucuuggga

SEQ ID NO: 275753 - RNA, 23 nt, Human
guugggucuugggaacaaaggcu

SEQ ID NO: 275754 - RNA, 20 nt, Human
uaaaaaaaaaaaaaaugagg

SEQ ID NO: 275755 - RNA, 24 nt, Human
uaaaaacaaaugugcaaccucuga

SEQ ID NO: 275756 - RNA, 21 nt, Human
uaaaaaugcuccacaaaacau

SEQ ID NO: 275757 - RNA, 25 nt, Human
uaaacagugaggauguuaauggagu

SEQ ID NO: 275758 - RNA, 25 nt, Human
uaaauauaauagcggcaaugcugua

SEQ ID NO: 275759 - RNA, 18 nt, Human
uaacaaauuauacacaau

SEQ ID NO: 275760 - RNA, 23 nt, Human
uaagaugaucauauuaaaaccua

SEQ ID NO: 275761 - RNA, 20 nt, Human
uaagcaggaaguaagacuua

SEQ ID NO: 275762 - RNA, 21 nt, Human
uaagcaugcaggaaauacugu

SEQ ID NO: 275763 - RNA, 24 nt, Human
uacaggacagugcuuuggccucac

SEQ ID NO: 275764 - RNA, 21 nt, Human
uaccaauuaacacaguuuacu

SEQ ID NO: 275765 - RNA, 23 nt, Human
uaccacaguuaugugucuaaaca

SEQ ID NO: 275766 - RNA, 20 nt, Human
uacuucacugugcccuaagc

SEQ ID NO: 275767 - RNA, 19 nt, Human
uagcggcaaugcuaaccac

SEQ ID NO: 275768 - RNA, 19 nt, Human
uagucauuaccaauuaaca

SEQ ID NO: 275769 - RNA, 21 nt, Human
uaguucaaugaacaaaaggga

SEQ ID NO: 275770 - RNA, 19 nt, Human
uauacacaagcaaaguaua

SEQ ID NO: 275771 - RNA, 22 nt, Human
uaugaaaugaagaguccauaua

SEQ ID NO: 275772 - RNA, 18 nt, Human
ucacugugcccuaagcag

SEQ ID NO: 275773 - RNA, 21 nt, Human
uccacaaaacaugcaaauuac

SEQ ID NO: 275774 - RNA, 19 nt, Human
uccuucuugaaaauggggu

SEQ ID NO: 275775 - RNA, 24 nt, Human
ucuuacacuagaaacaccucugac

SEQ ID NO: 275776 - RNA, 22 nt, Human
ugaaacaucugguaaaacacau

SEQ ID NO: 275777 - RNA, 23 nt, Human
ugacaguuguugggucuugggaa

SEQ ID NO: 275778 - RNA, 24 nt, Human
ugacauaaaaaugcuccacaaaac

SEQ ID NO: 275779 - RNA, 18 nt, Human
ugaccugucaaaaagccu

SEQ ID NO: 275780 - RNA, 22 nt, Human
ugaguaaauauaauagcggcaa

SEQ ID NO: 275781 - RNA, 20 nt, Human
ugcaaagacuccaucauggg

SEQ ID NO: 275782 - RNA, 24 nt, Human
ugcaaagacuccaucaugggagca

SEQ ID NO: 275783 - RNA, 18 nt, Human
ugcaacauacuuaucaag

SEQ ID NO: 275784 - RNA, 19 nt, Human
ugcaacuauauugcuuuuu

SEQ ID NO: 275785 - RNA, 20 nt, Human
ugcaacuauauugcuuuuug

SEQ ID NO: 275786 - RNA, 19 nt, Human
ugcuccacaaaacaugcaa

SEQ ID NO: 275787 - RNA, 24 nt, Human
uggacguaaucaauggguugaaga

SEQ ID NO: 275788 - RNA, 22 nt, Human
ugggaugccauuuagcuugcua

SEQ ID NO: 275789 - RNA, 18 nt, Human
ugugcaaccucugaagag

SEQ ID NO: 275790 - RNA, 20 nt, Human
uguuuauaauuuccaauccu

SEQ ID NO: 275791 - RNA, 24 nt, Human
uuacacagcuacagaguaucgacg

SEQ ID NO: 275792 - RNA, 20 nt, Human
uuauacacaauuauaagcuc

SEQ ID NO: 275793 - RNA, 24 nt, Human
uucauuuaaacaagcauaucauuc

SEQ ID NO: 275794 - RNA, 23 nt, Human
uugacaguccauuaguucuuuuc

SEQ ID NO: 275795 - RNA, 20 nt, Human
uugaugauuacaauucuuuc

SEQ ID NO: 275796 - RNA, 21 nt, Human
uugcacagaaaggagcagcug

SEQ ID NO: 275797 - RNA, 21 nt, Human
uugcaguuccugccgcugcua

SEQ ID NO: 275798 - RNA, 21 nt, Human
uuggugacauaaaaaugcucc

SEQ ID NO: 275799 - RNA, 21 nt, Human
uuguuuauaauuuccaauccu

SEQ ID NO: 275800 - RNA, 24 nt, Human
uuuguuggcacuuucacuuuuguu

SEQ ID NO: 275801 - RNA, 19 nt, Human
uuuuaugcaacuauauugc

SEQ ID NO: 275802 - RNA, 21 nt, Human
aaagagacaaaaugcagauua

SEQ ID NO: 275803 - RNA, 21 nt, Human
aagauacaaagagacaaaaug

SEQ ID NO: 275804 - RNA, 19 nt, Human
acugaagauacaaagagac

SEQ ID NO: 275805 - RNA, 18 nt, Human
caaaccugacgagaccaa

SEQ ID NO: 275806 - RNA, 21 nt, Human
cgagaccaaguaaauuacuga

SEQ ID NO: 275807 - RNA, 22 nt, Human
cucaaaccugacgagaccaagu

SEQ ID NO: 275808 - RNA, 26 nt, Human
uacaaagagacaaaaugcagauuacc

SEQ ID NO: 275809 - RNA, 22 nt, Human
ucuuauccuaaagugacugcuc

SEQ ID NO: 275810 - RNA, 20 nt, Human
aguaaauguuuuuguucugu

SEQ ID NO: 275811 - RNA, 21 nt, Human
aguucccaacugggagcucau

SEQ ID NO: 275812 - RNA, 24 nt, Human
caggaaauuucuucucccucaccu

SEQ ID NO: 275813 - RNA, 23 nt, Human
cgucacaggaauuccugguggag

SEQ ID NO: 275814 - RNA, 19 nt, Human
gagcucauaucaacaggcc

SEQ ID NO: 275815 - RNA, 22 nt, Human
uuccugguggaguucuuuggaa

SEQ ID NO: 275816 - RNA, 22 nt, Human
aagcccgaaggcccggcgccga

SEQ ID NO: 275817 - RNA, 25 nt, Human
aagcccgaaggcccggcgccgagcc

SEQ ID NO: 275818 - RNA, 25 nt, Human
aagucuuagaaauugcacucauucc

SEQ ID NO: 275819 - RNA, 19 nt, Human
aaucagccuuagauugagc

SEQ ID NO: 275820 - RNA, 25 nt, Human
accaaaaacaauuuaaagaggaaca

SEQ ID NO: 275821 - RNA, 24 nt, Human
agggucaaagacugaguggaagcc

SEQ ID NO: 275822 - RNA, 31 nt, Human
aucaacagugugcaucuaacaguuuucuuuu

SEQ ID NO: 275823 - RNA, 24 nt, Human
ccaaaaacaauuuaaagaggaaca

SEQ ID NO: 275824 - RNA, 19 nt, Human
cccacccgcaccgggucag

SEQ ID NO: 275825 - RNA, 26 nt, Human
ccccgccgcgcugcgcucugugcccg

SEQ ID NO: 275826 - RNA, 19 nt, Human
cccggcgccgagccagccc

SEQ ID NO: 275827 - RNA, 19 nt, Human
cgagaaggagcgggcggcg

SEQ ID NO: 275828 - RNA, 23 nt, Human
cgagaaggagcgggcggcggccg

SEQ ID NO: 275829 - RNA, 22 nt, Human
cgccggccccgccgcgcugcgc

SEQ ID NO: 275830 - RNA, 26 nt, Human
cggcccgagaaggagcgggcggcggg

SEQ ID NO: 275831 - RNA, 24 nt, Human
cucccacccgcaccgggucagcuc

SEQ ID NO: 275832 - RNA, 21 nt, Human
cuuagauugagcaaguucagc

SEQ ID NO: 275833 - RNA, 23 nt, Human
gagcgaggaccgagggucaaaga

SEQ ID NO: 275834 - RNA, 22 nt, Human
gagcgggcggcggccggggcag

SEQ ID NO: 275835 - RNA, 19 nt, Human
gcccgaaggcccggcgccg

SEQ ID NO: 275836 - RNA, 20 nt, Human
gcccugacucccacccgcac

SEQ ID NO: 275837 - RNA, 19 nt, Human
gcggcggccggggcagcgg

SEQ ID NO: 275838 - RNA, 19 nt, Human
ggcgcccugacucccaccc

SEQ ID NO: 275839 - RNA, 22 nt, Human
gggaguucuugaauccaccaug

SEQ ID NO: 275840 - RNA, 19 nt, Human
uagauugagcaaguucagc

SEQ ID NO: 275841 - RNA, 20 nt, Human
ucagggucucuuugguuucc

SEQ ID NO: 275842 - RNA, 18 nt, Human
uccaccaugaaaaucaac

SEQ ID NO: 275843 - RNA, 22 nt, Human
ucuucagggucucuuugguuuc

SEQ ID NO: 275844 - RNA, 19 nt, Human
ugacucccacccgcaccgg

SEQ ID NO: 275845 - RNA, 21 nt, Human
ugagaacugaaaagugaauca

SEQ ID NO: 275846 - RNA, 22 nt, Human
ugccgggccgcugagcgaggac

SEQ ID NO: 275847 - RNA, 18 nt, Human
uggaagcccgaaggcccg

SEQ ID NO: 275848 - RNA, 24 nt, Human
uggaagcccgaaggcccggcgccg

SEQ ID NO: 275849 - RNA, 19 nt, Human
uucagcuccucacuaggga

SEQ ID NO: 275850 - RNA, 18 nt, Human
uucuuuggcauaacacag

SEQ ID NO: 275851 - RNA, 22 nt, Human
uucuuuggcauaacacagcuga

SEQ ID NO: 275852 - RNA, 23 nt, Human
uuuuuuuuuuuuuuuuucagcuu

SEQ ID NO: 275853 - RNA, 24 nt, Human
uuuuuuuuuuuuuuuuuuuuucag

SEQ ID NO: 275854 - RNA, 22 nt, Human
aaagcgcaacuagaaggacuaa

SEQ ID NO: 275855 - RNA, 19 nt, Human
accaggcugggaaccucaa

SEQ ID NO: 275856 - RNA, 22 nt, Human
accguccugccucaggcccugg

SEQ ID NO: 275857 - RNA, 18 nt, Human
acugcauaccagccuggg

SEQ ID NO: 275858 - RNA, 25 nt, Human
acugcauaccagccugggcgcaaug

SEQ ID NO: 275859 - RNA, 21 nt, Human
cagcggaguaccguccugccu

SEQ ID NO: 275860 - RNA, 21 nt, Human
cagugagaccaagaacccacc

SEQ ID NO: 275861 - RNA, 18 nt, Human
ccguccugccucaggccc

SEQ ID NO: 275862 - RNA, 18 nt, Human
ccuggggccaccaggcug

SEQ ID NO: 275863 - RNA, 26 nt, Human
ccuggggccaccaggcugggaaccuc

SEQ ID NO: 275864 - RNA, 23 nt, Human
cugcggcuucauucuugaaguca

SEQ ID NO: 275865 - RNA, 19 nt, Human
gaccggaacguccuggggc

SEQ ID NO: 275866 - RNA, 20 nt, Human
ggacuuggggcagagcuugg

SEQ ID NO: 275867 - RNA, 21 nt, Human
ggcccugggacacccagcaac

SEQ ID NO: 275868 - RNA, 18 nt, Human
uaagggcuucauaggcgu

SEQ ID NO: 275869 - RNA, 25 nt, Human
uacaacaugacugcauaccagccug

SEQ ID NO: 275870 - RNA, 21 nt, Human
uagcaaaagcgcaacuagaag

SEQ ID NO: 275871 - RNA, 18 nt, Human
ugagaccaagaacccacc

SEQ ID NO: 275872 - RNA, 19 nt, Human
ugagaccaagaacccacca

SEQ ID NO: 275873 - RNA, 21 nt, Human
ugccucaggcccugggacacc

SEQ ID NO: 275874 - RNA, 22 nt, Human
ugccucaggcccugggacaccc

SEQ ID NO: 275875 - RNA, 22 nt, Human
ugcgaccggaacguccuggggc

SEQ ID NO: 275876 - RNA, 23 nt, Human
ugcgaccggaacguccuggggcc

SEQ ID NO: 275877 - RNA, 25 nt, Human
uugaagucagugagaccaagaaccc

SEQ ID NO: 275878 - RNA, 27 nt, Human
uugaagucagugagaccaagaacccac

SEQ ID NO: 275879 - RNA, 22 nt, Human
agaaagaacaggaaugagaaca

SEQ ID NO: 275880 - RNA, 23 nt, Human
augagaacagcuuuauuuuguag

SEQ ID NO: 275881 - RNA, 19 nt, Human
caaauccugggcaucucca

SEQ ID NO: 275882 - RNA, 22 nt, Human
cacaccuguaaucccagcuuug

SEQ ID NO: 275883 - RNA, 19 nt, Human
caccagaagggucugguag

SEQ ID NO: 275884 - RNA, 20 nt, Human
caccuguaaucccagcuuug

SEQ ID NO: 275885 - RNA, 21 nt, Human
caccuguaaucccagcuuuga

SEQ ID NO: 275886 - RNA, 24 nt, Human
cuaugcucacaccuguaaucccag

SEQ ID NO: 275887 - RNA, 20 nt, Human
cucacaccuguaaucccagc

SEQ ID NO: 275888 - RNA, 20 nt, Human
cucacaccuguaaucccagc

SEQ ID NO: 275889 - RNA, 18 nt, Human
gaaagaacaggaaugaga

SEQ ID NO: 275890 - RNA, 22 nt, Human
gcagacgccuucucgaugagcc

SEQ ID NO: 275891 - RNA, 26 nt, Human
gcucuuguguaagaaagaacaggaau

SEQ ID NO: 275892 - RNA, 18 nt, Human
ggaauguauuaucucaaa

SEQ ID NO: 275893 - RNA, 23 nt, Human
ggacagaggcacaugacuccagc

SEQ ID NO: 275894 - RNA, 21 nt, Human
uaagaaagaacaggaaugaga

SEQ ID NO: 275895 - RNA, 24 nt, Human
uagcagcugcuaugcaaaguucua

SEQ ID NO: 275896 - RNA, 18 nt, Human
uccgcuccgcuaugcuga

SEQ ID NO: 275897 - RNA, 18 nt, Human
ucucaaagagcuaguagc

SEQ ID NO: 275898 - RNA, 25 nt, Human
ucugcuacaaccuaaggacagaggc

SEQ ID NO: 275899 - RNA, 25 nt, Human
ugagaagaggaucuggcaccagaag

SEQ ID NO: 275900 - RNA, 21 nt, Human
ugccagacgacuccaaggcag

SEQ ID NO: 275901 - RNA, 24 nt, Human
ugcuccggugugcuccgauccgau

SEQ ID NO: 275902 - RNA, 19 nt, Human
ugggaaaggugaaggacag

SEQ ID NO: 275903 - RNA, 18 nt, Human
ugggagaugccagacgac

SEQ ID NO: 275904 - RNA, 18 nt, Human
ugguagaagaaaguggga

SEQ ID NO: 275905 - RNA, 21 nt, Human
uugagaagaggaucuggcacc

SEQ ID NO: 275906 - RNA, 20 nt, Human
uuggucucuggugauuuaga

SEQ ID NO: 275907 - RNA, 23 nt, Human
uuucugcuacaaccuaaggacag

SEQ ID NO: 275908 - RNA, 22 nt, Human
uuugagaagaggaucuggcacc

SEQ ID NO: 275909 - RNA, 21 nt, Human
aaggagcuggggggggggggg

SEQ ID NO: 275910 - RNA, 19 nt, Human
aggagcugggggggggggg

SEQ ID NO: 275911 - RNA, 22 nt, Human
ccuacuguccugggggaccccg

SEQ ID NO: 275912 - RNA, 19 nt, Human
cggcgccggcagcucugcc

SEQ ID NO: 275913 - RNA, 18 nt, Human
cuccgagccccgagucuc

SEQ ID NO: 275914 - RNA, 20 nt, Human
gagccccgagucuccugcag

SEQ ID NO: 275915 - RNA, 22 nt, Human
ggagaccuucuagggaaacuga

SEQ ID NO: 275916 - RNA, 19 nt, Human
ggagcuggggggggggggg

SEQ ID NO: 275917 - RNA, 22 nt, Human
ggcuccgagccccgagucuccu

SEQ ID NO: 275918 - RNA, 19 nt, Human
gggcucagggucccagcaa

SEQ ID NO: 275919 - RNA, 22 nt, Human
ggucccagcaaggagcuggggg

SEQ ID NO: 275920 - RNA, 21 nt, Human
ucccagcaaggagcugggggg

SEQ ID NO: 275921 - RNA, 18 nt, Human
agccagggguuuaguuca

SEQ ID NO: 275922 - RNA, 23 nt, Human
agcggccccgcggggccgggcgc

SEQ ID NO: 275923 - RNA, 21 nt, Human
cagacuccucuccccaucucc

SEQ ID NO: 275924 - RNA, 18 nt, Human
ccgccgccgccgccgccg

SEQ ID NO: 275925 - RNA, 18 nt, Human
ccgccgccgccgccgccg

SEQ ID NO: 275926 - RNA, 21 nt, Human
ccgccgccgccgccgccgcgg

SEQ ID NO: 275927 - RNA, 24 nt, Human
ccgccgccgccgccgcggcugcgg

SEQ ID NO: 275928 - RNA, 20 nt, Human
ccgccgcggcugcgggucuc

SEQ ID NO: 275929 - RNA, 19 nt, Human
ccgccgcuccugggccgca

SEQ ID NO: 275930 - RNA, 24 nt, Human
ccgcggcugcgggucuccgggcuc

SEQ ID NO: 275931 - RNA, 18 nt, Human
ccgggcuccgcggccgcc

SEQ ID NO: 275932 - RNA, 19 nt, Human
ccucccgccgccgcuggga

SEQ ID NO: 275933 - RNA, 22 nt, Human
ccucccgccgccgcugggagac

SEQ ID NO: 275934 - RNA, 18 nt, Human
cgagcgggcgcggcgagc

SEQ ID NO: 275935 - RNA, 21 nt, Human
cgccgccgccgccgccgcggc

SEQ ID NO: 275936 - RNA, 19 nt, Human
cgcggccgccgcuccuggg

SEQ ID NO: 275937 - RNA, 22 nt, Human
cggcgggaggcgcugcucuagc

SEQ ID NO: 275938 - RNA, 21 nt, Human
cgggccggagcggccccgcgg

SEQ ID NO: 275939 - RNA, 25 nt, Human
cgggucccucggcuccugcgagagg

SEQ ID NO: 275940 - RNA, 24 nt, Human
cuccucuccccaucuccuguggcc

SEQ ID NO: 275941 - RNA, 22 nt, Human
cuccugggccgcagccgcgcgg

SEQ ID NO: 275942 - RNA, 22 nt, Human
gccgcagccgcgcgggucccuc

SEQ ID NO: 275943 - RNA, 22 nt, Human
gccgccgccgccgccgccgccg

SEQ ID NO: 275944 - RNA, 20 nt, Human
gcgcgggucccucggcuccu

SEQ ID NO: 275945 - RNA, 18 nt, Human
gcggcgggaggcgcugcu

SEQ ID NO: 275946 - RNA, 22 nt, Human
gcugccgccgccgccgccgccg

SEQ ID NO: 275947 - RNA, 23 nt, Human
gcugcugccgccgccgccgccgg

SEQ ID NO: 275948 - RNA, 18 nt, Human
ggagacgcgccucccgcc

SEQ ID NO: 275949 - RNA, 22 nt, Human
gggccgcagccgcgcggguccc

SEQ ID NO: 275950 - RNA, 26 nt, Human
uccccaucuccuguggccaccccccu

SEQ ID NO: 275951 - RNA, 24 nt, Human
ugugcacaaaagccagggguuuag

SEQ ID NO: 275952 - RNA, 26 nt, Human
uguggccaccccccucauccauuggu

SEQ ID NO: 275953 - RNA, 20 nt, Human
uucagacuccucuccccauc

SEQ ID NO: 275954 - RNA, 22 nt, Human
uucagacuccucuccccaucuc

SEQ ID NO: 275955 - RNA, 26 nt, Human
uuuaguucagacuccucuccccaucu

SEQ ID NO: 275956 - RNA, 22 nt, Human
aaaaaacacaguguaagaacau

SEQ ID NO: 275957 - RNA, 19 nt, Human
aaaaccacagcaggaacca

SEQ ID NO: 275958 - RNA, 21 nt, Human
aaacaaagagaacagagugau

SEQ ID NO: 275959 - RNA, 23 nt, Human
aagagaacagagugaucagagua

SEQ ID NO: 275960 - RNA, 20 nt, Human
aaggaccuuuugagagaaac

SEQ ID NO: 275961 - RNA, 21 nt, Human
acagagaaggcaccucucuca

SEQ ID NO: 275962 - RNA, 18 nt, Human
accuguagaaaaaaaucc

SEQ ID NO: 275963 - RNA, 20 nt, Human
agacaaugcacuauaucuaa

SEQ ID NO: 275964 - RNA, 19 nt, Human
aguacuaaagagaacauac

SEQ ID NO: 275965 - RNA, 23 nt, Human
auagaccacugccacaccauaca

SEQ ID NO: 275966 - RNA, 21 nt, Human
caaaaaacacaguguaagaac

SEQ ID NO: 275967 - RNA, 20 nt, Human
caaaaccacagcaggaacca

SEQ ID NO: 275968 - RNA, 24 nt, Human
caaaauaaaaauauaccaaguaag

SEQ ID NO: 275969 - RNA, 24 nt, Human
caacaccagaagauaauccuccac

SEQ ID NO: 275970 - RNA, 19 nt, Human
cagauuggcuuuacuuaca

SEQ ID NO: 275971 - RNA, 25 nt, Human
ccaaaacaagugagaaacuauucca

SEQ ID NO: 275972 - RNA, 23 nt, Human
ccacaccauacaaauuucuuaca

SEQ ID NO: 275973 - RNA, 20 nt, Human
ccuccacauaaacucucaca

SEQ ID NO: 275974 - RNA, 22 nt, Human
ccuccacauaaacucucacaua

SEQ ID NO: 275975 - RNA, 30 nt, Human
cuaaccacuuaaaguucuguaaaaaaucuu

SEQ ID NO: 275976 - RNA, 24 nt, Human
cucuauuucaacaagauuuacaca

SEQ ID NO: 275977 - RNA, 21 nt, Human
cucuuuaaaacaaagagaaca

SEQ ID NO: 275978 - RNA, 22 nt, Human
gcaccucucucaucucucacuc

SEQ ID NO: 275979 - RNA, 20 nt, Human
gguaaagugugaaauuccag

SEQ ID NO: 275980 - RNA, 27 nt, Human
uaaaaaaucuuaaguuauaaaugaaag

SEQ ID NO: 275981 - RNA, 19 nt, Human
uaaaacaaagagaacagag

SEQ ID NO: 275982 - RNA, 18 nt, Human
uaaauccccagcauuuag

SEQ ID NO: 275983 - RNA, 22 nt, Human
uaacuauaugauauuuaguucc

SEQ ID NO: 275984 - RNA, 25 nt, Human
uaagaagacaugauuucuacacuga

SEQ ID NO: 275985 - RNA, 26 nt, Human
uaagcaucauuuuccuccaaaacaag

SEQ ID NO: 275986 - RNA, 23 nt, Human
uacacaguauuuacaauauggaa

SEQ ID NO: 275987 - RNA, 18 nt, Human
uaggagaaacuaaaauau

SEQ ID NO: 275988 - RNA, 25 nt, Human
uaggagaaacuaaaauauaaaacua

SEQ ID NO: 275989 - RNA, 22 nt, Human
uagucuaaccacuuaaaguucu

SEQ ID NO: 275990 - RNA, 19 nt, Human
uaguuccuuaggaauagac

SEQ ID NO: 275991 - RNA, 22 nt, Human
uaugauggacacaacaccagaa

SEQ ID NO: 275992 - RNA, 23 nt, Human
uauuuuuuuaaaggcccaguaca

SEQ ID NO: 275993 - RNA, 20 nt, Human
ucaaaaaacacaguguaaga

SEQ ID NO: 275994 - RNA, 24 nt, Human
ucaacaaaauauacaccuguagaa

SEQ ID NO: 275995 - RNA, 23 nt, Human
ucuaggaaaaaaacucaucaaac

SEQ ID NO: 275996 - RNA, 23 nt, Human
ucucuacuacaaaccaaaauuuu

SEQ ID NO: 275997 - RNA, 23 nt, Human
ucucucaucucucacucuccuua

SEQ ID NO: 275998 - RNA, 26 nt, Human
ucuguucucauuuaaaaguuuaaacc

SEQ ID NO: 275999 - RNA, 22 nt, Human
ugaaauuccagaaauauaauac

SEQ ID NO: 276000 - RNA, 19 nt, Human
ugaggaaagugacucuuca

SEQ ID NO: 276001 - RNA, 23 nt, Human
ugaguuuuuaacaccuacuguuc

SEQ ID NO: 276002 - RNA, 21 nt, Human
ugauauuuaguuccuuaggaa

SEQ ID NO: 276003 - RNA, 22 nt, Human
uguaguacuuagugauugugua

SEQ ID NO: 276004 - RNA, 19 nt, Human
ugucaaagcuauacaguuu

SEQ ID NO: 276005 - RNA, 25 nt, Human
uuagugauuguguauuuaaaugucu

SEQ ID NO: 276006 - RNA, 20 nt, Human
uucuuauguguccagaaugu

SEQ ID NO: 276007 - RNA, 24 nt, Human
uuuaacauacccauuguaggagaa

SEQ ID NO: 276008 - RNA, 21 nt, Human
uuuuucccaaaauaaaaauau

SEQ ID NO: 276009 - RNA, 24 nt, Human
aacccaguagacacaccuacgaga

SEQ ID NO: 276010 - RNA, 24 nt, Human
aaccgaugguuggcaccauccggu

SEQ ID NO: 276011 - RNA, 22 nt, Human
auaaaauguuauaaaguguauc

SEQ ID NO: 276012 - RNA, 27 nt, Human
auaaagcucuuuaaacuauaaaauguu

SEQ ID NO: 276013 - RNA, 19 nt, Human
auaaaguguaucuacaacc

SEQ ID NO: 276014 - RNA, 18 nt, Human
aucacauucacagccauc

SEQ ID NO: 276015 - RNA, 21 nt, Human
caaccucaacugucacuaaaa

SEQ ID NO: 276016 - RNA, 20 nt, Human
caggaggagcggaggagcug

SEQ ID NO: 276017 - RNA, 21 nt, Human
caguagacacaccuacgagau

SEQ ID NO: 276018 - RNA, 24 nt, Human
cauucacagccaucuagugucacc

SEQ ID NO: 276019 - RNA, 22 nt, Human
ccggaggcggcucuacuucccc

SEQ ID NO: 276020 - RNA, 22 nt, Human
ccugugguugccuccagaucua

SEQ ID NO: 276021 - RNA, 23 nt, Human
cgaccgacccuuagacacaguuc

SEQ ID NO: 276022 - RNA, 26 nt, Human
cugacgccggcggcguucggcugguu

SEQ ID NO: 276023 - RNA, 25 nt, Human
cugcuugccaaagaaugagguuucu

SEQ ID NO: 276024 - RNA, 20 nt, Human
cuucccaagucaacugugca

SEQ ID NO: 276025 - RNA, 18 nt, Human
gacacaccuacgagaugc

SEQ ID NO: 276026 - RNA, 19 nt, Human
gcggaggagcaggagcaaa

SEQ ID NO: 276027 - RNA, 27 nt, Human
gggagaaguuuaguguccugugguugc

SEQ ID NO: 276028 - RNA, 18 nt, Human
guaauacugcuucccaag

SEQ ID NO: 276029 - RNA, 28 nt, Human
guugcuuuuuucaaacagauuuuuggag

SEQ ID NO: 276030 - RNA, 20 nt, Human
uaaaacccaguagacacacc

SEQ ID NO: 276031 - RNA, 22 nt, Human
uacgagaugcuuucuuuguccc

SEQ ID NO: 276032 - RNA, 21 nt, Human
ucaaagcugcugccaaacaac

SEQ ID NO: 276033 - RNA, 19 nt, Human
ugagguuucuuuccugaag

SEQ ID NO: 276034 - RNA, 22 nt, Human
ugccacaucuaacuggcaauua

SEQ ID NO: 276035 - RNA, 24 nt, Human
ugucacuaaaaauaugguauagaa

SEQ ID NO: 276036 - RNA, 26 nt, Human
uguggccgcgcaaggcugcugacgcc

SEQ ID NO: 276037 - RNA, 21 nt, Human
ugugggauggcuuacuccuaa

SEQ ID NO: 276038 - RNA, 19 nt, Human
uguugcuuuuuucaaacag

SEQ ID NO: 276039 - RNA, 26 nt, Human
aaaaaaaauuaaacaucugcuaacca

SEQ ID NO: 276040 - RNA, 20 nt, Human
aaaaagagacaugagacaac

SEQ ID NO: 276041 - RNA, 21 nt, Human
aaagagacaugagacaaccac

SEQ ID NO: 276042 - RNA, 24 nt, Human
aaagagacaugagacaaccacuga

SEQ ID NO: 276043 - RNA, 18 nt, Human
aaccaccuaagacagaaa

SEQ ID NO: 276044 - RNA, 19 nt, Human
aaccacugagaaccagcca

SEQ ID NO: 276045 - RNA, 19 nt, Human
acagaaaaagagacaugag

SEQ ID NO: 276046 - RNA, 19 nt, Human
acagagcaccuccucuuca

SEQ ID NO: 276047 - RNA, 18 nt, Human
agaaaaagagacaugaga

SEQ ID NO: 276048 - RNA, 22 nt, Human
agaaccagccacccggagcuca

SEQ ID NO: 276049 - RNA, 25 nt, Human
agacagaaaaagagacaugagacaa

SEQ ID NO: 276050 - RNA, 22 nt, Human
agaguaaauuuccagguguaga

SEQ ID NO: 276051 - RNA, 21 nt, Human
agcucgggaaagaagcagcgg

SEQ ID NO: 276052 - RNA, 20 nt, Human
caccuccucuucaacgaauc

SEQ ID NO: 276053 - RNA, 24 nt, Human
caugagacaaccacugagaaccag

SEQ ID NO: 276054 - RNA, 25 nt, Human
cccgcggucacaagacaaaccuguc

SEQ ID NO: 276055 - RNA, 19 nt, Human
cccggagcucaguuucugc

SEQ ID NO: 276056 - RNA, 24 nt, Human
cucaguuucugcuacagagcaccu

SEQ ID NO: 276057 - RNA, 19 nt, Human
cucuucaacgaaucacugg

SEQ ID NO: 276058 - RNA, 24 nt, Human
gacaaccacugagaaccagccacc

SEQ ID NO: 276059 - RNA, 19 nt, Human
gacaugagacaaccacuga

SEQ ID NO: 276060 - RNA, 18 nt, Human
gagcucaguuucugcuac

SEQ ID NO: 276061 - RNA, 21 nt, Human
gcgggcccggggaggagccca

SEQ ID NO: 276062 - RNA, 23 nt, Human
gggaaagaagcagcggccgcccg

SEQ ID NO: 276063 - RNA, 19 nt, Human
gguguagaaagaggccaca

SEQ ID NO: 276064 - RNA, 23 nt, Human
uaaaaaaaaaauuaaacaucugc

SEQ ID NO: 276065 - RNA, 24 nt, Human
uaagacagaaaaagagacaugaga

SEQ ID NO: 276066 - RNA, 21 nt, Human
ucggggcgggcccggggagga

SEQ ID NO: 276067 - RNA, 19 nt, Human
ugcaccgaacucaaugagg

SEQ ID NO: 276068 - RNA, 21 nt, Human
uggaggugcugucaagagucu

SEQ ID NO: 276069 - RNA, 23 nt, Human
uguagaaagaggccacaaguuaa

SEQ ID NO: 276070 - RNA, 21 nt, Human
uugaagcagcagagcuggagg

SEQ ID NO: 276071 - RNA, 23 nt, Human
uuuuuuuuuuuuuuuuugacaag

SEQ ID NO: 276072 - RNA, 27 nt, Human
uuuuuuuuuuuuuuuuuuuuuuugggg

SEQ ID NO: 276073 - RNA, 21 nt, Human
aaaagcacacagcaucaaaac

SEQ ID NO: 276074 - RNA, 21 nt, Human
aaagcacacagcaucaaaaca

SEQ ID NO: 276075 - RNA, 21 nt, Human
aagaagaggcggaugccaagg

SEQ ID NO: 276076 - RNA, 22 nt, Human
aagaagaggcggaugccaagga

SEQ ID NO: 276077 - RNA, 21 nt, Human
agaggugcaggggaccaggag

SEQ ID NO: 276078 - RNA, 23 nt, Human
agccaaaagcacacagcaucaaa

SEQ ID NO: 276079 - RNA, 22 nt, Human
aggaggaggaggaggaagagga

SEQ ID NO: 276080 - RNA, 21 nt, Human
aggggucccagggccuggagc

SEQ ID NO: 276081 - RNA, 19 nt, Human
caaaagcacacagcaucaa

SEQ ID NO: 276082 - RNA, 23 nt, Human
caaaagcacacagcaucaaaaca

SEQ ID NO: 276083 - RNA, 18 nt, Human
caaggggucccagggccu

SEQ ID NO: 276084 - RNA, 20 nt, Human
cagcauggcaccgcgaggcc

SEQ ID NO: 276085 - RNA, 19 nt, Human
cagccaaaagcacacagca

SEQ ID NO: 276086 - RNA, 21 nt, Human
caggcccugccccuccccggg

SEQ ID NO: 276087 - RNA, 22 nt, Human
caugcccccuccaguuuggggg

SEQ ID NO: 276088 - RNA, 23 nt, Human
caugcccccuccaguuugggggu

SEQ ID NO: 276089 - RNA, 24 nt, Human
ccaaaagcacacagcaucaaaaca

SEQ ID NO: 276090 - RNA, 19 nt, Human
ccaggcccugccccucccc

SEQ ID NO: 276091 - RNA, 21 nt, Human
ccagggccuggagcccgaggc

SEQ ID NO: 276092 - RNA, 20 nt, Human
ccucgaggucggggagcagg

SEQ ID NO: 276093 - RNA, 19 nt, Human
ccuucagcgccgccgccgg

SEQ ID NO: 276094 - RNA, 21 nt, Human
cggaggcagcgggggaggacg

SEQ ID NO: 276095 - RNA, 20 nt, Human
cgggagcagcggaggcagcg

SEQ ID NO: 276096 - RNA, 21 nt, Human
cucccuggcaaggggucccag

SEQ ID NO: 276097 - RNA, 20 nt, Human
cucuacgguucuccaugccc

SEQ ID NO: 276098 - RNA, 23 nt, Human
gaagaagaggcggaugccaagga

SEQ ID NO: 276099 - RNA, 24 nt, Human
gaagaagaggcggaugccaaggag

SEQ ID NO: 276100 - RNA, 20 nt, Human
gaggaaaggcacgggcggcg

SEQ ID NO: 276101 - RNA, 18 nt, Human
gaggcccagccaaaagca

SEQ ID NO: 276102 - RNA, 19 nt, Human
gaugccaaggaggaggagg

SEQ ID NO: 276103 - RNA, 24 nt, Human
gaugccaaggaggaggaggaggaa

SEQ ID NO: 276104 - RNA, 19 nt, Human
gcagcgggggaggacgcag

SEQ ID NO: 276105 - RNA, 25 nt, Human
ggaagaagaggcggaugccaaggag

SEQ ID NO: 276106 - RNA, 23 nt, Human
ggagcagcggaggcagcggggga

SEQ ID NO: 276107 - RNA, 23 nt, Human
ggcaaggggucccagggccugga

SEQ ID NO: 276108 - RNA, 26 nt, Human
ggcagcgggggaggacgcaggaggaa

SEQ ID NO: 276109 - RNA, 19 nt, Human
ggccaggggcucggcgcgg

SEQ ID NO: 276110 - RNA, 19 nt, Human
gggaagcuccaggcccugc

SEQ ID NO: 276111 - RNA, 19 nt, Human
gggagcagcggaggcagcc

SEQ ID NO: 276112 - RNA, 21 nt, Human
gucggggagcaggugggcguc

SEQ ID NO: 276113 - RNA, 19 nt, Human
uaaaccgaacaggagaggu

SEQ ID NO: 276114 - RNA, 24 nt, Human
uacgguucuccaugcccccuccag

SEQ ID NO: 276115 - RNA, 18 nt, Human
ucccagggccuggagccc

SEQ ID NO: 276116 - RNA, 20 nt, Human
ucggcgcgggcuccgggcuc

SEQ ID NO: 276117 - RNA, 21 nt, Human
ucuaaaccgaacaggagaggu

SEQ ID NO: 276118 - RNA, 24 nt, Human
ucuaaaccgaacaggagaggugca

SEQ ID NO: 276119 - RNA, 20 nt, Human
ucuccaugcccccuccaguu

SEQ ID NO: 276120 - RNA, 24 nt, Human
uuagugggaagcuccaggcccugc

SEQ ID NO: 276121 - RNA, 21 nt, Human
uucuccaugcccccuccaguu

SEQ ID NO: 276122 - RNA, 18 nt, Human
uuuuuuuuuuuuuuucug

SEQ ID NO: 276123 - RNA, 19 nt, Human
aaaaaaaagccacuuggaa

SEQ ID NO: 276124 - RNA, 30 nt, Human
aaaaaaagaaaaaaaagguagggaaagaag

SEQ ID NO: 276125 - RNA, 18 nt, Human
aaaaccagaacaggguag

SEQ ID NO: 276126 - RNA, 23 nt, Human
aaacaauagcacaaaaauguuuc

SEQ ID NO: 276127 - RNA, 23 nt, Human
aaagaaaaaaaagguagggaaag

SEQ ID NO: 276128 - RNA, 21 nt, Human
aacacagcuucaaauaaggcu

SEQ ID NO: 276129 - RNA, 18 nt, Human
aagaagacuccaaauucu

SEQ ID NO: 276130 - RNA, 24 nt, Human
aauaacacaaaauauuuuuuuaag

SEQ ID NO: 276131 - RNA, 25 nt, Human
acacagcuucaaauaagggggaacc

SEQ ID NO: 276132 - RNA, 22 nt, Human
accauucccagaaauggacacc

SEQ ID NO: 276133 - RNA, 24 nt, Human
acugacuccaacuaugugauacca

SEQ ID NO: 276134 - RNA, 21 nt, Human
agaaggaggaggggaggaggc

SEQ ID NO: 276135 - RNA, 19 nt, Human
agagcuggcuuuucagaca

SEQ ID NO: 276136 - RNA, 21 nt, Human
agcgcuaggggcugggaagga

SEQ ID NO: 276137 - RNA, 23 nt, Human
aggaggaaaacuaaacuacaauc

SEQ ID NO: 276138 - RNA, 18 nt, Human
aggaggggaggaggcgga

SEQ ID NO: 276139 - RNA, 19 nt, Human
aggcggcggcgagaggagc

SEQ ID NO: 276140 - RNA, 23 nt, Human
aggcuucagaaaguuucacaguu

SEQ ID NO: 276141 - RNA, 19 nt, Human
agggaauggggguuggggg

SEQ ID NO: 276142 - RNA, 27 nt, Human
agguagggaaagaagaagggaaugaga

SEQ ID NO: 276143 - RNA, 24 nt, Human
auuaugcacugacuccaacuaugu

SEQ ID NO: 276144 - RNA, 23 nt, Human
caaauucuuggcauaugaaucaa

SEQ ID NO: 276145 - RNA, 29 nt, Human
caaauucuuggcauaugaaucagcuguuc

SEQ ID NO: 276146 - RNA, 21 nt, Human
cacccuuggcuuuauaggcuc

SEQ ID NO: 276147 - RNA, 23 nt, Human
cacugacuccaacuaugugauac

SEQ ID NO: 276148 - RNA, 19 nt, Human
cagaaaggccuggcugaag

SEQ ID NO: 276149 - RNA, 19 nt, Human
cagaaccgccaauggcggc

SEQ ID NO: 276150 - RNA, 21 nt, Human
ccagccuggauagagugacaa

SEQ ID NO: 276151 - RNA, 24 nt, Human
cccgugccaaaaaaaaaaaaagcc

SEQ ID NO: 276152 - RNA, 18 nt, Human
cgagaggagcggcugaag

SEQ ID NO: 276153 - RNA, 19 nt, Human
cgaggaagagcaggcggcg

SEQ ID NO: 276154 - RNA, 18 nt, Human
cgcggcgaggcccaggcu

SEQ ID NO: 276155 - RNA, 18 nt, Human
cggggaagggggcggagg

SEQ ID NO: 276156 - RNA, 24 nt, Human
cuaaagggaggaaaaaaaccagaa

SEQ ID NO: 276157 - RNA, 22 nt, Human
cucacaaucugaugaccuucug

SEQ ID NO: 276158 - RNA, 28 nt, Human
cugaagacgagaaggaggaggggaggag

SEQ ID NO: 276159 - RNA, 19 nt, Human
cuucagaaaggccuggcug

SEQ ID NO: 276160 - RNA, 21 nt, Human
cuuuaaaaagaaaaaaauaau

SEQ ID NO: 276161 - RNA, 22 nt, Human
gaaggaggaggggaggaggcgg

SEQ ID NO: 276162 - RNA, 18 nt, Human
gacuccaaauucuuggca

SEQ ID NO: 276163 - RNA, 18 nt, Human
gagccuggggggcggggg

SEQ ID NO: 276164 - RNA, 18 nt, Human
gagccuggggggcggggg

SEQ ID NO: 276165 - RNA, 20 nt, Human
gaggggaggaggcggagggc

SEQ ID NO: 276166 - RNA, 18 nt, Human
gagggggcggcagcugcc

SEQ ID NO: 276167 - RNA, 18 nt, Human
gccaaaaaaaaaaaaagc

SEQ ID NO: 276168 - RNA, 20 nt, Human
gccggagcgcuaggggcugg

SEQ ID NO: 276169 - RNA, 22 nt, Human
gcgaagcagcagaaccgccaag

SEQ ID NO: 276170 - RNA, 19 nt, Human
gcgcgggcgaccgccggag

SEQ ID NO: 276171 - RNA, 19 nt, Human
gcgcgggcgaccgccggag

SEQ ID NO: 276172 - RNA, 21 nt, Human
gcggcgagcgagggagggggc

SEQ ID NO: 276173 - RNA, 18 nt, Human
gcggcgaggcccaggcug

SEQ ID NO: 276174 - RNA, 19 nt, Human
gcggcggcgagaggagcgg

SEQ ID NO: 276175 - RNA, 20 nt, Human
gcugaagaucuuuuuauuuc

SEQ ID NO: 276176 - RNA, 19 nt, Human
gcuguucgguagcuccacc

SEQ ID NO: 276177 - RNA, 21 nt, Human
ggaggaaaaaaaccagaacag

SEQ ID NO: 276178 - RNA, 19 nt, Human
ggcgagcgagggagggggc

SEQ ID NO: 276179 - RNA, 24 nt, Human
ggcggcgagcgagggagggggcgg

SEQ ID NO: 276180 - RNA, 18 nt, Human
ggcuccuugcagaaccca

SEQ ID NO: 276181 - RNA, 18 nt, Human
ggcugggaaggaggcggu

SEQ ID NO: 276182 - RNA, 22 nt, Human
gggaaagaagaagggaaugaga

SEQ ID NO: 276183 - RNA, 18 nt, Human
gggaauggggguuggggg

SEQ ID NO: 276184 - RNA, 21 nt, Human
gggaauggggguugggggugg

SEQ ID NO: 276185 - RNA, 20 nt, Human
gggagaagccaguguugaua

SEQ ID NO: 276186 - RNA, 19 nt, Human
gggcugggaaggaggcggu

SEQ ID NO: 276187 - RNA, 24 nt, Human
guggaggcggcggcgagaggagcg

SEQ ID NO: 276188 - RNA, 21 nt, Human
guuuuuuuuuuggccaagggg

SEQ ID NO: 276189 - RNA, 20 nt, Human
uaaacuacaauccuugguuc

SEQ ID NO: 276190 - RNA, 25 nt, Human
uaacuacauucauuguccaaccccc

SEQ ID NO: 276191 - RNA, 23 nt, Human
uaccguuaagccacaccaaauau

SEQ ID NO: 276192 - RNA, 20 nt, Human
uagaguguuaaauacuuuua

SEQ ID NO: 276193 - RNA, 20 nt, Human
uauuuuuuuaaaacaauagc

SEQ ID NO: 276194 - RNA, 24 nt, Human
ucacaaaaaugcucuucaccaaga

SEQ ID NO: 276195 - RNA, 24 nt, Human
ucagaacaaaaauaaaauguccca

SEQ ID NO: 276196 - RNA, 24 nt, Human
ucauuguccaacccccacugguuu

SEQ ID NO: 276197 - RNA, 20 nt, Human
ucccagaaauggacaccacc

SEQ ID NO: 276198 - RNA, 18 nt, Human
ucccagaaauggacaccu

SEQ ID NO: 276199 - RNA, 19 nt, Human
uccuugguucagauugagu

SEQ ID NO: 276200 - RNA, 20 nt, Human
ugaagagguucaagagcugg

SEQ ID NO: 276201 - RNA, 20 nt, Human
ugaagcaaacaguggcacac

SEQ ID NO: 276202 - RNA, 19 nt, Human
ugaauugcugauuuuccuu

SEQ ID NO: 276203 - RNA, 18 nt, Human
ugauaccagcuaucagcc

SEQ ID NO: 276204 - RNA, 18 nt, Human
ugaucaguccccgugcca

SEQ ID NO: 276205 - RNA, 19 nt, Human
ugccaaaaaaaaaaaaagc

SEQ ID NO: 276206 - RNA, 19 nt, Human
uggcgggcgagcugccuac

SEQ ID NO: 276207 - RNA, 20 nt, Human
uggggguggaacuaaaggga

SEQ ID NO: 276208 - RNA, 19 nt, Human
uggggguuggggguggaac

SEQ ID NO: 276209 - RNA, 21 nt, Human
uguugauacuguugugaagag

SEQ ID NO: 276210 - RNA, 26 nt, Human
uguuuuuugcuuuuuguuuuuuuuuu

SEQ ID NO: 276211 - RNA, 18 nt, Human
uuacauuuuuauuuuuua

SEQ ID NO: 276212 - RNA, 21 nt, Human
uucaagagcuggcuuuucaga

SEQ ID NO: 276213 - RNA, 20 nt, Human
uucauuguccaacccccacu

SEQ ID NO: 276214 - RNA, 22 nt, Human
uugcugaauugcugauuuuccu

SEQ ID NO: 276215 - RNA, 20 nt, Human
uuggccaaggggucggucac

SEQ ID NO: 276216 - RNA, 18 nt, Human
uugguagguuauaaaaac

SEQ ID NO: 276217 - RNA, 20 nt, Human
uuucacaguuucguuaugcu

SEQ ID NO: 276218 - RNA, 23 nt, Human
uuuuaaccacugacaaggcuuca

SEQ ID NO: 276219 - RNA, 22 nt, Human
uuuuguguuuaaccauucccag

SEQ ID NO: 276220 - RNA, 30 nt, Human
uuuuuguuuuuugcuuuuuguuuuuuuuuu

SEQ ID NO: 276221 - RNA, 25 nt, Human
uuuuuguuuuuuuuuuggccaaggg

SEQ ID NO: 276222 - RNA, 18 nt, Human
uuuuuugcuuuuuguuuu

SEQ ID NO: 276223 - RNA, 26 nt, Human
aaaaggcaaaagcgacucugguggga

SEQ ID NO: 276224 - RNA, 24 nt, Human
aaaguguugggauuacaggcguga

SEQ ID NO: 276225 - RNA, 19 nt, Human
aaguagcugggauuacagg

SEQ ID NO: 276226 - RNA, 24 nt, Human
aaguagcugggauuacaggcacgc

SEQ ID NO: 276227 - RNA, 21 nt, Human
aaguguugggauuacaggcgu

SEQ ID NO: 276228 - RNA, 26 nt, Human
aaguguugggauuacaggcgugagcc

SEQ ID NO: 276229 - RNA, 24 nt, Human
aauuuuguguuuuuaguacagaua

SEQ ID NO: 276230 - RNA, 23 nt, Human
agaaagaaaagaguaaaaccuaa

SEQ ID NO: 276231 - RNA, 19 nt, Human
agggcuagaggcugccacu

SEQ ID NO: 276232 - RNA, 24 nt, Human
aggugauccacccaccucggccuc

SEQ ID NO: 276233 - RNA, 21 nt, Human
agugacagugauuuuugguuc

SEQ ID NO: 276234 - RNA, 24 nt, Human
agugcaauggcacgaucuuggcuc

SEQ ID NO: 276235 - RNA, 22 nt, Human
aucuggccuguuucuucggcgg

SEQ ID NO: 276236 - RNA, 20 nt, Human
augcaacaaggccugaaagg

SEQ ID NO: 276237 - RNA, 18 nt, Human
auuuuauuuucacaugga

SEQ ID NO: 276238 - RNA, 27 nt, Human
caaacaauucuucuaccucagccuccc

SEQ ID NO: 276239 - RNA, 24 nt, Human
caaaguguugggauuacaggcgug

SEQ ID NO: 276240 - RNA, 22 nt, Human
caacaguaccuaucuccuacag

SEQ ID NO: 276241 - RNA, 23 nt, Human
caaccuccaccucccagguucaa

SEQ ID NO: 276242 - RNA, 22 nt, Human
cacccaccucggccucccaaag

SEQ ID NO: 276243 - RNA, 23 nt, Human
cacccaccucggccucccaaagu

SEQ ID NO: 276244 - RNA, 24 nt, Human
caccucggccucccaaaguguugg

SEQ ID NO: 276245 - RNA, 22 nt, Human
cacuaccacgcccagcuaauuu

SEQ ID NO: 276246 - RNA, 24 nt, Human
cacucuuguugccuaggcuggagu

SEQ ID NO: 276247 - RNA, 21 nt, Human
cacugcaaccuccaccuccca

SEQ ID NO: 276248 - RNA, 23 nt, Human
cagaacuuucauaauaugacaga

SEQ ID NO: 276249 - RNA, 18 nt, Human
cagagcacuuauuuucuu

SEQ ID NO: 276250 - RNA, 22 nt, Human
ccaaaguguugggauuacaggc

SEQ ID NO: 276251 - RNA, 22 nt, Human
ccaaaguguugggauuacaggc

SEQ ID NO: 276252 - RNA, 24 nt, Human
ccaaaguguugggauuacaggcgu

SEQ ID NO: 276253 - RNA, 23 nt, Human
ccaaguagcugggauuacaggca

SEQ ID NO: 276254 - RNA, 26 nt, Human
ccaccucccagguucaaacaauucuu

SEQ ID NO: 276255 - RNA, 23 nt, Human
cccaaguagcugggauuacaggc

SEQ ID NO: 276256 - RNA, 24 nt, Human
cccaaguagcugggauuacaggca

SEQ ID NO: 276257 - RNA, 19 nt, Human
ccuaggcuggagugcaaug

SEQ ID NO: 276258 - RNA, 24 nt, Human
ccucccagguucaaacaauucuuc

SEQ ID NO: 276259 - RNA, 24 nt, Human
ccugaccucaggugauccacccac

SEQ ID NO: 276260 - RNA, 24 nt, Human
cucacugcaaccuccaccucccag

SEQ ID NO: 276261 - RNA, 24 nt, Human
cucagccucccaaguagcugggau

SEQ ID NO: 276262 - RNA, 18 nt, Human
cucuuguugccuaggcug

SEQ ID NO: 276263 - RNA, 21 nt, Human
cugaaaguuucuuuuugugcu

SEQ ID NO: 276264 - RNA, 19 nt, Human
cugaauuaagugauacaac

SEQ ID NO: 276265 - RNA, 23 nt, Human
cugcaaccuccaccucccagguu

SEQ ID NO: 276266 - RNA, 24 nt, Human
cugcaaccuccaccucccagguuc

SEQ ID NO: 276267 - RNA, 22 nt, Human
cuuguugccuaggcuggagugc

SEQ ID NO: 276268 - RNA, 24 nt, Human
cuuguugccuaggcuggagugcaa

SEQ ID NO: 276269 - RNA, 24 nt, Human
gaccucaggugauccacccaccuc

SEQ ID NO: 276270 - RNA, 18 nt, Human
gauuacaggcgugagcca

SEQ ID NO: 276271 - RNA, 22 nt, Human
gauuacaggcgugagccaccgc

SEQ ID NO: 276272 - RNA, 22 nt, Human
gauuacaggcgugagccaccgc

SEQ ID NO: 276273 - RNA, 22 nt, Human
gcaaccuccaccucccagguuc

SEQ ID NO: 276274 - RNA, 19 nt, Human
gccuaggcuggagugcaau

SEQ ID NO: 276275 - RNA, 19 nt, Human
gcuggagugcaauggcacg

SEQ ID NO: 276276 - RNA, 23 nt, Human
gcuggucucaaacuccugaccuc

SEQ ID NO: 276277 - RNA, 19 nt, Human
ggaaacaccuucauaccau

SEQ ID NO: 276278 - RNA, 18 nt, Human
ggauuaacugggcuaaug

SEQ ID NO: 276279 - RNA, 24 nt, Human
ggcuggucucaaacuccugaccuc

SEQ ID NO: 276280 - RNA, 18 nt, Human
guagcugggauuacaggc

SEQ ID NO: 276281 - RNA, 24 nt, Human
gugauccacccaccucggccuccc

SEQ ID NO: 276282 - RNA, 22 nt, Human
uaaaaggaaaggcuugggacau

SEQ ID NO: 276283 - RNA, 26 nt, Human
uaaggcagaacaucuuagguuguaga

SEQ ID NO: 276284 - RNA, 23 nt, Human
uaaguuguaaagugacagugauu

SEQ ID NO: 276285 - RNA, 23 nt, Human
uaauuuuguguuuuuaguacaga

SEQ ID NO: 276286 - RNA, 22 nt, Human
uacaggcgugagccaccgcgcc

SEQ ID NO: 276287 - RNA, 22 nt, Human
uacaggcgugagccaccgcgcc

SEQ ID NO: 276288 - RNA, 23 nt, Human
uacaggcgugagccaccgcgccu

SEQ ID NO: 276289 - RNA, 24 nt, Human
uaccucagccucccaaguagcugg

SEQ ID NO: 276290 - RNA, 21 nt, Human
uagaaagaaaagaguaaaacc

SEQ ID NO: 276291 - RNA, 23 nt, Human
ucacagguuuaucugagaugcaa

SEQ ID NO: 276292 - RNA, 21 nt, Human
ucacucuuguugccuaggcug

SEQ ID NO: 276293 - RNA, 23 nt, Human
ucacucuuguugccuaggcugga

SEQ ID NO: 276294 - RNA, 24 nt, Human
ucacugcaaccuccaccucccagg

SEQ ID NO: 276295 - RNA, 25 nt, Human
ucacugcaaccuccaccucccaggu

SEQ ID NO: 276296 - RNA, 27 nt, Human
ucacugcaaccuccaccucccagguuc

SEQ ID NO: 276297 - RNA, 18 nt, Human
ucagccucccaaguagcu

SEQ ID NO: 276298 - RNA, 20 nt, Human
ucagccucccaaguagcugg

SEQ ID NO: 276299 - RNA, 24 nt, Human
ucccaaaguguugggauuacaggc

SEQ ID NO: 276300 - RNA, 24 nt, Human
ucccaaguagcugggauuacaggc

SEQ ID NO: 276301 - RNA, 19 nt, Human
ucccagguucaaacaauuc

SEQ ID NO: 276302 - RNA, 20 nt, Human
ucccagguucaaacaauucu

SEQ ID NO: 276303 - RNA, 21 nt, Human
uccgugggaagcugagggcua

SEQ ID NO: 276304 - RNA, 23 nt, Human
ucuccagugccugaaaguuucuu

SEQ ID NO: 276305 - RNA, 23 nt, Human
ucuccuacaguaggugugaggau

SEQ ID NO: 276306 - RNA, 19 nt, Human
ucuuguugccuaggcugga

SEQ ID NO: 276307 - RNA, 21 nt, Human
ugaccucaggugauccaccca

SEQ ID NO: 276308 - RNA, 24 nt, Human
ugaccucaggugauccacccaccu

SEQ ID NO: 276309 - RNA, 19 nt, Human
ugagaaaugcucagacaca

SEQ ID NO: 276310 - RNA, 22 nt, Human
ugagaugcaacaaggccugaaa

SEQ ID NO: 276311 - RNA, 24 nt, Human
ugauccacccaccucggccuccca

SEQ ID NO: 276312 - RNA, 18 nt, Human
ugauuccgugggaagcug

SEQ ID NO: 276313 - RNA, 20 nt, Human
ugccuaggcuggagugcaau

SEQ ID NO: 276314 - RNA, 21 nt, Human
ugccuaggcuggagugcaaug

SEQ ID NO: 276315 - RNA, 24 nt, Human
ugccuaggcuggagugcaauggca

SEQ ID NO: 276316 - RNA, 23 nt, Human
ugccugaaaguuucuuuuugugc

SEQ ID NO: 276317 - RNA, 27 nt, Human
ugcucagacacacaguaggugcucaau

SEQ ID NO: 276318 - RNA, 23 nt, Human
uggagugcaauggcacgaucuug

SEQ ID NO: 276319 - RNA, 24 nt, Human
uggagugcaauggcacgaucuugg

SEQ ID NO: 276320 - RNA, 24 nt, Human
uggccaggcuggucucaaacuccu

SEQ ID NO: 276321 - RNA, 19 nt, Human
ugggauuacaggcacgcac

SEQ ID NO: 276322 - RNA, 21 nt, Human
ugggauuacaggcacgcacua

SEQ ID NO: 276323 - RNA, 24 nt, Human
ugggauuacaggcacgcacuacca

SEQ ID NO: 276324 - RNA, 18 nt, Human
ugggauuacaggcgugag

SEQ ID NO: 276325 - RNA, 19 nt, Human
ugggauuacaggcgugagc

SEQ ID NO: 276326 - RNA, 21 nt, Human
ugggauuacaggcgugagcca

SEQ ID NO: 276327 - RNA, 22 nt, Human
ugggauuacaggcgugagccac

SEQ ID NO: 276328 - RNA, 23 nt, Human
ugggauuacaggcgugagccacc

SEQ ID NO: 276329 - RNA, 24 nt, Human
ugggauuacaggcgugagccaccg

SEQ ID NO: 276330 - RNA, 20 nt, Human
ugggcuaaugagaaaugcuc

SEQ ID NO: 276331 - RNA, 19 nt, Human
uguuggccaggcuggucuc

SEQ ID NO: 276332 - RNA, 19 nt, Human
uuaucacuaaaaggaaagg

SEQ ID NO: 276333 - RNA, 24 nt, Human
uucaaacaauucuucuaccucagc

SEQ ID NO: 276334 - RNA, 24 nt, Human
uucacucuuguugccuaggcugga

SEQ ID NO: 276335 - RNA, 24 nt, Human
uucuugauuugaaaaggcaaaagc

SEQ ID NO: 276336 - RNA, 18 nt, Human
uugcaaauauguuuuccc

SEQ ID NO: 276337 - RNA, 18 nt, Human
uugccuaggcuggagugc

SEQ ID NO: 276338 - RNA, 24 nt, Human
uuucacucuuguugccuaggcugg

SEQ ID NO: 276339 - RNA, 29 nt, Human
uuucugagacuggggcucaaggguacccc

SEQ ID NO: 276340 - RNA, 20 nt, Human
uuuuguguuuuuaguacaga

SEQ ID NO: 276341 - RNA, 20 nt, Human
uuuuugguuccaucauuuua

SEQ ID NO: 276342 - RNA, 24 nt, Human
aaagugcugggauuauaggcguga

SEQ ID NO: 276343 - RNA, 20 nt, Human
aaguagcugggacuacaggc

SEQ ID NO: 276344 - RNA, 22 nt, Human
aaguagcugggacuacaggcau

SEQ ID NO: 276345 - RNA, 24 nt, Human
aaguagcugggacuacaggcaugc

SEQ ID NO: 276346 - RNA, 19 nt, Human
aagugcugggauuauaggc

SEQ ID NO: 276347 - RNA, 19 nt, Human
aagugcugggauuauaggc

SEQ ID NO: 276348 - RNA, 20 nt, Human
accauguuggccaggcuggu

SEQ ID NO: 276349 - RNA, 23 nt, Human
accauguuggccaggcuggucuc

SEQ ID NO: 276350 - RNA, 24 nt, Human
accauguuggccaggcuggucucg

SEQ ID NO: 276351 - RNA, 23 nt, Human
aggcgugagucaccgcacccggc

SEQ ID NO: 276352 - RNA, 25 nt, Human
aggcuggagugcaguggcgugaucu

SEQ ID NO: 276353 - RNA, 24 nt, Human
aggugauccacccgccucagccuc

SEQ ID NO: 276354 - RNA, 19 nt, Human
agugcaguggcgugaucuc

SEQ ID NO: 276355 - RNA, 21 nt, Human
agugcaguggcgugaucucag

SEQ ID NO: 276356 - RNA, 23 nt, Human
agugcaguggcgugaucucagcu

SEQ ID NO: 276357 - RNA, 24 nt, Human
agugcaguggcgugaucucagcuc

SEQ ID NO: 276358 - RNA, 24 nt, Human
aguggcgugaucucagcucacugc

SEQ ID NO: 276359 - RNA, 18 nt, Human
auggaguuuuaccauguu

SEQ ID NO: 276360 - RNA, 24 nt, Human
auggaguuuuaccauguuggccag

SEQ ID NO: 276361 - RNA, 24 nt, Human
caaagugcugggauuauaggcgug

SEQ ID NO: 276362 - RNA, 20 nt, Human
caaccuccgccuccuggguu

SEQ ID NO: 276363 - RNA, 27 nt, Human
caagcaauucucaugcaucagccuccc

SEQ ID NO: 276364 - RNA, 23 nt, Human
cacccgccucagccucccaaagu

SEQ ID NO: 276365 - RNA, 21 nt, Human
cacugcaaccuccgccuccug

SEQ ID NO: 276366 - RNA, 23 nt, Human
cacugcaaccuccgccuccuggg

SEQ ID NO: 276367 - RNA, 24 nt, Human
cauguuggccaggcuggucucgaa

SEQ ID NO: 276368 - RNA, 20 nt, Human
ccaaagugcugggauuauag

SEQ ID NO: 276369 - RNA, 22 nt, Human
ccaaagugcugggauuauaggc

SEQ ID NO: 276370 - RNA, 24 nt, Human
ccaaagugcugggauuauaggcgu

SEQ ID NO: 276371 - RNA, 26 nt, Human
ccacccgccucagccucccaaagugc

SEQ ID NO: 276372 - RNA, 24 nt, Human
ccaguggaguguaaauuccugcag

SEQ ID NO: 276373 - RNA, 23 nt, Human
cccaaguagcugggacuacaggc

SEQ ID NO: 276374 - RNA, 24 nt, Human
cccaaguagcugggacuacaggca

SEQ ID NO: 276375 - RNA, 20 nt, Human
ccgcacccggcagcauuuca

SEQ ID NO: 276376 - RNA, 24 nt, Human
ccgccucagccucccaaagugcug

SEQ ID NO: 276377 - RNA, 27 nt, Human
ccgccuccuggguucaagcaauucuuu

SEQ ID NO: 276378 - RNA, 23 nt, Human
ccuccauguccucuccugacacc

SEQ ID NO: 276379 - RNA, 19 nt, Human
ccuccgccuccuggguuca

SEQ ID NO: 276380 - RNA, 22 nt, Human
ccuccuggguucaagcaauucu

SEQ ID NO: 276381 - RNA, 22 nt, Human
ccugaccucaggugauccaccc

SEQ ID NO: 276382 - RNA, 23 nt, Human
ccugaccucaggugauccacccg

SEQ ID NO: 276383 - RNA, 22 nt, Human
ccuggcuaauuuuuuauauuuu

SEQ ID NO: 276384 - RNA, 23 nt, Human
ccuggguucaagcaauucucaug

SEQ ID NO: 276385 - RNA, 24 nt, Human
cgcccaggcuggagugcaguggcg

SEQ ID NO: 276386 - RNA, 24 nt, Human
cgccucagccucccaaagugcugg

SEQ ID NO: 276387 - RNA, 24 nt, Human
cgcucugucgcccaggcuggagug

SEQ ID NO: 276388 - RNA, 22 nt, Human
cguuuacaaucugcccuguccu

SEQ ID NO: 276389 - RNA, 24 nt, Human
cucacugcaaccuccgccuccugg

SEQ ID NO: 276390 - RNA, 18 nt, Human
cucaugcaucagccuccc

SEQ ID NO: 276391 - RNA, 21 nt, Human
cuccuggguucaagcaauucu

SEQ ID NO: 276392 - RNA, 24 nt, Human
cucgcucugucgcccaggcuggag

SEQ ID NO: 276393 - RNA, 26 nt, Human
cugcccuguccuuuuggagaaguuua

SEQ ID NO: 276394 - RNA, 24 nt, Human
cuggagugcaguggcgugaucuca

SEQ ID NO: 276395 - RNA, 24 nt, Human
gaccucaggugauccacccgccuc

SEQ ID NO: 276396 - RNA, 22 nt, Human
gauuauaggcgugagucaccgc

SEQ ID NO: 276397 - RNA, 22 nt, Human
gcaaccuccgccuccuggguuc

SEQ ID NO: 276398 - RNA, 20 nt, Human
gcaucagccucccaaguagc

SEQ ID NO: 276399 - RNA, 20 nt, Human
gcccaggcuggagugcagug

SEQ ID NO: 276400 - RNA, 24 nt, Human
gcccaggcuggagugcaguggcgu

SEQ ID NO: 276401 - RNA, 25 nt, Human
gcucugucgcccaggcuggagugca

SEQ ID NO: 276402 - RNA, 19 nt, Human
gcuggagugcaguggcgug

SEQ ID NO: 276403 - RNA, 23 nt, Human
gcuggucucgaacuccugaccuc

SEQ ID NO: 276404 - RNA, 19 nt, Human
ggacuacaggcaugcgcca

SEQ ID NO: 276405 - RNA, 22 nt, Human
ggaguuuuaccauguuggccag

SEQ ID NO: 276406 - RNA, 22 nt, Human
ggcuggagugcaguggcgugau

SEQ ID NO: 276407 - RNA, 24 nt, Human
ggcuggucucgaacuccugaccuc

SEQ ID NO: 276408 - RNA, 19 nt, Human
ggucucgaacuccugaccu

SEQ ID NO: 276409 - RNA, 24 nt, Human
gugauccacccgccucagccuccc

SEQ ID NO: 276410 - RNA, 18 nt, Human
guuucuaaagccaacccc

SEQ ID NO: 276411 - RNA, 22 nt, Human
uaauuuuuuauauuuuuaguag

SEQ ID NO: 276412 - RNA, 21 nt, Human
uaccauguuggccaggcuggu

SEQ ID NO: 276413 - RNA, 24 nt, Human
uaccauguuggccaggcuggucuc

SEQ ID NO: 276414 - RNA, 27 nt, Human
uaccauguuggccaggcuggucucgaa

SEQ ID NO: 276415 - RNA, 24 nt, Human
uaguagaaauggaguuuuaccaug

SEQ ID NO: 276416 - RNA, 23 nt, Human
ucacugcaaccuccgccuccugg

SEQ ID NO: 276417 - RNA, 24 nt, Human
ucacugcaaccuccgccuccuggg

SEQ ID NO: 276418 - RNA, 25 nt, Human
ucacugcaaccuccgccuccugggu

SEQ ID NO: 276419 - RNA, 26 nt, Human
ucacugcaaccuccgccuccuggguu

SEQ ID NO: 276420 - RNA, 22 nt, Human
ucagcccccuccauguccucuc

SEQ ID NO: 276421 - RNA, 20 nt, Human
ucagccucccaaguagcugg

SEQ ID NO: 276422 - RNA, 21 nt, Human
uccacccgccucagccuccca

SEQ ID NO: 276423 - RNA, 24 nt, Human
ucccaaagugcugggauuauaggc

SEQ ID NO: 276424 - RNA, 24 nt, Human
ucccaaguagcugggacuacaggc

SEQ ID NO: 276425 - RNA, 24 nt, Human
uccgccuccuggguucaagcaauu

SEQ ID NO: 276426 - RNA, 21 nt, Human
uccuggguucaagcaauucuc

SEQ ID NO: 276427 - RNA, 24 nt, Human
uccuggguucaagcaauucucaug

SEQ ID NO: 276428 - RNA, 24 nt, Human
ucgcccaggcuggagugcaguggc

SEQ ID NO: 276429 - RNA, 24 nt, Human
ucgcucugucgcccaggcuggagu

SEQ ID NO: 276430 - RNA, 23 nt, Human
ucucgaacuccugaccucaggug

SEQ ID NO: 276431 - RNA, 19 nt, Human
ucucgcucugucgcccagg

SEQ ID NO: 276432 - RNA, 23 nt, Human
ucucgcucugucgcccaggcugg

SEQ ID NO: 276433 - RNA, 24 nt, Human
ucucgcucugucgcccaggcugga

SEQ ID NO: 276434 - RNA, 26 nt, Human
ucucgcucugucgcccaggcuggagu

SEQ ID NO: 276435 - RNA, 24 nt, Human
ucugucgcccaggcuggagugcag

SEQ ID NO: 276436 - RNA, 21 nt, Human
ugaccucaggugauccacccg

SEQ ID NO: 276437 - RNA, 24 nt, Human
ugaccucaggugauccacccgccu

SEQ ID NO: 276438 - RNA, 18 nt, Human
ugagacagaaucucgcuc

SEQ ID NO: 276439 - RNA, 22 nt, Human
ugagacagaaucucgcucuguc

SEQ ID NO: 276440 - RNA, 23 nt, Human
ugagacgacguuuacaaucugcc

SEQ ID NO: 276441 - RNA, 22 nt, Human
ugcaguggcgugaucucagcuc

SEQ ID NO: 276442 - RNA, 24 nt, Human
ugcaucagccucccaaguagcugg

SEQ ID NO: 276443 - RNA, 19 nt, Human
uggagugcaguggcgugau

SEQ ID NO: 276444 - RNA, 24 nt, Human
uggagugcaguggcgugaucucag

SEQ ID NO: 276445 - RNA, 24 nt, Human
uggaguuuuaccauguuggccagg

SEQ ID NO: 276446 - RNA, 24 nt, Human
uggccaggcuggucucgaacuccu

SEQ ID NO: 276447 - RNA, 24 nt, Human
uggcgugaucucagcucacugcaa

SEQ ID NO: 276448 - RNA, 21 nt, Human
ugggacuacaggcaugcgcca

SEQ ID NO: 276449 - RNA, 22 nt, Human
ugggacuacaggcaugcgccac

SEQ ID NO: 276450 - RNA, 22 nt, Human
ugggacuacaggcaugcgccac

SEQ ID NO: 276451 - RNA, 23 nt, Human
ugggacuacaggcaugcgccacu

SEQ ID NO: 276452 - RNA, 24 nt, Human
ugggacuacaggcaugcgccacua

SEQ ID NO: 276453 - RNA, 18 nt, Human
ugggauuauaggcgugag

SEQ ID NO: 276454 - RNA, 18 nt, Human
ugggauuauaggcgugag

SEQ ID NO: 276455 - RNA, 21 nt, Human
ugggauuauaggcgugaguca

SEQ ID NO: 276456 - RNA, 22 nt, Human
ugggauuauaggcgugagucac

SEQ ID NO: 276457 - RNA, 23 nt, Human
ugggauuauaggcgugagucacc

SEQ ID NO: 276458 - RNA, 24 nt, Human
ugggauuauaggcgugagucaccg

SEQ ID NO: 276459 - RNA, 21 nt, Human
uuacaaucugcccuguccuuu

SEQ ID NO: 276460 - RNA, 18 nt, Human
uuaguagaaauggaguuu

SEQ ID NO: 276461 - RNA, 18 nt, Human
uuaguagaaauggaguuu

SEQ ID NO: 276462 - RNA, 24 nt, Human
uuaguagaaauggaguuuuaccau

SEQ ID NO: 276463 - RNA, 21 nt, Human
uuuuuaguagaaauggaguuu

SEQ ID NO: 276464 - RNA, 18 nt, Human
aaccaaguucccagaagu

SEQ ID NO: 276465 - RNA, 21 nt, Human
aagggcagggaaugaggacag

SEQ ID NO: 276466 - RNA, 18 nt, Human
acggaaacauguugucug

SEQ ID NO: 276467 - RNA, 22 nt, Human
aggacauacagugaaagggaca

SEQ ID NO: 276468 - RNA, 18 nt, Human
aggggcaagggagcgcag

SEQ ID NO: 276469 - RNA, 18 nt, Human
auagagugugacaagccc

SEQ ID NO: 276470 - RNA, 20 nt, Human
cagaggacauacagugaaag

SEQ ID NO: 276471 - RNA, 25 nt, Human
caucugaaccaaguucccagaaguc

SEQ ID NO: 276472 - RNA, 18 nt, Human
cgacuccaaguacaucuc

SEQ ID NO: 276473 - RNA, 20 nt, Human
cuuuacagucacauuaugcc

SEQ ID NO: 276474 - RNA, 22 nt, Human
cuuuacagucacauuaugcccc

SEQ ID NO: 276475 - RNA, 19 nt, Human
gagcagcagcgcgggagcg

SEQ ID NO: 276476 - RNA, 20 nt, Human
gagcagcagcgcgggagcgc

SEQ ID NO: 276477 - RNA, 23 nt, Human
gcugccgggcggcuggagcagca

SEQ ID NO: 276478 - RNA, 20 nt, Human
gcuguuucccauaauugcuc

SEQ ID NO: 276479 - RNA, 19 nt, Human
ggacagagugucucccuca

SEQ ID NO: 276480 - RNA, 19 nt, Human
ggcagggaaugaggacaga

SEQ ID NO: 276481 - RNA, 19 nt, Human
gucacggaaacauguuguc

SEQ ID NO: 276482 - RNA, 19 nt, Human
gugcauugugacuucgugc

SEQ ID NO: 276483 - RNA, 19 nt, Human
uauccgacuccaaguacau

SEQ ID NO: 276484 - RNA, 24 nt, Human
uccaaguacaucucucuuuuuugc

SEQ ID NO: 276485 - RNA, 25 nt, Human
ucccagaagucaaaauuuaaccucg

SEQ ID NO: 276486 - RNA, 18 nt, Human
ugaggaaaacuaagacuu

SEQ ID NO: 276487 - RNA, 24 nt, Human
ugaggaaaacuaagacuugguagu

SEQ ID NO: 276488 - RNA, 21 nt, Human
ugaggacagagugucucccuc

SEQ ID NO: 276489 - RNA, 19 nt, Human
uggagcagcagcgcgggag

SEQ ID NO: 276490 - RNA, 21 nt, Human
uuccaaaguagaauguugacc

SEQ ID NO: 276491 - RNA, 22 nt, Human
uucgggacagaagagcaauaga

SEQ ID NO: 276492 - RNA, 24 nt, Human
uucgggacagaagagcaauagagu

SEQ ID NO: 276493 - RNA, 24 nt, Human
uuguaggaagggcugugggagcug

SEQ ID NO: 276494 - RNA, 21 nt, Human
uugucugccuucucugucauu

SEQ ID NO: 276495 - RNA, 26 nt, Human
aaaaacuaaacaggcauuuuggacaa

SEQ ID NO: 276496 - RNA, 28 nt, Human
aaacaggcauuuuggacaacacauucuu

SEQ ID NO: 276497 - RNA, 19 nt, Human
agaacgcugcuccagagaa

SEQ ID NO: 276498 - RNA, 24 nt, Human
aggcauuuuggacaacacauucuu

SEQ ID NO: 276499 - RNA, 21 nt, Human
auucuuggcaauagaaccugg

SEQ ID NO: 276500 - RNA, 23 nt, Human
caggacggaaucacaccaggccc

SEQ ID NO: 276501 - RNA, 22 nt, Human
ccagauaucaacuguuacagaa

SEQ ID NO: 276502 - RNA, 19 nt, Human
ccccaccauuuccaugucu

SEQ ID NO: 276503 - RNA, 19 nt, Human
cgguagggaaaguucucac

SEQ ID NO: 276504 - RNA, 27 nt, Human
cucacucugcauuauaaaaaggacaac

SEQ ID NO: 276505 - RNA, 23 nt, Human
cugcauuauaaaaaggacagcca

SEQ ID NO: 276506 - RNA, 19 nt, Human
gacggaaucacaccaggcc

SEQ ID NO: 276507 - RNA, 20 nt, Human
gcauuuuggacaacacauuc

SEQ ID NO: 276508 - RNA, 21 nt, Human
uacuuuauuaaaauacugagu

SEQ ID NO: 276509 - RNA, 23 nt, Human
uagaaccuggacaacauuuauca

SEQ ID NO: 276510 - RNA, 24 nt, Human
uagaaccuggacaacauuuaucaa

SEQ ID NO: 276511 - RNA, 21 nt, Human
uagggaaaguucucacucugc

SEQ ID NO: 276512 - RNA, 19 nt, Human
uauuuuugucuccccacca

SEQ ID NO: 276513 - RNA, 20 nt, Human
uccauacauacuuaaaacca

SEQ ID NO: 276514 - RNA, 25 nt, Human
ugucugaccaccgcuacuacuaugu

SEQ ID NO: 276515 - RNA, 19 nt, Human
uucacauguguauuuuugu

SEQ ID NO: 276516 - RNA, 26 nt, Human
uucacauguguauuuuugucucccuc

SEQ ID NO: 276517 - RNA, 20 nt, Human
uuugucuccccaccauuucc

SEQ ID NO: 276518 - RNA, 26 nt, Human
uuuuuuuuuuuuuuuuuuugguuuuu

SEQ ID NO: 276519 - RNA, 28 nt, Human
uuuuuuuuuuuuuuuuuuuuuuuggggg

SEQ ID NO: 276520 - RNA, 23 nt, Human
aaaaauguguagcucugagcuuc

SEQ ID NO: 276521 - RNA, 24 nt, Human
acaggcccucuccuagcaccaaag

SEQ ID NO: 276522 - RNA, 26 nt, Human
accaaagacccaagucccucccaccc

SEQ ID NO: 276523 - RNA, 22 nt, Human
acccaagucccucccacccaac

SEQ ID NO: 276524 - RNA, 18 nt, Human
aggcaggugggaagggag

SEQ ID NO: 276525 - RNA, 28 nt, Human
caaagacccaagucccucccacccaacc

SEQ ID NO: 276526 - RNA, 21 nt, Human
caaggaagaaauauuuacaau

SEQ ID NO: 276527 - RNA, 23 nt, Human
caagucccucccacccaaccccc

SEQ ID NO: 276528 - RNA, 23 nt, Human
cacaggcccucuccuagcaccaa

SEQ ID NO: 276529 - RNA, 21 nt, Human
cacccaacccccacccaagcu

SEQ ID NO: 276530 - RNA, 23 nt, Human
caggcccucuccuagcaccaaag

SEQ ID NO: 276531 - RNA, 25 nt, Human
ccaacccccacccaagcucuccucu

SEQ ID NO: 276532 - RNA, 22 nt, Human
ccaagucccucccacccaaccc

SEQ ID NO: 276533 - RNA, 20 nt, Human
ccacccaacccccacccaag

SEQ ID NO: 276534 - RNA, 21 nt, Human
ccacccaacccccacccaagc

SEQ ID NO: 276535 - RNA, 20 nt, Human
cccucccacccaacccccac

SEQ ID NO: 276536 - RNA, 25 nt, Human
ccucccacccaacccccacccaagc

SEQ ID NO: 276537 - RNA, 18 nt, Human
cucuccucuucaaggaag

SEQ ID NO: 276538 - RNA, 21 nt, Human
gagcacaggcccucuccuagc

SEQ ID NO: 276539 - RNA, 18 nt, Human
ggaagggaggccccgggc

SEQ ID NO: 276540 - RNA, 18 nt, Human
gggaagggaggccccggg

SEQ ID NO: 276541 - RNA, 24 nt, Human
ggugaaaaucagaaaaccacggcu

SEQ ID NO: 276542 - RNA, 18 nt, Human
uagcaccaaagacccaag

SEQ ID NO: 276543 - RNA, 19 nt, Human
uagcaccaaagacccaagu

SEQ ID NO: 276544 - RNA, 21 nt, Human
ucagggaacagggugcauggc

SEQ ID NO: 276545 - RNA, 18 nt, Human
ucccucccacccaacccc

SEQ ID NO: 276546 - RNA, 19 nt, Human
ucccucccacccaaccccc

SEQ ID NO: 276547 - RNA, 18 nt, Human
uccuagcaccaaagaccc

SEQ ID NO: 276548 - RNA, 18 nt, Human
ugagcuucaggcacuaac

SEQ ID NO: 276549 - RNA, 23 nt, Human
ugcaaaaacuccacaccacuuua

SEQ ID NO: 276550 - RNA, 18 nt, Human
uguguagcucugagcuuc

SEQ ID NO: 276551 - RNA, 19 nt, Human
uuugcaaaaacuccacacc

SEQ ID NO: 276552 - RNA, 21 nt, Human
uuugcaaaaacuccacaccac

SEQ ID NO: 276553 - RNA, 21 nt, Human
uuuuuuuuuugcaaaaacucc

SEQ ID NO: 276554 - RNA, 21 nt, Human
uuuuuuuuuuuuuuuuugcaa

SEQ ID NO: 276555 - RNA, 21 nt, Human
uuuuuuuuuuuuuuuuuuugg

SEQ ID NO: 276556 - RNA, 23 nt, Human
aaagccccuuguggaaucagaag

SEQ ID NO: 276557 - RNA, 23 nt, Human
acugcggaggcugcugcugcugc

SEQ ID NO: 276558 - RNA, 21 nt, Human
ccccuuguggaaucagaagcu

SEQ ID NO: 276559 - RNA, 19 nt, Human
gagggacugcggaggcugc

SEQ ID NO: 276560 - RNA, 24 nt, Human
gccacaggguugaggaaaaagccc

SEQ ID NO: 276561 - RNA, 21 nt, Human
ggccacaggguugaggaaaaa

SEQ ID NO: 276562 - RNA, 19 nt, Human
ucucuggagggacugcggg

SEQ ID NO: 276563 - RNA, 19 nt, Human
ugcucaaagguaagaaacc

SEQ ID NO: 276564 - RNA, 21 nt, Human
ugcugcugcugcugcugcugc

SEQ ID NO: 276565 - RNA, 21 nt, Human
ugcugcugcugcuucugcugc

SEQ ID NO: 276566 - RNA, 28 nt, Human
ugcugcuucugcugcugcugcugcugcc

SEQ ID NO: 276567 - RNA, 18 nt, Human
ugcuucccaccugcccuc

SEQ ID NO: 276568 - RNA, 21 nt, Human
ugcuucugcugcugcugcugc

SEQ ID NO: 276569 - RNA, 24 nt, Human
uucugcugcugcugcugcugcugc

SEQ ID NO: 276570 - RNA, 20 nt, Human
aagcaaggcauacaggcccc

SEQ ID NO: 276571 - RNA, 18 nt, Human
aagcucugagaucccccc

SEQ ID NO: 276572 - RNA, 23 nt, Human
aaggcauacaggcccccaacccu

SEQ ID NO: 276573 - RNA, 23 nt, Human
acccgagugugaacaacugggag

SEQ ID NO: 276574 - RNA, 18 nt, Human
agaaggaugagagagggc

SEQ ID NO: 276575 - RNA, 19 nt, Human
aggaauccacagcccagcc

SEQ ID NO: 276576 - RNA, 23 nt, Human
aggagaacgucgggcuggagagg

SEQ ID NO: 276577 - RNA, 24 nt, Human
aggcugagggaggagagcaugggg

SEQ ID NO: 276578 - RNA, 18 nt, Human
agguccuaucuggugucu

SEQ ID NO: 276579 - RNA, 19 nt, Human
auggccuccucgguccccu

SEQ ID NO: 276580 - RNA, 25 nt, Human
auucaaauuacuuccauccuuuggc

SEQ ID NO: 276581 - RNA, 19 nt, Human
caacccuucugcgccaccc

SEQ ID NO: 276582 - RNA, 21 nt, Human
caacccuucugcgccaccccu

SEQ ID NO: 276583 - RNA, 18 nt, Human
cacagcccagcccggccu

SEQ ID NO: 276584 - RNA, 22 nt, Human
cacaggguagggagguguggag

SEQ ID NO: 276585 - RNA, 23 nt, Human
cagccccagaugugggcuccccu

SEQ ID NO: 276586 - RNA, 23 nt, Human
caggcccccaacccuucugcgcc

SEQ ID NO: 276587 - RNA, 23 nt, Human
cagggcgccgcggagcagguggg

SEQ ID NO: 276588 - RNA, 24 nt, Human
ccaacccuucugcgccaccccucu

SEQ ID NO: 276589 - RNA, 23 nt, Human
ccagcccggccugaguccaggug

SEQ ID NO: 276590 - RNA, 23 nt, Human
ccccaacccuucugcgccacccc

SEQ ID NO: 276591 - RNA, 25 nt, Human
ccccccaugccaguccccucucaga

SEQ ID NO: 276592 - RNA, 20 nt, Human
cccgagugugaacaacuggg

SEQ ID NO: 276593 - RNA, 19 nt, Human
ccugcccucucuucaccua

SEQ ID NO: 276594 - RNA, 19 nt, Human
ccuguaagcucugagaucc

SEQ ID NO: 276595 - RNA, 18 nt, Human
ccuucugcgccaccccuc

SEQ ID NO: 276596 - RNA, 24 nt, Human
ccuugggcucagcggccgguccca

SEQ ID NO: 276597 - RNA, 21 nt, Human
cuccccugcccucucuucacc

SEQ ID NO: 276598 - RNA, 20 nt, Human
gagagcauggggaggggagg

SEQ ID NO: 276599 - RNA, 21 nt, Human
gagauccccccaugccagucc

SEQ ID NO: 276600 - RNA, 22 nt, Human
gagcauggggaggggaggggau

SEQ ID NO: 276601 - RNA, 19 nt, Human
gcauacaggcccccaaccc

SEQ ID NO: 276602 - RNA, 24 nt, Human
ggagagcaggugcgugugccugug

SEQ ID NO: 276603 - RNA, 25 nt, Human
ggaggagagcauggggaggggaggg

SEQ ID NO: 276604 - RNA, 24 nt, Human
ggccgugggcuuggcucagccugu

SEQ ID NO: 276605 - RNA, 23 nt, Human
ggcuccccugcccucucuucacc

SEQ ID NO: 276606 - RNA, 21 nt, Human
ggguagggagguguggaggga

SEQ ID NO: 276607 - RNA, 26 nt, Human
gucacaggguagcaaggcugagggag

SEQ ID NO: 276608 - RNA, 21 nt, Human
ucagcggccggucccaggcau

SEQ ID NO: 276609 - RNA, 23 nt, Human
ucccuaugggaaggagcaggagc

SEQ ID NO: 276610 - RNA, 24 nt, Human
ugagauccccccaugccagucccc

SEQ ID NO: 276611 - RNA, 22 nt, Human
ugaggccuggcaccucuguugc

SEQ ID NO: 276612 - RNA, 20 nt, Human
ugagggaggagagcaugggg

SEQ ID NO: 276613 - RNA, 21 nt, Human
ugcugugggugaggcugaggc

SEQ ID NO: 276614 - RNA, 20 nt, Human
uggaauaaagauuuuaauug

SEQ ID NO: 276615 - RNA, 19 nt, Human
uggagggauaggagaggag

SEQ ID NO: 276616 - RNA, 22 nt, Human
ugggaaggagcaggagcgggac

SEQ ID NO: 276617 - RNA, 18 nt, Human
ugggccagccccagaugu

SEQ ID NO: 276618 - RNA, 19 nt, Human
ugggcuuggcucagccugu

SEQ ID NO: 276619 - RNA, 20 nt, Human
uggggaggggaggggaucag

SEQ ID NO: 276620 - RNA, 21 nt, Human
uggggaggggaggggaucagg

SEQ ID NO: 276621 - RNA, 19 nt, Human
uggggcugcugugggugag

SEQ ID NO: 276622 - RNA, 22 nt, Human
ugggugaggcugaggccuggca

SEQ ID NO: 276623 - RNA, 22 nt, Human
ugugucuacugcuggguggagg

SEQ ID NO: 276624 - RNA, 24 nt, Human
uuggcgauggggcugcugugggug

SEQ ID NO: 276625 - RNA, 19 nt, Human
acagggcugagcugcagag

SEQ ID NO: 276626 - RNA, 20 nt, Human
agaggagacauggaucuuca

SEQ ID NO: 276627 - RNA, 23 nt, Human
agauacagauauuuacagaaagu

SEQ ID NO: 276628 - RNA, 23 nt, Human
agggaggaaggggaccaagccag

SEQ ID NO: 276629 - RNA, 22 nt, Human
auccuuggugguagaggagaca

SEQ ID NO: 276630 - RNA, 21 nt, Human
caaaaagacaauaacggggca

SEQ ID NO: 276631 - RNA, 18 nt, Human
caagccagagagggacag

SEQ ID NO: 276632 - RNA, 24 nt, Human
cacauccccccgaagcucuagcug

SEQ ID NO: 276633 - RNA, 20 nt, Human
cacccagguaccagcagcag

SEQ ID NO: 276634 - RNA, 20 nt, Human
ccacauccccccgaagcucu

SEQ ID NO: 276635 - RNA, 20 nt, Human
cccccgaagcucuagcugga

SEQ ID NO: 276636 - RNA, 26 nt, Human
ccgaagcucuagcuggaagcauccua

SEQ ID NO: 276637 - RNA, 22 nt, Human
ccuuuccgcucuccuaagagcc

SEQ ID NO: 276638 - RNA, 22 nt, Human
cuuuccgcucuccuaagagcca

SEQ ID NO: 276639 - RNA, 20 nt, Human
gaaaguagggaggaagggga

SEQ ID NO: 276640 - RNA, 23 nt, Human
ggggguuuacaggaguccaggag

SEQ ID NO: 276641 - RNA, 22 nt, Human
ggucuuuuuguggcuguuuucc

SEQ ID NO: 276642 - RNA, 21 nt, Human
gucuuuuuguggcuguuuucc

SEQ ID NO: 276643 - RNA, 18 nt, Human
guggccauugcccaccca

SEQ ID NO: 276644 - RNA, 22 nt, Human
uacaacuuccauauaagguagg

SEQ ID NO: 276645 - RNA, 19 nt, Human
ucacugugucuccaaaaag

SEQ ID NO: 276646 - RNA, 19 nt, Human
ucuccaaaaagacaauaac

SEQ ID NO: 276647 - RNA, 21 nt, Human
uggugugugcagacauggugg

SEQ ID NO: 276648 - RNA, 21 nt, Human
ugucuccaaaaagacaauaac

SEQ ID NO: 276649 - RNA, 21 nt, Human
ugugugcagacaugguggcca

SEQ ID NO: 276650 - RNA, 23 nt, Human
uuacagaaaguagggaggaaggg

SEQ ID NO: 276651 - RNA, 24 nt, Human
uuuccuuuucccuucauuuccaca

SEQ ID NO: 276652 - RNA, 23 nt, Human
aaaaaagcaaaauacaaaaugua

SEQ ID NO: 276653 - RNA, 29 nt, Human
aaaaaagcaaaauacaaaauguaaugcgg

SEQ ID NO: 276654 - RNA, 23 nt, Human
aaacaaaaaacuaaaaccuaaaa

SEQ ID NO: 276655 - RNA, 25 nt, Human
aaaccuaaaaaacuugaaaaggugg

SEQ ID NO: 276656 - RNA, 20 nt, Human
aacagagugagaccccgucu

SEQ ID NO: 276657 - RNA, 24 nt, Human
aacagagugagaccccgucucaaa

SEQ ID NO: 276658 - RNA, 20 nt, Human
acaacagcugaccacggagg

SEQ ID NO: 276659 - RNA, 24 nt, Human
acagagugagaccccgucucaaaa

SEQ ID NO: 276660 - RNA, 26 nt, Human
accccgucucaaaaaagcaaaauaca

SEQ ID NO: 276661 - RNA, 22 nt, Human
accugagcccaggagauagagc

SEQ ID NO: 276662 - RNA, 19 nt, Human
acuacauggaagucacugu

SEQ ID NO: 276663 - RNA, 24 nt, Human
acuguauuccagccuggguaacag

SEQ ID NO: 276664 - RNA, 26 nt, Human
acuguauuccagccuggguaacagag

SEQ ID NO: 276665 - RNA, 21 nt, Human
acuugucagagacagccucga

SEQ ID NO: 276666 - RNA, 18 nt, Human
agaggcguccccaccucc

SEQ ID NO: 276667 - RNA, 20 nt, Human
agauagagccuacagugagc

SEQ ID NO: 276668 - RNA, 24 nt, Human
agccugggcaacauagggaaaccc

SEQ ID NO: 276669 - RNA, 22 nt, Human
agccuggguaacagagugagac

SEQ ID NO: 276670 - RNA, 19 nt, Human
aggugaauccuucauggag

SEQ ID NO: 276671 - RNA, 19 nt, Human
augccuguaaucccagcac

SEQ ID NO: 276672 - RNA, 24 nt, Human
auugugccacuguauuccagccug

SEQ ID NO: 276673 - RNA, 22 nt, Human
caaaaaacuaaaaccuaaaaaa

SEQ ID NO: 276674 - RNA, 22 nt, Human
caacauagggaaacccugucuc

SEQ ID NO: 276675 - RNA, 24 nt, Human
caacauagggaaacccugucucua

SEQ ID NO: 276676 - RNA, 21 nt, Human
caaccucuagacaguaugaca

SEQ ID NO: 276677 - RNA, 19 nt, Human
cacuguauuccagccuggg

SEQ ID NO: 276678 - RNA, 22 nt, Human
cacuguauuccagccuggguaa

SEQ ID NO: 276679 - RNA, 23 nt, Human
cacuguauuccagccuggguaac

SEQ ID NO: 276680 - RNA, 24 nt, Human
cacuguauuccagccuggguaaca

SEQ ID NO: 276681 - RNA, 19 nt, Human
cagaggcguccccaccucc

SEQ ID NO: 276682 - RNA, 24 nt, Human
cagaggcguccccaccuccuguga

SEQ ID NO: 276683 - RNA, 19 nt, Human
cagcacucugggaggcuug

SEQ ID NO: 276684 - RNA, 21 nt, Human
cagcacucugggaggcuugag

SEQ ID NO: 276685 - RNA, 20 nt, Human
cagccuggguaacagaguga

SEQ ID NO: 276686 - RNA, 18 nt, Human
cagcuguggcagcgacag

SEQ ID NO: 276687 - RNA, 20 nt, Human
caugccuguaaucccagcac

SEQ ID NO: 276688 - RNA, 20 nt, Human
cauggagacugaacacaggu

SEQ ID NO: 276689 - RNA, 20 nt, Human
ccacuguauuccagccuggg

SEQ ID NO: 276690 - RNA, 20 nt, Human
ccacuguauuccagccuggg

SEQ ID NO: 276691 - RNA, 21 nt, Human
ccacuguauuccagccugggu

SEQ ID NO: 276692 - RNA, 22 nt, Human
ccacuguauuccagccugggua

SEQ ID NO: 276693 - RNA, 24 nt, Human
ccacuguauuccagccuggguaac

SEQ ID NO: 276694 - RNA, 18 nt, Human
ccaugccuguaaucccag

SEQ ID NO: 276695 - RNA, 24 nt, Human
cccaggacuauaagaccagaccag

SEQ ID NO: 276696 - RNA, 23 nt, Human
cccaugccuguaaucccagcacu

SEQ ID NO: 276697 - RNA, 25 nt, Human
ccuccugugaacacuugucagagac

SEQ ID NO: 276698 - RNA, 19 nt, Human
ccucgcgcagaggcguccc

SEQ ID NO: 276699 - RNA, 20 nt, Human
ccucgcgcagaggcgucccc

SEQ ID NO: 276700 - RNA, 23 nt, Human
ccugcacauuuguguagccaagg

SEQ ID NO: 276701 - RNA, 22 nt, Human
ccugggcaacauagggaaaccc

SEQ ID NO: 276702 - RNA, 18 nt, Human
ccuguaaucccagcacuc

SEQ ID NO: 276703 - RNA, 20 nt, Human
ccuguaaucccagcacucug

SEQ ID NO: 276704 - RNA, 19 nt, Human
cucgaggccugugucgccc

SEQ ID NO: 276705 - RNA, 20 nt, Human
cucucggguuuccugaaugu

SEQ ID NO: 276706 - RNA, 19 nt, Human
cugaacacagguggccagc

SEQ ID NO: 276707 - RNA, 21 nt, Human
cugcugcuacuccaccauuua

SEQ ID NO: 276708 - RNA, 26 nt, Human
cugggaggcugaguuugggaggauca

SEQ ID NO: 276709 - RNA, 22 nt, Human
cuuuaagucugguggagagccu

SEQ ID NO: 276710 - RNA, 22 nt, Human
gaccagaccagccugggcaaca

SEQ ID NO: 276711 - RNA, 21 nt, Human
gacccaugccuguaaucccag

SEQ ID NO: 276712 - RNA, 20 nt, Human
gaguuugggaggaucaccug

SEQ ID NO: 276713 - RNA, 20 nt, Human
gaguuuuuuuuuuuuuuuuu

SEQ ID NO: 276714 - RNA, 20 nt, Human
gaucaccugagcccaggaga

SEQ ID NO: 276715 - RNA, 22 nt, Human
gaugcuucacagaugaugauca

SEQ ID NO: 276716 - RNA, 23 nt, Human
gccacuguauuccagccugggua

SEQ ID NO: 276717 - RNA, 24 nt, Human
gccacuguauuccagccuggguaa

SEQ ID NO: 276718 - RNA, 19 nt, Human
gcuuggugcggugacccau

SEQ ID NO: 276719 - RNA, 23 nt, Human
ggcccguagcuccucguuccucg

SEQ ID NO: 276720 - RNA, 18 nt, Human
gggaggcugaguuuggga

SEQ ID NO: 276721 - RNA, 23 nt, Human
ggugacccaugccuguaauccca

SEQ ID NO: 276722 - RNA, 24 nt, Human
ggugacccaugccuguaaucccag

SEQ ID NO: 276723 - RNA, 24 nt, Human
guauuccagccuggguaacagagu

SEQ ID NO: 276724 - RNA, 20 nt, Human
gugaauccuucauggagacu

SEQ ID NO: 276725 - RNA, 23 nt, Human
gugacccaugccuguaaucccag

SEQ ID NO: 276726 - RNA, 21 nt, Human
guuuuuuuuuuuuuuuuuugg

SEQ ID NO: 276727 - RNA, 20 nt, Human
uaaaaacaaaaaacuaaaac

SEQ ID NO: 276728 - RNA, 25 nt, Human
uaaaaacaaaaaacuaaaaccuaaa

SEQ ID NO: 276729 - RNA, 23 nt, Human
uaaaccaagcaucuagcagugcc

SEQ ID NO: 276730 - RNA, 23 nt, Human
uaacagagugagaccccgucuca

SEQ ID NO: 276731 - RNA, 22 nt, Human
uaagaccagaccagccugggca

SEQ ID NO: 276732 - RNA, 24 nt, Human
uaagaccagaccagccugggcaac

SEQ ID NO: 276733 - RNA, 18 nt, Human
uacagugagcugugauug

SEQ ID NO: 276734 - RNA, 21 nt, Human
uaccaugaugcuucacagaug

SEQ ID NO: 276735 - RNA, 21 nt, Human
uagcagcaccuggagaauuca

SEQ ID NO: 276736 - RNA, 21 nt, Human
uaggagggacuacccacagca

SEQ ID NO: 276737 - RNA, 21 nt, Human
uaggccacacaugugcaacuu

SEQ ID NO: 276738 - RNA, 19 nt, Human
uauacaguaguucgccugg

SEQ ID NO: 276739 - RNA, 24 nt, Human
uauuccagccuggguaacagagug

SEQ ID NO: 276740 - RNA, 19 nt, Human
uccagccuggguaacagag

SEQ ID NO: 276741 - RNA, 23 nt, Human
uccagccuggguaacagagugag

SEQ ID NO: 276742 - RNA, 24 nt, Human
uccagccuggguaacagagugaga

SEQ ID NO: 276743 - RNA, 18 nt, Human
ucccuagcagcaccugga

SEQ ID NO: 276744 - RNA, 21 nt, Human
uccucguuccucgcgcagagg

SEQ ID NO: 276745 - RNA, 20 nt, Human
uccuggugagaugcugcugc

SEQ ID NO: 276746 - RNA, 18 nt, Human
ucgccuggagccacagcu

SEQ ID NO: 276747 - RNA, 23 nt, Human
ucucuauauacaguaguucgccu

SEQ ID NO: 276748 - RNA, 18 nt, Human
ugaacacaugucaguguc

SEQ ID NO: 276749 - RNA, 21 nt, Human
ugacaagagacaccugcacau

SEQ ID NO: 276750 - RNA, 24 nt, Human
ugacccaugccuguaaucccagca

SEQ ID NO: 276751 - RNA, 24 nt, Human
ugagaccccgucucaaaaaagcaa

SEQ ID NO: 276752 - RNA, 23 nt, Human
ugagcccaggacuauaagaccag

SEQ ID NO: 276753 - RNA, 22 nt, Human
ugagcugugauugugccacugu

SEQ ID NO: 276754 - RNA, 23 nt, Human
ugaguuugggaggaucaccugag

SEQ ID NO: 276755 - RNA, 23 nt, Human
ugaugcuucacagaugaugauca

SEQ ID NO: 276756 - RNA, 23 nt, Human
ugccuguaaucccagcacucugg

SEQ ID NO: 276757 - RNA, 24 nt, Human
ugccuguaaucccagcacucuggg

SEQ ID NO: 276758 - RNA, 22 nt, Human
uggaugucuuuauuuacagaac

SEQ ID NO: 276759 - RNA, 23 nt, Human
uggccagugggccgcaaaugcuu

SEQ ID NO: 276760 - RNA, 19 nt, Human
ugggaggcugaguuuggga

SEQ ID NO: 276761 - RNA, 25 nt, Human
ugggaggcugaguuugggaggauca

SEQ ID NO: 276762 - RNA, 24 nt, Human
ugggcaacauagggaaacccuguc

SEQ ID NO: 276763 - RNA, 19 nt, Human
uggggaugggaggguuacu

SEQ ID NO: 276764 - RNA, 24 nt, Human
uggugcggugacccaugccuguaa

SEQ ID NO: 276765 - RNA, 19 nt, Human
uguaggccacacaugugca

SEQ ID NO: 276766 - RNA, 23 nt, Human
ugucacaacagcugaccacggag

SEQ ID NO: 276767 - RNA, 19 nt, Human
ugucagugagagcagaaaa

SEQ ID NO: 276768 - RNA, 22 nt, Human
ugugccacuguauuccagccug

SEQ ID NO: 276769 - RNA, 21 nt, Human
uguuuuggaugcacuggccag

SEQ ID NO: 276770 - RNA, 25 nt, Human
uuaugcuaaaaacaaaaaacuaaaa

SEQ ID NO: 276771 - RNA, 20 nt, Human
uuuaaaccaagcaucuagca

SEQ ID NO: 276772 - RNA, 20 nt, Human
uuuuggaugcacuggccagu

SEQ ID NO: 276773 - RNA, 23 nt, Human
uuuuuuguauuaaaggauguuua

SEQ ID NO: 276774 - RNA, 22 nt, Human
uuuuuuuuuuuuuugaaaugga

SEQ ID NO: 276775 - RNA, 18 nt, Human
uuuuuuuuuuuuuuuuug

SEQ ID NO: 276776 - RNA, 19 nt, Human
uuuuuuuuuuuuuuuuugu

SEQ ID NO: 276777 - RNA, 29 nt, Human
aggcagaaaaaaaaaaguggggggacccc

SEQ ID NO: 276778 - RNA, 19 nt, Human
ccgacucgcccucugcccc

SEQ ID NO: 276779 - RNA, 19 nt, Human
ccuuaaagaaucucaggca

SEQ ID NO: 276780 - RNA, 24 nt, Human
ccuuaaagaaucucaggcagaaaa

SEQ ID NO: 276781 - RNA, 21 nt, Human
gagcuugcccucgccgccgcc

SEQ ID NO: 276782 - RNA, 19 nt, Human
gcccucgccgccgccgacu

SEQ ID NO: 276783 - RNA, 23 nt, Human
uaaagaaucucaggcagaaaaaa

SEQ ID NO: 276784 - RNA, 18 nt, Human
ugcccucgccgccgccga

SEQ ID NO: 276785 - RNA, 20 nt, Human
aaaaaggaccuucccaccga

SEQ ID NO: 276786 - RNA, 18 nt, Human
aaaaaugcuucuuggugu

SEQ ID NO: 276787 - RNA, 27 nt, Human
aaaaggcaaaaagguucuggacacugc

SEQ ID NO: 276788 - RNA, 22 nt, Human
aaaaugcuucuugguguguuug

SEQ ID NO: 276789 - RNA, 19 nt, Human
aaacaaagacaaaugcgug

SEQ ID NO: 276790 - RNA, 24 nt, Human
aaacagaucaucgccgcacaagca

SEQ ID NO: 276791 - RNA, 23 nt, Human
aaacagcagggauggaugcuguu

SEQ ID NO: 276792 - RNA, 20 nt, Human
aaaggcaaaaagguucugga

SEQ ID NO: 276793 - RNA, 19 nt, Human
aacagaagacagaaacagg

SEQ ID NO: 276794 - RNA, 20 nt, Human
aagucagcuccaagacacag

SEQ ID NO: 276795 - RNA, 21 nt, Human
acaaaugcacauacacuucuc

SEQ ID NO: 276796 - RNA, 27 nt, Human
acaacacacacacacacacacaaaugc

SEQ ID NO: 276797 - RNA, 23 nt, Human
acacaaaugcacauacacuucuc

SEQ ID NO: 276798 - RNA, 25 nt, Human
acacacacacacaaaugcacauaca

SEQ ID NO: 276799 - RNA, 24 nt, Human
acacacacacacaacacacacaca

SEQ ID NO: 276800 - RNA, 20 nt, Human
acacagaugcacuagguucu

SEQ ID NO: 276801 - RNA, 21 nt, Human
acacagaugcacuagguucuu

SEQ ID NO: 276802 - RNA, 21 nt, Human
acacaggccgaccucccaggc

SEQ ID NO: 276803 - RNA, 22 nt, Human
acacaggccgaccucccaggcc

SEQ ID NO: 276804 - RNA, 19 nt, Human
acagaugcacuagguucuu

SEQ ID NO: 276805 - RNA, 22 nt, Human
accaaccccaaagcacgcacgc

SEQ ID NO: 276806 - RNA, 19 nt, Human
accacauguaacccaaggu

SEQ ID NO: 276807 - RNA, 24 nt, Human
accagcucggcaaaagcaaacacu

SEQ ID NO: 276808 - RNA, 23 nt, Human
acgcacacacguagacacacaca

SEQ ID NO: 276809 - RNA, 22 nt, Human
acguggauuagauuugcggcug

SEQ ID NO: 276810 - RNA, 22 nt, Human
acguugcagcacccacuucagc

SEQ ID NO: 276811 - RNA, 20 nt, Human
acuccgaggacaugcaaacg

SEQ ID NO: 276812 - RNA, 20 nt, Human
acuugucagcgguuugcuga

SEQ ID NO: 276813 - RNA, 24 nt, Human
agaaagcauacaaaauguaucucu

SEQ ID NO: 276814 - RNA, 20 nt, Human
agaagggaggggcagaccca

SEQ ID NO: 276815 - RNA, 21 nt, Human
agacacccacgagaacacuga

SEQ ID NO: 276816 - RNA, 20 nt, Human
agacacgcacacacagaucc

SEQ ID NO: 276817 - RNA, 22 nt, Human
agacacgcacacacagauccuc

SEQ ID NO: 276818 - RNA, 22 nt, Human
agagucggggugcccuccaggg

SEQ ID NO: 276819 - RNA, 24 nt, Human
agauccucucaccaacuucugccu

SEQ ID NO: 276820 - RNA, 24 nt, Human
agaugcacuagguucuugacacaa

SEQ ID NO: 276821 - RNA, 19 nt, Human
agaugggagcaggggcugc

SEQ ID NO: 276822 - RNA, 21 nt, Human
agcgggccaggaggcugcagg

SEQ ID NO: 276823 - RNA, 22 nt, Human
aggaagcuccuccuacccuggg

SEQ ID NO: 276824 - RNA, 21 nt, Human
aggaggcugcagggguggagg

SEQ ID NO: 276825 - RNA, 18 nt, Human
aggccccugccuggccag

SEQ ID NO: 276826 - RNA, 20 nt, Human
agggauggaugcuguucgcc

SEQ ID NO: 276827 - RNA, 20 nt, Human
aggggcggggcuggccggag

SEQ ID NO: 276828 - RNA, 23 nt, Human
aggggcugcuucgugugcaugag

SEQ ID NO: 276829 - RNA, 19 nt, Human
aggggugcuggggcccggc

SEQ ID NO: 276830 - RNA, 18 nt, Human
aggguaccaucccaggac

SEQ ID NO: 276831 - RNA, 21 nt, Human
augagacuccuggagacagag

SEQ ID NO: 276832 - RNA, 19 nt, Human
auggccaguuuuaccuccu

SEQ ID NO: 276833 - RNA, 24 nt, Human
augggcuggguugaagucccagug

SEQ ID NO: 276834 - RNA, 19 nt, Human
caaaagcaagaaggcuuac

SEQ ID NO: 276835 - RNA, 25 nt, Human
caaaccacuaaaagacauuuauuac

SEQ ID NO: 276836 - RNA, 19 nt, Human
caaagcacgcacgcagcua

SEQ ID NO: 276837 - RNA, 23 nt, Human
caaaggagaggggugcuggggcc

SEQ ID NO: 276838 - RNA, 25 nt, Human
caaagucccccaaaaaggaccuucc

SEQ ID NO: 276839 - RNA, 19 nt, Human
caaagugccaagugucaac

SEQ ID NO: 276840 - RNA, 22 nt, Human
caaagugccaagugucaacaca

SEQ ID NO: 276841 - RNA, 22 nt, Human
caaaugcacauacacuucucuc

SEQ ID NO: 276842 - RNA, 20 nt, Human
cacaacacagaaccggggca

SEQ ID NO: 276843 - RNA, 20 nt, Human
cacacaacacacacacacac

SEQ ID NO: 276844 - RNA, 20 nt, Human
cacacacaaaugcacauaca

SEQ ID NO: 276845 - RNA, 21 nt, Human
cacacacaacacacacacaca

SEQ ID NO: 276846 - RNA, 24 nt, Human
cacacacacacaacacacacacac

SEQ ID NO: 276847 - RNA, 25 nt, Human
cacacacacacacaacacacacaca

SEQ ID NO: 276848 - RNA, 18 nt, Human
cacacacacacacacaca

SEQ ID NO: 276849 - RNA, 18 nt, Human
caccaaccccaaagcacg

SEQ ID NO: 276850 - RNA, 18 nt, Human
caccccacacagccgcgc

SEQ ID NO: 276851 - RNA, 19 nt, Human
caccuggcgccuggugugc

SEQ ID NO: 276852 - RNA, 18 nt, Human
cacuucucuccccuccuu

SEQ ID NO: 276853 - RNA, 24 nt, Human
cagaaacaccugcuccuccugcag

SEQ ID NO: 276854 - RNA, 20 nt, Human
cagaagaaagaaggaaauga

SEQ ID NO: 276855 - RNA, 20 nt, Human
cagaagacagaaacaccugc

SEQ ID NO: 276856 - RNA, 19 nt, Human
cagagucggggugcccucc

SEQ ID NO: 276857 - RNA, 25 nt, Human
cagcacggcgccugaucugcacccc

SEQ ID NO: 276858 - RNA, 18 nt, Human
cagccucuccucaccccc

SEQ ID NO: 276859 - RNA, 24 nt, Human
cagcucggcaaaagcaaacacugc

SEQ ID NO: 276860 - RNA, 23 nt, Human
cagcucucccaccccggacaccc

SEQ ID NO: 276861 - RNA, 23 nt, Human
caggccccugccuggccaggccu

SEQ ID NO: 276862 - RNA, 19 nt, Human
cagggacagaugggagcag

SEQ ID NO: 276863 - RNA, 23 nt, Human
ccaaagcacgcacgcagcuaaca

SEQ ID NO: 276864 - RNA, 24 nt, Human
ccaaccccaaagcacgcacgcagc

SEQ ID NO: 276865 - RNA, 18 nt, Human
ccaagcucucuugcuggc

SEQ ID NO: 276866 - RNA, 24 nt, Human
ccacgcacgcacacacguagacac

SEQ ID NO: 276867 - RNA, 21 nt, Human
ccagccucuccucacccccuc

SEQ ID NO: 276868 - RNA, 22 nt, Human
ccagcucaccuggcgccuggug

SEQ ID NO: 276869 - RNA, 19 nt, Human
cccacacagccgcgcaccg

SEQ ID NO: 276870 - RNA, 24 nt, Human
cccacgagaacacugacacagaga

SEQ ID NO: 276871 - RNA, 24 nt, Human
cccaggccccaugcugcucucaag

SEQ ID NO: 276872 - RNA, 18 nt, Human
cccagggagcugucggac

SEQ ID NO: 276873 - RNA, 22 nt, Human
cccagugccccauguggccagg

SEQ ID NO: 276874 - RNA, 18 nt, Human
ccccacacagccgcgcac

SEQ ID NO: 276875 - RNA, 19 nt, Human
ccccacacagccgcgcacc

SEQ ID NO: 276876 - RNA, 21 nt, Human
ccccacacagccgcgcaccgg

SEQ ID NO: 276877 - RNA, 23 nt, Human
ccccacacagccgcgcaccggcg

SEQ ID NO: 276878 - RNA, 19 nt, Human
ccccggacacccagggagc

SEQ ID NO: 276879 - RNA, 20 nt, Human
cccgcccccggccuuugacc

SEQ ID NO: 276880 - RNA, 18 nt, Human
cccugaggcccggagagc

SEQ ID NO: 276881 - RNA, 23 nt, Human
ccgguaccgugcagacacccacg

SEQ ID NO: 276882 - RNA, 20 nt, Human
ccucaugccagccucuccuc

SEQ ID NO: 276883 - RNA, 30 nt, Human
ccuccuacccugggcagggccucccgagcc

SEQ ID NO: 276884 - RNA, 20 nt, Human
cgagaacacugacacagaga

SEQ ID NO: 276885 - RNA, 23 nt, Human
cgagaacacugacacagagacac

SEQ ID NO: 276886 - RNA, 22 nt, Human
cgcacaaacagaucaucgccgc

SEQ ID NO: 276887 - RNA, 23 nt, Human
cgcgcaccggcguugccuacaca

SEQ ID NO: 276888 - RNA, 19 nt, Human
cggcaggggcggggcuggc

SEQ ID NO: 276889 - RNA, 21 nt, Human
cggccgguccacacgccgcgc

SEQ ID NO: 276890 - RNA, 22 nt, Human
cggggaacaaaaaaaggcaaaa

SEQ ID NO: 276891 - RNA, 26 nt, Human
cgugcagacacccacgagaacacuga

SEQ ID NO: 276892 - RNA, 19 nt, Human
cuaagcccugaggcccgga

SEQ ID NO: 276893 - RNA, 20 nt, Human
cucacugcccacaagacacc

SEQ ID NO: 276894 - RNA, 19 nt, Human
cucagggcccucucuggga

SEQ ID NO: 276895 - RNA, 23 nt, Human
cucaugguccugaacggacagcu

SEQ ID NO: 276896 - RNA, 20 nt, Human
cuccuacagagaaguggggc

SEQ ID NO: 276897 - RNA, 24 nt, Human
cuccucacccccucacugcccaca

SEQ ID NO: 276898 - RNA, 19 nt, Human
cucucccaccccggacacc

SEQ ID NO: 276899 - RNA, 23 nt, Human
cucuggucugcacuccgggaggc

SEQ ID NO: 276900 - RNA, 19 nt, Human
cugacacagagacacugac

SEQ ID NO: 276901 - RNA, 18 nt, Human
cuugcuggcucccagcug

SEQ ID NO: 276902 - RNA, 18 nt, Human
cuuggcucagacccuagc

SEQ ID NO: 276903 - RNA, 20 nt, Human
cuugguguguuuggggaggg

SEQ ID NO: 276904 - RNA, 19 nt, Human
gaacacugacacagagaca

SEQ ID NO: 276905 - RNA, 21 nt, Human
gaagcuccuccuacccugggc

SEQ ID NO: 276906 - RNA, 20 nt, Human
gacacagagacacugacaga

SEQ ID NO: 276907 - RNA, 21 nt, Human
gagaacacugacacagagaca

SEQ ID NO: 276908 - RNA, 18 nt, Human
gaggaggggugaggaagg

SEQ ID NO: 276909 - RNA, 23 nt, Human
gaggguggggcuagaucuggucc

SEQ ID NO: 276910 - RNA, 22 nt, Human
gaguaaaugggaacuacgugga

SEQ ID NO: 276911 - RNA, 23 nt, Human
gcaaaagcaaacacugccucaac

SEQ ID NO: 276912 - RNA, 24 nt, Human
gcacagcuccagaggugagaaggg

SEQ ID NO: 276913 - RNA, 18 nt, Human
gccuggcuccacacguga

SEQ ID NO: 276914 - RNA, 19 nt, Human
gcgcucuucggccggucca

SEQ ID NO: 276915 - RNA, 22 nt, Human
gcggcucagccuggccugccgu

SEQ ID NO: 276916 - RNA, 20 nt, Human
gcucguguaggccgugagcc

SEQ ID NO: 276917 - RNA, 19 nt, Human
ggaacaaaaaaaggcaaaa

SEQ ID NO: 276918 - RNA, 19 nt, Human
ggaaggucgagggcagggc

SEQ ID NO: 276919 - RNA, 19 nt, Human
ggagcuaaaggucagcuuc

SEQ ID NO: 276920 - RNA, 23 nt, Human
ggagggggagagggaaacugagc

SEQ ID NO: 276921 - RNA, 21 nt, Human
ggcagcuugugggcucgugua

SEQ ID NO: 276922 - RNA, 18 nt, Human
ggcggcucagccuggccu

SEQ ID NO: 276923 - RNA, 18 nt, Human
ggcuggggcucggcucgg

SEQ ID NO: 276924 - RNA, 19 nt, Human
ggcuggggcucggcucggc

SEQ ID NO: 276925 - RNA, 18 nt, Human
gggaaaagggagagaaga

SEQ ID NO: 276926 - RNA, 18 nt, Human
gggagcuaaaggucagcu

SEQ ID NO: 276927 - RNA, 18 nt, Human
gggcagaagguggucugc

SEQ ID NO: 276928 - RNA, 19 nt, Human
gggcagagcuagcugagcu

SEQ ID NO: 276929 - RNA, 22 nt, Human
gggcagagcuagcugagcuggg

SEQ ID NO: 276930 - RNA, 23 nt, Human
gggcagagcuagcugagcugggc

SEQ ID NO: 276931 - RNA, 23 nt, Human
gggcagggccucccgagccugcu

SEQ ID NO: 276932 - RNA, 22 nt, Human
gggcuagaucuggucuagagag

SEQ ID NO: 276933 - RNA, 25 nt, Human
ggggcgagggcgggcggcucagccu

SEQ ID NO: 276934 - RNA, 20 nt, Human
gguaccaucccaggacggcc

SEQ ID NO: 276935 - RNA, 21 nt, Human
guaaaugggaacuacguggau

SEQ ID NO: 276936 - RNA, 18 nt, Human
gugggucagaggaggggu

SEQ ID NO: 276937 - RNA, 21 nt, Human
guucacuucuauuacaaaaua

SEQ ID NO: 276938 - RNA, 19 nt, Human
guuucaggccccugccugg

SEQ ID NO: 276939 - RNA, 21 nt, Human
uaagaaaaagcacuguugaac

SEQ ID NO: 276940 - RNA, 21 nt, Human
uaagaaaaagcacuguugaac

SEQ ID NO: 276941 - RNA, 20 nt, Human
uaauuuauagguuuguccuu

SEQ ID NO: 276942 - RNA, 21 nt, Human
uacccagccauuuucaguagc

SEQ ID NO: 276943 - RNA, 20 nt, Human
uagaaagacuugucagcggu

SEQ ID NO: 276944 - RNA, 22 nt, Human
uagaaggaacagaagacagaaa

SEQ ID NO: 276945 - RNA, 21 nt, Human
uagucagggcagaggauggcu

SEQ ID NO: 276946 - RNA, 18 nt, Human
uaucuaagaaaaagcacu

SEQ ID NO: 276947 - RNA, 24 nt, Human
uauggcugucaaagucccccaaaa

SEQ ID NO: 276948 - RNA, 21 nt, Human
ucacccccucacugcccacaa

SEQ ID NO: 276949 - RNA, 19 nt, Human
ucagacccuagcaagggca

SEQ ID NO: 276950 - RNA, 24 nt, Human
ucagccauccccucuccuccacgg

SEQ ID NO: 276951 - RNA, 22 nt, Human
ucagggcagaggauggcucaug

SEQ ID NO: 276952 - RNA, 22 nt, Human
ucaugccagccucuccucaccc

SEQ ID NO: 276953 - RNA, 22 nt, Human
uccaaagccagaagaaagaagg

SEQ ID NO: 276954 - RNA, 23 nt, Human
uccacacgugaggucucuggagu

SEQ ID NO: 276955 - RNA, 22 nt, Human
ucccaccccggacacccaggga

SEQ ID NO: 276956 - RNA, 20 nt, Human
ucccaggacggccugccuuc

SEQ ID NO: 276957 - RNA, 22 nt, Human
ucccagggcuggugacaaagug

SEQ ID NO: 276958 - RNA, 22 nt, Human
ucccccaaaaaggaccuuccca

SEQ ID NO: 276959 - RNA, 26 nt, Human
ucccccaaaaaggaccuucccaccga

SEQ ID NO: 276960 - RNA, 22 nt, Human
ucccugagaucaaggaugccuc

SEQ ID NO: 276961 - RNA, 19 nt, Human
uccuggggaaaagggagag

SEQ ID NO: 276962 - RNA, 20 nt, Human
uccuuggaaggacuagaagg

SEQ ID NO: 276963 - RNA, 24 nt, Human
ucgggccggcucggcucggcuggg

SEQ ID NO: 276964 - RNA, 21 nt, Human
ucggggccagcaaagugccaa

SEQ ID NO: 276965 - RNA, 26 nt, Human
ucuccucacccccucacugcccacaa

SEQ ID NO: 276966 - RNA, 21 nt, Human
ucugcacuccgggaggccaaa

SEQ ID NO: 276967 - RNA, 23 nt, Human
ucugcacuccgggaggccaaagg

SEQ ID NO: 276968 - RNA, 23 nt, Human
ucugcagcgugcagcugagccag

SEQ ID NO: 276969 - RNA, 22 nt, Human
ucuguagagagcccccgccccc

SEQ ID NO: 276970 - RNA, 22 nt, Human
ugaaaccacgacuucgucaagc

SEQ ID NO: 276971 - RNA, 27 nt, Human
ugaauaaauuuacacacuguguuuaag

SEQ ID NO: 276972 - RNA, 18 nt, Human
ugaccuccuccaacaccc

SEQ ID NO: 276973 - RNA, 21 nt, Human
ugacugaaccucaugccagcc

SEQ ID NO: 276974 - RNA, 22 nt, Human
ugacugaaccucaugccagccu

SEQ ID NO: 276975 - RNA, 24 nt, Human
ugagaaagguuugcaaacaaagac

SEQ ID NO: 276976 - RNA, 21 nt, Human
ugagaacagguggccccucuu

SEQ ID NO: 276977 - RNA, 21 nt, Human
ugagaagggaggggcagaccc

SEQ ID NO: 276978 - RNA, 22 nt, Human
ugagauggaggaguggguuuca

SEQ ID NO: 276979 - RNA, 23 nt, Human
ugagauggaggaguggguuucag

SEQ ID NO: 276980 - RNA, 22 nt, Human
ugagauuuuuccaaagccagaa

SEQ ID NO: 276981 - RNA, 18 nt, Human
ugagcugggcacacaggc

SEQ ID NO: 276982 - RNA, 18 nt, Human
ugcaaagcaggaagcucc

SEQ ID NO: 276983 - RNA, 19 nt, Human
ugccauaagauuccaaagg

SEQ ID NO: 276984 - RNA, 21 nt, Human
ugccuucaccuucagagacag

SEQ ID NO: 276985 - RNA, 19 nt, Human
uggaaugacugaaccucau

SEQ ID NO: 276986 - RNA, 19 nt, Human
uggcagggagcaccccaca

SEQ ID NO: 276987 - RNA, 26 nt, Human
ugggaacuacguggauuagauuugcg

SEQ ID NO: 276988 - RNA, 22 nt, Human
uggggcccggcuucccuggugg

SEQ ID NO: 276989 - RNA, 18 nt, Human
ugguccugaacggacagc

SEQ ID NO: 276990 - RNA, 21 nt, Human
uguagagagcccccgcccccg

SEQ ID NO: 276991 - RNA, 19 nt, Human
ugugaaccacauguaaccc

SEQ ID NO: 276992 - RNA, 19 nt, Human
uguggccaggucuucaucg

SEQ ID NO: 276993 - RNA, 25 nt, Human
uuagcgcacacacacacacaacaca

SEQ ID NO: 276994 - RNA, 22 nt, Human
uucaguagcuacacgggugguc

SEQ ID NO: 276995 - RNA, 20 nt, Human
uugaacaacaaccgcagcac

SEQ ID NO: 276996 - RNA, 20 nt, Human
uugguguguuuggggagggg

SEQ ID NO: 276997 - RNA, 22 nt, Human
uuugacaaaccacuaaaagaca

SEQ ID NO: 276998 - RNA, 23 nt, Human
uuugacaaaccacuaaaagacau

SEQ ID NO: 276999 - RNA, 19 nt, Human
aaaaaaaaacaaauccucc

SEQ ID NO: 277000 - RNA, 22 nt, Human
aaaaaaaaacaaauccuccaaa

SEQ ID NO: 277001 - RNA, 23 nt, Human
aaaaaaacaaauccuccaaacca

SEQ ID NO: 277002 - RNA, 18 nt, Human
aaaacaaauccuccaaac

SEQ ID NO: 277003 - RNA, 19 nt, Human
aaaacgagcacacucuuca

SEQ ID NO: 277004 - RNA, 21 nt, Human
aaacaaauccuccaaaccaca

SEQ ID NO: 277005 - RNA, 18 nt, Human
aagagaggccuuuuaaug

SEQ ID NO: 277006 - RNA, 22 nt, Human
aaggaaggaugaugggggaagg

SEQ ID NO: 277007 - RNA, 18 nt, Human
aaggcggggcuuugucug

SEQ ID NO: 277008 - RNA, 21 nt, Human
aagggacauggccacuccagc

SEQ ID NO: 277009 - RNA, 19 nt, Human
aagggaccggagaucacag

SEQ ID NO: 277010 - RNA, 21 nt, Human
aaucucuagccaaaugaucuc

SEQ ID NO: 277011 - RNA, 18 nt, Human
acaaauccuccaaaccac

SEQ ID NO: 277012 - RNA, 18 nt, Human
acuugaugaagacagucc

SEQ ID NO: 277013 - RNA, 23 nt, Human
agaagucuccugccgucucacag

SEQ ID NO: 277014 - RNA, 25 nt, Human
agccccccucccccccgaugucccc

SEQ ID NO: 277015 - RNA, 18 nt, Human
agcccuucuccuuucuga

SEQ ID NO: 277016 - RNA, 25 nt, Human
agcccuucuccuuucugagcccccc

SEQ ID NO: 277017 - RNA, 23 nt, Human
aggaacuggaaggcggcaggacu

SEQ ID NO: 277018 - RNA, 23 nt, Human
aggaaggaugaugggggaaggga

SEQ ID NO: 277019 - RNA, 18 nt, Human
aggaguucuguagggaaa

SEQ ID NO: 277020 - RNA, 19 nt, Human
agggaccggagaucacagc

SEQ ID NO: 277021 - RNA, 25 nt, Human
agggaccggagaucacagcccuucu

SEQ ID NO: 277022 - RNA, 22 nt, Human
aggggcucugaagaggggcugc

SEQ ID NO: 277023 - RNA, 18 nt, Human
aucucuguuuucuugagg

SEQ ID NO: 277024 - RNA, 21 nt, Human
caaacaagccagugacagaca

SEQ ID NO: 277025 - RNA, 22 nt, Human
caaacaagccagugacagacac

SEQ ID NO: 277026 - RNA, 23 nt, Human
caagccagugacagacacugccc

SEQ ID NO: 277027 - RNA, 22 nt, Human
cacagccaugaaaggggacaga

SEQ ID NO: 277028 - RNA, 21 nt, Human
caccagcggggaugcacucaa

SEQ ID NO: 277029 - RNA, 23 nt, Human
cacucagacaaucucuagccaaa

SEQ ID NO: 277030 - RNA, 18 nt, Human
cacuugcagcaggaaggc

SEQ ID NO: 277031 - RNA, 18 nt, Human
ccacuuggggcagguguc

SEQ ID NO: 277032 - RNA, 22 nt, Human
ccccccucccccccgauguccc

SEQ ID NO: 277033 - RNA, 18 nt, Human
ccgccgccgcugccgcgc

SEQ ID NO: 277034 - RNA, 22 nt, Human
ccugaacuuccauggcaacagc

SEQ ID NO: 277035 - RNA, 21 nt, Human
ccugaucccggccuccuggac

SEQ ID NO: 277036 - RNA, 19 nt, Human
ccuggggaaugagcucugg

SEQ ID NO: 277037 - RNA, 26 nt, Human
cggcugcacagccaugaaaggggaca

SEQ ID NO: 277038 - RNA, 23 nt, Human
cgggacaccaaggaacuggaagg

SEQ ID NO: 277039 - RNA, 19 nt, Human
cggggcagaagucuccugc

SEQ ID NO: 277040 - RNA, 19 nt, Human
cucugcuuuggggaaggcg

SEQ ID NO: 277041 - RNA, 18 nt, Human
cugcuggcaguagccgcg

SEQ ID NO: 277042 - RNA, 20 nt, Human
cugggaacccugagcccaga

SEQ ID NO: 277043 - RNA, 19 nt, Human
gacuugguccuacaaaugg

SEQ ID NO: 277044 - RNA, 23 nt, Human
gagaucacagcccuucuccuuuc

SEQ ID NO: 277045 - RNA, 23 nt, Human
gagcccagacugacaagaguuua

SEQ ID NO: 277046 - RNA, 18 nt, Human
gagcuuagucaccagcgg

SEQ ID NO: 277047 - RNA, 21 nt, Human
gaucucuguuuucuugaggag

SEQ ID NO: 277048 - RNA, 21 nt, Human
gcaacggaaccuuuggcacca

SEQ ID NO: 277049 - RNA, 23 nt, Human
gcaggugucuugggggcaucuuc

SEQ ID NO: 277050 - RNA, 22 nt, Human
gcggaacaucagaaaaugggag

SEQ ID NO: 277051 - RNA, 23 nt, Human
ggacccuggcacuacuucaaaca

SEQ ID NO: 277052 - RNA, 19 nt, Human
gggaaaaaaaaaaaacaaa

SEQ ID NO: 277053 - RNA, 26 nt, Human
ggggcaggugucuugggggcaucuuc

SEQ ID NO: 277054 - RNA, 20 nt, Human
gggguagccgcuugcugcga

SEQ ID NO: 277055 - RNA, 18 nt, Human
guaaaaagcugcaacgga

SEQ ID NO: 277056 - RNA, 18 nt, Human
uacagugaguagcuugga

SEQ ID NO: 277057 - RNA, 19 nt, Human
uacuugaugaagacagucc

SEQ ID NO: 277058 - RNA, 20 nt, Human
uagaacacaaagggagaggc

SEQ ID NO: 277059 - RNA, 19 nt, Human
uagccgcgcugucgucucg

SEQ ID NO: 277060 - RNA, 20 nt, Human
uauagaacacaaagggagag

SEQ ID NO: 277061 - RNA, 20 nt, Human
ucagucuaaggaaggaugau

SEQ ID NO: 277062 - RNA, 23 nt, Human
uccacagauuugcacuucaaaca

SEQ ID NO: 277063 - RNA, 26 nt, Human
uccuccaaaccacaccggaugguugu

SEQ ID NO: 277064 - RNA, 18 nt, Human
uccuuucugagccccccu

SEQ ID NO: 277065 - RNA, 27 nt, Human
ucucacagccgcacccaccgcgcugcu

SEQ ID NO: 277066 - RNA, 25 nt, Human
ugagcccagacugacaagaguuuaa

SEQ ID NO: 277067 - RNA, 21 nt, Human
ugaggaguucuguagggaaau

SEQ ID NO: 277068 - RNA, 19 nt, Human
ugaguagcuuggagucacu

SEQ ID NO: 277069 - RNA, 22 nt, Human
ugcacagccaugaaaggggaca

SEQ ID NO: 277070 - RNA, 21 nt, Human
uggcaacagccugaucccggc

SEQ ID NO: 277071 - RNA, 21 nt, Human
uggcacuacuucaaacagcaa

SEQ ID NO: 277072 - RNA, 21 nt, Human
uggcuguucuuuucuguuggg

SEQ ID NO: 277073 - RNA, 22 nt, Human
ugggagccuucuucuaauggcu

SEQ ID NO: 277074 - RNA, 18 nt, Human
ugggcaggcugggcguuc

SEQ ID NO: 277075 - RNA, 18 nt, Human
ugucaggaugggcauguc

SEQ ID NO: 277076 - RNA, 25 nt, Human
uuccauggcaacagccugaucccgg

SEQ ID NO: 277077 - RNA, 21 nt, Human
uuccuggggaaugagcucugg

SEQ ID NO: 277078 - RNA, 21 nt, Human
uuggggcaggugucuuggggg

SEQ ID NO: 277079 - RNA, 22 nt, Human
uuggggcaggugucuugggggc

SEQ ID NO: 277080 - RNA, 26 nt, Human
uugguagggaacaaacaagccaguga

SEQ ID NO: 277081 - RNA, 18 nt, Human
uugguccuacaaauggaa

SEQ ID NO: 277082 - RNA, 22 nt, Human
aguggcugcaugcauugguagg

SEQ ID NO: 277083 - RNA, 22 nt, Human
cugcaugcauugguaggauggg

SEQ ID NO: 277084 - RNA, 19 nt, Human
uaggaaaggccagagagca

SEQ ID NO: 277085 - RNA, 21 nt, Human
ugcauugguaggaugggugga

SEQ ID NO: 277086 - RNA, 29 nt, Human
aaaaaaaaaaaaaacaaacaaaaaccacc

SEQ ID NO: 277087 - RNA, 26 nt, Human
aaaaaaaaaaaacaaacaaaaaccac

SEQ ID NO: 277088 - RNA, 27 nt, Human
aaaaaaaacaaacaaaaaccaccaaaa

SEQ ID NO: 277089 - RNA, 24 nt, Human
aaaaaaacaaacaaaaaccaccaa

SEQ ID NO: 277090 - RNA, 25 nt, Human
aaaaaaacaaacaaaaaccaccaaa

SEQ ID NO: 277091 - RNA, 19 nt, Human
aaaaaacagaaaccucaaa

SEQ ID NO: 277092 - RNA, 18 nt, Human
aaaaagcaaaaacaauau

SEQ ID NO: 277093 - RNA, 18 nt, Human
aaaacagaaaccucaaac

SEQ ID NO: 277094 - RNA, 24 nt, Human
aaaacuauuuccagaagaccccaa

SEQ ID NO: 277095 - RNA, 26 nt, Human
aaacaaaaaccaccaaaaaacagaaa

SEQ ID NO: 277096 - RNA, 27 nt, Human
aaacaaacaaaaaccaccaaaaaacag

SEQ ID NO: 277097 - RNA, 20 nt, Human
aaacagaaaccucaaaccac

SEQ ID NO: 277098 - RNA, 20 nt, Human
aaagucuuucgaguacauau

SEQ ID NO: 277099 - RNA, 19 nt, Human
aacaaaaaccaccaaaaaa

SEQ ID NO: 277100 - RNA, 21 nt, Human
aaccaccaaaaaacagaaacc

SEQ ID NO: 277101 - RNA, 22 nt, Human
aaccaccaaaaaacagaaaccu

SEQ ID NO: 277102 - RNA, 21 nt, Human
aaucaagaugacccaaucuag

SEQ ID NO: 277103 - RNA, 24 nt, Human
aauccauuuaccaaaauuauucug

SEQ ID NO: 277104 - RNA, 25 nt, Human
aaugacuucaagacuaucuuucggc

SEQ ID NO: 277105 - RNA, 20 nt, Human
aauggaaaaucucuugacca

SEQ ID NO: 277106 - RNA, 20 nt, Human
acaaaaaccaccaaaaaaca

SEQ ID NO: 277107 - RNA, 21 nt, Human
acaaaaagcacuucaaagaug

SEQ ID NO: 277108 - RNA, 23 nt, Human
acaacaaaagcaguaaaaagcaa

SEQ ID NO: 277109 - RNA, 20 nt, Human
acacuaaaaugaugccuauc

SEQ ID NO: 277110 - RNA, 24 nt, Human
acaguuuauacaaguuaaaauggg

SEQ ID NO: 277111 - RNA, 20 nt, Human
acauuaacaugacacaacua

SEQ ID NO: 277112 - RNA, 22 nt, Human
accaaaaaacagaaaccucaaa

SEQ ID NO: 277113 - RNA, 25 nt, Human
accaaaaaacagaaaccucaaacca

SEQ ID NO: 277114 - RNA, 19 nt, Human
accaccaaaaaacagaaac

SEQ ID NO: 277115 - RNA, 22 nt, Human
agaagaccccaaagcccacacc

SEQ ID NO: 277116 - RNA, 25 nt, Human
agaagaccccaaagcccacaccuuu

SEQ ID NO: 277117 - RNA, 24 nt, Human
agacaaauggacaguauguuucuu

SEQ ID NO: 277118 - RNA, 21 nt, Human
agacaagaaaaucuuagucau

SEQ ID NO: 277119 - RNA, 22 nt, Human
agagacuccucagaaaaagcaa

SEQ ID NO: 277120 - RNA, 23 nt, Human
agcugcuuucucucuucauuccu

SEQ ID NO: 277121 - RNA, 18 nt, Human
aggcacugcuguauggaa

SEQ ID NO: 277122 - RNA, 18 nt, Human
agucaugggaugagaaaa

SEQ ID NO: 277123 - RNA, 22 nt, Human
agugacaaucagucgggaggaa

SEQ ID NO: 277124 - RNA, 23 nt, Human
caaaaaacagaaaccucaaacca

SEQ ID NO: 277125 - RNA, 21 nt, Human
caaacaaaaaccaccaaaaaa

SEQ ID NO: 277126 - RNA, 23 nt, Human
caaacaaaaaccaccaaaaaaca

SEQ ID NO: 277127 - RNA, 25 nt, Human
caaacaaaaaccaccaaaaaacaga

SEQ ID NO: 277128 - RNA, 24 nt, Human
caaauguaauuaugacaacuacaa

SEQ ID NO: 277129 - RNA, 24 nt, Human
caacaaaagcaguaaaaagcaaga

SEQ ID NO: 277130 - RNA, 18 nt, Human
caagacaagaaaaucuua

SEQ ID NO: 277131 - RNA, 22 nt, Human
caagacaagaaaaucuuaguca

SEQ ID NO: 277132 - RNA, 21 nt, Human
cacacaguuuauacaaguuaa

SEQ ID NO: 277133 - RNA, 19 nt, Human
caccaaaaaacagaaaccu

SEQ ID NO: 277134 - RNA, 23 nt, Human
cagaaaccucaaaccacuucuga

SEQ ID NO: 277135 - RNA, 23 nt, Human
cagguaccaaaaugguuuugaag

SEQ ID NO: 277136 - RNA, 20 nt, Human
caugacacaacuauucagua

SEQ ID NO: 277137 - RNA, 21 nt, Human
cuccucagaaaaagcaaaaac

SEQ ID NO: 277138 - RNA, 21 nt, Human
cuccugcuuauuaaagaagga

SEQ ID NO: 277139 - RNA, 23 nt, Human
cuuaaggugaaaaaaaaaaaaaa

SEQ ID NO: 277140 - RNA, 25 nt, Human
gaaaaaaaaaaaaaacaaacaaaaa

SEQ ID NO: 277141 - RNA, 25 nt, Human
gaaaccucaaaccacuucugaauga

SEQ ID NO: 277142 - RNA, 23 nt, Human
gaaagccucccuuaaggugaaaa

SEQ ID NO: 277143 - RNA, 21 nt, Human
ggagaacagguaaucaaagua

SEQ ID NO: 277144 - RNA, 19 nt, Human
guuggggagcugcuuucuc

SEQ ID NO: 277145 - RNA, 22 nt, Human
guugugcuuguuuuuaaacaga

SEQ ID NO: 277146 - RNA, 20 nt, Human
uaaaaagcaagacaagaaaa

SEQ ID NO: 277147 - RNA, 23 nt, Human
uaaaguaaggauggcccaaucug

SEQ ID NO: 277148 - RNA, 22 nt, Human
uaggcacauuaacaugacacaa

SEQ ID NO: 277149 - RNA, 20 nt, Human
ucaagaugacccaaucuaau

SEQ ID NO: 277150 - RNA, 21 nt, Human
ucaugggaugagaaaaaauga

SEQ ID NO: 277151 - RNA, 22 nt, Human
uccagaagaccccaaagcccac

SEQ ID NO: 277152 - RNA, 24 nt, Human
uccagaagaccccaaagcccacac

SEQ ID NO: 277153 - RNA, 20 nt, Human
ucuccaaaugauucugaggc

SEQ ID NO: 277154 - RNA, 25 nt, Human
ucuuucggcuccugaaugcugcuuu

SEQ ID NO: 277155 - RNA, 19 nt, Human
ugaaguaugucuuguucuu

SEQ ID NO: 277156 - RNA, 22 nt, Human
ugagaaaaaaugaaacugaaag

SEQ ID NO: 277157 - RNA, 22 nt, Human
ugcuagguaaagugaauauucc

SEQ ID NO: 277158 - RNA, 21 nt, Human
uggcagguacuucugaaguca

SEQ ID NO: 277159 - RNA, 23 nt, Human
ugggagaacagguaaucaaagua

SEQ ID NO: 277160 - RNA, 20 nt, Human
ugucuuguucuuuaaaauaa

SEQ ID NO: 277161 - RNA, 22 nt, Human
ugucuuuuucgcuccugcuuau

SEQ ID NO: 277162 - RNA, 24 nt, Human
uuauuaaagaaggaagggugggaa

SEQ ID NO: 277163 - RNA, 23 nt, Human
uucaaaugauuucaaccccauuc

SEQ ID NO: 277164 - RNA, 19 nt, Human
uugugcuuguuuuuaaaca

SEQ ID NO: 277165 - RNA, 22 nt, Human
uuuccagaagaccccaaagccc

SEQ ID NO: 277166 - RNA, 24 nt, Human
uuucuccaaaugauucugaggcuc

SEQ ID NO: 277167 - RNA, 23 nt, Human
aaagcgccagcaggauugcaccg

SEQ ID NO: 277168 - RNA, 21 nt, Human
aaaggcggggcggacagaccc

SEQ ID NO: 277169 - RNA, 21 nt, Human
aaaggcggggcggacagaccc

SEQ ID NO: 277170 - RNA, 18 nt, Human
aaaguacuucucucugcu

SEQ ID NO: 277171 - RNA, 18 nt, Human
aacacaaucucucucucu

SEQ ID NO: 277172 - RNA, 23 nt, Human
aaccccggaaaagcgccagcagg

SEQ ID NO: 277173 - RNA, 23 nt, Human
aaccccggaaaagcgccagcagg

SEQ ID NO: 277174 - RNA, 19 nt, Human
aagcggauguaacuugaaa

SEQ ID NO: 277175 - RNA, 19 nt, Human
aaggcggggcggacagacc

SEQ ID NO: 277176 - RNA, 19 nt, Human
aaggcggggcggacagacc

SEQ ID NO: 277177 - RNA, 20 nt, Human
aaggcggggcggacagaccc

SEQ ID NO: 277178 - RNA, 20 nt, Human
aaggcggggcggacagaccc

SEQ ID NO: 277179 - RNA, 23 nt, Human
aagguaaauaacaacagaaauca

SEQ ID NO: 277180 - RNA, 20 nt, Human
aauuucagcuuuugauucag

SEQ ID NO: 277181 - RNA, 22 nt, Human
acagguccacuuggccugcaac

SEQ ID NO: 277182 - RNA, 18 nt, Human
accugcagcugcugcugu

SEQ ID NO: 277183 - RNA, 19 nt, Human
accugcagcugcugcuguc

SEQ ID NO: 277184 - RNA, 18 nt, Human
acuacccaaccaacuguu

SEQ ID NO: 277185 - RNA, 18 nt, Human
acucgauagccaggaacu

SEQ ID NO: 277186 - RNA, 24 nt, Human
agaaaacaggugcagaggcugcgg

SEQ ID NO: 277187 - RNA, 22 nt, Human
agaaugaacaaaaaaaucaaaa

SEQ ID NO: 277188 - RNA, 20 nt, Human
agagggcccuggaaggugcc

SEQ ID NO: 277189 - RNA, 18 nt, Human
agccaggaaccuguguag

SEQ ID NO: 277190 - RNA, 18 nt, Human
agccaggaaccuguguag

SEQ ID NO: 277191 - RNA, 20 nt, Human
agccggagcagucagagcgg

SEQ ID NO: 277192 - RNA, 21 nt, Human
agcgaaggagaccucaggcug

SEQ ID NO: 277193 - RNA, 24 nt, Human
aggauaguggagacaaucagccgg

SEQ ID NO: 277194 - RNA, 19 nt, Human
aggcgagggcaaaggcggg

SEQ ID NO: 277195 - RNA, 19 nt, Human
aggcgagggcaaaggcggg

SEQ ID NO: 277196 - RNA, 18 nt, Human
agggucucucagccgccu

SEQ ID NO: 277197 - RNA, 21 nt, Human
aggugcagaggcugcgggcga

SEQ ID NO: 277198 - RNA, 19 nt, Human
agucagagcggcugggcgg

SEQ ID NO: 277199 - RNA, 19 nt, Human
agugcagauucagacucga

SEQ ID NO: 277200 - RNA, 19 nt, Human
agugcagauucagacucga

SEQ ID NO: 277201 - RNA, 18 nt, Human
aguuguauucuuguuauc

SEQ ID NO: 277202 - RNA, 19 nt, Human
auuccgcuacucuaaaaug

SEQ ID NO: 277203 - RNA, 18 nt, Human
caaauccgccccgggaaa

SEQ ID NO: 277204 - RNA, 22 nt, Human
caaccagcacaagagucuacaa

SEQ ID NO: 277205 - RNA, 24 nt, Human
caagaagguaaagcgaguucagau

SEQ ID NO: 277206 - RNA, 22 nt, Human
cacacaggcucugcccagccag

SEQ ID NO: 277207 - RNA, 26 nt, Human
cacaggcucugcccagccaguuuucc

SEQ ID NO: 277208 - RNA, 23 nt, Human
caccccuaccucccuucccuucc

SEQ ID NO: 277209 - RNA, 22 nt, Human
cacuugugagccgccaucaacc

SEQ ID NO: 277210 - RNA, 21 nt, Human
cagaaccccggaaaagcgcca

SEQ ID NO: 277211 - RNA, 22 nt, Human
cagaaccccggaaaagcgccag

SEQ ID NO: 277212 - RNA, 22 nt, Human
cagaauucauccauacauuuuc

SEQ ID NO: 277213 - RNA, 22 nt, Human
cagacucgauagccaggaaccu

SEQ ID NO: 277214 - RNA, 24 nt, Human
cagaugcuuccauuuagauccacu

SEQ ID NO: 277215 - RNA, 18 nt, Human
cagcagcgucuauuuccu

SEQ ID NO: 277216 - RNA, 18 nt, Human
cagccaccaccugcagcu

SEQ ID NO: 277217 - RNA, 20 nt, Human
cagccaccaccugcagcugc

SEQ ID NO: 277218 - RNA, 19 nt, Human
cagcugcggcugagggacu

SEQ ID NO: 277219 - RNA, 19 nt, Human
cagcugcggcugagggacu

SEQ ID NO: 277220 - RNA, 21 nt, Human
cagcugcugcugucaccuacu

SEQ ID NO: 277221 - RNA, 20 nt, Human
caggaaccuguguagugagc

SEQ ID NO: 277222 - RNA, 20 nt, Human
caggaaccuguguagugagc

SEQ ID NO: 277223 - RNA, 24 nt, Human
cagugguguuuucauaagccaagc

SEQ ID NO: 277224 - RNA, 18 nt, Human
cauacaaaaacgaaagcc

SEQ ID NO: 277225 - RNA, 23 nt, Human
ccagggucucucagccgccuccc

SEQ ID NO: 277226 - RNA, 19 nt, Human
ccauacauuuucacaccac

SEQ ID NO: 277227 - RNA, 18 nt, Human
cccagcugcggcugaggg

SEQ ID NO: 277228 - RNA, 18 nt, Human
cccagcugcggcugaggg

SEQ ID NO: 277229 - RNA, 22 nt, Human
cccccucgcggguccccagcca

SEQ ID NO: 277230 - RNA, 25 nt, Human
cccgcgccgcgcgggcgggcagccg

SEQ ID NO: 277231 - RNA, 22 nt, Human
cccgcucagccagacccuaccc

SEQ ID NO: 277232 - RNA, 24 nt, Human
cccggcgaagacagaccuccugga

SEQ ID NO: 277233 - RNA, 24 nt, Human
cccggcgaagacagaccuccugga

SEQ ID NO: 277234 - RNA, 22 nt, Human
cccuaccucccuucccuuccaa

SEQ ID NO: 277235 - RNA, 22 nt, Human
cccuaccucccuucccuuccac

SEQ ID NO: 277236 - RNA, 23 nt, Human
ccgccccgggaaaaggcgagggc

SEQ ID NO: 277237 - RNA, 20 nt, Human
ccuacugugccacccccaag

SEQ ID NO: 277238 - RNA, 19 nt, Human
ccucccgggcuugcaagcc

SEQ ID NO: 277239 - RNA, 25 nt, Human
ccucgcccagggcuggggcgcagug

SEQ ID NO: 277240 - RNA, 25 nt, Human
ccucgcccagggcuggggcgcagug

SEQ ID NO: 277241 - RNA, 22 nt, Human
ccugcagcugcugcugucaccu

SEQ ID NO: 277242 - RNA, 20 nt, Human
ccuggagaaauuucuguuca

SEQ ID NO: 277243 - RNA, 18 nt, Human
ccugugcuccaaacaaga

SEQ ID NO: 277244 - RNA, 18 nt, Human
ccugugcuccaaacaaga

SEQ ID NO: 277245 - RNA, 24 nt, Human
cgagaacaaauccuccgcacccuc

SEQ ID NO: 277246 - RNA, 24 nt, Human
cgagaacaaauccuccgcacccuc

SEQ ID NO: 277247 - RNA, 19 nt, Human
cgaguucagauccugccgc

SEQ ID NO: 277248 - RNA, 19 nt, Human
cgaguucagauccugccgc

SEQ ID NO: 277249 - RNA, 22 nt, Human
cgccucccgggcuugcaagccc

SEQ ID NO: 277250 - RNA, 22 nt, Human
cgccugggcaccgcacucacuc

SEQ ID NO: 277251 - RNA, 21 nt, Human
cgcgcagaaccccggaaaagc

SEQ ID NO: 277252 - RNA, 21 nt, Human
cgcgcagaaccccggaaaagc

SEQ ID NO: 277253 - RNA, 24 nt, Human
cgcuacucuaaaaugaaaaaaaaa

SEQ ID NO: 277254 - RNA, 18 nt, Human
cgggaaaaggcgagggca

SEQ ID NO: 277255 - RNA, 19 nt, Human
cggggugggcgggugaagg

SEQ ID NO: 277256 - RNA, 18 nt, Human
cuacuacccaaccaacug

SEQ ID NO: 277257 - RNA, 26 nt, Human
cuagagaaugaacaaaaaaaucaaaa

SEQ ID NO: 277258 - RNA, 24 nt, Human
cuaggagcgcaugccuauggaaua

SEQ ID NO: 277259 - RNA, 21 nt, Human
cucucagccgccucccgggcu

SEQ ID NO: 277260 - RNA, 22 nt, Human
cucucuuuccuuuguugguuuu

SEQ ID NO: 277261 - RNA, 22 nt, Human
cugcugcugucaccuacugugc

SEQ ID NO: 277262 - RNA, 18 nt, Human
cuugcaagcccgcucagc

SEQ ID NO: 277263 - RNA, 20 nt, Human
cuuggaauuucucugaaaua

SEQ ID NO: 277264 - RNA, 21 nt, Human
gaaaaaaaaauauuuaucugu

SEQ ID NO: 277265 - RNA, 25 nt, Human
gaaaagcgccagcaggauugcaccg

SEQ ID NO: 277266 - RNA, 18 nt, Human
gaaaucauacauguucaa

SEQ ID NO: 277267 - RNA, 19 nt, Human
gaaccccggaaaagcgccg

SEQ ID NO: 277268 - RNA, 18 nt, Human
gacuggaggagaaguuuu

SEQ ID NO: 277269 - RNA, 22 nt, Human
gagagcuggcccggcgaagaca

SEQ ID NO: 277270 - RNA, 19 nt, Human
gagcgaaggagaccucagg

SEQ ID NO: 277271 - RNA, 19 nt, Human
gagcgaaggagaccucagg

SEQ ID NO: 277272 - RNA, 23 nt, Human
gaggagggccggggcuggagaau

SEQ ID NO: 277273 - RNA, 23 nt, Human
gaggagggccggggcuggagaau

SEQ ID NO: 277274 - RNA, 22 nt, Human
gcacaccuccucaauccagguc

SEQ ID NO: 277275 - RNA, 27 nt, Human
gcagaaccccggaaaagccgggacgcu

SEQ ID NO: 277276 - RNA, 27 nt, Human
gcagaaccccggaaaagccgggacgcu

SEQ ID NO: 277277 - RNA, 22 nt, Human
gcagaaccccggaaaagcgcca

SEQ ID NO: 277278 - RNA, 27 nt, Human
gcagugcgcuggugcuccucuagcugg

SEQ ID NO: 277279 - RNA, 27 nt, Human
gcagugcgcuggugcuccucuagcugg

SEQ ID NO: 277280 - RNA, 21 nt, Human
gcccccucgcggguccccagc

SEQ ID NO: 277281 - RNA, 19 nt, Human
gcccggcgaagacagaccu

SEQ ID NO: 277282 - RNA, 19 nt, Human
gcccggcgaagacagaccu

SEQ ID NO: 277283 - RNA, 19 nt, Human
gccugcaaccagcacaaga

SEQ ID NO: 277284 - RNA, 20 nt, Human
gcgaaggagaccucaggcug

SEQ ID NO: 277285 - RNA, 18 nt, Human
gcgagggagcaggaacag

SEQ ID NO: 277286 - RNA, 19 nt, Human
gcgcugccgggucugcugc

SEQ ID NO: 277287 - RNA, 22 nt, Human
gcgggaggagggccggggcugg

SEQ ID NO: 277288 - RNA, 23 nt, Human
gcugggcgguuggcgcugccggg

SEQ ID NO: 277289 - RNA, 21 nt, Human
gcuggugcuccucuagcuggg

SEQ ID NO: 277290 - RNA, 21 nt, Human
gcuggugcuccucuagcuggg

SEQ ID NO: 277291 - RNA, 18 nt, Human
ggagcagagauggggagc

SEQ ID NO: 277292 - RNA, 18 nt, Human
ggagcagagauggggagc

SEQ ID NO: 277293 - RNA, 21 nt, Human
ggccaagcgcgccugggcacc

SEQ ID NO: 277294 - RNA, 20 nt, Human
ggcgggaggagggccggggc

SEQ ID NO: 277295 - RNA, 20 nt, Human
ggcgggaggagggccggggc

SEQ ID NO: 277296 - RNA, 20 nt, Human
gggaggagggccggggcugg

SEQ ID NO: 277297 - RNA, 24 nt, Human
gggaggggacuggaggagaaguuu

SEQ ID NO: 277298 - RNA, 18 nt, Human
gggcaaaccccacccuua

SEQ ID NO: 277299 - RNA, 19 nt, Human
gggcugagaaaauuccaca

SEQ ID NO: 277300 - RNA, 19 nt, Human
gggcugagaaaauuccaca

SEQ ID NO: 277301 - RNA, 25 nt, Human
gggcuggggcgcagugcgcuggugc

SEQ ID NO: 277302 - RNA, 25 nt, Human
gggcuggggcgcagugcgcuggugc

SEQ ID NO: 277303 - RNA, 23 nt, Human
gucuccuuguggugaagccuucc

SEQ ID NO: 277304 - RNA, 24 nt, Human
gugcuuggaauuucucugaaauau

SEQ ID NO: 277305 - RNA, 22 nt, Human
guggcucccuggagaaauuucu

SEQ ID NO: 277306 - RNA, 22 nt, Human
uaaaaugggaaaucaguuuuca

SEQ ID NO: 277307 - RNA, 21 nt, Human
uaaacacaagaaaacaggugc

SEQ ID NO: 277308 - RNA, 18 nt, Human
uaagucuuuacuuaacca

SEQ ID NO: 277309 - RNA, 21 nt, Human
uaaugcccagagccucccagg

SEQ ID NO: 277310 - RNA, 25 nt, Human
uagcaaggcaggcgagcgaaggaga

SEQ ID NO: 277311 - RNA, 25 nt, Human
uagcaaggcaggcgagcgaaggaga

SEQ ID NO: 277312 - RNA, 23 nt, Human
uagcugacuuccgaauccuucac

SEQ ID NO: 277313 - RNA, 19 nt, Human
uaggguccaggacagcccg

SEQ ID NO: 277314 - RNA, 21 nt, Human
uaucaucugccaaaauauuaa

SEQ ID NO: 277315 - RNA, 21 nt, Human
ucaacuuauuuucccaccguc

SEQ ID NO: 277316 - RNA, 27 nt, Human
ucacucgcggggugggcgggugaaggu

SEQ ID NO: 277317 - RNA, 20 nt, Human
ucagugguguuuucauaagc

SEQ ID NO: 277318 - RNA, 21 nt, Human
uccccgcgccucguaggggcu

SEQ ID NO: 277319 - RNA, 21 nt, Human
uccccgcgccucguaggggcu

SEQ ID NO: 277320 - RNA, 18 nt, Human
ucccuucccuuccacgaa

SEQ ID NO: 277321 - RNA, 23 nt, Human
uccuaggguccaggacagcccgc

SEQ ID NO: 277322 - RNA, 21 nt, Human
uccugcaggggaggggacugg

SEQ ID NO: 277323 - RNA, 21 nt, Human
ucgcggguccccagccaccac

SEQ ID NO: 277324 - RNA, 22 nt, Human
ucuagagaaugaacaaaaaaau

SEQ ID NO: 277325 - RNA, 19 nt, Human
ucucucagccgccucccgg

SEQ ID NO: 277326 - RNA, 23 nt, Human
ucucucuuuccuuuguugguuuu

SEQ ID NO: 277327 - RNA, 21 nt, Human
ucuuugauccugacccaagcc

SEQ ID NO: 277328 - RNA, 24 nt, Human
ucuuugauccugacccaagccacu

SEQ ID NO: 277329 - RNA, 26 nt, Human
ucuuuuguguguguaggagcagagau

SEQ ID NO: 277330 - RNA, 19 nt, Human
ugaagccuuccgcuaaugc

SEQ ID NO: 277331 - RNA, 20 nt, Human
ugacccaagccacucgugcc

SEQ ID NO: 277332 - RNA, 20 nt, Human
ugacuuccgaauccuucacu

SEQ ID NO: 277333 - RNA, 22 nt, Human
ugaggccgacuucaccaaaucc

SEQ ID NO: 277334 - RNA, 22 nt, Human
ugaggccgacuucaccaaaucc

SEQ ID NO: 277335 - RNA, 19 nt, Human
ugagggacugcggucccuc

SEQ ID NO: 277336 - RNA, 19 nt, Human
ugagggacugcggucccuc

SEQ ID NO: 277337 - RNA, 19 nt, Human
ugauacucugggcguuugc

SEQ ID NO: 277338 - RNA, 24 nt, Human
ugcaagcccgcucagccagacccu

SEQ ID NO: 277339 - RNA, 28 nt, Human
ugcaccgagaacaaauccuccgcacccu

SEQ ID NO: 277340 - RNA, 28 nt, Human
ugcaccgagaacaaauccuccgcacccu

SEQ ID NO: 277341 - RNA, 18 nt, Human
ugcccagagccucccagg

SEQ ID NO: 277342 - RNA, 22 nt, Human
uggaauacucgcuccugucucc

SEQ ID NO: 277343 - RNA, 18 nt, Human
uggcccacugaguguuga

SEQ ID NO: 277344 - RNA, 21 nt, Human
ugggacacgaauaaaacacaa

SEQ ID NO: 277345 - RNA, 18 nt, Human
ugggaggaucagagaugg

SEQ ID NO: 277346 - RNA, 22 nt, Human
ugggaggaucagagaugggagc

SEQ ID NO: 277347 - RNA, 20 nt, Human
ugggcggucccugugcucca

SEQ ID NO: 277348 - RNA, 20 nt, Human
ugggcggucccugugcucca

SEQ ID NO: 277349 - RNA, 18 nt, Human
ugggcgguuggcgcugcc

SEQ ID NO: 277350 - RNA, 18 nt, Human
uggggaggggggcaaacc

SEQ ID NO: 277351 - RNA, 23 nt, Human
uucauccauacauuuucacacca

SEQ ID NO: 277352 - RNA, 25 nt, Human
uuugauucagaguugaagaaacuuu

SEQ ID NO: 277353 - RNA, 23 nt, Human
uuuguguguguaggagcagagau

SEQ ID NO: 277354 - RNA, 23 nt, Human
uuuguguguguaggagcagagau

SEQ ID NO: 277355 - RNA, 19 nt, Human
ucaauccuuucuucuaacu

SEQ ID NO: 277356 - RNA, 30 nt, Human
aaaaaaguagaugacugcagcaaagaagaa

SEQ ID NO: 277357 - RNA, 24 nt, Human
aaaaagaaaaacacaaaucuuaaa

SEQ ID NO: 277358 - RNA, 22 nt, Human
aaaaaguagaugacugcagcaa

SEQ ID NO: 277359 - RNA, 25 nt, Human
aaaaguagaugacugcagcaaagaa

SEQ ID NO: 277360 - RNA, 22 nt, Human
aaacaacaaaagcugaccaaga

SEQ ID NO: 277361 - RNA, 24 nt, Human
aacaaaagcugaccaagaguggua

SEQ ID NO: 277362 - RNA, 21 nt, Human
aacaaaauauuuugcaaacug

SEQ ID NO: 277363 - RNA, 21 nt, Human
aacaacaaaagcugaccaaga

SEQ ID NO: 277364 - RNA, 20 nt, Human
aacauggugaaacgccgucu

SEQ ID NO: 277365 - RNA, 21 nt, Human
aacauggugaaacgccgucuc

SEQ ID NO: 277366 - RNA, 20 nt, Human
aacuguacccuaaacuuuga

SEQ ID NO: 277367 - RNA, 21 nt, Human
aagcaagaaauaucauaaaca

SEQ ID NO: 277368 - RNA, 19 nt, Human
aagcauuagauggcuaacu

SEQ ID NO: 277369 - RNA, 20 nt, Human
aaguauugaagguacuauuu

SEQ ID NO: 277370 - RNA, 18 nt, Human
aaguggccucuugagccc

SEQ ID NO: 277371 - RNA, 22 nt, Human
aaucaguuaaaaaugcauccaa

SEQ ID NO: 277372 - RNA, 18 nt, Human
aauugcuggaaccuggga

SEQ ID NO: 277373 - RNA, 20 nt, Human
aauuuacacaaaauugcagu

SEQ ID NO: 277374 - RNA, 24 nt, Human
acaaaucuuaaaaacuaaagcaag

SEQ ID NO: 277375 - RNA, 25 nt, Human
acacaaaucuuaaaaacuaaagcaa

SEQ ID NO: 277376 - RNA, 18 nt, Human
acaccacugcacuccagc

SEQ ID NO: 277377 - RNA, 20 nt, Human
acaccacugcacuccagccu

SEQ ID NO: 277378 - RNA, 22 nt, Human
acagagcaagacugcuucaaaa

SEQ ID NO: 277379 - RNA, 25 nt, Human
acaguggaaugagaugacuuccaga

SEQ ID NO: 277380 - RNA, 19 nt, Human
accaccagugccagucagc

SEQ ID NO: 277381 - RNA, 19 nt, Human
accacugcacuccagccug

SEQ ID NO: 277382 - RNA, 24 nt, Human
accugaggucaggaguuugagacc

SEQ ID NO: 277383 - RNA, 24 nt, Human
acgccgucucuacuaaaaauacaa

SEQ ID NO: 277384 - RNA, 24 nt, Human
acugcacuccagccuggguaacag

SEQ ID NO: 277385 - RNA, 26 nt, Human
acugcacuccagccuggguaacagag

SEQ ID NO: 277386 - RNA, 24 nt, Human
acuguauauaaacaacaaaagcug

SEQ ID NO: 277387 - RNA, 20 nt, Human
agaagauugcaagggccagg

SEQ ID NO: 277388 - RNA, 22 nt, Human
agaauugcuggaaccugggagg

SEQ ID NO: 277389 - RNA, 18 nt, Human
agagguugcagugagccg

SEQ ID NO: 277390 - RNA, 23 nt, Human
agagguugcagugagccgagauc

SEQ ID NO: 277391 - RNA, 24 nt, Human
agagguugcagugagccgagauca

SEQ ID NO: 277392 - RNA, 24 nt, Human
agcacuuugggaggcugagguagg

SEQ ID NO: 277393 - RNA, 19 nt, Human
agccuggccaacaugguga

SEQ ID NO: 277394 - RNA, 20 nt, Human
aggaguuugagaccagccug

SEQ ID NO: 277395 - RNA, 24 nt, Human
aggcaacaaaauauuuugcaaacu

SEQ ID NO: 277396 - RNA, 21 nt, Human
aggcagagguugcagugagcc

SEQ ID NO: 277397 - RNA, 24 nt, Human
aggcagagguugcagugagccgag

SEQ ID NO: 277398 - RNA, 22 nt, Human
aggcaggagaauugcuggaacc

SEQ ID NO: 277399 - RNA, 24 nt, Human
aggcaggagaauugcuggaaccug

SEQ ID NO: 277400 - RNA, 22 nt, Human
aggcggaucaccugaggucagg

SEQ ID NO: 277401 - RNA, 18 nt, Human
aggcugaggcaggagaau

SEQ ID NO: 277402 - RNA, 21 nt, Human
aggcugaggcaggagaauugc

SEQ ID NO: 277403 - RNA, 24 nt, Human
aggcugagguaggcggaucaccug

SEQ ID NO: 277404 - RNA, 22 nt, Human
agguaggcggaucaccugaggu

SEQ ID NO: 277405 - RNA, 26 nt, Human
agguaggcggaucaccugaggucagg

SEQ ID NO: 277406 - RNA, 24 nt, Human
aggugugguggaucacgccuguaa

SEQ ID NO: 277407 - RNA, 21 nt, Human
aguagaagauugcaagggcca

SEQ ID NO: 277408 - RNA, 23 nt, Human
agucaggcaugauggcaggcgcc

SEQ ID NO: 277409 - RNA, 19 nt, Human
aguggccucuugagcccag

SEQ ID NO: 277410 - RNA, 23 nt, Human
auaaacaacaaaagcugaccaag

SEQ ID NO: 277411 - RNA, 24 nt, Human
aucacaccacugcacuccagccug

SEQ ID NO: 277412 - RNA, 24 nt, Human
aucaccugaggucaggaguuugag

SEQ ID NO: 277413 - RNA, 23 nt, Human
caaaaaugcacgaauacggucga

SEQ ID NO: 277414 - RNA, 22 nt, Human
caaaaauuagucaggcaugaug

SEQ ID NO: 277415 - RNA, 23 nt, Human
caaaucuuaaaaacuaaagcaag

SEQ ID NO: 277416 - RNA, 24 nt, Human
caacauggugaaacgccgucucua

SEQ ID NO: 277417 - RNA, 23 nt, Human
caacuguacccuaaacuuugacc

SEQ ID NO: 277418 - RNA, 24 nt, Human
caacuguacccuaaacuuugaccc

SEQ ID NO: 277419 - RNA, 21 nt, Human
cacaccacugcacuccagccu

SEQ ID NO: 277420 - RNA, 26 nt, Human
caccacugcacuccagccuggguaac

SEQ ID NO: 277421 - RNA, 23 nt, Human
caccugaggucaggaguuugaga

SEQ ID NO: 277422 - RNA, 24 nt, Human
cacgccuguaaucccagcacuuug

SEQ ID NO: 277423 - RNA, 19 nt, Human
cacugcacuccagccuggg

SEQ ID NO: 277424 - RNA, 19 nt, Human
cacugcacuccagccuggg

SEQ ID NO: 277425 - RNA, 22 nt, Human
cacugcacuccagccuggguaa

SEQ ID NO: 277426 - RNA, 23 nt, Human
cacugcacuccagccuggguaac

SEQ ID NO: 277427 - RNA, 24 nt, Human
cacugcacuccagccuggguaaca

SEQ ID NO: 277428 - RNA, 21 nt, Human
cagcaaagaagagauuuauua

SEQ ID NO: 277429 - RNA, 24 nt, Human
cagcacuuugggaggcugagguag

SEQ ID NO: 277430 - RNA, 28 nt, Human
cagcacuuugggaggcugagguaggcgg

SEQ ID NO: 277431 - RNA, 21 nt, Human
caggcgccugucaucccagcu

SEQ ID NO: 277432 - RNA, 20 nt, Human
ccacugcacuccagccuggg

SEQ ID NO: 277433 - RNA, 20 nt, Human
ccacugcacuccagccuggg

SEQ ID NO: 277434 - RNA, 21 nt, Human
ccacugcacuccagccugggu

SEQ ID NO: 277435 - RNA, 22 nt, Human
ccacugcacuccagccugggua

SEQ ID NO: 277436 - RNA, 24 nt, Human
ccacugcacuccagccuggguaac

SEQ ID NO: 277437 - RNA, 25 nt, Human
ccacugcacuccagccuggguaaca

SEQ ID NO: 277438 - RNA, 22 nt, Human
ccugaggucaggaguuugagac

SEQ ID NO: 277439 - RNA, 23 nt, Human
ccuggccaacauggugaaacgcc

SEQ ID NO: 277440 - RNA, 24 nt, Human
ccuggccaacauggugaaacgccg

SEQ ID NO: 277441 - RNA, 25 nt, Human
ccugggaggcagagguugcagugag

SEQ ID NO: 277442 - RNA, 22 nt, Human
ccugucaucccagcuacuaggg

SEQ ID NO: 277443 - RNA, 23 nt, Human
cgccuguaaucccagcacuuugg

SEQ ID NO: 277444 - RNA, 24 nt, Human
cgccuguaaucccagcacuuuggg

SEQ ID NO: 277445 - RNA, 24 nt, Human
cggaucaccugaggucaggaguuu

SEQ ID NO: 277446 - RNA, 21 nt, Human
cuaaagcaagucagggaagcc

SEQ ID NO: 277447 - RNA, 23 nt, Human
cuagcaucuuucuacaucuuucc

SEQ ID NO: 277448 - RNA, 21 nt, Human
cucuuccuuucaagguaucug

SEQ ID NO: 277449 - RNA, 22 nt, Human
cucuuccuuucaagguaucugu

SEQ ID NO: 277450 - RNA, 23 nt, Human
gagaccagccuggccaacauggu

SEQ ID NO: 277451 - RNA, 23 nt, Human
gagaucacaccacugcacuccag

SEQ ID NO: 277452 - RNA, 24 nt, Human
gaucaccugaggucaggaguuuga

SEQ ID NO: 277453 - RNA, 24 nt, Human
gauggcuaacuaccaaacaaguua

SEQ ID NO: 277454 - RNA, 19 nt, Human
gauuuauuagcucuuccuu

SEQ ID NO: 277455 - RNA, 24 nt, Human
gcacuccagccuggguaacagagc

SEQ ID NO: 277456 - RNA, 19 nt, Human
gccaacauggugaaacgcc

SEQ ID NO: 277457 - RNA, 24 nt, Human
gccaacauggugaaacgccgucuc

SEQ ID NO: 277458 - RNA, 20 nt, Human
gccgagaucacaccacugca

SEQ ID NO: 277459 - RNA, 20 nt, Human
gcuaggcauauuaguaacug

SEQ ID NO: 277460 - RNA, 18 nt, Human
gcugggcucgugguugcc

SEQ ID NO: 277461 - RNA, 21 nt, Human
ggagaauugcuggaaccuggg

SEQ ID NO: 277462 - RNA, 22 nt, Human
ggaucaccugaggucaggaguu

SEQ ID NO: 277463 - RNA, 22 nt, Human
ggaucaccugaggucaggaguu

SEQ ID NO: 277464 - RNA, 25 nt, Human
ggaucaccugaggucaggaguuuga

SEQ ID NO: 277465 - RNA, 19 nt, Human
gggaagccuggaaagauac

SEQ ID NO: 277466 - RNA, 21 nt, Human
gggaggcugaggcaggagaau

SEQ ID NO: 277467 - RNA, 23 nt, Human
gguacuugugcuaggcauauuag

SEQ ID NO: 277468 - RNA, 19 nt, Human
ggucaggaguuugagacca

SEQ ID NO: 277469 - RNA, 24 nt, Human
gguggaucacgccuguaaucccag

SEQ ID NO: 277470 - RNA, 22 nt, Human
gugguacuugugcuaggcauau

SEQ ID NO: 277471 - RNA, 19 nt, Human
guugcagugagccgagauc

SEQ ID NO: 277472 - RNA, 21 nt, Human
uaaaaaaaaaguagaugacug

SEQ ID NO: 277473 - RNA, 20 nt, Human
uaaguggccucuugagccca

SEQ ID NO: 277474 - RNA, 21 nt, Human
uaauaccaacaguggaaugag

SEQ ID NO: 277475 - RNA, 18 nt, Human
uacuagggaggcugaggc

SEQ ID NO: 277476 - RNA, 19 nt, Human
uacuagggaggcugaggca

SEQ ID NO: 277477 - RNA, 21 nt, Human
uacuguauauaaacaacaaaa

SEQ ID NO: 277478 - RNA, 18 nt, Human
uagaaggaaauccaggcu

SEQ ID NO: 277479 - RNA, 24 nt, Human
uaggcggaucaccugaggucagga

SEQ ID NO: 277480 - RNA, 26 nt, Human
uauauaaacaacaaaagcugaccaag

SEQ ID NO: 277481 - RNA, 22 nt, Human
uauuaugccaaaacuguucacc

SEQ ID NO: 277482 - RNA, 18 nt, Human
ucaaugcaccacaagagg

SEQ ID NO: 277483 - RNA, 23 nt, Human
ucacaccacugcacuccagccug

SEQ ID NO: 277484 - RNA, 23 nt, Human
ucacgccuguaaucccagcacuu

SEQ ID NO: 277485 - RNA, 23 nt, Human
ucaguuaaaaaugcauccaaaaa

SEQ ID NO: 277486 - RNA, 23 nt, Human
ucccuaaguggccucuugagccc

SEQ ID NO: 277487 - RNA, 19 nt, Human
ucucccauuuuucaggcaa

SEQ ID NO: 277488 - RNA, 21 nt, Human
ucucuacuaaaaauacaaaaa

SEQ ID NO: 277489 - RNA, 21 nt, Human
ucucugagcaauucccuucug

SEQ ID NO: 277490 - RNA, 23 nt, Human
ugaaacacccagccgucagcuau

SEQ ID NO: 277491 - RNA, 23 nt, Human
ugaccaagagugguacuugugcu

SEQ ID NO: 277492 - RNA, 23 nt, Human
ugagaccagccuggccaacaugg

SEQ ID NO: 277493 - RNA, 19 nt, Human
ugaggcaggagaauugcug

SEQ ID NO: 277494 - RNA, 24 nt, Human
ugaggcaggagaauugcuggaacc

SEQ ID NO: 277495 - RNA, 24 nt, Human
ugaggcaggagaauugcuggaacc

SEQ ID NO: 277496 - RNA, 20 nt, Human
ugagguaggcggaucaccug

SEQ ID NO: 277497 - RNA, 24 nt, Human
ugagguaggcggaucaccugaggu

SEQ ID NO: 277498 - RNA, 26 nt, Human
ugagguaggcggaucaccugagguca

SEQ ID NO: 277499 - RNA, 18 nt, Human
ugaggucaggaguuugag

SEQ ID NO: 277500 - RNA, 18 nt, Human
ugcaguccggggcgcuga

SEQ ID NO: 277501 - RNA, 22 nt, Human
ugccaugauaguaaucauaaga

SEQ ID NO: 277502 - RNA, 25 nt, Human
uggaaaaagaaaaacacaaaucuua

SEQ ID NO: 277503 - RNA, 22 nt, Human
uggaucacgccuguaaucccag

SEQ ID NO: 277504 - RNA, 24 nt, Human
uggaucacgccuguaaucccagca

SEQ ID NO: 277505 - RNA, 18 nt, Human
uggccaacauggugaaac

SEQ ID NO: 277506 - RNA, 18 nt, Human
uggccucuugagcccagu

SEQ ID NO: 277507 - RNA, 25 nt, Human
uggcuaacuaccaaacaaguuaagu

SEQ ID NO: 277508 - RNA, 24 nt, Human
ugggaggcagagguugcagugagc

SEQ ID NO: 277509 - RNA, 18 nt, Human
ugggaggcugagguaggc

SEQ ID NO: 277510 - RNA, 19 nt, Human
ugggaggcugagguaggcg

SEQ ID NO: 277511 - RNA, 24 nt, Human
ugggaggcugagguaggcggauca

SEQ ID NO: 277512 - RNA, 21 nt, Human
uggugcaguccggggcgcuga

SEQ ID NO: 277513 - RNA, 24 nt, Human
ugguggaucacgccuguaauccca

SEQ ID NO: 277514 - RNA, 23 nt, Human
uucucugagcaauucccuucuga

SEQ ID NO: 277515 - RNA, 20 nt, Human
uugaaugauaccuagccaac

SEQ ID NO: 277516 - RNA, 21 nt, Human
uugauaacauguuagaaggaa

SEQ ID NO: 277517 - RNA, 21 nt, Human
uugcaagggccagguguggug

SEQ ID NO: 277518 - RNA, 18 nt, Human
uugcagugagccgagauc

SEQ ID NO: 277519 - RNA, 19 nt, Human
uugcagugagccgagauca

SEQ ID NO: 277520 - RNA, 20 nt, Human
uugcagugagccgagaucac

SEQ ID NO: 277521 - RNA, 18 nt, Human
uugcuggaaccugggagg

SEQ ID NO: 277522 - RNA, 23 nt, Human
uuggcugggcucgugguugccgg

SEQ ID NO: 277523 - RNA, 25 nt, Human
uugggaggcugagguaggcggauca

SEQ ID NO: 277524 - RNA, 18 nt, Human
uuucuagcaucuuucuac

SEQ ID NO: 277525 - RNA, 25 nt, Human
uuuguaauugaaagcaagaaauauc

SEQ ID NO: 277526 - RNA, 18 nt, Human
accagcgcacuccccagu

SEQ ID NO: 277527 - RNA, 19 nt, Human
accgcucuaggaguugcgc

SEQ ID NO: 277528 - RNA, 23 nt, Human
acugggacccgcgucuccccaag

SEQ ID NO: 277529 - RNA, 21 nt, Human
caguaggagccgcaggacugg

SEQ ID NO: 277530 - RNA, 29 nt, Human
ccagcaaucuuccgaccagcgcacucccc

SEQ ID NO: 277531 - RNA, 25 nt, Human
gacccgcgucuccccaaggaccgcu

SEQ ID NO: 277532 - RNA, 21 nt, Human
uccgaccagcgcacuccccag

SEQ ID NO: 277533 - RNA, 22 nt, Human
uccuucucucugauuugauggg

SEQ ID NO: 277534 - RNA, 21 nt, Human
ucucucugauuugaugggugg

SEQ ID NO: 277535 - RNA, 21 nt, Human
ucucuuugccugcgccugggc

SEQ ID NO: 277536 - RNA, 23 nt, Human
ucugauuugauggguggcugggg

SEQ ID NO: 277537 - RNA, 19 nt, Human
ugugcugcuuacgugaugc

SEQ ID NO: 277538 - RNA, 18 nt, Human
aagugcugucuauacagg

SEQ ID NO: 277539 - RNA, 20 nt, Human
aggcugaaucagcacugcca

SEQ ID NO: 277540 - RNA, 22 nt, Human
aucucugccugggcuggaacag

SEQ ID NO: 277541 - RNA, 21 nt, Human
caagaagggacaggagucuug

SEQ ID NO: 277542 - RNA, 21 nt, Human
caccaaaagccucccaggcag

SEQ ID NO: 277543 - RNA, 20 nt, Human
caccugaucucugccugggc

SEQ ID NO: 277544 - RNA, 20 nt, Human
cagcuggagcacugugucca

SEQ ID NO: 277545 - RNA, 23 nt, Human
cauucucaucccaagaagggaca

SEQ ID NO: 277546 - RNA, 24 nt, Human
ccaccaaaagccucccaggcagcu

SEQ ID NO: 277547 - RNA, 22 nt, Human
ccagccucugcccaccugaucu

SEQ ID NO: 277548 - RNA, 19 nt, Human
ccucugcccaccugaucuc

SEQ ID NO: 277549 - RNA, 23 nt, Human
gaagggacaggagucuuggccca

SEQ ID NO: 277550 - RNA, 22 nt, Human
ggcccagaggcuguggggacca

SEQ ID NO: 277551 - RNA, 24 nt, Human
ggggauggccaggcugaaucagca

SEQ ID NO: 277552 - RNA, 23 nt, Human
ucauaccuuuuauuacaaaaauc

SEQ ID NO: 277553 - RNA, 20 nt, Human
ucccaagaagggacaggagu

SEQ ID NO: 277554 - RNA, 20 nt, Human
uccuaaggagccaagugcug

SEQ ID NO: 277555 - RNA, 22 nt, Human
ucugcccaccugaucucugccu

SEQ ID NO: 277556 - RNA, 24 nt, Human
uggggaccaccaaaagccucccag

SEQ ID NO: 277557 - RNA, 19 nt, Human
uguauaaagucgauaggac

SEQ ID NO: 277558 - RNA, 18 nt, Human
uguccaaaccaaggaagu

SEQ ID NO: 277559 - RNA, 20 nt, Human
aagauucugguuugcuuuuc

SEQ ID NO: 277560 - RNA, 18 nt, Human
aagcacccugcagcaagg

SEQ ID NO: 277561 - RNA, 23 nt, Human
aagcacccugcagcaaggucuug

SEQ ID NO: 277562 - RNA, 20 nt, Human
agacaggaacagaacaaauc

SEQ ID NO: 277563 - RNA, 24 nt, Human
agacaggaacagaacaaaucagag

SEQ ID NO: 277564 - RNA, 23 nt, Human
agagagaagugcagaguucgauu

SEQ ID NO: 277565 - RNA, 24 nt, Human
agagagaguguguagggggaauca

SEQ ID NO: 277566 - RNA, 21 nt, Human
agaggaagagagguugcaacc

SEQ ID NO: 277567 - RNA, 27 nt, Human
aggaaguaaguaggugauggggagaaa

SEQ ID NO: 277568 - RNA, 27 nt, Human
aggggaggaggggaaguucggugaugg

SEQ ID NO: 277569 - RNA, 18 nt, Human
aggguugugggggagaca

SEQ ID NO: 277570 - RNA, 23 nt, Human
agguauuuacaagaaggcucagg

SEQ ID NO: 277571 - RNA, 23 nt, Human
aggucuugggguggccggacugc

SEQ ID NO: 277572 - RNA, 22 nt, Human
cacgaucaggauccgaagcacc

SEQ ID NO: 277573 - RNA, 19 nt, Human
cacucugccaaucucagcc

SEQ ID NO: 277574 - RNA, 20 nt, Human
cagcccaggguucccgggcc

SEQ ID NO: 277575 - RNA, 21 nt, Human
cauucaaacuggaccuugacu

SEQ ID NO: 277576 - RNA, 18 nt, Human
cccugggacagagggcuc

SEQ ID NO: 277577 - RNA, 21 nt, Human
cgaagcacccugcagcaaggu

SEQ ID NO: 277578 - RNA, 21 nt, Human
cucagggggccagaggcucau

SEQ ID NO: 277579 - RNA, 22 nt, Human
gacagagugguuuaaauagggg

SEQ ID NO: 277580 - RNA, 19 nt, Human
gaccccgcgacucacgauc

SEQ ID NO: 277581 - RNA, 19 nt, Human
gaggguugugggggagaca

SEQ ID NO: 277582 - RNA, 18 nt, Human
gaucaggauccgaagcac

SEQ ID NO: 277583 - RNA, 24 nt, Human
gcaugggaagagcagagagagugu

SEQ ID NO: 277584 - RNA, 22 nt, Human
gcccaggguucccgggccgcac

SEQ ID NO: 277585 - RNA, 19 nt, Human
gcggcacuggagcagguac

SEQ ID NO: 277586 - RNA, 21 nt, Human
gggcagcggcagaaggccggc

SEQ ID NO: 277587 - RNA, 21 nt, Human
ggggaaguucggugauggggg

SEQ ID NO: 277588 - RNA, 20 nt, Human
ggggcaccgagucgcaaaga

SEQ ID NO: 277589 - RNA, 23 nt, Human
ggugauggggagaaacggggcac

SEQ ID NO: 277590 - RNA, 18 nt, Human
gguuuaaauaggggagga

SEQ ID NO: 277591 - RNA, 19 nt, Human
gguuuaaauaggggaggag

SEQ ID NO: 277592 - RNA, 22 nt, Human
gugguuuaaauaggggaggagg

SEQ ID NO: 277593 - RNA, 20 nt, Human
uauaacaauauaaauaagaa

SEQ ID NO: 277594 - RNA, 22 nt, Human
ucaaacuggaccuugacucaaa

SEQ ID NO: 277595 - RNA, 24 nt, Human
ucaucuuggaauauuuuauaacaa

SEQ ID NO: 277596 - RNA, 24 nt, Human
ucccucggcaguaauauuucacuc

SEQ ID NO: 277597 - RNA, 19 nt, Human
ucccugggacagagggcuc

SEQ ID NO: 277598 - RNA, 18 nt, Human
uccgaagcacccugcagc

SEQ ID NO: 277599 - RNA, 21 nt, Human
ucuuggaauauuuuauaacaa

SEQ ID NO: 277600 - RNA, 19 nt, Human
ugcccugcuacguucccuc

SEQ ID NO: 277601 - RNA, 27 nt, Human
ugcuacguucccucggcaguaauauuu

SEQ ID NO: 277602 - RNA, 20 nt, Human
ugggaagagcagagagagug

SEQ ID NO: 277603 - RNA, 20 nt, Human
ugggaagagcagagagaguu

SEQ ID NO: 277604 - RNA, 19 nt, Human
uguacaagggggcagcggc

SEQ ID NO: 277605 - RNA, 18 nt, Human
ugugggggagacagagug

SEQ ID NO: 277606 - RNA, 24 nt, Human
uguguagggggaaucagccugcag

SEQ ID NO: 277607 - RNA, 22 nt, Human
uuugcccgagccuuucccuggg

SEQ ID NO: 277608 - RNA, 23 nt, Human
aaagcagaggaagaggaaggccc

SEQ ID NO: 277609 - RNA, 21 nt, Human
agaggaagaggaaggcccugg

SEQ ID NO: 277610 - RNA, 19 nt, Human
aggaagaggaaggggugcc

SEQ ID NO: 277611 - RNA, 20 nt, Human
aggcaaggcuguggggcugg

SEQ ID NO: 277612 - RNA, 24 nt, Human
agggcagccgggaagggucagugg

SEQ ID NO: 277613 - RNA, 22 nt, Human
ccauggguccuccccucccucu

SEQ ID NO: 277614 - RNA, 19 nt, Human
cccgggcuaggggggagag

SEQ ID NO: 277615 - RNA, 23 nt, Human
ccugcaacccuuucaccccuucu

SEQ ID NO: 277616 - RNA, 20 nt, Human
cgccccucuccaagcaacag

SEQ ID NO: 277617 - RNA, 24 nt, Human
cgggaccugcaacccuuucacccc

SEQ ID NO: 277618 - RNA, 23 nt, Human
cucuccaggucccgccccucucc

SEQ ID NO: 277619 - RNA, 18 nt, Human
gaggaaggcccuggucuc

SEQ ID NO: 277620 - RNA, 18 nt, Human
gcccagggccccuuccac

SEQ ID NO: 277621 - RNA, 18 nt, Human
gcccagggccccuuccac

SEQ ID NO: 277622 - RNA, 19 nt, Human
ggcagccgggaagggucag

SEQ ID NO: 277623 - RNA, 24 nt, Human
ggcuaggggggagagccauggguc

SEQ ID NO: 277624 - RNA, 22 nt, Human
ggucuacaggcucggcccaggg

SEQ ID NO: 277625 - RNA, 18 nt, Human
gguggucaggcaaggcug

SEQ ID NO: 277626 - RNA, 24 nt, Human
guaagcuggggagggagggcagcc

SEQ ID NO: 277627 - RNA, 20 nt, Human
guggucaggcaaggcugugg

SEQ ID NO: 277628 - RNA, 18 nt, Human
uacaggcucggcccaggg

SEQ ID NO: 277629 - RNA, 23 nt, Human
uauuaaauaaaagcagaggaaga

SEQ ID NO: 277630 - RNA, 21 nt, Human
ucuccaggucccgccccucuc

SEQ ID NO: 277631 - RNA, 21 nt, Human
ugcgugcugggcuugaggugu

SEQ ID NO: 277632 - RNA, 18 nt, Human
ugggcagggagggagccu

SEQ ID NO: 277633 - RNA, 20 nt, Human
ugggcagggagggagccucc

SEQ ID NO: 277634 - RNA, 22 nt, Human
uggucgggaccugcaacccuuu

SEQ ID NO: 277635 - RNA, 19 nt, Human
uucaccccuucuggaagac

SEQ ID NO: 277636 - RNA, 21 nt, Human
aaaagccagaauaucuaagua

SEQ ID NO: 277637 - RNA, 23 nt, Human
aaacaaggcaggcacuuucauac

SEQ ID NO: 277638 - RNA, 20 nt, Human
aaacaaguacaagccucugg

SEQ ID NO: 277639 - RNA, 18 nt, Human
aaacccaggccccaucaa

SEQ ID NO: 277640 - RNA, 19 nt, Human
aaagccaaagaggguggga

SEQ ID NO: 277641 - RNA, 20 nt, Human
aacaaaagccgaauguggug

SEQ ID NO: 277642 - RNA, 18 nt, Human
aacaagagagggagaggg

SEQ ID NO: 277643 - RNA, 22 nt, Human
aacacaggaaaaggggaagaga

SEQ ID NO: 277644 - RNA, 20 nt, Human
aacucugugagcucaggauc

SEQ ID NO: 277645 - RNA, 20 nt, Human
aagugaaauauugaauguca

SEQ ID NO: 277646 - RNA, 20 nt, Human
acagaaaguugacuugggcc

SEQ ID NO: 277647 - RNA, 21 nt, Human
acagaaucaacaaaagccgaa

SEQ ID NO: 277648 - RNA, 20 nt, Human
acauuaaacccagggcuaca

SEQ ID NO: 277649 - RNA, 18 nt, Human
acccagugcccgccauca

SEQ ID NO: 277650 - RNA, 19 nt, Human
accccaccacuuugaucuc

SEQ ID NO: 277651 - RNA, 23 nt, Human
accuaccuacaccaaaucacaca

SEQ ID NO: 277652 - RNA, 21 nt, Human
acucugugagcucaggaucua

SEQ ID NO: 277653 - RNA, 23 nt, Human
acucuucagccucaaccuucuua

SEQ ID NO: 277654 - RNA, 23 nt, Human
acuuuagugggaucugagggauu

SEQ ID NO: 277655 - RNA, 18 nt, Human
agaaagacuugaggcugg

SEQ ID NO: 277656 - RNA, 21 nt, Human
agagacacagaaugauguggc

SEQ ID NO: 277657 - RNA, 22 nt, Human
agagcauacccagcauuccagc

SEQ ID NO: 277658 - RNA, 19 nt, Human
agaggaggggaacgagugg

SEQ ID NO: 277659 - RNA, 19 nt, Human
agagggagagggagaccac

SEQ ID NO: 277660 - RNA, 21 nt, Human
agcaaugaaaagacucaggaa

SEQ ID NO: 277661 - RNA, 20 nt, Human
agcauccacacagggaaauu

SEQ ID NO: 277662 - RNA, 21 nt, Human
aggauggaccagcugagggcu

SEQ ID NO: 277663 - RNA, 21 nt, Human
aggcagggaggaccuagagua

SEQ ID NO: 277664 - RNA, 18 nt, Human
agggagacaggccagcag

SEQ ID NO: 277665 - RNA, 24 nt, Human
agggagagggaaagggugugagau

SEQ ID NO: 277666 - RNA, 23 nt, Human
aggggaagagaguggcaaauauc

SEQ ID NO: 277667 - RNA, 19 nt, Human
agguagcaaugaaaagacu

SEQ ID NO: 277668 - RNA, 20 nt, Human
aggugucacccaagggcagc

SEQ ID NO: 277669 - RNA, 18 nt, Human
aguguccaucugucuugg

SEQ ID NO: 277670 - RNA, 19 nt, Human
auuacaaaucccacuggac

SEQ ID NO: 277671 - RNA, 24 nt, Human
cacacacacgcacucacagcugca

SEQ ID NO: 277672 - RNA, 23 nt, Human
cacacacgcacucacagcugcag

SEQ ID NO: 277673 - RNA, 21 nt, Human
cacagccauagagcucugucc

SEQ ID NO: 277674 - RNA, 21 nt, Human
cacagggaaauuccuugugcu

SEQ ID NO: 277675 - RNA, 22 nt, Human
cacuacaaaaacacaggaaaag

SEQ ID NO: 277676 - RNA, 24 nt, Human
cacuacaaaaacacaggaaaaggg

SEQ ID NO: 277677 - RNA, 25 nt, Human
cacucccuacagacugaacuggggg

SEQ ID NO: 277678 - RNA, 18 nt, Human
cacucuucagccucaacc

SEQ ID NO: 277679 - RNA, 19 nt, Human
cacuggacagaaaguugac

SEQ ID NO: 277680 - RNA, 22 nt, Human
cacuuggcuugcaggcugaggc

SEQ ID NO: 277681 - RNA, 23 nt, Human
cagacugaacugggggugggggg

SEQ ID NO: 277682 - RNA, 18 nt, Human
cagcaguggggacuggga

SEQ ID NO: 277683 - RNA, 19 nt, Human
cagcaguggggacugggac

SEQ ID NO: 277684 - RNA, 25 nt, Human
cagcaguggggacugggacccacag

SEQ ID NO: 277685 - RNA, 19 nt, Human
caguaaagcaggggcaugg

SEQ ID NO: 277686 - RNA, 19 nt, Human
cauagaccccagauggccu

SEQ ID NO: 277687 - RNA, 18 nt, Human
ccacaaagcagcucggaa

SEQ ID NO: 277688 - RNA, 23 nt, Human
ccacaaagcagcucggaagagga

SEQ ID NO: 277689 - RNA, 21 nt, Human
ccaccacuuugaucucagaac

SEQ ID NO: 277690 - RNA, 20 nt, Human
ccagugcccgccaucacagc

SEQ ID NO: 277691 - RNA, 19 nt, Human
cccaagggaugagaaagac

SEQ ID NO: 277692 - RNA, 22 nt, Human
cccacagccauagagcucuguc

SEQ ID NO: 277693 - RNA, 24 nt, Human
cccagaccacagggccuuuuaaaa

SEQ ID NO: 277694 - RNA, 26 nt, Human
ccccugagaaacacagaucagaaggc

SEQ ID NO: 277695 - RNA, 21 nt, Human
ccgggaguggcggcucagagg

SEQ ID NO: 277696 - RNA, 27 nt, Human
ccuacagacugaacugggggugggggg

SEQ ID NO: 277697 - RNA, 20 nt, Human
ccucacucuucagccucaac

SEQ ID NO: 277698 - RNA, 21 nt, Human
ccuggagcccacaaagcagcu

SEQ ID NO: 277699 - RNA, 23 nt, Human
ccuuccacaccuugacacuuuag

SEQ ID NO: 277700 - RNA, 20 nt, Human
cggaggugucacccaagggc

SEQ ID NO: 277701 - RNA, 21 nt, Human
cggugcaaaggaucgaucaag

SEQ ID NO: 277702 - RNA, 19 nt, Human
cuagcagcaggugcuccca

SEQ ID NO: 277703 - RNA, 23 nt, Human
cuauccaauuugcacuucccaag

SEQ ID NO: 277704 - RNA, 20 nt, Human
cuccccagaccacagggccu

SEQ ID NO: 277705 - RNA, 22 nt, Human
cucggaggugucacccaagggc

SEQ ID NO: 277706 - RNA, 19 nt, Human
cucugggucuggcugccuc

SEQ ID NO: 277707 - RNA, 22 nt, Human
cugcaguuugugcccuugcucc

SEQ ID NO: 277708 - RNA, 21 nt, Human
cugggauugccaaaaaaugac

SEQ ID NO: 277709 - RNA, 21 nt, Human
cuuacauuuauuuauugacuu

SEQ ID NO: 277710 - RNA, 21 nt, Human
cuucacucccuacagacugaa

SEQ ID NO: 277711 - RNA, 30 nt, Human
cuucagccucaaccuucuuauucccuagcc

SEQ ID NO: 277712 - RNA, 25 nt, Human
cuuccuccuuuguugaaaccaccuc

SEQ ID NO: 277713 - RNA, 18 nt, Human
cuuggguacccagugccc

SEQ ID NO: 277714 - RNA, 23 nt, Human
cuuuugucacuuaucauuucucc

SEQ ID NO: 277715 - RNA, 18 nt, Human
gaacacuuggcuugcagg

SEQ ID NO: 277716 - RNA, 20 nt, Human
gaagaggaggggaacgagug

SEQ ID NO: 277717 - RNA, 18 nt, Human
gaauucccuagggagaca

SEQ ID NO: 277718 - RNA, 20 nt, Human
gaccccaccacuuugaucuc

SEQ ID NO: 277719 - RNA, 21 nt, Human
gacuugaggcugggauuuccu

SEQ ID NO: 277720 - RNA, 20 nt, Human
gagagggagagggagaccac

SEQ ID NO: 277721 - RNA, 19 nt, Human
gagcucuguccuuuuucca

SEQ ID NO: 277722 - RNA, 19 nt, Human
gagggugggaaagcuggaa

SEQ ID NO: 277723 - RNA, 18 nt, Human
gauauuggaaaggaaaag

SEQ ID NO: 277724 - RNA, 24 nt, Human
gcaacaguaaagcaggggcauggg

SEQ ID NO: 277725 - RNA, 19 nt, Human
gcaaugaaaagacucagga

SEQ ID NO: 277726 - RNA, 18 nt, Human
gcggcuccauugccccuc

SEQ ID NO: 277727 - RNA, 21 nt, Human
gcucugggucuggcugccucu

SEQ ID NO: 277728 - RNA, 18 nt, Human
gcugcaguuugugcccuu

SEQ ID NO: 277729 - RNA, 23 nt, Human
gcugcuuuugucacuuaucauuu

SEQ ID NO: 277730 - RNA, 22 nt, Human
gcuugccuugcuguuuucaacc

SEQ ID NO: 277731 - RNA, 24 nt, Human
ggaaagggcaaccuugccucucug

SEQ ID NO: 277732 - RNA, 19 nt, Human
ggaauucccuagggagaca

SEQ ID NO: 277733 - RNA, 19 nt, Human
ggacagaaaguugacuugg

SEQ ID NO: 277734 - RNA, 23 nt, Human
ggcaaacaaguacaagccucugg

SEQ ID NO: 277735 - RNA, 19 nt, Human
ggcaaccuugccucucuga

SEQ ID NO: 277736 - RNA, 21 nt, Human
gggaaccuucacuuggguacc

SEQ ID NO: 277737 - RNA, 18 nt, Human
gggaagugggagacagga

SEQ ID NO: 277738 - RNA, 26 nt, Human
ggguaggaggacagcauggggcuaua

SEQ ID NO: 277739 - RNA, 22 nt, Human
guggcaaacagaccuaccuaca

SEQ ID NO: 277740 - RNA, 22 nt, Human
uaaaaggcaaacaaguacaagc

SEQ ID NO: 277741 - RNA, 19 nt, Human
uaccaaggagccgcugccu

SEQ ID NO: 277742 - RNA, 23 nt, Human
uaccacuaggggcaacauuaauu

SEQ ID NO: 277743 - RNA, 19 nt, Human
uacccagugcccgccauca

SEQ ID NO: 277744 - RNA, 23 nt, Human
uagcuuauucucuugcuuuucuc

SEQ ID NO: 277745 - RNA, 23 nt, Human
uauaaacucugugagcucaggau

SEQ ID NO: 277746 - RNA, 21 nt, Human
ucaaccaagcgcagaauguaa

SEQ ID NO: 277747 - RNA, 20 nt, Human
ucaaguggcaaacagaccua

SEQ ID NO: 277748 - RNA, 23 nt, Human
ucacacacacgcacucacagcug

SEQ ID NO: 277749 - RNA, 19 nt, Human
ucacucccuacagacugaa

SEQ ID NO: 277750 - RNA, 23 nt, Human
ucauagguuaugauuuccccgga

SEQ ID NO: 277751 - RNA, 23 nt, Human
uccacaugggauucugcuagggc

SEQ ID NO: 277752 - RNA, 21 nt, Human
uccagucacauuucugauuau

SEQ ID NO: 277753 - RNA, 18 nt, Human
uccccugggguccacuuu

SEQ ID NO: 277754 - RNA, 21 nt, Human
uccugaggaaugcuagccagc

SEQ ID NO: 277755 - RNA, 18 nt, Human
uccuugugcugcuuuugu

SEQ ID NO: 277756 - RNA, 21 nt, Human
ucggaagaggaggggaacgag

SEQ ID NO: 277757 - RNA, 18 nt, Human
ucucauuauguucucccu

SEQ ID NO: 277758 - RNA, 20 nt, Human
ucuccacguaagagucugug

SEQ ID NO: 277759 - RNA, 19 nt, Human
ucucucaccuauauuucag

SEQ ID NO: 277760 - RNA, 19 nt, Human
ucucugaugguccugaccu

SEQ ID NO: 277761 - RNA, 25 nt, Human
ucugggguaggaggacagcaugggg

SEQ ID NO: 277762 - RNA, 21 nt, Human
ucuucagccucaaccuucuua

SEQ ID NO: 277763 - RNA, 25 nt, Human
ucuucagccucaaccuucuuauucc

SEQ ID NO: 277764 - RNA, 21 nt, Human
ugaaaagacucaggaagcgaa

SEQ ID NO: 277765 - RNA, 24 nt, Human
ugaacacuuggcuugcaggcugag

SEQ ID NO: 277766 - RNA, 22 nt, Human
ugaacagaaucaacaaaagccg

SEQ ID NO: 277767 - RNA, 19 nt, Human
ugaacuggggguggggggc

SEQ ID NO: 277768 - RNA, 20 nt, Human
ugaagaguccucacucuuca

SEQ ID NO: 277769 - RNA, 23 nt, Human
ugacuugggccuuaggcagggag

SEQ ID NO: 277770 - RNA, 24 nt, Human
ugagaaaagccagaauaucuaagu

SEQ ID NO: 277771 - RNA, 18 nt, Human
ugagaaacacagaucaga

SEQ ID NO: 277772 - RNA, 24 nt, Human
ugaguacaggccuggagcccacaa

SEQ ID NO: 277773 - RNA, 24 nt, Human
ugagucaaugcuguauaccccaca

SEQ ID NO: 277774 - RNA, 19 nt, Human
ugauugucagcguagccuu

SEQ ID NO: 277775 - RNA, 19 nt, Human
ugauuugacauuaaaccca

SEQ ID NO: 277776 - RNA, 19 nt, Human
ugcagguccccugagaaac

SEQ ID NO: 277777 - RNA, 24 nt, Human
ugcuccuaccuaaaaggcaaacaa

SEQ ID NO: 277778 - RNA, 23 nt, Human
ugcuuuguuuauaaagaugcuuu

SEQ ID NO: 277779 - RNA, 28 nt, Human
uggacagaaaguugacuugggccuuagg

SEQ ID NO: 277780 - RNA, 18 nt, Human
uggauuacaaaucccacu

SEQ ID NO: 277781 - RNA, 18 nt, Human
uggccucagggggcugcc

SEQ ID NO: 277782 - RNA, 21 nt, Human
ugggaucugagggauuucucc

SEQ ID NO: 277783 - RNA, 21 nt, Human
ugggauucugcuagggcuagg

SEQ ID NO: 277784 - RNA, 22 nt, Human
ugggauugccaaaaaaugacca

SEQ ID NO: 277785 - RNA, 23 nt, Human
ugggauuuccuagggguugacau

SEQ ID NO: 277786 - RNA, 22 nt, Human
ugggcauagaccccagauggcc

SEQ ID NO: 277787 - RNA, 20 nt, Human
uggggguggggggcacccau

SEQ ID NO: 277788 - RNA, 24 nt, Human
ugggguaggaggacagcauggggc

SEQ ID NO: 277789 - RNA, 19 nt, Human
ugucacuuaucauuucucc

SEQ ID NO: 277790 - RNA, 24 nt, Human
ugugaaaaugcaaaaaaauuuuua

SEQ ID NO: 277791 - RNA, 25 nt, Human
uguguacacagaaauauaaggugca

SEQ ID NO: 277792 - RNA, 18 nt, Human
uuacacagcucacugcug

SEQ ID NO: 277793 - RNA, 25 nt, Human
uuagcuuauucucuugcuuuucuca

SEQ ID NO: 277794 - RNA, 27 nt, Human
uuccagccccaggaacaaacccaggcc

SEQ ID NO: 277795 - RNA, 22 nt, Human
uuccugaggaaugcuagccagc

SEQ ID NO: 277796 - RNA, 18 nt, Human
uucucauuauguucuccc

SEQ ID NO: 277797 - RNA, 19 nt, Human
uucuuagguguggaaugcc

SEQ ID NO: 277798 - RNA, 20 nt, Human
uugucucucaccuauauuuc

SEQ ID NO: 277799 - RNA, 18 nt, Human
uuguuuuguuuuuaauug

SEQ ID NO: 277800 - RNA, 28 nt, Human
uuucccaaaacuaguucuucccuugccg

SEQ ID NO: 277801 - RNA, 21 nt, Human
uuucucacugugaacacuugg

SEQ ID NO: 277802 - RNA, 19 nt, Human
uuuuuacucacaaguggcu

SEQ ID NO: 277803 - RNA, 21 nt, Human
uuuuuuaacuauaaacucugu

SEQ ID NO: 277804 - RNA, 22 nt, Human
uuuuuuaacuauaaacucugug

SEQ ID NO: 277805 - RNA, 21 nt, Human
aacagauaaggagaaaccaga

SEQ ID NO: 277806 - RNA, 19 nt, Human
aagcggccucgaagcgggu

SEQ ID NO: 277807 - RNA, 19 nt, Human
acgccgaggugggagcggc

SEQ ID NO: 277808 - RNA, 24 nt, Human
ccggcgcggagggcagggcgcggg

SEQ ID NO: 277809 - RNA, 23 nt, Human
ccuacuagucuuuuaauugcuau

SEQ ID NO: 277810 - RNA, 20 nt, Human
cgccgaggugggagcggcga

SEQ ID NO: 277811 - RNA, 23 nt, Human
cuguguacguguuaccucaggau

SEQ ID NO: 277812 - RNA, 26 nt, Human
cuuuuaauugcuauugucugggauua

SEQ ID NO: 277813 - RNA, 24 nt, Human
gaaauauuugcacauaccaaaaua

SEQ ID NO: 277814 - RNA, 24 nt, Human
gcacauaccaaaauaccacuacuu

SEQ ID NO: 277815 - RNA, 19 nt, Human
gcgccaaagcggccucgaa

SEQ ID NO: 277816 - RNA, 20 nt, Human
gcgcggagggcagggcgcgg

SEQ ID NO: 277817 - RNA, 20 nt, Human
ggagccgggggccgcgggcu

SEQ ID NO: 277818 - RNA, 19 nt, Human
uaaggagaaaccagacagg

SEQ ID NO: 277819 - RNA, 18 nt, Human
ucccgugucugcggcggg

SEQ ID NO: 277820 - RNA, 21 nt, Human
ucugggauuaacagauaagga

SEQ ID NO: 277821 - RNA, 20 nt, Human
ugaacgguccuggaaggauu

SEQ ID NO: 277822 - RNA, 20 nt, Human
uggaaggauucuguugcucc

SEQ ID NO: 277823 - RNA, 20 nt, Human
aaaaaagaagauagagaaaa

SEQ ID NO: 277824 - RNA, 23 nt, Human
aaaaagaagaagaaagaacaaaa

SEQ ID NO: 277825 - RNA, 25 nt, Human
aaaaagaagaagaaagaacaaaaga

SEQ ID NO: 277826 - RNA, 26 nt, Human
aaaaagaagaagaaagaacaaaagaa

SEQ ID NO: 277827 - RNA, 19 nt, Human
aaaaagaagauagagaaaa

SEQ ID NO: 277828 - RNA, 20 nt, Human
aaaaagaagauagagaaaaa

SEQ ID NO: 277829 - RNA, 18 nt, Human
aaaauaaaugcuccaaca

SEQ ID NO: 277830 - RNA, 21 nt, Human
aaagaaagagaaagaaaagaa

SEQ ID NO: 277831 - RNA, 18 nt, Human
aaagaacaaaagaaagag

SEQ ID NO: 277832 - RNA, 18 nt, Human
aagaaagaacaaaagaaa

SEQ ID NO: 277833 - RNA, 23 nt, Human
aagaaagaacaaaagaaagagaa

SEQ ID NO: 277834 - RNA, 20 nt, Human
aagaaagagaaagaaaagaa

SEQ ID NO: 277835 - RNA, 20 nt, Human
aagaacccuuuuagcauuca

SEQ ID NO: 277836 - RNA, 23 nt, Human
aagaagaagaaagaacaaaagaa

SEQ ID NO: 277837 - RNA, 22 nt, Human
aagcauccuuaaguuucuuccc

SEQ ID NO: 277838 - RNA, 26 nt, Human
acacuaccgcagucucagaggcagac

SEQ ID NO: 277839 - RNA, 20 nt, Human
agaaaaaagaagauagagaa

SEQ ID NO: 277840 - RNA, 21 nt, Human
agaaaaagcaaaucacauggc

SEQ ID NO: 277841 - RNA, 22 nt, Human
agaaaaagcaaaucacauggca

SEQ ID NO: 277842 - RNA, 25 nt, Human
agaaaagaaaaaagaagauagagaa

SEQ ID NO: 277843 - RNA, 19 nt, Human
agaaagaaaagaaaaaaga

SEQ ID NO: 277844 - RNA, 23 nt, Human
agaagaagaaagaacaaaagaaa

SEQ ID NO: 277845 - RNA, 26 nt, Human
agaagaagaaagaacaaaagaaagag

SEQ ID NO: 277846 - RNA, 18 nt, Human
agagauggacaggaagac

SEQ ID NO: 277847 - RNA, 21 nt, Human
agcugcugggaaugcugcuug

SEQ ID NO: 277848 - RNA, 23 nt, Human
aggaaagaaggaaaacacuaccg

SEQ ID NO: 277849 - RNA, 23 nt, Human
aggaagaaggaagaacagcaaga

SEQ ID NO: 277850 - RNA, 22 nt, Human
agggaagaggcggccagguccg

SEQ ID NO: 277851 - RNA, 24 nt, Human
augaguacaaccuuuuaacuucac

SEQ ID NO: 277852 - RNA, 24 nt, Human
auucaaggcuuuacuagaaaccag

SEQ ID NO: 277853 - RNA, 23 nt, Human
caaaagaaagagaaagaaaagaa

SEQ ID NO: 277854 - RNA, 21 nt, Human
caaacuuuguaugcuaaaaag

SEQ ID NO: 277855 - RNA, 23 nt, Human
caagcgcagagugggaaaacuag

SEQ ID NO: 277856 - RNA, 20 nt, Human
caccccucuccuucccaccc

SEQ ID NO: 277857 - RNA, 18 nt, Human
ccaaggaaagaaggaaaa

SEQ ID NO: 277858 - RNA, 20 nt, Human
ccagggcauggcagcaguga

SEQ ID NO: 277859 - RNA, 24 nt, Human
cccccacugccuuugguuucagca

SEQ ID NO: 277860 - RNA, 22 nt, Human
ccccucuccuucccacccgccc

SEQ ID NO: 277861 - RNA, 22 nt, Human
cccggccggcagcgcccgccuc

SEQ ID NO: 277862 - RNA, 19 nt, Human
cccggggcggagcgguugg

SEQ ID NO: 277863 - RNA, 22 nt, Human
cccuccagccugcaaggcuccc

SEQ ID NO: 277864 - RNA, 18 nt, Human
ccgccgcucuccagccgc

SEQ ID NO: 277865 - RNA, 19 nt, Human
ccgccgcucuccagccgcc

SEQ ID NO: 277866 - RNA, 20 nt, Human
ccgccgcucuccagccgccc

SEQ ID NO: 277867 - RNA, 21 nt, Human
ccgccgcucuccagccgcccu

SEQ ID NO: 277868 - RNA, 24 nt, Human
ccgccucgccgccggcgccgccgc

SEQ ID NO: 277869 - RNA, 26 nt, Human
ccgccucgccgccggcgccgccgcuc

SEQ ID NO: 277870 - RNA, 27 nt, Human
ccgccucgccgccggcgccgccgcucu

SEQ ID NO: 277871 - RNA, 27 nt, Human
ccuaugguauuaaaaaagaagaagaaa

SEQ ID NO: 277872 - RNA, 21 nt, Human
ccuggucagggcggcagguca

SEQ ID NO: 277873 - RNA, 26 nt, Human
ccuguggcaacccccaguuugccccc

SEQ ID NO: 277874 - RNA, 23 nt, Human
cgagggaagaggcggccaggucc

SEQ ID NO: 277875 - RNA, 21 nt, Human
cgccucgccgccggcgccgcc

SEQ ID NO: 277876 - RNA, 21 nt, Human
cgcucagaauucguccaacag

SEQ ID NO: 277877 - RNA, 22 nt, Human
cggcaggucauagcuacugggg

SEQ ID NO: 277878 - RNA, 24 nt, Human
cguccauauucguuuccugucugg

SEQ ID NO: 277879 - RNA, 21 nt, Human
cugccggaacccaagcgcaga

SEQ ID NO: 277880 - RNA, 19 nt, Human
cuggccuaugguauuaaaa

SEQ ID NO: 277881 - RNA, 20 nt, Human
cuguugcaccccucuccuuc

SEQ ID NO: 277882 - RNA, 22 nt, Human
cuugaaguuccuucugcaauua

SEQ ID NO: 277883 - RNA, 19 nt, Human
cuugcaaaaccgcagcugc

SEQ ID NO: 277884 - RNA, 20 nt, Human
gaaaagaaaaaagaagauag

SEQ ID NO: 277885 - RNA, 22 nt, Human
gaagaaggaagaacagcaagag

SEQ ID NO: 277886 - RNA, 20 nt, Human
gaagauagagaaaaagcaaa

SEQ ID NO: 277887 - RNA, 18 nt, Human
gacauguuauccaaccug

SEQ ID NO: 277888 - RNA, 18 nt, Human
gacggugugugugugugu

SEQ ID NO: 277889 - RNA, 25 nt, Human
gauggacaggaagacugaggaagaa

SEQ ID NO: 277890 - RNA, 23 nt, Human
gcagcggcgaaggguccccgaag

SEQ ID NO: 277891 - RNA, 24 nt, Human
gcaugcagagugugggcaaucucu

SEQ ID NO: 277892 - RNA, 19 nt, Human
gccugucgcugcgggcugg

SEQ ID NO: 277893 - RNA, 18 nt, Human
gcggcgaaggguccccga

SEQ ID NO: 277894 - RNA, 18 nt, Human
ggaaaacacuaccgcagu

SEQ ID NO: 277895 - RNA, 23 nt, Human
ggaagaaggaagaacagcaagag

SEQ ID NO: 277896 - RNA, 21 nt, Human
ggagacacgaaaauggccuuc

SEQ ID NO: 277897 - RNA, 21 nt, Human
ggcgggacaggugggugucag

SEQ ID NO: 277898 - RNA, 20 nt, Human
gguaagaggcagaauggcac

SEQ ID NO: 277899 - RNA, 21 nt, Human
ggugugugugugugugugugu

SEQ ID NO: 277900 - RNA, 23 nt, Human
guaaauacaaugaguacaaccuu

SEQ ID NO: 277901 - RNA, 33 nt, Human
guguaggacgguguguguguguguguguguggu

SEQ ID NO: 277902 - RNA, 21 nt, Human
gugugugugugugugugugag

SEQ ID NO: 277903 - RNA, 20 nt, Human
gugugugugugugugugugu

SEQ ID NO: 277904 - RNA, 21 nt, Human
gugugugugugugugugugug

SEQ ID NO: 277905 - RNA, 21 nt, Human
gugugugugugugugugugug

SEQ ID NO: 277906 - RNA, 21 nt, Human
gugugugugugugugugugug

SEQ ID NO: 277907 - RNA, 29 nt, Human
guguguguguguguucauucaaggcuuua

SEQ ID NO: 277908 - RNA, 24 nt, Human
uaaaaaagaagaagaaagaacaaa

SEQ ID NO: 277909 - RNA, 22 nt, Human
uaacguaguuuugaaggccgca

SEQ ID NO: 277910 - RNA, 19 nt, Human
uaacucaguucugaaggcc

SEQ ID NO: 277911 - RNA, 18 nt, Human
uaaguauagagucauacc

SEQ ID NO: 277912 - RNA, 19 nt, Human
uacagcagcuauuuaaaaa

SEQ ID NO: 277913 - RNA, 24 nt, Human
uaugcuaaaaaggaagagaaagca

SEQ ID NO: 277914 - RNA, 23 nt, Human
ucacucaucuccacuuuauuugg

SEQ ID NO: 277915 - RNA, 23 nt, Human
ucacuuuguacaagaaaaguuuu

SEQ ID NO: 277916 - RNA, 20 nt, Human
ucagcuuuugaucguucagc

SEQ ID NO: 277917 - RNA, 23 nt, Human
ucccacccgcccuauccugguca

SEQ ID NO: 277918 - RNA, 20 nt, Human
ucccagggcauggcagcagu

SEQ ID NO: 277919 - RNA, 19 nt, Human
ucccucuacauaggcaugc

SEQ ID NO: 277920 - RNA, 21 nt, Human
uccuuugacaagguugccugg

SEQ ID NO: 277921 - RNA, 22 nt, Human
ucuccauggguugaaguucauc

SEQ ID NO: 277922 - RNA, 26 nt, Human
ucugauacugucccauccugaaaagu

SEQ ID NO: 277923 - RNA, 21 nt, Human
ugaaagacagagauggagaca

SEQ ID NO: 277924 - RNA, 22 nt, Human
ugaaguccuggugagaaucuca

SEQ ID NO: 277925 - RNA, 20 nt, Human
ugagaaucucauuuugucca

SEQ ID NO: 277926 - RNA, 22 nt, Human
ugcccgagucccggccggcagc

SEQ ID NO: 277927 - RNA, 20 nt, Human
ugccggaacccaagcgcaga

SEQ ID NO: 277928 - RNA, 18 nt, Human
ugcuguuuuuauucaucc

SEQ ID NO: 277929 - RNA, 22 nt, Human
uggacagacagauggagagaug

SEQ ID NO: 277930 - RNA, 21 nt, Human
ugggcgggacagguggguguc

SEQ ID NO: 277931 - RNA, 24 nt, Human
uguaggacggugugugugugugug

SEQ ID NO: 277932 - RNA, 18 nt, Human
ugucccggggcggagcgg

SEQ ID NO: 277933 - RNA, 18 nt, Human
ugugugugugugugugug

SEQ ID NO: 277934 - RNA, 18 nt, Human
ugugugugugugugugug

SEQ ID NO: 277935 - RNA, 18 nt, Human
ugugugugugugugugug

SEQ ID NO: 277936 - RNA, 18 nt, Human
ugugugugugugugugug

SEQ ID NO: 277937 - RNA, 18 nt, Human
ugugugugugugugugug

SEQ ID NO: 277938 - RNA, 18 nt, Human
ugugugugugugugugug

SEQ ID NO: 277939 - RNA, 18 nt, Human
ugugugugugugugugug

SEQ ID NO: 277940 - RNA, 18 nt, Human
ugugugugugugugugug

SEQ ID NO: 277941 - RNA, 18 nt, Human
ugugugugugugugugug

SEQ ID NO: 277942 - RNA, 18 nt, Human
ugugugugugugugugug

SEQ ID NO: 277943 - RNA, 18 nt, Human
ugugugugugugugugug

SEQ ID NO: 277944 - RNA, 18 nt, Human
ugugugugugugugugug

SEQ ID NO: 277945 - RNA, 18 nt, Human
ugugugugugugugugug

SEQ ID NO: 277946 - RNA, 18 nt, Human
ugugugugugugugugug

SEQ ID NO: 277947 - RNA, 18 nt, Human
ugugugugugugugugug

SEQ ID NO: 277948 - RNA, 18 nt, Human
ugugugugugugugugug

SEQ ID NO: 277949 - RNA, 18 nt, Human
ugugugugugugugugug

SEQ ID NO: 277950 - RNA, 21 nt, Human
ugugugugugugugugugugu

SEQ ID NO: 277951 - RNA, 21 nt, Human
ugugugugugugugugugugu

SEQ ID NO: 277952 - RNA, 21 nt, Human
ugugugugugugugugugugu

SEQ ID NO: 277953 - RNA, 21 nt, Human
ugugugugugugugugugugu

SEQ ID NO: 277954 - RNA, 21 nt, Human
ugugugugugugugugugugu

SEQ ID NO: 277955 - RNA, 21 nt, Human
ugugugugugugugugugugu

SEQ ID NO: 277956 - RNA, 21 nt, Human
ugugugugugugugugugugu

SEQ ID NO: 277957 - RNA, 21 nt, Human
ugugugugugugugugugugu

SEQ ID NO: 277958 - RNA, 21 nt, Human
ugugugugugugugugugugu

SEQ ID NO: 277959 - RNA, 21 nt, Human
ugugugugugugugugugugu

SEQ ID NO: 277960 - RNA, 21 nt, Human
ugugugugugugugugugugu

SEQ ID NO: 277961 - RNA, 21 nt, Human
ugugugugugugugugugugu

SEQ ID NO: 277962 - RNA, 21 nt, Human
ugugugugugugugugugugu

SEQ ID NO: 277963 - RNA, 21 nt, Human
ugugugugugugugugugugu

SEQ ID NO: 277964 - RNA, 21 nt, Human
ugugugugugugugugugugu

SEQ ID NO: 277965 - RNA, 21 nt, Human
ugugugugugugugugugugu

SEQ ID NO: 277966 - RNA, 21 nt, Human
ugugugugugugugugugugu

SEQ ID NO: 277967 - RNA, 21 nt, Human
ugugugugugugugugugugu

SEQ ID NO: 277968 - RNA, 21 nt, Human
ugugugugugugugugugugu

SEQ ID NO: 277969 - RNA, 21 nt, Human
ugugugugugugugugugugu

SEQ ID NO: 277970 - RNA, 21 nt, Human
ugugugugugugugugugugu

SEQ ID NO: 277971 - RNA, 21 nt, Human
ugugugugugugugugugugu

SEQ ID NO: 277972 - RNA, 21 nt, Human
ugugugugugugugugugugu

SEQ ID NO: 277973 - RNA, 21 nt, Human
ugugugugugugugugugugu

SEQ ID NO: 277974 - RNA, 21 nt, Human
ugugugugugugugugugugu

SEQ ID NO: 277975 - RNA, 21 nt, Human
ugugugugugugugugugugu

SEQ ID NO: 277976 - RNA, 21 nt, Human
ugugugugugugugugugugu

SEQ ID NO: 277977 - RNA, 21 nt, Human
ugugugugugugugugugugu

SEQ ID NO: 277978 - RNA, 21 nt, Human
ugugugugugugugugugugu

SEQ ID NO: 277979 - RNA, 21 nt, Human
ugugugugugugugugugugu

SEQ ID NO: 277980 - RNA, 21 nt, Human
ugugugugugugugugugugu

SEQ ID NO: 277981 - RNA, 21 nt, Human
ugugugugugugugugugugu

SEQ ID NO: 277982 - RNA, 22 nt, Human
ugugugugugugugugugugug

SEQ ID NO: 277983 - RNA, 22 nt, Human
ugugugugugugugugugugug

SEQ ID NO: 277984 - RNA, 22 nt, Human
ugugugugugugugugugugug

SEQ ID NO: 277985 - RNA, 22 nt, Human
ugugugugugugugugugugug

SEQ ID NO: 277986 - RNA, 22 nt, Human
ugugugugugugugugugugug

SEQ ID NO: 277987 - RNA, 22 nt, Human
ugugugugugugugugugugug

SEQ ID NO: 277988 - RNA, 22 nt, Human
ugugugugugugugugugugug

SEQ ID NO: 277989 - RNA, 22 nt, Human
ugugugugugugugugugugug

SEQ ID NO: 277990 - RNA, 22 nt, Human
ugugugugugugugugugugug

SEQ ID NO: 277991 - RNA, 22 nt, Human
ugugugugugugugugugugug

SEQ ID NO: 277992 - RNA, 22 nt, Human
ugugugugugugugugugugug

SEQ ID NO: 277993 - RNA, 22 nt, Human
ugugugugugugugugugugug

SEQ ID NO: 277994 - RNA, 23 nt, Human
uguugaaagacagagauggagac

SEQ ID NO: 277995 - RNA, 30 nt, Human
uuccccauuccugucacucagucuucgauu

SEQ ID NO: 277996 - RNA, 20 nt, Human
uuccucagugcuaguaccua

SEQ ID NO: 277997 - RNA, 23 nt, Human
uugcaccccucuccuucccaccc

SEQ ID NO: 277998 - RNA, 23 nt, Human
uuucacuuauuaacucaguucug

SEQ ID NO: 277999 - RNA, 20 nt, Human
uuuuauucauccucccuuga

SEQ ID NO: 278000 - RNA, 21 nt, Human
uuuuccucagugcuaguaccu

SEQ ID NO: 278001 - RNA, 20 nt, Human
aaagaucagaacuccaugga

SEQ ID NO: 278002 - RNA, 22 nt, Human
aaagucccucccaauucugcuu

SEQ ID NO: 278003 - RNA, 25 nt, Human
aaccuguuauaccuucaaagugggc

SEQ ID NO: 278004 - RNA, 19 nt, Human
aacuccuagagucucccuu

SEQ ID NO: 278005 - RNA, 23 nt, Human
acccauuucaacuccuagagucu

SEQ ID NO: 278006 - RNA, 20 nt, Human
agaaagguuagaggucaggg

SEQ ID NO: 278007 - RNA, 19 nt, Human
agaugagugggugggcgca

SEQ ID NO: 278008 - RNA, 19 nt, Human
agcuccucuucccucauuc

SEQ ID NO: 278009 - RNA, 20 nt, Human
aggcagagaaagguuagagg

SEQ ID NO: 278010 - RNA, 21 nt, Human
agugggugggcgcaugcucag

SEQ ID NO: 278011 - RNA, 22 nt, Human
caacauaucaugcuugccccuc

SEQ ID NO: 278012 - RNA, 18 nt, Human
caacuccuagagucuccc

SEQ ID NO: 278013 - RNA, 23 nt, Human
caaguccagcccugucuccacaa

SEQ ID NO: 278014 - RNA, 19 nt, Human
caccgggucugacccauuu

SEQ ID NO: 278015 - RNA, 19 nt, Human
caggagcugccccaagguc

SEQ ID NO: 278016 - RNA, 19 nt, Human
caucuugguccccacuccc

SEQ ID NO: 278017 - RNA, 24 nt, Human
caucuugguccccacucccggggc

SEQ ID NO: 278018 - RNA, 19 nt, Human
ccacucccggggccuggca

SEQ ID NO: 278019 - RNA, 19 nt, Human
ccccucucucccuuugcaa

SEQ ID NO: 278020 - RNA, 19 nt, Human
cccucugcucggaaaccug

SEQ ID NO: 278021 - RNA, 18 nt, Human
ccugcaguagcugcccuc

SEQ ID NO: 278022 - RNA, 18 nt, Human
ccugcaguagcugcccuc

SEQ ID NO: 278023 - RNA, 23 nt, Human
ccugcaguagcugcccucugccu

SEQ ID NO: 278024 - RNA, 23 nt, Human
cuagagucucccuucugcuuccc

SEQ ID NO: 278025 - RNA, 21 nt, Human
cuggacccauggccaugccag

SEQ ID NO: 278026 - RNA, 20 nt, Human
cuuuuagacuucuucuuccu

SEQ ID NO: 278027 - RNA, 24 nt, Human
gagugugggagaggcagagaaagg

SEQ ID NO: 278028 - RNA, 21 nt, Human
guggccuuuggcuggcauuca

SEQ ID NO: 278029 - RNA, 18 nt, Human
guugcugagccuggccca

SEQ ID NO: 278030 - RNA, 21 nt, Human
uagagucucccuucugcuucc

SEQ ID NO: 278031 - RNA, 21 nt, Human
uagggcaguuuuugucuucag

SEQ ID NO: 278032 - RNA, 18 nt, Human
ucaguaccuggcuagggc

SEQ ID NO: 278033 - RNA, 19 nt, Human
uccccuggccaugcccaaa

SEQ ID NO: 278034 - RNA, 25 nt, Human
ucccucauuccuuaccuucacccaa

SEQ ID NO: 278035 - RNA, 20 nt, Human
ucucuagaaggcaguagcuu

SEQ ID NO: 278036 - RNA, 22 nt, Human
ucucucugugccccugucuccc

SEQ ID NO: 278037 - RNA, 19 nt, Human
ucugaacucaggagcugcc

SEQ ID NO: 278038 - RNA, 23 nt, Human
ugaacugagacccuugugcuguc

SEQ ID NO: 278039 - RNA, 19 nt, Human
ugaggucacugccgguugu

SEQ ID NO: 278040 - RNA, 21 nt, Human
ugcccaaagaucagaacucca

SEQ ID NO: 278041 - RNA, 24 nt, Human
uggcaggaaccuguuauaccuucc

SEQ ID NO: 278042 - RNA, 20 nt, Human
ugggacaccauagauguugg

SEQ ID NO: 278043 - RNA, 21 nt, Human
ugucugaacucaggagcugcc

SEQ ID NO: 278044 - RNA, 21 nt, Human
uucugcuuuauguuucccaug

SEQ ID NO: 278045 - RNA, 21 nt, Human
uuggcuggcauucaaaguccu

SEQ ID NO: 278046 - RNA, 22 nt, Human
uuucuggcuuauucuccccauu

SEQ ID NO: 278047 - RNA, 19 nt, Human
ccgggaggggaggggaagg

SEQ ID NO: 278048 - RNA, 19 nt, Human
cgggagggcgccccgggug

SEQ ID NO: 278049 - RNA, 18 nt, Human
cucccccuucuuauuuua

SEQ ID NO: 278050 - RNA, 21 nt, Human
gaaggggacaggagagcgagu

SEQ ID NO: 278051 - RNA, 22 nt, Human
gaggggaaggggacaggagagc

SEQ ID NO: 278052 - RNA, 19 nt, Human
gcaaacuuguaacauccuu

SEQ ID NO: 278053 - RNA, 19 nt, Human
gcggcggcggcuccccggg

SEQ ID NO: 278054 - RNA, 19 nt, Human
gcggcggcggggcggcggc

SEQ ID NO: 278055 - RNA, 22 nt, Human
gcggcggcggggcggcggcggc

SEQ ID NO: 278056 - RNA, 22 nt, Human
gcucagcuuuguugguuucggg

SEQ ID NO: 278057 - RNA, 23 nt, Human
gcucgggggcugguugguugagg

SEQ ID NO: 278058 - RNA, 23 nt, Human
ggaggggaggggaaggggacagg

SEQ ID NO: 278059 - RNA, 19 nt, Human
ggcggcggcggcuccccgg

SEQ ID NO: 278060 - RNA, 18 nt, Human
ggcuccggcgcgccgccu

SEQ ID NO: 278061 - RNA, 18 nt, Human
gggaggggaaggggacag

SEQ ID NO: 278062 - RNA, 23 nt, Human
gggcggcggcggggcggcggcgg

SEQ ID NO: 278063 - RNA, 23 nt, Human
gucuuuugccuuuucuuucucug

SEQ ID NO: 278064 - RNA, 19 nt, Human
guuuuuccuuuuuuguuuu

SEQ ID NO: 278065 - RNA, 24 nt, Human
guuuuuccuuuuuuguuuuugcuu

SEQ ID NO: 278066 - RNA, 21 nt, Human
uccggcgcgccgccuuuugug

SEQ ID NO: 278067 - RNA, 23 nt, Human
ucuggcccgguguguuuguuuug

SEQ ID NO: 278068 - RNA, 19 nt, Human
ugugugcgagggugcaaga

SEQ ID NO: 278069 - RNA, 25 nt, Human
uguuucacucccccuucuuauuuua

SEQ ID NO: 278070 - RNA, 22 nt, Human
uugagguugguuaguuuuuccu

SEQ ID NO: 278071 - RNA, 19 nt, Human
uuuugcuuuugcaaaguuu

SEQ ID NO: 278072 - RNA, 20 nt, Human
aauagaagucugaggagaga

SEQ ID NO: 278073 - RNA, 24 nt, Human
aggccuuuguccaucaugccaggg

SEQ ID NO: 278074 - RNA, 20 nt, Human
aggggugcugaggaacaagg

SEQ ID NO: 278075 - RNA, 21 nt, Human
caccccucucggcccggggga

SEQ ID NO: 278076 - RNA, 18 nt, Human
cagggguccuggggagga

SEQ ID NO: 278077 - RNA, 21 nt, Human
ccccaccaucccacaaguuca

SEQ ID NO: 278078 - RNA, 22 nt, Human
ccccaccgcgcucuucccuccg

SEQ ID NO: 278079 - RNA, 26 nt, Human
ccccaccgcgcucuucccuccgggca

SEQ ID NO: 278080 - RNA, 18 nt, Human
cccgggaggccccucgag

SEQ ID NO: 278081 - RNA, 23 nt, Human
cccuccauccuggacagggguug

SEQ ID NO: 278082 - RNA, 20 nt, Human
cccuccgggcaccccucucg

SEQ ID NO: 278083 - RNA, 23 nt, Human
ccuccgggcaccccucucggccc

SEQ ID NO: 278084 - RNA, 19 nt, Human
ccucuggccgacgccaggc

SEQ ID NO: 278085 - RNA, 22 nt, Human
ccucuggccgacgccaggccuu

SEQ ID NO: 278086 - RNA, 25 nt, Human
ccugggccccgggaggccccucgag

SEQ ID NO: 278087 - RNA, 22 nt, Human
cgcucuucccuccgggcacccc

SEQ ID NO: 278088 - RNA, 18 nt, Human
cggcgcgcggggggcacg

SEQ ID NO: 278089 - RNA, 19 nt, Human
cgggggacccuacgcggcg

SEQ ID NO: 278090 - RNA, 20 nt, Human
cucagcauucccugucccuu

SEQ ID NO: 278091 - RNA, 22 nt, Human
cucucggcccgggggacccuac

SEQ ID NO: 278092 - RNA, 19 nt, Human
cuggaugaucagucucuuu

SEQ ID NO: 278093 - RNA, 23 nt, Human
gaggagagaagccagaguccugg

SEQ ID NO: 278094 - RNA, 19 nt, Human
gaggccccucgaggccuca

SEQ ID NO: 278095 - RNA, 18 nt, Human
gaggucugucugcaggcc

SEQ ID NO: 278096 - RNA, 19 nt, Human
gccacagcacacguggccc

SEQ ID NO: 278097 - RNA, 18 nt, Human
gcccacuggagcagcccc

SEQ ID NO: 278098 - RNA, 19 nt, Human
gcccgggggacccuacgcg

SEQ ID NO: 278099 - RNA, 20 nt, Human
gccggggcgcccccaccgcg

SEQ ID NO: 278100 - RNA, 22 nt, Human
ggacagggguccuggggaggau

SEQ ID NO: 278101 - RNA, 23 nt, Human
ggaggaugaggcugaggccugga

SEQ ID NO: 278102 - RNA, 18 nt, Human
gggggcacgggcugcacc

SEQ ID NO: 278103 - RNA, 21 nt, Human
ggguccuggggaggaugaggc

SEQ ID NO: 278104 - RNA, 18 nt, Human
uaggauuggacccuccau

SEQ ID NO: 278105 - RNA, 20 nt, Human
uccugggccccgggaggccc

SEQ ID NO: 278106 - RNA, 21 nt, Human
uccugggccccgggaggcccc

SEQ ID NO: 278107 - RNA, 24 nt, Human
ucugacauagguuacguguccaga

SEQ ID NO: 278108 - RNA, 19 nt, Human
ucugcaggccuggccacag

SEQ ID NO: 278109 - RNA, 23 nt, Human
ugaggucugucugcaggccuggc

SEQ ID NO: 278110 - RNA, 24 nt, Human
ugaucauuuaaaaaacagaaaaga

SEQ ID NO: 278111 - RNA, 18 nt, Human
ugcugaggaacaaggcug

SEQ ID NO: 278112 - RNA, 19 nt, Human
uggacccuccauccuggac

SEQ ID NO: 278113 - RNA, 25 nt, Human
uguccagaggaucugccuggcacac

SEQ ID NO: 278114 - RNA, 19 nt, Human
uucccugucccuugagguc

SEQ ID NO: 278115 - RNA, 20 nt, Human
uuuuugguuucaugaucauu

SEQ ID NO: 278116 - RNA, 21 nt, Human
uuuuuuuuuuuuuugcaggua

SEQ ID NO: 278117 - RNA, 21 nt, Human
uuuuuuuuuuuuuuuuugcag

SEQ ID NO: 278118 - RNA, 23 nt, Human
uuuuuuuuuuuuuuuuugcaggu

SEQ ID NO: 278119 - RNA, 23 nt, Human
uuuuuuuuuuuuuuuuuugcagg

SEQ ID NO: 278120 - RNA, 20 nt, Human
aaaaaugcuauccuaacuau

SEQ ID NO: 278121 - RNA, 22 nt, Human
aaaacaacaaaaccucuacagg

SEQ ID NO: 278122 - RNA, 24 nt, Human
aaacaaaacaacagaugaaaacaa

SEQ ID NO: 278123 - RNA, 20 nt, Human
aaacaacaaaaccucuacag

SEQ ID NO: 278124 - RNA, 28 nt, Human
aaacaacaaaaccucuacaggacaaacu

SEQ ID NO: 278125 - RNA, 21 nt, Human
aaacaaucucaucuaaaaauc

SEQ ID NO: 278126 - RNA, 22 nt, Human
aaacagcuguacaauaacuuuu

SEQ ID NO: 278127 - RNA, 23 nt, Human
aaagaaaacaaaaacauguccuc

SEQ ID NO: 278128 - RNA, 20 nt, Human
aacugugaaaaaaaguauga

SEQ ID NO: 278129 - RNA, 22 nt, Human
aagaaaacaaaaacauguccuc

SEQ ID NO: 278130 - RNA, 23 nt, Human
aagaaaacaaaaacauguccuca

SEQ ID NO: 278131 - RNA, 22 nt, Human
aagcaccaacccauuuucacac

SEQ ID NO: 278132 - RNA, 24 nt, Human
aauagcuauaaaaggcacaacuuc

SEQ ID NO: 278133 - RNA, 23 nt, Human
acagacuuugggcacuggugguu

SEQ ID NO: 278134 - RNA, 19 nt, Human
accaucuacucucccauca

SEQ ID NO: 278135 - RNA, 22 nt, Human
agggaaauauauuuuuuuuuuc

SEQ ID NO: 278136 - RNA, 23 nt, Human
auaaaacaacaaaaccucuacag

SEQ ID NO: 278137 - RNA, 22 nt, Human
caaaaagcauucaaagaaaaca

SEQ ID NO: 278138 - RNA, 24 nt, Human
caaaacaacagaugaaaacaauaa

SEQ ID NO: 278139 - RNA, 25 nt, Human
cacacaggaccagucuccaucuccc

SEQ ID NO: 278140 - RNA, 24 nt, Human
cacaggaccagucuccaucucccu

SEQ ID NO: 278141 - RNA, 21 nt, Human
cagaaggagcaggagggaaau

SEQ ID NO: 278142 - RNA, 18 nt, Human
cagguuagaagcaccaac

SEQ ID NO: 278143 - RNA, 25 nt, Human
cauacaguucuaaaucacaaaaauc

SEQ ID NO: 278144 - RNA, 18 nt, Human
ccaagucuuggcccucua

SEQ ID NO: 278145 - RNA, 24 nt, Human
ccaucuacucucccaucacugaaa

SEQ ID NO: 278146 - RNA, 18 nt, Human
ccauugcaaaaauagggc

SEQ ID NO: 278147 - RNA, 22 nt, Human
cccaucuuaaacagcuguacaa

SEQ ID NO: 278148 - RNA, 19 nt, Human
cgcagccgagauaaacaac

SEQ ID NO: 278149 - RNA, 22 nt, Human
cuaauuucugggauauauuaac

SEQ ID NO: 278150 - RNA, 19 nt, Human
cuagccauuuuugccauau

SEQ ID NO: 278151 - RNA, 20 nt, Human
cuagcugcccaucuuaaaca

SEQ ID NO: 278152 - RNA, 20 nt, Human
cucgcccgccaccguccgca

SEQ ID NO: 278153 - RNA, 20 nt, Human
cucuaugcaaacuauugcca

SEQ ID NO: 278154 - RNA, 25 nt, Human
cuuccugucuccuguuuacauacuu

SEQ ID NO: 278155 - RNA, 26 nt, Human
cuuccugucuccuguuuacauacuuu

SEQ ID NO: 278156 - RNA, 19 nt, Human
gacaguaauagcuauaaaa

SEQ ID NO: 278157 - RNA, 24 nt, Human
gagcaggagggaaauauauuuuuu

SEQ ID NO: 278158 - RNA, 18 nt, Human
ggguaaaguuuagugaga

SEQ ID NO: 278159 - RNA, 18 nt, Human
gguccugaaagacaaaua

SEQ ID NO: 278160 - RNA, 18 nt, Human
guagcccuucccuuccca

SEQ ID NO: 278161 - RNA, 24 nt, Human
gugaauaccaauaugauauauauc

SEQ ID NO: 278162 - RNA, 19 nt, Human
uaaaacaaaacaacagaug

SEQ ID NO: 278163 - RNA, 24 nt, Human
uaaaacaaaacaacagaugaaaac

SEQ ID NO: 278164 - RNA, 24 nt, Human
uaaaacaacaaaaccucuacagga

SEQ ID NO: 278165 - RNA, 21 nt, Human
uaaaaccagacaguaauagcu

SEQ ID NO: 278166 - RNA, 19 nt, Human
uaaacagcuguacaauaac

SEQ ID NO: 278167 - RNA, 24 nt, Human
uaaaucacaaaaaucaguagcuga

SEQ ID NO: 278168 - RNA, 19 nt, Human
uaaggcaaccauucuuauu

SEQ ID NO: 278169 - RNA, 21 nt, Human
uacaguucuaaaucacaaaaa

SEQ ID NO: 278170 - RNA, 19 nt, Human
uagcccuucccuucccaga

SEQ ID NO: 278171 - RNA, 24 nt, Human
uauggcacacauuagggaugugua

SEQ ID NO: 278172 - RNA, 19 nt, Human
uauuagauggugccuuuaa

SEQ ID NO: 278173 - RNA, 22 nt, Human
ucaaaagguccugaaagacaaa

SEQ ID NO: 278174 - RNA, 21 nt, Human
ucacuguuggaaugagaaggg

SEQ ID NO: 278175 - RNA, 23 nt, Human
ucagcauuucuuugaccccuaca

SEQ ID NO: 278176 - RNA, 27 nt, Human
ucaucuaaaaaucauucuuauuuuaca

SEQ ID NO: 278177 - RNA, 22 nt, Human
uccgcaguucccgccgcagccg

SEQ ID NO: 278178 - RNA, 23 nt, Human
ucucccucuuccccuagagcaaa

SEQ ID NO: 278179 - RNA, 21 nt, Human
ucuuccccuagagcaaacugu

SEQ ID NO: 278180 - RNA, 21 nt, Human
ugaaaaaaaguaugaagagaa

SEQ ID NO: 278181 - RNA, 22 nt, Human
ugaaaacaauaaaaaauaaaac

SEQ ID NO: 278182 - RNA, 30 nt, Human
ugaaaacaauaaaaaauaaaacaacaaaag

SEQ ID NO: 278183 - RNA, 19 nt, Human
ugacuguggagauuacguc

SEQ ID NO: 278184 - RNA, 24 nt, Human
ugagaaggguggucagaaugggag

SEQ ID NO: 278185 - RNA, 23 nt, Human
ugcacacagaaagggcuacuaca

SEQ ID NO: 278186 - RNA, 22 nt, Human
ugcauaaaucaaaaaugcuauc

SEQ ID NO: 278187 - RNA, 20 nt, Human
ugcugggggagggcuguaug

SEQ ID NO: 278188 - RNA, 20 nt, Human
ugcugggggagggcuguaug

SEQ ID NO: 278189 - RNA, 19 nt, Human
uggaaauaaacucuuguug

SEQ ID NO: 278190 - RNA, 20 nt, Human
ugggaaagcuacgaacuagc

SEQ ID NO: 278191 - RNA, 19 nt, Human
ugggcacuggugguuuagg

SEQ ID NO: 278192 - RNA, 19 nt, Human
uguuuagaguuuauuuggg

SEQ ID NO: 278193 - RNA, 21 nt, Human
uuaagguuucuaauuucuggg

SEQ ID NO: 278194 - RNA, 22 nt, Human
uuacagaaaguugguaaggugc

SEQ ID NO: 278195 - RNA, 25 nt, Human
uucccgccgcagccgagauaaacaa

SEQ ID NO: 278196 - RNA, 21 nt, Human
uuguggcuuaguaaauauguu

SEQ ID NO: 278197 - RNA, 23 nt, Human
uuuccaugcauaaaucaaaaaug

SEQ ID NO: 278198 - RNA, 18 nt, Human
uuuugcaaccaucaucca

SEQ ID NO: 278199 - RNA, 20 nt, Human
uuuuuugacaagaauacugg

SEQ ID NO: 278200 - RNA, 22 nt, Human
uuuuuuuugacaagaauacugg

SEQ ID NO: 278201 - RNA, 26 nt, Human
uuuuuuuuuuuuugacaagaauacug

SEQ ID NO: 278202 - RNA, 18 nt, Human
uuuuuuuuuuuuuuuuug

SEQ ID NO: 278203 - RNA, 23 nt, Human
uuuuuuuuuuuuuuuuugacaag

SEQ ID NO: 278204 - RNA, 20 nt, Human
aaaacuucuuccaucuguga

SEQ ID NO: 278205 - RNA, 22 nt, Human
aaacaaaaaguacagaaaaagu

SEQ ID NO: 278206 - RNA, 21 nt, Human
aaacaagcgaacgauaccaga

SEQ ID NO: 278207 - RNA, 22 nt, Human
aaaguacagaaaaaguagaaag

SEQ ID NO: 278208 - RNA, 26 nt, Human
aaaguacagaaaaaguagaaagguuu

SEQ ID NO: 278209 - RNA, 24 nt, Human
aaauuaccuuguuuagacaaagau

SEQ ID NO: 278210 - RNA, 21 nt, Human
aagcagaagccagaaaacgug

SEQ ID NO: 278211 - RNA, 21 nt, Human
acaaaacaaaaaguacagaaa

SEQ ID NO: 278212 - RNA, 20 nt, Human
accccucuaucucccggucu

SEQ ID NO: 278213 - RNA, 25 nt, Human
acuuaaggcaaaguucuucugggca

SEQ ID NO: 278214 - RNA, 22 nt, Human
acuuuguuaauacaaaaagcug

SEQ ID NO: 278215 - RNA, 23 nt, Human
agaacaaaacaaaaaguacagaa

SEQ ID NO: 278216 - RNA, 21 nt, Human
agaauucuuucaaaaauacuu

SEQ ID NO: 278217 - RNA, 21 nt, Human
agacaccgcagugugucauuc

SEQ ID NO: 278218 - RNA, 22 nt, Human
agagcugguucugcuucuagag

SEQ ID NO: 278219 - RNA, 24 nt, Human
agauacuagaaaucaaaccaaggc

SEQ ID NO: 278220 - RNA, 24 nt, Human
agcacagcaaaagacugcaaaaaa

SEQ ID NO: 278221 - RNA, 23 nt, Human
agcgcugggggauuggagguggg

SEQ ID NO: 278222 - RNA, 18 nt, Human
agcgcuugccaccgccac

SEQ ID NO: 278223 - RNA, 21 nt, Human
aggaugaagcagaagccagaa

SEQ ID NO: 278224 - RNA, 18 nt, Human
aucccgaggaacaggaac

SEQ ID NO: 278225 - RNA, 19 nt, Human
aucuaaaaccccucuaucu

SEQ ID NO: 278226 - RNA, 18 nt, Human
augaagcagaagccagaa

SEQ ID NO: 278227 - RNA, 19 nt, Human
augaagcuaaaaaaggcac

SEQ ID NO: 278228 - RNA, 21 nt, Human
augaagcuaaaaaaggcacag

SEQ ID NO: 278229 - RNA, 26 nt, Human
auggacgcuaacgaguguguauacca

SEQ ID NO: 278230 - RNA, 20 nt, Human
auggagcaggaugaagcaga

SEQ ID NO: 278231 - RNA, 23 nt, Human
caaaaauaagagcagacagacaa

SEQ ID NO: 278232 - RNA, 23 nt, Human
caaaaauacuuucccauucaucc

SEQ ID NO: 278233 - RNA, 25 nt, Human
caaaagauccuuauaccuuauuuca

SEQ ID NO: 278234 - RNA, 18 nt, Human
caaaauagaauucuuucc

SEQ ID NO: 278235 - RNA, 22 nt, Human
caaaaucagaguuauugacuag

SEQ ID NO: 278236 - RNA, 24 nt, Human
caagaacaaaacaaaaaguacaga

SEQ ID NO: 278237 - RNA, 18 nt, Human
caagcgaacgauaccaga

SEQ ID NO: 278238 - RNA, 22 nt, Human
cacagcaaaagacugcaaaaaa

SEQ ID NO: 278239 - RNA, 20 nt, Human
cacaggagaaaaucugauuu

SEQ ID NO: 278240 - RNA, 20 nt, Human
caccgcagugugucauuccc

SEQ ID NO: 278241 - RNA, 23 nt, Human
cagaaccucuuuccaagaucaga

SEQ ID NO: 278242 - RNA, 24 nt, Human
cagaaccucuuuccaagaucagaa

SEQ ID NO: 278243 - RNA, 24 nt, Human
cagcgagugccgcucucccugcag

SEQ ID NO: 278244 - RNA, 26 nt, Human
cagugccaaacaaacagauuaaugaa

SEQ ID NO: 278245 - RNA, 21 nt, Human
ccaaacaaacagauuaaugaa

SEQ ID NO: 278246 - RNA, 21 nt, Human
ccacggaaaaacagcuuuccc

SEQ ID NO: 278247 - RNA, 21 nt, Human
ccagcgagugccgcucucccu

SEQ ID NO: 278248 - RNA, 22 nt, Human
ccaucccaaaccugguuaagua

SEQ ID NO: 278249 - RNA, 18 nt, Human
cccacaaaugccccaagc

SEQ ID NO: 278250 - RNA, 19 nt, Human
cccacauguguugucaaau

SEQ ID NO: 278251 - RNA, 24 nt, Human
ccccugcugcggagccccccuaaa

SEQ ID NO: 278252 - RNA, 18 nt, Human
cccugccucggccggggu

SEQ ID NO: 278253 - RNA, 23 nt, Human
cccugcugcggagccccccuaaa

SEQ ID NO: 278254 - RNA, 22 nt, Human
ccgccacgaaaccccugcugcg

SEQ ID NO: 278255 - RNA, 20 nt, Human
ccgucccagcgcauccugcc

SEQ ID NO: 278256 - RNA, 20 nt, Human
ccguggacgagcgagggcuc

SEQ ID NO: 278257 - RNA, 27 nt, Human
ccuauaaauuaaauuccugaaauugcc

SEQ ID NO: 278258 - RNA, 25 nt, Human
ccucugagcagccugaaguuggcuc

SEQ ID NO: 278259 - RNA, 23 nt, Human
ccugcagcgggagagcccgaggc

SEQ ID NO: 278260 - RNA, 23 nt, Human
ccugcauggugaacccuggagaa

SEQ ID NO: 278261 - RNA, 23 nt, Human
cgaggcaggcuuucccaaagcug

SEQ ID NO: 278262 - RNA, 24 nt, Human
cgccacgaaaccccugcugcggag

SEQ ID NO: 278263 - RNA, 22 nt, Human
cgcuugccaccgccacgaaacu

SEQ ID NO: 278264 - RNA, 24 nt, Human
cggagccccccuaaauccaaccac

SEQ ID NO: 278265 - RNA, 21 nt, Human
cgggagaccaagaacaaaaca

SEQ ID NO: 278266 - RNA, 20 nt, Human
cgggagagcccgaggcagca

SEQ ID NO: 278267 - RNA, 19 nt, Human
cuaagucugaacuaaaagc

SEQ ID NO: 278268 - RNA, 20 nt, Human
cuccaaaccucugacaugac

SEQ ID NO: 278269 - RNA, 18 nt, Human
cuccaaggaccuccucuc

SEQ ID NO: 278270 - RNA, 23 nt, Human
cuccaugccauucagacugaacc

SEQ ID NO: 278271 - RNA, 22 nt, Human
cugcagcacuccaaggaccucc

SEQ ID NO: 278272 - RNA, 19 nt, Human
cugcggagccccccuaaau

SEQ ID NO: 278273 - RNA, 21 nt, Human
cuuccaggagcugcagacacc

SEQ ID NO: 278274 - RNA, 23 nt, Human
gaaaaaguagaaagguuucaaga

SEQ ID NO: 278275 - RNA, 24 nt, Human
gaacaagugugaaucaaccaucac

SEQ ID NO: 278276 - RNA, 23 nt, Human
gaacuguaccaaaccaagauuuu

SEQ ID NO: 278277 - RNA, 21 nt, Human
gaggaaaagaugcucucugag

SEQ ID NO: 278278 - RNA, 18 nt, Human
gcugcagacaccgcagug

SEQ ID NO: 278279 - RNA, 20 nt, Human
gcuugccaccgccacgaaac

SEQ ID NO: 278280 - RNA, 23 nt, Human
ggaacaacacagggaaacuuaag

SEQ ID NO: 278281 - RNA, 18 nt, Human
ggaauccuucagacugcu

SEQ ID NO: 278282 - RNA, 24 nt, Human
ggaauuuuuuuuucccacaggaga

SEQ ID NO: 278283 - RNA, 25 nt, Human
ggagccccccuaaauccaaccacau

SEQ ID NO: 278284 - RNA, 19 nt, Human
ggggauuggagguggggaa

SEQ ID NO: 278285 - RNA, 24 nt, Human
guaaguaagccauuuguuugcuag

SEQ ID NO: 278286 - RNA, 20 nt, Human
guguggaacaacacagggaa

SEQ ID NO: 278287 - RNA, 21 nt, Human
uaaaaaucuaaaaccccucua

SEQ ID NO: 278288 - RNA, 27 nt, Human
uaaaacaagcgaacgauaccagaaacc

SEQ ID NO: 278289 - RNA, 21 nt, Human
uaaacgguucauuaugcaugc

SEQ ID NO: 278290 - RNA, 18 nt, Human
uaaagccaacacaauaga

SEQ ID NO: 278291 - RNA, 19 nt, Human
uaagaaagacuccucccuc

SEQ ID NO: 278292 - RNA, 25 nt, Human
uaauuaauaugauuucacugaguaa

SEQ ID NO: 278293 - RNA, 21 nt, Human
uacacaacaggaaucuguaua

SEQ ID NO: 278294 - RNA, 22 nt, Human
uacaguccuuugcaaagacaga

SEQ ID NO: 278295 - RNA, 24 nt, Human
uaccaaaccaagauuuuuaagagc

SEQ ID NO: 278296 - RNA, 19 nt, Human
uaccagugaugcagaagac

SEQ ID NO: 278297 - RNA, 22 nt, Human
uaccuggagacacacaaagagc

SEQ ID NO: 278298 - RNA, 20 nt, Human
uaccuucaaaguguggcuuu

SEQ ID NO: 278299 - RNA, 25 nt, Human
uagaauucuuucaaaaauacuuucc

SEQ ID NO: 278300 - RNA, 22 nt, Human
uauacauacaguaauguacagc

SEQ ID NO: 278301 - RNA, 25 nt, Human
uauuuuuaaaaccuaccuuuuaaaa

SEQ ID NO: 278302 - RNA, 25 nt, Human
uccaaaacuguuuauguauaaaacu

SEQ ID NO: 278303 - RNA, 18 nt, Human
uccaagaucagaagggaa

SEQ ID NO: 278304 - RNA, 22 nt, Human
uccauucuaauuaaauaagaaa

SEQ ID NO: 278305 - RNA, 19 nt, Human
ucccggcuccaaaccucug

SEQ ID NO: 278306 - RNA, 20 nt, Human
ucccugcagcgggagagccc

SEQ ID NO: 278307 - RNA, 24 nt, Human
ucuaaaaugggaggaaaagaugcu

SEQ ID NO: 278308 - RNA, 22 nt, Human
ucucugagccaucaaguuccca

SEQ ID NO: 278309 - RNA, 25 nt, Human
ucuguaauuuuucuccaaaacuguu

SEQ ID NO: 278310 - RNA, 18 nt, Human
ugaaaauaucaaaaucag

SEQ ID NO: 278311 - RNA, 21 nt, Human
ugaaaauaucaaaaucagagu

SEQ ID NO: 278312 - RNA, 20 nt, Human
ugaagcagaagccagaaaac

SEQ ID NO: 278313 - RNA, 23 nt, Human
ugaagcagaagccagaaaacgug

SEQ ID NO: 278314 - RNA, 25 nt, Human
ugaagcagaagccagaaaacgugcu

SEQ ID NO: 278315 - RNA, 25 nt, Human
ugacaugacuuuaaacuugagaaac

SEQ ID NO: 278316 - RNA, 23 nt, Human
ugacugcacgggcuuccucugag

SEQ ID NO: 278317 - RNA, 19 nt, Human
ugaguaaaccugaugauua

SEQ ID NO: 278318 - RNA, 18 nt, Human
ugauuuggggcaagagaa

SEQ ID NO: 278319 - RNA, 22 nt, Human
ugcggagccccccuaaauccaa

SEQ ID NO: 278320 - RNA, 19 nt, Human
uggagaaaaguguugaucu

SEQ ID NO: 278321 - RNA, 21 nt, Human
uggagacacacaaagagccag

SEQ ID NO: 278322 - RNA, 22 nt, Human
uggguguggaacaacacaggga

SEQ ID NO: 278323 - RNA, 24 nt, Human
uguacagcacagcaaaagacugca

SEQ ID NO: 278324 - RNA, 25 nt, Human
uguguauuuauuaccuucaaagugg

SEQ ID NO: 278325 - RNA, 18 nt, Human
uuguaaagccaacacaau

SEQ ID NO: 278326 - RNA, 22 nt, Human
uuuaaaaaucuaaaaccccucu

SEQ ID NO: 278327 - RNA, 19 nt, Human
uuuaaucaagcaaaguuac

SEQ ID NO: 278328 - RNA, 24 nt, Human
uuuagugcaaucauauuguuaguu

SEQ ID NO: 278329 - RNA, 18 nt, Human
uuuuaugugcaaaccaag

SEQ ID NO: 278330 - RNA, 20 nt, Human
aagaggcgggguugaaggag

SEQ ID NO: 278331 - RNA, 25 nt, Human
aaggccggggccaggcuggggggga

SEQ ID NO: 278332 - RNA, 22 nt, Human
acccggccggcucccgcugccc

SEQ ID NO: 278333 - RNA, 22 nt, Human
aggaagaggcgggguugaagga

SEQ ID NO: 278334 - RNA, 19 nt, Human
aggcaucccccuccccaag

SEQ ID NO: 278335 - RNA, 21 nt, Human
aggcaucccccuccccaaggg

SEQ ID NO: 278336 - RNA, 20 nt, Human
agugcgcaugugcacacgug

SEQ ID NO: 278337 - RNA, 21 nt, Human
auaugagagugcgcaugugca

SEQ ID NO: 278338 - RNA, 22 nt, Human
caaaaaacauaaaggccggggc

SEQ ID NO: 278339 - RNA, 23 nt, Human
caaaaaacauaaaggccggggcc

SEQ ID NO: 278340 - RNA, 19 nt, Human
cagccccgcucccaccuca

SEQ ID NO: 278341 - RNA, 23 nt, Human
caggaaggcggggcccaucccuu

SEQ ID NO: 278342 - RNA, 22 nt, Human
caggaggaggaagaggcggggu

SEQ ID NO: 278343 - RNA, 23 nt, Human
caggcaggucuuggcaacaaugu

SEQ ID NO: 278344 - RNA, 27 nt, Human
caucccuuccucccagccccgcuccca

SEQ ID NO: 278345 - RNA, 23 nt, Human
cccaugaaggcaucccccucccc

SEQ ID NO: 278346 - RNA, 20 nt, Human
ccccaagggcuugagcuccc

SEQ ID NO: 278347 - RNA, 21 nt, Human
ccccaagggcuugagcucccu

SEQ ID NO: 278348 - RNA, 21 nt, Human
ccccgagucucagccuggucc

SEQ ID NO: 278349 - RNA, 19 nt, Human
cccgcugccccugcccgga

SEQ ID NO: 278350 - RNA, 19 nt, Human
cccgcugccccugcccgga

SEQ ID NO: 278351 - RNA, 21 nt, Human
cccugcccggacuggcgcccc

SEQ ID NO: 278352 - RNA, 22 nt, Human
ccguggacuaaaggcacauggg

SEQ ID NO: 278353 - RNA, 20 nt, Human
ccucaagcucuuucuuccug

SEQ ID NO: 278354 - RNA, 18 nt, Human
ccucccagccccgcuccc

SEQ ID NO: 278355 - RNA, 23 nt, Human
ccuccuggagcaggugagaaggu

SEQ ID NO: 278356 - RNA, 21 nt, Human
cggcucccgcugccccugccc

SEQ ID NO: 278357 - RNA, 25 nt, Human
cggggccaggcuggggggucugucg

SEQ ID NO: 278358 - RNA, 21 nt, Human
cucccagccccgcucccaccu

SEQ ID NO: 278359 - RNA, 22 nt, Human
cucccagccccgcucccaccuc

SEQ ID NO: 278360 - RNA, 19 nt, Human
cuccuggagcaggugagaa

SEQ ID NO: 278361 - RNA, 18 nt, Human
cuggagcaggugagaagg

SEQ ID NO: 278362 - RNA, 21 nt, Human
gaggcuggaaaggcugcccag

SEQ ID NO: 278363 - RNA, 21 nt, Human
gaggggggagcagucccacag

SEQ ID NO: 278364 - RNA, 20 nt, Human
gcaucccccuccccaagggc

SEQ ID NO: 278365 - RNA, 23 nt, Human
gcccaucccuuccucccagcccc

SEQ ID NO: 278366 - RNA, 23 nt, Human
ggaggguaggaagagagagccag

SEQ ID NO: 278367 - RNA, 19 nt, Human
ggggagcagucccacagga

SEQ ID NO: 278368 - RNA, 20 nt, Human
ggggccaggcugggggggau

SEQ ID NO: 278369 - RNA, 19 nt, Human
uaaaggcacaugggguggc

SEQ ID NO: 278370 - RNA, 19 nt, Human
uacaaaaaacauaaaggcc

SEQ ID NO: 278371 - RNA, 20 nt, Human
uacaaaaaacauaaaggccg

SEQ ID NO: 278372 - RNA, 22 nt, Human
ucacauacuauaaauccaggaa

SEQ ID NO: 278373 - RNA, 19 nt, Human
uccaggaaaauacacaaau

SEQ ID NO: 278374 - RNA, 18 nt, Human
ucccuuccucccagcccc

SEQ ID NO: 278375 - RNA, 23 nt, Human
ucuuggcaacaauguggcuugca

SEQ ID NO: 278376 - RNA, 24 nt, Human
ugaaggaggcaguggggagaaucc

SEQ ID NO: 278377 - RNA, 20 nt, Human
ugaaggcaucccccucccca

SEQ ID NO: 278378 - RNA, 18 nt, Human
ugcccaggaaggcggggc

SEQ ID NO: 278379 - RNA, 21 nt, Human
ugcccggacuggcgccccgag

SEQ ID NO: 278380 - RNA, 20 nt, Human
uggaaggaggguaggaagag

SEQ ID NO: 278381 - RNA, 18 nt, Human
uggcgccccgagucucag

SEQ ID NO: 278382 - RNA, 21 nt, Human
uggcgccccgagucucagccu

SEQ ID NO: 278383 - RNA, 23 nt, Human
uguguuaaaaacgguuuaucuua

SEQ ID NO: 278384 - RNA, 19 nt, Human
uuccucccagccccgcucc

SEQ ID NO: 278385 - RNA, 23 nt, Human
aaaaagccaaacugcauugggua

SEQ ID NO: 278386 - RNA, 23 nt, Human
aaacaaaauaauaaauuaacuga

SEQ ID NO: 278387 - RNA, 21 nt, Human
aacgguacauacaacacuuac

SEQ ID NO: 278388 - RNA, 24 nt, Human
aagaaagaauuuaucagaaaaaaa

SEQ ID NO: 278389 - RNA, 21 nt, Human
acaaacaaggaauguuggacg

SEQ ID NO: 278390 - RNA, 20 nt, Human
acaccauagaaaaaaaggca

SEQ ID NO: 278391 - RNA, 23 nt, Human
accauagaaaaaaaggcagugac

SEQ ID NO: 278392 - RNA, 23 nt, Human
acugucauacaccauagaaaaaa

SEQ ID NO: 278393 - RNA, 23 nt, Human
agaaagaauuuaucagaaaaaaa

SEQ ID NO: 278394 - RNA, 21 nt, Human
agagcugggcgaagggaaccc

SEQ ID NO: 278395 - RNA, 24 nt, Human
agauaacuaccaaucuuuauaaaa

SEQ ID NO: 278396 - RNA, 20 nt, Human
aggaugccccggagccaaaa

SEQ ID NO: 278397 - RNA, 25 nt, Human
auggccaaacauuucccauuauacc

SEQ ID NO: 278398 - RNA, 18 nt, Human
auggggggcagcuugagc

SEQ ID NO: 278399 - RNA, 20 nt, Human
auggggggcagcuugagcug

SEQ ID NO: 278400 - RNA, 30 nt, Human
augugucucuguguguguguguguguggug

SEQ ID NO: 278401 - RNA, 18 nt, Human
auuuuuagaaaagcaaug

SEQ ID NO: 278402 - RNA, 23 nt, Human
caacaaacugauuuuuaaacuga

SEQ ID NO: 278403 - RNA, 23 nt, Human
cacaaaauaauuuaaaaagccaa

SEQ ID NO: 278404 - RNA, 24 nt, Human
cacccacgcaacauuuaguuuuac

SEQ ID NO: 278405 - RNA, 22 nt, Human
cacuuacaaacaaggaauguug

SEQ ID NO: 278406 - RNA, 22 nt, Human
cagcagaaaacuuugaagucuu

SEQ ID NO: 278407 - RNA, 21 nt, Human
cagccuguccaaucuccuccu

SEQ ID NO: 278408 - RNA, 18 nt, Human
cauggccaaacauuuccc

SEQ ID NO: 278409 - RNA, 18 nt, Human
cauuaucauuccaguucc

SEQ ID NO: 278410 - RNA, 19 nt, Human
ccaguuccuuugaagugcu

SEQ ID NO: 278411 - RNA, 21 nt, Human
cggcuggacaggcaaaaggga

SEQ ID NO: 278412 - RNA, 21 nt, Human
cggggucggguagggguggga

SEQ ID NO: 278413 - RNA, 19 nt, Human
cugaacugcaacaaccaag

SEQ ID NO: 278414 - RNA, 18 nt, Human
cugauguguaauacuugu

SEQ ID NO: 278415 - RNA, 22 nt, Human
cugccgaagugcaguucccucu

SEQ ID NO: 278416 - RNA, 20 nt, Human
cuucaacucaugccacccac

SEQ ID NO: 278417 - RNA, 22 nt, Human
gaaaagcaauggggaguccagc

SEQ ID NO: 278418 - RNA, 18 nt, Human
gagacugcucacacggcu

SEQ ID NO: 278419 - RNA, 23 nt, Human
gcacaaaauaauuuaaaaagcca

SEQ ID NO: 278420 - RNA, 19 nt, Human
gcccuuucagguucugccu

SEQ ID NO: 278421 - RNA, 22 nt, Human
gccggggucggguagggguggg

SEQ ID NO: 278422 - RNA, 22 nt, Human
gggcgccggggucggguagggg

SEQ ID NO: 278423 - RNA, 23 nt, Human
guacauacaacacuuacaaacaa

SEQ ID NO: 278424 - RNA, 23 nt, Human
gucucucuucauucauucaacuc

SEQ ID NO: 278425 - RNA, 22 nt, Human
gugucucugugugugugugugu

SEQ ID NO: 278426 - RNA, 18 nt, Human
uaaauaggcacaaaauaa

SEQ ID NO: 278427 - RNA, 19 nt, Human
uaaauaggcacaaaauaau

SEQ ID NO: 278428 - RNA, 18 nt, Human
uacaaagaaaaauacuac

SEQ ID NO: 278429 - RNA, 21 nt, Human
uacuacagaauauggcaauau

SEQ ID NO: 278430 - RNA, 23 nt, Human
uagaaaaaaaggcagugacucau

SEQ ID NO: 278431 - RNA, 24 nt, Human
uaucagaaaaaaaaucagcaucuc

SEQ ID NO: 278432 - RNA, 22 nt, Human
uauggcaauauuaaaauucuua

SEQ ID NO: 278433 - RNA, 21 nt, Human
ucaacaucaacgguacauaca

SEQ ID NO: 278434 - RNA, 21 nt, Human
uccuuugaagugcuugggagg

SEQ ID NO: 278435 - RNA, 24 nt, Human
ucuccgcgucucucuucauucauu

SEQ ID NO: 278436 - RNA, 20 nt, Human
ucugaacaacaaacugauuu

SEQ ID NO: 278437 - RNA, 22 nt, Human
ucugaacugcaacaaccaagca

SEQ ID NO: 278438 - RNA, 21 nt, Human
ucuuuuuuuuugcaaacacac

SEQ ID NO: 278439 - RNA, 21 nt, Human
ugaaggacaaaguuuccaaga

SEQ ID NO: 278440 - RNA, 22 nt, Human
uggacgguguuacaaacacuau

SEQ ID NO: 278441 - RNA, 20 nt, Human
uguaguccauguucuaaauc

SEQ ID NO: 278442 - RNA, 21 nt, Human
uguauuguguguaguccaugu

SEQ ID NO: 278443 - RNA, 21 nt, Human
ugucauacaccauagaaaaaa

SEQ ID NO: 278444 - RNA, 26 nt, Human
ugucauacaccauagaaaaaaaggca

SEQ ID NO: 278445 - RNA, 19 nt, Human
uguguguaugugugugugu

SEQ ID NO: 278446 - RNA, 21 nt, Human
uguguguguaugugugugugu

SEQ ID NO: 278447 - RNA, 21 nt, Human
uguguguguaugugugugugu

SEQ ID NO: 278448 - RNA, 20 nt, Human
uguguguguguaugugugug

SEQ ID NO: 278449 - RNA, 21 nt, Human
uguguguguguaugugugugu

SEQ ID NO: 278450 - RNA, 21 nt, Human
uguguguguguguaugugugu

SEQ ID NO: 278451 - RNA, 21 nt, Human
uguguguguguguguaugugu

SEQ ID NO: 278452 - RNA, 23 nt, Human
uguguguguguguguaugugugu

SEQ ID NO: 278453 - RNA, 21 nt, Human
uguguguguguguguguaugu

SEQ ID NO: 278454 - RNA, 21 nt, Human
uguguguguguguguguaugu

SEQ ID NO: 278455 - RNA, 30 nt, Human
uguguguguguguguguaugugugugugug

SEQ ID NO: 278456 - RNA, 18 nt, Human
ugugugugugugugugug

SEQ ID NO: 278457 - RNA, 21 nt, Human
uguguguguguguguguguaa

SEQ ID NO: 278458 - RNA, 18 nt, Human
uguguguguuacauuugu

SEQ ID NO: 278459 - RNA, 19 nt, Human
uugcccccucuugacaguu

SEQ ID NO: 278460 - RNA, 22 nt, Human
uugcccccucuugacaguuucc

SEQ ID NO: 278461 - RNA, 20 nt, Human
uuucagguucugccugcagg

SEQ ID NO: 278462 - RNA, 18 nt, Human
aaaggaagagggaggggc

SEQ ID NO: 278463 - RNA, 18 nt, Human
aaaugaacuacaaacuug

SEQ ID NO: 278464 - RNA, 22 nt, Human
aagaaaaagcaaaggaaaaaaa

SEQ ID NO: 278465 - RNA, 20 nt, Human
aagccuuugauucacaguuu

SEQ ID NO: 278466 - RNA, 21 nt, Human
aaggaagagggaggggcuauu

SEQ ID NO: 278467 - RNA, 24 nt, Human
aaguuaagaaaaagcaaaggaaaa

SEQ ID NO: 278468 - RNA, 27 nt, Human
aauccuguaagcucaaaucccccgcug

SEQ ID NO: 278469 - RNA, 21 nt, Human
acaaaacaacccucagaacau

SEQ ID NO: 278470 - RNA, 22 nt, Human
acaaugccaaagccacauuuca

SEQ ID NO: 278471 - RNA, 19 nt, Human
accacagggcagaggugcu

SEQ ID NO: 278472 - RNA, 22 nt, Human
acccucagaacauauuuaaaau

SEQ ID NO: 278473 - RNA, 23 nt, Human
accucauccuuuccuuucucuuu

SEQ ID NO: 278474 - RNA, 19 nt, Human
acucaaaauuaggcuguuc

SEQ ID NO: 278475 - RNA, 22 nt, Human
agcaaaggaaaaaaaaaaaucc

SEQ ID NO: 278476 - RNA, 20 nt, Human
aggaaaaaaaaaaauccaga

SEQ ID NO: 278477 - RNA, 21 nt, Human
agggaggggcuauuguaggua

SEQ ID NO: 278478 - RNA, 21 nt, Human
auauggaauccucuggggcug

SEQ ID NO: 278479 - RNA, 18 nt, Human
auccagaauucauaaagu

SEQ ID NO: 278480 - RNA, 22 nt, Human
auccucuggggcugugaagccu

SEQ ID NO: 278481 - RNA, 23 nt, Human
caacaaugccaaagccacauuuc

SEQ ID NO: 278482 - RNA, 24 nt, Human
caagcaagucuuuucccuggacuc

SEQ ID NO: 278483 - RNA, 23 nt, Human
cacgagacaaaacaacccucaga

SEQ ID NO: 278484 - RNA, 23 nt, Human
cagaaaucauugagcaaaagaaa

SEQ ID NO: 278485 - RNA, 20 nt, Human
cagcuuuaccauggaggaau

SEQ ID NO: 278486 - RNA, 24 nt, Human
cauuuccaucccaacucuugagga

SEQ ID NO: 278487 - RNA, 22 nt, Human
ccacuggguguggcugaacaca

SEQ ID NO: 278488 - RNA, 23 nt, Human
ccccuccccacucccccaaucuc

SEQ ID NO: 278489 - RNA, 20 nt, Human
ccuccccacucccccaaucu

SEQ ID NO: 278490 - RNA, 20 nt, Human
ccucuggggcugugaagccu

SEQ ID NO: 278491 - RNA, 18 nt, Human
cgagacaaaacaacccuc

SEQ ID NO: 278492 - RNA, 20 nt, Human
cucuuccuuuccccuuuggg

SEQ ID NO: 278493 - RNA, 21 nt, Human
cugcauuuucuuaacaucaug

SEQ ID NO: 278494 - RNA, 19 nt, Human
cuucccccuccccacuccc

SEQ ID NO: 278495 - RNA, 23 nt, Human
gaacacgagacaaaacaacccuc

SEQ ID NO: 278496 - RNA, 19 nt, Human
gaagccuuugauucacagu

SEQ ID NO: 278497 - RNA, 18 nt, Human
gacuuaaaaaggucagua

SEQ ID NO: 278498 - RNA, 20 nt, Human
gagacaaaacaacccucaga

SEQ ID NO: 278499 - RNA, 19 nt, Human
gagcauuugcuuugaaagu

SEQ ID NO: 278500 - RNA, 18 nt, Human
gauuugguggagcuacca

SEQ ID NO: 278501 - RNA, 24 nt, Human
gcaaaggaaaaaaaaaaauccaga

SEQ ID NO: 278502 - RNA, 19 nt, Human
gcaauacaaauacccugau

SEQ ID NO: 278503 - RNA, 22 nt, Human
gccuugggaaggacacaucaga

SEQ ID NO: 278504 - RNA, 18 nt, Human
ggagaucaguuuaaauau

SEQ ID NO: 278505 - RNA, 21 nt, Human
ggaugaugaaaaagacugaug

SEQ ID NO: 278506 - RNA, 25 nt, Human
guucuucuucccccuccccacuccc

SEQ ID NO: 278507 - RNA, 23 nt, Human
uaagacacagacacucaaaauua

SEQ ID NO: 278508 - RNA, 19 nt, Human
uaaguugcuuuagcuaugg

SEQ ID NO: 278509 - RNA, 23 nt, Human
uacaguaacccuuagugaaaguu

SEQ ID NO: 278510 - RNA, 21 nt, Human
uacuuuuuuucuuccuguucu

SEQ ID NO: 278511 - RNA, 23 nt, Human
uagcagaaauaaggucuaaguug

SEQ ID NO: 278512 - RNA, 25 nt, Human
uauuuguucuacagcagacuuuggu

SEQ ID NO: 278513 - RNA, 20 nt, Human
ucaaaggaagagggaggggc

SEQ ID NO: 278514 - RNA, 22 nt, Human
ucaccauuuccaucccaacucu

SEQ ID NO: 278515 - RNA, 23 nt, Human
ucagaacauauuuaaaauggcaa

SEQ ID NO: 278516 - RNA, 18 nt, Human
ucaguaucacucucuucc

SEQ ID NO: 278517 - RNA, 18 nt, Human
uccaggacacauguaaaa

SEQ ID NO: 278518 - RNA, 23 nt, Human
uccguuuuucuucugaccguguu

SEQ ID NO: 278519 - RNA, 21 nt, Human
uccuguaagcucaaauccccc

SEQ ID NO: 278520 - RNA, 26 nt, Human
uccuguucuucuucccccuccccacu

SEQ ID NO: 278521 - RNA, 24 nt, Human
ucuuuuuguuuugaaagcagagcu

SEQ ID NO: 278522 - RNA, 22 nt, Human
ugaaaaagacugauguauacua

SEQ ID NO: 278523 - RNA, 24 nt, Human
ugaaauccaacaaugccaaagcca

SEQ ID NO: 278524 - RNA, 20 nt, Human
ugaagaauuugcgauucuuu

SEQ ID NO: 278525 - RNA, 21 nt, Human
ugaagccuuugauucacaguu

SEQ ID NO: 278526 - RNA, 20 nt, Human
ugacuauuugacauccuagc

SEQ ID NO: 278527 - RNA, 18 nt, Human
ugagcaaaagaaaagugc

SEQ ID NO: 278528 - RNA, 19 nt, Human
ugauccacaucugcacagc

SEQ ID NO: 278529 - RNA, 20 nt, Human
ugcaauacaaauacccugau

SEQ ID NO: 278530 - RNA, 18 nt, Human
ugcgauucuuuguccucc

SEQ ID NO: 278531 - RNA, 27 nt, Human
ugggaaggacacaucagacuacaguag

SEQ ID NO: 278532 - RNA, 24 nt, Human
uuaaaugaacuacaaacuuggaug

SEQ ID NO: 278533 - RNA, 23 nt, Human
uuccuuuccccuuuggggaagau

SEQ ID NO: 278534 - RNA, 26 nt, Human
uucuuuguccucccauauuuguucua

SEQ ID NO: 278535 - RNA, 19 nt, Human
uugacauccuagcaaaaug

SEQ ID NO: 278536 - RNA, 21 nt, Human
uugcaauacaaauacccugau

SEQ ID NO: 278537 - RNA, 20 nt, Human
uuuaaaauggcaagcuaaca

SEQ ID NO: 278538 - RNA, 22 nt, Human
uuugcgauucuuuguccuccca

SEQ ID NO: 278539 - RNA, 21 nt, Human
uuugguggagcuaccacuggg

SEQ ID NO: 278540 - RNA, 23 nt, Human
uuuuuuuuuuuuuuugacuuuaa

SEQ ID NO: 278541 - RNA, 23 nt, Human
aaacagccagaauuacaggaagc

SEQ ID NO: 278542 - RNA, 19 nt, Human
aaggagacagagccucucc

SEQ ID NO: 278543 - RNA, 22 nt, Human
aaggagacagagccucucccag

SEQ ID NO: 278544 - RNA, 21 nt, Human
aaguguugggauuacaagcau

SEQ ID NO: 278545 - RNA, 23 nt, Human
aaguguugggauuacaagcauga

SEQ ID NO: 278546 - RNA, 26 nt, Human
aaguguugggauuacaagcaugagcc

SEQ ID NO: 278547 - RNA, 23 nt, Human
aaugcuggagcaucagagagaaa

SEQ ID NO: 278548 - RNA, 18 nt, Human
aauuccugugggcaccuc

SEQ ID NO: 278549 - RNA, 18 nt, Human
acacugcagugaagggca

SEQ ID NO: 278550 - RNA, 19 nt, Human
acagagccucucccaggca

SEQ ID NO: 278551 - RNA, 21 nt, Human
accccgcucuguagcuccugg

SEQ ID NO: 278552 - RNA, 21 nt, Human
accucuggucagguucaaguc

SEQ ID NO: 278553 - RNA, 21 nt, Human
acucaggguccagcacucucc

SEQ ID NO: 278554 - RNA, 21 nt, Human
acucugaugaucuccagccuc

SEQ ID NO: 278555 - RNA, 20 nt, Human
acucugcagcuggugggccu

SEQ ID NO: 278556 - RNA, 21 nt, Human
agaaaguggguguagaccaga

SEQ ID NO: 278557 - RNA, 24 nt, Human
agaaaugcaaggagaaccgguacc

SEQ ID NO: 278558 - RNA, 21 nt, Human
agaauuacaggaagcagagag

SEQ ID NO: 278559 - RNA, 27 nt, Human
agacagagccucucccaggcacacagu

SEQ ID NO: 278560 - RNA, 19 nt, Human
agagauggggucucucugu

SEQ ID NO: 278561 - RNA, 20 nt, Human
agagccucucccaggcacac

SEQ ID NO: 278562 - RNA, 19 nt, Human
agcaggaaggagacagagc

SEQ ID NO: 278563 - RNA, 18 nt, Human
agcugagucuggaaaaac

SEQ ID NO: 278564 - RNA, 24 nt, Human
aggaaaugcuucauccuuggguca

SEQ ID NO: 278565 - RNA, 20 nt, Human
aggaagcagagaggcuacca

SEQ ID NO: 278566 - RNA, 20 nt, Human
aggaaggagacagagccucu

SEQ ID NO: 278567 - RNA, 20 nt, Human
aggccccuugcguuggccag

SEQ ID NO: 278568 - RNA, 18 nt, Human
agggagguccaggcccag

SEQ ID NO: 278569 - RNA, 19 nt, Human
aguucagaggagggaaaga

SEQ ID NO: 278570 - RNA, 23 nt, Human
augcgcucauugcagugcauaua

SEQ ID NO: 278571 - RNA, 21 nt, Human
auuacaagcaugagccaccac

SEQ ID NO: 278572 - RNA, 20 nt, Human
cacuuuguaggagccaggag

SEQ ID NO: 278573 - RNA, 18 nt, Human
cagcaggaaggagacaga

SEQ ID NO: 278574 - RNA, 21 nt, Human
cagcaggaaggagacagagcc

SEQ ID NO: 278575 - RNA, 23 nt, Human
cagcaggaaggagacagagccuc

SEQ ID NO: 278576 - RNA, 23 nt, Human
cagcaggcccuccauggaggauu

SEQ ID NO: 278577 - RNA, 23 nt, Human
cagcagggccuucuucuuuuuga

SEQ ID NO: 278578 - RNA, 20 nt, Human
cagccagaauuacaggaagc

SEQ ID NO: 278579 - RNA, 21 nt, Human
cagccagcaggcccuccaugg

SEQ ID NO: 278580 - RNA, 18 nt, Human
cagccagggcagaugcag

SEQ ID NO: 278581 - RNA, 19 nt, Human
cagcugcuccgggucgcag

SEQ ID NO: 278582 - RNA, 22 nt, Human
caggaaggagacagagccucuc

SEQ ID NO: 278583 - RNA, 18 nt, Human
cagggagguccaggccca

SEQ ID NO: 278584 - RNA, 23 nt, Human
caucugggagcugucggucacgg

SEQ ID NO: 278585 - RNA, 18 nt, Human
cauugcagugcauauagc

SEQ ID NO: 278586 - RNA, 25 nt, Human
cauugugcuccuucaauguggucua

SEQ ID NO: 278587 - RNA, 26 nt, Human
cauuuccacuuuguaggagccaggag

SEQ ID NO: 278588 - RNA, 18 nt, Human
ccaccacgcccagcugca

SEQ ID NO: 278589 - RNA, 18 nt, Human
ccaccaugccccugcccc

SEQ ID NO: 278590 - RNA, 24 nt, Human
ccacugucuccacccugggaagug

SEQ ID NO: 278591 - RNA, 18 nt, Human
ccagaaaguggguguagc

SEQ ID NO: 278592 - RNA, 21 nt, Human
ccagggcagaugcagcuaacg

SEQ ID NO: 278593 - RNA, 19 nt, Human
ccaguuccgcagcccgccg

SEQ ID NO: 278594 - RNA, 22 nt, Human
ccaucugggagcugucggucac

SEQ ID NO: 278595 - RNA, 23 nt, Human
ccaugggcagauggaacugggcu

SEQ ID NO: 278596 - RNA, 24 nt, Human
cccaauccuuuccuguccucgguu

SEQ ID NO: 278597 - RNA, 27 nt, Human
ccccaaugcuggagcaucagagagaaa

SEQ ID NO: 278598 - RNA, 19 nt, Human
ccccagugcuuuuugcacc

SEQ ID NO: 278599 - RNA, 24 nt, Human
ccccagugcuuuuugcaccucucc

SEQ ID NO: 278600 - RNA, 26 nt, Human
cccccaucucugcaaccccacugcag

SEQ ID NO: 278601 - RNA, 23 nt, Human
ccccugaccccuucaccuaccca

SEQ ID NO: 278602 - RNA, 24 nt, Human
cccgcucuguagcuccuggcucuu

SEQ ID NO: 278603 - RNA, 22 nt, Human
cccuccuguacugaagcucgcu

SEQ ID NO: 278604 - RNA, 18 nt, Human
cccugggagcuccugggg

SEQ ID NO: 278605 - RNA, 23 nt, Human
ccgccgagccauuuccacuuugu

SEQ ID NO: 278606 - RNA, 19 nt, Human
ccgggcuggucugugcugc

SEQ ID NO: 278607 - RNA, 20 nt, Human
ccgguaagcucccuggagac

SEQ ID NO: 278608 - RNA, 18 nt, Human
ccuaaguguugggauuac

SEQ ID NO: 278609 - RNA, 19 nt, Human
ccuaaguguugggauuaca

SEQ ID NO: 278610 - RNA, 24 nt, Human
ccuaaguguugggauuacaagcau

SEQ ID NO: 278611 - RNA, 22 nt, Human
ccuacugacaucuugcucuaga

SEQ ID NO: 278612 - RNA, 18 nt, Human
ccugaaggaggccgggcu

SEQ ID NO: 278613 - RNA, 20 nt, Human
ccugagcucaagugauucuc

SEQ ID NO: 278614 - RNA, 23 nt, Human
ccugagcucaagugauucuccug

SEQ ID NO: 278615 - RNA, 20 nt, Human
ccugccaacguugaggaaau

SEQ ID NO: 278616 - RNA, 19 nt, Human
cgaaaucaaagccaucuga

SEQ ID NO: 278617 - RNA, 22 nt, Human
cgaacugaacagacaguaacug

SEQ ID NO: 278618 - RNA, 23 nt, Human
cgguaagcucccuggagacccag

SEQ ID NO: 278619 - RNA, 24 nt, Human
cgugcagaaucucaguggcaucug

SEQ ID NO: 278620 - RNA, 26 nt, Human
cgugcagaaucucaguggcaucuggg

SEQ ID NO: 278621 - RNA, 23 nt, Human
cuaaguguugggauuacaagcau

SEQ ID NO: 278622 - RNA, 21 nt, Human
cucaagugauucuccugacuc

SEQ ID NO: 278623 - RNA, 20 nt, Human
cuccacugcuucugcccccc

SEQ ID NO: 278624 - RNA, 21 nt, Human
cucccccaucucugcaacccc

SEQ ID NO: 278625 - RNA, 23 nt, Human
cucccgcacuucagccucgugcc

SEQ ID NO: 278626 - RNA, 19 nt, Human
cuccugagcucaagugauu

SEQ ID NO: 278627 - RNA, 21 nt, Human
cucgugccgaauucuuggccu

SEQ ID NO: 278628 - RNA, 19 nt, Human
cucucccaggcacacaucc

SEQ ID NO: 278629 - RNA, 21 nt, Human
cucucccaggcacacaucccu

SEQ ID NO: 278630 - RNA, 25 nt, Human
cucucuggccucucaggggagagau

SEQ ID NO: 278631 - RNA, 23 nt, Human
cucugcagcuggugggccuuccu

SEQ ID NO: 278632 - RNA, 18 nt, Human
cucuggugaacaaacuuc

SEQ ID NO: 278633 - RNA, 21 nt, Human
cucuguagcuccuggcucuuc

SEQ ID NO: 278634 - RNA, 22 nt, Human
cucuuacacucuggggcccuau

SEQ ID NO: 278635 - RNA, 18 nt, Human
cugcuggucgccccccuc

SEQ ID NO: 278636 - RNA, 18 nt, Human
cuggccucucaggaauca

SEQ ID NO: 278637 - RNA, 24 nt, Human
cuguagugcacaucacuggccagc

SEQ ID NO: 278638 - RNA, 19 nt, Human
cuguggggaucucagcgcc

SEQ ID NO: 278639 - RNA, 24 nt, Human
cuucugagcaugccugaggcccag

SEQ ID NO: 278640 - RNA, 20 nt, Human
gaaaaacagccagaauuaca

SEQ ID NO: 278641 - RNA, 19 nt, Human
gaacuugauacugucuggu

SEQ ID NO: 278642 - RNA, 19 nt, Human
gaccccuucaccuacccaa

SEQ ID NO: 278643 - RNA, 19 nt, Human
gaguucaaaacaauagaau

SEQ ID NO: 278644 - RNA, 18 nt, Human
gaugaguucuccagccuu

SEQ ID NO: 278645 - RNA, 18 nt, Human
gauuacaagcaugagcca

SEQ ID NO: 278646 - RNA, 18 nt, Human
gcagcauucuccuccuug

SEQ ID NO: 278647 - RNA, 19 nt, Human
gccugaggcccagcugcuc

SEQ ID NO: 278648 - RNA, 21 nt, Human
gcucauuuccugccuuguagg

SEQ ID NO: 278649 - RNA, 18 nt, Human
gcuccuggcucuucuugg

SEQ ID NO: 278650 - RNA, 18 nt, Human
gcucuucuuggcgugcuc

SEQ ID NO: 278651 - RNA, 23 nt, Human
ggaaaaacagccagaauuacagg

SEQ ID NO: 278652 - RNA, 23 nt, Human
ggaaaucgcagggagguccaggc

SEQ ID NO: 278653 - RNA, 19 nt, Human
ggauggucggggaucaggg

SEQ ID NO: 278654 - RNA, 19 nt, Human
ggauuacaagcaugagcca

SEQ ID NO: 278655 - RNA, 19 nt, Human
ggcaugaaccaggucuggg

SEQ ID NO: 278656 - RNA, 20 nt, Human
gggcagaugcagcuaacggg

SEQ ID NO: 278657 - RNA, 19 nt, Human
gggcuggggcaggggcugc

SEQ ID NO: 278658 - RNA, 28 nt, Human
gggcuggucugugcugcugugaaacugg

SEQ ID NO: 278659 - RNA, 19 nt, Human
gugcaccauguccaugggc

SEQ ID NO: 278660 - RNA, 20 nt, Human
gugcugugaacuugugauac

SEQ ID NO: 278661 - RNA, 19 nt, Human
guguugggauuacaagcau

SEQ ID NO: 278662 - RNA, 23 nt, Human
guucaguuccuucucugagcugg

SEQ ID NO: 278663 - RNA, 22 nt, Human
uaaaagagauggggucucucug

SEQ ID NO: 278664 - RNA, 24 nt, Human
uaaaauuccugugggcaccucgau

SEQ ID NO: 278665 - RNA, 20 nt, Human
uaagcucccuggagacccag

SEQ ID NO: 278666 - RNA, 24 nt, Human
uacaagcaugagccaccacgccca

SEQ ID NO: 278667 - RNA, 20 nt, Human
uacucauugucacucuggag

SEQ ID NO: 278668 - RNA, 18 nt, Human
ucacugagauuugcagca

SEQ ID NO: 278669 - RNA, 19 nt, Human
ucagcauguucagccagca

SEQ ID NO: 278670 - RNA, 22 nt, Human
ucagccagcaggcccuccaugg

SEQ ID NO: 278671 - RNA, 20 nt, Human
uccaaggaggguggagguca

SEQ ID NO: 278672 - RNA, 22 nt, Human
uccaaggaggguggaggucauc

SEQ ID NO: 278673 - RNA, 23 nt, Human
uccccacucugaugaucuccagc

SEQ ID NO: 278674 - RNA, 18 nt, Human
ucccuaaguguugggauu

SEQ ID NO: 278675 - RNA, 19 nt, Human
ucccuggagacccaggccc

SEQ ID NO: 278676 - RNA, 20 nt, Human
ucccuggagacccaggcccc

SEQ ID NO: 278677 - RNA, 21 nt, Human
uccugagcucaagugauucuc

SEQ ID NO: 278678 - RNA, 24 nt, Human
uccugagcucaagugauucuccug

SEQ ID NO: 278679 - RNA, 26 nt, Human
uccuggcucuucuuggcgugcuccau

SEQ ID NO: 278680 - RNA, 22 nt, Human
uccuugggcccugggagcuccu

SEQ ID NO: 278681 - RNA, 23 nt, Human
uccuugggcccugggagcuccug

SEQ ID NO: 278682 - RNA, 23 nt, Human
ucgguucuuuuccacugucucca

SEQ ID NO: 278683 - RNA, 21 nt, Human
ucuagaacuccugagcucaag

SEQ ID NO: 278684 - RNA, 22 nt, Human
ucucaguggcaucuggguucac

SEQ ID NO: 278685 - RNA, 19 nt, Human
ucucccaggcacacauccc

SEQ ID NO: 278686 - RNA, 19 nt, Human
ucucuguugcccagauugg

SEQ ID NO: 278687 - RNA, 20 nt, Human
ucugcagcuggugggccuuc

SEQ ID NO: 278688 - RNA, 23 nt, Human
ucugcaggccucggucccgcagg

SEQ ID NO: 278689 - RNA, 21 nt, Human
ucuuacacucuggggcccuau

SEQ ID NO: 278690 - RNA, 23 nt, Human
ugacaugaacgggcaaacagcca

SEQ ID NO: 278691 - RNA, 18 nt, Human
ugacuuguagcgcaacuc

SEQ ID NO: 278692 - RNA, 18 nt, Human
ugagcucaagugauucuc

SEQ ID NO: 278693 - RNA, 22 nt, Human
ugagcugagucuggaaaaacag

SEQ ID NO: 278694 - RNA, 29 nt, Human
ugaggaaaugcuucauccuugggucaacc

SEQ ID NO: 278695 - RNA, 18 nt, Human
ugcuccgggucgcaggug

SEQ ID NO: 278696 - RNA, 21 nt, Human
uggaagaagacuaagaaagga

SEQ ID NO: 278697 - RNA, 22 nt, Human
uggacagacugcucauuuccug

SEQ ID NO: 278698 - RNA, 18 nt, Human
uggagccugccaacguug

SEQ ID NO: 278699 - RNA, 22 nt, Human
uggcagcaggaaggagacagag

SEQ ID NO: 278700 - RNA, 22 nt, Human
uggcaucaacacaggagggcau

SEQ ID NO: 278701 - RNA, 21 nt, Human
uggcaucuggguucaccuccc

SEQ ID NO: 278702 - RNA, 18 nt, Human
uggcauggaccaggugca

SEQ ID NO: 278703 - RNA, 18 nt, Human
ugggaaaucgcagggagg

SEQ ID NO: 278704 - RNA, 19 nt, Human
ugggauuacaagcaugagc

SEQ ID NO: 278705 - RNA, 22 nt, Human
ugggauuacaagcaugagccac

SEQ ID NO: 278706 - RNA, 23 nt, Human
ugggauuacaagcaugagccacc

SEQ ID NO: 278707 - RNA, 24 nt, Human
ugggauuacaagcaugagccacca

SEQ ID NO: 278708 - RNA, 24 nt, Human
ugggauuacaagcaugagccacca

SEQ ID NO: 278709 - RNA, 21 nt, Human
ugggcuggugggccauuccag

SEQ ID NO: 278710 - RNA, 24 nt, Human
ugggucaucgucgacacugcggua

SEQ ID NO: 278711 - RNA, 19 nt, Human
uguccucgguucuuuucca

SEQ ID NO: 278712 - RNA, 21 nt, Human
uguuggagaugauucagcaug

SEQ ID NO: 278713 - RNA, 24 nt, Human
uguugggauuacaagcaugagcca

SEQ ID NO: 278714 - RNA, 19 nt, Human
uucagccucgugccgaauu

SEQ ID NO: 278715 - RNA, 22 nt, Human
uucugggauggugaggcccagg

SEQ ID NO: 278716 - RNA, 18 nt, Human
uugccgaaaucaaagcca

SEQ ID NO: 278717 - RNA, 20 nt, Human
uugggauuacaagcaugagc

SEQ ID NO: 278718 - RNA, 20 nt, Human
uugggcccugggagcuccug

SEQ ID NO: 278719 - RNA, 22 nt, Human
uugggcccugggagcuccuggg

SEQ ID NO: 278720 - RNA, 21 nt, Human
uuuccuguccucgguucuuuu

SEQ ID NO: 278721 - RNA, 20 nt, Human
uuuguaggagccaggagggg

SEQ ID NO: 278722 - RNA, 25 nt, Human
uuuuuauuuaaaagagauggggucu

SEQ ID NO: 278723 - RNA, 25 nt, Human
uuuuuugcuccuucaauguggucua

SEQ ID NO: 278724 - RNA, 19 nt, Human
uuuuuuuuuuuuacggggg

SEQ ID NO: 278725 - RNA, 21 nt, Human
uuuuuuuuuuuuuugcuuuca

SEQ ID NO: 278726 - RNA, 21 nt, Human
uuuuuuuuuuuuuuuuacggg

SEQ ID NO: 278727 - RNA, 19 nt, Human
uuuuuuuuuuuuuuuugcu

SEQ ID NO: 278728 - RNA, 19 nt, Human
uuuuuuuuuuuuuuuugcu

SEQ ID NO: 278729 - RNA, 22 nt, Human
uuuuuuuuuuuuuuuugcuccu

SEQ ID NO: 278730 - RNA, 22 nt, Human
uuuuuuuuuuuuuuuugcuccu

SEQ ID NO: 278731 - RNA, 18 nt, Human
uuuuuuuuuuuuuuuuug

SEQ ID NO: 278732 - RNA, 20 nt, Human
uuuuuuuuuuuuuuuuugcu

SEQ ID NO: 278733 - RNA, 20 nt, Human
uuuuuuuuuuuuuuuuugcu

SEQ ID NO: 278734 - RNA, 24 nt, Human
uuuuuuuuuuuuuuuuuuacgggg

SEQ ID NO: 278735 - RNA, 25 nt, Human
uuuuuuuuuuuuuuuuuugcuccuu

SEQ ID NO: 278736 - RNA, 23 nt, Human
uuuuuuuuuuuuuuuuuugcuuu

SEQ ID NO: 278737 - RNA, 20 nt, Human
uuuuuuuuuuuuuuuuuugg

SEQ ID NO: 278738 - RNA, 20 nt, Human
uuuuuuuuuuuuuuuuuugg

SEQ ID NO: 278739 - RNA, 21 nt, Human
aaaaaggcacuucacugugaa

SEQ ID NO: 278740 - RNA, 22 nt, Human
aaauguuggagaccccggaacc

SEQ ID NO: 278741 - RNA, 22 nt, Human
aacugcuuuucagaugaaaaac

SEQ ID NO: 278742 - RNA, 18 nt, Human
aaguagcaggagcuucuc

SEQ ID NO: 278743 - RNA, 19 nt, Human
acaggaauacuucuccucc

SEQ ID NO: 278744 - RNA, 26 nt, Human
accccggaaccgccaugaacagcccc

SEQ ID NO: 278745 - RNA, 22 nt, Human
acugagagcuggggaaguagca

SEQ ID NO: 278746 - RNA, 19 nt, Human
acugcuuuucagaugaaaa

SEQ ID NO: 278747 - RNA, 21 nt, Human
agacugaagacagcaacagga

SEQ ID NO: 278748 - RNA, 21 nt, Human
agagguguguugagguguguu

SEQ ID NO: 278749 - RNA, 21 nt, Human
aggccucuggaaaaccaauuu

SEQ ID NO: 278750 - RNA, 22 nt, Human
agggugucagugcagcuugaaa

SEQ ID NO: 278751 - RNA, 20 nt, Human
auaacagggaguaacaagag

SEQ ID NO: 278752 - RNA, 25 nt, Human
caacaguaaaaagaaaaaaaaaauc

SEQ ID NO: 278753 - RNA, 26 nt, Human
cacagaccgggaaaaauguuggagac

SEQ ID NO: 278754 - RNA, 23 nt, Human
caccagcaagaaccucaagcucc

SEQ ID NO: 278755 - RNA, 22 nt, Human
cagaaaaauaacagggaguaaa

SEQ ID NO: 278756 - RNA, 22 nt, Human
cagcaacaggaauacuucuccu

SEQ ID NO: 278757 - RNA, 26 nt, Human
cagcaacaggaauacuucuccuccag

SEQ ID NO: 278758 - RNA, 24 nt, Human
cagccgcacccagacccgccccuc

SEQ ID NO: 278759 - RNA, 20 nt, Human
caggagcuucucugugagac

SEQ ID NO: 278760 - RNA, 18 nt, Human
ccacugccucugcuuugg

SEQ ID NO: 278761 - RNA, 20 nt, Human
ccagacccgccccucccacc

SEQ ID NO: 278762 - RNA, 23 nt, Human
ccagggcagaaaaauaacaggga

SEQ ID NO: 278763 - RNA, 23 nt, Human
ccccaaaacaggccucuggaaaa

SEQ ID NO: 278764 - RNA, 20 nt, Human
ccccggccacgugggccucc

SEQ ID NO: 278765 - RNA, 24 nt, Human
cccggaaccgccaugaacagcccc

SEQ ID NO: 278766 - RNA, 19 nt, Human
ccgcacccagacccgcccc

SEQ ID NO: 278767 - RNA, 20 nt, Human
cgcacccagacccgccccuc

SEQ ID NO: 278768 - RNA, 22 nt, Human
cgccaugaacagcccccaccaa

SEQ ID NO: 278769 - RNA, 23 nt, Human
cgccccggccacgugggccuccg

SEQ ID NO: 278770 - RNA, 26 nt, Human
cggaaccgccaugaacagcccccccu

SEQ ID NO: 278771 - RNA, 28 nt, Human
gaaaaauaacagggaguaaccgguaccc

SEQ ID NO: 278772 - RNA, 20 nt, Human
gaacagcccccaccaaggag

SEQ ID NO: 278773 - RNA, 18 nt, Human
gagaacuucucaaauaga

SEQ ID NO: 278774 - RNA, 22 nt, Human
gccgcacccagacccgccccuc

SEQ ID NO: 278775 - RNA, 23 nt, Human
gccgcacccagacccgccccucc

SEQ ID NO: 278776 - RNA, 21 nt, Human
gcucaagacacuguuuucaau

SEQ ID NO: 278777 - RNA, 20 nt, Human
gcuguggaagaacccagggc

SEQ ID NO: 278778 - RNA, 19 nt, Human
gggaaagccccaaaacagg

SEQ ID NO: 278779 - RNA, 22 nt, Human
gguguguuugugcuguggaaga

SEQ ID NO: 278780 - RNA, 24 nt, Human
guacaaaauggcaucugcucucaa

SEQ ID NO: 278781 - RNA, 19 nt, Human
guguugagguguguuugug

SEQ ID NO: 278782 - RNA, 22 nt, Human
guuugaaaaucacugaucacag

SEQ ID NO: 278783 - RNA, 19 nt, Human
uaacaaugcaccaaaguuu

SEQ ID NO: 278784 - RNA, 18 nt, Human
uaacagggaguaacaaga

SEQ ID NO: 278785 - RNA, 23 nt, Human
uaaccuaugaaaaaaguggagau

SEQ ID NO: 278786 - RNA, 20 nt, Human
ucaaaauucaguauucauuu

SEQ ID NO: 278787 - RNA, 21 nt, Human
ucaacaguaaaaagaaaaaaa

SEQ ID NO: 278788 - RNA, 25 nt, Human
ucaacaguaaaaagaaaaaaaaaau

SEQ ID NO: 278789 - RNA, 23 nt, Human
uccgaaccacgagucaugcggca

SEQ ID NO: 278790 - RNA, 18 nt, Human
ucuagagcagaugccagu

SEQ ID NO: 278791 - RNA, 18 nt, Human
ugaaaaaccugggguggc

SEQ ID NO: 278792 - RNA, 18 nt, Human
ugaaaaaccugggguggc

SEQ ID NO: 278793 - RNA, 18 nt, Human
ugaaaguggcucuuuucu

SEQ ID NO: 278794 - RNA, 24 nt, Human
ugacauuucuccaaaaauuaggca

SEQ ID NO: 278795 - RNA, 22 nt, Human
ugagguguguuugugcugugga

SEQ ID NO: 278796 - RNA, 25 nt, Human
ugccaggcgccugaguccccgcccc

SEQ ID NO: 278797 - RNA, 22 nt, Human
ugccucugcuuuggacagauuu

SEQ ID NO: 278798 - RNA, 19 nt, Human
ugcuacuuuagagcucaag

SEQ ID NO: 278799 - RNA, 20 nt, Human
ugggguggcagagguguguu

SEQ ID NO: 278800 - RNA, 19 nt, Human
uguggaagaacccagggca

SEQ ID NO: 278801 - RNA, 18 nt, Human
uuagagcucaagacacug

SEQ ID NO: 278802 - RNA, 23 nt, Human
uucaacaguaaaaagaaaaaaaa

SEQ ID NO: 278803 - RNA, 21 nt, Human
uucuccugggaaagccccaaa

SEQ ID NO: 278804 - RNA, 22 nt, Human
uuuacaauauuugaacaucugc

SEQ ID NO: 278805 - RNA, 22 nt, Human
uuucaguuucaucuuucuccug

SEQ ID NO: 278806 - RNA, 21 nt, Human
aaaacaaguaaacaaagugca

SEQ ID NO: 278807 - RNA, 20 nt, Human
aaaaguagacuuuuauuaca

SEQ ID NO: 278808 - RNA, 22 nt, Human
aaacaaguaaacaaagugcaga

SEQ ID NO: 278809 - RNA, 24 nt, Human
aaaggaugaugcucagaaccaggg

SEQ ID NO: 278810 - RNA, 20 nt, Human
aaggcggcugcugagaaggc

SEQ ID NO: 278811 - RNA, 22 nt, Human
accuuucucucccgccccggcc

SEQ ID NO: 278812 - RNA, 21 nt, Human
agagaggggaggggaaaggau

SEQ ID NO: 278813 - RNA, 21 nt, Human
agaggggaggaagagagggga

SEQ ID NO: 278814 - RNA, 24 nt, Human
agaggggaggaagagaggggaggg

SEQ ID NO: 278815 - RNA, 23 nt, Human
agggccaccacugcagcaccacc

SEQ ID NO: 278816 - RNA, 21 nt, Human
agugcagaggggaggaagaga

SEQ ID NO: 278817 - RNA, 20 nt, Human
aucacagcgacucccucaca

SEQ ID NO: 278818 - RNA, 21 nt, Human
augcucagaaccagggagccc

SEQ ID NO: 278819 - RNA, 19 nt, Human
caaaacaaguaaacaaagu

SEQ ID NO: 278820 - RNA, 19 nt, Human
caccuuucucucccgcccc

SEQ ID NO: 278821 - RNA, 18 nt, Human
cagaggggaggaagagag

SEQ ID NO: 278822 - RNA, 28 nt, Human
caggcccacgucugugcaaaacaaguaa

SEQ ID NO: 278823 - RNA, 19 nt, Human
ccccggaucacagcgacuc

SEQ ID NO: 278824 - RNA, 18 nt, Human
ccgcgccccgcagccugc

SEQ ID NO: 278825 - RNA, 19 nt, Human
ccgugggccuccuuuccac

SEQ ID NO: 278826 - RNA, 20 nt, Human
cgcuucagcuccagcucggg

SEQ ID NO: 278827 - RNA, 22 nt, Human
cuagugcccgugggccuccuuu

SEQ ID NO: 278828 - RNA, 19 nt, Human
cugcagcaccaccuuucuc

SEQ ID NO: 278829 - RNA, 20 nt, Human
cugcagcaccaccuuucucu

SEQ ID NO: 278830 - RNA, 18 nt, Human
cuggaaggaacacucagg

SEQ ID NO: 278831 - RNA, 24 nt, Human
cuggggggaagggacaggagggcu

SEQ ID NO: 278832 - RNA, 18 nt, Human
gaauggccccccagggcc

SEQ ID NO: 278833 - RNA, 19 nt, Human
gagaggggaggggaaagga

SEQ ID NO: 278834 - RNA, 18 nt, Human
gaggaagagaggggaggg

SEQ ID NO: 278835 - RNA, 19 nt, Human
gcuucagcuccagcucggg

SEQ ID NO: 278836 - RNA, 20 nt, Human
ggagcccccccagcccuccu

SEQ ID NO: 278837 - RNA, 24 nt, Human
ggagggcugcagcacguccaggga

SEQ ID NO: 278838 - RNA, 20 nt, Human
uacagcagcaacugaggcga

SEQ ID NO: 278839 - RNA, 21 nt, Human
uacagcagcaacugaggcgaa

SEQ ID NO: 278840 - RNA, 18 nt, Human
ucacagcgacucccucac

SEQ ID NO: 278841 - RNA, 22 nt, Human
ucagcgacuagcccccaacuag

SEQ ID NO: 278842 - RNA, 24 nt, Human
ucagcuccagcucggguuccgggg

SEQ ID NO: 278843 - RNA, 22 nt, Human
ucaggccucccgacuccgcgcc

SEQ ID NO: 278844 - RNA, 24 nt, Human
uccacacaggcugggcgggagccg

SEQ ID NO: 278845 - RNA, 23 nt, Human
ugaauaauaaaggagggaagggg

SEQ ID NO: 278846 - RNA, 23 nt, Human
ugaggcgaaucgaauggcccccc

SEQ ID NO: 278847 - RNA, 24 nt, Human
uggggggaagggacaggagggcug

SEQ ID NO: 278848 - RNA, 19 nt, Human
aaaaagacuaacgacagcu

SEQ ID NO: 278849 - RNA, 23 nt, Human
aaacugucuuauuuuuauuuuca

SEQ ID NO: 278850 - RNA, 24 nt, Human
aaagguggggggaggggggaaccc

SEQ ID NO: 278851 - RNA, 20 nt, Human
aaaugccgaaaugcacugca

SEQ ID NO: 278852 - RNA, 22 nt, Human
aaccauaaaggaccacaaaauc

SEQ ID NO: 278853 - RNA, 24 nt, Human
aaugacaguaaucuaggacccaga

SEQ ID NO: 278854 - RNA, 26 nt, Human
acaccucccaaauguuuuucugauuu

SEQ ID NO: 278855 - RNA, 18 nt, Human
acauaaauuacaaaagag

SEQ ID NO: 278856 - RNA, 21 nt, Human
acccagaauggacuggaccag

SEQ ID NO: 278857 - RNA, 19 nt, Human
acuaggccuacugugcccc

SEQ ID NO: 278858 - RNA, 20 nt, Human
acucuugacaaugaaaacgg

SEQ ID NO: 278859 - RNA, 20 nt, Human
acuuugaagaagcucuuaag

SEQ ID NO: 278860 - RNA, 20 nt, Human
agaaaauauacucucuaccc

SEQ ID NO: 278861 - RNA, 24 nt, Human
agagaaugucacaaagauucguuc

SEQ ID NO: 278862 - RNA, 22 nt, Human
agauuuugugaaacguugugug

SEQ ID NO: 278863 - RNA, 19 nt, Human
agcaaguauauacuguaca

SEQ ID NO: 278864 - RNA, 22 nt, Human
aggaaaucaagaauacccauuu

SEQ ID NO: 278865 - RNA, 22 nt, Human
aggaacuuuuaaaaccacauuu

SEQ ID NO: 278866 - RNA, 18 nt, Human
agguggggggagggggga

SEQ ID NO: 278867 - RNA, 19 nt, Human
agguggggggaggggggaa

SEQ ID NO: 278868 - RNA, 20 nt, Human
auauacucucuacccauaug

SEQ ID NO: 278869 - RNA, 21 nt, Human
augccaacagcuaagaccagc

SEQ ID NO: 278870 - RNA, 19 nt, Human
auuucacaacaauguccac

SEQ ID NO: 278871 - RNA, 22 nt, Human
caaacaagugcuuaggauaaac

SEQ ID NO: 278872 - RNA, 20 nt, Human
caacaaaauaucuacauaua

SEQ ID NO: 278873 - RNA, 19 nt, Human
caagagacagguggaucug

SEQ ID NO: 278874 - RNA, 24 nt, Human
cacauuguuuaugccuaaaaacaa

SEQ ID NO: 278875 - RNA, 24 nt, Human
cagaagguccacugggcuagacac

SEQ ID NO: 278876 - RNA, 21 nt, Human
ccaagaguagguaauaguucu

SEQ ID NO: 278877 - RNA, 19 nt, Human
ccaaggcaaaccuguuuug

SEQ ID NO: 278878 - RNA, 20 nt, Human
ccaggacccuggaccgccgg

SEQ ID NO: 278879 - RNA, 24 nt, Human
ccagguuacuaggccuacugugcc

SEQ ID NO: 278880 - RNA, 21 nt, Human
cccaggacccuggaccgccgg

SEQ ID NO: 278881 - RNA, 20 nt, Human
cccauaggcaaagcucugaa

SEQ ID NO: 278882 - RNA, 20 nt, Human
ccgccgguguccuccguucu

SEQ ID NO: 278883 - RNA, 18 nt, Human
ccgcgcccuccgcucagc

SEQ ID NO: 278884 - RNA, 19 nt, Human
cucuugacaaugaaaacgg

SEQ ID NO: 278885 - RNA, 21 nt, Human
cugaaauguauccauaacaau

SEQ ID NO: 278886 - RNA, 29 nt, Human
cugaauuuccuuuucuucuuucacaaaaa

SEQ ID NO: 278887 - RNA, 25 nt, Human
cuuuuagacaaugacaguaaucuag

SEQ ID NO: 278888 - RNA, 21 nt, Human
gaaaccauaaaggaccacaaa

SEQ ID NO: 278889 - RNA, 22 nt, Human
gacagcuauacauagucaccaa

SEQ ID NO: 278890 - RNA, 18 nt, Human
gacaguaaucuaggaccc

SEQ ID NO: 278891 - RNA, 20 nt, Human
gaccagcuuuggucgaaguc

SEQ ID NO: 278892 - RNA, 24 nt, Human
ggggauaaagaaugcugagagaga

SEQ ID NO: 278893 - RNA, 22 nt, Human
gggggaggggggaacccaauag

SEQ ID NO: 278894 - RNA, 21 nt, Human
guaagcaucagcaaugugacu

SEQ ID NO: 278895 - RNA, 24 nt, Human
guauauacuguacaaacuguuccu

SEQ ID NO: 278896 - RNA, 22 nt, Human
gugaaaaaugaauauagagaca

SEQ ID NO: 278897 - RNA, 23 nt, Human
gugauguugcauuauuuuuuauc

SEQ ID NO: 278898 - RNA, 22 nt, Human
uaaaaacaaccgaacauagaaa

SEQ ID NO: 278899 - RNA, 23 nt, Human
uaaaaacaaccgaacauagaaau

SEQ ID NO: 278900 - RNA, 21 nt, Human
uaaaaguuacuuuuagacaau

SEQ ID NO: 278901 - RNA, 28 nt, Human
uaaacaaaguaucaaaccaaucaacggg

SEQ ID NO: 278902 - RNA, 22 nt, Human
uaacaccuauaagcauauagca

SEQ ID NO: 278903 - RNA, 25 nt, Human
uacaguaacacucuugacaaugaaa

SEQ ID NO: 278904 - RNA, 19 nt, Human
uacauacaccauuacuugg

SEQ ID NO: 278905 - RNA, 24 nt, Human
uacuguacaaacuguuccuaacag

SEQ ID NO: 278906 - RNA, 18 nt, Human
uagaacacugugcugcug

SEQ ID NO: 278907 - RNA, 21 nt, Human
uagagaauacuacaguaacac

SEQ ID NO: 278908 - RNA, 22 nt, Human
uaguauaaacaaaguaucaaac

SEQ ID NO: 278909 - RNA, 26 nt, Human
uaguauaaacaaaguaucaaaccaug

SEQ ID NO: 278910 - RNA, 25 nt, Human
uauaaaaagcuuuacuuaaaauuaa

SEQ ID NO: 278911 - RNA, 21 nt, Human
uaugcuuuuaguguuggaaua

SEQ ID NO: 278912 - RNA, 19 nt, Human
uauuacagaagugacccuu

SEQ ID NO: 278913 - RNA, 19 nt, Human
ucacaaagauucguucucg

SEQ ID NO: 278914 - RNA, 23 nt, Human
ucacaacaauguccacaaagaca

SEQ ID NO: 278915 - RNA, 19 nt, Human
ucaguaagcaucagcaaug

SEQ ID NO: 278916 - RNA, 22 nt, Human
ucaguucugaggaaaucaagaa

SEQ ID NO: 278917 - RNA, 22 nt, Human
ucauguuuccuucuuuucccag

SEQ ID NO: 278918 - RNA, 19 nt, Human
uccacaaagacauugaagu

SEQ ID NO: 278919 - RNA, 20 nt, Human
uccugcagaggaaauaacag

SEQ ID NO: 278920 - RNA, 27 nt, Human
ucucccaaaaagacuaacgacagcuuu

SEQ ID NO: 278921 - RNA, 22 nt, Human
ucuucagaagguccacugggcu

SEQ ID NO: 278922 - RNA, 26 nt, Human
ugaaaaaugaauauagagacaugaaa

SEQ ID NO: 278923 - RNA, 19 nt, Human
ugacaaacaagugcuuagg

SEQ ID NO: 278924 - RNA, 19 nt, Human
ugauuuguuuuugauucuu

SEQ ID NO: 278925 - RNA, 21 nt, Human
ugcacagauaaauuucgcauc

SEQ ID NO: 278926 - RNA, 19 nt, Human
ugcagaguuuugaacacuu

SEQ ID NO: 278927 - RNA, 26 nt, Human
ugccuaaaaacaaccgaacauagaag

SEQ ID NO: 278928 - RNA, 19 nt, Human
ugcugagagagaaugucac

SEQ ID NO: 278929 - RNA, 18 nt, Human
uggaccgccgguguccuc

SEQ ID NO: 278930 - RNA, 24 nt, Human
uggcaaaugaaacugagcauuccu

SEQ ID NO: 278931 - RNA, 19 nt, Human
uggcacaaaugccgaaaug

SEQ ID NO: 278932 - RNA, 23 nt, Human
uggcacaaaugccgaaaugcacu

SEQ ID NO: 278933 - RNA, 22 nt, Human
uggggggaggggggaacccaau

SEQ ID NO: 278934 - RNA, 20 nt, Human
uguaaaaaguagaacacugu

SEQ ID NO: 278935 - RNA, 21 nt, Human
uguaauagaaaccauaaagga

SEQ ID NO: 278936 - RNA, 26 nt, Human
uguacaaacuguuccuaacagucucc

SEQ ID NO: 278937 - RNA, 18 nt, Human
uguccuuuaaauguggag

SEQ ID NO: 278938 - RNA, 24 nt, Human
uguuauagauuuucauauuuggag

SEQ ID NO: 278939 - RNA, 19 nt, Human
uguucuuccuuuuaauucu

SEQ ID NO: 278940 - RNA, 19 nt, Human
uguuuugucuuuuuauauu

SEQ ID NO: 278941 - RNA, 19 nt, Human
uuacauagguaaagucuug

SEQ ID NO: 278942 - RNA, 21 nt, Human
uucaagagacagguggaucug

SEQ ID NO: 278943 - RNA, 25 nt, Human
uucacugcauuaauuagcuuaccuc

SEQ ID NO: 278944 - RNA, 20 nt, Human
uuuccaaucccauucacugc

SEQ ID NO: 278945 - RNA, 20 nt, Human
uuucugauuucugaagcuau

SEQ ID NO: 278946 - RNA, 22 nt, Human
uuugauagauauuguuuaugaa

SEQ ID NO: 278947 - RNA, 21 nt, Human
aggcgguggcggccggcccug

SEQ ID NO: 278948 - RNA, 21 nt, Human
aucccgcuucccaggacccac

SEQ ID NO: 278949 - RNA, 18 nt, Human
caccaagcuggagcgaug

SEQ ID NO: 278950 - RNA, 26 nt, Human
caccaagcuggagcgauggacauccc

SEQ ID NO: 278951 - RNA, 18 nt, Human
caggccaacgugacugca

SEQ ID NO: 278952 - RNA, 20 nt, Human
cccuggugcugccgcagccg

SEQ ID NO: 278953 - RNA, 22 nt, Human
cccuggugcugccgcagccgcg

SEQ ID NO: 278954 - RNA, 19 nt, Human
ccugaaccccucccccacc

SEQ ID NO: 278955 - RNA, 19 nt, Human
cgauggacaucccgcuucc

SEQ ID NO: 278956 - RNA, 25 nt, Human
cuagaggcgguggcggccggcccuu

SEQ ID NO: 278957 - RNA, 22 nt, Human
gaacaggccugaaccccucccc

SEQ ID NO: 278958 - RNA, 24 nt, Human
gaacaggccugaaccccuccccca

SEQ ID NO: 278959 - RNA, 22 nt, Human
gacccaccuccuccgcguucua

SEQ ID NO: 278960 - RNA, 23 nt, Human
gcccuggugcugccgcagccgcg

SEQ ID NO: 278961 - RNA, 21 nt, Human
gccugaaccccucccccaccc

SEQ ID NO: 278962 - RNA, 21 nt, Human
ggcccuggugcugccgcagcc

SEQ ID NO: 278963 - RNA, 20 nt, Human
ugccgcagccgcggggaaca

SEQ ID NO: 278964 - RNA, 20 nt, Human
uuuuuuuucaggccaacgug

SEQ ID NO: 278965 - RNA, 23 nt, Human
uuuuuuuuuuuuuuuuuuucagg

SEQ ID NO: 278966 - RNA, 22 nt, Human
aaaaaaaaaaagguuaacaaaa

SEQ ID NO: 278967 - RNA, 26 nt, Human
aaacuuuccuuccaaagucgagagac

SEQ ID NO: 278968 - RNA, 22 nt, Human
aacugggugaauuauuguuucc

SEQ ID NO: 278969 - RNA, 23 nt, Human
acacauacacacacauaaguaua

SEQ ID NO: 278970 - RNA, 19 nt, Human
accccaugcuggagccucu

SEQ ID NO: 278971 - RNA, 20 nt, Human
acccugguaugaacaaaaac

SEQ ID NO: 278972 - RNA, 22 nt, Human
acccugguaugaacaaaaacug

SEQ ID NO: 278973 - RNA, 21 nt, Human
acugggugaauuauuguuucc

SEQ ID NO: 278974 - RNA, 19 nt, Human
agaugggaggcugaggccc

SEQ ID NO: 278975 - RNA, 22 nt, Human
auauauguauauauauacuuua

SEQ ID NO: 278976 - RNA, 24 nt, Human
augcggguuucauacauauauaua

SEQ ID NO: 278977 - RNA, 19 nt, Human
auguaaauguguaugucca

SEQ ID NO: 278978 - RNA, 21 nt, Human
auguguauguccauauguaca

SEQ ID NO: 278979 - RNA, 24 nt, Human
cacacacauaaguauacacacaca

SEQ ID NO: 278980 - RNA, 18 nt, Human
cagcaccugggccagccc

SEQ ID NO: 278981 - RNA, 19 nt, Human
cagucccuggaccuugcaa

SEQ ID NO: 278982 - RNA, 18 nt, Human
cauacauauauauauaua

SEQ ID NO: 278983 - RNA, 18 nt, Human
cauacauauauauauaua

SEQ ID NO: 278984 - RNA, 22 nt, Human
cauacauauauauauauauaua

SEQ ID NO: 278985 - RNA, 22 nt, Human
cauacauauauauauauauaua

SEQ ID NO: 278986 - RNA, 22 nt, Human
cauauguacacauauacauaua

SEQ ID NO: 278987 - RNA, 21 nt, Human
caugacccugguaugaacaaa

SEQ ID NO: 278988 - RNA, 18 nt, Human
caugagaucaaggauucc

SEQ ID NO: 278989 - RNA, 24 nt, Human
ccacgcagucccuggaccuugcaa

SEQ ID NO: 278990 - RNA, 22 nt, Human
ccauuugauugcaccucugcaa

SEQ ID NO: 278991 - RNA, 24 nt, Human
ccccaugcuggagccucuuuccuc

SEQ ID NO: 278992 - RNA, 28 nt, Human
cccugguaugaacaaaaacugggugacu

SEQ ID NO: 278993 - RNA, 19 nt, Human
ccuaccacccacuaaacug

SEQ ID NO: 278994 - RNA, 18 nt, Human
ccugggccagcccgagga

SEQ ID NO: 278995 - RNA, 19 nt, Human
cgccugaguuugucaguag

SEQ ID NO: 278996 - RNA, 20 nt, Human
cgccugaguuugucaguagc

SEQ ID NO: 278997 - RNA, 20 nt, Human
cucacacauacacacacaua

SEQ ID NO: 278998 - RNA, 20 nt, Human
cucugcaaacguguaaaaaa

SEQ ID NO: 278999 - RNA, 23 nt, Human
gaaguccugccacaauuuggcuu

SEQ ID NO: 279000 - RNA, 22 nt, Human
gcaaacguguaaaaaauuuuga

SEQ ID NO: 279001 - RNA, 21 nt, Human
gcaugacccugguaugaacaa

SEQ ID NO: 279002 - RNA, 20 nt, Human
gcgcaccuugauuucauaca

SEQ ID NO: 279003 - RNA, 19 nt, Human
gcuuuggugaagggcaugg

SEQ ID NO: 279004 - RNA, 24 nt, Human
ggagaugggaggcugaggcccggg

SEQ ID NO: 279005 - RNA, 18 nt, Human
gucaccuccgccugaguu

SEQ ID NO: 279006 - RNA, 18 nt, Human
guccauauguacacauau

SEQ ID NO: 279007 - RNA, 23 nt, Human
guggccacugggaggcagcuuug

SEQ ID NO: 279008 - RNA, 24 nt, Human
uaacaaaacuuuccuuccaaaguc

SEQ ID NO: 279009 - RNA, 25 nt, Human
uacacacacauuuccgcagaaagaa

SEQ ID NO: 279010 - RNA, 25 nt, Human
uacauauauauauauauauauguaa

SEQ ID NO: 279011 - RNA, 20 nt, Human
uacccuaccacccacuaaac

SEQ ID NO: 279012 - RNA, 23 nt, Human
uagacuagaaaacgaugccauaa

SEQ ID NO: 279013 - RNA, 23 nt, Human
uauauauauauguauauauauac

SEQ ID NO: 279014 - RNA, 21 nt, Human
uauauauauguaaauguguau

SEQ ID NO: 279015 - RNA, 18 nt, Human
uauauauauguauauaua

SEQ ID NO: 279016 - RNA, 18 nt, Human
uauauauguauauauaua

SEQ ID NO: 279017 - RNA, 24 nt, Human
uauguaaauguguauguccauaug

SEQ ID NO: 279018 - RNA, 18 nt, Human
uauguacacauauacaua

SEQ ID NO: 279019 - RNA, 25 nt, Human
uauguacacauauacauauauucac

SEQ ID NO: 279020 - RNA, 25 nt, Human
uauguauauauauacuuuauauaua

SEQ ID NO: 279021 - RNA, 25 nt, Human
uauguauauauauacuuuauauaua

SEQ ID NO: 279022 - RNA, 30 nt, Human
uauguauauauauacuuuauauauauguaa

SEQ ID NO: 279023 - RNA, 30 nt, Human
uauguccauauguacacauauacauagugu

SEQ ID NO: 279024 - RNA, 24 nt, Human
ucccagaaaaucaagaguggugcu

SEQ ID NO: 279025 - RNA, 21 nt, Human
ucucagcuggcagaccacgca

SEQ ID NO: 279026 - RNA, 24 nt, Human
ugaguccagcagggagaguucugu

SEQ ID NO: 279027 - RNA, 23 nt, Human
ugcaagcacaucucugacccacc

SEQ ID NO: 279028 - RNA, 21 nt, Human
uggcagaccacgcagucccug

SEQ ID NO: 279029 - RNA, 24 nt, Human
ugggaaggagaggagaugggaggc

SEQ ID NO: 279030 - RNA, 18 nt, Human
ugggaggcugaggcccgg

SEQ ID NO: 279031 - RNA, 22 nt, Human
ugggaggcugaggcccgggagc

SEQ ID NO: 279032 - RNA, 18 nt, Human
ugggugacugugucuggc

SEQ ID NO: 279033 - RNA, 21 nt, Human
uguauauauauacuuuauaua

SEQ ID NO: 279034 - RNA, 20 nt, Human
uguggccacugggaggcagc

SEQ ID NO: 279035 - RNA, 24 nt, Human
uguguauguccauauguacacaua

SEQ ID NO: 279036 - RNA, 26 nt, Human
uuaaaaaaaaaaagguuaacaaaacu

SEQ ID NO: 279037 - RNA, 19 nt, Human
uucauacauauauauauau

SEQ ID NO: 279038 - RNA, 23 nt, Human
uucauacauauauauauauauau

SEQ ID NO: 279039 - RNA, 25 nt, Human
uucauacauauauauauauauauau

SEQ ID NO: 279040 - RNA, 24 nt, Human
uugcaagcacaucucugacccacc

SEQ ID NO: 279041 - RNA, 26 nt, Human
uugcaagcacaucucugacccacccc

SEQ ID NO: 279042 - RNA, 20 nt, Human
uuuggcuuuuuugggacagu

SEQ ID NO: 279043 - RNA, 19 nt, Human
aaaaagcaacaaucaauca

SEQ ID NO: 279044 - RNA, 22 nt, Human
aaaacaaaaacaaaaacaaaaa

SEQ ID NO: 279045 - RNA, 23 nt, Human
aaaacaaaaacaaaaacaaaaaa

SEQ ID NO: 279046 - RNA, 21 nt, Human
aaaacuaaacuccguuuaaaa

SEQ ID NO: 279047 - RNA, 21 nt, Human
aaacaaaaacaaaaaacaccu

SEQ ID NO: 279048 - RNA, 23 nt, Human
aaacaaaaacaaaaaacaccuca

SEQ ID NO: 279049 - RNA, 28 nt, Human
aaacaaaaacaaaaacaaaaaacaccuc

SEQ ID NO: 279050 - RNA, 20 nt, Human
aaaguuugucccucgagggg

SEQ ID NO: 279051 - RNA, 31 nt, Human
aacauggcaaaaaaacaaaaacaaaaacaaa

SEQ ID NO: 279052 - RNA, 18 nt, Human
aagaaaaccacaaggaaa

SEQ ID NO: 279053 - RNA, 22 nt, Human
aagaaaaccacaaggaaagcac

SEQ ID NO: 279054 - RNA, 21 nt, Human
aagaaaagcuccuagcaacua

SEQ ID NO: 279055 - RNA, 22 nt, Human
aagcagaaggaggaccagccgg

SEQ ID NO: 279056 - RNA, 27 nt, Human
aagcagcaccaacugagccccaguagg

SEQ ID NO: 279057 - RNA, 24 nt, Human
aagcuggugucugcucgugacaca

SEQ ID NO: 279058 - RNA, 25 nt, Human
aaggagcugaacugcugagggugau

SEQ ID NO: 279059 - RNA, 22 nt, Human
aaguguaauagauauaugucag

SEQ ID NO: 279060 - RNA, 25 nt, Human
aaugauacagcaucuuacaggggga

SEQ ID NO: 279061 - RNA, 21 nt, Human
aauuguuuaauuuaaggugga

SEQ ID NO: 279062 - RNA, 21 nt, Human
acaaaaaacaccucacacaca

SEQ ID NO: 279063 - RNA, 22 nt, Human
acaaauaacacauucugaauca

SEQ ID NO: 279064 - RNA, 24 nt, Human
acacaccuauuaguaucucagagc

SEQ ID NO: 279065 - RNA, 19 nt, Human
acauaagcgacacacagga

SEQ ID NO: 279066 - RNA, 19 nt, Human
accaaccaagaaaaccaca

SEQ ID NO: 279067 - RNA, 23 nt, Human
accaaccaagaaaaccacaagga

SEQ ID NO: 279068 - RNA, 18 nt, Human
acgcggcgggcgguccgg

SEQ ID NO: 279069 - RNA, 18 nt, Human
acgcggcgggcgguccgg

SEQ ID NO: 279070 - RNA, 18 nt, Human
acgcggcgggcgguccgg

SEQ ID NO: 279071 - RNA, 18 nt, Human
acgcggcgggcgguccgg

SEQ ID NO: 279072 - RNA, 24 nt, Human
agaaaagcuccuagcaacuacaaa

SEQ ID NO: 279073 - RNA, 23 nt, Human
agaaagcagcaccaacuccaguc

SEQ ID NO: 279074 - RNA, 19 nt, Human
agauaccaaaaggcuauag

SEQ ID NO: 279075 - RNA, 24 nt, Human
agcagcagcggcggcaggagaggc

SEQ ID NO: 279076 - RNA, 18 nt, Human
agccggcgguggcggcgg

SEQ ID NO: 279077 - RNA, 26 nt, Human
agccggcgguggcggcggcggcagca

SEQ ID NO: 279078 - RNA, 18 nt, Human
aggaaagcacaaggaaag

SEQ ID NO: 279079 - RNA, 22 nt, Human
aggaaagcacaaggaaagcaag

SEQ ID NO: 279080 - RNA, 24 nt, Human
aggagaaguaaaagcagaaggagg

SEQ ID NO: 279081 - RNA, 31 nt, Human
aggaggaccagccggcgguggcggcggcggg

SEQ ID NO: 279082 - RNA, 20 nt, Human
aguaagcacaaucccaagug

SEQ ID NO: 279083 - RNA, 18 nt, Human
aucugaggggagaugcag

SEQ ID NO: 279084 - RNA, 19 nt, Human
augaugcaacaaaauugga

SEQ ID NO: 279085 - RNA, 21 nt, Human
auugcuuuuguuaauguucuc

SEQ ID NO: 279086 - RNA, 19 nt, Human
caaaaacaaaaaacaccuc

SEQ ID NO: 279087 - RNA, 29 nt, Human
caaaaacaaaaaacaccucacacacauug

SEQ ID NO: 279088 - RNA, 26 nt, Human
caaaaacaaaaacaaaaaacaccuca

SEQ ID NO: 279089 - RNA, 18 nt, Human
caaacuucuucucccgca

SEQ ID NO: 279090 - RNA, 24 nt, Human
caacaaaauuggaaaaaaagcaac

SEQ ID NO: 279091 - RNA, 22 nt, Human
caacacuauaaauaacauggca

SEQ ID NO: 279092 - RNA, 21 nt, Human
caacaguaagcacaaucccaa

SEQ ID NO: 279093 - RNA, 22 nt, Human
caacaguaagcacaaucccaag

SEQ ID NO: 279094 - RNA, 23 nt, Human
caacccgaucggggagagguuau

SEQ ID NO: 279095 - RNA, 23 nt, Human
caacccgaucggggagagguuau

SEQ ID NO: 279096 - RNA, 23 nt, Human
caacccgaucggggagagguuau

SEQ ID NO: 279097 - RNA, 23 nt, Human
caacccgaucggggagagguuau

SEQ ID NO: 279098 - RNA, 23 nt, Human
caaggccauuauuaaaaucaaga

SEQ ID NO: 279099 - RNA, 24 nt, Human
caaggccauuauuaaaaucaagaa

SEQ ID NO: 279100 - RNA, 21 nt, Human
cacaaggaaagcacaaggaaa

SEQ ID NO: 279101 - RNA, 25 nt, Human
cacacaccuauuaguaucucagagc

SEQ ID NO: 279102 - RNA, 22 nt, Human
cacaucuagcucuagguggaau

SEQ ID NO: 279103 - RNA, 22 nt, Human
cacaucuuuucugaauaaccaa

SEQ ID NO: 279104 - RNA, 21 nt, Human
caccuauuaguaucucagagc

SEQ ID NO: 279105 - RNA, 24 nt, Human
caccucccgcccgcagguuggagg

SEQ ID NO: 279106 - RNA, 22 nt, Human
cacgcagaggcccccccaacca

SEQ ID NO: 279107 - RNA, 24 nt, Human
cacgcagaggcccccccaaccaaa

SEQ ID NO: 279108 - RNA, 21 nt, Human
cagcaacaagaaagcagcacc

SEQ ID NO: 279109 - RNA, 23 nt, Human
cagcagcagcggcggcaggagag

SEQ ID NO: 279110 - RNA, 18 nt, Human
cagcagcggcggcaggag

SEQ ID NO: 279111 - RNA, 24 nt, Human
cagcagcggcggcaggagaggcuu

SEQ ID NO: 279112 - RNA, 19 nt, Human
cagccacccaccucccgcc

SEQ ID NO: 279113 - RNA, 20 nt, Human
cagccacccaccucccgccc

SEQ ID NO: 279114 - RNA, 20 nt, Human
cagccacccaccucccgccc

SEQ ID NO: 279115 - RNA, 24 nt, Human
cagccggcgguggcggcggcggca

SEQ ID NO: 279116 - RNA, 19 nt, Human
cauggcaaaaaaacaaaaa

SEQ ID NO: 279117 - RNA, 21 nt, Human
ccacccaccucccgcccgcug

SEQ ID NO: 279118 - RNA, 18 nt, Human
ccagccggcgguggcggc

SEQ ID NO: 279119 - RNA, 24 nt, Human
ccagccggcgguggcggcggcuuu

SEQ ID NO: 279120 - RNA, 19 nt, Human
cccgcccgcagguuggagg

SEQ ID NO: 279121 - RNA, 20 nt, Human
cccucgagggggagagcgag

SEQ ID NO: 279122 - RNA, 20 nt, Human
cccucgauggggagagcgag

SEQ ID NO: 279123 - RNA, 20 nt, Human
cccucgauggggagagcgag

SEQ ID NO: 279124 - RNA, 20 nt, Human
ccggagccucacacaccuau

SEQ ID NO: 279125 - RNA, 22 nt, Human
ccggagccucacacaccuauua

SEQ ID NO: 279126 - RNA, 23 nt, Human
ccuccagaagaaggccuggccgc

SEQ ID NO: 279127 - RNA, 19 nt, Human
ccucgauggggagagcgag

SEQ ID NO: 279128 - RNA, 19 nt, Human
ccucgauggggagagcgag

SEQ ID NO: 279129 - RNA, 23 nt, Human
cggacgcgugggcgcgugggguu

SEQ ID NO: 279130 - RNA, 25 nt, Human
cggcggcagcagcagcggcggcagg

SEQ ID NO: 279131 - RNA, 20 nt, Human
cguccggcagccgccgccgc

SEQ ID NO: 279132 - RNA, 20 nt, Human
cguccggcagccgccgccgc

SEQ ID NO: 279133 - RNA, 20 nt, Human
cguccggcagccgccgccgc

SEQ ID NO: 279134 - RNA, 20 nt, Human
cguccggcagccgccgccgc

SEQ ID NO: 279135 - RNA, 21 nt, Human
cuacuccaaaccaucccgggc

SEQ ID NO: 279136 - RNA, 21 nt, Human
cuccgcgcgagcccggaguuc

SEQ ID NO: 279137 - RNA, 18 nt, Human
cucuuuguugucuuauuc

SEQ ID NO: 279138 - RNA, 26 nt, Human
cugagggugauggucaaacuucuucu

SEQ ID NO: 279139 - RNA, 21 nt, Human
cugcuguuucugggccacuuu

SEQ ID NO: 279140 - RNA, 23 nt, Human
cuuuuguuaauguucucaugcga

SEQ ID NO: 279141 - RNA, 19 nt, Human
gaaggagcugaacugcuga

SEQ ID NO: 279142 - RNA, 24 nt, Human
gacaccgucaugcuggacacgggu

SEQ ID NO: 279143 - RNA, 18 nt, Human
gacacggguggagacauu

SEQ ID NO: 279144 - RNA, 22 nt, Human
gagaaguaaaagcagaaggagg

SEQ ID NO: 279145 - RNA, 19 nt, Human
gagcccggaguuccaacaa

SEQ ID NO: 279146 - RNA, 19 nt, Human
gagcccggaguuccaacaa

SEQ ID NO: 279147 - RNA, 19 nt, Human
gagcccggaguuccaacaa

SEQ ID NO: 279148 - RNA, 21 nt, Human
gagcggccgcgcugaggcgcu

SEQ ID NO: 279149 - RNA, 21 nt, Human
gagcggccgcgcugaggcgcu

SEQ ID NO: 279150 - RNA, 21 nt, Human
gagcggccgcgcugaggcgcu

SEQ ID NO: 279151 - RNA, 26 nt, Human
gcaaaaaaacaaaaacaaaaacaaaa

SEQ ID NO: 279152 - RNA, 18 nt, Human
gcagaggcccccccaacc

SEQ ID NO: 279153 - RNA, 21 nt, Human
gcagaggcccccccaaccaaa

SEQ ID NO: 279154 - RNA, 20 nt, Human
gcagcagcagcggcggcagg

SEQ ID NO: 279155 - RNA, 20 nt, Human
gccccgcagccacccaccuc

SEQ ID NO: 279156 - RNA, 24 nt, Human
gcccuggcucucggggcugcuccu

SEQ ID NO: 279157 - RNA, 24 nt, Human
gcccuggcucucggggcugcuccu

SEQ ID NO: 279158 - RNA, 24 nt, Human
gcccuggcucucggggcugcuccu

SEQ ID NO: 279159 - RNA, 24 nt, Human
gcccuggcucucggggcugcuccu

SEQ ID NO: 279160 - RNA, 26 nt, Human
gcccuggcucucggggcugcuccuga

SEQ ID NO: 279161 - RNA, 26 nt, Human
gcccuggcucucggggcugcuccuga

SEQ ID NO: 279162 - RNA, 26 nt, Human
gcccuggcucucggggcugcuccuga

SEQ ID NO: 279163 - RNA, 26 nt, Human
gcccuggcucucggggcugcuccuga

SEQ ID NO: 279164 - RNA, 21 nt, Human
gccggcgguggcggcggcggc

SEQ ID NO: 279165 - RNA, 22 nt, Human
gcggcgcggacgcggcgggcgg

SEQ ID NO: 279166 - RNA, 22 nt, Human
gcggcgcggacgcggcgggcgg

SEQ ID NO: 279167 - RNA, 22 nt, Human
gcggcgcggacgcggcgggcgg

SEQ ID NO: 279168 - RNA, 23 nt, Human
gcggcgcggacgcggcgggcggu

SEQ ID NO: 279169 - RNA, 24 nt, Human
gcgggcgguccggccaccuggaac

SEQ ID NO: 279170 - RNA, 24 nt, Human
gcgggcgguccggccaccuggaac

SEQ ID NO: 279171 - RNA, 24 nt, Human
gcgggcgguccggccaccuggaac

SEQ ID NO: 279172 - RNA, 24 nt, Human
gcgggcgguccggccaccuggaac

SEQ ID NO: 279173 - RNA, 21 nt, Human
ggagcgcggcgcggacgcggc

SEQ ID NO: 279174 - RNA, 21 nt, Human
ggagcgcggcgcggacgcggc

SEQ ID NO: 279175 - RNA, 21 nt, Human
ggagcgcggcgcggacgcggc

SEQ ID NO: 279176 - RNA, 21 nt, Human
ggagcgcggcgcggacgcggc

SEQ ID NO: 279177 - RNA, 24 nt, Human
ggcgcggacgcggcgggcgguccg

SEQ ID NO: 279178 - RNA, 24 nt, Human
ggcgcggacgcggcgggcgguccg

SEQ ID NO: 279179 - RNA, 24 nt, Human
ggcgcggacgcggcgggcgguccg

SEQ ID NO: 279180 - RNA, 24 nt, Human
ggcgcggacgcggcgggcgguccg

SEQ ID NO: 279181 - RNA, 22 nt, Human
guggaaggagcugaacugcuga

SEQ ID NO: 279182 - RNA, 19 nt, Human
gugggcgcgugggguugug

SEQ ID NO: 279183 - RNA, 20 nt, Human
uaaaacagcauuauucaaca

SEQ ID NO: 279184 - RNA, 19 nt, Human
uaaaagugagacuuugaaa

SEQ ID NO: 279185 - RNA, 20 nt, Human
uaaagaagauggacuguuca

SEQ ID NO: 279186 - RNA, 23 nt, Human
uaacauggcaaaaaaacaaaaac

SEQ ID NO: 279187 - RNA, 18 nt, Human
uaaccaaccaagaaaacc

SEQ ID NO: 279188 - RNA, 18 nt, Human
uacagcuuagcaacaccc

SEQ ID NO: 279189 - RNA, 21 nt, Human
uacagcuuagcaacacccuuu

SEQ ID NO: 279190 - RNA, 18 nt, Human
uagaggucucucuucuuc

SEQ ID NO: 279191 - RNA, 19 nt, Human
uagaggucucucuucuucc

SEQ ID NO: 279192 - RNA, 22 nt, Human
uagcaauauaaaacuaaacucc

SEQ ID NO: 279193 - RNA, 19 nt, Human
uaucucagagccaacuagu

SEQ ID NO: 279194 - RNA, 21 nt, Human
ucaucugaaacaaggaguuau

SEQ ID NO: 279195 - RNA, 20 nt, Human
ucauuuuuacauacauauau

SEQ ID NO: 279196 - RNA, 26 nt, Human
uccaaggccauuauuaaaaucaagaa

SEQ ID NO: 279197 - RNA, 22 nt, Human
ucgccggcucuuuuucaauugc

SEQ ID NO: 279198 - RNA, 22 nt, Human
ucgccggcucuuuuucaauugc

SEQ ID NO: 279199 - RNA, 25 nt, Human
ucgucaagaggacagggacgaaaau

SEQ ID NO: 279200 - RNA, 23 nt, Human
ucguccggcagccgccgccgcuc

SEQ ID NO: 279201 - RNA, 23 nt, Human
ucguccggcagccgccgccgcuc

SEQ ID NO: 279202 - RNA, 23 nt, Human
ucguccggcagccgccgccgcuc

SEQ ID NO: 279203 - RNA, 23 nt, Human
ucguccggcagccgccgccgcuc

SEQ ID NO: 279204 - RNA, 21 nt, Human
ucucaugcgacaggcagaggc

SEQ ID NO: 279205 - RNA, 23 nt, Human
ugaaaagagcaaaaaacaaaacu

SEQ ID NO: 279206 - RNA, 24 nt, Human
ugaaaugccuuuauuaucauauuu

SEQ ID NO: 279207 - RNA, 20 nt, Human
ugaaggggcugaccgccaug

SEQ ID NO: 279208 - RNA, 24 nt, Human
ugaauaaccaaccaagaaaaccac

SEQ ID NO: 279209 - RNA, 27 nt, Human
ugacaaauaacacauucugaaucaaaa

SEQ ID NO: 279210 - RNA, 22 nt, Human
ugcagcaacaagaaagcagcac

SEQ ID NO: 279211 - RNA, 18 nt, Human
ugcuggacacggguggag

SEQ ID NO: 279212 - RNA, 25 nt, Human
uggaaaaaaagcaacaaucaaucau

SEQ ID NO: 279213 - RNA, 18 nt, Human
uggaaaucuacaggugac

SEQ ID NO: 279214 - RNA, 22 nt, Human
uggaaggagcugaacugcugag

SEQ ID NO: 279215 - RNA, 27 nt, Human
uggaaggagcugaacugcugagggugg

SEQ ID NO: 279216 - RNA, 20 nt, Human
uggauguagaaguagauacc

SEQ ID NO: 279217 - RNA, 26 nt, Human
uggcaaaaaaacaaaaacaaaaacaa

SEQ ID NO: 279218 - RNA, 26 nt, Human
uggcaaaaaaacaaaaacaaaaacaa

SEQ ID NO: 279219 - RNA, 21 nt, Human
uggccucugcccggcgcccuc

SEQ ID NO: 279220 - RNA, 21 nt, Human
uggccucugcccggcgcccuc

SEQ ID NO: 279221 - RNA, 21 nt, Human
uggccucugcccggcgcccuc

SEQ ID NO: 279222 - RNA, 21 nt, Human
uggccucugcccggcgcccuc

SEQ ID NO: 279223 - RNA, 18 nt, Human
uggcugacacauaccuuc

SEQ ID NO: 279224 - RNA, 21 nt, Human
ugggucccgccgcuggcggcu

SEQ ID NO: 279225 - RNA, 21 nt, Human
ugggucccgccgcuggcggcu

SEQ ID NO: 279226 - RNA, 21 nt, Human
ugggucccgccgcuggcggcu

SEQ ID NO: 279227 - RNA, 21 nt, Human
ugggucccgccgcuggcggcu

SEQ ID NO: 279228 - RNA, 25 nt, Human
ugucuuauucauuuggcaggugauc

SEQ ID NO: 279229 - RNA, 21 nt, Human
uucaauugccccgcagccacc

SEQ ID NO: 279230 - RNA, 20 nt, Human
uugcuuuuguuaauguucuc

SEQ ID NO: 279231 - RNA, 19 nt, Human
uuugucccucgagggggag

SEQ ID NO: 279232 - RNA, 20 nt, Human
uuugucccucgauggggaga

SEQ ID NO: 279233 - RNA, 20 nt, Human
uuugucccucgauggggaga

SEQ ID NO: 279234 - RNA, 20 nt, Human
uuugucccucgauggggaga

SEQ ID NO: 279235 - RNA, 20 nt, Human
uuugucccucgauggggaga

SEQ ID NO: 279236 - RNA, 20 nt, Human
uuugucccucgauggggaga

SEQ ID NO: 279237 - RNA, 22 nt, Human
uuuuaaaugcuacuccaaacca

SEQ ID NO: 279238 - RNA, 27 nt, Human
uuuucaauugccccgcagccacccacc

SEQ ID NO: 279239 - RNA, 23 nt, Human
uuuuuuuuuuuuuuuucauuuuu

SEQ ID NO: 279240 - RNA, 23 nt, Human
uuuuuuuuuuuuuuuuuuacuag

SEQ ID NO: 279241 - RNA, 18 nt, Human
acagagcccgcuggaaaa

SEQ ID NO: 279242 - RNA, 20 nt, Human
acagagcccgcuggaaaacc

SEQ ID NO: 279243 - RNA, 20 nt, Human
agguggcccagcuagggcag

SEQ ID NO: 279244 - RNA, 23 nt, Human
agguggcccagcuagggcagggg

SEQ ID NO: 279245 - RNA, 23 nt, Human
auacuuuuuuccuuuuauagaaa

SEQ ID NO: 279246 - RNA, 23 nt, Human
auacuuuuuuccuuuuauagaaa

SEQ ID NO: 279247 - RNA, 24 nt, Human
auuuuguuauacuuuuuuccuuuu

SEQ ID NO: 279248 - RNA, 24 nt, Human
cacacagacgaugcccacgaccag

SEQ ID NO: 279249 - RNA, 21 nt, Human
caccacacagacgaugcccac

SEQ ID NO: 279250 - RNA, 19 nt, Human
caccggcagcccggggagg

SEQ ID NO: 279251 - RNA, 20 nt, Human
caccggcagcccggggaggu

SEQ ID NO: 279252 - RNA, 24 nt, Human
cagagcccgcuggaaaaccggaaa

SEQ ID NO: 279253 - RNA, 19 nt, Human
cagccgccgccgccuuggg

SEQ ID NO: 279254 - RNA, 21 nt, Human
cagcgcagcgcucccacccug

SEQ ID NO: 279255 - RNA, 19 nt, Human
cagcgcggcgcagcgcagc

SEQ ID NO: 279256 - RNA, 19 nt, Human
cagcuagggcagggggcag

SEQ ID NO: 279257 - RNA, 23 nt, Human
cagcuagggcagggggcaggcgg

SEQ ID NO: 279258 - RNA, 25 nt, Human
caguaggccaccacacagacgaugc

SEQ ID NO: 279259 - RNA, 21 nt, Human
ccacacagacgaugcccacga

SEQ ID NO: 279260 - RNA, 19 nt, Human
ccaccacacagacgaugcc

SEQ ID NO: 279261 - RNA, 19 nt, Human
ccacgaccagcagagccac

SEQ ID NO: 279262 - RNA, 18 nt, Human
ccgaagcuguaaaucagg

SEQ ID NO: 279263 - RNA, 18 nt, Human
ccgaagcuguaaaucagg

SEQ ID NO: 279264 - RNA, 20 nt, Human
ccgccgcucagccgccgccg

SEQ ID NO: 279265 - RNA, 22 nt, Human
ccgccgcucagccgccgccgcc

SEQ ID NO: 279266 - RNA, 22 nt, Human
ccgccgcucagccgccgccgcc

SEQ ID NO: 279267 - RNA, 21 nt, Human
ccucuuagcccuccaccggca

SEQ ID NO: 279268 - RNA, 25 nt, Human
cggcgcagcgcagcgcucccacccu

SEQ ID NO: 279269 - RNA, 24 nt, Human
gacgaugcccacgaccagcagagc

SEQ ID NO: 279270 - RNA, 20 nt, Human
gaugcgcagcgcggcgcagc

SEQ ID NO: 279271 - RNA, 21 nt, Human
gcagcccggggagguggccca

SEQ ID NO: 279272 - RNA, 20 nt, Human
gcagcgcggcgcagcgcagc

SEQ ID NO: 279273 - RNA, 21 nt, Human
gccauuuggggggcuccgccg

SEQ ID NO: 279274 - RNA, 19 nt, Human
gccgcucagccgccgccgc

SEQ ID NO: 279275 - RNA, 20 nt, Human
gccuugggaggggaaacaga

SEQ ID NO: 279276 - RNA, 18 nt, Human
gcuaguauuauaagacaa

SEQ ID NO: 279277 - RNA, 18 nt, Human
gcuaguauuauaagacaa

SEQ ID NO: 279278 - RNA, 24 nt, Human
ggaggggaaacagagcccgcugga

SEQ ID NO: 279279 - RNA, 24 nt, Human
ggcgcagcgcagcgcucccacccu

SEQ ID NO: 279280 - RNA, 25 nt, Human
ggggcggaggggcgcgcggcggggc

SEQ ID NO: 279281 - RNA, 25 nt, Human
ggggcggaggggcgcgcggcggggc

SEQ ID NO: 279282 - RNA, 25 nt, Human
uacuuuuuuccuuuuauagaaaaua

SEQ ID NO: 279283 - RNA, 25 nt, Human
uacuuuuuuccuuuuauagaaaaua

SEQ ID NO: 279284 - RNA, 18 nt, Human
uagcgccucuuagcccuc

SEQ ID NO: 279285 - RNA, 26 nt, Human
ucccacccugugcgccaggaccugga

SEQ ID NO: 279286 - RNA, 24 nt, Human
uccgccgcucagccgccgccgccu

SEQ ID NO: 279287 - RNA, 21 nt, Human
ucuuuuuuccuccuuucucuc

SEQ ID NO: 279288 - RNA, 18 nt, Human
uggccaggccauuugggg

SEQ ID NO: 279289 - RNA, 20 nt, Human
uggggcgggcggggcggagg

SEQ ID NO: 279290 - RNA, 20 nt, Human
uggggcgggcggggcggagg

SEQ ID NO: 279291 - RNA, 18 nt, Human
uguuacauauaaauaguu

SEQ ID NO: 279292 - RNA, 19 nt, Human
uucuuuuuuccuccuuucu

SEQ ID NO: 279293 - RNA, 19 nt, Human
uucuuuuuuccuccuuucu

SEQ ID NO: 279294 - RNA, 18 nt, Human
uuuccuccuuucucucca

SEQ ID NO: 279295 - RNA, 24 nt, Human
uuucuuuuuuccuccuuucucucc

SEQ ID NO: 279296 - RNA, 24 nt, Human
uuucuuuuuuccuccuuucucucc

SEQ ID NO: 279297 - RNA, 19 nt, Human
uuuuccuccuuucucucca

SEQ ID NO: 279298 - RNA, 19 nt, Human
uuuuccuccuuucucucca

SEQ ID NO: 279299 - RNA, 23 nt, Human
uuuuguuauacuuuuuuccuuuu

SEQ ID NO: 279300 - RNA, 19 nt, Human
uuuuuuccuccuuucucuc

SEQ ID NO: 279301 - RNA, 19 nt, Human
uuuuuuccuccuuucucuc

SEQ ID NO: 279302 - RNA, 25 nt, Human
aaacaagagagcuggagaggcugcc

SEQ ID NO: 279303 - RNA, 21 nt, Human
aaccaaaacaacccucuuccc

SEQ ID NO: 279304 - RNA, 25 nt, Human
aaccugagccccgcggccgggaagc

SEQ ID NO: 279305 - RNA, 22 nt, Human
aagcaaaagaaggaagauuggg

SEQ ID NO: 279306 - RNA, 25 nt, Human
accaaaacaacccucuucccuucau

SEQ ID NO: 279307 - RNA, 22 nt, Human
acuccuccuaccgagccuccca

SEQ ID NO: 279308 - RNA, 19 nt, Human
agccaaucaggagcagccu

SEQ ID NO: 279309 - RNA, 25 nt, Human
agggagucucugggacgcagggggc

SEQ ID NO: 279310 - RNA, 19 nt, Human
auaaacaagagagcuggag

SEQ ID NO: 279311 - RNA, 20 nt, Human
caaaacaacccucuucccuu

SEQ ID NO: 279312 - RNA, 18 nt, Human
caaagucuuggggcuagg

SEQ ID NO: 279313 - RNA, 22 nt, Human
caagggucguccgaaaccaaaa

SEQ ID NO: 279314 - RNA, 23 nt, Human
cagccccaggagcccggcggggg

SEQ ID NO: 279315 - RNA, 21 nt, Human
caggagcagccuccggcaggg

SEQ ID NO: 279316 - RNA, 24 nt, Human
caggagggggucacaaacacggca

SEQ ID NO: 279317 - RNA, 20 nt, Human
caucucgccccggauccaaa

SEQ ID NO: 279318 - RNA, 24 nt, Human
ccacagccccaggagcccggcggg

SEQ ID NO: 279319 - RNA, 20 nt, Human
ccagccgacccgcgccgaaa

SEQ ID NO: 279320 - RNA, 23 nt, Human
ccccaggagcccggcgggggggg

SEQ ID NO: 279321 - RNA, 27 nt, Human
cccgcggccgggaagccaaucaggagc

SEQ ID NO: 279322 - RNA, 18 nt, Human
cccucuucccuucaucuc

SEQ ID NO: 279323 - RNA, 19 nt, Human
cccucuucccuucaucucg

SEQ ID NO: 279324 - RNA, 18 nt, Human
ccucugcggggacgaagg

SEQ ID NO: 279325 - RNA, 21 nt, Human
ccugggugagggagucucugg

SEQ ID NO: 279326 - RNA, 24 nt, Human
cgaaaccaaaacaacccucuuccc

SEQ ID NO: 279327 - RNA, 18 nt, Human
cgccagccgacccgcgcc

SEQ ID NO: 279328 - RNA, 19 nt, Human
cgccgaaacagcagcucug

SEQ ID NO: 279329 - RNA, 19 nt, Human
cgcucggcuccgcucgcga

SEQ ID NO: 279330 - RNA, 21 nt, Human
cggccacagccccaggagccc

SEQ ID NO: 279331 - RNA, 22 nt, Human
cggccgccagccgacccgcgcc

SEQ ID NO: 279332 - RNA, 22 nt, Human
cgggaguggcacggagauguag

SEQ ID NO: 279333 - RNA, 21 nt, Human
cggggacgaagguggcgcagg

SEQ ID NO: 279334 - RNA, 18 nt, Human
cggggguccucugcgggg

SEQ ID NO: 279335 - RNA, 23 nt, Human
cucuggggcaucggccgccagcc

SEQ ID NO: 279336 - RNA, 21 nt, Human
cuggggaaaggggagggaacg

SEQ ID NO: 279337 - RNA, 18 nt, Human
gacccgcgccgaaacagc

SEQ ID NO: 279338 - RNA, 20 nt, Human
gacccgcgccgaaacagcag

SEQ ID NO: 279339 - RNA, 21 nt, Human
gagcagccuccggcagggugg

SEQ ID NO: 279340 - RNA, 22 nt, Human
gagcccggcggggggggagggc

SEQ ID NO: 279341 - RNA, 26 nt, Human
gagggcgggaccgacagggcggggcg

SEQ ID NO: 279342 - RNA, 18 nt, Human
gccacagccccaggagcc

SEQ ID NO: 279343 - RNA, 21 nt, Human
gccagccgacccgcgccgaaa

SEQ ID NO: 279344 - RNA, 22 nt, Human
gcgaauguaaccugagccccgc

SEQ ID NO: 279345 - RNA, 19 nt, Human
gcgagaagcaaaagaagga

SEQ ID NO: 279346 - RNA, 18 nt, Human
ggaagacuccuccuaccg

SEQ ID NO: 279347 - RNA, 21 nt, Human
ggaggcagagcugcaugcugg

SEQ ID NO: 279348 - RNA, 22 nt, Human
ggauccaaagucuuggggcuag

SEQ ID NO: 279349 - RNA, 22 nt, Human
ggcuccuguagcuggcagguug

SEQ ID NO: 279350 - RNA, 22 nt, Human
gggagggaacgugacaggcagg

SEQ ID NO: 279351 - RNA, 22 nt, Human
gggcgcccuccgcagugcgcgc

SEQ ID NO: 279352 - RNA, 23 nt, Human
gggcgggaccgacagggcggggc

SEQ ID NO: 279353 - RNA, 19 nt, Human
gggcuccuguagcuggcag

SEQ ID NO: 279354 - RNA, 24 nt, Human
ggggaaaggggagggaacgugaca

SEQ ID NO: 279355 - RNA, 20 nt, Human
ggggacgaagguggcgcagg

SEQ ID NO: 279356 - RNA, 19 nt, Human
ggggauggggucugugugg

SEQ ID NO: 279357 - RNA, 18 nt, Human
ggggcggggccguggaag

SEQ ID NO: 279358 - RNA, 25 nt, Human
ggggggagggcgggaccgacagggc

SEQ ID NO: 279359 - RNA, 18 nt, Human
uaccgagccucccaggcg

SEQ ID NO: 279360 - RNA, 20 nt, Human
uagacugcagaacuaacuaa

SEQ ID NO: 279361 - RNA, 18 nt, Human
uagggugggguggagugg

SEQ ID NO: 279362 - RNA, 27 nt, Human
uccaaagucuuggggcuaggcuggggc

SEQ ID NO: 279363 - RNA, 18 nt, Human
ucccgcgcucggcuccgc

SEQ ID NO: 279364 - RNA, 21 nt, Human
uccgaaaccaaaacaacccuc

SEQ ID NO: 279365 - RNA, 23 nt, Human
uccuccuaccgagccucccaggc

SEQ ID NO: 279366 - RNA, 22 nt, Human
ucgccccggauccaaagucuug

SEQ ID NO: 279367 - RNA, 23 nt, Human
ucucuuccggucagagcaagggu

SEQ ID NO: 279368 - RNA, 18 nt, Human
ugacaggcagguguggga

SEQ ID NO: 279369 - RNA, 24 nt, Human
ugcacacacggagaucagaaaccu

SEQ ID NO: 279370 - RNA, 23 nt, Human
ugcagaacuaacuaaaagggcac

SEQ ID NO: 279371 - RNA, 18 nt, Human
ugcaugcugggugcggga

SEQ ID NO: 279372 - RNA, 22 nt, Human
ugcccucaacagugcgcugggg

SEQ ID NO: 279373 - RNA, 22 nt, Human
ugcgcacagaacgaaagaacuc

SEQ ID NO: 279374 - RNA, 19 nt, Human
ugcugggcaggaggggguc

SEQ ID NO: 279375 - RNA, 23 nt, Human
uggcgcagggcggggaugggguu

SEQ ID NO: 279376 - RNA, 21 nt, Human
uggggaccauacuagacugca

SEQ ID NO: 279377 - RNA, 22 nt, Human
ugggggcucuggggcaucggcc

SEQ ID NO: 279378 - RNA, 18 nt, Human
ugggguggaguggaaggg

SEQ ID NO: 279379 - RNA, 21 nt, Human
uuagggcgcccuccgcagugc

SEQ ID NO: 279380 - RNA, 22 nt, Human
uuagggugggguggaguggaag

SEQ ID NO: 279381 - RNA, 24 nt, Human
aaaaaaauucacacugcaguaugu

SEQ ID NO: 279382 - RNA, 24 nt, Human
aaaaaacaaaacaaaaaaauucac

SEQ ID NO: 279383 - RNA, 22 nt, Human
aaaaacaaaacaaaaaaauuca

SEQ ID NO: 279384 - RNA, 23 nt, Human
aaaaauaaccauuuaggguuuua

SEQ ID NO: 279385 - RNA, 26 nt, Human
aaaacaaaacccacacacacacacac

SEQ ID NO: 279386 - RNA, 19 nt, Human
aaaacaaccagccaaccaa

SEQ ID NO: 279387 - RNA, 22 nt, Human
aaaaggaucagggugggacaga

SEQ ID NO: 279388 - RNA, 20 nt, Human
aaaauauauacucucaccag

SEQ ID NO: 279389 - RNA, 22 nt, Human
aaaaugcauuaauccacuauga

SEQ ID NO: 279390 - RNA, 18 nt, Human
aaaauggaaaucugccuu

SEQ ID NO: 279391 - RNA, 20 nt, Human
aaagcaaaauaaaguacccu

SEQ ID NO: 279392 - RNA, 18 nt, Human
aaaguuauccccuccacc

SEQ ID NO: 279393 - RNA, 18 nt, Human
aaccaaaaaaacaaaaca

SEQ ID NO: 279394 - RNA, 23 nt, Human
aaccagccaaccaaaaaaacaaa

SEQ ID NO: 279395 - RNA, 18 nt, Human
aacugaaaccccaugugg

SEQ ID NO: 279396 - RNA, 21 nt, Human
aagauccaauggagugauugu

SEQ ID NO: 279397 - RNA, 19 nt, Human
aagcagauagaauccuuag

SEQ ID NO: 279398 - RNA, 23 nt, Human
aaggcgccugccgccccguccug

SEQ ID NO: 279399 - RNA, 20 nt, Human
accaaaaaaacaaaacaaaa

SEQ ID NO: 279400 - RNA, 21 nt, Human
acccacacacacacacacaaa

SEQ ID NO: 279401 - RNA, 18 nt, Human
agaacacacaaauaauca

SEQ ID NO: 279402 - RNA, 22 nt, Human
agagauggugaaaacuguccaa

SEQ ID NO: 279403 - RNA, 19 nt, Human
agaguuaaaaauaaacacc

SEQ ID NO: 279404 - RNA, 19 nt, Human
agcaaaagugaaaaaugua

SEQ ID NO: 279405 - RNA, 24 nt, Human
agcucacaauccaaacacuucccc

SEQ ID NO: 279406 - RNA, 21 nt, Human
aggaggaggagaagaauuccu

SEQ ID NO: 279407 - RNA, 19 nt, Human
agugcugaucaacuucuac

SEQ ID NO: 279408 - RNA, 20 nt, Human
auaaaaaucuuagaaaccac

SEQ ID NO: 279409 - RNA, 19 nt, Human
auauauauauauauauaua

SEQ ID NO: 279410 - RNA, 19 nt, Human
auauauauauauauauaua

SEQ ID NO: 279411 - RNA, 19 nt, Human
auauauauauauauauaua

SEQ ID NO: 279412 - RNA, 19 nt, Human
auauauauauauauauaua

SEQ ID NO: 279413 - RNA, 19 nt, Human
auauauauauauauauaua

SEQ ID NO: 279414 - RNA, 19 nt, Human
auauauauauauauauaua

SEQ ID NO: 279415 - RNA, 19 nt, Human
auauauauauauauauaua

SEQ ID NO: 279416 - RNA, 19 nt, Human
auauauauauauauauaua

SEQ ID NO: 279417 - RNA, 19 nt, Human
auauauauauauauauaua

SEQ ID NO: 279418 - RNA, 21 nt, Human
auauugcaaauuuugagcuga

SEQ ID NO: 279419 - RNA, 23 nt, Human
auauugcaaauuuugagcugaug

SEQ ID NO: 279420 - RNA, 23 nt, Human
aucacccuaaauucaaauuggga

SEQ ID NO: 279421 - RNA, 19 nt, Human
augacaucacaugaagaaa

SEQ ID NO: 279422 - RNA, 19 nt, Human
caaaaaauggaaaucugcc

SEQ ID NO: 279423 - RNA, 24 nt, Human
caaaacaaaaaaauucacacugca

SEQ ID NO: 279424 - RNA, 21 nt, Human
caaaacaaaacccacacacac

SEQ ID NO: 279425 - RNA, 19 nt, Human
caaaauaaaguacccuaau

SEQ ID NO: 279426 - RNA, 22 nt, Human
caaaauaaaguacccuaauaaa

SEQ ID NO: 279427 - RNA, 18 nt, Human
caacaucaccaguaacca

SEQ ID NO: 279428 - RNA, 21 nt, Human
caacaucaccaguaaccaaua

SEQ ID NO: 279429 - RNA, 23 nt, Human
caaccaaaaaaacaaaacaaaac

SEQ ID NO: 279430 - RNA, 31 nt, Human
caaccaaaaaaacaaaacaaaacccacacaa

SEQ ID NO: 279431 - RNA, 21 nt, Human
caagaaacaccuagagagcau

SEQ ID NO: 279432 - RNA, 22 nt, Human
cacacacacacaaaaguagcaa

SEQ ID NO: 279433 - RNA, 19 nt, Human
cagccuccggcuccgucag

SEQ ID NO: 279434 - RNA, 23 nt, Human
cagccuccggcuccgucaggcuc

SEQ ID NO: 279435 - RNA, 22 nt, Human
cagggucccccaugcacuuuuc

SEQ ID NO: 279436 - RNA, 23 nt, Human
cauacagaaguguuaaacaacca

SEQ ID NO: 279437 - RNA, 22 nt, Human
cauauuauauauauauauauau

SEQ ID NO: 279438 - RNA, 25 nt, Human
cauauuauauauauauauauauaaa

SEQ ID NO: 279439 - RNA, 21 nt, Human
cauggaauagaauauauucaa

SEQ ID NO: 279440 - RNA, 22 nt, Human
ccaaaccauccuggaaucaccu

SEQ ID NO: 279441 - RNA, 21 nt, Human
ccaagaguuaaaaauaaacac

SEQ ID NO: 279442 - RNA, 20 nt, Human
ccagccaaccaaaaaaacaa

SEQ ID NO: 279443 - RNA, 21 nt, Human
cccacacacacacacacaaaa

SEQ ID NO: 279444 - RNA, 19 nt, Human
ccccaggccgccgcggcuc

SEQ ID NO: 279445 - RNA, 18 nt, Human
ccgccgcggcucccagcc

SEQ ID NO: 279446 - RNA, 20 nt, Human
ccgccgcggcucccagccuc

SEQ ID NO: 279447 - RNA, 20 nt, Human
ccgccgcggcucccagccuc

SEQ ID NO: 279448 - RNA, 18 nt, Human
ccucaugacaucuaaugu

SEQ ID NO: 279449 - RNA, 20 nt, Human
ccugccgccccguccuggcc

SEQ ID NO: 279450 - RNA, 21 nt, Human
ccuggaaucaccugaguuugg

SEQ ID NO: 279451 - RNA, 18 nt, Human
cgcgcggguggcgggcgg

SEQ ID NO: 279452 - RNA, 22 nt, Human
cguccuggcccggcgccccggg

SEQ ID NO: 279453 - RNA, 25 nt, Human
cuaaggcuccaaaccuuccacaacg

SEQ ID NO: 279454 - RNA, 21 nt, Human
cucacaauccaaacacuuccc

SEQ ID NO: 279455 - RNA, 20 nt, Human
cucucaccaguuuacucuuc

SEQ ID NO: 279456 - RNA, 19 nt, Human
cugacuucugaaaagcaaa

SEQ ID NO: 279457 - RNA, 18 nt, Human
gaaaacaaccagccaacc

SEQ ID NO: 279458 - RNA, 19 nt, Human
gaaacaccuagagagcaug

SEQ ID NO: 279459 - RNA, 18 nt, Human
gaugucaauaagcuguag

SEQ ID NO: 279460 - RNA, 21 nt, Human
gcacagaugcacagggucccc

SEQ ID NO: 279461 - RNA, 21 nt, Human
gcaggaaguaaacacuaaaag

SEQ ID NO: 279462 - RNA, 22 nt, Human
gccaaccaaaaaaacaaaacaa

SEQ ID NO: 279463 - RNA, 19 nt, Human
gccacgggcggacgggcgc

SEQ ID NO: 279464 - RNA, 22 nt, Human
gcgcagcggcggacgcgaggcc

SEQ ID NO: 279465 - RNA, 22 nt, Human
gcuguaguacccuuucacaaau

SEQ ID NO: 279466 - RNA, 22 nt, Human
gcuguguuucucccaaauguua

SEQ ID NO: 279467 - RNA, 19 nt, Human
ggaauccuggucauaacac

SEQ ID NO: 279468 - RNA, 22 nt, Human
ggcccuguuuuuccaucccuaa

SEQ ID NO: 279469 - RNA, 19 nt, Human
ggcgcagcggcggacgcga

SEQ ID NO: 279470 - RNA, 18 nt, Human
gguggcgggcgggcgugg

SEQ ID NO: 279471 - RNA, 20 nt, Human
gucauguccagaaauggaau

SEQ ID NO: 279472 - RNA, 20 nt, Human
guggcccuguuuuuccaucc

SEQ ID NO: 279473 - RNA, 23 nt, Human
guuguaagcuuuguuggcauugu

SEQ ID NO: 279474 - RNA, 24 nt, Human
uaaaaaacaaaacaaaaaaauuca

SEQ ID NO: 279475 - RNA, 19 nt, Human
uaaaaagauccaaaacugg

SEQ ID NO: 279476 - RNA, 24 nt, Human
uaaaagauuaaaaaacaaaacaaa

SEQ ID NO: 279477 - RNA, 20 nt, Human
uaaaguacccuaauaaaggc

SEQ ID NO: 279478 - RNA, 19 nt, Human
uaaaucaauauccuaacua

SEQ ID NO: 279479 - RNA, 20 nt, Human
uaaaucaauauccuaacuag

SEQ ID NO: 279480 - RNA, 19 nt, Human
uaaaugcaaauaucagugu

SEQ ID NO: 279481 - RNA, 21 nt, Human
uaaucacaacuuaaauaaaag

SEQ ID NO: 279482 - RNA, 21 nt, Human
uacaaaaaauggaaaucugcc

SEQ ID NO: 279483 - RNA, 19 nt, Human
uagaacacacaaauaauca

SEQ ID NO: 279484 - RNA, 23 nt, Human
uaggcugacuucugaaaagcaaa

SEQ ID NO: 279485 - RNA, 22 nt, Human
uaguaaaucagaacagcauucu

SEQ ID NO: 279486 - RNA, 21 nt, Human
uauacauauuauauauauaua

SEQ ID NO: 279487 - RNA, 21 nt, Human
uauauacauauuauauauaua

SEQ ID NO: 279488 - RNA, 22 nt, Human
uauauacauauuauauauauau

SEQ ID NO: 279489 - RNA, 21 nt, Human
uauauauacauauuauauaua

SEQ ID NO: 279490 - RNA, 24 nt, Human
uauauauacauauuauauauauau

SEQ ID NO: 279491 - RNA, 25 nt, Human
uauauauauauauauauaaaauaua

SEQ ID NO: 279492 - RNA, 19 nt, Human
uauauauauauauauauau

SEQ ID NO: 279493 - RNA, 19 nt, Human
uauauauauauauauauau

SEQ ID NO: 279494 - RNA, 19 nt, Human
uauauauauauauauauau

SEQ ID NO: 279495 - RNA, 19 nt, Human
uauauauauauauauauau

SEQ ID NO: 279496 - RNA, 19 nt, Human
uauauauauauauauauau

SEQ ID NO: 279497 - RNA, 22 nt, Human
uaucaccuuccaucgcaaucag

SEQ ID NO: 279498 - RNA, 21 nt, Human
uaugcauaaacaaagugaauc

SEQ ID NO: 279499 - RNA, 27 nt, Human
ucaauauauauauauauacauauuaua

SEQ ID NO: 279500 - RNA, 20 nt, Human
ucaccugaguuugguaaguu

SEQ ID NO: 279501 - RNA, 19 nt, Human
ucacuacuuuaaaguaaaa

SEQ ID NO: 279502 - RNA, 21 nt, Human
ucaggcucgguccgcgaaggc

SEQ ID NO: 279503 - RNA, 19 nt, Human
uccaaaccuuccacaacga

SEQ ID NO: 279504 - RNA, 23 nt, Human
uccaagaguuaaaaauaaacacc

SEQ ID NO: 279505 - RNA, 18 nt, Human
uccccaggccgccgcggc

SEQ ID NO: 279506 - RNA, 23 nt, Human
uccccaggccgccgcggcuccca

SEQ ID NO: 279507 - RNA, 27 nt, Human
uccccaggccgccgcggcucccagccu

SEQ ID NO: 279508 - RNA, 22 nt, Human
uccgcgaaggcgccugccgccc

SEQ ID NO: 279509 - RNA, 23 nt, Human
uccgcgaaggcgccugccgcccc

SEQ ID NO: 279510 - RNA, 24 nt, Human
uccuggaaucaccugaguuuggua

SEQ ID NO: 279511 - RNA, 22 nt, Human
ucgguccgcgaaggcgccugcc

SEQ ID NO: 279512 - RNA, 24 nt, Human
ugaaaacuguccaaagaaaagcca

SEQ ID NO: 279513 - RNA, 24 nt, Human
ugaaaagcaaaauaaaguacccua

SEQ ID NO: 279514 - RNA, 18 nt, Human
ugaacauaaaaacagacc

SEQ ID NO: 279515 - RNA, 18 nt, Human
ugaguccugagaacaguu

SEQ ID NO: 279516 - RNA, 22 nt, Human
ugaguccugagaacaguucuga

SEQ ID NO: 279517 - RNA, 22 nt, Human
uggaauaauguuugcaauggga

SEQ ID NO: 279518 - RNA, 23 nt, Human
uggaauauacaggaaccaaagag

SEQ ID NO: 279519 - RNA, 18 nt, Human
uggagugauuguguacaa

SEQ ID NO: 279520 - RNA, 23 nt, Human
uggauuguacaaacugaacauaa

SEQ ID NO: 279521 - RNA, 24 nt, Human
ugggaaccacaaaaccucuuccaa

SEQ ID NO: 279522 - RNA, 22 nt, Human
ugguaaguggcccuguuuuucc

SEQ ID NO: 279523 - RNA, 21 nt, Human
uguaaacaccagaauucuuac

SEQ ID NO: 279524 - RNA, 28 nt, Human
uguaacaagucaauauauauauauauua

SEQ ID NO: 279525 - RNA, 22 nt, Human
uguguaaacaccagaauucuua

SEQ ID NO: 279526 - RNA, 18 nt, Human
uguuaaaauaaugagucc

SEQ ID NO: 279527 - RNA, 18 nt, Human
uguuguaagcuuuguugg

SEQ ID NO: 279528 - RNA, 19 nt, Human
uuaaaaagauccaaaacug

SEQ ID NO: 279529 - RNA, 24 nt, Human
uucacaaagcuuaaaccacagacg

SEQ ID NO: 279530 - RNA, 25 nt, Human
uucacaauuaagaacaaaauaucug

SEQ ID NO: 279531 - RNA, 21 nt, Human
uucacacugcaguauguacag

SEQ ID NO: 279532 - RNA, 23 nt, Human
uuccuuuuccuucuucaucuuuu

SEQ ID NO: 279533 - RNA, 21 nt, Human
uuguaagcuuuguuggcauug

SEQ ID NO: 279534 - RNA, 20 nt, Human
uuuaaacuaaauguuguaag

SEQ ID NO: 279535 - RNA, 25 nt, Human
uuuaaaggaucuaucaaacuucccu

SEQ ID NO: 279536 - RNA, 23 nt, Human
aaacugaggugggagcugcaacc

SEQ ID NO: 279537 - RNA, 19 nt, Human
aacccuccuccaccuccca

SEQ ID NO: 279538 - RNA, 20 nt, Human
acaaaagcugcacucucuca

SEQ ID NO: 279539 - RNA, 20 nt, Human
acacagcucucucccaaccc

SEQ ID NO: 279540 - RNA, 19 nt, Human
acaggcacagcuucccagg

SEQ ID NO: 279541 - RNA, 19 nt, Human
accacacuuccacccccca

SEQ ID NO: 279542 - RNA, 23 nt, Human
acccagcccccacuacaccacaa

SEQ ID NO: 279543 - RNA, 18 nt, Human
acccccagagcucacucu

SEQ ID NO: 279544 - RNA, 18 nt, Human
acuaggacccagguuucc

SEQ ID NO: 279545 - RNA, 21 nt, Human
acuucagaaauggccgagagg

SEQ ID NO: 279546 - RNA, 18 nt, Human
agacagccuggagggagc

SEQ ID NO: 279547 - RNA, 26 nt, Human
agagaagccaggcuuccucgccuggg

SEQ ID NO: 279548 - RNA, 19 nt, Human
agagguccuaaucuaucua

SEQ ID NO: 279549 - RNA, 21 nt, Human
agaggugggagguggcaggag

SEQ ID NO: 279550 - RNA, 18 nt, Human
aggaccagaaggcgcucu

SEQ ID NO: 279551 - RNA, 23 nt, Human
aggccacaggguugggcagggaa

SEQ ID NO: 279552 - RNA, 22 nt, Human
aggucuggaggcccagacagcc

SEQ ID NO: 279553 - RNA, 22 nt, Human
aggugccuuuggcgagauuguc

SEQ ID NO: 279554 - RNA, 21 nt, Human
agucucaccucagcccucaga

SEQ ID NO: 279555 - RNA, 22 nt, Human
agugccagagccagacaggcaa

SEQ ID NO: 279556 - RNA, 18 nt, Human
auggaagagcugggacua

SEQ ID NO: 279557 - RNA, 18 nt, Human
caacaacccccagagcuc

SEQ ID NO: 279558 - RNA, 22 nt, Human
cacacagcucucucccaaccca

SEQ ID NO: 279559 - RNA, 19 nt, Human
caccaacaacccccagagc

SEQ ID NO: 279560 - RNA, 21 nt, Human
caccacacuuccaccccccag

SEQ ID NO: 279561 - RNA, 22 nt, Human
cacccagcccccacuacaccac

SEQ ID NO: 279562 - RNA, 25 nt, Human
caccccacccagcccccacuacacc

SEQ ID NO: 279563 - RNA, 21 nt, Human
cacuacaccacaaggugcucu

SEQ ID NO: 279564 - RNA, 19 nt, Human
cacuggucccugcagagcu

SEQ ID NO: 279565 - RNA, 20 nt, Human
cagaaauggccgagaggaug

SEQ ID NO: 279566 - RNA, 19 nt, Human
cagcgugcuagucaugugg

SEQ ID NO: 279567 - RNA, 21 nt, Human
cagggcguggcuaggaccaga

SEQ ID NO: 279568 - RNA, 20 nt, Human
cagugccagagccagacagg

SEQ ID NO: 279569 - RNA, 21 nt, Human
ccaacccacaccaacaacccc

SEQ ID NO: 279570 - RNA, 23 nt, Human
ccacaccaacaacccccagagcu

SEQ ID NO: 279571 - RNA, 26 nt, Human
ccacccagcccccacuacaccacaag

SEQ ID NO: 279572 - RNA, 19 nt, Human
ccagagccagacaggcaca

SEQ ID NO: 279573 - RNA, 25 nt, Human
ccagcaucuaaauucgggcaugacu

SEQ ID NO: 279574 - RNA, 24 nt, Human
ccaggcuuccucgccugggcugug

SEQ ID NO: 279575 - RNA, 22 nt, Human
cccaacccacaccaacaacccc

SEQ ID NO: 279576 - RNA, 26 nt, Human
cccagagcucacucuucaggccuuug

SEQ ID NO: 279577 - RNA, 25 nt, Human
cccaggagacugaaggcuccaugga

SEQ ID NO: 279578 - RNA, 20 nt, Human
ccccagagcucacucuucag

SEQ ID NO: 279579 - RNA, 23 nt, Human
ccugggcugugcauccccugccu

SEQ ID NO: 279580 - RNA, 21 nt, Human
cggagccaccccacccagccc

SEQ ID NO: 279581 - RNA, 18 nt, Human
cucagggugacaggggga

SEQ ID NO: 279582 - RNA, 21 nt, Human
cucagggugacagggggaucc

SEQ ID NO: 279583 - RNA, 25 nt, Human
cucucccaacccacaccaacaaccc

SEQ ID NO: 279584 - RNA, 24 nt, Human
cucucucagcaaauugucauccca

SEQ ID NO: 279585 - RNA, 19 nt, Human
cucucucccaacccacacc

SEQ ID NO: 279586 - RNA, 20 nt, Human
cugugcauccccugccuagg

SEQ ID NO: 279587 - RNA, 19 nt, Human
cugugucaccacacuucca

SEQ ID NO: 279588 - RNA, 21 nt, Human
cuucagaaauggccgagagga

SEQ ID NO: 279589 - RNA, 20 nt, Human
cuuuggggauauuugcgcgg

SEQ ID NO: 279590 - RNA, 25 nt, Human
gagccagacaggcacagcuucccag

SEQ ID NO: 279591 - RNA, 22 nt, Human
gaggacccaaaagcuuugggga

SEQ ID NO: 279592 - RNA, 19 nt, Human
gaugccagaacuggaaagg

SEQ ID NO: 279593 - RNA, 21 nt, Human
gcagggaaaaagcaucucgga

SEQ ID NO: 279594 - RNA, 19 nt, Human
gcccugaaggccacagggu

SEQ ID NO: 279595 - RNA, 20 nt, Human
gcucacagagaagccaggcu

SEQ ID NO: 279596 - RNA, 25 nt, Human
ggaagagcugggacuaggacccagg

SEQ ID NO: 279597 - RNA, 21 nt, Human
ggaccagaaggcgcucuggua

SEQ ID NO: 279598 - RNA, 24 nt, Human
ggacuucuuggggagaccaccggg

SEQ ID NO: 279599 - RNA, 23 nt, Human
ggagaagucucaccucagcccuc

SEQ ID NO: 279600 - RNA, 18 nt, Human
ggagcacccugugcaggu

SEQ ID NO: 279601 - RNA, 20 nt, Human
ggagcugcaacccuccucca

SEQ ID NO: 279602 - RNA, 18 nt, Human
ggagggagcugccgagga

SEQ ID NO: 279603 - RNA, 24 nt, Human
gggaaaaagcaucucggauagagg

SEQ ID NO: 279604 - RNA, 22 nt, Human
gggcaugacuugaggacccaaa

SEQ ID NO: 279605 - RNA, 21 nt, Human
ggggagaccaccgggacuucc

SEQ ID NO: 279606 - RNA, 21 nt, Human
guaacacaaguccaggaagca

SEQ ID NO: 279607 - RNA, 18 nt, Human
uaggaggugccuuuggcg

SEQ ID NO: 279608 - RNA, 23 nt, Human
ucaccacacuuccaccccccagu

SEQ ID NO: 279609 - RNA, 22 nt, Human
ucacugugucaccacacuucca

SEQ ID NO: 279610 - RNA, 21 nt, Human
ucagaaauggccgagaggaug

SEQ ID NO: 279611 - RNA, 22 nt, Human
ucagagaggugggagguggcag

SEQ ID NO: 279612 - RNA, 24 nt, Human
ucaucccaggagaagucucaccuc

SEQ ID NO: 279613 - RNA, 23 nt, Human
uccacaugagaauuagaugaagu

SEQ ID NO: 279614 - RNA, 24 nt, Human
uccauacuggggagaugccagaac

SEQ ID NO: 279615 - RNA, 23 nt, Human
ucggauagagguccuaaucuauc

SEQ ID NO: 279616 - RNA, 22 nt, Human
ucucggauagagguccuaaucu

SEQ ID NO: 279617 - RNA, 24 nt, Human
ucucucagcaaauugucaucccag

SEQ ID NO: 279618 - RNA, 19 nt, Human
ucuggaggcccagacagcc

SEQ ID NO: 279619 - RNA, 24 nt, Human
ugaaaacccugaauuaaaaacuaa

SEQ ID NO: 279620 - RNA, 18 nt, Human
ugaaggccacaggguugg

SEQ ID NO: 279621 - RNA, 20 nt, Human
ugacagggggaucccaugga

SEQ ID NO: 279622 - RNA, 21 nt, Human
ugacuugaggacccaaaagcu

SEQ ID NO: 279623 - RNA, 24 nt, Human
ugagaauuagaugaaguaacacaa

SEQ ID NO: 279624 - RNA, 19 nt, Human
ugaggugggagcugcaacc

SEQ ID NO: 279625 - RNA, 19 nt, Human
ugcagcugggaaacugcag

SEQ ID NO: 279626 - RNA, 21 nt, Human
ugccuaggcugcagcugggaa

SEQ ID NO: 279627 - RNA, 22 nt, Human
ugccuaggcugcagcugggaaa

SEQ ID NO: 279628 - RNA, 20 nt, Human
ugccuggcacuggucccugc

SEQ ID NO: 279629 - RNA, 23 nt, Human
uggaagagcugggacuaggaccc

SEQ ID NO: 279630 - RNA, 20 nt, Human
uggagcugggcugggaggag

SEQ ID NO: 279631 - RNA, 22 nt, Human
uggcaggagcacccugugcagg

SEQ ID NO: 279632 - RNA, 24 nt, Human
uggcaggagcacccugugcagguc

SEQ ID NO: 279633 - RNA, 19 nt, Human
ugggcagggaaaaagcauc

SEQ ID NO: 279634 - RNA, 19 nt, Human
ugucaccacacuuccaccc

SEQ ID NO: 279635 - RNA, 21 nt, Human
ugucuuggggacuucuugggg

SEQ ID NO: 279636 - RNA, 19 nt, Human
ugugcucacagagaagcca

SEQ ID NO: 279637 - RNA, 20 nt, Human
uguggucagugccagagcca

SEQ ID NO: 279638 - RNA, 21 nt, Human
uucccaggagacugaaggcuc

SEQ ID NO: 279639 - RNA, 24 nt, Human
uucccaggagacugaaggcuccau

SEQ ID NO: 279640 - RNA, 22 nt, Human
aaaaaaaaagaaaaacccaacu

SEQ ID NO: 279641 - RNA, 22 nt, Human
aaaaaagaaaaacccaacugaa

SEQ ID NO: 279642 - RNA, 20 nt, Human
aaaaaagccagcacuuuguu

SEQ ID NO: 279643 - RNA, 19 nt, Human
aaaacgucacuuaucacag

SEQ ID NO: 279644 - RNA, 23 nt, Human
aaaagaaaaagaaaaagaaaaaa

SEQ ID NO: 279645 - RNA, 24 nt, Human
aaacagaaaaagaaaaagaaaaag

SEQ ID NO: 279646 - RNA, 25 nt, Human
aaacagaaaaagaaaaagaaaaaga

SEQ ID NO: 279647 - RNA, 21 nt, Human
aaacauauguaauaacauaau

SEQ ID NO: 279648 - RNA, 21 nt, Human
aaacgucacuuaucacagucc

SEQ ID NO: 279649 - RNA, 20 nt, Human
aacaauccgaaacauagccc

SEQ ID NO: 279650 - RNA, 24 nt, Human
aagacagaagcagaccccauggaa

SEQ ID NO: 279651 - RNA, 20 nt, Human
aagcagaccccauggaaucc

SEQ ID NO: 279652 - RNA, 21 nt, Human
aagcagaccccauggaaucca

SEQ ID NO: 279653 - RNA, 21 nt, Human
aagcuccuccuggaagguccc

SEQ ID NO: 279654 - RNA, 24 nt, Human
aagggucccgagagacagaaaggu

SEQ ID NO: 279655 - RNA, 21 nt, Human
aaguacuaaaacuuaauugca

SEQ ID NO: 279656 - RNA, 21 nt, Human
acagaaaaagaaaaagaaaaa

SEQ ID NO: 279657 - RNA, 23 nt, Human
accgcgaauccacuagguaaauc

SEQ ID NO: 279658 - RNA, 21 nt, Human
agaaaaagaaaaagaaaaaaa

SEQ ID NO: 279659 - RNA, 21 nt, Human
agaaaaagaaaaagaaaaaga

SEQ ID NO: 279660 - RNA, 22 nt, Human
agaaaaagaaaaagaaaaagaa

SEQ ID NO: 279661 - RNA, 21 nt, Human
agaaacagaaaaagaaaaaga

SEQ ID NO: 279662 - RNA, 18 nt, Human
agaaagcacacagagaug

SEQ ID NO: 279663 - RNA, 19 nt, Human
agagauacucccaaagagu

SEQ ID NO: 279664 - RNA, 23 nt, Human
agcgccagccucccccgggcagc

SEQ ID NO: 279665 - RNA, 19 nt, Human
aggcaaaguuuggggcgcg

SEQ ID NO: 279666 - RNA, 19 nt, Human
agggaggccacuucgccgg

SEQ ID NO: 279667 - RNA, 19 nt, Human
augcagcuggagaggggcu

SEQ ID NO: 279668 - RNA, 23 nt, Human
caaaaugguccuggacaccguga

SEQ ID NO: 279669 - RNA, 20 nt, Human
caagacagaagcagacccca

SEQ ID NO: 279670 - RNA, 22 nt, Human
caaguacuaaaacuuaauugca

SEQ ID NO: 279671 - RNA, 21 nt, Human
cacaguccagaaagcacacag

SEQ ID NO: 279672 - RNA, 20 nt, Human
cacauuuuugaaaauaaggc

SEQ ID NO: 279673 - RNA, 23 nt, Human
caccgcgccagggcacccauccu

SEQ ID NO: 279674 - RNA, 21 nt, Human
cacuagguaaauccauuuagc

SEQ ID NO: 279675 - RNA, 18 nt, Human
cagcgcgcggagcagcgg

SEQ ID NO: 279676 - RNA, 24 nt, Human
caggggagcgggcggcgcggagug

SEQ ID NO: 279677 - RNA, 21 nt, Human
cauauaagaaaagaaguagcu

SEQ ID NO: 279678 - RNA, 22 nt, Human
ccaaccacugcuccaguugcac

SEQ ID NO: 279679 - RNA, 19 nt, Human
ccaauaaccccgcccucuc

SEQ ID NO: 279680 - RNA, 22 nt, Human
ccacuagguaaauccauuuagc

SEQ ID NO: 279681 - RNA, 18 nt, Human
ccagggcuccagguucuc

SEQ ID NO: 279682 - RNA, 19 nt, Human
cccaaccuccuuucaagac

SEQ ID NO: 279683 - RNA, 21 nt, Human
cccaaugauugcaucuaugcc

SEQ ID NO: 279684 - RNA, 22 nt, Human
cccauccucucccuccuucgga

SEQ ID NO: 279685 - RNA, 21 nt, Human
ccccuguuuuuuguuuuuugu

SEQ ID NO: 279686 - RNA, 21 nt, Human
ccccuucccuccauucagccc

SEQ ID NO: 279687 - RNA, 18 nt, Human
cccgggcagcgcgcggag

SEQ ID NO: 279688 - RNA, 19 nt, Human
cccucuuccuuccugcuuu

SEQ ID NO: 279689 - RNA, 19 nt, Human
cccucuuccuuccugcuuu

SEQ ID NO: 279690 - RNA, 20 nt, Human
cccucuuccuuccugcuuuu

SEQ ID NO: 279691 - RNA, 18 nt, Human
ccgaaacauagccgaggc

SEQ ID NO: 279692 - RNA, 24 nt, Human
ccgccgugccuagcaccccaaaca

SEQ ID NO: 279693 - RNA, 18 nt, Human
ccgcguccgccgccuccu

SEQ ID NO: 279694 - RNA, 24 nt, Human
ccggccggcucgcccgcuagcgcc

SEQ ID NO: 279695 - RNA, 23 nt, Human
ccuagcaccccaaacaauccgaa

SEQ ID NO: 279696 - RNA, 21 nt, Human
ccuccuuucaagacagaagcu

SEQ ID NO: 279697 - RNA, 19 nt, Human
ccucuuguuuuuguuuuga

SEQ ID NO: 279698 - RNA, 19 nt, Human
ccuggacaccgugacgaag

SEQ ID NO: 279699 - RNA, 21 nt, Human
ccuucugaaggaagugggaau

SEQ ID NO: 279700 - RNA, 24 nt, Human
cgccccuucccuccauucagcccc

SEQ ID NO: 279701 - RNA, 22 nt, Human
cggaaaggcagccccgggaaca

SEQ ID NO: 279702 - RNA, 23 nt, Human
cggaaaggcagcugagaagaaga

SEQ ID NO: 279703 - RNA, 23 nt, Human
cggccggcucgcccgcuagcgcc

SEQ ID NO: 279704 - RNA, 18 nt, Human
cggcgcgcaucgccugcu

SEQ ID NO: 279705 - RNA, 22 nt, Human
cggcucgcccgcuagcgccagc

SEQ ID NO: 279706 - RNA, 23 nt, Human
cgugugugugugugugugugugu

SEQ ID NO: 279707 - RNA, 20 nt, Human
cuaugcccucuuguuuuugu

SEQ ID NO: 279708 - RNA, 19 nt, Human
cucaaugaagcaaaucacc

SEQ ID NO: 279709 - RNA, 23 nt, Human
cuccagguucucgagagauacuc

SEQ ID NO: 279710 - RNA, 26 nt, Human
cuuuaugaaugcgugcggucaucacu

SEQ ID NO: 279711 - RNA, 20 nt, Human
gaaaggcagccccgggaaca

SEQ ID NO: 279712 - RNA, 21 nt, Human
gacgaaggaguaagggagaga

SEQ ID NO: 279713 - RNA, 20 nt, Human
gaggggcagccgccgcggga

SEQ ID NO: 279714 - RNA, 20 nt, Human
gcaaaaaaaaagaaaaaccc

SEQ ID NO: 279715 - RNA, 21 nt, Human
gcaaaucaccccauuugucau

SEQ ID NO: 279716 - RNA, 19 nt, Human
gcagccccgggaacagcaa

SEQ ID NO: 279717 - RNA, 19 nt, Human
gcgcaggggagcgggcggc

SEQ ID NO: 279718 - RNA, 21 nt, Human
gcgcggagugggcugaggggc

SEQ ID NO: 279719 - RNA, 20 nt, Human
gcggagugggcugaggggcc

SEQ ID NO: 279720 - RNA, 21 nt, Human
ggacaccgugacgaagaaaua

SEQ ID NO: 279721 - RNA, 23 nt, Human
ggcaaaaaaaaagaaaaacccaa

SEQ ID NO: 279722 - RNA, 19 nt, Human
ggcagcgcgcggagcagcg

SEQ ID NO: 279723 - RNA, 18 nt, Human
gggaacagcaagcgcgga

SEQ ID NO: 279724 - RNA, 22 nt, Human
gggaaugugaguauuucaggga

SEQ ID NO: 279725 - RNA, 22 nt, Human
ggggcuggggugcggcgggggg

SEQ ID NO: 279726 - RNA, 20 nt, Human
ggggugccggggccgacagg

SEQ ID NO: 279727 - RNA, 22 nt, Human
guaauuucuuuaaaaaauaaaa

SEQ ID NO: 279728 - RNA, 30 nt, Human
guggauucgugugugugugugugugugugg

SEQ ID NO: 279729 - RNA, 23 nt, Human
guggcaaaaaaaaagaaaaaccc

SEQ ID NO: 279730 - RNA, 24 nt, Human
gugugugugugugugaaaauagug

SEQ ID NO: 279731 - RNA, 21 nt, Human
gugugugugugugugugugug

SEQ ID NO: 279732 - RNA, 21 nt, Human
gugugugugugugugugugug

SEQ ID NO: 279733 - RNA, 21 nt, Human
gugugugugugugugugugug

SEQ ID NO: 279734 - RNA, 20 nt, Human
uaaaacgucacuuaucacag

SEQ ID NO: 279735 - RNA, 18 nt, Human
uaacauaauaagcgugca

SEQ ID NO: 279736 - RNA, 22 nt, Human
uaaccugcccacauaaugguuc

SEQ ID NO: 279737 - RNA, 23 nt, Human
uaagggagagaaacagaaaaaga

SEQ ID NO: 279738 - RNA, 24 nt, Human
uaagggagagaaacagaaaaagaa

SEQ ID NO: 279739 - RNA, 22 nt, Human
uaccaaaaauggcugaagagca

SEQ ID NO: 279740 - RNA, 22 nt, Human
uagcaacacuuauaacauugaa

SEQ ID NO: 279741 - RNA, 18 nt, Human
uagccgaggcgaaugcag

SEQ ID NO: 279742 - RNA, 18 nt, Human
uauauacauucauacaua

SEQ ID NO: 279743 - RNA, 20 nt, Human
uauauacauucauacauauc

SEQ ID NO: 279744 - RNA, 20 nt, Human
uaugcccucuuguuuuuguu

SEQ ID NO: 279745 - RNA, 22 nt, Human
ucaagacagaagcagaccccau

SEQ ID NO: 279746 - RNA, 19 nt, Human
ucaaugaagcaaaucaccc

SEQ ID NO: 279747 - RNA, 18 nt, Human
ucaggaaagcgcuagcac

SEQ ID NO: 279748 - RNA, 22 nt, Human
ucauaaaacucccuauacuuag

SEQ ID NO: 279749 - RNA, 21 nt, Human
uccaauaaccccgcccucucu

SEQ ID NO: 279750 - RNA, 19 nt, Human
uccagcauaucugauggau

SEQ ID NO: 279751 - RNA, 19 nt, Human
ucccagauuuccagggcuc

SEQ ID NO: 279752 - RNA, 24 nt, Human
ucccugucuucuuuuguaugugcu

SEQ ID NO: 279753 - RNA, 24 nt, Human
uccuuucaagacagaagcagaccc

SEQ ID NO: 279754 - RNA, 24 nt, Human
ucuaguucuuuuuuucuuuuucuu

SEQ ID NO: 279755 - RNA, 21 nt, Human
ucuaugcccucuuguuuuugu

SEQ ID NO: 279756 - RNA, 22 nt, Human
ucucucacaaccagaaaggggc

SEQ ID NO: 279757 - RNA, 24 nt, Human
ucuuuuguaugugcuucauaaaaa

SEQ ID NO: 279758 - RNA, 24 nt, Human
ugagauacuuguuuuuauuuuuua

SEQ ID NO: 279759 - RNA, 23 nt, Human
ugagucacucaaaaggacagucu

SEQ ID NO: 279760 - RNA, 21 nt, Human
uggauucgugugugugugugu

SEQ ID NO: 279761 - RNA, 21 nt, Human
uggauucgugugugugugugu

SEQ ID NO: 279762 - RNA, 29 nt, Human
uggauucgugugugugugugugugugugg

SEQ ID NO: 279763 - RNA, 21 nt, Human
uggcaaaaaaaaagaaaaacc

SEQ ID NO: 279764 - RNA, 23 nt, Human
ugggcugaggggccggccgccuc

SEQ ID NO: 279765 - RNA, 23 nt, Human
uguaauuucuuuaaaaaauaaaa

SEQ ID NO: 279766 - RNA, 21 nt, Human
uguauauacauucauacauag

SEQ ID NO: 279767 - RNA, 22 nt, Human
uguauauacauucauacauauc

SEQ ID NO: 279768 - RNA, 23 nt, Human
uguauauacauucauacauaucu

SEQ ID NO: 279769 - RNA, 21 nt, Human
ugugaaaauagugaauguaug

SEQ ID NO: 279770 - RNA, 22 nt, Human
ugugugaaaauagugaauguau

SEQ ID NO: 279771 - RNA, 25 nt, Human
ugugugugugugugugaaaauagug

SEQ ID NO: 279772 - RNA, 18 nt, Human
ugugugugugugugugug

SEQ ID NO: 279773 - RNA, 18 nt, Human
ugugugugugugugugug

SEQ ID NO: 279774 - RNA, 18 nt, Human
ugugugugugugugugug

SEQ ID NO: 279775 - RNA, 18 nt, Human
ugugugugugugugugug

SEQ ID NO: 279776 - RNA, 18 nt, Human
ugugugugugugugugug

SEQ ID NO: 279777 - RNA, 21 nt, Human
ugugugugugugugugugugu

SEQ ID NO: 279778 - RNA, 21 nt, Human
ugugugugugugugugugugu

SEQ ID NO: 279779 - RNA, 21 nt, Human
ugugugugugugugugugugu

SEQ ID NO: 279780 - RNA, 21 nt, Human
ugugugugugugugugugugu

SEQ ID NO: 279781 - RNA, 21 nt, Human
ugugugugugugugugugugu

SEQ ID NO: 279782 - RNA, 21 nt, Human
ugugugugugugugugugugu

SEQ ID NO: 279783 - RNA, 21 nt, Human
ugugugugugugugugugugu

SEQ ID NO: 279784 - RNA, 21 nt, Human
ugugugugugugugugugugu

SEQ ID NO: 279785 - RNA, 22 nt, Human
ugugugugugugugugugugug

SEQ ID NO: 279786 - RNA, 22 nt, Human
ugugugugugugugugugugug

SEQ ID NO: 279787 - RNA, 22 nt, Human
ugugugugugugugugugugug

SEQ ID NO: 279788 - RNA, 22 nt, Human
ugugugugugugugugugugug

SEQ ID NO: 279789 - RNA, 20 nt, Human
uguguugugccuugaugcug

SEQ ID NO: 279790 - RNA, 20 nt, Human
uguuauguuuuguguugguu

SEQ ID NO: 279791 - RNA, 21 nt, Human
uuaaagguuugcagguugagu

SEQ ID NO: 279792 - RNA, 18 nt, Human
uuaauugcaacagaauga

SEQ ID NO: 279793 - RNA, 23 nt, Human
uuagggaauuuauuggccccugu

SEQ ID NO: 279794 - RNA, 19 nt, Human
uucaagacagaagcagacc

SEQ ID NO: 279795 - RNA, 24 nt, Human
uuccaaccacugcuccaguugcac

SEQ ID NO: 279796 - RNA, 21 nt, Human
uuccagggcuccagguucucg

SEQ ID NO: 279797 - RNA, 20 nt, Human
uucucuggcaauuggacuga

SEQ ID NO: 279798 - RNA, 22 nt, Human
uucuuuuuuucuuuuucuucuu

SEQ ID NO: 279799 - RNA, 22 nt, Human
uuguguuauguuuuguguuggu

SEQ ID NO: 279800 - RNA, 21 nt, Human
uuuaaaaagucuuuccuuccu

SEQ ID NO: 279801 - RNA, 22 nt, Human
uuucaaaugcaaguuccaacca

SEQ ID NO: 279802 - RNA, 22 nt, Human
uuucaagacagaagcagacccc

SEQ ID NO: 279803 - RNA, 21 nt, Human
aaaaaauaaaucaacccaggg

SEQ ID NO: 279804 - RNA, 18 nt, Human
aaaccagacacacaaaaa

SEQ ID NO: 279805 - RNA, 24 nt, Human
aaacccccagccuuccuucccacc

SEQ ID NO: 279806 - RNA, 18 nt, Human
aacaaagagagaaaaaaa

SEQ ID NO: 279807 - RNA, 21 nt, Human
aacaggccuuccgucaggccu

SEQ ID NO: 279808 - RNA, 22 nt, Human
aacuggaucccgccgggaaauc

SEQ ID NO: 279809 - RNA, 27 nt, Human
aagagaaggaaggcaggagggacagaa

SEQ ID NO: 279810 - RNA, 20 nt, Human
aagccucgguccggagccaa

SEQ ID NO: 279811 - RNA, 24 nt, Human
aagccugggauggggauuggaggg

SEQ ID NO: 279812 - RNA, 22 nt, Human
acagaaggaagaagaagaaaaa

SEQ ID NO: 279813 - RNA, 19 nt, Human
acccaaccccaccaaaaua

SEQ ID NO: 279814 - RNA, 20 nt, Human
accccaccccacccacccac

SEQ ID NO: 279815 - RNA, 22 nt, Human
accccugcuccuccagcagcuu

SEQ ID NO: 279816 - RNA, 20 nt, Human
acccucccgcccuucuccca

SEQ ID NO: 279817 - RNA, 21 nt, Human
acccucccgcccuucucccac

SEQ ID NO: 279818 - RNA, 20 nt, Human
acccuccucccgggcccucc

SEQ ID NO: 279819 - RNA, 22 nt, Human
accugguucccccgaaggcggg

SEQ ID NO: 279820 - RNA, 19 nt, Human
acuugccccaccccacccc

SEQ ID NO: 279821 - RNA, 25 nt, Human
acuugccccaccccaccccacccac

SEQ ID NO: 279822 - RNA, 18 nt, Human
agaagaagaaaaauugag

SEQ ID NO: 279823 - RNA, 23 nt, Human
agaagaagaaaaauugaggaaaa

SEQ ID NO: 279824 - RNA, 18 nt, Human
agaagagggacggagacc

SEQ ID NO: 279825 - RNA, 24 nt, Human
agaaggaaggcaggagggacagaa

SEQ ID NO: 279826 - RNA, 25 nt, Human
agacacagcaagccugggaugggga

SEQ ID NO: 279827 - RNA, 18 nt, Human
agagagaaaaaaaacugg

SEQ ID NO: 279828 - RNA, 20 nt, Human
agagagaaaaaaaacugggg

SEQ ID NO: 279829 - RNA, 19 nt, Human
agagggacagucagccccg

SEQ ID NO: 279830 - RNA, 18 nt, Human
agagggacggagaccugg

SEQ ID NO: 279831 - RNA, 27 nt, Human
agccaacaaaaucaacuggaucccgcc

SEQ ID NO: 279832 - RNA, 18 nt, Human
agccccuucccugggcgg

SEQ ID NO: 279833 - RNA, 19 nt, Human
agccuuccuucccacccaa

SEQ ID NO: 279834 - RNA, 21 nt, Human
aggccccuggcagggagaggg

SEQ ID NO: 279835 - RNA, 20 nt, Human
agggaggggagcgcgggggc

SEQ ID NO: 279836 - RNA, 21 nt, Human
auggugccgaguggagaggga

SEQ ID NO: 279837 - RNA, 26 nt, Human
auuugccuuuccccucccucccaccc

SEQ ID NO: 279838 - RNA, 21 nt, Human
caaccccaccaaaauaaaacu

SEQ ID NO: 279839 - RNA, 26 nt, Human
cacagugccaugggcccggccgcggg

SEQ ID NO: 279840 - RNA, 21 nt, Human
cacccacccacugggccacuc

SEQ ID NO: 279841 - RNA, 21 nt, Human
caccccaccccacccacccac

SEQ ID NO: 279842 - RNA, 23 nt, Human
caccccugcuccuccagcagcuu

SEQ ID NO: 279843 - RNA, 27 nt, Human
caccccugcuccuccagcagcuucccc

SEQ ID NO: 279844 - RNA, 21 nt, Human
cacccuccucccgggcccucc

SEQ ID NO: 279845 - RNA, 25 nt, Human
cacccuccucccgggcccucccagg

SEQ ID NO: 279846 - RNA, 21 nt, Human
cacgggguuuuuccuuuucuu

SEQ ID NO: 279847 - RNA, 21 nt, Human
cacuuuacaaaacccccagcc

SEQ ID NO: 279848 - RNA, 20 nt, Human
cagaaggaagaagaagaaaa

SEQ ID NO: 279849 - RNA, 21 nt, Human
cagaaggaagaagaagaaaaa

SEQ ID NO: 279850 - RNA, 22 nt, Human
cagacacacaaaaaaagaagua

SEQ ID NO: 279851 - RNA, 18 nt, Human
cagagcuacagggccgcc

SEQ ID NO: 279852 - RNA, 19 nt, Human
cagcagucuguggacaaug

SEQ ID NO: 279853 - RNA, 21 nt, Human
cagcgggugccacaggcugcu

SEQ ID NO: 279854 - RNA, 23 nt, Human
caggccccuggcagggagagggu

SEQ ID NO: 279855 - RNA, 23 nt, Human
ccaaaauaaaacuacccccuuaa

SEQ ID NO: 279856 - RNA, 21 nt, Human
ccaaagggaggaaaggaaggg

SEQ ID NO: 279857 - RNA, 22 nt, Human
ccaacaaaaucaacuggauccc

SEQ ID NO: 279858 - RNA, 27 nt, Human
ccacccaaccccaccaaaauaaaacua

SEQ ID NO: 279859 - RNA, 20 nt, Human
ccaccccaccccacccaccc

SEQ ID NO: 279860 - RNA, 22 nt, Human
ccaccccugcuccuccagcagc

SEQ ID NO: 279861 - RNA, 24 nt, Human
ccagacacacaaaaaaagaaguag

SEQ ID NO: 279862 - RNA, 18 nt, Human
cccacacauuuccggggu

SEQ ID NO: 279863 - RNA, 19 nt, Human
cccaccccaccccacccac

SEQ ID NO: 279864 - RNA, 24 nt, Human
cccaccccaccccacccacccacu

SEQ ID NO: 279865 - RNA, 21 nt, Human
cccauggccgggggcggggac

SEQ ID NO: 279866 - RNA, 26 nt, Human
ccccaccaaaauaaaacuacccccuu

SEQ ID NO: 279867 - RNA, 19 nt, Human
ccccaccccaccccaccca

SEQ ID NO: 279868 - RNA, 20 nt, Human
ccccaccccaccccacccaa

SEQ ID NO: 279869 - RNA, 20 nt, Human
ccccaccccaccccacccac

SEQ ID NO: 279870 - RNA, 24 nt, Human
ccccaccccaccccacccacccac

SEQ ID NO: 279871 - RNA, 20 nt, Human
ccccaccccugcuccuccag

SEQ ID NO: 279872 - RNA, 18 nt, Human
ccccagccuuccuuccca

SEQ ID NO: 279873 - RNA, 19 nt, Human
ccccauggccgggggcggg

SEQ ID NO: 279874 - RNA, 21 nt, Human
ccccauggccgggggcgggga

SEQ ID NO: 279875 - RNA, 20 nt, Human
cccccaccccugcuccucca

SEQ ID NO: 279876 - RNA, 19 nt, Human
ccccccaccccugcuccuc

SEQ ID NO: 279877 - RNA, 23 nt, Human
ccccccaccccugcuccuccagc

SEQ ID NO: 279878 - RNA, 19 nt, Human
ccccgcgaagccccccucc

SEQ ID NO: 279879 - RNA, 20 nt, Human
ccccgcgcugagcggggcuc

SEQ ID NO: 279880 - RNA, 21 nt, Human
ccccgcgcugagcggggcucc

SEQ ID NO: 279881 - RNA, 19 nt, Human
ccccggccccgcccggccc

SEQ ID NO: 279882 - RNA, 19 nt, Human
ccccucccucccacccccc

SEQ ID NO: 279883 - RNA, 20 nt, Human
ccccuccggcuccgagcucc

SEQ ID NO: 279884 - RNA, 27 nt, Human
ccccuuaaaaaaauaaaucaacccagg

SEQ ID NO: 279885 - RNA, 20 nt, Human
cccgcccggcccccggcccc

SEQ ID NO: 279886 - RNA, 18 nt, Human
cccgccgggaaaucgggg

SEQ ID NO: 279887 - RNA, 23 nt, Human
cccggccccgcccggcccccggc

SEQ ID NO: 279888 - RNA, 19 nt, Human
cccgggggagcgcccgggg

SEQ ID NO: 279889 - RNA, 23 nt, Human
cccugcuccuccagcagcuuccc

SEQ ID NO: 279890 - RNA, 20 nt, Human
ccgccccgccgcggugccuc

SEQ ID NO: 279891 - RNA, 21 nt, Human
ccgcgcccagcgggugccaca

SEQ ID NO: 279892 - RNA, 20 nt, Human
ccggccccgcccggcccccg

SEQ ID NO: 279893 - RNA, 20 nt, Human
ccggcggcacacacagaaca

SEQ ID NO: 279894 - RNA, 18 nt, Human
ccucccaccccccacccc

SEQ ID NO: 279895 - RNA, 18 nt, Human
ccucccgcccuucuccca

SEQ ID NO: 279896 - RNA, 22 nt, Human
ccucccgcccuucucccaccga

SEQ ID NO: 279897 - RNA, 22 nt, Human
ccucccucccaccccccacccc

SEQ ID NO: 279898 - RNA, 18 nt, Human
ccucgcgccucucucccc

SEQ ID NO: 279899 - RNA, 20 nt, Human
ccucgcgccucucuccccgc

SEQ ID NO: 279900 - RNA, 24 nt, Human
ccuuaaaaaaauaaaucaacccag

SEQ ID NO: 279901 - RNA, 19 nt, Human
ccuucccacccaaccccac

SEQ ID NO: 279902 - RNA, 22 nt, Human
cgaagccccccuccggcuccga

SEQ ID NO: 279903 - RNA, 21 nt, Human
cgacagaagagcagggaggga

SEQ ID NO: 279904 - RNA, 18 nt, Human
cgagcuggggagcggggc

SEQ ID NO: 279905 - RNA, 21 nt, Human
cgcaccccgcgaagccccccu

SEQ ID NO: 279906 - RNA, 22 nt, Human
cgccucgcgccucucuccccgc

SEQ ID NO: 279907 - RNA, 24 nt, Human
cggcaggaggaagggggcgagcac

SEQ ID NO: 279908 - RNA, 18 nt, Human
cggcccccggcccccgcu

SEQ ID NO: 279909 - RNA, 22 nt, Human
cggccccggccccgcccggccc

SEQ ID NO: 279910 - RNA, 23 nt, Human
cguggaaucuagaguauuugucu

SEQ ID NO: 279911 - RNA, 21 nt, Human
cuaggggucucucugcauccc

SEQ ID NO: 279912 - RNA, 18 nt, Human
cucacagugccaugggcc

SEQ ID NO: 279913 - RNA, 22 nt, Human
cucccaggaggggcagcuggca

SEQ ID NO: 279914 - RNA, 19 nt, Human
cucccccgccgcgggcucc

SEQ ID NO: 279915 - RNA, 25 nt, Human
cucccgggcccucccaggaggggca

SEQ ID NO: 279916 - RNA, 20 nt, Human
cucccucccaccccccaccc

SEQ ID NO: 279917 - RNA, 20 nt, Human
cucccucccaccccccaccc

SEQ ID NO: 279918 - RNA, 22 nt, Human
cucccucccaccccccaccccu

SEQ ID NO: 279919 - RNA, 23 nt, Human
cucccucccaccccccaccccug

SEQ ID NO: 279920 - RNA, 21 nt, Human
cucccucccaccccccacccu

SEQ ID NO: 279921 - RNA, 20 nt, Human
cuccgagcuccgggagcggg

SEQ ID NO: 279922 - RNA, 18 nt, Human
cucuccccgcccgccccg

SEQ ID NO: 279923 - RNA, 23 nt, Human
cugcucccgccgccgcaucccuc

SEQ ID NO: 279924 - RNA, 18 nt, Human
cugcugcccgcgcccagc

SEQ ID NO: 279925 - RNA, 23 nt, Human
cuggaggagagaagagggacgga

SEQ ID NO: 279926 - RNA, 21 nt, Human
cugguucucggggcgccagaa

SEQ ID NO: 279927 - RNA, 21 nt, Human
cuguggacaaugccuugcucc

SEQ ID NO: 279928 - RNA, 20 nt, Human
cuucccacccaaccccacca

SEQ ID NO: 279929 - RNA, 19 nt, Human
cuugccccaccccaccccc

SEQ ID NO: 279930 - RNA, 22 nt, Human
gaacaggccuuccgucaggccu

SEQ ID NO: 279931 - RNA, 20 nt, Human
gaagagaaggaaggcaggag

SEQ ID NO: 279932 - RNA, 23 nt, Human
gaagagggacggagaccugguuc

SEQ ID NO: 279933 - RNA, 19 nt, Human
gacagucagccccgggacu

SEQ ID NO: 279934 - RNA, 19 nt, Human
gagcagggagggaugccug

SEQ ID NO: 279935 - RNA, 19 nt, Human
gagcuggggagcggggcgg

SEQ ID NO: 279936 - RNA, 25 nt, Human
gagcuggggagcggggcggugcggg

SEQ ID NO: 279937 - RNA, 23 nt, Human
gaggaaaggaagggagaaaccag

SEQ ID NO: 279938 - RNA, 19 nt, Human
gagggaggggagcgcgggg

SEQ ID NO: 279939 - RNA, 23 nt, Human
gagggccgucagaaacccggggg

SEQ ID NO: 279940 - RNA, 22 nt, Human
gauuggagggcuugggaagaga

SEQ ID NO: 279941 - RNA, 25 nt, Human
gcacgggguuuuuccuuuucuuuuu

SEQ ID NO: 279942 - RNA, 21 nt, Human
gcaguggacggcaggaggaag

SEQ ID NO: 279943 - RNA, 18 nt, Human
gccaagcagggaggggag

SEQ ID NO: 279944 - RNA, 19 nt, Human
gccaagcagggaggggaga

SEQ ID NO: 279945 - RNA, 21 nt, Human
gccccaccccaccccacccac

SEQ ID NO: 279946 - RNA, 21 nt, Human
gcgcaccccgcgaagcccccc

SEQ ID NO: 279947 - RNA, 21 nt, Human
gcgcagaggcccagaugccgg

SEQ ID NO: 279948 - RNA, 19 nt, Human
gcucccgccgccgcauccc

SEQ ID NO: 279949 - RNA, 19 nt, Human
gcucccgccgccgcauccc

SEQ ID NO: 279950 - RNA, 19 nt, Human
ggaaggaggguggggacag

SEQ ID NO: 279951 - RNA, 22 nt, Human
ggaaggaggguggggacaguga

SEQ ID NO: 279952 - RNA, 19 nt, Human
ggacagaaggaagaagaag

SEQ ID NO: 279953 - RNA, 18 nt, Human
ggagaaaccagacacaca

SEQ ID NO: 279954 - RNA, 18 nt, Human
ggagagggaggggagcgc

SEQ ID NO: 279955 - RNA, 19 nt, Human
ggagcagggagcccguggg

SEQ ID NO: 279956 - RNA, 20 nt, Human
ggcccccggcccccgcucag

SEQ ID NO: 279957 - RNA, 24 nt, Human
ggccgggggcggggacgcggggcu

SEQ ID NO: 279958 - RNA, 20 nt, Human
ggcgaccgccucacagcccc

SEQ ID NO: 279959 - RNA, 21 nt, Human
ggcgcagagcugagagggaca

SEQ ID NO: 279960 - RNA, 18 nt, Human
ggcgccagaagcuggagg

SEQ ID NO: 279961 - RNA, 22 nt, Human
gggaagagaaggaaggcaggag

SEQ ID NO: 279962 - RNA, 23 nt, Human
gggaaggaggguggggacaguga

SEQ ID NO: 279963 - RNA, 24 nt, Human
gggaaggaggguggggacagugag

SEQ ID NO: 279964 - RNA, 20 nt, Human
gggagcggggcggugcgggc

SEQ ID NO: 279965 - RNA, 23 nt, Human
gggcaaagaagugaccccagcag

SEQ ID NO: 279966 - RNA, 19 nt, Human
gggcagcuggcaguggggc

SEQ ID NO: 279967 - RNA, 22 nt, Human
gggccgucagaaacccggggga

SEQ ID NO: 279968 - RNA, 24 nt, Human
gggcggcugcucccgccgccgcau

SEQ ID NO: 279969 - RNA, 19 nt, Human
gggcgggagggggccgggc

SEQ ID NO: 279970 - RNA, 25 nt, Human
ggggcagcuggcaguggggcgcagu

SEQ ID NO: 279971 - RNA, 21 nt, Human
gggggcggggacgcggggcug

SEQ ID NO: 279972 - RNA, 22 nt, Human
guggaaucuagaguauuugucu

SEQ ID NO: 279973 - RNA, 24 nt, Human
uaaaccagggcccaagccucgguc

SEQ ID NO: 279974 - RNA, 19 nt, Human
uaacaaagagagaaaaaaa

SEQ ID NO: 279975 - RNA, 24 nt, Human
uaacaaagagagaaaaaaaacugg

SEQ ID NO: 279976 - RNA, 18 nt, Human
uaacaggacgagcagugg

SEQ ID NO: 279977 - RNA, 18 nt, Human
uaagagaagccugaggca

SEQ ID NO: 279978 - RNA, 25 nt, Human
uacaaaacccccagccuuccuuccc

SEQ ID NO: 279979 - RNA, 25 nt, Human
uagaguauuugucuguaauauauau

SEQ ID NO: 279980 - RNA, 18 nt, Human
uaggggucucucugcauc

SEQ ID NO: 279981 - RNA, 20 nt, Human
ucaaugcacgucgcccggcg

SEQ ID NO: 279982 - RNA, 27 nt, Human
ucaggcggcggcggcggcgccccuccc

SEQ ID NO: 279983 - RNA, 22 nt, Human
ucccacacauuuccgggguugg

SEQ ID NO: 279984 - RNA, 18 nt, Human
ucccacccaaccccacca

SEQ ID NO: 279985 - RNA, 19 nt, Human
ucccacccaaccccaccaa

SEQ ID NO: 279986 - RNA, 21 nt, Human
uccccgcgcugagcggggcuc

SEQ ID NO: 279987 - RNA, 21 nt, Human
uccccucccucccacccccca

SEQ ID NO: 279988 - RNA, 23 nt, Human
ucccucaggcggcggcggcggcg

SEQ ID NO: 279989 - RNA, 21 nt, Human
ucccugggcggcaccaagcag

SEQ ID NO: 279990 - RNA, 18 nt, Human
ucccuugcaggcucacag

SEQ ID NO: 279991 - RNA, 20 nt, Human
uccgacagaagagcagggag

SEQ ID NO: 279992 - RNA, 26 nt, Human
uccgggguugggguguuuuccaagac

SEQ ID NO: 279993 - RNA, 21 nt, Human
uccuccagcagcuuccccauc

SEQ ID NO: 279994 - RNA, 21 nt, Human
ucgggcccacccucccgcccu

SEQ ID NO: 279995 - RNA, 19 nt, Human
ucggggcgccagaagcugg

SEQ ID NO: 279996 - RNA, 22 nt, Human
ucuccccgcccgccccgccgcg

SEQ ID NO: 279997 - RNA, 20 nt, Human
ugaagcggagguaaaccaac

SEQ ID NO: 279998 - RNA, 26 nt, Human
ugcauuugccuuuccccucccuccca

SEQ ID NO: 279999 - RNA, 22 nt, Human
ugccaugggcccggccgcgggg

SEQ ID NO: 280000 - RNA, 22 nt, Human
ugccccaccccaccccacccac

SEQ ID NO: 280001 - RNA, 18 nt, Human
ugccuggcaggcgcagag

SEQ ID NO: 280002 - RNA, 20 nt, Human
ugcucccgccgccgcauccc

SEQ ID NO: 280003 - RNA, 18 nt, Human
uggaaacccaaagggagg

SEQ ID NO: 280004 - RNA, 24 nt, Human
uggaaaguuuuuguuuucuuuuuc

SEQ ID NO: 280005 - RNA, 21 nt, Human
uggaauuuggaaaguuuuugu

SEQ ID NO: 280006 - RNA, 20 nt, Human
uggacggcaggaggaagggg

SEQ ID NO: 280007 - RNA, 23 nt, Human
uggacggcaggaggaagggggcg

SEQ ID NO: 280008 - RNA, 24 nt, Human
uggaucccgccgggaaaucggggg

SEQ ID NO: 280009 - RNA, 28 nt, Human
uggcagggagaggguggcacccuccucu

SEQ ID NO: 280010 - RNA, 29 nt, Human
uggcagggagaggguggcacccuccucuu

SEQ ID NO: 280011 - RNA, 20 nt, Human
ugggauggggauuggagggc

SEQ ID NO: 280012 - RNA, 21 nt, Human
ugggauggggauuggagggcu

SEQ ID NO: 280013 - RNA, 25 nt, Human
ugggauggggauuggagggcuuggg

SEQ ID NO: 280014 - RNA, 22 nt, Human
uggggcgggagggggccgggcg

SEQ ID NO: 280015 - RNA, 22 nt, Human
ugggggagcagggagcccgugg

SEQ ID NO: 280016 - RNA, 23 nt, Human
ugggggagcagggagcccguggg

SEQ ID NO: 280017 - RNA, 22 nt, Human
uuccaagacucagacacauuug

SEQ ID NO: 280018 - RNA, 19 nt, Human
uuccuucccacccaacccc

SEQ ID NO: 280019 - RNA, 19 nt, Human
uugccccaccccaccccac

SEQ ID NO: 280020 - RNA, 20 nt, Human
uuugccuuuccccucccucc

SEQ ID NO: 280021 - RNA, 25 nt, Human
uuugccuuuccccucccucccaccc

SEQ ID NO: 280022 - RNA, 24 nt, Human
uuuuuuuuuuuuuuggaauuugga

SEQ ID NO: 280023 - RNA, 21 nt, Human
uuuuuuuuuuuuuuuggaauu

SEQ ID NO: 280024 - RNA, 23 nt, Human
uuuuuuuuuuuuuuuuggaauuu

SEQ ID NO: 280025 - RNA, 23 nt, Human
uuuuuuuuuuuuuuuuuggaauu

SEQ ID NO: 280026 - RNA, 20 nt, Human
uuuuuuuuuuuuuuuuuugg

SEQ ID NO: 280027 - RNA, 25 nt, Human
aaacaugguuacagucaagcuucac

SEQ ID NO: 280028 - RNA, 21 nt, Human
aaaccuccuacggagccccgg

SEQ ID NO: 280029 - RNA, 23 nt, Human
aaagaaaaaaaaaagauaaaagg

SEQ ID NO: 280030 - RNA, 19 nt, Human
aaauaacugugaaaacucu

SEQ ID NO: 280031 - RNA, 26 nt, Human
aaccagcagcagcagcagccaccgca

SEQ ID NO: 280032 - RNA, 30 nt, Human
aaccagcagcagcagcagccaccgcagccc

SEQ ID NO: 280033 - RNA, 20 nt, Human
aagaaugccauccacagaga

SEQ ID NO: 280034 - RNA, 20 nt, Human
aaggaagagaaggaggcagc

SEQ ID NO: 280035 - RNA, 18 nt, Human
aaggcaaaaagccccuuc

SEQ ID NO: 280036 - RNA, 20 nt, Human
aauaagaaggacuggaggga

SEQ ID NO: 280037 - RNA, 24 nt, Human
acauuccucaagcccuccaguccu

SEQ ID NO: 280038 - RNA, 23 nt, Human
accacauuccucaagcccuccag

SEQ ID NO: 280039 - RNA, 26 nt, Human
acgcaugucaggggaagaccggcgcg

SEQ ID NO: 280040 - RNA, 22 nt, Human
acggagccccggcaugccacgc

SEQ ID NO: 280041 - RNA, 20 nt, Human
acugcugcucuggaucgggu

SEQ ID NO: 280042 - RNA, 20 nt, Human
acuuuuuucuuuuuuuguug

SEQ ID NO: 280043 - RNA, 23 nt, Human
agaaaaaaaaaagauaaaaggca

SEQ ID NO: 280044 - RNA, 19 nt, Human
agaaggaaguuuccaggcc

SEQ ID NO: 280045 - RNA, 21 nt, Human
agaaggaaguuuccaggccug

SEQ ID NO: 280046 - RNA, 23 nt, Human
agaaggaggcagcccgaacccaa

SEQ ID NO: 280047 - RNA, 18 nt, Human
agcacaaccucagggggc

SEQ ID NO: 280048 - RNA, 19 nt, Human
agcacagauacucugagcc

SEQ ID NO: 280049 - RNA, 19 nt, Human
agccagguugacauaguca

SEQ ID NO: 280050 - RNA, 18 nt, Human
aggagaggaggaggaacc

SEQ ID NO: 280051 - RNA, 19 nt, Human
aggccugcggaaguggugg

SEQ ID NO: 280052 - RNA, 23 nt, Human
aggcugcagagguggccgagagg

SEQ ID NO: 280053 - RNA, 24 nt, Human
agggaccaccacauuccucaagcc

SEQ ID NO: 280054 - RNA, 20 nt, Human
auagcaggaggaagaguugc

SEQ ID NO: 280055 - RNA, 18 nt, Human
cacaaccucagggggcag

SEQ ID NO: 280056 - RNA, 19 nt, Human
cacacagaggaaagguggc

SEQ ID NO: 280057 - RNA, 20 nt, Human
cacccaaaccaacguggcac

SEQ ID NO: 280058 - RNA, 18 nt, Human
caccguccggcuccagag

SEQ ID NO: 280059 - RNA, 21 nt, Human
cagcagcagcagcagccaccg

SEQ ID NO: 280060 - RNA, 26 nt, Human
cagcagcagcagcagccaccgcagcc

SEQ ID NO: 280061 - RNA, 21 nt, Human
cagcagcagcagccaccgcag

SEQ ID NO: 280062 - RNA, 25 nt, Human
cagcagcagcagccaccgcagccag

SEQ ID NO: 280063 - RNA, 22 nt, Human
cagcagcagccaccgcagccag

SEQ ID NO: 280064 - RNA, 19 nt, Human
cagcagccaccgcagccag

SEQ ID NO: 280065 - RNA, 20 nt, Human
caggcugcagagguggccga

SEQ ID NO: 280066 - RNA, 21 nt, Human
caggucuuaaaggagagggaa

SEQ ID NO: 280067 - RNA, 23 nt, Human
caggucuuaaaggagagggugau

SEQ ID NO: 280068 - RNA, 20 nt, Human
cauaauuaaacagaaaaaac

SEQ ID NO: 280069 - RNA, 18 nt, Human
caugccacgcaugucagg

SEQ ID NO: 280070 - RNA, 19 nt, Human
caugccacgcaugucaggg

SEQ ID NO: 280071 - RNA, 18 nt, Human
caugccaggcguugucgu

SEQ ID NO: 280072 - RNA, 20 nt, Human
cauucacuggcuccacaaug

SEQ ID NO: 280073 - RNA, 23 nt, Human
cccaacauccaaggaguuugaac

SEQ ID NO: 280074 - RNA, 18 nt, Human
ccgcagccguggcugagc

SEQ ID NO: 280075 - RNA, 22 nt, Human
ccgcagccguggcugagcuuua

SEQ ID NO: 280076 - RNA, 20 nt, Human
ccucaaaggccccggacccc

SEQ ID NO: 280077 - RNA, 22 nt, Human
ccucaaaggccccggaccccag

SEQ ID NO: 280078 - RNA, 19 nt, Human
cggaccagggaggcacagg

SEQ ID NO: 280079 - RNA, 20 nt, Human
cggagcagccgccggcuucc

SEQ ID NO: 280080 - RNA, 21 nt, Human
cgggguggagggaggugggug

SEQ ID NO: 280081 - RNA, 23 nt, Human
cguagcacagauacucugagccu

SEQ ID NO: 280082 - RNA, 24 nt, Human
cugccaggcaaaagggggcugcag

SEQ ID NO: 280083 - RNA, 19 nt, Human
cuguguguguguguguccu

SEQ ID NO: 280084 - RNA, 22 nt, Human
cuuccuggguuucccaacugga

SEQ ID NO: 280085 - RNA, 20 nt, Human
cuuggaguuauggaacaagu

SEQ ID NO: 280086 - RNA, 22 nt, Human
cuuggaguuauggaacaaguua

SEQ ID NO: 280087 - RNA, 24 nt, Human
cuuuccaaacaaugaaucaguuaa

SEQ ID NO: 280088 - RNA, 24 nt, Human
gaagugcagagugcauaucccuga

SEQ ID NO: 280089 - RNA, 19 nt, Human
gacauagucagccgacuug

SEQ ID NO: 280090 - RNA, 22 nt, Human
gacaucugugagaucucaccgu

SEQ ID NO: 280091 - RNA, 22 nt, Human
gaggaagaguugccagaauucg

SEQ ID NO: 280092 - RNA, 22 nt, Human
gaggagaggaggaggaacccgg

SEQ ID NO: 280093 - RNA, 21 nt, Human
gaggcuuuuaacccugggcgu

SEQ ID NO: 280094 - RNA, 20 nt, Human
gagguggccgagaggcgggc

SEQ ID NO: 280095 - RNA, 19 nt, Human
gaguuggggagccaaauuc

SEQ ID NO: 280096 - RNA, 20 nt, Human
gcacaaaaccuucugucucc

SEQ ID NO: 280097 - RNA, 18 nt, Human
gcagggcacaaaaccuuc

SEQ ID NO: 280098 - RNA, 26 nt, Human
gcaguucugacaucuguggucccaug

SEQ ID NO: 280099 - RNA, 25 nt, Human
gcgagagcgcaagaggaggugccug

SEQ ID NO: 280100 - RNA, 18 nt, Human
gcugaaauuuagaaugcc

SEQ ID NO: 280101 - RNA, 18 nt, Human
ggaaaguggccacauucu

SEQ ID NO: 280102 - RNA, 18 nt, Human
ggaccagggaggcacagg

SEQ ID NO: 280103 - RNA, 21 nt, Human
ggaccccagguuaaugaccaa

SEQ ID NO: 280104 - RNA, 18 nt, Human
ggagaggaggaggaaccc

SEQ ID NO: 280105 - RNA, 19 nt, Human
ggagggaaagaggagagga

SEQ ID NO: 280106 - RNA, 21 nt, Human
ggagggaaagaggagaggagg

SEQ ID NO: 280107 - RNA, 21 nt, Human
ggaggugggugggcgaaauca

SEQ ID NO: 280108 - RNA, 23 nt, Human
ggaucucuaggcacuucgagucu

SEQ ID NO: 280109 - RNA, 21 nt, Human
ggcaaugaaggaagagaagga

SEQ ID NO: 280110 - RNA, 19 nt, Human
gggaaagaggagaggagga

SEQ ID NO: 280111 - RNA, 18 nt, Human
gggaagagggaagcaaua

SEQ ID NO: 280112 - RNA, 23 nt, Human
gggggcagaaacaacgaagagag

SEQ ID NO: 280113 - RNA, 23 nt, Human
gucaagcuucacaaacauuacag

SEQ ID NO: 280114 - RNA, 19 nt, Human
gugguaagaaugccaucca

SEQ ID NO: 280115 - RNA, 21 nt, Human
gugguaagaaugccauccaca

SEQ ID NO: 280116 - RNA, 25 nt, Human
uaagaaugccauccacagagauugu

SEQ ID NO: 280117 - RNA, 22 nt, Human
uacagucaagcuucacaaacau

SEQ ID NO: 280118 - RNA, 22 nt, Human
uaugauacagcagggcacaaaa

SEQ ID NO: 280119 - RNA, 21 nt, Human
uauggaacaaguaagccauga

SEQ ID NO: 280120 - RNA, 20 nt, Human
ucccagguauagcaaaccuc

SEQ ID NO: 280121 - RNA, 23 nt, Human
uccuccggaucucuaggcacuuc

SEQ ID NO: 280122 - RNA, 18 nt, Human
ucucgagcugccaagcuc

SEQ ID NO: 280123 - RNA, 18 nt, Human
ucucuaggcacuucgagu

SEQ ID NO: 280124 - RNA, 21 nt, Human
ucugugagaucucaccgucca

SEQ ID NO: 280125 - RNA, 25 nt, Human
ugagaaagcacaaccucagggggca

SEQ ID NO: 280126 - RNA, 20 nt, Human
ugagcuuuagagagagaugc

SEQ ID NO: 280127 - RNA, 24 nt, Human
ugccaggcaaaagggggcugcagg

SEQ ID NO: 280128 - RNA, 18 nt, Human
ugcggagcagccacccaa

SEQ ID NO: 280129 - RNA, 24 nt, Human
uggagggaaagaggagaggaggaa

SEQ ID NO: 280130 - RNA, 19 nt, Human
uggcaggcugcagaggugg

SEQ ID NO: 280131 - RNA, 24 nt, Human
uggcaggcugcagagguggccgag

SEQ ID NO: 280132 - RNA, 18 nt, Human
uggguucaggugaguuua

SEQ ID NO: 280133 - RNA, 18 nt, Human
ugguguuuuuuucuuuuu

SEQ ID NO: 280134 - RNA, 21 nt, Human
ugugagaucucaccguccaaa

SEQ ID NO: 280135 - RNA, 22 nt, Human
uucacaaaugggcaagucauau

SEQ ID NO: 280136 - RNA, 21 nt, Human
uuccauucacuggcuccacaa

SEQ ID NO: 280137 - RNA, 21 nt, Human
uucggguguuccugggagucu

SEQ ID NO: 280138 - RNA, 22 nt, Human
uugaacauuuuuauuuuccugu

SEQ ID NO: 280139 - RNA, 26 nt, Human
uuuauuuuccuguuuccaaccuucag

SEQ ID NO: 280140 - RNA, 21 nt, Human
uuucacugcaggaauggaagu

SEQ ID NO: 280141 - RNA, 22 nt, Human
uuuuuuguuguuguaguuuugu

SEQ ID NO: 280142 - RNA, 27 nt, Human
acgaugaccauguggaaaaguuggggg

SEQ ID NO: 280143 - RNA, 22 nt, Human
aguguugggauaugaggaaaga

SEQ ID NO: 280144 - RNA, 22 nt, Human
caaccauaagcccccacuggcu

SEQ ID NO: 280145 - RNA, 19 nt, Human
cacacaaccauaagccccc

SEQ ID NO: 280146 - RNA, 22 nt, Human
cugucugucuccuugguugggg

SEQ ID NO: 280147 - RNA, 19 nt, Human
gggaaaguguucggggcag

SEQ ID NO: 280148 - RNA, 23 nt, Human
uccccaaaugguacccugggggc

SEQ ID NO: 280149 - RNA, 19 nt, Human
uccuugguuggggcccacu

SEQ ID NO: 280150 - RNA, 22 nt, Human
ucggggcagauguguuuuuuuu

SEQ ID NO: 280151 - RNA, 20 nt, Human
ugaggaaagaauaccagugg

SEQ ID NO: 280152 - RNA, 28 nt, Human
ugggaaaguguucggggcagauguguuu

SEQ ID NO: 280153 - RNA, 21 nt, Human
ugggggaaagagacccaaguc

SEQ ID NO: 280154 - RNA, 26 nt, Human
ugucacaagaguucugaguguuggga

SEQ ID NO: 280155 - RNA, 19 nt, Human
uguuuuuuuuuaaggggga

SEQ ID NO: 280156 - RNA, 21 nt, Human
uucacacaaccauaagccccc

SEQ ID NO: 280157 - RNA, 21 nt, Human
uucacacaaccauaagccccc

SEQ ID NO: 280158 - RNA, 23 nt, Human
uucacacaaccauaagcccccac

SEQ ID NO: 280159 - RNA, 20 nt, Human
uuuaagggggaaagaaagaa

SEQ ID NO: 280160 - RNA, 18 nt, Human
uuuuuuuuuuuuuuuuug

SEQ ID NO: 280161 - RNA, 23 nt, Human
aaaaauaauaaaaaccccaugcu

SEQ ID NO: 280162 - RNA, 19 nt, Human
agacgucuuuagguaaaaa

SEQ ID NO: 280163 - RNA, 19 nt, Human
aggccggcggcggcggugg

SEQ ID NO: 280164 - RNA, 21 nt, Human
aguucuauuuaucuggucaac

SEQ ID NO: 280165 - RNA, 21 nt, Human
caacgggcaaaaagcaagcac

SEQ ID NO: 280166 - RNA, 18 nt, Human
cagggcucucuggggucc

SEQ ID NO: 280167 - RNA, 21 nt, Human
cggcugcggcagcugcggcuu

SEQ ID NO: 280168 - RNA, 18 nt, Human
cuaggccggcggcggcgg

SEQ ID NO: 280169 - RNA, 21 nt, Human
gcggcagcugcggcuccuccc

SEQ ID NO: 280170 - RNA, 19 nt, Human
gcggcggcgguggggcugc

SEQ ID NO: 280171 - RNA, 21 nt, Human
gcgguggggcugcucagggcu

SEQ ID NO: 280172 - RNA, 19 nt, Human
ggugauggugacuggggcc

SEQ ID NO: 280173 - RNA, 24 nt, Human
uaaaggcguauugagaaaaaccag

SEQ ID NO: 280174 - RNA, 24 nt, Human
uagguaaaaauaauaaaaacccca

SEQ ID NO: 280175 - RNA, 19 nt, Human
uaggucuucagcuccaauc

SEQ ID NO: 280176 - RNA, 22 nt, Human
uauuaccaaaaagagacgucuu

SEQ ID NO: 280177 - RNA, 18 nt, Human
uauugagaaaaaccaggc

SEQ ID NO: 280178 - RNA, 20 nt, Human
uauugagaaaaaccaggcuu

SEQ ID NO: 280179 - RNA, 21 nt, Human
ucugggguccgcucuccgcuc

SEQ ID NO: 280180 - RNA, 20 nt, Human
ucuuauugcuggaauuucau

SEQ ID NO: 280181 - RNA, 18 nt, Human
ucuuuuguucauuucuua

SEQ ID NO: 280182 - RNA, 22 nt, Human
uggugacuggggccggcugcgg

SEQ ID NO: 280183 - RNA, 26 nt, Human
uuaaaaaacacguuuguuauuaccaa

SEQ ID NO: 280184 - RNA, 19 nt, Human
aaaacacaaagacauuaag

SEQ ID NO: 280185 - RNA, 20 nt, Human
aaaacccaaaacaaagaaga

SEQ ID NO: 280186 - RNA, 24 nt, Human
aaaggacucaacgggugcuuccuu

SEQ ID NO: 280187 - RNA, 23 nt, Human
aacagaggagccacacccaagug

SEQ ID NO: 280188 - RNA, 25 nt, Human
aaccaaauugacaccuuccacgaga

SEQ ID NO: 280189 - RNA, 23 nt, Human
aagaaguguguggaggguaaagg

SEQ ID NO: 280190 - RNA, 18 nt, Human
aagccagauuugcaugua

SEQ ID NO: 280191 - RNA, 18 nt, Human
aaguauauuuacucuuua

SEQ ID NO: 280192 - RNA, 23 nt, Human
aauaacagaggagccacacccaa

SEQ ID NO: 280193 - RNA, 26 nt, Human
aaugauugagaacagcauuuuagaga

SEQ ID NO: 280194 - RNA, 21 nt, Human
aauggacaauaaaggacugag

SEQ ID NO: 280195 - RNA, 22 nt, Human
acaaaacacaaagacauuaagc

SEQ ID NO: 280196 - RNA, 19 nt, Human
agccacaaaauaagcuagg

SEQ ID NO: 280197 - RNA, 23 nt, Human
agcuagggaagaaaacccaaaac

SEQ ID NO: 280198 - RNA, 22 nt, Human
aggaaauguguucaauguauug

SEQ ID NO: 280199 - RNA, 19 nt, Human
aggaauccaggauacuggc

SEQ ID NO: 280200 - RNA, 22 nt, Human
aggagacuucuauuucuugccc

SEQ ID NO: 280201 - RNA, 25 nt, Human
agggaagaaaacccaaaacaaagaa

SEQ ID NO: 280202 - RNA, 27 nt, Human
agggaagaaaacccaaaacaaagaaga

SEQ ID NO: 280203 - RNA, 19 nt, Human
agggagagggcuagaaaau

SEQ ID NO: 280204 - RNA, 23 nt, Human
aguaagccuuaauauuauacuaa

SEQ ID NO: 280205 - RNA, 19 nt, Human
caaaacacaaagacauuaa

SEQ ID NO: 280206 - RNA, 23 nt, Human
caaagacauuaagcucauuuaac

SEQ ID NO: 280207 - RNA, 22 nt, Human
caaauacccagugacuuuuagu

SEQ ID NO: 280208 - RNA, 25 nt, Human
cacaaagacauuaagcucauuuaac

SEQ ID NO: 280209 - RNA, 18 nt, Human
cacccucaaaaggacuca

SEQ ID NO: 280210 - RNA, 22 nt, Human
cacuccauaagucucaucacca

SEQ ID NO: 280211 - RNA, 29 nt, Human
cacuccauaagucucaucaccaaauauga

SEQ ID NO: 280212 - RNA, 24 nt, Human
cacuguggccacaagccucauggg

SEQ ID NO: 280213 - RNA, 25 nt, Human
cagcaguugggagagagaggcacac

SEQ ID NO: 280214 - RNA, 25 nt, Human
caugacacugacugagaguuuucaa

SEQ ID NO: 280215 - RNA, 22 nt, Human
ccacaaaauaagcuagggaaga

SEQ ID NO: 280216 - RNA, 20 nt, Human
ccauaagucucaucaccaaa

SEQ ID NO: 280217 - RNA, 18 nt, Human
ccuuggucacuucccuug

SEQ ID NO: 280218 - RNA, 23 nt, Human
cuaaaccaaauugacaccuucca

SEQ ID NO: 280219 - RNA, 19 nt, Human
cucaaaaggacucaacggg

SEQ ID NO: 280220 - RNA, 23 nt, Human
cucaacgggugcuuccuuuugga

SEQ ID NO: 280221 - RNA, 22 nt, Human
cugacugcaacuugaaaacauc

SEQ ID NO: 280222 - RNA, 21 nt, Human
gaaaacccaaaacaaagaaga

SEQ ID NO: 280223 - RNA, 23 nt, Human
gaagauaugacauccaagucucc

SEQ ID NO: 280224 - RNA, 19 nt, Human
gacugagggagagggcuag

SEQ ID NO: 280225 - RNA, 22 nt, Human
gaucauuuaaaauaaaggauaa

SEQ ID NO: 280226 - RNA, 19 nt, Human
gaucucuggcccacaccuc

SEQ ID NO: 280227 - RNA, 23 nt, Human
gaugaucugcuuucucacaugag

SEQ ID NO: 280228 - RNA, 20 nt, Human
gccacacccaagugccacug

SEQ ID NO: 280229 - RNA, 25 nt, Human
ggaagaaaacccaaaacaaagaaga

SEQ ID NO: 280230 - RNA, 22 nt, Human
guaguguccacaaguacuggaa

SEQ ID NO: 280231 - RNA, 21 nt, Human
gucaaauguauauaaggagac

SEQ ID NO: 280232 - RNA, 19 nt, Human
guccuugcauuuuaagcag

SEQ ID NO: 280233 - RNA, 21 nt, Human
guuuuuaacaacaucuucuaa

SEQ ID NO: 280234 - RNA, 21 nt, Human
uaacaacaucuucuaaguggu

SEQ ID NO: 280235 - RNA, 25 nt, Human
uaagacaaaucacccucaaaaggac

SEQ ID NO: 280236 - RNA, 21 nt, Human
uaagccagauuugcauguaga

SEQ ID NO: 280237 - RNA, 20 nt, Human
uaagcgcagcauucuaaacc

SEQ ID NO: 280238 - RNA, 26 nt, Human
uaagcuagggaagaaaacccaaaaca

SEQ ID NO: 280239 - RNA, 24 nt, Human
uaaggaauugacccacuuggaguu

SEQ ID NO: 280240 - RNA, 23 nt, Human
uaaguuaacacaaugugugcugc

SEQ ID NO: 280241 - RNA, 19 nt, Human
uacaauccacuucuuuaaa

SEQ ID NO: 280242 - RNA, 20 nt, Human
uacaguuuuggacaaaacac

SEQ ID NO: 280243 - RNA, 21 nt, Human
uagaggaauccaggauacugg

SEQ ID NO: 280244 - RNA, 20 nt, Human
uagauaguacagaucauuua

SEQ ID NO: 280245 - RNA, 24 nt, Human
uagauaguacagaucauuuaaaau

SEQ ID NO: 280246 - RNA, 20 nt, Human
uagcucaggacagcugucag

SEQ ID NO: 280247 - RNA, 24 nt, Human
uaguagagagguugaaacguguag

SEQ ID NO: 280248 - RNA, 18 nt, Human
uauuuuuucaauacaguu

SEQ ID NO: 280249 - RNA, 24 nt, Human
ucaagggugauggugcuaguagag

SEQ ID NO: 280250 - RNA, 23 nt, Human
uccacuucuuuaaaagccacaaa

SEQ ID NO: 280251 - RNA, 20 nt, Human
ucugacugcaacuugaaaac

SEQ ID NO: 280252 - RNA, 19 nt, Human
ugagcaagaaggaaucacu

SEQ ID NO: 280253 - RNA, 21 nt, Human
ugaggacaaauaacagaggag

SEQ ID NO: 280254 - RNA, 21 nt, Human
ugauggugcuaguagagaggu

SEQ ID NO: 280255 - RNA, 20 nt, Human
ugcugcuuucaugaggagga

SEQ ID NO: 280256 - RNA, 19 nt, Human
uggagaauaguguuuuaga

SEQ ID NO: 280257 - RNA, 21 nt, Human
uggcaagauuuggagaugauc

SEQ ID NO: 280258 - RNA, 19 nt, Human
uggccacaagccucauggg

SEQ ID NO: 280259 - RNA, 19 nt, Human
uggcuucuaauugcuuguc

SEQ ID NO: 280260 - RNA, 19 nt, Human
ugggaagguaagcgcagca

SEQ ID NO: 280261 - RNA, 22 nt, Human
ugggagagagaggcacacucca

SEQ ID NO: 280262 - RNA, 24 nt, Human
ugggagagagaggcacacuccaua

SEQ ID NO: 280263 - RNA, 19 nt, Human
ugguaauaaugagcauauc

SEQ ID NO: 280264 - RNA, 19 nt, Human
uguagaaagucugccuucu

SEQ ID NO: 280265 - RNA, 24 nt, Human
uguuuggcuuugucaaauguauau

SEQ ID NO: 280266 - RNA, 22 nt, Human
uucaccuuggucacuucccuug

SEQ ID NO: 280267 - RNA, 21 nt, Human
uuccugcuaagucagucaguu

SEQ ID NO: 280268 - RNA, 21 nt, Human
uugcauuuuaagcagcaguug

SEQ ID NO: 280269 - RNA, 21 nt, Human
uuuuaagcagcaguugggaga

SEQ ID NO: 280270 - RNA, 22 nt, Human
aaaacacacacccaaaacccga

SEQ ID NO: 280271 - RNA, 19 nt, Human
aaacacacacccaaaaccc

SEQ ID NO: 280272 - RNA, 20 nt, Human
aagacaaaacagauucagaa

SEQ ID NO: 280273 - RNA, 20 nt, Human
aaguaaccacgcuaugaaac

SEQ ID NO: 280274 - RNA, 18 nt, Human
acaaaacagauucagaag

SEQ ID NO: 280275 - RNA, 18 nt, Human
aguaaacuuacuaagaac

SEQ ID NO: 280276 - RNA, 18 nt, Human
caccaugauuuagaaagu

SEQ ID NO: 280277 - RNA, 18 nt, Human
cagcauuauagaaaguaa

SEQ ID NO: 280278 - RNA, 21 nt, Human
cagcauuauagaaaguaacca

SEQ ID NO: 280279 - RNA, 22 nt, Human
cagcccaauuuaucucuuagcu

SEQ ID NO: 280280 - RNA, 24 nt, Human
ccacgcuaugaaaacacacaccca

SEQ ID NO: 280281 - RNA, 22 nt, Human
cuaugaaaacacacacccaaaa

SEQ ID NO: 280282 - RNA, 30 nt, Human
cuucuaauuacuaacauugcacauucaccu

SEQ ID NO: 280283 - RNA, 21 nt, Human
gaaaacacacacccaaaaccc

SEQ ID NO: 280284 - RNA, 23 nt, Human
gaaaguaaccacgcuaugaaaac

SEQ ID NO: 280285 - RNA, 22 nt, Human
gauggguggcaauugugauaga

SEQ ID NO: 280286 - RNA, 22 nt, Human
gcuaugaaaacacacacccaaa

SEQ ID NO: 280287 - RNA, 22 nt, Human
gguacagcauuauagaaaguaa

SEQ ID NO: 280288 - RNA, 24 nt, Human
uagaaaagaugaauagcuguaaug

SEQ ID NO: 280289 - RNA, 21 nt, Human
uccagguucuuagaaucuggg

SEQ ID NO: 280290 - RNA, 23 nt, Human
uccagguucuuagaaucugggua

SEQ ID NO: 280291 - RNA, 21 nt, Human
ucuccagguucuuagaaucug

SEQ ID NO: 280292 - RNA, 22 nt, Human
ucuuggaaaauuucuuaauugu

SEQ ID NO: 280293 - RNA, 21 nt, Human
ugaaaacacacacccaaaacc

SEQ ID NO: 280294 - RNA, 20 nt, Human
uggcaauugugauagauuag

SEQ ID NO: 280295 - RNA, 24 nt, Human
uguucagugcuuucugacaaguuc

SEQ ID NO: 280296 - RNA, 21 nt, Human
uuuaaaaguuugguuuaaaaa

SEQ ID NO: 280297 - RNA, 20 nt, Human
accggguggcugggccuggg

SEQ ID NO: 280298 - RNA, 21 nt, Human
ccccugugggccugcccuucc

SEQ ID NO: 280299 - RNA, 22 nt, Human
ccuuuagcuccagcugcugccc

SEQ ID NO: 280300 - RNA, 18 nt, Human
cggcucugcgguggcccc

SEQ ID NO: 280301 - RNA, 20 nt, Human
cucggcucugcgguggcccc

SEQ ID NO: 280302 - RNA, 23 nt, Human
cucucgggagguaccggguggcu

SEQ ID NO: 280303 - RNA, 19 nt, Human
gaagcggagggagcgcugc

SEQ ID NO: 280304 - RNA, 19 nt, Human
uccaugccagccagggucc

SEQ ID NO: 280305 - RNA, 24 nt, Human
uccaugccagccaggguccaggga

SEQ ID NO: 280306 - RNA, 23 nt, Human
ucggcucugcgguggccccugug

SEQ ID NO: 280307 - RNA, 22 nt, Human
ucgggagguaccggguggcugg

SEQ ID NO: 280308 - RNA, 18 nt, Human
ugcccuuccuuuagcucc

SEQ ID NO: 280309 - RNA, 21 nt, Human
ugcccuuccuuuagcuccagc

SEQ ID NO: 280310 - RNA, 23 nt, Human
uuaaaggucccgacugguuuucc

SEQ ID NO: 280311 - RNA, 26 nt, Human
aaacaaaagguaauaaggagggaccc

SEQ ID NO: 280312 - RNA, 24 nt, Human
aaagugcugggauuacaggcguga

SEQ ID NO: 280313 - RNA, 18 nt, Human
aagaaagagucuauaacc

SEQ ID NO: 280314 - RNA, 21 nt, Human
aagcagccuugccagagucac

SEQ ID NO: 280315 - RNA, 24 nt, Human
aaguagagcauacuucugugcaaa

SEQ ID NO: 280316 - RNA, 19 nt, Human
aagugcugggauuacaggc

SEQ ID NO: 280317 - RNA, 19 nt, Human
aagugcugggauuacaggc

SEQ ID NO: 280318 - RNA, 26 nt, Human
aagugcugggauuacaggcgugagcc

SEQ ID NO: 280319 - RNA, 18 nt, Human
aagugucacaagccacag

SEQ ID NO: 280320 - RNA, 25 nt, Human
aagugucacaagccacaguggagcc

SEQ ID NO: 280321 - RNA, 19 nt, Human
aaugacaagaauggaagaa

SEQ ID NO: 280322 - RNA, 24 nt, Human
aauuuuguauuuuuaguagagaug

SEQ ID NO: 280323 - RNA, 23 nt, Human
acaaacaaaagguaauaaggaua

SEQ ID NO: 280324 - RNA, 27 nt, Human
acaucacuguacuccagccugggcagc

SEQ ID NO: 280325 - RNA, 19 nt, Human
acuccagccugggcagcag

SEQ ID NO: 280326 - RNA, 24 nt, Human
acuguacuccagccugggcagcag

SEQ ID NO: 280327 - RNA, 26 nt, Human
acuguacuccagccugggcagcagag

SEQ ID NO: 280328 - RNA, 18 nt, Human
acuugcagcuaaauucuu

SEQ ID NO: 280329 - RNA, 18 nt, Human
acuuguaaucccagaacu

SEQ ID NO: 280330 - RNA, 21 nt, Human
acuuguaaucccagaacuuug

SEQ ID NO: 280331 - RNA, 20 nt, Human
agagaagcagccuugccaga

SEQ ID NO: 280332 - RNA, 18 nt, Human
agaggacaaagaaaucug

SEQ ID NO: 280333 - RNA, 21 nt, Human
agaugaugggauuacaggcau

SEQ ID NO: 280334 - RNA, 20 nt, Human
agcagcuaaucuacccuccc

SEQ ID NO: 280335 - RNA, 24 nt, Human
agccagugauagagaagcagccuu

SEQ ID NO: 280336 - RNA, 22 nt, Human
agccugggcagcagagcgaaac

SEQ ID NO: 280337 - RNA, 24 nt, Human
agccugggcagcagagcgaaacuc

SEQ ID NO: 280338 - RNA, 18 nt, Human
agcuaaucuacccucccc

SEQ ID NO: 280339 - RNA, 18 nt, Human
aggcaguucuucccuuuc

SEQ ID NO: 280340 - RNA, 21 nt, Human
aggcaguucuucccuuucuuu

SEQ ID NO: 280341 - RNA, 22 nt, Human
aggcaguucuucccuuucuuuu

SEQ ID NO: 280342 - RNA, 20 nt, Human
aggcaugcaccaccacgccc

SEQ ID NO: 280343 - RNA, 21 nt, Human
aggccgaggcgaauggaucac

SEQ ID NO: 280344 - RNA, 26 nt, Human
aggcgaauggaucacuugacgucagg

SEQ ID NO: 280345 - RNA, 24 nt, Human
aggugauccgccugucucggccuc

SEQ ID NO: 280346 - RNA, 22 nt, Human
aguacagauacacaaaaccaaa

SEQ ID NO: 280347 - RNA, 23 nt, Human
aguacagauacacaaaaccaaaa

SEQ ID NO: 280348 - RNA, 22 nt, Human
aguagagaugggguuucuccau

SEQ ID NO: 280349 - RNA, 18 nt, Human
agugcugggauuacaggc

SEQ ID NO: 280350 - RNA, 22 nt, Human
auagaauccugcccuaaagcaa

SEQ ID NO: 280351 - RNA, 24 nt, Human
auagagaagcagccuugccagagu

SEQ ID NO: 280352 - RNA, 21 nt, Human
aucaacucuuagaggacaaag

SEQ ID NO: 280353 - RNA, 24 nt, Human
aucacaucacuguacuccagccug

SEQ ID NO: 280354 - RNA, 23 nt, Human
aucacuguacuccagccugggca

SEQ ID NO: 280355 - RNA, 24 nt, Human
aucacuguacuccagccugggcag

SEQ ID NO: 280356 - RNA, 19 nt, Human
augaugggauuacaggcau

SEQ ID NO: 280357 - RNA, 20 nt, Human
augggguuucuccauguugg

SEQ ID NO: 280358 - RNA, 21 nt, Human
augggguuucuccauguuggu

SEQ ID NO: 280359 - RNA, 21 nt, Human
auucacacugauugugcccuc

SEQ ID NO: 280360 - RNA, 22 nt, Human
caaaaccaaaacaaguaucuau

SEQ ID NO: 280361 - RNA, 24 nt, Human
caaagugcugggauuacaggcgug

SEQ ID NO: 280362 - RNA, 22 nt, Human
caagcaauucuccugccucagc

SEQ ID NO: 280363 - RNA, 22 nt, Human
caccaccacgcccagguaauuu

SEQ ID NO: 280364 - RNA, 21 nt, Human
cacugcaaccuccgccuccug

SEQ ID NO: 280365 - RNA, 23 nt, Human
cacugcaaccuccgccuccuggg

SEQ ID NO: 280366 - RNA, 19 nt, Human
cacuguacuccagccuggg

SEQ ID NO: 280367 - RNA, 20 nt, Human
cacuguacuccagccugggc

SEQ ID NO: 280368 - RNA, 21 nt, Human
cacuguacuccagccugggca

SEQ ID NO: 280369 - RNA, 21 nt, Human
cacuguacuccagccugggca

SEQ ID NO: 280370 - RNA, 21 nt, Human
cacuguacuccagccugggca

SEQ ID NO: 280371 - RNA, 22 nt, Human
cacuguacuccagccugggcag

SEQ ID NO: 280372 - RNA, 22 nt, Human
cacuguacuccagccugggcag

SEQ ID NO: 280373 - RNA, 23 nt, Human
cacuguacuccagccugggcagc

SEQ ID NO: 280374 - RNA, 24 nt, Human
cacuguacuccagccugggcagca

SEQ ID NO: 280375 - RNA, 18 nt, Human
cagaacuuugggaggccg

SEQ ID NO: 280376 - RNA, 20 nt, Human
cagaacuuugggaggccgag

SEQ ID NO: 280377 - RNA, 25 nt, Human
cagcagagcgaaacucggcuccagu

SEQ ID NO: 280378 - RNA, 22 nt, Human
caguaaugauucauucuuguuu

SEQ ID NO: 280379 - RNA, 25 nt, Human
caguucuucccuuucuuuucugggg

SEQ ID NO: 280380 - RNA, 24 nt, Human
cauucuuguuuaaaacaagagggg

SEQ ID NO: 280381 - RNA, 22 nt, Human
ccaaagugcugggauuacaggc

SEQ ID NO: 280382 - RNA, 22 nt, Human
ccaaagugcugggauuacaggc

SEQ ID NO: 280383 - RNA, 24 nt, Human
ccaaagugcugggauuacaggcgu

SEQ ID NO: 280384 - RNA, 21 nt, Human
ccauccucugauguucaauuu

SEQ ID NO: 280385 - RNA, 22 nt, Human
ccauguugguaaggcuggucuc

SEQ ID NO: 280386 - RNA, 23 nt, Human
ccauguugguaaggcuggucucg

SEQ ID NO: 280387 - RNA, 18 nt, Human
cccgaccucaggugaucc

SEQ ID NO: 280388 - RNA, 21 nt, Human
cccgaccucaggugauccgcc

SEQ ID NO: 280389 - RNA, 23 nt, Human
cccgaccucaggugauccgccug

SEQ ID NO: 280390 - RNA, 19 nt, Human
cccucccccgaguagaacc

SEQ ID NO: 280391 - RNA, 27 nt, Human
ccgaggcgaauggaucacuugacguca

SEQ ID NO: 280392 - RNA, 26 nt, Human
ccgccuccuggguucaagcaauucuu

SEQ ID NO: 280393 - RNA, 23 nt, Human
ccucccccgaguagaacccuaac

SEQ ID NO: 280394 - RNA, 19 nt, Human
ccuccgccuccuggguuca

SEQ ID NO: 280395 - RNA, 24 nt, Human
ccuccuggguucaagcaauucucc

SEQ ID NO: 280396 - RNA, 21 nt, Human
ccucuucccacucuuuguucc

SEQ ID NO: 280397 - RNA, 23 nt, Human
ccuggguucaagcaauucuccug

SEQ ID NO: 280398 - RNA, 22 nt, Human
ccugucucggccucccaaagug

SEQ ID NO: 280399 - RNA, 20 nt, Human
cgaccucaggugauccgccu

SEQ ID NO: 280400 - RNA, 19 nt, Human
cggcuccagcgcacggcaa

SEQ ID NO: 280401 - RNA, 24 nt, Human
cucacugcaaccuccgccuccugg

SEQ ID NO: 280402 - RNA, 26 nt, Human
cucccgaccucaggugauccgccugu

SEQ ID NO: 280403 - RNA, 21 nt, Human
cuccuggguucaagcaauucu

SEQ ID NO: 280404 - RNA, 23 nt, Human
cugcaaccuccgccuccuggguu

SEQ ID NO: 280405 - RNA, 21 nt, Human
cugccucagccuccugaguag

SEQ ID NO: 280406 - RNA, 20 nt, Human
cuguaguauaagaaggcagu

SEQ ID NO: 280407 - RNA, 23 nt, Human
cugucucggccucccaaagugcu

SEQ ID NO: 280408 - RNA, 19 nt, Human
cuuacagagcccucuuccc

SEQ ID NO: 280409 - RNA, 23 nt, Human
cuuacagagcccucuucccaucc

SEQ ID NO: 280410 - RNA, 24 nt, Human
cuucccuuucuuuucugggggcuu

SEQ ID NO: 280411 - RNA, 24 nt, Human
cuuguugcccaggcuggagugcaa

SEQ ID NO: 280412 - RNA, 22 nt, Human
cuuucacuguacuggugaaaca

SEQ ID NO: 280413 - RNA, 23 nt, Human
gaauggaucacuugacgucagga

SEQ ID NO: 280414 - RNA, 24 nt, Human
gaauuuauucacacugauugugcc

SEQ ID NO: 280415 - RNA, 19 nt, Human
gaccucaggugauccgccu

SEQ ID NO: 280416 - RNA, 24 nt, Human
gaccucaggugauccgccugucuc

SEQ ID NO: 280417 - RNA, 24 nt, Human
gagaugggguuucuccauguuggu

SEQ ID NO: 280418 - RNA, 24 nt, Human
gagccacagcuauauagcccacac

SEQ ID NO: 280419 - RNA, 19 nt, Human
gagccgccgugccuggccu

SEQ ID NO: 280420 - RNA, 18 nt, Human
gaucacuugacgucagga

SEQ ID NO: 280421 - RNA, 18 nt, Human
gauuacaggcgugagccg

SEQ ID NO: 280422 - RNA, 21 nt, Human
gauuacaggcgugagccgccg

SEQ ID NO: 280423 - RNA, 24 nt, Human
gauuacaggcgugagccgccgugc

SEQ ID NO: 280424 - RNA, 22 nt, Human
gcaaccuccgccuccuggguuc

SEQ ID NO: 280425 - RNA, 18 nt, Human
gcaguucuucccuuucuu

SEQ ID NO: 280426 - RNA, 19 nt, Human
gcccaggcuggagugcaau

SEQ ID NO: 280427 - RNA, 25 nt, Human
gcuggagugcaauggcacaauccug

SEQ ID NO: 280428 - RNA, 23 nt, Human
gcuggucucgaacucccgaccuc

SEQ ID NO: 280429 - RNA, 24 nt, Human
ggagaucacaucacuguacuccag

SEQ ID NO: 280430 - RNA, 18 nt, Human
ggccgaggcgaauggauc

SEQ ID NO: 280431 - RNA, 18 nt, Human
gggguuucuccauguugg

SEQ ID NO: 280432 - RNA, 24 nt, Human
guaauuuuguauuuuuaguagaga

SEQ ID NO: 280433 - RNA, 24 nt, Human
guacuccagccugggcagcagagc

SEQ ID NO: 280434 - RNA, 23 nt, Human
guagagcauacuucugugcaaag

SEQ ID NO: 280435 - RNA, 23 nt, Human
guagaugaugggauuacaggcau

SEQ ID NO: 280436 - RNA, 19 nt, Human
guaguauaagaaggcaguu

SEQ ID NO: 280437 - RNA, 24 nt, Human
guucuuguugcccaggcuggagug

SEQ ID NO: 280438 - RNA, 19 nt, Human
uaaacaaacaaaagguaau

SEQ ID NO: 280439 - RNA, 20 nt, Human
uaaagcaacgcaaguagagc

SEQ ID NO: 280440 - RNA, 22 nt, Human
uaacauacacaguaaugauuca

SEQ ID NO: 280441 - RNA, 25 nt, Human
uacaauaccauguaaugcacuggaa

SEQ ID NO: 280442 - RNA, 23 nt, Human
uacacaaaaccaaaacaaguauc

SEQ ID NO: 280443 - RNA, 18 nt, Human
uacacugacauacggaug

SEQ ID NO: 280444 - RNA, 24 nt, Human
uacagauacacaaaaccaaaacaa

SEQ ID NO: 280445 - RNA, 24 nt, Human
uacaggcaugcaccaccacgccca

SEQ ID NO: 280446 - RNA, 23 nt, Human
uacuccagccugggcagcagagc

SEQ ID NO: 280447 - RNA, 24 nt, Human
uacuccagccugggcagcagagcg

SEQ ID NO: 280448 - RNA, 24 nt, Human
uacuuguaaucccagaacuuuggg

SEQ ID NO: 280449 - RNA, 24 nt, Human
uagaugaugggauuacaggcaugc

SEQ ID NO: 280450 - RNA, 22 nt, Human
uagcacaauuuguaacauuaca

SEQ ID NO: 280451 - RNA, 24 nt, Human
uaguagagaugggguuucuccaug

SEQ ID NO: 280452 - RNA, 19 nt, Human
uauacaaugguuaaagaaa

SEQ ID NO: 280453 - RNA, 19 nt, Human
ucaagcaauucuccugccu

SEQ ID NO: 280454 - RNA, 21 nt, Human
ucacagauaagaaggagguug

SEQ ID NO: 280455 - RNA, 23 nt, Human
ucacaucacuguacuccagccug

SEQ ID NO: 280456 - RNA, 23 nt, Human
ucacugcaaccuccgccuccugg

SEQ ID NO: 280457 - RNA, 24 nt, Human
ucacugcaaccuccgccuccuggg

SEQ ID NO: 280458 - RNA, 25 nt, Human
ucacugcaaccuccgccuccugggu

SEQ ID NO: 280459 - RNA, 27 nt, Human
ucacugcaaccuccgccuccuggguuc

SEQ ID NO: 280460 - RNA, 21 nt, Human
ucacuguacuccagccugggc

SEQ ID NO: 280461 - RNA, 22 nt, Human
ucacuguacuccagccugggca

SEQ ID NO: 280462 - RNA, 23 nt, Human
ucacuguacuccagccugggcag

SEQ ID NO: 280463 - RNA, 24 nt, Human
ucacuguacuccagccugggcagc

SEQ ID NO: 280464 - RNA, 24 nt, Human
ucccaaagugcugggauuacaggc

SEQ ID NO: 280465 - RNA, 25 nt, Human
uccccuauugaccaaugacaagaau

SEQ ID NO: 280466 - RNA, 25 nt, Human
ucccucaaaauagaauccugcccua

SEQ ID NO: 280467 - RNA, 24 nt, Human
uccgccuccuggguucaagcaauu

SEQ ID NO: 280468 - RNA, 21 nt, Human
uccuggguucaagcaauucuc

SEQ ID NO: 280469 - RNA, 24 nt, Human
uccuggguucaagcaauucuccug

SEQ ID NO: 280470 - RNA, 28 nt, Human
ucuacccuccccuauugaccaaugacaa

SEQ ID NO: 280471 - RNA, 23 nt, Human
ucuaugauaauaaaaucuucaga

SEQ ID NO: 280472 - RNA, 18 nt, Human
ucuccugccucagccucc

SEQ ID NO: 280473 - RNA, 20 nt, Human
ucucggccucccaaagugcu

SEQ ID NO: 280474 - RNA, 21 nt, Human
ucuguaguauaagaaggcagu

SEQ ID NO: 280475 - RNA, 18 nt, Human
ucuuguugcccaggcugg

SEQ ID NO: 280476 - RNA, 19 nt, Human
ucuuguugcccaggcugga

SEQ ID NO: 280477 - RNA, 21 nt, Human
ucuuguugcccaggcuggagu

SEQ ID NO: 280478 - RNA, 22 nt, Human
ucuuguugcccaggcuggagug

SEQ ID NO: 280479 - RNA, 25 nt, Human
ugaaacaguuuuaauacccuaacau

SEQ ID NO: 280480 - RNA, 18 nt, Human
ugacaagaauggaagaaa

SEQ ID NO: 280481 - RNA, 26 nt, Human
ugacaagaauggaagaaaauauacaa

SEQ ID NO: 280482 - RNA, 22 nt, Human
ugauaauaaaaucuucagaaac

SEQ ID NO: 280483 - RNA, 23 nt, Human
ugauaauaaaaucuucagaaacu

SEQ ID NO: 280484 - RNA, 18 nt, Human
ugcccaggcuggagugca

SEQ ID NO: 280485 - RNA, 21 nt, Human
ugcccaggcuggagugcaaug

SEQ ID NO: 280486 - RNA, 24 nt, Human
ugcccaggcuggagugcaauggca

SEQ ID NO: 280487 - RNA, 24 nt, Human
ugccucagccuccugaguagauga

SEQ ID NO: 280488 - RNA, 19 nt, Human
ugccuggccuugacuugag

SEQ ID NO: 280489 - RNA, 20 nt, Human
ugcugggauuacaggcguga

SEQ ID NO: 280490 - RNA, 22 nt, Human
uggaaaaguuggaccuuggagu

SEQ ID NO: 280491 - RNA, 24 nt, Human
uggagugcaauggcacaauccugg

SEQ ID NO: 280492 - RNA, 19 nt, Human
uggaucacuugacgucagg

SEQ ID NO: 280493 - RNA, 27 nt, Human
uggaucacuugacgucaggagaucaca

SEQ ID NO: 280494 - RNA, 24 nt, Human
uggcacaauccuggcucacugcaa

SEQ ID NO: 280495 - RNA, 24 nt, Human
ugggaggccgaggcgaauggauca

SEQ ID NO: 280496 - RNA, 21 nt, Human
ugggauuacaggcaugcacca

SEQ ID NO: 280497 - RNA, 24 nt, Human
ugggauuacaggcaugcaccacca

SEQ ID NO: 280498 - RNA, 18 nt, Human
ugggauuacaggcgugag

SEQ ID NO: 280499 - RNA, 20 nt, Human
ugggauuacaggcgugagcc

SEQ ID NO: 280500 - RNA, 21 nt, Human
ugggauuacaggcgugagccg

SEQ ID NO: 280501 - RNA, 22 nt, Human
ugggauuacaggcgugagccgc

SEQ ID NO: 280502 - RNA, 23 nt, Human
ugggauuacaggcgugagccgcc

SEQ ID NO: 280503 - RNA, 23 nt, Human
ugggauuacaggcgugagccgcc

SEQ ID NO: 280504 - RNA, 24 nt, Human
ugggauuacaggcgugagccgccg

SEQ ID NO: 280505 - RNA, 19 nt, Human
ugggguuucuccauguugg

SEQ ID NO: 280506 - RNA, 22 nt, Human
ugggugcuugggguuuuggucg

SEQ ID NO: 280507 - RNA, 21 nt, Human
uggguucaagcaauucuccug

SEQ ID NO: 280508 - RNA, 23 nt, Human
uggguucaagcaauucuccugcc

SEQ ID NO: 280509 - RNA, 24 nt, Human
uggguucaagcaauucuccugccu

SEQ ID NO: 280510 - RNA, 21 nt, Human
ugguaaggcuggucucgaacu

SEQ ID NO: 280511 - RNA, 19 nt, Human
uggucucgaacucccgacc

SEQ ID NO: 280512 - RNA, 21 nt, Human
uguauuuuuaguagagauggg

SEQ ID NO: 280513 - RNA, 22 nt, Human
ugugaguccugccaggacuugu

SEQ ID NO: 280514 - RNA, 20 nt, Human
uguugcccaggcuggagugc

SEQ ID NO: 280515 - RNA, 23 nt, Human
uuaaugggugcuugggguuuugg

SEQ ID NO: 280516 - RNA, 18 nt, Human
uuacaggcgugagccgcc

SEQ ID NO: 280517 - RNA, 18 nt, Human
uuaguagagaugggguuu

SEQ ID NO: 280518 - RNA, 24 nt, Human
uuaguagagaugggguuucuccau

SEQ ID NO: 280519 - RNA, 21 nt, Human
uucaagcaauucuccugccuc

SEQ ID NO: 280520 - RNA, 24 nt, Human
uucaagcaauucuccugccucagc

SEQ ID NO: 280521 - RNA, 24 nt, Human
uucauggagcccccucccuccccc

SEQ ID NO: 280522 - RNA, 20 nt, Human
uucugggggcuuguuccuuu

SEQ ID NO: 280523 - RNA, 25 nt, Human
uugggaggccgaggcgaauggauca

SEQ ID NO: 280524 - RNA, 23 nt, Human
uuguauuuuuaguagagaugggg

SEQ ID NO: 280525 - RNA, 23 nt, Human
uuguucuuguugcccaggcugga

SEQ ID NO: 280526 - RNA, 24 nt, Human
uuguucuuguugcccaggcuggag

SEQ ID NO: 280527 - RNA, 24 nt, Human
uuuguucuuguugcccaggcugga

SEQ ID NO: 280528 - RNA, 20 nt, Human
uuuugagauggaguuuuguu

SEQ ID NO: 280529 - RNA, 19 nt, Human
uuuuguauuuuuaguagag

SEQ ID NO: 280530 - RNA, 20 nt, Human
uuuuguauuuuuaguagaga

SEQ ID NO: 280531 - RNA, 24 nt, Human
uuuuguucuuguugcccaggcugg

SEQ ID NO: 280532 - RNA, 22 nt, Human
uuuuuaguagagaugggguuuc

SEQ ID NO: 280533 - RNA, 24 nt, Human
uuuuuauuuuuugagauggaguuu

SEQ ID NO: 280534 - RNA, 23 nt, Human
aaagacuccucaaaagcugcaug

SEQ ID NO: 280535 - RNA, 27 nt, Human
accaaaccuaacacaauuucaagagau

SEQ ID NO: 280536 - RNA, 18 nt, Human
acugagccagcaccaccc

SEQ ID NO: 280537 - RNA, 20 nt, Human
agauacggugaggagugugu

SEQ ID NO: 280538 - RNA, 25 nt, Human
agcauaauaacccaaauuacaaaaa

SEQ ID NO: 280539 - RNA, 21 nt, Human
aucugaaaauacuucaguuau

SEQ ID NO: 280540 - RNA, 25 nt, Human
auggguuaaaagauacggugaggag

SEQ ID NO: 280541 - RNA, 19 nt, Human
caagagauggugauaccau

SEQ ID NO: 280542 - RNA, 24 nt, Human
caagaugaacggaugaacaguuca

SEQ ID NO: 280543 - RNA, 26 nt, Human
cagcauaauaacccaaauuacaaaaa

SEQ ID NO: 280544 - RNA, 24 nt, Human
caugauaacauuaaacuacaaaau

SEQ ID NO: 280545 - RNA, 25 nt, Human
cccaaauuacaaaaauggcaaaaaa

SEQ ID NO: 280546 - RNA, 21 nt, Human
cccgucuuccucuucaaggug

SEQ ID NO: 280547 - RNA, 22 nt, Human
cgcucgcuaccgcgcccaccuc

SEQ ID NO: 280548 - RNA, 22 nt, Human
cugagccagcaccacccccgcc

SEQ ID NO: 280549 - RNA, 18 nt, Human
gagagagguggagaaaag

SEQ ID NO: 280550 - RNA, 21 nt, Human
gauauauuauaaauaagucuc

SEQ ID NO: 280551 - RNA, 21 nt, Human
gcaacauuguaaacaccacca

SEQ ID NO: 280552 - RNA, 24 nt, Human
guaaacaccaccagguuuuuccaa

SEQ ID NO: 280553 - RNA, 23 nt, Human
uaaauaagucucucagcaagaug

SEQ ID NO: 280554 - RNA, 21 nt, Human
uaacugcuagucuuuuccagu

SEQ ID NO: 280555 - RNA, 27 nt, Human
uaauaacccaaauuacaaaaauggccg

SEQ ID NO: 280556 - RNA, 21 nt, Human
uacggugaggaguguguugag

SEQ ID NO: 280557 - RNA, 20 nt, Human
uacuucaguuauacaaaggg

SEQ ID NO: 280558 - RNA, 18 nt, Human
ugagccagcaccaccccc

SEQ ID NO: 280559 - RNA, 19 nt, Human
uucaagagauggugauacc

SEQ ID NO: 280560 - RNA, 24 nt, Human
uuccccagacaaaauaaccaaacc

SEQ ID NO: 280561 - RNA, 20 nt, Human
uuucaagagauggugauacc

SEQ ID NO: 280562 - RNA, 19 nt, Human
uuuuuuuuuuuuuuuugca

SEQ ID NO: 280563 - RNA, 24 nt, Human
uuuuuuuuuuuuuuuuuugcauuu

SEQ ID NO: 280564 - RNA, 20 nt, Human
uuuuuuuuuuuuuuuuuugg

SEQ ID NO: 280565 - RNA, 19 nt, Human
aaaaauguauaccucuucc

SEQ ID NO: 280566 - RNA, 22 nt, Human
aaacauacuuccuaucaaaacc

SEQ ID NO: 280567 - RNA, 21 nt, Human
aaacaucucucuuuccuacca

SEQ ID NO: 280568 - RNA, 23 nt, Human
aagaugguuuuugcugucacaaa

SEQ ID NO: 280569 - RNA, 18 nt, Human
aagugaaaaaauagagac

SEQ ID NO: 280570 - RNA, 20 nt, Human
acacuaagaaacaaacauac

SEQ ID NO: 280571 - RNA, 19 nt, Human
agaaauggauaugaagaag

SEQ ID NO: 280572 - RNA, 20 nt, Human
agacaagaaauaaagcagag

SEQ ID NO: 280573 - RNA, 21 nt, Human
agagaggaugguauccugugu

SEQ ID NO: 280574 - RNA, 20 nt, Human
agaggacagaggcagagcug

SEQ ID NO: 280575 - RNA, 22 nt, Human
agauauuaaguauucugaacag

SEQ ID NO: 280576 - RNA, 23 nt, Human
agcuguauggucaagucaacccu

SEQ ID NO: 280577 - RNA, 22 nt, Human
auauaugcauagaaccgaggcu

SEQ ID NO: 280578 - RNA, 22 nt, Human
auuguugggaaucuacaauugc

SEQ ID NO: 280579 - RNA, 22 nt, Human
cacagauuuaggaaacuuaaaa

SEQ ID NO: 280580 - RNA, 20 nt, Human
caggagcuauaaagugaaaa

SEQ ID NO: 280581 - RNA, 22 nt, Human
ccccuuccuuucucucgugucc

SEQ ID NO: 280582 - RNA, 20 nt, Human
cucaugugguuccacuccca

SEQ ID NO: 280583 - RNA, 22 nt, Human
cuggccaaguguaaaaaauaaa

SEQ ID NO: 280584 - RNA, 19 nt, Human
cuuccccuuccuuucucuc

SEQ ID NO: 280585 - RNA, 18 nt, Human
gaacucuggacauuccau

SEQ ID NO: 280586 - RNA, 18 nt, Human
gacagaggcagagcugau

SEQ ID NO: 280587 - RNA, 21 nt, Human
gagacaagaaauaaagcagag

SEQ ID NO: 280588 - RNA, 21 nt, Human
gagcaggcucaugugguucca

SEQ ID NO: 280589 - RNA, 23 nt, Human
gagcuucaguuuuuucaucugac

SEQ ID NO: 280590 - RNA, 18 nt, Human
gaguccuguucuuccccu

SEQ ID NO: 280591 - RNA, 19 nt, Human
gcaagagaggaugguaucc

SEQ ID NO: 280592 - RNA, 18 nt, Human
ggacagaggcagagcuga

SEQ ID NO: 280593 - RNA, 21 nt, Human
ggcucaugugguuccacuccc

SEQ ID NO: 280594 - RNA, 19 nt, Human
gguccuaaaaggcagauuu

SEQ ID NO: 280595 - RNA, 20 nt, Human
gugcuuaaaacuuccuugug

SEQ ID NO: 280596 - RNA, 19 nt, Human
uaacaggagcuauaaagug

SEQ ID NO: 280597 - RNA, 23 nt, Human
uaauuuuuuuucuaacucacuag

SEQ ID NO: 280598 - RNA, 23 nt, Human
uagggcccuauguuaauuuuuuu

SEQ ID NO: 280599 - RNA, 19 nt, Human
uauaaagugaaaaaauaga

SEQ ID NO: 280600 - RNA, 26 nt, Human
uauaaagugaaaaaauagagacaaga

SEQ ID NO: 280601 - RNA, 21 nt, Human
uaucaaaaccucuagcugcca

SEQ ID NO: 280602 - RNA, 20 nt, Human
ucuacuacagcuugcuaccu

SEQ ID NO: 280603 - RNA, 18 nt, Human
ucuuccccuuccuuucuc

SEQ ID NO: 280604 - RNA, 23 nt, Human
ugaaaaaauagagacaagaaaua

SEQ ID NO: 280605 - RNA, 26 nt, Human
ugaaaaaaugcaguuucacacauuaa

SEQ ID NO: 280606 - RNA, 21 nt, Human
ugaacaguaacuugauauagu

SEQ ID NO: 280607 - RNA, 21 nt, Human
ugacuuucucuaauuuuccuu

SEQ ID NO: 280608 - RNA, 21 nt, Human
ugcagagcugagcaggcucau

SEQ ID NO: 280609 - RNA, 19 nt, Human
ugcucuuuagcucuugcuu

SEQ ID NO: 280610 - RNA, 19 nt, Human
uggaaucucauaaaauaac

SEQ ID NO: 280611 - RNA, 21 nt, Human
uggaggcagagcgacuuaaaa

SEQ ID NO: 280612 - RNA, 18 nt, Human
uguaaacacuaagaaaca

SEQ ID NO: 280613 - RNA, 19 nt, Human
uguaaagaugguuuuugcu

SEQ ID NO: 280614 - RNA, 22 nt, Human
uguaaagaugguuuuugcuguc

SEQ ID NO: 280615 - RNA, 24 nt, Human
uuaaaaaauguauaccucuuccua

SEQ ID NO: 280616 - RNA, 23 nt, Human
uucacacauuaaaggcaaggaga

SEQ ID NO: 280617 - RNA, 19 nt, Human
uucuucgagaacucuggac

SEQ ID NO: 280618 - RNA, 23 nt, Human
uugcugacccugaguaaucaugu

SEQ ID NO: 280619 - RNA, 23 nt, Human
uugcugucacaaagccagguccu

SEQ ID NO: 280620 - RNA, 19 nt, Human
uuuguaaacacuaagaaac

SEQ ID NO: 280621 - RNA, 22 nt, Human
accuggaagcaccucagucgcc

SEQ ID NO: 280622 - RNA, 21 nt, Human
aggucagagccccacagagga

SEQ ID NO: 280623 - RNA, 20 nt, Human
cagaggagcccgaagcacag

SEQ ID NO: 280624 - RNA, 20 nt, Human
cagcccccugaacaguggcc

SEQ ID NO: 280625 - RNA, 24 nt, Human
ccacaggccccgagcugggagccc

SEQ ID NO: 280626 - RNA, 23 nt, Human
ccaccuggaagcaccucagucgc

SEQ ID NO: 280627 - RNA, 23 nt, Human
ccagaccagcauacuggccccac

SEQ ID NO: 280628 - RNA, 22 nt, Human
ccagcgcgcuggcccgucgugg

SEQ ID NO: 280629 - RNA, 21 nt, Human
cccaccccugccccgugauca

SEQ ID NO: 280630 - RNA, 19 nt, Human
ccccacagaggagcccgaa

SEQ ID NO: 280631 - RNA, 21 nt, Human
ccccacaggccccgagcuggg

SEQ ID NO: 280632 - RNA, 22 nt, Human
ccccugaacaguggccucaacu

SEQ ID NO: 280633 - RNA, 24 nt, Human
ccccugaacaguggccucaacucu

SEQ ID NO: 280634 - RNA, 18 nt, Human
cccgucgugggcgcgggg

SEQ ID NO: 280635 - RNA, 18 nt, Human
cccgugaucagguuaagg

SEQ ID NO: 280636 - RNA, 24 nt, Human
cccuguccugagccccugggcuuc

SEQ ID NO: 280637 - RNA, 24 nt, Human
ccucccuguccugagccccugggc

SEQ ID NO: 280638 - RNA, 20 nt, Human
ccugagccccugggcuucug

SEQ ID NO: 280639 - RNA, 21 nt, Human
ccugagcggggcccugggaac

SEQ ID NO: 280640 - RNA, 23 nt, Human
ccuggaagcaccucagucgccgg

SEQ ID NO: 280641 - RNA, 20 nt, Human
ccugguggccgcugucaccu

SEQ ID NO: 280642 - RNA, 21 nt, Human
cggggagcggggcggggagcg

SEQ ID NO: 280643 - RNA, 27 nt, Human
cucaacacauguucaagccuacggacu

SEQ ID NO: 280644 - RNA, 21 nt, Human
cucucugcugggcccugagcc

SEQ ID NO: 280645 - RNA, 22 nt, Human
cugcugccugaggucaggcuga

SEQ ID NO: 280646 - RNA, 23 nt, Human
cuguggcugagaccaagaggggc

SEQ ID NO: 280647 - RNA, 20 nt, Human
gacucugggaacagggaacc

SEQ ID NO: 280648 - RNA, 20 nt, Human
gccaccagcccccugaacag

SEQ ID NO: 280649 - RNA, 25 nt, Human
gcccccugaacaguggccucaacuc

SEQ ID NO: 280650 - RNA, 24 nt, Human
gccccugggcuucuggcagcuugg

SEQ ID NO: 280651 - RNA, 19 nt, Human
gcccgucgugggcgcgggg

SEQ ID NO: 280652 - RNA, 19 nt, Human
gcccugggaacagaggugu

SEQ ID NO: 280653 - RNA, 24 nt, Human
gcggcgcgcgcggucccuaaagga

SEQ ID NO: 280654 - RNA, 21 nt, Human
gcugcagacucugggaacagg

SEQ ID NO: 280655 - RNA, 18 nt, Human
gcugccugaggucaggcu

SEQ ID NO: 280656 - RNA, 18 nt, Human
gcuggggcgcgcguggag

SEQ ID NO: 280657 - RNA, 18 nt, Human
ggacucucugcugggccc

SEQ ID NO: 280658 - RNA, 19 nt, Human
ggagacggccaccagcccc

SEQ ID NO: 280659 - RNA, 23 nt, Human
uauguccaagcgcccagagggcc

SEQ ID NO: 280660 - RNA, 18 nt, Human
ucauguggggugagcagg

SEQ ID NO: 280661 - RNA, 23 nt, Human
ucauguggggugagcagguuggg

SEQ ID NO: 280662 - RNA, 25 nt, Human
ucauguggggugagcagguugggca

SEQ ID NO: 280663 - RNA, 20 nt, Human
uccaagcgcccagagggccc

SEQ ID NO: 280664 - RNA, 23 nt, Human
ucccagaccagcauacuggcccc

SEQ ID NO: 280665 - RNA, 24 nt, Human
ucccagaccagcauacuggcccca

SEQ ID NO: 280666 - RNA, 20 nt, Human
ucccccagcacagagccugg

SEQ ID NO: 280667 - RNA, 22 nt, Human
ucuauguccaagcgcccagagg

SEQ ID NO: 280668 - RNA, 23 nt, Human
ucucugcugggcccugagcgggg

SEQ ID NO: 280669 - RNA, 23 nt, Human
ucugccucagagaacuugccuag

SEQ ID NO: 280670 - RNA, 21 nt, Human
uggcagggcuggggaagggaa

SEQ ID NO: 280671 - RNA, 21 nt, Human
uggccccacaggccccgagcu

SEQ ID NO: 280672 - RNA, 21 nt, Human
uggcugcagacucugggaaca

SEQ ID NO: 280673 - RNA, 24 nt, Human
ugggcuucuggcagcuuggugccu

SEQ ID NO: 280674 - RNA, 19 nt, Human
uguccaagcgcccagaggg

SEQ ID NO: 280675 - RNA, 22 nt, Human
uguggcugagaccaagaggggc

SEQ ID NO: 280676 - RNA, 25 nt, Human
uucugccucagagaacuugccuagg

SEQ ID NO: 280677 - RNA, 28 nt, Human
agaggcgaguuuauugggggaggggcug

SEQ ID NO: 280678 - RNA, 22 nt, Human
agcccggagucugucagcagcc

SEQ ID NO: 280679 - RNA, 20 nt, Human
cagcaggagggggagugagc

SEQ ID NO: 280680 - RNA, 20 nt, Human
caggucaguccagugugugg

SEQ ID NO: 280681 - RNA, 20 nt, Human
ccagcccaguccaggggugg

SEQ ID NO: 280682 - RNA, 21 nt, Human
ccaggggugggagggaggggg

SEQ ID NO: 280683 - RNA, 19 nt, Human
cccuguuucagaagagucc

SEQ ID NO: 280684 - RNA, 18 nt, Human
ccgcucagggcaggucag

SEQ ID NO: 280685 - RNA, 18 nt, Human
ccucccgggucacugccc

SEQ ID NO: 280686 - RNA, 22 nt, Human
cucugcaccuggugacuuccuc

SEQ ID NO: 280687 - RNA, 21 nt, Human
gcauagcagcaggagggggag

SEQ ID NO: 280688 - RNA, 20 nt, Human
gcccggagucugucagcagc

SEQ ID NO: 280689 - RNA, 18 nt, Human
ggagggagggggugaccc

SEQ ID NO: 280690 - RNA, 21 nt, Human
gggaugcuugggguggcgugg

SEQ ID NO: 280691 - RNA, 18 nt, Human
ggggaggggcuggucaag

SEQ ID NO: 280692 - RNA, 21 nt, Human
ggggccacccccagcccaguc

SEQ ID NO: 280693 - RNA, 21 nt, Human
uacccccacggggccaccccc

SEQ ID NO: 280694 - RNA, 18 nt, Human
uagcagcaggagggggag

SEQ ID NO: 280695 - RNA, 24 nt, Human
uagcagcaggagggggagugagcu

SEQ ID NO: 280696 - RNA, 21 nt, Human
uagcccggagucugucagcag

SEQ ID NO: 280697 - RNA, 19 nt, Human
uccaggggugggagggagg

SEQ ID NO: 280698 - RNA, 21 nt, Human
ucugcaccuggugacuuccuc

SEQ ID NO: 280699 - RNA, 23 nt, Human
ugcccuguuucagaagaguccug

SEQ ID NO: 280700 - RNA, 20 nt, Human
ugggagggagggggugaccc

SEQ ID NO: 280701 - RNA, 20 nt, Human
ugggaugcuugggguggcgu

SEQ ID NO: 280702 - RNA, 21 nt, Human
ugucagcagccugcaggcagg

SEQ ID NO: 280703 - RNA, 24 nt, Human
uuuuuuuuuuuuuuuuuuuccaag

SEQ ID NO: 280704 - RNA, 24 nt, Human
aaguugcuccaggagaacuccuau

SEQ ID NO: 280705 - RNA, 20 nt, Human
accuccaaaaccccaugugg

SEQ ID NO: 280706 - RNA, 21 nt, Human
agggagggggcaaccaccugg

SEQ ID NO: 280707 - RNA, 22 nt, Human
aguugcuccaggagaacuccua

SEQ ID NO: 280708 - RNA, 23 nt, Human
cagcugggccaucccugaggucu

SEQ ID NO: 280709 - RNA, 25 nt, Human
ccaaaaccccaugugguuucaccca

SEQ ID NO: 280710 - RNA, 19 nt, Human
ccuauucaaccuccaaaac

SEQ ID NO: 280711 - RNA, 21 nt, Human
ccucaaguugcuccaggagaa

SEQ ID NO: 280712 - RNA, 22 nt, Human
ccugucagcaccuccuccgccu

SEQ ID NO: 280713 - RNA, 19 nt, Human
ccuuagaucagcugggcca

SEQ ID NO: 280714 - RNA, 24 nt, Human
cgccucggagcucuggggcuggga

SEQ ID NO: 280715 - RNA, 22 nt, Human
cucaggagagggagggggcaac

SEQ ID NO: 280716 - RNA, 24 nt, Human
cuggggcgcccucuucggcucccg

SEQ ID NO: 280717 - RNA, 18 nt, Human
gcagagauugagcucaaa

SEQ ID NO: 280718 - RNA, 23 nt, Human
ggagagggagggggcaaccaccu

SEQ ID NO: 280719 - RNA, 24 nt, Human
ggagcaccugucagcaccuccucc

SEQ ID NO: 280720 - RNA, 19 nt, Human
gggagggggcaaccaccug

SEQ ID NO: 280721 - RNA, 19 nt, Human
gggggccccuguggaggac

SEQ ID NO: 280722 - RNA, 19 nt, Human
ucagcugggccaucccuga

SEQ ID NO: 280723 - RNA, 23 nt, Human
ucagcugggccaucccugagguc

SEQ ID NO: 280724 - RNA, 19 nt, Human
ucuguuauuuuccugggca

SEQ ID NO: 280725 - RNA, 24 nt, Human
uggaggacacagguggcccccucc

SEQ ID NO: 280726 - RNA, 18 nt, Human
agcagcggcgggcacgcc

SEQ ID NO: 280727 - RNA, 20 nt, Human
caaugccgaggaacagggcc

SEQ ID NO: 280728 - RNA, 21 nt, Human
cagccaguggccgggccccaa

SEQ ID NO: 280729 - RNA, 19 nt, Human
caggcccgcaaugccgagg

SEQ ID NO: 280730 - RNA, 22 nt, Human
ccaccaggcccgcaaugccgag

SEQ ID NO: 280731 - RNA, 18 nt, Human
ccagaggugggagcagcg

SEQ ID NO: 280732 - RNA, 20 nt, Human
ccagaggugggagcagcggc

SEQ ID NO: 280733 - RNA, 18 nt, Human
cccccgggcggccccagc

SEQ ID NO: 280734 - RNA, 25 nt, Human
cccccgggcggccccagcccggccc

SEQ ID NO: 280735 - RNA, 25 nt, Human
cgcaaugccgaggaacagggccccc

SEQ ID NO: 280736 - RNA, 23 nt, Human
cggcccagaggugggagcagcgg

SEQ ID NO: 280737 - RNA, 20 nt, Human
cgggcccagcacagcagcgg

SEQ ID NO: 280738 - RNA, 21 nt, Human
cgggcccagcacagcagcggg

SEQ ID NO: 280739 - RNA, 24 nt, Human
gaagcccucuccgcgguucugccc

SEQ ID NO: 280740 - RNA, 19 nt, Human
gcccagaggugggagcagc

SEQ ID NO: 280741 - RNA, 22 nt, Human
gccccgggcccagcacagcagc

SEQ ID NO: 280742 - RNA, 23 nt, Human
gccccgggcccagcacagcagcg

SEQ ID NO: 280743 - RNA, 22 nt, Human
ggagccgcugcgggucagccag

SEQ ID NO: 280744 - RNA, 18 nt, Human
gggcccccgggcggcccc

SEQ ID NO: 280745 - RNA, 19 nt, Human
gggcggccccagcccggcc

SEQ ID NO: 280746 - RNA, 18 nt, Human
guggccgggccccaagac

SEQ ID NO: 280747 - RNA, 19 nt, Human
ugccgaggaacagggcccc

SEQ ID NO: 280748 - RNA, 20 nt, Human
ugggagcagcggcgggcacg

SEQ ID NO: 280749 - RNA, 24 nt, Human
aaaaaagaaaaaggaacaaccaag

SEQ ID NO: 280750 - RNA, 27 nt, Human
aaaaagaaaauuuaaaaaaagaaaaag

SEQ ID NO: 280751 - RNA, 28 nt, Human
aaaaagaaaauuuaaaaaaagaaaaagg

SEQ ID NO: 280752 - RNA, 22 nt, Human
aaaagaaaaaggaacaaccaag

SEQ ID NO: 280753 - RNA, 22 nt, Human
aaaagaaaaaggaacaaccaag

SEQ ID NO: 280754 - RNA, 27 nt, Human
aaaagaagaaaaagaaaauuuaaaaaa

SEQ ID NO: 280755 - RNA, 22 nt, Human
aaaagaaucauccauggcacag

SEQ ID NO: 280756 - RNA, 23 nt, Human
aaagauguucauccucucagccc

SEQ ID NO: 280757 - RNA, 23 nt, Human
aaaggguaagaaucgugaagcag

SEQ ID NO: 280758 - RNA, 26 nt, Human
aaaggguaagaaucgugaagcaggga

SEQ ID NO: 280759 - RNA, 21 nt, Human
aaagguccucaggggaaggug

SEQ ID NO: 280760 - RNA, 20 nt, Human
aaccagugcuaucaucacaa

SEQ ID NO: 280761 - RNA, 22 nt, Human
aagaaaaagaaaauuuaaaaaa

SEQ ID NO: 280762 - RNA, 23 nt, Human
aagaaaaagaaaauuuaaaaaaa

SEQ ID NO: 280763 - RNA, 25 nt, Human
aagaaaaagaaaauuuaaaaaaaga

SEQ ID NO: 280764 - RNA, 21 nt, Human
aagaaguacacacugcuuccc

SEQ ID NO: 280765 - RNA, 21 nt, Human
aagacaaaacuguguccgagc

SEQ ID NO: 280766 - RNA, 22 nt, Human
aagcagccagcgaggcuccugc

SEQ ID NO: 280767 - RNA, 24 nt, Human
aaggugccgaauacauucuuccca

SEQ ID NO: 280768 - RNA, 19 nt, Human
acaucaaaggcaggaauac

SEQ ID NO: 280769 - RNA, 23 nt, Human
acgaaaaaaaagaagaaaaagaa

SEQ ID NO: 280770 - RNA, 20 nt, Human
acugacaccagcugauccca

SEQ ID NO: 280771 - RNA, 25 nt, Human
agaaaaaggaacaaccaagggagau

SEQ ID NO: 280772 - RNA, 23 nt, Human
agaaagagauaaugccaaaaaga

SEQ ID NO: 280773 - RNA, 21 nt, Human
agaaaggguaagaaucgugaa

SEQ ID NO: 280774 - RNA, 21 nt, Human
agacaaaacuguguccgagca

SEQ ID NO: 280775 - RNA, 23 nt, Human
agagaaagagauaaugccaaaaa

SEQ ID NO: 280776 - RNA, 26 nt, Human
agagaaagagauaaugccaaaaagaa

SEQ ID NO: 280777 - RNA, 20 nt, Human
agagugaaggagagcagcuu

SEQ ID NO: 280778 - RNA, 18 nt, Human
agcagccagugccagccc

SEQ ID NO: 280779 - RNA, 24 nt, Human
agcagggaagacgaaaaaaaagaa

SEQ ID NO: 280780 - RNA, 18 nt, Human
agccauccaaaaacaaua

SEQ ID NO: 280781 - RNA, 20 nt, Human
aggcaggaauacaacaaggc

SEQ ID NO: 280782 - RNA, 27 nt, Human
aggcggcaggguucacaguggucccgg

SEQ ID NO: 280783 - RNA, 18 nt, Human
aggguucacagugguccc

SEQ ID NO: 280784 - RNA, 19 nt, Human
aucauccauggcacagagg

SEQ ID NO: 280785 - RNA, 20 nt, Human
aucccagugguugucuuugu

SEQ ID NO: 280786 - RNA, 20 nt, Human
caaccuacgaagacaaaacu

SEQ ID NO: 280787 - RNA, 26 nt, Human
caaccuacgaagacaaaacugugucc

SEQ ID NO: 280788 - RNA, 18 nt, Human
cacgcccgccgccggcgc

SEQ ID NO: 280789 - RNA, 18 nt, Human
cagcuugguggccuccag

SEQ ID NO: 280790 - RNA, 23 nt, Human
cauuucuggugaugggaaaagaa

SEQ ID NO: 280791 - RNA, 21 nt, Human
ccacaucaaaggcaggaauac

SEQ ID NO: 280792 - RNA, 21 nt, Human
ccagcccgagugccugucccc

SEQ ID NO: 280793 - RNA, 18 nt, Human
ccccgcgcugcaccggcc

SEQ ID NO: 280794 - RNA, 23 nt, Human
cccggcgcgccgggcaccgaccg

SEQ ID NO: 280795 - RNA, 18 nt, Human
ccgccggggacugagcgc

SEQ ID NO: 280796 - RNA, 21 nt, Human
ccgcugcucggagcuccgcgg

SEQ ID NO: 280797 - RNA, 23 nt, Human
ccugaccccgaaaugagcucugg

SEQ ID NO: 280798 - RNA, 18 nt, Human
ccuguccccgcgcugcac

SEQ ID NO: 280799 - RNA, 19 nt, Human
cgaggccgggcuccggcgc

SEQ ID NO: 280800 - RNA, 20 nt, Human
cgccuggguccaggcuccug

SEQ ID NO: 280801 - RNA, 18 nt, Human
cggccgcuuucccccacc

SEQ ID NO: 280802 - RNA, 23 nt, Human
cggcggccgucgcugcauggccc

SEQ ID NO: 280803 - RNA, 22 nt, Human
cggcggcguccgggacucucug

SEQ ID NO: 280804 - RNA, 24 nt, Human
cucggagcuccgcggcggccgucg

SEQ ID NO: 280805 - RNA, 23 nt, Human
cugaccccgaaaugagcucugga

SEQ ID NO: 280806 - RNA, 27 nt, Human
cugaccccgaaaugagcucuggacaug

SEQ ID NO: 280807 - RNA, 21 nt, Human
cugcucggagcuccgcggcgg

SEQ ID NO: 280808 - RNA, 21 nt, Human
cuggacaugaauccaccucuu

SEQ ID NO: 280809 - RNA, 22 nt, Human
gaagaaguacacacugcuuccc

SEQ ID NO: 280810 - RNA, 23 nt, Human
gaguccagcuuaucagaggcuga

SEQ ID NO: 280811 - RNA, 19 nt, Human
gcagaagccagauugauuc

SEQ ID NO: 280812 - RNA, 24 nt, Human
gcugagcugguccggagcgaagag

SEQ ID NO: 280813 - RNA, 24 nt, Human
gcuucucggagucuuugauguuaa

SEQ ID NO: 280814 - RNA, 21 nt, Human
ggacaugaauccaccucuuuu

SEQ ID NO: 280815 - RNA, 21 nt, Human
ggcgccuggguccaggcuccu

SEQ ID NO: 280816 - RNA, 20 nt, Human
gguucacaguggucccggca

SEQ ID NO: 280817 - RNA, 23 nt, Human
guagagcgcgagcgaagcagcca

SEQ ID NO: 280818 - RNA, 19 nt, Human
gucuauggaugaagaagua

SEQ ID NO: 280819 - RNA, 19 nt, Human
gugaagcagggaagacgaa

SEQ ID NO: 280820 - RNA, 26 nt, Human
uaauaaaucuucuuucucucugguuu

SEQ ID NO: 280821 - RNA, 21 nt, Human
uaguuguggugggcaaacugg

SEQ ID NO: 280822 - RNA, 18 nt, Human
uccaaaaacaauaagaac

SEQ ID NO: 280823 - RNA, 22 nt, Human
ucccagugguugucuuuguucc

SEQ ID NO: 280824 - RNA, 21 nt, Human
uccccgcgcugcaccggccgc

SEQ ID NO: 280825 - RNA, 19 nt, Human
ucccuuuuuuucauccaca

SEQ ID NO: 280826 - RNA, 18 nt, Human
uccgggacucucuggggc

SEQ ID NO: 280827 - RNA, 23 nt, Human
ucucccauagauaaaggcuucac

SEQ ID NO: 280828 - RNA, 27 nt, Human
ucucccauagauaaaggcuucacagau

SEQ ID NO: 280829 - RNA, 20 nt, Human
ucuucuuucucucugguuuu

SEQ ID NO: 280830 - RNA, 25 nt, Human
ucuuucucucugguuuucggacuuc

SEQ ID NO: 280831 - RNA, 20 nt, Human
ugaaggagagcagcuuggug

SEQ ID NO: 280832 - RNA, 22 nt, Human
ugagaaacaaaccagugcuauc

SEQ ID NO: 280833 - RNA, 18 nt, Human
ugagcugguccggagcga

SEQ ID NO: 280834 - RNA, 18 nt, Human
ugauauaacaaauuacgu

SEQ ID NO: 280835 - RNA, 20 nt, Human
ugcagaagccagauugauuc

SEQ ID NO: 280836 - RNA, 23 nt, Human
uggugggcaaacuggagugucug

SEQ ID NO: 280837 - RNA, 23 nt, Human
uguguccgagcacacuaugcgcc

SEQ ID NO: 280838 - RNA, 22 nt, Human
uucacaguggucccggcauagc

SEQ ID NO: 280839 - RNA, 21 nt, Human
uucccaccugaccccgaaaug

SEQ ID NO: 280840 - RNA, 19 nt, Human
uugcucucuacugcacgcu

SEQ ID NO: 280841 - RNA, 24 nt, Human
agaguaugaauucaugaccaccag

SEQ ID NO: 280842 - RNA, 19 nt, Human
aggcagggagagaggaggc

SEQ ID NO: 280843 - RNA, 19 nt, Human
augaagauguucgcuucag

SEQ ID NO: 280844 - RNA, 18 nt, Human
ccgccgccgccgccgccg

SEQ ID NO: 280845 - RNA, 18 nt, Human
ccgccgccgccgccgccg

SEQ ID NO: 280846 - RNA, 24 nt, Human
ccgccgccgccgccgccgccgccg

SEQ ID NO: 280847 - RNA, 25 nt, Human
ccgccgccgccgccgccgccgccgg

SEQ ID NO: 280848 - RNA, 24 nt, Human
ccgccgccgccgccgccgccgggu

SEQ ID NO: 280849 - RNA, 20 nt, Human
cgagaggcccuaguggcucu

SEQ ID NO: 280850 - RNA, 25 nt, Human
cgccgccgccgccgccgccgccggc

SEQ ID NO: 280851 - RNA, 19 nt, Human
gaggcagggagagaggagg

SEQ ID NO: 280852 - RNA, 18 nt, Human
gaguaugaauucaugacc

SEQ ID NO: 280853 - RNA, 20 nt, Human
ggagagaggaggcaacagag

SEQ ID NO: 280854 - RNA, 19 nt, Human
guucgcuucagucaaggcu

SEQ ID NO: 280855 - RNA, 24 nt, Human
ugagguggaagggagaugugaggc

SEQ ID NO: 280856 - RNA, 19 nt, Human
uggaaggaguugugaggug

SEQ ID NO: 280857 - RNA, 21 nt, Human
uggaagggagaugugaggcag

SEQ ID NO: 280858 - RNA, 18 nt, Human
uucaugaccaccagccac

SEQ ID NO: 280859 - RNA, 21 nt, Human
aaaagucagaagcacacugaa

SEQ ID NO: 280860 - RNA, 18 nt, Human
aagccaaguccguaaaag

SEQ ID NO: 280861 - RNA, 20 nt, Human
aauuugauauuuaauuaagg

SEQ ID NO: 280862 - RNA, 25 nt, Human
agaaaaacacauucaauaaaccaca

SEQ ID NO: 280863 - RNA, 22 nt, Human
agccuucuaacaagccaagucc

SEQ ID NO: 280864 - RNA, 21 nt, Human
auuuuuuuuuuuuuuuuuugg

SEQ ID NO: 280865 - RNA, 21 nt, Human
caaguccguaaaagucagaag

SEQ ID NO: 280866 - RNA, 24 nt, Human
caaguccguaaaagucagaagcac

SEQ ID NO: 280867 - RNA, 20 nt, Human
cacuuccucuuuccuucagc

SEQ ID NO: 280868 - RNA, 20 nt, Human
cagccuucuaacaagccaag

SEQ ID NO: 280869 - RNA, 20 nt, Human
gaagauuuagauuuauuuga

SEQ ID NO: 280870 - RNA, 21 nt, Human
gaagggggcucucucuagcac

SEQ ID NO: 280871 - RNA, 19 nt, Human
gcacuuccucuuuccuuca

SEQ ID NO: 280872 - RNA, 18 nt, Human
gcggccccauuuuuuuuu

SEQ ID NO: 280873 - RNA, 22 nt, Human
gcggccccauuuuuuuuuuuuu

SEQ ID NO: 280874 - RNA, 19 nt, Human
uagaagagacagauaagug

SEQ ID NO: 280875 - RNA, 23 nt, Human
ugcagaaaaacacauucaauaaa

SEQ ID NO: 280876 - RNA, 26 nt, Human
ugcggccccauuuuuuuuuuuuuuuu

SEQ ID NO: 280877 - RNA, 24 nt, Human
uugucacauuuucacacaaauaua

SEQ ID NO: 280878 - RNA, 28 nt, Human
aaacauggguuagggggugggagggggg

SEQ ID NO: 280879 - RNA, 19 nt, Human
aaagaggagaugggggagg

SEQ ID NO: 280880 - RNA, 18 nt, Human
aacucaacagccagaucc

SEQ ID NO: 280881 - RNA, 22 nt, Human
aagcuagugauacgagaucagg

SEQ ID NO: 280882 - RNA, 23 nt, Human
acaagcaaagcacacggaaugcg

SEQ ID NO: 280883 - RNA, 23 nt, Human
accaccugcagauggugggagug

SEQ ID NO: 280884 - RNA, 21 nt, Human
accagguguccggguccuggg

SEQ ID NO: 280885 - RNA, 22 nt, Human
accagguguccggguccugggu

SEQ ID NO: 280886 - RNA, 23 nt, Human
acggagccugcgggacuggggcu

SEQ ID NO: 280887 - RNA, 18 nt, Human
agaccucagccugcacag

SEQ ID NO: 280888 - RNA, 20 nt, Human
agagaccaggcaccaucgcc

SEQ ID NO: 280889 - RNA, 22 nt, Human
agagcccagccugaggggccuu

SEQ ID NO: 280890 - RNA, 19 nt, Human
agaggagaugggggagggg

SEQ ID NO: 280891 - RNA, 22 nt, Human
agccaggggccuggcuagucau

SEQ ID NO: 280892 - RNA, 23 nt, Human
agccgaaggguccugugguugga

SEQ ID NO: 280893 - RNA, 21 nt, Human
agccgggccgccggaggcccg

SEQ ID NO: 280894 - RNA, 23 nt, Human
agccugaggggccuuagcauuug

SEQ ID NO: 280895 - RNA, 21 nt, Human
agccugcgggacuggggcugg

SEQ ID NO: 280896 - RNA, 24 nt, Human
agccugcgggacuggggcuggacu

SEQ ID NO: 280897 - RNA, 18 nt, Human
aggacagucucauccagc

SEQ ID NO: 280898 - RNA, 20 nt, Human
aggagaugggggaggggugg

SEQ ID NO: 280899 - RNA, 24 nt, Human
aggaguuggggacaggcccgggag

SEQ ID NO: 280900 - RNA, 23 nt, Human
aggaugggagggaggaggggagg

SEQ ID NO: 280901 - RNA, 21 nt, Human
aggcagccagcccagagccca

SEQ ID NO: 280902 - RNA, 23 nt, Human
aggcccccgaggacagcgcccag

SEQ ID NO: 280903 - RNA, 18 nt, Human
aggcccggccccacccag

SEQ ID NO: 280904 - RNA, 25 nt, Human
agggaggaggggaggcuggggucug

SEQ ID NO: 280905 - RNA, 18 nt, Human
aggugcuggagaccaggc

SEQ ID NO: 280906 - RNA, 18 nt, Human
aggugcuggagaccaggc

SEQ ID NO: 280907 - RNA, 23 nt, Human
agguguccggguccugggucgac

SEQ ID NO: 280908 - RNA, 24 nt, Human
agguguccggguccugggucgaca

SEQ ID NO: 280909 - RNA, 20 nt, Human
auccacucugcccucucuca

SEQ ID NO: 280910 - RNA, 26 nt, Human
auccacucugcccucucucagagcac

SEQ ID NO: 280911 - RNA, 20 nt, Human
augagucugugccucagccc

SEQ ID NO: 280912 - RNA, 21 nt, Human
caaagcacacggaaugcgcag

SEQ ID NO: 280913 - RNA, 28 nt, Human
caaaguggcugaacacagcccaagacca

SEQ ID NO: 280914 - RNA, 22 nt, Human
cacagcccaagaccaggugucc

SEQ ID NO: 280915 - RNA, 19 nt, Human
caccaggggccggcucagg

SEQ ID NO: 280916 - RNA, 19 nt, Human
cacgugaggcccaaagcca

SEQ ID NO: 280917 - RNA, 19 nt, Human
cacucauggcacgcagggc

SEQ ID NO: 280918 - RNA, 22 nt, Human
cagaccucagccugcacagcua

SEQ ID NO: 280919 - RNA, 18 nt, Human
cagagcaccauccugaga

SEQ ID NO: 280920 - RNA, 20 nt, Human
cagccacagaccccgcccca

SEQ ID NO: 280921 - RNA, 22 nt, Human
cagcccaagaccagguguccgg

SEQ ID NO: 280922 - RNA, 23 nt, Human
cagccugcacagcuacaagcaaa

SEQ ID NO: 280923 - RNA, 22 nt, Human
cagcgaauaggccugacucccc

SEQ ID NO: 280924 - RNA, 22 nt, Human
caggcagccagcccagagccca

SEQ ID NO: 280925 - RNA, 21 nt, Human
caggggccuggcuagucaugu

SEQ ID NO: 280926 - RNA, 27 nt, Human
caugaccgacgcacucauggcacgcag

SEQ ID NO: 280927 - RNA, 20 nt, Human
caugggaacagcagccgggc

SEQ ID NO: 280928 - RNA, 18 nt, Human
ccacagcugaagaucuug

SEQ ID NO: 280929 - RNA, 22 nt, Human
ccacagcugaagaucuugaggc

SEQ ID NO: 280930 - RNA, 20 nt, Human
ccagcccauuuuuguccuuu

SEQ ID NO: 280931 - RNA, 22 nt, Human
ccaugugguguccuggcagagc

SEQ ID NO: 280932 - RNA, 18 nt, Human
cccaagguccaggagccc

SEQ ID NO: 280933 - RNA, 18 nt, Human
cccagacgcgccgccccg

SEQ ID NO: 280934 - RNA, 20 nt, Human
cccagagaagggucugaggc

SEQ ID NO: 280935 - RNA, 21 nt, Human
cccagagcccauuucccuggg

SEQ ID NO: 280936 - RNA, 21 nt, Human
cccagccugaggggccuuagc

SEQ ID NO: 280937 - RNA, 22 nt, Human
cccauggccaggcuccuccugg

SEQ ID NO: 280938 - RNA, 19 nt, Human
ccccagagaccccacgucu

SEQ ID NO: 280939 - RNA, 25 nt, Human
ccccaggcccccgaggacagcgccc

SEQ ID NO: 280940 - RNA, 23 nt, Human
cccccgaggacagcgcccagccc

SEQ ID NO: 280941 - RNA, 24 nt, Human
ccccgggcuccgggcuccgggcuc

SEQ ID NO: 280942 - RNA, 18 nt, Human
ccccugucccacauuccc

SEQ ID NO: 280943 - RNA, 33 nt, Human
cccuugaagaaaaggcugacuuuugcuuccuuc

SEQ ID NO: 280944 - RNA, 18 nt, Human
ccgaggacagcgcccagc

SEQ ID NO: 280945 - RNA, 22 nt, Human
ccgaggacagcgcccagcccgg

SEQ ID NO: 280946 - RNA, 20 nt, Human
ccgcggcucuguccggcgcc

SEQ ID NO: 280947 - RNA, 20 nt, Human
ccggggccacaucaugaccu

SEQ ID NO: 280948 - RNA, 23 nt, Human
ccugcacagcuacaagcaaagca

SEQ ID NO: 280949 - RNA, 18 nt, Human
ccuggacacguuccgggg

SEQ ID NO: 280950 - RNA, 20 nt, Human
ccuggcuccagaccucagcc

SEQ ID NO: 280951 - RNA, 21 nt, Human
ccuggcuggcagcaaagcucu

SEQ ID NO: 280952 - RNA, 18 nt, Human
ccugggugaggaugggag

SEQ ID NO: 280953 - RNA, 23 nt, Human
ccuucugccgagcccgagaggcc

SEQ ID NO: 280954 - RNA, 18 nt, Human
cgaccucuggacaucccu

SEQ ID NO: 280955 - RNA, 19 nt, Human
cgagggucuagggcagugg

SEQ ID NO: 280956 - RNA, 23 nt, Human
cgcuggaguccgcggcucugucc

SEQ ID NO: 280957 - RNA, 19 nt, Human
cggcgaugggcccccagcu

SEQ ID NO: 280958 - RNA, 21 nt, Human
cggcuccuagcuccagaaccc

SEQ ID NO: 280959 - RNA, 26 nt, Human
cgggcuccgcucuccuccggacuccu

SEQ ID NO: 280960 - RNA, 20 nt, Human
cggggccagggcugccgccg

SEQ ID NO: 280961 - RNA, 22 nt, Human
cuccaggacagucucauccagc

SEQ ID NO: 280962 - RNA, 18 nt, Human
cuccugggacugucuucu

SEQ ID NO: 280963 - RNA, 20 nt, Human
cucugugcuggcccuguuuc

SEQ ID NO: 280964 - RNA, 18 nt, Human
cucugugggggaggaagg

SEQ ID NO: 280965 - RNA, 21 nt, Human
cugaagaucuugaggcugagg

SEQ ID NO: 280966 - RNA, 22 nt, Human
cugaagccugaguuccugggac

SEQ ID NO: 280967 - RNA, 21 nt, Human
cugaguccagagaaggcaaag

SEQ ID NO: 280968 - RNA, 21 nt, Human
cugcacagcuacaagcaaagc

SEQ ID NO: 280969 - RNA, 24 nt, Human
cugcauggcagggucugcacgugg

SEQ ID NO: 280970 - RNA, 18 nt, Human
cugccuggcugaugacca

SEQ ID NO: 280971 - RNA, 21 nt, Human
cugccuggcugaugaccaggc

SEQ ID NO: 280972 - RNA, 20 nt, Human
cugcgggacuggggcuggac

SEQ ID NO: 280973 - RNA, 19 nt, Human
cugcucugagacagggaaa

SEQ ID NO: 280974 - RNA, 21 nt, Human
cuggaguccgcggcucugucc

SEQ ID NO: 280975 - RNA, 18 nt, Human
cuggcccuguuucccugg

SEQ ID NO: 280976 - RNA, 21 nt, Human
cuggcuuucaaagaggagaug

SEQ ID NO: 280977 - RNA, 25 nt, Human
cuguggcucccagcuccuggcuggu

SEQ ID NO: 280978 - RNA, 22 nt, Human
cuucuccugggacugucuucuc

SEQ ID NO: 280979 - RNA, 26 nt, Human
cuucugccgagcccgagaggccacag

SEQ ID NO: 280980 - RNA, 21 nt, Human
gaaggccccucugugcuggcc

SEQ ID NO: 280981 - RNA, 22 nt, Human
gacacaccgcuccuucucaccu

SEQ ID NO: 280982 - RNA, 20 nt, Human
gacccauggccaggcuccuc

SEQ ID NO: 280983 - RNA, 18 nt, Human
gaccucagccugcacagc

SEQ ID NO: 280984 - RNA, 18 nt, Human
gaccucuggacaucccug

SEQ ID NO: 280985 - RNA, 25 nt, Human
gaccuggcaucuuacucagagacca

SEQ ID NO: 280986 - RNA, 24 nt, Human
gacuaugucaugggagcucugugg

SEQ ID NO: 280987 - RNA, 20 nt, Human
gagccccugggccuuggccu

SEQ ID NO: 280988 - RNA, 23 nt, Human
gaggccacagcugaagaucuuga

SEQ ID NO: 280989 - RNA, 19 nt, Human
gaggccugagcccccuccc

SEQ ID NO: 280990 - RNA, 21 nt, Human
gagggaggaggggaggcuggg

SEQ ID NO: 280991 - RNA, 18 nt, Human
gaguccagagaaggcaaa

SEQ ID NO: 280992 - RNA, 21 nt, Human
gagugggggugggcguuugag

SEQ ID NO: 280993 - RNA, 20 nt, Human
gauccuagagaccaaggagg

SEQ ID NO: 280994 - RNA, 21 nt, Human
gcaaaguggcugaacacagcc

SEQ ID NO: 280995 - RNA, 23 nt, Human
gcacugggagggcugccuggcug

SEQ ID NO: 280996 - RNA, 18 nt, Human
gcagccagcccagagccc

SEQ ID NO: 280997 - RNA, 19 nt, Human
gcaggcagccagcccagag

SEQ ID NO: 280998 - RNA, 25 nt, Human
gccccgggcuccgggcuccgggcuc

SEQ ID NO: 280999 - RNA, 21 nt, Human
gccuggcuccagaccucagcc

SEQ ID NO: 281000 - RNA, 18 nt, Human
gccugggggaggggggca

SEQ ID NO: 281001 - RNA, 21 nt, Human
gcuccgcucuccuccggacuc

SEQ ID NO: 281002 - RNA, 18 nt, Human
gcuccuggcuggucccgg

SEQ ID NO: 281003 - RNA, 22 nt, Human
gcugcaccgaccucuggacauc

SEQ ID NO: 281004 - RNA, 20 nt, Human
gcuggccucugccugacccc

SEQ ID NO: 281005 - RNA, 24 nt, Human
ggaaagccgacuucagucacagcc

SEQ ID NO: 281006 - RNA, 18 nt, Human
ggaaugcgcaccccaucc

SEQ ID NO: 281007 - RNA, 22 nt, Human
ggacaugggaacagcagccggg

SEQ ID NO: 281008 - RNA, 18 nt, Human
ggacuggggcuggacucc

SEQ ID NO: 281009 - RNA, 19 nt, Human
ggagaugggggaggggugg

SEQ ID NO: 281010 - RNA, 23 nt, Human
ggagcuuucuuggagcugccugg

SEQ ID NO: 281011 - RNA, 21 nt, Human
ggaggccggggccagggcugc

SEQ ID NO: 281012 - RNA, 18 nt, Human
ggcacugggagggcugcc

SEQ ID NO: 281013 - RNA, 18 nt, Human
ggcaggagugggcgcguc

SEQ ID NO: 281014 - RNA, 18 nt, Human
ggccggggccagggcugc

SEQ ID NO: 281015 - RNA, 21 nt, Human
ggccugaaggggcgagucagg

SEQ ID NO: 281016 - RNA, 22 nt, Human
ggccuuggccugggugaggaug

SEQ ID NO: 281017 - RNA, 25 nt, Human
ggcuccgcucuccuccggacuccca

SEQ ID NO: 281018 - RNA, 21 nt, Human
ggcuccgggcuccgcucuccu

SEQ ID NO: 281019 - RNA, 19 nt, Human
ggcucggcgcuugccacgg

SEQ ID NO: 281020 - RNA, 23 nt, Human
gggaaacugaguccagagaaggc

SEQ ID NO: 281021 - RNA, 18 nt, Human
gggagaggagcgcucucu

SEQ ID NO: 281022 - RNA, 19 nt, Human
gggaggaguuggggacagg

SEQ ID NO: 281023 - RNA, 20 nt, Human
gggaggcuggggucugggcc

SEQ ID NO: 281024 - RNA, 18 nt, Human
gggagggaggaggggagg

SEQ ID NO: 281025 - RNA, 19 nt, Human
gggcacugggagggcugcc

SEQ ID NO: 281026 - RNA, 19 nt, Human
gggcaggagugggcgcguc

SEQ ID NO: 281027 - RNA, 21 nt, Human
gggcaggugcuggagaccagg

SEQ ID NO: 281028 - RNA, 24 nt, Human
gggcgcguggcgaagaccagcggg

SEQ ID NO: 281029 - RNA, 20 nt, Human
gggcgcuggaguccgcggcu

SEQ ID NO: 281030 - RNA, 19 nt, Human
ggggaggaguuggggacag

SEQ ID NO: 281031 - RNA, 24 nt, Human
ggggagggguggggaggaguuggg

SEQ ID NO: 281032 - RNA, 18 nt, Human
gggggaggggggcauggg

SEQ ID NO: 281033 - RNA, 19 nt, Human
ggggucugggccauuccag

SEQ ID NO: 281034 - RNA, 24 nt, Human
gggugggaggggggggucccaggc

SEQ ID NO: 281035 - RNA, 26 nt, Human
ggguggggaggaguuggggacaggcc

SEQ ID NO: 281036 - RNA, 23 nt, Human
gggugugucuguggugcauggac

SEQ ID NO: 281037 - RNA, 25 nt, Human
gguggggaggaguuggggacaggcc

SEQ ID NO: 281038 - RNA, 22 nt, Human
guccagagaaggcaaaguggcu

SEQ ID NO: 281039 - RNA, 23 nt, Human
gucugagaacaaagaaaacugcc

SEQ ID NO: 281040 - RNA, 23 nt, Human
guuagggggugggaggggggggu

SEQ ID NO: 281041 - RNA, 20 nt, Human
guucagagcccagccugagg

SEQ ID NO: 281042 - RNA, 18 nt, Human
uagacagagggggugcag

SEQ ID NO: 281043 - RNA, 19 nt, Human
uagacagagggggugcagg

SEQ ID NO: 281044 - RNA, 26 nt, Human
uagcuccagaacccgugguuccuucc

SEQ ID NO: 281045 - RNA, 18 nt, Human
uauggcccaagguccagg

SEQ ID NO: 281046 - RNA, 20 nt, Human
ucacagccacagaccccgcc

SEQ ID NO: 281047 - RNA, 21 nt, Human
ucacagccacagaccccgccc

SEQ ID NO: 281048 - RNA, 22 nt, Human
ucaccugaagccugaguuccug

SEQ ID NO: 281049 - RNA, 21 nt, Human
ucagagcccagccugaggggc

SEQ ID NO: 281050 - RNA, 22 nt, Human
uccagguccucguucagagccc

SEQ ID NO: 281051 - RNA, 22 nt, Human
uccccacggcgaugggccccca

SEQ ID NO: 281052 - RNA, 24 nt, Human
uccccaggcccccgaggacagcgc

SEQ ID NO: 281053 - RNA, 23 nt, Human
ucccggccagcuucuccugggac

SEQ ID NO: 281054 - RNA, 21 nt, Human
ucccgggugggggcugcucug

SEQ ID NO: 281055 - RNA, 20 nt, Human
ucccugggguugguggcccu

SEQ ID NO: 281056 - RNA, 22 nt, Human
uccuagagaccaaggaggcgcc

SEQ ID NO: 281057 - RNA, 22 nt, Human
uccuccggacucccagcuuccg

SEQ ID NO: 281058 - RNA, 21 nt, Human
uccugugguuggagagggauu

SEQ ID NO: 281059 - RNA, 25 nt, Human
ucucaaggccccacccugaagccag

SEQ ID NO: 281060 - RNA, 18 nt, Human
ucuccaaaccgcgcgguu

SEQ ID NO: 281061 - RNA, 20 nt, Human
ucugcccucucucagagcac

SEQ ID NO: 281062 - RNA, 21 nt, Human
ucugccgagcccgagaggcca

SEQ ID NO: 281063 - RNA, 19 nt, Human
ucugugccucagcccaggg

SEQ ID NO: 281064 - RNA, 18 nt, Human
ucugugcuggcccuguuu

SEQ ID NO: 281065 - RNA, 23 nt, Human
ucugugcuggcccuguuucccug

SEQ ID NO: 281066 - RNA, 18 nt, Human
ucuguggugcauggacac

SEQ ID NO: 281067 - RNA, 24 nt, Human
ucuugaggcugaggccugagcccc

SEQ ID NO: 281068 - RNA, 18 nt, Human
ugaacacagcccaagacc

SEQ ID NO: 281069 - RNA, 20 nt, Human
ugacaaaugagucugugccu

SEQ ID NO: 281070 - RNA, 20 nt, Human
ugacccccaucaaggcuccc

SEQ ID NO: 281071 - RNA, 22 nt, Human
ugaccuggccgcaagcuaguga

SEQ ID NO: 281072 - RNA, 26 nt, Human
ugagaacaaagaaaacugccuuuugc

SEQ ID NO: 281073 - RNA, 18 nt, Human
ugagcccccucccaugug

SEQ ID NO: 281074 - RNA, 19 nt, Human
ugaggcugcccugucuggc

SEQ ID NO: 281075 - RNA, 19 nt, Human
ugcacagcuacaagcaaag

SEQ ID NO: 281076 - RNA, 21 nt, Human
ugcacagcuacaagcaaagca

SEQ ID NO: 281077 - RNA, 21 nt, Human
ugcacgugaggcccaaagcca

SEQ ID NO: 281078 - RNA, 18 nt, Human
ugccacggguuccaggug

SEQ ID NO: 281079 - RNA, 28 nt, Human
ugccuccgaucuccaaaccgcgcgguuc

SEQ ID NO: 281080 - RNA, 22 nt, Human
uggagaccaggccccugauccg

SEQ ID NO: 281081 - RNA, 24 nt, Human
uggagccuggauccuagagaccaa

SEQ ID NO: 281082 - RNA, 18 nt, Human
uggagcugccugggggag

SEQ ID NO: 281083 - RNA, 24 nt, Human
uggccaggcuccuccuggacacgu

SEQ ID NO: 281084 - RNA, 19 nt, Human
uggccucugccugaccccc

SEQ ID NO: 281085 - RNA, 18 nt, Human
uggccugggugaggaugg

SEQ ID NO: 281086 - RNA, 19 nt, Human
uggcuccagaccucagccu

SEQ ID NO: 281087 - RNA, 20 nt, Human
uggcucugaguccagguccu

SEQ ID NO: 281088 - RNA, 20 nt, Human
uggcugaacacagcccaaga

SEQ ID NO: 281089 - RNA, 24 nt, Human
ugggaacagcagccgggccgccgg

SEQ ID NO: 281090 - RNA, 18 nt, Human
ugggggagggguggggag

SEQ ID NO: 281091 - RNA, 24 nt, Human
ugggggagggguggggaggaguug

SEQ ID NO: 281092 - RNA, 19 nt, Human
ugggggugggcguuugagc

SEQ ID NO: 281093 - RNA, 18 nt, Human
ugggguugguggcccuug

SEQ ID NO: 281094 - RNA, 23 nt, Human
uggguuagggggugggagggggg

SEQ ID NO: 281095 - RNA, 22 nt, Human
uggucccggccagcuucuccug

SEQ ID NO: 281096 - RNA, 23 nt, Human
uggugcauggacacgugucccca

SEQ ID NO: 281097 - RNA, 21 nt, Human
ugucaugggagcucugugggg

SEQ ID NO: 281098 - RNA, 25 nt, Human
uguccggguccugggucgacauggc

SEQ ID NO: 281099 - RNA, 20 nt, Human
uguccuggcagagccccugg

SEQ ID NO: 281100 - RNA, 21 nt, Human
ugugcucuguggagccuggau

SEQ ID NO: 281101 - RNA, 19 nt, Human
uuccccaggcccccgagga

SEQ ID NO: 281102 - RNA, 21 nt, Human
uucccugggguugguggcccu

SEQ ID NO: 281103 - RNA, 21 nt, Human
uucccugggguugguggcccu

SEQ ID NO: 281104 - RNA, 20 nt, Human
uuccucgggcugucucccgg

SEQ ID NO: 281105 - RNA, 18 nt, Human
uugaagaaaaggcugacu

SEQ ID NO: 281106 - RNA, 24 nt, Human
uugaggcugaggccugagcccccu

SEQ ID NO: 281107 - RNA, 24 nt, Human
uugccacggguuccaggugccucc

SEQ ID NO: 281108 - RNA, 24 nt, Human
uugccgcacacuaauuucuccuug

SEQ ID NO: 281109 - RNA, 18 nt, Human
uuucuccuuguuagaggc

SEQ ID NO: 281110 - RNA, 21 nt, Human
uuugccgcacacuaauuucuc

SEQ ID NO: 281111 - RNA, 20 nt, Human
uuugcuagacucugagccca

SEQ ID NO: 281112 - RNA, 22 nt, Human
aagcugacugugccacuucauc

SEQ ID NO: 281113 - RNA, 20 nt, Human
acacgagagaaggcaagccc

SEQ ID NO: 281114 - RNA, 20 nt, Human
acccagcuguggaggggaca

SEQ ID NO: 281115 - RNA, 25 nt, Human
agaaggcaagccccucggaggacag

SEQ ID NO: 281116 - RNA, 30 nt, Human
agagaaggcaagccccucggaggacagaaa

SEQ ID NO: 281117 - RNA, 20 nt, Human
agcagcagcggggauuccag

SEQ ID NO: 281118 - RNA, 21 nt, Human
aggcuccugguaucaggguuc

SEQ ID NO: 281119 - RNA, 19 nt, Human
agggaggcccaggcuccug

SEQ ID NO: 281120 - RNA, 21 nt, Human
agggguucagggaggcccagg

SEQ ID NO: 281121 - RNA, 19 nt, Human
auggaacaggacacacagc

SEQ ID NO: 281122 - RNA, 23 nt, Human
caaccagaagcuuggcccggagc

SEQ ID NO: 281123 - RNA, 19 nt, Human
cacacagcaggaugcggag

SEQ ID NO: 281124 - RNA, 22 nt, Human
cacugagcaccucacuggacac

SEQ ID NO: 281125 - RNA, 22 nt, Human
cagaagcuuggcccggagcagc

SEQ ID NO: 281126 - RNA, 19 nt, Human
caggagcccaacaugacac

SEQ ID NO: 281127 - RNA, 24 nt, Human
caguguggucucuccccucgugcc

SEQ ID NO: 281128 - RNA, 20 nt, Human
caucaggaauccugagggcu

SEQ ID NO: 281129 - RNA, 24 nt, Human
caucaggaauccugagggcugggg

SEQ ID NO: 281130 - RNA, 20 nt, Human
ccaggcagcugaggccgagc

SEQ ID NO: 281131 - RNA, 21 nt, Human
cccaggagcccaacaugacac

SEQ ID NO: 281132 - RNA, 21 nt, Human
cccggagcagcagcggggauu

SEQ ID NO: 281133 - RNA, 18 nt, Human
ccgugcccccgccccagg

SEQ ID NO: 281134 - RNA, 22 nt, Human
ccugagggcuggggucccggag

SEQ ID NO: 281135 - RNA, 26 nt, Human
cggcuauacugaggauccccugcccc

SEQ ID NO: 281136 - RNA, 22 nt, Human
cuaggaacgcaggcucagagca

SEQ ID NO: 281137 - RNA, 19 nt, Human
cugaggauccccugccccu

SEQ ID NO: 281138 - RNA, 19 nt, Human
cuggcacccagcuguggag

SEQ ID NO: 281139 - RNA, 23 nt, Human
cuugagggaccaccccaugcccu

SEQ ID NO: 281140 - RNA, 18 nt, Human
gaaggggcugggggccaa

SEQ ID NO: 281141 - RNA, 18 nt, Human
gagcagcagcggggauuc

SEQ ID NO: 281142 - RNA, 20 nt, Human
gagcagcagcggggauucca

SEQ ID NO: 281143 - RNA, 21 nt, Human
gagcagcagcggggauuccag

SEQ ID NO: 281144 - RNA, 20 nt, Human
gaggauccccugccccuggc

SEQ ID NO: 281145 - RNA, 22 nt, Human
gcaagccccucggaggacagaa

SEQ ID NO: 281146 - RNA, 27 nt, Human
gcagcagcggggauuccaguagcugug

SEQ ID NO: 281147 - RNA, 27 nt, Human
gcaggaugcggagcagugucagaugag

SEQ ID NO: 281148 - RNA, 22 nt, Human
gcugggccuagguccuggagug

SEQ ID NO: 281149 - RNA, 21 nt, Human
gcuguguggggaaggggcugg

SEQ ID NO: 281150 - RNA, 19 nt, Human
ggaagagccacagacuugg

SEQ ID NO: 281151 - RNA, 23 nt, Human
ggaaggggcugggggccaagagg

SEQ ID NO: 281152 - RNA, 19 nt, Human
ggacagacggagaagggga

SEQ ID NO: 281153 - RNA, 24 nt, Human
ggaccugggguggcagcaaugcgu

SEQ ID NO: 281154 - RNA, 22 nt, Human
ggcugggccuagguccuggagu

SEQ ID NO: 281155 - RNA, 22 nt, Human
gugaaaugccaggccgugcccc

SEQ ID NO: 281156 - RNA, 20 nt, Human
uacaggaugcuagggcggcc

SEQ ID NO: 281157 - RNA, 20 nt, Human
ucagggaggcccaggcuccu

SEQ ID NO: 281158 - RNA, 19 nt, Human
ucauuaaucaaccagaagc

SEQ ID NO: 281159 - RNA, 23 nt, Human
uccacaaaagguaggggaagguc

SEQ ID NO: 281160 - RNA, 23 nt, Human
uccugagggcuggggucccggag

SEQ ID NO: 281161 - RNA, 22 nt, Human
ugaaaugccaggccgugccccc

SEQ ID NO: 281162 - RNA, 20 nt, Human
ugaggggcugggccuagguc

SEQ ID NO: 281163 - RNA, 19 nt, Human
ugccaggccgugcccccgc

SEQ ID NO: 281164 - RNA, 20 nt, Human
uggaagccagggguucaggg

SEQ ID NO: 281165 - RNA, 20 nt, Human
uggagacagguggaccuggg

SEQ ID NO: 281166 - RNA, 20 nt, Human
ugggacuggucuucaggggc

SEQ ID NO: 281167 - RNA, 20 nt, Human
uggggcuguguggggaaggg

SEQ ID NO: 281168 - RNA, 22 nt, Human
uggggcuguguggggaaggggc

SEQ ID NO: 281169 - RNA, 20 nt, Human
uggggucagcucugggaccc

SEQ ID NO: 281170 - RNA, 24 nt, Human
ugugaaaguggagacagguggacc

SEQ ID NO: 281171 - RNA, 21 nt, Human
uguggggaaggggcugggggc

SEQ ID NO: 281172 - RNA, 20 nt, Human
uuccagaaaguguauuugga

SEQ ID NO: 281173 - RNA, 23 nt, Human
uuguuccagaaaguguauuugga

SEQ ID NO: 281174 - RNA, 20 nt, Human
uuuuuuuuuuuuuuguucca

SEQ ID NO: 281175 - RNA, 22 nt, Human
uuuuuuuuuuuuuuuguuccag

SEQ ID NO: 281176 - RNA, 23 nt, Human
uuuuuuuuuuuuuuuuguuccag

SEQ ID NO: 281177 - RNA, 18 nt, Human
uuuuuuuuuuuuuuuuug

SEQ ID NO: 281178 - RNA, 20 nt, Human
uuuuuuuuuuuuuuuuuguu

SEQ ID NO: 281179 - RNA, 24 nt, Human
accuugcacucacucuccaagccg

SEQ ID NO: 281180 - RNA, 23 nt, Human
augcccccaggugaagaugguuu

SEQ ID NO: 281181 - RNA, 22 nt, Human
caaggcaagaaaccacgacucc

SEQ ID NO: 281182 - RNA, 23 nt, Human
caucaaggcaagaaaccacgacu

SEQ ID NO: 281183 - RNA, 20 nt, Human
cccaggggcugcccugggcu

SEQ ID NO: 281184 - RNA, 23 nt, Human
cccaggggcugcccugggcuccu

SEQ ID NO: 281185 - RNA, 20 nt, Human
cuagauagcuuuauuuuccc

SEQ ID NO: 281186 - RNA, 18 nt, Human
cuccugcccaggggcugc

SEQ ID NO: 281187 - RNA, 21 nt, Human
gaauccccgcgcgcgcuuuuc

SEQ ID NO: 281188 - RNA, 20 nt, Human
gugaagaugguuugcagcug

SEQ ID NO: 281189 - RNA, 18 nt, Human
uccagaugaaacccggcu

SEQ ID NO: 281190 - RNA, 22 nt, Human
ucuccaagccgccgugugaucu

SEQ ID NO: 281191 - RNA, 19 nt, Human
ugaagaugguuugcagcug

SEQ ID NO: 281192 - RNA, 21 nt, Human
ugcccaggggcugcccugggc

SEQ ID NO: 281193 - RNA, 22 nt, Human
aacgcaccgaagcagaaggagg

SEQ ID NO: 281194 - RNA, 20 nt, Human
acucuuuugccuuccuuucc

SEQ ID NO: 281195 - RNA, 18 nt, Human
aggacccuggcaacuacc

SEQ ID NO: 281196 - RNA, 19 nt, Human
auguguuuguugugacacu

SEQ ID NO: 281197 - RNA, 22 nt, Human
cacaaggauccugcugaagcaa

SEQ ID NO: 281198 - RNA, 21 nt, Human
cuccuccagggcucccuguaa

SEQ ID NO: 281199 - RNA, 22 nt, Human
cugcaggacccuggcaacuacc

SEQ ID NO: 281200 - RNA, 20 nt, Human
uacaagguacacuuacuugg

SEQ ID NO: 281201 - RNA, 20 nt, Human
ucccuggaccugaggguggc

SEQ ID NO: 281202 - RNA, 26 nt, Human
ugaagcaaaugacucugcuccaguca

SEQ ID NO: 281203 - RNA, 21 nt, Human
uggccucuaucccaacuccuc

SEQ ID NO: 281204 - RNA, 19 nt, Human
ugucaugagccaaauacca

SEQ ID NO: 281205 - RNA, 19 nt, Human
uucacaaaucugcucuugg

SEQ ID NO: 281206 - RNA, 20 nt, Human
uuuuacucuuuugccuuccu

SEQ ID NO: 281207 - RNA, 24 nt, Human
aaaaaaccuguacccaaaacaggc

SEQ ID NO: 281208 - RNA, 20 nt, Human
aaaaggacagaccaauaggg

SEQ ID NO: 281209 - RNA, 18 nt, Human
aaaggcacaacucaccaa

SEQ ID NO: 281210 - RNA, 20 nt, Human
aacauaaagaggccccaucu

SEQ ID NO: 281211 - RNA, 22 nt, Human
aacugaguuccuugaagucaga

SEQ ID NO: 281212 - RNA, 19 nt, Human
aagcaccccucuacccacc

SEQ ID NO: 281213 - RNA, 24 nt, Human
aagcaccccucuacccacccaaaa

SEQ ID NO: 281214 - RNA, 18 nt, Human
aagcacucaacaguguua

SEQ ID NO: 281215 - RNA, 20 nt, Human
aaggcagaaaguuugaacaa

SEQ ID NO: 281216 - RNA, 22 nt, Human
aauaaacaauagucaccauagc

SEQ ID NO: 281217 - RNA, 23 nt, Human
aauuauagaggauaugagaaaaa

SEQ ID NO: 281218 - RNA, 22 nt, Human
acaagcuaaauccaaaaaaacc

SEQ ID NO: 281219 - RNA, 22 nt, Human
acccaaaacaggcaaagcaccc

SEQ ID NO: 281220 - RNA, 21 nt, Human
acccauuaaaaauaaacaaua

SEQ ID NO: 281221 - RNA, 21 nt, Human
agaaaaaauucucccagcaaa

SEQ ID NO: 281222 - RNA, 21 nt, Human
agaaacugauuaaacgaacaa

SEQ ID NO: 281223 - RNA, 23 nt, Human
agaauaaacagaucuguauggug

SEQ ID NO: 281224 - RNA, 22 nt, Human
agcaagauucaugaacuucaau

SEQ ID NO: 281225 - RNA, 21 nt, Human
agcuaaauccaaaaaaaccug

SEQ ID NO: 281226 - RNA, 24 nt, Human
aggaaaauagaagucaauuauaga

SEQ ID NO: 281227 - RNA, 24 nt, Human
aggcagaaaguuugaacaauuaac

SEQ ID NO: 281228 - RNA, 19 nt, Human
aggcagauaauuucccaaa

SEQ ID NO: 281229 - RNA, 19 nt, Human
aggguuuugguuuuccucu

SEQ ID NO: 281230 - RNA, 22 nt, Human
aguguuacaugaauugaauuag

SEQ ID NO: 281231 - RNA, 29 nt, Human
auaaauguauuaaauuucccagagcuggu

SEQ ID NO: 281232 - RNA, 18 nt, Human
auagaaccaaaggaaaga

SEQ ID NO: 281233 - RNA, 21 nt, Human
aucagcuuucuuaccuuucuu

SEQ ID NO: 281234 - RNA, 24 nt, Human
aucccaacaauacagacacagucu

SEQ ID NO: 281235 - RNA, 19 nt, Human
auggggcucacuggaggag

SEQ ID NO: 281236 - RNA, 20 nt, Human
auuacaaauccaauuuugac

SEQ ID NO: 281237 - RNA, 20 nt, Human
caaaaaaaccuguacccaaa

SEQ ID NO: 281238 - RNA, 20 nt, Human
caccccucuacccacccaaa

SEQ ID NO: 281239 - RNA, 20 nt, Human
caccccucuacccacccaaa

SEQ ID NO: 281240 - RNA, 22 nt, Human
ccaaaaaaaccuguacccaaaa

SEQ ID NO: 281241 - RNA, 26 nt, Human
ccaaaaaaaccuguacccaaaacagg

SEQ ID NO: 281242 - RNA, 20 nt, Human
ccaacaauacagacacaguc

SEQ ID NO: 281243 - RNA, 26 nt, Human
ccauagcuaaagacugucagacauac

SEQ ID NO: 281244 - RNA, 26 nt, Human
cccaacaauacagacacagucuuaaa

SEQ ID NO: 281245 - RNA, 18 nt, Human
ccccuugcuacagaacau

SEQ ID NO: 281246 - RNA, 21 nt, Human
ccucuacccacccaaaacuca

SEQ ID NO: 281247 - RNA, 21 nt, Human
ccucuacuaacgaggaugaua

SEQ ID NO: 281248 - RNA, 23 nt, Human
ccuguacccaaaacaggcaaagc

SEQ ID NO: 281249 - RNA, 20 nt, Human
cuaaaccuaucuucaauucu

SEQ ID NO: 281250 - RNA, 21 nt, Human
cuaaauccaaaaaaaccugua

SEQ ID NO: 281251 - RNA, 24 nt, Human
cuaaauccaaaaaaaccuguaccc

SEQ ID NO: 281252 - RNA, 18 nt, Human
cuacagcuaguacaauga

SEQ ID NO: 281253 - RNA, 18 nt, Human
cucugcccaacuuugcuu

SEQ ID NO: 281254 - RNA, 21 nt, Human
cuuacaauuuaauuacaaauc

SEQ ID NO: 281255 - RNA, 19 nt, Human
cuucaguuauguaugcuga

SEQ ID NO: 281256 - RNA, 22 nt, Human
gagaggauuuuaccaacaugga

SEQ ID NO: 281257 - RNA, 25 nt, Human
gcaaagcaccccucuacccacccaa

SEQ ID NO: 281258 - RNA, 18 nt, Human
gcaccccucuacccaccc

SEQ ID NO: 281259 - RNA, 19 nt, Human
gcuacagaacaucuuccuu

SEQ ID NO: 281260 - RNA, 22 nt, Human
guaaaguauuucaguuauaaaa

SEQ ID NO: 281261 - RNA, 24 nt, Human
uaaaaauaaacaauagucaccaua

SEQ ID NO: 281262 - RNA, 22 nt, Human
uaaaaggcacaacucaccaaua

SEQ ID NO: 281263 - RNA, 20 nt, Human
uaaacaauagucaccauagc

SEQ ID NO: 281264 - RNA, 23 nt, Human
uaaacaauagucaccauagcuaa

SEQ ID NO: 281265 - RNA, 23 nt, Human
uacaaagaaaaaauucucccagc

SEQ ID NO: 281266 - RNA, 27 nt, Human
uacaaagaaaaaauucucccagcaaau

SEQ ID NO: 281267 - RNA, 24 nt, Human
uacaaagaguaagcacucaacagu

SEQ ID NO: 281268 - RNA, 21 nt, Human
uagcuaaagacugucagacau

SEQ ID NO: 281269 - RNA, 24 nt, Human
uaugguggguacaaggcuggaaaa

SEQ ID NO: 281270 - RNA, 19 nt, Human
uauuauaggagacaaaaag

SEQ ID NO: 281271 - RNA, 26 nt, Human
uauuaucaggaaacaagaaaaaugga

SEQ ID NO: 281272 - RNA, 24 nt, Human
uauuuuagaauaucaacucaguug

SEQ ID NO: 281273 - RNA, 18 nt, Human
ucaauccuuuuaaaagcu

SEQ ID NO: 281274 - RNA, 20 nt, Human
uccaagauucuggagaggau

SEQ ID NO: 281275 - RNA, 26 nt, Human
ucugaaauacccauuaaaaauaaaca

SEQ ID NO: 281276 - RNA, 24 nt, Human
ucuuuacugcuaaaccuaucuuca

SEQ ID NO: 281277 - RNA, 18 nt, Human
ugccagguguuccaagau

SEQ ID NO: 281278 - RNA, 25 nt, Human
ugccagguguuccaagauucuggag

SEQ ID NO: 281279 - RNA, 21 nt, Human
ugcccaacuuugcuuagcuga

SEQ ID NO: 281280 - RNA, 22 nt, Human
ugcuuagcugaaucaauccuuu

SEQ ID NO: 281281 - RNA, 20 nt, Human
uggaaucugaaauacccauu

SEQ ID NO: 281282 - RNA, 18 nt, Human
uggaggagcuaucagcuu

SEQ ID NO: 281283 - RNA, 26 nt, Human
uggcuaaacaugaaucuucaucucag

SEQ ID NO: 281284 - RNA, 19 nt, Human
ugguugggaaucacaucuu

SEQ ID NO: 281285 - RNA, 21 nt, Human
uguacccaaaacaggcaaagc

SEQ ID NO: 281286 - RNA, 20 nt, Human
uguauuaauauuuuaaacau

SEQ ID NO: 281287 - RNA, 23 nt, Human
uuaaaagcuuucuucuuuacugc

SEQ ID NO: 281288 - RNA, 24 nt, Human
uuauagaggauaugagaaaaagua

SEQ ID NO: 281289 - RNA, 22 nt, Human
uucaaucccaacaauacagaca

SEQ ID NO: 281290 - RNA, 21 nt, Human
uuuacaauuuuuaaaaagcuu

SEQ ID NO: 281291 - RNA, 23 nt, Human
uuuacuuuacaauuuuuaaaaag

SEQ ID NO: 281292 - RNA, 24 nt, Human
uuuuuuuuuuuaauaguccaaaug

SEQ ID NO: 281293 - RNA, 20 nt, Human
uuuuuuuuuuuuaauagucc

SEQ ID NO: 281294 - RNA, 23 nt, Human
uuuuuuuuuuuuuuuuuuaauag

SEQ ID NO: 281295 - RNA, 21 nt, Human
aaaaauagacuuuauuuacaa

SEQ ID NO: 281296 - RNA, 19 nt, Human
aaaccagccucaaaucugg

SEQ ID NO: 281297 - RNA, 25 nt, Human
aaaccagccucaaaucugguuguga

SEQ ID NO: 281298 - RNA, 22 nt, Human
aagaaaaaaggaggcaagguag

SEQ ID NO: 281299 - RNA, 21 nt, Human
aaggaccagggaccaggccag

SEQ ID NO: 281300 - RNA, 20 nt, Human
aauuaguuuccaccuggcug

SEQ ID NO: 281301 - RNA, 20 nt, Human
accccacuccugagacauag

SEQ ID NO: 281302 - RNA, 24 nt, Human
acuccaaaucccaccccagugcaa

SEQ ID NO: 281303 - RNA, 23 nt, Human
agcgcccacacuguccaugcucc

SEQ ID NO: 281304 - RNA, 21 nt, Human
agggauguuuucgauuuucug

SEQ ID NO: 281305 - RNA, 21 nt, Human
agggguuuggcuacuguuggc

SEQ ID NO: 281306 - RNA, 21 nt, Human
aguaauaacauuuagaaaaga

SEQ ID NO: 281307 - RNA, 19 nt, Human
agugcagccccccgggugg

SEQ ID NO: 281308 - RNA, 18 nt, Human
augaagaugcugcagucc

SEQ ID NO: 281309 - RNA, 23 nt, Human
caaggacccagccaucaaaacca

SEQ ID NO: 281310 - RNA, 25 nt, Human
cacaaaguccagucucucugacacc

SEQ ID NO: 281311 - RNA, 18 nt, Human
cacacuagaacaggguga

SEQ ID NO: 281312 - RNA, 21 nt, Human
caccaggacagcaggaaccag

SEQ ID NO: 281313 - RNA, 19 nt, Human
cacccaagagaggagugca

SEQ ID NO: 281314 - RNA, 19 nt, Human
cacuguccaugcuccaggc

SEQ ID NO: 281315 - RNA, 18 nt, Human
cagacagucacuccaaug

SEQ ID NO: 281316 - RNA, 18 nt, Human
cagcaucggggacacagg

SEQ ID NO: 281317 - RNA, 21 nt, Human
cagccccccggguggcgugga

SEQ ID NO: 281318 - RNA, 22 nt, Human
ccaaaucccaccccagugcaag

SEQ ID NO: 281319 - RNA, 21 nt, Human
ccacacuguccaugcuccagg

SEQ ID NO: 281320 - RNA, 21 nt, Human
ccaccaggucagacccagucc

SEQ ID NO: 281321 - RNA, 19 nt, Human
ccaggacagcaggaaccag

SEQ ID NO: 281322 - RNA, 21 nt, Human
cccaucacuccaaaucccacc

SEQ ID NO: 281323 - RNA, 22 nt, Human
cccccaaccccacuccugagac

SEQ ID NO: 281324 - RNA, 18 nt, Human
ccugggccagcuccgaga

SEQ ID NO: 281325 - RNA, 20 nt, Human
cuagauccagaggcuaagag

SEQ ID NO: 281326 - RNA, 22 nt, Human
cuccugagacauagggcccauc

SEQ ID NO: 281327 - RNA, 25 nt, Human
cuuaaaaaccuucccaucacuccuu

SEQ ID NO: 281328 - RNA, 18 nt, Human
cuucaagauuugcugucc

SEQ ID NO: 281329 - RNA, 20 nt, Human
gacccagccaucaaaaccag

SEQ ID NO: 281330 - RNA, 20 nt, Human
gagcugagagaaggcacuga

SEQ ID NO: 281331 - RNA, 19 nt, Human
gggccccugcugggcccag

SEQ ID NO: 281332 - RNA, 24 nt, Human
gucccucuucagugccauggauuc

SEQ ID NO: 281333 - RNA, 21 nt, Human
uaaaaaccuucccaucacucc

SEQ ID NO: 281334 - RNA, 18 nt, Human
uagaacagggugaucucc

SEQ ID NO: 281335 - RNA, 19 nt, Human
uagauccagaggcuaagag

SEQ ID NO: 281336 - RNA, 18 nt, Human
uaggcggaggaccaggug

SEQ ID NO: 281337 - RNA, 22 nt, Human
uagggagagcgcccacacuguc

SEQ ID NO: 281338 - RNA, 18 nt, Human
uaguuuccaccuggcugc

SEQ ID NO: 281339 - RNA, 21 nt, Human
ucaaugaucuugaugaagaug

SEQ ID NO: 281340 - RNA, 23 nt, Human
ucaaugaucuugaugaagaugcu

SEQ ID NO: 281341 - RNA, 21 nt, Human
ucacuccaaugcgccuccugg

SEQ ID NO: 281342 - RNA, 20 nt, Human
uccacacacuagaacagggu

SEQ ID NO: 281343 - RNA, 18 nt, Human
uccacagggucagccacg

SEQ ID NO: 281344 - RNA, 20 nt, Human
ucccuucuagauccagaggc

SEQ ID NO: 281345 - RNA, 21 nt, Human
ugaaggcugucccccaacccc

SEQ ID NO: 281346 - RNA, 23 nt, Human
ugacuuugcuuuaagaaaaaagg

SEQ ID NO: 281347 - RNA, 19 nt, Human
ugagagggacaguaggcgg

SEQ ID NO: 281348 - RNA, 21 nt, Human
ugagggccccugcugggccca

SEQ ID NO: 281349 - RNA, 23 nt, Human
ugcgggcaggcaucacugggucg

SEQ ID NO: 281350 - RNA, 23 nt, Human
ugcuccaggcccccugggccagc

SEQ ID NO: 281351 - RNA, 20 nt, Human
ugcugcugaaggcugucccc

SEQ ID NO: 281352 - RNA, 23 nt, Human
ugcuuuaagaaaaaaggaggcaa

SEQ ID NO: 281353 - RNA, 22 nt, Human
uggagcugcagcacagccucca

SEQ ID NO: 281354 - RNA, 22 nt, Human
uggcaggugcucccaccagguc

SEQ ID NO: 281355 - RNA, 21 nt, Human
uggcguggagugucaucuugg

SEQ ID NO: 281356 - RNA, 21 nt, Human
ugggaaagagcauccucuggc

SEQ ID NO: 281357 - RNA, 22 nt, Human
ugggaaagagcauccucuggca

SEQ ID NO: 281358 - RNA, 23 nt, Human
uguccaugcuccaggcccccugg

SEQ ID NO: 281359 - RNA, 20 nt, Human
ugucccccaaccccacuccu

SEQ ID NO: 281360 - RNA, 18 nt, Human
ugugagcugcugcugaag

SEQ ID NO: 281361 - RNA, 21 nt, Human
ugugauggagaagugacuuug

SEQ ID NO: 281362 - RNA, 24 nt, Human
uguucacccaagagaggagugcag

SEQ ID NO: 281363 - RNA, 30 nt, Human
uuaaaaaccuucccaucacuccaaaucccu

SEQ ID NO: 281364 - RNA, 18 nt, Human
uucuggggaagagggaug

SEQ ID NO: 281365 - RNA, 27 nt, Human
aaaaacaaagggagauugccgguaccc

SEQ ID NO: 281366 - RNA, 21 nt, Human
aaacaaaacccaccaagaccc

SEQ ID NO: 281367 - RNA, 24 nt, Human
aaaccacucuucuugaucucuaau

SEQ ID NO: 281368 - RNA, 22 nt, Human
aaacccaccaagacccauauua

SEQ ID NO: 281369 - RNA, 21 nt, Human
aaacuacaaccuagugacugu

SEQ ID NO: 281370 - RNA, 22 nt, Human
aaaggauaaaacaaaacccacc

SEQ ID NO: 281371 - RNA, 21 nt, Human
aacaaaacccaccaagaccca

SEQ ID NO: 281372 - RNA, 23 nt, Human
aaccaggacaauacugcuuuucc

SEQ ID NO: 281373 - RNA, 27 nt, Human
aacuucucccccaaaauauagcucugg

SEQ ID NO: 281374 - RNA, 19 nt, Human
aagaggacacacacaaagc

SEQ ID NO: 281375 - RNA, 21 nt, Human
aagccucaguuuccucauuug

SEQ ID NO: 281376 - RNA, 22 nt, Human
aauccccauccccacaaaacuc

SEQ ID NO: 281377 - RNA, 21 nt, Human
accaagacccauauuacaaac

SEQ ID NO: 281378 - RNA, 22 nt, Human
acuacaaccuagugacuguauu

SEQ ID NO: 281379 - RNA, 22 nt, Human
agaaaacaagcuagggauccug

SEQ ID NO: 281380 - RNA, 23 nt, Human
agauauauucucuauagagcaua

SEQ ID NO: 281381 - RNA, 18 nt, Human
agauugcuuugcuuccug

SEQ ID NO: 281382 - RNA, 21 nt, Human
agcgugccucucuguucccca

SEQ ID NO: 281383 - RNA, 22 nt, Human
agcuuccagccuuuccucuuuu

SEQ ID NO: 281384 - RNA, 25 nt, Human
aggcagcuuuucucuaggaaugcuu

SEQ ID NO: 281385 - RNA, 18 nt, Human
aggcaggugaauggccug

SEQ ID NO: 281386 - RNA, 23 nt, Human
auaaaacaaaacccaccaagacc

SEQ ID NO: 281387 - RNA, 19 nt, Human
auaugcccuccugggaauu

SEQ ID NO: 281388 - RNA, 22 nt, Human
auccccacaaaacucaugggaa

SEQ ID NO: 281389 - RNA, 19 nt, Human
auucuguuacucaaaaugg

SEQ ID NO: 281390 - RNA, 18 nt, Human
caaaacccaccaagaccc

SEQ ID NO: 281391 - RNA, 24 nt, Human
caaaauggaagcucaacuucuccc

SEQ ID NO: 281392 - RNA, 19 nt, Human
caagauacauagccauaau

SEQ ID NO: 281393 - RNA, 21 nt, Human
caauaugguaaccuguguucc

SEQ ID NO: 281394 - RNA, 25 nt, Human
caauaugguaaccuguguucccuuc

SEQ ID NO: 281395 - RNA, 23 nt, Human
cacacaaagcuaauaaaaccaga

SEQ ID NO: 281396 - RNA, 21 nt, Human
cacacacaaagcuaauaaaac

SEQ ID NO: 281397 - RNA, 25 nt, Human
caccaagacccauauuacaaaccaa

SEQ ID NO: 281398 - RNA, 23 nt, Human
caccaagccucaguuuccucauu

SEQ ID NO: 281399 - RNA, 19 nt, Human
cacucuuccccggaagaag

SEQ ID NO: 281400 - RNA, 21 nt, Human
cagccuuuccucuuuuuauuu

SEQ ID NO: 281401 - RNA, 24 nt, Human
cagcuuccagccuuuccucuuuuu

SEQ ID NO: 281402 - RNA, 18 nt, Human
caggagacaaagucuguu

SEQ ID NO: 281403 - RNA, 24 nt, Human
ccaccaagacccauauuacaaacc

SEQ ID NO: 281404 - RNA, 20 nt, Human
cccacaaaacucaugggaac

SEQ ID NO: 281405 - RNA, 23 nt, Human
cccacaaaacucaugggaacaaa

SEQ ID NO: 281406 - RNA, 27 nt, Human
cccaccaagacccauauuacaaaccaa

SEQ ID NO: 281407 - RNA, 21 nt, Human
cccgaccaacucaagcgcccu

SEQ ID NO: 281408 - RNA, 24 nt, Human
ccggaagaaguugcuuaagccuca

SEQ ID NO: 281409 - RNA, 24 nt, Human
ccugagcacaaaccacucuucuug

SEQ ID NO: 281410 - RNA, 24 nt, Human
cucacaguacucugggccuggacu

SEQ ID NO: 281411 - RNA, 18 nt, Human
cugccgcugcccccgacc

SEQ ID NO: 281412 - RNA, 21 nt, Human
ggccugaaaaacaaagggaga

SEQ ID NO: 281413 - RNA, 28 nt, Human
gggauuagugaaaagaguaccgguaccc

SEQ ID NO: 281414 - RNA, 20 nt, Human
gggguuugggggaagaggac

SEQ ID NO: 281415 - RNA, 23 nt, Human
ggugaauggccugaaaaacaaag

SEQ ID NO: 281416 - RNA, 20 nt, Human
gucaaggggauguucucacc

SEQ ID NO: 281417 - RNA, 21 nt, Human
gugcuacuuacaaugaaugac

SEQ ID NO: 281418 - RNA, 22 nt, Human
uaaaaaaaacuacaaccuagug

SEQ ID NO: 281419 - RNA, 25 nt, Human
uaaaaaaaacuacaaccuagugacu

SEQ ID NO: 281420 - RNA, 18 nt, Human
uaaaacaaaacccaccaa

SEQ ID NO: 281421 - RNA, 21 nt, Human
uaaaacaaaacccaccaagac

SEQ ID NO: 281422 - RNA, 22 nt, Human
uaaaacaaaacccaccaagacc

SEQ ID NO: 281423 - RNA, 21 nt, Human
uaaaaccagaauccccauccc

SEQ ID NO: 281424 - RNA, 20 nt, Human
uaaaaccaggacaauacugc

SEQ ID NO: 281425 - RNA, 25 nt, Human
uaaaggauaaaacaaaacccaccaa

SEQ ID NO: 281426 - RNA, 24 nt, Human
uaacuucaccaagccucaguuucc

SEQ ID NO: 281427 - RNA, 19 nt, Human
uaaggaaacugcagcaaua

SEQ ID NO: 281428 - RNA, 24 nt, Human
uaauaaaaccagaauccccauccc

SEQ ID NO: 281429 - RNA, 22 nt, Human
uacaacuagccccuuuaccuuu

SEQ ID NO: 281430 - RNA, 22 nt, Human
uacaggccacuacugacaggag

SEQ ID NO: 281431 - RNA, 19 nt, Human
uacccccugcucccugucu

SEQ ID NO: 281432 - RNA, 18 nt, Human
uagugaaaagaguacuaa

SEQ ID NO: 281433 - RNA, 24 nt, Human
uaguguuaaaggauuaacauaagg

SEQ ID NO: 281434 - RNA, 22 nt, Human
uccccacaaaacucaugggaac

SEQ ID NO: 281435 - RNA, 21 nt, Human
uccccauccccacaaaacuca

SEQ ID NO: 281436 - RNA, 26 nt, Human
ucccccaaaauauagcucugcugggc

SEQ ID NO: 281437 - RNA, 22 nt, Human
uccuaagugaggcgucugagga

SEQ ID NO: 281438 - RNA, 25 nt, Human
ucuaggaaugcuuuuucccaugucu

SEQ ID NO: 281439 - RNA, 26 nt, Human
ucucuaauacaggccacuacugacag

SEQ ID NO: 281440 - RNA, 23 nt, Human
ucucuaggaaugcuuuuucccau

SEQ ID NO: 281441 - RNA, 21 nt, Human
ucuguuacucaaaauggaagc

SEQ ID NO: 281442 - RNA, 19 nt, Human
ugaaaaacaaagggagauu

SEQ ID NO: 281443 - RNA, 23 nt, Human
ugaaaagaguacuaaucaggaga

SEQ ID NO: 281444 - RNA, 19 nt, Human
ugaaucuuggcugugcccu

SEQ ID NO: 281445 - RNA, 21 nt, Human
ugacagaaaacaagcuaggga

SEQ ID NO: 281446 - RNA, 19 nt, Human
ugacaggaggcaggugaaa

SEQ ID NO: 281447 - RNA, 21 nt, Human
ugaccgcuacccccugcuccc

SEQ ID NO: 281448 - RNA, 19 nt, Human
ugagcacaaaccacucuuc

SEQ ID NO: 281449 - RNA, 22 nt, Human
ugcccccgaccaacucaagcgc

SEQ ID NO: 281450 - RNA, 24 nt, Human
ugcuuugcuuccuguuguguuuua

SEQ ID NO: 281451 - RNA, 24 nt, Human
uggaagcucaacuucucccccaaa

SEQ ID NO: 281452 - RNA, 21 nt, Human
uggacuuguuccuugggaccu

SEQ ID NO: 281453 - RNA, 18 nt, Human
ugggcaguugcugauaug

SEQ ID NO: 281454 - RNA, 20 nt, Human
ugguaugauuaugucauguu

SEQ ID NO: 281455 - RNA, 23 nt, Human
ugucugcagcuuccagccuuucc

SEQ ID NO: 281456 - RNA, 22 nt, Human
uguuuugcuccuuugaccgcua

SEQ ID NO: 281457 - RNA, 20 nt, Human
uucaaaaguaaaaaugagau

SEQ ID NO: 281458 - RNA, 18 nt, Human
uuccuugggaccuuuggg

SEQ ID NO: 281459 - RNA, 18 nt, Human
uucuaugguaugauuaug

SEQ ID NO: 281460 - RNA, 26 nt, Human
uucucccccaaaauauagcucugcug

SEQ ID NO: 281461 - RNA, 25 nt, Human
uuuaaaggauaaaacaaaacccacc

SEQ ID NO: 281462 - RNA, 24 nt, Human
uuuuuuuuuuuuuuuucuaccaug

SEQ ID NO: 281463 - RNA, 29 nt, Human
aaacaacaaaaaaaucucuaacacaaaaa

SEQ ID NO: 281464 - RNA, 22 nt, Human
aaagagguucuauacaaagcca

SEQ ID NO: 281465 - RNA, 19 nt, Human
aacgaaagagaaaggagga

SEQ ID NO: 281466 - RNA, 19 nt, Human
aagacuaaacaaacaacaa

SEQ ID NO: 281467 - RNA, 19 nt, Human
aagauuuccaaauggauuu

SEQ ID NO: 281468 - RNA, 22 nt, Human
aaguccuuagcacggaccauuc

SEQ ID NO: 281469 - RNA, 20 nt, Human
aauaaugaaaaaggcaagac

SEQ ID NO: 281470 - RNA, 25 nt, Human
acaacaaaaaaaucucuaacacaaa

SEQ ID NO: 281471 - RNA, 21 nt, Human
acaagacuaaacaaacaacaa

SEQ ID NO: 281472 - RNA, 19 nt, Human
acaccagcacaaacucagc

SEQ ID NO: 281473 - RNA, 22 nt, Human
agaauuccucagauauaauuac

SEQ ID NO: 281474 - RNA, 22 nt, Human
agacuaaacaaacaacaaaaaa

SEQ ID NO: 281475 - RNA, 24 nt, Human
agacuaaacaaacaacaaaaaaau

SEQ ID NO: 281476 - RNA, 22 nt, Human
agggcaccagcuguuguuaaaa

SEQ ID NO: 281477 - RNA, 24 nt, Human
auaaaauaaugaaaaaggcaagac

SEQ ID NO: 281478 - RNA, 23 nt, Human
caaaacuggaucagaaaagccaa

SEQ ID NO: 281479 - RNA, 20 nt, Human
caaaagucaccacagaccau

SEQ ID NO: 281480 - RNA, 23 nt, Human
caacuuuaagaauccccaauuuu

SEQ ID NO: 281481 - RNA, 20 nt, Human
caagacaggugauaggagaa

SEQ ID NO: 281482 - RNA, 19 nt, Human
caaguccuuagcacggacc

SEQ ID NO: 281483 - RNA, 23 nt, Human
cacacauacaccagcacaaacuc

SEQ ID NO: 281484 - RNA, 22 nt, Human
cagauaaccccagcacaaagua

SEQ ID NO: 281485 - RNA, 24 nt, Human
cagcacaaacucagcauagaaauc

SEQ ID NO: 281486 - RNA, 18 nt, Human
ccaaaaaguacagaaaca

SEQ ID NO: 281487 - RNA, 19 nt, Human
ccagcacaaacucagcaua

SEQ ID NO: 281488 - RNA, 20 nt, Human
ccaguaucugaaagcagggc

SEQ ID NO: 281489 - RNA, 19 nt, Human
ccccaauuuuuuuuuuaaa

SEQ ID NO: 281490 - RNA, 18 nt, Human
cuucacacauacaccagc

SEQ ID NO: 281491 - RNA, 24 nt, Human
gacaagacuaaacaaacaacaaaa

SEQ ID NO: 281492 - RNA, 19 nt, Human
gcacaaaguacaauccagu

SEQ ID NO: 281493 - RNA, 23 nt, Human
ggaaaauuccaaaauuaaagaag

SEQ ID NO: 281494 - RNA, 18 nt, Human
ggugaggcaggguggggc

SEQ ID NO: 281495 - RNA, 18 nt, Human
uaaccccagcacaaagua

SEQ ID NO: 281496 - RNA, 23 nt, Human
uaauaaaauaaugaaaaaggcaa

SEQ ID NO: 281497 - RNA, 30 nt, Human
uaaucaggcuuccucuaucagaaaaguuuu

SEQ ID NO: 281498 - RNA, 23 nt, Human
uacagaauucuaaucuauacaga

SEQ ID NO: 281499 - RNA, 24 nt, Human
uacauaauaaaaucugagacaaga

SEQ ID NO: 281500 - RNA, 19 nt, Human
uauacagaauuccucagau

SEQ ID NO: 281501 - RNA, 22 nt, Human
uaugccaaaaaguacagaaaca

SEQ ID NO: 281502 - RNA, 22 nt, Human
ucaacacucucuaaucuauaca

SEQ ID NO: 281503 - RNA, 21 nt, Human
ucauccguuucaacacucucu

SEQ ID NO: 281504 - RNA, 23 nt, Human
ugaaaaaggcaagacaggugaua

SEQ ID NO: 281505 - RNA, 24 nt, Human
ugaacuagaucuaacaaguccuua

SEQ ID NO: 281506 - RNA, 22 nt, Human
ugacuucagauaaccccagcac

SEQ ID NO: 281507 - RNA, 27 nt, Human
ugauaggagaaugaaaauauagaaaua

SEQ ID NO: 281508 - RNA, 21 nt, Human
ugccaaaaaguacagaaacaa

SEQ ID NO: 281509 - RNA, 22 nt, Human
ugccaaaaaguacagaaacaaa

SEQ ID NO: 281510 - RNA, 18 nt, Human
ugggugaggcaggguggg

SEQ ID NO: 281511 - RNA, 18 nt, Human
uguaacgaaagagaaagg

SEQ ID NO: 281512 - RNA, 28 nt, Human
uucaacacucucuaaucuauacagaauu

SEQ ID NO: 281513 - RNA, 26 nt, Human
uugguccaaacaaaacuggaucagaa

SEQ ID NO: 281514 - RNA, 21 nt, Human
uuuuuuuuaaagauuuccaaa

SEQ ID NO: 281515 - RNA, 23 nt, Human
aaaaaugcagccaacagugccau

SEQ ID NO: 281516 - RNA, 21 nt, Human
aaaaugcagccaacagugcca

SEQ ID NO: 281517 - RNA, 22 nt, Human
auaaaacggaugaaaguauauc

SEQ ID NO: 281518 - RNA, 24 nt, Human
ccaaaaaugcagccaacagugcca

SEQ ID NO: 281519 - RNA, 22 nt, Human
uacagaucauaaaacggaugaa

SEQ ID NO: 281520 - RNA, 22 nt, Human
ugaaaagaagcugcuugcuggu

SEQ ID NO: 281521 - RNA, 18 nt, Human
aacgcugccacccacgcc

SEQ ID NO: 281522 - RNA, 22 nt, Human
acgcugccacccacgccuugcc

SEQ ID NO: 281523 - RNA, 20 nt, Human
agccaacgcugccacccacg

SEQ ID NO: 281524 - RNA, 19 nt, Human
caacgcugccacccacgcc

SEQ ID NO: 281525 - RNA, 24 nt, Human
cccacgccuugcccacggaaccca

SEQ ID NO: 281526 - RNA, 20 nt, Human
cccacggaacccaggccgcu

SEQ ID NO: 281527 - RNA, 25 nt, Human
cccacggaacccaggccgcucgaca

SEQ ID NO: 281528 - RNA, 23 nt, Human
gaacagccugcuccagcauuucu

SEQ ID NO: 281529 - RNA, 20 nt, Human
gaacccaggccgcucgacag

SEQ ID NO: 281530 - RNA, 20 nt, Human
ggaagaagcugaggaugcgg

SEQ ID NO: 281531 - RNA, 18 nt, Human
gggaagaagcugaggaug

SEQ ID NO: 281532 - RNA, 20 nt, Human
gggaucgaaaggccugcuga

SEQ ID NO: 281533 - RNA, 23 nt, Human
ucccagggaucgaaaggccugcu

SEQ ID NO: 281534 - RNA, 19 nt, Human
ugggagggaaaacccaaca

SEQ ID NO: 281535 - RNA, 26 nt, Human
uugauggcaacgucggucugaacagc

SEQ ID NO: 281536 - RNA, 21 nt, Human
uugguuucuguuguuucuuuc

SEQ ID NO: 281537 - RNA, 20 nt, Human
uuuuuuuuuuuuuuguacgg

SEQ ID NO: 281538 - RNA, 21 nt, Human
uuuuuuuuuuuuuuguacgga

SEQ ID NO: 281539 - RNA, 23 nt, Human
acuuuaaggggcgguggaagcag

SEQ ID NO: 281540 - RNA, 21 nt, Human
agcggcgcaggggucuggagc

SEQ ID NO: 281541 - RNA, 22 nt, Human
cagcggcgcaggggucuggagc

SEQ ID NO: 281542 - RNA, 19 nt, Human
ccacauuaaucuuccucac

SEQ ID NO: 281543 - RNA, 18 nt, Human
ccgcugcacucgcugggu

SEQ ID NO: 281544 - RNA, 21 nt, Human
cugcgcugcggaacucagagg

SEQ ID NO: 281545 - RNA, 19 nt, Human
cuggagcccgcaggggucg

SEQ ID NO: 281546 - RNA, 19 nt, Human
gaacucagaggacuuagug

SEQ ID NO: 281547 - RNA, 20 nt, Human
gagaagaaaaacugacuaac

SEQ ID NO: 281548 - RNA, 23 nt, Human
gcgcagcggcgcaggggucugga

SEQ ID NO: 281549 - RNA, 24 nt, Human
uaaggggcgguggaagcagcagca

SEQ ID NO: 281550 - RNA, 20 nt, Human
ucaaagaagagaagaaaaac

SEQ ID NO: 281551 - RNA, 20 nt, Human
ucggccgcuuccggugcugc

SEQ ID NO: 281552 - RNA, 22 nt, Human
uucuuagaaugucaaagaagag

SEQ ID NO: 281553 - RNA, 20 nt, Human
aaaaacgcaaagcacacagc

SEQ ID NO: 281554 - RNA, 24 nt, Human
aaacaaacaaacaaguaucuugcc

SEQ ID NO: 281555 - RNA, 28 nt, Human
aaacaaguaucuugccacaaccccaaac

SEQ ID NO: 281556 - RNA, 22 nt, Human
aaacgcaaagcacacagcgauc

SEQ ID NO: 281557 - RNA, 21 nt, Human
aaacggcuagcacaggauagc

SEQ ID NO: 281558 - RNA, 22 nt, Human
aaagaaagaaacaaacaaacaa

SEQ ID NO: 281559 - RNA, 19 nt, Human
aaagugcugagauuacagg

SEQ ID NO: 281560 - RNA, 20 nt, Human
aaagugcugagauuacaggg

SEQ ID NO: 281561 - RNA, 24 nt, Human
aaagugcugagauuacagggguga

SEQ ID NO: 281562 - RNA, 21 nt, Human
aagaaagaaacaaacaaacaa

SEQ ID NO: 281563 - RNA, 20 nt, Human
aagugccacccaagguacag

SEQ ID NO: 281564 - RNA, 21 nt, Human
aagugcugagauuacaggggu

SEQ ID NO: 281565 - RNA, 26 nt, Human
aagugcugagauuacaggggugagcc

SEQ ID NO: 281566 - RNA, 20 nt, Human
acacugggcuucauuguucu

SEQ ID NO: 281567 - RNA, 22 nt, Human
acaggcguccaccacaccugac

SEQ ID NO: 281568 - RNA, 24 nt, Human
accauguuggccaggcuggucucg

SEQ ID NO: 281569 - RNA, 18 nt, Human
acgggguuucaccauguu

SEQ ID NO: 281570 - RNA, 23 nt, Human
acgggguuucaccauguuggcca

SEQ ID NO: 281571 - RNA, 24 nt, Human
acgggguuucaccauguuggccag

SEQ ID NO: 281572 - RNA, 25 nt, Human
agaauucagcaaaguauaaagacaa

SEQ ID NO: 281573 - RNA, 20 nt, Human
agacaaauacaaaagaugcu

SEQ ID NO: 281574 - RNA, 21 nt, Human
agacaaauacaaaagaugcuu

SEQ ID NO: 281575 - RNA, 19 nt, Human
agaggaggugaggcccaag

SEQ ID NO: 281576 - RNA, 24 nt, Human
agagucucuguugccuaggcugga

SEQ ID NO: 281577 - RNA, 23 nt, Human
agauuacaggggugagccacugc

SEQ ID NO: 281578 - RNA, 19 nt, Human
agcaaaguauaaagacaaa

SEQ ID NO: 281579 - RNA, 22 nt, Human
aggcugcugccugggcagaagg

SEQ ID NO: 281580 - RNA, 25 nt, Human
aggcuggagugcaguggugugaucu

SEQ ID NO: 281581 - RNA, 21 nt, Human
agggaccugcgggccccaggg

SEQ ID NO: 281582 - RNA, 23 nt, Human
aguauaaagacaaauacaaaaga

SEQ ID NO: 281583 - RNA, 24 nt, Human
agucucuguugccuaggcuggagu

SEQ ID NO: 281584 - RNA, 24 nt, Human
agugauucuccugccucagccucc

SEQ ID NO: 281585 - RNA, 23 nt, Human
agugcaguggugugaucuugguu

SEQ ID NO: 281586 - RNA, 24 nt, Human
agugcaguggugugaucuugguuc

SEQ ID NO: 281587 - RNA, 20 nt, Human
aguuucuuuuuuuuuuuuuu

SEQ ID NO: 281588 - RNA, 23 nt, Human
auccgucggugucugcagccuug

SEQ ID NO: 281589 - RNA, 23 nt, Human
auccgucggugucugcagccuug

SEQ ID NO: 281590 - RNA, 23 nt, Human
augaaagccacagaagccacacc

SEQ ID NO: 281591 - RNA, 19 nt, Human
augacacccaugacuaugc

SEQ ID NO: 281592 - RNA, 20 nt, Human
augcuuuggagagaguggcu

SEQ ID NO: 281593 - RNA, 24 nt, Human
auuuuuguauuuuuaguagagacg

SEQ ID NO: 281594 - RNA, 21 nt, Human
caaaagaugcuugggauacaa

SEQ ID NO: 281595 - RNA, 23 nt, Human
caaagauacucaaaugaaagcca

SEQ ID NO: 281596 - RNA, 24 nt, Human
caaagugcugagauuacaggggug

SEQ ID NO: 281597 - RNA, 18 nt, Human
caacagggcgcauucccc

SEQ ID NO: 281598 - RNA, 21 nt, Human
caacugccuuucccgcccuuu

SEQ ID NO: 281599 - RNA, 22 nt, Human
caagaccaucagcacuucucca

SEQ ID NO: 281600 - RNA, 22 nt, Human
caagcucacacucgaaaacuag

SEQ ID NO: 281601 - RNA, 20 nt, Human
caagugauucuccugccuca

SEQ ID NO: 281602 - RNA, 22 nt, Human
caagugauucuccugccucagc

SEQ ID NO: 281603 - RNA, 26 nt, Human
cacaaccccaaacuacagacaacagg

SEQ ID NO: 281604 - RNA, 19 nt, Human
cacaggcguccaccacacc

SEQ ID NO: 281605 - RNA, 22 nt, Human
cacaguggauuuuacuguaacu

SEQ ID NO: 281606 - RNA, 21 nt, Human
caccauguuggccaggcuggu

SEQ ID NO: 281607 - RNA, 24 nt, Human
caccauguuggccaggcuggucuc

SEQ ID NO: 281608 - RNA, 27 nt, Human
caccauguuggccaggcuggucucgaa

SEQ ID NO: 281609 - RNA, 23 nt, Human
cacccugugugugcaggccccuc

SEQ ID NO: 281610 - RNA, 18 nt, Human
caccugacuaauuuuugu

SEQ ID NO: 281611 - RNA, 18 nt, Human
cacugcaacaccuccugg

SEQ ID NO: 281612 - RNA, 21 nt, Human
cagaaggcccagaauacccuc

SEQ ID NO: 281613 - RNA, 24 nt, Human
cagacaacagggcgcauuccccuc

SEQ ID NO: 281614 - RNA, 19 nt, Human
caggcucagggugcuacgg

SEQ ID NO: 281615 - RNA, 20 nt, Human
cagucaugugaaagaaagaa

SEQ ID NO: 281616 - RNA, 23 nt, Human
caugaacucccuagggaccugcg

SEQ ID NO: 281617 - RNA, 20 nt, Human
caugaggcugcugccugggc

SEQ ID NO: 281618 - RNA, 24 nt, Human
cauguuggccaggcuggucucgaa

SEQ ID NO: 281619 - RNA, 24 nt, Human
ccaaagugcugagauuacaggggu

SEQ ID NO: 281620 - RNA, 22 nt, Human
ccacacccaugaggcugcugcc

SEQ ID NO: 281621 - RNA, 18 nt, Human
ccacugcgcccugacuug

SEQ ID NO: 281622 - RNA, 19 nt, Human
ccacugcgcccugacuugg

SEQ ID NO: 281623 - RNA, 22 nt, Human
cccaaacuacagacaacagggc

SEQ ID NO: 281624 - RNA, 18 nt, Human
cccacgacccuggcuggg

SEQ ID NO: 281625 - RNA, 19 nt, Human
ccccucagcugaccugucu

SEQ ID NO: 281626 - RNA, 23 nt, Human
ccccucaugaacucccuagggac

SEQ ID NO: 281627 - RNA, 19 nt, Human
cccgaguagcugagauuga

SEQ ID NO: 281628 - RNA, 22 nt, Human
cccgccuuggccacccaaagug

SEQ ID NO: 281629 - RNA, 22 nt, Human
cccuccuaaauggaaaaacgca

SEQ ID NO: 281630 - RNA, 18 nt, Human
cccuggcugggaccaaga

SEQ ID NO: 281631 - RNA, 22 nt, Human
ccgccucuccuugcugcagcca

SEQ ID NO: 281632 - RNA, 22 nt, Human
ccgccucuccuugcugcagcca

SEQ ID NO: 281633 - RNA, 24 nt, Human
ccgccucuccuugcugcagccaug

SEQ ID NO: 281634 - RNA, 24 nt, Human
ccgccucuccuugcugcagccaug

SEQ ID NO: 281635 - RNA, 19 nt, Human
ccuaggcuggagugcagug

SEQ ID NO: 281636 - RNA, 24 nt, Human
ccuccuggguucaagugauucucc

SEQ ID NO: 281637 - RNA, 18 nt, Human
ccugagcuucggguagcu

SEQ ID NO: 281638 - RNA, 23 nt, Human
ccugccucagccucccgaguagc

SEQ ID NO: 281639 - RNA, 19 nt, Human
ccugcgcucuccgcuccca

SEQ ID NO: 281640 - RNA, 22 nt, Human
ccugggccaggcaaaaggcagg

SEQ ID NO: 281641 - RNA, 23 nt, Human
ccuggguucaagugauucuccuc

SEQ ID NO: 281642 - RNA, 23 nt, Human
ccuggguucaagugauucuccug

SEQ ID NO: 281643 - RNA, 21 nt, Human
ccuucuuucuucagccgaggc

SEQ ID NO: 281644 - RNA, 22 nt, Human
cgcaguaggugaaaaggggcca

SEQ ID NO: 281645 - RNA, 24 nt, Human
cgggguuucaccauguuggccagg

SEQ ID NO: 281646 - RNA, 23 nt, Human
cuaauuuuuguauuuuuaguaga

SEQ ID NO: 281647 - RNA, 26 nt, Human
cuccugaccucaagucaucugcccgc

SEQ ID NO: 281648 - RNA, 20 nt, Human
cuccuggguucaagugauuc

SEQ ID NO: 281649 - RNA, 21 nt, Human
cuccuggguucaagugauucu

SEQ ID NO: 281650 - RNA, 19 nt, Human
cucuguugccuaggcugga

SEQ ID NO: 281651 - RNA, 23 nt, Human
cugcccaugggaacucacaaucu

SEQ ID NO: 281652 - RNA, 23 nt, Human
cugccucagccucccgaguagcu

SEQ ID NO: 281653 - RNA, 20 nt, Human
cugggaccaagaccaucagc

SEQ ID NO: 281654 - RNA, 20 nt, Human
cugguggcggcagcuacucu

SEQ ID NO: 281655 - RNA, 20 nt, Human
cugguggcggcagcuacucu

SEQ ID NO: 281656 - RNA, 28 nt, Human
cugguggcggcagcuacucuggcucccu

SEQ ID NO: 281657 - RNA, 29 nt, Human
cugguggcggcagcuacucuggcucccuu

SEQ ID NO: 281658 - RNA, 21 nt, Human
cuucuccaacugccuuucccg

SEQ ID NO: 281659 - RNA, 24 nt, Human
gaccucaagucaucugcccgccuu

SEQ ID NO: 281660 - RNA, 24 nt, Human
gagacgggguuucaccauguuggc

SEQ ID NO: 281661 - RNA, 19 nt, Human
gagccugggccaggcaaaa

SEQ ID NO: 281662 - RNA, 19 nt, Human
gaggcugcugccugggcag

SEQ ID NO: 281663 - RNA, 20 nt, Human
gaggugaggcccaagguggg

SEQ ID NO: 281664 - RNA, 20 nt, Human
gaguuucuuuuuuuuuuuuu

SEQ ID NO: 281665 - RNA, 18 nt, Human
gauuacaggggugagcca

SEQ ID NO: 281666 - RNA, 22 nt, Human
gauuacaggggugagccacugc

SEQ ID NO: 281667 - RNA, 23 nt, Human
gcagucaugugaaagaaagaaac

SEQ ID NO: 281668 - RNA, 18 nt, Human
gccgaggccgccgccgcc

SEQ ID NO: 281669 - RNA, 18 nt, Human
gccgaggccgccgccgcc

SEQ ID NO: 281670 - RNA, 24 nt, Human
gccuaggcuggagugcaguggugu

SEQ ID NO: 281671 - RNA, 23 nt, Human
gcuggucucgaacuccugaccuc

SEQ ID NO: 281672 - RNA, 19 nt, Human
ggcgcccaucugugguucc

SEQ ID NO: 281673 - RNA, 22 nt, Human
ggcuggagugcaguggugugau

SEQ ID NO: 281674 - RNA, 24 nt, Human
ggcuggucucgaacuccugaccuc

SEQ ID NO: 281675 - RNA, 18 nt, Human
gggaagauuucuucuuuc

SEQ ID NO: 281676 - RNA, 24 nt, Human
gggcagucaugugaaagaaagaaa

SEQ ID NO: 281677 - RNA, 23 nt, Human
gggguuucaccauguuggccagg

SEQ ID NO: 281678 - RNA, 19 nt, Human
ggucucgaacuccugaccu

SEQ ID NO: 281679 - RNA, 20 nt, Human
gguggguggucgcaguaggu

SEQ ID NO: 281680 - RNA, 23 nt, Human
guagagacgggguuucaccaugu

SEQ ID NO: 281681 - RNA, 21 nt, Human
gucucuguugccuaggcugga

SEQ ID NO: 281682 - RNA, 24 nt, Human
gugauucuccugccucagccuccc

SEQ ID NO: 281683 - RNA, 23 nt, Human
guggcugcccccacgacccuggc

SEQ ID NO: 281684 - RNA, 27 nt, Human
guuucuuuuuuuuuuuuuuuuuuuuga

SEQ ID NO: 281685 - RNA, 24 nt, Human
uaacagcgagacgaggcacaaacg

SEQ ID NO: 281686 - RNA, 24 nt, Human
uaauuuuuguauuuuuaguagaga

SEQ ID NO: 281687 - RNA, 23 nt, Human
uacaggggugagccacugcgccc

SEQ ID NO: 281688 - RNA, 24 nt, Human
uacaggggugagccacugcgcccu

SEQ ID NO: 281689 - RNA, 25 nt, Human
uacaguaauagguauuucagagaag

SEQ ID NO: 281690 - RNA, 22 nt, Human
uagagacgggguuucaccaugu

SEQ ID NO: 281691 - RNA, 19 nt, Human
uagaggaggugaggcccaa

SEQ ID NO: 281692 - RNA, 21 nt, Human
uagcauaacaagugccaccca

SEQ ID NO: 281693 - RNA, 24 nt, Human
uaguagagacgggguuucaccaug

SEQ ID NO: 281694 - RNA, 26 nt, Human
uaguagagacgggguuucaccauguu

SEQ ID NO: 281695 - RNA, 19 nt, Human
uaucuugccacaaccccaa

SEQ ID NO: 281696 - RNA, 19 nt, Human
ucaagugauucuccugccu

SEQ ID NO: 281697 - RNA, 19 nt, Human
ucacugcaacaccuccugg

SEQ ID NO: 281698 - RNA, 21 nt, Human
ucacugcaacaccuccugggu

SEQ ID NO: 281699 - RNA, 18 nt, Human
ucagcaaaguauaaagac

SEQ ID NO: 281700 - RNA, 22 nt, Human
ucagccgaggccgccgccgccu

SEQ ID NO: 281701 - RNA, 22 nt, Human
ucagccgaggccgccgccgccu

SEQ ID NO: 281702 - RNA, 21 nt, Human
ucaucugcccgccuuggccac

SEQ ID NO: 281703 - RNA, 23 nt, Human
uccccucaugaacucccuaggga

SEQ ID NO: 281704 - RNA, 21 nt, Human
ucccuagggaccugcgggccc

SEQ ID NO: 281705 - RNA, 21 nt, Human
uccgagccaagucuacggcca

SEQ ID NO: 281706 - RNA, 23 nt, Human
uccgagccaagucuacggccacc

SEQ ID NO: 281707 - RNA, 18 nt, Human
uccggacucugguggcgg

SEQ ID NO: 281708 - RNA, 18 nt, Human
uccggacucugguggcgg

SEQ ID NO: 281709 - RNA, 21 nt, Human
uccuggguucaagugauucuc

SEQ ID NO: 281710 - RNA, 24 nt, Human
uccuggguucaagugauucuccug

SEQ ID NO: 281711 - RNA, 25 nt, Human
ucuauucacacugugcugcuuugcc

SEQ ID NO: 281712 - RNA, 24 nt, Human
ucuccugccucagccucccgagua

SEQ ID NO: 281713 - RNA, 21 nt, Human
ucucgaacuccugaccucaag

SEQ ID NO: 281714 - RNA, 18 nt, Human
ucucuguugccuaggcug

SEQ ID NO: 281715 - RNA, 25 nt, Human
ucugcagccuugggaagauuucacg

SEQ ID NO: 281716 - RNA, 22 nt, Human
ucuguugccuaggcuggagugc

SEQ ID NO: 281717 - RNA, 24 nt, Human
ucuguugccuaggcuggagugcag

SEQ ID NO: 281718 - RNA, 24 nt, Human
ucuugccacaaccccaaacuacag

SEQ ID NO: 281719 - RNA, 18 nt, Human
ugaccucaagucaucugc

SEQ ID NO: 281720 - RNA, 20 nt, Human
ugaccucaagucaucugccc

SEQ ID NO: 281721 - RNA, 22 nt, Human
ugacuagaguuacucuggugcc

SEQ ID NO: 281722 - RNA, 21 nt, Human
ugagaucacaggcguccacca

SEQ ID NO: 281723 - RNA, 22 nt, Human
ugagauuacaggggugagccac

SEQ ID NO: 281724 - RNA, 22 nt, Human
ugagauuacaggggugagccac

SEQ ID NO: 281725 - RNA, 24 nt, Human
ugagauuacaggggugagccacug

SEQ ID NO: 281726 - RNA, 23 nt, Human
ugagguggguggucgcaguaggu

SEQ ID NO: 281727 - RNA, 20 nt, Human
ugauucuccugccucagccu

SEQ ID NO: 281728 - RNA, 21 nt, Human
ugccacaaccccaaacuacag

SEQ ID NO: 281729 - RNA, 26 nt, Human
ugccacaaccccaaacuacagacaac

SEQ ID NO: 281730 - RNA, 24 nt, Human
ugccacccaagguacaggcucagg

SEQ ID NO: 281731 - RNA, 19 nt, Human
ugccuaggcuggagugcag

SEQ ID NO: 281732 - RNA, 20 nt, Human
ugccuaggcuggagugcagu

SEQ ID NO: 281733 - RNA, 24 nt, Human
ugccuaggcuggagugcaguggug

SEQ ID NO: 281734 - RNA, 24 nt, Human
ugccucagccucccgaguagcuga

SEQ ID NO: 281735 - RNA, 24 nt, Human
uggaaaaacgcaaagcacacagcg

SEQ ID NO: 281736 - RNA, 19 nt, Human
uggagugcaguggugugau

SEQ ID NO: 281737 - RNA, 23 nt, Human
uggagugcaguggugugaucuug

SEQ ID NO: 281738 - RNA, 24 nt, Human
uggagugcaguggugugaucuugg

SEQ ID NO: 281739 - RNA, 21 nt, Human
uggauuuuacuguaacugacu

SEQ ID NO: 281740 - RNA, 24 nt, Human
uggccaggcuggucucgaacuccu

SEQ ID NO: 281741 - RNA, 20 nt, Human
ugggaccaagaccaucagcu

SEQ ID NO: 281742 - RNA, 26 nt, Human
ugggaguuucuuuuuuuuuuuuuuuu

SEQ ID NO: 281743 - RNA, 27 nt, Human
ugggaguuucuuuuuuuuuuuuuuuuu

SEQ ID NO: 281744 - RNA, 21 nt, Human
ugggccaggcaaaaggcaggc

SEQ ID NO: 281745 - RNA, 22 nt, Human
ugggggugagccugggccaggc

SEQ ID NO: 281746 - RNA, 18 nt, Human
ugggucucugcccauggg

SEQ ID NO: 281747 - RNA, 23 nt, Human
uggguucaagugauucuccugcc

SEQ ID NO: 281748 - RNA, 24 nt, Human
uggguucaagugauucuccugccu

SEQ ID NO: 281749 - RNA, 24 nt, Human
ugguuagcaugguuagcuuucaca

SEQ ID NO: 281750 - RNA, 19 nt, Human
ugucaagggcagucaugug

SEQ ID NO: 281751 - RNA, 21 nt, Human
ugugugcaggccccucagcug

SEQ ID NO: 281752 - RNA, 21 nt, Human
uuagaaaagccacauacagua

SEQ ID NO: 281753 - RNA, 18 nt, Human
uuaguagagacgggguuu

SEQ ID NO: 281754 - RNA, 22 nt, Human
uuaguagagacgggguuucacc

SEQ ID NO: 281755 - RNA, 24 nt, Human
uuaguagagacgggguuucaccau

SEQ ID NO: 281756 - RNA, 21 nt, Human
uucaagugauucuccugccuc

SEQ ID NO: 281757 - RNA, 23 nt, Human
uucaagugauucuccugccucag

SEQ ID NO: 281758 - RNA, 24 nt, Human
uucaagugauucuccugccucagc

SEQ ID NO: 281759 - RNA, 18 nt, Human
uucacgccugcgcucucc

SEQ ID NO: 281760 - RNA, 20 nt, Human
uucccgcccuuucgcagcuc

SEQ ID NO: 281761 - RNA, 20 nt, Human
uucuugaucccgcucuguuc

SEQ ID NO: 281762 - RNA, 18 nt, Human
uugagacagagucucugu

SEQ ID NO: 281763 - RNA, 24 nt, Human
uugccuaggcuggagugcaguggu

SEQ ID NO: 281764 - RNA, 22 nt, Human
uuggagguucucuuacauuugg

SEQ ID NO: 281765 - RNA, 23 nt, Human
uuguauuuuuaguagagacgggg

SEQ ID NO: 281766 - RNA, 24 nt, Human
uuucaccauguuggccaggcuggu

SEQ ID NO: 281767 - RNA, 23 nt, Human
uuugagacagagucucuguugcc

SEQ ID NO: 281768 - RNA, 24 nt, Human
uuuuuaguagagacgggguuucac

SEQ ID NO: 281769 - RNA, 20 nt, Human
uuuuuguauuuuuaguagag

SEQ ID NO: 281770 - RNA, 18 nt, Human
uuuuuuuuuuuuuuuuug

SEQ ID NO: 281771 - RNA, 24 nt, Human
uacaauauggguuuaagccuucaa

SEQ ID NO: 281772 - RNA, 23 nt, Human
aaacagcccugaagaucaauccc

SEQ ID NO: 281773 - RNA, 20 nt, Human
aaaccagggaccaaaccaaa

SEQ ID NO: 281774 - RNA, 23 nt, Human
aaaggcccucugccugccccuaa

SEQ ID NO: 281775 - RNA, 21 nt, Human
aacaugggaugaacagggagg

SEQ ID NO: 281776 - RNA, 26 nt, Human
aaccugccauuuuuuauccaaacucu

SEQ ID NO: 281777 - RNA, 22 nt, Human
aagacugaaaaccagggaccaa

SEQ ID NO: 281778 - RNA, 19 nt, Human
aagcgcgguucggugggga

SEQ ID NO: 281779 - RNA, 19 nt, Human
aaggaaaaacacugaauga

SEQ ID NO: 281780 - RNA, 25 nt, Human
aaggcaggaacaaaaacagcccuga

SEQ ID NO: 281781 - RNA, 22 nt, Human
aauggcuagggauggaaaaaga

SEQ ID NO: 281782 - RNA, 20 nt, Human
acagagcagcgcgcggcccc

SEQ ID NO: 281783 - RNA, 18 nt, Human
agcccugaagaucaaucc

SEQ ID NO: 281784 - RNA, 23 nt, Human
aggaacaaaaacagcccugaaga

SEQ ID NO: 281785 - RNA, 21 nt, Human
aggaguagggaagcugguugg

SEQ ID NO: 281786 - RNA, 22 nt, Human
aggaguccuaguauaaaagggc

SEQ ID NO: 281787 - RNA, 21 nt, Human
aggcaggaacaaaaacagccc

SEQ ID NO: 281788 - RNA, 24 nt, Human
aggcaggaacaaaaacagcccuga

SEQ ID NO: 281789 - RNA, 22 nt, Human
aggcaggaacaaaaacagggga

SEQ ID NO: 281790 - RNA, 20 nt, Human
agggauggaaaaagaauacc

SEQ ID NO: 281791 - RNA, 19 nt, Human
agggguagauggagggugg

SEQ ID NO: 281792 - RNA, 18 nt, Human
agguguggccauauugcc

SEQ ID NO: 281793 - RNA, 24 nt, Human
aguauuaagaaaagcccugaacaa

SEQ ID NO: 281794 - RNA, 18 nt, Human
auaguaguagcaaaggua

SEQ ID NO: 281795 - RNA, 24 nt, Human
aucccauuuuguuuccuaacucag

SEQ ID NO: 281796 - RNA, 24 nt, Human
caaaccaaacucugggagcuuccc

SEQ ID NO: 281797 - RNA, 18 nt, Human
caacccagagaauggcaa

SEQ ID NO: 281798 - RNA, 24 nt, Human
caagacugaaaaccagggaccaaa

SEQ ID NO: 281799 - RNA, 23 nt, Human
cacagagcagcgcgcggccccca

SEQ ID NO: 281800 - RNA, 21 nt, Human
cagcaguguagcaaaggcccu

SEQ ID NO: 281801 - RNA, 23 nt, Human
cagggaggguuacccaaccugcc

SEQ ID NO: 281802 - RNA, 26 nt, Human
cagugccaauccaaacaaggcaggga

SEQ ID NO: 281803 - RNA, 18 nt, Human
ccaaacucugcaggcaaa

SEQ ID NO: 281804 - RNA, 23 nt, Human
ccaacccuccuuugccuccaaaa

SEQ ID NO: 281805 - RNA, 18 nt, Human
ccccuaacgcccaacucc

SEQ ID NO: 281806 - RNA, 22 nt, Human
ccccugccaccgaccgccgcuu

SEQ ID NO: 281807 - RNA, 22 nt, Human
ccccugcugccacccgccgcuc

SEQ ID NO: 281808 - RNA, 23 nt, Human
ccuaacaccagcuaucucaugcc

SEQ ID NO: 281809 - RNA, 22 nt, Human
ccuccgugacaggcauucacuu

SEQ ID NO: 281810 - RNA, 25 nt, Human
ccugccccuaacgcccaacuccaug

SEQ ID NO: 281811 - RNA, 20 nt, Human
cgaaaccgucgccgccgccg

SEQ ID NO: 281812 - RNA, 23 nt, Human
cgugacaggcauucacuucugcc

SEQ ID NO: 281813 - RNA, 26 nt, Human
cucacagagcagcgcgcggcccccac

SEQ ID NO: 281814 - RNA, 22 nt, Human
cucuaaaggcaggaacaaaaac

SEQ ID NO: 281815 - RNA, 23 nt, Human
cugccccuaacgcccaacuccuu

SEQ ID NO: 281816 - RNA, 20 nt, Human
gaauacccugguucuuuggg

SEQ ID NO: 281817 - RNA, 21 nt, Human
gagacggaucccucuuccuuc

SEQ ID NO: 281818 - RNA, 19 nt, Human
gcaaaggcccucugccugc

SEQ ID NO: 281819 - RNA, 24 nt, Human
gcaggaacaaaaacagcccugaag

SEQ ID NO: 281820 - RNA, 21 nt, Human
gcccugaagaucaaucccucc

SEQ ID NO: 281821 - RNA, 21 nt, Human
ggaccaaaccaaacucuggga

SEQ ID NO: 281822 - RNA, 18 nt, Human
ggccaacccuccuuugcc

SEQ ID NO: 281823 - RNA, 20 nt, Human
gggaagcugguuggcaugga

SEQ ID NO: 281824 - RNA, 20 nt, Human
ggguagaugccacagccaac

SEQ ID NO: 281825 - RNA, 22 nt, Human
gugacaggcauucacuucugcc

SEQ ID NO: 281826 - RNA, 21 nt, Human
gugucagaaagaucccauuuu

SEQ ID NO: 281827 - RNA, 27 nt, Human
guuuguuuuugcuucuggaagggguag

SEQ ID NO: 281828 - RNA, 22 nt, Human
uaaaagggccaggguaggagua

SEQ ID NO: 281829 - RNA, 19 nt, Human
uaacaccagcuaucucaug

SEQ ID NO: 281830 - RNA, 20 nt, Human
uaccaggaaugcuauaaaca

SEQ ID NO: 281831 - RNA, 25 nt, Human
uagauggagggugggaaaugcuuug

SEQ ID NO: 281832 - RNA, 18 nt, Human
ucacaugugaccaagggu

SEQ ID NO: 281833 - RNA, 27 nt, Human
ucacuucugcccuaagugugucagaaa

SEQ ID NO: 281834 - RNA, 18 nt, Human
ucagaaaaagaggaaaaa

SEQ ID NO: 281835 - RNA, 22 nt, Human
ucagaaaaagaggaaaauaucu

SEQ ID NO: 281836 - RNA, 21 nt, Human
ucauggaacucuaaaggcagg

SEQ ID NO: 281837 - RNA, 20 nt, Human
uccaaacaaggcagggaacc

SEQ ID NO: 281838 - RNA, 26 nt, Human
uccccugcugccacccgccgcucacu

SEQ ID NO: 281839 - RNA, 22 nt, Human
ucgccgccgccgcuaccacccc

SEQ ID NO: 281840 - RNA, 21 nt, Human
ucucaugccauuaccuggggc

SEQ ID NO: 281841 - RNA, 19 nt, Human
ucugcaggcaaauccagac

SEQ ID NO: 281842 - RNA, 21 nt, Human
ucugcccuaagugugucagaa

SEQ ID NO: 281843 - RNA, 18 nt, Human
ugacaggcauucacuucu

SEQ ID NO: 281844 - RNA, 20 nt, Human
ugaccaaggguuccugcaca

SEQ ID NO: 281845 - RNA, 21 nt, Human
ugaccaaggguuccugcacau

SEQ ID NO: 281846 - RNA, 22 nt, Human
ugcaggcaaauccagacagagu

SEQ ID NO: 281847 - RNA, 20 nt, Human
ugcauaaagacccaggugug

SEQ ID NO: 281848 - RNA, 22 nt, Human
ugccccuaacgcccaacuccau

SEQ ID NO: 281849 - RNA, 26 nt, Human
ugccccuaacgcccaacuccaugccu

SEQ ID NO: 281850 - RNA, 31 nt, Human
ugccucagucaugguuuguuuuugcuucugg

SEQ ID NO: 281851 - RNA, 21 nt, Human
uggcagcagggagggagggua

SEQ ID NO: 281852 - RNA, 22 nt, Human
uggcagcagggagggaggguag

SEQ ID NO: 281853 - RNA, 18 nt, Human
uggcauggagggucacaa

SEQ ID NO: 281854 - RNA, 18 nt, Human
ugucagcaguguagcaaa

SEQ ID NO: 281855 - RNA, 26 nt, Human
ugucucacuccuccuaaggaguccua

SEQ ID NO: 281856 - RNA, 20 nt, Human
uguggccauauugccugaga

SEQ ID NO: 281857 - RNA, 22 nt, Human
uuaccuggggcucccuauagcu

SEQ ID NO: 281858 - RNA, 24 nt, Human
uuaucaccugucucacuccuccua

SEQ ID NO: 281859 - RNA, 18 nt, Human
uucagaaaaagaggaaaa

SEQ ID NO: 281860 - RNA, 21 nt, Human
uuuauuuauacauauauauau

SEQ ID NO: 281861 - RNA, 24 nt, Human
aagaaggcauuuucacacaaggcu

SEQ ID NO: 281862 - RNA, 25 nt, Human
aagaaggcauuuucacacaaggcug

SEQ ID NO: 281863 - RNA, 20 nt, Human
aagaggaagaaggcauuuuc

SEQ ID NO: 281864 - RNA, 23 nt, Human
accuugucuugcccuuuuugcca

SEQ ID NO: 281865 - RNA, 22 nt, Human
agcuccucuaagccggcugcug

SEQ ID NO: 281866 - RNA, 23 nt, Human
auccuaaaagcauuucuuuuucu

SEQ ID NO: 281867 - RNA, 20 nt, Human
cacagcucggaccgccagcu

SEQ ID NO: 281868 - RNA, 24 nt, Human
cacgaacccugcaggucugggcuu

SEQ ID NO: 281869 - RNA, 24 nt, Human
caugaggccgcgccuguguccagc

SEQ ID NO: 281870 - RNA, 20 nt, Human
cuugcccuuuuugccaaaug

SEQ ID NO: 281871 - RNA, 26 nt, Human
cuugucuugcccuuuuugccaaaugu

SEQ ID NO: 281872 - RNA, 21 nt, Human
gcuucagcuucagcuuggccu

SEQ ID NO: 281873 - RNA, 23 nt, Human
gcuucagcuuggccucauucauu

SEQ ID NO: 281874 - RNA, 20 nt, Human
ggucuuucaagccacagcuc

SEQ ID NO: 281875 - RNA, 19 nt, Human
uaaaagcauuucuuuuucu

SEQ ID NO: 281876 - RNA, 21 nt, Human
uaaaagcauuucuuuuucuuc

SEQ ID NO: 281877 - RNA, 21 nt, Human
uaaaagcauuucuuuuucuuc

SEQ ID NO: 281878 - RNA, 20 nt, Human
uaccugaauccuaaaagcau

SEQ ID NO: 281879 - RNA, 18 nt, Human
uacuggaugacucgcugc

SEQ ID NO: 281880 - RNA, 23 nt, Human
uccuaaaagcauuucuuuuucuu

SEQ ID NO: 281881 - RNA, 24 nt, Human
ucgcgucggucuuucaagccacag

SEQ ID NO: 281882 - RNA, 20 nt, Human
ucggaccgccagcuccuaga

SEQ ID NO: 281883 - RNA, 25 nt, Human
ugccaaauguucaucuucuaauucu

SEQ ID NO: 281884 - RNA, 22 nt, Human
ugggaagaaucuucagcuucag

SEQ ID NO: 281885 - RNA, 18 nt, Human
uguccagcugaaaguggg

SEQ ID NO: 281886 - RNA, 24 nt, Human
uugucuugcccuuuuugccaaaug

SEQ ID NO: 281887 - RNA, 20 nt, Human
uuuaaaaauuguccuuuuuc

SEQ ID NO: 281888 - RNA, 22 nt, Human
aggagagggaucaggcagcccu

SEQ ID NO: 281889 - RNA, 18 nt, Human
caccagugaggcucaauc

SEQ ID NO: 281890 - RNA, 18 nt, Human
caggaggagaugacagac

SEQ ID NO: 281891 - RNA, 26 nt, Human
cagugaggcucaaucuucugaagucu

SEQ ID NO: 281892 - RNA, 18 nt, Human
ccgcuacgccggcaaaca

SEQ ID NO: 281893 - RNA, 18 nt, Human
ccgcuacgccggcaaaca

SEQ ID NO: 281894 - RNA, 25 nt, Human
gaugacagacgacaaccagacggua

SEQ ID NO: 281895 - RNA, 20 nt, Human
gcaccuaaguccuucgggua

SEQ ID NO: 281896 - RNA, 18 nt, Human
uaacucccaagcgcuccc

SEQ ID NO: 281897 - RNA, 21 nt, Human
ucaggcagcccucccucccuc

SEQ ID NO: 281898 - RNA, 24 nt, Human
uuaaguacacaaagcaccuaaguc

SEQ ID NO: 281899 - RNA, 25 nt, Human
aaaacuccuucuuccagcucuacuu

SEQ ID NO: 281900 - RNA, 27 nt, Human
aaacaaagaggaugugaacgaagacaa

SEQ ID NO: 281901 - RNA, 23 nt, Human
aaagauugaggaaaugucagccu

SEQ ID NO: 281902 - RNA, 23 nt, Human
aaagauugaggaaaugucagccu

SEQ ID NO: 281903 - RNA, 20 nt, Human
aacuccuucuuccagcucua

SEQ ID NO: 281904 - RNA, 20 nt, Human
aacuccuuuucaaugagaau

SEQ ID NO: 281905 - RNA, 22 nt, Human
aagaccaauaaagauugaggaa

SEQ ID NO: 281906 - RNA, 22 nt, Human
aagaccaauaaagauugaggaa

SEQ ID NO: 281907 - RNA, 19 nt, Human
aagcguccuggauaagauc

SEQ ID NO: 281908 - RNA, 19 nt, Human
aagcguccuggauaagauc

SEQ ID NO: 281909 - RNA, 28 nt, Human
aaggagaaaugaagaccaaaugcaaugg

SEQ ID NO: 281910 - RNA, 28 nt, Human
aaggagaaaugaagaccaaaugcaaugg

SEQ ID NO: 281911 - RNA, 22 nt, Human
acguggccugcaaguuaacguu

SEQ ID NO: 281912 - RNA, 24 nt, Human
acuggaaugccaguuccuggagcc

SEQ ID NO: 281913 - RNA, 23 nt, Human
agugguuuugaaacaguccucaa

SEQ ID NO: 281914 - RNA, 19 nt, Human
augaagaccaaaugcaaug

SEQ ID NO: 281915 - RNA, 19 nt, Human
augaagaccaaaugcaaug

SEQ ID NO: 281916 - RNA, 24 nt, Human
augaggccuccaggaaaguguagc

SEQ ID NO: 281917 - RNA, 22 nt, Human
auguccuuaaggccuugaugga

SEQ ID NO: 281918 - RNA, 24 nt, Human
caacaaugcuacgaaugcaguucu

SEQ ID NO: 281919 - RNA, 21 nt, Human
cacucuuuauuaugaaaauaa

SEQ ID NO: 281920 - RNA, 24 nt, Human
cacuuccccucagaaucuugccac

SEQ ID NO: 281921 - RNA, 18 nt, Human
cagccuggaggagacuaa

SEQ ID NO: 281922 - RNA, 18 nt, Human
cagccuggaggagacuaa

SEQ ID NO: 281923 - RNA, 26 nt, Human
ccucaaaacuccuucuuccagcucua

SEQ ID NO: 281924 - RNA, 19 nt, Human
ccugggagcuacacuuccc

SEQ ID NO: 281925 - RNA, 21 nt, Human
cguuggcuuccuggucagcca

SEQ ID NO: 281926 - RNA, 21 nt, Human
cuagcaagacugaggccagga

SEQ ID NO: 281927 - RNA, 25 nt, Human
cucaaaacuccuucuuccagcucua

SEQ ID NO: 281928 - RNA, 21 nt, Human
cucuucaggccuggagauaaa

SEQ ID NO: 281929 - RNA, 21 nt, Human
gaaaagaggaaacaaagagga

SEQ ID NO: 281930 - RNA, 18 nt, Human
gaagaagacuuggaacca

SEQ ID NO: 281931 - RNA, 21 nt, Human
gaagagaugcuguguuuucac

SEQ ID NO: 281932 - RNA, 23 nt, Human
gacuaaggagaaaugaagaccaa

SEQ ID NO: 281933 - RNA, 23 nt, Human
gacuaaggagaaaugaagaccaa

SEQ ID NO: 281934 - RNA, 23 nt, Human
gacuuggaaccaaccugggagcu

SEQ ID NO: 281935 - RNA, 21 nt, Human
gaggcccauguccuuaaggcc

SEQ ID NO: 281936 - RNA, 22 nt, Human
gaggcccauguccuuaaggccu

SEQ ID NO: 281937 - RNA, 19 nt, Human
gaucuucuggaaagauuuc

SEQ ID NO: 281938 - RNA, 21 nt, Human
gccaggccuuaggcuggugaa

SEQ ID NO: 281939 - RNA, 22 nt, Human
gugguuuugaaacaguccucaa

SEQ ID NO: 281940 - RNA, 20 nt, Human
guuggcuuccuggucagcca

SEQ ID NO: 281941 - RNA, 22 nt, Human
uaaaacuucaccagagaagcuu

SEQ ID NO: 281942 - RNA, 23 nt, Human
uagcaagacugaggccaggacag

SEQ ID NO: 281943 - RNA, 23 nt, Human
uaggcuggugaaaagaggaaaca

SEQ ID NO: 281944 - RNA, 23 nt, Human
ucaccagagaagcuucuggccac

SEQ ID NO: 281945 - RNA, 24 nt, Human
ucacguggccugcaaguuaacguu

SEQ ID NO: 281946 - RNA, 19 nt, Human
ucagucuauccacaaauuc

SEQ ID NO: 281947 - RNA, 22 nt, Human
ucugaauaaaacuucaccagag

SEQ ID NO: 281948 - RNA, 23 nt, Human
ucuuggugauguucuggaguugg

SEQ ID NO: 281949 - RNA, 22 nt, Human
ugaaaagaggaaacaaagagga

SEQ ID NO: 281950 - RNA, 23 nt, Human
ugaaaagaggaaacaaagaggau

SEQ ID NO: 281951 - RNA, 23 nt, Human
ugaauaaaacuucaccagagaag

SEQ ID NO: 281952 - RNA, 22 nt, Human
ugacacuacagucucacagaac

SEQ ID NO: 281953 - RNA, 22 nt, Human
ugacacuacagucucacagaac

SEQ ID NO: 281954 - RNA, 24 nt, Human
ugacugguaucuccaaaaguguca

SEQ ID NO: 281955 - RNA, 24 nt, Human
ugacugguaucuccaaaaguguca

SEQ ID NO: 281956 - RNA, 20 nt, Human
ugaggccaggacaguuaacu

SEQ ID NO: 281957 - RNA, 20 nt, Human
ugaguggggcgaauacacag

SEQ ID NO: 281958 - RNA, 24 nt, Human
uggaaagauuucguuuugugaaaa

SEQ ID NO: 281959 - RNA, 21 nt, Human
uggaagaagacuuggaaccaa

SEQ ID NO: 281960 - RNA, 25 nt, Human
uggacuuccugagacaccuguucac

SEQ ID NO: 281961 - RNA, 19 nt, Human
uggaggagacuaaggagaa

SEQ ID NO: 281962 - RNA, 19 nt, Human
uggaggagacuaaggagaa

SEQ ID NO: 281963 - RNA, 21 nt, Human
uggccuagaagagaugcuggc

SEQ ID NO: 281964 - RNA, 18 nt, Human
uuagagaucaucuagucc

SEQ ID NO: 281965 - RNA, 22 nt, Human
uucacucacacucagcauaguc

SEQ ID NO: 281966 - RNA, 19 nt, Human
uuccagcucuacuucaacu

SEQ ID NO: 281967 - RNA, 19 nt, Human
uucuuccagcucuacuuca

SEQ ID NO: 281968 - RNA, 27 nt, Human
uugcuuuguccugacacuacagucuca

SEQ ID NO: 281969 - RNA, 27 nt, Human
uugcuuuguccugacacuacagucuca

SEQ ID NO: 281970 - RNA, 19 nt, Human
uuguugcuuuguccugaca

SEQ ID NO: 281971 - RNA, 19 nt, Human
uuguugcuuuguccugaca

SEQ ID NO: 281972 - RNA, 25 nt, Human
uuguugcuuuguccugacacuacag

SEQ ID NO: 281973 - RNA, 25 nt, Human
uuguugcuuuguccugacacuacag

SEQ ID NO: 281974 - RNA, 22 nt, Human
uuuguuguugcuuuguccugac

SEQ ID NO: 281975 - RNA, 22 nt, Human
uuuguuguugcuuuguccugac

SEQ ID NO: 281976 - RNA, 20 nt, Human
uuuuuuuuuuuuuuuuuaac

SEQ ID NO: 281977 - RNA, 21 nt, Human
aagaacaugaggagcucugac

SEQ ID NO: 281978 - RNA, 22 nt, Human
aagacaccauacuuuauuguga

SEQ ID NO: 281979 - RNA, 20 nt, Human
aagugcacagaacaacuggc

SEQ ID NO: 281980 - RNA, 19 nt, Human
acagaacaacuggccccuu

SEQ ID NO: 281981 - RNA, 22 nt, Human
cagcccugugaguugggcuucg

SEQ ID NO: 281982 - RNA, 23 nt, Human
ccaauguccuuauagggcucucu

SEQ ID NO: 281983 - RNA, 21 nt, Human
ccccuuuggaaggaugagagu

SEQ ID NO: 281984 - RNA, 20 nt, Human
ccuggggguaacaggggugg

SEQ ID NO: 281985 - RNA, 19 nt, Human
cggcuucuuagccccagcc

SEQ ID NO: 281986 - RNA, 23 nt, Human
cucuugaggagaaucuguguggc

SEQ ID NO: 281987 - RNA, 22 nt, Human
cugugaguugggcuucggcuuc

SEQ ID NO: 281988 - RNA, 23 nt, Human
cuucggcuucuuagccccagccg

SEQ ID NO: 281989 - RNA, 21 nt, Human
gaacaacuggccccuuuggaa

SEQ ID NO: 281990 - RNA, 28 nt, Human
ggacaagugcacagaacaacuggccccu

SEQ ID NO: 281991 - RNA, 18 nt, Human
ggggacgggaguuuggag

SEQ ID NO: 281992 - RNA, 22 nt, Human
guugggcuucggcuucuuagcc

SEQ ID NO: 281993 - RNA, 21 nt, Human
uccuggggguaacaggggugg

SEQ ID NO: 281994 - RNA, 19 nt, Human
ucuguguggccuggggacg

SEQ ID NO: 281995 - RNA, 21 nt, Human
ugaaaaggaacagagauccug

SEQ ID NO: 281996 - RNA, 23 nt, Human
ugcaagaacaugaggagcucuga

SEQ ID NO: 281997 - RNA, 22 nt, Human
ugcacagaacaacuggccccuu

SEQ ID NO: 281998 - RNA, 19 nt, Human
uggggguaacaggggugga

SEQ ID NO: 281999 - RNA, 18 nt, Human
uuuuuuuuuuuuuuuuug

SEQ ID NO: 282000 - RNA, 20 nt, Human
aaauacacagaacaacuggc

SEQ ID NO: 282001 - RNA, 20 nt, Human
aaauacacagaacaacuggc

SEQ ID NO: 282002 - RNA, 20 nt, Human
aacaaacaccaccaccuucc

SEQ ID NO: 282003 - RNA, 26 nt, Human
aacaaacaccaccaccuuccuugaac

SEQ ID NO: 282004 - RNA, 21 nt, Human
aaguacuugcacaaguugcuc

SEQ ID NO: 282005 - RNA, 22 nt, Human
aaguacuugcacaaguugcucu

SEQ ID NO: 282006 - RNA, 27 nt, Human
accauguucauaaugacaguuccucuu

SEQ ID NO: 282007 - RNA, 22 nt, Human
accuuccuugaacacuccguug

SEQ ID NO: 282008 - RNA, 20 nt, Human
acucuggcucucugggccug

SEQ ID NO: 282009 - RNA, 20 nt, Human
acuguuuauuaugaaaauaa

SEQ ID NO: 282010 - RNA, 20 nt, Human
acuguuuauuaugaaaauaa

SEQ ID NO: 282011 - RNA, 19 nt, Human
agagcauccuuuccugaaa

SEQ ID NO: 282012 - RNA, 18 nt, Human
agaggaugagaaggaaga

SEQ ID NO: 282013 - RNA, 18 nt, Human
agaggaugagaaggaaga

SEQ ID NO: 282014 - RNA, 18 nt, Human
agaggaugagaaggaaga

SEQ ID NO: 282015 - RNA, 18 nt, Human
agaggaugagaaggaaga

SEQ ID NO: 282016 - RNA, 24 nt, Human
agaguggucuuaggcuggugaaaa

SEQ ID NO: 282017 - RNA, 24 nt, Human
agaguggucuuaggcuggugaaaa

SEQ ID NO: 282018 - RNA, 24 nt, Human
agaguggucuuaggcuggugaaaa

SEQ ID NO: 282019 - RNA, 24 nt, Human
agaguggucuuaggcuggugaaaa

SEQ ID NO: 282020 - RNA, 24 nt, Human
aggaagacaaagaugacaucaaag

SEQ ID NO: 282021 - RNA, 24 nt, Human
aggaagacaaagaugacaucaaag

SEQ ID NO: 282022 - RNA, 24 nt, Human
aggaagacaaagaugacaucaaag

SEQ ID NO: 282023 - RNA, 24 nt, Human
aggaagacaaagaugacaucaaag

SEQ ID NO: 282024 - RNA, 21 nt, Human
aggagagggagggcucagagc

SEQ ID NO: 282025 - RNA, 21 nt, Human
aggagagggagggcucagagc

SEQ ID NO: 282026 - RNA, 21 nt, Human
aggagagggagggcucagagc

SEQ ID NO: 282027 - RNA, 21 nt, Human
aggagagggagggcucagagc

SEQ ID NO: 282028 - RNA, 24 nt, Human
agggagggcucagagcuggaggag

SEQ ID NO: 282029 - RNA, 24 nt, Human
agggagggcucagagcuggaggag

SEQ ID NO: 282030 - RNA, 24 nt, Human
agggagggcucagagcuggaggag

SEQ ID NO: 282031 - RNA, 24 nt, Human
agggagggcucagagcuggaggag

SEQ ID NO: 282032 - RNA, 20 nt, Human
aggguuucauugucucagaa

SEQ ID NO: 282033 - RNA, 19 nt, Human
agguagugaugaaggucca

SEQ ID NO: 282034 - RNA, 19 nt, Human
agguagugaugaaggucca

SEQ ID NO: 282035 - RNA, 19 nt, Human
agguagugaugaaggucca

SEQ ID NO: 282036 - RNA, 20 nt, Human
augaguggggcaaauacaca

SEQ ID NO: 282037 - RNA, 20 nt, Human
augaguggggcaaauacaca

SEQ ID NO: 282038 - RNA, 20 nt, Human
augaguggggcaaauacaca

SEQ ID NO: 282039 - RNA, 23 nt, Human
augaguggggcaaauacacagaa

SEQ ID NO: 282040 - RNA, 19 nt, Human
caaacaccaccaccuuccu

SEQ ID NO: 282041 - RNA, 24 nt, Human
caaacaccaccaccuuccuugaac

SEQ ID NO: 282042 - RNA, 26 nt, Human
caacaaacaccaccaccuuccuugaa

SEQ ID NO: 282043 - RNA, 22 nt, Human
cacagacuggaauugcggccag

SEQ ID NO: 282044 - RNA, 22 nt, Human
cacagacuggaauugcggccag

SEQ ID NO: 282045 - RNA, 22 nt, Human
cacagacuggaauugcggccag

SEQ ID NO: 282046 - RNA, 21 nt, Human
cacucugagucucuugggggc

SEQ ID NO: 282047 - RNA, 21 nt, Human
cacucugagucucuugggggc

SEQ ID NO: 282048 - RNA, 21 nt, Human
cacucugagucucuugggggc

SEQ ID NO: 282049 - RNA, 21 nt, Human
cacucugagucucuugggggc

SEQ ID NO: 282050 - RNA, 21 nt, Human
cacuguuuauuaugaaaauaa

SEQ ID NO: 282051 - RNA, 21 nt, Human
cacuguuuauuaugaaaauaa

SEQ ID NO: 282052 - RNA, 21 nt, Human
cacuguuuauuaugaaaauaa

SEQ ID NO: 282053 - RNA, 21 nt, Human
cagagacaacaaacaccacca

SEQ ID NO: 282054 - RNA, 21 nt, Human
cagagcauccuuuccugaaaa

SEQ ID NO: 282055 - RNA, 19 nt, Human
cagcccuuucaccuugccc

SEQ ID NO: 282056 - RNA, 19 nt, Human
caggaauugcaggacuaaa

SEQ ID NO: 282057 - RNA, 23 nt, Human
caggcaaugcacugagggagucc

SEQ ID NO: 282058 - RNA, 25 nt, Human
caguaaaguuuuccuugcaggguuu

SEQ ID NO: 282059 - RNA, 24 nt, Human
cauuggauucuauaaggagugugu

SEQ ID NO: 282060 - RNA, 19 nt, Human
cauuucacuagcuuccugu

SEQ ID NO: 282061 - RNA, 21 nt, Human
ccacauguccaccaggaugga

SEQ ID NO: 282062 - RNA, 19 nt, Human
ccaccaggauggaggugaa

SEQ ID NO: 282063 - RNA, 18 nt, Human
cccaacucccacgccgac

SEQ ID NO: 282064 - RNA, 20 nt, Human
cccaccuuucuuccuucuuc

SEQ ID NO: 282065 - RNA, 25 nt, Human
cccucagaaacagcuuaucauucau

SEQ ID NO: 282066 - RNA, 25 nt, Human
cccucagaaacagcuuaucauucau

SEQ ID NO: 282067 - RNA, 25 nt, Human
cccucagaaacagcuuaucauucau

SEQ ID NO: 282068 - RNA, 26 nt, Human
ccuccaaccccaguccuuagaguggu

SEQ ID NO: 282069 - RNA, 19 nt, Human
ccugaaaaggaagcgcuca

SEQ ID NO: 282070 - RNA, 21 nt, Human
ccugagaccauccuuccacuc

SEQ ID NO: 282071 - RNA, 21 nt, Human
ccugagaccauccuuccacuu

SEQ ID NO: 282072 - RNA, 24 nt, Human
cggguucccuucuagccauagcuc

SEQ ID NO: 282073 - RNA, 24 nt, Human
cucagagcuggaggagagugugga

SEQ ID NO: 282074 - RNA, 24 nt, Human
cucagagcuggaggagagugugga

SEQ ID NO: 282075 - RNA, 24 nt, Human
cucagagcuggaggagagugugga

SEQ ID NO: 282076 - RNA, 24 nt, Human
cucagagcuggaggagagugugga

SEQ ID NO: 282077 - RNA, 24 nt, Human
cuccaaccccaguccuuagagugg

SEQ ID NO: 282078 - RNA, 24 nt, Human
cuccaaccccaguccuuagagugg

SEQ ID NO: 282079 - RNA, 24 nt, Human
cuccaaccccaguccuuagagugg

SEQ ID NO: 282080 - RNA, 21 nt, Human
cuccuaggagagggagggcuc

SEQ ID NO: 282081 - RNA, 21 nt, Human
cuccuaggagagggagggcuc

SEQ ID NO: 282082 - RNA, 21 nt, Human
cuccuaggagagggagggcuc

SEQ ID NO: 282083 - RNA, 20 nt, Human
cucuggagguuuucuauuuc

SEQ ID NO: 282084 - RNA, 23 nt, Human
cuggagguuuucuauuucuccaa

SEQ ID NO: 282085 - RNA, 23 nt, Human
cuucagagacaacaaacaccacc

SEQ ID NO: 282086 - RNA, 19 nt, Human
cuugcacaaguugcucugc

SEQ ID NO: 282087 - RNA, 18 nt, Human
cuugcccaacucccacgc

SEQ ID NO: 282088 - RNA, 21 nt, Human
gaaaagaggaaacaaagagga

SEQ ID NO: 282089 - RNA, 21 nt, Human
gaaaagaggaaacaaagagga

SEQ ID NO: 282090 - RNA, 21 nt, Human
gaaaagaggaaacaaagagga

SEQ ID NO: 282091 - RNA, 21 nt, Human
gaaaagaggaaacaaagagga

SEQ ID NO: 282092 - RNA, 22 nt, Human
gaaggcacucugagucucuugg

SEQ ID NO: 282093 - RNA, 22 nt, Human
gaaggcacucugagucucuugg

SEQ ID NO: 282094 - RNA, 22 nt, Human
gaaggcacucugagucucuugg

SEQ ID NO: 282095 - RNA, 22 nt, Human
gaaggcacucugagucucuugg

SEQ ID NO: 282096 - RNA, 23 nt, Human
gaggaugagaaggaagacaaaga

SEQ ID NO: 282097 - RNA, 23 nt, Human
gaggaugagaaggaagacaaaga

SEQ ID NO: 282098 - RNA, 21 nt, Human
gagguagugaugaagguccac

SEQ ID NO: 282099 - RNA, 21 nt, Human
gagguagugaugaagguccac

SEQ ID NO: 282100 - RNA, 20 nt, Human
gaugagaaggaagacaaaga

SEQ ID NO: 282101 - RNA, 20 nt, Human
gaugagaaggaagacaaaga

SEQ ID NO: 282102 - RNA, 20 nt, Human
gaugagaaggaagacaaaga

SEQ ID NO: 282103 - RNA, 18 nt, Human
gauucuauaaggagugug

SEQ ID NO: 282104 - RNA, 25 nt, Human
gcagcgugaaggcagaaguucauac

SEQ ID NO: 282105 - RNA, 19 nt, Human
gcaggguuucauugucuca

SEQ ID NO: 282106 - RNA, 18 nt, Human
gccuccacugggaucuug

SEQ ID NO: 282107 - RNA, 18 nt, Human
gccuccacugggaucuug

SEQ ID NO: 282108 - RNA, 18 nt, Human
gccuccacugggaucuug

SEQ ID NO: 282109 - RNA, 18 nt, Human
gccuccacugggaucuug

SEQ ID NO: 282110 - RNA, 26 nt, Human
gcucuucagguggcuauguccugugg

SEQ ID NO: 282111 - RNA, 26 nt, Human
gcucuucagguggcuauguccugugg

SEQ ID NO: 282112 - RNA, 26 nt, Human
gcucuucagguggcuauguccugugg

SEQ ID NO: 282113 - RNA, 26 nt, Human
gcucuucagguggcuauguccugugg

SEQ ID NO: 282114 - RNA, 21 nt, Human
ggaggaagcagguguucacgg

SEQ ID NO: 282115 - RNA, 21 nt, Human
ggaguccacguuucguggaca

SEQ ID NO: 282116 - RNA, 21 nt, Human
ggcgguccuuguggacauccc

SEQ ID NO: 282117 - RNA, 22 nt, Human
ggcuucuuggucagccaggccu

SEQ ID NO: 282118 - RNA, 22 nt, Human
ggcuucuuggucagccaggccu

SEQ ID NO: 282119 - RNA, 22 nt, Human
ggcuucuuggucagccaggccu

SEQ ID NO: 282120 - RNA, 22 nt, Human
ggcuucuuggucagccaggccu

SEQ ID NO: 282121 - RNA, 22 nt, Human
gggaggaagcagguguucacgg

SEQ ID NO: 282122 - RNA, 18 nt, Human
gggauggagaaggcacuc

SEQ ID NO: 282123 - RNA, 18 nt, Human
gggauggagaaggcacuc

SEQ ID NO: 282124 - RNA, 18 nt, Human
gggauggagaaggcacuc

SEQ ID NO: 282125 - RNA, 22 nt, Human
gggccugcccgagggaggaagc

SEQ ID NO: 282126 - RNA, 18 nt, Human
guaaaguuuuccuugcag

SEQ ID NO: 282127 - RNA, 18 nt, Human
gucuggagcauagugaag

SEQ ID NO: 282128 - RNA, 18 nt, Human
gucuggagcauagugaag

SEQ ID NO: 282129 - RNA, 18 nt, Human
gucuggagcauagugaag

SEQ ID NO: 282130 - RNA, 18 nt, Human
gucuggagcauagugaag

SEQ ID NO: 282131 - RNA, 22 nt, Human
guucauaaugacaguuccucuu

SEQ ID NO: 282132 - RNA, 19 nt, Human
uaacucucggccguccagg

SEQ ID NO: 282133 - RNA, 27 nt, Human
uacuuuuguuguugcugucucucagac

SEQ ID NO: 282134 - RNA, 18 nt, Human
uagaguggucuuaggcug

SEQ ID NO: 282135 - RNA, 18 nt, Human
uagaguggucuuaggcug

SEQ ID NO: 282136 - RNA, 18 nt, Human
uagaguggucuuaggcug

SEQ ID NO: 282137 - RNA, 18 nt, Human
uagaguggucuuaggcug

SEQ ID NO: 282138 - RNA, 25 nt, Human
uagcuuccuguugcauuggauucua

SEQ ID NO: 282139 - RNA, 23 nt, Human
uaggcuggugaaaagaggaaaca

SEQ ID NO: 282140 - RNA, 23 nt, Human
uaggcuggugaaaagaggaaaca

SEQ ID NO: 282141 - RNA, 23 nt, Human
uaggcuggugaaaagaggaaaca

SEQ ID NO: 282142 - RNA, 23 nt, Human
uaggcuggugaaaagaggaaaca

SEQ ID NO: 282143 - RNA, 24 nt, Human
uaggggauuugcuugaaggccucc

SEQ ID NO: 282144 - RNA, 24 nt, Human
uaggggauuugcuugaaggccucc

SEQ ID NO: 282145 - RNA, 24 nt, Human
uaggggauuugcuugaaggccucc

SEQ ID NO: 282146 - RNA, 24 nt, Human
uaggggauuugcuugaaggccucc

SEQ ID NO: 282147 - RNA, 24 nt, Human
uaugucauuucacuagcuuccugu

SEQ ID NO: 282148 - RNA, 20 nt, Human
ucagagcugucaaugucaac

SEQ ID NO: 282149 - RNA, 18 nt, Human
uccacaugaaggcaagau

SEQ ID NO: 282150 - RNA, 18 nt, Human
uccacucuggcucucugg

SEQ ID NO: 282151 - RNA, 21 nt, Human
uccacugggaucuugcccuca

SEQ ID NO: 282152 - RNA, 21 nt, Human
uccacugggaucuugcccuca

SEQ ID NO: 282153 - RNA, 21 nt, Human
uccacugggaucuugcccuca

SEQ ID NO: 282154 - RNA, 21 nt, Human
uccacugggaucuugcccuca

SEQ ID NO: 282155 - RNA, 25 nt, Human
uccacugggaucuugcccucagucu

SEQ ID NO: 282156 - RNA, 25 nt, Human
uccacugggaucuugcccucagucu

SEQ ID NO: 282157 - RNA, 25 nt, Human
uccacugggaucuugcccucagucu

SEQ ID NO: 282158 - RNA, 25 nt, Human
uccacugggaucuugcccucagucu

SEQ ID NO: 282159 - RNA, 20 nt, Human
uccuaggagagggagggcuc

SEQ ID NO: 282160 - RNA, 20 nt, Human
uccuaggagagggagggcuc

SEQ ID NO: 282161 - RNA, 20 nt, Human
uccuaggagagggagggcuc

SEQ ID NO: 282162 - RNA, 20 nt, Human
uccuaggagagggagggcuc

SEQ ID NO: 282163 - RNA, 23 nt, Human
uccuugaaguacuugcacaaguu

SEQ ID NO: 282164 - RNA, 26 nt, Human
ucuccuggcagcgugaaggcagaagu

SEQ ID NO: 282165 - RNA, 23 nt, Human
ucucuggagguuuucuauuucuc

SEQ ID NO: 282166 - RNA, 24 nt, Human
ucucuugggggcuggcaucccuca

SEQ ID NO: 282167 - RNA, 24 nt, Human
ucucuugggggcuggcaucccuca

SEQ ID NO: 282168 - RNA, 24 nt, Human
ucucuugggggcuggcaucccuca

SEQ ID NO: 282169 - RNA, 24 nt, Human
ucucuugggggcuggcaucccuca

SEQ ID NO: 282170 - RNA, 22 nt, Human
ugaaaagaggaaacaaagagga

SEQ ID NO: 282171 - RNA, 22 nt, Human
ugaaaagaggaaacaaagagga

SEQ ID NO: 282172 - RNA, 22 nt, Human
ugaaaagaggaaacaaagagga

SEQ ID NO: 282173 - RNA, 22 nt, Human
ugaaaagaggaaacaaagagga

SEQ ID NO: 282174 - RNA, 23 nt, Human
ugaaaagaggaaacaaagaggau

SEQ ID NO: 282175 - RNA, 23 nt, Human
ugaaaagaggaaacaaagaggau

SEQ ID NO: 282176 - RNA, 23 nt, Human
ugaaaagaggaaacaaagaggau

SEQ ID NO: 282177 - RNA, 23 nt, Human
ugaaaagaggaaacaaagaggau

SEQ ID NO: 282178 - RNA, 19 nt, Human
ugaagguccacaugaaggc

SEQ ID NO: 282179 - RNA, 19 nt, Human
ugaagguccacaugaaggc

SEQ ID NO: 282180 - RNA, 19 nt, Human
ugaagguccacaugaaggc

SEQ ID NO: 282181 - RNA, 22 nt, Human
ugacucccaccuuucuuccuuc

SEQ ID NO: 282182 - RNA, 19 nt, Human
ugagaccauccuuccacuc

SEQ ID NO: 282183 - RNA, 20 nt, Human
ugaguggggcaaauacacag

SEQ ID NO: 282184 - RNA, 20 nt, Human
ugaguggggcaaauacacag

SEQ ID NO: 282185 - RNA, 20 nt, Human
ugaguggggcaaauacacag

SEQ ID NO: 282186 - RNA, 18 nt, Human
ugcccaacucccacgccg

SEQ ID NO: 282187 - RNA, 25 nt, Human
uggacaucccucaucuccaugcuuc

SEQ ID NO: 282188 - RNA, 23 nt, Human
uggagaaggcacucugagucucu

SEQ ID NO: 282189 - RNA, 23 nt, Human
uggagaaggcacucugagucucu

SEQ ID NO: 282190 - RNA, 23 nt, Human
uggagaaggcacucugagucucu

SEQ ID NO: 282191 - RNA, 23 nt, Human
uggagaaggcacucugagucucu

SEQ ID NO: 282192 - RNA, 19 nt, Human
uggcacuuacauaggcaga

SEQ ID NO: 282193 - RNA, 22 nt, Human
uggcgguccuuguggacauccc

SEQ ID NO: 282194 - RNA, 20 nt, Human
uggcucucugggccugccuc

SEQ ID NO: 282195 - RNA, 19 nt, Human
ugggauggagaaggcacuc

SEQ ID NO: 282196 - RNA, 19 nt, Human
ugggauggagaaggcacuc

SEQ ID NO: 282197 - RNA, 21 nt, Human
ugggcagagaaagccugcacc

SEQ ID NO: 282198 - RNA, 21 nt, Human
ugggcagagaaagccugcacc

SEQ ID NO: 282199 - RNA, 21 nt, Human
ugggcagagaaagccugcacc

SEQ ID NO: 282200 - RNA, 21 nt, Human
ugggcagagaaagccugcacc

SEQ ID NO: 282201 - RNA, 21 nt, Human
ugguagaguauacuuuuguug

SEQ ID NO: 282202 - RNA, 22 nt, Human
ugucauuucacuagcuuccugu

SEQ ID NO: 282203 - RNA, 19 nt, Human
ugucuuaguuggcgguccu

SEQ ID NO: 282204 - RNA, 21 nt, Human
uuaaugguagaguauacuuuu

SEQ ID NO: 282205 - RNA, 18 nt, Human
uucaccuugcccaacucc

SEQ ID NO: 282206 - RNA, 19 nt, Human
uucagagacaacaaacacc

SEQ ID NO: 282207 - RNA, 20 nt, Human
uucagagacaacaaacacca

SEQ ID NO: 282208 - RNA, 21 nt, Human
uucagagacaacaaacaccac

SEQ ID NO: 282209 - RNA, 24 nt, Human
uuccaucauucuccuggcagcgug

SEQ ID NO: 282210 - RNA, 27 nt, Human
uugcccaacucccacgccgacuccagc

SEQ ID NO: 282211 - RNA, 22 nt, Human
uugugugcuuuagcagcuuccu

SEQ ID NO: 282212 - RNA, 24 nt, Human
uuuugugugcuuuagcagcuuccu

SEQ ID NO: 282213 - RNA, 22 nt, Human
aacuuguguuccucacauccuu

SEQ ID NO: 282214 - RNA, 25 nt, Human
agcaaagagaccucugccaccccca

SEQ ID NO: 282215 - RNA, 19 nt, Human
caacaaaaaagaguucaac

SEQ ID NO: 282216 - RNA, 19 nt, Human
caacaacagaaaugaacuu

SEQ ID NO: 282217 - RNA, 20 nt, Human
caccggggccccagagccgg

SEQ ID NO: 282218 - RNA, 20 nt, Human
cacgcagacgcgagcgcccc

SEQ ID NO: 282219 - RNA, 21 nt, Human
ccacgcagacgcgagcgcccc

SEQ ID NO: 282220 - RNA, 23 nt, Human
cccacggucgggacgccccccgc

SEQ ID NO: 282221 - RNA, 21 nt, Human
ccccagagccgggggacuuuc

SEQ ID NO: 282222 - RNA, 24 nt, Human
cccccgcgugggacgcaguuccac

SEQ ID NO: 282223 - RNA, 22 nt, Human
ccccggcgccgcccucucccgc

SEQ ID NO: 282224 - RNA, 19 nt, Human
ccucugguaggggcacggg

SEQ ID NO: 282225 - RNA, 20 nt, Human
ccuuucucuccuccuccucc

SEQ ID NO: 282226 - RNA, 19 nt, Human
cgagcgccccggcgccgcc

SEQ ID NO: 282227 - RNA, 21 nt, Human
cgccccggcgccgcccucucc

SEQ ID NO: 282228 - RNA, 19 nt, Human
cucugccuuggggaaccag

SEQ ID NO: 282229 - RNA, 21 nt, Human
cuucuuggaggcuuacucugg

SEQ ID NO: 282230 - RNA, 18 nt, Human
gacguccagggucagcgc

SEQ ID NO: 282231 - RNA, 19 nt, Human
gagaccucugccaccccca

SEQ ID NO: 282232 - RNA, 20 nt, Human
gcaaguagaaaaauagaaaa

SEQ ID NO: 282233 - RNA, 24 nt, Human
ggaaagggacuccuagaacuugag

SEQ ID NO: 282234 - RNA, 19 nt, Human
gggccggccgcggagguca

SEQ ID NO: 282235 - RNA, 22 nt, Human
uccacgcagacgcgagcgcccc

SEQ ID NO: 282236 - RNA, 20 nt, Human
uccacugaggggccggccgc

SEQ ID NO: 282237 - RNA, 22 nt, Human
ucuccgcaacaacagaaaugaa

SEQ ID NO: 282238 - RNA, 25 nt, Human
ucuccgcaacaacagaaaugaacuu

SEQ ID NO: 282239 - RNA, 18 nt, Human
ucuccuccuccuccuucu

SEQ ID NO: 282240 - RNA, 20 nt, Human
ucucuacagagcuagggcuu

SEQ ID NO: 282241 - RNA, 21 nt, Human
ugaaaaggaaacuaugacaaa

SEQ ID NO: 282242 - RNA, 22 nt, Human
ugaagcaaagagaccucugcca

SEQ ID NO: 282243 - RNA, 18 nt, Human
ugucagaauuuccagaau

SEQ ID NO: 282244 - RNA, 20 nt, Human
uugucagaauuuccagaauc

SEQ ID NO: 282245 - RNA, 20 nt, Human
uuuuuuuuuuuuuaagaagc

SEQ ID NO: 282246 - RNA, 19 nt, Human
uuuuuuuuuuuuuuuuuaa

SEQ ID NO: 282247 - RNA, 26 nt, Human
aaaccgguuuaaccuuuuuuuuuuuu

SEQ ID NO: 282248 - RNA, 23 nt, Human
aaacgguuccuuccacccuccac

SEQ ID NO: 282249 - RNA, 19 nt, Human
aauccauaccauccucccc

SEQ ID NO: 282250 - RNA, 21 nt, Human
accacaaacacacucaagccc

SEQ ID NO: 282251 - RNA, 21 nt, Human
acccagugcccaggagggccc

SEQ ID NO: 282252 - RNA, 25 nt, Human
acccagugcccaggagggccccaug

SEQ ID NO: 282253 - RNA, 22 nt, Human
accccaggaaccaccgccaccc

SEQ ID NO: 282254 - RNA, 23 nt, Human
accucugcccuccauuccggcuc

SEQ ID NO: 282255 - RNA, 27 nt, Human
acucugaaaaguccagcaguagagaaa

SEQ ID NO: 282256 - RNA, 22 nt, Human
acuucuuccugaaugcccugcc

SEQ ID NO: 282257 - RNA, 24 nt, Human
agaaaaucagaagcuccccacaaa

SEQ ID NO: 282258 - RNA, 19 nt, Human
agaacccucccaugccucc

SEQ ID NO: 282259 - RNA, 23 nt, Human
agaacccucccaugccuccacac

SEQ ID NO: 282260 - RNA, 24 nt, Human
agaacccucccaugccuccacacu

SEQ ID NO: 282261 - RNA, 19 nt, Human
agaggaaaccccugcagag

SEQ ID NO: 282262 - RNA, 24 nt, Human
agaugaggggaaggggaggggagg

SEQ ID NO: 282263 - RNA, 24 nt, Human
aggaggaggaggauugugguagaa

SEQ ID NO: 282264 - RNA, 19 nt, Human
aggcaaacgguuccuucca

SEQ ID NO: 282265 - RNA, 21 nt, Human
aggccccuggagaggaggagg

SEQ ID NO: 282266 - RNA, 28 nt, Human
aggggaaggggaggggaggggaagggau

SEQ ID NO: 282267 - RNA, 19 nt, Human
auuaggaaacccuuuguca

SEQ ID NO: 282268 - RNA, 22 nt, Human
caaggaaauggauggagaggaa

SEQ ID NO: 282269 - RNA, 20 nt, Human
cacacccccugcugccccuu

SEQ ID NO: 282270 - RNA, 23 nt, Human
cacccgagggcccacguucauuc

SEQ ID NO: 282271 - RNA, 20 nt, Human
cacccuuugucuuaaaucuc

SEQ ID NO: 282272 - RNA, 18 nt, Human
cagcaacucagauggcau

SEQ ID NO: 282273 - RNA, 24 nt, Human
cagcaaggaaauggauggagagga

SEQ ID NO: 282274 - RNA, 21 nt, Human
caggaaccaccgccacccuuu

SEQ ID NO: 282275 - RNA, 20 nt, Human
caucucagaccccaggaacc

SEQ ID NO: 282276 - RNA, 22 nt, Human
caucucuggaggcaaacgguuc

SEQ ID NO: 282277 - RNA, 20 nt, Human
caugagaacccucccaugcc

SEQ ID NO: 282278 - RNA, 24 nt, Human
cauuccggcuccucuccccuuacc

SEQ ID NO: 282279 - RNA, 21 nt, Human
ccauccucccccucgaguggc

SEQ ID NO: 282280 - RNA, 20 nt, Human
cccauccaucucccaaguca

SEQ ID NO: 282281 - RNA, 19 nt, Human
ccccaggaaccaccgccac

SEQ ID NO: 282282 - RNA, 26 nt, Human
ccccaggaaccaccgccacccuuugu

SEQ ID NO: 282283 - RNA, 18 nt, Human
cccccugcugccccuuuu

SEQ ID NO: 282284 - RNA, 20 nt, Human
ccccuccacucccucagccc

SEQ ID NO: 282285 - RNA, 21 nt, Human
ccccugcugccccuuuuuucc

SEQ ID NO: 282286 - RNA, 25 nt, Human
cccucagcccauccaucucccaagu

SEQ ID NO: 282287 - RNA, 24 nt, Human
cccuccacucccucagcccaucca

SEQ ID NO: 282288 - RNA, 20 nt, Human
cccugccuuucuuucuuccu

SEQ ID NO: 282289 - RNA, 21 nt, Human
ccuaaaguuccuuuguggcua

SEQ ID NO: 282290 - RNA, 22 nt, Human
ccucugaggucccccuccacuc

SEQ ID NO: 282291 - RNA, 25 nt, Human
ccuuaccacaaacacacucaagccc

SEQ ID NO: 282292 - RNA, 19 nt, Human
ccuuucuuucuuccucaca

SEQ ID NO: 282293 - RNA, 18 nt, Human
cuagaagcuuccgauucc

SEQ ID NO: 282294 - RNA, 24 nt, Human
cucacauuccuuccuucuuaauga

SEQ ID NO: 282295 - RNA, 22 nt, Human
cucccugguccugcuccucuga

SEQ ID NO: 282296 - RNA, 18 nt, Human
cucccuucucucacgucc

SEQ ID NO: 282297 - RNA, 28 nt, Human
cuuccgauuccuagucuucccaccuuac

SEQ ID NO: 282298 - RNA, 23 nt, Human
cuuugucuuaaaucucucuccca

SEQ ID NO: 282299 - RNA, 21 nt, Human
gaaaccaguaacaacagaaaa

SEQ ID NO: 282300 - RNA, 23 nt, Human
gaacccucccaugccuccacacu

SEQ ID NO: 282301 - RNA, 22 nt, Human
gacaguuuggaucuauuaggaa

SEQ ID NO: 282302 - RNA, 21 nt, Human
gagaacccucccaugccucca

SEQ ID NO: 282303 - RNA, 19 nt, Human
gaggaggaggauuguggua

SEQ ID NO: 282304 - RNA, 20 nt, Human
gccaggagaaaugggacggc

SEQ ID NO: 282305 - RNA, 28 nt, Human
gcccuagaagcuuccgauuccuagucuu

SEQ ID NO: 282306 - RNA, 22 nt, Human
gcuuaggaccacccagccgugg

SEQ ID NO: 282307 - RNA, 22 nt, Human
ggaaggggaggggaggggaagg

SEQ ID NO: 282308 - RNA, 20 nt, Human
gggaggggaggggaagggau

SEQ ID NO: 282309 - RNA, 18 nt, Human
ggggaaggggaggggagg

SEQ ID NO: 282310 - RNA, 22 nt, Human
guuaagcaaacuuuccccccuc

SEQ ID NO: 282311 - RNA, 23 nt, Human
uaacaacagaaaaucagaagcuc

SEQ ID NO: 282312 - RNA, 23 nt, Human
uacagcccugacagcaacucaga

SEQ ID NO: 282313 - RNA, 23 nt, Human
uaccacaaacacacucaagccca

SEQ ID NO: 282314 - RNA, 21 nt, Human
ucagaagcuccccacaaaugg

SEQ ID NO: 282315 - RNA, 19 nt, Human
uccaauggaugcccgugug

SEQ ID NO: 282316 - RNA, 25 nt, Human
uccacaaacacacccccugcugccc

SEQ ID NO: 282317 - RNA, 20 nt, Human
ucccuggggccaucucugga

SEQ ID NO: 282318 - RNA, 18 nt, Human
ucccuguguucucccugg

SEQ ID NO: 282319 - RNA, 20 nt, Human
uccucugaggucccccucca

SEQ ID NO: 282320 - RNA, 21 nt, Human
ucucccaucucccuucucuca

SEQ ID NO: 282321 - RNA, 20 nt, Human
ucucccugguccugcuccuc

SEQ ID NO: 282322 - RNA, 23 nt, Human
ucucucuaauucaggccuugcag

SEQ ID NO: 282323 - RNA, 19 nt, Human
ucucuggaggcaaacgguu

SEQ ID NO: 282324 - RNA, 21 nt, Human
ucuuucuuccucacauuccuu

SEQ ID NO: 282325 - RNA, 21 nt, Human
ugaaagacucugaaaagucca

SEQ ID NO: 282326 - RNA, 21 nt, Human
ugaggggaaggggaggggagg

SEQ ID NO: 282327 - RNA, 20 nt, Human
ugaggggagaaaggacaggg

SEQ ID NO: 282328 - RNA, 24 nt, Human
ugcccgugugacaaaagcagaaau

SEQ ID NO: 282329 - RNA, 24 nt, Human
ugcccugccuuucuuucuuccuca

SEQ ID NO: 282330 - RNA, 21 nt, Human
uggaagaugaggggaagggga

SEQ ID NO: 282331 - RNA, 24 nt, Human
uggagaggaggaggaggauugugg

SEQ ID NO: 282332 - RNA, 25 nt, Human
uggagaggaggaggaggauuguggu

SEQ ID NO: 282333 - RNA, 21 nt, Human
uggaggcaaacgguuccuucc

SEQ ID NO: 282334 - RNA, 22 nt, Human
uggcaucacugacaacccagca

SEQ ID NO: 282335 - RNA, 25 nt, Human
uggcuuaggaccacccagccguggg

SEQ ID NO: 282336 - RNA, 18 nt, Human
ugggaccccuaccugagg

SEQ ID NO: 282337 - RNA, 19 nt, Human
ugggaccccuaccugaggg

SEQ ID NO: 282338 - RNA, 22 nt, Human
ugguccugcuccucugaggucc

SEQ ID NO: 282339 - RNA, 19 nt, Human
ugucaggcuacagcccuga

SEQ ID NO: 282340 - RNA, 19 nt, Human
uugccuggaagaugagggg

SEQ ID NO: 282341 - RNA, 22 nt, Human
uugggagauucacaaugaaugu

SEQ ID NO: 282342 - RNA, 19 nt, Human
uuucaccucugcccuccau

SEQ ID NO: 282343 - RNA, 20 nt, Human
aacaagaauuguugagucug

SEQ ID NO: 282344 - RNA, 26 nt, Human
aacccuuucuccuauccuaaaggccc

SEQ ID NO: 282345 - RNA, 20 nt, Human
aagaauuguugagucugagg

SEQ ID NO: 282346 - RNA, 23 nt, Human
aauauggggucuggacccccagc

SEQ ID NO: 282347 - RNA, 22 nt, Human
agaauuguugagucugaggaau

SEQ ID NO: 282348 - RNA, 22 nt, Human
cuggugaugagagcaagguuuu

SEQ ID NO: 282349 - RNA, 23 nt, Human
gaaaacuuccuaguggcaacuaa

SEQ ID NO: 282350 - RNA, 18 nt, Human
gaacaagaauuguugagu

SEQ ID NO: 282351 - RNA, 20 nt, Human
gaccuuacacuuacuuuaca

SEQ ID NO: 282352 - RNA, 24 nt, Human
gagagcaagguuugggggggaagc

SEQ ID NO: 282353 - RNA, 20 nt, Human
ggcaacuaaggcuagagcag

SEQ ID NO: 282354 - RNA, 24 nt, Human
ggcccuucgggaagaagcucuagc

SEQ ID NO: 282355 - RNA, 21 nt, Human
gggaagaagcucuagcuggug

SEQ ID NO: 282356 - RNA, 24 nt, Human
uaaaggcccuucgggaagaagcuc

SEQ ID NO: 282357 - RNA, 23 nt, Human
uauggggucuggacccccagcac

SEQ ID NO: 282358 - RNA, 23 nt, Human
uauuuuauuuaacuacuucccca

SEQ ID NO: 282359 - RNA, 23 nt, Human
ucacacgugugugcaugaacccu

SEQ ID NO: 282360 - RNA, 22 nt, Human
uccauucucacacgugugugca

SEQ ID NO: 282361 - RNA, 23 nt, Human
ugagaacacaguucuaaagaaca

SEQ ID NO: 282362 - RNA, 24 nt, Human
ugagaacacaguucuaaagaacaa

SEQ ID NO: 282363 - RNA, 26 nt, Human
ugagagcaagguuugggggggaaguc

SEQ ID NO: 282364 - RNA, 18 nt, Human
ugaugagagcaagguuug

SEQ ID NO: 282365 - RNA, 24 nt, Human
ugcaguguugggaaggugagaaca

SEQ ID NO: 282366 - RNA, 27 nt, Human
uggugaugagagcaagguuugggggcc

SEQ ID NO: 282367 - RNA, 20 nt, Human
aaggaacugguccagauaac

SEQ ID NO: 282368 - RNA, 20 nt, Human
aaugaaggaacugguccaga

SEQ ID NO: 282369 - RNA, 21 nt, Human
aauuccagaaacccucgauug

SEQ ID NO: 282370 - RNA, 20 nt, Human
acacuggagcccuuuccccc

SEQ ID NO: 282371 - RNA, 19 nt, Human
agguggaaugaagugaggc

SEQ ID NO: 282372 - RNA, 19 nt, Human
agucccaccugaaaaugaa

SEQ ID NO: 282373 - RNA, 21 nt, Human
cacagaagaaagucaaggcug

SEQ ID NO: 282374 - RNA, 19 nt, Human
cauuagacauuacccuccc

SEQ ID NO: 282375 - RNA, 24 nt, Human
ccagauaacacuggagcccuuucc

SEQ ID NO: 282376 - RNA, 25 nt, Human
cugguccagauaacacuggagcccu

SEQ ID NO: 282377 - RNA, 18 nt, Human
cuuggauuauacaccagc

SEQ ID NO: 282378 - RNA, 21 nt, Human
cuuuggaaagaauggucucca

SEQ ID NO: 282379 - RNA, 22 nt, Human
gggaaugaauucuggacaaggg

SEQ ID NO: 282380 - RNA, 22 nt, Human
uauuuuuauuguuauugauaau

SEQ ID NO: 282381 - RNA, 19 nt, Human
ucacugaggagcuuugucu

SEQ ID NO: 282382 - RNA, 20 nt, Human
ucacugaggagcuuugucuu

SEQ ID NO: 282383 - RNA, 24 nt, Human
ucagggaauauuuucagagaauag

SEQ ID NO: 282384 - RNA, 19 nt, Human
ucuaugauaggauagaggg

SEQ ID NO: 282385 - RNA, 20 nt, Human
ucucuguucucucucaggga

SEQ ID NO: 282386 - RNA, 24 nt, Human
ucucuuaucuaaaucucucuguuc

SEQ ID NO: 282387 - RNA, 20 nt, Human
ucuggacaagggaugugaaa

SEQ ID NO: 282388 - RNA, 18 nt, Human
ugacaggagagagagugg

SEQ ID NO: 282389 - RNA, 18 nt, Human
ugacaggagagagagugg

SEQ ID NO: 282390 - RNA, 19 nt, Human
ugacaggagagagaguggc

SEQ ID NO: 282391 - RNA, 19 nt, Human
ugacaggagagagaguggc

SEQ ID NO: 282392 - RNA, 20 nt, Human
ugacuguaaaauauggagca

SEQ ID NO: 282393 - RNA, 18 nt, Human
ugcacagaagaaagucaa

SEQ ID NO: 282394 - RNA, 18 nt, Human
uggaaagaauggucucca

SEQ ID NO: 282395 - RNA, 18 nt, Human
uggaucaagagucccacc

SEQ ID NO: 282396 - RNA, 22 nt, Human
ugugaaaauuccagaaacccuc

SEQ ID NO: 282397 - RNA, 22 nt, Human
uucucuggaucaagagucccac

SEQ ID NO: 282398 - RNA, 22 nt, Human
uucuggacaagggaugugaaaa

SEQ ID NO: 282399 - RNA, 22 nt, Human
aaacagacaggacguggaugag

SEQ ID NO: 282400 - RNA, 18 nt, Human
aaagccaaggaaaaaguc

SEQ ID NO: 282401 - RNA, 22 nt, Human
aaccacaugacauucugagcaa

SEQ ID NO: 282402 - RNA, 19 nt, Human
aaccugguggagagaacca

SEQ ID NO: 282403 - RNA, 23 nt, Human
aagaaccugguggagagaaccaa

SEQ ID NO: 282404 - RNA, 23 nt, Human
aagccaaaggcagaaagagggac

SEQ ID NO: 282405 - RNA, 20 nt, Human
aagugcaaccaccuccacag

SEQ ID NO: 282406 - RNA, 21 nt, Human
aauaauuagagcuaaccccac

SEQ ID NO: 282407 - RNA, 21 nt, Human
acacaugcugcucaacauccu

SEQ ID NO: 282408 - RNA, 18 nt, Human
acagugcaugaaucuggg

SEQ ID NO: 282409 - RNA, 23 nt, Human
accucuucccuacauucccccca

SEQ ID NO: 282410 - RNA, 19 nt, Human
acuggguggcauguacugg

SEQ ID NO: 282411 - RNA, 19 nt, Human
agaaggaaaagacaacagc

SEQ ID NO: 282412 - RNA, 24 nt, Human
agaaggcaagggaaggaggaauag

SEQ ID NO: 282413 - RNA, 21 nt, Human
agaaguccaagaaggcaaggg

SEQ ID NO: 282414 - RNA, 21 nt, Human
agcaaggcagcuuuaugaaag

SEQ ID NO: 282415 - RNA, 21 nt, Human
agccuuuggagagcuugaagu

SEQ ID NO: 282416 - RNA, 19 nt, Human
aggaaaaaggaggagcuaa

SEQ ID NO: 282417 - RNA, 24 nt, Human
aggcagaaagaucugugaacccag

SEQ ID NO: 282418 - RNA, 19 nt, Human
auagaggaugucuguguca

SEQ ID NO: 282419 - RNA, 19 nt, Human
aucacuguguucuugaccu

SEQ ID NO: 282420 - RNA, 24 nt, Human
auuugugucugaguuaauuucagg

SEQ ID NO: 282421 - RNA, 26 nt, Human
caaacaaagaacugucuagcccaaug

SEQ ID NO: 282422 - RNA, 21 nt, Human
caaagaacugucuagcccaau

SEQ ID NO: 282423 - RNA, 24 nt, Human
caaagaacugucuagcccaaugug

SEQ ID NO: 282424 - RNA, 20 nt, Human
caagaggauacuccugggug

SEQ ID NO: 282425 - RNA, 22 nt, Human
caagaggauacuccuggguggg

SEQ ID NO: 282426 - RNA, 23 nt, Human
caagggaaggaggaauagggacc

SEQ ID NO: 282427 - RNA, 25 nt, Human
cacuuuuaauugucacaacugggug

SEQ ID NO: 282428 - RNA, 20 nt, Human
cagcaggggcagaaaggguu

SEQ ID NO: 282429 - RNA, 23 nt, Human
cagccucauauaaauaugacaac

SEQ ID NO: 282430 - RNA, 23 nt, Human
caggcucagaaggaaaagacaac

SEQ ID NO: 282431 - RNA, 23 nt, Human
cagguaaccacaugacauucuga

SEQ ID NO: 282432 - RNA, 18 nt, Human
cagugcaugaaucugggg

SEQ ID NO: 282433 - RNA, 21 nt, Human
ccaaacaaagaacugucuagc

SEQ ID NO: 282434 - RNA, 19 nt, Human
ccaagaaggcaagggaagg

SEQ ID NO: 282435 - RNA, 23 nt, Human
ccaucuggaggcaccguggccgc

SEQ ID NO: 282436 - RNA, 18 nt, Human
cccagguuggguguaggg

SEQ ID NO: 282437 - RNA, 21 nt, Human
ccccacgguuggcuuggcacc

SEQ ID NO: 282438 - RNA, 20 nt, Human
ccuacagugcaugaaucugg

SEQ ID NO: 282439 - RNA, 19 nt, Human
ccuacauuccccccagguu

SEQ ID NO: 282440 - RNA, 30 nt, Human
ccuguagugcaaggguucucaccuagggcc

SEQ ID NO: 282441 - RNA, 18 nt, Human
ccuuggguggcaagugca

SEQ ID NO: 282442 - RNA, 22 nt, Human
cuaaagaggguggagccaaaag

SEQ ID NO: 282443 - RNA, 25 nt, Human
cuccacagucaucuuuguagccacc

SEQ ID NO: 282444 - RNA, 20 nt, Human
cugaccagcuguuuaagcuc

SEQ ID NO: 282445 - RNA, 20 nt, Human
cuuugcuuugaagacacaga

SEQ ID NO: 282446 - RNA, 21 nt, Human
gaaacagacaggacguggaug

SEQ ID NO: 282447 - RNA, 20 nt, Human
gaaccugguggagagaacca

SEQ ID NO: 282448 - RNA, 25 nt, Human
gagccaaaagccaaaggcagaaaga

SEQ ID NO: 282449 - RNA, 22 nt, Human
gagccuccaaacaaagaacugu

SEQ ID NO: 282450 - RNA, 20 nt, Human
gcaaggguucucaccuaggg

SEQ ID NO: 282451 - RNA, 21 nt, Human
gcugaccagcuguuuaagcuc

SEQ ID NO: 282452 - RNA, 18 nt, Human
gcugcgcccagcccuaca

SEQ ID NO: 282453 - RNA, 25 nt, Human
ggaauagggaccaucaagggaagaa

SEQ ID NO: 282454 - RNA, 23 nt, Human
ggacguggaugaguuggaagcac

SEQ ID NO: 282455 - RNA, 19 nt, Human
ggagggcuuggagaggugu

SEQ ID NO: 282456 - RNA, 21 nt, Human
ggcaagugcaaccaccuccac

SEQ ID NO: 282457 - RNA, 21 nt, Human
gggaaggaggaauagggacca

SEQ ID NO: 282458 - RNA, 26 nt, Human
ggggauaaaggcaggcucagaaggaa

SEQ ID NO: 282459 - RNA, 24 nt, Human
gguggagagaaccaaguauaucug

SEQ ID NO: 282460 - RNA, 21 nt, Human
gguguggcagacauccuuggg

SEQ ID NO: 282461 - RNA, 22 nt, Human
gucucaagacacuuuuaauugu

SEQ ID NO: 282462 - RNA, 21 nt, Human
guggagccaaaagccaaaggc

SEQ ID NO: 282463 - RNA, 22 nt, Human
guggcagacauccuuggguggc

SEQ ID NO: 282464 - RNA, 19 nt, Human
uaaaggcaggcucagaagg

SEQ ID NO: 282465 - RNA, 21 nt, Human
uaaccacaugacauucugagc

SEQ ID NO: 282466 - RNA, 23 nt, Human
uaaccccacgguuggcuuggcac

SEQ ID NO: 282467 - RNA, 20 nt, Human
uaagcuccugugagcugggu

SEQ ID NO: 282468 - RNA, 20 nt, Human
uacaagaaaaaaaaauacaa

SEQ ID NO: 282469 - RNA, 18 nt, Human
uauacagaggaaacagac

SEQ ID NO: 282470 - RNA, 24 nt, Human
uaucuuuaaggcuaaagccaagga

SEQ ID NO: 282471 - RNA, 20 nt, Human
ucaacauccuacaugcacaa

SEQ ID NO: 282472 - RNA, 19 nt, Human
ucacagaguuaugagaacc

SEQ ID NO: 282473 - RNA, 19 nt, Human
ucagaaggaaaagacaaca

SEQ ID NO: 282474 - RNA, 19 nt, Human
ucagcaggggcagaaaggg

SEQ ID NO: 282475 - RNA, 24 nt, Human
ucagguugcuacaguaggagaagu

SEQ ID NO: 282476 - RNA, 20 nt, Human
uccuggguggggggauaaag

SEQ ID NO: 282477 - RNA, 20 nt, Human
uccugugagcuggguuuccu

SEQ ID NO: 282478 - RNA, 23 nt, Human
ugaaauggaagaaaauuugcgga

SEQ ID NO: 282479 - RNA, 20 nt, Human
ugacagaaauaagaugcaca

SEQ ID NO: 282480 - RNA, 24 nt, Human
ugacagaaauaagaugcacauaaa

SEQ ID NO: 282481 - RNA, 24 nt, Human
ugagaaccaaggggaaaguaaaga

SEQ ID NO: 282482 - RNA, 22 nt, Human
ugaguuggaagcaccgagagca

SEQ ID NO: 282483 - RNA, 23 nt, Human
ugcacaagagagccuccaaacaa

SEQ ID NO: 282484 - RNA, 22 nt, Human
ugccaucuggaggcaccguggc

SEQ ID NO: 282485 - RNA, 24 nt, Human
uggagagguguggcagacauccuu

SEQ ID NO: 282486 - RNA, 19 nt, Human
uggcaagugcaaccaccuc

SEQ ID NO: 282487 - RNA, 19 nt, Human
uggcagacauccuugggug

SEQ ID NO: 282488 - RNA, 18 nt, Human
uggguggggggauaaagg

SEQ ID NO: 282489 - RNA, 21 nt, Human
uggguggggggauaaaggcaa

SEQ ID NO: 282490 - RNA, 22 nt, Human
ugguagguaggagggcuuggag

SEQ ID NO: 282491 - RNA, 25 nt, Human
ugguagguaggagggcuuggagagg

SEQ ID NO: 282492 - RNA, 22 nt, Human
uguaucacaacugguauaugca

SEQ ID NO: 282493 - RNA, 29 nt, Human
uguucuugaccuuuggguaucccguuggg

SEQ ID NO: 282494 - RNA, 24 nt, Human
uuaaggcuaaagccaaggaaaaag

SEQ ID NO: 282495 - RNA, 21 nt, Human
uucaagaaguccaagaaggca

SEQ ID NO: 282496 - RNA, 20 nt, Human
uuccuucuuccugcuuggau

SEQ ID NO: 282497 - RNA, 19 nt, Human
uugaaguucuaaugaaagg

SEQ ID NO: 282498 - RNA, 24 nt, Human
uuggguaucuuuuccuucuuccug

SEQ ID NO: 282499 - RNA, 19 nt, Human
uuucaagaaguccaagaag

SEQ ID NO: 282500 - RNA, 24 nt, Human
uuuguagccaccuucaaguuacag

SEQ ID NO: 282501 - RNA, 22 nt, Human
uuuuaagcagggcuccugcaga

SEQ ID NO: 282502 - RNA, 18 nt, Human
aaagagccaccuaacugc

SEQ ID NO: 282503 - RNA, 20 nt, Human
aacccucuuuuaccaccaag

SEQ ID NO: 282504 - RNA, 23 nt, Human
aagaaaaggaggccucucaugaa

SEQ ID NO: 282505 - RNA, 19 nt, Human
aagccaugggaggcagggg

SEQ ID NO: 282506 - RNA, 21 nt, Human
aagccaugggaggcaggggag

SEQ ID NO: 282507 - RNA, 19 nt, Human
aagcccccaaaaguuacag

SEQ ID NO: 282508 - RNA, 18 nt, Human
aaggaggcccucuggcuc

SEQ ID NO: 282509 - RNA, 23 nt, Human
aaggcucuucccaucccauucaa

SEQ ID NO: 282510 - RNA, 19 nt, Human
aaggugcccuuagcguugg

SEQ ID NO: 282511 - RNA, 18 nt, Human
aaguuuuaacagugguuu

SEQ ID NO: 282512 - RNA, 30 nt, Human
aauuaaacacacacacacacacacacacag

SEQ ID NO: 282513 - RNA, 18 nt, Human
acacaaucucucucaucu

SEQ ID NO: 282514 - RNA, 23 nt, Human
acacacacacacacacacacaca

SEQ ID NO: 282515 - RNA, 23 nt, Human
acacacacacacacacacacaca

SEQ ID NO: 282516 - RNA, 23 nt, Human
acacacacacacacacacacaca

SEQ ID NO: 282517 - RNA, 23 nt, Human
acacacacacacacacacacaca

SEQ ID NO: 282518 - RNA, 23 nt, Human
acacacacacacacacacacaca

SEQ ID NO: 282519 - RNA, 22 nt, Human
acacacacacacacacacacag

SEQ ID NO: 282520 - RNA, 25 nt, Human
acacacaugcacacaugugcucaca

SEQ ID NO: 282521 - RNA, 27 nt, Human
acacacaugcacacgugugcacacaca

SEQ ID NO: 282522 - RNA, 25 nt, Human
acacaugcacacaugugcucacaca

SEQ ID NO: 282523 - RNA, 21 nt, Human
acacaugcacacgugugcaca

SEQ ID NO: 282524 - RNA, 21 nt, Human
accacuuuccucuacugcauc

SEQ ID NO: 282525 - RNA, 20 nt, Human
acuggcuugugaugcccagg

SEQ ID NO: 282526 - RNA, 22 nt, Human
agaaaugcaacccucuuuuacc

SEQ ID NO: 282527 - RNA, 20 nt, Human
agacaaaguaagccaauaug

SEQ ID NO: 282528 - RNA, 21 nt, Human
agaggagucagggaggagggg

SEQ ID NO: 282529 - RNA, 18 nt, Human
agagggcagagagaaaca

SEQ ID NO: 282530 - RNA, 26 nt, Human
aggagaggccaaugggaggaagggau

SEQ ID NO: 282531 - RNA, 24 nt, Human
aggcaggggagugugugagcuggg

SEQ ID NO: 282532 - RNA, 25 nt, Human
aggcugagccaaagacggcagagaa

SEQ ID NO: 282533 - RNA, 18 nt, Human
agucagggaggagggggc

SEQ ID NO: 282534 - RNA, 21 nt, Human
auaauuacucuaauucuggag

SEQ ID NO: 282535 - RNA, 19 nt, Human
auaguccagugguggccuc

SEQ ID NO: 282536 - RNA, 21 nt, Human
aucauggcacuuguaccacca

SEQ ID NO: 282537 - RNA, 19 nt, Human
augagcaagcccuccucuc

SEQ ID NO: 282538 - RNA, 22 nt, Human
augucucagacuccucugcagc

SEQ ID NO: 282539 - RNA, 31 nt, Human
auuaaacacacacacacacacacacacacag

SEQ ID NO: 282540 - RNA, 20 nt, Human
caaaguaagccaauaugggc

SEQ ID NO: 282541 - RNA, 19 nt, Human
caacucccucugucugugu

SEQ ID NO: 282542 - RNA, 18 nt, Human
caaggagaggccaauggg

SEQ ID NO: 282543 - RNA, 20 nt, Human
cacacacacacacacacaca

SEQ ID NO: 282544 - RNA, 20 nt, Human
cacacacacacacacacaca

SEQ ID NO: 282545 - RNA, 20 nt, Human
cacacacacacacacacaca

SEQ ID NO: 282546 - RNA, 20 nt, Human
cacacacacacacacacaca

SEQ ID NO: 282547 - RNA, 20 nt, Human
cacacacacacacacacaca

SEQ ID NO: 282548 - RNA, 20 nt, Human
cacacacacacacacacaca

SEQ ID NO: 282549 - RNA, 22 nt, Human
cacacacacacacacacacaca

SEQ ID NO: 282550 - RNA, 26 nt, Human
cacacacacacacacacacacacaca

SEQ ID NO: 282551 - RNA, 27 nt, Human
cacacacacacacacacacacacacca

SEQ ID NO: 282552 - RNA, 24 nt, Human
cacacacaugcacacaugugcuca

SEQ ID NO: 282553 - RNA, 25 nt, Human
cacacacaugcacacgugugcacac

SEQ ID NO: 282554 - RNA, 21 nt, Human
cacagcaucaagauguguaaa

SEQ ID NO: 282555 - RNA, 20 nt, Human
cacaugugcucacacacaca

SEQ ID NO: 282556 - RNA, 20 nt, Human
caccaagaugggggacaggg

SEQ ID NO: 282557 - RNA, 19 nt, Human
caccaggguggccauugcc

SEQ ID NO: 282558 - RNA, 19 nt, Human
caccuggucuucccaggag

SEQ ID NO: 282559 - RNA, 23 nt, Human
cagagagaaacaggcugagcacg

SEQ ID NO: 282560 - RNA, 18 nt, Human
cagagaggagucagggag

SEQ ID NO: 282561 - RNA, 21 nt, Human
cagcagccagggccaauccaa

SEQ ID NO: 282562 - RNA, 22 nt, Human
cagcaggaggaaagaugugagc

SEQ ID NO: 282563 - RNA, 20 nt, Human
cagcauaaaaggugaagaaa

SEQ ID NO: 282564 - RNA, 21 nt, Human
caguagcaguggcugcucucu

SEQ ID NO: 282565 - RNA, 24 nt, Human
cauuaagccuaucaaucaacucag

SEQ ID NO: 282566 - RNA, 20 nt, Human
cccacauauacacuguaaac

SEQ ID NO: 282567 - RNA, 25 nt, Human
ccccaaaaguuacaguggggccucg

SEQ ID NO: 282568 - RNA, 18 nt, Human
cccgcagcucuggcagcu

SEQ ID NO: 282569 - RNA, 19 nt, Human
ccucugccuucugcuccuc

SEQ ID NO: 282570 - RNA, 23 nt, Human
ccucuggcucucucacuuagcuu

SEQ ID NO: 282571 - RNA, 22 nt, Human
ccucugucccuucaccuacucu

SEQ ID NO: 282572 - RNA, 24 nt, Human
ccucuuuuaccaccaaggaggccc

SEQ ID NO: 282573 - RNA, 21 nt, Human
ccuggugggccuugcucuaga

SEQ ID NO: 282574 - RNA, 20 nt, Human
cgcccggcgcaggugcaagg

SEQ ID NO: 282575 - RNA, 31 nt, Human
cuaaaacacacacaugcacacgugugcacag

SEQ ID NO: 282576 - RNA, 25 nt, Human
cucagcauguuaggagagaaaacag

SEQ ID NO: 282577 - RNA, 18 nt, Human
cucucugcccuacccaga

SEQ ID NO: 282578 - RNA, 19 nt, Human
cucugguucccaccaucuc

SEQ ID NO: 282579 - RNA, 22 nt, Human
cucuucauccaguaggaccgcu

SEQ ID NO: 282580 - RNA, 19 nt, Human
cucuucccaucccauucaa

SEQ ID NO: 282581 - RNA, 21 nt, Human
cugcagccagaggucuggcug

SEQ ID NO: 282582 - RNA, 21 nt, Human
cugccuucugcuccuccagcc

SEQ ID NO: 282583 - RNA, 19 nt, Human
cuggcccugagcucuugga

SEQ ID NO: 282584 - RNA, 18 nt, Human
cuguaaaccugcaagcac

SEQ ID NO: 282585 - RNA, 20 nt, Human
cuucacuuucucugccuucu

SEQ ID NO: 282586 - RNA, 20 nt, Human
cuuggcacccauucaaucau

SEQ ID NO: 282587 - RNA, 24 nt, Human
cuuggcagagcaggucucugcugc

SEQ ID NO: 282588 - RNA, 24 nt, Human
cuugugaugcccaggccagggcca

SEQ ID NO: 282589 - RNA, 18 nt, Human
gacccacucccucaucca

SEQ ID NO: 282590 - RNA, 24 nt, Human
gagaagcugcaaacgcaggcuggu

SEQ ID NO: 282591 - RNA, 20 nt, Human
gagaagggauguucaguggc

SEQ ID NO: 282592 - RNA, 20 nt, Human
gagaggagucagggaggagg

SEQ ID NO: 282593 - RNA, 18 nt, Human
gaggaagggauggauugc

SEQ ID NO: 282594 - RNA, 26 nt, Human
gauccuaguguguaagccaugggagg

SEQ ID NO: 282595 - RNA, 23 nt, Human
gcaacagauggccaggaugcauc

SEQ ID NO: 282596 - RNA, 19 nt, Human
gcaagcccuccucucugcc

SEQ ID NO: 282597 - RNA, 18 nt, Human
gcaaggagaggccaaugg

SEQ ID NO: 282598 - RNA, 28 nt, Human
gcacacacaugcacacaugugcucacac

SEQ ID NO: 282599 - RNA, 18 nt, Human
gcagcaggaggaaagaug

SEQ ID NO: 282600 - RNA, 21 nt, Human
gcaggggagugugugagcugg

SEQ ID NO: 282601 - RNA, 22 nt, Human
gccaugggaggcaggggagugu

SEQ ID NO: 282602 - RNA, 19 nt, Human
gccauucuuuaaaacccuu

SEQ ID NO: 282603 - RNA, 21 nt, Human
gccuucugcuccuccagccuu

SEQ ID NO: 282604 - RNA, 24 nt, Human
gcuaagaaagggaggugggauccg

SEQ ID NO: 282605 - RNA, 20 nt, Human
gcuuccuuucuuuguuuccu

SEQ ID NO: 282606 - RNA, 23 nt, Human
ggaggcaggggagugugugagcu

SEQ ID NO: 282607 - RNA, 20 nt, Human
ggcugguguccaucuucucu

SEQ ID NO: 282608 - RNA, 23 nt, Human
gggggcauucucagcuggguggg

SEQ ID NO: 282609 - RNA, 23 nt, Human
ggucuucccaggagcaucacugg

SEQ ID NO: 282610 - RNA, 23 nt, Human
gucaagucuuuccauccgagggu

SEQ ID NO: 282611 - RNA, 20 nt, Human
gugagcuaauuugcaugggc

SEQ ID NO: 282612 - RNA, 18 nt, Human
gugagcugggagagcaga

SEQ ID NO: 282613 - RNA, 18 nt, Human
guguaaacuaggggagga

SEQ ID NO: 282614 - RNA, 20 nt, Human
guguguggcagcagccaggg

SEQ ID NO: 282615 - RNA, 18 nt, Human
guugcucaccucucucca

SEQ ID NO: 282616 - RNA, 18 nt, Human
uaaaaggugaagaaaagg

SEQ ID NO: 282617 - RNA, 23 nt, Human
uaaacuaggggaggagugcagca

SEQ ID NO: 282618 - RNA, 18 nt, Human
uaacagugguuuguggag

SEQ ID NO: 282619 - RNA, 22 nt, Human
uacacuguaaaccugcaagcac

SEQ ID NO: 282620 - RNA, 18 nt, Human
uacccaacugcgaccugc

SEQ ID NO: 282621 - RNA, 22 nt, Human
uacuuuuuuccccagagucuug

SEQ ID NO: 282622 - RNA, 27 nt, Human
uagagugcuuucuguuuucugggcuga

SEQ ID NO: 282623 - RNA, 22 nt, Human
uagcaugcaugucccaacuccc

SEQ ID NO: 282624 - RNA, 22 nt, Human
uaggggacccugaauuuccuca

SEQ ID NO: 282625 - RNA, 23 nt, Human
uauggcacagguauuagaagccc

SEQ ID NO: 282626 - RNA, 23 nt, Human
ucaccucucuccaagaaugacaa

SEQ ID NO: 282627 - RNA, 26 nt, Human
ucaguggcuuccuuucuuuguuuccu

SEQ ID NO: 282628 - RNA, 24 nt, Human
uccaagagguggaguuuggggucc

SEQ ID NO: 282629 - RNA, 22 nt, Human
uccccagagucuuggaaagagc

SEQ ID NO: 282630 - RNA, 19 nt, Human
uccuguggagcagagaagg

SEQ ID NO: 282631 - RNA, 23 nt, Human
ucugcccuacccagaugacaacc

SEQ ID NO: 282632 - RNA, 23 nt, Human
ucugccuucuggcugcaagaaau

SEQ ID NO: 282633 - RNA, 23 nt, Human
ucuuaggauucaguucuggacuu

SEQ ID NO: 282634 - RNA, 18 nt, Human
ugacagaugagaugggaa

SEQ ID NO: 282635 - RNA, 24 nt, Human
ugacagaugagaugggaacucucu

SEQ ID NO: 282636 - RNA, 19 nt, Human
ugagaugggaacucucugc

SEQ ID NO: 282637 - RNA, 23 nt, Human
ugaggucaggagagccuccugga

SEQ ID NO: 282638 - RNA, 18 nt, Human
ugauugcauuuagcuuuu

SEQ ID NO: 282639 - RNA, 23 nt, Human
ugcccaggccagggccacucugc

SEQ ID NO: 282640 - RNA, 21 nt, Human
ugccuaagauuccuagagugc

SEQ ID NO: 282641 - RNA, 25 nt, Human
ugcuaagaaagggaggugggauccg

SEQ ID NO: 282642 - RNA, 18 nt, Human
uggaagguacccaacugc

SEQ ID NO: 282643 - RNA, 22 nt, Human
uggaaugaaauacaccccuguu

SEQ ID NO: 282644 - RNA, 19 nt, Human
uggacacuguuguuggacu

SEQ ID NO: 282645 - RNA, 20 nt, Human
uggcaaggagaggccaaugg

SEQ ID NO: 282646 - RNA, 21 nt, Human
uggcaaggagaggccaauggg

SEQ ID NO: 282647 - RNA, 24 nt, Human
uggcaaggagaggccaaugggagg

SEQ ID NO: 282648 - RNA, 19 nt, Human
uggcacagguauuagaagc

SEQ ID NO: 282649 - RNA, 22 nt, Human
uggcacagguauuagaagcccu

SEQ ID NO: 282650 - RNA, 18 nt, Human
uggcagcuggccaucccu

SEQ ID NO: 282651 - RNA, 24 nt, Human
uggccaggaugcaucugcugggga

SEQ ID NO: 282652 - RNA, 22 nt, Human
uggcuagaccgggaagccccca

SEQ ID NO: 282653 - RNA, 24 nt, Human
uggcuagaccgggaagcccccaag

SEQ ID NO: 282654 - RNA, 20 nt, Human
uggcugcucucuggccucug

SEQ ID NO: 282655 - RNA, 21 nt, Human
uggcuuccuuucuuuguuucc

SEQ ID NO: 282656 - RNA, 21 nt, Human
uggugguaugaggauagaguc

SEQ ID NO: 282657 - RNA, 22 nt, Human
ugucccaacucccucugucugu

SEQ ID NO: 282658 - RNA, 21 nt, Human
ugucucagacuccucugcagc

SEQ ID NO: 282659 - RNA, 23 nt, Human
ugucucagacuccucugcagcca

SEQ ID NO: 282660 - RNA, 26 nt, Human
ugugcacacacaugcacacaugugcu

SEQ ID NO: 282661 - RNA, 25 nt, Human
ugugcacacacaugcacacaugugg

SEQ ID NO: 282662 - RNA, 26 nt, Human
ugugcucacacacacauguacacagu

SEQ ID NO: 282663 - RNA, 19 nt, Human
uguggagagucaggcuguc

SEQ ID NO: 282664 - RNA, 23 nt, Human
uguuguuggacuugaggucagga

SEQ ID NO: 282665 - RNA, 24 nt, Human
uguuuccuguuccuuccucugaga

SEQ ID NO: 282666 - RNA, 20 nt, Human
uuacguaccagcgccaugcu

SEQ ID NO: 282667 - RNA, 22 nt, Human
uuagauaaaaucccuuucugcc

SEQ ID NO: 282668 - RNA, 31 nt, Human
uucacuaaaacacacacaugcacacgugugg

SEQ ID NO: 282669 - RNA, 19 nt, Human
uuccucaugcugagggcug

SEQ ID NO: 282670 - RNA, 26 nt, Human
uugcguguguauuuuuccauaagaac

SEQ ID NO: 282671 - RNA, 26 nt, Human
uuugugguugcaggaaucuaaccuag

SEQ ID NO: 282672 - RNA, 26 nt, Human
uuuuccuagcuauugcguguguauuu

SEQ ID NO: 282673 - RNA, 19 nt, Human
aaaacuggugaagaccugg

SEQ ID NO: 282674 - RNA, 24 nt, Human
aaaguucugggauuacagguguga

SEQ ID NO: 282675 - RNA, 25 nt, Human
aagcgcuccucccaccucggccucc

SEQ ID NO: 282676 - RNA, 18 nt, Human
acauggcagaaauguaca

SEQ ID NO: 282677 - RNA, 24 nt, Human
caaaguucugggauuacaggugug

SEQ ID NO: 282678 - RNA, 24 nt, Human
caccucggccucccaaaguucugg

SEQ ID NO: 282679 - RNA, 22 nt, Human
cacgucuggccugggauaacuc

SEQ ID NO: 282680 - RNA, 23 nt, Human
cauggcagaaauguacagagaag

SEQ ID NO: 282681 - RNA, 21 nt, Human
ccaaaguucugggauuacagg

SEQ ID NO: 282682 - RNA, 24 nt, Human
ccaaaguucugggauuacaggugu

SEQ ID NO: 282683 - RNA, 24 nt, Human
cccuaugauacccaggcuggucuu

SEQ ID NO: 282684 - RNA, 22 nt, Human
ccuaugauacccaggcuggucu

SEQ ID NO: 282685 - RNA, 19 nt, Human
ccucccaccucggccuccc

SEQ ID NO: 282686 - RNA, 20 nt, Human
ccucccaccucggccuccca

SEQ ID NO: 282687 - RNA, 19 nt, Human
ccucggcucaagcgcuccu

SEQ ID NO: 282688 - RNA, 20 nt, Human
ccucggcucaagcgcuccuc

SEQ ID NO: 282689 - RNA, 24 nt, Human
cucaagcgcuccucccaccucggc

SEQ ID NO: 282690 - RNA, 24 nt, Human
cuccucccaccucggccucccaaa

SEQ ID NO: 282691 - RNA, 20 nt, Human
cuccucggcucaagcgcucc

SEQ ID NO: 282692 - RNA, 23 nt, Human
gaguacauggcagaaauguacag

SEQ ID NO: 282693 - RNA, 19 nt, Human
gauuacaggugugagcuac

SEQ ID NO: 282694 - RNA, 21 nt, Human
gauuacaggugugagcuacca

SEQ ID NO: 282695 - RNA, 23 nt, Human
gcuccucccaccucggccuccca

SEQ ID NO: 282696 - RNA, 18 nt, Human
ggcuggucuugaacuccu

SEQ ID NO: 282697 - RNA, 18 nt, Human
guagagacggggucuccc

SEQ ID NO: 282698 - RNA, 18 nt, Human
guagagacggggucuccc

SEQ ID NO: 282699 - RNA, 24 nt, Human
uacccaggcuggucuugaacuccu

SEQ ID NO: 282700 - RNA, 23 nt, Human
uaugauacccaggcuggucuuga

SEQ ID NO: 282701 - RNA, 24 nt, Human
uaugauacccaggcuggucuugaa

SEQ ID NO: 282702 - RNA, 23 nt, Human
ucccaaaguucugggauuacagg

SEQ ID NO: 282703 - RNA, 20 nt, Human
uccucggcucaagcgcuccu

SEQ ID NO: 282704 - RNA, 24 nt, Human
uccucggcucaagcgcuccuccca

SEQ ID NO: 282705 - RNA, 23 nt, Human
ucuugaacuccucggcucaagcg

SEQ ID NO: 282706 - RNA, 18 nt, Human
ugaguucuggaguacaug

SEQ ID NO: 282707 - RNA, 18 nt, Human
ugauacccaggcuggucu

SEQ ID NO: 282708 - RNA, 22 nt, Human
ugauacccaggcuggucuugaa

SEQ ID NO: 282709 - RNA, 24 nt, Human
ugauugacaggaugaguucuggag

SEQ ID NO: 282710 - RNA, 23 nt, Human
uggccugggauaacucauuguaa

SEQ ID NO: 282711 - RNA, 28 nt, Human
ugggauaacucauuguaaaaggucaucc

SEQ ID NO: 282712 - RNA, 18 nt, Human
ugggauuacaggugugag

SEQ ID NO: 282713 - RNA, 19 nt, Human
ugggauuacaggugugagc

SEQ ID NO: 282714 - RNA, 22 nt, Human
ugggauuacaggugugagcuac

SEQ ID NO: 282715 - RNA, 23 nt, Human
ugggauuacaggugugagcuacc

SEQ ID NO: 282716 - RNA, 24 nt, Human
ugggauuacaggugugagcuacca

SEQ ID NO: 282717 - RNA, 19 nt, Human
uguagagacggggucuccc

SEQ ID NO: 282718 - RNA, 23 nt, Human
uuguagagacggggucucccuau

SEQ ID NO: 282719 - RNA, 18 nt, Human
uuuguagagacggggucu

SEQ ID NO: 282720 - RNA, 23 nt, Human
uuuguagagacggggucucccua

SEQ ID NO: 282721 - RNA, 20 nt, Human
aaagcaaacggcagguucau

SEQ ID NO: 282722 - RNA, 22 nt, Human
aaccacagaucugacagcgccu

SEQ ID NO: 282723 - RNA, 23 nt, Human
aaguuuuugaagacucaugggag

SEQ ID NO: 282724 - RNA, 19 nt, Human
acguuacaaagcaaacggc

SEQ ID NO: 282725 - RNA, 19 nt, Human
aguuuuugaagacucaugg

SEQ ID NO: 282726 - RNA, 20 nt, Human
ccacugaaaacagcuggcua

SEQ ID NO: 282727 - RNA, 19 nt, Human
cccacauuaggaauaaagc

SEQ ID NO: 282728 - RNA, 20 nt, Human
cguuacaaagcaaacggcag

SEQ ID NO: 282729 - RNA, 23 nt, Human
gaaaaaaauauauucaaaaaaaa

SEQ ID NO: 282730 - RNA, 19 nt, Human
uaauccuuccuaaaauuca

SEQ ID NO: 282731 - RNA, 22 nt, Human
uacacuuaaccauuaauccuuc

SEQ ID NO: 282732 - RNA, 20 nt, Human
uauaaucaagcacucaaaac

SEQ ID NO: 282733 - RNA, 23 nt, Human
uauauacacuuaaccauuaaucc

SEQ ID NO: 282734 - RNA, 20 nt, Human
uaugaaacacuuauaccagu

SEQ ID NO: 282735 - RNA, 23 nt, Human
ucaaaauaaugacauccauagaa

SEQ ID NO: 282736 - RNA, 24 nt, Human
ugaaaaaaauauauucaaaaaaaa

SEQ ID NO: 282737 - RNA, 19 nt, Human
ugaauauagaugccauuac

SEQ ID NO: 282738 - RNA, 23 nt, Human
ugacauccauagaauacaacccu

SEQ ID NO: 282739 - RNA, 19 nt, Human
uggaaugugcccacauuag

SEQ ID NO: 282740 - RNA, 23 nt, Human
uucaaaauaaugacauccauaga

SEQ ID NO: 282741 - RNA, 19 nt, Human
agguccaggugguccgggc

SEQ ID NO: 282742 - RNA, 21 nt, Human
ccagagcucugugcugccgac

SEQ ID NO: 282743 - RNA, 23 nt, Human
cuggaggguagguccaggugguc

SEQ ID NO: 282744 - RNA, 20 nt, Human
cuggugguagggugggcucu

SEQ ID NO: 282745 - RNA, 20 nt, Human
gaggugcagacccgggggcu

SEQ ID NO: 282746 - RNA, 18 nt, Human
ggugggcucuggaggugc

SEQ ID NO: 282747 - RNA, 18 nt, Human
uggcuggaggguaggucc

SEQ ID NO: 282748 - RNA, 24 nt, Human
uggcuggaggguagguccaggugg

SEQ ID NO: 282749 - RNA, 20 nt, Human
ugguagggugggcucuggag

SEQ ID NO: 282750 - RNA, 23 nt, Human
uuuggagucaggugggugggagc

SEQ ID NO: 282751 - RNA, 21 nt, Human
ccagagcucugugcugccgac

SEQ ID NO: 282752 - RNA, 23 nt, Human
cuggaggguagguccaggugguc

SEQ ID NO: 282753 - RNA, 20 nt, Human
cuggugguagggugggcucu

SEQ ID NO: 282754 - RNA, 20 nt, Human
gaggugcagacccgggggcu

SEQ ID NO: 282755 - RNA, 18 nt, Human
ggugggcucuggaggugc

SEQ ID NO: 282756 - RNA, 23 nt, Human
guagguccaggugguccgggcuc

SEQ ID NO: 282757 - RNA, 24 nt, Human
ucuggaggugcagacccgggggcu

SEQ ID NO: 282758 - RNA, 18 nt, Human
uggcuggaggguaggucc

SEQ ID NO: 282759 - RNA, 24 nt, Human
uggcuggaggguagguccaggugg

SEQ ID NO: 282760 - RNA, 20 nt, Human
ugguagggugggcucuggag

SEQ ID NO: 282761 - RNA, 23 nt, Human
uuuggagucaggugggugggagc

SEQ ID NO: 282762 - RNA, 22 nt, Human
aggaggucaugguguuccaaca

SEQ ID NO: 282763 - RNA, 20 nt, Human
caggguaagcaccuuuucuu

SEQ ID NO: 282764 - RNA, 25 nt, Human
caguaaaccuuuucccagaaagucu

SEQ ID NO: 282765 - RNA, 18 nt, Human
cuacauuuuguccuuggg

SEQ ID NO: 282766 - RNA, 18 nt, Human
gggagaaaggacacacag

SEQ ID NO: 282767 - RNA, 25 nt, Human
uaauggguugugauggaugaaguuu

SEQ ID NO: 282768 - RNA, 22 nt, Human
uacaagaaaaacaaacuguguu

SEQ ID NO: 282769 - RNA, 21 nt, Human
uagcaucuccaggguaagcac

SEQ ID NO: 282770 - RNA, 18 nt, Human
ucuccaggguaagcaccu

SEQ ID NO: 282771 - RNA, 18 nt, Human
ugaaaagugauuacaaga

SEQ ID NO: 282772 - RNA, 24 nt, Human
uggggucaggguaguuuuaugacu

SEQ ID NO: 282773 - RNA, 23 nt, Human
uguagcaucuccaggguaagcac

SEQ ID NO: 282774 - RNA, 24 nt, Human
uguauagcaggaaggguuuuuaaa

SEQ ID NO: 282775 - RNA, 24 nt, Human
ugucaaggucuauuccaaccuagg

SEQ ID NO: 282776 - RNA, 21 nt, Human
ugucaaggucuauuccacugu

SEQ ID NO: 282777 - RNA, 22 nt, Human
ugucaaggucuauuccacugug

SEQ ID NO: 282778 - RNA, 22 nt, Human
ugucucuguagcaucuccaggg

SEQ ID NO: 282779 - RNA, 23 nt, Human
uugugauggaugaaguuuccuuu

SEQ ID NO: 282780 - RNA, 21 nt, Human
aacaguuaucugaaagguggu

SEQ ID NO: 282781 - RNA, 19 nt, Human
aaccaaaacuuugugaugc

SEQ ID NO: 282782 - RNA, 21 nt, Human
aagcaguuucacuucagagac

SEQ ID NO: 282783 - RNA, 21 nt, Human
aauaacaguuaucugaaaggu

SEQ ID NO: 282784 - RNA, 23 nt, Human
acaguuaucugaaaggugguuga

SEQ ID NO: 282785 - RNA, 18 nt, Human
agaaaaaaaauagggagg

SEQ ID NO: 282786 - RNA, 27 nt, Human
agaaaaaccucuuuuaaccauuuauau

SEQ ID NO: 282787 - RNA, 27 nt, Human
agauaaaccaaucugcugcguccuaga

SEQ ID NO: 282788 - RNA, 20 nt, Human
auaguagcuaaaauaugaaa

SEQ ID NO: 282789 - RNA, 22 nt, Human
caaccaaaacuuugugaugcuc

SEQ ID NO: 282790 - RNA, 18 nt, Human
cacagagguuuggcuucc

SEQ ID NO: 282791 - RNA, 20 nt, Human
cacagagguuuggcuuccgg

SEQ ID NO: 282792 - RNA, 25 nt, Human
cagaaccuuccuuuaaggcuuaaaa

SEQ ID NO: 282793 - RNA, 22 nt, Human
cagcacggaugggggucccuga

SEQ ID NO: 282794 - RNA, 18 nt, Human
cagcccaguugauuauca

SEQ ID NO: 282795 - RNA, 26 nt, Human
ccagaaccuuccuuuaaggcuuaaaa

SEQ ID NO: 282796 - RNA, 21 nt, Human
ccugccgccuccgccagagga

SEQ ID NO: 282797 - RNA, 19 nt, Human
cgccagaggaagcagggag

SEQ ID NO: 282798 - RNA, 19 nt, Human
cggauggaaccuuggggug

SEQ ID NO: 282799 - RNA, 28 nt, Human
cuaaaauaugaaaggccagggaauuuau

SEQ ID NO: 282800 - RNA, 21 nt, Human
cugaucuucaggaugagcaau

SEQ ID NO: 282801 - RNA, 24 nt, Human
cuuaaaaaccucaaacaguauuuc

SEQ ID NO: 282802 - RNA, 20 nt, Human
gaccuggcucucgguuccug

SEQ ID NO: 282803 - RNA, 19 nt, Human
gaguguagguguggugugu

SEQ ID NO: 282804 - RNA, 21 nt, Human
gccuucugagaagauugcaga

SEQ ID NO: 282805 - RNA, 20 nt, Human
gcgggaggacgcgguccugc

SEQ ID NO: 282806 - RNA, 21 nt, Human
gcggggcgcagaggagaggcg

SEQ ID NO: 282807 - RNA, 19 nt, Human
gggcagcacggaugggggu

SEQ ID NO: 282808 - RNA, 21 nt, Human
ggugaccaauucaccugaaac

SEQ ID NO: 282809 - RNA, 22 nt, Human
guagcuaaaauaugaaaggcca

SEQ ID NO: 282810 - RNA, 21 nt, Human
uaaaaaccucaaacaguauuu

SEQ ID NO: 282811 - RNA, 22 nt, Human
uaaaugagaucaccuaugcaaa

SEQ ID NO: 282812 - RNA, 19 nt, Human
uaggaaacaagcaguuuca

SEQ ID NO: 282813 - RNA, 24 nt, Human
uauauaacagaaaaaaaauaggga

SEQ ID NO: 282814 - RNA, 20 nt, Human
uaugcaaacaaauacaugua

SEQ ID NO: 282815 - RNA, 18 nt, Human
ucggaugggagggggcgg

SEQ ID NO: 282816 - RNA, 23 nt, Human
ucggugaccaauucaccugaaac

SEQ ID NO: 282817 - RNA, 24 nt, Human
ucucaaacaacuuggcaucagccu

SEQ ID NO: 282818 - RNA, 20 nt, Human
ucugaaaggugguugagagg

SEQ ID NO: 282819 - RNA, 22 nt, Human
ugauugucaauggucagcugau

SEQ ID NO: 282820 - RNA, 22 nt, Human
ugcaaacaaauacauguaggua

SEQ ID NO: 282821 - RNA, 21 nt, Human
ugcaggaacccaguuuccuua

SEQ ID NO: 282822 - RNA, 23 nt, Human
ugggagggggcgggaggacgcgg

SEQ ID NO: 282823 - RNA, 26 nt, Human
uguagguaugaagacaucgucugggg

SEQ ID NO: 282824 - RNA, 18 nt, Human
uuccaagauaaaccaagg

SEQ ID NO: 282825 - RNA, 20 nt, Human
aaaacaaugagcaaacugca

SEQ ID NO: 282826 - RNA, 22 nt, Human
accaagaaagucaugaagugac

SEQ ID NO: 282827 - RNA, 21 nt, Human
aucccuuucucucuuuucucc

SEQ ID NO: 282828 - RNA, 23 nt, Human
aucccuuucucucuuuucuccag

SEQ ID NO: 282829 - RNA, 24 nt, Human
caaugagcaaacugcagaagguuu

SEQ ID NO: 282830 - RNA, 18 nt, Human
ccugugggggaagggggg

SEQ ID NO: 282831 - RNA, 22 nt, Human
cuuucucucuuuucuccagaga

SEQ ID NO: 282832 - RNA, 21 nt, Human
gggcauauacccacacaccaa

SEQ ID NO: 282833 - RNA, 19 nt, Human
ucccagggcuuuggaaucu

SEQ ID NO: 282834 - RNA, 20 nt, Human
ucucucuuuucuccagagac

SEQ ID NO: 282835 - RNA, 25 nt, Human
ugggugauuuuuagaggcauugccc

SEQ ID NO: 282836 - RNA, 18 nt, Human
uuuuuagaggcauugccu

SEQ ID NO: 282837 - RNA, 22 nt, Human
aaaaacaccaaaauaugguaac

SEQ ID NO: 282838 - RNA, 24 nt, Human
aaagagaaaacacaaaaacaccaa

SEQ ID NO: 282839 - RNA, 18 nt, Human
aacaggaaaaggauagug

SEQ ID NO: 282840 - RNA, 20 nt, Human
aaccacacccuugaucaccc

SEQ ID NO: 282841 - RNA, 22 nt, Human
aaccauuucuucccuaagacag

SEQ ID NO: 282842 - RNA, 23 nt, Human
aacuaaguucaacaccuagcccc

SEQ ID NO: 282843 - RNA, 18 nt, Human
aagaaacaggagaaauca

SEQ ID NO: 282844 - RNA, 21 nt, Human
aagaugccauuguaguagaaa

SEQ ID NO: 282845 - RNA, 22 nt, Human
aauaagaaaacagugaaaggga

SEQ ID NO: 282846 - RNA, 23 nt, Human
aaugugaucuaagagaauauggu

SEQ ID NO: 282847 - RNA, 18 nt, Human
acagagccuccacuaacc

SEQ ID NO: 282848 - RNA, 21 nt, Human
accccagugucuaucaucugc

SEQ ID NO: 282849 - RNA, 19 nt, Human
accuucccccccaccccca

SEQ ID NO: 282850 - RNA, 21 nt, Human
accuucccccccacccccacc

SEQ ID NO: 282851 - RNA, 21 nt, Human
acguaccuucccccccacccc

SEQ ID NO: 282852 - RNA, 21 nt, Human
acuaaccacacccuugaucac

SEQ ID NO: 282853 - RNA, 18 nt, Human
agaacgaggggaguggag

SEQ ID NO: 282854 - RNA, 22 nt, Human
agaauaagaaaacagugaaagg

SEQ ID NO: 282855 - RNA, 19 nt, Human
agagccuccacuaaccaca

SEQ ID NO: 282856 - RNA, 24 nt, Human
agccaugguagggaagcagauuuc

SEQ ID NO: 282857 - RNA, 23 nt, Human
agccccugaccuaucauaccucc

SEQ ID NO: 282858 - RNA, 19 nt, Human
agccgggagcggggagcug

SEQ ID NO: 282859 - RNA, 21 nt, Human
aggauagugggaagcaggacc

SEQ ID NO: 282860 - RNA, 22 nt, Human
aggcaggagaugggucucagag

SEQ ID NO: 282861 - RNA, 20 nt, Human
agggaagcagauuucuucug

SEQ ID NO: 282862 - RNA, 19 nt, Human
aggguuuagccauauugca

SEQ ID NO: 282863 - RNA, 25 nt, Human
aggugacaucugcccuugguauuuc

SEQ ID NO: 282864 - RNA, 21 nt, Human
agguuggggugcuggaauagc

SEQ ID NO: 282865 - RNA, 20 nt, Human
aguagugcuuguaggccuag

SEQ ID NO: 282866 - RNA, 20 nt, Human
agucacuagccucacucaga

SEQ ID NO: 282867 - RNA, 18 nt, Human
agugcaaaacaaaggacu

SEQ ID NO: 282868 - RNA, 24 nt, Human
aguggagugcaaaggagugaucca

SEQ ID NO: 282869 - RNA, 19 nt, Human
aucccacuagcagcuuugc

SEQ ID NO: 282870 - RNA, 23 nt, Human
auucugauugugauucucucuca

SEQ ID NO: 282871 - RNA, 20 nt, Human
caaaacaaaggacucuagac

SEQ ID NO: 282872 - RNA, 21 nt, Human
caaaacaaaggacucuagaca

SEQ ID NO: 282873 - RNA, 20 nt, Human
caaaauaugguaacuuuggc

SEQ ID NO: 282874 - RNA, 21 nt, Human
caacaaacacaucccuaggug

SEQ ID NO: 282875 - RNA, 18 nt, Human
caaggggagucucuaaac

SEQ ID NO: 282876 - RNA, 23 nt, Human
caccaagaaacaggagaaaucac

SEQ ID NO: 282877 - RNA, 22 nt, Human
cacuaaccacacccuugaucac

SEQ ID NO: 282878 - RNA, 20 nt, Human
cagaauaagaaaacagugaa

SEQ ID NO: 282879 - RNA, 22 nt, Human
cagaaucuaggccuaggguacu

SEQ ID NO: 282880 - RNA, 24 nt, Human
cagcaggacagcggacugcgggcc

SEQ ID NO: 282881 - RNA, 20 nt, Human
cagcaggugcagagucuuuc

SEQ ID NO: 282882 - RNA, 19 nt, Human
ccacaauaccuuugcugug

SEQ ID NO: 282883 - RNA, 25 nt, Human
ccacacccuugaucacccaaagauc

SEQ ID NO: 282884 - RNA, 19 nt, Human
ccaccucggcugcgugucg

SEQ ID NO: 282885 - RNA, 22 nt, Human
ccaccucggcugcgugucguuu

SEQ ID NO: 282886 - RNA, 23 nt, Human
ccacuaaccacacccuugaucac

SEQ ID NO: 282887 - RNA, 19 nt, Human
cccacacccacccaccucg

SEQ ID NO: 282888 - RNA, 24 nt, Human
cccaccaagaaacaggagaaauca

SEQ ID NO: 282889 - RNA, 25 nt, Human
cccaccaagaaacaggagaaaucac

SEQ ID NO: 282890 - RNA, 19 nt, Human
ccccacacccacccaccuc

SEQ ID NO: 282891 - RNA, 22 nt, Human
ccccacacccacccaccucggc

SEQ ID NO: 282892 - RNA, 23 nt, Human
ccccccacccccaccaagaaaca

SEQ ID NO: 282893 - RNA, 21 nt, Human
cccccccacccccaccaagaa

SEQ ID NO: 282894 - RNA, 21 nt, Human
cccgcguccccacacccaccc

SEQ ID NO: 282895 - RNA, 22 nt, Human
cccgcguccccacacccaccca

SEQ ID NO: 282896 - RNA, 23 nt, Human
ccgacgacacuggcucccgcguc

SEQ ID NO: 282897 - RNA, 18 nt, Human
ccgggcgccgggcgccgg

SEQ ID NO: 282898 - RNA, 24 nt, Human
ccgggcucagcaggacagcggacu

SEQ ID NO: 282899 - RNA, 26 nt, Human
ccuccacuaaccacacccuugaucac

SEQ ID NO: 282900 - RNA, 18 nt, Human
ccuuacuucagagcagcu

SEQ ID NO: 282901 - RNA, 21 nt, Human
ccuugcggagaugacaaaccu

SEQ ID NO: 282902 - RNA, 19 nt, Human
cgcgccgggcgccgggcgc

SEQ ID NO: 282903 - RNA, 20 nt, Human
cgggccgauccgacgacacu

SEQ ID NO: 282904 - RNA, 21 nt, Human
cguaccuucccccccaccccc

SEQ ID NO: 282905 - RNA, 21 nt, Human
cuaaaaguauuuuucugugua

SEQ ID NO: 282906 - RNA, 22 nt, Human
cuaaccacacccuugaucaccc

SEQ ID NO: 282907 - RNA, 23 nt, Human
cuaaccacacccuugaucaccca

SEQ ID NO: 282908 - RNA, 19 nt, Human
cuaagacagcaggugcaga

SEQ ID NO: 282909 - RNA, 19 nt, Human
cucaaagugcuuccauucu

SEQ ID NO: 282910 - RNA, 27 nt, Human
cuccacuaaccacacccuugaucaccc

SEQ ID NO: 282911 - RNA, 26 nt, Human
cucccgcguccccacacccacccacc

SEQ ID NO: 282912 - RNA, 23 nt, Human
cuccgcgccgggcgccgggcgcc

SEQ ID NO: 282913 - RNA, 19 nt, Human
cucuagacaagucucagcu

SEQ ID NO: 282914 - RNA, 21 nt, Human
cucuagacaagucucagcuac

SEQ ID NO: 282915 - RNA, 19 nt, Human
gacagaacgaggggagugg

SEQ ID NO: 282916 - RNA, 22 nt, Human
gacucuagacaagucucagcua

SEQ ID NO: 282917 - RNA, 23 nt, Human
gagaaaacacaaaaacaccaaaa

SEQ ID NO: 282918 - RNA, 21 nt, Human
gaucccaggucagugauaugc

SEQ ID NO: 282919 - RNA, 21 nt, Human
gcacagagccuccacuaacca

SEQ ID NO: 282920 - RNA, 24 nt, Human
gccuccgggcucagcaggacagcg

SEQ ID NO: 282921 - RNA, 18 nt, Human
gcgccgggcgccgggcgc

SEQ ID NO: 282922 - RNA, 20 nt, Human
ggccaguguugcucuggagg

SEQ ID NO: 282923 - RNA, 19 nt, Human
gggccgauccgacgacacu

SEQ ID NO: 282924 - RNA, 20 nt, Human
ggggugcuggaauagccaug

SEQ ID NO: 282925 - RNA, 26 nt, Human
ggggugcuggaauagccaugguaggg

SEQ ID NO: 282926 - RNA, 20 nt, Human
ggugacugggagccaagggg

SEQ ID NO: 282927 - RNA, 21 nt, Human
guccccacacccacccaccuc

SEQ ID NO: 282928 - RNA, 22 nt, Human
gugcuggaauagccaugguagg

SEQ ID NO: 282929 - RNA, 22 nt, Human
uaaguucaacaccuagccccug

SEQ ID NO: 282930 - RNA, 22 nt, Human
uacagguuggggugcuggaaua

SEQ ID NO: 282931 - RNA, 19 nt, Human
uaccuucccccccaccccc

SEQ ID NO: 282932 - RNA, 22 nt, Human
uagccccugaccuaucauaccu

SEQ ID NO: 282933 - RNA, 25 nt, Human
uagccucacucagacuucguucaaa

SEQ ID NO: 282934 - RNA, 24 nt, Human
uaugcuagaaaugucacagaguca

SEQ ID NO: 282935 - RNA, 23 nt, Human
ucaaagugacagaacgaggggag

SEQ ID NO: 282936 - RNA, 21 nt, Human
ucacccaaagaucccagguca

SEQ ID NO: 282937 - RNA, 23 nt, Human
ucagcaggacagcggacugcggg

SEQ ID NO: 282938 - RNA, 19 nt, Human
ucauucugaaauacuugga

SEQ ID NO: 282939 - RNA, 20 nt, Human
uccacaauaccuuugcugug

SEQ ID NO: 282940 - RNA, 26 nt, Human
uccacuaaccacacccuugaucaccc

SEQ ID NO: 282941 - RNA, 24 nt, Human
ucccccccacccccaccaagaaac

SEQ ID NO: 282942 - RNA, 19 nt, Human
uccgcgccgggcgccgggc

SEQ ID NO: 282943 - RNA, 21 nt, Human
ucuagaauaucagagaacagu

SEQ ID NO: 282944 - RNA, 22 nt, Human
ucucaaucaggaaaggguuuag

SEQ ID NO: 282945 - RNA, 25 nt, Human
ucugccucuuuuugugaucacuuuc

SEQ ID NO: 282946 - RNA, 27 nt, Human
ucugccucuuuuugugaucacuuuccc

SEQ ID NO: 282947 - RNA, 25 nt, Human
ugaaaaggccaauguuacagagaca

SEQ ID NO: 282948 - RNA, 18 nt, Human
ugaaugcucucacucuuc

SEQ ID NO: 282949 - RNA, 23 nt, Human
ugcaucaggcaguuuugcaguca

SEQ ID NO: 282950 - RNA, 26 nt, Human
ugcuagaaaacaagcccaggaaaggu

SEQ ID NO: 282951 - RNA, 25 nt, Human
ugcugugggaaggagcaauagcucu

SEQ ID NO: 282952 - RNA, 24 nt, Human
uggaauagccaugguagggaagca

SEQ ID NO: 282953 - RNA, 22 nt, Human
uggcucccgcguccccacaccc

SEQ ID NO: 282954 - RNA, 19 nt, Human
ugguaugacccuaccccag

SEQ ID NO: 282955 - RNA, 23 nt, Human
ugguauuucagaagaccagagaa

SEQ ID NO: 282956 - RNA, 21 nt, Human
uggugacugggagccaagggg

SEQ ID NO: 282957 - RNA, 25 nt, Human
uguaacaaaagaaaaccaggaggaa

SEQ ID NO: 282958 - RNA, 19 nt, Human
uguacauacagccuguacg

SEQ ID NO: 282959 - RNA, 21 nt, Human
uguucugcucucagucuucca

SEQ ID NO: 282960 - RNA, 22 nt, Human
uuaaaucauucugaaauacuug

SEQ ID NO: 282961 - RNA, 18 nt, Human
uuaggaaacgcucuuccu

SEQ ID NO: 282962 - RNA, 22 nt, Human
uuaggaaacgcucuuccuuuuu

SEQ ID NO: 282963 - RNA, 18 nt, Human
uucugaaauacuuggagc

SEQ ID NO: 282964 - RNA, 21 nt, Human
uuggggugcuggaauagccau

SEQ ID NO: 282965 - RNA, 19 nt, Human
uuggguaggagggcaacaa

SEQ ID NO: 282966 - RNA, 20 nt, Human
uuguacauacagccuguacg

SEQ ID NO: 282967 - RNA, 21 nt, Human
uuuuugugaucacuuucuggc

SEQ ID NO: 282968 - RNA, 24 nt, Human
aaacuugcaguuaacagcuaccag

SEQ ID NO: 282969 - RNA, 22 nt, Human
aacagcagugacaaucucagag

SEQ ID NO: 282970 - RNA, 25 nt, Human
agacgccggagccugagucgcagcc

SEQ ID NO: 282971 - RNA, 24 nt, Human
agcugaggggcacucuugaguagc

SEQ ID NO: 282972 - RNA, 19 nt, Human
aggcgccgcaggccagccu

SEQ ID NO: 282973 - RNA, 24 nt, Human
aggggcggcgggcggcggcggcgg

SEQ ID NO: 282974 - RNA, 24 nt, Human
aggggcggcgggcggcggcggcgg

SEQ ID NO: 282975 - RNA, 18 nt, Human
aggucacaacacuaagcu

SEQ ID NO: 282976 - RNA, 27 nt, Human
aucccuuaauucaagcuaaacuugcag

SEQ ID NO: 282977 - RNA, 21 nt, Human
cagcagugacaaucucagagc

SEQ ID NO: 282978 - RNA, 23 nt, Human
cagccccauggggaagcgcagac

SEQ ID NO: 282979 - RNA, 20 nt, Human
cagcuucucacaaaggcaac

SEQ ID NO: 282980 - RNA, 21 nt, Human
caguaauuaaguuacaugguc

SEQ ID NO: 282981 - RNA, 22 nt, Human
caguuaacagcuaccagagugc

SEQ ID NO: 282982 - RNA, 21 nt, Human
ccagccccauggggaagcgca

SEQ ID NO: 282983 - RNA, 21 nt, Human
cccaggcgccgcaggccagcc

SEQ ID NO: 282984 - RNA, 26 nt, Human
ccccaaaucccuuaauucaagcuaaa

SEQ ID NO: 282985 - RNA, 24 nt, Human
ccccgccgcgcccgucagcgccug

SEQ ID NO: 282986 - RNA, 20 nt, Human
ccgccgcgcccgucagcgcc

SEQ ID NO: 282987 - RNA, 21 nt, Human
ccgccgcgcccgucagcgccu

SEQ ID NO: 282988 - RNA, 19 nt, Human
ccgcgcccgucagcgccug

SEQ ID NO: 282989 - RNA, 19 nt, Human
cggcccgagguggcgccgg

SEQ ID NO: 282990 - RNA, 23 nt, Human
cgggcggcggcggcggcggcuuu

SEQ ID NO: 282991 - RNA, 20 nt, Human
gcggcggcggcggcggcuac

SEQ ID NO: 282992 - RNA, 19 nt, Human
gcggcggcggcuacaggag

SEQ ID NO: 282993 - RNA, 21 nt, Human
gcggcgggcggcggcggcggc

SEQ ID NO: 282994 - RNA, 18 nt, Human
gcgggcggcggcggcggc

SEQ ID NO: 282995 - RNA, 21 nt, Human
gggcggcggcggcggcggcua

SEQ ID NO: 282996 - RNA, 19 nt, Human
uaaaacaaauauucaaaua

SEQ ID NO: 282997 - RNA, 23 nt, Human
uaagcuuuuggcccauucugcca

SEQ ID NO: 282998 - RNA, 20 nt, Human
uagucuuccauauggcugca

SEQ ID NO: 282999 - RNA, 26 nt, Human
uauaaaacaaauauucaaauaguuuc

SEQ ID NO: 283000 - RNA, 25 nt, Human
uauuucaagauacuuuauuuuaaaa

SEQ ID NO: 283001 - RNA, 24 nt, Human
ugaguagcgugucugaagagugaa

SEQ ID NO: 283002 - RNA, 25 nt, Human
uggaacagcagugacaaucucagag

SEQ ID NO: 283003 - RNA, 21 nt, Human
uggcgccggagcugcuggcag

SEQ ID NO: 283004 - RNA, 22 nt, Human
ugugacccauauccuagucuuc

SEQ ID NO: 283005 - RNA, 23 nt, Human
uuacaugguccccccaaaucccu

SEQ ID NO: 283006 - RNA, 22 nt, Human
uucaaauaguuuccauaggaac

SEQ ID NO: 283007 - RNA, 23 nt, Human
uucugccauuguacaagcuacaa

SEQ ID NO: 283008 - RNA, 22 nt, Human
uuggaacagcagugacaaucuc

SEQ ID NO: 283009 - RNA, 18 nt, Human
aaaaaucaaugaaauugg

SEQ ID NO: 283010 - RNA, 18 nt, Human
aaaacaccacacuuguga

SEQ ID NO: 283011 - RNA, 21 nt, Human
aacugauuacaaaagcuuuuu

SEQ ID NO: 283012 - RNA, 28 nt, Human
aagcacagcggaaagcaggccgguaccc

SEQ ID NO: 283013 - RNA, 18 nt, Human
acagcggaaagcaggcgg

SEQ ID NO: 283014 - RNA, 18 nt, Human
acccagaggggcaggcuu

SEQ ID NO: 283015 - RNA, 19 nt, Human
agaaaaaaaaaaaagcaag

SEQ ID NO: 283016 - RNA, 20 nt, Human
agaucccagacgccggcccc

SEQ ID NO: 283017 - RNA, 21 nt, Human
agcuugggaagggagccuugg

SEQ ID NO: 283018 - RNA, 22 nt, Human
agggagccuugggaaaacacca

SEQ ID NO: 283019 - RNA, 23 nt, Human
agggagccuugggaaaacaccac

SEQ ID NO: 283020 - RNA, 23 nt, Human
aggugacuauaucaggaaggaga

SEQ ID NO: 283021 - RNA, 19 nt, Human
caaauggacacaagcccuc

SEQ ID NO: 283022 - RNA, 18 nt, Human
caacuguccaggagcgac

SEQ ID NO: 283023 - RNA, 19 nt, Human
caagugauggugcuuacag

SEQ ID NO: 283024 - RNA, 22 nt, Human
caagugauggugcuuacagccc

SEQ ID NO: 283025 - RNA, 22 nt, Human
caaugagccucucaaggggccc

SEQ ID NO: 283026 - RNA, 21 nt, Human
cacaagcccucgagggucuau

SEQ ID NO: 283027 - RNA, 22 nt, Human
cagaacagaucccagacgccgg

SEQ ID NO: 283028 - RNA, 21 nt, Human
cagcggaaagcaggcggaucc

SEQ ID NO: 283029 - RNA, 27 nt, Human
caggccaaaagaaacaaaaaucaauga

SEQ ID NO: 283030 - RNA, 26 nt, Human
cccacacgauggaaaccugggggagc

SEQ ID NO: 283031 - RNA, 19 nt, Human
ccccaggguccuuagggcu

SEQ ID NO: 283032 - RNA, 20 nt, Human
ccuaaaacaaugagggcugu

SEQ ID NO: 283033 - RNA, 19 nt, Human
ccugggggagccgccugag

SEQ ID NO: 283034 - RNA, 19 nt, Human
cuccuuggauuuagugaag

SEQ ID NO: 283035 - RNA, 23 nt, Human
cucucugaggggagaagggugga

SEQ ID NO: 283036 - RNA, 20 nt, Human
cucugaggggagaagggugg

SEQ ID NO: 283037 - RNA, 21 nt, Human
cucugcucagggggacccaga

SEQ ID NO: 283038 - RNA, 24 nt, Human
cugcuucaccuucugcugcuuuug

SEQ ID NO: 283039 - RNA, 22 nt, Human
gagcgacacggcugcgcccaga

SEQ ID NO: 283040 - RNA, 18 nt, Human
gaggaaaaccaccaggcu

SEQ ID NO: 283041 - RNA, 23 nt, Human
gauacaaaucaggccaaaagaaa

SEQ ID NO: 283042 - RNA, 19 nt, Human
gccaaaagaaacaaaaauc

SEQ ID NO: 283043 - RNA, 21 nt, Human
ggaaggagcaaagucauggua

SEQ ID NO: 283044 - RNA, 20 nt, Human
ggcuccaggcccugauaagu

SEQ ID NO: 283045 - RNA, 19 nt, Human
ggcuguaaggggacuggug

SEQ ID NO: 283046 - RNA, 24 nt, Human
ggggagaaggguggaagcuuuggg

SEQ ID NO: 283047 - RNA, 20 nt, Human
guaaaaggccaaauggacac

SEQ ID NO: 283048 - RNA, 22 nt, Human
gucuauugugaagugcuugggg

SEQ ID NO: 283049 - RNA, 23 nt, Human
gugaagcacagcggaaagcaggc

SEQ ID NO: 283050 - RNA, 21 nt, Human
gugacuauaucaggaaggaga

SEQ ID NO: 283051 - RNA, 24 nt, Human
uaaaccugcuggaaugcacagcuc

SEQ ID NO: 283052 - RNA, 19 nt, Human
uaaaugcauuccagagaua

SEQ ID NO: 283053 - RNA, 19 nt, Human
uaaggacaagacccugaac

SEQ ID NO: 283054 - RNA, 24 nt, Human
uaaggacaagacccugaacccauu

SEQ ID NO: 283055 - RNA, 25 nt, Human
uacacugggugcgccacaaggugcu

SEQ ID NO: 283056 - RNA, 21 nt, Human
uacuccguucuucccacacga

SEQ ID NO: 283057 - RNA, 20 nt, Human
uagagcuaguagcuaaggac

SEQ ID NO: 283058 - RNA, 18 nt, Human
uagcuaaggacaagaccc

SEQ ID NO: 283059 - RNA, 28 nt, Human
uaucaggaaggagaaaaccaagugcuuc

SEQ ID NO: 283060 - RNA, 19 nt, Human
uauguggacguggacaggg

SEQ ID NO: 283061 - RNA, 25 nt, Human
uauguggacguggacagggguguuc

SEQ ID NO: 283062 - RNA, 19 nt, Human
ucagaaaaaaaaaaaagca

SEQ ID NO: 283063 - RNA, 22 nt, Human
ucagaaaaaaaaaaaagcaagu

SEQ ID NO: 283064 - RNA, 23 nt, Human
ucagaaaaaaaccugagagagau

SEQ ID NO: 283065 - RNA, 21 nt, Human
uccuauggcuuccaucagggc

SEQ ID NO: 283066 - RNA, 20 nt, Human
uccuucuacacagugaucuc

SEQ ID NO: 283067 - RNA, 23 nt, Human
ucgcuugugagauuucuggcugc

SEQ ID NO: 283068 - RNA, 21 nt, Human
ucugcgugagacucguuacuc

SEQ ID NO: 283069 - RNA, 24 nt, Human
ugaaaucagaaaaaaaaaaaagcc

SEQ ID NO: 283070 - RNA, 24 nt, Human
ugaagagcgguccuucaugguugg

SEQ ID NO: 283071 - RNA, 18 nt, Human
ugagacucguuacuccgu

SEQ ID NO: 283072 - RNA, 23 nt, Human
ugagagagauuccuaaaacaaug

SEQ ID NO: 283073 - RNA, 25 nt, Human
uggaaaccugggggagccgccugac

SEQ ID NO: 283074 - RNA, 27 nt, Human
uggaaauauuuucucaggaaaggaagg

SEQ ID NO: 283075 - RNA, 23 nt, Human
ugggagaggaaaaccaccaggcu

SEQ ID NO: 283076 - RNA, 18 nt, Human
uguccaggagcgacacgg

SEQ ID NO: 283077 - RNA, 25 nt, Human
ugugaaaucagaaaaaaaaaaaagc

SEQ ID NO: 283078 - RNA, 22 nt, Human
ugugagauuucuggcugcuggu

SEQ ID NO: 283079 - RNA, 18 nt, Human
uguggacguggacagggg

SEQ ID NO: 283080 - RNA, 24 nt, Human
uuacuccguucuucccacacgaug

SEQ ID NO: 283081 - RNA, 24 nt, Human
uuaggucagaaaaaaaccugagag

SEQ ID NO: 283082 - RNA, 23 nt, Human
uugggaggcgcuccucuacuguc

SEQ ID NO: 283083 - RNA, 19 nt, Human
uuuaacacuuccaacaggu

SEQ ID NO: 283084 - RNA, 23 nt, Human
uuuuuuuuuuuuuuuuuuaacug

SEQ ID NO: 283085 - RNA, 18 nt, Human
aacccugccucugucccg

SEQ ID NO: 283086 - RNA, 24 nt, Human
aggcggcuggagggcggggaccca

SEQ ID NO: 283087 - RNA, 22 nt, Human
aggcgucagcucccuccggagc

SEQ ID NO: 283088 - RNA, 24 nt, Human
caagacgagggggaaucccugccc

SEQ ID NO: 283089 - RNA, 27 nt, Human
cacgcgagcuuccuuucuucgcgguuc

SEQ ID NO: 283090 - RNA, 19 nt, Human
ccaagacgagggggaaucc

SEQ ID NO: 283091 - RNA, 20 nt, Human
ccuccggagcccgccucgcu

SEQ ID NO: 283092 - RNA, 21 nt, Human
ccuccggagcccgccucgcuc

SEQ ID NO: 283093 - RNA, 24 nt, Human
cuagcaaacacgcgagcuuccuuu

SEQ ID NO: 283094 - RNA, 25 nt, Human
cucagaacccugccucugucccgag

SEQ ID NO: 283095 - RNA, 26 nt, Human
cugaacguucucugccucgcacuccc

SEQ ID NO: 283096 - RNA, 23 nt, Human
cugaaggcagcgaggcaggaccc

SEQ ID NO: 283097 - RNA, 21 nt, Human
gaaaaaaaaacccacauugga

SEQ ID NO: 283098 - RNA, 23 nt, Human
gaacaaaggugcugaacguucuc

SEQ ID NO: 283099 - RNA, 22 nt, Human
gacccaggcacgacucaaaggc

SEQ ID NO: 283100 - RNA, 18 nt, Human
gaguuuagugcccagccc

SEQ ID NO: 283101 - RNA, 26 nt, Human
gaugauagggaaacauuuacaaagga

SEQ ID NO: 283102 - RNA, 23 nt, Human
ggcgguggggccaagacgagggg

SEQ ID NO: 283103 - RNA, 19 nt, Human
gggacccagacacuaggga

SEQ ID NO: 283104 - RNA, 18 nt, Human
gggaggaacaaaggugcu

SEQ ID NO: 283105 - RNA, 21 nt, Human
uaauuauggaaaaaaaaaccc

SEQ ID NO: 283106 - RNA, 24 nt, Human
uacacacauuuuuauugaguuuug

SEQ ID NO: 283107 - RNA, 21 nt, Human
uagcaaacacgcgagcuuccu

SEQ ID NO: 283108 - RNA, 22 nt, Human
uauggaaaaaaaaacccacauu

SEQ ID NO: 283109 - RNA, 18 nt, Human
ucugaggcaagggcgagg

SEQ ID NO: 283110 - RNA, 22 nt, Human
ucugucccgaggguucgggagg

SEQ ID NO: 283111 - RNA, 24 nt, Human
ucuucgcgguucugaggcaagggc

SEQ ID NO: 283112 - RNA, 22 nt, Human
ugaaggcagcgaggcaggaccg

SEQ ID NO: 283113 - RNA, 19 nt, Human
ugacuagauuauucuuggu

SEQ ID NO: 283114 - RNA, 21 nt, Human
ugacuagauuauucuugguuc

SEQ ID NO: 283115 - RNA, 22 nt, Human
ugagaaauacuaugacuggaga

SEQ ID NO: 283116 - RNA, 28 nt, Human
ugccucgcacucccaacuagguuuucua

SEQ ID NO: 283117 - RNA, 21 nt, Human
uuuacaaaggaguaaauguua

SEQ ID NO: 283118 - RNA, 24 nt, Human
uuuuuuuuuaaaagccaguuacuu

SEQ ID NO: 283119 - RNA, 22 nt, Human
uuuuuuuuuuuuaaaagccagu

SEQ ID NO: 283120 - RNA, 23 nt, Human
uuuuuuuuuuuuuuuuuuaaaag

SEQ ID NO: 283121 - RNA, 25 nt, Human
aaccaaaauaaauaaaucagaucug

SEQ ID NO: 283122 - RNA, 19 nt, Human
aagcugcccuuucugugcc

SEQ ID NO: 283123 - RNA, 22 nt, Human
aagcugcccuuucugugccagg

SEQ ID NO: 283124 - RNA, 21 nt, Human
aaggacaucccucgggggcca

SEQ ID NO: 283125 - RNA, 18 nt, Human
aaggggcagucaugggug

SEQ ID NO: 283126 - RNA, 19 nt, Human
acagagcagccagugcccc

SEQ ID NO: 283127 - RNA, 19 nt, Human
accaagacagagcagccag

SEQ ID NO: 283128 - RNA, 21 nt, Human
acccuagaaaccucugccagc

SEQ ID NO: 283129 - RNA, 21 nt, Human
accugagcggggcuuccuggc

SEQ ID NO: 283130 - RNA, 24 nt, Human
agagaggagguggaggguuaacag

SEQ ID NO: 283131 - RNA, 19 nt, Human
agagggcaguggcccaagc

SEQ ID NO: 283132 - RNA, 21 nt, Human
agccugggcagcguguggccu

SEQ ID NO: 283133 - RNA, 19 nt, Human
aggagguggaggguuaaca

SEQ ID NO: 283134 - RNA, 19 nt, Human
aggagguggaggguuaaca

SEQ ID NO: 283135 - RNA, 19 nt, Human
agggaguccaagagaggag

SEQ ID NO: 283136 - RNA, 21 nt, Human
aggugcugccugggcccagga

SEQ ID NO: 283137 - RNA, 25 nt, Human
aguggcccaagcaacccuaggcagc

SEQ ID NO: 283138 - RNA, 19 nt, Human
augaagcuauccuagucuc

SEQ ID NO: 283139 - RNA, 21 nt, Human
caaggcucucuccugccagcu

SEQ ID NO: 283140 - RNA, 23 nt, Human
cacagcaaagaaaacgaugcauc

SEQ ID NO: 283141 - RNA, 18 nt, Human
cacccuagaaaccucugc

SEQ ID NO: 283142 - RNA, 20 nt, Human
cagcgaggagggcgguggug

SEQ ID NO: 283143 - RNA, 25 nt, Human
cagcggaagccagcacacaaggccc

SEQ ID NO: 283144 - RNA, 21 nt, Human
cagcguguggccuguggggca

SEQ ID NO: 283145 - RNA, 20 nt, Human
caggaccaagacagagcagc

SEQ ID NO: 283146 - RNA, 18 nt, Human
caggagccugugccuugc

SEQ ID NO: 283147 - RNA, 24 nt, Human
caucagaaagucuccauuggguua

SEQ ID NO: 283148 - RNA, 21 nt, Human
ccagcacacaaggcccaguuc

SEQ ID NO: 283149 - RNA, 20 nt, Human
cccagccccuccucucccuc

SEQ ID NO: 283150 - RNA, 19 nt, Human
ccccucacccccagccccu

SEQ ID NO: 283151 - RNA, 19 nt, Human
ccccuccucucccucuucu

SEQ ID NO: 283152 - RNA, 19 nt, Human
ccccuuggccauggccugg

SEQ ID NO: 283153 - RNA, 22 nt, Human
ccccuuggccauggccuggccc

SEQ ID NO: 283154 - RNA, 22 nt, Human
ccuccugcuccccccggccucc

SEQ ID NO: 283155 - RNA, 19 nt, Human
ccucgggggcuaccuuucc

SEQ ID NO: 283156 - RNA, 22 nt, Human
ccucgggggcuaccuuuccucc

SEQ ID NO: 283157 - RNA, 30 nt, Human
ccucgggggcuaccuuuccuccuccugcuu

SEQ ID NO: 283158 - RNA, 18 nt, Human
ccucuacagauucuaagg

SEQ ID NO: 283159 - RNA, 26 nt, Human
ccuggccccucacccccagccccucc

SEQ ID NO: 283160 - RNA, 23 nt, Human
ccuggcuacacacagacucugug

SEQ ID NO: 283161 - RNA, 19 nt, Human
ccuuuccuccuccugcucc

SEQ ID NO: 283162 - RNA, 24 nt, Human
ccuuuccuccuccugcuccccccg

SEQ ID NO: 283163 - RNA, 24 nt, Human
cggcuggggcccacccuagaaacc

SEQ ID NO: 283164 - RNA, 20 nt, Human
cgggggcuaccuuuccuccu

SEQ ID NO: 283165 - RNA, 23 nt, Human
cuagaaaccucugccagccaugg

SEQ ID NO: 283166 - RNA, 31 nt, Human
cuaugagagcagagggaggggugguggcacc

SEQ ID NO: 283167 - RNA, 24 nt, Human
cuauucuuuaguugagaagcaagg

SEQ ID NO: 283168 - RNA, 22 nt, Human
cucaaauacaggagccugugcc

SEQ ID NO: 283169 - RNA, 22 nt, Human
cugaagcugcccuuucugugcc

SEQ ID NO: 283170 - RNA, 18 nt, Human
cugccccgggucauccuc

SEQ ID NO: 283171 - RNA, 24 nt, Human
cugccugggcccaggagggguggg

SEQ ID NO: 283172 - RNA, 20 nt, Human
cugggcccaggagggguggg

SEQ ID NO: 283173 - RNA, 20 nt, Human
cuuuccuccuccugcucccc

SEQ ID NO: 283174 - RNA, 20 nt, Human
gagggguggguggggcaugc

SEQ ID NO: 283175 - RNA, 20 nt, Human
gcaucagaaagucuccauug

SEQ ID NO: 283176 - RNA, 20 nt, Human
ggaccaagacagagcagcca

SEQ ID NO: 283177 - RNA, 20 nt, Human
ggagggguggguggggcaug

SEQ ID NO: 283178 - RNA, 26 nt, Human
gggcagcguguggccuggcccggcgg

SEQ ID NO: 283179 - RNA, 24 nt, Human
gggcuuccuggcuacacacagacu

SEQ ID NO: 283180 - RNA, 19 nt, Human
ggggaggauuguggccaga

SEQ ID NO: 283181 - RNA, 18 nt, Human
ggggagggaguccaagag

SEQ ID NO: 283182 - RNA, 19 nt, Human
ggguggggagggaguccaa

SEQ ID NO: 283183 - RNA, 22 nt, Human
ggucagagugauaaaugagggg

SEQ ID NO: 283184 - RNA, 18 nt, Human
gguggggaggauuguggc

SEQ ID NO: 283185 - RNA, 18 nt, Human
ggugguggcacagcgagg

SEQ ID NO: 283186 - RNA, 21 nt, Human
gucagagugauaaaugagggg

SEQ ID NO: 283187 - RNA, 20 nt, Human
gucuccggcucagcuccacc

SEQ ID NO: 283188 - RNA, 20 nt, Human
gugacagcggaagccagcac

SEQ ID NO: 283189 - RNA, 19 nt, Human
gugcugccugggcccagga

SEQ ID NO: 283190 - RNA, 25 nt, Human
guggccagagcugaccccuccccaa

SEQ ID NO: 283191 - RNA, 23 nt, Human
guggggcagccaagcacuggagg

SEQ ID NO: 283192 - RNA, 26 nt, Human
guucacgccacggcuggggcccacca

SEQ ID NO: 283193 - RNA, 21 nt, Human
ucaaauacaggagccugugcc

SEQ ID NO: 283194 - RNA, 19 nt, Human
ucgaaggaacagcagauaa

SEQ ID NO: 283195 - RNA, 23 nt, Human
ucuuuaguugagaagcaaggggc

SEQ ID NO: 283196 - RNA, 23 nt, Human
ugaccccuccccaaggacauccc

SEQ ID NO: 283197 - RNA, 24 nt, Human
ugaccugcuuuggcacagcaaaga

SEQ ID NO: 283198 - RNA, 20 nt, Human
ugagaagcaaggggcaguca

SEQ ID NO: 283199 - RNA, 23 nt, Human
ugagaagcaaggggcagucaugg

SEQ ID NO: 283200 - RNA, 18 nt, Human
ugagagcagagggagggg

SEQ ID NO: 283201 - RNA, 19 nt, Human
ugagagcagagggaggggu

SEQ ID NO: 283202 - RNA, 23 nt, Human
ugcccuuucugugccaggucagg

SEQ ID NO: 283203 - RNA, 19 nt, Human
ugccugggcccaggagggg

SEQ ID NO: 283204 - RNA, 21 nt, Human
ugcuugggccccacacacagc

SEQ ID NO: 283205 - RNA, 25 nt, Human
ugcuuuggcacagcaaagaaaacga

SEQ ID NO: 283206 - RNA, 22 nt, Human
uggagagggcaguggcccaagc

SEQ ID NO: 283207 - RNA, 22 nt, Human
uggcccaagcaacccuaggcag

SEQ ID NO: 283208 - RNA, 24 nt, Human
uggccccucacccccagccccucc

SEQ ID NO: 283209 - RNA, 20 nt, Human
ugggugagacugguggggag

SEQ ID NO: 283210 - RNA, 23 nt, Human
uggguuaaaggagaaagaaagag

SEQ ID NO: 283211 - RNA, 19 nt, Human
ugguggggaggauuguggc

SEQ ID NO: 283212 - RNA, 24 nt, Human
ugguggggaggauuguggccagag

SEQ ID NO: 283213 - RNA, 18 nt, Human
ugugccaggucaggccaa

SEQ ID NO: 283214 - RNA, 18 nt, Human
ugugggcagcgcugaggc

SEQ ID NO: 283215 - RNA, 18 nt, Human
uugagaagcaaggggcag

SEQ ID NO: 283216 - RNA, 20 nt, Human
aacccugucuucaccaagaa

SEQ ID NO: 283217 - RNA, 21 nt, Human
aagaccccgcccagacaagga

SEQ ID NO: 283218 - RNA, 21 nt, Human
aagaccccgcccagacaagga

SEQ ID NO: 283219 - RNA, 21 nt, Human
aagaccccgcccagacaagga

SEQ ID NO: 283220 - RNA, 19 nt, Human
aagccccgcuucguacccc

SEQ ID NO: 283221 - RNA, 19 nt, Human
aagccccgcuucgugcccc

SEQ ID NO: 283222 - RNA, 19 nt, Human
aagccccgcuucgugcccc

SEQ ID NO: 283223 - RNA, 18 nt, Human
aagugcuaguaagcuggc

SEQ ID NO: 283224 - RNA, 21 nt, Human
aagugcuaguaagcuggcuuc

SEQ ID NO: 283225 - RNA, 18 nt, Human
aauggaggagaggcugga

SEQ ID NO: 283226 - RNA, 18 nt, Human
aauggaggagaggcugga

SEQ ID NO: 283227 - RNA, 24 nt, Human
acacagcuccggccccagagcccu

SEQ ID NO: 283228 - RNA, 27 nt, Human
acucugucgccuaggcuggagugugau

SEQ ID NO: 283229 - RNA, 18 nt, Human
acugcaagcuccgccucc

SEQ ID NO: 283230 - RNA, 20 nt, Human
acugcaagcuccgccucccg

SEQ ID NO: 283231 - RNA, 24 nt, Human
agacuacuuugacuggccaggccu

SEQ ID NO: 283232 - RNA, 24 nt, Human
agacuacuuugacuggccaggccu

SEQ ID NO: 283233 - RNA, 20 nt, Human
agagaaguggggaauggagg

SEQ ID NO: 283234 - RNA, 20 nt, Human
agagaaguggggaauggagg

SEQ ID NO: 283235 - RNA, 20 nt, Human
agaguccuuuagggccaccu

SEQ ID NO: 283236 - RNA, 22 nt, Human
agcuccaggcuuacauccuacc

SEQ ID NO: 283237 - RNA, 22 nt, Human
agcuccaggcuuacauccuacc

SEQ ID NO: 283238 - RNA, 22 nt, Human
agcuccaggcuuacauccuacc

SEQ ID NO: 283239 - RNA, 22 nt, Human
agcugcucgccuuucccccucc

SEQ ID NO: 283240 - RNA, 21 nt, Human
agcugcugccugccgucuugg

SEQ ID NO: 283241 - RNA, 20 nt, Human
aggaccacgacccuuaaggc

SEQ ID NO: 283242 - RNA, 20 nt, Human
aggaccacgacccuuaaggc

SEQ ID NO: 283243 - RNA, 20 nt, Human
aggaccacgacccuuaaggc

SEQ ID NO: 283244 - RNA, 19 nt, Human
aggccucgucgacgcccaa

SEQ ID NO: 283245 - RNA, 19 nt, Human
aggccucgucgacgcccaa

SEQ ID NO: 283246 - RNA, 19 nt, Human
aggccucgucgacgcccaa

SEQ ID NO: 283247 - RNA, 18 nt, Human
aggcgcucgcgcgguugg

SEQ ID NO: 283248 - RNA, 22 nt, Human
aggcgguggcaaagaugaucgc

SEQ ID NO: 283249 - RNA, 25 nt, Human
aggcguccucugagaccucaggacc

SEQ ID NO: 283250 - RNA, 22 nt, Human
agggccacauaauguuaucagg

SEQ ID NO: 283251 - RNA, 18 nt, Human
aggggaaggugcuugggg

SEQ ID NO: 283252 - RNA, 18 nt, Human
aggggaaggugcuugggg

SEQ ID NO: 283253 - RNA, 22 nt, Human
aggugguggcaaagaugaucgc

SEQ ID NO: 283254 - RNA, 22 nt, Human
aggugguggcaaagaugaucgc

SEQ ID NO: 283255 - RNA, 21 nt, Human
aggugguggcaaagaugaugc

SEQ ID NO: 283256 - RNA, 20 nt, Human
agugugauggcgcgaucucg

SEQ ID NO: 283257 - RNA, 24 nt, Human
agugugauggcgcgaucucggcuc

SEQ ID NO: 283258 - RNA, 19 nt, Human
aguguugggagguggaaga

SEQ ID NO: 283259 - RNA, 19 nt, Human
aucugcucaugcuuuccuc

SEQ ID NO: 283260 - RNA, 24 nt, Human
augagacuggguggggauggggag

SEQ ID NO: 283261 - RNA, 24 nt, Human
augagacuggguggggauggggag

SEQ ID NO: 283262 - RNA, 21 nt, Human
caacaugagacugggugggga

SEQ ID NO: 283263 - RNA, 21 nt, Human
caacaugagacugggugggga

SEQ ID NO: 283264 - RNA, 21 nt, Human
cacagcaccaccggaaguagg

SEQ ID NO: 283265 - RNA, 18 nt, Human
caccaccggaaguagggc

SEQ ID NO: 283266 - RNA, 18 nt, Human
cacucggggcgcuaacga

SEQ ID NO: 283267 - RNA, 22 nt, Human
cacucugucgccuaggcuggag

SEQ ID NO: 283268 - RNA, 24 nt, Human
cacucugucgccuaggcuggagug

SEQ ID NO: 283269 - RNA, 18 nt, Human
cacugcuucuuaaaguuc

SEQ ID NO: 283270 - RNA, 18 nt, Human
cacugcuucuuaaaguuc

SEQ ID NO: 283271 - RNA, 18 nt, Human
cacugcuucuuaaaguuc

SEQ ID NO: 283272 - RNA, 18 nt, Human
cacugcuucuuaaaguuc

SEQ ID NO: 283273 - RNA, 20 nt, Human
cacugggguugggacagggg

SEQ ID NO: 283274 - RNA, 19 nt, Human
cagcaccaccggaaguagg

SEQ ID NO: 283275 - RNA, 18 nt, Human
cagccugccuucuagucg

SEQ ID NO: 283276 - RNA, 21 nt, Human
cagcugcugccugccgucuug

SEQ ID NO: 283277 - RNA, 23 nt, Human
cagcugcugccugccgucuuggg

SEQ ID NO: 283278 - RNA, 20 nt, Human
caggaaauauauuuggccau

SEQ ID NO: 283279 - RNA, 20 nt, Human
caggaaauauauuuggccau

SEQ ID NO: 283280 - RNA, 20 nt, Human
caggaaauauauuuggccau

SEQ ID NO: 283281 - RNA, 21 nt, Human
caggcucuccccaggcggugg

SEQ ID NO: 283282 - RNA, 27 nt, Human
cagggccgaaggcaaugagaauccacu

SEQ ID NO: 283283 - RNA, 20 nt, Human
cagggugccccaucuagccu

SEQ ID NO: 283284 - RNA, 19 nt, Human
caggugguggcaaagauga

SEQ ID NO: 283285 - RNA, 19 nt, Human
caggugguggcaaagauga

SEQ ID NO: 283286 - RNA, 19 nt, Human
caggugguggcaaagauga

SEQ ID NO: 283287 - RNA, 21 nt, Human
caucugggcgccccgcgguuc

SEQ ID NO: 283288 - RNA, 19 nt, Human
ccaacuguacacauaaucc

SEQ ID NO: 283289 - RNA, 19 nt, Human
ccaacuguacacauaaucc

SEQ ID NO: 283290 - RNA, 19 nt, Human
ccaacuguacacauaaucc

SEQ ID NO: 283291 - RNA, 22 nt, Human
ccacagcaccaccggaaguagg

SEQ ID NO: 283292 - RNA, 19 nt, Human
ccacugggucugggcugga

SEQ ID NO: 283293 - RNA, 20 nt, Human
ccagaagcccaucagguuga

SEQ ID NO: 283294 - RNA, 24 nt, Human
ccagcugcucgccuuucccccucc

SEQ ID NO: 283295 - RNA, 21 nt, Human
ccaggggagagacuacuuuga

SEQ ID NO: 283296 - RNA, 21 nt, Human
ccaggggagagacuacuuuga

SEQ ID NO: 283297 - RNA, 18 nt, Human
ccagggugccccaucuag

SEQ ID NO: 283298 - RNA, 18 nt, Human
ccaucucuggagccaggg

SEQ ID NO: 283299 - RNA, 18 nt, Human
cccaaagaccccgcccag

SEQ ID NO: 283300 - RNA, 18 nt, Human
cccaaagaccccgcccag

SEQ ID NO: 283301 - RNA, 19 nt, Human
cccaaagaccccgcccaga

SEQ ID NO: 283302 - RNA, 19 nt, Human
cccaaagaccccgcccaga

SEQ ID NO: 283303 - RNA, 19 nt, Human
cccaaagaccccgcccaga

SEQ ID NO: 283304 - RNA, 21 nt, Human
cccaccccaucuuguugugca

SEQ ID NO: 283305 - RNA, 21 nt, Human
cccaccccaucuuguugugca

SEQ ID NO: 283306 - RNA, 20 nt, Human
ccccagagccugugggcgcg

SEQ ID NO: 283307 - RNA, 20 nt, Human
ccccagagccugugggcgcg

SEQ ID NO: 283308 - RNA, 20 nt, Human
ccccagagccugugggcgcg

SEQ ID NO: 283309 - RNA, 18 nt, Human
cccgauaggggggccuuc

SEQ ID NO: 283310 - RNA, 18 nt, Human
cccgauaggggggccuuc

SEQ ID NO: 283311 - RNA, 20 nt, Human
cccgcccccuccuugcgacu

SEQ ID NO: 283312 - RNA, 20 nt, Human
cccgcccccuccuugcgacu

SEQ ID NO: 283313 - RNA, 20 nt, Human
cccgcccccuccuugcgacu

SEQ ID NO: 283314 - RNA, 18 nt, Human
cccgcuaagcuuguccca

SEQ ID NO: 283315 - RNA, 25 nt, Human
cccuccuugcgacuuaucuucuccc

SEQ ID NO: 283316 - RNA, 25 nt, Human
cccuccuugcgacuuaucuucuccc

SEQ ID NO: 283317 - RNA, 18 nt, Human
cccugaggcagccugccu

SEQ ID NO: 283318 - RNA, 19 nt, Human
ccgaaggcaaugagaaucc

SEQ ID NO: 283319 - RNA, 20 nt, Human
ccgccggccgccacagcugc

SEQ ID NO: 283320 - RNA, 24 nt, Human
ccgccggccgccacagcugcugcc

SEQ ID NO: 283321 - RNA, 25 nt, Human
ccgccggccgccacagcugcugccu

SEQ ID NO: 283322 - RNA, 22 nt, Human
ccuaccagcucaacaggagacu

SEQ ID NO: 283323 - RNA, 22 nt, Human
ccuaccagcucaacaggagacu

SEQ ID NO: 283324 - RNA, 19 nt, Human
ccucccggguucaagcgau

SEQ ID NO: 283325 - RNA, 20 nt, Human
ccucgcccacacggugcugu

SEQ ID NO: 283326 - RNA, 20 nt, Human
ccucgcccacacggugcugu

SEQ ID NO: 283327 - RNA, 20 nt, Human
ccucgcccacacggugcugu

SEQ ID NO: 283328 - RNA, 21 nt, Human
ccucugagaccucaggacauc

SEQ ID NO: 283329 - RNA, 21 nt, Human
ccucugagaccucaggacauc

SEQ ID NO: 283330 - RNA, 22 nt, Human
ccucugagaccucaggacauca

SEQ ID NO: 283331 - RNA, 21 nt, Human
ccuucucggaggugauccugg

SEQ ID NO: 283332 - RNA, 22 nt, Human
ccuugcgacuuaucuucucccg

SEQ ID NO: 283333 - RNA, 22 nt, Human
ccuugcgacuuaucuucucccg

SEQ ID NO: 283334 - RNA, 22 nt, Human
ccuugcgacuuaucuucucccg

SEQ ID NO: 283335 - RNA, 25 nt, Human
ccuugggccgccucccacgaacccu

SEQ ID NO: 283336 - RNA, 22 nt, Human
cgaaggcaaugagaauccacug

SEQ ID NO: 283337 - RNA, 21 nt, Human
cgacuuaucuucucccgcccc

SEQ ID NO: 283338 - RNA, 21 nt, Human
cgacuuaucuucucccgcccc

SEQ ID NO: 283339 - RNA, 21 nt, Human
cgacuuaucuucucccgcccc

SEQ ID NO: 283340 - RNA, 21 nt, Human
cgccacagcugcugccugccg

SEQ ID NO: 283341 - RNA, 20 nt, Human
cgcccccuccuugcgacuua

SEQ ID NO: 283342 - RNA, 20 nt, Human
cgcccccuccuugcgacuua

SEQ ID NO: 283343 - RNA, 20 nt, Human
cgcccccuccuugcgacuua

SEQ ID NO: 283344 - RNA, 24 nt, Human
cggugcuguuuaacaaccuucccu

SEQ ID NO: 283345 - RNA, 24 nt, Human
cggugcuguuuaacaaccuucccu

SEQ ID NO: 283346 - RNA, 20 nt, Human
cuaaaaaaguucccggguga

SEQ ID NO: 283347 - RNA, 20 nt, Human
cuaaaaaaguucccggguga

SEQ ID NO: 283348 - RNA, 20 nt, Human
cuaaaaaaguucccggguga

SEQ ID NO: 283349 - RNA, 24 nt, Human
cucacucugucgccuaggcuggag

SEQ ID NO: 283350 - RNA, 19 nt, Human
cuccccaacaugagacugg

SEQ ID NO: 283351 - RNA, 19 nt, Human
cuccccaacaugagacugg

SEQ ID NO: 283352 - RNA, 20 nt, Human
cucgaauuagcagaaaaagg

SEQ ID NO: 283353 - RNA, 20 nt, Human
cucgaauuagcagaaaaagg

SEQ ID NO: 283354 - RNA, 20 nt, Human
cucgaauuagcagaaaaagg

SEQ ID NO: 283355 - RNA, 23 nt, Human
cucugucgccuaggcuggagugu

SEQ ID NO: 283356 - RNA, 19 nt, Human
cugaacagcaccuguagga

SEQ ID NO: 283357 - RNA, 20 nt, Human
cugcgcuuugcugguggcuc

SEQ ID NO: 283358 - RNA, 23 nt, Human
cuggggcggugguggaagagucc

SEQ ID NO: 283359 - RNA, 19 nt, Human
cuguggccaggggagagac

SEQ ID NO: 283360 - RNA, 19 nt, Human
cuguggccaggggagagac

SEQ ID NO: 283361 - RNA, 18 nt, Human
cuguguggggaggagggu

SEQ ID NO: 283362 - RNA, 20 nt, Human
cuucucggaggugauccugg

SEQ ID NO: 283363 - RNA, 22 nt, Human
cuuugcugguggcuccucccgg

SEQ ID NO: 283364 - RNA, 19 nt, Human
gaaugggacguuugccggg

SEQ ID NO: 283365 - RNA, 30 nt, Human
gaaugggacguuugccggggguuugucuuc

SEQ ID NO: 283366 - RNA, 20 nt, Human
gacuuaucuucucccgcccc

SEQ ID NO: 283367 - RNA, 20 nt, Human
gacuuaucuucucccgcccc

SEQ ID NO: 283368 - RNA, 20 nt, Human
gacuuaucuucucccgcccc

SEQ ID NO: 283369 - RNA, 19 nt, Human
gagaauccacugggguugg

SEQ ID NO: 283370 - RNA, 18 nt, Human
gagccacguccuucccca

SEQ ID NO: 283371 - RNA, 23 nt, Human
gagggccacauaauguuaucagg

SEQ ID NO: 283372 - RNA, 23 nt, Human
gagggccacauaauguuaucagg

SEQ ID NO: 283373 - RNA, 19 nt, Human
gauggcaugaaaaagcagg

SEQ ID NO: 283374 - RNA, 24 nt, Human
gcaggcucuccccaggcgguggca

SEQ ID NO: 283375 - RNA, 25 nt, Human
gcaggcucuccccaggcgguggcaa

SEQ ID NO: 283376 - RNA, 25 nt, Human
gcaggcucuccccaggugguggcaa

SEQ ID NO: 283377 - RNA, 25 nt, Human
gcaggcucuccccaggugguggcaa

SEQ ID NO: 283378 - RNA, 19 nt, Human
gcauuucuuuuuuuuucuu

SEQ ID NO: 283379 - RNA, 19 nt, Human
gcauuucuuuuuuuuucuu

SEQ ID NO: 283380 - RNA, 19 nt, Human
gcauuucuuuuuuuuucuu

SEQ ID NO: 283381 - RNA, 20 nt, Human
gcauuucuuuuuuuuuucuu

SEQ ID NO: 283382 - RNA, 19 nt, Human
gcccaaagaccccgcccag

SEQ ID NO: 283383 - RNA, 19 nt, Human
gcccaaagaccccgcccag

SEQ ID NO: 283384 - RNA, 23 nt, Human
gcccagacaaggaccacgacccu

SEQ ID NO: 283385 - RNA, 23 nt, Human
gcccagacaaggaccacgacccu

SEQ ID NO: 283386 - RNA, 23 nt, Human
gcccagacaaggaccacgacccu

SEQ ID NO: 283387 - RNA, 18 nt, Human
gccccgccuacccagaac

SEQ ID NO: 283388 - RNA, 18 nt, Human
gccccgccuacccagaac

SEQ ID NO: 283389 - RNA, 18 nt, Human
gccccgccuacccagaac

SEQ ID NO: 283390 - RNA, 19 nt, Human
gcccugaggcagccugccu

SEQ ID NO: 283391 - RNA, 18 nt, Human
gccuaggcuggaguguga

SEQ ID NO: 283392 - RNA, 20 nt, Human
gccucccacgaacccugucu

SEQ ID NO: 283393 - RNA, 18 nt, Human
gcuaacgaguuccaucug

SEQ ID NO: 283394 - RNA, 18 nt, Human
gcuggagugugauggcgc

SEQ ID NO: 283395 - RNA, 20 nt, Human
ggaagcugggguuccaguuc

SEQ ID NO: 283396 - RNA, 18 nt, Human
ggaauggaggagaggcug

SEQ ID NO: 283397 - RNA, 22 nt, Human
ggagaggcuggagggaagcugg

SEQ ID NO: 283398 - RNA, 22 nt, Human
ggagaggcuggagggaagcugg

SEQ ID NO: 283399 - RNA, 21 nt, Human
ggagguggaagaauccuuggg

SEQ ID NO: 283400 - RNA, 21 nt, Human
gggaagauaaaaccauccuua

SEQ ID NO: 283401 - RNA, 21 nt, Human
gggaagauaaaaccauccuua

SEQ ID NO: 283402 - RNA, 21 nt, Human
gggaagauaaaaccauccuua

SEQ ID NO: 283403 - RNA, 18 nt, Human
gggaagcugggguuccag

SEQ ID NO: 283404 - RNA, 18 nt, Human
gggaagcugggguuccag

SEQ ID NO: 283405 - RNA, 21 nt, Human
gggaagcugggguuccaguuc

SEQ ID NO: 283406 - RNA, 20 nt, Human
gggaauggaggagaggcugg

SEQ ID NO: 283407 - RNA, 19 nt, Human
ggggaaggugcuuggggaa

SEQ ID NO: 283408 - RNA, 19 nt, Human
ggggaaggugcuuggggaa

SEQ ID NO: 283409 - RNA, 22 nt, Human
ggggauggggagagagaagugg

SEQ ID NO: 283410 - RNA, 22 nt, Human
ggggauggggagagagaagugg

SEQ ID NO: 283411 - RNA, 22 nt, Human
ggggcggugguggaagagucca

SEQ ID NO: 283412 - RNA, 19 nt, Human
gggguugggacaggggugg

SEQ ID NO: 283413 - RNA, 20 nt, Human
ggguggagucugugugggga

SEQ ID NO: 283414 - RNA, 21 nt, Human
ggguggggauggggagagaga

SEQ ID NO: 283415 - RNA, 21 nt, Human
ggguggggauggggagagaga

SEQ ID NO: 283416 - RNA, 18 nt, Human
ggucacagaacccauagg

SEQ ID NO: 283417 - RNA, 18 nt, Human
ggucacagaacccauagg

SEQ ID NO: 283418 - RNA, 20 nt, Human
ggucugggcuggaggagagg

SEQ ID NO: 283419 - RNA, 20 nt, Human
guccuuuagggccaccuggg

SEQ ID NO: 283420 - RNA, 25 nt, Human
guggggaggaggguacacugggguc

SEQ ID NO: 283421 - RNA, 24 nt, Human
guuaauuucauucccaagcaggcu

SEQ ID NO: 283422 - RNA, 24 nt, Human
guuaauuucauucccaagcaggcu

SEQ ID NO: 283423 - RNA, 21 nt, Human
guuccuuuuuaagaaccuguu

SEQ ID NO: 283424 - RNA, 25 nt, Human
uaaaaaaguucccgggugaugcuga

SEQ ID NO: 283425 - RNA, 25 nt, Human
uaaaaaaguucccgggugaugcuga

SEQ ID NO: 283426 - RNA, 25 nt, Human
uaaaaaaguucccgggugaugcuga

SEQ ID NO: 283427 - RNA, 19 nt, Human
uaaaaccauccuuagcgcu

SEQ ID NO: 283428 - RNA, 19 nt, Human
uaaaaccauccuuagcgcu

SEQ ID NO: 283429 - RNA, 19 nt, Human
uaaaaccauccuuagcgcu

SEQ ID NO: 283430 - RNA, 26 nt, Human
uaaagggaagauaaaaccauccuuag

SEQ ID NO: 283431 - RNA, 26 nt, Human
uaaagggaagauaaaaccauccuuag

SEQ ID NO: 283432 - RNA, 26 nt, Human
uaaagggaagauaaaaccauccuuag

SEQ ID NO: 283433 - RNA, 24 nt, Human
uaagaaccuguucuaaaacacugc

SEQ ID NO: 283434 - RNA, 24 nt, Human
uaagaaccuguucuaaaacacugc

SEQ ID NO: 283435 - RNA, 24 nt, Human
uaagaaccuguucuaaaacacugc

SEQ ID NO: 283436 - RNA, 24 nt, Human
uaagaaccuguucuaaaacacugc

SEQ ID NO: 283437 - RNA, 19 nt, Human
uaagaggacgcagaagcug

SEQ ID NO: 283438 - RNA, 19 nt, Human
uaagaggacgcagaagcug

SEQ ID NO: 283439 - RNA, 23 nt, Human
uacuuugacuggccaggccuggg

SEQ ID NO: 283440 - RNA, 19 nt, Human
uagcauagggauuuggggu

SEQ ID NO: 283441 - RNA, 20 nt, Human
uagcuccaggcuuacauccu

SEQ ID NO: 283442 - RNA, 20 nt, Human
uagcuccaggcuuacauccu

SEQ ID NO: 283443 - RNA, 20 nt, Human
uagcuccaggcuuacauccu

SEQ ID NO: 283444 - RNA, 23 nt, Human
uaggaggguggagucuguguggg

SEQ ID NO: 283445 - RNA, 22 nt, Human
ucaaggccuuuaggcguccucu

SEQ ID NO: 283446 - RNA, 24 nt, Human
ucacucugucgccuaggcuggagu

SEQ ID NO: 283447 - RNA, 18 nt, Human
ucacugcaagcuccgccu

SEQ ID NO: 283448 - RNA, 19 nt, Human
ucacugcaagcuccgccuc

SEQ ID NO: 283449 - RNA, 24 nt, Human
ucacugcaagcuccgccucccggg

SEQ ID NO: 283450 - RNA, 19 nt, Human
ucagggugggcgggccguu

SEQ ID NO: 283451 - RNA, 22 nt, Human
uccaaaagcccagggguagacc

SEQ ID NO: 283452 - RNA, 22 nt, Human
uccaaaagcccagggguagacc

SEQ ID NO: 283453 - RNA, 22 nt, Human
uccaaaagcccagggguagacc

SEQ ID NO: 283454 - RNA, 18 nt, Human
uccacagcaggcaccgcc

SEQ ID NO: 283455 - RNA, 18 nt, Human
uccacagcaggcaccgcc

SEQ ID NO: 283456 - RNA, 18 nt, Human
uccacagcaggcaccgcc

SEQ ID NO: 283457 - RNA, 21 nt, Human
uccacugggguugggacaggg

SEQ ID NO: 283458 - RNA, 19 nt, Human
uccagggugccccaucuag

SEQ ID NO: 283459 - RNA, 21 nt, Human
ucccaagcaggaucuccccag

SEQ ID NO: 283460 - RNA, 24 nt, Human
ucccacgaacccugucuucaccaa

SEQ ID NO: 283461 - RNA, 22 nt, Human
ucccgccggccgccacagcugc

SEQ ID NO: 283462 - RNA, 22 nt, Human
uccuuggggaacagggccgaag

SEQ ID NO: 283463 - RNA, 23 nt, Human
uccuuggggaacagggccgaagg

SEQ ID NO: 283464 - RNA, 18 nt, Human
ucgccuaggcuggagugu

SEQ ID NO: 283465 - RNA, 22 nt, Human
ucuaaaacacugcuucuuaaag

SEQ ID NO: 283466 - RNA, 22 nt, Human
ucuaaaacacugcuucuuaaag

SEQ ID NO: 283467 - RNA, 22 nt, Human
ucuaaaacacugcuucuuaaag

SEQ ID NO: 283468 - RNA, 22 nt, Human
ucuaaaacacugcuucuuaaag

SEQ ID NO: 283469 - RNA, 23 nt, Human
ucucacucugucgccuaggcugg

SEQ ID NO: 283470 - RNA, 24 nt, Human
ucucacucugucgccuaggcugga

SEQ ID NO: 283471 - RNA, 19 nt, Human
ucucagguuggacuuccuu

SEQ ID NO: 283472 - RNA, 19 nt, Human
ucucagguuggacuuccuu

SEQ ID NO: 283473 - RNA, 23 nt, Human
ucuccccaggcgguggcaaagau

SEQ ID NO: 283474 - RNA, 20 nt, Human
ucuccccaggugguggcaaa

SEQ ID NO: 283475 - RNA, 20 nt, Human
ucuccccaggugguggcaaa

SEQ ID NO: 283476 - RNA, 20 nt, Human
ucuccccaggugguggcaaa

SEQ ID NO: 283477 - RNA, 21 nt, Human
ucugccagcugcucgccuuuc

SEQ ID NO: 283478 - RNA, 24 nt, Human
ucugucgccuaggcuggaguguga

SEQ ID NO: 283479 - RNA, 18 nt, Human
ucuucuggguucuccagg

SEQ ID NO: 283480 - RNA, 18 nt, Human
ucuucuggguucuccagg

SEQ ID NO: 283481 - RNA, 22 nt, Human
ugaccaucucuggagccagggg

SEQ ID NO: 283482 - RNA, 22 nt, Human
ugaccaucucuggagccagggg

SEQ ID NO: 283483 - RNA, 20 nt, Human
ugacccaggauccaaagcag

SEQ ID NO: 283484 - RNA, 20 nt, Human
ugacccaggauccaaagcag

SEQ ID NO: 283485 - RNA, 20 nt, Human
ugacccaggauccaaagcag

SEQ ID NO: 283486 - RNA, 18 nt, Human
ugacuggccaggccuggg

SEQ ID NO: 283487 - RNA, 22 nt, Human
ugagacggagucucacucuguc

SEQ ID NO: 283488 - RNA, 19 nt, Human
ugagcauacaaaucaccug

SEQ ID NO: 283489 - RNA, 19 nt, Human
ugagcauacaaaucaccug

SEQ ID NO: 283490 - RNA, 19 nt, Human
ugagcauacaaaucaccug

SEQ ID NO: 283491 - RNA, 19 nt, Human
ugagcauacaaaucaccug

SEQ ID NO: 283492 - RNA, 19 nt, Human
ugagguagucacagggagg

SEQ ID NO: 283493 - RNA, 19 nt, Human
ugagguagucacagggagg

SEQ ID NO: 283494 - RNA, 18 nt, Human
ugagugacuaggggaggg

SEQ ID NO: 283495 - RNA, 18 nt, Human
ugagugacuaggggaggg

SEQ ID NO: 283496 - RNA, 23 nt, Human
ugcauuucuuuuuuuuucuuuuu

SEQ ID NO: 283497 - RNA, 23 nt, Human
ugcauuucuuuuuuuuucuuuuu

SEQ ID NO: 283498 - RNA, 18 nt, Human
ugccccaucuagccuucc

SEQ ID NO: 283499 - RNA, 21 nt, Human
ugccucgcccuuugcggguca

SEQ ID NO: 283500 - RNA, 21 nt, Human
ugccucgcccuuugcggguca

SEQ ID NO: 283501 - RNA, 21 nt, Human
ugccucgcccuuugcggguca

SEQ ID NO: 283502 - RNA, 24 nt, Human
uggagugugauggcgcgaucucgg

SEQ ID NO: 283503 - RNA, 24 nt, Human
uggauccagagggccacauaaugu

SEQ ID NO: 283504 - RNA, 24 nt, Human
uggauccagagggccacauaaugu

SEQ ID NO: 283505 - RNA, 24 nt, Human
uggauccagagggccacauaaugu

SEQ ID NO: 283506 - RNA, 24 nt, Human
uggcagaagauaagaggacgcaga

SEQ ID NO: 283507 - RNA, 24 nt, Human
uggcagaagauaagaggacgcaga

SEQ ID NO: 283508 - RNA, 21 nt, Human
uggcaugaaaaagcagggagc

SEQ ID NO: 283509 - RNA, 18 nt, Human
ugggagguggaagaaucc

SEQ ID NO: 283510 - RNA, 24 nt, Human
ugggagguggaagaauccuugggg

SEQ ID NO: 283511 - RNA, 25 nt, Human
ugggagguggaagaauccuugggga

SEQ ID NO: 283512 - RNA, 20 nt, Human
ugggcccagaagcccaucag

SEQ ID NO: 283513 - RNA, 18 nt, Human
ugggcgcgcacagcugug

SEQ ID NO: 283514 - RNA, 18 nt, Human
ugggcgcgcacagcugug

SEQ ID NO: 283515 - RNA, 18 nt, Human
ugggcgcgcacagcugug

SEQ ID NO: 283516 - RNA, 18 nt, Human
uggggcugggcccagaag

SEQ ID NO: 283517 - RNA, 24 nt, Human
uggggcugggcccagaagcccauc

SEQ ID NO: 283518 - RNA, 19 nt, Human
ugggguugggacaggggug

SEQ ID NO: 283519 - RNA, 25 nt, Human
ugggguugggacagggguggcugga

SEQ ID NO: 283520 - RNA, 20 nt, Human
ugggucugggcuggaggaga

SEQ ID NO: 283521 - RNA, 18 nt, Human
uggguggggauggggaga

SEQ ID NO: 283522 - RNA, 18 nt, Human
uggguggggauggggaga

SEQ ID NO: 283523 - RNA, 20 nt, Human
uguaauaaagggaagauaaa

SEQ ID NO: 283524 - RNA, 20 nt, Human
uguaauaaagggaagauaaa

SEQ ID NO: 283525 - RNA, 20 nt, Human
uguaauaaagggaagauaaa

SEQ ID NO: 283526 - RNA, 20 nt, Human
uguccagggugccccaucua

SEQ ID NO: 283527 - RNA, 19 nt, Human
ugucgccuaggcuggagug

SEQ ID NO: 283528 - RNA, 20 nt, Human
ugucucccucaauauccccc

SEQ ID NO: 283529 - RNA, 20 nt, Human
ugucucccucaauauccccc

SEQ ID NO: 283530 - RNA, 19 nt, Human
uguuucacuuaauuccucc

SEQ ID NO: 283531 - RNA, 19 nt, Human
uguuucacuuaauuccucc

SEQ ID NO: 283532 - RNA, 19 nt, Human
uguuucacuuaauuccucc

SEQ ID NO: 283533 - RNA, 22 nt, Human
uuagcgcugucucccucaauau

SEQ ID NO: 283534 - RNA, 22 nt, Human
uuagcgcugucucccucaauau

SEQ ID NO: 283535 - RNA, 27 nt, Human
uuagcgcugucucccucaauauccccc

SEQ ID NO: 283536 - RNA, 27 nt, Human
uuagcgcugucucccucaauauccccc

SEQ ID NO: 283537 - RNA, 20 nt, Human
uucucagguuggacuuccuu

SEQ ID NO: 283538 - RNA, 20 nt, Human
uucucagguuggacuuccuu

SEQ ID NO: 283539 - RNA, 18 nt, Human
uucuggguucuccagggg

SEQ ID NO: 283540 - RNA, 22 nt, Human
uucuuuguccagggugccccau

SEQ ID NO: 283541 - RNA, 22 nt, Human
uucuuuguccagggugccccau

SEQ ID NO: 283542 - RNA, 24 nt, Human
uuguaauaaagggaagauaaaacc

SEQ ID NO: 283543 - RNA, 24 nt, Human
uuguaauaaagggaagauaaaacc

SEQ ID NO: 283544 - RNA, 24 nt, Human
uuguaauaaagggaagauaaaacc

SEQ ID NO: 283545 - RNA, 18 nt, Human
uugugaauccccucuccc

SEQ ID NO: 283546 - RNA, 23 nt, Human
uuucugcgcuuugcugguggcuc

SEQ ID NO: 283547 - RNA, 18 nt, Human
uuuucuuuuuuuugaccc

SEQ ID NO: 283548 - RNA, 18 nt, Human
uuuucuuuuuuuugaccc

SEQ ID NO: 283549 - RNA, 18 nt, Human
uuuucuuuuuuuugaccc

SEQ ID NO: 283550 - RNA, 26 nt, Human
uuuuuuuucuuugagacggagucuca

SEQ ID NO: 283551 - RNA, 18 nt, Human
uuuuuuuucuuuuuuuug

SEQ ID NO: 283552 - RNA, 20 nt, Human
uuuuuuuuucuuuuuuuugg

SEQ ID NO: 283553 - RNA, 20 nt, Human
uuuuuuuuucuuuuuuuugg

SEQ ID NO: 283554 - RNA, 20 nt, Human
uuuuuuuuucuuuuuuuugg

SEQ ID NO: 283555 - RNA, 18 nt, Human
uuuuuuuuuuuuuuuuug

SEQ ID NO: 283556 - RNA, 18 nt, Human
uuuuuuuuuuuuuuuuug

SEQ ID NO: 283557 - RNA, 26 nt, Human
uuuuuuuuuuuuuuuuugauccuuuu

SEQ ID NO: 283558 - RNA, 26 nt, Human
uuuuuuuuuuuuuuuuugauccuuuu

SEQ ID NO: 283559 - RNA, 26 nt, Human
uuuuuuuuuuuuuuuuugauccuuuu

SEQ ID NO: 283560 - RNA, 27 nt, Human
uuuuuuuuuuuuuuuuuuuuuuugggg

SEQ ID NO: 283561 - RNA, 24 nt, Human
aaaacagaagcaaaugcuuaaaaa

SEQ ID NO: 283562 - RNA, 18 nt, Human
aaacaucugacauucuag

SEQ ID NO: 283563 - RNA, 18 nt, Human
aaacaucugacauucuag

SEQ ID NO: 283564 - RNA, 20 nt, Human
aaagacuuugccauagagaa

SEQ ID NO: 283565 - RNA, 20 nt, Human
aaagacuuugccauagagaa

SEQ ID NO: 283566 - RNA, 19 nt, Human
aaagaguugaaaguuucuu

SEQ ID NO: 283567 - RNA, 19 nt, Human
aaagaguugaaaguuucuu

SEQ ID NO: 283568 - RNA, 20 nt, Human
aaagaguugaaaguuucuug

SEQ ID NO: 283569 - RNA, 20 nt, Human
aaagaguugaaaguuucuug

SEQ ID NO: 283570 - RNA, 21 nt, Human
aaauuccuucaaaaugagaua

SEQ ID NO: 283571 - RNA, 21 nt, Human
aagguuaauauuaaaccaaua

SEQ ID NO: 283572 - RNA, 20 nt, Human
acaacuugauuucaauacau

SEQ ID NO: 283573 - RNA, 20 nt, Human
acaacuugauuucaauacau

SEQ ID NO: 283574 - RNA, 24 nt, Human
acaugauuuuuaaaugguagucua

SEQ ID NO: 283575 - RNA, 24 nt, Human
acucucuuuuucccuggaaauaaa

SEQ ID NO: 283576 - RNA, 18 nt, Human
agacuuagaauguuaaua

SEQ ID NO: 283577 - RNA, 18 nt, Human
agacuuagaauguuaaua

SEQ ID NO: 283578 - RNA, 23 nt, Human
aggugacuggaaguuaauaaacu

SEQ ID NO: 283579 - RNA, 23 nt, Human
aggugacuggaaguuaauaaacu

SEQ ID NO: 283580 - RNA, 23 nt, Human
aggugacuggaaguuaauaaacu

SEQ ID NO: 283581 - RNA, 21 nt, Human
aguaagggccagagaacagua

SEQ ID NO: 283582 - RNA, 23 nt, Human
auugugaauauucaguuuguuac

SEQ ID NO: 283583 - RNA, 23 nt, Human
auugugaauauucaguuuguuac

SEQ ID NO: 283584 - RNA, 18 nt, Human
caaaaaucaaggugacug

SEQ ID NO: 283585 - RNA, 18 nt, Human
caaaaaucaaggugacug

SEQ ID NO: 283586 - RNA, 18 nt, Human
caaaaaucaaggugacug

SEQ ID NO: 283587 - RNA, 18 nt, Human
cacaaaauaacgagaaag

SEQ ID NO: 283588 - RNA, 18 nt, Human
cacaaaauaacgagaaag

SEQ ID NO: 283589 - RNA, 18 nt, Human
cacaguccggacucaugu

SEQ ID NO: 283590 - RNA, 21 nt, Human
cagaaaguguuacucagaagc

SEQ ID NO: 283591 - RNA, 21 nt, Human
cagaaaguguuacucagaagc

SEQ ID NO: 283592 - RNA, 22 nt, Human
caguaagggccagagaacagua

SEQ ID NO: 283593 - RNA, 18 nt, Human
caguauuuaacccuuagu

SEQ ID NO: 283594 - RNA, 23 nt, Human
caguccggacucauguuucuaaa

SEQ ID NO: 283595 - RNA, 23 nt, Human
caguccggacucauguuucuaaa

SEQ ID NO: 283596 - RNA, 18 nt, Human
cauaaaagaagaaugagc

SEQ ID NO: 283597 - RNA, 26 nt, Human
cauuaccagaaaguaaaauaacuuga

SEQ ID NO: 283598 - RNA, 26 nt, Human
cauuaccagaaaguaaaauaacuuga

SEQ ID NO: 283599 - RNA, 18 nt, Human
ccagaaaguaaaauaacu

SEQ ID NO: 283600 - RNA, 18 nt, Human
ccagaaaguaaaauaacu

SEQ ID NO: 283601 - RNA, 24 nt, Human
ccagaaaguaaaauaacuugaaca

SEQ ID NO: 283602 - RNA, 24 nt, Human
ccagaaaguaaaauaacuugaaca

SEQ ID NO: 283603 - RNA, 22 nt, Human
cgcaguaagggccagagaacag

SEQ ID NO: 283604 - RNA, 22 nt, Human
cgcaguaagggccagagaacag

SEQ ID NO: 283605 - RNA, 21 nt, Human
cucuuuuucccuggaaauaaa

SEQ ID NO: 283606 - RNA, 22 nt, Human
cugaaaaacaucugacauucua

SEQ ID NO: 283607 - RNA, 22 nt, Human
cugaaaaacaucugacauucua

SEQ ID NO: 283608 - RNA, 24 nt, Human
cugacugugggacaaaacucucuu

SEQ ID NO: 283609 - RNA, 24 nt, Human
cugacugugggacaaaacucucuu

SEQ ID NO: 283610 - RNA, 24 nt, Human
cugacugugggacaaaacucucuu

SEQ ID NO: 283611 - RNA, 20 nt, Human
cuguuuugaaguuuuuugug

SEQ ID NO: 283612 - RNA, 21 nt, Human
gcuguuuugaaguuuuuugug

SEQ ID NO: 283613 - RNA, 18 nt, Human
gggcauuuauauaaaaac

SEQ ID NO: 283614 - RNA, 18 nt, Human
gggcauuuauauaaaaac

SEQ ID NO: 283615 - RNA, 23 nt, Human
uaaaaacaugauauuuaaauggu

SEQ ID NO: 283616 - RNA, 22 nt, Human
uaaaagaagaaugagcgaucau

SEQ ID NO: 283617 - RNA, 22 nt, Human
uaaaagaagaaugagcgaucau

SEQ ID NO: 283618 - RNA, 23 nt, Human
uaaacuaguggccugcugacugu

SEQ ID NO: 283619 - RNA, 23 nt, Human
uaaacuaguggccugcugacugu

SEQ ID NO: 283620 - RNA, 23 nt, Human
uaaacuaguggccugcugacugu

SEQ ID NO: 283621 - RNA, 21 nt, Human
uaacugaaaaacaucugacau

SEQ ID NO: 283622 - RNA, 21 nt, Human
uaacugaaaaacaucugacau

SEQ ID NO: 283623 - RNA, 19 nt, Human
uacacagagacaacuugau

SEQ ID NO: 283624 - RNA, 18 nt, Human
uacucauuguugagacag

SEQ ID NO: 283625 - RNA, 24 nt, Human
uagauaaagaaaauauuuuacuga

SEQ ID NO: 283626 - RNA, 24 nt, Human
uagauaaagaaaauauuuuacuga

SEQ ID NO: 283627 - RNA, 19 nt, Human
uagcaguuuuuauguauca

SEQ ID NO: 283628 - RNA, 19 nt, Human
uaucuugaggucaacuuug

SEQ ID NO: 283629 - RNA, 19 nt, Human
uaucuugaggucaacuuug

SEQ ID NO: 283630 - RNA, 22 nt, Human
uauugguuuuggccugcuugag

SEQ ID NO: 283631 - RNA, 22 nt, Human
uauugguuuuggccugcuugag

SEQ ID NO: 283632 - RNA, 24 nt, Human
ucagagaauaacauuuauuuuauu

SEQ ID NO: 283633 - RNA, 24 nt, Human
ucagagaauaacauuuauuuuauu

SEQ ID NO: 283634 - RNA, 20 nt, Human
uccuucaaaaugagauacaa

SEQ ID NO: 283635 - RNA, 20 nt, Human
ugaaauauucuuaggauacc

SEQ ID NO: 283636 - RNA, 23 nt, Human
ugaaucauaaaagaagaaugagc

SEQ ID NO: 283637 - RNA, 22 nt, Human
ugagaggaauguuauuuuagaa

SEQ ID NO: 283638 - RNA, 22 nt, Human
ugagaggaauguuauuuuagaa

SEQ ID NO: 283639 - RNA, 23 nt, Human
uggcaccacugagucaucauaaa

SEQ ID NO: 283640 - RNA, 23 nt, Human
uggcaccacugagucaucauaaa

SEQ ID NO: 283641 - RNA, 21 nt, Human
ugguuuuggccugcuugaguu

SEQ ID NO: 283642 - RNA, 21 nt, Human
ugguuuuggccugcuugaguu

SEQ ID NO: 283643 - RNA, 21 nt, Human
uguaagauuuugaacauccuu

SEQ ID NO: 283644 - RNA, 18 nt, Human
uguaugggugggaaggua

SEQ ID NO: 283645 - RNA, 18 nt, Human
uguaugggugggaaggua

SEQ ID NO: 283646 - RNA, 21 nt, Human
uuacacaguccggacucaugu

SEQ ID NO: 283647 - RNA, 21 nt, Human
uuacacaguccggacucaugu

SEQ ID NO: 283648 - RNA, 24 nt, Human
uugaaguuuuuugugguuuuccuc

SEQ ID NO: 283649 - RNA, 18 nt, Human
uuuagcaaaaaucaaggu

SEQ ID NO: 283650 - RNA, 18 nt, Human
uuuagcaaaaaucaaggu

SEQ ID NO: 283651 - RNA, 18 nt, Human
uuuagcaaaaaucaaggu

SEQ ID NO: 283652 - RNA, 24 nt, Human
uuucccguuguagcuguuuugaag

SEQ ID NO: 283653 - RNA, 20 nt, Human
uuuguuacagugaacaugga

SEQ ID NO: 283654 - RNA, 20 nt, Human
uuuguuacagugaacaugga

SEQ ID NO: 283655 - RNA, 18 nt, Human
uuuuuuuuuuuuuuuuug

SEQ ID NO: 283656 - RNA, 19 nt, Human
uuuuuuuuuuuuuuuuugg

SEQ ID NO: 283657 - RNA, 19 nt, Human
uuuuuuuuuuuuuuuuugg

SEQ ID NO: 283658 - RNA, 24 nt, Human
aaaaaaaaggaguucaugaucaaa

SEQ ID NO: 283659 - RNA, 21 nt, Human
aaaagcaguuucccaucuuuu

SEQ ID NO: 283660 - RNA, 20 nt, Human
aaaauaccugaaaccaaaca

SEQ ID NO: 283661 - RNA, 24 nt, Human
aaacaagagagaaaauaaaaacaa

SEQ ID NO: 283662 - RNA, 26 nt, Human
aaacaagagagaaaauaaaaacaaga

SEQ ID NO: 283663 - RNA, 22 nt, Human
aaaccuauaaaaagacuacacc

SEQ ID NO: 283664 - RNA, 22 nt, Human
aaagaaaaaaaaauccagaaga

SEQ ID NO: 283665 - RNA, 22 nt, Human
aaagaagaaaaaaggaaaaaaa

SEQ ID NO: 283666 - RNA, 19 nt, Human
aaagaagucagcaaccuaa

SEQ ID NO: 283667 - RNA, 27 nt, Human
aaaugaacaacaagaagaguuagaagc

SEQ ID NO: 283668 - RNA, 19 nt, Human
aacacauuuugggaaaugc

SEQ ID NO: 283669 - RNA, 23 nt, Human
aacggccaaccagauccauuaau

SEQ ID NO: 283670 - RNA, 20 nt, Human
aacugcugcgcuacauagaa

SEQ ID NO: 283671 - RNA, 23 nt, Human
aagaaaaaaaaauccagaagacu

SEQ ID NO: 283672 - RNA, 24 nt, Human
aagaaauacauugcauuucacuca

SEQ ID NO: 283673 - RNA, 28 nt, Human
aagaagaaaaaaggaaaaaaaaugaaac

SEQ ID NO: 283674 - RNA, 24 nt, Human
aauaugggaaacaugcagaaggga

SEQ ID NO: 283675 - RNA, 22 nt, Human
aaugcacugauuacaaaagaaa

SEQ ID NO: 283676 - RNA, 24 nt, Human
aaugcugcucuucaacaauguucc

SEQ ID NO: 283677 - RNA, 19 nt, Human
acaaagcacugauagcucc

SEQ ID NO: 283678 - RNA, 23 nt, Human
acccaaaauauaaagaaaaaaaa

SEQ ID NO: 283679 - RNA, 20 nt, Human
accugaaaccaaacauuuuu

SEQ ID NO: 283680 - RNA, 20 nt, Human
acgcaaugcgcauuaacgcu

SEQ ID NO: 283681 - RNA, 22 nt, Human
agaacccaagugcaaaccacca

SEQ ID NO: 283682 - RNA, 18 nt, Human
agaagagcagaaugcugc

SEQ ID NO: 283683 - RNA, 24 nt, Human
agaagggagaggguuaaucagggc

SEQ ID NO: 283684 - RNA, 19 nt, Human
agaauaacauuuuucaaac

SEQ ID NO: 283685 - RNA, 26 nt, Human
agacaaguaagaaguauguuaucuag

SEQ ID NO: 283686 - RNA, 24 nt, Human
agagguauggcugaaaaaaaagga

SEQ ID NO: 283687 - RNA, 19 nt, Human
agauucaggcauggaggca

SEQ ID NO: 283688 - RNA, 18 nt, Human
agcuggcugcuccugcgc

SEQ ID NO: 283689 - RNA, 21 nt, Human
agcuggcugcuccugcgccuu

SEQ ID NO: 283690 - RNA, 19 nt, Human
agcuuaaaaccuuaucuca

SEQ ID NO: 283691 - RNA, 19 nt, Human
aggaaaaaaaaaaaaacua

SEQ ID NO: 283692 - RNA, 19 nt, Human
aggauguuuugaaucaggc

SEQ ID NO: 283693 - RNA, 20 nt, Human
aggcuacagaauaggacuga

SEQ ID NO: 283694 - RNA, 23 nt, Human
aguaggauaucauaaagccaggc

SEQ ID NO: 283695 - RNA, 19 nt, Human
auaaaaccuauaaaaagac

SEQ ID NO: 283696 - RNA, 25 nt, Human
auaaaaccuauaaaaagacuacacc

SEQ ID NO: 283697 - RNA, 24 nt, Human
auagaacaccccuagacgcagcaa

SEQ ID NO: 283698 - RNA, 21 nt, Human
aucaucuaaaucaacaaagca

SEQ ID NO: 283699 - RNA, 18 nt, Human
aucuauaucuccccucca

SEQ ID NO: 283700 - RNA, 23 nt, Human
augaacaacaagaagaguuagaa

SEQ ID NO: 283701 - RNA, 23 nt, Human
caaacaaagaagaaaaaaggaaa

SEQ ID NO: 283702 - RNA, 22 nt, Human
caacaaagcaauugaaauucuu

SEQ ID NO: 283703 - RNA, 26 nt, Human
caacaaagcaauugaaauucuuugga

SEQ ID NO: 283704 - RNA, 20 nt, Human
caacuacgggcccuugucau

SEQ ID NO: 283705 - RNA, 25 nt, Human
caauggugaaaaaccaaaaacaaga

SEQ ID NO: 283706 - RNA, 24 nt, Human
caccagaacccaagugcaaaccac

SEQ ID NO: 283707 - RNA, 19 nt, Human
cacccaucugcaacaaggu

SEQ ID NO: 283708 - RNA, 18 nt, Human
caccuagguugagguccc

SEQ ID NO: 283709 - RNA, 18 nt, Human
caccugaaaccuucuaaa

SEQ ID NO: 283710 - RNA, 18 nt, Human
cacugauagcuccaaaua

SEQ ID NO: 283711 - RNA, 20 nt, Human
cagaacccaagugcaaaccc

SEQ ID NO: 283712 - RNA, 23 nt, Human
cagaguucagaaacuaaaacagg

SEQ ID NO: 283713 - RNA, 20 nt, Human
cagccuaaaccgaucucuaa

SEQ ID NO: 283714 - RNA, 21 nt, Human
caggcgcaaugucucagccua

SEQ ID NO: 283715 - RNA, 19 nt, Human
caucgcacugcgcaaucgc

SEQ ID NO: 283716 - RNA, 19 nt, Human
cauggaacucuucuuucau

SEQ ID NO: 283717 - RNA, 21 nt, Human
ccaaccaaagaccaacccuua

SEQ ID NO: 283718 - RNA, 23 nt, Human
ccaccagaacccaagugcaaacc

SEQ ID NO: 283719 - RNA, 25 nt, Human
cccaaaauauaaagaaaaaaaaauc

SEQ ID NO: 283720 - RNA, 23 nt, Human
cccuagauccaggccucgagcuc

SEQ ID NO: 283721 - RNA, 20 nt, Human
ccgcccuuuuuuuuuuuuuc

SEQ ID NO: 283722 - RNA, 18 nt, Human
ccuuuuuuuuuuuuuuuu

SEQ ID NO: 283723 - RNA, 18 nt, Human
cgcaaccuaacagcaucg

SEQ ID NO: 283724 - RNA, 24 nt, Human
cgcagcaaacggccaaccagaucc

SEQ ID NO: 283725 - RNA, 23 nt, Human
cgccaaaacuaaugcgcugccac

SEQ ID NO: 283726 - RNA, 27 nt, Human
cgcccuuuuuuuuuuuuuuuuuuaggg

SEQ ID NO: 283727 - RNA, 25 nt, Human
cggccgcccuuuuuuuuuuuuuuuu

SEQ ID NO: 283728 - RNA, 18 nt, Human
cggccggacaaucuauau

SEQ ID NO: 283729 - RNA, 20 nt, Human
cuagacgcagcaaacggcca

SEQ ID NO: 283730 - RNA, 25 nt, Human
cuaggauguuuugaaucaggcuuga

SEQ ID NO: 283731 - RNA, 23 nt, Human
cuauaucuccccuccacacuaac

SEQ ID NO: 283732 - RNA, 26 nt, Human
cucaagugguuuauaaaaccuauaaa

SEQ ID NO: 283733 - RNA, 26 nt, Human
cucacaaugccccgucucuugacggc

SEQ ID NO: 283734 - RNA, 22 nt, Human
cuccccuccacacuaaccaucc

SEQ ID NO: 283735 - RNA, 23 nt, Human
cuccccuccacacuaaccauccc

SEQ ID NO: 283736 - RNA, 27 nt, Human
cugaaaccucacaugacaggauugcac

SEQ ID NO: 283737 - RNA, 23 nt, Human
cugaagcugaaaccucacaugac

SEQ ID NO: 283738 - RNA, 19 nt, Human
cugccaaccaaagaccaac

SEQ ID NO: 283739 - RNA, 22 nt, Human
cugcgccugcgccaccagaacc

SEQ ID NO: 283740 - RNA, 21 nt, Human
cuuccagaccuaugcaccauc

SEQ ID NO: 283741 - RNA, 23 nt, Human
cuuuuuuuuuuuuuuuuuuaggg

SEQ ID NO: 283742 - RNA, 21 nt, Human
gcaaccuaacagcaucgcacu

SEQ ID NO: 283743 - RNA, 21 nt, Human
gccgaguuuuccuacccccac

SEQ ID NO: 283744 - RNA, 18 nt, Human
gccgcccuuuuuuuuuuu

SEQ ID NO: 283745 - RNA, 24 nt, Human
gccgcccuuuuuuuuuuuuuuuuu

SEQ ID NO: 283746 - RNA, 26 nt, Human
ggaaaugggaaauggaccagaaaaaa

SEQ ID NO: 283747 - RNA, 18 nt, Human
ggaagaaaaggaaauggg

SEQ ID NO: 283748 - RNA, 24 nt, Human
ggaauaugcuggcuugaauuuuca

SEQ ID NO: 283749 - RNA, 21 nt, Human
ggacaaucuauaucuccccuc

SEQ ID NO: 283750 - RNA, 18 nt, Human
gggaagaaaaggaaaugg

SEQ ID NO: 283751 - RNA, 21 nt, Human
gguaugggggucagggaagaa

SEQ ID NO: 283752 - RNA, 22 nt, Human
guaggauaucauaaagccaggc

SEQ ID NO: 283753 - RNA, 23 nt, Human
uaacagcaucgcacugcgcaauu

SEQ ID NO: 283754 - RNA, 19 nt, Human
uaauucuccugugcagucu

SEQ ID NO: 283755 - RNA, 18 nt, Human
uacaauaucaauggugaa

SEQ ID NO: 283756 - RNA, 19 nt, Human
uacauagaacaccccuaga

SEQ ID NO: 283757 - RNA, 20 nt, Human
uacauagaacaccccuagac

SEQ ID NO: 283758 - RNA, 19 nt, Human
uaccacaacugugcccuug

SEQ ID NO: 283759 - RNA, 22 nt, Human
uaccuagagggcgcaacuugag

SEQ ID NO: 283760 - RNA, 18 nt, Human
uaccugaaaccaaacauu

SEQ ID NO: 283761 - RNA, 27 nt, Human
uaccugaaaccaaacauuuuuaaaagc

SEQ ID NO: 283762 - RNA, 20 nt, Human
uacuagacaggcccauggag

SEQ ID NO: 283763 - RNA, 18 nt, Human
uaggugucuccagagcuc

SEQ ID NO: 283764 - RNA, 25 nt, Human
uauaucuccccuccacacuaaccau

SEQ ID NO: 283765 - RNA, 18 nt, Human
uauccaaacaacuacggg

SEQ ID NO: 283766 - RNA, 20 nt, Human
uaucuccccuccacacuaac

SEQ ID NO: 283767 - RNA, 19 nt, Human
ucauauacacuucacauga

SEQ ID NO: 283768 - RNA, 18 nt, Human
uccaaacaaagaagaaaa

SEQ ID NO: 283769 - RNA, 21 nt, Human
uccaaacaaagaagaaaaaag

SEQ ID NO: 283770 - RNA, 26 nt, Human
uccagaagacugaaucaauccaugga

SEQ ID NO: 283771 - RNA, 20 nt, Human
ucucacaaaaaaacagaaua

SEQ ID NO: 283772 - RNA, 26 nt, Human
ucuccagagcucugaaauaaagaagu

SEQ ID NO: 283773 - RNA, 22 nt, Human
ucugccaaccaaagaccaaccc

SEQ ID NO: 283774 - RNA, 21 nt, Human
ugaaaaaccaaaaacaagaga

SEQ ID NO: 283775 - RNA, 24 nt, Human
ugaaaaaccaaaaacaagagagaa

SEQ ID NO: 283776 - RNA, 22 nt, Human
ugaagugcaauucauguuagcu

SEQ ID NO: 283777 - RNA, 23 nt, Human
ugccacagcuggcugcuccugcg

SEQ ID NO: 283778 - RNA, 23 nt, Human
ugcgcaaccuaacagcaucgcac

SEQ ID NO: 283779 - RNA, 22 nt, Human
ugcgcuacugcagggucacagc

SEQ ID NO: 283780 - RNA, 23 nt, Human
ugcuauaaggcucuaugcuggag

SEQ ID NO: 283781 - RNA, 23 nt, Human
ugcuggaagaggaggaggagguu

SEQ ID NO: 283782 - RNA, 23 nt, Human
uggaagaaaggcucuucauuuuc

SEQ ID NO: 283783 - RNA, 19 nt, Human
uggaagaccaagggagauc

SEQ ID NO: 283784 - RNA, 19 nt, Human
uggaagaggaggaggaggu

SEQ ID NO: 283785 - RNA, 21 nt, Human
uggaagaggaggaggagguug

SEQ ID NO: 283786 - RNA, 18 nt, Human
uggaaucacaaagcggcc

SEQ ID NO: 283787 - RNA, 24 nt, Human
uggaaucacaaagcggccggacaa

SEQ ID NO: 283788 - RNA, 21 nt, Human
ugggaaugaggacagucucaa

SEQ ID NO: 283789 - RNA, 21 nt, Human
uuaucuaguucccucggccgc

SEQ ID NO: 283790 - RNA, 21 nt, Human
uuccggaaguguguucuauga

SEQ ID NO: 283791 - RNA, 19 nt, Human
uugaguuacaggagaauuu

SEQ ID NO: 283792 - RNA, 22 nt, Human
uuggacucgagguauguuaaaa

SEQ ID NO: 283793 - RNA, 18 nt, Human
uugggaaaugcugcucuu

SEQ ID NO: 283794 - RNA, 21 nt, Human
uuugcuggaagaaaggcucuu

SEQ ID NO: 283795 - RNA, 19 nt, Human
uuuugugucucucccuacc

SEQ ID NO: 283796 - RNA, 18 nt, Human
uuuuuuuuuuuuaggggu

SEQ ID NO: 283797 - RNA, 25 nt, Human
uuuuuuuuuuuuuuuuuuuauuuuu

SEQ ID NO: 283798 - RNA, 23 nt, Human
uuuuuuuuuuuuuuuuuuuuagg

SEQ ID NO: 283799 - RNA, 18 nt, Human
aaaugccaagguggggac

SEQ ID NO: 283800 - RNA, 20 nt, Human
agacgccuuucuagguuucc

SEQ ID NO: 283801 - RNA, 24 nt, Human
aguauaaaacguuugugcacagug

SEQ ID NO: 283802 - RNA, 20 nt, Human
cacaguguuaacaaauacaa

SEQ ID NO: 283803 - RNA, 18 nt, Human
cacgccacgggaaaugcc

SEQ ID NO: 283804 - RNA, 18 nt, Human
ccgcgcgucugcgccugc

SEQ ID NO: 283805 - RNA, 23 nt, Human
cugcgccgcuccucuccugcgcg

SEQ ID NO: 283806 - RNA, 18 nt, Human
gcgccgcuccucuccugc

SEQ ID NO: 283807 - RNA, 22 nt, Human
gucugcgccugcgccgcuccuc

SEQ ID NO: 283808 - RNA, 22 nt, Human
ugugcacaguguuaacaaauac

SEQ ID NO: 283809 - RNA, 21 nt, Human
uuccgccgccgcacuuucgac

SEQ ID NO: 283810 - RNA, 22 nt, Human
acaugaacuugacuaugucucu

SEQ ID NO: 283811 - RNA, 22 nt, Human
agcauugaaaaaacucuuuuaa

SEQ ID NO: 283812 - RNA, 21 nt, Human
aggaccacccagaaucagcca

SEQ ID NO: 283813 - RNA, 19 nt, Human
agggacagggcggggagga

SEQ ID NO: 283814 - RNA, 22 nt, Human
agggagaaacacggagguaaug

SEQ ID NO: 283815 - RNA, 20 nt, Human
agggcugggcagggcugggc

SEQ ID NO: 283816 - RNA, 23 nt, Human
auaagacacaggcauagcccuuu

SEQ ID NO: 283817 - RNA, 21 nt, Human
augucucuauaagggugaaca

SEQ ID NO: 283818 - RNA, 22 nt, Human
caaacaaugugggcacagcaac

SEQ ID NO: 283819 - RNA, 18 nt, Human
caagaagagaguaauucc

SEQ ID NO: 283820 - RNA, 24 nt, Human
cacagcaacuucacucuacacacu

SEQ ID NO: 283821 - RNA, 26 nt, Human
cacccggagcgggcggcgcgcggggg

SEQ ID NO: 283822 - RNA, 20 nt, Human
cacucuacacacucugacca

SEQ ID NO: 283823 - RNA, 20 nt, Human
cacugcagcauugaaaaaac

SEQ ID NO: 283824 - RNA, 19 nt, Human
cagcaacacagucaagaaa

SEQ ID NO: 283825 - RNA, 27 nt, Human
cagcaacacagucaagaaacggccggc

SEQ ID NO: 283826 - RNA, 19 nt, Human
cagcugcaaauacgggagu

SEQ ID NO: 283827 - RNA, 22 nt, Human
cagcugcaaauacgggaguuuc

SEQ ID NO: 283828 - RNA, 19 nt, Human
caguggguuuuuccccggu

SEQ ID NO: 283829 - RNA, 18 nt, Human
cauagcccuuuguggggc

SEQ ID NO: 283830 - RNA, 19 nt, Human
caugcaaaggaggauccug

SEQ ID NO: 283831 - RNA, 18 nt, Human
ccaaggugucucaauaag

SEQ ID NO: 283832 - RNA, 25 nt, Human
ccccaggugagcccuuccuaucugc

SEQ ID NO: 283833 - RNA, 21 nt, Human
cccuccucucuccucgccucc

SEQ ID NO: 283834 - RNA, 23 nt, Human
ccgacgucuguggcccgccggcu

SEQ ID NO: 283835 - RNA, 21 nt, Human
ccggccggcggcugcguggac

SEQ ID NO: 283836 - RNA, 19 nt, Human
ccggugagaacuggccaac

SEQ ID NO: 283837 - RNA, 25 nt, Human
ccuacggccgggugcagcccauggc

SEQ ID NO: 283838 - RNA, 24 nt, Human
ccucaagggaauaacagaagaacg

SEQ ID NO: 283839 - RNA, 19 nt, Human
ccugggugcuggccggccg

SEQ ID NO: 283840 - RNA, 21 nt, Human
ccuuagugaaauggugcuaag

SEQ ID NO: 283841 - RNA, 24 nt, Human
cgcccuccucucuccucgccuccu

SEQ ID NO: 283842 - RNA, 21 nt, Human
cgccgugggcugcaguuccag

SEQ ID NO: 283843 - RNA, 23 nt, Human
cgcuccggcucuggccccggcuc

SEQ ID NO: 283844 - RNA, 18 nt, Human
cggcgcgcgggcucugcu

SEQ ID NO: 283845 - RNA, 21 nt, Human
cggcggcgccuggcucguguc

SEQ ID NO: 283846 - RNA, 27 nt, Human
cggcucuggccccggcuccgcuggcuc

SEQ ID NO: 283847 - RNA, 24 nt, Human
cgugggcccuuggcuuccaggagg

SEQ ID NO: 283848 - RNA, 20 nt, Human
cguugcacaauguaucuacg

SEQ ID NO: 283849 - RNA, 22 nt, Human
cuaauuuaacaagaagagagua

SEQ ID NO: 283850 - RNA, 19 nt, Human
cuacacacucugaccaucg

SEQ ID NO: 283851 - RNA, 24 nt, Human
cucguguccccacgccuggauuca

SEQ ID NO: 283852 - RNA, 21 nt, Human
cugggcagggcugggcugggc

SEQ ID NO: 283853 - RNA, 21 nt, Human
gaaaagcaucuuuuggccugg

SEQ ID NO: 283854 - RNA, 18 nt, Human
gacacaggcauagcccuu

SEQ ID NO: 283855 - RNA, 24 nt, Human
gacgugggcccuuggcuuccagga

SEQ ID NO: 283856 - RNA, 18 nt, Human
gcauacuguugcccguau

SEQ ID NO: 283857 - RNA, 23 nt, Human
gccaucccucgaugucagaaucc

SEQ ID NO: 283858 - RNA, 21 nt, Human
gcccauggcucucaaagagcc

SEQ ID NO: 283859 - RNA, 20 nt, Human
gccuccgggcagggcugggc

SEQ ID NO: 283860 - RNA, 18 nt, Human
gcgaguuacacuagccua

SEQ ID NO: 283861 - RNA, 18 nt, Human
ggaguuucuuccgacguc

SEQ ID NO: 283862 - RNA, 20 nt, Human
ggcccuuggcuuccaggagg

SEQ ID NO: 283863 - RNA, 21 nt, Human
ggcccuuggcuuccaggagga

SEQ ID NO: 283864 - RNA, 22 nt, Human
ggcccuugggugcggccauguc

SEQ ID NO: 283865 - RNA, 19 nt, Human
ggcggggaggaaaaccggg

SEQ ID NO: 283866 - RNA, 18 nt, Human
ggcugggcagggcugggc

SEQ ID NO: 283867 - RNA, 23 nt, Human
ggcugggcagggcugggcugggc

SEQ ID NO: 283868 - RNA, 19 nt, Human
ggcugggcugggcgggagc

SEQ ID NO: 283869 - RNA, 18 nt, Human
gggaauaacagaagaacg

SEQ ID NO: 283870 - RNA, 22 nt, Human
gggaauaacagaagaacguugc

SEQ ID NO: 283871 - RNA, 20 nt, Human
gggcagggcugggcagggcu

SEQ ID NO: 283872 - RNA, 22 nt, Human
gggcagggcugggcagggcugg

SEQ ID NO: 283873 - RNA, 19 nt, Human
gggcugggcagggcugggc

SEQ ID NO: 283874 - RNA, 22 nt, Human
gggcugggcagggcugggcugg

SEQ ID NO: 283875 - RNA, 23 nt, Human
gggcugggcugggcgggagcugc

SEQ ID NO: 283876 - RNA, 21 nt, Human
ggucuuuauugucaguuuaga

SEQ ID NO: 283877 - RNA, 19 nt, Human
guccaggagcuauguggag

SEQ ID NO: 283878 - RNA, 20 nt, Human
gucccuuuguggugaggacg

SEQ ID NO: 283879 - RNA, 21 nt, Human
gugggcccuuggcuuccagga

SEQ ID NO: 283880 - RNA, 18 nt, Human
uaaggaaauguucaugcc

SEQ ID NO: 283881 - RNA, 21 nt, Human
uaaucuaagagacagcaacac

SEQ ID NO: 283882 - RNA, 20 nt, Human
uacacacucugaccaucgcu

SEQ ID NO: 283883 - RNA, 22 nt, Human
uagaaugcaacaucuuaagguu

SEQ ID NO: 283884 - RNA, 24 nt, Human
uaguacaaaguuugccuuuguuuu

SEQ ID NO: 283885 - RNA, 20 nt, Human
uaucugcgguuacaugauuu

SEQ ID NO: 283886 - RNA, 22 nt, Human
ucaaacuauucaugaaaugcag

SEQ ID NO: 283887 - RNA, 19 nt, Human
ucagcacccggagcgggcg

SEQ ID NO: 283888 - RNA, 19 nt, Human
uccagcugcaaauacggga

SEQ ID NO: 283889 - RNA, 21 nt, Human
uccccaggugagcccuuccua

SEQ ID NO: 283890 - RNA, 19 nt, Human
uccgcuggcuccggcggcg

SEQ ID NO: 283891 - RNA, 24 nt, Human
ucgaaagggagaaacacggaggua

SEQ ID NO: 283892 - RNA, 19 nt, Human
ugcaaaggaggauccuggu

SEQ ID NO: 283893 - RNA, 19 nt, Human
ugccaaggugucucaauaa

SEQ ID NO: 283894 - RNA, 18 nt, Human
ugccucgccucuuuagua

SEQ ID NO: 283895 - RNA, 19 nt, Human
ugggcagggcugggcuggg

SEQ ID NO: 283896 - RNA, 20 nt, Human
ugggcagggcugggcugggc

SEQ ID NO: 283897 - RNA, 18 nt, Human
ugggcugggcgggagcug

SEQ ID NO: 283898 - RNA, 18 nt, Human
uguuaguguuauugguau

SEQ ID NO: 283899 - RNA, 22 nt, Human
uuaaucuaagagacagcaacac

SEQ ID NO: 283900 - RNA, 25 nt, Human
uucaugccauccuaacaguggguuu

SEQ ID NO: 283901 - RNA, 18 nt, Human
uuuaacaagaagagagua

SEQ ID NO: 283902 - RNA, 20 nt, Human
uuuaacaagaagagaguaau

SEQ ID NO: 283903 - RNA, 19 nt, Human
uuuggccugggcauggagg

SEQ ID NO: 283904 - RNA, 25 nt, Human
uuuuucuuucuuuuucaaaaaaugc

SEQ ID NO: 283905 - RNA, 24 nt, Human
uuuuuuuuuucuccuaauguuuuu

SEQ ID NO: 283906 - RNA, 24 nt, Human
uuuuuuuuuuuuuuuuucuccuaa

SEQ ID NO: 283907 - RNA, 23 nt, Human
uuuuuuuuuuuuuuuuuuuaggg

SEQ ID NO: 283908 - RNA, 22 nt, Human
aaaaauaaaccaaaauagagga

SEQ ID NO: 283909 - RNA, 22 nt, Human
aaaauagaggaaagccggcuua

SEQ ID NO: 283910 - RNA, 18 nt, Human
aaacagaugauacacucu

SEQ ID NO: 283911 - RNA, 19 nt, Human
aaacagaugauacacucuc

SEQ ID NO: 283912 - RNA, 22 nt, Human
aacagaacccccaaauaaccca

SEQ ID NO: 283913 - RNA, 25 nt, Human
aacagaacccccaaauaacccaaac

SEQ ID NO: 283914 - RNA, 23 nt, Human
aaccauauucucccaaaucaacg

SEQ ID NO: 283915 - RNA, 19 nt, Human
aacgagagacagggaggaa

SEQ ID NO: 283916 - RNA, 19 nt, Human
aacuuguggccccuggccu

SEQ ID NO: 283917 - RNA, 23 nt, Human
aaguuuuuagaaucuuuucccgg

SEQ ID NO: 283918 - RNA, 23 nt, Human
aaugucuauaaacuugcucauac

SEQ ID NO: 283919 - RNA, 24 nt, Human
acagaacccccaaauaacccaaac

SEQ ID NO: 283920 - RNA, 21 nt, Human
acauccccucacuccccacug

SEQ ID NO: 283921 - RNA, 18 nt, Human
acccaaacuguuuccaca

SEQ ID NO: 283922 - RNA, 21 nt, Human
acuccgauggggcuggcaguc

SEQ ID NO: 283923 - RNA, 18 nt, Human
agaacauccccucacucc

SEQ ID NO: 283924 - RNA, 18 nt, Human
aggaagcacguggaggag

SEQ ID NO: 283925 - RNA, 20 nt, Human
aggcagcgccgaggcggcuu

SEQ ID NO: 283926 - RNA, 24 nt, Human
auccacaagugguucuacucugaa

SEQ ID NO: 283927 - RNA, 20 nt, Human
augaccaucagcgcuucuga

SEQ ID NO: 283928 - RNA, 24 nt, Human
augugucccccucccauaacaccc

SEQ ID NO: 283929 - RNA, 25 nt, Human
caaagcccaguuugcaacgcaggca

SEQ ID NO: 283930 - RNA, 22 nt, Human
caaugugucccccucccauaac

SEQ ID NO: 283931 - RNA, 19 nt, Human
cacuuugugcuuagagaag

SEQ ID NO: 283932 - RNA, 19 nt, Human
cagaacccccaaauaaccc

SEQ ID NO: 283933 - RNA, 20 nt, Human
cagaacccccaaauaaccca

SEQ ID NO: 283934 - RNA, 21 nt, Human
cagaacccccaaauaacccaa

SEQ ID NO: 283935 - RNA, 20 nt, Human
cagcucagguuaaagccaga

SEQ ID NO: 283936 - RNA, 20 nt, Human
cauaacacccccuccccccc

SEQ ID NO: 283937 - RNA, 23 nt, Human
cauaacacccccuccccccccga

SEQ ID NO: 283938 - RNA, 31 nt, Human
ccaaugugucccccucccauaacacccccuu

SEQ ID NO: 283939 - RNA, 18 nt, Human
ccagaacgcgccggcgcc

SEQ ID NO: 283940 - RNA, 24 nt, Human
ccagauauugagauuggauaugac

SEQ ID NO: 283941 - RNA, 19 nt, Human
ccaguccaugguccugcgc

SEQ ID NO: 283942 - RNA, 23 nt, Human
ccaucagcgcuucugauaccgaa

SEQ ID NO: 283943 - RNA, 23 nt, Human
cccaaauaacccaaacuguuucc

SEQ ID NO: 283944 - RNA, 21 nt, Human
cccaaaucaacgagagacagg

SEQ ID NO: 283945 - RNA, 21 nt, Human
cccaccaugccccacccccaa

SEQ ID NO: 283946 - RNA, 23 nt, Human
cccaccaugccccacccccaguc

SEQ ID NO: 283947 - RNA, 26 nt, Human
cccauaacacccccuccccccccgaa

SEQ ID NO: 283948 - RNA, 19 nt, Human
ccccaaugugucccccucc

SEQ ID NO: 283949 - RNA, 26 nt, Human
ccccaccaugccccacccccagucca

SEQ ID NO: 283950 - RNA, 21 nt, Human
ccccacccccaguccaugguc

SEQ ID NO: 283951 - RNA, 22 nt, Human
ccccaguccaugguccugcgcc

SEQ ID NO: 283952 - RNA, 23 nt, Human
cccccaaauaacccaaacuguuu

SEQ ID NO: 283953 - RNA, 19 nt, Human
ccccgaagugcugcccaag

SEQ ID NO: 283954 - RNA, 21 nt, Human
ccccgaagugcugcccaagcc

SEQ ID NO: 283955 - RNA, 18 nt, Human
cccgaaaaucuggaugcg

SEQ ID NO: 283956 - RNA, 25 nt, Human
ccgagcccagcgcaggccaguccuc

SEQ ID NO: 283957 - RNA, 20 nt, Human
ccgauggggcuggcagucac

SEQ ID NO: 283958 - RNA, 20 nt, Human
ccggagucucccacccgcca

SEQ ID NO: 283959 - RNA, 26 nt, Human
ccucccauaacacccccucccccccc

SEQ ID NO: 283960 - RNA, 22 nt, Human
ccuucccucggacccgaaaauc

SEQ ID NO: 283961 - RNA, 19 nt, Human
cgcaggguccuccuucccu

SEQ ID NO: 283962 - RNA, 22 nt, Human
cgccagaacgcgccggcgccag

SEQ ID NO: 283963 - RNA, 23 nt, Human
cggcuacccggagucucccaccc

SEQ ID NO: 283964 - RNA, 23 nt, Human
cucaacacucagucauuuauucc

SEQ ID NO: 283965 - RNA, 21 nt, Human
cucagguuaaagccagacagc

SEQ ID NO: 283966 - RNA, 23 nt, Human
cucugugggcgcccccauugcuu

SEQ ID NO: 283967 - RNA, 22 nt, Human
cugcgccccuccucgcgacaga

SEQ ID NO: 283968 - RNA, 21 nt, Human
cuggcuccccugucgccagaa

SEQ ID NO: 283969 - RNA, 19 nt, Human
cuuccccgcggccccuggc

SEQ ID NO: 283970 - RNA, 21 nt, Human
cuuguggccccuggccuuggg

SEQ ID NO: 283971 - RNA, 23 nt, Human
gaaaaccauauucucccaaauca

SEQ ID NO: 283972 - RNA, 25 nt, Human
gaacccccaaauaacccaaacuguu

SEQ ID NO: 283973 - RNA, 22 nt, Human
gaccagcucagguuaaagccag

SEQ ID NO: 283974 - RNA, 18 nt, Human
gagcaaggccccaaugug

SEQ ID NO: 283975 - RNA, 18 nt, Human
gaggaagaggagcaaggc

SEQ ID NO: 283976 - RNA, 21 nt, Human
gaggaaggguguuacacggca

SEQ ID NO: 283977 - RNA, 21 nt, Human
gcaggccaguccucgcuuccc

SEQ ID NO: 283978 - RNA, 22 nt, Human
gccaacagaacccccaaauaac

SEQ ID NO: 283979 - RNA, 18 nt, Human
gcgacagagcucccgagc

SEQ ID NO: 283980 - RNA, 19 nt, Human
ggaauccccaccaugcccc

SEQ ID NO: 283981 - RNA, 20 nt, Human
ggaauccccaccaugcccca

SEQ ID NO: 283982 - RNA, 20 nt, Human
ggccccuggccuugggccag

SEQ ID NO: 283983 - RNA, 20 nt, Human
ggccccuggccuugggccag

SEQ ID NO: 283984 - RNA, 21 nt, Human
ggggaagauagucgucgcagc

SEQ ID NO: 283985 - RNA, 22 nt, Human
uaaaaagccaacagaaccccca

SEQ ID NO: 283986 - RNA, 19 nt, Human
uaacacccccucccccccc

SEQ ID NO: 283987 - RNA, 21 nt, Human
uaacuacaaugcacccgcccc

SEQ ID NO: 283988 - RNA, 20 nt, Human
uaccaaaauaaccaaaucac

SEQ ID NO: 283989 - RNA, 23 nt, Human
uagaaucuuuucccggagguggu

SEQ ID NO: 283990 - RNA, 21 nt, Human
uagugaggaaugcacacagcg

SEQ ID NO: 283991 - RNA, 24 nt, Human
uccccaccaugccccacccccagu

SEQ ID NO: 283992 - RNA, 24 nt, Human
ucccccucccauaacacccccucc

SEQ ID NO: 283993 - RNA, 21 nt, Human
uccccucacuccccacugcuc

SEQ ID NO: 283994 - RNA, 19 nt, Human
ucggaugaguucuagugag

SEQ ID NO: 283995 - RNA, 20 nt, Human
ucuacuggaccagcucaggu

SEQ ID NO: 283996 - RNA, 22 nt, Human
ugaccaucagcgcuucugauac

SEQ ID NO: 283997 - RNA, 26 nt, Human
ugagauuggauaugaccaucagcgcu

SEQ ID NO: 283998 - RNA, 23 nt, Human
ugccccacccccaguccaugguc

SEQ ID NO: 283999 - RNA, 20 nt, Human
uggaauccccaccaugcccc

SEQ ID NO: 284000 - RNA, 24 nt, Human
ugguggucgggggucggaugaguu

SEQ ID NO: 284001 - RNA, 23 nt, Human
ugucgccagaacgcgccggcgcc

SEQ ID NO: 284002 - RNA, 21 nt, Human
ugugucccccucccauaacac

SEQ ID NO: 284003 - RNA, 21 nt, Human
uguuacacggcagacgcuaca

SEQ ID NO: 284004 - RNA, 21 nt, Human
uucccggaggugguggucggg

SEQ ID NO: 284005 - RNA, 23 nt, Human
uucgcagaugcuggaauccccac

SEQ ID NO: 284006 - RNA, 24 nt, Human
uugcuuggguucgcagaugcugga

SEQ ID NO: 284007 - RNA, 24 nt, Human
uuucccggaggugguggucggggg

SEQ ID NO: 284008 - RNA, 23 nt, Human
aaaaaggcuuccuuuaaaguaga

SEQ ID NO: 284009 - RNA, 24 nt, Human
aaaagcaaacaucucuugccuaca

SEQ ID NO: 284010 - RNA, 24 nt, Human
aaacaacccaaaugucaucaacaa

SEQ ID NO: 284011 - RNA, 23 nt, Human
aaagaaauucuauucuuaccucu

SEQ ID NO: 284012 - RNA, 21 nt, Human
aagaggagucaaauuuuaaaa

SEQ ID NO: 284013 - RNA, 19 nt, Human
aaggaguucugcagccagc

SEQ ID NO: 284014 - RNA, 19 nt, Human
aauagccugugaagagugg

SEQ ID NO: 284015 - RNA, 21 nt, Human
aauagccugugaagagugggu

SEQ ID NO: 284016 - RNA, 24 nt, Human
aauagcuuaaauuccagaauaaaa

SEQ ID NO: 284017 - RNA, 23 nt, Human
aaugugugugugugugugugugu

SEQ ID NO: 284018 - RNA, 23 nt, Human
aauuacuuucuugggcuccccac

SEQ ID NO: 284019 - RNA, 21 nt, Human
acaacccaaaugucaucaaca

SEQ ID NO: 284020 - RNA, 20 nt, Human
accucugggccacacauccc

SEQ ID NO: 284021 - RNA, 20 nt, Human
agcauugugacacuuugagg

SEQ ID NO: 284022 - RNA, 22 nt, Human
aggaagugguaacagguugugg

SEQ ID NO: 284023 - RNA, 23 nt, Human
agggaagcuugggacaagcuagg

SEQ ID NO: 284024 - RNA, 22 nt, Human
augugugugugugugugugugu

SEQ ID NO: 284025 - RNA, 24 nt, Human
augugugugugugugugugugugu

SEQ ID NO: 284026 - RNA, 23 nt, Human
auguucacucucuuaauuguagu

SEQ ID NO: 284027 - RNA, 18 nt, Human
auucacauaaaacuacaa

SEQ ID NO: 284028 - RNA, 23 nt, Human
auuccauucacauaaaacuacaa

SEQ ID NO: 284029 - RNA, 22 nt, Human
caaaaugcaaaaugaaagccga

SEQ ID NO: 284030 - RNA, 24 nt, Human
caagauggagacauaugaaucuca

SEQ ID NO: 284031 - RNA, 18 nt, Human
cacaguuuaaaaaccaag

SEQ ID NO: 284032 - RNA, 19 nt, Human
cagcaaaauaaaaaggcuu

SEQ ID NO: 284033 - RNA, 20 nt, Human
cagcagcuuuauuuguaaua

SEQ ID NO: 284034 - RNA, 26 nt, Human
caucaagauggagacauaugaaucuc

SEQ ID NO: 284035 - RNA, 21 nt, Human
caucaggaggagcauugugac

SEQ ID NO: 284036 - RNA, 26 nt, Human
ccaaaaugugugugugugugugugug

SEQ ID NO: 284037 - RNA, 20 nt, Human
ccauucacauaaaacuacaa

SEQ ID NO: 284038 - RNA, 25 nt, Human
cccaaaacuaaaacaacccaaaugu

SEQ ID NO: 284039 - RNA, 20 nt, Human
ccccaguuucugcaaaggag

SEQ ID NO: 284040 - RNA, 19 nt, Human
cucuguccuucuuuguuuc

SEQ ID NO: 284041 - RNA, 19 nt, Human
cugggccacacaucccaug

SEQ ID NO: 284042 - RNA, 22 nt, Human
gaaaagaccacucacuuacuaa

SEQ ID NO: 284043 - RNA, 22 nt, Human
gaaagaagccagacaaaaaaaa

SEQ ID NO: 284044 - RNA, 18 nt, Human
gagaagaguucaucuaca

SEQ ID NO: 284045 - RNA, 21 nt, Human
gagcauugugacacuuugagg

SEQ ID NO: 284046 - RNA, 24 nt, Human
gaggagucaucaggaggagcauug

SEQ ID NO: 284047 - RNA, 18 nt, Human
gaggguuuucaagcuuaa

SEQ ID NO: 284048 - RNA, 19 nt, Human
gaggguuuucaagcuugaa

SEQ ID NO: 284049 - RNA, 19 nt, Human
gcaaagugaaagaagccag

SEQ ID NO: 284050 - RNA, 20 nt, Human
gcaaagugaaagaagccaga

SEQ ID NO: 284051 - RNA, 20 nt, Human
gcauugugacacuuugaggg

SEQ ID NO: 284052 - RNA, 19 nt, Human
ggcacccaagugacaaaga

SEQ ID NO: 284053 - RNA, 19 nt, Human
gguaaagaagacugaguuc

SEQ ID NO: 284054 - RNA, 24 nt, Human
gguauguucuuuagggaaagaaau

SEQ ID NO: 284055 - RNA, 22 nt, Human
gucccaaaaugugugugugugu

SEQ ID NO: 284056 - RNA, 18 nt, Human
gugguuuucuggggagga

SEQ ID NO: 284057 - RNA, 21 nt, Human
gugugugugugugugugugug

SEQ ID NO: 284058 - RNA, 21 nt, Human
gugugugugugugugugugug

SEQ ID NO: 284059 - RNA, 19 nt, Human
uaaaacuacaaaaugcaaa

SEQ ID NO: 284060 - RNA, 18 nt, Human
uaaagaagacugaguuca

SEQ ID NO: 284061 - RNA, 19 nt, Human
uaacugauucaggaagugg

SEQ ID NO: 284062 - RNA, 21 nt, Human
uagaagccuaaaaauagaaga

SEQ ID NO: 284063 - RNA, 22 nt, Human
uagcaaaacagaguugagaaga

SEQ ID NO: 284064 - RNA, 23 nt, Human
uaucccaaaacuaaaacaaccca

SEQ ID NO: 284065 - RNA, 19 nt, Human
ucccaaaacuaaaacaacc

SEQ ID NO: 284066 - RNA, 22 nt, Human
ucccaaaacuaaaacaacccaa

SEQ ID NO: 284067 - RNA, 18 nt, Human
ucuccacaaggugugaaa

SEQ ID NO: 284068 - RNA, 19 nt, Human
ucuccauguucugucuuuc

SEQ ID NO: 284069 - RNA, 19 nt, Human
ucuguccucugguagaaaa

SEQ ID NO: 284070 - RNA, 19 nt, Human
ucuguccuucuuuguuucu

SEQ ID NO: 284071 - RNA, 23 nt, Human
ugaaagaagccagacaaaaaaaa

SEQ ID NO: 284072 - RNA, 29 nt, Human
ugaaagaagccagacaaaaaaaaaagaag

SEQ ID NO: 284073 - RNA, 23 nt, Human
ugaaagccgauuggugguuuucu

SEQ ID NO: 284074 - RNA, 25 nt, Human
ugacacagcucuuaaaaaaaaaaaa

SEQ ID NO: 284075 - RNA, 24 nt, Human
ugagugucuucauuuuuuuugucu

SEQ ID NO: 284076 - RNA, 21 nt, Human
ugauggauauguucacucucu

SEQ ID NO: 284077 - RNA, 19 nt, Human
ugcaaagugaaagaagcca

SEQ ID NO: 284078 - RNA, 23 nt, Human
ugcauguucuccacaagguguga

SEQ ID NO: 284079 - RNA, 18 nt, Human
ugccaggcaccuggaacc

SEQ ID NO: 284080 - RNA, 20 nt, Human
uggaaaggaaauagaagccu

SEQ ID NO: 284081 - RNA, 23 nt, Human
ugucugucuguccguaaguggua

SEQ ID NO: 284082 - RNA, 20 nt, Human
ugucuucauuuuuuuugucu

SEQ ID NO: 284083 - RNA, 19 nt, Human
ugugugugugugucugucu

SEQ ID NO: 284084 - RNA, 20 nt, Human
ugugugugugugucugucug

SEQ ID NO: 284085 - RNA, 21 nt, Human
ugugugugugugugugucugu

SEQ ID NO: 284086 - RNA, 18 nt, Human
ugugugugugugugugug

SEQ ID NO: 284087 - RNA, 18 nt, Human
ugugugugugugugugug

SEQ ID NO: 284088 - RNA, 18 nt, Human
ugugugugugugugugug

SEQ ID NO: 284089 - RNA, 18 nt, Human
ugugugugugugugugug

SEQ ID NO: 284090 - RNA, 18 nt, Human
ugugugugugugugugug

SEQ ID NO: 284091 - RNA, 18 nt, Human
ugugugugugugugugug

SEQ ID NO: 284092 - RNA, 18 nt, Human
ugugugugugugugugug

SEQ ID NO: 284093 - RNA, 18 nt, Human
ugugugugugugugugug

SEQ ID NO: 284094 - RNA, 22 nt, Human
ugugugugugugugugugucug

SEQ ID NO: 284095 - RNA, 21 nt, Human
ugugugugugugugugugugu

SEQ ID NO: 284096 - RNA, 21 nt, Human
ugugugugugugugugugugu

SEQ ID NO: 284097 - RNA, 21 nt, Human
ugugugugugugugugugugu

SEQ ID NO: 284098 - RNA, 21 nt, Human
ugugugugugugugugugugu

SEQ ID NO: 284099 - RNA, 21 nt, Human
ugugugugugugugugugugu

SEQ ID NO: 284100 - RNA, 21 nt, Human
ugugugugugugugugugugu

SEQ ID NO: 284101 - RNA, 21 nt, Human
ugugugugugugugugugugu

SEQ ID NO: 284102 - RNA, 21 nt, Human
ugugugugugugugugugugu

SEQ ID NO: 284103 - RNA, 21 nt, Human
ugugugugugugugugugugu

SEQ ID NO: 284104 - RNA, 21 nt, Human
ugugugugugugugugugugu

SEQ ID NO: 284105 - RNA, 21 nt, Human
ugugugugugugugugugugu

SEQ ID NO: 284106 - RNA, 22 nt, Human
ugugugugugugugugugugug

SEQ ID NO: 284107 - RNA, 22 nt, Human
ugugugugugugugugugugug

SEQ ID NO: 284108 - RNA, 22 nt, Human
ugugugugugugugugugugug

SEQ ID NO: 284109 - RNA, 22 nt, Human
ugugugugugugugugugugug

SEQ ID NO: 284110 - RNA, 24 nt, Human
uguucugucuuucaugcaauuuua

SEQ ID NO: 284111 - RNA, 18 nt, Human
uuaaaauaaaaaggggaa

SEQ ID NO: 284112 - RNA, 22 nt, Human
uuaccucugggccacacauccc

SEQ ID NO: 284113 - RNA, 19 nt, Human
uucuuccagagccuucaaa

SEQ ID NO: 284114 - RNA, 20 nt, Human
uucuugauuucggaauggcc

SEQ ID NO: 284115 - RNA, 21 nt, Human
uuuauuuguaauaucccaaaa

SEQ ID NO: 284116 - RNA, 23 nt, Human
uuuuccuuuucuuccagagccuu

SEQ ID NO: 284117 - RNA, 25 nt, Human
aaaaucacuaugcuccaaaccacua

SEQ ID NO: 284118 - RNA, 21 nt, Human
acacaacaucgauguggccag

SEQ ID NO: 284119 - RNA, 19 nt, Human
acacuccuaauccaaugaa

SEQ ID NO: 284120 - RNA, 18 nt, Human
accauguugguugcacuc

SEQ ID NO: 284121 - RNA, 20 nt, Human
aggcagaggcggcgaggggc

SEQ ID NO: 284122 - RNA, 24 nt, Human
aggugagcuaagucuuugguuucu

SEQ ID NO: 284123 - RNA, 23 nt, Human
agucagaaugcaggugagcuaag

SEQ ID NO: 284124 - RNA, 21 nt, Human
caaaaucacuaugcuccaaac

SEQ ID NO: 284125 - RNA, 24 nt, Human
caaugaacucagacaaccccauac

SEQ ID NO: 284126 - RNA, 25 nt, Human
cacaacaucgauguggccaggcaga

SEQ ID NO: 284127 - RNA, 21 nt, Human
cacuaaacagccaagcacagc

SEQ ID NO: 284128 - RNA, 18 nt, Human
cagugguguuuuccugcu

SEQ ID NO: 284129 - RNA, 21 nt, Human
ccaaacaaagucagaaugcag

SEQ ID NO: 284130 - RNA, 21 nt, Human
ccaaaccacuaaacagccaag

SEQ ID NO: 284131 - RNA, 19 nt, Human
ccacuaaacagccaagcac

SEQ ID NO: 284132 - RNA, 24 nt, Human
cugcuggcgacuguugccuuccuu

SEQ ID NO: 284133 - RNA, 20 nt, Human
cuuugguuucuuuggacuau

SEQ ID NO: 284134 - RNA, 22 nt, Human
gagcaggcggcggacacaacau

SEQ ID NO: 284135 - RNA, 24 nt, Human
gccaagucgccgcccugcugaagu

SEQ ID NO: 284136 - RNA, 23 nt, Human
gguguuuuccugcucaucauuug

SEQ ID NO: 284137 - RNA, 18 nt, Human
uaccauguugguugcacu

SEQ ID NO: 284138 - RNA, 28 nt, Human
uagaacaaccauuucugaaaggucaucc

SEQ ID NO: 284139 - RNA, 23 nt, Human
uagaacaaccauuucugaagacc

SEQ ID NO: 284140 - RNA, 19 nt, Human
uaguacugagacaccauac

SEQ ID NO: 284141 - RNA, 24 nt, Human
uaucuugagguccuggucuuuuaa

SEQ ID NO: 284142 - RNA, 23 nt, Human
ugagacaccauacaccuucgugg

SEQ ID NO: 284143 - RNA, 18 nt, Human
ugagauccagugguguuu

SEQ ID NO: 284144 - RNA, 24 nt, Human
ugcuccaaaccacuaaacagccaa

SEQ ID NO: 284145 - RNA, 22 nt, Human
ugcuggcgacuguugccuuccu

SEQ ID NO: 284146 - RNA, 19 nt, Human
ugugugucuccaaacaaag

SEQ ID NO: 284147 - RNA, 23 nt, Human
uucaaauauuucuaaguauaaac

SEQ ID NO: 284148 - RNA, 18 nt, Human
uucacaucggcugcuggc

SEQ ID NO: 284149 - RNA, 20 nt, Human
uuuccugcucaucauuuguc

SEQ ID NO: 284150 - RNA, 20 nt, Human
acuugugcccaagugagagu

SEQ ID NO: 284151 - RNA, 23 nt, Human
cagccuucauucaguccaucagg

SEQ ID NO: 284152 - RNA, 20 nt, Human
ggugacuugugcccaaguga

SEQ ID NO: 284153 - RNA, 21 nt, Human
uaggcagccuucauucagucc

SEQ ID NO: 284154 - RNA, 23 nt, Human
ucaguccaucagggcccggggcg

SEQ ID NO: 284155 - RNA, 21 nt, Human
ucauuuggaggugacuugugc

SEQ ID NO: 284156 - RNA, 18 nt, Human
uggaggugacuugugccc

SEQ ID NO: 284157 - RNA, 19 nt, Human
uguccucauuuggagguga

SEQ ID NO: 284158 - RNA, 19 nt, Human
uuggaggugacuugugccc

SEQ ID NO: 284159 - RNA, 22 nt, Human
uuuuccuuuguuuucuuuuggu

SEQ ID NO: 284160 - RNA, 21 nt, Human
aaaaaacccaugaaagaagcc

SEQ ID NO: 284161 - RNA, 18 nt, Human
aaaaacaucacacaaugg

SEQ ID NO: 284162 - RNA, 24 nt, Human
aaaacaaacauacacugaauuccu

SEQ ID NO: 284163 - RNA, 30 nt, Human
aaaagaagaaaaaaaaacccaugaaagaag

SEQ ID NO: 284164 - RNA, 23 nt, Human
aaacaaacauacacugaauuccu

SEQ ID NO: 284165 - RNA, 21 nt, Human
aaacugaauuaucauggucaa

SEQ ID NO: 284166 - RNA, 19 nt, Human
aaaguuccugacuaugcau

SEQ ID NO: 284167 - RNA, 25 nt, Human
aaaugaccuuugaucaagcacaggc

SEQ ID NO: 284168 - RNA, 24 nt, Human
aacaauaaaauggggaguagcaau

SEQ ID NO: 284169 - RNA, 21 nt, Human
aacagaaagccuaacguaagu

SEQ ID NO: 284170 - RNA, 21 nt, Human
aacugaacauugagcaaccuc

SEQ ID NO: 284171 - RNA, 24 nt, Human
aagaaaaaaaaacccaugaaagaa

SEQ ID NO: 284172 - RNA, 20 nt, Human
aagaagaaaaaaaaacccau

SEQ ID NO: 284173 - RNA, 22 nt, Human
aagaagaaaaaaaaacccauga

SEQ ID NO: 284174 - RNA, 18 nt, Human
aagcaaaaauaccagauu

SEQ ID NO: 284175 - RNA, 20 nt, Human
aagcaaaaauaccagauuuc

SEQ ID NO: 284176 - RNA, 24 nt, Human
aauccauuaccacuguucuuccau

SEQ ID NO: 284177 - RNA, 24 nt, Human
acagcagaagaaaaagaggcugga

SEQ ID NO: 284178 - RNA, 26 nt, Human
acaggagaaaaaccacuauuaacaga

SEQ ID NO: 284179 - RNA, 19 nt, Human
accaaaaagcaacuccaag

SEQ ID NO: 284180 - RNA, 22 nt, Human
accaaaaagcaacuccaagaaa

SEQ ID NO: 284181 - RNA, 23 nt, Human
accacaaauaagacaacaaacag

SEQ ID NO: 284182 - RNA, 25 nt, Human
acccaguaaggucaucuccuaaucu

SEQ ID NO: 284183 - RNA, 24 nt, Human
agaagaaaaagaggcuggacaaaa

SEQ ID NO: 284184 - RNA, 19 nt, Human
agacaacaaacagagaaca

SEQ ID NO: 284185 - RNA, 23 nt, Human
agacaacaaacagagaacaagcu

SEQ ID NO: 284186 - RNA, 25 nt, Human
agacaacaaacagagaacaagcuuc

SEQ ID NO: 284187 - RNA, 22 nt, Human
agagaacaagcuucuuaucuuc

SEQ ID NO: 284188 - RNA, 19 nt, Human
agagugagaaaacagcaac

SEQ ID NO: 284189 - RNA, 24 nt, Human
agagugagaaaacagcaacugaau

SEQ ID NO: 284190 - RNA, 19 nt, Human
aggcgccgagacggccacg

SEQ ID NO: 284191 - RNA, 21 nt, Human
aggcgccgagacggccacgcg

SEQ ID NO: 284192 - RNA, 21 nt, Human
aguagcaauggggcuguuacc

SEQ ID NO: 284193 - RNA, 18 nt, Human
auucagcugagaggggga

SEQ ID NO: 284194 - RNA, 23 nt, Human
caaaaacaucacacaauggacac

SEQ ID NO: 284195 - RNA, 19 nt, Human
caaauagguaagcugguac

SEQ ID NO: 284196 - RNA, 24 nt, Human
caagacacaggguuuacucuugag

SEQ ID NO: 284197 - RNA, 23 nt, Human
caagggccacuuauuucgugcug

SEQ ID NO: 284198 - RNA, 18 nt, Human
cacaagugaaaacaaggu

SEQ ID NO: 284199 - RNA, 23 nt, Human
caccacaaauaagacaacaaaca

SEQ ID NO: 284200 - RNA, 21 nt, Human
cacuauuaacagaaagccuaa

SEQ ID NO: 284201 - RNA, 18 nt, Human
cacugaacguuacaaucc

SEQ ID NO: 284202 - RNA, 22 nt, Human
cacugauuuuuaaaauugaagu

SEQ ID NO: 284203 - RNA, 21 nt, Human
cagaaagaagucugcggaaaa

SEQ ID NO: 284204 - RNA, 25 nt, Human
cagcagaagaaaaagaggcuggaca

SEQ ID NO: 284205 - RNA, 20 nt, Human
cagcgcaucugugcugcuua

SEQ ID NO: 284206 - RNA, 25 nt, Human
caggcgccgagacggccacgcggga

SEQ ID NO: 284207 - RNA, 18 nt, Human
cauaauccgguggcucug

SEQ ID NO: 284208 - RNA, 18 nt, Human
cauauagccaugaucauu

SEQ ID NO: 284209 - RNA, 19 nt, Human
caucacacaauggacacuu

SEQ ID NO: 284210 - RNA, 19 nt, Human
caugaaagaagccacauua

SEQ ID NO: 284211 - RNA, 18 nt, Human
ccagcgcaucugugcugc

SEQ ID NO: 284212 - RNA, 22 nt, Human
ccauuaaacgagugccaccaca

SEQ ID NO: 284213 - RNA, 18 nt, Human
ccauuaccacuguucuuc

SEQ ID NO: 284214 - RNA, 21 nt, Human
ccauuaccacuguucuuccau

SEQ ID NO: 284215 - RNA, 26 nt, Human
ccucccuuucuauucacuccuguccc

SEQ ID NO: 284216 - RNA, 19 nt, Human
ccugucccuagaccuaaaa

SEQ ID NO: 284217 - RNA, 23 nt, Human
cuaauauuagccuuuuccuuggg

SEQ ID NO: 284218 - RNA, 23 nt, Human
cuaauggccauaccaauuauauu

SEQ ID NO: 284219 - RNA, 19 nt, Human
cucugccauguucccuacu

SEQ ID NO: 284220 - RNA, 21 nt, Human
cuguuacccauuuuucuuuca

SEQ ID NO: 284221 - RNA, 19 nt, Human
gaacuacagacacaagaca

SEQ ID NO: 284222 - RNA, 21 nt, Human
gaagcaugcauugauguaaaa

SEQ ID NO: 284223 - RNA, 22 nt, Human
gaaguauuuuuucauauccuca

SEQ ID NO: 284224 - RNA, 22 nt, Human
gaaucaaauagguaagcuggua

SEQ ID NO: 284225 - RNA, 24 nt, Human
gacaacaaacagagaacaagcuuc

SEQ ID NO: 284226 - RNA, 18 nt, Human
gagcugauuaugaguacc

SEQ ID NO: 284227 - RNA, 18 nt, Human
ggaguagcaauggggcug

SEQ ID NO: 284228 - RNA, 18 nt, Human
gguccuguuuuauucuuu

SEQ ID NO: 284229 - RNA, 18 nt, Human
guacccaguaaggucauc

SEQ ID NO: 284230 - RNA, 19 nt, Human
guggaacagcagaagaaaa

SEQ ID NO: 284231 - RNA, 22 nt, Human
uaaaaagaagaaaaaaaaaccc

SEQ ID NO: 284232 - RNA, 21 nt, Human
uaaacugaauuaucaugguca

SEQ ID NO: 284233 - RNA, 25 nt, Human
uaaagcaugcuuaggaugagaucag

SEQ ID NO: 284234 - RNA, 22 nt, Human
uaacagaaagccuaacguaagu

SEQ ID NO: 284235 - RNA, 18 nt, Human
uaacaguagugacuaaua

SEQ ID NO: 284236 - RNA, 20 nt, Human
uaagauuuagcaaacuguaa

SEQ ID NO: 284237 - RNA, 23 nt, Human
uacacaaaugaccuuugaucaag

SEQ ID NO: 284238 - RNA, 24 nt, Human
uagaaagguggaacagcagaagaa

SEQ ID NO: 284239 - RNA, 22 nt, Human
uagaauaaauaaauacaaaauu

SEQ ID NO: 284240 - RNA, 22 nt, Human
uagagaacugagagaaaaacca

SEQ ID NO: 284241 - RNA, 19 nt, Human
uagagcucuccucccuuuc

SEQ ID NO: 284242 - RNA, 23 nt, Human
uaugaaagaaagccuuuuucuga

SEQ ID NO: 284243 - RNA, 24 nt, Human
uaugguccuguuuuauucuuuaga

SEQ ID NO: 284244 - RNA, 21 nt, Human
ucauauccucaaccgagcaua

SEQ ID NO: 284245 - RNA, 20 nt, Human
uccucccuuucuauucacuc

SEQ ID NO: 284246 - RNA, 20 nt, Human
ucuacacguaaugugaaggu

SEQ ID NO: 284247 - RNA, 18 nt, Human
ucuagaauaaauaaauac

SEQ ID NO: 284248 - RNA, 21 nt, Human
ucuagaauaaauaaauacaaa

SEQ ID NO: 284249 - RNA, 23 nt, Human
ugaaucaaauagguaagcuggua

SEQ ID NO: 284250 - RNA, 18 nt, Human
ugacuguuccacccgcaa

SEQ ID NO: 284251 - RNA, 20 nt, Human
ugcacaagugaaaacaaggu

SEQ ID NO: 284252 - RNA, 25 nt, Human
ugcuuuacaacugcaaaaauauuca

SEQ ID NO: 284253 - RNA, 21 nt, Human
uggaacagcagaagaaaaaga

SEQ ID NO: 284254 - RNA, 22 nt, Human
uggggaguagcaauggggcugu

SEQ ID NO: 284255 - RNA, 21 nt, Human
uguaaaacaauaaaaugggga

SEQ ID NO: 284256 - RNA, 25 nt, Human
uuaccaaaaagcaacuccaagaaaa

SEQ ID NO: 284257 - RNA, 21 nt, Human
uuaccacuguucuuccauucg

SEQ ID NO: 284258 - RNA, 24 nt, Human
uucaaaagguaagcauauuuuaaa

SEQ ID NO: 284259 - RNA, 20 nt, Human
uucaauaacaucugcaguug

SEQ ID NO: 284260 - RNA, 19 nt, Human
uuccugguuucggaaguau

SEQ ID NO: 284261 - RNA, 18 nt, Human
uuuacaguuguucagucu

SEQ ID NO: 284262 - RNA, 21 nt, Human
uuucugacuuuugaacuacag

SEQ ID NO: 284263 - RNA, 24 nt, Human
aaggugcuaggauuacaggcguga

SEQ ID NO: 284264 - RNA, 19 nt, Human
aaguagcuaggauuacagg

SEQ ID NO: 284265 - RNA, 25 nt, Human
aaguagcuaggauuacaggcaccca

SEQ ID NO: 284266 - RNA, 24 nt, Human
aagugauccgcccgccucggccuc

SEQ ID NO: 284267 - RNA, 23 nt, Human
acaggcacccaccaccacgcccg

SEQ ID NO: 284268 - RNA, 18 nt, Human
accauguuggccaggcug

SEQ ID NO: 284269 - RNA, 18 nt, Human
acggaguuucaccauguu

SEQ ID NO: 284270 - RNA, 24 nt, Human
acggaguuucaccauguuggccag

SEQ ID NO: 284271 - RNA, 22 nt, Human
acugcaacacacugcauuuccu

SEQ ID NO: 284272 - RNA, 26 nt, Human
acugcaacacacugcauuuugcgugc

SEQ ID NO: 284273 - RNA, 19 nt, Human
agaaaaggccacugcaaca

SEQ ID NO: 284274 - RNA, 24 nt, Human
agcugggauuacaagcgcacccca

SEQ ID NO: 284275 - RNA, 23 nt, Human
aggaggugaaggaugauggaggg

SEQ ID NO: 284276 - RNA, 20 nt, Human
aggcacccaccaccacgccc

SEQ ID NO: 284277 - RNA, 26 nt, Human
aggugcuaggauuacaggcgugagcc

SEQ ID NO: 284278 - RNA, 19 nt, Human
aguagcugggauuacaagc

SEQ ID NO: 284279 - RNA, 24 nt, Human
auuuuuguauuuuuaguagagacg

SEQ ID NO: 284280 - RNA, 22 nt, Human
caagcaauucuccugccucagc

SEQ ID NO: 284281 - RNA, 22 nt, Human
caagcaauucuccugccucagc

SEQ ID NO: 284282 - RNA, 27 nt, Human
caagcaauucuccugccucagccuccc

SEQ ID NO: 284283 - RNA, 24 nt, Human
caaggugcuaggauuacaggcgug

SEQ ID NO: 284284 - RNA, 24 nt, Human
caccacacccggcuaauuuuugua

SEQ ID NO: 284285 - RNA, 21 nt, Human
caccauguuggccaggcuggu

SEQ ID NO: 284286 - RNA, 22 nt, Human
caccauguuggccaggcugguc

SEQ ID NO: 284287 - RNA, 27 nt, Human
caccauguuggccaggcuggucuggaa

SEQ ID NO: 284288 - RNA, 18 nt, Human
cacccaccaccacgcccg

SEQ ID NO: 284289 - RNA, 19 nt, Human
caccccaccacacccggcu

SEQ ID NO: 284290 - RNA, 22 nt, Human
caccgcaaccuccaccucaugg

SEQ ID NO: 284291 - RNA, 24 nt, Human
caccucccaaguucaagcaauucu

SEQ ID NO: 284292 - RNA, 25 nt, Human
cacugcaacacacugcauuuccuua

SEQ ID NO: 284293 - RNA, 21 nt, Human
caggcacccaccaccacgccc

SEQ ID NO: 284294 - RNA, 24 nt, Human
cauguuggccaggcuggucuggaa

SEQ ID NO: 284295 - RNA, 22 nt, Human
ccaaggugcuaggauuacaggc

SEQ ID NO: 284296 - RNA, 24 nt, Human
ccaaggugcuaggauuacaggcgu

SEQ ID NO: 284297 - RNA, 26 nt, Human
ccaccucccaaguucaagcaauucuu

SEQ ID NO: 284298 - RNA, 20 nt, Human
ccacgcccgguuaacuuuug

SEQ ID NO: 284299 - RNA, 23 nt, Human
cccaaguagcuaggauuacaggc

SEQ ID NO: 284300 - RNA, 24 nt, Human
cccaaguagcuaggauuacaggca

SEQ ID NO: 284301 - RNA, 19 nt, Human
cccgaguagcugggauuac

SEQ ID NO: 284302 - RNA, 20 nt, Human
ccgauugacaaaaagaagaa

SEQ ID NO: 284303 - RNA, 18 nt, Human
ccgcaaccuccaccucau

SEQ ID NO: 284304 - RNA, 24 nt, Human
ccgcaaccuccaccucauggguuc

SEQ ID NO: 284305 - RNA, 24 nt, Human
ccucauggguucaagcaauucucc

SEQ ID NO: 284306 - RNA, 18 nt, Human
ccuccaccucccaaguuc

SEQ ID NO: 284307 - RNA, 24 nt, Human
ccucccaaguucaagcaauucucc

SEQ ID NO: 284308 - RNA, 18 nt, Human
ccugaccucaagugaucc

SEQ ID NO: 284309 - RNA, 19 nt, Human
ccugaccucaagugauccg

SEQ ID NO: 284310 - RNA, 22 nt, Human
ccugaccucaagugauccgccc

SEQ ID NO: 284311 - RNA, 23 nt, Human
ccugccucagccucccaaguagc

SEQ ID NO: 284312 - RNA, 23 nt, Human
ccugccucagccucccgaguagc

SEQ ID NO: 284313 - RNA, 24 nt, Human
ccugccucagccucccgaguagcu

SEQ ID NO: 284314 - RNA, 21 nt, Human
cgauugacaaaaagaagaagg

SEQ ID NO: 284315 - RNA, 21 nt, Human
cgcaaccuugcugacugggcg

SEQ ID NO: 284316 - RNA, 23 nt, Human
cgccucggccucccaaggugcua

SEQ ID NO: 284317 - RNA, 24 nt, Human
cgccucggccucccaaggugcuag

SEQ ID NO: 284318 - RNA, 24 nt, Human
cggugucuugcucuguugcccagg

SEQ ID NO: 284319 - RNA, 23 nt, Human
cuaauuuuuguauuuuuaguaga

SEQ ID NO: 284320 - RNA, 24 nt, Human
cucaccgcaaccuccaccucaugg

SEQ ID NO: 284321 - RNA, 23 nt, Human
cucagccucccgaguagcuggga

SEQ ID NO: 284322 - RNA, 24 nt, Human
cucccaaguagcuaggauuacagg

SEQ ID NO: 284323 - RNA, 26 nt, Human
cuccugaccucaagugauccgcccgc

SEQ ID NO: 284324 - RNA, 29 nt, Human
cucuguugcccaggcuagggugcaauggg

SEQ ID NO: 284325 - RNA, 23 nt, Human
cugccucagccucccaaguagcu

SEQ ID NO: 284326 - RNA, 21 nt, Human
cuugcucugucacccgggcug

SEQ ID NO: 284327 - RNA, 24 nt, Human
gacaaaaagaagaagguguuccag

SEQ ID NO: 284328 - RNA, 24 nt, Human
gaccucaagugauccgcccgccuc

SEQ ID NO: 284329 - RNA, 24 nt, Human
gaguagcugggauuacaagcgcac

SEQ ID NO: 284330 - RNA, 21 nt, Human
gaugagugucccaguaaaggu

SEQ ID NO: 284331 - RNA, 18 nt, Human
gauuacaggcgugagcca

SEQ ID NO: 284332 - RNA, 20 nt, Human
gauuacaggcgugagccacc

SEQ ID NO: 284333 - RNA, 21 nt, Human
gauuacaggcgugagccaccg

SEQ ID NO: 284334 - RNA, 23 nt, Human
gcuggucuggaacuccugaccuc

SEQ ID NO: 284335 - RNA, 23 nt, Human
ggaguuucaccauguuggccagg

SEQ ID NO: 284336 - RNA, 22 nt, Human
ggauuacaggcacccaccacca

SEQ ID NO: 284337 - RNA, 22 nt, Human
ggauuacaggcgugagccaccg

SEQ ID NO: 284338 - RNA, 22 nt, Human
ggcaaggguggugcgggaagaa

SEQ ID NO: 284339 - RNA, 24 nt, Human
ggcuggucuggaacuccugaccuc

SEQ ID NO: 284340 - RNA, 23 nt, Human
gggccagcgcaggcaaggguggu

SEQ ID NO: 284341 - RNA, 20 nt, Human
ggguucaagcaauucuccug

SEQ ID NO: 284342 - RNA, 24 nt, Human
ggugcaauggugccaucuuggcuc

SEQ ID NO: 284343 - RNA, 18 nt, Human
guagcugggauuacaagc

SEQ ID NO: 284344 - RNA, 24 nt, Human
gugauccgcccgccucggccuccc

SEQ ID NO: 284345 - RNA, 20 nt, Human
gugccgauugacaaaaagaa

SEQ ID NO: 284346 - RNA, 21 nt, Human
guuccaguguaacagaugagu

SEQ ID NO: 284347 - RNA, 19 nt, Human
uaaaccgggggugggggua

SEQ ID NO: 284348 - RNA, 22 nt, Human
uaagacggugucuugcucuguu

SEQ ID NO: 284349 - RNA, 24 nt, Human
uaauuuuuguauuuuuaguagaga

SEQ ID NO: 284350 - RNA, 19 nt, Human
uacaggcgugagccaccgc

SEQ ID NO: 284351 - RNA, 20 nt, Human
uacaggcgugagccaccgcu

SEQ ID NO: 284352 - RNA, 24 nt, Human
uacaggcgugagccaccgcuccca

SEQ ID NO: 284353 - RNA, 19 nt, Human
uacagugguacaaucuugg

SEQ ID NO: 284354 - RNA, 22 nt, Human
uagagacggaguuucaccaugu

SEQ ID NO: 284355 - RNA, 20 nt, Human
uaggaggugaaggaugauga

SEQ ID NO: 284356 - RNA, 20 nt, Human
uaggaggugaaggaugaugg

SEQ ID NO: 284357 - RNA, 19 nt, Human
uaggauuacaggcacccac

SEQ ID NO: 284358 - RNA, 21 nt, Human
uaggauuacaggcacccacca

SEQ ID NO: 284359 - RNA, 24 nt, Human
uaggauuacaggcacccaccacca

SEQ ID NO: 284360 - RNA, 18 nt, Human
uaggauuacaggcgugag

SEQ ID NO: 284361 - RNA, 19 nt, Human
uaggauuacaggcgugagc

SEQ ID NO: 284362 - RNA, 21 nt, Human
uaggauuacaggcgugagcca

SEQ ID NO: 284363 - RNA, 22 nt, Human
uaggauuacaggcgugagccac

SEQ ID NO: 284364 - RNA, 23 nt, Human
uaggauuacaggcgugagccacc

SEQ ID NO: 284365 - RNA, 24 nt, Human
uaggauuacaggcgugagccaccg

SEQ ID NO: 284366 - RNA, 24 nt, Human
uaguagagacggaguuucaccaug

SEQ ID NO: 284367 - RNA, 25 nt, Human
uaguagagacggaguuucaccaugu

SEQ ID NO: 284368 - RNA, 19 nt, Human
ucaagcaauucuccugccu

SEQ ID NO: 284369 - RNA, 24 nt, Human
ucaccgcaaccuccaccucauggg

SEQ ID NO: 284370 - RNA, 22 nt, Human
ucagcagggguaaccaaaugcc

SEQ ID NO: 284371 - RNA, 24 nt, Human
ucagcagggguaaccaaaugccaa

SEQ ID NO: 284372 - RNA, 20 nt, Human
ucagccucccaaguagcuag

SEQ ID NO: 284373 - RNA, 20 nt, Human
ucagccucccgaguagcugg

SEQ ID NO: 284374 - RNA, 24 nt, Human
ucauggguucaagcaauucuccug

SEQ ID NO: 284375 - RNA, 24 nt, Human
ucccaaggugcuaggauuacaggc

SEQ ID NO: 284376 - RNA, 24 nt, Human
ucccaaguagcuaggauuacaggc

SEQ ID NO: 284377 - RNA, 21 nt, Human
ucccaaguucaagcaauucuc

SEQ ID NO: 284378 - RNA, 24 nt, Human
ucccaaguucaagcaauucuccug

SEQ ID NO: 284379 - RNA, 25 nt, Human
ucccagccgcaccguuuuuuuccuc

SEQ ID NO: 284380 - RNA, 18 nt, Human
ucccgaguagcugggauu

SEQ ID NO: 284381 - RNA, 21 nt, Human
uccugcuggcugggaccuugc

SEQ ID NO: 284382 - RNA, 18 nt, Human
ucggccucccaaggugcu

SEQ ID NO: 284383 - RNA, 26 nt, Human
ucuccugccucagccucccaaguagc

SEQ ID NO: 284384 - RNA, 24 nt, Human
ucuccugccucagccucccgagua

SEQ ID NO: 284385 - RNA, 18 nt, Human
ucugucacccgggcugga

SEQ ID NO: 284386 - RNA, 24 nt, Human
ucuguugcccaggcuagggugcaa

SEQ ID NO: 284387 - RNA, 23 nt, Human
ucuugcucugucacccgggcugg

SEQ ID NO: 284388 - RNA, 24 nt, Human
ucuugcucugucacccgggcugga

SEQ ID NO: 284389 - RNA, 18 nt, Human
ucuugcucuguugcccag

SEQ ID NO: 284390 - RNA, 19 nt, Human
ucuugcucuguugcccagg

SEQ ID NO: 284391 - RNA, 23 nt, Human
ucuugcucuguugcccaggcuag

SEQ ID NO: 284392 - RNA, 23 nt, Human
ucuugcucuguugcccaggcuag

SEQ ID NO: 284393 - RNA, 24 nt, Human
ucuugcucuguugcccaggcuagg

SEQ ID NO: 284394 - RNA, 25 nt, Human
ucuugcucuguugcccaggcuaggg

SEQ ID NO: 284395 - RNA, 27 nt, Human
ucuugcucuguugcccaggcuagggug

SEQ ID NO: 284396 - RNA, 24 nt, Human
ucuuggccuccaccucccaaguuc

SEQ ID NO: 284397 - RNA, 23 nt, Human
ugacaaaaagaagaagguguucc

SEQ ID NO: 284398 - RNA, 18 nt, Human
ugaccucaagugauccgc

SEQ ID NO: 284399 - RNA, 24 nt, Human
ugaccucaagugauccgcccgccu

SEQ ID NO: 284400 - RNA, 18 nt, Human
ugauggagggggcuaugu

SEQ ID NO: 284401 - RNA, 19 nt, Human
ugcaacgcuucaccugcug

SEQ ID NO: 284402 - RNA, 18 nt, Human
ugcccaggcuagggugca

SEQ ID NO: 284403 - RNA, 23 nt, Human
ugccucagccucccaaguagcua

SEQ ID NO: 284404 - RNA, 24 nt, Human
ugccucagccucccaaguagcuag

SEQ ID NO: 284405 - RNA, 24 nt, Human
ugccucagccucccgaguagcugg

SEQ ID NO: 284406 - RNA, 24 nt, Human
ugcuaggauuacaggcgugagcca

SEQ ID NO: 284407 - RNA, 19 nt, Human
ugcucugucacccgggcug

SEQ ID NO: 284408 - RNA, 24 nt, Human
ugcucuguugcccaggcuagggug

SEQ ID NO: 284409 - RNA, 23 nt, Human
uggaauacagugguacaaucuug

SEQ ID NO: 284410 - RNA, 24 nt, Human
uggaauacagugguacaaucuugg

SEQ ID NO: 284411 - RNA, 20 nt, Human
uggagugggggauaggaggu

SEQ ID NO: 284412 - RNA, 24 nt, Human
uggccaggcuggucuggaacuccu

SEQ ID NO: 284413 - RNA, 19 nt, Human
ugggauuacaagcgcaccc

SEQ ID NO: 284414 - RNA, 24 nt, Human
ugggauuacaagcgcaccccacca

SEQ ID NO: 284415 - RNA, 21 nt, Human
uggguucaagcaauucuccug

SEQ ID NO: 284416 - RNA, 23 nt, Human
uggguucaagcaauucuccugcc

SEQ ID NO: 284417 - RNA, 24 nt, Human
uggguucaagcaauucuccugccu

SEQ ID NO: 284418 - RNA, 21 nt, Human
uguauuuuuaguagagacgga

SEQ ID NO: 284419 - RNA, 24 nt, Human
uguccugcuggcugggaccuugca

SEQ ID NO: 284420 - RNA, 21 nt, Human
ugucuugcucuguugcccagg

SEQ ID NO: 284421 - RNA, 22 nt, Human
uuaagagagcacugaugcucag

SEQ ID NO: 284422 - RNA, 18 nt, Human
uuaguagagacggaguuu

SEQ ID NO: 284423 - RNA, 24 nt, Human
uuaguagagacggaguuucaccau

SEQ ID NO: 284424 - RNA, 21 nt, Human
uucaagcaauucuccugccuc

SEQ ID NO: 284425 - RNA, 21 nt, Human
uucaagcaauucuccugccuc

SEQ ID NO: 284426 - RNA, 24 nt, Human
uucaagcaauucuccugccucagc

SEQ ID NO: 284427 - RNA, 24 nt, Human
uucaagcaauucuccugccucagc

SEQ ID NO: 284428 - RNA, 25 nt, Human
uucaccugcuggucccaguggcagg

SEQ ID NO: 284429 - RNA, 21 nt, Human
uuccuuacaguggucugugcc

SEQ ID NO: 284430 - RNA, 18 nt, Human
uugcccaggcuagggugc

SEQ ID NO: 284431 - RNA, 23 nt, Human
uuguauuuuuaguagagacggag

SEQ ID NO: 284432 - RNA, 24 nt, Human
uuucaccauguuggccaggcuggu

SEQ ID NO: 284433 - RNA, 24 nt, Human
uuuuuaguagagacggaguuucac

SEQ ID NO: 284434 - RNA, 20 nt, Human
uuuuuguauuuuuaguagag

SEQ ID NO: 284435 - RNA, 18 nt, Human
uuuuuuuuuuuuuuuuug

SEQ ID NO: 284436 - RNA, 21 nt, Human
aaaaaaacaaaaagaagccca

SEQ ID NO: 284437 - RNA, 23 nt, Human
aaaaacaaaaagaaaacaaaucu

SEQ ID NO: 284438 - RNA, 30 nt, Human
aaaaagaaaacaaaucuagaauaacagaaa

SEQ ID NO: 284439 - RNA, 24 nt, Human
aaaacaaaaagaaaacaaaucuag

SEQ ID NO: 284440 - RNA, 23 nt, Human
aaaaccacagugcuaaucaaaac

SEQ ID NO: 284441 - RNA, 26 nt, Human
aaaagcaaacaaacaaauaaacaaaa

SEQ ID NO: 284442 - RNA, 19 nt, Human
aaacacaggcucuuccggg

SEQ ID NO: 284443 - RNA, 22 nt, Human
aaacagauuaaaccagaacugg

SEQ ID NO: 284444 - RNA, 24 nt, Human
aaaccagaacuggagcagaaagga

SEQ ID NO: 284445 - RNA, 25 nt, Human
aaauaaacaaaaacaaaaagaaaac

SEQ ID NO: 284446 - RNA, 22 nt, Human
aaaucucugcagaugguggaag

SEQ ID NO: 284447 - RNA, 22 nt, Human
aacaaacaaauaaacaaaaaca

SEQ ID NO: 284448 - RNA, 22 nt, Human
aacagaaaaaaacaaaaagaag

SEQ ID NO: 284449 - RNA, 25 nt, Human
aacccugcccaccccgcccccaacc

SEQ ID NO: 284450 - RNA, 25 nt, Human
aagaugccaaugucugcugauggug

SEQ ID NO: 284451 - RNA, 21 nt, Human
aagcaaacaaacaaauaaaca

SEQ ID NO: 284452 - RNA, 28 nt, Human
aagcaaacaaacaaauaaacaaaaacaa

SEQ ID NO: 284453 - RNA, 19 nt, Human
aagcauaaaggcuggcacc

SEQ ID NO: 284454 - RNA, 27 nt, Human
aagcuggaaauaaaagcaaagggaccc

SEQ ID NO: 284455 - RNA, 23 nt, Human
aagcugguuugcucuccgcagug

SEQ ID NO: 284456 - RNA, 24 nt, Human
aauaacagaaaaaaacaaaaagaa

SEQ ID NO: 284457 - RNA, 18 nt, Human
aaugaaugauuauccuac

SEQ ID NO: 284458 - RNA, 22 nt, Human
acaaaaagaaaacaaaucuaga

SEQ ID NO: 284459 - RNA, 21 nt, Human
acccugcccaccccgccccca

SEQ ID NO: 284460 - RNA, 20 nt, Human
acugacacuuucucccuucu

SEQ ID NO: 284461 - RNA, 23 nt, Human
acuggagcagaaaggagacucua

SEQ ID NO: 284462 - RNA, 22 nt, Human
agaaaacaaaucuagaauaaca

SEQ ID NO: 284463 - RNA, 28 nt, Human
agaaaacaaaucuagaauaacagaaaag

SEQ ID NO: 284464 - RNA, 19 nt, Human
agaaaggaguguuagacaa

SEQ ID NO: 284465 - RNA, 21 nt, Human
agaacccugcccaccccgccc

SEQ ID NO: 284466 - RNA, 18 nt, Human
agagaagcagaggaaagg

SEQ ID NO: 284467 - RNA, 20 nt, Human
agagaggaagacaggugggu

SEQ ID NO: 284468 - RNA, 24 nt, Human
aggacuccggcagccgcacagucc

SEQ ID NO: 284469 - RNA, 24 nt, Human
aggagacucuagcugaagucaucc

SEQ ID NO: 284470 - RNA, 21 nt, Human
aggauagugucccagaaagaa

SEQ ID NO: 284471 - RNA, 23 nt, Human
agucccugcagcacaccugugcg

SEQ ID NO: 284472 - RNA, 20 nt, Human
auaaaugaauacagugggag

SEQ ID NO: 284473 - RNA, 23 nt, Human
aucagcuuuuuacuggauaguuu

SEQ ID NO: 284474 - RNA, 19 nt, Human
aucuguuagugucucccuu

SEQ ID NO: 284475 - RNA, 20 nt, Human
caaaaacaaaaagaaaacaa

SEQ ID NO: 284476 - RNA, 22 nt, Human
caaaaagaaaacaaaucuagaa

SEQ ID NO: 284477 - RNA, 24 nt, Human
caaacaaacaaauaaacaaaaaca

SEQ ID NO: 284478 - RNA, 27 nt, Human
caaacaaauaaacaaaaacaaaaagaa

SEQ ID NO: 284479 - RNA, 18 nt, Human
caagcuggaaauaaaagc

SEQ ID NO: 284480 - RNA, 21 nt, Human
caagguagcaggagcagaccc

SEQ ID NO: 284481 - RNA, 18 nt, Human
cacagugcuaaucaaaac

SEQ ID NO: 284482 - RNA, 22 nt, Human
caccccgcccccaaccccacuc

SEQ ID NO: 284483 - RNA, 22 nt, Human
cacuuggauguagcucuugcug

SEQ ID NO: 284484 - RNA, 20 nt, Human
cagaaaaaaacaaaaagaaa

SEQ ID NO: 284485 - RNA, 22 nt, Human
cccaaacuucaaaucucugcag

SEQ ID NO: 284486 - RNA, 27 nt, Human
cccaaccccacucauucaagcuggaaa

SEQ ID NO: 284487 - RNA, 22 nt, Human
ccccaaagccauuggagaagca

SEQ ID NO: 284488 - RNA, 21 nt, Human
ccccaaccccacucauucaag

SEQ ID NO: 284489 - RNA, 23 nt, Human
ccccaaccccacucauucaagcu

SEQ ID NO: 284490 - RNA, 26 nt, Human
ccccaaccccacucauucaagcugga

SEQ ID NO: 284491 - RNA, 23 nt, Human
cccccaaccccacucauucaagc

SEQ ID NO: 284492 - RNA, 19 nt, Human
cccugcccaccccgccccc

SEQ ID NO: 284493 - RNA, 19 nt, Human
ccgcccccaaccccacuca

SEQ ID NO: 284494 - RNA, 21 nt, Human
ccuuuguccuucaagugcaaa

SEQ ID NO: 284495 - RNA, 19 nt, Human
cgacagccacaacuuccca

SEQ ID NO: 284496 - RNA, 21 nt, Human
cgacagccacaacuucccagg

SEQ ID NO: 284497 - RNA, 23 nt, Human
cuacagaagauggcacaaucauc

SEQ ID NO: 284498 - RNA, 18 nt, Human
cucaagugcccucagcuu

SEQ ID NO: 284499 - RNA, 19 nt, Human
cugcaaugccuuuauuuug

SEQ ID NO: 284500 - RNA, 22 nt, Human
cugcccaccccgcccccaaccc

SEQ ID NO: 284501 - RNA, 24 nt, Human
gaaaaaaacaaaaagaagcccaag

SEQ ID NO: 284502 - RNA, 18 nt, Human
gaaucccaggcaacuuug

SEQ ID NO: 284503 - RNA, 22 nt, Human
gacucuucacuuugcauugcag

SEQ ID NO: 284504 - RNA, 19 nt, Human
gagcagaaaggagacucua

SEQ ID NO: 284505 - RNA, 23 nt, Human
gagcuggugaaguucuuccccaa

SEQ ID NO: 284506 - RNA, 20 nt, Human
gauaauaggacacuuggaug

SEQ ID NO: 284507 - RNA, 25 nt, Human
gaugaugaggagagaagcagaggaa

SEQ ID NO: 284508 - RNA, 23 nt, Human
gcaaacaaacaaauaaacaaaaa

SEQ ID NO: 284509 - RNA, 21 nt, Human
gcccaccccgcccccaacccc

SEQ ID NO: 284510 - RNA, 19 nt, Human
gcucuuguuuguaugcugg

SEQ ID NO: 284511 - RNA, 22 nt, Human
gcugaagucaucccacucaggc

SEQ ID NO: 284512 - RNA, 20 nt, Human
ggcaggucugcgauugaugc

SEQ ID NO: 284513 - RNA, 26 nt, Human
gucaucccacucaggcggguggacuc

SEQ ID NO: 284514 - RNA, 21 nt, Human
gucccaggagacaagacagca

SEQ ID NO: 284515 - RNA, 24 nt, Human
guuuuccaacugaggcagggcagg

SEQ ID NO: 284516 - RNA, 30 nt, Human
uaaaagcaaacaaacaaauaaacaaaaacc

SEQ ID NO: 284517 - RNA, 18 nt, Human
uaaagaguccacaacaca

SEQ ID NO: 284518 - RNA, 21 nt, Human
uaacuguaccauuacuuugau

SEQ ID NO: 284519 - RNA, 21 nt, Human
uaagaaaauaaucacagauaa

SEQ ID NO: 284520 - RNA, 20 nt, Human
uaaggaaagccagccauagg

SEQ ID NO: 284521 - RNA, 25 nt, Human
uagaauaacagaaaaaaacaaaaag

SEQ ID NO: 284522 - RNA, 18 nt, Human
uagacugagggccugaaa

SEQ ID NO: 284523 - RNA, 21 nt, Human
uagagaggaagacaggugggu

SEQ ID NO: 284524 - RNA, 19 nt, Human
uagcaggagcagaccccau

SEQ ID NO: 284525 - RNA, 20 nt, Human
uagcaggagcagaccccauu

SEQ ID NO: 284526 - RNA, 18 nt, Human
uagcuugcuacuuuggcc

SEQ ID NO: 284527 - RNA, 18 nt, Human
ucaaaucucugcagaugg

SEQ ID NO: 284528 - RNA, 23 nt, Human
ucaaguucuugcugcuaaggaaa

SEQ ID NO: 284529 - RNA, 22 nt, Human
uccaucagcuuuuuacuggaua

SEQ ID NO: 284530 - RNA, 21 nt, Human
ucccugcagcacaccugugcg

SEQ ID NO: 284531 - RNA, 21 nt, Human
ucccugcagcacaccugugcg

SEQ ID NO: 284532 - RNA, 20 nt, Human
ucccuucuguuugcaguguu

SEQ ID NO: 284533 - RNA, 24 nt, Human
uccgcaguguagauuaaagucugu

SEQ ID NO: 284534 - RNA, 21 nt, Human
ucuagaauaacagaaaaaaac

SEQ ID NO: 284535 - RNA, 22 nt, Human
ucucuuuuuaaaauagagguuc

SEQ ID NO: 284536 - RNA, 20 nt, Human
ucugcuucccaagaaagugu

SEQ ID NO: 284537 - RNA, 21 nt, Human
ucuucaaaaugccucccccuu

SEQ ID NO: 284538 - RNA, 20 nt, Human
ugaauacagugggagagaua

SEQ ID NO: 284539 - RNA, 22 nt, Human
ugaaugauuauccuacacgugg

SEQ ID NO: 284540 - RNA, 21 nt, Human
ugacaaaaccuaaauaaauca

SEQ ID NO: 284541 - RNA, 20 nt, Human
ugacauguacuuucuugaag

SEQ ID NO: 284542 - RNA, 21 nt, Human
ugagagaagcauaaaggcugg

SEQ ID NO: 284543 - RNA, 22 nt, Human
ugaggagagaagcagaggaaag

SEQ ID NO: 284544 - RNA, 24 nt, Human
ugaggagagaagcagaggaaaggg

SEQ ID NO: 284545 - RNA, 18 nt, Human
ugaggcagggcaggucug

SEQ ID NO: 284546 - RNA, 18 nt, Human
ugaguagagcggaggggc

SEQ ID NO: 284547 - RNA, 19 nt, Human
ugcaaaaggaaaaccacag

SEQ ID NO: 284548 - RNA, 22 nt, Human
ugcccaccccgcccccaacccc

SEQ ID NO: 284549 - RNA, 21 nt, Human
uggaaauaaaagcaaacaaac

SEQ ID NO: 284550 - RNA, 21 nt, Human
uggagaagcagcugcaucaga

SEQ ID NO: 284551 - RNA, 21 nt, Human
uggucacuugacuugcaaaau

SEQ ID NO: 284552 - RNA, 23 nt, Human
uggucacuugacuugcaaaauuu

SEQ ID NO: 284553 - RNA, 22 nt, Human
ugguggaaggaaugaguagagc

SEQ ID NO: 284554 - RNA, 18 nt, Human
uguugggaaugaugauga

SEQ ID NO: 284555 - RNA, 22 nt, Human
uguugggaaugaugaugaggag

SEQ ID NO: 284556 - RNA, 23 nt, Human
uucaagcuggaaauaaaagcaaa

SEQ ID NO: 284557 - RNA, 22 nt, Human
uucaggguguuuauugugaggc

SEQ ID NO: 284558 - RNA, 18 nt, Human
uucucauccucucugugg

SEQ ID NO: 284559 - RNA, 20 nt, Human
uuuuuuuuuuuuuuuuuugg

SEQ ID NO: 284560 - RNA, 22 nt, Human
aaaaaaaagaaaaaaaaaagaa

SEQ ID NO: 284561 - RNA, 21 nt, Human
aaaaaacaaaaacuucaaaaa

SEQ ID NO: 284562 - RNA, 18 nt, Human
aaaaaaccaaacaccgca

SEQ ID NO: 284563 - RNA, 22 nt, Human
aaaaaucacuuccuaggugagg

SEQ ID NO: 284564 - RNA, 18 nt, Human
aaaacuugcauaggagcc

SEQ ID NO: 284565 - RNA, 18 nt, Human
aaaagaaaaaaaaaggua

SEQ ID NO: 284566 - RNA, 26 nt, Human
aaaagccaacccccagaaaugauggc

SEQ ID NO: 284567 - RNA, 20 nt, Human
aaacaaguacugaugcucuu

SEQ ID NO: 284568 - RNA, 20 nt, Human
aaacauuaccaaaugugcaa

SEQ ID NO: 284569 - RNA, 19 nt, Human
aaacugcccaugcuacaac

SEQ ID NO: 284570 - RNA, 24 nt, Human
aaacugggcaguuguuagacuaaa

SEQ ID NO: 284571 - RNA, 21 nt, Human
aaagaguauuuuaacucaagu

SEQ ID NO: 284572 - RNA, 20 nt, Human
aaccggagcgcucuggcucc

SEQ ID NO: 284573 - RNA, 19 nt, Human
aaccugcacaaugugcaca

SEQ ID NO: 284574 - RNA, 18 nt, Human
aaccugcacccccucccu

SEQ ID NO: 284575 - RNA, 25 nt, Human
aagaaagacucuuucagaaccugga

SEQ ID NO: 284576 - RNA, 21 nt, Human
aagaacaaaaaaccaaacacc

SEQ ID NO: 284577 - RNA, 26 nt, Human
aagaacaaaaaaccaaacaccgcaua

SEQ ID NO: 284578 - RNA, 19 nt, Human
aagcagcaaaaaccgcagc

SEQ ID NO: 284579 - RNA, 20 nt, Human
aagcagcaaaaaccgcagcc

SEQ ID NO: 284580 - RNA, 18 nt, Human
aagcagcagugacagcug

SEQ ID NO: 284581 - RNA, 21 nt, Human
aagcagcagugacagcugccu

SEQ ID NO: 284582 - RNA, 18 nt, Human
aaggccaccuuccuaagu

SEQ ID NO: 284583 - RNA, 18 nt, Human
acacagucuccuuuuuuu

SEQ ID NO: 284584 - RNA, 20 nt, Human
acaguggagugaguucaaac

SEQ ID NO: 284585 - RNA, 18 nt, Human
accaaacaccgcauauuc

SEQ ID NO: 284586 - RNA, 23 nt, Human
accagagcgcugacauggcacca

SEQ ID NO: 284587 - RNA, 20 nt, Human
accuuuuaaaaaacaaaaac

SEQ ID NO: 284588 - RNA, 18 nt, Human
acgcuacagacaagcuac

SEQ ID NO: 284589 - RNA, 24 nt, Human
agaaauguccauuccucagauuuc

SEQ ID NO: 284590 - RNA, 19 nt, Human
agacaagcuacggcccagg

SEQ ID NO: 284591 - RNA, 22 nt, Human
agacuccugaggagcgcuggcu

SEQ ID NO: 284592 - RNA, 20 nt, Human
agacugcugguccccagcuc

SEQ ID NO: 284593 - RNA, 21 nt, Human
agagucaaaccauguuucuuu

SEQ ID NO: 284594 - RNA, 21 nt, Human
agauaagcagcaaaaaccgca

SEQ ID NO: 284595 - RNA, 23 nt, Human
agauaagcagcaaaaaccgcagc

SEQ ID NO: 284596 - RNA, 18 nt, Human
agcccgaggaccaaaccg

SEQ ID NO: 284597 - RNA, 24 nt, Human
agcugccuggccucaauccaccuu

SEQ ID NO: 284598 - RNA, 18 nt, Human
aggaacucaaaacagacc

SEQ ID NO: 284599 - RNA, 19 nt, Human
aggagccugggaccugaaa

SEQ ID NO: 284600 - RNA, 18 nt, Human
aggcaggcaagagucaag

SEQ ID NO: 284601 - RNA, 21 nt, Human
aggcgccggaaggguuaagcc

SEQ ID NO: 284602 - RNA, 19 nt, Human
aggggcaucauggaguuuc

SEQ ID NO: 284603 - RNA, 18 nt, Human
agucacagaacuauuucu

SEQ ID NO: 284604 - RNA, 20 nt, Human
auaagcagcaaaaaccgcag

SEQ ID NO: 284605 - RNA, 21 nt, Human
aucaccacagaaaaauuugua

SEQ ID NO: 284606 - RNA, 20 nt, Human
augaaacguagccucgcucc

SEQ ID NO: 284607 - RNA, 28 nt, Human
caaaaaaaaggagaaagaauaauccaaa

SEQ ID NO: 284608 - RNA, 24 nt, Human
caaaaugacuccgcacacaaaggu

SEQ ID NO: 284609 - RNA, 22 nt, Human
caagaacaaaaaaccaaacacc

SEQ ID NO: 284610 - RNA, 24 nt, Human
caagaacaaaaaaccaaacaccgc

SEQ ID NO: 284611 - RNA, 19 nt, Human
caagguaagcaauggcccc

SEQ ID NO: 284612 - RNA, 24 nt, Human
caagguaagcaauggccccaacuc

SEQ ID NO: 284613 - RNA, 22 nt, Human
caauagcaaagacuuggaacca

SEQ ID NO: 284614 - RNA, 24 nt, Human
cacaugagugugcauguacucacu

SEQ ID NO: 284615 - RNA, 20 nt, Human
cacauggaggugcugugggg

SEQ ID NO: 284616 - RNA, 20 nt, Human
cacccccucccuccuucaaa

SEQ ID NO: 284617 - RNA, 19 nt, Human
cacucuucuauuaucaccc

SEQ ID NO: 284618 - RNA, 19 nt, Human
cagaaccuggaaagggucc

SEQ ID NO: 284619 - RNA, 26 nt, Human
cagaauacaaaggagauauaaacacc

SEQ ID NO: 284620 - RNA, 21 nt, Human
cagcaaacauuucuauucccu

SEQ ID NO: 284621 - RNA, 20 nt, Human
cagcccaguuugcauuucca

SEQ ID NO: 284622 - RNA, 21 nt, Human
cagggagagcuaacuaucgca

SEQ ID NO: 284623 - RNA, 21 nt, Human
cagggccuugguagaagagug

SEQ ID NO: 284624 - RNA, 23 nt, Human
caguucauccauugccagauucu

SEQ ID NO: 284625 - RNA, 21 nt, Human
cauggccaaaaucugcacacc

SEQ ID NO: 284626 - RNA, 20 nt, Human
cauugggcccgcccaaggug

SEQ ID NO: 284627 - RNA, 21 nt, Human
cauuuguggaugucaccaguc

SEQ ID NO: 284628 - RNA, 22 nt, Human
ccaaacaccgcauauucucacu

SEQ ID NO: 284629 - RNA, 18 nt, Human
ccaacgccugcgccccgc

SEQ ID NO: 284630 - RNA, 19 nt, Human
ccaaggacuuaacaacugc

SEQ ID NO: 284631 - RNA, 22 nt, Human
ccaauacaucaaguacugcaga

SEQ ID NO: 284632 - RNA, 23 nt, Human
ccacugcucccuggccuccaggc

SEQ ID NO: 284633 - RNA, 24 nt, Human
ccagcaacuucccuucaacaaaca

SEQ ID NO: 284634 - RNA, 22 nt, Human
ccauauaaacugaaccugcacc

SEQ ID NO: 284635 - RNA, 25 nt, Human
cccauagccucugcaaaaugacugc

SEQ ID NO: 284636 - RNA, 19 nt, Human
cccaugcuacaaccuuggc

SEQ ID NO: 284637 - RNA, 18 nt, Human
ccccaauacaucaaguac

SEQ ID NO: 284638 - RNA, 19 nt, Human
cccccagaaaugauggcca

SEQ ID NO: 284639 - RNA, 22 nt, Human
cccugaaacaagggcucaaaaa

SEQ ID NO: 284640 - RNA, 19 nt, Human
ccgaauccgcgggcaaccc

SEQ ID NO: 284641 - RNA, 22 nt, Human
ccuccaggcagacugcuggucc

SEQ ID NO: 284642 - RNA, 18 nt, Human
ccuccggagacgggccgg

SEQ ID NO: 284643 - RNA, 24 nt, Human
cgccccgccccagcgaagcccgag

SEQ ID NO: 284644 - RNA, 22 nt, Human
cggagacgggccggauccuucc

SEQ ID NO: 284645 - RNA, 19 nt, Human
cuaaagccacaaaccacaa

SEQ ID NO: 284646 - RNA, 20 nt, Human
cuaccacaguguggcaaagg

SEQ ID NO: 284647 - RNA, 18 nt, Human
cuacugccuuucaguagc

SEQ ID NO: 284648 - RNA, 24 nt, Human
cuacugccuuucaguagcacuguu

SEQ ID NO: 284649 - RNA, 19 nt, Human
cucacucucuaucucucuc

SEQ ID NO: 284650 - RNA, 18 nt, Human
cucaugacauuucuggga

SEQ ID NO: 284651 - RNA, 18 nt, Human
cucucaauaaucuuccaa

SEQ ID NO: 284652 - RNA, 24 nt, Human
cucucagaguucaauggcccucug

SEQ ID NO: 284653 - RNA, 23 nt, Human
cugcauagaaacaaguacugaug

SEQ ID NO: 284654 - RNA, 21 nt, Human
cugcgccccgccccagcgaag

SEQ ID NO: 284655 - RNA, 23 nt, Human
cuggccuccaggcagacugcugg

SEQ ID NO: 284656 - RNA, 21 nt, Human
cuuaggcaucgccuucccaga

SEQ ID NO: 284657 - RNA, 23 nt, Human
cuucaacacaaaaugacuccgca

SEQ ID NO: 284658 - RNA, 19 nt, Human
cuuucaguucauccauugc

SEQ ID NO: 284659 - RNA, 21 nt, Human
gaaacaaguacugaugcucuu

SEQ ID NO: 284660 - RNA, 31 nt, Human
gaacacccccaaccuuuuaaaaaacaaaaag

SEQ ID NO: 284661 - RNA, 18 nt, Human
gaccagggcccgcuggcu

SEQ ID NO: 284662 - RNA, 23 nt, Human
gaccggccggccggccguccuuu

SEQ ID NO: 284663 - RNA, 20 nt, Human
gagcuacucagccacugcuc

SEQ ID NO: 284664 - RNA, 23 nt, Human
gagcuggagcugggaacagccuc

SEQ ID NO: 284665 - RNA, 19 nt, Human
gaguugaaaacugagcucc

SEQ ID NO: 284666 - RNA, 22 nt, Human
gcaagaacaaaaaaccaaacac

SEQ ID NO: 284667 - RNA, 22 nt, Human
gcaggagcagacgggcucuugg

SEQ ID NO: 284668 - RNA, 20 nt, Human
gcccaugcuacaaccuuggc

SEQ ID NO: 284669 - RNA, 18 nt, Human
gcccugaaacaagggcuc

SEQ ID NO: 284670 - RNA, 20 nt, Human
gccuccaggcagacugcugg

SEQ ID NO: 284671 - RNA, 18 nt, Human
gccugcgccccgccccag

SEQ ID NO: 284672 - RNA, 23 nt, Human
gcgggcaacccggauugcacugu

SEQ ID NO: 284673 - RNA, 25 nt, Human
gcuaaguuuugucccucaguggcug

SEQ ID NO: 284674 - RNA, 19 nt, Human
ggacauggaugaaauugga

SEQ ID NO: 284675 - RNA, 24 nt, Human
ggaccugaaaucuuguacuggugg

SEQ ID NO: 284676 - RNA, 22 nt, Human
ggagcgcucuggcuccuuccuc

SEQ ID NO: 284677 - RNA, 20 nt, Human
ggcagagucuggcuugaggg

SEQ ID NO: 284678 - RNA, 19 nt, Human
ggcgagguuagagcuggag

SEQ ID NO: 284679 - RNA, 18 nt, Human
gggagggauagcacuggg

SEQ ID NO: 284680 - RNA, 23 nt, Human
gguauuuucccccaagaaaacca

SEQ ID NO: 284681 - RNA, 19 nt, Human
guaggagacauguugagau

SEQ ID NO: 284682 - RNA, 21 nt, Human
uaaaagccaacccccagaaau

SEQ ID NO: 284683 - RNA, 18 nt, Human
uaacuaaccugcacaaug

SEQ ID NO: 284684 - RNA, 24 nt, Human
uaagcagcaaaaaccgcagcccga

SEQ ID NO: 284685 - RNA, 24 nt, Human
uacaucaaguacugcagaggcacc

SEQ ID NO: 284686 - RNA, 21 nt, Human
uaccuuagaaguaguauaauu

SEQ ID NO: 284687 - RNA, 19 nt, Human
uaccuuagaguuuccugac

SEQ ID NO: 284688 - RNA, 24 nt, Human
uaccuuagaguuuccugaccaggg

SEQ ID NO: 284689 - RNA, 19 nt, Human
uacugcagcaccagagcgc

SEQ ID NO: 284690 - RNA, 19 nt, Human
uagaccagagcaaaggcag

SEQ ID NO: 284691 - RNA, 22 nt, Human
uagcccccugggccauaauuuc

SEQ ID NO: 284692 - RNA, 22 nt, Human
uaggcugaaacugaaacugccc

SEQ ID NO: 284693 - RNA, 23 nt, Human
uauccucaguaggagacauguug

SEQ ID NO: 284694 - RNA, 19 nt, Human
ucaaaacagaccuucugag

SEQ ID NO: 284695 - RNA, 21 nt, Human
ucaaaacagaccuucugaggg

SEQ ID NO: 284696 - RNA, 20 nt, Human
ucaaguacugcagaggcacc

SEQ ID NO: 284697 - RNA, 20 nt, Human
ucacagagacuacuauuggg

SEQ ID NO: 284698 - RNA, 20 nt, Human
ucagaaccuggaaagggucc

SEQ ID NO: 284699 - RNA, 21 nt, Human
ucccccaagaaaaccagaguc

SEQ ID NO: 284700 - RNA, 22 nt, Human
ucccucaguggcugaacacccc

SEQ ID NO: 284701 - RNA, 23 nt, Human
ucccuuaggcaucgccuucccag

SEQ ID NO: 284702 - RNA, 23 nt, Human
uccggacagagaacaggcgcccc

SEQ ID NO: 284703 - RNA, 25 nt, Human
ucgcaagaacaaaaaaccaaacacc

SEQ ID NO: 284704 - RNA, 22 nt, Human
ucgggggaggggggagggauag

SEQ ID NO: 284705 - RNA, 18 nt, Human
ucucaggggcaucaugga

SEQ ID NO: 284706 - RNA, 19 nt, Human
ucugcaaaaugacugccca

SEQ ID NO: 284707 - RNA, 18 nt, Human
ucuugguuuuggcagagu

SEQ ID NO: 284708 - RNA, 22 nt, Human
ucuugguuuuggcagagucugg

SEQ ID NO: 284709 - RNA, 20 nt, Human
ucuuuagccccaaaucucuc

SEQ ID NO: 284710 - RNA, 22 nt, Human
ugaaaagagaauacuuucccau

SEQ ID NO: 284711 - RNA, 22 nt, Human
ugaaacaagggcucaaaaauca

SEQ ID NO: 284712 - RNA, 23 nt, Human
ugaagacagaauacaaaggagau

SEQ ID NO: 284713 - RNA, 19 nt, Human
ugaccagggcccgcuggcu

SEQ ID NO: 284714 - RNA, 22 nt, Human
ugaccagggcccgcuggcugcu

SEQ ID NO: 284715 - RNA, 21 nt, Human
ugaccccaauacaucaaguac

SEQ ID NO: 284716 - RNA, 21 nt, Human
ugagcaauugcaaacgugaca

SEQ ID NO: 284717 - RNA, 19 nt, Human
ugauugugguauuuucccc

SEQ ID NO: 284718 - RNA, 21 nt, Human
ugcacccccucccuccuucaa

SEQ ID NO: 284719 - RNA, 21 nt, Human
ugccucaguucccccgacugg

SEQ ID NO: 284720 - RNA, 20 nt, Human
ugccuggccucaauccaccu

SEQ ID NO: 284721 - RNA, 20 nt, Human
uggaauacuaugcagccaua

SEQ ID NO: 284722 - RNA, 20 nt, Human
uggauuaagaaaauguggcc

SEQ ID NO: 284723 - RNA, 24 nt, Human
uggcaacauacugcagcaccagag

SEQ ID NO: 284724 - RNA, 22 nt, Human
uggccuccaggcagacugcugg

SEQ ID NO: 284725 - RNA, 19 nt, Human
uggcugcauguaacagcag

SEQ ID NO: 284726 - RNA, 24 nt, Human
uggcugcuaagacuucuuccuggu

SEQ ID NO: 284727 - RNA, 18 nt, Human
uggggacugugguggggu

SEQ ID NO: 284728 - RNA, 20 nt, Human
uggggucgggggagggggga

SEQ ID NO: 284729 - RNA, 20 nt, Human
uggggucgggggagggggga

SEQ ID NO: 284730 - RNA, 19 nt, Human
ugguggcaaauauucaaga

SEQ ID NO: 284731 - RNA, 24 nt, Human
uguaaaaagaguauuuuaacucaa

SEQ ID NO: 284732 - RNA, 21 nt, Human
uguaaaaugagaauacuugca

SEQ ID NO: 284733 - RNA, 24 nt, Human
uuaaagggacuguggcccuauuag

SEQ ID NO: 284734 - RNA, 19 nt, Human
uuaagucagagugccaaag

SEQ ID NO: 284735 - RNA, 21 nt, Human
uuaagucagagugccaaaggc

SEQ ID NO: 284736 - RNA, 24 nt, Human
uuagaguauaauaaaaaaaagaaa

SEQ ID NO: 284737 - RNA, 24 nt, Human
uucaauauuuuguuaggcaggcaa

SEQ ID NO: 284738 - RNA, 21 nt, Human
uucagggccagggagagcuaa

SEQ ID NO: 284739 - RNA, 19 nt, Human
uucauccauugccagauuc

SEQ ID NO: 284740 - RNA, 21 nt, Human
uucccagauaagcagcaaaaa

SEQ ID NO: 284741 - RNA, 20 nt, Human
uuccugaccagggcccgcug

SEQ ID NO: 284742 - RNA, 19 nt, Human
uugaaaacugagcuccccu

SEQ ID NO: 284743 - RNA, 19 nt, Human
uuguccuaaguggcugcau

SEQ ID NO: 284744 - RNA, 18 nt, Human
uuuagcccccugggccau

SEQ ID NO: 284745 - RNA, 23 nt, Human
uuuccauauaaacugaaccugca

SEQ ID NO: 284746 - RNA, 21 nt, Human
uuugaaaaauggcaagccaag

SEQ ID NO: 284747 - RNA, 24 nt, Human
uuugcauuuccauauaaacugaac

SEQ ID NO: 284748 - RNA, 25 nt, Human
uuuguaagccaucucuugauuuugc

SEQ ID NO: 284749 - RNA, 20 nt, Human
aaacagaggccccaucuggc

SEQ ID NO: 284750 - RNA, 18 nt, Human
augcccaucuagcggccc

SEQ ID NO: 284751 - RNA, 19 nt, Human
caccccaugcccaucuagc

SEQ ID NO: 284752 - RNA, 23 nt, Human
caccuagagccguggacgggggc

SEQ ID NO: 284753 - RNA, 21 nt, Human
caucuggcggucccaaagccc

SEQ ID NO: 284754 - RNA, 18 nt, Human
ccaaagcccuccgaccua

SEQ ID NO: 284755 - RNA, 22 nt, Human
ccagaggcccaccccaugccca

SEQ ID NO: 284756 - RNA, 19 nt, Human
ccagccccccgguccgccc

SEQ ID NO: 284757 - RNA, 22 nt, Human
cccacuccacaucauggcucgc

SEQ ID NO: 284758 - RNA, 21 nt, Human
cccaucuggcggucccaaagc

SEQ ID NO: 284759 - RNA, 21 nt, Human
ccccccaacuccgaaaguccg

SEQ ID NO: 284760 - RNA, 25 nt, Human
ccccccaacuccgaaaguccggcuc

SEQ ID NO: 284761 - RNA, 22 nt, Human
ccccccgguccgcccgcucucc

SEQ ID NO: 284762 - RNA, 25 nt, Human
ccccgcugucucugcgccucguccg

SEQ ID NO: 284763 - RNA, 21 nt, Human
cccgcaccggcccagcccccc

SEQ ID NO: 284764 - RNA, 23 nt, Human
cccgccccaccuagagccgugga

SEQ ID NO: 284765 - RNA, 23 nt, Human
cccggaccccccaacuccgaaag

SEQ ID NO: 284766 - RNA, 19 nt, Human
ccgaaaguccggcuccaag

SEQ ID NO: 284767 - RNA, 23 nt, Human
ccgaccuaucuacuggccccacu

SEQ ID NO: 284768 - RNA, 18 nt, Human
ccgccccgcugucucugc

SEQ ID NO: 284769 - RNA, 23 nt, Human
ccgccccgcugucucugcgccuc

SEQ ID NO: 284770 - RNA, 22 nt, Human
ccgcgugccgcgccccggccgc

SEQ ID NO: 284771 - RNA, 25 nt, Human
ccgcgugccgcgccccggccgcccc

SEQ ID NO: 284772 - RNA, 18 nt, Human
ccucugccucgccccaaa

SEQ ID NO: 284773 - RNA, 23 nt, Human
ccucugccucgccccaaaccaga

SEQ ID NO: 284774 - RNA, 20 nt, Human
cgacgcgaggggagcggcaa

SEQ ID NO: 284775 - RNA, 21 nt, Human
cgcccgcucuccucgcccgga

SEQ ID NO: 284776 - RNA, 18 nt, Human
cgccgcgugccgcgcccc

SEQ ID NO: 284777 - RNA, 21 nt, Human
cgcgccucccacugggacuca

SEQ ID NO: 284778 - RNA, 21 nt, Human
cgugccgcgccccggccgccc

SEQ ID NO: 284779 - RNA, 22 nt, Human
cucugccucgccccaaaccaga

SEQ ID NO: 284780 - RNA, 21 nt, Human
cuggcggucccaaagcccucc

SEQ ID NO: 284781 - RNA, 23 nt, Human
gccccaaaccagaggcccacccc

SEQ ID NO: 284782 - RNA, 18 nt, Human
gccccacuccacaucaug

SEQ ID NO: 284783 - RNA, 19 nt, Human
gccccccgguccgcccgcu

SEQ ID NO: 284784 - RNA, 19 nt, Human
gccccggaccccccaacuc

SEQ ID NO: 284785 - RNA, 20 nt, Human
gccccggaccccccaacucc

SEQ ID NO: 284786 - RNA, 23 nt, Human
gccucgccgcccgcaccggccca

SEQ ID NO: 284787 - RNA, 21 nt, Human
gcuccaaguuagaaaccgaag

SEQ ID NO: 284788 - RNA, 18 nt, Human
ggcaaggcagaggccggc

SEQ ID NO: 284789 - RNA, 21 nt, Human
gggcacccagaccagaggcac

SEQ ID NO: 284790 - RNA, 21 nt, Human
gggcgcggggauccgacgcga

SEQ ID NO: 284791 - RNA, 20 nt, Human
guccgccgcgucccucucca

SEQ ID NO: 284792 - RNA, 19 nt, Human
uccgcccgcucuccucgcc

SEQ ID NO: 284793 - RNA, 22 nt, Human
ucguccgccugccucgccgccc

SEQ ID NO: 284794 - RNA, 22 nt, Human
ugccucgccccaaaccagaggc

SEQ ID NO: 284795 - RNA, 26 nt, Human
ugccucgccgcccgcaccggcccagc

SEQ ID NO: 284796 - RNA, 18 nt, Human
uggccuccggguacaacu

SEQ ID NO: 284797 - RNA, 21 nt, Human
ugggacucauguggccuccgg

SEQ ID NO: 284798 - RNA, 18 nt, Human
aagcgccucagccgcuuc

SEQ ID NO: 284799 - RNA, 22 nt, Human
acagaaaccaguccuggcugag

SEQ ID NO: 284800 - RNA, 19 nt, Human
ccaagcgccucagccgcuu

SEQ ID NO: 284801 - RNA, 21 nt, Human
cggaggggaccgagcugagca

SEQ ID NO: 284802 - RNA, 22 nt, Human
cuuuucggguuccaagcgccuc

SEQ ID NO: 284803 - RNA, 21 nt, Human
uacugacggccgggcgggcac

SEQ ID NO: 284804 - RNA, 23 nt, Human
uccuggcugagacagagaggagc

SEQ ID NO: 284805 - RNA, 21 nt, Human
ucgccgcugccacagcuccug

SEQ ID NO: 284806 - RNA, 18 nt, Human
ugacggccgggcgggcac

SEQ ID NO: 284807 - RNA, 21 nt, Human
ugagcaucugacauucuccuc

SEQ ID NO: 284808 - RNA, 23 nt, Human
uuccuuucgccgcugccacagcu

SEQ ID NO: 284809 - RNA, 20 nt, Human
aaaacaaauaacacaaaagc

SEQ ID NO: 284810 - RNA, 19 nt, Human
aaacaagaauaaugaggca

SEQ ID NO: 284811 - RNA, 24 nt, Human
aaagugcugggauuacaggcauga

SEQ ID NO: 284812 - RNA, 23 nt, Human
aacacaaaagcacaacucuugga

SEQ ID NO: 284813 - RNA, 19 nt, Human
aagugcugggauuacaggc

SEQ ID NO: 284814 - RNA, 21 nt, Human
aagugcugggauuacaggcau

SEQ ID NO: 284815 - RNA, 26 nt, Human
aagugcugggauuacaggcaugagcc

SEQ ID NO: 284816 - RNA, 24 nt, Human
acaggguuccgccauguuggccag

SEQ ID NO: 284817 - RNA, 23 nt, Human
acccaggcuggagugcaguggug

SEQ ID NO: 284818 - RNA, 24 nt, Human
acccaggcuggagugcaguggugu

SEQ ID NO: 284819 - RNA, 23 nt, Human
accucgaccucccaaagugcugg

SEQ ID NO: 284820 - RNA, 20 nt, Human
agacaggguuccgccauguu

SEQ ID NO: 284821 - RNA, 25 nt, Human
aggaaaaaaucugacauuuaccaac

SEQ ID NO: 284822 - RNA, 23 nt, Human
aggcaugagccacugugcccggc

SEQ ID NO: 284823 - RNA, 19 nt, Human
agugauccacccaccucga

SEQ ID NO: 284824 - RNA, 20 nt, Human
agugcaguggugucgucucg

SEQ ID NO: 284825 - RNA, 23 nt, Human
agugcaguggugucgucucggcu

SEQ ID NO: 284826 - RNA, 24 nt, Human
agugcaguggugucgucucggcuc

SEQ ID NO: 284827 - RNA, 18 nt, Human
agugcugggauuacaggc

SEQ ID NO: 284828 - RNA, 24 nt, Human
auuuuuguaauuuugguagagaca

SEQ ID NO: 284829 - RNA, 24 nt, Human
caaagugcugggauuacaggcaug

SEQ ID NO: 284830 - RNA, 23 nt, Human
caagugauccacccaccucgacc

SEQ ID NO: 284831 - RNA, 24 nt, Human
caccaugcucggcuaauuuuugua

SEQ ID NO: 284832 - RNA, 22 nt, Human
cacccaccucgaccucccaaag

SEQ ID NO: 284833 - RNA, 23 nt, Human
cacccaccucgaccucccaaagu

SEQ ID NO: 284834 - RNA, 24 nt, Human
cacccaggcuggagugcaguggug

SEQ ID NO: 284835 - RNA, 23 nt, Human
cacugcaacugccacuuccuggg

SEQ ID NO: 284836 - RNA, 24 nt, Human
caggguuccgccauguuggccagg

SEQ ID NO: 284837 - RNA, 24 nt, Human
cauguuggccaggcuggucucaaa

SEQ ID NO: 284838 - RNA, 23 nt, Human
ccaaagugcugggauuacaggca

SEQ ID NO: 284839 - RNA, 24 nt, Human
ccaaagugcugggauuacaggcau

SEQ ID NO: 284840 - RNA, 20 nt, Human
ccaagugauccacccaccuc

SEQ ID NO: 284841 - RNA, 22 nt, Human
ccaagugauccacccaccucga

SEQ ID NO: 284842 - RNA, 19 nt, Human
ccauguuggccaggcuggu

SEQ ID NO: 284843 - RNA, 22 nt, Human
ccauguuggccaggcuggucuc

SEQ ID NO: 284844 - RNA, 24 nt, Human
cccaaagugcugggauuacaggca

SEQ ID NO: 284845 - RNA, 19 nt, Human
cccaccucgaccucccaaa

SEQ ID NO: 284846 - RNA, 24 nt, Human
cccucugucacccaggcuggagug

SEQ ID NO: 284847 - RNA, 20 nt, Human
ccgccuggagagaacucccg

SEQ ID NO: 284848 - RNA, 24 nt, Human
ccugaccccaagugauccacccac

SEQ ID NO: 284849 - RNA, 23 nt, Human
ccuggguucaagcaauucuccug

SEQ ID NO: 284850 - RNA, 22 nt, Human
cgagacagagucucccucuguc

SEQ ID NO: 284851 - RNA, 18 nt, Human
cgcugaccagggaaccug

SEQ ID NO: 284852 - RNA, 24 nt, Human
cggcggcgguggcggagggggcag

SEQ ID NO: 284853 - RNA, 24 nt, Human
cucaaacccugaccccaagugauc

SEQ ID NO: 284854 - RNA, 24 nt, Human
cucacugcaacugccacuuccugg

SEQ ID NO: 284855 - RNA, 24 nt, Human
cucccucugucacccaggcuggag

SEQ ID NO: 284856 - RNA, 23 nt, Human
cucugucacccaggcuggagugc

SEQ ID NO: 284857 - RNA, 21 nt, Human
cugcaacugccacuuccuggg

SEQ ID NO: 284858 - RNA, 24 nt, Human
cuuccuggguucaagcaauucucc

SEQ ID NO: 284859 - RNA, 24 nt, Human
gaccccaagugauccacccaccuc

SEQ ID NO: 284860 - RNA, 24 nt, Human
gacuacaggcaugcgccaccaugc

SEQ ID NO: 284861 - RNA, 22 nt, Human
gagacagagucucccucuguca

SEQ ID NO: 284862 - RNA, 24 nt, Human
gaguagcugcgacuacaggcaugc

SEQ ID NO: 284863 - RNA, 18 nt, Human
gauuacaggcaugagcca

SEQ ID NO: 284864 - RNA, 21 nt, Human
gauuacaggcaugagccacug

SEQ ID NO: 284865 - RNA, 24 nt, Human
gauuacaggcaugagccacugugc

SEQ ID NO: 284866 - RNA, 25 nt, Human
gccauguuggccaggcuggucucaa

SEQ ID NO: 284867 - RNA, 24 nt, Human
gcggcggcgguggcggagggggca

SEQ ID NO: 284868 - RNA, 24 nt, Human
ggauuacaggcaugagccacugug

SEQ ID NO: 284869 - RNA, 23 nt, Human
ggcggcgguggcggagggggcag

SEQ ID NO: 284870 - RNA, 21 nt, Human
ggcgggcggcggcgguggcgg

SEQ ID NO: 284871 - RNA, 22 nt, Human
ggguuccgccauguuggccagg

SEQ ID NO: 284872 - RNA, 21 nt, Human
guagagacaggguuccgccau

SEQ ID NO: 284873 - RNA, 22 nt, Human
guagagacaggguuccgccaug

SEQ ID NO: 284874 - RNA, 24 nt, Human
gugauccacccaccucgaccuccc

SEQ ID NO: 284875 - RNA, 18 nt, Human
uaacacaaaagcacaacu

SEQ ID NO: 284876 - RNA, 24 nt, Human
uaauuuuuguaauuuugguagaga

SEQ ID NO: 284877 - RNA, 23 nt, Human
uacaggcaugagccacugugccc

SEQ ID NO: 284878 - RNA, 18 nt, Human
uacaggcaugcgccacca

SEQ ID NO: 284879 - RNA, 22 nt, Human
uagagacaggguuccgccaugu

SEQ ID NO: 284880 - RNA, 19 nt, Human
ucaaacccugaccccaagu

SEQ ID NO: 284881 - RNA, 19 nt, Human
ucaagcaauucuccugccu

SEQ ID NO: 284882 - RNA, 24 nt, Human
ucacccaggcuggagugcaguggu

SEQ ID NO: 284883 - RNA, 24 nt, Human
ucacugcaacugccacuuccuggg

SEQ ID NO: 284884 - RNA, 24 nt, Human
ucccaaagugcugggauuacaggc

SEQ ID NO: 284885 - RNA, 21 nt, Human
ucccgaccgggaugggacgcu

SEQ ID NO: 284886 - RNA, 20 nt, Human
ucccucugucacccaggcug

SEQ ID NO: 284887 - RNA, 24 nt, Human
ucccucugucacccaggcuggagu

SEQ ID NO: 284888 - RNA, 18 nt, Human
uccugccucaaccucgcg

SEQ ID NO: 284889 - RNA, 20 nt, Human
uccuggguucaagcaauucu

SEQ ID NO: 284890 - RNA, 21 nt, Human
uccuggguucaagcaauucuc

SEQ ID NO: 284891 - RNA, 24 nt, Human
uccuggguucaagcaauucuccug

SEQ ID NO: 284892 - RNA, 22 nt, Human
ucgagacagagucucccucugu

SEQ ID NO: 284893 - RNA, 24 nt, Human
ucgcgaguagcugcgacuacaggc

SEQ ID NO: 284894 - RNA, 23 nt, Human
ucucccucugucacccaggcugg

SEQ ID NO: 284895 - RNA, 24 nt, Human
ucucccucugucacccaggcugga

SEQ ID NO: 284896 - RNA, 24 nt, Human
ucuccugccucaaccucgcgagua

SEQ ID NO: 284897 - RNA, 24 nt, Human
ucugucacccaggcuggagugcag

SEQ ID NO: 284898 - RNA, 22 nt, Human
ugagugaaaacaaauaacacaa

SEQ ID NO: 284899 - RNA, 24 nt, Human
ugauccacccaccucgaccuccca

SEQ ID NO: 284900 - RNA, 22 nt, Human
ugcaguggugucgucucggcuc

SEQ ID NO: 284901 - RNA, 19 nt, Human
ugccgccuggagagaacuc

SEQ ID NO: 284902 - RNA, 20 nt, Human
ugccucaaccucgcgaguag

SEQ ID NO: 284903 - RNA, 24 nt, Human
ugcgacuacaggcaugcgccacca

SEQ ID NO: 284904 - RNA, 18 nt, Human
uggaggaaaaaaucugac

SEQ ID NO: 284905 - RNA, 23 nt, Human
uggagugcaguggugucgucucg

SEQ ID NO: 284906 - RNA, 24 nt, Human
uggagugcaguggugucgucucgg

SEQ ID NO: 284907 - RNA, 23 nt, Human
uggccaggcuggucucaaacccu

SEQ ID NO: 284908 - RNA, 18 nt, Human
ugggauuacaggcaugag

SEQ ID NO: 284909 - RNA, 21 nt, Human
ugggauuacaggcaugagcca

SEQ ID NO: 284910 - RNA, 22 nt, Human
ugggauuacaggcaugagccac

SEQ ID NO: 284911 - RNA, 22 nt, Human
ugggauuacaggcaugagccac

SEQ ID NO: 284912 - RNA, 22 nt, Human
ugggauuacaggcaugagccac

SEQ ID NO: 284913 - RNA, 23 nt, Human
ugggauuacaggcaugagccacu

SEQ ID NO: 284914 - RNA, 24 nt, Human
ugggauuacaggcaugagccacug

SEQ ID NO: 284915 - RNA, 26 nt, Human
ugggauuacaggcaugagccacugug

SEQ ID NO: 284916 - RNA, 21 nt, Human
uggguucaagcaauucuccug

SEQ ID NO: 284917 - RNA, 23 nt, Human
uggguucaagcaauucuccugcc

SEQ ID NO: 284918 - RNA, 24 nt, Human
uggguucaagcaauucuccugccu

SEQ ID NO: 284919 - RNA, 24 nt, Human
ugguagagacaggguuccgccaug

SEQ ID NO: 284920 - RNA, 21 nt, Human
uucaagcaauucuccugccuc

SEQ ID NO: 284921 - RNA, 26 nt, Human
uucaagcaauucuccugccucaaccu

SEQ ID NO: 284922 - RNA, 21 nt, Human
uuccgccauguuggccaggcu

SEQ ID NO: 284923 - RNA, 23 nt, Human
uuccucggcaucgugccgccugg

SEQ ID NO: 284924 - RNA, 24 nt, Human
uugguagagacaggguuccgccau

SEQ ID NO: 284925 - RNA, 20 nt, Human
uuuuuguaauuuugguagag

SEQ ID NO: 284926 - RNA, 27 nt, Human
uuuuuuuuuuuuuuuuuucuuucgggg

SEQ ID NO: 284927 - RNA, 19 nt, Human
aaaaaacaaaacccagcaa

SEQ ID NO: 284928 - RNA, 21 nt, Human
aacauggugaagcccugucuc

SEQ ID NO: 284929 - RNA, 22 nt, Human
aaugaaaagaagguggaaggag

SEQ ID NO: 284930 - RNA, 24 nt, Human
acagagcaagacccugucucaaaa

SEQ ID NO: 284931 - RNA, 20 nt, Human
acccagcaagaccccagucu

SEQ ID NO: 284932 - RNA, 24 nt, Human
acccugucucaaaaaacaaaaccc

SEQ ID NO: 284933 - RNA, 23 nt, Human
accuaagccugagaagucaaggc

SEQ ID NO: 284934 - RNA, 24 nt, Human
acugcacuccagccugggcgacag

SEQ ID NO: 284935 - RNA, 26 nt, Human
acugcacuccagccugggcgacagag

SEQ ID NO: 284936 - RNA, 21 nt, Human
agaaaugaaaagaagguggaa

SEQ ID NO: 284937 - RNA, 23 nt, Human
agaaaugaaaagaagguggaagg

SEQ ID NO: 284938 - RNA, 23 nt, Human
agcugggcaugguggcaugugcc

SEQ ID NO: 284939 - RNA, 21 nt, Human
agcuuggcaacauggugaagc

SEQ ID NO: 284940 - RNA, 23 nt, Human
agcuuggcaacauggugaagccc

SEQ ID NO: 284941 - RNA, 24 nt, Human
agguuggggggucaccuaagccug

SEQ ID NO: 284942 - RNA, 24 nt, Human
aucgugccacugcacuccagccug

SEQ ID NO: 284943 - RNA, 18 nt, Human
caaaaaacaaaacccagc

SEQ ID NO: 284944 - RNA, 20 nt, Human
caaaacccagcaagacccca

SEQ ID NO: 284945 - RNA, 20 nt, Human
caacauggugaagcccuguc

SEQ ID NO: 284946 - RNA, 22 nt, Human
caacauggugaagcccugucuc

SEQ ID NO: 284947 - RNA, 24 nt, Human
caacauggugaagcccugucucua

SEQ ID NO: 284948 - RNA, 24 nt, Human
caagacccugucucaaaaaacaaa

SEQ ID NO: 284949 - RNA, 21 nt, Human
caccucuaaccugcaccagca

SEQ ID NO: 284950 - RNA, 23 nt, Human
cacuccagccugggcgacagagc

SEQ ID NO: 284951 - RNA, 19 nt, Human
cacugcacuccagccuggg

SEQ ID NO: 284952 - RNA, 20 nt, Human
cacugcacuccagccugggc

SEQ ID NO: 284953 - RNA, 20 nt, Human
cacugcacuccagccugggc

SEQ ID NO: 284954 - RNA, 22 nt, Human
cacugcacuccagccugggcga

SEQ ID NO: 284955 - RNA, 24 nt, Human
cacugcacuccagccugggcgaca

SEQ ID NO: 284956 - RNA, 27 nt, Human
cacugcacuccagccugggcgacagag

SEQ ID NO: 284957 - RNA, 26 nt, Human
cagagcaagacccugucucaaaaaac

SEQ ID NO: 284958 - RNA, 22 nt, Human
cagcaagaccccagucuuuuaa

SEQ ID NO: 284959 - RNA, 26 nt, Human
caggaccaaagcgugugucucacuag

SEQ ID NO: 284960 - RNA, 24 nt, Human
caugaucgugccacugcacuccag

SEQ ID NO: 284961 - RNA, 20 nt, Human
ccacugcacuccagccuggg

SEQ ID NO: 284962 - RNA, 20 nt, Human
ccacugcacuccagccuggg

SEQ ID NO: 284963 - RNA, 21 nt, Human
ccacugcacuccagccugggc

SEQ ID NO: 284964 - RNA, 21 nt, Human
ccacugcacuccagccugggc

SEQ ID NO: 284965 - RNA, 24 nt, Human
ccacugcacuccagccugggcgac

SEQ ID NO: 284966 - RNA, 21 nt, Human
ccauguacuuccaaaaucaga

SEQ ID NO: 284967 - RNA, 23 nt, Human
cccugucucaaaaaacaaaaccc

SEQ ID NO: 284968 - RNA, 22 nt, Human
ccuccggcuagccgcaagcccu

SEQ ID NO: 284969 - RNA, 21 nt, Human
ccugggaggaugagguugggg

SEQ ID NO: 284970 - RNA, 26 nt, Human
ccuucuacaacuacgggccgaaagcc

SEQ ID NO: 284971 - RNA, 22 nt, Human
cugcagugagccaugaucgugc

SEQ ID NO: 284972 - RNA, 23 nt, Human
cuucgcgccaaucgcguggcccc

SEQ ID NO: 284973 - RNA, 21 nt, Human
gacagagcaagacccugucuc

SEQ ID NO: 284974 - RNA, 18 nt, Human
gcaacauggugaagcccu

SEQ ID NO: 284975 - RNA, 24 nt, Human
gcacuccagccugggcgacagagc

SEQ ID NO: 284976 - RNA, 22 nt, Human
gccacugcacuccagccugggc

SEQ ID NO: 284977 - RNA, 24 nt, Human
gccacugcacuccagccugggcga

SEQ ID NO: 284978 - RNA, 19 nt, Human
gccaugaucgugccacugc

SEQ ID NO: 284979 - RNA, 24 nt, Human
gccugagaagucaaggcugcagug

SEQ ID NO: 284980 - RNA, 23 nt, Human
gcgacagagcaagacccugucuc

SEQ ID NO: 284981 - RNA, 21 nt, Human
ggaaaauuccaaaauacauga

SEQ ID NO: 284982 - RNA, 23 nt, Human
uagcuuggcaacauggugaagcc

SEQ ID NO: 284983 - RNA, 24 nt, Human
ucagcugggcaugguggcaugugc

SEQ ID NO: 284984 - RNA, 24 nt, Human
uccagccugggcgacagagcaaga

SEQ ID NO: 284985 - RNA, 23 nt, Human
ucgugccacugcacuccagccug

SEQ ID NO: 284986 - RNA, 22 nt, Human
ucuacaacuacgggccgaaagc

SEQ ID NO: 284987 - RNA, 24 nt, Human
ucucaaaaaacaaaacccagcaag

SEQ ID NO: 284988 - RNA, 18 nt, Human
ugaaaagaagguggaagg

SEQ ID NO: 284989 - RNA, 20 nt, Human
ugaaaagaagguggaaggag

SEQ ID NO: 284990 - RNA, 22 nt, Human
ugcagugagccaugaucgugcc

SEQ ID NO: 284991 - RNA, 21 nt, Human
ugccuguaguuucagccaccu

SEQ ID NO: 284992 - RNA, 24 nt, Human
ugccuguaguuucagccaccuggg

SEQ ID NO: 284993 - RNA, 25 nt, Human
uggaaaauuccaaaauacaugagag

SEQ ID NO: 284994 - RNA, 19 nt, Human
uggcaacauggugaagccc

SEQ ID NO: 284995 - RNA, 18 nt, Human
ugguggcaugugccugua

SEQ ID NO: 284996 - RNA, 20 nt, Human
ugguggcaugugccuguagu

SEQ ID NO: 284997 - RNA, 23 nt, Human
ugucucacuagaaaugaaaagaa

SEQ ID NO: 284998 - RNA, 21 nt, Human
uuggcaacauggugaagcccu

SEQ ID NO: 284999 - RNA, 21 nt, Human
aaaaaguucuaauugaggaca

SEQ ID NO: 285000 - RNA, 21 nt, Human
aaaauucagauacagucaccg

SEQ ID NO: 285001 - RNA, 24 nt, Human
aaaggagaaagcuggaucccgucg

SEQ ID NO: 285002 - RNA, 20 nt, Human
aacaaacacacuugcaaaca

SEQ ID NO: 285003 - RNA, 24 nt, Human
aagccaauuuccaguaauucgcgc

SEQ ID NO: 285004 - RNA, 20 nt, Human
aagguaccuucggccccaac

SEQ ID NO: 285005 - RNA, 22 nt, Human
aauccaaaaggagaaagcugga

SEQ ID NO: 285006 - RNA, 19 nt, Human
acaaacacacuugcaaaca

SEQ ID NO: 285007 - RNA, 23 nt, Human
accaaguacauagccucaaucca

SEQ ID NO: 285008 - RNA, 21 nt, Human
acuacacauucugcagcugca

SEQ ID NO: 285009 - RNA, 27 nt, Human
agaaacaauaagagaugaccgguaccc

SEQ ID NO: 285010 - RNA, 18 nt, Human
agguaaugaaugaaaggc

SEQ ID NO: 285011 - RNA, 19 nt, Human
aguggcagcugggguacaa

SEQ ID NO: 285012 - RNA, 26 nt, Human
auggcacagacaauaacuguuccaaa

SEQ ID NO: 285013 - RNA, 25 nt, Human
auuucucuagccuggcuucucacug

SEQ ID NO: 285014 - RNA, 19 nt, Human
cacacagaauagcaaacaa

SEQ ID NO: 285015 - RNA, 21 nt, Human
cacacagaauagcaaacaaaa

SEQ ID NO: 285016 - RNA, 23 nt, Human
caccaaguacauagccucaaucc

SEQ ID NO: 285017 - RNA, 22 nt, Human
cacucuggaacaaacacacuug

SEQ ID NO: 285018 - RNA, 19 nt, Human
cagcugcaaaauucagaua

SEQ ID NO: 285019 - RNA, 18 nt, Human
ccaaauagucccugagca

SEQ ID NO: 285020 - RNA, 23 nt, Human
ccgucuggcgccgauccggcugc

SEQ ID NO: 285021 - RNA, 22 nt, Human
cgccgauccggcugcgucacgc

SEQ ID NO: 285022 - RNA, 20 nt, Human
cgucuggcgccgauccggcu

SEQ ID NO: 285023 - RNA, 27 nt, Human
cucuccauuacacucguugguucugac

SEQ ID NO: 285024 - RNA, 20 nt, Human
gaaggucauggcacagacaa

SEQ ID NO: 285025 - RNA, 23 nt, Human
gccccaacgggaaaagccaauuu

SEQ ID NO: 285026 - RNA, 24 nt, Human
gccucaauccaaaaggagaaagcu

SEQ ID NO: 285027 - RNA, 22 nt, Human
ggaagguaccuucggccccaac

SEQ ID NO: 285028 - RNA, 21 nt, Human
ggacaucccccccuucccaaa

SEQ ID NO: 285029 - RNA, 20 nt, Human
guaauucgcgcccgaccacc

SEQ ID NO: 285030 - RNA, 19 nt, Human
uaagagaugaccugcccuc

SEQ ID NO: 285031 - RNA, 23 nt, Human
uaauauauucccuccccugcccc

SEQ ID NO: 285032 - RNA, 19 nt, Human
uagcaaacaaaaccaauuu

SEQ ID NO: 285033 - RNA, 22 nt, Human
ucagauguaaacacaacacuuu

SEQ ID NO: 285034 - RNA, 18 nt, Human
uccaaaaggagaaagcug

SEQ ID NO: 285035 - RNA, 19 nt, Human
uccagcaagaagucuccag

SEQ ID NO: 285036 - RNA, 23 nt, Human
uccauuacacucguugguucuga

SEQ ID NO: 285037 - RNA, 24 nt, Human
ucccugagcacacuguucauucca

SEQ ID NO: 285038 - RNA, 24 nt, Human
ucgcgcccgaccaccggggaggua

SEQ ID NO: 285039 - RNA, 22 nt, Human
ucugacacacagaauagcaaac

SEQ ID NO: 285040 - RNA, 20 nt, Human
ucuucccaaucuacaccuuu

SEQ ID NO: 285041 - RNA, 19 nt, Human
ugaaaggcacauuuucucc

SEQ ID NO: 285042 - RNA, 23 nt, Human
ugccaaccuuuuaagguacuaca

SEQ ID NO: 285043 - RNA, 24 nt, Human
ugccaaccuuuuaagguacuacac

SEQ ID NO: 285044 - RNA, 21 nt, Human
ugcccccaccaaguacauagc

SEQ ID NO: 285045 - RNA, 22 nt, Human
ugucuuuauacuuccacacucu

SEQ ID NO: 285046 - RNA, 19 nt, Human
uguuuuauuuuuuguuguc

SEQ ID NO: 285047 - RNA, 23 nt, Human
uuaagguacuacacauucugcag

SEQ ID NO: 285048 - RNA, 21 nt, Human
uucaacuagaggaguggcagc

SEQ ID NO: 285049 - RNA, 23 nt, Human
uuccugugcuuucuaggcugggu

SEQ ID NO: 285050 - RNA, 23 nt, Human
uuuuuuuuuuuuuuuuuuacaag

SEQ ID NO: 285051 - RNA, 20 nt, Human
aaacaggcuccucuaauaua

SEQ ID NO: 285052 - RNA, 20 nt, Human
acacauuuaucuucucaaca

SEQ ID NO: 285053 - RNA, 18 nt, Human
acuggucaccuuuuucuc

SEQ ID NO: 285054 - RNA, 18 nt, Human
caacaaaacaggcuccuc

SEQ ID NO: 285055 - RNA, 22 nt, Human
cacauuuaucuucucaacaaaa

SEQ ID NO: 285056 - RNA, 18 nt, Human
uaaacaucaauggggguu

SEQ ID NO: 285057 - RNA, 18 nt, Human
uacaugccuguuuggggu

SEQ ID NO: 285058 - RNA, 21 nt, Human
ucucuuaagcuaaaugugaua

SEQ ID NO: 285059 - RNA, 18 nt, Human
uggaaaguacaguaaaau

SEQ ID NO: 285060 - RNA, 19 nt, Human
uggagucuaaaguacucca

SEQ ID NO: 285061 - RNA, 25 nt, Human
uuuuuuuuuuuuuuauacuccugga

SEQ ID NO: 285062 - RNA, 20 nt, Human
aaaaaaacacugcagcaaac

SEQ ID NO: 285063 - RNA, 21 nt, Human
acaagggauucugauguggau

SEQ ID NO: 285064 - RNA, 20 nt, Human
accaucuucugacuaagcug

SEQ ID NO: 285065 - RNA, 22 nt, Human
agaaaagguacaguaaaaauau

SEQ ID NO: 285066 - RNA, 19 nt, Human
aggaaucgcuucaccgaau

SEQ ID NO: 285067 - RNA, 18 nt, Human
aggcaagacacagccaag

SEQ ID NO: 285068 - RNA, 21 nt, Human
aguaccacauuuugagauguc

SEQ ID NO: 285069 - RNA, 18 nt, Human
caagacacagccaagaca

SEQ ID NO: 285070 - RNA, 18 nt, Human
caagggauucugaugugg

SEQ ID NO: 285071 - RNA, 21 nt, Human
caccgaaucgccuggccgcgu

SEQ ID NO: 285072 - RNA, 23 nt, Human
ccaaaguugaagucacugguuau

SEQ ID NO: 285073 - RNA, 18 nt, Human
cccuuuauacaaugucau

SEQ ID NO: 285074 - RNA, 25 nt, Human
ccuaaaacagucauauuuuauucuu

SEQ ID NO: 285075 - RNA, 20 nt, Human
cugggauagaauccaaaauu

SEQ ID NO: 285076 - RNA, 22 nt, Human
cuuggccuuuuucuuccaugga

SEQ ID NO: 285077 - RNA, 21 nt, Human
gaaguaugaaugaaaugccaa

SEQ ID NO: 285078 - RNA, 23 nt, Human
gcagcaaaccugcuguuguccga

SEQ ID NO: 285079 - RNA, 21 nt, Human
ggcaagacacagccaagacag

SEQ ID NO: 285080 - RNA, 20 nt, Human
uaaaaggcaagacacagcca

SEQ ID NO: 285081 - RNA, 20 nt, Human
uacaaugucauugaccaaaa

SEQ ID NO: 285082 - RNA, 18 nt, Human
uauagaauguuuagcaua

SEQ ID NO: 285083 - RNA, 23 nt, Human
uaugagaccacccuuuauacaau

SEQ ID NO: 285084 - RNA, 26 nt, Human
uauuuuauucuucugaacagcuacuu

SEQ ID NO: 285085 - RNA, 19 nt, Human
ucaccgaaucgccuggccg

SEQ ID NO: 285086 - RNA, 22 nt, Human
ucaccgaaucgccuggccgcgu

SEQ ID NO: 285087 - RNA, 21 nt, Human
uccaggucaaagaggggaacc

SEQ ID NO: 285088 - RNA, 19 nt, Human
ugaccaaaauguuacgugg

SEQ ID NO: 285089 - RNA, 18 nt, Human
ugagaugucuagaagaaa

SEQ ID NO: 285090 - RNA, 20 nt, Human
ugggauagaauccaaaauuu

SEQ ID NO: 285091 - RNA, 18 nt, Human
uguaaagacaucuagcug

SEQ ID NO: 285092 - RNA, 23 nt, Human
ugucauugaccaaaauguuacgu

SEQ ID NO: 285093 - RNA, 27 nt, Human
ugucuagaagaaaaaucuucaaacucc

SEQ ID NO: 285094 - RNA, 23 nt, Human
uguggacagaaaaaaacacugca

SEQ ID NO: 285095 - RNA, 18 nt, Human
uguggaugguaugaguac

SEQ ID NO: 285096 - RNA, 18 nt, Human
uuccauggaaccaucuuc

SEQ ID NO: 285097 - RNA, 21 nt, Human
uuguuuuuuuuacuccuuugg

SEQ ID NO: 285098 - RNA, 20 nt, Human
uuuuuuacuccuuugguuua

SEQ ID NO: 285099 - RNA, 23 nt, Human
aacacguugcuuccaaauacucc

SEQ ID NO: 285100 - RNA, 23 nt, Human
acggagccucucccgagucuggc

SEQ ID NO: 285101 - RNA, 23 nt, Human
agacggagccucucccgagucug

SEQ ID NO: 285102 - RNA, 19 nt, Human
agccaaagaacuccucucc

SEQ ID NO: 285103 - RNA, 22 nt, Human
caaagaacuccucuccuuggcc

SEQ ID NO: 285104 - RNA, 19 nt, Human
caagacggagccucucccg

SEQ ID NO: 285105 - RNA, 22 nt, Human
cacaagacggagccucucccga

SEQ ID NO: 285106 - RNA, 18 nt, Human
ccaugcugggccagcacc

SEQ ID NO: 285107 - RNA, 22 nt, Human
cccugguaaauagucuucugcu

SEQ ID NO: 285108 - RNA, 18 nt, Human
ccucuccuuggccagcua

SEQ ID NO: 285109 - RNA, 24 nt, Human
ccuugcacaagacggagccucucc

SEQ ID NO: 285110 - RNA, 21 nt, Human
cuccuuggccagcuaaguagc

SEQ ID NO: 285111 - RNA, 18 nt, Human
ggccagugcagccagccc

SEQ ID NO: 285112 - RNA, 28 nt, Human
uaaaacaguggccuuaggaaaaucugcu

SEQ ID NO: 285113 - RNA, 19 nt, Human
uaaacaagggcugcuggca

SEQ ID NO: 285114 - RNA, 20 nt, Human
uaggaaaaucugcuuuggca

SEQ ID NO: 285115 - RNA, 18 nt, Human
uauaaacaagggcugcug

SEQ ID NO: 285116 - RNA, 21 nt, Human
ucacauccacccagaccaauc

SEQ ID NO: 285117 - RNA, 22 nt, Human
ucugcucacauccacccagacc

SEQ ID NO: 285118 - RNA, 22 nt, Human
ugcagccagcccacaggacccc

SEQ ID NO: 285119 - RNA, 21 nt, Human
ugcucaaacccugcuguuuau

SEQ ID NO: 285120 - RNA, 20 nt, Human
uggcaagcgacugcagaggc

SEQ ID NO: 285121 - RNA, 22 nt, Human
uguuuauaauuaacacguugcu

SEQ ID NO: 285122 - RNA, 22 nt, Human
uguuuggacaaauccaauagag

SEQ ID NO: 285123 - RNA, 18 nt, Human
uuaaaacaguggccuuag

SEQ ID NO: 285124 - RNA, 21 nt, Human
uuccaaauacuccaggguccc

SEQ ID NO: 285125 - RNA, 24 nt, Human
uuccaugcugggccagcaccuguu

SEQ ID NO: 285126 - RNA, 21 nt, Human
uugcacaagacggagccucuc

SEQ ID NO: 285127 - RNA, 19 nt, Human
uugugcucaaacccugcug

SEQ ID NO: 285128 - RNA, 20 nt, Human
aggaggcacguggagccagg

SEQ ID NO: 285129 - RNA, 20 nt, Human
aggcagugcugguggcugca

SEQ ID NO: 285130 - RNA, 20 nt, Human
augcaagugagggaaaaagc

SEQ ID NO: 285131 - RNA, 20 nt, Human
caagucucuguccugaucca

SEQ ID NO: 285132 - RNA, 24 nt, Human
cagugcugguggcugcagggugca

SEQ ID NO: 285133 - RNA, 23 nt, Human
cucuguccugauccaaggcugug

SEQ ID NO: 285134 - RNA, 18 nt, Human
gugcugguggcugcaggg

SEQ ID NO: 285135 - RNA, 25 nt, Human
ugaugcaagugagggaaaaagcuga

SEQ ID NO: 285136 - RNA, 18 nt, Human
ugcagucaccuuuauaau

SEQ ID NO: 285137 - RNA, 20 nt, Human
aggaagaccccgcggauauu

SEQ ID NO: 285138 - RNA, 22 nt, Human
auccucuguccucuucuccauu

SEQ ID NO: 285139 - RNA, 20 nt, Human
ccacacauccucuguccucu

SEQ ID NO: 285140 - RNA, 20 nt, Human
cccacacggcuaccgcauca

SEQ ID NO: 285141 - RNA, 24 nt, Human
cccacacggcuaccgcaucagcca

SEQ ID NO: 285142 - RNA, 23 nt, Human
ccccacacggcuaccgcaucagc

SEQ ID NO: 285143 - RNA, 24 nt, Human
ccccgcccggccagccgcggggag

SEQ ID NO: 285144 - RNA, 22 nt, Human
ccgcccggagcgccccacacgg

SEQ ID NO: 285145 - RNA, 20 nt, Human
ccgcgcagcguccccgcccc

SEQ ID NO: 285146 - RNA, 18 nt, Human
ccgcggggaggagggcuc

SEQ ID NO: 285147 - RNA, 19 nt, Human
ccgucgccgcccggagcgc

SEQ ID NO: 285148 - RNA, 21 nt, Human
ccuggggugggacgcguccgc

SEQ ID NO: 285149 - RNA, 18 nt, Human
cgcccagugagagccugg

SEQ ID NO: 285150 - RNA, 19 nt, Human
cgcgcagcguccccgcccc

SEQ ID NO: 285151 - RNA, 21 nt, Human
cugcuguuuccgccauucauu

SEQ ID NO: 285152 - RNA, 20 nt, Human
cuuuuuuguuacugccguuu

SEQ ID NO: 285153 - RNA, 24 nt, Human
gcggauauuggcauuucucucggg

SEQ ID NO: 285154 - RNA, 18 nt, Human
ggugcuuuccugaaguuu

SEQ ID NO: 285155 - RNA, 21 nt, Human
ucacaacuuccagcuuuccca

SEQ ID NO: 285156 - RNA, 23 nt, Human
ucccacacauccucuguccucuu

SEQ ID NO: 285157 - RNA, 19 nt, Human
ugucacuugaggaagaccc

SEQ ID NO: 285158 - RNA, 21 nt, Human
uuccgccauucauuucaguuu

SEQ ID NO: 285159 - RNA, 18 nt, Human
aaaguucuccaggucccc

SEQ ID NO: 285160 - RNA, 22 nt, Human
acaauccucuuguaagacagaa

SEQ ID NO: 285161 - RNA, 19 nt, Human
acagagcgcugauuggucc

SEQ ID NO: 285162 - RNA, 19 nt, Human
acccucugucuucuggcuu

SEQ ID NO: 285163 - RNA, 23 nt, Human
agcaggacuguggggcugcagga

SEQ ID NO: 285164 - RNA, 21 nt, Human
aggcaacaucagaaaaccaga

SEQ ID NO: 285165 - RNA, 21 nt, Human
caaagcucccacagcguggaa

SEQ ID NO: 285166 - RNA, 18 nt, Human
cagccagcaggacugugg

SEQ ID NO: 285167 - RNA, 18 nt, Human
cagcguggaagcagacuc

SEQ ID NO: 285168 - RNA, 20 nt, Human
cagcguggaagcagacucuu

SEQ ID NO: 285169 - RNA, 19 nt, Human
cagcuucuccgccacucag

SEQ ID NO: 285170 - RNA, 19 nt, Human
cagugaguagacggcagug

SEQ ID NO: 285171 - RNA, 26 nt, Human
caucagaaaaccagacccagauccuc

SEQ ID NO: 285172 - RNA, 19 nt, Human
cccagggucccagcuucuc

SEQ ID NO: 285173 - RNA, 23 nt, Human
cccucugucuucuggcuuggaag

SEQ ID NO: 285174 - RNA, 18 nt, Human
ccgcggagcucagccagc

SEQ ID NO: 285175 - RNA, 22 nt, Human
ccucugucuucuggcuuggaag

SEQ ID NO: 285176 - RNA, 18 nt, Human
ccucuuguaagacagaaa

SEQ ID NO: 285177 - RNA, 21 nt, Human
ccucuuguaagacagaaaagu

SEQ ID NO: 285178 - RNA, 27 nt, Human
cggagcucagccagcaggacugugggg

SEQ ID NO: 285179 - RNA, 21 nt, Human
cuccagguccccauucaaccc

SEQ ID NO: 285180 - RNA, 19 nt, Human
cuggaaagaagcuacagca

SEQ ID NO: 285181 - RNA, 19 nt, Human
gagaacaaagcucccacag

SEQ ID NO: 285182 - RNA, 20 nt, Human
ggaagucucgggcugcagug

SEQ ID NO: 285183 - RNA, 21 nt, Human
ggagcucagccagcaggacug

SEQ ID NO: 285184 - RNA, 26 nt, Human
ggagcucagccagcaggacugugggg

SEQ ID NO: 285185 - RNA, 24 nt, Human
ggcaacaucagaaaaccagaccca

SEQ ID NO: 285186 - RNA, 19 nt, Human
ggcuccaucuuuguucugc

SEQ ID NO: 285187 - RNA, 24 nt, Human
gguuggaagucucgggcugcagug

SEQ ID NO: 285188 - RNA, 23 nt, Human
guagagcaagagaacaaagcucc

SEQ ID NO: 285189 - RNA, 21 nt, Human
guccaucuuacagagugcuga

SEQ ID NO: 285190 - RNA, 20 nt, Human
guguagagcaagagaacaaa

SEQ ID NO: 285191 - RNA, 25 nt, Human
uaagacagaaaaguucuccaggucc

SEQ ID NO: 285192 - RNA, 18 nt, Human
uacagcacagggcacagc

SEQ ID NO: 285193 - RNA, 19 nt, Human
ucauuuacggaagagagua

SEQ ID NO: 285194 - RNA, 20 nt, Human
uccagguccccauucaaccc

SEQ ID NO: 285195 - RNA, 25 nt, Human
uccagguccccauucaacccaggaa

SEQ ID NO: 285196 - RNA, 19 nt, Human
ucccuuauuguccccgccc

SEQ ID NO: 285197 - RNA, 21 nt, Human
ucccuuauuguccccgcccau

SEQ ID NO: 285198 - RNA, 18 nt, Human
uccgcggagcucagccag

SEQ ID NO: 285199 - RNA, 19 nt, Human
uccgcggagcucagccagc

SEQ ID NO: 285200 - RNA, 19 nt, Human
ucuccgccacucagguugg

SEQ ID NO: 285201 - RNA, 24 nt, Human
ugacugugucauagcccuauggca

SEQ ID NO: 285202 - RNA, 21 nt, Human
ugaggcaacaucagaaaacca

SEQ ID NO: 285203 - RNA, 21 nt, Human
ugcaggaaaggacaguccagc

SEQ ID NO: 285204 - RNA, 18 nt, Human
uggaaagaagcuacagca

SEQ ID NO: 285205 - RNA, 19 nt, Human
uggaaagaagcuacagcac

SEQ ID NO: 285206 - RNA, 25 nt, Human
uggcuucacgucucacuacuaccuu

SEQ ID NO: 285207 - RNA, 21 nt, Human
uggggugccgcgcucgccagc

SEQ ID NO: 285208 - RNA, 25 nt, Human
uguaagacagaaaaguucuccagga

SEQ ID NO: 285209 - RNA, 21 nt, Human
uguagagcaagagaacaaagc

SEQ ID NO: 285210 - RNA, 19 nt, Human
uugguccauuuuacagagc

SEQ ID NO: 285211 - RNA, 21 nt, Human
uuuuuuuuuuagcagcagcaa

SEQ ID NO: 285212 - RNA, 24 nt, Human
aaacacggaaaggaggaagucugg

SEQ ID NO: 285213 - RNA, 24 nt, Human
aagagaaaacagguccacagaggu

SEQ ID NO: 285214 - RNA, 23 nt, Human
aagucaugagagggaaggaccgg

SEQ ID NO: 285215 - RNA, 20 nt, Human
aagucggucccgcguggccc

SEQ ID NO: 285216 - RNA, 18 nt, Human
acaugaugaggcauagga

SEQ ID NO: 285217 - RNA, 21 nt, Human
acccccggaucagggcuccug

SEQ ID NO: 285218 - RNA, 21 nt, Human
agaccccugaaucaagacccu

SEQ ID NO: 285219 - RNA, 19 nt, Human
agagaaaacagguccacag

SEQ ID NO: 285220 - RNA, 24 nt, Human
agcgaggacccaagacgggcuucc

SEQ ID NO: 285221 - RNA, 19 nt, Human
aggaccggcaggccucggg

SEQ ID NO: 285222 - RNA, 21 nt, Human
aggcauaggaggccagcucag

SEQ ID NO: 285223 - RNA, 19 nt, Human
aggcauaggaggccagcuu

SEQ ID NO: 285224 - RNA, 20 nt, Human
aggcugugaccuccccuuca

SEQ ID NO: 285225 - RNA, 21 nt, Human
agggcuccugggacacccugc

SEQ ID NO: 285226 - RNA, 21 nt, Human
caccagggggagcagccagca

SEQ ID NO: 285227 - RNA, 20 nt, Human
caccggcaaggggugcucuc

SEQ ID NO: 285228 - RNA, 21 nt, Human
cagccagcagcgaggacccaa

SEQ ID NO: 285229 - RNA, 18 nt, Human
cagccugacucugucucc

SEQ ID NO: 285230 - RNA, 23 nt, Human
cagcgccauuugcaccaccuguc

SEQ ID NO: 285231 - RNA, 22 nt, Human
cagcugccuaaagugaggucac

SEQ ID NO: 285232 - RNA, 18 nt, Human
ccagcagcgaggacccaa

SEQ ID NO: 285233 - RNA, 18 nt, Human
cccccggaucagggcucc

SEQ ID NO: 285234 - RNA, 19 nt, Human
cccgcguggcccgcccggc

SEQ ID NO: 285235 - RNA, 22 nt, Human
cccggaucagggcuccugggac

SEQ ID NO: 285236 - RNA, 24 nt, Human
cccuggacccccggaucagggcuc

SEQ ID NO: 285237 - RNA, 23 nt, Human
ccggccaugagucagccuguguc

SEQ ID NO: 285238 - RNA, 21 nt, Human
ccuuguacagccucuaacucc

SEQ ID NO: 285239 - RNA, 20 nt, Human
cucccagcgccauuugcacc

SEQ ID NO: 285240 - RNA, 23 nt, Human
cuccguguacaccucccagcgcc

SEQ ID NO: 285241 - RNA, 18 nt, Human
cucgcaguuucugagacc

SEQ ID NO: 285242 - RNA, 21 nt, Human
cuucccggcgcugggaggugg

SEQ ID NO: 285243 - RNA, 18 nt, Human
gaccuccguguacaccuc

SEQ ID NO: 285244 - RNA, 19 nt, Human
gagaaaacagguccacaga

SEQ ID NO: 285245 - RNA, 21 nt, Human
gccagcucaggcugugaccuc

SEQ ID NO: 285246 - RNA, 22 nt, Human
gcgaugguuccucucauccaca

SEQ ID NO: 285247 - RNA, 18 nt, Human
ggccugggaccugagcuc

SEQ ID NO: 285248 - RNA, 21 nt, Human
gggcugaggugggagcgcaac

SEQ ID NO: 285249 - RNA, 21 nt, Human
ggggcuggccugggaccugag

SEQ ID NO: 285250 - RNA, 20 nt, Human
gggggcagucagcccggcca

SEQ ID NO: 285251 - RNA, 20 nt, Human
gguccacagagguaaaguga

SEQ ID NO: 285252 - RNA, 18 nt, Human
uacagcugccuaaaguga

SEQ ID NO: 285253 - RNA, 28 nt, Human
uagcuucacaaagagaaaacagguccac

SEQ ID NO: 285254 - RNA, 18 nt, Human
ucaugagagggaaggacc

SEQ ID NO: 285255 - RNA, 20 nt, Human
uccacagagcaccugccgca

SEQ ID NO: 285256 - RNA, 21 nt, Human
uccaccuuacgucagggaauc

SEQ ID NO: 285257 - RNA, 20 nt, Human
ucuuaaagugcacuucucaa

SEQ ID NO: 285258 - RNA, 23 nt, Human
ugacucugucucccagccuggag

SEQ ID NO: 285259 - RNA, 22 nt, Human
ugcccgugcuccggcccgcgcc

SEQ ID NO: 285260 - RNA, 24 nt, Human
ugccuaaagugaggucacccagac

SEQ ID NO: 285261 - RNA, 22 nt, Human
uggacccccggaucaggacccu

SEQ ID NO: 285262 - RNA, 23 nt, Human
uggacccccggaucagggcuccu

SEQ ID NO: 285263 - RNA, 20 nt, Human
ugggggccuuguacagccuc

SEQ ID NO: 285264 - RNA, 24 nt, Human
ugggucugcuuuuacagagaccuc

SEQ ID NO: 285265 - RNA, 19 nt, Human
ugguuugggacaugaugag

SEQ ID NO: 285266 - RNA, 18 nt, Human
uucccuggacccccggau

SEQ ID NO: 285267 - RNA, 24 nt, Human
uuuacagagaccuccguguacacc

SEQ ID NO: 285268 - RNA, 25 nt, Human
aaaaaaaaaaaacaaaacucuaagg

SEQ ID NO: 285269 - RNA, 27 nt, Human
aaaaaaaaaaacaaaacucuaagguaa

SEQ ID NO: 285270 - RNA, 22 nt, Human
aaaacaaaacucuaagguaagc

SEQ ID NO: 285271 - RNA, 21 nt, Human
aaaagaaaaagaaaagcuaag

SEQ ID NO: 285272 - RNA, 24 nt, Human
aaaagaaggagaaaccccagccca

SEQ ID NO: 285273 - RNA, 23 nt, Human
aaagaccaaacauuucacaaaua

SEQ ID NO: 285274 - RNA, 21 nt, Human
aacaaaacaagaacacaguuu

SEQ ID NO: 285275 - RNA, 18 nt, Human
aacagagauacgcaugug

SEQ ID NO: 285276 - RNA, 20 nt, Human
aacucgguaggguuacuagc

SEQ ID NO: 285277 - RNA, 23 nt, Human
aagggggugccugagagcagcuu

SEQ ID NO: 285278 - RNA, 18 nt, Human
acaaaaaaagaaaaagaa

SEQ ID NO: 285279 - RNA, 21 nt, Human
acaaaacaagaacacaguuua

SEQ ID NO: 285280 - RNA, 21 nt, Human
acagagugaugcugccacccc

SEQ ID NO: 285281 - RNA, 22 nt, Human
acagccgccgccgccgccgccg

SEQ ID NO: 285282 - RNA, 20 nt, Human
accucacugauuauucacau

SEQ ID NO: 285283 - RNA, 28 nt, Human
acggcggcagcggcucgcgguccucccu

SEQ ID NO: 285284 - RNA, 19 nt, Human
agaaagaccaaacauuuca

SEQ ID NO: 285285 - RNA, 23 nt, Human
agaaagaccaaacauuucacaaa

SEQ ID NO: 285286 - RNA, 25 nt, Human
agaaagaccaaacauuucacaaaua

SEQ ID NO: 285287 - RNA, 23 nt, Human
agaaggcaggccucucuggccca

SEQ ID NO: 285288 - RNA, 23 nt, Human
agagcaaugaagaagggggugcc

SEQ ID NO: 285289 - RNA, 21 nt, Human
agccccucugucccgcccucc

SEQ ID NO: 285290 - RNA, 19 nt, Human
aggaaaaaagaaaaaucaa

SEQ ID NO: 285291 - RNA, 21 nt, Human
aggaagacaggggacauauga

SEQ ID NO: 285292 - RNA, 25 nt, Human
aggaaucuccacuuauugguacauc

SEQ ID NO: 285293 - RNA, 19 nt, Human
aggcaggaugaggaagccc

SEQ ID NO: 285294 - RNA, 22 nt, Human
aggcaggaugaggaagcccgag

SEQ ID NO: 285295 - RNA, 18 nt, Human
aggcaggccucucuggcc

SEQ ID NO: 285296 - RNA, 24 nt, Human
auccaucuccucucuuccucccca

SEQ ID NO: 285297 - RNA, 29 nt, Human
aucucaccuacucuccuccuaacucccaa

SEQ ID NO: 285298 - RNA, 19 nt, Human
aucuccacaaagaaugcua

SEQ ID NO: 285299 - RNA, 23 nt, Human
augaaguaaguuuacuaacggaa

SEQ ID NO: 285300 - RNA, 23 nt, Human
caaauccuuuagucguuuagaaa

SEQ ID NO: 285301 - RNA, 21 nt, Human
caacagagauacgcaugugug

SEQ ID NO: 285302 - RNA, 20 nt, Human
caacagugcuggaaagggcu

SEQ ID NO: 285303 - RNA, 18 nt, Human
caacugaaauccaucucc

SEQ ID NO: 285304 - RNA, 21 nt, Human
caagaacacaguuuaggcugc

SEQ ID NO: 285305 - RNA, 23 nt, Human
caauucuacuucagugguaaaga

SEQ ID NO: 285306 - RNA, 19 nt, Human
cacaaagaaugcuagaaca

SEQ ID NO: 285307 - RNA, 19 nt, Human
caccagaccaucuccacaa

SEQ ID NO: 285308 - RNA, 25 nt, Human
caccccagccccacgcacgggccaa

SEQ ID NO: 285309 - RNA, 24 nt, Human
cacugcacaagccagcaaagggag

SEQ ID NO: 285310 - RNA, 19 nt, Human
cacuucucagauggaggaa

SEQ ID NO: 285311 - RNA, 19 nt, Human
cagagugaugcugccaccc

SEQ ID NO: 285312 - RNA, 23 nt, Human
cagcacacagagacccccuccaa

SEQ ID NO: 285313 - RNA, 19 nt, Human
cagcagcagcgacagaagc

SEQ ID NO: 285314 - RNA, 20 nt, Human
cagcagcagcgacagaagcu

SEQ ID NO: 285315 - RNA, 20 nt, Human
cagcggggguucagagcucc

SEQ ID NO: 285316 - RNA, 19 nt, Human
cauacccauuuccucacga

SEQ ID NO: 285317 - RNA, 21 nt, Human
caucucaccuacucuccuccu

SEQ ID NO: 285318 - RNA, 25 nt, Human
caucucaccuacucuccuccuaacu

SEQ ID NO: 285319 - RNA, 18 nt, Human
ccaaaaaaaggaggaaaa

SEQ ID NO: 285320 - RNA, 23 nt, Human
ccaaacauuucacaaauagcauu

SEQ ID NO: 285321 - RNA, 23 nt, Human
ccagaccaucuccacaaagaaug

SEQ ID NO: 285322 - RNA, 21 nt, Human
cccacagcccaucuuugugua

SEQ ID NO: 285323 - RNA, 20 nt, Human
ccccaacagccgccgccgcc

SEQ ID NO: 285324 - RNA, 21 nt, Human
ccccagcccaauucuauuugc

SEQ ID NO: 285325 - RNA, 19 nt, Human
cccgcccuccaccccagcc

SEQ ID NO: 285326 - RNA, 20 nt, Human
cccgcccuccaccccagccc

SEQ ID NO: 285327 - RNA, 27 nt, Human
cccuccaccccagccccacgcacgggc

SEQ ID NO: 285328 - RNA, 21 nt, Human
cccucugucccgcccuccacc

SEQ ID NO: 285329 - RNA, 19 nt, Human
ccgcagcagcagcgacaga

SEQ ID NO: 285330 - RNA, 18 nt, Human
ccgccgccgccgccgccg

SEQ ID NO: 285331 - RNA, 18 nt, Human
ccgccgccgccgccgcgc

SEQ ID NO: 285332 - RNA, 20 nt, Human
ccgccgcgcccccaccaauc

SEQ ID NO: 285333 - RNA, 21 nt, Human
ccgcgcgucuccccaccccca

SEQ ID NO: 285334 - RNA, 18 nt, Human
ccggcggaccucgccucc

SEQ ID NO: 285335 - RNA, 18 nt, Human
ccguccccccuccacaaa

SEQ ID NO: 285336 - RNA, 23 nt, Human
ccuagcagggcaaacaaugaacu

SEQ ID NO: 285337 - RNA, 21 nt, Human
ccuccuggcucagcaggcucc

SEQ ID NO: 285338 - RNA, 22 nt, Human
ccucgccgcgcgucuccccacc

SEQ ID NO: 285339 - RNA, 22 nt, Human
ccucggccuccgcagcagcagc

SEQ ID NO: 285340 - RNA, 23 nt, Human
ccucuccguccccccuccacaaa

SEQ ID NO: 285341 - RNA, 22 nt, Human
ccucucuuccuccccaacaucc

SEQ ID NO: 285342 - RNA, 20 nt, Human
ccugggcccagccccucugu

SEQ ID NO: 285343 - RNA, 21 nt, Human
ccuguccucggccuccgcagc

SEQ ID NO: 285344 - RNA, 18 nt, Human
ccuuguuccucuccgucc

SEQ ID NO: 285345 - RNA, 18 nt, Human
cgccgccgccgccgcgcc

SEQ ID NO: 285346 - RNA, 23 nt, Human
cggcacaugugguuucacuuucc

SEQ ID NO: 285347 - RNA, 19 nt, Human
cgucucggaacagccacgg

SEQ ID NO: 285348 - RNA, 19 nt, Human
cuagaauucacaucaggua

SEQ ID NO: 285349 - RNA, 19 nt, Human
cucagaaugaaacaaaagg

SEQ ID NO: 285350 - RNA, 19 nt, Human
cuccacaaaaaaagaaaaa

SEQ ID NO: 285351 - RNA, 26 nt, Human
cuccaccccagccccacgcacgggcc

SEQ ID NO: 285352 - RNA, 20 nt, Human
cuccaccccagccccacgcc

SEQ ID NO: 285353 - RNA, 22 nt, Human
cuccccacccccaacagccgcc

SEQ ID NO: 285354 - RNA, 27 nt, Human
cucccccuuuccagggacccacagccc

SEQ ID NO: 285355 - RNA, 18 nt, Human
cuccucucuuccucccca

SEQ ID NO: 285356 - RNA, 20 nt, Human
cuccucucuuccuccccaac

SEQ ID NO: 285357 - RNA, 19 nt, Human
cucgccgcgcgucucccca

SEQ ID NO: 285358 - RNA, 19 nt, Human
cugaacaaucaauucuacu

SEQ ID NO: 285359 - RNA, 18 nt, Human
cuggucaaucuucuuuuc

SEQ ID NO: 285360 - RNA, 26 nt, Human
cugucccgcccuccaccccagcccca

SEQ ID NO: 285361 - RNA, 22 nt, Human
cuuugccugggcccagccccuc

SEQ ID NO: 285362 - RNA, 19 nt, Human
gaaacaccaugaacaaaac

SEQ ID NO: 285363 - RNA, 23 nt, Human
gacagaagcuuugccugggccca

SEQ ID NO: 285364 - RNA, 19 nt, Human
gacuaaaacuaaagacuca

SEQ ID NO: 285365 - RNA, 19 nt, Human
gagcaggugaagaaagccc

SEQ ID NO: 285366 - RNA, 22 nt, Human
gauggguuugaaaaaaaaaaaa

SEQ ID NO: 285367 - RNA, 21 nt, Human
gcaaaacgcuuagaaacacca

SEQ ID NO: 285368 - RNA, 19 nt, Human
gcacacagagacccccucc

SEQ ID NO: 285369 - RNA, 21 nt, Human
gcagaaggcaggccucucugg

SEQ ID NO: 285370 - RNA, 22 nt, Human
gcagagcagcggggguucagag

SEQ ID NO: 285371 - RNA, 22 nt, Human
gcaguaaaauacaaaguccaaa

SEQ ID NO: 285372 - RNA, 20 nt, Human
gccaauagaagcaacagaga

SEQ ID NO: 285373 - RNA, 25 nt, Human
gccgccgcgcccccaccaaucgucu

SEQ ID NO: 285374 - RNA, 21 nt, Human
gccuccaucugaggcugugcu

SEQ ID NO: 285375 - RNA, 19 nt, Human
gcgcggcagagcagcgggg

SEQ ID NO: 285376 - RNA, 20 nt, Human
gcugggacguugaacuccgg

SEQ ID NO: 285377 - RNA, 20 nt, Human
gcuggucaaucuucuuuucu

SEQ ID NO: 285378 - RNA, 25 nt, Human
gcuuagaaacaccaugaacaaaaca

SEQ ID NO: 285379 - RNA, 24 nt, Human
ggaaaaaagaaaaaucaaccucac

SEQ ID NO: 285380 - RNA, 21 nt, Human
ggccaauagaagcaacagaga

SEQ ID NO: 285381 - RNA, 21 nt, Human
gguaaugaugggcuagagaaa

SEQ ID NO: 285382 - RNA, 23 nt, Human
guaaagggcaacucucccccuuu

SEQ ID NO: 285383 - RNA, 24 nt, Human
uaagcaaaaacccaacaaccccgg

SEQ ID NO: 285384 - RNA, 27 nt, Human
uaagguaaaacaaccuuguucaucaga

SEQ ID NO: 285385 - RNA, 18 nt, Human
uaagguaagcgguaagcc

SEQ ID NO: 285386 - RNA, 21 nt, Human
uaauuccuagcagggcaaaca

SEQ ID NO: 285387 - RNA, 20 nt, Human
uacaaaguccaaaaaaagga

SEQ ID NO: 285388 - RNA, 21 nt, Human
uacagucagauguuuugcacc

SEQ ID NO: 285389 - RNA, 19 nt, Human
uaccaagacugcugggacg

SEQ ID NO: 285390 - RNA, 24 nt, Human
uagaaacaccaugaacaaaacaag

SEQ ID NO: 285391 - RNA, 23 nt, Human
uagcauuggcacauauuacuuug

SEQ ID NO: 285392 - RNA, 19 nt, Human
uaggccaauagaagcaaca

SEQ ID NO: 285393 - RNA, 20 nt, Human
uaggccaauagaagcaacag

SEQ ID NO: 285394 - RNA, 23 nt, Human
uaggccaauagaagcaacagaga

SEQ ID NO: 285395 - RNA, 24 nt, Human
uaucacugcacaagccagcaaagg

SEQ ID NO: 285396 - RNA, 20 nt, Human
ucaccgcgcggcagagcagc

SEQ ID NO: 285397 - RNA, 18 nt, Human
ucagauggaggaagacag

SEQ ID NO: 285398 - RNA, 23 nt, Human
ucagguacaaagaaaaaacauua

SEQ ID NO: 285399 - RNA, 24 nt, Human
ucagugguaaagagauaucccaag

SEQ ID NO: 285400 - RNA, 18 nt, Human
uccaagagaaaauaaggu

SEQ ID NO: 285401 - RNA, 21 nt, Human
uccacaaaaaaagaaaaagaa

SEQ ID NO: 285402 - RNA, 22 nt, Human
uccauauccuggcagguguggg

SEQ ID NO: 285403 - RNA, 21 nt, Human
uccccaacauccaucucuuuc

SEQ ID NO: 285404 - RNA, 26 nt, Human
uccucuccguccccccuccacaaaaa

SEQ ID NO: 285405 - RNA, 21 nt, Human
uccugggaccuagucaaagag

SEQ ID NO: 285406 - RNA, 19 nt, Human
uccuuguuccucuccgucc

SEQ ID NO: 285407 - RNA, 22 nt, Human
ucgccgcgcgucuccccacccc

SEQ ID NO: 285408 - RNA, 21 nt, Human
ucuauaccucauuccuaccuc

SEQ ID NO: 285409 - RNA, 22 nt, Human
ucuccacaaagaaugcuagaac

SEQ ID NO: 285410 - RNA, 20 nt, Human
ucuccuccagauuauuaaau

SEQ ID NO: 285411 - RNA, 18 nt, Human
ucuggggaugcuggccac

SEQ ID NO: 285412 - RNA, 23 nt, Human
ucuguagaaaaucaaaugaacac

SEQ ID NO: 285413 - RNA, 22 nt, Human
ugaaaaaaaaaaaacaaaacuc

SEQ ID NO: 285414 - RNA, 22 nt, Human
ugaaaagaaggagaaaccccag

SEQ ID NO: 285415 - RNA, 25 nt, Human
ugaaauccaucuccucucuuccucc

SEQ ID NO: 285416 - RNA, 18 nt, Human
ugaacaaaacaagaacac

SEQ ID NO: 285417 - RNA, 25 nt, Human
ugcagaagaaguaacacuguccugg

SEQ ID NO: 285418 - RNA, 20 nt, Human
ugcuggaaagggcucgagug

SEQ ID NO: 285419 - RNA, 21 nt, Human
ugcugggacguugaacuccgg

SEQ ID NO: 285420 - RNA, 20 nt, Human
uggcaaaauucacauuuaca

SEQ ID NO: 285421 - RNA, 24 nt, Human
uggcaggugugggggaacaggcag

SEQ ID NO: 285422 - RNA, 22 nt, Human
uggccacuagugauccaacuuu

SEQ ID NO: 285423 - RNA, 19 nt, Human
ugggccaucauuggaguaa

SEQ ID NO: 285424 - RNA, 20 nt, Human
uggguuugaaaaaaaaaaaa

SEQ ID NO: 285425 - RNA, 18 nt, Human
uguaaaaacaauccaaag

SEQ ID NO: 285426 - RNA, 24 nt, Human
uguagaaaaucaaaugaacacugg

SEQ ID NO: 285427 - RNA, 18 nt, Human
ugucccgcccuccacccc

SEQ ID NO: 285428 - RNA, 21 nt, Human
ugucccgcccuccaccccagc

SEQ ID NO: 285429 - RNA, 23 nt, Human
ugugcuuuuuccuaacaaagguu

SEQ ID NO: 285430 - RNA, 23 nt, Human
uguuccucuccguccccccucca

SEQ ID NO: 285431 - RNA, 18 nt, Human
uuacgugcuguuccaccu

SEQ ID NO: 285432 - RNA, 22 nt, Human
uucaaaacuuaagcaaaaaccc

SEQ ID NO: 285433 - RNA, 20 nt, Human
uucacaaauagcauuggcac

SEQ ID NO: 285434 - RNA, 19 nt, Human
uugauuaaaaaugaagaaa

SEQ ID NO: 285435 - RNA, 23 nt, Human
uuucucccuccuggcucagcagg

SEQ ID NO: 285436 - RNA, 28 nt, Human
uuuuacaucuuccauaaccuagcauaca

SEQ ID NO: 285437 - RNA, 22 nt, Human
aaaaacaaauagaagugcccug

SEQ ID NO: 285438 - RNA, 19 nt, Human
aagcaaaguuaagcacgua

SEQ ID NO: 285439 - RNA, 19 nt, Human
aauuggcacugcaaaaaca

SEQ ID NO: 285440 - RNA, 22 nt, Human
acaauggcaaagcauaucguac

SEQ ID NO: 285441 - RNA, 18 nt, Human
agcgggggccaccuaaaa

SEQ ID NO: 285442 - RNA, 18 nt, Human
aggugaguagaaguaacu

SEQ ID NO: 285443 - RNA, 25 nt, Human
caaaaacacagauguagaugugaca

SEQ ID NO: 285444 - RNA, 25 nt, Human
cacagcaaguuagccagcgggggcc

SEQ ID NO: 285445 - RNA, 19 nt, Human
cagaaaaugcaaauuggca

SEQ ID NO: 285446 - RNA, 19 nt, Human
cccauaccacguguuaggg

SEQ ID NO: 285447 - RNA, 25 nt, Human
ccccugguuagagauacugcagggc

SEQ ID NO: 285448 - RNA, 20 nt, Human
cccuggaagcuauuuugggg

SEQ ID NO: 285449 - RNA, 20 nt, Human
cuggcugcugugaaggugag

SEQ ID NO: 285450 - RNA, 25 nt, Human
uauaugcaaggcacugcgguacugg

SEQ ID NO: 285451 - RNA, 26 nt, Human
uauuuauacugucacacgcauguaca

SEQ ID NO: 285452 - RNA, 19 nt, Human
uccacaaaaacaaauagaa

SEQ ID NO: 285453 - RNA, 24 nt, Human
ucuaugcccuugaaaacuccacag

SEQ ID NO: 285454 - RNA, 19 nt, Human
ugacaaguacucauugagg

SEQ ID NO: 285455 - RNA, 21 nt, Human
ugccuggccuccucauuuuuc

SEQ ID NO: 285456 - RNA, 20 nt, Human
uguacaaaaucaauugacaa

SEQ ID NO: 285457 - RNA, 23 nt, Human
uuuagauucucuucucuuuuccc

SEQ ID NO: 285458 - RNA, 18 nt, Human
uuuccccauaaaccaacu

SEQ ID NO: 285459 - RNA, 21 nt, Human
uuuuuuuggaagaaauccuga

SEQ ID NO: 285460 - RNA, 24 nt, Human
aaggccccaggguuucccugcccu

SEQ ID NO: 285461 - RNA, 21 nt, Human
agaguucuguggcuuaacugg

SEQ ID NO: 285462 - RNA, 19 nt, Human
agauggucacacuguagaa

SEQ ID NO: 285463 - RNA, 20 nt, Human
caacacaggacgaugcgcuc

SEQ ID NO: 285464 - RNA, 22 nt, Human
caacacaggacgaugcgcucag

SEQ ID NO: 285465 - RNA, 20 nt, Human
cacauguuggccagcugcuu

SEQ ID NO: 285466 - RNA, 18 nt, Human
caggacgaugcgcucagg

SEQ ID NO: 285467 - RNA, 23 nt, Human
caggccacucaccacaggagcuu

SEQ ID NO: 285468 - RNA, 20 nt, Human
ccaggcaauugacacacuac

SEQ ID NO: 285469 - RNA, 22 nt, Human
ccaucuggagcauccugucucu

SEQ ID NO: 285470 - RNA, 24 nt, Human
cuguggcuuaacuggucucagcuu

SEQ ID NO: 285471 - RNA, 19 nt, Human
gggaagggugucccaccau

SEQ ID NO: 285472 - RNA, 22 nt, Human
uaagugguugcugguuucacuu

SEQ ID NO: 285473 - RNA, 20 nt, Human
ucaggccacucaccacagga

SEQ ID NO: 285474 - RNA, 21 nt, Human
ucaguggagaaccaggcaauu

SEQ ID NO: 285475 - RNA, 21 nt, Human
ucccauaagauggucacacug

SEQ ID NO: 285476 - RNA, 20 nt, Human
ucccugcccuagaugagggu

SEQ ID NO: 285477 - RNA, 20 nt, Human
ucucugcugucuauggauau

SEQ ID NO: 285478 - RNA, 21 nt, Human
ucugcugucuauggauauccu

SEQ ID NO: 285479 - RNA, 21 nt, Human
ucuuuuggugcaugcugcugc

SEQ ID NO: 285480 - RNA, 22 nt, Human
ugcauuuucaccaucaaggccc

SEQ ID NO: 285481 - RNA, 22 nt, Human
ugcugcugcuacuguuugcugu

SEQ ID NO: 285482 - RNA, 18 nt, Human
ugcuuggggcaacacagg

SEQ ID NO: 285483 - RNA, 22 nt, Human
uggcuuaacuggucucagcuug

SEQ ID NO: 285484 - RNA, 20 nt, Human
uguuguguucuuuucacuuu

SEQ ID NO: 285485 - RNA, 22 nt, Human
uguuguguucuuuucacuuucc

SEQ ID NO: 285486 - RNA, 22 nt, Human
uguuguguucuuuucacuuucc

SEQ ID NO: 285487 - RNA, 24 nt, Human
uugcuauuuuuucucugcugucua

SEQ ID NO: 285488 - RNA, 20 nt, Human
aaacagccaacagaaaccca

SEQ ID NO: 285489 - RNA, 23 nt, Human
aaacagccaacagaaacccagac

SEQ ID NO: 285490 - RNA, 18 nt, Human
aaagaguccaagccacug

SEQ ID NO: 285491 - RNA, 26 nt, Human
aacccacaggcaggacaggggaaagu

SEQ ID NO: 285492 - RNA, 18 nt, Human
aagaaaagaaaaacagcc

SEQ ID NO: 285493 - RNA, 19 nt, Human
aagcaggaggcaggcucgg

SEQ ID NO: 285494 - RNA, 26 nt, Human
aagcaggaggcaggcucggcccaagg

SEQ ID NO: 285495 - RNA, 20 nt, Human
aagccauggaaacccacagg

SEQ ID NO: 285496 - RNA, 20 nt, Human
aaggagcuuuuugaccaugu

SEQ ID NO: 285497 - RNA, 21 nt, Human
aagugagaggagccaagugga

SEQ ID NO: 285498 - RNA, 20 nt, Human
acagggugugcccgggaugg

SEQ ID NO: 285499 - RNA, 21 nt, Human
accccauccaaggcuccccag

SEQ ID NO: 285500 - RNA, 20 nt, Human
acuccaagaaaagaaaaaca

SEQ ID NO: 285501 - RNA, 26 nt, Human
agaaaaacagccaacagaaacccaga

SEQ ID NO: 285502 - RNA, 24 nt, Human
agaaaagaaaaacagccaacagaa

SEQ ID NO: 285503 - RNA, 23 nt, Human
agcaggaggcaggcucggcccaa

SEQ ID NO: 285504 - RNA, 24 nt, Human
agccacugaaaggaaaugcggcag

SEQ ID NO: 285505 - RNA, 21 nt, Human
agccugggccugaagaagggu

SEQ ID NO: 285506 - RNA, 19 nt, Human
aggaaaugcggcagggcug

SEQ ID NO: 285507 - RNA, 23 nt, Human
aggaggcaggcucggcccaaggc

SEQ ID NO: 285508 - RNA, 23 nt, Human
aggcaugaaaaguggacgcuggg

SEQ ID NO: 285509 - RNA, 23 nt, Human
agggggcaggggugggaagacag

SEQ ID NO: 285510 - RNA, 21 nt, Human
caacagaaacccagacacagg

SEQ ID NO: 285511 - RNA, 23 nt, Human
caacagcgccagcacgaucuuga

SEQ ID NO: 285512 - RNA, 23 nt, Human
caagaaagacccauuccaggucc

SEQ ID NO: 285513 - RNA, 21 nt, Human
caccacuccaagaaaagaaaa

SEQ ID NO: 285514 - RNA, 20 nt, Human
caccccauccaaggcucccc

SEQ ID NO: 285515 - RNA, 20 nt, Human
cagacacaggcaggggcagc

SEQ ID NO: 285516 - RNA, 22 nt, Human
cagcucccaccugcagcugaaa

SEQ ID NO: 285517 - RNA, 19 nt, Human
cagcuccucagcugggccu

SEQ ID NO: 285518 - RNA, 22 nt, Human
caggagucuuccucuggagccu

SEQ ID NO: 285519 - RNA, 21 nt, Human
caggcaggacaggcgaccccc

SEQ ID NO: 285520 - RNA, 20 nt, Human
cauccaaggcuccccagccc

SEQ ID NO: 285521 - RNA, 24 nt, Human
ccaacagaaacccagacacaggcc

SEQ ID NO: 285522 - RNA, 23 nt, Human
ccaaggcuccccagcccacaggc

SEQ ID NO: 285523 - RNA, 19 nt, Human
ccagacacaggcaggggca

SEQ ID NO: 285524 - RNA, 21 nt, Human
cccaacaugagcagccccaac

SEQ ID NO: 285525 - RNA, 23 nt, Human
cccaacaugagcagccccaacua

SEQ ID NO: 285526 - RNA, 21 nt, Human
cccaaggcaugaaaaguggac

SEQ ID NO: 285527 - RNA, 23 nt, Human
ccccaccccauccaaggcucccc

SEQ ID NO: 285528 - RNA, 22 nt, Human
cccccgcaagcaggaggcaggc

SEQ ID NO: 285529 - RNA, 19 nt, Human
cccccugggaagugagagg

SEQ ID NO: 285530 - RNA, 18 nt, Human
cccgcaagcaggaggcag

SEQ ID NO: 285531 - RNA, 22 nt, Human
cccucugcugcuucucacagcu

SEQ ID NO: 285532 - RNA, 18 nt, Human
ccgcagccuggggcagug

SEQ ID NO: 285533 - RNA, 21 nt, Human
ccucagcugggccuggaggcg

SEQ ID NO: 285534 - RNA, 24 nt, Human
ccugcagcugaaagggccgggguc

SEQ ID NO: 285535 - RNA, 22 nt, Human
cuccaagaaaagaaaaacagcc

SEQ ID NO: 285536 - RNA, 24 nt, Human
cuccaagaaaagaaaaacagccaa

SEQ ID NO: 285537 - RNA, 27 nt, Human
gaaaagaaaaacagccaacagaaaccc

SEQ ID NO: 285538 - RNA, 20 nt, Human
gaaagggcuggaagggcaag

SEQ ID NO: 285539 - RNA, 19 nt, Human
gaaccuggagauguuggug

SEQ ID NO: 285540 - RNA, 19 nt, Human
gaagaagccaccucugggg

SEQ ID NO: 285541 - RNA, 19 nt, Human
gagcagccccaacagcgcc

SEQ ID NO: 285542 - RNA, 21 nt, Human
gagcagccccaacagcgccag

SEQ ID NO: 285543 - RNA, 23 nt, Human
gaggcaggcucggccccccaagg

SEQ ID NO: 285544 - RNA, 24 nt, Human
gaggcuguagaggaagagccccaa

SEQ ID NO: 285545 - RNA, 20 nt, Human
gaggguuucaggagucuucc

SEQ ID NO: 285546 - RNA, 20 nt, Human
gcaguggcagaaacauccgc

SEQ ID NO: 285547 - RNA, 30 nt, Human
gcgggacugggcaagccgcagccuggggcc

SEQ ID NO: 285548 - RNA, 25 nt, Human
ggaagagccccaacaugagcagccc

SEQ ID NO: 285549 - RNA, 21 nt, Human
ggagaugggaaagaguccaag

SEQ ID NO: 285550 - RNA, 18 nt, Human
ggcaggggugggaagaca

SEQ ID NO: 285551 - RNA, 20 nt, Human
ggcaggggugggaagacagg

SEQ ID NO: 285552 - RNA, 20 nt, Human
ggccugggcagaacucacgg

SEQ ID NO: 285553 - RNA, 18 nt, Human
ggcggccuucaugcccca

SEQ ID NO: 285554 - RNA, 22 nt, Human
gggaagacagggugugcccggg

SEQ ID NO: 285555 - RNA, 23 nt, Human
gggcaggggugggaagacagggu

SEQ ID NO: 285556 - RNA, 23 nt, Human
gggccagcucccaccugcagcug

SEQ ID NO: 285557 - RNA, 21 nt, Human
ggggcaagaaagacccauucc

SEQ ID NO: 285558 - RNA, 22 nt, Human
gguguucauggggguucuucag

SEQ ID NO: 285559 - RNA, 24 nt, Human
guuaauuucacuaaagcuucaauc

SEQ ID NO: 285560 - RNA, 20 nt, Human
guucauucuuuuuaaagccc

SEQ ID NO: 285561 - RNA, 25 nt, Human
ucaccacuccaagaaaagaaaaaca

SEQ ID NO: 285562 - RNA, 20 nt, Human
ucaucaauuucccagguucu

SEQ ID NO: 285563 - RNA, 21 nt, Human
uccaagaaaagaaaaacagcc

SEQ ID NO: 285564 - RNA, 30 nt, Human
uccaagaaaagaaaaacagccaacagaaaa

SEQ ID NO: 285565 - RNA, 22 nt, Human
uccccagcccacaggcaggggu

SEQ ID NO: 285566 - RNA, 21 nt, Human
uccccucugcugcuucucaca

SEQ ID NO: 285567 - RNA, 21 nt, Human
uccgcgcugggacuugugggc

SEQ ID NO: 285568 - RNA, 18 nt, Human
uccucaggcuccccaggg

SEQ ID NO: 285569 - RNA, 23 nt, Human
uccuugguuaauuucacuaaagc

SEQ ID NO: 285570 - RNA, 21 nt, Human
ucggcccaaggcaugaaaagu

SEQ ID NO: 285571 - RNA, 26 nt, Human
ugaaaggaaaugcggcagggcugggg

SEQ ID NO: 285572 - RNA, 18 nt, Human
ugaccauguagccaggga

SEQ ID NO: 285573 - RNA, 24 nt, Human
ugagaggagccaaguggagcccag

SEQ ID NO: 285574 - RNA, 25 nt, Human
ugagcagccccaacagcgccagcac

SEQ ID NO: 285575 - RNA, 19 nt, Human
ugcagcugaaagggcugga

SEQ ID NO: 285576 - RNA, 24 nt, Human
ugcugcuucucacagcuccucagc

SEQ ID NO: 285577 - RNA, 25 nt, Human
uggagauguugguguucaugggggu

SEQ ID NO: 285578 - RNA, 25 nt, Human
uggcagaaacauccgcgcugggacu

SEQ ID NO: 285579 - RNA, 21 nt, Human
ugggaaagaguccaagccacu

SEQ ID NO: 285580 - RNA, 23 nt, Human
ugggacuugugggcagggucugg

SEQ ID NO: 285581 - RNA, 20 nt, Human
ugggcugugagucuguggcu

SEQ ID NO: 285582 - RNA, 22 nt, Human
uggggagcggcuggcgggagcu

SEQ ID NO: 285583 - RNA, 22 nt, Human
ugguuaauuucacuaaagcuuc

SEQ ID NO: 285584 - RNA, 22 nt, Human
uguucauggggguucuucaguu

SEQ ID NO: 285585 - RNA, 23 nt, Human
uucuguucucagaaccuggagau

SEQ ID NO: 285586 - RNA, 19 nt, Human
uuucaggagucuuccucug

SEQ ID NO: 285587 - RNA, 24 nt, Human
uuuuuuuuuuuuuucagugcuuga

SEQ ID NO: 285588 - RNA, 18 nt, Human
aaaccugcauccuccuca

SEQ ID NO: 285589 - RNA, 25 nt, Human
aaauauuaaaaguaacaaaaauacu

SEQ ID NO: 285590 - RNA, 25 nt, Human
aacucuucuucccccaacagcuuua

SEQ ID NO: 285591 - RNA, 23 nt, Human
acaaagaaaaacucaugacuaca

SEQ ID NO: 285592 - RNA, 24 nt, Human
acaaauucuuaaaacgucagucca

SEQ ID NO: 285593 - RNA, 21 nt, Human
accacaaaaccugcauccucc

SEQ ID NO: 285594 - RNA, 19 nt, Human
accccuaagcccuugcucu

SEQ ID NO: 285595 - RNA, 20 nt, Human
agaaguaaauugaucauuua

SEQ ID NO: 285596 - RNA, 24 nt, Human
agacaaaugaguagaaaacaucau

SEQ ID NO: 285597 - RNA, 18 nt, Human
agagaaaauaaccuacag

SEQ ID NO: 285598 - RNA, 22 nt, Human
aggaagaggaaauucaaaguug

SEQ ID NO: 285599 - RNA, 23 nt, Human
auaaccuacagacuuuuuuuuuu

SEQ ID NO: 285600 - RNA, 21 nt, Human
caaaaucaaagcauauuucca

SEQ ID NO: 285601 - RNA, 23 nt, Human
caaagaaaaacucaugacuacau

SEQ ID NO: 285602 - RNA, 24 nt, Human
cacaaaaccugcauccuccucaga

SEQ ID NO: 285603 - RNA, 26 nt, Human
caccuccaaccccuaagcccuugcuc

SEQ ID NO: 285604 - RNA, 18 nt, Human
cagaccaggccagcagga

SEQ ID NO: 285605 - RNA, 20 nt, Human
ccaaccccuaagcccuugcu

SEQ ID NO: 285606 - RNA, 23 nt, Human
ccacaaaaccugcauccuccuca

SEQ ID NO: 285607 - RNA, 25 nt, Human
ccacaaaaccugcauccuccucaga

SEQ ID NO: 285608 - RNA, 18 nt, Human
ccauuaaaaauauuucca

SEQ ID NO: 285609 - RNA, 23 nt, Human
ccccaacagcuuuaccuccaaaa

SEQ ID NO: 285610 - RNA, 21 nt, Human
cccccaacagcuuuaccucca

SEQ ID NO: 285611 - RNA, 18 nt, Human
cccccuguaagaggagau

SEQ ID NO: 285612 - RNA, 19 nt, Human
cccuaagcccuugcucuuc

SEQ ID NO: 285613 - RNA, 20 nt, Human
cccuugcucuucuguaaggu

SEQ ID NO: 285614 - RNA, 19 nt, Human
cugccaccuccaaccccua

SEQ ID NO: 285615 - RNA, 19 nt, Human
cuguuauaugcaucccccu

SEQ ID NO: 285616 - RNA, 21 nt, Human
cuguuuuaacuugaacucuga

SEQ ID NO: 285617 - RNA, 18 nt, Human
cuuuuaucugccaccucc

SEQ ID NO: 285618 - RNA, 26 nt, Human
gacuuuuuuuuuucugggucuuuuga

SEQ ID NO: 285619 - RNA, 18 nt, Human
gcaaacaaagaaaaacuc

SEQ ID NO: 285620 - RNA, 20 nt, Human
gcucuuuucuuuauuuuugg

SEQ ID NO: 285621 - RNA, 22 nt, Human
ggaccacaaaaccugcauccuc

SEQ ID NO: 285622 - RNA, 24 nt, Human
gucaguccaaaauuacagacaugc

SEQ ID NO: 285623 - RNA, 26 nt, Human
uacacauacaugaucuguuauaugca

SEQ ID NO: 285624 - RNA, 26 nt, Human
uauauuaauaacacaaaaucaaagca

SEQ ID NO: 285625 - RNA, 21 nt, Human
uaucacacuugacuagaggaa

SEQ ID NO: 285626 - RNA, 21 nt, Human
uaugcaaacaaagaaaaacuc

SEQ ID NO: 285627 - RNA, 25 nt, Human
uaugcaaacaaagaaaaacucauga

SEQ ID NO: 285628 - RNA, 20 nt, Human
uauggcaaaucaaagagcug

SEQ ID NO: 285629 - RNA, 18 nt, Human
ucaaaguugaaauagaag

SEQ ID NO: 285630 - RNA, 26 nt, Human
uccaaaaacucuucuucccccaacag

SEQ ID NO: 285631 - RNA, 24 nt, Human
uccaaacaucuauggguccaaaaa

SEQ ID NO: 285632 - RNA, 18 nt, Human
ugacauuaaguagaggca

SEQ ID NO: 285633 - RNA, 20 nt, Human
ugaucuguuauaugcauccc

SEQ ID NO: 285634 - RNA, 23 nt, Human
ugaucuguuauaugcaucccccu

SEQ ID NO: 285635 - RNA, 28 nt, Human
ugcaaacaaagaaaaacucaugacuaca

SEQ ID NO: 285636 - RNA, 21 nt, Human
ugcacaggaagaggaaauuca

SEQ ID NO: 285637 - RNA, 20 nt, Human
uggcaaaucaaagagcuggg

SEQ ID NO: 285638 - RNA, 20 nt, Human
ugggcagaccaggccagcag

SEQ ID NO: 285639 - RNA, 23 nt, Human
uggucucaauuuacccauuugag

SEQ ID NO: 285640 - RNA, 21 nt, Human
uuaucugccaccuccaacccc

SEQ ID NO: 285641 - RNA, 18 nt, Human
uucuuucuauuugcaguu

SEQ ID NO: 285642 - RNA, 25 nt, Human
uugguguuuucuuucuauuugcagu

SEQ ID NO: 285643 - RNA, 21 nt, Human
uuuccccgcucuagcucgugg

SEQ ID NO: 285644 - RNA, 23 nt, Human
uuucuggucucaauuuacccauu

SEQ ID NO: 285645 - RNA, 21 nt, Human
uuugaguugaaaauccucuuu

SEQ ID NO: 285646 - RNA, 24 nt, Human
uuugcucuuuucuuuauuuuuggu

SEQ ID NO: 285647 - RNA, 20 nt, Human
uuuggccacuuuugcucuuu

SEQ ID NO: 285648 - RNA, 23 nt, Human
uuuggccacuuuugcucuuuucu

SEQ ID NO: 285649 - RNA, 25 nt, Human
uuuugcucuuuucuuuauuuuuggu

SEQ ID NO: 285650 - RNA, 19 nt, Human
uuuuuggccacuuuugcuc

SEQ ID NO: 285651 - RNA, 18 nt, Human
uuuuuuuuuucugggucu

SEQ ID NO: 285652 - RNA, 23 nt, Human
aaacaaccaagggcacagagcag

SEQ ID NO: 285653 - RNA, 18 nt, Human
aaacagaaaaggaagcaa

SEQ ID NO: 285654 - RNA, 22 nt, Human
aaacagaaaaggaagcaaacaa

SEQ ID NO: 285655 - RNA, 28 nt, Human
aaacagaaaaggaagcaaacaaacccca

SEQ ID NO: 285656 - RNA, 26 nt, Human
aaacagaaaaggaagcaaagggaccc

SEQ ID NO: 285657 - RNA, 22 nt, Human
aacaagaaugcuuuaucuacac

SEQ ID NO: 285658 - RNA, 18 nt, Human
aagaaugcuuuaucuaca

SEQ ID NO: 285659 - RNA, 25 nt, Human
aagacagaaacagaaaaggaagcaa

SEQ ID NO: 285660 - RNA, 21 nt, Human
aagcaaacaaaccccaguccu

SEQ ID NO: 285661 - RNA, 21 nt, Human
acacucucacacaguugugcu

SEQ ID NO: 285662 - RNA, 20 nt, Human
acagagcagcgagaagacag

SEQ ID NO: 285663 - RNA, 21 nt, Human
acagagcagcgagaagacaga

SEQ ID NO: 285664 - RNA, 24 nt, Human
acagagcagcgagaagacagaaac

SEQ ID NO: 285665 - RNA, 28 nt, Human
acagagcagcgagaagacagaaacagaa

SEQ ID NO: 285666 - RNA, 22 nt, Human
accaccacaaaacaaccaaggg

SEQ ID NO: 285667 - RNA, 20 nt, Human
acccaauccacugucacguu

SEQ ID NO: 285668 - RNA, 19 nt, Human
agaaacagaaaaggaagcc

SEQ ID NO: 285669 - RNA, 18 nt, Human
agaaagacaggagcuugg

SEQ ID NO: 285670 - RNA, 27 nt, Human
agacagaaacagaaaaggaagcaaaag

SEQ ID NO: 285671 - RNA, 19 nt, Human
agacggggcgaaggccggg

SEQ ID NO: 285672 - RNA, 24 nt, Human
agaggggaccggaggggaggcggc

SEQ ID NO: 285673 - RNA, 26 nt, Human
agcgagaagacagaaacagaaaagga

SEQ ID NO: 285674 - RNA, 22 nt, Human
agcugauuguguuucucuguac

SEQ ID NO: 285675 - RNA, 21 nt, Human
aggccggggcgggacggggcc

SEQ ID NO: 285676 - RNA, 18 nt, Human
aggcggaggggaggccuc

SEQ ID NO: 285677 - RNA, 19 nt, Human
aggggaccggaggggaggc

SEQ ID NO: 285678 - RNA, 23 nt, Human
auaaaauaaaaauaaaagcguua

SEQ ID NO: 285679 - RNA, 18 nt, Human
auaucacaaauugaccag

SEQ ID NO: 285680 - RNA, 25 nt, Human
caaaccccaguccugaaggauccag

SEQ ID NO: 285681 - RNA, 23 nt, Human
caaccaagggcacagagcagcga

SEQ ID NO: 285682 - RNA, 27 nt, Human
caagaaugcuuuaucuacugucguaga

SEQ ID NO: 285683 - RNA, 21 nt, Human
caagagagggcugcacggaug

SEQ ID NO: 285684 - RNA, 21 nt, Human
cacaaaacaaccaagggcaca

SEQ ID NO: 285685 - RNA, 23 nt, Human
caccgugucugugcgcgcgcgug

SEQ ID NO: 285686 - RNA, 24 nt, Human
cagaaagagcugauuguguuucuc

SEQ ID NO: 285687 - RNA, 21 nt, Human
cagagcagcgagaagacagaa

SEQ ID NO: 285688 - RNA, 20 nt, Human
cagauccugagucgacuccc

SEQ ID NO: 285689 - RNA, 20 nt, Human
cagcagggaggccagggugg

SEQ ID NO: 285690 - RNA, 22 nt, Human
cagccacccaauccacugucac

SEQ ID NO: 285691 - RNA, 23 nt, Human
ccagaaaagagauguggcuuuug

SEQ ID NO: 285692 - RNA, 23 nt, Human
cccaguccugaaggauccagaaa

SEQ ID NO: 285693 - RNA, 18 nt, Human
ccccggggcggugcuggg

SEQ ID NO: 285694 - RNA, 18 nt, Human
ccccggggcggugcuggg

SEQ ID NO: 285695 - RNA, 20 nt, Human
cccucagaugaggcgguugg

SEQ ID NO: 285696 - RNA, 26 nt, Human
ccgggguccgggugcgcgccggaagg

SEQ ID NO: 285697 - RNA, 19 nt, Human
ccuccuuuaagacaaaaau

SEQ ID NO: 285698 - RNA, 21 nt, Human
ccuuauaaagacuuaucaaaa

SEQ ID NO: 285699 - RNA, 21 nt, Human
cgacaggaccaccacaaaaca

SEQ ID NO: 285700 - RNA, 24 nt, Human
cgagaagacagaaacagaaaagga

SEQ ID NO: 285701 - RNA, 24 nt, Human
cgcgccggaagggccucggggcgg

SEQ ID NO: 285702 - RNA, 19 nt, Human
cgggaaggauacuuuuugc

SEQ ID NO: 285703 - RNA, 19 nt, Human
cggggcggcccccggggcg

SEQ ID NO: 285704 - RNA, 21 nt, Human
cggugcugggggcggagcggg

SEQ ID NO: 285705 - RNA, 24 nt, Human
cuccagccacccaauccacuguca

SEQ ID NO: 285706 - RNA, 25 nt, Human
cuguucccccccaaauuuuagcggc

SEQ ID NO: 285707 - RNA, 20 nt, Human
cuucuacacucucacacagu

SEQ ID NO: 285708 - RNA, 18 nt, Human
gaagggaagaggggcggc

SEQ ID NO: 285709 - RNA, 19 nt, Human
gacagaaacagaaaaggaa

SEQ ID NO: 285710 - RNA, 18 nt, Human
gagaggaaagaaagacag

SEQ ID NO: 285711 - RNA, 19 nt, Human
gagcacggccagcgccagc

SEQ ID NO: 285712 - RNA, 19 nt, Human
gaguguguguguuucugcc

SEQ ID NO: 285713 - RNA, 20 nt, Human
gcagggcgccgggguccggg

SEQ ID NO: 285714 - RNA, 18 nt, Human
gcggagcgggccggggcg

SEQ ID NO: 285715 - RNA, 18 nt, Human
gcggccgggagacggggg

SEQ ID NO: 285716 - RNA, 19 nt, Human
gcggccgggagacggggga

SEQ ID NO: 285717 - RNA, 22 nt, Human
gcggcuuuaaguuauuuaaaau

SEQ ID NO: 285718 - RNA, 19 nt, Human
ggaaagaggggaccggagg

SEQ ID NO: 285719 - RNA, 22 nt, Human
ggagcuuggagaguacaaggau

SEQ ID NO: 285720 - RNA, 27 nt, Human
ggcggcccccggggcggugcugggggc

SEQ ID NO: 285721 - RNA, 20 nt, Human
ggcggugcugggggcggagc

SEQ ID NO: 285722 - RNA, 19 nt, Human
ggggaaagaggggaccgga

SEQ ID NO: 285723 - RNA, 20 nt, Human
ggggcggagcgggccggggc

SEQ ID NO: 285724 - RNA, 20 nt, Human
gugcuuaagaaaaugaaaau

SEQ ID NO: 285725 - RNA, 21 nt, Human
guggcgggaagggugggcuga

SEQ ID NO: 285726 - RNA, 18 nt, Human
guugcaggguuguagaug

SEQ ID NO: 285727 - RNA, 23 nt, Human
uaaaauagauauaagcuauaagc

SEQ ID NO: 285728 - RNA, 22 nt, Human
uaagacaaaaaucccuaacauu

SEQ ID NO: 285729 - RNA, 22 nt, Human
uacacaaaacauccuauuucac

SEQ ID NO: 285730 - RNA, 19 nt, Human
uagaaagcgcuucuguucu

SEQ ID NO: 285731 - RNA, 24 nt, Human
uagaucaccuaaaugaaagaaaau

SEQ ID NO: 285732 - RNA, 19 nt, Human
uagauguccgagugccccc

SEQ ID NO: 285733 - RNA, 19 nt, Human
uagcaaugcuuguccuccu

SEQ ID NO: 285734 - RNA, 24 nt, Human
uauauagaucaccuaaaugaaaga

SEQ ID NO: 285735 - RNA, 19 nt, Human
ucacauacugaaaaugauu

SEQ ID NO: 285736 - RNA, 18 nt, Human
ucccugguacguaaaaug

SEQ ID NO: 285737 - RNA, 19 nt, Human
uccgggugcgcgccggaag

SEQ ID NO: 285738 - RNA, 19 nt, Human
ucgaaggugugggugggaa

SEQ ID NO: 285739 - RNA, 21 nt, Human
ucuacacaaaacauccuauuu

SEQ ID NO: 285740 - RNA, 26 nt, Human
ugaccagcacaugcagaaaggguuuc

SEQ ID NO: 285741 - RNA, 23 nt, Human
ugaggcgguugguagcaaugcuu

SEQ ID NO: 285742 - RNA, 21 nt, Human
ugcaagccaagagagggcugc

SEQ ID NO: 285743 - RNA, 25 nt, Human
ugcagaaagagcugauugaucagug

SEQ ID NO: 285744 - RNA, 19 nt, Human
ugcgcgcgcguguguagcg

SEQ ID NO: 285745 - RNA, 20 nt, Human
ugggaagggaagaggggcgg

SEQ ID NO: 285746 - RNA, 19 nt, Human
uggugggagaggaaagaaa

SEQ ID NO: 285747 - RNA, 24 nt, Human
uggugggagaggaaagaaagacag

SEQ ID NO: 285748 - RNA, 18 nt, Human
ugugcgcgcgcgugugua

SEQ ID NO: 285749 - RNA, 20 nt, Human
uugccgggcgcgggaggagg

SEQ ID NO: 285750 - RNA, 20 nt, Human
uugugcugucccuugaacac

SEQ ID NO: 285751 - RNA, 22 nt, Human
uuucugcccacaaaccagucca

SEQ ID NO: 285752 - RNA, 20 nt, Human
uuuuuuuuuuuuuuuuucac

SEQ ID NO: 285753 - RNA, 21 nt, Human
aaagacuggaaggggaggcuu

SEQ ID NO: 285754 - RNA, 21 nt, Human
agccgaagcaccggucccccc

SEQ ID NO: 285755 - RNA, 21 nt, Human
aguucaaccaaccaacagcaa

SEQ ID NO: 285756 - RNA, 20 nt, Human
aguuuaguaggggcugaagg

SEQ ID NO: 285757 - RNA, 19 nt, Human
auauauguauauauauaua

SEQ ID NO: 285758 - RNA, 19 nt, Human
auauauguguauauauaua

SEQ ID NO: 285759 - RNA, 20 nt, Human
auauguauauauauauauau

SEQ ID NO: 285760 - RNA, 19 nt, Human
auauguguauauauauaug

SEQ ID NO: 285761 - RNA, 18 nt, Human
auguauauauauauauau

SEQ ID NO: 285762 - RNA, 27 nt, Human
caagauauguucaguucaaccaaccaa

SEQ ID NO: 285763 - RNA, 25 nt, Human
cagcagcaacaggaucgggaccacg

SEQ ID NO: 285764 - RNA, 18 nt, Human
cagcguucccgccgaggc

SEQ ID NO: 285765 - RNA, 19 nt, Human
cagcugccggggccguuca

SEQ ID NO: 285766 - RNA, 18 nt, Human
ccgccgggcagccaaccu

SEQ ID NO: 285767 - RNA, 19 nt, Human
ccuccggcgggccuagccc

SEQ ID NO: 285768 - RNA, 18 nt, Human
cgaagcaccggucccccc

SEQ ID NO: 285769 - RNA, 20 nt, Human
cgccaguuagugacuccagu

SEQ ID NO: 285770 - RNA, 18 nt, Human
cgccgggaggcucuggcc

SEQ ID NO: 285771 - RNA, 20 nt, Human
cgccgggaggcucuggccgg

SEQ ID NO: 285772 - RNA, 19 nt, Human
cggcagugcaggcaaugga

SEQ ID NO: 285773 - RNA, 18 nt, Human
cgggaggaacucuuagug

SEQ ID NO: 285774 - RNA, 22 nt, Human
cgucugggggccuggccugccc

SEQ ID NO: 285775 - RNA, 20 nt, Human
cuauguacagcguucccgcc

SEQ ID NO: 285776 - RNA, 24 nt, Human
gcaggcguggagcaaaaucgaggg

SEQ ID NO: 285777 - RNA, 23 nt, Human
gccuagcccuggcgcgccccagc

SEQ ID NO: 285778 - RNA, 19 nt, Human
gcgucugggggccuggccu

SEQ ID NO: 285779 - RNA, 20 nt, Human
ggauccagggggcccggggc

SEQ ID NO: 285780 - RNA, 18 nt, Human
gggaggcucuggccggca

SEQ ID NO: 285781 - RNA, 22 nt, Human
guauauauauauauaugugcug

SEQ ID NO: 285782 - RNA, 24 nt, Human
gugcaggcaauggacaucuuuuug

SEQ ID NO: 285783 - RNA, 19 nt, Human
uaacagcuggguggaggcg

SEQ ID NO: 285784 - RNA, 20 nt, Human
uaaguggucccuggaacgga

SEQ ID NO: 285785 - RNA, 23 nt, Human
uacagcguucccgccgaggcgga

SEQ ID NO: 285786 - RNA, 18 nt, Human
uauauauauauguauaua

SEQ ID NO: 285787 - RNA, 20 nt, Human
uauauauauguauauauaua

SEQ ID NO: 285788 - RNA, 23 nt, Human
uauauauauguauauauauauau

SEQ ID NO: 285789 - RNA, 21 nt, Human
uauauauaugugcuguauaua

SEQ ID NO: 285790 - RNA, 20 nt, Human
uauauauguguauauauaua

SEQ ID NO: 285791 - RNA, 21 nt, Human
uauauguauauauauauauau

SEQ ID NO: 285792 - RNA, 23 nt, Human
uauauguauauauauauauaugu

SEQ ID NO: 285793 - RNA, 18 nt, Human
uauauguguauauauaua

SEQ ID NO: 285794 - RNA, 18 nt, Human
uauguauauauauauaua

SEQ ID NO: 285795 - RNA, 19 nt, Human
uauguauauauauauauau

SEQ ID NO: 285796 - RNA, 22 nt, Human
uauguguauauauauauguaua

SEQ ID NO: 285797 - RNA, 24 nt, Human
uauguguauauauauauguauaua

SEQ ID NO: 285798 - RNA, 19 nt, Human
ucaaacagcggaucagagc

SEQ ID NO: 285799 - RNA, 22 nt, Human
uccagcgcagggcggggcggga

SEQ ID NO: 285800 - RNA, 22 nt, Human
uccccccaagcaaguggcacaa

SEQ ID NO: 285801 - RNA, 24 nt, Human
uccccccaagcaaguggcacaaaa

SEQ ID NO: 285802 - RNA, 22 nt, Human
ucccuggaacggaccugacuau

SEQ ID NO: 285803 - RNA, 24 nt, Human
uccugggugcuaagacaagauaug

SEQ ID NO: 285804 - RNA, 22 nt, Human
ucuugcucgguuguuuagguga

SEQ ID NO: 285805 - RNA, 21 nt, Human
ugcccucagcugccggggccg

SEQ ID NO: 285806 - RNA, 18 nt, Human
uggccggcaggcguggag

SEQ ID NO: 285807 - RNA, 21 nt, Human
uggggggugaaaauucaguuu

SEQ ID NO: 285808 - RNA, 18 nt, Human
uguauauauauauauaug

SEQ ID NO: 285809 - RNA, 22 nt, Human
uguauauauauauguauauaua

SEQ ID NO: 285810 - RNA, 22 nt, Human
uguguauauauauauguauaua

SEQ ID NO: 285811 - RNA, 18 nt, Human
uucccgccgaggcggaag

SEQ ID NO: 285812 - RNA, 25 nt, Human
uuggagaagacgaggcaaaggcggg

SEQ ID NO: 285813 - RNA, 18 nt, Human
uugggcucaaacagcgga

SEQ ID NO: 285814 - RNA, 26 nt, Human
uuuuauauauguguauauauauaugu

SEQ ID NO: 285815 - RNA, 20 nt, Human
uuuuggggggugaaaauuca

SEQ ID NO: 285816 - RNA, 30 nt, Human
uuuuuuauauauguguauauauauauguaa

SEQ ID NO: 285817 - RNA, 23 nt, Human
uuuuuuuauauauguguauauau

SEQ ID NO: 285818 - RNA, 18 nt, Human
aaugcaaaaaugagcaga

SEQ ID NO: 285819 - RNA, 25 nt, Human
acacacacacagcagugcacacaca

SEQ ID NO: 285820 - RNA, 18 nt, Human
accugggcuggucccucu

SEQ ID NO: 285821 - RNA, 20 nt, Human
agaagagaggguccagcggg

SEQ ID NO: 285822 - RNA, 24 nt, Human
agagcccuccagaacccugagcau

SEQ ID NO: 285823 - RNA, 22 nt, Human
agagggcagcugggccaccaca

SEQ ID NO: 285824 - RNA, 21 nt, Human
agcagugcacacacacaagca

SEQ ID NO: 285825 - RNA, 20 nt, Human
aggaccgaacugcccugcca

SEQ ID NO: 285826 - RNA, 22 nt, Human
aggagcacccccagggcucgag

SEQ ID NO: 285827 - RNA, 24 nt, Human
aggagcacccccagggcucgagcc

SEQ ID NO: 285828 - RNA, 21 nt, Human
aggcagccuugccucaucccu

SEQ ID NO: 285829 - RNA, 19 nt, Human
aggcucagaacagccucgg

SEQ ID NO: 285830 - RNA, 23 nt, Human
auuagaagcccugccaggugggg

SEQ ID NO: 285831 - RNA, 24 nt, Human
caagcacacgcacacacacggcug

SEQ ID NO: 285832 - RNA, 22 nt, Human
caagcgccacugcccgcugagu

SEQ ID NO: 285833 - RNA, 23 nt, Human
caauuaucccuccggaguuuucu

SEQ ID NO: 285834 - RNA, 26 nt, Human
cacacaagcacacgcacacacacggc

SEQ ID NO: 285835 - RNA, 24 nt, Human
cacacacagcagugcacacacaca

SEQ ID NO: 285836 - RNA, 19 nt, Human
caccacacagcccgggggc

SEQ ID NO: 285837 - RNA, 20 nt, Human
cagacaggugagaggcuugg

SEQ ID NO: 285838 - RNA, 23 nt, Human
cagacaggugagaggcuuggugg

SEQ ID NO: 285839 - RNA, 18 nt, Human
cagagcccuccagaaccc

SEQ ID NO: 285840 - RNA, 21 nt, Human
cagcacaugugugccucuccu

SEQ ID NO: 285841 - RNA, 23 nt, Human
cagccccugcccugugcugagag

SEQ ID NO: 285842 - RNA, 21 nt, Human
cagcugggccaccacacagcc

SEQ ID NO: 285843 - RNA, 21 nt, Human
caggagggugggcuggccagg

SEQ ID NO: 285844 - RNA, 29 nt, Human
cagugcacacacacaagcacacgcacaca

SEQ ID NO: 285845 - RNA, 22 nt, Human
ccacugcugcaccgccuucccg

SEQ ID NO: 285846 - RNA, 18 nt, Human
ccagccaagcgccacugc

SEQ ID NO: 285847 - RNA, 22 nt, Human
ccaggcucagaacagccucggc

SEQ ID NO: 285848 - RNA, 20 nt, Human
ccccaccugggcuggucccu

SEQ ID NO: 285849 - RNA, 18 nt, Human
ccggaaggacagagcccu

SEQ ID NO: 285850 - RNA, 23 nt, Human
ccuccagaacccugagcauuaga

SEQ ID NO: 285851 - RNA, 19 nt, Human
ccugcagccccugcccugu

SEQ ID NO: 285852 - RNA, 18 nt, Human
ccuggagacuccgucccu

SEQ ID NO: 285853 - RNA, 21 nt, Human
ccugugcugagaggcgggggc

SEQ ID NO: 285854 - RNA, 22 nt, Human
ccuugccucaucccuucucuug

SEQ ID NO: 285855 - RNA, 18 nt, Human
cucccgguagggcugugg

SEQ ID NO: 285856 - RNA, 20 nt, Human
cucugugggcggcugcuucu

SEQ ID NO: 285857 - RNA, 20 nt, Human
cuucuuggcaccuuguaguu

SEQ ID NO: 285858 - RNA, 19 nt, Human
cuuuaaaaaauaaaaggaa

SEQ ID NO: 285859 - RNA, 20 nt, Human
gacggcuggaaccuggagac

SEQ ID NO: 285860 - RNA, 20 nt, Human
gaggcuugguggagaagaga

SEQ ID NO: 285861 - RNA, 24 nt, Human
gcacacacacggcugcagcacaug

SEQ ID NO: 285862 - RNA, 21 nt, Human
gcacaugugugccucuccuug

SEQ ID NO: 285863 - RNA, 23 nt, Human
gcacaugugugccucuccuugcc

SEQ ID NO: 285864 - RNA, 22 nt, Human
gcagcugggaggcaauccugga

SEQ ID NO: 285865 - RNA, 22 nt, Human
gcagugcacacacacaagcacc

SEQ ID NO: 285866 - RNA, 19 nt, Human
gcgccacugcccgcugagu

SEQ ID NO: 285867 - RNA, 21 nt, Human
gcgugcacacacacacagcag

SEQ ID NO: 285868 - RNA, 20 nt, Human
gcugugguggcagaagccca

SEQ ID NO: 285869 - RNA, 21 nt, Human
ggaaggacagagcccuccaga

SEQ ID NO: 285870 - RNA, 21 nt, Human
ggccacagaggguuccggcuc

SEQ ID NO: 285871 - RNA, 22 nt, Human
gggcaggaaggggguucggcca

SEQ ID NO: 285872 - RNA, 23 nt, Human
gggcugccccgaccaccacugcu

SEQ ID NO: 285873 - RNA, 20 nt, Human
gggcuuccaggagcaccccc

SEQ ID NO: 285874 - RNA, 22 nt, Human
ggggagagaacagacaggugag

SEQ ID NO: 285875 - RNA, 23 nt, Human
gggguucggccacagaggguucc

SEQ ID NO: 285876 - RNA, 25 nt, Human
ggugggcuggccaggcagcugggag

SEQ ID NO: 285877 - RNA, 27 nt, Human
gugcacacacacaagcacacgcacaca

SEQ ID NO: 285878 - RNA, 23 nt, Human
gugcacacacacacagcagugca

SEQ ID NO: 285879 - RNA, 25 nt, Human
gugcacacacacacagcagugcaca

SEQ ID NO: 285880 - RNA, 18 nt, Human
uagagucucgaaggcuca

SEQ ID NO: 285881 - RNA, 21 nt, Human
ucagaacagccucggcccaua

SEQ ID NO: 285882 - RNA, 21 nt, Human
ucgcauuggcaccaaaaauau

SEQ ID NO: 285883 - RNA, 21 nt, Human
ucggccacagaggguuccggc

SEQ ID NO: 285884 - RNA, 19 nt, Human
ucucuugacauagguacau

SEQ ID NO: 285885 - RNA, 18 nt, Human
ugacuggggagagaacag

SEQ ID NO: 285886 - RNA, 21 nt, Human
ugacuggggagagaacagaca

SEQ ID NO: 285887 - RNA, 19 nt, Human
ugagcagaggucauugcug

SEQ ID NO: 285888 - RNA, 23 nt, Human
ugagugagcacgugugcccaggg

SEQ ID NO: 285889 - RNA, 27 nt, Human
ugcacacacacaagcacacgcacacac

SEQ ID NO: 285890 - RNA, 27 nt, Human
ugccaggcacacagugugucucugugg

SEQ ID NO: 285891 - RNA, 24 nt, Human
ugcccugugcugagaggcgggggc

SEQ ID NO: 285892 - RNA, 28 nt, Human
ugcgugcacacacacacagcagugcaca

SEQ ID NO: 285893 - RNA, 19 nt, Human
ugcugagaggcgggggcag

SEQ ID NO: 285894 - RNA, 23 nt, Human
uggaugcucuuggggcuuccagg

SEQ ID NO: 285895 - RNA, 22 nt, Human
uggcaccaaaaauauauuaaca

SEQ ID NO: 285896 - RNA, 22 nt, Human
ugggauccuagcucgaaccucc

SEQ ID NO: 285897 - RNA, 26 nt, Human
ugucucugugggcggcugcuucuaau

SEQ ID NO: 285898 - RNA, 23 nt, Human
uucccuagccaugagacggcugg

SEQ ID NO: 285899 - RNA, 18 nt, Human
uuuaaaaaauaaaaggaa

SEQ ID NO: 285900 - RNA, 18 nt, Human
aaaacuaauaaaaaacca

SEQ ID NO: 285901 - RNA, 22 nt, Human
aaaaugagaaaacugagaagaa

SEQ ID NO: 285902 - RNA, 23 nt, Human
aaacaagagccugaaaguaaaac

SEQ ID NO: 285903 - RNA, 21 nt, Human
aaagucugaaacacaagaaaa

SEQ ID NO: 285904 - RNA, 19 nt, Human
aaaugaaaaacacgcagcc

SEQ ID NO: 285905 - RNA, 18 nt, Human
aacaaucaugacagcaac

SEQ ID NO: 285906 - RNA, 19 nt, Human
aacuaauaaaaaaccaccu

SEQ ID NO: 285907 - RNA, 23 nt, Human
aacuaguuauuucucccugcccu

SEQ ID NO: 285908 - RNA, 23 nt, Human
aagcaguaugggaggaaggggga

SEQ ID NO: 285909 - RNA, 18 nt, Human
aaggcugaauuaaaggca

SEQ ID NO: 285910 - RNA, 19 nt, Human
aaguagccuuggcagaaga

SEQ ID NO: 285911 - RNA, 18 nt, Human
aaugcuccuuuugcuuuu

SEQ ID NO: 285912 - RNA, 18 nt, Human
acagcaugccuagagaac

SEQ ID NO: 285913 - RNA, 19 nt, Human
acucauaaaaagccugucc

SEQ ID NO: 285914 - RNA, 23 nt, Human
agcaacucuccuaaccacaaaaa

SEQ ID NO: 285915 - RNA, 21 nt, Human
aggaagggggauguucuaggg

SEQ ID NO: 285916 - RNA, 19 nt, Human
aggcaggaggaggcugcgg

SEQ ID NO: 285917 - RNA, 23 nt, Human
auaaaaacaaccuucucagccuu

SEQ ID NO: 285918 - RNA, 18 nt, Human
aucaagaauauaaaguca

SEQ ID NO: 285919 - RNA, 26 nt, Human
augacagcaacucuccuaaccacaaa

SEQ ID NO: 285920 - RNA, 22 nt, Human
auggcugcauaaagucugaaac

SEQ ID NO: 285921 - RNA, 29 nt, Human
augggaggaagggggauguucuaggggga

SEQ ID NO: 285922 - RNA, 18 nt, Human
auuguagcuacaccugaa

SEQ ID NO: 285923 - RNA, 22 nt, Human
caaaacaagagccugaaaguaa

SEQ ID NO: 285924 - RNA, 19 nt, Human
caaauccuagacuugucca

SEQ ID NO: 285925 - RNA, 22 nt, Human
caagaaaacuaauaaaaaacca

SEQ ID NO: 285926 - RNA, 19 nt, Human
caauuucuagggcccuucu

SEQ ID NO: 285927 - RNA, 22 nt, Human
caccugaaaagaagugaguuuc

SEQ ID NO: 285928 - RNA, 23 nt, Human
caccugaaaagaagugaguuuca

SEQ ID NO: 285929 - RNA, 23 nt, Human
cagaggaggcugaagaaaaaaca

SEQ ID NO: 285930 - RNA, 18 nt, Human
cagugaaaaugcauucaa

SEQ ID NO: 285931 - RNA, 19 nt, Human
cagugaaaaugcauucaau

SEQ ID NO: 285932 - RNA, 24 nt, Human
cauguuuauucccugacacuaaaa

SEQ ID NO: 285933 - RNA, 23 nt, Human
cauuuuccccccaguacugggaa

SEQ ID NO: 285934 - RNA, 20 nt, Human
ccacaggguuucaauaacag

SEQ ID NO: 285935 - RNA, 27 nt, Human
ccagaaaggcuguuuuauauauggugg

SEQ ID NO: 285936 - RNA, 21 nt, Human
ccgggaugcuucugaagucau

SEQ ID NO: 285937 - RNA, 25 nt, Human
ccuaaaaacaugaauaaguuuguau

SEQ ID NO: 285938 - RNA, 19 nt, Human
ccugcccucccccacaaga

SEQ ID NO: 285939 - RNA, 22 nt, Human
ccuguucuucagggugccuaga

SEQ ID NO: 285940 - RNA, 21 nt, Human
cuguucuucagggugccuaga

SEQ ID NO: 285941 - RNA, 19 nt, Human
gaaaaaacaaucaugacag

SEQ ID NO: 285942 - RNA, 20 nt, Human
gaaaacuaauaaaaaaccac

SEQ ID NO: 285943 - RNA, 18 nt, Human
gaaccaaaacaagagccu

SEQ ID NO: 285944 - RNA, 22 nt, Human
gaaccaaaacaagagccugaaa

SEQ ID NO: 285945 - RNA, 18 nt, Human
gaagaaaaaacaaucaug

SEQ ID NO: 285946 - RNA, 25 nt, Human
gaagccccaaaagaaaagucagagg

SEQ ID NO: 285947 - RNA, 22 nt, Human
gaggcauuccugcuugccuucu

SEQ ID NO: 285948 - RNA, 19 nt, Human
gcgacugcgaaggaaaccc

SEQ ID NO: 285949 - RNA, 23 nt, Human
ggcagaagaaaaaccguuguucu

SEQ ID NO: 285950 - RNA, 24 nt, Human
ggugaggcaggaggaggcugcggg

SEQ ID NO: 285951 - RNA, 20 nt, Human
guaaucauaaaaucugaagc

SEQ ID NO: 285952 - RNA, 22 nt, Human
uaaaaucuccucugaaccaaaa

SEQ ID NO: 285953 - RNA, 21 nt, Human
uaaaaugaaaaacacgcagcc

SEQ ID NO: 285954 - RNA, 19 nt, Human
uaaaaugucacagcaugcc

SEQ ID NO: 285955 - RNA, 20 nt, Human
uaaauuaucccacagcccuu

SEQ ID NO: 285956 - RNA, 19 nt, Human
uaaccacaaaaaucacaua

SEQ ID NO: 285957 - RNA, 25 nt, Human
uacacaauuaugauuauugaugucc

SEQ ID NO: 285958 - RNA, 21 nt, Human
uacuggaaugauaaguuugaa

SEQ ID NO: 285959 - RNA, 24 nt, Human
uagcccacaggguuucaauaacag

SEQ ID NO: 285960 - RNA, 22 nt, Human
uauuucucccugcccuccccca

SEQ ID NO: 285961 - RNA, 21 nt, Human
ucacagcaugccuagagaaca

SEQ ID NO: 285962 - RNA, 22 nt, Human
ucagccuuaacaaaugagauaa

SEQ ID NO: 285963 - RNA, 21 nt, Human
ucccaugggccccugucaggu

SEQ ID NO: 285964 - RNA, 18 nt, Human
uccucugaaccaaaacaa

SEQ ID NO: 285965 - RNA, 23 nt, Human
ucggugcgcgacugcgaaggaaa

SEQ ID NO: 285966 - RNA, 24 nt, Human
ucucccugcccucccccacaagag

SEQ ID NO: 285967 - RNA, 19 nt, Human
ucugaaccaaaacaagagc

SEQ ID NO: 285968 - RNA, 20 nt, Human
ucugaagccccaaaagaaaa

SEQ ID NO: 285969 - RNA, 18 nt, Human
ugaaaaacacgcagccug

SEQ ID NO: 285970 - RNA, 23 nt, Human
ugaagccccaaaagaaaagucag

SEQ ID NO: 285971 - RNA, 21 nt, Human
ugacacuaaaaguucacugac

SEQ ID NO: 285972 - RNA, 19 nt, Human
ugacagcaacucuccuaac

SEQ ID NO: 285973 - RNA, 18 nt, Human
ugagaagaaucaguuagg

SEQ ID NO: 285974 - RNA, 23 nt, Human
ugagaggagguacaguacaagua

SEQ ID NO: 285975 - RNA, 19 nt, Human
ugagauaauuauaaaugcu

SEQ ID NO: 285976 - RNA, 21 nt, Human
ugaggauacaaaggaauacug

SEQ ID NO: 285977 - RNA, 25 nt, Human
ugaggcaggaggaggcugcggguug

SEQ ID NO: 285978 - RNA, 23 nt, Human
ugcauaaagucugaaacacaaga

SEQ ID NO: 285979 - RNA, 22 nt, Human
uggaaugauaaguuugaagaug

SEQ ID NO: 285980 - RNA, 23 nt, Human
uggauaaggcugaauuaaaggca

SEQ ID NO: 285981 - RNA, 19 nt, Human
uggcagaagaaaaaccguu

SEQ ID NO: 285982 - RNA, 23 nt, Human
uuaaaaucuccucugaaccaaaa

SEQ ID NO: 285983 - RNA, 24 nt, Human
uuuaaccauguggucagccagaaa

SEQ ID NO: 285984 - RNA, 26 nt, Human
uuucaaaaucauaucaauauauuacu

SEQ ID NO: 285985 - RNA, 23 nt, Human
uuuuauauaugguguguguuacu

SEQ ID NO: 285986 - RNA, 23 nt, Human
uuuuuuuuuuuuuuuuucaucag

SEQ ID NO: 285987 - RNA, 24 nt, Human
aaacaguauaccugacacaguaug

SEQ ID NO: 285988 - RNA, 24 nt, Human
acucaguggucuaugaaguaugua

SEQ ID NO: 285989 - RNA, 23 nt, Human
agagaauguuguagugugaauaa

SEQ ID NO: 285990 - RNA, 23 nt, Human
auacagguucaacaaaagagcac

SEQ ID NO: 285991 - RNA, 21 nt, Human
auguaaauaguauguuuucuu

SEQ ID NO: 285992 - RNA, 22 nt, Human
auguccaaauguuaccugugcc

SEQ ID NO: 285993 - RNA, 21 nt, Human
caacuucacagauacagaagu

SEQ ID NO: 285994 - RNA, 21 nt, Human
cacuguauugcuucuugaacu

SEQ ID NO: 285995 - RNA, 22 nt, Human
caugauuugaaaaauaaacucc

SEQ ID NO: 285996 - RNA, 23 nt, Human
cauguccaaauguuaccugugcc

SEQ ID NO: 285997 - RNA, 26 nt, Human
cauuuuucuuaaaaggaaauugagaa

SEQ ID NO: 285998 - RNA, 22 nt, Human
ccaaauuauaaaacaguauacc

SEQ ID NO: 285999 - RNA, 19 nt, Human
ccuaaagaacucugggaca

SEQ ID NO: 286000 - RNA, 22 nt, Human
cuuccuaagaauaagaugaaca

SEQ ID NO: 286001 - RNA, 19 nt, Human
gccaacuucacagauacag

SEQ ID NO: 286002 - RNA, 22 nt, Human
gccccaauuagacuguucuagu

SEQ ID NO: 286003 - RNA, 20 nt, Human
guaacaugugaaaaugaagu

SEQ ID NO: 286004 - RNA, 23 nt, Human
gugauacagacuaauuuuaaagc

SEQ ID NO: 286005 - RNA, 23 nt, Human
uaaaacaguauaccugacacagu

SEQ ID NO: 286006 - RNA, 25 nt, Human
uaaccuaaagaacucugggacaaga

SEQ ID NO: 286007 - RNA, 26 nt, Human
uaaccuaaagaacucugggacaagaa

SEQ ID NO: 286008 - RNA, 25 nt, Human
uaacuuuaucagauaauuuaaugau

SEQ ID NO: 286009 - RNA, 19 nt, Human
uacagaaguauccagucuu

SEQ ID NO: 286010 - RNA, 21 nt, Human
uacagacuaauuuuaaagcac

SEQ ID NO: 286011 - RNA, 22 nt, Human
uauaaucaaaauguugcccaaa

SEQ ID NO: 286012 - RNA, 19 nt, Human
uauguugaggaaauaugca

SEQ ID NO: 286013 - RNA, 21 nt, Human
uauuagggaacugaguaacau

SEQ ID NO: 286014 - RNA, 26 nt, Human
ucaauauaguuaaaaaaaaaaaaaaa

SEQ ID NO: 286015 - RNA, 22 nt, Human
ucauuauaaucaaaauguugcc

SEQ ID NO: 286016 - RNA, 20 nt, Human
uccaaauguuaccugugcca

SEQ ID NO: 286017 - RNA, 19 nt, Human
uccuaagaauaagaugaac

SEQ ID NO: 286018 - RNA, 21 nt, Human
ucuccucacauuucauuuuuc

SEQ ID NO: 286019 - RNA, 20 nt, Human
ugcccaaaccugcagaucau

SEQ ID NO: 286020 - RNA, 21 nt, Human
ugggacaagaacaugauuuga

SEQ ID NO: 286021 - RNA, 24 nt, Human
ugggaguuggugugcaauaaggcu

SEQ ID NO: 286022 - RNA, 24 nt, Human
ugucagguuugggccauucuccug

SEQ ID NO: 286023 - RNA, 21 nt, Human
ugugcaauaaggcuaaaacaa

SEQ ID NO: 286024 - RNA, 21 nt, Human
uguugaggaaauaugcaucug

SEQ ID NO: 286025 - RNA, 22 nt, Human
uugcccaaauucuaacaaaccc

SEQ ID NO: 286026 - RNA, 20 nt, Human
uauuuucaccauuucugggg

SEQ ID NO: 286027 - RNA, 19 nt, Human
uggguccaggguccgugac

SEQ ID NO: 286028 - RNA, 24 nt, Human
aaaaagaaaccccaaacccuuagu

SEQ ID NO: 286029 - RNA, 20 nt, Human
aaacccuuaguagucaugcc

SEQ ID NO: 286030 - RNA, 19 nt, Human
aaagaaaccccaaacccuu

SEQ ID NO: 286031 - RNA, 25 nt, Human
aaaugucuauucaaaccguuagccc

SEQ ID NO: 286032 - RNA, 19 nt, Human
aacuuuguucuuuuucaag

SEQ ID NO: 286033 - RNA, 25 nt, Human
aagcaggugcaccauuuacauuccc

SEQ ID NO: 286034 - RNA, 18 nt, Human
aagccacucacugcccag

SEQ ID NO: 286035 - RNA, 21 nt, Human
accgcuuuucacaauauccca

SEQ ID NO: 286036 - RNA, 22 nt, Human
acggccccagugacgcgugcgc

SEQ ID NO: 286037 - RNA, 24 nt, Human
acuagcuuaucaauuucuguaaaa

SEQ ID NO: 286038 - RNA, 19 nt, Human
agcaccacccuucccaucu

SEQ ID NO: 286039 - RNA, 21 nt, Human
agcaccacccuucccaucuga

SEQ ID NO: 286040 - RNA, 24 nt, Human
agcaggugcaccauuuacauuccc

SEQ ID NO: 286041 - RNA, 25 nt, Human
agcuucuuaaacauuuuuaacccaa

SEQ ID NO: 286042 - RNA, 21 nt, Human
aggagaaaaaacaagccacuc

SEQ ID NO: 286043 - RNA, 24 nt, Human
aggcaaauacacuuugaggucagg

SEQ ID NO: 286044 - RNA, 18 nt, Human
aggcucauccauguugug

SEQ ID NO: 286045 - RNA, 23 nt, Human
aggcugcagcccuggcccuggcu

SEQ ID NO: 286046 - RNA, 24 nt, Human
agggcagcaguggguucagggugg

SEQ ID NO: 286047 - RNA, 18 nt, Human
aggggcgcccggggcucc

SEQ ID NO: 286048 - RNA, 18 nt, Human
agugaaauuacaagucca

SEQ ID NO: 286049 - RNA, 25 nt, Human
auacgccaucaccuaggagcagagc

SEQ ID NO: 286050 - RNA, 21 nt, Human
caaagcaggugcaccauuuac

SEQ ID NO: 286051 - RNA, 22 nt, Human
caaauacacuuugaggucagga

SEQ ID NO: 286052 - RNA, 26 nt, Human
caagcccagagcccccagcgugccag

SEQ ID NO: 286053 - RNA, 26 nt, Human
cacaauaucccagaaugaagaaguaa

SEQ ID NO: 286054 - RNA, 21 nt, Human
cacagccuccaggcccuggcc

SEQ ID NO: 286055 - RNA, 19 nt, Human
cacagccugagccucaggc

SEQ ID NO: 286056 - RNA, 22 nt, Human
cacccgaaaaagaaaccccaaa

SEQ ID NO: 286057 - RNA, 21 nt, Human
cacugcaccgaguccgcaggc

SEQ ID NO: 286058 - RNA, 19 nt, Human
caggagaaaaaacaagcca

SEQ ID NO: 286059 - RNA, 26 nt, Human
caggaggcgagcgaggagcgccuccc

SEQ ID NO: 286060 - RNA, 22 nt, Human
caggugcaccauuuacauuccc

SEQ ID NO: 286061 - RNA, 23 nt, Human
caguuccucgggauguucagcgg

SEQ ID NO: 286062 - RNA, 26 nt, Human
cauacgccaucaccuaggagcagagc

SEQ ID NO: 286063 - RNA, 18 nt, Human
ccagagcccccagcgugc

SEQ ID NO: 286064 - RNA, 21 nt, Human
ccagauggucuuacaagguaa

SEQ ID NO: 286065 - RNA, 22 nt, Human
ccagcacagccugagccucagg

SEQ ID NO: 286066 - RNA, 21 nt, Human
ccaggcccuggcaaacgcuaa

SEQ ID NO: 286067 - RNA, 22 nt, Human
ccccuuaucauauauaugacuc

SEQ ID NO: 286068 - RNA, 24 nt, Human
cccgaaaaagaaaccccaaacccu

SEQ ID NO: 286069 - RNA, 20 nt, Human
cccuggcccuggcugguggg

SEQ ID NO: 286070 - RNA, 23 nt, Human
ccucaggcugcagcccuggcccu

SEQ ID NO: 286071 - RNA, 26 nt, Human
ccucaggcugcagcccuggcccuggc

SEQ ID NO: 286072 - RNA, 27 nt, Human
ccucaggcugcagcccuggcccuggcu

SEQ ID NO: 286073 - RNA, 22 nt, Human
ccucaucucucacagccuccag

SEQ ID NO: 286074 - RNA, 24 nt, Human
ccuccaggcccuggcaaacgcuaa

SEQ ID NO: 286075 - RNA, 21 nt, Human
ccuccggagcggagcugguuc

SEQ ID NO: 286076 - RNA, 22 nt, Human
ccucugagccacugcaaaugag

SEQ ID NO: 286077 - RNA, 26 nt, Human
ccugagccucaggcugcagcccuggc

SEQ ID NO: 286078 - RNA, 22 nt, Human
cgaggccagccgcgcagacccc

SEQ ID NO: 286079 - RNA, 19 nt, Human
cgcccggggcuccacuccc

SEQ ID NO: 286080 - RNA, 18 nt, Human
cggccacaagcccagagc

SEQ ID NO: 286081 - RNA, 23 nt, Human
cggcugggccggauccggcgugu

SEQ ID NO: 286082 - RNA, 18 nt, Human
cgggcgaggccagccgcg

SEQ ID NO: 286083 - RNA, 18 nt, Human
cucaucucucacagccuc

SEQ ID NO: 286084 - RNA, 20 nt, Human
cucaucucucacagccucca

SEQ ID NO: 286085 - RNA, 22 nt, Human
cucaucucucacagccuccagg

SEQ ID NO: 286086 - RNA, 18 nt, Human
cuccucugagccacugca

SEQ ID NO: 286087 - RNA, 21 nt, Human
cugcagcccuggcccuggcug

SEQ ID NO: 286088 - RNA, 22 nt, Human
cuuaaaccaguaacacacugag

SEQ ID NO: 286089 - RNA, 18 nt, Human
cuuagcaccacccuuccc

SEQ ID NO: 286090 - RNA, 23 nt, Human
gaaaaagaaaccccaaacccuua

SEQ ID NO: 286091 - RNA, 24 nt, Human
gaaaagacucuccuuucucuauug

SEQ ID NO: 286092 - RNA, 21 nt, Human
gagcccccagcgugccaguuc

SEQ ID NO: 286093 - RNA, 23 nt, Human
gaucugcuggguccacccuccuc

SEQ ID NO: 286094 - RNA, 21 nt, Human
gcagcaguggguucagggugg

SEQ ID NO: 286095 - RNA, 23 nt, Human
gcccagagcccccagcgugccag

SEQ ID NO: 286096 - RNA, 18 nt, Human
gcccggggcuccacuccu

SEQ ID NO: 286097 - RNA, 24 nt, Human
gcccggggcuccacuccuggagac

SEQ ID NO: 286098 - RNA, 19 nt, Human
gcggagcugguucgcccag

SEQ ID NO: 286099 - RNA, 21 nt, Human
gcggcgcugugccuggggcug

SEQ ID NO: 286100 - RNA, 20 nt, Human
gcgugcgcucccggcccgag

SEQ ID NO: 286101 - RNA, 19 nt, Human
gcuugugucuuugguauca

SEQ ID NO: 286102 - RNA, 23 nt, Human
ggacagaccacauuuuauuuccc

SEQ ID NO: 286103 - RNA, 22 nt, Human
ggcuccacuccuggagacucca

SEQ ID NO: 286104 - RNA, 22 nt, Human
ggugguagaaguacguguagga

SEQ ID NO: 286105 - RNA, 22 nt, Human
gguuguuuccacuuuuuggcua

SEQ ID NO: 286106 - RNA, 21 nt, Human
gugugugugugugugugugug

SEQ ID NO: 286107 - RNA, 18 nt, Human
uaaaaaagccagcuauga

SEQ ID NO: 286108 - RNA, 23 nt, Human
uaaauggaauuauuuaacuucgu

SEQ ID NO: 286109 - RNA, 22 nt, Human
uaagaaaccacugccuaauuca

SEQ ID NO: 286110 - RNA, 21 nt, Human
uaauuucgaacauuuucauca

SEQ ID NO: 286111 - RNA, 19 nt, Human
uaccccaaguccagaacac

SEQ ID NO: 286112 - RNA, 21 nt, Human
uaccggccacaagcccagagc

SEQ ID NO: 286113 - RNA, 24 nt, Human
uaucuaagaaaccacugccuaauu

SEQ ID NO: 286114 - RNA, 18 nt, Human
uccacccuccucugagcc

SEQ ID NO: 286115 - RNA, 27 nt, Human
ucccaaccccacugcuuaccccaaguc

SEQ ID NO: 286116 - RNA, 23 nt, Human
ucccaaccccacugcuuaccccc

SEQ ID NO: 286117 - RNA, 23 nt, Human
ucccaaccccacugcuuaccccu

SEQ ID NO: 286118 - RNA, 21 nt, Human
uccgcuagggggcgggcgagg

SEQ ID NO: 286119 - RNA, 20 nt, Human
uccugacccaauuggucacc

SEQ ID NO: 286120 - RNA, 25 nt, Human
ucgcuggauggguacaggaggcgag

SEQ ID NO: 286121 - RNA, 23 nt, Human
ucuauccuuaaaccaguaacacc

SEQ ID NO: 286122 - RNA, 22 nt, Human
ucucacagccuccaggcccugg

SEQ ID NO: 286123 - RNA, 20 nt, Human
ucugauccaugaacacagga

SEQ ID NO: 286124 - RNA, 21 nt, Human
ucugauccaugaacacaggau

SEQ ID NO: 286125 - RNA, 18 nt, Human
ucuuuuucuuucccaaau

SEQ ID NO: 286126 - RNA, 19 nt, Human
ugaagaaguaaaaauauac

SEQ ID NO: 286127 - RNA, 21 nt, Human
ugacgcgugcgcucccggccc

SEQ ID NO: 286128 - RNA, 22 nt, Human
ugacucgcaaauauuuucuccc

SEQ ID NO: 286129 - RNA, 22 nt, Human
ugaggucucucacuggagccuc

SEQ ID NO: 286130 - RNA, 20 nt, Human
ugaguauuuuucaugugcuu

SEQ ID NO: 286131 - RNA, 20 nt, Human
ugauuguaaacuggaaucuc

SEQ ID NO: 286132 - RNA, 18 nt, Human
ugauuuauuuuucuccuu

SEQ ID NO: 286133 - RNA, 18 nt, Human
ugcccagggcagcagugg

SEQ ID NO: 286134 - RNA, 20 nt, Human
ugccuggggcugaggcugca

SEQ ID NO: 286135 - RNA, 25 nt, Human
ugcgugugugugugugugugugugg

SEQ ID NO: 286136 - RNA, 27 nt, Human
ugcuaagcugaggucucucacuggagc

SEQ ID NO: 286137 - RNA, 21 nt, Human
uggaauuauuuaacuucguuu

SEQ ID NO: 286138 - RNA, 18 nt, Human
uggagaaaugucuauuca

SEQ ID NO: 286139 - RNA, 18 nt, Human
uggaugcggcgcugugcc

SEQ ID NO: 286140 - RNA, 21 nt, Human
uggcaaacgcuaaucuauauu

SEQ ID NO: 286141 - RNA, 19 nt, Human
uggccugccggcugcaccu

SEQ ID NO: 286142 - RNA, 21 nt, Human
ugggaaccuugucaaaaauca

SEQ ID NO: 286143 - RNA, 22 nt, Human
ugggaaccuugucaaaaaucaa

SEQ ID NO: 286144 - RNA, 19 nt, Human
ugggauggccugccggcug

SEQ ID NO: 286145 - RNA, 24 nt, Human
ugggccggauccggcgugucggag

SEQ ID NO: 286146 - RNA, 20 nt, Human
ugggcuuuugcaccuggcuu

SEQ ID NO: 286147 - RNA, 22 nt, Human
ugguaucauaucuaagaaacca

SEQ ID NO: 286148 - RNA, 24 nt, Human
uguaucuugaaaccuugcggaacu

SEQ ID NO: 286149 - RNA, 24 nt, Human
uguauguacguuuucauuucucuu

SEQ ID NO: 286150 - RNA, 20 nt, Human
ugucaaaaaucaauugaccg

SEQ ID NO: 286151 - RNA, 19 nt, Human
ugugugcgugugugugugu

SEQ ID NO: 286152 - RNA, 22 nt, Human
ugugugugugugugaguuccuu

SEQ ID NO: 286153 - RNA, 18 nt, Human
ugugugugugugugugug

SEQ ID NO: 286154 - RNA, 18 nt, Human
ugugugugugugugugug

SEQ ID NO: 286155 - RNA, 18 nt, Human
ugugugugugugugugug

SEQ ID NO: 286156 - RNA, 21 nt, Human
ugugugugugugugugugugu

SEQ ID NO: 286157 - RNA, 21 nt, Human
ugugugugugugugugugugu

SEQ ID NO: 286158 - RNA, 22 nt, Human
ugugugugugugugugugugug

SEQ ID NO: 286159 - RNA, 23 nt, Human
ugugugugugugugugugugugu

SEQ ID NO: 286160 - RNA, 22 nt, Human
uguguguguguguguguguguu

SEQ ID NO: 286161 - RNA, 24 nt, Human
uguuuccacuuuuuggcuauuaca

SEQ ID NO: 286162 - RNA, 24 nt, Human
uuaguagccauuugcauaucuucu

SEQ ID NO: 286163 - RNA, 19 nt, Human
uucccaucugaggucccaa

SEQ ID NO: 286164 - RNA, 19 nt, Human
uuccucgggauguucagcg

SEQ ID NO: 286165 - RNA, 23 nt, Human
uucuuucccaaaugcuucuuaaa

SEQ ID NO: 286166 - RNA, 19 nt, Human
uugcauuucaaugcaguca

SEQ ID NO: 286167 - RNA, 19 nt, Human
uuguuaaguugauuccuau

SEQ ID NO: 286168 - RNA, 20 nt, Human
uuuggagaaaugucuauuca

SEQ ID NO: 286169 - RNA, 23 nt, Human
caaaagcuuuaaauacagaaugg

SEQ ID NO: 286170 - RNA, 24 nt, Human
caaaggcaacgaguggagcggcug

SEQ ID NO: 286171 - RNA, 21 nt, Human
cagaaugggcuggccagagcg

SEQ ID NO: 286172 - RNA, 18 nt, Human
cagcagcgggacacggag

SEQ ID NO: 286173 - RNA, 19 nt, Human
cgggacggacucgccgggc

SEQ ID NO: 286174 - RNA, 24 nt, Human
cucacaggagcagcagcgggacac

SEQ ID NO: 286175 - RNA, 20 nt, Human
gagcagcagcgggacacgga

SEQ ID NO: 286176 - RNA, 22 nt, Human
gagcagcagcgggacacggagc

SEQ ID NO: 286177 - RNA, 19 nt, Human
gagucgaggcgaggggcag

SEQ ID NO: 286178 - RNA, 19 nt, Human
ggcaggcuggcuaccagcu

SEQ ID NO: 286179 - RNA, 19 nt, Human
ggugucgguguuggugaaa

SEQ ID NO: 286180 - RNA, 19 nt, Human
uauugggccucaaaagcuu

SEQ ID NO: 286181 - RNA, 19 nt, Human
ucgccgggcgcucacagga

SEQ ID NO: 286182 - RNA, 19 nt, Human
uggacguaucagaaaaauc

SEQ ID NO: 286183 - RNA, 21 nt, Human
aaaaaacaaacagguugaaaa

SEQ ID NO: 286184 - RNA, 19 nt, Human
aagccuuuuaaaaaacaaa

SEQ ID NO: 286185 - RNA, 23 nt, Human
aaucauuuggaucaauacaguga
